United States Patent 7,820,380 (GENETIC POLYMORPHISMS ASSOCIATED WITH LIVER FIBROSIS) - sequence listing, part 4

SEQ ID NO: 14022 - DNA, 201 bp, Homo sapiens
ccaagtcagtgtcactgtatgaatatgattattgcccatgttaatttctctaatttacttcttacatctatttcaggttataaatattcataattgtagtsctctggtagtagccccccaccactagtctacactaaattgtacttgctataatataaatctattttctcccattctaatttatgaaatggctgagaaaaa

SEQ ID NO: 14023 - DNA, 201 bp, Homo sapiens
aagggggagggatagctttaggagatatacctaatgctaaatgatgagttaatgggtgcagcacaccagcatggcacatgtatacgtatgtaactaacctkcacattgtgcacatgtaccctaaaacttaaagtataatcataataaaataaaataaataaataaataaataaataaaagtttggtggggctgtcaaaaaa

SEQ ID NO: 14024 - DNA, 201 bp, Homo sapiens
tcaggtagtgtgatgcctccagctttgttctttttgctcagtactgctttgagtattcagggtcttttgtggttccatatgaattttagaattgatttttytacttctgtgaagaatgtcattggtattttgatagagattgcattgaatctgtagattgcttcatgtagtatggtcattttaataatattaattatttta

SEQ ID NO: 14025 - DNA, 201 bp, Homo sapiens
aggacctcttccaggagaactacaaaccactgctcaacgaaataaaagaggacacaaacaaatggaagaaaattccatgctcatagataggaagaatcaayatcgtgaaaatggccatactgcccaaggtaatttatagattcaatgccatctccatcaagctaccaatgactttcttcacagaattggaaaaaactactt

SEQ ID NO: 14026 - DNA, 201 bp, Homo sapiens
aaaaggcctttgacaaaattcaacagcccttcatgctaaaaactctcaataaattaggtattgatgagacgtatctcaaaatgataagacctatttatgamaaacccacaggcaatatcatactgaatgggcaaaaacgggaagcgttccctttgaaaactggcacaagacagggatgtcctttctcaccactcctattca

SEQ ID NO: 14027 - DNA, 201 bp, Homo sapiens
aaactgaatccagcagcacatcaaaaagcttatccaccatgatcaagtgagattcatccctgggaagcaaggctggctcaacatatgcaaatcaataaacrtaatccagcatataaacagaaccaaagacaaaaaccacatgattatctgaatagatgcagaaaaggcctttgacaaaattcaacagcccttcatgctaaa

SEQ ID NO: 14028 - DNA, 201 bp, Homo sapiens
ctcctcagcaaatgtaaaagaacagaaattataacaaactgtctctcagaccacagtgcaatcaaactagaactcaggattaagaaactcattcaaaaccrctcaactacatggaaactgaacaacctgctcctgaatgactactgggtagataactaaatgaaagcagaaataaagttgttctttgaaaccaatgagaac

SEQ ID NO: 14029 - DNA, 201 bp, Homo sapiens
caagcagacataatagacatctacagaactctccaccccaaatcaacagaatatacattcttctcagcaccacatcacacttattccaaaattgaccacawagttggaagtaaagcactcctcagcaaatgtaaaagaacagaaattataacaaactgtctctcagaccacagtgcaatcaaactagaactcaggattaag

SEQ ID NO: 14030 - DNA, 201 bp, Homo sapiens
ttaaatttaccattcagtaatttataaattcttctactatcccttttggaaaattatctttaatttcttagaacctgttcagttctttgaatctgtaaagmtgaccactgatgcttccaggatccccacatgtgtatctggcctcaaaactgaactacttcattgcctacgagttcacccactatttccaaatattttaag

SEQ ID NO: 14031 - DNA, 201 bp, Homo sapiens
tggaaagctgagttgggggaaacggttgagcccaagaggttgaggctccagtgagctgtgattgtgcccctgcactccaacctgggtgacagagcaagatwctgtctcaaaaaaacaaaaagccaaaaaaagaaaaaagaaggaaggaaggaacgaagcaaggaaggaaggaaggaaggagggaaggaaggaaggaaggag

SEQ ID NO: 14032 - DNA, 201 bp, Homo sapiens
cctgtctctaaaattaaaaaaaaaaaaaaaaaaaaaaaagttaaaaattatccaggcacatctgcagtcccagctacttggaaagctgagttgggggaaayggttgagcccaagaggttgaggctccagtgagctgtgattgtgcccctgcactccaacctgggtgacagagcaagatactgtctcaaaaaaacaaaaagc

SEQ ID NO: 14033 - DNA, 201 bp, Homo sapiens
caccacgcccagataatttttgtatttttagtagagatggggtttcaccatgttgcccaggctgatcttgaactcgtggcctcaagcaatccacccatctyggcctcccaaagggctggaattacaggcatgagccactgcacccagcctatgctaaggtgtttaaaaagtaaataagaagcacaggagttggagacctgg

SEQ ID NO: 14034 - DNA, 201 bp, Homo sapiens
gaggcacaatttcagctcattgcaacctccacctcctgggttccagcaattctagtgcctcagcttcctaagtatttgggattacaggcacatgccaccaygcccagataatttttgtatttttagtagagatggggtttcaccatgttgcccaggctgatcttgaactcgtggcctcaagcaatccacccatctcggcct

SEQ ID NO: 14035 - DNA, 201 bp, Homo sapiens
tctagattgcagactcccactaaggcccttcctatataactccctatgcctgtggtggaaaataaacgtgtgcatacacatatattactatctatactaargtattttattttatctgtgttgcccaggctggagtgcagaggcacaatttcagctcattgcaacctccacctcctgggttccagcaattctagtgcctca

SEQ ID NO: 14036 - DNA, 201 bp, Homo sapiens
atgttccccaggatggccttgaactttgaggctcaaataatcctgctgccttggcctcccacagcacaaggattataggtgtgagccactcactgcacctsgctcttaacagtggggctcttgaaagaagatgggggaagaagaggtgctacaaagtaacttaagccaatttggccaattgcaactgtacaattctttgga

SEQ ID NO: 14037 - DNA, 201 bp, Homo sapiens
tttttagaaaagcatcctccctgcataaagcagaaaaagttcttcctttttaccctttaataggagaagtgggttgctctaacagtgatgttctttctttyttttttttttttttgagacgcaaggtctcaatctgttgctcaggctggactgcggtggcatgatcctagctcactgtcacctcaaactcttgggctcaag

SEQ ID NO: 14038 - DNA, 201 bp, Homo sapiens
acttgactttctttggaacctgtgaacaaccagctttctctttagttctctgcccaatcagcccaggccacacagtcattgatttgcaggtaacatggagwtttacctattatcacacacattcatcacttaattcccatagctactccccaattgtgacactcctgtttcataaacctaatgagaaagaaataggaaaaa

SEQ ID NO: 14039 - DNA, 201 bp, Homo sapiens
ttacagtattcatttatcttaattaaatagtgctagactgttctgtaggatgatggcaacagtttacacttttaccagcagtgcctaaggcttcctaaatwcaaaactctttgccaacattggctattacccaacttttccaactttttgcagcttaactgatgagagatgacatgccataattcctttagtttgcattta

SEQ ID NO: 14040 - DNA, 201 bp, Homo sapiens
acataaataccagtatgcaacataccactttgttcctttttagcttttggaatgtatccaaattgccataggtacataagtccatagcctctacctgctayatcatatgccttgatgtctagtatattctacttacccactttttcaatgatgtacacctagatctctactaacttgctgcccaaacaatgtggcaacgga

SEQ ID NO: 14041 - DNA, 201 bp, Homo sapiens
tacataaataccagtatgcaacataccactttgttcctttttagcttttggaatgtatccaaattgccataggtacataagtccatagcctctacctgctrtatcatatgccttgatgtctagtatattctacttacccactttttcaatgatgtacacctagatctctactaacttgctgcccaaacaatgtggcaacgg

SEQ ID NO: 14042 - DNA, 201 bp, Homo sapiens
cagcagctcaaggccaaggcaggaaccagccttggacaggacatcatcctatcccaggatgcatgaacgcgcgcacacacacacacacacacactcacacwcactcagactggggccatgtagacatgctaattcacctaatgtgcacatctttgggatgtgggaggaaactggagtacctggagaaaattcacatagaca

SEQ ID NO: 14043 - DNA, 201 bp, Homo sapiens
ctattccagcagctcaaggccaaggcaggaaccagccttggacaggacatcatcctatcccaggatgcatgaacgcgcgcacacacacacacacacacacwcacactcactcagactggggccatgtagacatgctaattcacctaatgtgcacatctttgggatgtgggaggaaactggagtacctggagaaaattcaca

SEQ ID NO: 14044 - DNA, 201 bp, Homo sapiens
gaacacctgtacattgctgatagaagagtaaaatagttccaaccattatgaaaaataatttgttggtttctcaaaaagttaaacatatcattaccatatgwcccagcaactccactcctaggtatatactcaaaagaactaaagacaggcacaaaaacaaatactgcacacacatgttcatagcagcactattcacaatag

SEQ ID NO: 14045 - DNA, 201 bp, Homo sapiens
tcaagcaatcctcctgcctcagcctcctgagtagctaggactacaggcacatgccgccatgcccaactaattattattattattattattgtagagacagrgggtctcactatgttgcccaggctggtctcaaacatctggcctcaatgatcctcctgcctcggcctcccaaagcacttggattacaggtgtgagccacct

SEQ ID NO: 14046 - DNA, 201 bp, Homo sapiens
atgctcagtatacattgttgaatcaataaatgaacgaataagtcacaacgtgagctgttttatctcacaaagtattaagggaattagttaatcattattgktattatttttgagatagagtcttgatgcatcacccaggctggagtgcaatggtgcaatcatagctcactgcaaccttgaactcctgggctcaagcaatcc

SEQ ID NO: 14047 - DNA, 201 bp, Homo sapiens
attttacacgtttaggtatacatatatgacatatgtcatgtgtatatacttgcatatatacttatacctgtttgtatgtttattacttcattgactacctsccagaaccactgcagagattagatgaaccaacatatgtaaagtaattactattggcccagactcatagcaaatgctttatatatgttcgttgttgttatt

SEQ ID NO: 14048 - DNA, 201 bp, Homo sapiens
ctttaaatccctgtgtctttataaagttgttgtacacacgtatatatgactccctcatctttttgtgcagtctgacaatctctactttttttttttttttwttttttttgagaccgaatctcactctggcgcccaggctggattgcaatggtacgatcttggcttatggcaacctccaactcctgggttcaagtgattctc

SEQ ID NO: 14049 - DNA, 201 bp, Homo sapiens
aaaataatgtgtattctgctgttgttgggtggcaagttctataaatatccgttagattaagttgactgatagtttttcagattttctatttgcttaataaytttctgtttgttctataaattaatgagaaagaaatattgatgtcttcacatatacttgtggatttttttctctttttcctttcaattctattatttgctt

SEQ ID NO: 14050 - DNA, 201 bp, Homo sapiens
aagccatgttaagcccagattttcctttgctggaggacttaaaacttcatattcaatatctgtatagtatactttagacttcaatttcctcttaagtgacwtttggcagtttgtttattttcagaaaggtatccatttcattcaagttgtcaaatttcttggcataaagttattcatgtgattcccttaccacccttttaa

SEQ ID NO: 14051 - DNA, 201 bp, Homo sapiens
aaagcagaatgctgttctcatgcagcaagggaattctagagggctacatcaggtcaacacgagggaagagcaggtctggctcattaatgctgggataacawgcaaataagcagtcctctcctacataaatacacccacacacaggttgcattcaatctgtctgctactactctaaagtgcttgataacaaaagtaaaatgg

SEQ ID NO: 14052 - DNA, 201 bp, Homo sapiens
tactttacttccagaatgaaaacaagtatagaatgcatgtaatattatcactgtatgatactttcatctagtagaagctttttgtttgattaaaaaacaarcaaaaaaaatcctgaagcccaagccgagcacggtggctcacgcctgtaatcccagcactttgggaggccgagacaggcggatcacaagatcaggagctca

SEQ ID NO: 14053 - DNA, 201 bp, Homo sapiens
gtcaaatcacaaacaatttcataaataatgtaggaggatttagccttatgctattgaagggttttatatagagaaatattgttatccaatccaggctttakaagttactaggattacacaatagaaaagaatgaaatgagagggaacaaaactggaggcaaggaaaccaacaaggaaactattccagtgagaaaggtggga

SEQ ID NO: 14054 - DNA, 201 bp, Homo sapiens
agctgaacattacacatatgaattgctgatgaactgatttatgtctatctccatgaaattatctagtaatagagtcaggcctatatatgtgcatatgtacwaagtttttattttttatttttcaaatcagtatcttagttgaagagataaaatgctatttagtataaaacataaaggatatgcaaagctagaaaaggacag

SEQ ID NO: 14055 - DNA, 201 bp, Homo sapiens
ctgaaagataaagcaataactagcatataaagcattgcattttcagcaaatcgcatgttagagtgactcgggatagtctagtaagttaaaaaacaaaacamagcatgagctgaacattacacatatgaattgctgatgaactgatttatgtctatctccatgaaattatctagtaatagagtcaggcctatatatgtgcat

SEQ ID NO: 14056 - DNA, 201 bp, Homo sapiens
ctggagtaggcagaggctggagtaagcagagaccacgccactgcactccagcctgggtgatagagcgagactccgtctcaaaaaaaaaaaaaaaaaaaaamaaagaaagaaaaaaaagaaaacccgaaagtataaaaaccccagaagaaaatctatgcaataccattcaggatataggcacaggcaaagattttacaatga

SEQ ID NO: 14057 - DNA, 201 bp, Homo sapiens
gaggctggagtaggcagaggctggagtaagcagagaccacgccactgcactccagcctgggtgatagagcgagactccgtctcaaaaaaaaaaaaaaaaamaaaaaaagaaagaaaaaaaagaaaacccgaaagtataaaaaccccagaagaaaatctatgcaataccattcaggatataggcacaggcaaagattttaca

SEQ ID NO: 14058 - DNA, 201 bp, Homo sapiens
gctgaggcaggagaactgtgtgaacccgggaggtggaggctggagtaggcagaggctggagtaagcagagaccacgccactgcactccagcctgggtgatrgagcgagactccgtctcaaaaaaaaaaaaaaaaaaaaaaaaagaaagaaaaaaaagaaaacccgaaagtataaaaaccccagaagaaaatctatgcaata

SEQ ID NO: 14059 - DNA, 201 bp, Homo sapiens
gataacattaggagatatacctaatgtaaatgacgcgttaatgggtgcagcacaccaacatggcatatgtaacaaacctgcacgttgtgcacatgtacccwagaatttaaagtataataaaaaatttttaaaaaagtaagtcatctacattgctgtaggcatgcatagttcattacgtttttgtttttttttttttttttt

SEQ ID NO: 14060 - DNA, 201 bp, Homo sapiens
tcggggcctgtcgtggggtggggggtggggggagggataacattaggagatatacctaatgtaaatgacgcgttaatgggtgcagcacaccaacatggcayatgtaacaaacctgcacgttgtgcacatgtaccctagaatttaaagtataataaaaaatttttaaaaaagtaagtcatctacattgctgtaggcatgcat

SEQ ID NO: 14061 - DNA, 201 bp, Homo sapiens
gaattgaacaatgagaacacttggacacaggaaggggaacatcacacatcggggcctgtcgtggggtggggggtggggggagggataacattaggagatayacctaatgtaaatgacgcgttaatgggtgcagcacaccaacatggcatatgtaacaaacctgcacgttgtgcacatgtaccctagaatttaaagtataat

SEQ ID NO: 14062 - DNA, 201 bp, Homo sapiens
cactcataggtgggaattgaacaatgagaacacttggacacaggaaggggaacatcacacatcggggcctgtcgtggggtggggggtggggggagggatarcattaggagatatacctaatgtaaatgacgcgttaatgggtgcagcacaccaacatggcatatgtaacaaacctgcacgttgtgcacatgtaccctagaa

SEQ ID NO: 14063 - DNA, 201 bp, Homo sapiens
gtagttgagagatcaaagtcaaaatgaggatgacaggcccatgtatatttataataccaaatgcagggatggaacagaagacaaagggtggctaagtctgkctaggtctgtcagggaacacttcatccaagagaggaattgtacagaatcctgaaggttgaagagtattttgaaaagcagagaacaggataaaagagtgaa

SEQ ID NO: 14064 - DNA, 201 bp, Homo sapiens
tgtagttgagagatcaaagtcaaaatgaggatgacaggcccatgtatatttataataccaaatgcagggatggaacagaagacaaagggtggctaagtctktctaggtctgtcagggaacacttcatccaagagaggaattgtacagaatcctgaaggttgaagagtattttgaaaagcagagaacaggataaaagagtga

SEQ ID NO: 14065 - DNA, 201 bp, Homo sapiens
tttctcaaccaaacgagtggatgaagaaaatgtatatatacacacatatatatgtgcgtatatatatgtatatatgtaccacattttctttatccactcawtggttgatgggcacttagcttttacgtatctttgcaattgtgaattctgctgcgataaacacaggagaacagcacacatttaacttgcatgggaagaaaa

SEQ ID NO: 14066 - DNA, 201 bp, Homo sapiens
tccaaaatttggatgaaccaagaagcatttcctaatcttatttgaccaatttttttttttcagaatattttatggggccattatttttaagaaaaactttragaaacacagagacagctctatcttttcatcctgttatcaagttagaatcaccagaaatgtctataaatcaccaaggaaaagagagcgacctgtttcatt

SEQ ID NO: 14067 - DNA, 201 bp, Homo sapiens
taaactctgacctgattgttctcataaagtcagtacagacaattgtctgatgtcagcgtaatatgctggtttgaaaaagacagtgaagcaaatttctagcrccaggtagcattagtacctacctcaaagccaggactcacaggagactgaaacatgaagttgtaagagcaaaaagcaggcaaaggtgcagaatcaaaggag

SEQ ID NO: 14068 - DNA, 201 bp, Homo sapiens
tttaaggtgtacactggcttagtggacatgtatcctgaaagactgagcactagacaaagaagttgccttttaagcagtttttggcaggaactacttgatgmaggaatcaggcttacagaagcaagaactaaagcagttaatcattaggtaacattcttgagattcagcttacatcttgggaaaaacatgtcctgtaactta

SEQ ID NO: 14069 - DNA, 201 bp, Homo sapiens
ttttagccatttattttaatttcttgcagttttgattgttttttcacaggtgatactggaggcgtgtatttatttgagctttactttttagaggcaggtarccttggtaaagggggataaattggattgtaaggaggaggggtctttattccctccagtggttcttgcaaaaccagtttttcctgtggctttccttttgtc

SEQ ID NO: 14070 - DNA, 201 bp, Homo sapiens
tcatgtaacccaaaaatatatatgcctactatgtactcacaaaaattagatagatagatagatagatagatagatagatagataaatttttttcaggacamttcagtcctatcaatctgcaaactgtccagagatttcttttttatatttcgaaactgtctgtctcacttagggatgatgacctaacctgctgttaggaaa

SEQ ID NO: 14071 - DNA, 201 bp, Homo sapiens
caccaaaatccaagacttagaaaataagcgataatttttgtaacagtgaggtagaatcacaacacttttgaaatgcatttaggcagacatggctatttttmaattttaacctattctttaaggcactcaatacatgttaatgtaataacatagccaagtgaatagtttaagtgaggacaactagagattggttttaaaatg

SEQ ID NO: 14072 - DNA, 201 bp, Homo sapiens
tcttctatgtttttcctgtaaatatcgctttttaaaatataactagcaaaaattttaagttcataaaaatactcagtgagataacctacctccataaacamttccaaactgtccagaacccagtacttcatcaggaaaaatctgatatactgtgctgatgtcctagaggtacaagcccaatgaaaaaaaaacatgaagcag

SEQ ID NO: 14073 - DNA, 201 bp, Homo sapiens
gtcttctcttctatgtttttcctgtaaatatcgctttttaaaatataactagcaaaaattttaagttcataaaaatactcagtgagataacctacctccawaaacaattccaaactgtccagaacccagtacttcatcaggaaaaatctgatatactgtgctgatgtcctagaggtacaagcccaatgaaaaaaaaacatg

SEQ ID NO: 14074 - DNA, 201 bp, Homo sapiens
acacagaaatatatacacataggtcttctcttctatgtttttcctgtaaatatcgctttttaaaatataactagcaaaaattttaagttcataaaaatacwcagtgagataacctacctccataaacaattccaaactgtccagaacccagtacttcatcaggaaaaatctgatatactgtgctgatgtcctagaggtaca

SEQ ID NO: 14075 - DNA, 201 bp, Homo sapiens
tatgtgattgaaaattcggtacataaatatgttgcaaatatccaactcagcataactgagcatagctgagtgatataatttaaagacccatgacagcaaasagctgtgtgcctttgtctgtgctgtatctactgaacctagaacagtgtttggctcataatatgtactcaataaatactagtttgatgaatgaggcaaaga

SEQ ID NO: 14076 - DNA, 201 bp, Homo sapiens
tttgacaaacctgagaaaaacaagcaatggggaaaggattccctatttaataaatggtgctgggaaaactggctagccatatgtagaaagctgaaactggrtcccttccttacaccttatacaaaaattaattcaagatggattaaagacttaaacgttagacctaaaaccataaaaaccctagaagaaaacctaggcatt

SEQ ID NO: 14077 - DNA, 201 bp, Homo sapiens
gtgagggcagtacagcaaagtggagatgtcctaaggatggaaatgtgagactgaagtgcctgtggaaggctggacttcaagagctgtattaagcaatggcytaagagatgacaggtgactctctcaaaatggatgacctcgctctggaaatgagcttcaaatgtgcgtaaatcctttagataaatggagggaaacgtttag

SEQ ID NO: 14078 - DNA, 201 bp, Homo sapiens
actacaggcatggggcaccatgcccagctaattttttttttttttttgtatttttagtagagacagggtttcgccatgttgcccaggctggtcttgaactmctgagctcaggcagtctgcccgcctcggcctcccaaagtgcttggattacaggcccgagccactatacccagccaatatacacatatttttattgcaaag

SEQ ID NO: 14079 - DNA, 201 bp, Homo sapiens
aagtaataagtgacaacagttataataataaattagtcatggagaatattttagacatttaaaatgttgccatcaagaaatttaaaaatatacacatatayttttttttttgagacagagtctcactttgtcacccaggctggagtcaactggcacgatctcggctcactgcaacctctgcctccaaggttctcgtgcttc

SEQ ID NO: 14080 - DNA, 201 bp, Homo sapiens
ggaggctgaggcaggagaatggcgtgaactcgggaggtggagcttgcagtgagccaagatcacgccactgcactccagcctgggtgacagagcgagactcygtctcaaaaaaaaaaattcttcatgtaatataatgcaaggaaagaaatatttgaagaaatatagtacatattagatgaaacaacaaaaatataagccaac

SEQ ID NO: 14081 - DNA, 201 bp, Homo sapiens
cgggcttgctggtgggtgcctgtagtcccagctactcgggaggctgaggcaggagaatggcgtgaactcgggaggtggagcttgcagtgagccaagatcaygccactgcactccagcctgggtgacagagcgagactccgtctcaaaaaaaaaaattcttcatgtaatataatgcaaggaaagaaatatttgaagaaatat

SEQ ID NO: 14082 - DNA, 201 bp, Homo sapiens
tcacgcctgtaaacccagcactttgggaggcctaggcgggtggatcacgaggtcaggagatcgagaccatcctggctaacaaggtgaaaccccgtctctaytaaaaatacaaaaaattagccgggcttgctggtgggtgcctgtagtcccagctactcgggaggctgaggcaggagaatggcgtgaactcgggaggtggag

SEQ ID NO: 14083 - DNA, 201 bp, Homo sapiens
taaattaattttctttttcttataatagatagttgttttccctattttagacatatatacataacctatacactttattttggaacatgcaaaagacagtrcgatttccttagagctccaaaacatgtcttgcctatagaaatagtttcataaaaattcatgtagggcgggcacggtggctcacgcctgtaaacccagcac

SEQ ID NO: 14084 - DNA, 201 bp, Homo sapiens
tgacagaatatctatttggaaaattttctaaattaattttctttttcttataatagatagttgttttccctattttagacatatatacataacctatacastttattttggaacatgcaaaagacagtgcgatttccttagagctccaaaacatgtcttgcctatagaaatagtttcataaaaattcatgtagggcgggca

SEQ ID NO: 14085 - DNA, 201 bp, Homo sapiens
gatacagtacatacacaacattttccaaattttcttgatgaaaaaatgtgttttcacctcttctgtgaaggggttcaaaagactagcgttctttgaaaaayatgctgggaaataatgatttttaaaatgctttatataggagttaatttagtccccaaaacactcctatgaaggaaatagaccaagtcagcatgatttcta

SEQ ID NO: 14086 - DNA, 201 bp, Homo sapiens
gcctcagcctcccaaagtgctgaaattacaggcataagccaccatgcccggccaaaaaccatgtatattcaaaaacctatccacacacctcgcagtcattyttcgtttcatacattctagaaatgattcaatctagatttagatccaggattgctgcagacacatgataaatgtaatgagtcctctcttttccctataaaa

SEQ ID NO: 14087 - DNA, 201 bp, Homo sapiens
cattagattgagcacacctgaataatccaaacgactcttcctattttaaggtctgcaactttaattatacctgtaaagttccttttgccacctaaggtaayatatttactggtgtcagagattagggtgcagacatctttaacagggcaggggtatgtgggggggcattctgcctaccacaccatacaaagactccactat

SEQ ID NO: 14088 - DNA, 201 bp, Homo sapiens
tgactttttttttcttttccttttttttggagacagattctcactctcttgcccaggctggactgcagtggtgcagtctcagttcactacagcctcccccwctcgggttcaagagattattctgcctcagtctcccaagtagctgggattacaggtgcccgccaccatgcctggctaatttttgtatttttcgtggaaacg

SEQ ID NO: 14089 - DNA, 201 bp, Homo sapiens
gaatttttatgagaattaaatacactccaatgtatgttaaaggaggaactcctttccgaagtactgaatgagtcactttctctgccctgtcagcccctgcratttcttttaaacaatcttttgtcctttaagaggaaggaaatatttattaagaatataactctaaacaatgcaacactgtcaaggtaatctattctaaag

SEQ ID NO: 14090 - DNA, 201 bp, Homo sapiens
agcataaagacactaagacaagggaaaggggaagccagttgtaaaggaacagccagtctagtaaagctggggaagtcacagcagtcccagaagagagccamcaatgagggaaaaaagagcccaactggggtctggagtccagttccaaaactaacatcaaaattcagaatttagatctagagtgaatgtggtaggacatgc

SEQ ID NO: 14091 - DNA, 201 bp, Homo sapiens
agactgccatgtgtaatttatcaagcataaagacactaagacaagggaaaggggaagccagttgtaaaggaacagccagtctagtaaagctggggaagtcmcagcagtcccagaagagagccaacaatgagggaaaaaagagcccaactggggtctggagtccagttccaaaactaacatcaaaattcagaatttagatct

SEQ ID NO: 14092 - DNA, 201 bp, Homo sapiens
aatttatgaagaaaaagtaatactcatcgttatctagtctgaaaatcatcctagttacccacagtatcatgtgatggagttctcactctccttttctggayattatattttcagtatacgtcattaatagttcattatttattaaagtcattccctcacacttctcattcttgtaataacttccatgtttctctttttgaa

SEQ ID NO: 14093 - DNA, 201 bp, Homo sapiens
tttatatgtacatcatttaaatatgtcttacaatatgggcaggataaaactaatattcaagataaagcatttactaattttgttataaaacatgctgaacrtttgaatacacacaatggttcacacagtattgaattaaatgacagatatctgaacatcatatttgtatggaaaaaatgcatcataacatgggtcatatct

SEQ ID NO: 14094 - DNA, 201 bp, Homo sapiens
ctataaatatttagaagctcattcaactaagaaaactcagtgattattgtttacctgtagccaagggtggctcaaggtcttatccacactgtagcgctttytcatttttacttgcagcaaattgttgataagatcaatggctgaaaaaaattaccagtaaaaatagatgacaaatctgtaacatatgcataattcatttat

SEQ ID NO: 14095 - DNA, 201 bp, Homo sapiens
aagatttctaaatatcaaaatcctataaatatttagaagctcattcaactaagaaaactcagtgattattgtttacctgtagccaagggtggctcaaggtyttatccacactgtagcgctttctcatttttacttgcagcaaattgttgataagatcaatggctgaaaaaaattaccagtaaaaatagatgacaaatctgt

SEQ ID NO: 14096 - DNA, 201 bp, Homo sapiens
gaataatcacactttaaaaattattgcaaaagatttctaaatatcaaaatcctataaatatttagaagctcattcaactaagaaaactcagtgattattgwttacctgtagccaagggtggctcaaggtcttatccacactgtagcgctttctcatttttacttgcagcaaattgttgataagatcaatggctgaaaaaaa

SEQ ID NO: 14097 - DNA, 201 bp, Homo sapiens
aaattgctatttgttgaattcaaccaatttcaatttcatatataaaaaagcaatcccttttactcctctattttctatccatcagacccattacagactakacagcagcgagcctgaaaaaaaaaggaagaaaaaaagaaaagctctcaagagagtagctattcaaacctctcaaggcaaaatacagagaaaaggaacaca

SEQ ID NO: 14098 - DNA, 201 bp, Homo sapiens
gcaattctgggttaaacaatagcatcctccacatgaatgcctgcagatgcacagctgagaccatgtgtgcctgcacacacacacccacacacaacctcctyaagcagacagactccacagtcagagcaaccttttaaacactttgcctttatcacccacagagaccaccagtctagtgcaatcatctaccctctcatagag

SEQ ID NO: 14099 - DNA, 201 bp, Homo sapiens
tttaatatacattccaatggagtgggttttgacgattttcctcccatttcctcccagtaacgacacagcacattcacttttcctttctttttagaccaatyagacctggttggccttacgctttgcttagagcatacagcctctactaagagacctgtagccttctgtatgtcactcctcacgttgcttccttctggaaca

SEQ ID NO: 14100 - DNA, 201 bp, Homo sapiens
tttacatccatttgaaatcaaagcacaacatccattcattatgaatttacctgttctgcaccctgggggaaatcagcattagttgagtgtatgcatgccayctcgcctaatcacaaaattgcacttcagagataatcacttagcacaggaaaacaaagtgaatgctgtaattccatttcatttaagtttaggaatcaaaat

SEQ ID NO: 14101 - DNA, 201 bp, Homo sapiens
cttctgctaccaaactcaaacacttaataggctgttcatattaatgggtggccctcagcatcaaggatgcaatgaggaatggttgagactatagtaatttkgagaggacagcgtcactgtaaaacagatagctacagctcaattagttctaacagctgccatgtgaacatgtgaacccattgttgatggatcttttagttt

SEQ ID NO: 14102 - DNA, 201 bp, Homo sapiens
tacacatgtgtacacacaaataaatggggatattttcttccagtattcaaagttgtaatttaagtgagccaagaattcacttgtcacttatgaacatttgragttctgacagaaatatttgctgtttccttttcatcttacttcttaacataaataaaattatcaaccaatagtgatgtcagaactacactaattgatact

SEQ ID NO: 14103 - DNA, 201 bp, Homo sapiens
cctccttagagaggctttccctgaccatccacaaggaatataacagttcctcttactcatatctgttgtcctgcttccttttaatcagataagtcatcacyacctacacttctatgatatatctatctttttaaaaaagaattctgtctcttaactcaaatatgggtccattagagtggggactttttccatcctagtcac

SEQ ID NO: 14104 - DNA, 201 bp, Homo sapiens
tgctcgtgtcacctccttagagaggctttccctgaccatccacaaggaatataacagttcctcttactcatatctgttgtcctgcttccttttaatcagayaagtcatcaccacctacacttctatgatatatctatctttttaaaaaagaattctgtctcttaactcaaatatgggtccattagagtggggactttttcc

SEQ ID NO: 14105 - DNA, 201 bp, Homo sapiens
gttagtaggtcatagagaaatgtatcatacttccagcaaatctgactaatggtctgttgctgtctctcttaaaggcagatataatttacaaagactaaatmtaaagaacagtaaaaaatagcaagttacacttgaccccatgaaaggctgaaataaaaaatgagatattgaggaaaaaatctatagatgttcatgttcttt

SEQ ID NO: 14106 - DNA, 201 bp, Homo sapiens
ctgacacttatattcattatatctatatatcttgtttttcctcaaaattaacctatattcagtgacaaactgattttttttaaaaaaactccctttctttkattaatattatgacatttttacattaattccatgtattgtgctagaatcaagcaagggccatggatttggatgctggcatggattcagtggaattccatt

SEQ ID NO: 14107 - DNA, 201 bp, Homo sapiens
ttccattttgttaattttactgacacttatattcattatatctatatatcttgtttttcctcaaaattaacctatattcagtgacaaactgattttttttwaaaaaactccctttctttgattaatattatgacatttttacattaattccatgtattgtgctagaatcaagcaagggccatggatttggatgctggcatg

SEQ ID NO: 14108 - DNA, 201 bp, Homo sapiens
caaaatgaaggctatgacagcaactaaaaaagtttaaccaaaagttaagaatcattaactttagagaagaaaaactcattttagagatgagtaagttgatrtccagaacatattaaggaatattttcaaggtgacagtggtaggtagtgccagaataatagctaagagctagtctcttgaattttactgcttgatctttcc

SEQ ID NO: 14109 - DNA, 201 bp, Homo sapiens
tatagcacaatgaagatttttatatttcataaaggctaaatgtttattactttaacaaattaaaaataatagacacaggtactgaacaaaatgaaggctaygacagcaactaaaaaagtttaaccaaaagttaagaatcattaactttagagaagaaaaactcattttagagatgagtaagttgatgtccagaacatatta

SEQ ID NO: 14110 - DNA, 201 bp, Homo sapiens
catattatcttgcattataccttgacagattactagttagtgatagctattagaagtcttagtagacactttgaaattattcacacaacagtaattaggcrtgtggatgtgcagcttggaaatgaaaaaaatgtacttcacacttcacactatttgtctcactctgaataaaactgtcactatagcacaatgaagattttt

SEQ ID NO: 14111 - DNA, 201 bp, Homo sapiens
catataaatatattgatgttgtgtatcaagtattgctaaagaagtctaataagctacaggtttctctttaaggcagatgtgactcagtgagatacttaatrgttggcaaaaaccttcttttattttaatttgaataacatgtcatctattaagataaaagcaataagatatgacttaataaatcattaactctaatgcagc

SEQ ID NO: 14112 - DNA, 201 bp, Homo sapiens
ggaataaagctagactataaatcctccttccttgggcatataaatatattgatgttgtgtatcaagtattgctaaagaagtctaataagctacaggtttcyctttaaggcagatgtgactcagtgagatacttaatggttggcaaaaaccttcttttattttaatttgaataacatgtcatctattaagataaaagcaata

SEQ ID NO: 14113 - DNA, 201 bp, Homo sapiens
gggctagaatctgacccataagctatcttctgcttagacctctctttttttttagccactctcctttctattgagttcaaaatctgattgtttaaaaaackgttttccttcataattttaaatttgtaccttaactttatcccatctatttgaattacagcaaaaataaaataaaataaatgggaaaagatatctaagaca

SEQ ID NO: 14114 - DNA, 201 bp, Homo sapiens
taacttccttttctcattcaagacaagactttaatttactccactctgtttttctaaaggcagggctagaatctgacccataagctatcttctgcttagayctctctttttttttagccactctcctttctattgagttcaaaatctgattgtttaaaaaacggttttccttcataattttaaatttgtaccttaacttta

SEQ ID NO: 14115 - DNA, 201 bp, Homo sapiens
gctgaaggatgttttcagaggtagggtcatggcgaaaaagcaggatcttatcatacattccgtagaaaccacattcagggaactgcaaatacaaataccaygagagtgtaaatgtcaaaatccttccaaatattttgttttaaatatttcagggcacaaatacaagctaattagaaaagttcaaagtatctagatcattaa

SEQ ID NO: 14116 - DNA, 201 bp, Homo sapiens
attgagtatcattgtaaggatctccactctagctgttgttctctggtgctttttaaaaaggttaaatacattcttttttttctgtttggttaggcacagtyctattactaactgctaaatcctaaacaagaaataaaaaatgtgagcagaggcaaatgtagccatttctcagggactgagttaactagcgtcacatggcat

SEQ ID NO: 14117 - DNA, 201 bp, Homo sapiens
ctgaatcaaagcaaagtgaataaaacaaagataaattgaattataatcagtgcatccaagtactgggctctgaacaagttgaggaacttgaggaaataaasttgagactctgtaatgctgctggacttcttttattcaaagagatggtaaacaaagaaggcatgagaggagaaaagagcaaggcaatccaagtttctcaat

SEQ ID NO: 14118 - DNA, 201 bp, Homo sapiens
tcctgctggtagattgttagttaaatataaaaacaaccaggttatgtttacatcaaactacagagtaaaatttaatttgtgataaggaaaaagaaagttcrgataaataaaacttaacagtaaaactacaggcttcagaaggaaaatgcagcacccttcgtgtccccttcagggactaggtcaggaaggagtatgtaatcc

SEQ ID NO: 14119 - DNA, 201 bp, Homo sapiens
gatataagcaaagaaaaaaaaaaatcttgatgttgtctgaagaaataaaattaaccttgaaatttttccctattttttctctcatttttactgcagtcctrtgtcagaaaatgttcctgctggtagattgttagttaaatataaaaacaaccaggttatgtttacatcaaactacagagtaaaatttaatttgtgataagg

SEQ ID NO: 14120 - DNA, 201 bp, Homo sapiens
tttcctcaataacccaatccatctactcatgagcaatcttttcctggcttactgcgtttaaatgtactagctcacactagtcatgtttttcaaaaagaaasggagggagaaaaaaatcagcaaattagccagaagcagcttggttagttttcactcccaaagcagttaaaagatgatgaaaagtctgagcagaaaatgata

SEQ ID NO: 14121 - DNA, 201 bp, Homo sapiens
gagtcatgtaaatgtagtcctgttactaatttgtttgctaaggctgaattatcaggatttgatagaggcccatcatgaagaaggcttcaaatacattccayaaccttgattttacagttcagtaccatacacttgaacttcactctggtaaaaaaaaaaaaatttccatgttcagtgttttcctacttcttaacaatagta

SEQ ID NO: 14122 - DNA, 201 bp, Homo sapiens
ccaatgtattatatctaagacaaattaatataatattatatctaagagaaattaatatataaagtcagtaatttgcactttctataaaagaaaaaagaagyttaataaaatgttgttaccatattttttttcctggtttatgatttaggcattgaatcgtagtaggagtaaaacatgcttataaggatttcttaaatatag

SEQ ID NO: 14123 - DNA, 201 bp, Homo sapiens
tggtaacattccaatctgcttgctgtctgcattctcttctctgagaaaatggtttagtgtggcacaaagaaattaaaaccaggttgatatggttaggcttygtgtccccacccgaatcttatcttgaattgtaatccccacgtgtcgaggcagggaagtggttaaattatggaggtggtttcccccatgctgttctcgtga

SEQ ID NO: 14124 - DNA, 201 bp, Homo sapiens
ctatggtaacattccaatctgcttgctgtctgcattctcttctctgagaaaatggtttagtgtggcacaaagaaattaaaaccaggttgatatggttaggyttcgtgtccccacccgaatcttatcttgaattgtaatccccacgtgtcgaggcagggaagtggttaaattatggaggtggtttcccccatgctgttctcg

SEQ ID NO: 14125 - DNA, 201 bp, Homo sapiens
gcttctccatctcctccctggagaatccattttatcaggagataaataaccaagaaaactatcaaagtgaggaagaagtgcaccaagcacaatatccctaytgaagtcacaagtagggaaaagtgggagtctatggtaacattccaatctgcttgctgtctgcattctcttctctgagaaaatggtttagtgtggcacaaa

SEQ ID NO: 14126 - DNA, 201 bp, Homo sapiens
taaaagcaaagaaccaaccagagtagagatttatacatgagataagcccaagactgctgttgaccttgaaggacaaaatagatgaatctatttgactcaayagataaacattacacatttgtcctaggtggaaaaggtggtatattgaggctatataattaaatatttttcattaaaattttataacaatgttataacatg

SEQ ID NO: 14127 - DNA, 201 bp, Homo sapiens
gacccccaacagagcagaggagactttgaaaatataacaacaaaatgtaatgtgctagagattgagtcccgagcagaaacaggacattaatgaaaaagatyggtaagttcaaatcatataccaatgttaatttcttagttttgacaaatgtaccatgacaatgtaagatgataatattaggggaaaataaatctgggtgag

SEQ ID NO: 14128 - DNA, 201 bp, Homo sapiens
atcataagatggcccctgggatacatctttcaggctaatagattactgacccttccaagacctctcaaaaatatctggctaatgacatatcaatcttcatyaactgcccatctcttctaacagcagctccttgaccatcaaaggtaattttgtcaaccttacatttggaggctcaccttttatctaaaacacaaatgctgc

SEQ ID NO: 14129 - DNA, 201 bp, Homo sapiens
taacttttcactgactcctgactctagattgtgtctgtcggcttcatgaatgttgatgttccatcctggactcattctttattcatcatcataagatggcycctgggatacatctttcaggctaatagattactgacccttccaagacctctcaaaaatatctggctaatgacatatcaatcttcattaactgcccatctc

SEQ ID NO: 14130 - DNA, 201 bp, Homo sapiens
cccttctttcacagagtatcttctactttaaaaccagcaaaagtgtaattataaacaaagtgagatatgttactgaagggaacacctggtagaaaaagttkcctcacccaaatgtggtatttcaggtgagattcttagggaaggatatatgtgctgagtcatgaaagatgaattgaaattagccaggcaaatcaaatgagg

SEQ ID NO: 14131 - DNA, 201 bp, Homo sapiens
ttggataaatgtctattcaaattctttgcccattttataaaattggtttccccatttctttttaagtctttgaatttcaatggaaattcaatccatatgcrttattcttgttcactgatgagtgttttccaggaaatcttgttagatgctgttaaaattatgagttttaaaaacccacactaacatccattaaaacaatgt

SEQ ID NO: 14132 - DNA, 201 bp, Homo sapiens
gttcatccatgatgtaacaagtatctttacttcatttttatagctaaataatattctactgaatgggtataccacattttctttaaccaccccttagttgrtgaacatctgttttttctacttttggctataattaataatgctactatgaatatttgtgtataaacttttgtatgaacatatgttttcaattctttgggg

SEQ ID NO: 14133 - DNA, 201 bp, Homo sapiens
gacgatgatctgaataaccactatccttattttatccctgaaatttatccctgaaataacttattcccaagaaataaatgtatttgagcttcttgacattyttatccttatattccacagaacttaagcaattaaaattatgaatgacctccatgttattttaacatactaggttgctgcaaaagtaattgcggtttttgc

SEQ ID NO: 14134 - DNA, 201 bp, Homo sapiens
tacacacacagacatacacacacaaatagactcacacacaattcggtccatgtgatatttgtcctatcaaggctaaagatgtagtgttattccatcaaaawtaccactgcataaaatgccactttagattgctctgccctgacaagagtggaaaatctctgcttcacagaagcaaagcataactgtacttcaggactgcaa

SEQ ID NO: 14135 - DNA, 201 bp, Homo sapiens
gtatctagtgaagagacagtcatgctccttgccatagctgacagagacccaggggaaaggcctgtttataaaagaagacccatgactcagaaataaaacaygtaattatggcataaccatagaaaggacccaccatgagaaaaatataaaataagggctactcaattcctatggaatggtctctcatctttgtactagtag

SEQ ID NO: 14136 - DNA, 201 bp, Homo sapiens
agattttcaaaggtattgataaaaagttatgcatagtattatctttaatattttgtaattcccttattttattgttctcttaaatgtcctttagcgaagtrattaattcattacttctaaatatttttgtacactaataaatgcatttaagggtattgattttcttcctgagaccattttagcaatatcctaaaagtgcat

SEQ ID NO: 14137 - DNA, 201 bp, Homo sapiens
agtttgtgaggctgcatatttccctgtaccctcatcagtactgtatccaatactgggcttttaatttttgactgtctgctaggtgaaagattaatttgcaytttgtagattacagatgaggttggccattttttttcaattgcgtattcatcttccatttgtattcacatatttttagttcttctgtaaactgtccagacc

SEQ ID NO: 14138 - DNA, 201 bp, Homo sapiens
tcttctccttctggaactaaaatttgagtatttagttggtttatggtgcccaatatattatgtaggctttctttattcttcttttttcttttcttaattgkggctttgttatttcaaaagacctgtcttccaattcagaaattagtttttctgcttcatctagtctattgttgaagctctgaactatatttttattctcct

SEQ ID NO: 14139 - DNA, 201 bp, Homo sapiens
tcccctctgccccttctcattcttcccttccctcccctcttataatcctcccccgtgctccctatgtatatgtatcagtctgtctggtgactaagtcttcrctgctgtattttattttgaattgttttcttgaggaagtctcaaaaatagaagccaaaagatagaatcaaaggtatgatcacagttgtaaccctcccaata

SEQ ID NO: 14140 - DNA, 201 bp, Homo sapiens
gtgacattagcttggcacttaagaaaatgcttccaggtggcaggcacctgctctggctttaaaatgccaacctcaaaacctacagtcaggcaccaaagtgrggaagtgcaacaaactatgtatttcagcacctagtagttttggcagctcatttggaactggttattgccagctgggcagtttgccatttccttgaggcaa

SEQ ID NO: 14141 - DNA, 201 bp, Homo sapiens
attgcaatctatgtaaccaacaatgttaacctcaggcacagatctactttctgtcaccctagtttaccttgtctgacatagaatttcatgtaaatgaaatmataaaatatgttatatgtactcttttctggctggcttttttggcttattataaagtttttgagattcattcatacatacatttgggttctttcacctttt

SEQ ID NO: 14142 - DNA, 201 bp, Homo sapiens
tgaaatcataaaatatgttatatgtactcttttctggctggcttttttggcttattataaagtttttgagattcattcatacatacatttgggttctttcwccttttattacttattagtatttcattaaatggatctagcataattgtttatcagttcacccacaaatggacattgtagtctttttttccagtttgcagc

SEQ ID NO: 14143 - DNA, 201 bp, Homo sapiens
cgcctcggcctcccaaagtgctgggattataggcatcagccacagcgcccggccaagttcagtttttaacctgtttagtacaaggtgcagctgagaaaacygagatattaaggtaggggtggatgaaaagtaggcaaataaatacataggatacacagtgaagtttagatttagagtaggacatggactgtagagttaatt

SEQ ID NO: 14144 - DNA, 201 bp, Homo sapiens
aacctccgcttcccaggttaagtgattctcctgcctcagactcccgaatagctgggattacagacatgtgccagcatgccaagctaatttagtagagatgkgatttcaccatgttggccaggcttgtctcaaactcctggcctcaggtgatccaccagccttggcctcccaaagtgctgggattacaggcttgtgccaccg

SEQ ID NO: 14145 - DNA, 201 bp, Homo sapiens
ggaggggcaggtgggaactgggtacatattaaacaaatttccaatttcaaagtgtttcaaaagtttcaaactcaaatttcaaagagtatgtgtgtgcacayattagggcaaagaggacattccaataacttttcacaatctaaatcataaagtaggtatgtttctaataaaatatatttcaatacttaactaaatttaatt

SEQ ID NO: 14146 - DNA, 201 bp, Homo sapiens
ttaaacaaatttccaatttcaaagtgtttcaaaagtttcaaactcaaatttcaaagagtatgtgtgtgcacatattagggcaaagaggacattccaataamttttcacaatctaaatcataaagtaggtatgtttctaataaaatatatttcaatacttaactaaatttaattgcatctctgataaaaaaatgcattttaa

SEQ ID NO: 14147 - DNA, 201 bp, Homo sapiens
aggtctaaattaataaaccgtgattatttgagtcacaatgtaattagcacacatttaacatgacaatcctaattttaaagcagaaatattattagaaatgrtaagcattaaaataaatactaaaaacaggggacaatgtgtatactaacttccagctttaggtaagtaaaaactttcagccactattaaaagctgcctgtt

SEQ ID NO: 14148 - DNA, 201 bp, Homo sapiens
agtaagaaccccggatggttaaactaagaaagcaacaagaggaatatataagaaagaaaaaaacctacaacgcactattatgaagtacagaaaggcaaatrtgactccgtttgttgtttatcttgcctctttgtttattgttggagttgttttaggttggctgatttttgcatgaaagaaacaaaatactggtactactaa

SEQ ID NO: 14149 - DNA, 201 bp, Homo sapiens
ataagaaagaaaaaaacctacaacgcactattatgaagtacagaaaggcaaatatgactccgtttgttgtttatcttgcctctttgtttattgttggagtwgttttaggttggctgatttttgcatgaaagaaacaaaatactggtactactaacagaaataagaggaacatttgaagggaaagcccaagttttagaccca

SEQ ID NO: 14150 - DNA, 201 bp, Homo sapiens
actggtactactaacagaaataagaggaacatttgaagggaaagcccaagttttagacccacagttgagggaataagacatttaagtgtgaaaactccatyggcagaagcaaatttaaaatgaagccaaggtgaagactaggggttcaagaaacaatttctaaaaactgcctgttgatgaaaatgagacaaacgagtcttt

SEQ ID NO: 14151 - DNA, 201 bp, Homo sapiens
atgagaatatgtggtgagttgaaaagctcaagaagcaaaaggaaaaaaaaaataggagaagttagattactggaaaatttattttgcttctgagtaatcacagttttattacatttatgtgtttccataactgagatgaataatattgtcacatgggatgaagggaagaatgaataagctgtctgtgtcactgttataaag

SEQ ID NO: 14152 - DNA, 201 bp, Homo sapiens
ctttcaaaattgctgagtatagatagcaattctcaattacactaccaatgacattttccctagcaaaaatgtacactgcatccaaagataatgaacaagtrgaaagtgagaactagaaaaatggccatggatgattgcacataatttgatatcgactgaatcataaagtgtatgtgtctgtatgtgctagtattcttgtaa

SEQ ID NO: 14153 - DNA, 201 bp, Homo sapiens
catggatgattgcacataatttgatatcgactgaatcataaagtgtatgtgtctgtatgtgctagtattcttgtaattaagaatttaggtatgcagtttgwttcctggtttttgttatactaggtcatccaaaaatttaaatgccacatctgggaatatcaacgtggcttggtgactatgatgcacttatttacttagcat

SEQ ID NO: 14154 - DNA, 201 bp, Homo sapiens
atggatgattgcacataatttgatatcgactgaatcataaagtgtatgtgtctgtatgtgctagtattcttgtaattaagaatttaggtatgcagtttgtytcctggtttttgttatactaggtcatccaaaaatttaaatgccacatctgggaatatcaacgtggcttggtgactatgatgcacttatttacttagcatc

SEQ ID NO: 14155 - DNA, 201 bp, Homo sapiens
aacgacagaggcatcaagagataagagtcctgaaaaaagttaaaaagacagacatacaggtcatgggagattcatgtatcaccaacaggagaaaaccaaarcacggtagacctatccttcatgggacacactcagagagtaactcctccatatgtaacacactctctctctctcttttcttttttaaataaaagaatccat

SEQ ID NO: 14156 - DNA, 201 bp, Homo sapiens
tgagggtggagccctcatgaatgggattagtgcccttataaaagaagcctgaaggaacctgtttgcctcttccaccattgtgaggatgtggccagaaggcrccacctatgaagcagagaacaagccttcaccacacactgaatctgtcaacacccttgattttggtctctccagtctccagaagtgtaagagaataaatct

SEQ ID NO: 14157 - DNA, 201 bp, Homo sapiens
cagtctaaggtattttgttatagccaactgatgggacaaatacagatattggtaccaagaagtggtgttgctatcacaaatacctaaaagcatggaagaascgctagaaatgggtaatgagtaaaggctgggaaagtcttgaagtgaatgctagaaaaagtctacgctgctataaaaggactagaaaaagtgattctggtg

SEQ ID NO: 14158 - DNA, 201 bp, Homo sapiens
aaccctcaccccagtgtgctgcaaaggcaggacatggaatctaagaagattattcacaagccttaagatttaatgtttgccctgttttgttgtggacttaytgcaacttgtactcttttcttccttcccatttctcccttttgaaagaggaatatctaccccgtgtctgttccaccactgtattttcaaaatgcataattt

SEQ ID NO: 14159 - DNA, 201 bp, Homo sapiens
ctcaccccagtgtgctgcaaaggcaggacatggaatctaagaagattattcacaagccttaagatttaatgtttgccctgttttgttgtggacttattgcracttgtactcttttcttccttcccatttctcccttttgaaagaggaatatctaccccgtgtctgttccaccactgtattttcaaaatgcataatttgttt

SEQ ID NO: 14160 - DNA, 201 bp, Homo sapiens
cccaccaagtgaggatgcagctaggagacaacatctatgaaccagaaagcaagcactcactcaattccgaatctgctggtgctttcatcttggacttgtgmgcaatacatttctgttgtttatcagtcacccagtcaaaggtattttgttatagccgcccaaatggaataaggtaatatcgtatgtactttatattttata

SEQ ID NO: 14161 - DNA, 201 bp, Homo sapiens
ttgcaggtggaaatactaaggcatagtacagcaatttgctggaatacagagttattaagtggtggaactggaatttgggacacaagtagttgacattattstgcattttttcatatcattcaactaaattcccacagcaactatacaatttataagtcattatcttcatttaaagaggaggaaactatgctttggggaaat

SEQ ID NO: 14162 - DNA, 201 bp, Homo sapiens
agagttattaagtggtggaactggaatttgggacacaagtagttgacattattgtgcattttttcatatcattcaactaaattcccacagcaactatacawtttataagtcattatcttcatttaaagaggaggaaactatgctttggggaaatgaagtaccttattcatggtcacacaatctaatatgaagaggataacg

SEQ ID NO: 14163 - DNA, 201 bp, Homo sapiens
atttataagtcattatcttcatttaaagaggaggaaactatgctttggggaaatgaagtaccttattcatggtcacacaatctaatatgaagaggataacrgctcacatttacttcattccaaagcttcaaacagttaggagatactaagaaagtgtgatttgcattcttccacaggaaagcaacatgataatagtggtgc

SEQ ID NO: 14164 - DNA, 201 bp, Homo sapiens
cttcagaagccaaacactgtccttcggcagcactgcactctcttacagagtgtctttgggggagctatttaactacaaatagtttcatcttccaggaagayccaaactgcttatgtagatctgatcctcattatttgccaattcctcatttgcaaattcatctacttgctaaaatgtatttatgacaccaaaataaatact

SEQ ID NO: 14165 - DNA, 201 bp, Homo sapiens
tgaaatccaaattcctaaaatcactactctgcttttcagtgtcttcatatttggtaagtccacatgcaggaaaatatttgacttgctttaccttatgaaamctaaaagtaaaattgtgaacactacagactctacacatagacatgctgatgtcaaatcacaggaaaaaaaatgtgtgttttctgttatttgaattttttg

SEQ ID NO: 14166 - DNA, 201 bp, Homo sapiens
aagttgacacgtgtagctagccatcacagtaccttaaacgataaagttgcctccaatgaacatgaataagcagtagggaaaaagaaccacttgaggcaatygccttgatcttcaatcccagctgtttcactaacagtgtggttttaagaaagtcattttttctttctgaacctcaatatgcttattaaaaaacaaaacaaa

SEQ ID NO: 14167 - DNA, 201 bp, Homo sapiens
aaccagaaactgcatttcaatgagccggacatgagacaggccaggtcaaaagccatgcaagactatcctctatatatccctcccaaatggtagtatttggktcatacctgagtgttcagggctgaaaggacccacaggcttaaggaaaaggattaaggataagaagtatttcagtgggcagaaattatgagtagaccattc

SEQ ID NO: 14168 - DNA, 201 bp, Homo sapiens
ggtattctgtagattaaaaacaaaaacaaaaacaaaacaaaacaatattggctgggcatagtggctcacgcctgggatcccaacactttgggaggccaagrcaggtggatcacctgaggtcagaagtttgagaccagcctggccaacacggtaaaaccctatctctactaaaaatacaaaaattagctgggcatggtggca

SEQ ID NO: 14169 - DNA, 201 bp, Homo sapiens
ttgttgggaagagtataaggaaatggaaactctcatacactattttcagtagagttaaaaatgtaaacttttacacttttgaataactatttttttttttwaaaaagcagtataacctatttggattctaataatgttatctactaactcattcagtaaataatttttatttttactttatttattattattttttgagac

SEQ ID NO: 14170 - DNA, 201 bp, Homo sapiens
tatttgtatttttgctgttggttgagtttgttgtatattctggatattagtcacctgttagatgaatagttagtgaatattttcttccattctacaggtcrtctactcattctattgactgtatcctttgctgtgcctaagctttttagtttgtctacttttgtttttgttggctgtgcttttgcaaccttagccataaaa

SEQ ID NO: 14171 - DNA, 201 bp, Homo sapiens
tatactgatttcctttccattagctacatacccagtagtgggattgctggattatatatatatggtggttccattttaagtttctaagaagcctccatacrtttaccaaaatagctatactaatttacattcccatcaatagtgtacaagagttcccttttctccatttccttgccagcacgctatttttttcataataga

SEQ ID NO: 14172 - DNA, 201 bp, Homo sapiens
acatttgtttctttgtgttaggaacatttcaaatgttctcttctagctattttgaaacataaaataaatcattgttaattatagtcatcctactgtgctaytgaacactagaatgtattccttctctctagctgtgtgtttgtacccgataactaacctgtctttattcccaatcccacccttcctagactctggtaacca

SEQ ID NO: 14173 - DNA, 201 bp, Homo sapiens
aagctctagactgaacttggcaacaagttcaaacacacattagaaagtaggcataaatactgtcatactacctattactatagactcttgaactccactcyctttgtcttcataggcactccagccaccactctgcatgaaagagtcaccattctagaaggaccagctactcttctagtcaaatcagaagacaggatgctt

SEQ ID NO: 14174 - DNA, 201 bp, Homo sapiens
gcccaaattcataagtaacttgggactgtctgagtcttggattgcttatccacaaaatgtgaataagagcacatttctcatttcattgttgagactgttarattactaatagcactcaaatagggtaagtttgtgtcattcatctggaaggctgaggtgttttcagtatctgctgagatagatgagacttccacctctact

SEQ ID NO: 14175 - DNA, 201 bp, Homo sapiens
cttaagtatattttgataaagatagtttaaattttgaacattagcttgaactgatcacaatgaacatcaacaattactggaagcaacacagtagagcattktaagaacaagcatgttaaaagtcctgagttcaatgcccaaattcataagtaacttgggactgtctgagtcttggattgcttatccacaaaatgtgaataa

SEQ ID NO: 14176 - DNA, 201 bp, Homo sapiens
agggcatatttcactcctcttttcacagatgtagtcagttggcaaatatataactagagaagtttaactgaaatatcaggacgtatttatatcttatttgsaaaaggtcaattcttcaattgagctctagagcacaagagaaaaactccacaaagatattatacttagtctatacttcatttttcaaccattatttttaaa

SEQ ID NO: 14177 - DNA, 201 bp, Homo sapiens
tgtaccaggaaatgacagagacaggacatccttcatatctggggtttcatccaccagatcatgttgacattctctaaagctgggactacaggaggaatagyagacataggggaaaacatgaggaacggttctaaggacctatgaaatgcaggacgcaagatttgtttcctgggtgtgtctctttctgattgcactgcatgg

SEQ ID NO: 14178 - DNA, 201 bp, Homo sapiens
cctatgcatacacagatttgtattcagtcaaatactaaaccagatccttacacagatttctggagctctttctttgtataagtccaacctttccattattrttcccccaaaatcctgttggcttggcctccctgagctcttatctctgtcttctttaagcagcaagacaattaggctctgcttgggttctccctttctata

SEQ ID NO: 14179 - DNA, 201 bp, Homo sapiens
ggttctccctttctatactacactctggtcctgctgctaggcaggaagctcaggtgtttgtagtacttaccttgtttgtttcccttttctgagggatcacrttactgcatggtgtgttggccaatgtctaaaacagtattttataaattttgtattgttttcctatttgtttagagcaagagggcatgtctcaaaccagtt

SEQ ID NO: 14180 - DNA, 201 bp, Homo sapiens
ctctatatttcatttctctctgtttctgcactgctgacatttgaacctcacattttgtgtgatgcctctttgtaaaacgatggttaaaatgtaataaatawtttggtgttcgagtaaggcttgaatgcctcaaatcctaattgttattatgtttctttataagggtggctgagaagacattaaaaaaattaggtagaataa

SEQ ID NO: 14181 - DNA, 201 bp, Homo sapiens
ggttaaaatgtaataaataatttggtgttcgagtaaggcttgaatgcctcaaatcctaattgttattatgtttctttataagggtggctgagaagacattwaaaaaattaggtagaataataccaaaatatgctgcacatattaaagctatcatttaaacactatatttttcaatgaagatagtgttataagtgatcataa

SEQ ID NO: 14182 - DNA, 201 bp, Homo sapiens
taaataatttggtgttcgagtaaggcttgaatgcctcaaatcctaattgttattatgtttctttataagggtggctgagaagacattaaaaaaattaggtrgaataataccaaaatatgctgcacatattaaagctatcatttaaacactatatttttcaatgaagatagtgttataagtgatcataaaggtaatctgcaa

SEQ ID NO: 14183 - DNA, 201 bp, Homo sapiens
tcattaaactaaacaggctttcagaaaggctcagaggcttgtaaactcagctggagcttattacaagatcagttctgtgtttctcagaggctttgtggtcstgagtgcaaacatctgagataagtgatttcaagctctctccaagtttgaatctaacaaaactggccactgtgaaaatatggccaacaatccaggcactgg

SEQ ID NO: 14184 - DNA, 201 bp, Homo sapiens
aaggttgctctgaagttaatcagttatttctgagtactcgtaatttggtaaaggaaagctaggcatgcgtgattcgctttaccactcaagcaacaactgaygccctgtgtccaactagctaagatgagttatctgaagataaggtttacaaggcacagtacttgactaacagatatctagtaaattcagacctctagtaca

SEQ ID NO: 14185 - DNA, 201 bp, Homo sapiens
atgtaaccatacgtttttcatccaaaatgcttataaatggacacccttatttgtaacctcctcagagaaaactgaggagaacacgaattagactagttccytttttgcattgagcaaaatgctccagaatgactatttcaatttgaatactattcatttgctttaagtggaactatcctttcattttctatccttttattt

SEQ ID NO: 14186 - DNA, 201 bp, Homo sapiens
gtccacctcctttttcttcatttttaaaatgctgctgacacgtagaagaagcctaatcacttctgctccttgttttttcatttaacttcttcctatttttyctgtatttcatgtaaaagaaagttacctctggaggactaattaaattcaggttcaactttttgggcaagaatgctttatgtttgtgtgacggttaatctt

SEQ ID NO: 14187 - DNA, 201 bp, Homo sapiens
gatgagattccggtagactttgagtaaagcagtttaccctccataatatgggaggacctcgtccaatcagttgaaggcattaacagaaaaaagactgacckcccctgaagaagagggaattctgtcagcagacttgggactccagctgcaagatcaattcttccctgggtctctgctaccctatcctacagattttggact

SEQ ID NO: 14188 - DNA, 201 bp, Homo sapiens
cataggagatatttgcaggtaatttaaaaatatgtatattcccattcaaaagatgtgtttccccatgacggtggacatttattgttgccattttacatccrctcctcttttggggactggcatttcacttttttgtggagagaattactcttccatctgttgtccactgaatgtaaaaacctggaactttgttctctatgg

SEQ ID NO: 14189 - DNA, 201 bp, Homo sapiens
tgtgcgttaactaaaattcatttcacagcaattcactgtgtctggatttggggagacaaactccctttgagttaaagagaaagagaaagagaatactttascatacacgccaacatctctttatggatttgtctgaatcatttgataataagctcctatggaagaacaaagtccgtgacaaacagtaagcagtttcacctg

SEQ ID NO: 14190 - DNA, 201 bp, Homo sapiens
tggcttccacaagtgctataaaatggcaggtagacatctcaggtaatcaaggtcaatgaatttgtttgcctgaaattgctttccacactttttcctaactycgttgcttgctcaactatatctgacacccagagactgtaatgcaccttacctaatcccgtgtcatgcctgtgctgaggtttactctgagtaatgcagaaa

SEQ ID NO: 14191 - DNA, 201 bp, Homo sapiens
ggacttacgaagtataagatagttatcactgttttattctctgcctagaatgcagtgtttcctataaaattctaaattgcagtgaagcattctgaaagcamatactgtggcttccacaagtgctataaaatggcaggtagacatctcaggtaatcaaggtcaatgaatttgtttgcctgaaattgctttccacactttttc

SEQ ID NO: 14192 - DNA, 201 bp, Homo sapiens
aaaagcaatacagtaacagaaatcagtcaattgtcaacttaactttgaaacgtgaatcaagttgttctctcttacgtacgtacacaacctcattcctcaaytattaagaaaatctcagggtacaggattccaatgttcctgaatgggtcagttcttcagggaaaacttagttaaggacttacgaagtataagatagttatc

SEQ ID NO: 14193 - DNA, 201 bp, Homo sapiens
aagttttttttggagttgtgttttactgggtgatatagtatgccacatctgtattacttaatgtagagggacagaataaaaattgctgccatttttttctmtagaggaaagtgctctttgtgaatattgacaagcatggagaaatcatacaatgtttcttcactcctagcagtgtgctagatgcagtggatatcaggagtt

SEQ ID NO: 14194 - DNA, 201 bp, Homo sapiens
ataacaaataaagcaaacatttgacagactgtaaaatatttcataatatgtctgatctacaattttcaaaaactgagctgcaaggatggagttacgtggcrcagatgactagggtgctaaaatgagaacccgtaagattcgatttatgcaactttcttaaagtctccttgatgtgtacaagtgactataagagcatttgca

SEQ ID NO: 14195 - DNA, 201 bp, Homo sapiens
acaaaagggtctgggtcacaggaggaggtagaaaaggccttattactttttggctacttgccatagggataaaatataacaaataaagcaaacatttgacrgactgtaaaatatttcataatatgtctgatctacaattttcaaaaactgagctgcaaggatggagttacgtggcacagatgactagggtgctaaaatgag

SEQ ID NO: 14196 - DNA, 201 bp, Homo sapiens
taagagaagtgttctttaggctttccgataactcaatggccaatccaaaatcttcagtggacaacagtggctgaatagagtggaacaattccacagctatyaggaatttcccaagaggcttatagagtaacttgtatttcctgaaatgtctctggctaaacaaaggcaataggaatctgcagaaaagaaatttctttagga

SEQ ID NO: 14197 - DNA, 201 bp, Homo sapiens
gacaagacaagtaatattaatactattctattattctgatttcaagctacttcatctgttaagagaagtgttctttaggctttccgataactcaatggccratccaaaatcttcagtggacaacagtggctgaatagagtggaacaattccacagctattaggaatttcccaagaggcttatagagtaacttgtatttcct

SEQ ID NO: 14198 - DNA, 201 bp, Homo sapiens
ctcccttattagtcacccacatgcagatgaacccaaagtgacagaagaggaggctgaatcactgtgagtgagctggagaggctgcagaaggatggcaaccyatatgaaattctcatctgtgaagtagctaaactcgtccaatttcatcacttcgggagctaacaagttccaaaagtctaattctttctctttgaaataata

SEQ ID NO: 14199 - DNA, 201 bp, Homo sapiens
tgactctcccagtctgtcttggatgtctctctactctcagagtctttgctataatcccctttcataacacttatcctaccatatttggttgttggtgaacmtatttgtcttatttacaaggctacaagctccataagagctataatttatcattttgtattcccagtcaatataagtctagtgcctgatacatactaaata

SEQ ID NO: 14200 - DNA, 201 bp, Homo sapiens
aagcatcagactcaaggctaagtatacacaactgataaaaagaagtcttagaagtttaaattcatttcacttggcccttgctcttttatgagcatatttayactttacagttttcccaaagtacatattgaatgacagctgaaaaatcttctcagtagcgaagtgattttgctttatctgaatagttgatatacaacaagt

SEQ ID NO: 14201 - DNA, 201 bp, Homo sapiens
gaaaggagcagagcaacagaagtagacaggaagggtaggtgtcctctgtgtgtaggcagacgaaaaactagtaggaacaagagataagcgttaagggagartgacctcgggggcccagggagggcaggggtcacgggagtagtattggagctgcacagcctgctgcttctgctgatcttagattctgaaagttggagaaga

SEQ ID NO: 14202 - DNA, 201 bp, Homo sapiens
atcttcattgattcttttatttttctatttaatataactgtaagcacttaagcagtgttctggggagtctggcttccttaaatggctaagctttgcagtaygggtgggaagcagaagcaatgaatcagaaaggagcagagcaacagaagtagacaggaagggtaggtgtcctctgtgtgtaggcagacgaaaaactagtag

SEQ ID NO: 14203 - DNA, 201 bp, Homo sapiens
tcatctaaaattatgtttaagtgatactgagctgcccttccatagataaagtaaatttaaagcgaatatttaaaaataggtacacaagttctttcaaggawccgagaagggtaacagaatgaatgtgttgacctttaagcctaatccggtatgagataaagttggagatgacagcaagaccatgtctaattactgatgggt

SEQ ID NO: 14204 - DNA, 201 bp, Homo sapiens
ctgtctgggattcacccttatgacataccacacactggaaacatgagggatatcttgatctatttcttgttcttgtttctaaaaatacaatgaaaggaggsccatactggtaaatgataaggtgcaattttccttagttgtacctggtcatctaaaattatgtttaagtgatactgagctgcccttccatagataaagtaa

SEQ ID NO: 14205 - DNA, 201 bp, Homo sapiens
agacacgcttggtttacaggtcatataaaacaaaattaatcagcaatatgtggagtaatttataaacattaactgataaattctaggttataacccatatytcctatagcctgtaaccccatatcttcaaacctatacccaaaggagaatttaagtgttaaagagattctcttttcctacattcctttatttcatttattt

SEQ ID NO: 14206 - DNA, 201 bp, Homo sapiens
gccttgagataccgtgtattctatattgtatagttgaggattgagaccagttggaagaataaattatagctgtgcttatcaggaaaaagaagcacaaataygaccatggaggttgccagggcacacaagtggaagaaactcgcgtcactggttgcatcaccataatctgataattttgcctttagttccttcagtgcacta

SEQ ID NO: 14207 - DNA, 201 bp, Homo sapiens
gccatggattcacaataatgttccctacaaattataaaaaaaatttattttttgaaatctaatgtttcttttgctacaataaatttttggctaacacagtyactctccttctaacttcctgtacagcattttttctccttgccctatcagtttagagacaaaaaaagtcaggaaagcaaagagaaaattttatcaaacatt

SEQ ID NO: 14208 - DNA, 201 bp, Homo sapiens
ctgacacgctcaccgagggctttcatttctgtttcttcagtctcaggagtgtcactgtggctagcacttggattgatcaggtgtgtggggtactgcagccsctgctcgcctgcatacttctcccacctcaggtcatcactttcatgggtgatgtagcgctccccgattttgcattccagctctcgcaaatctaaccaggtc

SEQ ID NO: 14209 - DNA, 201 bp, Homo sapiens
gacagaaaataatggcagttctgcaaggcaaatgttaaacctgaccgtatgtatttattagttccacagtgttttgacagattataggagatggaactcakaggatgctgacacgctcaccgagggctttcatttctgtttcttcagtctcaggagtgtcactgtggctagcacttggattgatcaggtgtgtggggtact

SEQ ID NO: 14210 - DNA, 201 bp, Homo sapiens
ttaaatatactgaggcacaccaggcaggcaaaggattcaaaactatacattaaaacttgttcatgcatttgtgtcttaggattttattccctaccctcctyattcatttttttcccacatgggttttggagttgttcatagaacactggaaataatcgactcttcaagagtttgtttacaatgacaacaccaatgggacac

SEQ ID NO: 14211 - DNA, 201 bp, Homo sapiens
ttactcactatgcttacttttcattgtttatctctatccactagaatgtagcttcaagagagcagggattttgtctgttttgtttacagatacatctatgygcctagaataccatctactttacaataggagcgcaatatatatttgtagaacaaatgagtgaataaataaattaaggactaagtattatccaagtgaatc

SEQ ID NO: 14212 - DNA, 201 bp, Homo sapiens
ggtttctcagtttctgaaacaagccagaacaatactgaatcacccctggactgtgtgctatgtgatcagaagaagcacagaagcaagctttattgagcttsaaacttgattttctcacaagatctttactaaaagcaatttaaactaagatgtcctatttaatttctagacatatgatgtcaaaacatgtacgtttaaata

SEQ ID NO: 14213 - DNA, 201 bp, Homo sapiens
tagatcttgaactccactttctatttaaagcatacacacacatgcatgcatgcgtgttctctctctctctctccccccccaccaacctttcactctctctrggattggcagaagatggtgcagcaagaagcataggaattgtctccccatctagacaacaattacactggcagaataggtcttacataattattttggaac

SEQ ID NO: 14214 - DNA, 201 bp, Homo sapiens
gcaattaaaaaaataataacccccattgtactgtccataccactaaagtaaaggacataccattatctttgaagctgacttgtgatcccctccccaactaygtggattaaacagagaagtgtcagtgtctagtgagtattgtttaggaggatataatgggaggtgcagaaagaatagacacactttagagactagtaagaa

SEQ ID NO: 14215 - DNA, 201 bp, Homo sapiens
gattacaggtatgtgccaccatgcctgactaattagagatggggtttcaccattttggccaggcagaatgtttacagcatttggtctttgagacatagatraacatttagttatatgtcatgtcctatattttgtaccagtaatttaagtctattgttcttttctgaactaaatagctatctccttcagacattgttatca

SEQ ID NO: 14216 - DNA, 201 bp, Homo sapiens
atcaactggaagaaagggtatcagtgattgaagatcaaattaatgaaatgaagcaagaagagaagtttagagaaaaaggagtaaaagaaatgaataaagcstccaagaaatatggaactatgtgaaaagaccaaatctagatctgattgctgtacctgaaagtgatggggagaatggaaccaagttggaaaacactctgta

SEQ ID NO: 14217 - DNA, 201 bp, Homo sapiens
tgttccaagacacaaatcatatccctttgaattccagatgaaaacattttaggcctatttaggatttatttcaatagatatgtatacacatgtaaagcagkttcaatgttatttaaaaatacacttcattggtcttattgtggtgacattagcttggcacttaagaaaatgcttccaggtggcaggcacctgctctggctt

SEQ ID NO: 14218 - DNA, 201 bp, Homo sapiens
ttagtagagatgaggtttcaccaccttggccaggatggtctcgatctcttgaccttgtgacctgcccgcctcagcctcccaaagtgtttataagtgtttaygggattacaagtgtgagccaccacgcccacagtctaattattacttagatttcatcattccagctaaaaaaaagattcataatttattcaataacatagt

SEQ ID NO: 14219 - DNA, 201 bp, Homo sapiens
atagccaaaacacaacctaagtgttgtgtcccaggagtaggtggatgataaggacacatcgtgtgatcaagtgttctaacaagaatgcctaaaaaattgastgataatgtctcttagctcccttggtggagtggttctagcattcagctgtaagggacagtccaaagttgttctgaaagcggtagatcctgaggtctactg

SEQ ID NO: 14220 - DNA, 201 bp, Homo sapiens
tgtgaaatttccaaatactcagagatttttccagataactttatgttcttaattcctcatttaattctgctaaggtccaaatcctactttgcataaatttracacttttacatttcctaagacgttttatggcccaggaggtcaaacttggtgaatattctatgtgcatctgaaaataatgtgtattctgctgttgttggg

SEQ ID NO: 14221 - DNA, 201 bp, Homo sapiens
aatccacaaagggatcgttatttaaaaaaatgtaaagaggatagtgacatggtttcaactgcattttagtcctcttagttagaattgaattttaagacctrgactgtttatcaactgtaactttccaaataggctcaccaatattttgtcaacatagtggtttttgaaagatatttttttcctatccagttatgttaaact

SEQ ID NO: 14222 - DNA, 201 bp, Homo sapiens
ttgttaggctctccaattataaacagtgtgtcaaatgatctttcaaaaatggtacttgaaaaacaaacaatttggctgacatcaacagaatatattcataygcaggaaattcactcactatactgatgaaactattctatcagataccctgttaaatacattctttactgcttaccagtctaggccagtgatttggagata

SEQ ID NO: 14223 - DNA, 201 bp, Homo sapiens
tgatttattaaaaattaccacggctctaaaagcacatctgttagtttcttcaatatgtagtgtgtccagctctgaacatttacccatctcatagctgctaytgagtgcacttttgtgatacttccatttcccataggtgccagctcccagcagagactgccatgtgtaatttatcaagcataaagacactaagacaaggga

SEQ ID NO: 14224 - DNA, 201 bp, Homo sapiens
gtagtgtgtccagctctgaacatttacccatctcatagctgctattgagtgcacttttgtgatacttccatttcccataggtgccagctcccagcagagaytgccatgtgtaatttatcaagcataaagacactaagacaagggaaaggggaagccagttgtaaaggaacagccagtctagtaaagctggggaagtcacag

SEQ ID NO: 14225 - DNA, 201 bp, Homo sapiens
ctataaacccttatctttttcctttgttcttccccctagaaaataactacaagttgtatccatcctgtgattcttcaaagtccccacaggatgagttcaaygctgtctagggacaagacaagtaatattaatactattctattattctgatttcaagctacttcatctgttaagagaagtgttctttaggctttccgataa

SEQ ID NO: 14226 - DNA, 201 bp, Homo sapiens
gcccagactcatagcaaatgctttatatatgttcgttgttgttattataagtagccatgaccttgagaagttcttctaggccactctgttctagttaaaamacgtcagataaggaacgacacagacacatacatcatgcacactcagtggtctgcaatttctgcttgccttctataacttcaatacagctccacatgattt

SEQ ID NO: 14227 - DNA, 201 bp, Homo sapiens
ggattacaggtgtgagccacctgcacccagcccattttttaaaacattaccaaccaaagcaacactggaaacagactaatgatttatcaatggagggttcrggctccttgtatctggagacattttaagaaaatggtatctaactatctataggtttgaacagattatctctcttcctattccaattccacaattaaaaca

SEQ ID NO: 14228 - DNA, 201 bp, Homo sapiens
atggtatctaactatctataggtttgaacagattatctctcttcctattccaattccacaattaaaacatttcaatgacctgtatttactgggacggtccrttcccctttgactcttaaaataaaagcagtatttatttttagaaatcaggatttcctttcctacagaggttacagctcagacacacttgagcactgaaat

SEQ ID NO: 14229 - DNA, 201 bp, Homo sapiens
catttaacaaaaggataataaattattttttccctgacagaatgctgctcaactctataggaaaagaatgacataaccagtggaagtaggttgtaacttcyctataaaactgcagggaaagataaagtaatggctggaggtgaagtcagtaggtggatttccacatacaagcactttttatttgcattcctcctcttgagt

SEQ ID NO: 14230 - DNA, 201 bp, Homo sapiens
tatcttttgtttgtatgagtatgcatttattttgatttacataaataccagtatgcaacataccactttgttcctttttagcttttggaatgtatccaaaytgccataggtacataagtccatagcctctacctgctatatcatatgccttgatgtctagtatattctacttacccactttttcaatgatgtacacctaga

SEQ ID NO: 14231 - DNA, 201 bp, Homo sapiens
acctagatctctactaacttgctgcccaaacaatgtggcaacggatagcctgatgcatgcctccttacgtacctgtgtgagaatttttttgagaacatacrtatgcaaaagggctgagttacagtattcatttatcttaattaaatagtgctagactgttctgtaggatgatggcaacagtttacacttttaccagcagtg

SEQ ID NO: 14232 - DNA, 201 bp, Homo sapiens
tacaattttagctttcatatttaagtttttcatctactagaaatacagctttgtatactgtattaactaggcatcagttttactttttccatatagtaaamcaatttttccaattatctattaatcaatctgttctctattgattatggtttaactctttatcatatataaatttttcctgtttacatcagtttatttcta

SEQ ID NO: 14233 - DNA, 201 bp, Homo sapiens
ctttcccttcttgagactgattcagctatttgtggaattctttcataaaatttttgaagtttagtattttttatccaactgatattgagatcaaggttcayttagggagattgatatttttatgatactaacttatatcatcccaaaagcatgggtagtttcttcttatatacattatctattatatttttattagggttt

SEQ ID NO: 14234 - DNA, 201 bp, Homo sapiens
ttatatactaaatgtcatcctgtcattgaatctaaagagctatagggaaagtttatcttcctctgtattcttacctcaattttgcaagaatgtgttttaartaattcatgttcccattatatgctcacctaattttcacataataaacactatttaacatttatgaaagctctaattaaacattgtcttttcttcaatatg

SEQ ID NO: 14235 - DNA, 201 bp, Homo sapiens
tccctgctttgctaattcagaattcttaagcaaagaaatttgcacatactaagtgttggacaaataaagaattaaaggattggcatcaacctaaaagtatyaaaatagtatgcaagaatcaaagttgtagacttgctaatttcttggcaaatttcaatatgacaaaagtcattaaaaggtgaaaacctcaattaaacaagt

SEQ ID NO: 14236 - DNA, 201 bp, Homo sapiens
acaagacaatcctgtggagggaatagtagaatattttcaacaataaaaaggtaaagaaagggaagggagaaaaggaatagcagttaacatgtaattgccakagtcttcaaatgttatcagagcttgaattgagacaacatcaacaaggaaagaggcacagatgaggtggaatgagttgtactcagcaaacccactgattgt

SEQ ID NO: 14237 - DNA, 201 bp, Homo sapiens
atagaagttagggtaaatataatgaatttttacatgttcacaatagattttagggtaacactgaggataattaaatacatgactgtgttcttgtattctcyaaggtagattgtgtagattgagaagacagctaagatagacatcttaagactgtcagaaagatatcaatctaaaggaaggagaatgaacagcagccagaat

SEQ ID NO: 14238 - DNA, 201 bp, Homo sapiens
gtcagaaagatatcaatctaaaggaaggagaatgaacagcagccagaattccgtggtaactcagagtacacagctcttggtatgtgggttaggtactcagwgaccatggttccactaacattcaattcactaaggtctattagtgaggcactggatgctttgctagatcctgactatgatattagcctgttttctgttcta

SEQ ID NO: 14239 - DNA, 201 bp, Homo sapiens
tgagatatcacgttaattcaaacttgagctcattcagctcaaatatcacctggggaagttgttgcccagagctgatacaggaagatacttgttttacagcyataactttagaaattaaatttaaattactgatataattttaagattccatgtattgcaaatgccttttcacttaataaacatacctatgtgtatttaaac

SEQ ID NO: 14240 - DNA, 201 bp, Homo sapiens
taaataaagatataatgaaaaattaaccaaagtacatgaggaaaatgtgacaaccttctctcccccttggttttcaagcttccttggagcattctacaatyttactctttttcaggtttggataatgtccattatatctggagaactgtgtcatgaaatacacactttttccccaacaaaaatcagtagagcatacagagt

SEQ ID NO: 14241 - DNA, 201 bp, Homo sapiens
aaatcccaaattccacttacctggcttctctccagattacctataacaacaaaccttctgctagtcctgtatgttactgactatccattaacttccatacwtctgggatacaataataattgacaattcaggtttataagatattttttaacctagaaagattgtcttgcactcagtattctttgaatataatttttaaaa

SEQ ID NO: 14242 - DNA, 201 bp, Homo sapiens
taggagaatactggaaataaaactgcacatggtgatgaaatacagaaagtagaggagtcatgcaaaaaaaaccagacacaccacacaaatcagaaattcarctcctcaataatgcagaatttattattactacatcactaagttacttatagctgacctagtttcaaagtcctgagcattaattcatatatattcaccctt

SEQ ID NO: 14243 - DNA, 201 bp, Homo sapiens
aagcctatttcttcataaagttaaattccattcagctctatgaatttgaaacccttagaatgccaaatgcatttcaataacatatctattgactttcttcygaaatggctagtaatggacctttcctaggatacaattcaaacttttctaaatgaatcagtaagacaaaatggacagattagtaaattttcattttattaa

SEQ ID NO: 14244 - DNA, 201 bp, Homo sapiens
cttattgtaagatatttgagttgtttgctatttgtttccttttataaacaactatacaatgggtattaccgcacaaataatcagatattcctgcacatatrataacacatgccaaacacagacaatcctagacactgcactgcaatgatctgttttgtagaactgtgatccagtggaaaagcaagtgttttggagcaaaca

SEQ ID NO: 14245 - DNA, 201 bp, Homo sapiens
tctaaatttatactttaatcaacttacatttgcatctatatcaacagtaatcaatagtacaacagcaacagcaatagtagaaaatgtcatactttgtcagycaataatattaccttctttttatcactatgctgggcccttttcaaaaatactcactcaagccgtatttattttgatccttacaacaaactctgatgttag

SEQ ID NO: 14246 - DNA, 201 bp, Homo sapiens
ggtccatatagtaaaatgaaagcagcaaattaacagttgttaattgtgtagctgatgttataatttcctttagaaggtatttttgaggatgcatcattcaytattttttggttttttattcgcccacagaggcgggaataaacatttctttcctacatggctgctccaagattgagatattattctgaaagtgctcagtat

SEQ ID NO: 14247 - DNA, 201 bp, Homo sapiens
acactctgtatatttaatgatctgtttttctagatgagaccagaaaaagtaagaaacagaacaacgtgaatttctctgctgccaaataacttcaagtggtrctatcacaactggtttttaatggcacaaaaatatttggttgacagtattaaaagaattcctgtgggaaatatctcatattcttatagattaaaaaatgtt

SEQ ID NO: 14248 - DNA, 201 bp, Homo sapiens
taggcagctttgaatccactttttggtgtgcatcaacctgtatggacctgaagatacagactgtcacatgagaccagaggaacaaagactgcttccttcartcagaatccttcccagtgtcaggcaaagaaaagtgacttctacagtcttttggtaattgagaaccatatctctatggagctaatgttacaagtatttgcc

SEQ ID NO: 14249 - DNA, 201 bp, Homo sapiens
tggtaccctgtacctccttctataaaaacagcaaaaggactatatccaaatacctagatttcttggggtaagatatattggaacatagtgcggtctttcartggtttcaggcaataaacagatgccgtttaaatagcagagatggaacaagggccaaagcagtaggggaaatgagaatcctttattctcttgggttccctg

SEQ ID NO: 14250 - DNA, 201 bp, Homo sapiens
aaaatttgtgttactactctagctctatgcctgtgaaagcattttaaaaatttaatgtgacagcatggctaaatacattagaaagataatcaagaggctgkcaatatcctggataagagcatctgccttggagccagcggacaggatttgtaccctggccccacctagacaagctacttaaccatctatgcctgcattacc

SEQ ID NO: 14251 - DNA, 201 bp, Homo sapiens
tgagggtttttgcagagcaaacacacataatcctttttaactaactaaccagccttttgctacctggttggatactatggatgtcaccttataagatggtktttctgtacaactttaattaattaattcaacaaaaatttatttagcagctaatatatgccaggaacaatttctggcagtggggatacattagtaaacaaa

SEQ ID NO: 14252 - DNA, 201 bp, Homo sapiens
gtggtaggtacaaaaatgtagcagtgttaattgaatctgaaaataataaatgaaaatgaatcagaaaatagaaatggaaaatggatctaattactcaaacyttttggtaacatacaaactaacttgaaattccagtcttccaacacttgtaaagctagtgttcactcaccttatatcccactctcactattccttctcttt

SEQ ID NO: 14253 - DNA, 201 bp, Homo sapiens
ggacaggctatgttccaataaaactttactacaaattgggcagcagtccaatttgctctggtggccacattgtgctgactcctgatataaaaagtggggaycatccagtaaccaaaagcataattaaataacagatataaaattgcacatacttctgaaataatatcaagaacagtgaagtgtacacagactatgatattt

SEQ ID NO: 14254 - DNA, 201 bp, Homo sapiens
ggagacaccaagcagctgggaaagtatgacataaacacagtcctaggccacaaaggtgagagcctctcccttcaaaaatggcccataaggataactttatrgtgttgcaggaaataaggggccggagagaccaaataggggtgcaggagagttaatttaaggtgtacactggcttagcagacgtgtcctgaaagactgagc

SEQ ID NO: 14255 - DNA, 201 bp, Homo sapiens
agtggaaggctctgttttgtgtcttgtcaggagtgctgtggaggtcacggtaccttgcctgagagttgcacgggattttcagagctgttactaaaaatccrattgtttttaagacctatatattagtaagtgtgaggcaattggtatatgatgccaccccctcccagcagggttcatgaagaactctccagtagtattcac

SEQ ID NO: 14256 - DNA, 201 bp, Homo sapiens
aggggagatgttctatgaacgtatgcagcctagagctcattttagtacaatccgtgtcttcattacatgtgagtcagtaaacctgtatgaaaataatagcrgtttatggccaattgttatttagaaaatatgcaacctcacataaaaagttaaactgaatattgtccggattgcataaaattaaaggatataaaatggtca

SEQ ID NO: 14257 - DNA, 201 bp, Homo sapiens
tgtgagtcagtaaacctgtatgaaaataatagcagtttatggccaattgttatttagaaaatatgcaacctcacataaaaagttaaactgaatattgtccrgattgcataaaattaaaggatataaaatggtcaaatgcagagaaagcttttagaatgagcgatttatttcctaatgatttctgtaaggtggcctgaatgt

SEQ ID NO: 14258 - DNA, 201 bp, Homo sapiens
gaagcagatgtcttcatcctgtagcttatgaatcagaaatcttgactcatccatcttaattaacccagaacatgttctggttgtgttttcattagcttccyttgttagagttaccgtaacaagaccatcttagaatggatactaataataatatttgaaatttatagtcccatgagggaaaataacagtatgtcaactctc

SEQ ID NO: 14259 - DNA, 201 bp, Homo sapiens
gaaaaagaaactttatagtcaaaataggcaatcatttatggaaaatataactttctcatatttgagagaaaatatacttaccatggcagacttgcaaaatraatggtctagtggccttaatgagcaatgctgtctttacaagggtcaggccatcattctttttggaaatggaaattattctttaatgtatatagaacccaa

SEQ ID NO: 14260 - DNA, 201 bp, Homo sapiens
ataatttcaacctaacatagtttatgttatgtgttattaatatatctagaacctcctaggtaatatagtatatgttgaaaataaaaaaaggactaaggaayggtatctgtagttgagagatcaaagtcaaaatgaggatgacaggcccatgtatatttataataccaaatgcagggatggaacagaagacaaagggtggct

SEQ ID NO: 14261 - DNA, 201 bp, Homo sapiens
tattttgtaccagtaatttaagtctattgttcttttctgaactaaatagctatctccttcagacattgttatcaccttttatatttcttctgtatcctaartagcaaattgttgtcagtgagtgaaacagcatgcccagtgaggaaatatttgttttgaatcaactcatgtcttcagattctaaatgaaatcaaaattgca

SEQ ID NO: 14262 - DNA, 201 bp, Homo sapiens
ttttcacttccgggtttgtcttattccccagttgacctggacagaatttcttccctctgccttgatatttaggggtgcttgaggaaaaatagatggagaarcaatgcactattgtgtcattgcttctccatctcctccctggagaatccattttatcaggagataaataaccaagaaaactatcaaagtgaggaagaagtg

SEQ ID NO: 14263 - DNA, 201 bp, Homo sapiens
aaaagatgtgagaataagggttcccaggtcagaccaactttgttcaagacaggaaacttaaagaaatgaacagaagagaatccatgtaccccctaaatgcstggaagatacttcggggagatactgctacactattgtagagggcacaacataagcagatagctccatcatgcattattttttattttttactatttcatt

SEQ ID NO: 14264 - DNA, 201 bp, Homo sapiens
aacttgtaagtacatagtacactttaccttcacaaccataatactgtagatctagagaaattagttattattttaaaccaactttgactaaaaatttgctycttctcatcgaaagattcctttccccagtttccactgaccagcctcgttgaaatctggtcacctccaggctttgcttttgaacaaattactcttttcttt

SEQ ID NO: 14265 - DNA, 201 bp, Homo sapiens
taatctcatttatcatcaagatactaatagtgagaaaaataaacctattttaggataaagaaggtcaagcttagaaaaggcacagagctattgtgtggagsgcctgggataactgtgtgaaccaagtatttggcagtaaacaaacctggctccagattttctttaagggcaagtgagggaaacttggaagaaaataaataa

SEQ ID NO: 14266 - DNA, 201 bp, Homo sapiens
cctctcacatactaacttgtggagaaggtagatgatcaaggctgaggcatcttttcaggtacacactggcttcagtgtgccaaaatgcagtaactttagamatagtaccttcagaagtggacccatcagactgagatgttatacactgtcctgttggtactttaaaactgattattagaatgaataagaataaatatgaat

SEQ ID NO: 14267 - DNA, 201 bp, Homo sapiens
atctagagtttataatttattccatatatgtagtttccaccttctacctttaggattattctactcaaacatatgagaggtaggaaagaggagaattagaytcaacctatctttgcaataggtctttaggagcagtgcagtcttaatatggggacctctgactaattttctgtcaaagaacaaactgatttagttcataat

SEQ ID NO: 14268 - DNA, 201 bp, Homo sapiens
aatgacatgacttcaacaagaccaaatagaacaatccaccctcttgtgaacaggtgtcactggttgactgttacatcaacgaggtcatgatcaaatataaytcactggactccgaggattcagaaattctcagatcactcctattaagaactgtttgctcataccatccactggaactagagtataattatacttttgttg

SEQ ID NO: 14269 - DNA, 201 bp, Homo sapiens
aagaacttttactaattctcccaacctgttataattaaagcaataaatctctggatggcatctttgaaagtgagcgcttcatcaaataaataatttctatmcccaattcctacccatcactcactcactgtatattcttgagcaagggaatcctcaattcttcatctataaaacaaatgttctgggaggaataacaaacgt

SEQ ID NO: 14270 - DNA, 201 bp, Homo sapiens
attcaatcttcttggcatttaacatttcaaaactgaaaagaatacttcatttgaaaaaaaaaaaaaagaaaagttcacctatgctccagtacaactatttygtttggtttcaatatcaatggaaagtcactaatagttattttatttctccttgcagtatcagaaagagtctagttatttacaaaatattggcatattcaa

SEQ ID NO: 14271 - DNA, 201 bp, Homo sapiens
tcaataatactggaagaaacctctacaaattgtcaaaaatgtgaataattctatccagtctctaggttctagtcctgtttgtccatcttttaaaaaatctktgcccatttctgataaacataaaaatcttctctttataaatgatttaaaatttcaaaatatctcacccacatccattctgagtaaaacattgcatttact

SEQ ID NO: 14272 - DNA, 201 bp, Homo sapiens
tagcgcacacacatgcacgcacacacactcacacacactcacactttttagtatactgaaggatattttgtaaagtgctcttttcttcctgattctattgktctttctgttcctcaacagttgtatgtgtctatcacctaactatttccttattctttgctcacctctctcctttcttaggaccttcctttttgatttttt

SEQ ID NO: 14273 - DNA, 201 bp, Homo sapiens
gctgtaagtgaaatcttagaatcaacaagagaaagtgttgttttcagagtaagctggagtaagctgggatcacaagaggaagcctgggtcattcatctctycatgccgtgatgtcactacttggttggccattaaccactagactgcagaccccgattcaaatataatcacaaaaatttactccaaaatcaagaataaatt

SEQ ID NO: 14274 - DNA, 201 bp, Homo sapiens
accaggaaggcggagcttgcagtgagccaagatcgcgccactggactccagcccgggcgacacagcgagactccgtctcaaaaaaaaaaaaaaaaaaaaaagtatgtgatttcattcaacaaatgcttactaattggcttctatgtgcagggcactattctaggcactaggaatacaataatgaacaaaataaagtccctg

SEQ ID NO: 14275 - DNA, 201 bp, Homo sapiens
ttcttccttccttctttcctccctctctccaaccctccccccttccttcctttcctccctctctctttctcattcaagccatccttctacctcaccctccytagtagccgcagctacaggcacacgtcaccatgcttggctaatttttttaaggttttcgtagacataaagtctcattatattgcccaagcttgtctcaaa

SEQ ID NO: 14276 - DNA, 201 bp, Homo sapiens
aagtttcttggctccctctaggaagatttccctagacgagcttagttagtcctacttgttctcccctaacccccagtacctcccatttcaaatcactcactttttttttttttttgagacagagtcttgctctgtcacccaggctggagtgcagtgatgtgatctcagctcactgcaacctccacctcccgggttcaagtg

SEQ ID NO: 14277 - DNA, 201 bp, Homo sapiens
gaattgatattcagaaccagttaatctctatgtgtggctggaattaaggcatataaaaaccacatatgtggtagtcatctgctgctatgagggctgaggaytagagaaagctgggcttcagatcaagaagaaaggaaaagaaagaagtgcagggaatatactgatgcctaagttacttactgcttctgagccctccagtag

SEQ ID NO: 14278 - DNA, 201 bp, Homo sapiens
agagtcacaaaatcctccctccctctctcccttctatttttttttggcggggggtggggagagcgagggaagaaatgaaaactagggaaaaaattattttwaaaaaaggggcacttaattaagactctaatttttaaaaaagtaccaacagttttcatctattcccctatgctactgatagcaacaaatatgaataccggc

SEQ ID NO: 14279 - DNA, 201 bp, Homo sapiens
agtcatcttttttcggagagtcacaaaatcctccctccctctctcccttctatttttttttggcggggggtggggagagcgagggaagaaatgaaaactasggaaaaaattattttaaaaaaaggggcacttaattaagactctaatttttaaaaaagtaccaacagttttcatctattcccctatgctactgatagcaac

SEQ ID NO: 14280 - DNA, 201 bp, Homo sapiens
aaattcaacataactaatctataattataggtgtatagataaatatcacttatgtttcttttacttagctgagcctaagaaacagtaaaaaaacttttaayatagcttacaaataataaagcaaccaattaaatgggtgataaagctaaattgtcacaaattaaattccctatgctgatatgcaatcttataatatcctac

SEQ ID NO: 14281 - DNA, 201 bp, Homo sapiens
tgggcgacagagtaaggctgtctcgaaaacaacaacaaaaaaaatgtttattccaggccatcttccttttctcacacactctagggattaaacatgtttawttgtgagacagctgacaaatggttaggagactaatctctgataacaaataaagaaattggcccctaagtcattctgttgccagggaattagccctttaac

SEQ ID NO: 14282 - DNA, 201 bp, Homo sapiens
accaacatggagaaaccttgtctctactaaaaatacaaaattagctgggcatggtgacgcatgcctgtaatcccagttacgcctataatcccagttactcrggaggctgaggcagaattgcttgaacccgggaggcagaggttgcagtgagtggagatggcgccattgcactccagcctgggcaacaagagcaaaactcca

SEQ ID NO: 14283 - DNA, 201 bp, Homo sapiens
gatctatgtaaagatagtatttaaaaaccaaacaaaactaagaaatgggaaaaagaaatggcaggtgaagaactcttttcagagaataaaagttgtcatayagcaatggatgctgtgtcagaacatactgccaataaactttaagaaaaaaggaactcaatgaagttactgttatataaaacaggagctcacagcagggat

SEQ ID NO: 14284 - DNA, 201 bp, Homo sapiens
gatgtaccaaattgaaataagtctgggtgtggtagctcatgcttgtaatcccagctctttgggaggcagaagcaggcagatcatttgaggtcaggagttcragaccagccttgccaacatggtgaaaccctgtctctactaaaaacacaaaaatcagctgggtgtggtggtgcatgcctgtaatcccagctagttgggaga

SEQ ID NO: 14285 - DNA, 201 bp, Homo sapiens
cttgggaacaaaattcctctagttgagaactactacactggtttgttttgtatatgtgtgtgtgtgtgtgtgtgtgtatatatatatatatatatatatawtttttttttttttttaaggatcatgtctctaacagtcatagaccttttaaattagtctgaacatgatttatttcctattcctaatatgaagaggtgagta

SEQ ID NO: 14286 - DNA, 201 bp, Homo sapiens
gggattacaggcatgcaccaccatttccagctaattttttgtattttaatagagatggggtttcaccatgttggccaagatggtctcaatctcctgacctygtgatctgcccacctcagcctccaaaagtgctgggattacaggcgtgagccactgcacccggcctcctcattgtttttaaaagcccactgttctccaaac

SEQ ID NO: 14287 - DNA, 201 bp, Homo sapiens
tgattatacaagctaattttatgtataatcgatttaattaaggtatatttgaatttaacaggattagaagagactgaattaaaacgattgcataggctgtrtgcagtggctcatgcctgtaatcccagcactttgggaggctgaggcgggtggattacttgaggtcaggagtttgagaccagcctggccaacagggtgaaa

SEQ ID NO: 14288 - DNA, 201 bp, Homo sapiens
ttttttttttcatcattttttattgtaagaaaatacacagtttgaaagtgtgaataatgcaatatttatgaccaagaaatgggacttaggaaggggaaggragataaagaaaaagatcaagatgatctgattgagagacagtgttgaactccaaatactgaactggaaaaggagggaggtggggaggaacaggaggaggaa

SEQ ID NO: 14289 - DNA, 201 bp, Homo sapiens
attacaaaaattcattttggtgtaattaatgttgaaataataacggttggtatttattaatcgatactatgcgccaggcagcactaaaaccttatatataktatctcctttaatccctacaatagcttcataatataatgactttactgtcttaattttatagaaccaactaagactttgatgggctaaactacttccaca

SEQ ID NO: 14290 - DNA, 201 bp, Homo sapiens
agtgcagtggcacaatcttggctcactgcaagctctgcctcccgagttcacgccattctcctgcctcagcctcccgagtagctaagtagctaagtacaggygtccaccaccatgtccggctaagtttttctatttttcagtagagacggggtttctccgtgttagccaggatagtctcgaactcttgacctcgtgatccgc

SEQ ID NO: 14291 - DNA, 201 bp, Homo sapiens
tttcttacatttataggataatcactgattagaacttaatgcttccactcacttacacatcctaatgtataggcagagacttgaaatttgaaaaacatttycatgttgattattctatagatgtgaactttttagtgcaaatgttaattttgctatagatgtgaatttttatactggctaaaagtcaaaacatgctagata

SEQ ID NO: 14292 - DNA, 201 bp, Homo sapiens
ttttgttaaaaacaaaaatctctaacactgttctggcttttaaactttaacactaaactgtgcttatatggcaatcataaataaaagctgatgtaaattcrgtattacaataaaggttaaagggactatatctgaaaagtagatatttgaggcatcaatatatatagtgcagcttaaggagcctgagaaagatttaggaaa

SEQ ID NO: 14293 - DNA, 201 bp, Homo sapiens
accaagtgacacaccaaagtattaacaaatgttaaatactgataacaaaagttaaatggaacagaaatgaaattagtaattttacagatcaaatagataawagaaaaaaaagaaaaagaaaaaaatgtaatagtaaaagataatagaggtccttcgacttacccaagcagtgtgttctttcaagtaacagcctttgtactc

SEQ ID NO: 14294 - DNA, 201 bp, Homo sapiens
aaacctgcaatgattccgtattgaccacctaccaataaacctcaactacacacataccttttctttcttgcctgtgaccctttctctctgtctttaattgkaactgcaactctaaggcatttgaggtacatgttatatagaaggtgatattttaaaaataactctgtacagtaaaaagaagaccctgaaagatcaaaacaa

SEQ ID NO: 14295 - DNA, 201 bp, Homo sapiens
ccatgcctggcttatttgcataattattttcttccttccttctttcctccctctctccaaccctccccccttccttcctttcctccctctctctttctcaytcaagccatccttctacctcaccctccctagtagccgcagctacaggcacacgtcaccatgcttggctaatttttttaaggttttcgtagacataaagtc

SEQ ID NO: 14296 - DNA, 201 bp, Homo sapiens
ccaaatagttataaaaatgtcatacttttcagcaaggaacactgtatctgaatagataatgtatgctctgtctcaacacatttaagtgtacatatagtttwaaaaaaaaaaagacaactggagaaataatgacatcatagagggccccttatctctgctgagaagtgatatcagctgagatgatcaatacaagaccatcat

SEQ ID NO: 14297 - DNA, 201 bp, Homo sapiens
ttatgcctcaagagttcacgaaacactgtttctgagccctcaagaagtgacattaggctgggcgtggtggctcacatctgtaatcccagcactttggaagrccgaggcaggctgatcacttgaggtcaggagtttgagactagcctggccaacatggtgaaaccccgtctctactaaaaacacaaaaaattagctgggcat

SEQ ID NO: 14298 - DNA, 201 bp, Homo sapiens
tttgtaccatttgactttcatctttccattccccatccctttcaaccacctttcattttgtgttttattctttgtttactttccacatgtaagtgacatcrtatgctatttttttgtgtgtctggtttatctcacttagcataatgtcttctgggttcacatgtattgctgcaaatggcaggcccactttcttaagactat

SEQ ID NO: 14299 - DNA, 201 bp, Homo sapiens
gcactccagcctgggcaacacagtgagactctgtctccaaaaattaaaaaaagaaaagaaaagatatatctgcttgattataacaatcaagggacaaaagmttccttctcccatattcatatattttggtatttattaagcacgttcttattgtgttgggtactcatttaactttcatttaactattatttaactttctca

SEQ ID NO: 14300 - DNA, 201 bp, Homo sapiens
agaggcaaaggacccacccctctattcagcaaaaataataggaaaggccactgaagcaagtgaaaattaaactagaacatcctattccctcaaggacattkcttttttttttttttttttttttatcccgcaaaggtggtgaaagctgttctttttttaaagaggggatgggaaaagaactaacattgactaacaggaagg

SEQ ID NO: 14301 - DNA, 201 bp, Homo sapiens
tctgcttcacatgtaaaaccactgatggtactcggttgctcagagcttgttatcatttccccactcatttcaacatgaacgggtctggataaaggtccaartctcacaagagtcgatggtaagtagtcatagttctctaaagcaccgtatttcttcttttgtcagatatcatggcatgaagacaatgactatttggtaatc

SEQ ID NO: 14302 - DNA, 201 bp, Homo sapiens
gtcattttagtcattttcatttgagctggggtccataaaacacaacagaattcataatatattttttaaaattaaatattttatgatattccagtgtcctsatttatacactactgttggcattaggctttaaaataatatagtgggtagaattgtagtacttggtaatatacattaaaaaatccatacccatagttagat

SEQ ID NO: 14303 - DNA, 201 bp, Homo sapiens
tttcactttcccatgatcttgctcttacttttatgtcattttagtcattttcatttgagctggggtccataaaacacaacagaattcataatatatttttwaaaattaaatattttatgatattccagtgtcctgatttatacactactgttggcattaggctttaaaataatatagtgggtagaattgtagtacttggta

SEQ ID NO: 14304 - DNA, 201 bp, Homo sapiens
tcatgtgaaagtgcctagcagggtgtctgactcctaggaaatgctcaacacatgctggtttccttccttctgatgccaggctctgcgaagcatgtcccttkgccctccacttagtatttctggtgatggagacacagagcacaagtggatccagaagaaggggcacatttaaggaaaaaaaaaaaaactagctgtatccag

SEQ ID NO: 14305 - DNA, 201 bp, Homo sapiens
ctgtaagtactggtaaaaggagaactgaagaaatttgagctttcagatcaaagtgcagttctttgggaagaactcctaagtccactagtggtcttcaaccraatattccagaatcaatcattcatttaccaaatattcatgtgtacagggcacagggatacagttgtgagcaaacaaaaacatggtctgtgctcttatgat

SEQ ID NO: 14306 - DNA, 201 bp, Homo sapiens
agaagcacgatgcagttcttaatggaaagcatctcctaacaggcacccacgtgcacgcgatacacccataggcacacatatgacatgcacacacacatagrcacacacatgaagtgcgcgcgcgcgcacacacacacacacacacacacacacacaggaactacgggaggaccgaggaaggctggctgagtcctgtgatca

SEQ ID NO: 14307 - DNA, 201 bp, Homo sapiens
acccacatcattcctctggctgggaacgttgagggtttcctagcagagcagaagaaagacttaggatgtggggtcagacatgcgtgccttggtgtttcggyctgtagaagggggacaatgcctacctcacaagggtaccagtagcataaagcagataagtgaaaagtgcccagtttaatctctaactaaggaaggctgcat

SEQ ID NO: 14308 - DNA, 201 bp, Homo sapiens
ttttgaggatcctaacaatgataacctttagactactcctgggtcaactgacattaaattatatgaagattcttctagtcactctttaagactttatctaygtaggctcaaaagcaaaaatatcaattattttgatttcttatggagtattattttcttcctcccttaataaaaagaggtttaagataagagacagatggg

SEQ ID NO: 14309 - DNA, 201 bp, Homo sapiens
aaaatatcaattattttgatttcttatggagtattattttcttcctcccttaataaaaagaggtttaagataagagacagatgggaaagtagaggccccaytggatctcttaaatttaacactgaatatcttttatttttaaagacagtctcactctgttgcccaggatggagtacagtgacaccatctcagctcactgca

SEQ ID NO: 14310 - DNA, 201 bp, Homo sapiens
agtgtctggtttaaataggtttatctctctccttagcttgtcctggaattacgcctaaagctcaatcctggcagcttttaggataagaaatctaattggaragagctcttagttttgcgactccaaaacctcttttgaaaatttagtttgaccttccaactatctccaacagatcaaagttaaacagtccagattccaaac

SEQ ID NO: 14311 - DNA, 201 bp, Homo sapiens
tggccaggatggtctccatctcctgaccttgtgatccgcctgcctcggcctcccaaagtgctaggattacaggtgtgagccaccgcgcctggccatgttartggaattttcataaccacatcaagctgcacactctctgaagccatagaagaactgctctgtatcaggtaatgtcaaataaaatccctaaacagtgcttct

SEQ ID NO: 14312 - DNA, 201 bp, Homo sapiens
gtatctgttttcctacttaaactaaattcattttatggactatagtagtcacataaattgttaataaccgaatggccaacatgttttatttttatactttmataagtagctaactctatgtattaaattgatttaaaaagttacaaaacaaaataaatgtgaccaaaccctctgacttttctgtctctaaatttggtatta

SEQ ID NO: 14313 - DNA, 201 bp, Homo sapiens
gtttcccagtataccagtacttctacctggcaagggtgctgcccaaaaatggtcttgggagaatgtagacggtgtagaaaagtctgtaatttggccgggcrcggtggctcacacctgtaatggcagcattttgggaggccgaggcaggtggattacctgaggtcaggagtttgagaccagcctgactaacatggtaaaacc

SEQ ID NO: 14314 - DNA, 201 bp, Homo sapiens
tcttgatcaccacaggtgatctgcctgccttggcctctcagagtgctaggattacaggtgtgagccaccaacagccattctgattggtgtgatatggtatytcattgtggttttgatttgtatttctctaatgattagtgatggtgagcattttttcgtatgcttgttggttgtgtgcatgtcttcttttgaaaagtgtct

SEQ ID NO: 14315 - DNA, 201 bp, Homo sapiens
ttggagtgcagtggcatgatctcggctcactgcaacctctgcctcctgggttcaagcaattcttctgcctcagcctcccgagtagctgggagtacaggcgygcaccaccatgcctggctaatttttgaatttttagtagagacaaggtgtcaccatactggccaggctggtctcaaactcctgatttcgtgatccacccac

SEQ ID NO: 14316 - DNA, 201 bp, Homo sapiens
aaatcaaactcaacaattgctttgacagtacagatgttattattttgttgatacaataacttccaaaacaaatatggcccattctactgtgtttcttattwttcagtatggaatgctcattcaccattagaccacgtttctctacctgtactcctaggaatacttcatttgtataacctggcttgatatcatctggccttc

SEQ ID NO: 14317 - DNA, 201 bp, Homo sapiens
gtttgtgctttacatggttttatattttaaagtagtaaaagttatgatatttatcattatgttttaaaaaacattgattagaaaaggtcttcattatactwgtaaaagtattttagagtaataataataacactaggccgggcctggtggctcacgcctgtaatcccagcactttggaaggctgaggcgggtggatcacaa

SEQ ID NO: 14318 - DNA, 201 bp, Homo sapiens
aaaattgtgtactatcaataaataaaacatgcagtataaaatatctcattgtactctgttttgggacatttgaaaccccagttagaaattaaaaagtcatytgggctctacagctcacacctgaaatcccagcaattttcccggctgaggcaagcagattgcttgagctcaggagttcgagaccagccagggcaacatgga

SEQ ID NO: 14319 - DNA, 201 bp, Homo sapiens
ggctcaagcgatctgcccgccccaacctcccaaagtgctgggattataggcatgagcgaccatgcctggcttatttgcataattattttcttccttccttytttcctccctctctccaaccctccccccttccttcctttcctccctctctctttctcattcaagccatccttctacctcaccctccctagtagccgcagc

SEQ ID NO: 14320 - DNA, 201 bp, Homo sapiens
acaagaagtaaaaacttgtcacctagccaaggtgttcttaaattataaaggcaaacatttttaagctttacaaattgaggcaatacaactcttctgagttyttcttaaaaacgaacaaacagaactgctatacaataaaagccagccattctagagacggaagaaacagaaagggttgaaaaacaaacatgcaaaagaagg

SEQ ID NO: 14321 - DNA, 201 bp, Homo sapiens
gtcttgaacagtaaagggtatcttgcaaaagtaatacttaaggtaaaacttgtaggatgaacggacaggcatggggatgtaatgtgcagagttttctaggkggggtaatagcacatataaggctctgaggcaggaaagagcttagcatacagtggaaatgcacaaagctcaacttcaagctcttaactttttttttttatt

SEQ ID NO: 14322 - DNA, 201 bp, Homo sapiens
tggaacaaaatcctgaatggggcacatcactaagcgcttggctagttaagaagaccagtctggtcaaggcagtgtgtgtgtgtgtgtgtgtgtgtgtgtgwgagagagagagagagagagacagacagacagacacacagacacacacaaacaggctgataggagcctaaaaacaggtttacaggccaggcgcggtggctc

SEQ ID NO: 14323 - DNA, 201 bp, Homo sapiens
cactgtcctgtaaaaatggggcactgaggttagaaaaaaagactgaagataaagagtcaatccattgacaaaagtgtcaagcacactcaattttgcagtgycaagttgcttttctgccaatctgcaaagacaaactttttatgtactggctccactactcctccaccattttcatacatctcatatttgcttcctatgcct

SEQ ID NO: 14324 - DNA, 201 bp, Homo sapiens
acatgccaggtttagtaccacactgcagttgcaaaaaggtaactgaaacatctggaagctaagtgacttgaactggattcgctatgattgacaaagctcayctctgtggagggtaccaagaaacctactttcttatgcacgacggaggagctggaattgattgtgctttcgtcatcgtgcatcatgacaagttcggaactg

SEQ ID NO: 14325 - DNA, 201 bp, Homo sapiens
tataaaatgatgtcaacttttcaccatctctttctgagtgtttatagaatggaatttctaataggctagatatcatttaatcttacagaatatataccaartgacacaccaaagtattaacaaatgttaaatactgataacaaaagttaaatggaacagaaatgaaattagtaattttacagatcaaatagataaaagaaa

SEQ ID NO: 14326 - DNA, 201 bp, Homo sapiens
gtagagcaggctctgctttttgatatcagttagctttatttctcattgacaattttttttggggggtaaatcttcagtacctgtagaaaaataaggtttgycattaaattatttctaacacattttacttggtggcaatacaaatacatacaaatattaaaagcctcttggtctcacaactcaataacaaaaggacaaaaa

SEQ ID NO: 14327 - DNA, 201 bp, Homo sapiens
ggctgggaacgttgagggtttcctagcagagcagaagaaagacttaggatgtggggtcagacatgcgtgccttggtgtttcggcctgtagaagggggacartgcctacctcacaagggtaccagtagcataaagcagataagtgaaaagtgcccagtttaatctctaactaaggaaggctgcatatatggcagttccctca

SEQ ID NO: 14328 - DNA, 201 bp, Homo sapiens
tgatgcttgtgaggcatcagtgtcacttgtaacaacatacagtgaaggaaagaaatgctttctaggtcagatatttaaaatgtaatgtaataaaaatgtcwaatacatacggtgattttcttagagatttaaaatgatagcagagtcttaccattcattagactgtaacgttggggagtcattctgggcaatgtgatataa

SEQ ID NO: 14329 - DNA, 201 bp, Homo sapiens
caggaagactgctaacatcactcagacactttcagtggcattgaagagaggaagtgtgcatggcttatccacaccaccctaaagctcaagccatcattcarttagactgcccaaactacactttagtatggcggtagataacattctgatcaaagtaaaacagaaaggagagtttaattccttctttcttaccttctaata

SEQ ID NO: 14330 - DNA, 201 bp, Homo sapiens
atcagctgcttctggtgctggcgccgcatccgcttataacctgacatctgttcccgcaactcgttctcctgctcatgctcatggatctgtcgtgtaacctraattgggttaggaaacagaactcaggtaaccaggttcatgggagacaagctttcatgcaaagtagaacggccctgtggcataattttatccatcaccttc

SEQ ID NO: 14331 - DNA, 201 bp, Homo sapiens
agtagatgatcagtttcattcctcattttattattttatacagctataccagactgggttacatactttctcacatgacaatttgggaacacattcacctrgatcttctatagaagataataagtgatcagacaacaggaaacccaagtatataaacacaaatgacccttcaaaacaaaaataaaacaaagaaagcctgat

SEQ ID NO: 14332 - DNA, 201 bp, Homo sapiens
ccaaaccagcttgcccaacatctccttttcaggagcttaaatatagactctgtgctttgcaactggagattctgatacaataggtgtggggtgcagaaatwtgtgattctgaaaagttgctcaggtgactctgacacttcaggtagagaaaccactgatctggtccaacactgtccagcagcacaaatcttacctttaagt

SEQ ID NO: 14333 - DNA, 201 bp, Homo sapiens
accagcttgcccaacatctccttttcaggagcttaaatatagactctgtgctttgcaactggagattctgatacaataggtgtggggtgcagaaatttgtrattctgaaaagttgctcaggtgactctgacacttcaggtagagaaaccactgatctggtccaacactgtccagcagcacaaatcttacctttaagttttt

SEQ ID NO: 14334 - DNA, 201 bp, Homo sapiens
gtcgtgtaacctgaattgggttaggaaacagaactcaggtaaccaggttcatgggagacaagctttcatgcaaagtagaacggccctgtggcataattttwtccatcaccttcaccatcaatttacctactgtttagtgaatgctcacccgtagggggcactgtgctagatagatactctttatgtattttatccctagtc

SEQ ID NO: 14335 - DNA, 201 bp, Homo sapiens
cacgtagcatctacagtgtggataggctggataaagggataattcatttccctggctagaaggagtaggtcagcaggagatttcatcacactactcaaaarggtaagcaatttaaaactcatgaatggggccaggcacagtggctcatgcctgtaatcccagcactttgggaggccaaggccagaggatcacttgaggcca

SEQ ID NO: 14336 - DNA, 201 bp, Homo sapiens
cattttagttgctctttttttttttcgagacggggtcttactctgtcgcccaggctggaatgcagtggtgcgatctcggctcactgcaacctccacctccygggttcaagcgattctgcctcagcctcccgagtagctgggactacaggcgcgccaccatgcccagctaatttttgtatttttagtagagacggggtttca

SEQ ID NO: 14337 - DNA, 201 bp, Homo sapiens
taagataaggaatcaacccaagtgtccgtcagtgggtgaatggaaaatgtggcatgtgtacacaatggaatactattcagccttcaaaaagaaggaaatcytgtcatttgcaacaacatggatgaacatagagaacattacactcaatgaaataaggcaggcacagaaagacagaagttgtatgatctcatttatgtgtgg

SEQ ID NO: 14338 - DNA, 201 bp, Homo sapiens
agctaatttttgtattttcagtagagatggggtttcgccatgttggccaggctggtctttaactcctgacctcaggtgatccacctgccttggcctcccaragtgttgggattacaggcgtgagccaccatgcctggtcccatattttaaatactaataaataaagttcaggtaacttctctctttacactcctggtcttg

SEQ ID NO: 14339 - DNA, 201 bp, Homo sapiens
agacggagtcttgctctattgtccaggctggagtgcaatggcacaatcttggctcactaccacctctgcctcctgggttcaagcgattctcctgcctcagmctctcaagtaactgggactataggcatgtgccaccacgcccggctaatttttgtatttttagtagagacggggtttcaccatgttggccaggctgatctt

SEQ ID NO: 14340 - DNA, 201 bp, Homo sapiens
tggtgcgatcttggctcactgcaacctccatctccaagattcaagcgattctcctgactcagtctcctgagtagctgggattacaggcatgcaccaccacrcccagctaatttttttgtatttttcgtagagacagggtttcaccatattaggcaggctggtctcgaactcctgacctcaggtgatccaccctcctgggcc

SEQ ID NO: 14341 - DNA, 201 bp, Homo sapiens
cagtcagtaaacgtctctctccaaatctatctcctaggcaaacactgatccactctctttcactatagattagtttacattttccagaatttcttttcttytcttttttttttctttttttgatagagtctcgctctgtggcccagactggagtgcagtactgcactctcggctcactccaacctctgcctcctgggttca

SEQ ID NO: 14342 - DNA, 201 bp, Homo sapiens
tgattaggctgtccaaagaaggcaatcagatatgcatttacctcagtgagcagaggggtgaccctgaatagaatgggaggcagattggccctaaggagttmccagcttgacttttccctttagcttagtgatttgggggctccaagatttattttcctttcacactctttataatccgaattttagatttagaatgaatct

SEQ ID NO: 14343 - DNA, 201 bp, Homo sapiens
tttttaaatattctcttgtgaacccagaaaatctgagacaggtttcagttaatttagaaagtttatttttccaaggttgaggacgtgcacccatgacacggcctcaggaggtcatgacaacatgtgcccaaggtggtcagagcagtttggttttgtacattctagggagaaatgagacatcaatcaacatatgcaagatga

SEQ ID NO: 14344 - DNA, 201 bp, Homo sapiens
tgaacaaactaaccttttaattgctgaattaatctatatatatctatatatatagattctcatgcctcagcctcctgagtagctgggattacaggtgcacrccaccatacctggctaatttttatattttttgtagagacggggtttctccatattgtccaggctggtcacgaactcctgacttcaagtggtctgcccgca

SEQ ID NO: 14345 - DNA, 201 bp, Homo sapiens
ccgaaactgctgaagttgtttattagatcaaagagcatttgggcagaggctatgcggttttctaggtatagaatcatgttgcctgcaaacagggatagttkgactttctttcttcctatttggataccttttatttctttcttttgcctgacttccctggtcaggacttccagtgctatgttgaataggagtggtgatagg

SEQ ID NO: 14346 - DNA, 201 bp, Homo sapiens
tctgcctctcaggttccagagattctcgtgcctcaatgtcccaagtagctgggactacaggcacgtgcgaccacaccctgttaatttttttttttttttttagtagagacagggtttcaccatgttggccagactggtcttgaactcctggcctcccaaagtgctgggattacaggcgtaagccaccacgcccagcaacac

SEQ ID NO: 14347 - DNA, 201 bp, Homo sapiens
ctctgcctctcaggttccagagattctcgtgcctcaatgtcccaagtagctgggactacaggcacgtgcgaccacaccctgttaatttttttttttttttttagtagagacagggtttcaccatgttggccagactggtcttgaactcctggcctcccaaagtgctgggattacaggcgtaagccaccacgcccagcaaca

SEQ ID NO: 14348 - DNA, 201 bp, Homo sapiens
cctctgcctctcaggttccagagattctcgtgcctcaatgtcccaagtagctgggactacaggcacgtgcgaccacaccctgttaatttttttttttttttttagtagagacagggtttcaccatgttggccagactggtcttgaactcctggcctcccaaagtgctgggattacaggcgtaagccaccacgcccagcaac

SEQ ID NO: 14349 - DNA, 201 bp, Homo sapiens
tagatcacttgacgtcagcagttcaagaccaggctggtcaacatggtaaaacccgtctctactgaaaatagaaaaaaattagctgggcgtggtggcgcatrcctataattccagctactcaggaggctgagacaggagaatagcttgaacccaggaggtggaggttgcagtgagccgagatcgtgccattgcactccagcc

SEQ ID NO: 14350 - DNA, 201 bp, Homo sapiens
acctctgcctcctgggttcaaccaattctcctgcctcagcctccccagtagctgggactacagacatgcgccaccacgcccggctaattttttttttttttgcattttgagtagagacgtggtttctccattttgatcaggctggtctcgaactcctgacctcaggtgatccacctgcctcagcctcccaaagtgctggga

SEQ ID NO: 14351 - DNA, 201 bp, Homo sapiens
ctagagtgcagtggtgcaatctcagctcactgcaacctctgcctcccaggttcaagcacttctcctgcctcagcctcccaagcaggtggaattacaggcaygcgccaccacatccagctaatttttgtatttttagtagagacagggtttcaccatgttggccaggctggtctcaaactcttgaccacaagtgatccaccc

SEQ ID NO: 14352 - DNA, 201 bp, Homo sapiens
aagtaacttaaatccagctatttgtcaatcaggtaaatgaaagcacaaaatgagagttcaaaaactggccgggcgcagtggcttacacctgtaatcccagyactttgggaggccaaggcaggcagatcacaaggtcaagagatcaagaccattctggccaacatggtaaaaccccatctctactaaaaaaatacaaaaatt

SEQ ID NO: 14353 - DNA, 201 bp, Homo sapiens
tcccagctactagggaggctgaggcaggagaatcgcttgaacccgggaggctgaggttgcggtgagccgagattgagccattgcactccagcctgggcaaygagagggaaactctgtctcaaaaaaaaaaaaaagaacagacatatgatttgaatacacatttctccaaaaagatatacaaatgaccattaacatatgaga

SEQ ID NO: 14354 - DNA, 201 bp, Homo sapiens
tttcaccgtgttagccaggatggtctcgatctcctgacctcgtgatctgcccgcctcagcctcccagagtgctgggattacaggcgtgagccactgtgccyggctgaagctcttaactttcttatactactttaataagtgagtcaattgattataaataccactgaattgaataaagcctaggattctggaactggcttt

SEQ ID NO: 14355 - DNA, 201 bp, Homo sapiens
gtgagccgagattgtgccactgcactccagcctgggcgacagagcaagactgtcttaaaacaaacaaacaaacaaacaaaaaaaaaaaacagggcccggtrcagtggctcacgcctgtaatcccaccactttgggaggccgaggtggtcagatcacgaggtcagttcaagaccagcctggccaacatggtgaaacccggtc

SEQ ID NO: 14356 - DNA, 201 bp, Homo sapiens
tttgggccttaaatgatattctgactacacactaacaagggagtgttaactaagaaattagcacccttttttcttttcttttttttttttttgagacagartctcactctgtcccccaggctggagtgcagtggcacaatcttggctcactgcaagctctgcctcccgagttcacgccattctcctgcctcagcctcccga

SEQ ID NO: 14357 - DNA, 201 bp, Homo sapiens
tcccgggttcacgccattctcctgcctcagcctccccagtagctgggactacaggcgcccgccaccatgcctggctaattttttgtatttttagtagagayggggtttcaccatgttagccaggatggtctcgatctcctgacctcgtgatccacccgcctcggcctcccaagtgctgggactacaggcatgagccactgc

SEQ ID NO: 14358 - DNA, 201 bp, Homo sapiens
ctgcttttttttttttttgagacagagtctcactctgtcccccaggctggagtgcagtggcacaatctcagctcactgcaagctccacctcccgggttcaygccattctcctgcctcagcctccccagtagctgggactacaggcgcccgccaccatgcctggctaattttttgtatttttagtagagatggggtttcacc

SEQ ID NO: 14359 - DNA, 201 bp, Homo sapiens
gaacctcttcagatacaatggtttctttatgatttttaaaaacggttaattcaaacaataaacaataatgtagtatgtacaaataatttgaccacagattyttatggaatgtcaaaatgaaaaaaaaaaaaacccacaataacgtactacaggagttttttttaaaaaagcattaaggtaaaagtacctattatatattaa

SEQ ID NO: 14360 - DNA, 201 bp, Homo sapiens
gacctctggaaggagactgtatttaccaagtctccctatcaggaattcactgaccacctcgttaagacccacaccagagtctccgtgcagcggactcaggmtccagctgtggctacaacatagggtttttatacaagaaaaataaagtgaattaagcgtgaaaaaaaaattataaaagaatttataccagaatatatatca

SEQ ID NO: 14361 - DNA, 201 bp, Homo sapiens; identical to SEQ ID NO: 4629

SEQ ID NO: 14362 - DNA, 201 bp, Homo sapiens; identical to SEQ ID NO: 4628

SEQ ID NO: 14363 - DNA, 201 bp, Homo sapiens
aaaacttcaggaacttttattatatgctccacaagaaggaaaaaaaaattgttctaaaaaaaagtttaaagaattttgttaatttcttttttctttttttyttttttttttttgagacagagcctcgctctgtcacccaggctggagtgcagcggcgtgatctcggctcactgcaagctccgcctcccgggttcacgccat

SEQ ID NO: 14364 - DNA, 201 bp, Homo sapiens
gaaaaacttcaggaacttttattatatgctccacaagaaggaaaaaaaaattgttctaaaaaaaagtttaaagaattttgttaatttcttttttctttttyttttttttttttttgagacagagcctcgctctgtcacccaggctggagtgcagcggcgtgatctcggctcactgcaagctccgcctcccgggttcacgcc

SEQ ID NO: 14365 - DNA, 201 bp, Homo sapiens
ctagaacattagcctttttaaaaataattatgaatgttcacacatttgtatgaaaaacttcaggaacttttattatatgctccacaagaaggaaaaaaaaattgttctaaaaaaaagtttaaagaattttgttaatttcttttttcttttttttttttttttttttgagacagagcctcgctctgtcacccaggctggagt

SEQ ID NO: 14366 - DNA, 201 bp, Homo sapiens
gcctcccaagtagctgggactacaggcgtgcaccaccagaccaaactaatttttttgtatttttagtagagacgaggtttctccgtgttggccaggctggkctcgaactcctgacctcaggtgatccgcccaccttggcctcccaaagtgctgggatcacaggcgtgagacactgtgcccggcctaaacatgccatttctt

SEQ ID NO: 14367 - DNA, 201 bp, Homo sapiens
aaaccaggtagccatgcttattagcagtctatataatctaagaataaacaggtggccgggtgcagtggctcatgcctgtaattccagcactttgggaggcmgaggtgggcggatcacctgaggtcgggagttcgagaccagcctgaccaacatggagaaaccccgtctctactaaatacacaaaattagccgggtgtggta

SEQ ID NO: 14368 - DNA, 201 bp, Homo sapiens
gtgtgagccaccgtgcccggcctctttctgtactcttatcctcgatttcttttttttctttgtatttttagtagggacggggtttcaccatgttggccagsctggtcttgatctcctgacctcgtgatccacccacctaggcctcccaaagtcctgggattacaggcataagccactgcacctggcccttcttatcctaga

SEQ ID NO: 14369 - DNA, 201 bp, Homo sapiens
agaagccattgaagcagatccaaaatcagctagttttacctgacctggctctgttagaagaatatttcctgctttaatatccctataggaaaaaaaaaaaagggttagaaaattacttttcaattttgattatggaataggtcagagcatgcaattaataagacaaaaagtttatttaaacgaacaaacaaacaaacaaaa

SEQ ID NO: 14370 - DNA, 201 bp, Homo sapiens
ccaccgcgcctggagtctttttttgttgttgttgttgagagtcttactttgtagcccaggttggggtgcagtggcgccatcttggcttactgcagcctctrcctcctgggttcaagcgattctcatgcctcagcctcccgagtagctgggattacaggcataggccaccacacctggccatattcttttaaaataattaaa

SEQ ID NO: 14371 - DNA, 201 bp, Homo sapiens
gatagcattaggagatatacctaatgttaaatgacgagttaatggatgcagcacaccaacatggcacatgtgtacatatgtaacaaacctgcacattgtgyacatgtaccctaaaacttaaagtgtaataataattaaaaaattaaaataaataaataaatacataaataaataaataaaaataagaacatgaaaatgtag

SEQ ID NO: 14372 - DNA, 201 bp, Homo sapiens
ggaggagaattgcttgaacttaggaggtggaggttgcaatgagccgagattgtgccactgcactccagcctgggtaacagagtaagactctgtctcaaaawaaataaataaataaatcatgctgctataaagacacatgcacacgcatgtttattgtggcactattcacaatagcaaagacttggaaccaacccaaatgtc

SEQ ID NO: 14373 - DNA, 201 bp, Homo sapiens
tgtaggaactgtgtagatagggcaggggtggaagaagatctttcactgtatgtctttttatgttttctgatttacaaaccttgtgattctgctacctaatwgaaaaaaataatattcaaattttcctccaggaattcttttttttttttaattaatacttctttaatgtaaaaaaaaaatccagataaattgtgcatcttt

SEQ ID NO: 14374 - DNA, 201 bp, Homo sapiens
tgggttcaggtgattctcctacctcagcttcacttaatcatattccttacccatttctctactggttgtttggctttttcttttttttccttttttttttkggggggacagagtttcgatcttgttgcccaggctggagtgcagtggcgcaatctcggctcactgcaacctccgcctcccaggttcagatgattctcttgc

SEQ ID NO: 14375 - DNA, 201 bp, Homo sapiens
cttgttaagaaaaaacttggtaagaaaaaactagttaaaaaatgggtaggcactaacagtaaaattcaacacaagtggcacattcttttaaaagatcgtamctgaggtgttgctatgatggtctcagtgttataaggaaaattttggtttatttttataaaatattacttttatattttaatataatataaaattatgtta

SEQ ID NO: 14376 - DNA, 201 bp, Homo sapiens
gttgtaggaacatttaacatcatttactctctcagcaatttcaactttcaatgcattttaccatgttgcttcctagtgttaaagagatgttaaaatgggcyggcatgatggcttgcgcctataatcccaacactttgggaggccgaggtgggtggatcatttgagatcaggagtttgagactagcctggccaacaaggtaa

SEQ ID NO: 14377 - DNA, 201 bp, Homo sapiens
gtctactgggcttaattttactaaggaaaatgaaagagtacgcctatctttagataaacactacctgaaaaggtataagggttcttttctttctttctttytttttttttttttttttttttgagacgcagtctcgcactgtcgcctaggctggagtgcagcggcgtgatctcggctcactgcaagctctgcctcccaggt

SEQ ID NO: 14378 - DNA, 201 bp, Homo sapiens
tgatgttcccatttctgtctcctgagtagctgggattataggcatgtgccattaagtccagctacttttttggctttttttttttttttttttttttttttagagatggggttttgctatgttgcctaggctggtctcaaactcctgggctcaagcgatctgcccgccccaacctcccaaagtgctgggattataggcatg

SEQ ID NO: 14379 - DNA, 201 bp, Homo sapiens
gtgatgttcccatttctgtctcctgagtagctgggattataggcatgtgccattaagtccagctacttttttggctttttttttttttttttttttttttttagagatggggttttgctatgttgcctaggctggtctcaaactcctgggctcaagcgatctgcccgccccaacctcccaaagtgctgggattataggcat

SEQ ID NO: 14380 - DNA, 201 bp, Homo sapiens
actagggaaaaaattattttaaaaaaaggggcacttaattaagactctaatttttaaaaaagtaccaacagttttcatctattcccctatgctactgatakcaacaaatatgaataccggccggcaatgaaaatgtttattcaggttggcttaaacattacaccaaattagatatcaaggtagtctctaagattacaatag

SEQ ID NO: 14381 - DNA, 201 bp, Homo sapiens
tgatatgcaatcttataatatcctacaacttaaaaatatgaattcaaaaactatacattactgaaaagtcatcttttttcggagagtcacaaaatcctccctccctctctcccttctatttttttttggcggggggtggggagagcgagggaagaaatgaaaactagggaaaaaattattttaaaaaaaggggcacttaat

SEQ ID NO: 14382 - DNA, 201 bp, Homo sapiens
ggccaggcacagtggctggtgcctgtaatcccagcacttcgagaggccaaggcaggaggattgctttagcccaggagtttgagaccagcctggccaacacsgtgaaatccccctactaaaaatacaaaaattagccaggcatggtggcgggtgcctgtaatcgcagctactccagaggctgaggcaggagaattgcttgaa

SEQ ID NO: 14383 - DNA, 201 bp, Homo sapiens
atggaacaaaatcctgaatggggcacatcactaagcgcttggctagttaagaagaccagtctggtcaaggcagtgtgtgtgtgtgtgtgtgtgtgtgtgtkagagagagagagagagagagacagacagacagacacacagacacacacaaacaggctgataggagcctaaaaacaggtttacaggccaggcgcggtggct

SEQ ID NO: 14384 - DNA, 201 bp, Homo sapiens
ctaaaaacacaaaacactagctgggtgtagtggcatgcgcctgtaatcccagctacttgggaggctgaggcaggagaattgcttgaacctgggaggcggargtggcagtgagccaggattgcaccactgcactccagcctgggcaacagagaaagactccgtatcaaaaaaaaaaaaaaaaaaaaaaaaagaaaagaaaga

SEQ ID NO: 14385 - DNA, 201 bp, Homo sapiens
ctggagtgcagtggtgtgatctcggcttactgcaacctctgcctcctgtattcaagcaatttgtcctgcctcaacctcctgagtagctgggattacaggcrcccgccatcaagctcagctaattttgtatttttatagagatgtcgttttaccatgttggccaggctggtcttgaactcctgacctcagttgatccaccca

SEQ ID NO: 14386 - DNA, 201 bp, Homo sapiens
cgtggtggctcacgcctgtaatctcagcactttgggaggctgaggtgaaggattacctgaggtcaggagttcaagaccagcctggctaacatggtgaaacyctgtttctactaaaaatacaaaaaattagctgggcatggtggtgcacgcctgtaatctcggctacttgggaggctgaagcaggagagttgcttgaacccg

SEQ ID NO: 14387 - DNA, 201 bp, Homo sapiens
aatgacgagttaatgggtgcagcacaccaacatggcagatgtatacatatgtaacaaacctgcacgttgtgcacatgtaccctagaacttaaagcataatrataataaaaaaagatgatattatgactatctgccttacccttctgttttttttttttttttttcagtcggagtcttgttcttgttgcccaggctggaatg

SEQ ID NO: 14388 - DNA, 201 bp, Homo sapiens
ccgggttcaagtgattctcttgtctcagcctcccgagtagctgggattacaggcacctgccaccatgcccagctaattttttgtatttttagtagagatasggtttcaccatgttggccaggctggtctcaaactcttgacctcaagtgatccacccacctcagcctcccaaagtgctgggattacaggcatgagccacca

SEQ ID NO: 14389 - DNA, 201 bp, Homo sapiens
atttttagtagagacggggtttcaccatgttggccaggctggtctcgaattcctgacctcaggcgatccacccacctcggcctcccaaagtgctgggattrcaggcgtgagccactgtgcctggcctttttttttttgagacagggtctcgctctgtcacccaggctagagtgcagtgacacaatctcggctcactgcaac

SEQ ID NO: 14390 - DNA, 201 bp, Homo sapiens
atttttttttttttttgagaagagacttcctctgttgcccaggctggagtgtaatggcatgatcttggctcactgcaacctctgccttccaggttcaagcrattctcctgcctcagcctcctgagtagctgggattacaggcatgtgccaccatgcccggctaatttttgtatttttagaagagatggagtttcaccatgt

SEQ ID NO: 14391 - DNA, 201 bp, Homo sapiens
atctccagatattgccaaatgttcccttgggaacaaaattcctctagttgagaactactacactggtttgttttgtatatgtgtgtgtgtgtgtgtgtgtrtatatatatatatatatatatatattttttttttttttttaaggatcatgtctctaacagtcatagaccttttaaattagtctgaacatgatttatttcc

SEQ ID NO: 14392 - DNA, 201 bp, Homo sapiens
ggaggccaaagagggtggatcacgaggtcaggagatcgagaccatcccggctaacacggtgaaaccctgtctctactaaaaatacaaaaaattagccaggygtggtggcaggcgcctgtagtcccagctactcaggaggctgatgcaggagaatggcgtgaacgcaggaggcggagcttgcagtgaactgagatcgcgcca

SEQ ID NO: 14393 - DNA, 201 bp, Homo sapiens
gcaggagaatggcgtgaacgcaggaggcggagcttgcagtgaactgagatcgcgccactgcactccagcctgggcgacagcacgagactccatctcaaaawaaataaataaataaataaataaataaataaataaataaataaaaggaagtttggattaggatcccctcagggcctgggaaagaccagagtagaggcaagg

SEQ ID NO: 14394 - DNA, 201 bp, Homo sapiens
gagaatggcgtgaacgcaggaggcggagcttgcagtgaactgagatcgcgccactgcactccagcctgggcgacagcacgagactccatctcaaaataaataaataaataaataaataaataaataaataaataaataaaaggaagtttggattaggatcccctcagggcctgggaaagaccagagtagaggcaaggactg

SEQ ID NO: 14395 - DNA, 201 bp, Homo sapiens
atttctgcttaaatgtcacctcatcaggtaggcttttcttactccctgctagagtaagtcctccttttacccgaggcaagtttctttctttcttcttcttytttttttttttttttttttttgagtctcactctgttgcccaggctggagtgcaatggcgcgatctcggctcactacaacctctgcctcctgggttcaagc

SEQ ID NO: 14396 - DNA, 201 bp, Homo sapiens
gcttgtaccttttaaatctgaaactacataataagcagaagcaatgcatagtatagtctattcttttttttttttttttttttttttgagatggagtctcrctctctcacccaagctggagtgcagtggtgcgatcttggctcactgcaacctccacctcctgggttcaggtaattctcctgactcagcctcccgagtagc

SEQ ID NO: 14397 - DNA, 201 bp, Homo sapiens
aactactttttgtatttttagtagagatggggtttcactatgttggccaggctggtctcaaactcctgaccttaggtgatccacccacctcagcctcccaragtgctgggattacaggcatgagccacagctttcagacccaatctctctctctctcttttttttttttttgccttacttgaagcactaggaagtaaagga

SEQ ID NO: 14398 - DNA, 201 bp, Homo sapiens
ttaatagagatggggtttcaccatgttggccaagatggtctcaatctcctgacctcgtgatctgcccacctcagcctccaaaagtgctgggattacaggcrtgagccactgcacccggcctcctcattgtttttaaaagcccactgttctccaaacccctacaactggaatgccctcggactcttttaaaaggacaatttt

SEQ ID NO: 14399 - DNA, 201 bp, Homo sapiens
ggtagatttttacctcactccttgtaacaaatttttgcataactctccccacctcctttccacaaaacatcagcataaagaatgtcaaaagagaaataggaaaaaaaaatccaagatctactataaattaaaaaggaaatacaaatggcttttcaacttacgagagagatgttcaacatctcccataatgtgaaatagcaa

SEQ ID NO: 14400 - DNA, 201 bp, Homo sapiens
ggctggagtgcagtggcacgatctcggctcactgcaaacttcgccttccgggttcaagtgattctcctgcctcagcttcccgagtagctgggattatcgaygcatgccaccatgcccagctaatttttgtatttttaggagagatggggtttcactattttggccaggctggtcttgaactcctgaccttgtgatctgccc

SEQ ID NO: 14401 - DNA, 201 bp, Homo sapiens
tgaacttctggcctcaggtgatctgcctgctttggcctcctaaagtgctgggattataggtgtgagccattgcacccggctcttcttcttcttcttcttcttttttttttttttgagacagggttttactcccatcacccaggctgaagtgcaatggcaggatctcggctcactgcaacctctgcctcccaggctcaagtg

SEQ ID NO: 14402 - DNA, 201 bp, Homo sapiens
ttggccaggctggtctcgaactggtgacctcctgatcctcccaccttggcctcccaaagtgctgggattacgggcatgagccgccacgcccggcctacttwtttatttcttactccttcttgtaagtttcacaagggcaggcactatgtttttattgtgtactactgtattctctgcgcttagaatagtacttgacaccca

SEQ ID NO: 14403 - DNA, 201 bp, Homo sapiens
ccaggttcaagtgattctccctcctcagcctcccaagtagctgggattacaggcacccaccaccacacttggctaatttttgtatttttagtagagacagrgtttcaccatgttggccaggctggtctcgaactcctgacctcaggtgacccacctgccttggcctcccaaagtgctgggattacaggcgtgagccaccac

SEQ ID NO: 14404 - DNA, 201 bp, Homo sapiens
tgcctcagcctcccgagtagctgggactacagatgcctgccactgcgcccagccaatttttttgaatttttagtagagacggggtttcaccatgttagccrggatggtctccatctcccgacctcgtgatccgcccgcctcggcttcccaaagtgctgggattacaggagtgagccactgcgcccggcctctctcgtatct

SEQ ID NO: 14405 - DNA, 201 bp, Homo sapiens
ttcttaatggaaagcatctcctaacaggcacccacgtgcacgcgatacacccataggcacacatatgacatgcacacacacataggcacacacatgaagtgcgcgcgcgcgcacacacacacacacacacacacacacacaggaactacgggaggaccgaggaaggctggctgagtcctgtgatcaatgcatctaaatcat

SEQ ID NO: 14406 - DNA, 201 bp, Homo sapiens
tcttaatggaaagcatctcctaacaggcacccacgtgcacgcgatacacccataggcacacatatgacatgcacacacacataggcacacacatgaagtgcgcgcgcgcgcacacacacacacacacacacacacacacaggaactacgggaggaccgaggaaggctggctgagtcctgtgatcaatgcatctaaatcatt

SEQ ID NO: 14407 - DNA, 201 bp, Homo sapiens
aagcatctcctaacaggcacccacgtgcacgcgatacacccataggcacacatatgacatgcacacacacataggcacacacatgaagtgcgcgcgcgcgcacacacacacacacacacacacacacacaggaactacgggaggaccgaggaaggctggctgagtcctgtgatcaatgcatctaaatcattatatttaaaa

SEQ ID NO: 14408 - DNA, 201 bp, Homo sapiens
agcatctcctaacaggcacccacgtgcacgcgatacacccataggcacacatatgacatgcacacacacataggcacacacatgaagtgcgcgcgcgcgcacacacacacacacacacacacacacacaggaactacgggaggaccgaggaaggctggctgagtcctgtgatcaatgcatctaaatcattatatttaaaac

SEQ ID NO: 14409 - DNA, 201 bp, Homo sapiens
ctagagtgctgtggtgtgatctcagctcactgcaacctccgactccctggttgaagcgattctcctgcctcagcctcctgagtagctgggattacaggcaygtgccaccatgcctagctaatttttgtatttttagcagagatgaggtttcaccaggttggccaggctggtctcgaactcctgacttccggtgatccaccc

SEQ ID NO: 14410 - DNA, 201 bp, Homo sapiens
ctgggattacaggcacgtgccaccatgcctagctaatttttgtatttttagcagagatgaggtttcaccaggttggccaggctggtctcgaactcctgacytccggtgatccacccgcctcagcctcccaaattgctgggattacaggcatgagccgcttcgcccagccataaataaagttttattggacattgataatac

SEQ ID NO: 14411 - DNA, 201 bp, Homo sapiens
ttttttaccatataggtaaatacaggtagaccatcatctactgctttatttttgttttttttttagatggagtctcactctgtcacccaggctggagtgcmgtggcgtgatctcggctcactgcaacctctgctgcctcctgggtccaagcgattctcccgcctcagtctcccaagtagctgggattacacaagtgtgtgc

SEQ ID NO: 14412 - DNA, 201 bp, Homo sapiens
tataggtaaatacaggtagaccatcatctactgctttatttttgttttttttttagatggagtctcactctgtcacccaggctggagtgcagtggcgtgayctcggctcactgcaacctctgctgcctcctgggtccaagcgattctcccgcctcagtctcccaagtagctgggattacacaagtgtgtgccaccaagccc

SEQ ID NO: 14413 - DNA, 201 bp, Homo sapiens
cactttttttttttttttgagacagagtcttgctctgtcacccaggctggagtgcagtgatgtgatctcagctcactgcaacctccacctcccgggttcawgtgattctcctgcctcagcctcctgagtagctgggactacaggtgcctgcccagctaatttttgtacttttggtagagatggggtttcaccatgttggtc

SEQ ID NO: 14414 - DNA, 201 bp, Homo sapiens
ttttgtacttttggtagagatggggtttcaccatgttggtcagcctggtttcgaactcctgaccttgtgatccacctgcctcggcctcccaaaatgctggrattacaggcgtgagccaccgcgcccggccccacttaccatgttttactattactgcttaattatctgaccacctggcttgactgacaaattgtctgtcta

SEQ ID NO: 14415 - DNA, 201 bp, Homo sapiens
accaggcagacagagaaataagaaactatgagcaaagctttgcggctaaatcaatagctcattactgtcatcatgccacataatccacttattttaatctstaaggttggcccaagatagccattcagaagaagctgccggacattaaatgtacattggcaaagctcctaacagaactcatttcaaaagagtgaaagaaaa

SEQ ID NO: 14416 - DNA, 201 bp, Homo sapiens
cattggttcccacaggtgcaagtgcctatgggtggtggcaattcacccttccttttgtaagagatccactaaaggagatttaagattggcacaagcaatgytaggaactattcgaacagaactaccttgggctaataccgagagacacccaaactaggatgattgtgaattgatgattacctaattcaaaaaagctggaga

SEQ ID NO: 14417 - DNA, 201 bp, Homo sapiens
atacaaagccatgtatacaaatgttcacagtagctttaatagccaaaattggaaacaacccaaatgtatatcaacaaatgaatggacaatctgtgataaawacaatggactgtaactcagcaataaaataaactacagatatacactacaatatgaatgaatctcaaaatatgctgtgtaaaagaagtcagacaaaaaata

SEQ ID NO: 14418 - DNA, 201 bp, Homo sapiens
atttcctttttcatacattagaaagaatagcgcccccattagtaatatccactgcaatgcttcttaaatgaaaacatcctatgcataattataagacttamtttacacatttaacctgcacagtattatgagtttggatatgacagtcacatgttagcctatgcattttatttaaacctcattccaagagactagtgaagt

SEQ ID NO: 14419 - DNA, 201 bp, Homo sapiens
cccccatcttttttctgctaacacgtggctttccacaaaagggtcagtgtgatctttgcagatcagagataaggaatatagccacaataaactagagaagkttaagcacgttttaagtaattcaggagtttaaaacttgtcatctatgtataaaacaagcaaacagttataagtggttaaataaacatgtacaaattaata

SEQ ID NO: 14420 - DNA, 201 bp, Homo sapiens
atccttcccccatcttttttctgctaacacgtggctttccacaaaagggtcagtgtgatctttgcagatcagagataaggaatatagccacaataaactakagaaggttaagcacgttttaagtaattcaggagtttaaaacttgtcatctatgtataaaacaagcaaacagttataagtggttaaataaacatgtacaaa

SEQ ID NO: 14421 - DNA, 201 bp, Homo sapiens
ttatctttaaatctgtgtaatgaatcatatcagagggctttgaaagagagatatttattaagcattttagttgctctttttttttttcgagacggggtctyactctgtcgcccaggctggaatgcagtggtgcgatctcggctcactgcaacctccacctcccgggttcaagcgattctgcctcagcctcccgagtagctg

SEQ ID NO: 14422 - DNA, 201 bp, Homo sapiens
gtggggtctcgctctgtcatccaggctggagtgcagttgtgcaatctcggatcactgcagcatcctaccctcagcctcctgagtagctgggaacacagtcrtgtaccaccctgcctggctagattctctctctttttttttttgattgttaataaagacaagctcttacaattttgtccaggctggtcttgaacttctggc

SEQ ID NO: 14423 - DNA, 201 bp, Homo sapiens
ccccccataggcaactccctcccttctcataattagcttaagaccttaatgttggctgggtgtggtggctcacacctgtaatcacagcattttgggaggcygaggcaggcagatcgcttgagcccaggagtttgaggccacaagatcagcctgaataacatggcaaaacccaatttctacaataaaatataaaaattagct

SEQ ID NO: 14424 - DNA, 201 bp, Homo sapiens
ttgctgacacatctcttgaccaattgtgcaagaagcaatgaggttttgagcacggttttttaccactttatgaatcaaccttcccgcctcctcttcccccscccatctctggagtcctcatagttttctctttaaaatcatttgtaaaacagaaagcaaagctctcagatctaaccagtagtctaactctgaccttaggct

SEQ ID NO: 14425 - DNA, 201 bp, Homo sapiens
agcgattctcctgcctcagcctccccagtagctgggactacaggtgcgtgccaacacacctggctgattttttgtatttttagtgaagacggggtttcacygtgaggatgatcttgatctcctgacctcgtgatctgctggccttggcctcccaaagtgctgggattacaggagtgagccactgcgcccaaccccatgaaa

SEQ ID NO: 14426 - DNA, 201 bp, Homo sapiens
tcatgagttttataagaggtatagtagctgaagcagtgctcaagtattcattcattctttcaacatttattggatacctgctatacttaagatattgtgtyaggtgctgaaagatatataacacataaaatatgtatacagatatgtgttcaccagaaactcattacctagaaccagtgaatgttgcaagtactatgaaag

SEQ ID NO: 14427 - DNA, 201 bp, Homo sapiens
tgcaatctcagctcactgcaacctctgcctcccaggttcaagcacttctcctgcctcagcctcccaagcaggtggaattacaggcacgcgccaccacatcyagctaatttttgtatttttagtagagacagggtttcaccatgttggccaggctggtctcaaactcttgaccacaagtgatccacccaccttggcctccca

SEQ ID NO: 14428 - DNA, 201 bp, Homo sapiens
cgggggcggtgtttcactgtgttgcccagcctggtcttgaactcctgggctcaagaaatcctccctcctccctcattagcctcccaaagtgctgggattayaggtgtgcccattgtctctttagtaccttttagatatatgtattttaaaaagcactcaatgagggtaagaaacaaagtgtggacataaatataatctact

SEQ ID NO: 14429 - DNA, 201 bp, Homo sapiens
gaaatacccttccttttcctaattcttcaaaataagggcaataatctctgcccttagaaaattataaaaattatacaattgtaataaaaagttacaatgckaaagttttctcaggatttcatctggtatcaaagtttatagtccttccttatcctttgttacaaatccaactgtgcagcagtgcataatacaaaaatctca

SEQ ID NO: 14430 - DNA, 201 bp, Homo sapiens
tcattcccagaagcaagtgtagcctgcacatttcaaggatgagaaagaaaggaagaaagtattatcattttcctcctctagtgcttacaattataaagagytaatcggtttttagtaaacttaaagctatgacttaacatcatagaattttagaacgggaatgcctcttagaaaactttctgtttcaaggctgggcatggt

SEQ ID NO: 14431 - DNA, 201 bp, Homo sapiens
tattcacagattgaaagactcaacatagaaaagacgtcaattatccccaaattgtatatagttttaatacaattcctatcaaaatcccagcacggattttygtagacataggcaagctaaatctgacgtttacatggacaggcaaaagagctagaatgactaaacaatcttgaaaaggaagaatatgaggaatcactttac

SEQ ID NO: 14432 - DNA, 201 bp, Homo sapiens
caggtgtgagccgctgcgcctggccacaactcttaaatatagggacaaatctgcatgaccatggatttggcaatgatttcttaattaaaaccacaaggagmtaccacctcacacctgtaagaatagtttttagcaaaaagacaaaagactgagtgttggtgagcatgtagagaaaagggaacccttgtacactgttagtgg

SEQ ID NO: 14433 - DNA, 201 bp, Homo sapiens
ttttttctttttttttgagaacgggtctcactcttgttgcccgggtctcactcttgttgcccgggtctcactcttgttgcccaggctggagtgcagtggcrcgttcttggcccactgcaacctctgcctcccaggcggttcaagcaattctcttgcctcaggctcttgagtagctgggattacaggtgctcaccaccacac

SEQ ID NO: 14434 - DNA, 201 bp, Homo sapiens
gaaaaagtgttaggaatttgagtaaaccatccaatacaaacttcatgaataatttttatttctattgtttttaaagataacatattttaaagctcaggtayaagaactaaatggatttcatgaaaagataccatatcttaagttttcatatatattctattttttgagctcacttacattttaaaggtaactcatccaaag

SEQ ID NO: 14435 - DNA, 201 bp, Homo sapiens
gtgaagtgttttttttttttttttttttttttttttgagacagagtcttgctctgtcacccaggctggagtgcagtggtgcgatctctcactgcaagctcygcctcccaggttcacaccgttctcctgcctcagcctcccgagtagctgggactacaggcacccaccaccacacctggctaatttttttgtatttttagta

SEQ ID NO: 14436 - DNA, 201 bp, Homo sapiens
gtagctgggataacaggcatctgccaccatgcccagctaatttttttttgtcgttttagcagagacagggttttaccatgttggccaggctggtcttgaastcctgaccttaggtgattcgcccgcctcggcctcccaaagtgctgggattacaggtgtgagccaccgtgcccagcggggtttttactttttaaaaggaat

SEQ ID NO: 14437 - DNA, 201 bp, Homo sapiens
tgcagtggcttgatcattgctcatgcaacctccatctcccaggttcaagtgatcctcccaccttagcctcctgaggagctgggattagaggcgtgcaaacmcacgcccagctaatttttgtattttttgtagagatgggcgggggcgggggcggtgtttcactgtgttgcccagcctggtcttgaactcctgggctcaaga

SEQ ID NO: 14438 - DNA, 201 bp, Homo sapiens
ctgtcgcccaggctggaatgcagtggtgcgatctcggctcactgcaacctccacctcccgggttcaagcgattctgcctcagcctcccgagtagctgggaytacaggcgcgccaccatgcccagctaatttttgtatttttagtagagacggggtttcaccatgttggccaggatagtcccgcctcggcttcccaaagcgc

SEQ ID NO: 14439 - DNA, 201 bp, Homo sapiens
acggggtcttactctgtcgcccaggctggaatgcagtggtgcgatctcggctcactgcaacctccacctcccgggttcaagcgattctgcctcagcctccygagtagctgggactacaggcgcgccaccatgcccagctaatttttgtatttttagtagagacggggtttcaccatgttggccaggatagtcccgcctcgg

SEQ ID NO: 14440 - DNA, 201 bp, Homo sapiens
atgcagtggcttgatcattgctcatgcaacctccatctcccaggttcaagtgatcctcccaccttagcctcctgaggagctgggattagaggcgtgcaaamacacgcccagctaatttttgtattttttgtagagatgggcgggggcgggggcggtgtttcactgtgttgcccagcctggtcttgaactcctgggctcaag

SEQ ID NO: 14441 - DNA, 201 bp, Homo sapiens
cctgcattcctaacaagcttccaggtaatgccattgctgctggtccacggactatactgaattgcaaggctcaagatgaagctgtaaataacctttagaaratcactgagagcaaaacagtaagtgttatattgtcaagatcacaaataaacactcatatagacaaaaaactaacaaataaaaccccacacctgtcctaat

SEQ ID NO: 14442 - DNA, 201 bp, Homo sapiens
aaccgcagaaatgaactaaaaattactgtgatcactgctttgaagaggacgtacttggccctagaagaatttaatagaaaatatttaatcttggtagtaaytaagaaaaattattcagagttaaccagcggaaaaggaaagggaagaatactctcagtagagaaaacagcatgtgcaaaaccctaggggttggagaggaaa

SEQ ID NO: 14443 - DNA, 201 bp, Homo sapiens
actaagaatccaaaagaactagtatctattcagataataatatttacactgaatattagtagtactcccagtcactcaggaggctgaagcgatccttccgrtatgttatgggggaaaaatagtaacaataatgaagactataagcacgcaccaccacaaccagctaatttttaaattttttgtagagatgggctctcactg

SEQ ID NO: 14444 - DNA, 201 bp, Homo sapiens
cactgaagctctctgaaaagggagtgacatgctagaagtagcatttaaagaagattcatcatgatgagttgggaaaaagagactgaaatgaaggcaggccmctgtggtagtccaggaacgaggcaacaagggtctgaatgggaaaggtgcacgaggtgcagtgcattttaccagcgatgtaatgagccttgagactattat

SEQ ID NO: 14445 - DNA, 201 bp, Homo sapiens
tagaaaagacgtcaattatccccaaattgtatatagttttaatacaattcctatcaaaatcccagcacggattttcgtagacataggcaagctaaatctgwcgtttacatggacaggcaaaagagctagaatgactaaacaatcttgaaaaggaagaatatgaggaatcactttactcaatattaagtcttcctatgtagc

SEQ ID NO: 14446 - DNA, 201 bp, Homo sapiens
agtgtatgtgcgtgtctggctgcagttgatagttgggcaaagaggaaactatcacaaagaggaagtatactgaatggcagctcctttaggttacaaaagargatagctgctaataaaactttaaatgtgttgattgataaaaaacgagaagaaaaagaaaccaagaaaaaaaaattcaaaaaaagaggtaaagaggaaagg

SEQ ID NO: 14447 - DNA, 201 bp, Homo sapiens
tgatttggcagaagtcaagagagatgtggggagaaaaataaaaccactaatgaaatgaagctggcaagaagcagcacaaagaactggcaatggtggagacrtggtaagggacatgggtggagaattgaggaaagtagcaaaacaacagcaccttgaataaagtttttaaaaactagagtaaattatagatttgaaagataa

SEQ ID NO: 14448 - DNA, 201 bp, Homo sapiens
ttcactctctaagaagcaggggatggagatgggtaggtgcttaatgctttaatggaagagacagtattttgattgttctgtaaagaacaggcacaattggycgagcacagtggctcatgcctgtaatcccaacactttgggaggctgaggtgggcggatcacaaggttaagagatcgagaccaacctgaccaacatggtga

SEQ ID NO: 14449 - DNA, 201 bp, Homo sapiens
gataagaatttagataatctaaaattgttttattagaaacctgataataatctacaacatataaagaactgctataacttaacaacaaaaagacaaacgayccaattttgaaatgagaactagaaaacttaatattgtcaaggacttgaatagccatttactcaaagaagatgtacaaatggccaataaacacatgaaaaa

SEQ ID NO: 14450 - DNA, 201 bp, Homo sapiens
tctcaatttcacaaaaaacattcaacaaactcatataaccttttgccatttatagctatcttgagttcaaatatagtactttaaaaaaatcaataaattayaccctttgaaggcataaaatgtgttttgagatgttttttatgggtctacggtacttaaggtttctgataattttgtgaattattaacagagttctatttg

SEQ ID NO: 14451 - DNA, 201 bp, Homo sapiens
gtggctaataaactttaaaaaataatcttgttatgaaaagttgaggttatccttgtacttgtgatcaccttatattcaggcagatgcgctttgttgttctracctaaatctatgccagagcccataatctatatcctggaaggtactacttccctagctttcatatttgttagaaagaaagccatttgtatttcatattgc

SEQ ID NO: 14452 - DNA, 201 bp, Homo sapiens
ttattagactttaatgcctaaaagccatgtcatcaagcttccactagacttcgttacagtgaacagagttttcttaggttttagccacaatgagatacagmcatcgtggatgtatggtgtggtagtaggaatggctttcatttgtattcaatgaaataaaaatatagtaaattcaaggctgctccaagaaaaatgtaaaac

SEQ ID NO: 14453 - DNA, 201 bp, Homo sapiens
attgttaataaccgaatggccaacatgttttatttttatactttcataagtagctaactctatgtattaaattgatttaaaaagttacaaaacaaaataartgtgaccaaaccctctgacttttctgtctctaaatttggtattacattcaagaaacagctctgctttctatactattttccctttctgtgaatgaagaaa

SEQ ID NO: 14454 - DNA, 201 bp, Homo sapiens
taactttttaacatacaaatgatgacatgtcaaaaaaaaagtatctgttttcctacttaaactaaattcattttatggactatagtagtcacataaattgktaataaccgaatggccaacatgttttatttttatactttcataagtagctaactctatgtattaaattgatttaaaaagttacaaaacaaaataaatgtg

SEQ ID NO: 14455 - DNA, 201 bp, Homo sapiens
gcattaactttttaacatacaaatgatgacatgtcaaaaaaaaagtatctgttttcctacttaaactaaattcattttatggactatagtagtcacataarttgttaataaccgaatggccaacatgttttatttttatactttcataagtagctaactctatgtattaaattgatttaaaaagttacaaaacaaaataaa

SEQ ID NO: 14456 - DNA, 201 bp, Homo sapiens
gtcatccttcccccatcttttttctgctaacacgtggctttccacaaaagggtcagtgtgatctttgcagatcagagataaggaatatagccacaataaaytagagaaggttaagcacgttttaagtaattcaggagtttaaaacttgtcatctatgtataaaacaagcaaacagttataagtggttaaataaacatgtac

SEQ ID NO: 14457 - DNA, 201 bp, Homo sapiens
caagactccctctttacaaaaaaaaagaaactttaaaaaattagccaggcatggtggcacatgcctgtagtctcggctactggggaggctgaggcaggagratcacttgagctcaggagttcaaggcagcagtgagctatgactgtgccactgcacaccaacctgggtgacagggtgagactctgtctctaaataaacaag

SEQ ID NO: 14458 - DNA, 201 bp, Homo sapiens
acaggcgtcagcaacaatgcccggcctcaatttggtcacattaaaaaaaaatgatatggccacgtgcagtggctcacacctgtaatcccagagttttgggwggcagaggcaggaggatctcttgaggccaggattttgagaccaacctaggcaacacagcaagactccctctttacaaaaaaaaagaaactttaaaaaatt

SEQ ID NO: 14459 - DNA, 201 bp, Homo sapiens
cctcagatgtctttattagcagcgtgaaaacagactaatacatcctgtctctgcaatttttttttttaattagctatctgggaggccaaggcaggagggtsccttgagtctaggagtttgaggctgaggctgtggtgagctatgatcgcaccactgcactccagactaggtggcaaagtgagactctgtcccaaaataaat

SEQ ID NO: 14460 - DNA, 201 bp, Homo sapiens
tgtggaactgtgagtccattaaacctctttcctgtataaattacccagcctcagatgtctttattagcagcgtgaaaacagactaatacatcctgtctctrcaatttttttttttaattagctatctgggaggccaaggcaggagggtcccttgagtctaggagtttgaggctgaggctgtggtgagctatgatcgcacca

SEQ ID NO: 14461 - DNA, 201 bp, Homo sapiens
ccccacccaaatctcatcttgaattgtagctcccacaattcccaagcattgtgggaggaactcggtgggaggtgagtgaatcatggggtgggtctttcccrtgctgttcttgtgatacagtctcatgagatctgatggttttatcagggggagtttctctgcacaagctctcttttttgcctgctgccatccatgtaagac

SEQ ID NO: 14462 - DNA, 201 bp, Homo sapiens
ggataattcatttccctggctagaaggagtaggtcagcaggagatttcatcacactactcaaaagggtaagcaatttaaaactcatgaatggggccaggcmcagtggctcatgcctgtaatcccagcactttgggaggccaaggccagaggatcacttgaggccagaccggatttggctatgtccccacccaaatctcatc

SEQ ID NO: 14463 - DNA, 201 bp, Homo sapiens
taaaaatcacccgagaatttgcaggaaaatagtaggagtaggaaaagcatctaacaggtagtacacttcacacaggatcttgaaggaatggtaaaatctgmgtaggcagcgagaagctccaagcaagggctttttgggtgaagtaaaaggcagagacttgaatgagtttggtgtgtttgagagaccgacttcaatagaaca

SEQ ID NO: 14464 - DNA, 201 bp, Homo sapiens
atgctaggaactgtgaaagatttagctaaaagatatggtgtttgtattcaaaatgtttacattagtgaagatacaagagtgtgtgatagaagacactacayagatttttgttcattggtttgctaaattaaaaatcacccgagaatttgcaggaaaatagtaggagtaggaaaagcatctaacaggtagtacacttcacac

SEQ ID NO: 14465 - DNA, 201 bp, Homo sapiens
gttacttaaataattggataaaaatgcttcttggttgtgtaaaattaaatgattatatttaatctatagttcttttttttttttttttttttttttttagkggcggagtctccctctttcacccaggccagactgcagtggcgctatcttggctcactccaagctccgcctcccgggttcatgccattctcctgcctcagc

SEQ ID NO: 14466 - DNA, 201 bp, Homo sapiens
attcatctggaattaaagactacttgtccagcctctgagctaaagtctaagtctgcttctgccttatttctttctttctttcttttttttttttttgagayggagtctcgctctgtcacccaggctggagtgcagtggcacaatcttggctcactgcaagctctgcctcccgggctcacgccattctcctgcctcaactac

SEQ ID NO: 14467 - DNA, 201 bp, Homo sapiens
catagtgccttcaatggaggaggcagtgttaaacacagactattcatctggaattaaagactacttgtccagcctctgagctaaagtctaagtctgcttckgccttatttctttctttctttcttttttttttttttgagacggagtctcgctctgtcacccaggctggagtgcagtggcacaatcttggctcactgcaag

SEQ ID NO: 14468 - DNA, 201 bp, Homo sapiens
gcttttcctgacaggaagatgctctggcaactcactagctccagcctcctcatttccaagtccaacaggagtcctctcaggtcatatccttccataacctytatgccgcatctccttacaaggttgtttcttggtttgtgtggcactgtcctctaggagtttctttccaacccacctcttctggcttatcctacttctctc

SEQ ID NO: 14469 - DNA, 201 bp, Homo sapiens
cactttgtaagaataaagactaagaaaaaaaatccactttgaaaaatccatgcaacaatgcatgcaggcttgaaaatgaagtggaagttatatttagagayagatgaatattgatacggtaatgatatactgttaaagtaaaagaaataaagcagcatagaaaacaatatatgtactataactgtcctaattactattcct

SEQ ID NO: 14470 - DNA, 201 bp, Homo sapiens
aaaccctgtctctactaaaaatacaaaaaattagccgggcatggtggcagatgcctgtagtcccagctactcaggaggctgaggcaggagaatggcatgamcctaggaggtggagcttgcagtgagctgagatggtgccactgcactccagcctgggggacagagcgagactgtctaaaaaaaaaaaaaatccactagaat

SEQ ID NO: 14471 - DNA, 201 bp, Homo sapiens
ctattggcaaattctagatagcatttcattgtggagtaaatttattaatcaaaacataaatttttaatagaaattcgtggccaggtgcggtggctcatgcytgcaatcccagcactttgggaggctgagatgggcagatcaccagaggtcaggagttcaagaccagcctggccaacatggtgaaaccctgtctctacaaaa

SEQ ID NO: 14472 - DNA, 201 bp, Homo sapiens
aaaaaagagagagagagagagagagaaatgaagaagtcttgcaatatttgcatatcaacttcagatactgtttcttaggcttaaaaaaaaaaactatcagkggttcctgctacatctattggcaaattctagatagcatttcattgtggagtaaatttattaatcaaaacataaatttttaatagaaattcgtggccaggt

SEQ ID NO: 14473 - DNA, 201 bp, Homo sapiens
aaccctgtctttacaaaaaatacaaaaattagccaggcaaggtagcaggtgcctgtagtcccaggtactggggaggctgaggcaggaggatcacttgcatytgggaggccaaggttacagtgagtggcgatcctgccattgcactccagcctgggccacagagtaagcctctgtctgctaaaaaaaaaaaaaaaaaaaaaa

SEQ ID NO: 14474 - DNA, 201 bp, Homo sapiens
attttcccggctgaggcaagcagattgcttgagctcaggagttcgagaccagccagggcaacatggagaaaccctgtctttacaaaaaatacaaaaattakccaggcaaggtagcaggtgcctgtagtcccaggtactggggaggctgaggcaggaggatcacttgcatctgggaggccaaggttacagtgagtggcgatc

SEQ ID NO: 14475 - DNA, 201 bp, Homo sapiens
cttttattccatttttttctatatgagtccaaattaggtccatctgtccaaattttgttttaatggcaataatgcaatgcattttaaaaattaaacttagwagttttaataaataattaaatctaatataaaaaccagattaagttgccctagcagggcaacgttgactatgtgtactacaaatgtatggacacatgatca

SEQ ID NO: 14476 - DNA, 201 bp, Homo sapiens
ctgggcagcaagtgagaccctgtctcaaaagaacaaaaagaaacaaaaaacattaactctaccattaatatatctaattttttttttttttttgagacagrgtctcactctgttgcccaggctggagtgcagtggcgccatctcagctgactgcaacctctgctgccctgccccaggttcaaggtattcttgttcgtcctc

SEQ ID NO: 14477 - DNA, 201 bp, Homo sapiens
aacagagaccccaccttcacagatgtcacaattgtgattatatggatgtttttgtgattctttaacatatgtgtccttcactaacagagggaagagacagygactgttttaataactctatttccagtaccaaacagtgtctggaacatagtaccttttagattaatacctccaaatgaatgaatgattgcatcaatcaat

SEQ ID NO: 14478 - DNA, 201 bp, Homo sapiens
ttcagcagtccagttctgggtattttataaaaaaaaaaaaaaattgaggctgggtgtggaggctcacgcctgtaatcccagcactttgggaggccgaggcrggcagaccacctgaggtcaggagttcgagaccagcctgaccaacatggagaaaccccatctctactaaaaatacaaaattagccaggcgtggtggtgcat

SEQ ID NO: 14479 - DNA, 201 bp, Homo sapiens
gggaggtggaggttgcagtgatccaagaacataccactgcactccagcctgggcaacagaacgagactcttatctcaaaaaaaaaaaaaaaaaaaaaaagrataatatctgactttacagtagtcttaaggatgaaatttaaaaatgcatgtaaaagtgctttataaattgctataaatatattattagtattaataaata

SEQ ID NO: 14480 - DNA, 201 bp, Homo sapiens
gaaatgaaactctggtataaccaaaaacataaggtagagcattggttatttgccttttaagtttcaaaaataatgacaagagaatgataatataccatcartctttccattcagtcagaactctgtatcaacaacaaccccaaaaatatgtggatatcttcaatattttggaggaaaaatacatcaggggttcaatgatgc

SEQ ID NO: 14481 - DNA, 201 bp, Homo sapiens
tgtgccaggcttcatgacaggtagcaaagatattatcttgaacatgttaaggtctctgtcctcaaagagattgcatctagtgagaaagcaagcctgaaatrcaggcaataacagaataatgtagcacacttaaagggtatttaacccagtctcttagggaaaggaagtaaagaagtactagagaagccaaaagatatttga

SEQ ID NO: 14482 - DNA, 201 bp, Homo sapiens
gcagaactaagatctccaccgtgtttcccctttcacgagtttattcaacaggtacttttttttttttttgagacagaatctcactctgttgcccaggctgkagtgcagtggtgcgattttggctcactgcaacctgcaacctctgcctcctgggttcaagtgattctcctacctcagcctcccgagtagctgggattacag

SEQ ID NO: 14483 - DNA, 201 bp, Homo sapiens
tggttttaataataaaagccactactaactccaccctatcaccaccatctacaatatgcttactttgtgctggaggctttatgtatattatatcaagtaaytcccacaagaatcccaagatgtaggcactattatcctacttttacagatgaagaagctgaagttctgaaaatgttaagaactagaattagtgaaagttca

SEQ ID NO: 14484 - DNA, 201 bp, Homo sapiens
cgccattctcctgcctcagcctcccgagtagctgggactacaggcgcccgccaccaggcccagctaattttttttgtatttttagtagagacggggtttcwccgtgttagccaggatggtctcgatctcctgaccttgtgatccgcccgcctcggcctcccaaagtgctgggattacaggcgtgagccaccgcgcccggcc

SEQ ID NO: 14485 - DNA, 201 bp, Homo sapiens
aaaaaatccaggagtaaatttaaaagcaatgtgtaagaactgggatggaagaaaattataaaatgtcacaaaagatataatagaaaatttgggccggtgcrgtggctcatgcctgtaatcccagcactttgggaggcagaggcaggcggatcacttgaggccaggagttagagaccagcccagccaacatggcgaaaccac

SEQ ID NO: 14486 - DNA, 201 bp, Homo sapiens
aaacaagaaaactagtcattttgccttcgactcataattaaaatatatgcttcagcaatccagttagattacaagacatttcaaaaaaagagaacctaaamtttcagaaaaataatttttctaccatcacctatatttttaccaagtacataatttccatttcctttgttgtttcacttatctgagatggcaatgttgcta

SEQ ID NO: 14487 - DNA, 201 bp, Homo sapiens
tctcctgcctcagcctccagagtagctgggactacaggcgcctgccaccacgccaagctaattttttgtatttttagtagagacgggtttcaccgtgttasccaggatggtctcgatctcctgacctcgtgatccacctgcctcggcctcccaaagtgctaggattacaggtgtgggattactgcacccagccagaaattt

SEQ ID NO: 14488 - DNA, 201 bp, Homo sapiens
cattgctggggctgggcacggtggctcacgcctgtaatctcagcatttgggaggccaaggtgggtggattgcttgagctcaggagttcgagaccagcctgsccaacatggcgaagccccgtctctattaaaaatacaaaaattagctgggtgtggtggtgcacgcctgtaactccagctacttgggaggctgaggcaggag

SEQ ID NO: 14489 - DNA, 201 bp, Homo sapiens
taagctggctgcaacctccgcctcccacatacaagcaattctcctgtctcagcctcccgactagctgggattacaggcatgtgccaccacccctggctaayttttatacttttagtagagatggggtttcaccatgttggtcatggtgaactcctgacctcaagtgatctgcccgccttggactcccaaagtgctgggatt

SEQ ID NO: 14490 - DNA, 201 bp, Homo sapiens
gacaactaaaataaattaagatttttcttggtctggggaagtagacggtagcaagggatgtttcttgaaattacttattaaaggcttattactaatatctrattcaataagcatcacaacctacaaatgttttataatagaattattcacaaaatccacaaaacagcttatgttagcctgattttacacatgaagaaatga

SEQ ID NO: 14491 - DNA, 201 bp, Homo sapiens
tacaattaatgaactgtgtccagcaaaggtttatactggcctttccttcaaaattaatgaaataaaactgtacattgttgtctcagtaaaaataaaggcayaaagaattcacaaataggggccgggcatggtggctcatgcctgtaatcccaccaccttgggagaccgaggcaggtggatcacctgaggtcaggagttcga

SEQ ID NO: 14492 - DNA, 201 bp, Homo sapiens
tggagtcaagaatgtgtaaaccgtgtagtgtagatagccttaatatattctggacttagagttttagggcagtgggaaaactaatcacattcataagacaytttgcaactacattattcccccacaaataatagttattttaatctatatccacaaataatagttactggctatatctacaaagtttgtgtagatatctac

SEQ ID NO: 14493 - DNA, 201 bp, Homo sapiens
gggtttcaccatgttggccaggctggtctcaaactcctgacctcaggtgatctgcccgcctcagcctcccaaagtgctgagattacaggcctgagtcatcrggccccgccacatggtggttttctttatcttcctcctggctatgtgctgggtagcagattatccacaattattattgtagctcaaaaacctgagttttcc

SEQ ID NO: 14494 - DNA, 201 bp, Homo sapiens
gaaggttaaggcattctaagtcacaggatgggataggaggtaggcacaagatacaggtcataaagaccttgctgataaaacaggttgcagtaaagaagccrgccaaaacccaccaaaaccaagatggcaatgagaatgacctctggtcgtcctcactgctatactcccaccaatgccatgacagtttacagatgccacggc

SEQ ID NO: 14495 - DNA, 201 bp, Homo sapiens
tgcctgtaatcccagctatttgggaggctgaggaaggagcattgcttgaacctgggaggcagagtttgcatgagctgagatcacgccactgcactccagcytgggcaacagcaaacgagactccgtctcaaaaaaaaaaaaaaaaaaaaaagttggctcaattgccattcgattttctcctctgctgctttggagaggtta

SEQ ID NO: 14496 - DNA, 201 bp, Homo sapiens
tagcctgaccatcatggtgaaaccccatctctactaaaaatacaaaaattagcagggtgtggtggcgggtgcctgtaatcccagctatttgggaggctgargaaggagcattgcttgaacctgggaggcagagtttgcatgagctgagatcacgccactgcactccagcctgggcaacagcaaacgagactccgtctcaaa

SEQ ID NO: 14497 - DNA, 201 bp, Homo sapiens
atagggatgccaataatttcattagatattataaaattacagttattccctcattttccgttgctatgaaaggcaaatggcaaagagaaacaacacgacayctggagtgaaaaagatttatgtttaaatcctctgcttaagagtgtagtcttcagcctgctatctggaaaagcaaccatggttaagaacacgggttatgat

SEQ ID NO: 14498 - DNA, 201 bp, Homo sapiens
ttggcctcccaaagtgttgggattacaggcgtgagccaccatgcctggtcccatattttaaatactaataaataaagttcaggtaacttctctctttacastcctggtcttgcccttccttttgcctccctcatgccaacaacactttgctgaagagagtctggcactgtttcagtgaagtcattatctatactacttggt

SEQ ID NO: 14499 - DNA, 201 bp, Homo sapiens
cctctctcctttcttaggaccttcctttttgatttttttttaaattttaattttatttatttttttgagacggagtcttgctctattgtccaggctggagwgcaatggcacaatcttggctcactaccacctctgcctcctgggttcaagcgattctcctgcctcagactctcaagtaactgggactataggcatgtgcca

SEQ ID NO: 14500 - DNA, 201 bp, Homo sapiens
cttatgtagagtgccttttctcccttgtagtgaccagcaccagactgttttcatcatagcacctgaaattatctgaaattattttattcatatgttccttmtatgtttattgtttctctcctgtctgtcctattcactgctatatcccctcatatatcatacatcataggaaatcacaaatatttgttaaaagaataaaag

SEQ ID NO: 14501 - DNA, 201 bp, Homo sapiens
accgggttcaagcgattctcctgcctcagcctcctgagtagctggggttacaggtgtgcaccaccccgcccagctaatttttgtatttttaatagagatgrggtcttaccatgttggccgggatggtctcaatctcttgacctcgtgatccgtctgcctcagcctcccaaagtgctgggattacaggcgtgagccaccgtg

SEQ ID NO: 14502 - DNA, 201 bp, Homo sapiens
gtcttgaactcctgacctcaggtgatctgcctgcctcggcctcccaaagtgttgggattacctgcacccagcctagaatttcatatgaatacaattacacmgcatacactatataaacttttttgtatctggctttttgtcattcagtattaagattctgagattcacacacattgttgtaccatagatactggatttgtg

SEQ ID NO: 14503 - DNA, 201 bp, Homo sapiens
agttgctcggactacaggtgtgcaccaccatgcccagctaatttttgtatttttagtagagatggggtttcaccatgttgaccaggctggtcttgaactcmtgacctcaggtgatctgcctgcctcggcctcccaaagtgttgggattacctgcacccagcctagaatttcatatgaatacaattacacagcatacactat

SEQ ID NO: 14504 - DNA, 201 bp, Homo sapiens
acaaggtcaggagttcgagaccagcctgaccaacattagaaacccagtttctaaaaaaaataaaaaattagctgggcgtggtggcacgcacctgtaatgcyagctaccaggaggctgaggcaggagaatcccttgaacccgggaggcagaggttgcagtgagccgagatcacaccattgcactccagcctgggtgatagag

SEQ ID NO: 14505 - DNA, 201 bp, Homo sapiens
cgatacacagtcaagttttatgcttaaggtgtttattacatagaaggagagacaagccacttggctgggtgtggtggctcacgcctgtaatcccagcactytgggaggctgaggtgggtggatcacaaggtcaggagttcgagaccagcctgaccaacattagaaacccagtttctaaaaaaaataaaaaattagctgggc

SEQ ID NO: 14506 - DNA, 201 bp, Homo sapiens
ctgttcaatgaagaggagtgtaccaattcaagacaagggaagcctaagtatttattccaaaatcttttcaagtaatcctgtaatgggacttttggggatgsctttataccctagaaagcatttaaaacttgaaactcttgcctaatttctaatgtcgaaaggacaattcagcattcttactcacttttaattttgctttgc

SEQ ID NO: 14507 - DNA, 201 bp, Homo sapiens
agggttttaccatgttggccaggctggtcttgaagtcctgaccttaggtgattcgcccgcctcggcctcccaaagtgctgggattacaggtgtgagccacygtgcccagcggggtttttactttttaaaaggaattatagtaaatgtttttgtaaagcaagtaaccattactacttcatgtgctttttttgaatgactatt

SEQ ID NO: 14508 - DNA, 201 bp, Homo sapiens
agagtatacatccttcttaagtataaaatcttgacctaaaatatgtttccaaagactctttaaatttatttgatctttcaacaatactatctctaaatacraacacagatgtttacattcctcaagatgtaagtaattacaagtacttccctgtttagatatttaaagcagtttctttatccttcaaagatttatttaaaa

SEQ ID NO: 14509 - DNA, 201 bp, Homo sapiens
gttgctcagtttaaaaatcttttattcagatacacacatacacacagacacacaacatactctgagttcaatatataagtaaaattcccagcattcttaaytgttccaaaaccaaataaaagaaaaatccaagatgtaaacacctttagcctctgcaaattttacctgccactgatcaccaaatacacaacagcactgtga

SEQ ID NO: 14510 - DNA, 201 bp, Homo sapiens
caacatgtgcccaaggtggtcagagcagtttggttttgtacattctagggagaaatgagacatcaatcaacatatgcaagatgaatattggtttggcctgraaaggtgggacaactcgaggcaaaaggcggaaggactccaagcgggaaggtggcttccaggtcacaggtaggtaagagactaatggttgcattcttttga

SEQ ID NO: 14511 - DNA, 201 bp, Homo sapiens
atgtagaatttattttttgtaatgaaaaaataaattaaaaatattttttgaagactgaattggaatagaaggagactagagcagggaggtcaggttatggytaccaaacaacaaagaacgataatcttattccagaatgttggcaataaaattgaaagcagaaggcagttaccataccatggttccatgagtgtggaggtc

SEQ ID NO: 14512 - DNA, 201 bp, Homo sapiens
cctgaccaacatggtgaaactctgtctctcctaaaaatacaaaaattagctgggcatggtggcacgcacctgtagtcccagctcctcgggaggctgaggcyggagaattgcttgaacctgggaggcagaggttgcagtcagccaaaatcatgccactgcactccagcctggtgacagagcaagacttcatcaacaaaacaa

SEQ ID NO: 14513 - DNA, 201 bp, Homo sapiens
tgcttaggatgctgttgatgccatcatcattcgattctgctctactggactcttatcatcttcacaactgccacaatcatctctgctgtgccctgagcttrcaagattcaaagttctgggtgggagtatctgattgaccaaagtcacatgcccgcctgaaagctgccaggcaactgaagatggaatatcgacctgtactcc

SEQ ID NO: 14514 - DNA, 201 bp, Homo sapiens
aaactgctgaagttgtttattagatcaaagagcatttgggcagaggctatgcggttttctaggtatagaatcatgttgcctgcaaacagggatagtttgamtttctttcttcctatttggataccttttatttctttcttttgcctgacttccctggtcaggacttccagtgctatgttgaataggagtggtgatagggtc

SEQ ID NO: 14515 - DNA, 201 bp, Homo sapiens
gagccaccgcgccccacctttttttttttttttttagatggagtctcgctctgtcgacaggctggggtgcagtggcgccatcttagctcactgcaacctcygcctcccgggttcaagtgattctcctgcctcagcctccaagtagctgggactacaggcgtgcgccactacgcccagctaatttttgtatttttagtagag

SEQ ID NO: 14516 - DNA, 201 bp, Homo sapiens
tccaccgctgatgggcatttaggttgattccatgtctttgttattgtgaaaagtgctgcaatgagcatatgggtacatgagtctttatagtagaatgattyatattcctttaggtaaataaccagtaatgggattgctaagtcaaatggtaattctgctttaagttgagaaatcgccaaactgctttccacaatgactgaa

SEQ ID NO: 14517 - DNA, 201 bp, Homo sapiens
agtaggccctggtgtctgtgattcccttctttgtatccaaatgtactcagtatttagctctcacttaaaagtgagaacatgcagtatttggttttctgttmctgtgttagttcatttactaaatgactcccagctccatccatgttgctgtaaaggacatgatctcattcttttttcatggctgcatagtattccatggtg

SEQ ID NO: 14518 - DNA, 201 bp, Homo sapiens
gtgaaggagtaagccctgaaggtcctggcaaggaagagtggtacaggcgagggaatagcaagattgttttgtgtactccagaaaacgccagaaggccagcrtgggtaagggaaagtgaacaatggggatgtagtaggagaagagatagggcctttcataatgtgatggagattttggattttattataagtgagatgggaa

SEQ ID NO: 14519 - DNA, 201 bp, Homo sapiens
ccagcctgggcgacagagcaagactttgtctctaaataaataaataaattctcacttaaaattaagtatagagtcttagatgaagctggtataagaagctytgaaacacgcttcacagtaaaccagcctttgaaaattcctaatatttcattcattatcttgctcccagagggtagactgaggcaggtaaaatcttaactt

SEQ ID NO: 14520 - DNA, 201 bp, Homo sapiens
gctgggccctacggcttctttaagtagcagatattccataaaaatctgatgaaatcaccttccctgttccatttcaatcttataattaaaatgaccattcraattaatcctttccccaaaagataaacaagaatattttttcttctaagaggataagatgaaataacaggcataaaataagtttttccctcttccttaacc

SEQ ID NO: 14521 - DNA, 201 bp, Homo sapiens
gccattctcctgtctcagcctccccagtagctgggactacaggcgcccgccaccacgcccagctaatttttttttgtatttttagtagagatggggtttcmccatgttagccaggatgatctcgatcttctgacctcgtgatccgcccgcctcagcctcccaaagtgctgggattacaggtgtgagccaccacgcccggct

SEQ ID NO: 14522 - DNA, 201 bp, Homo sapiens
atcaggaaaaaataaattccattcagttacatttgtatatatactttgtatttcacttctcacttggtctttgtctaagttgtgtcctctgcttataaggsccaaatctcagctattcttacagtccagctaaatgtcacttttttttttttttttttttttgagacaaagtcttgctctgtctcccacgctggagcgcag

SEQ ID NO: 14523 - DNA, 201 bp, Homo sapiens
gtggtggcgcattcctgtaatcccagctactcgggcagctgaggcaggagaatcgcttgaacctgggaggcggaagatggggtgagccgagatcatgccaytgcactccggcctggcaacaagagcaaaactctgtctcagaagaaagaaaagaaaagaaaacaaaagaaaagaaaaaagaaaagaaagagagtttcaaat

SEQ ID NO: 14524 - DNA, 201 bp, Homo sapiens
ttacaggaaaaaactagaaaaaaactatggacttccattttcacatttttcttgctgagaatatcccactcttgtctcatgcctatagttataaactgaaygttttcattatttctgttactccttccgattctgtctgtggctgtggaatgcttcagattaactggtagctaaaacttgcctgaattcagcatcacattt

SEQ ID NO: 14525 - DNA, 201 bp, Homo sapiens
aggagttcgagaccagccttgccaacatggtgaaaccctgtctctactaaaaacacaaaaatcagctgggtgtggtggtgcatgcctgtaatcccagctasttgggagactaaagtgagagaattcttttaatctcggaggcagaggttgcagtgagcagacattgtgccacttcactctggcctgggcaacagagcgaga

SEQ ID NO: 14526 - DNA, 201 bp, Homo sapiens
cagcaataaaataaactacagatatacactacaatatgaatgaatctcaaaatatgctgtgtaaaagaagtcagacaaaaaatagcacatactttatgatktcatttatatggaattctagaaaatgcaaactaatttaaagagatagaaatcatatcagtggttacctgggggaagggggtggtgatggcaggtaaaaag

SEQ ID NO: 14527 - DNA, 201 bp, Homo sapiens
ttcacagtagctttaatagccaaaattggaaacaacccaaatgtatatcaacaaatgaatggacaatctgtgataaatacaatggactgtaactcagcaawaaaataaactacagatatacactacaatatgaatgaatctcaaaatatgctgtgtaaaagaagtcagacaaaaaatagcacatactttatgatttcattt

SEQ ID NO: 14528 - DNA, 201 bp, Homo sapiens
agcactctaccaagtgagatggatgaatggcaaaagaaagatgcatactatcactactcattagggagatgcaaatgaaaacccatgagaggccgggcacrgtggctcacacctgtaatcccagcactttgggaggcggaggtgggtggatcacctgaggtcaggagttcaagaccagcctggccaacatggtgaaacctc

SEQ ID NO: 14529 - DNA, 201 bp, Homo sapiens
gaggggaaatccagttagagcctggtggactccctgagttgaggagacaaagatgacagtccaggttgaccaaggtgagtagagttggcagggcagagtgycaaatagaagagagcagcagagaaacaagatatggagatttgcaaagggttcccctcaagtcttcagctgagcactgattagtgcatgcatatgagaaaa

SEQ ID NO: 14530 - DNA, 201 bp, Homo sapiens
gacaatggatatcaggcaaagaaagacaatgatccctgacagaagataggcaaatgatgtaagccattaaatgtttgagcttaatgccctgggagaatttytaggccatgctgcagagaggggaaatccagttagagcctggtggactccctgagttgaggagacaaagatgacagtccaggttgaccaaggtgagtagag

SEQ ID NO: 14531 - DNA, 201 bp, Homo sapiens
atacaaaaaattagccaggcgtggtggcacatgcctgtaatcccagctactagggaggctgaggcaggagaatcgcttgaacccgggaggctgaggttgcrgtgagccgagattgagccattgcactccagcctgggcaacgagagggaaactctgtctcaaaaaaaaaaaaaagaacagacatatgatttgaatacacat

SEQ ID NO: 14532 - DNA, 201 bp, Homo sapiens
ctgagcgtggtggcacatgcctgtaatcccagctatgtggaaggctgacgcaggagaattgcttgaactgggatccaggaggcggaggttgcagtgagccragatcgtgccactgtactccagcctgggctacagagcgaggctctgtctcaaaaaacaaacaaaagaacaaacaaactgtattttatgtaatgaatttca

SEQ ID NO: 14533 - DNA, 201 bp, Homo sapiens
attctgactacacactaacaagggagtgttaactaagaaattagcacccttttttcttttcttttttttttttttgagacagaatctcactctgtcccccrggctggagtgcagtggcacaatcttggctcactgcaagctctgcctcccgagttcacgccattctcctgcctcagcctcccgagtagctaagtagctaag

SEQ ID NO: 14534 - DNA, 201 bp, Homo sapiens
ttccatttttaaaaagttcaaaactaagcaaaaccaatttacatttttaggagtacagattaagtgggttataactataaagaaaagtaagaaaataatcmccataaaaatcagaatggtggatactcttaaggggacggagagggttctgactgagggagacataaagaggggcttttgggatgctggcagtattgtatt

SEQ ID NO: 14535 - DNA, 201 bp, Homo sapiens
attcataatcattttcttaaatacaactaatttaaaatgaacctcttcagatacaatggtttctttatgatttttaaaaacggttaattcaaacaataaamaataatgtagtatgtacaaataatttgaccacagattcttatggaatgtcaaaatgaaaaaaaaaaaaacccacaataacgtactacaggagtttttttt

SEQ ID NO: 14536 - DNA, 201 bp, Homo sapiens
gaccaataaagctatcgcagtggttctgaagtaaaagattggaattcattcactgataaagtcaggttaacaattttagagaaaaattcataatcattttyttaaatacaactaatttaaaatgaacctcttcagatacaatggtttctttatgatttttaaaaacggttaattcaaacaataaacaataatgtagtatgt

SEQ ID NO: 14537 - DNA, 201 bp, Homo sapiens
agattacctctgcatcagtgccatacccctaatgtaagtaagctattttgcttctgtcacattattatcattgtggaccaataaagctatcgcagtggttytgaagtaaaagattggaattcattcactgataaagtcaggttaacaattttagagaaaaattcataatcattttcttaaatacaactaatttaaaatgaa

SEQ ID NO: 14538 - DNA, 201 bp, Homo sapiens
tattagttttcttaaaattttcataaaaataaatacaagacattaaaagattacctctgcatcagtgccatacccctaatgtaagtaagctattttgcttytgtcacattattatcattgtggaccaataaagctatcgcagtggttctgaagtaaaagattggaattcattcactgataaagtcaggttaacaattttag

SEQ ID NO: 14539 - DNA, 201 bp, Homo sapiens
ttatttaaaatatttaaaactattagttttcttaaaattttcataaaaataaatacaagacattaaaagattacctctgcatcagtgccatacccctaatrtaagtaagctattttgcttctgtcacattattatcattgtggaccaataaagctatcgcagtggttctgaagtaaaagattggaattcattcactgataa

SEQ ID NO: 14540 - DNA, 201 bp, Homo sapiens
tgagctactgctcccagcctcaacttatttaaaatatttaaaactattagttttcttaaaattttcataaaaataaatacaagacattaaaagattacctytgcatcagtgccatacccctaatgtaagtaagctattttgcttctgtcacattattatcattgtggaccaataaagctatcgcagtggttctgaagtaaa

SEQ ID NO: 14541 - DNA, 201 bp, Homo sapiens
ggcgtgatctcggctcactgcaagctccgcctcccgggttcacgccattctcctgcctcagtctcctgagtagctgggactacaggcgcccgccaccacgsccggctaattttttgtatttttagtagagatggggtttcatcatgttagccaggatggtctcaatctcccgacctcgtgagccgcccacctcggcctcgc

SEQ ID NO: 14542 - DNA, 201 bp, Homo sapiens
aaaaacttcaggaacttttattatatgctccacaagaaggaaaaaaaaattgttctaaaaaaaagtttaaagaattttgttaatttcttttttcttttttytttttttttttttgagacagagcctcgctctgtcacccaggctggagtgcagcggcgtgatctcggctcactgcaagctccgcctcccgggttcacgcca

SEQ ID NO: 14543 - DNA, 201 bp, Homo sapiens
ggaaaggagttggtacatggtaaacaataaatgctagttaaattggagtttaagtaggaatgtgcaatttgaaaaagtagaaagcataacattttcacatsctaaatgtgcctaatgtgccaacctaaaaccagaaatacaatcatataaaaatatactaagggccgagcacaatggctcatgcctgtaatcccagcactt

SEQ ID NO: 14544 - DNA, 201 bp, Homo sapiens
aattaaccagtcccttccaacatttcaatgtctggagtgttctaggttacattttcctcctctgccacaaagccatctttaattaccccttcaaactacargttttcattatttgtgaaagaagctaataagcaatttctattcagagatcaacagtgatttaattttttttttttttttgagacaggggtctcactctgt

SEQ ID NO: 14545 - DNA, 201 bp, Homo sapiens
taaatgagagcaggcaaaataatcacaagcaagttggcagtagtattaacaccttggtaccaaagacatatatttacaaaaagttgtcagatccatagacrttatgataattttatttaatcagtatttattaacatgattaggttcactctttgtccttaattcccagcaggatttcggtctgcctatctttaggaagtt

SEQ ID NO: 14546 - DNA, 201 bp, Homo sapiens
tgggattacaggcataggccaccacacctggccatattcttttaaaataattaaacaacatgaaaaatactttatggagccatataaagcaatataatcarctgttccaaagatactaaaacctacaaaaaccctaggttgtagtaatggatgttactttacttgtttgtccataatgcatcttcattaggagggcagggg

SEQ ID NO: 14547 - DNA, 201 bp, Homo sapiens
ttcactgtatgtctttttatgttttctgatttacaaaccttgtgattctgctacctaattgaaaaaaataatattcaaattttcctccaggaattcttttktttttttaattaatacttctttaatgtaaaaaaaaaatccagataaattgtgcatctttatcatatgttgttttgtcggaaggggtcaatgaaacattgg

SEQ ID NO: 14548 - DNA, 201 bp, Homo sapiens
tatggattctggggcagtgattcttctgttcaaattctatttctccaaagttgttttagctaattttggtcctatgacttctgggattaccctgtgaagtkttttttttttttttttttttttttttttgagacagagtcttgctctgtcacccaggctggagtgcagtggtgcgatctctcactgcaagctccgcctccc

SEQ ID NO: 14549 - DNA, 201 bp, Homo sapiens
ggttttatattttaaagtagtaaaagttatgatatttatcattatgttttaaaaaacattgattagaaaaggtcttcattatacttgtaaaagtattttakagtaataataataacactaggccgggcctggtggctcacgcctgtaatcccagcactttggaaggctgaggcgggtggatcacaaggtcaggagattgag

SEQ ID NO: 14550 - DNA, 201 bp, Homo sapiens
aagagatgttaaaatgggccggcatgatggcttgcgcctataatcccaacactttgggaggccgaggtgggtggatcatttgagatcaggagtttgagacyagcctggccaacaaggtaaaactccgtctctactaaaaatacaaaaattaggccgggtgcggtggctcacgcctgtaatcccagcactttgggaggccga

SEQ ID NO: 14551 - DNA, 201 bp, Homo sapiens
aacacttaggagctgtaaagtttgatctttaggaaagaaggacagtgtcagtaacactatcatcatcctgctttttgatgccatcccagcaattcaacttytagattagggtgtttttaaaaaaatatatactattatagaagagacagacaccataaagaaaggggataacaagctattatggaagagagagatatcaga

SEQ ID NO: 14552 - DNA, 201 bp, Homo sapiens
ctacctgaaaaggtataagggttcttttctttctttctttctttttttttttttttttttttgagacgcagtctcgcactgtcgcctaggctggagtgcarcggcgtgatctcggctcactgcaagctctgcctcccaggttcacgccattctcctgcctcagcctctccgagtagctgggactacaggtgcccgccacca

SEQ ID NO: 14553 - DNA, 201 bp, Homo sapiens
tttagataaacactacctgaaaaggtataagggttcttttctttctttctttctttttttttttttttttttttgagacgcagtctcgcactgtcgcctargctggagtgcagcggcgtgatctcggctcactgcaagctctgcctcccaggttcacgccattctcctgcctcagcctctccgagtagctgggactacagg

SEQ ID NO: 14554 - DNA, 201 bp, Homo sapiens
cattatgtgtttataatcacttcctcagggaaaccttccctgacctctcagactaggtctcctattagattttgtcattgcaaattatattttttgctttyttccacatatcacagccctagttatttgtgtaatttttttgagacagggtcttactctgtcacccaggctggagggagtgcatctcagctcactgcagcc

SEQ ID NO: 14555 - DNA, 201 bp, Homo sapiens
ttgctctgttgcccaggctggagtgcagtggcgtgatcagctcattgcaacctcaaactcatgggctcaagtgatcctcctcccttagcctcccaaagtgytagtattacaggctaattctcgacaatcctttcaggtttcatctcaaatataatttcatttctacatgaatttaataagtatgtattcaggattcattat

SEQ ID NO: 14556 - DNA, 201 bp, Homo sapiens
ttttcttggtctggacacccctctcccttttgctccctaaactttatctgggtacatctttttgtgtatgtgtgtgtgtgtcggggtcttgctctgttgcscaggctggagtgcagtggcgtgatcagctcattgcaacctcaaactcatgggctcaagtgatcctcctcccttagcctcccaaagtgctagtattacagg

SEQ ID NO: 14557 - DNA, 201 bp, Homo sapiens
gtctcataaataaataactaaataaataaaaccacgtggaactaggaactcatcacgtaaccatcaatggcttcccatcattcttaggccaaagtccaaayccttaaacatagtctcttggacttcattatcatgggactggctacttccagagcccgattctgagaagtaacctatttttccctctctcatgctttacgt

SEQ ID NO: 14558 - DNA, 201 bp, Homo sapiens
atatgtatgtatgtatgtgtgtgtgtgtgtgtgtgtatatatatatatatatatatatatatatatatatatatatatacacttttttttttttttgagayggagtctcgctctgtcaccagggtggagtgcagtggcgtgatctaggctcactgcaacctctgcctccaggttcaagtgattcttctgcctcagcctccc

SEQ ID NO: 14559 - DNA, 201 bp, Homo sapiens
tggtggcatgcgcctgtaatcccagctacttgggaggctgagaggaaaatcacttgaacccgggaggcggaggttgcaatgagctgagatcatgccactgyactccagcctgagtgatggagtgagactccatctcaaaaataaaaaataaattaaaaaaaatgaaatatagtagtctctctctatatatagacagttaat

SEQ ID NO: 14560 - DNA, 201 bp, Homo sapiens
gaagctgaggtgggtggatcatttgaggtcaggagttctagatcagcctggccaccgtggtgaaaaaccgcttctaataaaaatacaaacattagccgggygtggtggcgcacgcctgtaatcccagctacccgggaggctgaggcaggagaatcgctggaaccagggaggcggaggttgcagtgagccgaaatcgtgccc

SEQ ID NO: 14561 - DNA, 201 bp, Homo sapiens
gattttaaatataattcaatatccctaacaaatctcaattcagacaggaaaaaaatgtattatgttgatttataaagcaggtaactttaataacgtatgtytggaacaaaatttatcaatttaattctatcagttattactaaaatttgaaatagtttttttttttttttaatttggtgcttgtagcttggaaatgaggga

SEQ ID NO: 14562 - DNA, 201 bp, Homo sapiens
ttagccctttaacttgcaaattagaaataacttagaaagattttaaatataattcaatatccctaacaaatctcaattcagacaggaaaaaaatgtattawgttgatttataaagcaggtaactttaataacgtatgtctggaacaaaatttatcaatttaattctatcagttattactaaaatttgaaatagtttttttt

SEQ ID NO: 14563 - DNA, 201 bp, Homo sapiens
aaattggccatgggctgggcgcagtggctcacacctgtaatcccagcactttgggaggctgaagcaggcgatcacctgaggtcaggaattcgagaccagcytagtcaatatggcgaaaccccgtctctactaaaaatacaaaaattagccaggcgtggtggttggcgcctgtaatcccagctactctggaggctgaggcag

SEQ ID NO: 14564 - DNA, 201 bp, Homo sapiens
ttaaaataagaggccaggcacagtggctggtgcctgtaatcccagcacttcgagaggccaaggcaggaggattgctttagcccaggagtttgagaccagcstggccaacacggtgaaatccccctactaaaaatacaaaaattagccaggcatggtggcgggtgcctgtaatcgcagctactccagaggctgaggcaggag

SEQ ID NO: 14565 - DNA, 201 bp, Homo sapiens
agctatgagattcagcaaatgattagatactaggagtagaacacacacacaatatgaaattgtttcaagtgattaaaataagaggccaggcacagtggctsgtgcctgtaatcccagcacttcgagaggccaaggcaggaggattgctttagcccaggagtttgagaccagcctggccaacacggtgaaatccccctacta

SEQ ID NO: 14566 - DNA, 201 bp, Homo sapiens
cagacacacacaaacaggctgataggagcctaaaaacaggtttacaggccaggcgcggtggctcatgcctgtaatcccaacagtttgggaggctgaggtgrgcggatcacctgagtttgggagtttgagaccagcctgaccaacatggagaaaccttgtctctactaaaaatacaaaattagctgggcatggtgacgcatg

SEQ ID NO: 14567 - DNA, 201 bp, Homo sapiens
aatggaacaaaatcctgaatggggcacatcactaagcgcttggctagttaagaagaccagtctggtcaaggcagtgtgtgtgtgtgtgtgtgtgtgtgtgwgagagagagagagagagagagacagacagacagacacacagacacacacaaacaggctgataggagcctaaaaacaggtttacaggccaggcgcggtggc

SEQ ID NO: 14568 - DNA, 201 bp, Homo sapiens
tgaggcaggagaattgcttgaacctgggaggcggaagtggcagtgagccaggattgcaccactgcactccagcctgggcaacagagaaagactccgtatcmaaaaaaaaaaaaaaaaaaaaaaaagaaaagaaagaaagagacaggaaaacaaactttcaaataccaatctgataaaaataccacttaaggaaataaaata

SEQ ID NO: 14569 - DNA, 201 bp, Homo sapiens
agaatgaaggaggcaagaacatatgaagatagctgggaggctactggaaaggtccaggcaagagagatggtagtagcttggacaaaggaagtagtgacaasactgagagaagcagacagattccaaagagaagaggtgactatgcaaatgtcactagtttgaattttaggaaaaaacattcttcacttgggattatagagt

SEQ ID NO: 14570 - DNA, 201 bp, Homo sapiens
gaaagtgacatttaagttaagatcctaataaccaatcccgcattgcacaaggaggagaagtaggaattaaccgagcaaaattgtggtcagggagggcttgkgggtagggagaacatcttggtggaagaaacagtatgtggaaagaccttggggaagggtggagcttgataaatttgaggaactgaaaggtgaccatggtgg

SEQ ID NO: 14571 - DNA, 201 bp, Homo sapiens
ggactacaggcgtgagccaccatgccccagcctcagctgtactttaaattagaacaatagagggcctctcttctctgatggcatccactataggagaaaaygcaaattatttattttaatagatatcatcgataacatttttatactggcgtggttggaaatatcttgcacacttgggctccctattgattgaagagaaat

SEQ ID NO: 14572 - DNA, 201 bp, Homo sapiens
cccagcctcagctgtactttaaattagaacaatagagggcctctcttctctgatggcatccactataggagaaaatgcaaattatttattttaatagatawcatcgataacatttttatactggcgtggttggaaatatcttgcacacttgggctccctattgattgaagagaaatccttttaatagcacagcatctagta

SEQ ID NO: 14573 - DNA, 201 bp, Homo sapiens
ctaaaagtacaaaattagctgggcgtggtcgtgcatgcctgtaatcccagctactctggaggctgaggcaggagaatcgcttgaacccaggaggcagaggwtgcagtgagctgagatcacaccactgcactccagcctgggcaacaagagcagaactctgtctcaaaaaaagaaaaaaaagaaaaagaaaaagaaaaatac

SEQ ID NO: 14574 - DNA, 201 bp, Homo sapiens
atttttgtatttttagaagagatggagtttcaccatgttggccaggctggtctcgaactcctgacctcaggtgatctgcctgcctcggcctcccaaagtgytgggattacaggcgtgagccaccacgcctggcctcagaatatatttgaatggacaagaatgtaacatatattttcagttgctattttagctctgaacgac

SEQ ID NO: 14575 - DNA, 201 bp, Homo sapiens
ctcctcccgtgttttcctttgttttatttttcttctttacctagaccatcaaatttcttttttacaaagcagtaactggcccgtaggtggcaccaaaggayggagagcccttcccacagacgaaagctctcccaggccaaggaaagccctttaaatgaggactttaattgaggtccaggagtcccaacaccaggcatttat

SEQ ID NO: 14576 - DNA, 201 bp, Homo sapiens
tgggaacaaaattcctctagttgagaactactacactggtttgttttgtatatgtgtgtgtgtgtgtgtgtgtgtatatatatatatatatatatatattwtttttttttttttaaggatcatgtctctaacagtcatagaccttttaaattagtctgaacatgatttatttcctattcctaatatgaagaggtgagtatg

SEQ ID NO: 14577 - DNA, 201 bp, Homo sapiens
aaatatacaaaaaatatgatatttacagttatatgtgcctgtgtgtcttaagtgtacactatgagttttaagaatacaccttttggtcaataaaataaaamataatagctgataactttttcatgcatatggtttaaaaagtgctttcacatataatttacctctttaatttttagaaggccttggattcctatggttctt

SEQ ID NO: 14578 - DNA, 201 bp, Homo sapiens
gagtgtccctactgtgtacaaaacactgcactagaagggtaataagcaacttcctgaacataaaacaagagcatggtggctgatgatgttaccctcttaaragatcaaagccaacttacaagattaataatatgtaggaatcaaaatgatgcatatgataaaagtggccacctcagcacttagaacaaatgaaatttatag

SEQ ID NO: 14579 - DNA, 201 bp, Homo sapiens
agggtgtgagtcagtttcagctcctctataagtcttatgtatggcttggggcaagtctcttaatctgtatttcaggtgtaaaatgaggatagcagtacacmttgtgaactatcgtagttgtaaagataaaatgaaagaccataagaaagtgcttcagaatacataaatgtcattatttttctctattcagaagggaataca

SEQ ID NO: 14580 - DNA, 201 bp, Homo sapiens
tagcattatttatttcaatgaaaagacaaatagcttttaaaaaattggacaggctagcaacttcatctcaaaggccttatattttgcacatacagcatatmcaaacacacacagacacagacacacacacacacacacacacacacacacacacacacacacaaaggttttttttttttttccatgccatacacaatgcta

SEQ ID NO: 14581 - DNA, 201 bp, Homo sapiens
tatttatttcaatgaaaagacaaatagcttttaaaaaattggacaggctagcaacttcatctcaaaggccttatattttgcacatacagcatatacaaacmcacacagacacagacacacacacacacacacacacacacacacacacacacacacaaaggttttttttttttttccatgccatacacaatgctaaaatat

SEQ ID NO: 14582 - DNA, 201 bp, Homo sapiens
tttatttcaatgaaaagacaaatagcttttaaaaaattggacaggctagcaacttcatctcaaaggccttatattttgcacatacagcatatacaaacacmcacagacacagacacacacacacacacacacacacacacacacacacacacacaaaggttttttttttttttccatgccatacacaatgctaaaatatct

SEQ ID NO: 14583 - DNA, 201 bp, Homo sapiens
ggcgtacaattttaaccaaatgatacgttcacaaattcttcttcaactcagcatcggtatggtcaccagagtgagtaaagctggaatttaatgtccttgaytgatttaatcaagcccatgcttcttgataggcaaagataattaatcttgttctaacgtccagtgaaaaaatagcattccctggaaggataataatggatg

SEQ ID NO: 14584 - DNA, 201 bp, Homo sapiens
aaggaagtcgtaaaatagtgacacacacataagcacacctttacacagcggggtgcggggggatgtatctaaaaatggctcttatccggtgatgagaaacstttgtatagactcccacactttctacgctgtggagaagggatcagcagacccaccactctcctttgttttgttcatttcaaaattattaaattattgtcg

SEQ ID NO: 14585 - DNA, 201 bp, Homo sapiens
tcacccaggttgaagtgcactggcaccatcttggctcactgcaacctctgtcctccccaggtttaagcaattctcctgccttagcctccagagtagctgarattacaggcgcgtgccaccacgcccagctaatttttgtatttttagtagagacagattttcaccatattggccaggctcgtctcgaactcctgaactctt

SEQ ID NO: 14586 - DNA, 201 bp, Homo sapiens
tccctttcttctatcttcggtgcctctgactctgccctggctccatctctactgcatttaaagatgaagaagcctgccttatatttatggatctctctacrtgctgcccactcttacttttccttcttaacccaatttctgaatcttaacataattattttttcctgtctccctcttatcaactcccatgaattatacaac

SEQ ID NO: 14587 - DNA, 201 bp, Homo sapiens
tgaggacacgtagtggccggtctcgtcgaacaaagtcatgctgattgagggaggaggaaaaaataaactgataatgaagaaatgtccttaggtgcaaggtmcagatataaaaggaaatagagaatcataaaatagttctatggatattacagaaataacaaaatatgattttcatgtcatgtgtccttccatattttgtaa

SEQ ID NO: 14588 - DNA, 201 bp, Homo sapiens
ggttcacatgtattgctgcaaatggcaggcccactttcttaagactatatataaaataaatattataaataaacaaatatataataaatatatataataawatattcagtcatatatattattgagtcttaaatatctatatcacatataccataatttcttttatcctttcatccactgatgaacacataggatgtttcc

SEQ ID NO: 14589 - DNA, 201 bp, Homo sapiens
tttttctttttcaaagtgagaaaatttgggccctgagaagttaggtgatttccatagctaattagtagaagagctacggctgcaactcaggctttaaaaawttttttctgccaggggtgtgggtggtggtggttattttctggtgtcctactaccataattatctttctaaaatacaggtatgatcattcattgcaacaga

SEQ ID NO: 14590 - DNA, 201 bp, Homo sapiens
gcctgtaatcccagctactagggagggcgaggcaggagaatcgcttgaaccagggaggcagaggttgccatgagccgagatcgtgccattgcactccagcmtgggcaacaagagcgaaactccgtctcaggaaaaaaaaaaaaaaaagaaagaaaatcacccgaaattctaccatctcgaaataaatacataaatattaag

SEQ ID NO: 14591 - DNA, 201 bp, Homo sapiens
taccttctactgtatttttccttttggaaatttgtgagacctatttaaaatgaagaacatacagcttctttagccatgcaaaataaataaataagtatttkgggaggggcctctttaaattcaatatttaccatcagcccttttaccagtttctccagtccctcattcattcttcctgcttgccttcctccctctttttct

SEQ ID NO: 14592 - DNA, 201 bp, Homo sapiens
aagcagtaatcaacaaatctcctaaaggagtctgtcctgtgtgtgcaaatacacaaaagaaaataaactcagggtctgtagagcacactgattacttaaarcaattttcattcaagggaaaattttgcatttaaggagattttaaaaaaatgttttggaatatcaggataactggagcattttcaagttacgatatctaaa

SEQ ID NO: 14593 - DNA, 201 bp, Homo sapiens
gcctttttcattttgattttttgacttctgacaaactcaaaatgtgcagtactgaatcagcttgcttgctttccttccttccttccttccttccttccttytctttctttctttctttctatttttttgagacagagtttcactcttgttgcccaggctggagtggaatggcgcgatctcggctcactgcaacctctgcct

SEQ ID NO: 14594 - DNA, 201 bp, Homo sapiens
tagttacgagcgtaataaatacctcccgaatgttctgctgctccacctcgtgccgcttgatcattattttccgcttgaagaaacgacaatttttgtcgtartacagtctctgttgagtgagaaggtgggcttcctcttcagcctgtgtgtgctgcaagttctctttatgtttggagatccgctcttgcttctctttcttgg

SEQ ID NO: 14595 - DNA, 201 bp, Homo sapiens
tgtgaccttcccccttatccccccaagccagtggttggcacactacagcccatgggccaaatctagcctggtgcctggttttgtaaatatatatatatatwtttttttgagatggagtctcactctgtcaccaggctagagtgctgtggtgtgatctcagctcactgcaacctccgactccctggttgaagcgattctcct

SEQ ID NO: 14596 - DNA, 201 bp, Homo sapiens
tcagcaattgttattgttgttgtccatcctatggagtaacaagtttaaatgacgggtcttcagctacaagacaaatttgaggccaggcatggtgactcacrcctgtaatcccagcactttgggaggctgaggcaggtggatcaccttaggtcaggagttcgagaccagcttggccaacatggtgaaactctgtctctacta

SEQ ID NO: 14597 - DNA, 201 bp, Homo sapiens
gaggctgaggcaggagaatggcatgaacctaggaggtggagcttgcagtgagctgagatggtgccactgcactccagcctgggggacagagcgagactgtytaaaaaaaaaaaaaatccactagaatttatttgttccaagctctacaagattaagaaaagaaacaaaaccctgtgtggattttacaaatttagaacattg

SEQ ID NO: 14598 - DNA, 201 bp, Homo sapiens
gggaggctgaggcaggaggatcacttgcatctgggaggccaaggttacagtgagtggcgatcctgccattgcactccagcctgggccacagagtaagcctytgtctgctaaaaaaaaaaaaaaaaaaaaaaagagagagagagagagagagaaatgaagaagtcttgcaatatttgcatatcaacttcagatactgtttct

SEQ ID NO: 14599 - DNA, 201 bp, Homo sapiens
ccaagagcaaaaaaatttttaatcaggttggaaagggaagaaaagtaaaggtgttatataaaattcattgtaggcacagtaaagtgactccttctcccccytgttttcttttgacatcatgtgacaattttaagagctcttttctcacagcagagaataaggaatatggattatgagaagaaaaattttttatgaaaagaa

SEQ ID NO: 14600 - DNA, 201 bp, Homo sapiens
tgaatgaatgattgcatcaatcaatcaatagaagggatgattaccaccaaatggttacaatacagtacaaaaggtgtttatgaaaacagaggaagtgggcygggcttggtggctcaggcctgtaatcccagcactttgggaggccgaggtgggcggatcacaaggtcaggagctcgagaccagcctggccaatgtggtgaa

SEQ ID NO: 14601 - DNA, 201 bp, Homo sapiens
gctgaggcaggagactcgtttgaacccaggaggcggaggttgcagtgacctgagatcgcaccactgcactccagcctggggaacagcagcgaaactctgtytccaaaaaaaaaaaaaaaaaaaaaaaaaaaagcctgtatggttgtaattaattgagcactcaaatttagttcttaaaacattttctttcccctctttgaa

SEQ ID NO: 14602 - DNA, 201 bp, Homo sapiens
ggaggctgaggcaggagactcgtttgaacccaggaggcggaggttgcagtgacctgagatcgcaccactgcactccagcctggggaacagcagcgaaactytgtctccaaaaaaaaaaaaaaaaaaaaaaaaaaaagcctgtatggttgtaattaattgagcactcaaatttagttcttaaaacattttctttcccctctt

SEQ ID NO: 14603 - DNA, 201 bp, Homo sapiens
tataaacccccttgcagtcggagtctagtctatgttatttttaaaaattgaaataaaatgtatactacatatgaaatgaaaaaaaattttttttttgagayggagtctcgctctgttgcccaggttggagtgcagtggcatgatctcagctcactgcaagctccacctccgggttcaagcgattctcctgcctcagcctcc

SEQ ID NO: 14604 - DNA, 201 bp, Homo sapiens
aggaggcagaggttgcagtgagccgagatcggcaccactgcactccagcctgggtgacagagcgagactccgtctcaaaaagaaaaaaaagaaaaagaaaraaataggtcgggcatagtggctcatgcctataatctcagcactttgggaggctgaggcaggtagatcacttgacgtcagcagttcaagaccaggctggtc

SEQ ID NO: 14605 - DNA, 201 bp, Homo sapiens
agggcgagactccatctcaaagagaaagaaaaagaaaatcaaatttaaaaatatcatggtagcataaaaaatgtgaaatatggccgggtgcggtggctcaygcctataatcccagtactttgggaggctgaggtgggtggatcacttgaggtgaggcgttcaagaccagcctggccaacatggtgaaaccctgtctctact

SEQ ID NO: 14606 - DNA, 201 bp, Homo sapiens
gatatatgtgttatttacatttagatcttaaaatatttccagaataatattattataatactattgataggctaggtgcagcggctcacgcctgtaatccsagcactttgggaggctgaggcaggtggatcacctgaggccaggagttcaagaccagcctagtcaacatggtgaaaccccatctctactaaaaatacaaaa

SEQ ID NO: 14607 - DNA, 201 bp, Homo sapiens
caggagtttgagaccagcctggccaacacggtgaaatccccctactaaaaatacaaaaattagccaggcatggtggcgggtgcctgtaatcgcagctactycagaggctgaggcaggagaattgcttgaatctgggaggcggatgttgcagtgagccaagatcgcaccactgcactccagcctgggtgacagagcaaaact

SEQ ID NO: 14608 - DNA, 201 bp, Homo sapiens
tataacctcaaaatcctgggctcacgtgatcctcctgcctcagcctcctgagatgctgggattataggcgtgagccaccatacccagctccacattttttycccttttatggtagtaatttttatgtcttggttttttgtttgtttgtttttaagatctttgtgtacttcaaggtaataaagatattattgtgtgtttctg

SEQ ID NO: 14609 - DNA, 201 bp, Homo sapiens
cttcttcctatccccttggaatgggtagtacacaatgtggtaagaggaagggcataaataagatcggtggatttcatccctgtgttccctggtactttctraatacttctattattataacgctgattttattatctatacataatgccatgtgttgttgtatctctttccatgatcactttctggtgaagctatgaatga

SEQ ID NO: 14610 - DNA, 201 bp, Homo sapiens
tgtactatcaataaataaaacatgcagtataaaatatctcattgtactctgttttgggacatttgaaaccccagttagaaattaaaaagtcatctgggctytacagctcacacctgaaatcccagcaattttcccggctgaggcaagcagattgcttgagctcaggagttcgagaccagccagggcaacatggagaaaccc

SEQ ID NO: 14611 - DNA, 201 bp, Homo sapiens
gcagtgagccgagatcgtgccactgcattcaagcctggtgatgacagagcaagactctgtcataaaaaaaaaaaaagctcaaaaagcattttgattttatkgcttatgtctgagaacaacaaaaaaagaatcaatggattaaatcaaagatatacctttttggagactatacgtaaaagggaaattatgagactatcttta

SEQ ID NO: 14612 - DNA, 201 bp, Homo sapiens
aaaaaagctcaaaaagcattttgattttattgcttatgtctgagaacaacaaaaaaagaatcaatggattaaatcaaagatatacctttttggagactatmcgtaaaagggaaattatgagactatctttaagaaaatcaaaaagacctatgaactaaacttatgataattaaaatattttcaatcaccaaaacacattat

SEQ ID NO: 14613 - DNA, 201 bp, Homo sapiens
gtaaagatgcaattcataaaataatctcatttggaaggacaactaaagataagccctatccagatggcagaacataaaggaccacttaaaatggaagagtmagtaatgtttgattacaaagaaattatttgattacaagtttggagaagtaggtaataattagtacttaatttattatttgctttaatggactattatgct

SEQ ID NO: 14614 - DNA, 201 bp, Homo sapiens
tactaacttgtttatttcagtttaggtatacaactgtctctatctcacctcatgggtctgcttcccactataggacatcttcttaattgccaccacctcaytggtgtgagcatttgtagcctgtgttaagagggtagaagaaaaagaaaaagaattagtgatgtttcagccaatttaacttaaatatttgactagagacta

SEQ ID NO: 14615 - DNA, 201 bp, Homo sapiens
gaaaagattggtaacatgtttctctagaagttaatggagggagggaggttgcagggaggagagtgtggttgtggtagagaaaatacaaggcagagaaaagycctagaataggagtcaagaaacttgagtttcaatccttaacatattacttaaattctgtgaaactctgggcaagttaagtctttctgagccctggtctct

SEQ ID NO: 14616 - DNA, 201 bp, Homo sapiens
tgtacttttgcaattttatttgttcaccaaatattcaatgttatgattttgagatttatccatgatgatacatgtagatccagttcattcttaactatgayacagtattccataatttatacattctcctttggataagaatttaggctagttctaccttttctggctactataaaaacagttgcacccttgtacacattt

SEQ ID NO: 14617 - DNA, 201 bp, Homo sapiens
acaaaagaaaataaactcagggtctgtagagcacactgattacttaaaacaattttcattcaagggaaaattttgcatttaaggagattttaaaaaaatgytttggaatatcaggataactggagcattttcaagttacgatatctaaaattcttttggataatgagtgaggacaagtttcaagttagtcaacatattaat

SEQ ID NO: 14618 - DNA, 201 bp, Homo sapiens
tactctatatagttatcatacaccttcactgcctgaggatttggcaacaacctaactgaaaatcccagagttggtgtttgaaccaccggccagctctgtcytgagaccactggattaatgtttatgcagatgttaggcccaggaacatcacaatgatgactagagcaaggaggagaaatattatttgttataaggcaaaaa

SEQ ID NO: 14619 - DNA, 201 bp, Homo sapiens
ctatgtaaatgtctactctatatagttatcatacaccttcactgcctgaggatttggcaacaacctaactgaaaatcccagagttggtgtttgaaccaccrgccagctctgtcttgagaccactggattaatgtttatgcagatgttaggcccaggaacatcacaatgatgactagagcaaggaggagaaatattatttgt

SEQ ID NO: 14620 - DNA, 201 bp, Homo sapiens
aggttcctgaagaactaccagtctagagatgtggtgatgttcttgttattgaaaaaagtagtgtggcaacactagccagggggaaaaataagtacctaaartttattttgtcagaatatgcctttagccttatcaaatcattcttgctcaaaaagaagactggattgggccagtcgcagtgcctcatgcctgtaatcccag

SEQ ID NO: 14621 - DNA, 201 bp, Homo sapiens
gcctctgcataaggctgtgggctttttgaaggcagagtaaatgtcgtttgaaaaatcttagtctccctagcacctggcatagtgcttgatacttagtaggyattcagtaaatgtttgctgaataaacaaacacaagaatataggtctgaggagattttgagaaaatgacattttcttttggattatttaacagaattcaaa

SEQ ID NO: 14622 - DNA, 201 bp, Homo sapiens
ggtggcttataaaacttgtaagtttttaaaacttataagaaaatatttgaaaggtcagttaaaattattctacatgatttctcgcgaaatttgaactcctrttttacagggaagagcgagaacgtgtgtaattgggattcattcactaggcttaaggttctaaagaggaaggcactgggacctgctaccatttacattact

SEQ ID NO: 14623 - DNA, 201 bp, Homo sapiens
agaggtcaggccgcgcaggtctcttgatcattccaagatctttgtcctgcagccagccccaccagcccctccagctcctccagcccatgcgtttcacttcrgagatgtttcatgacataatccggctccggagtccccccggagtcccgggggctcacactccaccctcagggaggtcgctgatgccagaccctgggagca

SEQ ID NO: 14624 - DNA, 201 bp, Homo sapiens
ctgtcccccaactcccaccccctattgcttcccactatttgtttcaaccttttaatagatacacttgcctcccaccaggacacacagtgtctggtttaaawaggtttatctctctccttagcttgtcctggaattacgcctaaagctcaatcctggcagcttttaggataagaaatctaattggagagagctcttagtttt

SEQ ID NO: 14625 - DNA, 201 bp, Homo sapiens
tccctaaacagtgcttctcctctacttattattaccctgataaaaataacttcagtaatttttgtcttggatttacatagcagttatatgtaaggcatctrcattatatatttaggaaataatacaacattcctttattcctcttagttgaaactgcctatattgaacactggcaaaagacttctaataaaacacattcta

SEQ ID NO: 14626 - DNA, 201 bp, Homo sapiens
ttatttctgaagaaaagatatgggataagaattagctaaatacacaatattatgtgtgtttttgtgaggggggagaaaaaaaataatttcttttttttttytttttttttgagaacgggtctcactcttgttgcccgggtctcactcttgttgcccgggtctcactcttgttgcccaggctggagtgcagtggcgcgttct

SEQ ID NO: 14627 - DNA, 201 bp, Homo sapiens
aaatggcctcagattaataacctaagtttctaccataagaatcctagaacaggaagagcaacataacccaaagtaagcagaaagaaagaaaaaataaagamcagaaatctattaaattgaaaacaggagaaaacatgagaaaaatcaatgaaatcaaaactagttatttgaaaaaaaaatcaataaaatttgtaaacctgc

SEQ ID NO: 14628 - DNA, 201 bp, Homo sapiens
gagatatgggaacagacagattttccttaactatgatgacctctcaaaatatttggaaaacacagcattttttttctacaagtgaaaattccaatatcacractaccattttgtaaacttcataaatgcacacagatctcaggggaagatgagtggaaccgtgcactattctatcttcagtaccaccactccattttgact

SEQ ID NO: 14629 - DNA, 201 bp, Homo sapiens
tagtgcagaatattagtcactcaagacatgttggataaatgaataaaaaatggaggaacaactattcaatgctgataactgataaacttggtattaaaaaragatatgggaacagacagattttccttaactatgatgacctctcaaaatatttggaaaacacagcattttttttctacaagtgaaaattccaatatcaca

SEQ ID NO: 14630 - DNA, 201 bp, Homo sapiens
taagaatccaaaagaactagtatctattcagataataatatttacactgaatattagtagtactcccagtcactcaggaggctgaagcgatccttccggtwtgttatgggggaaaaatagtaacaataatgaagactataagcacgcaccaccacaaccagctaatttttaaattttttgtagagatgggctctcactgtg

SEQ ID NO: 14631 - DNA, 201 bp, Homo sapiens
cattgttgtaccatagatactggatttgtggacggactagatttagagtttgaaaaaacgtaactgaggatgattcctcaaggcttttggtcagagtgacyggaaaaatggaactaacatcaagtaagatagagaatgatccaggtgaagaggctggggaaagattaggaattaagcttttgatatattgaggatccaagt

SEQ ID NO: 14632 - DNA, 201 bp, Homo sapiens
agaaaaatccaagatgtaaacacctttagcctctgcaaattttacctgccactgatcaccaaatacacaacagcactgtgagagctctgtatttataactkttgactccctcctacaggattacaatgccaggcactggagataacagaacatgcagaaataaaagcttagaaaataaaccttcatacagctaatgaagga

SEQ ID NO: 14633 - DNA, 201 bp, Homo sapiens; identical to SEQ ID NO: 4631

SEQ ID NO: 14634 - DNA, 201 bp, Homo sapiens
gctcacaattcctggcttatattttatttcccttagaactctgcaaacactgttctattgttttctggctttgactgttcctgaagaggtaggtctggagycagttggtttttccaccccaaaataaactttttcagtctgcttgtatgaatctttctttattcctagagttcagggacttcaccaggatatgatttactg

SEQ ID NO: 14635 - DNA, 201 bp, Homo sapiens
ttatttaccaaatgagccatcatttccccattgatctgtaacggcttttgtgtcttataccaaaatctgactcatactagagtttcctagtctgttctacyggatactagtctttccctgcaacaataccatatggatttaattaatatggtatggattctggggcagtgattcttctgttcaaattctatttctccaaag

SEQ ID NO: 14636 - DNA, 201 bp, Homo sapiens
aggctggagggagtgcatctcagctcactgcagccttgacctcctgggctcaggtgatgttcccatttctgtctcctgagtagctgggattataggcatgwgccattaagtccagctacttttttggctttttttttttttttttttttttttttagagatggggttttgctatgttgcctaggctggtctcaaactcctg

SEQ ID NO: 14637 - DNA, 201 bp, Homo sapiens
agtgcatgcaaaagaagtaaagcctttttttttttcatcattttttattgtaagaaaatacacagtttgaaagtgtgaataatgcaatatttatgaccaaraaatgggacttaggaaggggaagggagataaagaaaaagatcaagatgatctgattgagagacagtgttgaactccaaatactgaactggaaaaggaggg

SEQ ID NO: 14638 - DNA, 201 bp, Homo sapiens
aaagcatctcctaacaggcacccacgtgcacgcgatacacccataggcacacatatgacatgcacacacacataggcacacacatgaagtgcgcgcgcgcrcacacacacacacacacacacacacacacaggaactacgggaggaccgaggaaggctggctgagtcctgtgatcaatgcatctaaatcattatatttaaa

SEQ ID NO: 14639 - DNA, 201 bp, Homo sapiens
tggaggtaggctcctgggcttgaattacagctacaccatccactttgtgtgtgtcacaccttggcacattacctacctctctagatctcatgtgtttcatyctcaagaaaataacaagaatagttcctattgcctgagattggtgggaggattaaatgaaagaattaatataaaatcctaggcacagttctcaatgcatta

SEQ ID NO: 14640 - DNA, 201 bp, Homo sapiens
cggtttcaactgatcatgtccttatttcaagttctttaaccctaaaatcatttagatatgcttagctctaaaaaattgattccaatttccataaaacttgrggaatataccacagtactgttatgctccaagtagtaatgttggcacctattgttggctataaaagttacattgctagccagccaatccaaaactccaaat

SEQ ID NO: 14641 - DNA, 201 bp, Homo sapiens
tatctgtcttcctcacttgactgtgggctccctaagggcagggactcttattcatttgtgcctgatattagttgcggggagggcagtcagtaaaatctttsataaatgaacacatggtatcatatgtggtatctatcacatttgccctcaaagtccctatgtgccacaggtctgatgtggcatgtcactccttgagttcca

SEQ ID NO: 14642 - DNA, 201 bp, Homo sapiens
agagaaggtagagtatattattttgagcccagaaggcattccatcaggttgccccacagtcatgtgtgcacttcacgaacactctgaggacttatggtgayagaaatcattgcttagcttaggatttgactgaagagacgcatagccagtgtgatccaggttggcctcatatctgtggcaacactgacaacgtcctcccgg

SEQ ID NO: 14643 - DNA, 201 bp, Homo sapiens
ttgagcccagaaggcattccatcaggttgccccacagtcatgtgtgcacttcacgaacactctgaggacttatggtgatagaaatcattgcttagcttagratttgactgaagagacgcatagccagtgtgatccaggttggcctcatatctgtggcaacactgacaacgtcctcccggatatatagcaatggcttagtac

SEQ ID NO: 14644 - DNA, 201 bp, Homo sapiens
tataatataaatttatatataaaatataaatatataaaatataaaatatctgtgttataagtaaaatataaaataagtaatattttataagaataaaccamaattttacttataacactgagaccattgtagcaactcctcagttatgaccctaaaggtactatgacctctaaaagtagcataattttatatggcctaaaa

SEQ ID NO: 14645 - DNA, 201 bp, Homo sapiens
aaatctgatgtgatgatgatcttgaatcatcataaaagggtatatgtagtttgtacaattgaagaagattggaaagggaagaatccatgtcaaatttcggmaagattttggtaagaaaaaaacttgttaagaaaaaacttggtaagaaaaaactagttaaaaaatgggtaggcactaacagtaaaattcaacacaagtggc

SEQ ID NO: 14646 - DNA, 201 bp, Homo sapiens
gctcttttttttttttttcctttttttgcaaaatgactcccccttatctggaatcagagagagtgttgaataaggcataagcacatgacccaatcaagttmtatctctcctaggaattttaatctcgaacagaaacgatacaaagacaaaaagtggttggaggaggtacactgaaatggcagtgcctggagaactgcacat

SEQ ID NO: 14647 - DNA, 201 bp, Homo sapiens
acatatgtatatagaaaaaaacctagaaatatacatgccaaattaatggagactgtttgagggtagagattgggtggaatgggattgtcgaaaaggtgaaratgggctgatgctggtcaaatggtagaaagttccagttatgcaagacgaataattactggagctctaatgcactcactgcatggtgatgatagttaacaa

SEQ ID NO: 14648 - DNA, 201 bp, Homo sapiens
aaaacctcatctatctcttactatataattgaccttgggcaaattacttaacctcttaaagtctctcagtttcttaatgtgtaaagagagaggaactaccmctgtcttcctcagggtcggaggactttctcatgtgaaagtgcctagcagggtgtctgactcctaggaaatgctcaacacatgctggtttccttccttctg

SEQ ID NO: 14649 - DNA, 201 bp, Homo sapiens
tactatataattgaccttgggcaaattacttaacctcttaaagtctctcagtttcttaatgtgtaaagagagaggaactaccactgtcttcctcagggtcrgaggactttctcatgtgaaagtgcctagcagggtgtctgactcctaggaaatgctcaacacatgctggtttccttccttctgatgccaggctctgcgaag

SEQ ID NO: 14650 - DNA, 201 bp, Homo sapiens
ttatacaattgtaataaaaagttacaatgctaaagttttctcaggatttcatctggtatcaaagtttatagtccttccttatcctttgttacaaatccaastgtgcagcagtgcataatacaaaaatctcagttataaggtgccaaaataataaagacatgtagcaatacagacccaatgcccatgggcttcttcatatac

SEQ ID NO: 14651 - DNA, 201 bp, Homo sapiens
aattcaacttaatattacagtgccagaaaagcaagcagctcttaaatgccagtaatcaaaagagatatgctaggtagaggcctgtgattttataggaggcyttaacaagtcgtagttttggtgaatattaattggctaacttaccaagtacattgatagagggggagacctcaaatacatgggcaacagttcagtttcaca

SEQ ID NO: 14652 - DNA, 201 bp, Homo sapiens
taggtagaggcctgtgattttataggaggccttaacaagtcgtagttttggtgaatattaattggctaacttaccaagtacattgatagagggggagaccycaaatacatgggcaacagttcagtttcacattgtaataacttgatttataaggataaccaatgacactagaatccacattctccacagggcagaccaaaa

SEQ ID NO: 14653 - DNA, 201 bp, Homo sapiens
aaaaagaaaaaaagaaaaaaaagaattttttaaaaactgattttttaaaaagtttaacatttttgatttaaaatttatgaaaatatgtagataaaggcagyattatgctgtagctagcacatactggctttggaaggcccattgtgcacatctttccccattttcacatttagtgaatagcattggctatagtaagagtat

SEQ ID NO: 14654 - DNA, 201 bp, Homo sapiens
ataatgaaagttaatttaaaaactgctgaaaccaactaaacaaccaatcaaggaactaagaatactaggtgaataaatattctgatctacccgaacttggrctgaatttttgtcatctggcactaattgatttttataattttcatcatctcagtttttattatttcttgtttgaaattggcctaaagattattgggggac

SEQ ID NO: 14655 - DNA, 201 bp, Homo sapiens
tttaaaataatatctccatactgcagtatcacagttcaaagatgcttcactttttgataggctaaatagacatctccactcccattttaatgtatagtttmtctatattcttttctggatacatgtaaagattgtaatataaaaaatgattagggtttaatatatcaaaccaaacaaaaaatgtcatattcccaaatgacc

SEQ ID NO: 14656 - DNA, 201 bp, Homo sapiens
tttcaccatattggccaggctggtctcgaactcctggcctcaagtaatccgcccgcatcagcctcccaaagtactggaattataggcgtgagctactgctsccagcctcaacttatttaaaatatttaaaactattagttttcttaaaattttcataaaaataaatacaagacattaaaagattacctctgcatcagtgcc

SEQ ID NO: 14657 - DNA, 201 bp, Homo sapiens
ctcgaactcttgacctcgtgatccgcctgcctcagcctcctaaagtgctgggattacaggcgtgagccactgcgcccagccgaaattagcacccttttcakccagaaaaatcttttattgtatttaatgacaaaatatacttcagtgggagccaagttattgatggtagtgagggaagcagaagtaatggtagggctgagc

SEQ ID NO: 14658 - DNA, 201 bp, Homo sapiens
cgaactcttgacctcgtgatccgcctgcctcagcctcctaaagtgctgggattacaggcgtgagccactgcgcccagccgaaattagcacccttttcagcmagaaaaatcttttattgtatttaatgacaaaatatacttcagtgggagccaagttattgatggtagtgagggaagcagaagtaatggtagggctgagcat

SEQ ID NO: 14659 - DNA, 201 bp, Homo sapiens
aaaaaacgagaagaaaaagaaaccaagaaaaaaaaattcaaaaaaagaggtaaagaggaaagggaaaagaaaaagaaagaaggaaagaagaaagaggaggrcaaaaaaaaaaaaaggtagaaagagccagaaaggggcagaaggttaaaaaggcaatctcagtgaacgatgatcctttggtttgacagtacccatttatct

SEQ ID NO: 14660 - DNA, 201 bp, Homo sapiens
gttttgaatctactgctctgacagccactaccaccagccttgtccatatcctatttcctgctactagtctcttctctctaatcctgtgtttctcaagcagtttttttttttcatcattgcccctataaggaggctttctaggctttttctcccttaattatccccatcactgaaatattaataccacaggtaaactgtgta

SEQ ID NO: 14661 - DNA, 201 bp, Homo sapiens
tttttgtttttattgttgttttttttttttttgagacagagtcttgcactgtcaaccaggctggagtgcagtggctttgatctccgcttactgcaatctcygtctcctgggttcaagcgattttcctgcctcagcctcccaagtagctgggattataggcgcccgccaccacgtccagctaattttttgtatttttagtag

SEQ ID NO: 14662 - DNA, 201 bp, Homo sapiens; identical to SEQ ID NO: 4626

SEQ ID NO: 14663 - DNA, 201 bp, Homo sapiens
atggattctggggcagtgattcttctgttcaaattctatttctccaaagttgttttagctaattttggtcctatgacttctgggattaccctgtgaagtgkttttttttttttttttttttttttttttgagacagagtcttgctctgtcacccaggctggagtgcagtggtgcgatctctcactgcaagctctgcctccc

SEQ ID NO: 14664 - DNA, 201 bp, Homo sapiens
tgaccctgactatcctcccgctttccctcaacaagcatcctatactcttgccatagcaattactcattgtttctcaaatgtgccatcctctttcacgtctytaagtctttgcatatactgtatcctctgtcaggaacaactttttcttttatgcctatttggtaaactattactctttaagactcatctccttgggaaagc

SEQ ID NO: 14665 - DNA, 201 bp, Homo sapiens
ttccatcaggttgccccacagtcatgtgtgcacttcacgaacactctgaggacttatggtgatagaaatcattgcttagcttagaatttgactgaagagaygcatagccagtgtgatccaggttggcctcatatctgtggcaacactgacaacgtcctcccggatatatagcaatggcttagtacacagagcttgttaatt

SEQ ID NO: 14666 - DNA, 201 bp, Homo sapiens
ataggagaaaatgcaaattatttattttaatagatatcatcgataacatttttatactggcgtggttggaaatatcttgcacacttgggctccctattgaytgaagagaaatccttttaatagcacagcatctagtactagagtacagtcactaatcattcacttattcattcaacaagtagttattgagcacctactatg

SEQ ID NO: 14667 - DNA, 201 bp, Homo sapiens
gaaagctctcccaggccaaggaaagccctttaaatgaggactttaattgaggtccaggagtcccaacaccaggcatttattcatcccacactttcctaaaytgagaaatgcaaactgagcctgagttgctaagagccctgaaactcatgggctcttgacacaaagcaaaacacacaaagcaagcaaacaccttcagaagaa

SEQ ID NO: 14668 - DNA, 201 bp, Homo sapiens
tccaactgtgcagcagtgcataatacaaaaatctcagttataaggtgccaaaataataaagacatgtagcaatacagacccaatgcccatgggcttcttcmtatacttgtcagtaacctcattcaaaagcacaatgttgaaagtgatactaagggggaaaagcacaaagccaggcctcttttaggcttatgttgaagaagt

SEQ ID NO: 14669 - DNA, 201 bp, Homo sapiens
gaaatgaattttaatattcagttccactgcataaaacaggttcaaaactccaaagacagcttatgaagctatttaaaaatgggagaatgtaacttgagaartaagctcaaagaaattaaagtatcaactttactggaaatattttctgttggttatactgcccctttaagtaacagtgcctctgtaagagaccactatacc

SEQ ID NO: 14670 - DNA, 201 bp, Homo sapiens
gctattttcccctaaagaaacatggaattgttgctaagtagttcatgtttaaaacatgtaagggctccacaacaaaggagaacaagatcaagctctttgtyctgttgcttctcttaccatactcctgtggcctaccgctcacaagaagtaaaaacttgtcacctagccaaggtgttcttaaattataaaggcaaacatttt

SEQ ID NO: 14671 - DNA, 201 bp, Homo sapiens
tttatctgactgcagagtctatgctctttagcacaatttgacactatcacttatcaatttgcagaaatagctgtcatagaggattagacaatttgggagarggctactttgtcctttagttcagtaaatcattttataaaatgcaatcaaaggctgatacagagagcatgtagttatacatatttcaattcatttttataa

SEQ ID NO: 14672 - DNA, 201 bp, Homo sapiens
agattggaaagggaagaatccatgtcaaatttcggaaagattttggtaagaaaaaaacttgttaagaaaaaacttggtaagaaaaaactagttaaaaaatrggtaggcactaacagtaaaattcaacacaagtggcacattcttttaaaagatcgtaactgaggtgttgctatgatggtctcagtgttataaggaaaattt

SEQ ID NO: 14673 - DNA, 201 bp, Homo sapiens
aaccttaactacacaatttaaagtcattgtaaattttatacaaagccagagtgtttctttttatgccagtgggctttctatccttctcaaatgaaacctcrttttgaggcatattggtaagacactgtcacaaaaccaagccaaaccagcaccatagttgagttcatgtatgcagattttaaaactatgtcatatagccta

SEQ ID NO: 14674 - DNA, 201 bp, Homo sapiens
tcatcagcaacaaataatatatatttagtgcctactgtaaatgagatcgtgccagcctttagagttgtaaacaaatattagaaatagtcctcaccttcaamaacgcacacactctagctaaatagacagggcttagcccaaaaagcaaataaaccactaggtcttctgcagcctagtacaacgtaggtctcattttgccac

SEQ ID NO: 14675 - DNA, 201 bp, Homo sapiens
gaagctggtgttgagccaaggaaaattgcaaaagaccctttaaaccatattaagaagtttagactttatcctgagggaaaggggaaccactgaaggtttayatgggaaaaaggatccctccgccaacaatgcacctataatcctaggcagtcatcctgccaatccatggatgccaataatcaagtataaagttactacatc

SEQ ID NO: 14676 - DNA, 201 bp, Homo sapiens
aattaaagaatcaataattgctcatgtggtagttttacatatttacaaatgtaatattacaaagttaaaattttatcttcatctgtttgtggatggcaaasttaaaaggtaagatgctcaaaacaaagatgcaagctactctttcacaggcaatatctgggaaacaaatgtgtcgttagatttaagaatctatactgaagc

SEQ ID NO: 14677 - DNA, 201 bp, Homo sapiens
ccgattctgtctgtggctgtggaatgcttcagattaactggtagctaaaacttgcctgaattcagcatcacattttacctaaccactaaccaatcaataaytgcaatgtttgcatgtctactctgctaatgtagtctgactatagctccaataaactaaaatattccttatgacatcatatgaacactagttgctaaattt

SEQ ID NO: 14678 - DNA, 201 bp, Homo sapiens
cagagtgagagactccgtctcaaacaaacaaaactgtaataaacctcttatggcttttatacaacttatatgaaacaaattcacaatgtctctccaaatcraactcaacaattgctttgacagtacagatgttattattttgttgatacaataacttccaaaacaaatatggcccattctactgtgtttcttattattcag

SEQ ID NO: 14679 - DNA, 201 bp, Homo sapiens
accttggcatttcccactgtgattccactgaacagctatcactcctatgccttttggcattggtagttcccttactgtagaatttcatcttatgttgtggragttcattgaaatgtattgatgaggctgttccactgtaagtactaatgaaaatcatcactgttagggtttttagttgcaaataatagaaaccaactctgg

SEQ ID NO: 14680 - DNA, 201 bp, Homo sapiens
ataattatacaaaaaaagttaaaatgtaggatccctcaaatacacaaaatattaaaatcttccaaacttttgaataatattcacttgtttcaacagttttytcttccctatataaacttctctcaatttcacaaaaaacattcaacaaactcatataaccttttgccatttatagctatcttgagttcaaatatagtactt

SEQ ID NO: 14681 - DNA, 201 bp, Homo sapiens
ctgtttgaactaggccgactacaaaatatataatattaaccaaaaagaagccttcaccaattggtgctgaattattaattacctcttcctagacttcttcrtatgataacttgattatttcttcataccccagtttagaaaaattaccataatttatgcttacactaaggaaatccctaaatattcttcaacaactttgca

SEQ ID NO: 14682 - DNA, 201 bp, Homo sapiens
tttaagactactttaaagcctatagaaaaaatatggctaaattatataagcaagtgtaattctgaaaataaacaatgctaagattttagataatagttacycataatgttcctataacctgtaactaaccataccttggacaactaaaataaattaagatttttcttggtctggggaagtagacggtagcaagggatgttt

SEQ ID NO: 14683 - DNA, 201 bp, Homo sapiens
aaaggctgtttcttataacttcaactaagactgggaccctctaatatttaaaagggttttattttgtcaaaagtaacctcatggtaaggttgtatcagacmcttgaatagtaagcttttacattacagaaatgactaaactgtccagtaatctaaggctaaaatttagggaaaagaaaatcaaatctatattaaagaataa

SEQ ID NO: 14684 - DNA, 201 bp, Homo sapiens
tataaatttatcaatatagacacatttccaaaacacaataaaggaaaaaccaagttgaagaatcatatgcaggatatattcaaatttatgcaaatgttaamacccacaaaaatgtattgtttgtagcacacataaataagagtacaaatggtaaaaagaataatatgcaccaccttcaggagagtagatggatttggggtg

SEQ ID NO: 14685 - DNA, 201 bp, Homo sapiens
caagttgaagaatcatatgcaggatatattcaaatttatgcaaatgttaaaacccacaaaaatgtattgtttgtagcacacataaataagagtacaaatgrtaaaaagaataatatgcaccaccttcaggagagtagatggatttggggtggatggaaaagaatggaattggaaagaagtacaaaggagactccaaatata

SEQ ID NO: 14686 - DNA, 201 bp, Homo sapiens
cagaaatgtggactcaacaggcctaactggtagtctatataattacatcacatagctatgttttggcaggcaaatgcatttaaaagcataggcaaagatakgttcaatgcatagctaaaagaatgaaacatttatacagaatggaaagtttaatctttctacatgtgcctgagataatgcaaggtattttctaaatctaac

SEQ ID NO: 14687 - DNA, 201 bp, Homo sapiens
attagtgaagatacaagagtgtgtgatagaagacactacacagatttttgttcattggtttgctaaattaaaaatcacccgagaatttgcaggaaaatagyaggagtaggaaaagcatctaacaggtagtacacttcacacaggatcttgaaggaatggtaaaatctgcgtaggcagcgagaagctccaagcaagggcttt

SEQ ID NO: 14688 - DNA, 201 bp, Homo sapiens
tgtgtttgagagaccgacttcaatagaacagaaagaataggcccaagatcataggaaatgaagctggataaatagtgtacaggcaaatcagaaagggtgtygaaagtcaagcagaagaagttagatttaacatagtggaaaacagggaaccactgaagctctctgaaaagggagtgacatgctagaagtagcatttaaaga

SEQ ID NO: 14689 - DNA, 201 bp, Homo sapiens
ttttttttttcaagtatcctataaggagtttccttgtttggtttagtgaattgactgcgggtgtcccctaaatttcacatctgttttgctaacacatcccyatgaaaatctgcttatgtaagaattagttttaatattttcaatacgtcaacaaagttaactgacccaatacaagatatgaaccctagagtctcagattgt

SEQ ID NO: 14690 - DNA, 201 bp, Homo sapiens
actgtcctaattactattcctaaaaatactttacctaaaaaaaattctgaaaggctgtcaaaatatatctaggtatagaatataaattttattttgttctractactcacatgtattttttatttattaaagcaaaaaacatgtattacttgtatagctattaaaaatatatgaaaagaactatcttaggtcagggacttc

SEQ ID NO: 14691 - DNA, 201 bp, Homo sapiens
cacaaatctgatccagttatgctttccttcttaaaacacggttcaacagctctccattgcttacaaaataacattcaaactcctggcttctgaggctctgrccctgactatcctcccgctttccctcaacaagcatcctatactcttgccatagcaattactcattgtttctcaaatgtgccatcctctttcacgtctcta

SEQ ID NO: 14692 - DNA, 201 bp, Homo sapiens
aagctgggcttcagatcaagaagaaaggaaaagaaagaagtgcagggaatatactgatgcctaagttacttactgcttctgagccctccagtaggtctagytgtattactgctattcgattttataagacattcctgtatttctatagtaatttccctggttttggcttaagctagctgaaataaatttcagttaacatgc

SEQ ID NO: 14693 - DNA, 201 bp, Homo sapiens
taaaaactcaaggaaggcacatctcaaaggcccaagaagtcagattagtgattctgcagaactatataaacaacttttttccagataacacatgagcccartatgaacttccttacagaagaaggaaaagaaaggttaaaataaagatgccatgaaatacccttccttttcctaattcttcaaaataagggcaataatctc

SEQ ID NO: 14694 - DNA, 201 bp, Homo sapiens
cctctgtatgaggtcaatgaggacacgtagtggccggtctcgtcgaacaaagtcatgctgattgagggaggaggaaaaaataaactgataatgaagaaatrtccttaggtgcaaggtacagatataaaaggaaatagagaatcataaaatagttctatggatattacagaaataacaaaatatgattttcatgtcatgtgt

SEQ ID NO: 14695 - DNA, 201 bp, Homo sapiens
taaataaatgaacaaataaataagacagaccttaatgttttctaacaaggtggttttgatatttggtgagctatgtatagactcttctgaaatgtgaaatmtgtatgtcttcaaacatataaacaaggtaagttcttcacacactatgaagcttcataaaaggttccatttaaatttgtatcttggcaaaattattgaact

SEQ ID NO: 14696 - DNA, 201 bp, Homo sapiens
acatcatgcacatgtgacttagagactgcctctaattatttgatttcttacatctcccttcaatttattcctaataatgggtgtttctgccttcttaaatraatttatgtgcagtgtctggtttaaaaatgttcaagaaaaggaatctaaaaaatggcctaatgatcatggatttgttaatgtaaatcttaccttttaact

SEQ ID NO: 14697 - DNA, 201 bp, Homo sapiens
agcctgcgggctatgggttggacaagtttgcacgtaggaatataagacaaacaagcaaaaaattcggcatgtgaggtggtaagtgctatggagaaggatayggtaggaaagatggaacaataagtttatttgttcacagtcgcaaattgcctagatcacacagtaagaaaaattgctttggaagaccagagtgctaagcct

SEQ ID NO: 14698 - DNA, 201 bp, Homo sapiens
gtgcattttaaaaactccaaatgaagactctctatgagcttttctatcgaatctggcaaagcgaagtaaaagactctatatttgcatgaatagaacaatamtacttttctcctacatgcctccttgggaattcccctatcacacccttctccctgacatgtgttctaacataaattcgcctctgtaatgcagtcacaggtg

SEQ ID NO: 14699 - DNA, 201 bp, Homo sapiens
aaacttgaaatgacattgattttagttgacacatatgtaattaagtaactcaagtatatttttaaaataatgctatttttatagtccaaagaataggttcraaattttaacccactttaaatataataatgctaatagtataattctttgcttccccctacatttttttccttttataaaattattcttagttttccagat

SEQ ID NO: 14700 - DNA, 201 bp, Homo sapiens
cacacacataagcacacctttacacagcggggtgcggggggatgtatctaaaaatggctcttatccggtgatgagaaacctttgtatagactcccacactktctacgctgtggagaagggatcagcagacccaccactctcctttgttttgttcatttcaaaattattaaattattgtcgaagcaggggtagctatcaaaa

SEQ ID NO: 14701 - DNA, 201 bp, Homo sapiens
ctctgcgatctgctccttgtctactcttggatcttgtccttagtaactccaaggcctcacactggatgcctcagctatctcagactacttccctgagataycaagtaacatcggttggcaagaaagcaagaaaagttatctgccttcctagctaaccagaatctgttcaagaatctgctttccttcagggaaatcttcctg

SEQ ID NO: 14702 - DNA, 201 bp, Homo sapiens
gctggatgcaaatctaagctgtctaatctcaagcccagtctttttaacaactatggtatagctttcagttaaatcatgacatgaaggatttcagaattagyggcttgataaattataaagaactacaagactgctgaatactaagcccctccatctaaaactttcttttcattttgtgctttaataaaaggcaacgtcatc

SEQ ID NO: 14703 - DNA, 201 bp, Homo sapiens
ttaaaataagggcttgacattaaaaaaaaatctagtcccttaatttaagactactttaaagcctatagaaaaaatatggctaaattatataagcaagtgtmattctgaaaataaacaatgctaagattttagataatagttacccataatgttcctataacctgtaactaaccataccttggacaactaaaataaattaag

SEQ ID NO: 14704 - DNA, 201 bp, Homo sapiens
catttccaaaacacaataaaggaaaaaccaagttgaagaatcatatgcaggatatattcaaatttatgcaaatgttaaaacccacaaaaatgtattgtttrtagcacacataaataagagtacaaatggtaaaaagaataatatgcaccaccttcaggagagtagatggatttggggtggatggaaaagaatggaattgga

SEQ ID NO: 14705 - DNA, 201 bp, Homo sapiens
aatagcccataacttcactgaatagtccacaactttttattgttgccatgttatctaaccagcttttgtattgtcatatatgaatgacatcttggggccaygtagcacttatcctgtaggcactaatagaacagtacagagttatttaattccaatcttcacaatgaggggtacatggcccaacagttataaacacaggca

SEQ ID NO: 14706 - DNA, 201 bp, Homo sapiens
aatctgcttatgtaagaattagttttaatattttcaatacgtcaacaaagttaactgacccaatacaagatatgaaccctagagtctcagattgtgagaamggaaaacattctttatgcagtagttgtccttatgtgtggggaatatgttctagaacatccagtggatttatgaaaccatagatagtatggaactctatat

SEQ ID NO: 14707 - DNA, 201 bp, Homo sapiens
gagagacacccaaactaggatgattgtgaattgatgattacctaattcaaaaaagctggagaaaatttatttcaatactttcattatttttctaagatgcrcgattattaagaatgtatgtggtcaggcgtggtggctcacacctgtaatcccagcactttgggaggccgaggcaggcggatcacctgaggttaggagttc

SEQ ID NO: 14708 - DNA, 201 bp, Homo sapiens
tattattttggtcttattagactttaatgcctaaaagccatgtcatcaagcttccactagacttcgttacagtgaacagagttttcttaggttttagccasaatgagatacagccatcgtggatgtatggtgtggtagtaggaatggctttcatttgtattcaatgaaataaaaatatagtaaattcaaggctgctccaag

SEQ ID NO: 14709 - DNA, 201 bp, Homo sapiens
cttacctcacagagctgctgtgaaccttagttaggtgatgtgctatgcataggtctacataaatgtttcttcagtgaagctagtggtcctacaccctgackgcccataaaaatcatgtgaggaaacttttcaaacataagatgcttgaatctcacagggtgaaattcttataactgtctggggtgggagcctgatgtcagt

SEQ ID NO: 14710 - DNA, 201 bp, Homo sapiens
gacattttagtcatttacatgtacacggtacaaaatctgatgtgatgatgatcttgaatcatcataaaagggtatatgtagtttgtacaattgaagaagaytggaaagggaagaatccatgtcaaatttcggaaagattttggtaagaaaaaaacttgttaagaaaaaacttggtaagaaaaaactagttaaaaaatgggt

SEQ ID NO: 14711 - DNA, 201 bp, Homo sapiens
tttgatattttctacattgaacatgtagaatttattttttgtaatgaaaaaataaattaaaaatattttttgaagactgaattggaatagaaggagactasagcagggaggtcaggttatggctaccaaacaacaaagaacgataatcttattccagaatgttggcaataaaattgaaagcagaaggcagttaccatacca

SEQ ID NO: 14712 - DNA, 201 bp, Homo sapiens
agttctccaggtggtgccaataagcaatcaagattgagaattaaactgataatatctgcaatgttcttagctttctgggaaatactctgtttttgcatgartcagaggtaggccaattgtctattttttaaaatctcagagttcaaggcatgttggggaaaaaaaaacagatgagatctctcccctttcatcttctgcatt

SEQ ID NO: 14713 - DNA, 201 bp, Homo sapiens
attcatttttcattatggtaatttagaatgagaaggtgtggatgtactccttattctttttaaaaaaggcatgaggtgtaatgagcactagaaaccatgawttggaagttgatggtcagtgaaaagataaaacagagaagatgaggaaatttatgtcaagctgaaaatgataaggttcaaatgcttcaaaataacttttat

SEQ ID NO: 14714 - DNA, 201 bp, Homo sapiens
taaatactctatgaatttgtttcaataatactggaagaaacctctacaaattgtcaaaaatgtgaataattctatccagtctctaggttctagtcctgttygtccatcttttaaaaaatctgtgcccatttctgataaacataaaaatcttctctttataaatgatttaaaatttcaaaatatctcacccacatccattct

SEQ ID NO: 14715 - DNA, 201 bp, Homo sapiens
aaatcagttattattattctgatttttatgagtgtcatctgactcctaggatagcagcatgtttcccagtataccagtacttctacctggcaagggtgctrcccaaaaatggtcttgggagaatgtagacggtgtagaaaagtctgtaatttggccgggcgcggtggctcacacctgtaatggcagcattttgggaggccg

SEQ ID NO: 14716 - DNA, 201 bp, Homo sapiens
tctgagaacaacaaaaaaagaatcaatggattaaatcaaagatatacctttttggagactatacgtaaaagggaaattatgagactatctttaagaaaatmaaaaagacctatgaactaaacttatgataattaaaatattttcaatcaccaaaacacattataaactttagaatattttggcttccatgtgaataaagct

SEQ ID NO: 14717 - DNA, 201 bp, Homo sapiens
aaatgaaatctttaaaaactgaaaatttaaaaatcatatataaagagacagctatccaactagagataatgctagatcctagtaggacagtcaggcaagayattacagaagacagacattttcagctctattacaaggaaagagaatggctgtttcttttcttttctcttcttttttattttttattttattttatctttt

SEQ ID NO: 14718 - DNA, 201 bp, Homo sapiens
aaaatcttaactttacagcagtgaaaaatgaagtataaatatatagtatctttttcgaagtcacatagttaggactagtcgagtatttggtttcttccccygtttccttccacacgacttcccataagacttgaagagaactgtctaaaaaaaacaaaccaaaaaaacaaaaaaaaaactagcaaattttgttgtaattgc

SEQ ID NO: 14719 - DNA, 201 bp, Homo sapiens
cacatacacacagacacacaacatactctgagttcaatatataagtaaaattcccagcattcttaattgttccaaaaccaaataaaagaaaaatccaagakgtaaacacctttagcctctgcaaattttacctgccactgatcaccaaatacacaacagcactgtgagagctctgtatttataacttttgactccctccta

SEQ ID NO: 14720 - DNA, 201 bp, Homo sapiens
ctcaaaaaaaaaaaaaaaaagaaagaaagaaagaaagaaagaacacttgatagagagtagaaatatatatttttaaaataattttccctttcccagaaacytcaagaaagatgattcattgaagatcttagttgtgtttcaatgtttttttcaacaataatgttcttctcaacaatgtttttctctggcagcactatcctg

SEQ ID NO: 14721 - DNA, 201 bp, Homo sapiens
tttttttccatttcttaggagaaagctaagttgtatggacaatacctttttgtgtgtggcacaaaatattccatattgctcagattcattttagcagcaawcttctcttttctcttttataacttcagtcctttgtatttatgatgcaacctatagaaaaagaagaacaaaatacataattatcagccaaattaaagaatc

SEQ ID NO: 14722 - DNA, 201 bp, Homo sapiens
gttagattagatcagcggctcttaacttttgaggggtcgtgggccctagagtcctgggaacgctatgcagtttcctcagcaaaatgcttgcatccacaacmtgcaagactgcagcagctgctgggctggggctgcgagaccagcgaaaagccctgacttgggggggtctcgggagtctctgcagtctccccacccacaccc

SEQ ID NO: 14723 - DNA, 201 bp, Homo sapiens
agagggggctgccgtcctgctcgcagcctctgccgccctctcctgggtaaggtgacacatgggcgcttccaggtgggtgggctgagagcctgggggagagracagggatgtccacctctctaagtttccaggttcaagaaaccccagaacgttagagaaagatgggctcccacaattgcccaaccccatcccataggatgc

SEQ ID NO: 14724 - DNA, 201 bp, Homo sapiens
agtgagtataattcaagtgtgggtgtgtgggtaagtgatcagaccggggttgctcagtgatcagactggggctgctcagagagaagagggctgcctcagtyttcagcctcccagtacccgcctcccatctccattaaaatcctggaaaatcctggctattttcgtcccttttgcaaaggggagctattttttttttttttt

SEQ ID NO: 14725 - DNA, 201 bp, Homo sapiens
agtgagactctgttaaaaaaaaaaaaaaaaaaaaagaagaagaagaagattttcccaacattgtccccatttcccagaaaagaaaactgaggcccatccaraagttaaggattccagtggtagaaccagcaccaggtgtcacgatccagctctgtcacatcatgagtccctagagagcagaaattttgtgctgacttcagg

SEQ ID NO: 14726 - DNA, 201 bp, Homo sapiens
cacgatccagctctgtcacatcatgagtccctagagagcagaaattttgtgctgacttcaggatctcccatgaacagctcctcacctgaattccagaaatyagtggggtgaaccgcacacaggtaggaaccaggtctgtctccttcacctcttaattccagagcctaacatagcacttggcacaaagtagtagcacttgta

SEQ ID NO: 14727 - DNA, 201 bp, Homo sapiens
aagttgcttgagcaccctcatgacatggcatctggcttcctccactgtgaatcatccaagaaattgctgggggaggccgaaatttcacttatgacctaatmtcagaggtcacacaccatccctctccaccacattctattctccaagagcaagtcaaaaagtccagcccacactcaaggagaggggaatgaatcattgcct

SEQ ID NO: 14728 - DNA, 201 bp, Homo sapiens
agaacttcgtgtgagaggtgctattgttattcccactgtaaaaaggagtatgctgaggcccagagaagttaagaaaggtcacacacctacctgtgaatccrgagctcaggtgtgcattcaagcaggccagcctcaaaggcaacagtgctgatgtattccagagggaatgctgcaaggaacatacagagacattggggtgaa

SEQ ID NO: 14729 - DNA, 201 bp, Homo sapiens
gtattccagagggaatgctgcaaggaacatacagagacattggggtgaaaatgcttctgaagggaaaataggtggagaaagagagagaaacagaagacgtkgaactgagatgccaagagatacaatgacagagaaagacagcaagggagacagaggaggattaagcatcagaaatctttaggcaggcagacacaaggaggt

SEQ ID NO: 14730 - DNA, 201 bp, Homo sapiens
ttgccactgcaccactccagcctggcgatagagtgagactctgttaaaaaaaaaaaaaaaaaaaaagaagaagaagaagattttcccaacattgtccccayttcccagaaaagaaaactgaggcccatccagaagttaaggattccagtggtagaaccagcaccaggtgtcacgatccagctctgtcacatcatgagtccc

SEQ ID NO: 14731 - DNA, 201 bp, Homo sapiens
ccttcacctcttaattccagagcctaacatagcacttggcacaaagtagtagcacttgtaaatactcgggggtctgaatagaactgaaagcttagtaaatwaataaattaaaatacttaataaatagacacatggttaagtgaataaattcattaattaacataaaggcattagggtgttcggattaaatgaaaagtatat

SEQ ID NO: 14732 - DNA, 201 bp, Homo sapiens
agacctggttggagtaaggcaggaggggggctgtggtgaccaaggtatgcagtgtggattctagcccactgcagattttatggagtgcttgcctgtgccartttttcgactccctccagaacttcgtgtgagaggtgctattgttattcccactgtaaaaaggagtatgctgaggcccagagaagttaagaaaggtcacac

SEQ ID NO: 14733 - DNA, 201 bp, Homo sapiens
aagagacagagacctggagacaggggaggcatgggatggaggatgtgagccagcatgtgcatggcgtgcgtgagtgcagtgcctttgcgctgggtggtgcygggaccccgctaactcagaccatccatcgctcctgtctctcatcagcaggagggccgggggagggagagaaagctgacaggagacagtgtgattccagta

SEQ ID NO: 14734 - DNA, 201 bp, Homo sapiens
cagacacaaggaggtggagagaaaaataaagtaagagacagagacctggagacaggggaggcatgggatggaggatgtgagccagcatgtgcatggcgtgygtgagtgcagtgcctttgcgctgggtggtgccgggaccccgctaactcagaccatccatcgctcctgtctctcatcagcaggagggccgggggagggaga

SEQ ID NO: 14735 - DNA, 201 bp, Homo sapiens
tattccagagggaatgctgcaaggaacatacagagacattggggtgaaaatgcttctgaagggaaaataggtggagaaagagagagaaacagaagacgtgkaactgagatgccaagagatacaatgacagagaaagacagcaagggagacagaggaggattaagcatcagaaatctttaggcaggcagacacaaggaggtg

SEQ ID NO: 14736 - DNA, 201 bp, Homo sapiens
tgaggcaagagaatggcttgaaccctggaggtggagactgtagtgagccgagatcttgccactgcaccactccagcctggcgatagagtgagactctgttaaaaaaaaaaaaaaaaaaaaagaagaagaagaagattttcccaacattgtccccatttcccagaaaagaaaactgaggcccatccagaagttaaggattcc

SEQ ID NO: 14737 - DNA, 201 bp, Homo sapiens
tgaaccctggaggtggagactgtagtgagccgagatcttgccactgcaccactccagcctggcgatagagtgagactctgttaaaaaaaaaaaaaaaaaaraagaagaagaagaagattttcccaacattgtccccatttcccagaaaagaaaactgaggcccatccagaagttaaggattccagtggtagaaccagcacc

SEQ ID NO: 14738 - DNA, 201 bp, Homo sapiens
ataagtggatgagtggatggatggatggatgcatggatggatggatagatagatggatgacaaatggatggtggatgaatgggtgaatggatggatgatgkatatgtggatagatgggtagatggatgggttggtggatggatagatggatgcatgaaagaatgggtggatgaatggaaagatgggtggatggtgggtgaa

SEQ ID NO: 14739 - DNA, 201 bp, Homo sapiens
gctgcctcagtcttcagcctcccagtacccgcctcccatctccattaaaatcctggaaaatcctggctattttcgtcccttttgcaaaggggagctattttttttttttttttttttttagacacagcttattaaaggagaaagcacacagagcccttcctcccacaggtgcctctttatctgcataaacccaccctctgt

SEQ ID NO: 14740 - DNA, 201 bp, Homo sapiens
ctgcctcagtcttcagcctcccagtacccgcctcccatctccattaaaatcctggaaaatcctggctattttcgtcccttttgcaaaggggagctattttttttttttttttttttttagacacagcttattaaaggagaaagcacacagagcccttcctcccacaggtgcctctttatctgcataaacccaccctctgtc

SEQ ID NO: 14741 - DNA, 201 bp, Homo sapiens
aaccctggaggtggagactgtagtgagccgagatcttgccactgcaccactccagcctggcgatagagtgagactctgttaaaaaaaaaaaaaaaaaaaargaagaagaagaagattttcccaacattgtccccatttcccagaaaagaaaactgaggcccatccagaagttaaggattccagtggtagaaccagcaccag

SEQ ID NO: 14742 - DNA, 201 bp, Homo sapiens
aaagaaatagtgagtgtattggtaatctatggctgcataataaatttcccaaaatgtagtggcacaatttctgggggccaagaatccatctgcatggctcyggcttaggagctcttgtgaagttgcagtccagatggtggccaggactgcagtctcatctgaaggcttaactggggctgaaggctccacttcccaggtggc

SEQ ID NO: 14743 - DNA, 201 bp, Homo sapiens
gaatggatgatggataagtggatagatgggtggatggaaggataggtggataaatgggtgaatgaatggatgatggataagtggatagatgagtggataartggatgagtggatggatggatggatgcatggatggatggatagatagatggatgacaaatggatggtggatgaatgggtgaatggatggatgatggatat

SEQ ID NO: 14744 - DNA, 201 bp, Homo sapiens
tcattgccttttgaagggaggagtgtcaaagaatgtaatgacatattttaaaaccaccacaaagagtgccagaaggccagaatgatgtgacaagtagatgytgtcaaagtctttggaaagagcctcccagggagaagatctgcaaggacaaaggcctagaggtgggagtgagcttgtcatgtttggaaacaagaaggtgtg

SEQ ID NO: 14745 - DNA, 201 bp, Homo sapiens
aaaaaagaagaagaagaagattttcccaacattgtccccatttcccagaaaagaaaactgaggcccatccagaagttaaggattccagtggtagaaccagyaccaggtgtcacgatccagctctgtcacatcatgagtccctagagagcagaaattttgtgctgacttcaggatctcccatgaacagctcctcacctgaat

SEQ ID NO: 14746 - DNA, 201 bp, Homo sapiens
taagcatcagaaatctttaggcaggcagacacaaggaggtggagagaaaaataaagtaagagacagagacctggagacaggggaggcatgggatggaggakgtgagccagcatgtgcatggcgtgcgtgagtgcagtgcctttgcgctgggtggtgccgggaccccgctaactcagaccatccatcgctcctgtctctcat

SEQ ID NO: 14747 - DNA, 201 bp, Homo sapiens
gtggagagaaaaataaagtaagagacagagacctggagacaggggaggcatgggatggaggatgtgagccagcatgtgcatggcgtgcgtgagtgcagtgyctttgcgctgggtggtgccgggaccccgctaactcagaccatccatcgctcctgtctctcatcagcaggagggccgggggagggagagaaagctgacagg

SEQ ID NO: 14748 - DNA, 201 bp, Homo sapiens
ttttgcaaaggggagctattttttttttttttttttttttagacacagcttattaaaggagaaagcacacagagcccttcctcccacaggtgcctctttakctgcataaacccaccctctgtcaggcagccaggaataaaactaagcagaaagccacagaaagtgtaagaaatcaaatacagaaagacagaaaaagaagtt

SEQ ID NO: 14749 - DNA, 201 bp, Homo sapiens
gggaattaattaacaattgacttggtggaaagatggataaatgaataagtgagtataattcaagtgtgggtgtgtgggtaagtgatcagaccggggttgcycagtgatcagactggggctgctcagagagaagagggctgcctcagtcttcagcctcccagtacccgcctcccatctccattaaaatcctggaaaatcctg

SEQ ID NO: 14750 - DNA, 201 bp, Homo sapiens
ggttggtggatggatagatggatgcatgaaagaatgggtggatgaatggaaagatgggtggatggtgggtgaatggatcagtgatggataaatgtatagakgggtggatagatggagagtggatggatggatgaatagctgagtgcatggatggataaatggattaattcataagtaaaaaatataggatagataatgaat

SEQ ID NO: 14751 - DNA, 201 bp, Homo sapiens
tggagtacagtggcgcgatctgagctcactgcaacctctgcctcccaggttcaagcaattctcctgcctcagcctcccaatagctgggattacaggtgcaygctaccatgcccggctgatttttgtatttttagtagaggtggggttttgctgtattggccaggccagtctcaaactcctgacctcaagaaatccgcccac

SEQ ID NO: 14752 - DNA, 201 bp, Homo sapiens
ttttttttttttgccaagcaccctgcctttttgcttgtctgtttcgtctttatctctccttccagtaaagttcttggcccagaggttctgctgccactcartgacatttgtgaaatgcaagggagcttgcaccatgggttcaagctcctgcagatccctgagcctgctacccttgtgcttctctgtccacgcaaagccaag

SEQ ID NO: 14753 - DNA, 201 bp, Homo sapiens
tggagatttcaaggatcatcagggaagctagtgtggctggagatgaatggagtgggtaggagaggtgctgttgggggatgggtatctggtagactctgagrtagcggtgaggaagacattagagggtttgagctagagagtgatgcgagctgtttgatttttgaaacatcgctggatttcagaatgaagtccagactgcat

SEQ ID NO: 14754 - DNA, 201 bp, Homo sapiens
gctacaaaacctggcattttacttctctcattttccccaaatgatctaggtgtcttttgctcactggtgataaggggtgacattggtatcacaggtaaaartgagtaaatttgagattattgtcgtcttgctttaaaggttggagatacagcttcaaaaaccttttactacccacacacccaaggggagtcaaatggattt

SEQ ID NO: 14755 - DNA, 201 bp, Homo sapiens
cattcagccctcgggttaccattggtagcacatctaggagcaagttttaattttttagtcatagtgactgtgctggatttggtaggtcgtacgaattgggkaagaggcataggacaccaaggattttgcaaaaagcaggcaactaacatttgttttccacctactatgattatgttaggctctcaatatatgtttaccact

SEQ ID NO: 14756 - DNA, 201 bp, Homo sapiens
tgactcactgtgttgatgttatgttttctaacattgactttcctttaaaccatagggttcgaaaccgccaagtcttttgccctccatggtgcacatgtgaycttggcctgcaggaacatggcaagggcgagtgaagcagtgtcacgcattttagaagaatgggtaagcgcttgactgttgttgttttttttaattgtcaaa

SEQ ID NO: 14757 - DNA, 201 bp, Homo sapiens
ttcagtggagtgtgtaaagtttattgctcttggaatcatgtctttatttttaaagtcatcttcactttgtttgtcttatgaatgaaagcatgagcaagtcmattattattcacgcatttgtttgtagttcattgtcagtgtcatctgctttattagtcaggggtttgagaatgtttcttcctttaactcatttattaagaa

SEQ ID NO: 14758 - DNA, 201 bp, Homo sapiens
cagtattttgtcctattcatgcaatataatttatataacctaattgataaaacattttggttgattgcagtctgtcgtagataatgccgtactgaatattmctcccacatatttgcaagtctatttgtaggataaatttctggttgtggctgggtcaaagagcatgtccacttcaaatttgatagctatgtcccaactgcc

SEQ ID NO: 14759 - DNA, 201 bp, Homo sapiens
aagaaaaataaaacgtggtgaacgcccatgattgcaactaggagactgttatgcttatggttgttaagattagaaagaaggaagctttaaccctatctctratttcttacttttctctgtctatgtagaagttgatgttgatacgtgtctacataaatatttactaagggcttgcattagtcttgggaccaaggatatagt

SEQ ID NO: 14760 - DNA, 201 bp, Homo sapiens
agaaggaagctttaaccctatctctgatttcttacttttctctgtctatgtagaagttgatgttgatacgtgtctacataaatatttactaagggcttgcmttagtcttgggaccaaggatatagtattaaacgaaacagaatccctgccctcataggcttaccttctaggtaggaaaaatagaccataatcaagtttaat

SEQ ID NO: 14761 - DNA, 201 bp, Homo sapiens
tccaatttttcaagctgctggccagcttgagcgtattcatatgttacctacgatgaatcacatcagtgtcggggccgggaaggtactgcaacatattggcrcctcacgggaggctctcaaaatgatccaaagttttttgttgcagcaaaagctcattcagaagtctttgggccatttggctcagcggaggctgtcatgtgc

SEQ ID NO: 14762 - DNA, 201 bp, Homo sapiens
atggcctgggaggcaagtgtgatcattcaggtaatcaaagtaactacagaaacagaggtatggattagctagtcattgcagatgtggcattgagcatatargcgtggtgtacatcttagaacttcatctggaaatgcctgtgggggagttggatttcaagatcatcgtcaatgtcatgtcactgtaatttcatttacatta

SEQ ID NO: 14763 - DNA, 201 bp, Homo sapiens
taagttcttaagatttggcagctgtggatcgtgtttagtaagcacgatctctaactctttggaactcagaactatgtaattgaaatggcctgggaggcaartgtgatcattcaggtaatcaaagtaactacagaaacagaggtatggattagctagtcattgcagatgtggcattgagcatataagcgtggtgtacatctt

SEQ ID NO: 14764 - DNA, 201 bp, Homo sapiens
agatttccccttttcataaggacaccagtcctattggattagggctcccccattatgacctcatttatccttaattatgaccataaaggccccatctccaratgcagtcatgttgggggttagggcttcagtgtatgagtttgggatggcaggggagcagttcagctcgtgagaatcgtaagattcctgatctgtttctct

SEQ ID NO: 14765 - DNA, 201 bp, Homo sapiens
atgttaacctcctttggaaacacccgcacagacacacccaggaacagcaccttgcatccttcaatccaatcacattgacactcaatattaaccatctcagyaggcttcttcgtgttcacatagtctcctcaccgtgtgctgtgtccagatttccccttttcataaggacaccagtcctattggattagggctcccccatta

SEQ ID NO: 14766 - DNA, 201 bp, Homo sapiens
ccgctgacttaaatgttaacctcctttggaaacacccgcacagacacacccaggaacagcaccttgcatccttcaatccaatcacattgacactcaatatyaaccatctcagtaggcttcttcgtgttcacatagtctcctcaccgtgtgctgtgtccagatttccccttttcataaggacaccagtcctattggattagg

SEQ ID NO: 14767 - DNA, 201 bp, Homo sapiens
aacttgttgtaacatgtaagaaattacatctgggctaaaaggttcaataatgattactcttataatggaatcttctacaaagcaagggatttcatgatatscctatgcttttaaaaaattattgtgatacagtgaaacaaggaagaacgtgtagctggaaaaatagtatttgcttgtaatatacattcagattcataacag

SEQ ID NO: 14768 - DNA, 201 bp, Homo sapiens
actaggaattgaaatggcctgaagctgagtttccactcttgtgaaggctggactgtctcttgttattacagcgagggtataactctttaggatcccgaccmaaggtttggtgtgtttaccgtggccctttcctggtgggtcctgagctcaaatttatgtctttttccttgttataaaattgccaaaagctcagcccatctt

SEQ ID NO: 14769 - DNA, 201 bp, Homo sapiens
gaagcagtgtcacgcattttagaagaatgggtaagcgcttgactgttgttgttttttttaattgtcaaatacacatgccgggctaaccatatggagatttyagtggagtgtgtaaagtttattgctcttggaatcatgtctttatttttaaagtcatcttcactttgtttgtcttatgaatgaaagcatgagcaagtccat

SEQ ID NO: 14770 - DNA, 201 bp, Homo sapiens
aatgtctccagacatttgcttctgtcccctggggatcaaaatcacccctggttgagaacttggggtaatttaagtggtgctccggtaaaggccattcaacwtgactcactgtgttgatgttatgttttctaacattgactttcctttaaaccatagggttcgaaaccgccaagtcttttgccctccatggtgcacatgtga

SEQ ID NO: 14771 - DNA, 201 bp, Homo sapiens
agccaagggatggctcagaagggtgaaggaactcacccgaattgcacagctggtgagctcagagtcaggctccttgcttggtccatctggcttccaaactscaagtctgtctgctccaccccatggcccatctttttaccatgtttagtatcaatgttcatactttgcagattttgctttcaaactctctagctgcggttt

SEQ ID NO: 14772 - DNA, 201 bp, Homo sapiens
tcaggcactttatatccctcatccaggaggatgcaaaaacctggtgtttttcttttttttttttttgcattttccagacgagccaagggatggctcagaarggtgaaggaactcacccgaattgcacagctggtgagctcagagtcaggctccttgcttggtccatctggcttccaaactccaagtctgtctgctccaccc

SEQ ID NO: 14773 - DNA, 201 bp, Homo sapiens
gtcatatgctgtgtcaggcactttatatccctcatccaggaggatgcaaaaacctggtgtttttcttttttttttttttgcattttccagacgagccaagrgatggctcagaagggtgaaggaactcacccgaattgcacagctggtgagctcagagtcaggctccttgcttggtccatctggcttccaaactccaagtct

SEQ ID NO: 14774 - DNA, 201 bp, Homo sapiens
tgccttcactgcacattccgggatcgccatgttctagaacattcatgtctgccttttagccagcagaatgctattctcacatccacaatgggacagctaayagcccccatttatcaaatccctgtcatatgctgtgtcaggcactttatatccctcatccaggaggatgcaaaaacctggtgtttttcttttttttttttt

SEQ ID NO: 14775 - DNA, 201 bp, Homo sapiens
tgaacccgggaggcggagcttgaagtgagccgagatcgcgccactgcactccagcctgggcgacagagcgagactccgtctcaagagaaaaaaaaaaaaaattataacatggaaatgtttccttgcatctccgtatcatttctcctcattctttttaggtgtaacacagtattttgtcctattcatgcaatataatttata

SEQ ID NO: 14776 - DNA, 201 bp, Homo sapiens
ctactaaaaatacaaaaaattagccgggtgtggtggcgggcgcctgtagtcccagctactcgggaggctgaggcaggagagtggcgtgaacccgggaggcrgagcttgaagtgagccgagatcgcgccactgcactccagcctgggcgacagagcgagactccgtctcaagagaaaaaaaaaaaaaattataacatggaaa

SEQ ID NO: 14777 - DNA, 201 bp, Homo sapiens
cctccaacttctgggctcaagtgatcctcccacctcagcctcttgagtaactgggactgcaggtgcatggcactgtgctccacaattttttttttttttttagagatgggatctcactgtgttgtccaggctggtctcaaacccttgggtttaagtgatcctcttgcctcagcttcccaatgtgctaggattacaggcatg

SEQ ID NO: 14778 - DNA, 201 bp, Homo sapiens
aagccactgttagattttacaaaactttaaaaagtaattatcttaaagatatctaagatagtgatctggttacatagattatcagagatacttttttttttgattatcagagatacttttaaaaaagcaactacaaggtaaggattatcctttaatttagtgtttttctattaaactcaatttgctttaaagttttttaca

SEQ ID NO: 14779 - DNA, 201 bp, Homo sapiens
gctaggggcaaaatacatatattctatgtagtttccatttctagaccctggatttctaaattcttccttataaaattttaaatttctttttttttttttttaaagatggtgctccctaactgatttccttcattttattatctcataacagatttgattttcacaatgaaggtaattattaaaatgcttcctttggtagtc

SEQ ID NO: 14780 - DNA, 201 bp, Homo sapiens
gttctagaggctagaagtctgaaatcaaggtgttggtagggccatactccctttaaaatgtgtagggaaggacccttccttgcctctttcagcttctggtrgccctagatgttcattggcctgtggcagggtaattccagtctctgcctccatctgcacaagccattctccctgtatcttttcacatcatcttccctctat

SEQ ID NO: 14781 - DNA, 201 bp, Homo sapiens
tcagagaatctctaggatggaaatggggggatccatattgtagccccaggtgaggccatctggttgcatttgtgtcaagttggttgaaaactgcatggtgrgcgtaaaaatggtttgagtaaaatggagctgtgagaatttgaaggggtgcatgagaggtgcccgatacagtccaccccctgcaccatgctcaggtctctt

SEQ ID NO: 14782 - DNA, 201 bp, Homo sapiens
cttacctctttttagtttaattaaaattatttctcagattaagagccatgctatgatgcttgccaacggatatttaaaacatgtaactgatttgttttttrtaatgcttcaggagaactcagttgagcagtaaagatgtgctcgtgatgtggttagctcagaataaggatgtgaaaaccaaaagggaaaggaggacaggag

SEQ ID NO: 14783 - DNA, 201 bp, Homo sapiens
ttcctcatctgtaaaatgggaaccatgacgtcagcatcacagagttgtgagaattcgacaaggtggaatgaaagcaactagtgtggtgtctgaccgcttgygttagtccatgaggaatttccttacgtattgttttgtgtctaggaccaagttcttattttcttcttatggatgacttcatatatatgccgccacagaggg

SEQ ID NO: 14784 - DNA, 201 bp, Homo sapiens
gcccctcttctcttagttgcctttagcctttgtttttattatgacaattggtatgaaatttttccttttcattacttcttttattcagagcacacctctgkcttatctcttcattctctgtttagtttcatattttactttaatttctgtacatcaatatctgccattatagtatttaagctcttggaaacatcaggcatt

SEQ ID NO: 14785 - DNA, 201 bp, Homo sapiens
tttcctgctggcctgatccgggagggatttgggaaagctagtcttgttggtgtgtcatcatcgcgacgctgttagtgattgacttacccgagtgtacacatgtttgcatctcacttgtatgttccttacatgtttacttaattattgggaaggtgtattaatgtcctgttgctactataatggaccaccacaaactcggtg

SEQ ID NO: 14786 - DNA, 201 bp, Homo sapiens
atttcctgctggcctgatccgggagggatttgggaaagctagtcttgttggtgtgtcatcatcgcgacgctgttagtgattgacttacccgagtgtacacatgtttgcatctcacttgtatgttccttacatgtttacttaattattgggaaggtgtattaatgtcctgttgctactataatggaccaccacaaactcggt

SEQ ID NO: 14787 - DNA, 201 bp, Homo sapiens
agactcctaaagggaagattagggttggaagaagatggaggaagagagtaatttaattccttaatggaaagaataaaataagagctcttgacttttttttkttgttgttgttaggatatggggagaggtttctgcaaatatcttcttcagggtttacgaagtgaaccggatgtccggtaacagggttgcatgtcatgcaat

SEQ ID NO: 14788 - DNA, 201 bp, Homo sapiens
cactcacatatatatttctgtttgcggctcacacagacataaatatatatatatatatacaaacgtacatttctgcttgtagcttgcacatatatatatayacacacacacatacatgtagacacacacatttatacatatacatgtcaacacatacacatacatatttctgcttatggctcaggatacttctttttttgg

SEQ ID NO: 14789 - DNA, 201 bp, Homo sapiens
tacagatacacactcacatatatatttctgtttgcggctcacacagacataaatatatatatatatatacaaacgtacatttctgcttgtagcttgcacayatatatatacacacacacacatacatgtagacacacacatttatacatatacatgtcaacacatacacatacatatttctgcttatggctcaggatactt

SEQ ID NO: 14790 - DNA, 201 bp, Homo sapiens
atacagatacacactcacatatatatttctgtttgcggctcacacagacataaatatatatatatatatacaaacgtacatttctgcttgtagcttgcacmtatatatatacacacacacacatacatgtagacacacacatttatacatatacatgtcaacacatacacatacatatttctgcttatggctcaggatact

SEQ ID NO: 14791 - DNA, 201 bp, Homo sapiens
acaaaaagcagctttcgtttgcttaaaatttttgttctctgcctttatttttcaaaaatattttcactaggtatagaattctaagatgaaagttttatttkttttcagctgtggcttccatcattttcctgagaggtataactatcagtcttgtagctactggtctctaactacttctaaaactatctgcagtttttagca

SEQ ID NO: 14792 - DNA, 201 bp, Homo sapiens
tctggtaataaaaagtcctttgccgtgggttattttgtcaagtgagatagcaggacttaacaggtttgtttgggaaaataaaatttgatagaaaaacggcrtgcttttcccccacagatttcttggtagcatcattcaaaactacagtgagcagtatctttgcaggattttaatatttattcattattataaaggaaggaa

SEQ ID NO: 14793 - DNA, 201 bp, Homo sapiens
ggggtggggttggcgagagggtgttgcttttctaatgattcacattgtataaaaagcagacagtaggtctggcactgttggctcatgcctgtaatcccagyactttgggaggccaaggcaggtgaatcatgaggtcaagggttcaagaccagcctggccaacatggtgaaaccccttctctactaaaaatacaaaaaatta

SEQ ID NO: 14794 - DNA, 201 bp, Homo sapiens
taaatgtctctgggtttaatgcaactttactaaggaatgaaagtccgataagaatccatatcttttgaaagaagattttttaaattccttatttttccttyctgcatggtcataaaacacactggggacagcccaccctgagaagtcaccaggcatctgcctgccttcagtagcaatcacccaactgctgtagaccgtaat

SEQ ID NO: 14795 - DNA, 201 bp, Homo sapiens
ggggttggcgagagggtgttgcttttctaatgattcacattgtataaaaagcagacagtaggtctggcactgttggctcatgcctgtaatcccagtacttygggaggccaaggcaggtgaatcatgaggtcaagggttcaagaccagcctggccaacatggtgaaaccccttctctactaaaaatacaaaaaattagttgg

SEQ ID NO: 14796 - DNA, 201 bp, Homo sapiens
ggtagaagaaaagatttatgtaaattagttctctcagtagctatctaggagagagataatcctagctttcttcaagggacagaaccaggaccaatggacaraatctgcaaggaggcagcatttaactgattagaattgtcgggggtggggttggcgagagggtgttgcttttctaatgattcacattgtataaaaagcaga

SEQ ID NO: 14797 - DNA, 201 bp, Homo sapiens
tctttaaggaaaaaggttggatggatgatgtcaaagacccactgttcagtctttctttcttatattttgagccttaattgggtccctgtgagtcaatttcmgatgatagaatttgctgttttatagttttactctaacatgtagtaccttgagatagaccagtgatcccagactaagaattattcagaatcattcaccgtc

SEQ ID NO: 14798 - DNA, 201 bp, Homo sapiens
ctagtgtgggtctatacgtgacactaggtgtagtgtaggtgacaaacaaaaagcagctttcgtttgcttaaaatttttgttctctgcctttatttttcaaraatattttcactaggtatagaattctaagatgaaagttttattttttttcagctgtggcttccatcattttcctgagaggtataactatcagtcttgtag

SEQ ID NO: 14799 - DNA, 201 bp, Homo sapiens
ttccattactcacctcctaggttaagcattgttattattattgatatagtaatttttgctatatattttaaaactcacagatttcactcttaccatttggrtcttaacatgtcgttaccctttatgttgctctttgttactttctgcatctctgggtttatagctaaggtcattttcctcctgcctgaagagcatccttta

SEQ ID NO: 14800 - DNA, 201 bp, Homo sapiens
ctctctctctttctttctctttcctttctttcttccatttaaattgagacagggccttgctctgtcactctggctggagtgcagtggcataatcatagctsactgtgcccttgaactcttggactcaggcaatccctcgacatcagccttctgagtagctgggactaccggtacctgccaccacacctggctatttctttt

SEQ ID NO: 14801 - DNA, 201 bp, Homo sapiens
ttattttcagtttatcaattaagttgttcaagtcttctatatactttgtgtttgtctgcttattttatctgttactaagagggatatgttaaaatcttccrttataattgtgaatttgtctatttattgtcctaattctgtcaatttttgacatatatgagaggctctattattaagtacatataaatttagaattgtcat

SEQ ID NO: 14802 - DNA, 201 bp, Homo sapiens
tgatcatcctcctgagtagctgggaccacaggtgtgcaccaccacgcccaactaattttttgtagagatggaattttgccatgttgcccaggctggtctcraactcttgggctcaagcgatccacccgcctcggccaccccgattcctgggattacagccatgagccactgtgcctggtcttctttttaatatatgtagtt

SEQ ID NO: 14803 - DNA, 201 bp, Homo sapiens
cttagggttcataggatctgtagtccttttctttatttttcatttttaaaaacaactttattgaggtatgattgacgtacaaaaagcctcacgtatttgaygtatagaacttgataagtttggagataagtatatacctgtgaaaccattatattttataagtacatgatacaatatgagcacagtactatatggtagatc

SEQ ID NO: 14804 - DNA, 201 bp, Homo sapiens
cttaagatcttcttagggttcataggatctgtagtccttttctttatttttcatttttaaaaacaactttattgaggtatgattgacgtacaaaaagcctyacgtatttgatgtatagaacttgataagtttggagataagtatatacctgtgaaaccattatattttataagtacatgatacaatatgagcacagtacta

SEQ ID NO: 14805 - DNA, 201 bp, Homo sapiens
gttgttcaccatatcttaagatcttcttagggttcataggatctgtagtccttttctttatttttcatttttaaaaacaactttattgaggtatgattgaygtacaaaaagcctcacgtatttgatgtatagaacttgataagtttggagataagtatatacctgtgaaaccattatattttataagtacatgatacaata

SEQ ID NO: 14806 - DNA, 201 bp, Homo sapiens
aacctgcctggccttgtgttatatcgatgctttctcaatctgttaaaaacgtagctgctattgaatgactaagaattgtttactctcatttccactctctkacatcttttttttttcttttaataccctgtgatgaaactgtgaagaaagatattcctgatcattgctttgacctggaaatttcaaagggacccacagtcc

SEQ ID NO: 14807 - DNA, 201 bp, Homo sapiens
tgtcagatgtgccctttctggtaataaaaagtcctttgccgtgggttattttgtcaagtgagatagcaggacttaacaggtttgtttgggaaaataaaatytgatagaaaaacggcatgcttttcccccacagatttcttggtagcatcattcaaaactacagtgagcagtatctttgcaggattttaatatttattcatt

SEQ ID NO: 14808 - DNA, 201 bp, Homo sapiens
aagtatgggccacacaaaacaggtctgtgggcttgacttgtcctctgatcatcagtttgtgacctctgttctaaagagtgaaaactatgtaagatagtatmagataagtaggtatttaaattactttgcaccttttccatttcatagaacttgaatgtttgtgttcaaagcttaaaacccaagacagtgagctattaagcc

SEQ ID NO: 14809 - DNA, 201 bp, Homo sapiens
gtaatgccagcagcacgggtgatgatcatggtcaacatgaccaactagaaagcccaaaccccacctctagctgacagtggcttctcagctaacctgtcacyacgtgggattgggcccccagtggtgtaagctttttcagagaagctacacatctagcttttggacctgtgatctccccaatgttttaatgctggcaactaa

SEQ ID NO: 14810 - DNA, 201 bp, Homo sapiens
ggagatgttctttgagattcggtgattgagttgtgaacatatggactgagggtgttttgtggtaaggcttgagtcatgtctgtagcaaggatgtttcctgrataatgtgcactgagcatcaagtgcctgcagtggcctggcgggtaatgccagcagcacgggtgatgatcatggtcaacatgaccaactagaaagcccaaa

SEQ ID NO: 14811 - DNA, 201 bp, Homo sapiens
agtctcacacttgacatagtagggtttgacatggtttaaataaaatctcaaccagatcagtgggagatgttctttgagattcggtgattgagttgtgaacrtatggactgagggtgttttgtggtaaggcttgagtcatgtctgtagcaaggatgtttcctgaataatgtgcactgagcatcaagtgcctgcagtggcctg

SEQ ID NO: 14812 - DNA, 201 bp, Homo sapiens
tgagcctgctacccttgtgcttctctgtccacgcaaagccaagtgctactgcggggttttccaaggcatagctagcatcctaatagtctcacacttgacakagtagggtttgacatggtttaaataaaatctcaaccagatcagtgggagatgttctttgagattcggtgattgagttgtgaacatatggactgagggtgt

SEQ ID NO: 14813 - DNA, 201 bp, Homo sapiens
aaacttaaaccagaaggaaccttcctggcatcggggaaagaagctgcctttttcttagctcctacctctgtgggagctttgtcagtatttgaggggacagrgttcccaccttcatgttttttgtgcctgaggattctgtgggcgactgtccccacctgtccagcctaccagtgagtctcatggtgtgcggctgcctgctcc

SEQ ID NO: 14814 - DNA, 201 bp, Homo sapiens
ttaggcctatcttcttgctttatgcataatggcagatctccagggagggagaggatgtgtgctggaagattctacaacttgttgattggttcctaaagatsgttttagtgctatgtttgtggggcggggctggagggggctggaaatcaccatctctgtggccttttaattgtgcccagttacaagtaacatttgtcccca

SEQ ID NO: 14815 - DNA, 201 bp, Homo sapiens
tttaggagctctgtgccaggaacctggatgaagacccagtatgtatttcttattatatcacaatatcacaaatccacagtcacatggtgattgtggtagtktggggggcctgatggtggggtacacctgcttgaagtcaggctaccatgcccattggggtcctcccccttttttgccctctgatcttgtgagttccttaac

SEQ ID NO: 14816 - DNA, 201 bp, Homo sapiens
accccatgcctggccaatttcaaggattttaggagctctgtgccaggaacctggatgaagacccagtatgtatttcttattatatcacaatatcacaaatscacagtcacatggtgattgtggtagtgtggggggcctgatggtggggtacacctgcttgaagtcaggctaccatgcccattggggtcctccccctttttt

SEQ ID NO: 14817 - DNA, 201 bp, Homo sapiens
tcagcttcccaatgtgctaggattacaggcatgagaccccatgcctggccaatttcaaggattttaggagctctgtgccaggaacctggatgaagacccartatgtatttcttattatatcacaatatcacaaatccacagtcacatggtgattgtggtagtgtggggggcctgatggtggggtacacctgcttgaagtca

SEQ ID NO: 14818 - DNA, 201 bp, Homo sapiens
ctcagcctcttgagtaactgggactgcaggtgcatggcactgtgctccacaattttttttttttttttagagatgggatctcactgtgttgtccaggctgrtctcaaacccttgggtttaagtgatcctcttgcctcagcttcccaatgtgctaggattacaggcatgagaccccatgcctggccaatttcaaggatttta

SEQ ID NO: 14819 - DNA, 201 bp, Homo sapiens
ttctcctgcctcaaggagctgcttctagtgtgtgctcttaaccctaaaggaaggaaacactgtgtcttcctcttctctcatacagagcccttcccatgacmaatgtgtggagtgttccctccttttacgtaattctccaattttctggaccccagcttggtgtcctacaattcagttttgacactaacgacccagagtcag

SEQ ID NO: 14820 - DNA, 201 bp, Homo sapiens
agaatagatggcaaatcccatgatttgtatttgactgacagtcaagaccctgtggggtgtgagcctggtgggggcattccaggctggtttctcctgcctcmaggagctgcttctagtgtgtgctcttaaccctaaaggaaggaaacactgtgtcttcctcttctctcatacagagcccttcccatgacaaatgtgtggagt

SEQ ID NO: 14821 - DNA, 201 bp, Homo sapiens
tatttggaccacttctccctctttccggacagctgcttagtaggtttagcttaaattatacacatgccaagcatgtacacatatgagaagcctatatctcrtaatatccacagagaatagatggcaaatcccatgatttgtatttgactgacagtcaagaccctgtggggtgtgagcctggtgggggcattccaggctggt

SEQ ID NO: 14822 - DNA, 201 bp, Homo sapiens
gaagagacctcaattctgtgccttgatgggattacaccgaagggagcactggtaggctgttgatgaaacaggtggtatttggaccacttctccctctttcmggacagctgcttagtaggtttagcttaaattatacacatgccaagcatgtacacatatgagaagcctatatctcgtaatatccacagagaatagatggca

SEQ ID NO: 14823 - DNA, 201 bp, Homo sapiens
ttggttgtcttagtagataggagtgtgagtacagaattatacgaagtgagaccatgggtgtgtgtgtgcacgtgtgtgcgcatgcctgtgtgtgtcattgsttagttaacaaaaggattgccctctgaagaacatgaacttgggccagacagcacgtgtagggggtggaattatggagcaattgttactttcttgtattaa

SEQ ID NO: 14824 - DNA, 201 bp, Homo sapiens
ctaaatcataaagaaccctgtctcgagcagacgagaaagagtaacggaggcctcaatggtgaaaggaaatcctgtaccagctgtgaaaacaatgagacacrttcagtaatagaatatagtgtgcttacaaattcagagttgggttcccttcttctcttgaagtggctataaattaattcatcaaaataaaaaaggccaaac

SEQ ID NO: 14825 - DNA, 201 bp, Homo sapiens
agagccaaggtcaatctgaatttttctttttctttcttcctttttttttttttttttttttttaaaaaaaaaaaggtgcttgaattagaaaggtagcacaytgtccacatggacagtgcaggatggggctggctttttcatttctgagagctggcaatggaatgaaggtctttttttttttcttaatttttcttttttaaa

SEQ ID NO: 14826 - DNA, 201 bp, Homo sapiens
aaagtaatataccacttttcgcttttttaatggtgagagccaaggtcaatctgaatttttctttttctttcttcctttttttttttttttttttttttaawaaaaaaaaggtgcttgaattagaaaggtagcacattgtccacatggacagtgcaggatggggctggctttttcatttctgagagctggcaatggaatgaa

SEQ ID NO: 14827 - DNA, 201 bp, Homo sapiens
caaagtaatataccacttttcgcttttttaatggtgagagccaaggtcaatctgaatttttctttttctttcttcctttttttttttttttttttttttawaaaaaaaaaggtgcttgaattagaaaggtagcacattgtccacatggacagtgcaggatggggctggctttttcatttctgagagctggcaatggaatga

SEQ ID NO: 14828 - DNA, 201 bp, Homo sapiens
gcaaagtaatataccacttttcgcttttttaatggtgagagccaaggtcaatctgaatttttctttttctttcttcctttttttttttttttttttttttwaaaaaaaaaaggtgcttgaattagaaaggtagcacattgtccacatggacagtgcaggatggggctggctttttcatttctgagagctggcaatggaatg

SEQ ID NO: 14829 - DNA, 201 bp, Homo sapiens
aatgtccggtttggagttggaggagtcattgattttaggcaaggtgatggtgagcccacagagcacagagttaatggaactctggccgttgatgtagcttygaagcctgaatttaagtcatatttttgaaaagttgcgtcttaaaaagttactagcgatggagaatgaaaagtcaatttggacactttaaaagtgagcctc

SEQ ID NO: 14830 - DNA, 201 bp, Homo sapiens
atctaagatagtgatctggttacatagattatcagagatacttttttttttgattatcagagatacttttaaaaaagcaactacaaggtaaggattatcckttaatttagtgtttttctattaaactcaatttgctttaaagttttttacattttgcctcttttttgtatgtttgagtaccacttcctaaccaatcacaat

SEQ ID NO: 14831 - DNA, 201 bp, Homo sapiens
aagaaaactcacagaagcagaaacttagggcttgctttaaatgttatcagtgtgaattgagatggtgtcagcattatttttttaaagaccaaaacaacaakagtaacaaacacacacaagccactgttagattttacaaaactttaaaaagtaattatcttaaagatatctaagatagtgatctggttacatagattatca

SEQ ID NO: 14832 - DNA, 201 bp, Homo sapiens
tcgcaatgattcggtgtgttttgttccgtgcatcctggcatgtgaaagaagtgaggtaaagagtataatttacttccttgttttaaagctagcattgcccrtgccttccacgcgggactgttgtggatatttgaccactgcaagaaaactcacagaagcagaaacttagggcttgctttaaatgttatcagtgtgaattga

SEQ ID NO: 14833 - DNA, 201 bp, Homo sapiens
aatcactgaatatgttataaccaaaaaggtcaaactcgcaatgattcggtgtgttttgttccgtgcatcctggcatgtgaaagaagtgaggtaaagagtayaatttacttccttgttttaaagctagcattgcccgtgccttccacgcgggactgttgtggatatttgaccactgcaagaaaactcacagaagcagaaact

SEQ ID NO: 14834 - DNA, 201 bp, Homo sapiens
tggtatccccaaacaaaatgttatcaaatgaagaactccttcccagctctcccttctgagtgtctgattttattcaagctcagatggcttctcagatagcktaaaaagtgatggagaatttcttttaccaattgtatgccctgtgggaacctgggtgctgtaatcactgaatatgttataaccaaaaaggtcaaactcgca

SEQ ID NO: 14835 - DNA, 201 bp, Homo sapiens
tggttagattacacgtttcctgagaggtatagatttcaaaattggtgtatttcacccgtccctcatcatggtatccccaaacaaaatgttatcaaatgaaraactccttcccagctctcccttctgagtgtctgattttattcaagctcagatggcttctcagatagcgtaaaaagtgatggagaatttcttttaccaatt

SEQ ID NO: 14836 - DNA, 201 bp, Homo sapiens
tactctaggaaggagaatctctgttgggatcttttggggagtacttgcctcccaagtgcttaggctcccgctgctgacaagaccctctgcctggcaagccstgcaggttggaatcctctgttagggttccaaagccttcaccaactcagagctctttctctctctgtttctcttttttgaatttaaattgatcctagtcac

SEQ ID NO: 14837 - DNA, 201 bp, Homo sapiens
gctgtttactctaggaaggagaatctctgttgggatcttttggggagtacttgcctcccaagtgcttaggctcccgctgctgacaagaccctctgcctggsaagccgtgcaggttggaatcctctgttagggttccaaagccttcaccaactcagagctctttctctctctgtttctcttttttgaatttaaattgatcct

SEQ ID NO: 14838 - DNA, 201 bp, Homo sapiens
ttaattatgaccataaaggccccatctccaaatgcagtcatgttgggggttagggcttcagtgtatgagtttgggatggcaggggagcagttcagctcgtragaatcgtaagattcctgatctgtttctcttccaagaaattgtttggtttcatgttgattttatctccttttccctatctgtctcaaagcactgaagaaa

SEQ ID NO: 14839 - DNA, 201 bp, Homo sapiens
tgtaaattgtctaaaattaaattttctgtggttgtcatccacatgggttctgaacttgctgttataattattcacattttcttgcagtgaaaatctacagrtcaaggtcatcttcacgtctttagttcttgttttgcttcaggtcagtttagaaccgaatgttaaaaggatattgtctattcgaagggtcagattgtggca

SEQ ID NO: 14840 - DNA, 201 bp, Homo sapiens
ttcttcctaccttccatatgagagaatagggaaaattaaagaataaatgtctctgggtttaatgcaactttactaaggaatgaaagtccgataagaatccrtatcttttgaaagaagattttttaaattccttatttttccttcctgcatggtcataaaacacactggggacagcccaccctgagaagtcaccaggcatct

SEQ ID NO: 14841 - DNA, 201 bp, Homo sapiens
ccctctgataatcctgcaagagccagcccagttttgctgacagcacagtctgctgtttaattattgtgtgttcaatgacttacctctttttagtttaattraaattatttctcagattaagagccatgctatgatgcttgccaacggatatttaaaacatgtaactgatttgttttttataatgcttcaggagaactcagt

SEQ ID NO: 14842 - DNA, 201 bp, Homo sapiens
gacgtctatgctttccagcttgccaattctggggcctggcacagtatctttcaccccggagtctcagtttcctcatctgtaaaatgggaaccatgacgtcrgcatcacagagttgtgagaattcgacaaggtggaatgaaagcaactagtgtggtgtctgaccgcttgtgttagtccatgaggaatttccttacgtattgt

SEQ ID NO: 14843 - DNA, 201 bp, Homo sapiens
atgcctatgcttttaaaaaattattgtgatacagtgaaacaaggaagaacgtgtagctggaaaaatagtatttgcttgtaatatacattcagattcataayaggcttatttgattcccaggacagggtgagcaaaggatgctgtttcctgggtgtctgctttggtgttcattgagtcatgtctctctctttagaccttact

SEQ ID NO: 14844 - DNA, 201 bp, Homo sapiens
attactgaaaaaaaaacaaaacaacaacaacaaacaacaaaaaaaacaccttccactaaaactgactcaaaaagataatagcagggaaaatgacatgtcgrtctgtgattccttttttacttgtcagtccttttgggagttgaacatataagcacatgtacctctatgtgacttttgagacgtctagaatagagaattcac

SEQ ID NO: 14845 - DNA, 201 bp, Homo sapiens
gcctgaaataatttcaaattaacccctgaggaacaaatgctcatgactttcaatgaatagaaaaatcagactgctagaacctccagactgcatgtcatgcrtagaagtagaatcctggggaagctagctcacaaaagcaagggagatacctgcaaggctgagctgagcttgcaagggaagaaaaatattagagagttgtca

SEQ ID NO: 14846 - DNA, 201 bp, Homo sapiens
agtggaatcacagacatgagccaccatgcctggcctgaaataatttcaaattaacccctgaggaacaaatgctcatgactttcaatgaatagaaaaatcaractgctagaacctccagactgcatgtcatgcgtagaagtagaatcctggggaagctagctcacaaaagcaagggagatacctgcaaggctgagctgagct

SEQ ID NO: 14847 - DNA, 201 bp, Homo sapiens
ggtccacctcctgggtaaaggagattctcctgcttcagcttcccaactagctgggacaacaggtgtgtgccaccacgtccagctaatttttgtatttttawtagagacggggtttcaccatgttggccaggctggtcttgaactcctaacctcaagtgatctgcccgccttggcctcccaaagtgctgggattacaggctc

SEQ ID NO: 14848 - DNA, 201 bp, Homo sapiens
caaattccaagcaaactttttacttcttattatgtaaaatggaagggttagccaaattaagatctcaccatcaaccttgagggagtgacttctacatgccrtgtattactggttataaagctagtcttgtttggattgaagaatttaatcatatttaacttttcaaaggatgctttttaaaaaaccttatccgcgtgttat

SEQ ID NO: 14849 - DNA, 201 bp, Homo sapiens
cattttattttgtgggcagatttcttttacagttctggctgggtttcttttagttggcttctttgctttgctcctgttacgacttagccctgtagctctgrgctcttcgattctcacgtgctgatggtgtagctgagctctgctaatgctggttattaatctgacaatctataccagggaggttttataattgccataatt

SEQ ID NO: 14850 - DNA, 201 bp, Homo sapiens
agctagtctgagtggcagccttacccattttattttgtgggcagatttcttttacagttctggctgggtttcttttagttggcttctttgctttgctcctrttacgacttagccctgtagctctgggctcttcgattctcacgtgctgatggtgtagctgagctctgctaatgctggttattaatctgacaatctatacca

SEQ ID NO: 14851 - DNA, 201 bp, Homo sapiens
ggattacaggcgtgagccaccacgcccggccttgatttttcttaacctttatttccaattatgcatcttctgagtaactataaagaaaagcaaaatctacrgtaggtatggagtgagtgcagagtcaccatcagcttgaacaaatgtgtgtatctgtggtcaagtttaattgcttcttctgtaatttatattaatcacgct

SEQ ID NO: 14852 - DNA, 201 bp, Homo sapiens
tggctaatttcttttgtatttttaatagagatgaggtcttgctatgttgcccatgctggtcttgaactcgtgggctcaagcagtccacttgcctcagcctmccaaagtactgggattacaggtgtgagccaccacatctggcgaaactctgggtagtttctaattatttctgtatttctatttgtatttaaaagtacagga

SEQ ID NO: 14853 - DNA, 201 bp, Homo sapiens
gtgttgttatgcagtgtgtgactgtaccagcagcttgatctttgtgcttctagagaacatttaaattgattcgcttttgtgagacagggtcttgctctgtyacccaggcttcagtgcatcagcgtgatcatagctcactgtagcctctccctcctgggccaagtgatcctctcacctcagcctcctgagtagcttggacta

SEQ ID NO: 14854 - DNA, 201 bp, Homo sapiens
aggatgtacttacaaatcctacgtggtataacccattatacacagaggctgtatgggatagcctgttgcttccaggctgcaaacttgtatagcatggtacygaactgaatactataggcagtcataacacaatggtaagtatttgtgtatctaaacacagaagtggtacagtaaaaatacagtgttgtaatcttatgggac

SEQ ID NO: 14855 - DNA, 201 bp, Homo sapiens
ggaggtgattagatcatgagggtggagccctcataagtaagatttgtgccctgatgagaagaggatagaaaggtagctaactttccttaagctatgtgaakgtgagaacacagtgggaaggcagccatctgtaactagtaggagggccctccccaagaacgtgaccatgctgccaccttgaccttggactttaagcctcca

SEQ ID NO: 14856 - DNA, 201 bp, Homo sapiens
agaaggacgtgtttgcttcctctcctgccatgattgtaagtttcctgaggtctccccagccacgtggaactgtgagtcaattaaacctctttcctttatamatttcccagtcttcgatatgtccttatagcagcatgaaaacagactaatacaggggcctctgggaggtgattagatcatgagggtggagccctcataagt

SEQ ID NO: 14857 - DNA, 201 bp, Homo sapiens
ggacatggttgtgtccccactgaaatctcatcttgaactatagttcccatgatccccatgtcttgtgggagggacccggtgggagataattgaatcatgcygttctcacgataatgagtgagttctcatgagatctgatggttttataaggggctttcttcccttttgcttggcacttctcttactgctgtcatgtgaaga

SEQ ID NO: 14858 - DNA, 201 bp, Homo sapiens
tctttttttttttgtcagactacttgccagcatactaaaatcaggatattttacttaaatgtagatttatgacagttttgaaaaatcagaatgagtattgkagactaaatgtttatgtcttccccaaaaattcctatgttgaaaccctaatcttaaggtcatggtatttggacatggttgtgtccccactgaaatctcatc

SEQ ID NO: 14859 - DNA, 201 bp, Homo sapiens
agtgattgacttacccgagtgtacacatgtttgcatctcacttgtatgttccttacatgtttacttaattattgggaaggtgtattaatgtcctgttgctrctataatggaccaccacaaactcggtgcttctatgctgcaaacctaagattataggcagtcataacacagtgttaagtatttgtgtatctaaacatagaa

SEQ ID NO: 14860 - DNA, 201 bp, Homo sapiens
tgctttcaggtggagaaattgtaccattgctgaaaatagcttcgctgacagttagggcaagcttcattggtagcaagtttctatctggaaagatgtaggasaggaacactgactctggaagcagacgtgacctagttttgaaacctgggataaccacttcctatctgtatgacccgagcaagttactttccttctcagaac

SEQ ID NO: 14861 - DNA, 201 bp, Homo sapiens
ttttttgccctctgatcttgtgagttccttaacattggggatcagtggtttttctcttacatgaaatgacaatgacactttatagggtttctgtagagaayaccttagaattagttaatgtgtttcataaagcacatggcgtggtacccagccaagagtaacactctgaagtgctcctccttacctggacattacagcatc

SEQ ID NO: 14862 - DNA, 201 bp, Homo sapiens
gctcgctgcatcctcttcacgagagctgatggtaggactgtagaagagtcacaaaacatcacatgacaacgccagtccctctgataatcctgcaagagccmgcccagttttgctgacagcacagtctgctgtttaattattgtgtgttcaatgacttacctctttttagtttaattaaaattatttctcagattaagagcc

SEQ ID NO: 14863 - DNA, 201 bp, Homo sapiens
tcttggaatcatgtctttatttttaaagtcatcttcactttgtttgtcttatgaatgaaagcatgagcaagtccattattattcacgcatttgtttgtagytcattgtcagtgtcatctgctttattagtcaggggtttgagaatgtttcttcctttaactcatttattaagaaaaataaaacgtggtgaacgcccatgat

SEQ ID NO: 14864 - DNA, 201 bp, Homo sapiens
taaattactttgcaccttttccatttcatagaacttgaatgtttgtgttcaaagcttaaaacccaagacagtgagctattaagcctccatggccacgtcawttttctgattgcatctgatgtaacaagtgctagaaaaactgatgctgttcattgctttaaaacgtctttctttattttcttggtattattaggtttacat

SEQ ID NO: 14865 - DNA, 201 bp, Homo sapiens
tggccaatttcaaggattttaggagctctgtgccaggaacctggatgaagacccagtatgtatttcttattatatcacaatatcacaaatccacagtcacrtggtgattgtggtagtgtggggggcctgatggtggggtacacctgcttgaagtcaggctaccatgcccattggggtcctcccccttttttgccctctgat

SEQ ID NO: 14866 - DNA, 201 bp, Homo sapiens
actattattctttaaaaccgttataccatgcatcatggtaacatcttttttactgagagttctgcattagcacacttgttcacccaagtttgtgatagttkataggactgcctggtgtattaagtagaaatgctcaactttgctgtcctatttttttgatcatatccaaaaagtgtcagtgtttgaatatagttttattgc

SEQ ID NO: 14867 - DNA, 201 bp, Homo sapiens
aaaatgtgtagggaaggacccttccttgcctctttcagcttctggtagccctagatgttcattggcctgtggcagggtaattccagtctctgcctccatcwgcacaagccattctccctgtatcttttcacatcatcttccctctattactgtttgtctctgttttctgatctcctcttcttctaagggtgacagttttac

SEQ ID NO: 14868 - DNA, 201 bp, Homo sapiens
ttaggattcttagagaggttttgttaccctaggcatgattacttaaatcattggccattggtgattaagtcaatctccagcccctcctcttcccccaaggyggggaatgtgggggttatcaattattcacaactctctaattgtgaataataaaagactctcccctcacccacattgctcagaaaatttcaaaggtttttg

SEQ ID NO: 14869 - DNA, 201 bp, Homo sapiens
ctctactaaaaatacaaaaattagctgggtgtggtggcacgcgcctgtaatcccagttgctggggagactgagacacgagaatcgcttgaatccctgcggkggaggttctagtgagcagaggttgcagattgcaccgctgcactccagcccgggtgacagagtgagactctgtctcagtcagtcaatcagtcaatcaatca

SEQ ID NO: 14870 - DNA, 201 bp, Homo sapiens
catgcaccaccattcctggctaatttcttttgtatttttaatagagatgaggtcttgctatgttgcccatgctggtcttgaactcgtgggctcaagcagtmcacttgcctcagcctcccaaagtactgggattacaggtgtgagccaccacatctggcgaaactctgggtagtttctaattatttctgtatttctatttgt

SEQ ID NO: 14871 - DNA, 201 bp, Homo sapiens
ggtgtgtgcttaggggcagctttgagccagataacaattctagttgcgcatgcttccataagctgtttactctaggaaggagaatctctgttgggatcttytggggagtacttgcctcccaagtgcttaggctcccgctgctgacaagaccctctgcctggcaagccgtgcaggttggaatcctctgttagggttccaaag

SEQ ID NO: 14872 - DNA, 201 bp, Homo sapiens
tctgcttatggctcaggatacttctttttttggccgtgtatgcgtcattgattttgtaacattatcagccattctgtctttaaatattgcttttcttagtstatttcacttgttttggaactcagattacatgtatgtgtaagagcctgggagaatgtgtttcatatgtctcttttgtgctttgttttattgtgttatttt

SEQ ID NO: 14873 - DNA, 201 bp, Homo sapiens
cgctttgtttctgttccaaaggcaattgtaaagggtaagaaaatggagttgtctattgcagcttttaaaagtagactagcaacgggtaatgcattgcttarataaaggaagatgtaagaaccagagtgtaatttcacaagacacagagacagatggcttacccgtaactacagtcaggaattctctaaaggagagagggtg

SEQ ID NO: 14874 - DNA, 201 bp, Homo sapiens
aagtagcgtcgacattatgaaatgcacaagaagttttcctgcccccaaccggtaactctctcctgcagtaatcaatgttggcacctgtttaaccacttttrtgtcttacgtgcacgctgttcggtactttgactttttttcttaatattataacatggaggccaggcgcggtggctcacgcctgtaatcccagcactttgg

SEQ ID NO: 14875 - DNA, 201 bp, Homo sapiens
ggaggctgaggcaggagaatggcgtgaacctgggaggcggagcttgcagtgagccgagattgcgccactgcactccagcctgggcgacagagcaagactcygtctcaaaaaaaaaaaaaaaaaaaaaaaaaaaagtgccatgtatattttgattacaaaaaatttcatgcggtgttactttctttttattggtagagggtc

SEQ ID NO: 14876 - DNA, 201 bp, Homo sapiens
ccccgtctctactaaaaataacacaaaattagctgggcatggtggcgggcgcctgtagtcccagctactcgggaggctgaggcaggagaatggcgtgaacstgggaggcggagcttgcagtgagccgagattgcgccactgcactccagcctgggcgacagagcaagactccgtctcaaaaaaaaaaaaaaaaaaaaaaaa

SEQ ID NO: 14877 - DNA, 201 bp, Homo sapiens
gagatcgagaccatcctggctaacacggtgaaaccccgtctctactaaaaataacacaaaattagctgggcatggtggcgggcgcctgtagtcccagctaytcgggaggctgaggcaggagaatggcgtgaacctgggaggcggagcttgcagtgagccgagattgcgccactgcactccagcctgggcgacagagcaaga

SEQ ID NO: 14878 - DNA, 201 bp, Homo sapiens
aaagtcaatttggacactttaaaagtgagcctcaaaaaactgctgaattttcccaacattgtgttttgagcacttccacgtgactttggtagcataaagamtttagtcttttcaagaggcaaagtaatataccacttttcgcttttttaatggtgagagccaaggtcaatctgaatttttctttttctttcttcctttttt

SEQ ID NO: 14879 - DNA, 201 bp, Homo sapiens
attactatatatatatatatatacacatatatatatatacacacatatatatatatatatatacacacacacacacatatatatatatatatatatatatwtttttttttttttggagatggagttttactctgtcgcccaggctggagtacagtggcgcgatctgagctcactgcaacctctgcctcccaggttcaagca

SEQ ID NO: 14880 - DNA, 201 bp, Homo sapiens
gatgttttattagggtggtgcaaacgtggtttttgccattactatatatatatatatatacacatatatatatatacacacatatatatatatatatatayacacacacacacatatatatatatatatatatatatttttttttttttttggagatggagttttactctgtcgcccaggctggagtacagtggcgcgatc

SEQ ID NO: 14881 - DNA, 201 bp, Homo sapiens
tgtagcaataattaataagctggatagcctgatagcctgatgttttattagggtggtgcaaacgtggtttttgccattactatatatatatatatatacayatatatatatatacacacatatatatatatatatatacacacacacacacatatatatatatatatatatatatttttttttttttttggagatggagtt

SEQ ID NO: 14882 - DNA, 201 bp, Homo sapiens
atgtagcaataattaataagctggatagcctgatagcctgatgttttattagggtggtgcaaacgtggtttttgccattactatatatatatatatatacrcatatatatatatacacacatatatatatatatatatacacacacacacacatatatatatatatatatatatatttttttttttttttggagatggagt

SEQ ID NO: 14883 - DNA, 201 bp, Homo sapiens
aaaacaaagctcattcctctaaaagaattggtatgtttttttttttttttttttggtggtggttgtttaatgaggaggacattataaagtattatatttcstttccttaccttggttgccaggaagctcagaactttaaacattaaaatgtttaagtaaccagctcacttcacgtttcggatcagctttctttttcttaac

SEQ ID NO: 14884 - DNA, 201 bp, Homo sapiens
ttaaaacaaaactgtgtagcagtgtgttatagccacaggaactcctcagccaaatgttaagttaatgcaatgaaaacatttgtaaaaacattatcaagctrcaaaagaactagaaatgctagatactccctagtagctgggtgttcaaaaacacttgtcattctcacagttatatttgtggtatcttagtggtcattcacc

SEQ ID NO: 14885 - DNA, 201 bp, Homo sapiens
aaggccctgtttccaagtaaggtgacattctgaggtactgggcttaggacttcaacatatctttttggggggacacaattagaccaatagcaactgtgctrtaaaagagatgttgctttttatcattgatgctatccagatgcatagcaatcattcaacaagtcattcgaaagaaataggtatttcctgagggtctagtat

SEQ ID NO: 14886 - DNA, 201 bp, Homo sapiens
tgaaaatgttttaagagttctttgtcttaccttaggttcctccaaaaacagaaccagagaaaaagacatatttatgcataatttgggatgtgattacaaasagagggatggggaattcaggaaggaaggagaggcaatataaaaatgtgttttttagttagtcattactagaggcaactagtgctcaactccaggcacttt

SEQ ID NO: 14887 - DNA, 201 bp, Homo sapiens
tgggcgtactggcaggcgcctataatcccagctactcgggaggctgaggcaggagaattgcttgaacccaggaggcggaggttgcagcgagctgagattgygccactgcactccagcccaggcgatagagtgagactctgtctctaaatacataaataaataaaagtagagagtaagttttctgtattgaaaatgttttaa

SEQ ID NO: 14888 - DNA, 201 bp, Homo sapiens
tggtaatattgtcatatggtgatcccactgtggatagatacgcaagagagaaaatccagaagaaagcatttcactgaagcctggggacatttctggtgacwaatggtgctgatggcacagtgagaacgggagagggcagaagcaatgcacagatagaaagggtgtcacctgcgcattgaaaaatcccagtgccataacaat

SEQ ID NO: 14889 - DNA, 201 bp, Homo sapiens
acttcgcaatgcctgctgaattttacctattctgtaagtctttttgggaaccgttgagcccctcttctcttagttgcctttagcctttgtttttattatgrcaattggtatgaaatttttccttttcattacttcttttattcagagcacacctctggcttatctcttcattctctgtttagtttcatattttactttaat

SEQ ID NO: 14890 - DNA, 201 bp, Homo sapiens
atggctgtcagaagtctttctttagaaatttaaccatatttttaatggtgggcattgcagtcaacaatagtacagactttgcaaagactattttttttttkgggtgcagtgaatacttcgcaatgcctgctgaattttacctattctgtaagtctttttgggaaccgttgagcccctcttctcttagttgcctttagcctt

SEQ ID NO: 14891 - DNA, 201 bp, Homo sapiens
ctgtagatgccttccatcttcttaagagattttgtgcctcttgcacaggtattatccctaagatgtgttttcttcaatgtacctagactgtttccttaaaraattgcttttgtatggtacggctctatgtgtctgtgtttctcatgttggttaggagaactaacccttgtgacgaataagaaatggcaaacattgttaatg

SEQ ID NO: 14892 - DNA, 201 bp, Homo sapiens
gattccaaatttacagtcaatggactgtagatgccttccatcttcttaagagattttgtgcctcttgcacaggtattatccctaagatgtgttttcttcartgtacctagactgtttccttaaagaattgcttttgtatggtacggctctatgtgtctgtgtttctcatgttggttaggagaactaacccttgtgacgaat

SEQ ID NO: 14893 - DNA, 201 bp, Homo sapiens
aaaggagattctcctgcttcagcttcccaactagctgggacaacaggtgtgtgccaccacgtccagctaatttttgtatttttattagagacggggtttcmccatgttggccaggctggtcttgaactcctaacctcaagtgatctgcccgccttggcctcccaaagtgctgggattacaggctcacgccaccatgcctag

SEQ ID NO: 14894 - DNA, 201 bp, Homo sapiens
atgcagtcagcttcactgaatgacagagatatgatctgagaagtgtgtcaggcagtgtcatcgttgtgcgaccctcataggatgtacttacaaatcctacrtggtataacccattatacacagaggctgtatgggatagcctgttgcttccaggctgcaaacttgtatagcatggtaccgaactgaatactataggcagtc

SEQ ID NO: 14895 - DNA, 201 bp, Homo sapiens
tgcccttgtggaggatacaaaacacaccaaaatgcagtcagcttcactgaatgacagagatatgatctgagaagtgtgtcaggcagtgtcatcgttgtgcraccctcataggatgtacttacaaatcctacgtggtataacccattatacacagaggctgtatgggatagcctgttgcttccaggctgcaaacttgtatag

SEQ ID NO: 14896 - DNA, 201 bp, Homo sapiens
gaaggcagccatctgtaactagtaggagggccctccccaagaacgtgaccatgctgccaccttgaccttggactttaagcctccagaactgtgttaaagamatgtctgctatttaagccactcggtccatgatattttgttgctgcagcttcagctgactatggcttatgtctatcaaggaacatagttgcactgaggttg

SEQ ID NO: 14897 - DNA, 201 bp, Homo sapiens
tgtaaattcaagagaataataacttctctgtcacatactgttttgtacagatcaagtaaaacaatgtgtgaaatgctgtaatgaagaagtccaatagtgtrtgaatataaggttgctggcgtttggggaaaaatcatagttatagaagaaagactcctaaagggaagattagggttggaagaagatggaggaagagagtaa

SEQ ID NO: 14898 - DNA, 201 bp, Homo sapiens
tgtgaagtcgtaaggccttcttgctctggtgacatctgttaggcttcgtctctatatcatcccccaactccttgacccttgatatttgctggtctacttcmcttcaggtccttcctcacctcacatctctgcgcaaggatttcatctggtatgtcactaaatattaccttcctgtgtttctcaaggtcaatttgatagact

SEQ ID NO: 14899 - DNA, 201 bp, Homo sapiens
ctgaagaaactcaacctgttcatcatctctcatcttttcacttgttctctgtgtatgccattatattgtgttcctcattttcccaagatgatgattatggwaactcaaattttgcaccagaagctgtagttaccatttcattccattgcaccattcataccctgcagagaggatgtgaagtcgtaaggccttcttgctctg

SEQ ID NO: 14900 - DNA, 201 bp, Homo sapiens
ctaatacacgtggctccagatgtttaaaattagatttgataggttgtaggctgaagaaactcaacctgttcatcatctctcatcttttcacttgttctctstgtatgccattatattgtgttcctcattttcccaagatgatgattatggaaactcaaattttgcaccagaagctgtagttaccatttcattccattgcac

SEQ ID NO: 14901 - DNA, 201 bp, Homo sapiens
cgagtcattttcttttttcttttttttctttttcttttttattttttttttgagactgagtttcactctgtcaccaggctggagtgcagtggcacaatctygactcactgcaactttcacctcctgcgttcaagcaattcttctgcctcagcctcccgagtagccgggactacaggcacgcgtcaccatgcccagctaatt

SEQ ID NO: 14902 - DNA, 201 bp, Homo sapiens
tatgtattcttccagaaaaaggttatctatataccagcaaacacactcacattctgttctgtactttttttttttttaaacttagtactgcaggagatctsttattagtgcatatagatctacttcattgttttaactgctgtataatattccatcatgtgcttatgctataaccagtcttccctttggtggccatttagg

SEQ ID NO: 14903 - DNA, 201 bp, Homo sapiens
tgaaattcagtatatttgaaatgagcccttatcttgagctcactgagcttattattttgggttaaataaaaaagaaaacagagtcttactttttctgatcmttttattgtctttctgactaatgttaaaaagtagtaacctctagtaggtgggatttttagggatgtattgagaagagtacaaatgggaatacgtgcatct

SEQ ID NO: 14904 - DNA, 201 bp, Homo sapiens
ctttattagtcaggggtttgagaatgtttcttcctttaactcatttattaagaaaaataaaacgtggtgaacgcccatgattgcaactaggagactgttaygcttatggttgttaagattagaaagaaggaagctttaaccctatctctgatttcttacttttctctgtctatgtagaagttgatgttgatacgtgtctac

SEQ ID NO: 14905 - DNA, 201 bp, Homo sapiens
atcagatttcttttggcccgtgttatacagtataccttttctattcttttactttttttatgcttatgtttaaataaggtataaaacataatgtacattcktttttaaggacagtatatgtatatttatgttttcttcagtctgacaaactttttcttttaattgccatctttaggccatttatatttaatgtaatgacag

SEQ ID NO: 14906 - DNA, 201 bp, Homo sapiens
tggcaactttttttgtagtgtttttctaggaatttgtcttttttacctgtattgtaaattcattggtataaagttgttcaccatatcttaagatcttcttwgggttcataggatctgtagtccttttctttatttttcatttttaaaaacaactttattgaggtatgattgacgtacaaaaagcctcacgtatttgatgta

SEQ ID NO: 14907 - DNA, 201 bp, Homo sapiens
gaaagatattcctgatcattgctttgacctggaaatttcaaagggacccacagtccaccattccgtccaagatcttctgggtgtgtgaagtcccgggctcmcaaatgcagttgtgtttggtcactgtgttgcttgcatatggctgttggcatctcattagcctgattgatggggcagatcagtcagcaagactttgttcgg

SEQ ID NO: 14908 - DNA, 201 bp, Homo sapiens
gcctaaatccacaggctcccgctgcctacagaggagtcccacagttttcgcttgcttcatggagcttcatctctgttgtattcatgtgatttatttacacrgagttgctccccaatccttgatctttttttttttttttttttttgccaagcaccctgcctttttgcttgtctgtttcgtctttatctctccttccagtaa

SEQ ID NO: 14909 - DNA, 201 bp, Homo sapiens
tacctctgtgggagctttgtcagtatttgaggggacagggttcccaccttcatgttttttgtgcctgaggattctgtgggcgactgtccccacctgtccarcctaccagtgagtctcatggtgtgcggctgcctgctccgatgctctccaccaccatgcccaagccatttctccctttgtgttccctgtctgggtaaacaa

SEQ ID NO: 14910 - DNA, 201 bp, Homo sapiens
ccccaactcctttgggcgtcttaataaaaatgataattaaaaccataatttacagtaaatggggacactgcccaagtacatccacaatatggagaaaattwaaaaacttaaaccagaaggaaccttcctggcatcggggaaagaagctgcctttttcttagctcctacctctgtgggagctttgtcagtatttgaggggac

SEQ ID NO: 14911 - DNA, 201 bp, Homo sapiens
ggcttgctttaaatgttatcagtgtgaattgagatggtgtcagcattatttttttaaagaccaaaacaacaatagtaacaaacacacacaagccactgttrgattttacaaaactttaaaaagtaattatcttaaagatatctaagatagtgatctggttacatagattatcagagatacttttttttttgattatcagag

SEQ ID NO: 14912 - DNA, 201 bp, Homo sapiens
gtattcttccagaaaaaggttatctatataccagcaaacacactcacattctgttctgtactttttttttttttaaacttagtactgcaggagatctgttrttagtgcatatagatctacttcattgttttaactgctgtataatattccatcatgtgcttatgctataaccagtcttccctttggtggccatttaggttg

SEQ ID NO: 14913 - DNA, 201 bp, Homo sapiens
agataaacattatgtattcttccagaaaaaggttatctatataccagcaaacacactcacattctgttctgtactttttttttttttaaacttagtactgyaggagatctgttattagtgcatatagatctacttcattgttttaactgctgtataatattccatcatgtgcttatgctataaccagtcttccctttggtg

SEQ ID NO: 14914 - DNA, 201 bp, Homo sapiens
tcttctcaggcttccaaccactatgtttggaaatgaaatatgccttgaaggaaaaaagctgccaaatgctggccttgcagtttttgcagatcttggccccmaaaattcttagtcatagtgcccttctgatgccttcaaacagatatgggtgtgtatgcacgtgtgttattttgtccatcttttctaattgttctcagtagg

SEQ ID NO: 14915 - DNA, 201 bp, Homo sapiens
agatggttctatgttgtcaggggctgccctgttcatggtaagatgttttgtaatgcctggtgtttacccactagatgccagtaggactctaccccacaacygtggccactgaaaatgtctccagacatttgcttctgtcccctggggatcaaaatcacccctggttgagaacttggggtaatttaagtggtgctccggtaa

SEQ ID NO: 14916 - DNA, 201 bp, Homo sapiens
ccaagtcttttgccctccatggtgcacatgtgatcttggcctgcaggaacatggcaagggcgagtgaagcagtgtcacgcattttagaagaatgggtaagygcttgactgttgttgttttttttaattgtcaaatacacatgccgggctaaccatatggagatttcagtggagtgtgtaaagtttattgctcttggaatca

SEQ ID NO: 14917 - DNA, 201 bp, Homo sapiens
aggaacatggcaagggcgagtgaagcagtgtcacgcattttagaagaatgggtaagcgcttgactgttgttgttttttttaattgtcaaatacacatgccrggctaaccatatggagatttcagtggagtgtgtaaagtttattgctcttggaatcatgtctttatttttaaagtcatcttcactttgtttgtcttatgaa

SEQ ID NO: 14918 - DNA, 201 bp, Homo sapiens
tcctttaactcatttattaagaaaaataaaacgtggtgaacgcccatgattgcaactaggagactgttatgcttatggttgttaagattagaaagaaggargctttaaccctatctctgatttcttacttttctctgtctatgtagaagttgatgttgatacgtgtctacataaatatttactaagggcttgcattagtct

SEQ ID NO: 14919 - DNA, 201 bp, Homo sapiens
ttccctttggtggccatttaggttgtttgcattgttttgctatttgttattccaagcaatggtgtttcacagttctctctttcttgcatcagtctttcttrcgatatcatctgatattgggcctaaactatgctgctgtgagcattctttatttacgtatttgtgagtaaatgcctggggcagaatcttagcactggactc

SEQ ID NO: 14920 - DNA, 201 bp, Homo sapiens
ggcacaatctcgactcactgcaactttcacctcctgcgttcaagcaattcttctgcctcagcctcccgagtagccgggactacaggcacgcgtcaccatgyccagctaatttttgtatttttaatacagacggagtttcaccatgttggctgggatagtctcgacctcctgatctcatgatctacacacctaggcctccca

SEQ ID NO: 14921 - DNA, 201 bp, Homo sapiens
ttctgcctcagcctcccgagtagccgggactacaggcacgcgtcaccatgcccagctaatttttgtatttttaatacagacggagtttcaccatgttggcygggatagtctcgacctcctgatctcatgatctacacacctaggcctcccaaagtgctgggattacaggcatgagccaccgtgcccgacctcccgagtcat

SEQ ID NO: 14922 - DNA, 201 bp, Homo sapiens
accatgcccagctaatttttgtatttttaatacagacggagtttcaccatgttggctgggatagtctcgacctcctgatctcatgatctacacacctaggmctcccaaagtgctgggattacaggcatgagccaccgtgcccgacctcccgagtcatttcttatcttgttgctccaatttccattcccactgacagtgtag

SEQ ID NO: 14923 - DNA, 201 bp, Homo sapiens
gcttgcagtgttcttgggactagcaggagggcgtgtcaaaattgtaaaactctgcctatttgatgtaatatttgaaactagaaaggtaaaattccagggaygctagtgacactatggtaacctgattgtacagtgacattcatgtttaaaccagtcttggaagataatgctgtagcacaactgtttttgcatcattaaatt

SEQ ID NO: 14924 - DNA, 201 bp, Homo sapiens
cccaagatgatgattatggaaactcaaattttgcaccagaagctgtagttaccatttcattccattgcaccattcataccctgcagagaggatgtgaagtygtaaggccttcttgctctggtgacatctgttaggcttcgtctctatatcatcccccaactccttgacccttgatatttgctggtctacttcacttcaggt

SEQ ID NO: 14925 - DNA, 201 bp, Homo sapiens
tttcttttttttttttttgcattttccagacgagccaagggatggctcagaagggtgaaggaactcacccgaattgcacagctggtgagctcagagtcagkctccttgcttggtccatctggcttccaaactccaagtctgtctgctccaccccatggcccatctttttaccatgtttagtatcaatgttcatactttgca

SEQ ID NO: 14926 - DNA, 201 bp, Homo sapiens
gttctgaacttgctgttataattattcacattttcttgcagtgaaaatctacaggtcaaggtcatcttcacgtctttagttcttgttttgcttcaggtcastttagaaccgaatgttaaaaggatattgtctattcgaagggtcagattgtggcacgtggaccaaatccagccccccgaggcccacttttgtaaatcaggt

SEQ ID NO: 14927 - DNA, 201 bp, Homo sapiens
aagactccgtctcaaaaaaaaaaaaaaaaaaaaaaaaaaaagtgccatgtatattttgattacaaaaaatttcatgcggtgttactttctttttattggtrgagggtctttatgttttatttttttgagacagaatctgctccatcactcaggctggagggcagtggcaggatcgtagctcactgtaacctcgaattccta

SEQ ID NO: 14928 - DNA, 201 bp, Homo sapiens
cccttgagcaggaataagtgagtggcagagggggtcagggatgttaacgcaaatggagatcccttcacccagaaagacacatctgaaatggagaagatgcytttttcctcctgcaaccaataagagagtgatgaaaattatgacgccttgggaaataagactgcaacgtaaatgtgtgtccaccccctagttttcttttgg

SEQ ID NO: 14929 - DNA, 201 bp, Homo sapiens
ctgaaccacacttgttatctttcattttatgatgagaaccaccttaagaggtgtgaggtgacatctcactgtggtttcaatttgcattttcctgagaattwgtgacagtgagccccttttcatacacttggctatttgtatgttttctttggagaattgtctatttggttcctttgcttgtttttaaaatctgtggttttt

SEQ ID NO: 14930 - DNA, 201 bp, Homo sapiens
tgtttacctgtttatgataaaggatattacaaagagtacagatgaagcggtacatagggccaggcatgcggaggggatgtggagcttccataccccctccyggcatgcccctctccaggcaccacatgctcagcaatctggaagctctccaaaccctatcgtttaggtttttgttgttgttgttttgagatagggtctcgc

SEQ ID NO: 14931 - DNA, 201 bp, Homo sapiens
gcaagtgtgatcattcaggtaatcaaagtaactacagaaacagaggtatggattagctagtcattgcagatgtggcattgagcatataagcgtggtgtacwtcttagaacttcatctggaaatgcctgtgggggagttggatttcaagatcatcgtcaatgtcatgtcactgtaatttcatttacattaatcagattagtt

SEQ ID NO: 14932 - DNA, 201 bp, Homo sapiens
aaatcaggatgctcaggaaataccttgtttggaataggaataggctcctccctttttttctcacttgccttgattgctctgtattaaaattcataaaggcycatgaattatcaattagatagcatttggtttgttatttttagtttcttcctatagcaggcatgtatgcatgtgttaaaaatggaagtagcgtcgacatta

SEQ ID NO: 14933 - DNA, 201 bp, Homo sapiens
gggttgcatgtcatgcaattgactgggtggtgatgactaaaattttaatgatgcgatctcatttaaagttgacaggctctgactctagccagatattcagragcagaaacttgattcaataagaagggaacctgcagaggcagaaacttctgtgggttgcagttgtgttgagattacacaggtggaaatgttgcgagttct

SEQ ID NO: 14934 - DNA, 201 bp, Homo sapiens
taggtaaaaaggagctgggttaagatgcaccgtcatatgaaacagggaaaaagggtttgcttgggttttagattcctgaaacagtctgctgagggattctraagttgttgtggtctctgttccactttgggagtttgataaaaattggcctgttttatttgacagctcttaggtagtgtgcaaaattgtcaacagataata

SEQ ID NO: 14935 - DNA, 201 bp, Homo sapiens
atctatgaagttgcctggttgccccacatctttaccgacaggactgccgctcaatgtagttacccttgtagaatctgtctgcatgtgcctgtctaggaccrtgttaattgtaatctttgggcatttttctcactcattcctaaccaggactgtcactggcaggttaaatgagaacttattcacccagcacagtggcagcac

SEQ ID NO: 14936 - DNA, 201 bp, Homo sapiens
ggatataggagaaactcatccttaaagatagtagtctgttaatacaaaaacagtccccacatttgcattgtccccaaatctaacccaagctgaaagacatyaggcctatcttcttgctttatgcataatggcagatctccagggagggagaggatgtgtgctggaagattctacaacttgttgattggttcctaaagatcg

SEQ ID NO: 14937 - DNA, 201 bp, Homo sapiens
taaccaatcacaataaatgtccggtttggagttggaggagtcattgattttaggcaaggtgatggtgagcccacagagcacagagttaatggaactctggscgttgatgtagcttcgaagcctgaatttaagtcatatttttgaaaagttgcgtcttaaaaagttactagcgatggagaatgaaaagtcaatttggacact

SEQ ID NO: 14938 - DNA, 201 bp, Homo sapiens
aaagccaactttcagcatttactgtggtgtctacttttgaacttaaaggcacacagcaaataaccctaaaagtggagggtatacagtttagcccttctackcaatgcaaaacaaaacaaattaaggcatgttcctgacttagtatgcattcttctcaacaaataaaagtaattttacagaagatatatagtagcccccaaa

SEQ ID NO: 14939 - DNA, 201 bp, Homo sapiens
ctcaggagttcaagaccagcttggccaaatgatgaaaccccatatctactaaaaatacaaaaatttgtcaggcatggtggtgcacatctgtaatcccagcwactcaggaggctgaggcacaagaatcacttgaacccaggaggtggaggttgcagcaagctgagatctagccactgaactccagcctgggaaacagagcga

SEQ ID NO: 14940 - DNA, 201 bp, Homo sapiens
gacaccttacaacacagtggagagtctactgcaacaaattaacagtttaataaaatggagaaaatacctggtttcacaatcatttgcaaagctcagggagataatgagataaggctgcagtgaacaaggagacacattacttacgtgacccattcatcacgctcattgccctcaaatctctgagagtccaaaaaaaaaaaa

SEQ ID NO: 14941 - DNA, 201 bp, Homo sapiens
ttcttaaacgaaactgcatatcacattattgcagggttgagctgcttgtctggctgagctaaaagcaccccatggacagttgtgccccattcttaataaayaggtagtgacaacttttagctaaggaaccgccattaagaagtatttatagtgactgttatggactgaaacatgtctttccttgcaatttatatgttgaga

SEQ ID NO: 14942 - DNA, 201 bp, Homo sapiens
tcacatcacttttgggtttggggttttgtttgtaatggtcagattacaggatacaggttttataggtctggctttgatacaaaccagtagacttgcattamaatcaaaacttcatttagtgtatggatggtgaaaattgtgtgcaaaactgtttctataattagacaaaagggaatcaggcagagcctattttcactgcct

SEQ ID NO: 14943 - DNA, 201 bp, Homo sapiens
gaattttgtagagtttttgtttttttaatgcatccaacacataggagaattttattttaaagccctttttaaaaatgaaaattctagttggtcatcaattytcttcagagcaaacatcatttattctactctataaaaagaaacctaaacaaattaagatgacaagtaagaaaaacttattctctttatctcctttaaaac

SEQ ID NO: 14944 - DNA, 201 bp, Homo sapiens
tgcgagggcggaactcatcactcatggcccgcatggcctccaggatggtctcgtgcatgttctgggccaccacagagtcatccacctgcatccagaactcyccgggccccgtcacggcagaacggcccacctcgatgaagaagaagttttccgagtggccacagcgcctgatgttcatcagctgcagcaccacggccgctg

SEQ ID NO: 14945 - DNA, 201 bp, Homo sapiens
atatagaacgtgcagttcagtcaatgaaatcctgaggattggataaagtaaacaaactgaaatggatgcatcgtaccatctactgatgaggaagatatgargtcctagttgtgaatcatgaaatatttagagtctgggtacccatgagttagaagaggatttgctgaggtcatttaggtcttcattctgaaaagaaaaagg

SEQ ID NO: 14946 - DNA, 201 bp, Homo sapiens
cctgccaggctgccctccggcccggccccaggtccatcttcatgtactcctcagtgccagtctcttcctctctgggagctggctggagctgggatggacayctgacagaaggtgagctgtggaaagccaccgggccagacaagtagccagactgatcactcccaaattcaatattgacatattcccccgggctcttgggct

SEQ ID NO: 14947 - DNA, 201 bp, Homo sapiens
agcccaggaggatgcgttttcccagctcttacctagctctggtgctttgcagtaaagtgtatggagcctagggcactttcaagccaaaggaattccccctycccccatgacccaaaacgatggcatccgcagcactcgcaggtctctctccctcccttggttgaggggggcgggcaggaatcgcgggccaaccccacctgg

SEQ ID NO: 14948 - DNA, 201 bp, Homo sapiens
tgggtcataacatttgcacctgcttggtacgtttccacctgtgatgtttcacttggcccctcagaaaaagcgctgccctgggatcttatgattcagtgatscaagagggatgttggctggtgagaaatgcttatttgagagggaaggaggaggaggagaaaatactcccatagcacttttctttcttattttccttatttt

SEQ ID NO: 14949 - DNA, 201 bp, Homo sapiens
atatttaaacatacatataatatacttaaacatctatatatatgtttatatacatatataaatccatctctttaagatgctcatgccttctgcctggcacrgcacacagcactggatctctctgtcaaagagtgctgagactcaagagtagagtcaagaattctacagaagaaaacattcagcactccccagtcatacttt

SEQ ID NO: 14950 - DNA, 201 bp, Homo sapiens
agacagagactctgaggggactacagtcccaagggaaataaatggggtcaccttcagacccatggaagggccagacagaagccatccatctggcctttggsagaaacacgctcatgaggctcaaccaatttctctttgcagacaccctccagtctccaagcatttcactaaatctctagggtaatggttctcaatttgtgt

SEQ ID NO: 14951 - DNA, 201 bp, Homo sapiens
aagacagagactctgaggggactacagtcccaagggaaataaatggggtcaccttcagacccatggaagggccagacagaagccatccatctggcctttgscagaaacacgctcatgaggctcaaccaatttctctttgcagacaccctccagtctccaagcatttcactaaatctctagggtaatggttctcaatttgtg

SEQ ID NO: 14952 - DNA, 201 bp, Homo sapiens
tctatgttgctttggtgttgcagtcccagaagataacacaaggcttgccacgtggtagtacttaataaataggagttaaataaatgaaaaggaaaaggacrcttcccattgagaacatatgacaaggtcctacagggtgagatggtagccgtgagcaggctcaagtagaggatgtggcttcactggaccccaagatatcta

SEQ ID NO: 14953 - DNA, 201 bp, Homo sapiens
tagaagagttaactagagaagaatgagaaacttctgccgccagggctcttgaacaatacagatttggatgactgcaaagaggacattgggggaaaactacmatagttagaattccttaaaagactccacacgggtatttttttttttttttttttttttttttgagacagagtctcgctttgtcgcccaggctggagtgca

SEQ ID NO: 14954 - DNA, 201 bp, Homo sapiens
tcgacttcttgtttggtcatcatggaacaaccataaaaagaatcatttctgtagaaatattcaaaggttttatgaattttcccaaggccctctcttaatchtatatatatatatatatatatatatatatatatatatatatattttttttttttttttttgagacagggtctcactctgttgcccaagctggagtgcagt

SEQ ID NO: 14955 - DNA, 201 bp, Homo sapiens
actgaggactgggacggggtcttctggtgggtaatggtaggggatgtgcctgccgagtgagttctctttcggaaccgattatccagatctgcagcactggstgcttcatccccagccaaggctggactcgtgcccaagcctgttcctggggtgcagcggtggccattgccaccccgagacaaaatgtagtgaccgttgggg

SEQ ID NO: 14956 - DNA, 201 bp, Homo sapiens
gatggacacctgacagaaggtgagctgtggaaagccaccgggccagacaagtagccagactgatcactcccaaattcaatattgacatattcccccgggcycttgggctctggagggtgcagcaagggctgctgctgctgctgctgctctcgggcccgaggtaaggtgctggccttgggatcccccagggacagcctcgtg

SEQ ID NO: 14957 - DNA, 201 bp, Homo sapiens
gtgtccacgtagctctgacggggacaactcatctgcatggtcatgtagtcaccccggctgctgggcactgcccgggtaggcctgcaaatgctagcagcccygggaggtgcagggcccagtctgcccatctcgaccccagtgctctcctgccaggctgccctccggcccggccccaggtccatcttcatgtactcctcagtg

SEQ ID NO: 14958 - DNA, 201 bp, Homo sapiens
agtcagcccgcttgttgatgttgaagcagctctcaagggggatcgagcgtttgggggcgctcgacttgtgccgccacttcttctcgttctcgtagtactcraggcgcgccgggcccccagcctcgctggccgcgcgcagtacgaagaagcgtttgtgcatgctcttgggtttgcgcaggtagcccaccttgcgcacgtccg

SEQ ID NO: 14959 - DNA, 201 bp, Homo sapiens
gctgggatggacacctgacagaaggtgagctgtggaaagccaccgggccagacaagtagccagactgatcactcccaaattcaatattgacatattccccsgggctcttgggctctggagggtgcagcaagggctgctgctgctgctgctgctctcgggcccgaggtaaggtgctggccttgggatcccccagggacagcc

SEQ ID NO: 14960 - DNA, 201 bp, Homo sapiens
tgccctttcggccactgggcactggggccacccctggggacatgggcatgtagccatcatccgtgtggagggtggagctgtctgggcggtggtgccccccycgacgctccaaggggtgcatttccagaccctcctctgggtaggagcgggtgggcacgaaggcggagtgcctgtgtcccggcagtcggcctccactgccac

SEQ ID NO: 14961 - DNA, 201 bp, Homo sapiens
cgtttgtccacagctttccatagctggtcccggaagggacggcgttgctgctgctgctgctgctgctggggccacctccaatgtcaggagagcagccaccrctgggggacatcatcatgtagccattggggtccactctctggggatggcgtctgatgggattgatgatctgctgtggggcagatacgctcttggggctca

SEQ ID NO: 14962 - DNA, 201 bp, Homo sapiens
tgaacataacaggaaccaaacagaagccactttaaaaagtaaatctgttgaaaacatggacctaatttttattgtaaatggatttaactgaaattttacamtagggaataaagctgaaatatatgaaaaaactatattaccttatgtttaacaaagcatgttttaattgaatctactagaaaattcttaaatgaacaaagt

SEQ ID NO: 14963 - DNA, 201 bp, Homo sapiens
tatatatatatatatatattttttttttttttttttgagacagggtctcactctgttgcccaagctggagtgcagtggcacgatctcggctcactgcaatmtctgcctccaaggttcaagcaattcttgtgccttagcctcctgagtagctaggattacaggcgtgtgccaccaacctcagctaatttttgtatctttagt

SEQ ID NO: 14964 - DNA, 201 bp, Homo sapiens
aactgcccaatccttaattgtgggttgtgtattgtgactttctgccaaagagcacaatatggaaaggcgggaaaaggctaaatttatagcagaaaaacctracaaacactccttcagccaagttatcaaggtcaacatcgaccttgagaaatcctgttgataacaggtacacttgataggtgatgaaatggcacctatcaa

SEQ ID NO: 14965 - DNA, 201 bp, Homo sapiens
ctcaggctgcaaaatatttttaaagaccaagttttaggaatgtaaccttttttattggactgcagtttccactcccttgccctcctcctcacccctaaatacacacacacacacacacacacacacacacacacacacacacgtttgggcaaaagggagttttaattatactcttggtaacttccagggtactctacaaat

SEQ ID NO: 14966 - DNA, 201 bp, Homo sapiens
tcaggctgcaaaatatttttaaagaccaagttttaggaatgtaaccttttttattggactgcagtttccactcccttgccctcctcctcacccctaaatacacacacacacacacacacacacacacacacacacacacacgtttgggcaaaagggagttttaattatactcttggtaacttccagggtactctacaaatg

SEQ ID NO: 14967 - DNA, 201 bp, Homo sapiens
cgttcccttccagtaccatatttgctttcaagtcctatgtgagccacctgaggactgttacaaagtgtaatccttggttgggtgctgtggctcatgcctgsaatcccagcattttgggaggccaaggtgggcagatcacttgaggtcaggagttcatggccagcttggccaacatggtgaaaccccgtctctactaaaaat

SEQ ID NO: 14968 - DNA, 201 bp, Homo sapiens
aagaataattttattctaaatgttcaacatgcagttgataaacatttactaatgacaacaaaataactgcatttagtatactatggtatcacagtaagtcaaaaaatacagattttctaatagtatctctattttatccccttgatgctgggtgtggctatgtgacttgctttaggcaatgggatagtagcaaatgtgata

SEQ ID NO: 14969 - DNA, 201 bp, Homo sapiens
ggcgggtggatcacttgaggtcaggagtctgagaccagtttggccaacatggtgaaaccctgtctctactaaaaatacaaaaattagccaggtgtggtggygcacgcctgtaatcccaactactcaggaggatgaggctggagaatggcttgaacctgggaggcgaaggttgcagtgagccaagattgtgtcactgcactc

SEQ ID NO: 14970 - DNA, 201 bp, Homo sapiens
agctcagggagataatgagataaggctgcagtgaacaaggagacacattacttacgtgacccattcatcacgctcattgccctcaaatctctgagagtccaaaaaaaaaaaaaaatcctcaagggccaggcatggtggctcacacctgtaataccagcactttgagaggccaaggagggcagatcacatgaggcctcagga

SEQ ID NO: 14971 - DNA, 201 bp, Homo sapiens
tctaagaggctattcctaaatcagaacactgtttcatagaggttttccctactttataagataaatatccacacctcggaagataatttatgatcaaaaamcaaacaaacaaaacaaaacccagtagtcaaatgcaagactgagatacaaatcatagttgctgtttctgtgtttaaaatgtcttctcaggaagacactttt

SEQ ID NO: 14972 - DNA, 201 bp, Homo sapiens
gctgagacaggagaatcacgtgaacccaggaggtggaggttgcagtgagctgaaatcacgccactgcactccagcctggtgacagagtgagactccgtctaataaataaataaataaataaataaataaataaataaataaataaaatacaatggctgctttccctaacaggctgtatgtagccaaagagaggcctaactg

SEQ ID NO: 14973 - DNA, 201 bp, Homo sapiens
ctgagacaggagaatcacgtgaacccaggaggtggaggttgcagtgagctgaaatcacgccactgcactccagcctggtgacagagtgagactccgtctaataaataaataaataaataaataaataaataaataaataaataaaatacaatggctgctttccctaacaggctgtatgtagccaaagagaggcctaactgc

SEQ ID NO: 14974 - DNA, 201 bp, Homo sapiens
tgagacaggagaatcacgtgaacccaggaggtggaggttgcagtgagctgaaatcacgccactgcactccagcctggtgacagagtgagactccgtctaataaataaataaataaataaataaataaataaataaataaataaaatacaatggctgctttccctaacaggctgtatgtagccaaagagaggcctaactgct

SEQ ID NO: 14975 - DNA, 201 bp, Homo sapiens
gagacaggagaatcacgtgaacccaggaggtggaggttgcagtgagctgaaatcacgccactgcactccagcctggtgacagagtgagactccgtctaataaataaataaataaataaataaataaataaataaataaataaaatacaatggctgctttccctaacaggctgtatgtagccaaagagaggcctaactgctt

SEQ ID NO: 14976 - DNA, 201 bp, Homo sapiens
agacaggagaatcacgtgaacccaggaggtggaggttgcagtgagctgaaatcacgccactgcactccagcctggtgacagagtgagactccgtctaatawataaataaataaataaataaataaataaataaataaataaaatacaatggctgctttccctaacaggctgtatgtagccaaagagaggcctaactgctta

SEQ ID NO: 14977 - DNA, 201 bp, Homo sapiens
ctccgtcgtggtggcccttagcacggttgtgcagctgtaggagagcctggtaccagctgtcttgctcggcctcgctgtccgccgcgatggcaaagtgctcrtcccgggtgtagagagccaccaggtgcttgttcttggagtcagcccgcttgttgatgttgaagcagctctcaagggggatcgagcgtttgggggcgctcg

SEQ ID NO: 14978 - DNA, 201 bp, Homo sapiens
attctcaaacgaaaaagccctcctgtggctgctcctacatgtttgtttgactctctgccagatgtcagtgtggggtgagcatcttgtgtgccctgagaatstaagtgcattctccctgaggaagcagtgggaaagaacaggaaggggcagaggcgaagaacagaattcaaggacaaggttaaaagcagttttgtcttctga

SEQ ID NO: 14979 - DNA, 201 bp, Homo sapiens
gcagccccacacagtttggctggctccttgggggctcccccaagctccccaggcctcagccacacattctcaaaggaagcagagctgtggcgtttcacatyctcgctgctgctgctgctaccgccaccgccccctactgctgcccccgctccaaagggcactgtgttgcccacccgggtggcactgggtgttgaggagaaa

SEQ ID NO: 14980 - DNA, 201 bp, Homo sapiens
ctggtggggtgtggcccagggaatccggagtgacactgcggaaggaactccggaaatcgcagggactggagccatactcatccgaggagatgaaaccgccrtcgctgggggaaccagacaccgaagcactagatcgccgtgggaagagacaatccgaggtggagccatggccactggtgctactggacgacagactgaccg

SEQ ID NO: 14981 - DNA, 201 bp, Homo sapiens
gttcacccgggtgaaggcgctcatgcccccaggtccttgtgggccccccagcagggacgagtgggcagccagctctgctgccccttgaggcccagtcgggkaagcagaggctgctgaggatgaggaggcagcagccatggtggccctgggcaggctcacctcctctgcagcaatgcctgttcgcatgtcagcatagcttac

SEQ ID NO: 14982 - DNA, 201 bp, Homo sapiens
atctgctgtggggcagatacgctcttggggctcatgggcatatagtctccactgccctttcggccactgggcactggggccacccctggggacatgggcaygtagccatcatccgtgtggagggtggagctgtctgggcggtggtgccccccccgacgctccaaggggtgcatttccagaccctcctctgggtaggagcgg

SEQ ID NO: 14983 - DNA, 201 bp, Homo sapiens
accgccccctactgctgcccccgctccaaagggcactgtgttgcccacccgggtggcactgggtgttgaggagaaagtctcggagctatgcctccgccggyacccttgtgggtctgcacggatcactttggcactctggttgcggttaggactgaggttcacccgggtgaaggcgctcatgcccccaggtccttgtgggcc

SEQ ID NO: 14984 - DNA, 201 bp, Homo sapiens
gggctcgccatgctgccaccgccaccaccaacgctgagcagagggaggctccgaaaaacaaccgggtggggggcggaggctcctcgccgcggcccggcacrtgcaaacagggctggaggcagcagaaaccccgactctgaaatccacgccgccccccgcgccggggaggggcagctgaaggaggacgcagctgctgagccc

SEQ ID NO: 14985 - DNA, 201 bp, Homo sapiens
tggagtccggcacagggaggcgacagtcgggggtccctgcggtgcccctccaggagcgcgcgcgcgcgcgcgccttccctcctgagttcccctctggaagyagcgattcccgaggcaaattaaatatccttgggcagggggaggcgggttgccaagtcccaacgttgcacggggttctccctcctccttcgcctcctccca

SEQ ID NO: 14986 - DNA, 201 bp, Homo sapiens
tttaatacggcattagccacagaagacctaaagccaactttcagcatttactgtggtgtctacttttgaacttaaaggcacacagcaaataaccctaaaartggagggtatacagtttagcccttctactcaatgcaaaacaaaacaaattaaggcatgttcctgacttagtatgcattcttctcaacaaataaaagtaat

SEQ ID NO: 14987 - DNA, 201 bp, Homo sapiens
gcccgcaggcccgcagccacgtgcgggactccctcctgctcgcggatctcgagaccggaagacgaaggaacgtggcctcgtagtaaaccgtagtaaagagmgaagggaaacaaaatggggctcgtcacatggttacggcctggatttttctcaattaaaaataagagcaagtgtgtgtttccggcccccgtccgtgggctg

SEQ ID NO: 14988 - DNA, 201 bp, Homo sapiens
ataaaattcacaagataatcagtttgtcagagtaaagtgtttccaaatgctggaaacttctgcattgccaactcatcacattatttgcaaactgtactctmttctacccacaattatgaccaccagaaaacaggatcaacagaacgaagggcaggctaatttcctattacaaatgtttttcatttttaatacggcattagc

SEQ ID NO: 14989 - DNA, 201 bp, Homo sapiens
aggatcttggcaatgagtagtaggagaggactggcttgtgctgggggtcctcagggccgtagtagcagtcggaggggctgctggtgttggagtcccccackggtgacatgttcatgtagtcacctgtgcaaggtaagagcttaccaccgctgctctccactgggggtttggggtgaggcaagacatgagagtggtggcccc

SEQ ID NO: 14990 - DNA, 201 bp, Homo sapiens
cgggtggcactgggtgttgaggagaaagtctcggagctatgcctccgccggcacccttgtgggtctgcacggatcactttggcactctggttgcggttagractgaggttcacccgggtgaaggcgctcatgcccccaggtccttgtgggccccccagcagggacgagtgggcagccagctctgctgccccttgaggccca

SEQ ID NO: 14991 - DNA, 201 bp, Homo sapiens
ctggttgctttcactgggactaaagatccaaagcaaagatatcttttttcctgctttttgtcaatattatgtttgcaagcttaatatccaaaaatgggccwttcttccaaatgagagttccttcctgattatttagtatgctgatggtattgtcagacaggaagccatggttagaaagattcagaaaaatacaaaccttta

SEQ ID NO: 14992 - DNA, 201 bp, Homo sapiens
actataggcgccccccaccacgcccggctaatttttgtatttttagtagaaacagggtttcaccatgttggtcaggctggtctcgaactcctgacctcacratctgcctgcctcggcctcccaaagtgctgggattacaggcgtgagccaccgcacccagcgaatccttctttaaagtaaccagagctcactgaggcaaga

SEQ ID NO: 14993 - DNA, 201 bp, Homo sapiens
tattttaccaatgaggcactttataatacaaatgcttaaagtgttgagggattctgactcccaaaaacatcatttgatataacaagatttgtactactgaygttgatatacacaattaaatctttcttctagtgaatgatgaaaataaatgttgaagtaaatactgatcaaataaatgctttttgtaacatatcacccaaa

SEQ ID NO: 14994 - DNA, 201 bp, Homo sapiens
ctgtttgaagtccttgaccaaatccaggtctatgtagttaagaccattctccaaacccccagcagccccacacagtttggctggctccttgggggctcccycaagctccccaggcctcagccacacattctcaaaggaagcagagctgtggcgtttcacatcctcgctgctgctgctgctaccgccaccgccccctactgc

SEQ ID NO: 14995 - DNA, 201 bp, Homo sapiens
ggcatatggtatgtttttcatttcatatctggctcttctccagaaggggtgggtaaacagcttagtacaggaacacactgtaccctcttttatcatcacaygtaccaacctgcacggatgcataaggacagagacccagggccctgtgaggagagggaaaaacaggtggcttcactgggtgctgaaatctgttgctttggg

SEQ ID NO: 14996 - DNA, 201 bp, Homo sapiens
ggaactagaaaattaatataaattaatttcctccacttaaagaaatgaatcaaaacagcatatttctctttcagttaacataaacagctgtgtgctttttwaaaaaaaaagtatcttgaatataatacagaaaatgtataaaatacaggaagatgtaaagaaggaataaacatgacttatattccccatcaccagaaaaac

SEQ ID NO: 14997 - DNA, 201 bp, Homo sapiens
atgccattctgttaaatctaaactaaatcagctaaaacaacatttcacttaataggcacttggatatcagaaataccttcacttctagaaaacagcttgcmaaagagattgtcattataaaagcacgtttttatctcttattatatgtcctcctataaaaacactaaaatgaaatctcatttccagaagagtctagacagt

SEQ ID NO: 14998 - DNA, 201 bp, Homo sapiens
ccttccatccttttttagaaagccaaaataaaaaccagaaaaggcatacttataaagtcataagccatatgctataacaggtaaataaaagtcctttgacrttagaagccacgaaagaacagaagattaaaaagtaaatcataaacagctgcatctcgcctcccagtgtttacattcttagacatccactttttaaaaata

SEQ ID NO: 14999 - DNA, 201 bp, Homo sapiens
gcccctcagaaaaagcgctgccctgggatcttatgattcagtgatgcaagagggatgttggctggtgagaaatgcttatttgagagggaaggaggaggagragaaaatactcccatagcacttttctttcttattttccttattttagaaaggccaaatctgaacacattttccatcccatgtagtaatatatctcacata

SEQ ID NO: 15000 - DNA, 201 bp, Homo sapiens
gtctgagcagctgtgtccacctttcgaggcagatggggctgcagaacctgatggtggggatgtggaaggctgggctccagcctagccccgcagtatccccsacccaggctgtcgctgctggtggaagaggaagaatcatctgctgttgcagcatagagaaggcgaccagagctagtggaaaggcggaggtgctgatgccgg

SEQ ID NO: 15001 - DNA, 201 bp, Homo sapiens
ggaacaacagagaaactctctcccactgctcagtagcagttttgggtcataacatttgcacctgcttggtacgtttccacctgtgatgtttcacttggccyctcagaaaaagcgctgccctgggatcttatgattcagtgatgcaagagggatgttggctggtgagaaatgcttatttgagagggaaggaggaggaggaga

SEQ ID NO: 15002 - DNA, 201 bp, Homo sapiens
gaaagcaagcgtctgattttacatttgagtaactgtctgactacccaattgtttctcaagcatcatcagtttttccataatagcccaggaatcaggcaccraacaagcatttgcatagacaaccctggtctgcagcggactgaggtaagaatcattaacaccactgacatcacttttggcagctggagaagtgggaaaacc

SEQ ID NO: 15003 - DNA, 201 bp, Homo sapiens
ctgctcagtagcagttttgggtcataacatttgcacctgcttggtacgtttccacctgtgatgtttcacttggcccctcagaaaaagcgctgccctgggaycttatgattcagtgatgcaagagggatgttggctggtgagaaatgcttatttgagagggaaggaggaggaggagaaaatactcccatagcacttttcttt

SEQ ID NO: 15004 - DNA, 201 bp, Homo sapiens
atggtggtgcacatctgtaatcccagcaactcaggaggctgaggcacaagaatcacttgaacccaggaggtggaggttgcagcaagctgagatctagccastgaactccagcctgggaaacagagcgagactctgtctcaaaaaaaaaaaaaaaaaaaaaaccaaaccaaaatgttaaatattagattccttctgttccag

SEQ ID NO: 15005 - DNA, 201 bp, Homo sapiens
aattattacatgtcacaagcgggccatggcctacctgttcatttggtttctccacgctttccttctgtaacaatgtaagcaagagttgtggccaggcaaaygtccttggaaagccttaccctttagagatagttttctttcttcctgaattctcttcactcccaaccagcagcaatactcaccagggcccctaaacacagc

SEQ ID NO: 15006 - DNA, 201 bp, Homo sapiens
agcatattcttccatagaagacttggagcagttgggcatttaaccaactttttattacaaagcttcaaaatttataagcagtctatctctggaaagataawcaaaacccagcagtgatggtggcctatgagaaactggggacaaaggtgggaggaagccttatttttcactctctaccttaaaaaaaaaaaaacaaaaaca

SEQ ID NO: 15007 - DNA, 201 bp, Homo sapiens
ctatcaaacatcaacaggctataattaacacttaattaacagcattatggtgaaatctgcttattctcctcaaaaactgcctgaagctttttttccccatwaaattattacatgtcacaagcgggccatggcctacctgttcatttggtttctccacgctttccttctgtaacaatgtaagcaagagttgtggccaggcaa

SEQ ID NO: 15008 - DNA, 201 bp, Homo sapiens
agcaatgcccatactagggtcttgcagtcagtcattcaatgcaataagcataaatacaatgataaagactggaataagcaggggaaaagcccgcataggcrtacatatgtttaatacactttatatatacaccacttcaattgactgaagggagacaattgacagaccagaggtagcaaatattgctacaaagttttacaa

SEQ ID NO: 15009 - DNA, 201 bp, Homo sapiens
ggaaggaagatggtccaatgactatccgaaagatgcacctggatgagttattccagagtttaactgccctattctcatttctacaggtggcatctaccacrtgaccaagtcaccatataaaaagctcatgaattaatatggacagagccatcaaaaagtctcaggcctggtattatgagggtttccttgattgtgtggtat

SEQ ID NO: 15010 - DNA, 201 bp, Homo sapiens
tttttcaaagctctattattcaaagatcactggctcactgaataagcacaaataacatttatccaaccaaatttatttcaacaaatagattatagcagagsctgctgcaagaatactattaaaatggaaagtgttccttttatcatacatgacagtaccttatacttgtccaatccatcttctccctttttgtgaattaag

SEQ ID NO: 15011 - DNA, 201 bp, Homo sapiens
attctctttgtgggaatttccagtagaaacaaagaccttcccagggactcttgagcagaggtgggaggattgctaagtccttgctaatttcccacctctcwaacgcatagttagaaaaagtcaataggaagttgacttgagaaccatttgccataagtcagtaagctgggacccttctccatggtggcctcctccgtctgc

SEQ ID NO: 15012 - DNA, 201 bp, Homo sapiens
aaaaaaggaagcattccaagtttgcccctttaattgccagagaaacaggatttactctgtgtgtctacaattgtggtgtccacaaatgaaaagaaagcccrtcccttcacaagccattggtatgctaggaaactccccacaacaagctccagatctcttatttactgtcaagattctcctgaatgcatataggaatgttcc

SEQ ID NO: 15013 - DNA, 201 bp, Homo sapiens
tatggttgctagatttttacaatgccatgctggaaaatggaaaaattctctctacaaaggaaaacgtttagtctggagaaaatgtttacagaggtttgcarcaaataaacttctaaatatagtaccagcacttaataaagggtcaaataagctctgggttcttgagcctgaagttttcaaggattttgacacagccccaat

SEQ ID NO: 15014 - DNA, 201 bp, Homo sapiens
aaacgcacctgctgtgatgtccagttgagctactgacggtcctctggctgcttctggaaactgatgctggcataggcgcttaaatcctcacttgagcggcrggtggagctgctctcaccgctgcccaggggttgatgagggggtgggggtgggggaggctgcggttcaggggtgcactcctgagggcactgtttgaagtcc

SEQ ID NO: 15015 - DNA, 201 bp, Homo sapiens
gtcaatgctgcttgagtaacttgatgaaaaattgaaattgctgccagatgcacatctaattgttggcagctggaagaggagggagggaaatctcagaaagwtaatctaaaataattgataatgcatccactgcttgcagctctaaggtcactgaggcagacaatggtgcaaatttctaactgactgccttgtgtaaagagg

SEQ ID NO: 15016 - DNA, 201 bp, Homo sapiens
ctttggatcccaagtctcttcctgtagggcaatgctggagatagtatttattgagggggaactcagagaaatgactacaatatatgcaacattttatggayttatttttactataaaaagatacctaaacaattgcaaacattaagcaaattattagctgctcaaacttttctggaacaacagagaaactctctcccactg

SEQ ID NO: 15017 - DNA, 201 bp, Homo sapiens
aagtcattggtgaagagacagtgggaagatatcccctggctctgcgttcccttccagtaccatatttgctttcaagtcctatgtgagccacctgaggactrttacaaagtgtaatccttggttgggtgctgtggctcatgcctggaatcccagcattttgggaggccaaggtgggcagatcacttgaggtcaggagttcat

SEQ ID NO: 15018 - DNA, 201 bp, Homo sapiens
caaggtaaaaggacttaggaaaaaaaaacaaaaaaaaaaagtccctcttcatttcaagtcagaccacacgtactctcaggcaggaagatttaatttttttyttttggagacagagtctcactctgtcacccaggcaggagtgcagtggtgccatttcagctcactgcaacctgcccctcctgggttcaagcaagtctcctg

SEQ ID NO: 15019 - DNA, 201 bp, Homo sapiens
ctgctttccctaacaggctgtatgtagccaaagagaggcctaactgcttatgtgcttgcttccaatgacaaagtgcgtgtgtaagaagcacagatatactwgactgtttataaactactgcaattaataatttatgacaacgactgcaagtcatacaacatctgagggtacctataatacactaagcaagaagctttcact

SEQ ID NO: 15020 - DNA, 201 bp, Homo sapiens
tacctaaacaattgcaaacattaagcaaattattagctgctcaaacttttctggaacaacagagaaactctctcccactgctcagtagcagttttgggtcwtaacatttgcacctgcttggtacgtttccacctgtgatgtttcacttggcccctcagaaaaagcgctgccctgggatcttatgattcagtgatgcaagag

SEQ ID NO: 15021 - DNA, 201 bp, Homo sapiens
gcaggagtgcagtggtgccatttcagctcactgcaacctgcccctcctgggttcaagcaagtctcctgcttcagcctcccaagtagctgggattacaggtrcacaccaccacacttggctaatttttgtatctttagcaaagacggggtttcaccgtgttggccaggctggtctcgaactcccaacctcaggtgatccacc

SEQ ID NO: 15022 - DNA, 201 bp, Homo sapiens
tgtaaatggatttaactgaaattttacactagggaataaagctgaaatatatgaaaaaactatattaccttatgtttaacaaagcatgttttaattgaatytactagaaaattcttaaatgaacaaagtttgatcaagtgttcatgtttttggattacttttccttcacgtttcaacttcgacttcttgtttggtcatcat

SEQ ID NO: 15023 - DNA, 201 bp, Homo sapiens
aactgaaattttacactagggaataaagctgaaatatatgaaaaaactatattaccttatgtttaacaaagcatgttttaattgaatctactagaaaattyttaaatgaacaaagtttgatcaagtgttcatgtttttggattacttttccttcacgtttcaacttcgacttcttgtttggtcatcatggaacaaccataa

SEQ ID NO: 15024 - DNA, 201 bp, Homo sapiens
ttgaatctactagaaaattcttaaatgaacaaagtttgatcaagtgttcatgtttttggattacttttccttcacgtttcaacttcgacttcttgtttggkcatcatggaacaaccataaaaagaatcatttctgtagaaatattcaaaggttttatgaattttcccaaggccctctcttaatcctatatatatatatata

SEQ ID NO: 15025 - DNA, 201 bp, Homo sapiens
aaaattcttaaatgaacaaagtttgatcaagtgttcatgtttttggattacttttccttcacgtttcaacttcgacttcttgtttggtcatcatggaacamccataaaaagaatcatttctgtagaaatattcaaaggttttatgaattttcccaaggccctctcttaatcctatatatatatatatatatatatatatat

SEQ ID NO: 15026 - DNA, 201 bp, Homo sapiens
ttcgacttcttgtttggtcatcatggaacaaccataaaaagaatcatttctgtagaaatattcaaaggttttatgaattttcccaaggccctctcttaatyctatatatatatatatatatatatatatatatatatatatatattttttttttttttttttgagacagggtctcactctgttgcccaagctggagtgcag

SEQ ID NO: 15027 - DNA, 201 bp, Homo sapiens
ttcaaaggttttatgaattttcccaaggccctctcttaatcctatatatatatatatatatatatatatatatatatatatatattttttttttttttttwtgagacagggtctcactctgttgcccaagctggagtgcagtggcacgatctcggctcactgcaatctctgcctccaaggttcaagcaattcttgtgcctt

SEQ ID NO: 15028 - DNA, 201 bp, Homo sapiens
ttttcctaagagtacttaccactatctgaattaacttgatctgtttagtgcctatttctccctctagaacataagctcagaagtgtggaaacgaagtcttrttcctagccctattcccagcaaatagtaaagccaaaatagtgaatggctttacaaatatttgaggatcaaatgaatgaacaatgacatctataacataca

SEQ ID NO: 15029 - DNA, 201 bp, Homo sapiens
atagcccagcatatgtactccagagaactggtcacactctaaatgcaaatatagtccagtaataccaattccttttaggctttggtgacagcatgaaacawgcaaaatcaaacagccacagaacttctaaagagaataccgtagaggtctgtagctaatgacctatgtaactctagctggactatttctggaaactttgaa

SEQ ID NO: 15030 - DNA, 201 bp, Homo sapiens
cccacccaaaggaaaaaaaagaaaaaagtccttgaataacaaagctaagatagcaagaaaagactttaaaatttattttgtagcccccactttccccccasgtttcctaacactgaccaccccataacaagtccacattcaacccctcttcatttaacagctggatgcctcttcttctggttgctttcactgggactaaag

SEQ ID NO: 15031 - DNA, 201 bp, Homo sapiens
gagagctgaccttaggatgtaggaactagcaggtgccttgcattcccacacacattttatttttaaaaaggcggaaggaagaggagcataattcagtctakagatggttccaaaaacttaggctggtcgatcaggagggtttgtcttagggtttgttaaaactcgaaaatgcccccttgaagcaagaaaagttaatgtcag

SEQ ID NO: 15032 - DNA, 201 bp, Homo sapiens
gcccccaggtccttgtgggccccccagcagggacgagtgggcagccagctctgctgccccttgaggcccagtcggggaagcagaggctgctgaggatgagraggcagcagccatggtggccctgggcaggctcacctcctctgcagcaatgcctgttcgcatgtcagcatagcttacaggggcagctggcgaggtgtccac

SEQ ID NO: 15033 - DNA, 201 bp, Homo sapiens
agggtgcagcaagggctgctgctgctgctgctgctctcgggcccgaggtaaggtgctggccttgggatcccccagggacagcctcgtgggccgggccaggmggctattggtctgagcagctgtgtccacctttcgaggcagatggggctgcagaacctgatggtggggatgtggaaggctgggctccagcctagccccgca

SEQ ID NO: 15034 - DNA, 201 bp, Homo sapiens
tcctcagggccgtagtagcagtcggaggggctgctggtgttggagtcccccactggtgacatgttcatgtagtcacctgtgcaaggtaagagcttaccacygctgctctccactgggggtttggggtgaggcaagacatgagagtggtggccccctaccccgtttgtccacagctttccatagctggtcccggaagggacg

SEQ ID NO: 15035 - DNA, 201 bp, Homo sapiens
tggagccatactcatccgaggagatgaaaccgccatcgctgggggaaccagacaccgaagcactagatcgccgtgggaagagacaatccgaggtggagccrtggccactggtgctactggacgacagactgaccgggctggtggccgaaggcgagcagcgggaagccggcatggggatggagcggctgtggttgagcgggg

SEQ ID NO: 15036 - DNA, 201 bp, Homo sapiens
gccatggccactggtgctactggacgacagactgaccgggctggtggccgaaggcgagcagcgggaagccggcatggggatggagcggctgtggttgagcsgggggtgcagccgggcgctgccccgatgccggtgggcgtgggttctgttggtgctgggactcacagggctgccgtccaccgaggctgggcgggacatggt

SEQ ID NO: 15037 - DNA, 201 bp, Homo sapiens
ccatggccactggtgctactggacgacagactgaccgggctggtggccgaaggcgagcagcgggaagccggcatggggatggagcggctgtggttgagcgsggggtgcagccgggcgctgccccgatgccggtgggcgtgggttctgttggtgctgggactcacagggctgccgtccaccgaggctgggcgggacatggtg

SEQ ID NO: 15038 - DNA, 201 bp, Homo sapiens
aaaatacaaaattaagattaattcttataaggaactcagctcaacatcaggtttatatgacaagagatagtatcagcaaatataactatacaattgagaamcatctatggcactatgattcttatattatgttttctgaattacaatcttaaaacaaggatcataccctattctactcttttaagccttgttttaagcatt

SEQ ID NO: 15039 - DNA, 201 bp, Homo sapiens
aggtaaattttaaagggtcactatccgtgattccccttcagagtgaagactcttttttttttactttttttattattatactttaagttttagggtacacrtgcacattgtgcaggttagttacatacgtatacatgtgccatgctggtgtgctgcacccactaactcgtcatctagcattaggtatatctcccagtgtta

SEQ ID NO: 15040 - DNA, 201 bp, Homo sapiens
ccctccccccaccccacaacagtccccagagtgtgatgttccccttcctgcatccatgtgatctcattgttcaattcccacctatgagtgagaatatgcgstgtttggttttttgttcttgtgatagtttactgagaatgatgatttccaatttcatccatgtccctacaaaggacatgaactcatcattttttatggctg

SEQ ID NO: 15041 - DNA, 201 bp, Homo sapiens
attttcttaatccagtctatcattgttggacatttgggttggttccttttcaacctcataaagcatcttttactcaagtattacactacctagtcttttayaggtccttgtttttcatgcattcaaaacttatctataaatatcagtatctacagagtgcatcaaagggtatttagcagagagtagatcagaaatacttgt

SEQ ID NO: 15042 - DNA, 201 bp, Homo sapiens
cttgaatgacaagctaagaggactttatctaattatagagacaacaaggacatgctacattgacataaggtcaagatgtagcagtaataatgcatatcacmtacaaggatagtgacagcttccaaaatacacgcaacgtaagtgtggaccgatatattagggtggagcaaaagcaattgcggtttttgccataaaataaat

SEQ ID NO: 15043 - DNA, 201 bp, Homo sapiens
tcaattgcaaatcaaaatgtttccaatctcccttttaccaatactatagtttgtcctatgtacatgacagattcaaggtaaaaggacttaggaaaaaaaamcaaaaaaaaaaagtccctcttcatttcaagtcagaccacacgtactctcaggcaggaagatttaattttttttttttggagacagagtctcactctgtca

SEQ ID NO: 15044 - DNA, 201 bp, Homo sapiens
attagctcatgttaaagagaaagctattaactgttgcttacagtaaagtaataatgcaataaatgtgtgtttcccttgagttgcctctttctgagtgacargtgagtaacctgtatgcgattttgaattaaaaaatgtactttagggaattcaaccccaaaaaaggttattttcagaatgaagatggaactattacatggc

SEQ ID NO: 15045 - DNA, 201 bp, Homo sapiens
tcatgctttttaaagactgataattttgtttaagtcaaaacttatttctgaattaaaatttgaaaggaaactaagacaagttccattatcccatctctcartgttcttttctctgtgatttcaggcaagttgctcaccctccaaaatcccaaatgttttcgtctgtaacacaggagagcattgcccatttcacagggttct

SEQ ID NO: 15046 - DNA, 201 bp, Homo sapiens
gttggtctcgaactcctgacctcaggtgatccacctgcctctgcctcccaaagtgctgggattgcaggtgtgagccatcatgcccagccctaacagcattyttaaacgaaactgcatatcacattattgcagggttgagctgcttgtctggctgagctaaaagcaccccatggacagttgtgccccattcttaataaacag

SEQ ID NO: 15047 - DNA, 201 bp, Homo sapiens
ctgggattgcaggtgtgagccatcatgcccagccctaacagcattcttaaacgaaactgcatatcacattattgcagggttgagctgcttgtctggctgarctaaaagcaccccatggacagttgtgccccattcttaataaacaggtagtgacaacttttagctaaggaaccgccattaagaagtatttatagtgactgt

SEQ ID NO: 15048 - DNA, 201 bp, Homo sapiens
tcacattattgcagggttgagctgcttgtctggctgagctaaaagcaccccatggacagttgtgccccattcttaataaacaggtagtgacaacttttagmtaaggaaccgccattaagaagtatttatagtgactgttatggactgaaacatgtctttccttgcaatttatatgttgagatcctaaccctcaacatgatg

SEQ ID NO: 15049 - DNA, 201 bp, Homo sapiens
gggtggagccctcatgggtgggataagtgcccttatgatgaaacatgagagcttgctttctgctctctaccacaggaggctacaataagaagacggccatygtaaaccaggaagagggcacaccaaaccagggtctgtggtgccttgttcttggacttacccgcctccagaactgtgagaaataaatgtgtgttgtttaag

SEQ ID NO: 15050 - DNA, 201 bp, Homo sapiens
ggtggaagtactgtcaaatctttcatctaaatagagtccactggaatatacaaagttatttttataaaaggaaacagggtaagctttgtgtttacaaaggyaatgagaaattacatactgaaatgccattctgttaaatctaaactaaatcagctaaaacaacatttcacttaataggcacttggatatcagaaatacctt

SEQ ID NO: 15051 - DNA, 201 bp, Homo sapiens
aaatttgatgccaggtaaaggtggcagggctgctatgaccgagtctgagaggctctttttgccctgcttcttgggctctcaatttactctctgcagagagygggccacaagtactgcgaaattctgaaaaggagcaaaagaaaaaaaggataatgtcaggaacatgaaataagaggtggaaacaaagggatggcaggggat

SEQ ID NO: 15052 - DNA, 201 bp, Homo sapiens
aaaggtggcagggctgctatgaccgagtctgagaggctctttttgccctgcttcttgggctctcaatttactctctgcagagagtgggccacaagtactgmgaaattctgaaaaggagcaaaagaaaaaaaggataatgtcaggaacatgaaataagaggtggaaacaaagggatggcaggggatagtactagaaaacgag

SEQ ID NO: 15053 - DNA, 201 bp, Homo sapiens
agatacgctcttggggctcatgggcatatagtctccactgccctttcggccactgggcactggggccacccctggggacatgggcatgtagccatcatccstgtggagggtggagctgtctgggcggtggtgccccccccgacgctccaaggggtgcatttccagaccctcctctgggtaggagcgggtgggcacgaaggc

SEQ ID NO: 15054 - DNA, 201 bp, Homo sapiens
tagggtcttgcagtcagtcattcaatgcaataagcataaatacaatgataaagactggaataagcaggggaaaagcccgcataggcgtacatatgtttaawacactttatatatacaccacttcaattgactgaagggagacaattgacagaccagaggtagcaaatattgctacaaagttttacaaatgcaaaaattcat

SEQ ID NO: 15055 - DNA, 201 bp, Homo sapiens
ttaattttatccaagtttttatattcagtcataccagattacagtcttgtaattttgatggactttttaatatatctgatattgttaaatctgaatttttwaaatattggacaaatgaaatggtttgagatactcaaaaaatatccacattattgttcttgtttgaaacttttctaaagccatcctctcccttgatccaag

SEQ ID NO: 15056 - DNA, 201 bp, Homo sapiens
caatgttttacttaggggtgagctttcagccttcactcaactaataagaggtattcttaaggagatctaactcttaaaaagatgccatcaagacctgaatytgcacttggcccacaaagcatgtaatataaaaatatgtgtttctcctttacaaacctgaataatagaagtacattatgtattttctgaaatcatttcctg

SEQ ID NO: 15057 - DNA, 201 bp, Homo sapiens
aaaacataatttgtttgccacattacatatattcaaaaaaaaaaacgtctctttgatcatttcaacaaacgtgagaaaacttctcaagattaagtgatatygttcagcaatatgacctaaatatgtcagggaggatcagagaacatgcattaaagtattctttggtcaacaataaaagtggagtgcaaggatacatatgta

SEQ ID NO: 15058 - DNA, 201 bp, Homo sapiens
ttccaatatactaaattaccaacccatcaaaataaaaggaaccatttatatactattcagctaagacacatatctgattatagtgagaggattggaaaagmataagtccgtggagtttcttaagaggcaacagactattttaatgacttgtgaaatccacatggagggacaaaaaaggtcggagcttctgaatatattggc

SEQ ID NO: 15059 - DNA, 201 bp, Homo sapiens
aggcagatggggctgcagaacctgatggtggggatgtggaaggctgggctccagcctagccccgcagtatcccccacccaggctgtcgctgctggtggaaraggaagaatcatctgctgttgcagcatagagaaggcgaccagagctagtggaaaggcggaggtgctgatgccgggcaccctcctccggctccccggggcg

SEQ ID NO: 15060 - DNA, 201 bp, Homo sapiens
gcagaacctgatggtggggatgtggaaggctgggctccagcctagccccgcagtatcccccacccaggctgtcgctgctggtggaagaggaagaatcatcygctgttgcagcatagagaaggcgaccagagctagtggaaaggcggaggtgctgatgccgggcaccctcctccggctccccggggcgctgggtgtgcttaa

SEQ ID NO: 15061 - DNA, 201 bp, Homo sapiens
ggtccactctctggggatggcgtctgatgggattgatgatctgctgtggggcagatacgctcttggggctcatgggcatatagtctccactgccctttcgrccactgggcactggggccacccctggggacatgggcatgtagccatcatccgtgtggagggtggagctgtctgggcggtggtgccccccccgacgctcca

SEQ ID NO: 15062 - DNA, 201 bp, Homo sapiens
gtcatccacctgcatccagaactccccgggccccgtcacggcagaacggcccacctcgatgaagaagaagttttccgagtggccacagcgcctgatgttcrtcagctgcagcaccacggccgctgcctccgagttcagcttcacgaagctgatggtcttgctggtcaggcaaaggcggtagataccaatcaggttctttgt

SEQ ID NO: 15063 - DNA, 201 bp, Homo sapiens
ggtcttgctggtcaggcaaaggcggtagataccaatcaggttctttgtctgacccaggcccttgggcttcaggatcacttgccagacctctttgaatgcgsgtcctgggggcacgtcaccgtagctcaagtcctccccagcctcaccaaggccggagctgccgctgcagctgcccccaccacctcccgccccgagggccgc

SEQ ID NO: 15064 - DNA, 201 bp, Homo sapiens
tctgacccaggcccttgggcttcaggatcacttgccagacctctttgaatgcgggtcctgggggcacgtcaccgtagctcaagtcctccccagcctcaccraggccggagctgccgctgcagctgcccccaccacctcccgccccgagggccgcagctccgtcgtggtggcccttagcacggttgtgcagctgtaggagag

SEQ ID NO: 15065 - DNA, 201 bp, Homo sapiens
ctgctcagctcattactgacactcaggctttaaaaactgggtggccccataccaagaaccatttttaaaattactgccttcaagcattaaaatgctaatcyaacagaaagcaaagcttaagagcatggagctcctcctcccaaaaacatacatgtatatgggagagaagcacggatgagccacatgtttaaaattctagtt

SEQ ID NO: 15066 - DNA, 100 bp, Homo sapiens
attgccaagatcctttaagcacacccagcgccccggggagccggaggagsgtgcccggcatcagcacctccgcctttccactagctctggtcgccttctc

SEQ ID NO: 15067 - DNA, 201 bp, Homo sapiens
tttcctggtaaaaagatttaaaaatctgtcggcaatatctttaaatgcattcattgccatttgtttttcacgtggaaaaaattccaagacgtgtatacttkccaaacaagaaaagaattaacattttcactgctggctaggtgtttcagtagcaggtcattaagcttttctgtgctctctgtacgctgtgttttgttaact

SEQ ID NO: 15068 - DNA, 201 bp, Homo sapiens
taaacagaaggagatgggtgattccttcaattcaaaagctctctttggaatgaacaatgtgggcgtttgtaaattctggaaatgtctttctattcataatraactagatactgttgatcttttcttctgtcccctccccccaccacttctgtaagtttcctgctctattcccaccatttttttctgtgcacacattatgat

SEQ ID NO: 15069 - DNA, 201 bp, Homo sapiens
ctaaagaaatcactaaccaaaagtcatcaatgtggaatctgtaaacaaatcaacatgatctggatgtttcagaggtttagcaaaggaaaaatagaaaattmtttggtgttgtgattgaagcaaaaacatacatcattagttgctatgtaaaatgaccatccgacatgagcgggttgtagtcagtctgtgttgtatctcctt

SEQ ID NO: 15070 - DNA, 201 bp, Homo sapiens
gtatctacagagtgcatcaaagggtatttagcagagagtagatcagaaatacttgttgaatgagtacgtggttgcactaaatactaggaagtgtagaaagytggattctgttggaagccctgccttctagtaattctagaaaggaaggcaagttctgttcataaatacatggcatgtgaagtagacatcagtacatgccaa

SEQ ID NO: 15071 - DNA, 201 bp, Homo sapiens
gctccagatctcttatttactgtcaagattctcctgaatgcatataggaatgttcccaccagaatttctagattagcgcttaacagagcttcacagctctsggcctctaattaggcaggaaggccacactttattaaaggacttgtgacaaacaaacaaactgccgaacataaaatgggggagaaagcaaagggcatatgg

SEQ ID NO: 15072 - DNA, 201 bp, Homo sapiens
ctgcagttataaaaagccacaaaactgccaactcagatctcatcccaaataaatgagtagaactgatataacaggtaaatgactatcatggtctataacamcttcaactttgaaatatcaaaagtattgatattaagacatgcttgctcccattttctgctgagtattaatttatcctcagaatcttaaagaacaagaagg

SEQ ID NO: 15073 - DNA, 201 bp, Homo sapiens
acctaactcactgtgctgttgtgaggattcaatgagatggtaactgtaaagcacgtggcacagatcctaacaactaacaaattacaggaccatcaattcaytctatccagtagcaagaagccaccagaaaacaaaatggccccgagggggtggcaaaaagaagaactgaaaagggatggaagggacttgacactgaagctc

SEQ ID NO: 15074 - DNA, 201 bp, Homo sapiens
ttcctgttttgctttaaacttataattttaatcaccgactcattatttaaaatggattgcccttaactaaaagggcaattcaaaagcaccctaaagttttrtaacctgcattattacacttcattagctgaaaggtaaaattatgtctaggcagagtagaatcataccatattctaaatatgccatgaaatgtaattttct

SEQ ID NO: 15075 - DNA, 201 bp, Homo sapiens
actaaactgtttaagaggtttcttatctctaactttctacctgatccattacagtgttttatatataactggtactcaattaataaatgtcaattaaaaamtgtgtataccaagaaaggatctataagaaaatcataggtactcataaatatagtctaaggtccatatgacttgattaaggagaagtaatttcagccaaat

SEQ ID NO: 15076 - DNA, 201 bp, Homo sapiens
ttccaaatgctttcttatataaatgtgagatatggttgctagatttttacaatgccatgctggaaaatggaaaaattctctctacaaaggaaaacgtttartctggagaaaatgtttacagaggtttgcagcaaataaacttctaaatatagtaccagcacttaataaagggtcaaataagctctgggttcttgagcctga

SEQ ID NO: 15077 - DNA, 201 bp, Homo sapiens
atagggcatggcatggctgctgaggagtttatagctgggtcccctttcctgttcccaagcacatggtatcagccggctgtccggtggctcagtaggctcaytgtgttccaaaattacttcagagcattcggctccaccactcaaggaaaagcaaaatagaaaatgaggagaggaacaaaggagtaggttggaggaagggtg

SEQ ID NO: 15078 - DNA, 201 bp, Homo sapiens
agcccctccccatcacatctcccccaggaaggcgaagaaggggttttgccttggttaactgtaaccactccaggagagtagtcttaaggctgattccatgytgtacctagtaaaggttcaaaagtacttgttgagtgttgaaagactgtataaatatgatcctcaagcccttttagctaattggatagtagctgccctttt

SEQ ID NO: 15079 - DNA, 201 bp, Homo sapiens
gcagtccaggcagttccagattcccactggacgtccggaaagcacaacagccaagcctcaatgaacttcattaacttgattccccgagacttgagagtccsttatagtaagaaagaataaaaatgttgtaaatgtctatactgaatcaaaatcacaaaatacttttttaaaaagactactggtagataggttcaaataaat

SEQ ID NO: 15080 - DNA, 201 bp, Homo sapiens
tttttaaaatgcaaataactgtccttcaaggaagagggcttaaaaaggctctgatgatcacagtggttccaaggtggtacataacctataaagttctgtckctgaaaaagtaaaacactaacatggggcaaattaaaatggagagaacatggggaaatcgggaagcaaatgtccaactatgtccagtgtggagttggtttg

SEQ ID NO: 15081 - DNA, 201 bp, Homo sapiens
taatatttcccatccacaaaaaaggaaaagaaaagaaaaatgctgaagtttcctaaagtggtgagtaacagtaaatcctgagttggggtagggagggagcygtggaatagggctctattcatagagaagagacacattaattaaaaatccacctaaaaggagccagtgaattagatcgaattgggtggtatgggtttttgt

SEQ ID NO: 15082 - DNA, 201 bp, Homo sapiens
taaagcaccagccattcatttttccatcttgagacacattcttcacccagttcaaaggcccaagaaacaacaagcctgtacactttctgaaggtcggcctytgtagggacttgtgagggactaaaggctcaggctgcaaaatatttttaaagaccaagttttaggaatgtaaccttttttattggactgcagtttccactc

SEQ ID NO: 15083 - DNA, 201 bp, Homo sapiens
gggttaggggggtggactggagctgccaagatcacaatataaataccaccacgttcaactttcagtctctccctcttggctcccctccatgacatattttrtacagtgtcttgttttgttttgttctgtaacctcaggaacatttacggtatttgagattctggtaaaagcaaaatgtaaatagtagctgatgggagagct

SEQ ID NO: 15084 - DNA, 201 bp, Homo sapiens
acatttacggtatttgagattctggtaaaagcaaaatgtaaatagtagctgatgggagagctgggtgaagagttaactaaagtactgcctttgctttgagyaggatgtggcaaaccatttgcatttgctttccaataatcagcaactttgtgttacccaaatctagatttatgctcaggcagcgaaagccctttcaaacca

SEQ ID NO: 15085 - DNA, 201 bp, Homo sapiens
gccagcctgggcaacacagtgagactgtgtcccaaaacaaaacaaaacaaagtgtaatcctctaacctagttcatagtagacatctagaacaaatagtatrttttcaccatccaccaatggcactaaaaatagagacaaccgcatctactactagaaacctcaatagtcatttttcaatgttttacttaggggtgagcttt

SEQ ID NO: 15086 - DNA, 201 bp, Homo sapiens
taaaaatagagacaaccgcatctactactagaaacctcaatagtcatttttcaatgttttacttaggggtgagctttcagccttcactcaactaataagakgtattcttaaggagatctaactcttaaaaagatgccatcaagacctgaatctgcacttggcccacaaagcatgtaatataaaaatatgtgtttctccttt

SEQ ID NO: 15087 - DNA, 201 bp, Homo sapiens
tatctgttaccacattctcgaaagtttctattttgtagcaagagctaccccattctattcatcctcttcctggaccacaattagcaagaatagcagggtaycagtcataaatgtttttgaccactagagaagctcctctttgcttcaaggtagaaattatctcagcaatacacactttccttaggagacagggtagattct

SEQ ID NO: 15088 - DNA, 201 bp, Homo sapiens
attcttttgagcactgaaaaatatgagacattggtatccagaaagtcttcaaaaagatccttaaccttaatacttaatcccattataccatattaagaacyagttattcactcagtcttgggggaatgaatgcctaagtaccatgaaagtgaacaggaaaagaaaataaagtagtaaagatttaaattggtggtgtttaaa

SEQ ID NO: 15089 - DNA, 201 bp, Homo sapiens
tgaacctgaggattgaaaagagacgtggaaagtagtgtgtccttttttttccctttaaaagtaacaacaacaacaacaaaagagaacagtaagtctgtgayacaaggtgtattatctgctgtgcccctttaagtgctgaaatttgggatctgagcatattcttccatagaagacttggagcagttgggcatttaaccaact

SEQ ID NO: 15090 - DNA, 201 bp, Homo sapiens
tactgagtaaaagaaggggaggggaagaacaagaaaaaatggcttagggcctatttgacaaaagcagataatttatgttagggttgagaaatgggtggtgsgcttgaatagtattaaagacaattaaagatcttctgatcttctgattgtccccacaacccctaaaactcaagggtaaacataattatttttcatatccat

SEQ ID NO: 15091 - DNA, 201 bp, Homo sapiens
gatctctgtcattatccacaagtatgttcaaagagcagggaataaaaggacgtatcaagtgcatcgacaccttccttccaaagtcttacttagcacactamttttcaaagccccttatcttaagtcctgatcaacacttgtctcaaaagggaaagtctgaagttcacacctgtttgtctttgtacagggtgtgtgtatctg

SEQ ID NO: 15092 - DNA, 201 bp, Homo sapiens
gttgaaaatacccaattactttataaaatgtcaatacaagaggatctcacagatagcaaatctaatagtgtccagtccacacttccctacaaatacatgcrgtcataattttttttaccctcttaatctgctgtggctccattagtaagcccctaaaaatgcaacctggcatttacattcttgtccatctggaatgtctct

SEQ ID NO: 15093 - DNA, 201 bp, Homo sapiens
ttaccacattctcgaaagtttctattttgtagcaagagctaccccattctattcatcctcttcctggaccacaattagcaagaatagcagggtaccagtcrtaaatgtttttgaccactagagaagctcctctttgcttcaaggtagaaattatctcagcaatacacactttccttaggagacagggtagattctccttat

SEQ ID NO: 15094 - DNA, 201 bp, Homo sapiens
ctctaccttaaaaaaaaaaaaacaaaaacaacaacaacaaaaaaaaaccaaaaaaaattggaaacttacagcatgtacatgtatcacctatacaaaaatayagagaaaaaaatagtgtgaagagacccagcaagctattataaaacttggtagtctaaaaaaaaaaaaaaaaacttttaaaacatgtttctgtaagagact

SEQ ID NO: 15095 - DNA, 201 bp, Homo sapiens
atcacaaccaccaacgtggtctcattattctcactgattgagctcaatcatgagcaaatgttatatttgaacctataaaattgatatacattaacaaatgytttctatattagggctccaactaagatttccctggaagaaaaagatgtcctgctgcctaaggtttgcaaaccactggcctattcctcccaccgttgctgc

SEQ ID NO: 15096 - DNA, 201 bp, Homo sapiens
tttatattaaattatcataaagtcctaaaatactgaacatagtggttaaataactccagaaagtccaatctctccagtgagtaacgttaaaaccattacamatgagcatgggagaatcgcttccattagtttaggacagagagattttgctttttacagagtaaatcagtgctcaaatagatacttcctcaaatatgtcct

SEQ ID NO: 15097 - DNA, 201 bp, Homo sapiens
cttatctgggacagaatcaggtctcccaatttaaggcttctcaaaaacagaggaaatccaggattaccctactcccagggacaggggaggaggagagatasaaccgcgagggagtaaaaagttctaagcgtttaaaatgtgaaccaagaagctctcttgtggccctaactgtcttggtccctaacagtccttgggttgacc

SEQ ID NO: 15098 - DNA, 201 bp, Homo sapiens
ccgccattctccatagcacatggtgtagacactgggtagagaggaggggatgttcaatggggagagctagggcataggagggccacggagaagccaatgckagccaagggctgctcacctgggggccggcggcggtggaagacatggatgtccattaggttttccaggttctcctgcagagtctcccggtccagccctgtc

SEQ ID NO: 15099 - DNA, 201 bp, Homo sapiens
ggctctcacctcggtgtgggcatcggcccatagcagttgggagctggccttgtccacagtcagtccattgggccatcctaggttgttgttgatgagcaccrcgcggtctgagccatccattccggaccgctctaacttggcattctccccccagtctgtccagtacataaacctgagtgaggaagaatattagctatatta

SEQ ID NO: 15100 - DNA, 201 bp, Homo sapiens
tgccagtcagtccagtagatataggagtcgagcagggtgaggccatatgggtgctgcaccggtgacaccaatgtatgccgattggcaccattcaggtcagyagcctcaattcgctgcagaggaaggagagggtcgggggtggtgatcagcagattgggaactctccatggagatcctaggcaggcctttcccatcttccca

SEQ ID NO: 15101 - DNA, 201 bp, Homo sapiens
gccgcagtttcccattgaggtcagcactctcgatccggtccagatgcgcatccacccagtagatcctgcgaagaaaatgaaaagagtggctgctccaaacrcttgccagggagcccagctcttccccctatgaacctgtttgtcccctcctgagctgactggcagatgctatgagaactcaagaagcaccctcgatgaggg

SEQ ID NO: 15102 - DNA, 201 bp, Homo sapiens
gctttttacagagtaaatcagtgctcaaatagatacttcctcaaatatgtcctttctacattctgaacagcccaagtgcaataagatccttccccctttcyaatcaagaaaatgccacttttctacttgctcttcctccccagacatgagtctaaggacccaaagtgctcactcctttactgcttgttaagtgtaatgtgg

SEQ ID NO: 15103 - DNA, 201 bp, Homo sapiens
cctgagcacttgagaaagaacataggaagttcaacaggaagtttgaccctcatggatacttctctttaggccctgggtttcccaagtctccaacctgatcrttctttctgaccatttatgacaacttctggtttttctttgaaagcttgtttctaggtctcttccccagaatcccaggacatgagggagagaggggtcagg

SEQ ID NO: 15104 - DNA, 201 bp, Homo sapiens
cgtcaatatagtggggtcctgcaacttataaccttttttgggaggttactctcgctctgctgccatgagtcctgggaccattcccaagcaaaacctgggaytcttccaggcacagcctggagttctgctcgggcctctccctttatggcttcttcaaagagcagcctcactcctggctgctggggtataccaaccgacata

SEQ ID NO: 15105 - DNA, 201 bp, Homo sapiens
gctcttttcactcatgccagtagccctaggagctggtggtaccaggccaggcactagacaaaaaagaggattggagtgggccactggaaccataaacatcyacatatggcccaagagtagcagctggagaacttgacaaaacaatcttttagctgccctagtcccaggcaccttcattagtagcccttcttaatactatca

SEQ ID NO: 15106 - DNA, 201 bp, Homo sapiens
acagatcagaccagtatcagaggctgctgactctcagcccttccaggggctctgccgagtggctccagccatacagtccaactcaccaagggagcagggcyggctatcaggttcgtcaggacaggcacatacgaagtccgaggctctggcaaagcagaggtgggtgcagccaccattgttcacaccacaggcattggtccc

SEQ ID NO: 15107 - DNA, 201 bp, Homo sapiens
ctcagcccttccaggggctctgccgagtggctccagccatacagtccaactcaccaagggagcagggctggctatcaggttcgtcaggacaggcacatacraagtccgaggctctggcaaagcagaggtgggtgcagccaccattgttcacaccacaggcattggtccctggaggcaaagtagatgaatgtcttatctggg

SEQ ID NO: 15108 - DNA, 201 bp, Homo sapiens
gctgacttagaaccccaaagaaacatcccagtcaaggaggtttagttacctctctcctgagccagtacctgtgtgagggcaaaggggtgggacacatggcygaccaagacctgccgcagtttcccattgaggtcagcactctcgatccggtccagatgcgcatccacccagtagatcctgcgaagaaaatgaaaagagtgg

SEQ ID NO: 15109 - DNA, 201 bp, Homo sapiens
agggtgaggccatatgggtgctgcaccggtgacaccaatgtatgccgattggcaccattcaggtcagcagcctcaattcgctgcagaggaaggagagggtsgggggtggtgatcagcagattgggaactctccatggagatcctaggcaggcctttcccatcttcccaggctcctgggaagcagcagggacacggctctca

SEQ ID NO: 15110 - DNA, 201 bp, Homo sapiens
atgtcttgaaacaccagagcatgtcagagagctctggagcctctagcagaggaaatcaaggaaaacgcagaaatatcatagcaggatagctcttggcagaracggagagaagagggccccaaaccatgctctcacaaccaaagagaaagtgctagagagacagggacaggggctatgccagagggaatggggaacaaacac

SEQ ID NO: 15111 - DNA, 201 bp, Homo sapiens
ctaatttttgtatttttttgtagagatggggtttcgtcatattgcccaggctggtctgaaactcctgggctcaagcctctgcccacctcagcctcctaaartgctgggattacaggcatgagccactactctcagcttaaattattaggcctcagttttcttatctataaaatggggacaataatggggtggctgtaaggg

SEQ ID NO: 15112 - DNA, 201 bp, Homo sapiens
caagaccccatctctacaaaaaaaaactgtaaaaattagctaggcattgtggtctgtgcctgcagtcccagctacttgggaggctgaggcaggaggattgyttgagcccaggaggttgaggctgcagtgagccgtgatttgcaccactgcactccatcctgggccacagagcaagaccctgtctcaaaacaaacaaacaac

SEQ ID NO: 15113 - DNA, 201 bp, Homo sapiens
acttcccaaacataggcaaccataatttaaggcgatgattctcaaactttagtgtgcgtaagaatcaggagagcttgttaaaacacagatttctgaacctracacccaaagattttttttaaaataaaaatattcagccgggcgtggtggctcacgcctgtaatcccagcactttgagaggccgaggcaagtggatcatga

SEQ ID NO: 15114 - DNA, 201 bp, Homo sapiens
gtggtagtgcacgcctgtaatcccagctactcgggaggctgaggcagaagaatcctttgaacccagggaggtggaggttgcagtgagctgagattgcgccrctgcactccagcctgggcagcagagcgagactccatctcaaaatttaaaaaagaaaaaaaaattctagtccatttcatgctcactaacccccaaagattc

SEQ ID NO: 15115 - DNA, 201 bp, Homo sapiens
ggctcactgcagccttgaactcccggattcaagcaatcctcccacttcagcctcccaagtagctgggactacaggcatgtgccattacaccaggctaattwaaaaaaaaaattggggatgtgtgtatgcgtgtgggggtcttgctatatttcccaggctgatcttgaactcctaagctcaagagatcttgccctggtcccc

SEQ ID NO: 15116 - DNA, 201 bp, Homo sapiens
cttgctatatttcccaggctgatcttgaactcctaagctcaagagatcttgccctggtcccccaaagcgctaggattataggtgtgagccaccatgcccarccctgattcagtaagtctagggtggggcccaagaatctgcatgtccaacaacttcccagatgatgctgatgctgccacgcagaggaggcaaggttgtcat

SEQ ID NO: 15117 - DNA, 201 bp, Homo sapiens
ggcaggaagcaaagctgtatcaccaactgtacttccactctagttctggagcccaaactccaccaattctcaaggttggcaaaggtatgggaagcccttcyctggagagggtggattccacccttcaacctccccacgctgggccctacctcctgtcctgttccatcccacttggccctgctgatggtatcagtgctgaca

SEQ ID NO: 15118 - DNA, 201 bp, Homo sapiens
cttgctctcctctttacaactttaagccagtagcttaagctgagcactttccttgccaggcactgtgcttggtgcttttttgatctcacaccaagcctctstcgtgtgttattcttattcccattttctagacgagcaaccctgaggctaatagagatcaagaaacttgcccaggatcccatggctacaaagcaccagagc

SEQ ID NO: 15119 - DNA, 201 bp, Homo sapiens
cctgaggctaatagagatcaagaaacttgcccaggatcccatggctacaaagcaccagagctgggactcagatctgactccagagaaagagctctggccastcctctacatagtttacttccagccagctcttccccatcctctgcctttcctctggtcagtctgaatactttctcagtagacttttctatccagaaaggc

SEQ ID NO: 15120 - DNA, 201 bp, Homo sapiens
aatagagatcaagaaacttgcccaggatcccatggctacaaagcaccagagctgggactcagatctgactccagagaaagagctctggccagtcctctacrtagtttacttccagccagctcttccccatcctctgcctttcctctggtcagtctgaatactttctcagtagacttttctatccagaaaggcacttcctga

SEQ ID NO: 15121 - DNA, 201 bp, Homo sapiens
ggctgaggtggggtcattgcttgggctcaggagtttgagaccagcctgagcaacatagtggaaccccgtctctactaaaaatacaaaattcactgggcacmgtggctcacgcctgtaatcccagcactttgggaggctgaggtggatagatcacgagatcaggagtttgagaccagcctggccaacatagtgaaacctcat

SEQ ID NO: 15122 - DNA, 201 bp, Homo sapiens
ctatgtcttatatttttgacatctgcccctgctgctagcacagtgagtacccggcacagaggagatgccctgtaaatgtctgcctgaattagatgggaacrgtgaagtctaatgaatcttttcgtgaatcttgttgtactgccccgaatgtccagcagagggaggaattagcccatgtcagtgccctgctggatttcccca

SEQ ID NO: 15123 - DNA, 201 bp, Homo sapiens
ccctgtaaatgtctgcctgaattagatgggaacggtgaagtctaatgaatcttttcgtgaatcttgttgtactgccccgaatgtccagcagagggaggaaktagcccatgtcagtgccctgctggatttccccatcagaagaaatggcaactctaaggggaaggaaggttctcagaggcaccagaggccacctcaaccacg

SEQ ID NO: 15124 - DNA, 201 bp, Homo sapiens
attagcccatgtcagtgccctgctggatttccccatcagaagaaatggcaactctaaggggaaggaaggttctcagaggcaccagaggccacctcaaccaygaggctactttggctcacccggtgggcagttttttacctgcaggttggcgctgggggtgcaaggtgtggatgtccatagggaagtggagtttgttgcgaa

SEQ ID NO: 15125 - DNA, 201 bp, Homo sapiens
cttggtgtgccagtctgtccagtacaggctgtcttcaaacactgtgatggcgaagggatgcgggaggcctggggaaagtccaggaagacctcagtctggaygtggtctgccatgtcccctgggcccaggcctggcaactacacaaaacctctaccaaggctcctggggggcagggacgggggcaggaggacaagagatgaa

SEQ ID NO: 15126 - DNA, 201 bp, Homo sapiens
gtccaggaagacctcagtctggatgtggtctgccatgtcccctgggcccaggcctggcaactacacaaaacctctaccaaggctcctggggggcagggacsggggcaggaggacaagagatgaaggagactgaaggaaggggctcaccctggctaatgacagccttacggtgactcccatccagattggccctctcgatga

SEQ ID NO: 15127 - DNA, 201 bp, Homo sapiens
ctgaactggttagggttaatgaggtccaggttgtacctccgttcccattagactaattagccaccctcagacatagatgctacaggtaggtcagagattgygcctctaatccagactattggcttagcagggatatttctatatatccaagacaggtcaccctggccaactgtgcagatgttaccatgctaggggaaaagg

SEQ ID NO: 15128 - DNA, 201 bp, Homo sapiens
agaggttgcaagaaagttcgggagcctgagatacaacttacccctccatgggatgcaaggcaatggcccggggcttctccaggttctgccacagcaacacyttccggtgggccccgtccagattggccacctcaatcctcgaggtgcctgagtcggtccagtagagtttgtcatggacccaatccacagccaggccccctg

SEQ ID NO: 15129 - DNA, 201 bp, Homo sapiens
gcagtcggtgtcaccgtcgcagtaccaatgctcagcaatgcagcttccgtcactacagcggaactccttgtcggagcacttgcgcatgtctggggggatgygatgggacagcagttctgagggggccccacaggcaaccctctcaccctcctctctgactcccaacctcactggctttggcgggtctgacctagcccccga

SEQ ID NO: 15130 - DNA, 201 bp, Homo sapiens
acactttgaggatgtactcccagaatgtctagtccaggtagcctgggagctgtcccgagaggttgcaagaaagttcgggagcctgagatacaacttacccytccatgggatgcaaggcaatggcccggggcttctccaggttctgccacagcaacaccttccggtgggccccgtccagattggccacctcaatcctcgagg

SEQ ID NO: 15131 - DNA, 201 bp, Homo sapiens
aaggtggtgggagaggaaagacagtaattgttgaagggcagggacagaaggccaggtgggaagagagggccatacagaccttcctgggggtctactccaayggcaatggtgttcttcatggtaatgttgattggtaccaccacatcagcaaaataagggatgtccagggagaccatgcgaatgtctatcctcctggcgaag

SEQ ID NO: 15132 - DNA, 201 bp, Homo sapiens
tggacctggggcattgctttctgattgaaaatcctttcccagtggaactcaatggagttccgcccagcctctgccaacactcacgacagtcctgctcatcygagtcatcctcacagtcgttgtccccgtcacacacccaggagcggcggatgcacttgccattgtcacagtgaaagtcaagaggggaacaggtaggtagta

SEQ ID NO: 15133 - DNA, 201 bp, Homo sapiens
aaaacgcagaaatatcatagcaggatagctcttggcagagacggagagaagagggccccaaaccatgctctcacaaccaaagagaaagtgctagagagacrgggacaggggctatgccagagggaatggggaacaaacaccctggctcttggcaggagacaaaggtggtgggagaggaaagacagtaattgttgaagggca

SEQ ID NO: 15134 - DNA, 201 bp, Homo sapiens
cagaggaaatcaaggaaaacgcagaaatatcatagcaggatagctcttggcagagacggagagaagagggccccaaaccatgctctcacaaccaaagagaragtgctagagagacagggacaggggctatgccagagggaatggggaacaaacaccctggctcttggcaggagacaaaggtggtgggagaggaaagacagt

SEQ ID NO: 15135 - DNA, 201 bp, Homo sapiens
aagcctgacttaaagccctccggagcagtcaagtagctccagtgctgccctgagggctccgaaggaggtggctgcctctcagcagcttatctgacttcgakaggaagtgaaaggacaggacaaagtgctgaaaacacaagggctcatgtggacctggggcattgctttctgattgaaaatcctttcccagtggaactcaat

SEQ ID NO: 15136 - DNA, 201 bp, Homo sapiens
gcagtcaggctgctgcaggcagtgggggtctggtgcctggaagcctgacttaaagccctccggagcagtcaagtagctccagtgctgccctgagggctccraaggaggtggctgcctctcagcagcttatctgacttcgagaggaagtgaaaggacaggacaaagtgctgaaaacacaagggctcatgtggacctggggca

SEQ ID NO: 15137 - DNA, 201 bp, Homo sapiens
ctgctgtgggctttcgtcgctgttgtcaccacagtcgttgaccccgttgcacagcttcctctgcccaatgcagcgcccattccaacacaggaactggtccraggcacattgggggcttcctagagagatggagggtcaggtcatagcaaggcagggcttgggccaacaaagagatgggagcctgtcattttctagggtaag

SEQ ID NO: 15138 - DNA, 201 bp, Homo sapiens
gggttcggccacaaaccatgggccaggtccgcccactggggacactcacggcaattctgctgtgggctttcgtcgctgttgtcaccacagtcgttgacccygttgcacagcttcctctgcccaatgcagcgcccattccaacacaggaactggtccaaggcacattgggggcttcctagagagatggagggtcaggtcata

SEQ ID NO: 15139 - DNA, 201 bp, Homo sapiens
acccatgttcccataactggaccccactgaactgtaagctccacagggatagagaccaggtatctatgagtacattcctcagcacccagcatgatagatgytcaataaaataattgcagaatgaaggaaccagttcttaggaggacacagtatttcctgctaactggacataatggcggttgccaggggatgtcttgctag

SEQ ID NO: 15140 - DNA, 201 bp, Homo sapiens
gttgctgcgcatgtggcatggctctgcccctctccatggggccttgttccctacctgggctctccagcccagtagacacaacctcctccacgttgctgccrttgaggttggcacggaggatccggtccagggtgacatctgaccagaagacaagctcgcggcggtggtggaaatcaagggcaatggcattctccaggttgt

SEQ ID NO: 15141 - DNA, 201 bp, Homo sapiens
cttttcactcatgccagtagccctaggagctggtggtaccaggccaggcactagacaaaaaagaggattggagtgggccactggaaccataaacatccacwtatggcccaagagtagcagctggagaacttgacaaaacaatcttttagctgccctagtcccaggcaccttcattagtagcccttcttaatactatcaata

SEQ ID NO: 15142 - DNA, 201 bp, Homo sapiens
ttcactcatgccagtagccctaggagctggtggtaccaggccaggcactagacaaaaaagaggattggagtgggccactggaaccataaacatccacatayggcccaagagtagcagctggagaacttgacaaaacaatcttttagctgccctagtcccaggcaccttcattagtagcccttcttaatactatcaataaaa

SEQ ID NO: 15143 - DNA, 201 bp, Homo sapiens
acctcccactgcctctggggaggtacttactacatccatcctcatcgctgtggtccccgcagtcattgtctccatcacactgccactgggcagggatgcasgtacactctccaagagcactcactgcacatgtgaagtggctccgaccacaagcacactcggggctgctggccaggcctgggcggagggaaaaggaatcag

SEQ ID NO: 15144 - DNA, 201 bp, Homo sapiens
tgtgcccggtccacagcctgcatgtccatgaggcctggcaggttggacctcacgaggatgacattgctgccagtacccttgtcagcacggtggatgctcckagtctgccagtcagtccagtagatataggagtcgagcagggtgaggccatatgggtgctgcaccggtgacaccaatgtatgccgattggcaccattcagg

SEQ ID NO: 15145 - DNA, 201 bp, Homo sapiens
ctcaaaaacagaggaaatccaggattaccctactcccagggacaggggaggaggagagatagaaccgcgagggagtaaaaagttctaagcgtttaaaatgkgaaccaagaagctctcttgtggccctaactgtcttggtccctaacagtccttgggttgaccgaccaatcccacagatgttaaggaagcaggctcagtacc

SEQ ID NO: 15146 - DNA, 201 bp, Homo sapiens
aaccaagaagctctcttgtggccctaactgtcttggtccctaacagtccttgggttgaccgaccaatcccacagatgttaaggaagcaggctcagtacccrggagcccacctgtctgccgctgaggggaaaccacgatgatatccatgagtccttccacatttgccagcactgtctccttgttccggcctgagtatttgtc

SEQ ID NO: 15147 - DNA, 201 bp, Homo sapiens
tttatggggatcccacccagaaggacagatcagaccagtatcagaggctgctgactctcagcccttccaggggctctgccgagtggctccagccatacagyccaactcaccaagggagcagggctggctatcaggttcgtcaggacaggcacatacgaagtccgaggctctggcaaagcagaggtgggtgcagccaccatt

SEQ ID NO: 15148 - DNA, 201 bp, Homo sapiens
ggaacagaatgaaaaagtgcaaccacatgctcaatactgggtgtggccaggggagcacacatgggggctgccagatggagggtagtccttcctcactagascagagctaaaggcactggctgtgtgtgagttagaataggagtggcaattgaaactcgcagctctgatactgtgctccaggccataaggccgcaggtcaat

SEQ ID NO: 15149 - DNA, 201 bp, Homo sapiens
tgttgctgcattttactgtgacagaaatctctctacctctctgcaaatccctgagcaccagagtacctggccttcctccatgctcggccctctgcccaccyagccaagtgccaacagcccttacccagagccttgcagctgcgccggtcgggccgtagttcatagcctgtttcacaccagcattggaaagccccttcgctg

SEQ ID NO: 15150 - DNA, 201 bp, Homo sapiens
ttgggcatttggagtaaaatccctccccacacctcgccaaaaagacccttgaatataaatttcaatttttacctctttcttatagcacagctggttgtacwtggctggtttggggattgcttcaatcttcacttcctgtgtggatgttcggtaggaggggttgctgtaggtgaggttccccattccaggatcagtgaactt

SEQ ID NO: 15151 - DNA, 201 bp, Homo sapiens
gcgtccagagccatccatgctggaggcctcaatacggggggtgttgccccagtctgtccagtaaatggtactaggaagagaaaagtaaattgggaagtggrcagcagaaaacaggtaggtaaccaggagaataatcaggtagggcgcttttatccatttaactcaggggactccaatgtttggtccacagaatgaattttt

SEQ ID NO: 15152 - DNA, 201 bp, Homo sapiens
ggccattgggccagaagagatgggtatcggcaatgatgcggcgtccagagccatccatgctggaggcctcaatacggggggtgttgccccagtctgtccartaaatggtactaggaagagaaaagtaaattgggaagtgggcagcagaaaacaggtaggtaaccaggagaataatcaggtagggcgcttttatccatttaa

SEQ ID NO: 15153 - DNA, 201 bp, Homo sapiens
actgggtagagaggaggggatgttcaatggggagagctagggcataggagggccacggagaagccaatgcgagccaagggctgctcacctgggggccggcrgcggtggaagacatggatgtccattaggttttccaggttctcctgcagagtctcccggtccagccctgtcagccggtcagcgctctgtatgctcttggtc

SEQ ID NO: 15154 - DNA, 201 bp, Homo sapiens
catctagatctgtgatgctttcactcacctggtgagcaggtcttgccatcagacagcaggttgatgcctgtggggcaggtacagctgaatccgcttggatytggggacctaagacacaggtggctacagccgccattctccatagcacatggtgtagacactgggtagagaggaggggatgttcaatggggagagctaggg

SEQ ID NO: 15155 - DNA, 201 bp, Homo sapiens
ctatagctgagactgctgacttagaaccccaaagaaacatcccagtcaaggaggtttagttacctctctcctgagccagtacctgtgtgagggcaaagggrtgggacacatggccgaccaagacctgccgcagtttcccattgaggtcagcactctcgatccggtccagatgcgcatccacccagtagatcctgcgaagaa

SEQ ID NO: 15156 - DNA, 201 bp, Homo sapiens
gcgcggtctgagccatccattccggaccgctctaacttggcattctccccccagtctgtccagtacataaacctgagtgaggaagaatattagctatattwgctagttattccagcagctaccacataccatgaatacttaacagtatgtcagatacacttgagtacttacagtatgtcaggcaaaatttttgcttgacaa

SEQ ID NO: 15157 - DNA, 201 bp, Homo sapiens
gagcccagtgttggatgagcaaccagactgacccagaatagagtagaactttaacccatgttcccataactggaccccactgaactgtaagctccacaggratagagaccaggtatctatgagtacattcctcagcacccagcatgatagatgctcaataaaataattgcagaatgaaggaaccagttcttaggaggacac

SEQ ID NO: 15158 - DNA, 201 bp, Homo sapiens
cataagggccacaaggtatgtattttcactaccacctccatttaataggtaaggaagctgagaattagagaggttaaataccggacccaagtgatatagcyaatagatgatgaaaacatttcaatcctggtattctgattcaaggctcatgcttttaacttctacactgtactgtcactctgcgagaagtcacaagagagt

SEQ ID NO: 15159 - DNA, 201 bp, Homo sapiens
gggccacaaggtatgtattttcactaccacctccatttaataggtaaggaagctgagaattagagaggttaaataccggacccaagtgatatagctaatasatgatgaaaacatttcaatcctggtattctgattcaaggctcatgcttttaacttctacactgtactgtcactctgcgagaagtcacaagagagtggaag

SEQ ID NO: 15160 - DNA, 201 bp, Homo sapiens
tttaagcatcacaactctgtgagctagatactgtaatttccatgaggatgaggaaattgaggcacaaaagagttaagtaactgtccaagggcatgcacttsctcctcacagtcaaccatacatcactttctgaattctgtctccctgacgcattcccagggtcccccactgcactgacccaggggtttgtaaattgtcatc

SEQ ID NO: 15161 - DNA, 201 bp, Homo sapiens
tggatctctcttctgctggccataaacttaccccttcctggggaaaacagcaatggcccggggctcatccaggctattgttgatcagtactttgcggcagraaccatccagcctggacgcctcaatggtatttcgacctgtgtctgtccagtacaggttcctggccacccagtccactgccagcccgtcagtggtcttcag

SEQ ID NO: 15162 - DNA, 201 bp, Homo sapiens
cttgaagtgaagacagaagtggtccaggagagacactgggctccttctatctgaggccagggttttaaacaagaggaatcccagggagccaggcaggccayggctcccctatgcatacctgcatctgtccagtacagtttgttggtgacccaatcaatggccaggccagctgggctctccaaactggtatccactaccacc

SEQ ID NO: 15163 - DNA, 201 bp, Homo sapiens
gggactgtcaaggttctgccacaccaacactttccgcatggacccgtccaggttgcccacttcaatccggtttgttcccgtgtctgtccagtatactttcyggccaatggcatcaaccgcgagcccatctgtggtctgtagccctgtgggaagtcaaaagagcacactggctcctattttaaaacagatgggctatttccc

SEQ ID NO: 15164 - DNA, 201 bp, Homo sapiens
ctccaggagtcctttgaaggtgacagctgtagtaccagccatacccagagagaacacagcccaatctggaagggagcttaaacaggtcaccgtctttctgsctgtaaaggagctctgtgctctggatatatctctgatgttgagatggccccagaaagccagaggctctgactcacagccccagccctctgactctcacct

SEQ ID NO: 15165 - DNA, 201 bp, Homo sapiens
cagatatctgggcagttggaggtttggcagtgctagggccattgctgctatcttctcccatggccaggccacccactggccaccttgcctgccttcccccrttggggtcacccaccacactgctcatcgctgttgtcgccacagtcattgtcaccatcgcagtgccacagactccggatgcagtagccattctggcaggga

SEQ ID NO: 15166 - DNA, 201 bp, Homo sapiens
gcctggaacatcatctgaatcttacaaaggtcccagttgtttgtggctggctctttgctgttctaagtgacaggattcagtgcctggcagggtgaggtagwaggagggtctgcaggaggatctccaggagtcctttgaaggtgacagctgtagtaccagccatacccagagagaacacagcccaatctggaagggagctta

SEQ ID NO: 15167 - DNA, 201 bp, Homo sapiens
cacaggtcttcccatctcccttcagctggatgccagtggggcaggcacaggagaagccagaaggccgaggcaagcagaggtgggagcagccgccatttctygagccgcacttgttaaaacctggtgatgagaagcacaagtattcacacctagcctggaacatcatctgaatcttacaaaggtcccagttgtttgtggctg

SEQ ID NO: 15168 - DNA, 201 bp, Homo sapiens
atctggcacttctgggcacagccaccgttgttaacattgcagttctcctcacccgtccggggccctgtgccagccaagccagagttgggagttgagcccakaatcctcccccagagagccaacttggcattccacctggaccacaaagaacagctcccaaagctgcaagagtcctgagggaggattccctttgaaccctat

SEQ ID NO: 15169 - DNA, 201 bp, Homo sapiens
ccctccctcattctcttttgctcttgctctgggagaagcaacctgccatgttgtaagttgtcctatggagaggcccacaaggcaagaaactaatgaggaaggcctccagccaacagcctatgaggagctgaatcctaccaacaactatgtgagtgagtgtggaaggggatccttccccggtcaaaccttgagatgagactg

SEQ ID NO: 15170 - DNA, 201 bp, Homo sapiens
cttggcacttagagaggctgaggtgggcagatcacacaaggccaggagttcgagaccagcctgaccaacatggaagaaaccctctctctactaaaaatacaaaaaaaaaaaaaaaaaaaaaaaaattagctgggcatggtggtgcatgcttgtagttctagctacttgggaggctgaggcacaagaattgcttgaatccag

SEQ ID NO: 15171 - DNA, 201 bp, Homo sapiens
ttgggcccggtggcgcacagctccagctactcaggagcctcagatgggaggatcacctgagcccaggtcagcatgggcaacacaccaagactgcagtctcaaaaaaaaaaaaaaaaaagctatgtgtggtggctcatgcctataaacccaacactttgggaggtcaaagcaggaggattgcttgagcctaggagttcaaga

SEQ ID NO: 15172 - DNA, 201 bp, Homo sapiens
aacccaacactttgggaggtcaaagcaggaggattgcttgagcctaggagttcaagactagcctagacaacaaagtgagacccccatctctacaaaaaataaaaaatcagccgagtggcctcaaacccgtaggctcctgagtagctagggtgcagtagtaggtgcctgtggtcccagctacgtgggaggatcccttgggcc

SEQ ID NO: 15173 - DNA, 201 bp, Homo sapiens
gcaccactgcactccatcctgggccacagagcaagaccctgtctcaaaacaaacaaacaacaacaaaaacaaggtagatctatacactcaactggaaagayacactagatataagggcaagcagaaaaaaagtcacaaaaagtatgctatttttgtaaaaccaaaaccatcaccaccaacaacaaatgtttacatacattt

SEQ ID NO: 15174 - DNA, 201 bp, Homo sapiens
actgcactccatcctgggccacagagcaagaccctgtctcaaaacaaacaaacaacaacaaaaacaaggtagatctatacactcaactggaaagatacacwagatataagggcaagcagaaaaaaagtcacaaaaagtatgctatttttgtaaaaccaaaaccatcaccaccaacaacaaatgtttacatacatttagaag

SEQ ID NO: 15175 - DNA, 201 bp, Homo sapiens
gcaaggaacacctggcctgcccagggcaggaaaactgcttaaaggcatttttaagccataaacaatagcatgagctatctgtgccttaggacatgctcctsctgcatttaactagcccaacctatttctttaattcggcccaccccttcatttcccataagggatacttttagttaatatctatagaaacaatgctaatga

SEQ ID NO: 15176 - DNA, 201 bp, Homo sapiens
ctttgagaggccgaggcaagtggatcatgaggtcaggagttcaagaccagcctgaccaacatggtaaaaccccgtctctactaaaaatacaaaaattggcygggcgcagtggctcacacctgtaatcccagcattttgggaggccgaggcgggtggatcacgagattaggagatcgagaccatcctggctaacatggtgaa

SEQ ID NO: 15177 - DNA, 201 bp, Homo sapiens
ctactaaaaaatacaaaaaattagccaggcgtcgtggcgggcacctgtagtcccagctacttgggaggctgaggcaggagaatggcgtgaacctgggaggyggagcttgcagtgagccgagatcgtgccacagcactccagcctgggggacagagtgagactccgtctcaaaaaaaaaaaaaaaaaaaaaaaattagctgg

SEQ ID NO: 15178 - DNA, 201 bp, Homo sapiens
acaaaaaattagccaggcgtcgtggcgggcacctgtagtcccagctacttgggaggctgaggcaggagaatggcgtgaacctgggaggtggagcttgcagygagccgagatcgtgccacagcactccagcctgggggacagagtgagactccgtctcaaaaaaaaaaaaaaaaaaaaaaaattagctgggtgtggtagtgc

SEQ ID NO: 15179 - DNA, 201 bp, Homo sapiens
tttttttgagacggagttttgcctaggctgaagtacaatggcgtgatctcggctcaccgcaacctccacttcctgagttcaagcaattctcctgcctcagyctcccaagtagctgggattacaggcatgcgccaccacgtccggctaacttttgtatttttagtagagatggggtttctccatgttggtcaggctggtctc

SEQ ID NO: 15180 - DNA, 201 bp, Homo sapiens
ggcgtgatctcggctcaccgcaacctccacttcctgagttcaagcaattctcctgcctcagtctcccaagtagctgggattacaggcatgcgccaccacgyccggctaacttttgtatttttagtagagatggggtttctccatgttggtcaggctggtctcaaactcccaacctcaggtgatctgcccacctcagcctcc

SEQ ID NO: 15181 - DNA, 201 bp, Homo sapiens
ttggacatattgcctctgcacagtgcacaacctacacaactgtacatggtggtggtcttacccagtgtcttcaagatttatgggtagtggcctgtttgtctttttttttttttctttttatttttttatttttatttttttttattttttaatttttttattatcattcttgggtgtttctcgcagagggggatttggcag

SEQ ID NO: 15182 - DNA, 201 bp, Homo sapiens
gtgttggccaggctggtctcaaacccccgacctcaggtgatctgcctgcctcagcctcccaaagtgctgggattacaggcatgagccatggcgcctggccttttttttttttttgaaacagagtctgactctgtcacccaggctggagtgcagtggtatgatctcggctcactgcaaccaccgcctcctgggttcaaggaa

SEQ ID NO: 15183 - DNA, 201 bp, Homo sapiens
atctcaccagtatctgctgctgaaaaggcagtgtctcttagggcaagaataatgtccactgccagcaatggaccagacacccagatccaactaccccccaragctttttcatgttaccaacacacttgaggctggaggtttcccagatgcccatacctgctgggctgattcttccttcttctctcagcctctatccttcat

SEQ ID NO: 15184 - DNA, 201 bp, Homo sapiens
cacacacagctgattcatgtcttgaaacaccagagcatgtcagagagctctggagcctctagcagaggaaatcaaggaaaacgcagaaatatcatagcagsatagctcttggcagagacggagagaagagggccccaaaccatgctctcacaaccaaagagaaagtgctagagagacagggacaggggctatgccagaggg

SEQ ID NO: 15185 - DNA, 201 bp, Homo sapiens
aagggtcgtgtgatggttttattggaagatgttggaagtcatctattactcacatcatctcaaagtatctctggacaaattacttattaagtacaaaattwaaaaatagcaactttacagtggacactaccttaaccatacaatggcagtaagtatcacaataacggaacaggccaacacctgtgtctactgatgagacac

SEQ ID NO: 15186 - DNA, 201 bp, Homo sapiens
tgcctaggctggtcttgaactcctgggctcaagcaatcttcccgccttggcctcccaaagtgctgggattataggcgcgagctaccacgccagaccctaaytgtgcacttttgcaaaggccctatgggcaggagggaactctacctcagaatggggagcatgtcactgtcacctaggggacttccctaaactgtatatgcc

SEQ ID NO: 15187 - DNA, 201 bp, Homo sapiens
aagtgatgtctgtaagcaggttttccacagcatgggtctgccagacagagcaggtgcaggattagtcatgactccaagccaggcaaggtgattaagaaaasctaaatttatattaaattatcataaagtcctaaaatactgaacatagtggttaaataactccagaaagtccaatctctccagtgagtaacgttaaaacca

SEQ ID NO: 15188 - DNA, 201 bp, Homo sapiens
tatgtcctttctacattctgaacagcccaagtgcaataagatccttccccctttccaatcaagaaaatgccacttttctacttgctcttcctccccagacrtgagtctaaggacccaaagtgctcactcctttactgcttgttaagtgtaatgtggggaggctcagaactggggctgacgctactgagagcaaggctaagg

SEQ ID NO: 15189 - DNA, 201 bp, Homo sapiens
tgctgaaaaggcagtgtctcttagggcaagaataatgtccactgccagcaatggaccagacacccagatccaactaccccccagagctttttcatgttacyaacacacttgaggctggaggtttcccagatgcccatacctgctgggctgattcttccttcttctctcagcctctatccttcatccctgtctttacccaca

SEQ ID NO: 15190 - DNA, 201 bp, Homo sapiens
cgtgtgttattcttattcccattttctagacgagcaaccctgaggctaatagagatcaagaaacttgcccaggatcccatggctacaaagcaccagagctrggactcagatctgactccagagaaagagctctggccagtcctctacatagtttacttccagccagctcttccccatcctctgcctttcctctggtcagtc

SEQ ID NO: 15191 - DNA, 201 bp, Homo sapiens
cccatgatcacaaccaccaacgtggtctcattattctcactgattgagctcaatcatgagcaaatgttatatttgaacctataaaattgatatacattaayaaatgctttctatattagggctccaactaagatttccctggaagaaaaagatgtcctgctgcctaaggtttgcaaaccactggcctattcctcccaccgt

SEQ ID NO: 15192 - DNA, 201 bp, Homo sapiens
ccagagcggcagggctggtgggaggctagggaaacacaagacttctgtctctagccagtctgtgcagtgtcccatggcagactagaaggccacagccccaraatcccagttcctccatctcttcccaagagggaccagaaaatccagaaactcctctctgaactcctgccccagctggcgactgtgccttgccacccaagc

SEQ ID NO: 15193 - DNA, 201 bp, Homo sapiens
cagtcggtgtcaccgtcgcagtaccaatgctcagcaatgcagcttccgtcactacagcggaactccttgtcggagcacttgcgcatgtctggggggatgcratgggacagcagttctgagggggccccacaggcaaccctctcaccctcctctctgactcccaacctcactggctttggcgggtctgacctagcccccgaa

SEQ ID NO: 15194 - DNA, 201 bp, Homo sapiens
actgctgtcaccttaaatgagatgatacatggaatgcagttatcagggagcttgacacaagatgcactataacatgttagctatgttacattgttactgtrgtttattaatgggacatcatgctgatataaatcatcaaaagcaattggcaagagcaattaaatgtacatttattcaggattttaagctacttcgggtgct

SEQ ID NO: 15195 - DNA, 201 bp, Homo sapiens
ggcatgatcacagctcactgcagcctccaactcctgagctcaagtgatcctcctacctcagcctcctgtgtagctgggactacaggcacaagccaccacamccagctcattgaaatgggactatttttcatgccttcacattgagcaaataattttccattgaagtgacaaagaagttaaaaacaaacaaacaaacaaaag

SEQ ID NO: 15196 - DNA, 201 bp, Homo sapiens
aggcacaagccaccacacccagctcattgaaatgggactatttttcatgccttcacattgagcaaataattttccattgaagtgacaaagaagttaaaaamaaacaaacaaacaaaagcaggctgggcgcagtggctcacgcctgtaatcccagcactttgggaggccgaggcaggtggatcacctgaggtcaggagttca

SEQ ID NO: 15197 - DNA, 201 bp, Homo sapiens
ctgtgagataatggttgtcattttaagtcactaagttttcgggtaatttgttatgcagcaatggagaactgatgcactgagctttagagtcagacagatcygtttcaattccacctctgtgatttattagctgggaccttgatagatataatctaaactctctggctgggtgcggtggctcacacctgtaatcttggcact

SEQ ID NO: 15198 - DNA, 201 bp, Homo sapiens
acatgcctgtaatcccacctactcgggaggctgaggcaggagaattgcttgaatctaggaagcggaggttgcagtgagctgagatcacaccaccgcactcyagcctgggcgacacagcaagactccatcttaaaaacaacaacaacaacaaaacaaacaaaaaaaatgctttttggctagtgggacataatatagaataca

SEQ ID NO: 15199 - DNA, 201 bp, Homo sapiens
cacagcaagactccatcttaaaaacaacaacaacaacaaaacaaacaaaaaaaatgctttttggctagtgggacataatatagaatacagacagagttgayaatatttggcaaaaaagggtcaaatttatttctctttcttttctttcctttcttctttcctttctgtctctctttctctgactctcctctctgagatagc

SEQ ID NO: 15200 - DNA, 201 bp, Homo sapiens
tagaaagtctagtgacctcagaggaaccaccacccagcctcatcttcaggaatttgattgccctttgactcctacccaataatcaaagcccaatttcttamaaatggtctttaagaagagagctcactcggccgggcatggtggctcacgcttgtaatcccagcactttgggaggccgaggcgggggatcacttgaggtca

SEQ ID NO: 15201 - DNA, 201 bp, Homo sapiens
ctttgggaagccaaggcagtaggattgcttgagtccaggagttcgagaccagcctgggcaacatagcgagatgctgtctctacaaaaaatttagaaattarctgggcatggtggcatgtgcctatagtccctgctacttgagaggctgaggtaagaagatggcttgagccagggaggttcaggctgcagagagctgtgact

SEQ ID NO: 15202 - DNA, 201 bp, Homo sapiens
cattcctcagcacccagcatgatagatgctcaataaaataattgcagaatgaaggaaccagttcttaggaggacacagtatttcctgctaactggacatartggcggttgccaggggatgtcttgctagaagacaagtttatcattccccacatacctttgggaagagacaaggattgctaggtggtgatgataagaaacg

SEQ ID NO: 15203 - DNA, 201 bp, Homo sapiens
taccggacccaagtgatatagctaatagatgatgaaaacatttcaatcctggtattctgattcaaggctcatgcttttaacttctacactgtactgtcacyctgcgagaagtcacaagagagtggaagagccccagggaggtcaccttgtttctgtgatgcaagcttcctctccactacccacctttaccccgtcataacc

SEQ ID NO: 15204 - DNA, 201 bp, Homo sapiens
aagccttgacttccgacatctgggtagccaggtactgcttctgggaccctccaataaggttgtcacataggttgtgcactcacaaaagtggcacatctaargaggagggtactgtgacattgtagatatcatacatttctgtttttattataccaattttgggcagttagaagtgtcttttttttttttttttttttttga

SEQ ID NO: 15205 - DNA, 201 bp, Homo sapiens
ggcgaaaccctgtctctactaaaaatacaaaaattagctgggcgtggtagcgggtgcctataatcccagctacttgggaggctgaggcaggagaattgctygaacccgggagacagagattgcagtgagctgagatcgcaccattgcacgccagtctgggcgacagagcaagactcttgtctcaaaacaaaacaaacaaac

SEQ ID NO: 15206 - DNA, 201 bp, Homo sapiens
gtaaatctctgttgggggctctcagttctgaaggctgtgagacccctgatttcttacttcacacctctatagttctgtgtgtgtatctttaattcctctascaccactgggttagggtctccccgacagagctggtcttggcaaccagcctctggtttctacagctgctcttgcttccttgggcatatccataagatctgg

SEQ ID NO: 15207 - DNA, 201 bp, Homo sapiens
ggtggctcacgcctgtaatcccagcactttgagaggccgaggcaagtggatcatgaggtcaggagttcaagaccagcctgaccaacatggtaaaaccccgyctctactaaaaatacaaaaattggctgggcgcagtggctcacacctgtaatcccagcattttgggaggccgaggcgggtggatcacgagattaggagatc

SEQ ID NO: 15208 - DNA, 201 bp, Homo sapiens
caggagttcaagaccagcctgaccaacatggtaaaaccccgtctctactaaaaatacaaaaattggctgggcgcagtggctcacacctgtaatcccagcaktttgggaggccgaggcgggtggatcacgagattaggagatcgagaccatcctggctaacatggtgaaaccccgtctctactaaaaaatacaaaaaattag

SEQ ID NO: 15209 - DNA, 201 bp, Homo sapiens
gattggcatgcagtggtgtgatcatggctcactgcagccttgaactcccggattcaagcaatcctcccacttcagcctcccaagtagctgggactacaggyatgtgccattacaccaggctaattaaaaaaaaaaattggggatgtgtgtatgcgtgtgggggtcttgctatatttcccaggctgatcttgaactcctaag

SEQ ID NO: 15210 - DNA, 201 bp, Homo sapiens
atggtgaaaccccgtctctactaaaatacaaaaacttagccgggcatggtggtgcacgcctgtagtcccagctacttgggaggctgaggcaggagaaaacrgcatgaacccgggaggcggagcttgcagtgagccgagatcgcaccactgcactccagcctggcgacagagcaagactccgcctcaaaaaaaaaaaaaaaa

SEQ ID NO: 15211 - DNA, 201 bp, Homo sapiens
gaacccgggaggcggagcttgcagtgagccgagatcgcaccactgcactccagcctggcgacagagcaagactccgcctcaaaaaaaaaaaaaaaaaaagsctgatttacccagaaagcgatggaaagaaaacaaggcataggttcatgatctgaaatgccttaaaacactccccagcatcagctacacagcagaagcagc

SEQ ID NO: 15212 - DNA, 201 bp, Homo sapiens
cgctcacctgcgtgacatctggttcaatcacacttcctgggatctggtgccctttgccccctatactttatacctcaggcttcttttaagcactgccatgytagcagaatcagacttctaaatcaaatggaaacagactctactaaggtcccagaagtgcatgctgtttaagcatctgtcggcttcatctcaacttttctc

SEQ ID NO: 15213 - DNA, 201 bp, Homo sapiens
cgagatcaggagtttgagaccagcctggccaacatagtgaaacctcatctctactaaaaatacaaaaattagccaggcatggtggcaggtgcctgtaatcycagctacttgggagcccaaagcagaagaatcgcttgaaccagggaggtggaggttacaatgagccgagatcatgccgccacactccagcctgggtgacag

SEQ ID NO: 15214 - DNA, 201 bp, Homo sapiens
gagatcatgccgccacactccagcctgggtgacagagtgagactctgtctcaaaaacaaaacaaacaaacaaaaaactccacaaaattcgccaggtgtgayagtgtatgcctgtagtcccagctacttagggggctggggcgggaggcttgcttaagcccaggaagtcgaagctgcagtgagcactgtttacaacactgca

SEQ ID NO: 15215 - DNA, 201 bp, Homo sapiens
ggtgtgatagtgtatgcctgtagtcccagctacttagggggctggggcgggaggcttgcttaagcccaggaagtcgaagctgcagtgagcactgtttacamcactgcactccagcctaggtgacagagcaagaccctgtctcaaaaaaaaaaaaaaaaaaaaaaaaaaaaaggccgggggcggtggcttatgcctgtaatc

SEQ ID NO: 15216 - DNA, 201 bp, Homo sapiens
gtgacagagcaagaccctgtctcaaaaaaaaaaaaaaaaaaaaaaaaaaaaaggccgggggcggtggcttatgcctgtaatcccaacactttggaaggcaraggcgggcaggtcatgaggtcaggagttcaagaccagcctgaccaacatggtgaaacctcatctctactaaaaatacaaaaattagctgggtgtggtagt

SEQ ID NO: 15217 - DNA, 201 bp, Homo sapiens
gggcaggtcatgaggtcaggagttcaagaccagcctgaccaacatggtgaaacctcatctctactaaaaatacaaaaattagctgggtgtggtagtgcacrcttataatccccgctactcaggaggctgaggcaggagaagcacttgaacccgggaggcggacaaaaaaaaaaaaaatgccaggcacagtggctcatgcct

SEQ ID NO: 15218 - DNA, 201 bp, Homo sapiens
aatctcttccactgccttttgtattttattttcttttatttttgagactcgctctgttgcccaggctggaatgcagtggcacgatttcagctcactgcaasctccacctcctggacccaagtgattctcctgcctcagcctcccaagtagctggaattacaggcacccgccaccatgcccagctaatttttgtatttttag

SEQ ID NO: 15219 - DNA, 201 bp, Homo sapiens
gtcttactctgtcacccaggctggaggtcactgttgcaatcacggttccctgcaacctcgacctcccagtctcaagccatccttgcacctcagcctcccaygtagctgggactacaggcatgtgccactatgccaggctaatttagaaaacatttttgtagagatgaggccacactatgttgcccaggctgatcttgaact

SEQ ID NO: 15220 - DNA, 201 bp, Homo sapiens
gttcgggagcctgagatacaacttacccctccatgggatgcaaggcaatggcccggggcttctccaggttctgccacagcaacaccttccggtgggccccrtccagattggccacctcaatcctcgaggtgcctgagtcggtccagtagagtttgtcatggacccaatccacagccaggccccctggtgagaagcagcagc

SEQ ID NO: 15221 - DNA, 201 bp, Homo sapiens
gaccacttcacctatttgtaaaatagcctgagattgacaagtgagctgtttctgtggttttttgtttgtttgtttcgagatggagtctcactcccattgcrcaggctggagtgcagtggtgcagtctcgggtcactgcaacctccacctcctgggttcaagagtttctccttcctcagcctcccaagtagctgggattaca

SEQ ID NO: 15222 - DNA, 201 bp, Homo sapiens
ctctgcacagtgcacaacctacacaactgtacatggtggtggtcttacccagtgtcttcaagatttatgggtagtggcctgtttgtctttttttttttttytttttatttttttatttttatttttttttattttttaatttttttattatcattcttgggtgtttctcgcagagggggatttggcagggtcataggacaa

SEQ ID NO: 15223 - DNA, 201 bp, Homo sapiens
acagtgcacaacctacacaactgtacatggtggtggtcttacccagtgtcttcaagatttatgggtagtggcctgtttgtctttttttttttttctttttwtttttttatttttatttttttttattttttaatttttttattatcattcttgggtgtttctcgcagagggggatttggcagggtcataggacaatagtgg

SEQ ID NO: 15224 - DNA, 201 bp, Homo sapiens
caacctacacaactgtacatggtggtggtcttacccagtgtcttcaagatttatgggtagtggcctgtttgtctttttttttttttctttttatttttttwtttttatttttttttattttttaatttttttattatcattcttgggtgtttctcgcagagggggatttggcagggtcataggacaatagtggagggaagg

SEQ ID NO: 15225 - DNA, 201 bp, Homo sapiens
atttggcagggtcataggacaatagtggagggaaggtcagcagataaacaagtgaacaaaggtctctggttttcctaggcagaggaccctgcggccttccrcagtgtttgtgtccctgggtacttgagattagggagtggtgatgactcttaacgagcatgcggccttcaagcatctgtttaacaaagcacatcttgcacc

SEQ ID NO: 15226 - DNA, 201 bp, Homo sapiens
gagctgttgggtacacctcccagacggggtggtggcctggcagaggggctcctcacttcccagtaggggcggccgggcagaggcgcccctcacctcccggwcggggcggctggccgggcggggggctgaccccccaacctccctcccggacggggcggctggccgggcggggggctgacccccccacctccctcccggacg

SEQ ID NO: 15227 - DNA, 201 bp, Homo sapiens
agctgttgggtacacctcccagacggggtggtggcctggcagaggggctcctcacttcccagtaggggcggccgggcagaggcgcccctcacctcccggamggggcggctggccgggcggggggctgaccccccaacctccctcccggacggggcggctggccgggcggggggctgacccccccacctccctcccggacgg

SEQ ID NO: 15228 - DNA, 201 bp, Homo sapiens
cggggtggctgaccgggcggggggctgacccccccacctccctcctggatggggcggctggccgggcagaggggctcctcacttcccagtaggggcggccrggcagaggcgccccctcacctcccggattgtcttgttttttgagatgtcatctcactctgctacagggacgccgtctcgggtcactgcaacctctgcctc

SEQ ID NO: 15229 - DNA, 201 bp, Homo sapiens
gacgccgtctcgggtcactgcaacctctgcctcctaggttcaagcgattctcctgcctcagcctcccgagtagctgggattacaggcatgcgccaccacamccagctaagttttgtatttttagtagagatggggtttaaccatgttacccaggctggtcttgaactcctgacctcaagcaatccacccaccttggtctcc

SEQ ID NO: 15230 - DNA, 201 bp, Homo sapiens
agtcagtgcagactctccagggagaacggaggccctggagagactgggcctcagcctcctggtccacagtttctggggggtctgagcggctctgccccctmtgcgttcctctagctgctccagatatctgggcagttggaggtttggcagtgctagggccattgctgctatcttctcccatggccaggccacccactggcc

SEQ ID NO: 15231 - DNA, 201 bp, Homo sapiens
aatcccaggaaaagaaaagaaaagtcaatcaacctggtattcttactcaggctcaactaggccagatagccttttgctccaaatccccttgtctttttttytttttttgagaccgagtcttactctgtcacccaggttggagtacagtggcgcaatcttggctcactgcaacctctgcctcctggttcaggcgattctgac

SEQ ID NO: 15232 - DNA, 201 bp, Homo sapiens
gtgcagtggtatgatctcggctcactgcaaccaccgcctcctgggttcaaggaattctcatgcctcagcctcccgagtagctggtgttacaggtgcccgcygccacacccggctatctttttttttgtgtgtatttttagtagaggtgggttttcgccatgttggccaggccagtctcgaactcctggcctcaagagatcc

SEQ ID NO: 15233 - DNA, 201 bp, Homo sapiens
atgatctcggctcactgcaaccaccgcctcctgggttcaaggaattctcatgcctcagcctcccgagtagctggtgttacaggtgcccgccgccacacccrgctatctttttttttgtgtgtatttttagtagaggtgggttttcgccatgttggccaggccagtctcgaactcctggcctcaagagatccacctgccttg

SEQ ID NO: 15234 - DNA, 201 bp, Homo sapiens
ttttttgtgtgtatttttagtagaggtgggttttcgccatgttggccaggccagtctcgaactcctggcctcaagagatccacctgccttggcctcccaawctgttgggattacaggcgtgagccaccacacccagcccccttgtctgttttatagtccttccttactgactcctaggcccatccccagctgatggagaag

SEQ ID NO: 15235 - DNA, 201 bp, Homo sapiens
ccctgttgtgttctcttacacgtgttgtcaagtttgttttcttggacatatatgcatgaaccaaccaaaagaaacacaggagagttggagccatatatagwgaagaaactacccaaatgtcaatatctatcaagcttgcaaaagaccaactctctgagtccgacacagttgatgcagaaaatactccatcagccttgtcct

SEQ ID NO: 15236 - DNA, 201 bp, Homo sapiens
ctcagctactcaggatcctagtaggtcgagggtgcagtgacccaatattgtgccactgcactccagcctgggtgacacagcatgaccctgcctctaaaaamccaaaaaaaaaaaaaaaaaaaaaaaaagacagtaatattggatcaatgttaaatttaaatttcctgattttgatcattgtactgtggtgatgtaagacaa

SEQ ID NO: 15237 - DNA, 201 bp, Homo sapiens
atcagtacccatgccactcttgacaccgggatcacagctggtctatatagtgtctttgtgtgaatcagaaaaaagtatcctttcctcaagacactttactsccatctgctggaaaactgccatgatgagtatataaatctattatgtgactggcttccctttggacatattgcctctgcacagtgcacaacctacacaact

SEQ ID NO: 15238 - DNA, 127 bp, Homo sapiens
ggtttacaccattctcctgcctcagcctcccaagtagctgggacctcaggtgcctgccaccacgcccggctaatttttttgtatttttaatagagacaggstttcagcgtattagccaggatggtct

SEQ ID NO: 15239 - DNA, 201 bp, Homo sapiens
agcgccaggacaggcggacacagcggcctgagtgacagcggaactgttctgccgtacacatggaggtggctgggcaaagcaaaggcttaatgaaaggtggrccccatttcagcctgaaattctccctgccacccaaatctgcagcttatatcagtacccatgccactcttgacaccgggatcacagctggtctatatagtg

SEQ ID NO: 15240 - DNA, 201 bp, Homo sapiens
cacagttctcttcatcgctgttgtctgcacagtcgtcctccccatcacagcgccaggacaggcggacacagcggcctgagtgacagcggaactgttctgcygtacacatggaggtggctgggcaaagcaaaggcttaatgaaaggtgggccccatttcagcctgaaattctccctgccacccaaatctgcagcttatatca

SEQ ID NO: 15241 - DNA, 201 bp, Homo sapiens
cttcctagagagatggagggtcaggtcatagcaaggcagggcttgggccaacaaagagatgggagcctgtcattttctagggtaagctggagacagatgaractcaaggtgggagggtgagggtcctgggcaggaagcagctcagacagggctggctgaatgtctgcatttgctttctccccaggactccacagtgggatg

SEQ ID NO: 15242 - DNA, 201 bp, Homo sapiens
ccactgcactccagcctgggtgacacagcatgaccctgcctctaaaaaaccaaaaaaaaaaaaaaaaaaaaaaaaagacagtaatattggatcaatgttaratttaaatttcctgattttgatcattgtactgtggtgatgtaagacaacatccttgcttttaggaaatgtgcacaggaatagtctggagtcaagggcagg

SEQ ID NO: 15243 - DNA, 201 bp, Homo sapiens
ccccagggaggtcaccttgtttctgtgatgcaagcttcctctccactacccacctttaccccgtcataaccccagctgagctggccccccacactacccaktgcgatacagccagctctcaccccatctcatggtacagtacgatggcccggggactgtcaaggttctgccacaccaacactttccgcatggacccgtcca

SEQ ID NO: 15244 - DNA, 201 bp, Homo sapiens
ctatggagaggcccacaaggcaagaaactaatgaggaaggcctccagccaacagcctatgaggagctgaatcctaccaacaactatgtgagtgagtgtggwaggggatccttccccggtcaaaccttgagatgagactgtaaccccagctgatatctggattgcagtctgtgagacaccttgaggcagaggcacctagcta

SEQ ID NO: 15245 - DNA, 201 bp, Homo sapiens
aaataagtctcaatttccctgataccaggctgagacacgtgccctttgtgtgaatgagcatgaaccaagtgatggcatcccacatggaaactaagcccctyagctgaggggacagctggaagaggaacatcaccaccccgtagccacaggcttgctgtccactaacttagatccctgagcacttgagaaagaacataggaa

SEQ ID NO: 15246 - DNA, 201 bp, Homo sapiens
gggtgcagtgacccaatattgtgccactgcactccagcctgggtgacacagcatgaccctgcctctaaaaaaccaaaaaaaaaaaaaaaaaaaaaaaaaargacagtaatattggatcaatgttagatttcctgattttgatcattgtactgtggtgatgtaagacaacatccttgcttttaggaaatgtgcacaggaata

SEQ ID NO: 15247 - DNA, 201 bp, Homo sapiens
ccagaggaaagctacttgcaagagcatttggaaccaagatgcactgaattttcaaatagaactctgacaataagaaaaggtccgagcggggtcaaaagttytctaaataaacctaaagaaaatccgagagtaataatgactgatagtacttaaaagttagtgagaaaggcacatgtttatacctgggtgtttccttttctt

SEQ ID NO: 15248 - DNA, 201 bp, Homo sapiens
actctcagcccttccaggggctctgccgagtggctccagccatacagtccaactcaccaagggagcagggccggctatcaggttcgtcaggacaggcacayacgaagtccgaggctctggcaaagcagaggtgggtgcagccaccattgttcacaccacaggcattggtccctggaggcaaagtagatgaatgtcttatct

SEQ ID NO: 15249 - DNA, 201 bp, Homo sapiens
atctttaattcctctagcaccactgggttagggtctccccgacagagctggtcttggcaaccagcctctggtttctacagctgctcttgcttccttgggcwtatccataagatctggtcactcttcctaatctttagactcctctctggagctcagatcttgggaggggtggatggagctcattcccaaggggcagccact

SEQ ID NO: 15250 - DNA, 201 bp, Homo sapiens
gattgtatgaagggagtgggtgcaggagacaaaatggctaaaatgaaaatgggagtcactggtccccatctgcagctacaactcaagatgtctacagatgkggtcagtgtgacatgtgcaggtgggaggggcagagggacaagacaggcagggagggtgctcctggggacagtatcctccctgctggccttcacttcttgg

SEQ ID NO: 15251 - DNA, 201 bp, Homo sapiens
accaggaagcactcctgcccctcagaggtcaaggagctgatcctatattggtatgaggaatggcttattttctgatgactacatgtgggactatttcaacygccacgagaaaccccagaagggttattgttttgtattatttatatatactatacttcttaaattaaatgtaacacataactaaattcaggattgatccca

SEQ ID NO: 15252 - DNA, 201 bp, Homo sapiens
cgccacgagaaaccccagaagggttattgttttgtattatttatatatactatacttcttaaattaaatgtaacacataactaaattcaggattgatcccaaccttctagagccagctcctctggcgtcagggaggaaacagttgtcacatcaccatgcaggttacattcatcttccactggaatgactagagccctcagg

SEQ ID NO: 15253 - DNA, 201 bp, Homo sapiens
cactcctttattatactgatctggaaaaagatttagtacagttatgctcagatgaacactggacccatgtggcagggccaagcaagtagaacatgattcaraaatcagtgaaagacatacttggacaggaccaagaggcatttcactgtcacgaaacaaggcaggaagggattgtaatacccacaccaggaagcactcctg

SEQ ID NO: 15254 - DNA, 201 bp, Homo sapiens
agtacagttatgctcagatgaacactggacccatgtggcagggccaagcaagtagaacatgattcagaaatcagtgaaagacatacttggacaggaccaaraggcatttcactgtcacgaaacaaggcaggaagggattgtaatacccacaccaggaagcactcctgcccctcagaggtcaaggagctgatcctatattgg

SEQ ID NO: 15255 - DNA, 201 bp, Homo sapiens
tgaaagacatacttggacaggaccaagaggcatttcactgtcacgaaacaaggcaggaagggattgtaatacccacaccaggaagcactcctgcccctcaraggtcaaggagctgatcctatattggtatgaggaatggcttattttctgatgactacatgtgggactatttcaaccgccacgagaaaccccagaagggtt

SEQ ID NO: 15256 - DNA, 201 bp, Homo sapiens
ttggtatgaggaatggcttattttctgatgactacatgtgggactatttcaaccgccacgagaaaccccagaagggttattgttttgtattatttatatayactatacttcttaaattaaatgtaacacataactaaattcaggattgatcccaaccttctagagccagctcctctggcgtcagggaggaaacagttgtca

SEQ ID NO: 15257 - DNA, 201 bp, Homo sapiens
atctgcagctacaactcaagatgtctacagatggggtcagtgtgacatgtgcaggtgggaggggcagagggacaagacaggcagggagggtgctcctgggracagtatcctccctgctggccttcacttcttggccttgccctgggcagccacagcttccatggctttgcgtaccatctcttcatcccccagaaactgcat

SEQ ID NO: 15258 - DNA, 201 bp, Homo sapiens
ggaagggattgtaatacccacaccaggaagcactcctgcccctcagaggtcaaggagctgatcctatattggtatgaggaatggcttattttctgatgacyacatgtgggactatttcaaccgccacgagaaaccccagaagggttattgttttgtattatttatatatactatacttcttaaattaaatgtaacacataa

SEQ ID NO: 15259 - DNA, 201 bp, Homo sapiens
agaagggaacccccagtccccagccctagtgggagtggggaagaggcccagcaaggccccggacagaccgccagcctgtgaggtctccgctttcagttgcrttgatttgattttttctgagccttgaaggaggggtccggggcctggccctgcccaaaggcccctaggcaggccccaaagccgggacctagggtgctgagc

SEQ ID NO: 15260 - DNA, 201 bp, Homo sapiens; identical to SEQ ID NO: 1591

SEQ ID NO: 15261 - DNA, 201 bp, Homo sapiens; identical to SEQ ID NO: 1583

SEQ ID NO: 15262 - DNA, 201 bp, Homo sapiens; identical to SEQ ID NO: 1592

SEQ ID NO: 15263 - DNA, 201 bp, Homo sapiens
tgatgaaaaccccagcgaccttccaggaggcttttattcagctctgtttggagcatcaggtgtttccactgcctccttagcaatgacactaataaaagtcrtaacacctgttcacatgcacagccctgttgagtgttctgggtgctggagatatcatggtggatgacacaaaggccctggcctcttggagcttatgctccc

SEQ ID NO: 15264 - DNA, 201 bp, Homo sapiens
agctgggggagctctctcctgaagggaaccctgtgtcctccctcaccaggacctctgcgtctctccttaaatggcctctgacgcctgatgaaaaccccagsgaccttccaggaggcttttattcagctctgtttggagcatcaggtgtttccactgcctccttagcaatgacactaataaaagtcgtaacacctgttcaca

SEQ ID NO: 15265 - DNA, 201 bp, Homo sapiens
ggggtctgtgggttttggcagctccctgcccttcagggaggtctgctgagaccacgggtggcccctaccccagcagcagagctctcaggaggcgcccacasggctggactgcctttactcaccacctctaccagagctctgaggtcctggggagagagcccaggcctcttgtgggccccacaccctctaggtgcctgtcct

SEQ ID NO: 15266 - DNA, 201 bp, Homo sapiens
ttgttcccgtggactgagcccagttctcagactcagctgcctggggccttgcacaggactggggcgtgggggctgccctccctgatcaggcccaaagcgcrgatctcacgcccctgaggttggctgtaccctctcagctcagagcagagtgtgggccagggatgagcaggcactggagcagggccctggggtctgtgggtt

SEQ ID NO: 15267 - DNA, 201 bp, Homo sapiens; identical to SEQ ID NO: 1587

SEQ ID NO: 15268 - DNA, 201 bp, Homo sapiens
ggcggtgggttctggcccctcctttgcacatggaatatgagaccctgagtaagtgacctgactccctggggcctcagtttccccatttgcccagtaggatygtcgggagggtccggtgaggcccctggtgtgcccaggctctgtggccagcacgtccacagccggcactgtccttccaggtcggaggagcggccggtgaag

SEQ ID NO: 15269 - DNA, 201 bp, Homo sapiens
agcaccccccacccctgccttcatctctccctgggggtggtctctccacccctggcccccaactggggctgagcccccacctgcccagtttggtgggtgargggtgctccctggcaggatatgcccctctgcagcccagaacatcccaccctttccagaccgaaggggtgtggattgtcctgggaccctggtcattggggt

SEQ ID NO: 15270 - DNA, 201 bp, Homo sapiens
tctcagctcagagcagagtgtgggccagggatgagcaggcactggagcagggccctggggtctgtgggttttggcagctccctgcccttcagggaggtctrctgagaccacgggtggcccctaccccagcagcagagctctcaggaggcgcccacagggctggactgcctttactcaccacctctaccagagctctgaggt

SEQ ID NO: 15271 - DNA, 201 bp, Homo sapiens
actgtcccttaagttcaggtagtgtgtctgcttgtccttcccctgccctggggtatctcagcccccgccatttagagaaagggactgggagtggcaaggcyggcggcggcggccacagtggttgcagaggccgtggctgcgggcagcgcctccagggacaggcggcctcagaccagggagggctttagtgtccacaggcag

SEQ ID NO: 15272 - DNA, 201 bp, Homo sapiens
tcgaggatgatcgctccgacagctcctccagcttactgtcccttaagttcaggtagtgtgtctgcttgtccttcccctgccctggggtatctcagcccccrccatttagagaaagggactgggagtggcaaggctggcggcggcggccacagtggttgcagaggccgtggctgcgggcagcgcctccagggacaggcggcc

SEQ ID NO: 15273 - DNA, 201 bp, Homo sapiens
cccagcatgcacagataaccttagtaatactgggacgtgtgcttcctttttaacatctgagcccgtgtaggtcctgaagcccagcttctttctaagtccawtgtcatcttgaccctggagcctggccgattttgctggggaggcccttgccagccgagagcggctcctgcctgtgccggcgtggcgcgcccctctgctgag

SEQ ID NO: 15274 - DNA, 201 bp, Homo sapiens
ggagggtttctgtctccattcctggaggctgagagatgagggtgcagcagagtgggggcctccactccagaccctgcagtctgggctggccaagggctgcrccggtgcactgcacgtcatggctgatgaagcacttccacaccgcagcccctcagagctgccacagtcagccttagttcaccgagggggaagctgaggccc

SEQ ID NO: 15275 - DNA, 201 bp, Homo sapiens
gcaacctgcagggaaggccggaggggaccacccagccagggagatgttggcgtctaggaggggacaggtgtggtcccacacacccagcatcttaaagtgcrtgggtccccagcccattaggacagggtcccgggtgggcaggggtcatggtggggtgaaggtctcaggcacaggcaaggtcacaggtgcggtgagggtctt

SEQ ID NO: 15276 - DNA, 201 bp, Homo sapiens
gggaaactgaggcccagcaagggcaggaaaccagtctaagagctgaggggtagcaggggtggggctggtgctgggcagaggccaggatggctcccaggacrtatgggcggtctgggcactgtccctcggaggcagcaacactcatggtggtgcccactgacctcacaccctgctcccccatagggaggcggcggctgccag

SEQ ID NO: 15277 - DNA, 201 bp, Homo sapiens
ggccagcacgtccacagccggcactgtccttccaggtcggaggagcggccggtgaagaagcgcaaggtgcagagctgccacctgcagaagaagcagctgckgctgctggaggccatggtggaggagcagcgccggctgagccgcgccgtggaggagacctgccgcgaggtgcgccgtgtgctggaccagcagcacatcctg

SEQ ID NO: 15278 - DNA, 201 bp, Homo sapiens; identical to SEQ ID NO: 1584

SEQ ID NO: 15279 - DNA, 201 bp, Homo sapiens; identical to SEQ ID NO: 1586

SEQ ID NO: 15280 - DNA, 201 bp, Homo sapiens
ggacagccagccgccggggccctccacgtcccagaccgaggcgtccctgtcgccgcccgctaagtccacccctctgtacttcccgtataaccagtgctccyacgaaggccgcttcgaggatgatcgctccgacagctcctccagcttactgtcccttaagttcaggtagtgtgtctgcttgtccttcccctgccctggggt

SEQ ID NO: 15281 - DNA, 201 bp, Homo sapiens
aggtgggcccttcctgccctggcaacctgcagggaaggccggaggggaccacccagccagggagatgttggcgtctaggaggggacaggtgtggtcccacrcacccagcatcttaaagtgcgtgggtccccagcccattaggacagggtcccgggtgggcaggggtcatggtggggtgaaggtctcaggcacaggcaaggt

SEQ ID NO: 15282 - DNA, 201 bp, Homo sapiens
ccaaagccgggacctagggtgctgagcatgacggatgttgggtttgagcggctggcttgcgacgtgagggctgaggtgtgagcctgggtatcttcagaggytcggtggacacaggcagctgcccgcggccccactgttcccgtggcctcctagtcctgctcaggcacctggtgaggaagggacgcagagggcagtgggagg

SEQ ID NO: 15283 - DNA, 201 bp, Homo sapiens; identical to SEQ ID NO: 1588

SEQ ID NO: 15284 - DNA, 201 bp, Homo sapiens
ggtgggtgctgggggtcccagtggtaatgaggcatcaggcagtgtgggaaggggcccatccggcccaccccagggcctctgggcaggttgcaggttgtagygctggatctaggctcctgcccagactgtaggttcaaccaagaatggcatgggagcccagcctgctgtttgctttattaaatctgccctgtagctggggga

SEQ ID NO: 15285 - DNA, 201 bp, Homo sapiens
gggaagaggcccagcaaggccccggacagaccgccagcctgtgaggtctccgctttcagttgcgttgatttgattttttctgagccttgaaggaggggtcyggggcctggccctgcccaaaggcccctaggcaggccccaaagccgggacctagggtgctgagcatgacggatgttgggtttgagcggctggcttgcgacg

SEQ ID NO: 15286 - DNA, 201 bp, Homo sapiens
tgccctctcagcactggggagggtgtcgggctgcacctcatcacgtgttgccgtgggcatgacccgtcccctctgccatccatcccacacctcagacccgkcccgtgctggccacgtgactgtgcctgcaagatgctcacagggcagccgggagccaggcagcatgcaggacagacacctgcggggtgggcctggggagcc

SEQ ID NO: 15287 - DNA, 201 bp, Homo sapiens; identical to SEQ ID NO: 1590

SEQ ID NO: 15288 - DNA, 201 bp, Homo sapiens
cctctcagcactggggagggtgtcgggctgcacctcatcacgtgttgccgtgggcatgacccgtcccctctgccatccatcccacacctcagacccgtccygtgctggccacgtgactgtgcctgcaagatgctcacagggcagccgggagccaggcagcatgcaggacagacacctgcggggtgggcctggggagcccag

SEQ ID NO: 15289 - DNA, 201 bp, Homo sapiens
gctgccctctcagcactggggagggtgtcgggctgcacctcatcacgtgttgccgtgggcatgacccgtcccctctgccatccatcccacacctcagaccmgtcccgtgctggccacgtgactgtgcctgcaagatgctcacagggcagccgggagccaggcagcatgcaggacagacacctgcggggtgggcctggggag

SEQ ID NO: 15290 - DNA, 201 bp, Homo sapiens; identical to SEQ ID NO: 1589

SEQ ID NO: 15291 - DNA, 201 bp, Homo sapiens
acaccctctaggtgcctgtccttctgcctctctaccaaggtgtgccggccccatttctaggccgccgggagataagggggctcacatctcaggcccttccytctgggacctcagtttccccatctgcctaaggccgggtggggctggtggtcttggcttccctacaggggtcctgagtactctgcactacccagcaccccc

SEQ ID NO: 15292 - DNA, 201 bp, Homo sapiens
gcaggttgcaggttgtagcgctggatctaggctcctgcccagactgtaggttcaaccaagaatggcatgggagcccagcctgctgtttgctttattaaatstgccctgtagctgggggaggggcttactttgatcatcactatgtcattgatataaaaatagaggctcagagaggtgaatgaacctgcccaaagtcacaca

SEQ ID NO: 15293 - DNA, 201 bp, Homo sapiens
gccatattttccatctattaggcctaggtcttttggcctaatgcaccaaacaacagaaacaagctgtatggctttgggcaagtcttttcattcctatgagyctcagttttctcatctgcagaatgaaaggattgggccagatcatctgcatgctccctttatatttgaaaatgatttgattatttaattgtaattttagcc

SEQ ID NO: 15294 - DNA, 201 bp, Homo sapiens
ggagcgaggtcgggaaagtctcacccgcccaaagcctcaccaccgagaggcacttaaaaaggaaagcgcagagggaccctgcccacgcgcgtgtacacacmcacccccccacacacacacaagcaaacacgagctccccgccacttcctccccagggtctcctcaaggccaaatattgctcccaatgacagccagtcaccc

SEQ ID NO: 15295 - DNA, 201 bp, Homo sapiens
agttataaatatattttgtcaaaatatatgatcaatatggtcaaaacatttgcacgtaaagtcataaataaggtcaaggtgaatgtttagggattttttcwttttttttttttttttttaaataaaagtccagctataaggaagcagtctgtgtagtgtgtgggtgagtggatgggaacgtgtgtgtgtggtgtatgtggt

SEQ ID NO: 15296 - DNA, 201 bp, Homo sapiens
aacaagaactacttcctgtgtggaacacagattacaaagggtgggaaatatctgagatcagagaagcaactgtcagagcaaggccaagacatcctgccatmttttccatctattaggcctaggtcttttggcctaatgcaccaaacaacagaaacaagctgtatggctttgggcaagtcttttcattcctatgagcctcag

SEQ ID NO: 15297 - DNA, 201 bp, Homo sapiens
cctcccgaccgtggatgcccggagtcgaccaacacctcaggtccgggtgcggaggccgcgggcgcccctgcgcgaccgtccgcgcccggcaagagccgcgsggctttcgcctttgctggtcccgcgccaccgctggggcgggctgcgaaagggttgggaagagcaaagggtttttttgttttgttttgagacgcagaagcc

SEQ ID NO: 15298 - DNA, 201 bp, Homo sapiens
cggagtcgagaaaacggtgaacagctttcggcctgcgctcgacctctgcgtctgcgtctctctcgcctcggcttcccttattttttaaaccaccaccacastccttcccccgccacttccttcccccacccccttcctccgttgcaccagcagcagagtcgcacgcagcaaatactccttcaagaattttacctacctaca

SEQ ID NO: 15299 - DNA, 201 bp, Homo sapiens
cacacacaagcaaacacgagctccccgccacttcctccccagggtctcctcaaggccaaatattgctcccaatgacagccagtcaccccttggcgaacgcytgctaaggctccgaagagccgggccaccgatctagctcccggctgaaagcagccgaccttgtcacgcgcggggccgggaatgggagggagggtgttagag

SEQ ID NO: 15300 - DNA, 201 bp, Homo sapiens
cctcccgcggcaggcggcgaaagggcctgcgcgccctcccctcctccacagccccccgcccctcgcgggcccgcccctccaggcgaggccaacctccgcgyccgccgcccgagcctcagcggtccgggaggagctcccggcggcgctcggcagagccctcggccggtgccccgcggccgccgcgctcccagggctactggc

SEQ ID NO: 15301 - DNA, 201 bp, Homo sapiens
aatataatgagactccaccgcagacaggctctgtttttcttccagcccctcggagtcacgtgagcgccgaggcccctcccgcggcaggcggcgaaagggcytgcgcgccctcccctcctccacagccccccgcccctcgcgggcccgcccctccaggcgaggccaacctccgcgcccgccgcccgagcctcagcggtccgg

SEQ ID NO: 15302 - DNA, 201 bp, Homo sapiens
tttaaaccttcccaaacaggaactaatttcacacactgcctctgatggagctgtgagggagctatcagcctcatctctctgttttacaaacaaggaaaggmaggactaccaggttaaagggacttgcccagatctctgaagtaaatcacagcctctgctccagagctaatgcttcagggaggggttgaggctcatagcctg

SEQ ID NO: 15303 - DNA, 201 bp, Homo sapiens
tgagtttagtgtaactgctgcccaaactgatgattaaaacactgagtaatcaccatttaccctgagtaattagagataatgaaacacctctaaaatcaggktatggagaaaggagctgttggatcggtttaaaaggtggccttccataaactgttaaaagatttccaaacgttgagaaacaggctgtgtgcagaactgtgt

SEQ ID NO: 15304 - DNA, 201 bp, Homo sapiens
gaggttccttgggttccgcaagtcgacgaaaatagctcgtggagaaggcgcgtcctgcaactgcagttcgcaagctctcagggcgccccgccagctggggsccagattgggtgacactcccctcgacgcagcctccggagcggcgcgcactctccagaggccagcaggactgcgctctctaccgcagaacctgctccagct

SEQ ID NO: 15305 - DNA, 201 bp, Homo sapiens
ctcccgaccgtggatgcccggagtcgaccaacacctcaggtccgggtgcggaggccgcgggcgcccctgcgcgaccgtccgcgcccggcaagagccgcgcsgctttcgcctttgctggtcccgcgccaccgctggggcgggctgcgaaagggttgggaagagcaaagggtttttttgttttgttttgagacgcagaagccc

SEQ ID NO: 15306 - DNA, 201 bp, Homo sapiens
ttaccaagtatgtatcttttgggggtttaacctctcacaaagccttcaactcacaaaccgcgatccttggaaaccatcctccaaagcagtgcttggaggcstctaaggcccccggaccaactcccgctggaagaagcctgcagggactcgggaatcacgggaacctttcccgtcggttccgggcctggagggccaggaaga

SEQ ID NO: 15307 - DNA, 201 bp, Homo sapiens
acacacaagcaaacacgagctccccgccacttcctccccagggtctcctcaaggccaaatattgctcccaatgacagccagtcaccccttggcgaacgccygctaaggctccgaagagccgggccaccgatctagctcccggctgaaagcagccgaccttgtcacgcgcggggccgggaatgggagggagggtgttagagg

SEQ ID NO: 15308 - DNA, 201 bp, Homo sapiens
ctagcaggacttggcataataaaacgaccatcagcattcggttaccaggaatcatggtgtctctggggagggggaggggagtggaaggttaaagaataaayaaacaccaataaatagggagaaatagagatgtgtctgcatatgcatttagggctagaaatggaggggcaagatggaaagcaggtcagaaagatcaagttt

SEQ ID NO: 15309 - DNA, 201 bp, Homo sapiens
aataaacaaacaccaataaatagggagaaatagagatgtgtctgcatatgcatttagggctagaaatggaggggcaagatggaaagcaggtcagaaagatsaagtttgtgtcttctccctcacaccacccgcccacccaccagctgcagccatgcacggcctgaaagtaagaattgccctgtaattacttggtctaacttg

SEQ ID NO: 15310 - DNA, 201 bp, Homo sapiens
gttataaatatattttgtcaaaatatatgatcaatatggtcaaaacatttgcacgtaaagtcataaataaggtcaaggtgaatgtttagggattttttccwtttttttttttttttttaaataaaagtccagctataaggaagcagtctgtgtagtgtgtgggtgagtggatgggaacgtgtgtgtgtggtgtatgtggtg

SEQ ID NO: 15311 - DNA, 201 bp, Homo sapiens
ggccacaatccagtcattccagcccacatcgctgaagtccacatagagcgagtggcgccggcagttcttattcttcttcctggcccgctgtgagtgatgcttagggctacgcttggccctccggcgtcgggtcaaggcatggccccggccatcatggccaaaggtgaccaggaggggccggagctgggcccaattcccact

SEQ ID NO: 15312 - DNA, 201 bp, Homo sapiens
tgcccagatctctgaagtaaatcacagcctctgctccagagctaatgcttcagggaggggttgaggctcatagcctgagctccaggtagccagaggagtgstggaagactgagcatttcctgtcctggatttctttccctgggacagacatgacactttactgtctctgcaaagcatttaggtctttacttaaacagatat

SEQ ID NO: 15313 - DNA, 201 bp, Homo sapiens
catctcctgataatttttcagtaccaccttatcatactcatccaggtacagcatggagatggcactcagttcagtgggcacacaacaggctttggggatastggaattgacagaattgaccagggtctgcacaatggcatggttggttgagttgaggtggtcagccagtggaaaggggcagtccccatggcagtagaaggc

SEQ ID NO: 15314 - DNA, 201 bp, Homo sapiens
ggtaacgatcggctaatcctgacatgctggccctggtgggtccgagtctgatggaggtgagtcacctcaatggctagcccatagtttggctgcttctcccrggtccagcgaaggaccgcagggctcacatcaaaagtttcccaccgtgtcacattgtggtggaccagtctcgtgtccagtagtcgtgtgatgaggtgccca

SEQ ID NO: 15315 - DNA, 201 bp, Homo sapiens
aacgatcggctaatcctgacatgctggccctggtgggtccgagtctgatggaggtgagtcacctcaatggctagcccatagtttggctgcttctcccgggyccagcgaaggaccgcagggctcacatcaaaagtttcccaccgtgtcacattgtggtggaccagtctcgtgtccagtagtcgtgtgatgaggtgcccaggc

SEQ ID NO: 15316 - DNA, 201 bp, Homo sapiens
accttcgtggtggaagctcctcacggtgttggcccggctggccgggcgctcaggatactcaagaccagtgctgtggatctgctcttcctcctcctccccasactgaagccggtaaagatcccgcatgtagtccggaatgacggcactcttgctaggctgcgggcggcggcgcagcccaaacatctgcagaagtgtcgcctc

SEQ ID NO: 15317 - DNA, 201 bp, Homo sapiens
gtcgggaaagtctcacccgcccaaagcctcaccaccgagaggcacttaaaaaggaaagcgcagagggaccctgcccacgcgcgtgtacacacacacccccmcacacacacacaagcaaacacgagctccccgccacttcctccccagggtctcctcaaggccaaatattgctcccaatgacagccagtcaccccttggcga

SEQ ID NO: 15318 - DNA, 201 bp, Homo sapiens
tagagatgtgtctgcatatgcatttagggctagaaatggaggggcaagatggaaagcaggtcagaaagatcaagtttgtgtcttctccctcacaccacccscccacccaccagctgcagccatgcacggcctgaaagtaagaattgccctgtaattacttggtctaacttgtttacagtcaaataaccccaaatcagatag

SEQ ID NO: 15319 - DNA, 201 bp, Homo sapiens
ttgatatagcaaaaacacaccgctggggctagcccacgtctgagtgctgtcattccccttcccctgaacacctccccctctgtctccaaaaaataagttcrgcggcagctctgcaaattcttggaggtaagcagctctgttcctcagcctcctggactggggctttgatgtaacccgaactcttcttccccagggctttca

SEQ ID NO: 15320 - DNA, 201 bp, Homo sapiens
gcgacagtgctgccagggagcagagtgtggatattgtaaaggaggtccgacggaagggacagccggcgagcaggggtggtgagggcagagtgaattccggrgagggggaaggaagaggtgtctactcactgacagaaaacaaggcatataataacagtccatgattcttgacagccaatcttgaacaaacttgctggaaag

SEQ ID NO: 15321 - DNA, 201 bp, Homo sapiens
gcccctctccccatgcaaagcagacccccgaagaagccatgccaggctgagggacagacgccggggctcgaagctccgggcagattcagaaagaggcgtckctgcagaaaggacgcatcacagttttcagatcttaatgtggccgaggttttacaactcccgacccggcgcagaaaggaaatcccaccatgttccccggag

SEQ ID NO: 15322 - DNA, 201 bp, Homo sapiens
ctggtcccgcgccaccgctggggcgggctgcgaaagggttgggaagagcaaagggtttttttgttttgttttgagacgcagaagccctttaaaaagcccgscgaggagaggtccagaagtagagaaagcagacggaggcaagctgtgcccgcggggcaaagggacagtagaaggggcgggcgcccgggttccccggaaaac

SEQ ID NO: 15323 - DNA, 201 bp, Homo sapiens
cgtggagaaggcgcgtcctgcaactgcagttcgcaagctctcagggcgccccgccagctgggggccagattgggtgacactcccctcgacgcagcctccgkagcggcgcgcactctccagaggccagcaggactgcgctctctaccgcagaacctgctccagctaggtgttctctccccatctcgccgtcgctctgccccc

SEQ ID NO: 15324 - DNA, 201 bp, Homo sapiens
aacgcgttcagcccaagaccccacagtttttcccaacgacccccctaccaagggcttctcttgtttctgctctcctgccccgcacttcccaaaggtgagamtctcccagggactgctggacagagaaggcctgggcaggggcagtagccgatatttaaaggtctttcagcgccagcatccccacctccagcaccactattg

SEQ ID NO: 15325 - DNA, 201 bp, Homo sapiens
atacttggttttcttcttaggggcattggcaggtagactttgaggaagaaaagtaaaggatcgaacagctcagccctccctcccgaccgtggatgcccggrgtcgaccaacacctcaggtccgggtgcggaggccgcgggcgcccctgcgcgaccgtccgcgcccggcaagagccgcgcggctttcgcctttgctggtccc

SEQ ID NO: 15326 - DNA, 201 bp, Homo sapiens
cttcataacctcataaatgtttatacggtggaagcccctttcccaatcagggccctggtccacctgctcccggaagagccgaagctctgcagaggagatcrcctcgttctcagggatgctgctgaggttaaagaggaaacgaaaagcagagttttcactggtccctgggatgttctccagatgttctaggcacagttagga

SEQ ID NO: 15327 - DNA, 201 bp, Homo sapiens
tcttttaaaccccccaccttggctttgtgtccacagttttctttacaagtggttgtaaagaaaaagaggggccaacagagcacaggcaggaggaaacatgsagacaaccaccctctccctcttccactattgagtatgttactaaacatttccccagcgatcttggaaacacagagcatgccttgttgatcatgttacaga

SEQ ID NO: 15328 - DNA, 201 bp, Homo sapiens
catgccaggctaatttttgtattttttagtagagatggggttttaccatgttagccaggctggtcttgaactcctgaacctcaagtgatttcctgtctcakcctcccaaagtgctgagattacagccgtgagccactacaccgggcttgatgttgctttttaatccagactgacagtctttgcccctaaactggaatgttt

SEQ ID NO: 15329 - DNA, 201 bp, Homo sapiens
ttttcacttggaatgattgaaactcgtgctgctccttccgcgtgcatgtgtaaaacgagccacagactgctagtctgttctgctctcctgctgtccgtgascgttgctagacctcctgtatggaggcagtgtggtgccatggaaggaggcgatgcagtagagtcaggccggcataagtggcttctctgcatgtgtgtcagc

SEQ ID NO: 15330 - DNA, 201 bp, Homo sapiens
gtaggtgctgcagaggttaaagagagactgttggtttccagttggcagtatggaaagtgccagtcgtagtgcacagtgctcgagaggttcaaaggaaacgrtgatggcacccggcagagatgggagctgctggccaccccctagtggactctgcatagcccatggccagtgtgcccttgccatggtctcgaggatggaaaa

SEQ ID NO: 15331 - DNA, 201 bp, Homo sapiens
gaatgtctggtgacattcccttgtagaccttcttgttgggtggcctacttcctagtaccttagctgtaactcaactcccctcctgcactcaaggaatcacrctggaatacaggggagtaaatgatgctattatagggataaccttgaatctgttctgagttatcagaaacataagtacctgcaaggtgtagttttgttctt

SEQ ID NO: 15332 - DNA, 201 bp, Homo sapiens
ttcttttatcctgctgcctgcctgagtattctgggaatcctacaaggatttgagggagcccttgggattccaacctaacaaattagttttctgtaatattrttctagtccatttagattgtgtaaatgatctaaatggtgtaaccatttaatatcaaaagtataacagcatttaagtcagcttttcgaagaaacttttatt

SEQ ID NO: 15333 - DNA, 201 bp, Homo sapiens
gtctcaaaaaacaaagacttaattattttaatagagcagttttaggttcacagcaaaattaagaggaaggtccaatgattttctgtatatcctcatttttwaaaattgagttgtttgtcagtgagttgtaagagtttatgtattatgaatatgtcttttgtcagatatgatttgcaactattttctcccaatgtgtggcct

SEQ ID NO: 15334 - DNA, 201 bp, Homo sapiens
aggtgccagattaagaaaagctccttaagaagcaatttattccttagccaggggcttggcctgtttggtgtagcagagtgaccagattcattctggtcttwcaggtgctatcttgaccgctttcatttttataaataagggattcatcttccctggcctcaggatcgtcataacagctgctttgcaagaaattcgatggaa

SEQ ID NO: 15335 - DNA, 201 bp, Homo sapiens
tgaggctgggtgtgggctgatcacttgaggtcaggagttcgagaccagcctggccaacattgtgaaaacccatttctactaaaactacaaaaattagccargtgaagaaaaaaaaattagccaggtgttgtgttgtggtgaatgcttgtaatcccagctactcaagaggccaaggagggaagattgcttgaacccaggagg

SEQ ID NO: 15336 - DNA, 201 bp, Homo sapiens
tgctcataagttctagtggttctgaaaagaataggtttaaaagtgaggtataagattatgtatgatgttgatgttatgtgtgaggttgatgtttacctttyttggttgacaaatctggtattggtcctctgacaagaatggaaactgtatgtttggacaaaaatactgaagatacagatactgaagttcacaagtatcatg

SEQ ID NO: 15337 - DNA, 201 bp, Homo sapiens
gatgttgatgttatgtgtgaggttgatgtttacctttcttggttgacaaatctggtattggtcctctgacaagaatggaaactgtatgtttggacaaaaawactgaagatacagatactgaagttcacaagtatcatgatgtgagaggatagatcattttcatttcaaggacttggttcatggaaaaaccttttttttttt

SEQ ID NO: 15338 - DNA, 201 bp, Homo sapiens
tttttgagtacatgaatttgagtactttatgttcatcatctcacttaatcatcactctaactctatggagtaagactgttctctcccacccccattgtgcrggtaaggaaacaggtttggggaggttaaggaactcacacaagatcaggtggttagtaggtggtggagatgggattggaatgcaggttggctggtgccaga

SEQ ID NO: 15339 - DNA, 201 bp, Homo sapiens
ctgcctcagcctcccaaagtgctgggattacaggggagccaccgtgcccggccatgtccaaatttttgtgtagacattttcttgttttacttaaaaaaaawttttttttctaaggttttttgtttgtttgtttgtttgttttgtttgttttgagaaagggtctcactttgtcccccaggctggagagcagtggtgtgatct

SEQ ID NO: 15340 - DNA, 201 bp, Homo sapiens
ttttttctttgtgtgtgatgatctgttgaacaaaaacgttcatttattccattgatagcctctggtataccaggacctatggtaggtgctgagaatatatrtatttattatagagcaattaacttattctttccaagaatctttgcttcctcactccttaagagtctgaatattttagcttctgggagattttaccttttc

SEQ ID NO: 15341 - DNA, 201 bp, Homo sapiens
ttgttaggtgctcttgaccattttttttctattaggaaaaggctgggaaggagaagcttgagtcattaccttaggcatagagaggggatggatgagctgtkaagattactactaataagtagaggtgggaccagtgcaaattgtgctgggtgcaatatttttttttaacttagcaataaagatgctatgacagtgtcaatc

SEQ ID NO: 15342 - DNA, 201 bp, Homo sapiens
gttagcatgcagtggtgtgatcatggctcactatagcctcaacctccccaggctcaggggatcctcctgcctcagcttcccaagtagctggaactacaggyacgccgccacgtctggctgatttttgtattttctgtagagatggggttttgccctgttgcccaggctcatctcaaactcctggactcaagtgattcacct

SEQ ID NO: 15343 - DNA, 201 bp, Homo sapiens
gaaattgtttagttattttttttgtctactttgtccttccttccattctttattagttttttatttgctggaatttggaatccctttttttttttttgagrtggagtctctcactttgtcacccaggctggaatgcaatggtgcaatctcagctcactgcaaactccgcctccagagttcaagcaattctcctgcctcagc

SEQ ID NO: 15344 - DNA, 201 bp, Homo sapiens
aagtgctgggattacaggtgtgagcaccacacccggcctggaatccttttttttatgtctttaatcttttaaaaattttttagaccaggtctcgctctgtwgcccaggctgggtgcagtagcacgatcatagcttactgcagcctcagccttccaagctcaggcaattctcctgcctcagcctcccgagcagctgggacca

SEQ ID NO: 15345 - DNA, 201 bp, Homo sapiens
ttagtaaggttattctaatacaaatacagatggtgacagttttgttttcttctttgctctgctagagtcaccaggtttgatcaacacttggagtttttttwaatatattgatttggtcctggataaagaggtgccagattaagaaaagctccttaagaagcaatttattccttagccaggggcttggcctgtttggtgtag

SEQ ID NO: 15346 - DNA, 201 bp, Homo sapiens
ttctaagccatagtactaaaagcaaatgatgtctgcgcaaaaacaggtaatagacaaatgaaatagaataatgatctcagagaaagacccatatacatacrggaatttaatatacgataaaggggcaccatgaatcaatgggagaaggatggattgcttaatagataatgttaggagaattgactaattaaaatggagaaa

SEQ ID NO: 15347 - DNA, 201 bp, Homo sapiens
ttcagagtcgggttgaccagatgtcccttctggattctaagtccagcagatggcccattgggcagccagcccactggccccaggagcatagggaccttcaygtttggcagggcagcagggccgcctagcccaggccggcctctccattcacaccaccgatagcctgaatgactgcagtaactccccactgctctgcaagct

SEQ ID NO: 15348 - DNA, 201 bp, Homo sapiens
aagctggggtcatgccacccggtgaggctccatatgccagcatgtagcacagagcctactgggtgacccttccaacagccccttgagaggagagggcacartgctgcataagttggtgtctaaagggtgtggagttgtatttaagcctttactatcacattgtgaatatttatgggtggatttatttcgtgtctggaattt

SEQ ID NO: 15349 - DNA, 201 bp, Homo sapiens
gcaggctgactgcccttaatttgttatctctttccggttgtacagctgggcctttttcacacatttccgtgaagtgtgatgttcattcatccaacagataytttcaagagcccatcatatgccaggctctagggctacagcagtaaaataaacagactctgccttcaaggggcttatactgtaagggggccacagacagca

SEQ ID NO: 15350 - DNA, 201 bp, Homo sapiens
aacacagttgtggcctactggactgtgccctctgggttccagcctccatctacctgtgttggaggtgcagctgaacagaggatgccctgatgacagggtascaggactgggtccaaggcaggaaggtagcctgtagtgtagctgcgtgccaggaccccagcctgagttgatggtgtttttgttttttgttttttgtttttt

SEQ ID NO: 15351 - DNA, 201 bp, Homo sapiens
tgctgcctcaacttactgggctccagccatcctcctgcctcagcctcccaagtagctgggaccacaggcatgtgcaaccatgcctggctaatttttatatwtttggtagagacagggtttcaccatgttgcccacgctggtcttgaatacctgagatcaagtgatctacctgccttggcctcctaaagtgctgggattaga

SEQ ID NO: 15352 - DNA, 201 bp, Homo sapiens
aggggttggcaaggtagcttagtgcaccccacctcccagaggggcggacccccatctccagccattctgtctcctttggttatgggatgacctctcccccracctctggctccgagcgggtaagggcagaggccgtcagacaggtgtccactgtgccggcgggaaggtgcgagcatcccaagtgcagagcagagtggagtt

SEQ ID NO: 15353 - DNA, 201 bp, Homo sapiens
tgaacttctggtgacaggccagcaaaaggttggagggggatttcccaggctcctagcgggagggcaaaaaaggcctggcaggaggaaaacaggtctgtctrctaggtcaggcatctagaaaattggccaaaagggatgtgggggccgctatttgctaattggcaagttgagtgatgaagttacatcttaagattcttttgg

SEQ ID NO: 15354 - DNA, 201 bp, Homo sapiens
gtctcgctgggctgaaatcaaggtgtctgcagtgctgtgctgcttctggaggctctaggggagaatccatttccttgtctttcccagctcctggaggccasgctttccttggctcatggtcccttcctctaacttcaaagctaatggcaaagcatcttcaaatctctgtctgtctgcttccatagtcatgtcttcttctct

SEQ ID NO: 15355 - DNA, 201 bp, Homo sapiens
ctgaaatcaaggtgtctgcagtgctgtgctgcttctggaggctctaggggagaatccatttccttgtctttcccagctcctggaggccacgctttccttgrctcatggtcccttcctctaacttcaaagctaatggcaaagcatcttcaaatctctgtctgtctgcttccatagtcatgtcttcttctctgcctctctctt

SEQ ID NO: 15356 - DNA, 201 bp, Homo sapiens
ggtcttcccgtgaatctgcatctttttgtaacagggagcctgtcacggtggggcattattgcctggctgttggcacatgactggggaaaaggaggattcasagaatctggatgaattcattttatgaacttctggtgacaggccagcaaaaggttggagggggatttcccaggctcctagcgggagggcaaaaaaggcctg

SEQ ID NO: 15357 - DNA, 201 bp, Homo sapiens
ctcaaatgagtccttgaaggaggacaggtccagggtctgttctgatggtcatcctccacattgaccctgagcccacatggctgtcattcgagagtgtccayatgtactgtggatgtactggatctggagaaaacatttcatcccattctcctctctttcaggtttcaagtgccccatttgctccaagtctgtggcttctga

SEQ ID NO: 15358 - DNA, 201 bp, Homo sapiens
agttttgccaccctgctggagatctgtttgaaatgtttaaaatggagcagccggcaggcggctggcatagacaggtgtggctgctgtacggagggcccagycggcgagtctcgcgggggctttgcaggacccgggctgtggtcacccgtactgcatgcagcaggcttggctccgcgactctcgcctccctccatctttttt

SEQ ID NO: 15359 - DNA, 201 bp, Homo sapiens
agtcttttcttttcttttcttttctttttttttgagatggagtctcgctgtgtcacccaggctggagttcagtggcgcgatcttggctcactgcaggcccygcctcccaggttcacgccattctcttgcttcagcctcccaagtagctgggactacaggcgctcgccaccacacccagctaatttttttgtatttttagtg

SEQ ID NO: 15360 - DNA, 201 bp, Homo sapiens
gctggctagttcctccagtaaaaatcgtattagaatctatgatcatgggaatccttatttttctcctgcttttttttaaagggaatgtttcctgcttttggaagcatcacatatgtttttggtatattgcctttattctcttttattcctactttgctaaattatcacaaacagcaattttatcaacagttttccttgtat

SEQ ID NO: 15361 - DNA, 201 bp, Homo sapiens
tctgcctcccgggttcaagcaattctcatgccatagcctccagagtagctgggactacaggcgtctgtcaccatgcctggcttttttttttttttttttttgtatgagtagagatggggtttcaccatgttggtcaggctggtctcgaactcctgacctcaggtgattcacctgcctcggcctcccagagtgctgggatta

SEQ ID NO: 15362 - DNA, 201 bp, Homo sapiens
tgttggccaggctggtcttgtactcctgacctcaagtgatctgcctgccttggccttccaaagtgctgggattacaggcttgagccactgcacccagcctrtttttattttttgagacagagtcttgctctgtcacccaggccggagtgcagtggcctgatctcgactgactgcaacgtctgcctcccgggttcaagcaat

SEQ ID NO: 15363 - DNA, 201 bp, Homo sapiens
caggcatgtgccaccacagccggctaattttgtacttttagtagagatggggtttcgccaattggccaggctggtcttgaactcctgacctcaagtgatcygcccaccttggcctcccagagtgctgggattgcaggcgtgagccaccatgcccagctgggagaagctttaacctggattcaggaacagaggtaggagaac

SEQ ID NO: 15364 - DNA, 201 bp, Homo sapiens
agcaattctcttgcttcagcctcccaagtagctggaattacaggcatgtgccaccacagccggctaattttgtacttttagtagagatggggtttcgccarttggccaggctggtcttgaactcctgacctcaagtgatccgcccaccttggcctcccagagtgctgggattgcaggcgtgagccaccatgcccagctggg

SEQ ID NO: 15365 - DNA, 201 bp, Homo sapiens
gttggtagtagcttgagccctctgaaaagtaattaatccatacttcataaagagttgttctgaaattagtcacctctgtactgtactgtttttttttgttktttttttttttttttttgaggagtctcgctctgtcaccaggctggagtgcagtggcatgatctccactcactgcaacctctgcctcctgggctcaagcaa

SEQ ID NO: 15366 - DNA, 201 bp, Homo sapiens
atccttaggtaggggtgtttttaatgacagtggatcactaaggttgtggttctagaatcttgaagttagcccaaaacctaaatcttaacctcagtcagttwgtttgtttgtttgtttgtttattgagacagagtctcactctgtcacccaggctggagtgcagtggcatgatctgagctcactgcaacgtccacttcccgg

SEQ ID NO: 15367 - DNA, 201 bp, Homo sapiens
caaaagtcaaaggacattctaaatggagagtggtggagttcctatgggggcactctcttatagttgtctgccttcaatcgcctcagattttttttttttttcttttgagacagggtcttattctgtcacccaggctggagtgcagtggcgagatcatagctcactgcagtctcagactcctgggctcagttgatcctccca

SEQ ID NO: 15368 - DNA, 201 bp, Homo sapiens
aattctgtaaactttaatttgtgaaatagtgttgggggagaaacgattagtgactaatttagggtaacacttagaagtagcttgtgaattgttaggatgatattttaatctctgacagacctccggatatcattggagcttttctgacctcatggaactctgccctgagtgagaagcaggacatgattgcctttggctctt

SEQ ID NO: 15369 - DNA, 201 bp, Homo sapiens
caattctgtaaactttaatttgtgaaatagtgttgggggagaaacgattagtgactaatttagggtaacacttagaagtagcttgtgaattgttaggatgatattttaatctctgacagacctccggatatcattggagcttttctgacctcatggaactctgccctgagtgagaagcaggacatgattgcctttggctct

SEQ ID NO: 15370 - DNA, 201 bp, Homo sapiens
tcaattctgtaaactttaatttgtgaaatagtgttgggggagaaacgattagtgactaatttagggtaacacttagaagtagcttgtgaattgttaggatgatattttaatctctgacagacctccggatatcattggagcttttctgacctcatggaactctgccctgagtgagaagcaggacatgattgcctttggctc

SEQ ID NO: 15371 - DNA, 201 bp, Homo sapiens
aagattgctcctgcctttagggtactttatggagggtaatatctgttggatcactcttttaactactgtgaaatagggttgacttttggggtatctctttycccccccctgcaaatagcctggggtttgttttcatttggtttggttttttgtcaattctgtaaactttaatttgtgaaatagtgttgggggagaaacgat

SEQ ID NO: 15372 - DNA, 201 bp, Homo sapiens
gttcccgatgccaagggatgaatgggatacctaccgtctggaaactaggctttctgcgaggctgcggagcctggcgatttagggactcacggcgtgtgttmacttgtggaagggcagagcgaagcctacctattggagttccatttattggcatcaccctcctcagagaagaggtcgtgtctggctgagagcaagtcagcc

SEQ ID NO: 15373 - DNA, 201 bp, Homo sapiens; identical to SEQ ID NO: 1624

SEQ ID NO: 15374 - DNA, 201 bp, Homo sapiens
cccttctcagtttgtgtcaccctttcaggtgggtcctcgggctagccagatgttctagacagaaaatgaccacaagttgtcctggtggccaggaagctgasagtgacttctctcgcaactcatgtgcctggggacttaaggatcgaatcggttccattttatgctttttccttggggttcctggtggggggctttgaggag

SEQ ID NO: 15375 - DNA, 201 bp, Homo sapiens
gtcatggaattgaggggcaggccacctcctcaagggtgcatgtgtttctgtatgtgtgcacgtgtgtgtgtgtgtgtgtgtgtgtgtgtgtgtgtgtgtgtaaactagaggctttacacctaaggctctcttttgcaaaagccagtcctttaccactggaggcaaagagaggccagttgtctccagtccttccagtggact

SEQ ID NO: 15376 - DNA, 201 bp, Homo sapiens
tgtcatggaattgaggggcaggccacctcctcaagggtgcatgtgtttctgtatgtgtgcacgtgtgtgtgtgtgtgtgtgtgtgtgtgtgtgtgtgtgtgtaaactagaggctttacacctaaggctctcttttgcaaaagccagtcctttaccactggaggcaaagagaggccagttgtctccagtccttccagtggac

SEQ ID NO: 15377 - DNA, 201 bp, Homo sapiens
ttgtcatggaattgaggggcaggccacctcctcaagggtgcatgtgtttctgtatgtgtgcacgtgtgtgtgtgtgtgtgtgtgtgtgtgtgtgtgtgtgkgtaaactagaggctttacacctaaggctctcttttgcaaaagccagtcctttaccactggaggcaaagagaggccagttgtctccagtccttccagtgga

SEQ ID NO: 15378 - DNA, 201 bp, Homo sapiens
tgaccactgctcctctggttctggttctagtttttcccttgtcatggaattgaggggcaggccacctcctcaagggtgcatgtgtttctgtatgtgtgcaygtgtgtgtgtgtgtgtgtgtgtgtgtgtgtgtgtgtgtgtaaactagaggctttacacctaaggctctcttttgcaaaagccagtcctttaccactggag

SEQ ID NO: 15379 - DNA, 201 bp, Homo sapiens
atgaccactgctcctctggttctggttctagtttttcccttgtcatggaattgaggggcaggccacctcctcaagggtgcatgtgtttctgtatgtgtgcrcgtgtgtgtgtgtgtgtgtgtgtgtgtgtgtgtgtgtgtgtaaactagaggctttacacctaaggctctcttttgcaaaagccagtcctttaccactgga

SEQ ID NO: 15380 - DNA, 201 bp, Homo sapiens
aagtttttgtttggtattttaatagacagatttattggtcagtgttttctagagaaacagatccgacagagtgagagagagagagagagagagagagagartgagtgtgtgtgtgtgtgtgtgtgtagagatttattataagaaactggcttacatgattatggaagctgagaaatcccatgatctaccatctgcaagctg

SEQ ID NO: 15381 - DNA, 201 bp, Homo sapiens
ggcatttcctggccagacctgtctatcctactgcctagcttgtaggtaatccctagtgtctaagaactagaagaaattcttgggctactgcaccaagaggragaggatctcctttttcaacagatggtccatcctttaaataagacatctccaaaatacaagccaagtgtttccctggagactttacatccacactttctg

SEQ ID NO: 15382 - DNA, 201 bp, Homo sapiens
tcctcctactcttcattgttggtgggaggaatgagaacctggaggctgtcctagctgtctgtgacttgatttagcatagggggaaagggctgacctttttyctgccagcagtactgtcaaggcctgcccaggtggcagccgaagtagctcccttcatgcccactgcacaccacagcatggtggcaggggcgcctgcagtct

SEQ ID NO: 15383 - DNA, 201 bp, Homo sapiens
ggccaaggtgggaggaatgcttgagcccaagagttggagaccaacctgggtaacatagtgagaccccatctctctctctctctctctctctctctctctcbctctgtctctctgtctatatatatgtatatatatatacacacatagatatgtatacgtatctatatacatagatttatatacataaatataaaattgagg

SEQ ID NO: 15384 - DNA, 201 bp, Homo sapiens
ttcgccatgttggcctggctggtctcgaactcctgacctcaagcgatctgcccaccttggcctcccaattacgggtgtgaaccaccgtacctggccacaggtaccttttgatggctcattccctcacgtgtctggttctccacagagacctcagcaagggccgtcaatccaaatgctgatggtggcctctctatgtggcct

SEQ ID NO: 15385 - DNA, 201 bp, Homo sapiens
aggagaattgtttgagcccggggtgcagaggttgcagtgagccaagatcgtgccattgcactccagcctgggtgacagagtgagactcagtctccgagggraaaaaaaaaaaaaagcgtgcttagagcagaggttcatgggattaaatgcaacaatgtaaataaatctcccagaacctgcctggcacgtaggagtggctct

SEQ ID NO: 15386 - DNA, 201 bp, Homo sapiens
tggcatgatctcggctcactgcaatctctacctcccgggttcaagcgattctcctgcctcagccttgtgagtagctgggattacaggcatgtgccaccackcccaactaatttttgtatttttagtagatatggggtttcaccgtgttggtcaggctggtctcgaactcctgacctcatgatccacccacctcagcttccc

SEQ ID NO: 15387 - DNA, 201 bp, Homo sapiens
gtggcatgatctcggctcactgcaatctctacctcccgggttcaagcgattctcctgcctcagccttgtgagtagctgggattacaggcatgtgccaccaygcccaactaatttttgtatttttagtagatatggggtttcaccgtgttggtcaggctggtctcgaactcctgacctcatgatccacccacctcagcttcc

SEQ ID NO: 15388 - DNA, 201 bp, Homo sapiens
ggctaacacggtgaaacaccgtctctactaaaaaaatacagaaaaattagctgggcatggtggcaggcgcctgtagtcccagctactcaggaggctgaggyaggagaatgacatgaacccgggaggtggagcttgcagtgagccaagattgcgccactgcactccagcctgggcgacagagcaagactccgtctcaaaaaa

SEQ ID NO: 15389 - DNA, 201 bp, Homo sapiens
gcacggtggctcacgcctgtaatcccagcactttgggaggccaaggcgggcggatcacgaggtcaggagatcgagaccatcctggctaacacggtgaaacmccgtctctactaaaaaaatacagaaaaattagctgggcatggtggcaggcgcctgtagtcccagctactcaggaggctgaggtaggagaatgacatgaac

SEQ ID NO: 15390 - DNA, 201 bp, Homo sapiens
ggatggaccacggtttgtttaatccatccgaggacctttttaaaatacttgtgcccagatgcagtggctcactcctgtaatcccggcacttggtgaggtcraggcgggaggattgcttgaccccaggaattcgagaccatactgggcaacatggcaaaaccctgtctctacccaaaatacaaaaattagctgggcgtggtg

SEQ ID NO: 15391 - DNA, 201 bp, Homo sapiens
ggcagttgatgtgggtttctagatacctttcactgagttgaagaaattcccttttgtaacttgtcggctctcgagaatagaaccattagggcctgcctttrccagttaagcatttttggcagaaggactgcacagatgatgatgtgtccttcccactgcatcctatcaggaagctcatgatgtcagtctgtccgtggcttg

SEQ ID NO: 15392 - DNA, 201 bp, Homo sapiens
tttccttggcttgcagatggtggtcttctccgcttctccgtgtcctgacatggtcttccctttgtatgtgtctgtgtcctcatcattctttttttttttttgagacaaggtctggctttgttgcctaggttagcatgcagtggtgtgatcatggctcactatagcctcaacctccccaggctcaggggatcctcctgcctc

SEQ ID NO: 15393 - DNA, 201 bp, Homo sapiens
tatttttatttttgagatggagtttcactctcgttgcccaagctagagtacaatggcacgatctcagctcattgcaatctccacctcctgggttcaagcarttctcctgcctcagcctcccaagtagctgggattacaggcacgcaccaccatgcctggctaattttttttatttttagtagaaacggggtttcaccatgt

SEQ ID NO: 15394 - DNA, 201 bp, Homo sapiens
ctgggctcaagtgatcctcccacctcagcctcccaaatagctggcactacaggccactgtgtcccgctgtcatttagaatttaatgtttgctttttttttwatttttatttttgagatggagtttcactctcgttgcccaagctagagtacaatggcacgatctcagctcattgcaatctccacctcctgggttcaagcaa

SEQ ID NO: 15395 - DNA, 201 bp, Homo sapiens
gacatgggggatcctgggttgggtggagtactggttttccacgaaacctgttgcatatcaggagccagccattcttgctttgtactttttttttttttttttttttttttttgagacagagttttgttcttgttgcccaggctggagggtaatgatgcgatctctgctcactgcaacctccacttccctggttcaagccat

SEQ ID NO: 15396 - DNA, 201 bp, Homo sapiens
atatagcatgtaagagacatgggggatcctgggttgggtggagtactggttttccacgaaacctgttgcatatcaggagccagccattcttgctttgtacyttttttttttttttttttttttttttgagacagagttttgttcttgttgcccaggctggagggtaatgatgcgatctctgctcactgcaacctccacttc

SEQ ID NO: 15397 - DNA, 201 bp, Homo sapiens
tgccagaaaactacagttctaccagaaagtatcccaaaagattttcactgtatataggaacctgcagttagggatcctccagatgttgtgggatattggtkgttactgttttgaaactgaggtatagttgacataccataatattcatacattataaatgtacaatgagatttagtaaatatatagttatgaaaccatcac

SEQ ID NO: 15398 - DNA, 201 bp, Homo sapiens
ttgaatctttttgaggaattgccagcctgttttccaaaggaattgcacaattttatactcccaccaacagtatataagggttctgattctccacatcttttccaacacttattattacctgtctatttgataatagcagtcatagtggttctgatgtggtatcattatagttttgatttgcaaaggatattgggcatcttt

SEQ ID NO: 15399 - DNA, 201 bp, Homo sapiens
cttttagcatctggtttctttaagttaccataatgttttcaaggttcactcacattgtagcatgcagcactttattcctttttttttttttttttttttgktaagacggagcctcgctctgtcacccaggctggagtgcggtggcgtgatttcggttcactgcaacctccgcctcccgggttcaagcaattcttcctcagc

SEQ ID NO: 15400 - DNA, 201 bp, Homo sapiens
tcaactgattttcaacaagggtgtcaagaccattcaatagagaaagaatagtgttttcaatagatgctactgggacaactgaatatccatatggaaaagaatgtggtttggacccctacctcacaccacatacaaaaattaattccaaatggatcaaagacctaaatataagaactaaaactttgatctgcagtagctgga

SEQ ID NO: 15401 - DNA, 201 bp, Homo sapiens
tcaggaggctgaggcacaagaatcacttgaacccagaggcggcactccagcctgggcaacagaatgagactgtctcaaaaaaaaaaagaaagaaagaaaaagaatatcactaataacagacatttatttcatcttattaagtgcccggcacagttctaaatgcttaacattcaattattgaatcctcaccccttgaggtga

SEQ ID NO: 15402 - DNA, 201 bp, Homo sapiens
ctcaggaggctgaggcacaagaatcacttgaacccagaggcggcactccagcctgggcaacagaatgagactgtctcaaaaaaaaaaagaaagaaagaaaaagaatatcactaataacagacatttatttcatcttattaagtgcccggcacagttctaaatgcttaacattcaattattgaatcctcaccccttgaggtg

SEQ ID NO: 15403 - DNA, 201 bp, Homo sapiens
actcaggaggctgaggcacaagaatcacttgaacccagaggcggcactccagcctgggcaacagaatgagactgtctcaaaaaaaaaaagaaagaaagaaaaagaatatcactaataacagacatttatttcatcttattaagtgcccggcacagttctaaatgcttaacattcaattattgaatcctcaccccttgaggt

SEQ ID NO: 15404 - DNA, 201 bp, Homo sapiens
gctactcaggaggctgaggcacaagaatcacttgaacccagaggcggcactccagcctgggcaacagaatgagactgtctcaaaaaaaaaaagaaagaaagaaaaagaatatcactaataacagacatttatttcatcttattaagtgcccggcacagttctaaatgcttaacattcaattattgaatcctcaccccttga

SEQ ID NO: 15405 - DNA, 201 bp, Homo sapiens
attttaaacattaatgtagaaagcggaagtttcccccatgatccctctggtgtatatgtctccaaatttttgcctctggatgaatgggtgtgtgtaaagcygtagaaagcacattatgcttgtttcacaacttctctttcttatttaatgtcctcttcattgtttcatgttgttccatgtacatgtgtggattttattatt

SEQ ID NO: 15406 - DNA, 201 bp, Homo sapiens
tttctgcaggaaattaatctcaaacaaaaaagatggcttgtaagatgacaggaaggggtttagaaagaggcagcatttgcagaaggaagaggaagaagttrcaaaagaaggaaagccctggagcaggtgagggagttggaaaggctgaactcgcacatgctgtgcagaagcagaagacaacagacctttgtggtttccaaa

SEQ ID NO: 15407 - DNA, 201 bp, Homo sapiens
acacaatggtagactctagaagggctaaagacctaaatgagaatggtaacaccacaaaattaatacgtctcttatctacaaatctgaaatccagaacactstgaaaattaaatgctttttcttaacccacatggcagcaaaacttgagctgaggtgaagctatttataatcatgtatttatcctgcttaatgtgaatatcc

SEQ ID NO: 15408 - DNA, 201 bp, Homo sapiens
tcactgcagttttaaaaaactattattataaaaactttcaaacattcagaaaaatttaaaaatagtattagagggccaggcatggtggctcatgcctgtartccaagcatttggggaggcttaggtgggagtatcacttgaggccaggaattcaagaccaacctggtgaaaaagagcgagaccttgtcttaaaaaaaaaaa

SEQ ID NO: 15409 - DNA, 201 bp, Homo sapiens
ttcttttgacccaggaaggagctctttcaggactgtggcacccagagccgtggccctcctgccatgccattgttcccacttccctgcccttgggagtcttrgagacagctgactagctgccctgaggggtccaccgctctcaccttctcactggtggctgctgccattctcctgggctctgcacagaaagctttggtcctt

SEQ ID NO: 15410 - DNA, 201 bp, Homo sapiens
taaaaagtaataataataaaatattgaataaatgtattaaggaaatgtttgtatcagagtgcagaagcacccaaaagttcgcactgtccaggaaatggctrttgagtactttgccaacccctgcctggggtcataagcccaggtcaccatgctgtctgcttttcccccctatctctgggcacttccaggtgggggtgggtg

SEQ ID NO: 15411 - DNA, 201 bp, Homo sapiens
tttgttttctaattgttattggcatgtggaggagtgctgttgacttttgtgtgtgtagatcttgcgtctagcaactttgctgaacttgtgttagttattamcatttgtagattttcttgcctttcctaatatagataatcatatcacagctgtttcctccttttaagcccttaaatcttttgcctaccatgttactttgct

SEQ ID NO: 15412 - DNA, 201 bp, Homo sapiens
attttgttacagcagctcaaactgactaagatatcctgcttcataattttcagcagagccagggaaccccagctactctcctttaagagttgatccaggcygggcatggtggctcgtgcctgtaatctcagcactttgggaggccaaggtgggcggaccacgaggtcaggagatcgagaccgtcctggccaacatggtgaa

SEQ ID NO: 15413 - DNA, 201 bp, Homo sapiens
tcctatcagccagtagggtggacagtagggtagacagtgcctttaggagcccagaaatcaactattggtcctgtatagattctctgtgaaagtttccttcrttgtccttttcccttccctaactgtttttccccttttcccctccaaacacctcccccaaccccacacacactccataaaaaagggaagttagttggaggt

SEQ ID NO: 15414 - DNA, 201 bp, Homo sapiens
gcaccttaatcattcttaacacactttgtaagtattttatctgtttacttttttctgtgtatggtttgcctaaagtctaagctccgtgagagcaggactgygttccttgatctctgttgtgggtcctgcactgtgcctgccactcacattttttgagtacatgaatttgagtactttatgttcatcatctcacttaatcat

SEQ ID NO: 15415 - DNA, 201 bp, Homo sapiens; identical to SEQ ID NO: 1629

SEQ ID NO: 15416 - DNA, 201 bp, Homo sapiens; identical to SEQ ID NO: 1627

SEQ ID NO: 15417 - DNA, 201 bp, Homo sapiens; identical to SEQ ID NO: 1626

SEQ ID NO: 15418 - DNA, 201 bp, Homo sapiens
cccagaggggcggacccccatctccagccattctgtctcctttggttatgggatgacctctcccccgacctctggctccgagcgggtaagggcagaggccrtcagacaggtgtccactgtgccggcgggaaggtgcgagcatcccaagtgcagagcagagtggagttgccagaggtgtgctctggtttgagggctcaggtg

SEQ ID NO: 15419 - DNA, 201 bp, Homo sapiens
catggtgaaaccccgtctctactaaaaatacaaaaactagccaggcgtggtggtgggcgcctgtaatcctagctactcgggaggctgagacaggaaaatcrcttgaacccaggaggcgggggttgcagtgagccgagatagtgccactgcactccagtctgggtgacagagtgagactccatctcaaataaaagcggggtg

SEQ ID NO: 15420 - DNA, 201 bp, Homo sapiens
gagagtctattggtgctaaactctttttgcttacctaaaagtgtttttatttgtcataaccattggataatttagctagttataaaagtctgggttggcakttactgtttctcagcaattagatgatgttattgtgtttcattatcttctagcttttgatattactgcatttgaaaagtcttctcaactcttagagttaat

SEQ ID NO: 15421 - DNA, 201 bp, Homo sapiens
attaattagatgcctggaagttgatatgatatgtttgcttgtgttttcaaggtgctcttgcaactcttcatgggcacagaaaacagttgtcagtgaaatamatgagggagttcagtgtatacaaggccttctcagagagcgtgggcttaggctgggtctggaggtagaatactgaagggccctggtcccagctactcctct

SEQ ID NO: 15422 - DNA, 201 bp, Homo sapiens
gccggggcgccccaagccttcgcgtgcgtgccaaggtttgggaatgtagtgcacgaccgggatctgtctgcattccctttggttcccgatgccaagggatraatgggatacctaccgtctggaaactaggctttctgcgaggctgcggagcctggcgatttagggactcacggcgtgtgttcacttgtggaagggcagagc

SEQ ID NO: 15423 - DNA, 201 bp, Homo sapiens; identical to SEQ ID NO: 1625

SEQ ID NO: 15424 - DNA, 201 bp, Homo sapiens
ctgtgtgggcactgctggcttccccatgctgtctgagtcaaagaccctgactccttcctattgccgggaacctccaggtggccttttgcagccagtggctyttggtcccagtgaaatgtgctccctgccgtgtgccagcctggttggggtgcctgcacattttagttcttcccaccagtgcagcagactcaggccagctgg

SEQ ID NO: 15425 - DNA, 201 bp, Homo sapiens
gagagtgtcagggcctggaggcagaaggcctgtcctagaccacatccctcctctccttccacagcctcagcctgcaggcaggtgccaagttaaagtgcagktgtcctttagttatttaaagggttgcaaaaccttggtctttggggttgaaaaaaaccccatgtgagtgcagagggacttaggctggatcggaaaagcatc

SEQ ID NO: 15426 - DNA, 201 bp, Homo sapiens
ttggccaggctggagtgtagtggcatgatcatggctcactgcagcctcaacctcctgggctcaagcgatcctcctgcctcaacctcccacgtagctgggaytagaggcatgcaccaccatgcccagctaattaaaaaaaaaaagtttttaatagagacggggtctccctgtgttgtccaggctgatctcaaactcctgggc

SEQ ID NO: 15427 - DNA, 201 bp, Homo sapiens
cacttatttctgtgttgacagagagggagtctgtgtctttgagggtgaagaatgtgatacctacagcttagaaatgtgaaagaaaatcatcagtgttaccycttgatcttttattcataataaatcccatttatgaaaattagtttattcaagtcccattttattgacactaagcaccatgaggatgtgacggaaagattg

SEQ ID NO: 15428 - DNA, 201 bp, Homo sapiens
ggactgaccctgatttgatcattgttgaagctgggtgatgagtacctgggagctcactctattcaatttttttgtttgtctgaaaatttccataataaagktttttttaggcccagtgcagtggctcatgcctataatcccagctctttaggaggcctgggcaggaggatcacttgaagccaggacttggaggccagcctg

SEQ ID NO: 15429 - DNA, 201 bp, Homo sapiens
gctccatatgccagcatgtagcacagagcctactgggtgacccttccaacagccccttgagaggagagggcacagtgctgcataagttggtgtctaaaggstgtggagttgtatttaagcctttactatcacattgtgaatatttatgggtggatttatttcgtgtctggaattttcttcaaaataatctggtgcagggag

SEQ ID NO: 15430 - DNA, 201 bp, Homo sapiens
tagaccaaaggaggggaagacatgattatctcatttgatacggaaaacaaattcgatgagttcagtaccattttatgtttaacattctcaataaaatattsatgaagggatatttaatttgatttttaaatcctgtaccaaaaatctacagcaaacattatattcaatggaagatttttttgagacagttttgctcggtca

SEQ ID NO: 15431 - DNA, 201 bp, Homo sapiens
gtacactcagaaatgtatccttccttatgcttatgcaagcatgaatgggttttgtttgctaagggtgtcacattcttcgtgtctataacttgctttttttyccccttcaatttgtggacaagtcagtatatcgaagttttacccttttcagggctagtggtagcccctcctgtggacactccaccaattattagccagatc

SEQ ID NO: 15432 - DNA, 201 bp, Homo sapiens
aagcttaaagttaaaggtcttatcccttcttctgccctggtctccctgctcttgggtgaccaggcagcccttgtaaagcatgggtgtgtacactcagaaaygtatccttccttatgcttatgcaagcatgaatgggttttgtttgctaagggtgtcacattcttcgtgtctataacttgcttttttttccccttcaatttg

SEQ ID NO: 15433 - DNA, 201 bp, Homo sapiens
taccacgtgggaggcctggggcttcccagctccttttgctcacctggagatagtgccccctttcttcagggtggaagaacacagggttcttccagaacttscccttgaggggacctgtggtaggaaagaaacatgacaataatctctaacttttcagaggctttataatgggagggaaacttagaggcataagcctcactt

SEQ ID NO: 15434 - DNA, 201 bp, Homo sapiens
actcctttttatatatagtttgaagtttaaggatccataaggatgaattggaatcttcttcttaagaggtatgggcttaagaaagttgaactgtaaaaggwtcagtttcattctattcagcccagcgtgtaagcctagtgactgtgtgttcattcacattttcatcaggcagctctggccagaggccctgaaagggttgag

SEQ ID NO: 15435 - DNA, 201 bp, Homo sapiens
gcttctctaggaatgtgggaattgctccatggcaatggtgctttggccttcactgcccacatcactgggaccatcccagcccttcttgtctctagcctttyttacaggtcaagtccaaacaggaggatctgactctcttcttggtcttttctcctgtctagctgtcttgttttagagcagaaattaaaggagcagggtgtc

SEQ ID NO: 15436 - DNA, 201 bp, Homo sapiens
atggtatacgagagtgttgtagctcatggagtactaaaccatgagatcaatcataagattctccctgatacttgtaagaggtacagattcccaggttcccstttgttagagatttggatataatacatctctggtgagactttgaaatctctgtttttaatgactggtcctggagcttttaggaatgcagatttatgggcc

SEQ ID NO: 15437 - DNA, 201 bp, Homo sapiens
gtcccaccccctcctccctctcttcattcagaaaatggatggaatcaagctgatgcccgaagaacaccaaagggacccaagaaagtcagaaaaatggtacyttctgctgctctttagccaaaggggtgaacagcgttaattggctcatcgttttaaagatctgagttgttcaaccaaagttaggagataatctttcagtgg

SEQ ID NO: 15438 - DNA, 201 bp, Homo sapiens
aaacttggtgaagtcattaatattagtggttgtaaatacagtgtgtatgctacatgtccagcttgactgcaatcttgaccttttttttttttttgctacawctccagcttgactgcagtcttgacttttttattattttattttatttttatttttatttttatttttatttttgagacggagtctcgtgctgtcgcccag

SEQ ID NO: 15439 - DNA, 201 bp, Homo sapiens
ggtctccatttgttgcccaggctggtcttaaactcctgggctcaagcgatcctcctgcctcagcctcctaaagtgctgggattacaggtgtcagcgacgaygccagaccccaaatttaatcctaaagcagcagctgaaatagtttctagactgatgagactgtttaccttgagacctccctagagtcgttagtcttgaaca

SEQ ID NO: 15440 - DNA, 201 bp, Homo sapiens
catgcatttgttaggccatgctcaggtgggaggacccgcacggccctcccctgggcatcatagctgtggtctgggaagcccctttcctccccaggggacarcgcctcctttctcctgggctgactgctgccagttctctaagtctgttgtcacatgtgctgcaggcttcgcgtcagtcctgtcgcatgcatgctgtcagga

SEQ ID NO: 15441 - DNA, 201 bp, Homo sapiens
taaagatgctatgacagtgtcaatcgctggctttatctgagccatccatagtaatagacttgtttgtttgtttgtttgttttttaagagacagggtcttgytgtgttgcccaggctggcctcctgccatggccatagcatggtcttgactttgagtgtgaacctgcatctggtgccagtaaacctaacttgctcagctgaa

SEQ ID NO: 15442 - DNA, 201 bp, Homo sapiens
tgggaggccaaggtgggaggaatgcttgagcccaagagttggagaccaacctgggtaacatagtgagaccccatctctctctctctctctctctctctctstctctctctgtctctctgtctatatatatgtatatatatatacacacatagatatgtatacgtatctatatacatagatttatatacataaatataaaat

SEQ ID NO: 15443 - DNA, 201 bp, Homo sapiens
cgttttaggatcagcctgttgatttctgcagaatggtttttgaatcctgatattttttcattcagaggtccttgtgacctctcacagagggcctgaaatgkgctcactgctctttagaggttataataagcgaaggcctgctgtacaccaatgcttgatgtattagcgttcttccaggtttggcatgttgggtttaacagc

SEQ ID NO: 15444 - DNA, 201 bp, Homo sapiens
gtggtcctttgtaccttcgcccggttttcttcagtggtacatcctacataattacagtgcaatagcaaaatgaggcaattggcatgggtgctgttagtacyatccatagaccatattcagatctcatcactttcacatgcacccatttgtgtgtgtgtgtgtgtgtgtgtgtgtgtggtttagtgcagtttcatcatacat

SEQ ID NO: 15445 - DNA, 201 bp, Homo sapiens
cgccatctcagctcactgcaagctccaccttccgggttcacgccattctcctgcctcagccacccaggtagctgggattacaggtgcccaccaccatgccyggctaattttttttgtatttttagtagagacggggttctaccatcttagccaggatagtctcgatctcctgaccttgtgattcgcctgcctcggcttccc

SEQ ID NO: 15446 - DNA, 201 bp, Homo sapiens
ttgcccaggctgttctcgaactcctgaactcaagcattctgcccatctcggcttctcaaagtgttggaattacaggcgtgagccaccacacccggctatayatacctacgagtagaattgctcggtcagttctactgtgtcgagtcaattctgccggatctacccggtagaaatgctgggtaactttaattgaatcttttt

SEQ ID NO: 15447 - DNA, 201 bp, Homo sapiens
gcgtgagccaccacacccagctgttttcttctattattattttttatttatttttttatttttttgagactgagtctcgctctgtcgcccaggctggagcrcagtggcgcgatctctgctcactgcaagctccgcctcctggattcacaccattctcctgcctcagcctcccaagtagctgggactacaggcatctgccac

SEQ ID NO: 15448 - DNA, 201 bp, Homo sapiens
accagggagggagaggagccttccctgcgtctcacagccctccctagccatggcctcaaaaaccctattcacttctttcccacatgtgtggagacctcatraagtcctccgtttgtcctgtgggttgctagggcgttctctgtagacactgcgtttgttgtaggaagaatacaaagaagcctcagaggggctcagcctgag

SEQ ID NO: 15449 - DNA, 201 bp, Homo sapiens
ggggagtggtggattaatgggtataacattttagttatgcacgatgagtaagttctagacatctgccatacaacatagtgcctacagttgacaatactatrttgtacacttgaagatttgttaagaggatagagcatatgttagtcttaccacaataaaataaagtttttaaaaggggaaaaaacgggtcaggcgtggtgg

SEQ ID NO: 15450 - DNA, 201 bp, Homo sapiens
aaatggtttactctgcacagagcagtcacacatccatccttggttggactttaaaacaattctggaataggaagggcactacttgaatattactaagtagytggtacaaggccatctggctagtgattgggaaagcgtgttttcctctgatgcctagtctgattctctttcttccataccagtcagtgtggaattcagaaa

SEQ ID NO: 15451 - DNA, 201 bp, Homo sapiens
gcgaccaattattattttagggggacagcttaacaactgcctgaccatcacctgatggtcacctgacattcctggttgggggtgtgaggggacctctcctsctctgctcatgttttactagctacctcctataacaatctcagctcacagcagccttgacctcctgggctcatgtgatcctcctacctcagcctcctgggt

SEQ ID NO: 15452 - DNA, 201 bp, Homo sapiens
tcagtggattggatgaggcctgctcaccttggggagggcggtccgcttcactcagtctatggtttcaaatgctgatctcatctggaaccaccctcacagtmacaccaaaaataatgttgagccaaataatctgggcaccccatggcccagtcaaattgacccatcacaacagatatgttaacacacacacagatacattaa

SEQ ID NO: 15453 - DNA, 201 bp, Homo sapiens
ttgttttttgttttttctgttttttgagacggagtctcactctgccgctcaggctggagtgcagtggcgcgagcttggctcgctgcaacctccacctcccrggttcaagcgattctcctgcttcagcctcccaagtagctgggattataggcacccgccaccatgcctggctaatttttgtatacttagtagagatggggt

SEQ ID NO: 15454 - DNA, 201 bp, Homo sapiens
ggattttaatcttggccgcagctttgattttgatggtagaattccaaggtcatctctatttctcccctgtactatgagggtactggagttttgtaacttcrtgaggaggaggaggctaagaaaatagggaaggaagttctcaagaaggctgtgcagtggtgactccccttcaggggacactaacgaattcagatcctaata

SEQ ID NO: 15455 - DNA, 201 bp, Homo sapiens
gtgtgatctcggctcactgcaacctccgcctcccaggttcaagcgattctcctgcctccctcccaagtagctggtattacaggcacacaccaccctgcctygctaatttttgtatttttagtagagatggggttttgccatgttggccaggctggtcttgagctccttgacctcaagtgatccacttgcctcggcctccca

SEQ ID NO: 15456 - DNA, 201 bp, Homo sapiens
ctcggcctcccaaagtgttgggattacaggcgtcagctattgtgcttggcctatagttttagaataaaagtcttgtgcacattttaaaatatttacctctraatgattcttctttgatgttgtttaaagattgttaaaattaattgtgacaaaatacacttagcataaaaattacccttggccaggtgcagtggctcacgc

SEQ ID NO: 15457 - DNA, 201 bp, Homo sapiens
gctagagtgcagtggcatgatctcggctcactgcaatctctacctcccgggttcaagcgattctcctgcctcagccttgtgagtagctgggattacaggcrtgtgccaccacgcccaactaatttttgtatttttagtagatatggggtttcaccgtgttggtcaggctggtctcgaactcctgacctcatgatccaccca

SEQ ID NO: 15458 - DNA, 201 bp, Homo sapiens
ctacagtacagtggcatggtcatagctcaccgcagccttgaccttctaggctcaagggatcctccttcctcagccttccacgtagctggcactgcaggcgmgcaccaccacgcatggcttaaaatccaattttataacacttccatctctcaaaaagtcctttttttatttttattgttttaaaacaagggtgtcactctg

SEQ ID NO: 15459 - DNA, 201 bp, Homo sapiens
gcaacaagagcgaaactccatctcaaaaaacaaacaaacaacaacacaaagaaaattaaagacttgtgctgcagaggatactatctagaaaataataagayaagttacagaatgggagaaaaattttgcaaatcatgttctgataaggaattagtatatctaaaatgtataaaaatgtcttacaactcaacaaccaaaaga

SEQ ID NO: 15460 - DNA, 201 bp, Homo sapiens
ttgcccaggctggtcttaaactcctgggctcaagcgatcctcctgcctcagcctcctaaagtgctgggattacaggtgtcagcgacgatgccagaccccaratttaatcctaaagcagcagctgaaatagtttctagactgatgagactgtttaccttgagacctccctagagtcgttagtcttgaacacacagctttcct

SEQ ID NO: 15461 - DNA, 201 bp, Homo sapiens
ggaaggctagaaatatttggtgaacagcattgatgacttaccaccaggggaagtaatgaaacatatagaagaaaatttctctaaagaaggaagacttgagrctgcatattgaaaggtaaaactgataagagaagacactaagcatgtcctggtaacgtttctgaactcttaggatgaagagaaaaatcttcaagctttcag

SEQ ID NO: 15462 - DNA, 201 bp, Homo sapiens
ggtgaggcctatacatctgtctgggataggatcccacagaggggtcttgtgtgggattgatccaataaccccatagtttgagtcaggtgacaggtcagcargggcctgaattttcctccctcttctagtgatctgcagaataatcaaatgaccaataactaagcatcttatttgagttgtaaaagaactctcatctgtgtt

SEQ ID NO: 15463 - DNA, 201 bp, Homo sapiens
gaattgctcggtcagttctactgtgtcgagtcaattctgccggatctacccggtagaaatgctgggtaactttaattgaatctttttgaggaattgccagmctgttttccaaaggaattgcacaattttatactcccaccaacagtatataagggttctgattctccacatcttttccaacacttattattacctgtctat

SEQ ID NO: 15464 - DNA, 201 bp, Homo sapiens
atgttgggtgaagttttattctgtatgtccttacatcaagcttatcagttatgttgtccaaatcttccatattttaccaacttttgatttttgttttgttytgttttgttttgtttgtttgtttgttgagacagggtcttgctttgttgcccaggctggagtgcagtggtgcagtcgcggctcactgcagcctcaaactct

SEQ ID NO: 15465 - DNA, 201 bp, Homo sapiens
ccagctaagttttgtatttttagtggagacggggtttcaccatgttgcccaggttgatcccgaactcctgacctcaggtgatctgctgccttggcctcccmaaatgctgagattacaggcgtgagccaccacacccagctgttttcttctattattattttttatttatttttttatttttttgagactgagtctcgctct

SEQ ID NO: 15466 - DNA, 201 bp, Homo sapiens
cctaagagcttattgggatcaccagtttcagctttttctatctactgggagactaccgttctctggcaccagttgcgaccaattattattttagggggacwgcttaacaactgcctgaccatcacctgatggtcacctgacattcctggttgggggtgtgaggggacctctcctgctctgctcatgttttactagctacct

SEQ ID NO: 15467 - DNA, 201 bp, Homo sapiens
tgattccagctaagtacctaccaagaaattcctcgtatgtctcagtatgaggggtcctctgtcctctcagtgagaatatcaaaagaaaaactgattttcasactcttcatgtgcatctttaatttcagtatctttgtcatccctagagccacttttctttctggtcattgaacactattttctagaagcatgattcaccac

SEQ ID NO: 15468 - DNA, 201 bp, Homo sapiens
ctcaaaaaaaaaaaaaaaaaaaaaaatcaccaatgtccagtggctgtcactatcaggggctatttgtgagcttccctaatgcccatgatagatgtgccccrtgctgtaaaacacatccacctattaaataagcagagtggactcacataagtagtaatttcctcacaagctcagaaaatgtcttttcagtttgtactttgg

SEQ ID NO: 15469 - DNA, 201 bp, Homo sapiens
ccgctttggccccccaaagtgctgggattacaggtgtgagcaccacacccggcctggaatccttttttttatgtctttaatcttttaaaaattttttagamcaggtctcgctctgttgcccaggctgggtgcagtagcacgatcatagcttactgcagcctcagccttccaagctcaggcaattctcctgcctcagcctcc

SEQ ID NO: 15470 - DNA, 201 bp, Homo sapiens
tgtctttttcttctcttactaagattaataaggcaaggcttggtggctcacgcctgtaatcccagcactttgggaggctgaggcaggcggatcatttgagktcaggagttcaagaccagcctggctaacatgatgaaaccctgtctctactgaaaatataaaagttagccgggcgtggtggcgcgtgactgtaatcccagc

SEQ ID NO: 15471 - DNA, 201 bp, Homo sapiens
agtgccactgcactccagtctgggtgacagagtgagactccatctcaaataaaagcggggtggtggggggggagaaaaccccctacccattaagcagtcaytccccatatccctctgtccccaatactgatctcctttccctctctatggatgtatctattctggacatttcatataaatgggttcatacaataggtggtt

SEQ ID NO: 15472 - DNA, 201 bp, Homo sapiens
ggtctcccaaagtgctgggattacaggcatgagccaccgcgcccggccgctaatactcttttatttttatttttttatttttgagacggagtctcactctrtcgcccaggctggagtgcagtggcgttatctcggctcactgcaacctccacctcccgggttcaagcaattctcccacctcagcctcccgagtagctggga

SEQ ID NO: 15473 - DNA, 201 bp, Homo sapiens
ctgcaggcgagcaccaccacgcatggcttaaaatccaattttataacacttccatctctcaaaaagtcctttttttatttttattgttttaaaacaagggygtcactctgccacctaggctggagtacagtagtgagactgtagctcactgcagcctcaaactcttgggctcaagcaatcctctcactttgtcctcccaaa

SEQ ID NO: 15474 - DNA, 201 bp, Homo sapiens
cagggtggtctcaaactcctgacctcaagtgatctgcccgccttggcctcccaaagtgttgggattacaggcatgagccaccgcatccagcctgcatcttyccctttttttttttgggggggacggagtcttgctgtgtctcccaggctagagtgcagtggcatgatctcggctcactgcaatctctacctcccgggttca

SEQ ID NO: 15475 - DNA, 201 bp, Homo sapiens
cagccctttgagggcctctctttggaagaaatggtctagagggtcaaagggaagaggaccaatgaatggccatagctcctgttcctggtagatgctttccscattcttcatgtggctggaatactgttgctgaggatccacctggcaggctgcaggctggacttactgtacagcagggtgggtttgatgtcttcacgctca

SEQ ID NO: 15476 - DNA, 201 bp, Homo sapiens
ttacaggcgtgagccactgcgccccacctgtttttttttttttagacagagtcttgctctgttgcccaggctggagtgaactggcgcgatcttggctctcygcaatctccgcctcctgggttcaagtcattctcctgcctcagcctcccaggtagctaggattacaggcgtgcaccaccaaacccaactaatttttgtatt

SEQ ID NO: 15477 - DNA, 201 bp, Homo sapiens
ccaaagtgctgggattacaggcatgagccactgcacccggccttttcttgtttttattgggtcttcatatatagtccttggagaaatgtctatgcaagtcytttgtcaattgactttgtcaattgtcattgcactccagcctgggcaacaagagcgaaactccatctcaaaaaacaaacaaacaacaacacaaagaaaatt

SEQ ID NO: 15478 - DNA, 201 bp, Homo sapiens
agatggggtttcactatgttggcaaagctggtctcgaactcctgacctgaggtgatctgcccaccttggcctcccaaagtgctgggattataggcatgagscaccgtgcctggctgagctgatggttttgatgaaatgaatacagcagcacacattctgcatcccaggattatgctgggagccgtggaaggagccttctca

SEQ ID NO: 15479 - DNA, 201 bp, Homo sapiens
gcctgctgtacaccaatgcttgatgtattagcgttcttccaggtttggcatgttgggtttaacagctagtgggaacgcaggccaaggccagctccgggacrgtaaagatgacccttgagtgcttcccttggtgttatacttggtgtcatcccacctccttgtctcactggtagttggcactccaaaaatacttgaatagaa

SEQ ID NO: 15480 - DNA, 201 bp, Homo sapiens
aaaaaaaaaaaaaaaaaaattagctgggcatgattgcatgcacctgtagtctcagctactccagagactgagatgggaggattgcttaagccctggaggtygaagctgcagtgaactgtgatcacaccactgtactccatcctggttgacagagcaagaccctgtctcaaaaaaatcatgaaccagttaaccctggcctgg

SEQ ID NO: 15481 - DNA, 201 bp, Homo sapiens
cccaaagtgctaggattacaggcgtgagccactgcgccccacctgtttttttttttttagacagagtcttgctctgttgcccaggctggagtgaactggcrcgatcttggctctctgcaatctccgcctcctgggttcaagtcattctcctgcctcagcctcccaggtagctaggattacaggcgtgcaccaccaaaccca

SEQ ID NO: 15482 - DNA, 201 bp, Homo sapiens
gggttttgccatgttggccaggctggtcttgagctccttgacctcaagtgatccacttgcctcggcctcccaaagtgctgagattacaggcgtgagccacygcgcccggccagaaacttggattttaatcttggccgcagctttgattttgatggtagaattccaaggtcatctctatttctcccctgtactatgagggta

SEQ ID NO: 15483 - DNA, 201 bp, Homo sapiens
ctgagactagagaggatgggtttgtgaggtgactggagaaaaacagcttaagttcttatgacttgaaatttgactcaagttggaaattccttgtaattaastcatcttttctctccacccccttaaattgccatctcattctcctttgagttgctatagaacagttaaagattctcaagaaaagataccttcccctacctt

SEQ ID NO: 15484 - DNA, 201 bp, Homo sapiens
gttgcagtgagatgagatcatgccactgcactccagcctgggtgacagagcgagactctgtctcaaaaatttttttaaaaaataattaattggctgagcgmggtggctcacgcctgtaatcccagcactttgggaggctgtggcgggtggatcacgaggtcaggagatcgagaccatcctggctaacatggtgaaaccccg

SEQ ID NO: 15485 - DNA, 201 bp, Homo sapiens
tctactctcttcccaaatagaaatccacagtttgtcttacacattgctgtggatcggtattacaattctaccttgttttgtttgtttgtttgtttttgagrtggagttttgcttttgttgcccaggctggagtgcaatggggcggtctcagctcagtgcaacgtccacctcccgggttcaagtgattctcctgcctcagcc

SEQ ID NO: 15486 - DNA, 201 bp, Homo sapiens
ttttgaaaattttgtttcattacatacgtgaatgagtttttctagggtacatccttagtcatgaaatagtggggttacagggtatgtgtatgtgtgcatgygtgcatgtgtgtgtatcttcaactcataattaaatattgcccagtaaatccccaatgtgcttataccagtttacactcctgaaataacatatttttgctt

SEQ ID NO: 15487 - DNA, 201 bp, Homo sapiens
gcctgccactcacattttttgagtacatgaatttgagtactttatgttcatcatctcacttaatcatcactctaactctatggagtaagactgttctctcmcacccccattgtgcaggtaaggaaacaggtttggggaggttaaggaactcacacaagatcaggtggttagtaggtggtggagatgggattggaatgcagg

SEQ ID NO: 15488 - DNA, 201 bp, Homo sapiens
agggagttcagtgtatacaaggccttctcagagagcgtgggcttaggctgggtctggaggtagaatactgaagggccctggtcccagctactcctctgagyagctgtgaccttgggcaagacatatcccctctcttgagccttatctttgtcgtttttaaaatagttgtggtcaccctcacgagctccagccttgctccgc

SEQ ID NO: 15489 - DNA, 201 bp, Homo sapiens
gccttgggactccagtgtgagcctcgtccttgtttccagctggaaggaaggcaccctcttgcccaagacaggacactgtgctgcctggggccagcacctgytgaatcctcgagcccagagcttcttcctgacactcaggcctttcaaagcctgactctcagggccactgctgcacagggtgacaaccgggcatggcacgca

SEQ ID NO: 15490 - DNA, 201 bp, Homo sapiens
aggaagagccatttcctgtggggccacagcactgggcacagttaaaagtagcagggcccagatatgccttgggactccagtgtgagcctcgtccttgtttycagctggaaggaaggcaccctcttgcccaagacaggacactgtgctgcctggggccagcacctgctgaatcctcgagcccagagcttcttcctgacactc

SEQ ID NO: 15491 - DNA, 201 bp, Homo sapiens
ctgcgcactccttgttgtcggccccagacaccacagcagaacacaaggctgttccctgtgcccagaatctcccgtccccaccccagcttcatccatcctcmaccttctccagaaccttcccagatcagcccccatcctgatgaggtctctttccccataccctcagccctgggcctgcgcgtgagaagatgtcctggaagt

SEQ ID NO: 15492 - DNA, 201 bp, Homo sapiens
ttttaatagagacagactttcaccatgttggccaggctggtctcaaactcctgagttcaggtgatccatctgcctcagcctcccagaatgctggaattacmggcatgagccactgcacccagtgtacggcaaagctgaaagcattgtatagagaacacccttattgctgggcgcggtggctcacgcctgtaatctcagcac

SEQ ID NO: 15493 - DNA, 201 bp, Homo sapiens
ggcacaatcttggctcactgtaatctctgcctcccgggttcaaatgattctcctgcctcagcctcccaagtagctgggactacaggtgcatgccaccatgscaggctaacttttggttttttaatagagacagactttcaccatgttggccaggctggtctcaaactcctgagttcaggtgatccatctgcctcagcctcc

SEQ ID NO: 15494 - DNA, 201 bp, Homo sapiens
tggcctcagtaggaaagtatgaagcgctccaggcctgagctttagttggctgcccccactatcctcattgcgggtggcccagctcaccaaaacaattgcaytgcacttcaaagggctgggcagttggatgggccgctgctggtaggctacactctctgctcaaggtcaccctgttgcctgaagagcacagccccccagatt

SEQ ID NO: 15495 - DNA, 201 bp, Homo sapiens
ttaatgcagagaaataagatttcagtggcaacagatctttttgatagaatgtatatggaaaagaattgatccatttgaaaatcatttcaatgaaagtagawtggaaaaaattagaaataattcatctgtgttgtatggacaaatggatcaggggattaggtttgcttaacggagttcaactcgaaagattctcaaccaaaa

SEQ ID NO: 15496 - DNA, 201 bp, Homo sapiens
ttacaacagtatagtgaactcttgaactacgtgggagactctgacccccacacagtcaaaaatctgcatataacttttttttttttttttttgagacaggrtcttgctctgtcccccaggctggagtgcagtggcacaaacatggctcactgcagctttgacctcctgggctcaagccatcctcccacctcagcctctcaa

SEQ ID NO: 15497 - DNA, 201 bp, Homo sapiens
ccccaccttggcctcctaaagtgctgggattacaggcgtgagacaccgcacccagccacattcagccttttatctgtttcataagaaatgttgggtgactsatgcctgtaatcccagcactttgggaagctcaggcaggtagatcatctgaggtcaggcatttgagaccagtctagccaatgtggcgaaacctagtctctc

SEQ ID NO: 15498 - DNA, 201 bp, Homo sapiens
gagtttaactatgttgctcaggctagtcttgaactcctgagctcaagtgatttccccaccttggcctcctaaagtgctgggattacaggcgtgagacaccrcacccagccacattcagccttttatctgtttcataagaaatgttgggtgactgatgcctgtaatcccagcactttgggaagctcaggcaggtagatcatc

SEQ ID NO: 15499 - DNA, 201 bp, Homo sapiens
ggattggtagcgtttccaagactttttaagtgacatgctcagatgctaagaatctctgaggaaagaggttggggaaatggcgactgtgccatggagtcaastgtccactttgtctgtagttagccaggccctgaattttctgcctggtcccatagttcaaagcactgccaatgaagggaaaaaaagaggatttggagagga

SEQ ID NO: 15500 - DNA, 201 bp, Homo sapiens
aaataatcagcctggtgtgtttagatccagctgtgcaagaaaactggatggaattcccctcctttctttatagtcttctggggtttgttgttgttgttctkgttgttgtgtcctttttgtggagaacggggtctcactgtgttgcccgggcaggtctcaaactcctgagtccaagtgatcctcccaccgtggcctctcaaa

SEQ ID NO: 15501 - DNA, 201 bp, Homo sapiens
ttgcaaaaccttggtctttggggttgaaaaaaaccccatgtgagtgcagagggacttaggctggatcggaaaagcatcttccatctgtgagacgcaggttyacacctcacctccccatcgagctgtgaccctggatctgcacatttctaaactgagttagaaaataatcagcctggtgtgtttagatccagctgtgcaaga

SEQ ID NO: 15502 - DNA, 201 bp, Homo sapiens
tgtaggcctcttcctacaccagtggtgcttcctctccagaggtaatatttcccaacatgcctcgttcttaaaaccctatggccaactctccctaccctgayggaaaggactttagatttgaagcagagaaccctgaggctagtctcagctccacctcctcagttgtgtgacagtgtgctactcagaggccttcaccagggc

SEQ ID NO: 15503 - DNA, 201 bp, Homo sapiens
tgatacctacagcttagaaatgtgaaagaaaatcatcagtgttaccccttgatcttttattcataataaatcccatttatgaaaattagtttattcaagtsccattttattgacactaagcaccatgaggatgtgacggaaagattgaggctggaaactaagaactgaatgctaagggcaaagtcaaggggcacgcgctct

SEQ ID NO: 15504 - DNA, 201 bp, Homo sapiens
tttaatagacagatttattggtcagtgttttctagagaaacagatccgacagagtgagagagagagagagagagagagagagagtgagtgtgtgtgtgtgwgtgtgtgtagagatttattataagaaactggcttacatgattatggaagctgagaaatcccatgatctaccatctgcaagctggagacctgggaaaactc

SEQ ID NO: 15505 - DNA, 201 bp, Homo sapiens
aaagtttttgtttggtattttaatagacagatttattggtcagtgttttctagagaaacagatccgacagagtgagagagagagagagagagagagagagwgtgagtgtgtgtgtgtgtgtgtgtgtagagatttattataagaaactggcttacatgattatggaagctgagaaatcccatgatctaccatctgcaagct

SEQ ID NO: 15506 - DNA, 201 bp, Homo sapiens
ctgcttgacactttgttcaatgtttattaaaatttcaaacgtttggaaaagttggaagaagtttaacttatgcatctttgtttctgttcatttcattttawtgcagacatcagtgtacttccttgacacagatcattaactacagttagttaactgcagttccatatttgtttacaggttttttttctggttgaggtaaaa

SEQ ID NO: 15507 - DNA, 201 bp, Homo sapiens
taagcatgtcctggtaacgtttctgaactcttaggatgaagagaaaaatcttcaagctttcagaagccaaaggaacaaattattaaggaaaagagtcacastggcaccagatttcctatttacaacaccaagaagctagaagatggtggaatttcatctacagaccacggggataaaaggaatgcagctcaagcatcctgt

SEQ ID NO: 15508 - DNA, 201 bp, Homo sapiens
tagttggtaaaaattgagaatcctaatacccaacagaagaaagtggctaggcacagtattattagattatcatatggaatacaaacattgaaaatgacaartgcctagattgcagttgatacaaggaagcctatatttgtaaagagcagaatataaatatcctaactccttgacttccaatgccaaccatttacctccttg

SEQ ID NO: 15509 - DNA, 201 bp, Homo sapiens
atttttggtagagacagggtttcaccatgttgcccacgctggtcttgaatacctgagatcaagtgatctacctgccttggcctcctaaagtgctgggattmgaggcatgagccactgcacccggccaggaataaattgattgggtctattattggaattcagtctgtatgatttttcagatattcatatatgtatttttca

SEQ ID NO: 15510 - DNA, 201 bp, Homo sapiens
tgctttatagacagcccacaaatcccttgggagtggtaactgcctgttttacctagagagcagtttttattgttgcctttgtttttgtttcttgagggaargtggtccttggctccagttgttgctgattttatgaggaacaggcaggggaattcaagccactctaaggagtgttctctggcattgcccaaacgctagaag

SEQ ID NO: 15511 - DNA, 201 bp, Homo sapiens
tacatgctctgcggggaccttgcccgttcccctggggatcatctgctacccgacatggttctgtggccaacatcctcgtgctgtattctgattgacctgtstgaggatttcgctaggaaatatacccagaaatagggttgccggatcatagactagggaactttccggttcacttctgaggactcagaaaacatgattatg

SEQ ID NO: 15512 - DNA, 201 bp, Homo sapiens
aatcatgaaccagttaaccctggcctggccagggtctcagtttgcggggggcacaagcagtggagcagctgtgctgctgtggccaatccctttctcccacrgcagagtcgggagtggcactctgatccatatctactgctcctttttcacggattgtctacttgattggttttgcctattaaagccaaattcaaatatttg

SEQ ID NO: 15513 - DNA, 201 bp, Homo sapiens
tgaagtgacagttttcttttcttttttttttgaggcgagtctcactctcttgcccaggctggagtgcagtgacacgatctcggctcactgcaacctccgcstcacaggttcaagtgattctcctgcctcagcctcccgagtagctggaactacaggcgcgcatcaccacacctggctaatttttgtatttttagtagagac

SEQ ID NO: 15514 - DNA, 201 bp, Homo sapiens
gattttcttttttcttttcttttcttttcctttccttccttctttccttctttctttctttttttttttttttcttttttttttttttttgtggagaaagrgtctcactctgtcccccaggctggagtgcaatggcgcaattttggctcactgcaacctccacctcctccgttcaagcgattctcctgcctcagcctccca

SEQ ID NO: 15515 - DNA, 201 bp, Homo sapiens
cttgtaggcttggccccagatatcttggattttcttttttcttttcttttcttttcctttccttccttctttccttctttctttctttttttttttttttyttttttttttttttttgtggagaaagagtctcactctgtcccccaggctggagtgcaatggcgcaattttggctcactgcaacctccacctcctccgttc

SEQ ID NO: 15516 - DNA, 201 bp, Homo sapiens
ccttgtaggcttggccccagatatcttggattttcttttttcttttcttttcttttcctttccttccttctttccttctttctttcttttttttttttttycttttttttttttttttgtggagaaagagtctcactctgtcccccaggctggagtgcaatggcgcaattttggctcactgcaacctccacctcctccgtt

SEQ ID NO: 15517 - DNA, 201 bp, Homo sapiens
attggttctttccttctgccttggaaactgctatgtatttttcatttttatttttttgagagtctcactctgtcaccccagctggagcgcagtggcacaayctcagcttactgcaacttccgtctcccgggttcaagtgattctcttgcctcagcctcctgagtagagtagctgggattacaggtgtgcactaccacaccc

SEQ ID NO: 15518 - DNA, 201 bp, Homo sapiens
ctcctgatgcattcaggcctgtggcatcctctagttcagtttcttgggtagttggtattacagatttagagtcttgttttgatggacatttctccatacaragtaccgtaatgctgttgcattttctttcagatttgttcagaatctcctgggggtttctctcattcagaatcaggtactaccggggcatcttggaatacc

SEQ ID NO: 15519 - DNA, 201 bp, Homo sapiens
gccaggcactggctcatcttttcctgcctgattctctgggcagatttctccatagggtctgcagggaagtgggggaaagctgggtatggtcagagtggagrtcactatgtgggcttctcagtcctcatgctggtctgtgtcaggtgcctttaattcagggcctaaggaaccattgctttttagcctaagcagcaatttaat

SEQ ID NO: 15520 - DNA, 201 bp, Homo sapiens
actcctgacctcaagtgatctgcccgccttggcctcccaaagtgttgggattacaggcatgagccaccgcatccagcctgcatcttccccttttttttttkgggggggacggagtcttgctgtgtctcccaggctagagtgcagtggcatgatctcggctcactgcaatctctacctcccgggttcaagcgattctcctgc

SEQ ID NO: 15521 - DNA, 201 bp, Homo sapiens
aactcctgacctcaagtgatctgcccgccttggcctcccaaagtgttgggattacaggcatgagccaccgcatccagcctgcatcttcccctttttttttktgggggggacggagtcttgctgtgtctcccaggctagagtgcagtggcatgatctcggctcactgcaatctctacctcccgggttcaagcgattctcctg

SEQ ID NO: 15522 - DNA, 201 bp, Homo sapiens
agcagtcttcctgcttcagcctcccaagtagttaggactacaggtgcatgccaccatgcccagctaattcttaaattttttgtagcgatggattctggctrtgttgcccaggctggtcttgaactcctggctacaagcaggcctcccagagagtcgggattacaagcatgagcttgtgcctggctcaatttatttatttgt

SEQ ID NO: 15523 - DNA, 201 bp, Homo sapiens
aagagacatgggggatcctgggttgggtggagtactggttttccacgaaacctgttgcatatcaggagccagccattcttgctttgtactttttttttttytttttttttttttttgagacagagttttgttcttgttgcccaggctggagggtaatgatgcgatctctgctcactgcaacctccacttccctggttcaag

SEQ ID NO: 15524 - DNA, 201 bp, Homo sapiens
tttgcttgcttgttgttttctgtttttaagacttaattctctcaggagttcgagaccagcctggccaacatggtgaaaccccatctctactaaaaaaaaawatatatatatataaaattagctgggcatggtggcagacgcctataatcccagctactcgggagcctgaggcaggagaatcacttgaacctgggagacgga

SEQ ID NO: 15525 - DNA, 201 bp, Homo sapiens
tgagccaccgtgcccagtcctcactgtgattttaatttgtatttcgttagctagtgatgatcccttttcatgtgtttaacaattcacttatcttttttggygaaatgtcaattcaaatctttgcttgcttgttgttttctgtttttaagacttaattctctcaggagttcgagaccagcctggccaacatggtgaaacccc

SEQ ID NO: 15526 - DNA, 201 bp, Homo sapiens
ggattacaggcgtgagccaccgtgcccagtcctcactgtgattttaatttgtatttcgttagctagtgatgatcccttttcatgtgtttaacaattcactkatcttttttggtgaaatgtcaattcaaatctttgcttgcttgttgttttctgtttttaagacttaattctctcaggagttcgagaccagcctggccaaca

SEQ ID NO: 15527 - DNA, 201 bp, Homo sapiens
tacgcccgcctcagcctctcaaaggtctgggattacaggcgtgagccaccgtgcccagtcctcactgtgattttaatttgtatttcgttagctagtgatgwtcccttttcatgtgtttaacaattcacttatcttttttggtgaaatgtcaattcaaatctttgcttgcttgttgttttctgtttttaagacttaattctc

SEQ ID NO: 15528 - DNA, 201 bp, Homo sapiens
atacgcccgcctcagcctctcaaaggtctgggattacaggcgtgagccaccgtgcccagtcctcactgtgattttaatttgtatttcgttagctagtgatratcccttttcatgtgtttaacaattcacttatcttttttggtgaaatgtcaattcaaatctttgcttgcttgttgttttctgtttttaagacttaattct

SEQ ID NO: 15529 - DNA, 201 bp, Homo sapiens
aggatcacttgagccaaggtgttcaaggctgtagtgagctgtaagcatgctgctgcactccatctgggtgacagagcaagactccactggattaccatggmaggtttaagggtactattggcaatacatgtagagtctatttctggactttattctgtttttctttatacgtctgtccttaagccaataccatgttccttt

SEQ ID NO: 15530 - DNA, 201 bp, Homo sapiens
aattgccagcctgttttccaaaggaattgcacaattttatactcccaccaacagtatataagggttctgattctccacatcttttccaacacttattattwcctgtctatttgataatagcagtcatagtggttctgatgtggtatcattatagttttgatttgcaaaggatattgggcatcttttcttgtgaggtttttt

SEQ ID NO: 15531 - DNA, 201 bp, Homo sapiens
gagtgcggtggcgtgatttcggttcactgcaacctccgcctcccgggttcaagcaattcttcctcagcctcctaaatagctgggactagaggtgtgcaccrccacgcctagctaatgtttgtatttttagtagagatggggtttcaccacattaaccaggctcgtcttgaacgcctgacctcatgatccgcccacctcagc

SEQ ID NO: 15532 - DNA, 201 bp, Homo sapiens
tttcctccattttcccctacccaagacaaccactaatccactttctgcctatgtaaacttgcctattctggacattttatataaatgggataatatataaygcatagcttttagcatctggtttctttaagttaccataatgttttcaaggttcactcacattgtagcatgcagcactttattcctttttttttttttttt

SEQ ID NO: 15533 - DNA, 201 bp, Homo sapiens
gcatgtgcctgtagccccagctgaggctgaggctgagcttggagaatcgcttgaacctaggaggcggaggttgcagtgagccaagatcatgccactgcackctagcctgggtaacagagcgagactccatctcagaacaaacaaacaaaaaatttattgaggctgggtgtgggctgatcacttgaggtcaggagttcgaga

SEQ ID NO: 15534 - DNA, 201 bp, Homo sapiens
tgagccaccacgcccggctgaccttttcttaaaaaacaaaacaaaaaactattattggctggactcagtggctcacacttataatcccagcactttgggargctgaggcgggcagatcacttgaggtcaggagttcaagaccagcctggccaacatggtgaaaacccatctctacaaaaaaatacaaaaattagtcatgca

SEQ ID NO: 15535 - DNA, 201 bp, Homo sapiens
gaacttctgacctcaagtgatccacccaccttgggctcccaaagtgctgggattataggcgtgagcctctgtgcccggcccctgctacttcttttaagacraaaagttctcaagaattctcttttcttggttttctgatttttcttcttccatcctccttgaatccactccactcaggtgtttgccctcatcactcaattg

SEQ ID NO: 15536 - DNA, 201 bp, Homo sapiens
tttcctgtatatacatacctttgataaagttttatttataaattaggcacaataaaagctcgacagcagtaactaataatagaacaattataacaatataytgtgataaaagttatgtgaatgtgttctctctctctctctccctgtctcgaaagtacagtcatgcattgcttaatgacagggatactttctgagaaatgg

SEQ ID NO: 15537 - DNA, 201 bp, Homo sapiens
cattttgaaattaataatttttcctatggaatttagtccagagagttagccatatttttgagatgactagtttggtgtttaaaagaactgtaatgagcatmtggttttgaacttaaaagtactgtaagaagtttctctaaaatcacagaattttttgtgttgaaaaacatatgagatatgtagggaggaagaaagggagtg

SEQ ID NO: 15538 - DNA, 201 bp, Homo sapiens
ggatcacttgagcccaggagattgaggcagcagtgagcttgatcacgccactgcactccagcctaggcaacagagcttgaccctgtctcaaaaaataaaayataaaataaaaatgtgagaggacctggcttcctggaaaagcagaaatggctcctgctatagcctgccctgtgcctgcaggcaattctttgtcccatgtct

SEQ ID NO: 15539 - DNA, 201 bp, Homo sapiens
ttcatttcctgttgttgctgtagcaaatatccacaaatttgacaacacaaatgtattttcttgcatttttggagatgagaaatctgcattggtctcgctgrgctgaaatcaaggtgtctgcagtgctgtgctgcttctggaggctctaggggagaatccatttccttgtctttcccagctcctggaggccacgctttcctt

SEQ ID NO: 15540 - DNA, 201 bp, Homo sapiens
ctgtaaatattcttcactgctctcttatatttcctgtatccaccatctttgcccaggtgtttaactctgttcccttaaatggtttcccctcaggcttagtsttggatctttgtacattctcctggagtgggcttatctgggcttttgtttttttgagacagagtcttgctctattgcccaggctggagtacagtggcgcga

SEQ ID NO: 15541 - DNA, 201 bp, Homo sapiens
ttcactgcagttttaaaaaactattattataaaaactttcaaacattcagaaaaatttaaaaatagtattagagggccaggcatggtggctcatgcctgtratccaagcatttggggaggcttaggtgggagtatcacttgaggccaggaattcaagaccaacctggtgaaaaagagcgagaccttgtcttaaaaaaaaaa

SEQ ID NO: 15542 - DNA, 201 bp, Homo sapiens
aagcccttaaatcttttgcctaccatgttactttgctagggctgctgtactaccaactgggtagcttaaacaacagaaatgtattttctcacagttctagrggcatggcggccgagatcaaggtattagcagggttgtttcttctgaggcctctttccttggcttgcagatggtggtcttctccgcttctccgtgtcctga

SEQ ID NO: 15543 - DNA, 201 bp, Homo sapiens
atcttatttgagttgtaaaagaactctcatctgtgtttaaacgaacatttaaaatattcctaaaaaagaaaaacattctaaggttatttattttttttttwaagctgttgctgttacatgtgactgagcaactgtgtgggcaagagtaaaagtactggcatagaacctggaaacaagagtttagaatgaagttgaacccat

SEQ ID NO: 15544 - DNA, 201 bp, Homo sapiens
gggaccaattaaataataagccagcaaagagctcgacccccactgcagaggacatttcgtaagaggggattcataggagccccactttctctttcccagcyctctgttctgaagaatctgaatgtgtctaacttgtttcagagttcactgtttctttccatttttctttctgatgggatgattgcttctgccaatggctag

SEQ ID NO: 15545 - DNA, 201 bp, Homo sapiens
aagtttaacttatgcatctttgtttctgttcatttcattttaatgcagacatcagtgtacttccttgacacagatcattaactacagttagttaactgcarttccatatttgtttacaggttttttttctggttgaggtaaaatttgcagacaatgaaatctcaaatcttaagtgtatatttggtggattttgacaaacac

SEQ ID NO: 15546 - DNA, 201 bp, Homo sapiens
cattctcctgccttggcctcctaggtagctgggattacaggcatgcaccaccatacccggctaattttgtatttgtagtactggctaattttgtgtttgtrgtagagacgtggtttcaccatgttggccaggctggtcttgaactgctgacctcaggtgatccacccgcctcagcctcccaaagtgctgggaatacaggtg

SEQ ID NO: 15547 - DNA, 201 bp, Homo sapiens
gctggccaccccctagtggactctgcatagcccatggccagtgtgcccttgccatggtctcgaggatggaaaagccaggtcatcatgtgatttcccactcrcataatagacaccaacttactcatttttgttttttgtttagacagggtctcactctgttggccaggctggagtgtagtggcatgatcatggctcactgca

SEQ ID NO: 15548 - DNA, 201 bp, Homo sapiens
cactcacataatagacaccaacttactcatttttgttttttgtttagacagggtctcactctgttggccaggctggagtgtagtggcatgatcatggctcactgcagcctcaacctcctgggctcaagcgatcctcctgcctcaacctcccacgtagctgggattagaggcatgcaccaccatgcccagctaattaaaaaa

SEQ ID NO: 15549 - DNA, 201 bp, Homo sapiens
gtggagaacggggtctcactgtgttgcccgggcaggtctcaaactcctgagtccaagtgatcctcccaccgtggcctctcaaaatgctgggattacaggcrtgagccaccacaccaggcctggtcttctagctttgttaatgatggatttataaccacccagaggttagaaatacagccctttcccgaagctccaccaaag

SEQ ID NO: 15550 - DNA, 201 bp, Homo sapiens
aaaggctgtttccaggtgccttggtttgatgcctccctaccccattgtccaccagacccatctgagaaagggtctaaagaagataaaactcaagtcaggtrtcagtgaccttggttaaaccttaacgaggcacataaggcagggtgagccctagtgaaagctggcagtcagtcaaaggctgcaataaaaggcaaatgccac

SEQ ID NO: 15551 - DNA, 201 bp, Homo sapiens
ggaggcctgcaaggccctaacacaagtggggaaaccaggaacaggtggctacaggaaagaggactgtgggagggagctgtagtggcctcagtaggaaagtwtgaagcgctccaggcctgagctttagttggctgcccccactatcctcattgcgggtggcccagctcaccaaaacaattgcattgcacttcaaagggctgg

SEQ ID NO: 15552 - DNA, 201 bp, Homo sapiens
tgtgaggtagtatcccatagtattcatttgcatttctctaatgaattagtgatattgagcatcttttcatgtgtttattggccatttgtatatcttttttrgagaaatatctatttatatgtccatgtttgaatcaggttgcctcttttcttttcttttgatacggagttttgccctgttgcccaggctgaagtgcagtgg

SEQ ID NO: 15553 - DNA, 201 bp, Homo sapiens
gtaattaatccatacttcataaagagttgttctgaaattagtcacctctgtactgtactgtttttttttgttttttttttttttttttttgaggagtctcrctctgtcaccaggctggagtgcagtggcatgatctccactcactgcaacctctgcctcctgggctcaagcaattctcttgcttcagcctcccaagtagct

SEQ ID NO: 15554 - DNA, 201 bp, Homo sapiens
agctatgactgaaacattcatgccattgcagccagtgccctggaaagctataagcaagtcttaagacctgtgataagggctgacttgcaagctagctgccrtccatcttaatatctgacgagcccagtcatgttggctgtgtttaattgatccatttcctacttgcttcctcaacccagaggccaagggcagcacaaaagg

SEQ ID NO: 15555 - DNA, 201 bp, Homo sapiens
tcgttttgtaataggtcttgctacatggaagggcaaaactgtgttggctaactgaatctttctaagggacaaataagggaatccagatagaataaacacartgaagtacagagtaccaggaactgctctgtttaaagctggtattcttttttaatgataggacatctggcaaacccaccctaatgggcagtttcatttttt

SEQ ID NO: 15556 - DNA, 201 bp, Homo sapiens
ctatcatataggactcatatgaatcaaatgagtttgtagcatatccacatcactcacaacagtgcccagcaggtagtaagtgatcagtaatgtaagctgtyaatatttaatgtcactggataaagctttatgatttttttgaagatcttgaattccttttgttaggataccctatagttttggtccttactgttaatagta

SEQ ID NO: 15557 - DNA, 201 bp, Homo sapiens
atgggggttcgccatgttgcccaggctgggctcaggcgatcctcccaccttggcctcccaaagtgctgggattacaggtgtgagccaccgcgcccagccargtgttcttgatttaacaattccagagagaactatgttaaagtttttttttaatgactgaatttgtgaacttctcttcataattttgtcaaacgtgtctgc

SEQ ID NO: 15558 - DNA, 201 bp, Homo sapiens
ttacacattgctgtggatcggtattacaattctaccttgttttgtttgtttgtttgtttttgagatggagttttgcttttgttgcccaggctggagtgcartggggcggtctcagctcagtgcaacgtccacctcccgggttcaagtgattctcctgcctcagcctcgcaagtagctgggatcacaagtgtgtgccaccat

SEQ ID NO: 15559 - DNA, 201 bp, Homo sapiens
ttttttgccttcccttccttcttttatcatacttcatccttttgagttaaatttccttcttccagaggtaggctttaacactgttttttagtgagagtctrttggtgctaaactctttttgcttacctaaaagtgtttttatttgtcataaccattggataatttagctagttataaaagtctgggttggcatttactgtt

SEQ ID NO: 15560 - DNA, 201 bp, Homo sapiens
tgatctctgttgtgggtcctgcactgtgcctgccactcacattttttgagtacatgaatttgagtactttatgttcatcatctcacttaatcatcactctractctatggagtaagactgttctctcccacccccattgtgcaggtaaggaaacaggtttggggaggttaaggaactcacacaagatcaggtggttagtag

SEQ ID NO: 15561 - DNA, 201 bp, Homo sapiens; identical to SEQ ID NO: 1628

SEQ ID NO: 15562 - DNA, 201 bp, Homo sapiens
tttgaccactgcttcttcccatgccgcttccagatgaatctgaggcctccaggccagactcgatccctctatcccacagcactgggtgctgactccacacrtccccctggcttaccgctgggtctggcctccccatttctcccccaggggtaccccacttgctgccaaccatccacccctgacccccatctcacctgtccc

SEQ ID NO: 15563 - DNA, 201 bp, Homo sapiens
tgggaggccaaggtgggaggaatgcttgagcccaagagttggagaccaacctgggtaacatagtgagaccccatctctctctctctctctctctctctctstctctctgtctctctgtctatatatatgtatatatatatacacacatagatatgtatacgtatctatatacatagatttatatacataaatataaaattg

SEQ ID NO: 15564 - DNA, 201 bp, Homo sapiens
gcaggacagcagaatagaacagagaagcctgtgctcagtgaattgctgcagtagcatgaccagtgagactggagtttcaattaaaacaccgttgtagtgtraaaggatcatgagatggaaggaggccttgggttagagagccagaagccatttataggcagaacatcagctttctggattaaaggatggctgtggacctaa

SEQ ID NO: 15565 - DNA, 201 bp, Homo sapiens
ttcccgccatatatgttcatgcttttgctccctgtagctatccaaaacaccatttgttttctgtaaacttcatgtaaactgtatagacatggaaggagaargatattatgaggtgtgtgtgtgtatatatgctacctcaaaatggaggtagtatataaattcattttactacttattgctatagcacatttattttcacag

SEQ ID NO: 15566 - DNA, 201 bp, Homo sapiens
gttaactttctgtgaggagaaaaaactgttaggatatttattagaattaaattgagtttatcaataagccatttttgtaaatttgggcttatccatgaatstgatagaattgatttacagatataaaaataaaaattttaaacattttatttacatttaaaatttttggaaataatttcagacttacagaaaagttgcaga

SEQ ID NO: 15567 - DNA, 201 bp, Homo sapiens
gtttatattattttttatttctgtggatttctctgtacttgtaccacttataagaatccccacaattttgtgtgtatgttaaaagtggatataatctgtcycttgccattaaaaaaaattaagcattatgtttttgagatgtattcattacagatccaccccattcatttgaactgctttatagtgttcccttaatatgtg

SEQ ID NO: 15568 - DNA, 201 bp, Homo sapiens
ccaaagtgctggggtttacaggcgtgagccaccacgcccacccagaaattgctgtttatacatggtgggctgtgtgtggagaaaagtagggaccactgctkttgtaaaccttctcaacaaatatgaggcctgagagagaaccgcattccatcctttctggtcctctaaatacactgatacttgacctgccctttttccttt

SEQ ID NO: 15569 - DNA, 201 bp, Homo sapiens
ggactacaagcatgtgccacaatggacgctcctttgctttctgtgcgggagcgtttagatctgaggagcgctgtggctggtcccttgaggtgagctgttcycatccattatatgcagctttttctactttggctttcagtagctttgcttgcaaggagcactctaagaataacacaataaatgttagacccaaggattatt

SEQ ID NO: 15570 - DNA, 201 bp, Homo sapiens
gatatcttggattttcaaaaagaacagcataatgaattcagataaagcatgagaaatctcagatgcagtgggggtatcagagaaaactacccatcttcttrcttttgtttgtgacgaaatggctcagatctcgtaggaaccggtttttcagccatcaaaaagactcccatctatctcttgaagtttgttctcaggtcttat

SEQ ID NO: 15571 - DNA, 201 bp, Homo sapiens
gtcctagctgtctgtgacttgatttagcatagggggaaagggctgacctttttcctgccagcagtactgtcaaggcctgcccaggtggcagccgaagtagytcccttcatgcccactgcacaccacagcatggtggcaggggcgcctgcagtctgtgcacatgcacacatgatcgttctctgcaccccttatcggaactgc

SEQ ID NO: 15572 - DNA, 201 bp, Homo sapiens
attttgctctgtggaacacaaacttacagagttaaagcaaggctggcaacccatgtgaaaatgaggagaatctgagccttttcatttgctgccactggggwcatgatgtgaatcggcgccctctgacttagctccatggggcctctggattggaagtgagggaggagcctcctgagcaaatggactgaaattcctgcccta

SEQ ID NO: 15573 - DNA, 201 bp, Homo sapiens
acgttgtcccgcatggtgccgtagcggaccgcgttggtccccgacgccccggtggccgccatgccacagagagaggcgtccgcgcctgggtctggagggcrgcgtacagaaggcagcctcagggaccggaggtcctttccctcgggctgggggaggaaggtcccctgaaccccagacacagccctgctcccacggtgccct

SEQ ID NO: 15574 - DNA, 201 bp, Homo sapiens
cctccaggttgagcacgttgtcccgcatggtgccgtagcggaccgcgttggtccccgacgccccggtggccgccatgccacagagagaggcgtccgcgccygggtctggagggcggcgtacagaaggcagcctcagggaccggaggtcctttccctcgggctgggggaggaaggtcccctgaaccccagacacagccctgc

SEQ ID NO: 15575 - DNA, 201 bp, Homo sapiens
aaaccagggggccgccaggaggtgcttttcacagcccggtctctgcagggcagcccgccagcagtgcccagggccagagcccgggccccccgcagagggcrctcaccggaaatgccggcctcggcccgccgtgtgcagcagccgcccgtcgggcagcaccacctccaggttgagcacgttgtcccgcatggtgccgtagcg

SEQ ID NO: 15576 - DNA, 201 bp, Homo sapiens
ctagcctgccaaaccagggggccgccaggaggtgcttttcacagcccggtctctgcagggcagcccgccagcagtgcccagggccagagcccgggcccccsgcagagggcgctcaccggaaatgccggcctcggcccgccgtgtgcagcagccgcccgtcgggcagcaccacctccaggttgagcacgttgtcccgcatgg

SEQ ID NO: 15577 - DNA, 201 bp, Homo sapiens
agggcttcagagcctgaggaagcctagcctgccaaaccagggggccgccaggaggtgcttttcacagcccggtctctgcagggcagcccgccagcagtgcycagggccagagcccgggccccccgcagagggcgctcaccggaaatgccggcctcggcccgccgtgtgcagcagccgcccgtcgggcagcaccacctccag

SEQ ID NO: 15578 - DNA, 201 bp, Homo sapiens
tcccaggttgcagacctgagcagtcgggccatagccaggcactggccagagggtgtgagcactgggtggcagggtgaccagtcagctactgtggcagcagmtactgctgctgtcagcccattggctaggccaggggtggggcctgcttaaggtggcacgggctttaaggtggcccttgcagatcttgcagacattttcgtg

SEQ ID NO: 15579 - DNA, 201 bp, Homo sapiens
gtgaggcctggccttcccagggggcctcttccagggagcccaccctgactgcccccatcctcagctcaccaatgcgggctacgggcactgcagcctggagratgtgtacagtgctgtccacagcagcctggacactggggaacgcacacgtggcggccactgtggcctcaggggcagggtgcaggcgcagggtggtggctg

SEQ ID NO: 15580 - DNA, 201 bp, Homo sapiens
acacacatccgtggagtagccctggtcagagggaagcctatgagttacccctgcctgattgggtgtacggggtcaccgtggtcaaggctgaggatgggtcrgagggcactgggcttcagctcttggcctcacacaaggaaataatcctgctcttctctaggcctcagccctcacctccccccgacacaacacaggagacca

SEQ ID NO: 15581 - DNA, 201 bp, Homo sapiens
ggaaggagacatcctcagggggctccctttcctctgccctcagctcttcccctccctggctttgctcctacctgcccagctgttctgcaaaagccttgacsctgcccagttcctcggcgtcatcagggttgaccagcaggatgcagtggaagttgccgtcacccacatgcccgacaatgcttcctgggggcccagaggaca

SEQ ID NO: 15582 - DNA, 201 bp, Homo sapiens
ccgtggcatgaagaaaagttccagaaccggctccgtagtcagggaacttgtgggctaagtgctcagacccccttcacagcactttgcctggattcatgagrccttgggggtctagcacggccttgagctgccgcatggtctccacgcccacggcgcccacctcctcctgcagcagctgccgcttgcccattccgatgccat

SEQ ID NO: 15583 - DNA, 201 bp, Homo sapiens
gggaggaagtgctgcctgctgacttccaggtagctgtaggtgggtttcaggtttattacagatttattgggggaggccccaaggagaagacctatcatcatgtcacgggagctcacgttccataccaggaaaggagtgttcctgtcaccaggtgaagggggaagggtcctgggaccccggcagtgggaggcctcggggagg

SEQ ID NO: 15584 - DNA, 201 bp, Homo sapiens
ggggaggaagtgctgcctgctgacttccaggtagctgtaggtgggtttcaggtttattacagatttattgggggaggccccaaggagaagacctatcatcatgtcacgggagctcacgttccataccaggaaaggagtgttcctgtcaccaggtgaagggggaagggtcctgggaccccggcagtgggaggcctcggggag

SEQ ID NO: 15585 - DNA, 201 bp, Homo sapiens
aggggaggaagtgctgcctgctgacttccaggtagctgtaggtgggtttcaggtttattacagatttattgggggaggccccaaggagaagacctatcatcatgtcacgggagctcacgttccataccaggaaaggagtgttcctgtcaccaggtgaagggggaagggtcctgggaccccggcagtgggaggcctcgggga

SEQ ID NO: 15586 - DNA, 201 bp, Homo sapiens
tggggggcggggcgcggcggggcgggggatgtgtttcttcccattttacagatgagaaatggaggccaagttaaggacagagcctggcctggaacccaggycctttccttcagggccttcttccacaggtgtgttttattccaggggcatccatttgactcccccagccccactcatggtagcagtggggactcagctgat

SEQ ID NO: 15587 - DNA, 201 bp, Homo sapiens
catggtgccgtagcggaccgcgttggtccccgacgccccggtggccgccatgccacagagagaggcgtccgcgcctgggtctggagggcggcgtacagaargcagcctcagggaccggaggtcctttccctcgggctgggggaggaaggtcccctgaaccccagacacagccctgctcccacggtgccctcagggtcccag

SEQ ID NO: 15588 - DNA, 201 bp, Homo sapiens
aggggcagggtgcaggcgcagggtggtggctgtgatgaggcccagcgtcccctcggagcccacgaagagccccgtgaggttgtagccggctgcactcttcytacgtcccagggacacacaaggtgagtaccaggctgtgtgatgagggatttctggccagaagccgaagctggaacccaagacaccgaccccaggcactga

SEQ ID NO: 15589 - DNA, 201 bp, Homo sapiens
cctgggggcccagaggacagaactattctccagcccagtcctcctcttgcctcctgctgccccaggctctgatcagccctgacacctccccacctctcccsagcagcagggtgggcagaacctgtgagtcctgaggcattcagatcctccttggtctgcaccacgatctccggcagccgggagatgggcacacacacatcc

SEQ ID NO: 15590 - DNA, 201 bp, Homo sapiens
agtagcccctccaggggaacagctcccaggttgcagacctgagcagtcgggccatagccaggcactggccagagggtgtgagcactgggtggcagggtgamcagtcagctactgtggcagcagctactgctgctgtcagcccattggctaggccaggggtggggcctgcttaaggtggcacgggctttaaggtggcccttg

SEQ ID NO: 15591 - DNA, 201 bp, Homo sapiens
cggccttcagagcctctacgaagtccctgcagagctctccctgcagggaagaaacacactgccagggtcccccgaaagacacatggggccacagccctgcyccagtgtcggggggagggctgggggctggaggctggagtgagcctcccctgcgcccgccccgctgacaacatccttgccaggtgggcccactttaaacaa

SEQ ID NO: 15592 - DNA, 201 bp, Homo sapiens
agaatctgattcaaataatttccccctaaataagaaattgtaagatataatttttgagcctataagggacacatgtatcagttcccaattctatatgtctyggtgggcattgaacaaaaattgtttgctaagcctttgtttccagcaaggtccacatcatttcttttcacagtttgatggagcaataatagtcacgattct

SEQ ID NO: 15593 - DNA, 201 bp, Homo sapiens
gcacagtcccacatagcacacagtcaagctggatggttcttcgaggtaacactaagtcagctgtatatgcagtggatagaggatgctgctgcggcatgggcctcccagggcatgaatagaaaatgtctcactggagggtccctggaagtaagggagatgggctttagatctgatcccccataaattcactgtctgaaggtc

SEQ ID NO: 15594 - DNA, 201 bp, Homo sapiens
ccacaacaatcttggaaaatacattattatccctgtcaaatacatgaagaaaccgaggggagtctcctctgcaggtgaagttcacacagcctgtaagtggyagtgaagccaggtctgctcagttctcaagcccatactcaactctttctcctgacccagtttccagaattggaaataagaattctactgcttagctttcct

SEQ ID NO: 15595 - DNA, 201 bp, Homo sapiens
ggaagacattcccaaactagtgtgtacattgtctttatcaggtgtctttcctcctgagcagggcctggcaatgtagtattttagttttataattgtaccagggatcaaatctgaattaggccagtaaaatctcaagggctataaaagcacttggctgcccactcagcagatagagattttccctgagctaagtatgaagaa

SEQ ID NO: 15596 - DNA, 201 bp, Homo sapiens
ctccgcagaagaagccccatgactctttgcatgtccccagagtgcctcaccaagctctgtgctatacattcagtaacttcttaggaatgaatgaatgaatkaatggcattcagtgtatacagagagtcataagattactgtagtgtaactgtaacaatatccatctttattaggagaaatcattatgagaatattatgtcg

SEQ ID NO: 15597 - DNA, 201 bp, Homo sapiens
tagtaggtgttccctgactcagaggagatgactgagtctgtggagtcagaggaccagcttcggcggcagtggtcctcaggggtagcagaatggcggttgcsgtggctgtactggtggggctctttctggaccatcagatgcctgccatcagctgggatgctccagcgctgctgctgtggctgcatgcccacagtgccctgg

SEQ ID NO: 15598 - DNA, 201 bp, Homo sapiens
ttaagaaatatgttcataaatatgctttatcaaatgttaaaatggttattttgcaaaataataataaatagagcagagctgtgacatacaagggtcaaccmaagtactggaagtttttatgctatatgttttataaaaattcagacttctgattatacattaaaaattgacattttgcactacagggtatcaataattctg

SEQ ID NO: 15599 - DNA, 201 bp, Homo sapiens
ttcaggagctttgggctcagagacattgctcctcttcggacaagtgcaagaatgaatcttgagactctccctgttttggctgtagttttcttccttttttwaaaaaaaatgctgttccctaggaataagtgggcttgtttttccatcttgagtataatagaaatgcagcctccagctctacttggtaatggaaactttcct

SEQ ID NO: 15600 - DNA, 201 bp, Homo sapiens
cgtgtgcctgctcacaatatgcagaaggaatgagatcacagtgggactatttggattaccaggggtagaacctcacaacctcaacctgtaaattagacaaygcaagggagactgtcagagcctgagcagcacagaacggggatggcctgactgctgcttcccaccacagggttcttagctcttctctaaaacccctccctg

SEQ ID NO: 15601 - DNA, 201 bp, Homo sapiens
tcctccacttcagcctcccaagtagctgggactacagacctgcactaccacgtccactagtttttttatttttatttttattttttggtagagacagtggyctcactaggttgcccaggctggtctcgaactcctggggtcaagtgatcctccggcctcggcttccgaaagtgctgagatcacaggcctgagccaccattc

SEQ ID NO: 15602 - DNA, 201 bp, Homo sapiens
ttcagcctcccaagtagctgggactacagacctgcactaccacgtccactagtttttttatttttatttttattttttggtagagacagtggtctcactakgttgcccaggctggtctcgaactcctggggtcaagtgatcctccggcctcggcttccgaaagtgctgagatcacaggcctgagccaccattctcagatcc

SEQ ID NO: 15603 - DNA, 201 bp, Homo sapiens
ccactagtttttttatttttatttttattttttggtagagacagtggtctcactaggttgcccaggctggtctcgaactcctggggtcaagtgatcctcckgcctcggcttccgaaagtgctgagatcacaggcctgagccaccattctcagatccccttcttgaagcaaatcagaaggctgaagactcccctaaatgata

SEQ ID NO: 15604 - DNA, 201 bp, Homo sapiens
tgaactaaggaacctgctgatgagaagcgacatcctttgcacttgaagctctgacccctaccagaaaatcccagtgctgagcgcacgttccaggggttctyttctcaacttcgaaagttctgcgggctgggaaactcccactctctcccttctccgtctcgggccgtcccccttacttggctcggccggatcggcgtcggg

SEQ ID NO: 15605 - DNA, 201 bp, Homo sapiens
gcacaatgccctcaaacagctccttcacgttgtgctggacagctgcagaggtctcgatgaacttgcagtcaaacaccactgcacaggctctcccttctggsaaggaaagaaagaggtcagagggactgcagagcacagtcccacatagcacacagtcaagctggatggttcttcgaggtaacactaagtcagctgtatatg

SEQ ID NO: 15606 - DNA, 201 bp, Homo sapiens; identical to SEQ ID NO: 15597

SEQ ID NO: 15607 - DNA, 201 bp, Homo sapiens
gatattggagtcaggcgaatatgcaacacttctccataagagggtcaggtagaaaattgtgctagaacataaacttactaaatatgcaattaattatgtargtatacagatattttcaaaggcaaattactattttttgtcaccttcaacaacattctacatataattcctccagtccttatccagcagaacgtctctctc

SEQ ID NO: 15608 - DNA, 201 bp, Homo sapiens
aacagtctcattcttcagcagtatgcttttaatcaagaaaatgagcccacctcatctggaacacctactatataggacaaggtcacccttgcaccaaacarcttgttgaaaggaaagccctaaaggaatttagagagctacaggctctgcataccttattttcccacatatccaggagtataatcgttgcactttccccat

SEQ ID NO: 15609 - DNA, 201 bp, Homo sapiens
ctgggatgctccagcgctgctgctgtggctgcatgcccacagtgccctggcgcatggtgacattattcagagtcatcgttgagtcctggggagcaaagcasccaagatggcagcattagtaagcatgagtgagagctccgctcaaatacatggtcagtcatcagtaatattttattagatgagatgagaagcaagtatccc

SEQ ID NO: 15610 - DNA, 201 bp, Homo sapiens
agcagaatggcggttgcggtggctgtactggtggggctctttctggaccatcagatgcctgccatcagctgggatgctccagcgctgctgctgtggctgcrtgcccacagtgccctggcgcatggtgacattattcagagtcatcgttgagtcctggggagcaaagcagccaagatggcagcattagtaagcatgagtgag

SEQ ID NO: 15611 - DNA, 201 bp, Homo sapiens
gactcagaggagatgactgagtctgtggagtcagaggaccagcttcggcggcagtggtcctcaggggtagcagaatggcggttgcggtggctgtactggtrgggctctttctggaccatcagatgcctgccatcagctgggatgctccagcgctgctgctgtggctgcatgcccacagtgccctggcgcatggtgacatta

SEQ ID NO: 15612 - DNA, 201 bp, Homo sapiens
ctgaagactcccctaaatgatattcaacaacttctctacaactttccctttgcagactgcctcccctagccgggaggtctgtttttccggctactggtgayaaagtataagtacttacgttgcaatcagcaagatgcacaaacactcctctcccaccctcacccccacactccgtaccccaacatctcgccactaaccagg

SEQ ID NO: 15613 - DNA, 201 bp, Homo sapiens
actcatgagtacaagaactttgtgaagaccaaaataaacagcagcaaatataaggcacctaacaaagtgcctctcccgttgcaaacattcactctaaatgytagccccttcctcccgtttctctttcctagcaagtcacctggcagcctttacaaagaaagagggaatcaattgtacaacactggccctatttctcccttt

SEQ ID NO: 15614 - DNA, 201 bp, Homo sapiens
cacctgcctcggcctcccaaagtgttgggattacaggcatgagccaccatgccgggccaaccatgaagctcttaaatccacagtcagaggtaatcttttcrcctcggaattcccacagcactctccttacaccactttcaagacatttaccacatcctatctcaatttctacttggtgtatacattatgctccattgcata

SEQ ID NO: 15615 - DNA, 201 bp, Homo sapiens
tttgatctccctgagacttagtttactcatgagtacaagaactttgtgaagaccaaaataaacagcagcaaatataaggcacctaacaaagtgcctctccygttgcaaacattcactctaaatgttagccccttcctcccgtttctctttcctagcaagtcacctggcagcctttacaaagaaagagggaatcaattgtac

SEQ ID NO: 15616 - DNA, 201 bp, Homo sapiens
cagagctggcacaaaggcagctggaaagaaccagcagactccaaagatggcttgaaaagcaacaagttaatgttgctggggaccagctggtcaggttagcygctcttgtctaaacttggctcttaattgcaccagtgtccagcaggttttgtgcctcagtgggaaacacgtggcaatgacatcaccctcccctcccctgcc

SEQ ID NO: 15617 - DNA, 201 bp, Homo sapiens
ggacaggcacttattggaacttccatgtttagtaaagttgccttgatgctctccagctgcctggagagcatccacctgccattattgggggtaggggggamattttctgtttaaagtttatgcctcagctgtgccctcttacccacagataccacttttaaaacatcccggctccaaacctagacaccctggcagagaaat

SEQ ID NO: 15618 - DNA, 201 bp, Homo sapiens
cactctattttcacaatgaggtttcctgttttgaatttcatcttttgaaaattatgactttcataatgatttatcatttttcttctgttctttttgtctaraatcttttccctcaaatacccacaaggcctgtttccttacctccctctgggggaggtgcttcctggccatccatttaaaattgcaacacttctatcccac

SEQ ID NO: 15619 - DNA, 201 bp, Homo sapiens
atgcaagggagactgtcagagcctgagcagcacagaacggggatggcctgactgctgcttcccaccacagggttcttagctcttctctaaaacccctcccygcactcagacaactccttcaatgatggaggaactttctcagcccaccactcaggtacaggggactcgcttgagtgcccagtcattcaaatagaaacatac

SEQ ID NO: 15620 - DNA, 201 bp, Homo sapiens
ttggctgtagttttcttcctttttttaaaaaaaatgctgttccctaggaataagtgggcttgtttttccatcttgagtataatagaaatgcagcctccagytctacttggtaatggaaactttcctccctgcacttgagcccagatcttgtgtaggtgaagggtgaacacagtacagtacaatgggccaaagcagttccag

SEQ ID NO: 15621 - DNA, 201 bp, Homo sapiens
aaaaaatgattactgtagacagttgtgtcctagtaggaagacattcccaaactagtgtgtacattgtctttatcaggtgtctttcctcctgagcagggccyggcaatgtagtattttagttttataattgtaccagggatcaaatctgaattaggccagtaaaatctcaagggctataaaagcacttggctgcccactcag

SEQ ID NO: 15622 - DNA, 201 bp, Homo sapiens
aaaaaaaatgattactgtagacagttgtgtcctagtaggaagacattcccaaactagtgtgtacattgtctttatcaggtgtctttcctcctgagcagggsctggcaatgtagtattttagttttataattgtaccagggatcaaatctgaattaggccagtaaaatctcaagggctataaaagcacttggctgcccactc

SEQ ID NO: 15623 - DNA, 201 bp, Homo sapiens
cagagcacagtcccacatagcacacagtcaagctggatggttcttcgaggtaacactaagtcagctgtatatgcagtggatagaggatgctgctgcggcaygggcctcccagggcatgaatagaaaatgtctcactggagggtccctggaagtaagggagatgggctttagatctgatcccccataaattcactgtctgaa

SEQ ID NO: 15624 - DNA, 201 bp, Homo sapiens
tttatgactcattggcctcaaagtcacatatcagaacactgggaaaaatttttaatgatgaaaagttcttgttctaggcattctttgtaagctttacttcyctactatccaaaatagaagaaacacatgtgaacaccaaacacatcctctaaagagtcttgggtgttcaaatagcaaggtcaggcttttcctggaaataaa

SEQ ID NO: 15625 - DNA, 201 bp, Homo sapiens
cctttcagtgggtagttactgaatactcactagcaatttcaggagctttgggctcagagacattgctcctcttcggacaagtgcaagaatgaatcttgagmctctccctgttttggctgtagttttcttcctttttttaaaaaaaatgctgttccctaggaataagtgggcttgtttttccatcttgagtataatagaaat

SEQ ID NO: 15626 - DNA, 201 bp, Homo sapiens
actttctctagaccagtttgtctttcctcatttgatccccctgacagactctctccctgaccaaactttagtcaggctcctctgaatcctcttctctaccyggcctctccctgggcttccgtttccatcctggcagaattcagctttagcaagaatcctgctaagtcagtttagtgagaatcccccaccttcaatatctga

SEQ ID NO: 15627 - DNA, 201 bp, Homo sapiens
cacagataccacttttaaaacatcccggctccaaacctagacaccctggcagagaaatgacctgctcatgttcagacctatgaaatttgcagagaaagtgyctcattcttaaaaaaccacatccattctcaagagttctttaattcaactcagattccttttttgagtcagggtcttgctctgtcacccaggctggagtgc

SEQ ID NO: 15628 - DNA, 201 bp, Homo sapiens
gtggcacgatcatagctcactgtagctagcctccaactgccaggctcaagagatcctccacttcagcctcccaagtagctgggactacagacctgcactaycacgtccactagtttttttatttttatttttattttttggtagagacagtggtctcactaggttgcccaggctggtctcgaactcctggggtcaagtgat

SEQ ID NO: 15629 - DNA, 201 bp, Homo sapiens
ccatctttattaggagaaatcattatgagaatattatgtcgattttttttcttacagtgaatgctgatttaaaaaaaaaaaaatgtaggggtgtgccttaraaaaccttcctcttgggaaacaaaaccaactagtgattccagcaggtcctacagattctctgtgtaagaagctagggaaaggattccctttctctcatga

SEQ ID NO: 15630 - DNA, 201 bp, Homo sapiens
ggggtctacgcaacttaggctctctgagcctcagttttcttcatctgtgcaatgggattgataatagtactcacaccttagggctatgtgacaattacctrtattaagcctgggcacaaagtagaaactcagtcagtgttagccattatcacttcttcaggtgaaggaagctggttcttgccatactcagcacttcctcac

SEQ ID NO: 15631 - DNA, 201 bp, Homo sapiens
tgttaaaatggttattttgcaaaataataataaatagagcagagctgtgacatacaagggtcaaccaaagtactggaagtttttatgctatatgttttatraaaattcagacttctgattatacattaaaaattgacattttgcactacagggtatcaataattctgattttaaaaatatttttatgatggctccatgaat

SEQ ID NO: 15632 - DNA, 201 bp, Homo sapiens
gttcataaatatgctttatcaaatgttaaaatggttattttgcaaaataataataaatagagcagagctgtgacatacaagggtcaaccaaagtactggargtttttatgctatatgttttataaaaattcagacttctgattatacattaaaaattgacattttgcactacagggtatcaataattctgattttaaaaat

SEQ ID NO: 15633 - DNA, 100 bp, Homo sapiens
cagcagcgctggagcatcccagctgatggcaggcatctgatggtccagawagagccccaccagtacagccaccgcaaccgccattctgctacccctgagg

SEQ ID NO: 15634 - DNA, 201 bp, Homo sapiens
tagagaaaaagtggactaaggatcacagccatgaaagtaaaaacatgctttcccgttctagaagcttcctgacaggatcattctgtctgatcttacctttrcctgaaaattacggtgttggaggcctgggaggctaaaacaatccatctcctccctgctcagcacgtgtgctccccactttaccccccaccccagtacatg

SEQ ID NO: 15635 - DNA, 201 bp, Homo sapiens
aatatgctttatcaaatgttaaaatggttattttgcaaaataataataaatagagcagagctgtgacatacaagggtcaaccaaagtactggaagtttttrtgctatatgttttataaaaattcagacttctgattatacattaaaaattgacattttgcactacagggtatcaataattctgattttaaaaatattttta

SEQ ID NO: 15636 - DNA, 201 bp, Homo sapiens
caatttctatttaatctaccaaaaatgagccttttctgacttcccaaaaactcccttttgccttttccaagtgatgagattaagaacacttttgtgggacwaggagggttttcaattaacagaagtctagcacataggttctgaagctttttaaaatctttaaaaagccaatgttgaagactggtattgagaatctcaact

SEQ ID NO: 15637 - DNA, 201 bp, Homo sapiens
catggccctgtctttctgtgagtttccccacctcccacagcgtcattcttctaatcagtaagtgtttgcccttggggaattaaaactctgtctcgcccatygtgtgcctgctcacaatatgcagaaggaatgagatcacagtgggactatttggattaccaggggtagaacctcacaacctcaacctgtaaattagacaac

SEQ ID NO: 15638 - DNA, 201 bp, Homo sapiens
cctctgaacatctcccatctcccatttctgtcaggcatgaatttgtatccttgcagctcttagtacatacatgacacccacatacttacacacacacacayacacacgttcttatagaaatggatttaataggggctgggtgtggtggctcatgcctgtaatcccagcactttgggaggccgaggtgggcggatcacttga

SEQ ID NO: 15639 - DNA, 201 bp, Homo sapiens; identical to SEQ ID NO: 1675

SEQ ID NO: 15640 - DNA, 201 bp, Homo sapiens
aagatctatgtggctgccatgtgacaccaggacggaagcagggaggccggttaaggggctgctgctgtcatcaagcaagagaccaggttgaactgggccayggtggcagcagcagaggcagtgaggagagcttagattctggcttaattctgaaggatttgctgaaggactggacgcacaggcttcttgcccattgggaag

SEQ ID NO: 15641 - DNA, 201 bp, Homo sapiens
ttctggggtagaacattccaggcagagggaactgccaggcagaggccctgcaggggaaagtgtgcccagggtgaagagcaaggagggccctgtggctgaarcagagttgggaggtgggcgacaggtgaggtcggggagggcagttctgcaggaccctgtgtccagcgttctaggacttcagctttgtctctgaatgagaca

SEQ ID NO: 15642 - DNA, 201 bp, Homo sapiens
ctgctgccgaggcccagtctgaagcgcccatgtcttccctgcagtgggatctggtgtgtgaggcccgcactctccgagacctggcgcagtccgtctacatkgccggggtgctggtgggggctgccgtgtttggcagcttggcagacaggtgagcccgtggggataagggccccagccacccagtgcgggccagaaagccta

SEQ ID NO: 15643 - DNA, 201 bp, Homo sapiens
tgggaaggggaggtggtggaaatcctggttctcctctgggttctgagtgggctctgcctcttccccccacctcgccctatcccctcctgaggctccacccytctccactacaccctgggcctccctctcctcccctcctcctcagctgcaccctactcccctgtctaggcacgcagatcctgtgcacagcccaggcagcgc

SEQ ID NO: 15644 - DNA, 201 bp, Homo sapiens
cgcccctggttaccacacttggggaatacagcaccatcctgccacccgtgagctttggggccaccgcaatcctggctgggctggccgtctgcttcctgacygagacccgcaacatgcccctggtggagaccatcgcagccatggagaggaggtgaggggcctccagcaccaagaggccgaaagttacaggaaataactggg

SEQ ID NO: 15645 - DNA, 201 bp, Homo sapiens
gggctcaccgaggcaggacccctggtccctcctgccctgtcctctgacactcagggcgtggccctcttgggcccctaggggtgcaggttgctgcactgacycatccccatccacacacctcccacaggcagatggggatgggctttgcctctgtccacgcccgcctcgggggcctgacggcgcccctggttaccacacttg

SEQ ID NO: 15646 - DNA, 201 bp, Homo sapiens
taagcacttagtgcccagtggcaattagtggcaggtggaggtcttgagccttggccctcagagcttctactgtgtggccagggaggttagacaggtgcacytaagcagctggagagcacaggggctggctcggtgtggccagcagtgtgtgcggccccccgaagtctgagcaggcagcatgtccaagggttgagaagttag

SEQ ID NO: 15647 - DNA, 201 bp, Homo sapiens
actgtactccagcctgggagacagagtgagactcaaagaaaagaaaaaagaaaaagaaagcgactgttgattactagagtttgtattaagcacttagtgcscagtggcaattagtggcaggtggaggtcttgagccttggccctcagagcttctactgtgtggccagggaggttagacaggtgcacctaagcagctggaga

SEQ ID NO: 15648 - DNA, 201 bp, Homo sapiens
ggatggcaggcgttcatggaggctgcaagctctcaagtcctcacgaatggctactgggacgctctggtaaaatcccttgcattagtgtggggccctggaaygtcccaagagcttttgccttcatcaactccttcgcatccctcaacacttcataagtactctaagtgcttataaagttataagaatataactggggcatat

SEQ ID NO: 15649 - DNA, 201 bp, Homo sapiens
tatatacattatatatatatacacacacacatataaacatgtatatatttttttctggataaaatttattttctggatattggttttcttaaatatattcygttagcttaccttcataaaattttggaataaatgtgtatttattcttctataaatgtataattatagaaaagttgcaaagatagtacagagagttcctgt

SEQ ID NO: 15650 - DNA, 201 bp, Homo sapiens
aaaaaatgccacgggtctgttgaaatcctaagtcctctgtagttttgtttttttttttttggttttttttttgttttgagatggagtttccctctgttacycaggctggagtgcagtggcgcgatctcggctctgcaacctccacctcccaggttcaagcgattctcctgtctcagcctcctcctgagtagctgtgattac

SEQ ID NO: 15651 - DNA, 201 bp, Homo sapiens
atgagtgagtgggtgagtgagtgggagagtgagtgggtggatgagtgagtgggcgagtgagtgggtgggtgagtgagtgggtgggtgggtgagtgggcggrtgagtgagtgggcgagtgagtgagtggatgagtgagtgggtgggtgatgagtgggtgatcgagcgagtgagcgagtgagtggatgagtgagtgggtgggt

SEQ ID NO: 15652 - DNA, 201 bp, Homo sapiens
cctgacggcgcccctggttaccacacttggggaatacagcaccatcctgccacccgtgagctttggggccaccgcaatcctggctgggctggccgtctgcktcctgaccgagacccgcaacatgcccctggtggagaccatcgcagccatggagaggaggtgaggggcctccagcaccaagaggccgaaagttacaggaaa

SEQ ID NO: 15653 - DNA, 201 bp, Homo sapiens
tgtgagtgttttataaaatctccccacctgattccaatgtgcagccagggctgccacccagccagagaaggcaccatcatttccttgactgctgtcctaaygttggatgtttgaataggggttttgctacttataaacaacagcgggagaagcatattgaaaatgaggacaatgggccgggcgcggtggctcatgcctgta

SEQ ID NO: 15654 - DNA, 201 bp, Homo sapiens
actcccagggcccaggtgctccatgccagcgccctgggaatctcaaggagtggaactcaaccctcagtattttacaaactgtccagtgagtccagcaagaygccagggttgaatagcagcgacatagagcatgggccaaaccatgtgcccattgtgactgcagccttggccgtgggcaggttgtccaacttctctgtgcct

SEQ ID NO: 15655 - DNA, 201 bp, Homo sapiens
aggttctccaactctgtggcttactatggcctggccatggacctgcagaagtttgggctcagcctatacctggtgcaggccctgtttggaatcatcaacaycccggccatgctggtggccaccgccaccatgatttacgtgggccgccgtgccacggtggcctccttcctcatcctggccgggctcatggtgatcgccaac

SEQ ID NO: 15656 - DNA, 201 bp, Homo sapiens
actccagcctcagtgacagagagactctgtctcaaaaaaaaagaaagaaagaaagaaagaaaatgaaggcaatggcaaacatttaatgggcactttgcacmcctggcattgtgtccagcttacgccaaccccatgaagcaggtgctgctattttccttattttacagatgaggacagggaggtgcagagtgggtaagaaac

SEQ ID NO: 15657 - DNA, 201 bp, Homo sapiens
taaatggaaggaattagaacataaatcatttcaaagactagagggttcttttttaaggcgataggccaggcatggtggctcatacctgtaatcccagcacrttgagaggttgaggcggaaggattgcttgagccccggagttcaagaccagcctgggcaacatagcaagacccccatttctacccccccatcaaaaaaggc

SEQ ID NO: 15658 - DNA, 201 bp, Homo sapiens
ttgcagtgagctgagattgcgccactgcactccagcctgggcaaaaagagtgagactccttctcaaaaatatatatatacattttttatatatatatatayacacacacacacacattatatatatacattatatatatacattatatatatacattatatatatatacacacacacatataaacatgtatatattttttt

SEQ ID NO: 15659 - DNA, 201 bp, Homo sapiens
gagaagcatgcatactcattgttaaaaacattttttccccaaacaatccagaaacaggcagtgtagttcattggttaagaagcaggactcgaacgtactcytttggtttgaatctcagctctgccacttactggctttgtgatccttgacaagttacttaaccgctctgtgcctcagtttctccatttgtaacatgggcat

SEQ ID NO: 15660 - DNA, 201 bp, Homo sapiens
ctcctgagtagctgggactacaggtatgtgccaccatgcccagctagtttttgtatttttagtagagacgggttttctctatgtgggccaggctggtctcraactcctgacctgaagggatctgtctgcctcagcctcccaaaatgctgggattacaggcatgagccaccgcacgtggcccacatatactttttattgaag

SEQ ID NO: 15661 - DNA, 201 bp, Homo sapiens
acactccagaacccatgcactggatccaggagtgggtggtagaaagggatgtggagggaggggtctgagctctaatactaaagacagagacttaggagacygtgaaggggtgtttatggaaagtcagggaattttacctccccgaggagaggaatcctgtgtcatccacctttgtgtcccctcccctgggctcacaacagt

SEQ ID NO: 15662 - DNA, 201 bp, Homo sapiens
ggctcatgtgtaaccatgtagtttatactttgggttataattcaacaacgtttttcctttatttagtagatactacattctttaccttatttcccaaattsctccagctttggccattgggagctcttccacattggctcctgtgtcctttgaccttcctccatcttcttctctttttattttttagcactgccttaattt

SEQ ID NO: 15663 - DNA, 201 bp, Homo sapiens
cttctcacttccagaagtgtaagataatacatttgtgttgttctatggcactaaatttgtggtaatctgttacagcagcaattggaaactaatacagaaaygttaccaatttttttttttctgagacggagtctcgccctgttgcccaggctggagtgcagtggcacgatctcagctcactgcaacctcctccgcctcctg

SEQ ID NO: 15664 - DNA, 201 bp, Homo sapiens
acctcttccgaaccccggccatccgcaaggtcacatgctgtctcatggtgatttggtaggtgacaggctcatgcccaagactttcacctgaggcaggggcrtgctctctgcccccactgaaaaactctgttctgaaatactcttaatgcaatgagcaggtgagccgtgtgaactcaatctcttcccacaccctttttccag

SEQ ID NO: 15665 - DNA, 201 bp, Homo sapiens
ccttggacggagcggagacaagggccagccacctcaccaaagacctcaaccccagctctcctccacacagacgaaggggttcccagcagggatgtggggtycgagctccctcgctttccctgagcagagtcttcttacctaggtgatgagctcctacatccaaagcgagtttgcaagtgtctgcacctccaactcaatctt

SEQ ID NO: 15666 - DNA, 201 bp, Homo sapiens
ctgaagcgcccatgtcttccctgcagtgggatctggtgtgtgaggcccgcactctccgagacctggcgcagtccgtctacatggccggggtgctggtgggsgctgccgtgtttggcagcttggcagacaggtgagcccgtggggataagggccccagccacccagtgcgggccagaaagcctaggcctctgcattcatttt

SEQ ID NO: 15667 - DNA, 201 bp, Homo sapiens
gggctggccgtctgcttcctgaccgagacccgcaacatgcccctggtggagaccatcgcagccatggagaggaggtgaggggcctccagcaccaagaggcygaaagttacaggaaataactggggggcaaatggggtgccctccccactcctgcgtatcggaaatgtcctggccagatgcaccagagctgtgagatgcctc

SEQ ID NO: 15668 - DNA, 201 bp, Homo sapiens
cgcaacatgcccctggtggagaccatcgcagccatggagaggaggtgaggggcctccagcaccaagaggccgaaagttacaggaaataactggggggcaawtggggtgccctccccactcctgcgtatcggaaatgtcctggccagatgcaccagagctgtgagatgcctcccccacctccatctgcactggcttagcttt

SEQ ID NO: 15669 - DNA, 201 bp, Homo sapiens
gctgaatgtcactgttttctccccagttgtggagtggatgcccacacggggccggactgtggcgggtattttgctggggtattccttcaccctgggccagstcatcctggctggggtagcctacctgattcgcccctggcggtgcctgcagtttgccatctctgctcctttcctgatctttttcctctattcttggtatgt

SEQ ID NO: 15670 - DNA, 201 bp, Homo sapiens
ttaagtggtcagaatcataagggggggtgtggtgaattaaccacatgggtagctgaatgccgctgaatgtcactgttttctccccagttgtggagtggatrcccacacggggccggactgtggcgggtattttgctggggtattccttcaccctgggccagctcatcctggctggggtagcctacctgattcgcccctggc

SEQ ID NO: 15671 - DNA, 201 bp, Homo sapiens
ttctttgatccacttagaatttatctggagtgcagtagggacacctttgcctgtgtctcagagggtctctggaatgagtttaagtggtcagaatcataagsgggggtgtggtgaattaaccacatgggtagctgaatgccgctgaatgtcactgttttctccccagttgtggagtggatgcccacacggggccggactgtg

SEQ ID NO: 15672 - DNA, 201 bp, Homo sapiens
acctttgtgtcccctcccctgggctcacaacagtgaaccatggggtgaacaaggaccattccactgcctctcccaggttctccaactctgtggcttactayggcctggccatggacctgcagaagtttgggctcagcctatacctggtgcaggccctgtttggaatcatcaacatcccggccatgctggtggccaccgcca

SEQ ID NO: 15673 - DNA, 201 bp, Homo sapiens
cgcagatcctgtgcacagcccaggcagcgctgggcaaaggctgcctggccagctccttcatctgtgtgtacctgtttaccggcgagctgtaccccacggasatcaggtgggtgcatggggggagatgctgcaggttgagacctgttgggctcaccgaggcaggacccctggtccctcctgccctgtcctctgacactcagg

SEQ ID NO: 15674 - DNA, 201 bp, Homo sapiens
ccctactcccctgtctaggcacgcagatcctgtgcacagcccaggcagcgctgggcaaaggctgcctggccagctccttcatctgtgtgtacctgtttacyggcgagctgtaccccacggagatcaggtgggtgcatggggggagatgctgcaggttgagacctgttgggctcaccgaggcaggacccctggtccctcctg

SEQ ID NO: 15675 - DNA, 201 bp, Homo sapiens
ggacctgcagaagtttgggctcagcctatacctggtgcaggccctgtttggaatcatcaacatcccggccatgctggtggccaccgccaccatgatttacrtgggccgccgtgccacggtggcctccttcctcatcctggccgggctcatggtgatcgccaacatgtttgtgccagaaggtgagtcacccacttctgccct

SEQ ID NO: 15676 - DNA, 201 bp, Homo sapiens
aatgggccctaacttgttccccgttattttttagaggtgaggtctcactctgtcacccaggctgtagggcagtggtacaaacatagctctctgcagcttcraccttctgagctcaagtgatcctcctgcttcagcctccccagtagctgggactacaggcacgcaccaccgcacccagctaataaaaaaaaaattattttt

SEQ ID NO: 15677 - DNA, 201 bp, Homo sapiens
agtgagtgagtgagccggtgactgagcgagtgagcgggtgagtgactgagtgagcgggtgggcgagcgagtgagcgggtgggcgagcgagtgagcgggtgrgcaagcgagtgggtggataagcgggtgagtgggcgagtgagcgggtgagcgagtgagtgggcggatgagtgagtgggtgagtgagtgggagagtgagtgg

SEQ ID NO: 15678 - DNA, 201 bp, Homo sapiens
gatgagtgagtgggtgagtgagtgggagagtgagtgggtggatgagtgagtgggcgagtgagtgggtgggtgagtgagtgggtgggtgggtgagtgggcgratgagtgagtgggcgagtgagtgagtggatgagtgagtgggtgggtgatgagtgggtgatcgagcgagtgagcgagtgagtggatgagtgagtgggtggg

SEQ ID NO: 15679 - DNA, 201 bp, Homo sapiens
gagtggatgagtgagtgggtgggtgatgagtgggtgatcgagcgagtgagcgagtgagtggatgagtgagtgggtgggtgagtgagtgggtgagcgagcgrgtgagcgagtgagtcagtgagtgagtggatgagtgagtgagtgggtgggtgaatggataagtgagtgggtgggtgggtgggtgagtggatgagtgagtga

SEQ ID NO: 15680 - DNA, 201 bp, Homo sapiens
agtgagtgggtgggtgggtgggtgagtggatgagtgagtgagtgagtgggtgcgtgagtgggtgagcgagcgagtgagcaagtgagtcagtgagtgagtgratgagtgggtgggtgggtgagtgggtgggtgggtgagtgggtgggtgaatgagtgggtgggtgggtgggtgagtgagtgggtgagtgggtgggtggctcg

SEQ ID NO: 15681 - DNA, 201 bp, Homo sapiens
ggtgagtgagtgggtgagtgggtgggtggctcggtgggtgagtgagtgagtgcatgagtgagcgagtgagtcggtgagtgagtgagtgagtgggtgggtgratgagtgagtaggtgggtgggtgagtgggtgggtgagtgagtgcgtgggtgggtgagtgagtgcgtgggtgggtgagtgagtgggtgggtgagtgggtga

SEQ ID NO: 15682 - DNA, 201 bp, Homo sapiens
agtgggtgggtgagtgagtgcgtgggtgggtgagtgagtgcgtgggtgggtgagtgagtgggtgggtgagtgggtgagtgagcgagtgagcgagtgagtcrgtgagtgagtggatgagtgagtgggtgggtgagtggatgggtgagtgggtgggtgggtgagtgagtgggtgggtgggtaggtgagtgagtgggtgagtgg

SEQ ID NO: 15683 - DNA, 201 bp, Homo sapiens
ctacagaggaaaaccgaagcctggaaaggggataagaatggccgggttggccaggcgcagtgactcatgcctgtaatcccagcactttgggaggccaaggygggcagatcgcctgaggtcaggagtttgagaccagcctggccaacatggtgaaaccctgtctctactacaaatacaattagcccgagcatggtggcgggc

SEQ ID NO: 15684 - DNA, 201 bp, Homo sapiens
tgaagcacagcccagagagggcccatgactcacacaaggccacacagctggggtcagaaccagattcaaaaccgggtctgggataggtgtggtggctcacrtctgtaatcccagcactttgggaggctgaggtgggcagatcacttgaggtcaggagttcgagaccagcctggccaacatggtgaaaccccatctctacaa

SEQ ID NO: 15685 - DNA, 201 bp, Homo sapiens
gcgacagagtgagacttggtccaaaaaaaaaaaaaaaaaaaaaatgccacgggtctgttgaaatcctaagtcctctgtagttttgtttttttttttttggktttttttttgttttgagatggagtttccctctgttacccaggctggagtgcagtggcgcgatctcggctctgcaacctccacctcccaggttcaagcgat

SEQ ID NO: 15686 - DNA, 201 bp, Homo sapiens
ggtgaaaccccgtctttaccaaaaatacaaaaaattagccgggcatggtggcgggcacctgtagtcccagctactcgggaggctgaggcaggagaatggcrtcaacccgggaggcggagcttgcagtgagccgagatcatgccattgcactccagcctgggcgacagagcaagactctgtctcaaaaaaaaaaaaaaaaaa

SEQ ID NO: 15687 - DNA, 201 bp, Homo sapiens
actctcccttccacctctgaacatctcccatctcccatttctgtcaggcatgaatttgtatccttgcagctcttagtacatacatgacacccacatacttmcacacacacacatacacacgttcttatagaaatggatttaataggggctgggtgtggtggctcatgcctgtaatcccagcactttgggaggccgaggtgg

SEQ ID NO: 15688 - DNA, 201 bp, Homo sapiens
gagacctttggagacgctgtgtgctgctggctttgaagacagaggaaggagccacaagtcaaggaatgcaggcagcctctagaagctggcaaaggcaagcmaacagattctcccatggagtcttcagaaggaacacagccctgcccacactctgacattagctcagtaacacacgttaggcttctcacttccagaagtgta

SEQ ID NO: 15689 - DNA, 201 bp, Homo sapiens
actgcacctggcctcaatttggatttgtctgatggttctctcatgactaaactgggattgtggatttgggaaaggagaaccatggaggtgatatgaccttctcatcatatcatatcatatcatatgagggcatatatgatgtcaacatgactgattactggtgattttgaagttaatcccttggttaaggtagtgtctacc

SEQ ID NO: 15690 - DNA, 201 bp, Homo sapiens
gcacctggcctcaatttggatttgtctgatggttctctcatgactaaactgggattgtggatttgggaaaggagaaccatggaggtgatatgaccttctcwtcatatcatatcatatcatatgagggcatatatgatgtcaacatgactgattactggtgattttgaagttaatcccttggttaaggtagtgtctaccagg

SEQ ID NO: 15691 - DNA, 201 bp, Homo sapiens
tgaaaagaaagcaactgttaggctgggcacggtggctcacgcctgtaatcccagcactttgggaggccaaggcgggcaaatcacctgaggttaggagttcragaccagcctggccaacatggtgaaaccccgtctctacagaaaatacaaaaaaattagctgggcgtggtggtgtgcacctgtaatcccagctacttggga

SEQ ID NO: 15692 - DNA, 201 bp, Homo sapiens
atagatttgtattcagcatagttgagatattttatatgtttatacatacaaaaatataaataggatacatacatatatatgtatatatgtgcatgtgtacwtatatatatatatatatatatatatatatatatatagtgcccttatttcattatatgttgaaacatacacattcttttccatgttagcacaaatgtttca

SEQ ID NO: 15693 - DNA, 201 bp, Homo sapiens
atgggccgggcgcggtggctcatgcctgtaatcccagtactttgggaagccaaggcaggtggatcacctgaggtcaggagttcgagaccagcctggacaayatggtgaaaccctgtctctactaaaaatacaaaaattagctgggcgcggtggtgcacacctataatcccagctactcaggaggctgaggcaggagaattg

SEQ ID NO: 15694 - DNA, 201 bp, Homo sapiens
ccaggtgcagtggctcacacctgtaatcccagcactttgggagactgaggtgggtggatcacctaaggtcaggagtttgagaccagcctggccaacatggygaaaccctgtctccattaaaaatacaaaattaggctcttgctacttccttcttcccgctgccgggaacacaagcaaaacgttgagggctgcagcagccat

SEQ ID NO: 15695 - DNA, 201 bp, Homo sapiens
gaggagcccctctgtccggccagccgccccgtccaggagggaggtcggggggggtcagccccccctgcccggccagccgccccgtccgggagggaggtggrggggtcagccccctgcccagccagccgccccgtctgggaggtgaggggtgcctctgcccggccgccccgactgggaagtgaggagcccctctgcccggcc

SEQ ID NO: 15696 - DNA, 201 bp, Homo sapiens
tccccacctgccacacgcccctctggggctttgcagaatccctgcctttcctcgagcccggactaaatctcctcgccagcttccttctacactatgtcccyctgtctgtgaccaacctctgccacgaagcctgggtcccagcagtttcaagtttctgttttggaagggtggctttcgcggggtaccccatcttccccggga

SEQ ID NO: 15697 - DNA, 201 bp, Homo sapiens
ttcgaggcctccctccagccacagcagtgctcaggtgacctctccccacctgccacacgcccctctggggctttgcagaatccctgcctttcctcgagccyggactaaatctcctcgccagcttccttctacactatgtccctctgtctgtgaccaacctctgccacgaagcctgggtcccagcagtttcaagtttctgtt

SEQ ID NO: 15698 - DNA, 201 bp, Homo sapiens
gaacctcagtagtgttggagttcgtgttggagcttctcaacaccctggaaacagtgtgttggcacttctcaacacccctcaagtgccatcagtccttggayggagcggagacaagggccagccacctcaccaaagacctcaaccccagctctcctccacacagacgaaggggttcccagcagggatgtggggtccgagctc

SEQ ID NO: 15699 - DNA, 201 bp, Homo sapiens
cttccctccactattgtcccatgaccctgccaaatccccctctgtgagaaacacccaagtattatcaataaaaaaataaattaaaaaagaaaaaaaaaaaraaagaaaggaagccatgtgctaagaatggtggagaagaaaggaggaagtgcgtgatgaatttgtcaacatccctggactacctaattccagactttttta

SEQ ID NO: 15700 - DNA, 201 bp, Homo sapiens
caatgaacattgtgtcacaatgaatgagtgaatgaaagaatgcatgaagaaatgaagaaacgagtgagtgagtgagtgagcaggcgagtgagtgggcgagmgagtgagtgggcagatgagtgagtgagtggactagtgagtgagtgagtgagccggtgactgagcgagtgagcgggtgagtgactgagtgagcgggtgggc

SEQ ID NO: 15701 - DNA, 201 bp, Homo sapiens
attagtcctttatctgctagttgggttacaactatatttttacattttttgttgacgttatggcttgacttacggtgttttgttttgttttattccaatgyggacattttttatttttacgactccaagtttgtcaacctccccttttattgcctctgggttttgtgactttcttggaaaagcctttccctactctaagat

SEQ ID NO: 15702 - DNA, 201 bp, Homo sapiens
cgggaggcggagcttgcagtgagccgagatcatgccattgcactccagcctgggcgacagagcaagactctgtctcaaaaaaaaaaaaaaaaaaaaaaagwtggttaatcaagtttgcaaggtgggcaggaaggaatacctaacaggttcacaggcatgaagatgtgaaatggacaaaaatacaaaggcagcccatatgca

SEQ ID NO: 15703 - DNA, 201 bp, Homo sapiens
ctttctttccttctctccttccttcccccctcccctcccctcccctcccctcccctctcctctcctttctttccacggagtctccctctgtcttcaggctrgagtgcaatggtgcgatctcggctcactgcaacctccgcctcccgggctcaggtgattcttctgcctcagtctcccaagtagctaggactacaggcacat

SEQ ID NO: 15704 - DNA, 201 bp, Homo sapiens
aaaaacacacttgtctgtccttccttccttccatccttcctttcttcctttccttccttcctttccttccttccttccttccttccttccttccttccttycttccttctttctttctttctttctttttctctctttctttctttccttaaatatggagacaggatctcactatgtcgcccaggctggtctcaaattcct

SEQ ID NO: 15705 - DNA, 201 bp, Homo sapiens
acacacttgtctgtccttccttccttccatccttcctttcttcctttccttccttcctttccttccttccttccttccttccttccttccttccttccttycttctttctttctttctttctttttctctctttctttctttccttaaatatggagacaggatctcactatgtcgcccaggctggtctcaaattcctaagc

SEQ ID NO: 15706 - DNA, 201 bp, Homo sapiens
cactatgtcgcccaggctggtctcaaattcctaagctcaagcaatcctcccacttcagcctcccaaagtgctgggattacagatgtgagccactgcactgrgcccacgcttgcgtttctgtcagatacatacctaggattggaactgctggatcataaagtatgggtgtgtttctctgtaatagaagcaagcagttttcca

SEQ ID NO: 15707 - DNA, 201 bp, Homo sapiens
ttatttattttgagaccaggttatgagactggcgaatttttgtacttttggtagaaatggggtttcaccatgttgccaaggctagtcttgaactcctgggytgaagcaatccacccacctcagcctcccaaagtgctgggattaaaagtatgagccaccatgagcagcctctttccatatactattatttgaaagtgagtc

SEQ ID NO: 15708 - DNA, 201 bp, Homo sapiens
agaatcacttgaacccaggagacggaggctgcagtgagccaagatcgtgccactgtactccagcctgggagacagagtgagactcaaagaaaagaaaaaakaaaaagaaagcgactgttgattactagagtttgtattaagcacttagtgcccagtggcaattagtggcaggtggaggtcttgagccttggccctcagagc

SEQ ID NO: 15709 - DNA, 201 bp, Homo sapiens
cccttatttcattatatgttgaaacatacacattcttttccatgttagcacaaatgtttcatggacctgatttttttttttttttttgagatgaagtctcmtttgttgcccaggctggagtgctgtggtgctcactgcaacctctgcctcctaggttcaagtgattcccctgccttagcctgcagagtagctgggattaga

SEQ ID NO: 15710 - DNA, 201 bp, Homo sapiens
cctcctaggttcaagtgattcccctgccttagcctgcagagtagctgggattagagatgcgtgccatcatgcccggctaatttttgtatttttagtacagrcggggtttcatcattttggccagggtggtctcaaactcgtgacctcaagtgatctgcccacctcggcctcctaaagtgctgggattacaggcatgagcca

SEQ ID NO: 15711 - DNA, 201 bp, Homo sapiens
cccgccaccatgcccagctaatttttgtatttttagtagagatggggtttcaccatcttggccaggctggtcttgaactcctgaccttgtgatccacctgyctcggcctcccaaagtgctgggattacaggcgtgagccacggcgcccagcccaagtcctatcatttctgcctccagaatagacttaaatctgtcattctc

SEQ ID NO: 15712 - DNA, 201 bp, Homo sapiens
ctgactggttttggtggagacggggtttcgctgtgttggccgggccggtctccagcccctaaccgcgagtgatccgccagcctcggcctcccgaggtgccrggattgcagacggagtctcgttcactcagtgctcaatggtgcccaggctggagtgcagtggcgtgatctcggctcgctacaacctacacctcccagccgc

SEQ ID NO: 15713 - DNA, 201 bp, Homo sapiens
aggcaggcgaatcacttgaacccgggagacagaggctgcagtgagccaagatctcgccactgtactccagcctgggcaacagagcgagacagagtgtctcmagagaaaaaaaaaaaaggattaatactctacctcttctgcttttgtttttttaataacttaatcacatctgtaaaaacttttacaacattacatgtaacc

SEQ ID NO: 15714 - DNA, 201 bp, Homo sapiens
ttttttttcttggccaggcgcagtggctcatgcctgtaatcccagcactttgggaggctgaggtgggcagataacttgaggtcaggagtttgagaccagcstggtcaatgcagtaaaaccccatctctactaaaaatacaaaattagctgggcgtggtggtgtgcgcctgtaatcccggcaacttggaaagctgagacagg

SEQ ID NO: 15715 - DNA, 201 bp, Homo sapiens
gcgccgggctcgctcctgggatcaactgcacagtcctggctttggggagcgggaggcggtgagcctgcccgccccccgaccccttcctcaccagtgtgtcwggggtgaggtggggatggggagtcctggggttcgaaaaaggatgggggaggagaaagaggaagtgttaggaactggtgaactttcacaaacttccacaaa

SEQ ID NO: 15716 - DNA, 201 bp, Homo sapiens
cgctttggaggcctctcctattccttcagaaagagctgtcccattcctcctagtctttacactacatcccactgtatgaatgggccctaacttgttccccrttattttttagaggtgaggtctcactctgtcacccaggctgtagggcagtggtacaaacatagctctctgcagcttcaaccttctgagctcaagtgatcc

SEQ ID NO: 15717 - DNA, 201 bp, Homo sapiens
aatccccagagggcagcctgctttctatgccttttaccagagacattttatgattctatgcagtcaagcaagtgggtgtatatgttccattcccccatttytcttttcctgttttgtatttgttttcttcttcatgtgcccccatttttttctttgagatgaggtctcactatgttggccaggctggtctcaaacttctac

SEQ ID NO: 15718 - DNA, 201 bp, Homo sapiens
tgggtgtgtgggggggctgctgccgaggcccagtctgaagcgcccatgtcttccctgcagtgggatctggtgtgtgaggcccgcactctccgagacctggygcagtccgtctacatggccggggtgctggtgggggctgccgtgtttggcagcttggcagacaggtgagcccgtggggataagggccccagccacccagtg

SEQ ID NO: 15719 - DNA, 201 bp, Homo sapiens; identical to SEQ ID NO: 1677

SEQ ID NO: 15720 - DNA, 201 bp, Homo sapiens; identical to SEQ ID NO: 1689

SEQ ID NO: 15721 - DNA, 201 bp, Homo sapiens; identical to SEQ ID NO: 1683

SEQ ID NO: 15722 - DNA, 201 bp, Homo sapiens
accagcctgggcaacatagcaagacccccatttctacccccccatcaaaaaaggcaaaattggatcttgtcaagtgatagaaagccagtggggtagcctcrggctatttgggactgagggggcctcaaagtccaggcaagccccccaccaccctcaacctcccctgacttcttcaagagccaaccagggcagggcaggagt

SEQ ID NO: 15723 - DNA, 201 bp, Homo sapiens
caggtggcttccagagtcatcccgctggctcctcctgcatggcaagtcccagttagctgtacagaatctgcagaaggtggctgcaatgaacgggaggaagsaggaaggggaaaggctgaccaaggaggtaagcgagctgggaggaaggaagggtgggaacagtcttcagtcttgctggcaacctccagttgtactagaatt

SEQ ID NO: 15724 - DNA, 201 bp, Homo sapiens
ttcagcctccccagtagctgggactacaggcacgcaccaccgcacccagctaataaaaaaaaaattatttttagtagagatcggggggtgggggtgggggrgggtgtctcactatgttgcccaggctggtctcgaactcctgggctcaagcaatcctcctccctctacctcctaaagtgctgggattacaggtgtgagcac

SEQ ID NO: 15725 - DNA, 201 bp, Homo sapiens
gtgctgggattacaggcgtgagccactgcgcccagcctaattttctttcatacttcattgctgacattcctgacgggggttccagtttaattgcaggaacytcctgttggattctctacctcaggtagatgtttatcatctgcttctataccctggggttcaggggtctacagaagccctttagcattatttaccttgcag

SEQ ID NO: 15726 - DNA, 201 bp, Homo sapiens
tccttttaatatgctgttgggttgggttcatcgctttttttgggagggggtggatttttgcatctatattcataagtgatattggtctgtaatcttctttycttgtggtgtctttatctggctttaaggtaatgctggcctcctgggatgagttaggaagtgtcccctcatcttcagttatttagaagagtttgaggattg

SEQ ID NO: 15727 - DNA, 201 bp, Homo sapiens
gctcctttctcagttcactaattttcttttttgctctgtcaaatctgttagttatttcttccaagaacttaatttcaattttaaaaattttgtttctagargatgtaatggatcttttcaaatctgttcatttttgctcaaattttcaaacttttcatctatttctttaaacatagtaagcatagtcttatattctgtgtc

SEQ ID NO: 15728 - DNA, 201 bp, Homo sapiens
gtgctagtggtgacatggtaacagccatcttgtccttttccccacggttactagcaccctgcctagccccagccccctcctggggacccaacccctccccyatcctgttgggcaggggctgcgcctcactgaccttcactcactctcctggaccaggcttcaagctcaacaagaagctgtacgagctcatcatcacccgct

SEQ ID NO: 15729 - DNA, 201 bp, Homo sapiens
cggctggatgagacggatgacccggacgactacggggaccgcgagtcaggctgcagcttcgtgctcgcccttatgcagaagcaccgtcgccgcgagcgccscttcggccgcgacatggagactattggcttcgcggtctacgaggtcaggagggtggatcaccggtggatctcactgagcaggcagaggacctggcgcccc

SEQ ID NO: 15730 - DNA, 201 bp, Homo sapiens
agtgcctacgagatgcggatggccattgagtcggcaggtgagactccaaggctgacggcacctgtggggcccaggacaggtagccccactgctcctatgcyccaggcccttgtccctggggtgctagtggtgacatggtaacagccatcttgtccttttccccacggttactagcaccctgcctagccccagccccctcct

SEQ ID NO: 15731 - DNA, 201 bp, Homo sapiens
ggggcaggtgccacctcctctctctccccaggacatggagatcagcgtgaaggagttgcggacaatcctcaataggatcatcagcaaacgtgagtccccgyggggctgtcccaccaccccaccatttcttccacatcagaatccaggctcctgctcacacattgagctgaacctcatcccttggtctgcatgagtcgggga

SEQ ID NO: 15732 - DNA, 201 bp, Homo sapiens
caccctcctgcaccgagtggttccgcacggccagagcttccagaatggctatgccggcatcttccatttccaggtgagggctcccctggggaggaggggcwgcaggcactgggggagatgcggaaggatgacccacaatacctgcagttagggccacaccctgtggggccagccctccctctagcaggtatttgacctctc

SEQ ID NO: 15733 - DNA, 201 bp, Homo sapiens
tgggcagctgcagccctgctccctcctccctcccaccagctggtgggccagccggccgtacacttgaagcgtgacttcttcctggccaatgcgtctcgggygcgctcagagcagttcatcaacctgcgagaggtcagcacccgcttccgcctgccacccggggagtatgtggtggtgccctccaccttcgagcccaacaag

SEQ ID NO: 15734 - DNA, 201 bp, Homo sapiens; identical to SEQ ID NO: 1692

SEQ ID NO: 15735 - DNA, 201 bp, Homo sapiens
ttagggccacaccctgtggggccagccctccctctagcaggtatttgacctctcagtgccatctcgggtctgtcatgtgtgaagtgactgggctgggcagstatttcggctggcagttttcctaggtggttgtatgtatcaggtggaaagtgcttgaaagaacagaaagacttttgtgttatatcctgtgggacaaattcc

SEQ ID NO: 15736 - DNA, 201 bp, Homo sapiens
gtatgtatctaatttacatgatttagtctatgtgtatctagtatgtatctgggatgtagaatcctgcatctaggaaggtaggggtaaggatggagctcagktccgggggattccaaagcaggtactcaccgtgcccctcccccacagctgtggcaatttggggagtgggtggacgtggtcgtggatgacctgctgcccatc

SEQ ID NO: 15737 - DNA, 201 bp, Homo sapiens
tggcctggtgccaatttctgggaggggctggccgaggaacaggactctgggtctctcgtaggaactgctgtcaaacccccagttcattgtggatggagctrcccgcacagacatctgccagggagcactgggtaggcccccagggcgtcgggtcccgggtattttttccacagtagttccccattcccgctccttcaggct

SEQ ID NO: 15738 - DNA, 201 bp, Homo sapiens
gtggggccttccctgaagggcggttcctgccccctggcctgtccttgcctctctggcacctgaccagggctgtggaaggtgctggctcctcctttcccctcctgcagcaccttatctctcttctggggacacccatctgagatgcctatcatgtcctgccctgactgactgtagttcatgtgtgcagctgcctgcctgggc

SEQ ID NO: 15739 - DNA, 201 bp, Homo sapiens
attgaatccattactacagatgtgtaagtcctgctgttggacagggcaaattccttcttcaagagtctcttagctgttttttttgttgttggttttttttktttttgtttttgttttttgagacggagtcttgctctgttgcccaggctggagtgcagtggcgcgatctcggctcactgcaacctctgcctcctgggttca

SEQ ID NO: 15740 - DNA, 201 bp, Homo sapiens
tgaatccattactacagatgtgtaagtcctgctgttggacagggcaaattccttcttcaagagtctcttagctgttttttttgttgttggttttttttgtktttgtttttgttttttgagacggagtcttgctctgttgcccaggctggagtgcagtggcgcgatctcggctcactgcaacctctgcctcctgggttcaga

SEQ ID NO: 15741 - DNA, 201 bp, Homo sapiens
tccattactacagatgtgtaagtcctgctgttggacagggcaaattccttcttcaagagtctcttagctgttttttttgttgttggttttttttgtttttktttttgttttttgagacggagtcttgctctgttgcccaggctggagtgcagtggcgcgatctcggctcactgcaacctctgcctcctgggttcagatgat

SEQ ID NO: 15742 - DNA, 201 bp, Homo sapiens
attgaaagttaaaggttatagaattgttcagattttctgtttcttgagccaattttgatgagttgtattttcttttgttttttctttttctttttctttctttttttttttaagagagacagggttttttagagagaggttactcactgcaacctcgaactcctgagctcaaatcctgcctcagcctcctgagtagctggg

SEQ ID NO: 15743 - DNA, 201 bp, Homo sapiens
ttttttgtatttttagtagagatggggtttcaccatggtctcgatcatctgaccttgtgatcctcctgcctcggcctcccaaagtgctgggattacaggcrtgagccactgcacccagccccctcttaatatactcttatgtctcgtgtataataatgtcccctttttatgcatgggattgctcatttgcattgtctcttt

SEQ ID NO: 15744 - DNA, 201 bp, Homo sapiens
gggttctgatttctccacatcctcttcaacactagttattgctcttctttttgattatagccatcctagtgggtgtgaagtggtatcactgaagttttttgggggttttttttttttttttttttttttttgagtctggatcttgctctatcacctaggctgaagtgcagtggcgccatctcagctcactgcaacctctgc

SEQ ID NO: 15745 - DNA, 201 bp, Homo sapiens
ggttctgatttctccacatcctcttcaacactagttattgctcttctttttgattatagccatcctagtgggtgtgaagtggtatcactgaagttttttgggggttttttttttttttttttttttttttgagtctggatcttgctctatcacctaggctgaagtgcagtggcgccatctcagctcactgcaacctctgcc

SEQ ID NO: 15746 - DNA, 201 bp, Homo sapiens
ctctcagccagtacgctattctctgagtactagggggattgttctataattgtccattatatcaaacttattgttttgtctgcttaatctatcaattactgaaagaaagaaagaaagatgataaaaatcttataacatcctaatggctttgccaatttctctctgtatttctatcaattatttttcattatatattttgag

SEQ ID NO: 15747 - DNA, 201 bp, Homo sapiens
tctcagccagtacgctattctctgagtactagggggattgttctataattgtccattatatcaaacttattgttttgtctgcttaatctatcaattactgaaagaaagaaagaaagatgataaaaatcttataacatcctaatggctttgccaatttctctctgtatttctatcaattatttttcattatatattttgagc

SEQ ID NO: 15748 - DNA, 201 bp, Homo sapiens
ctcagccagtacgctattctctgagtactagggggattgttctataattgtccattatatcaaacttattgttttgtctgcttaatctatcaattactgaaagaaagaaagaaagatgataaaaatcttataacatcctaatggctttgccaatttctctctgtatttctatcaattatttttcattatatattttgagct

SEQ ID NO: 15749 - DNA, 201 bp, Homo sapiens
tcagccagtacgctattctctgagtactagggggattgttctataattgtccattatatcaaacttattgttttgtctgcttaatctatcaattactgaaagaaagaaagaaagatgataaaaatcttataacatcctaatggctttgccaatttctctctgtatttctatcaattatttttcattatatattttgagcta

SEQ ID NO: 15750 - DNA, 201 bp, Homo sapiens
cagggtttcaccatcttggccaggctggtcttgaactcctgacctcgtgatccacccaccttggtctcccaaagtgctgggattacaggtgtgagccaccrtgcccggccgccttgttctttttttgagacagtgtctcattctgtcacccaggttggagtgcagtggtgcaatcatagctcactgcagcctcagccttct

SEQ ID NO: 15751 - DNA, 201 bp, Homo sapiens
agcctccccagtagctgggactacaggtgcccaccaccacgcccgggtaattttttgtgtttttagtagagatggggtttcaccatgttagccaggatggkcttgatctcctgacctcatgatccgcccatcttggcctcccaaagtgctgagattacaggtgtgagccaccacgcctggtcgtctggctcattttcttac

SEQ ID NO: 15752 - DNA, 201 bp, Homo sapiens
attttttccttccctccagggaggtttaattttctttctttctttttttttgtttttgagacggagtctcgctctgtcgcccaggcttgagtgcagtggcrcgatctcggctcactgcaagctccgcctcccaggttcatgccattctcctgcctcagcctcccgagtagctgggactacaggcacctgccaccacgcccg

SEQ ID NO: 15753 - DNA, 201 bp, Homo sapiens
tggcgcgatctcggctcactgcaagctccgcctcccaggttcatgccattctcctgcctcagcctcccgagtagctgggactacaggcacctgccaccacrcccggctaatttttttgtatttttagtagagacggggtttcaccgtgttagccaggatggtctcgatctcctgacctcgtgatccgcccgtctcggcctc

SEQ ID NO: 15754 - DNA, 201 bp, Homo sapiens
ccatacaagtcacctatttaaagttgcaatttaaatatactattaaatatacaatttaaatgtactgaagtatattacgattttatttatttatttatttrtttgtttgtttgtttattgagatggagtctcgctctgtcacccaggctggagtgcagtggccagatctcggctcactgcaacctctgtctcctgggttca

SEQ ID NO: 15755 - DNA, 201 bp, Homo sapiens
ctgggattacaggcgcacgttaccacacctggctaatttttgtatttttagtagagacggggttttgccattttggtcaggctggtttcaaactcctgacytcaagtgatccacccacctcggcctcacaaagtgctaggattacaggtgtgagccaccgcacctggcccaaactcttgccttttactcactgagctgaac

SEQ ID NO: 15756 - DNA, 201 bp, Homo sapiens; identical to SEQ ID NO: 1697

SEQ ID NO: 15757 - DNA, 201 bp, Homo sapiens
ccatcacttccaccccccatgcctggtgtcgctcctgtcctcacctacccactcctcccccaaaacttcacacctcagctctttcctgtgcttgttttccygtctaccatgctgtttccctcattcctgtcatctcaatccatgccatcctctgtccagttcaccagcctcagatttcatctcctggtctcagttcccacc

SEQ ID NO: 15758 - DNA, 201 bp, Homo sapiens
atctgcccacgtcagcctcccaaagtgctgagattacaggtgttagccaccgcgcccggccaattttctgaatttttaaaatcatgaactgatgtgctttytgtgcatcaattgagatgatcattttgaggtttttttccccttcattctattaatgtggtatattacattgatcaactttcctttgttgaactacccttg

SEQ ID NO: 15759 - DNA, 201 bp, Homo sapiens
tttcacccttcagaccagccgtgttggtcaggctggtctcaaactcctgacctcgtgatctgcccacgtcagcctcccaaagtgctgagattacaggtgtkagccaccgcgcccggccaattttctgaatttttaaaatcatgaactgatgtgctttttgtgcatcaattgagatgatcattttgaggtttttttcccctt

SEQ ID NO: 15760 - DNA, 201 bp, Homo sapiens
agtagagacagggtttcacccttcagaccagccgtgttggtcaggctggtctcaaactcctgacctcgtgatctgcccacgtcagcctcccaaagtgctgrgattacaggtgttagccaccgcgcccggccaattttctgaatttttaaaatcatgaactgatgtgctttttgtgcatcaattgagatgatcattttgagg

SEQ ID NO: 15761 - DNA, 201 bp, Homo sapiens
cagctaatttttgtagttttagtagagacagggtttcacccttcagaccagccgtgttggtcaggctggtctcaaactcctgacctcgtgatctgcccacrtcagcctcccaaagtgctgagattacaggtgttagccaccgcgcccggccaattttctgaatttttaaaatcatgaactgatgtgctttttgtgcatcaa

SEQ ID NO: 15762 - DNA, 201 bp, Homo sapiens
ttttttgaggaactgccaattgttttccaaagcagcagcaccattttatatccccaccaacaacatgtgagggttctgatttctccacatcctcttcaacrctagttattgctcttctttttgattatagccatcctagtgggtgtgaagtggtatcactgaagttttttgggggtttttttttttttttttttttttttt

SEQ ID NO: 15763 - DNA, 201 bp, Homo sapiens
tccaatttcagtctttccccaaatagataaccaccgttccctgtaccatttattgagaaatacatcatctcgtctctccccagcagcactagcgccctcamgtagtcctgaggtatgtgttggtctgtttctggactcaccattctgtccctgggtctatccctctgccgataacacattgaatccattactacagatgtg

SEQ ID NO: 15764 - DNA, 201 bp, Homo sapiens
caatttatcaggaattaccatactccctatttcctttctcacttctgcttcattgcttaacccttcccagtccagcttcatccctaccatgctgctaaaaycaccctctcaaaggtcacttaagctttggccttgccagatccgccgctgctctgtcctcctgtgctgcatcctcagcacggctccctgccctctgttttg

SEQ ID NO: 15765 - DNA, 201 bp, Homo sapiens
cagcccccaccatgagggcaccagagctgccttgtcttgcaaacacccgctctctgacctccaccttcgactctttccactcccttagtcttcaacccttsgaccaagccagtccgttgaacccatcacttgcgtaccatcctgcctctcccatcttgccttctctccttacctaggttagagctatcattttaatcttgt

SEQ ID NO: 15766 - DNA, 201 bp, Homo sapiens
tgtaattccagctatttgggaggctgaggcaagagaattgaattgcttgaacccaggaggcggaggttgcagtgagctgagatcgcaccactgcactccarcctgggtgacagagcaagactctgtctcaaaaaagaaaaaaaaaaaaagtgcctgctggaagctagcactgacaggagctctggcaaataggtgaactac

SEQ ID NO: 15767 - DNA, 201 bp, Homo sapiens
catggaggccatcactttcaagaagttggtgaagggccatgcctactctgtgaccggggccaagcaggtactgccctgggtggggccttccctgaagggcrgttcctgccccctggcctgtccttgcctctctggcacctgaccagggctgtggaaggtgctggctcctcctttcccctcctgcagcaccttatctctctt

SEQ ID NO: 15768 - DNA, 201 bp, Homo sapiens
ggaggtggccctcggaacccagggtgcggaacccacagtgcggatccactttggcccagcgccacacccacctgctccagtctgcaggggcgcagtctcgyccccttccctcgctcctccaatccgctcctccctggcctccgattggccagttcagtacccgccacccacactctccgcaacctgggctcctagggccgc

SEQ ID NO: 15769 - DNA, 201 bp, Homo sapiens
gattctccctagcacccgcttccccccccggggcaggttggtagagcaggctaatgtgcatccctcctgccccaggggactgctggctcttggcggccatygcctccctcactctcaacgacaccctcctgcaccgagtggttccgcacggccagagcttccagaatggctatgccggcatcttccatttccaggtgaggg

SEQ ID NO: 15770 - DNA, 201 bp, Homo sapiens
cccaacccctccctcttgcaagcccaggcaggatctggctatcagcgctggggctggtttgcccagattcctgggtcttttctgcaagctgaggggagttwagtggcaccctggccaaggaaccccagattctccctagcacccgcttccccccccggggcaggttggtagagcaggctaatgtgcatccctcctgcccca

SEQ ID NO: 15771 - DNA, 201 bp, Homo sapiens
ttacagggctacttctgtttgcagaccctctgaacagctatctcaaaatatgttgaagaagtatatttcagggtgaaatactttgatttccttcaatacckagatacatgtatctagtatatctgtagcatacatgtatctagaggtacacatgcatctagtatgtatctagtatatgtgatttagtatacatgcatctac

SEQ ID NO: 15772 - DNA, 201 bp, Homo sapiens
ccttatgcagaagcaccgtcgccgcgagcgccgcttcggccgcgacatggagactattggcttcgcggtctacgaggtcaggagggtggatcaccggtggwtctcactgagcaggcagaggacctggcgcccccgacccgcagtgcaggcgggcttccaccagggggcgccagggaccatgcccttccccacaaattcccc

SEQ ID NO: 15773 - DNA, 201 bp, Homo sapiens
tctgtttcttgagccaattttgatgagttgtattttcttttgttttttctttttctttttctttctttttttttttaagagagacagggttttttagagasaggttactcactgcaacctcgaactcctgagctcaaatcctgcctcagcctcctgagtagctgggactacacaggtgtgagcctctatgattggctaatt

SEQ ID NO: 15774 - DNA, 201 bp, Homo sapiens
agttatccttaatatactcttttttttttttttgagacagagtcttgctctgtcgcccaggctggagtgcagtggtgccatctcagcttactgcaagctcygcctcccgggttcacgccattctcctgcctcagcctcccgagtagctgggactacaggtgcccaccaccacgcctggctaatttttttttttttttttgt

SEQ ID NO: 15775 - DNA, 201 bp, Homo sapiens
gtgggggctggcggagcggcacagcccaggcgcctgtcccagcctggctcaccgctgtccccaggggctgggctagggcccaccagctctgatatcgagcytgctgcgggggcctgaggagggggaccccgaccgtctggggttttcagcccacggcaaggggccggtgcaccaggagcttggttagtttggggagggggt

SEQ ID NO: 15776 - DNA, 201 bp, Homo sapiens
actacagatgtgtaagtcctgctgttggacagggcaaattccttcttcaagagtctcttagctgttttttttgttgttggttttttttgtttttgtttttkttttttgagacggagtcttgctctgttgcccaggctggagtgcagtggcgcgatctcggctcactgcaacctctgcctcctgggttcagatgatgcttct

SEQ ID NO: 15777 - DNA, 201 bp, Homo sapiens
tttattttggcctttaatgtctttcaatagaatgttgtattttttatcataaagaatttatacatctcttgagatttaatgctaggtacactataattttktttctattataaatagtatgttctttaaaattacatctcccaagtgatcttgttgctcatacgataacatgcatttgaccttttagatgtagtttttata

SEQ ID NO: 15778 - DNA, 201 bp, Homo sapiens
tcaatataaatctttacaaataaatgacttttggccagctgcactcaggagatcgagaccatcctggccaacacagtgaaaccccgtctctactaaaaatmcaaaaaattagccgggcgtagtggcaggtgcctgtggtcccagctgcttgggaggctgaggcaggagaatggtgtgaacctgggagacagagcttgcagt

SEQ ID NO: 15779 - DNA, 201 bp, Homo sapiens
tctgatttctccacatcctcttcaacactagttattgctcttctttttgattatagccatcctagtgggtgtgaagtggtatcactgaagttttttggggkttttttttttttttttttttttttttgagtctggatcttgctctatcacctaggctgaagtgcagtggcgccatctcagctcactgcaacctctgcctcc

SEQ ID NO: 15780 - DNA, 201 bp, Homo sapiens
aagtgctgagattacaggtgttagccaccgcgcccggccaattttctgaatttttaaaatcatgaactgatgtgctttttgtgcatcaattgagatgatcrttttgaggtttttttccccttcattctattaatgtggtatattacattgatcaactttcctttgttgaactacccttgcattcctgggataaatcccact

SEQ ID NO: 15781 - DNA, 201 bp, Homo sapiens
tggaaggttaggttattgatttgatagctctctcttttaatatatgtacatttttcatggccatgctatgtaatttctcattaccattatcatctctttcygataaactagttattttagaagaatgttttttaaaacataaaaaaatttctaacttaattttctcatagtaaaaaaatgtgacctacataagatcatagc

SEQ ID NO: 15782 - DNA, 201 bp, Homo sapiens
gaagtggcaaaactgggatttgaacccaggcagagggatcctgaagtctgttctctcagccagtacgctattctctgagtactagggggattgttctatawttgtccattatatcaaacttattgttttgtctgcttaatctatcaattactgaaagaaagaaagaaagatgataaaaatcttataacatcctaatggctt

SEQ ID NO: 15783 - DNA, 201 bp, Homo sapiens
actgaggcaggagaatcacttgaacctgggaggtggaggttgcagtgagccaagattgtgccattgcactccagcctgggtgaaaagagcaaaactctatytgaaaaaaaaaaaaaaaaaaaaagacaaaggaatattttgtcctttgactagagagtttagttcatttacactcacagtgattaatgctgtatttatttc

SEQ ID NO: 15784 - DNA, 201 bp, Homo sapiens
tgagtttgaaagacataagagtttgcttaatacatactaaagttagttaatcagtgtcttttttttttttctctgagacagggtctggctctgtcacccargctggagtgtggtggcgtgatctcagctcactgcaacctctgcctcctgggctcaagccatcctcccacctgagcttcccgagtagctgagtggtactac

SEQ ID NO: 15785 - DNA, 201 bp, Homo sapiens
ctttgagtcctcagataaagttaaattgctccggggtgtttctgctagtcacctggaatgccaccaatccagaacacctttttcgttcttttttatttatytacttattttttgagacacagtcttgctccggctggagtgcaatggcataacctcagctcacttcagcctcgacctcccaggctcaaggaatccttccac

SEQ ID NO: 15786 - DNA, 201 bp, Homo sapiens
tagagatggggtttcaccatgttagccaggatggtcttgatctcctgacctcatgatccgcccatcttggcctcccaaagtgctgagattacaggtgtgarccaccacgcctggtcgtctggctcattttcttactttttgtagtgatggggtctccctatgttgcccaggctggtcttgaactcctgggctcaagcagtc

SEQ ID NO: 15787 - DNA, 201 bp, Homo sapiens
ttacgattttatttatttatttatttgtttgtttgtttgtttattgagatggagtctcgctctgtcacccaggctggagtgcagtggccagatctcggctsactgcaacctctgtctcctgggttcacgcaattctcctacctcagccttccaggtagctgggattacaggcacctgccaccatggccacctaatttttgc

SEQ ID NO: 15788 - DNA, 201 bp, Homo sapiens
ctgtgaggttcccatccctccacatcctcacccaagttgttattatctttattattattattattattgtcaatggagggcaggggatgcagtggcttatyagtgcctttaaaaataagttttgcagtttaccgttctatcccgcactgggttgttttagtcaagaaggttctttaggcagcaaaatcacccaactgccag

SEQ ID NO: 15789 - DNA, 201 bp, Homo sapiens
cggacgactacggggaccgcgagtcaggctgcagcttcgtgctcgcccttatgcagaagcaccgtcgccgcgagcgccgcttcggccgcgacatggagacwattggcttcgcggtctacgaggtcaggagggtggatcaccggtggatctcactgagcaggcagaggacctggcgcccccgacccgcagtgcaggcgggct

SEQ ID NO: 15790 - DNA, 201 bp, Homo sapiens
ggtgtgtgatggggacccaggtgtcctgtcccctgagttcctgctaacagggaagatcccctcctggtggaagccataggagtagtgctaatccctcatcygcccagcactttacagtttgcagaggacctgtgatactaatggcacaggccctgagctctcacccggtggcgggtttgtgctgagcacttcacctgtgtt

SEQ ID NO: 15791 - DNA, 201 bp, Homo sapiens
cctgacttcaagtgatccacccacctcggcctcacaaagtgctaggattacaggtgtgagccaccgcacctggcccaaactcttgccttttactcactgarctgaacagcatccccttcatttaggtcacatgagtgctggatatggggcggggcagggcagggcaggaacgagattcccttttcagattagaaaagtgag

SEQ ID NO: 15792 - DNA, 201 bp, Homo sapiens
tcatcatcacccgctactcggagcccgacctggcggtcgactttgacaatttcgtttgctgcctggtgcggctagagaccatgttccgtgagtgtccccarctgcctcccaccctccagctccgtcccaaacgcgtcccccaggagctggggggaatgacagatgggtgaattagcagatacaggccagtgctgtgggtgt

SEQ ID NO: 15793 - DNA, 201 bp, Homo sapiens
tccttttccccacggttactagcaccctgcctagccccagccccctcctggggacccaacccctcccccatcctgttgggcaggggctgcgcctcactgaycttcactcactctcctggaccaggcttcaagctcaacaagaagctgtacgagctcatcatcacccgctactcggagcccgacctggcggtcgactttgac

SEQ ID NO: 15794 - DNA, 201 bp, Homo sapiens
tgcggatggccattgagtcggcaggtgagactccaaggctgacggcacctgtggggcccaggacaggtagccccactgctcctatgccccaggcccttgtycctggggtgctagtggtgacatggtaacagccatcttgtccttttccccacggttactagcaccctgcctagccccagccccctcctggggacccaaccc

SEQ ID NO: 15795 - DNA, 201 bp, Homo sapiens
atggcaatgggaagctgggcctggtggagttcaacatcctgtggaaccgcatccggaattacctggtaggttgtccccactcacctcagtcatgcaggtgygggccgggcaggtgggaagggccgggtgactcagcctggccctcaccctctgccgccacctcagtccatcttccggaagtttgacctggacaagtcgggc

SEQ ID NO: 15796 - DNA, 201 bp, Homo sapiens
gaaaggtggagcaagacctgggtccccattgaccctgaggctggtgctatttctgacccctccccagcccactccactgcagcccagctcagagaataagrcaagcccggctgtgggctgactgtacatggcttttgctgcttctcctcacccagccccaagtcgacttgccggctcggcggccatctccccttctgcaca

SEQ ID NO: 15797 - DNA, 201 bp, Homo sapiens
tctcttgccttcttctaagctgttgtccacgcagcactcgagccaccttttagagtcctaatgcagtcacatgcctcctcgctgcaagctgtgggagggtycttaccctttgcttcagtccacacgccctagtccctggccggctcctgggagctctgcggcctccctgggtctccgtgtttcctagagcctccgtaagtg

SEQ ID NO: 15798 - DNA, 201 bp, Homo sapiens
tgtggcctcctgtcggacccctgctttttctcttgccttcttctaagctgttgtccacgcagcactcgagccaccttttagagtcctaatgcagtcacatscctcctcgctgcaagctgtgggagggttcttaccctttgcttcagtccacacgccctagtccctggccggctcctgggagctctgcggcctccctgggtc

SEQ ID NO: 15799 - DNA, 201 bp, Homo sapiens
aacaaggctttgcatggacacgttttcatttctcttgggtatagagcttggagtggaatttctgggtcatatgaagctctgtgtttaaccttttgagaaastgccagaatgttcttcggagcagctgcaacattttacattcccaccggcatcctgtgaggttcccatccctccacatcctcacccaagttgttattatct

SEQ ID NO: 15800 - DNA, 201 bp, Homo sapiens
atcccaaaaacaaatgaggtactccttagccatgactccccagccctcccagcagccctggcaaccacaaatctacttcttatctctatggatttgcctaytgggatatttcatgtgaacaggatcatataatacatggtcctttgtggctggcctttttcatttagcataatgtttgcaaggttcctccatgttgtagca

SEQ ID NO: 15801 - DNA, 201 bp, Homo sapiens
ttacaggtgtgagccaccgtgcccggccgccttgttctttttttgagacagtgtctcattctgtcacccaggttggagtgcagtggtgcaatcatagctcrctgcagcctcagccttctgggctcaaactatcctcccaagtagctgggactatgatagagacacacaccacacgcccagctaacttcttacattttttgg

SEQ ID NO: 15802 - DNA, 201 bp, Homo sapiens
gggacaaattccactcctcccggaggtcggtctcagttgccccatctgagaaaggagtgttcgctggggaaaacagatcagcacgtgtggccttctccacstgtcaagcctcctatcccccaactcctcctgcgctttggcaaggtctgactgagcccagcagaaaagaaagactcgggattaagtctacgtaaaccagct

SEQ ID NO: 15803 - DNA, 100 bp, Homo sapiens
tcccctctcctcccagccaccatcgttcatctgctccgggcagaactgtstggcccctgcctgtgccagccatgggctcgggatggactccctgggcccc

SEQ ID NO: 15804 - DNA, 201 bp, Homo sapiens
tccacatcctcttcaacactagttattgctcttctttttgattatagccatcctagtgggtgtgaagtggtatcactgaagttttttggggtttttttttktttttttttttttttttgagtctggatcttgctctatcacctaggctgaagtgcagtggcgccatctcagctcactgcaacctctgcctcccaggttcaa

SEQ ID NO: 15805 - DNA, 201 bp, Homo sapiens
aagactcgggattaagtctacgtaaaccagcttttcctgacggtgtgcccagggcccatttttcaagtcacaccaatcaattctcaatgagctgcctttgrgagggacatgcccagcaaccctggatgagactctccagccttggaggccccagccctgcccgaaggactcttgggtgttccctccttctgcctggttaga

SEQ ID NO: 15806 - DNA, 201 bp, Homo sapiens
tcaacgccagacttgaccccagtatcactgccatccgcagctctaaccccagctcccattcccatttctaactgactcttctgtcctcacgtccttctccrtgaggcccactgagggctgtgtggctctggtgggctgtgcacggctgtgtgtgtgcacatgcatgttcgcacaggttctggtcagccctggccagtagca

SEQ ID NO: 15807 - DNA, 201 bp, Homo sapiens
gcatgagtcggggaatcctccagtttttctgagcccagttccctgccatttccatcccatactcctcctcctgacctgccatcctgataatccctgtgctygggtgctgtgcctttgtgggattagcagcgcagcctggccaggcacagtggctcacacctgtagtcccaacactctgggaggccgaggcaggagtcgctt

SEQ ID NO: 15808 - DNA, 201 bp, Homo sapiens
gcctgggttacaaggacctgggtcccaattcctccaagacctatggcatcaagtggaagcgtcccacggtgagaggggccatcctgggtgggactcggctragccagatcctggatgaggagtagggatgggactccatgtccctggtggggaatggggtctggggtggcctggtgccaatttctgggaggggctggccga

SEQ ID NO: 15809 - DNA, 201 bp, Homo sapiens
gaaggcacgtcatcttactgagcctccgtttcctcacttgcaagatataggctgatctcttgaatttgctttgaggagtaaaatattaaatgtcctagtarattttaaagaggcatgcttgactcaccgtcttggggcctgagcccagggtgctcatgaggggcaaagatcttgtggccatccagccacctgcctgtcact

SEQ ID NO: 15810 - DNA, 201 bp, Homo sapiens
aggagcaggaggggaggtccaggcccttggaggcccctatgggagcagcactctggtttcccaggggtggaggaggtaagaaagtaacccctccatgaggytcctgaggtggctcctgagacgtggagttgggggctggacctggggtttgggtggggaagaagccagggagccatttctgcggccccagctgacctgcct

SEQ ID NO: 15811 - DNA, 201 bp, Homo sapiens
tgagcaggcttgatctcctggtctcaggtgagcctcccacctcagtgtctcaagtagctaggactacaggcacatgccaccatgcccagataatttttttkgggagggttggggggcagttgacggagtcgcgctctgtcgcccaggctggagtgcagtggcgcgatctccactcaccgcaacctctgcctcccaagttca

SEQ ID NO: 15812 - DNA, 201 bp, Homo sapiens
tatgtatctgggatgtagaatcctgcatctaggaaggtaggggtaaggatggagctcaggtccgggggattccaaagcaggtactcaccgtgcccctcccycacagctgtggcaatttggggagtgggtggacgtggtcgtggatgacctgctgcccatcaaggacgggaagctagtgttcgtgcactctgccgaaggcaa

SEQ ID NO: 15813 - DNA, 201 bp, Homo sapiens
ggctggtctcgatctcctgacctcaggtgatccgaccaccttggcctcccaaagtgctgggattacaggcgtgcgccactgtgccaggtcccttcttgccktctcttgccacctttccctgggcttctagatccatgtggctgatgtgggccacagcctggcctctcagttccttgtcactctcactgcagcacgcttttt

SEQ ID NO: 15814 - DNA, 201 bp, Homo sapiens
tagctaggactacaggcacatgccaccatgcccagataattttttttgggagggttggggggcagttgacggagtcgcgctctgtcgcccaggctggagtrcagtggcgcgatctccactcaccgcaacctctgcctcccaagttcaagcgattcttcttcctcagcctcccaagtagctgggattctaggtgtgcaccac

SEQ ID NO: 15815 - DNA, 201 bp, Homo sapiens
gggcaggaacgagattcccttttcagattagaaaagtgagactcaagccgggctcagtggctcacgcctgtaatcctagcactttgggaggttgaggcggkcggataacctgaggtcgggagtttgagaccagcctggccaacatggcaaaaccccgtctctactaaaaatacaaaaattagccgggcatggtggtgggca

SEQ ID NO: 15816 - DNA, 201 bp, Homo sapiens
gcaggcagaggacctggcgcccccgacccgcagtgcaggcgggcttccaccagggggcgccagggaccatgcccttccccacaaattcccctccactcccsccaccatcctgagggctgggaaatctcagcctccaggaggcacctgctgaggccctctggccgaaagagaggaagggggttggctcagggaagggagatt

SEQ ID NO: 15817 - DNA, 201 bp, Homo sapiens
ggggaatgacagatgggtgaattagcagatacaggccagtgctgtgggtgtgtgccagagaggcctgggtctgggtttggggggccctggctgagtgccargagagtcggggagggagggagttgacagtggcttctcaggcagcaggaaggggtgaagcttcccagcttcaaggggtgtcagcttgcggtactgtgggga

SEQ ID NO: 15818 - DNA, 201 bp, Homo sapiens
tttgagatagcccatgttatttggattacccacaaataaaagtatttttgttcagcattctcagacctttcatctgagatcattttccatccacccgaaayatatccttttgtatttcctttgttttgttttctttttgagcaggcttgatctcctggtctcaggtgagcctcccacctcagtgtctcaagtagctaggac

SEQ ID NO: 15819 - DNA, 201 bp, Homo sapiens
tatttcagggtgaaatactttgatttccttcaatacctagatacatgtatctagtatatctgtagcatacatgtatctagaggtacacatgcatctagtaygtatctagtatatgtgatttagtatacatgcatctactatgtatctggtatacctgacctagtatacatctagtatgtatctaatttacatgatttagtc

SEQ ID NO: 15820 - DNA, 201 bp, Homo sapiens
aaagacttttgtgttatatcctgtgggacaaattccactcctcccggaggtcggtctcagttgccccatctgagaaaggagtgttcgctggggaaaacagwtcagcacgtgtggccttctccacctgtcaagcctcctatcccccaactcctcctgcgctttggcaaggtctgactgagcccagcagaaaagaaagactcg

SEQ ID NO: 15821 - DNA, 201 bp, Homo sapiens
agggaacttgcctgaggccatacagtagggatccaaactcttgccttttttttttttttttttttgagagagtctcactctgtcacccaggctggagtgcratggcgtgatctcggctcactgcaacctccgtctcctgggttcaggtgattctcctgcctcagcctcctgagtagctgggattacaggcgcacgttacca

SEQ ID NO: 15822 - DNA, 201 bp, Homo sapiens
gtctggctctgtcacccaggctggagtgtggtggcgtgatctcagctcactgcaacctctgcctcctgggctcaagccatcctcccacctgagcttcccgwgtagctgagtggtactacaggtgcacaccaccatgcctggctaatttttgcacttttttggtagagatggggttttgctctgttacccaggctggtctca

SEQ ID NO: 15823 - DNA, 201 bp, Homo sapiens
aagggcttcagcctagagtcgtgccgcagcatggtgaacctcatggatgtatccttccgtttgcttttgtctcctgagtggggttttgggtggaggtatcrgtgctgggagaactgtcccaggacagcacagagaacaggacagagccatgcggagtgtggacacacagtgccccatgctcagatgtctccctggacgtct

SEQ ID NO: 15824 - DNA, 201 bp, Homo sapiens
ctacagagctgcaagcccctgacaatgggatccgggaaaggagaggtggccggcacgcctgggaactgggaaatccctttcctggattcactgggagcacygggaggtggctgagaaccctacttctgtgaggggagcagtgaggcagggaaaccctaggtttggggatggataagcaggggcaggagagcagagcttgca

SEQ ID NO: 15825 - DNA, 201 bp, Homo sapiens
ccttttccccacggttactagcaccctgcctagccccagccccctcctggggacccaacccctcccccatcctgttgggcaggggctgcgcctcactgacmttcactcactctcctggaccaggcttcaagctcaacaagaagctgtacgagctcatcatcacccgctactcggagcccgacctggcggtcgactttgaca

SEQ ID NO: 15826 - DNA, 201 bp, Homo sapiens
ttgatgaagtcactgatctatgaagtggcaaaactgggatttgaacccaggcagagggatcctgaagtctgttctctcagccagtacgctattctctgagyactagggggattgttctataattgtccattatatcaaacttattgttttgtctgcttaatctatcaattactgaaagaaagaaagaaagatgataaaaat

SEQ ID NO: 15827 - DNA, 201 bp, Homo sapiens
aagtcttccgtgaagaaggcaccgctgctcctttttatggatagggaaactgaggctcagaggcgataacttttccaggatcatgtagctagtatgtctcragcatacatgtacatatcaagtatacacatgtctatatgtggtatgcatgtattagtatacagcaaatatgcaggtatctagtatacattgtacaggcaa

SEQ ID NO: 15828 - DNA, 201 bp, Homo sapiens
ctgacctgctggctcactacagagctgcaagcccctgacaatgggatccgggaaaggagaggtggccggcacgcctgggaactgggaaatccctttcctgsattcactgggagcaccgggaggtggctgagaaccctacttctgtgaggggagcagtgaggcagggaaaccctaggtttggggatggataagcaggggcag

SEQ ID NO: 15829 - DNA, 201 bp, Homo sapiens
cagtgttattgaaacacatgcctaatctgcaatccggtgctcctctcctctaccctctgcagtgagtagggttgttacattttacagatgaggaaactgargcaaaatgtcttgttagggtcacacaggctgtgagtgagccatgccccagctctccagccccttggccaggacaaggagcctggagtctgggtctggggg

SEQ ID NO: 15830 - DNA, 201 bp, Homo sapiens
taaaacataaaaaaatttctaacttaattttctcatagtaaaaaaatgtgacctacataagatcatagctttgaagtgaacagaagctggtgctatggctyagtgtatgatgaattttcataaaggttccttcgttcttgaaaagactggctaacaaattgtgactgtaggtgaagcactcctaagtattttaaatatgat

SEQ ID NO: 15831 - DNA, 201 bp, Homo sapiens
actggttagtaacatttccactctcacctcgatatctccccactgttactctcaccttcgggcctggccttgcacttcactgaaaagatagacttcatccygcaggacaccttgtgttcccacctccaaatcccccagccttctgcacctgtgcctgtgtcctcatcgcctccccacctgcgacagtggcagaacagtccc

SEQ ID NO: 15832 - DNA, 201 bp, Homo sapiens
ttcagcccacggcaaggggccggtgcaccaggagcttggttagtttggggagggggttgcaggcctgtgaacaggatcaaagaggccttccctgctgtgtyccacctgcccagttccttgtgctgtctggaggctccgccctgccccacctgacctgctggctcactacagagctgcaagcccctgacaatgggatccggg

SEQ ID NO: 15833 - DNA, 201 bp, Homo sapiens
ttcacactcatttctttttactttggactaattgtggctgttgggactttggcttgattgctaaaatactttacttgtacttcctgatgatacaaacaatyctgcccacttcctctgccagatattgcacccactcgtcaggatttgtgcgtccttgactctgccccacccagtgctcccagcaggggcaggtgcaggaag

SEQ ID NO: 15834 - DNA, 201 bp, Homo sapiens
ttgtttgtttgtttattgagatggagtctcgctctgtcacccaggctggagtgcagtggccagatctcggctcactgcaacctctgtctcctgggttcacrcaattctcctacctcagccttccaggtagctgggattacaggcacctgccaccatggccacctaatttttgcatttttagtacagacggggtttcaccac

SEQ ID NO: 15835 - DNA, 201 bp, Homo sapiens
catcagcaaacgtgagtccccgcggggctgtcccaccaccccaccatttcttccacatcagaatccaggctcctgctcacacattgagctgaacctcatcycttggtctgcatgagtcggggaatcctccagtttttctgagcccagttccctgccatttccatcccatactcctcctcctgacctgccatcctgataatc

SEQ ID NO: 15836 - DNA, 201 bp, Homo sapiens; identical to SEQ ID NO: 1716

SEQ ID NO: 15837 - DNA, 201 bp, Homo sapiens
ggaattacctggtaggttgtccccactcacctcagtcatgcaggtgcgggccgggcaggtgggaagggccgggtgactcagcctggccctcaccctctgcygccacctcagtccatcttccggaagtttgacctggacaagtcgggcagcatgagtgcctacgagatgcggatggccattgagtcggcaggtgagactcca

SEQ ID NO: 15838 - DNA, 201 bp, Homo sapiens
atctgagaaaggagtgttcgctggggaaaacagatcagcacgtgtggccttctccacctgtcaagcctcctatcccccaactcctcctgcgctttggcaargtctgactgagcccagcagaaaagaaagactcgggattaagtctacgtaaaccagcttttcctgacggtgtgcccagggcccatttttcaagtcacacca

SEQ ID NO: 15839 - DNA, 201 bp, Homo sapiens
gggggttggctcagggaagggagattctgggattcacctcacgcttagagggcggcctgctgctcttggaggagggagctggctcagctgatgcctgggartactgagccctccgtcttggaagctgtgagcagaagctggcaggggaaagataggggatagggagggcctgtcggccaaggtgaggctgtgccagtcgct

SEQ ID NO: 15840 - DNA, 201 bp, Homo sapiens
gaggaagggggttggctcagggaagggagattctgggattcacctcacgcttagagggcggcctgctgctcttggaggagggagctggctcagctgatgcytgggagtactgagccctccgtcttggaagctgtgagcagaagctggcaggggaaagataggggatagggagggcctgtcggccaaggtgaggctgtgcca

SEQ ID NO: 15841 - DNA, 201 bp, Homo sapiens
ccacgactaccctagcagccagtgacccaggccccagggaggagcgggccaggtgggcggaggggatgggagctccctggagaggagcccatgtcccccgyctcagccagagcgagccgggttcaccacgtggctgggagggcttagagccaggagcccccgcaggcaagcacaggctcggaggccggggccgcacccgac

SEQ ID NO: 15842 - DNA, 201 bp, Homo sapiens
gggttcaccacgtggctgggagggcttagagccaggagcccccgcaggcaagcacaggctcggaggccggggccgcacccgacaggacgtagtcggcactyggcttctcgctgaccctgatcaggaaggcgcccgtggcgttgccctcggcctgcagccgacgcacagcttccgagcgggagatgcagccaaagaaccacc

SEQ ID NO: 15843 - DNA, 201 bp, Homo sapiens
gagagtggcgttcgccacatgataccccatgaggaaaacgccatcacaggtaaacaacaccgagcctcgtgagatggaggcggagctgggggagtccctcycagttctgtccccagacctcagctccaggctcagtgctgctggtctgtctccctgctgtctctagactccacacctgcaccctcactgtgggcagcgaca

SEQ ID NO: 15844 - DNA, 201 bp, Homo sapiens
cctctgcctcccaggttcaagtgattctcctgcctcagccccccgagtagatgggactacaggcacgcaccatcatgcccagctaaattttgtatttttttgtagagacagggtttcgccatgttggtcaggctggtttcgaattcctgacctcctgatccgcccgcctaggcctcccaaagtgctgggattacaggcgtg

SEQ ID NO: 15845 - DNA, 201 bp, Homo sapiens
agatgggcacaaagggcacggtggccgggttgtagccgatcttcttgatgtaggcgctgacttccttgacgatctcgtcgtagcgcttctcgctgtaggcyggctctgtggagtccattttgttcacgcccacgatgagctgcttcacacccagcgtgtaggccagcagggcatgctcccgcgtctgcccattcttggaga

SEQ ID NO: 15846 - DNA, 201 bp, Homo sapiens
tcccgtcccctcctctcctggtctcccgccccccccacctggcctcccgccccccctcacctggcctccagccccccccacctagcctcccgctccccccyccacctggcctcccaccccctcctcacctggcctcctccccacttctcacctgggcgagttctcaggactcagggtctttgcacctgggagctgaccagc

SEQ ID NO: 15847 - DNA, 201 bp, Homo sapiens
tgtcccgaaaggccaggacaggcccctgaggacccggcgggggcaggggcaggcgctaccacaccctgccctgagtggcccgagtctaggggtcagagcckagggtggagctggggagggcagctgagcaggatggctgcccagagctgcctgcacacacccatgtgtgacgcacgctcacacacacacagtcacaaaccc

SEQ ID NO: 15848 - DNA, 201 bp, Homo sapiens
gtgtatgtctgtgtgcatgtgtgtgtgcatgtgtgtctgtgcgtgtgtgtctctgtgtgtctgtgtctgtgtctgtgtgtgcatgtgtgtgtctgtgtgtstgtgtgtctacgtgtgtgtgtgtgtagacgtgggggggggtgtgcactttatttcctcacgtgcccccgctgcctccagcaagagccccggcccatgcca

SEQ ID NO: 15849 - DNA, 201 bp, Homo sapiens
cggctccacccgctggggagcgcccttcatgacggaaggccgctgacccgaggggctcctccacccccatgcgcagatcccaccagccagcaagctaaagyatggcggccatcccctccagcggctcgctcgtggccacccacgactactaccggcgtgagtagcccctgccccccatccacgcggatgctctgctggcgc

SEQ ID NO: 15850 - DNA, 201 bp, Homo sapiens
ccccaccccagggctgccctggacagcagccctccacagcccagcacaagaaaatggagcagacgggccggctgcccatcaatcagctattaatagtagcrtgtgccctggcagggccctaggacaagtgagggcagtaccatccccagccccagccttggccctggggggaagggggtaaggctccagcgccctccagcc

SEQ ID NO: 15851 - DNA, 201 bp, Homo sapiens
gtccagcagctccgaaacgggcaggactttctcatcagagtctgcagaggggagtggagcagagcctggggtcagctgagccagctgaggtggggaagggytggggaggctgggccatgtctcatctgcctccaagctctgcgggctcagaggaggggccggggcaaagggcagctggcctgattgaaaattggaactgca

SEQ ID NO: 15852 - DNA, 201 bp, Homo sapiens
gtgacagggtgaggccctgttggaaaacaaaaatgaggaagaacctatgtggttaatcactattcttgttccacttacataaataaccacaccaggtttamtgaggccaaacttactctgcaatcaaatcaatcttttattatctttgatagaaatgtgttaatttgaaaacaatcctacttttattatctttgatagaaa

SEQ ID NO: 15853 - DNA, 201 bp, Homo sapiens
tgtcgtcccagctactctggagggtggggctggaaggtggcttgagcccaggaggtcaaggcagcagtgaaccatgatggtaccactgcactccagcctcrgtgacagggtgaggccctgttggaaaacaaaaatgaggaagaacctatgtggttaatcactattcttgttccacttacataaataaccacaccaggttta

SEQ ID NO: 15854 - DNA, 201 bp, Homo sapiens
tcagattccttataaaaagttccagtaggccaggcacagtggctcacacctgtaatcccagcactttgggaggccacggtgggcagatcacgaggtcaggrgatcgagaccatcctggctaacacggtgaaaccccgtctctactaaaaataaaaaaattagccgggcatggtggcgggtgcctgtagtcccagctatgcg

SEQ ID NO: 15855 - DNA, 201 bp, Homo sapiens
taaggaactttcgctgagcacctgccccgtgccagatactggtccaagcacctgcaggaagcatcttaccctcaaggtggccacaggagttagctatgccygtctcacgcgcagggacactgaggaacaggcagccttggctgctgccccccggacttcacctgccacatcaggtgccgccggcatagcaggccttcatca

SEQ ID NO: 15856 - DNA, 201 bp, Homo sapiens
ggcggaatggctctgcccagtcaggcctggcccatgcccaagggcaccacagtccaacagccgcccgtgcccacggagaagtgggggttccacggagaagygctgctgttcagcacctgcagtggttgccaagcctgagctgcactcaggtgaaaaattgcctgcttatttaagtgttggccagatattttaacatcatta

SEQ ID NO: 15857 - DNA, 201 bp, Homo sapiens
aggggctctccctaatgaggcccgggggtgcaggcctcagggtggaaccccggaatctgctggtttccagtccctgtcctcacgtgcctgccctcctgggygcaccatgacaggccccgaggatccagcgcagaaccaccctccccctgagaggctggtctcccacggtgcagggaacgccggaagcccgctcccagaccc

SEQ ID NO: 15858 - DNA, 201 bp, Homo sapiens
gcatgcgggaggcgcgggctgcaaagacggacgcgggaggcgggggagaaacgcgccgcggcgggggcggggcggggggcagggcagggaggcggcgggarggagggaccgggacggagacggcgcggggagagcgcggcgggcccgggagacggggcgagagccggctcagggcaggaacacgcttgagccgcgaaaagc

SEQ ID NO: 15859 - DNA, 201 bp, Homo sapiens
gcgcgggggcgggtgcggggcccggccaccctctgccccccaggaccggccccgggggtccctcttcggaagacgggggcgggggcggaggcccgggggcsgagcgtccttacccggagccgaggtctcagccagagggactggcggcgccggcgccggcggttttatctccgggagggggtccacctattgacggtggcg

SEQ ID NO: 15860 - DNA, 201 bp, Homo sapiens
tcgctctacgagcgaagccgccagatgggataaacccctcccgggcgagggctcccctttatctgaagctgcggacgcccccagatcccttcctcaaccaraggccaataataccaccgtgtttggggctgtcagataaataaccctctgtgtgtgtgtgtttttttaaggtaaggagaaaggaaaactgaatgaggtcag

SEQ ID NO: 15861 - DNA, 201 bp, Homo sapiens
agtcgctcgctctacgagcgaagccgccagatgggataaacccctcccgggcgagggctcccctttatctgaagctgcggacgcccccagatcccttcctmaaccagaggccaataataccaccgtgtttggggctgtcagataaataaccctctgtgtgtgtgtgtttttttaaggtaaggagaaaggaaaactgaatga

SEQ ID NO: 15862 - DNA, 201 bp, Homo sapiens
ccccccagggccggcctccgcacctgctccgaaatgggcgcggctacgcaggtccaccagcaggtggcgcaagggcctgggagtcgctcgctctacgagcraagccgccagatgggataaacccctcccgggcgagggctcccctttatctgaagctgcggacgcccccagatcccttcctcaaccagaggccaataatac

SEQ ID NO: 15863 - DNA, 201 bp, Homo sapiens
ggtcaggggaccgaggttcagccctggctccaccaccagtgggctgtgtgtccctggacaagtcactcagcctatctgctcctgttcctcacttgaggacrgatagaagtcacagttatcaaagcagtttggaggtggtggcatgtgtcctgctgtctgcagggtgctgtgtctggggtgtccgtgcgtctctgtgagtgc

SEQ ID NO: 15864 - DNA, 201 bp, Homo sapiens
cccatcccatgaagcctccctctgggccacctgccacaaacagggagcaggggagggggccggcagcacagtgccccagccccccagggcctgtgtaagcrcgggccacctagcagctcaggccagaggggagtgcagggtccctgatggctggaggcctccctggggaggggagagtggcgttcgccacatgatacccca

SEQ ID NO: 15865 - DNA, 201 bp, Homo sapiens
cccactcccatcccatgaagcctccctctgggccacctgccacaaacagggagcaggggagggggccggcagcacagtgccccagccccccagggcctgtrtaagcacgggccacctagcagctcaggccagaggggagtgcagggtccctgatggctggaggcctccctggggaggggagagtggcgttcgccacatgat

SEQ ID NO: 15866 - DNA, 201 bp, Homo sapiens
cccccactcccatcccatgaagcctccctctgggccacctgccacaaacagggagcaggggagggggccggcagcacagtgccccagccccccagggcctrtgtaagcacgggccacctagcagctcaggccagaggggagtgcagggtccctgatggctggaggcctccctggggaggggagagtggcgttcgccacatg

SEQ ID NO: 15867 - DNA, 201 bp, Homo sapiens
gacttgactaggaggatgctgagtctggccaagggccaggccagggacagagctggaggagcctcgccccaccctagcttctggacaccgtgctgcctccragcttggcccagccttgtccggagcttctcctagtgtggcccccactcccatcccatgaagcctccctctgggccacctgccacaaacagggagcagggg

SEQ ID NO: 15868 - DNA, 201 bp, Homo sapiens
caaacttgcaggcgatgtgggctgtgtggcagtcgatgaccggggagtagccggcgctaatctgccccgggtggttcaggatgatgacctgcgagcggagscacaggcggccatcaggcacatcggcggtgggcaccgggagggcgccagagcggggctgggaggcccagtcaccggcgcccctgcacgggctcctgggcc

SEQ ID NO: 15869 - DNA, 201 bp, Homo sapiens
ctctggccgggcgggggcgcaaccgcgtcgggaatgtcctcggaacacgcttagcgcagagcgcgcccctgtgaagacggccggcctcgcgggagtcctgsctgggcggctgctccacggtctgcggggcggccacggggcgggggcagccctaacgctgccactgggcgaccgcgggccttcctcactcgcggggcctcc

SEQ ID NO: 15870 - DNA, 201 bp, Homo sapiens
gcggaggtgcagacatgcgcctggcgggggtgcggggcgccggaccggcgcgcggggcgggggcggggcgggggcccgggcccggggttcggagcgcggcrccgccggggagggtcgcgccgcgggcgcccgcgcttcacttgcccgccttctgcgccttctgcgccgacttggtgaccttgccggcgccgccgctcttct

SEQ ID NO: 15871 - DNA, 201 bp, Homo sapiens
acttccactggaccttgatggcgagcatccagtcgctgaccgagggcctctggcaagcggaggtgcagacatgcgcctggcgggggtgcggggcgccggascggcgcgcggggcgggggcggggcgggggcccgggcccggggttcggagcgcggcaccgccggggagggtcgcgccgcgggcgcccgcgcttcacttgcc

SEQ ID NO: 15872 - DNA, 201 bp, Homo sapiens
ctgtggagtccattttgttcacgcccacgatgagctgcttcacacccagcgtgtaggccagcagggcatgctcccgcgtctgcccattcttggagatgccygcctcgaactcgcccacgcccgccgccacgatcagcactgcgcagtccgcctgcccggcaggggacacagtgagccctgccccgcctgcctggcagggga

SEQ ID NO: 15873 - DNA, 201 bp, Homo sapiens
gtggcgcaagggcctgggagtcgctcgctctacgagcgaagccgccagatgggataaacccctcccgggcgagggctcccctttatctgaagctgcggacscccccagatcccttcctcaaccagaggccaataataccaccgtgtttggggctgtcagataaataaccctctgtgtgtgtgtgtttttttaaggtaagga

SEQ ID NO: 15874 - DNA, 201 bp, Homo sapiens
ctaatctgccccgggtggttcaggatgatgacctgcgagcggagccacaggcggccatcaggcacatcggcggtgggcaccgggagggcgccagagcgggrctgggaggcccagtcaccggcgcccctgcacgggctcctgggcccggagtgctgactggagggggctcaggctctgaggacccagcccccagacctgaac

SEQ ID NO: 15875 - DNA, 201 bp, Homo sapiens
gcaaacttgcaggcgatgtgggctgtgtggcagtcgatgaccggggagtagccggcgctaatctgccccgggtggttcaggatgatgacctgcgagcggasccacaggcggccatcaggcacatcggcggtgggcaccgggagggcgccagagcggggctgggaggcccagtcaccggcgcccctgcacgggctcctgggc

SEQ ID NO: 15876 - DNA, 201 bp, Homo sapiens
gctctggccgggcgggggcgcaaccgcgtcgggaatgtcctcggaacacgcttagcgcagagcgcgcccctgtgaagacggccggcctcgcgggagtcctscctgggcggctgctccacggtctgcggggcggccacggggcgggggcagccctaacgctgccactgggcgaccgcgggccttcctcactcgcggggcctc

SEQ ID NO: 15877 - DNA, 201 bp, Homo sapiens
tgtgtgcatgtgtgtctgtgcgtgtgtgtctctgtgtgtctgtgtctgtgtctgtgtgtgcatgtgtgtgtctgtgtgtctgtgtgtctacgtgtgtgtgygtgtagacgtgggggggggtgtgcactttatttcctcacgtgcccccgctgcctccagcaagagccccggcccatgccactcaccgcggagcagctccag

SEQ ID NO: 15878 - DNA, 201 bp, Homo sapiens
gtgtgtgtctgtgtgtgcatgtgtatgtctgtgtgcatgtgtgtgtgcatgtgtgtctgtgcgtgtgtgtctctgtgtgtctgtgtctgtgtctgtgtgtrcatgtgtgtgtctgtgtgtctgtgtgtctacgtgtgtgtgtgtgtagacgtgggggggggtgtgcactttatttcctcacgtgcccccgctgcctccagc

SEQ ID NO: 15879 - DNA, 201 bp, Homo sapiens
gaagtgccagtctgaagccagcacagggagcctggatttagcctcagatttagggccacgatcagcctgggttgggggtttctgagtgtctgacacaaggstggactctcctgggggctgcccccagcccagcatgaaacacccagacagaccggagccaggaccctgcagagtgccgctggcctctccgagagtggccag

SEQ ID NO: 15880 - DNA, 201 bp, Homo sapiens
tggggcaggggctcaggctcgtgctggaggaagagtcggggacacagggcaggggctcatccttcaggaagtgccagtctgaagccagcacagggagcctrgatttagcctcagatttagggccacgatcagcctgggttgggggtttctgagtgtctgacacaagggtggactctcctgggggctgcccccagcccagca

SEQ ID NO: 15881 - DNA, 201 bp, Homo sapiens
cccaaagtagccggaccccagcttcctgcagagcgtgaactcctccctcggcctctcccagtcatcccaatggggcaggggctcaggctcgtgctggaggragagtcggggacacagggcaggggctcatccttcaggaagtgccagtctgaagccagcacagggagcctggatttagcctcagatttagggccacgatca

SEQ ID NO: 15882 - DNA, 201 bp, Homo sapiens
cccggtctttccagagcccctcgaagacctccccaaagtagccggaccccagcttcctgcagagcgtgaactcctccctcggcctctcccagtcatcccartggggcaggggctcaggctcgtgctggaggaagagtcggggacacagggcaggggctcatccttcaggaagtgccagtctgaagccagcacagggagcct

SEQ ID NO: 15883 - DNA, 201 bp, Homo sapiens
ggcttgggctgagcccagccctgcggcgttcgtcttggggcggcccggccggtcctgggtctgcaggggttaaaaggccccgcgcccgggtccgggagccrggaacaaaggcgctttgtgcgcggggccccggcccagacgtcgggaacctggtgggcgccgtcccaacccgcccgacccgagaggagcccgccggggacc

SEQ ID NO: 15884 - DNA, 201 bp, Homo sapiens
gagtagcccctgccccccatccacgcggatgctctgctggcgccagtgccggccccgtgcaggctgcggaaccagcgctcggcctgaaggccggtgggctrgggggctccgcgccccgcgttgctgacgggacctctcctctccaggccgcctgggttccacttccagcaacagctcctgcagcagtaccgagtgccccgg

SEQ ID NO: 15885 - DNA, 201 bp, Homo sapiens
aatggctgaatccctcccgacctcactgccttgtgggggctggccctgctcccaggcctttctgggcctcctcacgctgtgaggctgttgctggggctgakaagggtggggttcactgctgcttctggagagccttggacagcaggcagtcctggagctggacaagcaggacccagggcagccactgaggtgggcccccgt

SEQ ID NO: 15886 - DNA, 201 bp, Homo sapiens
gccactgaggtgggcccccgtgccacctttagcggggggaaagggagcagggagggctggtcctctgagggattcaggccccttacccgagggcctgcggkgcggggagtagcctctggctgtgagctgggaagccctcactctggagggacctggttcctgctggtaggtgtctcccaagggcctcccataggggtgttg

SEQ ID NO: 15887 - DNA, 201 bp, Homo sapiens
cactgaggtgggcccccgtgccacctttagcggggggaaagggagcagggagggctggtcctctgagggattcaggccccttacccgagggcctgcggggsggggagtagcctctggctgtgagctgggaagccctcactctggagggacctggttcctgctggtaggtgtctcccaagggcctcccataggggtgttgcc

SEQ ID NO: 15888 - DNA, 201 bp, Homo sapiens
tggtgagaggaggggcctccgtggggtgggaaagggtggggttcagtggtgggggagggactctggggaggggtggggatcagtgggtgctccctgcctgktaccctgttccactgcactataaatagctgtactagttggtgggaagctggtgggaaggcatctggcttgtggcctctgatggctgagcctttgtcctgt

SEQ ID NO: 15889 - DNA, 201 bp, Homo sapiens
acagggtggaggcagcctcacccagccatccaagccggtggtcagtgctgaggctgggtgggggagcctccgatggacccaggagtgggaggctgctcctratggcagttgagccccctgcagccttttgcagtgtccagatgaagcccacagagaccctcctccatgtacacacagctgtgagggtagcaggagttggtg

SEQ ID NO: 15890 - DNA, 201 bp, Homo sapiens
ctggcttttggagtcagcgggggaggggcactgcccgggagctggtgtcttgttggaaggggcagctgggagtagggagcagccgagccacaggctgcccrcggcatcgtcccctgcctcgggtcagggggccccttgactggaggacctcacaaccctgggggtgtccatggcctgttcctgggagctgcaccctcatca

SEQ ID NO: 15891 - DNA, 201 bp, Homo sapiens
accaggatggacttgatctcttgacctcgtgatctgcccgcctcggcctctcaaagtgctgggattacaggcgtgagccactgcgcccagcctgagggtcyggttttctccccacgccaggccacctgccgacagcagcctcacccaggacagtcctgctgctgtccagcaggcgccagccccctggacccagcgcagccc

SEQ ID NO: 15892 - DNA, 201 bp, Homo sapiens
gtctgcgcgtgaccctgctaacgaggtcgtgggtctgcacgtaatagaggggtctccaccatgggcccctgcccgacggcctctttacagcctcccctgcktgttgcttgggtcccccgggagctaaccctacacagcctgtgactcacgcacacacacagtgggtgcccaatcactgatgagaaacgcgggatctcagga

SEQ ID NO: 15893 - DNA, 201 bp, Homo sapiens
gcgtgaccctgctaacgaggtcgtgggtctgcacgtaatagaggggtctccaccatgggcccctgcccgacggcctctttacagcctcccctgcttgttgyttgggtcccccgggagctaaccctacacagcctgtgactcacgcacacacacagtgggtgcccaatcactgatgagaaacgcgggatctcaggagcgtga

SEQ ID NO: 15894 - DNA, 201 bp, Homo sapiens
attatttaacaggctcatagatttctgggcagcccagctcagcgctgaccaaggtggggaggggcagcggggtgccggcctgggcagtgtccctcaggccstcccagctctgtctggggtcggttggggaggatgcagggggaggggtggggggtggggaatgcggaaggagggtgccggggcacctggccgggcagcgtc

SEQ ID NO: 15895 - DNA, 201 bp, Homo sapiens
caggtggccagggtcccaaaggctcagataaagcctcttgcctccaccatctgcaggggtcctggttcctgctgcttccctccgcttggccttgttcctcygatgcacgggccccaggaagcccccgcgctgcctccgttctcggagcctccgagtggcctcttccttccccggggccacctgtctctgcacacgggagtc

SEQ ID NO: 15896 - DNA, 201 bp, Homo sapiens
tgcttccctccgcttggccttgttcctccgatgcacgggccccaggaagcccccgcgctgcctccgttctcggagcctccgagtggcctcttccttccccrgggccacctgtctctgcacacgggagtctcatctcttagctccctcctgagccaggctttggccggggcctgtggacggcagccatcagcacttcggctc

SEQ ID NO: 15897 - DNA, 201 bp, Homo sapiens
caaagcccaggagtggcggcagacgcagggcccggccctcgggggctgcaggagacagcgcggggtcttttagggcacggggccaacggccggtgaggccrgcgtccacccacgtcaccttcccccatgcctcagcctcctcatctctaagacgtggcgaggatggcatggccggctaaggccacgggaagccccaagtga

SEQ ID NO: 15898 - DNA, 201 bp, Homo sapiens
ctcaggccttgcccagctggatgccagaccaaggcagccgctcagagcagccgcactgggcatctggactaggcgcctctgcaacccctgctcacctgccytcacccagagctcctggagcgtgggcccctgtctcagcccccagtcccagcccctgctcacctgccttcacccagagctcctggagcgtgggcccgtctc

SEQ ID NO: 15899 - DNA, 201 bp, Homo sapiens
gcccccagtcccagcccctgctcacctgccttcacccagagctcctggagcgtgggcccgtctcagcccccagcccctgctcacctgccctcacccagagytcctggagcatgggcccctgtctcagcccccagcccccagcccctgctcacctgccgtcacccagagctcctggagctcctgtcatctggtgcctcccag

SEQ ID NO: 15900 - DNA, 201 bp, Homo sapiens
ccagcccctgctcacctgccttcacccagagctcctggagcgtgggcccgtctcagcccccagcccctgctcacctgccctcacccagagttcctggagcrtgggcccctgtctcagcccccagcccccagcccctgctcacctgccgtcacccagagctcctggagctcctgtcatctggtgcctcccagcccccagccc

SEQ ID NO: 15901 - DNA, 201 bp, Homo sapiens
agcccccagcccctgctcacctgccgtcacccagagctcctggagctcctgtcatctggtgcctcccagcccccagcccctgccctccaagcagtgaccgmtccatgaacactggactccctgtgtgagggcgggagggcctggccagccaggcagggtcctggaggaaccgcctgctgggtgtccagctggtgcagctga

SEQ ID NO: 15902 - DNA, 201 bp, Homo sapiens
tgaatgaatgcgtggatgaacgaatgaatgaacagatagccacggacatgcgatttccaactcaaaatcctgccgttgttctggactccccagctgggggygaggcaggctctgactccgaggccgaggtactcacggttggtctgagagcgtctcaggagaagccttggccacgtgggtgatgggcacgagcccggcgct

SEQ ID NO: 15903 - DNA, 201 bp, Homo sapiens
gcggaatggctctgcccagtcaggcctggcccatgcccaagggcaccacagtccaacagccgcccgtgcccacggagaagtgggggttccacggagaagcrctgctgttcagcacctgcagtggttgccaagcctgagctgcactcaggtgaaaaattgcctgcttatttaagtgttggccagatattttaacatcattaa

SEQ ID NO: 15904 - DNA, 201 bp, Homo sapiens
gcctggccccagttcagggggatgagcacacggagaaggggcggcgggtgagtccctggctggggacctcccaccctctccctggacagcgccaagccccsgcatgctgaagcaaactctgcccgctcaggtaggtccccagatcggggcaggactgggggagcaaatcccagcaaaacccagcagcacggtacagggtcc

SEQ ID NO: 15905 - DNA, 201 bp, Homo sapiens
aactcttggcctcaagcgatcctcctgcctcccaaagtgctgggactacaggtgtggctaccagctctcccaaatcctccctaggacgtgactcttccccsctagaacgccaaggccgcagagccccagggaggcctcctcaggccatggaaagctcctgtgcccaccacaccagggtcagatgttcagggcactgaatgc

SEQ ID NO: 15906 - DNA, 201 bp, Homo sapiens
cggccccgcatgcccagctgccctgtcccgctgccctccaagttgtgcccgcccgtccaccccttcctcacctcacccaccaggcgcaacacagcccagcrtagggcccctgccaggtgtcggtgtcagcagccccttccctgcctgctgtgccccccccacatgacctcacctcctccctcagccctaaccgggtgggtg

SEQ ID NO: 15907 - DNA, 201 bp, Homo sapiens
tgtcccacagaaagtgtgtggtaaggggagagattggagacagcccagtcttgagatgccttgtaggggcccctggtctagggcaggcagagctggccagkcaggagctccagcacagcgcccttgctcaccgccaatcttgtacacgtcctgcagcggcaggcgcaggggcttgtccgtggggcgcgtggggggcaggat

SEQ ID NO: 15908 - DNA, 201 bp, Homo sapiens
ccagcagggacacgccgcttgcgttgccctccttacgctccaccttccagcccttgaaccacggcatctggaccaaagggagaaaatcaatccgttaagaracattggtggcctccccaccctcaggcctccccagggtgcttccaggagtactgctgttcaggctaaacttgcctcgtgccctttgagatgaggaatttc

SEQ ID NO: 15909 - DNA, 201 bp, Homo sapiens
tcatgttcttgatgaagtcgcggtggccgggggcatcgatgatggtgatgtagtacttggtggtctcgaacttccagagggagatgtcgatggtgatgccrcgctcacgctccgccttcagcttgtccagcacccaggcatacttgaaggatcccttccccatctggagcgggtgagggtcacggctgagggcgggacccg

SEQ ID NO: 15910 - DNA, 201 bp, Homo sapiens
gtgccctgctcacctgggatgtacccgtgatcatgttcttgatgaagtcgcggtggccgggggcatcgatgatggtgatgtagtacttggtggtctcgaayttccagagggagatgtcgatggtgatgccgcgctcacgctccgccttcagcttgtccagcacccaggcatacttgaaggatcccttccccatctggagcg

SEQ ID NO: 15911 - DNA, 201 bp, Homo sapiens
ccagagcactggattcatccttaggggggctctgagccagactgggtgagggtggcccaggtgaggggtcccctgccctcacaggaagcacaggagacccyaccatcccagtgaccccaggggcccccagtgtcccttgaagggtgcagcggcctctcccccagccccgcctgctgtgccctgctcacctgggatgtaccc

SEQ ID NO: 15912 - DNA, 201 bp, Homo sapiens
agatgccagagcactggattcatccttaggggggctctgagccagactgggtgagggtggcccaggtgaggggtcccctgccctcacaggaagcacaggasaccccaccatcccagtgaccccaggggcccccagtgtcccttgaagggtgcagcggcctctcccccagccccgcctgctgtgccctgctcacctgggatg

SEQ ID NO: 15913 - DNA, 201 bp, Homo sapiens
ccccagggaagcgcgtgggccttgatcccaggtccaggccctctgcccaggcccctcctcagcagggcccggccatgcccgctccacagcagctcaggtcrggttctcgtagctggtgaagctggagagcctctcccgcagggccttgaagcagggtctctgctcggggtccctgcaccagcatgtcagcatcagcttgtg

SEQ ID NO: 15914 - DNA, 201 bp, Homo sapiens
agtctcccggatctcatctgcaggctccagagcaggctgcgtgtcagcagctgagacccaaggcacacacgatggagtaaggagaggagcacacgcgtgtrttggacgcagacactccacatttgtgaacctttcctgcacccatcacctcagtaaaccccagggaagcgcgtgggccttgatcccaggtccaggccctct

SEQ ID NO: 15915 - DNA, 201 bp, Homo sapiens
acctccctgcccagcctgggctcccgagggcaggggccgcatcctgctcccagccgagtccccagctccacacacaggaagcccccagccctccggccacrccccggccacgaccccagccacgccctctgagggccctaccttgataagcctggctaacccgaagtccccaactttgcagagggtgttttccccgacgag

SEQ ID NO: 15916 - DNA, 201 bp, Homo sapiens
gtctgtgtgtctgtgtgtctacgtgtgtgtgtgtgtagacgtgggggggggtgtgcactttatttcctcacgtgcccccgctgcctccagcaagagccccrgcccatgccactcaccgcggagcagctccagcaggctgcccttggccatgagctccgtgatgatgtacacggggtcccccacggacaccacggcgtacag

SEQ ID NO: 15917 - DNA, 201 bp, Homo sapiens
cgtacagcgccaggatgtgtttgtgccgcagcttcttcatggcctggatctccgactgcagcatctgctggtgcaggaggttgtctgcggggacgggtggsctcggtggatgcagcccctgaccccccaggccccaaggaagaggccaaggccctgcccccacacacagcagccatcacacccagcagctgtgcaggacac

SEQ ID NO: 15918 - DNA, 201 bp, Homo sapiens
ttgaaagggaaccactctcgcatggacgctgtgggtgctgcttggggctcgaggccagaggtccctgttggcggggtgggagggtggcccagggcaggcayggggccacacagagccctgatcggggcccactcacctcgagaaatcaccttaatggccacctggacccggtctttccagagcccctcgaagacctcccca

SEQ ID NO: 15919 - DNA, 201 bp, Homo sapiens
tgctggaggaagagtcggggacacagggcaggggctcatccttcaggaagtgccagtctgaagccagcacagggagcctggatttagcctcagatttaggrccacgatcagcctgggttgggggtttctgagtgtctgacacaagggtggactctcctgggggctgcccccagcccagcatgaaacacccagacagaccgg

SEQ ID NO: 15920 - DNA, 201 bp, Homo sapiens
ccagggcaggcacggggccacacagagccctgatcggggcccactcacctcgagaaatcaccttaatggccacctggacccggtctttccagagcccctcraagacctccccaaagtagccggaccccagcttcctgcagagcgtgaactcctccctcggcctctcccagtcatcccaatggggcaggggctcaggctcgt

SEQ ID NO: 15921 - DNA, 201 bp, Homo sapiens
tgcccggccaacctctcccagtaggaaatgccagcctgtgaccccccagcctgaccccgcgtgaccaagtcagggcggagcggctaccttccggcagggcrcggccagccgcaggccgtgggacaggctctgggccctgtggtagttcacaagctcgggcaggctgaggaaggacaccgcctcgttcaggtgcagccggcc

SEQ ID NO: 15922 - DNA, 201 bp, Homo sapiens
accacggcatctggaccaaagggagaaaatcaatccgttaagagacattggtggcctccccaccctcaggcctccccagggtgcttccaggagtactgctrttcaggctaaacttgcctcgtgccctttgagatgaggaatttccccaccctgctcctccccagcccatagccccagcatcacagggactctgggaaggag

SEQ ID NO: 15923 - DNA, 201 bp, Homo sapiens
cggcgctaatctgccccgggtggttcaggatgatgacctgcgagcggagccacaggcggccatcaggcacatcggcggtgggcaccgggagggcgccagarcggggctgggaggcccagtcaccggcgcccctgcacgggctcctgggcccggagtgctgactggagggggctcaggctctgaggacccagcccccagacc

SEQ ID NO: 15924 - DNA, 201 bp, Homo sapiens
ctgccggtgcctcgctctgggccagggggtccagccagctcccgtggcccgccccgccctagccgccactcacgttgggggagggctccagcatgttgtcrccgtgccagccggagatgggcacaaagggcacggtggccgggttgtagccgatcttcttgatgtaggcgctgacttccttgacgatctcgtcgtagcgct

SEQ ID NO: 15925 - DNA, 201 bp, Homo sapiens
aggtttcgaggggaacctgcatttcccggggacaggccctcgacctccccgtgccacctgccggtgcctcgctctgggccagggggtccagccagctcccstggcccgccccgccctagccgccactcacgttgggggagggctccagcatgttgtcgccgtgccagccggagatgggcacaaagggcacggtggccgggt

SEQ ID NO: 15926 - DNA, 201 bp, Homo sapiens
catgccctcagccacctggcaggcaaagcccaggagtggcggcagacgcagggcccggccctcgggggctgcaggagacagcgcggggtcttttagggcayggggccaacggccggtgaggccggcgtccacccacgtcaccttcccccatgcctcagcctcctcatctctaagacgtggcgaggatggcatggccggcta

SEQ ID NO: 15927 - DNA, 201 bp, Homo sapiens
cacgagcacgttccgggcggccaagtcccggtgcacaacgcgctgctcctccaggtagctcatgccctcagccacctggcaggcaaagcccaggagtggcrgcagacgcagggcccggccctcgggggctgcaggagacagcgcggggtcttttagggcacggggccaacggccggtgaggccggcgtccacccacgtcac

SEQ ID NO: 15928 - DNA, 201 bp, Homo sapiens
tgggtcaggggcccagagcctccgctgaccttgagcagccgggccaggccgaagtcagccaccttgcaggccaggccgtcgtccacgagcacgttccgggyggccaagtcccggtgcacaacgcgctgctcctccaggtagctcatgccctcagccacctggcaggcaaagcccaggagtggcggcagacgcagggcccgg

SEQ ID NO: 15929 - DNA, 201 bp, Homo sapiens
gcccagagcgttgggtcacgtgaggactcaggggtggcatctgtggatggcgtgcagcttctcccgcagcgtggcgaaggagggccgttcctcggggctgstcctccagcactccagcatgagcacgtagacctccgccgggcaggcagccgggcgcggcagccggtaccctcgcatgatctgctgcagcgtctcgtggtt

SEQ ID NO: 15930 - DNA, 201 bp, Homo sapiens
cccaccttcatagggacactggccataggtgaaaacctcgtgcagcaggacgccgaaggaccagacgtctgacttctgggagaagacacgataattggccrcctcaggcgctgtccacttgaccgggatcttggagctgctgctcggggagtagatgtcgtcctgggggcgagggaaggcccctggtagggcaggtggacc

SEQ ID NO: 15931 - DNA, 201 bp, Homo sapiens
gaaggggctgcaaggctcggcggggagcgtgggcactgggtcagtgttggggtccagggacccgggggtgccatggtccggctcgccgcccgccggccagrtcttgtcccagaagaaggacaggaaggccagccgcctcctgaggaacggctccatcccccggggtcaccacgctgggcccgagggccatgggagcccgcg

SEQ ID NO: 15932 - DNA, 201 bp, Homo sapiens
atggtccggctcgccgcccgccggccagatcttgtcccagaagaaggacaggaaggccagccgcctcctgaggaacggctccatcccccggggtcaccacrctgggcccgagggccatgggagcccgcgagcccggaagaggaactggcagggccggtgggacccggtgtccagcgctccctgccctggccgtggggtgac

SEQ ID NO: 15933 - DNA, 201 bp, Homo sapiens
acatcactgccctggggcttgagggttggacagcaggtgcggggcccggccgtggcgcaggatctcggggcctcacctgacttgatgaccttgatcgccaygggcagggagcccagccacaggccttcccacacctccccaaagtagccttcacccagcttcctcccaagggcgaattcggagtgtggccgctcccacacg

SEQ ID NO: 15934 - DNA, 201 bp, Homo sapiens
ggatgagccgctcgtgccgcaggcccttcagtgtctggatctccttggcgaggtcagtgagcttcatgttggctgcgagagagggtgtggctccaggaccrgcccacgccacgaacatcactgccctggggcttgagggttggacagcaggtgcggggcccggccgtggcgcaggatctcggggcctcacctgacttgatg

SEQ ID NO: 15935 - DNA, 201 bp, Homo sapiens
ggccacgtggcagcagggaggggactcactgcccaggaaggcctgcaggttccccttgcgcatgagttccgtgacgatgtacacaggctccccgcccgagyacactgcgtgcagccggatgagccgctcgtgccgcaggcccttcagtgtctggatctccttggcgaggtcagtgagcttcatgttggctgcgagagaggg

SEQ ID NO: 15936 - DNA, 201 bp, Homo sapiens
gaaggggcggtcgcaggcgcgtcagggccacgtggcagcagggaggggactcactgcccaggaaggcctgcaggttccccttgcgcatgagttccgtgackatgtacacaggctccccgcccgagcacactgcgtgcagccggatgagccgctcgtgccgcaggcccttcagtgtctggatctccttggcgaggtcagtga

SEQ ID NO: 15937 - DNA, 201 bp, Homo sapiens
actcacggttggtctgagagcgtctcaggagaagccttggccacgtgggtgatgggcacgagcccggcgctgggctggcccgaaagcctgcgtgcgaagaygtagccgcccccctcttcgagggcacagagcctgtccccgcggcggacactcagctccccgccacaccgcgccgtgaagtcatagagcgcaaggaagagc

SEQ ID NO: 15938 - DNA, 201 bp, Homo sapiens
gcccggcgctgggctggcccgaaagcctgcgtgcgaagatgtagccgcccccctcttcgagggcacagagcctgtccccgcggcggacactcagctccccrccacaccgcgccgtgaagtcatagagcgcaaggaagagctgagggaaggggctgcaaggctcggcggggagcgtgggcactgggtcagtgttggggtcca

SEQ ID NO: 15939 - DNA, 201 bp, Homo sapiens
gcctgcgtgcgaagatgtagccgcccccctcttcgagggcacagagcctgtccccgcggcggacactcagctccccgccacaccgcgccgtgaagtcatasagcgcaaggaagagctgagggaaggggctgcaaggctcggcggggagcgtgggcactgggtcagtgttggggtccagggacccgggggtgccatggtccg

SEQ ID NO: 15940 - DNA, 201 bp, Homo sapiens
ctccacctcctgggttcaagcgattctcctgcctcagcctcctgagtagctgggactacaggcgcccaccaccacgtccagctaattttttttttttttttgagacagagtctcgctctgtcgcccaggctggagtgcagtggcgtgatctcggctcactgcaagctccaccttccaggttcacgccattctcctgcctca

SEQ ID NO: 15941 - DNA, 201 bp, Homo sapiens
gtggatgaatggatgaatgaatgagtgaattagtgagtgaggaatgaacgagtgaatgagatgaatggatgaatgaatgaatgagtgaattagtgagtgaggaatgaatgaacaagtgaatgagtgactgaatgaatgagtgggtgaatgactgaatgaatgaataaatgggtgagttagcaagtgcaggaggtgaccagc

SEQ ID NO: 15942 - DNA, 201 bp, Homo sapiens
agtggatgaatggatgaatgaatgagtgaattagtgagtgaggaatgaacgagtgaatgagatgaatggatgaatgaatgaatgagtgaattagtgagtgaggaatgaatgaacaagtgaatgagtgactgaatgaatgagtgggtgaatgactgaatgaatgaataaatgggtgagttagcaagtgcaggaggtgaccag

SEQ ID NO: 15943 - DNA, 201 bp, Homo sapiens
gagtggatgaatggatgaatgaatgagtgaattagtgagtgaggaatgaacgagtgaatgagatgaatggatgaatgaatgaatgagtgaattagtgagtgaggaatgaatgaacaagtgaatgagtgactgaatgaatgagtgggtgaatgactgaatgaatgaataaatgggtgagttagcaagtgcaggaggtgacca

SEQ ID NO: 15944 - DNA, 201 bp, Homo sapiens
tgagtggatgaatggatgaatgaatgagtgaattagtgagtgaggaatgaacgagtgaatgagatgaatggatgaatgaatgaatgagtgaattagtgagtgaggaatgaatgaacaagtgaatgagtgactgaatgaatgagtgggtgaatgactgaatgaatgaataaatgggtgagttagcaagtgcaggaggtgacc

SEQ ID NO: 15945 - DNA, 201 bp, Homo sapiens
gtaggcacttaataaatacttgtagaatgaatgagtccatgagtcagtgaatgaatgaaggaataaggaaggaaagaaggaaaagtgaatgaatgaatgaacgaataagcaaatgagtgaaagaataagctagtgaacaaatcagtgaataaatgagtgaattagtgagtgacgaatgaacgagtgaatgagtggatgaat

SEQ ID NO: 15946 - DNA, 201 bp, Homo sapiens
agtaggcacttaataaatacttgtagaatgaatgagtccatgagtcagtgaatgaatgaaggaataaggaaggaaagaaggaaaagtgaatgaatgaatgaacgaataagcaaatgagtgaaagaataagctagtgaacaaatcagtgaataaatgagtgaattagtgagtgacgaatgaacgagtgaatgagtggatgaa

SEQ ID NO: 15947 - DNA, 201 bp, Homo sapiens
gagtaggcacttaataaatacttgtagaatgaatgagtccatgagtcagtgaatgaatgaaggaataaggaaggaaagaaggaaaagtgaatgaatgaatgaacgaataagcaaatgagtgaaagaataagctagtgaacaaatcagtgaataaatgagtgaattagtgagtgacgaatgaacgagtgaatgagtggatga

SEQ ID NO: 15948 - DNA, 201 bp, Homo sapiens
agagtaggcacttaataaatacttgtagaatgaatgagtccatgagtcagtgaatgaatgaaggaataaggaaggaaagaaggaaaagtgaatgaatgaatgaacgaataagcaaatgagtgaaagaataagctagtgaacaaatcagtgaataaatgagtgaattagtgagtgacgaatgaacgagtgaatgagtggatg

SEQ ID NO: 15949 - DNA, 201 bp, Homo sapiens
agctgaccagcctccggccagaccccacccctgcacccctgctcactaacgaggtcgtgggtctgcgcgtgaccctgctaacgaggtcgtgggtctgcacrtaatagaggggtctccaccatgggcccctgcccgacggcctctttacagcctcccctgcttgttgcttgggtcccccgggagctaaccctacacagcctg

SEQ ID NO: 15950 - DNA, 201 bp, Homo sapiens
cagggtctttgcacctgggagctgaccagcctccggccagaccccacccctgcacccctgctcactaacgaggtcgtgggtctgcgcgtgaccctgctaaygaggtcgtgggtctgcacgtaatagaggggtctccaccatgggcccctgcccgacggcctctttacagcctcccctgcttgttgcttgggtcccccggga

SEQ ID NO: 15951 - DNA, 201 bp, Homo sapiens
ttttattatctttgatagaaatgtgttaatttgaaaacaatcctacttttattatctttgatagaaatgcgttaatttgcagccggtcacggtggctcacwcctgtaatcccagcactttgggaagccgaggtgggcggatcacctgaggtcaggagttcgagaccagcctggccaacatggcaaaaccctatctctacta

SEQ ID NO: 15952 - DNA, 201 bp, Homo sapiens
gggcatggtggcgggtgcctgtagtcccagctatgcgggaggctgaggcagaagaatggcatgaacccgggagacggagcttgcagtgagccgagatcgcrccactgcactccagcctgggcgacagagcaagactccgtctcaggaaaaaaaaaaaaaaaagttccagtaaagcaaattttaaaagagcccacgtgtcca

SEQ ID NO: 15953 - DNA, 201 bp, Homo sapiens
ccgggcatggtggcgggtgcctgtagtcccagctatgcgggaggctgaggcagaagaatggcatgaacccgggagacggagcttgcagtgagccgagatcrcgccactgcactccagcctgggcgacagagcaagactccgtctcaggaaaaaaaaaaaaaaaagttccagtaaagcaaattttaaaagagcccacgtgtc

SEQ ID NO: 15954 - DNA, 201 bp, Homo sapiens
caagaggcttttaaaagcccaatctcagattccttataaaaagttccagtaggccaggcacagtggctcacacctgtaatcccagcactttgggaggccamggtgggcagatcacgaggtcaggagatcgagaccatcctggctaacacggtgaaaccccgtctctactaaaaataaaaaaattagccgggcatggtggcg

SEQ ID NO: 15955 - DNA, 201 bp, Homo sapiens
tcaagaggcttttaaaagcccaatctcagattccttataaaaagttccagtaggccaggcacagtggctcacacctgtaatcccagcactttgggaggccrcggtgggcagatcacgaggtcaggagatcgagaccatcctggctaacacggtgaaaccccgtctctactaaaaataaaaaaattagccgggcatggtggc

SEQ ID NO: 15956 - DNA, 201 bp, Homo sapiens
aacaaaaaaattagccagacgtggcggtgcatgcctggagtcccagctactggggaggctgagatgggaggatcccctgagcccgggaggcggaggctgcrgtgagccaagattgcgctactgcactccagcctgggcgtcagagagcaagactctgtcttaaaaaaaaaaaagaaaaagcatacaaacatttaatgcgag

SEQ ID NO: 15957 - DNA, 201 bp, Homo sapiens
aggaaggacaggaacaggtagctaaagatgacttaggtcagagcaggtgaccaggggccgggtgcgatggctcacgcctgtaatcccagcactttgggagkccgaggcgggtggatcatgaggtcaggagatcgagaccatcttggcaaacgtggtgaaaccccgtctctactaaaaatacaaaaaaaattagccaggcgt

SEQ ID NO: 15958 - DNA, 201 bp, Homo sapiens
ctgcaccctcatcagattctctgtagggggagaagtcatatcttttcctcacccatcacaagcttcatggctgagacctgttagaaacaaaatgcttcctyggtgccacaaagaaatagcactcaaacattaattttctcagcaaggcaatttttacttctatagaagggtgcgactcgcggatggagcaatggtgagagc

SEQ ID NO: 15959 - DNA, 201 bp, Homo sapiens
cagcgctgggcccccgtcctgacctgagcggttaccaccagccccaggcctgcggaggcgctagtccaccagagcccctccccgcccctctccccactccscatccctcgcccccctccccacctcccaccccccaccctgtaaactaggcggctgcagcaagcagaccttcgcatcaacacagcagacaccaaaaaccag

SEQ ID NO: 15960 - DNA, 201 bp, Homo sapiens
gcaagctccacctcctgggttcacaccattctcctgcctcagcctcccaggtagctgggactacaggcgcccgccaccacgcccggctaatttttttgtawttttttagtggagatgggttttcaccatgttagccaggatggtctcgatctcctgacctcgtgatccgcccacctcggcctctcaaagtgctgggattac

SEQ ID NO: 15961 - DNA, 201 bp, Homo sapiens
ctcttccctcacccgtctatcaatacaatgaaaccacctcttccctcacccgtctatcaatatgatgaagccggctcttccctcacctgtctatcaatatsatgaagccggctcttccctcacctgtctatcaatatcatgaagccggctcttccctcacctgtctatcaatatcatgaagccggctcttccctcacctgt

SEQ ID NO: 15962 - DNA, 201 bp, Homo sapiens
atcatgaagccggctcttccctcatctgtctatcaatatcatgaaaccacctcttccctcacccgtctatcaatacaatgaaaccacctcttccctcaccygtctatcaatatgatgaagccggctcttccctcacctgtctatcaatatcatgaagccggctcttccctcacctgtctatcaatatcatgaagccggctc

SEQ ID NO: 15963 - DNA, 201 bp, Homo sapiens
ctcttccctcacctgtcaatcaatatcatgaagccggctcttccctcatctgtctatcaatatcatgaaaccacctcttccctcacccgtctatcaatacratgaaaccacctcttccctcacccgtctatcaatatgatgaagccggctcttccctcacctgtctatcaatatcatgaagccggctcttccctcacctgt

SEQ ID NO: 15964 - DNA, 201 bp, Homo sapiens
gctcttccctcacctgtcaatcaatatcatgaagccggctcttccctcatctgtctatcaatatcatgaaaccacctcttccctcacccgtctatcaatayaatgaaaccacctcttccctcacccgtctatcaatatgatgaagccggctcttccctcacctgtctatcaatatcatgaagccggctcttccctcacctg

SEQ ID NO: 15965 - DNA, 201 bp, Homo sapiens
agaatagtcttttcaacaaatgacgttagaaaatctgcatatccacctgcaatataatgaaacccgctcttccctcacctgtcaatcaatatcatgaagcyggctcttccctcatctgtctatcaatatcatgaaaccacctcttccctcacccgtctatcaatacaatgaaaccacctcttccctcacccgtctatcaat

SEQ ID NO: 15966 - DNA, 201 bp, Homo sapiens
gcagtggcatgatctcagctcactgcaacctctgcctctcgggctcaagcgatcctcccaccacagcttcctgagtagccgggactgtaggcacgtgccaygaagcccagctattttttgtagagacaagttctcaccatgttgcccctgctggtctctaacccctgggctcaagtgatccgcccgcctcagtctcccaaa

SEQ ID NO: 15967 - DNA, 201 bp, Homo sapiens
tttgtatagttaatctttgtataatatgtgagatttaggtcaaggtttttgtttggttggttgttttttgttgttgttgttttgtttttttttttttttttgcatgtgaatgtcaaattcttccagcaccatttgttgaaaagattatactctttttttttgaaacaaggactcactctgttgcccagggtggagtgcagt

SEQ ID NO: 15968 - DNA, 201 bp, Homo sapiens
tacattatccatttgtatagttaatctttgtataatatgtgagatttaggtcaaggtttttgtttggttggttgttttttgttgttgttgttttgtttttktttttttttttgcatgtgaatgtcaaattcttccagcaccatttgttgaaaagattatactctttttttttgaaacaaggactcactctgttgcccaggg

SEQ ID NO: 15969 - DNA, 201 bp, Homo sapiens
atgactaaccctatggatcttttcatgtaccttttagccatttgcatgtcttttttgcagaaatgtctattcaaatccttgacttttttttttttttttttgagatggagtctcactctgttgtccaggctggagtgcagtggtgcaatctcggctcactgcaacctctgcctcccaggttcaagtgattctcctgcctca

SEQ ID NO: 15970 - DNA, 201 bp, Homo sapiens
gccaggctggtctcgaactcctgacctcaggtgatccgcccacctcggcctcccaaagtgctgggattacaggcatgagccaccgcgcccagcctgtttcyactttttagctaacatgaataatgctctatggtggtacaagttttttgtgtgtggacacgttttcatttatcccgggtagatattgaagagcaaaatcct

SEQ ID NO: 15971 - DNA, 201 bp, Homo sapiens
ctgcctcccaggttgaagcgattctcctgcctcagcctcctgagtagctgggattacaggcatgcaccaccaccctggctaattttttttttttttttttwaatagagacagggtttctccatgttgcccaggctggtctcgaactcctgacctcaggtgatccgcctgcctcggcctcccaaagtgctgggattataggc

SEQ ID NO: 15972 - DNA, 201 bp, Homo sapiens
tttcatgggctagttagtacacggtctttggtgaagctcccattaagtcttttatcctttttttttttttttttttttttttgagatggagttttgctctygtcgcccaggctggagtgcagtggtgcgatctcggctcactgtaacctctgcctcccaggttgaagcgattctcctgcctcagcctcctgagtagctggg

SEQ ID NO: 15973 - DNA, 201 bp, Homo sapiens
atggtgcttttaatttgcatttccctaatgttgctgaagaacatttcatgggctagttagtacacggtctttggtgaagctcccattaagtcttttatccyttttttttttttttttttttttttgagatggagttttgctcttgtcgcccaggctggagtgcagtggtgcgatctcggctcactgtaacctctgcctccc

SEQ ID NO: 15974 - DNA, 201 bp, Homo sapiens
aggccaaggcgggtggatcacttgagcccaggagttcaagaccagcccggccaaaatggtgaaaccccatccctactaaaaattcaaaaattagccaggtrtggtggcacatgccggtattcccagctactcaggaggctgagtcacgagaatcgctggatcccgggaggcagaggttgcagtagccaagatcatgccact

SEQ ID NO: 15975 - DNA, 201 bp, Homo sapiens
tatctgaagctgcggacgcccccagatcccttcctcaaccagaggccaataataccaccgtgtttggggctgtcagataaataaccctctgtgtgtgtgtktttttttaaggtaaggagaaaggaaaactgaatgaggtcaggaggagggcctggccacgcagctccttcccgctgctccagcctccccatccctctgagg

SEQ ID NO: 15976 - DNA, 201 bp, Homo sapiens
ggaggacaaagagggaaagcacccttcccagcccaggctgctcaggagttgctgacactgtgaacaaatccccagtccagccccaagtccccgaaaccccrggcccctgaccatcagctccaggcagggcagatgacttgactaggaggatgctgagtctggccaagggccaggccagggacagagctggaggagcctcgc

SEQ ID NO: 15977 - DNA, 201 bp, Homo sapiens
tagagacggggtttcaccatgttgaccaggatggacttgatctcttgacctcgtgatctgcccgcctcggcctctcaaagtgctgggattacaggcgtgarccactgcgcccagcctgagggtccggttttctccccacgccaggccacctgccgacagcagcctcacccaggacagtcctgctgctgtccagcaggcgcc

SEQ ID NO: 15978 - DNA, 201 bp, Homo sapiens
aggagaatcacttgaacccgggaggcggaggttgcagtgagccgagatcgcaccactgcactccagcctgggcaacagagcgagactccgtctcaaaaaawaaataaataaatcatatgaagaggccagcaaagaggggcaatgaagactgtagagaataaaagtatgacagagatgtctcagacagtaagttaacaaaag

SEQ ID NO: 15979 - DNA, 201 bp, Homo sapiens
tgaagaggccaggcacggtggctcacacctgtcatcccagtactttgggaggctgacgcacgtggatcacttgaggtcaggagttcgagaccagcctggcyaacatggtgaaaccccgtatctactaataatacaaaaattagccaggcgtggtggcacatgcctgtaatcttacctacttgggaggctgaggcaggagaa

SEQ ID NO: 15980 - DNA, 201 bp, Homo sapiens
aaatcatatgaagaggccaggcacggtggctcacacctgtcatcccagtactttgggaggctgacgcacgtggatcacttgaggtcaggagttcgagaccrgcctggctaacatggtgaaaccccgtatctactaataatacaaaaattagccaggcgtggtggcacatgcctgtaatcttacctacttgggaggctgagg

SEQ ID NO: 15981 - DNA, 201 bp, Homo sapiens
cactgctgcttctggagagccttggacagcaggcagtcctggagctggacaagcaggacccagggcagccactgaggtgggcccccgtgccacctttagcrgggggaaagggagcagggagggctggtcctctgagggattcaggccccttacccgagggcctgcggggcggggagtagcctctggctgtgagctgggaag

SEQ ID NO: 15982 - DNA, 201 bp, Homo sapiens
agctggacaagcaggacccagggcagccactgaggtgggcccccgtgccacctttagcggggggaaagggagcagggagggctggtcctctgagggattcrggccccttacccgagggcctgcggggcggggagtagcctctggctgtgagctgggaagccctcactctggagggacctggttcctgctggtaggtgtctc

SEQ ID NO: 15983 - DNA, 201 bp, Homo sapiens
ctgggattacaggcatgagccaccgcgcccagcctgtttccactttttagctaacatgaataatgctctatggtggtacaagttttttgtgtgtggacacrttttcatttatcccgggtagatattgaagagcaaaatcctgtgactatatttaaccttttgaggaaatgccaaaatgttttccaaagtggttacactatt

SEQ ID NO: 15984 - DNA, 201 bp, Homo sapiens
gagcttctcctagtgtggcccccactcccatcccatgaagcctccctctgggccacctgccacaaacagggagcaggggagggggccggcagcacagtgcyccagccccccagggcctgtgtaagcacgggccacctagcagctcaggccagaggggagtgcagggtccctgatggctggaggcctccctggggaggggag

SEQ ID NO: 15985 - DNA, 201 bp, Homo sapiens
atcccatgaagcctccctctgggccacctgccacaaacagggagcaggggagggggccggcagcacagtgccccagccccccagggcctgtgtaagcacgrgccacctagcagctcaggccagaggggagtgcagggtccctgatggctggaggcctccctggggaggggagagtggcgttcgccacatgataccccatga

SEQ ID NO: 15986 - DNA, 201 bp, Homo sapiens
gaggaaaacgccatcacaggtaaacaacaccgagcctcgtgagatggaggcggagctgggggagtccctctcagttctgtccccagacctcagctccaggytcagtgctgctggtctgtctccctgctgtctctagactccacacctgcaccctcactgtgggcagcgacagtgctggcagagcctagtggtggccattct

SEQ ID NO: 15987 - DNA, 201 bp, Homo sapiens
gacccgggacccaggagtccctggtggtgcgagctgcttgttacagcagagtggccgcgagaggcgggagatgggctccagcacccccttgctctccgtcrgggtcctgggacgccggccccctccgtcgggaccccacacccagaccctgccccccagggccggcctccgcacctgctccgaaatgggcgcggctacgca

SEQ ID NO: 15988 - DNA, 201 bp, Homo sapiens
agtgcacgagttgtaacttaatccccaatgcaacagtgttgggggctggcgctttcgggaaggagtctgggtcataaagggtttgcccttccgaatggatytgtgccctataaacaggactcatggcagtgggttctctcttgctcttccgccttctcccatgtgaggacacagcaagaaggccctaccagatggcagcac

SEQ ID NO: 15989 - DNA, 201 bp, Homo sapiens
cacagcaagtaagggggcctgtggcctgtgctttccctgccctcccccaggtcaggacttgggcccctcttcttgcatctgagtccctggtcacagtgccstcctcaccaacaacctggggggggtggggggaggggaaatggcgagtcaagagggcaccagccaatcagggcttccctgggggcaggccccgcccctcct

SEQ ID NO: 15990 - DNA, 201 bp, Homo sapiens
ttttcatcactgtactgcattccacttccagttctgaacgactacaaataaagctgctacgaacacttgtgtgcgtctctcttgtgcgggtgtacctgctyagtacacaccccaggatgtttcagccacatgataggtgcattatgccaaccactagtttattgtcttttggctcgaaatttaaccttcaatacctgctcc

SEQ ID NO: 15991 - DNA, 201 bp, Homo sapiens
aaggcgggtggatcacttgagcccaggagttcaagaccagcccggccaaaatggtgaaaccccatccctactaaaaattcaaaaattagccaggtatggtrgcacatgccggtattcccagctactcaggaggctgagtcacgagaatcgctggatcccgggaggcagaggttgcagtagccaagatcatgccactgcact

SEQ ID NO: 15992 - DNA, 201 bp, Homo sapiens
tgcctcttaacaccatcacaaaacgaattcaaggatgagttaaaaaataatgaaagtagagatttattgcaaagcaaaaagtacaccctccagaaagcagwgtgtggctgggtgtgaaggctcacgcctgtaatcctaacacattgggaggctgaggcaggagttcgagatcagcctgggcaacatagtgagaccctgcct

SEQ ID NO: 15993 - DNA, 201 bp, Homo sapiens
ctcggccagcgtggcccagtgggtccagttgtctcggctcagcgtggcccagtgggtccagtcctcttggcccagctcggcccagtgggtccagtcgtctyggcccagctcagcccagtgggtccagtcgtctcggcccaggtcggcccagtgggtccagtcgtctcggccagcttggcccatgtcctggtcttcagtgtc

SEQ ID NO: 15994 - DNA, 201 bp, Homo sapiens
gggtccagtcgtctcggccagcttggcccatgtcctggtcttcagtgtctggtcaccccctggcctctgcagctttttcaacagctctcttttgatagccrtgaaactgctacctggaatcatctgttctcctgcggccaccctgtcgtagtcctgtctcactttgggttaggtaaatgtcctgtccctcatcagaatcca

SEQ ID NO: 15995 - DNA, 201 bp, Homo sapiens
acggcctctttacagcctcccctgcttgttgcttgggtcccccgggagctaaccctacacagcctgtgactcacgcacacacacagtgggtgcccaatcamtgatgagaaacgcgggatctcaggagcgtgaccctcctcagcctgagctccgggcagctgtggaagccagggccaggccacaccagctgctgtctggttc

SEQ ID NO: 15996 - DNA, 201 bp, Homo sapiens
aactcggcttcgctgagcccctgcacagacatggagctgacggcctggtgagctgcccggaagcactgctgggctgtcgtggctgtacagggccatgggcrtcacctggctgggcacggcccacctgcctcaggcagttggttagtggagggggcccatgcaagctgtgtcctgaggaggcagcctaagccaggctgtgca

SEQ ID NO: 15997 - DNA, 201 bp, Homo sapiens
gcacattccatgcccagctggaaccagaggcaggcctggccatcagggttagggccccattgggcctctgccccggcgtgtctcacccccaccgccccacytgcccacagatcagctccccacgtctgccccatcttccccctccttgcacctgctgcccttgcaccgcacacatgccagggtgagtgtggtcggcaggca

SEQ ID NO: 15998 - DNA, 201 bp, Homo sapiens
attcttgaaatgaccagacagagccggagagatgagtggttgcagggctagggagaggtgggagggagcagcgtggctgtaaagaacatgtcagggtcccrtgggggtggcactgccttgcgtctgtatcgacgtcaaggtcctggcgtgattctgcactgcagtcctgcaagatgctaccactggggatgctggatagag

SEQ ID NO: 15999 - DNA, 201 bp, Homo sapiens
ctagggagaggtgggagggagcagcgtggctgtaaagaacatgtcagggtcccgtgggggtggcactgccttgcgtctgtatcgacgtcaaggtcctggcrtgattctgcactgcagtcctgcaagatgctaccactggggatgctggatagagggtaacgggacctctgtgttacttcttacaactgcagatgaatctat

SEQ ID NO: 16000 - DNA, 201 bp, Homo sapiens
gggggggctccgcccttggctgagctggagggcttggggtcaggaccaagggtgggtccaccctgcttggaaagaagctgtcctggcttttggagtcagcrggggaggggcactgcccgggagctggtgtcttgttggaaggggcagctgggagtagggagcagccgagccacaggctgcccgcggcatcgtcccctgcct

SEQ ID NO: 16001 - DNA, 201 bp, Homo sapiens
gagccatggccaggggccagtcggcagcccctctgcccgacaaggatgtgggccagcgtcgtctgcacttcagaggagacgagaaccaggaggcggccccygagggcatcccgcgggtcctcacggaggctgcgttctcccaccttggccaggatgccccgggaacaccatgcagcgtctctgaggcttcctgtgcagagg

SEQ ID NO: 16002 - DNA, 201 bp, Homo sapiens
gccacctggaacccacccagggagatggaatcggcagctcctgccaatgcccttggggctcacgctctctgggcaccatgatgtcctgggctgggggtccrggcggcatgggggccgctccaacctgcattttctagccacgtggacccgtacgctccagctcctgggtctgggtttggggggctgagcctgtgtgtgatg

SEQ ID NO: 16003 - DNA, 201 bp, Homo sapiens
ctcctgtccagcccgcaggacccctgcccccttccagctggcctcccttctcccgactcatgcctgagtgagccctgccgtgacccccacctgcacccgayggccgcctgccccccagcccctgagactcgggacaccccctccctggaggcccctccccgccccaccctcccactgaccctactgtgtccacccgggagc

SEQ ID NO: 16004 - DNA, 201 bp, Homo sapiens
gcctcgggcccagcatggggcagcttggcaggcacaggcccacctggggcatgcagggctgcagcagggggttctggatcagcttccagttggccttgtartaggtgagcagctcctccaggccgggaaagagccgtcccttctgcaggtagaggctgccatcagctgccatggagacccggtagtggcagaccttggcct

SEQ ID NO: 16005 - DNA, 201 bp, Homo sapiens
agggcagggcagaaacagcacccaacaggactgggtgcaaggctcacacctgtaatccggaaggatcagaaagacccaggtgggaggatcacttgagcccygggggtgaagactgccgcatgggtgacagagcaagacgctatctcaaaaaaaaaaccacccacatccacccacttcctgccaggcctaacccctggggcc

SEQ ID NO: 16006 - DNA, 201 bp, Homo sapiens
acctgcagtggttgccaagcctgagctgcactcaggtgaaaaattgcctgcttatttaagtgttggccagatattttaacatcattaaccctgcaccaggkgccgagcctccggcctctgcagtaaattctgaggacaggcgagtgagggggctctcagcaccccggctttcatgcagtaaaacgagatgctgattgcagg

SEQ ID NO: 16007 - DNA, 201 bp, Homo sapiens
gcagctcccaggtcaccaagcctcccggcccacccttcctgtgccacctggaacccacccagggagatggaatcggcagctcctgccaatgcccttggggytcacgctctctgggcaccatgatgtcctgggctgggggtccgggcggcatgggggccgctccaacctgcattttctagccacgtggacccgtacgctcca

SEQ ID NO: 16008 - DNA, 201 bp, Homo sapiens
ccggcgggggcaggggcaggcgctaccacaccctgccctgagtggcccgagtctaggggtcagagcctagggtggagctggggagggcagctgagcaggakggctgcccagagctgcctgcacacacccatgtgtgacgcacgctcacacacacacagtcacaaacccccacacatgcgcacagttcacccgcacacctga

SEQ ID NO: 16009 - DNA, 201 bp, Homo sapiens
agaacacagaggggacgtctgcctttttaaagacgtgactttgagcatacatagagaaaagtgacacactgcaaatgtgcctgatgagttatcaccaggaraacacacccagaccaagaaacaacattccctcctgcccctcggtaaaggtgacttctgacagcacagatcacgtttgcctgtttttaaactttatataaa

SEQ ID NO: 16010 - DNA, 201 bp, Homo sapiens
agggcagggagaacacagaggggacgtctgcctttttaaagacgtgactttgagcatacatagagaaaagtgacacactgcaaatgtgcctgatgagttaycaccaggaaaacacacccagaccaagaaacaacattccctcctgcccctcggtaaaggtgacttctgacagcacagatcacgtttgcctgtttttaaact

SEQ ID NO: 16011 - DNA, 201 bp, Homo sapiens
ggcagctgggaatcttatgaagggaataacaggaccctgcctgcaccctggggatgagcctcccaggggctgccgcccaccatcgcctcccacagagattsagagcctccccacccctggagggacctccccacacggccaggaaccgagcagctgggccagggcaggaggaagggcagggagaacacagaggggacgtct

SEQ ID NO: 16012 - DNA, 201 bp, Homo sapiens
gcccttccctcaattaggcagctgggaatcttatgaagggaataacaggaccctgcctgcaccctggggatgagcctcccaggggctgccgcccaccatcrcctcccacagagattcagagcctccccacccctggagggacctccccacacggccaggaaccgagcagctgggccagggcaggaggaagggcagggagaa

SEQ ID NO: 16013 - DNA, 201 bp, Homo sapiens
atagcccttccctcaattaggcagctgggaatcttatgaagggaataacaggaccctgcctgcaccctggggatgagcctcccaggggctgccgcccaccrtcgcctcccacagagattcagagcctccccacccctggagggacctccccacacggccaggaaccgagcagctgggccagggcaggaggaagggcaggga

SEQ ID NO: 16014 - DNA, 201 bp, Homo sapiens
gggggtccagtgtctgtggtcagggccccctcaagggcccactaaagcagagctcccttcctgggccccacccaaggtcccatctcctctcctatgtagcyggcaccaggttcaagggggatctctcaaggtgggaaattgccctggggaacctgaagttcattagcagctctggaggccctgttttcacctctttgaata

SEQ ID NO: 16015 - DNA, 201 bp, Homo sapiens
tcccggcccctggccattacagcccattgcaggctgggaggctaaacaggaggccggggtcaccgaccagggtggggtcacctcttggacccaagaagggsagcccctggtgccagcacaggggcgctgtgccctccagtgcccagaggcagaggggagagcctgggtagggtctgcagaccattgaccctacagctgcct

SEQ ID NO: 16016 - DNA, 201 bp, Homo sapiens
ggctgccggtgacgtcactgctgggttaataatagccgccgagtgcctaacgaaccacctgtgcatggggcacagccaggccatcaccccggggccaccgycgcaggcaggtggaggctggcagcccagaggcagacaggggcttggaggcagggtggggagcaaggccaaggccgctctctggcccccagtgtcacagga

SEQ ID NO: 16017 - DNA, 201 bp, Homo sapiens
ggtctcccaggcgccaggacacgtttggtccacggtgtggcccctcggggtcctgggagccaccgactcagttccgcagacacttggaacacacagctaayggggctgcggtcacaaggctaaacactaacacactgatggttccgagccaccgcggagactgaacaggactgaatggctactaactacggaatgctaact

SEQ ID NO: 16018 - DNA, 201 bp, Homo sapiens
cacctgtgtgctgactctgggcaagggtgtcggtggctgctccaaagggtctcccaggcgccaggacacgtttggtccacggtgtggcccctcggggtcckgggagccaccgactcagttccgcagacacttggaacacacagctaacggggctgcggtcacaaggctaaacactaacacactgatggttccgagccaccg

SEQ ID NO: 16019 - DNA, 201 bp, Homo sapiens
tctgaggcctgagtgccccacagcgggggtccctcctgccctggaggaggtcacctgagccccatgccctggggctgggagatgccaagcctggccaccaygggagttgggggttccttctcagggggccaagaccatagcctggggagctcacctcagccgcctccttctcgaacttctcaatggtccttttgtcaatac

SEQ ID NO: 16020 - DNA, 201 bp, Homo sapiens
gaccacagctgctctcaggagctgtcgctgacccagacgccctgaatgtcccgaaaggccaggacaggcccctgaggacccggcgggggcaggggcaggcrctaccacaccctgccctgagtggcccgagtctaggggtcagagcctagggtggagctggggagggcagctgagcaggatggctgcccagagctgcctgca

SEQ ID NO: 16021 - DNA, 201 bp, Homo sapiens
ccagcctgaggaaggaggaccgcccctgccgagcccagcaagtgccaggtggagatgccctcggcccgtgggggtatagggggcaccctccctcccccccyccctgtgactcaggaccctgggtcacagccctgtcccatcacagaggtcagtggagaaacccacgctgctcctcgcggacaggtggctgggggagggaaa

SEQ ID NO: 16022 - DNA, 201 bp, Homo sapiens
gctttcgggaaggagtctgggtcataaagggtttgcccttccgaatggatttgtgccctataaacaggactcatggcagtgggttctctcttgctcttccrccttctcccatgtgaggacacagcaagaaggccctaccagatggcagcaccttgatcctggacttcctggcctccagactgagaaataaacttctgttta

SEQ ID NO: 16023 - DNA, 201 bp, Homo sapiens
catgttagccaggctggtctcgaactcctgacctcaggtgatccgcccacctcggcctcccaaagtgctgggattacaggcatgagccaccgcgcccagcytgtttccactttttagctaacatgaataatgctctatggtggtacaagttttttgtgtgtggacacgttttcatttatcccgggtagatattgaagagca

SEQ ID NO: 16024 - DNA, 201 bp, Homo sapiens
tgtgtctatgtgtatgtctgtgtgtgtcatgtgatgtgtcttgtgtgtgtgtctgtgtgtgcatgtgtatgtctgtgtgcatgtgtgtgtgcatgtgtgtstgtgcgtgtgtgtctctgtgtgtctgtgtctgtgtctgtgtgtgcatgtgtgtgtctgtgtgtctgtgtgtctacgtgtgtgtgtgtgtagacgtggggg

SEQ ID NO: 16025 - DNA, 201 bp, Homo sapiens
gcaggagagggggaggaggacctcccggttggggcttcttgggggtccaacttatggacactcaggcactcagggaagccaacggccctctgggaacaagmctcgcagcctgagggcaggaaggtgagggctgcaggcgctgccttcccaaccctcagagctgcgggggcacaggtgggggccgcctctctccccgcttcc

SEQ ID NO: 16026 - DNA, 201 bp, Homo sapiens
gctggagtgcagtggtgcgatctcggctcactgtaacctctgcctcccaggttgaagcgattctcctgcctcagcctcctgagtagctgggattacaggcrtgcaccaccaccctggctaatttttttttttttttttttaatagagacagggtttctccatgttgcccaggctggtctcgaactcctgacctcaggtgat

SEQ ID NO: 16027 - DNA, 201 bp, Homo sapiens
tgctgaataacggcagtggcctgaccacgtccccaaagtgcacgagttgtaacttaatccccaatgcaacagtgttgggggctggcgctttcgggaaggartctgggtcataaagggtttgcccttccgaatggatttgtgccctataaacaggactcatggcagtgggttctctcttgctcttccgccttctcccatgtg

SEQ ID NO: 16028 - DNA, 201 bp, Homo sapiens
tttccccaaaacatcgccagcctcctctgaagcccacatcagggcttgggggtcagaggtgagcccctgtgggatcctgagatgcagaggatgtgtctgargtctctccctggggcgtggggccaggtgtctggagctaatgacacctgagtgtggttagtcttttaatctccagcctaggcaaatagtcattagctttgc

SEQ ID NO: 16029 - DNA, 201 bp, Homo sapiens
gaccaaggctggtgacccagatgggaccgcgccccccaccgcccccgaacaccagctccagccccggagccacaaggctctggcctggcccagacctgacrccagccccctgttggctggagaccagacagggatgggatctgcagccggggccacctgctcccggtagagaggcccggttcacctcggaaaccccgcagg

SEQ ID NO: 16030 - DNA, 201 bp, Homo sapiens; identical to SEQ ID NO: 8119

SEQ ID NO: 16031 - DNA, 201 bp, Homo sapiens
agggcgggagggcctggccagccaggcagggtcctggaggaaccgcctgctgggtgtccagctggtgcagctgatgctcccccccacaggacctgaccacrcctgccggagcctcctctccctctcggcagcccacagcggacactgctgttttcctaccacacctgccggcccggggcccatcagctgtccctgaatgaa

SEQ ID NO: 16032 - DNA, 201 bp, Homo sapiens
aattagtcacagccaagtcgcccagctgtgtgagttcacagtgtgggggacgggggacagggggccgtgcacgtgcacagtgtgcggggatgggggctgcrgggacagaggctacaaggtaggccccacaaggctggctggaggaccttgagaacctgtgaggcaactgggcacagaaaggccaagattcctgtccaagga

SEQ ID NO: 16033 - DNA, 201 bp, Homo sapiens
agccacgtggacccgtacgctccagctcctgggtctgggtttggggggctgagcctgtgtgtgatgtgcgcctgtgtgcgtgtctgagtgggtcagtcccrgcttactgagtgctgtgtgcgtgagtgggtttgtgcacaggccgccagcgtgtctgtgaggggcaggtgacggtgccaccccgtgcctacataccacaca

SEQ ID NO: 16034 - DNA, 201 bp, Homo sapiens
tgagcctgtgtgtgatgtgcgcctgtgtgcgtgtctgagtgggtcagtcccagcttactgagtgctgtgtgcgtgagtgggtttgtgcacaggccgccagygtgtctgtgaggggcaggtgacggtgccaccccgtgcctacataccacacatccagtggggtcaacaccacggtctgcctgggagtcagcactggtcatt

SEQ ID NO: 16035 - DNA, 201 bp, Homo sapiens
gggaggaggggctggcctggctggagcccagagcgttgggtcacgtgaggactcaggggtggcatctgtggatggcgtgcagcttctcccgcagcgtggcraaggagggccgttcctcggggctgctcctccagcactccagcatgagcacgtagacctccgccgggcaggcagccgggcgcggcagccggtaccctcgca

SEQ ID NO: 16036 - DNA, 201 bp, Homo sapiens
tctgtggatggcgtgcagcttctcccgcagcgtggcgaaggagggccgttcctcggggctgctcctccagcactccagcatgagcacgtagacctccgccrggcaggcagccgggcgcggcagccggtaccctcgcatgatctgctgcagcgtctcgtggttggtcatccctgggaggcgcggggcaagagctgcctcgat

SEQ ID NO: 16037 - DNA, 201 bp, Homo sapiens
atctccttggcgaggtcagtgagcttcatgttggctgcgagagagggtgtggctccaggaccggcccacgccacgaacatcactgccctggggcttgaggrttggacagcaggtgcggggcccggccgtggcgcaggatctcggggcctcacctgacttgatgaccttgatcgccacgggcagggagcccagccacaggcc

SEQ ID NO: 16038 - DNA, 201 bp, Homo sapiens
gagcccagccacaggccttcccacacctccccaaagtagccttcacccagcttcctcccaagggcgaattcggagtgtggccgctcccacacgtcctgcckcggggccttctgcagggagggtgggcagggaggctggtcagcgtgggcccctgtgctctgtcccaggcacagccccccacaccaggcctctggcgggcac

SEQ ID NO: 16039 - DNA, 201 bp, Homo sapiens
gcccagccacaggccttcccacacctccccaaagtagccttcacccagcttcctcccaagggcgaattcggagtgtggccgctcccacacgtcctgcctcrgggccttctgcagggagggtgggcagggaggctggtcagcgtgggcccctgtgctctgtcccaggcacagccccccacaccaggcctctggcgggcaccc

SEQ ID NO: 16040 - DNA, 201 bp, Homo sapiens
caaggaaacttggttatttctgtggcatgcagcattttaatgtaataaccaaaattatgactgataacattgcaccagatttctaggaatagcatgtgagwtaggatatatatcataggataacgtatcagatttctaggaattttatagagtttctgcaacattcatatcaaaaccaaacccgtaaatagaacctccaga

SEQ ID NO: 16041 - DNA, 201 bp, Homo sapiens
ggccaggctggtctcaaactcctgacctcgtgatccgcccaccttggcttcccaaagtgtggggattacagatgtgagccaccgtgcccggcctaaaattytcttttataataaatgtatttaggtaaaaacataggtgcaattgaaagggaaccactctcgcatggacgctgtgggtgctgcttggggctcgaggccaga

SEQ ID NO: 16042 - DNA, 201 bp, Homo sapiens
tgggccctgctgtgcgtgccattcagaatgggggccccaccggactcacggtggcttcccacctccctgcccagcctgggctcccgagggcaggggccgcmtcctgctcccagccgagtccccagctccacacacaggaagcccccagccctccggccacgccccggccacgaccccagccacgccctctgagggccctac

SEQ ID NO: 16043 - DNA, 201 bp, Homo sapiens
gtgggggctgcctgtgccctgcccccgaagcatggacgggcacagcggccgcattgccccagcagtgggacggtgatgaccccactgtctgacccacgcayggccgctgcagctaaggccacactggggcctgaccaccttcaggagcccaacttcccctgggattgcaggtgtgtggggaccggagggcccgggggacag

SEQ ID NO: 16044 - DNA, 201 bp, Homo sapiens
cggagggccctgaagcccgtgggggaggcaccccccagcgtccctgccggctacccaggacctcccccactctgcctctcatgcccagtcagggacagtgrggacagtacctgggtagggcacctgacccctgctgaacatctcatgcaggagaatcccaaaggaccagacgtcggatttggtggagtaatggcctcggga

SEQ ID NO: 16045 - DNA, 201 bp, Homo sapiens
ccgcggagggccctgaagcccgtgggggaggcaccccccagcgtccctgccggctacccaggacctcccccactctgcctctcatgcccagtcagggacastggggacagtacctgggtagggcacctgacccctgctgaacatctcatgcaggagaatcccaaaggaccagacgtcggatttggtggagtaatggcctcg

SEQ ID NO: 16046 - DNA, 201 bp, Homo sapiens
ttagtcgggcgtggtagcaggcacctgtaatcccagagacttgggaggctgaggcaggagaatcacttgaacccgagaggcagaggttgcagtgagccaakattgcgccattgcactccagcctgggcgacagagcgagactccatctcaaaaaaaaaaaggaagaaggaaatttgttggctgggtgcggtggctcacacc

SEQ ID NO: 16047 - DNA, 201 bp, Homo sapiens
atggcaaaaccctatctctactaaaaatacaaaaattagtcgggcgtggtagcaggcacctgtaatcccagagacttgggaggctgaggcaggagaatcayttgaacccgagaggcagaggttgcagtgagccaatattgcgccattgcactccagcctgggcgacagagcgagactccatctcaaaaaaaaaaaggaaga

SEQ ID NO: 16048 - DNA, 201 bp, Homo sapiens
tcccaaagtgctgggattacagttgtgagccaccgcgcccggccggtaaatgttgataataggagtaggagtggatgcgctcgtcctgctctcagtcctgrgaaaaggattctctcacctcagtacagcactggctgtaaatacttcatcagagctctttcttagattgaagttgttttctgttcctgctttgccgagatg

SEQ ID NO: 16049 - DNA, 201 bp, Homo sapiens
attttcacggtatatacattgggcctgtctttttaaaaatcttttatgacactgaaacttttgaagaatgcaaaccggttgttttgtagattgtccccgcrttgagcgttcctgacatttctgcatgaacagattggcaccaagagccaggcatccttcccagcactcgggacgctggctgcccaccagcggcaacggtac

SEQ ID NO: 16050 - DNA, 201 bp, Homo sapiens
cccactattagactctagcccggtttgctgtctggaggttttgtcgcccacctgtggtccggaccgggtcctgaacttcagtttcctccaatatttgcctrcagctcaccaaaccactctttccaattttttcttccaccattcctcatggagtcactgaaaattaaaactgctcttttcccaaagccctgtaagctgaag

SEQ ID NO: 16051 - DNA, 201 bp, Homo sapiens
cttgtaatagggcacaattgaaaacattggttatattaccaaggctttgactggaatgtcctattttcagatacgactaaaggagttagggttgactgcakggtccaataaagccccttggaaaaaagctggcctggtacctcacatacgtggttcccttacagatgagtaaagaatgtcaattcctggcaggtcccagaa

SEQ ID NO: 16052 - DNA, 201 bp, Homo sapiens
ggctcatgactgcgtgatgtaggcagtgggaactcgaacaggagaatggctgtcagcggcttgcggcctggtggtgcctgttttaccccacattccctccyggaggaccctgaagggcgtggggactgtctgagatgatcaagccctttgtgtgagggcgaggggtacggagcctttcgctcagagcgcaaacgtgcgtgg

SEQ ID NO: 16053 - DNA, 201 bp, Homo sapiens
ggagggccctgaagcccgtgggggaggcaccccccagcgtccctgccggctacccaggacctcccccactctgcctctcatgcccagtcagggacagtggrgacagtacctgggtagggcacctgacccctgctgaacatctcatgcaggagaatcccaaaggaccagacgtcggatttggtggagtaatggcctcgggag

SEQ ID NO: 16054 - DNA, 201 bp, Homo sapiens
tgcaatgagctgtggtcacgccactgcgctccagcctgggtgacagagcaagaccctgtcttcaaaaacaaaaacagaaacaaaaaacgttttcttacatytggaaaacaaaatattaaagaaccgtaatgcttcagacaaaagtcattaaacagtaaacatcctcgtcagttcattcattcccatgtcattaattcttgt

SEQ ID NO: 16055 - DNA, 201 bp, Homo sapiens
acactcgactaatttttgtatttttagtagagacagggtttcgccatgttagccaggctggtctcgaactcctgacctcaggtgatccgcccacctcggcytcccaaagtgctgggattacaggcatgagccaccgcgcccagcctgtttccactttttagctaacatgaataatgctctatggtggtacaagttttttgt

SEQ ID NO: 16056 - DNA, 201 bp, Homo sapiens
tgctgtttgcctttggttaaattccaaagcactgacatggttgtttctgacttttgtttagatttacaggtacattttggagagagggtttgttgacctcstcacccctccactctggaaatctttaatatattttattatgcaattcaaccttccatccaatatacatactggacgcctgcctcctgcatggctggctct

SEQ ID NO: 16057 - DNA, 201 bp, Homo sapiens
gctgtggacacccacccagggggtttcacggatcgacggctcgttccttctatcactcagcagtatctcgtacacgacacaccacagtctctgttcacccrcagaagaacacctgcaatgtttccaggttgggcagctatgaatagagctcccataaacatctgtgtaccgtcctttaacgtaaacctgtttgaatttgtc

SEQ ID NO: 16058 - DNA, 201 bp, Homo sapiens
cctgggtcccggcaatgcagcgtccacccccgagctgtgacaaggatgagcccaaggcaggggccgtgccctctgacccccgtgctccaactcccgcaggracagtcctgggcactcctgggcgccagcgcatggggcctgcagggaggatcaagcgggatgcccagcctggactttggggtgcaggaagatggaaccggg

SEQ ID NO: 16059 - DNA, 201 bp, Homo sapiens
atcggataagcctgattagtctgacatctgtctttcacaaggcagaagacaaatccttttgagaaatcctagtacctttccagaaactcccaaaattattwttctttctttcttttttttttttttttttttgagatggagtctcgctctgtcgcccaggctggagtgcagtggcgcgatctcggctcactgcaagctcca

SEQ ID NO: 16060 - DNA, 201 bp, Homo sapiens
cagtaagttaaacatagacagcgatgtgtgagccagcaattccactcctaagtacagacccaaaagagttgaaaacaggtattcaaacaaaaacttgtacrtggaatgtttgcaacagcactatttataatatccaaaaggtggaaacaactgacgtccataaatggatggagagagaaatgtggtctatccatacaaagg

SEQ ID NO: 16061 - DNA, 201 bp, Homo sapiens
ttacaactgcagatgaatctatacttatcttaaaagtaaaagtttaactttattattattattattattttcgagacaggcctctgtcttattgcacccakgctggagtgcagtggcacaatctcggctcactgcaacctccacctcctgggttcaagcgattctcctgcctcagcctcctgagtagctgggactacaggc

SEQ ID NO: 16062 - DNA, 201 bp, Homo sapiens
tggggcccagacgggttccagggaagttttacccatttccagtgatctattttaatggctttccattacgtcaaggattttaaattttctttctttctttyttttttttttttcccaagacggggtcttgctctgtcgcccaggctggagtgcaatggcgcgatctcagctcactgcaatctccgcctcctgggttgaagc

SEQ ID NO: 16063 - DNA, 201 bp, Homo sapiens
aaactcctgacttcaggtgatctgcctgcctcagcctcccaaagtgctgggattacaggcatgagccaccatgcccagcaactgagattttcctggttcayttatgccaagtaattttggattttatcctaaagtgtagggttttattcttttttttttttttttttttgaggcggagtctcgctctgtcacccaggctgg

SEQ ID NO: 16064 - DNA, 201 bp, Homo sapiens
tgcaggtagaggctgccatcagctgccatggagacccggtagtggcagaccttggcctgggcccggactaggaagggttcagagatggagacccctgcctyggctgccagctgccccgaccctcccaccccagaggatgctggccacaacccactaaggggtctggctcagacctagctggggaccctgagatggtcagag

SEQ ID NO: 16065 - DNA, 201 bp, Homo sapiens
aggaagaggccaaggccctgcccccacacacagcagccatcacacccagcagctgtgcaggacacacagacctcctgcccccgacagggcacctggctccygaggccacgaaatggcagatgcagccggccccacagggccccagcctggcgtacccacggggctgtggtggccacccgatttcttcctgtgcccggccca

SEQ ID NO: 16066 - DNA, 201 bp, Homo sapiens
acaaaaaaaaaaaaaaattagccaggcatggtggcgggcgcctatagtcccagctactcgggaggctgaggcaggagaattgcttgaacccaggacgcggmggttgcagtgagctgaaatcgggccactgcactccagcctgggggacaaagcgagactctgtctcaaaaaaaaaaaaaaaaaagaaagaaagaaaataga

SEQ ID NO: 16067 - DNA, 201 bp, Homo sapiens
tctgcctggagccctgcttgtggggttatggccaaggagagccgggagtgtgggcgcctccaagcaccctctcggtcttgtgctgtcctcaccccactgcytgaagagagcagcgcacgaattttgtctggtctcagagtcgtttctggagggagacgtacctggcagcagctactcccccgcaactggaagcagcggttg

SEQ ID NO: 16068 - DNA, 201 bp, Homo sapiens
ctcctctgaagcccacatcagggcttgggggtcagaggtgagcccctgtgggatcctgagatgcagaggatgtgtctgaggtctctccctggggcgtgggrccaggtgtctggagctaatgacacctgagtgtggttagtcttttaatctccagcctaggcaaatagtcattagctttgcctatggaccgccctgctccac

SEQ ID NO: 16069 - DNA, 201 bp, Homo sapiens
ccccagggaggagcgggccaggtgggcggaggggatgggagctccctggagaggagcccatgtcccccgtctcagccagagcgagccgggttcaccacgtrgctgggagggcttagagccaggagcccccgcaggcaagcacaggctcggaggccggggccgcacccgacaggacgtagtcggcactcggcttctcgctga

SEQ ID NO: 16070 - DNA, 201 bp, Homo sapiens
gtgagccgagatcacgccactgcactccagcctgggcgacagagccagactccgtctcaaaaaaaaaaaaaaaaaaaaaatatatatatatatatatatawaattagctgggcgtggtgacaggtgcctgtaatctcagctactcaggtggctgaggcaggagaatcatttgaacccaggaggtggaggttacagtgagcc

SEQ ID NO: 16071 - DNA, 201 bp, Homo sapiens
ggtcataaggccaagctctcaagacacaagacaaacaggaaagaaacacctgcccctgggaggaaagaacccttgagcaccaaaaccaaatttacatgagmgtcccgagccacgcgaatgactttctcccaccaagctgaactgggaagagcaggaacaaggcgtgtttgcctcccaccctcagccgggcactgcagacag

SEQ ID NO: 16072 - DNA, 201 bp, Homo sapiens
ccctgccctccaggaactgctgaaggggtctgtcctccacacctggggtgactgtgagccccttcccatcacaaaggctgcttgccccccaaccactgctyaggacaagcggggcaggtgtggggtgagggcctggggcccctcagaaggccccttcctgtgactccggcttcacccgcccatgcaacccccaggacgatg

SEQ ID NO: 16073 - DNA, 201 bp, Homo sapiens
tccgaatatacaaaggactcttacaactcaacaatacaaagacactcaatatcattagtcattaggaaaatgcaaatcaaaaccacagtaagacaccactycacactctctgaggtggctataatcagaaatatgaaaaatatcaaggttggcaaaaatgtggaaaaatgggaagcctcttccattgttggtagcaacata

SEQ ID NO: 16074 - DNA, 201 bp, Homo sapiens
cgggcgtggtggcgggcgcctgtagtcccagctactcgggaggctgaggcaggagaatggcgtgaacccgggaggcggagcttgcagtgagccgagatcaygccactgcactccagcctgggcgacagagccagactccgtctcaaaaaaaaaaaaaaaaaaaaaatatatatatatatatatatataattagctgggcgt

SEQ ID NO: 16075 - DNA, 201 bp, Homo sapiens
cccaccccccaggtgagtgcaggatcgcccctttctccccccgctcctccaggagctggcagcatcaagaccccacttcgcttctctcaggtctccccaargctgacccgggtcattggtgggccagcttctttttcgggaagtccaccctcccgttcatggccacggtgttggagtccgcagagcactcggaacctcccc

SEQ ID NO: 16076 - DNA, 201 bp, Homo sapiens
cagctgtgcaggacacacagacctcctgcccccgacagggcacctggctcccgaggccacgaaatggcagatgcagccggccccacagggccccagcctgrcgtacccacggggctgtggtggccacccgatttcttcctgtgcccggcccagacctctgacatagaggccagacctctgctggggcccagacgggttcca

SEQ ID NO: 16077 - DNA, 201 bp, Homo sapiens
gtgagccaccactcccggccctcactgtcttgttttgttttattctgttatttttgtttttctaagacatcttgttatcgcacactgtgttcaatattgcrattttgtagcaatttctaaaataagatcatggccgggtgcagtggctcacgccattaatcccagcacttcgggagcctgaggcgggcagatccctgagcc

SEQ ID NO: 16078 - DNA, 201 bp, Homo sapiens
tttgcctgggtcttgatactttcattaacatttcatttttttaaatttctgattctaactgtacattgcaggtagaaatactgtattagtttgtccttgcrctgctataaagaactacctaagactgggtaatttataaagaaaagaggtttaattgactcacagttctgcaggctgtacaggaggcctcagggaacttac

SEQ ID NO: 16079 - DNA, 201 bp, Homo sapiens
ttccgaatatacaaaggactcttacaactcaacaatacaaagacactcaatatcattagtcattaggaaaatgcaaatcaaaaccacagtaagacaccacwtcacactctctgaggtggctataatcagaaatatgaaaaatatcaaggttggcaaaaatgtggaaaaatgggaagcctcttccattgttggtagcaacat

SEQ ID NO: 16080 - DNA, 201 bp, Homo sapiens
tggggcccaggtgagcctggtcccgggacaccatggcgggcgggcgcagcggcaggaccaggctgtggcccagctggagcacccagagctgggcgtggcargcgggccgtcccacttcctcatgacaggccgggaagcagccacacccagcacccacaggcgctccagagcaccccggctcctcctgagggcccagccggc

SEQ ID NO: 16081 - DNA, 201 bp, Homo sapiens
atattcgcccatttaaagtgcatgatgcaatggctcttagcatatttacaaagccgagcaaccatcaccataatctaattttagaacatttcatcaccccraaaagaaaccttgtaccatttagtaatcagtccccattcctcctccacctctaaccaagccctgggcaaccactcatctgccttctggctccatgcattt

SEQ ID NO: 16082 - DNA, 201 bp, Homo sapiens
ggcccccgacaaagaccagggcagagaagagccagaggctgggctgggtctatgtcacattagaccaaggctggtgacccagatgggaccgcgccccccascgcccccgaacaccagctccagccccggagccacaaggctctggcctggcccagacctgacgccagccccctgttggctggagaccagacagggatggga

SEQ ID NO: 16083 - DNA, 201 bp, Homo sapiens
acctggcaccaagcggaaaataaactccaagcagccagtagccccgatggtgtgtgcctgagctgtgtggcccgaggttccatttgagtgtgagaaatggytgaatccctcccgacctcactgccttgtgggggctggccctgctcccaggcctttctgggcctcctcacgctgtgaggctgttgctggggctgataaggg

SEQ ID NO: 16084 - DNA, 201 bp, Homo sapiens
taggcacttaataaatacttgtagaatgaatgagtccatgagtcagtgaatgaatgaaggaataaggaaggaaagaaggaaaagtgaatgaatgaatgaaygaataagcaaatgagtgaaagaataagctagtgaacaaatcagtgaataaatgagtgaattagtgagtgacgaatgaacgagtgaatgagtggatgaatg

SEQ ID NO: 16085 - DNA, 201 bp, Homo sapiens
tgaacccgggaggcggagcttgcagtgagccgagatcacgccactgcactccagcctgggcgacagagccagactccgtctcaaaaaaaaaaaaaaaaaawaaatatatatatatatatatatataattagctgggcgtggtgacaggtgcctgtaatctcagctactcaggtggctgaggcaggagaatcatttgaaccc

SEQ ID NO: 16086 - DNA, 201 bp, Homo sapiens
cctgcccagctgtgggtcctcactgagcacccggcgaggacagagtacggcatccgttggcctcgatctccggaacaacacgggcacacggccgtcccagscagcaacgagagccacgaaacaaatccacccgggctgactcccgaagccctcggactgttccgccccacggacctcccggaccctctcttccacggggaa

SEQ ID NO: 16087 - DNA, 201 bp, Homo sapiens
gggacctgccagaactggaagctcagctcaaggcctcagtgggcccaggtaccagaaccagcccctcccctaggttctcccatgcagatggagctgggcargtggccagggtcccaaaggctcagataaagcctcttgcctccaccatctgcaggggtcctggttcctgctgcttccctccgcttggccttgttcctccga

SEQ ID NO: 16088 - DNA, 201 bp, Homo sapiens
actgctgaataacggcagtggcctgaccacgtccccaaagtgcacgagttgtaacttaatccccaatgcaacagtgttgggggctggcgctttcgggaagragtctgggtcataaagggtttgcccttccgaatggatttgtgccctataaacaggactcatggcagtgggttctctcttgctcttccgccttctcccatg

SEQ ID NO: 16089 - DNA, 201 bp, Homo sapiens
tagaaatactgtattagtttgtccttgcactgctataaagaactacctaagactgggtaatttataaagaaaagaggtttaattgactcacagttctgcargctgtacaggaggcctcagggaacttacaatcatggtgaaaggcaaaggggaagcaagcacatcttcacgtggcagcaggaagagagtgaagggggagtt

SEQ ID NO: 16090 - DNA, 201 bp, Homo sapiens
atctgcagtctctcactcctcctgccggcctcccccagcagccccttccgcacctgggtggccttcagggagcctcacgcccctttcccacatctcacacrcatccatgcccccacttcatgcgtgtggctgaatgcatccctccaataggcgtgaccagtgtccagccaatgacaagcccctcgcacctgcctgccctgg

SEQ ID NO: 16091 - DNA, 201 bp, Homo sapiens
cagccggcccaggcccccgacaaagaccagggcagagaagagccagaggctgggctgggtctatgtcacattagaccaaggctggtgacccagatgggacmgcgccccccaccgcccccgaacaccagctccagccccggagccacaaggctctggcctggcccagacctgacgccagccccctgttggctggagaccaga

SEQ ID NO: 16092 - DNA, 201 bp, Homo sapiens
acttagagaggatgaagtctttgagccaatgtgatctgtgtgtgtctgtgtgtgtgtctggatcagtgtgtgtctgtgtgtgtgtgtgtctgtgtgtgtcygtgtgatctgtgtgtgtgtctgtgtgtgtccgtgtgatctgttttgtgtgtctctgtgtgtgtgtctgtgtctatgtgtatgtctgtgtgtgtcatgtga

SEQ ID NO: 16093 - DNA, 201 bp, Homo sapiens
ccctttgtgtgagggcgaggggtacggagcctttcgctcagagcgcaaacgtgcgtggtgcctcagtgtagctctcctcagacacacacggcatttttccyataccacaacgttccctcccattctaacatcggaatccaaactgcgccttcacgcacgggcatctccattccctggcagcgattgtctttggttttggtg

SEQ ID NO: 16094 - DNA, 201 bp, Homo sapiens
aatggcagatgcagccggccccacagggccccagcctggcgtacccacggggctgtggtggccacccgatttcttcctgtgcccggcccagacctctgacrtagaggccagacctctgctggggcccagacgggttccagggaagttttacccatttccagtgatctattttaatggctttccattacgtcaaggatttta

SEQ ID NO: 16095 - DNA, 201 bp, Homo sapiens
aacccgggaggcggagcttgcagtgagccgagatcacgccactgcactccagcctgggcgacagagccagactccgtctcaaaaaaaaaaaaaaaaaaaawatatatatatatatatatatataattagctgggcgtggtgacaggtgcctgtaatctcagctactcaggtggctgaggcaggagaatcatttgaacccag

SEQ ID NO: 16096 - DNA, 201 bp, Homo sapiens
gtcagttcattcattcccatgtcattaattcttgttctggttgatcctgggacagaactttcatggacctgccaggtccctccttcgagttctggaaattygcacccaatccaaggctatgacctgaaccagaaacctgtgctccagagcacctgtcagaatccttcccaggaatctctttgaagaataaacaatttggga

SEQ ID NO: 16097 - DNA, 201 bp, Homo sapiens
ggctggagtgcagtggcgcgatcttggctcaccgcaagctccacctcctgggttcacaccattctcctgcctcagcctcccaggtagctgggactacaggygcccgccaccacgcccggctaatttttttgtaattttttagtggagatgggttttcaccatgttagccaggatggtctcgatctcctgacctcgtgatcc

SEQ ID NO: 16098 - DNA, 201 bp, Homo sapiens
gcccccaggaggctggaagtggccctgagcaaggctgaccccgaaggtctccagggctcaggccttgcccagctggatgccagaccaaggcagccgctcaragcagccgcactgggcatctggactaggcgcctctgcaacccctgctcacctgccctcacccagagctcctggagcgtgggcccctgtctcagcccccag

SEQ ID NO: 16099 - DNA, 201 bp, Homo sapiens
gagggcgaggggtacggagcctttcgctcagagcgcaaacgtgcgtggtgcctcagtgtagctctcctcagacacacacggcatttttcctataccacaaygttccctcccattctaacatcggaatccaaactgcgccttcacgcacgggcatctccattccctggcagcgattgtctttggttttggtgagaaaggaaa

SEQ ID NO: 16100 - DNA, 201 bp, Homo sapiens
gctaccacactcgactaatttttgtatttttagtagagacagggtttcgccatgttagccaggctggtctcgaactcctgacctcaggtgatccgcccacytcggcctcccaaagtgctgggattacaggcatgagccaccgcgcccagcctgtttccactttttagctaacatgaataatgctctatggtggtacaagtt

SEQ ID NO: 16101 - DNA, 201 bp, Homo sapiens
cctcctgcccccgacagggcacctggctcccgaggccacgaaatggcagatgcagccggccccacagggccccagcctggcgtacccacggggctgtggtrgccacccgatttcttcctgtgcccggcccagacctctgacatagaggccagacctctgctggggcccagacgggttccagggaagttttacccatttcca

SEQ ID NO: 16102 - DNA, 201 bp, Homo sapiens
ggctggagtgcagtggcgcgatctcggctcactgcaagctccacctcccgggttcacaccagtctgctgcctcagcctcccacgtagctgggactacaggsgcccacccccaccaccacacccagctaattttttgtattttttagtagagacggggtttcaccgtgttagccaggatggtgtcgatctcctgacctcgtg

SEQ ID NO: 16103 - DNA, 201 bp, Homo sapiens
ggcccgtgagtctatgtccaggaagcctcgagtatccctgagttcggacgtgcaggactttcagtctaagccacaccaggaggcaggaacgtccccagccyctcccagatacccaggagcaccaaacctgttcagctggtggctggcgagatgcctaggagggcacaggtgccacagacacacctggtccccttaatccca

SEQ ID NO: 16104 - DNA, 201 bp, Homo sapiens
ccattctcctgcctcagtctcccgagtagctgggactacaggcgcctgccaccactcccagctagtgttttgtatttttagtagagacggggtttcaccayggtctcgatcacgtccagctaatttttgtattgttagtagagactgggtcttactatgttggccaggctggtcttgaactcctgacctcaggtgatctgc

SEQ ID NO: 16105 - DNA, 201 bp, Homo sapiens
aacttagagaggatgaagtctttgagccaatgtgatctgtgtgtgtctgtgtgtgtgtctggatcagtgtgtgtctgtgtgtgtgtgtgtctgtgtgtgtscgtgtgatctgtgtgtgtgtctgtgtgtgtccgtgtgatctgttttgtgtgtctctgtgtgtgtgtctgtgtctatgtgtatgtctgtgtgtgtcatgtg

SEQ ID NO: 16106 - DNA, 201 bp, Homo sapiens
ttaaaaggaggaggacaaagagggaaagcacccttcccagcccaggctgctcaggagttgctgacactgtgaacaaatccccagtccagccccaagtcccsgaaaccccgggcccctgaccatcagctccaggcagggcagatgacttgactaggaggatgctgagtctggccaagggccaggccagggacagagctggag

SEQ ID NO: 16107 - DNA, 201 bp, Homo sapiens
ctgcaggggggttgctgtgcgaacgttcaaagcatcctgcatcccatgctggagagttgtgcccagtacaggacggccctaagcccactggcgtctgttcrcacagacaccccctcggaaaagccaggtgcaggtgagacctctctgaacacggtggcagggtggcagggagctcccaggtgcccactcctcagatgccca

SEQ ID NO: 16108 - DNA, 201 bp, Homo sapiens
taacatcggaatccaaactgcgccttcacgcacgggcatctccattccctggcagcgattgtctttggttttggtgagaaaggaaataatggaacttagaraggatgaagtctttgagccaatgtgatctgtgtgtgtctgtgtgtgtgtctggatcagtgtgtgtctgtgtgtgtgtgtgtctgtgtgtgtccgtgtgat

SEQ ID NO: 16109 - DNA, 201 bp, Homo sapiens
acattatccatttgtatagttaatctttgtataatatgtgagatttaggtcaaggtttttgtttggttggttgttttttgttgttgttgttttgttttttkttttttttttgcatgtgaatgtcaaattcttccagcaccatttgttgaaaagattatactctttttttttgaaacaaggactcactctgttgcccagggt

SEQ ID NO: 16110 - DNA, 201 bp, Homo sapiens
cgtccccagccctgctggccacacctgcgcagagtttctgggtccccacagttgctgttggtgcttcctcagtaccacccctgcctcccctccctcagaayggctccctcctgccctgcacgctctggccaagctctctggcccctcctgcccccgtgccaggcagccagtggcctccgcctggatggcagctgcctaaaa

SEQ ID NO: 16111 - DNA, 201 bp, Homo sapiens
ggccctcggcagggtggctcacatcggggacagtccccgggatccagtgtctccagcccaggtgcagcatcttgtgatctgcctctcctcccacaccttcygcccttggggcctggggcagccttgagtgccttccccaaactggccccaccctcctggctgctcccctgcagagctgggcactgctacaggtctcctttc

SEQ ID NO: 16112 - DNA, 201 bp, Homo sapiens
tgcccggccctgcaccctccccaccccttcccaggtgctgatcaccagtactcactctgcaccccaaaccccaaaccccgtctcagcgtctgcccctgagraccctctgagtgtcaacccaactgacccgtctgcctcatcagtgacccctcggggctgcacacctctcccatcgcaggtcctggcactgctctccggcac

SEQ ID NO: 16113 - DNA, 201 bp, Homo sapiens
cacacgccaccatgcccagctaatttttgtatttttagtagagacggggtttcaccatgttgggcaggatggtctcaatctcctgacctcgtgatccaccygccttggcctcccaaagtgctgggattacaggtgtgagccaccactcccggccctcactgtcttgttttgttttattctgttatttttgtttttctaaga

SEQ ID NO: 16114 - DNA, 201 bp, Homo sapiens
ccacctcagcctcccaagtatttgggactacaggtacacaccaccacgcccagctaatttttgtattttttatagagatagggtcttgccatgttgcctargctggtctccaactcatgggctcaagtgatccacccgccttcgtctcccaaagccctgggattacagacgcgaaccactgcacccagctgagattcactt

SEQ ID NO: 16115 - DNA, 201 bp, Homo sapiens
accctctccctggacagcgccaagcccccgcatgctgaagcaaactctgcccgctcaggtaggtccccagatcggggcaggactgggggagcaaatcccakcaaaacccagcagcacggtacagggtcctgaggcaggaggatggggtggtggccatctgcagtctctctctcctcccacatcccctccgggtcctgagtg

SEQ ID NO: 16116 - DNA, 201 bp, Homo sapiens
aatggggcaggggctcaggctcgtgctggaggaagagtcggggacacagggcaggggctcatccttcaggaagtgccagtctgaagccagcacagggagcytggatttagcctcagatttagggccacgatcagcctgggttgggggtttctgagtgtctgacacaagggtggactctcctgggggctgcccccagcccag

SEQ ID NO: 16117 - DNA, 201 bp, Homo sapiens
gctgagtgggccgtgggggctgcctgtgccctgcccccgaagcatggacgggcacagcggccgcattgccccagcagtgggacggtgatgaccccactgtstgacccacgcacggccgctgcagctaaggccacactggggcctgaccaccttcaggagcccaacttcccctgggattgcaggtgtgtggggaccggaggg

SEQ ID NO: 16118 - DNA, 201 bp, Homo sapiens
gaacaggcagccttggctgctgccccccggacttcacctgccacatcaggtgccgccggcatagcaggccttcatcaaatattagtcagcacttctgtttycttctgcaggtggtgacaccatctaagaggcactggccagagagctgggcagcagctgccacctgggatgaagatgggcagagctgggccaccagggccg

SEQ ID NO: 16119 - DNA, 201 bp, Homo sapiens
ttctggacaccgtgctgcctccgagcttggcccagccttgtccggagcttctcctagtgtggcccccactcccatcccatgaagcctccctctgggccacytgccacaaacagggagcaggggagggggccggcagcacagtgccccagccccccagggcctgtgtaagcacgggccacctagcagctcaggccagagggg

SEQ ID NO: 16120 - DNA, 201 bp, Homo sapiens
ccaggcctctggcgggcacccctgtccccagcacacactcaccccaccctggctgggacaaaggggagtgggtgccaggcttggaggcccggcccagcccygtgggagctcattgctctgggggcctaagtggcacctttgccccagccggatatccgtctacacatgctcattactgcccctggccgcgctgtcattatg

SEQ ID NO: 16121 - DNA, 201 bp, Homo sapiens
ccacattccctcccggaggaccctgaagggcgtggggactgtctgagatgatcaagccctttgtgtgagggcgaggggtacggagcctttcgctcagagckcaaacgtgcgtggtgcctcagtgtagctctcctcagacacacacggcatttttcctataccacaacgttccctcccattctaacatcggaatccaaactg

SEQ ID NO: 16122 - DNA, 201 bp, Homo sapiens
ggggatattgtggtcatgggagaggtagacgtcctcctgcaatcagcctggagctgagtgggccgtgggggctgcctgtgccctgcccccgaagcatggaygggcacagcggccgcattgccccagcagtgggacggtgatgaccccactgtctgacccacgcacggccgctgcagctaaggccacactggggcctgacca

SEQ ID NO: 16123 - DNA, 201 bp, Homo sapiens
cgcgaaccactgcacccagctgagattcacttttttgaggaaggcaataaagggtgaatttgcagctggaaataaatcaattgataattggcttttacccyttgagcgtgggttgcattgtcctgtttcttcgtgtgtctagtgatttttgactgaatactgaacatcatgtggagagtctactctgcttcctcctctgaa

SEQ ID NO: 16124 - DNA, 201 bp, Homo sapiens
agccctaaccgggtgggtggcacagaggggagtgaggaaaggggcctgggtacaggatcagtctggacggggtcaggagtctggggcttggccgggtgagkcggctcactcctgtaataccagcatctggggaggccaagcaggaggatcgcttaagcccaagggttcaagaccagcctgggcaacatagtgagaccccca

SEQ ID NO: 16125 - DNA, 201 bp, Homo sapiens
cacctcacccaccaggcgcaacacagcccagcatagggcccctgccaggtgtcggtgtcagcagccccttccctgcctgctgtgccccccccacatgaccycacctcctccctcagccctaaccgggtgggtggcacagaggggagtgaggaaaggggcctgggtacaggatcagtctggacggggtcaggagtctggggc

SEQ ID NO: 16126 - DNA, 201 bp, Homo sapiens
cccagcgccttctcctcccgcgcttccccccgccgccctctcctcccgcccccgccgccctctcctccccccacccgctgcccgtctcctcccgcccccgmcgccgtctcctccccacaacccacccccgccgtctcctcccctccactccccccgccgccgtctcctccccacacccaccgccgtctcctcacgtgcagg

SEQ ID NO: 16127 - DNA, 201 bp, Homo sapiens
tgtgagggcgggagggcctggccagccaggcagggtcctggaggaaccgcctgctgggtgtccagctggtgcagctgatgctcccccccacaggacctgaycacgcctgccggagcctcctctccctctcggcagcccacagcggacactgctgttttcctaccacacctgccggcccggggcccatcagctgtccctgaa

SEQ ID NO: 16128 - DNA, 201 bp, Homo sapiens
tgcaggagacagcgcggggtcttttagggcacggggccaacggccggtgaggccggcgtccacccacgtcaccttcccccatgcctcagcctcctcatctmtaagacgtggcgaggatggcatggccggctaaggccacgggaagccccaagtgagacagggcgagggtcctgtactcaccacagtgacccggcagccggc

SEQ ID NO: 16129 - DNA, 201 bp, Homo sapiens
gtgacccccacctgcacccgacggccgcctgccccccagcccctgagactcgggacaccccctccctggaggcccctccccgccccaccctcccactgacmctactgtgtccacccgggagctccaacccagggacctggactggcagccacaagggggcaggaaggggcgggaagggaaattcaaagtctgcaaggggtg

SEQ ID NO: 16130 - DNA, 201 bp, Homo sapiens
ctcccgccccccccacctggcctcccgccccccctcacctggcctccagccccccccacctagcctcccgctcccccctccacctggcctcccaccccctyctcacctggcctcctccccacttctcacctgggcgagttctcaggactcagggtctttgcacctgggagctgaccagcctccggccagaccccacccctg

SEQ ID NO: 16131 - DNA, 201 bp, Homo sapiens
gcgtgtgtgtctctgtgtgtctgtgtctgtgtctgtgtgtgcatgtgtgtgtctgtgtgtctgtgtgtctacgtgtgtgtgtgtgtagacgtggggggggktgtgcactttatttcctcacgtgcccccgctgcctccagcaagagccccggcccatgccactcaccgcggagcagctccagcaggctgcccttggccatg

SEQ ID NO: 16132 - DNA, 201 bp, Homo sapiens
gctactcaggtggctgaggcaggagaatcatttgaacccaggaggtggaggttacagtgagccgagactgcgccattgcactccagcctgggcgacagagygagactccgtctcaaaaaaaaaaaaaagaaccaaggagcagttcctagtggtctagcccagcgatttcccttctggaagtttgtgatgacgcgggaggag

SEQ ID NO: 16133 - DNA, 201 bp, Homo sapiens
gggcgtggtagcaggcacctgtaatcccagagacttgggaggctgaggcaggagaatcacttgaacccgagaggcagaggttgcagtgagccaatattgcrccattgcactccagcctgggcgacagagcgagactccatctcaaaaaaaaaaaggaagaaggaaatttgttggctgggtgcggtggctcacacctgtaat

SEQ ID NO: 16134 - DNA, 201 bp, Homo sapiens
gacgtccataaatggatggagagagaaatgtggtctatccatacaaaggaatgctattcagccacaaaaaatgaatctagaaaagtgggtgaagaaaccakaaacaaaaggcacaactcgtatgattccatttgtatgatgtgttcagaataggtaaattcagagacacagaaagcatattagtggttgccaggggctggg

SEQ ID NO: 16135 - DNA, 201 bp, Homo sapiens
caccaccaccctggctaatttttttttttttttttttaatagagacagggtttctccatgttgcccaggctggtctcgaactcctgacctcaggtgatccrcctgcctcggcctcccaaagtgctgggattataggcgtgaaccactgcacccatccttttatcctttttttaaaacagctttattgagatatcatttaca

SEQ ID NO: 16136 - DNA, 201 bp, Homo sapiens
aacagcgccagccaagggcgagtcagatccagacagacccaggcccccccgcccagcgccccaccccgctgcacctcagcgccttgtagctgatgctcatrtggggtcaggatgccaagccaaagaccgggccacgctctgtaggaagtggggagtccctgaggtcctggcacacgcgggtaatgaccaacgtgggttgtg

SEQ ID NO: 16137 - DNA, 201 bp, Homo sapiens
tgggtaggtgggtgagtggatgaatggatggatggatagatagaaggatggatgggtgggtcaatagatggatggatagagagaaggatggatgggtgggkagatggatggatggatggatggatggatagagagaaggatggatggttgagacaatggatggatggatggatggatggagagatggatggatggatggat

SEQ ID NO: 16138 - DNA, 201 bp, Homo sapiens
tggatggatggatggatggatggatggatggatggggggatagatggatggatggatggatggacggacggatggggaggtggatggatggatggatggakggatggatggatggatggatggatgaggagatgaacggatggatgagatggatggatggatgatggagggaaggatggctgggtggggagatggatggat

SEQ ID NO: 16139 - DNA, 201 bp, Homo sapiens
ttgtttatggtttctcttcttggtgggatggatggatggatggacggatggatggggaggtgggtggatggatggatggatgtatgaatggggtggtagayggatggggaggtggatggacagaaggatgggtggggagatggatgagtagggagatggatggatggattggtggatggatggatggatggatggatgagg

SEQ ID NO: 16140 - DNA, 201 bp, Homo sapiens
gcccggccgcaggatgccggtctccacccggcccacgggcaccgtgccaatgcctgcagaggggagggggtgtgaggggaaggtggggcccgaggggatgytggggcaggatattcggggacagagcctggaaaccaacaaagcctgggactggatccccccgacaggcctgggggttggggccacatgggcggagtgcag

SEQ ID NO: 16141 - DNA, 201 bp, Homo sapiens
acctgccgtcacccagagctcctggagctcctgtcatctggtgcctcccagcccccagcccctgccctccaagcagtgaccgatccatgaacactggactmcctgtgtgagggcgggagggcctggccagccaggcagggtcctggaggaaccgcctgctgggtgtccagctggtgcagctgatgctcccccccacaggac

SEQ ID NO: 16142 - DNA, 201 bp, Homo sapiens
tgagaaaggaaataatggaacttagagaggatgaagtctttgagccaatgtgatctgtgtgtgtctgtgtgtgtgtctggatcagtgtgtgtctgtgtgtytgtgtgtctgtgtgtgtccgtgtgatctgtgtgtgtgtctgtgtgtgtccgtgtgatctgttttgtgtgtctctgtgtgtgtgtctgtgtctatgtgtat

SEQ ID NO: 16143 - DNA, 201 bp, Homo sapiens
gtggaagctgggggcgcggcctcgccggggccaggaaaggggcggggccgggtggggcccggggaggagcctgtgcgccccgccctccgtgacgcgccgcsgcccccgcgcatataagtgggcgcgtccgcgcgtgcgcaccccgcgcgcgcctctctgtcgtggcgcggcttcccgcggtcttctctgcaaatgggctcc

SEQ ID NO: 16144 - DNA, 201 bp, Homo sapiens
gggatgctggggcaggatattcggggacagagcctggaaaccaacaaagcctgggactggatccccccgacaggcctgggggttggggccacatgggcggrgtgcaggggaagggaggccagggacaagggcagacacagagattccaagggaagtgggggctctcccacccagctggggaaataagaggctgagcagcag

SEQ ID NO: 16145 - DNA, 201 bp, Homo sapiens
ctgcctgcaccctggggatgagcctcccaggggctgccgcccaccatcgcctcccacagagattcagagcctccccacccctggagggacctccccacacsgccaggaaccgagcagctgggccagggcaggaggaagggcagggagaacacagaggggacgtctgcctttttaaagacgtgactttgagcatacatagag

SEQ ID NO: 16146 - DNA, 201 bp, Homo sapiens
caccccagggctgccctggacagcagccctccacagcccagcacaagaaaatggagcagacgggccggctgcccatcaatcagctattaatagtagcgtgygccctggcagggccctaggacaagtgagggcagtaccatccccagccccagccttggccctggggggaagggggtaaggctccagcgccctccagcccca

SEQ ID NO: 16147 - DNA, 201 bp, Homo sapiens
cacaagaaaatggagcagacgggccggctgcccatcaatcagctattaatagtagcgtgtgccctggcagggccctaggacaagtgagggcagtaccatcyccagccccagccttggccctggggggaagggggtaaggctccagcgccctccagccccagctcaacatggcagagttccagagccttctgcagaccctcc

SEQ ID NO: 16148 - DNA, 201 bp, Homo sapiens
tggccctggggggaagggggtaaggctccagcgccctccagccccagctcaacatggcagagttccagagccttctgcagaccctcccaggtcacctcccycaccacagggcaagtccggcagctcgatggccacccctcccccaccaagctccccctaagagagaggctgccccaccagaccctctgaggcctgagtgcc

SEQ ID NO: 16149 - DNA, 201 bp, Homo sapiens
cacgttgagctcccaggtgaccggccaagagccaacccttggccatcccagcaagcccagaagcatgcacacttcccaaagcccaaccctgctccaagatyccaggggaggcagccaaggaggcccccacggcccagcccaaagcccctgcacggtgtccaggaccaggacaatggcctggcagagatgaaaccgaccgcc

SEQ ID NO: 16150 - DNA, 201 bp, Homo sapiens
gagcaggcagccagcaagaggtggatgtgggtccaagcccaggccacacggctcccagcaagagccatggccaggggccagtcggcagcccctctgcccgrcaaggatgtgggccagcgtcgtctgcacttcagaggagacgagaaccaggaggcggcccccgagggcatcccgcgggtcctcacggaggctgcgttctcc

SEQ ID NO: 16151 - DNA, 201 bp, Homo sapiens
ttcccaaaagcccccagacacaccaagggcaccgccgaacccctcagagccaagggagaggagagctagcgttccctgagctcaccttgcctggtggcacrggtcccctctgtctgcggccactgtcatgggagaagccaggctcagccactggcaagagcaggcagccagcaagaggtggatgtgggtccaagcccaggc

SEQ ID NO: 16152 - DNA, 201 bp, Homo sapiens
gagagctgggcagcagctgccacctgggatgaagatgggcagagctgggccaccagggccgtggtgtgaacacaccactctccctccaggggccgaccaasgagctccgggggtccaaccctggctccggctttggcagaactctcacctcgcccccagacacctgtgggaggagcacagtgcaggtggcgacagctccca

SEQ ID NO: 16153 - DNA, 201 bp, Homo sapiens
cccttggggctcacgctctctgggcaccatgatgtcctgggctgggggtccgggcggcatgggggccgctccaacctgcattttctagccacgtggacccstacgctccagctcctgggtctgggtttggggggctgagcctgtgtgtgatgtgcgcctgtgtgcgtgtctgagtgggtcagtcccagcttactgagtgct

SEQ ID NO: 16154 - DNA, 201 bp, Homo sapiens
actcaggggtggcatctgtggatggcgtgcagcttctcccgcagcgtggcgaaggagggccgttcctcggggctgctcctccagcactccagcatgagcamgtagacctccgccgggcaggcagccgggcgcggcagccggtaccctcgcatgatctgctgcagcgtctcgtggttggtcatccctgggaggcgcggggca

SEQ ID NO: 16155 - DNA, 201 bp, Homo sapiens
catctgtggatggcgtgcagcttctcccgcagcgtggcgaaggagggccgttcctcggggctgctcctccagcactccagcatgagcacgtagacctccgycgggcaggcagccgggcgcggcagccggtaccctcgcatgatctgctgcagcgtctcgtggttggtcatccctgggaggcgcggggcaagagctgcctcg

SEQ ID NO: 16156 - DNA, 201 bp, Homo sapiens
ggaaggggcggtcgcaggcgcgtcagggccacgtggcagcagggaggggactcactgcccaggaaggcctgcaggttccccttgcgcatgagttccgtgasgatgtacacaggctccccgcccgagcacactgcgtgcagccggatgagccgctcgtgccgcaggcccttcagtgtctggatctccttggcgaggtcagtg

SEQ ID NO: 16157 - DNA, 201 bp, Homo sapiens
gctccgcgcacgtagcactttttggcccgcccggcgcccccgtcgcctccacaagggctgaagaggacgggcgggctggaccaggcggggctccgagacgsgtccgagacgggggcctgggcccgggagaggggcgggggctgggctcccggacccgggcgcggggccttttaacccctgcagacccaggaccggccgggc

SEQ ID NO: 16158 - DNA, 201 bp, Homo sapiens
gactctgacatccctttcctctggttagggggcgggacaccacgtgagggtctgcagggagagggtctgggagtggccttcctgggttttatggcctgctycagggaagaaaggcagggaggttagaatggcctcaacggtgaaatatttatctttttcttcctccctaatcccagaattcagaaactgttagtgggtttg

SEQ ID NO: 16159 - DNA, 201 bp, Homo sapiens
gcagggaggttagaatggcctcaacggtgaaatatttatctttttcttcctccctaatcccagaattcagaaactgttagtgggtttgcataagttcaatragaatctgttcttgtaatagggcacaattgaaaacattggttatattaccaaggctttgactggaatgtcctattttcagatacgactaaaggagttagg

SEQ ID NO: 16160 - DNA, 201 bp, Homo sapiens
taatcccagaattcagaaactgttagtgggtttgcataagttcaatgagaatctgttcttgtaatagggcacaattgaaaacattggttatattaccaagkctttgactggaatgtcctattttcagatacgactaaaggagttagggttgactgcatggtccaataaagccccttggaaaaaagctggcctggtacctca

SEQ ID NO: 16161 - DNA, 201 bp, Homo sapiens
agacaccgcccagccaggaccgggtgtataaagaaacgggatttccgtaggggcaggccgatttcccctgcggggccgagggaggtgtggggaggattctrcgctggggggaggaggagagggaggacgcctttctgcctgggaagggaaaacgcgccccctcctgattggcatggcgggccgtcccccgggccccagggc

SEQ ID NO: 16162 - DNA, 201 bp, Homo sapiens
gcggggtgtgggccagccctggactgtggacttccaggtggagcttgcagaagctccaggtgacctgcgccctttgtgtgtctgactccctcaggtcactrgaacacaaaccccacacagaagaccacggcccagcatggagcccctggggtccaccccctccacttccgcacacctggaagcactgccccacctgcccct

SEQ ID NO: 16163 - DNA, 201 bp, Homo sapiens
cgccggggagggtcgcgccgcgggcgcccgcgcttcacttgcccgccttctgcgccttctgcgccgacttggtgaccttgccggcgccgccgctcttcttytccacgttcttgatgacgcctacggccaccgtctgcctcatgtcgcgcacggcgaagcggcctggggggcggggggcggcgtgtgggcggggccggagga

SEQ ID NO: 16164 - DNA, 201 bp, Homo sapiens
agatgtctcagacagtaagttaacaaaagcgtttttctaggacgaatgtaggacctcaaaggctgggcatcccagcagtgcagcgtggaagacagacccgsgattgcacacaggctgggagccacagggcctgcacccctcccagaactgattgatcccctcgttgagtgctcggtggccccctcggtggtatgcgggtcc

SEQ ID NO: 16165 - DNA, 201 bp, Homo sapiens
ccctgtgagtgtgggcggggcgactgactgcttctgcctggggcctggtggccctgctccctgctccctgcaggccctgctccctgctccctgcaggctcyctgggccccacttggatgctgcaggtctctatcactaaaggggcctctcagccagatgcagcacaggcacagcggcacatgagcgtccctggcatttctc

SEQ ID NO: 16166 - DNA, 201 bp, Homo sapiens
gctggggtgagcatgatgcccccacagtgcacacagagatgcctgcaacatctttggctgcagcccactggctgggggtctcctatcagtgcccttctctrgggtctcagatttgtttatggtttctcttcttggtgggatggatggatggatggacggatggatggggaggtgggtggatggatggatggatgtatgaat

SEQ ID NO: 16167 - DNA, 201 bp, Homo sapiens
gtcggggtcctgggacgccggccccctccgtcgggaccccacacccagaccctgccccccagggccggcctccgcacctgctccgaaatgggcgcggctaygcaggtccaccagcaggtggcgcaagggcctgggagtcgctcgctctacgagcgaagccgccagatgggataaacccctcccgggcgagggctccccttt

SEQ ID NO: 16168 - DNA, 201 bp, Homo sapiens
aggagtgggcttctccccagagtcctgggtgggggatggggatcagagagcagaccccgtctcatgaccgctccccaccaccgtctcagccaccaaagagraatcgcttcaaaaggtcagctaggaggtcacctcatccaggacccccaccccagggctgccctggacagcagccctccacagcccagcacaagaaaatgg

SEQ ID NO: 16169 - DNA, 201 bp, Homo sapiens
accatttggagagaccacgcagcgccaggctgggtacgtccgtgaccagcagagccgggtgatgagtcacctgcccagcgctccagggccctgtcctgcamgcgcactcccctcccccggcggcagggccagggacacggcgccccacccccacccgctgccaccggggagagatggccactgctccccactcccctcctc

SEQ ID NO: 16170 - DNA, 201 bp, Homo sapiens
aggctgggccagagcccgacggagatgcgctgcccagattaggaacccagaatagctctaggcacccccctccggactctcacagggacagacagcggccrggaggtgggggtccctgttccagcctgaggaaggaggaccgcccctgccgagcccagcaagtgccaggtggagatgccctcggcccgtgggggtataggg

SEQ ID NO: 16171 - DNA, 201 bp, Homo sapiens
cccccacccccacgcactcggatcttcctgccagcggggtctcgggaggtgtgtgctgagtgggggcagagccctggcacctgtcctctcagccctgagtkcccactgggtgttgacatggaggccccgggtcgggcccagcagctgcgactgggcaaatccatggggatccccagcgactggacccctacctggcctgct

SEQ ID NO: 16172 - DNA, 201 bp, Homo sapiens
ggcaggagaggaggcagggagggcctgctaggtgccccggcacttccgagtgctgccgatgccgtcaaacaggagccaggaataaaaataaccgcctggcragaaagcaaggcccgccccaccccacccagctggtctctatatttaacgcctcccctgcagcctgaaggttaggcagggatttggaagtgggcttgctgc

SEQ ID NO: 16173 - DNA, 201 bp, Homo sapiens
aatgtggcaacctccccaaagcacctgtgtgctgactctgggcaagggtgtcggtggctgctccaaagggtctcccaggcgccaggacacgtttggtccayggtgtggcccctcggggtcctgggagccaccgactcagttccgcagacacttggaacacacagctaacggggctgcggtcacaaggctaaacactaacac

SEQ ID NO: 16174 - DNA, 201 bp, Homo sapiens
acagaggctacaaggtaggccccacaaggctggctggaggaccttgagaacctgtgaggcaactgggcacagaaaggccaagattcctgtccaaggacacrcagcaagtaagggggcctgtggcctgtgctttccctgccctcccccaggtcaggacttgggcccctcttcttgcatctgagtccctggtcacagtgccgt

SEQ ID NO: 16175 - DNA, 201 bp, Homo sapiens
aacctggggggggtggggggaggggaaatggcgagtcaagagggcaccagccaatcagggcttccctgggggcaggccccgcccctcctcgacccctcccrgagcccccaggccccgcccctccttgccgcctcccagagcccccaggacccatccctgagctgtttggggagacacaggcaaccccttctttggctggct

SEQ ID NO: 16176 - DNA, 201 bp, Homo sapiens
ctgtttggggagacacaggcaaccccttctttggctggctagggtttcacgagcctcgggaaagaagatgcagctaaaattaaccgctatcaagctgtcarccctggaaataaacctgcctcccattggctgccggtgacgtcactgctgggttaataatagccgccgagtgcctaacgaaccacctgtgcatggggcaca

SEQ ID NO: 16177 - DNA, 201 bp, Homo sapiens
ggtatctgggtgtgcctgaggcagacctgagtctaccagggaggcccaggagggatgcagcccctccgccagggggaagggcggcctggcctgccaccccsacctgcaggccccagcagggagcgttgccatggtgagaggcagcagcagcaggatgccctccctccaggccctgctgcccgggagcccagcacccaccct

SEQ ID NO: 16178 - DNA, 201 bp, Homo sapiens
cctctcatcccagggggactgccgtgctctgcctggagccctgcttgtggggttatggccaaggagagccgggagtgtgggcgcctccaagcaccctctcrgtcttgtgctgtcctcaccccactgcctgaagagagcagcgcacgaattttgtctggtctcagagtcgtttctggagggagacgtacctggcagcagcta

SEQ ID NO: 16179 - DNA, 201 bp, Homo sapiens
gctgtcctcaccccactgcctgaagagagcagcgcacgaattttgtctggtctcagagtcgtttctggagggagacgtacctggcagcagctactcccccrcaactggaagcagcggttgactccacatcaatacaaagacaaggttacttcagtctttttacttttatattttattgttttactattttcacggtatata

SEQ ID NO: 16180 - DNA, 201 bp, Homo sapiens
taaatcattgttttatctgtcattatttttttgaattgtcacacagtaagttgacttttttggaagatgtacgactctgtgaatattcacacacacgtatygccaccgccgcactcaggaagcaggacatcccacgactcggaaatctccccagacataccgtttgcggtcacccatcctcttccccctggaaaccccatt

SEQ ID NO: 16181 - DNA, 201 bp, Homo sapiens
tttttggaagatgtacgactctgtgaatattcacacacacgtattgccaccgccgcactcaggaagcaggacatcccacgactcggaaatctccccagacrtaccgtttgcggtcacccatcctcttccccctggaaaccccatttgttctaagaatgtcagatgaggcccaggacgtagacgcaccgggttgcgttgagg

SEQ ID NO: 16182 - DNA, 201 bp, Homo sapiens
tacacgacacaccacagtctctgttcacccgcagaagaacacctgcaatgtttccaggttgggcagctatgaatagagctcccataaacatctgtgtaccrtcctttaacgtaaacctgtttgaatttgtcttggataaatgctcagaagcggaattgctgggtcatacgtcaggcgcaggtttcccttcaccagaagctg

SEQ ID NO: 16183 - DNA, 201 bp, Homo sapiens
acctgtttgaatttgtcttggataaatgctcagaagcggaattgctgggtcatacgtcaggcgcaggtttcccttcaccagaagctgccgacctggcttcrggagggaaacccgcgccgtctgcacccccaggggagttcccggagcctcacggccgctgcagcacttggtgtccttggtgtttggaaatttttttttttt

SEQ ID NO: 16184 - DNA, 201 bp, Homo sapiens
tattgtgtgtctttttatcagagctctgctgggtgtgaagtgttgtctcattggggtttggatttgcatttccctaatgactaaccctatggatcttttcrtgtaccttttagccatttgcatgtcttttttgcagaaatgtctattcaaatccttgacttttttttttttttttttgagatggagtctcactctgttgtc

SEQ ID NO: 16185 - DNA, 201 bp, Homo sapiens
tggccaagttttcaattgaattgtttatttttattttttggtgttgagtcttgagagttttctatgtattgtggatacaagtcctttgtcagttctgtgayttgcacatattttctccaagtctgtggcttgtctttctaatctcttaacaggatcattcacaatacaagttttttatttcagtgaagcccagtttatcca

SEQ ID NO: 16186 - DNA, 201 bp, Homo sapiens
ggctcaagcgatcctcccaccacagcttcctgagtagccgggactgtaggcacgtgccacgaagcccagctattttttgtagagacaagttctcaccatgytgcccctgctggtctctaacccctgggctcaagtgatccgcccgcctcagtctcccaaagcgctgggattgcatgcgtgagccactgtgcccggcagaaa

SEQ ID NO: 16187 - DNA, 201 bp, Homo sapiens
aaaaaaagaaaaataggtaaattgttcatgaccttcttagataagacactaaaaccacaagcaaagtaagaaaaggtaggtaactggactttgccaaaatwaaaaacttttgagcatcaaaggacactgtcaagagaatgaaaagagaatctatagaatgggggaaaatatttgtgaatcacagcagataagggtccagca

SEQ ID NO: 16188 - DNA, 201 bp, Homo sapiens
cagcaattccactcctaagtacagacccaaaagagttgaaaacaggtattcaaacaaaaacttgtacatggaatgtttgcaacagcactatttataatatscaaaaggtggaaacaactgacgtccataaatggatggagagagaaatgtggtctatccatacaaaggaatgctattcagccacaaaaaatgaatctagaa

SEQ ID NO: 16189 - DNA, 201 bp, Homo sapiens
ttagtggttgccaggggctggggacggggacaggggaagagactgtttaatgggtgtagtttccttttggggagatgaaatgttttggaactagtcagagrtgatgggtgcactgcattgcgagtgttccatgatgctactgaattgcatattttaaaatgcttaattttatgatatgggaattttacctcaacaaaaatt

SEQ ID NO: 16190 - DNA, 201 bp, Homo sapiens
gggacggggacaggggaagagactgtttaatgggtgtagtttccttttggggagatgaaatgttttggaactagtcagaggtgatgggtgcactgcattgygagtgttccatgatgctactgaattgcatattttaaaatgcttaattttatgatatgggaattttacctcaacaaaaattattgaggtagcataatttct

SEQ ID NO: 16191 - DNA, 201 bp, Homo sapiens
gcgcggggccttttaacccctgcagacccaggaccggccgggccgccccaagacgaacgccgcagggctgggctcagcccaagccagacggcgagagtcgsaccgaggtggaagctgggggcgcggcctcgccggggccaggaaaggggcggggccgggtggggcccggggaggagcctgtgcgccccgccctccgtgacg

SEQ ID NO: 16192 - DNA, 201 bp, Homo sapiens
gagtttattatattcgtgacacggttggcaaggaaacttggttatttctgtggcatgcagcattttaatgtaataaccaaaattatgactgataacattgyaccagatttctaggaatagcatgtgagataggatatatatcataggataacgtatcagatttctaggaattttatagagtttctgcaacattcatatcaa

SEQ ID NO: 16193 - DNA, 201 bp, Homo sapiens
cttggttatttctgtggcatgcagcattttaatgtaataaccaaaattatgactgataacattgcaccagatttctaggaatagcatgtgagataggatayatatcataggataacgtatcagatttctaggaattttatagagtttctgcaacattcatatcaaaaccaaacccgtaaatagaacctccagaagacttag

SEQ ID NO: 16194 - DNA, 201 bp, Homo sapiens
ggggaccggagggcccgggggacagggaactgggaggctcccaggccgtcagaggggcccagggctgggccagtgaacaaggcacgtgaacaaggcagcgsctgcgtggtgggccctgctgtgcgtgccattcagaatgggggccccaccggactcacggtggcttcccacctccctgcccagcctgggctcccgagggca

SEQ ID NO: 16195 - DNA, 201 bp, Homo sapiens
aggtcgtgggtctgcacgtaatagaggggtctccaccatgggcccctgcccgacggcctctttacagcctcccctgcttgttgcttgggtcccccgggagmtaaccctacacagcctgtgactcacgcacacacacagtgggtgcccaatcactgatgagaaacgcgggatctcaggagcgtgaccctcctcagcctgagc

SEQ ID NO: 16196 - DNA, 201 bp, Homo sapiens
cagcggggtgccggcctgggcagtgtccctcaggccctcccagctctgtctggggtcggttggggaggatgcagggggaggggtggggggtggggaatgcrgaaggagggtgccggggcacctggccgggcagcgtccctcagagcccggccagactctgggcccgtgagtctatgtccaggaagcctcgagtatccctga

SEQ ID NO: 16197 - DNA, 201 bp, Homo sapiens
caccctgaggcccctggaaatagcctccaagggcagctcccaggtcaccaagcctcccggcccacccttcctgtgccacctggaacccacccagggagatkgaatcggcagctcctgccaatgcccttggggctcacgctctctgggcaccatgatgtcctgggctgggggtccgggcggcatgggggccgctccaacctg

SEQ ID NO: 16198 - DNA, 201 bp, Homo sapiens
ccaagcctcccggcccacccttcctgtgccacctggaacccacccagggagatggaatcggcagctcctgccaatgcccttggggctcacgctctctgggsaccatgatgtcctgggctgggggtccgggcggcatgggggccgctccaacctgcattttctagccacgtggacccgtacgctccagctcctgggtctggg

SEQ ID NO: 16199 - DNA, 201 bp, Homo sapiens
cccctgtctcagcccccagtcccagcccctgctcacctgccttcacccagagctcctggagcgtgggcccgtctcagcccccagcccctgctcacctgccytcacccagagttcctggagcatgggcccctgtctcagcccccagcccccagcccctgctcacctgccgtcacccagagctcctggagctcctgtcatctg

SEQ ID NO: 16200 - DNA, 201 bp, Homo sapiens
gtggctcacacctgtcatcccagtactttgggaggctgacgcacgtggatcacttgaggtcaggagttcgagaccagcctggctaacatggtgaaaccccrtatctactaataatacaaaaattagccaggcgtggtggcacatgcctgtaatcttacctacttgggaggctgaggcaggagaatcacttgaacccgggag

SEQ ID NO: 16201 - DNA, 201 bp, Homo sapiens
agccctgagcatcctcacgttggccgtgggctctccgttagccctgctgggcgtgacctccagttccctgttcatagtgaccgccagccccagccacaggwtaacagtcagccctggccatgggccataggcctccaaactcggcttcgctgagcccctgcacagacatggagctgacggcctggtgagctgcccggaagc

SEQ ID NO: 16202 - DNA, 201 bp, Homo sapiens
tgcaagctgtgtcctgaggaggcagcctaagccaggctgtgcaggaggtcaggaggggcagccagtgggcggctgcaggggggttgctgtgcgaacgttcraagcatcctgcatcccatgctggagagttgtgcccagtacaggacggccctaagcccactggcgtctgttcgcacagacaccccctcggaaaagccaggt

SEQ ID NO: 16203 - DNA, 100 bp, Homo sapiens
cgggcatctccaagaatgggcagacgcgggagcatgccctgctggcctayacgctgggtgtgaagcagctcatcgtgggcgtgaacaaaatggactccac

SEQ ID NO: 16204 - DNA, 100 bp, Homo sapiens
cactcggaacctccccaggcctccagcagcatgaccgcctgtggcctggytcgggacgccccgaggaagcagcccggcggtcagtccagcacagccagcg

SEQ ID NO: 16205 - DNA, 201 bp, Homo sapiens
gcgtgtgtgtctctgtgtgtctgtgtctgtgtctgtgtgtgcatgtgtgtgtctgtgtgtctgtgtgtctacgtgtgtgtgtgtgtagacgtggggggggkgtgtgcactttatttcctcacgtgcccccgctgcctccagcaagagccccggcccatgccactcaccgcggagcagctccagcaggctgcccttggccat

SEQ ID NO: 16206 - DNA, 201 bp, Homo sapiens
ctcacctcagtacagcactggctgtaaatacttcatcagagctctttcttagattgaagttgttttctgttcctgctttgccgagatgttcaccgtgaacrcacactaaatgttgtccaatgctcgctcactgtccatcgcttgatgtaaggggcttacaactgcaggttggtgcatttttacaaatcccagcacctgtgc

SEQ ID NO: 16207 - DNA, 201 bp, Homo sapiens
agagtctactctgcttcctcctctgaagctgtcggtgtttgctttgcaggttggttcactgctgggccctgtggacttgttctcatgctttgtcagtgtcratgtcgaaagcccaaagtgtttcccaagtcctgctaccttggtaagactcaaccctcaatctcagtctcccctgcagatctctgtggggcttggtctgaa

SEQ ID NO: 16208 - DNA, 201 bp, Homo sapiens
cccaaagtgtttcccaagtcctgctaccttggtaagactcaaccctcaatctcagtctcccctgcagatctctgtggggcttggtctgaactttcgttagrtgagtgtggagtaggcattattgtacattgtagtcctttctcctcaaaaaaaaaaaaaaaaagtaaggtctctccactctagccaggtccaaatgccaaa

SEQ ID NO: 16209 - DNA, 201 bp, Homo sapiens
gaaataaatcaattgataattggcttttaccccttgagcgtgggttgcattgtcctgtttcttcgtgtgtctagtgatttttgactgaatactgaacatcrtgtggagagtctactctgcttcctcctctgaagctgtcggtgtttgctttgcaggttggttcactgctgggccctgtggacttgttctcatgctttgtca

SEQ ID NO: 16210 - DNA, 201 bp, Homo sapiens
aggaaccagaggaaaccacataaaccaaaggggaaccttgtggttaggacaaagatctgtgtttctataaaaacgaaaaacaagactcatccccagaagtsctgggtgggccatgctgcagccttccccgtgacactctccttgggccagggccccggcagaggcacccagctcctcacctgacagcagacccggccaccc

SEQ ID NO: 16211 - DNA, 201 bp, Homo sapiens
gcagcgtgtgctcggccgcccgggccctggccacactgaacagccggggtgtgacctgcatgtggtcgcccgccagcacgaggcgggtgccgtgcgaggcrtaggccagcggggtgagggcctcgcactccagcatctgggccgcctcatcgatgagaatgtgggagaagaagccgaccggcaccctgagctcacgggcct

SEQ ID NO: 16212 - DNA, 201 bp, Homo sapiens
gcagctgggccaggtgttgtaggcctcctgcaccttctcgacgacctgcgcaatctcagccagattcagccaggacgccatggacatgtcccggtctgggytgcccgccacgtggcagaacatgagcgggtagtgccgggggtggggcggaaccttgcccctggcgtggatggggttgcccttggccacgtagaagtgccg

SEQ ID NO: 16213 - DNA, 201 bp, Homo sapiens
gggccgtgcgcccgtcgccatcaggggcagggggtgtgagcaggtccccccgctggaggccacccagctgctcggcctcccacacagccatctccacggcrctgtgtgcaaactggcagcgggactccccacgccagcacggctgcccacgccccacaaacctgcagtaggcaggaggctggccggcccggggccgcggcc

SEQ ID NO: 16214 - DNA, 201 bp, Homo sapiens
gatgcgcagtggttctcgaaggcctcctgagagtggcaggtgaccaagcaggccgggcagtacagctgggccccagggggctggccaaggggggccgtgcrcccgtcgccatcaggggcagggggtgtgagcaggtccccccgctggaggccacccagctgctcggcctcccacacagccatctccacggcgctgtgtgca

SEQ ID NO: 16215 - DNA, 201 bp, Homo sapiens
tcctgggttcaagtgattttcctgcctcagcctcccgagaagatgggatcacaggcacccaccaccatgcctggctaatttttttttttttttttttttttcagtagagacggagtttcaccctattggccaggctgatctcgaactcccgacctcaggtgatccacctgcctcggtctcccaaagtgctgggattacagg

SEQ ID NO: 16216 - DNA, 201 bp, Homo sapiens
ctaggtgaggagactgaggcagagaggctaagggacctgctgcaggtcacgcaggtgctgagcggcagtgcctcggtattagctccatgacccaggctgtygacgtctgcccgggctgaagtcaccacttccccagggctccctccgcccagtcggagctgttctccgctcacctcagagtggacggcaaacgtccagctg

SEQ ID NO: 16217 - DNA, 201 bp, Homo sapiens
agtgaggactgggccacccccgacaaggagacggcacccccaccaagctcggggatgagcgcaggacgcagtgaggactgggccacccccgacaaggagasggcacccccaccaagctccagacacctcaggggccgagccccacctcagccctgggaggcaaatactgcagccccctcttacagatggggaaactgaggc

SEQ ID NO: 16218 - DNA, 201 bp, Homo sapiens
agtgaggactcggccacccccgacaaggagagggcacccccaccaagctcggggatgagcgcaggacgcagtgaggactgggccacccccgacaaggagasggcacccccaccaagctcggggatgagcgcaggacgcagtgaggactgggccacccccgacaaggagacggcacccccaccaagctccagacacctcagg

SEQ ID NO: 16219 - DNA, 201 bp, Homo sapiens
tacgccagagggggcagcagcgcagaaggaggtggtctcctgtgagggtgggagtcagatgggagtcagtcagggtcaggtgggaggagtcagggtcaggygggaggagtcagggtcaggtgggagtcagtcagggtcaggtgggaggagtcagggtcaggtgggaggagtcagggtcagatgggagtcagtcagagtcag

SEQ ID NO: 16220 - DNA, 201 bp, Homo sapiens
tcaccatgcggtactgagtgtccagcatatgtgcgtcctcgtggtaccgctcgaacagagaccggtccagacccaggttttgcagccgctcattcttgacyacaggccgcagctgcttgtggtctccgagaagaaccacctggaggaataggcaggcctggccctgacacccctagacccagagggaccccagccccacac

SEQ ID NO: 16221 - DNA, 201 bp, Homo sapiens
ccaggtgcaggctgcgcgcccgccgctgatagctctgggcaagtgcgtgctggaggctgaaggcctggcagagcccatcgatgtccctggcagagtaggcrgagcccccatggcccagcgccagcaggatctgccgctgcaacaccacgtccaggtacctgcggatgggcgaggtggcccacgtgtaccagtccacctgca

SEQ ID NO: 16222 - DNA, 201 bp, Homo sapiens
tctgagacttcccagggacagcagaacttccttacactggtcccaaggaagcccctcttggccaccctgagaggtgttcctgtccccagatgcccaggagragcaagagtgtggggaccggcccttgccgttcctcctccaagtccacccacttcctgccccagggagatcctgaggccaggaggcaggctggcccaggca

SEQ ID NO: 16223 - DNA, 201 bp, Homo sapiens
cgagccggatgcagaggtagcagcagctgaagttgatgtcggcacagttctcctcgaggaaggcggcctccaggcggaaggcgccctgcagctgcccctgyggcgtccgtgacgcctcccaggagacactcaggtgctgaagtgtgacggagtcattctcggcaaccgcgccggtggccgactccagggcgcagaatggtt

SEQ ID NO: 16224 - DNA, 201 bp, Homo sapiens
aatgtgggagaagaagccgaccggcaccctgagctcacgggcctgggaggtggtggtgaccaccacgcggtgccgcgccagctctgcccgtgtgggcgggyggaaagcctggcggtcgtcggtcaggcaacagtactgcagcgtgactgggtccgtctggctcagcggccggtccgtgtacatcacacggagaggagtggc

SEQ ID NO: 16225 - DNA, 201 bp, Homo sapiens
cagccacctcctccaggttggccttggagttctcattcccttcgtccgtggacaccagcaggctccgctcgtggccctgcacgtggccaaagatgacaggrcagctctccttgccagcgtggcccaggacactgggcggcctcctcaggccctgccacgtcttcagcttgctcttgtagaacgccacagaggggaaggcac

SEQ ID NO: 16226 - DNA, 201 bp, Homo sapiens
tgacctgcatgtggtcgcccgccagcacgaggcgggtgccgtgcgaggcgtaggccagcggggtgagggcctcgcactccagcatctgggccgcctcatcratgagaatgtgggagaagaagccgaccggcaccctgagctcacgggcctgggaggtggtggtgaccaccacgcggtgccgcgccagctctgcccgtgtgg

SEQ ID NO: 16227 - DNA, 201 bp, Homo sapiens
ccctggccacactgaacagccggggtgtgacctgcatgtggtcgcccgccagcacgaggcgggtgccgtgcgaggcgtaggccagcggggtgagggcctcrcactccagcatctgggccgcctcatcgatgagaatgtgggagaagaagccgaccggcaccctgagctcacgggcctgggaggtggtggtgaccaccacgc

SEQ ID NO: 16228 - DNA, 201 bp, Homo sapiens
ggatgacctcatgccggtccagctcgaacttccgagcctcccacaagaccttcttgtacctgccggggacactgcttgtcaccccagggcccccatgctgyaggcagctccaccccctggcccctgccacttaccagaccaggtcctccctggagaagagctcccctctctgcagccgggtgtcaaaggccttgatttccg

SEQ ID NO: 16229 - DNA, 201 bp, Homo sapiens
tgactcacaggcaccagacactcaccacctcagccacctcctccaggttggccttggagttctcattcccttcgtccgtggacaccagcaggctccgctcrtggccctgcacgtggccaaagatgacagggcagctctccttgccagcgtggcccaggacactgggcggcctcctcaggccctgccacgtcttcagcttgc

SEQ ID NO: 16230 - DNA, 201 bp, Homo sapiens
tcaggacggtgttgagcacgcgggcgtcggtgaagaactcaggggccagtgccccagggctgagcaggctctggcaggtgtgcacagtgctgagcaccacracccggaactgccgccctgcagggggcacgcagtcaggtcaggctgggtgcgcaagacggtgggaccagccccacccctgccgatgccaggctgaggagt

SEQ ID NO: 16231 - DNA, 201 bp, Homo sapiens
cagcctgtgtgcctcggggaggccagcgccgtctctgcgccacaccctgctcgacctgctccatggacaggccctcggggcagacactgtgccgctccacrcactcacggatgaagctctcccagagcttgccgcaggccccgaaggagcagagggccacggcgtcccccactaccaccagctgggactgggcgcgggtca

SEQ ID NO: 16232 - DNA, 201 bp, Homo sapiens
gatggcctgggtcagctcatggggccacagctgccagccccgctgccaagtccacgcccccatccgctcccgttgccccagccgctcccattgccccagcygctcctgctaccccagctgctcctgttgcccccagctcacttggccaccagctgctgctgagccgcctcctcctcatagagaaactggtgcatcctctgc

SEQ ID NO: 16233 - DNA, 201 bp, Homo sapiens
tagttctcgtggaagaccaggcggctctgccgcgccacctcgtgagtctcctgctggtagcacaggaagaggcggtgcagcagcgtgtgctcggccgcccrggccctggccacactgaacagccggggtgtgacctgcatgtggtcgcccgccagcacgaggcgggtgccgtgcgaggcgtaggccagcggggtgagggcc

SEQ ID NO: 16234 - DNA, 201 bp, Homo sapiens
ccccagggctgagcaggctctggcaggtgtgcacagtgctgagcaccacgacccggaactgccgccctgcagggggcacgcagtcaggtcaggctgggtgygcaagacggtgggaccagccccacccctgccgatgccaggctgaggagtgggccgagccacccggggtatcctggggcagctggcagcacctggccccgc

SEQ ID NO: 16235 - DNA, 201 bp, Homo sapiens
cttggccatcagggccgtctgctcggccgtccgctccacgccaggcaccacgtggcggttgccagtgtgccagcgctccatctcctcagggtggccgagcrccagattcctgcagggtcctgggcgacgcccctggcccagctgcagccccagcttttgtagcagcaccggccggcggccaaagtcgaagaccacccattg

SEQ ID NO: 16236 - DNA, 201 bp, Homo sapiens
tggcccagctgcagccccagcttttgtagcagcaccggccggcggccaaagtcgaagaccacccattgctcaaaggtgccgaacgaggcggcctgcacacrcactcccacctggaagtcggcagtggagctgggcacacggaagcgctcaccccgtgcgtagagccggcctggcgggaggccgggagccaccagagagaag

SEQ ID NO: 16237 - DNA, 201 bp, Homo sapiens
aggcgtccccatactcacagaggtcaggcctgggggacagggaggtcggcagggctacacagaggcacagccgccgtgctgagttcaaaggccgggacccytcagcccaatactggcctctgtagggagcaggggctttattcgtcccacccactcctgtgctcccgggacaaggcctggctcaagcagttcccaaacatg

SEQ ID NO: 16238 - DNA, 201 bp, Homo sapiens
ccatactcacagaggtcaggcctgggggacagggaggtcggcagggctacacagaggcacagccgccgtgctgagttcaaaggccgggacccctcagcccratactggcctctgtagggagcaggggctttattcgtcccacccactcctgtgctcccgggacaaggcctggctcaagcagttcccaaacatgaacctccc

SEQ ID NO: 16239 - DNA, 201 bp, Homo sapiens
tttagccctcagcaggtggcagggaggcccccgtccactgaacctgggagcctctggctctgcctgcggtgggctcctgccccgctccaagctcctgggarcctctggctctgcctgtggtgggctcctgccccgctccaagctcctgggagcctctggctctgcctacggtgggctcctgccccgctccaagctcctggg

SEQ ID NO: 16240 - DNA, 201 bp, Homo sapiens
caccgccgaccccggcgcacctgccaggacatccaccgacttgttggaggggccgcagtacaagatgcagggaccccccagccgcttctccccacgggggsggcctccgggctgcacctgctcctggtttgatttatgaaaccagaatacgatgtggaggcccacgatcgtcttccctgtacctgcagccagagaatagga

SEQ ID NO: 16241 - DNA, 201 bp, Homo sapiens
ccactccgcccaagccccaaagacagcaggcacacctgaggctctggttcggcctcccctcccgggggctcttcctgagcagcttcctgctgcccacacgyggcactgggaactcgctggcctcagcctgctcactgtacacacggaggggcttcagctccatccttctcaggagcagtcctgagggtagttgggggacgt

SEQ ID NO: 16242 - DNA, 201 bp, Homo sapiens
tgacgtctgcccgggctgaagtcaccacttccccagggctccctccgcccagtcggagctgttctccgctcacctcagagtggacggcaaacgtccagctrtactgggtcttcctctcctgggcctggtacatcaggggctggttgcaggtgacacgcactccatcaagggtctctgccagctgcgtggaagtctagcctt

SEQ ID NO: 16243 - DNA, 201 bp, Homo sapiens
cccctcgggcgccttgtctcccgaaaggagctgcaccagcacctcatccccggcgaaggccatcccacagtccaggcggcccctgacctggatggggcccraggaggcatcgtccagcgggatggctgacgcccgctcgaaggtctctggcacgaaagagcagtggcggtaccgctcgggctccgcgcgcagcagcttccg

SEQ ID NO: 16244 - DNA, 201 bp, Homo sapiens
ctcccatccccagggccccagcccgcgatgagcgccacggccagctcctgcttgcggttgccacgccgcaagggtgggacagaccaaggtctgggcagggygcaggtgggcaagtcgggcaccaccagctgctcctcaggcagtgtgtccactgcctggtgccagaggcggaaggtcatcgggtcaatctggaactgcacc

SEQ ID NO: 16245 - DNA, 201 bp, Homo sapiens
gggaccccagccccacacgacacccgcgtctgcacacacagggcaccccaggtgggagactgtgccagggacgcctgctcatgctgcccacaccccccgcygaccaaccttctcggcctgtgggaactgcaccagggggatgagggtttcaggttccgtggccatgcctgcctcgtcaacaaggatctgcctcacgtccag

SEQ ID NO: 16246 - DNA, 201 bp, Homo sapiens
aagaaccacctggaggaataggcaggcctggccctgacacccctagacccagagggaccccagccccacacgacacccgcgtctgcacacacagggcaccycaggtgggagactgtgccagggacgcctgctcatgctgcccacaccccccgccgaccaaccttctcggcctgtgggaactgcaccagggggatgagggtt

SEQ ID NO: 16247 - DNA, 201 bp, Homo sapiens
gcagctgcttgtggtctccgagaagaaccacctggaggaataggcaggcctggccctgacacccctagacccagagggaccccagccccacacgacacccrcgtctgcacacacagggcaccccaggtgggagactgtgccagggacgcctgctcatgctgcccacaccccccgccgaccaaccttctcggcctgtgggaa

SEQ ID NO: 16248 - DNA, 201 bp, Homo sapiens
ccggcgctcctggtcccagtcctgcgtctgcccgtgggccacccaggtatacgtgccggggtcaacattcaggccagggccgaggctgctgggcccagggygtgggctggccgtgggagccggcagcccctcgagccggatgcagaggtagcagcagctgaagttgatgtcggcacagttctcctcgaggaaggcggcctc

SEQ ID NO: 16249 - DNA, 201 bp, Homo sapiens
ctgcccggcgctcctggtcccagtcctgcgtctgcccgtgggccacccaggtatacgtgccggggtcaacattcaggccagggccgaggctgctgggcccrgggcgtgggctggccgtgggagccggcagcccctcgagccggatgcagaggtagcagcagctgaagttgatgtcggcacagttctcctcgaggaaggcgg

SEQ ID NO: 16250 - DNA, 201 bp, Homo sapiens
acctcttccggaaccttctccatgcccatgtggtggacgaagaggtgcacccgtctgggagcctcctgccggtctgcccggcgctcctggtcccagtcctscgtctgcccgtgggccacccaggtatacgtgccggggtcaacattcaggccagggccgaggctgctgggcccagggcgtgggctggccgtgggagccggc

SEQ ID NO: 16251 - DNA, 201 bp, Homo sapiens
tcgctggcctcagcctgctcactgtacacacggaggggcttcagctccatccttctcaggagcagtcctgagggtagttgggggacgtgagtcctgccccrcgtgccagctccccaaaggcccccaccgccgaccccggcgcacctgccaggacatccaccgacttgttggaggggccgcagtacaagatgcagggacccc

SEQ ID NO: 16252 - DNA, 201 bp, Homo sapiens
ttcagctccatccttctcaggagcagtcctgagggtagttgggggacgtgagtcctgccccgcgtgccagctccccaaaggcccccaccgccgaccccggygcacctgccaggacatccaccgacttgttggaggggccgcagtacaagatgcagggaccccccagccgcttctccccacggggggggcctccgggctgca

SEQ ID NO: 16253 - DNA, 201 bp, Homo sapiens
ccacccattgctcaaaggtgccgaacgaggcggcctgcacacgcactcccacctggaagtcggcagtggagctgggcacacggaagcgctcaccccgtgcrtagagccggcctggcgggaggccgggagccaccagagagaagtcggctcctggctcctgcttcagcagggccacgtgtagcaggggctcctggagaggag

SEQ ID NO: 16254 - DNA, 201 bp, Homo sapiens
acgtgctccaggcagaggctgaagcccggtgccaccgtccagagctgagggctcggtaccaggaagccgtgctgcaggctggtgccgagctgcacctgcarggtgtccccactgcccagctcccgggccacctccaggaaatggccacagtggctccgctgcacctgcaccagctcccgccgctgggacgcctcgcccttc

SEQ ID NO: 16255 - DNA, 201 bp, Homo sapiens
cagtctccgggccgctccacgtgctccaggcagaggctgaagcccggtgccaccgtccagagctgagggctcggtaccaggaagccgtgctgcaggctggygccgagctgcacctgcagggtgtccccactgcccagctcccgggccacctccaggaaatggccacagtggctccgctgcacctgcaccagctcccgccgc

SEQ ID NO: 16256 - DNA, 201 bp, Homo sapiens
cacggaagcgctcaccccgtgcgtagagccggcctggcgggaggccgggagccaccagagagaagtcggctcctggctcctgcttcagcagggccacgtgyagcaggggctcctggagaggaggccagacggtgaggggggcccagggctccccccaaccctcccgagaggcagcctggccagcgtagcccaagtgcaggg

SEQ ID NO: 16257 - DNA, 201 bp, Homo sapiens
ggggggcccagggctccccccaaccctcccgagaggcagcctggccagcgtagcccaagtgcagggttcaggtcctggccctgccacttcctggatagaaygcaagcaggccacccggcctctgccatcctcagtttcttcctgtgctacatgggggtggctgaaccctcctggggcccctgtggatgtcccgtggggcag

SEQ ID NO: 16258 - DNA, 201 bp, Homo sapiens
agggtgcaaagcgcaggctcttcagctggccactggccttctccatggtgaggaacagggagatggccaggcggtcccggccaggcaggaggctgaggacrtcctggcagaggctggccggcagcatgggcactggctccctgccgggggcatagaacgcagcgccctgccttcgcgcctccacgtccagcaccccgtccc

SEQ ID NO: 16259 - DNA, 201 bp, Homo sapiens
ctggcggtcagactggaccacggagggtgcaaagcgcaggctcttcagctggccactggccttctccatggtgaggaacagggagatggccaggcggtccrggccaggcaggaggctgaggacgtcctggcagaggctggccggcagcatgggcactggctccctgccgggggcatagaacgcagcgccctgccttcgcgc

SEQ ID NO: 16260 - DNA, 201 bp, Homo sapiens
cggaagcccagggtgccgtcctcgtccggctgctcatagaagcagtcggaccgcaggcggtgccggcgcagcagccgagagaagtagcacgcggccacgaygcaggcgtccacggagtccaggcgggccggcagctcacggccggcacccgggtgctgcctgatcacctcctccgcctcctcgtaggacagctggcggtca

SEQ ID NO: 16261 - DNA, 201 bp, Homo sapiens
gcaccctcaagctgtactccaggccgaggatgcggaggccctgctcccaggtgctggcctcaggcagcacctcccggacgatgcccagcgggtagtagaasccttgccgccacaggacaatttggacccagaagagccggctgtgccgggcctcggcggtgagcctctcaagccccacacgctgcagccggcccttccgga

SEQ ID NO: 16262 - DNA, 201 bp, Homo sapiens
gcgcaatctcagccagattcagccaggacgccatggacatgtcccggtctgggttgcccgccacgtggcagaacatgagcgggtagtgccgggggtggggsggaaccttgcccctggcgtggatggggttgcccttggccacgtagaagtgccgcgagatgaagctgacaatggcgtccgtgcagcggtagttctcgtgga

SEQ ID NO: 16263 - DNA, 201 bp, Homo sapiens
ccagggtgccgtcctcgtccggctgctcatagaagcagtcggaccgcaggcggtgccggcgcagcagccgagagaagtagcacgcggccacgacgcaggcrtccacggagtccaggcgggccggcagctcacggccggcacccgggtgctgcctgatcacctcctccgcctcctcgtaggacagctggcggtcagactgga

SEQ ID NO: 16264 - DNA, 201 bp, Homo sapiens
tgggacccaggtctcggacactgagggcatcatcgaggttgcaggcgccctgggggtccacagtgaaggtcaagaaggcgcggcagtcctctcggcggccsgcaacccggccaagctccgtgtggtatttctgcagcaccttggtgatggtggcctggtccgacgggggcaccctcaagctgtactccaggccgaggatgc

SEQ ID NO: 16265 - DNA, 201 bp, Homo sapiens
tcaggtgggaggagtcagggtcaggtgggagtcagtcagggtcaggtgggaggagtcagggtcaggtgggaggagtcagggtcagatgggagtcagtcagrgtcaggtgggaggagtcagggtcaggtgggaggagtcagggtcaggtcggagtcagggtcaggcaggagtcggcagctccctagcccagccctggcctca

SEQ ID NO: 16266 - DNA, 201 bp, Homo sapiens
agagtcaggtgggaggagtcagggtcaggtgggaggagtcagggtcaggtcggagtcagggtcaggtgggaggagtcagggtcaggtgggagtcagtcagrgtcaggtgggaggagtcagggtcaggtgggaggagtcagggtcagatgggagtcagtcagagtcaggtgggaggagtcagggtcaggtgggaggagtcag

SEQ ID NO: 16267 - DNA, 201 bp, Homo sapiens
ctctggctctgcctacggtgggctcctgccccactccaagctcctgggaacctctggctctgcctacggtgggctcctgccctgctccaagctcctgggarcctctggctctgcctgtggtgggctcctgcgctactccaagctcctgggagcctctggctctgcctacggtgggctcctgccctactccaagctcctggg

SEQ ID NO: 16268 - DNA, 201 bp, Homo sapiens
gctcctgggaacctctggctctgcctacggtgggctcctgccccgctccaagctcctgggagcctctggctctgcctgtggtgggctcctgccccgctccmagctcctgggagcctctggctctgcctacggtgggctcctgccccactccaagctcctgggaacctctggctctgcctacggtgggctcctgccctgctc

SEQ ID NO: 16269 - DNA, 201 bp, Homo sapiens
tccaagctcctgggaacctctggctctgcctgtggtgggctcctgccctgctccaagctcctgggaacctctggctctgcctgtggtgggctcctgccccrctccaagctcctgggaacctctggctctgcctacggtgggctcctgccctactccaagctcctgggaacctctggctctgcctgtggtgggctcctgccc

SEQ ID NO: 16270 - DNA, 201 bp, Homo sapiens
ccaagctcggggatgagcgcaggacgcagtgaggactgggccacccccgacaaggagacggcacccccaccaagctcggggatgagcgcaggacgcagtgrggactgggccacccccgacaaggagacggcacccccaccaagctccagacacctcaggggccgagccccacctcagccctgggaggcaaatactgcagcc

SEQ ID NO: 16271 - DNA, 201 bp, Homo sapiens
cccccaccaagctcggggatgagcgcaggacgcagtgaggactgggccacccccgacaaggagacggcacccccaccaagctcggggatgagcgcaggackcagtgaggactgggccacccccgacaaggagacggcacccccaccaagctccagacacctcaggggccgagccccacctcagccctgggaggcaaatact

SEQ ID NO: 16272 - DNA, 201 bp, Homo sapiens
gagagggcacccccaccaagctcggggatgagcgcaggacgcagtgaggactgggccacccccgacaaggagacggcacccccaccaagctcggggatgarcgcaggacgcagtgaggactgggccacccccgacaaggagacggcacccccaccaagctccagacacctcaggggccgagccccacctcagccctgggag

SEQ ID NO: 16273 - DNA, 201 bp, Homo sapiens
ggtgggaggagtcagggtcagatgggagtcagtcagagtcaggtgggaggagtcagggtcaggtgggaggagtcagggtcaggtcggagtcagggtcaggyaggagtcggcagctccctagcccagccctggcctcacctgtgttcccaccctggaagagcccagccccgccctcaccgatcaggcagagcccctcctggg

SEQ ID NO: 16274 - DNA, 201 bp, Homo sapiens
gcccccggctgcactcaccctcccggacccccccctccgcccccggccccgccaccctgggacccccgcgctcaccctcctggagccgcccctggaccccygcgcccccgcccctccaccctgggacccccgcgctcaccctcctggagctgcctgccctgccgagcctgcccaggagctctcagtttcgattctggcccg

SEQ ID NO: 16275 - DNA, 201 bp, Homo sapiens
cagtttcttcctgtgctacatgggggtggctgaaccctcctggggcccctgtggatgtcccgtggggcagtgtgggcagcttgaggcctcaccacccactytccaggtgccagaccctggtgaatccttgtttttgttttggtttttgagacggagtttcactcttgtcgccaggctggagtgcaatggcgcgatctcaac

SEQ ID NO: 16276 - DNA, 201 bp, Homo sapiens
cctcagtttcttcctgtgctacatgggggtggctgaaccctcctggggcccctgtggatgtcccgtggggcagtgtgggcagcttgaggcctcaccacccmctctccaggtgccagaccctggtgaatccttgtttttgttttggtttttgagacggagtttcactcttgtcgccaggctggagtgcaatggcgcgatctc

SEQ ID NO: 16277 - DNA, 201 bp, Homo sapiens
gctgctcctgttgcccccagctcacttggccaccagctgctgctgagccgcctcctcctcatagagaaactggtgcatcctctgccgatagttggttggcragatggggcccgaggccacgctgctgcggttgaactccagggccagggcagggcccttgtacttggccatcagggccgtctgctcggccgtccgctccac

SEQ ID NO: 16278 - DNA, 201 bp, Homo sapiens
tcagctcatggggccacagctgccagccccgctgccaagtccacgcccccatccgctcccgttgccccagccgctcccattgccccagctgctcctgctascccagctgctcctgttgcccccagctcacttggccaccagctgctgctgagccgcctcctcctcatagagaaactggtgcatcctctgccgatagttggt

SEQ ID NO: 16279 - DNA, 201 bp, Homo sapiens
gtcagctcatggggccacagctgccagccccgctgccaagtccacgcccccatccgctcccgttgccccagccgctcccattgccccagctgctcctgctrccccagctgctcctgttgcccccagctcacttggccaccagctgctgctgagccgcctcctcctcatagagaaactggtgcatcctctgccgatagttgg

SEQ ID NO: 16280 - DNA, 201 bp, Homo sapiens
aagaaggcgcggcagtcctctcggcggccggcaacccggccaagctccgtgtggtatttctgcagcaccttggtgatggtggcctggtccgacgggggcamcctcaagctgtactccaggccgaggatgcggaggccctgctcccaggtgctggcctcaggcagcacctcccggacgatgcccagcgggtagtagaagcct

SEQ ID NO: 16281 - DNA, 201 bp, Homo sapiens
gtcctggcagaggctggccggcagcatgggcactggctccctgccgggggcatagaacgcagcgccctgccttcgcgcctccacgtccagcaccccgtccytgggcacgaagctggccacatcagtgatgtgcacagccacctcgcacctgggacccaggtctcggacactgagggcatcatcgaggttgcaggcgccctg

SEQ ID NO: 16282 - DNA, 201 bp, Homo sapiens
gcctattaaactgaatcatgtactccttcaccatgatgtgggccgcgcggaagcccagggtgccgtcctcgtccggctgctcatagaagcagtcggaccgyaggcggtgccggcgcagcagccgagagaagtagcacgcggccacgacgcaggcgtccacggagtccaggcgggccggcagctcacggccggcacccgggt

SEQ ID NO: 16283 - DNA, 201 bp, Homo sapiens
ccgctgcaacaccacgtccaggtacctgcggatgggcgaggtggcccacgtgtaccagtccacctgcagcgagtagtggccgccctgctgctggtggcccygggcgcagcggccgaacgccgagcgctccagggccttgcggaggtcgcggcctgcaggagccaggaatgggtgcatgtcgtccgtggtgaccaagtccac

SEQ ID NO: 16284 - DNA, 201 bp, Homo sapiens
gtgtgggtccggcacagtgccaggcagtggcaggggcgggctggatccctgcgctgagtagacacggcgccgccacaggagccgcaggcccggccggcctrccagggcgtgggggtgctcggccagctgcagggagccgtaggggacggggcaggggtcaggcagcgtctcccggttgctggggaagagcagccggaagca

SEQ ID NO: 16285 - DNA, 201 bp, Homo sapiens
ggacgcctcgcccttctcctggatgagagcagccgcctccggccagcgctgcagctccaccagctccagcagctgcttccacagggccgtctccacggccmgggtgtgtgggtccggcacagtgccaggcagtggcaggggcgggctggatccctgcgctgagtagacacggcgccgccacaggagccgcaggcccggccg

SEQ ID NO: 16286 - DNA, 201 bp, Homo sapiens
ctgcgtctgcccgtgggccacccaggtatacgtgccggggtcaacattcaggccagggccgaggctgctgggcccagggcgtgggctggccgtgggagccrgcagcccctcgagccggatgcagaggtagcagcagctgaagttgatgtcggcacagttctcctcgaggaaggcggcctccaggcggaaggcgccctgcag

SEQ ID NO: 16287 - DNA, 201 bp, Homo sapiens
ggcccacgatcgtcttccctgtacctgcagccagagaataggagattgtagcccaccctgtgggtccctgtggcccaaggcagcctgcggctcccccggcrtgggccctacctggtgggccctgaatgaccgtgaaaggcttctccagagcctccctgaccgccacgttctggctggggttcagcttgtggcggcctccgg

SEQ ID NO: 16288 - DNA, 201 bp, Homo sapiens
gggaggtgaggccctgctgccgctgcgcccaccctcccggccccacccacgagcccccagcctcaccctggctcttggtgatggaggacacggccaccccrgcgatgccctctcgccgaagggccttgctgatctcagaggcctgcgcgttgtagggcgtgaggacggcgatgtcctggggctctacggtcctccccaggg

SEQ ID NO: 16289 - DNA, 201 bp, Homo sapiens
ctagcccagccctggcctcacctgtgttcccaccctggaagagcccagccccgccctcaccgatcaggcagagcccctcctgggcccgcgtgacagccacrttcacttggttggggtccacaacgaagcccagaaacttcttgagccagctcttggtgggccgctggtccaggtcgctcttggcacaggtgcggacggtgc

SEQ ID NO: 16290 - DNA, 201 bp, Homo sapiens
catccagagtgattacaggtggcgtccaaaggtcaaagggcagcctccacagggtttccttcctggttctgagacttcccagggacagcagaacttccttrcactggtcccaaggaagcccctcttggccaccctgagaggtgttcctgtccccagatgcccaggaggagcaagagtgtggggaccggcccttgccgttcc

SEQ ID NO: 16291 - DNA, 201 bp, Homo sapiens
tctgtagggagcaggggctttattcgtcccacccactcctgtgctcccgggacaaggcctggctcaagcagttcccaaacatgaacctcccttatccgggwcctcagaggccacatggctttagccctcagcaggtggcagggaggcccccgtccactgaacctgggagcctctggctctgcctgcggtgggctcctgccc

SEQ ID NO: 16292 - DNA, 201 bp, Homo sapiens
cagagaataggagattgtagcccaccctgtgggtccctgtggcccaaggcagcctgcggctcccccggcgtgggccctacctggtgggccctgaatgaccrtgaaaggcttctccagagcctccctgaccgccacgttctggctggggttcagcttgtggcggcctccggggatgttgtaggtctgccgctccaggaacct

SEQ ID NO: 16293 - DNA, 201 bp, Homo sapiens
ggtgggccgctggtccaggtcgctcttggcacaggtgcggacggtgctcaccagcacatagcgccactcgctccctgcgggatgggaggtgaggccctgckgccgctgcgcccaccctcccggccccacccacgagcccccagcctcaccctggctcttggtgatggaggacacggccaccccggcgatgccctctcgccg

SEQ ID NO: 16294 - DNA, 201 bp, Homo sapiens
tccaagctcctgggagcctctggctctgcctacggtgggctcctgccccactccaagctcctgggaacctctggctctgcctacggtgggctcctgccctrctccaagctcctgggagcctctggctctgcctgtggtgggctcctgcgctactccaagctcctgggagcctctggctctgcctacggtgggctcctgccc

SEQ ID NO: 16295 - DNA, 201 bp, Homo sapiens
cagacacctggcctaggtcccgcctcctcagctcctgcctcagtgcactgacctgaagacgcagcagggccggggatgagtgctggacgcagtgaggactsggccacccccgacaaggagagggcacccccaccaagctcggggatgagcgcaggacgcagtgaggactgggccacccccgacaaggagacggcaccccca

SEQ ID NO: 16296 - DNA, 201 bp, Homo sapiens
gacgcagcagggccggggatgagtgctggacgcagtgaggactcggccacccccgacaaggagagggcacccccaccaagctcggggatgagcgcaggackcagtgaggactgggccacccccgacaaggagacggcacccccaccaagctcggggatgagcgcaggacgcagtgaggactgggccacccccgacaaggag

SEQ ID NO: 16297 - DNA, 201 bp, Homo sapiens
gcctcctcagctcctgcctcagtgcactgacctgaagacgcagcagggccggggatgagtgctggacgcagtgaggactcggccacccccgacaaggagasggcacccccaccaagctcggggatgagcgcaggacgcagtgaggactgggccacccccgacaaggagacggcacccccaccaagctcggggatgagcgca

SEQ ID NO: 16298 - DNA, 201 bp, Homo sapiens
gacccggacacagccagaccctccctcctgaagggtctcaggccccacctagaaggagccaaggtgactgcttgtggagccctggagggggcagagccctyggcacagtgccgcccccaggaggccgcacccctctgccccagccaggggtcctgtgcaccccagggcctcaggctcctgactcttctaaggacacagcac

SEQ ID NO: 16299 - DNA, 201 bp, Homo sapiens
cactccaagctcctgggaacctctggctctgcctacggtgggctcctgccctgctccaagctcctgggagcctctggctctgcctgtggtgggctcctgcsctactccaagctcctgggagcctctggctctgcctacggtgggctcctgccctactccaagctcctgggagcctctggctctgcctgtggtgggctcctg

SEQ ID NO: 16300 - DNA, 201 bp, Homo sapiens
gcgcaggacgcagtgaggactgggccacccccgacaaggagacggcacccccaccaagctcggggatgagcgcaggacgcagtgaggactgggccaccccmgacaaggagacggcacccccaccaagctccagacacctcaggggccgagccccacctcagccctgggaggcaaatactgcagccccctcttacagatggg

SEQ ID NO: 16301 - DNA, 201 bp, Homo sapiens
aagacgcagcagggccggggatgagtgctggacgcagtgaggactcggccacccccgacaaggagagggcacccccaccaagctcggggatgagcgcaggrcgcagtgaggactgggccacccccgacaaggagacggcacccccaccaagctcggggatgagcgcaggacgcagtgaggactgggccacccccgacaagg

SEQ ID NO: 16302 - DNA, 201 bp, Homo sapiens
ctcaaaactgccgacagacacctggcctaggtcccgcctcctcagctcctgcctcagtgcactgacctgaagacgcagcagggccggggatgagtgctggrcgcagtgaggactcggccacccccgacaaggagagggcacccccaccaagctcggggatgagcgcaggacgcagtgaggactgggccacccccgacaagg

SEQ ID NO: 16303 - DNA, 201 bp, Homo sapiens
cagcctccgtctgcgctgtggttgccgtgatgtcacgggatgctgggctcagagcctcatctcccggctctgccttcaccatggccgtcaccacagccgcytgctcctcggccaggtcccctactggctctggggcagcctcccagttccccgctgccccagcctgtgtgcctcggggaggccagcgccgtctctgcgcca

SEQ ID NO: 16304 - DNA, 201 bp, Homo sapiens
aaagcccaaagctggtcggctacagggagtgcagaatcagaggactggagcacatccagggggtgaccgcctgcccggtgtagacttgggccgggcgtcargtgaggtgggggcaggccaggctcgggcttacctgttggtgtgtgtgcagatgagcaccttggtttcaggcctccggatgacctccagggaggccatggc

SEQ ID NO: 16305 - DNA, 201 bp, Homo sapiens
tcctgcagggtcctgggcgacgcccctggcccagctgcagccccagcttttgtagcagcaccggccggcggccaaagtcgaagaccacccattgctcaaargtgccgaacgaggcggcctgcacacgcactcccacctggaagtcggcagtggagctgggcacacggaagcgctcaccccgtgcgtagagccggcctggcg

SEQ ID NO: 16306 - DNA, 201 bp, Homo sapiens
aagtggaggccttggcagtagctgtgtcctgtcagggagtacagggctcactgacccggacacagccagaccctccctcctgaagggtctcaggccccacytagaaggagccaaggtgactgcttgtggagccctggagggggcagagccctcggcacagtgccgcccccaggaggccgcacccctctgccccagccaggg

SEQ ID NO: 16307 - DNA, 201 bp, Homo sapiens
cccactccccactgggcagggatgggaaggccccggcctggggaggtggtggtggcaggaaccagaggaaaccacataaaccaaaggggaaccttgtggtyaggacaaagatctgtgtttctataaaaacgaaaaacaagactcatccccagaagtgctgggtgggccatgctgcagccttccccgtgacactctccttgg

SEQ ID NO: 16308 - DNA, 201 bp, Homo sapiens
ctggggttcagcttgtggcggcctccggggatgttgtaggtctgccgctccaggaacctgctggggatcactgagagggggcagcctccctgagcactcaygcagggtggggctgggggccagaggggaagctggaggggtggggcagacctacctctgcagaggggctgcgggacaggccggcccagtgcgatgctggtg

SEQ ID NO: 16309 - DNA, 201 bp, Homo sapiens
caccaccacaaactgttgcttgcggcggccctcggcgctcacgtgggccaggagggaggggcaggctccgtgctcagggcactgcccctgggggtccacgygacagatgcatgggggacagcgcctgaagcagagggagcaaagcagctcgaagcggccgccaaactccgtaaggatggcgtcggccgcccggcctgcccc

SEQ ID NO: 16310 - DNA, 201 bp, Homo sapiens
aactgttgcttgcggcggccctcggcgctcacgtgggccaggagggaggggcaggctccgtgctcagggcactgcccctgggggtccacgcgacagatgcrtgggggacagcgcctgaagcagagggagcaaagcagctcgaagcggccgccaaactccgtaaggatggcgtcggccgcccggcctgcccctccctgggcc

SEQ ID NO: 16311 - DNA, 201 bp, Homo sapiens
cactgcccctgggggtccacgcgacagatgcatgggggacagcgcctgaagcagagggagcaaagcagctcgaagcggccgccaaactccgtaaggatggygtcggccgcccggcctgcccctccctgggccccgctgccctgcacctccgccttcagccataggcgctggaggttgtgctgacgctcgaaggtccagacc

SEQ ID NO: 16312 - DNA, 201 bp, Homo sapiens
catgttggccaggatggtctcgaactcctgacctcaggtgatctgcccgcctcggcttcccaaagtgctggattatgggcgtgagccaccacgcccggcargatgctggcttttagttcatttaaatagaaaataaacctgaactccacagacaccatccagagtgattacaggtggcgtccaaaggtcaaagggcagcct

SEQ ID NO: 16313 - DNA, 201 bp, Homo sapiens
ggcgctcctggtcccagtcctgcgtctgcccgtgggccacccaggtatacgtgccggggtcaacattcaggccagggccgaggctgctgggcccagggcgkgggctggccgtgggagccggcagcccctcgagccggatgcagaggtagcagcagctgaagttgatgtcggcacagttctcctcgaggaaggcggcctcca

SEQ ID NO: 16314 - DNA, 201 bp, Homo sapiens
caggatctcaaaactgccgacagacacctggcctaggtcccgcctcctcagctcctgcctcagtgcactgacctgaagacgcagcagggccggggatgagygctggacgcagtgaggactcggccacccccgacaaggagagggcacccccaccaagctcggggatgagcgcaggacgcagtgaggactgggccacccccg

SEQ ID NO: 16315 - DNA, 201 bp, Homo sapiens
gactcggccacccccgacaaggagagggcacccccaccaagctcggggatgagcgcaggacgcagtgaggactgggccacccccgacaaggagacggcacycccaccaagctcggggatgagcgcaggacgcagtgaggactgggccacccccgacaaggagacggcacccccaccaagctccagacacctcaggggccga

SEQ ID NO: 16316 - DNA, 201 bp, Homo sapiens
acacggccaccccggcgatgccctctcgccgaagggccttgctgatctcagaggcctgcgcgttgtagggcgtgaggacggcgatgtcctggggctctacrgtcctccccagggtcagctgcttggtgatacggacctgaggagccgagggggcaggtggagcggaccctggtgtctctcctgccctcctccaggaagccc

SEQ ID NO: 16317 - DNA, 201 bp, Homo sapiens
atttttttctttttttgagacagagtctcactctgttgcccaggctagagtgcagtggcgggatctcagctcacggcaagctccgcctcccgggttcaagygattctcctgcctcagcctcccaagtagctgggattacaggcgcgcactaccatgcccagctaatttttgtatttttttaaatagagatggggtttcacc

SEQ ID NO: 16318 - DNA, 201 bp, Homo sapiens
ccatccagaaaggacgggagccgagaccccaaaatcctgcgctccagtgggtgcagagaccacagcgctgggtcttgctgcggagggtgctggtcctggaygggctgcactgccccgggctgggtctgtggctcccgggactccgcgcccccggctgcactcaccctcccggacccccccctccgcccccggccccgccac

SEQ ID NO: 16319 - DNA, 201 bp, Homo sapiens
aaccacctggaggaataggcaggcctggccctgacacccctagacccagagggaccccagccccacacgacacccgcgtctgcacacacagggcaccccakgtgggagactgtgccagggacgcctgctcatgctgcccacaccccccgccgaccaaccttctcggcctgtgggaactgcaccagggggatgagggtttca

SEQ ID NO: 16320 - DNA, 201 bp, Homo sapiens
ggattacaggcgcccgccaccacgcccagctaattttgtatttttagtggagacggggtttcaccatgttggccaggatggtctcgaactcctgacctcargtgatctgcccgcctcggcttcccaaagtgctggattatgggcgtgagccaccacgcccggcaggatgctggcttttagttcatttaaatagaaaataaa

SEQ ID NO: 16321 - DNA, 201 bp, Homo sapiens
gcctccttgtcctgagcttgggctgaggtctctgttccagtaacagatgctggttttgttttgtttttttttttaagacagggtctcgctctgtcacccakgctggagtgcagtggtaccatcagagctcactgcagcctgcgcctcctggagtcaagcgattctcctgcctcagcctcccaagtagctgggattacaggc

SEQ ID NO: 16322 - DNA, 201 bp, Homo sapiens
ctccaggaacctgctggggatcactgagagggggcagcctccctgagcactcatgcagggtggggctgggggccagaggggaagctggaggggtggggcaracctacctctgcagaggggctgcgggacaggccggcccagtgcgatgctggtgaccagcggggacgcctcctctagtccacgcacggcttcctccttgcg

SEQ ID NO: 16323 - DNA, 201 bp, Homo sapiens
ccctcccggacccccccctccgcccccggccccgccaccctgggacccccgcgctcaccctcctggagccgcccctggacccccgcgcccccgcccctccrccctgggacccccgcgctcaccctcctggagctgcctgccctgccgagcctgcccaggagctctcagtttcgattctggcccgggcactgacgctgatcg

SEQ ID NO: 16324 - DNA, 201 bp, Homo sapiens
cctccggatgacctccagggaggccatggccagcgtgtaggtcttgccggtgccaaaggggccatagatgagtagcggggggacacgcctcccatccccarggccccagcccgcgatgagcgccacggccagctcctgcttgcggttgccacgccgcaagggtgggacagaccaaggtctgggcagggcgcaggtgggcaa

SEQ ID NO: 16325 - DNA, 201 bp, Homo sapiens
tgccgacagacacctggcctaggtcccgcctcctcagctcctgcctcagtgcactgacctgaagacgcagcagggccggggatgagtgctggacgcagtgrggactcggccacccccgacaaggagagggcacccccaccaagctcggggatgagcgcaggacgcagtgaggactgggccacccccgacaaggagacggca

SEQ ID NO: 16326 - DNA, 201 bp, Homo sapiens
gatctcaaaactgccgacagacacctggcctaggtcccgcctcctcagctcctgcctcagtgcactgacctgaagacgcagcagggccggggatgagtgcwggacgcagtgaggactcggccacccccgacaaggagagggcacccccaccaagctcggggatgagcgcaggacgcagtgaggactgggccacccccgaca

SEQ ID NO: 16327 - DNA, 201 bp, Homo sapiens
tcctcctccaagtccacccacttcctgccccagggagatcctgaggccaggaggcaggctggcccaggcaggctgatggcggagggtggtggggagggtgsgggggccctggactttccctcccagtcctggcaccttgcaggtggagagggctcttcaggaaggcatagttggcctcctgcagacgcgcacctggccggc

SEQ ID NO: 16328 - DNA, 201 bp, Homo sapiens
gagggcttcaggcaacacctgggcgagcccagcggctcctctgacactgcagacacctgcacctccctggtccccagaacccccaatccagaaatcagccygggacgtatggccactgtcccaggctcttcctcccactccccactgggcagggatgggaaggccccggcctggggaggtggtggtggcaggaaccagagg

SEQ ID NO: 16329 - DNA, 201 bp, Homo sapiens
gtgctgtccgctaaagcacctactgtgtgcccagccgagctgcccctgagcacagcccttgtctggctgtcagaggtgagcagcaaacactggtgtccctsctgtcaggagtccaaggggcaagaggccacggagggcttcaggcaacacctgggcgagcccagcggctcctctgacactgcagacacctgcacctccctg

SEQ ID NO: 16330 - DNA, 201 bp, Homo sapiens
tcatgggcttcttgctgggggcctcagtgctgtccgctaaagcacctactgtgtgcccagccgagctgcccctgagcacagcccttgtctggctgtcagargtgagcagcaaacactggtgtccctgctgtcaggagtccaaggggcaagaggccacggagggcttcaggcaacacctgggcgagcccagcggctcctctg

SEQ ID NO: 16331 - DNA, 201 bp, Homo sapiens
agagctccccctcccccagcaggggtgcggtcgggggctgtcccgggctggccgggctcacctgggcaccgtgggaaacgacacagatgcacctctgctcrcggccgccccagcagctgggccaggtgttgtaggcctcctgcaccttctcgacgacctgcgcaatctcagccagattcagccaggacgccatggacatgt

SEQ ID NO: 16332 - DNA, 201 bp, Homo sapiens
ctggatggggcccgaggaggcatcgtccagcgggatggctgacgcccgctcgaaggtctctggcacgaaagagcagtggcggtaccgctcgggctccgcgygcagcagcttccgtagcgcagccgggggcaggttctcgtacagccgggcctgctgcagggactcgggcctggcgacggtgtccagcagcccgtcctcccc

SEQ ID NO: 16333 - DNA, 201 bp, Homo sapiens
ggcggtaccgctcgggctccgcgcgcagcagcttccgtagcgcagccgggggcaggttctcgtacagccgggcctgctgcagggactcgggcctggcgacrgtgtccagcagcccgtcctccccgacggtcaccatcaccttctggctctcgtccagaagctcccgtaggatggcgtcgtcagcgttgagctccccgtccc

SEQ ID NO: 16334 - DNA, 201 bp, Homo sapiens
agctgctcctgttgcccccagctcacttggccaccagctgctgctgagccgcctcctcctcatagagaaactggtgcatcctctgccgatagttggttggygagatggggcccgaggccacgctgctgcggttgaactccagggccagggcagggcccttgtacttggccatcagggccgtctgctcggccgtccgctcca

SEQ ID NO: 16335 - DNA, 201 bp, Homo sapiens
ggcgacgcccctggcccagctgcagccccagcttttgtagcagcaccggccggcggccaaagtcgaagaccacccattgctcaaaggtgccgaacgaggcrgcctgcacacgcactcccacctggaagtcggcagtggagctgggcacacggaagcgctcaccccgtgcgtagagccggcctggcgggaggccgggagcca

SEQ ID NO: 16336 - DNA, 201 bp, Homo sapiens
ttcactcttgtcgccaggctggagtgcaatggcgcgatctcaactcactacaacctccgcctcctgggttcaagtgattttcctgcctcagcctcccgagwagatgggatcacaggcacccaccaccatgcctggctaatttttttttttttttttttttttcagtagagacggagtttcaccctattggccaggctgatc

SEQ ID NO: 16337 - DNA, 201 bp, Homo sapiens
ctgcgtgcgccggacccactcctgcagctcctgtgctgagtgtgccttggtgcaggcgtccccatactcacagaggtcaggcctgggggacagggaggtcrgcagggctacacagaggcacagccgccgtgctgagttcaaaggccgggacccctcagcccaatactggcctctgtagggagcaggggctttattcgtccc

SEQ ID NO: 16338 - DNA, 201 bp, Homo sapiens
agaggccacatggctttagccctcagcaggtggcagggaggcccccgtccactgaacctgggagcctctggctctgcctgcggtgggctcctgccccgctmcaagctcctgggaacctctggctctgcctgtggtgggctcctgccccgctccaagctcctgggagcctctggctctgcctacggtgggctcctgccccgc

SEQ ID NO: 16339 - DNA, 201 bp, Homo sapiens
acctgaagacgcagcagggccggggatgagtgctggacgcagtgaggactcggccacccccgacaaggagagggcacccccaccaagctcggggatgagcrcaggacgcagtgaggactgggccacccccgacaaggagacggcacccccaccaagctcggggatgagcgcaggacgcagtgaggactgggccacccccga

SEQ ID NO: 16340 - DNA, 201 bp, Homo sapiens
ccttcctggttctgagacttcccagggacagcagaacttccttacactggtcccaaggaagcccctcttggccaccctgagaggtgttcctgtccccagaygcccaggaggagcaagagtgtggggaccggcccttgccgttcctcctccaagtccacccacttcctgccccagggagatcctgaggccaggaggcaggct

SEQ ID NO: 16341 - DNA, 100 bp, Homo sapiens
aggtttattttctatttaaatgaactaaaagccagcatcctgccgggcgyggtggctcacgcccataatccagcactttgggaagccgaggcgggcagat

SEQ ID NO: 16342 - DNA, 201 bp, Homo sapiens
gttcagataaggaacctgattaagtgtcgagtagtgtactcagcaccagggtaaagatggcagacacagtcccatggaactggctggctgtccatggaagrtaagtaagtaccaacagcagagtggtgagttttatcacgggaggacacggtagcaaagaggatctaacatggcctagtagtcatggaattccttccttag

SEQ ID NO: 16343 - DNA, 201 bp, Homo sapiens
ataagtctatgatttcagaactatgtccatctttacacctctaaagcgttatgatttacctgatttggtggaggaaaggtatttttggtaattttctgtcmctatgggaattcaaaggataaatttcaatctctttttctttctttctctctctgtccatcttatgcagctgaaaactggcatatgactctttgagaagag

SEQ ID NO: 16344 - DNA, 201 bp, Homo sapiens
ctatgatattttgacatgtatacattgtagaatggctagatcaacctaattaacatatgcattatctcacatacttttttgtggtgagaacacttaaaatytactttcttagcaattttcaagtatataatacattgttattaactgtagtcaccatgttgtacaagagatctcttgaacatcactgaacatatttatggc

SEQ ID NO: 16345 - DNA, 201 bp, Homo sapiens
tgcactctttgtgtactcagagcatttgaatgcttttggtcacacactagttgctgtttaactacaataaaattgtgaccaaaggagataaacatttaaargataaatgacaggcctgttaatctgaaagcaagttttgtagcgttgttgtttttagctaataggtgtatagccaggagtcacggtgatgacttttaaatc

SEQ ID NO: 16346 - DNA, 201 bp, Homo sapiens
gagagtggccaaaatgtcttttcagagccaccaggtgtaggtcacacagaggggacagaactcttcaggtggctcaagtctcaggagcaatctagatacasggagaagccatttgtatcccactgagtcctgtgatgctgcacacacacagctgagatttacagaggccgggcggggagggctgctgagagggggtaatgg

SEQ ID NO: 16347 - DNA, 201 bp, Homo sapiens
tgggggagacagtcagattccacagagcatgttttggtgtggattggatgagttaggttctgtattgccccacatgaccttttacagacatggggacttamacagtgtattttctttgtctctctgcgttagcttcatcttcagtgatgaaatcttgttgcttcctgaagcattaaattcagtgagttgagagtggccaaa

SEQ ID NO: 16348 - DNA, 201 bp, Homo sapiens
tgaaagttcctttagtacatttaaaagcattatttatttttaattgtcttacctctggagggagaggttacttctttttggggtgtttttggttgttgttktttttttttgttttctttttttgaatagacttaaaaaaaaaaactttgcctatgcatttctggttaatttatttcaaaccttttgctttttatagtctta

SEQ ID NO: 16349 - DNA, 201 bp, Homo sapiens
tctacctgcaggaggagatgctgaaccaggctaggaccagagaaagatgagtgaggcgaggtagtgtcactctgtttcctcctgctagcagccataaggaragagaatcatttgtggcactctggggacagttttgtcaccctgacagtaatgctgttatgcgctggcttgacacacaggatgaatccataaagacagata

SEQ ID NO: 16350 - DNA, 201 bp, Homo sapiens
attagaagttctggaacaaggttgtttgataacatctctgaagggcaaaggagcaaacggaaacctcagaggactggatgccaaaacagaacactctctaracttgtgggcaacaggagcttttctgagatcgtattattctcaccgataatagcatcctgccttgactgagggtgagggtgtgcaagatggatcattcgt

SEQ ID NO: 16351 - DNA, 201 bp, Homo sapiens
cagtgacttacaagttcggacagcctccagcaaacacaggaaacaggattcgaacccatgcagtctgcctcagagccaaagcccttggccatttttctatmctgccttccacagatcatttctgcctacagcagaggtcagaaactgacaaccggctggccttacctagccttaggtaacagtaatggctattgaacactt

SEQ ID NO: 16352 - DNA, 201 bp, Homo sapiens
cgggtactttattatctatccctgtttgccagataaggaagctgagacttcatacagtgacttacaagttcggacagcctccagcaaacacaggaaacagrattcgaacccatgcagtctgcctcagagccaaagcccttggccatttttctatcctgccttccacagatcatttctgcctacagcagaggtcagaaactg

SEQ ID NO: 16353 - DNA, 201 bp, Homo sapiens
cagtttctatccttaaggaacttggagcctagtaagggagactagtgagtaaacaattacctgagagtatgaggatcactctcttttgataggggtattgyattagctcttatgctgctgatatgcctgagactgggtaatttataaaggaaagaggtttaattgactcacagttccacagggctgaggaggcctcaggaa

SEQ ID NO: 16354 - DNA, 201 bp, Homo sapiens
tggagtcttgctctgtcacccaggctagagtgcagtggcactatcttggcttactgcaacctctgcctcccaggttcaagtgattctcctgcctcagcctyctgagtagctgggattacaggcatgtgccaccacacccggctaatttttgtatttttagtagagacgggatttcaccatgttggccaggctggtcttgaa

SEQ ID NO: 16355 - DNA, 201 bp, Homo sapiens
gagttaaggaaacagaggaagtaatcacaagggtgggaatcttcttttttgagatggagtcttgctctgtcacccaggctagagtgcagtggcactatctyggcttactgcaacctctgcctcccaggttcaagtgattctcctgcctcagccttctgagtagctgggattacaggcatgtgccaccacacccggctaatt

SEQ ID NO: 16356 - DNA, 201 bp, Homo sapiens
ttccatctggtggtaggtgctcaataaacagatgctgcatgaaaaaaaaaacgtttggaagaatactggtcttgccctgcctatcatgtgaatggtaattrctaaatgaagacagagaaggaaggtatcttaacaatggtgggcaacacaatacagggaggacaggttaatgtgttgatcatgtctgactctttctttaag

SEQ ID NO: 16357 - DNA, 201 bp, Homo sapiens
tgggactaggatttaagtctgggctgttggcttttgggtctccactcttaagtcctatactgcttctctcttcccttgtgtctcttcatccttctgagatractctgctcttgtctcaaaggttccagacctctgtccccatcccagctctccctgtgacctccagctctccacttccaactgcctacggagtggctctac

SEQ ID NO: 16358 - DNA, 201 bp, Homo sapiens
ttttgtttttgactttcacataaactgtttatagtgtctggaacatacatatatatatatatacacacacacacacatatatgtatgtatgtatacatgtrtacatgtatataaacatgtatatgtatgtatattccagacaaattatataaatgtatgtatatatatacaaattatatatacatatacgtatatatatac

SEQ ID NO: 16359 - DNA, 201 bp, Homo sapiens
tcaaattgtacctggttttttatttttgtttctgtttttgtttttgactttcacataaactgtttatagtgtctggaacatacatatatatatatatacayacacacacacatatatgtatgtatgtatacatgtgtacatgtatataaacatgtatatgtatgtatattccagacaaattatataaatgtatgtatatat

SEQ ID NO: 16360 - DNA, 201 bp, Homo sapiens
cttcaaattgtacctggttttttatttttgtttctgtttttgtttttgactttcacataaactgtttatagtgtctggaacatacatatatatatatatayacacacacacacatatatgtatgtatgtatacatgtgtacatgtatataaacatgtatatgtatgtatattccagacaaattatataaatgtatgtatat

SEQ ID NO: 16361 - DNA, 201 bp, Homo sapiens
aagctttttaaaatttcagatttcaaatgtcaagtctctattcagtgcttttgggccccttgcatcagagtgtttatattttgcctgactctttggtttcyggccataaagtttgcatgttgtcatcttttctctaacattatgtgtattagataacatgtactacaatagctatagtgggttacaaaagattcttaacac

SEQ ID NO: 16362 - DNA, 201 bp, Homo sapiens
gatctcagtaagagagatatatgagagggagattaacaagaaggctagaaaggaaaataacacatttaggaaaatgataacgaggactggtcttcatggcsttctgtaataggtcagggagctctcactcccttccagtgttggtggcagcaacagcttcttttcttagattattagaggccctagggattcgatttcacc

SEQ ID NO: 16363 - DNA, 201 bp, Homo sapiens; identical to SEQ ID NO: 1884

SEQ ID NO: 16364 - DNA, 201 bp, Homo sapiens
ccacaatggctggactaaatgacactgccaccaacagtgtataagtgttcccttttctccccaacctcgccagcatctgttatttttttacttttaataakagccattctgactggtgtgagatgatatctcattgtggttttgatttgcatttctctaataatcagggctattgagctttctttcatatgctagttggct

SEQ ID NO: 16365 - DNA, 201 bp, Homo sapiens
ccctgtttatctgaaaaattactccagtcagattctcctacttaaatattcatgaagatgttatgaggactatatgatgtcaagtaaagggacatggcttwtgtgaaattctatttaaactgttgaaatgagggtggtgtcactctctccaaactttccagttccctccaataaacctgtagaaagcagaccaccagatgt

SEQ ID NO: 16366 - DNA, 201 bp, Homo sapiens
tgatgattaaatctggatgatcataatatccagatgcattaaacaatgaccttctcaaatcataacggaacagagatgtcacgtggctctggccaaggacrtaagtgagttcgttcaacaggcattttagttctggtgccaggtcattggggacagagcagagatacagcctgattttcctcagcatctaccgccccgtca

SEQ ID NO: 16367 - DNA, 201 bp, Homo sapiens
tgtgggacccaagactcatctgtcaagcccttcttctgactgcttttaaggtaatatttttaaaaaacaagaaattacaataagcttttttttttcaaatgagtcttcttgtcctattcctttattattttgccacctacctttgtcatcggtggaattgtacttcatctatttcagctttacttatcctgctagttttac

SEQ ID NO: 16368 - DNA, 201 bp, Homo sapiens
gagagcactatcctacattctcagcccttggctgtgggcatcccatgatcaacgtgactcagtttgagtgactcttgccagtctgtcagttttctttcctyttccctggtctctctgtcattaacaccctattacctatggatgtcttcattagaagcaaatgttgttttttgttttttgttttgacacggtctcattctg

SEQ ID NO: 16369 - DNA, 201 bp, Homo sapiens
atacatacatacatccatacatacatacatacattcattcatgtgtttgtgtatgtgtatgtgtgtgttactcctccttaatggacaaatggtgatatggwttggctgtgtccccacccaaatctcatcttgaattatagttcccataatccccacgtgtgatgggagagacccagtgggaggtaattgaatcatgggggt

SEQ ID NO: 16370 - DNA, 201 bp, Homo sapiens
ttctagtactctctttttcactttgctaaagtttgaatcatcttttgtaatggatgcgtaatactctaccaaatatagagtatgtatttgtccatgttttraattatttccctaggagagcttacccaaggtaaaatacttggtcaaaatttataagcctcttcatagctcttggtacatactgacaaactctctccaaaa

SEQ ID NO: 16371 - DNA, 201 bp, Homo sapiens
ataatgcagggtagaaatttcaaatataaatattatttcctatttaggaaatttggaaaagaaagcaggaaaaaaataactcaccccctggtcccccaccrtgacactacctctgtgaacattttggtagatattctttgggctctgacacgtacacacatgttgacttttatcatcatcatcatcatcatcattattcta

SEQ ID NO: 16372 - DNA, 201 bp, Homo sapiens
tgtactaagcagctgaataatgcagggtagaaatttcaaatataaatattatttcctatttaggaaatttggaaaagaaagcaggaaaaaaataactcacyccctggtcccccaccatgacactacctctgtgaacattttggtagatattctttgggctctgacacgtacacacatgttgacttttatcatcatcatcat

SEQ ID NO: 16373 - DNA, 201 bp, Homo sapiens
atgtattacaaaaacaattgtgtttcatgtaaagtattaaacatcaacattacgtcaccacaagggtgattacagcaaccttcactcctaagtgtgcgtcrcctacacaaacagagttgtttgtctgcagcattgttttcatttggtaacaattgtaagagttgaagtagcaccttaaggagtaattttcagaggtgaagc

SEQ ID NO: 16374 - DNA, 201 bp, Homo sapiens
tgttttaatggagagagatgtcctgggcatttgaactgcagattcccttaaactggacattgtcagctatttatgtattacaaaaacaattgtgtttcatrtaaagtattaaacatcaacattacgtcaccacaagggtgattacagcaaccttcactcctaagtgtgcgtcacctacacaaacagagttgtttgtctgca

SEQ ID NO: 16375 - DNA, 201 bp, Homo sapiens
aggcatgagccaccatgcccagttgcatgttttaatggagagagatgtcctgggcatttgaactgcagattcccttaaactggacattgtcagctatttaygtattacaaaaacaattgtgtttcatgtaaagtattaaacatcaacattacgtcaccacaagggtgattacagcaaccttcactcctaagtgtgcgtcac

SEQ ID NO: 16376 - DNA, 201 bp, Homo sapiens
cgtttagcttgcctgaagtgtgttctataaaatgcacccagattttcaggcatttaaaattattattattttaaatctcctactttctctctctctctctytttttttttttttttttttttgagatggggtcttgccctgtcatccagtctggagtgcagtagtgcaatcacagctcgcttcagcctccaactcctagcc

SEQ ID NO: 16377 - DNA, 201 bp, Homo sapiens
attattcttacaacttctctgcaagtttaaaatgataatctaaattttaaaaacttattttccgttcatcaaactactcttaaaatgtgtaaaactatacstgaatttaaaagcaacaaaactcatattgcaagtcttggcaaactgagagataggagcagaaaacaatggtggatgcctataaacggatcaagaaaaggg

SEQ ID NO: 16378 - DNA, 201 bp, Homo sapiens
ggaaaggaactgtcatcctgaactcggcatagcaccaagcactgggttgttacatggtgggtgttaagcaaatgccatggaatgcaacagacccctttttytgctgctgtaaactgtggtgtttgaacctagtagtgaatggcccaaggaaaaaaatactgcaggaaatatagtaatagatgaatttggataaagggtata

SEQ ID NO: 16379 - DNA, 201 bp, Homo sapiens
atgcctttgcactccagcctgagtgacagaaaaagaccctgtcccccccccaaaaaaaaagtctagcaacttgagtgtggcagtggccaacttgatggtamctaacaatgggattgcaaactctttgaggaaaggaactgtcatcctgaactcggcatagcaccaagcactgggttgttacatggtgggtgttaagcaaat

SEQ ID NO: 16380 - DNA, 201 bp, Homo sapiens
agcccgttgagggcgaagttgtcttaaatggctttgtgtccccaactgccaccagggagatgcatagtaactagccaatgaatgaatgttttcttcccttmaaaaataccaacagatgcctaacataagcaattaagtgagggaaagcttttttgccattttaaaagtcattcgtcagcccacacgataccactgaggaag

SEQ ID NO: 16381 - DNA, 201 bp, Homo sapiens
aggaggctagccagggccttgccacagactaacttcaagaaaagaggaaaagagtgcaccagcagactctggactgaggagcatgtccaacggaggaggckaggtgtggccaatggttcttttgttgataagaaagaccctgaaattgcctgttgcatggtgaggagagtagtagattggaccgtaattttctggtgacct

SEQ ID NO: 16382 - DNA, 201 bp, Homo sapiens
aatctacagtgactttgagtttgtgcctagggagactctagtgaaatgtgccaaggcctagttcagagagtcctgaagtagtgcgctgtgcgtggcacacagatgattctgtgagacactgatgaatactttttatttgaaaatttatatgctttgctttttgtgtatatagggagacatttgaaattcactctcagcaat

SEQ ID NO: 16383 - DNA, 201 bp, Homo sapiens
gagccttttctgcttcaattcttgtgtagaaaacatatgttcagtgatgcaggcagcagttgggttaaagacacactgtagggccgcagacaaaaggcctrtgcccttcctgcattcacaatgtttccaaacatattcacttgtctcacttgttagggactgagctgtcagctggatcctcttgcaagtgtgatttctttt

SEQ ID NO: 16384 - DNA, 201 bp, Homo sapiens
ccttatttcacaagtgtgtgtctgttgtggaaaaacagaggaaaatggttgggcattattacagtatagctgggggtactaggagaaggatcaaattgttgcaatttagagtaaaacctcacttacagttacctgtgtcctaaggcaacctccaggagtaatctctaggagggttgtgagtcagaagtccagatacctggg

SEQ ID NO: 16385 - DNA, 201 bp, Homo sapiens
tatttttaattgttttgtagagacagcatcttgcaatgttgcccaggctgggcttaaactcctggcctcaagagatcctcacgtctcagcctgccaaactrttaggattataggcatgaaccaacacgtctggccagacctcagttttaagactactcttttcttagctttgcagatatgctctggagatgccagcttaca

SEQ ID NO: 16386 - DNA, 201 bp, Homo sapiens
atttatttttaattgttttgtagagacagcatcttgcaatgttgcccaggctgggcttaaactcctggcctcaagagatcctcacgtctcagcctgccaawctattaggattataggcatgaaccaacacgtctggccagacctcagttttaagactactcttttcttagctttgcagatatgctctggagatgccagctt

SEQ ID NO: 16387 - DNA, 201 bp, Homo sapiens
ctccagaaccacaggggaagcaattctgcctttcaggggagtagtaaccacttttgatgctgagctcaagtctgacttgctgcccttcattgtgcctgatrggtgttctactttctctcttattagtccctgctggagacattgctgatagccagaacttcaggaaagaatacatttatgggcctgatgacctccctgaat

SEQ ID NO: 16388 - DNA, 201 bp, Homo sapiens
ttgttgctagtagacgtgtattgcaggaaatttgtcagaagaagaatgatatagatcagaaactcagatctacataaagaaaggaagagattttgagatgraataagtgaaggtaaaataaaaaccattatttttcttacccttaattgatagaagagataacaatttattcacaataataacaacaatgtattcaattat

SEQ ID NO: 16389 - DNA, 201 bp, Homo sapiens
tattattttctagtttaattccattctggactgaggtcaaatattttttaaaaaaatgtttcagacaaataaaaattcagggaatttgttgctagtagacktgtattgcaggaaatttgtcagaagaagaatgatatagatcagaaactcagatctacataaagaaaggaagagattttgagatgaaataagtgaaggtaa

SEQ ID NO: 16390 - DNA, 201 bp, Homo sapiens
tcacaactcactgcagcctccacctcccaggctccagcaatcctcccacctcagcctcctgagtagctggagccacaggcacgtgccaccatgccccactmatttcttttactttttgtagaggtagggtttcaccatgttgtcctggctggcctcgaacttctgagctcaagcaatcttcctcccttggcctcccaaagt

SEQ ID NO: 16391 - DNA, 201 bp, Homo sapiens
cagaaatactatatgtgcttgatatttatttatttatatttattttgaggcagggcctcactctgttgcccagaatggagtgcactggtgctatcacaacycactgcagcctccacctcccaggctccagcaatcctcccacctcagcctcctgagtagctggagccacaggcacgtgccaccatgccccactcatttctt

SEQ ID NO: 16392 - DNA, 201 bp, Homo sapiens
aaatgttgtattccagtcttgtgtatccttccagaagtattataaatattatattattatccttccagaaaaatcagtcttgagtatccttccagaaataytatatgtgcttgatatttatttatttatatttattttgaggcagggcctcactctgttgcccagaatggagtgcactggtgctatcacaactcactgcag

SEQ ID NO: 16393 - DNA, 201 bp, Homo sapiens
atgtagagttattcctgcagggctgtgattataggcaaatcatagtgtgtataccttctaccttttttagtgtatctcccactcttgtaccccagaaaaaytagtcttgagtatccttccagaaatgttgtattccagtcttgtgtatccttccagaagtattataaatattatattattatccttccagaaaaatcagtc

SEQ ID NO: 16394 - DNA, 201 bp, Homo sapiens
aatgccttctctgtgccagtcactagggctataattgtggatgaaatagaaaaacagactctgccctggaagatcagagtctagtacagcagtttaaagtstgatggaatttcaatttaaaatgtccccttcatggtaatcagtgatgcacatttacagctccactaaaaggagaagctccagtggggcatagctctttgt

SEQ ID NO: 16395 - DNA, 201 bp, Homo sapiens
ctttcttatgtcctttggttgtaaatttgaggcatttttgtttttttcttccaaattaacattttctttccctgccatctagcacaaggactgtgaatggwgtgaactaaaagaacattttgtttaagcaagccatggtgttcattgaatgccttctctgtgccagtcactagggctataattgtggatgaaatagaaaaa

SEQ ID NO: 16396 - DNA, 201 bp, Homo sapiens
atatttaacaataaaaagtttatcagacgtgaaactttcctcctccctacacagcctaaggaggggaaaaactctcaccaaactatcattttactgagcaratttcaaaggtgttggatttttgggagacatcgagaaagactaattgcaattattgtctctaattgtctttattgatgccagcttgagaagagtaccagg

SEQ ID NO: 16397 - DNA, 201 bp, Homo sapiens
ttaattttggggggaagttttggacaatttaaacttgacttttaaacttaacagtcttttgtatgttgtcacatcttctacttatttaacagtttggttaktgggagctgggagctgggagtgcaccaaacacactgaggtacttaaaatcttttcaattttattgaggcttaaaggcaagtaagaacctgttgcctctgc

SEQ ID NO: 16398 - DNA, 201 bp, Homo sapiens
cagtgtctgcttccccacaacagtaaacactctcctgacttctaaggccataaatagttttatgtgtgtttgaattagacttgtaaacttgtaagctcctwaaagaagtaatttgtgtcttcatccttctttgtatccgtatatagtggcaaatgagtattttttgccccaaatctgttaagtatttgttgttcttgagga

SEQ ID NO: 16399 - DNA, 201 bp, Homo sapiens
atcttacagtgttcattttaagagttctgaatttttcttcagcttttatgtcgctttttttgttggatctttttttgaatgttttacaatttcacagtgawatttttcactcattttactgtcattgtgtagggctttcaatcatgcccttcagttgttggacattttcttgaattgctttgttagttatttcttcctctc

SEQ ID NO: 16400 - DNA, 201 bp, Homo sapiens
ttcagagagtactggaggtgttaagacagtgtgaagaaattaccttcttcatcacttcttcatcattgctttgagtatactggggcctcagggacttgctwagaaagtaaccagtatagtgatagaattagagttgctgctcatggcttcagaatatttggtctctgcttacaggattgcattgctttcttcataagctat

SEQ ID NO: 16401 - DNA, 201 bp, Homo sapiens
gtttactgagaatgatgatttccaatttcatccatgtccaggaaaggtttctataagaaaatgacccagggatgggaaggaccatccaggtgtggagttgsgggaggagcctgggggaagtatttaagagctggacacttgaggactgcaggaatagaagcacatatggtcagagagaaaggggacatgatctgagtggga

SEQ ID NO: 16402 - DNA, 201 bp, Homo sapiens
tgtttgaagacctgttattaggtgtatatatgtttaagatttttatgttcttgatgatttgactcctttatcattatgaaatgactttttctcttgtaatattttttgttctgaattccattttgtctgatatcaatatagccacttcaactttcttttaattagtattactgggtaaatttttttccaactttttacttc

SEQ ID NO: 16403 - DNA, 201 bp, Homo sapiens
ttcaagctggttgatggtgttgttcaaatctcttatggtgcttttgtctacttgttctaccagttattaagacaaggatattgaaatcttagactattaaytatggaattacctatttctttttgttctttcagtttttgctgcatgtttgaagacctgttattaggtgtatatatgtttaagatttttatgttcttgatg

SEQ ID NO: 16404 - DNA, 201 bp, Homo sapiens
gaaaactgaggacgaagcaggtctggggtgaatcaggtgctatccctttggacagtcacatgactggtgtctgttcagcacccaagggaccatcaaagagrctgttgtggagagggaatccgaaggtcagggccagagatagaaatctggggagtcatccactatataggtgatgggttaaagccttagaactcttctttt

SEQ ID NO: 16405 - DNA, 201 bp, Homo sapiens
atcactactcctggctaattttttcgttatccgtgaagatgcctcactgcattgcccaggctggtctccaactcctgggctcaagtgatttacccatttcrgtgctccaaagtgctgggattacaggtgtgagcctctgccctggcctgagcaactagattgtgaccatttactgagataagaaaactgaggacgaagcag

SEQ ID NO: 16406 - DNA, 201 bp, Homo sapiens
ctgttgcccaggccggagtgcagtggcgcgatcgtggctcactgcagccttgacctcccaggcttcagcgatcctctcaccttagtctcctgagtagctgygactacaggcgtacatcactactcctggctaattttttcgttatccgtgaagatgcctcactgcattgcccaggctggtctccaactcctgggctcaagt

SEQ ID NO: 16407 - DNA, 201 bp, Homo sapiens
ccaggcttttagcttgagtaactagattggttttgtttgcttgttgtttctttttggagatggggtctcactctgttgcccaggccggagtgcagtggcgygatcgtggctcactgcagccttgacctcccaggcttcagcgatcctctcaccttagtctcctgagtagctgtgactacaggcgtacatcactactcctgg

SEQ ID NO: 16408 - DNA, 201 bp, Homo sapiens
atgtgggccaggctggtctcaaactcctgacctcaggtgatccacccgcctcggcttcccaaagtgctgggattacaggcatgagccaccgtgcccagccytgtagctattttaaatgggattgttttcttgatttcttttttatatagttcactgttagcatatagaaagactactgatttttgtgtgttgattttgtat

SEQ ID NO: 16409 - DNA, 201 bp, Homo sapiens
caatggtagaatgttgcatgctgttcttctgtaattataatggcctgatccgtgtggagtgggtgagtcctgcttaacaatcgttaatctactgagtcttmgtatcagcctcccatcttgaggagcagcagttcttggctggatgagtcggtctttgatttcattataataaggatagctttgttaaaattccgctgcgca

SEQ ID NO: 16410 - DNA, 201 bp, Homo sapiens
ccgctagatatgaaagacaggtagctatgaatgcatggctccaggaccttctgccatgtcaaatgagctaaacccttccccgaaagccagccaggaaaacrtatgataccatttgcaatggtagaatgttgcatgctgttcttctgtaattataatggcctgatccgtgtggagtgggtgagtcctgcttaacaatcgtta

SEQ ID NO: 16411 - DNA, 201 bp, Homo sapiens
tagtggttctgtcagtgtaatatgacatgaagcatttctcagtaatgacagacattgaatatgagtgacaggaaccctgaccacaaggaatgggttcaatyaccagaaatgggggtggggggggcgcggttacctgagataaaaccaaagggcccaattgtgcttggttttgaccccttgactcccagatccagagcaaag

SEQ ID NO: 16412 - DNA, 201 bp, Homo sapiens
atgaatttttatctcccatttactagactttcattgtattgtgcttacagacacagtgtcagcacataaaatgttaaacatcactggtctgaaagaggctyccattgtcttacctctggtgctgggggaatcttgctagctttgctgtagtggttctgtcagtgtaatatgacatgaagcatttctcagtaatgacagaca

SEQ ID NO: 16413 - DNA, 201 bp, Homo sapiens
gaattatattatttatagtgaacatagtagtgtggtttcatctaataaaataacaggtcacatttactatttgttatggtcctggcacttgtctaaaatascaacttttcccaagtaggtcaatccattccttgactgcaaaatcagctttttaatactcttggtatagggcatgcgtggccattttaagagatcagtgaa

SEQ ID NO: 16414 - DNA, 201 bp, Homo sapiens
ttatttattcattggagttgaatgtaatttttttaaagtaccttctttttgctatcagtaacaatgcctctttaggcatttagagaccacctcctgctaaycgctaatgtggcaaacttatgaatatatatttgggggaatcctatcttctattgtttaaatagcagaccctcatggactgaatatttatagttttgatat

SEQ ID NO: 16415 - DNA, 201 bp, Homo sapiens
cctgggcatagataggtcaactttaagatgatcttttttcaattgagggcatatcccaataaaattttcttatcccctggcttgcccggggctggcatttmtgacagacgtgtaaacagatgcaagcattgttgctaatgacaggtgattataagaggcatggaggccaaggtaattaaaccacgatttgacagggacatt

SEQ ID NO: 16416 - DNA, 201 bp, Homo sapiens
ctgtggaaaacacagttcctctaatcaaggttatagtttagttgttgggaaagagacataattgattgtgagataaatgccaagttaaataacattgaccrtaagtacatcatgagctctttgaaataagtagtcagtgtgaattggggaagtctttatggagagaaagagggcatcaaaattggagctcaaaactattga

SEQ ID NO: 16417 - DNA, 201 bp, Homo sapiens
gaccatatgggtccttaatttgtatctgagtatccagttgcatgaagatggatggttaagaaaaaaaccaagagctattcatttattccacaaatatttaytgaacacctaacagtgtccctggaactgggtatacaagagtgaacaaaaaaaccacagcctgtttcttgtgctggtagagcttacagtctagtggcagga

SEQ ID NO: 16418 - DNA, 201 bp, Homo sapiens
ctctgatttccctgtggaacaaagaaataatcttcttttaacatggctacctgtggatgggcctttcatttaaaaggaggcagaactttttttttccctaracctacctcagagggtacatagggttttgaatctttactacaataaaaccaacaatgttaccttgtcatttaaggcagatggcgtaccttgactattcct

SEQ ID NO: 16419 - DNA, 201 bp, Homo sapiens
ctaggaacttaggctaataacagggaactgctttcagttttttagtgctgagataggattcagacctgaatgtgtactaagccaagtaagcttagtgacartcatccatgttcagtcccttaacaaggctgtgtattgtccatgtggataattttggtggtgggtttctgtctaatctacagtgactttgagtttgtgcct

SEQ ID NO: 16420 - DNA, 201 bp, Homo sapiens
ctgctttgcccttcatgtgagagagtgcccagaagaactaatagtaattcaaatgatgcggtaacttacagcttgcattaataacacacaaatagaacagycttcttactaaatattagtaatataataatgttttactgtctttcccatagtggggaattatgaggacctcatgttaggacctcagtgtcctgacatagt

SEQ ID NO: 16421 - DNA, 201 bp, Homo sapiens
catgtgtagttaaatttcactgtaaatatttcataagggttcttagaatggagccaggttgacatcacagccccaactgtaccaaaggaaccatttcattmaaataagccaacatttccaaagaaacacgaatgtctatggcagagttaacataaggtcagaaaatcctctggaagaaatttcggtatcaatgtttataat

SEQ ID NO: 16422 - DNA, 201 bp, Homo sapiens
tagtctcaccactccacactgatggtcacatagaggtgtgagttgggaagttgttaaatacaagagggtttgagcttctggagaagaggaaaatgtaaaartattttttcctttaagaaagataaaaaggtaagcctaaaccttggcggccaccgaagtcagctgttacgcatgtgtagttaaatttcactgtaaatattt

SEQ ID NO: 16423 - DNA, 201 bp, Homo sapiens
ctgaactccaggaagcatatgaccagatgctgtgctacggctctctttccagactgttgacagccattgtatctgtccaggtaccccatggcctggccagmaaaacctccacccctctgcccagctctggcctctttcctaccagaatacgggcctgggaggcaactgcaatgaaccctcggaaagcataggttttgctaa

SEQ ID NO: 16424 - DNA, 201 bp, Homo sapiens
attttttttcactgaaaaagttgctgtttactgaaaaaatgaagtcatatctacaaggaaggcttatgtagggcctggtctgaactccaggaagcatatgrccagatgctgtgctacggctctctttccagactgttgacagccattgtatctgtccaggtaccccatggcctggccagcaaaacctccacccctctgccc

SEQ ID NO: 16425 - DNA, 201 bp, Homo sapiens
ttaaatgttttatatgatgagaaaaccgaggcacagaggtgcagagtaacttgcccaaggcaacagctagtaagtagtgaagatggaatttaagccaagayggcccaggttggccaagagcaataacaaagctttagtttttaatcaaccactgatacgattcacttagtattttagagaccttctaggatccttctcagt

SEQ ID NO: 16426 - DNA, 201 bp, Homo sapiens
catgatcttcagatcaaaacaataaagccaggaataaacccagccacccttatccaaattggcctctcctttgagagaatgcctcatgaagtaaatatccyagcctcctggtaggggcctgatattgcaaaattggtgcagggaagaacactagacagagttggtgctctgtgctcagcagtgtcacacagaattgacagg

SEQ ID NO: 16427 - DNA, 201 bp, Homo sapiens
tcagcacagttatgaactttagcgttggtgattcggcatgtggactagaacttggagctgtgttcacaaaaagtggagctcctcaccttgaggatgggctrtgggataatgagactgatgcagttatctgctgagacaacctgtgattgtgtcatcggaccacgtcagctgctatcattcatgctaaagagactggctgct

SEQ ID NO: 16428 - DNA, 201 bp, Homo sapiens
ttaaaaaatgaagtaacctgacattaattatatatggacttgattctgtgtttacatttttatctctcctaccagaatgaaagttttatgaggattggacrtttgtttgtttaccagccgtaaaacatacacctcaggccaggtgcagtggctcaggcctgtaatcccaactctttgggaggctgaggcgggcagattgct

SEQ ID NO: 16429 - DNA, 201 bp, Homo sapiens
cattcttttttactgctgaataatattccactatatcgatgtgccacattttatttatccagtaatcaactgatgggcagttgggttgttggacagtaatmaattgatggacatttgggtgggttgactttctggctatcatgaataatgctgctgtaaacattcatgtacaagtttttgagtgacatgttttcagttctc

SEQ ID NO: 16430 - DNA, 201 bp, Homo sapiens
tgttatagcatataagtacttcattcttttttactgctgaataatattccactatatcgatgtgccacattttatttatccagtaatcaactgatgggcakttgggttgttggacagtaataaattgatggacatttgggtgggttgactttctggctatcatgaataatgctgctgtaaacattcatgtacaagtttttg

SEQ ID NO: 16431 - DNA, 201 bp, Homo sapiens
tagtataagtcttttgtaataaaggtttttacctctctttagcaggttcatttgcgatcatattagggagaatttttaaagtaaaacttgtaacctggttrtaaaatatttgtctgtctctcaggtcaggcgccaagccattgtttgggactcactgaagtctcttaaactgaagcatatgttccttgtaatttagctttt

SEQ ID NO: 16432 - DNA, 201 bp, Homo sapiens
tgaagttgatgtagtctagcaactgaaacaaaaattctcaagtcctttgtgttaagggaggaggaaagaaagagcttaacagctgacactgtgcagacccmcttaaaactaaacacctgaaagaaaatttcaagaggctggtgtcttgagatctcagaaggaaaagtgtcctcagagtattaaataaccataatccttctc

SEQ ID NO: 16433 - DNA, 201 bp, Homo sapiens
caggctgatctcaaactactgatctcagatgatctacctgcctcggcctcccaaagtgctgggattacaggcatgagccacatgtcctatgagttttaacrtctgtataaactcacgtaaccaccaccacaatcaaggtacagaatggttccatcatgctcaaaaattcccttatgctgcgtcttgcccaaccgaatccct

SEQ ID NO: 16434 - DNA, 201 bp, Homo sapiens
gaagtatgccaccacacctggctaatttttgtattttagtagagacagggttttgccatgttggtcaggctgatctcaaactactgatctcagatgatctrcctgcctcggcctcccaaagtgctgggattacaggcatgagccacatgtcctatgagttttaacatctgtataaactcacgtaaccaccaccacaatcaa

SEQ ID NO: 16435 - DNA, 201 bp, Homo sapiens
cccaggctggagtgcagtggcatgatcccggctcactacaacctatgcctcctgggttcaagcgattctcctgcctcagcctcccgagtagctgggattayagaagtatgccaccacacctggctaatttttgtattttagtagagacagggttttgccatgttggtcaggctgatctcaaactactgatctcagatgatc

SEQ ID NO: 16436 - DNA, 201 bp, Homo sapiens
ggggatttgagcagccagcactctaaagaatatattaatacttagttctttctgatctggcctgcatttccatagatttctattgaaaaaaagtactaatraaatgaaatttagccaccaggacacgtttcctaatgaaatgaaatttagccaccagtgcacgtttcctaaacctgtgggggttttctcctgtattttggg

SEQ ID NO: 16437 - DNA, 201 bp, Homo sapiens
tcccagctgataacatcttaaaccaagtttcttcacaagttgaacctttagccctcattatcagtcagagcatatctttgtaatttgtgtgtgcagagggraaatacagccctaacatgagacagctatgtatataaaaagtgttgggggtgacatttttcccgtaatgacagtattacttctgtggtggtagtgaggatg

SEQ ID NO: 16438 - DNA, 201 bp, Homo sapiens
tacttccatcactgattactcttgggcatttcaccctcccaaaatggacaagtgaaaatctgcaaaatgggaattacatgatcatcatactttataaagcrtaccatagtaaaataaaaacagttttatcgatgatggtcaacaacaacaattttcttgtctttgtagagatcttggattgtgtcttcattcccatatcat

SEQ ID NO: 16439 - DNA, 201 bp, Homo sapiens
gctcaattatttcgtacttggtatagttagccgttcttcaccttcaattaacagttaggacaacgaacagattagtgcagtggaattcttagaagtagcgkctgggaattaggggcatgtgtgtgttgtggtggggttgggagagttcttgcttttatttataaagttaatagtttttgataaaaagataaagataaggca

SEQ ID NO: 16440 - DNA, 201 bp, Homo sapiens
aataataattttaaaaagactaaatgggggaaagagaggaataaagaaaggcttcatttttatgactcattttagtagatttaatgtgactctgactggcyggtactttagatttatcctaaatctcagtagcaaaattctagggagaaaaaggagctaacacttacagactggctgccatgtgtcaggtactatggtaag

SEQ ID NO: 16441 - DNA, 201 bp, Homo sapiens
tacacattgggtacagtgtacactgctcaggtgatgagtgcaccaaaatctcaggaatcaccactaaagaatttattcatgtaaccaaacaccacctgttycccaaaacctactgaaataataataattttaaaaagactaaatgggggaaagagaggaataaagaaaggcttcatttttatgactcattttagtagattt

SEQ ID NO: 16442 - DNA, 201 bp, Homo sapiens
caaaataatggcattcacagcaacctggatggaattggagaccattgttctaactgaagtaactcaggaatggaaaaccaaccatcgcatgttctcactcrtaagtgggagctaagctgtgaggaggcaaaggcataagaatgatacaatggactttggggacttggggaaaagggtgggaaggaggtgagggataaaaga

SEQ ID NO: 16443 - DNA, 201 bp, Homo sapiens
tcttgtccccactacttatcagctctgtgatctgaggcaagttacttaatatctttgtgctttgattttcttttctgtaagctgggataataataaaacckatttcactgaattgttataaggatttaaattggggttacatgaaaagtgattaggacagggcttggcacacggtaagtgtaaaataagtaatagttattg

SEQ ID NO: 16444 - DNA, 201 bp, Homo sapiens
gactttagcatttctgtttcttttaaaaccatctcctgtgatgtcttagaagaaatacttcttctttctttcttttttctttttttttttgtcctgtttcwaattctgtttcggagttctcagtgctttctctttcacacattggaaataaatgactgcatttttgttgaaataattttttttttgcagataaataattgt

SEQ ID NO: 16445 - DNA, 201 bp, Homo sapiens
ataattatctgagagctgggggttttgtggtagattttctttgatgtatgggcagtggtggtaatttgtttctttcttcccccttctattttgctttgcckcatttcaacttaagcaatgaattgtgtggtcttttataatatagagattagtgtagccatttttagccagtttttatcatctcccttaggagctgactct

SEQ ID NO: 16446 - DNA, 201 bp, Homo sapiens
aatttagagtaaaacctcacttacagttacctgtgtcctaaggcaacctccaggagtaatctctaggagggttgtgagtcagaagtccagatacctgggtwacactttagcctctgctaatcacttgctggtatcagatgagcctcttcccctccctggcgtgttttgtggttttatgtgttaacttcagagatgcactga

SEQ ID NO: 16447 - DNA, 201 bp, Homo sapiens
taagagagaatgtagtttcaagagtaaaggagaacaaagtagggtgacctagtctgaaggacaggcgcagaacagtcagtggaacagccagagatagcagygagagaggtgagaagaggaccaggagtaggtggtagaatggagtggaggaaagtcagcgaatgtaatagtgtcgaaccctgcagggaagttaagaagtgg

SEQ ID NO: 16448 - DNA, 201 bp, Homo sapiens
acgtacaagaatcttcatgctgactgagttggaatctcctggtgagaagtgatttgttgtcctgatgagaatgtaaacacttgctaaagttgagtatcgtytctcatgtgagttctattatagccttctgtgtttataaacatgtcttgagcatgagggagaaatgtggtaacctttgagtccccaagaaaatgttcattt

SEQ ID NO: 16449 - DNA, 201 bp, Homo sapiens
catgcagtttctttgtatagattctccaaattattggaatatgagccaattccatgggattaatttaggtcctattatctgcaataagacatcccttgtcrgattttcgttgtcaggggcaagtctaaaatgtccaaccattgcatgcaaactcgtagtaaagccattgtctagttattaacaaatgatgagcaggtgagt

SEQ ID NO: 16450 - DNA, 201 bp, Homo sapiens
gatggttgtgagatttgcctgagataatacatgtagtgttttgtccattgcctggcatcttttgcatttttgctttgaatctacttcttttattcctcccrccatcctgctaatttggtgaccccttaactttcacctgagttcctgttgctccttagactctcatcttaggtttgtgcatatgtataatccatgctttcc

SEQ ID NO: 16451 - DNA, 201 bp, Homo sapiens
ttactatatttgagtgggtggacactaattctcaggagttgggggccttactagaccacatctcttgctgtgttatctcatgctatgttgtaaagtgagcrtctgttgctggctgtatgacccatgtgatcagccactccatcacctttgaagtggtcaggcttagatattcttgggttaagagctttagctttcaagtta

SEQ ID NO: 16452 - DNA, 201 bp, Homo sapiens
tccccatccctggaaacatggcactttgcctgattttctgtttaaagttatgttcctgttggaatctgttcaggtctgagtttcagttgtcaccttctgawatgatgagcctccttggcctctcctgctcgcctcgttcttcctccacctgtcagtcttcattaggatcatttaaacactgactcattctctgctctgggc

SEQ ID NO: 16453 - DNA, 201 bp, Homo sapiens
cacacgggatgtaggtggccctttatgtaccctgctgagttctaggcctttgtgctataactatttttggcaatggaaggtgaagggagggctccccatcmctggaaacatggcactttgcctgattttctgtttaaagttatgttcctgttggaatctgttcaggtctgagtttcagttgtcaccttctgatatgatgag

SEQ ID NO: 16454 - DNA, 201 bp, Homo sapiens
tatgttatctatatacatgtgtatatgtatctatatttacatatagatatatgtatatacatatacatatatgtacatgtgtacatatgtgtccatataaygccagtttcccaacatcctcaccagtgcagtgtatcatcagacttttttgcaagaatgattggtgaaaaatggtgccccatttccatttgcatttctctc

SEQ ID NO: 16455 - DNA, 201 bp, Homo sapiens
cttagagattgttccaaatttgtatgttcttttaaattactgtgtagctttttattgtatggttccataacttatgtaaccagacttctactgtctttagycttctgcttttacaaataatattgtagtgagtatcctaatacataacgtttttcacaagtgagatctatggtaattaatacctaggagtaaaattgttgg

SEQ ID NO: 16456 - DNA, 201 bp, Homo sapiens
attgcctcttgtccaggtgacagtcttgtgaactcaatacttgcataaaaattattttgaaataaagccaaagtgtcattcatgagctatttgatttggtycaagagagtggatgtggtcttctctcacttccactgctgaaatagagtggtttctttcccacacatacctctccactccttggctaacagtcccacatta

SEQ ID NO: 16457 - DNA, 201 bp, Homo sapiens
cttgatttatcagtgaatccagttagctctactttcaaaatatactcatgacctgactacccttcactacctcctgtgctaccaccttggtaaaaactacyatcgtttataaaatagcctctcaaccagctttcctgcttctactaccctatgtccatcccagtcagaatgttcctttgagatacaagtcaggtcgtcgtt

SEQ ID NO: 16458 - DNA, 201 bp, Homo sapiens
atctgcatagccatatctgcattggttataaagacttagagctggtggtagcttgagcatatatagccctcttattaaatattattaattgaaatgacaarttatgaaatatccagaattatgcgtcagatgttctttaacagatgttgggggattaagaggtttcaaattttacttgatgacataaacttttcatgcagt

SEQ ID NO: 16459 - DNA, 201 bp, Homo sapiens
ggaacacattaagttggcccttccgtgccttatggtaacataaccaccatcctgctccctcctcattgacatctgcaaaataatgacccttttttaaccaragggaactgtgatctattttttttctgtattcctgaaaggatctctgtgattatttgtagatgatatttttaatagcatgttttccctaacaagttaaat

SEQ ID NO: 16460 - DNA, 201 bp, Homo sapiens
aatactttgagaggctgggctgggaatctttccatattgtacagaaatgtctctatggagaaatgtactcccagtgccaaaaaatgacttacagagagccscgggaacacattaagttggcccttccgtgccttatggtaacataaccaccatcctgctccctcctcattgacatctgcaaaataatgacccttttttaac

SEQ ID NO: 16461 - DNA, 201 bp, Homo sapiens
gaaaaatattgttatgatgatccaatgagaaagtttgtaaaatataaaacatacataaatgcaaggtatcaccagtattgattttaaaaggaagcgtggasagtcttcaactgaggaatccttacttcgaggccggttgaccgagtcttccttattgacagcatccctttcctttcctaattttccttcctctggagctgg

SEQ ID NO: 16462 - DNA, 201 bp, Homo sapiens
atgcacttcctacccccaccgcccctgccatccaagatgattgtattatgagaagactcttcaggataagagagagttaccatttgaaagaaactgtacarctgctttgctttctgggtaaagagaaatatgaaaagctgaagtctcctgtgaggtgggcaagtcttgctgtagccagagattcaatggataggccatttg

SEQ ID NO: 16463 - DNA, 201 bp, Homo sapiens
gacttgcgctgtgatttctgtctttgtgctcttttttcactttgtggctgcaaggtgtagtctcaggaaggatatagaagaatggaaaatgagctttgaartcgcttttcttccattaatggtaattgcttcacatgtcataaccagtcacatatttcaaaaagtttagtcagctgtctctaaaactcccccatcctccac

SEQ ID NO: 16464 - DNA, 201 bp, Homo sapiens
agaaggtcttcagtgctgttgaacgtttctgactggcattagtgggaaagggtgggcatgaattgacaaggacattaaaacttttcctggtcagaaaattkgtaagattgtgagatgcttgaggacaggaagtccaaagccttgtggtcttgtttagtatgcattcttgacatctagcaagtgcctaacagatagtaggca

SEQ ID NO: 16465 - DNA, 201 bp, Homo sapiens
ggaattgcattttgggcataaggagcagccactgcaaaggctgtgtggtgggggaatgcctggagtccgtggaacagtccaggaacagtatgtttgagtgragggagtaaggctgctacttgtaggagaagaggtcatagaggtagttccatgagactggggagcagcagattgtataggtccttggaggcccttgtaagg

SEQ ID NO: 16466 - DNA, 201 bp, Homo sapiens
cacagtgaaaccccgtctctactaaaaaaaaaaaaaaaaaaaaaaaaaatacaaaaaattagctgggcatggtggcgggtgcctgtagtaccagttactcrggaggctgaagcaggagaatggcatgaacctgcgaggcggagcttgcagtgagccaagatcgcgtgactgcactccagcctgggcaacagagtgagactc

SEQ ID NO: 16467 - DNA, 201 bp, Homo sapiens
agtagagacgaggtttcaccacgttggccaggctggtctcgaactcctgacctcaagtgatctgcccgcctcagcctcctgaagtgctgggattacagtcrtgagccactgtgcctggcaagactttcaagaattgtgaaagatctgagattctaccctacttgcaagctaacaagttaatctgccacaatttcatattgt

SEQ ID NO: 16468 - DNA, 201 bp, Homo sapiens
caatgatgatgtctctttgaaatcctttgagcctgcagttttgaaacaaggagaagaaattcataatgaggtaaggactttctttttttttttttgagatrgagtctcgctctgtcacccaggctggagtgcagcggcatgacctcggctcactacaacctccatctcccaggttcaagtgatcctcctgtctcaagctcc

SEQ ID NO: 16469 - DNA, 201 bp, Homo sapiens
gtcattcacctttattctttgtggggttttttttggcaggaaattggagctgcctgcccttatgcacccagcactctgggatcttcatattaaaatacatwttagtcaagcttctgtttcttggcacagaaactttgtttttcccaggcttgttgatgtcgcattgtataaaatggcagtaaatgtgcaaggaaattttat

SEQ ID NO: 16470 - DNA, 201 bp, Homo sapiens
ggatttcatttccccagttataggcatctgtctttctagctataaccctcctaagaatccctttcttgtggatcacttgagtatatggctacttaagtgckcccttctacgtctttcctaatctaatccagaagagtggacagtctcattagtgctgggttcaaagggctgtacaaaatgataaataaaaagcttgggaaa

SEQ ID NO: 16471 - DNA, 201 bp, Homo sapiens
ggtacaggtgcaaggtcttccagtggcagtactgcgtgagtctatacggcagtgttgtgtcttttggtcattaagtagctttaccagtggaacgatcataytgctgtgtggcagagagagaatgaatgagtatttaaaccaagatgccagcaagcccatccagcacctctttcttcctttctcccctttcttctcttttcc

SEQ ID NO: 16472 - DNA, 201 bp, Homo sapiens
ggggtcccatgtactcagttaagaggggttccagagagcaaggcatgaaagggattacaagtgaccttctacctaagcttgctatccatgctttgctttayagcttgacctttcatggaactacaggggacaagtgtgagaaaattgggcggaagtggtacaacaaagtgagaggtacaggtgcaaggtcttccagtggca

SEQ ID NO: 16473 - DNA, 201 bp, Homo sapiens
gaaacattacaactctctttttttgtaatagaggaagtcatgtcctgagcagaggttgtatagattttgcctgacttgtggtatcatttcttaggatatayaacaacttggtcattggtttttctcccactgcttgtggttttaggaatattcttcaactgatgaattcaccacctacttcattcttgggttgtgaatccc

SEQ ID NO: 16474 - DNA, 201 bp, Homo sapiens
ggaaacattacaactctctttttttgtaatagaggaagtcatgtcctgagcagaggttgtatagattttgcctgacttgtggtatcatttcttaggatatrtaacaacttggtcattggtttttctcccactgcttgtggttttaggaatattcttcaactgatgaattcaccacctacttcattcttgggttgtgaatcc

SEQ ID NO: 16475 - DNA, 201 bp, Homo sapiens
ttccacctgctgcattctggtgcttctttttttggcccttgggaaatttttattcatacatgcacaggtcagtgctcttccaaatacttgagggaaccttyctgcagtctgtttgctgtctctctgtatagctgtttctgttccagcattctgcctttcgaggccctgtggccttggcctccctatactccagtctttgtc

SEQ ID NO: 16476 - DNA, 201 bp, Homo sapiens
ttaacctaggactcatttagccctacttctgcagtgatgctttcctaaggattttctagtatctcatgtagtgggagccattttggctgctgggatcataraatactcctggctgtgtgtgaaatctgaaattggttccacctgctgcattctggtgcttctttttttggcccttgggaaatttttattcatacatgcaca

SEQ ID NO: 16477 - DNA, 201 bp, Homo sapiens
atctttttttgcttagaattcgttgagcttattggatctctgggtttatagttttcatgaaatttggtgaattttggccattgtttctataaaaatgtgtrtgtttttgtcactctttcttccctagaattcaaattaaattttcattaaatggcttaatattgtcctggctgtcactcatgccctttcatatttttgtag

SEQ ID NO: 16478 - DNA, 201 bp, Homo sapiens
tgtgttacagtgttattgatttccagcattttgtttttgattctttcttagaatttccatccctctgcttacgttccccatcagttcttgcatgtcgtctrcgttgtcctttagggtccttagaatagtaatcatagtttcaaaaacatttctgataattaatttctgccatttctgactctgggtctgatttttgctcag

SEQ ID NO: 16479 - DNA, 201 bp, Homo sapiens
catttggcctgagtcactaggtgactcagtgttcccctcagtggaacaaaagcacttaacaaacctactcattaaggtggtgatttttcccctaattatgwctgtgggtcccagtattaatagcataggagtaataaggcttttatttgggtagatgagactggcatttatgtatttcctagacattgtcccagtctttta

SEQ ID NO: 16480 - DNA, 201 bp, Homo sapiens
aagagaaatgatccaatttaaaatggcaaaggaatcgaattaacatgtcacaggctgggtgcagtggctcatgcctgtaatcccagcactttaggaggccraggtgagtggatcacttgaggccaggagttcaagaccagcctggccaacatggtaaaaccccgtctttactaaaaattcaaaaattagccaggtgtggtg

SEQ ID NO: 16481 - DNA, 201 bp, Homo sapiens
gaatggatgttaggaaggcaacctgcagtttctggcacaactcccttgtgtgaaggagacagtcttcagctctgtgaactctcctggcagcccttgatgtyggccagtattatagacgagaagccaggagagtcataatgaagcacttcctggggcagagaaaaaagtaagtggagtgaatgatgaaaactttaggtcatt

SEQ ID NO: 16482 - DNA, 201 bp, Homo sapiens
gccatttttggccatcatttactgcattgatttgttagcaggggaactgtaataaaaaagccattgatttactgtccttatttgcttatgggctttttttwattattaatttttcactttttctttctctgttttggatcatttcttgtagacaaatgctgtgcttcatgaagttaaaagagaggggctccccgtggaaca

SEQ ID NO: 16483 - DNA, 201 bp, Homo sapiens
ctttctactctttacctacttgttttgccagattggtaactgattttcaacataagaactgtagcttggaggtgatttaaaaagatatttttaaaggaaarcaaatattgccaaacaatctggtttggtttaacaccctttggattgtacatttctcacaaatgcttatgaataattcagcaaagccaaatgcaatctgct

SEQ ID NO: 16484 - DNA, 201 bp, Homo sapiens
ttaaattttgtggaggttttgtttgctttgtgtatatgtgtgtatttttaaagttctctttataacaattgataaataatttgggaacagcccccttggcraggccttcctctaggggaccccctgtctcagcagtgctgcagctgctacttttaactgtgtgttaactcggagttgggccagggcctaagcaggatcccc

SEQ ID NO: 16485 - DNA, 201 bp, Homo sapiens
agtagaaacatgacagtatagtttccactgcctatccaatatgaacttctggcattcttgttatcttctcaggaactgcactgtttgcttcttgtgttcawtttttttttttttccagggatgaggatgtatctctcctcctgaaactttcactctaaaatatgcccccaaatactgacattttcaagcttgtgctttttt

SEQ ID NO: 16486 - DNA, 201 bp, Homo sapiens
tgctatttaagtggaaagtgcttgaacagccaaatgagcacctgtcatgtttattttcactttgaaaagtagaaacatgacagtatagtttccactgcctrtccaatatgaacttctggcattcttgttatcttctcaggaactgcactgtttgcttcttgtgttcaatttttttttttttccagggatgaggatgtatct

SEQ ID NO: 16487 - DNA, 201 bp, Homo sapiens
atgagctagttttatttccttttatgtattgtgcctttataacatgctcagttttaaatttgtctattggcctttatcttactgatgtatagttgctcttwatatatttagaaaaacattccttggctgttcttgcttgtttatatttccatgtgtattatagaaacagcttttctagttactaaccccattcatctaaaa

SEQ ID NO: 16488 - DNA, 201 bp, Homo sapiens
ttagatagttccatatctgtatatagtcatattatttttggtgactacatagtattttattgtctggagagatcataatttatttaaccagaaacctactsatgaacatttgagtaatttctgatcttttgctcttacaagcaatactacaataaatatacttgctcaacagtcattttacaacccctgaatgtaggactt

SEQ ID NO: 16489 - DNA, 201 bp, Homo sapiens
tcggctattcataatagccatcttttggctatggtggataaagttgctgtgaacaaatatctctgtatacaaatatctgtgggaatctccgctttcagtayttttgtgtgtatactttttttgtgtatatacttttgtgtatgtacttttgcgtaggattgctggatcaaatgataggtctatgttgacatttttgaggaa

SEQ ID NO: 16490 - DNA, 201 bp, Homo sapiens
tagcagtgctttttagtttgttctagtcagcacttgctgtgcattttgttggaccactgggaaataaatacaacaagattatacatttggaataccacaasagttcacaaaaaaaaccacaaatgataaattatacacttggtagaaagtgacatgctatcttgtgctattaacaaccaaagataattgcaacgaattgta

SEQ ID NO: 16491 - DNA, 201 bp, Homo sapiens
caccttcacaaaataccattccatacgtatatttgctacatataggaactacaagaaagggaagttttaccaatggattcttgagggtgaggagaattaayatctggtccattggttatcagagccctgtagtaatcagtcttactttggtggaggccagctttacttttagagcctggccagtagttttttatagattaa

SEQ ID NO: 16492 - DNA, 201 bp, Homo sapiens
tccagtttagcaaattctggtattttcaagtgtaacagtatattatgtatgaataagaagtgcctgtagaatgtcatcagacatcgatagcaactatctartgctggtgctgccactcactaacccttgtagtgcccatgacagacatcagtaattgatcataacactctttcctgctgagctaggagaaagtttcagatt

SEQ ID NO: 16493 - DNA, 201 bp, Homo sapiens
gggggtgatgggaaacatccttggcttttttcctcattttagggtaaaatcattcactcttttaccactaggtagggtttcattgattcctttattaagaygaagaaattccgtagtttaccgagtgtgtttatcagggtcattgttgggtattgtctaatgctcttacatctattcaggtgaccctctagtttttctttc

SEQ ID NO: 16494 - DNA, 201 bp, Homo sapiens; identical to SEQ ID NO: 1882

SEQ ID NO: 16495 - DNA, 201 bp, Homo sapiens
ccaccatggagaaataattcacagacccactcgctgcctccccaaaagacctttctcctgggaaagaactttataaatcactttaagttagcaaccgtaaytcccagacgcttacatgagacccactgaaaaaggacgttaacttggaaccagttaaattgcttctagtctttatttgctggcctcctgtacatctctctc

SEQ ID NO: 16496 - DNA, 201 bp, Homo sapiens
tggctgtgacatttaacccttcccaagacaaattttctatagttatccattttttccagccttcctttagattttggaaaaacactttgtcttctgcattrggcctgtagggtctcttgatttattagcatggtttacctgtacgtttttagatttttattttttagtttattatgagtacattccattatctagatcttt

SEQ ID NO: 16497 - DNA, 201 bp, Homo sapiens
tatccttgtctaaaaattttgtgtgaatctttatcacctaaggatagattcctagaaattgaattaccgagccaaggattcacacatttttaaggctctamcacatactgcaaaatgttcttccaaaaagtgcaacaagttatataggctccccaagtagccagtgagcatacctgtttttctgtagctttaaccagaact

SEQ ID NO: 16498 - DNA, 201 bp, Homo sapiens
tcaatacttctgtgaaatttgacgttatgaagatatccccaaactcttctccaaaaaaaaaagcagaaatttacttatatctaagtttacttttcctaagycaagtgattcagaaacttttaggaaataattttgaggctaaatatttctgggtttgcttttttaattaacatgttttaaattagcatgtaatctgtcttc

SEQ ID NO: 16499 - DNA, 201 bp, Homo sapiens
tttggaatgtcctgcatatttaaatttgacaagaatagctgactagtcaatggacaggatccattttagtccaaatggaaatccatgaaaaagatggaacrgagtgaaaagggcagccagccagatgtccaggggtctgacccgccctggctcacttgcacaccgttccatcaaaccttgagtaaggcagccctcactcaa

SEQ ID NO: 16500 - DNA, 201 bp, Homo sapiens
ccactcgctataacagattatttggagcaaaatatggtgagactatgaaaaacagtgcaatggagtgtcctcttccatgaggttagattttaaatgtagcrcttaaggtaggcatcatggaggtgagaattatacatggaaatcccttcaatttgtacatcaggtactggcagggatttagataccatgttaatatgaaaa

SEQ ID NO: 16501 - DNA, 201 bp, Homo sapiens
acagatctaagtaatgatggccagaaagtcacagttttgcccaagatcctagggtaaagtagtggcagaactgggtctttaactctcagaccagtgctctycctactataccatctggcttgttaggttgttagcttgctctttttttgttttttttttgttgttgttgttgtgttgtttttggtgacagggtctggctct

SEQ ID NO: 16502 - DNA, 201 bp, Homo sapiens
tctcgcccgagctaacctatcagctagcgcggcagaaaacgcataatggagcctccgtaaagtattctgtgccaactcccaggtggtctcagctgcagaastgttcttccaaaaagtgtaaattctaacttagcagtctgctgagaagcccagctccctggcaggccgggcacggggcaggaggtcacagcagctaatcaa

SEQ ID NO: 16503 - DNA, 201 bp, Homo sapiens
aacccaagggcttgatttcccttggcactaaatgttatgttttgggtgtcttatagtctgtcctgtgagttaacattgtacaataaactgttttatcaggmcttgctgatcatcctgcctgctagttctaccctcgaaaactgttttttttaatgcttatttcaatacttctgtgaaatttgacgttatgaagatatcccc

SEQ ID NO: 16504 - DNA, 201 bp, Homo sapiens
aacttcatgttttgcaatattccttaacattgacagttacaaagaattattctggttggagtttaaagagagaaggaccttattaggctgtagttgggtaktctgggatatgcgaaatcaagtgagttaaaacactaggcacatagtaggttctcaatcaataaaccaataattgttgatccaccaaaaattcacctttct

SEQ ID NO: 16505 - DNA, 201 bp, Homo sapiens
agactctgaaatctaggtgcaaggcatggttcaaaggctgactgttcgtgttcctttccccaggctgtagttttgtgccccgccccatcctcacactgtcmcccatcctatcagcctcctcactaggatggctaactaggaagtaccacagggggcttccgttttggaaggagcttccctctgactcggtcagaaagaagg

SEQ ID NO: 16506 - DNA, 201 bp, Homo sapiens
ccggacaaggtatccacatctatttttcattgttgttttgagttgctgtttagtaattaaaatttttgatcatagactaattttcccataccatgtggccrtgcgattgacaagggactgattaatgggctgaccccagggccaggaggctgctgggctcttctcttgtggaaggcatgccggcaaaataaagttgatggt

SEQ ID NO: 16507 - DNA, 201 bp, Homo sapiens
cacgaggactaactccacaattatgaaaatctcaaaaacaaagctactctgaagtctctatatagctttgcccttcatatgattccaaattcccatgccartgaagctgcagttccggggaaaatcccgtgaaaggaaagtcttctttggctagctattcagaccaggccagggagggcttagcagtgtgccctacaccca

SEQ ID NO: 16508 - DNA, 201 bp, Homo sapiens
atcaacacttggtattaccccagcctccttggagtcctcgtccccatctccctctgacctgagtaactttgaggaactttagtatatttggaacccgtatsccagcagcactgttggaagctatcaggaggacacctggtaactaactaacttactagctaacttactaacttatacagctcaactaacttatacagcaga

SEQ ID NO: 16509 - DNA, 201 bp, Homo sapiens
ctggaaaggcttgttcttcctggctggaaatctgcttttcgtcaatgaaagaaattccaagggaattgtttgaaaaaacaagcacaaggctggaactgctstttcccacttgggcttgagatccgaacagcgctacgttttacagttttgaaatctgttactgttattatgcagaatagatcatctttgttgtaattatcc

SEQ ID NO: 16510 - DNA, 201 bp, Homo sapiens
tcacttactaaatcagatcggctcatttgtatttcactcccagccatactgggacgctagtttcagtgtaatggcaattatctatggcatgtactttatgsaggtattttgtttggtctattgcggcagcaaagcaccactcccttgctgctattcatatttactttctattcatcattatctgccattttgctaaataac

SEQ ID NO: 16511 - DNA, 201 bp, Homo sapiens
atcacttactaaatcagatcggctcatttgtatttcactcccagccatactgggacgctagtttcagtgtaatggcaattatctatggcatgtactttatkgaggtattttgtttggtctattgcggcagcaaagcaccactcccttgctgctattcatatttactttctattcatcattatctgccattttgctaaataa

SEQ ID NO: 16512 - DNA, 201 bp, Homo sapiens
ataaacaagggcatttttgaaatgtaaatttgtcatttttcgtaagcaacttaaatcaactccacctgccttgagactggtttctccttcagcacaaagcmacgtgctcctaggttctcttttggctcctgcagctccgattccccgtgcacttagatcctggtgtcggttttttttttccttgaacactttctgcagttt

SEQ ID NO: 16513 - DNA, 201 bp, Homo sapiens
cctgttagacaatattattatcctcgtttaggtgaggaaactaaggctcggagtattggaaatttccagtacttgtattggaaagtatgatattggacaartattttcaatacgtgtgttgaagatattggaaatacttgtccaatatcatccttcatctctctgaactaaaaatgagttttttatttctagtaatctgtc

SEQ ID NO: 16514 - DNA, 201 bp, Homo sapiens
gcaagggaataatacagaaaccagtaataaattataacttcaggctgcagttggtaagctggaggaattgctatttaagtggaaagtgcttgaacagccaratgagcacctgtcatgtttattttcactttgaaaagtagaaacatgacagtatagtttccactgcctatccaatatgaacttctggcattcttgttatct

SEQ ID NO: 16515 - DNA, 201 bp, Homo sapiens
atacactgtttctacacttgcagaagatgaaaacgccaaacccttggattgccttttcccttcctaagtattaatatcaaaacttaaacaggttcctttcyccttctttcaactcctctaaattaaaacaacctacaaaaagatcatgcagtaatttatttaaaaactaaagacatgagagagatctcagtaagagagata

SEQ ID NO: 16516 - DNA, 201 bp, Homo sapiens
agcatcaactgaagatggtgtccctactgcagtcaaacagaaatgctgagtaatgactggtttaataatgatcagatagacgagaaaaggccttgactaastcagtgatattgggatatgattattttaattattttaatattgattcttttggtgtcttttggattgtttagctgtcgctttttctcttggcttttgagg

SEQ ID NO: 16517 - DNA, 201 bp, Homo sapiens
agcaaaagcaacgggacaaacattgaaggcacaatactgcactgtagaggcctcccatctctgcagccccagcttggatcacaagggaagttactgcacakccaagtatgctgcatttgcaaaggtcaggctttaattacatgcacagttaaatggaaatactgtagagaggtcacactcatatttctttggctttcatta

SEQ ID NO: 16518 - DNA, 201 bp, Homo sapiens
gatcctggcactgcccaccatttgctgactcatgtcccaggcatttgcaaagtgtatgggctgtcatacagaaatagagtggatgtttggaagaagagtakcaggtgtagctcaggaccagtaggaaaggtgtccctgccagtggggacagagagcaaaagcaacgggacaaacattgaaggcacaatactgcactgtaga

SEQ ID NO: 16519 - DNA, 201 bp, Homo sapiens
cagcgagagaggtgagaagaggaccaggagtaggtggtagaatggagtggaggaaagtcagcgaatgtaatagtgtcgaaccctgcagggaagttaagaartggccataccgttgcattcatcatgggaagaatttcagtagaatggtaaggacaggaggacaaggtgggggaagataggtgaatctatagatgcatttgt

SEQ ID NO: 16520 - DNA, 200 bp, Homo sapiens
tggcccctctgatgccaacaattcctcttaattatgtggaatatcatgagcttctttgggactctgtcaacagtgccattgttggcttacattagaaggacatctatgtccctgcttttatttaaaagaatgcagtgccttccagcccccaccttgcactcttaggcgcttctaggcaaatgtattctgaagcagaacac

SEQ ID NO: 16521 - DNA, 201 bp, Homo sapiens; identical to SEQ ID NO: 1883

SEQ ID NO: 16522 - DNA, 201 bp, Homo sapiens
gaggtggcccagactgtcccatgcttgagcatttaccagacgtgactttgggtccctgtggctgtctcagcttgacagatgagaaaatgctgttgctaagkgcccttcccaaggtcaccccacaagcaaacattggtgctgggagaatgagatcacccccagacagtgaaggaatgacagacccacgctttcaaagccccg

SEQ ID NO: 16523 - DNA, 201 bp, Homo sapiens
gttttccccggaatttttctgataccaataggggtccccatctgcaaatcaaatgaatccaagttatgagagcaaaatactactgctgaactgctgatgtyggtggcaccaggcaagggacaagcggaagcaggggggcccttatttatcttttatgctggaaaggcttgttcttcctggctggaaatctgcttttcgtca

SEQ ID NO: 16524 - DNA, 201 bp, Homo sapiens
aggctgtgcttactttccgttttccccggaatttttctgataccaataggggtccccatctgcaaatcaaatgaatccaagttatgagagcaaaatactaytgctgaactgctgatgttggtggcaccaggcaagggacaagcggaagcaggggggcccttatttatcttttatgctggaaaggcttgttcttcctggctg

SEQ ID NO: 16525 - DNA, 201 bp, Homo sapiens
cttcatggaaggccccagcagggaagctgtaatcatgtgctcagtgaaggcaaaagtcgttttgatatctttttagtaaatcattccaccaacgctgtgcragccataaatgtggcacagattaattgagcaaaaaaagtgacttgcatacagttggcacttctgttcttattaggatcagaaagaacaattgggtgaaga

SEQ ID NO: 16526 - DNA, 201 bp, Homo sapiens
gtatgaatgaaccttgaaaatattatgctacgtgaaataagccaaacacaaaggacaaatattgtatgatttaacttacatagaatatctagaataggcaratccatggagacaaagtagatgataggttaccaggggctgggagaagggaaatggggagtttgttgcctaacacgtacagcatttctgtttggtgtaatg

SEQ ID NO: 16527 - DNA, 201 bp, Homo sapiens
atgaagctgtccatttaaactgctctagtctttagaagtgtgatgtctttcgtttttatttgcgagcgttacaagcccttctggccagcgttgcatgatcrctagattgatcagcgaggttttaaaaataggacttgtatcacataagaagagggatactgaggcataattatacatttatatggtagtttacatatttta

SEQ ID NO: 16528 - DNA, 201 bp, Homo sapiens
ggaggtgagaattatacatggaaatcccttcaatttgtacatcaggtactggcagggatttagataccatgttaatatgaaaaatacttatctttacaccytggaatcactctgtatggcaagacatttgccacacaaatacacattagagtgaaatgaaccctcaagatactgaattgaacagaggacattagggtccca

SEQ ID NO: 16529 - DNA, 201 bp, Homo sapiens
ccatgaactgctagcattagagaaattaactccattacactaaccataaaattgaggctgaaatttgattactaatagatcctcaattcaactagaaactktagaaacggggtggtgccagtggggaggaaggtgaacgcgtgtgaaatgccagcatccacattttcatcagtgtgtgtgttcaccacacttccaatttat

SEQ ID NO: 16530 - DNA, 201 bp, Homo sapiens
agcctggccaacatggtgataccccacctctactaaaaaaaaaaaaaaaaaaaaaaaattagccaggtgtggtggcgtgcacctgtaatcccagctactcsggaggctgaggcatgataatcacttgaacctgggaggcagaggttgcagcgagtcaagattgcaccactgcactccagcctgggcaacagagtgagactc

SEQ ID NO: 16531 - DNA, 201 bp, Homo sapiens
atcaaaaccacgacgggataacatttcacactcactaggatagctagaataaaaaagacagtgacaagtgttggtgaggacatgcaggaagtggcacccaygtgcactgccagagggaatggacagtggtgcagccactttgggaaacagtctggcacatcttcagaaggttaaatccaaaggtaccctatgacacagcaa

SEQ ID NO: 16532 - DNA, 201 bp, Homo sapiens
gtttaagatttttatgttcttgatgatttgactcctttatcattatgaaatgactttttctcttgtaatattttttgttctgaattccattttgtctgatmtcaatatagccacttcaactttcttttaattagtattactgggtaaatttttttccaactttttacttctttacaaatctttttttattgcagtagaatg

SEQ ID NO: 16533 - DNA, 201 bp, Homo sapiens
ccaacctgtctattgattttttttttttttttgagatggagttttgctcttgtcacccaggctggtgtgcaatggcacaatctcagttcactgcaacctcygcctcccaggttcaagtgattcttctgccacagcctcctgagtagctgggattacaggcgcgggccaccatgcccagcaaatttttgtatttttagtaga

SEQ ID NO: 16534 - DNA, 201 bp, Homo sapiens
gggagccactgaggagtagaagaagggaagcaacaccagaaacaggagagctcacagaggtgaccaaagtaatccagactagggatatgatggtccagatyagaagaggcagagcaggggagaaatgtgtaaatacagtcctgtaactttttaccaacaaagagagtggcagtgtttcagcaccagtgagaaaggataacc

SEQ ID NO: 16535 - DNA, 201 bp, Homo sapiens
attttaggtaggagagccaggcaaggccttgttaaaggggtaacatttaagcagattggacggagagaatgagccactgagaaatttgaagcgggagcacrtaggcgggaagatagaacatgattgggatgtttcagaagcaacaagtgtggatggaatagagtgagagaagaggaaatgaaatgaagacaaagggacaag

SEQ ID NO: 16536 - DNA, 201 bp, Homo sapiens
gtgatgtttaatgttatcttagcgtcccagcatccctgtctaaaatctcaaagcttatttgacctagcttttttttattgtatcatgctatgccttgtcastgatttttgaaatcacttatactgctcagtaaaacttgtttggtcttataagtcacatttttgggggtgaccatccagttatttattcatctaacaataa

SEQ ID NO: 16537 - DNA, 201 bp, Homo sapiens
tgtagccgtctcagggattttattttattattttacttttttaattttttgagacagagtgttgctctatctcccaggccggagtgcagtggcacgatctyggctcactgcaacctccgcctcctgggttcaagtgattctcctgcctcagcttcccgagtagctgggattacaggcatgcaccactactcccagctaatt

SEQ ID NO: 16538 - DNA, 201 bp, Homo sapiens
ggctatgtgcattatgagcaggtatttcttatcccagcagtgtagccgtctcagggattttattttattattttacttttttaattttttgagacagagtrttgctctatctcccaggccggagtgcagtggcacgatctcggctcactgcaacctccgcctcctgggttcaagtgattctcctgcctcagcttcccgagt

SEQ ID NO: 16539 - DNA, 201 bp, Homo sapiens
gcagccctaacctacattaatcattccatgtatttctgtattagggaagggaattgaccaatattactctcctccagtgacaccagtagaattattagaaytttgtagaattacaatgtaataatacctcattcatccatgcacgaatccatttattcattcctttaccatttactgagtaaattctgggcactcatatta

SEQ ID NO: 16540 - DNA, 201 bp, Homo sapiens
ctttaagacagcctaaaactagggaggaacaaatcagatcaaacgttacagaggtaaatgtaaaatcctgtgatttggttacaaataaatcagttgcattwtacagaatcaggaaactccagtctgacaccgattcacatgccaagtcctaaggaaagtggtagccgaaaagctaatgcagccctaacctacattaatcat

SEQ ID NO: 16541 - DNA, 201 bp, Homo sapiens
taggccactgtctcttatctccattcccatttgatctgcaccatctttcctcttcactgtcagtcctcttataggtctgtctagttttcctctttgccccmcttcatccttgaagctatagtattttctaaccaagatgtaaatctgagcatggcaaccctctgcttcaaatcccacatcattgactggctcctacatttt

SEQ ID NO: 16542 - DNA, 201 bp, Homo sapiens
actatgtgagttagacatgggtggctctcccaaaggaaaatcagagtcctgtttccaaagaaggaagagtaggccctctgggcatgtaaaaataataaatkttcacctcttttttcctactacaatgtgaagtcttgaagcagagggttgccgtgaaaatcagaataggaattaggtcacagcatctttgtatctctagca

SEQ ID NO: 16543 - DNA, 201 bp, Homo sapiens
agacatgtgccaccatgcccagctaattttgaatttttagtagagatggggttttgcaatgtcggccaggctaatctggaactcctgacctcaggtgatckgcccgcattggcctcccaaagtgccgggactgtaggagcgagccactgctcctggcctagtttttaattaaaacaagtgaacaaacaaaggtgggcatag

SEQ ID NO: 16544 - DNA, 201 bp, Homo sapiens
agcatctttcatatccttaaagattctatgtacttttcagcacattgttctgtttcaaggggctctgcaaagtatacttgctgtctgtacatttccactgygaaaactccttgaaatcatgtagacaaatgaaagctaaacatcaaataaataacctaaactggtaatactcccatttggctctccttgtgtcttttcatg

SEQ ID NO: 16545 - DNA, 201 bp, Homo sapiens
atcactttaaactcggtatttgatttccttttccctgggacctgtgacagtgccagcttcatagcctagtctaggcatgccagttgcccactgtggcaatmaatatctgagcctgtggtttttgccttaggtaaactgtagagatggactcatggaatgcttggaaaatttttcagtttatgataatgtgtaaatgtcgag

SEQ ID NO: 16546 - DNA, 201 bp, Homo sapiens
attatccctatttttccaattgagtaatcagggttcagagaggtaaagtaacttacccaaggctacgcagctactaaatgctagtagttcctggtatttgkactgaatgctgattacaaagaccatgttctttctgttatgccacaatacataagtggatctttatttcagattctgtcatttatagcagatgattttcag

SEQ ID NO: 16547 - DNA, 201 bp, Homo sapiens
agcaactagcttagtgggccctcagtagatgtgttaatgacattgacttccttatttcttatatggccccacctttcctagtcacgtgtcttggtactatrtgagatttcagatccacctgcctacctgtaactcttgattccttttcatttccattgctgtctccttgttcaggtccagctcctgtctgcctgggctttt

SEQ ID NO: 16548 - DNA, 201 bp, Homo sapiens
gagattataatacgcacccttgtgtgtctcctccaccaggtaaaagtgaaacaataacttctcaatatacctttgcttatattcaaagctccaggtaaatrtaagatgttgctataattacctaagaaagctaggaagatttttctttgttgattccaaggtgagttgtagaaattccagaagatggattaatgtagtctg

SEQ ID NO: 16549 - DNA, 201 bp, Homo sapiens
attacaacaaaaacaacttctttggctttctttctgatctttttccctgaatcgtttctgacctcttcccctactcttcttctctttctttttaacccacycagactggcccctattttgttcctctaacagggcaagtgcttcctgccatgggcctttgtattttctcttctctctttttgtagaactttcttcccccag

SEQ ID NO: 16550 - DNA, 201 bp, Homo sapiens
cagcaaattctgttgcatctgtcttcagaatatattcagaatccaaccacttcttacaacgtctccttctgccatccttctccaagccactagcatcactstcctggatcatcgcaatttcttcctatctagtctccttgcttctttccttgcctttccctacatagcaatcaaagtttagtcttcaaaacacaacaaaac

SEQ ID NO: 16551 - DNA, 201 bp, Homo sapiens
agagggaactaatatttatagttactcctatagtcatctccatctcagtacaggacatcttcatccttccagttgttcagaccaaaaaccctggaaacatmcttgacttcgtctttcccattccacatttcacccatcagcaaattctgttgcatctgtcttcagaatatattcagaatccaaccacttcttacaacgtct

SEQ ID NO: 16552 - DNA, 201 bp, Homo sapiens
ctattttttgctctcttacacactttgctgttgtcctgccaattggaatttgatttgttaattacaaaagcaaactatccaggatggctctaaagggactycgctataggttggggctatgatagagactttcgcgaaagggattggcaattaagaaatatagcaactgcttctgatgattaaacatttcaagcaactctg

SEQ ID NO: 16553 - DNA, 201 bp, Homo sapiens
ccaagtactatccagtgattgctgagaaattataattagtcataaatgagtttctcaaggccaaataaattcaaacgaaaaatcttctcaaattattttgyattgcagagaaaccttttaatgtgaaatatgaatacaatttaatatgtttattttgatgttgagtgaggccttcaaaagtagcaggatcatggcctacag

SEQ ID NO: 16554 - DNA, 201 bp, Homo sapiens
gtaggggatggaatagatatttcttacccgagtagaagatgatgccgggggatctaatgcttcttttaaatttcccttttgatgcacaaaggggcaactcygtgtagcaggaccttggtgggatggataggcagctttgtaagtggagaaatggcctctgtttagcttatgagcacagagtcattttgggggtggtttatg

SEQ ID NO: 16555 - DNA, 201 bp, Homo sapiens
ttgagtaccctggatgtttgctatgtattatgctaaactaacgcatgattacattgaccctatgattatagtgacctaaattggcaagtttctgtcacttrtaaagtcaaggtagtaatgttggaagggaaactgtagtgagactctcctttgcaactgtaatgttttgtctgtagattgcaaatgagggaattttataaa

SEQ ID NO: 16556 - DNA, 201 bp, Homo sapiens
tctttccttaccgactttatttcctgtgtcaaaaagtatgatactaacggtaagtttgtgtatggtacatttactggtgtatggtaccgtatgtggttgaygttaggtcatattaaattttacattttgagattgcttatacatagtagtgttttatacacagtaattctcttttccctatggggattataagatccctct

SEQ ID NO: 16557 - DNA, 201 bp, Homo sapiens
catctctttccttaccgactttatttcctgtgtcaaaaagtatgatactaacggtaagtttgtgtatggtacatttactggtgtatggtaccgtatgtggytgacgttaggtcatattaaattttacattttgagattgcttatacatagtagtgttttatacacagtaattctcttttccctatggggattataagatcc

SEQ ID NO: 16558 - DNA, 201 bp, Homo sapiens
gagaaataaaaactattttaatgattgtatgatccaccagactgtgaggtcttttcttcagtccctcctctttcatgaagcgtttgaggattattccattyatctctttccttaccgactttatttcctgtgtcaaaaagtatgatactaacggtaagtttgtgtatggtacatttactggtgtatggtaccgtatgtggt

SEQ ID NO: 16559 - DNA, 201 bp, Homo sapiens
attattatatttggttgaatttcctcccaccatttatattggccaaatatagttcttttgtgatttgtttattcatataggctttgttcattttgctaacrtgttcgtcttttcttactgatttggaaaaatattttgtagattagggatgttatttactaatcatgtgatagaaatatttttccagtttgtttattgcct

SEQ ID NO: 16560 - DNA, 201 bp, Homo sapiens
gcagaattctgacatccactttgagacttgtttctgaatgactcgtagctgtttgaaagaaatctcttccttcctcactggagacatgtttaccaccctarggggatagtcaaaggaaagttttccaaaaatgttttgatcaatgatcacatctttggatatgtatagagtttcccaaggaggctacttgaaaggagatag

SEQ ID NO: 16561 - DNA, 201 bp, Homo sapiens
cactttattaccagaggggcaattttctcttcatatgtaatagcagcggtgcctcatattgatcagaccatcaagatactaatcctctgtaaaattacttkttataactgaaaatgtgttaatccaaatcagtctgtgtcctgactgtctacttactattgaatacggactattagatgctttatttttcatgatttaaag

SEQ ID NO: 16562 - DNA, 201 bp, Homo sapiens
tcatggtgttgtgcatgatgtctttctcatctttcaggtttatttttaaagtatttcatttattctgtgaagatttgttgagcacctattatttgccatamgttgggattataattttggctgaaatagaatcactgcaccaaagaagctcttactctattgaaaccataaccattgcctgtgagggagttactagtgtca

SEQ ID NO: 16563 - DNA, 201 bp, Homo sapiens
aacagagattttaaaaagcatttattgtgggtcaggcactgtattaagtgcataatatttaaattatttcatatcattgtcacagcagattgcaagatagrtattatacagatggagtataaataacagcccagcttcacagatgaagaactgaggctcagaagcattgagtgttttcctttctctcattcccaaactcag

SEQ ID NO: 16564 - DNA, 201 bp, Homo sapiens
ataaaattgtgaccaaaggagataaacatttaaaggataaatgacaggcctgttaatctgaaagcaagttttgtagcgttgttgtttttagctaataggtrtatagccaggagtcacggtgatgacttttaaatctgaaactgagtgaagtctgtgttttcaaccagtttaaaaaatgttgccactggacctttttaaaaa

SEQ ID NO: 16565 - DNA, 201 bp, Homo sapiens
ccaaatatggtatagccatccagtcacgtaagtagggtcaaaggggatttgaatataaatcaatttcattttgaggaaatcttaattcaaaagggtagtgytcaaatattatctttaaaattaaaaaagttgactcctagactatatctcagcaatcaatcttgcatatctttttgcatacttcttttcaatccatatgga

SEQ ID NO: 16566 - DNA, 201 bp, Homo sapiens
gtggaattgctgggtcatatggtaagtctatgtttggcagtttttgaggaactgccaaactgttttccagagtgacattcccactagaaatgtattagagwtccattttctctacacccttgccaacacttgttattgtctatataacaccatgtcacattcccactggcagtgtattagagttccagtttctctacatct

SEQ ID NO: 16567 - DNA, 201 bp, Homo sapiens
gtctggctatgttgcctaggctgttcttgaactcctggtgtcaggcagtcctccctcctcggcctcccaaagtgcacggattacaggcaatactttatttrtttttatggctgaataatattccattatatggacacatcccacgttatctcattcattagttgatggacattgggttgtttccactttttggctattatg

SEQ ID NO: 16568 - DNA, 201 bp, Homo sapiens
ttctaggttattgctagacacaggagatactgcagtgaataagatggacagtctctgaactcatagggttgatagtctagtaggactgagagattaggaartagtttcagtagatatggggaaggcacagtttgctgtgcggtgaatgcaaatcagctaacatggactcggagagtcagggagggcctcttggaggaggct

SEQ ID NO: 16569 - DNA, 201 bp, Homo sapiens
caaaagcagtcctcatattaaaatcaccctttatatcaatacttcattttatgtaacatagtgttttaaaattatatttaaaaggcagcttcttttgtctwatgtgcccttggctaggaaacaaaggaagtctcttttaagaggtgttttacattttatgactactgagagagaacatagttctttaataggtagatatct

SEQ ID NO: 16570 - DNA, 201 bp, Homo sapiens
catggcactgtgcccatcaacacttggtattaccccagcctccttggagtcctcgtccccatctccctctgacctgagtaactttgaggaactttagtatrtttggaacccgtatgccagcagcactgttggaagctatcaggaggacacctggtaactaactaacttactagctaacttactaacttatacagctcaact

SEQ ID NO: 16571 - DNA, 201 bp, Homo sapiens
gggaaaatcccgtgaaaggaaagtcttctttggctagctattcagaccaggccagggagggcttagcagtgtgccctacacccagcgcatgtgctcaccarcccattggtattgaaggtgctaacagtctggactcagatcctggcactgcccaccatttgctgactcatgtcccaggcatttgcaaagtgtatgggctgt

SEQ ID NO: 16572 - DNA, 201 bp, Homo sapiens
ttctgttatctcttcagtggcccatgcttggtaatatttctccatcaagttctagtctgtgtgtgtgtgtgtgtgtgtgtgtgtgtgtgtgtgtgtgtgtrtgttacatttgcttattctgatgaatctttcagcagaaaccatttctcctgaaatctttatcatttcatcaagagtaatggaaatgttacctgtccttta

SEQ ID NO: 16573 - DNA, 201 bp, Homo sapiens
tgtatgtaatttcaaaaatatttttaaatataaacggtagcctactatatatatggttctgtagttttgtttcagtaaactttggtaataattactcatcmatatatagcacttagcgaggagtaggtaatggctttttagatatgacatcaaaagcataaacaactgaagaaaaaaacagataaattggccttcatcaaa

SEQ ID NO: 16574 - DNA, 201 bp, Homo sapiens
agacctgggaccgtgttttctgggctgctgtgttatacaaatcctccactgcctcatttgcttaggcaaatgtagatttaattattcctaattatcaagtyagattcttcttggtaaggtgatgggtatagccaggattttgtcagtacaacctcagtttagttcaataagcatttattgagtattttctcctcatagggc

SEQ ID NO: 16575 - DNA, 201 bp, Homo sapiens
gtagatttaattattcctaattatcaagttagattcttcttggtaaggtgatgggtatagccaggattttgtcagtacaacctcagtttagttcaataagmatttattgagtattttctcctcatagggcatgtgctggacatatactatgaagtggtgataagaggataacaattcgaaaataatatttaacattcattt

SEQ ID NO: 16576 - DNA, 201 bp, Homo sapiens; identical to SEQ ID NO: 1878

SEQ ID NO: 16577 - DNA, 201 bp, Homo sapiens
ggctaatatggcttccagtctgtaggcagctgttttttcctggtcacctgctaatgtcctcgtctgctttagtgatatcagcacagttatgaactttagcrttggtgattcggcatgtggactagaacttggagctgtgttcacaaaaagtggagctcctcaccttgaggatgggctgtgggataatgagactgatgcagt

SEQ ID NO: 16578 - DNA, 201 bp, Homo sapiens
atgaggtttggtcctggacagtagcacagggatcctggtggaggcagctgcagaaacactatggagggaaaggtgagcacaggtggagagaaaggggagtragagaagcaaagaagaaaagcctttcacttagaattagccttcaaaatgcaataccaaaatactggaagaaaataaataccaagaaagatagctaacaaa

SEQ ID NO: 16579 - DNA, 201 bp, Homo sapiens
aaaaatttatcccagatgagatgaatttttacagaaaagtcagtcaaaaattaaaagaatcatgttcagaatactcaaggggataaataaaggcattacaytgatgaaaaatgatgtttaaaaatactcccaagatatgcagaaatggaagaggaacaacgacatgaaaaagaaccagttacaaattttggaaatgaaaaa

SEQ ID NO: 16580 - DNA, 201 bp, Homo sapiens
tttgatatttttagtagagacgaggtttcaccacgttggccaggctggtctcgaactcctgacctcaagtgatctgcccgcctcagcctcctgaagtgctrggattacagtcatgagccactgtgcctggcaagactttcaagaattgtgaaagatctgagattctaccctacttgcaagctaacaagttaatctgccaca

SEQ ID NO: 16581 - DNA, 201 bp, Homo sapiens
gtcttataagtcacatttttgggggtgaccatccagttatttattcatctaacaataaggtctcccatgaagagccaagaaggctcacaagaagaccaaaggggggggaaaaaacttatttgatctacaaagttacatttttttcatgcctatgcaattattttttcatttaacaataagcatctactatttgctagtcag

SEQ ID NO: 16582 - DNA, 201 bp, Homo sapiens
ttcctctagttttcttgtttattcccttattttcaatctttatgtttgttttttagtctaatatctgggagattttattaacttccaacctgtctattgattttttttttttttttgagatggagttttgctcttgtcacccaggctggtgtgcaatggcacaatctcagttcactgcaacctctgcctcccaggttcaag

SEQ ID NO: 16583 - DNA, 201 bp, Homo sapiens
cacttattagactgtccacacgcagtggcattaaaacttcataaaaactgttccttacagtttgaaaattatttttttcaagtcattataattggttttctttttatttatttatttatttatttatttatttatttatttatttattttaaggtgcagtgtcactatgtcaccaggctggagtgcagtggcgcgatctcg

SEQ ID NO: 16584 - DNA, 201 bp, Homo sapiens
attagactgtccacacgcagtggcattaaaacttcataaaaactgttccttacagtttgaaaattatttttttcaagtcattataattggttttctttttatttatttatttatttatttatttatttatttatttatttattttaaggtgcagtgtcactatgtcaccaggctggagtgcagtggcgcgatctcggctca

SEQ ID NO: 16585 - DNA, 201 bp, Homo sapiens
cggtagagtacgacattcagaatttagggattctgtgtgtgccatctgggatgcatgtattttttaaattgtttatgtgatatatacatgatacagcccagggaaaacatgctttattgtgcattttgaaagctttgcatctttttgtcttcctgcattacttctcattttaccctctgccagtctaaacactgttgtctt

SEQ ID NO: 16586 - DNA, 201 bp, Homo sapiens
ttttaaggctatgaaaatgctctaaaattagtttgtggtgatggttgcacatctctgaacgtactaaaatacattgaattatatactttcttttttcttckttttgcagcttttgctcaaaggagaattagatatttaaaatgagtgaattgtatggtacatgaattagatctcaataaaactattttaaaaaaagaaact

SEQ ID NO: 16587 - DNA, 201 bp, Homo sapiens
tcttgaggtcaggagtttgagaccagcctggccaacatggtgataccccacctctactaaaaaaaaaaaaaaaaaaaaaaaattagccaggtgtggtggcrtgcacctgtaatcccagctactcgggaggctgaggcatgataatcacttgaacctgggaggcagaggttgcagcgagtcaagattgcaccactgcactcc

SEQ ID NO: 16588 - DNA, 201 bp, Homo sapiens
tgaggcatgataatcacttgaacctgggaggcagaggttgcagcgagtcaagattgcaccactgcactccagcctgggcaacagagtgagactccgtctcaaaaaaaaaaaaaggaaaaaaaataattggagaaataatacatgaacacacatgtattctcattcaaactttgtggaactatatgaaataaaatgtagaca

SEQ ID NO: 16589 - DNA, 201 bp, Homo sapiens
ttaggataagggcttctagctgcttatgtcacctacttatgtcacctactactactaagctttttgagaacctggtctctctctctctctctctctctctmtttctatatatatataggaagtcctggattctggggcttcgagggctgacctggagcctgagtccacaagggcatacctggtgctagagtaggcttggag

SEQ ID NO: 16590 - DNA, 201 bp, Homo sapiens
gataagggcttctagctgcttatgtcacctacttatgtcacctactactactaagctttttgagaacctggtctctctctctctctctctctctctctttmtatatatatataggaagtcctggattctggggcttcgagggctgacctggagcctgagtccacaagggcatacctggtgctagagtaggcttggagcctt

SEQ ID NO: 16591 - DNA, 201 bp, Homo sapiens
tgataagaaaacaatgctcaaaatataaaagtatcagggaaaaaagatgcaaaatgtttgtacaacatgatattaattttatataaacaaaggataaacayattactaagtataaaaaaaaactagaaggaattagaccaaataattataaataatattttctcttctttacacttttctatagtttgcaaattctctaca

SEQ ID NO: 16592 - DNA, 201 bp, Homo sapiens
tttgtggggacacagatccaaacaatatcagtaattatatttattaatactgtattacatatgtgaaattagctaagagagtagatcttaaatgtttttaacacacacacacacacacacacacacacacacacacgtttactgtgaggtcatgggtatattaattagattggttttagaagtcatttcacaatgtatatg

SEQ ID NO: 16593 - DNA, 201 bp, Homo sapiens
ttgtggggacacagatccaaacaatatcagtaattatatttattaatactgtattacatatgtgaaattagctaagagagtagatcttaaatgtttttaacacacacacacacacacacacacacacacacacacgtttactgtgaggtcatgggtatattaattagattggttttagaagtcatttcacaatgtatatgt

SEQ ID NO: 16594 - DNA, 201 bp, Homo sapiens
tactattaggtgcatactgttatatcttctgggagaatttaccactttatcattatgtactacccctttttctctgtgataatttatctttgctctgaaabctgtctgaaattaatataggcactccagctttctttagattaatgttagcatagtatatctgtcttctttgtttctttaagtttaatctgtgtgtttctt

SEQ ID NO: 16595 - DNA, 201 bp, Homo sapiens
ccagaggcaaccaatgtttaaaggttcttgttactcttttggtgatatttaatatataagtaaaaatgtatgtaatttcaaaaatatttttaaatataaayggtagcctactatatatatggttctgtagttttgtttcagtaaactttggtaataattactcatcaatatatagcacttagcgaggagtaggtaatggct

SEQ ID NO: 16596 - DNA, 201 bp, Homo sapiens
atatttgtataactctgtgactatacgaaacaacattgcattatatgctttaaatgcttgaattttatgacgtgaattatagctcaataaagctgttaccaaaaaaaaaaaacctatctcaaactaggcctgattatagattatttacataaaacaaaacactatacatccagaaaaaaattattccacatcccacccctc

SEQ ID NO: 16597 - DNA, 201 bp, Homo sapiens
aataaaatagacattctagtacagggagatgatggtaagtaatacacttaacacactggtaaattatacagtatgttagaagttgataagtgctacaggaaaaaaaaaaaaaaacagagcaagatgatagaaattgagagaactagagagcctccctgttgaaaagatgtcctttgagcagagaattgaaggacatgagaa

SEQ ID NO: 16598 - DNA, 201 bp, Homo sapiens
taaacgtggcatttgattaaaatcctgtaatagtttttacccacaacattgaaatgaaaaagtcaggtcatggagttgaatagaaggcatgccagtggacdtgatgtccagagattgtatctcatgggcagtacttcaactcatgaataaaattgtgttgggagaaggtcttcagtgctgttgaacgtttctgactggcat

SEQ ID NO: 16599 - DNA, 201 bp, Homo sapiens
atttctcacaaatgcttatgaataattcagcaaagccaaatgcaatctgctggtggtatctagtgttattcacacttgctaatgaataattccctttggcttttatagggcggctctaaggaatgacttctgagactcagatgagttattattgggctatttgtcagtgtccttggggcattgcgagccaaagcccaactt

SEQ ID NO: 16600 - DNA, 201 bp, Homo sapiens
ctcacaaatgcttatgaataattcagcaaagccaaatgcaatctgctggtggtatctagtgttattcacacttgctaatgaataattccctttggcttttatagggcggctctaaggaatgacttctgagactcagatgagttattattgggctatttgtcagtgtccttggggcattgcgagccaaagcccaacttggct

SEQ ID NO: 16601 - DNA, 201 bp, Homo sapiens
actgagggcacagaggacagtcttgttttatgcctctggcatttatagctgagaagattgagcaatcacaggcaaacaacttatgcaaatatggaaaatcttttttttttttaatgagaggcttaagtaggttattagtttcccagagtaccagtgttgctaaaagttagaatcatagtgttttgtcttatttgtgatcat

SEQ ID NO: 16602 - DNA, 201 bp, Homo sapiens
tatggaagaggagtgcctttcaattgtgccttgaaaggtgaattagattttaacaggcagagatttggtgggtgaaaaagagggacagagagccccgcctyttttttttttttttttttttttttttttgagacagagccttttttttgagacagagtctcactctgtcacccaggctggagtgcagtggtgcaatcatgg

SEQ ID NO: 16603 - DNA, 201 bp, Homo sapiens
tttttttttttttttttttgagacagagccttttttttgagacagagtctcactctgtcacccaggctggagtgcagtggtgcaatcatggctcactgcascctccgcctcccaggttcaagcgattcttctgcctcagcttcccaagtagctgggattacaggtgcccgccaccacgctcggctaatttttgtatttttg

SEQ ID NO: 16604 - DNA, 201 bp, Homo sapiens
gagactttttccaagaaagacaggaaacttaagcataaaattcaaggctccttagagttcttggcttttcttttctaatttgcattcagtctctctctctstctctctctggctgtggattttttgctttggttttatacatgaagttttgagccaggagaaatgaaagactctgggaaattcttaggggtccttaatatg

SEQ ID NO: 16605 - DNA, 201 bp, Homo sapiens
gatcattagcttcactccccagacatgtttcagcatgtcatttggcttcatttattccaaagtatccatcaggagtccacttccgtggcatgttgccataytaggcaccttggagattattaagaaatggtcatggacccttctggtctaatggagcccacactctggaagagaaaaatttaaatgaatatgtaagtgcaa

SEQ ID NO: 16606 - DNA, 201 bp, Homo sapiens
ctctggaagagaaaaatttaaatgaatatgtaagtgcaatggagtacgacatggtggtgcataaagagaatgatcagctccatctaatttggtggaaggaygtagtttgtggaagacttcacagaggaggtgtttttgagatgtttcttgaagagtgagtagttactggaaagttatatggcaaaggtacaaatcgaagta

SEQ ID NO: 16607 - DNA, 201 bp, Homo sapiens
ggagcatgctttagtctcagagccctcagcaagcaacagtatctctctagaatgaaataaatatatagttttgtttatatttacttttatgattatcttcytttttttttttttttttttttttttgagacagagtctcgctcccaggctggagtgaagtggcgcgatcttggctcactgcaagctctgcctcccgggttc

SEQ ID NO: 16608 - DNA, 201 bp, Homo sapiens
tctattcagcccattggtgtttctcatttgacccacatggtatttttttaaaaaattttaatgagtttacaagatttacaaaaatcagtttttacattaaacacacacacacacacacacacacacacacacacacgcacataccagatttcttgtttattttgaaaattcatgaatctagcatcagtgagccagcttttc

SEQ ID NO: 16609 - DNA, 201 bp, Homo sapiens
ctattcagcccattggtgtttctcatttgacccacatggtatttttttaaaaaattttaatgagtttacaagatttacaaaaatcagtttttacattaaacacacacacacacacacacacacacacacacacacgcacataccagatttcttgtttattttgaaaattcatgaatctagcatcagtgagccagcttttct

SEQ ID NO: 16610 - DNA, 201 bp, Homo sapiens
gggcagttgggttgttggacagtaataaattgatggacatttgggtgggttgactttctggctatcatgaataatgctgctgtaaacattcatgtacaagtttttgagtgacatgttttcagttctcttgggtatatacctaggaatggaattgctgggtcatatggtaattctgtgtctaactttttgaagaactgtcag

SEQ ID NO: 16611 - DNA, 201 bp, Homo sapiens
ctattgcaattagaacacatctcaccggtgtatttcccacagacaagcagaaatgctatgaaaggaggcataatacagtcatgaaacatctaaattttccttttttttttttcttcttttttattttttagatggagtttcattctcgttgcccaggctggagtgcaatggcacaatcttggctcactgcaacctccacct

SEQ ID NO: 16612 - DNA, 201 bp, Homo sapiens
cagcaaaaagtttatgagtcattcaccctaacaattgtaatagtttccttgttactccattcctgtagtgatgaaccccccgccctttttttgttttgagmtggagtctccctctgttgcccaggctggagtgcagtggcgtgatctcggctcactgcaacctccgcctcctgggttcaagcgattctcctgcctcagcct

SEQ ID NO: 16613 - DNA, 201 bp, Homo sapiens
ccgcctgccgggttcaagtgattctcatgcctcagcctcccgagtagctgggactacaggactacaggcctgcgccaccacgcccaactaatgtttgtactttttttttttttttttgagacggagtctccctcttttgcccaggctggactgcagtggcactatctcggctcactgcaagctcctcctcctgggttcacg

SEQ ID NO: 16614 - DNA, 201 bp, Homo sapiens
tgaggtgggaggatcacctgagcctagggagttgaggttgcagtgagccgtgatcgcatcactgcattccagcatgggcaacagagagagaccctgtctcaaaaaaaaaaaaaaaacaaaacaaaacaaaatgcaaaaccagaaaaaccagggatgggttttcagtgtgggcatttatttgatccagcccaataaacatga

SEQ ID NO: 16615 - DNA, 201 bp, Homo sapiens
tgcagcctcaaactcctgggctcagaggatcctcctacctgtctcccaggtagcaagtactacaggcatgcaccactatgactggctaatttttaaaaaawttttttttgtagagataggggtctcactgtattgcccaggctagatatttagtattttataatgagaaacagtgaggttagagaagacactattgtttca

SEQ ID NO: 16616 - DNA, 201 bp, Homo sapiens
aatgagacctatttgcaccccctagtatggaaacagcagtctttggatgccaggagtcctaagctttcagtctctaatttgcagtgtgaaacatcaagctrtttcaaaatttaatcttagttttcacagctatacaatgaagagattaaactggataatataatggattttctgattctgtttacatatgctccttcatta

SEQ ID NO: 16617 - DNA, 201 bp, Homo sapiens
gaacccaggaggtgaagtttgcagtgagccaagattgtgccactgcactccagcctgggcgacagagcgagactctgttaaaaaaaaaaacaaaaaacaasacattcttagcttcatttcaatatctccatcctaagccttagagaaaacttcagtcctcacctcaccacattctgttattagaaggcattaagaaggagg

SEQ ID NO: 16618 - DNA, 201 bp, Homo sapiens
gggaaaataattatttgctgagcaattaattcgaattcacaaacacacacacacacacacatcagatatggtaagctcagatctctgcagaagccggcagktaatgtcaacgagtgaagcaggggttggtgtaatacattagggagttgtggggacaagaaagaactagaaagcacacccccggtctaagaggacaaccag

SEQ ID NO: 16619 - DNA, 201 bp, Homo sapiens
taaagcatcaactgaagatggtgtccctactgcagtcaaacagaaatgctgagtaatgactggtttaataatgatcagatagacgagaaaaggccttgactaagtcagtgatattgggatatgattattttaattattttaatattgattcttttggtgtcttttggattgtttagctgtcgctttttctcttggcttttg

SEQ ID NO: 16620 - DNA, 201 bp, Homo sapiens
aaagcatcaactgaagatggtgtccctactgcagtcaaacagaaatgctgagtaatgactggtttaataatgatcagatagacgagaaaaggccttgactaagtcagtgatattgggatatgattattttaattattttaatattgattcttttggtgtcttttggattgtttagctgtcgctttttctcttggcttttga

SEQ ID NO: 16621 - DNA, 201 bp, Homo sapiens
aagcatcaactgaagatggtgtccctactgcagtcaaacagaaatgctgagtaatgactggtttaataatgatcagatagacgagaaaaggccttgactaagtcagtgatattgggatatgattattttaattattttaatattgattcttttggtgtcttttggattgtttagctgtcgctttttctcttggcttttgag

SEQ ID NO: 16622 - DNA, 201 bp, Homo sapiens
gcttgaacccaggaggcggatgttacagtgaaccgagattgcgccactgcactcaagcctgggccacagagaaagactctgtctcaaaaaaaaaaaaaaagaaaagaaaagaaaaatgacagtatggcttccccccattctatgggtttgtgcacacagaaatacacccatcctcccatcataaacactggttcttccaac

SEQ ID NO: 16623 - DNA, 201 bp, Homo sapiens
ttataggtgaagaaattgaagtctagagaggttaagaattttctcaaggtaagatagctagtaaatggtagagctaggggtttaaccttggccatctggcaaccaagacataggtttgaacccattatgcctcatcatacctcataatacctagtattataaggggttttgttgttttttctttgtattggttttgtcatc

SEQ ID NO: 16624 - DNA, 201 bp, Homo sapiens
ttgtattggttttgtcatctgaatcaaacgtctttgacctagaaagaatcttaaaatatgcttctgccgcctccctcttttatcccaattcagaaaaccattttttgggagacctaggtgccataaaaatgaaaagaaatgaggcatggtgctcatggtactcacagttcagttagtgaggggggttggtaagtaaagggg

SEQ ID NO: 16625 - DNA, 201 bp, Homo sapiens
aagccatggagtaattaagaggggaactttcagagatgaccgtgaatatgaaatacagtgatttgtattattaatggatttggggaaaaccagcccacctyttttaagctcaactatgtgtatttggggggttttatatttttaatttatttctttgtttctctcaaggcagtaggggttccatcgcaagctcttaagatc

SEQ ID NO: 16626 - DNA, 201 bp, Homo sapiens
atgaaatacagtgatttgtattattaatggatttggggaaaaccagcccacctcttttaagctcaactatgtgtatttggggggttttatatttttaattwatttctttgtttctctcaaggcagtaggggttccatcgcaagctcttaagatctaccaatcctccttttgtagcctgctgcttctgaatatgagcctttc

SEQ ID NO: 16627 - DNA, 201 bp, Homo sapiens
gaagcaaacacatccttcttcacatggtggcagcaaggagaagtgtcgagcaaaagggggaaaagccccttataaaaccattggatctcaggccgggcacrggggctcacacctgtaatcccagcactttgggaggccgaggcaggcagatcacctgaggtcaggagttcaagaccagcctggccaacatggtgaaacccc

SEQ ID NO: 16628 - DNA, 201 bp, Homo sapiens
acagaggttgcagtgagccgagattgtgccattgcactccaggcaatggagtggagcaagactctatctaaagaaaaaaaagaaagaaagaaggaaagaaagagagagagagagagagaaaagagagagggagagaaagaaggaaggaaggagaaagaaagaaggaaggaaggagagagagagaaagaaagaaagaaagag

SEQ ID NO: 16629 - DNA, 201 bp, Homo sapiens
cagaggttgcagtgagccgagattgtgccattgcactccaggcaatggagtggagcaagactctatctaaagaaaaaaaagaaagaaagaaggaaagaaagagagagagagagagagaaaagagagagggagagaaagaaggaaggaaggagaaagaaagaaggaaggaaggagagagagagaaagaaagaaagaaagaga

SEQ ID NO: 16630 - DNA, 201 bp, Homo sapiens
agaggttgcagtgagccgagattgtgccattgcactccaggcaatggagtggagcaagactctatctaaagaaaaaaaagaaagaaagaaggaaagaaagagagagagagagagagaaaagagagagggagagaaagaaggaaggaaggagaaagaaagaaggaaggaaggagagagagagaaagaaagaaagaaagagaa

SEQ ID NO: 16631 - DNA, 201 bp, Homo sapiens
gaggttgcagtgagccgagattgtgccattgcactccaggcaatggagtggagcaagactctatctaaagaaaaaaaagaaagaaagaaggaaagaaagagagagagagagagagaaaagagagagggagagaaagaaggaaggaaggagaaagaaagaaggaaggaaggagagagagagaaagaaagaaagaaagagaaa

SEQ ID NO: 16632 - DNA, 201 bp, Homo sapiens
gaaaaaaaagaaagaaagaaggaaagaaagagagagagagagagagaaaagagagagggagagaaagaaggaaggaaggagaaagaaagaaggaaggaagragagagagagaaagaaagaaagaaagagaaaccatcagatctcgtgagaactcaatcactatcagcatgggggtaaccgcccccatgattcaattatcta

SEQ ID NO: 16633 - DNA, 201 bp, Homo sapiens
aagaaagaaagaaggaaagaaagagagagagagagagagaaaagagagagggagagaaagaaggaaggaaggagaaagaaagaaggaaggaaggagagagagagaaagaaagaaagaaagagaaaccatcagatctcgtgagaactcaatcactatcagcatgggggtaaccgcccccatgattcaattatctaccactga

SEQ ID NO: 16634 - DNA, 201 bp, Homo sapiens
gaaagaaagaaggaaagaaagagagagagagagagagaaaagagagagggagagaaagaaggaaggaaggagaaagaaagaaggaaggaaggagagagagagaaagaaagaaagaaagagaaaccatcagatctcgtgagaactcaatcactatcagcatgggggtaaccgcccccatgattcaattatctaccactgagt

SEQ ID NO: 16635 - DNA, 201 bp, Homo sapiens
atcaggaaatgtttcctggcagaaataatggctaagtcaaatcttgaagaagggataggattttgccagaccaagaaagacaaggaaagaaggggcggggyggggtgggagtgggggggtggtgcagtatacaaaacagaggggacgtgttataaggcagagaggtatgagagaaatagaacattcagaaactgtccttct

SEQ ID NO: 16636 - DNA, 201 bp, Homo sapiens
acaaaacagaggggacgtgttataaggcagagaggtatgagagaaatagaacattcagaaactgtccttcttaatatttttgccatatttgatttggatctttttttttttaggaaaaagctgctgatggctacaaatgtgtctgttatgttattctctatacttgttatttcaaaaatattttataaaaatttgtgagtg

SEQ ID NO: 16637 - DNA, 201 bp, Homo sapiens
caaaacagaggggacgtgttataaggcagagaggtatgagagaaatagaacattcagaaactgtccttcttaatatttttgccatatttgatttggatctttttttttttaggaaaaagctgctgatggctacaaatgtgtctgttatgttattctctatacttgttatttcaaaaatattttataaaaatttgtgagtga

SEQ ID NO: 16638 - DNA, 201 bp, Homo sapiens
gcggaggggggaggatcacttgggcctgggagttccagactacagtgagttatgaagggacccactgcactgcagcctgggcaacagagcaagaccctgcwaataaataaataaataaataaataaatgtcgtggtttttttttaatttagcaagtaaagtagcagaatatcctatgttggattagtcagtggaaaaaaat

SEQ ID NO: 16639 - DNA, 201 bp, Homo sapiens
agttccagactacagtgagttatgaagggacccactgcactgcagcctgggcaacagagcaagaccctgcaaataaataaataaataaataaataaatgtygtggtttttttttaatttagcaagtaaagtagcagaatatcctatgttggattagtcagtggaaaaaaatatctttcaaatcgcatttgatgtttgctca

SEQ ID NO: 16640 - DNA, 201 bp, Homo sapiens
tgaggtgaggagatcaagaccatcctggctagtacagtgaaaccccatctctactaaaaatacaaaaaattagccgggcatggtggcaggcgcctgtagtygcagctacttgggaggctgaggcaggagaatggtgtgaacctgggaggcagagctcacagtgagccgagatcgcgccacggcactccagcctgggccaca

SEQ ID NO: 16641 - DNA, 201 bp, Homo sapiens
aattagccgggcatggtggcaggcgcctgtagtcgcagctacttgggaggctgaggcaggagaatggtgtgaacctgggaggcagagctcacagtgagccragatcgcgccacggcactccagcctgggccacagagcgaggctccgtctaaaaaaaaaaaaaaaaaaaaagaaacaaattcattggagtaccttagcatt

SEQ ID NO: 16642 - DNA, 201 bp, Homo sapiens
ggtgtgaacctgggaggcagagctcacagtgagccgagatcgcgccacggcactccagcctgggccacagagcgaggctccgtctaaaaaaaaaaaaaaaraaaaagaaacaaattcattggagtaccttagcattatgggatatctctaggcagcgccaggtttcttgtcttcatagctaagatagatgttaaaggaagg

SEQ ID NO: 16643 - DNA, 201 bp, Homo sapiens
tattgccaaagaagcttgaaatctggacttggtcaaaaaatctctcaacttgtaaaggtggttgctttattttaaattactctacaagccaaataaaacaytgtctccaggctattggccaccagtgaatgacctctttggactaacaattaaactcagctatggaaattcatctgattactttattgtcacactgtgaaa

SEQ ID NO: 16644 - DNA, 201 bp, Homo sapiens
tttttgtgtcatttatcatccccttttatttgatgtctctactcaggacttaggactcgggctgtgatattgtgtatgttacctcacaattttttttctgttttttttttctttaagtgtataagcttcgtttatacttccaaaggatcttcaatggaactctacttctgtgagctaaaccagtgtcatactgcaatgaaa

SEQ ID NO: 16645 - DNA, 201 bp, Homo sapiens
ggctgaggtaggaggtttgtttggtctcaggagttcgaggttgcagtgagctatgatcatgcctttgcactccagcctgagtgacagaaaaagaccctgtcccccccccaaaaaaaaagtctagcaacttgagtgtggcagtggccaacttgatggtaactaacaatgggattgcaaactctttgaggaaaggaactgtca

SEQ ID NO: 16646 - DNA, 201 bp, Homo sapiens
aatcttcaataaaatgtatatgggaaatcaatatggcaccctcaaacctagttgtaatagtcaggagaagaccattctagcctttaaaatcagtcctgttaaaaaaaaaaatcagtcctattgacatcaatgtttttacctccagttcctctccacccttctctacctcctgatttcatgtaggcgagcaatttaggacaa

SEQ ID NO: 16647 - DNA, 201 bp, Homo sapiens
gttatagcgtcctccaagtgttcaagtgaaaggaagagttgcacatctctcactgtaattcaaaagctagaaatgattaagcttagtgaggaaggcatatyaaaagcaaagacagtctgaaaaccaagacttttgtgccaaatagccaagttgtgaatgcagagagaaagatcctgcaccaaattaaaatgtgactccagt

SEQ ID NO: 16648 - DNA, 201 bp, Homo sapiens
tgatacggagagagtttgagtggtctggatagaagatcaaaccagccacaacattccctaatgtttgtaagccaaagcctaatccagagcaaagccctaamtcttcaattctatgaaggctgagagaagtgagaaactgcagaagaaaagttgaaaggtagcagaggatggttcatgagatttaagaaaagaaactgtctc

SEQ ID NO: 16649 - DNA, 201 bp, Homo sapiens
acgtttagcttgcctgaagtgtgttctataaaatgcacccagattttcaggcatttaaaattattattattttaaatctcctactttctctctctctctctttttttttttttttttttttttgagatggggtcttgccctgtcatccagtctggagtgcagtagtgcaatcacagctcgcttcagcctccaactcctagc

SEQ ID NO: 16650 - DNA, 201 bp, Homo sapiens
gtttagcttgcctgaagtgtgttctataaaatgcacccagattttcaggcatttaaaattattattattttaaatctcctactttctctctctctctctttttttttttttttttttttttgagatggggtcttgccctgtcatccagtctggagtgcagtagtgcaatcacagctcgcttcagcctccaactcctagccc

SEQ ID NO: 16651 - DNA, 201 bp, Homo sapiens
tttagcttgcctgaagtgtgttctataaaatgcacccagattttcaggcatttaaaattattattattttaaatctcctactttctctctctctctctttttttttttttttttttttttgagatggggtcttgccctgtcatccagtctggagtgcagtagtgcaatcacagctcgcttcagcctccaactcctagcccc

SEQ ID NO: 16652 - DNA, 201 bp, Homo sapiens
tagcttgcctgaagtgtgttctataaaatgcacccagattttcaggcatttaaaattattattattttaaatctcctactttctctctctctctctttttytttttttttttttttttgagatggggtcttgccctgtcatccagtctggagtgcagtagtgcaatcacagctcgcttcagcctccaactcctagccccaa

SEQ ID NO: 16653 - DNA, 201 bp, Homo sapiens
tcgcttcagcctccaactcctagccccaagcaatcctcctgcctcagcctctcaagtagctaggactataggtacacaccactgcacctggctaattaaattttttttttctttttagagacatggtctcactctaggtcttgcctaggctgttctcaaactcctggcctcaaaagatcctcctgcctcagcttcctaaag

SEQ ID NO: 16654 - DNA, 201 bp, Homo sapiens
gaatcccctcctcttcaccattatgctaaaaatacagttgtctgccaacatgacaaacctggatgtttccccagaaaatgaaggcttctgacttgtcatgaaaaaaaaaaaaaaaaaaaaaaactggaagacttgtcctcttggaccgagcaacagtcacttgtaacaatgggcagctgcccattttagatgaggtatctc

SEQ ID NO: 16655 - DNA, 201 bp, Homo sapiens
atatttaaaaagggcttttctaagaactcaatcttgattatttgttccatgttgggccaaaccagtgcattattgggaagataatgagtggcattcacccaagggtaatcctttcagggattttgatgatgcagtaaatcatgagtgtaaagcctgagtggtttatgccattaaaacctcaagatagaattagacttgtaa

SEQ ID NO: 16656 - DNA, 201 bp, Homo sapiens
taaaatctcaccagtaatatatgcagatactggtttgatgttattgagatttaaattcagttgtgttggcatggttacagcttagatagatagatagatasatacatacatacatacatccatacatacatacatacattcattcatgtgtttgtgtatgtgtatgtgtgtgttactcctccttaatggacaaatggtgat

SEQ ID NO: 16657 - DNA, 201 bp, Homo sapiens
ctcccaggtagtgatcatcctccacaattcctttacattttcctaaaaacctatctcagtgttgggcccttcaggtagaaaccaggaacacctcggtttctagattcctttggcatataggtttcctatgggaaagaaataggagagctggctttcctctttgagaatcttctgtttggtggagatttgacatccaggata

SEQ ID NO: 16658 - DNA, 201 bp, Homo sapiens
tcccaggtagtgatcatcctccacaattcctttacattttcctaaaaacctatctcagtgttgggcccttcaggtagaaaccaggaacacctcggtttctagattcctttggcatataggtttcctatgggaaagaaataggagagctggctttcctctttgagaatcttctgtttggtggagatttgacatccaggatac

SEQ ID NO: 16659 - DNA, 201 bp, Homo sapiens
cccaggtagtgatcatcctccacaattcctttacattttcctaaaaacctatctcagtgttgggcccttcaggtagaaaccaggaacacctcggtttctagattcctttggcatataggtttcctatgggaaagaaataggagagctggctttcctctttgagaatcttctgtttggtggagatttgacatccaggatacc

SEQ ID NO: 16660 - DNA, 201 bp, Homo sapiens
ccaggtagtgatcatcctccacaattcctttacattttcctaaaaacctatctcagtgttgggcccttcaggtagaaaccaggaacacctcggtttctagattcctttggcatataggtttcctatgggaaagaaataggagagctggctttcctctttgagaatcttctgtttggtggagatttgacatccaggatacca

SEQ ID NO: 16661 - DNA, 201 bp, Homo sapiens
caggtagtgatcatcctccacaattcctttacattttcctaaaaacctatctcagtgttgggcccttcaggtagaaaccaggaacacctcggtttctagattcctttggcatataggtttcctatgggaaagaaataggagagctggctttcctctttgagaatcttctgtttggtggagatttgacatccaggataccat

SEQ ID NO: 16662 - DNA, 201 bp, Homo sapiens
aaggctgaggcaggcggattacttgaggtcaggagttcgagtccagcctggccaacatggcgaaacttcatctctactaacaatacaaaaattagctgggmatggtggcacatgcctgtaatcccagctacttgggaggctgagcaggagaatcccttgaatctgggagacagaggttgcagtgagtcaagatggcaccac

SEQ ID NO: 16663 - DNA, 201 bp, Homo sapiens
tcgagtccagcctggccaacatggcgaaacttcatctctactaacaatacaaaaattagctgggcatggtggcacatgcctgtaatcccagctacttgggwggctgagcaggagaatcccttgaatctgggagacagaggttgcagtgagtcaagatggcaccactgtactccagcttgggcaacagagtgagactttgtc

SEQ ID NO: 16664 - DNA, 201 bp, Homo sapiens
ctgtggagtaggaattgaaggaaaatgtgccatgccatttttctttagcctttttgcaatgcaacgcacaatcaatacaaatctttgcagtaatcatatattgattttcctagaatataactccatttaaagcacttttatccccaagagtagaaacattggaggctatcaaaggaggaagtagatttccttgaccccatc

SEQ ID NO: 16665 - DNA, 201 bp, Homo sapiens
ttgaaaatatgatagcagaaattaaattttcaacagaagtattagaaaatacagttgaagacatttgtccagaaattagcccaaaacaaagcaatggaaartaagaaaggaaaaatatgaaattagaggatcagtccaggtggtccagtatttaactctgggagttacagaatgagaaccaaaatatcagaaggaaagaga

SEQ ID NO: 16666 - DNA, 201 bp, Homo sapiens
tattcctgagcctttctgtagatggtggcatgggagctcacttcttattggtcttccccttttctccctcaatcctgtctaccagttagtcttcagctttkgtgtgtgtgtgtgtgtgtgtgtgtgtgtgtgtgtgtgtgtgtgtgtgtgtgtgtgttttttggagacagggtctcactttgtcacccaggctggtgcagt

SEQ ID NO: 16667 - DNA, 201 bp, Homo sapiens
agaaccttacctcctgtaacctgacccttgtgggcttcagaactggcagtggaagcatagaacgtttccagtgtttagaggtggaacttggctaaagtacagagagaggactctcagtgaagttccttctgctgccatagcagctgcattgtgattatgcccaacctggaaagtgcctcccccaccttcccaggagcctca

SEQ ID NO: 16668 - DNA, 201 bp, Homo sapiens
gaaccttacctcctgtaacctgacccttgtgggcttcagaactggcagtggaagcatagaacgtttccagtgtttagaggtggaacttggctaaagtacagagagaggactctcagtgaagttccttctgctgccatagcagctgcattgtgattatgcccaacctggaaagtgcctcccccaccttcccaggagcctcac

SEQ ID NO: 16669 - DNA, 201 bp, Homo sapiens
cttgtgattcccaggatgtctccacttctagggccacattagctaaatggtaattatgaaaatatccagggcaagaagctaataaataagaactgacaggyattgcatagtaaagaattgttgtgcacgctggctcttctgcaagacacacgatggaggttgagagtgtctaacaatcctcctgaaacgtgctgcccgatg

SEQ ID NO: 16670 - DNA, 201 bp, Homo sapiens
ggatgtctccacttctagggccacattagctaaatggtaattatgaaaatatccagggcaagaagctaataaataagaactgacaggcattgcatagtaargaattgttgtgcacgctggctcttctgcaagacacacgatggaggttgagagtgtctaacaatcctcctgaaacgtgctgcccgatgtgctgatgataca

SEQ ID NO: 16671 - DNA, 201 bp, Homo sapiens
ggaggttgagagtgtctaacaatcctcctgaaacgtgctgcccgatgtgctgatgatacaaaaggaaacctgctcgaatagaagagcacgggagaagattkatgtcctgcggatggctgttcctattgtcgtggatccctgggatgtttctgagagctttcttgtgaccttcggtttctaaatgtagaacctggctgtgat

SEQ ID NO: 16672 - DNA, 201 bp, Homo sapiens
cttagagtataataaaaaaaaaaaattaaaaaaaaaaaaaaaagaatttccctaagtcaacaagacaaggtctaataaacttcaggtctaacaaagacttytgctgtttaatgtaaaaaaaaataaaaaataaaaaataaaaaaataaaaatacttgaaaaaaaaaaaaaaaaagaagctaagatttgagttgcttgggtg

SEQ ID NO: 16673 - DNA, 201 bp, Homo sapiens
ataggcatgtgatgcccatctaaaatacggataataagaggaaagggcttctcaattattggtgtggatatgagaacttgactttttttttttgagacagrgtctcgctctgttgcccacgttggagtgcagtggcactacctctgtctcctgggttcaagagattctcctgcctcagcctcctgagtagctgggactaca

SEQ ID NO: 16674 - DNA, 201 bp, Homo sapiens
gtggtctggcccccacccgcctgactctggtcacaatggccactgtcaggcaccaaggcacgtaccactgaggctggggacagctgagtgttagcataacwttttattttattttattttattttattttattttattttattttattttattttattttatttattaatgtactgatttttgacctggggtcttgctcca

SEQ ID NO: 16675 - DNA, 201 bp, Homo sapiens
cactgaggctggggacagctgagtgttagcataacattttattttattttattttattttattttattttattttattttattttattttattttatttaytaatgtactgatttttgacctggggtcttgctccatcatccagtctggagtgcagtggtgcaatcatagctcactgcagcctcaaactcctcggcttgag

SEQ ID NO: 16676 - DNA, 201 bp, Homo sapiens
acttatacagcagagctgtttagactagccacttttgcacacagtacttctcttgatcctcctaacccagtgagatgaatgaggtagatattattggtccygccttgccttggggacactagcatctgaggagttaccactactagtgagtgttgggaccgggattccccatagcatttttgctgtcccaggagactttca

SEQ ID NO: 16677 - DNA, 201 bp, Homo sapiens
cttccaacttttagaccgacaccctttcattacacgaggactaactccacaattatgaaaatctcaaaaacaaagctactctgaagtctctatatagcttygcccttcatatgattccaaattcccatgccagtgaagctgcagttccggggaaaatcccgtgaaaggaaagtcttctttggctagctattcagaccaggc

SEQ ID NO: 16678 - DNA, 201 bp, Homo sapiens
gcaaaatgttcttccaaaaagtgcaacaagttatataggctccccaagtagccagtgagcatacctgtttttctgtagctttaaccagaactggaaagagggagagagagagagagagagagagtgtgtgtgtgtgtgtgtgtgtgtgtgtgtgtgtgtgtaaactgttttagtttgatagtttagaaaaccagcacagta

SEQ ID NO: 16679 - DNA, 201 bp, Homo sapiens
caaaatgttcttccaaaaagtgcaacaagttatataggctccccaagtagccagtgagcatacctgtttttctgtagctttaaccagaactggaaagagggagagagagagagagagagagagtgtgtgtgtgtgtgtgtgtgtgtgtgtgtgtgtgtgtaaactgttttagtttgatagtttagaaaaccagcacagtat

SEQ ID NO: 16680 - DNA, 201 bp, Homo sapiens
aaaatgttcttccaaaaagtgcaacaagttatataggctccccaagtagccagtgagcatacctgtttttctgtagctttaaccagaactggaaagagggagagagagagagagagagagagtgtgtgtgtgtgtgtgtgtgtgtgtgtgtgtgtgtgtaaactgttttagtttgatagtttagaaaaccagcacagtatc

SEQ ID NO: 16681 - DNA, 201 bp, Homo sapiens
aaatgttcttccaaaaagtgcaacaagttatataggctccccaagtagccagtgagcatacctgtttttctgtagctttaaccagaactggaaagagggagagagagagagagagagagagtgtgtgtgtgtgtgtgtgtgtgtgtgtgtgtgtgtgtaaactgttttagtttgatagtttagaaaaccagcacagtatct

SEQ ID NO: 16682 - DNA, 201 bp, Homo sapiens
aatgttcttccaaaaagtgcaacaagttatataggctccccaagtagccagtgagcatacctgtttttctgtagctttaaccagaactggaaagagggagagagagagagagagagagagtgtgtgtgtgtgtgtgtgtgtgtgtgtgtgtgtgtgtaaactgttttagtttgatagtttagaaaaccagcacagtatctt

SEQ ID NO: 16683 - DNA, 201 bp, Homo sapiens
tgttcttccaaaaagtgcaacaagttatataggctccccaagtagccagtgagcatacctgtttttctgtagctttaaccagaactggaaagagggagagagagagagagagagagagtgtgtgtgtgtgtgtgtgtgtgtgtgtgtgtgtgtgtaaactgttttagtttgatagtttagaaaaccagcacagtatctttt

SEQ ID NO: 16684 - DNA, 201 bp, Homo sapiens
aacaagttatataggctccccaagtagccagtgagcatacctgtttttctgtagctttaaccagaactggaaagagggagagagagagagagagagagagwgtgtgtgtgtgtgtgtgtgtgtgtgtgtgtgtgtgtaaactgttttagtttgatagtttagaaaaccagcacagtatctttttgatttaatttgcattct

SEQ ID NO: 16685 - DNA, 201 bp, Homo sapiens
acaagttatataggctccccaagtagccagtgagcatacctgtttttctgtagctttaaccagaactggaaagagggagagagagagagagagagagagtgtgtgtgtgtgtgtgtgtgtgtgtgtgtgtgtgtgtaaactgttttagtttgatagtttagaaaaccagcacagtatctttttgatttaatttgcattctt

SEQ ID NO: 16686 - DNA, 201 bp, Homo sapiens
caagttatataggctccccaagtagccagtgagcatacctgtttttctgtagctttaaccagaactggaaagagggagagagagagagagagagagagtgtgtgtgtgtgtgtgtgtgtgtgtgtgtgtgtgtgtaaactgttttagtttgatagtttagaaaaccagcacagtatctttttgatttaatttgcattcttt

SEQ ID NO: 16687 - DNA, 201 bp, Homo sapiens
aagttatataggctccccaagtagccagtgagcatacctgtttttctgtagctttaaccagaactggaaagagggagagagagagagagagagagagtgtgtgtgtgtgtgtgtgtgtgtgtgtgtgtgtgtgtaaactgttttagtttgatagtttagaaaaccagcacagtatctttttgatttaatttgcattctttt

SEQ ID NO: 16688 - DNA, 201 bp, Homo sapiens
agttatataggctccccaagtagccagtgagcatacctgtttttctgtagctttaaccagaactggaaagagggagagagagagagagagagagagtgtgtgtgtgtgtgtgtgtgtgtgtgtgtgtgtgtgtaaactgttttagtttgatagtttagaaaaccagcacagtatctttttgatttaatttgcattcttttg

SEQ ID NO: 16689 - DNA, 201 bp, Homo sapiens
gtaatcccagcactttgggaggccgaggcgggcggatcactaggtcaggagatcaaaaccatcctggctaacatggtgaaaccccatctctactaaaaatmcaaaaaaaaaaaaaaaagaaaagaggggctgaattaactgacttgtagaggcaaatgtgatattggtgttgggacacatcatctgaacttccactgtcat

SEQ ID NO: 16690 - DNA, 201 bp, Homo sapiens
gtccttgaaatagttacagcacagccaggcagactacaataatatgccagttttagaaaaccttggctttgtcatggttagagagcccagtgactgatgtragctacggtggatccatttccgaagaagttctgcactttgcctcgagtcccatttttacacacgacaccgccctccctaccgccattatggagcctattt

SEQ ID NO: 16691 - DNA, 201 bp, Homo sapiens
ccttgggaagaaaagtcatgtgcctcttgggcccttggcagaagtcaaaggtccaaggtaatgtattggcaaagatcctgtctgctttggtgccttacttactgctccctaatgcttttaggtggaaatattgtcaacgctattgattagttgatctgataatccagcaggctccctgatgtgttaaatttcctacttttg

SEQ ID NO: 16692 - DNA, 201 bp, Homo sapiens
aaataaccatttttctgctcgtgctaaatgaaccacaagacccatgtatccagccacagaaaaacacaagattgcccattccatctgcatataatcagcakacttgctggcaagggcactgcaggatcaaaagagttaataattggatcctgcccacagcaaccacacaattaaggacaagattagcagagatgaggaatt

SEQ ID NO: 16693 - DNA, 201 bp, Homo sapiens
ctcgcacactccctgctcaagtagactccagtgtctcttgtttccttctttgtgttcataggttcttatcatttaactcccacttaaaagtgagaacatgsaggatttgttccagggttagtttgctaaggataatagcctccagctccatccacgttcccatagaagatacgatcttgttttttgttatggctgcattgt

SEQ ID NO: 16694 - DNA, 201 bp, Homo sapiens
tggctcacttgcacaccgttccatcaaaccttgagtaaggcagccctcactcaaactggggatccaaatacctacccctgccatctctcctagattattargaaagtaagaagcagtgctgtggattgacattattcgggacatttaaacattgtacaaaatgtaattgttattttaattaggagttgttctcctctttcc

SEQ ID NO: 16695 - DNA, 201 bp, Homo sapiens
ctaaaacttaaagtataataaaaaaaataaaaaataaataaaatactataatctgacttttttatttttacttttttactttggagcctggctttatgaattttttttttaaacaggggaaggtacctcttttcaaggtgtcattattaagcccatgggactcttcaattttaatgttatatcaaagagagtaaatttctt

SEQ ID NO: 16696 - DNA, 201 bp, Homo sapiens
tatgatgttcattttttgttatatcccattaggtgcccatatttaaaaattgggagatttcacataaaattaaaaggtctgcattttcttttttcttttctttttttttttttttgagacacagtctcactctgtcaccaggctagagtgcagtggcacgatctcagctcactgcaacctctgcctcccaggttcaagtaa

SEQ ID NO: 16697 - DNA, 201 bp, Homo sapiens
agatttaattttgaaggaactttctgtcagatgattattggtaaagtaaaatgtatttctgggaagcagctgattacttgggcctttgatttatttatttatttttttttttgaggagttcatattgcgatatacctatttggtggttatttagaaaggccaaggtagggagaaaaaggaaagaataaaatatatgtatgc

SEQ ID NO: 16698 - DNA, 201 bp, Homo sapiens
tgaggcaggagaattgcttgaacccaggaggcagaggttgcagtgagccaaggtcgcaccactgcactctagcctgggcaacagagtgagactccttctcaaaaaaaaaaaaaaaaaaaaaaaaaaaaaaaggaaaaagaaacaccatccttgtaaagagagcgcatacaccttcaatttctagggcagcagcgtttgctt

SEQ ID NO: 16699 - DNA, 201 bp, Homo sapiens
atgtttgtgtatgtatagttatatatacacataaatattttgtattttgtatatatgtatacatatacattttgtaatatatacgtatatattactatatrtatttttaattgtaaaatacacataggataaaatttataattttagtccttagccattttttttaaccatttaacaagtggtattaagttcatcctcatt

SEQ ID NO: 16700 - DNA, 201 bp, Homo sapiens
ctgaggcaggaggattgcttgagcctaggagtttgagaccagcctgggcaacagagtaagacccccatctctataaagaaaacaaaaccaaaataaagcaaaaaaaaaaaaaaaaaaaaaggagaaacagatttaagacagtcaggaaagaaaaatattgactttgattttggtcttattgaatcttaggtgctggcaggt

SEQ ID NO: 16701 - DNA, 201 bp, Homo sapiens
tatgttgtagaatgtataagttctttctttcttttttttcttttttgagacaaggtttcgctctgtcacccaggttagaatgcagttgcacaatcgtagctttttttttttttttttgagatggagttttgctcttgttgcccaggctggagtgcaatggcgtgatctcagctcacagcaacctccgcctcctgggttcaa

SEQ ID NO: 16702 - DNA, 201 bp, Homo sapiens
cctccccccaccccacaacagtccccagagtgtaatattccccttcctgtgtccatgtgatctcattgttcaattcccacctatgagtgagaatatgcggkgtttggttttttgttcttgcgatagtttactgagaatgatgatttccaatttcatccatgtccaggaaaggtttctataagaaaatgacccagggatggg

SEQ ID NO: 16703 - DNA, 201 bp, Homo sapiens
aagtgtgagccatcgcaatctggcccttgtctgtctttttaatctttctcatttgattcttataattctattagccaaagaaaaatattcttactattacwatttatttatttatttatttgagacggagtctcgctctgtcgcccaggctggagtgcaatggcacgatgtcggctcactgcaagctctgcctcctgggtt

SEQ ID NO: 16704 - DNA, 201 bp, Homo sapiens
aagagatggatttgtggttttccaggattccttttccctgacttggtagaaagatagccaggcatagctcagcagacctgaaaataggtgagctgtcaagktgttggcagggagaggctcctctgggtgggacttggggcatcctaccagcgaaaaagagactaagtttaagtgatttcacatttgggctttacttactat

SEQ ID NO: 16705 - DNA, 201 bp, Homo sapiens
agtgtacagttatagctgtgaaggtacagtctgctcttggaaaaagcagccctgtatgtaataatatgacccgagttgtttaggctctggagatacacacrcatatacatgaacatgtttgcatgtgtgcttgcgtgtgtacatgcacatgcgtgtgtgtgtatcatgtgtcctttttagtcttgtcacacctgtatgtct

SEQ ID NO: 16706 - DNA, 201 bp, Homo sapiens
cagtgagccgagattgcgccactgcactcccgcctgggccacagagcgagacttcgtctcaaaaaaaaaaaaaaaaaataaaaataaaaaaaataaagcgygtatattgactttccagaatcttgagaatggataaatggaaacaaagagaaatacctattttgtattataaacctctaaaatagttactaaataagttat

SEQ ID NO: 16707 - DNA, 201 bp, Homo sapiens
ataaagcgtgtatattgactttccagaatcttgagaatggataaatggaaacaaagagaaatacctattttgtattataaacctctaaaatagttactaartaagttattcttttaggtatttttctttcacttttcatcgctattaggcaaaactgatagtcgatgtagctgtgtcagtagctaagggatttttgttgtt

SEQ ID NO: 16708 - DNA, 201 bp, Homo sapiens
aaaaaataaaaataaaaaaaataaagcgtgtatattgactttccagaatcttgagaatggataaatggaaacaaagagaaatacctattttgtattataamcctctaaaatagttactaaataagttattcttttaggtatttttctttcacttttcatcgctattaggcaaaactgatagtcgatgtagctgtgtcagta

SEQ ID NO: 16709 - DNA, 201 bp, Homo sapiens
gaatggcgtgaaccctggaggcggagcttgcagtgagccgagattgcgccactgcactcccgcctgggccacagagcgagacttcgtctcaaaaaaaaaawaaaaaaataaaaataaaaaaaataaagcgtgtatattgactttccagaatcttgagaatggataaatggaaacaaagagaaatacctattttgtattata

SEQ ID NO: 16710 - DNA, 201 bp, Homo sapiens
gccgagattgcgccactgcactcccgcctgggccacagagcgagacttcgtctcaaaaaaaaaaaaaaaaaataaaaataaaaaaaataaagcgtgtataytgactttccagaatcttgagaatggataaatggaaacaaagagaaatacctattttgtattataaacctctaaaatagttactaaataagttattctttt

SEQ ID NO: 16711 - DNA, 201 bp, Homo sapiens
tgcaacgtttcaatcaagaaagcatgataataaagcgtgtataggccgggcgcggtggctcacgcttgtaatcccagcactttgggaggccgaggcgggcrgatcacgaggtcaggagatcgagaccatcctggctaacacggtgaaaaccccgtctctactaaaaatacaaaaaaaattatccgggcgtgatggcgggcg

SEQ ID NO: 16712 - DNA, 201 bp, Homo sapiens
tgaaccctggaggcggagcttgcagtgagccgagattgcgccactgcactcccgcctgggccacagagcgagacttcgtctcaaaaaaaaaaaaaaaaaawaaaaataaaaaaaataaagcgtgtatattgactttccagaatcttgagaatggataaatggaaacaaagagaaatacctattttgtattataaacctcta

SEQ ID NO: 16713 - DNA, 201 bp, Homo sapiens
gaacttgttctaaaaataaaacccaccctcaaaggataaagagataaagattttccaccactagggatatgcaaaaagatacgcctctggcttctggtacwtaaaaattttatggttgtgattgttcagtggttgcctgatttcctttaaagtttttccacttaaagtaatagacattttcaggaatccctttgttaaact

SEQ ID NO: 16714 - DNA, 201 bp, Homo sapiens
caatttttgataaggtaaaataagattatcttatatgactagtgtatactaccttatatttgtatgacactccatgtttttcaatgactttcttccagagkttttgttgaaacacaaaaggatttgtacccaaactgactttactttcaattctggataatagataattattattgcattacaacttttaaaaataattaa

SEQ ID NO: 16715 - DNA, 201 bp, Homo sapiens
ctttattgttccccctttttgatttgaaaataatagagaaaaatgggggagtgggacttcaccatggtcccactctcctaatacagctatttttaccttgraagttaatttccagccattgaccataggaatgtgtgggttaatttaggtattgttgttgagtacatgaaattttgtatcatgcttttttatttaatgcta

SEQ ID NO: 16716 - DNA, 201 bp, Homo sapiens
attagataaatgaaagctagtgatgtagattggtattttattgtatacactatatacagtatttaaaattatattaaattttgaaataataataaattatrctctgcatattatgtagtactcattaatacaaagatgggatcattttatagaggagtcctttaccaatttttcttcctctctctacattgttattagtat

SEQ ID NO: 16717 - DNA, 201 bp, Homo sapiens
tgcagccattttaatgctgaatgatattcatcactgtctgaaatgggcttatttatgtacgaatgtttattcctatctcttcctccattctcccaaaatgwaaaccccataagaacaggaatcttgtctgtcttagtcacactcagtatccttagagccttgtgtgtagtaggtgtgtagtgaattttggttgaatgagtg

SEQ ID NO: 16718 - DNA, 201 bp, Homo sapiens
gagcaaggatcagggaaccggaagggcttggtttgatggcgagcggatgcgcggtgttaaactaagggatgacagggccttgtcagcaagggacctggagwtattagaggggatgttacaaattcgtgctcttcaggatgcaggccgagtcttgttggatcggctcaaaaatgagaagcaagatacccatttccttgtcct

SEQ ID NO: 16719 - DNA, 201 bp, Homo sapiens
atgaattgcacctaaggtggcacctttctcttgtgcctggagtggaatgtcacccagaaccaacagtagaacaactgggaaataagttgatattctttccracatcgaatggattcatttcacagagttggggaggaagtgagggtaataagagtgtgtttctgaggctcttccttccagcagataggttttgttttcttg

SEQ ID NO: 16720 - DNA, 201 bp, Homo sapiens
atatgaatagaataatttatttaaatagtttcctctattgttgaccaattagcttgtttcatttattttatcagcataaataatgctgtgttgagtcagtkggtttaaacatttgtatgtgcatttttaaatgaataaattcctagaaacagaacaacggagttaaagatagggattttttaaggctcttgatgcatattg

SEQ ID NO: 16721 - DNA, 201 bp, Homo sapiens
aataataaattatactctgcatattatgtagtactcattaatacaaagatgggatcattttatagaggagtcctttaccaatttttcttcctctctctacmttgttattagtataaagatatttcttcattatagaaaacttggaaaattctagaaaagtctaaaaaattttaatttatcataatcttgtcatctcagaat

SEQ ID NO: 16722 - DNA, 201 bp, Homo sapiens
taattgaaactttatgccgcttgattagctctttcccatcctcccagccctggtcatcatctttctactctctgattctatgagtttgactattagacgtrcatttttgtttttgctataagcatctgtcctgttgctatgctgatcatttatttactctgtagttttggaaatgacctgcttacaagataaccatgcctc

SEQ ID NO: 16723 - DNA, 201 bp, Homo sapiens
ttgtctctcttgtgcccaggagagcagcctcttggtttcatacagccgactgtcttctctacagctcagaggagattgtacagttgctataattaacttgytgataaagagctgggaaaacaaaaatctgtcaaatctttccaggttcccacaggtgcacatttccagacctgccaaaatattttattatggttgacatca

SEQ ID NO: 16724 - DNA, 201 bp, Homo sapiens
ttgtccaaggtcattcaactggtatagtggcagagctcaggctgtacaaatcaggtgagtattcttcagctcctcagaagccagtaacttccactcacttstgtgtgtctgaaattcattaaaccttcgacacaaagtgcagccattttaatgctgaatgatattcatcactgtctgaaatgggcttatttatgtacgaat

SEQ ID NO: 16725 - DNA, 201 bp, Homo sapiens
ttgcatgcaaactcgtagtaaagccattgtctagttattaacaaatgatgagcaggtgagtgaattgacaggaattattcttttgggatgttgcctctggyagaacctcagttatggcctctgtcattctcccttcctaatttcattatcttccaaatattattgacctcagatgttaagaaaggtccaggttcctggggg

SEQ ID NO: 16726 - DNA, 201 bp, Homo sapiens
tacaggagtacttccttttcatttgtcctgtggtgtctgaaggagaactttcttttatctttcctgtattagttcacgttatactgtgaggtttgcaactyaggtctaaatacaggatttgggaaagatgttcctgtctctcaattcagtctttgtgattttatgtacatatatgcctgaatattagataaggaattttcc

SEQ ID NO: 16727 - DNA, 201 bp, Homo sapiens
gatagtagtgcagtcaccactctagggaaatacggtggaaggagagcaaaaatagttcaaatgtggacaggtgaaggtcaaatcttatgtttgaggcagtrtgtttaaggaagatagtcagttgttggctgtatgggaccagagcttagtggaaaggtccgcttgaaggtagaagcgtagagatgtccgcagtctacaggg

SEQ ID NO: 16728 - DNA, 201 bp, Homo sapiens
ctagttctcgcaaatgttaggattatcttttagatctgtagtttgtaaaaattattgaattgtcatccgtctctaagccagagggagaggaatcaggaagsgtatggcatattttgtctcagagtcttatttggtgcttaaaaattctatgtgcctggaagtcaagaacatttattgatagacataatattctccaaatga

SEQ ID NO: 16729 - DNA, 201 bp, Homo sapiens
agaactcctcccctgggagaaaaggtctttaaggtattttgaggggaggagaagggttaagaggtctaatccataactctaaatccccatgcttggaggarctcattgacattgtcggttttaagggctcctttggagccattatggtgtgtcacgctgagacccactggagaacacttaattgtagatcattgtcccagt

SEQ ID NO: 16730 - DNA, 201 bp, Homo sapiens
gaaagtttcgatactgacaaacccaagaatattcttcaggtttgtgcttttaaattaaataactagaattatcagaggtttttctgtcttcctttcacccscttcctcttgaaatgaaacctcaactggacatagaccccctggctgctggatatgtgttggctacatttctttccttttctaatttctttggttttgagg

SEQ ID NO: 16731 - DNA, 201 bp, Homo sapiens
tgtagtaatacagaggacacttatgaagactgttaactgtgagtcctttttgctatgtgagatataccagtaaaataagggacatgattgttttggtaggmctctgtacggatacaggatagctcattgaacccgatctcaggaattatagattagaaagttgtcagtctttgatttctgcatctccccgtgtgtccactt

SEQ ID NO: 16732 - DNA, 201 bp, Homo sapiens
tttgatttctgcatctccccgtgtgtccacttgctcccctctttcagcaaaccaactgccactgtatctttgggccacgtgaccaaaaagatggttaccartgggttttgagttttcatgtctcaggtccaacaacctgggtagagacagaatctctttaggatctcaattccagattcccagggagagaattctgattgt

SEQ ID NO: 16733 - DNA, 201 bp, Homo sapiens
gtgggcggcctcctgttaacactgctttctttttctccttgaaaaaggcaaactgggttttcaaggagaatgagaatttcagggaagggatcagagagagygggcactacatgtgccacatctgtcagatgtcttcaaaccattaactcccagaccccaggaagctgctgctctttctagcattttctagagcatctagca

SEQ ID NO: 16734 - DNA, 201 bp, Homo sapiens
gggaaggtttatcctgattgtaatccctccagaggttttgatcatttctctaatcacttattaggcctcttgcttcctgtaggaatttgttctctatattrgattgaaatctgcctgttctaatttcaacttcctttcttctggccctggctagtcctcagtgtacagaattgccattggtacctgctggtcaaggccaag

SEQ ID NO: 16735 - DNA, 201 bp, Homo sapiens
taataacagtgcaaaaattgaatttaaaataatccttttagggatgcaagatgcagtggtttagccttttattaatattcttttctttccactaataaagrttttaagtcaacatctccttaaatttgattaattccattaggatcactccaaaaaaaggtttatcagtggctttgaaatccaaatgggatgaagaaaaaa

SEQ ID NO: 16736 - DNA, 201 bp, Homo sapiens
acaaatgtaaatatgcaacttttaagcacatagagaaatctaccctaaagttgatgttttttcaagttctcttggagcttacattccagtgggagaaaccygtgttaaacaaatacatagaagacaatttcagattgtgagctaggaaatcagggtagaggaatgggtaatattagagagatcggggaggcttctctgaga

SEQ ID NO: 16737 - DNA, 201 bp, Homo sapiens
ttccagtgggagaaacctgtgttaaacaaatacatagaagacaatttcagattgtgagctaggaaatcagggtagaggaatgggtaatattagagagatcrgggaggcttctctgagaggtgacatttgagctgagatctgaaagaccaagccacagtcacatgaagacatggagttagcgttacatgcagagcaaacggt

SEQ ID NO: 16738 - DNA, 201 bp, Homo sapiens
tagagagatcggggaggcttctctgagaggtgacatttgagctgagatctgaaagaccaagccacagtcacatgaagacatggagttagcgttacatgcaragcaaacggttaagtgcaaagtccctgaggctggaacgggcttaatgtcgtggagaaacaggaagagagtggaggagtgatgcgagatgagaatagtcag

SEQ ID NO: 16739 - DNA, 201 bp, Homo sapiens
tgagctgagatctgaaagaccaagccacagtcacatgaagacatggagttagcgttacatgcagagcaaacggttaagtgcaaagtccctgaggctggaaygggcttaatgtcgtggagaaacaggaagagagtggaggagtgatgcgagatgagaatagtcagagaggaaggtagggccataggaagaagttttgatttt

SEQ ID NO: 16740 - DNA, 201 bp, Homo sapiens
tggtggaaggcgaagggaaagcaagacggcaggagagggagcacagggggaaaccaccacttttaaaccatcagatctcgtgagaactccctcattatcaygagaacagcatgggggaaaccgcctccatgatccaatcacctcccaccactcccctcccttgacacctggggattacaattccagatgagatttgggtgg

SEQ ID NO: 16741 - DNA, 201 bp, Homo sapiens
tatgaggattccgttgccattttccttatctcatataggtctaaggaaggaagatttccactgtttagaccggaagaccctgaggacagtatcctttctgrctgccctgctgtcatatgagtccatagggggcaaaggtgaggctttcctgggcttgtgattcccaggatgtctccacttctagggccacattagctaaat

SEQ ID NO: 16742 - DNA, 201 bp, Homo sapiens
cttaagtctcatcgttcttctgtgtgccttccttttcaagggcaggctgagtccatgtggagcattatggttgataggcatgtgatgcccatctaaaatayggataataagaggaaagggcttctcaattattggtgtggatatgagaacttgactttttttttttgagacagggtctcgctctgttgcccacgttggagt

SEQ ID NO: 16743 - DNA, 201 bp, Homo sapiens
cttgaagtctttagaacaagattaatttagcttccgttagttcataccagcgaactaggattaagtgggcgacagggcccaggtttgattcagccctgctygcaatactgggtggaactggtgctctgatatactgatgttcagtcttgctctgtttggagtagagaagtatcttgaagaggccacgaacagcatattcat

SEQ ID NO: 16744 - DNA, 201 bp, Homo sapiens
acactgaaggttggtttatgagcagcaggcatacaaaggaggaagctggagtggaaggagccgtaaaattgacaaagtggtctctaatataaccctccccmgacacacatacaaatacaacactttcttcctaactttcacttagcttagctgtagacagttccagcaaaccttgtttagcactgctccgtgctacattga

SEQ ID NO: 16745 - DNA, 201 bp, Homo sapiens
tcgaactcctgacttcaggtgattcacccacctcagcctcccaaagtgctgggattacaggcgtgagccaccacgcctggccggaggagaaactccagcgyagtaaagaaacagccctgctggtactgggtcctttaccctccagagtggggctcaggaagaaggaacaggaccaggtaccaaaagccccagtaatcccgt

SEQ ID NO: 16746 - DNA, 201 bp, Homo sapiens
tccaaagctattttacaacccacagcattcgatttttattttgccaagaacacgttggtaatgggatgtaaatctcccggtgcacacctgattaaacaggmctgtatacgtgaattaaaaaagagggtgagccccttgccatcacggggtgacagggaagcacgccagataaccggagctcagttggctgaagggagctcg

SEQ ID NO: 16747 - DNA, 201 bp, Homo sapiens
tttatttattaatgtactgatttttgacctggggtcttgctccatcatccagtctggagtgcagtggtgcaatcatagctcactgcagcctcaaactcctmggcttgagccttcttctgcctccgccttcccagtagctgggactagggactacaggcgcacaccatcacacttagctaatttttaaactttttttaggaa

SEQ ID NO: 16748 - DNA, 201 bp, Homo sapiens
tatgctgcatttgcaaaggtcaggctttaattacatgcacagttaaatggaaatactgtagagaggtcacactcatatttctttggctttcattaatgttrttgctctgtcactttccctctccttaggtttgtaaatgaaagttcctttagtacatttaaaagcattatttatttttaattgtcttacctctggagggag

SEQ ID NO: 16749 - DNA, 201 bp, Homo sapiens
atctttattgcaaaggttagtttacgcagtgcatataaaatccgcatgtgctccgcatcagccaccagctgtctgacagtgtgttgctattgcagtgagtkttcacataaattttatgttggttatattaacagtccgtccatatcactacccacagatgccagtagacataaaaattgctctctagtgagcctaaatatc

SEQ ID NO: 16750 - DNA, 201 bp, Homo sapiens
ctatccaaagcaagtattattccagaaaaatactggaaacctatcaggaatctttagaatatcgtccatttttttagagtcagttttgctattctcatgcrtttcttacttatagggtcaaaaacactttctaataccacggatggcatggaattcttccctgcaggcagccatcttcaagactgaaagcagaatttaaaa

SEQ ID NO: 16751 - DNA, 201 bp, Homo sapiens
cttctatcagcagttgttaacaaccaattgtttgcaccaaacccaagggcttgatttcccttggcactaaatgttatgttttgggtgtcttatagtctgtyctgtgagttaacattgtacaataaactgttttatcaggacttgctgatcatcctgcctgctagttctaccctcgaaaactgttttttttaatgcttattt

SEQ ID NO: 16752 - DNA, 201 bp, Homo sapiens
cagaagtttgagaccagcctcagcaacatggcaaaaccctgtctctactaaaaatacaaaaaataaaatttaaaaatttaaaaaaatctaaaacagagaarcagtttataaactactcagtgtaatattttcatttggtaaatgaacatgttcttctctacataaaatatttagctgaatttcaataatgtttttaagttg

SEQ ID NO: 16753 - DNA, 201 bp, Homo sapiens
ctacccaagtaattgctgcgggattgggaaacgcatgagactatggtaaagcagctccaaggccctgaactaaaactgcaggaagtgcaatagagaggcarcccacggggtgaggggccacactaaatgggcaggctctattatagcccaatagaccgaataggacctggtgataaataggaacgaagcaggccgcacaga

SEQ ID NO: 16754 - DNA, 201 bp, Homo sapiens
cctgaatattacagacagtaacagaatggctatcacaacagtcacagcttgcagacaccaagctcctcagaaaatattctactaataataatagttgtcaytgggctagtcactgagtgccaggcattgtgctatacattttgcattcacgatctcgttgagtccttacagtagctctatgaaatggatacttgtgtctgc

SEQ ID NO: 16755 - DNA, 201 bp, Homo sapiens
tcaatcaaagcctctcttgaactgagcctaaattgccgatggtgaggggactctgttagctaaactgaggaaccacaggcagggtggccttgaatttcagkctgaaggacccatcacccaagagtcttggcagcttcctcagcaaagatgaatgggcttgttaggtggtttttgttacctgatcagtaattgtttcaacac

SEQ ID NO: 16756 - DNA, 201 bp, Homo sapiens
tactaaacgcccccaaacactatggcattgtttggagatagggcatgtgtaggaatagtaggaggcacctaatcagaaattcaaaatgaacagcctcaccraacagatgggcagagtctatggactttccttccttcaggagaggatgggccattatttaaatttatatacagtggaagccactagaaccccattctgatg

SEQ ID NO: 16757 - DNA, 201 bp, Homo sapiens
tgcctcttgggcccttggcagaagtcaaaggtccaaggtaatgtattggcaaagatcctgtctgctttggtgccttacttactgctccctaatgcttttargtggaaatattgtcaacgctattgattagttgatctgataatccagcaggctccctgatgtgttaaatttcctacttttggaggactataagtatgggca

SEQ ID NO: 16758 - DNA, 201 bp, Homo sapiens
tgcacatccaaaggccacttggacaaatgatgccttcagcttttggggtccacagtgccatttcttctacatcccagcttactatgcttgacttcagttayattccccagtaccaagaacgcaggaggactactttaatcccctttgcaaaataacaacaacaataaggcctccaggcagagcacattgagcctaattcag

SEQ ID NO: 16759 - DNA, 201 bp, Homo sapiens
atcctgcccacagcaaccacacaattaaggacaagattagcagagatgaggaatttatggtgaaaatgcaatgatagtctgaaaaacaaaatgatttcacygagcagttgttctgttgccataatcctaatgatcaactctattacaccaataataggagaaaaactaattgcagtgaggacaggacaaatctttttaaat

SEQ ID NO: 16760 - DNA, 201 bp, Homo sapiens
aagcaaacacttaggggaggggtcgtgaactgaacggggagagcttgtattcccaagaccctccacgtcccaaaggagttcagtgggctgccggcccccawaaggaaaaagcaaactcagccagagaatgagatgccattgctttctcttggacttgcttgggcctcttgtgctgggtgctctgtagctgagttaaaactg

SEQ ID NO: 16761 - DNA, 201 bp, Homo sapiens
aagcaaactcagccagagaatgagatgccattgctttctcttggacttgcttgggcctcttgtgctgggtgctctgtagctgagttaaaactgagagcccraggccttcccctgtcttcaaggcttgccaggaacttaggctgccatgaccaggccctgtttgagcatgtgtgcccagcagggtgcaaggaacatgccagg

SEQ ID NO: 16762 - DNA, 201 bp, Homo sapiens
agacacggttaagagttaatggaaaaaacagataaattggacttcatcagaattacaaactcttatgcatcaagaatgctaccaaggtgaaaaaaatagcrtatagaatggaagaaaatattgcaaatcatataatctgataaaagtttaatgtccagagtatgtaaagagtgcctaaaactcaataacaggaagacaatc

SEQ ID NO: 16763 - DNA, 201 bp, Homo sapiens
tacttcacacctactgggatggcaattaaaaaaaaaaaaagaaaagaaaataacaaggcaagcatgtggagaaatggggctcctccattattggtgggagygcaaaatggtgcagcacctttcaaaaacagtttgatgggtcctcaaaaaaattacacatagaattaccatgtgacccagcaattccactcctagatgtat

SEQ ID NO: 16764 - DNA, 201 bp, Homo sapiens
atggcccagagtcacctgtgccgtgatctgttgttgaaagcaagtcacagaaagggccagtccaggttgaatgcaggagtgagtgctggaggtgtggtccrttggaggccatgtttggaggctagttaccacaaacaccatggacatatgcatggaacaagtgagagcaaaatcctcatgaaacattataggaaaccaaca

SEQ ID NO: 16765 - DNA, 201 bp, Homo sapiens
gaacaagtgagagcaaaatcctcatgaaacattataggaaaccaacagataatatctaaaattaatcgatcaagaaatggtatgccggtacagtggctcayacctgtaatcccaggactttgggaggccaagacagaaggattgcttgaggccaggattcaagaccagcctgagcaacacagtgggactctgtctctacaa

SEQ ID NO: 16766 - DNA, 201 bp, Homo sapiens
gatgtcgtcctttgattccttatgaccttctgaattttggcaaatgagaaagcatctgggatccgcagtgagggcctaagggtgtcttttctacaaagagytactgtcgtcctccaccccaccctgcctttgcccccatctctaccaggcacgtggcaaggacatggccttgcttattttccctgttggaaaaagccttct

SEQ ID NO: 16767 - DNA, 201 bp, Homo sapiens
cttcttcccagagccagggggctttgagatgaggtggcccagactgtcccatgcttgagcatttaccagacgtgactttgggtccctgtggctgtctcagyttgacagatgagaaaatgctgttgctaagtgcccttcccaaggtcaccccacaagcaaacattggtgctgggagaatgagatcacccccagacagtgaag

SEQ ID NO: 16768 - DNA, 201 bp, Homo sapiens
tatcctggctttatcagtggacacttagcaagcatcttcttgatcactgacccagcggcatagatatttatgtgggacaaagcaatgttagtttccaaatkttagctgtagaaagagtgtcattcatttcctaggtgtacaaaatgcagacttgctttggatttaaggccaggacactatgacatctttggagttcagggg

SEQ ID NO: 16769 - DNA, 201 bp, Homo sapiens
ttgtacagatctaagtaatgatggccagaaagtcacagttttgcccaagatcctagggtaaagtagtggcagaactgggtctttaactctcagaccagtgytctccctactataccatctggcttgttaggttgttagcttgctctttttttgttttttttttgttgttgttgttgtgttgtttttggtgacagggtctgg

SEQ ID NO: 16770 - DNA, 201 bp, Homo sapiens
ggatatagcagtgagcaaaacagacagaaatccctgccttcagagagcttagctcatgtgcgtgtgcacacacagacacacacacgcacacacaaatggcrtcaagtgctacagagaaaaataggacagtgaaggaagatggggagtgctagagttgggggacagggaggggagatgtttgctgtcctgagtaaggcggtc

SEQ ID NO: 16771 - DNA, 201 bp, Homo sapiens
tgctagagttgggggacagggaggggagatgtttgctgtcctgagtaaggcggtcaaggaaggtctccctgattggattaaggagtgacctgaaggggtarggggaggaagccatgtggatattttaggggaggagtgttcaagggagaaggagcagcaggttctaatatgctgagactgctcttggccccttcagggtga

SEQ ID NO: 16772 - DNA, 201 bp, Homo sapiens
gggcagagaatcggggtcaggaaagggtccatcatggagggccctgtggaccactgtaagaattttgactttgactcagcttttaaatcagtttaattcaycagaagactgatatgatctttataaattagcatttttcttttgacccaccattttctccctaatcctgaatttgaactgtgtcacacagttggtattaga

SEQ ID NO: 16773 - DNA, 201 bp, Homo sapiens
agaaatgttttttagaatgttgtagtgcgtttaaaaatcacagccaccttggatttctaatcagaagttattctggaatctttctgaagtttgagactgtyccatgcaaacgttacttaaatttcaagcaacagggaagtcatgagatttggaaagggttatcttttctcaatcatggtcctttgtggagttctgtggtga

SEQ ID NO: 16774 - DNA, 201 bp, Homo sapiens
ttatgtaactgacaagcccacaaatgaactgggggataaaattattctcagccctctacctcctgggtttacacctcagtggtgggccaagcagtctcacrtattaagtggttccaagggcctgccacagtccctgaagtagggggaggacttcaggagacctatttcatgtgccagaccctgggaagtcaccagctgcct

SEQ ID NO: 16775 - DNA, 201 bp, Homo sapiens
cttcaggagacctatttcatgtgccagaccctgggaagtcaccagctgcctgcctggggagccaagttgccgctctacaggactctacagcggcctgagtytggtttcctctgaaatggagctgaattgaatgttagttctttctggacccaaagacacgtatgtctcccccaccgcaacccacctttagcatctttgtgg

SEQ ID NO: 16776 - DNA, 201 bp, Homo sapiens
ctacaggggcggttttgagagggacaggagaaaggcagtgctgtgaggatcacacatgctcatcacatggcttgggaggtgccctggtggatcccgcacaytgtagcagtaaaggggaaaaggcagggcactcctctggacccctgaagaaagcgtggagatgcctttgagctatttcatgaccataagtggccctgactt

SEQ ID NO: 16777 - DNA, 201 bp, Homo sapiens
gccctgacttccaaaccagcaaggggctcttgcatcccttatctcctcatcttctgacctcctggaggtacgatctgagcacttttaccctcaccccataragcctttaccataggccagaggaactgggtttttttctttctttttttttttccacttttattttaggtttaggggtatgtgtggaggtttgttacatag

SEQ ID NO: 16778 - DNA, 201 bp, Homo sapiens
gggcattgttttgcgtgcctgtaatcccagctatgtaagaggctgagaaaggaggatcacttgagtccaggaattctagaccagtctgggcaacctagagwgaccccatctcaaaacaaaacaaaaagccctgatgttcatggctatttcactttatagtattattaatattatatttcagacaaactgtaggtcatgtag

SEQ ID NO: 16779 - DNA, 201 bp, Homo sapiens
cagtcaaagggtttttaaagcacctgaacagcctatcttatataggacttctcacctcttcccagaagcgtgaggcccaaaagtagatgtatatacaactrgaagttaagccaaacccggcttctcaagtggtcatggttgaagaacactaactactaaaaaggtgtattgacccgggggaaaaaaagctgacccctaggg

SEQ ID NO: 16780 - DNA, 201 bp, Homo sapiens
agtgcagcggttcgatctcggctcgctgcaatctctgcctcccgggttcaagtgattctcctgcctcagccttctcagtagctgggattataggcgtgcaycaccacacctggataatttttatatttttagtagagacagggtttcaccacattggtcaggctggtctcgaactcctgacctcgtgatctgcccacctca

SEQ ID NO: 16781 - DNA, 201 bp, Homo sapiens
ctgcccacctcagcctcccaaagtgctgggattacaggtgtgaaccaccttgcctggctcctgaggcctcttaagccttggtattggcttatgctattgcrcattaggagaatgcattatcatgtagctgatgccctcaaacagactcctactcagcatttggccaagtgactgtcaactccttaaattcaacttccagaa

SEQ ID NO: 16782 - DNA, 201 bp, Homo sapiens; identical to SEQ ID NO: 1881

SEQ ID NO: 16783 - DNA, 201 bp, Homo sapiens
aggaacttttgttaaggtggtacttttggaaccttaatgaaaaacacaccttagagaaggtgaatttagagttctgctaagcacattcatttactcttctmttataaactggttttgtaatattttataaaattgtctcactggttgatttcacaatgtaaactgggaggattcttaggattccttgggttggattagaac

SEQ ID NO: 16784 - DNA, 201 bp, Homo sapiens
atggctgaggagttatgcttaacggtatactttgcatgcatttgtgatttgaaataggaaaaaaagtcaaatttgagacagcttgaatggcatgctgtcartttggagcttcatgaattggcaatggtctcatttaggaccttcagatgtgtctctgcctggacagaatgagaacattttgcatgttcagaaggagacagc

SEQ ID NO: 16785 - DNA, 201 bp, Homo sapiens
ttattaggtattagtcacattacatcataattattttatgcagcctcaacttctttactaaaatgtgcagtagacatcagatcacaaatatcaagactttygaacaggtgttggcaaattttttttgtaaagggccagaaacaagtacttttggctttgtgggttttatagtctgtgtcttatctactcaaccttgctgtc

SEQ ID NO: 16786 - DNA, 201 bp, Homo sapiens
taaaatgtgcagtagacatcagatcacaaatatcaagactttcgaacaggtgttggcaaattttttttgtaaagggccagaaacaagtacttttggctttrtgggttttatagtctgtgtcttatctactcaaccttgctgtctgtgtgaaagcagccatttatgtaaatgaatgggcatgactgtgttctagttaaactt

SEQ ID NO: 16787 - DNA, 201 bp, Homo sapiens
ttatctactcaaccttgctgtctgtgtgaaagcagccatttatgtaaatgaatgggcatgactgtgttctagttaaactttattttgcaaaagcaggtcaygggactgatttgcctgtgatctctgcaacccagctcttgagtaagggtcacagactttgctgtggttaggcaggtacctcaaatgagtaaagtgaagtgg

SEQ ID NO: 16788 - DNA, 201 bp, Homo sapiens
ctttattttgcaaaagcaggtcacgggactgatttgcctgtgatctctgcaacccagctcttgagtaagggtcacagactttgctgtggttaggcaggtayctcaaatgagtaaagtgaagtggctgtggggactgcgactagcaaaggtcacgtccttgtctaaaatgggcagctacttcttccctatagccactgtgac

SEQ ID NO: 16789 - DNA, 201 bp, Homo sapiens
gaccaaacttaggggaaagagtatccaaagtcagatgtatccttaaaagtcacttagcagcattccttccttgcagagaccatgaacttggctttctgatktgttcattttcaccatgcctagtgcaaattaatgtgaatgaatagttacaaaggggagtttctttttttccttcctttcactgcctttgacccttctgca

SEQ ID NO: 16790 - DNA, 201 bp, Homo sapiens
tagtgcaaattaatgtgaatgaatagttacaaaggggagtttctttttttccttcctttcactgcctttgacccttctgcacatttggcggtagagtacgmcattcagaatttagggattctgtgtgtgccatctgggatgcatgtattttttaaattgtttatgtgatatatacatgatacagcccagggaaaacatgct

SEQ ID NO: 16791 - DNA, 201 bp, Homo sapiens
cccttctgcacatttggcggtagagtacgacattcagaatttagggattctgtgtgtgccatctgggatgcatgtattttttaaattgtttatgtgatatrtacatgatacagcccagggaaaacatgctttattgtgcattttgaaagctttgcatctttttgtcttcctgcattacttctcattttaccctctgccagt

SEQ ID NO: 16792 - DNA, 201 bp, Homo sapiens
aatttagggattctgtgtgtgccatctgggatgcatgtattttttaaattgtttatgtgatatatacatgatacagcccagggaaaacatgctttattgtscattttgaaagctttgcatctttttgtcttcctgcattacttctcattttaccctctgccagtctaaacactgttgtctttcacgtttgaccttctctaa

SEQ ID NO: 16793 - DNA, 201 bp, Homo sapiens
atatttagaaaaacattccttggctgttcttgcttgtttatatttccatgtgtattatagaaacagcttttctagttactaaccccattcatctaaaaaaygatccctttggtctttttatttatattatgtccaatttctagatgaatttagaaagtactgacatttctgtgatgttcagtcttatttcctaagaacata

SEQ ID NO: 16794 - DNA, 201 bp, Homo sapiens
aatactccaggggtgtctgatggggaacgtgtcgggtgcctgtaataaatccactgcccatggaagtgagtgaaggccttgttggcagtgcctgaggacaygcttaactaaggttgtcacggttttacttttaaattggaatctttgccctaatctcagagttagacatgaccagatttgcaaacagatttacaattttca

SEQ ID NO: 16795 - DNA, 201 bp, Homo sapiens
cagttagttgtaagtatttggctttatttatggcttctccattttgttccatcagtctgtgtatctacttttataccagtaccatgctgttttagttactmcagctttgtggtataattttaagacagataatgtgatgcctccagatttgttctatttgtttaggattcattggctattcaggctcttttttggttctgt

SEQ ID NO: 16796 - DNA, 201 bp, Homo sapiens
actacaggggacaagtgtgagaaaattgggcggaagtggtacaacaaagtgagaggtacaggtgcaaggtcttccagtggcagtactgcgtgagtctatayggcagtgttgtgtcttttggtcattaagtagctttaccagtggaacgatcatactgctgtgtggcagagagagaatgaatgagtatttaaaccaagatgc

SEQ ID NO: 16797 - DNA, 201 bp, Homo sapiens
tagtcaagcttctgtttcttggcacagaaactttgtttttcccaggcttgttgatgtcgcattgtataaaatggcagtaaatgtgcaaggaaattttataycagaggattagccttcaaggttatttacaagggctcagtttaaattataaataataaaaccaaaatattttagggatacattttcctcattgggactgaa

SEQ ID NO: 16798 - DNA, 201 bp, Homo sapiens
cagttgctttccaaggacacctagacaagatggaaagcttaacgtgaagtaattaaatttgcatctgctctgtgacaggactctaaggacttttcttcccsccccctcatatatgaatctcattgtagagctcctaccgtctttgaccatacaacatctaaaaaagggaggatgtggacaggtaaacaaacattggttcag

SEQ ID NO: 16799 - DNA, 201 bp, Homo sapiens
aagagttcacgtgaggtctgtgttctagtcctgccttttcctcccacccatgttgatcagtgtggccttaaatctttttttgggacggtcttactctgttrcctaggctagagtacagtggtgtgatcatagctcactgtagcctcaaactcctgggctcaagtgatttgcccacctcagcctcctgagttgctggaacta

SEQ ID NO: 16800 - DNA, 201 bp, Homo sapiens
aggttgaagcctttaccttgcacacatagtttgttaggtaagagttttatttcaagaagactttgcggggaactgtgatgactggggagtggttagaacartattttctaataaagacaaggacgaaaagagatctcagcaggggaggagagctttctttgaccccttactatatttgagtgggtggacactaattctcag

SEQ ID NO: 16801 - DNA, 201 bp, Homo sapiens
ctcaaaatgaaaagataatagcacagtcatgtgttgcttaatgatggggatattttccgggaaatgtctcattaggtgatgttgttgttgtgtgaacatcrtagagtgtacttacacaaacctagaaggtagagcctactacacacctaggctatatggtgtagtctgttgcccccaggctataaacctgtacagcatgtt

SEQ ID NO: 16802 - DNA, 201 bp, Homo sapiens
tccgggaaatgtctcattaggtgatgttgttgttgtgtgaacatcatagagtgtacttacacaaacctagaaggtagagcctactacacacctaggctatrtggtgtagtctgttgcccccaggctataaacctgtacagcatgttactgtactgcacactgtaggcaactgtgacacaatgataagtatttgtgtatcta

SEQ ID NO: 16803 - DNA, 201 bp, Homo sapiens
cagtttacgtatatgttagttttgggcacaggcgcctgatgtctgggttagatttggctctgttgcttactaatgatataaaatttgacaaattacttaayctttctgagtctcagttttttcatttgcaaaatggaaatgataatacctttatcttatagactgatttttaggattcagtaacatagtatatgtgagcag

SEQ ID NO: 16804 - DNA, 201 bp, Homo sapiens
aattacttaacctttctgagtctcagttttttcatttgcaaaatggaaatgataatacctttatcttatagactgatttttaggattcagtaacatagtayatgtgagcagcacctggcatatagaaagcacccaataatgttggctgctgtatcattatcatcattatcatgagtcagaaagtgtcgaggttaagagata

SEQ ID NO: 16805 - DNA, 201 bp, Homo sapiens
ctttgcagtggcaggggttggcatgagggatatactgtctttgtgcctcagttttttcatctttaaaatggagatgcttgatatatggtgattgctggatkaagtgagataatgttgatggaatggttgttggcatggcaggtcgtaagcactaaataaacatagctgttgttcttattgccactctggggggaccagttc

SEQ ID NO: 16806 - DNA, 201 bp, Homo sapiens
caacaattttcttgtctttgtagagatcttggattgtgtcttcattcccatatcattgagtcagttttaatgctctcatttcctttttttccccaagagtyttgctcttgctttgtgtttcatgctattgtttattagttgggttgctcatcctgaaaagcagcagcatatcccaaggaaggagaggcagtaggcaggcag

SEQ ID NO: 16807 - DNA, 201 bp, Homo sapiens
tctttgtagagatcttggattgtgtcttcattcccatatcattgagtcagttttaatgctctcatttcctttttttccccaagagtcttgctcttgctttstgtttcatgctattgtttattagttgggttgctcatcctgaaaagcagcagcatatcccaaggaaggagaggcagtaggcaggcagagaatttcccattg

SEQ ID NO: 16808 - DNA, 201 bp, Homo sapiens
catggggctgtttttcaccatcatctgaaacaccagcgttgccaactggagctctgaggtctagctttcgtacattgccccagcatccgagcttaaacatrtggggcaggccatcttttcccacagcagcctgaacattccagcggtcgcccacatgactgtccccgagagtttctgcagtggcaggcaggctgctgtggc

SEQ ID NO: 16809 - DNA, 201 bp, Homo sapiens
aagagctccttgataaagcacataactatttcttagtttatccattttatgagtttataatttatgtaatagttcttaaaagaagatagccttcattgttytttgtttttgtaatacttatttttcaagtcccttctttattcactgatttgacagatattttgtgggcaatggggatacggtgttgaactaaacaggcga

SEQ ID NO: 16810 - DNA, 201 bp, Homo sapiens
agagcagctgcaaggaccgggtgtcccaggataggctactttagggtcactctctgataatgaaaatgattaccaaattatatggaagtttaactgcaatmgtgagtgagaggagggtggggcccggcgtattaggtttgataaatgaactgtgaagaggcccatctggctctcaacatcttttctccccctctttcccta

SEQ ID NO: 16811 - DNA, 201 bp, Homo sapiens
ggataggctactttagggtcactctctgataatgaaaatgattaccaaattatatggaagtttaactgcaatcgtgagtgagaggagggtggggcccggcrtattaggtttgataaatgaactgtgaagaggcccatctggctctcaacatcttttctccccctctttccctaccaaggggaaacattttaaaataacagc

SEQ ID NO: 16812 - DNA, 201 bp, Homo sapiens
ttggacagtaataaattgatggacatttgggtgggttgactttctggctatcatgaataatgctgctgtaaacattcatgtacaagtttttgagtgacatrttttcagttctcttgggtatatacctaggaatggaattgctgggtcatatggtaattctgtgtctaactttttgaagaactgtcaggctgtttttcatgt

SEQ ID NO: 16813 - DNA, 201 bp, Homo sapiens
tttttttcactgaaaaagttgctgtttactgaaaaaatgaagtcatatctacaaggaaggcttatgtagggcctggtctgaactccaggaagcatatgacsagatgctgtgctacggctctctttccagactgttgacagccattgtatctgtccaggtaccccatggcctggccagcaaaacctccacccctctgcccag

SEQ ID NO: 16814 - DNA, 201 bp, Homo sapiens
tcaatgaagggtaagtaaagtcaaagagaaaagaaggtcaaagggaagtggctgacataaaacttaggtgcagaactctgggtgcacaggggatgcattcmggaagggtgctggtgtggctgcagggtagagagaagggtgaaatcttcagaactttagaaggcagagtaaagagacgacggtttcagctgtggcagggtt

SEQ ID NO: 16815 - DNA, 201 bp, Homo sapiens
gctgacataaaacttaggtgcagaactctgggtgcacaggggatgcattcaggaagggtgctggtgtggctgcagggtagagagaagggtgaaatcttcaraactttagaaggcagagtaaagagacgacggtttcagctgtggcagggttttcaccttggcccctctttagctttcacagtagagcccatgggctgttga

SEQ ID NO: 16816 - DNA, 201 bp, Homo sapiens
attcattcccaactctttggtggacctctatttttagagcagaaacctaatttcacccaagttaccaccgtctctaattagaccagtaagaaagtttctcstgtttctgtcagtgcttgaccagttctggagtgttttatcccataaagcattctttaagcattagtgccattggagtctagcattgaccatatgggtcct

SEQ ID NO: 16817 - DNA, 201 bp, Homo sapiens
acctctatttttagagcagaaacctaatttcacccaagttaccaccgtctctaattagaccagtaagaaagtttctcgtgtttctgtcagtgcttgaccasttctggagtgttttatcccataaagcattctttaagcattagtgccattggagtctagcattgaccatatgggtccttaatttgtatctgagtatccagt

SEQ ID NO: 16818 - DNA, 201 bp, Homo sapiens
gctggtggcctcgggaaagctgccgaagccaaagtgaattgtctcatttctctgccttgcagccaacagagcacaaccccaaataaatactcagcctgacwtctaggccggtggattcaccatggagctccaggcagccaacctttctcagagtgcctgcttaaagcaaagcctgggttcagctccagcagctgatggggg

SEQ ID NO: 16819 - DNA, 201 bp, Homo sapiens
tttctttataaattatccagtctcactctgtctcccaggctggagtgcagtagcacgatcttagctcactgcagcctccgcctcccaggttcaagtgattstcctgcctcagcctcccaagtagctgggattacaggcacccgccacaatgcctggctaatttttatatttttagtagagacagggtttcaccatgttgac

SEQ ID NO: 16820 - DNA, 201 bp, Homo sapiens
tctcaagatcttttgttgatcttggtttcagttgctctggagaacaactgccttccaaagctcccttttaaagtaaattttctttttaatagctaattctmtttagaggtggaccaagccaagaatagcctccaagttcagtgaccatctttgcagtcatatacaagtgatgcaatcacaaaaagaaagaaacttaatttt

SEQ ID NO: 16821 - DNA, 201 bp, Homo sapiens
ttctccacgttgtgaaagtttctttctgtgtgaccaggagtctgtttagcagaccatattgtgagtgaagggccagcgtttgttgcctgattttggcaacrctgggtagtcagctgggatgtaattaagactctgagaacaggctgtcttctccacgggaagggcatgttagatggtgctgggatttggggctgtcagttt

SEQ ID NO: 16822 - DNA, 201 bp, Homo sapiens
actgttagaagcagtttctttatatgatttataatggctactggatattccatgtagaggatgtattacaatatgcaaaatcatttccttattgttggaamtttaagttgcttttgatttaacatagttataagtaatgctgcaattacatatttgcttatactgctttctcctttttttggattagatccttagaatcta

SEQ ID NO: 16823 - DNA, 201 bp, Homo sapiens
atacatttttcaaaacttgtagaacttatactaaagatctgtccactttaccgtatgtaaaataagtgtaaaatgagtgaaatggactaggtagtaaactkcagagcatatacctcatttaaaaggggcgaatgataagctctagccaatggcttctcttcagaatagaggcccagtgttgctacattttcaagtaaagcc

SEQ ID NO: 16824 - DNA, 201 bp, Homo sapiens
caccatgagtaaatgacttgcctgcaaatgatcatgcaaacctttcactatccttagaggggaatgtttctgttgtgtgtgacaagaagaaaaggcatttyatttgtacagctactcatataaattgcaaaaaccatgggagctgaagtccaaggtacagcaatagcatataacgaaatgaacttgatgctgtattaaaga

SEQ ID NO: 16825 - DNA, 201 bp, Homo sapiens
tttgcccaaagaagttttcatatttattttatgctaatttctccattattttatctttaatattttttgactttccaaatttaatacaattattgctattrcacagaatttagtcatttgtataaagatttggtctggtggacttgtgtggaaagaagcacaaaatagattttgaaagcatatctcacattttacttggca

SEQ ID NO: 16826 - DNA, 201 bp, Homo sapiens
tcacattttacttggcaaagttattctaaatattggctttcttccctaaagataagatctttctagatacagatattgaaaatactcagttagcatatacmgagtggctcccttcagactctctgtactctacgaatcttaccctcatcctgtcattctacagtcctcaaaaaaaaaagacatgtaatttatattttaaaa

SEQ ID NO: 16827 - DNA, 201 bp, Homo sapiens
gcactgttaattgttaagctgctcttgctggtgtctgacctcacggggtttgtgctgtgacagctctttcatgttgatgaggtaaatgagtctctgccatsatggccgggagaagccaggacagagtatcagatcgtgtttcaccaggaaaacaaggttgatttactgtgttacacgagggtgaagtggacccagcaccac

SEQ ID NO: 16828 - DNA, 201 bp, Homo sapiens
gattgtaacccattattagagtattgaggacctgagttccccactcatgttgaacttgaggcaagactgggcggtttattcccctctggctactctcccayttgtaaaatgaggcgacatctctaatcattgacaccaaacaagaacatagcctaataataaaatgaatggtgttatatggtcatgaagaaggttcaagac

SEQ ID NO: 16829 - DNA, 201 bp, Homo sapiens
aggcaagactgggcggtttattcccctctggctactctcccacttgtaaaatgaggcgacatctctaatcattgacaccaaacaagaacatagcctaatartaaaatgaatggtgttatatggtcatgaagaaggttcaagactggaatctactccataaggaaggacacaaaaagattcaacagtgatttagacaaatct

SEQ ID NO: 16830 - DNA, 201 bp, Homo sapiens
ctattcatttagatccttccctgtttctacttttctcgttctctccccggagggtttttatgacgttgtaatcatttataattttaaaatgtcttcaatcrtgcttaaaaacagcacttgattttaatgggtactgcttaaccatagaaagattgtgtctgtattactgtcggttcttacaacaatactttggaacgaaag

SEQ ID NO: 16831 - DNA, 201 bp, Homo sapiens
ttcagaaaacttgaccgagaagggaagtacgcttctagggtagcatcagagcagaacatggggaaagggagacatttcacaagaagggagagtcaagatcwtgtgtatttatttgccaagggcaaaaagcagtagtgaggaaaagcaaacaaaaaccagttgaagacacagcaacagaggagaatgattgacaaagtaagc

SEQ ID NO: 16832 - DNA, 201 bp, Homo sapiens
tgaagggtgttgacagccatcatggggaatgctgatgcttgctgaagaagtcatgcaataaatcctctttagaaataaacaaaaagcagcttttgagaacycggcttttacccaagaccaaaacctgtcagccacaggcagaagtcattaggcaggatttatatgtgctggtatccaacactgagtcaaaaggagatccgt

SEQ ID NO: 16833 - DNA, 201 bp, Homo sapiens
gctgattttttatgtggcttttcttttctttctcctgtttggttgcaaacttattttgactgaggatttacttgtcacctcatgttgacatttcaagttaytgcattgagaaaaacataggagaaagcaaacaagcaagtatattccaacggtcaacaggcacagaagtcatactcacatttcaaagaaaaacaggagagt

SEQ ID NO: 16834 - DNA, 201 bp, Homo sapiens
ccttgccccgaaagtaaggcagctctgcagaactagtatttgtgcccaacgaagtgggaagatatgaggctgatagacttttctctctcttcttggttggyggcactctggtagtgcttggttagcgataatggagcatctcatggctttgttatgtgtcatagtaggctattgtgtgacatagagacacctggcttttgt

SEQ ID NO: 16835 - DNA, 201 bp, Homo sapiens
tggcttttgtacacgccagagcaaaattcaactacaacatccagaattgaagagaaggatattggcaggtacatgcctccttctcaaaccagagatttatrtatttaaaaagggcttttctaagaactcaatcttgattatttgttccatgttgggccaaaccagtgcattattgggaagataatgagtggcattcaccca

SEQ ID NO: 16836 - DNA, 201 bp, Homo sapiens
gtctcactttccactttgaattactcaggctctgtgcatctctttccactgcacagcgtagcattttgaacacttcactactcattagcacctccagtgaragatcagaaaagaaggtggctgggaggggaggattgaagaatgcagattagtcaaattgttttttgttttatctagttagagaaacagctgaaattactg

SEQ ID NO: 16837 - DNA, 201 bp, Homo sapiens
aataagccattaagaagaacttctcagtaagaaatgttcagtctgtaaggtagaggcttttagaaattccatctcttaatttataataaaacagcttttawtccagaatcatctaaatgggtcttgaatccttaatgaaagtctgaaggagtttagtctggatctcatacctgctcctccattaggggaggccagagcccc

SEQ ID NO: 16838 - DNA, 201 bp, Homo sapiens
ttattctggtggctccacaacatcaccaatgttcatggcccctttggtcttgaggttctgctatactttgacttggcttctggcttcaggtttccctcacrgtcacaaaagaactgctgtggctcctaatggctcacctacattacaggtaggaagaaggaagaaagggagggaagggtataatgtgcctggcagctgagc

SEQ ID NO: 16839 - DNA, 201 bp, Homo sapiens
tgtgaccatgagctatgtgactcctaagctgtaagcaattatagaaaagcaaagcaaagcaaagcaagttatgaaacaataactggttatgatttaactaygcccataccttagcaaaccttaagtccttatcacaattctaaccttgtgggcttttactaatttttttaaggtggttttataagacatgggcagacagat

SEQ ID NO: 16840 - DNA, 201 bp, Homo sapiens
cttatctcatataggtctaaggaaggaagatttccactgtttagaccggaagaccctgaggacagtatcctttctggctgccctgctgtcatatgagtccrtagggggcaaaggtgaggctttcctgggcttgtgattcccaggatgtctccacttctagggccacattagctaaatggtaattatgaaaatatccagggc

SEQ ID NO: 16841 - DNA, 201 bp, Homo sapiens
aatgccctccctgtcagtgtgggctgacgcttctgatgaattgagtaagggggaataaactaggttacaaaaggcagtgtggccacttatgatctctttcygtctggactactcacgctgggagaagccagttctacattgtgagcaaccctatggagaagcccttaagttgctgaagcctccagccaacagccatgtcgc

SEQ ID NO: 16842 - DNA, 201 bp, Homo sapiens
gtgtgggctgacgcttctgatgaattgagtaagggggaataaactaggttacaaaaggcagtgtggccacttatgatctctttctgtctggactactcacrctgggagaagccagttctacattgtgagcaaccctatggagaagcccttaagttgctgaagcctccagccaacagccatgtcgctgattttggaaggcga

SEQ ID NO: 16843 - DNA, 201 bp, Homo sapiens
caacttgataacgtgaccatttcatatgccttgagaattaaggatagtgatggtggaatgatcaaaaaatgtgctgggtaaatgttcatctctgcccaatyggtggactacaaattttccacttttaactctcctcttttcaaatcgtactctgggttcaaccgaaagactcagtgaatgaagaagattggataaaatgaa

SEQ ID NO: 16844 - DNA, 201 bp, Homo sapiens
ttgaccatagacattggcctttcaaggggatcatctggttttagaggctttagtctcctttgagtaccctggatgtttgctatgtattatgctaaactaaygcatgattacattgaccctatgattatagtgacctaaattggcaagtttctgtcacttataaagtcaaggtagtaatgttggaagggaaactgtagtgag

SEQ ID NO: 16845 - DNA, 201 bp, Homo sapiens
attggcctttcaaggggatcatctggttttagaggctttagtctcctttgagtaccctggatgtttgctatgtattatgctaaactaacgcatgattacaytgaccctatgattatagtgacctaaattggcaagtttctgtcacttataaagtcaaggtagtaatgttggaagggaaactgtagtgagactctcctttgc

SEQ ID NO: 16846 - DNA, 201 bp, Homo sapiens
accacagagaaagccagttgtctcctgctgaaggggtggccaagcataaagcattccttccagttatttatactgcagccacttagctaacagtatgtacrgggctactggcagtcttgagctgggggaggggaaggattctgctgtgcatctgaatttgaaaatcttgagctttgaaataaaagcagactctgaaatcta

SEQ ID NO: 16847 - DNA, 201 bp, Homo sapiens
tgcaatattccttaacattgacagttacaaagaattattctggttggagtttaaagagagaaggaccttattaggctgtagttgggtattctgggatatgygaaatcaagtgagttaaaacactaggcacatagtaggttctcaatcaataaaccaataattgttgatccaccaaaaattcacctttcttcctctcctacg

SEQ ID NO: 16848 - DNA, 201 bp, Homo sapiens
tgtttattatttttgttaccaaagcgatgccctggaaagaatcgggatttttgagtgagtgatgtgatgtggatttaaatcctgtctttgccacttagttstttcacttccagcaagtcctgaacctaagactcaattttttctctcaaaatggggctcatgatgatttacttcgcagatttgttaaagcttgtaagcatt

SEQ ID NO: 16849 - DNA, 201 bp, Homo sapiens
ttatgggtcaaaattttaagcaaaagctgaggaaaacaacttcagttaatcggcctatgtgattatttgacatatgtgattaactgactgaggtaaggagygtcattattatatcataatcatcattatatataaaggaactccaggctaagactgccctcaaagaaatcttaaaaatcatggattgatttgcagatttag

SEQ ID NO: 16850 - DNA, 201 bp, Homo sapiens
taatcggcctatgtgattatttgacatatgtgattaactgactgaggtaaggagcgtcattattatatcataatcatcattatatataaaggaactccagsctaagactgccctcaaagaaatcttaaaaatcatggattgatttgcagatttagtgggatatgaaaagctgatgttgtgcctgaataagataagcattct

SEQ ID NO: 16851 - DNA, 201 bp, Homo sapiens
cagctccaaggccctgaactaaaactgcaggaagtgcaatagagaggcaacccacggggtgaggggccacactaaatgggcaggctctattatagcccaayagaccgaataggacctggtgataaataggaacgaagcaggccgcacagagagagcctggacgagtttcaaactggaacgtgtacgtcctatctaaggagg

SEQ ID NO: 16852 - DNA, 201 bp, Homo sapiens
gaggcaacccacggggtgaggggccacactaaatgggcaggctctattatagcccaatagaccgaataggacctggtgataaataggaacgaagcaggccrcacagagagagcctggacgagtttcaaactggaacgtgtacgtcctatctaaggaggcagtcgcgactcggctctggccagttaccgtcatggcagagta

SEQ ID NO: 16853 - DNA, 201 bp, Homo sapiens
ggggtgaggggccacactaaatgggcaggctctattatagcccaatagaccgaataggacctggtgataaataggaacgaagcaggccgcacagagagagsctggacgagtttcaaactggaacgtgtacgtcctatctaaggaggcagtcgcgactcggctctggccagttaccgtcatggcagagtattggcccagata

SEQ ID NO: 16854 - DNA, 201 bp, Homo sapiens
ctctattatagcccaatagaccgaataggacctggtgataaataggaacgaagcaggccgcacagagagagcctggacgagtttcaaactggaacgtgtaygtcctatctaaggaggcagtcgcgactcggctctggccagttaccgtcatggcagagtattggcccagataagcagatcttcccatttttcaagcagagt

SEQ ID NO: 16855 - DNA, 201 bp, Homo sapiens
atttatttttctcttctttttaggaactaattcacattttttaaatattgcaagagtcattactatttaggccaaaataaatacctgtagatttaatgtarcccctgagccaccattttgtctcctctgagccagagccttaacctgttccagttgaatctgttggtcgctctccataccagtcataagatagttttcatg

SEQ ID NO: 16856 - DNA, 201 bp, Homo sapiens
tgaatcccagcctttccatgtacaggttaagcatccctaatccaaaatctgaaatccgaaatgctccaaaatccaaaactttttgagcaccagcatgatgytgaaaggaaatgcccattggagcatttcagattttggattttgaattagtgatgctcagccagtgagtataatgcaaatattcccaaatctgaaaaagtc

SEQ ID NO: 16857 - DNA, 201 bp, Homo sapiens
gttactgggattattacatgagtaaagcacttacagtgccatctggcacatagtagatgctcagaaaatgttggcaattaacaattacaacattagaaaamagaaaaagggctgggcactatagcttatgcctgtaatcccagcactttgggaagccaaggtgggaggatcccttgaggccaggagtttgggaccagcctg

SEQ ID NO: 16858 - DNA, 201 bp, Homo sapiens
ttttggcaaatgagaaagcatctgggatccgcagtgagggcctaagggtgtcttttctacaaagagctactgtcgtcctccaccccaccctgcctttgccyccatctctaccaggcacgtggcaaggacatggccttgcttattttccctgttggaaaaagccttcttcccagagccagggggctttgagatgaggtggcc

SEQ ID NO: 16859 - DNA, 201 bp, Homo sapiens
gaccgttatgatagctgtaagtatgactgggtgactatttacttgtaaagttgtccacagtgtcatgatagcagtgacaaaagtccaaaaagacacattayaaattcattgacttgttcttttcagaggatttagagtgtcaagggaaagattattataaactagactgcaaatttttttcaccactcgctataacagatt

SEQ ID NO: 16860 - DNA, 201 bp, Homo sapiens
acaataaatgtatctatgacaaacatggggatgtggtattgcatattcgattatgtccatttatctttccttcttctgggtgagaggggagatgaaaatgragctaccttggagttcatgttttcaccttgattctccgcatttatagcatactgattgaaagcatggctgccagaaccatattacttgggcttgagtact

SEQ ID NO: 16861 - DNA, 201 bp, Homo sapiens
tagtgaaaatgttctgaaattaagtagtggtgacgattgcataactctatgaatatactttctggcttgtatacttttttgaaggggaaaattgtgtggtrtgttaacgatatctcaataaagctgctattacaacaaaaacaacttctttggctttctttctgatctttttccctgaatcgtttctgacctcttccccta

SEQ ID NO: 16862 - DNA, 201 bp, Homo sapiens
tttatatgggttaaacctatcaatatttactgtactgggaactaaaacaggaacttttaaaagcctttattgatttaaaaatagcaaaaccccttcattamaagttaatgtaacattttttatgaaaaataactcttttccaatgtaaaaaattagcaagaagtgtgccattgttttacttttctgcacatctctttactg

SEQ ID NO: 16863 - DNA, 201 bp, Homo sapiens
caatgtaaaaaattagcaagaagtgtgccattgttttacttttctgcacatctctttactgtctagcttgatgcttgattcttatacttttttgtttagtygttgaaatatgttgttttggttgaagtatatgaacaaaatctggcctcagacattaatggaaaaagggagtattttaattgcttcttcagctattaaatg

SEQ ID NO: 16864 - DNA, 201 bp, Homo sapiens
agtttggtaccgctggcttgattagtgacaaggcacctgcagttttacccagcattctttaaaccgtcagtggaaatgtccacacggtgaaaaaagcaagyaatagtattattctgaaaatagtattgatcttgtggaacctttgccaatctactgcactatgccaattaggaagatttgagtagctaaaaattccaagag

SEQ ID NO: 16865 - DNA, 201 bp, Homo sapiens
gtagctaaaaattccaagagtggaataatagttttattagttatatcttgaaggccaatttccttttttaccctggaacttaggctaagtgaggcaacctrgaggagaaaatttctctcctgtcctgagattgctgttagcccagggtcggaattcctggggcctgattttttgagtttaagaagcacagggaggattttt

SEQ ID NO: 16866 - DNA, 201 bp, Homo sapiens
gcttggcacacagaaactgttttaatttaacagtccagctcctttaatagatcaattctctattgtggtttgaatttggtgcactcccaatttactctaawcttctacgggcttccttggagaaactggggcagagatgccgaagactcatttcgggtacaatttagagtttgtttatttatataaatgtaaggggtacca

SEQ ID NO: 16867 - DNA, 201 bp, Homo sapiens
agatcaattctctattgtggtttgaatttggtgcactcccaatttactctaaacttctacgggcttccttggagaaactggggcagagatgccgaagactyatttcgggtacaatttagagtttgtttatttatataaatgtaaggggtaccagtgcagttttgttacatggatatattgtgtagtggtaaagtctgggtc

SEQ ID NO: 16868 - DNA, 201 bp, Homo sapiens
atggctctgatgttgttggaagtgggaaagcaggttaataggttcttcttaatggaaaatgcagccaatattggccaacttactttgatttcggtagtcayaacaccaccctggaaggcaccctagatagaggtcacttgctaccactcattttacagatcaggatactaaggattttcctgattttaagcattaagtatg

SEQ ID NO: 16869 - DNA, 201 bp, Homo sapiens
ggcaccctagatagaggtcacttgctaccactcattttacagatcaggatactaaggattttcctgattttaagcattaagtatggatatccctgttggtygaagttaaattggtcaactagaatttaaaagcaaaaattaaaaaaaaattattttgtattaggtttcaaaggaattgttgtcagtaggagaagcctgatt

SEQ ID NO: 16870 - DNA, 201 bp, Homo sapiens
ttccttttacgctgactcatacagtttcagcagattacatttgaggcctaatgttgaaatctcatctgtaagtctggtatatctaactaatcatataaacrtctttcatcttagactgtgtagcatgtccctagtagaccaggtgggccaaatgacattatagttaaatcaagccaataaatatatgagaaagaaggcaaa

SEQ ID NO: 16871 - DNA, 201 bp, Homo sapiens
ggtatatctaactaatcatataaacatctttcatcttagactgtgtagcatgtccctagtagaccaggtgggccaaatgacattatagttaaatcaagccrataaatatatgagaaagaaggcaaatgagcgtagactccatagtgaatgatggaggttccgacgagtcaaagacactgaactattcattgctattggttt

SEQ ID NO: 16872 - DNA, 201 bp, Homo sapiens
gacactgaactattcattgctattggtttatggaagagcaaacccagatatgtgttatgctgattctgtgtgattggctacttccaggattgaccctgttytcctgtcctgctcaagtctccttccttcacttaaccatatattgtgggtactcagaaatgccatgcttttgtttagagtagcaggattggtgttgaagat

SEQ ID NO: 16873 - DNA, 201 bp, Homo sapiens
ggtggttgtaggctacttaaagagatacctatacacctgcagttaaaatccaagtaactcagtggagagcctggtccttcgttattatgtctcagattgawgttttatattttacagcatgatgaaattacatatatgatggttaggttaggttgcaagtcttggaatatatgcagaggaataactttattacaatgacta

SEQ ID NO: 16874 - DNA, 201 bp, Homo sapiens
ggaagcagcatagcagagtgtaaatggcattgtctttgaagcctagttggataagctttctgcctcaatctatctgtgtaaggaacagggtttctctgaargtatctttgaaatactctaccatcagttcatatttctactttcacctaagtcaatattgaatcctctttggaaatcttggggtcatccttcctttctgtc

SEQ ID NO: 16875 - DNA, 201 bp, Homo sapiens
tatcccttttggctgtaggataaaaggccaagtgccacaggtttccagagcactatctgacgtaaccagcgtctcctcccagttctgacactttccatctmcccgctaccagctccatctatttgctgtgtagtttgtcagggatgctgtcttccatactcattcccctcccccagatttatgtgggggaactccttttta

SEQ ID NO: 16876 - DNA, 201 bp, Homo sapiens
tgcatagttgaagaagtattatgtggaaaatgataaatggataaagaataagtgtcattagcagcataatcttgacacggctgaagagtcaggagtgggaygaaaaatacacttcatttgtaggtgagatacacccttacatgatgagtcataatccacttaatctttttatgtaattactgtaagactctcaaaccatat

SEQ ID NO: 16877 - DNA, 201 bp, Homo sapiens
ctcttctctttgtcactttcaattcatggtcaacacctcagataggcattttgagaagcagggcagtcctaccacacttacctagtaaagtcattttttcwcattcagacttgactcattcatttttcttctgcatacttcctcccactttctgcatgtcttctataatatctcctgcactctgcctcattcagaacaggc

SEQ ID NO: 16878 - DNA, 201 bp, Homo sapiens
ggaagggaattgaccaatattactctcctccagtgacaccagtagaattattagaattttgtagaattacaatgtaataatacctcattcatccatgcacraatccatttattcattcctttaccatttactgagtaaattctgggcactcatattatagtcatgagcaaaattgccatggcttttgtgttcatggaactt

SEQ ID NO: 16879 - DNA, 201 bp, Homo sapiens
agtactctttaaatttcttacaatttcccagtctcaaaaatttcctcagaactactaatattttttctaactttatcttatgtcttcagtctgaaacaagraactagtttagcatttggaaatttcaccactttctctggcatctcaaataatgatgctgacctaagaaaatcgcttgaagggatttaacgctgtcctaat

SEQ ID NO: 16880 - DNA, 201 bp, Homo sapiens
ggaccaagacttaggagccctgccccaatcacgttgcttctcccagtttactcggggtgacctagacagctacatcaacacacagtctggtgaaatgcacrtgcgtaacttgaggatgtcaaccttttggcacagtctcatttcctctgcagaagagcggctagagacattatactctgttcccgaagtatatagactaat

SEQ ID NO: 16881 - DNA, 201 bp, Homo sapiens
acatattgaacatttatagttttataagtttcaacacacctgtgaaactatccccactatcaagataatgaacatacccattattccagaagtttccttgygcccctttgcaattcctcttcctgacatatctgttttctttttttattgttttttatttgtttgtagagactgggtctcaatatgtttcccaggctgatc

SEQ ID NO: 16882 - DNA, 201 bp, Homo sapiens
gaactcaacagtgaacatatttgggcctggcgctttggaaacatgttaattattgattcaatttctttaatagagataggcctattcatattattcatttmttcttgtaagagttttggcagattttatttctcaaggaattggttcattttttataggttttcagatttttgggtaaataactattgacatcattttaaa

SEQ ID NO: 16883 - DNA, 201 bp, Homo sapiens
agctttgctctaatttgagtttttgtactgtccagatcgcagcctacatagggcacatataaagtgtagaatttgtgtgtgtgtatatataattttcccamatctttcatttttagctatacatttctctcatgttccaaaatgctgtctgcttaatgttccaaagcatctccaactccatgtgtctagtatggaacgcgt

SEQ ID NO: 16884 - DNA, 201 bp, Homo sapiens
attcagatattgcagatatgttcatatacatcaaagctgtttcaatgtgtcaacgaactcagttcatttacctctgccaaggtggtatagtgtatgtgggrgtgcagagtgggggaaagtgaggaggggttgtgatttatgagaaactgtaaaagaggttagaattgggaaacaagtttttttcttagaggagtggcaaat

SEQ ID NO: 16885 - DNA, 201 bp, Homo sapiens
aagtatatataagtatatcatatttattgtatacttatatttatattattatacttgttatgtatctacatatatataatgtctacttataagtagatacrcatataatggaatatatatatatgtagtcacctacttataagggattgattaaagaatacaaggtaagtattgattccttggttattgttatttcttgga

SEQ ID NO: 16886 - DNA, 201 bp, Homo sapiens
cttaactcattcatgttatgtgcctggcccagtgagtatttgaatttgcaacctgtggatcctgggtttcatgcactggaattacctagagaagctgaacrttcctccttgtgctggagggctgaaaatgttgttgccacagaagctgcttgagtgtccaactgggcatatcttccagcacagtagatggaatactgggat

SEQ ID NO: 16887 - DNA, 201 bp, Homo sapiens
taatcaaaacatgtgtggagcctggacattgtgggcaggattctgctatagaatgaaagtcctgactgctttgaattaaaaaccttctccatcttctcacrcttctcaagaatagaaggaatgaccctggctgggagaccaggacacaatctgtgtattgcctctgtgaccttgtgaccttgtaacattgcattattccat

SEQ ID NO: 16888 - DNA, 201 bp, Homo sapiens
cagtctcactctgtcaccaggctggagtgcagaggcactatctcggctcactgcaacctctgcctcccaggttcaagagattctcctgcctcaacctcccragtagctgggattacaggtgcacaccaccacgcccagctaatttttttttttgtatttttagtagagacggggtctcaccatattggccaggctggtctc

SEQ ID NO: 16889 - DNA, 201 bp, Homo sapiens
gtctctgctttcatggagcttatatgctagtgggagagagacaaaaattaagtacaaataaataaacagaatatatgatagcaactagggtgagagtgctrtttttgataggatggcagggattgggccatttggggaatgaattgatgagaaagagaaagttgtgcaaagctgggagaggaaacatcatttgaaggacag

SEQ ID NO: 16890 - DNA, 201 bp, Homo sapiens
gtcccattggaaatcactggagtgttttaaggtagggagcgtgtgtgtggagtgacttactctgatttgatttctataaagatcactgtggctctgcgtgrggaatattggaaggccagagtagaattagggagaaatattgggaaaggaatgttctgatggcttggcccagttggtgactgtgcagatagactgaagggg

SEQ ID NO: 16891 - DNA, 201 bp, Homo sapiens
ctctgtgaattagagttgaagagcaaataagaaaggagctcttattgatttttttttttttttgagacggagtcttgctctgttgcccaggctggagtgcratggcgcgatctcagctcactgcaacctccgcctcccgagttcaagtgattctcctgcctcagcctccctagtagctgggataacaggggcccgccacca

SEQ ID NO: 16892 - DNA, 201 bp, Homo sapiens
aactattctggatgtggcaagtcagagttaagtaggaattcatgccaaccgcagcagtagtttgcaggttttagactgtattaatcaagacagaaacatgrcttttgttgtccttggggcagctcaaagcaactttgtggcaaccacactggctttctaaagctaaggctaaactctgcacagtctgcatctatttatatc

SEQ ID NO: 16893 - DNA, 201 bp, Homo sapiens
tagttttgtttatatttacttttatgattatcttcctttttttttttttttttttttttttgagacagagtctcgctcccaggctggagtgaagtggcgckatcttggctcactgcaagctctgcctcccgggttcatgccattctcctgcctcagcctcctgagtagctgggactacgggcacctgccaccacgcccggc

SEQ ID NO: 16894 - DNA, 201 bp, Homo sapiens
ctgcaagctctgcctcccgggttcatgccattctcctgcctcagcctcctgagtagctgggactacgggcacctgccaccacgcccggctaattttttgtrtttttagtagagacggggtttcaccgtgttagccaggatggtctcgatctcctgatcttgtgatccacccatctgggcctcccaaaatgctgggattaca

SEQ ID NO: 16895 - DNA, 201 bp, Homo sapiens
cagttgtgttggcatggttacagcttagatagatagatagatacatacatacatacatacatccatacatacatacatacattcattcatgtgtttgtgtrtgtgtatgtgtgtgttactcctccttaatggacaaatggtgatatggtttggctgtgtccccacccaaatctcatcttgaattatagttcccataatccc

SEQ ID NO: 16896 - DNA, 201 bp, Homo sapiens
tgtctgaaattcattaaaccttcgacacaaagtgcagccattttaatgctgaatgatattcatcactgtctgaaatgggcttatttatgtacgaatgtttrttcctatctcttcctccattctcccaaaatgtaaaccccataagaacaggaatcttgtctgtcttagtcacactcagtatccttagagccttgtgtgtag

SEQ ID NO: 16897 - DNA, 201 bp, Homo sapiens
gtaaggttcaggagaccatcaggatgaaaagatcatgaagactattgcaattagaacacatctcaccggtgtatttcccacagacaagcagaaatgctatraaaggaggcataatacagtcatgaaacatctaaattttccttttttttttttcttcttttttattttttagatggagtttcattctcgttgcccaggctg

SEQ ID NO: 16898 - DNA, 201 bp, Homo sapiens
gattaaatctggatgatcataatatccagatgcattaaacaatgaccttctcaaatcataacggaacagagatgtcacgtggctctggccaaggacgtaartgagttcgttcaacaggcattttagttctggtgccaggtcattggggacagagcagagatacagcctgattttcctcagcatctaccgccccgtcagaca

SEQ ID NO: 16899 - DNA, 201 bp, Homo sapiens
agcacttaataaatattttagataataagcagttaataaaatggtgttgagatttagggtgagaaaaagtggtcacagaataatcctggtgtatcaggacmcacattattattttttgttttttattaaagattgttagtaatttgagcttgaacttgaaaatcttgactttagagtttgatgacatttgttttatttggt

SEQ ID NO: 16900 - DNA, 201 bp, Homo sapiens
tagaactcttcttttcatgaatcattgttgttctttaggttgtaatgaagttttaggcctcagcttccctgaactggagtgtttttccttcaccttttccrgtctctgggttgcatcgccagactgtctctaagcccaacaaacgcgttccttccaggcaaaagcaggagatgacacacaccatgagccagattttccatg

SEQ ID NO: 16901 - DNA, 201 bp, Homo sapiens
ttgctctttaggaagtttggtggggaaagaaaggatgcagatagggaatctcaggcacatagaggttaagtaacttgctcaaggtcacacagtaaccttargtaggcaggataagctctggttctggagctggtgctcttcatcattattttaggctgtactctcccacctttttttctttgtggttgtaggtggttgtag

SEQ ID NO: 16902 - DNA, 201 bp, Homo sapiens
attactatttcctgagtccttaccatatgccaaataccgttgtacattgtacctgcttcacataaattatttcatctcattctcacaacattctgtgaagygcgggtactttattatctatccctgtttgccagataaggaagctgagacttcatacagtgacttacaagttcggacagcctccagcaaacacaggaaaca

SEQ ID NO: 16903 - DNA, 201 bp, Homo sapiens
aagtgcttcctgccatgggcctttgtattttctcttctctctttttgtagaactttcttcccccaggtatctgcgtggctggttcacttgcttcctttagstctctatttaaacatcctattctcaggagactttctctgattacccgaaaatagtactccctacttcatggcctgctggcgttctctgtttctttcatcc

SEQ ID NO: 16904 - DNA, 201 bp, Homo sapiens
ttgcatgtacttaaaaacacttaaaaaatagaagcagtataaagtttgatctcccaaggagccatcatagatctatagagggaacaagaatagaagtaccrcgaggcaaactggaagtcacttgttttaaagtaattaagataaccatgttgacttttatccatactttatgtatagccttttcaaaattagaaggctgtg

SEQ ID NO: 16905 - DNA, 201 bp, Homo sapiens
aattgaaatctggtaatagatgtgaaacgttaaaagaaaatcatagttccagaggagggagtattacattcagaccacttgagccggctgggatggtggtraaatggcagatgtggtttttggggcccttggatgctgaggagtatgatgggatgggggatctggggaagaacattagaatccagaaactaaaaacaaggc

SEQ ID NO: 16906 - DNA, 201 bp, Homo sapiens
attttgcatgacttggggtaaccgagtttgtcacagtgtcacacaacccagcgactctagaggcacatctgagtgctgtgggtttccttctccaagcttcrtaatcccataaacaaccctctccaaataggcttattagggctgtctattcacttccccagagttgaatgatccaaaggacatcgggagaagctgtgtgaa

SEQ ID NO: 16907 - DNA, 201 bp, Homo sapiens
tgtatctttgggccacgtgaccaaaaagatggttaccagtgggttttgagttttcatgtctcaggtccaacaacctgggtagagacagaatctctttaggrtctcaattccagattcccagggagagaattctgattgtttcacccacttctggaactaacagctgtggctagggagttcaggccaccccgagcgagcatg

SEQ ID NO: 16908 - DNA, 201 bp, Homo sapiens
aactgttccttacagtttgaaaattatttttttcaagtcattataattggttttctttttatttatttatttatttatttatttatttatttatttatttwttttaaggtgcagtgtcactatgtcaccaggctggagtgcagtggcgcgatctcggctcactgcaacctctgcctcctggattcaagcgattctcctgcc

SEQ ID NO: 16909 - DNA, 201 bp, Homo sapiens
tatcggccctcgtaccagggaagagacttgcgctgtgatttctgtctttgtgctcttttttcactttgtggctgcaaggtgtagtctcaggaaggatatasaagaatggaaaatgagctttgaaatcgcttttcttccattaatggtaattgcttcacatgtcataaccagtcacatatttcaaaaagtttagtcagctgt

SEQ ID NO: 16910 - DNA, 201 bp, Homo sapiens
ttgttgagtagggattaactttattattaggttttcaaatggacgggcaattggcacaacaccttttatggaataaaccattcttgcctccactgatttgraaagacacttttatcatatactaaatttgcagaaatttatgtgtcaggtttttttttgcctaattaccaaaactttgtgtgtttttagatattatagggc

SEQ ID NO: 16911 - DNA, 201 bp, Homo sapiens
tcttgcctaaaatgacacccactcaatgtgccttccctgaccagctgagctacagcggtttccctctaccgcatcactagattttactttctttctttttktttgagatggagttttgctcttgttgcccaggctggagtgcagtggcatgatctgggctcactgtaaccacctcctgggttcaagcgattttcccacctg

SEQ ID NO: 16912 - DNA, 201 bp, Homo sapiens
tggcacacagatgattctgtgagacactgatgaatactttttatttgaaaatttatatgctttgctttttgtgtatatagggagacatttgaaattcactmtcagcaattttgaaatcatgcactctattattattaactgtgttacactgctatgcaatatatctcaaaaactgattcctcctgtctaactgaatatatt

SEQ ID NO: 16913 - DNA, 201 bp, Homo sapiens
catcactgtctggggagtcagtgaggaacagggcagagtgccagtgcatatgaagagggatttttttgccttcttggttcactgcatattcccagtaattsgaacaatgcctgacatgaagtagacataaaataattactgaatgaaagtggaaaggaaagtatacttagtctctgctttcatggagcttatatgctagtg

SEQ ID NO: 16914 - DNA, 201 bp, Homo sapiens
caaactcctttgttctcttttttttctttttttcttttgagacggggtctcgctctgtcgcccaggctggagtgcagtggtgcgatctccactcactgcargctccgcctcccaggttcacgccattcttctgcctcagcctcccaagtaactggggctacaggcgcccgccaccacgcccggctaattttttgtattttt

SEQ ID NO: 16915 - DNA, 201 bp, Homo sapiens
agtcctggtttatacttgttgttctggaataattgttaatagcatcccctttcactcttcaaagtgtcatactttgtatgatagaatatatacatatttarttatatacatatgattatatatatctacttatatatacttgcatatgtataagtatatataagtatatcatatttattgtatacttatatttatattatt

SEQ ID NO: 16916 - DNA, 201 bp, Homo sapiens
gcgttgcatgatcactagattgatcagcgaggttttaaaaataggacttgtatcacataagaagagggatactgaggcataattatacatttatatggtastttacatattttagagtgcttttatatgtgttatttgattttatcttcacataacccggtaaagcagagaagcattaacttcattgtaatagttgaggaa

SEQ ID NO: 16917 - DNA, 201 bp, Homo sapiens
tcattctcatcctgtagtagagggataacacaaaagtatggagtctcagggctccagagtcctcatcctctgagctacatctcctacttagccgaggtctyttcactctctgggcaagtctcctcactttgctgaaatggcagcgttcctggtacatgcccggtttagcctaggctaacctcttcttgagtgaacctaggt

SEQ ID NO: 16918 - DNA, 201 bp, Homo sapiens
tttagtagagatggggttttaccgtgttagccaggatggtcttgatctcctgaccttgtgatccgcccgccttggcctcccaaagtgctgggattacaggygtgagccactgtgcctggcctactattactttttagatgaaaaccccaaggcaacagacagattaaatgagatgcctcatatatgtgtgaatggaaagaa

SEQ ID NO: 16919 - DNA, 201 bp, Homo sapiens
aacacaatgtagcatgtagtatatgtgacacataccatagctacctgtgcaggagcttggtgagttctggttttgtctttcttcccctcaatttctatccyttcttttctttgtgcttcttccactctcctctttctattcttctaccatcctcatcttttcatttagaggcttggagaagagcttaaaacaataggtgat

SEQ ID NO: 16920 - DNA, 201 bp, Homo sapiens
ccaagtaggtttcattaccagtcattgcatagataaatgatgttccttatgttaaaaaataaaaccaaactaaagaaaaaaaattggactatatttggagktagaattcagatattgcagatatgttcatatacatcaaagctgtttcaatgtgtcaacgaactcagttcatttacctctgccaaggtggtatagtgtatg

SEQ ID NO: 16921 - DNA, 201 bp, Homo sapiens
gagagaaaatagacgtttcgctctcttccatattctcagcacccaagtgctttgcaaatagtatgtgctcaatacatatgtattcagtacctaagggtttyccagcttttccttcccaattattccctgctcccacagcagtatactcacacttctattgtaggacattcttctcttttggtttccattttggtttatact

SEQ ID NO: 16922 - DNA, 201 bp, Homo sapiens
cttgactttgaagttgtaatttgacaactctgtgaattagagttgaagagcaaataagaaaggagctcttattgatttttttttttttttgagacggagtyttgctctgttgcccaggctggagtgcgatggcgcgatctcagctcactgcaacctccgcctcccgagttcaagtgattctcctgcctcagcctccctagt

SEQ ID NO: 16923 - DNA, 201 bp, Homo sapiens
ttagccaggatggtctcgatctcctgatcttgtgatccacccatctgggcctcccaaaatgctgggattacaggcctgagccaccgcgccaggccaattaycttctcatttataagtaccatttttcttttgaagtgaacttatagttttaaaaaatgagccaattatcatagtatcattttttctttttttacttttatc

SEQ ID NO: 16924 - DNA, 201 bp, Homo sapiens
ttccaccatgagtggaagcttcctgaggccctcagcagaagctgatgctggtgtcctgtttcttgtacagcttgtagaactgtgagccaaataaacttctwtttttataaattacccagcctcgggtgttccttcatagcaaggcagacagtctaggacaccccccaaatgtgagctgcaccataaggcaaactgggaaac

SEQ ID NO: 16925 - DNA, 201 bp, Homo sapiens
ttgcccagtctggtgtgcagtggcacaatcatagctcactgcagcataaaactcctgggctgaagggatcctcctgcctcagcttcccaagtaactgggasatcaggcgcacaccaccacacccagctcattttttttttttcagttttgtagagatggcaccttattatgtttcccaggcttgtttccaactcctgggct

SEQ ID NO: 16926 - DNA, 201 bp, Homo sapiens
aggccgaggcgggaggatcacctgaggtcaggagttcgagactagcctgccaaacatggcgaaacccctgtctctactaaagatacgaaaaattagccagktgtggtggtgggtgcctgtaatctcagctactcgggaggttgaggcatgagaatcacttgaacctgagaggcggaggttgcagtgagccgagatcgcaca

SEQ ID NO: 16927 - DNA, 201 bp, Homo sapiens
caactgaaaataaaaattaaaggtggttatttcccccattactgaaaggtatatgtgaaatcttgcatttacttttttttaaatagactttaaacattgaytttcctttctctgggaaggcagatgtttgtgtaaccaggaaagaaagctgctctcaacagcagttttctaataaaaggcctacttgcttttccattttaa

SEQ ID NO: 16928 - DNA, 201 bp, Homo sapiens
aaagatatgccacatgacaatacatgattgtcaaatgcatttacagattccctttagaacaaaaactgttcttgaatccttctaatagaaggggttcgtaragaccattatgaagccttaaaatattaagaaactgaagtattattccataagaatgcctttcaatttagaaatttcaatgcaaaggagaaatctggttta

SEQ ID NO: 16929 - DNA, 201 bp, Homo sapiens
aggaaagatatgccacatgacaatacatgattgtcaaatgcatttacagattccctttagaacaaaaactgttcttgaatccttctaatagaaggggttcrtagagaccattatgaagccttaaaatattaagaaactgaagtattattccataagaatgcctttcaatttagaaatttcaatgcaaaggagaaatctggt

SEQ ID NO: 16930 - DNA, 201 bp, Homo sapiens
aaagtaaaactctaataaaggatttaaagaacagttcaagataacagtaggaaagatatgccacatgacaatacatgattgtcaaatgcatttacagattycctttagaacaaaaactgttcttgaatccttctaatagaaggggttcgtagagaccattatgaagccttaaaatattaagaaactgaagtattattccat

SEQ ID NO: 16931 - DNA, 201 bp, Homo sapiens
tttgtttgtttttcctctgatatgcaatgtagactacatcaggcctttatagtcaaaaccagaccaaccagttttgaccaagcacttcctctcttcaaggytatgtttagtgcatcaggaatcgaaagacatctaagacataaaccctatccccagagagtatactatctgttagggaagattagacattaaaaacatgaa

SEQ ID NO: 16932 - DNA, 201 bp, Homo sapiens
gtctctaggtagcaacagtgagaaaagcacttattaaagaatattttttcttctactaaattagtccatgacttcatttgtgctggtctctgtttgtcaaytgctgccaaaaatttttaactcatgcagtaaagtaagcttcgtaaatctatataattcaactcaacacttgcatgagaaaatatttcaggtaaccagtta

SEQ ID NO: 16933 - DNA, 201 bp, Homo sapiens
gagtcctttaccaatttttcttcctctctctacattgttattagtataaagatatttcttcattatagaaaacttggaaaattctagaaaagtctaaaaarttttaatttatcataatcttgtcatctcagaatgatcaatattaacattgtatcatcctattaaaattaaataacagcacaaataccttaattagtaatt

SEQ ID NO: 16934 - DNA, 201 bp, Homo sapiens
tctgtcagcagcacccttgtgaattaatcataattcaataggattactaatcaagatttgagatgaatgttttgatagagctatcagatttgtctaatctrtcattagttgacagtcgctgcaggcagagtgaaaacttggcaatagtagacctgtttctgatccctttggcttggcccaccagttgggtagcttcactga

SEQ ID NO: 16935 - DNA, 201 bp, Homo sapiens
taccccctgaagcaatcgtgagttaatgtctcttacatactccttgctgaaaaggcagagagtgtactcttgtttatagtgtattgttctcactgtatttstctccctaagtccctcttgtttttttgtatcaagactgagttctcacaaacaagctctttattaaattaaatggttcatgtagcctcattatccttctca

SEQ ID NO: 16936 - DNA, 201 bp, Homo sapiens
aaagatttaaaaaaaaaaatctgctttctgaaaatcccatgagtttaggtctgctgggtatttctatgcacagatgtcttcatcccagagacaagaagagwaattggatggtaagttgcaaaaagcatgcaagttctgctctgcctctggcctgagtaactgggatgtagccaaaatggagaatggtaccccctgaagcaa

SEQ ID NO: 16937 - DNA, 201 bp, Homo sapiens
tataggacattaggctttttgtaaaatcataaggtcaggataagataatgataccatctaaaattacacaagattttgagtacttagtatcctctgactgmcccagcaacccaacccaaaccccaacaagcatagctgaatttttggggttggcaaagccatgaatggaatgataggtttaggttcaggccccatgagctg

SEQ ID NO: 16938 - DNA, 201 bp, Homo sapiens
tcatctataggtaagggaaaactgagaagtgcttttcagctgggtacattgctgctctcaacaaaatcaggcctgtgtgagagagtagaaagggaagaatrgatgttaggaaggcaacctgcagtttctggcacaactcccttgtgtgaaggagacagtcttcagctctgtgaactctcctggcagcccttgatgttggcc

SEQ ID NO: 16939 - DNA, 201 bp, Homo sapiens
accactgcctatgacatttatcctagagataaatgttacttatttttggccaggtgtggtggctcacacctataatcccagcactttgggaggccaagggrggagggtcacttgaggtcaggagttcaagaccagcctggccaacatggtgaaatcttgtctctactgaaaacacaaaaattagctaggcttggtgacgcg

SEQ ID NO: 16940 - DNA, 201 bp, Homo sapiens
agacaccttgaagtatttgggtcacccagtaaccactgcctatgacatttatcctagagataaatgttacttatttttggccaggtgtggtggctcacacytataatcccagcactttgggaggccaagggaggagggtcacttgaggtcaggagttcaagaccagcctggccaacatggtgaaatcttgtctctactgaa

SEQ ID NO: 16941 - DNA, 201 bp, Homo sapiens
tcttgctggagacaaaaagaaaaacagaagcacctactgtacttgtgcactttctgttttacagtttcataaggatttttacaacataagtacatgctctrtgatattacatacctttccaccacttatataatcaagtgcaattatactgactgcttgaatagatgatgggaaaaatgacttgaatcaaaaattacacaa

SEQ ID NO: 16942 - DNA, 201 bp, Homo sapiens
taggttttcttgctggagacaaaaagaaaaacagaagcacctactgtacttgtgcactttctgttttacagtttcataaggatttttacaacataagtacrtgctctatgatattacatacctttccaccacttatataatcaagtgcaattatactgactgcttgaatagatgatgggaaaaatgacttgaatcaaaaat

SEQ ID NO: 16943 - DNA, 201 bp, Homo sapiens
tacattttagagtaaaataataaataaacaataacaaaaaatggctacaacagaagaaaacatgttcctggattgaagaaaccaacctagaaattatactrtatgcctcagaaatttaatactattttgtctttcctgtatgcagttggattatagagtacagatattgtctctttattaatgcatgatttataaatatta

SEQ ID NO: 16944 - DNA, 201 bp, Homo sapiens
gggaggattgaagaatgcagattagtcaaattgttttttgttttatctagttagagaaacagctgaaattactgcctcaaaaaaatttggaaaattatctrgcttatagtttatttctatagttattttcccactaattgtaaaaattaggagtattacattttagagtaaaataataaataaacaataacaaaaaatggc

SEQ ID NO: 16945 - DNA, 201 bp, Homo sapiens
ttgttggcatatctaccaagtactgggctttgtccaatgtggaaggtcctcccaggtagtgatcatcctccacaattcctttacattttcctaaaaacctrtctcagtgttgggcccttcaggtagaaaccaggaacacctcggtttctagattcctttggcatataggtttcctatgggaaagaaataggagagctggct

SEQ ID NO: 16946 - DNA, 201 bp, Homo sapiens
taacagttgatgcatttaatgggcatatgcaaaagttgttggcatatctaccaagtactgggctttgtccaatgtggaaggtcctcccaggtagtgatcakcctccacaattcctttacattttcctaaaaacctatctcagtgttgggcccttcaggtagaaaccaggaacacctcggtttctagattcctttggcatat

SEQ ID NO: 16947 - DNA, 201 bp, Homo sapiens
attctgttaacaaggaagaaggtgggaatggttgttgaggcaccaacagtgcctcccataggcatcatgatttttttatgcctctgccatactcatagaaycatatacatttctttagtaacagttgatgcatttaatgggcatatgcaaaagttgttggcatatctaccaagtactgggctttgtccaatgtggaaggtc

SEQ ID NO: 16948 - DNA, 201 bp, Homo sapiens
tgaatacctgaataaaatagattctgttaacaaggaagaaggtgggaatggttgttgaggcaccaacagtgcctcccataggcatcatgatttttttatgyctctgccatactcatagaaccatatacatttctttagtaacagttgatgcatttaatgggcatatgcaaaagttgttggcatatctaccaagtactgggc

SEQ ID NO: 16949 - DNA, 201 bp, Homo sapiens
tcctttgagtgctgaatacctgaataaaatagattctgttaacaaggaagaaggtgggaatggttgttgaggcaccaacagtgcctcccataggcatcatkatttttttatgcctctgccatactcatagaaccatatacatttctttagtaacagttgatgcatttaatgggcatatgcaaaagttgttggcatatctac

SEQ ID NO: 16950 - DNA, 201 bp, Homo sapiens
agaaggaaatcaattcttcttgtgtctccttcttaagagtgaggagatccttcctagaagctcccaactgaaacccctaaaccaagactggcaagggaaayggaagcaccattatcgactgattaactaagatttactcccaatctggcaatggagtcaacttcctttgagtgctgaatacctgaataaaatagattctgt

SEQ ID NO: 16951 - DNA, 201 bp, Homo sapiens
caacagagatagaaggaaatcaattcttcttgtgtctccttcttaagagtgaggagatccttcctagaagctcccaactgaaacccctaaaccaagactgrcaagggaaatggaagcaccattatcgactgattaactaagatttactcccaatctggcaatggagtcaacttcctttgagtgctgaatacctgaataaaa

SEQ ID NO: 16952 - DNA, 201 bp, Homo sapiens
aatgtgtttgcttccccttctgccatgattgtaagtttcctgaggcctcccaagtcctgtggaactgagtcaattaaacctctttcctttataatttaccyagttttggccgttctctatagcactgtgagaatggactaatacaatgggcacagtatcaaattgtaccctgactcaaattactgtaaacaatgccagttg

SEQ ID NO: 16953 - DNA, 201 bp, Homo sapiens
gttcccccatgctagtctcgtgatagtgagtaaattctcatgagatctgatggttttataaggggcttccccctttactgggttctcattcttctgcttcytgctgtcatgtgaagaagaatgtgtttgcttccccttctgccatgattgtaagtttcctgaggcctcccaagtcctgtggaactgagtcaattaaacctc

SEQ ID NO: 16954 - DNA, 201 bp, Homo sapiens
atgcagtgccttccagcccccaccttgcactcttaggcgcttctaggcaaatgtattctgaagcagaacacttgaatcaaagcacttcgcattttctttcwtatttagaaataagaattttccccaatgggcttctttcggtgatggcacgttagctcaccatcccatatgtgttaactatttttgttcaccttacccaaa

SEQ ID NO: 16955 - DNA, 201 bp, Homo sapiens
ctctttcctattttcttccctgtcccttgccccgaaagtaaggcagctctgcagaactagtatttgtgcccaacgaagtgggaagatatgaggctgatagmcttttctctctcttcttggttggtggcactctggtagtgcttggttagcgataatggagcatctcatggctttgttatgtgtcatagtaggctattgtgt

SEQ ID NO: 16956 - DNA, 201 bp, Homo sapiens
gttttttattgtagcacaagttgcttaatgttctctaaaaagcattccccacaaatagcagtaaatgcctctttcctattttcttccctgtcccttgcccygaaagtaaggcagctctgcagaactagtatttgtgcccaacgaagtgggaagatatgaggctgatagacttttctctctcttcttggttggtggcactct

SEQ ID NO: 16957 - DNA, 201 bp, Homo sapiens
attttgcagtctcagtctaaggtatccttaatactggatctgcctcacttaacaagctaaatgtctgtgtgttttatgttttttattgtagcacaagttgyttaatgttctctaaaaagcattccccacaaatagcagtaaatgcctctttcctattttcttccctgtcccttgccccgaaagtaaggcagctctgcagaa

SEQ ID NO: 16958 - DNA, 201 bp, Homo sapiens
acatgacaaacctggatgtttccccagaaaatgaaggcttctgacttgtcatgaaaaaaaaaaaaaaaaaaaaaaactggaagacttgtcctcttggacckagcaacagtcacttgtaacaatgggcagctgcccattttagatgaggtatctcctacctagttgctaccacccctcatttaggctgctttgctctttgat

SEQ ID NO: 16959 - DNA, 201 bp, Homo sapiens
ctcgcttcagcctccaactcctagccccaagcaatcctcctgcctcagcctctcaagtagctaggactataggtacacaccactgcacctggctaattaawttttttttttctttttagagacatggtctcactctaggtcttgcctaggctgttctcaaactcctggcctcaaaagatcctcctgcctcagcttcctaaa

SEQ ID NO: 16960 - DNA, 201 bp, Homo sapiens
aaaatatcagcattaacaggagtttgggagaagttgattccaaccctcacggatgactttgaggggcttaagacttcagtggaggaagttactgcagatgyggtggaaatagcaaaagaactagactcgtaaatggagcctgaagatgtgattgaattgcataatctcatgatcaaacttaacagataagtagttgcttct

SEQ ID NO: 16961 - DNA, 201 bp, Homo sapiens
ttgttttcatgcctgctaacacaacacccattctacagcccatgggtcaaggagtaatttctgctgttaagccctattatttaagaaacacattttgtaargctatagctggcattcctctgataaatctgggaaggataattgaaaaccttctgggaaggattcaccattctagacactgttaagaaaattcatgattca

SEQ ID NO: 16962 - DNA, 201 bp, Homo sapiens
gccctaaatcttcaattctatgaaggctgagagaagtgagaaactgcagaagaaaagttgaaaggtagcagaggatggttcatgagatttaagaaaagaarctgtctccataacataagtgcaagatgaagcagcaagtgctgatacagaggctgcagcaagctatccagaagatctagctaaggtcattgatgaaatggt

SEQ ID NO: 16963 - DNA, 201 bp, Homo sapiens
caaagccctaaatcttcaattctatgaaggctgagagaagtgagaaactgcagaagaaaagttgaaaggtagcagaggatggttcatgagatttaagaaamgaaactgtctccataacataagtgcaagatgaagcagcaagtgctgatacagaggctgcagcaagctatccagaagatctagctaaggtcattgatgaaa

SEQ ID NO: 16964 - DNA, 201 bp, Homo sapiens
aaaacaaaatgagtttacatatagtcataatatccataactagagatataaaacaaaaagctatggagattcttatctagtgaagaaatctcttttagaamgtttctgatgactttcagttgcaaagcatagctctttcacaatatatcaacccactttcaatgatttgagatttggagagggcccagccatagatttacc

SEQ ID NO: 16965 - DNA, 201 bp, Homo sapiens
atatggcaccctcaaacctagttgtaatagtcaggagaagaccattctagcctttaaaatcagtcctgttaaaaaaaaaaatcagtcctattgacatcaaygtttttacctccagttcctctccacccttctctacctcctgatttcatgtaggcgagcaatttaggacaatgagagtcacaggattttaaataacttaat

SEQ ID NO: 16966 - DNA, 201 bp, Homo sapiens
aaactgagagataggagcagaaaacaatggtggatgcctataaacggatcaagaaaagggagtgagaatttactggaaagaaggacaaatgagcatcgaawtcagcaggtttgggtttttccagagatcagtgcctgatactggttcccagatgatatctcccaagagcccggttcccagggtgtgttccagcctctgtcc

SEQ ID NO: 16967 - DNA, 201 bp, Homo sapiens
gccacctgctcctttacaagttgttgacaattaagaaacacctagcacttaatagattctccataaatgtaggttccaactccttccattacctttgatamgtctagacctgatccagtgagtatttgagggccaatctcagtttctaagtaggaatagtgatattgttgaaaactaatgaacccaccgacaacatcacag

SEQ ID NO: 16968 - DNA, 201 bp, Homo sapiens
tggtgcaaaggatgtgcccaagaatcaggcagacaatccaaagaagccacctgctcctttacaagttgttgacaattaagaaacacctagcacttaatagrttctccataaatgtaggttccaactccttccattacctttgatacgtctagacctgatccagtgagtatttgagggccaatctcagtttctaagtaggaa

SEQ ID NO: 16969 - DNA, 201 bp, Homo sapiens
gtcctgtgtcgccagagcttctggtattgccaaagaagcttgaaatctggacttggtcaaaaaatctctcaacttgtaaaggtggttgctttattttaaawtactctacaagccaaataaaacactgtctccaggctattggccaccagtgaatgacctctttggactaacaattaaactcagctatggaaattcatctga

SEQ ID NO: 16970 - DNA, 201 bp, Homo sapiens
aaaaaataaaagaaaaaacaaaaaagaatggtcgtgtagtagagacagtggtgaagagcaggactctggagccaggtgttctgagttcagagcccactctkccacttactagatctgagacctggaggaagttatttgccctttccctgtttggctcttttgtaaaatggaaatataagagtacccacctcctaaggtggg

SEQ ID NO: 16971 - DNA, 201 bp, Homo sapiens
gcacatgtatacatatgtaacaaacctgcacattgtgtacatgtaccctaaaacttaaagtataatttaaaaaataaaagaaaaaacaaaaaagaatggtygtgtagtagagacagtggtgaagagcaggactctggagccaggtgttctgagttcagagcccactctgccacttactagatctgagacctggaggaagtt

SEQ ID NO: 16972 - DNA, 201 bp, Homo sapiens
gaagtatttatcaaacaactactatatactgtcattaaagatacaaaaaggatcaaacataatccttgccttcaaagaagccacagtctaaggttaacaartggactggagcggaatttggttttatcatttcaaaggcaaaggaacccagattggagagttttctggcaactgccttaggactttttggccaagattaat

SEQ ID NO: 16973 - DNA, 201 bp, Homo sapiens
agagctcacagtgagccgagatcgcgccacggcactccagcctgggccacagagcgaggctccgtctaaaaaaaaaaaaaaaaaaaaagaaacaaattcaytggagtaccttagcattatgggatatctctaggcagcgccaggtttcttgtcttcatagctaagatagatgttaaaggaaggggaacctttttctatccc

SEQ ID NO: 16974 - DNA, 201 bp, Homo sapiens
aattatgaagcgcccatgctagggaccgcatgccatttaatgagtttacatcagtaaaaagagaggacagattcaaaaatgggacatgtcacacatacatrtgagaattttcccataggccaaagggcctctttcttggttttgatatcaggcaccaactctaataggatgaagctatctgtgtagcttgatgaagtagaa

SEQ ID NO: 16975 - DNA, 201 bp, Homo sapiens
cctccaaaagctctggaattacaggcaagagccactgtgcccaacctccccatatagaattttctatagcaatcttgtcctaggaaatatcatagaaatastttaggttttaaaaagaagggctgtatgtcatctaaactcttatttaacctatggttgacagccttgctattaaaaaaagatcttaagttgttttacatt

SEQ ID NO: 16976 - DNA, 201 bp, Homo sapiens
acatttccctaggctacatctccatatagagctttccttttttaaaatctgttctttattttttatagagacagggtcttgctatgttgcccaagccagtytcaaacttctggcctcaagtgatcctccagcctcagcctccaaaagctctggaattacaggcaagagccactgtgcccaacctccccatatagaattttc

SEQ ID NO: 16977 - DNA, 201 bp, Homo sapiens
tagtgcagccactctggaaaatagtgtagaagaccctttttaaaagttaaatatagaattaccctaaaaagcacaggcttttgttgactttccctgggggycaggtgggctcaccttggtgcatcctcccctggggggctctggtgtgggaagccagctttcctaccattctgcatgcagccttgtactgggtccttgggg

SEQ ID NO: 16978 - DNA, 201 bp, Homo sapiens
atttataaactcaaatgactcagctatcaagatgccaaattggattttagagagcctcctcctaggcacctgatactttcatgcttggcttattgtacgargtaactccactttctgttcatctcaaaagtgttgggaagtgtttgcaggttaccttcctagcacctgcccaaccttctagagaagtggagaaacctgtga

SEQ ID NO: 16979 - DNA, 201 bp, Homo sapiens
cttattcttattttccacttagaggtagagactgggtctcaccatgttgcccaggctggtcttcaactcctgggctcaggctcaagtgatcctccgacctyggcctcctgaagtgctgggattacaggcatgagccactgtgtctggccacaatacacacttgactgtcatttataaactcaaatgactcagctatcaaga

SEQ ID NO: 16980 - DNA, 201 bp, Homo sapiens
agcctccttattcttattttccacttagaggtagagactgggtctcaccatgttgcccaggctggtcttcaactcctgggctcaggctcaagtgatcctcygacctcggcctcctgaagtgctgggattacaggcatgagccactgtgtctggccacaatacacacttgactgtcatttataaactcaaatgactcagcta

SEQ ID NO: 16981 - DNA, 201 bp, Homo sapiens
tcttgggtatgttactttatttctctgggccccattttccccagctataaaatgaggggtttaaactagatgagctctaaagagcttttcacttcggagtytggctattccaagaccttttctagtcttgtgaatttaattactgaattctgggatcttaagtctctttatcagttgagtctcctcctttgtggtcttaca

SEQ ID NO: 16982 - DNA, 201 bp, Homo sapiens
aggccagagtctatacgcagacagtgagcagtgatcttccgtttcctacttgttgcagtagacataaaatcagggcaaatggtgagttccagaggaaaggwtccagcatgcagcctgctgaataagagaacaggaatgatctcgaatgatgataaatgtttatactctattagagctttggccatgggtttggccaccatt

SEQ ID NO: 16983 - DNA, 201 bp, Homo sapiens
aatgttaaaaaccagtacagttggttcttcgccactctggattgacagacattctttgtgtaggtgcctctggctttgagaaacgaggccagagtctataygcagacagtgagcagtgatcttccgtttcctacttgttgcagtagacataaaatcagggcaaatggtgagttccagaggaaaggatccagcatgcagcct

SEQ ID NO: 16984 - DNA, 201 bp, Homo sapiens
aagaccaaaacctgtcagccacaggcagaagtcattaggcaggatttatatgtgctggtatccaacactgagtcaaaaggagatccgtagaggggatttcyctcttccggaaacccagcagaggaacggggaagactttccgggtaaagtttcagagaacctaatgcataaatccccttaacaaacactgggatttgggtt

SEQ ID NO: 16985 - DNA, 201 bp, Homo sapiens
acccaagtaagtgaagggtgttgacagccatcatggggaatgctgatgcttgctgaagaagtcatgcaataaatcctctttagaaataaacaaaaagcagmttttgagaacccggcttttacccaagaccaaaacctgtcagccacaggcagaagtcattaggcaggatttatatgtgctggtatccaacactgagtcaaa

SEQ ID NO: 16986 - DNA, 201 bp, Homo sapiens
caggtctgacagcatgaattagatccctccatgtggagcacccaagtaagtgaagggtgttgacagccatcatggggaatgctgatgcttgctgaagaagycatgcaataaatcctctttagaaataaacaaaaagcagcttttgagaacccggcttttacccaagaccaaaacctgtcagccacaggcagaagtcattag

SEQ ID NO: 16987 - DNA, 201 bp, Homo sapiens
tttagggtcccaggtctgacagcatgaattagatccctccatgtggagcacccaagtaagtgaagggtgttgacagccatcatggggaatgctgatgcttrctgaagaagtcatgcaataaatcctctttagaaataaacaaaaagcagcttttgagaacccggcttttacccaagaccaaaacctgtcagccacaggcag

SEQ ID NO: 16988 - DNA, 201 bp, Homo sapiens
ttggttggtgtaattgaaaagtacatggttaactagcttcaggcatagcttgatccaggtattaactatgtcaccaagatccatctcactgctcataagcyctctcagttggctctattcttatgttcctcatggctcctggaaactttagcctctttccttctggttgcaggatggttgtagctccatagacatcacatc

SEQ ID NO: 16989 - DNA, 201 bp, Homo sapiens
taaggaacagaaaacccaacttaaattgacttacgtaaaaagagtttgttggttggtgtaattgaaaagtacatggttaactagcttcaggcatagcttgwtccaggtattaactatgtcaccaagatccatctcactgctcataagccctctcagttggctctattcttatgttcctcatggctcctggaaactttagcc

SEQ ID NO: 16990 - DNA, 201 bp, Homo sapiens
aatatttttgccatatttgatttggatctttttttttttaggaaaaagctgctgatggctacaaatgtgtctgttatgttattctctatacttgttatttyaaaaatattttataaaaatttgtgagtgaataaatgagaggggagaaaggaaggcaatgagtatgaatcatcattctgattttaagcataataaaagcag

SEQ ID NO: 16991 - DNA, 201 bp, Homo sapiens
aagacaaggaaagaaggggcggggcggggtgggagtgggggggtggtgcagtatacaaaacagaggggacgtgttataaggcagagaggtatgagagaaayagaacattcagaaactgtccttcttaatatttttgccatatttgatttggatctttttttttttaggaaaaagctgctgatggctacaaatgtgtctgtt

SEQ ID NO: 16992 - DNA, 201 bp, Homo sapiens
tgatattttggtttcacagccaggtaccctggcagccacaccagtgttatgctggcaggcatgctttgtctgctatctgtggcgtgaactttactaaaatraaacatgatgccatggagcaaattaagaggaaagctttcagagatgaccatgtatatgaaacacagttcctactccgcctccttcaccccaatgagagaa

SEQ ID NO: 16993 - DNA, 201 bp, Homo sapiens
agccaatgaatgaatgttttcttcccttaaaaaataccaacagatgcctaacataagcaattaagtgagggaaagcttttttgccattttaaaagtcattmgtcagcccacacgataccactgaggaagcctcatgtgagagctaatgaacattaaacccagacaccatcgggagctcaccagaaacccatggctggctag

SEQ ID NO: 16994 - DNA, 201 bp, Homo sapiens
cagtcatttctctagcattataataagctctttgtgtttataaacctagttcatagtaatttttggagtgctgcaatttggtagttatttaatttgcaaaygggattggcctctctaacctctaaaggaactagttccttttaatgctttaaaactttcattgactctcaattgccaactgcaggaaaaagttcaggtttt

SEQ ID NO: 16995 - DNA, 201 bp, Homo sapiens
taagaggggaactttcagagatgaccgtgaatatgaaatacagtgatttgtattattaatggatttggggaaaaccagcccacctcttttaagctcaactrtgtgtatttggggggttttatatttttaatttatttctttgtttctctcaaggcagtaggggttccatcgcaagctcttaagatctaccaatcctccttt

SEQ ID NO: 16996 - DNA, 201 bp, Homo sapiens
ttctttttatctttacaaatgtgcctggtggggactaatctaaaccagttcaagatgcttttgcttaagcctgtttagaggaacggaaggtgctgcagaawtggaaatagagtggtatatgggcctctttgccaccccgctcctgagctcgctgcctcttttttgtttttgtgggtttcttggcacctacctagatttctg

SEQ ID NO: 16997 - DNA, 201 bp, Homo sapiens
tcttctgtaacccaaatctcagcgtgtgtccttattttccttgttttcagcatgtccaagtgaagccattaagtaggtaatatactgttagacacagatcrtggtgcttgggaaaacaacacccaagcctcgtgattaataagcactgttaattgttaagctgctcttgctggtgtctgacctcacggggtttgtgctgtg

SEQ ID NO: 16998 - DNA, 201 bp, Homo sapiens
cattcaataaataccacttagtagcctcttggctactactcactcatttgggtgagtaggattttatccccattttatagatgaggatgctaaaatttgartaggtagagtagctttccagagtcctaaagccagtaaagcctggcaggggtgagtagagacccaggctcctgccttgtggtgtagtttctgacttcaatt

SEQ ID NO: 16999 - DNA, 201 bp, Homo sapiens
aaagctgaatatcatcccaaactctggatccttctgacgggcatttgtgtggtacacaggaaggggtgcattatgaatatgcaattactggcatgtaatgytgtcttctgctaaaaatacaaaaagggtactctgatctcagagttgggagctgatttctgatttcagcctagacaggtctgcttaaaactataatcaagc

SEQ ID NO: 17000 - DNA, 201 bp, Homo sapiens
ctttcgaaataagttcacattgctctaacacttcataagttcaatctttttctcattctgtttaaaataaccaccatgaccaccaaacgcctgaaattcaytgtagttaaaattatgactgaaatagacagggaaaacctgagagtgaacgttacccagcaaatctgggttaaacaggttcgagtttttccagagcacact

SEQ ID NO: 17001 - DNA, 201 bp, Homo sapiens
gagaaaatgaacgccaaggttgacaccaaatgtagggcccgagtgatttttctgtttttcaaatccgctgtcagttctccacctctgactcttagtctttytctccttccccacctctagagagaggacatttcctgagtaaaatgaaaatcaaagctaggagctaatcatatttttaaagtcagatatgttgggggtata

SEQ ID NO: 17002 - DNA, 201 bp, Homo sapiens
aaaatgatggaaatgtgtttgtttttcagggcagagaggagtgttggtaagtagagaaattacattgtgtcctcagctgccattgatgtccttccaaatargtgaagtttagtttaaaacctgccgttaatttctggcctctggcaagagtggtacaaggttacctgtttgttccagtatgtgtagggaggggctgggggt

SEQ ID NO: 17003 - DNA, 201 bp, Homo sapiens
aaaaaattagccgagcgtggtggcaggcacctgcaatcccagctcgtcatgaggctgaggcagaagaatcgcttgaacctgggaggcggaggttgcagtgrgccaagatcgcaccactgcactctagcctgggcaacaagagtgaagctctgtttccaaaaaaaaaaaaaaaaaattagctgggcatggtggcatatgcct

SEQ ID NO: 17004 - DNA, 201 bp, Homo sapiens
aaagacatgtaatttatattttaaaaatccaaacaatataaataatattagattggaccatataaaattactattttttgtagatccaaacagtcacatakgagcaattttatgtggctcacccaagcaatgaagatttatattgtatttactacatgccaaacatgtgctggatgtatatgaattcatatactgattata

SEQ ID NO: 17005 - DNA, 201 bp, Homo sapiens
tgaaagcatatctcacattttacttggcaaagttattctaaatattggctttcttccctaaagataagatctttctagatacagatattgaaaatactcarttagcatataccgagtggctcccttcagactctctgtactctacgaatcttaccctcatcctgtcattctacagtcctcaaaaaaaaaagacatgtaatt

SEQ ID NO: 17006 - DNA, 201 bp, Homo sapiens
atgtttgagtttgcatttcttgaggttttcccgttaatctgtcgactaattgtatttgttcttacaacatctgtattttctaaggttaaattttgtggagrttttgtttgctttgtgtatatgtgtgtatttttaaagttctctttataacaattgataaataatttgggaacagcccccttggcaaggccttcctctagg

SEQ ID NO: 17007 - DNA, 201 bp, Homo sapiens
atgatttataatggctactggatattccatgtagaggatgtattacaatatgcaaaatcatttccttattgttggaaatttaagttgcttttgatttaacrtagttataagtaatgctgcaattacatatttgcttatactgctttctcctttttttggattagatccttagaatctaaaaggaagattactaagtcaaaa

SEQ ID NO: 17008 - DNA, 201 bp, Homo sapiens
tggcagataattcactgttttaaaacatgcagataaaactcaactgtagttggatgtactttacgggttgctagtttgcacacacttatatacataatgcrgaacataagtgggaatattctaaataatagacagtgtggaaacttttcttaataatagtaagaaactgagccccaaacaactattaatatgtttagatgt

SEQ ID NO: 17009 - DNA, 201 bp, Homo sapiens
tcgcccgtaacctgctctatctctgtctcaggaaacgcagaaaataatttgtctctgtaatatagaaaagcagttagggtaacgtggctgtgaactgctgyctaaaagtgtgctgtgtgctcgcctctgtagttgctaagcacggaggaggaggctagccagggccttgccacagactaacttcaagaaaagaggaaaaga

SEQ ID NO: 17010 - DNA, 201 bp, Homo sapiens
tctattaattcatctaccaacattatggccttttgcatgcgtgtaagtaaatgaacataatatatactgtcattggtagtttgtgctttttttgtggcgaytcacaaacagcgagttcccagacattctcaccacactgcatctttatgcaatagatgtgacaggacctatatcctccagtgtcacctctctactactgca

SEQ ID NO: 17011 - DNA, 201 bp, Homo sapiens
aggaaaattagcagactcctggggcatgtattctagaacaacaaaaaacaatcacttactaaatcagatcggctcatttgtatttcactcccagccatacygggacgctagtttcagtgtaatggcaattatctatggcatgtactttatggaggtattttgtttggtctattgcggcagcaaagcaccactcccttgctg

SEQ ID NO: 17012 - DNA, 201 bp, Homo sapiens
agtagcattagaaggtcactttgggcaggccagtgaaatgacagaggacctggtctagggctagaatgccttaacatggactcctcaagcaagttcctggyggcaataaaatttcagtgtgtcccttgatgcctttattttggtgtgctgttgtgggatcaaaataaaggaaaagcagaaaccttccttccaagtaacatg

SEQ ID NO: 17013 - DNA, 201 bp, Homo sapiens
ttatctatctttgaaatggggtctcactctgtggcccaggcttaggctcacttcagcttccacttcctgggctcaagccatccttccacctcagctgcccragtagctgggaccacaggtgcgtgccaccacacctggctaatttttttgtattgttagtagagaggggatttcaccttgttgcccgggctagtctcgagc

SEQ ID NO: 17014 - DNA, 201 bp, Homo sapiens
gaattttaaccagatggaattatatatgtgcacggtttttttgtctggattctttaacttagcatagttattttgagattcatccatgttgttatgtatakcagtagctcattcccttgtatccttttttatttcaataaaatatacataaaattaatcattataaccatattaactgtacagttgagtggcattaagcat

SEQ ID NO: 17015 - DNA, 201 bp, Homo sapiens
ccagtacataatgatgttgatgtaagtgttgtttattgcaaaatgagatagagtgatggaattaataggtagaaaatgtaatctactgtaactatccaacytgcgccaatgaatgaagaatactgcacatgtcaggtcaagattttatacttaatcaaaagctcaaaattatgtacattttagcttgctttgtatttgaat

SEQ ID NO: 17016 - DNA, 201 bp, Homo sapiens
cagtatattgttttaatttctttacaggcgttccagtgaggttttgggaaggagccaagtgcatgttttgaatccaccatgttagaatggaagttaatttsttgtgttaatcattaatttgtatgtcagagtttcttttcctgaggtttatttgaaaatcaacgtaagaaaacaaaatttaatatggagaaaataatttcc

SEQ ID NO: 17017 - DNA, 201 bp, Homo sapiens
gaggccagatcatgagggtagggactttagactgcggtagatttcgattttattccaagtcccattggaaatcactggagtgttttaaggtagggagcgtrtgtgtggagtgacttactctgatttgatttctataaagatcactgtggctctgcgtgaggaatattggaaggccagagtagaattagggagaaatattgg

SEQ ID NO: 17018 - DNA, 201 bp, Homo sapiens
gcctgtagtcccagctactcgggaggctgaggcaggagaattgcttgaacccaggaggcagaggttgcagtgagccaaggtcgcaccactgcactctagcstgggcaacagagtgagactccttctcaaaaaaaaaaaaaaaaaaaaaaaaaaaaaaaggaaaaagaaacaccatccttgtaaagagagcgcatacacctt

SEQ ID NO: 17019 - DNA, 201 bp, Homo sapiens
tgtgtcatctatgatttctttcatcagtgttttatagttctctttgtagagatcttctactaccttggtcaagtttatttctaggtactttattattattwttttttttagctattatcaaagggattgagttcttgatttgattctcagcttggtcattgttagtgcattgcagtgctactgatttgtgtacattgattt

SEQ ID NO: 17020 - DNA, 201 bp, Homo sapiens
tcattgtagttggggaggtagaatagggtagacggcaagaacttggactctatattcagatggtcctgggtggcaatctgtgctctcccacttactggtakagttactttcagcaagtcacttgtttagactctagtctcctcatctataaggcgggaataatattaacacagctgacacttgagcaacacaggtttacac

SEQ ID NO: 17021 - DNA, 201 bp, Homo sapiens
tgtggggctgctagcctgtggcagctttggtcaacatcgggcttgcttttgggtgagccagactttggctggtttcctgatggaggttaggggaattgtgraatgtgtctccttacacagatcgtcctgatcaaatgaaataaaaaggtattttaaaaataatttgcttagtgaaatacaaaggaaataggatgcatttca

SEQ ID NO: 17022 - DNA, 201 bp, Homo sapiens
tgaatataaagctaaaactctggagaatgatgagaatgtaagaagggagaagtaaattatgtgtgatccaatattagggacacaaaaagggacatactacrtgaattactaatatctaagaaaatatgatacatttgagaacttagatgaagttgatacatacctagaaagataggcattacttaaattgcttcaagaagt

SEQ ID NO: 17023 - DNA, 201 bp, Homo sapiens
tattctttgatccctttttttcttgatttctgccttttttggatttttttataattccattttatctcttttgttggcttattacttgtaattttttggtkttttttttatgttggttttagggtttctggtatccatctttatcgtatcggaatctttcttgaagtattactgtgcttcacatgtagcataaaaattttt

SEQ ID NO: 17024 - DNA, 201 bp, Homo sapiens
aaaatgctggccttataaactggaggggtgcagaaacatatgtttcaatcataattatgctattgattatgaagaagatgctgatcatcatcatcatcatmataatagcagctaacctccactgagtctttactgtatgccaggtactattctacgtgttttgcccatattccttacttactcctcacaccaacccagtga

SEQ ID NO: 17025 - DNA, 201 bp, Homo sapiens
tgggtctttaactctcagaccagtgctctccctactataccatctggcttgttaggttgttagcttgctctttttttgttttttttttgttgttgttgttstgttgtttttggtgacagggtctggctctgttgcccaggctggagtgcagtggtgtgattactgctcactgcaacctcgaccttctgggctcaagtgatc

SEQ ID NO: 17026 - DNA, 201 bp, Homo sapiens
accctatgaagattcccacttattagactgtccacacgcagtggcattaaaacttcataaaaactgttccttacagtttgaaaattatttttttcaagtcrttataattggttttctttttatttatttatttatttatttatttatttatttatttatttattttaaggtgcagtgtcactatgtcaccaggctggagtg

SEQ ID NO: 17027 - DNA, 201 bp, Homo sapiens
catgcctgtaatcccagcactttgaaaggctgaggcaggcggattacttgaggtcaggagttcgagtccagcctggccaacatggcgaaacttcatctctrctaacaatacaaaaattagctgggcatggtggcacatgcctgtaatcccagctacttgggaggctgagcaggagaatcccttgaatctgggagacagagg

SEQ ID NO: 17028 - DNA, 201 bp, Homo sapiens
ttatttctatagactgtagatacttatgctgtaagggcctcacagtcaaaagaatgaaaagaagaaaactaggttttgtcagtcatctgacataataatartccttctagaaactggaggtaaaaacaacatttgcttctttcctctgaaatgatttggaatgtcctgcatatttaaatttgacaagaatagctgactagt

SEQ ID NO: 17029 - DNA, 201 bp, Homo sapiens
aaatttcccttggaaaagaaattggtgagattaaggaatgctatagctaactttgtaggatatttggaaaactatgagttatagtgaaaggtgctgtcttrgggagtacattttaaaagtgctagaaaatataatattacagcttgaatcaagagaagtgaactctgctagggactaagtactttgttagaaaggtgctca

SEQ ID NO: 17030 - DNA, 201 bp, Homo sapiens
tgtgaatgatgccattatttttttcagtcgatctttattgaaggttcgaatttaggactaggccgggaatgagtttgactttcctcatctagtcagtcccrgcagcacgtttcaaggtcagactatatacctcatgctggaaggttccttagactttgtaatctaagcccaataaacatctttttttttttttgggggggg

SEQ ID NO: 17031 - DNA, 201 bp, Homo sapiens
gtagccagtgagcatacctgtttttctgtagctttaaccagaactggaaagagggagagagagagagagagagagagtgtgtgtgtgtgtgtgtgtgtgtrtgtgtgtgtgtgtaaactgttttagtttgatagtttagaaaaccagcacagtatctttttgatttaatttgcattcttttgataatgaatgaggtagcag

SEQ ID NO: 17032 - DNA, 201 bp, Homo sapiens
tctgtttttgcaccagtttcaattagttgatttttctcttcattatcagtcatattgtcttgccttgtagtattctcttagaaacttccatgccttgttgyttttgattggatgacaaacattgtaaatttttaacatttaagtgctggattttgtgcttgctgttcctttaagtaactcatttatgttacttggaaacag

SEQ ID NO: 17033 - DNA, 201 bp, Homo sapiens
ggtggcaatctgtgctctcccacttactggtagagttactttcagcaagtcacttgtttagactctagtctcctcatctataaggcgggaataatattaayacagctgacacttgagcaacacaggtttacactgtgcaggtccacttatacgtggatctttcaaaataaaagctgcaccaagtatgcctgcctctcctgc

SEQ ID NO: 17034 - DNA, 201 bp, Homo sapiens
ctattatgtgacagttattgggaataatttgttataaaagacagataggtaaaaaataatctgcttcaactgtcagatatgctaggtacgcccttagagayggggtagtatttatgaagatctagtgagttcagtgcctgctgacataatcagtggtaataaggtaatacaagcacaggatggccaaaccaagaatgaagc

SEQ ID NO: 17035 - DNA, 201 bp, Homo sapiens
cagtgagccgagagatcacgccattgcactccagcctgggcaacaagagcgaaactccgtctcaaaaaaaaaaaaaaagaaagtaaacatatttaaggtcrtaaataaggccatgtctaatagtgataaacagtatgttgtgttaatgactgaggggaggggactgctttagatacagtggtctgaggtcacctttgatgt

SEQ ID NO: 17036 - DNA, 201 bp, Homo sapiens
gtcttttatatatgaaatgagatttcatgctacagtgaatgtccagagctctcttctccactgccagggcacgcagcattcagccagcaaagagtgagagygtcttttctttttgtgtgtgtgttgtcacatcatctacaaactcttactccagttggatacagtgtcagtcaagtttcagctgtattctgagatagctgt

SEQ ID NO: 17037 - DNA, 201 bp, Homo sapiens
aagtaccatttttcttttgaagtgaacttatagttttaaaaaatgagccaattatcatagtatcattttttctttttttacttttatctagaaattactaygaaaaatgagtcaatttaaagaaaaatattaaatactgtattacatagttcatatacaaatgtggcaagaattatgaggatgtgctagaataactgaagt

SEQ ID NO: 17038 - DNA, 201 bp, Homo sapiens
tgagatagataactctataactaactctgggcttggttcaggagaggaggagaataagggggcggaagctattagtggcagcacttcccagccaccccttrctggtctcctacttggtaatttctatcttgcaaaagcccctggcttgaacgagcattttatttgtggtggtgatttttcatataatctgataaagcgaga

SEQ ID NO: 17039 - DNA, 201 bp, Homo sapiens
cctagcctggtctcaaactcctgggctcaagccatcctcctgccccaacctcccaaagtattgggattactggcgtgagctactgtgcccatccagaatgkgttactttttaaagtacattgtgaggcaggacagtattcacattgcctttcccagagcccctaaagcatcaactgaagatggtgtccctactgcagtcaa

SEQ ID NO: 17040 - DNA, 201 bp, Homo sapiens
tttgttaatgttttctatattttgtcttgttttttcccctgtttttgtcttccactctttttctgcttttatagttttgagtatttcatgatttcatttcrtctcctttcttagcatatcaattacatatgtatttttttactttttaagtagtgacctagaggttgcagtatacatttacagctgttccaagtccacttt

SEQ ID NO: 17041 - DNA, 201 bp, Homo sapiens
ctggtctcaaactcctgacctcaggtgatccacccgcctcggcttcccaaagtgctgggattacaggcatgagccaccgtgcccagccttgtagctatttyaaatgggattgttttcttgatttcttttttatatagttcactgttagcatatagaaagactactgatttttgtgtgttgattttgtatcctgcagcttaa

SEQ ID NO: 17042 - DNA, 201 bp, Homo sapiens
gtaatcccagcactttgaaaggctgaggcaggcggattacttgaggtcaggagttcgagtccagcctggccaacatggcgaaacttcatctctactaacartacaaaaattagctgggcatggtggcacatgcctgtaatcccagctacttgggaggctgagcaggagaatcccttgaatctgggagacagaggttgcagt

SEQ ID NO: 17043 - DNA, 201 bp, Homo sapiens
ccagaagtgtatcccttctggagctctagtttgcatcatgcaggcagagtctgggtcagacgagtgtttagcccgttagtcatcggatggctgccaagtcrcaagcattttacaacaaaaattatatagaaaatgagtgatagggtgcaaattgctgagtgcaaaatagaaagtgttaggagcaaaatctattaacagcta

SEQ ID NO: 17044 - DNA, 201 bp, Homo sapiens
tcaacacctaaaaatccacagacaaaaaaaaatgtcatataagtattttttaacagaaaatgccaacaaagtcatcctcccaatacgtgtcagaaccgacraaggaaactactgatggtgttataacttttagtactgtcatctgaaaaatccttgaaaggaaaacactgtggtaacgcatacatattcccctcagactga

SEQ ID NO: 17045 - DNA, 201 bp, Homo sapiens
actgggtctttaactctcagaccagtgctctccctactataccatctggcttgttaggttgttagcttgctctttttttgttttttttttgttgttgttgytgtgttgtttttggtgacagggtctggctctgttgcccaggctggagtgcagtggtgtgattactgctcactgcaacctcgaccttctgggctcaagtga

SEQ ID NO: 17046 - DNA, 201 bp, Homo sapiens
ttttgtttgcattaatgggaaagtcaccaatttttgtgtgtgtgtgtgtgtgtgtataatttttttcacccttcttttcagtgttaatgtgcacattaagwtacatcagccaacataatccagtctcccatttttcagggttagcatttctgatttaagagcagagtatattatagtaatttaggatcagatgtgagatgt

SEQ ID NO: 17047 - DNA, 201 bp, Homo sapiens
gaggcactatctcggctcactgcaacctctgcctcccaggttcaagagattctcctgcctcaacctcccaagtagctgggattacaggtgcacaccaccaygcccagctaatttttttttttgtatttttagtagagacggggtctcaccatattggccaggctggtctcgaactcctgaccttgtgatctgcctgcctca

SEQ ID NO: 17048 - DNA, 201 bp, Homo sapiens
ttctttccctttccctttccttctcccttcctccctccctcccttcctttcttccttcctcggttccttttcttccttttctttcttttctttttttctgsagacagggtcttgctctgttgcccagtctggtgtgcagtggcacaatcatagctcactgcagcataaaactcctgggctgaagggatcctcctgcctcag

SEQ ID NO: 17049 - DNA, 201 bp, Homo sapiens
gtacataatgatgttgatgtaagtgttgtttattgcaaaatgagatagagtgatggaattaataggtagaaaatgtaatctactgtaactatccaacctgygccaatgaatgaagaatactgcacatgtcaggtcaagattttatacttaatcaaaagctcaaaattatgtacattttagcttgctttgtatttgaatcat

SEQ ID NO: 17050 - DNA, 201 bp, Homo sapiens
ctgacttttttatttttacttttttactttggagcctggctttatgaattttttttttaaacaggggaaggtacctcttttcaaggtgtcattattaagcycatgggactcttcaattttaatgttatatcaaagagagtaaatttcttgtgattattgtgatatgatgcattcaacttgcaggtcaggttttatatcatt

SEQ ID NO: 17051 - DNA, 201 bp, Homo sapiens
cagaggttgcagtgagctgagattgtgccactgcactccagcctgggcgattagtgagacttcatctcaaaaaacaaacaaacaaacaaaaaaaccaccamcaacaactctatggatatcgttctgtgacctctgatatttgatgttgggagatgtctgaggtgatctacattatggtttcattttggtaagctgtatttt

SEQ ID NO: 17052 - DNA, 201 bp, Homo sapiens
gcgttacaagcccttctggccagcgttgcatgatcactagattgatcagcgaggttttaaaaataggacttgtatcacataagaagagggatactgaggcwtaattatacatttatatggtagtttacatattttagagtgcttttatatgtgttatttgattttatcttcacataacccggtaaagcagagaagcattaa

SEQ ID NO: 17053 - DNA, 201 bp, Homo sapiens
atgatgagaatgtaagaagggagaagtaaattatgtgtgatccaatattagggacacaaaaagggacatactacatgaattactaatatctaagaaaataygatacatttgagaacttagatgaagttgatacatacctagaaagataggcattacttaaattgcttcaagaagtagaaaatctgaataaaacaatgaacg

SEQ ID NO: 17054 - DNA, 201 bp, Homo sapiens
gtagctgggaccacaggtgcgtgccaccacacctggctaatttttttgtattgttagtagagaggggatttcaccttgttgcccgggctagtctcgagctygtcagctcaagcaatacacccgcctgagtctcccaaagtgctgggattacaggtgtgagccaccacgcccaggcagttaatttttttatgtgctaagagg

SEQ ID NO: 17055 - DNA, 201 bp, Homo sapiens
tactcctgagcaaaattctgaaaaactggctggtctagtttagagaagaacgctgatgtgggagtattttcaccatgcattcctgctctaaatcctttgcytctactgatagactattctactttcgaaataagttcacattgctctaacacttcataagttcaatctttttctcattctgtttaaaataaccaccatgac

SEQ ID NO: 17056 - DNA, 201 bp, Homo sapiens
tataaatttgtctttgtaaaggtcagacttgtccagacacagtggttcatgcctgtaatctcagcactttgggaggctgacacaggaggacccttgaggcyagaagttcaagaccagcctgggcaatataacgagaccctgcctctacaaaaaagagacaacttaacagggtgtggtggttcatgcctgtaataccagcta

SEQ ID NO: 17057 - DNA, 201 bp, Homo sapiens
tactgaagcacagtaaaacctaaggctcacatcactgtctggggagtcagtgaggaacagggcagagtgccagtgcatatgaagagggatttttttgcctycttggttcactgcatattcccagtaattggaacaatgcctgacatgaagtagacataaaataattactgaatgaaagtggaaaggaaagtatacttagtc

SEQ ID NO: 17058 - DNA, 201 bp, Homo sapiens
tctataaagatcactgtggctctgcgtgaggaatattggaaggccagagtagaattagggagaaatattgggaaaggaatgttctgatggcttggcccagktggtgactgtgcagatagactgaaggggaaggatttaagatacattttgtaggcaaagctgccaggatttacttttagacagcataagaagtttgaaaga

SEQ ID NO: 17059 - DNA, 201 bp, Homo sapiens
ttatgagataatgtcctttttaaaaataaacactaacatcagttatgcatttagaatgtctgaattattattctaggttccttgcgactgctgtgaatttwgtgatgcacttggatagtctctgttactctaaagttttaataggtaacagtcagaaatggagtgggagagcataaaagcaaactgaaatgcaaatagctg

SEQ ID NO: 17060 - DNA, 201 bp, Homo sapiens
tactgttagaagcagtttctttatatgatttataatggctactggatattccatgtagaggatgtattacaatatgcaaaatcatttccttattgttggamatttaagttgcttttgatttaacatagttataagtaatgctgcaattacatatttgcttatactgctttctcctttttttggattagatccttagaatct

SEQ ID NO: 17061 - DNA, 201 bp, Homo sapiens
tacattgtagaatggctagatcaacctaattaacatatgcattatctcacatacttttttgtggtgagaacacttaaaatctactttcttagcaattttcmagtatataatacattgttattaactgtagtcaccatgttgtacaagagatctcttgaacatcactgaacatatttatggctgatcattttgtgttttaac

SEQ ID NO: 17062 - DNA, 201 bp, Homo sapiens
aactgcagagaactagaactaatttaagtgaaaggataggctccaagcccgctgtttgggtaaacccacactgaaccaagtgagcgattgatgaaacttartatatgtgtattccagtcatcagcctggagtatgtgtaatgcaagcccatggtgtttgtcactgtgagaaatggaaaggcagaccttcattctcaactgt

SEQ ID NO: 17063 - DNA, 201 bp, Homo sapiens
cgcctggcttgggtggtgtgattcttatgtaggagaaaaaagaggaacataaatgcagaacacaattatgcaaaattaggagcctttaaaatgaaatatgrtattgtaggtagtttcttcaaaacaacatactagttttttatacttgtttattcatcactgaaaacaaaacatatggaaaaggcaatttttctcccagcc

SEQ ID NO: 17064 - DNA, 201 bp, Homo sapiens
aactccgtctccaaaaaaagaaaaaataaaaaagaagaagaagatgagctgaatacagggcgacctgtacagttgataggctctgaggagatatcaacacrgaaaattagggacgtaattacccactcctcaatgaaggaggattcttctcagttaagtttatttacttacttggctttgagaccagagtctgataactct

SEQ ID NO: 17065 - DNA, 201 bp, Homo sapiens
ttttttattatactttaagttttagggtacatgtgcacattgtgcaggttagttacatatgtatacatgtgccatgctggtgcgctgcacccactaactcrtcatctagctttaggtatatctcctgatgctatccctccccctccccccaccccacaacagtccccagagtgtaatattccccttcctgtgtccatgtga

SEQ ID NO: 17066 - DNA, 201 bp, Homo sapiens
gcaacaagttatataggctccccaagtagccagtgagcatacctgtttttctgtagctttaaccagaactggaaagagggagagagagagagagagagagwgtgtgtgtgtgtgtgtgtgtgtgtgtgtgtgtgtgtgtaaactgttttagtttgatagtttagaaaaccagcacagtatctttttgatttaatttgcatt

SEQ ID NO: 17067 - DNA, 201 bp, Homo sapiens
agaaaaccagcacagtatctttttgatttaatttgcattcttttgataatgaatgaggtagcagtattttcttatatttaaaggctatttctatttcttcrtttgtgaaatacttgttcatgtcgtttgcccattttgggggaatgcttggctttttctaattgattcaaatatttttttctttttaattaagaattgtgg

SEQ ID NO: 17068 - DNA, 201 bp, Homo sapiens
gctggagtgaagtggcgcgatcttggctcactgcaagctctgcctcccgggttcatgccattctcctgcctcagcctcctgagtagctgggactacgggcrcctgccaccacgcccggctaattttttgtgtttttagtagagacggggtttcaccgtgttagccaggatggtctcgatctcctgatcttgtgatccaccc

SEQ ID NO: 17069 - DNA, 201 bp, Homo sapiens
gttgtccggactgcagtacagtggtgcaatctctgctcacagcaatttccgtctcccaggttcaaacaattctcgtgcctcagcctcccgagtagctgggwttacaggtggacactaccactcccagctaatttttgtattttttggtagagacgggtttcaccatgttggccaggctggtctcaaactcctgacctcaag

SEQ ID NO: 17070 - DNA, 201 bp, Homo sapiens
agccaagatctccactcatctgcttcagtcttttaaagcttttattcttagaaaggagtcttgagcacttatgtggaaccaagtgatgtggctataacagrtactaatgctattttcttcttcttctttttttttttttttgagatggagtcttgctctgtcacccaggctggagtgcagtggtgtgatctcggctcactg

SEQ ID NO: 17071 - DNA, 201 bp, Homo sapiens
gggctcaagccatcctcctgccccaacctcccaaagtattgggattactggcgtgagctactgtgcccatccagaatgtgttactttttaaagtacattgkgaggcaggacagtattcacattgcctttcccagagcccctaaagcatcaactgaagatggtgtccctactgcagtcaaacagaaatgctgagtaatgact

SEQ ID NO: 17072 - DNA, 201 bp, Homo sapiens
ttttcatgagagcagtgtataagagttctagttttgagagcagattttcttaaatttcatgaagtttatcctttttttcttttatggattttacttctggkttcatttctctgaaatctctgccttgtgtaacttaaatactaaaagagtttcgtatgttttctaatactagttttatagttttaaggttttatattaggt

SEQ ID NO: 17073 - DNA, 201 bp, Homo sapiens
tttaacatgacttgctctatatttctcagctcatcactgagaccatgaaaagctagtttataattacagcttggagttttggagtattcataaaaacgctrtgatgtttaatgttatcttagcgtcccagcatccctgtctaaaatctcaaagcttatttgacctagcttttttttattgtatcatgctatgccttgtcac

SEQ ID NO: 17074 - DNA, 201 bp, Homo sapiens
gacttcctcttttcaatttggatgccctttatttctttcctttgcctggttgctctggctgggacttcctgccaattccacttttacttggatcatttgtrtttctctttcttagaattttctaaaaattctgttatatttaaattttctaaaaattataccatattttagattcttccaggcaaggactgttttagcttt

SEQ ID NO: 17075 - DNA, 201 bp, Homo sapiens
tgcatagcttgcaaatattttctcccattctgtaggttgtctgtttactctgataattatttattttgttgtgcagaagctttttagtttaagtaggtccygtttatttattttttgttgcatttgcttttggggtcctattcataaattcttgcctagcccaatgtctagaaagagttttcttctagaatttttatgggc

SEQ ID NO: 17076 - DNA, 201 bp, Homo sapiens
cgctctgtcgcccaggctggagtgcagtggtgcgatctccactcactgcaggctccgcctcccaggttcacgccattcttctgcctcagcctcccaagtarctggggctacaggcgcccgccaccacgcccggctaattttttgtatttttagtagagacggggtttcaccgtggtctcaatcttctgatctcatgatccg

SEQ ID NO: 17077 - DNA, 201 bp, Homo sapiens
ggcttttttaagagagtaattgtgtggtttaacctgtcatcttgaaatatgaattatacagagataacattaaaaaaggttatatgtgacatttctaggtrtctcagaaaaagatttgagtttgtctcatgtctaccatggcaacactcttgagttattataaagaacattatataaggatttcctctagaatttttaaat

SEQ ID NO: 17078 - DNA, 201 bp, Homo sapiens
aaaatggagattataatacgcacccttgtgtgtctcctccaccaggtaaaagtgaaacaataacttctcaatatacctttgcttatattcaaagctccagrtaaatataagatgttgctataattacctaagaaagctaggaagatttttctttgttgattccaaggtgagttgtagaaattccagaagatggattaatgt

SEQ ID NO: 17079 - DNA, 201 bp, Homo sapiens
agttctgaaatgcttactaaattttcatagctataagccttctggtgcatgattacatgcattgtcacaaagcaactgccaagccatttcagcttttgtcrtgtgaaaatggtacaggaagaatgagatacaaaaggttatcagcccactgtgctctgaaccagccatccactgagggataaaaggaaacccaaatgcaaa

SEQ ID NO: 17080 - DNA, 201 bp, Homo sapiens
gagcggatcatgaggtgaggagatcaagaccatcctggctagtacagtgaaaccccatctctactaaaaatacaaaaaattagccgggcatggtggcaggygcctgtagtcgcagctacttgggaggctgaggcaggagaatggtgtgaacctgggaggcagagctcacagtgagccgagatcgcgccacggcactccagc

SEQ ID NO: 17081 - DNA, 201 bp, Homo sapiens
ggactaatacaatgggcacagtatcaaattgtaccctgactcaaattactgtaaacaatgccagttgttatctcacatcacaggaagttcggaaataggayagctgtaggtgtgatatgatcataggcccaatgatgcgattggagacttgagttcttttcttcagtttctgccatcatcaccaccctcatgctggcctcc

SEQ ID NO: 17082 - DNA, 201 bp, Homo sapiens
agaagagatgatctcaaatctactttatgagataatgtcctttttaaaaataaacactaacatcagttatgcatttagaatgtctgaattattattctagrttccttgcgactgctgtgaattttgtgatgcacttggatagtctctgttactctaaagttttaataggtaacagtcagaaatggagtgggagagcataaa

SEQ ID NO: 17083 - DNA, 201 bp, Homo sapiens
acatttgttccttagaaacaccatccttgggctgggcgcagtggctcacgcctgtgtttccaggactttgggaggctgaggcgggcagatcatgaggtcartagatcgaaactatcctggctaacacggtgaaatcccatctctactaaaaatacaaaaaattagccaggtgtggtggcgggtgcctgtagtcccagctac

SEQ ID NO: 17084 - DNA, 201 bp, Homo sapiens
ctcaagcaatacacccgcctgagtctcccaaagtgctgggattacaggtgtgagccaccacgcccaggcagttaatttttttatgtgctaagaggcttctytattaatttgcttgtgaatgggtgtgtgtgtgtgtatttaaatttttaatggttctgcattaatgtttctgcattcctgccatataggttgtactttttt

SEQ ID NO: 17085 - DNA, 201 bp, Homo sapiens
agttgttcttgagtttattttttcctgacttgactcatccagttcattagcatgtcctattgtcttttcctagaacattctgaatctgttgtctgcttatygtctcctcccctgtctctgtagttcaagtcactgttaactcctgcatgacttactgcaacagcttcctgactggccttctgctgccattcttgtttcccc

SEQ ID NO: 17086 - DNA, 201 bp, Homo sapiens
tacttatatatacttgcatatgtataagtatatataagtatatcatatttattgtatacttatatttatattattatacttgttatgtatctacatatatrtaatgtctacttataagtagatacgcatataatggaatatatatatatgtagtcacctacttataagggattgattaaagaatacaaggtaagtattgat

SEQ ID NO: 17087 - DNA, 201 bp, Homo sapiens
gtcaagatggtactgtaagctcacagtttgtacataccttctgctctaaattcataggaatggcagatataatgcattaaaagaattaaagaaaaaagtcrtagctgggcttacagacaagatagtgttgtagacccgaaagctaactaaacataaagggctagtaagctggattgaagggatggtgctgcagaggctctg

SEQ ID NO: 17088 - DNA, 201 bp, Homo sapiens
aaatacaaaaataagccggttgtggtggtgggcgcctataatcccaactactcgggaggctgaggcagggagaattgcttgaacctgtgaggcagaggtcrtagtgagccgagattgcaccattgtactccagcctgggcaacagggcgagactccatctcaaaaaaaaaaaaaaaaagaaaagaaaaaagaaaaagacaa

SEQ ID NO: 17089 - DNA, 201 bp, Homo sapiens
tattacaatatgcaaaatcatttccttattgttggaaatttaagttgcttttgatttaacatagttataagtaatgctgcaattacatatttgcttatacygctttctcctttttttggattagatccttagaatctaaaaggaagattactaagtcaaaagatatgaacgtttttatggcttttggtacatattaccaga

SEQ ID NO: 17090 - DNA, 201 bp, Homo sapiens
tattggatcttatattgttgaatcatctttccatttctgaaatagagcttactgtatcttgaggtaatatatgcaggaacttaatttggtgacattttatrtataattttctataggtgatatttttctatagcagtattttctgatgctctctgaccctggttaacaggtctcagtagaactcattcattcctaacattt

SEQ ID NO: 17091 - DNA, 201 bp, Homo sapiens
tttctcttcttcgtgattttcttaacattttcttttctctagcttactttattgtaagaatacagtatagaatgtgtgtgtacatataaaaaatatatgcyaattgactgtttatgtgaatcagtaaggctgccggtcaacagcaagctattaatagttaaatttgggaggagtcaaaatttatacataaattttagcctg

SEQ ID NO: 17092 - DNA, 201 bp, Homo sapiens
atgtacgaatgtttattcctatctcttcctccattctcccaaaatgtaaaccccataagaacaggaatcttgtctgtcttagtcacactcagtatccttaragccttgtgtgtagtaggtgtgtagtgaattttggttgaatgagtggcagttctaataatgtcagaagaattggaatttctttacagaaatctttatcag

SEQ ID NO: 17093 - DNA, 201 bp, Homo sapiens
aaaaaaacctgcagggatcttagtttgagattgcatcaatttggggacagtgaaatattttatcgagtcttccagtccactaacatggcatatctctttgwttaatttcggtagtgttttttaaattttctttgtataagtgtggaaaaccttttgtccagtttatctctgagtactttataatttttgttaaggtacatg

SEQ ID NO: 17094 - DNA, 201 bp, Homo sapiens
ggcaaatgtattctgaagcagaacacttgaatcaaagcacttcgcattttctttcttatttagaaataagaattttccccaatgggcttctttcggtgatrgcacgttagctcaccatcccatatgtgttaactatttttgttcaccttacccaaatcatggaataatcatctccttttaaaaaaggaaagaaaagaaaag

SEQ ID NO: 17095 - DNA, 201 bp, Homo sapiens
gttctgaattccattttgtctgatatcaatatagccacttcaactttcttttaattagtattactgggtaaatttttttccaactttttacttctttacaratctttttttattgcagtagaatgtacataacatataatttatcattttaaccattttaaagtatacacttatgtggcattaaatacaatttcacaatgt

SEQ ID NO: 17096 - DNA, 201 bp, Homo sapiens
tcataggaacagtgggcctgccacaagcaccacattttaggttaaaatcggagaagaaaattacacatggaattttaattttttccatggtcgtaagttcrgccccatttaattctttgtggtttttacaagccctcttaggctcctaatatttctatagcaacaatttcaacgtttattttagaatgtggtcagaattaa

SEQ ID NO: 17097 - DNA, 201 bp, Homo sapiens
aacaagtactacttgtcttttcagagcgctgtcatggagctgtaagtctctttgtggtttagacttaatgtgagtaagattcctctgcattctcagcctasaaaaacttgaccgttctcttggaatttggtgaaagtttcctaactttgaagctagagaatactctcatttcagattaggcaattattaacatttttttct

SEQ ID NO: 17098 - DNA, 201 bp, Homo sapiens
atactggttaaaccaccaaaatcaagattaggagacatgttcattatcactcctaatttgtgtccctcagaaatccttttctccttctctcccctagtggwtctgggcagctactaatctgctttctgtcactattgactagttggcattttctcgaattttgcataaatggaatcaatcaaacagtatgtgcttttgcac

SEQ ID NO: 17099 - DNA, 201 bp, Homo sapiens
ggctggagtgcagtggtgcgatcccggctcactgcaagctctgcctccgggcttcatgccattctcctgcctcagcctcctgagtagctgggactacaggsgcccgccaccacgcccggctaatttctttttgtatttttagtagagacagggtttcaccatgttagccagcatggtctcgatctcctgacctcgtgatcc

SEQ ID NO: 17100 - DNA, 201 bp, Homo sapiens
ttttgttctaaaatgaatataaagctaaaactctggagaatgatgagaatgtaagaagggagaagtaaattatgtgtgatccaatattagggacacaaaargggacatactacatgaattactaatatctaagaaaatatgatacatttgagaacttagatgaagttgatacatacctagaaagataggcattacttaaat

SEQ ID NO: 17101 - DNA, 201 bp, Homo sapiens
agacaggcacagagatttcccatatactccctacctccacacatgctctgttacacacactccactattatcaatatctgccattagagtggtacatctgytacacatcattatcacctaatgtccataagtttaataaaccattagggtttacttttggtggtatatattgttgcttgggacaaatgtatagtgacatgt

SEQ ID NO: 17102 - DNA, 201 bp, Homo sapiens
agtggagagcctggtccttcgttattatgtctcagattgaagttttatattttacagcatgatgaaattacatatatgatggttaggttaggttgcaagtyttggaatatatgcagaggaataactttattacaatgactatttactttttataagacaatccagcaatggtaatttttcattagtgatataattgcaaga

SEQ ID NO: 17103 - DNA, 201 bp, Homo sapiens
ataagcgtagtacctgatagataatttttcgatccttaccctcctcccaccttccaccctcaagtgggccctagtgtctgttgttcctttctttgtgtccrtgtttactcagtgtttagctcccacttataagagagaacgtgcagtatttggttttcttttcctgcgtgaattcacttaggataagggcttctagctgct

SEQ ID NO: 17104 - DNA, 201 bp, Homo sapiens
tcccaggctggagtgaagtggcgcgatcttggctcactgcaagctctgcctcccgggttcatgccattctcctgcctcagcctcctgagtagctgggactrcgggcacctgccaccacgcccggctaattttttgtgtttttagtagagacggggtttcaccgtgttagccaggatggtctcgatctcctgatcttgtgat

SEQ ID NO: 17105 - DNA, 201 bp, Homo sapiens
cacctcagctgcccgagtagctgggaccacaggtgcgtgccaccacacctggctaatttttttgtattgttagtagagaggggatttcaccttgttgcccrggctagtctcgagctcgtcagctcaagcaatacacccgcctgagtctcccaaagtgctgggattacaggtgtgagccaccacgcccaggcagttaatttt

SEQ ID NO: 17106 - DNA, 201 bp, Homo sapiens
tggtggctcatgcctgtaatcctagcactttggaaggccaaggcaggtggatcacctgaggtcaggagttcgagaccagcctgggcaatatggtgaaaccyggtctactaaaaatacaaaaattagctgggggtggtggcaggtgcctgtaatcccagctactcgggaggctgaagcaggagaatcgcttgatcctgggag

SEQ ID NO: 17107 - DNA, 201 bp, Homo sapiens
gactggtgtctgttcagcacccaagggaccatcaaagaggctgttgtggagagggaatccgaaggtcagggccagagatagaaatctggggagtcatccastatataggtgatgggttaaagccttagaactcttcttttcatgaatcattgttgttctttaggttgtaatgaagttttaggcctcagcttccctgaactg

SEQ ID NO: 17108 - DNA, 201 bp, Homo sapiens
tttctctacatctttgccaatacttgttattgcctatttaaaaaaaattttttttttgagatagggtctcactctgtcacccaggctggagtgcagtggcmagatcatgattcactggagcctcaacctccggggctcaagcagtctttccacctcagcctcctgagtagctgtaaccacaggtgtgcttttaaaaaattt

SEQ ID NO: 17109 - DNA, 201 bp, Homo sapiens
gtgccttgagggcttaagccaaatattctccattatttgaagaatctattctgccaaggactgccactgcctagtgtatgctttttgcagaaaagagaaakgagttctttgccttgtgattataactgcatttttccccgctgtcattatagaaccatttattgtgcttttgaaccagctttgcagcctggttacctttct

SEQ ID NO: 17110 - DNA, 201 bp, Homo sapiens
atttgaaataattcagaaaaaaggatagagtcgtgtgggagatagataaaatgagattggcaaaatgttggtaattgttgaagcatgctgcgtaatgggcrcataggggttcattatattattatttgtacttttgtgtgtttgaaattttccattatacaaccttaaagaaaggatcatttagaaagcaagaaagagctt

SEQ ID NO: 17111 - DNA, 201 bp, Homo sapiens
ccacatctttcagccattgacaaaggcctggcatgctggcattttatatctaaaatacctttccaaatacttattaaactatataatcatcatttatgccmcaggatcatttgtgaatctcaagaaatacagtatgtgaccagacaactgctaatataaatttcatgactgcatactcattggaaaaaactctaatgggat

SEQ ID NO: 17112 - DNA, 201 bp, Homo sapiens
cgttgcttctcccagtttactcggggtgacctagacagctacatcaacacacagtctggtgaaatgcacatgcgtaacttgaggatgtcaaccttttggcrcagtctcatttcctctgcagaagagcggctagagacattatactctgttcccgaagtatatagactaataaaatagtggagttgatttagattgataaca

SEQ ID NO: 17113 - DNA, 201 bp, Homo sapiens
ggaagaatgactgtgaatgatgccattatttttttcagtcgatctttattgaaggttcgaatttaggactaggccgggaatgagtttgactttcctcatcyagtcagtcccagcagcacgtttcaaggtcagactatatacctcatgctggaaggttccttagactttgtaatctaagcccaataaacatctttttttttt

SEQ ID NO: 17114 - DNA, 201 bp, Homo sapiens
tgggttttgaagagaatagattcttgaggttaataattgatttttgctttgctttcttttctttttttttcctttttgtgagacggggtcttgatctgtcrcccaggctggagggcagtggtgggatctcggctcactgcaacctccgcctcctgggttcaaatgattctcctgcctcaatctcctgagcggctgggacta

SEQ ID NO: 17115 - DNA, 201 bp, Homo sapiens
ctttgcccaaagaagttttcatatttattttatgctaatttctccattattttatctttaatattttttgactttccaaatttaatacaattattgctatyacacagaatttagtcatttgtataaagatttggtctggtggacttgtgtggaaagaagcacaaaatagattttgaaagcatatctcacattttacttggc

SEQ ID NO: 17116 - DNA, 201 bp, Homo sapiens
aatcagcatacttgctggcaagggcactgcaggatcaaaagagttaataattggatcctgcccacagcaaccacacaattaaggacaagattagcagagakgaggaatttatggtgaaaatgcaatgatagtctgaaaaacaaaatgatttcaccgagcagttgttctgttgccataatcctaatgatcaactctattaca

SEQ ID NO: 17117 - DNA, 201 bp, Homo sapiens
ggtgcataatataatgcctgacacatagtagatgctcaatttatgttaactactgttagctgctttagcctgttgttaactgcaaactccttttacattayctagcacaggcctgggcacaagtatgatatttaagtagatgcttagtgactgattgatgtctccaaacatttgggatttccttccacatttgccatagca

SEQ ID NO: 17118 - DNA, 201 bp, Homo sapiens
cattctcagcctagaaaaacttgaccgttctcttggaatttggtgaaagtttcctaactttgaagctagagaatactctcatttcagattaggcaattatyaacatttttttctgttctaatttcatgatgccaaaaaatcatgtatggttgatctatttggagaacaatatgtagcctcagacacttaagatcatatgta

SEQ ID NO: 17119 - DNA, 201 bp, Homo sapiens
ttttgttttgtttttgcttatgtctttgatattaatatatttttcagaatattataaaccacccttccccaaagttttatttccgcaatcactccctaatstttatttcttttttgcttcgcatcatatacatttttctcttcaggacaccttcttttcccttttgaaacttggactatgttcttaaaattgacgattata

SEQ ID NO: 17120 - DNA, 201 bp, Homo sapiens
gatcactgtggctctgcgtgaggaatattggaaggccagagtagaattagggagaaatattgggaaaggaatgttctgatggcttggcccagttggtgacwgtgcagatagactgaaggggaaggatttaagatacattttgtaggcaaagctgccaggatttacttttagacagcataagaagtttgaaagaaaagaaca

SEQ ID NO: 17121 - DNA, 201 bp, Homo sapiens
ttttccagtttgtttgccttttaattttatgatttattttatacaaaaatttaaattttcagatattcacatctatcaatcttctttttcaaaaagtttaytgattaactgtatatgtgtataatttacataccataaaatgcacgttttgaaattgtacaattcagtgatttttggtaaatttccagaggcatacaacca

SEQ ID NO: 17122 - DNA, 201 bp, Homo sapiens
gtttagttacttaatattttactttaaatcaactcttttttaacatgtatacatttctttaaaaagggagctttatattgctactttaagtggaaatccartatcattagccaaaagaaaaagtatccagaaaaatagatccaatgaaaacagagtaatgttattacattccagcagatattcttgtctggaggaggctct

SEQ ID NO: 17123 - DNA, 201 bp, Homo sapiens
ttggctttcttccctaaagataagatctttctagatacagatattgaaaatactcagttagcatataccgagtggctcccttcagactctctgtactctaygaatcttaccctcatcctgtcattctacagtcctcaaaaaaaaaagacatgtaatttatattttaaaaatccaaacaatataaataatattagattggac

SEQ ID NO: 17124 - DNA, 201 bp, Homo sapiens
tgcccgccaccacgcccagctagtttttgtatttttagtagaaacagggttttaccttgttggccaggttggtctcgagctcctgacatcagatgatccasctgcctcggcctcccaaagtgctgggattacaggtgtaagccaccgctccaggccactagtactatcttcttttaggagcttgtgatcttacaggacaga

SEQ ID NO: 17125 - DNA, 201 bp, Homo sapiens
aaaaaaaagttgtccttagttattagagatttatgctaaataattacaatttgaatattgtgatgtctgggatgtgatttgaaataattcagaaaaaaggrtagagtcgtgtgggagatagataaaatgagattggcaaaatgttggtaattgttgaagcatgctgcgtaatgggcgcataggggttcattatattattat

SEQ ID NO: 17126 - DNA, 201 bp, Homo sapiens
tttctttagcctttttgcaatgcaacgcacaatcaatacaaatctttgcagtaatcatatattgattttcctagaatataactccatttaaagcacttttrtccccaagagtagaaacattggaggctatcaaaggaggaagtagatttccttgaccccatctgcagtgcacaattgattaacaggatagttatgagagtg

SEQ ID NO: 17127 - DNA, 201 bp, Homo sapiens
ctcactctgtggcccaggcttaggctcacttcagcttccacttcctgggctcaagccatccttccacctcagctgcccgagtagctgggaccacaggtgcrtgccaccacacctggctaatttttttgtattgttagtagagaggggatttcaccttgttgcccgggctagtctcgagctcgtcagctcaagcaatacacc

SEQ ID NO: 17128 - DNA, 201 bp, Homo sapiens
gtaagatcttcgtgaaatgcaaatataattatgtccctttcctttctccttactctgccaaccacctgtttaaaaatattccatggctttctgttgctctyaggataaaggcaaaacttcacattgcctacaagatcctgcatgatctggaccctacctgctttcacaaccccattggatatgacactctgctctctgcct

SEQ ID NO: 17129 - DNA, 201 bp, Homo sapiens
gagacttgtaggtaaatcgtgacttgcccaaggccacttggttgctaggtgaaactagtgctctgagccaggtcttctgactccaaattcaaggcttttcycattttctgcttgtgaaacatgttgaattagtagagcaaattgtcttccttttttctttaaaaaattggctgttcatttaaaatttgtttgcttaatatt

SEQ ID NO: 17130 - DNA, 201 bp, Homo sapiens
aggggcttgtttccaaacgtttgtccttggcatgctctttgttaagccatcacatgtttgaaagttaaaccttgaattggtgccatggtttgcatttaaawaaatgtattttattatggtaagaacacaacataagatctactctcttaccacatttttaagtgtacaataaagtattgtaaactgtaggtacaatgttgt

SEQ ID NO: 17131 - DNA, 201 bp, Homo sapiens
gggcttgtttccaaacgtttgtccttggcatgctctttgttaagccatcacatgtttgaaagttaaaccttgaattggtgccatggtttgcatttaaaaaratgtattttattatggtaagaacacaacataagatctactctcttaccacatttttaagtgtacaataaagtattgtaaactgtaggtacaatgttgtat

SEQ ID NO: 17132 - DNA, 201 bp, Homo sapiens
acatgtttgaaagttaaaccttgaattggtgccatggtttgcatttaaaaaaatgtattttattatggtaagaacacaacataagatctactctcttaccwcatttttaagtgtacaataaagtattgtaaactgtaggtacaatgttgtatagcagatctctggcactgattcatcttgtataattgaaactttatgccg

SEQ ID NO: 17133 - DNA, 201 bp, Homo sapiens
tttaaaaaaatgtattttattatggtaagaacacaacataagatctactctcttaccacatttttaagtgtacaataaagtattgtaaactgtaggtacartgttgtatagcagatctctggcactgattcatcttgtataattgaaactttatgccgcttgattagctctttcccatcctcccagccctggtcatcatct

SEQ ID NO: 17134 - DNA, 201 bp, Homo sapiens
ttaaaaaaatgtattttattatggtaagaacacaacataagatctactctcttaccacatttttaagtgtacaataaagtattgtaaactgtaggtacaakgttgtatagcagatctctggcactgattcatcttgtataattgaaactttatgccgcttgattagctctttcccatcctcccagccctggtcatcatctt

SEQ ID NO: 17135 - DNA, 201 bp, Homo sapiens
aaatgtattttattatggtaagaacacaacataagatctactctcttaccacatttttaagtgtacaataaagtattgtaaactgtaggtacaatgttgtrtagcagatctctggcactgattcatcttgtataattgaaactttatgccgcttgattagctctttcccatcctcccagccctggtcatcatctttctact

SEQ ID NO: 17136 - DNA, 201 bp, Homo sapiens
aatgtattttattatggtaagaacacaacataagatctactctcttaccacatttttaagtgtacaataaagtattgtaaactgtaggtacaatgttgtawagcagatctctggcactgattcatcttgtataattgaaactttatgccgcttgattagctctttcccatcctcccagccctggtcatcatctttctactc

SEQ ID NO: 17137 - DNA, 201 bp, Homo sapiens
acacaacataagatctactctcttaccacatttttaagtgtacaataaagtattgtaaactgtaggtacaatgttgtatagcagatctctggcactgattyatcttgtataattgaaactttatgccgcttgattagctctttcccatcctcccagccctggtcatcatctttctactctctgattctatgagtttgacta

SEQ ID NO: 17138 - DNA, 201 bp, Homo sapiens
cacaacataagatctactctcttaccacatttttaagtgtacaataaagtattgtaaactgtaggtacaatgttgtatagcagatctctggcactgattcwtcttgtataattgaaactttatgccgcttgattagctctttcccatcctcccagccctggtcatcatctttctactctctgattctatgagtttgactat

SEQ ID NO: 17139 - DNA, 201 bp, Homo sapiens
aataaagtattgtaaactgtaggtacaatgttgtatagcagatctctggcactgattcatcttgtataattgaaactttatgccgcttgattagctctttyccatcctcccagccctggtcatcatctttctactctctgattctatgagtttgactattagacgtacatttttgtttttgctataagcatctgtcctgtt

SEQ ID NO: 17140 - DNA, 201 bp, Homo sapiens
ttgtatagcagatctctggcactgattcatcttgtataattgaaactttatgccgcttgattagctctttcccatcctcccagccctggtcatcatctttstactctctgattctatgagtttgactattagacgtacatttttgtttttgctataagcatctgtcctgttgctatgctgatcatttatttactctgtagt

SEQ ID NO: 17141 - DNA, 201 bp, Homo sapiens
cagaagagcggctagagacattatactctgttcccgaagtatatagactaataaaatagtggagttgatttagattgataacaaattataaaattgataamaaatattttctatttttataccatttagaacagctattaatatttttaaaatttttttctcaattggatgaaaaataaatgtatgattattccttccctt

SEQ ID NO: 17142 - DNA, 201 bp, Homo sapiens
ttttttttttcatttcatggtagtgtgtcttggttatacaagcaaaaggaagtattaattctatccttgaaagcccctgcctgggaaaggttttgaaattycttctcaaacagatggccattcacctaatgcttggagattaccagagacagaatttagaatcttccatggcagcctattctttttcacagtaactcatgc

SEQ ID NO: 17143 - DNA, 201 bp, Homo sapiens
aggttgtagtaatttacatttccacccccagtgtataagcactcccttttcactacatttctagcaacatctattattttttgactttttaataatggtcrttctggctaggataaggtgatatctcattgtggttttaatttgcatttctttgatgatatgtgatattgagcattttttcatatgtttattggccatttg

SEQ ID NO: 17144 - DNA, 201 bp, Homo sapiens
ttgttattataaaaatactacatgcacaaggaaataaaaattgaaagatttaaaatggaaagttgaggaagatctaaaatggaaagtgaaaaactccacckatccccaagttccatcccttagaggtaactgcttttcactgtatttgcgttttattctttgattacctccctaacccttaaacatatatatacttgtact

SEQ ID NO: 17145 - DNA, 201 bp, Homo sapiens
atgatactttattataaatattactctagtgtttgttttttgtacataatatgtgctggaaatttttttatgtcagtatgtcattcatattattattgttrttataaaaatactacatgcacaaggaaataaaaattgaaagatttaaaatggaaagttgaggaagatctaaaatggaaagtgaaaaactccacctatccc

SEQ ID NO: 17146 - DNA, 201 bp, Homo sapiens
acacatgtattctcattcaaactttgtggaactatatgaaataaaatgtagacattctctttccccttgctttcccatctggtcctttgtaagtgttagcrtaaagatagttatgttgacatatttaaatatatgttgctgctgctgtatttttaaaaaacataaatgatactttattataaatattactctagtgtttgt

SEQ ID NO: 17147 - DNA, 201 bp, Homo sapiens
aaaatatgcccccaaatactgacattttcaagcttgtgcttttttacttgatatctgattttttttaaatttttatttaatagggagaaggtcatgacttrtggaatttactctaaggatagggatctgagcaggttcctgagtacttgaaaggctttatttacctcttacacttttttgttacatccaggtttttgctca

SEQ ID NO: 17148 - DNA, 201 bp, Homo sapiens
aaaattccactgcaaaaaaagaaaactgcaatagaaatgtaaatgcatagcccttcttttttggtttttctttaccttgtcaacagtttagggtagagttstgaaaggaccataggatttctatcaggtaaccaggtcccagactcaccgcattgtcaattgcctgtgtattgctagtgcctctcttagtctctgccttca

SEQ ID NO: 17149 - DNA, 201 bp, Homo sapiens
ccaggtaaaaattccactgcaaaaaaagaaaactgcaatagaaatgtaaatgcatagcccttcttttttggtttttctttaccttgtcaacagtttagggkagagttgtgaaaggaccataggatttctatcaggtaaccaggtcccagactcaccgcattgtcaattgcctgtgtattgctagtgcctctcttagtctct

SEQ ID NO: 17150 - DNA, 201 bp, Homo sapiens
aaaaaccctctcttcctcccttaatttgttattgttattctttacatgtcaccattcatgactctgttctctctgctctatttacatttgtttcttaagcmcaactaaatctcactttcaagtatttgttgttactataccaatcagcagtttcaaaacttaagttgccaggtaaaaattccactgcaaaaaaagaaaact

SEQ ID NO: 17151 - DNA, 201 bp, Homo sapiens
gtaaacatttggggcaaaaaccctctcttcctcccttaatttgttattgttattctttacatgtcaccattcatgactctgttctctctgctctatttacwtttgtttcttaagcacaactaaatctcactttcaagtatttgttgttactataccaatcagcagtttcaaaacttaagttgccaggtaaaaattccactg

SEQ ID NO: 17152 - DNA, 201 bp, Homo sapiens
tatacattgggtcccttgagctattgtacatgataaacagaagaagttagcattattttataggagctgatatccaagacataatataaaatctactcttsatttcccatgtcttatttttagatgtaggtgatatagttggtatcctactgaactgtgccaaacacagcacaatatatcccaaagtctgcacttagaata

SEQ ID NO: 17153 - DNA, 201 bp, Homo sapiens
tcctgtcagctttgtgagggagatggcagagattgttctttttttaagtgatcttcctaaagtcacttagttatgaggtagaacagggaccagaatgggtrgcaggcatcttatgcagtgcttttcctactctaaatggggctatttcaacctgatcccaatatactgaaatctctatgtgggaatgttttcagtgttaag

SEQ ID NO: 17154 - DNA, 201 bp, Homo sapiens
ggcctctcagctatgtggtactgtaagtccaattaatcctctttttgtttccggtttcggatatgtctttatgagcagcatgaaaacaaactaatacaacyattttacttaacatagtgtcctcaagattcatccatgttatggcatgtatcagaatttaattcctttttaaagatgactaatattccattgtatgaatat

SEQ ID NO: 17155 - DNA, 201 bp, Homo sapiens
ataagtctcacgagatctggtgggttcatcaggggtttccgcttttgcttcctcctcattttctcttgccactgccatgtaagaagtgccttttgcctccygccatgattcagaggcctctcagctatgtggtactgtaagtccaattaatcctctttttgtttccggtttcggatatgtctttatgagcagcatgaaaac

SEQ ID NO: 17156 - DNA, 201 bp, Homo sapiens
gggctacaggcgcccgccaccacgcccggctaattttttgtatttttagtagagacggggtttcaccgtggtctcaatcttctgatctcatgatccgcccrcctcggcctcccaaagtgctgggattacaggcttgagccaccatgcccggcctcctttgttctcttaactgcagaaattctcagaactccatctaataat

SEQ ID NO: 17157 - DNA, 201 bp, Homo sapiens
tgaagcagtggtatgtgatagtacaaagctctacaaagatgtctttgtgctcccaattactctgagccctccagtttaatagtcctattgtactcccttcscgtgggtgatcaagtagtttttgaaacctagaatatctttcagaaaggaatttaaatgtctaatgaatagtttctatgctcaggagtaattaagactgac

SEQ ID NO: 17158 - DNA, 201 bp, Homo sapiens
ccttgttgggtggctgtggtagacttgttcttgcattttctgatgtataatccccttgaaactagatcgtaggctacctcttagtagcccacccacatttytcttcttctattattgtttctgtgtgtttatggccctcatttttccttagaatagaattacaaaaatggtagttgaacagatggaggagagcatgacctc

SEQ ID NO: 17159 - DNA, 201 bp, Homo sapiens
atagtttgtaactactgtccttccttgccagaagcagttgaggtaggttttgtaagcagacagtcctctattttcaggaaactccctagctctttacccarttctgcagttttagaccttgttgggtggctgtggtagacttgttcttgcattttctgatgtataatccccttgaaactagatcgtaggctacctcttagt

SEQ ID NO: 17160 - DNA, 201 bp, Homo sapiens
gtcacacctgtatgtctgcagaatatgcctctttctcatctggccatgctagctggctcattgttatactgtactcagaatattttcgcacataagcgctrctgtcatttgtctctcttgtgcccaggagagcagcctcttggtttcatacagccgactgtcttctctacagctcagaggagattgtacagttgctataat

SEQ ID NO: 17161 - DNA, 201 bp, Homo sapiens
cttgtcacacctgtatgtctgcagaatatgcctctttctcatctggccatgctagctggctcattgttatactgtactcagaatattttcgcacataagcrctactgtcatttgtctctcttgtgcccaggagagcagcctcttggtttcatacagccgactgtcttctctacagctcagaggagattgtacagttgctat

SEQ ID NO: 17162 - DNA, 201 bp, Homo sapiens
tttagtcttgtcacacctgtatgtctgcagaatatgcctctttctcatctggccatgctagctggctcattgttatactgtactcagaatattttcgcacrtaagcgctactgtcatttgtctctcttgtgcccaggagagcagcctcttggtttcatacagccgactgtcttctctacagctcagaggagattgtacagt

SEQ ID NO: 17163 - DNA, 201 bp, Homo sapiens
aaagaattaaagaaaaaagtcgtagctgggcttacagacaagatagtgttgtagacccgaaagctaactaaacataaagggctagtaagctggattgaagsgatggtgctgcagaggctctggatggagaaacagaaagctagatttagctcccatagagtgctaggactgaaagtttaccacttgaaatgggaccataac

SEQ ID NO: 17164 - DNA, 201 bp, Homo sapiens
ttttctggtcttataatccttggcagaatgccagaactatggcaaaggtggacttgaagagaatcatttggtttaaaattttggttgaggttgagaagggsttaaggaggtcatagagagtggacacttcagagaattgtatttttttctgtgtccttgaacttgtttgtcaatgagctgttctagacagtatgggaactc

SEQ ID NO: 17165 - DNA, 201 bp, Homo sapiens
atgtttaatatggtccagcaccttgttctttgactggaacaccttcagaaacatcacttagatcaacagtaactattggctaccatttttgtttctttgtytggaaggaaacattttctgtgaaattgtctttctagaaagaaaagcaattcttaagattttaaactagtgccaagtattgcatattcttgacattatttt

SEQ ID NO: 17166 - DNA, 201 bp, Homo sapiens
tgtgtatactttttttgtgtatatacttttgtgtatgtacttttgcgtaggattgctggatcaaatgataggtctatgttgacatttttgaggaactgctrtactgttttctacagcgactgaactgttttatattctcgctggcaatgcgcaagggctctaatttctccacatctacgccaacacttactgtttcctgtt

SEQ ID NO: 17167 - DNA, 201 bp, Homo sapiens
gtatgtacttttgcgtaggattgctggatcaaatgataggtctatgttgacatttttgaggaactgctgtactgttttctacagcgactgaactgttttayattctcgctggcaatgcgcaagggctctaatttctccacatctacgccaacacttactgtttcctgttttttgataacagccatcataatgggtatgaag

SEQ ID NO: 17168 - DNA, 201 bp, Homo sapiens
ttgacatttttgaggaactgctgtactgttttctacagcgactgaactgttttatattctcgctggcaatgcgcaagggctctaatttctccacatctacrccaacacttactgtttcctgttttttgataacagccatcataatgggtatgaagtggtatctccttgtggttttgatacacattttcctaataattaatg

SEQ ID NO: 17169 - DNA, 201 bp, Homo sapiens
gacatgtctattcaagttgtttgcccatttttgaatttggctggtttttagttgttgagttttgtgagttccttatgtattctagatattaattccttatyagatatatgacttgcaatattttcttcaaggatagctgaactttttttttttattttttttgagacggagtctcggtctgtcacccaggctggagtgcag

SEQ ID NO: 17170 - DNA, 201 bp, Homo sapiens
aatctggtgttctatgcctgatgcatggggatccctttctgtgacctcttcattgtaatccagcggattcctttacttctctcttttgtggactcctcacrttcctgcatcctggccttgctctttcctgactgttttcttattttggtggagcatgtcctacaatgttttcttcagaaagatgcttaggaggtaaatttt

SEQ ID NO: 17171 - DNA, 201 bp, Homo sapiens
tttggtggagcatgtcctacaatgttttcttcagaaagatgcttaggaggtaaatttttaagaccttaaatgtcttcaatcatctttattccaccttggtmtatgtaggttcttccagtatgaaaaccttgttaggaaataatattttttttcagaatcgtagtgacattgcattactgtcttttatcttacagtgttcat

SEQ ID NO: 17172 - DNA, 201 bp, Homo sapiens
ggggtttcaccatgttggccaggatggtctcaatctcctgacctcgtgatccacccacctcagcctcccaatgtgctgggattacaggtgtgagccaccayacctgggcctttttatttctttttaattttgtgtggacttcaatggtagaagttatagttgatttgaccagaaagggacatgtgaaaaaccttcctaaaa

SEQ ID NO: 17173 - DNA, 201 bp, Homo sapiens
tccccatctgtttcaattcttcatcttgtaatgcttcctttcaaatagctacatgattaccttccagtttaggggcactgaaaatgttatctctggctcakttgacagtttttattgatgatctggtgggaaccaggtctgtggctttttcagcacatttcaatgtcccaataccacacaagaagcttttctctctcccct

SEQ ID NO: 17174 - DNA, 201 bp, Homo sapiens
aactagtcttgagtatccttccagaaatgttgtattccagtcttgtgtatccttccagaagtattataaatattatattattatccttccagaaaaatcartcttgagtatccttccagaaatactatatgtgcttgatatttatttatttatatttattttgaggcagggcctcactctgttgcccagaatggagtgcac

SEQ ID NO: 17175 - DNA, 201 bp, Homo sapiens
ataaatattatattattatccttccagaaaaatcagtcttgagtatccttccagaaatactatatgtgcttgatatttatttatttatatttattttgagkcagggcctcactctgttgcccagaatggagtgcactggtgctatcacaactcactgcagcctccacctcccaggctccagcaatcctcccacctcagcct

SEQ ID NO: 17176 - DNA, 201 bp, Homo sapiens
ctttttgtagaggtagggtttcaccatgttgtcctggctggcctcgaacttctgagctcaagcaatcttcctcccttggcctcccaaagtgctgggattasaggtgtgagccactgcgcccagtctgtactttgttttctatatgagtatagcctatttatttttttctctgaaaatatattagatagttccatatctgta

SEQ ID NO: 17177 - DNA, 201 bp, Homo sapiens
ttgggaggctgaggtgggcggatcacctgaggtcaagagtttgagaccagcctggccaacatggtgggaccctgtcactactaaaaatacaaaaattagcygggtgtggtggtggatgcctgtaatcccagctactctggaagctgaggcaggagaactacttgaacccgggaggcagaggttgcaatgagccgagatcac

SEQ ID NO: 17178 - DNA, 201 bp, Homo sapiens
ccacagatgttttccatagactgaatgtaaccagggagttagggacttaaaagtggcttggagacaaaccatgggtttgttttttgtggaacagattatayagttcaagggacatcaacacaattatgtttattaaccaggagctgggtgtggaggtgggatgtttcaggacaaaggtgagtgctaggtaaacatttgggg

SEQ ID NO: 17179 - DNA, 201 bp, Homo sapiens
ccagaaaaaaaaattaatggagattgattgctaatgggtacagggctgcttttaaggctatgaaaatgctctaaaattagtttgtggtgatggttgcacawctctgaacgtactaaaatacattgaattatatactttcttttttcttcgttttgcagcttttgctcaaaggagaattagatatttaaaatgagtgaattg

SEQ ID NO: 17180 - DNA, 201 bp, Homo sapiens
gctatgaaaatgctctaaaattagtttgtggtgatggttgcacatctctgaacgtactaaaatacattgaattatatactttcttttttcttcgttttgcrgcttttgctcaaaggagaattagatatttaaaatgagtgaattgtatggtacatgaattagatctcaataaaactattttaaaaaaagaaactaaagctt

SEQ ID NO: 17181 - DNA, 201 bp, Homo sapiens
aaagcttagagaagtataatatcttgttcaatatgacactacctggtaaagcttttgtccaaatttttctgagaccaaagctattctttcttccactgacscatgctatctctactaattatatagccacggtatcctttttctttaaaaatgtaggaaaaaatggctgggtgcggtggctcacgcctgtaatcccagcac

SEQ ID NO: 17182 - DNA, 201 bp, Homo sapiens
ttctttcttccactgacgcatgctatctctactaattatatagccacggtatcctttttctttaaaaatgtaggaaaaaatggctgggtgcggtggctcaygcctgtaatcccagcactttgggaggccaaggcggacggatctcttgaggtcaggagtttgagaccagcctggccaacatggtgataccccacctctact

SEQ ID NO: 17183 - DNA, 201 bp, Homo sapiens
ttatgttgacatatttaaatatatgttgctgctgctgtatttttaaaaaacataaatgatactttattataaatattactctagtgtttgttttttgtacrtaatatgtgctggaaatttttttatgtcagtatgtcattcatattattattgttattataaaaatactacatgcacaaggaaataaaaattgaaagattt

SEQ ID NO: 17184 - DNA, 201 bp, Homo sapiens
gatcacctgaggttgggagtttgagaccagcctggccaacatggcgaaaccccatctctactaaaaatacaaaaattagccaggtgtcgtggcaggcaccygtagtcctagtgcctgttttagttactggggaggccgaggccagagaatcccttgaacctgttaggcggtggttgcagtgagccaagatcgcaccattgc

SEQ ID NO: 17185 - DNA, 201 bp, Homo sapiens
ggcgaaaccccatctctactaaaaatacaaaaattagccaggtgtcgtggcaggcacccgtagtcctagtgcctgttttagttactggggaggccgaggcmagagaatcccttgaacctgttaggcggtggttgcagtgagccaagatcgcaccattgcactctagcctgggtgacagagcaggactttgtctcaagaaaa

SEQ ID NO: 17186 - DNA, 201 bp, Homo sapiens
gcgaaaccccatctctactaaaaatacaaaaattagccaggtgtcgtggcaggcacccgtagtcctagtgcctgttttagttactggggaggccgaggccrgagaatcccttgaacctgttaggcggtggttgcagtgagccaagatcgcaccattgcactctagcctgggtgacagagcaggactttgtctcaagaaaaa

SEQ ID NO: 17187 - DNA, 201 bp, Homo sapiens
aaaatacaaaaattagccaggtgtcgtggcaggcacccgtagtcctagtgcctgttttagttactggggaggccgaggccagagaatcccttgaacctgtyaggcggtggttgcagtgagccaagatcgcaccattgcactctagcctgggtgacagagcaggactttgtctcaagaaaaaaaaatgtattttaaatttca

SEQ ID NO: 17188 - DNA, 201 bp, Homo sapiens
tcccttgaacctgttaggcggtggttgcagtgagccaagatcgcaccattgcactctagcctgggtgacagagcaggactttgtctcaagaaaaaaaaatrtattttaaatttcagtagccttagggatataagcagtttttggttccatggatgatttgtatagtgttgaagtctggtattttaatgtacctgtcacctg

SEQ ID NO: 17189 - DNA, 201 bp, Homo sapiens
tttaatgtacctgtcacctgagtagtatacatctgataagtgttttgttttttttttcatccatcacccccctcccatcctcctctcttctgaatctccartgtccattgtaccactctctacaccttcatgtgcccatagcttagtgcccacttacaagtgagaacatgcaatatttgtttgtccattcctgagttactt

SEQ ID NO: 17190 - DNA, 201 bp, Homo sapiens
tctgataagtgttttgttttttttttcatccatcacccccctcccatcctcctctcttctgaatctccagtgtccattgtaccactctctacaccttcatktgcccatagcttagtgcccacttacaagtgagaacatgcaatatttgtttgtccattcctgagttacttcacttagaataatggccttcagtttcatcca

SEQ ID NO: 17191 - DNA, 201 bp, Homo sapiens
tcatccatcacccccctcccatcctcctctcttctgaatctccagtgtccattgtaccactctctacaccttcatgtgcccatagcttagtgcccacttayaagtgagaacatgcaatatttgtttgtccattcctgagttacttcacttagaataatggccttcagtttcatccacgttgctgcaaaagacatgatttca

SEQ ID NO: 17192 - DNA, 201 bp, Homo sapiens
tgttgggcactttggttgattccatatctttgcaattgtgaaatgtgctgcaataaacatatgcgtgcagatatctttttgatataatgacttctttttcrggtagatacccagcagtggattgttgggtcaaatggtagagttacttttagttctttgagaaatctccatactgttttccatggaggttgtagtaattta

SEQ ID NO: 17193 - DNA, 201 bp, Homo sapiens
tgggtcaaatggtagagttacttttagttctttgagaaatctccatactgttttccatggaggttgtagtaatttacatttccacccccagtgtataagcmctcccttttcactacatttctagcaacatctattattttttgactttttaataatggtcattctggctaggataaggtgatatctcattgtggttttaat

SEQ ID NO: 17194 - DNA, 201 bp, Homo sapiens
tattattttttgactttttaataatggtcattctggctaggataaggtgatatctcattgtggttttaatttgcatttctttgatgatatgtgatattgarcattttttcatatgtttattggccatttgtatattttcttttgagaaatgtctattcatgtcatttgcccactttttagtgggattatttgttttttttc

SEQ ID NO: 17195 - DNA, 201 bp, Homo sapiens
aatttgcatttctttgatgatatgtgatattgagcattttttcatatgtttattggccatttgtatattttcttttgagaaatgtctattcatgtcatttkcccactttttagtgggattatttgttttttttcttgctgatttgtttggattccttataggttctttgtcagatgcatagcttgcaaatattttctccca

SEQ ID NO: 17196 - DNA, 201 bp, Homo sapiens
ttgagaaatgtctattcatgtcatttgcccactttttagtgggattatttgttttttttcttgctgatttgtttggattccttataggttctttgtcagawgcatagcttgcaaatattttctcccattctgtaggttgtctgtttactctgataattatttattttgttgtgcagaagctttttagtttaagtaggtccc

SEQ ID NO: 17197 - DNA, 201 bp, Homo sapiens
ggtcttagatttaagtctttaatccatgttgagttaatttttgtatatggtgagacacagggatccagtttcattcttctacatgtggctatccaatgttyccgcactgttttgaatagggtgtcccttttccagtatatcctttgtcgaagatcagttagttgtaagtatttggctttatttatggcttctccattttgt

SEQ ID NO: 17198 - DNA, 201 bp, Homo sapiens
gaacccaggaggcagaggttgcagtgagctgagatcgcgccactacactccagcctgggtgacagagccagactccatctcaaaaaaaaaaacaagcatgraggtgaagatgatctcaaggtacataagatacatacctaaaggtacaaagatataaatcatagtccttggtcaattcattatagtggttttgtagtctgt

SEQ ID NO: 17199 - DNA, 201 bp, Homo sapiens
tacatatgtgaaattagctaagagagtagatcttaaatgtttttaacacacacacacacacacacacacacacacacacacgtttactgtgaggtcatggrtatattaattagattggttttagaagtcatttcacaatgtatatgtatattaaaacgttacattttacattgtagatatataaaatgtttgtcaattata

SEQ ID NO: 17200 - DNA, 201 bp, Homo sapiens
tattttgctcatttttctgttgaggtgttagtgtttttcttaacatttactttatcccttctgcctttaactttattgctttaacccttctgcccacttcscagatattttcttatacccaattttcaattttgtatttagatttttaatatttattttaggtgaaacatctttccatttaagtcttaatcgcaatagttg

SEQ ID NO: 17201 - DNA, 201 bp, Homo sapiens
aaattggttccacctgctgcattctggtgcttctttttttggcccttgggaaatttttattcatacatgcacaggtcagtgctcttccaaatacttgaggraacctttctgcagtctgtttgctgtctctctgtatagctgtttctgttccagcattctgcctttcgaggccctgtggccttggcctccctatactccagt

SEQ ID NO: 17202 - DNA, 201 bp, Homo sapiens
ggtggctcacgcgtgtaatcccagcactttgggaggccgaggcggtggatcacctgaggtcaggagttcgagaccagcctggccaacatggtgaaaccccrtttctactaaaaatacaaaaagttagccaggtgtggtggcgggcgcctgtaatcccagctacttgggaggctgaggcaggagaatcgcttgaacccggga

SEQ ID NO: 17203 - DNA, 201 bp, Homo sapiens
cgcttgaacccgggaggcagaagttgcagtgagccgagattgtgccattgcactccagcctgggcaacaagggcgaaactctatctcaaaaaaaaaaaaamaaaaaaaaaaaaacaaatttgtctgcttcagaaagtgactggctgcttttgatattatgtgttagggaggtggggcagagatgtactgtatcagaaacct

SEQ ID NO: 17204 - DNA, 201 bp, Homo sapiens
ctcatgggcagtacttcaactcatgaataaaattgtgttgggagaaggtcttcagtgctgttgaacgtttctgactggcattagtgggaaagggtgggcawgaattgacaaggacattaaaacttttcctggtcagaaaattggtaagattgtgagatgcttgaggacaggaagtccaaagccttgtggtcttgtttagta

SEQ ID NO: 17205 - DNA, 201 bp, Homo sapiens
ctgtagtggtacccacttttgaactgactccagaacccatattccttttttcttttagagacatggcctcactgtgttgcccagactggagtttagtggcrcgatcatggctcactgcagcctggacctcctggctcaagtgatcctcctgcctcagccatctaagtagctgggagcacaggcgcgtgccaccacaaccat

SEQ ID NO: 17206 - DNA, 201 bp, Homo sapiens
ggcttttatagggcggctctaaggaatgacttctgagactcagatgagttattattgggctatttgtcagtgtccttggggcattgcgagccaaagcccarcttggctacccactccacataccttctgcaattcttctgggaaacatgcagctctctctgtcccagctttttagccccagaacgttgctatgaaagagac

SEQ ID NO: 17207 - DNA, 201 bp, Homo sapiens
agacatgtggaaaatgagtaggtgttttatttaataatgtaaccagtttcttgttgttaaagttttaagagagaaatgtacttaagaaggtaaaggttgtscctgacaagttagttataatagtttaattttaagatgagtcatgccttttcccctgctattttggcctatgtaaatcatctgggaaggcccttgccagga

SEQ ID NO: 17208 - DNA, 201 bp, Homo sapiens
cctctagaggagtgtaatcttcctctgagcacactggaagattacagttcccagcttccttgcagttaggtaggatcatgtgattagttctagccaatgaygtggaagtgatgggtattatttcctggtcaagacattaggagctagtgtgccacttgcattctttccctttccctgccacagtgactttgggggccttgt

SEQ ID NO: 17209 - DNA, 201 bp, Homo sapiens
gtgattagttctagccaatgatgtggaagtgatgggtattatttcctggtcaagacattaggagctagtgtgccacttgcattctttccctttccctgccmcagtgactttgggggccttgtgtttcagatggtggggtctccattgggctgatccaggaaggactgagtggagtagagtccattcccttcccccatcaac

SEQ ID NO: 17210 - DNA, 201 bp, Homo sapiens
tgatgggtattatttcctggtcaagacattaggagctagtgtgccacttgcattctttccctttccctgccacagtgactttgggggccttgtgtttcagrtggtggggtctccattgggctgatccaggaaggactgagtggagtagagtccattcccttcccccatcaacatattagacaggtaacttgagcaagacaa

SEQ ID NO: 17211 - DNA, 201 bp, Homo sapiens
cacatgagctttctcagagctgtttgcttataaatatacatacaatatcatagacacaggatgcagaattcaaaagttatcaacgtggccgggcatggtgsctcattcctgtaattctagctcttagagagactgaggggcgaggatcacttcagactaagagttcaagaccagcaacatagcaagaccttgcctctacaa

SEQ ID NO: 17212 - DNA, 201 bp, Homo sapiens
ttcaagaccagcaacatagcaagaccttgcctctacaaaaaatgcaaaagacttagccaggcgtagtggcacatgcccgtagttccagctactcgggaggstggggcaggaggatcacttgagtctaggagttggaggttacagtgagctgtggtagcaccactgtgctctagcctgggtgacagagtgagaccctgtctc

SEQ ID NO: 17213 - DNA, 201 bp, Homo sapiens
tcctctgttgcccaggctggagtgcaatggtgcaatctaggctcattgcaacctttgcctcctgggtccaagcgattctcctgcctcagcctcccgagtcrctgggattccaggtgctcgccaccacaccaagctaatttttgtatttttagtagagacagggttttgttatgttggctagactagtctcaaactcctgac

SEQ ID NO: 17214 - DNA, 201 bp, Homo sapiens
tttgcactgaggtgggagcaactgttctcttaattgctataataatctttacccaggctccattctgttactgcaactgaagaatcccaatacatatagcrgttcccatgaggaacacccatctgtccttgactggtaaatgtgggaaggttgttctctttcaccatggacttgtgcgtcaaatcaactgatcagtctggg

SEQ ID NO: 17215 - DNA, 201 bp, Homo sapiens
ctagccttgggtacccaccattctattctttgcttctttgagttcagttgtttttgattccacatgtaagtgagaatatgcagtatttgtccttctgtacstggcttatttcacttagcataatgttctctcattccatccaatgttgctgcaaatgacaaaatttctttctttttaaaggctgagtggtatttacgggct

SEQ ID NO: 17216 - DNA, 201 bp, Homo sapiens
cttgatctgtctgactagatcaggtccctgcactatactttaccattactctcatgaaagccatgcttgagagctcaagctttattctggaggcactgagrttctatggcagatagagtttgagagtacttacctgtttcgtgaaggtccagtgctgctagagacattaaagttgctgaagtggtttttggtcatataatt

SEQ ID NO: 17217 - DNA, 201 bp, Homo sapiens
agccatgcagaatgtggacagtgggtttggaattgtcattgagatgccactttcttattcttcttgtgttggtgcctagagtcacaatccggcctgaaggsccaggaggttttctggcccagggtagatcccccttggcccacgtacaagaatcttcatgctgactgagttggaatctcctggtgagaagtgatttgttgt

SEQ ID NO: 17218 - DNA, 201 bp, Homo sapiens
tattaaatttttttaaaggtttaaggtgtcgaacatttgagaaaacagagttgctgcccttgtgctgctcacatgtgtgttagcacatgtaacagacatayacatgaataaggcatgatgtgcagtggcaaatgagggggtagaaaatacatgttctgagggtgctgcagagaacagaagtcagattcagaaaactgggca

SEQ ID NO: 17219 - DNA, 201 bp, Homo sapiens
gactagagaggagaggctggaggcatggggacctgctgcaaaaattttgctgcaaaattatgaggttctgaaccagggcaataattggagggaattaaaargggtggtaaattcagagtttttgttgattgttagtttgagactcagtcttactgtgtcacttaggctggagtgcagtggtgtgatctctgctcactgcaa

SEQ ID NO: 17220 - DNA, 201 bp, Homo sapiens
ataattggagggaattaaaaggggtggtaaattcagagtttttgttgattgttagtttgagactcagtcttactgtgtcacttaggctggagtgcagtggkgtgatctctgctcactgcaacctccgcctcccaggttcaagtaatcctcctgcctcagcctcccaagtagtggtattacagatgcgcaccaccatgcttg

SEQ ID NO: 17221 - DNA, 201 bp, Homo sapiens
tttttttcatgtatctggtggccatttgtcttcttttgagaaatgtctattcaggtaccttccccattttttaactgggttattaaatttttaatgtagargtatttgagtttagatattaatcagatgtatagcttataaatgttttctcccaatctgtaggttgtctcttcacttttttaattgtttcctttcttgtgc

SEQ ID NO: 17222 - DNA, 201 bp, Homo sapiens
gatatttccagttaataggtcctgaattcctatttgagagccataccacaaaattgagtgagtgtgtgtgtgtgtgtgtgtgtgtgtgtgtgtgtccatcygtccatccgtcgtccatctcctctgggtaaatatgtgccgagtagcaggtagttctgacattgaagactctgtagacagtggcgtttaggcagggactgc

SEQ ID NO: 17223 - DNA, 201 bp, Homo sapiens
gcttactaatgatataaaatttgacaaattacttaacctttctgagtctcagttttttcatttgcaaaatggaaatgataatacctttatcttatagactkatttttaggattcagtaacatagtatatgtgagcagcacctggcatatagaaagcacccaataatgttggctgctgtatcattatcatcattatcatgag

SEQ ID NO: 17224 - DNA, 201 bp, Homo sapiens
tggattcatttcacagagttggggaggaagtgagggtaataagagtgtgtttctgaggctcttccttccagcagataggttttgttttcttggttgtaaargaggctaatgcttcagaagctagagtgattcctggactctcttggtaagactaattatgctgtttcctgctcccgtctgtgaatcagctttgttacatag

SEQ ID NO: 17225 - DNA, 201 bp, Homo sapiens
tacatggggctgtttttcaccatcatctgaaacaccagcgttgccaactggagctctgaggtctagctttcgtacattgccccagcatccgagcttaaacrtgtggggcaggccatcttttcccacagcagcctgaacattccagcggtcgcccacatgactgtccccgagagtttctgcagtggcaggcaggctgctgtg

SEQ ID NO: 17226 - DNA, 201 bp, Homo sapiens
tgagatgaactgaaccaagtgtgtctttaaggtgggaatgaaagcctgctttgttggcagcctcttgaagacttctgcctttgtgccttcctttcaagacrgtggagtttatctcctgctttcctgggtgagtagactatgaagggcgggggaggggaaggaaggatgaagacagcagccttaagtagtccagtagacgtg

SEQ ID NO: 17227 - DNA, 201 bp, Homo sapiens
ccatgtgtttttagggaattacagttttatatgaaacagaagatgatagaagataaaatatgagaagtaagcaggacctgtatcaaaagggtttttttttyccccaggctaaggaatttggatttaaaaaaaaaaatccttttttgtgtgtgtcctccaaatgccaataaccgaagcatatataaacaaaggtgctctggt

SEQ ID NO: 17228 - DNA, 201 bp, Homo sapiens
gaagatgatagaagataaaatatgagaagtaagcaggacctgtatcaaaagggtttttttttcccccaggctaaggaatttggatttaaaaaaaaaaatcmttttttgtgtgtgtcctccaaatgccaataaccgaagcatatataaacaaaggtgctctggtttaggtgggattttgaagccaaagctccttgtctcctt

SEQ ID NO: 17229 - DNA, 201 bp, Homo sapiens
gtggaaaggtccgcttgaaggtagaagcgtagagatgtccgcagtctacagggaacccttaaagccattggaagggcagatcacccagagagagagcaaaycgaagagatgagaggaggatgaaaggtatgaccttgggataacaacagttcctcatcctagaatgaggaaaggcatacaggagactgagaaggaccagct

SEQ ID NO: 17230 - DNA, 201 bp, Homo sapiens
gagagatcaagtgaaatcagaacttgttctaaaaataaaacccaccctcaaaggataaagagataaagattttccaccactagggatatgcaaaaagataygcctctggcttctggtacttaaaaattttatggttgtgattgttcagtggttgcctgatttcctttaaagtttttccacttaaagtaatagacattttca

SEQ ID NO: 17231 - DNA, 201 bp, Homo sapiens
cacgcccggccaatttttttgtatttttagtagagacggggtttcaccgtgttagccaggatggtctcgatctcctgacctcgtgatccgcccgcctcggyctcccaaagtgctgggatcacaagcgtgagccactgcgcccggccaagattttaattctttaccattgagtataatggtagctgtgggcttatgtatggc

SEQ ID NO: 17232 - DNA, 201 bp, Homo sapiens
ggcctagacgggcggatcatgaggtcaggagatgctgaccatcctggctaacacggtgaaaccctgtctctactaaaaatacaaaaaaaaaaaaaaattakccgggcttggtggcgggtgcctgtagtcccagctactcggaaggctgaggcaggagaatggcatgaacccgggaggcggagcttgcagtgagccgagatg

SEQ ID NO: 17233 - DNA, 201 bp, Homo sapiens
catattaatacttccaaatttgaaaagtttgaaagccacttggtaggtctctatgtttactactatcattttcagacacatgattcaaaagggaattatcwtgttcatgcctctgttgtttgagatgtcagcctcctagttcattgttaccttctttttttaaaatttaatttaatttaatttaaattttttgacatggag

SEQ ID NO: 17234 - DNA, 201 bp, Homo sapiens
ctgctatagaatgaaagtcctgactgctttgaattaaaaaccttctccatcttctcacacttctcaagaatagaaggaatgaccctggctgggagaccagkacacaatctgtgtattgcctctgtgaccttgtgaccttgtaacattgcattattccatgtaggttcttgcgcgtgagtgtgtatgtgtgtacgtgtgtgt

SEQ ID NO: 17235 - DNA, 201 bp, Homo sapiens
ttagaggcatttggcaggaaaaaaaaagatattcacatttgtaaaaaaaaaaaaaaaaaaaaaaaacttaatccatgctcacagatggtcctgttcaggtkctattttaattatgaggtaaaaaaacagccccacacagtaggaagtcgtcttaataaatggactggagcttttgtcttcaagcgtcaaaaagcctcgtta

SEQ ID NO: 17236 - DNA, 201 bp, Homo sapiens
tttgtaaaaaaaaaaaaaaaaaaaaaaaacttaatccatgctcacagatggtcctgttcaggtgctattttaattatgaggtaaaaaaacagccccacacrgtaggaagtcgtcttaataaatggactggagcttttgtcttcaagcgtcaaaaagcctcgttactgagaaatttaaatactttgtattataggggagagt

SEQ ID NO: 17237 - DNA, 201 bp, Homo sapiens
aaaaacagccccacacagtaggaagtcgtcttaataaatggactggagcttttgtcttcaagcgtcaaaaagcctcgttactgagaaatttaaatactttrtattataggggagagtctcaaaatgaccaggatacttggagaaagcaaaatgatggattcttctaaagatcaaatgagtatacgagaaatgttttacaat

SEQ ID NO: 17238 - DNA, 201 bp, Homo sapiens
cccacacagtaggaagtcgtcttaataaatggactggagcttttgtcttcaagcgtcaaaaagcctcgttactgagaaatttaaatactttgtattatagkggagagtctcaaaatgaccaggatacttggagaaagcaaaatgatggattcttctaaagatcaaatgagtatacgagaaatgttttacaattgtatagct

SEQ ID NO: 17239 - DNA, 201 bp, Homo sapiens
taggaagtcgtcttaataaatggactggagcttttgtcttcaagcgtcaaaaagcctcgttactgagaaatttaaatactttgtattataggggagagtcwcaaaatgaccaggatacttggagaaagcaaaatgatggattcttctaaagatcaaatgagtatacgagaaatgttttacaattgtatagctttgagcttc

SEQ ID NO: 17240 - DNA, 201 bp, Homo sapiens
ataaatggactggagcttttgtcttcaagcgtcaaaaagcctcgttactgagaaatttaaatactttgtattataggggagagtctcaaaatgaccaggayacttggagaaagcaaaatgatggattcttctaaagatcaaatgagtatacgagaaatgttttacaattgtatagctttgagcttccttagtattggtcat

SEQ ID NO: 17241 - DNA, 201 bp, Homo sapiens
taaatggactggagcttttgtcttcaagcgtcaaaaagcctcgttactgagaaatttaaatactttgtattataggggagagtctcaaaatgaccaggatmcttggagaaagcaaaatgatggattcttctaaagatcaaatgagtatacgagaaatgttttacaattgtatagctttgagcttccttagtattggtcatt

SEQ ID NO: 17242 - DNA, 201 bp, Homo sapiens
gcctcgttactgagaaatttaaatactttgtattataggggagagtctcaaaatgaccaggatacttggagaaagcaaaatgatggattcttctaaagatyaaatgagtatacgagaaatgttttacaattgtatagctttgagcttccttagtattggtcattttagtgatattttttccagtgataaatgtcgtagata

SEQ ID NO: 17243 - DNA, 201 bp, Homo sapiens
ttgtcagtggtcaagccaggatttgagcccaggcagtcagcttctggtgtcttcttcttaatctacttccttttgtgatagattaagaaatattattctcyctctgttctctaaagaagaaaggtggagaagcaacatggaaacatgcaacatagcatatgataatgccatgattatccatgttttctgaagggctctaac

SEQ ID NO: 17244 - DNA, 201 bp, Homo sapiens
tcattaaacatataccaatcaatgaagggtaagtaaagtcaaagagaaaagaaggtcaaagggaagtggctgacataaaacttaggtgcagaactctgggkgcacaggggatgcattcaggaagggtgctggtgtggctgcagggtagagagaagggtgaaatcttcagaactttagaaggcagagtaaagagacgacggt

SEQ ID NO: 17245 - DNA, 201 bp, Homo sapiens
cttctgttgaagcctgggaagacagatgtagctagccagatgcactggcttgtgtttcatcattatcagagacatttcaatttcagatctggccaggcatwtatcagctttacctgaaatctcttttaaaatacactttcgcttctaattcagtcagcatatgttgggatctaccctggggaattcagttatgatgaccaa

SEQ ID NO: 17246 - DNA, 201 bp, Homo sapiens
tccaaatcttacctggacttacttttctgtatatttgtgttattgttggggcctagattgacctcttttgtgtggacagcacagagaacatagggaagacytcagcatgcaagctgattgacatcatttggatctgtgtctctgaccaaatctcatgtcaaattgtaatccccagtgttggaggaggagcctggtgggagg

SEQ ID NO: 17247 - DNA, 201 bp, Homo sapiens
gcaatttgaatgtagtctgcttctataatggaaacagtattccaaatcttcattatttaagtttcatagaaaataatgaatcattgaattggttattactsaacattgttaaggcatatactgaattctttgttttcttgtcttatagccttatatcagctcaaaggataaaatagtatgaagatttcattttatggatac

SEQ ID NO: 17248 - DNA, 201 bp, Homo sapiens
gcatgcgtcaccacgcctggcttgtttttttgtatttttagtagagacggggtttcaccatattggccaggttggtcttgaactcctgaccttgtgatccrcccaccttggcctcccaaagtgctaggatgacccccttttataaaacgtcccatcatgttagctccatatagtagggattagtgacatcaaattcttttt

SEQ ID NO: 17249 - DNA, 201 bp, Homo sapiens
tttgtcctttatctgaaataactctcttgcctgaataacagtttcccaagccttaggaaacaggtaaggacattcggcccagagccctgatgtttactaarggtccttggtccaggagctgtccctcagccttcactagatcagacatgtagactagaaaattacttgcttattttttggggggggcttgttttctattaa

SEQ ID NO: 17250 - DNA, 201 bp, Homo sapiens
gtactttagtttttatatagagcacattgaaaacttggtaatattagcattcgacaactaaaactaaagccacgctaacattttgtaaatagaaagagtcrcgtattttggttttaaatattgtaagtttttttttttttggtgttgcagttgcagctgtgtcctaaaggttgtaaggttgttatattcataacaaattta

SEQ ID NO: 17251 - DNA, 201 bp, Homo sapiens
gtcctaaagcactttatgtgagacttagattttcttttttcatggtgtaagttaaatatgaagtaatcttgattaggccttttgttcacagaaccaatgarctgatgaaaaccttgatgatattcatgtgtctaatgttatcatcggaggggtttcagtgaaacagcttaactttaggttcagagaggtttcattctcaca

SEQ ID NO: 17252 - DNA, 201 bp, Homo sapiens
agagttcatttttatagtttgcctttaaaacatgcaacagacccctagggtattggataatttttagaggagatgctgacctggtggtcagccattttgasggaactggggcccaggatatcttcaggcaagcataaagatgtgtggcatacattgttctgaaacttaaacactgactttctcagtggagtggaatttggg

SEQ ID NO: 17253 - DNA, 201 bp, Homo sapiens
gtgtgaggtggcatcgagaaaatgaacgccaaggttgacaccaaatgtagggcccgagtgatttttctgtttttcaaatccgctgtcagttctccacctckgactcttagtctttttctccttccccacctctagagagaggacatttcctgagtaaaatgaaaatcaaagctaggagctaatcatatttttaaagtcaga

SEQ ID NO: 17254 - DNA, 201 bp, Homo sapiens
ccgagtgatttttctgtttttcaaatccgctgtcagttctccacctctgactcttagtctttttctccttccccacctctagagagaggacatttcctgartaaaatgaaaatcaaagctaggagctaatcatatttttaaagtcagatatgttgggggtataactggaagctaatttttaaaagaatcctgccatatctt

SEQ ID NO: 17255 - DNA, 201 bp, Homo sapiens
caaggaaaggaaatattctacccatgtcataacatatctaccatttattgagcacctactatgtgccaagttgtattctaaatgcttcatgtattatctcmtctgatccttaaggcagactcataggtaggtactactgttatctcctattttataggtgaagaaattgaagtctagagaggttaagaattttctcaaggt

SEQ ID NO: 17256 - DNA, 201 bp, Homo sapiens
tccacttccacttaatgaatagtaaatacattttctcttcttcgtgattttcttaacattttcttttctctagcttactttattgtaagaatacagtataraatgtgtgtgtacatataaaaaatatatgctaattgactgtttatgtgaatcagtaaggctgccggtcaacagcaagctattaatagttaaatttgggag

SEQ ID NO: 17257 - DNA, 201 bp, Homo sapiens
ccaaaacataccctcttctgtaacccaaatctcagcgtgtgtccttattttccttgttttcagcatgtccaagtgaagccattaagtaggtaatatactgktagacacagatcgtggtgcttgggaaaacaacacccaagcctcgtgattaataagcactgttaattgttaagctgctcttgctggtgtctgacctcacgg

SEQ ID NO: 17258 - DNA, 201 bp, Homo sapiens
ctcagggatttcttctttaccatgtcatagtctccaaaattgtgcccttcctttctgtcaactcaagtgtttcctcctttttttttttctgagacaaggtytcgctctgttgtccggactgcagtacagtggtgcaatctctgctcacagcaatttccgtctcccaggttcaaacaattctcgtgcctcagcctcccgagt

SEQ ID NO: 17259 - DNA, 201 bp, Homo sapiens
ccgagtagctgggattacaggtggacactaccactcccagctaatttttgtattttttggtagagacgggtttcaccatgttggccaggctggtctcaaaytcctgacctcaagtgatccgcccgtctcggcctcctcttaagaggtattttttactctgtatccagagcttcctcatatacccatgcagcatgtggaaaa

SEQ ID NO: 17260 - DNA, 201 bp, Homo sapiens
ctcctaaccttagataaaccgcccacctcggcctcccaaagtgctgggattacaggcgtgagccaccgcgccccagccctcattgtggccttatttttttwtttttttttttttttttgagacggagtctcgctctgtcgcccaggctggagtgcagtggtgcgatcccggctcactgcaagctctgcctccgggcttcat

SEQ ID NO: 17261 - DNA, 201 bp, Homo sapiens
aataatagaaaattaaatagtgttcattattgtgagaattcccagaacccttaatattcccatgttgattgttactgtccaagatggggccactgtctagygcacttcctaggatagatttgtccataggcccctcttttatgtaaccatctgccgaactgaggccttggaaaggcttgatgtagaccgctctttcagaaa

SEQ ID NO: 17262 - DNA, 201 bp, Homo sapiens
ccctcagtgttcttctatttataaggaacagaaaacccaacttaaattgacttacgtaaaaagagtttgttggttggtgtaattgaaaagtacatggttarctagcttcaggcatagcttgatccaggtattaactatgtcaccaagatccatctcactgctcataagccctctcagttggctctattcttatgttcctca

SEQ ID NO: 17263 - DNA, 201 bp, Homo sapiens
ctttcacatttaaggtatttctttgatttatcagaatttctaagaacataaaatagaagtcagaaagtctgttttctgagctgggacctgccattcatcasctgtgtgatcttgggtatgttactttatttctctgggccccattttccccagctataaaatgaggggtttaaactagatgagctctaaagagcttttcac

SEQ ID NO: 17264 - DNA, 201 bp, Homo sapiens
cagctgtgtgatcttgggtatgttactttatttctctgggccccattttccccagctataaaatgaggggtttaaactagatgagctctaaagagcttttyacttcggagtttggctattccaagaccttttctagtcttgtgaatttaattactgaattctgggatcttaagtctctttatcagttgagtctcctccttt

SEQ ID NO: 17265 - DNA, 201 bp, Homo sapiens
ttattcttattttccacttagaggtagagactgggtctcaccatgttgcccaggctggtcttcaactcctgggctcaggctcaagtgatcctccgacctcrgcctcctgaagtgctgggattacaggcatgagccactgtgtctggccacaatacacacttgactgtcatttataaactcaaatgactcagctatcaagat

SEQ ID NO: 17266 - DNA, 201 bp, Homo sapiens
cttcaactcctgggctcaggctcaagtgatcctccgacctcggcctcctgaagtgctgggattacaggcatgagccactgtgtctggccacaatacacacktgactgtcatttataaactcaaatgactcagctatcaagatgccaaattggattttagagagcctcctcctaggcacctgatactttcatgcttggctta

SEQ ID NO: 17267 - DNA, 201 bp, Homo sapiens
cctttataggacttggcttaatatttttattttattttatattattaaattaatatatttttattttataaaataaaaatattaagccaagtcctatgaargccagcagattttattttatatatataaattttttaaaatatgaaataaatatataatacatatataaatatatttttaaaatatgtaatatacatatat

SEQ ID NO: 17268 - DNA, 201 bp, Homo sapiens
aatggctatataacatagctgtgtcccaaatacatgtaatacatattacttttcatctcatttaaacctcacgagagttctttggtgaagatatgattacyattttacagatgagaaaacctgagaagaatagaagttaagtagcatgccaagcttacccaactagctctcattcattcattcatgattcatgaagtattt

SEQ ID NO: 17269 - DNA, 201 bp, Homo sapiens
ccattttttcaacaacatgtgctcacttcgtgtctctgtcacattttagtaattcttgcaatctttcaaaagtatttattaagataaaaaacaaaagaaaygatataaaaataaagagaaaaaggaagaaaatttgttattattatacctgtcatagtgacctgtgatccgtgatctttcatattactattgtaattgttt

SEQ ID NO: 17270 - DNA, 201 bp, Homo sapiens
tgagagaagtgagaaactgcagaagaaaagttgaaaggtagcagaggatggttcatgagatttaagaaaagaaactgtctccataacataagtgcaagatraagcagcaagtgctgatacagaggctgcagcaagctatccagaagatctagctaaggtcattgatgaaatggttgcaccaaacagcagattttcaatgta

SEQ ID NO: 17271 - DNA, 201 bp, Homo sapiens
gctaaaggctcagataattgttagcattttttagcaatcgagtatttttaagtatgtacatcgttttttacactatattgtagtctgctatgcatgcaatrgcattatgtctaaaaaacataatttttatatgcactgggaagccaaaaaattcacgtgagctactttattgctatatttattgtggtggtctggaactga

SEQ ID NO: 17272 - DNA, 201 bp, Homo sapiens
gatcccggctcactgcaagctctgcctccgggcttcatgccattctcctgcctcagcctcctgagtagctgggactacaggcgcccgccaccacgcccggstaatttctttttgtatttttagtagagacagggtttcaccatgttagccagcatggtctcgatctcctgacctcgtgatccacctgtgttggcctcccaa

SEQ ID NO: 17273 - DNA, 201 bp, Homo sapiens
tctctctctgtccatcttatgcagctgaaaactggcatatgactctttgagaagagctcaaacagttgtggtaagggtgcttagatgttgagtgctatctrttttctggggtgtgaaacatacagggttttaccagtctgttgttgcagagtgctgggtgtattttgctttagctgactgttccgttggagtattcagcct

SEQ ID NO: 17274 - DNA, 201 bp, Homo sapiens
ctgtctcattccagaatcccctcctcttcaccattatgctaaaaatacagttgtctgccaacatgacaaacctggatgtttccccagaaaatgaaggcttytgacttgtcatgaaaaaaaaaaaaaaaaaaaaaaactggaagacttgtcctcttggaccgagcaacagtcacttgtaacaatgggcagctgcccatttta

SEQ ID NO: 17275 - DNA, 201 bp, Homo sapiens
cagtaatatatgcagatactggtttgatgttattgagatttaaattcagttgtgttggcatggttacagcttagatagatagatagatacatacatacatmcatacatccatacatacatacatacattcattcatgtgtttgtgtatgtgtatgtgtgtgttactcctccttaatggacaaatggtgatatggtttggct

SEQ ID NO: 17276 - DNA, 201 bp, Homo sapiens
tatgcagatactggtttgatgttattgagatttaaattcagttgtgttggcatggttacagcttagatagatagatagatacatacatacatacatacatmcatacatacatacatacattcattcatgtgtttgtgtatgtgtatgtgtgtgttactcctccttaatggacaaatggtgatatggtttggctgtgtcccc

SEQ ID NO: 17277 - DNA, 201 bp, Homo sapiens
tacttgaggtcaggagttcgagtccagcctggccaacatggcgaaacttcatctctactaacaatacaaaaattagctgggcatggtggcacatgcctgtratcccagctacttgggaggctgagcaggagaatcccttgaatctgggagacagaggttgcagtgagtcaagatggcaccactgtactccagcttgggcaa

SEQ ID NO: 17278 - DNA, 201 bp, Homo sapiens
ccattgtaaccagggaaggatacatgaggattcctcttcagggaagctgaccagcccaataaaaaatatataggttgacatttggagatatcttaaaagayggccaggtttccatcatatcgctctgtagtgaggcccaccagttgacaaactaagcttctgcacattcagcttctgatctgtttcatattccctcactgg

SEQ ID NO: 17279 - DNA, 201 bp, Homo sapiens
ggtataagtgtttgtatggcttttactatacattaccaaaaaaatgtctaggctgtttttctgtttgtttgttttttgttttttgagacagtctcactctstcaccaggctggagtgcagaggcactatctcggctcactgcaacctctgcctcccaggttcaagagattctcctgcctcaacctcccaagtagctgggat

SEQ ID NO: 17280 - DNA, 201 bp, Homo sapiens
acattggaggctatcaaaggaggaagtagatttccttgaccccatctgcagtgcacaattgattaacaggatagttatgagagtgtgagagagagacagasagagagaagagagaagtcaccgaaaggttaataccagctaaagagaaacatgattataggacattaggctttttgtaaaatcataaggtcaggataagat

SEQ ID NO: 17281 - DNA, 201 bp, Homo sapiens
agttaaacacttcctttcttctactttccctcttccctatcactttactccctaaagatttaaaaaaaaaaatctgctttctgaaaatcccatgagtttargtctgctgggtatttctatgcacagatgtcttcatcccagagacaagaagagtaattggatggtaagttgcaaaaagcatgcaagttctgctctgcctct

SEQ ID NO: 17282 - DNA, 201 bp, Homo sapiens
tacataagatcttagggaaaaaatggattttttagttgtctaaatgacactgcaatttgttacagcccaacggatacttcttgcttgctgcacagaaaagycaatgcactgaaacagtggtgttgcggcagaaaaacagtttaataatctcaggaccagctaagtgaggagatgggagatatttctcatatttgccttccc

SEQ ID NO: 17283 - DNA, 201 bp, Homo sapiens
cagtttaataatctcaggaccagctaagtgaggagatgggagatatttctcatatttgccttcccaagaatttggaagctagggttattaaggaaatttgrtgggcttggggctagggaatggatactgctgattgggtggagatgaaatagcacgggcgtcaaaactgtctttgtgcctgagtcagtttctgggtggggc

SEQ ID NO: 17284 - DNA, 201 bp, Homo sapiens
gaaacagaaaattcaggaaacttagaccaatatatgggaggcatcaaaagatggctccattctgggaagccttcaaaggtttccgaggctaacagtgacawgatgctggtgatattacaggcagattagtctagtgggcagtgtctacaatggatttgagttgttcttgcttgaggcaaagggatgtacctagagaaaagc

SEQ ID NO: 17285 - DNA, 201 bp, Homo sapiens
atctgacagagcagttataatagaaaagacgtgaatttcagaggacttctaagttgacagaactttgtaatcaattggtttggaggatgaagaagaggaaygagccaagagtgattctctgatatcaaacccagaaacaagtggacatttggaggctccaaaaccaatttgagtatgggaagaggttttaaagatacagcc

SEQ ID NO: 17286 - DNA, 201 bp, Homo sapiens
gacagagcagttataatagaaaagacgtgaatttcagaggacttctaagttgacagaactttgtaatcaattggtttggaggatgaagaagaggaacgagscaagagtgattctctgatatcaaacccagaaacaagtggacatttggaggctccaaaaccaatttgagtatgggaagaggttttaaagatacagccatgt

SEQ ID NO: 17287 - DNA, 201 bp, Homo sapiens
aaattatgaaattattccccaaaggactacttagatcattatgtctgctcagtcatctgaaatatattgatatccaaagtacacatccagtaattaaaagraaaaagaatccaaacagtttgttgattttgatattttgttatgggttagtaattgccttgactatcttcttgcagagcttgtagttaaaggcttgcttat

SEQ ID NO: 17288 - DNA, 201 bp, Homo sapiens
atccctcatggcttggtgctgtccatgatctcatggacagtgagtggggtctcacaaaatctggttgtttaaaagtgtggcatctccctcccctccactcratctctcttgtgcctgctctggccatgtgacataaccgctcctgcttcaccttctgccatgagcaaaagctctctgaggcctccccagaagccaagcata

SEQ ID NO: 17289 - DNA, 201 bp, Homo sapiens
gtgaccgcccagcacaacagatgaaaaatgatcccactatggcattttatcatgaaatttcctaaccccagaggaaaagagaagattctaagagctctcayttgcatcctgagctggtctaggatccagggtttccttgggccaatgcttcagatagttaaactcatcttttgcttggtcagggatgtggtggttgcctgg

SEQ ID NO: 17290 - DNA, 201 bp, Homo sapiens
agcaaatgaatgcttatatatagtcattatgttaaaaaatatgtaaaaattacgtatgcatatatcaactaggcttgttagaatagtagtattacgtgtamctttaaattttccttaacaccatcattaaattattttagcagttaattttagaaaacatatttaatacaaatacaccctacactacttctcatcttagag

SEQ ID NO: 17291 - DNA, 201 bp, Homo sapiens
aaaataccgaggcttctccccattttattcttccacattgagtgtacagctattagtaaaatgaaatattatttgcaaaaatgctttgaaaatgttaaagyactattctccttaaatttaagaatattgtcctggaaagatttaaaatgactaagggtactattactttatcacagaagaatcatgctgtgttagtccatt

SEQ ID NO: 17292 - DNA, 201 bp, Homo sapiens
ggtctacagctcccagcgtgagtgacgcagaagacgggtgatttctgcatttccatctgaggtaccgggttcatctcactagggagtgccagacagtgggygcaggccagtgtgtgtgcgcaccgtgcgcgagccgaagcagggcgaggcattgccttacctgggaagcgcaaggggtcagggagttccctttccgagtca

SEQ ID NO: 17293 - DNA, 201 bp, Homo sapiens
cctcccaaatagctaggattacaggtatgcaccgctatgcccagctagtttttgtatttttagtagagacagggtttcaccatgttggccaggctggtctsaaactcctgacctcaagtgatccacctgccttggcctcccaaagtgctgggattacaggcgtgagccactgcgcctcatctgctcttatctttcacattg

SEQ ID NO: 17294 - DNA, 201 bp, Homo sapiens
ggtttcaccatgttggccaggctggtctgaaactcctgacctcaagtgatccacctgccttggcctcccaaagtgctgggattacaggcgtgagccactgmgcctcatctgctcttatctttcacattgactttgacgatttatttttattgttgttattgttgtctccttttcttttttcttttcttttctttcctttct

SEQ ID NO: 17295 - DNA, 201 bp, Homo sapiens
tctgaaactcctgacctcaagtgatccacctgccttggcctcccaaagtgctgggattacaggcgtgagccactgcgcctcatctgctcttatctttcacrttgactttgacgatttatttttattgttgttattgttgtctccttttcttttttcttttcttttctttcctttctttccctttccctttccttctccctt

SEQ ID NO: 17296 - DNA, 201 bp, Homo sapiens
ctgaaactcctgacctcaagtgatccacctgccttggcctcccaaagtgctgggattacaggcgtgagccactgcgcctcatctgctcttatctttcacawtgactttgacgatttatttttattgttgttattgttgtctccttttcttttttcttttcttttctttcctttctttccctttccctttccttctcccttc

SEQ ID NO: 17297 - DNA, 201 bp, Homo sapiens
attacaggcgtgagccactgcgcctcatctgctcttatctttcacattgactttgacgatttatttttattgttgttattgttgtctccttttcttttttyttttcttttctttcctttctttccctttccctttccttctcccttcctccctccctcccttcctttcttccttcctcggttccttttcttccttttcttt

SEQ ID NO: 17298 - DNA, 201 bp, Homo sapiens
cctgcacaatgtgcacatgtaccctaaaacttagagtataataaaaaaaaaaaattaaaaaaaaaaaaaaaagaatttccctaagtcaacaagacaaggtytaataaacttcaggtctaacaaagacttctgctgtttaatgtaaaaaaaaataaaaaataaaaaataaaaaaataaaaatacttgaaaaaaaaaaaaaaa

SEQ ID NO: 17299 - DNA, 201 bp, Homo sapiens
gatttgagttgcttgggtggagtaggtacaagttggtgattaccattcaggttggctgccatctgggtaggtctcccttcatggaaggccccagcagggargctgtaatcatgtgctcagtgaaggcaaaagtcgttttgatatctttttagtaaatcattccaccaacgctgtgcaagccataaatgtggcacagattaa

SEQ ID NO: 17300 - DNA, 201 bp, Homo sapiens
cctcacggaaattggtttgtttctactttctctgaaatactgtggccctgggagactcctgctcagtttagcaaagaattctctactgttttgggtcttartctaagcactggatgtgtgcttttcacccaactagattatggagtctctgtgaacctagggagatatcttagtctgctcattgattaccttacggctcct

SEQ ID NO: 17301 - DNA, 201 bp, Homo sapiens
actcacgctgggagaagccagttctacattgtgagcaaccctatggagaagcccttaagttgctgaagcctccagccaacagccatgtcgctgattttggraggcgattttggaagcttatctcccagaccaaatcaagcctcaggtgactgcagccccagctgaaacattgattgcattcttatgagaaaccctaaaacc

SEQ ID NO: 17302 - DNA, 201 bp, Homo sapiens
gttctattatatttagaaagagaaggaatggaaacctgactagtcattatactgaggttgggaaatctggaacttgagttctgaatcagttttctgtagayagcctgtttcacagtggatttgcttaatgttttaccggtaaacaggcactcctgtttattttcagctcttgcctttcagcacaggatagctacaattgtt

SEQ ID NO: 17303 - DNA, 201 bp, Homo sapiens
tgccaagaacacgttggtaatgggatgtaaatctcccggtgcacacctgattaaacaggcctgtatacgtgaattaaaaaagagggtgagccccttgccawcacggggtgacagggaagcacgccagataaccggagctcagttggctgaagggagctcggtggctgtttttattaacttgagagctaaggtcatgcggct

SEQ ID NO: 17304 - DNA, 201 bp, Homo sapiens
ggtcaggctttaattacatgcacagttaaatggaaatactgtagagaggtcacactcatatttctttggctttcattaatgttattgctctgtcactttcyctctccttaggtttgtaaatgaaagttcctttagtacatttaaaagcattatttatttttaattgtcttacctctggagggagaggttacttctttttgg

SEQ ID NO: 17305 - DNA, 201 bp, Homo sapiens
agagagcagcagccccagttctgcaaatccttgatggctgcaggctgaagtatcgtttccatctttcaagcaagaatatcaaccatatatatttccaaaamattacccaagaaaacgaaagcattttttgatcatgattatttttttacacatacataattaaactgatcgctccagttttatgttgggctttttctgcac

SEQ ID NO: 17306 - DNA, 201 bp, Homo sapiens
cctaccaccttgggtaccactaggaatatttgagcctgttgcctcccagtctgtttttaatgcatatatacttgtatatatactttttaaagcaatattargatcataatattttataacttttgcctcttttcacttactatatcataagcaggttttcttatctttaaatattccttgggaacatgattattaagggaa

SEQ ID NO: 17307 - DNA, 201 bp, Homo sapiens
catttaggttgtttcctatttttttccctatcatataaaatgctgggatgaatatccttgtctaaaaattttgtgtgaatctttatcacctaaggatagaytcctagaaattgaattaccgagccaaggattcacacatttttaaggctctaccacatactgcaaaatgttcttccaaaaagtgcaacaagttatataggc

SEQ ID NO: 17308 - DNA, 201 bp, Homo sapiens
gaatatccttgtctaaaaattttgtgtgaatctttatcacctaaggatagattcctagaaattgaattaccgagccaaggattcacacatttttaaggctstaccacatactgcaaaatgttcttccaaaaagtgcaacaagttatataggctccccaagtagccagtgagcatacctgtttttctgtagctttaaccaga

SEQ ID NO: 17309 - DNA, 201 bp, Homo sapiens
gtgcaacaagttatataggctccccaagtagccagtgagcatacctgtttttctgtagctttaaccagaactggaaagagggagagagagagagagagagwgagtgtgtgtgtgtgtgtgtgtgtgtgtgtgtgtgtgtgtaaactgttttagtttgatagtttagaaaaccagcacagtatctttttgatttaatttgca

SEQ ID NO: 17310 - DNA, 201 bp, Homo sapiens
caacaagttatataggctccccaagtagccagtgagcatacctgtttttctgtagctttaaccagaactggaaagagggagagagagagagagagagagaktgtgtgtgtgtgtgtgtgtgtgtgtgtgtgtgtgtgtaaactgttttagtttgatagtttagaaaaccagcacagtatctttttgatttaatttgcattc

SEQ ID NO: 17311 - DNA, 201 bp, Homo sapiens
actctgttagctaaactgaggaaccacaggcagggtggccttgaatttcagtctgaaggacccatcacccaagagtcttggcagcttcctcagcaaagatsaatgggcttgttaggtggtttttgttacctgatcagtaattgtttcaacactagagtttgtcgttactgttgtcctgttatgaagaattctctttaacaa

SEQ ID NO: 17312 - DNA, 201 bp, Homo sapiens
atatttaagaaagcttcagaggctgcctctgtgctttatgcctaaaaaggagttgggattttttttcccccttttgcttttcagacctggaatcgcatcawtattttttttcaacaaaagaatgtgtctcttgtccccaggtatggcaagggtacaaagaagccaacttgtagaggggagagagaagaggtaactgacaga

SEQ ID NO: 17313 - DNA, 201 bp, Homo sapiens
gtaaataagtaaacagtggctgggcatggtggctcatgcctgtaatcctagcactttggaaggccaaggcaggtggatcacctgaggtcaggagttcgagmccagcctgggcaatatggtgaaacccggtctactaaaaatacaaaaattagctgggggtggtggcaggtgcctgtaatcccagctactcgggaggctgaa

SEQ ID NO: 17314 - DNA, 201 bp, Homo sapiens
gggagaagggaaatggggagtttgttgcctaacacgtacagcatttctgtttggtgtaatggcaaagttttagaaatagatagtggtgatggttgcacaayattgtaagtgtaaatgtgataattccactgaaccgtatacttaaaaatgattcaaatggcatatttttgttatatatattttgtcataaaaaaagttaat

SEQ ID NO: 17315 - DNA, 201 bp, Homo sapiens
acagagagagaccctgtgtcttaaaaagcaaacaaagaaatcagggtacatgcatattagttagagatacagaaggtaactaccatatgaaacaaatctgygggttggatggatggagtggaacagtcttgctttttcgttgtgaacccttctacgtcattggatgtaaacctgtgagtgggccatgtttccatcatatta

SEQ ID NO: 17316 - DNA, 201 bp, Homo sapiens
tctttctgaagtttgagactgtcccatgcaaacgttacttaaatttcaagcaacagggaagtcatgagatttggaaagggttatcttttctcaatcatggkcctttgtggagttctgtggtgacagaggacagcggagagaccgtattctgtggctgaaaggagggcttgatactacccggtggggattttgttccagtaa

SEQ ID NO: 17317 - DNA, 201 bp, Homo sapiens
ttgattccatgtctttgctattgtgaatagtgctgcggtgaacatttgcatgcatgtgtctttatggcagaatgatttatattcctctgagtgtatacccrgtaatgggattgctgggctgaatattagttctgcttttagctctttcgggaattgctatactgctttccacaatggctggactaaatgacactgccacca

SEQ ID NO: 17318 - DNA, 201 bp, Homo sapiens
agtttaattagatcctacttatcaacttttgcttttgaaaccctggaagacaaactaggcaatagcatcctggacataggaatggacagaaatttcatgamaaagacaccaaaagcaatcataacaagagcaggggagctcttaaccatgatttacagtgagacactctggttccatagccaggatgatgggaaaccttta

SEQ ID NO: 17319 - DNA, 201 bp, Homo sapiens
tacaataggtaaactgagttatttgacatgctgacttgataaagccacctttgtccgagtagaccgttatgatagctgtaagtatgactgggtgactattyacttgtaaagttgtccacagtgtcatgatagcagtgacaaaagtccaaaaagacacattacaaattcattgacttgttcttttcagaggatttagagtgt

SEQ ID NO: 17320 - DNA, 201 bp, Homo sapiens
tttcaccactcgctataacagattatttggagcaaaatatggtgagactatgaaaaacagtgcaatggagtgtcctcttccatgaggttagattttaaatrtagcacttaaggtaggcatcatggaggtgagaattatacatggaaatcccttcaatttgtacatcaggtactggcagggatttagataccatgttaatat

SEQ ID NO: 17321 - DNA, 201 bp, Homo sapiens
ttatttcctgctgatctggcaggtgggttttgcaggttcatgtggacttgatgtaacaccaatgttttctacctgaggcctctttttttttttttttttgrgatggagtttcactctgtcacctaggctggagtgcagcggttcgatctcggctcgctgcaatctctgcctcccgggttcaagtgattctcctgcctcagc

SEQ ID NO: 17322 - DNA, 201 bp, Homo sapiens
ctgggggaaatcagcgggcagtgacgcccttcatgagttacaccttggtcaggaggacctctagacaatctgctagcagccagccaatgtgacacctttcrgctgcttcctgttacgtcactaggtcattcagggagaaccactcctaagtagctgagagttttaggaggtggtttatagagtgctttgagtcaaaataat

SEQ ID NO: 17323 - DNA, 201 bp, Homo sapiens
tgatgcattcaacttgcaggtcaggttttatatcatttatagatcagattctgaagatatcttcagtcaaatttaataacaatcaaggaatatattattcrccggcctgaagtatagaaagagttcccagaaatcatctaaaaataactgtttcatataaaacattttgactttctattgtaataagattaatatattttt

SEQ ID NO: 17324 - DNA, 201 bp, Homo sapiens
actttcgcgaaagggattggcaattaagaaatatagcaactgcttctgatgattaaacatttcaagcaactctgaaggtagaatgtggggaatctccagasaaggaaggaaatagagagggaactaatatttatagttactcctatagtcatctccatctcagtacaggacatcttcatccttccagttgttcagaccaaa

SEQ ID NO: 17325 - DNA, 201 bp, Homo sapiens
gctgaggcaagagaatggcgtgaacccgggaggcggagcttgcagtgaaacgaggttgcgccacggcactccagcctgggtgacagagcaagactccatawaaaaaaaaaaaaaaaaaaaaagtaaaagaaaattagccgggcgtggtggcacgtgcctataatcccagctactcgggaggctgaggcaggagaatcactt

SEQ ID NO: 17326 - DNA, 201 bp, Homo sapiens
aataaaaccaaactaaagaaaaaaaattggactatatttggaggtagaattcagatattgcagatatgttcatatacatcaaagctgtttcaatgtgtcarcgaactcagttcatttacctctgccaaggtggtatagtgtatgtgggagtgcagagtgggggaaagtgaggaggggttgtgatttatgagaaactgtaaa

SEQ ID NO: 17327 - DNA, 201 bp, Homo sapiens
aattagctgggcgtggtgacatgcgcctgtagtcccagctactcgggaggctgaggcaggagaattgcttgaacccgggaggcggaggttgcagttagccragattccgccgctgcactccagcctggtgacagagcgagactccatctcaaaaagaaaaaaaaaaaaaaaagaaagtcatgataaagagtgtggatttta

SEQ ID NO: 17328 - DNA, 201 bp, Homo sapiens
ccgccgctgcactccagcctggtgacagagcgagactccatctcaaaaagaaaaaaaaaaaaaaaagaaagtcatgataaagagtgtggattttattttaygcaaagtgggagctcattaagaaggtaaaagtttttaagcaagggaatgacatgatttgacctactttttaaaggaggttgctctgacggctgtagagga

SEQ ID NO: 17329 - DNA, 201 bp, Homo sapiens
gcctggtgacagagcgagactccatctcaaaaagaaaaaaaaaaaaaaaagaaagtcatgataaagagtgtggattttattttacgcaaagtgggagctcrttaagaaggtaaaagtttttaagcaagggaatgacatgatttgacctactttttaaaggaggttgctctgacggctgtagaggatagaccataggcaggg

SEQ ID NO: 17330 - DNA, 201 bp, Homo sapiens
aaaaaagaaagtcatgataaagagtgtggattttattttacgcaaagtgggagctcattaagaaggtaaaagtttttaagcaagggaatgacatgatttgwcctactttttaaaggaggttgctctgacggctgtagaggatagaccataggcaggggacaatagagagaccaggaggaggctgttggagtgtgttaggcg

SEQ ID NO: 17331 - DNA, 201 bp, Homo sapiens
ggctgtagaggatagaccataggcaggggacaatagagagaccaggaggaggctgttggagtgtgttaggcgagatatggtgagtggtttcagaggcttgygtgagaaagttgatacactgcccctaccccatgcaaacacacactttcttttcttatgatgacctttctttaaaagcatttgttggaatatgagattata

SEQ ID NO: 17332 - DNA, 201 bp, Homo sapiens
tgttgttggaagtgggaaagcaggttaataggttcttcttaatggaaaatgcagccaatattggccaacttactttgatttcggtagtcataacaccaccytggaaggcaccctagatagaggtcacttgctaccactcattttacagatcaggatactaaggattttcctgattttaagcattaagtatggatatccctg

SEQ ID NO: 17333 - DNA, 201 bp, Homo sapiens
atatacaaatatataatatgtttgtgtatgtatagttatatatacacataaatattttgtattttgtatatatgtatacatatacattttgtaatatataygtatatattactatatgtatttttaattgtaaaatacacataggataaaatttataattttagtccttagccattttttttaaccatttaacaagtggta

SEQ ID NO: 17334 - DNA, 201 bp, Homo sapiens
atggcgtgaaccctggaggcggagcttgcagtgagccgagattgcgccactgcactcccgcctgggccacagagcgagacttcgtctcaaaaaaaaaaaawaaaaataaaaataaaaaaaataaagcgtgtatattgactttccagaatcttgagaatggataaatggaaacaaagagaaatacctattttgtattataaa

SEQ ID NO: 17335 - DNA, 201 bp, Homo sapiens
taatagaggggatggactttagacctcacacaattaaaaagagaattgatgaattagaagagaatactaaggaattcattcagaatgtatcataaagagayaaaagattttttaaaaggcatttaggagatttgaaggatagatggagttccaacatatgtctaataagagaacacagccttgaacttttggcctcaagtg

SEQ ID NO: 17336 - DNA, 201 bp, Homo sapiens
agaacacagccttgaacttttggcctcaagtgatcttcctgcctcagcctcctgagtagctgggactacaggcacatgacaccagaccctgctaatacatwtgtgtgtgtgtgtgtgtgcgtgcgtgtgtgtgtgtgtagagaccagattctcgcgatgttgcccaggctggtctcaaactcctaggctcaagccatccac

SEQ ID NO: 17337 - DNA, 201 bp, Homo sapiens
gctctaaaatctgacccttccttctccttcttactgcctctgctttagtttcttactctataaaatggagataatatatcactgtgtagatgccataatasaaatagcaagctcttatggcactaataattttttaatacatgttaaccatatgaataggtcttattattattatgtccattttatggatggagaggttaa

SEQ ID NO: 17338 - DNA, 201 bp, Homo sapiens
aattgcttcaagaagtagaaaatctgaataaaacaatgaacgaaattgaatgataatgaaaagtccatctgtcaaatgacagcaggcccagttttataggyacgttaaaccaaatttaagtaatccttacttactcttcttccctttttaaagagttttattggggtataattgatatagaataaactgcacatatttaaa

SEQ ID NO: 17339 - DNA, 201 bp, Homo sapiens
attatggaattacctatttctttttgttctttcagtttttgctgcatgtttgaagacctgttattaggtgtatatatgtttaagatttttatgttcttgaygatttgactcctttatcattatgaaatgactttttctcttgtaatattttttgttctgaattccattttgtctgatatcaatatagccacttcaactttc

SEQ ID NO: 17340 - DNA, 201 bp, Homo sapiens
gctatataaatagttgttatatttcattgtttagggaataatgataagaaaaaagtctgcacatgtttggtatagctgcaaccatccattttttttttcarcaatattttttatctgacattgtttgaatccataaatgggaaacccatatatatggagggccaactgtattttcttttgtctgactgcttttaagacttt

SEQ ID NO: 17341 - DNA, 201 bp, Homo sapiens
attgtaaatttttaacatttaagtgctggattttgtgcttgctgttcctttaagtaactcatttatgttacttggaaacagttgaatcttttcaggtgttkcatttaattagaaaggaacagtgtgacattgagtctagggctatcgcaccactgctgaggtgaagtccttctgagtgttcttcctgatgttttctaaatt

SEQ ID NO: 17342 - DNA, 201 bp, Homo sapiens
gctgtgtcaccatgcagcggtgactcactgcaacctccatctgccaggttcaagcgattctcttgcctcagccaccctagaagctggaattacaggtgtgygccaccatggccggctaatttttgtatttttggtagagacggggttccctttgatggccaggctggtcttgaactcctggcctcaagtgatccgtcttcc

SEQ ID NO: 17343 - DNA, 201 bp, Homo sapiens
tctaactttaaacccttatgagtttgagttgtggttttttttttttttttttttgagacagagagtcttattctgtcacacaggctggagtgcagtggcgygatctcggctcactgcaacctctgcctcccaggctcaagtggatcctcctacctcagcctcctgagttgctgggactgcaagtgcacaccaccacgcctg

SEQ ID NO: 17344 - DNA, 201 bp, Homo sapiens
ctggagagctttttagttcataaacagagagcgtccttgtttttgtttactgttgctttatacttcatcatgtggatgtcctgtagtttattccactgtcscctgtggctggagatttgcattgtttctaatcttattgttttattgagataataatttccatatcataaaattcaccattttaaagtgtacagttcagtg

SEQ ID NO: 17345 - DNA, 201 bp, Homo sapiens
agtactgagtgttggtgttcagagcagatttttatctgtagggtcttaagctggatgattttctggtccccattctctgctgtcatgtagatacaacagtrctcacaggattaaaatgaaaattcctagtggaagatcaattatatgctgcttgctctagagtaggaaaaatcttgtcaaattttatccttttgatacagc

SEQ ID NO: 17346 - DNA, 201 bp, Homo sapiens
tctggtccccattctctgctgtcatgtagatacaacagtactcacaggattaaaatgaaaattcctagtggaagatcaattatatgctgcttgctctagaktaggaaaaatcttgtcaaattttatccttttgatacagccttataagttacaatgttttatacctgtctgatgctcagttccgaaatgaactgagaagtg

SEQ ID NO: 17347 - DNA, 201 bp, Homo sapiens
ttttgctttctttcttacagataatgtctgttgtatgtacctgtctatgtgtatatgtgtctgtgagtgtatatgcacatttatgccttttatatgccacrtacacacgaaaactccatatattcttgaatgtaaggtcagatattctttgaaaaatatccctcagaaggacggaggtgccctatatgtatctgatttctt

SEQ ID NO: 17348 - DNA, 201 bp, Homo sapiens
gactctagtgatgaaaaagacccggttgtcaacaatacatgtgaagagtgaatcaaattgtctcatgaaatgtgagagtgaataaaattatttctaaattyatgcttcataccgtgtgtaatttagtatatatgtaattgactgggtgccatgactcatgcctgtaatcccagcactgtaggaggccaaggtgggaggatt

SEQ ID NO: 17349 - DNA, 201 bp, Homo sapiens
gtgccctcttatccttccttgcctttgtgcccactagtactctcttcccttttctgtctggtgagcatctactcttaaagactttacttaaacactacatrttctgtgaaggcttcagaaaatcccttctgttctaaaatgtatgaaaaatctgactgcttctcaccacctctgcttcttacaccgtggccgaaactgcca

SEQ ID NO: 17350 - DNA, 201 bp, Homo sapiens
gcactttactcttcctggaataaaccaagctcactcctgccccaaggcctttgcactgaatgttccctcaacctggaactctctcatccccccaggcatcygcagatattgtatccttgtttcttgctttcttctgctctgatgtcactgtatctagaggccttcccttaccaccctgtggaaagtaggcatacttacccc

SEQ ID NO: 17351 - DNA, 201 bp, Homo sapiens
ttgagatggagttttgctcttgttgcccaggctggagtgcaatggcgtgatctcagctcacagcaacctccgcctcctgggttcaagcgattctgcctcasccttccgggtagctgggattacaagcatgcgccaccacgcccagctaattttgtatttttagtagagacggggtttctccatgttggtcaggctggtctc

SEQ ID NO: 17352 - DNA, 201 bp, Homo sapiens
ggctataacaggtactaatgctattttcttcttcttctttttttttttttttgagatggagtcttgctctgtcacccaggctggagtgcagtggtgtgatstcggctcactgtaacctctacctcccgggttcaggtgattctcctgcttcagcctcctgagtagctgggattacagatgcccgccaccacgcccagctag

SEQ ID NO: 17353 - DNA, 201 bp, Homo sapiens
tgtccatgtgatctcattgttcaattcccacctatgagtgagaatatgcggtgtttggttttttgttcttgcgatagtttactgagaatgatgatttccartttcatccatgtccaggaaaggtttctataagaaaatgacccagggatgggaaggaccatccaggtgtggagttgcgggaggagcctgggggaagtattt

SEQ ID NO: 17354 - DNA, 201 bp, Homo sapiens
tttagtccagaccatcacttttcttccagatgattgtaatagcacattccacgctcacatgtgcctctttccaatctgtgcctgatattataactaagagygattgtataagatgtaaatcaagttatttttctcccttctacatcctccagtgcatctagagttagcttcagattccttaccacgacctctagggctatg

SEQ ID NO: 17355 - DNA, 201 bp, Homo sapiens
aaatcaagttatttttctcccttctacatcctccagtgcatctagagttagcttcagattccttaccacgacctctagggctatgtgtgatctggcctccrccttcctctgcctcctcgtagcatgccactctgtctttggctcttgtgctctagtaaaacaagcctttttttgtccctagaataggttggtctttttcct

SEQ ID NO: 17356 - DNA, 201 bp, Homo sapiens
cacatgccaagtcctaaggaaagtggtagccgaaaagctaatgcagccctaacctacattaatcattccatgtatttctgtattagggaagggaattgacyaatattactctcctccagtgacaccagtagaattattagaattttgtagaattacaatgtaataatacctcattcatccatgcacgaatccatttattca

SEQ ID NO: 17357 - DNA, 201 bp, Homo sapiens
tacattaatcattccatgtatttctgtattagggaagggaattgaccaatattactctcctccagtgacaccagtagaattattagaattttgtagaattmcaatgtaataatacctcattcatccatgcacgaatccatttattcattcctttaccatttactgagtaaattctgggcactcatattatagtcatgagca

SEQ ID NO: 17358 - DNA, 201 bp, Homo sapiens
tgccagctgtgtgactttgggcaaattaatgtctttggtcagattaatgtctctgtgtttcagtggtctcatctataaactggagataataatactatgcmtagagttaaaatgagctaatgcacacaagtaacttacaacagtacctggtacgtagtaagcacttaataaatattttagataataagcagttaataaaat

SEQ ID NO: 17359 - DNA, 201 bp, Homo sapiens
tgcccaggctggagtgcagtggcgcgatctcagctcactgcaacctccacctcccgagttcaagcgattcttctgcctcagcctcctgagtagctcagacwacagacacgtgccaccacacccagctaatttttgtatttttagtagagatgggtttcaccatgttggccagcctgatctcgaactcctgacctcgtgatt

SEQ ID NO: 17360 - DNA, 201 bp, Homo sapiens
cccatagttctgattcttgcttatgacatcacgttttagtcaagcactcaaactaccaatctgagtaggctgcctgccttccttttttctccttcccttcyttccattcattcattcactcaacagatatttatagagctcctactatgtgccaggccctggtctaagttctaggatacagccatgaactagataggtatc

SEQ ID NO: 17361 - DNA, 201 bp, Homo sapiens
gagaccgaggcaggtggatcacttgaggtcaggagttcgagaccagcctgggcaacatggtgaaaggctgtctctactaaaaatacaaaaattagctgagygtggtggcgtgtgcctgtaatcccagctactcgagaggctgaggcaggagaatcacttgaacccaggaggcagaggttgcagtgagctgagatcgcgcca

SEQ ID NO: 17362 - DNA, 201 bp, Homo sapiens
tgaaaatgctctaaaattaattgtagtgatatttgtataactctgtgactatacgaaacaacattgcattatatgctttaaatgcttgaattttatgacgkgaattatagctcaataaagctgttaccaaaaaaaaaaaacctatctcaaactaggcctgattatagattatttacataaaacaaaacactatacatccag

SEQ ID NO: 17363 - DNA, 201 bp, Homo sapiens
ggagttatacaaagagctaggacttatgtctcccaggttgataaggcacaaggcagtaagtaattcagaggaagaaaaaggagaagagcagattctgacaraggcctttgggaatacgaaggattttgatagatggagatgggtggagaatattcaaagatggcagaagcagggccatcgcagtgggaaaacacagacctg

SEQ ID NO: 17364 - DNA, 201 bp, Homo sapiens
aattggcacaacaccttttatggaataaaccattcttgcctccactgatttgaaaagacacttttatcatatactaaatttgcagaaatttatgtgtcagktttttttttgcctaattaccaaaactttgtgtgtttttagatattatagggccttccctcctccattttctttttagaaaatttcgttaactgttttcat

SEQ ID NO: 17365 - DNA, 201 bp, Homo sapiens
ggccttggtgaggaaatgtaagtgagaggtctttccctggctgcagatctcctcattctgatgtgcaaggatgctcctggaagtggtctggcccccacccrcctgactctggtcacaatggccactgtcaggcaccaaggcacgtaccactgaggctggggacagctgagtgttagcataacattttattttattttattt

SEQ ID NO: 17366 - DNA, 201 bp, Homo sapiens
accagtcattgcatagataaatgatgttccttatgttaaaaaataaaaccaaactaaagaaaaaaaattggactatatttggaggtagaattcagatattrcagatatgttcatatacatcaaagctgtttcaatgtgtcaacgaactcagttcatttacctctgccaaggtggtatagtgtatgtgggagtgcagagtgg

SEQ ID NO: 17367 - DNA, 201 bp, Homo sapiens
gcccaacctctatctccattatctcctagctttttggaaaatatttagtactggcatttcttcttcactgatttttcattctacctgtctttagtatcatrggggtagttacctcagcgggggtagggagaccttgggtgtctcttacttgtacatactctgtcctctataagtaagtgtgtaaatacactgtattttccc

SEQ ID NO: 17368 - DNA, 201 bp, Homo sapiens
tgcatattcacttatatgtaattattattttcaaacagaaactgaggcttcttgaagagcttgaagacacttggctcccttatctgacccccaaagatgaygaattctatcagcaggtaaggtattttaatatttttatcagtttcagtgatgtgttctgatcaaccttattttacctatgaggaagctgggctagagagg

SEQ ID NO: 17369 - DNA, 201 bp, Homo sapiens
caaactggtctcaaactcctgggctcaagtgatcctccagcctcggctgcccaaactgctgggattacaagtgtgagccatcgcaatctggcccttgtctrtctttttaatctttctcatttgattcttataattctattagccaaagaaaaatattcttactattactatttatttatttatttatttgagacggagtct

SEQ ID NO: 17370 - DNA, 201 bp, Homo sapiens
ttggaggaataaataagcatagaatgtatttattctttagagaatagtagagttcatttttatagtttgcctttaaaacatgcaacagacccctagggtaytggataatttttagaggagatgctgacctggtggtcagccattttgacggaactggggcccaggatatcttcaggcaagcataaagatgtgtggcataca

SEQ ID NO: 17371 - DNA, 201 bp, Homo sapiens
attttgatgtgaatgccactgggggctgaagatttttcttcctccccaccaacccaccccaccactttgttgtaggagagaaatcagttgtgtttgtagcygatgctcaggtcttctgactggttctagagtgccccatctcccttttgtcctgagacagaattcgaatgcatatggcatccacatagcctggcataagta

SEQ ID NO: 17372 - DNA, 201 bp, Homo sapiens
cttcagtttggagcacttggaagtttcttattttgaagaccatttgtttgaatgaaatcatcaatcatttctagtttcgtaaaacttggaagtctccttgwggtagagactgcacagatcccttcttgcttctttgagtcatggacttttcaggctggactgctgcccaaaatgcagattgcatttccccagcctcccctg

SEQ ID NO: 17373 - DNA, 201 bp, Homo sapiens
gagactgcacagatcccttcttgcttctttgagtcatggacttttcaggctggactgctgcccaaaatgcagattgcatttccccagcctcccctgcaackgggtgtggccatgtgactgagagaaggtgtactatgggagtctctgaggtgtttctttaagagaaagctggtgtatgccctttgccctttgcttcttagg

SEQ ID NO: 17374 - DNA, 201 bp, Homo sapiens
ggcagacttgtaaggaacaagataatctcattgttcctcctgctacttaaaataaaggtaatattgattttatagtagcagttcaggtcctaaggcatgayattgattaagtgtctgatgagaatttgtagggtagtctcccagacctgcagctacagggcatctccccactgggccaggcctctgtgctgacctccactg

SEQ ID NO: 17375 - DNA, 201 bp, Homo sapiens
cttattagtagcagtagatttcatgaattttctgctgtgaaatttcctattaaaatactataatctaatgttaaatgacgagttaatgggtgcagcacacmagcatggcacatgtatacatatgtaactaacctgcacgttgtgcacatgtaccctaaaacttaaagtataataaaaaaaataaaaaataaataaaatact

SEQ ID NO: 17376 - DNA, 201 bp, Homo sapiens
tgtggtattgcatattcgattatgtccatttatctttccttcttctgggtgagaggggagatgaaaatggagctaccttggagttcatgttttcaccttgwttctccgcatttatagcatactgattgaaagcatggctgccagaaccatattacttgggcttgagtactagctctgtcacttactcattgtttaactttg

SEQ ID NO: 17377 - DNA, 201 bp, Homo sapiens
attgcataaataaaagagatgaaagtctaaattattaatcagggccatttatctatgagacactacaggcattgtgtctagccctgtgggtttacattagwtagggtaggttattgctgcaacgtaccctaacttgatatgatttttgctgcaaaaatcatatcaaaatagtctataatggcttaaacataataaaatgca

SEQ ID NO: 17378 - DNA, 201 bp, Homo sapiens
gaggaagctgggctagagaggttaaatgacaggtgaaaaggtcaaattagatcacccatgacttctcatggcctacagagcatgtacatttcttcagaatyggctttttgctgtgaatttaatgctttagcatagtgactgtttttatttcctcggacattccacacttccttgcctctgctcatgctgtttcttctgcct

SEQ ID NO: 17379 - DNA, 201 bp, Homo sapiens
acactacatgttctgtgaaggcttcagaaaatcccttctgttctaaaatgtatgaaaaatctgactgcttctcaccacctctgcttcttacaccgtggccraaactgccatcatctctgttgcaacagcctcctgactggttctgcctccttcccctggtctagtttaacacagcatccggaatgatctttgaaaacataa

SEQ ID NO: 17380 - DNA, 201 bp, Homo sapiens
tgtctgctccaatctggtgttctatgcctgatgcatggggatccctttctgtgacctcttcattgtaatccagcggattcctttacttctctcttttgtgractcctcacgttcctgcatcctggccttgctctttcctgactgttttcttattttggtggagcatgtcctacaatgttttcttcagaaagatgcttagga

SEQ ID NO: 17381 - DNA, 201 bp, Homo sapiens
tgtaatccagcggattcctttacttctctcttttgtggactcctcacgttcctgcatcctggccttgctctttcctgactgttttcttattttggtggagyatgtcctacaatgttttcttcagaaagatgcttaggaggtaaatttttaagaccttaaatgtcttcaatcatctttattccaccttggtatatgtaggtt

SEQ ID NO: 17382 - DNA, 201 bp, Homo sapiens
atgccatttccctcctagaatgtgccttccctatgtcacactttccccttttgccttctgtctcctttcgttctacaaaatggatttcccatcccagacaygggaatgtcgaagatcagcactggacagatgaggcatcattagactccatggtaccagctggccatctacaacttgtgagtttctcctgcctcaagatct

SEQ ID NO: 17383 - DNA, 201 bp, Homo sapiens
ggtccaggcattgtgctggcagatttgatatatttttgtttattccttattacaggactattacatagtagactctcattctgacactcactttttttttycagaaaaaaaaattaatggagattgattgctaatgggtacagggctgcttttaaggctatgaaaatgctctaaaattagtttgtggtgatggttgcacat

SEQ ID NO: 17384 - DNA, 201 bp, Homo sapiens
gcctgattatagattatttacataaaacaaaacactatacatccagaaaaaaattattccacatcccacccctctctctttttgttttctgcaaccatacktcattaaactagttttcctattgttaagaaatttaggttgtttctaatcttgcatgaaaatgcaattaataacctatgtagctcactccatacttgggaa

SEQ ID NO: 17385 - DNA, 201 bp, Homo sapiens
cttcctaatttccagagtttattacctcagactctgaatcaagcaggtggagattttttttgccttcttaattaagtttaaggagagagtcagctacttckttctcttggcagtggggaaactggtaaacgtggcatttgattaaaatcctgtaatagtttttacccacaacattgaaatgaaaaagtcaggtcatggagt

SEQ ID NO: 17386 - DNA, 201 bp, Homo sapiens
aactgaaatcagtcctacatagcaaacaaacatttagttaatgtaaactaaaaccttttcatacaacttggtattctcaggttacttatttgagccatttycaccatcgttaaatcttcacaagttgcttttgtttgcctcatgaaagttcaatatggataaacacacaaaaaaattctttgcggtaacaggtgaagatta

SEQ ID NO: 17387 - DNA, 201 bp, Homo sapiens
caaattcacaatgatacagaaaagaatgctaggtgcgaaatcctctaaattgatgacatttattcatttcctattgaccttaaaaaaaaaaaaggtcaatktgttataatccagtggaaatattcgacaatcgtttccagagtaaacattttcgaaagtagtgatgatttcgatactggagagaaattcttcttgctgttt

SEQ ID NO: 17388 - DNA, 201 bp, Homo sapiens
attcacaatgatacagaaaagaatgctaggtgcgaaatcctctaaattgatgacatttattcatttcctattgaccttaaaaaaaaaaaaggtcaatgtgktataatccagtggaaatattcgacaatcgtttccagagtaaacattttcgaaagtagtgatgatttcgatactggagagaaattcttcttgctgttttcc

SEQ ID NO: 17389 - DNA, 201 bp, Homo sapiens
ctgattaaaatatttatcatcctttgggtatgcaatagcttttgatgatggaaggcatattaatattcatctttgctgcttgtctacacttcagacagatyccaggaaaggatgttcagatgaccagttttctttcctcaccaggagtccttgagaaaccagtacagcttggaaccaagaaatgccttgtgatgtggattg

SEQ ID NO: 17390 - DNA, 201 bp, Homo sapiens
cagtttccttgtctataaaaatgtgattaatacttgctctacccaacacacatagttagtatgaggatcaaatgagatgaagttaatgaaagcactttccraactttgtcagtttacgtatatgttagttttgggcacaggcgcctgatgtctgggttagatttggctctgttgcttactaatgatataaaatttgacaaa

SEQ ID NO: 17391 - DNA, 201 bp, Homo sapiens
tgatgctagtggaaacctttatgtcccgttctatatagtgataatatatttgctgtaaagttgttagcttgtttttcgtaagtaattaatcttttcttatrccaaatgtatcacatgaaaatgggttagcacagggtcaaaatacatttaaaccagtctgcagagattggataagacctttgaatagagcatcactttttt

SEQ ID NO: 17392 - DNA, 201 bp, Homo sapiens
ccaggggcacaaggctgggaggcaggggagctgggattcccaagcaggaagtttggttccagagcccatgctctaggccagtggttctgtaattttagcaytagaatcacctgtgggcttgtgaaacacagattgcaggcccttcctgaatgggcttgaatagttgcagtcctaacaaattctcaggtgatgtggatgccc

SEQ ID NO: 17393 - DNA, 201 bp, Homo sapiens
gctctaggccagtggttctgtaattttagcattagaatcacctgtgggcttgtgaaacacagattgcaggcccttcctgaatgggcttgaatagttgcagwcctaacaaattctcaggtgatgtggatgcccacagctctatgccaagtgggaagagcacagtggaaaccagtcactataaaacaaggaaaagtggaacat

SEQ ID NO: 17394 - DNA, 201 bp, Homo sapiens
ggccagtggttctgtaattttagcattagaatcacctgtgggcttgtgaaacacagattgcaggcccttcctgaatgggcttgaatagttgcagtcctaamaaattctcaggtgatgtggatgcccacagctctatgccaagtgggaagagcacagtggaaaccagtcactataaaacaaggaaaagtggaacatcctgtt

SEQ ID NO: 17395 - DNA, 201 bp, Homo sapiens
caatatctccatcctaagccttagagaaaacttcagtcctcacctcaccacattctgttattagaaggcattaagaaggaggtgttctaagttcttctcamccttattgaggatgaaggtgaagggttgtacccttacaatagggcatggtatacctccaatacacctcttttcttttgtctgcccatgtttgtgactatg

SEQ ID NO: 17396 - DNA, 201 bp, Homo sapiens
tcctaagccttagagaaaacttcagtcctcacctcaccacattctgttattagaaggcattaagaaggaggtgttctaagttcttctcaaccttattgagratgaaggtgaagggttgtacccttacaatagggcatggtatacctccaatacacctcttttcttttgtctgcccatgtttgtgactatgatgtcctaaag

SEQ ID NO: 17397 - DNA, 201 bp, Homo sapiens
tcctcacctcaccacattctgttattagaaggcattaagaaggaggtgttctaagttcttctcaaccttattgaggatgaaggtgaagggttgtacccttmcaatagggcatggtatacctccaatacacctcttttcttttgtctgcccatgtttgtgactatgatgtcctaaagcactttatgtgagacttagattttc

SEQ ID NO: 17398 - DNA, 201 bp, Homo sapiens
catgatttataaatattatttgacactagggatatcaaagtgattgtggatcaaagctgcccatcccttcaccctggtagatgagaacacaaaatatatcyatttcctatacaccatgaagacattgcttccagtaggttttcttgctggagacaaaaagaaaaacagaagcacctactgtacttgtgcactttctgtttt

SEQ ID NO: 17399 - DNA, 201 bp, Homo sapiens
agagaaacatgattataggacattaggctttttgtaaaatcataaggtcaggataagataatgataccatctaaaattacacaagattttgagtacttagyatcctctgactgccccagcaacccaacccaaaccccaacaagcatagctgaatttttggggttggcaaagccatgaatggaatgataggtttaggttcag

SEQ ID NO: 17400 - DNA, 201 bp, Homo sapiens
tcttttaaaaaataagaggtgtatgtatttatttatgtacaactctgttactggttttaaaaatccaagtgacttctaatcctgatttttttgctgcccawtaaactccacaagtatctttctgtggtgacggggagaatgatatttactgaactacaagattagctaatatcccatcaataactgagtgccacagacttc

SEQ ID NO: 17401 - DNA, 201 bp, Homo sapiens
aactacaagattagctaatatcccatcaataactgagtgccacagacttcctcagttcatcccattcctgtctctaggtagcaacagtgagaaaagcactkattaaagaatattttttcttctactaaattagtccatgacttcatttgtgctggtctctgtttgtcaattgctgccaaaaatttttaactcatgcagtaa

SEQ ID NO: 17402 - DNA, 201 bp, Homo sapiens
taaatcagtaatttacaggtatataaactaaagcatcaagaaaacagcaaagaagttttttccaagatcattcacatccagaaatgaaatgaaacccctamgaggctccttcttcattttgatggggccattgtggttctggcccctcagtttggttgagggcaacatgcggagtatctcagctgaacacagatccttcat

SEQ ID NO: 17403 - DNA, 201 bp, Homo sapiens
acggctggattgagggaaaaccaccaaaaaaccaattcccatttcttgggcctgggaatccggggccctaacagtgagctcagaatgaattgagagaatcyctctgggtcataaagatagactgcagggtcaaaactcaaaaccttgaggttctttttgcttaaaattccaaactcaatcaaaaatgagttcatttctaaa

SEQ ID NO: 17404 - DNA, 201 bp, Homo sapiens
cactgtaaaacagaagttaaactctagggtcagaaatagttaacaaagagagcctttgtgctaagcaggagtctgtggattgagttctggctcagccagtrtatttctgtgtcatttggctttttataagctcattgcctcagtttctcttccataaatggaggcaataatattattgcatttctatcttctaaaattacc

SEQ ID NO: 17405 - DNA, 201 bp, Homo sapiens
tattcatccactgatgtttttcattcaacagactactactaagcatcttcgactatgctaagtcctgagcagacagtgaagaactagaaagacatggcccygccctcatgaagattacaagttaggcctattctccacacttgttctaactcaatctgctacatataccttgagtacccagtatgtgttaggtactaaaag

SEQ ID NO: 17406 - DNA, 201 bp, Homo sapiens
agaaagacatggccctgccctcatgaagattacaagttaggcctattctccacacttgttctaactcaatctgctacatataccttgagtacccagtatgygttaggtactaaaaggagctacaaagatgaaccagacacagtcttcaagaacttcagggatcagggaaggtttatcctgattgtaatccctccagaggtt

SEQ ID NO: 17407 - DNA, 201 bp, Homo sapiens
ggttttgccatgttggccaggctagtctcgaactcctgacttcaggtgattcacccacctcagcctcccaaagtgctgggattacaggcgtgagccaccaygcctggccggaggagaaactccagcgcagtaaagaaacagccctgctggtactgggtcctttaccctccagagtggggctcaggaagaaggaacaggacc

SEQ ID NO: 17408 - DNA, 201 bp, Homo sapiens
tgttaaggaagctcgatttaccttgcagccgagtgaaaaatgatcagaatattagactcatctagcccacattaaggagccattgcatttcccgacaattktatgctatctcaatatgaaaacagagcaatttcaactcatatcaggttatgatcggcaattacagttgcataattcacctagtcatctctttgcagggcc

SEQ ID NO: 17409 - DNA, 201 bp, Homo sapiens
aggtttgtttttccagtgtcagaaatcagattgaacctgtttaaaaaaactcagacagtgagtgctcatcaggataagaacaaagcggagtttgaggcacrcctgaactggcatgtgtgtttgtgtgtgtgtgtgtgtgtgtgtgtgtacagccgcacgcatgcacttgtgtttcagttgaccttccaaaggcagagcaaa

SEQ ID NO: 17410 - DNA, 201 bp, Homo sapiens
gtgcagtggtgcaatcatagctcactgcagcctcaaactcctcggcttgagccttcttctgcctccgccttcccagtagctgggactagggactacaggcrcacaccatcacacttagctaatttttaaactttttttaggaatggggtcttactgtgttgcccaggctggtctcgaactcctggactcaagcgttccact

SEQ ID NO: 17411 - DNA, 201 bp, Homo sapiens
cggccattatgaattatccttaattatagcgatttcctaaactaataaacctgctaaatctttattgcaaaggttagtttacgcagtgcatataaaatccrcatgtgctccgcatcagccaccagctgtctgacagtgtgttgctattgcagtgagtgttcacataaattttatgttggttatattaacagtccgtccata

SEQ ID NO: 17412 - DNA, 201 bp, Homo sapiens
ttgtgcatggctgtggagtgcttcgttaaggctattgacatatatctctcttccccactcttcttccagcagcccatctcggcaaataatattgagatgcrgtaactgttccctgatattgatttcagattgtgttcatcacacccttctcggggccaggcagagagcagcagccccagttctgcaaatccttgatggctg

SEQ ID NO: 17413 - DNA, 201 bp, Homo sapiens
tttttaatgcttatttcaatacttctgtgaaatttgacgttatgaagatatccccaaactcttctccaaaaaaaaaagcagaaatttacttatatctaagkttacttttcctaagccaagtgattcagaaacttttaggaaataattttgaggctaaatatttctgggtttgcttttttaattaacatgttttaaattagc

SEQ ID NO: 17414 - DNA, 201 bp, Homo sapiens
agcaagaccctgtctctaaaaaaagcaaagaaaagtagaagcattcctgaatattacagacagtaacagaatggctatcacaacagtcacagcttgcagayaccaagctcctcagaaaatattctactaataataatagttgtcattgggctagtcactgagtgccaggcattgtgctatacattttgcattcacgatctc

SEQ ID NO: 17415 - DNA, 201 bp, Homo sapiens
tccctctggaagaacagctcgtgcttggaggcgtcacaagctccaaaagatcctgttaaggcaggatgtagtgtgaaacccacaagcgaagcaaaaccccrtgtcccctaattataatgttaatatttaagaaagcttcagaggctgcctctgtgctttatgcctaaaaaggagttgggattttttttcccccttttgctt

SEQ ID NO: 17416 - DNA, 201 bp, Homo sapiens
ggggagagagaagaggtaactgacagagtcagagcacgttggaaagtgatacgagaacaggggcttatggttacagccctaccccctttccaaagaaggcrattagatattatttcagatagtttctcactgtgtcctaatatcattttccagcaaccctgtggcaggtccccagtttttcttggacttatgtgattagct

SEQ ID NO: 17417 - DNA, 201 bp, Homo sapiens
gaaagtgatacgagaacaggggcttatggttacagccctaccccctttccaaagaaggcgattagatattatttcagatagtttctcactgtgtcctaatwtcattttccagcaaccctgtggcaggtccccagtttttcttggacttatgtgattagctaaactagccatgcaggtattggcattacactcacagatatg

SEQ ID NO: 17418 - DNA, 201 bp, Homo sapiens
aagtgatacgagaacaggggcttatggttacagccctaccccctttccaaagaaggcgattagatattatttcagatagtttctcactgtgtcctaatatyattttccagcaaccctgtggcaggtccccagtttttcttggacttatgtgattagctaaactagccatgcaggtattggcattacactcacagatatgaa

SEQ ID NO: 17419 - DNA, 201 bp, Homo sapiens
ctttccaaagaaggcgattagatattatttcagatagtttctcactgtgtcctaatatcattttccagcaaccctgtggcaggtccccagtttttcttggrcttatgtgattagctaaactagccatgcaggtattggcattacactcacagatatgaaatccagcctgacacccaatcaggacacattcttgagtggctg

SEQ ID NO: 17420 - DNA, 201 bp, Homo sapiens
ccccagtttttcttggacttatgtgattagctaaactagccatgcaggtattggcattacactcacagatatgaaatccagcctgacacccaatcaggacrcattcttgagtggctgtgtggccccagagtctcccactgtcttccacttatgcacagtgtatctaaatagacactggccatgttcagtccaccctaaacc

SEQ ID NO: 17421 - DNA, 201 bp, Homo sapiens
tgacacccaatcaggacacattcttgagtggctgtgtggccccagagtctcccactgtcttccacttatgcacagtgtatctaaatagacactggccatgktcagtccaccctaaacccttgtgtcaatagccaaagaggaatcagatttgaagccaaaataacaagcactatatataaattactaaacgcccccaaacac

SEQ ID NO: 17422 - DNA, 201 bp, Homo sapiens
ttgagtagaaaacaggacatgtcacagatatatattttcttaattgtaaaaagtaaatactctaaaatgtatttttttcattgtgattatgttacagtggyttctatgtaccatagattagatttttattaagggttttattaaataactggtgtttcaccaacatctaattaaatcttctatctaaattgaacagaaaat

SEQ ID NO: 17423 - DNA, 201 bp, Homo sapiens
ccatttgtatcccactgagtcctgtgatgctgcacacacacagctgagatttacagaggccgggcggggagggctgctgagagggggtaatggcatgaccygccatgctgcttcagatgcctgggagactgggtctgtgccatttgcatatgtcctctgtacccattcctgatgaaggatgcaattgactcaactcaagca

SEQ ID NO: 17424 - DNA, 201 bp, Homo sapiens
catttgtatcccactgagtcctgtgatgctgcacacacacagctgagatttacagaggccgggcggggagggctgctgagagggggtaatggcatgacctrccatgctgcttcagatgcctgggagactgggtctgtgccatttgcatatgtcctctgtacccattcctgatgaaggatgcaattgactcaactcaagcag

SEQ ID NO: 17425 - DNA, 201 bp, Homo sapiens
gtctgtgccatttgcatatgtcctctgtacccattcctgatgaaggatgcaattgactcaactcaagcaggtcaaaatcacttaggcagaaaatcccaggycttgggaagaaaagtcatgtgcctcttgggcccttggcagaagtcaaaggtccaaggtaatgtattggcaaagatcctgtctgctttggtgccttactta

SEQ ID NO: 17426 - DNA, 201 bp, Homo sapiens
cttttaggtggaaatattgtcaacgctattgattagttgatctgataatccagcaggctccctgatgtgttaaatttcctacttttggaggactataagtrtgggcagagtgtatacttctgtaggaaagaactctcagtggaccttgctaagacactgcttctacagcgagattgctacaggcatgacaattccaattat

SEQ ID NO: 17427 - DNA, 201 bp, Homo sapiens
ggattgcttgagccctggagttcacagtgagctatgatcacgccactgcactccagcctgggaaaccgagtgagaccctatctctaaaaagacaaagaaawttacaaaaacaagatgcaaagaaattgtttcacctagttgacttcaaagtactgtattgaccaagccaagaatttacttcttgctaagttcccagaattt

SEQ ID NO: 17428 - DNA, 201 bp, Homo sapiens
cacagtgagctatgatcacgccactgcactccagcctgggaaaccgagtgagaccctatctctaaaaagacaaagaaatttacaaaaacaagatgcaaagraattgtttcacctagttgacttcaaagtactgtattgaccaagccaagaatttacttcttgctaagttcccagaattttattagaaaggaaatgagaatt

SEQ ID NO: 17429 - DNA, 201 bp, Homo sapiens
cttaactagcttttgcaagtacagttttcttcagtatgtttctactgacctgatcattcaaaacactcttttaatgttttctaccaagccacacctccttyttgatggtaaggacaaaaacaactatgagatatttcgtattttgaatgccccacaaataaacagatattccaaatacggcagtgaattaaatgttttcaa

SEQ ID NO: 17430 - DNA, 201 bp, Homo sapiens
ctgacctgatcattcaaaacactcttttaatgttttctaccaagccacacctccttcttgatggtaaggacaaaaacaactatgagatatttcgtattttraatgccccacaaataaacagatattccaaatacggcagtgaattaaatgttttcaatagggggaaaatgagaatctcctgtcagaaatgcccaaggaaag

SEQ ID NO: 17431 - DNA, 201 bp, Homo sapiens
ccagagtgtaagagatactggatatctcatattccttcagctccaatttgtgctgttaattggctcagtctttcattctatactgagcactcatatctgcrtcttataaaaagggaagttgggagacacggttaagagttaatggaaaaaacagataaattggacttcatcagaattacaaactcttatgcatcaagaatg

SEQ ID NO: 17432 - DNA, 201 bp, Homo sapiens
atattccttcagctccaatttgtgctgttaattggctcagtctttcattctatactgagcactcatatctgcatcttataaaaagggaagttgggagacayggttaagagttaatggaaaaaacagataaattggacttcatcagaattacaaactcttatgcatcaagaatgctaccaaggtgaaaaaaatagcgtatag

SEQ ID NO: 17433 - DNA, 201 bp, Homo sapiens
tctttctccttgtagtctcagggcctctttctctccaagtggcctttccatgtgggctctccagcagggcagccatgctccttacatggcggctcaagacwcctaagaatacaaaagcagaaactgccaggcttttttaaggaaatggcccagagtcacctgtgccgtgatctgttgttgaaagcaagtcacagaaagggc

SEQ ID NO: 17434 - DNA, 201 bp, Homo sapiens
tccagctaaaatctcacacttcccagtgactaagttctaatcagtgagatccagatggagggggttacttgtcctcctttcaaagaggaggtaaggggatrttatagccctctgtcttttctgctgccccccgcctgggactcagatatggtggttggagtgtcctggccccaaaggtgacttcgcagatggcagccatgt

SEQ ID NO: 17435 - DNA, 201 bp, Homo sapiens
gtgtagttctctactggatctctagatcctggcacctagtaaatatttgttgaatgaatggatactaaaagcacaaaagtcacagaagtccttctgcccawatcctggctttatcagtggacacttagcaagcatcttcttgatcactgacccagcggcatagatatttatgtgggacaaagcaatgttagtttccaaatg

SEQ ID NO: 17436 - DNA, 201 bp, Homo sapiens
gtttaagagtgagtggcagtaatcccaattttaccaagttcagtttagttgaaaagtgttggactagtgagtgacctaagtttcagccccaattaatatgwcttgttatttatgtggttgtgtgacctggaacaatgctttcacttaagggcactaatccctttcataagggtaccaccctcatgacctaattacctccca

SEQ ID NO: 17437 - DNA, 201 bp, Homo sapiens
ccccaattaatatgacttgttatttatgtggttgtgtgacctggaacaatgctttcacttaagggcactaatccctttcataagggtaccaccctcatgamctaattacctcccaaaggccgaccttcagatactgtcacattagaggctaggagtttaagatatgacttttaggaggacacagacatttagtccgtaaca

SEQ ID NO: 17438 - DNA, 201 bp, Homo sapiens
ttctttgctgccctagtagtgaggatcacatgggataatgcatatggacgtaagccatactgtttatatatataactacagtttttttagagatgggaagrcctttagggattgtctaactcaagccctcattgtacagatctaagtaatgatggccagaaagtcacagttttgcccaagatcctagggtaaagtagtggc

SEQ ID NO: 17439 - DNA, 201 bp, Homo sapiens
agaatgttatgtgtaatgtacgacggattgagtgcataggatgccggtgtagcaattaaccacactcgaaaataggtgtaaagttgaagtatgttttcccyggggggatcccctcaccattaataattccccagagaagaagatgtctttcagttaggaaccctctctaccatcaggcttggaaatggggccaggatattc

SEQ ID NO: 17440 - DNA, 201 bp, Homo sapiens
taaataaagctaaagccactgagttttcccaggtcactttttaaataagccagtctctctgagagatagatgcctgccaaggtgtaagaacgttgccccartttttttcctgtgaggctataatttagcttcatatgataattaatttctctactattgatgaataatccattcaataaaaaccgtgatttaagtgttttc

SEQ ID NO: 17441 - DNA, 201 bp, Homo sapiens
gacctaacgaaaaggcacatggtggaaggagggagagtggtaacctaggtttaggtctaaggggactcttgcttgctgtcagcacctggtacaaataccargatagggtttttggggccacattttccatttgagggagttcctactcacctccactgatctgtggaacactgaaatagcaggagtcactaatttgcctgc

SEQ ID NO: 17442 - DNA, 201 bp, Homo sapiens
ggtagggatttccttgctgtgtttgctaagcttggccatgtcatccacataaatatctgaatatattcatatatgaatacatactgtatataatatgtgtrtatatatgaatacataatacctatatttatatataatatgtgtgtatatatgaatacataatacctatatttatatatataatatgtgcatatataaaat

SEQ ID NO: 17443 - DNA, 201 bp, Homo sapiens
acttcttttctattaagcttgtgtatttagagaggagtgtggggaaattctttcttgttttgccttttgttttgataaaagcaaatggttcccactcgccrtagaatcatcatcaacagattgcatggggaatgttgaggttggagcctcttcttaatggggattttgagaaccaggacatgacttgttcaccggttcatt

SEQ ID NO: 17444 - DNA, 201 bp, Homo sapiens
attagactgtccacacgcagtggcattaaaacttcataaaaactgttccttacagtttgaaaattatttttttcaagtcattataattggttttctttttwtttatttatttatttatttatttatttatttatttatttatttattttaaggtgcagtgtcactatgtcaccaggctggagtgcagtggcgcgatctcgg

SEQ ID NO: 17445 - DNA, 201 bp, Homo sapiens
gttccttacagtttgaaaattatttttttcaagtcattataattggttttctttttttttatttatttatttatttatttatttatttatttatttatttwttttaaggtgcagtgtcactatgtcaccaggctggagtgcagtggcgcgatctcggctcactgcaacctctgcctcctggattcaagcgattctcctgcc

SEQ ID NO: 17446 - DNA, 201 bp, Homo sapiens
ccacaggtcgagtttgagtggctgaggcagttttggtttcaaggcaatcgatacagaaagtgcactgactggtggtgtcaacccatggctcaactggaagyactgtggaagaagatggagggtgtggtaagtccatcagacctgggaccgtgttttctgggctgctgtgttatacaaatcctccactgcctcatttgctta

SEQ ID NO: 17447 - DNA, 201 bp, Homo sapiens
aaaagcaagtaatagtattattctgaaaatagtattgatcttgtggaacctttgccaatctactgcactatgccaattaggaagatttgagtagctaaaarttccaagagtggaataatagttttattagttatatcttgaaggccaatttccttttttaccctggaacttaggctaagtgaggcaacctggaggagaaaa

SEQ ID NO: 17448 - DNA, 201 bp, Homo sapiens
tacctccttccagcacagttgcaatagtctcagaactaatgttcttgcctctatttttcccttctccccaacatcctctctttttgccaatttctgtttcwcattgctgacaagtggtttttcttattatttaactctggtttgactttgattcaatgtaggtcttaaatgtatcccttttggctgtaggataaaaggcca

SEQ ID NO: 17449 - DNA, 201 bp, Homo sapiens
tatggaagggttgattgatgtcctgagagtatgtttttaattttgcatggtggacacattttatatatttatctgtgggaaggagattcatgaataagtgygtatatatctctatatacatacacacatatacaatcatgcattgcttaatgacaaggatacattctgagaaatgcattgttaggcagtttcatcatgtga

SEQ ID NO: 17450 - DNA, 201 bp, Homo sapiens
tgttgtatatgcggtccgttgttgtctgaaataccattctgcaatgcaagactgtgcatatgtggatgtaagaaggatgctccttgtcacccagcagtaayatgagccatcacttattttgcctgtatagtgccctcttgggaaacatgtttattggctcccttagattaactttatgacgagagagtatgtacccttcac

SEQ ID NO: 17451 - DNA, 201 bp, Homo sapiens
cagtataaagtttgatctcccaaggagccatcatagatctatagagggaacaagaatagaagtaccacgaggcaaactggaagtcacttgttttaaagtarttaagataaccatgttgacttttatccatactttatgtatagccttttcaaaattagaaggctgtgtcttccttgttattctgacatgaatatttagcag

SEQ ID NO: 17452 - DNA, 201 bp, Homo sapiens
tctggacctttatagaaaaaaaatctgctgacccttggtctatacccttcaagactttttctgtgcatttgcgtgtgtgtgtttacattttgaaacaatgmggttattctatgtgcttttgtaatttaccctttttgctgaatagtgtttacaagtaacttctattgcattgtttgtttattccattggattataatctgt

SEQ ID NO: 17453 - DNA, 201 bp, Homo sapiens
aatttaccctttttgctgaatagtgtttacaagtaacttctattgcattgtttgtttattccattggattataatctgtgaaccactctgttgctcttttrtttgtattgtacaaacccattagatgttacctaggaacagtaataataatagtagtagtagtagtacttactatatgaattaaaattgattttaattgtt

SEQ ID NO: 17454 - DNA, 201 bp, Homo sapiens
aaaagaagtagcataaaaggaagaaaaaaatacattgattgggtgcatagtatgtaccaggcattttatttacatgcagtatctgagttaatcttcatcayaaacctaactgggtattgtttgccacactttatagataaagaaaagaaagcccaataagattaactaggttgttgaaggagcgctttccactagtgtgcc

SEQ ID NO: 17455 - DNA, 201 bp, Homo sapiens
gatgtggaaaaggttagagtgtataactctatccatgagtaagtgaatccaggtatgtataattccagctgcctgtctcctttccactgtcaggctctcamcaatctatagaagccttgaattttcgttagcctaaaatttgaaatgccccttcatttgctacaaaaatattatatttctacattttcttggattataaag

SEQ ID NO: 17456 - DNA, 201 bp, Homo sapiens
gttaacatgatttgaagcttcactgtggtcggaatgaaagcttgcttggccactaggtggctccttttggttctttctcccagtcgatggttgtggctttstcctgtgccacctcttagaaggaacctaaattggacataaggaagcctagacaacaaggagatctgaaatgaatgggacatgcactctgatgattgcagt

SEQ ID NO: 17457 - DNA, 201 bp, Homo sapiens
aagctccatgataccttgaatttaagggaaaattaatggtgagttaggaaaggcatgatacacaatgcaccaaacaacactccatgaaaatacctcaacarcgaagtactttggaaagagatgacgctgaggtatttaaaattttatttactttcatgattatccaagaagtaacaaatctttttttagattatttctgat

SEQ ID NO: 17458 - DNA, 201 bp, Homo sapiens
aagtgacttgtgatttctttaataatgatccacagagaaaattaacataaaggaagaagtgtctaattatttaggaaaggtttggaagatgtttatcccgrctaatatagatagagagtgtctaatatcttacagcatagaaaggggctaaaacaaatgtgccaaccaatttgttttgcccctgtgcccagtattttatat

SEQ ID NO: 17459 - DNA, 201 bp, Homo sapiens
tataattacattgacttttggactcatctacccacatatgtggtgggcgccttttgaaagtcaggattcagagtaaatcagaactgtcttgagttagctgragttctctttaaggttaacaataaatgtatctatgacaaacatggggatgtggtattgcatattcgattatgtccatttatctttccttcttctgggtga

SEQ ID NO: 17460 - DNA, 201 bp, Homo sapiens
gccctgaaacatgcacctcttgtggtcatggcctgttaactatgcttatttggtgtaataattagcagaatttctcactaacaggggtacttaccaacacstcacatcttcactgtgtttttgtacgtgatggattgtacattctgtggagaaagttgggaaggtcaaagcttaacctctgcctaacaggactagttttcg

SEQ ID NO: 17461 - DNA, 201 bp, Homo sapiens
aggaccagagaaatgggctgaaggtggagcctccagagatgggcttctgaaacaatattacagattggcttgccagggtagccgctcatctgtcacactcrggaagggctaagaatcaggagtcattcctagaactgttgatttgtaagaacacacaaccatagttgtagttgggatcaggaaggtaccaccattacaact

SEQ ID NO: 17462 - DNA, 201 bp, Homo sapiens
ggtgatggcctccattttatttttgacttctgattctcacatgccgccattaaattggtgaagcttatttctcatccagaactcctagctgcaaaagggtmtgagaaataatagtgtttaccttttcatcctctgcaccataggaaggcacaataagaggagattggaagggtgctgagtgccaccatatctacctcttcc

SEQ ID NO: 17463 - DNA, 201 bp, Homo sapiens
acttgcttgggaaaaaggggatggtggagggtcaatctgggggctgaagcggtactctagctgtgtgattttgtctttttgattactactgaaattaactrtttgctttgagcaaactaatgctgagttttgtggatttagtgtttgaaaagggccctgagagggaaaaccctggagttgagctccttatccccgtttgcc

SEQ ID NO: 17464 - DNA, 201 bp, Homo sapiens
tggctcctacattttcagcctcatctcccctgctcttacaccttttatccacactggatttttgcagtactttaaatttgctatgagtttcatctttgggrccttcttgctacgtcctctgctgacgtacctccttctctttatctgtctcttctttttttttattttttgacagaggatctcactctgtcacccagactg

SEQ ID NO: 17465 - DNA, 201 bp, Homo sapiens
tgttaaaggggtaacatttaagcagattggacggagagaatgagccactgagaaatttgaagcgggagcacataggcgggaagatagaacatgattgggaygtttcagaagcaacaagtgtggatggaatagagtgagagaagaggaaatgaaatgaagacaaagggacaagtaaatgggtggcagaaggtagggctttgt

SEQ ID NO: 17466 - DNA, 201 bp, Homo sapiens
aagctctggtttggagaatattgtttgagaagtatctctgcttccttacctgatttcatattttacttcagataatatagtgattttgaagctttagctartggcccgcatagcagtttttctctccttttcatactttcaatttttctcccaagtccgtgaaacatgatgtaatgaggttctcctctgtaatgtaaatat

SEQ ID NO: 17467 - DNA, 201 bp, Homo sapiens
taaggaaatatggttgaggtcaagctacacaccttcgtgagttcttttctggtccatgaactccagtttagcaaattctggtattttcaagtgtaacagtrtattatgtatgaataagaagtgcctgtagaatgtcatcagacatcgatagcaactatctaatgctggtgctgccactcactaacccttgtagtgcccatg

SEQ ID NO: 17468 - DNA, 201 bp, Homo sapiens
ttgcaaaatgagatagagtgatggaattaataggtagaaaatgtaatctactgtaactatccaacctgcgccaatgaatgaagaatactgcacatgtcagstcaagattttatacttaatcaaaagctcaaaattatgtacattttagcttgctttgtatttgaatcatgactttgttgcatagtttccctctccccctgg

SEQ ID NO: 17469 - DNA, 201 bp, Homo sapiens
ttttagctttgtatcctgtacagcacctaacacagtactttgaatatggctggtgcttactaagtatttgttgaactaataagtgaatgaatgaaccaagractggcttttttttttcatttcatggtagtgtgtcttggttatacaagcaaaaggaagtattaattctatccttgaaagcccctgcctgggaaaggtttt

SEQ ID NO: 17470 - DNA, 201 bp, Homo sapiens
ataaaaataatgtgttggtttcttttaggctgaggaggaatgttttactatgcattttgaaatttttttgttctctcatatttcattcaattagagtcacmctgttttggggtaattctgcatctgagtttggtggtggaatttttcccattggctaacagtcttcatatgccctctttggccacctgtctattgaacata

SEQ ID NO: 17471 - DNA, 201 bp, Homo sapiens
gctgataggcaagtagctgagattggttctgtgagagattagtatggattcctggccaaatcctttacttgaaggtggaagaagatgtgtccttacacagycatgtagagattttataaattggagtgtgcttaagaacttgtttttgtctttatgtggatgcttgcagtatgagcaaaccatggtaggttttggcccact

SEQ ID NO: 17472 - DNA, 201 bp, Homo sapiens
ctttcattggctatcaaattctgaaaatgttttcagccatgggtggcccacatctaggaaaaacaaggtcataaatattaagattgagagatgagaatggrcaggtaagtaagaatgaaaagcttcagtgattgtttgaagctgggaagactggatttcagtactgggcttatttaccccaagagtgcctttagcaaaagt

SEQ ID NO: 17473 - DNA, 201 bp, Homo sapiens
gattgtaggaactactattcagaagggatttcagtttgttctctcttcaaacttttattgaactttatagtgttcaaggtattcttgtagggacttgtgarcaggaatggttatattcagtgtcttcaagatgcttatggtctaaagagtatgtacagtgcagaatagaatgtagcagatagcccggctaaattttgtatt

SEQ ID NO: 17474 - DNA, 201 bp, Homo sapiens
tgcagtgaaacattattacaccactatactccagcttgggtgacacagcaagaccctatctcaaaattaaaaaaaaaaaaaaaaaaaaaaggagtatagastgagccatggggcaacaggtgaattcacagccagggacaaatatgaacaatcctaggaaggatggtagagtaaacttagattttgcccataattgtgatt

SEQ ID NO: 17475 - DNA, 201 bp, Homo sapiens
aaaaaaaaaaaaacaaatttgtctgcttcagaaagtgactggctgcttttgatattatgtgttagggaggtggggcagagatgtactgtatcagaaacctyggccccctggggttgaatagagagattgatcttgaatttaaatagcgtgtgtgccagtcttcaccatccccccaatctctgattcttcaaggtcatctcc

SEQ ID NO: 17476 - DNA, 201 bp, Homo sapiens
tggaatgatggatatgatttacaactatatggtgataaagtggctcagaaatattcttttgaagtcttattagctttgctctccaatgcctaagtgcccartgactgaagtccagatatgtgggttgattccatttctttctcctcttctaggcttatttccattaagtgcatgttcaaaatcagggagtttggtttgtaa

SEQ ID NO: 17477 - DNA, 201 bp, Homo sapiens
tcttaaagtgctgggattataggtcagagcccttatttttaaccatgatactatctgcctcaaaacatggttgggcatccaagggaagatgaaggcattayttattaaaatagccagggctctctctttgctctcttgtccaatagcagagcccctagatatagccttctccttgcttccaagttttaatttactgaaatc

SEQ ID NO: 17478 - DNA, 201 bp, Homo sapiens
aatttgaatggctttgtcggtttaatgtatgcctccataattagttttatatatataggttaagattatcaccagctcctcctggcccatgggtaagttaytttaatttattgtaatttaagaaacttataattaatatttcctaatatatattggtgttttgcttgtaataccagccttaaataaagacatttaataaaa

SEQ ID NO: 17479 - DNA, 201 bp, Homo sapiens
ttttaatatagtgacatcagaagtgctctttcttcatcccagtcatttaatcattcatctgctcctttttttttttttttttttttttttttgcagataartgtggagttatacaaagagctaggacttatgtctcccaggttgataaggcacaaggcagtaagtaattcagaggaagaaaaaggagaagagcagattctg

SEQ ID NO: 17480 - DNA, 201 bp, Homo sapiens
taaaagattcaataattatccattactaactgcagaaatcttatctttttcaccttctctggaatgtaatttctctgcattagactctgtcaacattagcrtctatatcaaagacacttcatgcaactttttaaagacataagcaccagctccaggcatcggggttcagtagccatagctctcgatcttggctgcatattt

SEQ ID NO: 17481 - DNA, 201 bp, Homo sapiens
cgttggaatgatataagaaaatgaatgcagtataatgagaattaaaaaaataaatttgtaagaagtatagagttggaaatcttgttcctataaacgtaagrcacaaattctaatgagcttatagatggtccgtaaatcacgttttgctcatgtgaacattgaacattgggtattctttcctaaccagagagaagctacgat

SEQ ID NO: 17482 - DNA, 201 bp, Homo sapiens
gcctcagttttttcatctttaaaatggagatgcttgatatatggtgattgctggatgaagtgagataatgttgatggaatggttgttggcatggcaggtcrtaagcactaaataaacatagctgttgttcttattgccactctggggggaccagttctctaggcctgggggcagtagtaaggtctcagtaggaccttctgg

SEQ ID NO: 17483 - DNA, 201 bp, Homo sapiens
aatgcttcagaagctagagtgattcctggactctcttggtaagactaattatgctgtttcctgctcccgtctgtgaatcagctttgttacatagaatgcaygtaatagtgacgaagagtagactctactgaagcaaaccaatctattaggctgcttggaaaacagagggagaaagaagaacaatgattttgtaaactccat

SEQ ID NO: 17484 - DNA, 201 bp, Homo sapiens
tatataaaaagtgttgggggtgacatttttcccgtaatgacagtattacttctgtggtggtagtgaggatgggtagatggggaggtcagaaaggtacgcarttctgggatcctggtgtttaaatgccttttgaaattgcaagaacagtagtagattttttttttaatgaactctgaagagggattaccagccatatttgta

SEQ ID NO: 17485 - DNA, 201 bp, Homo sapiens
gtggaaggaattaagggaattgataaattgcctcagcattttcccccgtttctttatcattcctctcaagagtctgaaatcctggaaaagaatcaatttgstctggcccacatccttcataggggaagataggacaccttggttgacagtccctctaagactttataccatgaaagaaaagactttgtaagaagagattta

SEQ ID NO: 17486 - DNA, 201 bp, Homo sapiens
gccaggaataaacccagccacccttatccaaattggcctctcctttgagagaatgcctcatgaagtaaatatcctagcctcctggtaggggcctgatattrcaaaattggtgcagggaagaacactagacagagttggtgctctgtgctcagcagtgtcacacagaattgacaggtggagggctggactccagtttgaatc

SEQ ID NO: 17487 - DNA, 201 bp, Homo sapiens
gcaactttatgtaagaaagaagcgacttgatctcgatcgccccaaaagtgggaggcatcttccagctctcacaaggagtggctccatacgtgagatccccrggagcagggaaaagtggatgttactcctgatgggtttcactcctctacttccactttccctgaagtctgcaattgtactaattttaacaacaatagcagc

SEQ ID NO: 17488 - DNA, 201 bp, Homo sapiens
tacttttcctcgaccaattttgattttccccagaaagggatgtagagggaaatgaacttgtgagtatagtttcttatggcagaggagtgctgagtgattgygcctcttcctgggttgcctcctccagcgtggaaagcttgggaacacttcggcgggcagcctgggaagctggcggccggcttttacattctgcttcaggct

SEQ ID NO: 17489 - DNA, 201 bp, Homo sapiens
tttcagacccagaactaattctccatgtttctgtctctgtgtctctcaagcaggagtggtaagctcttctctccaaatcttacctggacttacttttctgwatatttgtgttattgttggggcctagattgacctcttttgtgtggacagcacagagaacatagggaagacctcagcatgcaagctgattgacatcatttg

SEQ ID NO: 17490 - DNA, 201 bp, Homo sapiens
agttttggagtcaaaacccctgttatcttggaaaagccatttaacttccttgaccttcagtttcatcttgtgtaaaatcagaataataatgccaaccttayagagtaattttgaaactttttttttttttttttgagttagagtcttcctctgtcacccaggctggagtgcagtggcacgatctcggctcactgcaacctc

SEQ ID NO: 17491 - DNA, 201 bp, Homo sapiens
atcagtagccaaattctacatggttgattcctcagtcctaagttccttcagattcatatggctttttaagtttcatatatgaagataatcttggcaacatmaaaccaagtacagcaccatcatcgccaccctcctccagaaattctggtaatgaaatacaccatctaaaatcagcaggccaagtctaggactcgtggcagg

SEQ ID NO: 17492 - DNA, 201 bp, Homo sapiens
gcagtctttggatgccaggagtcctaagctttcagtctctaatttgcagtgtgaaacatcaagctatttcaaaatttaatcttagttttcacagctatacratgaagagattaaactggataatataatggattttctgattctgtttacatatgctccttcattatttcagggccaaacatcgttttaggttttgtaaat

SEQ ID NO: 17493 - DNA, 201 bp, Homo sapiens
ccttttaccgaacaattgtgaaattagtaactaacctctgcttgctgatgagattgtttgacagccgtttgctacctggaaaccagaatggctggaaagasacctgtttatgcatttttcatgttaaatgctaggcaaagaggttataccctacatgtggactctaagctaaggaagctgacacgtggggagggaaaaggg

SEQ ID NO: 17494 - DNA, 201 bp, Homo sapiens
tatgtaaaacctcttgtttataaatccaaggtggcattaagcagccactgggagtatgatctgttagggacaggcttttgctccagtatttaggcttgttsttatcagtaaatctaaatagaaagttcctaagtaaagaagcttccgtatttaaatagctcaaaatacgacagccttatttttttaatagcggcattgttt

SEQ ID NO: 17495 - DNA, 201 bp, Homo sapiens
gctggcaggcatgctttgtctgctatctgtggcgtgaactttactaaaatgaaacatgatgccatggagcaaattaagaggaaagctttcagagatgaccmtgtatatgaaacacagttcctactccgcctccttcaccccaatgagagaatccaaattttatttaactggtgcatagaggtctcttgatttgggggaaga

SEQ ID NO: 17496 - DNA, 201 bp, Homo sapiens
ttgaagacacagcaacagaggagaatgattgacaaagtaagcaaggtgcttgaggttacaaaagggatcagctattaaaggacttctgctagtgtctactygtcatcttcaagatggcacaatttttacagtaccatgtatctgtgttgcaggagaaggtaggcctctcaatcagagacttagcctataaaccagcatcta

SEQ ID NO: 17497 - DNA, 201 bp, Homo sapiens
gaaaaagaccctgtcccccccccaaaaaaaaagtctagcaacttgagtgtggcagtggccaacttgatggtaactaacaatgggattgcaaactctttgargaaaggaactgtcatcctgaactcggcatagcaccaagcactgggttgttacatggtgggtgttaagcaaatgccatggaatgcaacagacccctttttc

SEQ ID NO: 17498 - DNA, 201 bp, Homo sapiens
ttttcttcttgcccaaaacattcacaacaaactctgtggagtaggaattgaaggaaaatgtgccatgccatttttctttagcctttttgcaatgcaacgcrcaatcaatacaaatctttgcagtaatcatatattgattttcctagaatataactccatttaaagcacttttatccccaagagtagaaacattggaggcta

SEQ ID NO: 17499 - DNA, 201 bp, Homo sapiens
taccacatacgtcttgatggaagccaccattgttcaacatctgtagttccacagccttaattacgcacttaactcagcaagcctgtcagcagtttatttcyacaagtaccgtcacttttgtaaatcttcccttaaaaattgaatgctgccaatcagcacagggaagagagacagagaccctggaagaccttgtgcaaaaag

SEQ ID NO: 17500 - DNA, 201 bp, Homo sapiens
tctttatttttttaaagaggaaaaaaatgctccaacaaatcaacagaactattaactttctgatttatttgctagagagagcaaaaaaagtcaatgtgaastgacagaaacgccagaacagacagtatgaaaacattctatgtgaaagtttccaactgaaatcgcaccacaagcagttggttatctggagatagacatctt

SEQ ID NO: 17501 - DNA, 201 bp, Homo sapiens
tttcaactcatatcaggttatgatcggcaattacagttgcataattcacctagtcatctctttgcagggcctttattttccctcttggtgacattcctgaraaagtgcctgataaaaatgtcatatatcatcccagctttagaactcgtgagggggtaatctgctatgccttgctgagcccatattcatcactggattttt

SEQ ID NO: 17502 - DNA, 201 bp, Homo sapiens
tggcctcccaaagagctgtgattgcaggtgtgcaccaccgcatccggcccacagttactcattctgctgacctctgttgctgctctcctgagtatattccrgctttgtagtcaggacatcagatactagcatttgtcaataaaaagtgtcaaatgatgtgaacttcctcagtcttaccaccaaaccctacttttcagcgag

SEQ ID NO: 17503 - DNA, 201 bp, Homo sapiens
tccggcccacagttactcattctgctgacctctgttgctgctctcctgagtatattccggctttgtagtcaggacatcagatactagcatttgtcaataamaagtgtcaaatgatgtgaacttcctcagtcttaccaccaaaccctacttttcagcgagagtgcttgcagagagaaatttcttctagagggtttggcttgc

SEQ ID NO: 17504 - DNA, 201 bp, Homo sapiens
ataagatgtttccagcccactgttagggatcatggcactgtgcccatcaacacttggtattaccccagcctccttggagtcctcgtccccatctccctctracctgagtaactttgaggaactttagtatatttggaacccgtatgccagcagcactgttggaagctatcaggaggacacctggtaactaactaacttact

SEQ ID NO: 17505 - DNA, 201 bp, Homo sapiens
ttccctgcaggcagccatcttcaagactgaaagcagaatttaaaaagcagctaaattagagactttacacagttgctggatcctgcttaatgagagacagygaacattttgcaggctactgaacttctgaaatgtgacaatccaagcaaatgaaatcatggtacctttcattgtagtttaattggactcaaactcggcaag

SEQ ID NO: 17506 - DNA, 201 bp, Homo sapiens
gcaatattccttaacattgacagttacaaagaattattctggttggagtttaaagagagaaggaccttattaggctgtagttgggtattctgggatatgcraaatcaagtgagttaaaacactaggcacatagtaggttctcaatcaataaaccaataattgttgatccaccaaaaattcacctttcttcctctcctacgt

SEQ ID NO: 17507 - DNA, 201 bp, Homo sapiens
gtgattatttgacatatgtgattaactgactgaggtaaggagcgtcattattatatcataatcatcattatatataaaggaactccaggctaagactgccytcaaagaaatcttaaaaatcatggattgatttgcagatttagtgggatatgaaaagctgatgttgtgcctgaataagataagcattctttattagattgt

SEQ ID NO: 17508 - DNA, 201 bp, Homo sapiens
catttgcgtcagtattctgctcctggaagagtatactttgacttatgcattgcttgcttaatagaccacaaaagtcaacatccctctggaagaacagctcrtgcttggaggcgtcacaagctccaaaagatcctgttaaggcaggatgtagtgtgaaacccacaagcgaagcaaaaccccgtgtcccctaattataatgtt

SEQ ID NO: 17509 - DNA, 201 bp, Homo sapiens
tccaaacatagaccttcttgcccttccaaatattcttctatgcatttacagacatacatgtatccaacgacaaacatatgttttccttatttgttttacayaagtggttattatgccatacaaatcaatacccacattgcgtttttactcaataatatgccttatgtttagaaatctttccatgttagaacatatcaatct

SEQ ID NO: 17510 - DNA, 201 bp, Homo sapiens
attgactttctacaaactttatgatattctaggtggatcgacacttatcatagccctttaatctgccagccaggataatgtgtgcacggacaatttatccrctgtgagattgaaatgctcaatttggaataactttccctacccagtaaattgagcattactctaggattctgagacagagagaaagcacaattttaaaag

SEQ ID NO: 17511 - DNA, 201 bp, Homo sapiens
gccttttaatttgaagaatagcaggatcttgtcttttgttcacatgagtagaagtccattcagctggaaaaagaacagtgcactctttgtgtactcagagyatttgaatgcttttggtcacacactagttgctgtttaactacaataaaattgtgaccaaaggagataaacatttaaaggataaatgacaggcctgttaat

SEQ ID NO: 17512 - DNA, 201 bp, Homo sapiens
agtgtgggaggcactcaatgaatattagctcctttctccttccttttcagctaaaccaaaaaggctttatctaggaggtgagacttgtagaaactcttgaytgatggaaggaatgagtcagtgaactagaagaagggtattcgaggcctgtggataaccatgtgagaaggtgagaagtgagtgtgtagtgatgggagagtg

SEQ ID NO: 17513 - DNA, 201 bp, Homo sapiens
aacattttcccagcttaccctacctacaagtcaagttgattgcactcccggtaaataactctataccacctagcacatggtattgcaattacagaattccrtgtctctgtctctgaattagacaccactgtttcaattacaaatgacaaaaacccaaatcaaactcacagtggcaaaaaataaggggaatttattgacttg

SEQ ID NO: 17514 - DNA, 201 bp, Homo sapiens
ggtatgccacatgactcttctctttgtcactttcaattcatggtcaacacctcagataggcattttgagaagcagggcagtcctaccacacttacctagtraagtcattttttcacattcagacttgactcattcatttttcttctgcatacttcctcccactttctgcatgtcttctataatatctcctgcactctgcct

SEQ ID NO: 17515 - DNA, 201 bp, Homo sapiens
tgatgatgaatatgtactgaacctgtgagggaagttcttgacatacactattatgtatgttattaaatatggtacaaaattttttgtgatatattttattygagtatcactgtaatctctactgtcatactctggcttctgtctttgtttcctgtagagccgtggttataattagaaatgtaaacaaagtattttgtgctt

SEQ ID NO: 17516 - DNA, 201 bp, Homo sapiens
aagtccttttatcagttggcaactcatttagatttgttaaggaaatatggttgaggtcaagctacacaccttcgtgagttcttttctggtccatgaactcyagtttagcaaattctggtattttcaagtgtaacagtatattatgtatgaataagaagtgcctgtagaatgtcatcagacatcgatagcaactatctaatg

SEQ ID NO: 17517 - DNA, 201 bp, Homo sapiens
atggctgtgcttgggatatttctctgatgcattcgccaactttcaacggtgtgccaatagcaaaataagataaactgagtgtttctctggaactttttctmtaccctgtgtttggacctggcatatcaaaatgaggctctctggtgttgagatggacactgtttttgctcacccagcattcattcctccttctctggcagc

SEQ ID NO: 17518 - DNA, 201 bp, Homo sapiens
gaaactgaggtccagagaggataagtaacttgcctgtggccagcttggtcgctaagttggccttcagggccttggttcttccttcctgtgctaaagtcctsaagtacaagggagacctcctgaatcaccaaaaataattttttcttcattgcagccaaaagcagagaagtttatgcatcagctttgctctaatttgagttt

SEQ ID NO: 17519 - DNA, 201 bp, Homo sapiens
aggcatgaaccaccgcacctggtcccactttggttttagaactaaggcaaccctatttaaaatgtatttctataatatgtagatgtttgcttcagggatcytttccttagattatctttttaagggttggcctgggcatagataggtcaactttaagatgatcttttttcaattgagggcatatcccaataaaattttctt

SEQ ID NO: 17520 - DNA, 201 bp, Homo sapiens
ctctctgaatttcttcatggttcattgtagaacgctagaaaatgattaccattggacgttgtgggaatctagtcagtatctaagaccctatccaaggttcrtccagtagtagtggaatagggtctgtgaccctactgctggcattgtatttgaatattattatgccctatgtgatagtgatagtgcctttggagagaaaca

SEQ ID NO: 17521 - DNA, 201 bp, Homo sapiens
atattcatgtgtctaatgttatcatcggaggggtttcagtgaaacagcttaactttaggttcagagaggtttcattctcacaccagatccagaagttactrttataatacctgcttgcatgaacttgttcatggtactcactggtacaaatttatggcttcaagtgatagaatgctcagtaatattgccctcttggaagct

SEQ ID NO: 17522 - DNA, 201 bp, Homo sapiens
aataacttaatgtactttgaaattgattgttcagtgccaagacaataagaagccaggaggagccagctttattttttacgttggggccttaagttgggctmtgaagaaaaaattctggcagggtttgccacatccaacttttaagggtttttttaatctgtaagagggaacatggactagaatgcttgtttctctttcctg

SEQ ID NO: 17523 - DNA, 201 bp, Homo sapiens
aagaaaagggagtgagaatttactggaaagaaggacaaatgagcatcgaattcagcaggtttgggtttttccagagatcagtgcctgatactggttcccaratgatatctcccaagagcccggttcccagggtgtgttccagcctctgtccgccaggcttcccaccaagtcttgtgccaatagtagttgccagcacattct

SEQ ID NO: 17524 - DNA, 201 bp, Homo sapiens
ggcatttgaactgcagattcccttaaactggacattgtcagctatttatgtattacaaaaacaattgtgtttcatgtaaagtattaaacatcaacattacrtcaccacaagggtgattacagcaaccttcactcctaagtgtgcgtcacctacacaaacagagttgtttgtctgcagcattgttttcatttggtaacaatt

SEQ ID NO: 17525 - DNA, 201 bp, Homo sapiens
tcttgtttttttgtatcaagactgagttctcacaaacaagctctttattaaattaaatggttcatgtagcctcattatccttctcaatgtgcaatacttgrtagtttattttactagcaacttctggagtttgtgtttttttttgttttggggggctttttttaaattttggcttcgggcaaagcaactagtacacattgt

SEQ ID NO: 17526 - DNA, 201 bp, Homo sapiens
caggctgaagtatcgtttccatctttcaagcaagaatatcaaccatatatatttccaaaacattacccaagaaaacgaaagcattttttgatcatgattawttttttacacatacataattaaactgatcgctccagttttatgttgggctttttctgcacttttctttttaaggaatgctagaagatccatgggtccctg

SEQ ID NO: 17527 - DNA, 201 bp, Homo sapiens
ataatctgtatactctagaggtggtgagctctggcagggttttgatgattttatgatggcttgtgtatatttatagtgtgtttaaaatactctttttagtkatcatttgagtgacacaacttaatctttcgatctttacctgcacctcctggtgatgtgtgtttgttaggtaactaaaaagaggaaattaagcaaagccag

SEQ ID NO: 17528 - DNA, 201 bp, Homo sapiens
tgaccttctcaaatcataacggaacagagatgtcacgtggctctggccaaggacgtaagtgagttcgttcaacaggcattttagttctggtgccaggtcaytggggacagagcagagatacagcctgattttcctcagcatctaccgccccgtcagacagggggcaataattcttctcccttagttaaactctgccccaca

SEQ ID NO: 17529 - DNA, 201 bp, Homo sapiens
acgatgttttaaaactcctttctaaccaagtcatttcagaagcaaaccttgcactgactcagaaggcctgttcagtcttccgtggctctcagcatataggrttaccctccttcctcagcctgaattcacggcaccaaaaagaaaaagaacagcataaattggatgtgtgttgagttctgaagatacacatcaggtggactt

SEQ ID NO: 17530 - DNA, 201 bp, Homo sapiens
acaggtaccccacaggaaaattagaatcctgttggtggaacggtgggagtaaatacaggacaacaaatttccatcacagtcagtattcctcacacatttcktaagacaatttggggcccctttattttgcaagagactatgtagagtattgtgtgctaagaaacaatccaactttatttcctgtaaatacaaaatcagtct

SEQ ID NO: 17531 - DNA, 201 bp, Homo sapiens
gttggtctcaaactcctggactcaagccgtctgcccgcactggcctcccaaagtactgggattacaggcgtgagccaccacacctggctttaggattcagsttttgctgttacattacttgccattcctttttcatcttttaacatctctcatctgcttgctttcttttttttttttttttttttcctgagactgagtctg

SEQ ID NO: 17532 - DNA, 201 bp, Homo sapiens
cctcttgggaaacatgtttattggctcccttagattaactttatgacgagagagtatgtacccttcactctactcctccccccagcctacccaattaaagrtgactagtcttttaaaaatagcgttattgagatataacttacatcatataaatggaatcataccgtgtgtggtctttgtgactggcttcttccacttagc

SEQ ID NO: 17533 - DNA, 201 bp, Homo sapiens
aacgtaaacatatttgagcttttatgtaaggacctagtgaaggtttgtaaacacaacactgttaattttccaactcatagaatgacagaaaaataaatgartagctgctggaataattggacgacacttgttactcagaactgtgagtgttggaagcgtgtcataggaacagtgggcctgccacaagcaccacattttagg

SEQ ID NO: 17534 - DNA, 201 bp, Homo sapiens
ggtgaagaggaggagattgtgtaactggagtctccccttaactggtctttattgttaaagaagagtgatccctttgtgtttcagcttggcacacagaaackgttttaatttaacagtccagctcctttaatagatcaattctctattgtggtttgaatttggtgcactcccaatttactctaaacttctacgggcttcctt

SEQ ID NO: 17535 - DNA, 201 bp, Homo sapiens
gccaagagttaggccacaggcaagttaggaaagtgagatatagcacacccaccacattcagtggtggaagaaaagttacctgattcctgccttggagatgygtagggtagtgaccttggggttgggctgcctgaggaggttcctatgctttgatttctgaatggacaggatccctaaagtcatcgaccctagtttgggctc

SEQ ID NO: 17536 - DNA, 201 bp, Homo sapiens
atttaaaagtttgataataatgaatgtttgagtatatgaagaactgggtattatttgttgatggacatgtaccatagcatttttctggagcgtaatttcayaatgtgaatcagaagtcttaatagtgcatacgttttgacctagtgaatctcctgctaagactttttatcctaaagaagtcatctgtgccttcttgtcaag

SEQ ID NO: 17537 - DNA, 201 bp, Homo sapiens
ttcatccttctttgtatccgtatatagtggcaaatgagtattttttgccccaaatctgttaagtatttgttgttcttgaggagcttgtactattcagttayattgtggccactgttcagtaactctttgatttctgcaactgcagtctctgtttagtaataggattcttttgatagcaaataataattccagacccaaaga

SEQ ID NO: 17538 - DNA, 201 bp, Homo sapiens
ggcccccaaatgactgcccccagcttttgtggccactctctctttctttttcctgagctttggggaggagagaaactgggtattgggtgtgtactttgaaytctggatcaagctttacctgaagctagatgaacaaataatgaccctcttttgattaacccagttcggttctggtttctgtgttatttacaacgtaagggt

SEQ ID NO: 17539 - DNA, 201 bp, Homo sapiens
agctaatggcccgcatagcagtttttctctccttttcatactttcaatttttctcccaagtccgtgaaacatgatgtaatgaggttctcctctgtaatgtraatatttttatcttaaattttttccccaaatgcttaatctgaaagctgacagagccagacatgatgttgaagggctttagatttttctgtaaagagtttt

SEQ ID NO: 17540 - DNA, 201 bp, Homo sapiens
caagggactatgtttgtcttgaattgcttgtttcgaggcatctgagagcggcttcttgttatagattctgagctgggaatgattagtttgtttttttttcycaccccttcagacttttctaaattctccattttttcagaccattcattgctccgtggctgagaaggagtatgtgctgtgtcagcagcaagcttttcttgc

SEQ ID NO: 17541 - DNA, 201 bp, Homo sapiens
attatgcacgaagaagctggtaccttctagagagatcattctgaaaacagatctgactggtgaaaaaggctttagtgtctgtcagtagtctcagtgtaagktctagattctttcctatggttcataaacccatgtcctggtctccacccacctctccaggctcttctcttgcaagtccatgccattcatgtgacactattg

SEQ ID NO: 17542 - DNA, 201 bp, Homo sapiens
aagttctagattctttcctatggttcataaacccatgtcctggtctccacccacctctccaggctcttctcttgcaagtccatgccattcatgtgacactmttgcagctgggaattgattgtgctcttatacacacaccatgccatttccctcctagaatgtgccttccctatgtcacactttccccttttgccttctgtc

SEQ ID NO: 17543 - DNA, 201 bp, Homo sapiens
atttgagtatcactgtaatctctactgtcatactctggcttctgtctttgtttcctgtagagccgtggttataattagaaatgtaaacaaagtattttgtsctttattaaatagaattttttctcaaaaactagctggcataaaacattgaatgggttaattttggggggaagttttggacaatttaaacttgacttttaa

SEQ ID NO: 17544 - DNA, 201 bp, Homo sapiens
ttctcaaaaactagctggcataaaacattgaatgggttaattttggggggaagttttggacaatttaaacttgacttttaaacttaacagtcttttgtatkttgtcacatcttctacttatttaacagtttggttagtgggagctgggagctgggagtgcaccaaacacactgaggtacttaaaatcttttcaattttatt

SEQ ID NO: 17545 - DNA, 201 bp, Homo sapiens
agccaaaatgtagtttctaataatatttatgaagactaatggcaggggagtggtcgtggcatattctttgagtctttgcattatagaagagtgacttcctrtcctttcacttgtgaatatctgcttgattggctataggattcttaagtatcaaacttcccccttaaaactctgtagaggctgggtgcagtggctcatccg

SEQ ID NO: 17546 - DNA, 201 bp, Homo sapiens
catttctgctggccatgatgcttagatgagaagtagatctctcaacatccaggcacatttgttctgcgattccacctaccattttcctgggtagtgctggrattaattaagtctgatacgccatccagttgaaatttactaccagcttcttagcctagtatatattatccttacaagtcaggcctcaccttgaggtcagaa

SEQ ID NO: 17547 - DNA, 201 bp, Homo sapiens
tattgctgaaagaggagttgggtgggtaggtgggtgggggtagatatatacaaaggagtgaattataacaaagagccttttctgcttcaattcttgtgtaraaaacatatgttcagtgatgcaggcagcagttgggttaaagacacactgtagggccgcagacaaaaggcctgtgcccttcctgcattcacaatgtttcca

SEQ ID NO: 17548 - DNA, 201 bp, Homo sapiens
aacacaaattatattataatgaagcttttttcccaataagcattttataagaggaaaacctgaaaacaaacaacaatcagcaaaaagtttatgagtcattyaccctaacaattgtaatagtttccttgttactccattcctgtagtgatgaaccccccgccctttttttgttttgagatggagtctccctctgttgcccag

SEQ ID NO: 17549 - DNA, 201 bp, Homo sapiens
ataactaaagtttcttgtgttctcttgatttatctcatgctgtacctgtgaaatatttagttaccctcattctctcttttctctctgttttctagagcaaygacatagggcagtggaaaaagaatgagttttggagtcaaaacccctgttatcttggaaaagccatttaacttccttgaccttcagtttcatcttgtgtaa

SEQ ID NO: 17550 - DNA, 201 bp, Homo sapiens
attattttttaaaaccaagagtaatatttgcccagtttgcctcatagacatgttgtgaggctcaagggagataatgaatatgtaggtactttgaaaagtayaaaatgcaattgttagaaagtattattagtatattagtctgaaaacagcataagcagtaagccccccagatacccccacatttttgtgtgtacaatgggg

SEQ ID NO: 17551 - DNA, 201 bp, Homo sapiens
tcctaactgattcagttacttttagaaggaaaaataaaagtggagacagcatcctaagaggaaaggtggtgactggataaactatatggaagtcctgacarcatcatatttaagaaatttggtggctggcctctattcttctgttaggtgtaaggaagacccactgagtaacactggagcattcatcattcaagaaacatt

SEQ ID NO: 17552 - DNA, 201 bp, Homo sapiens
tatacacttggtagaaagtgacatgctatcttgtgctattaacaaccaaagataattgcaacgaattgtaattgcagtttgcaacttacagtacagtgtgyccaacatcaatcttaatagtgaacaaagcaatttatattaaaacttaattcacttggtaactttccgctgtatacacgggagctaacagatgtagctttt

SEQ ID NO: 17553 - DNA, 201 bp, Homo sapiens
tttgaaaataatagagaaaaatgggggagtgggacttcaccatggtcccactctcctaatacagctatttttaccttgaaagttaatttccagccattgamcataggaatgtgtgggttaatttaggtattgttgttgagtacatgaaattttgtatcatgcttttttatttaatgctacattgtttcctgtgttgcttca

SEQ ID NO: 17554 - DNA, 201 bp, Homo sapiens
catggcccctttggtcttgaggttctgctatactttgacttggcttctggcttcaggtttccctcacggtcacaaaagaactgctgtggctcctaatggcycacctacattacaggtaggaagaaggaagaaagggagggaagggtataatgtgcctggcagctgagccaaaccccaacccctttttaaggaacttcccca

SEQ ID NO: 17555 - DNA, 201 bp, Homo sapiens
ttaataccagctaaagagaaacatgattataggacattaggctttttgtaaaatcataaggtcaggataagataatgataccatctaaaattacacaagaktttgagtacttagtatcctctgactgccccagcaacccaacccaaaccccaacaagcatagctgaatttttggggttggcaaagccatgaatggaatgat

SEQ ID NO: 17556 - DNA, 201 bp, Homo sapiens
tccttaaagatgcccaggtgggaaacttgtggttgtgatgattaattaataagtccgcccagttaacctgaagtttgcaggccatactgcaagcctaaggmggtctctttggcaactcatccttcttttccgaggctccagtgggctttattcagtggcggcattgctagcagcaccgcaaaaacttcagtcggaggactt

SEQ ID NO: 17557 - DNA, 201 bp, Homo sapiens
gttagtctgtccctccaccttggcccccaaacaaccactgatatgttttttgtctctgtagatgcatctgtattttctagatttcatataaatggaagcayacagtgtatacttttgggtctttttttcattcagcgtaatgatttttttttcaaaatagagatggtgtcttgctgtgttgcccaagttggtctggaactc

SEQ ID NO: 17558 - DNA, 201 bp, Homo sapiens
ttaggtgctgtggaaaacacagttcctctaatcaaggttatagtttagttgttgggaaagagacataattgattgtgagataaatgccaagttaaataacrttgaccataagtacatcatgagctctttgaaataagtagtcagtgtgaattggggaagtctttatggagagaaagagggcatcaaaattggagctcaaaa

SEQ ID NO: 17559 - DNA, 201 bp, Homo sapiens
agaaatgtctgatcacctgccctaagtctacagttgagagcagttttggggactagtaagtcatgttctcttaaggacagcgtctcctaggtgagcggctygtagtccatatggagcaaattagacagtgaaagaatggtgctgctactgtttctgattggttacggtagtattaaaaaagaacaacaaccgacttgccca

SEQ ID NO: 17560 - DNA, 201 bp, Homo sapiens
actgacttgtagaggcaaatgtgatattggtgttgggacacatcatctgaacttccactgtcattatctgcttctcaaaattggagttgagagcatgtgcraacttgagaatttattcttcttgtctacttgaacatctctcttttaaaaaatgcaaaatgttagaaatgtttgatccaatatagggcaaataaaaattgg

SEQ ID NO: 17561 - DNA, 201 bp, Homo sapiens
agtccctcccacaacacatggggatttggggaactacaattcaagatgagatttgggtggggacacagccaaaccgtatcaggtgtgtttggggtactatyggagatcagatcaggaccacaaaacctggataggctggggaacaggagaaatcaggaaatgtttcctggcagaaataatggctaagtcaaatcttgaaga

SEQ ID NO: 17562 - DNA, 201 bp, Homo sapiens
aaaaagtaatccagctcaacaacctgtgtgccaagtttctctcatataatttgaaacagtcaagcaataaactctgaaaaaggaatttctaatggaagccytgaaaacacttgactccagctttgctactgggtgccataataaatccagaaacctaaaacctcagatacactggagaagtaaaaactttcagcggagcta

SEQ ID NO: 17563 - DNA, 201 bp, Homo sapiens
gctctgtattttggttgtggtggtagttatatgaatctatacatgtgataaaactgcaaagaataattgcacatatacgtacgcgcgtgcgcgcgcgcgcrccacacacacacacacacacacacacacacacacaaaagtgcatgtaaaaactgacgaaatctgagtaaggtatgtagcctaattaatagtattgtcccg

SEQ ID NO: 17564 - DNA, 201 bp, Homo sapiens
tgtgatattagtcacgcttctttaactgaaagtcatagaaactaattctatttagcaaaaacaacaaaaaagggactttaaggttacaggcatatttcacrgaatacatagtagaaatatggctggaccttcggaaggcagtggcctagaaaccagcagaatgtcctctccatctgatctccatttttttctgtatgtttg

SEQ ID NO: 17565 - DNA, 201 bp, Homo sapiens
taaaaataacacaacactccatttttatggtttgttttaatgtagagctctaggagaacatactaagctgttttagcttagggtcatggtagcctgatatyattttttattcctctccaattatatactaacaatcacacaataaagttgattgatctcagaatttatagggtgtctattgggtctgtgctggtccagtaa

SEQ ID NO: 17566 - DNA, 201 bp, Homo sapiens
gcattggtgttctcaagattcatacatcttgtagcatatgtcaaatttcattccttcttaaggctgtataatatttcatcatatgtatataccacattttrtttatccacttatcctgtgatagacatttggattgtttccacctttgactattatggataatgctgctctaaacatgggcatacaaatatctgagttctt

SEQ ID NO: 17567 - DNA, 201 bp, Homo sapiens
gatttactgcattttctttcacccaagaagcaagtgataatgataatgtatggcagactgcttgtccttcctgacagcctcagtaatttaatccttctctyctgccacaacatgcaataaaagaggcatctagtgtattgggttgaggaaatccgcaggctgacgcctgctggggaggggtatgggagagaaacgtgcagg

SEQ ID NO: 17568 - DNA, 201 bp, Homo sapiens
ttaaaaattttcatttaaaagcttcacaaataatttctctttacactaccttatataaattttaagaacgtttatactctttagcatgtgtttatgatttstttttacagacgcttaaatttggtattttccgagccaggcttggtggctcacgcctgtaatctcagcactttggggggctggggcgggtggatcacctga

SEQ ID NO: 17569 - DNA, 201 bp, Homo sapiens
acataatataactaagatatttttctgtgctatgagtgtcttagaaaacaaactataaaagttgtaagaccaaatcaaaaaacccctaaatttaaaaattwtcatttaaaagcttcacaaataatttctctttacactaccttatataaattttaagaacgtttatactctttagcatgtgtttatgatttctttttacag

SEQ ID NO: 17570 - DNA, 201 bp, Homo sapiens
ataaagacttttgaatttacctgctgaatgttgtgacaactaaaagagtatccgaagcttatttttttacaaaggcaagagtaagagtaatttggtaaacrtaatataactaagatatttttctgtgctatgagtgtcttagaaaacaaactataaaagttgtaagaccaaatcaaaaaacccctaaatttaaaaattttc

SEQ ID NO: 17571 - DNA, 201 bp, Homo sapiens
atatttctctcagtagttataatcaaatggtatcagaacttcctgcaatcttggcaaatggggtaaatgaacatagaaaacaagatgagggtgatttccaygcatcagaagctgcttaaaagcacagcaggttagggaaaactgtctttagactagagttcttgacagcagttagtaggtcgagcataggcttatatgaag

SEQ ID NO: 17572 - DNA, 201 bp, Homo sapiens
agctagtggacgctgggtttaatatctgggtgacgggattatctgtgcagcaaaccaccatggtacacatttatctatgtaacaaacctacacatcctgtrcatgtacccctgaacttaaaagttggaaattataacaaaaaaagttttttaatgtcatagatgaaaaggcagcaaggagactatctacaggaccaactgt

SEQ ID NO: 17573 - DNA, 201 bp, Homo sapiens
tgctatgtgtagaacttatttggattccaattcaaatgaacagtagaaggacatcttcacagaagtttgaatataaaccagttattagacgatatcaaagwactactgtgatttttgttaggtgtgataatggcatggtaggtatgtttttaaaaattccttttcagacagaaatagaggttgaagtatttatcagtgagg

SEQ ID NO: 17574 - DNA, 201 bp, Homo sapiens
taaatttggatgtttttaatgtcatataattcttggcagtctaaaaagtaaaaaaataaaaaaataaaaaaaaaaaacctgtgatcctaggcaatacagaracattttacatcaaggctggcgcagtggctcatgcctgtaatcccagcactttgggaggctgaggcaggtggatcgcgaggtcaggagttcgagaccagc

SEQ ID NO: 17575 - DNA, 201 bp, Homo sapiens
cccatggttaccactatcttgaagttggttgtatcattcccaaacatgcctttatattttctactgcatgtgtgtatatctataaacaacatacagtattrttttctgttttttggttttatatttgtggtatcatattcttattaatcattctgcaatttctgtttttttatactcaatactatatttttgagatttatc

SEQ ID NO: 17576 - DNA, 201 bp, Homo sapiens
tgatagaaactgcatgcatcaaagaaaatgcatactgagctttaatgtgcataaaatggatattagcattttaaagaggaagattaacacattaatccaastaattttcatatattgcttctaataaaatcttcacagtataaaactcttaatgaagctaatcataggcattccatttagtgggacgattagggataacat

SEQ ID NO: 17577 - DNA, 201 bp, Homo sapiens
actttataggtattatgctaatatatgtagctatatgaatcaatattaactagagcagaaactacagttcattctcttatattctgtcataatatactttrttgaataaataatacattttcaagcaaaagaaacaattttatgtctaatttgaacattttctcataatttatctttaattttatttttacaaaattaaca

SEQ ID NO: 17578 - DNA, 201 bp, Homo sapiens
cagttttcacacaactgctaggagtaggaacagagaaagagaatgatgtaaatatgcactgcacagaagagtccattgctctttcagcctgtaatttcccrttctcacctgtgggcacattttaagacagctgtgagttcatggcaatacattttgttgtgaaaaatgaaagctgcactattgaatgataaaattagaaat

SEQ ID NO: 17579 - DNA, 201 bp, Homo sapiens
agtttctttgtgttgatggaacagctctgtattttggttgtggtggtagttatatgaatctatacatgtgataaaactgcaaagaataattgcacatataygtacgcgcgtgcgcgcgcgcgcgccacacacacacacacacacacacacacacacacaaaagtgcatgtaaaaactgacgaaatctgagtaaggtatgta

SEQ ID NO: 17580 - DNA, 201 bp, Homo sapiens
tgggttaaggttacaggggatctctttgtactatttttaccacttcctgtgagtatatgattacttcaaaataaaagttaaaaaaagacacttgatggctrtgaaaatgattttagtttaaagcacgacacataaataaatattataaaatttctatgtcataaaagggtcttaaagccaaatgagcttaccgactgcata

SEQ ID NO: 17581 - DNA, 201 bp, Homo sapiens
agtacataacccaaggttaaaatagtttcatacattaaaatagatagcagtaaaaatacatcaatggcattatgcattaaaactatacattttatgctgartaaaataatatgacttgcacaaatgatgtgagattggcaaataacagatgaagaaaatagttacttctgaagtatgagtttcattgtatattaaatatta

SEQ ID NO: 17582 - DNA, 201 bp, Homo sapiens
tgaaagaaatagagtatactgttatggaaaaatgttgatggtatattagtaagagttagttaaattgcaaagcataaaaaatagttttaaaagcaatttcyactaggagagtatgtcaacatttccagtttgacataaaatatattttatttttatttatttatttttgtgacagagtcttgctctgttgcccaggctgga

SEQ ID NO: 17583 - DNA, 201 bp, Homo sapiens
aaatggggtttcatcatgttagccaggctggtcttgaactcctgacctcaagtgatccgcccgcctcagcctcccaaagtgctgggattacaggcgtgagscactgtgcctggcctatttacttctaaaagataaatttaaagacagttctacccatgtatctaggtcacagtcagtggtgtgagatcgagaggcatttag

SEQ ID NO: 17584 - DNA, 201 bp, Homo sapiens
aggggccaaaaaaatgagctcagagccagccgaagtgacaacaaacatgtggttgtttactaggactggagaggtttagtctgcagatgtttgtggtctcyagaaggttccagaggaacgagttgttatgaagatttgcagagttggatgagagcaagattcttctcggagatggcaggccccaggacagggaggcccagt

SEQ ID NO: 17585 - DNA, 201 bp, Homo sapiens
gtctaactaagcatatcagaatttgagttatacttttcataatttctttctgtgtcatatactaagttttcaacgtgtaaatttcacatctatctatatamctatctcctttttatatatacatccctgggtcaccattacaaatgtatgaaaataatacaaatagaatgaacttttaagaaagaaagacaaaaaacttgc

SEQ ID NO: 17586 - DNA, 201 bp, Homo sapiens
tttgtggagctaaaactaataagctaatcctgaagtttacctagtgaaagcgtctaggataatgaccctcacacacaatcagaatttttaagctactggaygggcatggtggctcatgcctgtaatctcagcactttgggaggccgaggtgaggtgatcacctgaggttgagagtttgaaactagcctgaccaacatggag

SEQ ID NO: 17587 - DNA, 201 bp, Homo sapiens
ctgaggaaaacatttcatttaaaatagattttatgtgaaattagaaaagattaaaatggcagacccaagaatcttaagatctgtgggtttgagtatatgtrggattttcttggaagagggaccactactttcagtggtgtcccaaaggtagatcttgggctcaagtgattcccccactgtggcctccccaagtgttaggat

SEQ ID NO: 17588 - DNA, 201 bp, Homo sapiens
ttaagatctgtgggtttgagtatatgtaggattttcttggaagagggaccactactttcagtggtgtcccaaaggtagatcttgggctcaagtgattcccmcactgtggcctccccaagtgttaggattagaggcctgagccactgcacccagccccgaaggtagactatttggctggagccatgggcattctctgagctc

SEQ ID NO: 17589 - DNA, 201 bp, Homo sapiens
ttcagtggtgtcccaaaggtagatcttgggctcaagtgattcccccactgtggcctccccaagtgttaggattagaggcctgagccactgcacccagcccygaaggtagactatttggctggagccatgggcattctctgagctcagtggtggaagccaaatgggatgccgattcaatacctgagactccatccctctgtg

SEQ ID NO: 17590 - DNA, 201 bp, Homo sapiens
atgcctggcacataagaggtgctcccttcagtgtttgttgaatgcacaagtgaatatgtaaacaagtcatgcacatttttccaaagatggctctgctaacytaacaaatgggactaggaatcagccttatttctctatttactacataaagcctaggccatccctgattatgatttttaaaagtctgattaataaaacaat

SEQ ID NO: 17591 - DNA, 201 bp, Homo sapiens
tgggactaggaatcagccttatttctctatttactacataaagcctaggccatccctgattatgatttttaaaagtctgattaataaaacaatttagcacrttctaaatacagaagaatagagagtagaaattaagcattgttgggaatcacaactagtaagttaaaaatccaggacagcacatttgtcaggaacagatca

SEQ ID NO: 17592 - DNA, 201 bp, Homo sapiens
tctaaatgccagagaaagaactcgaaatttaaaaatgcaatatttctggctttaaattctatatagagaaaaatgagatgtcaaaaacaaaattaagaaaycagaaagttaagctgaaaagggaggaaaagtacactaaaatcatttaagaattaaaagtaatttttaaaaaataacgaaaagacacacacacaaatcttt

SEQ ID NO: 17593 - DNA, 201 bp, Homo sapiens
gcttttggctgtggaaaaacatacatgtaaacgcctctttcccttaggacaatgatactgttgagggagaacagtcaatggggccatccactcccatggtkgttcgaggagtgcatggccagcactgaaacactcatccatggttggaagccctgagccagtcacttggcacctgcaatacctctctatctttctcaaaaa

SEQ ID NO: 17594 - DNA, 201 bp, Homo sapiens
aacctagaccagatttgataaatttcaatagcttaaatcatttttttattgtggtaaaatacacataacataaaatttaccatcctaaattaacaattaayatttaagtattcagtttagtggcattaaatatctacatattgtggtacaatgatcaccactatccatttccagaacttcttcatcttcccaaactgaaac

SEQ ID NO: 17595 - DNA, 201 bp, Homo sapiens
tcctttatgacagcaatactgatctctaagagcaagttggttgtttcctcctctgggcctttactgcacttctccatcacattgtactacatggaactgtycacatatttgcctctgtctatagactctgggcttcaggagggcaggaccaatatcttactcattttttgctacttcacatcctccccaacatagactgtc

SEQ ID NO: 17596 - DNA, 201 bp, Homo sapiens
attgttatatataataatgttcatcttaagcagatatatttgtattagcaaaaaatcatagaaacacttaagggtccatcaaaaggggcttatttaaatamatatagtatagccatataatggaatattataggtatgttgaaagaaatagagtatactgttatggaaaaatgttgatggtatattagtaagagttagtta

SEQ ID NO: 17597 - DNA, 201 bp, Homo sapiens
tcttggagataggacctggaataatacagtcatcactgtcagaagctgacatgtcctcttcaactgtttaaaaaataaaagggtaacatttacacaagttraaccaattctacttataccctgtaaaataaagagaaacaagcacacaccataagataaccttaagaaacatggtaattatacctagatcttttttagtag

SEQ ID NO: 17598 - DNA, 201 bp, Homo sapiens
gccaagctttgttctgcaagctgaccttcagatagtaaagacacatcatcttttccttgctgcattttctcagtattctcttttacctcatctacactgcyttcttgtgaaacctgaagaaatcaaagcacactggtatatttataattgcttagatcacattttatagcattattgctggaacagttgaataataaagca

SEQ ID NO: 17599 - DNA, 201 bp, Homo sapiens
acagtcagcatattaatttctatttctggtatatgctctacctctggtgaaatttccttcctatcttcaggaggaggagaagtctccttatattaatgtgraaacacgcatgtatgtcattttttatttattactaaatcccaaatcattctatcatatacatattgaactactaaaaattggcagcaaatgtaacagtta

SEQ ID NO: 17600 - DNA, 201 bp, Homo sapiens
ggccaacatggtggtgaaaccttgtctctactaaaaatacaaaaattagccaggtgtggtggcgggtgcctgtaatcccagctacttgggaggctgaggcrggagaattgctagaacgtgggaagaggaggttgctgtgagcccaggtggcaccactgcattccagcctgggcgacagagcaagactccatctaaaaaaaa

SEQ ID NO: 17601 - DNA, 201 bp, Homo sapiens
cattgtactgacatcatcaatgacattttttttttgagatggaagagcgaaagctcttgttatccaggctggagtgcagtggcgccatctcagctcactgyaacctctgcctctcgggttcaagcaattctgcctcagcctcccaagtagctgggattacaggcatgcaccaccacacctggctaatttttgtatttttac

SEQ ID NO: 17602 - DNA, 201 bp, Homo sapiens
aagggtcttaaagccaaatgagcttaccgactgcatatgctctggccccttaaaatttgatgttatataccccaaagcctttgccctttctcgataaagtygaattgcttgatccatgggaactcttaatcggaaccagtattccactgtgccaaaatttgggatgtctccttttgttcctacaaatcagtacataaccca

SEQ ID NO: 17603 - DNA, 201 bp, Homo sapiens
gaggtcagtattatcttccatgtaaaacagttactcagtggcagaatgtactttctaatttataattcattatgcttactttagttgtattcagagtctaytgccaatctcacatagctaggagtagccaagccctttcatcctgcagctgcctcctgcctgtgtggaggccttattgacttcaaaggaactctatctagg

SEQ ID NO: 17604 - DNA, 201 bp, Homo sapiens
gctgtgcgtggtggctcacacctgtaatcccagcactttgcgaggccgagacgggcggctgacttcaggccaggagttcgagaccagcctggccaacatgrtgaaaccctgtctctactaaaaatacaaaaattagctgggtgtggtggcacacgcctgtaatcccagctactcgggaggctgaggcagaagaatcgcttg

SEQ ID NO: 17605 - DNA, 201 bp, Homo sapiens
tggctgtgcgtggtggctcacacctgtaatcccagcactttgcgaggccgagacgggcggctgacttcaggccaggagttcgagaccagcctggccaacawgatgaaaccctgtctctactaaaaatacaaaaattagctgggtgtggtggcacacgcctgtaatcccagctactcgggaggctgaggcagaagaatcgct

SEQ ID NO: 17606 - DNA, 201 bp, Homo sapiens
acatggcaggctgaggcaggagaatcgcttaaatccgggaggcggaggttgtagtgagcggaggtcgcgccactgcactccagcctgggcgacagagcgaracttcgtctcaaaaaaaaaaaaaaaaaaaaaaatttctgtgtagccaaattttatctttttcaataaacaatacattgaccacttttctggttttcacag

SEQ ID NO: 17607 - DNA, 201 bp, Homo sapiens
tgtgtttatgatttctttttacagacgcttaaatttggtattttccgagccaggcttggtggctcacgcctgtaatctcagcactttggggggctggggcrggtggatcacctgaggtcgggagttcaagaccagcctggccaacatggtgaaaccccgtctctactaaaaatacgaaacttagctgggcatggtggcgga

SEQ ID NO: 17608 - DNA, 201 bp, Homo sapiens
aagatgaataaactctgaatctgaaatgaaaagccagaaaatcttacttggtttttctaataagaacctaggcatacaagtatgatatcaaacttgttggwaaggagaaaagtaagtacagcaactaggtctggtttaaaaaaaaaatccagggaaataaaagagacataataaccaaatgctatgtgtagaacttatttg

SEQ ID NO: 17609 - DNA, 201 bp, Homo sapiens
ctgacctcataatccacccgcctcggcctcccaaagtgctgggattacaggtgtgagccactgtacccggccgcagtatgttgatacttttaagaaaattmagatatatttgaataataaccattaattacagtaacacaattaaatctctataatccattcgggcacatagggtgatagaaataacagtttttaatttta

SEQ ID NO: 17610 - DNA, 201 bp, Homo sapiens
taaaaaaacacttagtacaaactagttacacatttgtaagagtataaatatttttggagttgaaaaaggtcagtaaatggtaaaatcattctgattttaaygttcatgtacatgtgttcactggttactgctttgaatttaatttaagacggcctttttaataagcagaaaatgtgcatttttatattgtttaaatttaat

SEQ ID NO: 17611 - DNA, 201 bp, Homo sapiens
tggctgggtacagcggctcatgcctgtaatcccaatgctttgggaggctgaggcaggaggatggcttgagcccaggagttcaagaccagcctaggaaacakagagagatcccatctctataaaaaataaaattgaagacccagtgtggtggcttgtgcctgtaatcccagcactttgggaggccgaggtgggcagatcact

SEQ ID NO: 17612 - DNA, 201 bp, Homo sapiens
tttccttctacagaagaaactccatttgttcaatgttcaagggcatcctaatgtgagagacaggaaagaatatactctaaatcatccataaagaaatccayagtggctgggtacagcggctcatgcctgtaatcccaatgctttgggaggctgaggcaggaggatggcttgagcccaggagttcaagaccagcctaggaaa

SEQ ID NO: 17613 - DNA, 201 bp, Homo sapiens
agaaattttgagcaaccactgaattcatgagagtggatgactgtgtctgtccctcatacattgcggggatactggcaaacagtaggcaccagagtaagtaytgactgattcaatgaagaaacattagatgtctgaaatgagtaaggcagtggttatttcaaatgtacctctttcagtttttaatctgtcaaggatttcagt

SEQ ID NO: 17614 - DNA, 201 bp, Homo sapiens
ttaacatacctttgatctgtagcttgctgttctcgaagctgaagaagagataactcaatttcattttcttttctcctcaactgagttttcaggatctcagycaagtgctctaactcctctatctggcctctttgtgactgaataacgttttctctgaaataaagagcctctgtaagaacttgtagtttgaggaaaattttt

SEQ ID NO: 17615 - DNA, 201 bp, Homo sapiens
tacaccagagtaattacaaaaatctcatgtaggaactttcatgtgagcatttactgaggagtaggagatgcctctggagcatttgctttcaagcctccaartcatctctgtattgcttgtagacagactggagggcatggagagcttcgactgttaccctgagcttgccaataccttcaccatctgctcgtgcatcaaaaa

SEQ ID NO: 17616 - DNA, 201 bp, Homo sapiens
atgggcagcactgaaggcactgcaaaacacacgtgacatgcaaggaaagcttggaaatcagcttcaaccgaaaataataaagagaaaagcttttagtggcrcagagaccactgtcatcatgtcttaggaattaagtaaacatatgctggtctgctgctgttgaaaccaaggcgcctttctcaggctgcggttagggaacat

SEQ ID NO: 17617 - DNA, 201 bp, Homo sapiens
atacaaaacttcaacacttcaaacccaggtctccccgctcccagcttcccatgaattatagattatatacaccagagtaattacaaaaatctcatgtaggwactttcatgtgagcatttactgaggagtaggagatgcctctggagcatttgctttcaagcctccaagtcatctctgtattgcttgtagacagactggagg

SEQ ID NO: 17618 - DNA, 201 bp, Homo sapiens
tgattagttataaacgaatcatatccataacactaaggtataattttgttttgtttttacaattttatagattcaaaaacataggcttacctgagatacayctgtcatgtgccaacgaaatcagaggcacattgacttttcctatgtaaatattctcctgggtatcactatcatcaaaaacataaaaactcagagactctg

SEQ ID NO: 17619 - DNA, 201 bp, Homo sapiens
gtttggagttcagcaattgttggttgcacaaactgagcaacactttcacccataccatcgatattttgctcaatgaggtccctcccttcctgaaacatgtyggcaaggtcgacgtgagccacgccaatgtcctcacactccaggtcctgctcgtcctctggagggtcactgaccacggtgaagcgaaggctggtaaggcag

SEQ ID NO: 17620 - DNA, 201 bp, Homo sapiens
aacttataattttaaataagtacaattttgaaatatctctattttactttttcaaaacagttaccaagaagttgtaatgcaacagatggctaaactctttkggagcttacctcttctattcttctttcagaaaacttcatagaatgtaattgtttctcaagactgcagcattttaaacgctgctctttaagttgcatgttt

SEQ ID NO: 17621 - DNA, 201 bp, Homo sapiens
gctttcgctttgtagtatagtgctttctctatgcataaaatattgagataaaaattctgagttttatttcttaaataaggaaataattcacctggttgtayaattttatgcgttttttaagttcatcaagttgttgcttttgttccagatactgtaactgtagttctctattctcttgaacgagtttttcattttgatctt

SEQ ID NO: 17622 - DNA, 201 bp, Homo sapiens
gtctatattacaaatgaatcatacataccattgctatagttatagtagacccactgcccactcttgggttttggaagtgacacgggtgtctcttcagcagsaagactgtagaatcgacactcaacaaacagccgttggatagtgtcatccatggttacttgagaatcattaaggcttagagctatgatctcaatccgaatt

SEQ ID NO: 17623 - DNA, 201 bp, Homo sapiens
aggcaggagaatcgcctgaactcgggaggtggaggttgcggtgagccgagatcatgccactgcacgccagcctgagagacaagagcgagactcctcaaagaaaaaaaaaaaaaagaatttttaagctagtaaggagtaagtctaaagggaatttatgataatctatacagtgtttcagaatggcaaaccactgtacagatg

SEQ ID NO: 17624 - DNA, 201 bp, Homo sapiens
agactgttccatccctagaggctaagggtccagacatgtataagtctcataaaaactttggatgatttcattaatctttttccttccactgtcaattccaytgtaggctttattcagcccagacaacattcttcagacctaccattaatcttattttttcccaaactattttcttgctttctcagcattctctgagcaaaa

SEQ ID NO: 17625 - DNA, 201 bp, Homo sapiens
aaatacaaatgttttgttcctgctaccactgtctggcaagtaaattcaattttagtttttcagtgttggtatttctaagaatatatatatatatatatatatattttttttttttttttttgagatggagtctcgctctgtcacccagtctggagtgcagtggcgcgatcttggctcgctgcaacctccgcctcctgggtt

SEQ ID NO: 17626 - DNA, 201 bp, Homo sapiens
atacaaatgttttgttcctgctaccactgtctggcaagtaaattcaattttagtttttcagtgttggtatttctaagaatatatatatatatatatatatwttttttttttttttttttgagatggagtctcgctctgtcacccagtctggagtgcagtggcgcgatcttggctcgctgcaacctccgcctcctgggttca

SEQ ID NO: 17627 - DNA, 201 bp, Homo sapiens
cccaaacaccaaaacaacaaaaaagaaaactcactgtattatcaaaaaaataaaataactttaaaattctttttatgatgtctatcttatttctggtcaattttttttttttttttttggatctctacactactgccattacttcgatcaaatgtcctttttaattctctgaccaatacacctggcagaaatgatcagtta

SEQ ID NO: 17628 - DNA, 201 bp, Homo sapiens
acataggagactccattttgttctgtactaagaaaaattcttctgccttgggatgctgttaatctataacctcacccccaaccccgtgctctctgaaacaygtgctgtgtcaactcagggttaaatggattaagggcggtgcaagatgtgctttgttaaacagatgcttgaaggcagcatgctcgttaagagtcatcacca

SEQ ID NO: 17629 - DNA, 201 bp, Homo sapiens
ttagcatcctcagtatcaccatgtaaaaagaacatttataaattttgattgtgggctggccgtggggactcacgcctgtaatcccagcactttgggaggcygaggcaagtggatcacttgagaccatgacttcaagaccagcctggccaacatggtgaaaccccttctctactaaagatacaaaaattagccaggtgtggt

SEQ ID NO: 17630 - DNA, 201 bp, Homo sapiens
aggcaggagaatcgcttgaacatgggaggcagaggtttcagtgaggtgagactgcactactacactccaccctgggtgacagagtgagaccctgtctctcaaaaaaaaaaaaaaaaaaaattttttttgtggtgaacagaagtcattcaaatcagaactccatgcaacttatttttagttgtctgtatagatggacactat

SEQ ID NO: 17631 - DNA, 201 bp, Homo sapiens
ggagcagaactgctgggtaataggtaagagaatttcaaccataaagtattatcaaattaatctccagataattataaattggtattatttataaaaatackgtgtgtgtgtgtgtgtgtgtgtgtgtacatagatacaaataaagcctacctgtaggagccacagtatgtagaacttgttactttgtaacaaaacaacaga

SEQ ID NO: 17632 - DNA, 201 bp, Homo sapiens
tgatttggattatttttttcctgccctaatatcaaattaatctccaaataattatgccaaataattataaattggtattatttcatcaccatagaaatggkgtgtgtgtgtgtataaatgtgtataaatagatacaaacctgagggatatgacacattgcagcaatgtgaagcaaggagaattttaaaaatcaccctcaat

SEQ ID NO: 17633 - DNA, 201 bp, Homo sapiens
aatgttcagttttgatgtctgttttgaggacctgaaacaaggcttttaatcaatgtattatacatcaaatttatactgttaacttctgattattcaaattwatattcatagagaaatgtccaaagttttacatctctcagaattctgtccccccacactcgccattaattatcatgcctagaagctttttagtaaaagcag

SEQ ID NO: 17634 - DNA, 201 bp, Homo sapiens
cataacaattatgtatgaaagaatgtatgtttataagtaaatacctaagtatgtgcactatatgcatatataggagagagactagaaatgataaaacaaatagagtaaagacttaaaatctatgaatccaggtaaggaatatacagaagttctttgtaccacttttgcaatctttaaagagaaaggttctattattcatat

SEQ ID NO: 17635 - DNA, 201 bp, Homo sapiens
ataacaattatgtatgaaagaatgtatgtttataagtaaatacctaagtatgtgcactatatgcatatataggagagagactagaaatgataaaacaaatagagtaaagacttaaaatctatgaatccaggtaaggaatatacagaagttctttgtaccacttttgcaatctttaaagagaaaggttctattattcatatt

SEQ ID NO: 17636 - DNA, 201 bp, Homo sapiens
taacaattatgtatgaaagaatgtatgtttataagtaaatacctaagtatgtgcactatatgcatatataggagagagactagaaatgataaaacaaatagagtaaagacttaaaatctatgaatccaggtaaggaatatacagaagttctttgtaccacttttgcaatctttaaagagaaaggttctattattcatatta

SEQ ID NO: 17637 - DNA, 201 bp, Homo sapiens
aacaattatgtatgaaagaatgtatgtttataagtaaatacctaagtatgtgcactatatgcatatataggagagagactagaaatgataaaacaaatagagtaaagacttaaaatctatgaatccaggtaaggaatatacagaagttctttgtaccacttttgcaatctttaaagagaaaggttctattattcatattaa

SEQ ID NO: 17638 - DNA, 201 bp, Homo sapiens
acaattatgtatgaaagaatgtatgtttataagtaaatacctaagtatgtgcactatatgcatatataggagagagactagaaatgataaaacaaatagagtaaagacttaaaatctatgaatccaggtaaggaatatacagaagttctttgtaccacttttgcaatctttaaagagaaaggttctattattcatattaaa

SEQ ID NO: 17639 - DNA, 201 bp, Homo sapiens
tgttgatggaacagctctgtattttggttgtggtggtagttatatgaatctatacatgtgataaaactgcaaagaataattgcacatatacgtacgcgcgygcgcgcgcgcgcgccacacacacacacacacacacacacacacacacaaaagtgcatgtaaaaactgacgaaatctgagtaaggtatgtagcctaattaa

SEQ ID NO: 17640 - DNA, 201 bp, Homo sapiens
gttgatggaacagctctgtattttggttgtggtggtagttatatgaatctatacatgtgataaaactgcaaagaataattgcacatatacgtacgcgcgtgcgcgcgcgcgcgccacacacacacacacacacacacacacacacacaaaagtgcatgtaaaaactgacgaaatctgagtaaggtatgtagcctaattaat

SEQ ID NO: 17641 - DNA, 201 bp, Homo sapiens
ttgatggaacagctctgtattttggttgtggtggtagttatatgaatctatacatgtgataaaactgcaaagaataattgcacatatacgtacgcgcgtgygcgcgcgcgcgccacacacacacacacacacacacacacacacacaaaagtgcatgtaaaaactgacgaaatctgagtaaggtatgtagcctaattaata

SEQ ID NO: 17642 - DNA, 201 bp, Homo sapiens
cagctctgtattttggttgtggtggtagttatatgaatctatacatgtgataaaactgcaaagaataattgcacatatacgtacgcgcgtgcgcgcgcgcrcgccacacacacacacacacacacacacacacacacaaaagtgcatgtaaaaactgacgaaatctgagtaaggtatgtagcctaattaatagtattgtcc

SEQ ID NO: 17643 - DNA, 201 bp, Homo sapiens
ctctgtattttggttgtggtggtagttatatgaatctatacatgtgataaaactgcaaagaataattgcacatatacgtacgcgcgtgcgcgcgcgcgcgccacacacacacacacacacacacacacacacacaaaagtgcatgtaaaaactgacgaaatctgagtaaggtatgtagcctaattaatagtattgtcccga

SEQ ID NO: 17644 - DNA, 201 bp, Homo sapiens
atataaataaaaatgttaaattacacagttaggaataaatttggatgtttttaatgtcatataattcttggcagtctaaaaagtaaaaaaataaaaaaataaaaaaaaaaaacctgtgatcctaggcaatacagagacattttacatcaaggctggcgcagtggctcatgcctgtaatcccagcactttgggaggctgagg

SEQ ID NO: 17645 - DNA, 201 bp, Homo sapiens
aaaaatgttaaattacacagttaggaataaatttggatgtttttaatgtcatataattcttggcagtctaaaaagtaaaaaaataaaaaaataaaaaaaawaaacctgtgatcctaggcaatacagagacattttacatcaaggctggcgcagtggctcatgcctgtaatcccagcactttgggaggctgaggcaggtgga

SEQ ID NO: 17646 - DNA, 201 bp, Homo sapiens
ataatttctatgtatggccaaattgtatatatcaaacacatccacatatatgcatgaatgtgagtacatctatgtgtgtgtgtgtgtgtgtgtgtgtgtawatatatatatatatgtatgtatgtatgtatatgcatgtgtcttattttattaaaaacatgtaccacccggaaaaaaaaattagcatgatgaaataggcac

SEQ ID NO: 17647 - DNA, 201 bp, Homo sapiens
tacttccatatatctcacataaacttcacgtgtgagcagcataacgaagtctgcttttagtgtgacaggaaaaaaatgttagtgcaagcataaaacattgaaaaaaaaaaacccttcaaatttatactcttagatcatcttctaatatggaaagataaagttttatggtgggaaagtaaatatgagaaaaacatgactttc

SEQ ID NO: 17648 - DNA, 201 bp, Homo sapiens
ttaagtgctttgtaaaaataaatttctcaaaattttcatcaaggattttgaaaaagtcaggaatgattaagttggaaaatgcagtttcttttctctttccttttttttttttaaaaaaacatgattttaaattatgatcaaatcttataaaactatgagaagagttgctggcccatctctagattaagaacaaactgaaat

SEQ ID NO: 17649 - DNA, 201 bp, Homo sapiens
aaatttctcaaaattttcatcaaggattttgaaaaagtcaggaatgattaagttggaaaatgcagtttcttttctctttccttttttttttttaaaaaaacatgattttaaattatgatcaaatcttataaaactatgagaagagttgctggcccatctctagattaagaacaaactgaaataaattagatttcatgtcca

SEQ ID NO: 17650 - DNA, 201 bp, Homo sapiens
tcactcataggtgggaattgaacaatgagaacacatggacacaggaaggggaacatgacacaccagggactgttatgggtgggggttggggggagggatarcattaggagatatacctaatgctaaatgacgagttaatgggtgcagcacaccaacatcgcacatgtatacaatgtaacaaacctgcacgttgtgcacatg

SEQ ID NO: 17651 - DNA, 201 bp, Homo sapiens
ttcgtatttttttggtggagacggggtttcgctgtgttggccgggctggtctccagctcctgaccgcgagtgatccaccagcctcggcctctggaggtgcygggattgcagacggtgtctggttcactcagtgctcaatggtgcccaggctggagtgcagtggcgtgatctcggctcgctacaacctccacctcccagccg

SEQ ID NO: 17652 - DNA, 201 bp, Homo sapiens
ctcggctcgctacaacctccacctcccagccgcctgccttggcctcccaaagtgcccagagtgcagcctctgcccggccgccaccccgtctaggaagtgaggagcgtctctgcctggccgcccatcgtctgggatgtgaagagcccctctgcctggctgcccagtctggaaagtgaggagcgtctctgcccggccgccatc

SEQ ID NO: 17653 - DNA, 201 bp, Homo sapiens
tctgcccggccgccaccccgtctaggaagtgaggagcgtctctgcctggccgcccatcgtctgggatgtgaagagcccctctgcctggctgcccagtctgraaagtgaggagcgtctctgcccggccgccatcccatctaggaagtgaggagcgcctcttcccggccgccatcccatctaggaagtgaggagcgtctctgc

SEQ ID NO: 17654 - DNA, 201 bp, Homo sapiens
ctttggagctcagttcacttcctcagacaggttttccctgaccatcctatgttagagtagtcttccttacatttcttcactgtttatttcttttcttttcttttttttttttttgagacagggtcttgctatgttgcccgggctggccttgaattcatgggttcaagtgatcctcccacctcagcctcccgagtagctgga

SEQ ID NO: 17655 - DNA, 201 bp, Homo sapiens
tgcaagtacagttaaacactgatttgccattcatatattaacaactatattttgctgtgctcaaaacaccatgtacataacttataattttaaataagtayaattttgaaatatctctattttactttttcaaaacagttaccaagaagttgtaatgcaacagatggctaaactctttgggagcttacctcttctattctt

SEQ ID NO: 17656 - DNA, 201 bp, Homo sapiens
tcagctgttgctcctttaacttccattgctcttcatgggcagcactgaaggcactgcaaaacacacgtgacatgcaaggaaagcttggaaatcagcttcarccgaaaataataaagagaaaagcttttagtggcacagagaccactgtcatcatgtcttaggaattaagtaaacatatgctggtctgctgctgttgaaacc

SEQ ID NO: 17657 - DNA, 201 bp, Homo sapiens
cacctccatctgaatagcttgcagttatttctaaatacaatataaaaaagcatgggccccagaacctctaggggtagggcccaggaaactacattttaaamgagttcctcaagtgattttcctacttgctaaagtctaaaaatcactgtaaggacatttcaagtagagggatcgctaggaataattagaaccagcttccta

SEQ ID NO: 17658 - DNA, 201 bp, Homo sapiens
gtaaactgttgccatattttgtaaacatgggatgtggagtttctgctacatctgcatcttggaattttatacctaaaaacaaagtaataaaatatgattayagaattgaagttagaaaagaaggatctttgatttgctataataaggatatttataataaaatctcttaagtattaagaggtatgtgttttatagtacaca

SEQ ID NO: 17659 - DNA, 201 bp, Homo sapiens
gcattaaataaaacacagcagcaagtattgctcattttacaaatctactgtagaaatcaaattacctagaaataattttattcaacttaagatttagactyctgcagtaatttctgaaataaatcagtcttctattcaagttttaacaatgtaaataggttataaaaacctgattttttccccagtgtttgtgataagggt

SEQ ID NO: 17660 - DNA, 201 bp, Homo sapiens
tattaagaggtatgtgttttatagtacacagaattataaatacactgccaaagggaatatgtgatctcagccaccagtaggcattaaataaaacacagcarcaagtattgctcattttacaaatctactgtagaaatcaaattacctagaaataattttattcaacttaagatttagactcctgcagtaatttctgaaata

SEQ ID NO: 17661 - DNA, 201 bp, Homo sapiens
aaaagcaattcttttggcatatacactaagctgagtatgagaaattttgagcaaccactgaattcatgagagtggatgactgtgtctgtccctcatacatygcggggatactggcaaacagtaggcaccagagtaagtactgactgattcaatgaagaaacattagatgtctgaaatgagtaaggcagtggttatttcaaa

SEQ ID NO: 17662 - DNA, 201 bp, Homo sapiens
tttttagagactgtgtctcactacgtcgcccaggctagactcaaactcctgggctcaagtaatcttcccacctcagcttctcgaggactttaggtgtacaycattgtgcctagcttgaacattatttttatttagtataaaagatcttgcagactttagagatcatcttgcccagttccagttccagatggcaaaactaag

SEQ ID NO: 17663 - DNA, 201 bp, Homo sapiens
gcagacaaataagactgaataggctactgaatcgcagcccaggacttgtccatgggaactgagctccatcctagacagccatggcgcagcttgctgactgkagggaagcagatgccatggccagtgctgtttattccctcgtcactcatgacctgggataaccctgggggactggtggctttgaagggggccctgaaagaa

SEQ ID NO: 17664 - DNA, 201 bp, Homo sapiens
ccatggcgcagcttgctgactggagggaagcagatgccatggccagtgctgtttattccctcgtcactcatgacctgggataaccctgggggactggtggytttgaagggggccctgaaagaagctgaagcaagtcaaacctgagtgattaccatcctgggaaaagtagagcctcagaaagctagtgaaagaatagtgata

SEQ ID NO: 17665 - DNA, 201 bp, Homo sapiens
ttctttcttctgaaaattatatacatgtattttctctactgaaccagaattgcaaggtatcctatttaaattagaaaaaaaatgccttcaaaaaataatamtgaaatgatggcttattaaacagtgatagtaagatacaaattagtctgaaaggctgatgagccattacaaacaataatattaatgtcactacttacaatg

SEQ ID NO: 17666 - DNA, 201 bp, Homo sapiens
ttctatttctggtatatgctctacctctggtgaaatttccttcctatcttcaggaggaggagaagtctccttatattaatgtgaaaacacgcatgtatgtyattttttatttattactaaatcccaaatcattctatcatatacatattgaactactaaaaattggcagcaaatgtaacagttactcatatgacactgaat

SEQ ID NO: 17667 - DNA, 201 bp, Homo sapiens
tcctttcctttaacttattaagatttatacttttcttcttcgtggggtgatggataagtttattatcctgatcatgatgatggtttcaccgttatatacakaggccaaccaaatatcaccaacgtgaatatctgccttgcttttctgtgaaactgctccagaaaaagccaacaataatcaattaattgctagacgcaatga

SEQ ID NO: 17668 - DNA, 201 bp, Homo sapiens
gagtattatgttaggtttcaaagcagggaagcgtgtatcttggaatcatggtagaaaggaggtttaggcagagcaaacagcaagaacaaaggcatggcagygggcctgagcatgacatatctgcaaagagcaggtggaggacctgtttggctgaggtgcacaggttgcttagaagagaaattaaaaagtggtagtaaattt

SEQ ID NO: 17669 - DNA, 201 bp, Homo sapiens
cttgagatatttataattcaatattttacttagggtgtgcatcaaggtctcttagggcagaaaatcgatgagttaaatagtgaagcagataaaagtaaaaygtttgttataattaaagaaagtgctttaaatgagagtttttgaggtctggtttaatgtaactttgatgtcattatgaaatatgtatatgctataactaaa

SEQ ID NO: 17670 - DNA, 201 bp, Homo sapiens
gatgtcattatgaaatatgtatatgctataactaaatgtcacctgatcactttcctgagtcttagtagtgttgacatgttacatacatatttgtaaaggaygtactaagtttcagaagatgcaagaataattcattctccaaatgtaagggttacagataagggtcatcattatgctgaaacagttgtatgcagacatgaa

SEQ ID NO: 17671 - DNA, 201 bp, Homo sapiens
taatggccaacaggtaggtataaatacaacttacgtagtatttagacaacagcagtaatgtactttaaacaataccttaagtaacaacgtggtataataaygttgtacttcaaataaaaagtcagtttgctgcagagtacacctttcctgggacaatgctaaacttgtaagtctttaataattacttttacgtatcagttt

SEQ ID NO: 17672 - DNA, 201 bp, Homo sapiens
tcaaagcaattaagggctttggataaccaaaagtttatgtcaagctgatgccaaaccaaactggtctattaaacacatactatgaagagtttctgtaatawtctatgaaaaggctctttgccataaatatcaagcactgccactctgaagattacaactacgttaggttcatgtttgagaacaaggagtccaacatccaga

SEQ ID NO: 17673 - DNA, 201 bp, Homo sapiens
agaatatttatatgtctttgttctttcatatatgcacatctgcttataacacccaaattaacacttcagagagagagggcaggaaatttgccaaatataamttagtggtctctggcatgcatttatctctatcatgtctggcagcatcacactgtaatgagtctcaggaaccggtataaacgttggcttttcaggtgatca

SEQ ID NO: 17674 - DNA, 201 bp, Homo sapiens
tgagatattccacttaaaaggcaaaacacttaaaatacggcctttcctcccatataaaatttaaacacaaagaaatgttttaacactgaatgtaatttaamccaggcaattcagtttggaggcttgatactctctatgtagtttctactgatgtgaggaattttaaaaagatgatttatgttaattctttatcagaacaga

SEQ ID NO: 17675 - DNA, 201 bp, Homo sapiens
ttgccatgaggcctaggtctcacccagggttcaactacttcaacatataggctctctagctaattctagtatttttgtagtttctattctttacagaaatrcaccatagtaactctattttgagtatggatgtgagtggtccacacaatatctagtatgcaaaaataaaggattttatattttcatttcaatctacctagt

SEQ ID NO: 17676 - DNA, 201 bp, Homo sapiens
gattttaaaaatgtcatatgctagcataggtatgtattccttaaaatcaatgtcatctttttatttcatcaaatatgaatttatagttagctattattccwgggttaacaaacgaatgtttagttttaaaatacagcttatgacttttactatttttaaaagtaaacatggccaatataggaaatgtaaaagataaatata

SEQ ID NO: 17677 - DNA, 201 bp, Homo sapiens
ggaaattataacaaaaaaagttttttaatgtcatagatgaaaaggcagcaaggagactatctacaggaccaactgtaatcttatcacagccaacagattgmaatccaaacttggaatattagggatctttttgggattacaaactggtaccatattatggaatttactatcttttaaggttgaaaaaagtaatgctggact

SEQ ID NO: 17678 - DNA, 201 bp, Homo sapiens
tgtgatccacctgccttgacctcccaaagtgctgggattataggcgtgagtcactgcgcccagcctagactcacttatttttagagactgtgtctcactaygtcgcccaggctagactcaaactcctgggctcaagtaatcttcccacctcagcttctcgaggactttaggtgtacaccattgtgcctagcttgaacatta

SEQ ID NO: 17679 - DNA, 201 bp, Homo sapiens
aagaatgtatgtttataagtaaatacctaagtatgtgcactatatgcatatataggagagagactagaaatgataaaacaaatagagtaaagacttaaaawctatgaatccaggtaaggaatatacagaagttctttgtaccacttttgcaatctttaaagagaaaggttctattattcatattaaatgatttgctaaagt

SEQ ID NO: 17680 - DNA, 201 bp, Homo sapiens
aacgcctactcacaaaataattataaagagtacagatcttggccttcaaggtggtacgaaggaatttttataacatgtataagatggagggattaagatgkagtggttaagggcattcattctgggctcaaattcctgctttcctactgcttagctgtgtgaccttagacaagttactttaacctctctcatctcagtttc

SEQ ID NO: 17681 - DNA, 201 bp, Homo sapiens
tcagccatgcatcagcttctgaagacatttctttttcataggccattttggatgtaaaggctcccctgtgaccagatctcaacttagagattattcctggycaaaagcatgcaatgggtgaaagatatcacgatagttctaaagccagttctccttaggctctgccaggaacaaacatcttttatgttgaaaatgtttccc

SEQ ID NO: 17682 - DNA, 201 bp, Homo sapiens
gagcaaatcccacacgaatagattaatgccctcactctgttagttcccttgagagctgattgttataaagaacctggcaactctcacctctctctctcctscttcctctcttgccatgtgatctacacatgctctagctccccttatccttatgccatgagtggaagcagcttgaggccctcaccaaatgcagatgccagt

SEQ ID NO: 17683 - DNA, 201 bp, Homo sapiens
cttgcagtgatttggattatttttttcctgccctaatatcaaattaatctccaaataattatgccaaataattataaattggtattatttcatcaccataraaatggtgtgtgtgtgtgtataaatgtgtataaatagatacaaacctgagggatatgacacattgcagcaatgtgaagcaaggagaattttaaaaatcac

SEQ ID NO: 17684 - DNA, 201 bp, Homo sapiens
caaatttatctaagtggttattttattaataatatattagctctacaatccccatatgaaaacttgcattattgtaagaaccaatttagactgtcaaatawgactacatgcaactctttaaagtttaaaatacaatcctagataaaactattcacttggatcctagccaaaacacagaaacaaaataacaaaaccccaaac

SEQ ID NO: 17685 - DNA, 201 bp, Homo sapiens
catgggaggcagaggtttcagtgaggtgagactgcactactacactccaccctgggtgacagagtgagaccctgtctctcaaaaaaaaaaaaaaaaaaaawtttttttgtggtgaacagaagtcattcaaatcagaactccatgcaacttatttttagttgtctgtatagatggacactatgtgttatgtgattaaatgat

SEQ ID NO: 17686 - DNA, 201 bp, Homo sapiens
tgttctgtattgcctgtattcctctctagaaggtaagctacagggggtagttttgtctgtcttatttaccactgaccaccatattcccagtgcctactaayagtgataacataaggtcttaaaaaattaataatttcataaatagcttatattattatttataatagttataactattaaaccataaataatttaaactat

SEQ ID NO: 17687 - DNA, 201 bp, Homo sapiens
tactaagtctctgtttttagctagcaataagaatttttttgtttgttgtgttttttttgagatggagtctcgctctgtcacccaggctggagtgaagtggygcaatcttggctcactgcaacctctgcctcctgggttcaagcaattctcctgcctcagcctcccgagtagctgggattacaggtgcccgccaccacatct

SEQ ID NO: 17688 - DNA, 201 bp, Homo sapiens
aagacgtctgaggattgactgcagaggcacgacgatatttaaacatatgatcaaggagcatgagaagtataacagtaaagttggaggcaagctaggaaggyatggtgtcccagaggccaagagaagagaggcccatatttcactgtcaaatgctcctgggagatgaagacaggcactgagaattgactactgtatatggca

SEQ ID NO: 17689 - DNA, 201 bp, Homo sapiens
ctaagctatgctgacctatggttaaaagtgaaacaaaaagaaaaaaagaaacaaaacttagctgaaacatcagtggctatacacagcagaggaaatagatkctacagaaatagtccaggcaagtcaccaagcaaaaatagcaacaataaccacctaggaaatgacgttacaatatattatccaaaaatgtccagttttcta

SEQ ID NO: 17690 - DNA, 201 bp, Homo sapiens
ctggtggtgggggttctacacattgagaaacattgtttggcccaacattcatttgccaaatttttaaatgggatcaggagctagtgaacacttttgggttraataccgtgggaaacaggaacactttggctgcctctgattatgtcatgatatcctatgactaaccatggttcatttagtattctaaaaccctagatggtt

SEQ ID NO: 17691 - DNA, 201 bp, Homo sapiens
ccacacctggcctttttaaatttcttaatctattctggtacaaataagtgggtcctctgaggaaaggcaggtctaacacaaaagcagaacttgattttaarttttttaaataaacacttttggggtaaaaaaatgttgtctcccaatatgatctcacatttcagaaacaaagcgaacacagaggcagacaaataagactga

SEQ ID NO: 17692 - DNA, 201 bp, Homo sapiens
acttttctctttttttgagacagggtcttgctctctcacccaggttggagtacagtggcacaaccattgctcactgcaagctcgaactcctgggctcaagyggtccttcctcctcaaccttcatagtagctgggactactggtgcatgccaccatgcctggctaattttttcttttttaatttttagtagagatggggagt

SEQ ID NO: 17693 - DNA, 201 bp, Homo sapiens
gagtctgctctcttaacctccatgttacataacctctcctccttccatatgaagccaaagttttcctgtttaagctgtagttattttgttaacacaagacyagaaggtaagagaatgttccataacaatatcaagggaagtcacctcattttcttttgtttcataaaggaataattgcttagatatacctagtctaggtgt

SEQ ID NO: 17694 - DNA, 201 bp, Homo sapiens
gagtacttctggtgaacagtctctattttaaattctatgactacactgtttttctgtaaataatactttatcgtacaaaaatttatcatttctgttttgayatcacttattaggcagcaacaaaattgcaacttcagttttaatatagcctaagccaggaaaaaggggagaaaaatatcaaaagaagaaaagcgctcttaa

SEQ ID NO: 17695 - DNA, 201 bp, Homo sapiens
atagcacactggccaccttgaactcctggcctcaagccatccgcctactcagcctccggagtagctgggactacaggcaccggctcaaacctaaatttcargcattagcttttgcttaagagtatcctttactttgctctcaagtgttgatactccttttaatggctggctggaaaaaaaaaaaacctcccaaactctaga

SEQ ID NO: 17696 - DNA, 201 bp, Homo sapiens
agactttcagccatgcatcagcttctgaagacatttctttttcataggccattttggatgtaaaggctcccctgtgaccagatctcaacttagagattatwcctggccaaaagcatgcaatgggtgaaagatatcacgatagttctaaagccagttctccttaggctctgccaggaacaaacatcttttatgttgaaaatg

SEQ ID NO: 17697 - DNA, 201 bp, Homo sapiens
caaaaaagattcatcttccatccatggagacttctaacatctttatagaaaagctttcacaatattcatgttaaacagttcttttgctattattcaacatkttagtacagaattagctaactacttccttttttgagtcaatcgatgctcaccattaaaaataatccaacaatataaattaccaaatgtcaaatatgaaag

SEQ ID NO: 17698 - DNA, 201 bp, Homo sapiens
ctactgtgtgaagtcttgcctgaatcttgaggtagaaataggcattctctcctcaatgtttccttgatacctttagattttcttagctttacactcttcayagtaaaacataaccatttatttacttgtcaacatcttaggagttccatgagggtagtgcctcagtttttcctatttgtattctccctgcccagcactttg

SEQ ID NO: 17699 - DNA, 201 bp, Homo sapiens
atagattggatgctgttattgtaattaataaatatataataataatgataaaactttggacagataaaatgttctatttgtatttatcaagaacagaaacratgggtatctctatttcatggaggaatctgtgacaacaactgaaatgttctgttctattgttttgctttatttctttattttttgagagacagaatctca

SEQ ID NO: 17700 - DNA, 201 bp, Homo sapiens
agactttcttggtcctggtagtctttaaaagggttcaggttaatatttcaatcctctcatctttttctctgtgccaaagttgtgaccaactgccacgtggktagaaatgtatagtttataaagatttcccagaagaagtttttaatttggttatttggtctaatttggttaattatctggcttgagcctgacttttcagca

SEQ ID NO: 17701 - DNA, 201 bp, Homo sapiens
cctaggtgggcagatcacttgagcccaggagttcgagaccagcctgggcaacatgatgaaaccctgtctctataaaaaataccaaaaaaattagccgggcrtggtgatgcacgcctgtagtcccagatacctgggaggctgaggtgggagaattgcttgagcctaggaagtcgaggctgcagtgagccaagactgcactcc

SEQ ID NO: 17702 - DNA, 201 bp, Homo sapiens
gtagtcccagatacctgggaggctgaggtgggagaattgcttgagcctaggaagtcgaggctgcagtgagccaagactgcactccaacttgggtgacagarcaaaactctgtctcagaaaaaaaaaaaatccaatggccaactttttttcacgccttcactcaatactaacaaatgaataattccttgtgaagctaaatta

SEQ ID NO: 17703 - DNA, 201 bp, Homo sapiens
actcttttgatatgtcttggcagcatagcttaaaccatagatgcttgtaaactttaccattttaaacttttcaaaatgtatccatcccaaatcagaaacaraacaagaaacataaaaatctacatctctgagaaatcatgccttgaaaaacacaaataaaatcctttccaaatgcttataggtaaacatgacaatacattt

SEQ ID NO: 17704 - DNA, 201 bp, Homo sapiens
tgcttgtaaactttaccattttaaacttttcaaaatgtatccatcccaaatcagaaacaaaacaagaaacataaaaatctacatctctgagaaatcatgcyttgaaaaacacaaataaaatcctttccaaatgcttataggtaaacatgacaatacatttaaccaacttgctgaaagtaagtattctatattgaattcctt

SEQ ID NO: 17705 - DNA, 201 bp, Homo sapiens
ttaatttttagtagagatggggagtctcactatgttgctcaggccagtctctaacttctgggcaccagggatccttttgccttggcctcccaaagtgctgrgattacaggtatgagccaccacacctggcctttttaaatttcttaatctattctggtacaaataagtgggtcctctgaggaaaggcaggtctaacacaaa

SEQ ID NO: 17706 - DNA, 201 bp, Homo sapiens
gtggaggttgcagtaagccaagattgtgccactgcactccagcctgggcaatagcaccagaccttgcatcacaaaaaaaaaaaaaaaaaaaaaaaaaagcwcaactaacaaaacaccccaaacagacctagaggtaaccatgtgagaatgcacaaaatttgggccacttgagcatatatcacagtttgagctaaagaaaga

SEQ ID NO: 17707 - DNA, 201 bp, Homo sapiens
aaacctaataaatcaaatgactgccaaatgtcattaaagtgatggtctttgacttgaatatgcttttcatattcaaatttgaaaagaaagagatgaaagcytggaaaggttactcggtttcaactaataacctcaagccctctccgttcacgtgcataaaaaatgaagttggctctattgtctaatctcacttcagaaaac

SEQ ID NO: 17708 - DNA, 201 bp, Homo sapiens
cccgtctctactaaaaatacaaaaaatcaatcgggtgtggtggcgggcacctgtagtcccagctactcgggaggctgaggcaggggaatggcgtgaacccrgggggcggagcttgcagtgagccgagattgcgttactgcactccagcctggcagacagagcaagactccgtctcaaaaaaaaaaaaaaaaaaaaaaaaaa

SEQ ID NO: 17709 - DNA, 201 bp, Homo sapiens
gtcccagctacctgggaggctgaggttggaggattgcttgagcctgagaggttggggctgtagggagccatgatcttgccactgcactctatgcactgtarcctgggtgacagggtgagaccctgtctcaaaacaaagaaacaaacaaaaaaaccactcaatgattcactgaattgttgaaagcatatatttcagacattg

SEQ ID NO: 17710 - DNA, 201 bp, Homo sapiens
gctgaagtgcagtggcaagatgacaactcactgcagcctcaatctcccaggctcgagtgatcctcccatctcagccccctgagtagctgggactagaggascatgccaacatacccagatattttttaaattttttgtagagacggggtttcactatgttgcccggactggtctcaaactcctggcctcaagcaatcctcc

SEQ ID NO: 17711 - DNA, 201 bp, Homo sapiens
cctgcctcagcctgccgagtgcctgggattgcaggcgtgcgccaccacgcctgactggtttttgtatttttggtggagacagggtttggccgtgttggccrggctggtatccagctcctgacctcgagtgatctgcccaccttggcctccccaggtgccgggattgcagacggagtctcgctcactcagtgctcaatgttg

SEQ ID NO: 17712 - DNA, 201 bp, Homo sapiens
tcaaaaaaaaaaaaaaaaaaaattttttttgtggtgaacagaagtcattcaaatcagaactccatgcaacttatttttagttgtctgtatagatggacacyatgtgttatgtgattaaatgatctagaaatgtgatgacagcttgtattgctctaaaaaaataaattatagctctcgtgattttggctcaattccactatt

SEQ ID NO: 17713 - DNA, 201 bp, Homo sapiens
caaatcagaactccatgcaacttatttttagttgtctgtatagatggacactatgtgttatgtgattaaatgatctagaaatgtgatgacagcttgtattrctctaaaaaaataaattatagctctcgtgattttggctcaattccactattgcttcctgactgatgataattcatactttggatcatatttttctatgtg

SEQ ID NO: 17714 - DNA, 201 bp, Homo sapiens
tgaatgaaaggcagccttatttcagaacatttctagttggcatcaagttactgacctgtttgatattcttggagataggacctggaataatacagtcatcrctgtcagaagctgacatgtcctcttcaactgtttaaaaaataaaagggtaacatttacacaagttaaaccaattctacttataccctgtaaaataaagag

SEQ ID NO: 17715 - DNA, 201 bp, Homo sapiens
taactgaaaaaataatggcagtaaactccccaaatgtggtgcataacattacactacacacaggaagctcaataaattctaagtaggataaatgcaaaagratccacatttagacacatcagtagaactgttgaaagccaaaacaaatagaaaaacctggaaaacaacatcaagtatgagagaaccacaataaaattaaca

SEQ ID NO: 17716 - DNA, 201 bp, Homo sapiens
atatagtaatataggcctaaagtttaaagactgagaagaggttagggtgattagttataaacgaatcatatccataacactaaggtataattttgttttgkttttacaattttatagattcaaaaacataggcttacctgagatacacctgtcatgtgccaacgaaatcagaggcacattgacttttcctatgtaaatatt

SEQ ID NO: 17717 - DNA, 201 bp, Homo sapiens
tatgtttgttcattactctctttcttcagactcattgtgttaccttcgctgtttaacatggtagatgatggctgcctacagcccccaattttacgtgtccwgatatgtcttgctttctcctgatctcagagggcagaatctgattggctcaactggggtcaagtgggtattcccaaatcattagttataatagggtgggga

SEQ ID NO: 17718 - DNA, 201 bp, Homo sapiens
ctgtattttggttgtggtggtagttatatgaatctatacatgtgataaaactgcaaagaataattgcacatatacgtacgcgcgtgcgcgcgcgcgcgccrcacacacacacacacacacacacacacacacaaaagtgcatgtaaaaactgacgaaatctgagtaaggtatgtagcctaattaatagtattgtcccgatt

SEQ ID NO: 17719 - DNA, 201 bp, Homo sapiens
ctcctggcctcaagtgcttcacctgcctcggcctcccaaagtgctgggattaaaggagtgagccactgtgctcggcatcagtgacgtttaagatagtccarttaactgtgggtaaagaatgttgtccttgctctaaaggcacctttaatatacaagaaaagatagtaatgtagagtaccataacgatatataaaccaaatt

SEQ ID NO: 17720 - DNA, 201 bp, Homo sapiens
gtaagtgctgagctagtttttttcaacatgtagtcttgcacctccatctgaatagcttgcagttatttctaaatacaatataaaaaagcatgggccccagracctctaggggtagggcccaggaaactacattttaaaagagttcctcaagtgattttcctacttgctaaagtctaaaaatcactgtaaggacatttcaag

SEQ ID NO: 17721 - DNA, 201 bp, Homo sapiens
cacctgatcactttcctgagtcttagtagtgttgacatgttacatacatatttgtaaaggatgtactaagtttcagaagatgcaagaataattcattctcyaaatgtaagggttacagataagggtcatcattatgctgaaacagttgtatgcagacatgaaaatcacgatgaagttcagaaccttacctttataagtagg

SEQ ID NO: 17722 - DNA, 201 bp, Homo sapiens
attagctgggcatgcttgtagtcccatctacttgggaggctgaggtgggaggatctgttgagcctggggagttgaggctgcagtgagccatgattgtgccwctgcattccagcctgggcgacagagcaagactctgtccccccaaaataaataaattcatatgtgttctttattcactgagttcatgctactaatcagtcg

SEQ ID NO: 17723 - DNA, 201 bp, Homo sapiens
gcgaacaaatccacagtatttgataatctcacgtacttaagtgtactctttgctagagctcactgtcacactcaggtatcctcctttgttgactccctgtrgactaactctaagccatgtcatctaaagtatctctaccaatttcatcctgctctcaaccatttatgtttatcataagtcttcaatttatgttgtacattt

SEQ ID NO: 17724 - DNA, 201 bp, Homo sapiens
acaagaattagctgggcatggtggtgcatgcctgtagtcccagctactcaggaggctgagacaggataagaattgcttgaacctgggaggcggaggttgtrgtgagccgagatcgcaccactgcactccagcctgggcaacagagcgacactccatttcaaaaaaaaaaaaaaagaatatccaaatgtgaacaatacttaa

SEQ ID NO: 17725 - DNA, 201 bp, Homo sapiens
tctttaaaaagtactgaaatgctatagttcaaagaggaaatatacttgctgaattataataggcaaaatcaaagcactctgtacaagatgaaaaataaccyccttaccttatgatttgacaaaaagcaggtcaagctaaacagcattttattcaaatgagataacatttcactcttttaaaattatgttcttccagcacac

SEQ ID NO: 17726 - DNA, 201 bp, Homo sapiens
caatatagcaaaaaaagcacattgtaaaactacatctatcatttagaaataactctgaaaggacataaatcaaatattagcagtgattattttgctaataytttgtgggttgtgggattgatttttctaatttacatactggactttttcataatgtacatgagttatgtttattattaaaaaaaattcccaaatgataaa

SEQ ID NO: 17727 - DNA, 201 bp, Homo sapiens
aaaatatgaaaagataatgttccttatagtcagtgaaatatggcattgtggtctaaataaaaacataagaatactaactagaaacgtaactgttttttagkgagtatgtattaaacttttaaacattctcatgcaactgaattgcaagttttcaaaagcagcaaccttcttagcacatgactcggtttatctagggcatga

SEQ ID NO: 17728 - DNA, 201 bp, Homo sapiens
ttttcagaaataaacggagtaataattacatccctatggctaaaatgtagatttctgtactctagtatttatttttaagttttattcataagtatattttrcagtcacaactttttcctgtggatcagattactctttatttccattttcagaattctcttttgatgctagtatgagacagtaaaagattctcccaagatc

SEQ ID NO: 17729 - DNA, 201 bp, Homo sapiens
agttcacttttaggaaaaataaatgtaaaaaatttaaaatcagagttcaatatttaaagtaagagattttacttttaaaacttatctagtgtacacatatkggaaaaattgtcataatgccctactggaaccagaaaatggactacaaagctcacacatctgtaaaccagctgaggacttgaaatacttaattttcctctt

SEQ ID NO: 17730 - DNA, 201 bp, Homo sapiens
cccaggctggagtgtagtggcgcgatctcggctactgcaacctccgcctcctggtttcaagcgattctcctgcctcagcttcctgagtagcagggactacmggcgcgtgccaccatgcacagctgatttttttgtatttttagtagagacgggttttcactgtgttagccaggatggtttcgatctcctgacctcataatc

SEQ ID NO: 17731 - DNA, 201 bp, Homo sapiens
ttttgtatttttagtagagacgggttttcactgtgttagccaggatggtttcgatctcctgacctcataatccacccgcctcggcctcccaaagtgctggrattacaggtgtgagccactgtacccggccgcagtatgttgatacttttaagaaaattaagatatatttgaataataaccattaattacagtaacacaatt

SEQ ID NO: 17732 - DNA, 201 bp, Homo sapiens
aaggatttaaatgtaaaacccgaaactacaaaaactctagaagaaaacctaggtgatatccagttagaatggtgatcactaaaaattcaggaaacaacagrtgctggagaggatgtggagaaataggaacacttttacactgttggtgggactggaaactagttcaaccattgtggaagtcagtgtggcaattcctcaggg

SEQ ID NO: 17733 - DNA, 201 bp, Homo sapiens
ctataaggaacttaaacaaatttacaagaaaaaaaagccaaacaaccccattacaaagtgggcaaaggacatgaacagacacttctcaaaagaagacatcwtgtggccaaaaaaacataaaaaaaaagctcaacatcactgatcattagagaaatgcaagccaaaaccacaatgagataccatctcacaccagtgagactg

SEQ ID NO: 17734 - DNA, 201 bp, Homo sapiens
aagccctttcatcctgcagctgcctcctgcctgtgtggaggccttattgacttcaaaggaactctatctagggaaaagatagtgctaacattttggcttcragagcgaactacaacaaatttttctccctttctgttcatagtggtttttcgtttttttttttttaattcctcaaagaattgaaactaaagttttacatgc

SEQ ID NO: 17735 - DNA, 201 bp, Homo sapiens
taattccgagaatgatatatcactgggaaatttggccaggtatcacagtccaagagggccacacactctacctggccctttaatgagtttagggtcctaakccccacccaatggcctgtgcacaaaagtaaggttgtcatatgaatgagacgtcaacctaaatatctgaattttctgttacagagagactttcacacagag

SEQ ID NO: 17736 - DNA, 201 bp, Homo sapiens
cccaatggcctgtgcacaaaagtaaggttgtcatatgaatgagacgtcaacctaaatatctgaattttctgttacagagagactttcacacagagatgtakattacattcaaaagaaagacacagatttaatataaaaaggcagttaacacccaggtaaaaataaatgaccctaatttttaaggcagggtatctttaaatt

SEQ ID NO: 17737 - DNA, 201 bp, Homo sapiens
aatctccctctccctctccctctccctctccccacggtctccctctccccacggtctccctctccctctccctctctttccacggtctccctctgatgccragccgaagctggactgtgctgctgccatctcggctcactgcaacctccctgcctgattctcctgcctcagcctgccgagtgcctgcgattgcaggcgcac

SEQ ID NO: 17738 - DNA, 201 bp, Homo sapiens
ccctctccctctccctctccctctccccacggtctccctctccccacggtctccctctccctctccctctctttccacggtctccctctgatgccaagccraagctggactgtgctgctgccatctcggctcactgcaacctccctgcctgattctcctgcctcagcctgccgagtgcctgcgattgcaggcgcacgccgc

SEQ ID NO: 17739 - DNA, 201 bp, Homo sapiens
tttctgtgtagccaaattttatctttttcaataaacaatacattgaccacttttctggttttcacagtggccatttacactgttctgattgaaaagtgtaygtagattcctaaatggaatgtatcttaaatccctagccttctcaggctagagggggattttacgttttctatgagctgttgataatcgatacatgcatga

SEQ ID NO: 17740 - DNA, 201 bp, Homo sapiens
taaaaataaatttctcaaaattttcatcaaggattttgaaaaagtcaggaatgattaagttggaaaatgcagtttcttttctctttccttttttttttttwaaaaaacatgattttaaattatgatcaaatcttataaaactatgagaagagttgctggcccatctctagattaagaacaaactgaaataaattagatttc

SEQ ID NO: 17741 - DNA, 201 bp, Homo sapiens
agccaccatctcctgatctcttatctaagctggattattaccactccattttatagatggggaaaatgaggctgaggtcagtattatcttccatgtaaaamagttactcagtggcagaatgtactttctaatttataattcattatgcttactttagttgtattcagagtctactgccaatctcacatagctaggagtagc

SEQ ID NO: 17742 - DNA, 201 bp, Homo sapiens
gtaaaaataaatttctcaaaattttcatcaaggattttgaaaaagtcaggaatgattaagttggaaaatgcagtttcttttctctttcctttttttttttwaaaaaaacatgattttaaattatgatcaaatcttataaaactatgagaagagttgctggcccatctctagattaagaacaaactgaaataaattagattt

SEQ ID NO: 17743 - DNA, 201 bp, Homo sapiens
taaatttctcaaaattttcatcaaggattttgaaaaagtcaggaatgattaagttggaaaatgcagtttcttttctctttccttttttttttttaaaaaamcatgattttaaattatgatcaaatcttataaaactatgagaagagttgctggcccatctctagattaagaacaaactgaaataaattagatttcatgtcc

SEQ ID NO: 17744 - DNA, 201 bp, Homo sapiens
ttcttttctctttccttttttttttttaaaaaaacatgattttaaattatgatcaaatcttataaaactatgagaagagttgctggcccatctctagattragaacaaactgaaataaattagatttcatgtccaaaaaaaagtaatccagctcaacaacctgtgtgccaagtttctctcatataatttgaaacagtcaag

SEQ ID NO: 17745 - DNA, 201 bp, Homo sapiens
tcctgaatttttgagataaaaatgtcatagtatttaacgtcatttagaagagaaggctttaaaacacaaaagctaggctatgagattcggggaagtagttmggtcaaatatttacgacacagaatggagagactgttttgagtaatagttacaggctgaccaaatttggggcataaggttgaaaacaaccttagggttaaa

SEQ ID NO: 17746 - DNA, 201 bp, Homo sapiens
aaaaagtcactatcatgtgagatattccacttaaaaggcaaaacacttaaaatacggcctttcctcccatataaaatttaaacacaaagaaatgttttaayactgaatgtaatttaaaccaggcaattcagtttggaggcttgatactctctatgtagtttctactgatgtgaggaattttaaaaagatgatttatgttaa

SEQ ID NO: 17747 - DNA, 201 bp, Homo sapiens
tagctgtgtgaccttagacaagttactttaacctctctcatctcagtttccttaccagtggaatggggataattatacttatcttacagggctcttgtgargatcaaatgagatgatacaagtgaacagttgcctggaacacagtaagcactgagtaaatgtttgctcttctttttagtagtatttttaatatagatagag

SEQ ID NO: 17748 - DNA, 201 bp, Homo sapiens
ttacctgctgatgaacaattatgttgtttaccattttttgctattacaatgctgcattaaatatccttttatgttacattgtttacaattttttgctattrcaaacaatgttgcattaaatatccttttatgttttcttgtatacatgcatgattcccttaggagcagaactgctgggtaataggtaagagaatttcaacc

SEQ ID NO: 17749 - DNA, 201 bp, Homo sapiens
caaagcattaaaatcccaacctcacttatacctaatcttttggctctttcccaaaacatggccacaatagctgattatgtcagatcagtgggtcatatgcsgtctctcagaagaagatgggttgctaaacagccatttggaaaaaatacgaagaatataaagcaaagataattttggtatttttgtcagactttcttggtc

SEQ ID NO: 17750 - DNA, 201 bp, Homo sapiens
tgtcagactttcttggtcctggtagtctttaaaagggttcaggttaatatttcaatcctctcatctttttctctgtgccaaagttgtgaccaactgccacrtggttagaaatgtatagtttataaagatttcccagaagaagtttttaatttggttatttggtctaatttggttaattatctggcttgagcctgacttttc

SEQ ID NO: 17751 - DNA, 201 bp, Homo sapiens
ctcctcacaaaatcctggtgggaaataaaggatcaaagctacttccttgctttgactgtatcactacattgcaacactgaattaaagagaagccttgagaragacattatcaggatcactcagaataacatgcttaaggttaagtaccttaacagaaataaggcttccataaacattaacagaataacatcctgaaggtta

SEQ ID NO: 17752 - DNA, 201 bp, Homo sapiens
tgaattcatttctaatagattactggttttcttgctgctatcaaatgattgattcattaaaaacataactgttaacataccaattagacaataaaataccmtgcagtaaagggaaaaaacaaaccaaaatgcacaaccaggctgggcatggtggctcgcacctgtaataccagcactttgggaggctgaggcaggtggatc

SEQ ID NO: 17753 - DNA, 201 bp, Homo sapiens
gaatagatgatcctgttattagcaataaaccttggagactgagcatacatgtagcgattggtgctaaaatcaaataaaaccaagaaaaatgttaatctgaygttcttcaattctgttagataactaaagactatagtgagcaatgggtagatagacgaatgtcctaactaaaatacattcacccgcccacccagagtaatg

SEQ ID NO: 17754 - DNA, 201 bp, Homo sapiens
ctttcttaagtttgggaatcagtgtgatattagtcacgcttctttaactgaaagtcatagaaactaattctatttagcaaaaacaacaaaaaagggacttyaaggttacaggcatatttcacggaatacatagtagaaatatggctggaccttcggaaggcagtggcctagaaaccagcagaatgtcctctccatctgatc

SEQ ID NO: 17755 - DNA, 201 bp, Homo sapiens
tcatagaaactaattctatttagcaaaaacaacaaaaaagggactttaaggttacaggcatatttcacggaatacatagtagaaatatggctggaccttcrgaaggcagtggcctagaaaccagcagaatgtcctctccatctgatctccatttttttctgtatgtttgttcattactctctttcttcagactcattgtgt

SEQ ID NO: 17756 - DNA, 201 bp, Homo sapiens
caacagcagtaatgtactttaaacaataccttaagtaacaacgtggtataataatgttgtacttcaaataaaaagtcagtttgctgcagagtacacctttyctgggacaatgctaaacttgtaagtctttaataattacttttacgtatcagttttagggactttattattatgactttatttttttttcatgtaacaatg

SEQ ID NO: 17757 - DNA, 201 bp, Homo sapiens
aaggctcgcagacagaaacagtagttgaaaagatgaaaatagttctacagaagtccaaagttcactggcatcttgggtatctaaagaataaaccttgtcaygtgtgcatggagatgtgcatttgagacgtaccgcatggacctgtacatattgtttgtggagctaaaactaataagctaatcctgaagtttacctagtgaa

SEQ ID NO: 17758 - DNA, 201 bp, Homo sapiens
ctaaagccagttctccttaggctctgccaggaacaaacatcttttatgttgaaaatgtttccctgaacaattttagttcaattccaaattatgatgctatyaactcatttgtttggctcagttgagcaaatattaactgagggccaaaggcactgagtaggcacaaggcgggagagacataaaggtggcgggagagacata

SEQ ID NO: 17759 - DNA, 201 bp, Homo sapiens
ccatttctagactatctcacaagcataagggaaaatgtcatagctatgccaaatacatgtcccatgcagtacacccttgcacgatgtttgccctgcacacyctcagtactcctctcaactcaggcagctcttcatctctcttccatggggaagactttctgtgtggctcccaggagagtagagccctgtgcctccttcatg

SEQ ID NO: 17760 - DNA, 201 bp, Homo sapiens
tcatctctcttccatggggaagactttctgtgtggctcccaggagagtagagccctgtgcctccttcatggacatcgtatgtccttgttagggcactgacktctttggcccgtctgtttaccagcctatttctctaatacgccataagtttcttgagagcaagggccataatttccaccaatatactcctactacagggac

SEQ ID NO: 17761 - DNA, 201 bp, Homo sapiens
ctttcccttaggacaatgatactgttgagggagaacagtcaatggggccatccactcccatggttgttcgaggagtgcatggccagcactgaaacactcayccatggttggaagccctgagccagtcacttggcacctgcaatacctctctatctttctcaaaaatgacatgaacatttgtttctttggggggtgtttgca

SEQ ID NO: 17762 - DNA, 201 bp, Homo sapiens
ggtgaaaccccatctctactaaaaatacaaacaattagctggacgtggtggcgggtgcctgtagtcccagctacttgggaggctgaggcaggagaatggcrtgaacccgggaggcagagcttacaatgagccaagattatgccactacactccaacctgggtgacagagcgagactttgtctcaaaaaaaaaaaaaagatg

SEQ ID NO: 17763 - DNA, 201 bp, Homo sapiens
ccttaccaattcatgcatttttatttctgtagctctttgtgatgtatagagttaggcagccaaaggacacagggaaatgggagctgggagctgggaagggwcggggcatattgagagatcctagagagcccatgctcagatgctttcaggtaaaatcgggccagtgaaagctggggcctggagggaagttactggaggttc

SEQ ID NO: 17764 - DNA, 201 bp, Homo sapiens; identical to SEQ ID NO: 1906

SEQ ID NO: 17765 - DNA, 201 bp, Homo sapiens
atgtatagagttaggcagccaaaggacacagggaaatgggagctgggagctgggaagggacggggcatattgagagatcctagagagcccatgctcagatsctttcaggtaaaatcgggccagtgaaagctggggcctggagggaagttactggaggttctggttcgtcttttgtttcttatatttagaaagcctaagtca

SEQ ID NO: 17766 - DNA, 201 bp, Homo sapiens
gacggggcatattgagagatcctagagagcccatgctcagatgctttcaggtaaaatcgggccagtgaaagctggggcctggagggaagttactggaggtyctggttcgtcttttgtttcttatatttagaaagcctaagtcagaggtttgtggttttgttgtgactgtggttatttttaaaccatgcttgcttctcagca

SEQ ID NO: 17767 - DNA, 201 bp, Homo sapiens
agagggagaatcttgagctataagtgcttaaaatttagtttggtaagatccctggtgcattgatatgtcaaagccttctgccctccaaaaaaaaaaaaaaragagagagagatagtgtcatcagacttgcaaggtggtttccggtttcgttgaggcaaatacatccaacaatacatccaacatcacctgtcatcctgcagg

SEQ ID NO: 17768 - DNA, 201 bp, Homo sapiens
tttttttttttttttttaagtagagatggggtttcaccctgttggtcaggctggtctcgaacttctgacctcgtgatccgcccacctcggcctcccaaagygctgggattacaggcatgagccactgcgcccagccatacctggctagtttcttaaaacattttcttgtagagatggggtcttactatgttggacaggctg

SEQ ID NO: 17769 - DNA, 201 bp, Homo sapiens
tctcacagattctgtttcagtttcccctcaagagggatcttgatagggttccatcagtttcactttcctttcccctttcataaaagcacagacctaacagyaccctgggtggaaacctcttcagcatttgcttggaatcagtaagctaaaaacaaaatcaaccgggaccccagcttttcagaactgcagggaaacagccat

SEQ ID NO: 17770 - DNA, 201 bp, Homo sapiens
catgaggtaaatagtccctgcttctctgataggaaacagaatttcttatgtacaacttcctgacttatgctatttcagtgtttgcttagagatgaaatatrcatttatctaattcaagcataaatctgccttaccaattcatgcatttttatttctgtagctctttgtgatgtatagagttaggcagccaaaggacacagg

SEQ ID NO: 17771 - DNA, 201 bp, Homo sapiens
gtttgcttagagatgaaatatgcatttatctaattcaagcataaatctgccttaccaattcatgcatttttatttctgtagctctttgtgatgtatagagwtaggcagccaaaggacacagggaaatgggagctgggagctgggaagggacggggcatattgagagatcctagagagcccatgctcagatgctttcaggta

SEQ ID NO: 17772 - DNA, 201 bp, Homo sapiens; identical to SEQ ID NO: 1903

SEQ ID NO: 17773 - DNA, 201 bp, Homo sapiens; identical to SEQ ID NO: 1907

SEQ ID NO: 17774 - DNA, 201 bp, Homo sapiens; identical to SEQ ID NO: 1899

SEQ ID NO: 17775 - DNA, 201 bp, Homo sapiens; identical to SEQ ID NO: 1901

SEQ ID NO: 17776 - DNA, 201 bp, Homo sapiens
tgccctactctcccacccctttatatagttccttcagtatttacttgaggcagacaggaagacttctgaagaacaaatcagcctggtcaccagcttttcgsaacagcagagacacagagggcagtcatgaggtcagtgaaataagaatgcataatcatgcttgtttttgagtgcaaattgtaagttgagtttcttactgtg

SEQ ID NO: 17777 - DNA, 201 bp, Homo sapiens
tagtttcactttccagtttcctcttccttcccctaaaagcaattactcaaaaacggagaaaacatcagctgatgcgtgccctactctcccacccctttatrtagttccttcagtatttacttgaggcagacaggaagacttctgaagaacaaatcagcctggtcaccagcttttcggaacagcagagacacagagggcagt

SEQ ID NO: 17778 - DNA, 201 bp, Homo sapiens
agcatttgtaagatgtttgaggggtttttccctgtggctttttttggtgtacacacaggcttcttaagtttctggaatggttccctacggaactacatggsgggaggcagggtggggaatgcatcagctcatgtttcctccctgtgtgcagctatttcctgcaatgagaggaaggcttggcaggagcggtgtatttcactc

SEQ ID NO: 17779 - DNA, 201 bp, Homo sapiens
tgtttatagattcaatatgtctttatcagtctgagcatttgtaagatgtttgaggggtttttccctgtggctttttttggtgtacacacaggcttcttaartttctggaatggttccctacggaactacatggggggaggcagggtggggaatgcatcagctcatgtttcctccctgtgtgcagctatttcctgcaatgag

SEQ ID NO: 17780 - DNA, 201 bp, Homo sapiens; identical to SEQ ID NO: 1902

SEQ ID NO: 17781 - DNA, 201 bp, Homo sapiens; identical to SEQ ID NO: 1900

SEQ ID NO: 17782 - DNA, 201 bp, Homo sapiens
ttaatagagacagggtttcaccatgttagccacggtggtctcgatctcctgacctcgtgatccacctgcctcggcctcccaaagtgctgggattacaggcrtgagccactgcgcccggccctaatccattttttttaaagtgaatttccttgtggccccaggtggtgagcaacaatagtgggagaaagttcacacacagat

SEQ ID NO: 17783 - DNA, 201 bp, Homo sapiens; identical to SEQ ID NO: 1909

SEQ ID NO: 17784 - DNA, 201 bp, Homo sapiens
caaacaggctttgtgtgagcaacaaggctgtttatttcacctgggtgcaggtgggctgagtccgaaaagaaagtcagggaagggagataggggtggggccrttttataagatttgggtaggtaaaggaaaattactgtcaaaggggggttgttctctggtgggcaggtgtgggggtcacaaggtgctcagtaggggagctt

SEQ ID NO: 17785 - DNA, 201 bp, Homo sapiens
aaatgctgcactaggctcaggtggtgtatcaacagccaggtgagaacaaaatgtcatcaataagaaaagccagttagaggccagctgtggtggctcatgcytgtaatcccagcactttgggaggccgaggtgggcggatcacctgaggttaggagtttcagaccagcctggccgacatggtgaaaccccatctctactaaa

SEQ ID NO: 17786 - DNA, 201 bp, Homo sapiens
catttctctgctctgagaaaggagataggtttgcttgttgcttcctggtatccattccccctttccctgacatccattagaaactcaaagatggctgggcrcagtggctcatgcctgtaatcccagcactttgggaggccgaggtgggcggatcatgaggtcaagagatggagaccatcctgccaacatggtgaaaccctg

SEQ ID NO: 17787 - DNA, 201 bp, Homo sapiens; identical to SEQ ID NO: 1910

SEQ ID NO: 17788 - DNA, 201 bp, Homo sapiens; identical to SEQ ID NO: 1908

SEQ ID NO: 17789 - DNA, 201 bp, Homo sapiens
cagaaaaagaccaatgtcctagctcaagcagtcggtcagagggagaattctcccttcctctgcctttttgttctattaaggccctcaacagaatggataaygcccacccatactggggagagcaatctgctctactcagtccaccaattcacatgttcatgtcttccagaaacaacctcacatacatacccagaaataatg

SEQ ID NO: 17790 - DNA, 201 bp, Homo sapiens
gaacatctatatataaagagatttattatgaggaattggctcacctgattatggagactggcaagtcccataatctgttgtctgcaagctggagaccaagraaagttgatggtgtagtcccagtccaagtctaaaagtctgagaaccaggtaagccaatggtgaaagttctagtccaagtctagtctaagggcagaaaaag

SEQ ID NO: 17791 - DNA, 201 bp, Homo sapiens
aggtttgtggttttgttgtgactgtggttatttttaaaccatgcttgcttctcagcaaatgtgtcaataattaattcagcactgcaaaattccaatttatrttgaggtcacttttaccttgaaatgcactttttcataattgggggatatgtctacttgagttgtcctctagcaggtctagtgacctgctaagcctcccac

SEQ ID NO: 17792 - DNA, 201 bp, Homo sapiens
ttttccaaatctgtctggaacatgttcctggcgtgagtgagctcagttctcacagattctgtttcagtttcccctcaagagggatcttgatagggttccawcagtttcactttcctttcccctttcataaaagcacagacctaacagcaccctgggtggaaacctcttcagcatttgcttggaatcagtaagctaaaaaca

SEQ ID NO: 17793 - DNA, 201 bp, Homo sapiens
attttctttttacagtgcctttttacaactttcaaaccacagttttccaaatctgtctggaacatgttcctggcgtgagtgagctcagttctcacagattstgtttcagtttcccctcaagagggatcttgatagggttccatcagtttcactttcctttcccctttcataaaagcacagacctaacagcaccctgggtgg

SEQ ID NO: 17794 - DNA, 201 bp, Homo sapiens
ctcaggagttggagaccagcctgggcaacatagtgagaccccgtctgtactaaaaatacaaaaatcagccaggcgtggtggcacgtgcctatagtctcatygactggagaggctgagatgggaggatcgcttgagcctgggaggcagaggttgcagtaagctgagatcgtgctactgcactccagcctggatgacagagtg

SEQ ID NO: 17795 - DNA, 201 bp, Homo sapiens
gagggcagatgcttgagctcaggagttggagaccagcctgggcaacatagtgagaccccgtctgtactaaaaatacaaaaatcagccaggcgtggtggcaygtgcctatagtctcattgactggagaggctgagatgggaggatcgcttgagcctgggaggcagaggttgcagtaagctgagatcgtgctactgcactcca

SEQ ID NO: 17796 - DNA, 201 bp, Homo sapiens
tcttttgtaaagaggtaacatggctggccgcagtggctcacacccataagcccaacactttgggaggccgaggagggcagatgcttgagctcaggagttgragaccagcctgggcaacatagtgagaccccgtctgtactaaaaatacaaaaatcagccaggcgtggtggcacgtgcctatagtctcattgactggagagg

SEQ ID NO: 17797 - DNA, 201 bp, Homo sapiens
tcttgcaatttatccagctaaataaggcaagtgatctcctttagtatcttccaactacaaaacaaaaatgagtccattttgtttgtttgttgcaacaaattcattctgtctgggaatctggcctgtgtggtggggagactacttcagtcagactcaagctgagcctccgtgggtctgtttgtaagtggtggaaaagatgaa

SEQ ID NO: 17798 - DNA, 201 bp, Homo sapiens
aggtggtttccggtttcgttgaggcaaatacatccaacaatacatccaacatcacctgtcatcctgcaggtccactggatactctctattaattactagagtgttcagctatttttttcaggcacccatatgtacctacaaatctgcagatacattctattgatctgagactcacactttctccttttaaccttcctaatt

SEQ ID NO: 17799 - DNA, 201 bp, Homo sapiens
aaggtggtttccggtttcgttgaggcaaatacatccaacaatacatccaacatcacctgtcatcctgcaggtccactggatactctctattaattactagagtgttcagctatttttttcaggcacccatatgtacctacaaatctgcagatacattctattgatctgagactcacactttctccttttaaccttcctaat

SEQ ID NO: 17800 - DNA, 201 bp, Homo sapiens
tgatgggtttatcaggatataaccccatcataagtcaaggaacatctatatataaagagatttattatgaggaattggctcacctgattatggagactggyaagtcccataatctgttgtctgcaagctggagaccaaggaaagttgatggtgtagtcccagtccaagtctaaaagtctgagaaccaggtaagccaatggt

SEQ ID NO: 17801 - DNA, 201 bp, Homo sapiens
agctaggctaagctatggtaggttagatgtattaaatgcatctttttatttacaatgttttcaatttatgatgggtttatcaggatataaccccatcatamgtcaaggaacatctatatataaagagatttattatgaggaattggctcacctgattatggagactggcaagtcccataatctgttgtctgcaagctggag

SEQ ID NO: 17802 - DNA, 201 bp, Homo sapiens
cagactgtagctaaagaaaagtgaatgtaggaagcaacttacaatttttccaaccttgtgatggtacaaaagtgataattccattcttgtttttcacttamaatacagtattcaataagttacatgagatactcaacactttagtataaaataggctttgtgttaggtgactttgccccactgtaggctaatgtaagggtt

SEQ ID NO: 17803 - DNA, 201 bp, Homo sapiens
gtgtaagggatgtgctttgtgggtgtctgcacagactgtagctaaagaaaagtgaatgtaggaagcaacttacaatttttccaaccttgtgatggtacaamagtgataattccattcttgtttttcacttaaaatacagtattcaataagttacatgagatactcaacactttagtataaaataggctttgtgttaggtga

SEQ ID NO: 17804 - DNA, 201 bp, Homo sapiens
caggtccactggatactctctattaattactagagtgttcagctatttttttcaggcacccatatgtacctacaaatctgcagatacattctattgatctragactcacactttctccttttaaccttcctaattcacacatcagcaaagttaactcatgtttccatgactttattatgatttagtggcataacagatata

SEQ ID NO: 17805 - DNA, 201 bp, Homo sapiens
attcaagcataaatctgccttaccaattcatgcatttttatttctgtagctctttgtgatgtatagagttaggcagccaaaggacacagggaaatgggagmtgggagctgggaagggacggggcatattgagagatcctagagagcccatgctcagatgctttcaggtaaaatcgggccagtgaaagctggggcctggagg

SEQ ID NO: 17806 - DNA, 201 bp, Homo sapiens
aaaactgtggaattgtacattatcattcagagaaagagaataaaaaagggagcggccaggcgccgtggctcatgcctgtaatcccagcactttgggaggcygaggtgggcggatcacaaggtcgggagttcgagaccagcctgaccaacatggtgaaaccccgtctctactaaaaatacaaaaaaaataggcaggcgtggt

SEQ ID NO: 17807 - DNA, 201 bp, Homo sapiens
gtaagaaaggtaacatcccagcttatctgaatccagatctgcattttaaaaagatctccagatgtttgtgtccatatgtacattaaaggttgagaagtccrgctctggagagttccttcacttgctttctgaagtgatggactccttggattgggcctgttctgaccaaccaactgagcacaggtctgccagttccttcac

SEQ ID NO: 17808 - DNA, 201 bp, Homo sapiens
tttttaattggtgagacagagtctctctctgtcgcccaggctggagtgcagtggtgtgatctcggctcactgcaacttctgcctcctgggcccgggttcaygccattctcctgcctcagcctcccaagtagctgggactacaggcacccaccaccacacctggctaatttttttgtatttttagtagagacggggtttcac

SEQ ID NO: 17809 - DNA, 201 bp, Homo sapiens
gaaagttctagtccaagtctagtctaagggcagaaaaagaccaatgtcctagctcaagcagtcggtcagagggagaattctcccttcctctgcctttttgytctattaaggccctcaacagaatggataacgcccacccatactggggagagcaatctgctctactcagtccaccaattcacatgttcatgtcttccagaa

SEQ ID NO: 17810 - DNA, 201 bp, Homo sapiens
agtctcgctctttcgcccaggctggactgcagtggcactatcttggctcactgcaagctccacctcccgggttcacgccattctcctgcctcagcctcccragtagctgggactacaggtgcctgctaccatgcccagctaattttttttgtatttttagtagagacggggtttcactgtgttagccaggttggtcttgat

SEQ ID NO: 17811 - DNA, 201 bp, Homo sapiens
agtctaaaagtctgagaaccaggtaagccaatggtgaaagttctagtccaagtctagtctaagggcagaaaaagaccaatgtcctagctcaagcagtcggkcagagggagaattctcccttcctctgcctttttgttctattaaggccctcaacagaatggataacgcccacccatactggggagagcaatctgctctact

SEQ ID NO: 17812 - DNA, 201 bp, Homo sapiens
aggaggggggaggggtgggaagaatgttgaaataaagcaaagcttgtttctgggcacagtggctaagcctgtaatcccagcactttgggaggctgaggcargaggattgcttgagcccaggggctccagaccagaattggcaacaaagtgagacctacaaaaaaacaaaaataaaataaaaataaagcaaagtttgactgt

SEQ ID NO: 17813 - DNA, 201 bp, Homo sapiens
ctaagggcagaaaaagaccaatgtcctagctcaagcagtcggtcagagggagaattctcccttcctctgcctttttgttctattaaggccctcaacagaayggataacgcccacccatactggggagagcaatctgctctactcagtccaccaattcacatgttcatgtcttccagaaacaacctcacatacatacccaga

SEQ ID NO: 17814 - DNA, 201 bp, Homo sapiens
gaactaagcaaagaggtcactgaaatccaggtgtcctgtggttttcttcccttcactcaagatgcctgataatgctgcttaattcaccacattagctccayaaataaaggggaaaactgctttttaaaatacctctatgacagcacttctcaaaatgtggtacaggaactcctgcactgaatttccaaggcacttgtgaaa

SEQ ID NO: 17815 - DNA, 201 bp, Homo sapiens
ggtacaggaactcctgcactgaatttccaaggcacttgtgaaaacacaggtttctaagctcacatcagattcactgcaccagaatctctgggagtaggacygcatagtcagtactgtcaatatacaataatcagaaggctcaggatccagttaaaagagtttattcaacaaaaagttgagggcagcagtcccaggagtaga

SEQ ID NO: 17816 - DNA, 201 bp, Homo sapiens
tgtttttgagacagagtctcactctgtcacccaggctggagtgcagtggcccgatcatggctcactgcagcctcagactcctgggctcaagggattctccyacccagcctcccaagtagctgggactataggagcacgccactatgcctggttaatttttttgtattttagtagcaatggggttttgccatgttggtcagg

SEQ ID NO: 17817 - DNA, 201 bp, Homo sapiens
ctcctaacaaaactgaaagcacctggcgggcagagaaggttgggataatctctatttttcttagtatccataatatctaataaagtgacaaaaagaggtascccaataaagagtcatgggatagctaaacaaaccttacccagaatgtacaaggaatgagaactgacttggtattttttaatttttattcttacttttatt

SEQ ID NO: 17818 - DNA, 201 bp, Homo sapiens
ggtaagatccctggtgcattgatatgtcaaagccttctgccctccaaaaaaaaaaaaaaaagagagagagatagtgtcatcagacttgcaaggtggtttcyggtttcgttgaggcaaatacatccaacaatacatccaacatcacctgtcatcctgcaggtccactggatactctctattaattactagagtgttcagcta

SEQ ID NO: 17819 - DNA, 201 bp, Homo sapiens
ggtgaaaccctgtctctactaaaaacacaaaaaaattacctgagagtggtggtggacacctgtagtcccagctacttgggaggctgaggcaggagaatggygtgaacccaggaggcagagcttgcagtgagccgagatcctgccactgcactccagcctgggcaacagagtgagatgccatctcaaaacaaacaaacaaac

SEQ ID NO: 17820 - DNA, 201 bp, Homo sapiens; identical to SEQ ID NO: 1916

SEQ ID NO: 17821 - DNA, 201 bp, Homo sapiens; identical to SEQ ID NO: 1915

SEQ ID NO: 17822 - DNA, 201 bp, Homo sapiens; identical to SEQ ID NO: 1914

SEQ ID NO: 17823 - DNA, 201 bp, Homo sapiens; identical to SEQ ID NO: 1913

SEQ ID NO: 17824 - DNA, 201 bp, Homo sapiens; identical to SEQ ID NO: 1912

SEQ ID NO: 17825 - DNA, 201 bp, Homo sapiens; identical to SEQ ID NO: 1911

SEQ ID NO: 17826 - DNA, 201 bp, Homo sapiens
ctgacttggtaattgagcagcgtgagagagatctcatttcctgtcactgaagctgcctcctcttacccatcttacctcacctcctgcatatctgcttacayggtgtaagggatgtgctttgtgggtgtctgcacagactgtagctaaagaaaagtgaatgtaggaagcaacttacaatttttccaaccttgtgatggtaca

SEQ ID NO: 17827 - DNA, 201 bp, Homo sapiens
ggactacaggcatgtactaccatccctggctaatttttgtatttttagtagaggcaggctttcgccatgttgcccaggctggtcttgaatcctgggctcargtgatccacccgccttggcctcccaaagtgctaggactacaggcatgagtcaccattcctggctgacttggtaattgagcagcgtgagagagatctcatt

SEQ ID NO: 17828 - DNA, 201 bp, Homo sapiens
ttacttttattttttttgaggcagggtcccactctatcaccctggctggagtgtaatggtgtgatctcagctcactacaacttttgcctcctgggctcaartgatcctcctgtctcagcctcccgaatggcgaggactacaggcatgtactaccatccctggctaatttttgtatttttagtagaggcaggctttcgccat

SEQ ID NO: 17829 - DNA, 201 bp, Homo sapiens
agaatgtacaaggaatgagaactgacttggtattttttaatttttattcttacttttattttttttgaggcagggtcccactctatcaccctggctggagygtaatggtgtgatctcagctcactacaacttttgcctcctgggctcaagtgatcctcctgtctcagcctcccgaatggcgaggactacaggcatgtacta

SEQ ID NO: 17830 - DNA, 201 bp, Homo sapiens
agcacctggcgggcagagaaggttgggataatctctatttttcttagtatccataatatctaataaagtgacaaaaagaggtaccccaataaagagtcatkggatagctaaacaaaccttacccagaatgtacaaggaatgagaactgacttggtattttttaatttttattcttacttttattttttttgaggcagggtc

SEQ ID NO: 17831 - DNA, 201 bp, Homo sapiens
aagggaaaaatacctaaatcacataacatgttggcagacatatctgggcttttatttctttacatgtctcctaacaaaactgaaagcacctggcgggcagwgaaggttgggataatctctatttttcttagtatccataatatctaataaagtgacaaaaagaggtaccccaataaagagtcatgggatagctaaacaaac

SEQ ID NO: 17832 - DNA, 201 bp, Homo sapiens
tcttccaactacaaaacaaaaatgagtccattttgtttgtttgttgcaacaaattcattctgtctgggaatctggcctgtgtggtggggagactacttcartcagactcaagctgagcctccgtgggtctgtttgtaagtggtggaaaagatgaagggaaaaatacctaaatcacataacatgttggcagacatatctggg

SEQ ID NO: 17833 - DNA, 201 bp, Homo sapiens
ctttttttctgaaattgtgcttgtctgtgaaatccaaaaataaggacacttggtttaatgatttctggaggttctttccaatcttatggtgccgtgactcyactggtaagaaggaagaagcacaaactcaagagtgagggacatacagcccaagccccaggcaaatgtagataatgggaacacacttagagaactcttgca

SEQ ID NO: 17834 - DNA, 201 bp, Homo sapiens
ttcataactttttttctgaaattgtgcttgtctgtgaaatccaaaaataaggacacttggtttaatgatttctggaggttctttccaatcttatggtgccrtgactccactggtaagaaggaagaagcacaaactcaagagtgagggacatacagcccaagccccaggcaaatgtagataatgggaacacacttagagaac

SEQ ID NO: 17835 - DNA, 201 bp, Homo sapiens
aaaacccctagggccaggtgtggtggttcacacctgtaatcccaacactttggtatgtcgaggcagaaggattgcttgagaccaggagtttgagaccactytgggcaatatagtgagaccctgtctctgcaaaaaaaggaaggaagggaggaaagaaggaaaatagggagggaggaagggagggagggagggaaggaagga

SEQ ID NO: 17836 - DNA, 201 bp, Homo sapiens
tattcattttttaaataattgctaacttgacttttgacttgtagtccttcatacagggtagttagaatacccaggtaaagccaaattgaaaacccctaggrccaggtgtggtggttcacacctgtaatcccaacactttggtatgtcgaggcagaaggattgcttgagaccaggagtttgagaccactctgggcaatatag

SEQ ID NO: 17837 - DNA, 201 bp, Homo sapiens
atacatccaacaatacatccaacatcacctgtcatcctgcaggtccactggatactctctattaattactagagtgttcagctatttttttcaggcacccrtatgtacctacaaatctgcagatacattctattgatctgagactcacactttctccttttaaccttcctaattcacacatcagcaaagttaactcatgtt

SEQ ID NO: 17838 - DNA, 201 bp, Homo sapiens
gtgggttttataatcataaagccacatgagtagttgactatcttcctgaataaattgttccatgttatcattaaatgtctcagcctggccagctctcgcaytggtaaagcattggtggggatggaatatccctgagagatccatattcagagctctttcacaagtccagaaatgttcagtgtgcttttctgcttgtccaac

SEQ ID NO: 17839 - DNA, 201 bp, Homo sapiens
ctgacctgtggctctggggttcatgtttcttcttatcgaggtctcaggccttccagtccaatatattttgctccaaattttacttcaaggagagatcaagyatcaaatacctcatcaaattggagactttagggagtaaggcttaggaaaaatcaagagaatcaagggacccaattttcagtgggttttataatcataaag

SEQ ID NO: 17840 - DNA, 201 bp, Homo sapiens
gaactcttgacctcatgatccacccgcctcagcctcccaaaatgctgggattacaggtgtgagccaccgcgcccggccacctagctgttctttatcaagtractgtagtcatcatcccacctgcctgcttgtatttatttaaatatctgcattaattactgttaactaacttatttatacatataagaagtattcagagta

SEQ ID NO: 17841 - DNA, 201 bp, Homo sapiens
cggggtttcatcatgttggccaggctagtctcgaactcttgacctcatgatccacccgcctcagcctcccaaaatgctgggattacaggtgtgagccaccrcgcccggccacctagctgttctttatcaagtgactgtagtcatcatcccacctgcctgcttgtatttatttaaatatctgcattaattactgttaactaa

SEQ ID NO: 17842 - DNA, 201 bp, Homo sapiens
gcggggtttcatcatgttggccaggctagtctcgaactcttgacctcatgatccacccgcctcagcctcccaaaatgctgggattacaggtgtgagccacygcgcccggccacctagctgttctttatcaagtgactgtagtcatcatcccacctgcctgcttgtatttatttaaatatctgcattaattactgttaacta

SEQ ID NO: 17843 - DNA, 201 bp, Homo sapiens
ctcactgcaacctccgccttccggtttcaagcaattctgcctcggcttcccgagtagctgggattacaggcgcctgccaccacgcccggctaatttttgtrtttttagtacaggcggggtttcatcatgttggccaggctagtctcgaactcttgacctcatgatccacccgcctcagcctcccaaaatgctgggattaca

SEQ ID NO: 17844 - DNA, 201 bp, Homo sapiens
cccgatcttggctcactgcaacctccgccttccggtttcaagcaattctgcctcggcttcccgagtagctgggattacaggcgcctgccaccacgcccggstaatttttgtgtttttagtacaggcggggtttcatcatgttggccaggctagtctcgaactcttgacctcatgatccacccgcctcagcctcccaaaatg

SEQ ID NO: 17845 - DNA, 201 bp, Homo sapiens
ccaggctggagtgtagtggcccgatcttggctcactgcaacctccgccttccggtttcaagcaattctgcctcggcttcccgagtagctgggattacaggygcctgccaccacgcccggctaatttttgtgtttttagtacaggcggggtttcatcatgttggccaggctagtctcgaactcttgacctcatgatccaccc

SEQ ID NO: 17846 - DNA, 201 bp, Homo sapiens
cggagttttgctctttcgcccaggctggagtgtagtggcccgatcttggctcactgcaacctccgccttccggtttcaagcaattctgcctcggcttcccragtagctgggattacaggcgcctgccaccacgcccggctaatttttgtgtttttagtacaggcggggtttcatcatgttggccaggctagtctcgaactc

SEQ ID NO: 17847 - DNA, 201 bp, Homo sapiens
tttttcttctttttcttttattctttttttttttttttttttttttttttttttttgagacggagttttgctctttcgcccaggctggagtgtagtggccygatcttggctcactgcaacctccgccttccggtttcaagcaattctgcctcggcttcccgagtagctgggattacaggcgcctgccaccacgcccggcta

SEQ ID NO: 17848 - DNA, 201 bp, Homo sapiens
cgaggtcatgggaaatctctttctggacctgagggaatcctatctccctaaggtcttctactagatgcagatccaggtaggactggcattctactccccamgtttcacctgaacctagctattctgttttttcttctttttcttttattctttttttttttttttttttttttttttttttttgagacggagttttgctct

SEQ ID NO: 17849 - DNA, 201 bp, Homo sapiens
ggcagatcatgaggtcaggagttcgagaccagcctgaccaacatggtgaaaccccgcctctactaaaaatacaaaaattatccaggcatggtggtgcacgyctgtaatcccagctactcaggaggctgaggcaggagaatcacttgaacccgagaggcagaaattgcagtgagactagggagtctggttaacatgtaaccc

SEQ ID NO: 17850 - DNA, 201 bp, Homo sapiens
aaagactaggttgtctgaggccgggcacggtggtgcaaggctataatcccagcactttgggaggccaaggcgggcagatcatgaggtcaggagttcgagamcagcctgaccaacatggtgaaaccccgcctctactaaaaatacaaaaattatccaggcatggtggtgcacgcctgtaatcccagctactcaggaggctga

SEQ ID NO: 17851 - DNA, 201 bp, Homo sapiens
aaaaaaaaaaaaaaaaaaaaaagtaacaatcaaaagggtctctatttccataacatgaggtctacgttttaataaagactaggttgtctgaggccgggcayggtggtgcaaggctataatcccagcactttgggaggccaaggcgggcagatcatgaggtcaggagttcgagaccagcctgaccaacatggtgaaaccccg

SEQ ID NO: 17852 - DNA, 201 bp, Homo sapiens
atggggttttgccatgttggtcaggttggtcttgaactcctgaccttaagtgatgcacccaccttggcctcccaaagtgctgagattacaggcgtgagccwccgtgcctggccaacattttccatacagaggctaacatacagatatacaatttgattggctactattgattacagtccaagggaattgcttaatattctt

SEQ ID NO: 17853 - DNA, 201 bp, Homo sapiens
tagcaatggggttttgccatgttggtcaggttggtcttgaactcctgaccttaagtgatgcacccaccttggcctcccaaagtgctgagattacaggcgtsagcctccgtgcctggccaacattttccatacagaggctaacatacagatatacaatttgattggctactattgattacagtccaagggaattgcttaata

SEQ ID NO: 17854 - DNA, 201 bp, Homo sapiens
cgccactatgcctggttaatttttttgtattttagtagcaatggggttttgccatgttggtcaggttggtcttgaactcctgaccttaagtgatgcacccrccttggcctcccaaagtgctgagattacaggcgtgagcctccgtgcctggccaacattttccatacagaggctaacatacagatatacaatttgattggc

SEQ ID NO: 17855 - DNA, 201 bp, Homo sapiens
catcctagggcattttaaggataagggaatgaggctcagtgatatgactcaagaaatatcccagaactaagcaaagaggtcactgaaatccaggtgtcctrtggttttcttcccttcactcaagatgcctgataatgctgcttaattcaccacattagctccataaataaaggggaaaactgctttttaaaatacctctat

SEQ ID NO: 17856 - DNA, 201 bp, Homo sapiens
taattttctatcatttggatgaagggaaaaggaaattcatcctagggcattttaaggataagggaatgaggctcagtgatatgactcaagaaatatcccakaactaagcaaagaggtcactgaaatccaggtgtcctgtggttttcttcccttcactcaagatgcctgataatgctgcttaattcaccacattagctccat

SEQ ID NO: 17857 - DNA, 201 bp, Homo sapiens
caacagccctaggaagtaagagctattatttctattattagcctcattttctagatgaccaaaatggggcttagaagggcaaattacttgcccaagacatmagatagagagcaggtgtcagagcagagtcattaatggaggcaccaaactctactgctgatcatctgactctatgcccaatggccaaaaggtgaaagatct

SEQ ID NO: 17858 - DNA, 201 bp, Homo sapiens
tgaccagagagcaaggcgtcttagtagccagcttgcaggaaaggttttacagggtcctgtctttaggtgtgtctatagccactgacctgaggaggtctgargggggctctctgaactatgctggactcaggttcacatcaaggtgctcctatttccagaggctataggaacaggaagagattgggctgctcctccccagtt

SEQ ID NO: 17859 - DNA, 201 bp, Homo sapiens
acatttaccaaaactcatcagactatacactgaaaatgggtgcatcttattgtatataaagcataatctcagtaaacttgatttttaaatttatatattgwcctcctggagttcttcaggggatagcatgttagggagaactaagagaaaaggatgcctttcccaccaagcatctctaggaaaggagtgaggaggtgattg

SEQ ID NO: 17860 - DNA, 201 bp, Homo sapiens
accctataatagacagggaagatattgacactggaaccctagacagggaccaagaaaaggaaaaggactgtccccaaatcaaagcacacacataaagaggmtagccggatgtagatggcaacttccctcctcactcccattgcccttgagttgattctgcatctctcactataaagcatttcatgtgcaatcatattgggc

SEQ ID NO: 17861 - DNA, 201 bp, Homo sapiens
catattgggccaaaaatggtttagatcagcattactggagagacagacaggaagtataatagatcagtacacttgcagtagcggtgtgagggccagtgctsgtccatggtaaattgcaaataaagtcaatggctccttgtagaacaaaatgcattcaatttaaagaattttgtttattctgagattactttttcagtggca

SEQ ID NO: 17862 - DNA, 201 bp, Homo sapiens
cttttaaaataaaatattggtcagaatagatggttggtatcttttcagatacattagcagccctatttggttcataactttttttctgaaattgtgcttgyctgtgaaatccaaaaataaggacacttggtttaatgatttctggaggttctttccaatcttatggtgccgtgactccactggtaagaaggaagaagcaca

SEQ ID NO: 17863 - DNA, 201 bp, Homo sapiens
aaaatttgcagtctcatctcattttcatccagacttctggaactcaaagattaacttttgactaaccctggaatatctcttatctcacttatagcttcagscatgtatttatatgtattcttgatagcaataccataatcaatgtgtattcctgatagtaatgctacaataaatccaaacatttcaactctgttagaatag

SEQ ID NO: 17864 - DNA, 201 bp, Homo sapiens
atgcaaatttctaggtcctgcattctgaaatcctgattgagtaaaacagaaataaggtccagaaacaaacatatatttaaagaggaccacaagtacttcayaggcatactgaatggcttacagaagaaatgtccatctccaaatcctctcttccttaaatgcatacaaggcttcctgcattgtatgtgtgtaaatgtgaag

SEQ ID NO: 17865 - DNA, 201 bp, Homo sapiens
aactaccatcagagtggacaggcaacctacagagtgggagaaaatttttacaatctacccatctgacaaaggactaatatccagaatctacaaaaaacttmaacaaatttacaagaaaaaaatcaaacaaccccatcaaaaagtgggcaaaggctatgaatggacacttctcaaaagaagacatttatgcagccaacagac

SEQ ID NO: 17866 - DNA, 201 bp, Homo sapiens
gtattcgccctgcctatattaaccattaacaagcattgtactgttagtgcagctaaagtaattatatcagaaaaacatatcaattgtcattttgtccaccrgacagtattgtaaggaaatgatgctgcaagaaaagcagacaaatatggacttcccaacatagggacgtgaagcaggtgtattaaaaataaggatgcatat

SEQ ID NO: 17867 - DNA, 201 bp, Homo sapiens
tgggactgcctagtctactcctcaggggagagtgtccagagaaaggcaggaatggtttgaaaccaaagagggccctggggcaaggataattgagagaggaraaggagggtgatatgtggcagccaggccaggacagaggctggaaggggagatgttggccagcacatgggaccaggactcagctccccaccttctctcgat

SEQ ID NO: 17868 - DNA, 201 bp, Homo sapiens
caaagcctcagagattttagcatatcctcaaatgaatctggcctttgaacaaaaaattagatgactcttgtccttacttctttaaaagaaaattatttttytttgccttgcaaacctcaacacagttagtgctttcgtctaaaaataatcccatttcaatgtttttaagttaaatctgaacttggttactaacacaaaacc

SEQ ID NO: 17869 - DNA, 201 bp, Homo sapiens
gaagaagtcctttattgagcaacagtacagctctcaggagacccaaagtgggtagctcctttccacaggcaggttgtcccaacaagtgatcagccctcagwggagaggagacccccagtgggtagctcctatcttcaagcagattgtcccaatgagtgtgcagctcagtggagagcagacctggagtgggtagctcctatc

SEQ ID NO: 17870 - DNA, 201 bp, Homo sapiens
gacagaagtaggaaatacagctgaggccaaaactcattctgaacagcaaatgaaaacagatacttttggccgggcatggtggctcatgcgtgtaatctcakcactttgggaggctgaggcaggcagattacctgagattgggagtttgagaccagcctgaccaacatggagaaaccccgtctctgctaaaaatacaaaaaa

SEQ ID NO: 17871 - DNA, 201 bp, Homo sapiens
aacgatacaaatagaccccagagccttggtttatgtctcacttgttttggaaacataatgagtcatagtttgtgttatttctgagtaaaatgtaaaaatayatagtaaattctgccctgaacctagaaattcctgaaacccttctagagatctggaaattggccccagtgtgtttatacagatataatctaattaaaatat

SEQ ID NO: 17872 - DNA, 201 bp, Homo sapiens
cgatacaaatagaccccagagccttggtttatgtctcacttgttttggaaacataatgagtcatagtttgtgttatttctgagtaaaatgtaaaaatatayagtaaattctgccctgaacctagaaattcctgaaacccttctagagatctggaaattggccccagtgtgtttatacagatataatctaattaaaatattt

SEQ ID NO: 17873 - DNA, 201 bp, Homo sapiens
gagcctatttatgttctgcttttgattcacagatattacagagcaaaggcactgtgatataaaaccactgagcacacattttcctttctcatttttaaatkaaacttactaatttgtcatcaagcactacatttaaaaactcaaacctggctgggcgtggtggctcaagcctaaaatcccagcactttgggaggccaagga

SEQ ID NO: 17874 - DNA, 201 bp, Homo sapiens; identical to SEQ ID NO: 17763

SEQ ID NO: 17875 - DNA, 201 bp, Homo sapiens; identical to SEQ ID NO: 1906

SEQ ID NO: 17876 - DNA, 201 bp, Homo sapiens
tgaatggactgatggaaaacaaacactagtcaactcctgcaaacatttcccacagcacctgagcctggccagaatcctgataggccaggctggctttcttratgagttttcagggccccctttaatgaaaagactaaaaactttacctggttgtaatgaaaataattcttggcactgcttccccagtcaaaggcttgaaac

SEQ ID NO: 17877 - DNA, 201 bp, Homo sapiens
ccgatccaatgtctctactgcaaaccccatgcccagtggaggcccaagacacagaagggtgaagcaacacaggtctgtaatataaaatagagttggcctargacagccttggtttcaacattcccaagggcctctgacatcccaggtctggtggccatttgtactttgctgaggcctggcgtgtactgtgtgtgggctgct

SEQ ID NO: 17878 - DNA, 201 bp, Homo sapiens
actttgctgaggcctggcgtgtactgtgtgtgggctgctggcagtcactaagctggtgggaaagctcaggatctgcctccagccagctcagtcaccctccrtcatctctgggggtgcaataactgatgaggtgacagacattgggccttttaggaaaatgtccattaggtaagaggtcctaggcatcctcaaaaatgtagg

SEQ ID NO: 17879 - DNA, 201 bp, Homo sapiens
ttaaaatagcaggaccccaggccaagagtataaaatgattcccataactttttttttttttaagagagaaaaggtctcattctatcacctagactggagtrcagtggcatgactgctcactgcagcctcaaactcctggactcaagtgatcctcccacctcaggcccctgaagaactgggattacaggtgtgtaccacaac

SEQ ID NO: 17880 - DNA, 201 bp, Homo sapiens
gcacctgcaggggacacagggctagaaatgacacagtgcttgtcacctgacccccagacatagttctatgacatttcttacttttcttacttctgtccatygtaaacaaatgcatcttcctcctgtccacacagtttagaatacatccctgtcatggagggcttaatcctgaagaagtcaatatcagagaccaccatcaaa

SEQ ID NO: 17881 - DNA, 201 bp, Homo sapiens
tttaagttcagccactattagctcttcctcctacttatctaaccactattagctcttcctcctacttatctaaccacttctgttcttgccccaaattataygtcagcatttaaatttgtcattcatgggaaaaaagtgaaatgaaagaaaatagagctttcaaaagaaacagaaaggaaaaatttgacccgtctctctcct

SEQ ID NO: 17882 - DNA, 201 bp, Homo sapiens
ttcagccactattagctcttcctcctacttatctaaccactattagctcttcctcctacttatctaaccacttctgttcttgccccaaattatacgtcagyatttaaatttgtcattcatgggaaaaaagtgaaatgaaagaaaatagagctttcaaaagaaacagaaaggaaaaatttgacccgtctctctccttctgaa

SEQ ID NO: 17883 - DNA, 201 bp, Homo sapiens
aattggaaaccatcattctcagtaaactatcgcaagaacaaaaaaccaaacaccgcatattctcactcataggtgggaattgaacaatgagatcacatggwcacaggaaggggaatatcacactctggggactgtggtggggtggggggaggggggaggggtagcattgggagatatacctaatgctagatgacgagttag

SEQ ID NO: 17884 - DNA, 201 bp, Homo sapiens; identical to SEQ ID NO: 17765

SEQ ID NO: 17885 - DNA, 201 bp, Homo sapiens; identical to SEQ ID NO: 17766

SEQ ID NO: 17886 - DNA, 201 bp, Homo sapiens; identical to SEQ ID NO: 17767

SEQ ID NO: 17887 - DNA, 201 bp, Homo sapiens
caaacagaccaccaaccccaagaaccgcattttcattctgtataataaaacagtctattattatttgcttgaattttactacacaaaaatattctggtaamttaatgctcccacaaaaagttctgaaccagatttagggcaagtaaaaggtgaaaggaaaatatgaaacaaatgactccagccatatctgaaaggagaata

SEQ ID NO: 17888 - DNA, 201 bp, Homo sapiens
taaataatgatacagtcatatagtgaaatatcatgcacttctggaagatgtgctttatgtattgtatggaaagatctccaagatattaagtaaaaaattcraagaacaaaatagtgccatcttttgcattcaaatggaggcaagggaaaaataagaatctgtgtgtgtatttgtttctaatgagatttttggaaataaaaa

SEQ ID NO: 17889 - DNA, 201 bp, Homo sapiens
acagaatagcatctgcaggagctgctttcattcagcggttttcctacagaacctgtatcaaccgcccagaggaaggtccatgagagtaacagctaaagctmctcagctgaaaatctcacccagttaagttttccttccaacacaacactacatacttagtatgtttttctcaacatactaagccaagcaattcttactaag

SEQ ID NO: 17890 - DNA, 201 bp, Homo sapiens
aatgacattgctgagaagacaaacagggtttgggtggcaccacagaaattattagcaacagtggaaagagctggggcattattggatgaaggaagtgtcayaccatagaccagaagttgagcaacagtctctgtcagagacactactcatggccaagaaagagaggagctagaaatagctggacctccccttctttcttcc

SEQ ID NO: 17891 - DNA, 201 bp, Homo sapiens
accagatttagggcaagtaaaaggtgaaaggaaaatatgaaacaaatgactccagccatatctgaaaggagaataaggaatttttaaattttatttatttwtttttattttatttatttatttatttatttatttatttatttatgttgagatggagtcttgctctgtcacccaggctggagtgcagtggtgcaatctcag

SEQ ID NO: 17892 - DNA, 201 bp, Homo sapiens
tattgaatgtactgatggtttcacaggtgtgtacacatgcaaaaacttatacaattgtacaattgaaatatgccatgctattgtatgtcaataatactccwatacagctgtttgtttttagttttgtgtttaaactgaatattccacaagtcttaagaaattgattctcaggagattgcaaaagtgaactgactcccttct

SEQ ID NO: 17893 - DNA, 201 bp, Homo sapiens
atagtacataaaatagagcacacacatactgagtatgcagtttgatgagttatcacaaactaaacacagctgggaaaaccagcagtgagtccaggaaacamcaccagcaggactgcagaagcccccttgggctctcttccagttgtgtctcccaaaagtaactattgtcctcatttttcacaccagaaattagtttcgcct

SEQ ID NO: 17894 - DNA, 201 bp, Homo sapiens
agataacactattctacccaccaggatggctaaaattaaaaagtgttggcaaggatgtgaagcagctgggaaactctttcatcgctgatgggaatgtaaamtggtacaatcactttagataaaagattataagtatatctaccatatggcccagctattctactcttaagtatttactcaagagaaatgaaagtgtttgtc

SEQ ID NO: 17895 - DNA, 201 bp, Homo sapiens
tgaatgatatgggagaggtgggaatgacctcatcagaactctaaagagtctttcatttgagaggcacaagcatgaactttggccaatgcctagaatacggrggaggggtgatcattaaggccctttcccactgtagaagtccgctgaaaacttatttgattttctgcctccttctcttcatttggagaatttaaatacacc

SEQ ID NO: 17896 - DNA, 201 bp, Homo sapiens
taactggatcggggaaatagatgcattttaaaagtacataactttgagaaacttaccacattcatgtttgtttcaggatccacagctgtcagtttccctcyagacccctcagaatgcagggtccagagaaccaaacagaccaccaaccccaagaaccgcattttcattctgtataataaaacagtctattattatttgctt

SEQ ID NO: 17897 - DNA, 201 bp, Homo sapiens
ctgggtctggaaggaggggtaaacggaaaaagaaaagcccactgctccactgatatcaaaacgcaggggaggaaggcacagattatccctccccttgccakttcttcagatctcaggaggaaatctgcggggagaggagagggatgggaggggtccaagtaccttaatgagatgatctggtaatcgtcctaatttggccat

SEQ ID NO: 17898 - DNA, 201 bp, Homo sapiens
atcagcctttgccagaacactgcaggacaccagtgcagcgcccagcctgcgaccatgaggtaaaggattttttcttgcatttatcccttgaaattatgttstgtgcctttgaaaacctcaaggtagattttcttaggtgctggatttgggcatctgcttaaatatttaacatatcttagagaatacttgtttcttgttaat

SEQ ID NO: 17899 - DNA, 201 bp, Homo sapiens
tttattataaagcctccaaggggcatccaggccccaaatgaagtcaagatgctcccattccggaatgctctcatggaacaccaagttggtgatctgagtcrgtaagatattgacgtcgtagacatctgcaagccagtcgtgacccccgctccagactgcagtcggcacaagcatgtccttcacattgtatgtgggaggata

SEQ ID NO: 17900 - DNA, 201 bp, Homo sapiens
agatgctcccattccggaatgctctcatggaacaccaagttggtgatctgagtcagtaagatattgacgtcgtagacatctgcaagccagtcgtgaccccygctccagactgcagtcggcacaagcatgtccttcacattgtatgtgggaggataactctacaatgaaaaggaaccagagaaagcctcgttgttgttgttg

SEQ ID NO: 17901 - DNA, 201 bp, Homo sapiens
tcagtaagatattgacgtcgtagacatctgcaagccagtcgtgacccccgctccagactgcagtcggcacaagcatgtccttcacattgtatgtgggaggwtaactctacaatgaaaaggaaccagagaaagcctcgttgttgttgttgttttaattttcaaaatcacaataagcgcaatctccattaaacattgtctagt

SEQ ID NO: 17902 - DNA, 201 bp, Homo sapiens
ctttgtcagaatggttcttcctcccatgaggaattcggttaaggcacagaatatatccatcttctgtctcaactaggtattcctcactagggaatccccastaagagataatttcactctgtagagaaaaaggacgatggaaattgggtggacagaatctgaaacagtctcccacattaacaagcaaaggagcagataaac

SEQ ID NO: 17903 - DNA, 201 bp, Homo sapiens
agtaaggacaagagtcatctaattttttgttcaaaggccagattcatttgaggatatgctaaaatctctgaggctttgtttttttaaggaagtgtatttaragtttaaccagacaccggtaggtggaacacaagcgtgaaacaagggaggatttactcttgtgatgagaagttggctactagatttagcagactaaaattt

SEQ ID NO: 17904 - DNA, 201 bp, Homo sapiens
ttccttagtactcttaaagcagacaacaggcttccagcagaagaggtagataggtggtaactctgaagttgtatgagaggggaagttagtgtcttttgaamatatattgatttttgtttttgctgcttacataagtgtgtcttgttagtggacatgcaaaaaatggtccagtttcactgctaccttgccagtgctgtttta

SEQ ID NO: 17905 - DNA, 201 bp, Homo sapiens
catcctcaggctgactgtggtcaccttcttatgttgtacctagatggagattattgaatgaggagatctgtcacaaattaagctgtaatatttataattamatttttgctttggtaaacttgtgcaaaagcatcctgatttgatgtccactggttgccattctctcctgaggccattcgtggagacattgggtacttgtct

SEQ ID NO: 17906 - DNA, 201 bp, Homo sapiens
tggggcacactgtgttatacgtgggttcacaaacagctactggggttgacatttttcttttccctcctctcccttcctcaagtctcaggttaatatattcsaaaatgccctgtaaacgaaacccacacagtcccgtgcttaccatgttgttgcacctccttcatatggactttgtatgtggttgtatgtatttttataggg

SEQ ID NO: 17907 - DNA, 201 bp, Homo sapiens
gtctttctatttggaaagggtttgcatgcccagacctttctgatgttgattttacatgaaccccaaatgcactcctggaatgcctacctggctccagtgtracatgttttgcacagaagttccagcaggagaatgtgttgtatatacatccactctagactgcaaaataaatacattgaaatgaagaatgaaaacagcatt

SEQ ID NO: 17908 - DNA, 201 bp, Homo sapiens
ttgtctttctatttggaaagggtttgcatgcccagacctttctgatgttgattttacatgaaccccaaatgcactcctggaatgcctacctggctccagtrtaacatgttttgcacagaagttccagcaggagaatgtgttgtatatacatccactctagactgcaaaataaatacattgaaatgaagaatgaaaacagca

SEQ ID NO: 17909 - DNA, 201 bp, Homo sapiens
accatgagtacacgtggcaccagtgtgcaggaaacgacaggcgtccccggccacccctgggtctggaaggaggggtaaacggaaaaagaaaagcccactgytccactgatatcaaaacgcaggggaggaaggcacagattatccctccccttgccatttcttcagatctcaggaggaaatctgcggggagaggagagggat

SEQ ID NO: 17910 - DNA, 201 bp, Homo sapiens
ggctagtacagaaggcgacggaagccacaggacccagggcaaaaaacattttaatccttttagccagctcagggatctgtgaaaatgctataaaacctgtragaacaaaggacagaaaacaggaattccatcatctgggatttccttctcagaaaacacaaaggccgtcactcgcgacgccctctcgcggaggcctgagac

SEQ ID NO: 17911 - DNA, 201 bp, Homo sapiens; identical to SEQ ID NO: 17769

SEQ ID NO: 17912 - DNA, 201 bp, Homo sapiens; identical to SEQ ID NO: 17770

SEQ ID NO: 17913 - DNA, 201 bp, Homo sapiens; identical to SEQ ID NO: 17771

SEQ ID NO: 17914 - DNA, 201 bp, Homo sapiens; identical to SEQ ID NO: 1903

SEQ ID NO: 17915 - DNA, 201 bp, Homo sapiens; identical to SEQ ID NO: 1907

SEQ ID NO: 17916 - DNA, 201 bp, Homo sapiens; identical to SEQ ID NO: 1899

SEQ ID NO: 17917 - DNA, 201 bp, Homo sapiens; identical to SEQ ID NO: 857

SEQ ID NO: 17918 - DNA, 201 bp, Homo sapiens; identical to SEQ ID NO: 1901

SEQ ID NO: 17919 - DNA, 201 bp, Homo sapiens; identical to SEQ ID NO: 17776

SEQ ID NO: 17920 - DNA, 201 bp, Homo sapiens
aactcagctccggaggaaaaagagtcctctaaagtataataaaaagaaaaaaagaaaaagagtcctgccaatttcactttctagtttcactttcccttttrtaacgtcagctgaagggaaacaaacaaaaaggaaccagaggccacttgtatatataggtctcttcagcatttattggtggcagaagaggaagatttctga

SEQ ID NO: 17921 - DNA, 201 bp, Homo sapiens; identical to SEQ ID NO: 17777

SEQ ID NO: 17922 - DNA, 201 bp, Homo sapiens; identical to SEQ ID NO: 851

SEQ ID NO: 17923 - DNA, 201 bp, Homo sapiens; identical to SEQ ID NO: 17778

SEQ ID NO: 17924 - DNA, 201 bp, Homo sapiens; identical to SEQ ID NO: 17779

SEQ ID NO: 17925 - DNA, 201 bp, Homo sapiens
atctctttgagtatcttttcaagttgccattaccggcacaaaaaaagaaatctaaccccaaatgagagaatgctaattataatcgccactagctgtggagytgctgccgtaggctgggcaccaaaatgaatgtttaatccccggcaaggaaggtgttgtactccataggtagtagactcaaggcaatagtggctggaaaga

SEQ ID NO: 17926 - DNA, 201 bp, Homo sapiens; identical to SEQ ID NO: 1902

SEQ ID NO: 17927 - DNA, 201 bp, Homo sapiens; identical to SEQ ID NO: 1900

SEQ ID NO: 17928 - DNA, 201 bp, Homo sapiens; identical to SEQ ID NO: 1909

SEQ ID NO: 17929 - DNA, 201 bp, Homo sapiens; identical to SEQ ID NO: 17784

SEQ ID NO: 17930 - DNA, 201 bp, Homo sapiens
catctacaaccatctgatctttgacaaacctgacaaaaacaagcaatggggaaaggattccctatttaataaatggtgctgggaaaactggctagccatakgtagaaagctgaaactggatcccttccttacaccttatacaaaaattaattcaagatggattaaagatttaaatgttagacctaaaaccataaaaaccct

SEQ ID NO: 17931 - DNA, 201 bp, Homo sapiens
ccagcctgaccaacatggagaaaccccgtctctgctaaaaatacaaaaaaattagccgggcatggtggtgcatgcctataatcccagctactcaggaggcygaggcaggagaatcgcttgaacccaggaggcagaggttgcggtgagccgagatcgtgccattgcactccagcctgggtaacaagagcgaaactccgtctc

SEQ ID NO: 17932 - DNA, 201 bp, Homo sapiens
ggctctccttgagggccccacccctgcagcaaacttctgcctggacattcaggcttttccacacatcctctgaaatacaggtggaggttcccaaacctcarttcttgacttctgtgcacccacaggctcaacaccacatggaaactgccaaggcttagggactgtaccctgtgaagccatggcctgagctgtactttaacc

SEQ ID NO: 17933 - DNA, 201 bp, Homo sapiens
tcaccgtgttagccaggatggtctcgatctcctgacctcgtgatccgccggcctcggcctccaaaagtgctaggattacaggcgtgagccaccgcgcccgrccgtgaactctgaacaggagcaaacgttatccccttcagtgtgcattggcaaagcaaggccactgcttctacttacaactttgtacttcttcatgatagg

SEQ ID NO: 17934 - DNA, 201 bp, Homo sapiens
ctgctaatccctgagccttaaagggaaaatatagacatcagctgtcagtcttttggctgtacaataagaaggactggacaatgagaactatttttccagaytggttccattgatgcttttttcctgaagtcaggaagtgctttgccagtaagggactgcctttcaaagttcttttgatataggaaaatgcctctggccacc

SEQ ID NO: 17935 - DNA, 201 bp, Homo sapiens
tcctgccaaccaagaggctgcatataaattcctagaggaaaatgtatctgcctgaacaggtttttaatgcagatgaaagtgttccattctaacaaaaaaawatatatatatatatcccacaaaggacgtttattagtaaggaagagaaacaagcaccaggatttaaggcaagaagggataggctaactctactgttctgtg

SEQ ID NO: 17936 - DNA, 201 bp, Homo sapiens
aggtagctgggtgtggtgccccacacctgtaatcccagctattcaggaagctgaggcaggagaattgcttgaacccgggaggcagaggttgcagtgagccragattgcactgctgcactccagcctaggggacagagggagactcagtctcaaaaaaaaaaaaaaaagggaaccctaatgtaaactacggactttgtgtga

SEQ ID NO: 17937 - DNA, 201 bp, Homo sapiens
tcaagaataccacagatgatcacccttaagatattataagatgggcagagagcacagacttccactcttaactcttgcctggctgatcacaaatcatatcscagcccaggtccagggacctacttgcttccttacaaacgaggagaccctggttctaagacttttgctgagagcagaaataacctcccccatcctcctgct

SEQ ID NO: 17938 - DNA, 201 bp, Homo sapiens
ccctagctgatttaacacctggaaacttgcttgtaggttcataagtggcagaaagactgtggccctaaaggagttcatctctcagaatttagaatatagamcctacaccaggaacccataaagagttgccctctggtattcacagacatagtatatgcaccttggaccatttccaaactcaaagatccagacctgctaggg

SEQ ID NO: 17939 - DNA, 201 bp, Homo sapiens; identical to SEQ ID NO: 1910

SEQ ID NO: 17940 - DNA, 201 bp, Homo sapiens; identical to SEQ ID NO: 1908

SEQ ID NO: 17941 - DNA, 201 bp, Homo sapiens; identical to SEQ ID NO: 17789

SEQ ID NO: 17942 - DNA, 201 bp, Homo sapiens; identical to SEQ ID NO: 17790

SEQ ID NO: 17943 - DNA, 201 bp, Homo sapiens; identical to SEQ ID NO: 17791

SEQ ID NO: 17944 - DNA, 201 bp, Homo sapiens; identical to SEQ ID NO: 17792

SEQ ID NO: 17945 - DNA, 201 bp, Homo sapiens; identical to SEQ ID NO: 17793

SEQ ID NO: 17946 - DNA, 201 bp, Homo sapiens; identical to SEQ ID NO: 17794

SEQ ID NO: 17947 - DNA, 201 bp, Homo sapiens; identical to SEQ ID NO: 17795

SEQ ID NO: 17948 - DNA, 201 bp, Homo sapiens; identical to SEQ ID NO: 17796

SEQ ID NO: 17949 - DNA, 201 bp, Homo sapiens
ggtttccagcttcatccatgtccctgcaaaggacacaactcatccttttttatggatgcattgtattccatggtgcatatgtgccacattttctttacccrgtctattgggttggttccaagtctttgctattgcaaatagtgccgcaataaacatatgaaccaacatggcacatgtatacctatgtaacaaacctgcaca

SEQ ID NO: 17950 - DNA, 201 bp, Homo sapiens
ccatccattaaacaataatatgtgtattacttttgcccattttacagctgggtaaactaaattattatccagagcttggaaagctaaacagctcacagatycctccagggcctggcttcgtatgtttagtgtgaggcaaaaaggaaattctggctcaatgatatggcccctggaaaattcgagaactagtaaagtaaacag

SEQ ID NO: 17951 - DNA, 201 bp, Homo sapiens
ttgttggaaacaccatatgtcatgttaattttgctacacaagagtctctgctttgtgcagctacaggatggaggaaacgcttctagctaacaattccttcrttatcaaattagtcatgacaactatactccctaggtttttatgaatatttacatcatggttgggaagtattataaaaatgaaaagaaaaaaaaaacctct

SEQ ID NO: 17952 - DNA, 201 bp, Homo sapiens
tataacaacctctgaactcgaagtatctcatgagactctgttgttggaaacaccatatgtcatgttaattttgctacacaagagtctctgctttgtgcagmtacaggatggaggaaacgcttctagctaacaattccttcattatcaaattagtcatgacaactatactccctaggtttttatgaatatttacatcatggt

SEQ ID NO: 17953 - DNA, 201 bp, Homo sapiens; identical to SEQ ID NO: 860

SEQ ID NO: 17954 - DNA, 201 bp, Homo sapiens; identical to SEQ ID NO: 859

SEQ ID NO: 17955 - DNA, 201 bp, Homo sapiens; identical to SEQ ID NO: 858

SEQ ID NO: 17956 - DNA, 201 bp, Homo sapiens; identical to SEQ ID NO: 856

SEQ ID NO: 17957 - DNA, 201 bp, Homo sapiens; identical to SEQ ID NO: 855

SEQ ID NO: 17958 - DNA, 201 bp, Homo sapiens; identical to SEQ ID NO: 852

SEQ ID NO: 17959 - DNA, 201 bp, Homo sapiens; identical to SEQ ID NO: 8053

SEQ ID NO: 17960 - DNA, 201 bp, Homo sapiens
aaggagctctggtatatgtgaccaacaggcatatgaaaaaatactcaacatcactcaaccccaaggaaatgcaaataaaaatcacaatgagatatcatctmaccccagttagtatggctattattaaaaaaaaaaataacaaatgctggcaaggatgcaggggaaagggaactcttatacactgttggtaggaatgtaaat

SEQ ID NO: 17961 - DNA, 201 bp, Homo sapiens
gatgagaacttcccaagtctagtaagagatttagacatccagatacaggaggcccagcaatccccaatcagatacagtgaaaaacgttcttctccatggcrcattatagtcaaactatctaaagtcagtgacaaaaagaaaattttaaagacagcaaaggaaaagcatctcatcacctataaaggagctctggtatatgtg

SEQ ID NO: 17962 - DNA, 201 bp, Homo sapiens
taaagaaaaaaaaagaattaaaaagtatgaacaaagtcttcacgatctatgggacaccataaggtgaccaaatatatgaattatcagtatctccaaaggcraagggaaactgaaagggtttgaaaacctatgtaatgaaataatagatgagaacttcccaagtctagtaagagatttagacatccagatacaggaggccca

SEQ ID NO: 17963 - DNA, 201 bp, Homo sapiens
aggtcttttgaaataatccaataagacgaaaataaagaaaaaaaaagaattaaaaagtatgaacaaagtcttcacgatctatgggacaccataaggtgacmaaatatatgaattatcagtatctccaaaggcgaagggaaactgaaagggtttgaaaacctatgtaatgaaataatagatgagaacttcccaagtctagta

SEQ ID NO: 17964 - DNA, 201 bp, Homo sapiens
caaaatctttcttcagcttaatctctcccactctagaagcagccctgagaaacatcgcccattatctctccatgccacccccaaaatttttgctgccaacrcttcaatactattttatgctatttttcttattaatataagaagacaggaatgtcaggcctctgagcccaagctaagccaacatatcccctgtgacctgca

SEQ ID NO: 17965 - DNA, 201 bp, Homo sapiens
agaatgcccccccaccctgatatacaattaagtacttctttcccaggccttgatatctaagcaagttctttttagtaattttccatccactccttcatccrgcctgttgactacaaatccacacttgttgtattcagtgttgagtttagtctttctcccatattgcaatagtctgtctctctcattgtaatagtcttgaaa

SEQ ID NO: 17966 - DNA, 201 bp, Homo sapiens
gctgagccactttatcaagaatgcccccccaccctgatatacaattaagtacttctttcccaggccttgatatctaagcaagttctttttagtaattttcyatccactccttcatccggcctgttgactacaaatccacacttgttgtattcagtgttgagtttagtctttctcccatattgcaatagtctgtctctctca

SEQ ID NO: 17967 - DNA, 201 bp, Homo sapiens
tatgtgtcggttggaagtctgaagttttcttcaccatctggtttcactaaagatagaatgtgtgaggatgttttatctgatgccttcttcctcgttattaytccaaagtagaaatttctgactaagctgctccagtgttttttaatggtatcatttctgaagttggtttcaatggccaattttggaattcatggctgaata

SEQ ID NO: 17968 - DNA, 201 bp, Homo sapiens
agttcacagtacaacctttctactccatagtataattttgtagaggatgttaagctttaaaaggtagagttgtaaaaggtaggctctggatagggctgggwctagataggtaaggtaagcaaggcacttaatgcacattaagaagacactcactctcacgtcttgcaaatgtgtggtcagcacttgaactacctgcagagt

SEQ ID NO: 17969 - DNA, 201 bp, Homo sapiens
tactatctttgatgctcaagtacatagcttgtgtgagaataatgccagctcagttcacagtacaacctttctactccatagtataattttgtagaggatgytaagctttaaaaggtagagttgtaaaaggtaggctctggatagggctgggactagataggtaaggtaagcaaggcacttaatgcacattaagaagacact

SEQ ID NO: 17970 - DNA, 201 bp, Homo sapiens
gtatgtccagatataccagatgcttcataaataactttctaactgcagtgtatggagattatgttatgattgcatctattttaatactatctttgatgctsaagtacatagcttgtgtgagaataatgccagctcagttcacagtacaacctttctactccatagtataattttgtagaggatgttaagctttaaaaggta

SEQ ID NO: 17971 - DNA, 201 bp, Homo sapiens
gttttcagtcaggatgagtcagtagacatttttgcatgtgatttagagggtggaaaagaagcaactatttagcctttttatgcttggaacgttcaagcagktgtgtttgtgaaccacagaatactatggcccatctcctgggttaactccttggtgtaccagacctgcaactactccaacttcccctgaatcctccttcag

SEQ ID NO: 17972 - DNA, 201 bp, Homo sapiens
aatctagcaggttgagaggaattttccctaatccttgaacaatgacaagagactagggataaggatggccaccagaactcccagcaggtactggaatttcygtgtctgatgggtgggaggtgacctctgttgagacagactttattggagttttcttcctcctataacacacaaagatgcagaatgaattaatttgttgat

SEQ ID NO: 17973 - DNA, 201 bp, Homo sapiens
ggaaaatgcttttgactgatgtctgtcccttagtatcctgggctcactgaccctataaacaatcccgtttattgctgctgaaatctagcaggttgagaggwattttccctaatccttgaacaatgacaagagactagggataaggatggccaccagaactcccagcaggtactggaatttccgtgtctgatgggtgggagg

SEQ ID NO: 17974 - DNA, 201 bp, Homo sapiens
actgttgggttgaacatctgagaaactaggacacatcatgtctttatagtgatttgattaaaatataaaggatttttttggaaaatgcttttgactgatgyctgtcccttagtatcctgggctcactgaccctataaacaatcccgtttattgctgctgaaatctagcaggttgagaggaattttccctaatccttgaaca

SEQ ID NO: 17975 - DNA, 201 bp, Homo sapiens
agagctgatggttaagaacattttgacaccctggaaagtgttgtgctgagaaaaatattgtgaattggggagctgtgaggagcctgctagggaaagaagartcacaactgacaggacagtactcataatctagtcaaaggttttagccaatgtaaagacagataacatgtgtgggtattcattgagatattcctgagctgt

SEQ ID NO: 17976 - DNA, 201 bp, Homo sapiens
gattgcaaaaagtttctcccattctgtaggttgtctggtcactctgaagataggtaaaagaaagaagttataaacactagctacaaccttgtgccctgtcwtagaaatgaagactaaacagttaacatcagaattcctcttttggtggaggggagggaagcataaggaattcctttctatttttctctttgttttttgtaa

SEQ ID NO: 17977 - DNA, 201 bp, Homo sapiens
caggattgtagttaggagtgcagactcaggggtcaggctgcccacattcaaggcaaaatctacaatttgctggctgtgcaaactagtgtaagatttttaasttcttcttgagttagagttctcttctgtaaaatagaattaatattgtctagggacatctcaaattttggataagataatatgtgttaagtgcttagaata

SEQ ID NO: 17978 - DNA, 201 bp, Homo sapiens
ccttcagctgtgatgtatgttttctacatatgatatatgttttctatcctcagattctcacataaaaaataccttgtacagtaactttttaatcaaaacayagcatcgtaggtggagactgaaagcctgctgttgtttgttgttgctgtcatttaacagctgacgcagatattccagtgatgctacggtgctgtttagtta

SEQ ID NO: 17979 - DNA, 201 bp, Homo sapiens
ggaggaagtgtatgctgattggtccatgggcggccatgggtgggcccagaaaaagcaccataagttctcactctgggctgtggacaccacctggaactgayaggttggcccccaggcttcaggccctccctggcttcaaggtggtgcttcactgggactgcccctttctgcccaggggcctatctgcttcctgctgccatc

SEQ ID NO: 17980 - DNA, 201 bp, Homo sapiens
aagagggtggcacagccctggcttggggagcctctaggtttgggctcctggaagggcctctgctcttctctgctgcccttctctccttctcattgctggcracatggcaagcagggggggtggtaggggcatgtttcagccctatttgtgttacagctctttcagtcccaccattcagggggtcctgagttcttgtcccac

SEQ ID NO: 17981 - DNA, 201 bp, Homo sapiens
cctgagctttactcaggcctgctgggcttgttttgcccacttggcctggcaggctgtgcttggctcatgctaaccaaccagatcccacgcctccaaggtcmagccaggtgtagagtggtgagaggtgcataagcaagtgagtgtggggtccagccactgtggagagtcagcaagccagctgctctggtggggtgggcagct

SEQ ID NO: 17982 - DNA, 201 bp, Homo sapiens
atgggctgaacttgctcagattcattaagaaattctgtctctctattgctgccctgcaatgtgctattcctgagctcccctccctatccctgaacagcccrgttgatttttttgccgtaaccaatccaattccaatctcgcttttcaattaaaagtttctctccctcttttacttcaggcctgcttaagatgaagtccagc

SEQ ID NO: 17983 - DNA, 201 bp, Homo sapiens
ggaggagaggaggctggatgacagagaggcatggggaaacttggagggaataaatatatttgttatcttcactgtagtgatggtttcacaggtatatacayatgtgaaaactcatcaaaatgtacaatttaaatatgtgcagtttaatcttcatctgtcatacttcgataagcctatttaaaaaaatactaatagttacta

SEQ ID NO: 17984 - DNA, 201 bp, Homo sapiens
catagagttatcatatgacccatcaactgcactttcaagtatatacccagtagaaataagaactgatgtttacataaaaacttgtacatgaatgttcatargagcatcactcaatatagccaaaaagtggaaacaaccatatgttcatcaactgatgaagacatgaataaataaaatttgatatgttcatacaatggaata

SEQ ID NO: 17985 - DNA, 201 bp, Homo sapiens
ttaagaaatttgagttttgtcaaagattgtttaaatacaacacaaaaagcacaacctataaaagaaaaaatatcaacaaattggaccccttcaaagtaaartaacttttttttctaaaaaaaagacgttttataaccatgatgagataccacttcatacccactaggatagctataataaaaaatacaggtaataacaagt

SEQ ID NO: 17986 - DNA, 201 bp, Homo sapiens
ttgaaagggaaaaaattaaaggaattaccacaattgaaaacagaatagcatctgcaggagctgctttcattcagcggttttcctacagaacctgtatcaaycgcccagaggaaggtccatgagagtaacagctaaagctactcagctgaaaatctcacccagttaagttttccttccaacacaacactacatacttagtat

SEQ ID NO: 17987 - DNA, 201 bp, Homo sapiens
aaggccactgcttctacttacaactttgtacttcttcatgataggaaggattgtacagccccaggctattttttatcataaatgcaacctcccaaaagtcyattattactagagaataaggagtaaattgaaagggaaaaaattaaaggaattaccacaattgaaaacagaatagcatctgcaggagctgctttcattcag

SEQ ID NO: 17988 - DNA, 201 bp, Homo sapiens
ttcttatttaaaaaattattttaaaagttggaaaaattgggaggcaaaagaaaagctttgagctaagaagtaaaacttaactttaagaccctgttatcagrtcatactctcctggctcactgtgaatttctctgcgagtccctaagcttgcctgattcttcagctgggtcactgcaacatctattttaaagttgctgtttt

SEQ ID NO: 17989 - DNA, 201 bp, Homo sapiens
accgggcacaaataaatgctcatttctttcttttctaaatatcccagctagaactgtcaatgtataaaacactttctttgttttgagagatcccctgctgrccaataaagtataaaaaatattaacttgtttttatcaatggactaaaataattacatagaatgtcaaggtgggatggaagaaaagttgaacaaaataggg

SEQ ID NO: 17990 - DNA, 201 bp, Homo sapiens
ggtgtctggttaaacttcagtttcatcattctagcatgttttataccaaatttgcctaactttaccacatcttgggcctctttgtttccatcctgcctacygggcacaaataaatgctcatttctttcttttctaaatatcccagctagaactgtcaatgtataaaacactttctttgttttgagagatcccctgctggcc

SEQ ID NO: 17991 - DNA, 201 bp, Homo sapiens
caagcaaaggagcagataaactatgttctccaggctttaagaaagcatttgtcattgaaattttagtctgctaaatctagtagccaacttctcatcacaasagtaaatcctcccttgtttcacgcttgtgttccacctaccggtgtctggttaaacttcagtttcatcattctagcatgttttataccaaatttgcctaac

SEQ ID NO: 17992 - DNA, 201 bp, Homo sapiens
tttgcattcaaatggaggcaagggaaaaataagaatctgtgtgtgtatttgtttctaatgagatttttggaaataaaaagattttaaaatgaagttatttyaaaaagatacacaaaaaagcaggaagtagggagtgagagagaagggaggcatttcactgtatgtcttctaattctctgatttttagattatgtgaattca

SEQ ID NO: 17993 - DNA, 201 bp, Homo sapiens
tcatgcacttctggaagatgtgctttatgtattgtatggaaagatctccaagatattaagtaaaaaattcaaagaacaaaatagtgccatcttttgcattmaaatggaggcaagggaaaaataagaatctgtgtgtgtatttgtttctaatgagatttttggaaataaaaagattttaaaatgaagttatttcaaaaagat

SEQ ID NO: 17994 - DNA, 201 bp, Homo sapiens
tcatagtgatagtaattatcaggacacatgcacatgaaaatcagcttggcaatatatatcaaaatcacaaatgcatatatcctgtgatccaaaaattctayttctggacatgtatcatgtaaataaacttgcacacacaaaagcttatttacagcagcaatatttgttaacagaagactgaaatagcacaaatatgcatta

SEQ ID NO: 17995 - DNA, 201 bp, Homo sapiens
atgttttaatacattttgtaattacttgtaaatagtatgaatgtatagcagtatttttgtgtgtattaaaagcattaatttcttaaactatataagcaaastgaatttccataatcctgtcttgaaattctttctttctgttagtatacgaggagccttgaaaatggaaatggctcaagactctctcagctgctgagctta

SEQ ID NO: 17996 - DNA, 201 bp, Homo sapiens
agcctgagctcagcccaagtcaccaagctcaggcattgattaatgaaaccatgtctgttcggcaccaccaggggtgaggaattacatcccagattaccaasgcctatgtgtagcccgttagagcactgcagtgattcaaaaaatagtttctttagaagtgaaggatttttctataaggaaagaaaaatctagaaatcaacc

SEQ ID NO: 17997 - DNA, 201 bp, Homo sapiens
tgctccattaggcaaaggttctgaatgcaatcccctacccaatgcgccatcagagtgctacatgagcctgagctcagcccaagtcaccaagctcaggcatygattaatgaaaccatgtctgttcggcaccaccaggggtgaggaattacatcccagattaccaacgcctatgtgtagcccgttagagcactgcagtgattc

SEQ ID NO: 17998 - DNA, 201 bp, Homo sapiens
aatattttaaataaataaatgttgtaaaagaaattgtatcacctgcacttactatactgcatatatttcacaggccttatcaaattttcacaacagcctaygaagtagccagtattattcttcctgtttaataattgaataagtcaaaacttcaagaggtaaagaaaattgccaaggtcacacagccagttaaatagtaga

SEQ ID NO: 17999 - DNA, 201 bp, Homo sapiens
gcaggacatctaagtcagatactttccactttccacagtgtgactttatcagggacatcatagctgttctctagcctgagaagagggccaagtgggcagaracagtcacgggctgtgtgactcctgccttcactacccatcagctgctttatcttgggcaagttaattaaccctataaaccttggtttcctcatctgtaaa

SEQ ID NO: 18000 - DNA, 201 bp, Homo sapiens
ccaactcctcctcttcctcctcttccttagcctgttccaacataagaatgaagacctttatgatgatccacttccacttaatgaatagtaaatacatcctmttttccttatgatttccttataacattttcttttctctagcttacttattgtatatatggaatataatacatataacatataaaatatttgttaattggc

SEQ ID NO: 18001 - DNA, 201 bp, Homo sapiens
gaccaactcctcctcttcctcctcttccttagcctgttccaacataagaatgaagacctttatgatgatccacttccacttaatgaatagtaaatacatcytcttttccttatgatttccttataacattttcttttctctagcttacttattgtatatatggaatataatacatataacatataaaatatttgttaattg

SEQ ID NO: 18002 - DNA, 201 bp, Homo sapiens
agaccaactcctcctcttcctcctcttccttagcctgttccaacataagaatgaagacctttatgatgatccacttccacttaatgaatagtaaatacatyctcttttccttatgatttccttataacattttcttttctctagcttacttattgtatatatggaatataatacatataacatataaaatatttgttaatt

SEQ ID NO: 18003 - DNA, 201 bp, Homo sapiens
aacagaagatgatttgatggagacgagtgcttctaaaacagcaccagacgatgggaaagaagacatgggagatgcagtgctagaaaacaaactgatattaracaattcaggagaagggtggcaattgcaattattcaagacttcctttacaacactgacgcttctatgacacaggcactgaaactaaagcaaatgatggaa

SEQ ID NO: 18004 - DNA, 201 bp, Homo sapiens
ttgcagtgagccgagattgcactgctgcactccagcctaggggacagagggagactcagtctcaaaaaaaaaaaaaaaagggaaccctaatgtaaactacrgactttgtgtgaatgtaggttcatcagctgtaacaattacaattccactctgtgagggatgttcataacaggggagtgtgggggcagagggtgtatggga

SEQ ID NO: 18005 - DNA, 201 bp, Homo sapiens
aagaaattataaaatgtttttacaatttttttcttataaaatgtttttacaatttgctttcgtaattgcatttctcacaataattcctaacaaaataaacmaaaggaaagaaaaagatcacacataatgagacatcactatacacgtatcagaatgagcaacatccaaaaacgctgaaaacaccaactgctgaagaggatg

SEQ ID NO: 18006 - DNA, 201 bp, Homo sapiens
tgggacctgaaaaacattcattgtttaggaggcagtagcaccaagcttcaaaacaaatatgatatcttgctaaatagaacattcgtaaaagatccataagsaaataatgaactagaaataaattgaaagattgacatagtgatgtactcacatataatgttagtaaagaatttttttaaaacagcactggcaaggtagcag

SEQ ID NO: 18007 - DNA, 201 bp, Homo sapiens
aatgcttaaattattttctcccagactctccttgctctccctgtgaggtgggcagagctgtactgacgcatgctaaccatgagtacacgtggcaccagtgygcaggaaacgacaggcgtccccggccacccctgggtctggaaggaggggtaaacggaaaaagaaaagcccactgctccactgatatcaaaacgcagggga

SEQ ID NO: 18008 - DNA, 201 bp, Homo sapiens
acacaggagtatttgttttataagcctggatggtagccaatccaagaattccactataattccaactctcattacttttttaatgcaatgatttattaaayagtgtactttttaaagcaatttggtgattctgatgcaagcagtgactgccaggtgtttggaaattactattcaagacacctacagtgtcttggtttaggg

SEQ ID NO: 18009 - DNA, 201 bp, Homo sapiens; identical to SEQ ID NO: 17797

SEQ ID NO: 18010 - DNA, 201 bp, Homo sapiens; identical to SEQ ID NO: 17798

SEQ ID NO: 18011 - DNA, 201 bp, Homo sapiens; identical to SEQ ID NO: 17799

SEQ ID NO: 18012 - DNA, 201 bp, Homo sapiens
tcatgtactatgcttatgagtggggtgactaaataatctgtacactaaagcctcatgacatgcaatttacctaaataacaaacctgtacgtgtatacctgmacataaaatataagttaaaaaaaaacctacaatgagatatgatcttaccctggttaaaattgcttttatccaaaagacaggcaataacaaatgctggcaa

SEQ ID NO: 18013 - DNA, 201 bp, Homo sapiens
attccctgttcaataaagggtgctgggataactggctagccatatatagaagactgaaattggaccccttccttacatcatatatggaaatcaactcaagmtggatgaaatgtaaaacctaaaaatattaaaaccctggaagataacctaggaaatacgattctcaacatagaaaccagcaaagatttcatgatgaagaca

SEQ ID NO: 18014 - DNA, 201 bp, Homo sapiens
tgctcaaatacccaaagcaatcctaagcaaaaagaacaaagctggaggcatcatgttacctgactttgaactatactataaggctacagtaaccaaaatascatggtactggtacaaaaacagacacatagaccaatagaacagaatagagagcccatgttacctgactttgaactatactacaaggctatagtaaccaaa

SEQ ID NO: 18015 - DNA, 201 bp, Homo sapiens
tccctgtgtgcagatgacatgattgtatatttagaaaaccccatagtctcagcccaaaagctccttaagctgataagcaacttcagcaaagtctcaggatmcaaaatcaatgtgcaaaaatcacaagcattcctatacaccaataacagacaaacagagagccaaatcatgagtgaactcccattcacaattgcttcaaag

SEQ ID NO: 18016 - DNA, 201 bp, Homo sapiens
tccctaactcatttgatgtggccagcatcatcctgataccaaagcctggcagaaacacaacaaaaaaagagaatatcaggccaatacccctgatgaacatygatgcaatgcaaatatcctcaataaaatactggcaaactgaatccagcagcacatcaaaaagcttatccaccatgatcaagttagcttcatcactgggat

SEQ ID NO: 18017 - DNA, 201 bp, Homo sapiens
gagaacaaagacacaacacaccagaatctctgggacatatttaaagcagtgtatagagggaaatttatagcactaaatgcccacaagagaaagcaggaaakatctaaaattgacacctaatattacaattaaaagaactagagaagcaagagcaaacacattcaaaagctagcagaaggcaagaaataactaagatcagag

SEQ ID NO: 18018 - DNA, 201 bp, Homo sapiens
gctgcagacaatcggtaataacaaatttcttcgagctaagggaggatgtttgaacccatggcaaagaagctaataaccttgaaaaaagattcgacgaatgrctaactagaataaagagcgtagagaagaccttaaatgatgtgatggagctgaaaaccatggcatgagaactatatgacgcatgcacaaccttcagtagcc

SEQ ID NO: 18019 - DNA, 201 bp, Homo sapiens
agaaggctgcagacaatcggtaataacaaatttcttcgagctaagggaggatgtttgaacccatggcaaagaagctaataaccttgaaaaaagattcgacraatggctaactagaataaagagcgtagagaagaccttaaatgatgtgatggagctgaaaaccatggcatgagaactatatgacgcatgcacaaccttcag

SEQ ID NO: 18020 - DNA, 201 bp, Homo sapiens
ccttcattatcaaattagtcatgacaactatactccctaggtttttatgaatatttacatcatggttgggaagtattataaaaatgaaaagaaaaaaaaaacctctcagggtagtatcaactccttcagagctcaaagcataaatatataatccatccattaaacaataatatgtgtattacttttgcccattttacagct

SEQ ID NO: 18021 - DNA, 201 bp, Homo sapiens
ccccatcctggacgcaatccaaatgcatgttaaagagtcttccctattaagtaaagaataggaagagacaagaaggcccaaaatctctattatttttcaakaggcctctaatggaaaacacaaatcacaccaactgcaaaggtaaactcatttcattggatcaaaatggacaagtgtatgtttcaggggaagatctagctc

SEQ ID NO: 18022 - DNA, 201 bp, Homo sapiens; identical to SEQ ID NO: 8054

SEQ ID NO: 18023 - DNA, 201 bp, Homo sapiens; identical to SEQ ID NO: 8055

SEQ ID NO: 18024 - DNA, 201 bp, Homo sapiens
cctggagatggcagccttttctttatcttcacatggcctttcctctgtgtgagacgagagagagagagagagagagagagagagagagagagagagagagrtatctgaggtctcttctttttcttcttgtttgtatgaagacgtcagtgttaccagattaggggttaccagattaggggccccacccttaagacctcattt

SEQ ID NO: 18025 - DNA, 201 bp, Homo sapiens
tgctagaagtccaagttggtttctggtgagacctctcttcctgacctggagatggcagccttttctttatcttcacatggcctttcctctgtgtgagacgagagagagagagagagagagagagagagagagagagagagagagatatctgaggtctcttctttttcttcttgtttgtatgaagacgtcagtgttaccaga

SEQ ID NO: 18026 - DNA, 201 bp, Homo sapiens
atgctagaagtccaagttggtttctggtgagacctctcttcctgacctggagatggcagccttttctttatcttcacatggcctttcctctgtgtgagacgagagagagagagagagagagagagagagagagagagagagagagatatctgaggtctcttctttttcttcttgtttgtatgaagacgtcagtgttaccag

SEQ ID NO: 18027 - DNA, 201 bp, Homo sapiens
taatccttctttaacaaacaattgctggctttgcatttctctttcctacaaaatcgctgaggccttgacttactcactgctaaaaaaaaagggggggggggactctgtatattttcacatgaagagtgctgtttttacctaaatcaatctggcctggtatatgacaacaataaaaaaaactcaaagatagagcctaaaaac

SEQ ID NO: 18028 - DNA, 201 bp, Homo sapiens
ccacccttcttcccaacccaaagcctccttcatgtcttcctttcatatccccccaccttaacccacaagtataagatacctctactccctccttggtgacygatcatgcaccccttaccatcccattaaaacctaatcacccttacaccactcaatgccaatatcccatcccacagcacgctttaaaaaggattaaagcat

SEQ ID NO: 18029 - DNA, 201 bp, Homo sapiens
gtgccctgtcttagaaatgaagactaaacagttaacatcagaattcctcttttggtggaggggagggaagcataaggaattcctttctatttttctctttkttttttgtaaaagaaattaacttgatacattttctagagtcagagtagaacatattgtccctcattataggaggaagatgagaggatgagctgagtgtcc

SEQ ID NO: 18030 - DNA, 201 bp, Homo sapiens
atggtgtgaacctgggaggcggagcttgcagtgagccaagatagcaccactgcactccagtctgggcgacagagacagactctgtctcaaaaaaaaaaaaagtataaaaatactttaaatgatttactttatttaaaaatacttagggccaggcacggtggctcacacctctaatcccagcactttgggaggctgaggcag

SEQ ID NO: 18031 - DNA, 201 bp, Homo sapiens
ttctttcttactgtattaatgatatgtctttttttatgtaaaattcttatgtgtgaattaatgtaagaaaatgactgtgtattggtagcatataaattcartcaagaatgatggtgatgccaaacaaccacagactatccacatgtgtggctgagatagtgacacctttactttctgatgatggttcagtgtacacaaaca

SEQ ID NO: 18032 - DNA, 201 bp, Homo sapiens
gaggttgcagtgagcccagatcgtgccattgcactccagccggggtgacagagcgagactctgtctcaaaaaaataaattaattaattaaaattaaaattwaaaaaatcagaagagctcacataaaaatatataatcctggcttctcttgaaaaacagagagaatgctggctcttgattacaagatgaaataaatgtctta

SEQ ID NO: 18033 - DNA, 201 bp, Homo sapiens
cttgaaccaggtaggtggaggttgcagtgagcggagatcatgccactgcactccagcatggacaacagagtgagactccatcccaaaaaaaaaaaaaaaaacagggataaggaggatgatatgtatatggtaatcaggaaaggactcttatgaagtgacacctgagcacaggcaaggaggtagttaacagccttagatact

SEQ ID NO: 18034 - DNA, 201 bp, Homo sapiens
tcagacatccctgctgtcctcgcggtccaggagcactgggcagcttcactgaccggagaccgcgcctgtccaggaaagtggacagcgcccagggaagagagtgggcttctctctgaagttgctctctgaagttgccctggttgattggcagatgccttgagccaacgcccgcagaaaaagcacccgcaggcaccccaggca

SEQ ID NO: 18035 - DNA, 201 bp, Homo sapiens
atcagacatccctgctgtcctcgcggtccaggagcactgggcagcttcactgaccggagaccgcgcctgtccaggaaagtggacagcgcccagggaagagagtgggcttctctctgaagttgctctctgaagttgccctggttgattggcagatgccttgagccaacgcccgcagaaaaagcacccgcaggcaccccaggc

SEQ ID NO: 18036 - DNA, 201 bp, Homo sapiens
tttcactatattggcaaggctggtctcagatgacttcgtgacctgcccgcctccgcctcccaaaggaattattattattattattattatttatttatttwtttatttatttatttatttatttatttattttgaggctgagtctcgctctgtcgcccaggctggagtgcagtggcgcaatcttggctcactgcaagctcc

SEQ ID NO: 18037 - DNA, 201 bp, Homo sapiens
ggtttcactatattggcaaggctggtctcagatgacttcgtgacctgcccgcctccgcctcccaaaggaattattattattattattattatttatttatttatttatttatttatttatttatttatttattttgaggctgagtctcgctctgtcgcccaggctggagtgcagtggcgcaatcttggctcactgcaagct

SEQ ID NO: 18038 - DNA, 201 bp, Homo sapiens
gggtttcactatattggcaaggctggtctcagatgacttcgtgacctgcccgcctccgcctcccaaaggaattattattattattattattatttatttatttatttatttatttatttatttatttatttattttgaggctgagtctcgctctgtcgcccaggctggagtgcagtggcgcaatcttggctcactgcaagc

SEQ ID NO: 18039 - DNA, 201 bp, Homo sapiens
gacagggtttcactatattggcaaggctggtctcagatgacttcgtgacctgcccgcctccgcctcccaaaggaattattattattattattattatttatttatttatttatttatttatttatttatttatttattttgaggctgagtctcgctctgtcgcccaggctggagtgcagtggcgcaatcttggctcactgc

SEQ ID NO: 18040 - DNA, 201 bp, Homo sapiens
tagagacagggtttcactatattggcaaggctggtctcagatgacttcgtgacctgcccgcctccgcctcccaaaggaattattattattattattattatttatttatttatttatttatttatttatttatttatttattttgaggctgagtctcgctctgtcgcccaggctggagtgcagtggcgcaatcttggctca

SEQ ID NO: 18041 - DNA, 201 bp, Homo sapiens
tttagtagagacagggtttcactatattggcaaggctggtctcagatgacttcgtgacctgcccgcctccgcctcccaaaggaattattattattattatwattatttatttatttatttatttatttatttatttatttatttattttgaggctgagtctcgctctgtcgcccaggctggagtgcagtggcgcaatcttg

SEQ ID NO: 18042 - DNA, 201 bp, Homo sapiens
gaggtcgcaatgagccgagatcacaccactgcactccagcctgggcgggcaggtgacagagtaagactctgcctcaaaaaaaaaaaaaaaaaaaaaaaaawtcagagaaattgaaaagcaaaggagttataaagagatgaatgtatgggtatggcttcatgtagctcacataactggatcggggaaatagatgcattttaa

SEQ ID NO: 18043 - DNA, 201 bp, Homo sapiens
agctacatcttacttgaacctgggaggcggaggttgcagtgagccaagattgcaccattgcattccagcctgggcaacaagaccgaaaatccgtctcaaawaaataaataaataaataagctacatctggagagataattgaataaagattagatccttcttctgataactgcttaataatttcaatcagtctgtctagaa

SEQ ID NO: 18044 - DNA, 201 bp, Homo sapiens
ttctaaagacctagactctccactctcccaatccccaaccctcttgccaaaaataaaataaagtatatataatatatcccacagaggttaaaaaaaaaaaagaaaaaacaaagcacacaagaagtcaggggcaaacccaggtgtagcaccaaggtcccataagtctcctttctattacctgggagcatatcaagactcatg

SEQ ID NO: 18045 - DNA, 201 bp, Homo sapiens
gtgattcaaaaaatagtttctttagaagtgaaggatttttctataaggaaagaaaaatctagaaatcaaccagaattctaaaataaacaatcaaagcaaaatacaagctgatggtctccttctaaagacttaactcacaagccacgctgtgaattttcagctatgactctaatagctcaatggacaacccctggggaatct

SEQ ID NO: 18046 - DNA, 201 bp, Homo sapiens
ctggagttgtacaacctgggggtgctataccctcgtgttgttaaaatagcaggaccccaggccaagagtataaaatgattcccataactttttttttttttaagagagaaaaggtctcattctatcacctagactggagtgcagtggcatgactgctcactgcagcctcaaactcctggactcaagtgatcctcccacctc

SEQ ID NO: 18047 - DNA, 201 bp, Homo sapiens
tcacctcagaagcagagacaagtacccaatgtctccacgaatggcctcaggagagaatggcaaccagtggacatcaaatcaggatgcttttgcacaagtttaccaaagcaaaaatcacacactacagaggtgtatttaaattctccaaatgaagagaaggaggcagaaaatcaaataagttttcagcggacttctacagtg

SEQ ID NO: 18048 - DNA, 201 bp, Homo sapiens
aaatttgcatcctaagctttttcaaagagttagtcattttacttgggaaataaaggtagacagataggtagctacatatatatatacatatatatatatawaatagagagagagagagagagatggatatatatagataaaataattataatatacaattggccctccatatccagttttgtatctgtggattcagccaag

SEQ ID NO: 18049 - DNA, 201 bp, Homo sapiens
atgtttaagtcagagataatcacgtttacatcacagagatgctctgggaattaaatttaaaaaacagagcaaagtgcctcacacttcagtgcatttagcaygctcaaaaatgctaattttattagtgcagggaagaggcttaagcaatgtaatctggccaaggccccatagctaccagataacagacataggactgtctga

SEQ ID NO: 18050 - DNA, 201 bp, Homo sapiens
gacaagtgtatgtttcaggggaagatctagctcaccttgatctgagtaaattaggactacatctggtgcctgggaaggaacaccacacgtattctgagtgraaggttaaaatggacaggtatgccgaccttgagagaggacccttggtacctgtgtgtgctaaagatggatgtatgtaatcttgtccttgcatgtcatgcc

SEQ ID NO: 18051 - DNA, 201 bp, Homo sapiens
agaggagagggatgggaggggtccaagtaccttaatgagatgatctggtaatcgtcctaatttggccatagggctagtacagaaggcgacggaagccacargacccagggcaaaaaacattttaatccttttagccagctcagggatctgtgaaaatgctataaaacctgtgagaacaaaggacagaaaacaggaattcca

SEQ ID NO: 18052 - DNA, 201 bp, Homo sapiens
ttccgagaccaggtatttcctctgctgttgcccatccacacgtcaaaaccagcatcagcaagaatgaagcccaggctgctgttggcaaggtttgtgacccwgttactagaatctgccagcaagccatgttgcaggaagacaactggtttgggacctgaaaaacattcattgtttaggaggcagtagcaccaagcttcaaaa

SEQ ID NO: 18053 - DNA, 201 bp, Homo sapiens
attatcaattcatatatacctgaaagcccagaattcatcctgagaaactgagagtgtcttatgtttccgagaccaggtatttcctctgctgttgcccatcyacacgtcaaaaccagcatcagcaagaatgaagcccaggctgctgttggcaaggtttgtgacccagttactagaatctgccagcaagccatgttgcaggaa

SEQ ID NO: 18054 - DNA, 201 bp, Homo sapiens
ttggtgagtatggccttagaatttaattttttggtttacattaggaatgcttccacattctctcaaacaaattttagtcacagttttgaataacgtactcyggctcagccattgcaggtctcaagccgttaggtttcattttcctcctcccaacgattttaaattagtttcactttccagtttcctcttccttcccctaaa

SEQ ID NO: 18055 - DNA, 201 bp, Homo sapiens
tagtggtgccttgagaatgacccacataatacacttgttcttggccagttttattcagaatgaagttaatggaagctggtaggtcatattttgccatctcwtcataactgtaatccaagaaaggaactctttcattgaaatagtacataaaatagagcacacacatactgagtatgcagtttgatgagttatcacaaacta

SEQ ID NO: 18056 - DNA, 201 bp, Homo sapiens
ggaaatggagtcagaggtaggggttgctggatgagccagaggaagcatttgtggcactatgtgtgactgttttgggggtactgggaagttaatatcacatstggatcaacacaagtggcataaacacagtgtcaatgtagcaggagctcaggagaccaggagcactggaacccaatttacctaggcttctgtaaagcatca

SEQ ID NO: 18057 - DNA, 201 bp, Homo sapiens
gtcatctggagttacaatgatttactttaaatcatttgaatgatgtactttatttaaaaatgcttcccagcactttgggatgctgaggcgggtggatcacraggccaggagattgagaccatcctgactaacacagtgaaaccctgtctctactaaaaatacaaaaagttagctgggcgcggtgacgggcgcctgtagtcc

SEQ ID NO: 18058 - DNA, 201 bp, Homo sapiens
ccagacgatgggaaagaagacatgggagatgcagtgctagaaaacaaactgatattagacaattcaggagaagggtggcaattgcaattattcaagacttyctttacaacactgacgcttctatgacacaggcactgaaactaaagcaaatgatggaagaattgctattctatagaaacatttctagggaaatgaaaaaag

SEQ ID NO: 18059 - DNA, 201 bp, Homo sapiens
tcctggctcctttcacaggctggtgttgagtgtctgtagctttcccaggtgcacagtgcaagctatcggtggatctaccattctggggtctggaggacagyggctctcttctcacagctgcactaggcagtgccccattggggactctgtgtgaggcctccaatcccacatttcccttctgcactgacctagcccaggctc

SEQ ID NO: 18060 - DNA, 201 bp, Homo sapiens
tgtgtgggaccccactgaaaatcagactgtccagctcacctggcagccactcccagagcccctggaactctggcccaaggctctctgattgacttcttccmagatcttctgggcttagtggctgaagactgacactgcccgatcacctgagaagcctcctggaccatcacagatgctttaggtaactcttacagtagaggg

SEQ ID NO: 18061 - DNA, 201 bp, Homo sapiens
agaggcaactagagattccatcaagtcttcatgaattccttacctctttcttcctagaacttctcttcacatacaaaatagatatagggtatcagggccartttggctttgactttcacttctcttcctcctaattgcccttcaccgcctccaagactccctcagtgaactttcttaaatgaactgcaagcctattgggcc

SEQ ID NO: 18062 - DNA, 201 bp, Homo sapiens
gaacaccaggagattatatcctgctcctggctcagagggtcccatgcccagggagccttgctcactgctggcacagcagtctgagatggaactgcaaggcrgcagtgaggctgggggaggggcgcccaccattgctgaggcttgagtaggtaaacaaagtggctaggaagctcaaactgggtggagcccaccacagctcaa

SEQ ID NO: 18063 - DNA, 201 bp, Homo sapiens
taagttcaaatctgcatgtgtacaagtttaagaataatgtgaatttatgcccgagcgcagtggcttacgcctctaatcccaacactttgggaggccaaggygggtggatcacgaggtttagagatcgagaccatcctggccaacatggtgaaaccccatctctactaaaaatacaaaaattaggtgggtatggtggtgggt

SEQ ID NO: 18064 - DNA, 201 bp, Homo sapiens
aatagacacaccagaggaattaacagaagatgatttgatggagacgagtgcttctaaaacagcaccagacgatgggaaagaagacatgggagatgcagtgytagaaaacaaactgatattagacaattcaggagaagggtggcaattgcaattattcaagacttcctttacaacactgacgcttctatgacacaggcactg

SEQ ID NO: 18065 - DNA, 201 bp, Homo sapiens
ccctctggtattcacagacatagtatatgcaccttggaccatttccaaactcaaagatccagacctgctagggattttgggttttgccaaggcattatacmgtattaagaggctaacatagtacatcatggtgactatagttaataatgatatgttgcatacgtgaaaattgctgagagagtagattttgtgttctcacta

SEQ ID NO: 18066 - DNA, 201 bp, Homo sapiens; identical to SEQ ID NO: 17800

SEQ ID NO: 18067 - DNA, 201 bp, Homo sapiens; identical to SEQ ID NO: 17801

SEQ ID NO: 18068 - DNA, 201 bp, Homo sapiens; identical to SEQ ID NO: 17802

SEQ ID NO: 18069 - DNA, 201 bp, Homo sapiens; identical to SEQ ID NO: 17803

SEQ ID NO: 18070 - DNA, 201 bp, Homo sapiens; identical to SEQ ID NO: 17804

SEQ ID NO: 18071 - DNA, 201 bp, Homo sapiens; identical to SEQ ID NO: 17805

SEQ ID NO: 18072 - DNA, 201 bp, Homo sapiens; identical to SEQ ID NO: 8056

SEQ ID NO: 18073 - DNA, 201 bp, Homo sapiens; identical to SEQ ID NO: 8057

SEQ ID NO: 18074 - DNA, 201 bp, Homo sapiens
atcagtacattccacaaagaggaagttcttctaactcactacgcagctgggcttggctcttactcaagagcattttggggtgaaaatatctaagtttaccrgcccttgtgcaaatctgagatgaaggactacattaaaagtaaaattcaccttagcaggaagtggggtttgctattctgtgtatatctttaacagtatctg

SEQ ID NO: 18075 - DNA, 201 bp, Homo sapiens
taattttctgacctcaatctttgaggtactattattttcttttgggcctatatacatgattaccccctttgtgactaagggtatgaataaggaaaatacakttcttctatcattacaaaacactatggctgtacattgtgatttggggatgtcaaataccagggcaacaagcagggatttaaaatatggtggggattctgg

SEQ ID NO: 18076 - DNA, 201 bp, Homo sapiens
attctatataaatgaaatctattgttctaggaaatatgaacagggcctatattccaggaaaaagacacatatatatttgtagcaacgaggttaggcagaaytctttctaataagtttcattttctcaaaatagaaataacaccaggagaaagttggttttccttttcagttgctattttgcaatcacattgcatgcatagt

SEQ ID NO: 18077 - DNA, 201 bp, Homo sapiens
catttctaatccttctttaacaaacaattgctggctttgcatttctctttcctacaaaatcgctgaggccttgacttactcactgctaaaaaaaaaggggkggggggactctgtatattttcacatgaagagtgctgtttttacctaaatcaatctggcctggtatatgacaacaataaaaaaaactcaaagatagagcct

SEQ ID NO: 18078 - DNA, 201 bp, Homo sapiens
tgcaacagaaatactaaataatggctagaggagctagcgagtggcaggtctgaggtcgaacgaaggcagcctagcccccagagccctgtctcgaccctccrtctcattcactgctgaatccctagtactcaccccagagctcatcagttggcttcactaaatgtttattgaatatatacctaatggctgtttttattagat

SEQ ID NO: 18079 - DNA, 201 bp, Homo sapiens
gtaggggcatgtttcagccctatttgtgttacagctctttcagtcccaccattcagggggtcctgagttcttgtcccacatccaggaagaatgaaatatgyagacgactggagggtgagcaaggtgaagaagtcctttattgagcaacagtacagctctcaggagacccaaagtgggtagctcctttccacaggcaggttg

SEQ ID NO: 18080 - DNA, 201 bp, Homo sapiens
gaattaccacaattgaaaacagaatagcatctgcaggagctgctttcattcagcggttttcctacagaacctgtatcaaccgcccagaggaaggtccatgwgagtaacagctaaagctactcagctgaaaatctcacccagttaagttttccttccaacacaacactacatacttagtatgtttttctcaacatactaagc

SEQ ID NO: 18081 - DNA, 201 bp, Homo sapiens
accacaggaagcatttaagttgtgttcgtggactcctaggagcccaggagtaggaaatccttcatgcagtgtgcccttgagcaggggacactattaaatcrcaatgtcacaggagggctgcaggagcatgcttgggtagactgcagcctggagctaaagcaatttaccaagtaaagagaatcagaaaagtcttcatccccg

SEQ ID NO: 18082 - DNA, 201 bp, Homo sapiens
atgacaggtcaagggctgccttccccagctatgccctacgggtggctctgggagttctgtgcaaatgcaacttgaagaaaaagaagccctaggagggctgrggattaagggaaaagactaaaggaccatttctcagcctggagatggcaagtgatttcattatggccctaaataggacaaagctgacaaagaagcagccca

SEQ ID NO: 18083 - DNA, 201 bp, Homo sapiens
aaacctcttgccccttccctctggcattgggtgaatacaaaagggaatggaaaagactggacgctggaagcaggcccagccaactgttgccagcttctctyacctgctcccaccagggggaagaaaggaaggtacaatgtggttctttcccatcccaccaccaaagaaggatttaaggattgactggcaaaggatgtttct

SEQ ID NO: 18084 - DNA, 201 bp, Homo sapiens
aagagacagatgtttccacaaagggttctggagaaaacataggagccagatgaataaagagctgacactgcacccaggccttggccagatgggaccagtgygcacatgaaagcctccctgcctgattctgacgcgcagccaggctggggaaccactaggaaaagtccagtgccttgtctgacctggggacacagggaatag

SEQ ID NO: 18085 - DNA, 201 bp, Homo sapiens
caaaaaccacaattacttttgccccaaactaatagatgctaggaatgcaaagatgggtaacccacactccctcccacagggagctccatcctcgagggagwcagacacacgatgactgtctaacccagcaagaagaaggctagaacaccactcaggaagtcccagaagaaggagaaagttacttggccagtgggacaaaca

SEQ ID NO: 18086 - DNA, 201 bp, Homo sapiens
agaaggaaagggagagaatatattaacctgagacttgaggaagggagaggagggaaaagaaaaatgtcaaccccagtagctgtttgtgaacccacgtatarcacagtgtgccccaccacaggtatcaaaagcaacacaagcacgatgacaaaaacccaggactctggggaagaaaaccagatcagatttgtaagcaggttg

SEQ ID NO: 18087 - DNA, 201 bp, Homo sapiens
tggtttagctccagtttattcactgctattccaagcatattgtgatcaggggttagtgttgaaacagcggtttctatctccaaaacggatttaaaatcackctttatgaagcaacacagaaataaaaaaaaatctaggactcaatgagaagcagatggaggggaggaaacaggaggaggaaaagaaagctgggggagaagg

SEQ ID NO: 18088 - DNA, 201 bp, Homo sapiens
aattataatcgccactagctgtggagctgctgccgtaggctgggcaccaaaatgaatgtttaatccccggcaaggaaggtgttgtactccataggtagtasactcaaggcaatagtggctggaaagagtttggggtcatgccctcctacttcttccctttgggtgtaagacaagtcacagaaattctctaagcctcactgt

SEQ ID NO: 18089 - DNA, 201 bp, Homo sapiens; identical to SEQ ID NO: 17807

SEQ ID NO: 18090 - DNA, 201 bp, Homo sapiens; identical to SEQ ID NO: 17809

SEQ ID NO: 18091 - DNA, 201 bp, Homo sapiens
gccgggcgtggtggctcacgcctgtaatcccagaactttggcaggccaaggcgggcagatcacctgagatcaggagttcgagaccagcctggccaacatgrtggaaccccatctctactaaaaatacaaaaattagccaggcgtggtggtgcgtgcctgtaatcccagctactcgagaggctgaggcgaatcacttgaacc

SEQ ID NO: 18092 - DNA, 201 bp, Homo sapiens
attctgatgggaagagacacatcatgaataactatataatacatgaggtggtgataagtgctataaataacaacaaaaacaaacaaacaacaacaacaacmaacaacaaggggctgggcacagtggctcacgcctgtaatcccagcagtttgggaagctgaggacggcggatcacctgaggacaggagttcaggaccagcc

SEQ ID NO: 18093 - DNA, 201 bp, Homo sapiens
acatattgtcaggtgaaaaaagaaaagcaagctgtaaaacagtaagcaggagaaaaatcaatctatttctacatctactatttctatccatgtctttaacrgcatctttttgaaaagaggtatagaatagaatgcagagacattcaatatctatggatatgcatttcctctctgtctagggttatagaatgattttatttt

SEQ ID NO: 18094 - DNA, 201 bp, Homo sapiens
atgtctttaacagcatctttttgaaaagaggtatagaatagaatgcagagacattcaatatctatggatatgcatttcctctctgtctagggttatagaawgattttattttcattttaagataatttttttctagatgtagtttctaaattttctagaatgaacatgacttatttacatgataaaataatcaaaactgta

SEQ ID NO: 18095 - DNA, 201 bp, Homo sapiens
gcattccagatgcccctcttttaggccacaacaaactctgcccctgaggaactgacatttaactctcagccttctagttactataaaggaccaggagcctsaggccaggctcttcctagttccttagagacgagccccagggaaaggagaactatagcactgttagagttcctggggcaactgaagaaggagatgaaagta

SEQ ID NO: 18096 - DNA, 201 bp, Homo sapiens
acttcatgtctaaaacaccaaaagcaatggcaacaaaagccaaaattgacaaatgggatctaattaaactaaagagcttctgcacagcaaaagaaactacyatcagagtggacaggcaacctacagagtgggagaaaatttttacaatctacccatctgacaaaggactaatatccagaatctacaaaaaacttcaacaaa

SEQ ID NO: 18097 - DNA, 201 bp, Homo sapiens
atgattcaggaggtaattctctctgctttagtgtagcaggaaggtgtggagaagggtccactaacatgtattaacagcgtgcagtttgccaggcaccatcmctgaggcttttcttggtttagctgatttaatccttacaataaacatctgtgataggaagcagagggaaagagaggttaagcaagttccccagggccacac

SEQ ID NO: 18098 - DNA, 201 bp, Homo sapiens
tccctttcaaactgccagcatctgacacggtgagctccattttgttcaggttaaagtcagacctggacagcaaaggtctcttaaacacatgggggaatagyctccatggactcttgagattaacttctgcagttcatttttaattcactcatgaatgtaatatctagtcacaaaggtgtaaacagaaaggtaaaagtatat

SEQ ID NO: 18099 - DNA, 201 bp, Homo sapiens
tggcaggccaaggcgggcagatcacctgagatcaggagttcgagaccagcctggccaacatggtggaaccccatctctactaaaaatacaaaaattagccrggcgtggtggtgcgtgcctgtaatcccagctactcgagaggctgaggcgaatcacttgaaccagggaggtggaggttgcagtaagccaggatctttccac

SEQ ID NO: 18100 - DNA, 201 bp, Homo sapiens; identical to SEQ ID NO: 17811

SEQ ID NO: 18101 - DNA, 201 bp, Homo sapiens; identical to SEQ ID NO: 17812

SEQ ID NO: 18102 - DNA, 201 bp, Homo sapiens; identical to SEQ ID NO: 17813

SEQ ID NO: 18103 - DNA, 201 bp, Homo sapiens
tgatggaattcctcctgggattatttttttccaagaagtagtgaactctgaaattcttttcttttttcttttttctttttctttttcttttcttttctttyttttttttttttgagacagtcttgctctgtcccccaggctggagtacagtggcgagatcttggctcactgcaagctccacctcctgggttcaggccattc

SEQ ID NO: 18104 - DNA, 201 bp, Homo sapiens
gcatttctgtgtgtcagacattgggcaatatagttaccctttctaagcctcagcgtcttcacttgtaaaatgggtgtatgaaggtagtcttgaggattaastgagacactgtatgtagagggcttagcacaatttcacaaaagtaaaaagtgatgtagcccaaaatgcaacccaggcaaactaaatccaggttgtcatccg

SEQ ID NO: 18105 - DNA, 201 bp, Homo sapiens
ctctcctactttaaacagctaagttggaaaaagtatgaaacgataatttcagacattggacaacaaatagtgcaaaagaaagagcaatccttgagaaaagraaaacaaatgaaatgatccctgcaatgcctcagataattgcctggacagattttccaggctgtagtttagggaggccaaatccaagcaaaatccagcagt

SEQ ID NO: 18106 - DNA, 201 bp, Homo sapiens
ggagtgcttcccaaggcgggcagatcccttaaggccagaagttcatgaccagactggccaacatggcaataccccatctctactaaaaatacaaaaatcakctgggcctggtagctgggccaagtagccagctacttgggagggtgaggcacgagaactgcttgaacccggtaggcagaggttgcagagagccaagatctc

SEQ ID NO: 18107 - DNA, 201 bp, Homo sapiens
atatatttgacaaatgttatattgtctatttgtgttggtaaagatcagctgaagcagtttgcttccaccagtcagggccagaaatccaccttcattgtccyattttagggatatgtaattctccagaactgcaaagatttttacctgccaaaacttatcacttctccatttcacaatacatcatgtggtccaatgtgatac

SEQ ID NO: 18108 - DNA, 201 bp, Homo sapiens
ggctcacctcatgggataaagggcaactccacaaatgcttaaattattttctcccagactctccttgctctccctgtgaggtgggcagagctgtactgacrcatgctaaccatgagtacacgtggcaccagtgtgcaggaaacgacaggcgtccccggccacccctgggtctggaaggaggggtaaacggaaaaagaaaag

SEQ ID NO: 18109 - DNA, 201 bp, Homo sapiens
ccagaatgtcactttaggaagcagtggggcaaaggtcccaagcaggcaagtcatgaaagaagaaatataaataaagaaaaatgcctaactccatttttttyctggcaatataaccacatgttttgagacccttcaaaacattcatacctttcatatagtaaggctccttctaggaatatattgtaaggaaagcatgtgatg

SEQ ID NO: 18110 - DNA, 201 bp, Homo sapiens
acatgttttgagacccttcaaaacattcatacctttcatatagtaaggctccttctaggaatatattgtaaggaaagcatgtgatgggaacactaaggtgytagtcatagtaaacattaaaagggagaattaaataaattataggacaggttcctagtccctaattacaaaaactcttgctgactagaattatgggcaatt

SEQ ID NO: 18111 - DNA, 201 bp, Homo sapiens
tgcagaagcccccttgggctctcttccagttgtgtctcccaaaagtaactattgtcctcatttttcacaccagaaattagtttcgcctgtttttaaatatytctgtaagtagaattatacaatgtgtattctcctgtatctggcttaatccattttttgctgcatataattgtaagttgttcattcttattctactatata

SEQ ID NO: 18112 - DNA, 201 bp, Homo sapiens
tatgggtatatgcatgcgcatgttgccactggcaggagaagagccaacccctagccagttcatacaaggtgccaggttctgtggaggttccttctctgcaycctctcctttaagcccccagtgaccttatgaggtaggtgtttattacgctccattttacaaataaggaaaccgagacacaggaggcttatgtaagatgtc

SEQ ID NO: 18113 - DNA, 201 bp, Homo sapiens
cctttaagcccccagtgaccttatgaggtaggtgtttattacgctccattttacaaataaggaaaccgagacacaggaggcttatgtaagatgtccaatgkcatacagcaattaactggtggagccagaaggaagagggaggaaaggataatttctggaaagaagaaaagtgaacatctggattacatatttatggagaaa

SEQ ID NO: 18114 - DNA, 201 bp, Homo sapiens
atgtgagaaatcagctgagggccagggcagaaccaaaacagagaacaaggaggtggtcagacaccagggcgttagcatgaagcagacctcagttcttactrgctacaaaactttgtaggatttgctcaactctctctgaagtataggtgtccttttctaaagtgagaatgacgaagtagttaatacatagtaaagctgaat

SEQ ID NO: 18115 - DNA, 201 bp, Homo sapiens; identical to SEQ ID NO: 17814

SEQ ID NO: 18116 - DNA, 201 bp, Homo sapiens; identical to SEQ ID NO: 17815

SEQ ID NO: 18117 - DNA, 201 bp, Homo sapiens; identical to SEQ ID NO: 17816

SEQ ID NO: 18118 - DNA, 201 bp, Homo sapiens; identical to SEQ ID NO: 17817

SEQ ID NO: 18119 - DNA, 201 bp, Homo sapiens
tcgggagggcggatgcccaccaccctcggactatttgttcagccaatcagagcagccagccaccgggaagtgcctcggagactccgccccagaccagcgckgccgcttgccagccccccagttgaccccatagagcatgcgccgtaggcgtttctaagagatggagcccgtcctccgcctcgcaggctggcaggtccacag

SEQ ID NO: 18120 - DNA, 201 bp, Homo sapiens
ggcaagactcgctgggtccaaacgcagagggtcttgccggccggcagagcctcggggcgcgaccctccccttgctgaaggcaccagcttccacgccgcacycgcacctggcagcgccgcggcgccggcactctcacctggagctgtcctgccgggccgctgtctcgagtcgcagtgccagctctcaggggccggggtgcgg

SEQ ID NO: 18121 - DNA, 201 bp, Homo sapiens
gagaggacccgtggtcaagaatgattctgcagattccaggctaggtcattaggaggatgctggtgctattaataatagaggaggaagtcaggaggggaagygggatgcatgagaagaggacgcgtttcactttgggtgtgaaaggccttctccattctttttatctatttgcctttaaacaccggaaataacaccagtggc

SEQ ID NO: 18122 - DNA, 201 bp, Homo sapiens
cgacttgactttgaaaggccaggaacgggctgctcccacaggtcaggtcatttccaacaaaaacgactgcaatcgtcttccctcaggatggagagtcagasagaggcaagaggaaggctcggtaggtggcctaattccttggcacttgttccaatctgtgcctctgtagttaacacggaaaacatgggactgcctagtcta

SEQ ID NO: 18123 - DNA, 201 bp, Homo sapiens
gatttgataactagcaaattgtttttaaatgacagttctgctgcaaggtagcttccgtagactactccggaaggcactgctcacatacatgaaaatatacrtggtactccctggagttgtacaacctgggggtgctataccctcgtgttgttaaaatagcaggaccccaggccaagagtataaaatgattcccataacttt

SEQ ID NO: 18124 - DNA, 201 bp, Homo sapiens
gattggtgaataattctttgctcaattaaactctactaaatttaatttgtctaaggtttttcttttaacattagctactgatgtcactattaatattagckagtgatgacaacagttctccggaatccaccctagtcctgtggtcatttttagatttctggttctctgaccactacattgctaatcctccttctagtaaat

SEQ ID NO: 18125 - DNA, 201 bp, Homo sapiens
cttcaaagcatttaaaacatacttttgtttttgttttatcagtgcaatttgtttttgaagacgccggaaaactatttcatttaacctgagcaattaaaacrtgtcaaatcacagctgtcacagttaggtttgataaaattaattgttagcatccttattactggcacagctgtgatatttctggatttgactatgcacctg

SEQ ID NO: 18126 - DNA, 201 bp, Homo sapiens
gagaagtaatatcaagtcttggctctggggagctccgaaattcatcaggtttataaggagaatggaaagatgagtatgctatatttaaaatcccgctaaasaacaaggtatggaatttattaacaagttaatcctaattatttaaacaaaaagtaaacttctgaatggactgtaaacaaaatggcctttaaggtcaacccc

SEQ ID NO: 18127 - DNA, 201 bp, Homo sapiens
gacctggcaatgttatcttagtttggaatattaaccaaaaatataaaattacaaagacaggctccaaatagttctttatgctttggaaaagtaagaagtcycataaaatataattgaattgtgaaaaatgtaaaatcttcagtctaggttaaaaaaagtaattatggaagaacacaaaatatatattacttacatatgtgt

SEQ ID NO: 18128 - DNA, 201 bp, Homo sapiens
tattctgatgggaagagacacatcatgaataactatataatacatgaggtggtgataagtgctataaataacaacaaaaacaaacaaacaacaacaacaamaaacaacaaggggctgggcacagtggctcacgcctgtaatcccagcagtttgggaagctgaggacggcggatcacctgaggacaggagttcaggaccagc

SEQ ID NO: 18129 - DNA, 201 bp, Homo sapiens; identical to SEQ ID NO: 17818

SEQ ID NO: 18130 - DNA, 201 bp, Homo sapiens
ccaaagggagatgagaagcattctaaagtgcactgatcatgagtttctatgtgatgatttgtgtccatttggagctccagtgctttaaagctgaaatgaaycctggcctttcaccaccctccctgcccatagtatggtatatcctcttattccttccctcttagcttactgagagtgtaatttccaaccagttaagccaaa

SEQ ID NO: 18131 - DNA, 201 bp, Homo sapiens
ctgggcgacagagacagactctgtctcaaaaaaaaaaaaagtataaaaatactttaaatgatttactttatttaaaaatacttagggccaggcacggtggytcacacctctaatcccagcactttgggaggctgaggcaggtggaccacctgaggtcaaaagatcgagaccatcatggccaacacagtgaaaccccgtctc

SEQ ID NO: 18132 - DNA, 201 bp, Homo sapiens
gcacagtgcaagctatcggtggatctaccattctggggtctggaggacagtggctctcttctcacagctgcactaggcagtgccccattggggactctgtrtgaggcctccaatcccacatttcccttctgcactgacctagcccaggctctccttgagggccccacccctgcagcaaacttctgcctggacattcaggct

SEQ ID NO: 18133 - DNA, 201 bp, Homo sapiens
tagcttaattaaatgtatacattcacatcatttaaatagtcaacgtgatctacaaggtaggagacatagcaacccccttccccattccaccctatttcccrgtctccagaggtaaccacatataactcttttggtgcctattttgtgatttgttgccacaccctgagattcttccatgctgtcttttttcagtttaaagta

SEQ ID NO: 18134 - DNA, 201 bp, Homo sapiens; identical to SEQ ID NO: 1916

SEQ ID NO: 18135 - DNA, 201 bp, Homo sapiens; identical to SEQ ID NO: 1915

SEQ ID NO: 18136 - DNA, 201 bp, Homo sapiens; identical to SEQ ID NO: 1914

SEQ ID NO: 18137 - DNA, 201 bp, Homo sapiens; identical to SEQ ID NO: 1913

SEQ ID NO: 18138 - DNA, 201 bp, Homo sapiens; identical to SEQ ID NO: 1912

SEQ ID NO: 18139 - DNA, 201 bp, Homo sapiens; identical to SEQ ID NO: 1911

SEQ ID NO: 18140 - DNA, 201 bp, Homo sapiens; identical to SEQ ID NO: 17826

SEQ ID NO: 18141 - DNA, 201 bp, Homo sapiens; identical to SEQ ID NO: 17827

SEQ ID NO: 18142 - DNA, 201 bp, Homo sapiens; identical to SEQ ID NO: 17828

SEQ ID NO: 18143 - DNA, 201 bp, Homo sapiens; identical to SEQ ID NO: 17829

SEQ ID NO: 18144 - DNA, 201 bp, Homo sapiens; identical to SEQ ID NO: 17830

SEQ ID NO: 18145 - DNA, 201 bp, Homo sapiens; identical to SEQ ID NO: 17831

SEQ ID NO: 18146 - DNA, 201 bp, Homo sapiens; identical to SEQ ID NO: 17832

SEQ ID NO: 18147 - DNA, 201 bp, Homo sapiens; identical to SEQ ID NO: 17833

SEQ ID NO: 18148 - DNA, 201 bp, Homo sapiens; identical to SEQ ID NO: 17834

SEQ ID NO: 18149 - DNA, 201 bp, Homo sapiens; identical to SEQ ID NO: 17835

SEQ ID NO: 18150 - DNA, 201 bp, Homo sapiens; identical to SEQ ID NO: 17836

SEQ ID NO: 18151 - DNA, 201 bp, Homo sapiens; identical to SEQ ID NO: 17837

SEQ ID NO: 18152 - DNA, 201 bp, Homo sapiens; identical to SEQ ID NO: 17838

SEQ ID NO: 18153 - DNA, 201 bp, Homo sapiens; identical to SEQ ID NO: 17839

SEQ ID NO: 18154 - DNA, 201 bp, Homo sapiens; identical to SEQ ID NO: 17840

SEQ ID NO: 18155 - DNA, 201 bp, Homo sapiens; identical to SEQ ID NO: 17841

SEQ ID NO: 18156 - DNA, 201 bp, Homo sapiens; identical to SEQ ID NO: 17842

SEQ ID NO: 18157 - DNA, 201 bp, Homo sapiens; identical to SEQ ID NO: 17843

SEQ ID NO: 18158 - DNA, 201 bp, Homo sapiens; identical to SEQ ID NO: 17844

SEQ ID NO: 18159 - DNA, 201 bp, Homo sapiens; identical to SEQ ID NO: 17845

SEQ ID NO: 18160 - DNA, 201 bp, Homo sapiens; identical to SEQ ID NO: 17846

SEQ ID NO: 18161 - DNA, 201 bp, Homo sapiens; identical to SEQ ID NO: 17847

SEQ ID NO: 18162 - DNA, 201 bp, Homo sapiens; identical to SEQ ID NO: 17848

SEQ ID NO: 18163 - DNA, 201 bp, Homo sapiens; identical to SEQ ID NO: 17849

SEQ ID NO: 18164 - DNA, 201 bp, Homo sapiens; identical to SEQ ID NO: 17850

SEQ ID NO: 18165 - DNA, 201 bp, Homo sapiens; identical to SEQ ID NO: 17851

SEQ ID NO: 18166 - DNA, 201 bp, Homo sapiens; identical to SEQ ID NO: 17852

SEQ ID NO: 18167 - DNA, 201 bp, Homo sapiens; identical to SEQ ID NO: 17853

SEQ ID NO: 18168 - DNA, 201 bp, Homo sapiens; identical to SEQ ID NO: 17854

SEQ ID NO: 18169 - DNA, 201 bp, Homo sapiens; identical to SEQ ID NO: 17855

SEQ ID NO: 18170 - DNA, 201 bp, Homo sapiens; identical to SEQ ID NO: 17856

SEQ ID NO: 18171 - DNA, 201 bp, Homo sapiens; identical to SEQ ID NO: 17857

SEQ ID NO: 18172 - DNA, 201 bp, Homo sapiens; identical to SEQ ID NO: 17858

SEQ ID NO: 18173 - DNA, 201 bp, Homo sapiens
tttttggtttacattaggaatgcttccacattctctcaaacaaattttagtcacagttttgaataacgtactctggctcagccattgcaggtctcaagccrttaggtttcattttcctcctcccaacgattttaaattagtttcactttccagtttcctcttccttcccctaaaagcaattactcaaaaacggagaaaaca

SEQ ID NO: 18174 - DNA, 201 bp, Homo sapiens
atattagccgggcatggtggtgggtgcctgtaatcccagctactcgggaggctgaggcaagagaatcacttgaacccaggaggcagaggttgcagtgagaygcaatcatgccactgcattccagcctgggcaacagagtaagactctgtctcaaaaaaaaacaaaaacaaaaacaaaaaaagagtgtgttctattagtaat

SEQ ID NO: 18175 - DNA, 201 bp, Homo sapiens
catgacatgcaatttacctaaataacaaacctgtacgtgtatacctgcacataaaatataagttaaaaaaaaacctacaatgagatatgatcttaccctgsttaaaattgcttttatccaaaagacaggcaataacaaatgctggcaaggatgtggaaaaaaggaaactcttgtacactgttggtgggaatgtaaactatt

SEQ ID NO: 18176 - DNA, 201 bp, Homo sapiens
tcatgacatgcaatttacctaaataacaaacctgtacgtgtatacctgcacataaaatataagttaaaaaaaaacctacaatgagatatgatcttaccctrgttaaaattgcttttatccaaaagacaggcaataacaaatgctggcaaggatgtggaaaaaaggaaactcttgtacactgttggtgggaatgtaaactat

SEQ ID NO: 18177 - DNA, 201 bp, Homo sapiens
attatggacacaaagaggggaacaacagacactggggcctacttgagggtaaagaatgggtgaagagagaggactgaaaaactacctatcatgtactatgyttatgagtggggtgactaaataatctgtacactaaagcctcatgacatgcaatttacctaaataacaaacctgtacgtgtatacctgcacataaaatata

SEQ ID NO: 18178 - DNA, 201 bp, Homo sapiens
tacaccatggactactatgcagccacaaaaaaaagaatatcatgtcctttgcagtaatgtgaatggaactggaggccattatcctaagtaaactaatgcakgaagagaaaaccaaatactgcatgttctcacttataagtgggaactgaacattatggacacaaagaggggaacaacagacactggggcctacttgagggt

SEQ ID NO: 18179 - DNA, 201 bp, Homo sapiens
tcttccttcagataccctaaaaaaaagaatatgaaaaaatactcaatatcattaatcattagaaaaatgcaaatcaaaaccacaatgagatatcatgtcayaccagtcagaatgactattattaaaaagtcaacaaaaataacagatgctggtgaggttacagagaaaagggaacacttacaaactgctggtgagaatgta

SEQ ID NO: 18180 - DNA, 201 bp, Homo sapiens
aatgacagtcttcatagaattagaaaaacctattttaaaattcctatagaacaaaaagtgctcaaatacccaaagcaatcctaagcaaaaagaacaaagcyggaggcatcatgttacctgactttgaactatactataaggctacagtaaccaaaatagcatggtactggtacaaaaacagacacatagaccaatagaaca

SEQ ID NO: 18181 - DNA, 201 bp, Homo sapiens
taaaactgaaaccacgtgatcatctcaatagatacagaaaaggcttttgataaaattcaacatccattaatgttaaaaatcctcaacaaactagatattgraggaacatacctccagataataagagccatctatgataaacccaaggtcaacatcatactgaatgggcgaaagctgaaagatttccccttgagaactgga

SEQ ID NO: 18182 - DNA, 201 bp, Homo sapiens
ttaaaactgaaaccacgtgatcatctcaatagatacagaaaaggcttttgataaaattcaacatccattaatgttaaaaatcctcaacaaactagatattkaaggaacatacctccagataataagagccatctatgataaacccaaggtcaacatcatactgaatgggcgaaagctgaaagatttccccttgagaactgg

SEQ ID NO: 18183 - DNA, 201 bp, Homo sapiens
gcagcacaccaacatggcacaagtatacatatgtaacaaacctgcgtgttgtgcacatgtatcctagaacttaaagtaaaattttaaaaaatgcagtttcvagctcggggttaagatggtaaactagaagcaactcatgtgccaggctatcacggaaaggaaacaaaagggctagtgagcattgaccctgcaggccaatca

SEQ ID NO: 18184 - DNA, 201 bp, Homo sapiens
gggttagcattaggagatatacctaatgtaaatgacgagttaatgggtgcagcacaccaacatggcacaagtatacatatgtaacaaacctgcgtgttgtkcacatgtatcctagaacttaaagtaaaattttaaaaaatgcagtttcgagctcggggttaagatggtaaactagaagcaactcatgtgccaggctatcac

SEQ ID NO: 18185 - DNA, 201 bp, Homo sapiens
tagcaaagacttggaaccaacccaaatgtccatcaatgatagactggattaagaaaatgtggcacatatacaccatggaatactatgcagccataaaaaakgatgagttcatgtcctttgtagggacatggatgaagctggaaaccatcattctgagcaaactatcgcaaggacagaaaaccaaacaccgcatgttctcac

SEQ ID NO: 18186 - DNA, 201 bp, Homo sapiens
ggaaaactggctagccatatgtagaaagctgaaactggatcccttccttacaccttatacaaaaattaattcaagatggattaaagatttaaatgttagayctaaaaccataaaaaccctagaagaaaacctaggcaataccattcaggacataggcatgggcaaggacttcatgtctaaaacaccaaaagcaatggcaac

SEQ ID NO: 18187 - DNA, 201 bp, Homo sapiens
tatgcaaattaataaatgtaatccagcataaaaacagaaccaaagacaaaaaccacatgattatctcaatagatgcagaaaaggcctttaacaaaattcartagcccttcatgctaaaaactctcaataaactaggtattgatgggacatatctcaaaataataagagctatttatgacaaacccacagccaatatcatac

SEQ ID NO: 18188 - DNA, 201 bp, Homo sapiens
taaacacctctatgcaaataaactagaaaatctagaagaaatggataaattcatggacacatacaccctcccaagactaaaccaggaagaagttgaattcytgaatagaccaataacagggtctgaaattgaggcaataattaatagcctaccaaccaaaaaaagtccatgaccagatggattcacaactgaattctacca

SEQ ID NO: 18189 - DNA, 201 bp, Homo sapiens
taaaacagactttaaccaacaaagatcaaaagagacaaagaaggccattacataatggtaaagggatcaattcaacaagaagagctaactatcctaaatawatatgcacccaacacaggagcacccaggttcataaagcaagtccttagagacctacaaaaagatgtagactcccaaacaataataacaggagactttaac

SEQ ID NO: 18190 - DNA, 201 bp, Homo sapiens
acatctgactggtgtacctgaaagtgacacggagaatggaaccaagttggaaaacactctgcaggatattatgcaggagaacttccccaacctagcaaggsaggctaacattcaaattcaggaaatacggagaacgccacaaagatattcctcgagaagagcaattccaagacacataattagcagattcaccaaagttga

SEQ ID NO: 18191 - DNA, 201 bp, Homo sapiens
gcttacgcctctaatcccaacactttgggaggccaaggcgggtggatcacgaggtttagagatcgagaccatcctggccaacatggtgaaaccccatctcyactaaaaatacaaaaattaggtgggtatggtggtgggtacctgcagtcccaactattcgggaggctgaggcaggtgaatttcttgaacccaggaggtgaa

SEQ ID NO: 18192 - DNA, 201 bp, Homo sapiens
cagcaattccattcctagatacatatgtaagaaaaaggaaaacatgaaaacataggttcacacaaaacttgtgcatgaatgttcatagctgtattattcaygatggccaaaaagtggacccatcaactgatgaattgataaattaaatatggtagagccacataatggaatattatttggaaacaaaaataagtgaagtac

SEQ ID NO: 18193 - DNA, 201 bp, Homo sapiens
agaatggcgtgaacctgggaggcagagcttgcagtgagccgagattgcaccactgctctccaggctgggtgacacagcaagactccctctcaaaaaaaaawaataataataataataatccagttgaccaagagaatgagatcatattccagagaaagcaggggcttagagtgcatgctttctgcaggaatgagagcaaat

SEQ ID NO: 18194 - DNA, 201 bp, Homo sapiens
aatactgaatgttaccagtctttaatttttgtcaatctgatgagtgcatgcatatatttccaaaaaaggcactggcgtatagatcacagaaaaataaaatrttcaagtgtggaatctgtatgacggaaatcctctccacacccagaatgctagttttctctcctctctctctgtctgtccccaccatctctctcttccttt

SEQ ID NO: 18195 - DNA, 201 bp, Homo sapiens
cccagcactttgggaggccaaggagggtagatcacctgaggtcaggagttccagaccagcctgatcaatatggtgaaaccccatctctaccaaaaaaaatmcaaaaaaaaattaaccaggcatggcggtgtgtgcctgtaatcccagctactcaggaggttgaggcaggagaatctcatgaacctgggaggtggtagttgc

SEQ ID NO: 18196 - DNA, 201 bp, Homo sapiens
tatttctctgcctcagagtcctcagtgaaaaagattcatcacttctgcttgtctttctccatagagctcagacacagtccctggggacagctgaccttgartcatgctgcactttcaccttccttcataccctatgtcaattgacatatccaatacaactggatccagtgcaactggaagactggaagcattagaattctg

SEQ ID NO: 18197 - DNA, 201 bp, Homo sapiens
tgggaaggaacaccacacgtattctgagtggaaggttaaaatggacaggtatgccgaccttgagagaggacccttggtacctgtgtgtgctaaagatggawgtatgtaatcttgtccttgcatgtcatgcctccagtcccttgctggaacaggacccttagtgggaaaacagcaagaagggtagaaaagggaaacataaca

SEQ ID NO: 18198 - DNA, 201 bp, Homo sapiens
gatctagctcaccttgatctgagtaaattaggactacatctggtgcctgggaaggaacaccacacgtattctgagtggaaggttaaaatggacaggtatgscgaccttgagagaggacccttggtacctgtgtgtgctaaagatggatgtatgtaatcttgtccttgcatgtcatgcctccagtcccttgctggaacagga

SEQ ID NO: 18199 - DNA, 201 bp, Homo sapiens
aggggaagatctagctcaccttgatctgagtaaattaggactacatctggtgcctgggaaggaacaccacacgtattctgagtggaaggttaaaatggacmggtatgccgaccttgagagaggacccttggtacctgtgtgtgctaaagatggatgtatgtaatcttgtccttgcatgtcatgcctccagtcccttgctgg

SEQ ID NO: 18200 - DNA, 201 bp, Homo sapiens
gtatgtttcaggggaagatctagctcaccttgatctgagtaaattaggactacatctggtgcctgggaaggaacaccacacgtattctgagtggaaggttmaaatggacaggtatgccgaccttgagagaggacccttggtacctgtgtgtgctaaagatggatgtatgtaatcttgtccttgcatgtcatgcctccagtc

SEQ ID NO: 18201 - DNA, 201 bp, Homo sapiens
gtgtatgtttcaggggaagatctagctcaccttgatctgagtaaattaggactacatctggtgcctgggaaggaacaccacacgtattctgagtggaaggktaaaatggacaggtatgccgaccttgagagaggacccttggtacctgtgtgtgctaaagatggatgtatgtaatcttgtccttgcatgtcatgcctccag

SEQ ID NO: 18202 - DNA, 201 bp, Homo sapiens
aaaacacaaatcacaccaactgcaaaggtaaactcatttcattggatcaaaatggacaagtgtatgtttcaggggaagatctagctcaccttgatctgagkaaattaggactacatctggtgcctgggaaggaacaccacacgtattctgagtggaaggttaaaatggacaggtatgccgaccttgagagaggacccttgg

SEQ ID NO: 18203 - DNA, 201 bp, Homo sapiens; identical to SEQ ID NO: 8058

SEQ ID NO: 18204 - DNA, 201 bp, Homo sapiens; identical to SEQ ID NO: 8059

SEQ ID NO: 18205 - DNA, 201 bp, Homo sapiens; identical to SEQ ID NO: 8060

SEQ ID NO: 18206 - DNA, 201 bp, Homo sapiens
ggacaaggagggtggatcacctgaggtcaggagttccagaccagcctggccaacatagtgaaaacccatctctactaaaaatacaaaaattagccaggcayggtggtacatgcctgtaatcccagctcgagaggctgaggaaggagaatcacttgaaccagggaggcagaggttgcagtgagcagagatcgcaccactgca

SEQ ID NO: 18207 - DNA, 201 bp, Homo sapiens
aagaagaaccaaaattatgaatagataattatacctcgaatagaacatctaggagacaacactagaattcaacagagaagtcatgggaaacacccaaggcrcagaagaagaaggtatcaagtggccagcttggctgagattggccaggataacagagggccttggcatttcagggaaaggtcaaatgagagaacttcagca

SEQ ID NO: 18208 - DNA, 201 bp, Homo sapiens
gcttgaacccggtaggcagaggttgcagagagccaagatctcaccactgtagtctagctttggcaacagagcgagactgtctcaaaaaaaaaaaaaaaaaraagaagaagaagaacttgtaaacagaaaaggaacttgaaactcttgcgtaagacacaaaagtaagggtttccaactgggacaggcttagctgtgcatcct

SEQ ID NO: 18209 - DNA, 201 bp, Homo sapiens
attccaggaaaaagacacatatatatttgtagcaacgaggttaggcagaactctttctaataagtttcattttctcaaaatagaaataacaccaggagaargttggttttccttttcagttgctattttgcaatcacattgcatgcatagtctcacactaacccagctactaaatcagctgatgcatacctgctgtggtaa

SEQ ID NO: 18210 - DNA, 201 bp, Homo sapiens
ttgtgaatgagtacagaagggaatgtcatataggtgggaacacattgttttcaaattacagcccattgtggggatcaagagaacccactgggctacctaartattcctctaacaagtgcgaatactattgaacagtcaccagctcttctaggtggacaaaacttcagttaaaaatagactcaaaacaaaaaagagggtcaa

SEQ ID NO: 18211 - DNA, 201 bp, Homo sapiens
aaagaaaaaagaaaaaaaggaagaaaggaaaggaaatgaaatgaaaggaaaggaaaggaaaggaaaggaaaggaaaggaaaggaaaggaaaggaaaggaawggaaaggaatggaaaggaaaaaagaatggggagctattttattaactatatcaatatttttgaagttcatgtggaagaccattttaaacgtgtatttgtg

SEQ ID NO: 18212 - DNA, 201 bp, Homo sapiens
gtaaatagggggtgagggtgagcaagagaaggttgaagtcatccttttatatggaactccgtccctcaataatggcattaatctattcaagaggacaatgsccccataacccaaatacctcccattaggtcccacctcccaacactgccacattggggatcaagtttccaacacatgaactttggaggacatattcaaacc

SEQ ID NO: 18213 - DNA, 201 bp, Homo sapiens
ggaagggtaaatagggggtgagggtgagcaagagaaggttgaagtcatccttttatatggaactccgtccctcaataatggcattaatctattcaagaggwcaatgcccccataacccaaatacctcccattaggtcccacctcccaacactgccacattggggatcaagtttccaacacatgaactttggaggacatatt

SEQ ID NO: 18214 - DNA, 201 bp, Homo sapiens
agacgtcagtgttaccagattaggggttaccagattaggggccccacccttaagacctcatttaaccttaaatacctcctcacaggccctatctccaaacraagttacgttgagggttagggcttcaatgatgaattttgggaaaggagttgggaactcaattcagtccaaagcagttgtttattgccatctcttcctgat

SEQ ID NO: 18215 - DNA, 201 bp, Homo sapiens
gatgctagaagtccaagttggtttctggtgagacctctcttcctgacctggagatggcagccttttctttatcttcacatggcctttcctctgtgtgagaygagagagagagagagagagagagagagagagagagagagagagagatatctgaggtctcttctttttcttcttgtttgtatgaagacgtcagtgttacca

SEQ ID NO: 18216 - DNA, 201 bp, Homo sapiens
ctacattggctgccataatgaaaaatcacagactaggtggcttaagcaacagaaatctattttctcacagttctagatgctagaagtccaagttggtttcyggtgagacctctcttcctgacctggagatggcagccttttctttatcttcacatggcctttcctctgtgtgagacgagagagagagagagagagagagag

SEQ ID NO: 18217 - DNA, 201 bp, Homo sapiens
tttctccacccatatgtaattcctcttacggtctccacttactcttttttttccccatggacttgtcccatattgtctaatttatttattattgtattagyctacattggctgccataatgaaaaatcacagactaggtggcttaagcaacagaaatctattttctcacagttctagatgctagaagtccaagttggtttc

SEQ ID NO: 18218 - DNA, 201 bp, Homo sapiens
tgtgattcagttaaacctctttcccagtctcaggtagtatctttctagagtatgagaacagactaacacagtttccatctctattacttaacagcagcagycagatcccggcccccttttctccacccatatgtaattcctcttacggtctccacttactcttttttttccccatggacttgtcccatattgtctaattta

SEQ ID NO: 18219 - DNA, 201 bp, Homo sapiens
tagtcacgttctgtcacacaggctggagtacaatggtgcaatcttggttcactgcagcctcaaactcctgggctaaagcaatcctcctgggtagctaggasgacaggctcatgccaccatgcctggctactttttttttttttaattgtagagatagggtcttgctatgttgcccagacttgtttcaaactcctggcctca

SEQ ID NO: 18220 - DNA, 201 bp, Homo sapiens
cttttctactcttttggcagcacaaagatccctttgtacagaggcactgatttgtcttcttctggagtagcatcccagtttctcactgtggccaacaaagygaataaaaagaaaaaaaggatctgaaatagcaatccagcggcagccaccaatacctgataatactatagtcaaagctccacattagagaacagaccactt

SEQ ID NO: 18221 - DNA, 201 bp, Homo sapiens
ttttcagtttaaagtatttattatagttaacctaccacaatacatgataccatgatacacatgagttatatagtcttaactagccttttgatttttttttycttttaagcatgagaccacaaggagtcacatactgacctttaggcaggacagtgctttactcagaaatccctgaccatgagctgagtgcaatgattcctt

SEQ ID NO: 18222 - DNA, 201 bp, Homo sapiens
tccttccttcctttcctccttcattccttttttccttccttctctccaatccttcctcttacttccttcctttgttccttccctccattctcttcttcctyattttttccccttcctccctgccttccagattccttcctttttagcttaattaaatgtatacattcacatcatttaaatagtcaacgtgatctacaaggt

SEQ ID NO: 18223 - DNA, 201 bp, Homo sapiens
ccggccctatctcccttcactgactctcttttcagactcagcctgcctgcacccaggtgattaaaaagctttattgctcacacaaagcctgtttggtggtstcttcacgtggaaaagagtgaaactatataaaatagatttctttggaaaatatttcaaagttaagggtgtatgttacagttggtttcatcttatcctttc

SEQ ID NO: 18224 - DNA, 201 bp, Homo sapiens
attaccttgtgaaattccttttcctggctcatcctagctcaaaagctcccgcactgagcacctggtgacccccacctctgccagccagagaacaacccccyttgatgtaattttccactatctacccaaatcttataaaacggccccggccctatctcccttcactgactctcttttcagactcagcctgcctgcacccag

SEQ ID NO: 18225 - DNA, 201 bp, Homo sapiens
aagaatcacaaaaaaagtgaaaacgtcctgtccctgccttaactgatgacattaccttgtgaaattccttttcctggctcatcctagctcaaaagctcccrcactgagcacctggtgacccccacctctgccagccagagaacaaccccctttgatgtaattttccactatctacccaaatcttataaaacggccccggcc

SEQ ID NO: 18226 - DNA, 201 bp, Homo sapiens
ccaaaatttttgctgccaacacttcaatactattttatgctatttttcttattaatataagaagacaggaatgtcaggcctctgagcccaagctaagccarcatatcccctgtgacctgcacgtataaatccagatggcctgaagtaactgaagaatcacaaaaaaagtgaaaacgtcctgtccctgccttaactgatgac

SEQ ID NO: 18227 - DNA, 201 bp, Homo sapiens
ccatttctaatccttctttaacaaacaattgctggctttgcatttctctttcctacaaaatcgctgaggccttgacttactcactgctaaaaaaaaagggkgggggggactctgtatattttcacatgaagagtgctgtttttacctaaatcaatctggcctggtatatgacaacaataaaaaaaactcaaagatagagcc

SEQ ID NO: 18228 - DNA, 201 bp, Homo sapiens
agggcaatgcttatgctgataaggtagctaaagaagcagctagcattccaacttctgtccttcacggccagtttttctccttctcaatggtcactcccacytactctcccactgaaacttccacctatcaatctcttcccacacaaggcaaatggttcttggaccaaggaaaatatctccttccagcctcacgggcccatt

SEQ ID NO: 18229 - DNA, 201 bp, Homo sapiens
tgaccccatagatcctaaatccttttgccactcctctttccattccttaaaaacagccctagaagctgcccccatgctagctctccctaactcatcccaamccttttcattacacacagcgaaagtacagggctgtgcagtcaaaattcttacacaagagccaggactgcatcctgtagcctttctgtccaaacaacctga

SEQ ID NO: 18230 - DNA, 201 bp, Homo sapiens
aggtatttccacctttggatacctagttttaccatcctgactaaaccattatgtaaactgacaaaagcaaacctagctgaccccatagatcctaaatcctyttgccactcctctttccattccttaaaaacagccctagaagctgcccccatgctagctctccctaactcatcccaacccttttcattacacacagcgaaa

SEQ ID NO: 18231 - DNA, 201 bp, Homo sapiens
aagcctccttcatgtcttcctttcatatccccccaccttaacccacaagtataagatacctctactccctccttggtgaccgatcatgcaccccttaccawcccattaaaacctaatcacccttacaccactcaatgccaatatcccatcccacagcacgctttaaaaaggattaaagcatgttatcacttgcctgttaca

SEQ ID NO: 18232 - DNA, 201 bp, Homo sapiens
gaacagcaaatgaaaacagatacttttggccgggcatggtggctcatgcgtgtaatctcagcactttgggaggctgaggcaggcagattacctgagattgrgagtttgagaccagcctgaccaacatggagaaaccccgtctctgctaaaaatacaaaaaaattagccgggcatggtggtgcatgcctataatcccagcta

SEQ ID NO: 18233 - DNA, 201 bp, Homo sapiens
agtgttgagtttagtctttctcccatattgcaatagtctgtctctctcattgtaatagtcttgaaaaaaaataaaagtctctcttgacattttaacaggtkcccactgcaaaatttatctttaactccacaaggttgctatcaatactcaacactttacagatgtggaaactaaggctccaatagatcaagtaattatcca

SEQ ID NO: 18234 - DNA, 201 bp, Homo sapiens
gattttccagcctaaacctggcctatacacactgtacttaagtaaggaagtgggaaatggtagccaagtgtgaattaaatagcaactcaacaccattttgkacaaaaaatggggccaggatttaagacatggtgtgaagcatctggtcaatttctttgacctggaaattctaatttccggaatgcatcgtattgaaaaacc

SEQ ID NO: 18235 - DNA, 201 bp, Homo sapiens
ggatgatagagaacaattgatagaaaaattcattcatttcctgagaaagtaataggaaaatataaacccacaaacaaaaagtgaccttcccatgctcccasaggggtaacagaattgacagtggaaggagggattttccagcctaaacctggcctatacacactgtacttaagtaaggaagtgggaaatggtagccaagtg

SEQ ID NO: 18236 - DNA, 201 bp, Homo sapiens
acaggggtctacataatacgaggtataagggattatgtactgccattgtgagaacccctcatacaatcctgccttttttctttagtttccctctttttgaycagattatgctcctggtgtaaatcaggctcaggaccaagagccctggtgggaccagcaagagggacacagcaggaaaaagaagaacaattcctaccaaag

SEQ ID NO: 18237 - DNA, 201 bp, Homo sapiens
aacacaggggtctacataatacgaggtataagggattatgtactgccattgtgagaacccctcatacaatcctgccttttttctttagtttccctcttttkgatcagattatgctcctggtgtaaatcaggctcaggaccaagagccctggtgggaccagcaagagggacacagcaggaaaaagaagaacaattcctacca

SEQ ID NO: 18238 - DNA, 201 bp, Homo sapiens
tggaggcagtaaggtgacttctttcattcatcttccaagaaaacaaagtactactatatttgaacttacctggtaacttttactctatgttgttgtcgttkttttcaaaaataaacaaacccctccccactctttcctttctcttgttttcatttgtgtttttttaagtgtttcgtgctcacttacctaaattacaaaggt

SEQ ID NO: 18239 - DNA, 201 bp, Homo sapiens
accagtcagggccagaaatccaccttcattgtcccattttagggatatgtaattctccagaactgcaaagatttttacctgccaaaacttatcacttctcyatttcacaatacatcatgtggtccaatgtgatactgacagtatttgctgatttagaccaagtaagcaggaaatagcaagcattctagacaccttggcaag

SEQ ID NO: 18240 - DNA, 201 bp, Homo sapiens
ggtcactccaaattagctactattctaaatgtcttttccttggagaaagttgacacattccctagcatgtggtgtgccacaatatatttgacaaatgttayattgtctatttgtgttggtaaagatcagctgaagcagtttgcttccaccagtcagggccagaaatccaccttcattgtcccattttagggatatgtaatt

SEQ ID NO: 18241 - DNA, 201 bp, Homo sapiens
gtctctactaaaaaatacaaaaaaaaattagctgggcgtggtggcgcatgcctgtagtcccagctactcgggaggctgaggcaggagaatcacttgaaccygggaggcagaggttgcagtgagccaagatctcaccactgcactccagcctggtgacagagtcaaaaaaataataataatactttaagaagtttagtttat

SEQ ID NO: 18242 - DNA, 201 bp, Homo sapiens
tagaattaatattgtctagggacatctcaaattttggataagataatatgtgttaagtgcttagaatagtgccttgcactcaatagatgttagttgattgwgttttttaaatatttttcctgacagtaattttttttataaatccaatttatttgctgattattaatggattctagttactatgtaggttcaatatagtta

SEQ ID NO: 18243 - DNA, 201 bp, Homo sapiens
caccgcatattctcactcataggtgggaattgaacaatgagatcacatggtcacaggaaggggaatatcacactctggggactgtggtggggtggggggargggggaggggtagcattgggagatatacctaatgctagatgacgagttagtgggtgcagcgcaccagcatggcacatgtatacatatgtaactaacctgc

SEQ ID NO: 18244 - DNA, 201 bp, Homo sapiens
acacacagtttattcagcgtccctaagaaagaacctcccagcccccttcagctgtgatgtatgttttctacatatgatatatgttttctatcctcagattstcacataaaaaataccttgtacagtaactttttaatcaaaacacagcatcgtaggtggagactgaaagcctgctgttgtttgttgttgctgtcatttaac

SEQ ID NO: 18245 - DNA, 201 bp, Homo sapiens
gcaatcaaaatgcatgtgtacaacacacagtttattcagcgtccctaagaaagaacctcccagcccccttcagctgtgatgtatgttttctacatatgatrtatgttttctatcctcagattctcacataaaaaataccttgtacagtaactttttaatcaaaacacagcatcgtaggtggagactgaaagcctgctgttg

SEQ ID NO: 18246 - DNA, 201 bp, Homo sapiens
caaaatccaaaatgctccgggattcaaagcatttttgggccaacatgaaaaattccattctgacctcatgtgacaagttgcaatcaaaatgcatgtgtacracacacagtttattcagcgtccctaagaaagaacctcccagcccccttcagctgtgatgtatgttttctacatatgatatatgttttctatcctcagatt

SEQ ID NO: 18247 - DNA, 201 bp, Homo sapiens
atgggaaagcatacgattgctagctctctcatttagcacacacaaatggactgaacgttccaaaaaaaaaaatcagcatataccatctgacagtggcaagmtactatgcaggcaatgaggcatgaattaaacagcattgagtatctagtaaggcttccctcagtggcttcaagtcatccctggagtctgctcacaagctgt

SEQ ID NO: 18248 - DNA, 201 bp, Homo sapiens
atacacatacatttgaaagttaaaaatataggagttcctggaaaaaaattggagaaaatcttaagaaatttgagttttgtcaaagattgtttaaatacaayacaaaaagcacaacctataaaagaaaaaatatcaacaaattggaccccttcaaagtaaagtaacttttttttctaaaaaaaagacgttttataaccatga

SEQ ID NO: 18249 - DNA, 201 bp, Homo sapiens
taccttttccaagttaaacttaataaagagagaaaaggagactctacataagaaaatgatatttattcaggtttgcaatgtgaataagtgtgccatattayactatgtgcatatttaaagaagttaagacaaggggaagtttttaaaggcaaaatgagaaagaataaataagttgttttgaatcaattgtccttggctacg

SEQ ID NO: 18250 - DNA, 201 bp, Homo sapiens
cttccacatttttgggtatctttacaatagcaccccattctactggtaccaatttactgtgtcagttcttatgctgctaataaagacatacccaaaactakgtaatttgtaaaggaaagaggtttaattgactcacagttccacgtggctagggaggcctcacaatcatggcagaaggcaaaaggcacgtcttacatggca

SEQ ID NO: 18251 - DNA, 201 bp, Homo sapiens
aaaagtattttttcctcctaggcctctgggcctgtgatgggaggggctgcctcaaaggtctctgacatgccctgtcagacattttccccattgtcttggtrattaacatttggctcctcattacttatgcaaatttctgcagccagcttgaatttctgctcagaaaatgggtttttcttttctatcgtattgtcagactgc

SEQ ID NO: 18252 - DNA, 201 bp, Homo sapiens
gctgcactaggcagtgccccattggggactctgtgtgaggcctccaatcccacatttcccttctgcactgacctagcccaggctctccttgagggccccamccctgcagcaaacttctgcctggacattcaggcttttccacacatcctctgaaatacaggtggaggttcccaaacctcaattcttgacttctgtgcaccc

SEQ ID NO: 18253 - DNA, 201 bp, Homo sapiens
tacatggcggcacatgtgagagaaagaaccaagtaaaaggattttcctcttataaaaccatcagaccttgtgagacttatttaccaccacaagaacagtawgggctagactgcccccatgattcagttatctcccaccgggtccctcccacaacatgtgggaattacaggagctataattcaagatgagatttgggtgggg

SEQ ID NO: 18254 - DNA, 201 bp, Homo sapiens
gaggcaggaaaatggcttgaaccaggtaggtggaggttgcagtgagcggagatcatgccactgcactccagcatggacaacagagtgagactccatcccamaaaaaaaaaaaaaaacagggataaggaggatgatatgtatatggtaatcaggaaaggactcttatgaagtgacacctgagcacaggcaaggaggtagtta

SEQ ID NO: 18255 - DNA, 201 bp, Homo sapiens
tgaggcaggaaaatggcttgaaccaggtaggtggaggttgcagtgagcggagatcatgccactgcactccagcatggacaacagagtgagactccatcccmaaaaaaaaaaaaaaaacagggataaggaggatgatatgtatatggtaatcaggaaaggactcttatgaagtgacacctgagcacaggcaaggaggtagtt

SEQ ID NO: 18256 - DNA, 201 bp, Homo sapiens
aaataacaacaaaaacaaacaaacaacaacaacaacaaacaacaaggggctgggcacagtggctcacgcctgtaatcccagcagtttgggaagctgaggasggcggatcacctgaggacaggagttcaggaccagcctggccaacttggtgaaaccccatctctactaaaaatacaaaattagcgggtgtggtggtgtgtg

SEQ ID NO: 18257 - DNA, 201 bp, Homo sapiens
gctccgcccccgaagctcctgcagggctggcaccttctgcgcctgacagagagcatgtgggctctataaatgaaagtgaatcatgggctccatttaaagckcttatcattgtgcctgatgcaaagcaatcttgctgctttaaattttttattattattaaagatttgttaaaagaggaaacaatattcaatatgtacatat

SEQ ID NO: 18258 - DNA, 201 bp, Homo sapiens
agtgcctcggagactccgccccagaccagcgctgccgcttgccagccccccagttgaccccatagagcatgcgccgtaggcgtttctaagagatggagccsgtcctccgcctcgcaggctggcaggtccacagctctaccagcgcgtcgcctacgcatgctctcttagcaaaggctgttttaggcggccttctgctccgcc

SEQ ID NO: 18259 - DNA, 201 bp, Homo sapiens
gatgcccaagtctgctttcgaccacgccgttggctaacaagagaggtaggatgggatgcctggaggagctaaggggagagcacgaggatgcagagagaggmatcagacatccctgctgtcctcgcggtccaggagcactgggcagcttcactgaccggagaccgcgcctgtccaggaaagtggacagcgcccagggaagag

SEQ ID NO: 18260 - DNA, 201 bp, Homo sapiens
ctgcaacatctattttaaagttgctgttttctttaataatttgtactttactgatattttgtgcctaaatgaggtatttccagattttattgtttacttaygattaataactttcagatgttttaattagtcgagtggttatttttgcatattttttctaacaaaatttagctcagatactttgacttctgtatagaaata

SEQ ID NO: 18261 - DNA, 201 bp, Homo sapiens
atagcacaaatatgcattaataggacacttggtaaataaataatgatacagtcatatagtgaaatatcatgcacttctggaagatgtgctttatgtattgyatggaaagatctccaagatattaagtaaaaaattcaaagaacaaaatagtgccatcttttgcattcaaatggaggcaagggaaaaataagaatctgtgtg

SEQ ID NO: 18262 - DNA, 201 bp, Homo sapiens
tgttttgagcacaggaaaaactaaaagctctcactataactcatcactcattttataacatatttataaaaaggaagcttaatggcatatatctgtaaagyataaaaatctcaagagttagaaatcaaatttcaaaaaaaatggttgtcgtggccacctaaacattattaaaatcttattacagctagaacacatggaaga

SEQ ID NO: 18263 - DNA, 201 bp, Homo sapiens
cttcatccccgcagagtctggtggggatgacagaggtcacacacatcatcacctacataataatatattgtttattgtcttaattgcgatggagaaaaacmcagaggactataagaatatgtagccaggggcctgacctggtgtgagaggctgaggaaatcctccctgaagatgtgaaaattaggttgagaacagaggaca

SEQ ID NO: 18264 - DNA, 201 bp, Homo sapiens
gtcttcatccccgcagagtctggtggggatgacagaggtcacacacatcatcacctacataataatatattgtttattgtcttaattgcgatggagaaaamcacagaggactataagaatatgtagccaggggcctgacctggtgtgagaggctgaggaaatcctccctgaagatgtgaaaattaggttgagaacagagga

SEQ ID NO: 18265 - DNA, 201 bp, Homo sapiens
tatatcccacaaaggacgtttattagtaaggaagagaaacaagcaccaggatttaaggcaagaagggataggctaactctactgttctgtgcaaatgcagkagggttgatggtcaggtctgcccttacctataaatctgctaatccctgagccttaaagggaaaatatagacatcagctgtcagtcttttggctgtacaat

SEQ ID NO: 18266 - DNA, 201 bp, Homo sapiens
gtttattgtgtactactgtaataattttgtagccgcctcctgttgctcaagtattgtaaatatctgcttaaatttctcatgacactaatcatctccacgtragcagtttctccagtaaattgcacattgcagtaaaaagtgatctcttgcagttctcatatgtttttcatcatgtttagcacgatatcataaaccttgaat

SEQ ID NO: 18267 - DNA, 201 bp, Homo sapiens
aaatttgttggagatttgcaacaatttgagaaaaactaacagaccaactctgtagtctggaaataataaaaagttactaaaaggttaagtatgtcatgaaygcataaaatatatttagatattggccttttttatttattaccataaatatacacaaagtataaaaagttaacattttcaaaacttagacacacacttaca

SEQ ID NO: 18268 - DNA, 201 bp, Homo sapiens
atagtaaagctgaataaataatggtccctgatagtaacaataataaatctatacagttggtccttaaacaacacaggtttgaactgcacaggtccactcayacatggattttttttcaataaacattgaaaaatttgttggagatttgcaacaatttgagaaaaactaacagaccaactctgtagtctggaaataataaaa

SEQ ID NO: 18269 - DNA, 201 bp, Homo sapiens
tcccaagggcaatgaggagctgctgcagttttcctgggaggtgagtgtgaagaaaggaatggcctgtggacagctggagcatgtgctacccaggagaccaygcctaaggtggctgtgcagcttctaagaacatcggtaaatacccttgttccacccagaccgaattcacacctgcacaacgcttttctcagggaattactt

SEQ ID NO: 18270 - DNA, 201 bp, Homo sapiens
gtcttactatgttgcccaggctggtctcaaactcctggcctcaagtgattctctcgccttggcctctcaaagtgcggggattacagaagtgaaacatcatrtatggctggtgtgattttctaatcacaaaatagaaatgccagggccatgcaggtgaacttctacccatggggagaaaatagaaagcaaactggacaagat

SEQ ID NO: 18271 - DNA, 201 bp, Homo sapiens
atttgtccaaaactatagaatatacaacatcaagagtgaactgtagtggccgggtgtggtggttcatgcctgcaatcccagcactttgggaggctgaggcragtggatcacttgaggtcagtagttcgagactagcctggccaacatggcgaaaccctgtctctactaaaaatacaaaaaaggtagctgggtgtggtgccc

SEQ ID NO: 18272 - DNA, 201 bp, Homo sapiens
gcattctatatgacatgctggaaaagacaaaactatagagagagtaaaaaagatcctggttgccaggggttaggagggaggaaggaattcatagacagagyaaagaggatttttcagggcagtaagactactctgcatgatactatagaggtagacacatgccatcatacatttgtccaaaactatagaatatacaacatc

SEQ ID NO: 18273 - DNA, 201 bp, Homo sapiens
ttacatctacacaaaaacctgcatacagatgtctatagtagttttactcataattgccaaaatttagaagcaaccaagatgtgctccagtaaatgaatgcrtaactaaactgtgctacatccagacaatggagtattactcagccctaaaaggaaatgagctatcaagccacaaaaagatgtagaggaaccttaaatacat

SEQ ID NO: 18274 - DNA, 201 bp, Homo sapiens
aaggaactctttcattgaaatagtacataaaatagagcacacacatactgagtatgcagtttgatgagttatcacaaactaaacacagctgggaaaaccarcagtgagtccaggaaacaacaccagcaggactgcagaagcccccttgggctctcttccagttgtgtctcccaaaagtaactattgtcctcatttttcaca

SEQ ID NO: 18275 - DNA, 201 bp, Homo sapiens
ttctaagaaacagtcaaggctgtgattgatcagtaatgtctgccagaggtgtgcccatctaattcaatgctactggccagcaggccaaatccagcccatcrcttgcttttttattttgttttttaaaattttttttattggccaggcatggtagctcatgcctgtaatcccagcactttgagaggccaaggcagaaggact

SEQ ID NO: 18276 - DNA, 201 bp, Homo sapiens
aatttgtgacagatctcctcattcaataatctccatctaggtacaacataagaaggtgaccacagtcagcctgaggatggcagcaggtggtaccgtattcyaggcattggccaaagttcatgcttgtgcctctcaaatgaaagactctttagagttctgatgaggtcattcccacctctcccatatcattcaacacaaata

SEQ ID NO: 18277 - DNA, 201 bp, Homo sapiens
atcagatttgtaagcaggttgtctttctatttggaaagggtttgcatgcccagacctttctgatgttgattttacatgaaccccaaatgcactcctggaaygcctacctggctccagtgtaacatgttttgcacagaagttccagcaggagaatgtgttgtatatacatccactctagactgcaaaataaatacattgaaa

SEQ ID NO: 18278 - DNA, 201 bp, Homo sapiens
acatctatcattggtttagctccagtttattcactgctattccaagcatattgtgatcaggggttagtgttgaaacagcggtttctatctccaaaacggayttaaaatcactctttatgaagcaacacagaaataaaaaaaaatctaggactcaatgagaagcagatggaggggaggaaacaggaggaggaaaagaaagct

SEQ ID NO: 18279 - DNA, 201 bp, Homo sapiens
atgcatttcctctctgtctagggttatagaatgattttattttcattttaagataatttttttctagatgtagtttctaaattttctagaatgaacatgasttatttacatgataaaataatcaaaactgtatttcaaaagtcaggggcccccattcacatctatcattggtttagctccagtttattcactgctattcca

SEQ ID NO: 18280 - DNA, 201 bp, Homo sapiens
gtgtcgattatggtgatggtttcacaggtgtatacaaacactgaaatatatcaaattgtatactttaaatattctatgtcacttatacctcaataaaaaawtttttttttaaataataaaacgactcgggaggctgaggcaggagaatcacatgaagctgggaggcggaggttgcagtgagccaagatcgcaccactacac

SEQ ID NO: 18281 - DNA, 201 bp, Homo sapiens
aggggagggatggggggaggtatcacaaaggggcagcagggaccttttaggatgatgatatatttgctgtgtcgattatggtgatggtttcacaggtgtawacaaacactgaaatatatcaaattgtatactttaaatattctatgtcacttatacctcaataaaaaaatttttttttaaataataaaacgactcgggagg

SEQ ID NO: 18282 - DNA, 201 bp, Homo sapiens
agtatcaggatgtcccgaacaggtctgctcccaaacctggtggagcaaaagaatctaccaggcagattttttaaaaatgcagatcctcagaaataaaaagsaatgaactactgacatacacaacataggaaaatttcaaaacaagtattctgagtggaagaagccagacaaaaacaagtataaactgcatgactgttctca

SEQ ID NO: 18283 - DNA, 201 bp, Homo sapiens
atttgggtaaatatgttacataaatatacacaaggggtatgccactgtcataaatataaataaaatacaaacagaaaatggcttacagataatctcataamtaatactaagtggaaaaaaatgaaaccaaatatacactaaggttatacttctgtgataatcatatcacagagtatatgtagataatgatcaggaggaaat

SEQ ID NO: 18284 - DNA, 201 bp, Homo sapiens
ttgagggatgactgtatattttctatttacccattctacttgtctagttatattagtcaaattttaatgatggtattgattaaacactttttcttgagtaytggtatcagtataatcaccaagtagtactgcatgccagcacaattctaactagttagggatactagagccatgaaattgaaattgtattgaaatttacat

SEQ ID NO: 18285 - DNA, 201 bp, Homo sapiens
ataggtagtagactcaaggcaatagtggctggaaagagtttggggtcatgccctcctacttcttccctttgggtgtaagacaagtcacagaaattctctamgcctcactgtcctcatgtttaagtcagagataatcacgtttacatcacagagatgctctgggaattaaatttaaaaaacagagcaaagtgcctcacactt

SEQ ID NO: 18286 - DNA, 201 bp, Homo sapiens
atataaaaaaacaaaagacctgggaaagaaaaacaagtgttttacagaaatgaagcaaacacattttcacatgacataatcattgacttggtggtacacarctcaagtccagctttcactgatatttcctcattagattaataattttattataaagcctccaaggggcatccaggccccaaatgaagtcaagatgctccc

SEQ ID NO: 18287 - DNA, 201 bp, Homo sapiens
gataaaattaattgttagcatccttattactggcacagctgtgatatttctggatttgactatgcacctgctgcaggaaaacatgataaaatgtcatttaratctctaactacaagaccgttagactagagagctctttaaggcaaggacatgaaaactgcgtacttttatacctcgcttaagtcagtgacagatttacca

SEQ ID NO: 18288 - DNA, 201 bp, Homo sapiens
gaaaaaaaggaagaaaggaaaggaaatgaaatgaaaggaaaggaaaggaaaggaaaggaaaggaaaggaaaggaaaggaaaggaaaggaaaggaaaggaawggaaaggaaaaaagaatggggagctattttattaactatatcaatatttttgaagttcatgtggaagaccattttaaacgtgtatttgtgaatgagtaca

SEQ ID NO: 18289 - DNA, 201 bp, Homo sapiens
ggagggatggggggaggtatcacaaaggggcagcagggaccttttaggatgatgatatatttgctgtgtcgattatggtgatggtttcacaggtgtatacwaacactgaaatatatcaaattgtatactttaaatattctatgtcacttatacctcaataaaaaaatttttttttaaataataaaacgactcgggaggctg

SEQ ID NO: 18290 - DNA, 201 bp, Homo sapiens
gtctgggcatttctttttaccgggcgccaccttgtggccaaaacttaccatttcaaataatagatatttgggtaaatatgttacataaatatacacaaggrgtatgccactgtcataaatataaataaaatacaaacagaaaatggcttacagataatctcataaataatactaagtggaaaaaaatgaaaccaaatatac

SEQ ID NO: 18291 - DNA, 201 bp, Homo sapiens
tgtggccaaaacttaccatttcaaataatagatatttgggtaaatatgttacataaatatacacaaggggtatgccactgtcataaatataaataaaatasaaacagaaaatggcttacagataatctcataaataatactaagtggaaaaaaatgaaaccaaatatacactaaggttatacttctgtgataatcatatca

SEQ ID NO: 18292 - DNA, 201 bp, Homo sapiens
tttaaaaattatatttaggtcttgaatggtaataaaaatgtaaacgggttcaacttttctaaagtacaatatgtattagaagtcttaaagctatgcctacmctctcccttactaagtctactgctataaatgtatcatcctaagaaaacactctaacatataaggacagatgatttatgactgcaaaacaactatcactgc

SEQ ID NO: 18293 - DNA, 201 bp, Homo sapiens
ctgacccggaaaggcatttttaattatggcagagactgccacccattcccattcttgccttcttcctttcagtaacagaatccctaaagctttccctaagyacatggctgccaagatagaaaccacatcctcatcctcctgcgagcagccaggctatggccataccgctcacttctaagctatctccttcgcacaaagtca

SEQ ID NO: 18294 - DNA, 201 bp, Homo sapiens
ctgcagcctttgaccctggcaagctgctggataagagggctggaacaagaccagtagcctagatgatagccgatccaatgtctctactgcaaaccccatgmccagtggaggcccaagacacagaagggtgaagcaacacaggtctgtaatataaaatagagttggcctaggacagccttggtttcaacattcccaagggcc

SEQ ID NO: 18295 - DNA, 201 bp, Homo sapiens
gaggcccaagacacagaagggtgaagcaacacaggtctgtaatataaaatagagttggcctaggacagccttggtttcaacattcccaagggcctctgacrtcccaggtctggtggccatttgtactttgctgaggcctggcgtgtactgtgtgtgggctgctggcagtcactaagctggtgggaaagctcaggatctgcc

SEQ ID NO: 18296 - DNA, 201 bp, Homo sapiens
gagggatgggaggggtccaagtaccttaatgagatgatctggtaatcgtcctaatttggccatagggctagtacagaaggcgacggaagccacaggacccrgggcaaaaaacattttaatccttttagccagctcagggatctgtgaaaatgctataaaacctgtgagaacaaaggacagaaaacaggaattccatcatct

SEQ ID NO: 18297 - DNA, 201 bp, Homo sapiens
ttgtctgctttaagagtactaaggaaatacatccatgccattatcaattcatatatacctgaaagcccagaattcatcctgagaaactgagagtgtcttabgtttccgagaccaggtatttcctctgctgttgcccatccacacgtcaaaaccagcatcagcaagaatgaagcccaggctgctgttggcaaggtttgtgac

SEQ ID NO: 18298 - DNA, 201 bp, Homo sapiens
ttccaggtatggttagaaaagagatcagaccttagtgactgctggtgaagtgaattgcatgctgcagcccctcatcagcatctttgtacagctcagtttcrtgttttctgcagaatcaggagctgacaatcaaaatggcccctcactcacattcattggtcagactgggcttgtgataacaatttagactaatcactgaca

SEQ ID NO: 18299 - DNA, 201 bp, Homo sapiens; identical to SEQ ID NO: 17859

SEQ ID NO: 18300 - DNA, 201 bp, Homo sapiens; identical to SEQ ID NO: 854

SEQ ID NO: 18301 - DNA, 201 bp, Homo sapiens; identical to SEQ ID NO: 850

SEQ ID NO: 18302 - DNA, 201 bp, Homo sapiens; identical to SEQ ID NO: 8063

SEQ ID NO: 18303 - DNA, 201 bp, Homo sapiens
aactcatcccaaatcttccttctttccctcctgcctgtcccctcagttccaaccccaagtgtcactaagtctttccaatcttccttttctacggacccatmtgacctctcccctcctccccaggctgctcctagccaggccgagccagttccaattctcccttagcctccgctcccccaccctataatccttctatcacct

SEQ ID NO: 18304 - DNA, 201 bp, Homo sapiens
ctgaactaatttacactcccaccaacagtgtaaaagtgttcctttctctctacaacctcgccagcatctattatttttggacgttttattaacagccattrtgactggcgtgagatgatatttcattgtggttttaatttgcatttctctaatgaacagtaatgttgagcttttttcacttgattgttgtctgcatgtatg

SEQ ID NO: 18305 - DNA, 201 bp, Homo sapiens
gtagacccccaattgatttttaccaaggttccatgacaattcaatggggaaagaataatctttttaacaatggtgctagaacacttgaatagctatatgcraaacaatgaacctagacccttaagtcatagaaaaattaactcaaaatggaccatacacatacatttgaaagttaaaaatataggagttcctggaaaaaaa

SEQ ID NO: 18306 - DNA, 201 bp, Homo sapiens
gcagtggcgtgatctctgctcacagcaacctccaccttctgggctcaagtgatccttccatctcaacctcctgagtagttgggatttcaggcgtgcaccamcacacccagctaatttttgtgttttttgtagagacagtgtttcaccatgttcccaggctggtctcaaactcctggactcaagcgatccacccacctcggc

SEQ ID NO: 18307 - DNA, 201 bp, Homo sapiens
atatcacttaagttctctgaatcttctcttactcatctgttaaatggccatatttcacatgagtgtaaaatggagtaaattaggtaagtcctataaagccmtgagcaaaaattctcaatcaatattagtgttgaattaagtttcacttaaagctgcctccttgcatattttaagttcaccctgacagtttttctgtacata

SEQ ID NO: 18308 - DNA, 201 bp, Homo sapiens
aaaactgtactgttgtagagccttagatgatcaaatgaccttaaccaagtttctgattagtttaacagtatcgttggaagagacttatttttctgtctacsaaactgtaaggcatttgagggtaggatccatctaataataataacatatgccagttatttaatatttagtggctgcaaagtgttattctaagtggtttgc

SEQ ID NO: 18309 - DNA, 201 bp, Homo sapiens
cacaaattcaaaagtatcacaccacattatgttccacatacagtattggttaactataatacaccaagtaatggcattgccctatcttgagatatctttayggattagaggggaacattttaaaataagagctgtaaaactgtactgttgtagagccttagatgatcaaatgaccttaaccaagtttctgattagtttaac

SEQ ID NO: 18310 - DNA, 201 bp, Homo sapiens
aaataaaaccaggtattttattgggcctcatttcttcaagatgctctgtgaacatgaagaattcatagggccagagagcaaaggttaacacactacagctygtgggctgaaaccagtctgccacctgtttttgtaaataaagttttattggaatttgtattgtctatgactgcttttacactacttttacagcacagttga

SEQ ID NO: 18311 - DNA, 201 bp, Homo sapiens
agaaaaatattgtgaattggggagctgtgaggagcctgctagggaaagaagaatcacaactgacaggacagtactcataatctagtcaaaggttttagccratgtaaagacagataacatgtgtgggtattcattgagatattcctgagctgtaggtcatttacagcaagaaggcagatttgaaataaaaccaggtatttt

SEQ ID NO: 18312 - DNA, 201 bp, Homo sapiens
ccagtcagggccagaaatccaccttcattgtcccattttagggatatgtaattctccagaactgcaaagatttttacctgccaaaacttatcacttctccrtttcacaatacatcatgtggtccaatgtgatactgacagtatttgctgatttagaccaagtaagcaggaaatagcaagcattctagacaccttggcaaga

SEQ ID NO: 18313 - DNA, 201 bp, Homo sapiens
gcaaatttatcagatcgcagggtgactcacatgaggaatgtttgagaagcactctttacaagattctaattctatatattaaacgtatttttcatatttgwagtaaatttcatcaaaacaattccaaactctttcctcacatttcctcagaaatctcagtggactcttgtctaggattcctctcagttgacaatcactttt

SEQ ID NO: 18314 - DNA, 201 bp, Homo sapiens
ggtctgccttgtcgggagggcggatgcccaccaccctcggactatttgttcagccaatcagagcagccagccaccgggaagtgcctcggagactccgcccyagaccagcgctgccgcttgccagccccccagttgaccccatagagcatgcgccgtaggcgtttctaagagatggagcccgtcctccgcctcgcaggctgg

SEQ ID NO: 18315 - DNA, 201 bp, Homo sapiens
tgcattttaaaagtacataactttgagaaacttaccacattcatgtttgtttcaggatccacagctgtcagtttccctccagacccctcagaatgcagggkccagagaaccaaacagaccaccaaccccaagaaccgcattttcattctgtataataaaacagtctattattatttgcttgaattttactacacaaaaata

SEQ ID NO: 18316 - DNA, 201 bp, Homo sapiens
taaagtatatataatatatcccacagaggttaaaaaaaaaaaagaaaaaacaaagcacacaagaagtcaggggcaaacccaggtgtagcaccaaggtcccmtaagtctcctttctattacctgggagcatatcaagactcatgctcactttcttcatattccagggcactgcaccttcccctgcaacagtgtgatacacac

SEQ ID NO: 18317 - DNA, 201 bp, Homo sapiens
ggaagtcaggaggggaagtgggatgcatgagaagaggacgcgtttcactttgggtgtgaaaggccttctccattctttttatctatttgcctttaaacacyggaaataacaccagtggcaacaaccttgctcttgaataggagtgaaggacagtaaagagcctctgtccatgctctgttttagaatgtggaaatgcaaacc

SEQ ID NO: 18318 - DNA, 201 bp, Homo sapiens
aagaaaaagatgaactgaagcaatttaacgtgggtggcctagagaggacccgtggtcaagaatgattctgcagattccaggctaggtcattaggaggatgytggtgctattaataatagaggaggaagtcaggaggggaagtgggatgcatgagaagaggacgcgtttcactttgggtgtgaaaggccttctccattcttt

SEQ ID NO: 18319 - DNA, 201 bp, Homo sapiens
actccccatgactttctgaaataaggctgagcagatgaaaacagagccacttccctatgaagtgtaatttctgaatttcaattcccttcaggagcaaagcrttgctcaacacttcctaagaaggttgcttaatggtgggaaacagcatgcacatactgcacgagtagccaagggctactactgtgcagaatggaggtgaaa

SEQ ID NO: 18320 - DNA, 201 bp, Homo sapiens
gacaacccctggggaatctttgctgaggccacagttgaaaagcctgtttctgcatgctgaaggcagtcattccaggctttcacagtctagagtgccacttyacccactcggcaatcagatgcataactttcagatacaaatgtgccactcttggtgtgtgtatatatatataaaatatatattgtgcctatcatggcatca

SEQ ID NO: 18321 - DNA, 201 bp, Homo sapiens
gtaaatgtaataaaatattattagaacataaccactatgaagaaggatagagtgaagtggcattctttggcccaggtaatataatcatagtaacagcaagygcatactaagtgttgacaatgtgacaggcaccatgctaagcacttaagcactttacacgcattatctcagataagtcacctaacagctctctgagttgct

SEQ ID NO: 18322 - DNA, 201 bp, Homo sapiens
atgtcacagctctttaggtatgttgaggcacttttcacccaccaggagtgatcaggagctaggccatgagtaaggcgacttgactttgaaaggccaggaaygggctgctcccacaggtcaggtcatttccaacaaaaacgactgcaatcgtcttccctcaggatggagagtcagagagaggcaagaggaaggctcggtagg

SEQ ID NO: 18323 - DNA, 201 bp, Homo sapiens
tctagaaagaggggctttcctgctcatgtcacagctctttaggtatgttgaggcacttttcacccaccaggagtgatcaggagctaggccatgagtaaggygacttgactttgaaaggccaggaacgggctgctcccacaggtcaggtcatttccaacaaaaacgactgcaatcgtcttccctcaggatggagagtcagag

SEQ ID NO: 18324 - DNA, 201 bp, Homo sapiens
tgcaaggtagcttccgtagactactccggaaggcactgctcacatacatgaaaatatacatggtactccctggagttgtacaacctgggggtgctataccytcgtgttgttaaaatagcaggaccccaggccaagagtataaaatgattcccataactttttttttttttaagagagaaaaggtctcattctatcacctag

SEQ ID NO: 18325 - DNA, 201 bp, Homo sapiens
catcaaccatgacaaggacagtgacagcatagaaaagcttataccttgcaaaggaaaaaaaagcaaaatacaaaattatagactactctaaattacagctrtgcaaaattaatgtacaccaaagaggagtgtaaaataccaaggaaaaatgagaagaatgatttgtccagatgataagactataagtgaattgacaaatgt

SEQ ID NO: 18326 - DNA, 201 bp, Homo sapiens
gcagagggtgtatgggaaatctctgtaccttccactcaattttgctatgaacttaaaactgctttaaaaaataaaatttaataaaaatttttaaagctgartaaaagttaaatagataaaaaggctcacacacacaaattcataaatatatgtgtctgtgtctgcctgtgagaatttattttctactcacctgtacccgag

SEQ ID NO: 18327 - DNA, 201 bp, Homo sapiens
gtacccagccacttcaaaaacgcactctggggaagaaattctttgtctccaaataagtcctacaaaataaaaagaaacccaagaacatctcagcatttcaytctggtgcataagtctccgtgactcacctcagaagcagagacaagtacccaatgtctccacgaatggcctcaggagagaatggcaaccagtggacatcaa

SEQ ID NO: 18328 - DNA, 201 bp, Homo sapiens
aaaataaggatgcatataaaactaagacacaaaatgaatccctgagctgagtttgcatccgaaaacatcacgttcacacttcatttgggtgaaaatgaacwaggacacttctcatgggcaaccacggggctttggcttcacacagatgtgatcaataacgacagtagcgggctccaagagtacattaatctcagaaaaaat

SEQ ID NO: 18329 - DNA, 201 bp, Homo sapiens
actatattggcaaggctggtctcagatgacttcgtgacctgcccgcctccgcctcccaaaggaattattattattattattttatatttatttatttattwatttatttatttatttatttatttatttattttgaggctgagtctcgctctgtcgcccaggctggagtgcagtggcgcaatcttggctcactgcaagctc

SEQ ID NO: 18330 - DNA, 201 bp, Homo sapiens
ctatattggcaaggctggtctcagatgacttcgtgacctgcccgcctccgcctcccaaaggaattattattattattattttatatttatttatttatttwtttatttatttatttatttatttatttattttgaggctgagtctcgctctgtcgcccaggctggagtgcagtggcgcaatcttggctcactgcaagctcc

SEQ ID NO: 18331 - DNA, 100 bp, Homo sapiens
tgtttttttatatccaagaaaatgataactttgaagatgcccagttcacyctagtttcaattagaaacatactagctattttttctttaattagggctgg

SEQ ID NO: 18332 - DNA, 201 bp, Homo sapiens; identical to SEQ ID NO: 17936

SEQ ID NO: 18333 - DNA, 201 bp, Homo sapiens; identical to SEQ ID NO: 17860

SEQ ID NO: 18334 - DNA, 201 bp, Homo sapiens
cagccctaggaattcagagtctccacaggtctcagacaggcccaagaaccagtatttttaatagcaccttaggtaggtcagaacaacactggaaaactacrctgggatggccttcttcaaacaggtgagagtacctgggctctgggcagggccagtgagaaagtgagaagtaatatcaagtcttggctctggggagctccg

SEQ ID NO: 18335 - DNA, 201 bp, Homo sapiens
cctccatcatctctgggggtgcaataactgatgaggtgacagacattgggccttttaggaaaatgtccattaggtaagaggtcctaggcatcctcaaaaaygtaggggaattctagtgacagggtatatgaagaaaacaagtgactataagcataaatgtgaccaaggagaaaagcagagacctgaaccaagaacgaaaat

SEQ ID NO: 18336 - DNA, 201 bp, Homo sapiens
ccctgcccctctctgccaccacggcctgtcctcagacagctttgcagcacagcaacttgagttccagagcttcacagttgagcgaattttgggaaattatscagctctcatccaaaattctccctcaacagaaggagcagagggtccacagaagaaagcacctgcaggggacacagggctagaaatgacacagtgcttgtc

SEQ ID NO: 18337 - DNA, 201 bp, Homo sapiens
tactaaagaactagcctggagctgaggacacagaaatgactaagtccaagctttcagtgccctcctacataaatgtgagtaattggatgtgatgcctagtycagaagtcatagccagaggccctcagatatgcatcctttgccaaaatagctggaccctctgggtgttctagaaatttgaattagtagtcaacagttaaaa

SEQ ID NO: 18338 - DNA, 201 bp, Homo sapiens
atataaatgaaatctattgttctaggaaatatgaacagggcctatattccaggaaaaagacacatatatatttgtagcaacgaggttaggcagaactcttyctaataagtttcattttctcaaaatagaaataacaccaggagaaagttggttttccttttcagttgctattttgcaatcacattgcatgcatagtctcac

SEQ ID NO: 18339 - DNA, 201 bp, Homo sapiens
ctgagactctgtatttctcacaagctctcaggtcaaaacaaggcctgtagtctgtaaactacaccttgaatagcagaggtatagactgaactgcaaccaaytcaatctggttccatttttcagtttatcctttagtcagaaatgaagatcataccagcacattttccttcctacagccttctctctctttcagtaactcat

SEQ ID NO: 18340 - DNA, 201 bp, Homo sapiens; identical to SEQ ID NO: 17861

SEQ ID NO: 18341 - DNA, 201 bp, Homo sapiens; identical to SEQ ID NO: 17862

SEQ ID NO: 18342 - DNA, 201 bp, Homo sapiens; identical to SEQ ID NO: 17863

SEQ ID NO: 18343 - DNA, 201 bp, Homo sapiens
ctgacagtggcaagctactatgcaggcaatgaggcatgaattaaacagcattgagtatctagtaaggcttccctcagtggcttcaagtcatccctggagtstgctcacaagctgttctctttgcctctgcattctccattcagcacttgttggagtctctcttttctttgtctctctgtacctacagcctaaggctcctaa

SEQ ID NO: 18344 - DNA, 201 bp, Homo sapiens; identical to SEQ ID NO: 17864

SEQ ID NO: 18345 - DNA, 201 bp, Homo sapiens
tttaatccagaagttacattttaatggaagatagaaaactatagatctgttttcgatttcttactctacactaacatgctctttggagacaccaaagggcaaaaaaaaaaaaaaaaaaaagaaaaacccagaaatgtttcctgagatgcgtccagtgtgtgaacagaaaaaagttcctgtgcctggctttctccacaggtg

SEQ ID NO: 18346 - DNA, 201 bp, Homo sapiens
agtgaggatgagaagacaaagaggacaaaacaggtttctgcagcggggcctctaaggaaacacagtggccacccaggattagcccatggagggaggaacgrcttccctctgcccccaaacacacgcccgcccctgcaggctcacacattctttccagtgtataaattgtcgttaattctcctctcaaattaacctctgttc

SEQ ID NO: 18347 - DNA, 201 bp, Homo sapiens
agggggaagtgaatggcagaggaaaggaatggatgaggcggctgcagtcacacctcttggttgtaatgcgagggttgttcgagaatcctgagtctagtgargcccttggagtggacaccaccatgccctgtgactcctggggccacacaggtgggtggcagtgctgtggattggctctgagggcttcctgggagagccgcc

SEQ ID NO: 18348 - DNA, 201 bp, Homo sapiens
attccataaactgagtggataaagcagtgcagggcttgagaggattaactccaattttgaaagttctactgtgggtgaaatgctatcaaacagcatcacayactatagagaaatctttcctgaaaggaagagtcagttgatgtgccaaactgcattgttgtcttattttcagaaactgccaccgcaaccccagccttcagt

SEQ ID NO: 18349 - DNA, 201 bp, Homo sapiens
gcccaggctggagtgcagtggcactaccacggttcactgcagccttgacccccctaggctcaagtgatcctcctgcctcaccctcccacgtagctgagacyacaggcctgtgccaccatgcctggctaatgttttcattttttgtagagacaggatcttgccacattgaccagactggtcttcaactactgggctcgagca

SEQ ID NO: 18350 - DNA, 201 bp, Homo sapiens
tataagagcacgaacttaagtgcaattgttttggagtaccacgagccatgtccatgtaagaacatgaacttaactgatgaatgctgagtgtgttctgactkctccaccaactggcggttccctgtctctctccctgtcctcaggcctccatattccctgagacacaacaatattgaaattaggccagttaacaactctaca

SEQ ID NO: 18351 - DNA, 201 bp, Homo sapiens
agtggacagtgctccttctcactctatgaaataattgtccaaaaatgtataatttaacacttataggcaaacctcattttattgcactttgttctattggrcttcacaggtaatgcttttttaataaaacaaattgaaggtttgtgtcaactctgcatcaagcaagtctacggctccatttttccaacagtatgtgctcac

SEQ ID NO: 18352 - DNA, 201 bp, Homo sapiens
gttgtccaggctggtctcgaactcctcggttcaaacaatcctcctgcttcagcctcccaaagtgctgggactacaggtgtgagctaccatgcccagctcartgacatatattctaaactcattcttaattcattggccatcctgacatattgcttgctataaaacacttaataacattgaattaaatatttaaaacctttt

SEQ ID NO: 18353 - DNA, 201 bp, Homo sapiens
tccaagtattaactctgagtccttgctgtggattccaagcctggtaaagttaaaggaaaaaaaaaatgcaagatgcaaacacgccaaccctccaccacatkgcgtttgttttcacagacaatagttaccagcagacagcgggcctctctccttaagccaaggatagcaacagggcccaagggaacctacgtcctagctttc

SEQ ID NO: 18354 - DNA, 201 bp, Homo sapiens
catttccaacctgaagttatactcccaatctaaattatcatctaagcatgaggatagactaagacatttttagacacgtaaggtctgaagaaattacatcycatgtactcttcctcatggaagctactggagaaggcactgcaccaaaatgaggctgtgaatcccacaaggaagatgcgggctccaggagtcaggagccca

SEQ ID NO: 18355 - DNA, 201 bp, Homo sapiens
tggataaaaataataaactgagagtaagacagaataaaagataaagaaattagtctagatgcagcacagaagacagattgcaaatatacaagagaggttargagaaacagtcaagagttagagaggctaacgtgtctgtctggtgagcattacggaaggagagaggagagaaaatgggggagaggcatctttggagtgagg

SEQ ID NO: 18356 - DNA, 201 bp, Homo sapiens
ataactgtggatgctcagatttaggaaacctaatgaactctaagaaagacaaacaaaaagaaaaaccaaagacaaaaagaaaatctcaaatgcactagagwagaaagatacattacctagacttgcatctgactgcttgttagaaataatgggaaacagcagactgttttcaaagcattggcagaaaaaacctgacaacct

SEQ ID NO: 18357 - DNA, 201 bp, Homo sapiens
tgtggatgctcagatttaggaaacctaatgaactctaagaaagacaaacaaaaagaaaaaccaaagacaaaaagaaaatctcaaatgcactagagtagaargatacattacctagacttgcatctgactgcttgttagaaataatgggaaacagcagactgttttcaaagcattggcagaaaaaacctgacaacctagaat

SEQ ID NO: 18358 - DNA, 201 bp, Homo sapiens
tgtttcctctgcctacaacactcttagcatccaccttcaatctacttccacccaatgaactccccctaatccaaacacacctcctcagggaagccttcccsgactgccatgcttgctcaacacgtcccaccccctcagcccattactgctcctttgccacattttccatggttccactccgacctttaattacatgatgat

SEQ ID NO: 18359 - DNA, 201 bp, Homo sapiens
gccctggacttcaaaggccagtgaaactacatctggatttgctattggtttcaagttataggcaaggtcagtgaatcacctgacagtgaatattctctcgytaactcaagatctagggtaatgtgattacgtgcagtccccatagagaggcctaattttcaagaattagcatctcacttttgttaaacacaatcctaaaat

SEQ ID NO: 18360 - DNA, 201 bp, Homo sapiens
acactgaaatgtttacattaaaatgtaggtgtttacaccacacctgaagtcaacccatcaggtcagtctgggaaaggctgatatttcaatctaggcacatygaggcacctatttgtggaattcctaccaatgcagtgtcggtctgagtcatcacctgttaggatcacaaagctctcagcagctaggtgacatgagggacag

SEQ ID NO: 18361 - DNA, 201 bp, Homo sapiens
cagcttagaaaggttagtccaagaactataaagttctaagaagccacactgatctgcttgggcctgagcagcactgtcagaccccccttggatactgaccrtaaataaatggtcgcaagccgggtgggtctgccagtccatcccatcagtcaagcaaaagcactgagggaactgtgtgcccagccctgcttcaggctgtgg

SEQ ID NO: 18362 - DNA, 201 bp, Homo sapiens
gagagatgctgtggcttctgcctggacacagcttccaattctgctggcagaaccacaactacacagagcagctgtgctttatacacttaagttgcttatartctagataagagaacccaaagaaccataaaggaccaatgttatcaaagtaatacacattggacctactatggtcattggatcaatattccacatcatcct

SEQ ID NO: 18363 - DNA, 201 bp, Homo sapiens
ccataaagtggggataaaaagaatgcctatcctacagagttgttaggaggattaaataaaggtgcaaaaatatgacataaaccacagctgtgactgattaygtaccctatacaagcgttacctgttatcatgagagattgggacacgaaggaagcaggctctgccctgaagccacaggaccgtgccccacaccaatatgcc

SEQ ID NO: 18364 - DNA, 201 bp, Homo sapiens
gctaagatggagtagaaatgagaatcttagaggtgagatgtgaaaggctcatgtccctgttttgctaatgagacaaccaaaaatcctgatacaatacatasgtgaaatgaaaaacgagtgaaatgatcagtcgacttagtaatgatggggtccagcatttagtataatgttagtcctacacatcttctttagcataattac

SEQ ID NO: 18365 - DNA, 201 bp, Homo sapiens
atttagaaaattgaaatctcagtgataagtagaagttatggtgaaaccctgtctctactaggcatggtggcacactcccagctaccggagaggttgaggcrggagaactgcttgaacctgggaggcggaggttgctgtgagctgagacagtgccattgcattccagcccagccccatcacacattcttccagcatgctcag

SEQ ID NO: 18366 - DNA, 201 bp, Homo sapiens
aaaagccccaaatccttggtaacgttttaatattatttatgatgtgtttataggaagatttgtaattaggtagtagccctttcctgccttaatagtaggayaacaaacatgaaatggtggagagtagggagtggctgccagctttgtgttcaagctgtcttctgtaacaactgtcaacccgatgacaaaattaccaaagat

SEQ ID NO: 18367 - DNA, 201 bp, Homo sapiens
agaaactctggaagaaaaaaataattatatttatctttttaaattacagcaaagtttttttaaccacaaaagttactcaacatatttacctgtgttttttkttagtgagttagggagctgggcactaacctcatagcactcgcagtaattcttcaggcagcctgacctcctgcagttgcaccctttgttgtgctggggctt

SEQ ID NO: 18368 - DNA, 201 bp, Homo sapiens
cagagggacaaagccacgcagagggcaccctcactgggtactcagggctgggctcaggggaagcaacatgctccaaaaggagccctcagcaaattgacccrgttcacaaagctcagctgtatttgggaaattaattcagattgatgtaagtgtccttctagaaactctggaagaaaaaaataattatatttatctttttaa

SEQ ID NO: 18369 - DNA, 201 bp, Homo sapiens
taagagacaataatgcaaaattgtattttttaaattaaaacaatgactcacttgttgtgtaatgagatttaattttgttgatgctggcaaaaatctccctrctaaagcagtcattggtttagggacatctgtaaggaagataattaaaaattaattgtagcatctatcgttcctcttccacttacacgtggatgaaagtac

SEQ ID NO: 18370 - DNA, 201 bp, Homo sapiens
aagcaggcaggcgcatgtggcctccaccacctcccaggagatgcatgaggaaggccgcctgtcagaaacagagcagttaaaggccgctcaacagtgcaccrtttctacctacagtactatttatattcaacagaacattgcttgtccatgctattttaaagaacatcatccactaaaatctaacgttgtcttcctcatact

SEQ ID NO: 18371 - DNA, 201 bp, Homo sapiens
gaagccaggagtttgagaccagcctgggcaacaaagtgagaccctttttttttttttgatactgagtcctgctctgttgccaggctggagtgcaatggcaygatctcggctcactgcaacctccaactccctggttcaagtgattctcctgcctcagcctcctgagtagctgggatcacaggcatgcaccaccacacctgg

SEQ ID NO: 18372 - DNA, 201 bp, Homo sapiens
tcaggtggactgttctcaagcccaaccctctgtgacagacagcctttgaaaagtataattcacaggaacccccaaaagacctcaagcaaaccaaaacagargtttgtaaggaaggtttgctcggctgttcccctgatagggcctaagggttccctcactttctctttcctcctttccctcaacacaaaggaaaagagaaat

SEQ ID NO: 18373 - DNA, 201 bp, Homo sapiens
atacacacaaatacatacatatctttacatacaaaacaattcaacgctctttgtaaaaattcaaatacagaggtcacagtggaagtctgtggcctccgttscgcttcctggggttgacatttggaatcggtgctgtccagcagcacggcccctagcacagggccatcgctacagaatgtgctgctggacagccccagcctg

SEQ ID NO: 18374 - DNA, 201 bp, Homo sapiens
gatgatactgttcaaggaaatactcatgataccctctgtcagattcacttcccacaggcatattgaatcatgaaattttagtcttggtggttgaaaagacstaaaatgacagttttttgttgttgttgttgttggaaacgggttctcactatgttgtccaggctggtctcgaactcctcggttcaaacaatcctcctgctt

SEQ ID NO: 18375 - DNA, 201 bp, Homo sapiens
gaaatactcatgataccctctgtcagattcacttcccacaggcatattgaatcatgaaattttagtcttggtggttgaaaagacctaaaatgacagttttttgttgttgttgttgttggaaacgggttctcactatgttgtccaggctggtctcgaactcctcggttcaaacaatcctcctgcttcagcctcccaaagtgc

SEQ ID NO: 18376 - DNA, 201 bp, Homo sapiens
aaatactcatgataccctctgtcagattcacttcccacaggcatattgaatcatgaaattttagtcttggtggttgaaaagacctaaaatgacagttttttgttgttgttgttgttggaaacgggttctcactatgttgtccaggctggtctcgaactcctcggttcaaacaatcctcctgcttcagcctcccaaagtgct

SEQ ID NO: 18377 - DNA, 201 bp, Homo sapiens
aatactcatgataccctctgtcagattcacttcccacaggcatattgaatcatgaaattttagtcttggtggttgaaaagacctaaaatgacagttttttgttgttgttgttgttggaaacgggttctcactatgttgtccaggctggtctcgaactcctcggttcaaacaatcctcctgcttcagcctcccaaagtgctg

SEQ ID NO: 18378 - DNA, 201 bp, Homo sapiens
actgtcatgtgtttttatctctattgatggcaattataataataatccctcatagcctgtatacagcagagactcccatgagagtaggactaactcacgcwaagaaaattacattccattgccttgcgctcatgacttagttgcggggaataaaaaggtaaaagaaatggaaagctattgatggcgatgatgccacaagtg

SEQ ID NO: 18379 - DNA, 201 bp, Homo sapiens
gacgcctttgaaaaacttgtaccatctcatctttgttgatggaaactccatctctccaatcatccaggctgaaaaccttgggcgcatccttgactcctctstttctctcacatcccacatccaatccatcagcaaatcctgttgactcaaccttcaaagtatccctagaagctatttcttgccacctccactgccaccacc

SEQ ID NO: 18380 - DNA, 201 bp, Homo sapiens
cagggagacaatcaggatgcaatggggagacagggagtcacgctttgtctttttgccctggacttcaaaggccagtgaaactacatctggatttgctattrgtttcaagttataggcaaggtcagtgaatcacctgacagtgaatattctctcgttaactcaagatctagggtaatgtgattacgtgcagtccccatagag

SEQ ID NO: 18381 - DNA, 201 bp, Homo sapiens
cagtcagcccacacctcagctacagcccccagacagcccactcctcagctacagccccccggtcagcccacccctcacctgcagcccccagtcagcccacrcctcattcttaagtatgagcagagtgacgcccagggatccacagacatgttaggaaatcttccagagtatgaaagacaggggcccagagaaacggaccat

SEQ ID NO: 18382 - DNA, 201 bp, Homo sapiens
ataatttgaaaaacaaacaagaaaccattagggttttcatgcagagcagcctccagagcaacattctctgagaggaagagtcgaccagagtgagctctccrcagggcctgctctgccctcccctgccccgctctgcccttcgcagggcctgctgtgccctcccctgccctgctctgccctccgccgccctgcagacactct

SEQ ID NO: 18383 - DNA, 201 bp, Homo sapiens
gacacgtaaggtctgaagaaattacatcccatgtactcttcctcatggaagctactggagaaggcactgcaccaaaatgaggctgtgaatcccacaaggargatgcgggctccaggagtcaggagcccaaacatgacaaagaagctggtgaaccccttagcatgatagtagaggggggtccaagacgagagctgcacacag

SEQ ID NO: 18384 - DNA, 201 bp, Homo sapiens
tttctgtaaaactatacatactgaaataagtatatgttgtttggttacagattatatgtaaacaaaaataagatcatattctacaaactgcttcagtgtgmttttattacttatcaatagaagtaataaagataacatctttcattactcatcagtatgttatgaatgtttcccatgtaaatagatttacataccatttta

SEQ ID NO: 18385 - DNA, 201 bp, Homo sapiens
tgctgctgcagtggcctcctaattaacctcgctttcaacttcctccactttgccattagcactaattttccaaaacataaatcaggcaaaaataagcaagygaaaaagcagtaatcagaaaatgcaaaataagatggtattgtatattcctagtgggggtataaaatggtatggccactatggaaagatacggcagttcct

SEQ ID NO: 18386 - DNA, 201 bp, Homo sapiens
gtatttgtcctctacttttatgtaatatacacatatcatggtgtaatcataaaagcaaactttaaaaaagtatttccataacactgaggagggtgaggagygttctggaccgaggaggtggaatatgctgttggtggggtcacagaggacaagttagcaagcgtggcagaatgccggtctggaggctgcaggaaagggcaa

SEQ ID NO: 18387 - DNA, 201 bp, Homo sapiens
ggtgacatgagggacagctatccaagaatttgagacagtcagtacagggtacaaaaattagtctatagatatacatttttatattcttagcttactaatayggactacgaggtttgccaaatttcctatttaatatcctggttgccatttcactttatatacaaagccaaacatattcatttaccaacttacatatatgac

SEQ ID NO: 18388 - DNA, 201 bp, Homo sapiens
agctacagtgaccaagccctcagcagtgcacctgcaggcccagtcagcccacacctcagctacagcccccagacagcccactcctcagctacagccccccrgtcagcccacccctcacctgcagcccccagtcagcccacacctcattcttaagtatgagcagagtgacgcccagggatccacagacatgttaggaaatct

SEQ ID NO: 18389 - DNA, 201 bp, Homo sapiens
ccaagccctcagcagtgcacctgcaggcccagtcagcccacacctcagctacagcccccagacagcccactcctcagctacagccccccggtcagcccacscctcacctgcagcccccagtcagcccacacctcattcttaagtatgagcagagtgacgcccagggatccacagacatgttaggaaatcttccagagtatg

SEQ ID NO: 18390 - DNA, 201 bp, Homo sapiens
cagcagtgcacctgcaggcccagtcagcccacacctcagctacagcccccagacagcccactcctcagctacagccccccggtcagcccacccctcacctrcagcccccagtcagcccacacctcattcttaagtatgagcagagtgacgcccagggatccacagacatgttaggaaatcttccagagtatgaaagacagg

SEQ ID NO: 18391 - DNA, 201 bp, Homo sapiens
gtctttgctgcgctgggtcgttgtggctctatattaacgcaaaggcagtgtcagaactctgctagccctgctggtgatcctggcagcagggctcttttgtytggtacaaaacgggagtaactcagacagtgaggatgagaagacaaagaggacaaaacaggtttctgcagcggggcctctaaggaaacacagtggccaccc

SEQ ID NO: 18392 - DNA, 201 bp, Homo sapiens
acacgaatgccagagactaaagggcagtgctatccctttcctctgagcctgcacattctgtgggctgtgcccagcataggctctgccttggggaagtgggytgagccacagttccatggcagccagtgaaggtgttttgcaggacagaggagctgctgtgggtgcgattggaagtggttcctcgggggtgatgtcagtccc

SEQ ID NO: 18393 - DNA, 201 bp, Homo sapiens
aaggagcttcggaaggctctggaatgggcagcaccaggttcctccaagggagagcaaagccaggtgagataagaagagaaccagggggattctctgcaggraggcatgagtccccagatgactcctccttcctaagcagctgggacccccctgccaccgtggcagagactaaaagtgactctcttggagcaaaaccattgg

SEQ ID NO: 18394 - DNA, 201 bp, Homo sapiens
cttcggaaggctctggaatgggcagcaccaggttcctccaagggagagcaaagccaggtgagataagaagagaaccagggggattctctgcaggaaggcaygagtccccagatgactcctccttcctaagcagctgggacccccctgccaccgtggcagagactaaaagtgactctcttggagcaaaaccattgggcgtgg

SEQ ID NO: 18395 - DNA, 201 bp, Homo sapiens
ctagaatttgacattgagctttcccaataaaatagctaagtgaccaccctgtggtgaagctacagtgaccaagccctcagcagtgcacctgcaggcccagwcagcccacacctcagctacagcccccagacagcccactcctcagctacagccccccggtcagcccacccctcacctgcagcccccagtcagcccacacct

SEQ ID NO: 18396 - DNA, 201 bp, Homo sapiens
gacattgagctttcccaataaaatagctaagtgaccaccctgtggtgaagctacagtgaccaagccctcagcagtgcacctgcaggcccagtcagcccacwcctcagctacagcccccagacagcccactcctcagctacagccccccggtcagcccacccctcacctgcagcccccagtcagcccacacctcattcttaa

SEQ ID NO: 18397 - DNA, 201 bp, Homo sapiens
tcgatgaaacaggaaaataattcttattaaaaatctcaggatatgaaaaaagatattttaggaagcaaaaaagtaatcacagtgatgaaagacctagaagrtatgaaaactagaactaatcagaggagaaagcaacagtgggccagactagaaaatccaacatttatatagtaagaatttcagaaatactgaatattaaga

SEQ ID NO: 18398 - DNA, 201 bp, Homo sapiens
attcaaaaatatttatggaatgaatgaataaatgagtgaaaaaatgatacaatgcatatgttggaaaagtctctggaatctgtgttttttccttcattgtyaccacccctgcccgggttcaggtctgtgctgctgcagtggcctcctaattaacctcgctttcaacttcctccactttgccattagcactaattttccaaa

SEQ ID NO: 18399 - DNA, 201 bp, Homo sapiens
gtagaaggtctgctgcaggatccacacatggaccagaactgcggagggctctatctactctgggaacaaatgccctgaaaacaaatggcaaggaaatgtgygtgtgatcctggctggtgggaggggaggaggctcacttcaggttgaaatctgaattcatactgtgcagcctaataaaaaaaaaattagccaaaaattgtt

SEQ ID NO: 18400 - DNA, 201 bp, Homo sapiens
atcaatatatgaaagggctaattaaaactgtcctaaaaggctgagtgcagtggctcatgtctgtaatcccagcactttgggaggccaaggtgggcggatcwcttgaggccaggagttcaagaccagccttgccaacatggcgaaaacccatcctactaaaaatacaaaaattagctgggcatggtgatgcatgcctgtaat

SEQ ID NO: 18401 - DNA, 201 bp, Homo sapiens
ttaggccagttaacaactctacaatggcctctaagtgttcaagagaaaagaagagtcccacgtctctcactttaaatcaaaagattaagcttagtgaggamggcatgtcgaaagccaagataggctgtgaatcaaaggaaaagctttcggaggaaattaaaagtgttactccagtgaacacacaaattataagaaagcaaa

SEQ ID NO: 18402 - DNA, 201 bp, Homo sapiens
tggcaattataataataatccctcatagcctgtatacagcagagactcccatgagagtaggactaactcacgctaagaaaattacattccattgccttgcrctcatgacttagttgcggggaataaaaaggtaaaagaaatggaaagctattgatggcgatgatgccacaagtgtgagtgaagcaagcaacggaggatccc

SEQ ID NO: 18403 - DNA, 201 bp, Homo sapiens
atgacaaggaggggcacgtgtacaaaacaccatgtgacaaaaaccaaactagatgaattctaaacgaatatagcatttaatttagaattctgtgacagggytgtccctgtgcccagtgggggcatgcatctctgtcagtgtgctctttgaggtcatgtacacaggcctcatctctgcaacgcactggccacttctgagcaa

SEQ ID NO: 18404 - DNA, 201 bp, Homo sapiens
aaagcactggaggctgcgggctgtatcctgtaaggtgtttgactgctgtctctcaggcccagggtatgtgtttgccttagactgtgggcccaaagaactcytgcaggcaggccgggcacgcctgtaatcccagcactttgggaggctgagatgggcggatcatctgaggtcagtatttcaagaccagcctggccaacatgg

SEQ ID NO: 18405 - DNA, 201 bp, Homo sapiens
ctgaggtcagtatttcaagaccagcctggccaacatggtaaaacccagtctctactaaaaaatacaaaaattagcctggtatagtggtatgcgcctgtggkcccagctactcgggaggctgaggaaggagaattgcttgaacccaggaggcggaggttgcagtgagcagagatcatgccattgtattccagcctgggtgac

SEQ ID NO: 18406 - DNA, 201 bp, Homo sapiens
ggaggctgaggaaggagaattgcttgaacccaggaggcggaggttgcagtgagcagagatcatgccattgtattccagcctgggtgacagagcaagagtcygtctcaaaaaaacaaaacaaacaaacaaacaaaaaacaagaaaaaacaaacaaacaaacaaacacctcttggaggcaggaatatgctgatctccataatc

SEQ ID NO: 18407 - DNA, 201 bp, Homo sapiens
aattagcaacaattataaacacaagacaggcaagaaatagcaagattataaacacaagacaggcaagaaatagcaagatgaggtcccagataagtgcagcytatgtccacctggagatgtgaagacagatcatgcattagcacctgccatagagctcgagccaactcagcatggaaggcagcgggcggaggcagctggagg

SEQ ID NO: 18408 - DNA, 201 bp, Homo sapiens
gccttgacttcctccctgccctgctcccctagctcacactatcccaggcccagtggcctcctcgctgccaccacagcaggcatgaccctatccaaggccckcctgggatgttccacagcttgcttcacagagctcattccctcatctctttaaaggctttgctcaaatgtcaccttcacaacggagccatgatcacctttt

SEQ ID NO: 18409 - DNA, 201 bp, Homo sapiens
gcaattctctcacctcagccccccagtcaactgggacaacaggtgcacaccaccaagcccagctcatttttttttgtatttcttgtagagacagggtttcsccatggtacccaggctggtcttgaactcctgagctcaagtgattcacctgcctcagcctcccaaagtgctaggattataggcgtgagccacggcagccag

SEQ ID NO: 18410 - DNA, 201 bp, Homo sapiens
cagggtttcgccatggtacccaggctggtcttgaactcctgagctcaagtgattcacctgcctcagcctcccaaagtgctaggattataggcgtgagccayggcagccagcactactttcgatttatgtgtatttttttttcaagtggttactaagttgtttggatataaatacttactaagctatttagactaaactact

SEQ ID NO: 18411 - DNA, 201 bp, Homo sapiens
tttttttttcaagtggttactaagttgtttggatataaatacttactaagctatttagactaaactacttagtactggaactgataggtacttatttggtytacaagtgccatgaaaaacattcttgagacactaagggtgtgtaagcctctgtgctcatgagttcaagtagaagcacctgaacactttttctcctccagg

SEQ ID NO: 18412 - DNA, 201 bp, Homo sapiens
acaagtgccatgaaaaacattcttgagacactaagggtgtgtaagcctctgtgctcatgagttcaagtagaagcacctgaacactttttctcctccaggcmtaggcatcctttgagtgaggaatctcagacgcaggcagcaggatgcacgtactttattgtgatgtttaatatgtgcacagtgtaacaaaggagatgcagg

SEQ ID NO: 18413 - DNA, 201 bp, Homo sapiens
ctcatgagttcaagtagaagcacctgaacactttttctcctccaggcctaggcatcctttgagtgaggaatctcagacgcaggcagcaggatgcacgtacyttattgtgatgtttaatatgtgcacagtgtaacaaaggagatgcaggtggggggagtatgattatatgataaggaacttgaactggaaaacactatataa

SEQ ID NO: 18414 - DNA, 201 bp, Homo sapiens
ttaattaactttgtacctgactgtagataattattttgatcttgatactgaggaaccaaatggagtgcttttagttctcttgttctagaattgtctatacrtagcatttgtgtgccccctttcaattggcatatcacctaaaatgaaaaagaacaatcaggtttcatttttgaaacataattccagtaataatgaacctaa

SEQ ID NO: 18415 - DNA, 201 bp, Homo sapiens
ggtcctttttgaggggtcgagaacacattttcctgggaccctttgtttcctttgaaaactcattagttttggcaagaacaaagcggaaaattatcagcggkcatctacagctagagagggcagtcggctgagagctggcaagcatttctttaggctctgatttacattgcatatgcttgaagagctattactcattagcaa

SEQ ID NO: 18416 - DNA, 201 bp, Homo sapiens
gcctataccaaaataggcctgttataaacgtttttatattttatattttacgttaaatttttaagttgtatattttacagttgctttaaaaaatgatgtascaaatcaatgtttaacatatacaaaaatgattaagaaagacatttgtaacagtgctggaaaggtagatgttaattactttaaaaatctggctgggcgcag

SEQ ID NO: 18417 - DNA, 201 bp, Homo sapiens
cgaggctggcttcaaactcccgggctcaagcaatcctcctgcctcagcctcctaagtagctgagcctataggcatacccagcttcgctggatattttatgktttcttttttttttttctttttgcttttttgagataggatcttgctctgttgcccaggctggagtgcagtggcactaccacggttcactgcagccttgac

SEQ ID NO: 18418 - DNA, 201 bp, Homo sapiens
actcactaggaaaaaaaatgtttgagatagggtctcgctatgttgcgaggctggcttcaaactcccgggctcaagcaatcctcctgcctcagcctcctaartagctgagcctataggcatacccagcttcgctggatattttatgttttcttttttttttttctttttgcttttttgagataggatcttgctctgttgccc

SEQ ID NO: 18419 - DNA, 201 bp, Homo sapiens
cggggaggtgacacttcataccaaaactcgggaaaaagagcgtatttgtcctctacttttatgtaatatacacatatcatggtgtaatcataaaagcaaactttaaaaaagtatttccataacactgaggagggtgaggagcgttctggaccgaggaggtggaatatgctgttggtggggtcacagaggacaagttagcaa

SEQ ID NO: 18420 - DNA, 201 bp, Homo sapiens
gacccctcctccccaccagcccctctttagagtggaagccataatcctcccagtgccttgacttcctccctgccctgctcccctagctcacactatcccargcccagtggcctcctcgctgccaccacagcaggcatgaccctatccaaggcccgcctgggatgttccacagcttgcttcacagagctcattccctcatct

SEQ ID NO: 18421 - DNA, 201 bp, Homo sapiens
gccatgcccgatggcagaactctgcaggagcctggaaagcactggaggctgcgggctgtatcctgtaaggtgtttgactgctgtctctcaggcccagggtrtgtgtttgccttagactgtgggcccaaagaactcctgcaggcaggccgggcacgcctgtaatcccagcactttgggaggctgagatgggcggatcatctg

SEQ ID NO: 18422 - DNA, 201 bp, Homo sapiens
actgcagaaactgaagcagcggtgcccaggagcaaccaacgcccttcagcgaccatgagggctgatagcgttgatcggttccagtgtgtttccagattcayggcctttcattccagccccaaaccactctcctcacacttaccaaggccatcacgaagccatgcccgatggcagaactctgcaggagcctggaaagcactg

SEQ ID NO: 18423 - DNA, 201 bp, Homo sapiens
gctctgtgcaaatgcccatcggctgcaacacatagaagcctcagagggtgctgcaactgggagagcacgcaattaaagtatgagaagtatcaaatgtcctygaatgttctagacacaatacagcacagaggcaatactattgaccagatgcccccagattacaagaaagatgagtatcttcagaactgtagccttttagat

SEQ ID NO: 18424 - DNA, 201 bp, Homo sapiens
actaatacaaacgccctaaagagaggcaaagtcttcgccctgtcctctgtgctccgagcgcccgcacgctcagcagtcttggctggctgtcggggctgagstcagttccaaatcctcccccacttggcctgccctcacctcactgctctggtcttccgcccctgctctcaccacctgtgcatctgtttagtgacccatccc

SEQ ID NO: 18425 - DNA, 201 bp, Homo sapiens
gattaaaaaagaaaatgtattcagctggttactccttatatagagaattagctaagcatctggtgtttttcaacacattgtgagaatctcaacaccagatygttataggtattattgacagatgcctaatcatgaagtgggagtttccaatgtgatggaactagcaccaccaaacacagccacacatgcccagggagccag

SEQ ID NO: 18426 - DNA, 201 bp, Homo sapiens
tggatgccaccacctggtcctcctccacatctgacatctccatctgggaaggcctgctctggcttgacagcgtcacagggtccaggctttctcccactgtscttcctcctccttacccagagctgcgtctttagcttccccatcagtcatgtcatggcgtttccaatgttcagagaagtatatggcctcgtagactaaacc

SEQ ID NO: 18427 - DNA, 201 bp, Homo sapiens
gaagctgtttctttggccttccattctgacgtaattcaagttaagcctttcttagagtcatctcgtttccaagtccttaggagttacctcattttgtcccyagttacagtctacaccctgctttaggcttcatggtcatttgacctgcctggtccccacacccagccagcagctgagcagctcccatccccaggagcccac

SEQ ID NO: 18428 - DNA, 201 bp, Homo sapiens
atgattgttagcatttcctagaaacagtgtttttaaattaaggtatgtactttttagatagaatgctattgcacactgattgtactacagcatgtttatarttatataaacataacttctacatgcattaggaaaccaaaaaccttgtgtgacttgctttattgtgatttgctctgttgtggctgtggagctgaagctgca

SEQ ID NO: 18429 - DNA, 201 bp, Homo sapiens
ccctctgtgacagacagcctttgaaaagtataattcacaggaacccccaaaagacctcaagcaaaccaaaacagaggtttgtaaggaaggtttgctcggcwgttcccctgatagggcctaagggttccctcactttctctttcctcctttccctcaacacaaaggaaaagagaaatagcaaagagaggtgaaactgcgaca

SEQ ID NO: 18430 - DNA, 201 bp, Homo sapiens
taactgctggtaagtggcgagatcctgattcaaagtccctgtgctgacttcaaagcaggtctcaaccgctgggccatgcctttcccaagcaatacacacgrtatgttatccaggtctatttgttgtccctttttaatctatctatacacacaaatacatacatatctttacatacaaaacaattcaacgctctttgtaaaa

SEQ ID NO: 18431 - DNA, 201 bp, Homo sapiens
ggatggacatttgggctgtttccagtgcctggctactctgaatgaagctgctgtgaacattcccgtacaaatctcccagtggacattggcgcttgcttctrttggctatatttgtaggaaggaaatggctggatcatagcatacacaaaggtttagttttggtagctattgtcaaacagtttcccgaagtggttgtgcccc

SEQ ID NO: 18432 - DNA, 201 bp, Homo sapiens
tctattggctatatttgtaggaaggaaatggctggatcatagcatacacaaaggtttagttttggtagctattgtcaaacagtttcccgaagtggttgtgyccctttatatgcctatcagcaatgtatgaaaattccaaccctttttgtttttacagttttaactgtagatagtattctttatccctaaataaaatgtact

SEQ ID NO: 18433 - DNA, 201 bp, Homo sapiens
actgtagatagtattctttatccctaaataaaatgtactaaagtttacatgcgtgacaattttcttctgtcctatggctctggctatatcaaaattggttrgatatttcaagtcatttatccataattcaagaggagaattaaattattttagaaaacaatgcagagagcagccacacccttataattgtgttctatttgc

SEQ ID NO: 18434 - DNA, 201 bp, Homo sapiens
ttgaaaatgtaggctgcctgatcactttcccctagccttctcacgcagtggactgtctacacctttgcggctacactgctccagctcatgcttatctgctwtgtaagatgaccccaaatgtctaaactccaagataaagtggacattcgcatgttcttgaatcagaaccttcctagactgctgcatctctgaagccttccc

SEQ ID NO: 18435 - DNA, 201 bp, Homo sapiens
caaggagtgaattattagagacaactccactccacaacaggggagaggagagacacatcccctgcagggagaaaggggaactatagaggtctctcctgaamctgcaagccacgcagatggaaagaagggaaaggggacagtgacagaagatttggacaccagatagcagaggggcgagagaactggcgtggcagactcaag

SEQ ID NO: 18436 - DNA, 201 bp, Homo sapiens
gggcacagtggtctgtaatcccagcaccttgggaggccaaggcaggaggatggtctgaagccaggagtttgagaccagcctgggcaacaaagtgagaccctttttttttttttgatactgagtcctgctctgttgccaggctggagtgcaatggcacgatctcggctcactgcaacctccaactccctggttcaagtgatt

SEQ ID NO: 18437 - DNA, 201 bp, Homo sapiens
aatcccagtactttgggaggctgaggcaggcggatcatgaggtcaggagattgagaccatcctggccaacatggtgaaaccctgtctctactaaaaatacaaaaattagctgggcgtggtggtgggcgcctgtaatcccagctacttgggaggctgagccaggagaatggcttgaacctgggaggtggaggttacagtgag

SEQ ID NO: 18438 - DNA, 201 bp, Homo sapiens
tgagcccagggggtcaaggctgcagtaagctacgattgagccactgcacaccagcctgggtgacacagtgagaccctgtctgaaaaaagagttataaaataaaaaaaaaaatactgtcatgtgtttttatctctattgatggcaattataataataatccctcatagcctgtatacagcagagactcccatgagagtagga

SEQ ID NO: 18439 - DNA, 201 bp, Homo sapiens
aatactgggatttgactttcaggctaaacttgagaagtgtggcctctgctgtcctgccagagctctccagccagtgcccagggctctccagccagtgcccrggggtctccaccagtgcccgggggtctccgccagtgccaggggtctccgccagtgcccaggggtctccgccagtgctcaggagtcttggtttctttgtct

SEQ ID NO: 18440 - DNA, 201 bp, Homo sapiens
cgtggaagcctggagctgaggcagtgtgggcgacccctggagcagtgagtgcttccttcatggccttcatcgcaccctgcagtcctcatgtaggggatgcmatccatgaatttagttttcccagcctcctttaaaaacgcgttcatgctggggccggggcagtgcagtggctcacatctgaaatcccaccactttgggagg

SEQ ID NO: 18441 - DNA, 201 bp, Homo sapiens
aggctgtgtgtgtgtgtgtgtgtgtgtgtgtgtgtgtgtgtggtgtgtgtgtggtgtgtgtgtgtgtatgggggagggaggcaccctttccatctgggggkgtgtgtgtgtggggtgtgtgtgtgtgtgtgcgcgtgtgtgtggtgtgtggtgtgtgtgtgtgtatgggggaggcaccctttccatctgggtccaagagac

SEQ ID NO: 18442 - DNA, 201 bp, Homo sapiens
cactccttcgctgcagagggacctgggctgagagctcctctcttatggctgcagtcgggagagaagtctgttggggggagaagggggcttcctcaagggaytccctgtgccctttggcaccttcgtgccaggtcaggcttgaggcctgaaggcagtggtgggggccaccaagggtcgcctcctctgctgggcaagttccca

SEQ ID NO: 18443 - DNA, 201 bp, Homo sapiens
ctgggctgagagctcctctcttatggctgcagtcgggagagaagtctgttggggggagaagggggcttcctcaagggactccctgtgccctttggcacctycgtgccaggtcaggcttgaggcctgaaggcagtggtgggggccaccaagggtcgcctcctctgctgggcaagttcccagtctgacgggcctgtgccgtgg

SEQ ID NO: 18444 - DNA, 201 bp, Homo sapiens
attgaatactgaaccattgctcctaggggaaacatcgggctaggttcctgtgagcctcaggtcacaacgtttttgccaactgttcgatacctgacctggcttttttttttttttttttaagacagcgtcttgctgtgtcaccccaggctggaatgcagtggtacaatcatgggtcactgcagccttgacctcctgggctca

SEQ ID NO: 18445 - DNA, 201 bp, Homo sapiens
aggaggtgccagctctgactcgtgctggaaggcatcccctggtggctggagcgagagtgagctgtggggtgggtggcgtgggggcaggagccctctccacrgttattaccgggatcctggcgacagaaagcagcagcggggacacctcacttgtgggggtaaggagtggcgagatttgggatctgttctgaagagaaaaga

SEQ ID NO: 18446 - DNA, 201 bp, Homo sapiens
gtcatacaggatagttccactgccctgattttctgtgctccactcattcatccctctcctctccaactcctggcaaccactgatgctttactgtctctgtrtatttgctttttccagagtgtttagaactggactcatacagattggctctttcacctactaacatgcatttaagtttcctccatgtcttttcatggcttg

SEQ ID NO: 18447 - DNA, 201 bp, Homo sapiens
gttgaaaataagaatgttagtaatgggctggtttctggcaggtcaaactgggactctgaaatacatatttttctctgctctgccctaaaccttctaattartgaaaacgcacatttgcagacatcaatcaaatgtcatattccctagcagcttgtcctgggatcactgagctggtcacattccacagttgctaactcaggg

SEQ ID NO: 18448 - DNA, 201 bp, Homo sapiens
ataagaatgttagtaatgggctggtttctggcaggtcaaactgggactctgaaatacatatttttctctgctctgccctaaaccttctaattagtgaaaaygcacatttgcagacatcaatcaaatgtcatattccctagcagcttgtcctgggatcactgagctggtcacattccacagttgctaactcagggcttgcag

SEQ ID NO: 18449 - DNA, 201 bp, Homo sapiens
cctaaaccttctaattagtgaaaacgcacatttgcagacatcaatcaaatgtcatattccctagcagcttgtcctgggatcactgagctggtcacattccrcagttgctaactcagggcttgcagagtatgtgtgcacgtgtgtgtgcatgcgtgtgtttgtgagagagatacatgccttctggggagccctggtggcctg

SEQ ID NO: 18450 - DNA, 201 bp, Homo sapiens
actgggctgggagagggcaggtgggggccaagctggaagaggtggtgttattctgtagcacctgatgtacacagaccttgggggtgcagctccaggctttytctctccccacccgcccctgaaggccccactctcccgccttctgcagccagccttccttttgtctgcccctgagctcctccgctcttgtggtcgttaaga

SEQ ID NO: 18451 - DNA, 201 bp, Homo sapiens
tctagttacccctgccgctggagattgttcttttttttttttttttttttttttttttttttgctattacaaataaggcctcagcaaatattgtgactcaracgttttccttctttctggtgtttcttgggacagactcctgcaggggtgatccctggggagagggcgtaattattttatgttcatgatgcggcagtcacc

SEQ ID NO: 18452 - DNA, 201 bp, Homo sapiens
ttttttttttttttttttttttttttttgctattacaaataaggcctcagcaaatattgtgactcagacgttttccttctttctggtgtttcttgggacaractcctgcaggggtgatccctggggagagggcgtaattattttatgttcatgatgcggcagtcaccaccgtgtttctgaaaggtttgttctgcactctgg

SEQ ID NO: 18453 - DNA, 201 bp, Homo sapiens
agcggggcacatttccaacaggacacaccgccctggtctgagtctcgtgggtagtgggagcagaggagagcgccctatgtctgtggggcggcttggctgarcctggaagccacctgacctcccccgtcccttccctgccaggcatcgcatgcggaaagtccatgatgagctccgtgagcctgatggggggccggggcgggg

SEQ ID NO: 18454 - DNA, 201 bp, Homo sapiens
acgtgtatatcctacctccatcagcagagaggcctagaagcaatgaccccaagtagcagtgagcacaccagagcccaggtctgggtttctgaataccattytccacccaaaggagtcagagcttgtccacgaagaagctggttctagggctggggcaaggaaaggtacaagccgagcatggggcatcttattgtgtaagaa

SEQ ID NO: 18455 - DNA, 201 bp, Homo sapiens
agtcagagcttgtccacgaagaagctggttctagggctggggcaaggaaaggtacaagccgagcatggggcatcttattgtgtaagaaagcaaagaagttytggaggactggtggggacctctgggacagaagagccagcttagaggggtgctcactgtccaaatctaggaatatttgaacgtcaaaatgttgtgtacatg

SEQ ID NO: 18456 - DNA, 201 bp, Homo sapiens
tgcgattgcaggaggtaaatatgtatcaaagacatgagttttagtgaaggatatctttttttttttttttttttgagacagagtcttgctctgttgtccargttggagtacagtggctcacagcagcttccacctcccaggttcaagcaattctcctgcctcagcctcccaagcagctgggattacaggcgcccgctacta

SEQ ID NO: 18457 - DNA, 201 bp, Homo sapiens
aggaggtaaatatgtatcaaagacatgagttttagtgaaggatatctttttttttttttttttttgagacagagtcttgctctgttgtccaggttggagtrcagtggctcacagcagcttccacctcccaggttcaagcaattctcctgcctcagcctcccaagcagctgggattacaggcgcccgctactatgtctggct

SEQ ID NO: 18458 - DNA, 201 bp, Homo sapiens
cccctgcaggctggcagggggcctggtggctctggccccagccctgggctctgtggcatggagctgacaccacagacacctgtggggttggaccgctggaytagcagcgagccctgcccttccagttggatagcttttccattccagagccgtcagggccgcagggctgagcacgcagctccacgctccctagagactcag

SEQ ID NO: 18459 - DNA, 201 bp, Homo sapiens
aatgaggtttagggaacagcagctgtgtcatgtcacacagcgagcagggggtctctgagccgtctgaccccacagccgaccaagctccaatccttaccgcytcctagtgttgtggatgtagcccagggtgctcccacatttttcagatgagaacaccgaagctcaaaacaggagcgttttgtccacattggatacacgatg

SEQ ID NO: 18460 - DNA, 201 bp, Homo sapiens
ctgaccatgctcctttcagcagccttgctgcactttagtttccttgaatgaaaaatggggatgagaatagctcctacctccaaggtgaatggagtgagttyggacaggtgactccctgggaccagtgcctggcgcctgacaaggtccagtcagagcccgcactgctgttactgatacccttggctgtaccaggggagaact

SEQ ID NO: 18461 - DNA, 201 bp, Homo sapiens
ttggttgccattgccaggtgttctcccaccacccccactactgtccctgtttgatgtgtggcgggaataaagctgtgcacattggagcttttggcacatcstggctttcaggtgaaaggtgcgtgtgtgtttgagggtttagcctggccaacccagccatgaggtcggacctgacctgggggtgagtcctgagctcggcac

SEQ ID NO: 18462 - DNA, 201 bp, Homo sapiens
ttgccattgccaggtgttctcccaccacccccactactgtccctgtttgatgtgtggcgggaataaagctgtgcacattggagcttttggcacatcctggytttcaggtgaaaggtgcgtgtgtgtttgagggtttagcctggccaacccagccatgaggtcggacctgacctgggggtgagtcctgagctcggcacccct

SEQ ID NO: 18463 - DNA, 201 bp, Homo sapiens
ttttggcacatcctggctttcaggtgaaaggtgcgtgtgtgtttgagggtttagcctggccaacccagccatgaggtcggacctgacctgggggtgagtcytgagctcggcacccctgagctgtgtggctcacggcagcattcattgtgtggcttggccgcacccctttccctgctgggctgttgatgtttagactggagc

SEQ ID NO: 18464 - DNA, 201 bp, Homo sapiens
tgtgcacagagaagcatgtgaatttgcccagagccacacagctagtcccagccagggttggaacatagggtctgtagctccagggtctggtctgttctcarcctctctcccacctgcttccccgcgggattcttctgcctctgcagcggccatcgctcttcatgatgcacctggggctattcacatggaagcgtcgtgtgt

SEQ ID NO: 18465 - DNA, 201 bp, Homo sapiens; identical to SEQ ID NO: 2028

SEQ ID NO: 18466 - DNA, 201 bp, Homo sapiens
cctcgtccagcagctcgtccagcacgaaggccacgctgtacccgccggtgaggggcggggccggggaggggcggggcgggatggggctgtgggcccctccmaccgtcagtgctggccaccggaggcttcccgggttcctgggggctgtgccaccgcctctgaggcatgcttgctttcttcccttttcaaacccttctgctt

SEQ ID NO: 18467 - DNA, 201 bp, Homo sapiens
gtggtgagctgagatggcaccattgcactccagcctgggcaacaaaagtgaaactccgtctcagaaaaaaaaaagtttgattggtgtaaccaaagcgcatytgtttatggattgtctgtggcagcttttgttctgccgagatgagttgtgacagatctgtatgggctctaaagcctaaaacatgtgccatccgccccttta

SEQ ID NO: 18468 - DNA, 201 bp, Homo sapiens
gcctctggctggaccatctcattgtcctcagacacagcctctcgggtctagtttcatttcctgaaaaacaagtgcacagaactagagcaggagtcgagagmtacggcccccgggccagatccagccctgccacctgttttcacaccatgctcaagctgagtgggttttacattttttaattacttgaaaaaaaaaaagcca

SEQ ID NO: 18469 - DNA, 201 bp, Homo sapiens
tccctgtgccctttggcaccttcgtgccaggtcaggcttgaggcctgaaggcagtggtgggggccaccaagggtcgcctcctctgctgggcaagttcccartctgacgggcctgtgccgtgggccccagctgtgggggcgctgttgatgcgcagccaggcctcgccgccagagcccgcacgcttccattccgctgacttca

SEQ ID NO: 18470 - DNA, 201 bp, Homo sapiens
ggtctcacacacaactctcttcccagcgaaggcccctcctgccctcaggcctcagtgctgcttccgtctcggaaggccccaggagctcctgcatcctgggsgtgattcctgtgtgcctgcagaccccctcgcggctgccatctcatcctttggtgcacctgttggccagacctcctggtagcgggtgctgcactcccctga

SEQ ID NO: 18471 - DNA, 201 bp, Homo sapiens
ctttctccccaccctccaccagtggcaaagccagccccttcagggcgcacggtgtctgcccccaaggagggcccattccgttggggttaatgttggccacmtctttctgtttgtctctggcagaaatcaccaagccgccctcagacgacagcccggcccacagcagtgccatcgggcccgtcattggcatcatcctctctc

SEQ ID NO: 18472 - DNA, 201 bp, Homo sapiens
tccatgcattcatcccaccttttcttcttgggtggttttgtgtgtgcgtgtgtgtgtgtatgtgtgtatatcctgcccaactaacctgcaggctccttgamtctggagccctgatgtcttctgtttctctgtctcttccatcatgctggcactggacgcaggatcattcctgactgattaatctctagcttgtgtccaggc

SEQ ID NO: 18473 - DNA, 201 bp, Homo sapiens
tcttgttgatcttgtcacagcccctctggaaggtggagatggtactcgctcaggaacgataccactcaaggaagcatggccccctggatggggtggccctkggtgcacctgaggctcctgaggctgcagagcaccatggtgggggaggaggcggctgtgtgtctgtcatttgcctcttctgctgaatggagacccccagag

SEQ ID NO: 18474 - DNA, 201 bp, Homo sapiens
cccgaagtactggaattacaggtgcaagccatcgtgcctggccatgttttgttgtttttaaatagacttaattttttcaaacagttgtaggttcacagcawaattgatgagcagcaggtactgagttcctatacatccctgtcctcacacccacacagccttcccaactgtcagcatcctgtgcagggtggtacatttgtt

SEQ ID NO: 18475 - DNA, 201 bp, Homo sapiens
atcccagctactcaggaggctgaggcaggagaatggcgtgaacctgggaggcagaggttacagtgagtcgagatcgcgccactgcactccagcctgggcartaagagtgaagcttcgtctcaaaaacaaagtcacacacgcttcttgtacgagggtcatttggccgaggggccagatggctcaccatctagttgggacagg

SEQ ID NO: 18476 - DNA, 201 bp, Homo sapiens
gctgaccagcgcctctactggaccgacctggacaccaacatgatcgagtcgtccaacatgctgggtgagggccgggctggggccttctggtcatggagggyggggcagccgggcgttggccacctcccagcctcgccgcacgtaccctgtggcctgcaagttccccaacctggcaggagctgtggccacacccacgactgc

SEQ ID NO: 18477 - DNA, 201 bp, Homo sapiens
gccctccatggccattgggttcccgccagcccgtggtggaggggcctaatccccatgccactgatgaggggaggtattctgggtgctagtgggcaggtgcygggcccagccctgcctccctctgctctgccaaccacactaggctgcctccccagacaagctcagcgggcactgcatgttgggttcagaaatcagcagaac

SEQ ID NO: 18478 - DNA, 201 bp, Homo sapiens
gctcggtggagcacgtggtggagtttggccttgactaccccgagggcatggccgttgactggatgggcaagaacctctactgggccgacactgggaccaayagaatcgaagtggcgcggctggacgggcagttccggcaagtcctcgtgtggagggacttggacaacccgaggtcgctggccctggatcccaccaaggggt

SEQ ID NO: 18479 - DNA, 201 bp, Homo sapiens
acactgggcaagctgttctgggtggacgcggacctgaagcgcattgagagctgtgacctgtcaggtacgcgccccggggcctgccctaaccgcagacaccyggccttcattgtcagtaatggcagcagctgccacattgtccgagacctgccgtgagcccagtgccgcgccaggggctttgtgtgtagcgtgttttgtcct

SEQ ID NO: 18480 - DNA, 201 bp, Homo sapiens
aagagcacagacccatttatcctctgcctggtttcccccagtgctgcctgccatcttgcatgacttccattcctatcataagcaagacactgataacgatyctttcaccttattcagattgacataagtgttttttgtttgttcttgagacaaacttcctctgtcacccagtgggagtgcagtggcacaatcacagctcac

SEQ ID NO: 18481 - DNA, 201 bp, Homo sapiens
aaagaggtctgtctggctcatggttctgtaggcagcaccagtatggcacccgcatctgctcagcttctagtgaggtctcaggaagctttgactcatggtgraagtcgaagcgggagcaggtgcatcacatggtgagagagggagcaacggagagagagagagagcgcctctccctcttgccctcaccttgagaggagatgc

SEQ ID NO: 18482 - DNA, 201 bp, Homo sapiens
gagccgcagcgatggaggatgtgcgggtgcagcaccccgtacagcagggatgccaaacccgcgctgagtccctctcaacttctgctttgaagcccagtcaygccattgcctgggttttgctgggcggggctgcgtgtgatgttctcctctgtccctcccccagagccgcccacctgctccccggaccagtttgcatgtgcc

SEQ ID NO: 18483 - DNA, 201 bp, Homo sapiens
tcttctgggttggggctggaggtggagcggcacacaggagccgcagcgatggaggatgtgcgggtgcagcaccccgtacagcagggatgccaaacccgcgmtgagtccctctcaacttctgctttgaagcccagtcacgccattgcctgggttttgctgggcggggctgcgtgtgatgttctcctctgtccctcccccaga

SEQ ID NO: 18484 - DNA, 201 bp, Homo sapiens
agtgaatgtgtattctcccagcctctcttctgggttggggctggaggtggagcggcacacaggagccgcagcgatggaggatgtgcgggtgcagcaccccrtacagcagggatgccaaacccgcgctgagtccctctcaacttctgctttgaagcccagtcacgccattgcctgggttttgctgggcggggctgcgtgtga

SEQ ID NO: 18485 - DNA, 201 bp, Homo sapiens
cagacatctgtcgttggctcctctcagccgtcgtgggctgaccctggcacgtcctcctgtggctgagcccagtggggacagctgcttccttttattaccckagaactctcgtctttgatcaggccccctcccctatgccacacagtccctgtcactcgggtgagcccagtagtcatggggaaggcctgcgggttccaaaca

SEQ ID NO: 18486 - DNA, 201 bp, Homo sapiens
ccgtgtcagtaggaagactctgtaggctgccaagaggaataagtgggaggatcctcccagagaggccgggcctgcaggagggccagttctcatgagttctyatttggcccctaccctccaggctgtggttctgaggtgggagacagagcctgacctctgtttgtcttgttttgtctttgcagcagcccacccatgtgcccg

SEQ ID NO: 18487 - DNA, 201 bp, Homo sapiens
ttgggattccttcctccagtattagagcaactgagagctgctcattgcaagcctgatgttttcccagttggccgggtccaccgggtgccctgggattctgsgatctgggtggaaagtagggggcttgggggagtgtcctgggttctggaatccaggtggcaagtggtgaggttcagggagtggcttctgagccaccatagg

SEQ ID NO: 18488 - DNA, 201 bp, Homo sapiens
cccctgttatttctgaactctgttttggctctgttccctcccaggagccaggacaggcacgttctctgcatcttgtcccctgacgcccagaggcttggctyggctcaggcattcttggaaatatctggctccaggaaaggcagaggcctcctgagtcggcccagagggaacctgccccaggtctgggggaggcctgaccca

SEQ ID NO: 18489 - DNA, 201 bp, Homo sapiens
acacacgggtgggggatgtaggcaggtgaggcctctgagttgctttctcccttgcagcgacgggttgcagggctgatgggggtggaggggtttggggtcaracccacctgggtttacatgctcagtggctgtttgacttcgggcaccatacctagtttctgttatctcaccccgttcctctcccaggctatggggagccct

SEQ ID NO: 18490 - DNA, 201 bp, Homo sapiens
ctcaaggcaggaggggccacgagctggcctttctctgacactgacttgccagaagtgggcgttcctgggagtggcagacatgcacccactagagatagatytgaatcaccccctcacattctcctaatagtgccaagaacccacagcagagtgcggggtgtactgagtttgtgctgagcaggggtgcctgaatcccggatt

SEQ ID NO: 18491 - DNA, 201 bp, Homo sapiens
tggccagcccctcctggtgcctgggctgcgtctcctccttagtgtgctgcctctacaggcttttctcctgaactgtcctctttgctttttttttttttttwaagctttaaaagaagtttttgtagagatgcggtcttgctgtgttgcccaggctggtcttgaactcctggcctgagatgatcctctctcctcggaaagtgc

SEQ ID NO: 18492 - DNA, 201 bp, Homo sapiens
ggggtgatggtctgaaggcctctcctgatttctcattgagcccgttgtgggaatgagaccgttgtctgtgagatgaggcttcttgcacaggcagaaggggytgagggctgcggtgcagagggaggtgagggagccagcctggccgcaggcagatcaggaatgcttggggtggggtggtggagagaagtgtaggtgaggcca

SEQ ID NO: 18493 - DNA, 201 bp, Homo sapiens
tggaatacaggggtggatgggaagctgatgccacggccaaggaaacgggcctgagcttggacagtggtcaaagacttgtaagggaatcttgaggctctgtytggcctgggctctgaacccctcaaaaaatgtggccctgtggctgggtctgtagcgagcagcatggccagtgctgtgcctgcatgtccccgtcccctgtgt

SEQ ID NO: 18494 - DNA, 201 bp, Homo sapiens
cagcatggccagtgctgtgcctgcatgtccccgtcccctgtgtcaggccaacaaaggggatgtggcttctctgcagaacaggacagggcccctgtagcctytggaggacgatgtgggaggttttgggcatggcaggaagggtcacccatatctgggggaacagacgtaacagttggtaaacaaacaggtgctgtcaccgaa

SEQ ID NO: 18495 - DNA, 201 bp, Homo sapiens
tcaaaaaaaaaaaagagctcagctttcaagatttgttattgttgaaggaattacttccccttgagattccatagttatgttcctttttttttttttttttyttaattgagatggagtctcccttgttgcccaggctggagtgcagtggcacaatctcggctcactgcaaccttcgcctcccgggttcaagtgattctcctg

SEQ ID NO: 18496 - DNA, 201 bp, Homo sapiens
ttcgaggctcctatgccctcattcttgttgatcttgtcacagcccctctggaaggtggagatggtactcgctcaggaacgataccactcaaggaagcatgsccccctggatggggtggcccttggtgcacctgaggctcctgaggctgcagagcaccatggtgggggaggaggcggctgtgtgtctgtcatttgcctcttc

SEQ ID NO: 18497 - DNA, 201 bp, Homo sapiens
attcttggtttagacagatgagtaaggacatgcacccaccattccatgtcatacaggatagttccactgccctgattttctgtgctccactcattcatccytctcctctccaactcctggcaaccactgatgctttactgtctctgtgtatttgctttttccagagtgtttagaactggactcatacagattggctctttc

SEQ ID NO: 18498 - DNA, 201 bp, Homo sapiens
caagggggtgtgagtgtttagtaccacagggagggctggcgcggtggctcacgcctgtaatcccagcactttaggaactcctcacctgaggtcaggagttygagaccagcctggccaacatggtgaaatcccatccccactgcctgcctggggagtggccatgcagccatgggcctgaggttgtggtggggcatgggggca

SEQ ID NO: 18499 - DNA, 201 bp, Homo sapiens
gggcagaggatttgtgggctgtggagcctgtgctcgtggcccagccctgggggttgtgagtgtgctggccggggagcttttcctgcaagtggactggtgtytaggagccagcatgtcaggcagcaggcagcgggagtgcagcaggcagcgggagcacagcaggcagagggcggggctcgagcagccatccgtggaccctgg

SEQ ID NO: 18500 - DNA, 201 bp, Homo sapiens
cacgttgccccaggaagaggaccctgtccccggcatcctgacccacctcccttagagaccgagagcctctaaggataaacccattcacccgtgtttcagargcttttttttcctcttataaaataacatttatacgttcgctgtagcaaggaaaacattataaaaaatagtgaagaaaatagaaattacccataattttgc

SEQ ID NO: 18501 - DNA, 201 bp, Homo sapiens
tgtttcagaggcttttttttcctcttataaaataacatttatacgttcgctgtagcaaggaaaacattataaaaaatagtgaagaaaatagaaattacccmtaattttgccacacagacttagttgtgtccatgtatcttgtgcaccttttttctgtttacggatcaaaatcgacttttagggtcaggcgcggtggctcac

SEQ ID NO: 18502 - DNA, 201 bp, Homo sapiens
ggatctgtcaggattatggggcaccctgggggccccaagtctgcatgggtctccacttgcaatttctgtaggaagctctgataaatccaaactgggggtcmtaggacacagtcagaaatgctgataccgttgtgtgtggagcctcgggccctgggggtcaggagcatgtggagggtgggccacgggggttcagaagagaat

SEQ ID NO: 18503 - DNA, 201 bp, Homo sapiens
aaccacgagtctgtgccagcccagccgactgtcggggggtttggcagcctcctttcccatggtggtaatttgcagggtcatggctcaggggcaccgcagtytgcacctccgtccctggatccgtgcgtttgctgtgtggcctcgcagtaaatgcttccatctgcgtggcatttatggaccctggggcttggtactgtctgt

SEQ ID NO: 18504 - DNA, 201 bp, Homo sapiens
gctctgtcacccaggctggagtgcagtgctatggcatggctcgctgtacccttgacctcccaggctcaagcgatcctcctgtctcagcctcctgagtagckgggactacgggtgtgtgccaccaagcccggctaatttttttttaattttagtaaagacagggtctttctatgttgcccaggcttttctggaactccatct

SEQ ID NO: 18505 - DNA, 201 bp, Homo sapiens
agcagcatggccagtgctgtgcctgcatgtccccgtcccctgtgtcaggccaacaaaggggatgtggcttctctgcagaacaggacagggcccctgtagcmtctggaggacgatgtgggaggttttgggcatggcaggaagggtcacccatatctgggggaacagacgtaacagttggtaaacaaacaggtgctgtcaccg

SEQ ID NO: 18506 - DNA, 201 bp, Homo sapiens
ggctggtctcaaactcctaacctcaagtgatccaccctcctcggcctcccaaagtgttgggattgcaggcgtgagccactgcacccagcctgacctagatyttctaggttagaaagtcccaggagtgggcggccatgcatccaggcctgccacaggagcccgcctgccctcctccctgaagtcagggctctggaagccctt

SEQ ID NO: 18507 - DNA, 201 bp, Homo sapiens
ctgttggttctgtgctctgctcagcgacctttctcccgtgggagttcctgggggttcagcttcatcctacagacagcagcacacactggctgtgcaccctttttttttttttttttttttttttgagatggagtctcgcttttttcgcgcaggctgaagtgcagtggtgtgatcttggctcactgcaacctctacctcctg

SEQ ID NO: 18508 - DNA, 201 bp, Homo sapiens
atgttggccaggatggtcttgaactcctgacctcaggtgatccgcccacctcagcctcccaaagtgcagggattacaggcgtgagccaccacacccggagygccggttgtttttagcagtttgtcttgttcctggagagactggctcctgcccaggagctcggggagtagggccgcggggtgctgcctcacacctcgagtt

SEQ ID NO: 18509 - DNA, 201 bp, Homo sapiens
gccaagaaacggggccgtcagaacgctgcactaactgcagccttgggcctccatgccagaggccatgcccttccatccaccaccccctggcctgggccctggccctcctggctcgggaactccaggccccttcctcacggctcgagagacgtgtatttaccgcacaggtgcttgtcattctcttgtggcctcttctccagg

SEQ ID NO: 18510 - DNA, 201 bp, Homo sapiens
gggttcagcgacatgtccgaatgtcccgaggcctctgaggttgttttcttttgccgcagaacaaatcaccacgaacagcgttttaagacaacaccaactctttttttttttttttttttgagtcaggatcttgctctgttgcccaggctggggtgccctggtgcaaacacagttcactgcagcctcgacctctgggcttaa

SEQ ID NO: 18511 - DNA, 201 bp, Homo sapiens
gctgagtgacatgaagacctgcatcgtgcctgaggccttcttggtcttcaccagcagagccgccatccacaggatctccctcgagaccaataacaacgacrtggccatcccgctcacgggcgtcaaggaggcctcagccctggactttgatgtgtccaacaaccacatctactggacagacgtcagcctgaaggtagcgtg

SEQ ID NO: 18512 - DNA, 201 bp, Homo sapiens
gtatttactcgccttacgagtgagccactgtgggaattcagggaggtggcgcagtgaccacccctggagggatatgtgtgtggcaggggtcgagggtctcscccttccctgcttcctgcgcgtggctttctccaggacggggagggctgagctgaagaggtggggacagttgcgtccccccgccacccactgtcctgcggt

SEQ ID NO: 18513 - DNA, 201 bp, Homo sapiens
aagtgggtatttactcgccttacgagtgagccactgtgggaattcagggaggtggcgcagtgaccacccctggagggatatgtgtgtggcaggggtcgagrgtctcgcccttccctgcttcctgcgcgtggctttctccaggacggggagggctgagctgaagaggtggggacagttgcgtccccccgccacccactgtcc

SEQ ID NO: 18514 - DNA, 201 bp, Homo sapiens
ccatccccacacccgtccttcacccgccaccctcccgcaggtacctgtacttcaccaacatgcaggaccgggcagccaagatcgaacgcgcagccctggayggcaccgagcgcgaggtcctcttcaccaccggcctcatccgccctgtggccctggtggtggacaacacactgggcaagctgttctgggtggacgcggacc

SEQ ID NO: 18515 - DNA, 201 bp, Homo sapiens
cacagggcagaggcagaaaatgagtctcagagagggtgagcgagctgcttggggccccacagcaggagatggagcaggactgcagcctagcctctgccccyagcacctgcgcaagaagctgctctgctctggactgtgttaggctgcgagggctggagagaaatgagagttggtgcttagagagggggcgcaggtccccat

SEQ ID NO: 18516 - DNA, 201 bp, Homo sapiens
actccttccccgactgtatcgacggctccgacgagctcatgtgtggtgagccagcttctggcacggggaaggggcgtccgggctgggttcccccaggaacrtggagtttaggggaggagacgtgcctttccagcggggctgggggctgtgtgggagactcaggcggctgggaggctccttgcgggaggcagggaagccttt

SEQ ID NO: 18517 - DNA, 201 bp, Homo sapiens
gtcctcatcaaacagcagtgcgactccttccccgactgtatcgacggctccgacgagctcatgtgtggtgagccagcttctggcacggggaaggggcgtcygggctgggttcccccaggaacgtggagtttaggggaggagacgtgcctttccagcggggctgggggctgtgtgggagactcaggcggctgggaggctcct

SEQ ID NO: 18518 - DNA, 201 bp, Homo sapiens; identical to SEQ ID NO: 2019

SEQ ID NO: 18519 - DNA, 201 bp, Homo sapiens
atcgaagtggcgcggctggacgggcagttccggcaagtcctcgtgtggagggacttggacaacccgaggtcgctggccctggatcccaccaaggggtaagygtttgcctgtcccgtgcgtccttgtgttcacctcgtatgagacagtgcgggggtgccaactgggcaaggtggcaggctgtccgtgtggccctcagtgatt

SEQ ID NO: 18520 - DNA, 201 bp, Homo sapiens
aaaaaaaaaaagatgctggttcctaaaatgtggcccttttcctcctcacctgctgccagaccatcagccgcgccttcatgaacgggagctcggtggagcaygtggtggagtttggccttgactaccccgagggcatggccgttgactggatgggcaagaacctctactgggccgacactgggaccaacagaatcgaagtgg

SEQ ID NO: 18521 - DNA, 201 bp, Homo sapiens
acaccggcagctgggccccacccccagagcggtgattcaggagctccagggcggggctgaagacttgggtttctaacaagcaccccagtggtccggtgctsctgctgggtccatgcgtagaaagccctggagacctggagggagccctttgttcccctggcttcagtttcctcatctgtagaatggaacggtccatctggg

SEQ ID NO: 18522 - DNA, 201 bp, Homo sapiens
gtgtcggaggacctggacgagccccgagccatcgcactgcaccccgtgatggggtaagacgggcgggggctggggcctggagccagggccaggccaagcamaggcgagagggagattgacctggacctgtcattctgggacactgtcttgcatcagaacccggaggagggcttgttaaaacaccggcagctgggccccacc

SEQ ID NO: 18523 - DNA, 201 bp, Homo sapiens
cgaggtgacgcgcctcaacggcacctcccgcaagatcctggtgtcggaggacctggacgagccccgagccatcgcactgcaccccgtgatggggtaagacrggcgggggctggggcctggagccagggccaggccaagcacaggcgagagggagattgacctggacctgtcattctgggacactgtcttgcatcagaaccc

SEQ ID NO: 18524 - DNA, 201 bp, Homo sapiens
accccgtacagcagggatgccaaacccgcgctgagtccctctcaacttctgctttgaagcccagtcacgccattgcctgggttttgctgggcggggctgcrtgtgatgttctcctctgtccctcccccagagccgcccacctgctccccggaccagtttgcatgtgccacaggggagatcgactgtatccccggggcctgg

SEQ ID NO: 18525 - DNA, 201 bp, Homo sapiens
gtatccccggggcctggcgctgtgacggctttcccgagtgcgatgaccagagcgacgaggagggctgccccgtgtgctccgccgcccagttcccctgcgcrcggggtcagtgtgtggacctgcgcctgcgctgcgacggcgaggcagactgtcaggaccgctcagacgaggcggactgtgacggtgaggccctccccgtca

SEQ ID NO: 18526 - DNA, 201 bp, Homo sapiens
gtgtgctccgccgcccagttcccctgcgcgcggggtcagtgtgtggacctgcgcctgcgctgcgacggcgaggcagactgtcaggaccgctcagacgaggyggactgtgacggtgaggccctccccgtcaaggctctgccaagaccctggccctgccctccgggatacgagcttggggctgcctccggcctcacaggagta

SEQ ID NO: 18527 - DNA, 201 bp, Homo sapiens
ccctgcgcgcggggtcagtgtgtggacctgcgcctgcgctgcgacggcgaggcagactgtcaggaccgctcagacgaggcggactgtgacggtgaggcccwccccgtcaaggctctgccaagaccctggccctgccctccgggatacgagcttggggctgcctccggcctcacaggagtaggggctctgaaaacctttgct

SEQ ID NO: 18528 - DNA, 201 bp, Homo sapiens
tcaccagcagagccgccatccacaggatctccctcgagaccaataacaacgacgtggccatcccgctcacgggcgtcaaggaggcctcagccctggacttygatgtgtccaacaaccacatctactggacagacgtcagcctgaaggtagcgtgggccagaacgtgcacacaggcagcctttatgggaaaaccttgcctct

SEQ ID NO: 18529 - DNA, 201 bp, Homo sapiens
tgccctgtgggaagggtgcggggtgtgcttcccaaggcgctcctcttgctggtttccaggctgctgcccctgtccttagcagagggaggaaacagaggatrgctctgggtgaatgatgacttgggcttcgattatgtagtcacagggtatgaccctgagatgcgtggaaccccgagactgtgattatatgtagaaactggg

SEQ ID NO: 18530 - DNA, 201 bp, Homo sapiens
tcaagcgagccaaggacgacgggacccaggcaggtgccctgtgggaagggtgcggggtgtgcttcccaaggcgctcctcttgctggtttccaggctgctgyccctgtccttagcagagggaggaaacagaggatggctctgggtgaatgatgacttgggcttcgattatgtagtcacagggtatgaccctgagatgcgtgg

SEQ ID NO: 18531 - DNA, 201 bp, Homo sapiens
tgatggggctcaaagctgtgaatgtggccaaggtcgtcggtgagtccggggggtcccaagccatggctcagccatgcagacttgcatgaggaggaagtgaygggtccatgcctgggcataagtgttgagctcaggtgccccgacctggggaagggcaggacaggaaaggtgacagtatctggccaaggacagatgggaagg

SEQ ID NO: 18532 - DNA, 201 bp, Homo sapiens
ggtggctcacgcctgtaatctcagcactttgggaggctgaggcaggtggatcaactgaggtctggatttcgagaccagccttgccagcttggtgaaacccyatctctactaagaatacaaaaaaattagccaggcgtggtggcatgtgcctgtaatcccacctacttgggaggctaaggctggagaatcgcttgaacccag

SEQ ID NO: 18533 - DNA, 201 bp, Homo sapiens
ccttgggcctccatgccagaggccatgcccttccatccaccaccccctggcctgggccctggccctcctggctcgggaactccaggccccttcctcacggmtcgagagacgtgtatttaccgcacaggtgcttgtcattctcttgtggcctcttctccagggagatcacagaaggacagggcctcactgaggtctcggaca

SEQ ID NO: 18534 - DNA, 201 bp, Homo sapiens
caccgacatttactgacaccaatatttactgacatcaacatttagccatgtgatgggggccggcttgggggcaggccttgctcttggcactggggatgctrcagagaccagacagactcatggggtcatggacttctgcttcttctccagcctcatgtactggacagactggggagagaaccctaaaatcgagtgtgccaa

SEQ ID NO: 18535 - DNA, 201 bp, Homo sapiens
tcttggctctgtgcatccttgagaccagaaaggtctggaacaaatgagtagacgatgccctaacctggggagggagccacatcctgatcccagcaacctcrggaaggatctgtcaggattatggggcaccctgggggccccaagtctgcatgggtctccacttgcaatttctgtaggaagctctgataaatccaaactggg

SEQ ID NO: 18536 - DNA, 201 bp, Homo sapiens
gggctggtgtggtgaaacccgcacagggtggaagtgggcatccctgtcccaggggagcccccagggactctggtcactgggcttgccgctggcatgctcaktcctccagcacttactgacaccagcatctactgacaccaacatttacaaacaccgacattgaccgacaccgacatttaccgacactgacatttaccaaca

SEQ ID NO: 18537 - DNA, 201 bp, Homo sapiens
gtggtgaaacccgcacagggtggaagtgggcatccctgtcccaggggagcccccagggactctggtcactgggcttgccgctggcatgctcagtcctccascacttactgacaccagcatctactgacaccaacatttacaaacaccgacattgaccgacaccgacatttaccgacactgacatttaccaacactgtttac

SEQ ID NO: 18538 - DNA, 201 bp, Homo sapiens
tgaggccagcccgggcaaaggggacacaggaatcctctgcactgcttttgccacttactgtgagatttaaattatttcacaatacaaaattaagacaaaargttaatcacatatccactgccctgcttaagacagaaaacatgggtgttgttgaagccagaggcagctgctggcctgagtttggtgattggttcctaagca

SEQ ID NO: 18539 - DNA, 201 bp, Homo sapiens
tgctggcctgagtttggtgattggttcctaagcagttgaaggcagttttgtttttccatagatgtctgttctccctttgctgggtgcagcctcgccctgcygctgtggtcgggtttcagtggcctcgtcccgtggacgcagcctcgccctgccgctgtggtcgggtttcagtggcctcgtcccgtggacgcagcctcgccc

SEQ ID NO: 18540 - DNA, 201 bp, Homo sapiens
gtggtcgggtttcagtggcctcgtcccgtggacgcagcctcgccctgccgctgtggtcgggtttcagtggcctcgtcccgtggacgcagcctcgccctgcygctgtggtcgggtttcagtggcctcgtcccgtggacgcagcctcgccctgccgctgtggtcgggtttcagtggcctcgtcccgtggacgcagcctcgccc

SEQ ID NO: 18541 - DNA, 201 bp, Homo sapiens
gacgcagcctcgccctgccgctgtggtcgggtttcagtggcctcgtcccgtggacgcagcctcgccctgccgctgtggtcgggtttcagtggcctcgtccygtggacgcagcctcgccctgccgctgtggtcgggtttcagtggcctcgtcctgtggacgcagcctcgccctgccgctgtggtcgggtttcagtggcctcg

SEQ ID NO: 18542 - DNA, 201 bp, Homo sapiens
gacgcagcctcgccctgccgctgtggtcgggtttcagtggcctcgtcccgtggacgcagcctcgccctgccgctgtggtcgggtttcagtggcctcgtccygtggacgcagcctcgccctgccgctgtggtcgggtttcagtggcctcgtcccatgggcgtgctttggcagctttttgctcacctgtggagcctctcttga

SEQ ID NO: 18543 - DNA, 201 bp, Homo sapiens
gccagcctagcaagaccccagctaccaaaaaattttaaaagttaactgaacgtggtggtggtgggcacttgtggttcccagctacctgggaggctgaggtkggaggatcgcttaagcccaggaggtcaaggctgcagtgagctatgatcgcaccactgcactccagcctggacaacagagcaagaccctgtctgaaaaaaa

SEQ ID NO: 18544 - DNA, 201 bp, Homo sapiens
ccactgcactccagcctggacaacagagcaagaccctgtctgaaaaaaaaaacaaaaaaaaaagttcctttctttttgtggctggatgacatcccattgtwtggccacagcacattttgtttgtctgtttatcgggtggtgggcagtggtttccaccttttgtctcctgtgaataatgctgctgtgaacatttgaattcaa

SEQ ID NO: 18545 - DNA, 201 bp, Homo sapiens
ggacaacagagcaagaccctgtctgaaaaaaaaaacaaaaaaaaaagttcctttctttttgtggctggatgacatcccattgtatggccacagcacatttkgtttgtctgtttatcgggtggtgggcagtggtttccaccttttgtctcctgtgaataatgctgctgtgaacatttgaattcaagtttttgtttgaacacc

SEQ ID NO: 18546 - DNA, 201 bp, Homo sapiens
tacacttgctggggccttcgtgtcacaatgacgtgagcactgcgtgttgattacccactttttttttttttttgaggtggagtctcgctctcttgcccagkctggagtgcagtggcacgatctcggctcactgcaagctctgcctcccgggttcatgccattctcctgcctcagcctcccgcgtagctgggactacaggcg

SEQ ID NO: 18547 - DNA, 201 bp, Homo sapiens
tccaaatggcgacacctggtccctgcctggaggctggaagctgtggcccttgtatgcccctccagggtctgtgcgctcggttggcccgagttcccatcaccgtcgtcatcatcaccatcatcattgtcatttcgcttgtctgtgagccggcctggtctcccagagcagagaccctctgaggtccagcctgagttggggtct

SEQ ID NO: 18548 - DNA, 201 bp, Homo sapiens
ccaaatggcgacacctggtccctgcctggaggctggaagctgtggcccttgtatgcccctccagggtctgtgcgctcggttggcccgagttcccatcaccgtcgtcatcatcaccatcatcattgtcatttcgcttgtctgtgagccggcctggtctcccagagcagagaccctctgaggtccagcctgagttggggtctc

SEQ ID NO: 18549 - DNA, 201 bp, Homo sapiens
caaatggcgacacctggtccctgcctggaggctggaagctgtggcccttgtatgcccctccagggtctgtgcgctcggttggcccgagttcccatcaccgtcgtcatcatcaccatcatcattgtcatttcgcttgtctgtgagccggcctggtctcccagagcagagaccctctgaggtccagcctgagttggggtctcc

SEQ ID NO: 18550 - DNA, 201 bp, Homo sapiens
aaacaaacaaacaaaaaacaaacaaacaaagcgtcatttatccagcacccctggggaaccatgctacctggtgttttatggtacctggcaaggtgcaggtraagttgctgctcttgggcattgaacccgtcttgtttggggcagctcaggccccaggcagggtccgggttggctctcgttggtgtggccctggcccatcca

SEQ ID NO: 18551 - DNA, 201 bp, Homo sapiens
ggcgggtggatcatgaggtcaggagatcgagaccatcctggctaacaaggtgaaaccccgtctctactaaaaatacaaaaaattagccgggtgcggtggcrggcgcctgtagtcccagctactcgggaggctgaggcaggagaatggcgtgaacccgggaagcggagcttgcagtgagccgagattgcgccactgcagtcc

SEQ ID NO: 18552 - DNA, 201 bp, Homo sapiens
attgcttgaacccaggaggtagaggttgtagtgagcccgtatcgtaccactgccctccacctgggcaatagagcgagactctgtctcaaaaagaaaaaaaraaaaagaacatttatgccaggtgtggtggctcatgcctgaaatcccagaactttggaagactgaggcaggaggatcacttgagcccagaaatttgagagt

SEQ ID NO: 18553 - DNA, 201 bp, Homo sapiens
aggaagggcctagctgggactctcaggagccaaggccctgaggggcaacttgcctggtccctgccctgaggcgttcactgctttcttcctgggccagatcrcaggcccggaggctggaccactgggctggcactcttgccgagctgctccctgacttcctgaccatgctcctttcagcagccttgctgcactttagtttcc

SEQ ID NO: 18554 - DNA, 201 bp, Homo sapiens
cagtcagagcccgcactgctgttactgatacccttggctgtaccaggggagaacttggttgccattgccaggtgttctcccaccacccccactactgtccytgtttgatgtgtggcgggaataaagctgtgcacattggagcttttggcacatcctggctttcaggtgaaaggtgcgtgtgtgtttgagggtttagcctgg

SEQ ID NO: 18555 - DNA, 201 bp, Homo sapiens
ctgctgttactgatacccttggctgtaccaggggagaacttggttgccattgccaggtgttctcccaccacccccactactgtccctgtttgatgtgtggsgggaataaagctgtgcacattggagcttttggcacatcctggctttcaggtgaaaggtgcgtgtgtgtttgagggtttagcctggccaacccagccatga

SEQ ID NO: 18556 - DNA, 201 bp, Homo sapiens
gtttgattggtgtaaccaaagcgcatttgtttatggattgtctgtggcagcttttgttctgccgagatgagttgtgacagatctgtatgggctctaaagcmtaaaacatgtgccatccgcccctttacagaaaaagtgtgctgacctctgttctaaagtattggacaactacaatgtttgctcatttattattctatgatt

SEQ ID NO: 18557 - DNA, 201 bp, Homo sapiens
tgttctaaagtattggacaactacaatgtttgctcatttattattctatgatttgttttctgctttttgttgttgttgttgttgttgagatagggtttccytctgtcactcaggctggagtgcagtggtgtaatctcagctcactgcagcctcgacctcctgggctctagtgatcctctcatctcagcctccctagtagct

SEQ ID NO: 18558 - DNA, 201 bp, Homo sapiens
catttattattctatgatttgttttctgctttttgttgttgttgttgttgttgagatagggtttccctctgtcactcaggctggagtgcagtggtgtaatytcagctcactgcagcctcgacctcctgggctctagtgatcctctcatctcagcctccctagtagctgggactacaggcacacaccaccactcctggctga

SEQ ID NO: 18559 - DNA, 201 bp, Homo sapiens
ttgttgttgttgttgttgttgagatagggtttccctctgtcactcaggctggagtgcagtggtgtaatctcagctcactgcagcctcgacctcctgggctytagtgatcctctcatctcagcctccctagtagctgggactacaggcacacaccaccactcctggctgattttttttttttttttttttttttgtggagac

SEQ ID NO: 18560 - DNA, 201 bp, Homo sapiens
catgttgcccaggctggtttcaaactcctaggctcaaacacccacctcagcctcccaaagtgctgggattacaggcgtgagccaccatgcccagcctattytactgtttgtattacatagctttaaaagattttttatgactttaagtcacaagggttctttgtagaaaaaaatatatatataggaaagtataaaaagaaa

SEQ ID NO: 18561 - DNA, 201 bp, Homo sapiens
gaggctgagttgggaggattgcttgagccccaggaggttgatgctgcagtgacctgagattactccactgtactccaacctgagcgacagagcaagacttrtctggggaaaaaaaaaaaaaaatatatatatatatatatatatatatatacatatatacatacacgcacacacacataatataaaaatatatatttataa

SEQ ID NO: 18562 - DNA, 201 bp, Homo sapiens
tgagccccaggaggttgatgctgcagtgacctgagattactccactgtactccaacctgagcgacagagcaagacttgtctggggaaaaaaaaaaaaaaatatatatatatatatatatatatatatacatatatacatacacgcacacacacataatataaaaatatatatttataaatatataatatataatataaaaa

SEQ ID NO: 18563 - DNA, 201 bp, Homo sapiens
agtgacctgagattactccactgtactccaacctgagcgacagagcaagacttgtctggggaaaaaaaaaaaaaaatatatatatatatatatatatatayatacatatatacatacacgcacacacacataatataaaaatatatatttataaatatataatatataatataaaaatatatatttataaataaaatttat

SEQ ID NO: 18564 - DNA, 201 bp, Homo sapiens
acctgagattactccactgtactccaacctgagcgacagagcaagacttgtctggggaaaaaaaaaaaaaaatatatatatatatatatatatatatatayatatatacatacacgcacacacacataatataaaaatatatatttataaatatataatatataatataaaaatatatatttataaataaaatttataaat

SEQ ID NO: 18565 - DNA, 201 bp, Homo sapiens
cgcacacacacataatataaaaatatatatttataaatatataatatataatataaaaatatatatttataaataaaatttataaattatatttataagtraatatataatatataatataaaaatatatattatataatatataataaaatatataatataaaaatatatatttataaataatatataatacatacttat

SEQ ID NO: 18566 - DNA, 201 bp, Homo sapiens
aaatatatatttataaatatataatatataatataaaaatatatatttataaataaaatttataaattatatttataagtaaatatataatatataatataaaaatatatattatataatatataataaaatatataatataaaaatatatatttataaataatatataatacatacttataagtatatatttaaaatata

SEQ ID NO: 18567 - DNA, 201 bp, Homo sapiens
gttttgtgatgtgcttgtgtccatcctggtttctgccgtgtccccaacatccggccaagcttaggtggatgttccagcacacactcaccctgtctgtgcayctgtttttgtgtccgtaagtgggtatttactcgccttacgagtgagccactgtgggaattcagggaggtggcgcagtgaccacccctggagggatatgtg

SEQ ID NO: 18568 - DNA, 201 bp, Homo sapiens
gggtatgagtttcactacattccaccaccagtgttcactaccattacctgccttccgtcttaagtgttcatcatttaaaaataaatttattgggctggacrcggtggctcatgactgttatcccagcactttgggaggctgaggcgggcagatcacctgaggtcaggagttcaagaccagcctggccaatatggtgaaact

SEQ ID NO: 18569 - DNA, 201 bp, Homo sapiens
tatggtgaaactccatctctactaaaaatacaaaattagctgggcatggtggggcatgcctataatcccagctactcaggaggctgaggcaggagaatggygtgaacccgagaggcagagcttacagtgagcccagatagcaccactgcagtccagcgtgggcaacagtgcgagactccatctcaaaaaaaaaataaataa

SEQ ID NO: 18570 - DNA, 201 bp, Homo sapiens
ctagtgaggaaaaggcgtgtttgtggtgttgcataggattctggtaagaaagtttgcactaaccataagtatttgtactacattaaaatgaaagctcaggkgccgggcgcggtggctcacgcctgtaatcccagcactttgggaggccagggcgggcggatcatgaggtcaggagatcaagaccatcctggccaacatggt

SEQ ID NO: 18571 - DNA, 201 bp, Homo sapiens
gctggggttctgagtgagccccacagggcagaggcagaaaatgagtctcagagagggtgagcgagctgcttggggccccacagcaggagatggagcaggastgcagcctagcctctgcccccagcacctgcgcaagaagctgctctgctctggactgtgttaggctgcgagggctggagagaaatgagagttggtgcttag

SEQ ID NO: 18572 - DNA, 201 bp, Homo sapiens
ggctgatcacttgaggttgggagttcgagaccagcctgcccaacatagtgaaatcccgtctctactaaaaatacaaaaattagctgggtgtggtggcaggygcctgtattcccagctactggggaggctgaggtgggagaattacttgaacctgggaggcggaagttgcagtgagccaaaattacgccactgcactccagc

SEQ ID NO: 18573 - DNA, 201 bp, Homo sapiens
aattacttgaacctgggaggcggaagttgcagtgagccaaaattacgccactgcactccagcctaggcaatagagtgagactccgtctcaaaaaaaaaaargggccaggggtggtagtgacaaagagaccctatcccaaaaaaaccgaacactgaatccttgagactgagtaaggacactgtgaaatttttctgggtgggg

SEQ ID NO: 18574 - DNA, 201 bp, Homo sapiens
tccgggtgttggacacatttggttaactggatagaataacgcgagttcccagggacttggtccatttgctattttattttattttattttattttattttwtttatttatttatttatttatttatttattgagatggagtttcgtttttgtcgcccaggctggagtgcagtggcgcgatctcggttcactgcaacctctg

SEQ ID NO: 18575 - DNA, 201 bp, Homo sapiens
gttaactggatagaataacgcgagttcccagggacttggtccatttgctattttattttattttattttattttattttatttatttatttatttatttakttatttattgagatggagtttcgtttttgtcgcccaggctggagtgcagtggcgcgatctcggttcactgcaacctctgcctcccaggttcaagtgattc

SEQ ID NO: 18576 - DNA, 201 bp, Homo sapiens
tctgctcagcgacctttctcccgtgggagttcctgggggttcagcttcatcctacagacagcagcacacactggctgtgcacccttttttttttttttttyttttttttgagatggagtctcgcttttttcgcgcaggctgaagtgcagtggtgtgatcttggctcactgcaacctctacctcctgggttcaagtgatttt

SEQ ID NO: 18577 - DNA, 201 bp, Homo sapiens
ctccagggttcaagggattctcccacctcagcctcccaagtagctgggattacaggtgcccgccaccacacccggctaattttcatatttttagtagagaygaggtttcaccatgttggccaggctggtctcgaactcctgacctcaagtgatccgcccgcctcggcctcccaaagtgctaggtcaagcccattttaaagt

SEQ ID NO: 18578 - DNA, 201 bp, Homo sapiens
tcactgcaagctccacctcccagggtcacgcctttctcctgcctcagcctcctgagtagctggaactacaggcacccgccaccacgcccggctaatttttkgcatttttagtagagacggggtttcaccgtgttagccaggatggtctccatctcctgatcctcccgctcggcctcccaaggtgctgggattacaggcgtg

SEQ ID NO: 18579 - DNA, 201 bp, Homo sapiens
acccgccaccacgcccggctaattttttgcatttttagtagagacggggtttcaccgtgttagccaggatggtctccatctcctgatcctcccgctcggcytcccaaggtgctgggattacaggcgtgagccaccacacccggcctgcttttttttttttttttgagtcttgctctgttgctgaggctggagtgcagtgat

SEQ ID NO: 18580 - DNA, 201 bp, Homo sapiens
tgcctcagtagctgggactacaggcatctgccaccatgcccagctaatttttgtatttttagtagagacagggttttgccacgttggccaggctggtctcsaactcctgacctcaagtgatctgcctgcctcggcctcccaaagtgctgggattacaggcgtgagccaccatgcccagcctgcctggctgattttttaaaa

SEQ ID NO: 18581 - DNA, 201 bp, Homo sapiens
cccaggctggccttgaactcctgggatcaagcgatcctcccacctcagcctcccaaagtgttgggattacaggcatgagccgctgtgcccagcctattttwttattattattatttaattttattttttctcactattgcccagctcctggcctccaactcctgggctcaaaggatcttcctgcctcagcctcctgagtag

SEQ ID NO: 18582 - DNA, 201 bp, Homo sapiens
gtagcacagtcttggctcactgcaacctctgcctcctgggttcaagcagttctcctgcctcagcttcctgagtagctgggattacaggcacccgccaccaygcctgggtaatttttgtatttttagtggagatggagtttcaccatgttggctgggctggtctcgaacttctgactcaggtgatccacttgcctcagcctc

SEQ ID NO: 18583 - DNA, 201 bp, Homo sapiens
ctgggtaatttttgtatttttagtggagatggagtttcaccatgttggctgggctggtctcgaacttctgactcaggtgatccacttgcctcagcctcccwgagtgctgggattacaggtgtgagccaccaagcctggcttggtgctttttaaatttattttgagatagagtctgactctgttacccaggctggagtgcag

SEQ ID NO: 18584 - DNA, 201 bp, Homo sapiens
ttagtggagatggagtttcaccatgttggctgggctggtctcgaacttctgactcaggtgatccacttgcctcagcctccctgagtgctgggattacaggygtgagccaccaagcctggcttggtgctttttaaatttattttgagatagagtctgactctgttacccaggctggagtgcagtggtgccatcacagcctac

SEQ ID NO: 18585 - DNA, 201 bp, Homo sapiens
tgggcttgtggtggctttggtgccgtccgctgcgtctgcctcttagagcatggagttctccttctcaggagggctgagctgctggagctctagtcctgccrcagagcagcccccaagtgcggcgttgcctgtccctgtggagcaggtgactacctggctgcgggcggaacagcaggccatggctctggtagtggtctgtga

SEQ ID NO: 18586 - DNA, 201 bp, Homo sapiens
tttctctgctctgccctaaaccttctaattagtgaaaacgcacatttgcagacatcaatcaaatgtcatattccctagcagcttgtcctgggatcactgasctggtcacattccacagttgctaactcagggcttgcagagtatgtgtgcacgtgtgtgtgcatgcgtgtgtttgtgagagagatacatgccttctgggga

SEQ ID NO: 18587 - DNA, 201 bp, Homo sapiens
cacatttgcagacatcaatcaaatgtcatattccctagcagcttgtcctgggatcactgagctggtcacattccacagttgctaactcagggcttgcagartatgtgtgcacgtgtgtgtgcatgcgtgtgtttgtgagagagatacatgccttctggggagccctggtggcctgtttccttccctcccaggcccctgagc

SEQ ID NO: 18588 - DNA, 201 bp, Homo sapiens
ttcgatggggggccaggggccaacaggaatgggggtggctgagctgagaggccaagggcaggttccaggttgcattgagagccgaagctggtgagtgtgakgcgggcagatgtgaggtgtgtgtggggagtggggtgctgtctgggtgactgggctgggagagggcaggtgggggccaagctggaagaggtggtgttattc

SEQ ID NO: 18589 - DNA, 201 bp, Homo sapiens
taatagagacagagtttcaccgtgttggcgagactggtctcgaacccctgacctcaggtgatctgcctgccttggcctcccaaagtgctgagattacagtygtgagccaccgtgcccggcctgcatttacctgtttttaattgtggtaaaatacatataacacttatcgtcgtaaccatttgtaagtgtgaagttcagtgg

SEQ ID NO: 18590 - DNA, 201 bp, Homo sapiens
catgcattcatcccaccttttcttcttgggtggttttgtgtgtgcgtgtgtgtgtgtatgtgtgtatatcctgcccaactaacctgcaggctccttgactytggagccctgatgtcttctgtttctctgtctcttccatcatgctggcactggacgcaggatcattcctgactgattaatctctagcttgtgtccaggctg

SEQ ID NO: 18591 - DNA, 201 bp, Homo sapiens
aggcactaccaggctgttttccacagcagccagaggtgtctttaaaagcagttgtcaactgggcttggtggctcacacctgtaatcccagcactttgggakgccaaggcgggcggatcacctgaggtcaggagttcgagaccagcctgaccaacatggcaaaaccccgtctctactaaaaatacaaaattagctgggcgtg

SEQ ID NO: 18592 - DNA, 201 bp, Homo sapiens
acaggcgtgagccaccacgcccagctaatttttgtatttttagtagaggcaaggtttcgtcatgttggccaggctggtctcaaactcctggccttaagtgrtctgcccgcctcggcctcccaaagtgctgagatgacaggtgtgagccaccgtgcccggcccagaactctttaattcccacctgaaacttgccgccttaag

SEQ ID NO: 18593 - DNA, 201 bp, Homo sapiens
tcccaccattctgctttctgtctcaatgaatttgcctaccgtaagtacctcatataaattgaatcataaagtatttgtctttttatatctggcttatttcmcttagcataacattcttaagtttcatccatgttgtagcatgtgtcagaatctctctctttttttttttttttttttttttttttttgcagacagagtctc

SEQ ID NO: 18594 - DNA, 201 bp, Homo sapiens
tttttgtttttgttttgctgttttttgagacagagtctcgctgtgtcacccaggctggaatgcagtggcgcaatcttggctcactgcaacctccacctccrgggttcaagtgattctcctgcctcagacttgtgagtagctgggattacaggtgcccgtcactacgcccagctaatttttgtattttagtagagacggggt

SEQ ID NO: 18595 - DNA, 201 bp, Homo sapiens
ggggagtgtcaccatctctctctcgaatttgcatgagcccaagttgtttttcagaaaaagggtgtgactctgaaaatgaacccgtgggggggttggctcargcctgtaaccccagcactcggtgtgactctgaaaatgaacccgtgggggtgttggctcaggcctgtaaccccagcactcggtgtcactcttaaaatgaac

SEQ ID NO: 18596 - DNA, 201 bp, Homo sapiens
tctctctctcgaatttgcatgagcccaagttgtttttcagaaaaagggtgtgactctgaaaatgaacccgtgggggggttggctcaggcctgtaaccccarcactcggtgtgactctgaaaatgaacccgtgggggtgttggctcaggcctgtaaccccagcactcggtgtcactcttaaaatgaacccgtgggggggttg

SEQ ID NO: 18597 - DNA, 201 bp, Homo sapiens
ttcagaaaaagggtgtgactctgaaaatgaacccgtgggggggttggctcaggcctgtaaccccagcactcggtgtgactctgaaaatgaacccgtggggktgttggctcaggcctgtaaccccagcactcggtgtcactcttaaaatgaacccgtgggggggttggctcaggcctgtaaccccagcactcggtgcgactc

SEQ ID NO: 18598 - DNA, 201 bp, Homo sapiens
agtgaggagatcctgtctcaaaaaaaaaaaagagctcagctttcaagatttgttattgttgaaggaattacttccccttgagattccatagttatgttccytttttttttttttttttttaattgagatggagtctcccttgttgcccaggctggagtgcagtggcacaatctcggctcactgcaaccttcgcctcccggg

SEQ ID NO: 18599 - DNA, 201 bp, Homo sapiens
ttttaattgagatggagtctcccttgttgcccaggctggagtgcagtggcacaatctcggctcactgcaaccttcgcctcccgggttcaagtgattctccygcctcagcttcccaagtagctgggattacaggcgcccaccaccacgcccagctaatttttgtagttttggtacagatggggtttcaccatggtgtctagg

SEQ ID NO: 18600 - DNA, 201 bp, Homo sapiens
aatctcggctcactgcaaccttcgcctcccgggttcaagtgattctcctgcctcagcttcccaagtagctgggattacaggcgcccaccaccacgcccagytaatttttgtagttttggtacagatggggtttcaccatggtgtctaggctggtctcgaactcctgacctcaggtgatccacccacctcggcctcccaaag

SEQ ID NO: 18601 - DNA, 201 bp, Homo sapiens
cagcctggacctcaccggttgaggggccggcctagatcttctttgcgcaatggcacgatctcagctcactgcaacctccacctcccgagttcaagtgattmtcctgcctcagcctcctgagtagctgtgattacaggcgtgcactaccacacctggctaggttttgtatttttagtagacacagggtttcgccatgttggc

SEQ ID NO: 18602 - DNA, 201 bp, Homo sapiens
tggtctcaaactcctaacctcaagtgatccaccctcctcggcctcccaaagtgttgggattgcaggcgtgagccactgcacccagcctgacctagatcttytaggttagaaagtcccaggagtgggcggccatgcatccaggcctgccacaggagcccgcctgccctcctccctgaagtcagggctctggaagcccttccc

SEQ ID NO: 18603 - DNA, 201 bp, Homo sapiens
gcttttgctatgttggttgggaagtgctcagtgctaggttgggaggtgatcagtcgggaggtgctaggtgatttgttgggaggtgcatgatgctcagttgrgaggtgctaggtgctcggttggaaggtgattggtactttgttaggaggtgcttggcgcttggttgggagttgttggtgtccagttgagaggtgctaggtg

SEQ ID NO: 18604 - DNA, 201 bp, Homo sapiens
ggtgctaggtgctcggttggaaggtgattggtactttgttaggaggtgcttggcgcttggttgggagttgttggtgtccagttgagaggtgctaggtgctyggttgggaggtatttgattgggaggtgcttggcacttggttgggaggtgctctgcacttggttgggaggtgctcggtgctaggttgggaggtgatcagtt

SEQ ID NO: 18605 - DNA, 201 bp, Homo sapiens
ggtgctcggttggaaggtgattggtactttgttaggaggtgcttggcgcttggttgggagttgttggtgtccagttgagaggtgctaggtgcttggttggraggtatttgattgggaggtgcttggcacttggttgggaggtgctctgcacttggttgggaggtgctcggtgctaggttgggaggtgatcagttgggaggt

SEQ ID NO: 18606 - DNA, 201 bp, Homo sapiens
attcttgttgatcttgtcacagcccctctggaaggtggagatggtactcgctcaggaacgataccactcaaggaagcatggccccctggatggggtggccyttggtgcacctgaggctcctgaggctgcagagcaccatggtgggggaggaggcggctgtgtgtctgtcatttgcctcttctgctgaatggagacccccag

SEQ ID NO: 18607 - DNA, 201 bp, Homo sapiens
gccatgggttttattcttttttttttgagacggagtgttgctgtctcccaggctgagagtgcagtggtgtgatcttggctcactgcaagctccgcctcccrggttcacgccattctcctgcctcagcctcccgagtagctgtgactacaggtgtccgccaccatgcccggctaatttttttttttgtacttttagtagaga

SEQ ID NO: 18608 - DNA, 201 bp, Homo sapiens
acggggtttcaccgtgttagccaggatggtctcgatctcctgacctcgtgatccgcccatctcggcctcccaaagcgctggaattacaggcatgagccacygcacccagcctttttttttttttttttaggcagggtctcactctgtcatccaggctggagtgcagtggtacagtcacagctcactgcagcctcgacctcc

SEQ ID NO: 18609 - DNA, 201 bp, Homo sapiens
ccgtgttagccaggatggtctcgatctcctgacctcgtgatccgcccatctcggcctcccaaagcgctggaattacaggcatgagccaccgcacccagcctttttttttttttttttaggcagggtctcactctgtcatccaggctggagtgcagtggtacagtcacagctcactgcagcctcgacctcccagggctgaag

SEQ ID NO: 18610 - DNA, 201 bp, Homo sapiens
aatttttattttttgtagaggtgggattttgccatgttgcccagggtggctcaagtgacccacccacctcagcctcccgaagtactggaattacaggtgcragccatcgtgcctggccatgttttgttgtttttaaatagacttaattttttcaaacagttgtaggttcacagcaaaattgatgagcagcaggtactgagt

SEQ ID NO: 18611 - DNA, 201 bp, Homo sapiens
ttttccagagtgtttagaactggactcatacagattggctctttcacctactaacatgcatttaagtttcctccatgtcttttcatggcttgatagatcatttcttttcttttcttttttttttttttgagatggagtctcgctctgtcgcccaggatggagtgcaatggtgcgatttctgctcactgcaacctccccctc

SEQ ID NO: 18612 - DNA, 201 bp, Homo sapiens
tttccagagtgtttagaactggactcatacagattggctctttcacctactaacatgcatttaagtttcctccatgtcttttcatggcttgatagatcatttcttttcttttcttttttttttttttgagatggagtctcgctctgtcgcccaggatggagtgcaatggtgcgatttctgctcactgcaacctccccctcc

SEQ ID NO: 18613 - DNA, 201 bp, Homo sapiens
ttccagagtgtttagaactggactcatacagattggctctttcacctactaacatgcatttaagtttcctccatgtcttttcatggcttgatagatcatttcttttcttttcttttttttttttttgagatggagtctcgctctgtcgcccaggatggagtgcaatggtgcgatttctgctcactgcaacctccccctccc

SEQ ID NO: 18614 - DNA, 201 bp, Homo sapiens
tccagagtgtttagaactggactcatacagattggctctttcacctactaacatgcatttaagtttcctccatgtcttttcatggcttgatagatcatttcttttcttttcttttttttttttttgagatggagtctcgctctgtcgcccaggatggagtgcaatggtgcgatttctgctcactgcaacctccccctcccg

SEQ ID NO: 18615 - DNA, 201 bp, Homo sapiens
ccagagtgtttagaactggactcatacagattggctctttcacctactaacatgcatttaagtttcctccatgtcttttcatggcttgatagatcatttcttttcttttcttttttttttttttgagatggagtctcgctctgtcgcccaggatggagtgcaatggtgcgatttctgctcactgcaacctccccctcccgg

SEQ ID NO: 18616 - DNA, 201 bp, Homo sapiens
ggggtctcacatgttgctcaggctggtctcaaactcctaagctcaagggatccttcccctcggctcccagagtgctgggattacaggcgtgagccaccgcrcccggcccatgcaccaaatgaggttttgtcaccagatgagcaacaaaagctttccatcttcagagcgttttggattttggaattgttggggagggcttat

SEQ ID NO: 18617 - DNA, 201 bp, Homo sapiens
tcatggttcactgcagccttgacctctttttttgtttgtttgtttgttttttttttttttgggatggagtcttgctctgtccccctggctggagtgcagcrgcaccatcttggctaactacaacctccacctcccaggttctagcgattctcctgcctcagcctcccaagtagctgggattacaggtgcccgccaccacgc

SEQ ID NO: 18618 - DNA, 201 bp, Homo sapiens
accatgttgcccaggctggtctcaaactcctgagcttaagccatgtgtccacctcggcctctcaaagcactgggattataggtgtgaaccactgtgcctascctgtgtttgctattttgatcccctgtgcacagagaagcatgtgaatttgcccagagccacacagctagtcccagccagggttggaacatagggtctgta

SEQ ID NO: 18619 - DNA, 201 bp, Homo sapiens
ccatggcttacgcgtgtaatcccagcactttgggaggccgaggcgggcggattacgaggtcaggagatcgagaccatcctggctaacacggtgaaacctcrtctctactaaaaatacaaaacattagccaggtgtggtggtgggtgcctgtagtcccagctactcgggaggctgaggcaggagaatggcgtgaacctggga

SEQ ID NO: 18620 - DNA, 201 bp, Homo sapiens
aatggcgtgaacctgggaggtggagcttgcagtgagctgagatcccgccactgcactccagcctgggctacagagcgagactctgtctcaaaaaaaaaaawaataaaataaaataataaaattaaaaaattaaaagtaaggccgggcgtggtggctcacgcctgtaatcccagaactttgggaggccaaggcaggtggatc

SEQ ID NO: 18621 - DNA, 201 bp, Homo sapiens
tcaaagaagacagacatcagaggctgtatattgtgattccgtttatatgagatgttgagaatgtgtgtagttaagtccatcaaaagtgtttgccggggctrggggcggggactggggagtgactgctgccgggtgtggggtttgcctgtggggcaatggaagtgctttggaactagacagaagtggaggctgcaccgcctt

SEQ ID NO: 18622 - DNA, 201 bp, Homo sapiens
aatcccagcactttgagaggccaaggcgggtggatcgcctgagctcagggcttcaagaccagccttgggcaacatggcgaaaccctgtctctaccaaaaarataccccccaaaaattagctgggtgtggtggtgcacgcctgtggtcccagctactctggaggcggaggtgggagaatcgcttgaacctgggaggcagagg

SEQ ID NO: 18623 - DNA, 201 bp, Homo sapiens
tgaggcaggagaattgcttgagcctaggaggcggaggttgcactgagccaagatcatgccgctatactccagcctgggcaacagagtgagaccctgtctcmaaaaaaaaaaaaaaaaaatgcagctcgtcctggctagtctgaaaaaggtggagcatatatgttgcccaatatccacaaatattccagaaaatatctgaga

SEQ ID NO: 18624 - DNA, 201 bp, Homo sapiens
actgcagaagcatttgcgattgcaggaggtaaatatgtatcaaagacatgagttttagtgaaggatatctttttttttttttttttttgagacagagtctygctctgttgtccaggttggagtacagtggctcacagcagcttccacctcccaggttcaagcaattctcctgcctcagcctcccaagcagctgggattaca

SEQ ID NO: 18625 - DNA, 201 bp, Homo sapiens
ctgcagaagcatttgcgattgcaggaggtaaatatgtatcaaagacatgagttttagtgaaggatatctttttttttttttttttttgagacagagtcttrctctgttgtccaggttggagtacagtggctcacagcagcttccacctcccaggttcaagcaattctcctgcctcagcctcccaagcagctgggattacag

SEQ ID NO: 18626 - DNA, 201 bp, Homo sapiens
cgattgcaggaggtaaatatgtatcaaagacatgagttttagtgaaggatatctttttttttttttttttttgagacagagtcttgctctgttgtccaggytggagtacagtggctcacagcagcttccacctcccaggttcaagcaattctcctgcctcagcctcccaagcagctgggattacaggcgcccgctactatg

SEQ ID NO: 18627 - DNA, 201 bp, Homo sapiens
ctcccaggttcaagcaattctcctgcctcagcctcccaagcagctgggattacaggcgcccgctactatgtctggctaatttttgtatgtttagtagagakggggtttcaccatgttggctaggctggtcttgaactcctaacctcaggtgatccacctacctcagcctcctaaagttctaggatcacaggcatgagccac

SEQ ID NO: 18628 - DNA, 201 bp, Homo sapiens
atttttgtatgtttagtagagatggggtttcaccatgttggctaggctggtcttgaactcctaacctcaggtgatccacctacctcagcctcctaaagttytaggatcacaggcatgagccactgtgcctggcctatgcctgaacaatatcttatcaagacatgtcttttagtcatcctcccgctatggggcgtttctgtt

SEQ ID NO: 18629 - DNA, 201 bp, Homo sapiens
gtgtcaggcggacccgggaccgtggcggcgaggaggtgcagtgtcaggcggacccgggaccgtggcggcgaggaggtgcagtgtcaggcggacccgggacygtggcggcgaggaggtgcagtgtcaggcggacccgggaccgtggcggcgaggaggtgcagtgtcaggcggtcccgggaccgtggcggcgaggaggtgcag

SEQ ID NO: 18630 - DNA, 201 bp, Homo sapiens
ggaggtgcagtgtcaggcggacccgggaccgtggcggcgaggaggtgcagtgtcaggcggacccgggaccgtggcggcgaggaggtgcagtgtcaggcggwcccgggaccgtggcggcgaggaggtgcagtgtcaggcagaccggggacttggagcacctagttccacttgcgggctgaccttctattttttgtcatcgtg

SEQ ID NO: 18631 - DNA, 201 bp, Homo sapiens
atctcgtgatccacccaccttggcctcccaaagtgctgggattacaggcatgagccaccatgcctggccggccctacttcttaaatgggcctgaggcacayggtgccgagagctcgctgaggtctatggaggaagggcgcagatgggatctgggcctggcgtcctggccggcccccaaggccttctccacagagtttccat

SEQ ID NO: 18632 - DNA, 201 bp, Homo sapiens
tttcagaggcttttttttcctcttataaaataacatttatacgttcgctgtagcaaggaaaacattataaaaaatagtgaagaaaatagaaattacccatwattttgccacacagacttagttgtgtccatgtatcttgtgcaccttttttctgtttacggatcaaaatcgacttttagggtcaggcgcggtggctcacac

SEQ ID NO: 18633 - DNA, 201 bp, Homo sapiens
gagagcagacctctcaatctcagcaggccccccacacagaccccataaccctagtctgccttcacagtacagttcgtggctatgtgttcacggatggtgtygttcacctaaggtctctgccctgtgaccccaagggcgtcctgagggcagattccaagtctgtttcgtccacccctccttccctagcagcgggtccagggc

SEQ ID NO: 18634 - DNA, 201 bp, Homo sapiens
ctctccttgcagccatctgcctgcccaaccagttccggtgtgcgagcggccagtgtgtcctcatcaaacagcagtgcgactccttccccgactgtatcgayggctccgacgagctcatgtgtggtgagccagcttctggcacggggaaggggcgtccgggctgggttcccccaggaacgtggagtttaggggaggagacgt

SEQ ID NO: 18635 - DNA, 201 bp, Homo sapiens
gagcgatgaagtggcgtcgagctgggcaggaagggtgagcccctgcaaggtgggcatgctggggacgctgagcagcatggccagcagctgggtctgcagcytggtacccggcgggacttgtggttggggctggtttgtggccaggagaggggctggcaggagacaagggggactgtgaggcagctcccacccagcagctga

SEQ ID NO: 18636 - DNA, 201 bp, Homo sapiens
ccccactgcgctggggtctcctgggccatgctctggccctttgtgttcccagctaccctcatagaggctgcaaatctttcccctgctgaaatgaaaccaastgaactaactacaggattcagttctgtgattgtcattggctgagttgagtttgttttggctttctctttcttggtgaaggtgggagtgtggggttggctg

SEQ ID NO: 18637 - DNA, 201 bp, Homo sapiens
ggacaagcacgttaactgcttcagagctcagtttccccatccgtgatagggaatgatctttatgctcccacaggctcgtcctgaggctgcagagaggcagsgttgaaaagtacctagctcagggcctggctcagtgacggttagctgttagggttaccatcgcatcgcaattgttactccatagtgacgaccccccgggga

SEQ ID NO: 18638 - DNA, 201 bp, Homo sapiens
ggggtgtcctcagccctcctgcctgtgctttgtcccgtcttctgcaggcgcctgggacgtgctgacaggtcctctgccggctcctgccttgctatgcgcaygctggtcaccacagaggcctggcccttcttctgtagcagtcccacacccgcaacaggtgtggctgctgaccacctgctttctgcccctctggtcctgagg

SEQ ID NO: 18639 - DNA, 201 bp, Homo sapiens
tctcagcaccttcagggtggggaacccagggatgggggaggctgagtggacgcccttcccacgaaaaccctaggagctgcaggtgtggccatttcctgctrgagctccttgtaaatgttttgtttttggcaaggcccatgtttgcgggccgctgaggatgatttgccttcacgcatccccgctacccgtgggagcaggtca

SEQ ID NO: 18640 - DNA, 201 bp, Homo sapiens
cgtggagccccgaggggcaggatggcctccatggtcacacgtaggaagtggcctccaccctccgatgatcctctccctcctccctttcagcgccctccccrggggtgtcctcagccctcctgcctgtgctttgtcccgtcttctgcaggcgcctgggacgtgctgacaggtcctctgccggctcctgccttgctatgcgca

SEQ ID NO: 18641 - DNA, 201 bp, Homo sapiens
cctcctctggcttctctgtgccagtgcccccacgctttgtgtctgtgtccccagcccatgggactctgctattccctgagtgctgccgcatgcccagcccrcactgaggacgtggagccccgaggggcaggatggcctccatggtcacacgtaggaagtggcctccaccctccgatgatcctctccctcctccctttcagc

SEQ ID NO: 18642 - DNA, 201 bp, Homo sapiens
tggcacgatctcggctcactgcaagctctgcctcccgggttcatgccattctcctgcctcagcctcccgcgtagctgggactacaggcgcctgccaccgcrcccggctaatttttgtatttttagtagagatgggatttcactacattagccaggatggtctcgatctcctgacctcatgatccgcccgtctcggcctccc

SEQ ID NO: 18643 - DNA, 201 bp, Homo sapiens
agctcatgtgtggtgagccagcttctggcacggggaaggggcgtccgggctgggttcccccaggaacgtggagtttaggggaggagacgtgcctttccagyggggctgggggctgtgtgggagactcaggcggctgggaggctccttgcgggaggcagggaagcctttcccagggcagcggccaggaggacagactgtgag

SEQ ID NO: 18644 - DNA, 201 bp, Homo sapiens
ctttcccagggcagcggccaggaggacagactgtgagctgtgggctcggcggctacagagtctgcctcagtgggcggggctgatggtgtccaggtgcctgyagcacgcacccacccacgggaccttgctgagcagcgtctgtcaggcagcaagattacccgagggctgcagtggtcctgttccctggcagcttactgtctg

SEQ ID NO: 18645 - DNA, 201 bp, Homo sapiens
ccaagggtcgcctcctctgctgggcaagttcccagtctgacgggcctgtgccgtgggccccagctgtgggggcgctgttgatgcgcagccaggcctcgccrccagagcccgcacgcttccattccgctgacttcatcgacgccctcaggatcgctgggccggccctgtgggagagtgaatgtggcttttgccaaagttgag

SEQ ID NO: 18646 - DNA, 201 bp, Homo sapiens
ggatttcagaccctgcttctgagcgggaggagtctcagcaccttcagggtggggaacccagggatgggggaggctgagtggacgcccttcccacgaaaacyctaggagctgcaggtgtggccatttcctgctggagctccttgtaaatgttttgtttttggcaaggcccatgtttgcgggccgctgaggatgatttgcctt

SEQ ID NO: 18647 - DNA, 201 bp, Homo sapiens
ggaggtgtgggggacagcggggaacaggaggagcttggagtttgtttcacgtcctcctgcctctgacccaagcctagagattctatggacagtttcacccyaaatctgcctctttcaggagcgtgtttacattgtggggccttgtctggagctagcaaaacaaggtgaagacaaaacagcgacagtatctggggagtacag

SEQ ID NO: 18648 - DNA, 201 bp, Homo sapiens
gcgaggagccgccgccgccgcgccatggagcccgagtgagcgcggcgcgggcccgtccggccgccggacaacatggaggcagcgccgcccgggccgccgtrgccgctgctgctgctgctgctgctgctgctggcgctgtgcggctgcccggcccccgccgcgggtaggtgggcgcaggccggccgggggccgcgggttgct

SEQ ID NO: 18649 - DNA, 201 bp, Homo sapiens; identical to SEQ ID NO: 2036

SEQ ID NO: 18650 - DNA, 201 bp, Homo sapiens
catggggtcatggacttctgcttcttctccagcctcatgtactggacagactggggagagaaccctaaaatcgagtgtgccaacttggatgggcaggagcrgcgtgtgctggtcaatgcctccctcgggtggcccaacggcctggccctggacctgcaggaggggaagctctactggggagacgccaagacagacaagatc

SEQ ID NO: 18651 - DNA, 201 bp, Homo sapiens
gaggcggaccctcctggaggacaagctcccgcacattttcgggttcacgctgctgggggacttcatctactggactgactggcagcgccgcagcatcgagygggtgcacaaggtcaaggccagccgggacgtcatcattgaccagctgcccgacctgatggggctcaaagctgtgaatgtggccaaggtcgtcggtgagtc

SEQ ID NO: 18652 - DNA, 201 bp, Homo sapiens
gcctggctgtgcctttgctgacaccgtgcccgtgtgtgttcatgcaggtcaggagcgggtcgtgattgccgacgatctcccgcacccgttcggtctgacgyagtacagcgattatatctactggacagactggaatctgcacagcattgagcgggccgacaagactagcggccggaaccgcaccctcatccagggccacct

SEQ ID NO: 18653 - DNA, 201 bp, Homo sapiens
ggggcgcagccatgcgtcaggctggagccagctgcagaggccacagacagggtgtcatgagcagtacaagtaaccgctgctgtccattgaacacctactgkgtgcctgggttcagaaaggcaccctgtgctggcttttaaagaattaggccgcctgcctaaaggggggagtgtggccttctttttcatttaagtcaccaac

SEQ ID NO: 18654 - DNA, 201 bp, Homo sapiens
cagtcctccccgtttctgtagcgtgatggggcccagcttgcagaaggtggtgggggacagggcctgcttcctgtgccggtgtcccactcgggagggcaggkggcttccaagtgggctggcttccacactcaggaacagtcctaagggcagagtctcggtgtggggccccctagaaggactctcctggcatccggtggatgg

SEQ ID NO: 18655 - DNA, 201 bp, Homo sapiens
ttggagcaggagtcaggaggggctcctgtctttccttgaaacgttggatgccgggatcctggaacagtctctgcattcctcctggcgagaaccagagcctrggcacaggggaccatctgttgtttgaaggctgcagcctggcagggcactcaggagatctggcagttggctgcagggccaggtctaggggccagggcatca

SEQ ID NO: 18656 - DNA, 201 bp, Homo sapiens
gggatctgagaccatgtcattgcactccagcctgggcaacagagcgagacgccatctcaaaaaaaaaaaacctacagagccacacggcctctttctccacygagtgttggtgtgggagcttgtgttattgtggtgaaatcttggtactttcttgaggcagagagaggctgagcgcctggagagactttcacatgggtcgcc

SEQ ID NO: 18657 - DNA, 201 bp, Homo sapiens
ttgaggcagagagaggctgagcgcctggagagactttcacatgggtcgccatgtccgccgtcggtttcgctgttgtgctccccatctgaaggctggtgccrtccagacaggctggacgcccctttccaccagatccttcctcccgcagcagtttctagttacgttgtactgtgaggtctgtgtccttggttgatggcaaaa

SEQ ID NO: 18658 - DNA, 201 bp, Homo sapiens
ccagtgcccccacgctttgtgtctgtgtccccagcccatgggactctgctattccctgagtgctgccgcatgcccagcccgcactgaggacgtggagcccygaggggcaggatggcctccatggtcacacgtaggaagtggcctccaccctccgatgatcctctccctcctccctttcagcgccctccccgggggtgtcct

SEQ ID NO: 18659 - DNA, 201 bp, Homo sapiens
ctatgcgcacgctggtcaccacagaggcctggcccttcttctgtagcagtcccacacccgcaacaggtgtggctgctgaccacctgctttctgcccctctrgtcctgaggagggcgcagtgggcactcaggcgtggctgagcagatgtgtgttgccgggaggaggaaggactgctccagtcagggctgaatttcccacccg

SEQ ID NO: 18660 - DNA, 201 bp, Homo sapiens
acaggcatgagccactgcgcctgggctgacatatgtgttttcgtaagcccgaaagatagcatctgaagagtcaacattgagccttgccttttgctgctaaygatgtataaaagctgctgttctgagcatttcggaggctcccagctgccgtgtgcaccctgcctagagctctaccgtaacccatctccgggaggaggtgct

SEQ ID NO: 18661 - DNA, 201 bp, Homo sapiens
gaaccactggcctgggtcgttcggttggtaggcagtggggccaggccatccaactcacaaccaccttctactctgcttcccccgcaccctgaagtttgttytgttttgaggacacagccgtcacattcttggtggctgaacagcactccttgtcaggcgtggctgggcccccactggagggcatcatggtcctctctcctg

SEQ ID NO: 18662 - DNA, 201 bp, Homo sapiens
gtaggcagtggggccaggccatccaactcacaaccaccttctactctgcttcccccgcaccctgaagtttgttctgttttgaggacacagccgtcacattyttggtggctgaacagcactccttgtcaggcgtggctgggcccccactggagggcatcatggtcctctctcctgctgcggttgaaccttggctgtttcaac

SEQ ID NO: 18663 - DNA, 201 bp, Homo sapiens
ggctacgcggaggtgacgtggtcccagatcgcggggcagtgggggaggcaggcttgtgcctcagttgtacactcccgtggggagaggtagggcgggggaaytttctctccaacttttggtgtttcccagggggtggagttgaggtcaggaggactcaggaaacttaagcagtcgtgaaacgctacacatgttcttttaatt

SEQ ID NO: 18664 - DNA, 201 bp, Homo sapiens
ttcctgtatgaccttggacatccagtccactgacaaactcactcactcaccgctgcagccctcgggggcaggagtagttagttagcactgtggacagagcycctgcgcccagggtctgattccagcctggccgcttcctgtgctgggaggcttaggaagctgatgctacctttgtgtgcctcagttttctcacctgtaaaa

SEQ ID NO: 18665 - DNA, 201 bp, Homo sapiens
tcatccaagtagtaccacgtatgggtgtttcagccttttattttttttttgaaatggagtcttgctctgttgcccaggttggagtgcggtggtgcgatctyggctcactgcaacttctgcctcctgggtttaagtgattctcctgcctcaggctcccaagtagcttgcattacaggtgcccgccaccacgcccagctaatt

SEQ ID NO: 18666 - DNA, 201 bp, Homo sapiens
tcatctgcaaaatcgggacgatggtgtccaccttgcccatgctggtggggtcccaagagctggtgtctggggtgagggagctgggggccaaaagctcctgmcctggggcatccagctgtcctttgaagagtaccccgagggtgtgactgagagccagtccccagcacccttgtccagatggggaccaggaggtgggtgaag

SEQ ID NO: 18667 - DNA, 201 bp, Homo sapiens
gagggggcagtagcgagctgcaggtgcagggtcggggtcctgggggttgcgtgtatgcgcagcctccagagaagcccatgcaggcccccctcacccgttcytgcctgacctgctgttgtgtcctgctcctagctctgcggtctgggacaagcacgttaactgcttcagagctcagtttccccatccgtgatagggaatgat

SEQ ID NO: 18668 - DNA, 201 bp, Homo sapiens
cctgacgtcaccaacactgttctgtcaccttgctttggtgtggcttcttcacagttgtcacatctgggccgtttggagtgacctagcaagtcctttgcttrtctcccaggactttccggagtagccaagcagagccttcggccagttcccttgtggggccaggccctgcccgggagcacaggcaggagaacagctgcctcc

SEQ ID NO: 18669 - DNA, 201 bp, Homo sapiens
ggagaggactgcagtagatgttcacggataggaagacaggagatggagatggcagttgcccccagattgatcagtggattcagtgcaggggccggcagtgygctctcctccctgttctttcctcccaccccattgcacaaatgttggtgcctggcatttaaagaagcagaccaggcgcggtggctcacacctgtaatccca

SEQ ID NO: 18670 - DNA, 201 bp, Homo sapiens
gtggacagttagaccaagaggagcccggaagcagacccaggctttggcatcaggagctttggcatctggcagaactcctgtccctggggttggggtgtgargaggtgtgcagggtagtagcgtgaataactgctttgaggagctgaagctagaaggtgcccagagctgtgttaggtgtcagagaagttgtttgtgaggcat

SEQ ID NO: 18671 - DNA, 201 bp, Homo sapiens
ctcaacattcaccaagtcatgtttgtttttcaatgctccagctcttcctcctccaggaagcctgcccagtctacccacagccaggtctacccacagtcagmccttcctcttcttagaagcctgcccactctaaccgcagccagatcttcctctgtctaggaagcctgcctggttcacccacagccgtgtcttcttcctcta

SEQ ID NO: 18672 - DNA, 201 bp, Homo sapiens
tccctggggagagggcgtaattattttatgttcatgatgcggcagtcaccaccgtgtttctgaaaggtttgttctgcactctgggctgccagttgacattyggtttttcatggtgatctggtgggtcctggggtgtgatggtggccgggcccagctgcttcagccctcagcctgtccatcccccacccacacccagaactg

SEQ ID NO: 18673 - DNA, 201 bp, Homo sapiens
cattcagtgtcaccacagtctctcagcactcccagcctggacctcaccggttgaggggccggcctagatcttctttgcgcaatggcacgatctcagctcaytgcaacctccacctcccgagttcaagtgattctcctgcctcagcctcctgagtagctgtgattacaggcgtgcactaccacacctggctaggttttgtat

SEQ ID NO: 18674 - DNA, 201 bp, Homo sapiens
ggttagaaagtcccaggagtgggcggccatgcatccaggcctgccacaggagcccgcctgccctcctccctgaagtcagggctctggaagcccttcccttkgccatgccctgtgggacagtgtccaagctctggagtaggactgaagacccctgggctctagtcctggggccaccaacttgctgttgccctttgcagtgac

SEQ ID NO: 18675 - DNA, 201 bp, Homo sapiens
cctcctgagactcgacttcgttgcagtttcagcaatgcaggtggccccgtgcggacatccaggcagggttgagggaaggcacatccctcccaggcccaggktacccatgtgggtggcagagcgggctctggggatgaccctctggcccctgaggatctggggccagaaagacactggcttagcatgggaggagtccccggc

SEQ ID NO: 18676 - DNA, 201 bp, Homo sapiens
caggaaggtcacggctggttttggggaaattgcaggccgtctggccaggctgagggccccatgtggacggggccagcgatgaggcaggtggaatggtgccmgcggggaggtccctgatgccacttgaggccgatgtttgggcagagggacacactggaggctgtcacgggggacgaggcaggatgtgactcattcagaaac

SEQ ID NO: 18677 - DNA, 201 bp, Homo sapiens
gggtgtggccgcctgagccggcaggtcagaggtctctctcaggaggcctgagatctgaaggactaaaagagggaaaggcgagaaggaacagcacgtgcagyggctttgaggcaggagcatgctggtgttgggaccgacttcacgggctgtgtgacctgtgtagtcatatgaggtgagctctgttgttgacctgaaattcct

SEQ ID NO: 18678 - DNA, 201 bp, Homo sapiens
cgccaagcctggctgattattcactggatgaggagacaggcccagagaggggcaggaacctgcccgaggtcacccagcaggccccagaggtttcggtctcrgattctccctgctcatccctggatgtagtgctgctgtggatgtggttctgtgctgggggctgtggagagcagggggcttgtgccaggaccccagtgaggg

SEQ ID NO: 18679 - DNA, 201 bp, Homo sapiens
gaatccaggcaactgagtctgagtggatggtgtgtgctttgtgttggagctggcccagggctggatgaaggcaacatttaattaatgaaaaccactacccmctcccggctgttacctcttgagcgcttttctatgaagcatcctgtttaagcctcgcactctgtgatgtggaggtgcagtaattatccccatttcacagac

SEQ ID NO: 18680 - DNA, 201 bp, Homo sapiens
tgggctctagtgatcctctcatctcagcctccctagtagctgggactacaggcacacaccaccactcctggctgattttttttttttttttttttttttgkggagacagggtttccgcatgttgcccaggctggtttcaaactcctaggctcaaacacccacctcagcctcccaaagtgctgggattacaggcgtgagcca

SEQ ID NO: 18681 - DNA, 201 bp, Homo sapiens
gtagctgggactataggcatgcaccaccacacctgtctgatttaaaaaaatatacagatgaggtcttgccatgttgcccaggctagtctcaaacttctggsctcaagtgaacctcccaccttggcctcccaaagtgttgggattacaggcatgagccaccgcactcagcccataaccttgtcttatgtgtgtttctaagac

SEQ ID NO: 18682 - DNA, 201 bp, Homo sapiens
cctctccagtagctgggactataggcatgcaccaccacacctgtctgatttaaaaaaatatacagatgaggtcttgccatgttgcccaggctagtctcaamcttctggcctcaagtgaacctcccaccttggcctcccaaagtgttgggattacaggcatgagccaccgcactcagcccataaccttgtcttatgtgtgtt

SEQ ID NO: 18683 - DNA, 201 bp, Homo sapiens
caccaccacacctgtctgatttaaaaaaatatacagatgaggtcttgccatgttgcccaggctagtctcaaacttctggcctcaagtgaacctcccacctyggcctcccaaagtgttgggattacaggcatgagccaccgcactcagcccataaccttgtcttatgtgtgtttctaagacaccttatttaggctgagtgca

SEQ ID NO: 18684 - DNA, 201 bp, Homo sapiens
accaccacacctgtctgatttaaaaaaatatacagatgaggtcttgccatgttgcccaggctagtctcaaacttctggcctcaagtgaacctcccaccttrgcctcccaaagtgttgggattacaggcatgagccaccgcactcagcccataaccttgtcttatgtgtgtttctaagacaccttatttaggctgagtgcag

SEQ ID NO: 18685 - DNA, 201 bp, Homo sapiens
caagtggttctcctgcctcagtatcccaagtagagctgggattacagggacccacccgccaccacacctggctaattttttcttttttttccgaaacggarttttggtctgtcgcccaggctggagtgcagtggtgcaatctcagctcactgcaacctctgtttcccaggttcaagggattctcttgcctcagcctccgga

SEQ ID NO: 18686 - DNA, 201 bp, Homo sapiens
ggcgtgagccaccatgcccagcctattctactgtttgtattacatagctttaaaagattttttatgactttaagtcacaagggttctttgtagaaaaaaawatatatataggaaagtataaaaagaaagtaaaaattgtccataacctctccagccagagacgaccgttgctgacacctcagcatattgcctttaagtctt

SEQ ID NO: 18687 - DNA, 201 bp, Homo sapiens
tggagtctgcagcatggggcacaacaggttcattagtgtagaattccaggacaggcctggctcctaagcagccttcttttacaaaaactgcagagcccgcytgtatcctagcactttgggaggccgaagtgggtggatcacgaggtcaggagttcaagaccagcctggccaacatggtgaaaccccatctctactaaatat

SEQ ID NO: 18688 - DNA, 201 bp, Homo sapiens
tctcaaaaaataaaaaatagaaaaacaagtgctgtagcggaagtgagcactttgcggagtcaggcttgtgtggcctgttccacaaatgatgtgctcacggyggcctcaggcccacctggagtctgcagcatggggcacaacaggttcattagtgtagaattccaggacaggcctggctcctaagcagccttcttttacaaa

SEQ ID NO: 18689 - DNA, 201 bp, Homo sapiens
aaacaaaaaacaaacaaacaaagcgtcatttatccagcacccctggggaaccatgctacctggtgttttatggtacctggcaaggtgcaggtgaagttgckgctcttgggcattgaacccgtcttgtttggggcagctcaggccccaggcagggtccgggttggctctcgttggtgtggccctggcccatccagacctata

SEQ ID NO: 18690 - DNA, 201 bp, Homo sapiens
tgcagtggttcgggagaggacacctgcttgcctggtctgttccaaatcttgcttctcatcccagcacaggtagggggtgctatgggaaagggatcctcagytggccctgtcactgctctatcagctggggacgtggcatcctagtgaaaacatcatggccgggcgcggtggctcacgcctggaatcccagcactttgggag

SEQ ID NO: 18691 - DNA, 201 bp, Homo sapiens
cgcgatctcagctcattgcaacctctgcctcctgggttcaagtgattctcctgcctcagcctcccaagtagctggaattacaggagtgcgccaccaggccyggcatatttttctatttttagtagagagggggttttaccatgttggctaggctggtcttgaactcctgacctcaggtgatccacctgcctcggcctccca

SEQ ID NO: 18692 - DNA, 201 bp, Homo sapiens
ctataggcatgcaccaccacacctgtctgatttaaaaaaatatacagatgaggtcttgccatgttgcccaggctagtctcaaacttctggcctcaagtgawcctcccaccttggcctcccaaagtgttgggattacaggcatgagccaccgcactcagcccataaccttgtcttatgtgtgtttctaagacaccttattta

SEQ ID NO: 18693 - DNA, 201 bp, Homo sapiens
tgggtgtggtggcaggcgcctgtattcccagctactggggaggctgaggtgggagaattacttgaacctgggaggcggaagttgcagtgagccaaaattaygccactgcactccagcctaggcaatagagtgagactccgtctcaaaaaaaaaaaagggccaggggtggtagtgacaaagagaccctatcccaaaaaaacc

SEQ ID NO: 18694 - DNA, 201 bp, Homo sapiens
gcttccctgacctttgaaatgtggtccctgctcgggaaacttgcctggacctcagtcaattatggttttcctctgggctgtgtgtgtgtgtgtgtgtgtgkgtgtttgagtgtgcaagtgtgtgcattaggattagagagaattcgatggggggccaggggccaacaggaatgggggtggctgagctgagaggccaagggc

SEQ ID NO: 18695 - DNA, 201 bp, Homo sapiens
gtcagcccttcctcttcttagaagcctgcccactctaaccgcagccagatcttcctctgtctaggaagcctgcctggttcacccacagccgtgtcttcttyctctaggaagcctgcctggtccacccatagtcaggtctacctcctccaagaagcctgcctgatccacccacagccagatcttcctcctccaagaagcctg

SEQ ID NO: 18696 - DNA, 201 bp, Homo sapiens
gtgggcgttcctgggagtggcagacatgcacccactagagatagatctgaatcaccccctcacattctcctaatagtgccaagaacccacagcagagtgcrgggtgtactgagtttgtgctgagcaggggtgcctgaatcccggattgaagaaagtgttctacgcccgattaaaccaactgggaatccaggcaaaagaaga

SEQ ID NO: 18697 - DNA, 201 bp, Homo sapiens
gaattaaaaaatatattaaaaactatatatttaccagtattacaatatattacccagagacttgtctccctaatgaggccacctttactttttcaatcttygtctccgctggtgctttctcataactgccattcattctagtagaaatcatggttcacggttatgctgggtgtgtggtttttggtgttgacatgtcgaacg

SEQ ID NO: 18698 - DNA, 201 bp, Homo sapiens
ccctcccgtcgggttctgctcctgccacgttctcccctctccccaccaaaggctgggttttctttgtcagggctcctttcccctttggagaagagggggcygtagggccttggtgcgaggccctccagtgacaggatcccccatcacccagagttccacaggccctggtagggaggagggggagcagaagaggaggtgcca

SEQ ID NO: 18699 - DNA, 201 bp, Homo sapiens
tgccagttccttccaaaggaaagccagctccccaggtggtgggagagtgatgtggcttcctcttaaacttaggaattgagtgtgtggttgcttctaagtgycttagaagccggagcggctcctggaaagagcctgcctgccacagcgggccttaccctggctgtgcccacagatgtccctggggcctgccgctcctgcccg

SEQ ID NO: 18700 - DNA, 201 bp, Homo sapiens
tggaccagtttctcaaaaggcctgtgaccccaagaaccaaggaatttcagcctgggtggatcacaccttcactggtgagtgggacaagctgggggccctcrccacaggagcagccagggcatggggcacagttggcctcattcacaaaatgggagtataagtgatccctgctctggcggccaggacgatgagtgggaacac

SEQ ID NO: 18701 - DNA, 201 bp, Homo sapiens
cagggcatggggcacagttggcctcattcacaaaatgggagtataagtgatccctgctctggcggccaggacgatgagtgggaacacaccgtgtgggggcygcctggcctgggtgtgccgcgggtgtccttgttggtgatggttccacctgcttgtgccaccagtgccctctgggtctcacacacaactctcttcccagcg

SEQ ID NO: 18702 - DNA, 201 bp, Homo sapiens
ccctcctcggcctcccaaagtgttgggattgcaggcgtgagccactgcacccagcctgacctagatcttctaggttagaaagtcccaggagtgggcggccrtgcatccaggcctgccacaggagcccgcctgccctcctccctgaagtcagggctctggaagcccttcccttggccatgccctgtgggacagtgtccaagc

SEQ ID NO: 18703 - DNA, 201 bp, Homo sapiens
tatgagtgtgcgcatgtgactgtgtgtgcacgtgtatgtgcccgtgtgagcgagtatgtgcgcgagagtgtctgcatctgaaccagtctgtgtgtaagtayggggtaccagcaggggtgggacacggtggaatttatcgccaaagtattttgagtccctgaggtcaggccagagcagcctcgtgcccccactacctgagaa

SEQ ID NO: 18704 - DNA, 201 bp, Homo sapiens
agaagtgcccccggcctcccaggggtgctgtgctgggcaaccactcatccctggagcccctcgtatgccctcgctgccctccgagtgggctagccaccccygcagctgccggggagccagctgacctccggggcagcctctgttccgcttggtgaactgttgccctctcagccctctccccctgcactgtggctccaggag

SEQ ID NO: 18705 - DNA, 201 bp, Homo sapiens
gatagcagcttgctagaagccctctcccagggccggcctgcggttgctcaccagcggctgccatggccatcgtgtcgccaggacctgcgctcctcctgtcmttgcgttccctcccagcgtgggtcgctgcagctccctcacctcccaaccaggcatccactgcatttgtgagcccttgcgcctggtcctgctccccacgca

SEQ ID NO: 18706 - DNA, 201 bp, Homo sapiens
tgtcgttataataaaaatgccctttcctcgccaccagaagtccagtctccatgcctacgtggttttgtctttttacttctttatggcttttgctatgttgkttgggaagtgctcagtgctaggttgggaggtgatcagtcgggaggtgctaggtgatttgttgggaggtgcatgatgctcagttgggaggtgctaggtgct

SEQ ID NO: 18707 - DNA, 201 bp, Homo sapiens
gcatcatctctgcgagccaactgtccctgtttggctctggcttttcttaactatttgaaatggttcctttacatgcttgcctctgaattctctcccagaasccctccccaggatcacacctgtggctgttcactcccacccctgcccctggggcaaagttgaccttagtgttgattcctgggcctctccccacaccttccc

SEQ ID NO: 18708 - DNA, 201 bp, Homo sapiens
tgacatgctacagcctggatgaacctcgaaaacatggtgccaagtcaaagaagacagacatcagaggctgtatattgtgattccgtttatatgagatgttkagaatgtgtgtagttaagtccatcaaaagtgtttgccggggctgggggcggggactggggagtgactgctgccgggtgtggggtttgcctgtggggcaat

SEQ ID NO: 18709 - DNA, 201 bp, Homo sapiens
cggccattggagcgtggggggcagcctttgcagaggggtgtcctttgggggctccgaggagctggggagggtgttctagtcataggagcttggtgggaggragcagatggggaggatgtcactccatgggcaggtcacatctgggtgtgagggtggccaggaaggtcacggctggttttggggaaattgcaggccgtctgg

SEQ ID NO: 18710 - DNA, 201 bp, Homo sapiens
cacactggaggctgtcacgggggacgaggcaggatgtgactcattcagaaacaagtgacggtcctcttctggaaccttctctcactctgtcctggttttcycagtccacactcgctgtgaggaggacaatggcggctgctcccacctgtgcctgctgtccccaagcgagcctttctacacatgcgcctgccccacgggtgt

SEQ ID NO: 18711 - DNA, 201 bp, Homo sapiens
ctgctgtccattgaacacctactgtgtgcctgggttcagaaaggcaccctgtgctggcttttaaagaattaggccgcctgcctaaaggggggagtgtggcyttctttttcatttaagtcaccaactgttttatacatccacgcccctaaattcttcagttttaggcaaagatgagagggctgcccaggcgtcatttgctca

SEQ ID NO: 18712 - DNA, 201 bp, Homo sapiens
ctaaacaacaaaaataatctggccgcctgccagctgggaagccactgtggccaggctgtttatggccttgggatctgcgcagtggacagtggcctgcaccrtgaccccgttcatcctgcgtgccccaggcccaggaggtggctcaagccctctgcctcctgtaagggcacctgagaaggaggccctggagctgggagcaga

SEQ ID NO: 18713 - DNA, 201 bp, Homo sapiens
ggagggtattaactgtgatgaccttctgagttcctgcacactggtgacccattggcagggtctcctcctggctctggcaggggtggctcaggccgctgggygacggtgtgctggccagatagttcctggggctgcaggtggcttctttcgccccatccctcccatcccctttcattcttcctgtcaacacatctcagaccc

SEQ ID NO: 18714 - DNA, 201 bp, Homo sapiens
aggagattggttcaaacaatgtgtgtaatgttgtgtctgagtgtttttcatttatcgttcatgcaaattccgacatcattcactcttctccagagtgtgcygttttcctgcctgtgtcatcacccgtcaccttgaatgccctcgtttaggtaaaataagtacattttattcaaaaatatttgaggacatttgggttgtctc

SEQ ID NO: 18715 - DNA, 201 bp, Homo sapiens
ccaggcgtggtggcgggcacctgtaatcccagctactcaggaggctgaggcaggagaatggcgtgaacctgggaggcagaggttacagtgagtcgagatcrcgccactgcactccagcctgggcaataagagtgaagcttcgtctcaaaaacaaagtcacacacgcttcttgtacgagggtcatttggccgaggggccaga

SEQ ID NO: 18716 - DNA, 201 bp, Homo sapiens
ctggaggccagctgtgggcaccagccttggcagggctgtggcggagcccaggctgctggtactctctctgcagctgctccctgctggcctggctggacagmgtccccaccaccactggggtcacctctgtgctggtcacagctcactcagaccttcaggcaaatgggttggatcctgcctctctcccaggtgtctcagtct

SEQ ID NO: 18717 - DNA, 201 bp, Homo sapiens
actccggggcttggagcaggagtcaggaggggctcctgtctttccttgaaacgttggatgccgggatcctggaacagtctctgcattcctcctggcgagarccagagcctgggcacaggggaccatctgttgtttgaaggctgcagcctggcagggcactcaggagatctggcagttggctgcagggccaggtctaggggc

SEQ ID NO: 18718 - DNA, 201 bp, Homo sapiens
agtgcccccgggtctcaggcctcagaaccagggtttcccttcatctcggtggcctgggagcatctgggcagttgagcaaagagggcgattcacttgaaggrtgtgtctggccctgcctaggagccccccggcacggtgctggggcctgaagctgccctcgggtggtggagaggagggagcgatgaagtggcgtcgagctgg

SEQ ID NO: 18719 - DNA, 201 bp, Homo sapiens
cctgggagcatctgggcagttgagcaaagagggcgattcacttgaaggatgtgtctggccctgcctaggagccccccggcacggtgctggggcctgaagcygccctcgggtggtggagaggagggagcgatgaagtggcgtcgagctgggcaggaagggtgagcccctgcaaggtgggcatgctggggacgctgagcagca

SEQ ID NO: 18720 - DNA, 201 bp, Homo sapiens
ccaacaccaacatttaccgacaccaacatttaccaacactgaaatttaccgacaccgacatttaccgacaccgtttaccaacaccgacgtttaccgacacygacatttaccgacactgatatttaccaacactgacatctactgacgctggcatctactgacaccgatgccagcatctaccaacaccgacatttaccaaca

SEQ ID NO: 18721 - DNA, 201 bp, Homo sapiens
gcgagtcatggctgcttctcaggtccttgcccagcgccaggagcaaaccctcctggcactttgttcaggggtggatgcgccagtgttcctgctgtggaccsccatctcacatgagggtcttgggcctgcaggctcgttcaggaaacacccgctgagtatgcagtgtgtgccagctgtgtcccaggcaatggcggggacagt

SEQ ID NO: 18722 - DNA, 201 bp, Homo sapiens
ctttgttcaggggtggatgcgccagtgttcctgctgtggacccccatctcacatgagggtcttgggcctgcaggctcgttcaggaaacacccgctgagtaygcagtgtgtgccagctgtgtcccaggcaatggcggggacagtggctgctgctggggttgtggtggcttctggggactctggggacagctgaggtgcaagg

SEQ ID NO: 18723 - DNA, 201 bp, Homo sapiens
gatcgagtcgtccaacatgctgggtgagggccgggctggggccttctggtcatggagggcggggcagccgggcgttggccacctcccagcctcgccgcacrtaccctgtggcctgcaagttccccaacctggcaggagctgtggccacacccacgactgcccagcagcctcaccctctgctgtgggagttgtccccgtcca

SEQ ID NO: 18724 - DNA, 201 bp, Homo sapiens
aaataggaggagagacaagtgggcagttcagactgatggtatgggcacagtagagactggtgcagacaggctggcctgtgatgtcaagcaacttctgtaaytgtttccggcatccatttgtgtgtcaatttccgtgtcagtaggaagactctgtaggctgccaagaggaataagtgggaggatcctcccagagaggccggg

SEQ ID NO: 18725 - DNA, 201 bp, Homo sapiens
cgtaagcagaggggacattttgtgactgtccccctcctgagcttcccagcagcttttctccaagttacagcccaaaagctcaggtggatttgcaacccaasggtgtctgtgcacctcccactgatgcccgaactgccctggccaagaaacggggccgtcagaacgctgcactaactgcagccttgggcctccatgccagag

SEQ ID NO: 18726 - DNA, 201 bp, Homo sapiens
ggtgtggagaaagctccttggacttgaccttcatattctagtaggacatgtgctgtgttgtccacaaatcctcatgtaccctagaaatgaatgtgggggcrgctgggctctctccagagctgaaggaatcactctgtaccatacagcagctttgtcttgagtgcagctgggatttgtggctgagcagttacaattcctacg

SEQ ID NO: 18727 - DNA, 201 bp, Homo sapiens
aggacagggaaagaagctttgcagctatgcagaggtgggcccacgggtgctccttcaccctcggggtgtcctgcgagaggcccttagaggccagatcatgstgtggagtctggttgtgatccacaaggcagcggaagcttctggaaggctttaggcaggagttacaggaaatgcaagctaaagccagatctttcctaggtg

SEQ ID NO: 18728 - DNA, 201 bp, Homo sapiens
cttggttggttgcatctcccagccggcacgagcaggtctcatgcctcctgcatcctggtggaggtggctggtgggaggatctggcctgagactctcctgcygaggttcaggaacgagccaggtgatggggacaagttggggagtcagtgctggcatctcagaggaggggcctgggccctgagaggagtgctgggagggcag

SEQ ID NO: 18729 - DNA, 201 bp, Homo sapiens
atctgtggtttgtgaggctttggaaacacttaatgcgctctccaaatggggagtctgttggggaggccctggcgggagccggggctacatccaggtcctcrgcttggtggccttgttcacttatttgttcaggaagcagcagggtgtgggctctgtgccaggccgccctggagggctgtcctggggccagtgaggtccaag

SEQ ID NO: 18730 - DNA, 201 bp, Homo sapiens
ccagcacccttgtccagatggggaccaggaggtgggtgaagatatttggggtctgagctctgtgctggttgcccccgagggggcctggagccctgagttasgagcagaacggggtgctggtcctatccgttccctacctgggtagtgggggctgccttcctgggttgggggtggggggagctccctgtgtccctaagccat

SEQ ID NO: 18731 - DNA, 201 bp, Homo sapiens
agggacactgttctctgtctctcgtgcttggggtctcttgctgtggaccccctgggaggttgtcctgggggtgcggggattgtgttttctgggtattttcktatttgctctattggagtgtatttaatttaatatatatattttaaacatcttttagtttgccttaatgtaattttttttgagatttaatttttttttttt

SEQ ID NO: 18732 - DNA, 201 bp, Homo sapiens
cccatgtctacaaaaaatttaaaaaattagctgagtatgattgcacactcctgtagtctcagctacttgaaaggctgaggtgggaaaatctattgagctcrggaggtcaaggctgcagtaagccatgatcacagcactgcaacagatctagcctgggcaacagagcgagaccctgtctcaaatacatacatacaagcatac

SEQ ID NO: 18733 - DNA, 201 bp, Homo sapiens
gtcctccaggctggagtgcagtggcgcgattgccatcttggttcactgcaacctctgcctcccgggttccagctgttctcctggctcagcctcccaagtarctgggactacaggcatgcgccaccacgcctggctaatttttgtatttttggtagagacagggtttcaccatgttggccaggctggtctcgaactcctgac

SEQ ID NO: 18734 - DNA, 201 bp, Homo sapiens
gattgccatcttggttcactgcaacctctgcctcccgggttccagctgttctcctggctcagcctcccaagtagctgggactacaggcatgcgccaccacrcctggctaatttttgtatttttggtagagacagggtttcaccatgttggccaggctggtctcgaactcctgacctcaagtgacctacccatctccgcctc

SEQ ID NO: 18735 - DNA, 201 bp, Homo sapiens
ccacgcctggctaatttttgtatttttggtagagacagggtttcaccatgttggccaggctggtctcgaactcctgacctcaagtgacctacccatctccrcctcccaaagtgctgggattacagacataagccacggtgccagcctgtttatctttttcttatagatttgtgggaggtctttatttggtatggactttaa

SEQ ID NO: 18736 - DNA, 201 bp, Homo sapiens
ggaatgctgctgtctccatctctgaagcatcagaacatattttaagatcagttatgtaaattcccacctcattgtccttttcaaaagacgtattggctctkcttgcacgtttatgcttttgtggtgaacttcagagccgtcctatcaggttccaccctttgatctcttgatctggggacggtaaatggtgatatccagcag

SEQ ID NO: 18737 - DNA, 201 bp, Homo sapiens
ctgggtgcagtggagccggccttgacatttgtgggttttgctgacatttgtggaaggctctggaggtgccctttgtgccgacttgcccgagccactcctgytgcccaactcactccggtgtctgctcaggaaagaaattctaatgcacactaattttagcattagcccgatggcaaatataattactgagttaattatcac

SEQ ID NO: 18738 - DNA, 201 bp, Homo sapiens
ggcgtgagccaccgcgcctggctactttggtacttttgagttaaaactatagagtaggtgactgagtgatatttttaatgcgttctcaagaatttgaacaygaagagagtgtcaccctcccaggttatgcccccgggagttcatgcacttgccacctggtcgctgctcagggggcccagggagtttgctgcagtgccggag

SEQ ID NO: 18739 - DNA, 201 bp, Homo sapiens
ggagtttgctgcagtgccggaggactcctgggtcccggctgtgcctccccgcagccgcctgctcccttgggacactcattcatttgctgtggccactgccrcccacagtccttgcctcgtagactccactgcagctctggttacaaagagcgagtggtcagggactcctgacctgccatgcagggccccgtgggcttgtgg

SEQ ID NO: 18740 - DNA, 201 bp, Homo sapiens
ctccactgcagctctggttacaaagagcgagtggtcagggactcctgacctgccatgcagggccccgtgggcttgtggtggctttggtgccgtccgctgcrtctgcctcttagagcatggagttctccttctcaggagggctgagctgctggagctctagtcctgccgcagagcagcccccaagtgcggcgttgcctgtcc

SEQ ID NO: 18741 - DNA, 201 bp, Homo sapiens
gcctggctcagtgacggttagctgttagggttaccatcgcatcgcaattgttactccatagtgacgaccccccggggactctggacttgttcagctcagcygagaggctgcttggccgaaaccatctcagctctgcatagtgtggcctggtggcctgtgggttgcgctcatgacaacgtggagcctattcagtcggtaccg

SEQ ID NO: 18742 - DNA, 201 bp, Homo sapiens
ttatacgagtgttttcttccatcaataaaagaaatcggcgaacagcctcccatgggtttcagtaagtgcaagccctccttgtcatcccagacctcagcctrcccatttaatggatgaagacactgaggcctggagggaacagtgacttcggagccactctcctggactctgccactcctctcgcctcccatatgaacctga

SEQ ID NO: 18743 - DNA, 201 bp, Homo sapiens
ggaactttccttggggattcaacacgtgcaagtcttaggggctggcaaatcctgccctcagctagagagggggcttttatttgagaccagaatcacctgarcatcctcctgtccccagctgtgtccagcctgtctgcagggacatcctgagaggaccaggctctcccctcatccacctgcctaagtgccactctgaaccct

SEQ ID NO: 18744 - DNA, 201 bp, Homo sapiens
tggcatcgcggtcgactgggtggcccgaaacctctactggaccgacacgggcacggaccgcatcgaggtgacgcgcctcaacggcacctcccgcaagatcytggtgtcggaggacctggacgagccccgagccatcgcactgcaccccgtgatggggtaagacgggcgggggctggggcctggagccagggccaggccaag

SEQ ID NO: 18745 - DNA, 201 bp, Homo sapiens
gcctcgccctgctgctgtggtcgggtttcagtggcctcgtcccgtggacgcagcctcgccctgccgctgtggtcgggtttcagtggcctcgtcccgtggaygcagcctcgccctgccgctgtggtcgggtttcagtggcctcgtcccgtggacgcagcctcgccctgccgctgtggtcgggtttcagtggcctcgtcccgt

SEQ ID NO: 18746 - DNA, 201 bp, Homo sapiens
gacgcagcctcgccctgccgctgtggtcgggtttcagtggcctcgtcccgtggacgcagcctcgccctgccgctgtggtcgggtttcagtggcctcgtccygtggacgcagcctcgccctgccgctgtggtcgggtttcagtggcctcgtcccgtggacgcagcctcgccctgccgctgtggtcgggtttcagtggcctcg

SEQ ID NO: 18747 - DNA, 201 bp, Homo sapiens
aggatcgcttaagcccaggaggtcaaggctgcagtgagctatgatcgcaccactgcactccagcctggacaacagagcaagaccctgtctgaaaaaaaaamcaaaaaaaaaagttcctttctttttgtggctggatgacatcccattgtatggccacagcacattttgtttgtctgtttatcgggtggtgggcagtggttt

SEQ ID NO: 18748 - DNA, 201 bp, Homo sapiens
tggtttccaccttttgtctcctgtgaataatgctgctgtgaacatttgaattcaagtttttgtttgaacacctgttgtgaattatttggatatatgtgtargggtaggattgctgagtcctatggtaatgttaggtttgacttactgaggaaccattaaactgttttcaacagtggctgcgccgttctgcatccccaccgg

SEQ ID NO: 18749 - DNA, 201 bp, Homo sapiens
actacacttgctggggccttcgtgtcacaatgacgtgagcactgcgtgttgattacccactttttttttttttttgaggtggagtctcgctctcttgcccrgtctggagtgcagtggcacgatctcggctcactgcaagctctgcctcccgggttcatgccattctcctgcctcagcctcccgcgtagctgggactacagg

SEQ ID NO: 18750 - DNA, 201 bp, Homo sapiens
cttccagggaaggtcctctttccaaatggcgacacctggtccctgcctggaggctggaagctgtggcccttgtatgcccctccagggtctgtgcgctcggktggcccgagttcccatcaccgtcgtcatcatcaccatcatcattgtcatttcgcttgtctgtgagccggcctggtctcccagagcagagaccctctgagg

SEQ ID NO: 18751 - DNA, 201 bp, Homo sapiens
tctgtgcgctcggttggcccgagttcccatcaccgtcgtcatcatcaccatcatcattgtcatttcgcttgtctgtgagccggcctggtctcccagagcakagaccctctgaggtccagcctgagttggggtctccgtgctgacccctgacggggactcaggacgtaccaggtctgggtcaggagtgacccccaaacctcg

SEQ ID NO: 18752 - DNA, 201 bp, Homo sapiens
atgggacagggtctgttggctgcactgtgctcccagggatctggggagaggctatatccctgggctttggcactgcagagctgtgtgtgtttgtgtgtgtktgtgtgtgtgtgtgtgtgtgtgtgtgtgtgtgtgtgtttgcgtgcgcgcacatgtgtataagatctttttttattacatgaagcaagataactgttgctg

SEQ ID NO: 18753 - DNA, 201 bp, Homo sapiens
ttgagcccaggagtttgaggttgcagcgagccaagatcgtgtcactacactctagcctgggtgacagagcccagaccctgcctctttaaaaaaaaaaaccmaaaaacatgtattggaacacagccatgcctgttcagtcacgtgctctccatgctgctttctgctccagagacccttatggcctgaaagctgaaaatattt

SEQ ID NO: 18754 - DNA, 201 bp, Homo sapiens
aagaagagaaaaatctctccaagagataatagtgacctctgagctgggcgcggtggctcacgcctgtaaatcccagtactttgggaggctgaggcgggcasatcacctgaggtcgggagtttgtgaccggcctgaccaagatggagaaaccccgtctctactaaaaataaataaataaataaataaataaatacaaaatta

SEQ ID NO: 18755 - DNA, 201 bp, Homo sapiens
gtcctgcagttgctctgtgtggtgggtgtgatctggagccctccgcccattgctgcacctggggcaggcattgctaattgatcccaggactccttcctgcrgagcacgccctggttctccaggcagccgctgcctgtcagcctgcagtggttcgggagaggacacctgcttgcctggtctgttccaaatcttgcttctcat

SEQ ID NO: 18756 - DNA, 201 bp, Homo sapiens
gggaagcggagcttgcagtgagccgagattgcgccactgcagtccgcagtccggcctgggcgacagagcgagactccgtctcaaaaaaaaaaaaaaaagtmcaaaaaaaaaaaaattagtctgggtgtggtatcacgcgcctataatctcactactcgagaggctgaggcggagaattgcttgaacccaggaggtagaggt

SEQ ID NO: 18757 - DNA, 201 bp, Homo sapiens
ttggtggctgggtgcggtggctcacacctgtaatcccagcactttgggaggccgaggtgggcagatcacctgaggtcgggagttcgagaccagcctcaccmacgtggagaaaccccgtctctactaaaaataccaaaaaaaaaattaaccgggcatggcggcgcctgcctgtaatcgcagctactcaggaggctgaagcag

SEQ ID NO: 18758 - DNA, 201 bp, Homo sapiens
cgcagctactcaggaggctgaagcaggagaattgcttgaacctgggaggcggaggttgtggtgagctgagatggcaccattgcactccagcctgggcaacmaaagtgaaactccgtctcagaaaaaaaaaagtttgattggtgtaaccaaagcgcatttgtttatggattgtctgtggcagcttttgttctgccgagatga

SEQ ID NO: 18759 - DNA, 201 bp, Homo sapiens
ggctgagttgggaggattgcttgagccccaggaggttgatgctgcagtgacctgagattactccactgtactccaacctgagcgacagagcaagacttgtytggggaaaaaaaaaaaaaaatatatatatatatatatatatatatatacatatatacatacacgcacacacacataatataaaaatatatatttataaat

SEQ ID NO: 18760 - DNA, 201 bp, Homo sapiens
gtgtgggcagctgtgccttgccatccccggcggccaccgctgcggctgcgcctcacactacaccctggaccccagcagccgcaactgcagccgtaagtgcytcatggtcccccgcacctcactccctcgttagatcaggctggttctgggagctgacgctgaaaggagcttctcatctggggttcctgggtgtacatagat

SEQ ID NO: 18761 - DNA, 201 bp, Homo sapiens
tatgacacggagaatgaaattccccatagcgcacccccaagagacagccctggtccccccgtctttcccgtggacctccagcggggcagatgctgagccgyctgttgtcgagtggcgtgctatcccgtcctccagctcctctgtggcttacagacacccacctgcagccctgtctttgcctcctctagcgcccaccacctt

SEQ ID NO: 18762 - DNA, 201 bp, Homo sapiens
agcgcatgagtttttgtgaaacactggaaggaggattgtgggaaatcaaatggaaagttctcaccccaggcgtggagaagagtgggtcatggccccagcartgagcccagggaggtcagagacggaggtgtgtgtgtgggtgtgaccctgcgcagttccctgccggctgtagttttttgcattcgcttaatgtttctcgtg

SEQ ID NO: 18763 - DNA, 201 bp, Homo sapiens
attttgggagtccgaggtgggcagatcacttgaggtcaggagtttgagaccagcctggccaacatagtgaaaccctggctctactaaaagtacaaaattakctgggtgtggtggcgcgcacctgtaatcccagttactcaggaggctgaggcaggagaatcgcttgtacccgggaggcagaggttgcagtgaaccaagatt

SEQ ID NO: 18764 - DNA, 201 bp, Homo sapiens
agctcaggggccgggcgcggtggctcacgcctgtaatcccagcactttgggaggccagggcgggcggatcatgaggtcaggagatcaagaccatcctggcyaacatggtgaaaccccgtctctactaaaaataccaaaaaactagccaggtgtggtggcgggcacctgtagtcccagctacttgggaggctgaggcaggag

SEQ ID NO: 18765 - DNA, 201 bp, Homo sapiens
aaagacacatgatccttcgtgtccagatgaaagtgatgatgtctttgcagctgcccagcaaggctgtgtgtgtgtgtgtgtgtgtgtgtgtgtgtgtgtgkggtgtgtgtgtggtgtgtgtgtgtgtatgggggagggaggcaccctttccatctgggggtgtgtgtgtgtggggtgtgtgtgtgtgtgtgcgcgtgtgtg

SEQ ID NO: 18766 - DNA, 201 bp, Homo sapiens
aagacacatgatccttcgtgtccagatgaaagtgatgatgtctttgcagctgcccagcaaggctgtgtgtgtgtgtgtgtgtgtgtgtgtgtgtgtgtgtkgtgtgtgtgtggtgtgtgtgtgtgtatgggggagggaggcaccctttccatctgggggtgtgtgtgtgtggggtgtgtgtgtgtgtgtgcgcgtgtgtgt

SEQ ID NO: 18767 - DNA, 201 bp, Homo sapiens
atccttcgtgtccagatgaaagtgatgatgtctttgcagctgcccagcaaggctgtgtgtgtgtgtgtgtgtgtgtgtgtgtgtgtgtgtggtgtgtgtgkggtgtgtgtgtgtgtatgggggagggaggcaccctttccatctgggggtgtgtgtgtgtggggtgtgtgtgtgtgtgtgcgcgtgtgtgtggtgtgtggt

SEQ ID NO: 18768 - DNA, 201 bp, Homo sapiens
tccttcgtgtccagatgaaagtgatgatgtctttgcagctgcccagcaaggctgtgtgtgtgtgtgtgtgtgtgtgtgtgtgtgtgtgtggtgtgtgtgtkgtgtgtgtgtgtgtatgggggagggaggcaccctttccatctgggggtgtgtgtgtgtggggtgtgtgtgtgtgtgtgcgcgtgtgtgtggtgtgtggtg

SEQ ID NO: 18769 - DNA, 201 bp, Homo sapiens
gacggtgaccccagagagtgtggagacggagagtccttgagagtcactgagagacgtggctgccctgccttcccaagaggggctctgagtcattccccacmctcacctgcccctacccaccctcacctggcccccagcctcacctacccccacatctgtaccgatccctttacccgcaccttccctacccaccctcacctc

SEQ ID NO: 18770 - DNA, 201 bp, Homo sapiens
cgaccgccagcagcagatgatcgagcgtgtggagaagaccaccggggacaagcggactcgcatccagggccgtgtcgcccacctcactggcatccatgcastggaggaagtcagcctggaggagttctgtacgtgggggctggcagtggggtgggcagggtggcctctaaacccgacccctggaggaggctggaggccagt

SEQ ID NO: 18771 - DNA, 201 bp, Homo sapiens
atcacatctgcagaatcccttctgccacataaggtcatgacgccgtgctggggactggggtgggaaattacggggtcatttaggattctgcctgccactgycttgctgtgtcccagggcttgggggaggggcctccacagctgggaccacagtccttcctcccctccatggtaaccatctgaggattacttgagaccagcc

SEQ ID NO: 18772 - DNA, 201 bp, Homo sapiens
tctggggggcactatccaaccccttatacaatgaaagacgggaagagggccaggtgtggtagttcacgcctgtaatctcagcactttaggaagctgaagcrggaggatcacttgagcccaggagtttacaagtagctaggcaacatgatgagaccccatttctacaaaaagtgaaaaaaaaaaaaaaaaaaaaaaagccag

SEQ ID NO: 18773 - DNA, 201 bp, Homo sapiens
aatctcagcactttaggaagctgaagcgggaggatcacttgagcccaggagtttacaagtagctaggcaacatgatgagaccccatttctacaaaaagtgraaaaaaaaaaaaaaaaaaaaaagccaggtgtggtggctcacacctgtaatcccagcactttgggaggctgaggcaggcagatcacgaggtcaggagattg

SEQ ID NO: 18774 - DNA, 201 bp, Homo sapiens
agcgggaggatcacttgagcccaggagtttacaagtagctaggcaacatgatgagaccccatttctacaaaaagtgaaaaaaaaaaaaaaaaaaaaaaagwcaggtgtggtggctcacacctgtaatcccagcactttgggaggctgaggcaggcagatcacgaggtcaggagattgagaccatcctggctaacacggtga

SEQ ID NO: 18775 - DNA, 201 bp, Homo sapiens
gcgggaggatcacttgagcccaggagtttacaagtagctaggcaacatgatgagaccccatttctacaaaaagtgaaaaaaaaaaaaaaaaaaaaaaagcwaggtgtggtggctcacacctgtaatcccagcactttgggaggctgaggcaggcagatcacgaggtcaggagattgagaccatcctggctaacacggtgaa

SEQ ID NO: 18776 - DNA, 201 bp, Homo sapiens
ttgttattgtttttgtgtctttttgttttgttttgcttcgtttgttttgtttttgagacagtgtcttgctctgtcactcaggctggagtgcaatggcgcgwtctcagctcaccgcaacctctgcctcccgggttcaagtgatcctcttgcctcagcctcctgagtagctgggattacaggtgcacgccaccatacccagct

SEQ ID NO: 18777 - DNA, 201 bp, Homo sapiens
atttgcacaatgtctgtggctgctttcatgccaaaagcaagagaactgagtggttatgctggagacctacggccttcaaagccccagacctcacgtctggsccttgacagacagagcttccccagccctgctgcgcatcctggcccagcatgtgctgtgtgtgtgatttcagcttgcaggagccgtggttaggaattgtcc

SEQ ID NO: 18778 - DNA, 201 bp, Homo sapiens
aagcaagagaactgagtggttatgctggagacctacggccttcaaagccccagacctcacgtctggcccttgacagacagagcttccccagccctgctgcrcatcctggcccagcatgtgctgtgtgtgtgatttcagcttgcaggagccgtggttaggaattgtccctgtgttggtccattttgcattgctatgaaggag

SEQ ID NO: 18779 - DNA, 201 bp, Homo sapiens
gagggcaccaggcatctgctcccatgacccaaacactgcccaccaggccctacctccaaccttggggtcatattttattctgttctatgctatgctatgcyatgccatgccatgccatgccatgctattcctattctattatttgagacagaatctcgctctgttgcccaggctggagtgcagtggcatgatcttggctca

SEQ ID NO: 18780 - DNA, 201 bp, Homo sapiens
tatttgagacagaatctcgctctgttgcccaggctggagtgcagtggcatgatcttggctcactgcaacctccacctcccaggttcaagcgattctcctgyatcagcctcccgagtagctgggattacaggcacacaccaccacacccggctaatttttgtattttcaatagagatggggtttcaccatgttggccaggct

SEQ ID NO: 18781 - DNA, 201 bp, Homo sapiens
atttgagacagaatctcgctctgttgcccaggctggagtgcagtggcatgatcttggctcactgcaacctccacctcccaggttcaagcgattctcctgtmtcagcctcccgagtagctgggattacaggcacacaccaccacacccggctaatttttgtattttcaatagagatggggtttcaccatgttggccaggctg

SEQ ID NO: 18782 - DNA, 201 bp, Homo sapiens
cccttcccgcacgagtatgtcagcgggaccccgcacgtgcccctcaatttcatagccccgggcggttcccagcatggccccttcacaggtaaggagcctgrgatatggaatgatctggaggaggcaggagagtagtctgggcagctttggggagtggagcagggatgtgctaccccaggccctcttgcacatgtggcagac

SEQ ID NO: 18783 - DNA, 201 bp, Homo sapiens
ccctatgtctgtggggcggcttggctgagcctggaagccacctgacctcccccgtcccttccctgccaggcatcgcatgcggaaagtccatgatgagctcygtgagcctgatggggggccggggcggggtgcccctctacgaccggaaccacgtcacaggggcctcgtccagcagctcgtccagcacgaaggccacgctgt

SEQ ID NO: 18784 - DNA, 201 bp, Homo sapiens
ccgtcccttccctgccaggcatcgcatgcggaaagtccatgatgagctccgtgagcctgatggggggccggggcggggtgcccctctacgaccggaaccaygtcacaggggcctcgtccagcagctcgtccagcacgaaggccacgctgtacccgccggtgaggggcggggccggggaggggcggggcgggatggggctgt

SEQ ID NO: 18785 - DNA, 201 bp, Homo sapiens
gtccagcagctcgtccagcacgaaggccacgctgtacccgccggtgaggggcggggccggggaggggcggggcgggatggggctgtgggcccctcccaccrtcagtgctggccaccggaggcttcccgggttcctgggggctgtgccaccgcctctgaggcatgcttgctttcttcccttttcaaacccttctgcttcctt

SEQ ID NO: 18786 - DNA, 201 bp, Homo sapiens
ggggtttctccatgttggtcaggctgatcttgaactccctacctcaggtgatccgcccaccttggcctcccaaagtgctgggattacaggcgtgagccacygcacctggcctttttcttttcttttcttttcttttttctgagacagggtctcgctctgtcacccaggctggagtgcaatggtgtcatcatggctaactgc

SEQ ID NO: 18787 - DNA, 201 bp, Homo sapiens
tgatcccagctacttgggagtctgaagcatgagaattgcttgaacatgggaggcggaggttgcagtgagccgagatcgcgccattgcactccagcctgggygacagagcgagactctgtctcaaaaaaaaaaaaaaaaaagaaaagaaaagaaattatcaatctcctcttttatggcatatatatatatatatatatatat

SEQ ID NO: 18788 - DNA, 201 bp, Homo sapiens
gctacttgggagtctgaagcatgagaattgcttgaacatgggaggcggaggttgcagtgagccgagatcgcgccattgcactccagcctgggcgacagagygagactctgtctcaaaaaaaaaaaaaaaaaagaaaagaaaagaaattatcaatctcctcttttatggcatatatatatatatatatatatatatatatat

SEQ ID NO: 18789 - DNA, 201 bp, Homo sapiens
gactctgtctcaaaaaaaaaaaaaaaaaagaaaagaaaagaaattatcaatctcctcttttatggcatatatatatatatatatatatatatatatatatwttttttttttttggttatgttcagaaaggccttccctgctctgatcataaaaaacaacttattttcacactctctctcttttttttttgagacagagttt

SEQ ID NO: 18790 - DNA, 201 bp, Homo sapiens
tttttttggttatgttcagaaaggccttccctgctctgatcataaaaaacaacttattttcacactctctctcttttttttttgagacagagttttgctcytgttgcccaggctggagtgcagtggcgcaatctcagctcactgtaacctccgcctcccgggttggagtgattctcctgccttaccttcccgagtagctgg

SEQ ID NO: 18791 - DNA, 201 bp, Homo sapiens
gttttgctcctgttgcccaggctggagtgcagtggcgcaatctcagctcactgtaacctccgcctcccgggttggagtgattctcctgccttaccttcccragtagctgggattataggcatgcaccaccatgcctggctaattttgtacttttagtagagacgggggtttctccatgttggtcaggctggtctcgaactc

SEQ ID NO: 18792 - DNA, 201 bp, Homo sapiens
cagccttacagaccactgtctccagaatggtcacatccacactgggcagcccagtctcgctagttcctcgtcccacctcctgcctttgctcatgcccgtcmtgctctgggcccaccgcggacacatcttccccccgcccgccgtctgacctcacagcagctgggccccaagaggagtatcctgtcctgctgcacttttctc

SEQ ID NO: 18793 - DNA, 201 bp, Homo sapiens
ttacagaccactgtctccagaatggtcacatccacactgggcagcccagtctcgctagttcctcgtcccacctcctgcctttgctcatgcccgtcctgctytgggcccaccgcggacacatcttccccccgcccgccgtctgacctcacagcagctgggccccaagaggagtatcctgtcctgctgcacttttctcaacac

SEQ ID NO: 18794 - DNA, 201 bp, Homo sapiens
ggcagcccagtctcgctagttcctcgtcccacctcctgcctttgctcatgcccgtcctgctctgggcccaccgcggacacatcttccccccgcccgccgtytgacctcacagcagctgggccccaagaggagtatcctgtcctgctgcacttttctcaacacccggtgttggctgcaccttcccacccattgcaggcccct

SEQ ID NO: 18795 - DNA, 201 bp, Homo sapiens
attgtggggccttgtctggagctagcaaaacaaggtgaagacaaaacagcgacagtatctggggagtacaggccagcgccgctcctttttccggaaatgcmtgggtcaaggaggcaaaaggggttttggggaaactgtttgttttaaagggggggtttctaggccgaccgcgttgcctttcacctcattgcagttttgggt

SEQ ID NO: 18796 - DNA, 201 bp, Homo sapiens
ctcgtggtgtgccagagcccgtggctgctgggcgactgtgcctctttctctcagtggcaagagccttattttctaatagagcctgatgggccagaggttcygccacagggacactgttctctgtctctcgtgcttggggtctcttgctgtggaccccctgggaggttgtcctgggggtgcggggattgtgttttctgggta

SEQ ID NO: 18797 - DNA, 201 bp, Homo sapiens
tcaagtgatctgcctgcctcggcctcccaaagtgctgggattacaggcgtgagccaccatgcccagcctgcctggctgattttttaaaatttgtcgttgaratgggtgtcttgctttgctgcccaggctggccttgaactcctgggatcaagcgatcctcccacctcagcctcccaaagtgttgggattacaggcatgagc

SEQ ID NO: 18798 - DNA, 201 bp, Homo sapiens
atgggtgtcttgctttgctgcccaggctggccttgaactcctgggatcaagcgatcctcccacctcagcctcccaaagtgttgggattacaggcatgagcygctgtgcccagcctattttattattattattatttaattttattttttctcactattgcccagctcctggcctccaactcctgggctcaaaggatcttcc

SEQ ID NO: 18799 - DNA, 201 bp, Homo sapiens
cagagcgaacttgcttcccaaaaggagtctggatccgggcgtggccgtgctgccctggccgcctcctcacttcagctggagcctccgagctgacgtccatkcctattcctcctgagcactgtagacacaggccccagctctgtcccctgccctctcctccactcagactccctgggctctgaggctttacctacaggccct

SEQ ID NO: 18800 - DNA, 201 bp, Homo sapiens
actcctgacctgccatgcagggccccgtgggcttgtggtggctttggtgccgtccgctgcgtctgcctcttagagcatggagttctccttctcaggagggytgagctgctggagctctagtcctgccgcagagcagcccccaagtgcggcgttgcctgtccctgtggagcaggtgactacctggctgcgggcggaacagca

SEQ ID NO: 18801 - DNA, 201 bp, Homo sapiens
ccacagcacctaaggccagcttggtcaccaaggcatgctggaaggtcaccacaggtggcacaggtggcttggggtgtgctgggcagcaaccattatgcagyagtggcctccaagcagaagctgctgtttcggacacccgaggtattcccagcctccttcccctaccccgaggtttgctggagtcactgagggggcagtagc

SEQ ID NO: 18802 - DNA, 201 bp, Homo sapiens
cttttctgccagttctaaaatgcgttctgagctcggtcctccagtttcctccctgtgaggaagaacaatgagacctttgtaaccacacaggggaaacggcygcttccctctgcagtgggcatgggggaggggctgggacgtcccacctcctcccacctcgatggaaaccacgagtctgtgccagcccagccgactgtcggg

SEQ ID NO: 18803 - DNA, 201 bp, Homo sapiens
cctgggggagagctactcaactgtcccaaggagagggtgatgactgctggcctcccaccggccatcagcgccccactgactgacacccctgagtcagtctycaccctggaactgtttctctcactatttgccatggccttgggccgcttccgggggcttggcaaggcaggaggcgtggaaccaagatggtatgtaatcaga

SEQ ID NO: 18804 - DNA, 201 bp, Homo sapiens
agagctactcaactgtcccaaggagagggtgatgactgctggcctcccaccggccatcagcgccccactgactgacacccctgagtcagtctccaccctgraactgtttctctcactatttgccatggccttgggccgcttccgggggcttggcaaggcaggaggcgtggaaccaagatggtatgtaatcagaatgctata

SEQ ID NO: 18805 - DNA, 201 bp, Homo sapiens
gggtgcagctccaggctttctctctccccacccgcccctgaaggccccactctcccgccttctgcagccagccttccttttgtctgcccctgagctcctcygctcttgtggtcgttaagaaaagctttttataatccaagttggtttgggaagaggcaaactgtcctttcccaacagtcatatgccaaccctggccacatc

SEQ ID NO: 18806 - DNA, 201 bp, Homo sapiens
ggcagaacatgtgcttggttaaaggaaacccaagattttattattgttgtaaatgtcaagtccctcattttgaatctttagacaactgcagaattgtgtcmctgacttgggtaaaagcccaaggaaaaacatgaaattatgttgccaaaattgcggtcatcgtagctgcatgagggtttgagtggccaccgccaccccagt

SEQ ID NO: 18807 - DNA, 201 bp, Homo sapiens
cgttatagtcatgctagttttatttttttaaatgtggtttgaattttatataaagtatatggattatatctgagaactaatatgcaaggcctgtatgcaamacataatacaactttacagaaggacattggagaggactgcagtagatgttcacggataggaagacaggagatggagatggcagttgcccccagattgatc

SEQ ID NO: 18808 - DNA, 201 bp, Homo sapiens
tgcctgggccacctgcagtcagcttatccatccccaggctccaggcattacctgtccatgcattcatcccaccttttcttcttgggtggttttgtgtgtgygtgtgtgtgtgtatgtgtgtatatcctgcccaactaacctgcaggctccttgactctggagccctgatgtcttctgtttctctgtctcttccatcatgct

SEQ ID NO: 18809 - DNA, 201 bp, Homo sapiens
gggtgtgtggtttttggtgttgacatgtcgaacgttttgttgttaccgcagtcattttgttactagttaattggtgctacctttccacggagacaatagtytagttacccctgccgctggagattgttcttttttttttttttttttttttttttttttttgctattacaaataaggcctcagcaaatattgtgactcaga

SEQ ID NO: 18810 - DNA, 201 bp, Homo sapiens
gctgcgtctcctccttagtgtgctgcctctacaggcttttctcctgaactgtcctctttgcttttttttttttttttaagctttaaaagaagtttttgtaragatgcggtcttgctgtgttgcccaggctggtcttgaactcctggcctgagatgatcctctctcctcggaaagtgctgggattataggtgtgagctacgg

SEQ ID NO: 18811 - DNA, 201 bp, Homo sapiens
gaagagggggctgtagggccttggtgcgaggccctccagtgacaggatcccccatcacccagagttccacaggccctggtagggaggagggggagcagaakaggaggtgccatctttgcctgctggggaagggcaggggccacccacacagagctctcccatttgctgtggaccctggggccactgccagttccttccaaa

SEQ ID NO: 18812 - DNA, 201 bp, Homo sapiens
gtgccgcgggtgtccttgttggtgatggttccacctgcttgtgccaccagtgccctctgggtctcacacacaactctcttcccagcgaaggcccctcctgycctcaggcctcagtgctgcttccgtctcggaaggccccaggagctcctgcatcctgggcgtgattcctgtgtgcctgcagaccccctcgcggctgccatc

SEQ ID NO: 18813 - DNA, 201 bp, Homo sapiens
ctgtgtgcctgcagaccccctcgcggctgccatctcatcctttggtgcacctgttggccagacctcctggtagcgggtgctgcactcccctgaatgtgccrgggcctgggggcagggacctgggctcctccctcactgagtggagggaactcagtgtcttggagttggggtgcctgcaggctgggtggtgcaggtgaaatg

SEQ ID NO: 18814 - DNA, 201 bp, Homo sapiens
tgggcatgggcagggcagtaccaggagtgctctgggcatagtgctccatcccagggctgtgtatcttgctggcttagccagtggccctcacggtttgcttstgccccacagcctcgccgctcctgctatttgccaaccgccgggacgtacggctggtggacgccggcggagtcaagctggagtccaccatcgtggtcagcg

SEQ ID NO: 18815 - DNA, 201 bp, Homo sapiens; identical to SEQ ID NO: 2032

SEQ ID NO: 18816 - DNA, 201 bp, Homo sapiens
cagctcactgcaacctccacctcccgagttcaagtgattctcctgcctcagcctcctgagtagctgtgattacaggcgtgcactaccacacctggctaggktttgtatttttagtagacacagggtttcgccatgttggccaggctggtctcaaactcctaacctcaagtgatccaccctcctcggcctcccaaagtgttg

SEQ ID NO: 18817 - DNA, 201 bp, Homo sapiens
tgagagccaggcgtgtgtgtgtctgagcaactgagtgtgggagtgggaggatgtgagcgtgtgtgtgtgtgtgtgcgtgtgcacgcatatgcgtgcatacrtgtgagcctgtgtgtgtccgtgtgtgtgcatgcatgcgtgtgagtggatatttgtgtgtgtatgagtgtgcgcatgtgactgtgtgtgcacgtgtatgtg

SEQ ID NO: 18818 - DNA, 201 bp, Homo sapiens
gcgtgtgtgtgtgtgtgtgcgtgtgcacgcatatgcgtgcatacgtgtgagcctgtgtgtgtccgtgtgtgtgcatgcatgcgtgtgagtggatatttgtktgtgtatgagtgtgcgcatgtgactgtgtgtgcacgtgtatgtgcccgtgtgagcgagtatgtgcgcgagagtgtctgcatctgaaccagtctgtgtgta

SEQ ID NO: 18819 - DNA, 201 bp, Homo sapiens
gggcatctgcagtagtcggagaggctgaagatagcagcttgctagaagccctctcccagggccggcctgcggttgctcaccagcggctgccatggccatcrtgtcgccaggacctgcgctcctcctgtcattgcgttccctcccagcgtgggtcgctgcagctccctcacctcccaaccaggcatccactgcatttgtgag

SEQ ID NO: 18820 - DNA, 201 bp, Homo sapiens
aaccgtgtggctgtctgggggcagcgcggtccaggcagagggatcagccagtgcaaaggccctgggctggtttggggcggggcctgtttgaggggctgtarcagaatgtagggaaacagggcccaaggtgtgaggagaggacacatgaggtctcgagcagaggaggtgccagctctgactcgtgctggaaggcatcccctg

SEQ ID NO: 18821 - DNA, 201 bp, Homo sapiens
ctcgctcaggaacgataccactcaaggaagcatggccccctggatggggtggcccttggtgcacctgaggctcctgaggctgcagagcaccatggtggggraggaggcggctgtgtgtctgtcatttgcctcttctgctgaatggagacccccagagggcaaagcggggcttgttctccctgtgtcccgggatcactctca

SEQ ID NO: 18822 - DNA, 201 bp, Homo sapiens
ggacattctgggcactgtcccctttctctgctgtgaagggtggacaaaacacaataggtctgccagcccttgtgtcctgtggctcatcccagctggctggsatgggaactgagtcctccaagctggtgtggttcccctctggtctccgctgagagtcacgcccagcctctgggcacacaccctgtggtcacctccaaacag

SEQ ID NO: 18823 - DNA, 201 bp, Homo sapiens
ggccagagatcacgtaagggcgccctgaggatgtgcttgtttctcatggatgggtgatgcttgtctcttgggaacatggagaagcaaagccacgtcgcccmcagacctacccaggaacagctgcagctgcaggttcagggtccatcccagccatgggttttattcttttttttttgagacggagtgttgctgtctcccagg

SEQ ID NO: 18824 - DNA, 201 bp, Homo sapiens
tcagcttcatccaccgtgccaacctggacggctcgttccggtaggtacccacgcagtcctggggcacccctttcccctttgtccccagggcttttgaaggygttccttcttaactcaggcctacagactcttctctgaaactctggggccctgaggaatgcaggacttctcagaacttggaacagcgtcagggtctgtgtg

SEQ ID NO: 18825 - DNA, 201 bp, Homo sapiens
gtgagctgagattacatcactgcactccagcctgggcgacagaccgagactccatctcaaaaaaaaaaaaagaaattaattgggtcagcagcaatgactgwcgggggaccctcctgatggctcctccaccccgcttccctgactgcaggcagaaggtggtggagggcagcctgacgcaccccttcgccctgacgctctccg

SEQ ID NO: 18826 - DNA, 201 bp, Homo sapiens
acccgggaccgtggtgatgaggaaatgcagtgtcaggcagacccgggactgtggtgatgaggaaatgcagtgtcaggcagacccgggactgtggtggtggygaggaggtgcagtgtcaggcagacccgggaccgtggtggtgttgaggaggtgcagtgtcaggcagacccgggaccgtggcggcgaggaggtgcagtgtca

SEQ ID NO: 18827 - DNA, 201 bp, Homo sapiens
gaaatgcagtgtcaggcagacccgggactgtggtgatgaggaaatgcagtgtcaggcagacccgggactgtggtggtggtgaggaggtgcagtgtcaggcrgacccgggaccgtggtggtgttgaggaggtgcagtgtcaggcagacccgggaccgtggcggcgaggaggtgcagtgtcaggcggacccgggaccgtggcg

SEQ ID NO: 18828 - DNA, 201 bp, Homo sapiens
atgcagtgtcaggcagacccgggactgtggtggtggtgaggaggtgcagtgtcaggcagacccgggaccgtggtggtgttgaggaggtgcagtgtcaggcrgacccgggaccgtggcggcgaggaggtgcagtgtcaggcggacccgggaccgtggcggcgaggaggtgcagtgtcaggcggacccgggaccgtggcggcg

SEQ ID NO: 18829 - DNA, 201 bp, Homo sapiens
gaggaggtgcagtgtcaggcggacccgggaccgtggcggcgaggaggtgcagtgtcaggcggacccgggaccgtggcggcgaggaggtgcagtgtcaggcrgacccgggaccgtggcggcgaggaggtgcagtgtcaggcggtcccgggaccgtggcggcgaggaggtgcagtgtcaggcagaccggggacttggagcacc

SEQ ID NO: 18830 - DNA, 201 bp, Homo sapiens
gtggcggcgaggaggtgcagtgtcaggcggacccgggaccgtggcggcgaggaggtgcagtgtcaggcggacccgggaccgtggcggcgaggaggtgcagygtcaggcggtcccgggaccgtggcggcgaggaggtgcagtgtcaggcagaccggggacttggagcacctagttccacttgcgggctgaccttctattttt

SEQ ID NO: 18831 - DNA, 201 bp, Homo sapiens
gaggaggtgcagtgtcaggcggacccgggaccgtggcggcgaggaggtgcagtgtcaggcggtcccgggaccgtggcggcgaggaggtgcagtgtcaggcrgaccggggacttggagcacctagttccacttgcgggctgaccttctattttttgtcatcgtgttgggagcttaggaaagtgacttaacctctctgtgctt

SEQ ID NO: 18832 - DNA, 201 bp, Homo sapiens
ggtgcagtgtcaggcggacccgggaccgtggcggcgaggaggtgcagtgtcaggcggtcccgggaccgtggcggcgaggaggtgcagtgtcaggcagaccsgggacttggagcacctagttccacttgcgggctgaccttctattttttgtcatcgtgttgggagcttaggaaagtgacttaacctctctgtgcttcagtt

SEQ ID NO: 18833 - DNA, 201 bp, Homo sapiens
ccccctgcccccggccacagcgcccctccatccagaccccactcctgcacacggctcctccgcccgtgcgcagccctctgagagtgtggcaggtgcaccargctctgctctagggagcttcttcctcttcctgtgtcccacgggaccaacatcgggacccaggaaacaggctgggagagttcggtaacaccttcaagaggg

SEQ ID NO: 18834 - DNA, 201 bp, Homo sapiens
cgtccgtggctggccctgcttctttttttttttttttttttttttaattgagacagagtctctctctgtcacctaggctggagtgcaatggcgcgatctcygctaactgcaacctctgcctgctgagctcaagcgattatcctgcctcagcctcccgagtagcttggactataggcacccgccaccacactcggcttattt

SEQ ID NO: 18835 - DNA, 201 bp, Homo sapiens
gtcatgagcagtacaagtaaccgctgctgtccattgaacacctactgtgtgcctgggttcagaaaggcaccctgtgctggcttttaaagaattaggccgcytgcctaaaggggggagtgtggccttctttttcatttaagtcaccaactgttttatacatccacgcccctaaattcttcagttttaggcaaagatgagagg

SEQ ID NO: 18836 - DNA, 201 bp, Homo sapiens
gagggtattaactgtgatgaccttctgagttcctgcacactggtgacccattggcagggtctcctcctggctctggcaggggtggctcaggccgctgggtracggtgtgctggccagatagttcctggggctgcaggtggcttctttcgccccatccctcccatcccctttcattcttcctgtcaacacatctcagaccct

SEQ ID NO: 18837 - DNA, 201 bp, Homo sapiens
ccatccctcccatcccctttcattcttcctgtcaacacatctcagaccctggacaccgaatgagccgtcggtacccacaccccagggcaattcagtggagsggtaggtggctcgttcccccacgttgccccaggaagaggaccctgtccccggcatcctgacccacctcccttagagaccgagagcctctaaggataaacc

SEQ ID NO: 18838 - DNA, 201 bp, Homo sapiens
gcaggagaatcgcttgaacccaggagacagaggttgcagtgagccaggatcacgccactgcactccagcctggcaacagagcgagactctgtctcaaaaawaaaaataaaaataaaataaataaatacataaattgacttttaggagattggttcaaacaatgtgtgtaatgttgtgtctgagtgtttttcatttatcgtt

SEQ ID NO: 18839 - DNA, 201 bp, Homo sapiens; identical to SEQ ID NO: 2037

SEQ ID NO: 18840 - DNA, 201 bp, Homo sapiens
caggggggcccacgggctgcttgcaggggccaaccgcctgaccctggaggacgccaacatcgtgcagcctctgggcctgaccatccttggcaagcatctcyactggatcgaccgccagcagcagatgatcgagcgtgtggagaagaccaccggggacaagcggactcgcatccagggccgtgtcgcccacctcactggcat

SEQ ID NO: 18841 - DNA, 201 bp, Homo sapiens
agctgaagcgggaggatcacttgagcccaggagtttacaagtagctaggcaacatgatgagaccccatttctacaaaaagtgaaaaaaaaaaaaaaaaaaraaaagccaggtgtggtggctcacacctgtaatcccagcactttgggaggctgaggcaggcagatcacgaggtcaggagattgagaccatcctggctaaca

SEQ ID NO: 18842 - DNA, 201 bp, Homo sapiens
catttgcagacatcaatcaaatgtcatattccctagcagcttgtcctgggatcactgagctggtcacattccacagttgctaactcagggcttgcagagtrtgtgtgcacgtgtgtgtgcatgcgtgtgtttgtgagagagatacatgccttctggggagccctggtggcctgtttccttccctcccaggcccctgagctt

SEQ ID NO: 18843 - DNA, 201 bp, Homo sapiens; identical to SEQ ID NO: 2039

SEQ ID NO: 18844 - DNA, 201 bp, Homo sapiens
gatggatggcagcacccggaagatcattgtggactcggacatttactggcccaatggactgaccatcgacctggaggagcagaagctctactgggctgacrccaagctcagcttcatccaccgtgccaacctggacggctcgttccggtaggtacccacgcagtcctggggcacccctttcccctttgtccccagggcttt

SEQ ID NO: 18845 - DNA, 201 bp, Homo sapiens
atggatggcagcacccggaagatcattgtggactcggacatttactggcccaatggactgaccatcgacctggaggagcagaagctctactgggctgacgycaagctcagcttcatccaccgtgccaacctggacggctcgttccggtaggtacccacgcagtcctggggcacccctttcccctttgtccccagggctttt

SEQ ID NO: 18846 - DNA, 201 bp, Homo sapiens
gctcctccaccccgcttccctgactgcaggcagaaggtggtggagggcagcctgacgcaccccttcgccctgacgctctccggggacactctgtactggayagactggcagacccgctccatccatgcctgcaacaagcgcactggggggaagaggaaggagatcctgagtgccctctactcacccatggacatccaggtg

SEQ ID NO: 18847 - DNA, 201 bp, Homo sapiens
ggagcggtgcccatggagggctgccagtgcccagagagccttccgaggtgtcacgttgggcagtgaaattcagagtcgggcagaggaggccctggggtcayacagggatctcctccaggctatgggttggtgaggtccagtgtccgggggtgaaggatagaggctctgtggtgagggctctggagctggccctgggctagc

SEQ ID NO: 18848 - DNA, 201 bp, Homo sapiens
cacattggagcttttggcacatcctggctttcaggtgaaaggtgcgtgtgtgtttgagggtttagcctggccaacccagccatgaggtcggacctgacctrggggtgagtcctgagctcggcacccctgagctgtgtggctcacggcagcattcattgtgtggcttggccgcacccctttccctgctgggctgttgatgtt

SEQ ID NO: 18849 - DNA, 201 bp, Homo sapiens
gcacattggagcttttggcacatcctggctttcaggtgaaaggtgcgtgtgtgtttgagggtttagcctggccaacccagccatgaggtcggacctgaccygggggtgagtcctgagctcggcacccctgagctgtgtggctcacggcagcattcattgtgtggcttggccgcacccctttccctgctgggctgttgatgt

SEQ ID NO: 18850 - DNA, 201 bp, Homo sapiens
ggagtccccctgctcccccaaaagatggtgtctaaattatcatccaattggccgaggttttgttttctattaattgtttttattttttattgtggtaaatwtatataacataaaatttgccattttaattgttttgttattgttgtttttgagacagggtctcaccccagtgcccaggctggagtgcagtggtgcgatcat

SEQ ID NO: 18851 - DNA, 201 bp, Homo sapiens
gactgtcacgtggagtcctttggagagagggacgtgttaattgatggatgtggctcccatgctgagaaagctcctgggcgtacattgccttagagtttcaytggagctgcgttcttttatggtgtctgctaggcagaagtgatgaagacttggaagaaaacccagaaggttttccacttaatttggaaaatgtgcttttcc

SEQ ID NO: 18852 - DNA, 201 bp, Homo sapiens
ggttgactgtggcaggctggctcaagagtccctgctcctgaacccttgccaggcagcctggcatcagctcggggaatttttgccctgacccttggaagcargtgggcctctttgttctcatgtcagtgatgagaagagtgactttcctatggcccctctggagtacaggtgtttcctgttggcgggctcttcccccatgac

SEQ ID NO: 18853 - DNA, 201 bp, Homo sapiens
accgcacactctgttctgctagagtagttagctgtcctgggtgatatggcaggtgacaggggcaactgtgcttaacaaaggaacccccatcccccctgccmagttgggagactagaaggtcaggggcagaagctctgaagggccaggtgcagtggctgacacctctaatcccagcactttgtgaggccaaggcgggcagat

SEQ ID NO: 18854 - DNA, 201 bp, Homo sapiens
gagttcaggatcccccagagataccagggccagcactcgatccccacccagccctgaaccccaccatgtgctgggattgtgctgggagtgtccacacgccygggaccccagggctggtgctctcatctcctttttccagatcatgagaatgaggctcagggaagtttgaaaaaaacctatcccaagtcacacagcaacagg

SEQ ID NO: 18855 - DNA, 201 bp, Homo sapiens
acactgtttctagcaccttccaggcagaatctcatgtatccttcactttcgaaatgggtactatttcatccccacttttatcaatgagaaactaaagctcraagaggtcaagtaagttcctggccaaggtcagctagcaggctctagaggcctcgttctccttagaggcagccttgccagggcccaggcttggcaggctgc

SEQ ID NO: 18856 - DNA, 201 bp, Homo sapiens
accacactaggctgcctccccagacaagctcagcgggcactgcatgttgggttcagaaatcagcagaactccacgttctgagctgctcttcaagttgctcytatgggggttacttttaagctgggaaatggctgtggcgtcgaggggccgggggcttgggctccagagtctgactgtgtgtttgagtccggctgtggaaac

SEQ ID NO: 18857 - DNA, 201 bp, Homo sapiens
tgccgtgtccccaacatccggccaagcttaggtggatgttccagcacacactcaccctgtctgtgcacctgtttttgtgtccgtaagtgggtatttactcrccttacgagtgagccactgtgggaattcagggaggtggcgcagtgaccacccctggagggatatgtgtgtggcaggggtcgagggtctcgcccttccctg

SEQ ID NO: 18858 - DNA, 201 bp, Homo sapiens
gtgcgtccttgtgttcacctcgtatgagacagtgcgggggtgccaactgggcaaggtggcaggctgtccgtgtggccctcagtgattagagctgtactgaygtcattagccttgatggtggccaggactggtagggccctcagaggtcatggagttccttcgtggagcgggtgctgaggctgtatcaggcacagtgctggc

SEQ ID NO: 18859 - DNA, 201 bp, Homo sapiens
ggtaagtgtttgcctgtcccgtgcgtccttgtgttcacctcgtatgagacagtgcgggggtgccaactgggcaaggtggcaggctgtccgtgtggccctcrgtgattagagctgtactgatgtcattagccttgatggtggccaggactggtagggccctcagaggtcatggagttccttcgtggagcgggtgctgaggct

SEQ ID NO: 18860 - DNA, 201 bp, Homo sapiens
tgtggaggtgaggcctcactaaatttcctgggctagtcttgaactcctgagctaaagtgatcctcctgcctcagcctcccaaagtggtaggattacaggcrtgagccactgcgcctgggctgacatatgtgttttcgtaagcccgaaagatagcatctgaagagtcaacattgagccttgccttttgctgctaacgatgta

SEQ ID NO: 18861 - DNA, 201 bp, Homo sapiens
tttgtggaggtgaggcctcactaaatttcctgggctagtcttgaactcctgagctaaagtgatcctcctgcctcagcctcccaaagtggtaggattacagrcatgagccactgcgcctgggctgacatatgtgttttcgtaagcccgaaagatagcatctgaagagtcaacattgagccttgccttttgctgctaacgatg

SEQ ID NO: 18862 - DNA, 201 bp, Homo sapiens
tattttgcatcctttaaatatatgttcatggtacaaaattcaaaagatacagaagagtctgcagtccaaagagactccgcccccatgacgccaagcaggcmtccctgggaggcatggcctcctgcagtgtgtttcttctatgtccccccaggggtcatctgtacatatgcaagcatacaagagcgtggactttgttttcca

SEQ ID NO: 18863 - DNA, 201 bp, Homo sapiens
ttattttgcatcctttaaatatatgttcatggtacaaaattcaaaagatacagaagagtctgcagtccaaagagactccgcccccatgacgccaagcaggmatccctgggaggcatggcctcctgcagtgtgtttcttctatgtccccccaggggtcatctgtacatatgcaagcatacaagagcgtggactttgttttcc

SEQ ID NO: 18864 - DNA, 201 bp, Homo sapiens
cctagcctcccagctcccccactttctccccaccctccaccagtggcaaagccagccccttcagggcgcacggtgtctgcccccaaggagggcccattccrttggggttaatgttggccacctctttctgtttgtctctggcagaaatcaccaagccgccctcagacgacagcccggcccacagcagtgccatcgggcccg

SEQ ID NO: 18865 - DNA, 201 bp, Homo sapiens
actcaggcggctgggaggctccttgcgggaggcagggaagcctttcccagggcagcggccaggaggacagactgtgagctgtgggctcggcggctacagartctgcctcagtgggcggggctgatggtgtccaggtgcctgcagcacgcacccacccacgggaccttgctgagcagcgtctgtcaggcagcaagattaccc

SEQ ID NO: 18866 - DNA, 201 bp, Homo sapiens
cagacgttggagccatctgagccccctcgtcccgctctagcttctcctcccgtgtgccccgcggtgctggtggcaggcccttacgccggttctggctgcaygctctgttccagaagctttcttccctgcttggttaccagaaaatcatcccatccattacaaggacagggtccccttatctcccattcccagggcaggaca

SEQ ID NO: 18867 - DNA, 201 bp, Homo sapiens
ctgatttgcttctaaagggccctgtgattcggctcagccacctttagattaggttagcctcccctttgatagactccaagtcggctgattaataaccttamtcacatctgcagaatcccttctgccacataaggtcatgacgccgtgctggggactggggtgggaaattacggggtcatttaggattctgcctgccactgc

SEQ ID NO: 18868 - DNA, 201 bp, Homo sapiens
ttggtcggggaccactctcagctcctagaggccaccacaggtccttgccccgtggccctctctgcctcagcagtgggggctccctgcgtcagtccctcccrcaccttgagtctctctgatttgcttctaaagggccctgtgattcggctcagccacctttagattaggttagcctcccctttgatagactccaagtcggct

SEQ ID NO: 18869 - DNA, 201 bp, Homo sapiens
tagcttccttgctcactcagcaggtagcagttgtgggatcgaggttctgttttctctctggttattggtcggggaccactctcagctcctagaggccaccmcaggtccttgccccgtggccctctctgcctcagcagtgggggctccctgcgtcagtccctcccacaccttgagtctctctgatttgcttctaaagggccc

SEQ ID NO: 18870 - DNA, 201 bp, Homo sapiens
tcaccacagaggcctggcccttcttctgtagcagtcccacacccgcaacaggtgtggctgctgaccacctgctttctgcccctctggtcctgaggagggcrcagtgggcactcaggcgtggctgagcagatgtgtgttgccgggaggaggaaggactgctccagtcagggctgaatttcccacccggagcatttctgctgt

SEQ ID NO: 18871 - DNA, 201 bp, Homo sapiens
gtctttgatcaggccccctcccctatgccacacagtccctgtcactcgggtgagcccagtagtcatggggaaggcctgcgggttccaaacatccaaaggcytgcgtgcagcatgacagcttgaaaccgatgttttttaccttgatcagatttcagcttggcgggggctttgctcagctttcagtgaggcctgggccgattt

SEQ ID NO: 18872 - DNA, 201 bp, Homo sapiens
ctgtccccctcctgagcttcccagcagcttttctccaagttacagcccaaaagctcaggtggatttgcaacccaacggtgtctgtgcacctcccactgatrcccgaactgccctggccaagaaacggggccgtcagaacgctgcactaactgcagccttgggcctccatgccagaggccatgcccttccatccaccacccc

SEQ ID NO: 18873 - DNA, 201 bp, Homo sapiens
tgcaggaccgggcagccaagatcgaacgcgcagccctggacggcaccgagcgcgaggtcctcttcaccaccggcctcatccgccctgtggccctggtggtrgacaacacactgggcaagctgttctgggtggacgcggacctgaagcgcattgagagctgtgacctgtcaggtacgcgccccggggcctgccctaaccgca

SEQ ID NO: 18874 - DNA, 201 bp, Homo sapiens
gcattgttcaactagtatagaatgtgacctgtcagcctcgggcagccctgagaggcaggggctttccacagcccagctgggtgccctgggctccgtgctgkccgaggagacgccatccccacacccgtccttcacccgccaccctcccgcaggtacctgtacttcaccaacatgcaggaccgggcagccaagatcgaacgc

SEQ ID NO: 18875 - DNA, 201 bp, Homo sapiens
attgtggtcgtatcttgatccttcatgacatttgtaaagaccctgcttccaaataagctcacattctgaggttctggggtgagcgggaatttggagagcaytgttcaactagtatagaatgtgacctgtcagcctcgggcagccctgagaggcaggggctttccacagcccagctgggtgccctgggctccgtgctgtccg

SEQ ID NO: 18876 - DNA, 201 bp, Homo sapiens
tctggctgcacatggcgtggcctcttctgtaccattgaaggacacttcagttggatttagggcctaccctcacccattgtggtcgtatcttgatccttcakgacatttgtaaagaccctgcttccaaataagctcacattctgaggttctggggtgagcgggaatttggagagcattgttcaactagtatagaatgtgacc

SEQ ID NO: 18877 - DNA, 201 bp, Homo sapiens
tgggcagggccctgcgccctctgaaggctctgagggaacctttgggcttctggtggctccaggcaccccttgacttgtggtcctgtcactccagtctctcygtctggctgcacatggcgtggcctcttctgtaccattgaaggacacttcagttggatttagggcctaccctcacccattgtggtcgtatcttgatccttc

SEQ ID NO: 18878 - DNA, 201 bp, Homo sapiens
gagactcagtttcctcattggtaggagtgacggccacagtggtgcggcctctgcagcacacggggggctcggtgggcggaagccccgggtctataaggcgrctgtgcaggagccagccgagctggtctcccaacagccagggctccggggtccttagcagctgtggggggcctgcacctgtttcccatggctgctgtcaga

SEQ ID NO: 18879 - DNA, 201 bp, Homo sapiens
caggagcccaggtgctccaggccccatttgccccaggccaaatcactcgggaacttggatgcagctgtctttcagggtaacccaaaggaaccagatccccscaggcagtaggcttctgggctgtcctctcctcctacgtcagctcagtaagagcccttcgaagggatgctgtgtcggaggccccaaaagcccaggctcatc

SEQ ID NO: 18880 - DNA, 201 bp, Homo sapiens
cctggcccatccagacctatatttctgccgtcctgcaggtgatcaatgttgatgggacgaagaggcggaccctcctggaggacaagctcccgcacattttygggttcacgctgctgggggacttcatctactggactgactggcagcgccgcagcatcgagcgggtgcacaaggtcaaggccagccgggacgtcatcattg

SEQ ID NO: 18881 - DNA, 201 bp, Homo sapiens
gagttcatccggccctgacccagcgggaaatgagttcacagagaagcgggagaactttgccccaggccctgccgttgctcataactgccccaggtccttamatttgctccaggtcctgccccaggccctgcagttgctcataactgccccaggtccttatatttgctccaggtcctgccccaggtcctgcagttgctctgt

SEQ ID NO: 18882 - DNA, 201 bp, Homo sapiens
tggaaatgtaatctggtagcaggaggcctgtggaagcttgcctttaatggccttgtgtctctttcatcctgtcctgagagccggagaacttggatgttgcrcctaactcaaccttcctgttaacatacagttctgcaggctcatggatcatcagaaccacgtcctatctcacgcggctgtatgcttccgttggttcaggtg

SEQ ID NO: 18883 - DNA, 201 bp, Homo sapiens
ctgttcattgcacaccggagcatccaggcatgggtggagagctcagacttccaggcacggtcgcaggggctggtctaaccatgttcccgcccgcctgctcrtcagaaccgcctgttgggagctgttatcatgataccatacctgggccctgggctatccgattctgacttaattgctccaggttggggccaggccgttgtt

SEQ ID NO: 18884 - DNA, 201 bp, Homo sapiens
aaaggttgcagtgagccaagatcacgccattgcactctagtctgggcaacaagagtgaaactccgtctcaaaaaaaataaataaataaaaaataaaaatartgacctctggccaggtgtggcagctcatacccgtaatcccagcactttggaaggaaggccgagatgggcagattgctttagcacaggagtttgagaccag

SEQ ID NO: 18885 - DNA, 201 bp, Homo sapiens
gtattagagcaactgagagctgctcattgcaagcctgatgttttcccagttggccgggtccaccgggtgccctgggattctgggatctgggtggaaagtarggggcttgggggagtgtcctgggttctggaatccaggtggcaagtggtgaggttcagggagtggcttctgagccaccataggggtctctgtgggaggctc

SEQ ID NO: 18886 - DNA, 201 bp, Homo sapiens
ctgacgcccagaggcttggctcggctcaggcattcttggaaatatctggctccaggaaaggcagaggcctcctgagtcggcccagagggaacctgccccargtctgggggaggcctgacccagcagagtggcttttgccgatgggttgggccggtcaagatgtgctgaaagttgtcctcagaaggccactttgggattcct

SEQ ID NO: 18887 - DNA, 201 bp, Homo sapiens
gagccaggacaggcacgttctctgcatcttgtcccctgacgcccagaggcttggctcggctcaggcattcttggaaatatctggctccaggaaaggcagargcctcctgagtcggcccagagggaacctgccccaggtctgggggaggcctgacccagcagagtggcttttgccgatgggttgggccggtcaagatgtgct

SEQ ID NO: 18888 - DNA, 201 bp, Homo sapiens
tatttctgaactctgttttggctctgttccctcccaggagccaggacaggcacgttctctgcatcttgtcccctgacgcccagaggcttggctcggctcargcattcttggaaatatctggctccaggaaaggcagaggcctcctgagtcggcccagagggaacctgccccaggtctgggggaggcctgacccagcagagt

SEQ ID NO: 18889 - DNA, 201 bp, Homo sapiens
cctgggtgacagagcaagaacctatctcttaaaaatatatatttaaaaagtattgggtgtggtggctcacgcctgtggtcccagctacttaggcatctgargtgggaggatggcttgagcccaggagtttgaggttgcagcgagccaagatcgtgtcactacactctagcctgggtgacagagcccagaccctgcctcttt

SEQ ID NO: 18890 - DNA, 201 bp, Homo sapiens
gcattccagcctgggtgacagagcaagaacctatctcttaaaaatatatatttaaaaagtattgggtgtggtggctcacgcctgtggtcccagctacttargcatctgaggtgggaggatggcttgagcccaggagtttgaggttgcagcgagccaagatcgtgtcactacactctagcctgggtgacagagcccagaccc

SEQ ID NO: 18891 - DNA, 201 bp, Homo sapiens
tcacaccatgctcaagctgagtgggttttacattttttaattacttgaaaaaaaaaaagccaaaggaggtttcatgacccatgaaaattatatggaattcmaaaaaaaaaaattatatggaattcaaatttcagtgtccataaataatttcttgagacagggtctcgctctgtcacccaggctggagtgcagtgctatggc

SEQ ID NO: 18892 - DNA, 201 bp, Homo sapiens
tgtctgatttaaaaaaatatacagatgaggtcttgccatgttgcccaggctagtctcaaacttctggcctcaagtgaacctcccaccttggcctcccaaastgttgggattacaggcatgagccaccgcactcagcccataaccttgtcttatgtgtgtttctaagacaccttatttaggctgagtgcagtagctcacgcc

SEQ ID NO: 18893 - DNA, 201 bp, Homo sapiens
tttgagctgtttccatgttttggctttgtgaacactgctgttaacatgcgtgtacctgtatgtgtacatacatgagtagaggggttcagttcttttgggtmtatatgtaggagtggaattactggtcataggatcattctatgtgtaactttttgaggcactaccaggctgttttccacagcagccagaggtgtctttaaa

SEQ ID NO: 18894 - DNA, 201 bp, Homo sapiens
tgtgactcagacgttttccttctttctggtgtttcttgggacagactcctgcaggggtgatccctggggagagggcgtaattattttatgttcatgatgcrgcagtcaccaccgtgtttctgaaaggtttgttctgcactctgggctgccagttgacattcggtttttcatggtgatctggtgggtcctggggtgtgatgg

SEQ ID NO: 18895 - DNA, 201 bp, Homo sapiens
gcaggaccttgaccagccgagggccatcgccttggaccccgctcacgggtaaaccctgctgcgactccacctgggtccagggggcggggagtgtcaccatytctctctcgaatttgcatgagcccaagttgtttttcagaaaaagggtgtgactctgaaaatgaacccgtgggggggttggctcaggcctgtaaccccagc

SEQ ID NO: 18896 - DNA, 201 bp, Homo sapiens
atcgaggctgcagtgagctgtgatcccaccactgcactccagcctgggcgacaaagtgaggagatcctgtctcaaaaaaaaaaaagagctcagctttcaaratttgttattgttgaaggaattacttccccttgagattccatagttatgttccttttttttttttttttttttaattgagatggagtctcccttgttgcc

SEQ ID NO: 18897 - DNA, 201 bp, Homo sapiens
cccctgaccccattgcacctgtctccacaggagccgaggaggtgctgctgctggcccggcggacggacctacggaggatctcgctggacacgccggacttyaccgacatcgtgctgcaggtggacgacatccggcacgccattgccatcgactacgacccgctagagggctatgtctactggacagatgacgaggtgcggg

SEQ ID NO: 18898 - DNA, 201 bp, Homo sapiens
ctgacattggcatctaccaacaccaacatttaccgacaccaacatttaccaacactgaaatttaccgacaccgacatttaccgacaccgtttaccaacacygacgtttaccgacaccgacatttaccgacactgatatttaccaacactgacatctactgacgctggcatctactgacaccgatgccagcatctaccaaca

SEQ ID NO: 18899 - DNA, 201 bp, Homo sapiens
catttaccgacaccaacatttaccaacactgaaatttaccgacaccgacatttaccgacaccgtttaccaacaccgacgtttaccgacaccgacatttacygacactgatatttaccaacactgacatctactgacgctggcatctactgacaccgatgccagcatctaccaacaccgacatttaccaacactgacattta

SEQ ID NO: 18900 - DNA, 201 bp, Homo sapiens
gaggcttgcaaaggttaaggggctgttcgaggcccaggctggcaggagatgggcctgggccagagtctgggacttcccatgcctgggctgtctttggtccygttgctcaccatccctccctggggccatgaccttagagagccaaatggaggtgcaggtaacccacggcaaggaggggttgccatgactcagagtccccgt

SEQ ID NO: 18901 - DNA, 201 bp, Homo sapiens
ggcatagcctcttggagactcagtttcctcattggtaggagtgacggccacagtggtgcggcctctgcagcacacggggggctcggtgggcggaagccccrggtctataaggcggctgtgcaggagccagccgagctggtctcccaacagccagggctccggggtccttagcagctgtggggggcctgcacctgtttccca

SEQ ID NO: 18902 - DNA, 201 bp, Homo sapiens
tccaactctaatggtggatttgtttatttctcctagtagttctatctttttctctccttctacccttgatcctcttctccccctagggcttcctggtgttrgtggtgggagagtggggtagtgaagaacctggactttagggccaaagaggccagggttcaaatcctggctctgtcacttcccagttgagtgaccctggct

SEQ ID NO: 18903 - DNA, 201 bp, Homo sapiens
agttctatctttttctctccttctacccttgatcctcttctccccctagggcttcctggtgttagtggtgggagagtggggtagtgaagaacctggacttyagggccaaagaggccagggttcaaatcctggctctgtcacttcccagttgagtgaccctggctggtgcctgaatctctgtgagcctccacttcctcctct

SEQ ID NO: 18904 - DNA, 201 bp, Homo sapiens
ttttctctccttctacccttgatcctcttctccccctagggcttcctggtgttagtggtgggagagtggggtagtgaagaacctggactttagggccaaaraggccagggttcaaatcctggctctgtcacttcccagttgagtgaccctggctggtgcctgaatctctgtgagcctccacttcctcctctgtgaaattga

SEQ ID NO: 18905 - DNA, 201 bp, Homo sapiens
cagcctgccacctacttttgtaaataaagttttcttggtgcacagccatgcccattcattcatttgcacaatgtctgtggctgctttcatgccaaaagcargagaactgagtggttatgctggagacctacggccttcaaagccccagacctcacgtctggcccttgacagacagagcttccccagccctgctgcgcatcc

SEQ ID NO: 18906 - DNA, 200 bp, Homo sapiens
gtggagtggcccaaggagcccacccagccgaccctgcccctcccgtggctggtgggcggcaccaggggctgcctggctttgctcgttcaccaacatcaccgggctggccagggcgcgctcacttctgccaccaccgagggccctgggcgaaggagtgaataccaggctgccttggcagggatgtgttgagggctgtgggg

SEQ ID NO: 18907 - DNA, 201 bp, Homo sapiens
acgagtatgtcagcgggaccccgcacgtgcccctcaatttcatagccccgggcggttcccagcatggccccttcacaggtaaggagcctgagatatggaaygatctggaggaggcaggagagtagtctgggcagctttggggagtggagcagggatgtgctaccccaggccctcttgcacatgtggcagacattgctaatc

SEQ ID NO: 18908 - DNA, 201 bp, Homo sapiens
acgtgcccctcaatttcatagccccgggcggttcccagcatggccccttcacaggtaaggagcctgagatatggaatgatctggaggaggcaggagagtastctgggcagctttggggagtggagcagggatgtgctaccccaggccctcttgcacatgtggcagacattgctaatcgatcacagcattcagcctttccca

SEQ ID NO: 18909 - DNA, 201 bp, Homo sapiens
agagaacgcggccctgtctgttcctggcgtgctctgtgctgccccgcctgggttccctgccccagtcgcaggccccttggaggaggtaccatgtgtctccygtttcacagatgagccccggggagctcactctagtagtggccagagaggcctgcggctcagggagcggggcacatttccaacaggacacaccgccctggt

SEQ ID NO: 18910 - DNA, 201 bp, Homo sapiens
tttttttgagacggagtttcacttttgttgcccaggcttcagtgcaatggtgtgatctctaggctcaccgcaacctctgcctcccaggttcaagcagttcycctgcctcagcctccctagtagctgggattacaggcatgtgccaccacgcccagctaattttgtatttttagtagagatggggtttctccatgttggtca

SEQ ID NO: 18911 - DNA, 201 bp, Homo sapiens
cttggctctcctcagatcctgaacccgccgccctccccggccacggacccctccctgtacaacatggacatgttctactcttcaaacattccggccactgygagaccgtacaggtaggacatcccctgcagccctccatggccattgggttcccgccagcccgtggtggaggggcctaatccccatgccactgatgagggg

SEQ ID NO: 18912 - DNA, 201 bp, Homo sapiens
gcgcggccactgcaatgagatacagacgttcgcccaattaaaacacagttagtggaggacacatggctttcagggaaaactgctttctctcaggaagatckctgctgtgcagtattccatagctagaccccagctccactcaacagtggactccattaatagcctgggttttggaagaggcgatttgcttctggtaactgg

SEQ ID NO: 18913 - DNA, 201 bp, Homo sapiens
ggatagtaacacaagccaggctttgcactttggagaaggtgcttacaaacttggacgagacagtacccagacacatagctgaaactgtaggtactgccacrcacacatgcacagaaatagagaaatagtcatagatgcatgtgtgtataaaagtgtatgtaggctaggcacggcagctcatgcctgtaattccagcacttt

SEQ ID NO: 18914 - DNA, 201 bp, Homo sapiens
acatgccttagcgaccaacccacatttaaaacaaattcctgaatgagggctgtaactgtagtcccaagtcattcttttttgtagctcataatagcccatamtattactataccatatgtttgcatttacctatttttattttattttatttttttgagacagagttttgcttttgtcacccaggctggagtgcaatggtac

SEQ ID NO: 18915 - DNA, 201 bp, Homo sapiens
gctgagattacagtcgtgagccaccgtgcccggcctgcatttacctgtttttaattgtggtaaaatacatataacacttatcgtcgtaaccatttgtaagygtgaagttcagtggcattaagaacattcatgttgctggtaaccactgccaccatccatctcccaccacaatttaataaatcattgaaaacagactttctt

SEQ ID NO: 18916 - DNA, 201 bp, Homo sapiens
agcctgcccagtgtgcatggtgccttttaaacaaattatctgcattcccattgggatgaagttcacttgacaacattactcattggtttttttgcttttgkttagtttttttttttttttttttttttttgagacagaatctcactctgtcacccaggctggagtataatggtgcaatgtcggctcactgcaacctccgct

SEQ ID NO: 18917 - DNA, 201 bp, Homo sapiens
gtcaggtggtgaatagactacgtttcatttatccgttcatcggttatggacatttgagctgtttccatgttttggctttgtgaacactgctgttaacatgsgtgtacctgtatgtgtacatacatgagtagaggggttcagttcttttgggtatatatgtaggagtggaattactggtcataggatcattctatgtgtaac

SEQ ID NO: 18918 - DNA, 201 bp, Homo sapiens
aaaataaaaggaatgatcacttcctgtttcatgaatgaggaaactgaggctctgggagatgggaaatcctgcccggaatctcacagctggaggccaggccrggctttgaatccaggcaactgagtctgagtggatggtgtgtgctttgtgttggagctggcccagggctggatgaaggcaacatttaattaatgaaaacca

SEQ ID NO: 18919 - DNA, 201 bp, Homo sapiens
cgggtgtccttgttggtgatggttccacctgcttgtgccaccagtgccctctgggtctcacacacaactctcttcccagcgaaggcccctcctgccctcargcctcagtgctgcttccgtctcggaaggccccaggagctcctgcatcctgggcgtgattcctgtgtgcctgcagaccccctcgcggctgccatctcatcc

SEQ ID NO: 18920 - DNA, 201 bp, Homo sapiens
ctgggtaggggtggagcctgggtggccctgcctgtgagctgcatagttgtcgcctttgaccctgagttttcttcgttatctgtttggacctgtttggggcrggcaggggatgagatctgaagataaatgccttagctgtgaccatctccttttgtgagaggtcaatgtccagttccgctgcagttataacatcccattttt

SEQ ID NO: 18921 - DNA, 201 bp, Homo sapiens
cctgtttggggcaggcaggggatgagatctgaagataaatgccttagctgtgaccatctccttttgtgagaggtcaatgtccagttccgctgcagttatamcatcccattttttgatttctttttattttttcctttttctttttgagatggagtctcgctctgtcacccaggctggagtgcaatggggtgacctcagctc

SEQ ID NO: 18922 - DNA, 201 bp, Homo sapiens
caaaatctttagcttcccatgaagtcccgtttgtctttatttgtggcctatgccttcctgttgtttgactttcacagtgtccctcgttgccacaaagaacygtagacctaagatgatgacagcacgggtggggcggcggaggcgccgctgtcattttcctggcctcaggtcctctgtgtgtcctcccatcctgtggagcat

SEQ ID NO: 18923 - DNA, 201 bp, Homo sapiens
gaggctctgtctggcctgggctctgaacccctcaaaaaatgtggccctgtggctgggtctgtagcgagcagcatggccagtgctgtgcctgcatgtccccrtcccctgtgtcaggccaacaaaggggatgtggcttctctgcagaacaggacagggcccctgtagcctctggaggacgatgtgggaggttttgggcatggc

SEQ ID NO: 18924 - DNA, 201 bp, Homo sapiens
tttgttaggaggtgcttggcgcttggttgggagttgttggtgtccagttgagaggtgctaggtgcttggttgggaggtatttgattgggaggtgcttggcrcttggttgggaggtgctctgcacttggttgggaggtgctcggtgctaggttgggaggtgatcagttgggaggtgctagatgctctgttgggaggtgcatg

SEQ ID NO: 18925 - DNA, 201 bp, Homo sapiens
tgggaggtgcttggcacttggttgggaggtgctctgcacttggttgggaggtgctcggtgctaggttgggaggtgatcagttgggaggtgctagatgctcwgttgggaggtgcatgatgctcagttgggaggtgctaggcgcttggttgggaggtaattggtacttggttgggaggtgcttggcacttggttgggaggtac

SEQ ID NO: 18926 - DNA, 201 bp, Homo sapiens
ccagagcagccgctcagcgcctgtaacctggaacaggccagcctttcggggcctcagttttctcatctgcctaatgggaatagcaattcccaccttccctktgttggttgggttctcactagatgcacaggagacagcagcttgagagggactgtttggagagctgttccatgtgacacccctcttaccctgtccccacgg

SEQ ID NO: 18927 - DNA, 201 bp, Homo sapiens
ggtgaatggatgcacagattgggttctgtctgcacactggaatatggttcacccctaaaacgggatgaagcactgacatgctacagcctggatgaacctcraaaacatggtgccaagtcaaagaagacagacatcagaggctgtatattgtgattccgtttatatgagatgttgagaatgtgtgtagttaagtccatcaaa

SEQ ID NO: 18928 - DNA, 201 bp, Homo sapiens
acatccaggtgctgagccaggagcggcagcctttctgtgagtgccggctggggcgcgggggcgagggtgcgggggctggggggagcgggggcgcggggcakgggagtgggaggatgcgggggcgtgggggtgcgcgggcgtgggtggggtgggggggcaggtgacccctccctgcagaagcccatgctctggggggccccc

SEQ ID NO: 18929 - DNA, 201 bp, Homo sapiens
ggcgtgggtggggtgggggggcaggtgacccctccctgcagaagcccatgctctggggggccccctctctaaaggggtacctgctgcaatggagggaggtrtgtggctggctgggggacacgggcctgcagaggacccctctgcagagctcatgggggctatttcaggctcagcagtggcaaggggatttccaaggaaggt

SEQ ID NO: 18930 - DNA, 201 bp, Homo sapiens
gaggaggtgcagtgtcaggcggacccgggaccgtggcggcgaggaggtgcagtgtcaggcggacccgggaccgtggcggcgaggaggtgcagtgtcaggcrgacccgggaccgtggcggcgaggaggtgcagtgtcaggcggacccgggaccgtggcggcgaggaggtgcagtgtcaggcggtcccgggaccgtggcggcg

SEQ ID NO: 18931 - DNA, 201 bp, Homo sapiens
ttggtagaaagggggtgattatactccccgctccatggggtttggaggaaggctgtgtgggttgtgctgagcagcgtgatggtgcaggctgtctgggtcaktgccgagggagcgagtcttccttcggcggttgtaatcagaagtagcttccaaggctgggtgctgccaggaggagctggggtgggtgaaggggcagtgggg

SEQ ID NO: 18932 - DNA, 201 bp, Homo sapiens
cgtgatggtgcaggctgtctgggtcagtgccgagggagcgagtcttccttcggcggttgtaatcagaagtagcttccaaggctgggtgctgccaggaggakctggggtgggtgaaggggcagtggggagcacggctcacacggccagcgggtgacctggggaggacggaggggggtgtgctgggcgcttcaggcgtgtggc

SEQ ID NO: 18933 - DNA, 201 bp, Homo sapiens
aggaggagctggggtgggtgaaggggcagtggggagcacggctcacacggccagcgggtgacctggggaggacggaggggggtgtgctgggcgcttcaggygtgtggctccctttcctgtggggcgaaggtcaggaggggggcagggcctggctgtgtcagaatcactcagactcttaagacacatccagagtccccagcc

SEQ ID NO: 18934 - DNA, 201 bp, Homo sapiens
ttgaattctgctttttcctgattttgagcaaatgaaagccagctgggtgtagggagtcaggtgccttccccaaggaaggggctgagagggtggtcacaccrggaccccaagggacagggagcagcgttcccaggggcacacaggcggcctcctagaggtagggatgcgttggtggcggggggggccccgcactgctgtgtg

SEQ ID NO: 18935 - DNA, 201 bp, Homo sapiens
tgctctctgcagctcagagtcactctcatccccagcagtcgagtgcagagcctgggcctccggcctccccaccccctccacacagccccaggaccaaggcrgcagctggcttcggtttctgccatgtttttccaattatgtggaatgagctaaaaacagcaggagtgaggccttatttgggagttgccaccgccatcctcg

SEQ ID NO: 18936 - DNA, 201 bp, Homo sapiens
tgcccctgttcttttgacttttgtctcctgcacatccctcctgcttgggggcctttgggcagtgggcttagcggcgtgcaccatgccactcgggccacacrtgccctggccggtggctctcagagctatgtccagagggtggccaggcagtgctcccggcagcgcccagatgaggctggggtgcggcttggggatttgtgg

SEQ ID NO: 18937 - DNA, 201 bp, Homo sapiens
atgactccttgtttcgtttcactgaccgtgccctgtgcctctgctctccctccccagttccgtgtgccctggggtcagtgatagaagacacggcccctggrccccaagtctgctgagctgacacctcgggctgccgctcacctgcagagagacactagaaggctccgactcccttcctggcccccactctgtttttctacc

SEQ ID NO: 18938 - DNA, 201 bp, Homo sapiens
gggtttgagagctgaggttctttggtcttcagtggagctggcagtgactttcttgactttgtcaagagaagccccccgtctctgtgccacctctggggatstgattgaacggaaatcagagcatccgagttccagcctcagccctctgctgtgtggctgtgaaatgtaggccctgtgtgccttgctgacctgggagggtcg

SEQ ID NO: 18939 - DNA, 201 bp, Homo sapiens
tcctggaggatagggctgggctcggagctgcacgcagtggggcgtgtcctgcatgcagtggggcctcagaagagagctgtggtgggcggggcagtgccaaygctggtgggtgccaggcctccacgctcagatcagccccggcgacaggtttgggccaccctctctctggcctctgtgcagtggcccaggccgtctgctctg

SEQ ID NO: 18940 - DNA, 201 bp, Homo sapiens
cccggctgggtacgttgaattgtgtccctcaaggagatatgctaaaggtctaaccccaggaacctgtgtatgtgatctaatttggaaacagggtcttggcwgatgtaatcaagcgaggatgaggtcaccctagagtagggggcctatatccacggtgctggtgtcctcatgagagcaggtgagcagacactgacactcagg

SEQ ID NO: 18941 - DNA, 201 bp, Homo sapiens
gggttggatcctgcctctctcccaggtgtctcagtctctgcaaaactcaaaaacctcagaggccttgcagcctgaggggtgtcagagacacctccttcgartcagtaaacacctacagattcaccccagcagtgaaaggactgcttcgccacagaggtttgatttactcctaagtaattggaagggatgccgagaataggt

SEQ ID NO: 18942 - DNA, 201 bp, Homo sapiens
tgcttcgccacagaggtttgatttactcctaagtaattggaagggatgccgagaataggttcctcatggtgggactagaggccctctgctgacctagttamcagagggctagggctgggtgtgctcagcccctgaaggttctaggcccatttgggacaccccgccagaacctgccacaacctgccatgtggtgacagctac

SEQ ID NO: 18943 - DNA, 201 bp, Homo sapiens
ccgacatttaccaacactgacatttaccaacactgacatttaccgacattgacatttactgacactgacatctactgacactggcatctactgacactgaygtttaccgacactagcatctactgacactgacatttaccaacaccagcatctaccaacaccgacatttaccaacactgacatttactgacactgatatct

SEQ ID NO: 18944 - DNA, 201 bp, Homo sapiens
tctcccagcctctgtcaaccactaatctactttctgtctctgggggttcacttcttctggacgttttgtgtgactggaatcctgcaatatgtggtccctgygtgtggcttctttccatagcattgtgttttccagattcacccacacattgtcgcacgttatcagaatctcattcctgactgggtgcagtgggttaggcct

SEQ ID NO: 18945 - DNA, 201 bp, Homo sapiens
gtgtgactggaatcctgcaatatgtggtccctgcgtgtggcttctttccatagcattgtgttttccagattcacccacacattgtcgcacgttatcagaayctcattcctgactgggtgcagtgggttaggcctgtaatcctaacattctgggaggccaaggcgggacgatcacttgaggcaggagtttgagaccagcctg

SEQ ID NO: 18946 - DNA, 201 bp, Homo sapiens
accctgtggtcatgcactggaagctcattacctgacgatttggagctcatcactgggggcctaaggagaatagatactgaaggatgaggagtgatggcgcrgggcacgggtgtctttggtggccagaacttggggactgctggggtgcctcactgcaggccttctcagcgccctttatatgcttacacaggctgtttctaa

SEQ ID NO: 18947 - DNA, 201 bp, Homo sapiens
atatgacacggagaatgaaattccccatagcgcacccccaagagacagccctggtccccccgtctttcccgtggacctccagcggggcagatgctgagccrcctgttgtcgagtggcgtgctatcccgtcctccagctcctctgtggcttacagacacccacctgcagccctgtctttgcctcctctagcgcccaccacct

SEQ ID NO: 18948 - DNA, 201 bp, Homo sapiens
ggtcatggccccagcagtgagcccagggaggtcagagacggaggtgtgtgtgtgggtgtgaccctgcgcagttccctgccggctgtagttttttgcattcrcttaatgtttctcgtggaggaaattgtgcatgagcaaatgtgaaaccgtgctgtgctcaaattgtcctaatacatcattgcattggaacagattggcttt

SEQ ID NO: 18949 - DNA, 201 bp, Homo sapiens
aaagcagggccccgtgtgtttagctcccctcttcagttccaagaaattcgccggtgaacccgatccagcatttgttcagcactttcctggggagattcacytcgtgcttcctgtcgtttttggaacccgtttaatttcagccgtgctgtgtcactgctcaggcatttagtagaactcacacacacgggtgggggatgtagg

SEQ ID NO: 18950 - DNA, 201 bp, Homo sapiens
tataaaatattaaagtatagaaggcaggcatttggtacattcacagtgtttacaaccctctcttctatcaagttataagagatttccatcaccccaaaatwaaacccatacccattacacggtgacttcccgttccctctccccggatcccctggtgaacaccagtcgactttctgcctctgtggttctgcctgttctggg

SEQ ID NO: 18951 - DNA, 201 bp, Homo sapiens
tacctgcctggcaaagctctcaggaaattgctcaacggggcattaatagctatctgagcgtgtggcctgggctggaacacaccagcctgggtgctgggtgycttccaggctctggccaccttgggttctgccccaggaaggagcagactgtctcctctaggggacctgaagcttaacgtcctcactgtacgagatagtttt

SEQ ID NO: 18952 - DNA, 201 bp, Homo sapiens
gtgtggccctgtgtgctgacccagctgggctctgccctgtgtggcccccagggtgcccggcgtgtgccctgatggcctggggcagagctccagagagccayggctggccgagggctcacggattctcacccgcccccagtgcctcaggagacacctgggcagcgaacagcttgaggtgtgcagaggatgggtcacgatggg

SEQ ID NO: 18953 - DNA, 201 bp, Homo sapiens
ggccctccagctgtgagcccaggtgggaccacccagttacaagagcgttaggcctggctgtgtaggagacgtgtgtctccacaccagagtccttgcggcayatgggaagccttcatggtcctcatggtggggaggggtccccggggaggcatggagtctcgctcctaggttgctgtgtggcttcagcgctctgtacctcca

SEQ ID NO: 18954 - DNA, 201 bp, Homo sapiens
ccccggggaggcatggagtctcgctcctaggttgctgtgtggcttcagcgctctgtacctccatgcccctgtcctgcagatgtcaacacccagttgaggaraacgtggactttgcccagtgttgtgcagggatggtggggccaggctggagcccacgtgtcctgccttcgccctggccaaggtgggggttatctgccctgg

SEQ ID NO: 18955 - DNA, 201 bp, Homo sapiens
tccaaagccaagtcctccaggacggttcttgcccctgagaaggggcagtgtgggtgctgggctgcagcgagcccctcttcgttccatttcctcacagtctyggggacggagggcttgtcctggagcacaggaccgggattgtgctgaggtcctgggaggccacggtcatgaggggacccagtgaaggccaggaggggacaa

SEQ ID NO: 18956 - DNA, 201 bp, Homo sapiens
ctcaaaaaaaaaaaaaaaaaagaaaagaaaagaaattatcaatctcctcttttatggcatatatatatatatatatatatatatatatatatatatatatwttttttttttttggttatgttcagaaaggccttccctgctctgatcataaaaaacaacttattttcacactctctctcttttttttttgagacagagttt

SEQ ID NO: 18957 - DNA, 201 bp, Homo sapiens
tatttcttaatccagagggagatggggatgggcgagaaacggctttgtccttaaggaagtcatgttctggttggaggacaggcacggcctagcattgaagytggtgagtcagagccggacctgtgagcggggccagaatggggcgcgggcttcagacttcacaaagcagaccacgcggcagcctggggctttagtatccaa

SEQ ID NO: 18958 - DNA, 201 bp, Homo sapiens
ggctttccaggctgcaggtgcccattggtattgcggccgtgcgcccggcgggcatgaattagctgtgccgcctggctgctgacgggacgcctcgcctcgaytgaaaactacctggagctgctcacccaggggcaacgtgaagaaaacgtgaaattctgtcgcttgttgcagctgacagcacggctgtgaggtcccagtggg

SEQ ID NO: 18959 - DNA, 201 bp, Homo sapiens
ggtgcggggcctggtgggacgcccacgttgcccagacagaacccttgtgcggctgcgggcactccttgccctttccgcatttggtgatgactccttgtttygtttcactgaccgtgccctgtgcctctgctctccctccccagttccgtgtgccctggggtcagtgatagaagacacggcccctgggccccaagtctgctg

SEQ ID NO: 18960 - DNA, 201 bp, Homo sapiens
tctgctgagctgacacctcgggctgccgctcacctgcagagagacactagaaggctccgactcccttcctggcccccactctgtttttctaccttttaccrcctattccaatggaaatgcacgatttgtttctccctgtgcacatctgagtgtggacctccctgcccctgctcgtgctgtgcccaccacctggagcaccct

SEQ ID NO: 18961 - DNA, 201 bp, Homo sapiens
accaatttccacgtttactgactgctgtttctcctgttaatttgtatttatagtcttcgctaatttattgctagggttttggtgttgtccctattgacttktatgccttttaattttttaaacaacattaatagacttcatttttttagagcagttttaagtttacaggaaaattaagggacaagtacagagagttccttc

SEQ ID NO: 18962 - DNA, 201 bp, Homo sapiens
cagctagtggcttttaggaaggaatttgttcagttggctttgacacatggccccctagggtccacagctctgtagtgatgtggatgttgttatctacaaasacacatgatccttcgtgtccagatgaaagtgatgatgtctttgcagctgcccagcaaggctgtgtgtgtgtgtgtgtgtgtgtgtgtgtgtgtgtgtggt

SEQ ID NO: 18963 - DNA, 201 bp, Homo sapiens
gccagaatggggcgcgggcttcagacttcacaaagcagaccacgcggcagcctggggctttagtatccaaatgtcctgccctccaggtttcattccttgcsgtaaaatatcacgttaaaggaaaatgttttgttaaaagaccacagtcctgtcacctgagcacagtcgctgttctcggttcctctgtggctttccaggctg

SEQ ID NO: 18964 - DNA, 201 bp, Homo sapiens
actaatctactttctgtctctgggggttcacttcttctggacgttttgtgtgactggaatcctgcaatatgtggtccctgcgtgtggcttctttccatagmattgtgttttccagattcacccacacattgtcgcacgttatcagaacctcattcctgactgggtgcagtgggttaggcctgtaatcctaacattctggga

SEQ ID NO: 18965 - DNA, 201 bp, Homo sapiens
tacaagcatttacctctgataacaagaactttcaaatatctagctgtcatgtaagcacttttcataaacattaagagtatctgtgacacttatgtgtaatktttcgtatctctgaaattgatatttaccagtcatttatcttggctaccaactaacaactatccatattatctgtaccaatcagatgtataatcacaattt

SEQ ID NO: 18966 - DNA, 201 bp, Homo sapiens
ttctaaatttcagtttcctgcatgaaaattttgtcaagtactctattaaggtagaccacctctccctttttttttttttcaaacaagaagtagtttttcaycaaacaatgtctcttatgtaattcatcttcaatccactggatacccaataaacttgccccagaaaccttaaatctgtgcttacagagaggccagcttccc

SEQ ID NO: 18967 - DNA, 201 bp, Homo sapiens
ataggatgtaacaaaggagtaatggaacaattcaaaggcagtggtatagtgcatagagtcctgttggggtcagaagacctgagccaagtttacccccaacmtttataaccatgtaaccttaggcatattacttcatctcccttaatcttagttttcatatctgatcaatggaaatgatgaaacttattctgctggattaaa

SEQ ID NO: 18968 - DNA, 201 bp, Homo sapiens
caaaacattttacatattttttattatagaaattattgataaagactaaggtcacagtataaaaatcctttttagagcagacatttctgtagaagagtgarcatatgacctattatactctaatttggatatagataggatgtaacaaaggagtaatggaacaattcaaaggcagtggtatagtgcatagagtcctgttgg

SEQ ID NO: 18969 - DNA, 201 bp, Homo sapiens
gccaaggaaaagaatgcagttgtcaaaatctgggccatgactaaggaaggtctggacatcttgactgccagacagtctccccaatgatatggagtatttaraatgatactggatattttatttattttttgtattttcaacttttaagttcagaggcacatgtgcagagcatgcaggtttattacataagtaaatgtgtgc

SEQ ID NO: 18970 - DNA, 201 bp, Homo sapiens
gcacttgaccttatttactaggttccaccatgggaatccatgcactctaaagatttccccctatttctacatcactttgctcaagggtcaatgagccaagraaaagaatgcagttgtcaaaatctgggccatgactaaggaaggtctggacatcttgactgccagacagtctccccaatgatatggagtatttagaatgat

SEQ ID NO: 18971 - DNA, 201 bp, Homo sapiens
gcagtgggcaaacccatcaaacttgcaatggaatacaggagatgaacaatacgatgagaacaatcagatagacaacataatgttagatggttgtgcttccygtgaaagggaataaaagagggcaaagaaagagtgcctggcactgtttctattagacaatattgtctttgaggctccatggcttgcaacatttaagcagac

SEQ ID NO: 18972 - DNA, 201 bp, Homo sapiens
ttagcgtatttaaaataatgtttaaaattttaatatatatttacctattattgatatttttacattccttgtttggtactaagtctggaatttagtatatrttttacatttaccacacttctcaatttacactattcacatttcttgtgtttgataactgtgtatggctagtgactaccgtattggtcagtgcagcccaag

SEQ ID NO: 18973 - DNA, 201 bp, Homo sapiens; identical to SEQ ID NO: 2082

SEQ ID NO: 18974 - DNA, 201 bp, Homo sapiens; identical to SEQ ID NO: 2088

SEQ ID NO: 18975 - DNA, 201 bp, Homo sapiens; identical to SEQ ID NO: 2118

SEQ ID NO: 18976 - DNA, 201 bp, Homo sapiens; identical to SEQ ID NO: 2117

SEQ ID NO: 18977 - DNA, 201 bp, Homo sapiens; identical to SEQ ID NO: 2116

SEQ ID NO: 18978 - DNA, 201 bp, Homo sapiens; identical to SEQ ID NO: 2089

SEQ ID NO: 18979 - DNA, 201 bp, Homo sapiens; identical to SEQ ID NO: 2076

SEQ ID NO: 18980 - DNA, 201 bp, Homo sapiens
tcacctaatgtatagagcaatgcagagatagaatgatgggctataacaatcatataattgaaagaaagaacttcaaaaataatcaagttcagctgtttgayttataaatgtgataactaaaacctagagaggaaaagaggtactcaagatcacacagtaggagaggactgcagaaacaccaaacccaagctcttttgtcca

SEQ ID NO: 18981 - DNA, 201 bp, Homo sapiens
gcatgaaaattttgtcaagtactctattaaggtagaccacctctccctttttttttttttcaaacaagaagtagtttttcaccaaacaatgtctcttatgkaattcatcttcaatccactggatacccaataaacttgccccagaaaccttaaatctgtgcttacagagaggccagcttcccttcttgttaacccatagga

SEQ ID NO: 18982 - DNA, 201 bp, Homo sapiens
agctatagcttcttcagtttcccagaactgcaggtgctggatttatccaggtaatgaatccacttttacatactgcacaaggtgaggtgttcattgtcctrtcatttcattattggactggaaagcttggtttgtggagtctcatcttcattcacttattcattcatacaacagatgtcttattaactatataaccttgag

SEQ ID NO: 18983 - DNA, 201 bp, Homo sapiens
cattttacatattttttattatagaaattattgataaagactaaggtcacagtataaaaatcctttttagagcagacatttctgtagaagagtgaacataygacctattatactctaatttggatatagataggatgtaacaaaggagtaatggaacaattcaaaggcagtggtatagtgcatagagtcctgttggggtca

SEQ ID NO: 18984 - DNA, 201 bp, Homo sapiens
gcgcatattacttcatttctttgaatttccattttcctcatctttaaatgcttatttgaagattaagtgaaagtatataacaaacaagaactatgcaggcrtatggtaagggattaatgatagatgataataattaatgttgacatctattgatcacttatactgtagcgggcttttaaataaactctttaaacaccttat

SEQ ID NO: 18985 - DNA, 201 bp, Homo sapiens
tgcccatccccttagttccactgtaaggcaggccctcatttcccctggcattgactcttacacactaactgctttcctgattccagtcttcttcctttaaytcattctgcacgttcttgtttgttatgtacttgcatttgttgttattatttttccttaggcttcaatctaacaaattactctccttaaaaacttttaata

SEQ ID NO: 18986 - DNA, 201 bp, Homo sapiens; identical to SEQ ID NO: 2074

SEQ ID NO: 18987 - DNA, 201 bp, Homo sapiens; identical to SEQ ID NO: 2087

SEQ ID NO: 18988 - DNA, 201 bp, Homo sapiens; identical to SEQ ID NO: 2085

SEQ ID NO: 18989 - DNA, 201 bp, Homo sapiens; identical to SEQ ID NO: 2073

SEQ ID NO: 18990 - DNA, 201 bp, Homo sapiens; identical to SEQ ID NO: 2086

SEQ ID NO: 18991 - DNA, 201 bp, Homo sapiens; identical to SEQ ID NO: 2083

SEQ ID NO: 18992 - DNA, 201 bp, Homo sapiens; identical to SEQ ID NO: 2084

SEQ ID NO: 18993 - DNA, 201 bp, Homo sapiens; identical to SEQ ID NO: 2077

SEQ ID NO: 18994 - DNA, 201 bp, Homo sapiens; identical to SEQ ID NO: 2090

SEQ ID NO: 18995 - DNA, 201 bp, Homo sapiens
tattcagcagaaatattagataatcaatgtctttttattcctgtaggtgtgaaatccagacaattgaagatggggcatatcagagcctaagccacctctcyaccttaatattgacaggaaaccccatccagagtttagccctgggagccttttctggactatcaagtttacagaagctggtggctgtggagacaaatctag

SEQ ID NO: 18996 - DNA, 201 bp, Homo sapiens
agccctgcgtggaggtatgtggctggagtcagctcctctgaactttccctcacttctgcccagaacttctcactgtgtgccctggtttgtttatttttgcaaaaaaaaaaagagttaaattaccttaaagactcaagaagccacagagatcaaataattcattgttacagggcactagaggcagccattgggggtttgttc

SEQ ID NO: 18997 - DNA, 201 bp, Homo sapiens
tgacacttatgtgtaatgtttcgtatctctgaaattgatatttaccagtcatttatcttggctaccaactaacaactatccatattatctgtaccaatcaratgtataatcacaattttgtgtgacagaaaatggctaaacttgatccaaggctattacatgctttatcaactgcacaatctttatatatgtcaattattg

SEQ ID NO: 18998 - DNA, 201 bp, Homo sapiens
atctggttggtaaacctctgcctaattgggaaccttctttctccacaactccatattgtacactccaatttcatctctgttctccaaccatggaagctatktgtcatgattcctccttgtgtcattttttttctgtcaaccttggggcttttgtgtttgctgttcacttcacctccttttattgttaacttctactcatct

SEQ ID NO: 18999 - DNA, 201 bp, Homo sapiens
ttttcataaacattaagagtatctgtgacacttatgtgtaatgtttcgtatctctgaaattgatatttaccagtcatttatcttggctaccaactaacaaytatccatattatctgtaccaatcagatgtataatcacaattttgtgtgacagaaaatggctaaacttgatccaaggctattacatgctttatcaactgca

SEQ ID NO: 19000 - DNA, 201 bp, Homo sapiens
aagaaagagtgcctggcactgtttctattagacaatattgtctttgaggctccatggcttgcaacatttaagcagacatacgaatgaagatctgcatgttkgaactctgactttgcgcatattacttcatttctttgaatttccattttcctcatctttaaatgcttatttgaagattaagtgaaagtatataacaaacaa

SEQ ID NO: 19001 - DNA, 201 bp, Homo sapiens
ttggctaccaactaacaactatccatattatctgtaccaatcagatgtataatcacaattttgtgtgacagaaaatggctaaacttgatccaaggctattrcatgctttatcaactgcacaatctttatatatgtcaattattgatctttaactgatttccttcttatggattttctcctctgcttatcatgtatgcctaa

SEQ ID NO: 19002 - DNA, 201 bp, Homo sapiens; identical to SEQ ID NO: 2113

SEQ ID NO: 19003 - DNA, 201 bp, Homo sapiens; identical to SEQ ID NO: 2119

SEQ ID NO: 19004 - DNA, 201 bp, Homo sapiens
gaaataccaatcagctggttggtaatcttattcatgatggatctcttttgtttttcccctgcgcagacttcacagttgctttagaaacccatagtagagcygaacagctaagaaaatgatttacagtgaggcagggtcagaaactcaagagagaaaaagccagctgcagtcctgaagttgaggatataggagaaaatcaag

SEQ ID NO: 19005 - DNA, 201 bp, Homo sapiens
agtcttccttgattgccccatgtagagctctccagcctcacttatttgcctcaaatccccttatactgcttaatatttttttttctagagcacaacatttyatatttttgtttgtttattttctctctctccctttgtaatggaatcggtaaggaggcaggatcattgctggttttatttaccactatatttccagtggcc

SEQ ID NO: 19006 - DNA, 201 bp, Homo sapiens
cactctttacgtgctcacgttgtcctctccttaggacatgtttttcttcccctttccacatatctaaaccttactcatcttccaagacccactttaaaatyttccttttctgggaagcctttcctgaatccagacttgatctctgctttctctgaaccacagggcatattttctaagcctattttatggccccttgagata

SEQ ID NO: 19007 - DNA, 201 bp, Homo sapiens
aaagtatataacaaacaagaactatgcaggcgtatggtaagggattaatgatagatgataataattaatgttgacatctattgatcacttatactgtagcrggcttttaaataaactctttaaacaccttatctcatttaatccttcaaacattctattggtttcaaacaacagaaaactacaattagctggcttctgcaa

SEQ ID NO: 19008 - DNA, 201 bp, Homo sapiens
cgggcttttaaataaactctttaaacaccttatctcatttaatccttcaaacattctattggtttcaaacaacagaaaactacaattagctggcttctgcraggaattttgttggaggaaatgagagcattcagaaattagatgggagcgttagagaattaggcttacaaagaatgtgggaaagtaggctagaaagcagtg

SEQ ID NO: 19009 - DNA, 201 bp, Homo sapiens
tactaggttccaccatgggaatccatgcactctaaagatttccccctatttctacatcactttgctcaagggtcaatgagccaaggaaaagaatgcagttktcaaaatctgggccatgactaaggaaggtctggacatcttgactgccagacagtctccccaatgatatggagtatttagaatgatactggatattttatt

SEQ ID NO: 19010 - DNA, 201 bp, Homo sapiens
atgaaaatatggaacgcatcatggatttgtgtgtcatccttgtgcaggggccatgctcatcttctctgtatccttccaattttagtatatgtgctactgcmgcaagcacgatattggatattttattacctacattttacatatgataaaatgaggctcactgaggtttttcttttgttcgttttattttgttttgttttt

SEQ ID NO: 19011 - DNA, 201 bp, Homo sapiens
tacctacattttacatatgataaaatgaggctcactgaggtttttcttttgttcgttttattttgttttgtttttaaagacttggccctaaaccacacagmagagctggcatgaaacccagagctttcagactccggagcctcagcccttcaccccgattccattgcttcttgctaaatgctgccgttttatcacggaggt

SEQ ID NO: 19012 - DNA, 201 bp, Homo sapiens
gatgaaaggttgactgaattttgtgcttgcacaaaaagaggcccctctccaccatctctggtctaggagaggggagttgggagaccatgcagtaaagatasttcatgtcatgtgtaatcattgcaggtggttcctaatattacttatcaatgcatggagctgaatttctacaaaatccccgacaacctccccttctcaacc

SEQ ID NO: 19013 - DNA, 201 bp, Homo sapiens
gttcattgtcctatcatttcattattggactggaaagcttggtttgtggagtctcatcttcattcacttattcattcatacaacagatgtcttattaactrtataaccttgagcaagctacctctattctccaggtctcagttttctaatctgtgaagtaggcagttggctgagacagcttctaagggcaattctaatttt

SEQ ID NO: 19014 - DNA, 201 bp, Homo sapiens
ttttctaatctgtgaagtaggcagttggctgagacagcttctaagggcaattctaattttaggttttcttttaagacaggagagaaaattagcttaaattytttcataagcagctatttattgactacttgctatatgttgtacactctgcaagaagacaggcatatattgatatataacacacagcccctgttgttaagg

SEQ ID NO: 19015 - DNA, 201 bp, Homo sapiens
ctaatctgtgaagtaggcagttggctgagacagcttctaagggcaattctaattttaggttttcttttaagacaggagagaaaattagcttaaattctttyataagcagctatttattgactacttgctatatgttgtacactctgcaagaagacaggcatatattgatatataacacacagcccctgttgttaaggaggc

SEQ ID NO: 19016 - DNA, 201 bp, Homo sapiens
acagcttctaagggcaattctaattttaggttttcttttaagacaggagagaaaattagcttaaattctttcataagcagctatttattgactacttgctrtatgttgtacactctgcaagaagacaggcatatattgatatataacacacagcccctgttgttaaggaggcatatcttcttgaaagagttaataccttaa

SEQ ID NO: 19017 - DNA, 201 bp, Homo sapiens
taagacaggagagaaaattagcttaaattctttcataagcagctatttattgactacttgctatatgttgtacactctgcaagaagacaggcatatattgrtatataacacacagcccctgttgttaaggaggcatatcttcttgaaagagttaataccttaaagtcctgggtatggtcctgggtacatagtatatagtca

SEQ ID NO: 19018 - DNA, 201 bp, Homo sapiens
tagtcaacacattttaattatgattttttggatctggaaactgatataaagatagcgacatataacagtaggtgataaattatgtttaaactaaaggtaamtaattgtatttttcagaagaggggccttctctgtggtgggtagtcaagaaagatttcatgaactgcataagattcaaacaatgtctagaatattaaaact

SEQ ID NO: 19019 - DNA, 201 bp, Homo sapiens
agtcctgttggggtcagaagacctgagccaagtttacccccaacatttataaccatgtaaccttaggcatattacttcatctcccttaatcttagttttcrtatctgatcaatggaaatgatgaaacttattctgctggattaaatgtgataataaatattaatatgctgtatatatttaaatttttataaaatatatttt

SEQ ID NO: 19020 - DNA, 201 bp, Homo sapiens
atgaaacttattctgctggattaaatgtgataataaatattaatatgctgtatatatttaaatttttataaaatatattttataagcataaagtattcttrcagaatttcattaggtttttaaaataatttcaacttttatttttgattcagggatttacatggttatattgcgtaatgctgaggtgtagggtacaatcga

SEQ ID NO: 19021 - DNA, 201 bp, Homo sapiens
gtgataataaatattaatatgctgtatatatttaaatttttataaaatatattttataagcataaagtattcttacagaatttcattaggtttttaaaatmatttcaacttttatttttgattcagggatttacatggttatattgcgtaatgctgaggtgtagggtacaatcgataccatcactcaggtagtgagcatag

SEQ ID NO: 19022 - DNA, 201 bp, Homo sapiens
gataatggctactagctgcatctatgccattatgttctaaatttcagtttcctgcatgaaaattttgtcaagtactctattaaggtagaccacctctcccyttttttttttttcaaacaagaagtagtttttcaccaaacaatgtctcttatgtaattcatcttcaatccactggatacccaataaacttgccccagaaac

SEQ ID NO: 19023 - DNA, 201 bp, Homo sapiens
tctaaatttcagtttcctgcatgaaaattttgtcaagtactctattaaggtagaccacctctccctttttttttttttcaaacaagaagtagtttttcacyaaacaatgtctcttatgtaattcatcttcaatccactggatacccaataaacttgccccagaaaccttaaatctgtgcttacagagaggccagcttccct

SEQ ID NO: 19024 - DNA, 201 bp, Homo sapiens
cttatatacattatcattgcttgttagccacagaccagagatttaagttcacatctccagaatccaacttaaatgttttctttgtcttaatactctacttytctaaagtgattatcaccaatgtaatgatatagagacacagcaagaccctttccttctcacctaatgtatagagcaatgcagagatagaatgatgggcta

SEQ ID NO: 19025 - DNA, 201 bp, Homo sapiens
tcatttcttttaggataaaattcaaaaccctttatctggttggtaaacctctgcctaattgggaaccttctttctccacaactccatattgtacactccartttcatctctgttctccaaccatggaagctatttgtcatgattcctccttgtgtcattttttttctgtcaaccttggggcttttgtgtttgctgttcact

SEQ ID NO: 19026 - DNA, 201 bp, Homo sapiens; identical to SEQ ID NO: 2079

SEQ ID NO: 19027 - DNA, 201 bp, Homo sapiens; identical to SEQ ID NO: 2080

SEQ ID NO: 19028 - DNA, 201 bp, Homo sapiens; identical to SEQ ID NO: 2078

SEQ ID NO: 19029 - DNA, 201 bp, Homo sapiens; identical to SEQ ID NO: 2091

SEQ ID NO: 19030 - DNA, 201 bp, Homo sapiens; identical to SEQ ID NO: 2081

SEQ ID NO: 19031 - DNA, 201 bp, Homo sapiens; identical to SEQ ID NO: 2100

SEQ ID NO: 19032 - DNA, 201 bp, Homo sapiens; identical to SEQ ID NO: 2101

SEQ ID NO: 19033 - DNA, 201 bp, Homo sapiens; identical to SEQ ID NO: 2104

SEQ ID NO: 19034 - DNA, 201 bp, Homo sapiens; identical to SEQ ID NO: 2105

SEQ ID NO: 19035 - DNA, 201 bp, Homo sapiens; identical to SEQ ID NO: 2115

SEQ ID NO: 19036 - DNA, 201 bp, Homo sapiens; identical to SEQ ID NO: 2120

SEQ ID NO: 19037 - DNA, 201 bp, Homo sapiens; identical to SEQ ID NO: 2121

SEQ ID NO: 19038 - DNA, 201 bp, Homo sapiens; identical to SEQ ID NO: 2122

SEQ ID NO: 19039 - DNA, 201 bp, Homo sapiens
ccttatcccttatgcttggtggatacgttcttagaccccaagtggatctctgagaccgcagatggtaccaaacctcatatatgcaatattttttcctatayataaatacctaagataaagttcatcttctgaattaggcacagtaagagattaacaataactaacaataaaattgaatagttataataatatattgtaata

SEQ ID NO: 19040 - DNA, 201 bp, Homo sapiens
ctggattaagaaagaacttatttgtacattgtaactgacaagcacctgcaatgctgaaaggaatttttcattggcttgctgtttgctggctgcatcaaagmcctgtctctaggacatgtctctgaacattgtgtgtagcatggctttcatttcttttaggataaaattcaaaaccctttatctggttggtaaacctctgcc

SEQ ID NO: 19041 - DNA, 201 bp, Homo sapiens
ccaaccatggaagctatttgtcatgattcctccttgtgtcattttttttctgtcaaccttggggcttttgtgtttgctgttcacttcacctccttttattsttaacttctactcatctttcaattttcaacttaagtgttctcagagaaacctactttgattttcttggtccacaacggttctctggatgtgaactcttat

SEQ ID NO: 19042 - DNA, 201 bp, Homo sapiens; identical to SEQ ID NO: 2092

SEQ ID NO: 19043 - DNA, 201 bp, Homo sapiens; identical to SEQ ID NO: 2093

SEQ ID NO: 19044 - DNA, 201 bp, Homo sapiens; identical to SEQ ID NO: 2094

SEQ ID NO: 19045 - DNA, 201 bp, Homo sapiens; identical to SEQ ID NO: 2095

SEQ ID NO: 19046 - DNA, 201 bp, Homo sapiens; identical to SEQ ID NO: 2096

SEQ ID NO: 19047 - DNA, 201 bp, Homo sapiens; identical to SEQ ID NO: 2097

SEQ ID NO: 19048 - DNA, 201 bp, Homo sapiens; identical to SEQ ID NO: 2098

SEQ ID NO: 19049 - DNA, 201 bp, Homo sapiens; identical to SEQ ID NO: 2099

SEQ ID NO: 19050 - DNA, 201 bp, Homo sapiens
ttgctgcatagatcatgaaaatatggaacgcatcatggatttgtgtgtcatccttgtgcaggggccatgctcatcttctctgtatccttccaattttagtrtatgtgctactgcagcaagcacgatattggatattttattacctacattttacatatgataaaatgaggctcactgaggtttttcttttgttcgttttat

SEQ ID NO: 19051 - DNA, 201 bp, Homo sapiens; identical to SEQ ID NO: 2102

SEQ ID NO: 19052 - DNA, 201 bp, Homo sapiens; identical to SEQ ID NO: 2103

SEQ ID NO: 19053 - DNA, 201 bp, Homo sapiens; identical to SEQ ID NO: 2106

SEQ ID NO: 19054 - DNA, 201 bp, Homo sapiens; identical to SEQ ID NO: 2107

SEQ ID NO: 19055 - DNA, 201 bp, Homo sapiens; identical to SEQ ID NO: 2108

SEQ ID NO: 19056 - DNA, 201 bp, Homo sapiens; identical to SEQ ID NO: 2109

SEQ ID NO: 19057 - DNA, 201 bp, Homo sapiens; identical to SEQ ID NO: 2110

SEQ ID NO: 19058 - DNA, 201 bp, Homo sapiens; identical to SEQ ID NO: 2111

SEQ ID NO: 19059 - DNA, 201 bp, Homo sapiens; identical to SEQ ID NO: 2112

SEQ ID NO: 19060 - DNA, 201 bp, Homo sapiens; identical to SEQ ID NO: 2114

SEQ ID NO: 19061 - DNA, 201 bp, Homo sapiens
aagaaaaagcctaaagaactgtttcagattaaagaagactaaagagacattacaatcaaatgcattgaattatcctgaacatggatttttaagaaatacayataaatggcattattgggacaattgacaaaatttgaacatggattacagattagatcatagtactgtactaatgctaaatttcctgagtttgataattgc

SEQ ID NO: 19062 - DNA, 201 bp, Homo sapiens
atttggaagtatttactatgtctaaaatgtaatatatcaaagtgacatattacataatgtctgattaagtgactaaatatattttaaaatacaggtttaamtgtaacttttactgtatcatatgaaattatttcataacttgatatcatgaattcttttatgctatgattttttaaacattcattagatttgcatatacat

SEQ ID NO: 19063 - DNA, 201 bp, Homo sapiens
caaataaaagcccttgtgcccattttagcacaaatatatttttactgaaaacctccatattctatgtcagcaaaaagtgcaagtctttaatttgctcacargaccaaaatgatcagaattttcaggggagtttacatacgagttcatcttttgggagcattaataatgtaagatgtgccaatgaattttgggaactgtagg

SEQ ID NO: 19064 - DNA, 201 bp, Homo sapiens
gttacctatgaatgcaatgaaaatcactattgaggctaatttgtaaagctgttatcacttttacgttcctcattattatctccattttgaagataggctcrgagaggttaaataaatactagaggtcatccatctccctttctaaggagtctgcagtataaccactgacagggagatgatttgcaaagacccaaacagcat

SEQ ID NO: 19065 - DNA, 201 bp, Homo sapiens
gaaaaagatctcaaaaaaaaaagaatgttaagtggatgttacctatgaatgcaatgaaaatcactattgaggctaatttgtaaagctgttatcacttttaygttcctcattattatctccattttgaagataggctcggagaggttaaataaatactagaggtcatccatctccctttctaaggagtctgcagtataacca

SEQ ID NO: 19066 - DNA, 201 bp, Homo sapiens
tctctttttacaattctgttttaaagatacacatcttgagataatatataagaatgttaaaaaaaagaaaaagatctcaaaaaaaaaagaatgttaagtgratgttacctatgaatgcaatgaaaatcactattgaggctaatttgtaaagctgttatcacttttacgttcctcattattatctccattttgaagataggc

SEQ ID NO: 19067 - DNA, 201 bp, Homo sapiens
tcaatattgttatattcaatattgttatcactattattccgtattgttacactatatcactatattttctctttttacaattctgttttaaagatacacawcttgagataatatataagaatgttaaaaaaaagaaaaagatctcaaaaaaaaaagaatgttaagtggatgttacctatgaatgcaatgaaaatcactatt

SEQ ID NO: 19068 - DNA, 201 bp, Homo sapiens
tggataactttcattagtaacagtttttaaaaattttaaacataattgttttaaaattcaatattgttatattcaatattgttatcactattattccgtaytgttacactatatcactatattttctctttttacaattctgttttaaagatacacatcttgagataatatataagaatgttaaaaaaaagaaaaagatct

SEQ ID NO: 19069 - DNA, 201 bp, Homo sapiens
tatgctatgattttttaaacattcattagatttgcatatacattttgtgttgttttcctaaacaataaataaaagtttcaggctaatctttgcaaacatayctctataaaaacatattttgagtatttggataactttcattagtaacagtttttaaaaattttaaacataattgttttaaaattcaatattgttatattc

SEQ ID NO: 19070 - DNA, 201 bp, Homo sapiens
aaatctaataaattctggaaaaataaaaatatcttggcttttaaaaacttacatgtattctaatatacatgtaaatataacaaagttcttgcattctttcyaactatacttgactctatcagagtgctttccaaaatgtatcgcatataccttctacaaaagaattatttgagggttaatattgcaaattggttaacatgc

SEQ ID NO: 19071 - DNA, 201 bp, Homo sapiens
attattaactctttgtggctcatctcttccttttctacctatacttcctaaaacactcttacccattgttctaattgttactaaagactcctgcttaaaartgagttaaactgtgtgaaatgagaaaagattctctttagacacaatcatttcacccccgcccccccaccaatgttacagtttgaatgctttccagacact

SEQ ID NO: 19072 - DNA, 201 bp, Homo sapiens
taaaatcccaatagcaatcaataattataatacaaggttcatcaagattctggaatacaagagataccttcactccagtgtccaatgcagcattattcacmatagccaagctatggaaacaacctaaatgtccactgatggacgaatggctaaagaaaatgtgttatatacacagaacggaatattattcagcttccaaaa

SEQ ID NO: 19073 - DNA, 201 bp, Homo sapiens
agcccatcataactaaataaaatcccaatagcaatcaataattataatacaaggttcatcaagattctggaatacaagagataccttcactccagtgtccmatgcagcattattcacaatagccaagctatggaaacaacctaaatgtccactgatggacgaatggctaaagaaaatgtgttatatacacagaacggaata

SEQ ID NO: 19074 - DNA, 201 bp, Homo sapiens
gtttatcagcccatcataactaaataaaatcccaatagcaatcaataattataatacaaggttcatcaagattctggaatacaagagataccttcactccmgtgtccaatgcagcattattcacaatagccaagctatggaaacaacctaaatgtccactgatggacgaatggctaaagaaaatgtgttatatacacagaa

SEQ ID NO: 19075 - DNA, 201 bp, Homo sapiens
atatttatcctttagcttttgagatcctcagtgtctgaaagttgtatctctgattatctctatattaaagcagcaaaagttattctcaatgcatagtttamcaatgaccacatttgaagggagagagagagagcatagaaaaattagaatgccccttttgattcaaacattgttactgcatcattgccattaagatttggt

SEQ ID NO: 19076 - DNA, 201 bp, Homo sapiens
ctggaaattacatgcatgcattgtagaaatcccgcacacaggaatagttctataggatttaaaaagtccatcccacataaaagcaccaatagcagtagacmcaaaacatgtagcaaaatctaagctaacgtgtgtgttccttcctgtgatcacaactaatcatgaagagaaaggaaaaagcactcaataatgctaagaaat

SEQ ID NO: 19077 - DNA, 201 bp, Homo sapiens
ttactgaaaacctccatattctatgtcagcaaaaagtgcaagtctttaatttgctcacaggaccaaaatgatcagaattttcaggggagtttacatacgarttcatcttttgggagcattaataatgtaagatgtgccaatgaattttgggaactgtaggcttttactaatctaaacatggatcctggggtcccaatccca

SEQ ID NO: 19078 - DNA, 201 bp, Homo sapiens
aatagaccaaatatgtgaaaccaaggcagaatggaaacacacacgtgtgcacgacacacacaattatctttataacagcatccaaataaaagcccttgtgsccattttagcacaaatatatttttactgaaaacctccatattctatgtcagcaaaaagtgcaagtctttaatttgctcacaggaccaaaatgatcagaat

SEQ ID NO: 19079 - DNA, 201 bp, Homo sapiens
gtcgcacaaacattaacactgtggcaaatcttgcagatgtgctacagggagtacatactggtcacaaatagaccaaatatgtgaaaccaaggcagaatggraacacacacgtgtgcacgacacacacaattatctttataacagcatccaaataaaagcccttgtgcccattttagcacaaatatatttttactgaaaacc

SEQ ID NO: 19080 - DNA, 201 bp, Homo sapiens
aggttcatcaagattctggaatacaagagataccttcactccagtgtccaatgcagcattattcacaatagccaagctatggaaacaacctaaatgtccaytgatggacgaatggctaaagaaaatgtgttatatacacagaacggaatattattcagcttccaaaagaagtaaatcctgctatatatgacaacatggatg

SEQ ID NO: 19081 - DNA, 201 bp, Homo sapiens
tcgtggtgatggtttcatttctgtccaaattcgtcaaattgaaaacattaaaaatatgcatttttgtatatcaataatacctcaataaaattgtctaaaamcaataaaattgaattaagtttttaaaaaagattctagaatgttttctaaataaaagaaaaattttaaaactttttcttttcctcctatattttatactat

SEQ ID NO: 19082 - DNA, 201 bp, Homo sapiens
gtaaaatacgagttcatctttgtcatctatcttcaaaagggatgatctacaatgttgacaagtctgtttacatcccttccagtctttcttctgcatggtaraataataacagtttactccacaacaggacccgtggtcttcagagaatttgcctacaatatataaggtgaatcatcaaacttcttgtcatctggtattctg

SEQ ID NO: 19083 - DNA, 201 bp, Homo sapiens
ccatagttggaatgggtgaagtatttggaagtatttactatgtctaaaatgtaatatatcaaagtgacatattacataatgtctgattaagtgactaaatmtattttaaaatacaggtttaaatgtaacttttactgtatcatatgaaattatttcataacttgatatcatgaattcttttatgctatgattttttaaaca

SEQ ID NO: 19084 - DNA, 201 bp, Homo sapiens
atatctaccaataggaaagttgttaaatattttataatgctttatgaaactatccaaaatcatgctccagaagaatatttaggatgtagaaaattgatcawcacttaatcttaagtgaaaaaaggaatcctcaaaacaaatctattaaaataaaaaggtgtgtgtatgataggggcgcagtaaaatcttaagccccataag

SEQ ID NO: 19085 - DNA, 201 bp, Homo sapiens
gaactcacaagatgtgttaggtgtgaacaggtaaaattagtaacatatgagatgttagatatagatacgtaagtaaagtatgtgagcaccgaacatagacmaaaaaagaagggaccaaatagacactaaacatacacaaaataaacatgaggctcatacaaactcaacattcttgaggtcttaaattcaccacccattggt

SEQ ID NO: 19086 - DNA, 201 bp, Homo sapiens
accaagtagtttgtgaggcataggtagaactcacaagatgtgttaggtgtgaacaggtaaaattagtaacatatgagatgttagatatagatacgtaagtwaagtatgtgagcaccgaacatagacaaaaaaagaagggaccaaatagacactaaacatacacaaaataaacatgaggctcatacaaactcaacattcttg

SEQ ID NO: 19087 - DNA, 201 bp, Homo sapiens
taaatgaaaccaagtagtttgtgaggcataggtagaactcacaagatgtgttaggtgtgaacaggtaaaattagtaacatatgagatgttagatatagatwcgtaagtaaagtatgtgagcaccgaacatagacaaaaaaagaagggaccaaatagacactaaacatacacaaaataaacatgaggctcatacaaactcaa

SEQ ID NO: 19088 - DNA, 201 bp, Homo sapiens
gacctcttaatcacacccacaatctcccattttattccacaccgacaatttttggtcagaaggcaaaagtaccttgcaatattgcaatgaaattatgatayattgctttcttgtgctaattttttttcaataaaagtgagagattaaaaaagaaagatggtggccaggtacagtggctcacacctgtagccccagtacttt

SEQ ID NO: 19089 - DNA, 201 bp, Homo sapiens
gaattgaatatctgtaacatagataaccagggctcatgtatatatattgtaagaagaaaagggaagaattggaatatagtcagagatgagattgttcgatygtgttttctctccgggaagaattggaatatagtcagagatgagattgttcgatcgtgttttctctcctttcctcccccaccctatagctaagagttatta

SEQ ID NO: 19090 - DNA, 201 bp, Homo sapiens
cacattcctgtaagagagaatcttccctgtagacaaacatgtgtgtgctggccacaaaaactttgtgtctgttgggaccccttactcacacgacaagatgkccccatatcatcatcaggagaggattatgcagcagagagagtcaggtcgtatgaagactgcataacccaagattcacggttatgcacaacccaagattca

SEQ ID NO: 19091 - DNA, 200 bp, Homo sapiens
gtatgaagactgcataacccaagattcacggttatgcacaacccaagattcagggtgatcccttcaccctgcaccttatcccaagtgcatcaacttatccatctctttccctttgaactgtgctatgggttttacattggtttagccaactgtgatttgatcatcttaatttggcctgtgagcctttctgttctctgacc

SEQ ID NO: 19092 - DNA, 201 bp, Homo sapiens
ctgttaaccagaggaatatgtttatcagcccatcataactaaataaaatcccaatagcaatcaataattataatacaaggttcatcaagattctggaatayaagagataccttcactccagtgtccaatgcagcattattcacaatagccaagctatggaaacaacctaaatgtccactgatggacgaatggctaaagaaa

SEQ ID NO: 19093 - DNA, 201 bp, Homo sapiens
acgttaaaattttagaaataatcttccggtatattgccagagaagcctatgtgaaaataacagttgtcaacaggcagtcattaatgtccataaaagattcwattgattaatgaatgtcaatatagaaaagaataattaaatagtaaatacctaaaatttacttcttatgttagtcagtataaaaagatgatatccaagaaa

SEQ ID NO: 19094 - DNA, 201 bp, Homo sapiens
aaaaaaatctaccaatagattattgttctattcacccagccaattttgctcaaaatattcaacatacatatacaaatgttaggtaaaattgataccactgyaaatcactgaaacactttatgagttcaacaaacaaaaaatctaataaattctggaaaaataaaaatatcttggcttttaaaaacttacatgtattctaat

SEQ ID NO: 19095 - DNA, 201 bp, Homo sapiens
ttgttaaagtcatttatacttctagtgatcacagccatgataatgagaaaatacagaaatgatgagaaaaaaatctaccaatagattattgttctattcayccagccaattttgctcaaaatattcaacatacatatacaaatgttaggtaaaattgataccactgcaaatcactgaaacactttatgagttcaacaaaca

SEQ ID NO: 19096 - DNA, 201 bp, Homo sapiens
gcctgtctgtgtgtctattggcgtgtgtttattaactaagtgcctaaagcatttagagtgagcctcatttatagaagaaatgaaaaatctttcaatacttytgttaaagtcatttatacttctagtgatcacagccatgataatgagaaaatacagaaatgatgagaaaaaaatctaccaatagattattgttctattcac

SEQ ID NO: 19097 - DNA, 201 bp, Homo sapiens
atatgaaaatctgaactaagaaagaaacatgaagtgatagcacaattattattggggcagatagactatccgcagcagaaaagagagtaagatccagataygtaattttatctgaatataaaatatcagtgatttttttcaaaagatatgaaggaattcaaacaaaaggtaaagcttgaatttaatattatataactgcat

SEQ ID NO: 19098 - DNA, 201 bp, Homo sapiens
aactttaaaaacgatctcattttctctatgacatctgttcttttgtataaggcgtgaatccagttcctttttctgctgaaagctatttttgagaacgtcawattttaaagtcttatttgtcaaaatctgctcttttaagtagttgtcattttgcatgatgtacttttcactacagtttcttagaatttcctgccgttgatg

SEQ ID NO: 19099 - DNA, 201 bp, Homo sapiens
attaggcttcaaggattatggaggggaagaaataatgcaaaatcatgcaatctttcattcaagatttcctttgtacctgtattttgcaaaactttaaaaaygatctcattttctctatgacatctgttcttttgtataaggcgtgaatccagttcctttttctgctgaaagctatttttgagaacgtcatattttaaagtc

SEQ ID NO: 19100 - DNA, 201 bp, Homo sapiens
agtagttgttgattaaccgggtcaattaattccatcattatgcaagataatagagtttactgtatgagatttaatatttttatatcttaagtgctttcaayggtatcatcgcacagagtcgcacaaacattaacactgtggcaaatcttgcagatgtgctacagggagtacatactggtcacaaatagaccaaatatgtga

SEQ ID NO: 19101 - DNA, 201 bp, Homo sapiens
tgactaaattcccatctgttcgatgagtgagaacaaggacaggtcaaggggccgactgtttctatggccagtactctgctactctccacatcatccttcaycccttttccctagaaaaacctctcttccctagatccctgcctttccatttcccaaagtaattttcccctcatattaatatagtattcatttatgttaaaa

SEQ ID NO: 19102 - DNA, 201 bp, Homo sapiens
tttccacttactttccctttcatcatatgataatccaatccagtaattattttcataaatctgagattgaatgaaggcctataatagaaacaaaacatatyaggtgactaaattcccatctgttcgatgagtgagaacaaggacaggtcaaggggccgactgtttctatggccagtactctgctactctccacatcatcct

SEQ ID NO: 19103 - DNA, 201 bp, Homo sapiens
tcccatctctttccctttgaactgtgctatgggttttacattggtttagccaactgtgatttgatcatcttaatttggcctgtgagcctttctgttctctsacctctggaatagtttgcctgggagtgtgcttgaaggatatgattacatcaaggtaattccctctgtgtgacatcttttgcaggtttgcagcccagaact

SEQ ID NO: 19104 - DNA, 201 bp, Homo sapiens
agattcagggtgatcccttcaccctgcaccttatcccaagtgcatcaacttatcccatctctttccctttgaactgtgctatgggttttacattggtttarccaactgtgatttgatcatcttaatttggcctgtgagcctttctgttctctgacctctggaatagtttgcctgggagtgtgcttgaaggatatgattaca

SEQ ID NO: 19105 - DNA, 201 bp, Homo sapiens
tccacagctgctcatcagggtaactggaaacttacagctgtggccaggcttacacattcctgtaagagagaatcttccctgtagacaaacatgtgtgtgckggccacaaaaactttgtgtctgttgggaccccttactcacacgacaagatgtccccatatcatcatcaggagaggattatgcagcagagagagtcaggtc

SEQ ID NO: 19106 - DNA, 201 bp, Homo sapiens
atcataacttcatcactaaaatattttcttttgctcttagtccattaaatagaatcatgacctcttaatcacacccacaatctcccattttattccacacygacaatttttggtcagaaggcaaaagtaccttgcaatattgcaatgaaattatgatatattgctttcttgtgctaattttttttcaataaaagtgagaga

SEQ ID NO: 19107 - DNA, 201 bp, Homo sapiens
tgtcaaaatctgctcttttaagtagttgtcattttgcatgatgtacttttcactacagtttcttagaatttcctgccgttgatgtttttcttgaatacacygaaagactaaaattaatggcatagatataatacaaataagtactcataataattaaatattgaaatttaagacaaaagaaaaaatttcactctgacaacc

SEQ ID NO: 19108 - DNA, 201 bp, Homo sapiens
atcattcatctttagagtaagaaggtaagttttgcattcaaatcctgaaataggatggtttctgttgaaagaaaaattaaaatgtcagccaataagaacayaccaggatttgatgctgagagatgtatgtgtgcctgtctgtgtgtctattggcgtgtgtttattaactaagtgcctaaagcatttagagtgagcctcatt

SEQ ID NO: 19109 - DNA, 201 bp, Homo sapiens
gtattttattactcactatttgtcaccaacactgtgactatcatcagaagaagtaaacagaggatcccaagagtcactgcaatgaggtgccagggcactgraaattctttaaatacaaaaataaggaaaataatcaccaggggaagagcttggctcactactaatcttgacctgagaaaccatttgaaacaaagagacaat

SEQ ID NO: 19110 - DNA, 201 bp, Homo sapiens
ggagcctcttaactacatcatttttgctcacacgacagacacacacaaagaatagttgaagtctctcactctgggctccagcctgtcttcaatatcttagstccaacattgagaaacagagtccaagagaataaaagtgaatgtaaaatacgagttcatctttgtcatctatcttcaaaagggatgatctacaatgttgac

SEQ ID NO: 19111 - DNA, 201 bp, Homo sapiens
atatcttaggtccaacattgagaaacagagtccaagagaataaaagtgaatgtaaaatacgagttcatctttgtcatctatcttcaaaagggatgatctayaatgttgacaagtctgtttacatcccttccagtctttcttctgcatggtaaaataataacagtttactccacaacaggacccgtggtcttcagagaattt

SEQ ID NO: 19112 - DNA, 201 bp, Homo sapiens
ccttaataataatggtcatcataatagataacgtattgaatatttagtaagtagtagaattatatgaccattagcaggcattgtttcctgggagcctcttmactacatcatttttgctcacacgacagacacacacaaagaatagttgaagtctctcactctgggctccagcctgtcttcaatatcttaggtccaacattg

SEQ ID NO: 19113 - DNA, 201 bp, Homo sapiens
accattagcaggcattgtttcctgggagcctcttaactacatcatttttgctcacacgacagacacacacaaagaatagttgaagtctctcactctgggcwccagcctgtcttcaatatcttaggtccaacattgagaaacagagtccaagagaataaaagtgaatgtaaaatacgagttcatctttgtcatctatcttca

SEQ ID NO: 19114 - DNA, 201 bp, Homo sapiens
gttaagtaaattaaaaatgacactgtcatatgcccagaaaaaaattaccaacaaaggccagagccacctgggacattctctgattacagacggggaacaayggacggagcatggttaatatctgcacaatcagtggttactgctgctactcggacgagaaagctgtattttattactcactatttgtcaccaacactgtga

SEQ ID NO: 19115 - DNA, 201 bp, Homo sapiens
ctgattacagacggggaacaatggacggagcatggttaatatctgcacaatcagtggttactgctgctactcggacgagaaagctgtattttattactcaytatttgtcaccaacactgtgactatcatcagaagaagtaaacagaggatcccaagagtcactgcaatgaggtgccagggcactgaaaattctttaaatac

SEQ ID NO: 19116 - DNA, 201 bp, Homo sapiens
aaagaaagatggtggccaggtacagtggctcacacctgtagccccagtactttggaaggctgaagagggctgatcactggagcccaggagttcaagactarcctgggcaacatagtgagatcctatctctaccaaaaaatacaaaaattaccagattatcagggtgtggtggcacacgcctgtagtcccagctactcagga

SEQ ID NO: 19117 - DNA, 201 bp, Homo sapiens
acgcctgtagtcccagctactcaggagactgaggcaggaggatcacttgagcccgggaggttggggctacagtgagctgagatcatgccactgcactccarcctggtgacaaagtgaaatcctgcctctaaaacaatttaaaaaagagagagagagaggaattgaatatctgtaacatagataaccagggctcatgtatat

SEQ ID NO: 19118 - DNA, 201 bp, Homo sapiens
acaaattaaatccacagctgctcatcagggtaactggaaacttacagctgtggccaggcttacacattcctgtaagagagaatcttccctgtagacaaacatgtgtgtgctggccacaaaaactttgtgtctgttgggaccccttactcacacgacaagatgtccccatatcatcatcaggagaggattatgcagcagaga

SEQ ID NO: 19119 - DNA, 201 bp, Homo sapiens
caaattaaatccacagctgctcatcagggtaactggaaacttacagctgtggccaggcttacacattcctgtaagagagaatcttccctgtagacaaacatgtgtgtgctggccacaaaaactttgtgtctgttgggaccccttactcacacgacaagatgtccccatatcatcatcaggagaggattatgcagcagagag

SEQ ID NO: 19120 - DNA, 201 bp, Homo sapiens
tatgataatccaatccagtaattattttcataaatctgagattgaatgaaggcctataatagaaacaaaacatatcaggtgactaaattcccatctgttcratgagtgagaacaaggacaggtcaaggggccgactgtttctatggccagtactctgctactctccacatcatccttcaccccttttccctagaaaaacct

SEQ ID NO: 19121 - DNA, 201 bp, Homo sapiens
aatcctgctatatatgacaacatggatgaaccttgaggacataatgctcagtgaaataagccagtcacagaagaacaaatactttattattccaattatakgagggatctaaaatagttaaactcacagaagcatagaatggtggttgcccaggattggagggaagttcaatggtataaagtttcagtcatgcaagataac

SEQ ID NO: 19122 - DNA, 201 bp, Homo sapiens
ccacatttaaataaaaacattctactagtttctcaaatttaaaagaattcactcatttctccattctcacaacttaaaacaaaaatacttctactactctrccccattatagtttcttatcaccagccaagaacaagaagtacagataggaatcttttttcaaatgtcaaaagtttgacaatccataagaaacaggtgaat

SEQ ID NO: 19123 - DNA, 201 bp, Homo sapiens
ataaccagggctcatgtatatatattgtaagaagaaaagggaagaattggaatatagtcagagatgagattgttcgattgtgttttctctccgggaagaaytggaatatagtcagagatgagattgttcgatcgtgttttctctcctttcctcccccaccctatagctaagagttattagctaatgacaattctttgaaaa

SEQ ID NO: 19124 - DNA, 201 bp, Homo sapiens
tagacaaaaaaagaagggaccaaatagacactaaacatacacaaaataaacatgaggctcatacaaactcaacattcttgaggtcttaaattcaccacccrttggtgatacccattctggcctctgcccaagaaacacaaattaaatccacagctgctcatcagggtaactggaaacttacagctgtggccaggcttacac

SEQ ID NO: 19125 - DNA, 201 bp, Homo sapiens
tactcatttgtggttgtgggagggatcattatggctgacttaggatggtccaatcacttcataccacccaccttcctttatgattttatttcattttatgyacctcataatacatatttctgagcacgtatttagcgtgatacttttaaaattattattaactctttgtggctcatctcttccttttctacctatacttcc

SEQ ID NO: 19126 - DNA, 201 bp, Homo sapiens
ttgtggttgtgggagggatcattatggctgacttaggatggtccaatcacttcataccacccaccttcctttatgattttatttcattttatgtacctcakaatacatatttctgagcacgtatttagcgtgatacttttaaaattattattaactctttgtggctcatctcttccttttctacctatacttcctaaaaca

SEQ ID NO: 19127 - DNA, 201 bp, Homo sapiens
tacccattgttctaattgttactaaagactcctgcttaaaaatgagttaaactgtgtgaaatgagaaaagattctctttagacacaatcatttcacccccscccccccaccaatgttacagtttgaatgctttccagacacttacattccaggagatgtgccattatcaatccatttccacttactttccctttcatcata

SEQ ID NO: 19128 - DNA, 201 bp, Homo sapiens
acccattgttctaattgttactaaagactcctgcttaaaaatgagttaaactgtgtgaaatgagaaaagattctctttagacacaatcatttcacccccgsccccccaccaatgttacagtttgaatgctttccagacacttacattccaggagatgtgccattatcaatccatttccacttactttccctttcatcatat

SEQ ID NO: 19129 - DNA, 201 bp, Homo sapiens
gtatgataggggcgcagtaaaatcttaagccccataagaggaagccttgctatagttccatagttggaatgggtgaagtatttggaagtatttactatgtytaaaatgtaatatatcaaagtgacatattacataatgtctgattaagtgactaaatatattttaaaatacaggtttaaatgtaacttttactgtatcata

SEQ ID NO: 19130 - DNA, 201 bp, Homo sapiens
atggtataaagtttcagtcatgcaagataactaggttctagagatctgctgtacagcgtagtgccaatagttaatgatactgtattgtacacttaaaaacytattaagagggtagatctcgtgttgttaccgcaaatacataaataaatgaaaggacatgaggaaacttttggagatgatggatatatctattactctgat

SEQ ID NO: 19131 - DNA, 201 bp, Homo sapiens
aaaaacaataaaattgaattaagtttttaaaaaagattctagaatgttttctaaataaaagaaaaattttaaaactttttcttttcctcctatattttatmctatattaaacttttaaaatactactcagcctttacaaatagagatggtaaatttctactaattatcatacctaaatgagattaaatatacaaaaattct

SEQ ID NO: 19132 - DNA, 201 bp, Homo sapiens
tcatgcaatctttcattcaagatttcctttgtacctgtattttgcaaaactttaaaaacgatctcattttctctatgacatctgttcttttgtataaggcrtgaatccagttcctttttctgctgaaagctatttttgagaacgtcatattttaaagtcttatttgtcaaaatctgctcttttaagtagttgtcattttgc

SEQ ID NO: 19133 - DNA, 201 bp, Homo sapiens
gactatcatcagaagaagtaaacagaggatcccaagagtcactgcaatgaggtgccagggcactgaaaattctttaaatacaaaaataaggaaaataatcmccaggggaagagcttggctcactactaatcttgacctgagaaaccatttgaaacaaagagacaatatcctctaaaactctgacaaaaatatatcacacaa

SEQ ID NO: 19134 - DNA, 201 bp, Homo sapiens
aaagttattctcaatgcatagtttaacaatgaccacatttgaagggagagagagagagcatagaaaaattagaatgccccttttgattcaaacattgttamtgcatcattgccattaagatttggtaaatacttaaggcacataaaatatctgctatctgcataaaaatgttgtttttaacattgatttttcatttcttac

SEQ ID NO: 19135 - DNA, 201 bp, Homo sapiens
gcttttaaaaacttacatgtattctaatatacatgtaaatataacaaagttcttgcattctttccaactatacttgactctatcagagtgctttccaaaawgtatcgcatataccttctacaaaagaattatttgagggttaatattgcaaattggttaacatgccagactcagtgccttttgcaagatgtactaaataaa

SEQ ID NO: 19136 - DNA, 201 bp, Homo sapiens
ttttaaaaacttacatgtattctaatatacatgtaaatataacaaagttcttgcattctttccaactatacttgactctatcagagtgctttccaaaatgyatcgcatataccttctacaaaagaattatttgagggttaatattgcaaattggttaacatgccagactcagtgccttttgcaagatgtactaaataaaaa

SEQ ID NO: 19137 - DNA, 201 bp, Homo sapiens
ttgcaaattggttaacatgccagactcagtgccttttgcaagatgtactaaataaaaatcacttcggttggagcccagataaatgtattttaaatctcaawtgattccatgtacgttaaaattttagaaataatcttccggtatattgccagagaagcctatgtgaaaataacagttgtcaacaggcagtcattaatgtcc

SEQ ID NO: 19138 - DNA, 201 bp, Homo sapiens
accatattcttttctaatttttttaatttacaaaattttctaacctagtcacattttccctaatttcctaagaaaaagaagtattttctattatagagtcrttcaagatggataaaatatgtaaatcattagacttaagtaaaaagtaattaacccctcaaatctctattctttattttgataacacaaagcaaaaatcac

SEQ ID NO: 19139 - DNA, 201 bp, Homo sapiens
aaatgatcagaattttcaggggagtttacatacgaattcatcttttgggagcattaataatgtaagatgtgccaatgaattttgggaactgtaggcttttrctaatctaaacatggatcctggggtcccaatcccacatttgaaacaagcaaaacctccaagatacccacactacatctaagaggcacagattaaaagttg

SEQ ID NO: 19140 - DNA, 201 bp, Homo sapiens
caccttacttctcagtttagtttatttttaataactcatcatttacaaataagcactaaagtaaaagtcagtttgccaacatttaaccacatatcttctgyatatgaaaatctgaactaagaaagaaacatgaagtgatagcacaattattattggggcagatagactatccgcagcagaaaagagagtaagatccagata

SEQ ID NO: 19141 - DNA, 201 bp, Homo sapiens
ctttgagggagtttctagaaatcaacttttctttctttttcatcaattctatttttctctaaacaatgctatatttatcctttagcttttgagatcctcartgtctgaaagttgtatctctgattatctctatattaaagcagcaaaagttattctcaatgcatagtttaacaatgaccacatttgaagggagagagagag

SEQ ID NO: 19142 - DNA, 201 bp, Homo sapiens
taaatttctactaattatcatacctaaatgagattaaatatacaaaaattctttgtaaactctaaatcctaaacaagtatttagtagttgttgattaaccrggtcaattaattccatcattatgcaagataatagagtttactgtatgagatttaatatttttatatcttaagtgctttcaacggtatcatcgcacagagt

SEQ ID NO: 19143 - DNA, 201 bp, Homo sapiens
gtttcaggaatgtagagaaatatccaacttaaatagcgaaaaagtgcaccataattactgctgcactgcagtcatttctgcaattcccatgtttcttaaayaactatcttgtcagataacacacaatataaagagcaattatgaaaaacagacatttacatatacttctaaagtcttattgggaatatcctgttggcattg

SEQ ID NO: 19144 - DNA, 201 bp, Homo sapiens
cggcagcggaggaaggacaccgatgacaccagccgaagctgcactactagagaccggtagaaatgaatgaggtgccggccgctttccggcagccgcttttrtagtctggaccgcctcctacgccgcagggaacgctgggagccgctctatgacctaatcgccccgcccctcgcgcataggccgcaacgcccgctggcgttc

SEQ ID NO: 19145 - DNA, 201 bp, Homo sapiens
accagcctagcaattcactatcagcaataacaaggctacatgaaccgaagagcatcacgacgatgttactcatatggccgttttggaaccaaacagctttrgtggtaagaacctaaacagtacagtcagcgataacagaacaagggttttctcagaaacacttctgctagcaaacccagctgggggaacgccgcggtagag

SEQ ID NO: 19146 - DNA, 201 bp, Homo sapiens
aaacgcctgctaatccacttatcgagcagttcgacccttggtccttaagtcaaccaggggacacatgaattccttctataggaaagctataaatggtgacrgccattatttgaaggattcaagaaattttcaggattagtaggctaactaaatgaaatcacaccaactgaaataacctaaaacaactcaccaaacaatgat

SEQ ID NO: 19147 - DNA, 201 bp, Homo sapiens
gcacaaacctggatactagttttaaactgctaacttattatactagcagatcctttcttcatgtgttgtccaatacccaaaacagctccagctgaataggrtgagctaacctctatataaaaccaccacaaatgattacatctttagctatgtagtctaaaatctacacattatgcttctaataaaagtaaaaatatatac

SEQ ID NO: 19148 - DNA, 201 bp, Homo sapiens
ttgtgacctctaactgtaatttccttgcttcttctgtatgtttccacctcttgctgcaaaacaaattataacagtcttaaaattcatgacaccacccctasctaaatacgtaattgataagcccctaacttcataatttagtaactagtttaaagtagccttcattttaatctggacccacctatgaacaccctattatga

SEQ ID NO: 19149 - DNA, 201 bp, Homo sapiens
tgtgacctctaactgtaatttccttgcttcttctgtatgtttccacctcttgctgcaaaacaaattataacagtcttaaaattcatgacaccacccctagstaaatacgtaattgataagcccctaacttcataatttagtaactagtttaaagtagccttcattttaatctggacccacctatgaacaccctattatgaa

SEQ ID NO: 19150 - DNA, 201 bp, Homo sapiens
ttgataagcccctaacttcataatttagtaactagtttaaagtagccttcattttaatctggacccacctatgaacaccctattatgaaaaaaaaaatttmttgttatactcaacctaatttaagtaaaaatcccaaagccacctatatccaaaagtgagtcacacctttcccaattatgaagtcagaacatgtaactcta

SEQ ID NO: 19151 - DNA, 201 bp, Homo sapiens
ccagcctagcaattcactatcagcaataacaaggctacatgaaccgaagagcatcacgacgatgttactcatatggccgttttggaaccaaacagctttartggtaagaacctaaacagtacagtcagcgataacagaacaagggttttctcagaaacacttctgctagcaaacccagctgggggaacgccgcggtagagc

SEQ ID NO: 19152 - DNA, 201 bp, Homo sapiens
cacatggctgatgccggccgccctcctaccccaacagcaccagggctttggaagtggtcccctcgctcccacagaatgcccggccaccccaaaaacacctmccgaaacgccgcacctaacagatgttccttcgtctgcctcgaagcgtcccgctttcatccgcacaatacgctccctctcaactccctcaacagctaccaa

SEQ ID NO: 19153 - DNA, 201 bp, Homo sapiens
acgaaatagctcaccggaagtgcgctgctcgcaccccgggacccgcccgggctgccggctgatgtggaccgtccgacccgcgtgtctgataatcctttgasgggttttggtcggcggagaatggtctctaaacttcccaaaccgcccccgtttcacgtcctgtgaaaggaagtgctcctctgatgaccaatcagcggcgag

SEQ ID NO: 19154 - DNA, 201 bp, Homo sapiens
gtgagtcacacctttcccaattatgaagtcagaacatgtaactctaccaaaattgagttatttgcaaaacacctgtcagaatttcatttactagaatccaygatcgagttacagcctgatgaagccacatgaatttactcactgctgtgcgcctagccaaatcagggtgctcttgataaaaattcttctcaaatttaggca

SEQ ID NO: 19155 - DNA, 201 bp, Homo sapiens
ccggccaccccaaaaacacctcccgaaacgccgcacctaacagatgttccttcgtctgcctcgaagcgtcccgctttcatccgcacaatacgctccctctsaactccctcaacagctaccaaatggcagccgccccgacagctccccaatccccacacaaaaagcaagcttgaagacactacaccgtcaaatctcttccaa

SEQ ID NO: 19156 - DNA, 201 bp, Homo sapiens
acagatgttccttcgtctgcctcgaagcgtcccgctttcatccgcacaatacgctccctctcaactccctcaacagctaccaaatggcagccgccccgacrgctccccaatccccacacaaaaagcaagcttgaagacactacaccgtcaaatctcttccaatcactgtgacgtgaatatcaaaatggcgcaagccttcgg

SEQ ID NO: 19157 - DNA, 201 bp, Homo sapiens
cacaatacgctccctctcaactccctcaacagctaccaaatggcagccgccccgacagctccccaatccccacacaaaaagcaagcttgaagacactacaycgtcaaatctcttccaatcactgtgacgtgaatatcaaaatggcgcaagccttcgggaaaggaagtcccaagatagcccggaaaggccaagtccaagccg

SEQ ID NO: 19158 - DNA, 201 bp, Homo sapiens
gatatgaaaaaaatccactgctcgtgatccaagtttgccctttcctaagctgttttaatcaatctgcttcaatggaggagctcacacatacccatctctcytcatttttctggtaagctcatcacatcttcttttggtttccacaaaaacaatggttttattctccttctcactcatgatctcttccattagacgaataag

SEQ ID NO: 19159 - DNA, 201 bp, Homo sapiens
gtagcacttaccagggaaattggcttcataaaaatttagaactggcttcgggcagttgtgacctctaactgtaatttccttgcttcttctgtatgtttccrcctcttgctgcaaaacaaattataacagtcttaaaattcatgacaccacccctagctaaatacgtaattgataagcccctaacttcataatttagtaact

SEQ ID NO: 19160 - DNA, 201 bp, Homo sapiens
ccagctgaataggatgagctaacctctatataaaaccaccacaaatgattacatctttagctatgtagtctaaaatctacacattatgcttctaataaaartaaaaatatatacttacaataggcccatcgcctctctctaggaatggctgatgattgatgtggacaatggcaggaagcaaatactatttagggtgaaagt

SEQ ID NO: 19161 - DNA, 201 bp, Homo sapiens
tcaggctaatggattttggggggaaaaattagtatcagactcttaagagtgaaaacacaattcagtttgatcacatatttcaaaggacacttactcttatytgatccacaatcttccttatttggggttcaaagcccatatcaagcattctatctgcttcatcaaggacaaggtaggttgttcttctcagattggtttttc

SEQ ID NO: 19162 - DNA, 201 bp, Homo sapiens
ctttccagataagggccctgccctacttcctccaaatcgaggtgcaccaaacctggaatgaaaaaaaacgttattcacattttcaaatggctatacccagrtttctgtatagatttgtcatccattggcacaagctaaaaaccactgaaaacagacttcgagaggtaaacctagcactgtccttcgtgaaaatctctctct

SEQ ID NO: 19163 - DNA, 201 bp, Homo sapiens
cttctttccagataagggccctgccctacttcctccaaatcgaggtgcaccaaacctggaatgaaaaaaaacgttattcacattttcaaatggctataccyaggtttctgtatagatttgtcatccattggcacaagctaaaaaccactgaaaacagacttcgagaggtaaacctagcactgtccttcgtgaaaatctctc

SEQ ID NO: 19164 - DNA, 201 bp, Homo sapiens
gtagacttcaagcgacatgctctacaatattcagcagctacttgctgcacctgttgggccagttcccgagttggtgccagcaccaaacactaaggaaagasaaacagctttcagcacaaacctggatactagttttaaactgctaacttattatactagcagatcctttcttcatgtgttgtccaatacccaaaacagctc

SEQ ID NO: 19165 - DNA, 201 bp, Homo sapiens
agtctaataataggagagagaaaggaaaaatcctgagttttaaaagaccattgctagggccacacatttatggtcagcaaaacattaagttcaatttacayggctggaagtcaaagaggaaacgcctgctaatccacttatcgagcagttcgacccttggtccttaagtcaaccaggggacacatgaattccttctatagg

SEQ ID NO: 19166 - DNA, 201 bp, Homo sapiens
tgatgccggccgccctcctaccccaacagcaccagggctttggaagtggtcccctcgctcccacagaatgcccggccaccccaaaaacacctcccgaaacrccgcacctaacagatgttccttcgtctgcctcgaagcgtcccgctttcatccgcacaatacgctccctctcaactccctcaacagctaccaaatggcagc

SEQ ID NO: 19167 - DNA, 201 bp, Homo sapiens
ctgatgccggccgccctcctaccccaacagcaccagggctttggaagtggtcccctcgctcccacagaatgcccggccaccccaaaaacacctcccgaaasgccgcacctaacagatgttccttcgtctgcctcgaagcgtcccgctttcatccgcacaatacgctccctctcaactccctcaacagctaccaaatggcag

SEQ ID NO: 19168 - DNA, 201 bp, Homo sapiens
caagtcgctggaaatggcctcgatgacggcgaagccttgcgggggcggcagcggaggaaggacaccgatgacaccagccgaagctgcactactagagaccsgtagaaatgaatgaggtgccggccgctttccggcagccgcttttgtagtctggaccgcctcctacgccgcagggaacgctgggagccgctctatgaccta

SEQ ID NO: 19169 - DNA, 201 bp, Homo sapiens
tcctccgccgggcggggtaacaaaggcgccgccgccatgtccgaggccggcattttgtactcgcgactcagccacatggctgatgccggccgccctcctaycccaacagcaccagggctttggaagtggtcccctcgctcccacagaatgcccggccaccccaaaaacacctcccgaaacgccgcacctaacagatgttcc

SEQ ID NO: 19170 - DNA, 201 bp, Homo sapiens
cctcctacgccgcagggaacgctgggagccgctctatgacctaatcgccccgcccctcgcgcataggccgcaacgcccgctggcgttccaggatcgccgcsctttcacccctccccgcgccactctctcaggtcagggcccacccaccattggaatgcctcattctgcactctcttgacctcaccttcttctggtctttcc

SEQ ID NO: 19171 - DNA, 201 bp, Homo sapiens
gaaatgaatgaggtgccggccgctttccggcagccgcttttgtagtctggaccgcctcctacgccgcagggaacgctgggagccgctctatgacctaatckccccgcccctcgcgcataggccgcaacgcccgctggcgttccaggatcgccgcgctttcacccctccccgcgccactctctcaggtcagggcccacccac

SEQ ID NO: 19172 - DNA, 201 bp, Homo sapiens
ccgcctcctacgccgcagggaacgctgggagccgctctatgacctaatcgccccgcccctcgcgcataggccgcaacgcccgctggcgttccaggatcgcmgcgctttcacccctccccgcgccactctctcaggtcagggcccacccaccattggaatgcctcattctgcactctcttgacctcaccttcttctggtctt

SEQ ID NO: 19173 - DNA, 201 bp, Homo sapiens
tcgccgcgctttcacccctccccgcgccactctctcaggtcagggcccacccaccattggaatgcctcattctgcactctcttgacctcaccttcttctgstctttccacacctcaagcaagccaccccgccctttcccaagcccagccccgcccaccctcgccactcggagatgtttacgtctccaaagagccctcacgt

SEQ ID NO: 19174 - DNA, 201 bp, Homo sapiens
ctcacacatacccatctctcctcatttttctggtaagctcatcacatcttcttttggtttccacaaaaacaatggttttattctccttctcactcatgatmtcttccattagacgaataagtctaataataggagagagaaaggaaaaatcctgagttttaaaagaccattgctagggccacacatttatggtcagcaaaa

SEQ ID NO: 19175 - DNA, 201 bp, Homo sapiens
cgaagttaaacctaaagctatcccctggatctttctagcaataaacccatgttgaacctaccatgaaaactttcattcactgtgcttttggttacgttgcytcctgattagtcattaattttaatgaggttttttccttgtgttgagtatgaatagaccttacagtttgaggatctctagaattccctgaattattggaaa

SEQ ID NO: 19176 - DNA, 201 bp, Homo sapiens
tcattataaagaagggccttctgattccccctgcctcccaaattaaataaaaaggaacagtcatttgttttcatggaaaaaaaaaaccaaacaaaaacaaraaaaaaaccagaccatcttaagcaaagttttacatgacattatataaaataaagtacaatttccacttaattcagtcttcaaatattttttattggaagg

SEQ ID NO: 19177 - DNA, 201 bp, Homo sapiens
atttctgcaattcccatgtttcttaaataactatcttgtcagataacacacaatataaagagcaattatgaaaaacagacatttacatatacttctaaagkcttattgggaatatcctgttggcattggataaccaatcataggtgcagctgcagtagcaggatatgcatatgcctgttggttcataccattgtgcatatt

SEQ ID NO: 19178 - DNA, 201 bp, Homo sapiens
tgcattttctagtacaaaaaaaacctaaaaattgtttcaggaatgtagagaaatatccaacttaaatagcgaaaaagtgcaccataattactgctgcactrcagtcatttctgcaattcccatgtttcttaaataactatcttgtcagataacacacaatataaagagcaattatgaaaaacagacatttacatatacttc

SEQ ID NO: 19179 - DNA, 201 bp, Homo sapiens
cattcaaggttttactcaccctccaataccatttaaatggatttgtagacaacgatgtgactcgtaactaccaacatttcctatcagtcatccttacctgmacctctgtcttcgaccaactgaagcaacttgggattaattgcttgattagcttcacgaagcacagagataaggtcgctcacttgctttatgttattaggt

SEQ ID NO: 19180 - DNA, 100 bp, Homo sapiens
atttcaaatcactgtacatttacttttgtgaaaacactgcctgcattttytagtacaaaaaaaacctaaaaattgtttcaggaatgtagagaaatatcca

SEQ ID NO: 19181 - DNA, 100 bp, Homo sapiens
aacagacatttacatatacttctaaagtcttattgggaatatcctgttgrcattggataaccaatcataggtgcagctgcagtagcaggatatgcatatg

SEQ ID NO: 19182 - DNA, 100 bp, Homo sapiens
acaaaaaaaacctaaaaattgtttcaggaatgtagagaaatatccaactkaaatagcgaaaaagtgcaccataattactgctgcactgcagtcatttctg

SEQ ID NO: 19183 - DNA, 201 bp, Homo sapiens
taaacagtacagtcagcgataacagaacaagggttttctcagaaacacttctgctagcaaacccagctgggggaacgccgcggtagagctccggatcaacraatcaaaattatataacgcaggaaaaaagaaaaggaggagccggcgactaccgggggaggagtcccggcccgggcggagtcggccgggcggcgttcccgc

SEQ ID NO: 19184 - DNA, 201 bp, Homo sapiens; identical to SEQ ID NO: 930

SEQ ID NO: 19185 - DNA, 201 bp, Homo sapiens
ggacagtttcacataactgtaaagtccaggctgctcgggtctgacccctacagacctgccatgttgaagcccagctttttcgctcccgcacaggtaagaakctgctgatcttctgcagacccgccatgttggggcccagctccccacgccaagtcagaagctgctcatcttctgcaacagggtttggcgccgttcttcagg

SEQ ID NO: 19186 - DNA, 201 bp, Homo sapiens
ttatgatagtttgtacgttacaaatacccaagaaactattttctttacaccattattgccatgactttttgtggacagtttcacataactgtaaagtccakgctgctcgggtctgacccctacagacctgccatgttgaagcccagctttttcgctcccgcacaggtaagaagctgctgatcttctgcagacccgccatgt

SEQ ID NO: 19187 - DNA, 201 bp, Homo sapiens; identical to SEQ ID NO: 926

SEQ ID NO: 19188 - DNA, 201 bp, Homo sapiens
atgtttggccctaaacacctgccttccaggcgcattaagtacgcacagtttgaagtagtaagtcccagggcggttactagctggaaaatactccggtactstatcatggatggttaactagtgcttgccacagcccgcttcttaggtttattaagcacctactccatgccagacactgtgctaggtggtacacaggtaaga

SEQ ID NO: 19189 - DNA, 201 bp, Homo sapiens
ccttcctcagtctgtcatgcccccaagagctcatattccccattttcacaggccagacaccagcagagaaaacactgactccaggagactaaggaccatcytacccctcccaccatttatgggagcggcagcaggccaagggctcagcactatgtaacccacttgtggaggcaatccatctcatctcacagtggctgagac

SEQ ID NO: 19190 - DNA, 201 bp, Homo sapiens
ctccttgggaagctgccagtatttgctgaagcggtccaagagctggcacaagctgaagaggagtggaaacggggagcaggtctggagccagtattcctctyggcacgcgtttgcctctagagtctggatgaagatcctcagactgaggtctacctcttcaacatctaacctcaagaaaggcaggacaaattccttcagcac

SEQ ID NO: 19191 - DNA, 201 bp, Homo sapiens
ctctaaaaattgcttttcttccttgggtgtagagaacttcatccagacggtttctttgaggcatgacaccatgaaagtggcagatgaattgggaccctgcwcttccacaaacctaagggcagggaaggcagtgagaatctggcccaggaacttgtgggtgccgagattgaccacagccaggctgcacattttcttcaccgt

SEQ ID NO: 19192 - DNA, 201 bp, Homo sapiens
ggagccccgtgccagccccgtaccctgggtgggcctgggaggtccactcgtcttctgaaagcttacagatctcaaaaagtgtggctggcacttcacacttsaagtgcccctcgaagaagctcttcagcctcaggcccacagtccagtctagctgttctaacttgcggtggagccaggacagggacttgatccagacatccg

SEQ ID NO: 19193 - DNA, 201 bp, Homo sapiens; identical to SEQ ID NO: 931

SEQ ID NO: 19194 - DNA, 201 bp, Homo sapiens
aggggcatggtggggcacgcgtctgggtctgacctaagcctctttggaggatgggggaactcatctaaggcaggcaggtacttatgggccattgcactaarctgggagagcagggggtcctgcgggtgacccttgtgcttcatcacctcccaccagacgtccaggaagaaggccacgtcttcggcagaagtgtcaacggtc

SEQ ID NO: 19195 - DNA, 201 bp, Homo sapiens
tgctgcggagcacggcctgcaactcctccccccactcccgcagcaggtggtgcaggaactcgcagcccacgaaaatggtctcactggggagtttggccagygaggtcaggctgacatcccgttctgcctccttcaccttctctgccagcgcctgctggtggtagggattctgggtgtccgagttccacacagagatcaccg

SEQ ID NO: 19196 - DNA, 201 bp, Homo sapiens
ggttggccagcgcacagcacttcctccccgggcccaggatccgactctggatctgtgtcagcccgcggagcagcatggccaacaggggcatggtggggcaygcgtctgggtctgacctaagcctctttggaggatgggggaactcatctaaggcaggcaggtacttatgggccattgcactaaactgggagagcagggggt

SEQ ID NO: 19197 - DNA, 201 bp, Homo sapiens
ccgtgctcgttttcctcaggaagtccctgacacactccgccagctcagagaccacctgcctgtcctccttggacaggctggtgcggttcaggtagagcgtygcgttctggctgaaggaagtcagactgtcgcacagccggtagctgtcgtaacttgtcccctggctgctgcggagcacggcctgcaactcctccccccact

SEQ ID NO: 19198 - DNA, 201 bp, Homo sapiens
tgagtgagctggttaaaagttgtattgaggtcttcctgaaaaccctccacataagccagcaacttttcagagaggccctttcgcccccaggaacgcaggayacctgcaaggactttatttttacctggcagggagaggtctgcgtaacattccaggatcaggtggatcacctgccggatctgagactcagggatggctctg

SEQ ID NO: 19199 - DNA, 201 bp, Homo sapiens
gaagtgcccctcgaagaagctcttcagcctcaggcccacagtccagtctagctgttctaacttgcggtggagccaggacagggacttgatccagacatccrgggagaaggtctcagcattggctgatacaatctcacacaggagctccaggatatggatcgctagatccttcctatccaaagagaggcaccgcttctcctt

SEQ ID NO: 19200 - DNA, 201 bp, Homo sapiens
acaatctcacacaggagctccaggatatggatcgctagatccttcctatccaaagagaggcaccgcttctccttgggaagctgccagtatttgctgaagcrgtccaagagctggcacaagctgaagaggagtggaaacggggagcaggtctggagccagtattcctctcggcacgcgtttgcctctagagtctggatgaag

SEQ ID NO: 19201 - DNA, 201 bp, Homo sapiens
agggccaccagaaagcctttgctgaacagtctgacctcctcaggattgcccacgtccaccaccaagagagacagcatcctctccgagatgccgctggagamgcagcagcactccatccaggccaggagccccgtgccagccccgtaccctgggtgggcctgggaggtccactcgtcttctgaaagcttacagatctcaaaa

SEQ ID NO: 19202 - DNA, 201 bp, Homo sapiens
ctgccacagaggagtttgaccacgtggttccagccttccagaggaagccaatcacgacagctatggctgcagagaaactggaaagtcctcaggaagaggayggagagttgcaactcctgggcaaagggcttcaggttgagcaggggaacaaactgaatatattccaggctataagggacatggaggagctgcttctccagc

SEQ ID NO: 19203 - DNA, 201 bp, Homo sapiens
gctacttggggggctgaggcaggtggatccctgaggccaggagttcaagactagctggggtaacacagtgagactccccctccatctccgaaaaaaaaaaagggatgtgatcttggtcagattgcttctccaagccttccttctgcatatgtggggataatacagacttcatgttatgcctttggggatcatgtgatatat

SEQ ID NO: 19204 - DNA, 201 bp, Homo sapiens
tgggcacagagcgatcacacggccacaggataatgggcacagagcaatcacacagccacagggtaatgggcacagcagcaatcacgcagccacagggtaaygggcacagcagcagtcacacagccacagggtaatgggcacagagcaatcacatagccacagagcaatgggcacagaaggaatcagacaagccctgccttc

SEQ ID NO: 19205 - DNA, 201 bp, Homo sapiens
atcacacagccacaggataatgggcacagcagcaatcacacagccacaaggtaatgggcacagcagcaatcacacggctacagggtaatgggcacagagcratcacacggccacaggataatgggcacagagcaatcacacagccacagggtaatgggcacagcagcaatcacgcagccacagggtaatgggcacagcagc

SEQ ID NO: 19206 - DNA, 201 bp, Homo sapiens
aatcacacagccacaggataatgggcacagcagcaatcacacagccacaaggtaatgggcacagcagcaatcacacggctacagggtaatgggcacagagygatcacacggccacaggataatgggcacagagcaatcacacagccacagggtaatgggcacagcagcaatcacgcagccacagggtaatgggcacagcag

SEQ ID NO: 19207 - DNA, 201 bp, Homo sapiens
gccacaggataatgggcacagcagcaatcacacagccacagggtaatgggcacagaagcaatcacacggctacaggataatgggcacagagcaatcacacrgccacaggataatgggcacagagcaatcacacagccacaggataatgggcacagcagcaatcacacagccacaaggtaatgggcacagcagcaatcacac

SEQ ID NO: 19208 - DNA, 201 bp, Homo sapiens
gccacagggtaatgggcacagagcaatcacacggccacagggtaatgggcacagcagcaatcacacggccacaggataatgggcacagcagcaatcacacrgccacagggtaatgggcacagaagcaatcacacggctacaggataatgggcacagagcaatcacacagccacaggataatgggcacagagcaatcacaca

SEQ ID NO: 19209 - DNA, 201 bp, Homo sapiens
gataatgggcacagagcaatcacacggccacaggataatgggcacagagcaatcacacggccacaggataatgggcacagagcaatcacacggccacaggrtaatgggcacagagcaatcacacggccacagggtaatgggcacagagcaatcacacggccacaggataatgggcacagagcaatcacacggccacagggt

SEQ ID NO: 19210 - DNA, 201 bp, Homo sapiens
ataatgggcacagagcaatcacacggccacaggataatgggcacagagcaatcacacggccacagggtaatgggcacagcagcaatcacacggccacaggrtaatgggcacagagcaatcacacggccacaggataatgggcacagagcaatcacacggccacaggataatgggcacagagcaatcacacggccacaggat

SEQ ID NO: 19211 - DNA, 201 bp, Homo sapiens
gccacagggtaatgggcacagcagcagtcacacggccacagggtaatgggcacagagcaatcacacggccacagggtaatgggcacagcagcaatcacacrgccacaggataatgggcacagcagcaatcacacagccacagggtaatgggcacagaagcaatcacacggctacaggataatgggcacagagcaatcacac

SEQ ID NO: 19212 - DNA, 201 bp, Homo sapiens
ggccacagggtaatgggcacagagcaatcacacggccacaggataatgggcacagagcaatcacacggccacagggtaatgggcacagcagcaatcacacrgccacagggtaatgggcacagcagcagtcacacggccacagggtaatgggcacagagcaatcacacggccacagggtaatgggcacagcagcaatcacac

SEQ ID NO: 19213 - DNA, 201 bp, Homo sapiens
agaatcttgtcactattctttgcctcccccagctcagaaacatcaaaggatgtaggtctttatcaggtatgtttcctttggcccagaaactaaaacgaggktgcaaacactgctccctattcctcattcctgagtcatctcccctttcccaggagtgagagatgctactccttcctcagtctgtcatgcccccaagagctc

SEQ ID NO: 19214 - DNA, 201 bp, Homo sapiens
gcgcctgctggtggtagggattctgggtgtccgagttccacacagagatcaccgtggccagtttgtccagatacacggttgcagacacctcctgggggtcrtcctctgtcagcgcaaacacagtcagcatgtcagccaggttggccagcgcacagcacttcctccccgggcccaggatccgactctggatctgtgtcagcc

SEQ ID NO: 19215 - DNA, 201 bp, Homo sapiens
atcaggtggatcacctgccggatctgagactcagggatggctctgtcagctgtgctgacgtctatcactgtttccagcagcctcaacaccaagtctggctstcggaagagggccctgttactccccaggcaggctacccactcgtccgagaaggcccacttcttctcagaggcaaaaatgtagcacacttccatatggcgg

SEQ ID NO: 19216 - DNA, 201 bp, Homo sapiens
ttcaccgtgacttccgggtgcactatgaccaggcgggccacggaggccacagcttttgccaagccctgttcggaggcactctgagtgagctggttaaaagwtgtattgaggtcttcctgaaaaccctccacataagccagcaacttttcagagaggccctttcgcccccaggaacgcaggatacctgcaaggactttattt

SEQ ID NO: 19217 - DNA, 201 bp, Homo sapiens
caggcccacagtccagtctagctgttctaacttgcggtggagccaggacagggacttgatccagacatccggggagaaggtctcagcattggctgatacartctcacacaggagctccaggatatggatcgctagatccttcctatccaaagagaggcaccgcttctccttgggaagctgccagtatttgctgaagcggtc

SEQ ID NO: 19218 - DNA, 201 bp, Homo sapiens
agcagcactccatccaggccaggagccccgtgccagccccgtaccctgggtgggcctgggaggtccactcgtcttctgaaagcttacagatctcaaaaagygtggctggcacttcacacttgaagtgcccctcgaagaagctcttcagcctcaggcccacagtccagtctagctgttctaacttgcggtggagccaggaca

SEQ ID NO: 19219 - DNA, 201 bp, Homo sapiens
gggccagctgcctgtatcgccctgactgagtccaggaggcgggtcagactgccacagaggagtttgaccacgtggttccagccttccagaggaagccaatyacgacagctatggctgcagagaaactggaaagtcctcaggaagaggacggagagttgcaactcctgggcaaagggcttcaggttgagcaggggaacaaac

SEQ ID NO: 19220 - DNA, 201 bp, Homo sapiens
gcccagctccccacgccaagtcagaagctgctcatcttctgcaacagggtttggcgccgttcttcagggccgatgccctcagcaatggactttaagaagcrctgctcgtgtgccctctggagcaaggagctgacagaagggttggtcttgctcaaagtctcatagcaggtgagggtttccaaggctaaaacgtagagtggc

SEQ ID NO: 19221 - DNA, 201 bp, Homo sapiens
tcacacggccacaggataatgggcacagagcaatcacacggccacagggtaatgggcacagcagcaatcacacggccacagggtaatgggcacagcagcartcacacggccacagggtaatgggcacagagcaatcacacggccacagggtaatgggcacagcagcaatcacacggccacaggataatgggcacagcagca

SEQ ID NO: 19222 - DNA, 201 bp, Homo sapiens
gataatgggcacagagcaatcacacggccacagggtaatgggcacagagcaatcacacggccacagggtaatgggcacagagcaatcacacggccacaggrtaatgggcacagagcaatcacacggccacagggtaatgggcacagcagcaatcacacggccacagggtaatgggcacagcagcagtcacacggccacagg

SEQ ID NO: 19223 - DNA, 201 bp, Homo sapiens
gataatgggcacagagcaatcacacggccacaggataatgggcacagagcaatcacacggccacagggtaatgggcacagagcaatcacacggccacaggrtaatgggcacagagcaatcacacggccacaggataatgggcacagagcaatcacacggccacagggtaatgggcacagcagcaatcacacggccacaggg

SEQ ID NO: 19224 - DNA, 201 bp, Homo sapiens
ataatgggcacagagcaatcacacggccacagggtaatgggcacagcagcaatcacacggccacagggtaatgggcacagagcaatcacacggccacaggrtaatgggcacagagcaatcacacggccacaggataatgggcacagagcaatcacacggccacaggataatgggcacagagcaatcacacggccacagggt

SEQ ID NO: 19225 - DNA, 201 bp, Homo sapiens; identical to SEQ ID NO: 933

SEQ ID NO: 19226 - DNA, 201 bp, Homo sapiens
atacgtaccatgtaatgctttttccactcacatggtttcaactttgggcttatttgccaaaatctaggatggaaaagtccagttatgaacatgttcctccyggctggatttgatcttgaagacactaaacccaatttcagagcatatttaatcctgggctattgctgaggccgacttagaagagacaaagtgagatgcgaa

SEQ ID NO: 19227 - DNA, 201 bp, Homo sapiens
agtttgtacgttacaaatacccaagaaactattttctttacaccattattgccatgactttttgtggacagtttcacataactgtaaagtccaggctgctygggtctgacccctacagacctgccatgttgaagcccagctttttcgctcccgcacaggtaagaagctgctgatcttctgcagacccgccatgttggggcc

SEQ ID NO: 19228 - DNA, 201 bp, Homo sapiens
ctgatcttctgcagacccgccatgttggggcccagctccccacgccaagtcagaagctgctcatcttctgcaacagggtttggcgccgttcttcagggccratgccctcagcaatggactttaagaagcactgctcgtgtgccctctggagcaaggagctgacagaagggttggtcttgctcaaagtctcatagcaggtga

SEQ ID NO: 19229 - DNA, 201 bp, Homo sapiens
ccagacggtttctttgaggcatgacaccatgaaagtggcagatgaattgggaccctgctcttccacaaacctaagggcagggaaggcagtgagaatctggsccaggaacttgtgggtgccgagattgaccacagccaggctgcacattttcttcaccgtgacttccgggtgcactatgaccaggcgggccacggaggccac

SEQ ID NO: 19230 - DNA, 201 bp, Homo sapiens; identical to SEQ ID NO: 2425

SEQ ID NO: 19231 - DNA, 201 bp, Homo sapiens
aaggggctatggagtcagtgggaagtgggccagtagcagacaggagagttgcctggcataggcagtaggtgtgaatgcaagctgtgatatttcagcagagrcctggaattcagtcataaacagaaaagaaagaaaacactaaatattgttccaatgcaattgtatcaaaaacagtaataactgtcagttactgcatgttgg

SEQ ID NO: 19232 - DNA, 201 bp, Homo sapiens
gacagcaacctcgaattgacttcagttgccaagagcattgggcacttcccccacaaggtgaaaagatcatcctgtgtccactgctctgtggcttggcatgyctcgatgctggcttctcagacaggccctgcacgggtggctcttcttgccaactttaccccattctctgaagggcactgggagatggaggggaagaggttg

SEQ ID NO: 19233 - DNA, 201 bp, Homo sapiens
ccccgctgaatgacagcaacctcgaattgacttcagttgccaagagcattgggcacttcccccacaaggtgaaaagatcatcctgtgtccactgctctgtrgcttggcatgcctcgatgctggcttctcagacaggccctgcacgggtggctcttcttgccaactttaccccattctctgaagggcactgggagatggagg

SEQ ID NO: 19234 - DNA, 201 bp, Homo sapiens
atggtgggcagggtatagccccgctgaatgacagcaacctcgaattgacttcagttgccaagagcattgggcacttcccccacaaggtgaaaagatcatcmtgtgtccactgctctgtggcttggcatgcctcgatgctggcttctcagacaggccctgcacgggtggctcttcttgccaactttaccccattctctgaag

SEQ ID NO: 19235 - DNA, 201 bp, Homo sapiens
tttgttctgagggttccataagtttattttttgttatattattaatttaaatcagttttgtagagcattatagaaattaaaaaagcacaaagaagaaaacraaagtcactcaaaaactaagcattgtaaccatctttgggtatatccttttttaaaatagatgtggggggtgggggcaaaatgggataattcgaaataaac

SEQ ID NO: 19236 - DNA, 201 bp, Homo sapiens
cccctattgaggctctgagctaatatcctcccaaaatagacatgaaccacaaggagaattttttaaaagccaaatgataacaccacgttctttccggatgyggggctggagcgctcattccctttcccaggaagctcagccttatccccatgaagagctgggggggcggggagggcgggaataaaatggctcctgagattt

SEQ ID NO: 19237 - DNA, 201 bp, Homo sapiens
cgtggagtgacgctgcccggggccaaggagggcatcctcttctacatcacacccaacttccgcaagctgtctgactccgaggtgagtgcccctcccagccyggattctgagccaccacttagcagctttgagataagcttttgcatctttctgaccctcactgtagaccaggtttgttgccagggagagctggtgggcaca

SEQ ID NO: 19238 - DNA, 201 bp, Homo sapiens
taactttctcctccctccactgtttgaccaggcgcaacatgcatcagatgacggacgggctggataagccaggtcagatccgctggccactggccatcackctggccatcgcctggatccttgtgtatttctgtatctggaagggtgttggctggactggaaaggtaagggatatatgtgcacagtggggacaggagggca

SEQ ID NO: 19239 - DNA, 201 bp, Homo sapiens
catatgatccagcaattctgcttctgagtagatacctgaagaattacaagcagctctcaaagagatatttgtacactcctgttcacagcagcactattcayagtaggcaaaaggtggaagcaagccaagcgttcactgataaatgaattggtaagcaaaatgtggtctatacatacaatggaatgtaattcagccttaaaa

SEQ ID NO: 19240 - DNA, 201 bp, Homo sapiens; identical to SEQ ID NO: 2412

SEQ ID NO: 19241 - DNA, 201 bp, Homo sapiens
ctgcacccctgctgccctctgtaggagctgcctgcctgccccatcgctgcttcaccatccctcctctcctccccttctctgctttgcaggatctcacccarggtggcagaaggaggccttctggagctgacccacccccgacgaccatcaggtaacgtcaacagccccggtaacaacatccatgagtggagttctctctct

SEQ ID NO: 19242 - DNA, 201 bp, Homo sapiens
gggagataatggcgttgcacaaggcagagcgatgtgtgttgaatgctgattcaggacctgctagagtgagagtgagtacaagaggagagtggaggggaccrtgtctagaactcgagcttccccaagaaggaggtgcgggactggtaggggtggggcaaattgccttctctacttccatccttcctacagccttgtcagaat

SEQ ID NO: 19243 - DNA, 201 bp, Homo sapiens
gccatgcccaggcaagagggcagggatcactcacctctgcctttggactgttgccatgctggagattgtgaaatatcatgagttctaggagcttccctctkgggtgcagggggaggcaagagacctgagggtttgacagttccctggctggatggtggggagagaacttgtccagctgggccctgacagtgagttcagagg

SEQ ID NO: 19244 - DNA, 201 bp, Homo sapiens
taggctgaaatccaagttcaccaggtagccccttgagaaggagcccagatgaggccagatctggtaggaggcagagcacagagcactcaaagatcgagacktacaagagagcgtgggaaggcacggctgtgaggctggggagaaaagggccgtagcatcttgtaaccttacctgagctctggccagagattaacatctcct

SEQ ID NO: 19245 - DNA, 201 bp, Homo sapiens
gccccaatgccaaacccagttagagccacttcatcccctctctgcccaaatgaaaactaaaatgcaagcgtcagcaggcctgtctatgcctgtgtcgggastaccccttcaattcacccgtgcaacgtcgcctgagcttctctgtgcctggagaatggtgggcagggtatagccccgctgaatgacagcaacctcgaattg

SEQ ID NO: 19246 - DNA, 201 bp, Homo sapiens
tggaggcttgatgagaagtgggtctccaggaacttagatggggctgggaaggatgtctggagaccaaggagtaggtagcttagagggtaaagatgaggcamaatcaagtccatcgaagccaaaagatgcacagtggccacgtctctcctgcctgccacggattttacatgcctggtgaccccggagcagcagaggctataa

SEQ ID NO: 19247 - DNA, 201 bp, Homo sapiens
tgcccttagaagtgggagtccctgggggagtgggacagaccttttcccagagcagccctggcaaaatggctgagcctcccttgagcctcagaaataaatcrtcaggcaggcagcaaacaaagaaagagctctgtctccagccaagcactggctcagtggccagtccttggaggacaaacagtgagtcccaagcagagagac

SEQ ID NO: 19248 - DNA, 201 bp, Homo sapiens
ccacatcctgattcatcctgaaaaccagcctgatctacttacgaacctagagtcactcggaataaacatgcacacacactctggccatagtgaaggccgtrctgattgtatcttcaggggagtaccttgtagagatgtgtgtcgggggtcactgatgtgacacaatgaggtgctggggcccaaatctctctggcatgaagg

SEQ ID NO: 19249 - DNA, 201 bp, Homo sapiens
gaccagggctgacatcacatatccatccaccaggtgcatatctgagcagagtgagggctgttgcaaggggccaggtggcagatgacagtgctggtcagaarctagggaggtggaggtggagaggcccaatccagagtcccccgcacatcagcctgctctgtcctgttagcccatctatttcctctgcaagggctgggtgtg

SEQ ID NO: 19250 - DNA, 201 bp, Homo sapiens
ttgctttggtacaaagagagcccaaagccaagagacttggcatttctgttagctggtattccccagggtgactaaaaggatgatttccattggattttttwaaatgctgaagacactgaaagacctgaatagtaagcccgtaataaacgttattcggtattattattgttgttgttgtagccttctgggaagttgcgaatg

SEQ ID NO: 19251 - DNA, 201 bp, Homo sapiens; identical to SEQ ID NO: 2423

SEQ ID NO: 19252 - DNA, 201 bp, Homo sapiens
ttcctctcacactggactccaaccaccttgggcaccttggtgtctttcaaaagtgccaggctccttcctgcctcagggcctttgcacttgctgctccctcygtttgaaatactgtatcccagagagtcccatttctggctcctaattcagactgaattttttttttttttttttttttttttttgctcaggccaaataaaa

SEQ ID NO: 19253 - DNA, 201 bp, Homo sapiens
tttctctcctcctctccttccatacccttttctctcctttcccctccttcccaccctcctctctctccatccctctccactctttcaaatccacccagggrgatgcctctgagttcctgtgtctgatcccagggttcgatgttcctcatcctgcagcagacgtctctgcgggcacccaccagccccagcatgcgctccagg

SEQ ID NO: 19254 - DNA, 201 bp, Homo sapiens
ccattttgtttgtttccgcaaacctgtttgagcaaatccacccccagagatagcaacctgtttctgggtcccctgagagagagggtcatttgtttgctgckgtttctggggctggatgccaagctatgaggcaatgagctgacgaccttggatcctgacacccctattctatgcaggcaggagaagggtcagggagactga

SEQ ID NO: 19255 - DNA, 201 bp, Homo sapiens
ctgtgcagatgacgccactcaccatgggaaactatgttttccccaagtggggccagggtgtgggctggctgatggctctgtcttccatggtcctcatcccygggtacatggcctacatgttcctcaccttaaagggctccctgaagcaggtaagcccttccccacccttcaaattgccagtgcccttctcccactgtgtca

SEQ ID NO: 19256 - DNA, 201 bp, Homo sapiens
ttggatccaggccctgcatctggtggaaactctgctggtctttcttcacaccaatcattgtggcggtaagaacaaggcctgactagccctgttaggatgargctagaccaagccctggggggactcaggtccagggagaaacttctagaggcagaggcaggtgggagaggcccccagaaaccctgttccttaataatactt

SEQ ID NO: 19257 - DNA, 201 bp, Homo sapiens
agagcagttaaatgaattcatttaaaataagtggagattttatccagaaaagggaaaccaaaactactttttaaagttttaaagttatatatttaacacartctaggctgtaattaaaagtgtgcactatcttaaaacaaataacaaaagaaacattgattttgtttattttgtggcctaagtttcttgagccaactgcat

SEQ ID NO: 19258 - DNA, 201 bp, Homo sapiens
aataagattgtagaggtcatggaacatgccacgacagttcatgttaattccgtattaaatggacgcgtgtctgtgttccgctcccaggcgtgggccttgcrgctgctgtgctatcattctggctgaacatctactacatcgtcatcatctcctgggccatttactacctgtacaactccttcaccacggtgagtggtccct

SEQ ID NO: 19259 - DNA, 201 bp, Homo sapiens
ctcctgcctgccacggattttacatgcctggtgaccccggagcagcagaggctataaatttttttacacgtggcccagcacacagcaggacctcaataaayctcttagaataaagcctgcatggatggaaggtgatgctatcactggcatggacctacctgcaatctgtacctgtctcactgagccaggaaggctataaaa

SEQ ID NO: 19260 - DNA, 201 bp, Homo sapiens
gagggtaaagatgaggcaaaatcaagtccatcgaagccaaaagatgcacagtggccacgtctctcctgcctgccacggattttacatgcctggtgaccccrgagcagcagaggctataaatttttttacacgtggcccagcacacagcaggacctcaataaacctcttagaataaagcctgcatggatggaaggtgatgct

SEQ ID NO: 19261 - DNA, 201 bp, Homo sapiens
gagccaaaaaggctgctaccccagtcccccaaattccaaaacaaaagaggtcagtgaaagctactcgcattttgcatgttatctctttatctttggagcayattgggaaggactgacccagctccagatcagggtctgattggggcaggacagaccctctccaaggcagagaaggggaaaaagaacttgcccttagaagtg

SEQ ID NO: 19262 - DNA, 201 bp, Homo sapiens
gggtgagaggacagcatgaaagtgggagtggaagctgagggctgattgggagttgttgcaataacccaagtgagaggggctgtggcgtggcccatgtgggrcagtggcaggggtgcaggaggtggggatgtggctggagtctgggtgtagtttggaggcagagcagacaggatgcacttgaatagagagcaggagagggaa

SEQ ID NO: 19263 - DNA, 201 bp, Homo sapiens
cgataaatactactgacaaagacacctgcttctgcaaattccctctcaggtacgttgaggcagctgaggggtttataccaaggcatgaaactgctttcctycatctcttgagtaagagtatgcggctggctgggagttgggagtccataaggttcaggccactctcaggctgtgtgaccttgggccagccaccagtccttg

SEQ ID NO: 19264 - DNA, 201 bp, Homo sapiens
ccctttcccaggaagctcagccttatccccatgaagagctgggggggcggggagggcgggaataaaatggctcctgagatttgtgacaccccaaaaatcakagacggtatcagactgagtggcattgggggtctacctttgtttttctatgacacacaaggtgggtgtttggcaagagagtagggatgttgggtgctggat

SEQ ID NO: 19265 - DNA, 201 bp, Homo sapiens
tcttgctgaactgggcacggtgctagaaaattcaaatccagtcatcacagagtgggaagtgcttactattgacctcctttattgatgaagaaacaaaaacttttttttttttgagacgaagtctcgctctgtcatccaggctggagtgcagtggcgcgatctcagctcactgcaagctctgcctcccgggttcatgccatt

SEQ ID NO: 19266 - DNA, 201 bp, Homo sapiens
tctccccacaacagccatagcctcacaaatttagcatctcctgtgagacaggcactccttgcaggctcacatccaatcctcatgacacccctctaaagtgsgtattgttagcacattttatatggacacagacagcctgggttcaaatcctgactctactatataccagctgtgcaacttcagaaaagagacttaacctct

SEQ ID NO: 19267 - DNA, 201 bp, Homo sapiens
tcaaagaagtatgagttatatcaattcatggctttactttgtttatcttcatatgtgccacatcttctaaaaggaaaactccaaatatagtcatgtggctyctcctagggaattataggcatttggctgaatctgaatacatatccccgtattccagaaattggaaatcacatgtatgtcttctttatggtgaggtcttca

SEQ ID NO: 19268 - DNA, 201 bp, Homo sapiens
ggtcagctgagccgagttagagctatgcccctcatttgttctctgcgggctacggcggggtcgggtgcgacttgaggatgggacgtctctgggacagcccragctctcagaaacgttggcttaaaagcacaccggggcttgggctgagtgcaccggagctaagcctagtgcaccagagctcgcgccgcgctctcccagccc

SEQ ID NO: 19269 - DNA, 201 bp, Homo sapiens
ttgcatgccccttccctcccgcggtgccccactggccccgcaagttggcactggattctgctggagccgtcgaagctccctattcattccccagggcatgraggggacgcggagtgaatgacaagagcagcgttggggggccgtgcgccactttcccaatcctggggtcagctgagccgagttagagctatgcccctcatt

SEQ ID NO: 19270 - DNA, 201 bp, Homo sapiens; identical to SEQ ID NO: 2424

SEQ ID NO: 19271 - DNA, 201 bp, Homo sapiens; identical to SEQ ID NO: 2422

SEQ ID NO: 19272 - DNA, 201 bp, Homo sapiens
cagcggtaggaagggccaagacatacctgaggccagggtgtgagctgacggggcaggatggcgaaggcagtagggggtccatccattcagcacacatggayggaaccctgatgatgtgccagacactactgtcagtgctggggacacagccatgaacaagataagcagaaattgcaccctcctggagctcccattcaggga

SEQ ID NO: 19273 - DNA, 201 bp, Homo sapiens; identical to SEQ ID NO: 2421

SEQ ID NO: 19274 - DNA, 201 bp, Homo sapiens
gaggtgtgtgcaggctgaaaagatgccacggggagaagtggagagtcggagtgtgagggctgccccggaaggccctggatgagttgctgtccactatagtkccctgggaaatgcacctgccagacccaggggaagcgctctcaggtctgagatacagggaagcctggctgcaggttatgtgctgccgtggagttactggcc

SEQ ID NO: 19275 - DNA, 201 bp, Homo sapiens
ttgatgaggtgtgtgcaggctgaaaagatgccacggggagaagtggagagtcggagtgtgagggctgccccggaaggccctggatgagttgctgtccactrtagtgccctgggaaatgcacctgccagacccaggggaagcgctctcaggtctgagatacagggaagcctggctgcaggttatgtgctgccgtggagttac

SEQ ID NO: 19276 - DNA, 201 bp, Homo sapiens
tgacaagagatgaggttgggatgtaagaaggtccagccagatcatgaagggctttgaaaaccaggacaagaactttgaactttatcctggcagcaatgggktgtcatgaagggcttggaacagacggagggtgggatcacatttgcccagggctcactctagatctcatttgtagggttgatatagagaaaatgtggtctt

SEQ ID NO: 19277 - DNA, 201 bp, Homo sapiens
catccagatgagcagtagtggtggctgactaaggccctggcaggtcctgttctctttgatctcttgaccaaacagcactttctactgattagtataatggrcctcacagtccccagctacctcttgaatcacggtgatgacggtgtcagcacagttctagggcggggatatcatctgtggccatgccctgggcacccctgg

SEQ ID NO: 19278 - DNA, 201 bp, Homo sapiens
tgctgagaggagagagagatgcaagggccttgaaaggctggccagggagtttgggcttcattctgagaacaagcgggtgctattcatcgcagtaagcagargagtgacatgatcagacttgcaatttagaaggctctctggggctggagaggggatagagcaaaactgaaggcagggtcccactaggaggccactgggcca

SEQ ID NO: 19279 - DNA, 201 bp, Homo sapiens
aggtcgggagtggcatctagaagagaaaactgcagggcaggcaggtgctggagagaaacagtgtgaaggctgggaggcagatgaggtcaggccaggcaccrgcaaacagctgcagtgagtgctgagaggagagagagatgcaagggccttgaaaggctggccagggagtttgggcttcattctgagaacaagcgggtgcta

SEQ ID NO: 19280 - DNA, 201 bp, Homo sapiens
cctcctggggactctgattagagcctgcagccccacagctcagccagaatcccacgtgacctcccggggtctccctggatacctgtaggctttgtccagcrcaaccgtagaagccattttggagccagaactcagaggctctcatgctagcagcctctcttgggtttcttaaaaagaacagcaggccttgtccttgtggag

SEQ ID NO: 19281 - DNA, 201 bp, Homo sapiens
taaagagtgatttttttaaagctagttttcttataaagcccaaatcagaatgaccttgacccaaatgaggctcctttgcacacatgtgcgtacatgcacasgttaacacttatgtagaatttcagttttcaaagtgttttctcagtcgaagcttgtgacagccctgggaacttcaagtgaaggtaattttattgttattat

SEQ ID NO: 19282 - DNA, 201 bp, Homo sapiens
gggccagggtcaggctgtcttcttcaggtacaagcaacatgaccttcctggacagcttagccccaggttctgaaacaagccatgacctggatgaagagccrggttttccacttgctgaggcaccacaggcgactcctttgccctctctgagcctcagtttgcacatctgcaaaatggggaggataagggccatgatggctg

SEQ ID NO: 19283 - DNA, 201 bp, Homo sapiens
accagcacctgcccctccatcccctacatatctctctatctggttgcctctctgcacctgcactatcctcactactggccaagccatgccatcccccatcragatgatggccacagctcctcactggtcctcttgcctctgggcacaattactatggccccacatcccccaccctctttctgcacctggaaaaaggggctg

SEQ ID NO: 19284 - DNA, 201 bp, Homo sapiens
accgtgtccggcagattgccagtttcttatagcatctgaccatcagggagaaacagcccctgcccaggaaagcctttgaaggaatggctgggatagatgtygagtgggagggacattgagagtggcaggggtggaggggatcatcatgtcagtctccttttgttggtagatatcttcacattaaagtgacttgctcaccta

SEQ ID NO: 19285 - DNA, 201 bp, Homo sapiens
tcttcacaccaatcattgtggcggtaagaacaaggcctgactagccctgttaggatgaggctagaccaagccctggggggactcaggtccagggagaaacytctagaggcagaggcaggtgggagaggcccccagaaaccctgttccttaataatacttctctctaccatttgttgggcatctattctgcaccctgcatgg

SEQ ID NO: 19286 - DNA, 201 bp, Homo sapiens
ccaacttccgcaagctgtctgactccgaggtgagtgcccctcccagcccggattctgagccaccacttagcagctttgagataagcttttgcatctttctraccctcactgtagaccaggtttgttgccagggagagctggtgggcacatggaaaagttcctggatagctgcggctatggtgattacttttgacagtcttt

SEQ ID NO: 19287 - DNA, 201 bp, Homo sapiens
gggcctggggtccctgatcgctctcgggagctacaactctttccacaacaatgtctacaggtttgagaggacagctgcgggagccccttccttcctggccsagccctttgagtccacatcccacactcatgtgttagggccctctttggccactttgcactctcagcttaacctctccctgagccagtcgtttgtttaact

SEQ ID NO: 19288 - DNA, 201 bp, Homo sapiens
gaggaggggtcaccagtcacccactttcctcccaggtggtctacttttcagccacatacccctacatcatgctgatcatcctgttcttccgtggagtgacrctgcccggggccaaggagggcatcctcttctacatcacacccaacttccgcaagctgtctgactccgaggtgagtgcccctcccagcccggattctgagc

SEQ ID NO: 19289 - DNA, 201 bp, Homo sapiens
cgctgcttctccaactacagcatggtcaacactaccaacatgaccagcgctgtggtggagttctgggagtgagtatggggccatcaggggatggcagggayggggcatgtcagccagagcccggcaggagacagaggcccctcggaggggtaacagaagaggtggataaaggggctacagtcatgtgtcacatcatgacat

SEQ ID NO: 19290 - DNA, 201 bp, Homo sapiens
cacaccaatcattgtggcggtaagaacaaggcctgactagccctgttaggatgaggctagaccaagccctggggggactcaggtccagggagaaacttctrgaggcagaggcaggtgggagaggcccccagaaaccctgttccttaataatacttctctctaccatttgttgggcatctattctgcaccctgcatggtaca

SEQ ID NO: 19291 - DNA, 201 bp, Homo sapiens
ctacatcgtcatcatctcctgggccatttactacctgtacaactccttcaccacggtgagtggtccctttgaccaccccatccagcagaagccacacccasagcccacccttggcccaccacggccaccactctgctgacaaggccattcctccaggagtggggaacttggtttgtcttttgtgggccttggtctccccac

SEQ ID NO: 19292 - DNA, 201 bp, Homo sapiens
cttcattgagcatcatctctgtgccaagctctgggcacataacagtgagtcagatggggtccctgccctccagaggctcccaggctggtggagacacaaayattgagctaagacatataggacagagctagagaatgcagcacctaactggactcggagcaccagggactgcttcttggaggaggggatgtagaaattgag

SEQ ID NO: 19293 - DNA, 201 bp, Homo sapiens
catcatctctgtgccaagctctgggcacataacagtgagtcagatggggtccctgccctccagaggctcccaggctggtggagacacaaacattgagctargacatataggacagagctagagaatgcagcacctaactggactcggagcaccagggactgcttcttggaggaggggatgtagaaattgagctttgaaagg

SEQ ID NO: 19294 - DNA, 201 bp, Homo sapiens
acaggcagaatcaggctggaccctgggctctcctggctcggtgctgctgggcctcccgtccttccttagagggccaggctttgggtgggttggggctgggrctgctgcaggtggctgacctctgttcccacctgaagttctgcactgtggagggcttcatcacagccctggtggatgagtaccccaggctcctccgcaacc

SEQ ID NO: 19295 - DNA, 201 bp, Homo sapiens
ccaaggaggagcttcagataagtggccaaggagagcaaggatctgggaaggcttcctggaggcggaagaactggaatcaagcccagagccacaacagatayggatgtaggggaaatgggggaggaggaagcaagggtgtacaggaggaggggtcaccagtcacccactttcctcccaggtggtctacttttcagccacata

SEQ ID NO: 19296 - DNA, 201 bp, Homo sapiens
tgagtcacaggcagaatcaggctggaccctgggctctcctggctcggtgctgctgggcctcccgtccttccttagagggccaggctttgggtgggttgggkctggggctgctgcaggtggctgacctctgttcccacctgaagttctgcactgtggagggcttcatcacagccctggtggatgagtaccccaggctcctcc

SEQ ID NO: 19297 - DNA, 201 bp, Homo sapiens
ctacaccttctgccagctgcaccctcctcaccccacccctccctctcttcagggactccatcatcgtctgctgcatcaattcgtgcaccagcatgttcgcrggattcgtcatcttctccatcgtgggcttcatggcccatgtcaccaagaggtccattgctgatgtggcggcctcaggtcagtgcaacactgtgtggggcc

SEQ ID NO: 19298 - DNA, 201 bp, Homo sapiens
gcagggctctccccgagctgggcgggctccgggcgccgcgggccctgccctccccctccatccctccggactcgctcccccctcctctcccttccccgcgwccctccgcccgccctcggaagaccgagacagcggagaggttgcgggtgactgcgctgagcccaggagccgaggagtcgggagcgcagcgcagcccgagcc

SEQ ID NO: 19299 - DNA, 201 bp, Homo sapiens
ctccccctccatccctccggactcgctcccccctcctctcccttccccgcgtccctccgcccgccctcggaagaccgagacagcggagaggttgcgggtgsctgcgctgagcccaggagccgaggagtcgggagcgcagcgcagcccgagcccgagcccgagcggccccgcgtcccgagcgcatcggagcggccgagccgc

SEQ ID NO: 19300 - DNA, 201 bp, Homo sapiens
ccccctccatccctccggactcgctcccccctcctctcccttccccgcgtccctccgcccgccctcggaagaccgagacagcggagaggttgcgggtgacsgcgctgagcccaggagccgaggagtcgggagcgcagcgcagcccgagcccgagcccgagcggccccgcgtcccgagcgcatcggagcggccgagccgccc

SEQ ID NO: 19301 - DNA, 201 bp, Homo sapiens
ccggactcgctcccccctcctctcccttccccgcgtccctccgcccgccctcggaagaccgagacagcggagaggttgcgggtgactgcgctgagcccagragccgaggagtcgggagcgcagcgcagcccgagcccgagcccgagcggccccgcgtcccgagcgcatcggagcggccgagccgcccggtgcagcgcctgt

SEQ ID NO: 19302 - DNA, 201 bp, Homo sapiens
gtgccccactggccccgcaagttggcactggattctgctggagccgtcgaagctccctattcattccccagggcatggaggggacgcggagtgaatgacamgagcagcgttggggggccgtgcgccactttcccaatcctggggtcagctgagccgagttagagctatgcccctcatttgttctctgcgggctacggcggg

SEQ ID NO: 19303 - DNA, 201 bp, Homo sapiens
cttagagggtaaagatgaggcaaaatcaagtccatcgaagccaaaagatgcacagtggccacgtctctcctgcctgccacggattttacatgcctggtgamcccggagcagcagaggctataaatttttttacacgtggcccagcacacagcaggacctcaataaacctcttagaataaagcctgcatggatggaaggtga

SEQ ID NO: 19304 - DNA, 201 bp, Homo sapiens
aaatcaagtccatcgaagccaaaagatgcacagtggccacgtctctcctgcctgccacggattttacatgcctggtgaccccggagcagcagaggctatamatttttttacacgtggcccagcacacagcaggacctcaataaacctcttagaataaagcctgcatggatggaaggtgatgctatcactggcatggaccta

SEQ ID NO: 19305 - DNA, 201 bp, Homo sapiens
tgaccgttgattcagccttgccaccacctttagccacctgcatcctgaagtccatctcctttgtccttagaagcccatccctgttgcctagcccaaaatgkgcccaccttccccttgactaccacccccgccccagcagcccctctcctcagccacagccccaatgccaaacccagttagagccacttcatcccctctctg

SEQ ID NO: 19306 - DNA, 201 bp, Homo sapiens
ttagagccacttcatcccctctctgcccaaatgaaaactaaaatgcaagcgtcagcaggcctgtctatgcctgtgtcgggactaccccttcaattcacccrtgcaacgtcgcctgagcttctctgtgcctggagaatggtgggcagggtatagccccgctgaatgacagcaacctcgaattgacttcagttgccaagagca

SEQ ID NO: 19307 - DNA, 201 bp, Homo sapiens
gggacattcaaggtcaaagatgccctgaaacatcgacagcaggttgctttcatggctgtgtagtttgataaggagattctgtgcagggagagggcagcagccacagggaggtgagcaaagacatttggtatcagtgttgcggtttgctgcaacttagcgctgatcacgatactcccggtcatcagaaccgcactttatact

SEQ ID NO: 19308 - DNA, 201 bp, Homo sapiens
aggtgggaggattgcttgagcctgagagacagaggttacaatgagccgagatcatgccactgcactgcagcctaggtgacagagtgagaccctgtctcagaaaaaaaaaaagaatctgatgttaccaaatgggtagactgttcttgctacataggagtttccactttacaaaaacaaggggctctataccataaaattcct

SEQ ID NO: 19309 - DNA, 201 bp, Homo sapiens
aatttcacacaggccagcgcctgggaggcactttctggacaagcaaatagcaccagactataactcagagggcctgggtcaagtcctgtgtgaccttgggyaggccatttgacgtctctgggccttagtgccatcatctgcaaaatgggaccaatgatcagtttagcgtcaatgtatttagctcttgctgaactgggcacg

SEQ ID NO: 19310 - DNA, 201 bp, Homo sapiens
acgtctctgggccttagtgccatcatctgcaaaatgggaccaatgatcagtttagcgtcaatgtatttagctcttgctgaactgggcacggtgctagaaarttcaaatccagtcatcacagagtgggaagtgcttactattgacctcctttattgatgaagaaacaaaaacttttttttttttgagacgaagtctcgctct

SEQ ID NO: 19311 - DNA, 201 bp, Homo sapiens
ctcctgcctcagcctcccgagtggctgggactacagacacccaccaccatgcccagctaatttttcgtattttttagtagagacgggttttcaccgtgttrgccaggatggtctcgatctcctgacctagtgatccgcccgcctcggcctcccaaagtgctgggattacaggcgtgagccaccgcgcccggccaaaacaaa

SEQ ID NO: 19312 - DNA, 201 bp, Homo sapiens
cagactgaattttttttttttttttttttttttttttgctcaggccaaataaaacaagcccaagggccagttttgacccattttgccacttctgatgtagrgcttccaaactgtacatgttttctttccctacaaagcatcttgtcattcagagattggcagaggaattctttgtgcttggtttggccccatttttatcaa

SEQ ID NO: 19313 - DNA, 201 bp, Homo sapiens
gaccgttaagggcatcattgttaccagagttaatggctgaggctgctctctcctgcgtatcccaagagtccctggtagaccacagaatcggccgcctcctrctatcctgccattctccagaaggggaggcaggcaccctactgagtccagagctctctctaacattgccatgcccaggccaggatctagatgggcatccaa

SEQ ID NO: 19314 - DNA, 201 bp, Homo sapiens
ctatcctgccattctccagaaggggaggcaggcaccctactgagtccagagctctctctaacattgccatgcccaggccaggatctagatgggcatccaasaccagcctgtgtgccgtgaaggagttcaaagtgagcaggccatccctgagaacgaggagcaggggtgttaggaaagtttggattatctgaagatggcctg

SEQ ID NO: 19315 - DNA, 201 bp, Homo sapiens
acagagcaagactccatctcaaaaaaaaaaaaatgtggtaaagtggactgtgatcagaggtcgtaactcctaggctctgtcgtcttcacccagacacctcygtagtggggacacctttctccccattcagccacaggtggagcttctttcttgctcaccctggcgatggctagtatggccgcagagtgtgacaaggctccc

SEQ ID NO: 19316 - DNA, 201 bp, Homo sapiens
ttctttcttgctcaccctggcgatggctagtatggccgcagagtgtgacaaggctcccaattgcatccttggaggcaaagttaaagattttatgattaagyacttaacatttcctgttggaagtttggtggcctcagatttctcctctgagcaggacatacaacagagggttggacacagatggccagagttgaagctagg

SEQ ID NO: 19317 - DNA, 201 bp, Homo sapiens
agatggccagagttgaagctaggccaggaaacatcgctgtgtctttggaaacaaaagtcaccttccttcctccaggagcaagggcgggtgagaggaagagsgcttatagagagccttttcaagcccctagcttgtttatgggttattttgtttttgtcattttagggtgaggcaactccaaggtcctactctctttctgtg

SEQ ID NO: 19318 - DNA, 201 bp, Homo sapiens
gcactccttgcaggctcacatccaatcctcatgacacccctctaaagtgggtattgttagcacattttatatggacacagacagcctgggttcaaatcctsactctactatataccagctgtgcaacttcagaaaagagacttaacctctctgagtctcagtgccctcatttataaaatggaaataaaattagaacctgcc

SEQ ID NO: 19319 - DNA, 201 bp, Homo sapiens
tggtctatacatacaatggaatgtaattcagccttaaaaggaaggaaattctgacgcatgcatcaacatggatggaccttgaggatattatgtcaagtgaaataagccggtcacaaaaatacaaatagtgtttgatcttgcttatatgagttccctagagtaatcaaatttatagagacagaaagtagaatgatggttgcc

SEQ ID NO: 19320 - DNA, 201 bp, Homo sapiens
ggtctatacatacaatggaatgtaattcagccttaaaaggaaggaaattctgacgcatgcatcaacatggatggaccttgaggatattatgtcaagtgaaataagccggtcacaaaaatacaaatagtgtttgatcttgcttatatgagttccctagagtaatcaaatttatagagacagaaagtagaatgatggttgcca

SEQ ID NO: 19321 - DNA, 201 bp, Homo sapiens
gtctatacatacaatggaatgtaattcagccttaaaaggaaggaaattctgacgcatgcatcaacatggatggaccttgaggatattatgtcaagtgaaataagccggtcacaaaaatacaaatagtgtttgatcttgcttatatgagttccctagagtaatcaaatttatagagacagaaagtagaatgatggttgccag

SEQ ID NO: 19322 - DNA, 201 bp, Homo sapiens
gtctagaaggtctcagagcaccttggataagctcccaggaggagctgttctcaggcactgtcagaatcagagttgcctgatctcttcatggccaatgtccrtggttacactgtttctttacaaataaaaatcaaattctgctctggtgggttctgctttctggcatctcccgcatgctgctctcaggcacgttcggacttt

SEQ ID NO: 19323 - DNA, 201 bp, Homo sapiens
gagcttcagataagtggccaaggagagcaaggatctgggaaggcttcctggaggcggaagaactggaatcaagcccagagccacaacagatacggatgtaggggaaatgggggaggaggaagcaagggtgtacaggaggaggggtcaccagtcacccactttcctcccaggtggtctacttttcagccacatacccctaca

SEQ ID NO: 19324 - DNA, 201 bp, Homo sapiens
atacccagaggcggtgacccagctgcctatctccccactctgggccatcctcttcttctccatgctgttgatgctgggcattgacagccaggtgagggcgccccccccgcaccccaggagctctccatccccagactcctcagtccccgagtaaacagggagaggaggcaactcttaggctgccaagaagatgaccaaaaa

SEQ ID NO: 19325 - DNA, 201 bp, Homo sapiens
cctctcgtggtcacaaagccctcagtgcttcatctaatctaccctgaagcctaatcccagccccatcagcctccagagtccatgtggtctgtgaactggaygcagtgggcgccggggacaatgcacctgttctcacctcttttcatcttgcaggggggtatttatgtcttcaaactctttgactactactctgccagtggc

SEQ ID NO: 19326 - DNA, 201 bp, Homo sapiens
cggagatcagtgtggctggaaggtaaagtggaaaggggtgcgaggaggggacatgacaagagatgaggttgggatgtaagaaggtccagccagatcatgargggctttgaaaaccaggacaagaactttgaactttatcctggcagcaatggggtgtcatgaagggcttggaacagacggagggtgggatcacatttgccc

SEQ ID NO: 19327 - DNA, 201 bp, Homo sapiens
tgtggctggaaggtaaagtggaaaggggtgcgaggaggggacatgacaagagatgaggttgggatgtaagaaggtccagccagatcatgaagggctttgamaaccaggacaagaactttgaactttatcctggcagcaatggggtgtcatgaagggcttggaacagacggagggtgggatcacatttgcccagggctcact

SEQ ID NO: 19328 - DNA, 201 bp, Homo sapiens
tcagggagaggaagataagcaactaacaaaataaaagcacgtgaggtggcgaggagcactatagagaaaaatcaagtagacagggtgtttagggagtgccrgatgaggcctcactgagaaggcgaaacatttgagccaagacctggggaagtggaaagcgagctgtcgctatctgagaggaaggctctgccagacagaggg

SEQ ID NO: 19329 - DNA, 201 bp, Homo sapiens
caaggtgctctttctcgtgttcttacgtggtctttttgttacatttccacaagtttggatggaggacagagaaaagtctcagcagcccctctgttggtttytcttttcttctgataaaattatggaatgtcttctccacgctgccctcatcccacgcccacagctgtcccgagggcagcgggccccactcctgcatgttcc

SEQ ID NO: 19330 - DNA, 201 bp, Homo sapiens
aggcattattgtcccactttaccgctgcaggatctggggctcacctagccagcatcacccagctagtcagcactgggattcgaaccaagcccagtctcttkgcacttggagactctccttctcagggtccctcatccccacaagcaggagctgaagcaggggcgggcctgggaggggccacccaaggttcttgaggtgggg

SEQ ID NO: 19331 - DNA, 201 bp, Homo sapiens
gttctgggagtgagtatggggccatcaggggatggcagggacggggcatgtcagccagagcccggcaggagacagaggcccctcggaggggtaacagaagmggtggataaaggggctacagtcatgtgtcacatcatgacattttggtcatcagtggaccacatatgcaacgatggtcccataagattataataccatatt

SEQ ID NO: 19332 - DNA, 201 bp, Homo sapiens
ccagagtccccaagtcactagcaaaactgcccttcttcctgggtcccatgccaaattccagagaaggaatttgattggctagcctgggtcaggtggtcagycctgattcaaggtgattggatcattttgaacaaatatggcagctggagcccacaagggtagatcatgggaccgttaagggcatcattgttaccagagtta

SEQ ID NO: 19333 - DNA, 201 bp, Homo sapiens
cctattgtgggtctctgggcctcggtttttccatctgtaaagtgaagtgatggggtggtagttcccgtgggcctgccatgggagcagtggctggtcctctrccttggtggcatatgacatgtggagagcaccatgaaataaataaagcaccaatatcaggccacttcttgccatcacacaaagactccattccttggcttg

SEQ ID NO: 19334 - DNA, 201 bp, Homo sapiens
gcctcccttgagcctcagaaataaatcgtcaggcaggcagcaaacaaagaaagagctctgtctccagccaagcactggctcagtggccagtccttggaggrcaaacagtgagtcccaagcagagagacgcagcccggcctgtctggcagagcatctggaaagtggggttcccctaggaacacacaggagagaggcagccac

SEQ ID NO: 19335 - DNA, 201 bp, Homo sapiens
ggccaggcttggggatgcaggagttagtgactgccttggacggtgacctgcagctctgcccacctgtcagctgcctggtgtctgcaagttctgtgtctcaygccagctcctgagataactgagccctggccagagggacattcaaggtcaaagatgccctgaaacatcgacagcaggttgctttcatggctgtgtagtttg

SEQ ID NO: 19336 - DNA, 201 bp, Homo sapiens
tggctgtgtagtttgataaggagattctgtgcagggagagggcagcagccacagggaggtgagcaaagacatttggtatcagtgttgcggtttgctgcaasttagcgctgatcacgatactcccggtcatcagaaccgcactttatactttgctaaaaatgctcttgcagctgctttttcttttgatcatgtatgaagtat

SEQ ID NO: 19337 - DNA, 201 bp, Homo sapiens
agggcagcagccacagggaggtgagcaaagacatttggtatcagtgttgcggtttgctgcaacttagcgctgatcacgatactcccggtcatcagaaccgyactttatactttgctaaaaatgctcttgcagctgctttttcttttgatcatgtatgaagtattccaggggaagaaaatatggtccttgagatcctggaga

SEQ ID NO: 19338 - DNA, 201 bp, Homo sapiens
gaatgaccttgacccaaatgaggctcctttgcacacatgtgcgtacatgcacacgttaacacttatgtagaatttcagttttcaaagtgttttctcagtcraagcttgtgacagccctgggaacttcaagtgaaggtaattttattgttattattggtaccattattatccccatccaaaagatgaacctgaggctcagtg

SEQ ID NO: 19339 - DNA, 201 bp, Homo sapiens
caagtgaaggtaattttattgttattattggtaccattattatccccatccaaaagatgaacctgaggctcagtgagccctgactcctcatctctgtcccytagtttcccagctgatgaaaatcacctttgctaggctgaaatccaagttcaccaggtagccccttgagaaggagcccagatgaggccagatctggtagga

SEQ ID NO: 19340 - DNA, 201 bp, Homo sapiens
caacgtctgtgcttaaaagtgatgccatcaaaccgggccggggcagagcagccccctccccaaacttggagctagacaggagtcacaaagtaagggtcccytcattggtcacagacccctcttcagctcagggtccgaagcagctccttggagacatggatcggtggctgctttgggagattttcttaaaggcccctgggg

SEQ ID NO: 19341 - DNA, 201 bp, Homo sapiens
ttagagtggccccggcacattagtaagtgtgtccagctcacttcctccctgtactgagctcttctttttctttcaccccttgttaatgaaaagttggggartttttcttttctgtaggcggctgcagaaggagaaccatcctcctggaatctgtttcaccattggatgggtctgtcatattccagtagtcgcaaagttgaa

SEQ ID NO: 19342 - DNA, 201 bp, Homo sapiens
aagttggggaatttttcttttctgtaggcggctgcagaaggagaaccatcctcctggaatctgtttcaccattggatgggtctgtcatattccagtagtckcaaagttgaatttgttctcgcctgggttgtcggggtggggatgccctctggccttcttccacattgtggtttcagaggtgtcctagaaaacctgacttct

SEQ ID NO: 19343 - DNA, 201 bp, Homo sapiens
ggtcaggtggtcagtcctgattcaaggtgattggatcattttgaacaaatatggcagctggagcccacaagggtagatcatgggaccgttaagggcatcaytgttaccagagttaatggctgaggctgctctctcctgcgtatcccaagagtccctggtagaccacagaatcggccgcctcctactatcctgccattctcc

SEQ ID NO: 19344 - DNA, 201 bp, Homo sapiens
tttaaaatagatgtggggggtgggggcaaaatgggataattcgaaataaactgtctagaaacctgcctttctcaccccaaaacaaggtgctctttctcgtrttcttacgtggtctttttgttacatttccacaagtttggatggaggacagagaaaagtctcagcagcccctctgttggtttctcttttcttctgataaaa

SEQ ID NO: 19345 - DNA, 201 bp, Homo sapiens
ggtggagaggcccaatccagagtcccccgcacatcagcctgctctgtcctgttagcccatctatttcctctgcaagggctgggtgtgactttctttgcctygtgctcagtgcctgacaggcacccaggtagatacatggtgagtcatgctcactgaccgagggcctgggcctcacctcgtccggcaagctgagaccccagc

SEQ ID NO: 19346 - DNA, 201 bp, Homo sapiens
tctgctgtcttggagcttacattttggtggacaagactgacagacaaattagatgattttggagagtgtcaagtgccctggagaaaagaggacagcagcayagagaatggccagtagcacaggaggggcgctccctcagacaaggtagtcaagggaggtctctctctccaagaaagcgacagttgagctgagacttaaatg

SEQ ID NO: 19347 - DNA, 201 bp, Homo sapiens
gctgctggggctggatgggatcctggcacacaggccaggcttggggatgcaggagttagtgactgccttggacggtgacctgcagctctgcccacctgtcrgctgcctggtgtctgcaagttctgtgtctcacgccagctcctgagataactgagccctggccagagggacattcaaggtcaaagatgccctgaaacatcg

SEQ ID NO: 19348 - DNA, 201 bp, Homo sapiens
tgggaaaatattttagaccctggaatctgacccttaattgactctgaaaatacacgcctccctcattcttgcagactattctaaagcagagtctctctgcrgttttttaaatccaactgagcttttattaagagaccaataggatttgttgtttcccaaatataaaactataacaccaaacatgctttttcaaacttcacc

SEQ ID NO: 19349 - DNA, 201 bp, Homo sapiens
tgcagactattctaaagcagagtctctctgcggttttttaaatccaactgagcttttattaagagaccaataggatttgttgtttcccaaatataaaactrtaacaccaaacatgctttttcaaacttcaccacccccaagagtttgacatatcccccaggaaaggggcaatattaaccctcatccatcttccactgctta

SEQ ID NO: 19350 - DNA, 201 bp, Homo sapiens
catggtggctcatgtctataatcccagcactttgggaggcagaggccggcggatcacctgaagtcaggagtttgagaccagcttggccaatgtggtgaaamcccgtctctacttaaaaaaataaaataaagtaaataaataatacaaaaattagtcaggcattggggcaggtgcctgtaatcccagctacttgggaggctg

SEQ ID NO: 19351 - DNA, 201 bp, Homo sapiens
aaacgtcaaattgttcatgaggcaataaaacaacgtttagtgaacaaaatgggaaacaaacctgtatgtactgcgttttttttaactctaaacatgttacrtggaaaggcaagtacctaatttgaacctcattttgtaagaaaatgtgattgcatctgcaaaggagagtttcagaggagcattaaagtaggaacatccctg

SEQ ID NO: 19352 - DNA, 201 bp, Homo sapiens
ccccccacataacttacattctaggtgctggttaaaggaactttcattttatgtgtgtgtgtgcatatgtaatttaaaagttttcctgtcaccacatgcawtacttggataatttagaagtcaaaaaataggaggggacaggggaagggaaaaaccaaatgtgagctggttggctcagactccaaggaggagcttcagata

SEQ ID NO: 19353 - DNA, 201 bp, Homo sapiens
ctgggaggggccacccaaggttcttgaggtgggggcagagccactgcatatgttgtgtccacataaggggaccctgccaatggcacattgggagctgatayctcacccttgctctgcttttgaagctggggaacttggaggaaggggttcccttttctaattagtctccctagaggagttgccttttcctactgatcttcc

SEQ ID NO: 19354 - DNA, 201 bp, Homo sapiens
ggaagagtggatcagagaggcaaacggaggggaataaccagcatagccaattagaatcacctggagaggttgaccacatcctgattcatcctgaaaaccarcctgatctacttacgaacctagagtcactcggaataaacatgcacacacactctggccatagtgaaggccgtgctgattgtatcttcaggggagtacctt

SEQ ID NO: 19355 - DNA, 201 bp, Homo sapiens
tagaggcagggtttcaccatgttggccaagatggtctcgacctcctgacctcatgatccgcccacctcggcctcccaaagtgctgggattacaggcataarccaccaagcccagcagtacattctacccactaagtaatttctcatcatccaccccagctcccattcccccacccttctgagtctccagtgtctattattc

SEQ ID NO: 19356 - DNA, 201 bp, Homo sapiens
aggcactccttgcaggctcacatccaatcctcatgacacccctctaaagtgggtattgttagcacattttatatggacacagacagcctgggttcaaatcytgactctactatataccagctgtgcaacttcagaaaagagacttaacctctctgagtctcagtgccctcatttataaaatggaaataaaattagaacctg

SEQ ID NO: 19357 - DNA, 201 bp, Homo sapiens
agcagtgcccgaagccgctctggtgaacttcaagacaccagtttggggtttggggtttttctttttcatgagatttgcagttctttgcaattgattgtcartttctttttctttcattcattcatttatttatttatttatttatttatttatttatttttgagacgaagtctcgctcttgttccccaggctggagtacaa

SEQ ID NO: 19358 - DNA, 201 bp, Homo sapiens
cgagggaagccagagtggtggaggcagagggagtgaggcagtgggtgggagacgaagaaccagcccatgcggaccttgcaggccaagacatttgggtgggrtgggatgggatgggatgggatgggatgggattggatggcatgggattggattagatctctctctgcttatttatgtgttatattattgtctcatttaagt

SEQ ID NO: 19359 - DNA, 201 bp, Homo sapiens
ctcccaggttcaagcagttctcctgcctcagcctcccaagtagctgggattacaggcgcccgccaccacacctggctaatgtttatatttttagtagagayggagtttcaccgtgttggccaggctggtctcgaactcctgacctcaggtgatcctcccacctcggcctcccaaagtgctgggattacaggcatgggccac

SEQ ID NO: 19360 - DNA, 201 bp, Homo sapiens
tcccaatggtcaaacccagctagaagccagagggcaggggaccagataatgtggccatagtcgtcagcatcctggggcctggcacagagtggtcaaggggragagtggatcagagaggcaaacggaggggaataaccagcatagccaattagaatcacctggagaggttgaccacatcctgattcatcctgaaaaccagcc

SEQ ID NO: 19361 - DNA, 201 bp, Homo sapiens
taatttccaggccaactctgtcctattgtgggtctctgggcctcggtttttccatctgtaaagtgaagtgatggggtggtagttcccgtgggcctgccatkggagcagtggctggtcctctaccttggtggcatatgacatgtggagagcaccatgaaataaataaagcaccaatatcaggccacttcttgccatcacaca

SEQ ID NO: 19362 - DNA, 201 bp, Homo sapiens
ggtcacatagccaggaggaggaagggcagggatcttaaccctactgttctaatttccaggccaactctgtcctattgtgggtctctgggcctcggtttttscatctgtaaagtgaagtgatggggtggtagttcccgtgggcctgccatgggagcagtggctggtcctctaccttggtggcatatgacatgtggagagcac

SEQ ID NO: 19363 - DNA, 201 bp, Homo sapiens
gccagggattattcctacaagaaccgtgtggagcaggcactattctaatccccacttcagaggcgatgaaactggatgcagagaggggaagtgacttgtcmaaggtcacatagccaggaggaggaagggcagggatcttaaccctactgttctaatttccaggccaactctgtcctattgtgggtctctgggcctcggttt

SEQ ID NO: 19364 - DNA, 201 bp, Homo sapiens
tgatacataacagggctcttcattccaggctagtaaatatcactagaacaaatgaacagctccatcaccaaaaatatacataaatattttgcatttgaagrgtgtgaatgttgtacctcactgcaaatgtactgtccttaaaaacctccatgcacacctcactgagggaatgtgtgttttctctgtgccagctatctaaat

SEQ ID NO: 19365 - DNA, 201 bp, Homo sapiens
ggagtttcaccgtgttggccaggctggtctcgaactcctgacctcaggtgatcctcccacctcggcctcccaaagtgctgggattacaggcatgggccacygtgtccggcagattgccagtttcttatagcatctgaccatcagggagaaacagcccctgcccaggaaagcctttgaaggaatggctgggatagatgtcga

SEQ ID NO: 19366 - DNA, 201 bp, Homo sapiens
agctaagccagtgaactgtccatgctgaccgggaaacaggctcacattagactctgagatacaaaggtcatcaaacttgaacattgctcttccatactagwgagcaaagaaatgcaattttagacaatgatcatcagtttggcaaaaaataattgtttaaatgatgatacctagtgctggccttgtgacagaaaggcactc

SEQ ID NO: 19367 - DNA, 201 bp, Homo sapiens
aaccccagacagcccttcgctgcacagccaggcaagcagccaacaggtggaacccactgtatgcagggcagaggcccctgaggctcatggaggccacacgrctggtcccttgaagaagtgggctggttccgtgaaaggagcattctctgctccggttctaatctccccttcaagggcagccaccatctcgtttctctgcaa

SEQ ID NO: 19368 - DNA, 201 bp, Homo sapiens
aacactttggctcaattcagacatgttcatcaccatactacaaagaccactaaatccatgcttttgtctcagctccaaaaatgttctcgccaagtgggccrtgcccactctgctcaccacacagtcatcaatgccacagaacccaaggaaaaccccagacagcccttcgctgcacagccaggcaagcagccaacaggtgga

SEQ ID NO: 19369 - DNA, 201 bp, Homo sapiens
aactctaaacatgttacatggaaaggcaagtacctaatttgaacctcattttgtaagaaaatgtgattgcatctgcaaaggagagtttcagaggagcattraagtaggaacatccctgcatttatgtgttcgtcagacaattcttgagtgtctactatatacggtggactgttctagacatggggatgtgaacaacacaag

SEQ ID NO: 19370 - DNA, 201 bp, Homo sapiens
cttttaattcagtagttccacctctaaaaatttttcccaagagtggtataataattttgtagctgaagatttatatacaggggtgtttaatttggtgttayttagagtcacataaaattggaggtaacctgaatgcatagcagtggggaagcttaaaagagaatggtaggaccttctgagggactgttttgtgcaattaaa

SEQ ID NO: 19371 - DNA, 201 bp, Homo sapiens
ccatactagtgagcaaagaaatgcaattttagacaatgatcatcagtttggcaaaaaataattgtttaaatgatgatacctagtgctggccttgtgacagraaggcactctctgtaatgccaggtgaagttccatttctcgaaagcaacaaggtaatatggatcaaaagcctgtgatgaatttattccttttaattcagta

SEQ ID NO: 19372 - DNA, 201 bp, Homo sapiens
attgtggctgccttccttaatcctgcagaatctcggggtcaagtcagggaggtgaagctaagccagtgaactgtccatgctgaccgggaaacaggctcacrttagactctgagatacaaaggtcatcaaacttgaacattgctcttccatactagtgagcaaagaaatgcaattttagacaatgatcatcagtttggcaaa

SEQ ID NO: 19373 - DNA, 201 bp, Homo sapiens
tcacacaggccagcgcctgggaggcactttctggacaagcaaatagcaccagactataactcagagggcctgggtcaagtcctgtgtgaccttgggtaggycatttgacgtctctgggccttagtgccatcatctgcaaaatgggaccaatgatcagtttagcgtcaatgtatttagctcttgctgaactgggcacggtgc

SEQ ID NO: 19374 - DNA, 201 bp, Homo sapiens
ttgccttgacaaaatgaagttctcagttgggcactacagataattaggggccagaacagacgttagtaaaccactgatcgtgtgagcgagacaagcaggaytggatcagagtgaagtggagctggaaattggagtctgactgtcctgcttgcacacagaagaaagctgaggcacagagaggggaagggactggcataaggt

SEQ ID NO: 19375 - DNA, 201 bp, Homo sapiens
tcctggcacacaggccaggcttggggatgcaggagttagtgactgccttggacggtgacctgcagctctgcccacctgtcagctgcctggtgtctgcaagwtctgtgtctcacgccagctcctgagataactgagccctggccagagggacattcaaggtcaaagatgccctgaaacatcgacagcaggttgctttcatgg

SEQ ID NO: 19376 - DNA, 201 bp, Homo sapiens
gggacctagattttaaattcatttgcagctagtgctgatgtcatgcactcagccacctttccctaactctcgggtatcccccaattttgtccccaccatcytactgctcaggaagctattgagagtgccctgacaaagccatcagctgcatttaccgtgatctgacatgacacagaagtggcatccgattctatgcaagct

SEQ ID NO: 19377 - DNA, 201 bp, Homo sapiens
aagagatgtggggtgcgggcggtcccttagagggctggaggacggtgcctccttgctgcttcgggaactgcgctccccttcttgcttttggtctctgcgtktactccccggcgcgacaccgctcaccacggtagcctcgggcagtgcccattgggttctgagcacacgtccccacgggtggcacccacagatgtcctgttc

SEQ ID NO: 19378 - DNA, 201 bp, Homo sapiens
ttgggttctgagcacacgtccccacgggtggcacccacagatgtcctgttctaggcttggctcggtcttcagacaagaaactcagaccgggcagtcccctrttgaggctctgagctaatatcctcccaaaatagacatgaaccacaaggagaattttttaaaagccaaatgataacaccacgttctttccggatgtggggc

SEQ ID NO: 19379 - DNA, 201 bp, Homo sapiens
aacttggagctagacaggagtcacaaagtaagggtcccctcattggtcacagacccctcttcagctcagggtccgaagcagctccttggagacatggatcrgtggctgctttgggagattttcttaaaggcccctggggggcctagactagttatccttaggggcagatgtggacaaacaattggaccgaataaaactctg

SEQ ID NO: 19380 - DNA, 201 bp, Homo sapiens
tttgagcaaatccacccccagagatagcaacctgtttctgggtcccctgagagagagggtcatttgtttgctgctgtttctggggctggatgccaagctaygaggcaatgagctgacgaccttggatcctgacacccctattctatgcaggcaggagaagggtcagggagactgattcagtgaacaaataaagacggttga

SEQ ID NO: 19381 - DNA, 201 bp, Homo sapiens
cccagagatagcaacctgtttctgggtcccctgagagagagggtcatttgtttgctgctgtttctggggctggatgccaagctatgaggcaatgagctgaygaccttggatcctgacacccctattctatgcaggcaggagaagggtcagggagactgattcagtgaacaaataaagacggttgacatttaaccaggattt

SEQ ID NO: 19382 - DNA, 201 bp, Homo sapiens
agataacactggcctgccttccacccaggactttttcccatcactaactaaaaatataaatgaaagccctgatcaggtggtttattataatatctgccagktatcaagcatttactatgtcctagatgctgtactaactacatatttccccatttaatcctcatagcagccctagaagtaggtgttatcacttctgtttta

SEQ ID NO: 19383 - DNA, 201 bp, Homo sapiens
aaatacacgcctccctcattcttgcagactattctaaagcagagtctctctgcggttttttaaatccaactgagcttttattaagagaccaataggatttrttgtttcccaaatataaaactataacaccaaacatgctttttcaaacttcaccacccccaagagtttgacatatcccccaggaaaggggcaatattaacc

SEQ ID NO: 19384 - DNA, 201 bp, Homo sapiens
caaatatagtcatgtggctcctcctagggaattataggcatttggctgaatctgaatacatatccccgtattccagaaattggaaatcacatgtatgtctkctttatggtgaggtcttcagagcagccaccgtctctgatcgttcagggcttggcatgaggaggtgctcaatatagtcatggagaagaactcatggactga

SEQ ID NO: 19385 - DNA, 201 bp, Homo sapiens
attcgccatttctggctgtgccatgcaagggctgagaaaaagtgaaagcaatacaaaataaaagtggccaaaagcaaaagctaccagcttcctgggcaccstctgagctgccagcctgcaatccaggcttcactgccgcctgagctgaccaagcccctttccgcccaagtcagatgtttccagagcttaagatccaggacc

SEQ ID NO: 19386 - DNA, 201 bp, Homo sapiens
cgctcctcctttcttcctcctgttttcctcctcatcactctgctcctttaccccagcctcctccttgtctgtttctctcctcctctccttccatacccttytctctcctttcccctccttcccaccctcctctctctccatccctctccactctttcaaatccacccagggagatgcctctgagttcctgtgtctgatccc

SEQ ID NO: 19387 - DNA, 201 bp, Homo sapiens
agctgtgattatttgaaaaatatccccacttctgctcccttttccaccaaccgcaatgctacccctcccagttgcctgcctgaacccagaccccggggcarggtgccacctctccttctctgcgtgctgtggaagaacttaccccgtggatgtggattgtccatggcccatctcccagctgtcccgagagctcagtggcag

SEQ ID NO: 19388 - DNA, 201 bp, Homo sapiens
gtgaacttcaagacaccagtttggggtttggggtttttctttttcatgagatttgcagttctttgcaattgattgtcaatttctttttctttcattcattyatttatttatttatttatttatttatttatttatttttgagacgaagtctcgctcttgttccccaggctggagtacaatggcacgatctcggctcactgc

SEQ ID NO: 19389 - DNA, 201 bp, Homo sapiens
aaaaatcccggctcctcagccgcttttgaccttggcctccgccaacctcaggcttctcttggctgaaaggtaggctccttccctccctccttgggttcagkgagcgacacagtggagccttgcccagctcacaagcagtgaatggcgcatctgttttctcttctgtccttccttccttctgcccttatttttcctctttcc

SEQ ID NO: 19390 - DNA, 201 bp, Homo sapiens
tgcacgccccacttcctcctctcctcctccatttcccccataatagcctccccgagactaatgactgaggaagataagagccctttctccaaatggcagtraatgccactaatgacagagcagatgcagcactgttaattattccacgggtattaaatgaaaacgccagccctggaggagttaaatagcaccactgatctg

SEQ ID NO: 19391 - DNA, 201 bp, Homo sapiens
accgtgggcaggttctttcccctcttggctttgcatgctcagttcatacagccaagaggtttggaccattggataggatgatcggctgctccccgcaccasgcgccagttctccaggcaaggggagggaagttgcacgccccacttcctcctctcctcctccatttcccccataatagcctccccgagactaatgactgag

SEQ ID NO: 19392 - DNA, 201 bp, Homo sapiens
aggaaactgaggctcagggagctcaagaagttgcccaaggtcataccactgacacagggcagagctgggaatcagatccaaagctgcagggctccgaggcytgggcttgcagacctgagaaagaagtgggagagccgccttctgctgggcctcaagcctgtgggggaccgtgggcaggttctttcccctcttggctttgca

SEQ ID NO: 19393 - DNA, 201 bp, Homo sapiens
tctcacgccagctcctgagataactgagccctggccagagggacattcaaggtcaaagatgccctgaaacatcgacagcaggttgctttcatggctgtgtwgtttgataaggagattctgtgcagggagagggcagcagccacagggaggtgagcaaagacatttggtatcagtgttgcggtttgctgcaacttagcgctg

SEQ ID NO: 19394 - DNA, 201 bp, Homo sapiens
gctgcatcaattcgtgcaccagcatgttcgcaggattcgtcatcttctccatcgtgggcttcatggcccatgtcaccaagaggtccattgctgatgtggcsgcctcaggtcagtgcaacactgtgtggggccgggctcctggcatgggggcactaaccatgctggcctttgccatcatcaccattaccaccaccactgtgg

SEQ ID NO: 19395 - DNA, 201 bp, Homo sapiens
atgcatagcagtggggaagcttaaaagagaatggtaggaccttctgagggactgttttgtgcaattaaaacgtcaaattgttcatgaggcaataaaacaaygtttagtgaacaaaatgggaaacaaacctgtatgtactgcgttttttttaactctaaacatgttacatggaaaggcaagtacctaatttgaacctcattt

SEQ ID NO: 19396 - DNA, 201 bp, Homo sapiens
ctgtattaagcagtccatgagttaagatcccaacctcaccatttactagctgtgagctcaggcaagtcactttgcctccctggaactcagtttccttctckgtaaaacggggctaataattatacttatctgttggtttattatgataatcagatgagatggtgcttttgtcaagcgctcagcacccagcaaggagagttg

SEQ ID NO: 19397 - DNA, 201 bp, Homo sapiens
atggtcaacactaccaacatgaccagcgctgtggtggagttctgggagtgagtatggggccatcaggggatggcagggacggggcatgtcagccagagccyggcaggagacagaggcccctcggaggggtaacagaagaggtggataaaggggctacagtcatgtgtcacatcatgacattttggtcatcagtggaccaca

SEQ ID NO: 19398 - DNA, 201 bp, Homo sapiens
tcaaatctcagctctggcacttagtagctgtgcattctcaagcaagtcactgtccctctctgatctgtcaaatggggatcataatgctacttgcctcccaragctgctgcgaaggggaggtgtgaggaggcttggggaccatgagggtgggcagggtgcactgggaccactcatgccagcccctgggagcccagcaggatg

SEQ ID NO: 19399 - DNA, 201 bp, Homo sapiens
gaatgatggttgccaggggttgtgggtagggggatgaggagttgttgtttagtgggtggagttgcagttttgcaaaatgaaaaaagttctggagctggatrctgacaatgttaggcaatacatttctcacaatgtactcccattgttaagtgacacatgactgtatttgcagaggtgtggcagggttcagggagctacatt

SEQ ID NO: 19400 - DNA, 201 bp, Homo sapiens
agcctgctctgtcctgttagcccatctatttcctctgcaagggctgggtgtgactttctttgcctcgtgctcagtgcctgacaggcacccaggtagatacrtggtgagtcatgctcactgaccgagggcctgggcctcacctcgtccggcaagctgagaccccagccctgcctgccaccagtctgcactgggccccagaca

SEQ ID NO: 19401 - DNA, 201 bp, Homo sapiens
tacccagatggtggcgattgcagtgataacaatggctgagatttcctaagccctaactatatgccaggcatagttgtacatgctttacacacatgatctcrtttaatcatcaccataaccctcggaaggagttattattatcttcccattttatagatgagggtcagagaggtgaagtaactcacccagcattagtaggtg

SEQ ID NO: 19402 - DNA, 201 bp, Homo sapiens
aggtgtgtgggtgaggcacgcttcctgggaccactccatttaagcattgggtcccaggcatgttcactactagcaggaggctctttatcaatttcctcccrtggaccagatgattgggatttttttttctaccagactttattacagaataactatttttgtattaactaagcaaacaaatgtaccgctcccagcttctga

SEQ ID NO: 19403 - DNA, 201 bp, Homo sapiens
gggtacacaacggatgctcaataaagccttgtccaatggattgagcctagcatttttcccgaaggcagagaataaactgtattatgtttccccttggaatraagccaaactcaatattaatttctttcttaaaccacagagtttcaaaaagaaataaaggcaaactagagtgattgcagtctgaagcgagcctctgtaatt

SEQ ID NO: 19404 - DNA, 201 bp, Homo sapiens
tctgggtacacaacggatgctcaataaagccttgtccaatggattgagcctagcatttttcccgaaggcagagaataaactgtattatgtttccccttggmatgaagccaaactcaatattaatttctttcttaaaccacagagtttcaaaaagaaataaaggcaaactagagtgattgcagtctgaagcgagcctctgta

SEQ ID NO: 19405 - DNA, 201 bp, Homo sapiens
gaagggctagagcttccatttattcatctgtcctaggacagtgaggctaggcaaactcatctccatgcagtcacatttctctccctctggcatccagcagscatgcttgggcagatcagatcatgaggcctgataggtctaatggtttcagggaatttcacacaggccagcgcctgggaggcactttctggacaagcaaat

SEQ ID NO: 19406 - DNA, 201 bp, Homo sapiens
aaggtcacacagctagtaagtttagagagagatttcaaacctgtgtctactggacttcagggcgtcaagctaactgcccttcctcctcaggtcagctcctygcagcagctgcaaggcacgagccatgtctgcagttggaggagagctggggtctccaagaggggagtgctgcccctagaggctggctgcctcctggggact

SEQ ID NO: 19407 - DNA, 201 bp, Homo sapiens
ttacagggtaagatgcgccctcttttcctgcatcagagctctttactactactggcggcttcctggccacgttcccctaaatcaccccagattctagcccycaacaagcctcctcactgtctccaaatgtgttctgtattttggctttgttctatctgcctggaatggaccaggagtggttagggttgcagttaaaagcaa

SEQ ID NO: 19408 - DNA, 201 bp, Homo sapiens
catcaaatctccccatcttccacggttcaggtggcagccctggtgaccaccccatgcccacagtggagagggatagttaagaacatgggctttggaatcamactgcagtgtctgggagctgggaagttgttttactgtctgaacttcgccttcctcatctgtacagtgtgcagtacagaaatgcagtaaatatattaagca

SEQ ID NO: 19409 - DNA, 201 bp, Homo sapiens; identical to SEQ ID NO: 2420

SEQ ID NO: 19410 - DNA, 201 bp, Homo sapiens; identical to SEQ ID NO: 2419

SEQ ID NO: 19411 - DNA, 201 bp, Homo sapiens
gggaaactatgttttccccaagtggggccagggtgtgggctggctgatggctctgtcttccatggtcctcatccccgggtacatggcctacatgttcctcrccttaaagggctccctgaagcaggtaagcccttccccacccttcaaattgccagtgcccttctcccactgtgtcaggcacagccccaccccttgtgaagc

SEQ ID NO: 19412 - DNA, 201 bp, Homo sapiens
agatgaacctgaggctcagtgagccctgactcctcatctctgtcccctagtttcccagctgatgaaaatcacctttgctaggctgaaatccaagttcaccrggtagccccttgagaaggagcccagatgaggccagatctggtaggaggcagagcacagagcactcaaagatcgagacttacaagagagcgtgggaaggca

SEQ ID NO: 19413 - DNA, 201 bp, Homo sapiens
agcgtcaatgtatttagctcttgctgaactgggcacggtgctagaaaattcaaatccagtcatcacagagtgggaagtgcttactattgacctcctttatygatgaagaaacaaaaacttttttttttttgagacgaagtctcgctctgtcatccaggctggagtgcagtggcgcgatctcagctcactgcaagctctgcc

SEQ ID NO: 19414 - DNA, 201 bp, Homo sapiens
atcattttgaacaaatatggcagctggagcccacaagggtagatcatgggaccgttaagggcatcattgttaccagagttaatggctgaggctgctctctyctgcgtatcccaagagtccctggtagaccacagaatcggccgcctcctactatcctgccattctccagaaggggaggcaggcaccctactgagtccagag

SEQ ID NO: 19415 - DNA, 201 bp, Homo sapiens
cctggcttcatgctgaacacggaaggcacagggaagtacgagaccaaggtgacatataataagcctgcggcatgtcctgatgtgactgacctttctgagcmgtaggtgtgactgtgcctgattccagacaagagaaagtgaagctaagagaaaatacaacattgaccctaagttacgcagcttgtgggtgacacagatgag

SEQ ID NO: 19416 - DNA, 201 bp, Homo sapiens
tccactatagtgccctgggaaatgcacctgccagacccaggggaagcgctctcaggtctgagatacagggaagcctggctgcaggttatgtgctgccgtgragttactggcccatcttcctccaacctcagatgaagaaactggggaaccacaggggttgagtaagcaggttcccagctcaggaagctgtgagcagagcta

SEQ ID NO: 19417 - DNA, 201 bp, Homo sapiens
agagggcctgggtcaagtcctgtgtgaccttgggtaggccatttgacgtctctgggccttagtgccatcatctgcaaaatgggaccaatgatcagtttagygtcaatgtatttagctcttgctgaactgggcacggtgctagaaaattcaaatccagtcatcacagagtgggaagtgcttactattgacctcctttattga

SEQ ID NO: 19418 - DNA, 201 bp, Homo sapiens
gtcagtagaatatcttagggtgattgaaggctgaaagaggtcatctaaaccagtggcccttagctgagggccagggctgggctaccagtataagaatctcytttggcagagcttgttaaaagtatagactcaggacttcctgcaacccagtgagagatgtaccagtgtcatcctcattttaaaagataggggcacacagag

SEQ ID NO: 19419 - DNA, 201 bp, Homo sapiens
aacacatcaccacttcccttctccaaagcatgcaagttcaatttctaaaattcaaatctgataccactcaatcaagcatagctgtgggacccattcggctyaaaaccaccacgttgagatccctggtggttcttattgtgaccttgtgtgatcttgatccagacagtttctctttggggctcagtctgattgtctctagaa

SEQ ID NO: 19420 - DNA, 201 bp, Homo sapiens
tgtggccagattctaaaaaaactgaaaaatacttagactacatgcactaaatttattatttagagtttatgttagaaaccgagcacactaacattaagaayaaacaaacccatatttttagtttcccaagtctatctctgaaatatcaacagcacctttctatgaagatttttctttcttgtaaaggagttctctgtcagc

SEQ ID NO: 19421 - DNA, 201 bp, Homo sapiens
tttgggaggctgaggcagggggattgtttcatcccaggagttcgagaccagcccgggcaacaaagctagaccccgtctctacaaatattaaaccatcagtmgggcatggtgatacatgcttgtagtcctagctacttgggaggctgaggcaggattgcttgagctcaagagtttgaggttgcagtgagctatcaccatacc

SEQ ID NO: 19422 - DNA, 201 bp, Homo sapiens
gcattttgggaggctgaggcagggggattgtttcatcccaggagttcgagaccagcccgggcaacaaagctagaccccgtctctacaaatattaaaccatyagtcgggcatggtgatacatgcttgtagtcctagctacttgggaggctgaggcaggattgcttgagctcaagagtttgaggttgcagtgagctatcacca

SEQ ID NO: 19423 - DNA, 201 bp, Homo sapiens
acggctacacgagagcgcatctctctccgaagttaaagagcacactctcccatcactcaacggatcccaacaagccaccactaccgttaacagaatccggrgaggccacggcgcaggcgcaacggaggtgagcgtgcttgcgggcggcaggccccaccccggaagcgcatgtctgcgttccggccgcagccgtcccccgcc

SEQ ID NO: 19424 - DNA, 201 bp, Homo sapiens
gtagatttttgtttcttgtagctgaacatattcctgatacaatgaaagacataaaaaatataaacactgaatgaaagcaagcaccacaaatgtccactttrtaagtgcaaaggggctagaaataaatctaagtgaacataagacaaccaaattaggagagaagaatatttattatacaaatataaaaatctatacattctt

SEQ ID NO: 19425 - DNA, 201 bp, Homo sapiens
aggtatacatacttcatgacattaagtcttggaactacatacagcatgtgctcaaacatacttgctgaatactgttccctgctgaggcaattaactaaatrcacatagttctgtaaaagggaaactgaggaataatttaaaattatattttatatataaatttagaagagatttgtttctgtaattcataaacataatcaa

SEQ ID NO: 19426 - DNA, 201 bp, Homo sapiens
tgtaaaagggaaactgaggaataatttaaaattatattttatatataaatttagaagagatttgtttctgtaattcataaacataatcaaaaactcttgartaaatacactctttaatgaaaatacaattcttacttcgaataaagttgttccaatgaggactgcatagtttccaaataaccaggccacacagaaatccca

SEQ ID NO: 19427 - DNA, 201 bp, Homo sapiens
aaagggaaactgaggaataatttaaaattatattttatatataaatttagaagagatttgtttctgtaattcataaacataatcaaaaactcttgaataamtacactctttaatgaaaatacaattcttacttcgaataaagttgttccaatgaggactgcatagtttccaaataaccaggccacacagaaatcccatttt

SEQ ID NO: 19428 - DNA, 201 bp, Homo sapiens
cagctccctgcaacctctgcctcccaggttcaagtgattctcctgcctcagcctcctgagtacatattttagacttacacaatcagaatacaaaagtaaartttcattttacaaagcacccactctgtaccaggcctgtggtaggcactgggcccacgaagacgataaagatgcattctctgctctcactgagctcagtgt

SEQ ID NO: 19429 - DNA, 201 bp, Homo sapiens
gatttgtttctgtaattcataaacataatcaaaaactcttgaataaatacactctttaatgaaaatacaattcttacttcgaataaagttgttccaatgargactgcatagtttccaaataaccaggccacacagaaatcccattttctagtaactcattaaatagcccttgacaaacctagaaagaaatagaaaaacttc

SEQ ID NO: 19430 - DNA, 201 bp, Homo sapiens
caggttagagtgcagtggctagtcacaggtacaatcatagctcactgctgcctcctactgctggcctcaagcaatcctcctgcctcaggattcagagtagytgggaccacaggttgctgaaatttaatttttaaaaagtgaaaatactggccaggcacagtggctcacgcctgttatgccagctctttgggaggctgaggc

SEQ ID NO: 19431 - DNA, 201 bp, Homo sapiens
gtcaaactaggggagctgccaagctggatcttgatgtgggacttcagccctagtggccttgatggagcgtttcaaagaggttactactggtactacaacargtacatcaacgtgaagaaggggagcatctcggggtttaccatggtgctggcagggtacatgctcttcatctactgcctttcctacaaggagctcaagcac

SEQ ID NO: 19432 - DNA, 201 bp, Homo sapiens
ttgtaccagtgaaggacaagaaacttctggaggtcaaactaggggagctgccaagctggatcttgatgtgggacttcagccctagtggccttgatggagcrtttcaaagaggttactactggtactacaacaagtacatcaacgtgaagaaggggagcatctcggggtttaccatggtgctggcagggtacatgctcttca

SEQ ID NO: 19433 - DNA, 201 bp, Homo sapiens
aagaggttactactggtactacaacaagtacatcaacgtgaagaaggggagcatctcggggtttaccatggtgctggcagggtacatgctcttcatctacygcctttcctacaaggagctcaagcacgagcggctatgcaagtaccactgaagaagacatgctctgcactcccccagcaaccttcttggctgcaacccctc

SEQ ID NO: 19434 - DNA, 201 bp, Homo sapiens
aggttgctgaaatttaatttttaaaaagtgaaaatactggccaggcacagtggctcacgcctgttatgccagctctttgggaggctgaggcagggggatcrcttgagcttaggacttcgagaccagcctgggtaacagagcaagacttcatctctacaaataataaaagaagttgcagtgagctgtgattgtgcaacggca

SEQ ID NO: 19435 - DNA, 201 bp, Homo sapiens
aaggagctcaagcacgagcggctatgcaagtaccactgaagaagacatgctctgcactcccccagcaaccttcttggctgcaacccctccataagcaacamaatctcgattgttgctgaatcctttcatatcctaatgggaattaacctccaaataaaagatgactggtacttgtgaaaaaaaaaaaacaaaaaaaaaacc

SEQ ID NO: 19436 - DNA, 201 bp, Homo sapiens
cggacagattgtttaaggaacagcaatgattccatggaccagttttctccagggtagagcactgttaatatatccgactacttcaaaaagatgagaactarctaacttccttgcatgggaatacagggccagttgcaatccccaagatccagcaagactgcctcgcctttccacccgacacctgttttgaagcatgaaatc

SEQ ID NO: 19437 - DNA, 201 bp, Homo sapiens
tttaaatataacacaagtttaaatataacacaagtattaacaaacagtttcttaacagttataattttctgtgtgaaaacagaagttagctgaggtcatamaaacaccatgtagtaacatattcagctgccccccagatttctccacttagatgtttggcagaaagaaattaatttggccaggcatggtggtacatgccta

SEQ ID NO: 19438 - DNA, 201 bp, Homo sapiens
aagaaataatggtagctagagtgattattctatttttgtgaagccacaaatcaccctcttcaatctctaaaatgggtatgtttctttaattatgtgatgtyaatgtttataacttccatatcatatactttataaatcgtatacttcttctgaaaatgaagtaattaagcatagcaaagctgaatactaaatgccaatctt

SEQ ID NO: 19439 - DNA, 201 bp, Homo sapiens
taacaaacacatctgagcccaacaaatgtttttaccaaagtaactttgtaatctagaacaatgaaaattgttacaaagagtttttgtatttgtataatatrttaatagctacatacatcaaatataatttcttgtatgtcagaagaattaccactgacacattaagacaatttatgtattaactattaaattaaaggtaat

SEQ ID NO: 19440 - DNA, 201 bp, Homo sapiens
aatcgcttgaacacgggaggcagaggttgcactaagccgagatcacgccattgcaccagcccgggcgacagtgcgagactctgtcttaaaaaaaaagaatratacatttttctgtgttgttcaccactatagcaaagtgaataaaacatagtacgtgtttaataataatttcataaaaatatcctgggacaataaaacctt

SEQ ID NO: 19441 - DNA, 201 bp, Homo sapiens
ggcggatcatgaggtcaggagttcgagaccagcctggccaacatagtgaaaccccatctctaccaaaactacaaaaaattagctgggcgtggtggcaggcrcatgtaatcccagctactcgggaggctgaggcaggagaatcgcttgaacacgggaggcagaggttgcactaagccgagatcacgccattgcaccagcccg

SEQ ID NO: 19442 - DNA, 201 bp, Homo sapiens
ctgagaataaacactggtacctcaacacatcatttggggtgatatcacagaagaaccgcataataacctcagccttttggttcttggatgcaatccaagarcaattattttagactgaagtctcttacaataaacaatattataataaagatgcaatttggtataacaaattataccaaaatcatgtttcctttattgagt

SEQ ID NO: 19443 - DNA, 201 bp, Homo sapiens
cttacttcaactctttttttttcagtgagtactaaaacttgatcatcaattacagagccattttgactaatatggaaagttcatggaggtaggtagcaaargctgaagctgtgacaatggtcaagggtcaaactctacatcagccaggaatgctaggtgagggctttgaattttaccttacacagaaaggctaattaacaa

SEQ ID NO: 19444 - DNA, 201 bp, Homo sapiens
tgagtcgggaaatggtaacataacacatggcaagacaaaaatgcttacttcaactctttttttttcagtgagtactaaaacttgatcatcaattacagagmcattttgactaatatggaaagttcatggaggtaggtagcaaaagctgaagctgtgacaatggtcaagggtcaaactctacatcagccaggaatgctaggt

SEQ ID NO: 19445 - DNA, 201 bp, Homo sapiens
tctaaaaaaactgaaaaatacttagactacatgcactaaatttattatttagagtttatgttagaaaccgagcacactaacattaagaacaaacaaacccrtatttttagtttcccaagtctatctctgaaatatcaacagcacctttctatgaagatttttctttcttgtaaaggagttctctgtcagctggaaagaatc

SEQ ID NO: 19446 - DNA, 201 bp, Homo sapiens
aaaaaatttttaaatgaaatttgctttttttttttttttaaagggtctggctctgttgcccaggctagaatgctccactcactgcctcactgcaacccccrcctctgggctcaagccatcctcccacttcagcctcctaagtagcagggactacaggtgcacgccaccacgcccagctagttttagtatttttttgtagag

SEQ ID NO: 19447 - DNA, 201 bp, Homo sapiens
cttctttcagcatcactttggaccctaccagcctgggccacgtggcttaccatttcaactttctctctcttgtcaaaacctactgttcttctctttttatrtatatttttttgaatgaaaaaaatttttaaatgaaatttgctttttttttttttttaaagggtctggctctgttgcccaggctagaatgctccactcact

SEQ ID NO: 19448 - DNA, 201 bp, Homo sapiens
atccctatttaaaacaaacaaaaaagattgtttattgttttctaattttttgaaaattggatatccaacaatgtcaggatatctggtggcaactcttccawcaatatctgatttctcacactatccagaataaattcttttctatcctaactgttcttcagcctttattggtctgcttcactgttctctaaaaaatatatt

SEQ ID NO: 19449 - DNA, 201 bp, Homo sapiens
ttattgtctattttgtcctactagaatataagcttaacaagaatagtatggctgggcgtggtgactcatgcctgtaatcccagcactttgggaggctgagrtgggcggatcatgaggtcaggagttcgagaccagcctggccaacatagtgaaaccccatctctaccaaaactacaaaaaattagctgggcgtggtggcag

SEQ ID NO: 19450 - DNA, 201 bp, Homo sapiens
tctactaaaaatacaaaaattaaccgggcgtggtggcgcacacctatagtcctagctactcaggaggctgaggcagaagaactgcttgaacctgggaatcrcgacactgcactccagcctgggcaacagagtgagatgctgtctcaaaaaataaaaaaataaaaattaatctactttctactcattatatataaactccta

SEQ ID NO: 19451 - DNA, 201 bp, Homo sapiens
agaatgaggaagagggaggagttaaggatgatagccagtttctctgtcttgagcaattgggtgaacagaggtgccaatcccttagaagactagaacagacyatccctccagaatagaattcccttccactcagtctcagaatggaccacaatgccagcaaagaaaggcattccactcatattccttcagtcttgattcaac

SEQ ID NO: 19452 - DNA, 201 bp, Homo sapiens
ccacccgggttcaagtgattctcttgcctcagtctcctgagtagctaggactacaggcacacaccaccatgtctggctaatttttttctatttttagtagrgacggggtttcaccatgttggccaggttgttctcaaactcctcacctcaggtgatcagcccacctcagcctcccaaagtgctgggattacaggcgtgagc

SEQ ID NO: 19453 - DNA, 201 bp, Homo sapiens
tagaaaaacttcaaatatgaaagaaataatggtagctagagtgattattctatttttgtgaagccacaaatcaccctcttcaatctctaaaatgggtatgyttctttaattatgtgatgttaatgtttataacttccatatcatatactttataaatcgtatacttcttctgaaaatgaagtaattaagcatagcaaagct

SEQ ID NO: 19454 - DNA, 201 bp, Homo sapiens
gaaaaaaaagaacaaaataagacactaatagccacaatacaaaaatcatctttaaatccctagtcacaaggttgagctgttcgttaactatgataataacyaataagtttcatttgagagctgagtaccccaaaatgaagtgtgatggtggtggagttaaaggaaaatgttcaccagttaataagccttctagtttttcat

SEQ ID NO: 19455 - DNA, 201 bp, Homo sapiens
cattttaaaaagcaaatgaatcaaaataaaattttaaatggcaagctatcaagtttacttagagtaagggttaggttgagcatccctaatcagaaaatccraaatccaaaatgctccaaaacctgaaaccttgagttcaaaggaaatgctcatcagaacatttaagattttggatttttggattagagatgcaaatatacc

SEQ ID NO: 19456 - DNA, 201 bp, Homo sapiens
gcgggcggatcacaaggtcaggagatagagaccatcctggctaacaaggtgaaaccccgtctctactaaaaatacaaaaaattagccaggcgtggtggcargtgcctgtagtctagtcccagctactcgggaggctgaggcaggagaatggcgtgaacctgggagatggagcttgcagtgagccgagattgtgccactgca

SEQ ID NO: 19457 - DNA, 201 bp, Homo sapiens
aggctagaatgctccactcactgcctcactgcaacccccacctctgggctcaagccatcctcccacttcagcctcctaagtagcagggactacaggtgcaygccaccacgcccagctagttttagtatttttttgtagagatgaagttttgccatgttgcccagacagactggtctcgaactcctgacctgaatgatccac

SEQ ID NO: 19458 - DNA, 201 bp, Homo sapiens
tgcaacctccgcctcctgggttcaagcaattctcctgcctcagcctcccaagtagctaggactacaggcacaagccaccatggccaggtaattttttgtakttttagtagagacggggttttgctatgttggccaggctggtcttgaactcctgacctcaggtgatctgcccgcctcaacctcccaaagtgctgggattac

SEQ ID NO: 19459 - DNA, 201 bp, Homo sapiens
aaaacatagtacgtgtttaataataatttcataaaaatatcctgggacaataaaacctttaccatataaagaacaactgcaacttgacaatgtccacatgsctcaaaggataagaattgagaacctgagaggacaagaaagttcaagtgctgccccttcattttacacataataaaaccattagatgctctaattatagaa

SEQ ID NO: 19460 - DNA, 201 bp, Homo sapiens
tccacccgacacctgttttgaagcatgaaatcgtgaagcataccgtgaagaaggttctcccgtagtttcccagaagtttttaatacgttctcaagaaatgytactagctgttccttactcagctctttgtcttgcaagatttcgcgtagagtttctgcagaaactaacctgaaggcactgtccccgggtagcaaagggcct

SEQ ID NO: 19461 - DNA, 201 bp, Homo sapiens
cgtccaccgggaatacctgctccctgaacaccaccaccgaggtccaccattctgcggccaggttcttccgcaactctacgcccaagggtccgaagccgggrtggcacccactcagaagagaatcccggctaagctgctgcttgcttccacttaggaaatgccttctctgacagatctctaacagcgcctcgcttccctctc

SEQ ID NO: 19462 - DNA, 201 bp, Homo sapiens
gccttaaaggtccttatgacaccctgatctagaggctgaattagagatgtgtgtttgggggcaagtagatcacttcaatgtcttcggtgttgaactcatgsagtttggggtggcctcgggcattctccagtatcaaaagaactttaaaaggcagtccccttactggcaagatactacttaacttcagggacaaatcgacaa

SEQ ID NO: 19463 - DNA, 201 bp, Homo sapiens
atgtccccaagctgaaaaactgtctttgctgcctttttgcttactcttcatacggatctattcattgattagttccgtggctgtcaatatacagttgaatyctttacgatccggtttgtggcctacatccaacaccgactgagcacttgctaagtactgggatctgaagattactcagccactgtctccacggagatcatc

SEQ ID NO: 19464 - DNA, 201 bp, Homo sapiens
ttctgtggtaataccatgcactagggaaagcacgtgatgacttacaacagttaattttattgtgtcaagttggctaggctatggcacccagctatctgctgaaactccagatgttgctgtgaaggtattctgtagatgtgattaatatttataatcggctgactataaggaaagcagattattccccataatgtgggaagg

SEQ ID NO: 19465 - DNA, 201 bp, Homo sapiens
aagaaggccgttagaggctgggaagcagacttcatcccacttgccagaggggttcaagggcaatcttttctttttcaaaggacccttcctgctcagcctcrtctctaaaataagaacaataataactgccaaaaaatagctttccatgcagataaaatatcaagaatcaataaggtcagaaatatatgtttattttcttgt

SEQ ID NO: 19466 - DNA, 201 bp, Homo sapiens
gacaaactacatgactggcttctccaatcagatccgaaagtcagggcctgggtgttgtctttatttcttgttccactcagcaacaggcatagaactgttaycagatggctgaatttaggactgcatgctggctgattctgttcccagaagcccaagataattaagaacctacttgtatctcttttccaaatgaggagttct

SEQ ID NO: 19467 - DNA, 201 bp, Homo sapiens
ttttctatcacatagttctaccaccctatgatttcacacctaagttcctgtaatcaggactaaagatagatacctaagacgtggctggtccagtgcaaaayggaatgtgaagccatccaatccatcagtgagccctgacatctccatctcctacacatatctcaaacccatctcctttttcccctcactaactccactcaa

SEQ ID NO: 19468 - DNA, 201 bp, Homo sapiens
ctcaaatcagttaaacctaccttttctatcacatagttctaccaccctatgatttcacacctaagttcctgtaatcaggactaaagatagatacctaagaygtggctggtccagtgcaaaatggaatgtgaagccatccaatccatcagtgagccctgacatctccatctcctacacatatctcaaacccatctccttttt

SEQ ID NO: 19469 - DNA, 201 bp, Homo sapiens
ataaacccaaagctacataatttttaaatgtgtattatatattaactgcatattatataatatataaaatcaaactacagttgtcccccagtatctatggrgaattggttccaggacaccccaaggataccaaaatccaagcataccccagtcctacatttgaccccatggagcctggatacacaaaatgttggccctctg

SEQ ID NO: 19470 - DNA, 201 bp, Homo sapiens
agagctgtaaagaatagaagagatccaagaacagagatagaaggtataaacaaccaatatcataaatttctaaagcagaaaggaacaatggagaccgaacraataactaaaaggcctgaaataaggaattctcgacatttgtaaaaagaggccagcatggaaacggagggatttgggaaaggctaataaccagaaaaagaa

SEQ ID NO: 19471 - DNA, 201 bp, Homo sapiens
tttctactttggcaaactcaattttaaaaagcacagctaccttgagatgtaattaagtactttctaccaaggtcaaaccagtggtatgttaaagtagagcmccttcatattctacctcaccaaacttagagatgtactaaatttagatttccaagtcaagccagcaagataagacctctggggcaaacactatctctggac

SEQ ID NO: 19472 - DNA, 201 bp, Homo sapiens
ttttgggggtgttagaaatgttctagatcatgagtgcaatggtggttacacagctacaaacatatgtccaaatgtactgaattcttcatctaaaattggtraattagctttattatatgtaaattatacaactgtacaacacataattttattgtatgtaaattacacaaaataattttatgcattaatcttcctttacaa

SEQ ID NO: 19473 - DNA, 201 bp, Homo sapiens
aactttactgactgatcagtttgccaaaggctggcagtggagggagaaggctgactgcaaaaggggaagtagggaacttttgggggtgttagaaatgttcyagatcatgagtgcaatggtggttacacagctacaaacatatgtccaaatgtactgaattcttcatctaaaattggtgaattagctttattatatgtaaat

SEQ ID NO: 19474 - DNA, 201 bp, Homo sapiens
ataccttaattgcagccttgtaaaggaccctgagccagaggccccagctaagcccagccaagattcttggcccattgaaaaagtgggataatagggtctgytgttttaagctgccagcttttaaggtaagttgttacgtagcaatagataatacatctagtgtcacagtaatacacccagtgttggtgagtataggagtca

SEQ ID NO: 19475 - DNA, 201 bp, Homo sapiens
tcacaactctaactctgctgctgtagtgttaaagcagccatacacaagatgtaaactaatgagcatggctatgctccaataaagctttatttacaaaaacrggtggcatgctggatttgtcacaggttgtagtttgccaactctgcaatagagagcattaaaaaaaaaaaaaaaagcaaatatcaggccaggcacggaggc

SEQ ID NO: 19476 - DNA, 201 bp, Homo sapiens
cataccaataaatctgacaatttagatgaaatgaacaaattacttgaaagacataaactaccaatgctcattccagaagacacagataaacttgaataggytaatgtctactaaagtaactgaactaatagtgaaaaactttcattaaagaaaactcctggccgagatggccttactggtatattctactaaacatttaaa

SEQ ID NO: 19477 - DNA, 201 bp, Homo sapiens
ttgtttagtcctctaatacttatttaacaaatccatatattaaattctgtgataaaataatagataggcttttgttttcctttctagatcttgactgatayaccagcctttttgaatccaaataaaaactcttaacaatagacttgaagtataagagagtgaacagaggtataaataataaacagatgacaatatactaga

SEQ ID NO: 19478 - DNA, 201 bp, Homo sapiens
acagttttgaagatgatgatcacatttcttctaagaaatacctattataataaattcaagaagttctggggccctgattcctagttgcttttatttcaacrgtttgtaaagtgcttttacacacaccctcttatttaaccttcaaagcattctattgaagcacacagagaagtcttatgcccatttctaaatgaggaaatc

SEQ ID NO: 19479 - DNA, 201 bp, Homo sapiens
gaccacttgagcccaggagttgttcaagaccagcggggacaacttggtgacaccctgtctctacagaaaatttgaaaattaaccaggtgttgtggcatgcrcctgtagtcccagctactcaagaggctgaggtgggaggatcacctgagcccggggcggtggatgctgcagtgagcggtgatcactgcactccagcctgag

SEQ ID NO: 19480 - DNA, 201 bp, Homo sapiens
tcgtaaagcctgtgaagtcatgcacatctggacacagttttctctagcaggaatttattgtcctgggcttgatggctttcacagctttttctataacaatkatggcatcattgatggtgtaattctttcagactttcatgttctgtcaaggttcttttccatacatttgacaatcctttctatagagtactgtttgtaacg

SEQ ID NO: 19481 - DNA, 201 bp, Homo sapiens
ttttttttgtgccagatccacaatctttttcatgatttccttgattggctgtcgtaaagcctgtgaagtcatgcacatctggacacagttttctctagcasgaatttattgtcctgggcttgatggctttcacagctttttctataacaatgatggcatcattgatggtgtaattctttcagactttcatgttctgtcaag

SEQ ID NO: 19482 - DNA, 201 bp, Homo sapiens
tttttttttgtgccagatccacaatctttttcatgatttccttgattggctgtcgtaaagcctgtgaagtcatgcacatctggacacagttttctctagcmggaatttattgtcctgggcttgatggctttcacagctttttctataacaatgatggcatcattgatggtgtaattctttcagactttcatgttctgtcaa

SEQ ID NO: 19483 - DNA, 201 bp, Homo sapiens
tgaaggaaatcccatacctgactactttcaactacgttttatggggcagaaggctggggtactacagctgtcttaccacaggttttcggaatggagctttyttctctctgaaggtcttccagccagactgcaagcacagaggaatctgcattccagagcaagtcatttacctagaagggaaaaaagatctgtcattggctt

SEQ ID NO: 19484 - DNA, 201 bp, Homo sapiens
ctctcatctctctctcctcaccttcttccaaatgaggaattctatctaaaatggaaccctcaccttctaaaatggaaggctttacgttggtttctataatmtccagtctgttatatttgtatacctagaaggaaaaacacaataattttaggaaggaaaacttctagtcactggagagttaagatacttagaaagacatgg

SEQ ID NO: 19485 - DNA, 201 bp, Homo sapiens
tagaattgggacctagaacctgaggagaaaatagactgtatcagcaaagattatctaatacttctcaagacttccaataccaaaggccaaatccctaccascagaaaacagcctgtcatttctactggtatggtgtgaaacacagtaattctctttcccaatgtgattttaatttgccagtttctccagctgcaactcaga

SEQ ID NO: 19486 - DNA, 201 bp, Homo sapiens
gtagaattgggacctagaacctgaggagaaaatagactgtatcagcaaagattatctaatacttctcaagacttccaataccaaaggccaaatccctaccmgcagaaaacagcctgtcatttctactggtatggtgtgaaacacagtaattctctttcccaatgtgattttaatttgccagtttctccagctgcaactcag

SEQ ID NO: 19487 - DNA, 201 bp, Homo sapiens
tgataagatgccatgatactatttgcagtagaattgggacctagaacctgaggagaaaatagactgtatcagcaaagattatctaatacttctcaagactkccaataccaaaggccaaatccctaccagcagaaaacagcctgtcatttctactggtatggtgtgaaacacagtaattctctttcccaatgtgattttaat

SEQ ID NO: 19488 - DNA, 201 bp, Homo sapiens
actggaactgtggtgtgcctttatgaacaagcatatgccacataaatatttttaaaaattacacatacaatggtcatgctggattttcctgcaccaggtcycccaccgctagaagcatgaaactgatcatactaaagatgcggtcttagaattgaggaagaattgtagtcaattttttgtagtgaaaaattgtatccaatc

SEQ ID NO: 19489 - DNA, 201 bp, Homo sapiens
gcacatgacctggtaagatgttacaaaataatagctgtcagcaaaggagggcttataatttcaaaggatactttttattctgctttagtttaaggtgacawgaagctatttaagtgattacatttgaccaaatgtagcactaatagccattgtaatcttctccgccaacaaaataagacaatttagaaacattgttttact

SEQ ID NO: 19490 - DNA, 201 bp, Homo sapiens
ggctccacctgcatgatctcaggcaagttatctaactgctccatgtcttagttgtctcatctgtaaaatgatggtgcaaatggcatatactttacagaggkattatgagaaataagtaagctaaaacagacaaagcatttagaagagtattttttacaaagtataagctaaagtaaatgtaaactaaatcgagggactttg

SEQ ID NO: 19491 - DNA, 201 bp, Homo sapiens
tataagagtttaaatgaatttaatgtgacacggacactacttccccaggtgccccaagagtctgcactcttcttgtgtccacacacctctgccttcagggsccgccccgcctacattagaagattaaaaagtcctgccttgagtcatcaagacatcattatatggtcttcagaattttccaatccagaagtaaggaaaaca

SEQ ID NO: 19492 - DNA, 201 bp, Homo sapiens
gactgcagagtatgacgtctccagaggctgtggccacacacacagactcctgatccagcaagtcctgaacaccaacaatgcggccacttccatcctctggragaaagccttctgccaccaaagaaacttcatttttcacctttcaccaaagtaaacacaagcaaattaacccagtctactttcaagaataattgataacat

SEQ ID NO: 19493 - DNA, 201 bp, Homo sapiens
caaaagacattggagaagggaccatttctgttttatacattgaaaacttacttttaaatgaagcatccctcaggcaaaaacactggcaggtatgggaatgrgttgtcaacaataaaaactcatcatatactgcaaatgacgtgatatttgacgcaacctgcaagagaaggccagagaggcatgggtgaaagctagctagat

SEQ ID NO: 19494 - DNA, 201 bp, Homo sapiens
cacttcggtttttcaaaggatgccacctggtgacagcatacatacttatgaggatttatgctctccatgactgctctcatagcatcgcagacaaggtctaktttattcccgtcaggatccctggacaggtagacactgctggtaactggtgcagggtacatggtcttcgtgacatcttcttctctaagaacaggtgtgtat

SEQ ID NO: 19495 - DNA, 201 bp, Homo sapiens
caccagaatgagaaaggtaagtaggctggacaaggacaactacacacttcggtttttcaaaggatgccacctggtgacagcatacatacttatgaggattyatgctctccatgactgctctcatagcatcgcagacaaggtctattttattcccgtcaggatccctggacaggtagacactgctggtaactggtgcagggt

SEQ ID NO: 19496 - DNA, 201 bp, Homo sapiens
atcagtcactgtctaaactaacagtttaatttataccttgcctagttccaaagaagatctgaagtagagataaacatactaatccccacacttaccacatwtgctgaggtggccaatggctttttcatatcgtttcaagtatttgtctatagtaaaccgctgataattagtttccattttcttaagtgtattaagaaatgg

SEQ ID NO: 19497 - DNA, 201 bp, Homo sapiens
accagctggtctttggtaaagttaagctgggctgccacacagagggcttgcttccagttgccacatgtcagaaaggctgagagagctttctcgtgggcacygcaacgggcaaacatgagccccgctggctcatacatgtgctcctgcatcaggtgctccccataagcaatgctgatatcctgtgacaagaggagatttagg

SEQ ID NO: 19498 - DNA, 201 bp, Homo sapiens
ctacttatttcatgaacctcagaagacaagagattccaactgacctggaatcccttgcttgctctctctgcttagcacccaacatccagaggatttacaarattcttaccagcctcaaagcttcttcccaggcagctccttctaacagcaagagcacagcttcttcataatcctgacaagggaacaggaagaagacaacaa

SEQ ID NO: 19499 - DNA, 201 bp, Homo sapiens
ggctgaggaagaaaaccttccaatgccaagtttaatgtctcagatatgctgggaaagtgtctgaacaacttccacacagcgctgaagaatattctccccaytcccactacaccgtcccagtagaaaaccaatctatttgcttccactttccctatatgcccaggatatagtcaatgtgctgaatcaatgtgatacgtacgc

SEQ ID NO: 19500 - DNA, 201 bp, Homo sapiens
ctccaacctcattgaaggccaggagcaatcatgtgactttcccattttctccatgacagctacttcatccagaaaggaaaatgacagtccatttaacctawgccaaggtatactagtcactctacaggcaaatatcaaatcttactgacagcttacacataaatctaagataatttaactatggcatcttatgttttaaga

SEQ ID NO: 19501 - DNA, 201 bp, Homo sapiens
cagaggaggctccgggtctccttcacccggacaccgccggcggagaggtccactcccgtgcccctaccctggatggatcgcttacctgaggacccccaaasagaggtgcgtccggcctcgcctccccagccacgcgcagccggctacccagagtcagctcccacagtccgcacccagagtcggctccgaattgcgcacgcg

SEQ ID NO: 19502 - DNA, 201 bp, Homo sapiens
ccccgatggagcaggtggcaaggctgcaaaaagaatttaaggctctaggaaagaggtggtgcagcccgcactccagtccccggcccgcagcaggcagaggmggctccgggtctccttcacccggacaccgccggcggagaggtccactcccgtgcccctaccctggatggatcgcttacctgaggacccccaaacagaggt

SEQ ID NO: 19503 - DNA, 201 bp, Homo sapiens
gggctgtcgcgcctcccagcgcccccgatggagcaggtggcaaggctgcaaaaagaatttaaggctctaggaaagaggtggtgcagcccgcactccagtcsccggcccgcagcaggcagaggaggctccgggtctccttcacccggacaccgccggcggagaggtccactcccgtgcccctaccctggatggatcgcttac

SEQ ID NO: 19504 - DNA, 201 bp, Homo sapiens
gctaatagacatttaatagctgggggtttaactttcacagttctttggcctaatgacatggctattagtgcacaaggaaatggtcaaaaatgggaagaaaygtaggtcacaaaatattgcacaaagctatacttactttcaccaaaatcatcctgatggatctgctgctccaggattggctcaaaatcttttgtcatcata

SEQ ID NO: 19505 - DNA, 201 bp, Homo sapiens
agtgtaaacagaccatttttctcaaaaatagtgacatttcactgattttgaaaatcaacaatttccttttgatgctgcactacctacttcaatacaatgtmgacaaaatacatatatacacacccaatactatacacacacacacacacacacacacacttatacacttagagacagacggttagatgaatagataaaact

SEQ ID NO: 19506 - DNA, 201 bp, Homo sapiens
atttaactgagatattatgttgagattagggtctaagtaaaataactctaaagattttctccagcctaggactccttgataaaaagccaaaataaatgaakaattcaaaaagtcatcaagactccaaaagacattggagaagggaccatttctgttttatacattgaaaacttacttttaaatgaagcatccctcaggcaa

SEQ ID NO: 19507 - DNA, 201 bp, Homo sapiens
cttgttgttctctatatttatcttgactttcaagaaaagtttcgctttgagccttatggtcacagcctgtatcaacactcctttgaataaagctaacagaraactatcaaggaaaggtttacaataaacgatacaaagaataagaaagcctaaaatacaacctgcaagaattatgcttggtacttggctgaatgacaatca

SEQ ID NO: 19508 - DNA, 201 bp, Homo sapiens
aagatacacatgaattattcaaaatacttacttcaattctgtaaaaaacaagttaatatgattcacagaatctatctgtttaatgaaggtttccacatttycaagaaacacctaccaaaaaaaggacaaaacatcttcgttcagatcatattagtttaagtacaaagtaagctagagtaaatgacagcttagaaagttacc

SEQ ID NO: 19509 - DNA, 201 bp, Homo sapiens
aacaagtagttttatatgtatacctaaaaatcaagtgaaataataattctgaatgacatgttttaaggacatagttttaaacaggctgttttaaaaagaamggaaaagagcaaaaaaccaactggcatctaagagttatagcaatttttaaaaatgaacagtaaggaatttttcttctctagctatttatgcttgatttcc

SEQ ID NO: 19510 - DNA, 201 bp, Homo sapiens
aaaacagaacacaatcatttggggaaaaaatccacagacctaacaacataaccaaaaagacaataaatttttctcaatagaactggacatcagaagaatayatacttctgatacttttatatatgctttagagggcagcactgaaaaaaactgacaagggtcttaaaatggcaactaaaaagtcacatgttaaatctgtgg

SEQ ID NO: 19511 - DNA, 201 bp, Homo sapiens
tttcctaacagtgtttagaaaacaaaacagaacacaatcatttggggaaaaaatccacagacctaacaacataaccaaaaagacaataaatttttctcaayagaactggacatcagaagaatatatacttctgatacttttatatatgctttagagggcagcactgaaaaaaactgacaagggtcttaaaatggcaactaa

SEQ ID NO: 19512 - DNA, 201 bp, Homo sapiens
gacggcactaggcctccaaggatggaggcgccctccaggggaaaacgctgaagcgctgcaaagaagccagcgactcaatgggtgcgtcaactaggcagccscagcactgggagtgcggcgcgggagtgacgtcaccaggcggagggggcgaggccgggcccgcttctggtcacttacggcggccggccttctttgtaggcc

SEQ ID NO: 19513 - DNA, 201 bp, Homo sapiens
ccgtgcccctaccctggatggatcgcttacctgaggacccccaaacagaggtgcgtccggcctcgcctccccagccacgcgcagccggctacccagagtcmgctcccacagtccgcacccagagtcggctccgaattgcgcacgcgtctctgtccgcggctcccgctctctctccgacggcactaggcctccaaggatgga

SEQ ID NO: 19514 - DNA, 201 bp, Homo sapiens
actttacagaatactacaggcaattgtaataccatgtcaagtatttgtgtatctaaacatagaaaaggtatgtatacacacacacacacacacacacacayacacatatatgcgcatgactgcatttatacaaaatttcttcccatcacattagcccatgagaattagccactctaattatgcttgacagttattaaaatc

SEQ ID NO: 19515 - DNA, 201 bp, Homo sapiens
atgaacatatttgcacttttttttaaagctattttgaaaagtttaaggaggactgtaacagcattttacacactgaaactataatcagagaaactggtgakacatccagataggatccatgtacacagtgggctgctgacttaacagaaaagctgatatgaaagtaaggacttcccatttaaattaattaattttgattat

SEQ ID NO: 19516 - DNA, 201 bp, Homo sapiens
ttttgtgaggataaattatctgtcaagaagagaacaaactctggagctagactcgctgggatttgatcctggctccacctgcatgatctcaggcaagttayctaactgctccatgtcttagttgtctcatctgtaaaatgatggtgcaaatggcatatactttacagaggtattatgagaaataagtaagctaaaacagac

SEQ ID NO: 19517 - DNA, 201 bp, Homo sapiens
atacttacgtataatctccattccaacacactgaactgaactcttgagatgaagcctgaatatcattttttttctaaaggtgtggccagggttaagaactrttgtgttgaatgaataatgagtttcttaacattgcagttaaaagggttctactgaggccgggcacggtggctcacgcctgtaatcccagcactttgggag

SEQ ID NO: 19518 - DNA, 201 bp, Homo sapiens
accacaaacttcatttgaaaaggtaacttttaaaaaatactttgaaacgttgaaacctacataaaagttgtaagagttcaatgaacacacatatacccttyactttgatttaccaattactaacattttgacatttttttgcttcctgtttctctgcatgcatacacacattcattaatacttttgtggaaccttttaaga

SEQ ID NO: 19519 - DNA, 201 bp, Homo sapiens
agctttaaacctgggcctgcaaccaagccacactaaaccaagggaattaatactttcaaaatccttaaagcactttcctatgtgtggatttggtaataacrcagatctgattaagttctctatatagaatacatgactataaaatcagtattatgtagaatattacacagaatatgaattaatataccacctcacattaca

SEQ ID NO: 19520 - DNA, 201 bp, Homo sapiens
gtgtgggatggggaaatgtcatgggttctgtccataattggctattgtcacctctaggcctaggggagtccatctcagtacctggagtttcaggtgccagrgactaaggcaaaaaggccaagaggtcagacctctagctttaaacctgggcctgcaaccaagccacactaaaccaagggaattaatactttcaaaatcctt

SEQ ID NO: 19521 - DNA, 201 bp, Homo sapiens
tgaccacccgggcattcatcatcatattctagtaacagcctaagaattctgctagtactgtactgtagtctgcacagtagggaatacataggtagcctaamaaaatttattctcaatgaaactgtcctagggtatagaaaccaaacctcctttactgaagggttaaggcctgaaataggcattatatgaaatagaactgga

SEQ ID NO: 19522 - DNA, 201 bp, Homo sapiens
ggtgcaaacccccaggcttctatctgcaagtttccacagaaagattaaggaccaaggaatgaagaaagagaacttttccaatggaagacaagaaatgatgsggttacagcagggatttgcaaaactacagcctacatctgcttttacaaacaaacgtttactggaacatagatgtgcttatgtatcatgtataactttcac

SEQ ID NO: 19523 - DNA, 201 bp, Homo sapiens
atctgcaagttaaacatacttctaaataagccaaggttcaataaagaaatcacaagggaaattaggaaatgaaaacaaaacatttcaaaatttgtataacrtaactaaaacggtgcttgaggaaaattatggcattatatgcttaaactataaagtaaggaatcatctcaaatcaatagctttaagccatcaccttggtca

SEQ ID NO: 19524 - DNA, 201 bp, Homo sapiens
acataactaaaacggtgcttgaggaaaattatggcattatatgcttaaactataaagtaaggaatcatctcaaatcaatagctttaagccatcaccttggycaggcacagtggcttacacatggaatcccagcactttgggaggcagaggtggagggatcacttgaggccaggagtttcagaccagcgtgggcaactagta

SEQ ID NO: 19525 - DNA, 201 bp, Homo sapiens
tgaggccaggagtttcagaccagcgtgggcaactagtaacaccccatctctacaaaaaaaattaaaaattagccaggcatggtggcatgcacctgtaatcycaactactctggaggctgaggggggaggacagcttgaatgtaggagtttgagactgcagtgaaccatgatcgtgccactgcactccagcctgagcaagag

SEQ ID NO: 19526 - DNA, 201 bp, Homo sapiens
tagagaaaaacaatgaaacagttcattctttaataagatcaataaaattgataaacctctggccagaataatcagaaaaaagaagacacatcaatatctasaatgaaagacaggacatcaccatagaccctacggacagtaaaataagagaatactataaacacttcataccaataaatctgacaatttagatgaaatgaa

SEQ ID NO: 19527 - DNA, 201 bp, Homo sapiens
actgatttgaaaacttccacaaatagcaagtaacctatttgaggatgcttgagactcccccctcactggagtcttccacttacctgttgtgtgctgagacygcagagtatgacgtctccagaggctgtggccacacacacagactcctgatccagcaagtcctgaacaccaacaatgcggccacttccatcctctgggaga

SEQ ID NO: 19528 - DNA, 201 bp, Homo sapiens
atgcagcaaatatttcaaggcctcttcagcactcacagcatcaggatcagagggagcatttcctaacagtgtttagaaaacaaaacagaacacaatcattkggggaaaaaatccacagacctaacaacataaccaaaaagacaataaatttttctcaatagaactggacatcagaagaatatatacttctgatacttttat

SEQ ID NO: 19529 - DNA, 201 bp, Homo sapiens
agcactgaggattccctggaccttgaatatccctgaactccagggtccgaaataatttcagatttcgcatgatgaagtgattcccacgagacaagtacaastatcccttgatgaatcattaatctctaagagaaaaataaatagcttaatagtgataaatgaccatatttatttaaatgaaatgattcagggggtgaagaa

SEQ ID NO: 19530 - DNA, 201 bp, Homo sapiens
ttgaaaacttacttttaaatgaagcatccctcaggcaaaaacactggcaggtatgggaatgggttgtcaacaataaaaactcatcatatactgcaaatgaygtgatatttgacgcaacctgcaagagaaggccagagaggcatgggtgaaagctagctagattactcggagctaacactgtgaaaaggatccaacaccaaa

SEQ ID NO: 19531 - DNA, 201 bp, Homo sapiens
gcaggtatgggaatgggttgtcaacaataaaaactcatcatatactgcaaatgacgtgatatttgacgcaacctgcaagagaaggccagagaggcatgggygaaagctagctagattactcggagctaacactgtgaaaaggatccaacaccaaaccaagccttgatacctcaatgtcattgatgaaaaagcgacacctgt

SEQ ID NO: 19532 - DNA, 201 bp, Homo sapiens
aaaaagcgacacctgtcagtcagaccaaggacacattcctgcaaagaaataaaactgaaatcacaagcaattctatctcaaatcagttaaacctacctttyctatcacatagttctaccaccctatgatttcacacctaagttcctgtaatcaggactaaagatagatacctaagacgtggctggtccagtgcaaaatgga

SEQ ID NO: 19533 - DNA, 201 bp, Homo sapiens
aaataactctaaagattttctccagcctaggactccttgataaaaagccaaaataaatgaagaattcaaaaagtcatcaagactccaaaagacattggagragggaccatttctgttttatacattgaaaacttacttttaaatgaagcatccctcaggcaaaaacactggcaggtatgggaatgggttgtcaacaataaa

SEQ ID NO: 19534 - DNA, 201 bp, Homo sapiens
attttctccagcctaggactccttgataaaaagccaaaataaatgaagaattcaaaaagtcatcaagactccaaaagacattggagaagggaccatttctrttttatacattgaaaacttacttttaaatgaagcatccctcaggcaaaaacactggcaggtatgggaatgggttgtcaacaataaaaactcatcatatac

SEQ ID NO: 19535 - DNA, 201 bp, Homo sapiens
attagagactgagattccagatcttagagttcatcaacattatcccagaatatgcgctaccactgaacttgtaaaatcacctgaacgaagacttgataccyaaagcaagggaggattggcaaaacaaacaaacaaacaaaacaaacaaacaaaaaaagggggggtaggggaggggagctcagttaacaaaaataagaagaa

SEQ ID NO: 19536 - DNA, 201 bp, Homo sapiens
agaagactagtagcagtcacggccaccttaagcactttctctgtgagcggatctctaccttgaagctcgtgtactttttgcagtacaatttccagttctgsggttgtcttctttacatgagatgtaagtatggataggcagtatctgaggtaataagtgaagaacaccagaatgagaaaggtaagtaggctggacaaggac

SEQ ID NO: 19537 - DNA, 201 bp, Homo sapiens
gggttaaaattcagcaaaaagaaagaggttactaggttttccaagcgagctctttttccttaataagcattaacaaattagagactgagattccagatctyagagttcatcaacattatcccagaatatgcgctaccactgaacttgtaaaatcacctgaacgaagacttgatacctaaagcaagggaggattggcaaaac

SEQ ID NO: 19538 - DNA, 201 bp, Homo sapiens
taaaaagtcacatgttaaatctgtggtgtggcaatgacatggtgattgtcacctgcagaagactagtagcagtcacggccaccttaagcactttctctgtragcggatctctaccttgaagctcgtgtactttttgcagtacaatttccagttctggggttgtcttctttacatgagatgtaagtatggataggcagtatc

SEQ ID NO: 19539 - DNA, 201 bp, Homo sapiens
aggcatttagtggagacccaagtccacctccaaagcccacgctctttctacttaatgccatcagtccctgggtaactactttaagtaaatttcctgctccrtgttcacctacctcttctccaatcatggccaattcggtctgggtgcatggataaggaaaccgaacaggaaatccaccagagttcttccatggtttaatag

SEQ ID NO: 19540 - DNA, 201 bp, Homo sapiens
ctacctcttctccaatcatggccaattcggtctgggtgcatggataaggaaaccgaacaggaaatccaccagagttcttccatggtttaatagccagagamggtgactctgcaagattcacagatctagttcacaaatagctgatgcgctctttgcaaaaaaccatcaacatcaacatttgctaaaacacttaacatgcaa

SEQ ID NO: 19541 - DNA, 201 bp, Homo sapiens
attgaggaagaattgtagtcaattttttgtagtgaaaaattgtatccaatctctccttatactgctgatcttctcaatacttacagaaagatagtccttcygcttagtattgtaatattaaatgagaaaaaatactaaccaagaacaggaaccgaagtcttctgttgctgataagatgccatgatactatttgcagtagaa

SEQ ID NO: 19542 - DNA, 201 bp, Homo sapiens
gccactgcattctaccatccaccacaattataggcattctagtatgtgttgaataaaaatctactaaaactattctcaagatcacatttctgtttcccctmctaaataaaattaactttgaatgatttgtacaactagggataaaaggttgctaatcacatatattatctcatttagtcttctgaaccctgatagacagat

SEQ ID NO: 19543 - DNA, 201 bp, Homo sapiens
tctgtttaatgaaggtttccacatttccaagaaacacctaccaaaaaaaggacaaaacatcttcgttcagatcatattagtttaagtacaaagtaagctasagtaaatgacagcttagaaagttaccttagggttatgatcataaatcagattgagattgattctcagctttctcatgcattcaaatgcctctttaaacat

SEQ ID NO: 19544 - DNA, 201 bp, Homo sapiens
gatccctggacaggtagacactgctggtaactggtgcagggtacatggtcttcgtgacatcttcttctctaagaacaggtgtgtatggaatggtcatcaayagaacatgtagcccagcgatcaaattactaacatacacctggcatgctgatgatgataaataaaaatgacttttggaaaagagttgaattataaaaatat

SEQ ID NO: 19545 - DNA, 201 bp, Homo sapiens
cacagttcctttaactttcatgatcactaagatacaattgagaagacctttcttgctgactggggggtttagaagggaggaattgagtttacctgggcacwctcttccaaaaccatggccgcatcaatgtgcttcctctgctcaaccagctttcctgtagagacaataagcagcagttgactacaaagttaaacagatact

SEQ ID NO: 19546 - DNA, 201 bp, Homo sapiens
tttaaaaagaacggaaaagagcaaaaaaccaactggcatctaagagttatagcaatttttaaaaatgaacagtaaggaatttttcttctctagctatttaygcttgatttccttaacaagaagagagaaaactatggaaaagatacacatgaattattcaaaatacttacttcaattctgtaaaaaacaagttaatatgat

SEQ ID NO: 19547 - DNA, 201 bp, Homo sapiens
atctctggacttaacaattatgcacagttcctttaactttcatgatcactaagatacaattgagaagacctttcttgctgactggggggtttagaagggargaattgagtttacctgggcacactcttccaaaaccatggccgcatcaatgtgcttcctctgctcaaccagctttcctgtagagacaataagcagcagttg

SEQ ID NO: 19548 - DNA, 201 bp, Homo sapiens
atttttctgggctggagatgcagaatggaaaatagtttgagcatgaggtttaagcaaagagaaaaaactaaaggcggggagcagtgaaggagggttaaaaytcagcaaaaagaaagaggttactaggttttccaagcgagctctttttccttaataagcattaacaaattagagactgagattccagatcttagagttcat

SEQ ID NO: 19549 - DNA, 201 bp, Homo sapiens
agtctgtgagaagacagagaaagaatagaaaagatattcacaaaaactgagctccatgggcccagcatattttcattatgatacaaaccagttataatcasattacagccccaatgccaagctgctatcactggatttctactctgaaattacagaataaaaaaatcaggtaccacattcatttaccttcttaaaaggtgt

SEQ ID NO: 19550 - DNA, 201 bp, Homo sapiens
tgcattaaagtaaaaaagttaaaaaaaaaaaaaagagcctctaagaatctgattgatgatataggtaatgagggcttttcataattttaagttctcgaaaytgtaataaaatacttattgtcttcacacataaatcacaagctaactagtcgcaaacagtacaatggcacttacttgtccaaccacttccgaatctgagct

SEQ ID NO: 19551 - DNA, 201 bp, Homo sapiens
ccagtaatgatgcttcagaagaatcttttgatgtatatgtaaatgtagacagtttagactgaaactggaactgtggtgtgcctttatgaacaagcatatgycacataaatatttttaaaaattacacatacaatggtcatgctggattttcctgcaccaggtctcccaccgctagaagcatgaaactgatcatactaaaga

SEQ ID NO: 19552 - DNA, 201 bp, Homo sapiens
agacacaatcttgctcttcccacaggtgctgaaggataaactttgcttgagataccagtgatagtttccaacagtccagagctgaactgcaagggaaaatraaaagaaggccgttagaggctgggaagcagacttcatcccacttgccagaggggttcaagggcaatcttttctttttcaaaggacccttcctgctcagcc

SEQ ID NO: 19553 - DNA, 201 bp, Homo sapiens
caagtacatgttcttaagaactaagcatctatgtaagtcataacatgctttcctaacaccttgatactcaccccaaaggtacttaaatatctggccatcarccagctgtaatactactgacttggtcttggaattgcaacatagactgattatgaccccatccaccgctgcagatgaactgacaaaaaaaaggagaaggga

SEQ ID NO: 19554 - DNA, 201 bp, Homo sapiens
aaaaaaaaagaagaaacaaagatagatacagccttataaccaaatgaagaaacgtaaaaatccttttgtgttacacaaacatctgtatcatctgtatccaygtgtaccaccacctctactctggttccaagaatttctctaaggtttcttctcccactcacttccaagccagggctggtcccagtcctgccacaggctcac

SEQ ID NO: 19555 - DNA, 201 bp, Homo sapiens
ttaaggaagggaagtgtaaagtgtccatgaaggagtccatttttctcaaaaaacacaatatcctgctggttgggtttatcttgtgtagatgcaatcaaacygcctgagggtcttaaagcaaactcagagtgttacaatatcgaaagctcacctaactaaagaatagataaaatccagaagagttttttttccagcaaacat

SEQ ID NO: 19556 - DNA, 201 bp, Homo sapiens
agctttcttctctctgaaggtcttccagccagactgcaagcacagaggaatctgcattccagagcaagtcatttacctagaagggaaaaaagatctgtcaytggctttcagttatggatttacttccaaatctttataatagctgtatttcctctctcaaatcaaataatcccactacctgagctcatccctagctgtaaa

SEQ ID NO: 19557 - DNA, 201 bp, Homo sapiens
gaatctgcattccagagcaagtcatttacctagaagggaaaaaagatctgtcattggctttcagttatggatttacttccaaatctttataatagctgtayttcctctctcaaatcaaataatcccactacctgagctcatccctagctgtaaatcactaacctacagaggcattaaacaaatctgtaaaatatgtcatta

SEQ ID NO: 19558 - DNA, 201 bp, Homo sapiens
agcagttggtaggtgcacatgggaggcggaaccacagtctgccggaagactgtcaccaacaccctgtctgcagtgaaaaagaaagaagaggattagacctrgggatattcaatttgtaagataagccatctgaacatcacagtatatctaaacaataatggcaattcacaaaaaaataactttcaatgtttttctcaggaa

SEQ ID NO: 19559 - DNA, 201 bp, Homo sapiens
gaggcggaaccacagtctgccggaagactgtcaccaacaccctgtctgcagtgaaaaagaaagaagaggattagacctagggatattcaatttgtaagatwagccatctgaacatcacagtatatctaaacaataatggcaattcacaaaaaaataactttcaatgtttttctcaggaacaagtctaaaaacagtgtggga

SEQ ID NO: 19560 - DNA, 201 bp, Homo sapiens
ctatagctatggaaagtcctctacattcgagggtgaaacaaactcaggcacttaccttaacctcatctttaaggaagggaagtgtaaagtgtccatgaagragtccatttttctcaaaaaacacaatatcctgctggttgggtttatcttgtgtagatgcaatcaaactgcctgagggtcttaaagcaaactcagagtgtt

SEQ ID NO: 19561 - DNA, 201 bp, Homo sapiens
tgaggctgtgcttcttccgctccgcttttcggcgattcttggatgatctcctgttagaaattacacagatatttttaagcctcctgagtagctaggactayaggcatgtgctaccttgcctggctactttcttgcagttgctgatgaccccacacaacttcacagatctccattttaaattcctaaagcaaaattcagttt

SEQ ID NO: 19562 - DNA, 201 bp, Homo sapiens
cttcatctagagagaagaaatttgaaagagtggtaagttatattcccagctccattgacagaatcatacatagcttctatccaaagccaaaaatttctatsatcccactgcaggtcctttctcccacattatcttttttcttcccaaatgctggaataattaaacacatgtactacaaaaagaaaatcaagcacgctgggg

SEQ ID NO: 19563 - DNA, 201 bp, Homo sapiens
gccctaggctcaggaccccttgcaggctcatggacacacttcccaggagcttacttccatcaatgacagccacattggacaagtcacttgaattatctccyacgctccggtcagtcgtccagtgccaatcataggcgaggtaatgccagccctgacagagaacatgcagccggtatggggtcacagggtcccacatcagag

SEQ ID NO: 19564 - DNA, 201 bp, Homo sapiens
accccttgcaggctcatggacacacttcccaggagcttacttccatcaatgacagccacattggacaagtcacttgaattatctcccacgctccggtcagycgtccagtgccaatcataggcgaggtaatgccagccctgacagagaacatgcagccggtatggggtcacagggtcccacatcagagacacaatcttgctc

SEQ ID NO: 19565 - DNA, 201 bp, Homo sapiens
ggcaagagaggtgggcacactcagtgtcactaactttacagaaatacaccataatttctgatgtttttgctttttcatttctctaaggtaccaatccttccacagtttcttttagtttcagtgcccataacatagaatcatccatgttgtaaaagaagccaaaggcagtcttgaataattggaacctttggaacaaatgtc

SEQ ID NO: 19566 - DNA, 201 bp, Homo sapiens
gcaagagaggtgggcacactcagtgtcactaactttacagaaatacaccataatttctgatgtttttgctttttcatttctctaaggtaccaatccttccacagtttcttttagtttcagtgcccataacatagaatcatccatgttgtaaaagaagccaaaggcagtcttgaataattggaacctttggaacaaatgtca

SEQ ID NO: 19567 - DNA, 201 bp, Homo sapiens
ctcatctccatcaagtcatcttctgttaattcctctggtgtgatgtctatcacctcttgaatttctccaagattcctatcttgaaatccttcatgcaccatttttttttttttttttttttttttgtgccagatccacaatctttttcatgatttccttgattggctgtcgtaaagcctgtgaagtcatgcacatctggac

SEQ ID NO: 19568 - DNA, 201 bp, Homo sapiens
gtttgtttacatttctctccactaaatggtgccataaagatataagaatatcaatactgaaaaaaggctacttaaataaattcactatcaacaaggtattycataaattccaattaaagttggaataagactttatcttaaaaaaactagttacaggccgggcgcggtggctcacgcttgtaatcccagcactttgggagg

SEQ ID NO: 19569 - DNA, 201 bp, Homo sapiens
atcaatactgaaaaaaggctacttaaataaattcactatcaacaaggtatttcataaattccaattaaagttggaataagactttatcttaaaaaaactakttacaggccgggcgcggtggctcacgcttgtaatcccagcactttgggaggccgaggcgggtggatcacgaggtcaggagatcgagaccatcctggctaa

SEQ ID NO: 19570 - DNA, 201 bp, Homo sapiens
cggtggctcacgcttgtaatcccagcactttgggaggccgaggcgggtggatcacgaggtcaggagatcgagaccatcctggctaacacggtgaaaccccktctctactaaaaatacaaaaaaattagccgggcgtgatggcgggcgcctgtagtcccagctactcaggagggtgaggcaggagaatggcgtgaacccggg

SEQ ID NO: 19571 - DNA, 201 bp, Homo sapiens
tacaggcatgcgccaccatgcccgggtaattttgtatttttagtagagacggggcttctccatgttggccacattagtcatgaactcctgacttcaggtgrtccgcctgccttggcctcccaaagtgctgggattacaggcgtgagccaccaccacacctggcccgaccggctggcttttcccccagcagcagctgttcct

SEQ ID NO: 19572 - DNA, 201 bp, Homo sapiens
ccctcagaaatgccaggattagctggctggcaccctcctctcagaggttcaagagccagctctacagggccccacttccaggcttctaaattctaataatycccaacaactcctcctgttccctcagctagagggtaaagctgcttcctacagttactatctcaatgtccttcctctgtatttcccttttgccttgtttag

SEQ ID NO: 19573 - DNA, 201 bp, Homo sapiens
caaacttcatttgaaaaggtaacttttaaaaaatactttgaaacgttgaaacctacataaaagttgtaagagttcaatgaacacacatatacccttcactktgatttaccaattactaacattttgacatttttttgcttcctgtttctctgcatgcatacacacattcattaatacttttgtggaaccttttaagagtaa

SEQ ID NO: 19574 - DNA, 201 bp, Homo sapiens
tgagcatggctatgctccaataaagctttatttacaaaaacaggtggcatgctggatttgtcacaggttgtagtttgccaactctgcaatagagagcattaaaaaaaaaaaaaaaagcaaatatcaggccaggcacggaggctcatgcctgtaatcccagcactttgggaggctgagacaggcgaattgcttgaatccaac

SEQ ID NO: 19575 - DNA, 201 bp, Homo sapiens
tacagatagaaaaaagtattgattgtaagaaagacataaaactatatttatagaaaccatgtttgttgatgtagaaaatcctagagaatacacccaagagsttctagaactaataaatgagtttagcaaggttgcaggatacaaggtcaattatacagcctccctgcaaaacacttcagctatatttctatatactagtaa

SEQ ID NO: 19576 - DNA, 201 bp, Homo sapiens
acagaggacagtctccttgcagctctcagggagtgtgagctctaatggctgtcaggagaataaaccacgtgatgagatagggggcaccaggcagagggcasagaaggcaccatggccatgcagcaggaatgtgtatagcaggtctgaggagtaacaggacggccagtgtgactagagcagagagagtgtggaagagaacag

SEQ ID NO: 19577 - DNA, 201 bp, Homo sapiens
ggaggccgaggcagatggattgcttcagctcacaagtttgagaccagcctgggcaacatggcgaaaccccgtctcaacaaaaaaaattcaaaacttagccrggcatggtggtgcacgcctgtaagctgaggtgagattgcttgagcctaggaggcgtaggttgcagtgagccaagatggtgccactgcactccagcccggg

SEQ ID NO: 19578 - DNA, 201 bp, Homo sapiens
ggagactgaggtaggcggatcacgaggtcaggagatggagaccatcctggctaacacagtgaaaccctgtctctactaaaaatacaaaaaattagccgggygtggtgatgggcacctgtagtcccagctactagagaggctgaggcaggagaatggcgtgaacacgggaggtggaacttgcagtaagccgagatcgcacca

SEQ ID NO: 19579 - DNA, 201 bp, Homo sapiens
tctactaaaaatacaaaaaattagccgggcgtggtgatgggcacctgtagtcccagctactagagaggctgaggcaggagaatggcgtgaacacgggaggyggaacttgcagtaagccgagatcgcaccactgcactccagcctgggcgactgagtgagactccgtctcaaaaaaaaagaaacaaaaaaaagccatgcaat

SEQ ID NO: 19580 - DNA, 201 bp, Homo sapiens
ctaaaaatacaaaaaattagccgggcgtggtgatgggcacctgtagtcccagctactagagaggctgaggcaggagaatggcgtgaacacgggaggtggarcttgcagtaagccgagatcgcaccactgcactccagcctgggcgactgagtgagactccgtctcaaaaaaaaagaaacaaaaaaaagccatgcaatttta

SEQ ID NO: 19581 - DNA, 201 bp, Homo sapiens
ttccctcaggttaagagaagccctcctttatatgatgagtgtcacgattctttctgctaggaatctccactacaaaatactgcattaaagtaaaaaagttaaaaaaaaaaaaaagagcctctaagaatctgattgatgatataggtaatgagggcttttcataattttaagttctcgaaattgtaataaaatacttattgt

SEQ ID NO: 19582 - DNA, 201 bp, Homo sapiens
acatttcactgattttgaaaatcaacaatttccttttgatgctgcactacctacttcaatacaatgtagacaaaatacatatatacacacccaatactatmcacacacacacacacacacacacacttatacacttagagacagacggttagatgaatagataaaactactccaaaccaaagcccagataaagccacatct

SEQ ID NO: 19583 - DNA, 201 bp, Homo sapiens
catttcactgattttgaaaatcaacaatttccttttgatgctgcactacctacttcaatacaatgtagacaaaatacatatatacacacccaatactatacacacacacacacacacacacacacttatacacttagagacagacggttagatgaatagataaaactactccaaaccaaagcccagataaagccacatctg

SEQ ID NO: 19584 - DNA, 201 bp, Homo sapiens
gctacaaacctggacagcatgttactttacagaatactacaggcaattgtaataccatgtcaagtatttgtgtatctaaacatagaaaaggtatgtatacacacacacacacacacacacacacacacatatatgcgcatgactgcatttatacaaaatttcttcccatcacattagcccatgagaattagccactctaat

SEQ ID NO: 19585 - DNA, 201 bp, Homo sapiens
ctacaaacctggacagcatgttactttacagaatactacaggcaattgtaataccatgtcaagtatttgtgtatctaaacatagaaaaggtatgtatacacacacacacacacacacacacacacacatatatgcgcatgactgcatttatacaaaatttcttcccatcacattagcccatgagaattagccactctaatt

SEQ ID NO: 19586 - DNA, 201 bp, Homo sapiens
tacaaacctggacagcatgttactttacagaatactacaggcaattgtaataccatgtcaagtatttgtgtatctaaacatagaaaaggtatgtatacacmcacacacacacacacacacacacacatatatgcgcatgactgcatttatacaaaatttcttcccatcacattagcccatgagaattagccactctaatta

SEQ ID NO: 19587 - DNA, 201 bp, Homo sapiens
atatctttaaaaagttgcttcatctactaatatttatcctatttttcaccactttttgatatatttttggtctgttattttgacatggctcataactagayttaaccttcttgttaagtgtgtctaacaagaaagctactgctcctcaaccttgatcaatagaagtcaaaagttgtatgctcataaaagacaaaaacctaa

SEQ ID NO: 19588 - DNA, 201 bp, Homo sapiens
acatactatgttatttccagagtccaatgttattcttaaataactgactcttcaagtcagtaagggaaaaggaatggctcgtacaaaccagtataggattaaaaaaaaaaaaaacaaaaacccaagccaattaaatatcataatgataatgatatcaactgcagacttaaaaattttgagaaacactagacctatggcaac

SEQ ID NO: 19589 - DNA, 201 bp, Homo sapiens
ggctggagtgcagtggcgcaatctcggctcactgcaagctccatctcccgggttcatgccattctcctgcctcagcctctcgagtagctaggactacaggsgcccaccaccacacccggctaattttttttttttgtatttttagtagaaacatggtttcaccgtgttagccaggatggtcttgatctcctgaccttgtga

SEQ ID NO: 19590 - DNA, 201 bp, Homo sapiens
tcggctcactgcaagctccatctcccgggttcatgccattctcctgcctcagcctctcgagtagctaggactacaggcgcccaccaccacacccggctaattttttttttttgtatttttagtagaaacatggtttcaccgtgttagccaggatggtcttgatctcctgaccttgtgatccgcctgcctcggcctcccaaa

SEQ ID NO: 19591 - DNA, 201 bp, Homo sapiens
agtagctaggactacaggcgcccaccaccacacccggctaattttttttttttgtatttttagtagaaacatggtttcaccgtgttagccaggatggtctygatctcctgaccttgtgatccgcctgcctcggcctcccaaagtgctgagattacaggcctgagccaccgtgcctggcccacatgtttattttcaacttta

SEQ ID NO: 19592 - DNA, 201 bp, Homo sapiens
ggtttcaccgtgttagccaggatggtcttgatctcctgaccttgtgatccgcctgcctcggcctcccaaagtgctgagattacaggcctgagccaccgtgyctggcccacatgtttattttcaactttacttccaaactttatgatcacaatggaaggctaccaggaaaaagcattcttttagtgggttttctcatgaaga

SEQ ID NO: 19593 - DNA, 201 bp, Homo sapiens
gggaggccgagacgggcagatcacgagatggagatcgagaccatcctggctaacgcggtgaaaccctgcctctaccaaaaatacaaaaaattagccaggcktggtggcgggcgcctgtagacccagctactcgggaagctgaggcaggaaaatggagtgaacccgggaggcagagcttgcagtgaccgagatcgggccact

SEQ ID NO: 19594 - DNA, 201 bp, Homo sapiens
ctcagcctcctgagtagctgggactacaggcgcctgccaccacgcccagctaattttttgtatttttagtagagatggggttacaccgtgttagccaggayggtctcgatctcctgacctcgtgatccgcccgcctcggcctcccaaagtgctgggcccccaaagtgcatgagccaccgcacctggcccatacctactacg

SEQ ID NO: 19595 - DNA, 201 bp, Homo sapiens
acaacacaggcttgaactgcacaggtcgatttatattcgtatttttttcaatgaatacagtcggcccttcatattgtggattctatacccgcaaccaaacrcacatcaaaaatatggtacttgaggaatgcaaaacccaagtatacaaaaggctgacttttcatatctgagtgttctgcagggttgactgcaggacttgac

SEQ ID NO: 19596 - DNA, 201 bp, Homo sapiens
gaggcaggagaatcacttgaacctaggaggcggaggttgcagtgaaccgagattgcactatcgcactccaacctgggcaacaagaatgaaactccatctcaaaaaaaaaaaaaaaaaattccctctatagctatggaaagtcctctacattcgagggtgaaacaaactcaggcacttaccttaacctcatctttaaggaag

SEQ ID NO: 19597 - DNA, 201 bp, Homo sapiens
agagttaggaatgcaaaatatatgcggccttggaacaatgaaatctgtgaagaagcgtaaaatctactattcgagttgaattcagacttcagggaataagaaaaaaaaaaaagaagaaacaaagatagatacagccttataaccaaatgaagaaacgtaaaaatccttttgtgttacacaaacatctgtatcatctgtatc

SEQ ID NO: 19598 - DNA, 201 bp, Homo sapiens
agtgttccatttgtccaacagggtagagttttgtttacatattgtgtaagcttcacaacagggcacagatgagttaagatgtgaacaaggtgaatagggakgagccacagaggtggtaaaggcagcagcagacaatgacgaaaacatggaaatgttctcattctgcagcatgacgggaagaaacgtctcctccagggccac

SEQ ID NO: 19599 - DNA, 201 bp, Homo sapiens
ttctagaagagtagctcatagaaatttctacatataattatgcttccatttgttcaggcccaacccttggtatcctcctcaattcctccctctcacccaatttttttttttttttttttgagacggagtcttgctttatggcccaggctggagtgcagtggcacaatcttggctcaccgcaacctctgcctcccaggtaca

SEQ ID NO: 19600 - DNA, 201 bp, Homo sapiens
tgttaaattagacccactatgcatattttactcacaataaagttgttttgaaataaaaactacgctttaaaaagtttcaaaaattatttgtctactaaaayaaaagcagcaactaccatttgagtgcctacactgtgctgatgctatgatagctgttttatatatgctattacctgcccatctcaacccttgtaaggagac

SEQ ID NO: 19601 - DNA, 201 bp, Homo sapiens
ccattaaatgaagataaatagactggaagagctcagtaaccaggaaacaatgctacaaaatgtttggaaagtaaaagcatctatctttcaaatacgaaaaraaaacaagctgtatatgacaagtttgatatttcccaccatgaactgcaagtaaaggtttatgattgtactaaatggaatggttaagagcagaggtgccag

SEQ ID NO: 19602 - DNA, 201 bp, Homo sapiens
tgattttagtaagttttggtgacaattatattcaagaactgctagaaattacttgaacctctaacatatcatgcaggtttttttgttttttgagacggagtttcgctcttattgcccaggctggggtgcaatggcgcgatctcggctcaccgcaacatctgcctcccgggttcaagcgattctcctgcctcagcctccgga

SEQ ID NO: 19603 - DNA, 201 bp, Homo sapiens
ggctgtatacatttattaaaactcatcaaattgtacacctgaaatctctgcatttcactatatgtaaagtctagctcaatttttaaggaatagcaaaatgygatagcacatattcagtaagtgaagttaatggacaggaactactttatgatgaaacttcgacaaacatgttgatcaataaagatgcccctgctttaaaaa

SEQ ID NO: 19604 - DNA, 201 bp, Homo sapiens
tttttcatctttaaacatcataaaaacgcctcaaaactagtttctctgaaatttcacacccatcagccttattcccttatcttctcggaggaagacttccytccacttctttccaggctaggaaaggaatatcctccatattgccacaggacctaggcctattagtactctttcttggacatctgcaacctccaaccttcc

SEQ ID NO: 19605 - DNA, 201 bp, Homo sapiens
gactaaagatagatacctaagacgtggctggtccagtgcaaaatggaatgtgaagccatccaatccatcagtgagccctgacatctccatctcctacacayatctcaaacccatctcctttttcccctcactaactccactcaaccggtgttgatcccatattccagtctcgtcactctccaatcaagtctcttctgggca

SEQ ID NO: 19606 - DNA, 201 bp, Homo sapiens
tatccaagacatgaataaaacttaaaaaccactgagacgttcctggatgaaggaagactgaagcatcttgtatacagtccactcctaattatttggagggrcaaaacctgagatactaccaaatactacaaaatctaaaattaatctttgtctggcttaagaatacgtttttatattttccctaaatttctcataccctga

SEQ ID NO: 19607 - DNA, 201 bp, Homo sapiens
aaacaccacgttagatggagaagcacagaggacaccacctccacgaaaaagtctcacacgcgagaaaggacccgcaccacagcacccgagcctctattaaycgccgccttccatcgtgaattaatactctcgctttcagcgttattatcaaccccctgcaagcaatcaagaggctgggttaagtccggctggaggggcagc

SEQ ID NO: 19608 - DNA, 201 bp, Homo sapiens
aaagtagagcaccttcatattctacctcaccaaacttagagatgtactaaatttagatttccaagtcaagccagcaagataagacctctggggcaaacacyatctctggacttaacaattatgcacagttcctttaactttcatgatcactaagatacaattgagaagacctttcttgctgactggggggtttagaaggga

SEQ ID NO: 19609 - DNA, 201 bp, Homo sapiens
cttacctgttgtgtgctgagactgcagagtatgacgtctccagaggctgtggccacacacacagactcctgatccagcaagtcctgaacaccaacaatgcrgccacttccatcctctgggagaaagccttctgccaccaaagaaacttcatttttcacctttcaccaaagtaaacacaagcaaattaacccagtctacttt

SEQ ID NO: 19610 - DNA, 201 bp, Homo sapiens
ttggagggacaaaacctgagatactaccaaatactacaaaatctaaaattaatctttgtctggcttaagaatacgtttttatattttccctaaatttctcrtaccctgaaatctttaaatttgaagagaacacttgaggaaactgactacacaagaaaattaccagccctagtccctacactaatgaaccccagagctttt

SEQ ID NO: 19611 - DNA, 201 bp, Homo sapiens
agtagagcaccttcatattctacctcaccaaacttagagatgtactaaatttagatttccaagtcaagccagcaagataagacctctggggcaaacactayctctggacttaacaattatgcacagttcctttaactttcatgatcactaagatacaattgagaagacctttcttgctgactggggggtttagaagggagg

SEQ ID NO: 19612 - DNA, 201 bp, Homo sapiens
ttggtacttggctgaatgacaatcagactatctatcttgtctgaaaaaccagcttacctgtaatacaagctttgtgtcctggggcacaacagtgacaatcsgtgaacccctctccactttccgcagaacttccccatgggacacatgattgctgctcaggccggcctgtaatgctaaacacaccattaactaataagcctt

SEQ ID NO: 19613 - DNA, 201 bp, Homo sapiens
agaggcaagattctcaactttagaatgttttcttcaaaaaagatgtaatatcagttattcctttgggaaagttgaaagaacaaatgaatggggaaacattytatttttgcatattaggacatctttataaaatcatgaggaaaaacaaaagggtatcccactgattagcactatttgaaaatccatttttatatactggca

SEQ ID NO: 19614 - DNA, 201 bp, Homo sapiens
atcaaaatgaatacatctataacatactcataaacatgtatgcacctataacagagcttcaaaatacattaagcaaacactggtagaatcaaaggagaaayagacaaatactgggagacttcaacactttcccagtcattgatagagcaagtagtgaggaaatcaataaggatataaaaagctagaacagcatgatcaacc

SEQ ID NO: 19615 - DNA, 201 bp, Homo sapiens
caatattgggcacttaattacagcaaacccatgtaagtcaaaaagtagatttctccaaagcaaagtatatcttctttctcttctttttaaaaactcctatkagattgtgaaaatgttcaaacatacagaaaagttgaattttacagtgaatactcctagattgattctatagttaacatcttgctatactggcaaaggctt

SEQ ID NO: 19616 - DNA, 201 bp, Homo sapiens
acacagtaattctctttcccaatgtgattttaatttgccagtttctccagctgcaactcagacttctaattctcctttctcccagaacaaggtaaagatgkggggtggaggaaaagaaaagaaacgaaactctacagtgatatatcttggccttttctaaatgagcaaaccactccctgaggaaagggaaaagagtaaaag

SEQ ID NO: 19617 - DNA, 201 bp, Homo sapiens
acatggcgaaaccccgtctcaacaaaaaaaattcaaaacttagccaggcatggtggtgcacgcctgtaagctgaggtgagattgcttgagcctaggaggcrtaggttgcagtgagccaagatggtgccactgcactccagcccgggtgatagagcccgaccttgtctcaaaaataaataaataaataccgcactctagata

SEQ ID NO: 19618 - DNA, 201 bp, Homo sapiens
taggccgcacatggtggcccacacctgtaattccagcactttgggagactgaggtaggcggatcacgaggtcaggagatggagaccatcctggctaacacrgtgaaaccctgtctctactaaaaatacaaaaaattagccgggcgtggtgatgggcacctgtagtcccagctactagagaggctgaggcaggagaatggcg

SEQ ID NO: 19619 - DNA, 201 bp, Homo sapiens
taaaaagaacggaaaagagcaaaaaaccaactggcatctaagagttatagcaatttttaaaaatgaacagtaaggaatttttcttctctagctatttatgyttgatttccttaacaagaagagagaaaactatggaaaagatacacatgaattattcaaaatacttacttcaattctgtaaaaaacaagttaatatgattc

SEQ ID NO: 19620 - DNA, 201 bp, Homo sapiens
ctctctacctagagtcaaagttttcagtgtcttcaaaggccaggcaagtaaacgtgtgaaggccacagatgcagtataacaggaaactggtgggggagggkggacaatggttctcaggagagaacataccccaccttatatcccattcaataaaaaaacaagtaacccaaacagccaaaacaaataaagattccccactgt

SEQ ID NO: 19621 - DNA, 201 bp, Homo sapiens
gaaaaataacactagtagaatacattttaaaaaagcaaaatactactatccaaggatgcattttattaataggttttgggcctatgtagatgaattatcgrcatttatctaagaaaggttctcattagtggtgaaaatctaagtaagagctggttagattattatagatgaggaatgatgttttcagtacccagttagagg

SEQ ID NO: 19622 - DNA, 201 bp, Homo sapiens
gagtgaacccgggaggcagagcttgcagtgaccgagatcgggccactgcactccagcctgggggaaagagagagactccgtctccaaaaaaaaaaaaaaarggggggggggttctactgattaaagagtttgaaagctacttagaaaataatcaagtaaaaagatttatgaacaaaaatgtaccatgcattgctgtttaca

SEQ ID NO: 19623 - DNA, 201 bp, Homo sapiens
gtggtaagttatattcccagctccattgacagaatcatacatagcttctatccaaagccaaaaatttctatgatcccactgcaggtcctttctcccacatkatcttttttcttcccaaatgctggaataattaaacacatgtactacaaaaagaaaatcaagcacgctggggggcctacgcagaaagcagtgtcccacaat

SEQ ID NO: 19624 - DNA, 201 bp, Homo sapiens
actggcatctaagtggacaccaaagagttcctggtgggtggcaaacttacatttgttccagtcaaggctttttatccatcaaaccaaacttaccatttgcwtctgaaaagctgcttgtctgccttctgatccatggaactgtgtctccttcctaccccatccaacagtgataaacttgcctacagaacaattggcaagaca

SEQ ID NO: 19625 - DNA, 201 bp, Homo sapiens
gcattctgatttccatcccaggagcctcaaagcacagcacccagaagttctagattctgggatggagcaaagacagaggctgcattaggtcatccatgttwacaacccatacatccccatttatgtaagagaatgcagctccgccttatcattgtcatctccatctttcccacatgatttttcctggagaaccaagcgcta

SEQ ID NO: 19626 - DNA, 201 bp, Homo sapiens
aaggtttctataagtcaaactgatgtccttctccactttgcttttaagaggtcacagtgaccatctgagtattctagaactggtaatattcatatgttctytaagaaccacaaacttcatttgaaaaggtaacttttaaaaaatactttgaaacgttgaaacctacataaaagttgtaagagttcaatgaacacacatata

SEQ ID NO: 19627 - DNA, 201 bp, Homo sapiens
gtttctaacatttaaatattttgttaccatttaatagttcagcatatttaaaaattctagtgagaattaaatattatatccaggtggtaattttgattgartctacatgacatattattaagaaaacacagtaaataggaggagactctctcatctctctctcctcaccttcttccaaatgaggaattctatctaaaatgg

SEQ ID NO: 19628 - DNA, 201 bp, Homo sapiens
agggtctgttgttttaagctgccagcttttaaggtaagttgttacgtagcaatagataatacatctagtgtcacagtaatacacccagtgttggtgagtayaggagtcactgaagcactctcacatatcactgaggggaatgcaaaatgatacggccactgcagattagttctgcagcttcctaaaaagttaaacatccac

SEQ ID NO: 19629 - DNA, 201 bp, Homo sapiens
tcttctggccacaacttactgcaacttattacaaagtattgccttcattagacatggatggtaccaatatcatttctgtctgcttaaaatagttaaagcarctggtctgtaggaaaatgagcacactcaatatctctatcactatcatatcgattgatggaaaattgtggattttcactaatgagatgaagggaatttgtt

SEQ ID NO: 19630 - DNA, 201 bp, Homo sapiens
tagcaaggttgcaggatacaaggtcaattatacagcctccctgcaaaacacttcagctatatttctatatactagtaataaaacattagaaaatgaaattwaaaactagtcaagccttgagatgactctagccctggccaataccttaattgcagccttgtaaaggaccctgagccagaggccccagctaagcccagccaa

SEQ ID NO: 19631 - DNA, 201 bp, Homo sapiens
ccccagctaagcccagccaagattcttggcccattgaaaaagtgggataatagggtctgttgttttaagctgccagcttttaaggtaagttgttacgtagyaatagataatacatctagtgtcacagtaatacacccagtgttggtgagtataggagtcactgaagcactctcacatatcactgaggggaatgcaaaatga

SEQ ID NO: 19632 - DNA, 201 bp, Homo sapiens
tagataatacatctagtgtcacagtaatacacccagtgttggtgagtataggagtcactgaagcactctcacatatcactgaggggaatgcaaaatgatayggccactgcagattagttctgcagcttcctaaaaagttaaacatccacttaccacgggatgtggcattcctactcctgtccccataaagacctgcactag

SEQ ID NO: 19633 - DNA, 201 bp, Homo sapiens
gataatacatctagtgtcacagtaatacacccagtgttggtgagtataggagtcactgaagcactctcacatatcactgaggggaatgcaaaatgatacgrccactgcagattagttctgcagcttcctaaaaagttaaacatccacttaccacgggatgtggcattcctactcctgtccccataaagacctgcactagaa

SEQ ID NO: 19634 - DNA, 201 bp, Homo sapiens
atacaactgtacaacacataattttattgtatgtaaattacacaaaataattttatgcattaatcttcctttacaaagaaaaaaagataatgacatcttayccatttaattaaccctcgatgtggtatatctttccaacccaacctatctacccttttaggtatgtttcattcactggtattttcaattcaatcacccaac

SEQ ID NO: 19635 - DNA, 201 bp, Homo sapiens
ctgcaggtcctttctcccacattatcttttttcttcccaaatgctggaataattaaacacatgtactacaaaaagaaaatcaagcacgctggggggcctaygcagaaagcagtgtcccacaattctttatcctggcctaagcatctctcccagttcagttagggggatgccaaatggaggaaggcttctcagttaccagct

SEQ ID NO: 19636 - DNA, 201 bp, Homo sapiens
cctagcctcaagcaatcctcctgtctcaatctgccaagcagctgggtttacaggcgtttgctcatttcaaaattgatttaactggctttctgttgttgagytgcaggagttccttacatattctggatattaaacctttatcagatataggatttgcaaatatcttcttccattctatatgctgtcttttcacattcttga

SEQ ID NO: 19637 - DNA, 201 bp, Homo sapiens
gaagaaaattacctaaatgtttctggctaaacatccatcaaaatgcccatggatgtggaaaaaatgtatctaataaatattgtccaatggaaaaatacacmagagaaaaataacactagtagaatacattttaaaaaagcaaaatactactatccaaggatgcattttattaataggttttgggcctatgtagatgaatta

SEQ ID NO: 19638 - DNA, 201 bp, Homo sapiens
gccaataccttaattgcagccttgtaaaggaccctgagccagaggccccagctaagcccagccaagattcttggcccattgaaaaagtgggataatagggwctgttgttttaagctgccagcttttaaggtaagttgttacgtagcaatagataatacatctagtgtcacagtaatacacccagtgttggtgagtatagga

SEQ ID NO: 19639 - DNA, 201 bp, Homo sapiens
tcaaaaatgaattaagccttcaggcattgcattggtataagcaagaggctaaaaccagggaaagcaccaactctctctgttccattttttcccaaggaacwactcactagtcaagagtcagctggatccacacagacatgagggttggttcactgttgaaggagcttggaaaaaaaggctttagcagtttgatggatcttg

SEQ ID NO: 19640 - DNA, 201 bp, Homo sapiens
gacctggtatctctcactaaaccacttcgtcccttaacagtaagagaccactatttctttggttgagcactagatggaggtagctgacttatgtttgagtmatgcagtgtctttagatcctagaatcactctcagcccaattgagataaaccacaatgagaggcacagagaacccaaggctttcgaaggagctggtagatt

SEQ ID NO: 19641 - DNA, 201 bp, Homo sapiens
agcttctatccaaagccaaaaatttctatgatcccactgcaggtcctttctcccacattatcttttttcttcccaaatgctggaataattaaacacatgtrctacaaaaagaaaatcaagcacgctggggggcctacgcagaaagcagtgtcccacaattctttatcctggcctaagcatctctcccagttcagttagggg

SEQ ID NO: 19642 - DNA, 201 bp, Homo sapiens
aactcctatgagattgtgaaaatgttcaaacatacagaaaagttgaattttacagtgaatactcctagattgattctatagttaacatcttgctatactgrcaaaggcttcttaaattacaattttggctatatcacttctttgaggatcaaaagcagcatttcctgttagtttatgtacagtgctgtagtttaggcattt

SEQ ID NO: 19643 - DNA, 201 bp, Homo sapiens
actcctatgagattgtgaaaatgttcaaacatacagaaaagttgaattttacagtgaatactcctagattgattctatagttaacatcttgctatactggsaaaggcttcttaaattacaattttggctatatcacttctttgaggatcaaaagcagcatttcctgttagtttatgtacagtgctgtagtttaggcatttg

SEQ ID NO: 19644 - DNA, 201 bp, Homo sapiens
aaggagggcttataatttcaaaggatactttttattctgctttagtttaaggtgacaagaagctatttaagtgattacatttgaccaaatgtagcactaayagccattgtaatcttctccgccaacaaaataagacaatttagaaacattgttttacttgtcttcacactttggaggtagaaatcatgaaacattaatctc

SEQ ID NO: 19645 - DNA, 201 bp, Homo sapiens
tattcagtaagtgaagttaatggacaggaactactttatgatgaaacttcgacaaacatgttgatcaataaagatgcccctgctttaaaaaaagtgaatgkagagagagggttaggaaaagattctgtcattgtaacctaaaactcccaggcactctttcacttagatttgttaagtttcttttctaaccaggaatcatat

SEQ ID NO: 19646 - DNA, 201 bp, Homo sapiens
atttattttctggcactgcttcttttatgtaatcttcctcattgtctggcgctggtttggaagtactcatctccatcaagtcatcttctgttaattcctcyggtgtgatgtctatcacctcttgaatttctccaagattcctatcttgaaatccttcatgcaccatttttttttttttttttttttttttgtgccagatcc

SEQ ID NO: 19647 - DNA, 201 bp, Homo sapiens
gatggcatcattgatggtgtaattctttcagactttcatgttctgtcaaggttcttttccatacatttgacaatcctttctatagagtactgtttgtaacragccttaaaggtccttatgacaccctgatctagaggctgaattagagatgtgtgtttgggggcaagtagatcacttcaatgtcttcggtgttgaactcat

SEQ ID NO: 19648 - DNA, 201 bp, Homo sapiens
agtttggggtggcctcgggcattctccagtatcaaaagaactttaaaaggcagtccccttactggcaagatactacttaacttcagggacaaatcgacaayggaaccaatccagaaaaagtgttctccttgtccaagccttcttgttgtatggtacaaccaaaagcctggcagctggtgttaatcttttcccttccaggct

SEQ ID NO: 19649 - DNA, 201 bp, Homo sapiens
gacaaatcgacaatggaaccaatccagaaaaagtgttctccttgtccaagccttcttgttgtatggtacaaccaaaagcctggcagctggtgttaatcttytcccttccaggctcgggggttagcagctttacagataagggcagtcctgatcataaacctgactgcctttgctgctgcctcctggatggcaggagctgct

SEQ ID NO: 19650 - DNA, 201 bp, Homo sapiens
atcgagaccatcctggctaacacggtgaaaccccgtctctactaaaaatacaaaaaaattagccgggcgtgatggcgggcgcctgtagtcccagctactcrggagggtgaggcaggagaatggcgtgaacccgggaggcggagcttgcagtgagccgagattgcgccactgcactcccgcctgggccacagagcaagactc

SEQ ID NO: 19651 - DNA, 201 bp, Homo sapiens
accatcctggctaacacggtgaaaccccgtctctactaaaaatacaaaaaaattagccgggcgtgatggcgggcgcctgtagtcccagctactcaggaggstgaggcaggagaatggcgtgaacccgggaggcggagcttgcagtgagccgagattgcgccactgcactcccgcctgggccacagagcaagactctgtctg

SEQ ID NO: 19652 - DNA, 201 bp, Homo sapiens
tgaccaaatggcctcaggtctaatgtaagttcctagcatctgggaaataagtgggctgggcacaggggcagacgcctgtaatcccagcactttgggaggcygaggcaggaggatcacttgagaccaggaggctgagaccagcctgggcaacatattaagaccccatctgtttttttttctaaatgaaaaaacttaagaaaa

SEQ ID NO: 19653 - DNA, 201 bp, Homo sapiens
agagttatgggaaacaaacatttttaggttgaaataaatacaaacatgtgcatactatggagcagaatggaaactgtgcacatgtgctccaggtaaaacamaagactccgcaggaatttcaagcctgcagcgagcctctgggcacacccctggttagtgcagacccttggtggcacactctcaagagcaatgccatgagaa

SEQ ID NO: 19654 - DNA, 201 bp, Homo sapiens
caaccatacttcaccaatcaaaaccacaatcataaaattgatgtcttagaacttaatgtgggaggcatggtggcttacacctgtaatctcagcactttggraggccaaggcaggaggatcacttgaggccaggagttcaagaccagcttgggcaacacagcaagactccctctccccatgtctaggaaaaaattttaaaat

SEQ ID NO: 19655 - DNA, 201 bp, Homo sapiens
gaaaaaaataaaataaaatagaccttaatgtgaatatgtgatcagaagagaagatcactcatgggagtggtattataaattattatcttcaagccgggcayggtggctgatgcctatagtcccagcactttggagaggtgaggtgggcagaccacttgagcccaggagttgttcaagaccagcggggacaacttggtgaca

SEQ ID NO: 19656 - DNA, 201 bp, Homo sapiens
tctgtctcccaggttcaagcgattctcttgcctcagcctcctgagtagctgggattacaggcatgcgccaccatgcccgggtaattttgtatttttagtaragacggggcttctccatgttggccacattagtcatgaactcctgacttcaggtgatccgcctgccttggcctcccaaagtgctgggattacaggcgtgag

SEQ ID NO: 19657 - DNA, 201 bp, Homo sapiens
gcctcctgagtagctgggattacaggcatgcgccaccatgcccgggtaattttgtatttttagtagagacggggcttctccatgttggccacattagtcaygaactcctgacttcaggtgatccgcctgccttggcctcccaaagtgctgggattacaggcgtgagccaccaccacacctggcccgaccggctggcttttc

SEQ ID NO: 19658 - DNA, 201 bp, Homo sapiens
caccctcctctcagaggttcaagagccagctctacagggccccacttccaggcttctaaattctaataatccccaacaactcctcctgttccctcagctasagggtaaagctgcttcctacagttactatctcaatgtccttcctctgtatttcccttttgccttgtttagtcctctaatacttatttaacaaatccatat

SEQ ID NO: 19659 - DNA, 201 bp, Homo sapiens
tgaatcaatgtgatacgtacgctgatatcctggagttactatgggagtatttgccactcatctcactgccactcacgacactgctagtttcagagaagagrtctgactcttgcccgtggggtacctcatcatctagaaaagaagaaccagaagccgatgaaaacactgcctgctaatgtgtgggtttactttcagggcggt

SEQ ID NO: 19660 - DNA, 201 bp, Homo sapiens
ttgagcatgaggtttaagcaaagagaaaaaactaaaggcggggagcagtgaaggagggttaaaattcagcaaaaagaaagaggttactaggttttccaagygagctctttttccttaataagcattaacaaattagagactgagattccagatcttagagttcatcaacattatcccagaatatgcgctaccactgaactt

SEQ ID NO: 19661 - DNA, 201 bp, Homo sapiens
ggtgaaaatctaagtaagagctggttagattattatagatgaggaatgatgttttcagtacccagttagaggtacctaaagtgaatgacataaaaagtacyccagcaacgttttaattaggatggaggaagggggtgcagacaaggtaagaatgtgcatacatgtaaatgtcagaaaggccagacgttacttacagggtag

SEQ ID NO: 19662 - DNA, 201 bp, Homo sapiens
tagatgtgcataaaaatgcagaacttaaaatcaaccactccctaaggtttctataagtcaaactgatgtccttctccactttgcttttaagaggtcacagkgaccatctgagtattctagaactggtaatattcatatgttctctaagaaccacaaacttcatttgaaaaggtaacttttaaaaaatactttgaaacgttg

SEQ ID NO: 19663 - DNA, 201 bp, Homo sapiens
ccctaaggtttctataagtcaaactgatgtccttctccactttgcttttaagaggtcacagtgaccatctgagtattctagaactggtaatattcatatgytctctaagaaccacaaacttcatttgaaaaggtaacttttaaaaaatactttgaaacgttgaaacctacataaaagttgtaagagttcaatgaacacaca

SEQ ID NO: 19664 - DNA, 201 bp, Homo sapiens
caatgaacacacatatacccttcactttgatttaccaattactaacattttgacatttttttgcttcctgtttctctgcatgcatacacacattcattaayacttttgtggaaccttttaagagtaaggcagagatatgatccttcattcctaaatatttcagcatttatctcttgagaataataggatattatcttatat

SEQ ID NO: 19665 - DNA, 201 bp, Homo sapiens
aataataggatattatcttatataaccacaacatgattattaaatgccagaaatttatcagtgttatattattatctaatatagttcatattcaagtttamtatttccaaatacaaagattcttaatcatatttgatcacaggtttctaacatttaaatattttgttaccatttaatagttcagcatatttaaaaattcta

SEQ ID NO: 19666 - DNA, 201 bp, Homo sapiens
ttttggtattaattctaaccatccattgccaaatccaaagtcatgaagatttagccctgttttcttctaagagttttatagtttcgttctggttttgagamagggtcttgttctgttgtccaggctgaagtgcagtggcgtgaactcagctcactgcagtctcaaacttacaggctcaggaaatcctgccaccttggcctc

SEQ ID NO: 19667 - DNA, 201 bp, Homo sapiens
ttaaatttttgttgatccactttgagtggccagcagtttttgaaaactcggaaaatactgaatcttttggaaaaaaaaaaaaaagaataaacatgaaaggkcattaaaaaatttccttaaacaatcattgatcacttaaagcaaaagcaataacaaagtattatggagtgaatactcttgtaaggtttttacactatatat

SEQ ID NO: 19668 - DNA, 201 bp, Homo sapiens
caaaggatcaatgaaacaaacaaaaagcaaacagcaagactgtaggtttaaatctaactatattggtaatcacattcaatgcaaatgtctaaaccctccarttaaaagacagagattgtcaaattagatttaaaaaaaaaaaagaaccaataatgctatcaacaaggaacgcactttcaaaataaagactacattcagcta

SEQ ID NO: 19669 - DNA, 201 bp, Homo sapiens
gaaacaaacaaaaagcaaacagcaagactgtaggtttaaatctaactatattggtaatcacattcaatgcaaatgtctaaaccctccaattaaaagacagrgattgtcaaattagatttaaaaaaaaaaaagaaccaataatgctatcaacaaggaacgcactttcaaaataaagactacattcagctagattaaaagtaa

SEQ ID NO: 19670 - DNA, 201 bp, Homo sapiens
aaacaaacaaaaagcaaacagcaagactgtaggtttaaatctaactatattggtaatcacattcaatgcaaatgtctaaaccctccaattaaaagacagarattgtcaaattagatttaaaaaaaaaaaagaaccaataatgctatcaacaaggaacgcactttcaaaataaagactacattcagctagattaaaagtaaa

SEQ ID NO: 19671 - DNA, 201 bp, Homo sapiens
caagactgtaggtttaaatctaactatattggtaatcacattcaatgcaaatgtctaaaccctccaattaaaagacagagattgtcaaattagatttaaawaaaaaaaagaaccaataatgctatcaacaaggaacgcactttcaaaataaagactacattcagctagattaaaagtaaaaggatagaaaaagatatgcaa

SEQ ID NO: 19672 - DNA, 201 bp, Homo sapiens
ctatattggtaatcacattcaatgcaaatgtctaaaccctccaattaaaagacagagattgtcaaattagatttaaaaaaaaaaaagaaccaataatgctmtcaacaaggaacgcactttcaaaataaagactacattcagctagattaaaagtaaaaggatagaaaaagatatgcaatgaaaagactaaccaagagaaag

SEQ ID NO: 19673 - DNA, 201 bp, Homo sapiens
taatcacattcaatgcaaatgtctaaaccctccaattaaaagacagagattgtcaaattagatttaaaaaaaaaaaagaaccaataatgctatcaacaagkaacgcactttcaaaataaagactacattcagctagattaaaagtaaaaggatagaaaaagatatgcaatgaaaagactaaccaagagaaagctggaagaa

SEQ ID NO: 19674 - DNA, 201 bp, Homo sapiens
cattcaatgcaaatgtctaaaccctccaattaaaagacagagattgtcaaattagatttaaaaaaaaaaaagaaccaataatgctatcaacaaggaacgcmctttcaaaataaagactacattcagctagattaaaagtaaaaggatagaaaaagatatgcaatgaaaagactaaccaagagaaagctggaagaattatat

SEQ ID NO: 19675 - DNA, 201 bp, Homo sapiens
aagacagagattgtcaaattagatttaaaaaaaaaaaagaaccaataatgctatcaacaaggaacgcactttcaaaataaagactacattcagctagattwaaagtaaaaggatagaaaaagatatgcaatgaaaagactaaccaagagaaagctggaagaattatattaataacattaaagtcaaattcagaattaggaa

SEQ ID NO: 19676 - DNA, 201 bp, Homo sapiens
tatcaacaaggaacgcactttcaaaataaagactacattcagctagattaaaagtaaaaggatagaaaaagatatgcaatgaaaagactaaccaagagaargctggaagaattatattaataacattaaagtcaaattcagaattaggaatagtaacagagaaagaaggatatcaaaatgaatacatctataacatactca

SEQ ID NO: 19677 - DNA, 201 bp, Homo sapiens
ctagattaaaagtaaaaggatagaaaaagatatgcaatgaaaagactaaccaagagaaagctggaagaattatattaataacattaaagtcaaattcagawttaggaatagtaacagagaaagaaggatatcaaaatgaatacatctataacatactcataaacatgtatgcacctataacagagcttcaaaatacattaa

SEQ ID NO: 19678 - DNA, 201 bp, Homo sapiens
aaaaggatagaaaaagatatgcaatgaaaagactaaccaagagaaagctggaagaattatattaataacattaaagtcaaattcagaattaggaatagtamcagagaaagaaggatatcaaaatgaatacatctataacatactcataaacatgtatgcacctataacagagcttcaaaatacattaagcaaacactggta

SEQ ID NO: 19679 - DNA, 201 bp, Homo sapiens
ataacattaaagtcaaattcagaattaggaatagtaacagagaaagaaggatatcaaaatgaatacatctataacatactcataaacatgtatgcacctayaacagagcttcaaaatacattaagcaaacactggtagaatcaaaggagaaatagacaaatactgggagacttcaacactttcccagtcattgatagagca

SEQ ID NO: 19680 - DNA, 201 bp, Homo sapiens
cacacaacattctgtaaaacagaccatattataaattaaaataaattataaatttaaattaataaaatgtatgttctctaatcacaacaaaattaaagtasaaattaataacaaaaagatggctggcaaatctccaatatctgcaagttaaacatacttctaaataagccaaggttcaataaagaaatcacaagggaaatt

SEQ ID NO: 19681 - DNA, 201 bp, Homo sapiens
agaatacagaaaaatcatagagaaaaacaatgaaacagttcattctttaataagatcaataaaattgataaacctctggccagaataatcagaaaaaagamgacacatcaatatctagaatgaaagacaggacatcaccatagaccctacggacagtaaaataagagaatactataaacacttcataccaataaatctgac

SEQ ID NO: 19682 - DNA, 201 bp, Homo sapiens
cataaactaccaatgctcattccagaagacacagataaacttgaataggttaatgtctactaaagtaactgaactaatagtgaaaaactttcattaaagamaactcctggccgagatggccttactggtatattctactaaacatttaaagaaaaaaatatctcccaagagctgggagaaagagctgagctgtcaggtgtt

SEQ ID NO: 19683 - DNA, 201 bp, Homo sapiens
gggggctaagggtggaaaagtactgggtagtgagtcacagtggaaaaaaatgtcaaggtttttccactccttcttgcataaacaggccttggcagaggtgyctgaagaagaccttggcccatggcctcagatagagagacctaagaatgaaagtgccaggactctcaatgcaaatactgttacaagagcatgactaacagg

SEQ ID NO: 19684 - DNA, 201 bp, Homo sapiens
gatacccaaaacatggcaaagacacgaaaaaactacaatatccctcatgaacacaaacacaaaaatcctcaagaaaattttagtagatctaatctgccacragagaaaaagggtaataaatctataataccaagtggggttgaacccagagatgcaaggttggtttaacagtagaaaatcaatcacctagtcccccatatc

SEQ ID NO: 19685 - DNA, 201 bp, Homo sapiens
cccagctaagcccagccaagattcttggcccattgaaaaagtgggataatagggtctgttgttttaagctgccagcttttaaggtaagttgttacgtagcratagataatacatctagtgtcacagtaatacacccagtgttggtgagtataggagtcactgaagcactctcacatatcactgaggggaatgcaaaatgat

SEQ ID NO: 19686 - DNA, 201 bp, Homo sapiens
acagttcctttaactttcatgatcactaagatacaattgagaagacctttcttgctgactggggggtttagaagggaggaattgagtttacctgggcacastcttccaaaaccatggccgcatcaatgtgcttcctctgctcaaccagctttcctgtagagacaataagcagcagttgactacaaagttaaacagatactt

SEQ ID NO: 19687 - DNA, 201 bp, Homo sapiens
aaggaacaatggagaccgaacgaataactaaaaggcctgaaataaggaattctcgacatttgtaaaaagaggccagcatggaaacggagggatttgggaawggctaataaccagaaaaagaaaagtgataatcccatacactggtataatcccaagaaaaaaagaatactgcaaatgacaaagaaggactggtacataaat

SEQ ID NO: 19688 - DNA, 201 bp, Homo sapiens
acaagttagggaaaaaaatataccagtcattgctttacttcaagcactgctgagatgaccagagcttctgctcatctcttttcataggtgtccttaccctytcctccactctggtactagagcccctggtaccagcctcgcctctggttcgggcaacccttgtccctgacgcagctaaactgcctttgctttcagaatgct

SEQ ID NO: 19689 - DNA, 201 bp, Homo sapiens
ctgacgcagctaaactgcctttgctttcagaatgcttcgacatttggccttttattttccccacctcattcctggctattccaacaacctactgtctatamcagaatggacccatccaaaaattcatctttaccttcttacagggcacagcccatccagctacatggcgtggccgagatggaatagaaggtgatagtttaa

SEQ ID NO: 19690 - DNA, 201 bp, Homo sapiens
attccaacaacctactgtctataacagaatggacccatccaaaaattcatctttaccttcttacagggcacagcccatccagctacatggcgtggccgagrtggaatagaaggtgatagtttaacttccatccaggtcatttccaacttaaaggtaaatgttttaccatgattctaacttctccccactctccttccttcc

SEQ ID NO: 19691 - DNA, 201 bp, Homo sapiens
atataagaaccaccaccaagttgctgctcttatagtaacagaggatggacttagggacaaaatatagtctatagcataatggcaaacgtgagtaaagggasagaggacagtctccttgcagctctcagggagtgtgagctctaatggctgtcaggagaataaaccacgtgatgagatagggggcaccaggcagagggcaca

SEQ ID NO: 19692 - DNA, 201 bp, Homo sapiens
ttcctttcccccatcagtcctcagtaaagaatcacaactgttccagcatgggaagaacaactggcaccccatcactgtcaattaaaactgcgtcttgcagrgcacggggaggtggcctcatcactctctccagacaagcagagtttccctgacatgtctgcaaacagcatgagaaggaagaactgtcaaccaattttgatt

SEQ ID NO: 19693 - DNA, 201 bp, Homo sapiens
cccatggagcctggatacacaaaatgttggccctctgtatctgcaagtttcaaatcctgcaaatattgtacttttgatccacactgattgtggatgcagawgccgtggacacaaagggccaactgtgtttgagagagatccacatttagataaacccacacagttcaaactcgcacagttgaaactcacgttgtgcaaggg

SEQ ID NO: 19694 - DNA, 201 bp, Homo sapiens
cataggctaataagggaaataaggtttcagtctagaagatattcaacaaatgcatctaagtttctcctaaaagtctaagacattgctcttggtgctgtttkcatgacattccatgctctcctgaaatgatcacattaaaacaaacataaaattatactgagttggacacaaaactctgagaccctgccaacctagtattta

SEQ ID NO: 19695 - DNA, 201 bp, Homo sapiens
gtctagaagatattcaacaaatgcatctaagtttctcctaaaagtctaagacattgctcttggtgctgttttcatgacattccatgctctcctgaaatgawcacattaaaacaaacataaaattatactgagttggacacaaaactctgagaccctgccaacctagtatttattggcactatcatctccagctctatgcca

SEQ ID NO: 19696 - DNA, 201 bp, Homo sapiens
cattcccagcactctgggaggccgaggcagatggattgcttcagctcacaagtttgagaccagcctgggcaacatggcgaaaccccgtctcaacaaaaaarattcaaaacttagccaggcatggtggtgcacgcctgtaagctgaggtgagattgcttgagcctaggaggcgtaggttgcagtgagccaagatggtgccac

SEQ ID NO: 19697 - DNA, 201 bp, Homo sapiens
attttcatttttggagaggtcatggggaagagactgaggctgcaaaaaaataaataaaaaatatgcataccagtggtgttcaaagtttttgatcatagcamatgtaccaacataggaaaggaggccatgagccttctgtgctccatgtgcccaccctccactagaaaaaagagccatgtgagaaagaaccggagtggaaca

SEQ ID NO: 19698 - DNA, 201 bp, Homo sapiens
ggaggtggaacttgcagtaagccgagatcgcaccactgcactccagcctgggcgactgagtgagactccgtctcaaaaaaaaagaaacaaaaaaaagccaygcaattttacttcacttcttcaacctcacaatcaaaacactttcataagcacaggggcttaggaatgtgggccctagaaactcacagatctgtctccagc

SEQ ID NO: 19699 - DNA, 201 bp, Homo sapiens
aagactagtagcagtcacggccaccttaagcactttctctgtgagcggatctctaccttgaagctcgtgtactttttgcagtacaatttccagttctgggkttgtcttctttacatgagatgtaagtatggataggcagtatctgaggtaataagtgaagaacaccagaatgagaaaggtaagtaggctggacaaggacaa

SEQ ID NO: 19700 - DNA, 201 bp, Homo sapiens
tcaagacaatatgctgaatgaaaacagctttatgcagaagagtaatactgtatgcttccatttaggtgaagttcttgaacaggcaaaactgatttatggtraaaaattcagaagagtagttgcctggggaatgggacagggactgattgaaaggaatctgaagcagctttctgaaaaggagtaaatgccctctaacttgac

SEQ ID NO: 19701 - DNA, 201 bp, Homo sapiens
gatggatggacagattatagagaatgagaatgtgtatacagaaaaatataaactggcgaatccaggtggggtatatataggttgcttactggacaattctstcaacttttctctattttgaaagtgtttcattaaaaagttgaggggaaagatcatcagagagaaagatgccatttgatttcagtctcctaggaaaaacaa

SEQ ID NO: 19702 - DNA, 201 bp, Homo sapiens
gggcccagcatattttcattatgatacaaaccagttataatcagattacagccccaatgccaagctgctatcactggatttctactctgaaattacagaayaaaaaaatcaggtaccacattcatttaccttcttaaaaggtgtaatttagtcatcatgactgtctgagaactacatcttcacatacatacaacagaaaat

SEQ ID NO: 19703 - DNA, 201 bp, Homo sapiens
agccaggcgtggtgcacacctgtaatcctagctatgcgggaggctgaagtgggaggattgcttgaacccagaaggcagaggttgcagtaagccgagattgygccactgtactccagcctgggtgacagagcaagactctgtctcaaaaaaaaaacaaagaaaatcatcatggaattcaggtctactttttaaacaaaacat

SEQ ID NO: 19704 - DNA, 201 bp, Homo sapiens
ggattgcttgaacccagaaggcagaggttgcagtaagccgagattgcgccactgtactccagcctgggtgacagagcaagactctgtctcaaaaaaaaaamaaagaaaatcatcatggaattcaggtctactttttaaacaaaacattagtatagatctttccaatacaaagtttcctccaaataggttcagaaaatcagt

SEQ ID NO: 19705 - DNA, 201 bp, Homo sapiens
tgagggcttttcataattttaagttctcgaaattgtaataaaatacttattgtcttcacacataaatcacaagctaactagtcgcaaacagtacaatggcrcttacttgtccaaccacttccgaatctgagctaaaaccagggctcgatgatgaacaacttctaagtttccccttggcatcttaaataaattaaagcagta

SEQ ID NO: 19706 - DNA, 201 bp, Homo sapiens
aaagcagtaacatttttaattaagtagaaaacatttaaatagccaggatacaccattttacctaactcttcacagagaattaccacaactctctaaaatcmgcacacttttagcagaatcttgttgttctctatatttatcttgactttcaagaaaagtttcgctttgagccttatggtcacagcctgtatcaacactcct

SEQ ID NO: 19707 - DNA, 201 bp, Homo sapiens
aggcatgggtgaaagctagctagattactcggagctaacactgtgaaaaggatccaacaccaaaccaagccttgatacctcaatgtcattgatgaaaaagygacacctgtcagtcagaccaaggacacattcctgcaaagaaataaaactgaaatcacaagcaattctatctcaaatcagttaaacctaccttttctatca

SEQ ID NO: 19708 - DNA, 201 bp, Homo sapiens
catagccaccatcctcaaattacccctcaaacatctcagtattctctaccagtatactctgtccatttccatcacactcccaacaaagggaatcattacaytgaaattaatagatcacaagttccagaagagcaggaattagtcaagcggttttgttttccagccactgcattctaccatccaccacaattataggcattc

SEQ ID NO: 19709 - DNA, 201 bp, Homo sapiens
tccctgcgatagtcatcaatcacttttttaagagtacgttagttcattaaaagaggaaacaggagtagaatacacttgccaattccactctaaagcttagrgttttccagggtagttaaaagacctgacaatcaatattgaactgacaagatacaagtacatgttcttaagaactaagcatctatgtaagtcataacatgc

SEQ ID NO: 19710 - DNA, 201 bp, Homo sapiens
tagtcatcaatcacttttttaagagtacgttagttcattaaaagaggaaacaggagtagaatacacttgccaattccactctaaagcttagggttttccasggtagttaaaagacctgacaatcaatattgaactgacaagatacaagtacatgttcttaagaactaagcatctatgtaagtcataacatgctttcctaac

SEQ ID NO: 19711 - DNA, 201 bp, Homo sapiens
gactgcattaaaatgttttatgtctataaatttatgtaatgtatatatataaaggaaaggttcctaattttgcaacaacgtttctcagaaatctcaccagyagggctttaattacaaattaatctggggattagtgtcagtggacaaaggtgccaagtattgacactggaaacaaggagttctgggaactggctagaaaat

SEQ ID NO: 19712 - DNA, 201 bp, Homo sapiens
aagatatagtcaggaatcaaaacaaaactcaggcccagagaacagtgaaatttcagcaaagaagaatagagactttctaatggtaaatgtagtcaggtacraaataggatatatagaagaggaggctggaagaagcattttgaagtcaccacatcaaaacaaagcatatatgtgcaattatgcatcatttaacgatgggga

SEQ ID NO: 19713 - DNA, 201 bp, Homo sapiens
tgaaactataatcagagaaactggtgagacatccagataggatccatgtacacagtgggctgctgacttaacagaaaagctgatatgaaagtaaggacttsccatttaaattaattaattttgattattctctcttggcaactatctaggctttttctgagaattcaaaagatatttgaaaacaaggctaacactgccata

SEQ ID NO: 19714 - DNA, 201 bp, Homo sapiens
gtgcacatgggaggcggaaccacagtctgccggaagactgtcaccaacaccctgtctgcagtgaaaaagaaagaagaggattagacctagggatattcaayttgtaagataagccatctgaacatcacagtatatctaaacaataatggcaattcacaaaaaaataactttcaatgtttttctcaggaacaagtctaaaaa

SEQ ID NO: 19715 - DNA, 201 bp, Homo sapiens
tgaaggataaactttgcttgagataccagtgatagtttccaacagtccagagctgaactgcaagggaaaatgaaaagaaggccgttagaggctgggaagcmgacttcatcccacttgccagaggggttcaagggcaatcttttctttttcaaaggacccttcctgctcagcctcgtctctaaaataagaacaataataact

SEQ ID NO: 19716 - DNA, 201 bp, Homo sapiens
ttccatgcagataaaatatcaagaatcaataaggtcagaaatatatgtttattttcttgttttttttctatttttaacttttattcatatgtttattttcrttttttttttttttttattgacacagagtctcgctctgccggccaggctggagtgcagtggcgcaatctcggctcactgcaagctccatctcccgggttc

SEQ ID NO: 19717 - DNA, 201 bp, Homo sapiens
cattattacaacactttgaagttagaccacatgctgatgttctgtgagcacagatgttgtggctgttcttgtgcaatgtgtgtgtgtgtgtatatatatayatacatgtttttgagatggagtctcactctgtcacccatgctggagtgcagtggctcaatctcggctcacggcaacctctgcctcccagttcaagcgatt

SEQ ID NO: 19718 - DNA, 201 bp, Homo sapiens
caagcgattcccttgtctcagcctcccgagtagctaggactacaggcgcgcaccaccacgccggactaatttttgcatttttagtagagacagggtttcaycctgtgcaatatttttatgctcagcatatcacagtgccatcccttgacacactggttaatcggtggttctcaactgcggctgtttaaaatcacttggggg

SEQ ID NO: 19719 - DNA, 201 bp, Homo sapiens
tgggaaggtcccattcattcagctgaagaccttaaaagcaaaaactgaggcttcgcagaaaagaagaaattctgccttaaggctgtaacagaaatcctccstaagtttccagcctgccctacagatttcatactcaagacagcaacatcaattcttacctgaatttccagcctgccaacctgcccccacaaatttcaaact

SEQ ID NO: 19720 - DNA, 201 bp, Homo sapiens
gagacggagtcttgctttatggcccaggctggagtgcagtggcacaatcttggctcaccgcaacctctgcctcccaggtacaagtgattctactaccttarcttctcaagtagctgagattacaggcatctgccaccatgcctggctaatttttgtatttttagtagagataggatttcaccatgttggacatgctggtct

SEQ ID NO: 19721 - DNA, 201 bp, Homo sapiens
ttcaaattgcaccaactatttacttggtcaagttcctgtttagtcaaggataccttttaagtcctgccaaaaaaaaaaaaaatcacttaaaaatcaggggracatgaaaaccacttgtccaaagctgggcagttgtagtggatcacccccaaagaagcaaggttgtgtctcagagtacttactccatgtttctgccctcta

SEQ ID NO: 19722 - DNA, 201 bp, Homo sapiens
agaaaaatatctaatatacacatatatgggaaaagtatgagaacatgcatgtgaatgaaggatggcagctctctctggagaggaaggggagggacatcggsacgggatacacagggggtttcctttgtctgtgatgttttattttttaaactgggtgatgaatattggttataattatttgctactatgaaaataaatcac

SEQ ID NO: 19723 - DNA, 201 bp, Homo sapiens
attggttataattatttgctactatgaaaataaatcacaaagcaacttggcaataacaaggaaaaaaaggatctttctagagggattcatttcctgaaggytctaggcagttttactaaagcagaagagaactgttcattactggcatctaagtggacaccaaagagttcctggtgggtggcaaacttacatttgttccag

SEQ ID NO: 19724 - DNA, 201 bp, Homo sapiens
cagctaattctaaaaaatgtactcccatcctcattgtgaatcaagttttttcctgaatgattcctgcttctagccccacacaaaccttccttatctttcayctggattcctgtagcaacctcctacctgatcaccctgcctctcatctcttccctctccacacacaaaaacaacaaaaatatgccatcacgagccatcttt

SEQ ID NO: 19725 - DNA, 201 bp, Homo sapiens
taaataaatctctttaaacctcttatcatcaaaacttgtaatggctgatcaactataactcaatgtccatattccctactacaaactcaatcaaatctgtyccatttatttcattctacactcacattctgccacttcagcaatgctgaattactcacagttccctgagtaacccacaatgtttctatgaaataaccctcc

SEQ ID NO: 19726 - DNA, 201 bp, Homo sapiens
atatctgcactctcatgtttgttgcagctctgttcacaatagctaagatttggaagcaacctaagtgtccatcaatggatgactggataaagaaattgtgrtactatacacaatggagtactattcagccataaaaaaagaataagatcctgtcatctgcaacaacatagatggaactggagatgattacattaagtgaaa

SEQ ID NO: 19727 - DNA, 201 bp, Homo sapiens
actggataaagaaattgtggtactatacacaatggagtactattcagccataaaaaaagaataagatcctgtcatctgcaacaacatagatggaactggaratgattacattaagtgaaataaaccagacacaaaaagacaaacatcacatgttctcacttatttgtgcgatctaaaaatcaaaacaattgaactcacgga

SEQ ID NO: 19728 - DNA, 201 bp, Homo sapiens
cacaagcaaattaacccagtctactttcaagaataattgataacatttccagaaatactttttaatgcttcttttattacataaaagctttcaaaaatatkttttctagatgaaaatccaaactttcatttgagaaatatcactactctgtcatctctaacaagaaaaataggtaatgtgacctttttgccaaacaaacac

SEQ ID NO: 19729 - DNA, 201 bp, Homo sapiens
ttgtttacatttctctccactaaatggtgccataaagatataagaatatcaatactgaaaaaaggctacttaaataaattcactatcaacaaggtatttcwtaaattccaattaaagttggaataagactttatcttaaaaaaactagttacaggccgggcgcggtggctcacgcttgtaatcccagcactttgggaggcc

SEQ ID NO: 19730 - DNA, 201 bp, Homo sapiens
aatggctttttcatatcgtttcaagtatttgtctatagtaaaccgctgataattagtttccattttcttaagtgtattaagaaatggaagatattctttgrgatcctaaaaaaatgattaatgagaactttattacttgtgatattcatatataggaatagaaactagcatttacatatagcaataaacccaaagctacat

SEQ ID NO: 19731 - DNA, 201 bp, Homo sapiens
cctcatctacaaaagaggaaaaccccatctctgacacagctcctaggagggatgagatcaactgaaaatatgtgtaaaggctatgaaaagagtaaaacatrttaacaatgtataacatactatgttatttccagagtccaatgttattcttaaataactgactcttcaagtcagtaagggaaaaggaatggctcgtacaaa

SEQ ID NO: 19732 - DNA, 201 bp, Homo sapiens
gccacattggacaagtcacttgaattatctcccacgctccggtcagtcgtccagtgccaatcataggcgaggtaatgccagccctgacagagaacatgcarccggtatggggtcacagggtcccacatcagagacacaatcttgctcttcccacaggtgctgaaggataaactttgcttgagataccagtgatagtttcca

SEQ ID NO: 19733 - DNA, 201 bp, Homo sapiens
ataaataataaacagatgacaatatactagaattctgcgatacaaagctgattcagccttaaacacaacccgcaaagtccatcataacaacatagaagtgmcaagtcaaatttttcataaaacaaaaggaaaagcaattacctggggtccctttaaagcctgatcccatccctgagttctgaaaggaaagtgagaggccgt

SEQ ID NO: 19734 - DNA, 201 bp, Homo sapiens
atacaaagctgattcagccttaaacacaacccgcaaagtccatcataacaacatagaagtgacaagtcaaatttttcataaaacaaaaggaaaagcaattrcctggggtccctttaaagcctgatcccatccctgagttctgaaaggaaagtgagaggccgtctctgaccccatcttcccccatctctccccactccaacc

SEQ ID NO: 19735 - DNA, 201 bp, Homo sapiens
ccaaatgctggaataattaaacacatgtactacaaaaagaaaatcaagcacgctggggggcctacgcagaaagcagtgtcccacaattctttatcctggcytaagcatctctcccagttcagttagggggatgccaaatggaggaaggcttctcagttaccagctaagaagggctgcttcaggaatgtgtgcagacatgac

SEQ ID NO: 19736 - DNA, 201 bp, Homo sapiens
tcacaacatttgttcaaaaaataaaatcagatgttaatataaactgagcattcaggggaggaactgcctcgtggggaatgggaaaacacacaagccacaargctgaggaagaaaaccttccaatgccaagtttaatgtctcagatatgctgggaaagtgtctgaacaacttccacacagcgctgaagaatattctccccac

SEQ ID NO: 19737 - DNA, 201 bp, Homo sapiens
cgctgatatcctggagttactatgggagtatttgccactcatctcactgccactcacgacactgctagtttcagagaagaggtctgactcttgcccgtggrgtacctcatcatctagaaaagaagaaccagaagccgatgaaaacactgcctgctaatgtgtgggtttactttcagggcggtaaatgaactaactagagtc

SEQ ID NO: 19738 - DNA, 201 bp, Homo sapiens
aggaatgatgttttcagtacccagttagaggtacctaaagtgaatgacataaaaagtaccccagcaacgttttaattaggatggaggaagggggtgcagasaaggtaagaatgtgcatacatgtaaatgtcagaaaggccagacgttacttacagggtagatgtgcataaaaatgcagaacttaaaatcaaccactcccta

SEQ ID NO: 19739 - DNA, 201 bp, Homo sapiens
gaatattttcctgaaaaacaggcctcctacaaggcagccaaggaaattcaattcatttcagtaaaagacagtaatatttcaaattattatcaagaatgatraaaatgattttaaaaacaccgcttttccttaagccaggaacctgacctatttctacttatttcatgaacctcagaagacaagagattccaactgacctgg

SEQ ID NO: 19740 - DNA, 201 bp, Homo sapiens
tgagatgaccagagcttctgctcatctcttttcataggtgtccttaccctttcctccactctggtactagagcccctggtaccagcctcgcctctggttcrggcaacccttgtccctgacgcagctaaactgcctttgctttcagaatgcttcgacatttggccttttattttccccacctcattcctggctattccaaca

SEQ ID NO: 19741 - DNA, 201 bp, Homo sapiens
tatcagtgagaacaagactgtctcagagtattctgccctaaatttatttgcaaaattaccaaacaaaagaaataaattttttaaaacctttgtagatgtaracatataaatgattgtacttacctgccagagttctgccgaggcccaccagctggtctttggtaaagttaagctgggctgccacacagagggcttgcttcc

SEQ ID NO: 19742 - DNA, 201 bp, Homo sapiens
tgtacttacctgccagagttctgccgaggcccaccagctggtctttggtaaagttaagctgggctgccacacagagggcttgcttccagttgccacatgtsagaaaggctgagagagctttctcgtgggcaccgcaacgggcaaacatgagccccgctggctcatacatgtgctcctgcatcaggtgctccccataagcaa

SEQ ID NO: 19743 - DNA, 201 bp, Homo sapiens
ctccttgcagctctcagggagtgtgagctctaatggctgtcaggagaataaaccacgtgatgagatagggggcaccaggcagagggcacagaaggcaccayggccatgcagcaggaatgtgtatagcaggtctgaggagtaacaggacggccagtgtgactagagcagagagagtgtggaagagaacagaaaacaagggca

SEQ ID NO: 19744 - DNA, 201 bp, Homo sapiens
ggccaaatcctcgattctccaggctggatgttagccagagattcagagaggaatacaacatggagtccctgcccttaaggagcccacagcctggtggaggygacaaaccagctaatcagcagtttgacaaatgcaatcaccaaggcgagggcaggctgctctgggggctcagtgtttggcgcctggtccaggaatggcatt

SEQ ID NO: 19745 - DNA, 201 bp, Homo sapiens
ggtagagaaatgacagaggaatcacacgatgtgacatctgtagaactacctacaagtaactgggaatgtggacagtggcagaagctggtgctaaagaagcyggcaggggcttgatcaaagaaagatgtgtatattgtctgaggacaaactgaaaatggtgatgctggtggcatggtagagtggtggttaatggcatgggca

SEQ ID NO: 19746 - DNA, 201 bp, Homo sapiens
ctgaaatatatgggaaagatctgtacttgttaggataatcagacttacagcagtaaggttgggctagaggaggggtgggaaagaagcagggaaccccacgrggaaggtgctgtggtattccagatgaggaatcagagaacaggtcaggaccattctcccagataagaagttcaaattgaggctaattagttttaagataaa

SEQ ID NO: 19747 - DNA, 201 bp, Homo sapiens
aactgcgtcttgcagggcacggggaggtggcctcatcactctctccagacaagcagagtttccctgacatgtctgcaaacagcatgagaaggaagaactgwcaaccaattttgattctgagacactgaagttaacttcacaggtgctcattcttaaccaaaaaaggatctacttgacgttcttacctagggagctcctcca

SEQ ID NO: 19748 - DNA, 201 bp, Homo sapiens
aatagaaaagatattcacaaaaactgagctccatgggcccagcatattttcattatgatacaaaccagttataatcagattacagccccaatgccaagctrctatcactggatttctactctgaaattacagaataaaaaaatcaggtaccacattcatttaccttcttaaaaggtgtaatttagtcatcatgactgtctg

SEQ ID NO: 19749 - DNA, 201 bp, Homo sapiens
atatgtcgaaactgataccaaaagaaccttgccattctctagacagaagaggagctaggaatacagtagttacagtctggatgtatgagtttagctgggawggaaggtagctgttcttcctggtagcaacataagctgttaaagtcaaacttaatttgaatccccacaggctacttcaaatgtcatcaaaatgctattaca

SEQ ID NO: 19750 - DNA, 201 bp, Homo sapiens
cctgggcaacatattaagaccccatctgtttttttttctaaatgaaaaaacttaagaaaaaaaaaggaataagtggatatgtcgaaactgataccaaaagwaccttgccattctctagacagaagaggagctaggaatacagtagttacagtctggatgtatgagtttagctgggatggaaggtagctgttcttcctggta

SEQ ID NO: 19751 - DNA, 201 bp, Homo sapiens
aggcaggtggagtttgcagcaataagaccatcagagccagagttcatgtgtctgctacccctgcaacctccaggtcagagcaaacacaacctggaggcccygccctgagaggagggactgcatttcaacctcaggcatgctcacccagtgattcaaagtggaagaatgttctgtatttcaaactggtgggaggggtggtgg

SEQ ID NO: 19752 - DNA, 201 bp, Homo sapiens
cgacaaacatgttgatcaataaagatgcccctgctttaaaaaaagtgaatggagagagagggttaggaaaagattctgtcattgtaacctaaaactcccakgcactctttcacttagatttgttaagtttcttttctaaccaggaatcatatactgcaagcagagataggagaaaatatgtatatataaggattttctttt

SEQ ID NO: 19753 - DNA, 201 bp, Homo sapiens
gcttctatccaaagccaaaaatttctatgatcccactgcaggtcctttctcccacattatcttttttcttcccaaatgctggaataattaaacacatgtaytacaaaaagaaaatcaagcacgctggggggcctacgcagaaagcagtgtcccacaattctttatcctggcctaagcatctctcccagttcagttaggggg

SEQ ID NO: 19754 - DNA, 201 bp, Homo sapiens
ctaattttgcaacaacgtttctcagaaatctcaccagtagggctttaattacaaattaatctggggattagtgtcagtggacaaaggtgccaagtattgayactggaaacaaggagttctgggaactggctagaaaatgctatcaactatacaacagggcttacattacacagaagagcattcattaactgaaacctgtta

SEQ ID NO: 19755 - DNA, 201 bp, Homo sapiens
aagttacctaacctctacactttgtttttttaatctgtaagtactcaataagtggtactttttaaaaaagttctctcacagatgtggcattataatttggwttctaggtcattttgcaaatgcctatagtgtacctgaggtattcaataacatccaattgtttacaatactgtttcaatggaagaatgcattctgatttcc

SEQ ID NO: 19756 - DNA, 201 bp, Homo sapiens
tcaataagtggtactttttaaaaaagttctctcacagatgtggcattataatttggtttctaggtcattttgcaaatgcctatagtgtacctgaggtattmaataacatccaattgtttacaatactgtttcaatggaagaatgcattctgatttccatcccaggagcctcaaagcacagcacccagaagttctagattct

SEQ ID NO: 19757 - DNA, 201 bp, Homo sapiens
atgttattcttaaataactgactcttcaagtcagtaagggaaaaggaatggctcgtacaaaccagtataggattaaaaaaaaaaaaaacaaaaacccaagscaattaaatatcataatgataatgatatcaactgcagacttaaaaattttgagaaacactagacctatggcaacaccaaactataatttgcttttatgta

SEQ ID NO: 19758 - DNA, 201 bp, Homo sapiens
agaggattagacctagggatattcaatttgtaagataagccatctgaacatcacagtatatctaaacaataatggcaattcacaaaaaaataactttcaaygtttttctcaggaacaagtctaaaaacagtgtgggatggggaaatgtcatgggttctgtccataattggctattgtcacctctaggcctaggggagtcca

SEQ ID NO: 19759 - DNA, 201 bp, Homo sapiens
agatatatacatgaaaaacctagaagacaagaaaatttgaatagtgattattacgaagtggtagaactatgagatttttttctcatcttattttctaacaytttcaagtattatttaatacttaaaaccacacacttatacattttaaaagctataaaaatattcttacttttacgcttaatctaaatcttctttcacgtc

SEQ ID NO: 19760 - DNA, 201 bp, Homo sapiens
ggacacattcacttgcttggactgttccccacccttatccctcacctacccaataccaattcagctgactactccaaacccttatccctcacctgcccaayaccaattcagctgactactccccacccttatccctcacctacccaacaccaattcagctgagactcagctcaagttggcctcctaggggaaataaatcat

SEQ ID NO: 19761 - DNA, 201 bp, Homo sapiens
actttgtgacttcaagatggccaaagcttatgcttaataagcgtctctcttctcctgcactgcccttcaatacccccacagccttaatgcccagatgaccytggctagattttagcaagaaaataatctgattgttcccatggaaatgcagattggatctaatcgtagtaacaaaaaccagccttctattccatctttctt

SEQ ID NO: 19762 - DNA, 201 bp, Homo sapiens
ctattagtgcacaaggaaatggtcaaaaatgggaagaaacgtaggtcacaaaatattgcacaaagctatacttactttcaccaaaatcatcctgatggatytgctgctccaggattggctcaaaatcttttgtcatcataatcagggtctgttgaccttagagaaacacaaacaaaaatgattttgttttcatgtaacaaa

SEQ ID NO: 19763 - DNA, 201 bp, Homo sapiens
attttaaaataactaaaagactgtaattggattgtttgtaacacaaaggataaacgcttgatgggatggatatcctattctccatgatgtggttattttgyactgcatgcctgtatcagaacatctcatgtagcccataaatatatgtacctactatgtactcataaaaattaaaaatttatatttaaaaattaaaacaag

SEQ ID NO: 19764 - DNA, 201 bp, Homo sapiens
agtacggcacacactcaaaaagtaaggtcagagttctactgacttaggttaaaatagcagcagagttaaagaaggattacgatttaagctatgtctaacayggcatatatatgaagcaaaagatgtttatttgggaggatataaattcaataagatataaagaaagaccatgtggggaaagaaatttggaagaagagaaat

SEQ ID NO: 19765 - DNA, 201 bp, Homo sapiens
tttttatcagtgagaacaagactgtctcagagtattctgccctaaatttatttgcaaaattaccaaacaaaagaaataaattttttaaaacctttgtagaygtaaacatataaatgattgtacttacctgccagagttctgccgaggcccaccagctggtctttggtaaagttaagctgggctgccacacagagggcttgc

SEQ ID NO: 19766 - DNA, 201 bp, Homo sapiens
aagtttgagaccagcctgggcaacatggcgaaaccccgtctcaacaaaaaaaattcaaaacttagccaggcatggtggtgcacgcctgtaagctgaggtgrgattgcttgagcctaggaggcgtaggttgcagtgagccaagatggtgccactgcactccagcccgggtgatagagcccgaccttgtctcaaaaataaata

SEQ ID NO: 19767 - DNA, 201 bp, Homo sapiens
atagcaaatgtaccaacataggaaaggaggccatgagccttctgtgctccatgtgcccaccctccactagaaaaaagagccatgtgagaaagaaccggagkggaacatgaaccacttgttacatttcctttataagagaagaaattagctcacacatatgcccatcatcttaaaaataaccatgtaattttaggccgcaca

SEQ ID NO: 19768 - DNA, 201 bp, Homo sapiens
taactcttcacagagaattaccacaactctctaaaatcagcacacttttagcagaatcttgttgttctctatatttatcttgactttcaagaaaagtttcrctttgagccttatggtcacagcctgtatcaacactcctttgaataaagctaacagaaaactatcaaggaaaggtttacaataaacgatacaaagaataag

SEQ ID NO: 19769 - DNA, 201 bp, Homo sapiens
catgattgctgctcaggccggcctgtaatgctaaacacaccattaactaataagccttaattatcacaacaagccactctccattaactgcaattgaaacygcacacattatgtgaaatagaagagaacaaataacaaccatgtgccttagctctcccactgaacctcaagactatcagccctgctgatgaacacgctcat

SEQ ID NO: 19770 - DNA, 201 bp, Homo sapiens
atgattgctgctcaggccggcctgtaatgctaaacacaccattaactaataagccttaattatcacaacaagccactctccattaactgcaattgaaaccrcacacattatgtgaaatagaagagaacaaataacaaccatgtgccttagctctcccactgaacctcaagactatcagccctgctgatgaacacgctcatc

SEQ ID NO: 19771 - DNA, 201 bp, Homo sapiens
ttgtggtcaggaatcatcatcaggactgagaatatacctttcaggttttcagtgttctgcaccacttcactcagtgcctccaggagggccaggtcctccakcggactgccttctttgaggctgtgcttcttccgctccgcttttcggcgattcttggatgatctcctgttagaaattacacagatatttttaagcctcctg

SEQ ID NO: 19772 - DNA, 201 bp, Homo sapiens
acatgtggagtacagggaaaaactgcaatacctgacattgagctgtccatgctcttcatccatctcagaagaagctgcagtcaaatggtgaatgacagacygggggctgaactcactgtggcttacagccaggaagacgtcttcttcaatccaagtgagaaggcctagtttcagcgggtttacatcttgatcttcattatt

SEQ ID NO: 19773 - DNA, 201 bp, Homo sapiens
atcccaggagcctcaaagcacagcacccagaagttctagattctgggatggagcaaagacagaggctgcattaggtcatccatgttaacaacccatacatycccatttatgtaagagaatgcagctccgccttatcattgtcatctccatctttcccacatgatttttcctggagaaccaagcgctattgggagtaggtcc

SEQ ID NO: 19774 - DNA, 201 bp, Homo sapiens
ttcctggagaaccaagcgctattgggagtaggtcctaggctggcttacaactcatgctctcctgctacctatcaaattatatggcattcagacaaactacmtgactggcttctccaatcagatccgaaagtcagggcctgggtgttgtctttatttcttgttccactcagcaacaggcatagaactgttatcagatggctg

SEQ ID NO: 19775 - DNA, 201 bp, Homo sapiens
gagttctaaggcaaactttaaatccacttccacccacagctcccagtttcactgtagggtcagcacttggacaatcacctggaaaacaaaaatgcaaataytatcatcgtaaattataagatttcacctaatactaaggggatggtgtctgcaattaatgagttctagaaggcaaacagcaatctagaaaataatcacatc

SEQ ID NO: 19776 - DNA, 201 bp, Homo sapiens
aagatttcacctaatactaaggggatggtgtctgcaattaatgagttctagaaggcaaacagcaatctagaaaataatcacatctcaacctccttaaaatytctgctttcctcttaagaacacatcagtcataatcttccctgacaaaggccacatctcagcaagaccaggtgaaggggctaccctctcagcccagtgctg

SEQ ID NO: 19777 - DNA, 201 bp, Homo sapiens
agtacaacaagccaagtactagaaaaaagcctggcatataataaacaatcaagaagcaatgagggggaaaaaggagtgatactcaggatgcatcaaacacmatctttgaaaactttggcaacgaacttgtctccacaccactcaaatgtctaccacttgactccaagttcttaatttcccttccacttgggcacggagccc

SEQ ID NO: 19778 - DNA, 201 bp, Homo sapiens
ctcttggcaactatctaggctttttctgagaattcaaaagatatttgaaaacaaggctaacactgccatatgccagcagaatttatgacataaccacagarctcacaagtaaaaacaaatttcagattctccagcacatcaggaaagtaatgaagaactgacagcaatggggctgtggcaggacaagtggattaggagcta

SEQ ID NO: 19779 - DNA, 201 bp, Homo sapiens
cggtctcgatctcctgacctcgtgatccgcccgcctcggcctcccaaagtgctgggcccccaaagtgcatgagccaccgcacctggcccatacctactacrcttttaacaaaaacaagatgatagctatactgagatatatacatgaaaaacctagaagacaagaaaatttgaatagtgattattacgaagtggtagaact

SEQ ID NO: 19780 - DNA, 201 bp, Homo sapiens
acactctattactctctctccctcccgccccaccctattccctctctcaccgtctctctatgtaagtacagctgacccttgaacaacacaggcttgaactrcacaggtcgatttatattcgtatttttttcaatgaatacagtcggcccttcatattgtggattctatacccgcaaccaaacacacatcaaaaatatggta

SEQ ID NO: 19781 - DNA, 201 bp, Homo sapiens
tactctctctccctcccgccccaccctattccctctctcaccgtctctctatgtaagtacagctgacccttgaacaacacaggcttgaactgcacaggtcsatttatattcgtatttttttcaatgaatacagtcggcccttcatattgtggattctatacccgcaaccaaacacacatcaaaaatatggtacttgaggaa

SEQ ID NO: 19782 - DNA, 201 bp, Homo sapiens
tcaatcaaaacctaaccacccccatttccacctacccacttcagcatctttgattctactaagggactaagtagaagggatgaaggaaatcccatacctgwctactttcaactacgttttatggggcagaaggctggggtactacagctgtcttaccacaggttttcggaatggagctttcttctctctgaaggtcttcca

SEQ ID NO: 19783 - DNA, 201 bp, Homo sapiens
ggttatgtaaagaaaaatgtccttaactgttataaataaatattgaaaatatgatttctagaattaaaactccaggaaataaaaatatatgtaagtatatrtatgtataggccaaagagttgcggaccgatgaaaatagttttgcaaaatgttggtatctactgaaagtgagtaatagttacatgggagttcattaaactc

SEQ ID NO: 19784 - DNA, 201 bp, Homo sapiens
caccattttctgctctgtacaatggcttcatatataccctgccttaaaaccacagccttttaagagttaggaatgcaaaatatatgcggccttggaacaaygaaatctgtgaagaagcgtaaaatctactattcgagttgaattcagacttcagggaataagaaaaaaaaaaaagaagaaacaaagatagatacagcctta

SEQ ID NO: 19785 - DNA, 201 bp, Homo sapiens
catcacctaatccaggacccaatactttcctcctgccattgattctgattctgatgaagcagggctgtttgcaattcctataaattatgggtccatatgaycatttcctgtctgctcacatccaagtgctacagtacctcaattgctgctgcgtacaaatggtagtgactatcctggtgcaaacccccaggcttctatctg

SEQ ID NO: 19786 - DNA, 201 bp, Homo sapiens
ctttcccatcccaaagtatactgtgtgctgttactctctctctgactgtcctcaaagctggatgccccagagttccaccctggattctagactcttcctgyacagcatctgctccctgagacagtccatctgttcccaaaactgtcagaatttcctacatacccactactctcagtccatagctctggcctctcctgagct

SEQ ID NO: 19787 - DNA, 201 bp, Homo sapiens; identical to SEQ ID NO: 19686

SEQ ID NO: 19788 - DNA, 201 bp, Homo sapiens
cagctggtctttggtaaagttaagctgggctgccacacagagggcttgcttccagttgccacatgtcagaaaggctgagagagctttctcgtgggcaccgyaacgggcaaacatgagccccgctggctcatacatgtgctcctgcatcaggtgctccccataagcaatgctgatatcctgtgacaagaggagatttaggac

SEQ ID NO: 19789 - DNA, 201 bp, Homo sapiens
ttataccttgcctagttccaaagaagatctgaagtagagataaacatactaatccccacacttaccacatttgctgaggtggccaatggctttttcatatygtttcaagtatttgtctatagtaaaccgctgataattagtttccattttcttaagtgtattaagaaatggaagatattctttgggatcctaaaaaaatga

SEQ ID NO: 19790 - DNA, 201 bp, Homo sapiens; identical to SEQ ID NO: 19707

SEQ ID NO: 19791 - DNA, 201 bp, Homo sapiens
ccatacctgactactttcaactacgttttatggggcagaaggctggggtactacagctgtcttaccacaggttttcggaatggagctttcttctctctgarggtcttccagccagactgcaagcacagaggaatctgcattccagagcaagtcatttacctagaagggaaaaaagatctgtcattggctttcagttatgga

SEQ ID NO: 19792 - DNA, 201 bp, Homo sapiens
aacagcaagagcacagcttcttcataatcctgacaagggaacaggaagaagacaacaagtgaagagagcatgtcagatgtcatcacagccaactacaaaaytaaccacagacctgcctctatctccctggccaggggagaactcctagttctcaacatcatgcctatcctagagttcatgactccataaatattgatacaa

SEQ ID NO: 19793 - DNA, 201 bp, Homo sapiens
aaccattccaggtataatgtcctaaaaatcaaaatctatttctccttccattatacaacttcagcaaatattctatgctccagtaggtcttttttaagacktcaccaaatgttgaaaacatcttaattgcctcatcttattcatatttgtctctagggttttaattcaaatacatttctcttctgctctatcatataatac

SEQ ID NO: 19794 - DNA, 201 bp, Homo sapiens
accattaaatgaagataaatagactggaagagctcagtaaccaggaaacaatgctacaaaatgtttggaaagtaaaagcatctatctttcaaatacgaaaraaaaacaagctgtatatgacaagtttgatatttcccaccatgaactgcaagtaaaggtttatgattgtactaaatggaatggttaagagcagaggtgcca

SEQ ID NO: 19795 - DNA, 201 bp, Homo sapiens
tcctttacagcaaatgagatgactgcatcaagcttttgcctctacaagctaatgatgaagaatttcaaatctgaagaagtagaaacttagtaaattgctcygcttttcaaaaggtaatctaatggcttactttaagtgctacatatttctagaacatattctgcatttagacatgttaacaaaaggctttttcaaaatatc

SEQ ID NO: 19796 - DNA, 201 bp, Homo sapiens
aacaaggtgaatagggaggagccacagaggtggtaaaggcagcagcagacaatgacgaaaacatggaaatgttctcattctgcagcatgacgggaagaaaygtctcctccagggccacgtgtatctcaatcctgaagccaactctaccgggtgggagacagatgaccacccgggcattcatcatcatattctagtaacagc

SEQ ID NO: 19797 - DNA, 201 bp, Homo sapiens
ccatatcaaaaccaacccacagaggtttttaaagtacatatagttaggagccaacactaaagattctgatttagttgacatgagatgtgggctcaaacttytagaaagctccatgggcaactttcgtgttcattcccaattaaaaaccactcttggccgggcgctgaggcaggcggatcacgaggtcaggagatcaagacc

SEQ ID NO: 19798 - DNA, 201 bp, Homo sapiens
agcctgcctctagaatcagaaaccatccaagggttggttcttagaacgcagaaatcatcaaaaagaagaaaaaaatgtaaaacaaacaaaatcctcctttsggcattaaaaaaaaaaaaagtggcctctgagaacagcaaaagaggaaaagagctacagatctagatcctgaatataatgagctaaggaacctatcaggta

SEQ ID NO: 19799 - DNA, 201 bp, Homo sapiens
ctgcctggacacttgacaacagcttctcctaactagaatctctgcctccaggtgcccctgacctatggccaaccccacatattgatgccgaacaatctttsaaaagtggagctctcaacctgtcctatctcatcacagggagttttctctcaagtaaaatgaatgcagggtggtacagggtttcattctgaggagataaaa

SEQ ID NO: 19800 - DNA, 201 bp, Homo sapiens
gtgaatttatagtttaagagtgatttacactgaatttcaaataaaaggactataaaacgtgttatttttctgtaagggctataacatacatgtcaatatcmctgtttttaaataaaatatacttttatacagaagaaatcattcgatgtattaattccattggttatctatcctcttatgctgttgaagtcataagttacc

SEQ ID NO: 19801 - DNA, 201 bp, Homo sapiens
caaatggaggaccacatcatcagctgctacttgaagtggccagtctgtgcccaactactgaactgttcagagcccacagaaagggctacggtagagacatktatggtatctcgtatacacaggcatgccttatttctttgtcttctaccccagtgctacctacctaaagacctctggtactcttccctttcctgggaaaga

SEQ ID NO: 19802 - DNA, 201 bp, Homo sapiens
ccaaatggaggaccacatcatcagctgctacttgaagtggccagtctgtgcccaactactgaactgttcagagcccacagaaagggctacggtagagacaygtatggtatctcgtatacacaggcatgccttatttctttgtcttctaccccagtgctacctacctaaagacctctggtactcttccctttcctgggaaag

SEQ ID NO: 19803 - DNA, 201 bp, Homo sapiens
aagtgcggagtgatgttgatccctccttggccgcactggcctaatgctgtgtagactatgttgacagatcataagccacgcgcgctctccctggctctccstccccacgtcagaaggcactggacttctgtgttccgtctagccccagggaatggcatttgcaaagacctggtggcctgaaatacttcagggcgcattctg

SEQ ID NO: 19804 - DNA, 201 bp, Homo sapiens
aatgaaaacatcctccataagccatctattcttcaagaaaaggtaaaagagagagaaaaaatatgatctcatccacataccttttattggtttttttttcrtcgtttgacagtactaaatgttctttcctttccagccatctactgaaggctacattgcagttgtgttacccaaatttgaagaaagtaaaagcataacaga

SEQ ID NO: 19805 - DNA, 201 bp, Homo sapiens
aaacttttgttttccacattttcctcaaagtgcatgtttttgtttttgtttttcttaactagaaaaaatatcccttactaacacactggggaattacaaaggggggggggggaaagaacaatatcccttcttcaaaaagtcttagtgattgaccctggtaaataagttcctttatctattaagttctaatattaaaatgag

SEQ ID NO: 19806 - DNA, 201 bp, Homo sapiens
tccacattttcctcaaagtgcatgtttttgtttttgtttttcttaactagaaaaaatatcccttactaacacactggggaattacaaaggggggggggggaaagaacaatatcccttcttcaaaaagtcttagtgattgaccctggtaaataagttcctttatctattaagttctaatattaaaatgaggtagaaatctta

SEQ ID NO: 19807 - DNA, 201 bp, Homo sapiens; identical to SEQ ID NO: 2707

SEQ ID NO: 19808 - DNA, 201 bp, Homo sapiens
tttcaaataaaaggactataaaacgtgttatttttctgtaagggctataacatacatgtcaatatcactgtttttaaataaaatatacttttatacagaaraaatcattcgatgtattaattccattggttatctatcctcttatgctgttgaagtcataagttaccccttcccaacccccacttgctctttctttcacta

SEQ ID NO: 19809 - DNA, 201 bp, Homo sapiens
tcatgtattcttctagatgtcaaaggaaaattttgtgaggaccactgtatactacagcactctaaccggtaagcaaattgggaattttaaattatcaaaawtttttttttcctggtattgtagcctggtatggtcttgtggtcttggattgaacaaatgttcactaaacaaacatgcattaattatcttctactgtgttga

SEQ ID NO: 19810 - DNA, 201 bp, Homo sapiens
agaacaaggtctctgggaaatttaagcgggtatgttcctgtaattctgtgattatctacttacatcctctatattcatggtaatgacagatccaatgaacyttagaatccagtagcatatgcttagcatacttctctagcagtttgaggtgctaattttaggtatactttcacctaaagaaattctcagctcccccaaatt

SEQ ID NO: 19811 - DNA, 201 bp, Homo sapiens
ctgtaaaatttaggtgactaactcttctttaccatatatttccacatgtaaattaaacagaaaaaaaattcccaagggagttagaaaaaaaaaaagaaaamcatgggccggtcacaatggctcacgcctataatctcagcattttgggagaccaaggtgggtggatcatgaggtcaggagtttgagactagcctggccaac

SEQ ID NO: 19812 - DNA, 201 bp, Homo sapiens
gagaccaaggtgggtggatcatgaggtcaggagtttgagactagcctggccaacggggtgaaaacccatctctataaaaatacaaaaattagccaggcacrgtagtgggcacctgtaatcccagccactcgggaggctgaggcaggagaatggcttgaacctgggaggcggaggttgcagtgagctgagatcgcaccactg

SEQ ID NO: 19813 - DNA, 201 bp, Homo sapiens
ctcatgcctgtaatcccagcactttgggaagccgaggcgggaagatcacttgaggccaggaatttgtgacaaacctaggcaacataacaagacctcatttytaccaaaaaaaaaaaatttttttttaattagctgggcatggtggcatgtgcctatagtcccagttacccaggaggctgaggtaagaggattgcttgagca

SEQ ID NO: 19814 - DNA, 201 bp, Homo sapiens
aaaggcatcaaaacatttctgctgttttggcacagacctagctcttttgtgtctgctcttttaacacaagccttccccttccttccaaaagcagaaagtcmcaatgactctagtattttaaaatgaagaacccacgtgcggaggagtgaagccaatatagtaatatctgaatgccatctaaaaatgttttgagtggtaaat

SEQ ID NO: 19815 - DNA, 201 bp, Homo sapiens
tttgttttccacattttcctcaaagtgcatgtttttgtttttgtttttcttaactagaaaaaatatcccttactaacacactggggaattacaaagggggrggggggaaagaacaatatcccttcttcaaaaagtcttagtgattgaccctggtaaataagttcctttatctattaagttctaatattaaaatgaggtaga

SEQ ID NO: 19816 - DNA, 201 bp, Homo sapiens
caatatcccttcttcaaaaagtcttagtgattgaccctggtaaataagttcctttatctattaagttctaatattaaaatgaggtagaaatcttaatgaawctaactttatacaatattgctgtcatactgtgtcatgttgaattttatattgtttcttgttgatggattttcccatacttttgaaatctttatacctggt

SEQ ID NO: 19817 - DNA, 201 bp, Homo sapiens
cttagtgattgaccctggtaaataagttcctttatctattaagttctaatattaaaatgaggtagaaatcttaatgaaactaactttatacaatattgctstcatactgtgtcatgttgaattttatattgtttcttgttgatggattttcccatacttttgaaatctttatacctggttatatgtagctttttcatttac

SEQ ID NO: 19818 - DNA, 201 bp, Homo sapiens
acgtcagaaggcactggacttctgtgttccgtctagccccagggaatggcatttgcaaagacctggtggcctgaaatacttcagggcgcattctggggccrgcgattgcagtgcgagctctagggtgttgctcgcagtaagatgagtactctaaacggaggccccaaaggtaggcggagggctaggttgcaacagtcctta

SEQ ID NO: 19819 - DNA, 200 bp, Homo sapiens
catctgccacttagaagtaggtattctttttgtactgttttgtgtaagcagaaccagtggtgggagcatcgttggggactctcctttcttcctttcattcgtgataatggttatactcagtttaaaaaatatatattgtagcatattttctgttggccaaacatagggtgaccaacctgtcctagttcacccatgactga

SEQ ID NO: 19820 - DNA, 201 bp, Homo sapiens
aaatgaggtagaaatcttaatgaaactaactttatacaatattgctgtcatactgtgtcatgttgaattttatattgtttcttgttgatggattttcccayacttttgaaatctttatacctggttatatgtagctttttcatttacagttgataaaatatattatcagtctgtaaattcccatttatcatgtgtcttagc

SEQ ID NO: 19821 - DNA, 201 bp, Homo sapiens
aaatggtattattataggagtttgtttggcaagaatgagtattccagtgcctggccactctgaacatataaatttgattactcaaacatccaaatggaggwccacatcatcagctgctacttgaagtggccagtctgtgcccaactactgaactgttcagagcccacagaaagggctacggtagagacatgtatggtatct

SEQ ID NO: 19822 - DNA, 201 bp, Homo sapiens
ccagaactttgtcatcattcctaattgaagcaggaactcctcattatctccttccccagcccctggaaccactatcctactttctgcctctataaattcarttatcctagggacctcatataagcggaatcatacagtctttgcccttttgtacctggcttatttcacttagcataattattttttatcaatacataagag

SEQ ID NO: 19823 - DNA, 201 bp, Homo sapiens
ccatgttttggccaggctggacattgtggttttaatttgcatttccctaatggctaatggtatggaatatcttttcatgtgctcattggccatccatcttycctctttgctgaaatgtcggttcacgtattttgcacattgtctctttctttattattttttagagacagggtcccactctgtcactgagactggatggca

SEQ ID NO: 19824 - DNA, 201 bp, Homo sapiens
agatgaggcttcgccatgttttggccaggctggacattgtggttttaatttgcatttccctaatggctaatggtatggaatatcttttcatgtgctcattkgccatccatcttccctctttgctgaaatgtcggttcacgtattttgcacattgtctctttctttattattttttagagacagggtcccactctgtcactg

SEQ ID NO: 19825 - DNA, 201 bp, Homo sapiens
tagaccactacaaactgtgtgtggtgggggggtgggtctgagatggagtcttgctctgtcccccagctggagtgcagtggcgcaatctcagctcactgcamtctctgcctcctgggttcaaacgattcttgtacctcagcctcccaagtagctggactacaggtgcatgccaccacaactagctaattttttgtatttgtt

SEQ ID NO: 19826 - DNA, 201 bp, Homo sapiens
tggggtattttccaaagtcattatggatcctcaaatttgagagtttccctttagctcataatttacccccattacctgtgtatgcagatgagtaaaaatarcaatgccaatttaaaattcagatgctggataacaagctaggttcgtttattagctgaagagatcactctgatagaaactgtagaagctcactagatttgt

SEQ ID NO: 19827 - DNA, 201 bp, Homo sapiens
catactatgactactttctacatgaaaatataaagaaatagggcaagagagaaaacgcattcaaaatatagtcaccaaaagtgactggtttttgtcttcartttttaagtgtttgttttcatttctgatccacttaattctgttgttttaggaatattattttagcatttgcgggtaccctgaggcatggtctcattccta

SEQ ID NO: 19828 - DNA, 201 bp, Homo sapiens
tgccataaattataaacacttaaaatcttaatggcttttcacaaataaaatttatttcttgcttgtagtcgtagacgcatgctcagtaagcagccttctayatactgattcagggaagcaggtttcttccagcttgaggatctgtcagtttccatggcttctggggcctctccaggaggcaagcagagagggaaagagagc

SEQ ID NO: 19829 - DNA, 201 bp, Homo sapiens
tacttctcaggtacgatataaaacaaataaaaactaaaaaattaagttgataaacaaatacaaatagaagtgtgatatttgctcctagcatcccaagggartgttttgcctattccatacttgtaaaaaataggactgtattcagatttgcagataggttttttggggttcattttaaactgattggggatgtcttccttt

SEQ ID NO: 19830 - DNA, 201 bp, Homo sapiens
accaggcatttatgtgtgttttttatggctagctgattcttcatgtttctattttttccaactcttgacattctgtgtttttttaaatcaaatttattttrctattctcttttctatattttcccccaattttaaaaaataaacccaatcttgtaattatcaagaggtcatgtaagggtccctataaattataaaacaaaa

SEQ ID NO: 19831 - DNA, 201 bp, Homo sapiens
atttcaatcattttgcagtgatatggtttactgtggaatttatgacaatgcattagacaatgacaactacaatcttgctaaaggtttcaattatcaccaasgacctgtaagaatttcatttatcttctgagtttcagtttaaattatttttcaagtaatttttaggtatttatggttttttttgtcttttaaataatcttt

SEQ ID NO: 19832 - DNA, 201 bp, Homo sapiens
caaacaggatcagccattgtttgaagtcatacaggaagcaatgcaaaaacacatgcagggcatacagttccgagaaaggaatgctggtccccagatagatygaaacatgaaggacgaaggtacagaactttaactaaaatagtacaaatttatcaaggtgatgaaattaaaccttgcaattgttcacttagtaaatatttg

SEQ ID NO: 19833 - DNA, 201 bp, Homo sapiens
tctatatcctcaccaatacttgtttttttctgtgtttgtttttttggattttgtttttgttgttttggtttttgtttttgttcgtttgtttttgttttttkttttttttgctagtagccatcctaaatggctatgaggtggtatctaatggttttgatttgcatttccttaatgatttcttagtgatgttgagcatctctt

SEQ ID NO: 19834 - DNA, 201 bp, Homo sapiens
tcaagtgcccagtttccagaatgtatcctacagatgattctgctcctttgcctgctggcacactggtaaagatatttcttaaaatgtttttttgttttttkttttttttctgaaaaatgacttttagtttctaatgtaaaaataagggtaattaagaatccaaatcttacgaattattcaaatgtcagtattgatttggca

SEQ ID NO: 19835 - DNA, 201 bp, Homo sapiens
acattttaatatttgttttttatttcagtcatcaaatatttataggtatatattatatacagttacaattttcaatgaatacatacttgttggtgaacaargtagatgaggtttctactcataggtcttatttcctactgggaagatatatgcattcaacagatagcaaacaagataattttcagatagcgttaagtgctt

SEQ ID NO: 19836 - DNA, 201 bp, Homo sapiens
aaatcaaggacataataataaatattaccatgttatatataatatttacattgttttctaacctgaaccattttcctccttccttcatcatctttcagttrtaataaatggaaatcgggtttatagattactagataaagttgcacatttagatttacctctaaaaacacacctagtctgtacacataccaaattaacttt

SEQ ID NO: 19837 - DNA, 201 bp, Homo sapiens
tgatgccaatataatttttaaggtagcatcattgaaataataaaatctgggaaattctaatgcttctaattgaagactagaaggattaagaaaaaaaaaawatatatatatatacctcattttgatacttcacttagttctaagtacctcctgttaaattttaacaattccttccaaagcatgctttattcttattatctc

SEQ ID NO: 19838 - DNA, 201 bp, Homo sapiens
attaatgccaaattgtattatagaaaaagtacatttagttgcttagagaagaaattcttagtttcactatagagcattctcttagtgtcttttactgaaawcttttgttcacagaaaatatccctgttagtatatcctcttttattactttgttggatgtttaataagtcaaggattataaattataaataatatatatta

SEQ ID NO: 19839 - DNA, 201 bp, Homo sapiens
gctcacacacttggcggactgaggcaggaggatcacttcagcccaggagtttgagaccagcctggatatcataatgaagccccaccaccatatttgaaaaraaaagaaaagaaaatgatatttgtatagcacaataggttacatggagtaggctgcttgtgctagatccaactacttcagttagccccaggccccacccag

SEQ ID NO: 19840 - DNA, 201 bp, Homo sapiens
aagaactttatcttaaatttatatagtttttagtttctcaaaacatgctacatacctagtaaaattcatgcaattctaaatagataaataaatttagtctwaatgaagtcagtgatgccaatataatttttaaggtagcatcattgaaataataaaatctgggaaattctaatgcttctaattgaagactagaaggattaa

SEQ ID NO: 19841 - DNA, 201 bp, Homo sapiens
tttatcattgtgattaagaaacaggctttaaaaccagatttcctgggttacattgactagttttataacctgaagtaaatgctctatggcttacttttccmctgcaaaatggtacctaccacagggattatggttaggattaatgaattaatacatgtgaacagctcattagacgacacctaattcatactaagtaattgg

SEQ ID NO: 19842 - DNA, 201 bp, Homo sapiens
tcttaatctgagaaaaatcctggtttcttgaataaacaagctgaggggcagtgcaaccttagagaagagaaaggaagggacttggagagaaatatgaaggyagagagcatgtgatttcctaggcaattaactttgactttttattcctttagtcatcctctgataagtatttttagtatacaataactagcataaaaagtt

SEQ ID NO: 19843 - DNA, 201 bp, Homo sapiens
tcagttgagcccaggaggtctaggctgcaatgagccatgattgtgccactgctctccagcctgggcaacagagcaagaccctgtctctagaaaaaaaaaaagagatctttgagaatttataatagacataattatagcacctttcttacagattacttgagtaaaacacaatagtttttgacacatagtgattgataagtg

SEQ ID NO: 19844 - DNA, 201 bp, Homo sapiens
catctggctccttactttgtaagtgacataaagcataggttgggcaactagagtgcagtaaaagcctttgcatatctttacttagagtcttttttaaaaatatctttgcaaagtaacatcaatgcctcaattatgtatttattttttttctttgagatggagtcttgttctgtcacccaggctggagtgcagtggcacgat

SEQ ID NO: 19845 - DNA, 201 bp, Homo sapiens
aaagcaatcttgaaaaagaactcctgaggttagaatatttggtagcaccggggaggaaaacgggttccactaaagtccttaaagtgtttaaaaaaaaaaaaggtacatgtatacatgtataacaaacctgcaagttgtgcacatgtaccctagaacttaaagtataataaaatatatatataaaaaaataaaaaaagaata

SEQ ID NO: 19846 - DNA, 201 bp, Homo sapiens
ctgcactcctgcactcctgggtgatggagaaagacctttctcaaaaataaatggatgaatgagagcagcattggtatttactcttttttttttttttttttgagacagggtctcattctgtcacccaggctgtagtgcagtggcacaatctcagttcattgcaacctccacttattggggtcaagcagccctcccacctta

SEQ ID NO: 19847 - DNA, 201 bp, Homo sapiens
gtttaacccagtttaccttacaaatgttatcttgtgtgtatgctacaatgtagaaaagtttggaaaccactgatttgcatatgtaaagaacaagaattctrgttggtacaaacatttaaaagatacaatctgctgtttcataaaacagttctccaagtaaccatagaaactatgaagatatttaaaagctcatagatctgg

SEQ ID NO: 19848 - DNA, 201 bp, Homo sapiens
accggtaaatgtatccaaatgttataaatgagaatgtgccacctttttttgcagtaatggtgtgatcattttgttttagaagataatttgaagccgggtgyggtggctcacgcctgtaatcctagcactttgggaggccgaggcgggcggatcacgaggtcaggagatcgagactatcctggctaacatagtgaaaccccg

SEQ ID NO: 19849 - DNA, 201 bp, Homo sapiens
gcttgactcacaaactagctctggggagggaggctgatatggagagaacaaagcacagatgacaatgattttctaaattgagccagaactaaatgggaaaraaagatacacattcaagaggatatgtgttcacataaaatggcagtcatgtaaaatgaaattacctgagcatctattatagaagcacaagaaaatacagtt

SEQ ID NO: 19850 - DNA, 201 bp, Homo sapiens
ggagagaacaaagcacagatgacaatgattttctaaattgagccagaactaaatgggaaagaaagatacacattcaagaggatatgtgttcacataaaatrgcagtcatgtaaaatgaaattacctgagcatctattatagaagcacaagaaaatacagtttcagctgtattcaggtgtggtcagttatacagtcttactg

SEQ ID NO: 19851 - DNA, 201 bp, Homo sapiens
ttcagacttgaacaaggtcagtagcaagttgttttgatttgctcatttgcgtcttttaaacttttaattcattggcagtcctgttaaatgttttaaagctytaagataaatattatttccaagggtctaaaacttgatttgtgcaaagatggtgctgtgttctccatatatcactaattaatgttgatttgaattaaaaat

SEQ ID NO: 19852 - DNA, 201 bp, Homo sapiens
tctttttcaaacatttcttggcagtgttcttttttttttttttttttgagacagagtttcactcttgtcgcctaggctaaagtgcagtggtgtaatctccrctcaccacaacctccgcttcctgggttcaagcgattctcctgcctcagcctcccgagtagctgggattacaggcatgtgccaccacacccagctaattct

SEQ ID NO: 19853 - DNA, 201 bp, Homo sapiens
attttgtttttttgttcgtgtttttataagtcatttcaaagtctctttagaataagccagacacaaattaattagttaatataaaatcaagttcaatggargcaatcctgtaccagttcttaattttattacaaacaagttccagaaaaagagtgaaaatttccccaaaaaccatttatttcctttttaatttttaagtta

SEQ ID NO: 19854 - DNA, 201 bp, Homo sapiens
aaacaagttccagaaaaagagtgaaaatttccccaaaaaccatttatttcctttttaatttttaagttattatctaaggaatatggttgatgaaaagggaraaaaagtattaaacctgtgtgcttcttttagagaattcaaagaaagtcaggttgttaataagacttcaggaagcaaactttgaaagcaatcttgaaaaag

SEQ ID NO: 19855 - DNA, 201 bp, Homo sapiens
agagtgaaaatttccccaaaaaccatttatttcctttttaatttttaagttattatctaaggaatatggttgatgaaaagggaaaaaaagtattaaacctktgtgcttcttttagagaattcaaagaaagtcaggttgttaataagacttcaggaagcaaactttgaaagcaatcttgaaaaagaactcctgaggttagaa

SEQ ID NO: 19856 - DNA, 201 bp, Homo sapiens
tattatctaaggaatatggttgatgaaaagggaaaaaaagtattaaacctgtgtgcttcttttagagaattcaaagaaagtcaggttgttaataagacttyaggaagcaaactttgaaagcaatcttgaaaaagaactcctgaggttagaatatttggtagcaccggggaggaaaacgggttccactaaagtccttaaagt

SEQ ID NO: 19857 - DNA, 201 bp, Homo sapiens
cttccttgagatgcaaatagaatattctttgatttctaggaggtaattttatggtccattgcagagctaaagtatcaagtaaatgtattttaagtaacatmttaaaatgtagtaatttcatgcaacctgattataggttgctgtttatttgcgtgcccttgttattactgataggttttagtatacttatatttcattaaa

SEQ ID NO: 19858 - DNA, 201 bp, Homo sapiens
atcaaaaaaaaagtacaaaaaattagatgggcatggtggcacatgcctgtagtcttggctactcctgaagctgaggtgggaggatcgcttgagcccagcasgcagtggttacactgagtccagatcccaccactgcactctactgggtgatagagtgagaccctatctcaaaaaaaaagaaatttttggcaacttatattt

SEQ ID NO: 19859 - DNA, 201 bp, Homo sapiens
caatagttattttcgatattttaactcctttttgtttcataggggtaactcattcgactgtggagttcttttaattcttatgaaagatttcaaatcctctrgaagccaaaatgggacacagtaaacagattcgaattttacttctgaacgaaatggagaaactggaaaagaccctcttcagacttgaacaaggtcagtagc

SEQ ID NO: 19860 - DNA, 201 bp, Homo sapiens
gcccaactttacagggaaaagcagttaccgtgtatacaaattacccatttcctggagaaacatttaatagagaaaaattccgttctctggattgggaaaayccaacagaaagagaagatgattctgataaatactgtaaacttaatctgcaacaatctggttcatttcagtattatttccttcaagggtaagtcaggtgtt

SEQ ID NO: 19861 - DNA, 201 bp, Homo sapiens
atctcataccactttagatataatttaaccaatatatcatttatggcagaaatgatcaaagcaatttaaaaaccagtgtttccttgaagtaattgttttcrttttatttcttgaaccattgaaagcaatctcttttctgaacaggttcagaagtttacctaaggagagaacttatttgctggggagacagtgttaaattac

SEQ ID NO: 19862 - DNA, 201 bp, Homo sapiens
ccgtactgtcttccacagtggctgtgccattttacactcttactaatagtaaacaggcttccattcatctatatcctcaccaatacttgtttttttctgtktttgtttttttggattttgtttttgttgttttggtttttgtttttgttcgtttgtttttgttttttgttttttttgctagtagccatcctaaatggctat

SEQ ID NO: 19863 - DNA, 201 bp, Homo sapiens
tgtgttttttttgttaggcttacctcatttttcttctggtattttccgctgctggggaagggatacttttattgcacttagaggtatactgctgattactrgacgctatgtagaagccaggtaggagagcctctaaagtgttgtactgcgagtttatgtctgaatgtcttttacatgctcttcaaactttccttcttgtcc

SEQ ID NO: 19864 - DNA, 201 bp, Homo sapiens
taacacatgattaaagtcctgtgaactcagtatgtactaatttaaggttagatggatgatgtactaatgccgagcttattctgtagaagacaaaataattrattatttctcttacctttgttattgaaatttttctaatgctttttacataatatctgatcatcttttatttaacttaaatttcaatcattttgcagtgat

SEQ ID NO: 19865 - DNA, 201 bp, Homo sapiens; identical to SEQ ID NO: 2752

SEQ ID NO: 19866 - DNA, 201 bp, Homo sapiens
taattataaaattatgcaaatgtataaaaagcattttttctgtgttttttttttaattaggattatactatctaaacaattttgtaacctgcctttttccygtttgtagtagtattatggtgtatgtactctacctccctgcctactgccatgtttcagccatacttttttccagaagatattttaaaagctctacataaa

SEQ ID NO: 19867 - DNA, 201 bp, Homo sapiens
gttgttgtcagtttatttcatttcaataaatgaggctgtgataaatatccttatacataatctctgtttacatcactgatacttttctcaaaaaatctatrtaaaattcctagatcaaaaaatataaacattcttaatatattaatgccaaattgtattatagaaaaagtacatttagttgcttagagaagaaattcttag

SEQ ID NO: 19868 - DNA, 201 bp, Homo sapiens
ctcatcagttattattgcccattattaattgaaagttatattcgtgtttaaaatttatatgtattatatttctaatagacttgaccatagtcagtattttygtattctaataattataaagaaggtttaaagtctgctttaaaccaaccaaaatgtttctttcacagtacagttttaactgtaatgtgcttatttgttttc

SEQ ID NO: 19869 - DNA, 201 bp, Homo sapiens
ctaaggtatgtttttttaaaaataacctaacttgggcaaaagtagaaatgcattggctctcaggattacaagacagctttagtaactaaaccatgaagcayagggatataggcagtagtgtgttggaggtgcttttgctggctcacaagagctgattgtgcacatcccttcccacttccacgttcaatgttgtcgtgttgg

SEQ ID NO: 19870 - DNA, 201 bp, Homo sapiens
agaaatgcattggctctcaggattacaagacagctttagtaactaaaccatgaagcacagggatataggcagtagtgtgttggaggtgcttttgctggctyacaagagctgattgtgcacatcccttcccacttccacgttcaatgttgtcgtgttggtagcttaagattgcccatgtcgggattatttccaccagaaagt

SEQ ID NO: 19871 - DNA, 201 bp, Homo sapiens
tttaagtaacatgacaaactctcatgccatcctgctctatcccacctggaatgtgactcatccttttgtccagtgcatccatgctgtaaatactacctgtmcaccagttacttaatagcctgctcagttatcagataaaaaaacacaaaatatcaaaatatatatatatatagggtttcatactatctatagttttacaca

SEQ ID NO: 19872 - DNA, 201 bp, Homo sapiens
ttgggtatgatatgatatatattactgtgttcatattgcatcacaggaatttgtctcttgccatacctaccttaaaggagacctgcagcgtagtcttgagwttgtcagctatgtgtaaagttgaaccttgggaattttattactaaagaaagaaagggaggataaaactgagtacagcagcagtctctaccacagactgta

SEQ ID NO: 19873 - DNA, 201 bp, Homo sapiens
aaagttgaaccttgggaattttattactaaagaaagaaagggaggataaaactgagtacagcagcagtctctaccacagactgtatttctgagacatttgrgagattctgtgcaatgtaaaagaagtaaaccttgccacagccttacttgaaaagtgttgcaaatcgtaatatcctttctgtgaaacaagttttcttttat

SEQ ID NO: 19874 - DNA, 201 bp, Homo sapiens
cttggtgattgaaccaagacctgctccattatcttacacaaatgcctctgttatggaagctgtatcacaggtgctccactcctggtaggtgtggccaagarggagacattctctcctcccaactcccagcctggggttatagtttcatgctaagaggcacagtctatgagtgtttttaattctccctgccggccctgtctt

SEQ ID NO: 19875 - DNA, 201 bp, Homo sapiens
gaaaaataccttgaatttcagtgattgtgttgatgaatctcggaggaactacttaatgcaagttttgagaattaccaatttaacttttattacaacttctytgctccttacatagcctttcttcatctgagtgcttattatgggtatgaataaatactaagtaaataaatgacttactaaataaatgactgaaactggaaa

SEQ ID NO: 19876 - DNA, 201 bp, Homo sapiens
gattctaaaattatataagggtgctcagctgagtaaatgaagcacaaacaattcatttcagcagcagagcaatgtggttaagattgcatattctgaagagrgacttggccaagttaattcctgactgtatgacttgggctgagttacttaactctctgtgcttcagtttctcttttgttaagggaacataacagtatgtcc

SEQ ID NO: 19877 - DNA, 201 bp, Homo sapiens
ccaccacacccagctaatttttgtatttttagtagagacggggtttcaccatgttggccaggatggtctcgatctcttgacctcgtgatctgcctgcctcrgcctcccaaagtactgggattacaggcgtgagccaccgcgcccagccttttaagttacatttctttgcttattaatgaagtatatttttacaccttgatt

SEQ ID NO: 19878 - DNA, 201 bp, Homo sapiens
cttcaggaagcaaactttgaaagcaatcttgaaaaagaactcctgaggttagaatatttggtagcaccggggaggaaaacgggttccactaaagtccttamagtgtttaaaaaaaaaaaaggtacatgtatacatgtataacaaacctgcaagttgtgcacatgtaccctagaacttaaagtataataaaatatatatata

SEQ ID NO: 19879 - DNA, 201 bp, Homo sapiens
aagtaacatcaatgcctcaattatgtatttattttttttctttgagatggagtcttgttctgtcacccaggctggagtgcagtggcacgatctcagctcaytgcaacctccgcctccagggttcaagcgattctcctgcctcagcctcccaagtagccaggactacagaggtgcaccaccatgcccagctaatttttgtag

SEQ ID NO: 19880 - DNA, 201 bp, Homo sapiens
atcctcttcgaaactttgctgaaccgggtatgtaatttttaacttctctgtggatggggaaagaatagttcatggcaaggtcaaaataaaatctgctttaytgattttcttccccattagtctattggtttttaaatatttcaccataaaggtaccagagatacatacaatttgagaaagaaaacatggagccaacaaaaa

SEQ ID NO: 19881 - DNA, 201 bp, Homo sapiens
acattgacataagagatattttcactcattggccagaggtattaagaatttcagtggcaattaaaccagaacctaatggttttaggtcccccctcactctyagtgtcttgtgtttctatagctatttcattaccaggaagaatgttgcaggagcccattgatatatttattttttaacatttcgaaactaggagtctatat

SEQ ID NO: 19882 - DNA, 201 bp, Homo sapiens
gtggcaattaaaccagaacctaatggttttaggtcccccctcactcttagtgtcttgtgtttctatagctatttcattaccaggaagaatgttgcaggagyccattgatatatttattttttaacatttcgaaactaggagtctatattagtgacattaaaatttattcagaaatcttaatgcttttttttaagagtataa

SEQ ID NO: 19883 - DNA, 201 bp, Homo sapiens
aggtcccccctcactcttagtgtcttgtgtttctatagctatttcattaccaggaagaatgttgcaggagcccattgatatatttattttttaacatttcraaactaggagtctatattagtgacattaaaatttattcagaaatcttaatgcttttttttaagagtataaatttgggtgtaagtatctctgccctctttt

SEQ ID NO: 19884 - DNA, 201 bp, Homo sapiens
ggagtctatattagtgacattaaaatttattcagaaatcttaatgcttttttttaagagtataaatttgggtgtaagtatctctgccctcttttttctagycattctaaacgaaatcaagccattctgctgtatgccatggatctaatacaacctgttgccgaaaataagtaggagggtggagatggagttttaaatgttt

SEQ ID NO: 19885 - DNA, 201 bp, Homo sapiens
taaatttgggtgtaagtatctctgccctcttttttctagccattctaaacgaaatcaagccattctgctgtatgccatggatctaatacaacctgttgccraaaataagtaggagggtggagatggagttttaaatgtttttggtagaactatggttttaaaaggcctatgatattaacatttctgttttcccttatgatg

SEQ ID NO: 19886 - DNA, 201 bp, Homo sapiens
aatttttagaagagactgtaagctagagttttttcagaatagctatgagaaataaataattattaattttttaaaacattatctcataccactttagatawaatttaaccaatatatcatttatggcagaaatgatcaaagcaatttaaaaaccagtgtttccttgaagtaattgttttcattttatttcttgaaccattg

SEQ ID NO: 19887 - DNA, 201 bp, Homo sapiens
accagtgtcacttaggtgttctttggaaatgtgtgcttacctaaaaaatgtctatttctataatattaaagcagtattataatatatatttcaagtcctakgatgaaaaattgatttgatttggagggatttagtgaatattagttaagctggtagaacattgtttagttccaaaaaatgacggctttattttattgtgct

SEQ ID NO: 19888 - DNA, 201 bp, Homo sapiens
ttcttctcttgataaattctcttgtttctatgtgttttggtatgtttgatatcttgctgcatatttttctatgtcaaatcatgcctccttttgtctctttscttcctcctatcttgcttttctctttctgttacatttatttgttacatttgtcactgtgctttttacagtacatgttggatgctgctaggaatttgcaac

SEQ ID NO: 19889 - DNA, 201 bp, Homo sapiens
gcgtatgatgctcttccaagtactacaattgtttctatggcatgttgtgctagtggaagtacaagaggctatgatgaattagtgcctcatcaggtttgttyatatgttgtttcttaaaacctacatggccaacaactttgggcatttttattaaaaaaaattcattgtaattaagatgtatccatgctaaattttaccttt

SEQ ID NO: 19890 - DNA, 201 bp, Homo sapiens
acagaggctttattgtatttgtaaagtttaagtgaggaagtagaacttgggtttttaatttttttttgtatccgaaatattccaagttttaaaaaaatgtmagcctttcaagtgatttgcttttctctgctcaaaattaggaagttgttccctagagctaagctattattttgatacgtttctacttcaaaaaaagctttg

SEQ ID NO: 19891 - DNA, 201 bp, Homo sapiens
gatttgccaccttaataagtaagttaccactagactgaattaagcagttttaagggtcctctatatccttgctactcaaagtacggtccaaggaccagcartgtcagcatcacctgttgttaacattttaccctattgttttataatttgtgtgtgtacctgcatgtgtattctctctatagatatagatacacacatgcc

SEQ ID NO: 19892 - DNA, 201 bp, Homo sapiens
catcattttttaaaaatgtcaacatattattctactttatggctttaccataatttatttaaacaatttccatttttggacatctagattgcttctaattrttccctattatttatgtctttgtacattcatctttacatgaatccttagttattccctttctagatgtttctgcatactacagaagaatataggttttga

SEQ ID NO: 19893 - DNA, 201 bp, Homo sapiens
tatccatatatttgaggctgttaatacatactgccaaattttctccagaaagattataataattaatactttcagctctatccaagagtttccatcattascaatactgagtatatattattataacgtagtgtttaagggcatggagtatagaaccagactaactggatttgaattccattgcagactcttattagctat

SEQ ID NO: 19894 - DNA, 201 bp, Homo sapiens
tgttaatacatactgccaaattttctccagaaagattataataattaatactttcagctctatccaagagtttccatcattagcaatactgagtatatatyattataacgtagtgtttaagggcatggagtatagaaccagactaactggatttgaattccattgcagactcttattagctataagaagtaagacctggct

SEQ ID NO: 19895 - DNA, 201 bp, Homo sapiens
ctttcagctctatccaagagtttccatcattagcaatactgagtatatattattataacgtagtgtttaagggcatggagtatagaaccagactaactggrtttgaattccattgcagactcttattagctataagaagtaagacctggctgagtgcagtggctcactcctataatctcagcactttggtaggccaaggtg

SEQ ID NO: 19896 - DNA, 201 bp, Homo sapiens
tttaccgatgtgaatcagaagaaaaggaagatggtggagggtgctatgacataccaaactggtcagcccttaaatatgcaggtcttcaaggtaagcaaatrgaaggatagctgagctttgtgtttttcttttagggtcatctggtgtcttctttacagacatagatataggctcagagtatgcctacttgggttgcaatta

SEQ ID NO: 19897 - DNA, 201 bp, Homo sapiens
atttttaaaagatgtatgtatgttatcagatttgagtaattatctacttcattttcactctgagttgttaaactacttctagttcactacaaagaccaaayttgtgtgtgctctttttctagcctttgtctttcttatagttaagtttggttctttgctaattctccttatctttctaatgaaatgattcttcttatcttt

SEQ ID NO: 19898 - DNA, 201 bp, Homo sapiens
tccagcaggctgctaataagagcctcagattaaatcagatttaactactttgttgacctgtctttcccttaaacaaaatgtatttccctccttataatacrgtatatctagtcatgttggaatccaggaatccattttggatctgctcctttcatcctcagtatccaatcagtcattatgatttgtggattcttttccatg

SEQ ID NO: 19899 - DNA, 201 bp, Homo sapiens
catcagatctgtttctaaaacactgttttccttatgtccttccattattcaacagtgagaccaacatttaccgagcattatctgctgtccatgaaaatgcyagggcatatgtagaatattattttatagtcttgtttcccaacatctttatgttttaagctttcttccccagagaagattgtgagccccttgagggaaaga

SEQ ID NO: 19900 - DNA, 201 bp, Homo sapiens
tattttatagtcttgtttcccaacatctttatgttttaagctttcttccccagagaagattgtgagccccttgagggaaagaactttatcttaaatttatrtagtttttagtttctcaaaacatgctacatacctagtaaaattcatgcaattctaaatagataaataaatttagtctaaatgaagtcagtgatgccaata

SEQ ID NO: 19901 - DNA, 201 bp, Homo sapiens
ataataaatggaaatcgggtttatagattactagataaagttgcacatttagatttacctctaaaaacacacctagtctgtacacataccaaattaacttwcaaatttattttaattacaggttggtaaatggttgcaggctatgttcttctacctgaagcagatcccacgttaccttatcccatgttactttgatgctat

SEQ ID NO: 19902 - DNA, 201 bp, Homo sapiens
attttaaataagtatatgtatatatgtattttttaactattgacatttttcagtccatccgaaaaataatttgggaggatatttttccaaagcttaaactytgggaatttttccaagtagatgtcaacaaagcggttgagcaatttagaagacttcttacacaaggtaaaggatacatactagaatgttcctatcgatttt

SEQ ID NO: 19903 - DNA, 201 bp, Homo sapiens
ggcagatcgcttgagctcaggagtttgagaccatcctgggcaacatgaaaacccatgtctacaagaaatacaaaaattagtagggtgtggttatgtgagcytgtagtcccagctacttgagaggctgaggtgggaggatggcttgagcccaggaagcggaggttgcggtgagccaagttcatactactgcactccagcttg

SEQ ID NO: 19904 - DNA, 201 bp, Homo sapiens
agataagaaagcagcatagctgttgcctttattgtgcatgtctttttcctcactgtgactgagcaagttgcatttctgtgagcaattttgcaatctttacwtgtctttttctagaatagtgctgtccaaaataatgtgaaccacatacataattttaaattttatagtacccacattttaaaaagtaaaaagaagcaggtg

SEQ ID NO: 19905 - DNA, 201 bp, Homo sapiens
ctgatctgcctttatgttaatagtttgttatatatgattgggggggctgggaggggatagtagctttgtaagctactccagggttagcatatatttgtgtyctcatgatatttatttatatcatgaagtactcaacatttgtccaaaatttttttatttgtcctctgttatcaactgacatttctgttacaatgaatatag

SEQ ID NO: 19906 - DNA, 201 bp, Homo sapiens
catttctgatccacttaattctgttgttttaggaatattattttagcatttgcgggtaccctgaggcatggtctcattcctaatctactgggtgaaggaawttatgccagatacaattgtcgggatgctgtgtggtggtggctgcagtgtatccaggattactgtaaaatggttccaaatggtctagacattctcaagtgc

SEQ ID NO: 19907 - DNA, 201 bp, Homo sapiens
atttgcaggtgcctgccttgtaccccaggtttagagtaactgttctatagtaatggagttcataggtttgtgtgtattattatgattaacatattactttrttgtgttttttttgttaggcttacctcatttttcttctggtattttccgctgctggggaagggatacttttattgcacttagaggtatactgctgattac

SEQ ID NO: 19908 - DNA, 201 bp, Homo sapiens
tttgtatgttcacttaataggatcataaaatttcaaaggggtgaaaatctttgaagtcactaagttctagtccttcatattacaagtcaggttatctttarcattagctaatttatttcaacaaaactaaaaatgttataacctttttatgccttccatagtgaaggcattgctagttctttgtctgagtcttgtagaagt

SEQ ID NO: 19909 - DNA, 201 bp, Homo sapiens
ttcaacctttgtgaaacacctttcattgggttcagttcaactgtgtggagtaggaaaattcccttccctgccaattctttcacctgccctaatggatgtaycttataggttaaatgagatcacaaaagaaaaggagcaatgttgtgtttctctagctgcaggtaaggaattatgtacaaggttaaaatatgtaaatcgata

SEQ ID NO: 19910 - DNA, 201 bp, Homo sapiens
ggaagcagatgtcaaggtatatccaacaaagcttgaataaatgggcatatctgtgttgaaactatatacagagtcacttcatacatgttcttaaaaaaccmaaccataaagaattgtcatagaactgaaaaggcttgtaggtggatagtaaatttattagcatcctttagtctgtgtagcatacaaaaacaaacttgaata

SEQ ID NO: 19911 - DNA, 201 bp, Homo sapiens
acagcatgacatgtctctgaattttcaggtttaatgtctgtattggcagaaataagaccaaagaatgacttggggcatcctttttgtaataatttgagatstggagattggatgattgactatgtcagtaaccggcttatttcacgatcaggaactattgctgaagtaagtagagctatattatcgtcccaaaaaatcaag

SEQ ID NO: 19912 - DNA, 201 bp, Homo sapiens
tgtgcctctaatacgtattcaccccaaatcactagaatagagactagcagaatagggactagaggatataggaacaaattgatgctaccaataatacagcrtgacatgtctctgaattttcaggtttaatgtctgtattggcagaaataagaccaaagaatgacttggggcatcctttttgtaataatttgagatctggag

SEQ ID NO: 19913 - DNA, 201 bp, Homo sapiens
aatgtttatttgaatgctgagttcctaaaacatacactgctaagacattttatgattgtaattcagattttcttcttttgtttctattgacaacaagcgawacttcaatatatggttatctttattttccaattcttagtcttgcctccagattaactttggctgagctaaatcagatcctttaccgatgtgaatcagaag

SEQ ID NO: 19914 - DNA, 201 bp, Homo sapiens
tggctgagctaaatcagatcctttaccgatgtgaatcagaagaaaaggaagatggtggagggtgctatgacataccaaactggtcagcccttaaatatgcmggtcttcaaggtaagcaaatagaaggatagctgagctttgtgtttttcttttagggtcatctggtgtcttctttacagacatagatataggctcagagta

SEQ ID NO: 19915 - DNA, 201 bp, Homo sapiens
ctgttgacaatgcagatcctatattaaaaattccttttgcttcgtaagtatgccttgtttggtagagatttgccaccttaataagtaagttaccactagaytgaattaagcagttttaagggtcctctatatccttgctactcaaagtacggtccaaggaccagcagtgtcagcatcacctgttgttaacattttacccta

SEQ ID NO: 19916 - DNA, 201 bp, Homo sapiens
tatatctgcatttctccatctgctctagcaaggggccagcagcaattgaagaatgctgtaattggtttcataaaagaatggaggaattaaattcagagaakcatcgactcattaactatcatcaggaacaggttttacttatttttgaactgctgcttttccttgcatcttactactatttttttgttgtcttgaggatgg

SEQ ID NO: 19917 - DNA, 201 bp, Homo sapiens
tatttcacctctaaacttaacatagatacagtttcaatttaattatgagatactcctttgtgtctcctttttccttcagctgctaatagtaaatggatccrggaacatccagaatgtgcctataatcttgtgaattctccacacttaaaacctgcctgggtcttagacagagcactttggcgtttctcctgtgatgttgca

SEQ ID NO: 19918 - DNA, 201 bp, Homo sapiens
aaggaatggaatgttatttgtattactgatgttgtctacaatcatactggtatgagcttcattgactgccttcattaattttgatgagaatttatgcacayacacatatacacacaaataagagaaaggaagaaagaaagagaaaggaaaggggctaacataaattttaaaaacacaaatgatgattaggtgtccttccgt

SEQ ID NO: 19919 - DNA, 201 bp, Homo sapiens
agataccagaatattttacattttttatattaaccagtatttgttaatcatttttaacacatgattaaagtcctgtgaactcagtatgtactaatttaagkttagatggatgatgtactaatgccgagcttattctgtagaagacaaaataattgattatttctcttacctttgttattgaaatttttctaatgcttttta

SEQ ID NO: 19920 - DNA, 201 bp, Homo sapiens
gattcattacaattgtttaccgaatgccctttaaatagtacttaaaggacgccaacttaaagaataaaaatacgttttttaattttagagatgggtctgcygtggaaattgtgggcctgagtaaatctgctgttcgctggttgctggaattatccaaaaaaaatattttcccttatcatgaagtcacagtaaaaagacatg

SEQ ID NO: 19921 - DNA, 201 bp, Homo sapiens
ctaataaaacatattgataagaatattgttttatattgtttctatgtattcactgacttattgagttaattgataaagtttctgaaatctacatgtacaawttttctaatttttcatcaattaggagaaaaaattccactattactatgaatgaaatttgcctttaatgatgaatttccctaaaatgaaaccacaaattta

SEQ ID NO: 19922 - DNA, 201 bp, Homo sapiens
tatgcctttgtaacttggctcaagccagtattgtcatacttatctccaactgtattaagcagtgttgtggactgggtagcccttgtgtgtgcctctaataygtattcaccccaaatcactagaatagagactagcagaatagggactagaggatataggaacaaattgatgctaccaataatacagcatgacatgtctctg

SEQ ID NO: 19923 - DNA, 201 bp, Homo sapiens
ctgcatttctccatctgctctagcaaggggccagcagcaattgaagaatgctgtaattggtttcataaaagaatggaggaattaaattcagagaagcatcractcattaactatcatcaggaacaggttttacttatttttgaactgctgcttttccttgcatcttactactatttttttgttgtcttgaggatggtgatg

SEQ ID NO: 19924 - DNA, 201 bp, Homo sapiens
gtagtcctagctactcaggaggctaaggcaggagtatcacttgagcccaggagatcaaggctgtagtgagctatgatggcaccactgcactccagcctgcytgacagaatgagacactgtattaaaacacacacacacacacgcacacacacaccaaaactcacaattaaagctgactcttgtgaccagctctccaaaaaa

SEQ ID NO: 19925 - DNA, 201 bp, Homo sapiens; identical to SEQ ID NO: 2753

SEQ ID NO: 19926 - DNA, 201 bp, Homo sapiens
gtttttatcatttcaaatgctaaatacatcatcataagctattaaaatcacttttaatattactatcacccaaataacgtactttgtacccattaagtaatgtctattaaaatagcttctgatactgtattaagctgagaagttattttcttattctaatttttttttttgaaagagagagcctcactctgttgcccagcc

SEQ ID NO: 19927 - DNA, 201 bp, Homo sapiens
agtttttatcatttcaaatgctaaatacatcatcataagctattaaaatcacttttaatattactatcacccaaataacgtactttgtacccattaagtaatgtctattaaaatagcttctgatactgtattaagctgagaagttattttcttattctaatttttttttttgaaagagagagcctcactctgttgcccagc

SEQ ID NO: 19928 - DNA, 201 bp, Homo sapiens
gtctaagaattttatagttttaactcttgtgtttaggtctttgatccatattgagttaatttttgcatatgatattaagtccaagtccattttttttttttgcatgtgaatatccagtttactcagctccatttgccaaaaaaaatataaactgtcccttccccaatgaatggtcttggcacccttgtcaaaaaaaatttg

SEQ ID NO: 19929 - DNA, 201 bp, Homo sapiens
tattttctcccatattgtgggttgtctattcactatcttaaaagtatcctttgataaacaaaagtttctgattttgattaagtccaatttatctacttttrttacctgtgcctattgtatcatatgcaaaaaagcctcatcaaattcaatgtcatgaagcttttgccatacatttttgtctaagaattttatagttttaac

SEQ ID NO: 19930 - DNA, 201 bp, Homo sapiens
agtaaacaggcttccattcatctatatcctcaccaatacttgtttttttctgtgtttgtttttttggattttgtttttgttgttttggtttttgtttttgktcgtttgtttttgttttttgttttttttgctagtagccatcctaaatggctatgaggtggtatctaatggttttgatttgcatttccttaatgatttctt

SEQ ID NO: 19931 - DNA, 201 bp, Homo sapiens
ggtttttgattttttggttattgacttgtagaagtttcttatatattctggatattaaccccttatcatacatatgagaatttcatttctttttaaggctraataatattccattgtatgtatataccacattttgtgtttccattcatttgtcaatggacatttgggttttttccaccttttggctattgggaataatgc

SEQ ID NO: 19932 - DNA, 201 bp, Homo sapiens
tgtgattttgactactttagatacttcatatgagtgaaatcatgcagtatttgttcttttgtgactgattttttccacttagcataatgccaaggttcatycatctcatagcatgtgacaggattcccttctttttcaaggctgcataatattccattgtatgcatacattttctttattcattcattgtcagtgggcatt

SEQ ID NO: 19933 - DNA, 201 bp, Homo sapiens
acaatggttgaactagttaacagtccccccaacagtgtaaaagtgttcctatttctccacatcctctccagcacctgttgtttcctgactttttaatgatygccattctaactggtgtgagatggtatctcattgtggttttgatttgcatttctctgatggccagtgatgatgagcattttttcatgtgtctgttggctg

SEQ ID NO: 19934 - DNA, 201 bp, Homo sapiens
ccagtttccagaatgtatcctacagatgattctgctcctttgcctgctggcacactggtaaagatatttcttaaaatgtttttttgtttttttttttttttctgaaaaatgacttttagtttctaatgtaaaaataagggtaattaagaatccaaatcttacgaattattcaaatgtcagtattgatttggcacctgctgg

SEQ ID NO: 19935 - DNA, 201 bp, Homo sapiens
cccagtttccagaatgtatcctacagatgattctgctcctttgcctgctggcacactggtaaagatatttcttaaaatgtttttttgtttttttttttttttctgaaaaatgacttttagtttctaatgtaaaaataagggtaattaagaatccaaatcttacgaattattcaaatgtcagtattgatttggcacctgctg

SEQ ID NO: 19936 - DNA, 201 bp, Homo sapiens
gctggtctcaaactcctgacctcaggtgttccgcccgcctcggcctcccaaaatgctgagattacaggtgtgagccactatgcccagccagtttgttttcytatatgtttgttttactcttggtttctgctatttaaaataattaagttcttgtttaatagttacttcgattttgaaataccatagacttcaaaagtagaa

SEQ ID NO: 19937 - DNA, 201 bp, Homo sapiens
tctctctctctctctttctctctctctttctctctctctctctttccctccctccctccctccctctctccttccttccttcctttctttctttccttctttctttcttttctttcttttttttgagactgagtctcgctctgccatccaggctggagtgccgtggcgcaatctccgctcactgcaagctccgcctccctg

SEQ ID NO: 19938 - DNA, 201 bp, Homo sapiens
ctctctctctctctctttctctctctctttctctctctctctctttccctccctccctccctccctctctccttccttccttcctttctttctttccttctttctttcttttctttcttttttttgagactgagtctcgctctgccatccaggctggagtgccgtggcgcaatctccgctcactgcaagctccgcctccct

SEQ ID NO: 19939 - DNA, 201 bp, Homo sapiens
tctctctctctctctctttctctctctctttctctctctctctctttccctccctccctccctccctctctccttccttccttcctttctttctttccttctttctttcttttctttcttttttttgagactgagtctcgctctgccatccaggctggagtgccgtggcgcaatctccgctcactgcaagctccgcctccc

SEQ ID NO: 19940 - DNA, 201 bp, Homo sapiens
ttctctctctctctctctctttctctctctctttctctctctctctctttccctccctccctccctccctctctccttccttccttcctttctttctttccttctttctttcttttctttcttttttttgagactgagtctcgctctgccatccaggctggagtgccgtggcgcaatctccgctcactgcaagctccgcct

SEQ ID NO: 19941 - DNA, 201 bp, Homo sapiens
ctgtcttcaaccagtttttaaactggttgaattatgtttttcaaggtcagcttctaccagtttgttttctttctctctctctctctctctttctctctctytttctctctctctctctttccctccctccctccctccctctctccttccttccttcctttctttctttccttctttctttcttttctttcttttttttga

SEQ ID NO: 19942 - DNA, 201 bp, Homo sapiens
tctagacttaaaatggttttttttgtttttgttttttgttttttgtttttgagacagagtctcgcactgtcgtccgggctggagtgcagcggcacagtctyggctcactgcaacctccgactccgcctcccgggttgaagccattctgctgcctcagcctcctgagtagctgagattacaggcgcccgccaccacgcccag

SEQ ID NO: 19943 - DNA, 201 bp, Homo sapiens
tttcatagatattcactcataaaaataataaccatgcttactgtttaattataactgtgcaccaggcatttatgtgtgttttttatggctagctgattctycatgtttctattttttccaactcttgacattctgtgtttttttaaatcaaatttattttactattctcttttctatattttcccccaattttaaaaaata

SEQ ID NO: 19944 - DNA, 201 bp, Homo sapiens
tatatatttcaagtcctatgatgaaaaattgatttgatttggagggatttagtgaatattagttaagctggtagaacattgtttagttccaaaaaatgacrgctttattttattgtgcttttagcaatagcaaaaagaaatatgcttctaagattgttacatggcagaaaagaatgttcaaacttaatttacttaatttta

SEQ ID NO: 19945 - DNA, 201 bp, Homo sapiens
attaatgaagtatatttttacaccttgattagctatttatatttcttccattaattgcctgttaatgtttcttctcatttttctattgagttgtctctttktttatatcgacattattgattattacacaggcctcaaatatatcccctagtatgctcttgatcttttaactcttgtttatggtgacattttttttcaatg

SEQ ID NO: 19946 - DNA, 201 bp, Homo sapiens
ctagtgatattgaagccagatattgacgagataacaaaaggtaacgaagtgagtcttctattaaggacataactaatcaagcagttaatgtgccccccccccaacaaaatagggtaggaaaaaataggtgaaatgagaaagtagggtttgtaggagacaaattagaaaggattattaagagtctatctgcatttcatatag

SEQ ID NO: 19947 - DNA, 201 bp, Homo sapiens
gcaccactgcactcctgcactcctgggtgatggagaaagacctttctcaaaaataaatggatgaatgagagcagcattggtatttactctttttttttttkttttttgagacagggtctcattctgtcacccaggctgtagtgcagtggcacaatctcagttcattgcaacctccacttattggggtcaagcagccctccc

SEQ ID NO: 19948 - DNA, 201 bp, Homo sapiens
tctcactgtgttgcccaagctggtcttgaactcctgggctcaagtagtcctcttgccttggcctcccaaagtgctgggattacaggtgcaaaccactgcayctgatctcaatattaattttctgcttttaagttggataatacatgaagaaaggaatgagaagttcactgacataactaaaacagaatacaagtactatgg

SEQ ID NO: 19949 - DNA, 201 bp, Homo sapiens
ctctgtcacccagactggagtgcagtggcctgatctattttttgtagagacaaaagtctcactgtgttgcccaagctggtcttgaactcctgggctcaagyagtcctcttgccttggcctcccaaagtgctgggattacaggtgcaaaccactgcacctgatctcaatattaattttctgcttttaagttggataatacat

SEQ ID NO: 19950 - DNA, 201 bp, Homo sapiens
attttgtttcttattatttagtaatataagtagatagaaccatattaaaaaaaaattttttttttttgagacggagtatcaccctgtcacgtaggctgcartggtgcgatctcagctcactacaacctccacctcccgggttcaaacgattttcctgcctcagcctcctgagtagctgggattataggcacctgccaccat

SEQ ID NO: 19951 - DNA, 201 bp, Homo sapiens
tctatgtttaattttgtttcttattatttagtaatataagtagatagaaccatattaaaaaaaaattttttttttttgagacggagtatcaccctgtcacrtaggctgcaatggtgcgatctcagctcactacaacctccacctcccgggttcaaacgattttcctgcctcagcctcctgagtagctgggattataggcac

SEQ ID NO: 19952 - DNA, 201 bp, Homo sapiens
tagtctatcccttcataattgtagctctaattttaaaatgttttccctaattataaaattatgcaaatgtataaaaagcattttttctgtgttttttttttaattaggattatactatctaaacaattttgtaacctgcctttttcccgtttgtagtagtattatggtgtatgtactctacctccctgcctactgccatgt

SEQ ID NO: 19953 - DNA, 201 bp, Homo sapiens
aaatactgttttggagattttagatgagttttaacctttgctctgcaagttctctgaatacttgtgtaattataaaaacagtatttgtataaacttaacaggggacaggttgtacacatatacccagacagctaatctctgctgtttgtacttgttcaaaatgacactatttctcctaaagataaatttagtcattcttgt

SEQ ID NO: 19954 - DNA, 201 bp, Homo sapiens
caaatactgttttggagattttagatgagttttaacctttgctctgcaagttctctgaatacttgtgtaattataaaaacagtatttgtataaacttaacaggggacaggttgtacacatatacccagacagctaatctctgctgtttgtacttgttcaaaatgacactatttctcctaaagataaatttagtcattcttg

SEQ ID NO: 19955 - DNA, 201 bp, Homo sapiens
tcttcacttcccagtaggggcggccgggcagaggcgcccctcacctcccggacggggtcgcagccgggcagaggcgctcctcacatcccagacggggcggygggacaaaggcgctccccacatctcagacgatgggcggccgggcagagacgctcctcacttcctagatgggatggcggccgggaagaggtgctcctcact

SEQ ID NO: 19956 - DNA, 201 bp, Homo sapiens
cctccttccttctttccttccttcttccctttcttttcttttcttgtatttatttatttatttatttatttttattgatcattcttgggtgtttctcgcaragggggatttggcagggtcataagacaatagtggagggaaggtcagcagataaacaagtgaacagaggtctctggttttcctaggcaaaggaccctgcgg

SEQ ID NO: 19957 - DNA, 201 bp, Homo sapiens
catgaaaactttagatccagagtaagttggaatataagtattaagaatgttatcatatttaatccaaatacattgacatcaaccataatttttttttttttgccagggcaacaaaaggagatgccatctctacaaaaataaaagttaaaaaaaaaattagttgggagagattgtgtacacctgtagtcctagctactcagg

SEQ ID NO: 19958 - DNA, 201 bp, Homo sapiens
gatttcagtggtttctgaagaacggttttacactaagtggaatcctgaagcattgccttcaaacacaggtgaagttaatttccaaagcggcattattgcakccaggtgtgctatcagtaaacttcatcaggagcttggagccaagggttttattcaggcaagaaataattaaatttgtttcttcaggttcaatttcagagt

SEQ ID NO: 19959 - DNA, 201 bp, Homo sapiens
ctttattttattgtgcttttagcaatagcaaaaagaaatatgcttctaagattgttacatggcagaaaagaatgttcaaacttaatttacttaattttaarttacaaaatctaggattctacttgttagctaatagagtttcaagtattttattaatctttgtgcaaatgttgtgtttaacagtttggaaccaatctgatt

SEQ ID NO: 19960 - DNA, 201 bp, Homo sapiens
ttggatattttgtgtattatacatgtaattatgtagattgtgaaagggtaaaagtagcttttccattaagttttgttgcaacttttaaaatgattttatgygcttagaaataaatacattttatttgggacaattaaccttttagttagagtcagactatattatatgaggattttttttctatcactgactgaaaagttt

SEQ ID NO: 19961 - DNA, 201 bp, Homo sapiens
gatgttttattttcttagcctttgtaatttttcaacattgaagaagtgtaatatatgaaaaatccagtcccccttattaatgtaccaaatggatgttgctrgtcataaacatttcaaaggaatttttaaatttcgctaatgttttaagaattaaatttttgaaaaaaatttcacacatacaatgtgatatcttcatgccaa

SEQ ID NO: 19962 - DNA, 201 bp, Homo sapiens
tcctaccttttccaactgccatcttcttttattccacaattcccattctacatcatagaattttttaaaattatgtgaggatgatagacaatggcaaaacygtgagaggaaaaaatctttacatgatatagtacacattcctatagagtaaggattttttaatagttttcataatatgttatatgattcattacaattgtt

SEQ ID NO: 19963 - DNA, 201 bp, Homo sapiens
atattcactatccttatctgatctttgctaatatacgtattcagttttataggacaacaatcactgtgtacaatattatctcaggttttgttttggtcacrgatcattcttaaaacatttccacttcagtccgcaaaattgtgatttttattttgttaaatgttcgtacgttctgttattatgcccttttaaatattctat

SEQ ID NO: 19964 - DNA, 201 bp, Homo sapiens
ccagcagggaatttatgaataattatttagtcaaccacctggaaattaagtctgattaaagttttaaaaataagcaagcaggcccaggcacggtggctcaygcctgtaatcccaacacttttaggctcaggcaggcagatcagctgaggttgggagtttgcaaccagcctgaccaacatggagaaaccccatctctactaa

SEQ ID NO: 19965 - DNA, 201 bp, Homo sapiens
cttctaagattgttacatggcagaaaagaatgttcaaacttaatttacttaattttaaattacaaaatctaggattctacttgttagctaatagagtttcragtattttattaatctttgtgcaaatgttgtgtttaacagtttggaaccaatctgattttttattataaaccagtgtttataataaacagctagatagat

SEQ ID NO: 19966 - DNA, 201 bp, Homo sapiens
tttctaacagaggtaacacccattatgtctcaaacaggatcagccattgtttgaagtcatacaggaagcaatgcaaaaacacatgcagggcatacagttcygagaaaggaatgctggtccccagatagatcgaaacatgaaggacgaaggtacagaactttaactaaaatagtacaaatttatcaaggtgatgaaattaaa

SEQ ID NO: 19967 - DNA, 201 bp, Homo sapiens
ccctttgcccttcacggcgcccggccctccttgggctgcggcttctgtgcgaggctgggcagccagcccttccccttctgtttctccccgtcccctccccscgaccgtagcaccagagtcgcgggtcctgcagtgccccagaagccgcacgtataactccctcggcgtaagtgctaggaatgccgctggcctcgcggggaa

SEQ ID NO: 19968 - DNA, 201 bp, Homo sapiens
cttaattctgttgttttaggaatattattttagcatttgcgggtaccctgaggcatggtctcattcctaatctactgggtgaaggaatttatgccagatasaattgtcgggatgctgtgtggtggtggctgcagtgtatccaggattactgtaaaatggttccaaatggtctagacattctcaagtgcccagtttccagaa

SEQ ID NO: 19969 - DNA, 201 bp, Homo sapiens
aataaaccagaggactgtccttatctctgggcacacatgaaaaaatacactgaaataactgcaacttatttccagggagtacgtcttgataactgccactsaacacctcttcacgtagctgaggtacagaaaaacaatttatctacattaagaaaagaaattcagtgttccttcctagctttccttaagtaaactatgcag

SEQ ID NO: 19970 - DNA, 201 bp, Homo sapiens
cacctcctttgtgaagtctttccctaatttttcactgtctgcttcctttgatttccaattacacaatgagcacagaactattaagtgctgaataatgaagyagtgtctaaaggcttgttagtcttacagtgtcagactagggtttaaaatctgtgagaattgatgagggcaggtgactcacacttgtaatctcagtgcttt

SEQ ID NO: 19971 - DNA, 201 bp, Homo sapiens
tcttcaatgttgtaaatatttggaatactgtgccaaactcctgattctgattctgaactataagctacattcgtattccttgagcgtatttattttagcaytttctcaacctcgcttttatccaacttatcaaaacaacgtatttcattaacactttaggatgagccatacaaaagtgttacctatgagagagttgctttt

SEQ ID NO: 19972 - DNA, 201 bp, Homo sapiens
agccgggcatggtggtgggcgcctgtaatcccagctactccagaggctgaggcaggagaatcacttgaacccaggaggtggaggttacagtgagccgagaytgtgccactgtactccagcctgggtgacaaagcaagactctgtctcaaaaaaagggaaaaatttaaattagctgtgtgtgttggcatacacttgtcgtcc

SEQ ID NO: 19973 - DNA, 201 bp, Homo sapiens
aaaatacaaaaattagccgggcatggtggtgggcgcctgtaatcccagctactccagaggctgaggcaggagaatcacttgaacccaggaggtggaggttrcagtgagccgagactgtgccactgtactccagcctgggtgacaaagcaagactctgtctcaaaaaaagggaaaaatttaaattagctgtgtgtgttggca

SEQ ID NO: 19974 - DNA, 201 bp, Homo sapiens
gtgagatgtaaatgtttatgcttctcagtcactaagtattttacttcatgttttaattctttctgtaattatttcttagtctatcccttcataattgtagstctaattttaaaatgttttccctaattataaaattatgcaaatgtataaaaagcattttttctgtgttttttttttaattaggattatactatctaaaca

SEQ ID NO: 19975 - DNA, 201 bp, Homo sapiens
caacctccgcctccagggttcaagcgattctcctgcctcagcctcccaagtagccaggactacagaggtgcaccaccatgcccagctaatttttgtagttytagtagagacggggtttccccatgttggccaggctggtctcaaactcctgacctcaggtaatccccctgcctcggcctccgaaagttctaggattacagg

SEQ ID NO: 19976 - DNA, 201 bp, Homo sapiens
gaatggtcttggcacccttgtcaaaaaaaatttgactgcatatacagggtttatttctgggttctctgttccataggcctctgtgtctgtctttatgacasaaccacactgttttggttagtgtagctttgtagtaagttttgaaatgaggaagcatgagtcttctaactttgttctttttctagattgttttggctattc

SEQ ID NO: 19977 - DNA, 201 bp, Homo sapiens
tgtgggctgtggtttcagtaacaatttaatatttagcaaggttattctggtctacttcattcatgggctatcaggaggccactcaggaaacctgagtggarttccacactgtgtaatttacttctcaaacctttgggtgtgttaatgctcatctgtttcacatgtagattggtcagagcctgcccaggacttcctatacag

SEQ ID NO: 19978 - DNA, 201 bp, Homo sapiens
gagtcttttttaaaaatatctttgcaaagtaacatcaatgcctcaattatgtatttattttttttctttgagatggagtcttgttctgtcacccaggctgkagtgcagtggcacgatctcagctcattgcaacctccgcctccagggttcaagcgattctcctgcctcagcctcccaagtagccaggactacagaggtgca

SEQ ID NO: 19979 - DNA, 201 bp, Homo sapiens
ataatggctttacaatatgccagcttgtagatttaccataatttatttaatcactgccaatcattagatatttaggttgttgtcagtttatttcatttcawtaaatgaggctgtgataaatatccttatacataatctctgtttacatcactgatacttttctcaaaaaatctatataaaattcctagatcaaaaaatata

SEQ ID NO: 19980 - DNA, 201 bp, Homo sapiens
cgactcaaaaaaaaagaaaaaagaaaaagagaggacaaagtatgagttattttcaagttcagaggacttggtaaccaatcaaatgtgaggaaaaactctgscagtttttggctgtttcatatttaattggtcatcaaagccctcatatttctttccttctctcttttctacaagaaggaattcctcctcgtttttaagact

SEQ ID NO: 19981 - DNA, 201 bp, Homo sapiens
ttgttatttttaggttgctttcaatatattttagaagtgactgtgaaggtgaatagcttattacacattatagtggtgtgtgcctatagtcccagctactygggcggctgaggcaggagaatcacttgaacccaggaggtggaggttgcagtgagccgagatcacaccactgcactccagcctggcgacagagtgagactc

SEQ ID NO: 19982 - DNA, 201 bp, Homo sapiens
ccattcatctatatcctcaccaatacttgtttttttctgtgtttgtttttttggattttgtttttgttgttttggtttttgtttttgttcgtttgtttttkttttttgttttttttgctagtagccatcctaaatggctatgaggtggtatctaatggttttgatttgcatttccttaatgatttcttagtgatgttgagc

SEQ ID NO: 19983 - DNA, 201 bp, Homo sapiens
caattggtttttcttggaactctttgtcattacctgttggaggttgcaggttgcttttccaagtttacatctcacccagactggtatatatggagaatttwaaaaaaagaaaaaaaaaaccagggaactcaccactatgacattcctcaagtcttgaggttcctagccaatctgccttcctctttacactttttgagtcct

SEQ ID NO: 19984 - DNA, 201 bp, Homo sapiens
atacagatttcaaatataataaatttattttcacagcaagttataccaacttaatattatcactaacattagatatcattaacctttatcatgtttgtcarttaggcaaaacataccttattttaatttacatttcttttttttttttgagactgagtctcactctgtcaccaggctagagtgcagtggtgtgatcttggc

SEQ ID NO: 19985 - DNA, 201 bp, Homo sapiens
ccagctaatttttgtagttttagtagagacggggtttccccatgttggccaggctggtctcaaactcctgacctcaggtaatccccctgcctcggcctccraaagttctaggattacaggcatgagccaccatgcccagctgcctcaatgattttttaaaataattttatgaagttttaaaaattgtttaaactgttagcc

SEQ ID NO: 19986 - DNA, 201 bp, Homo sapiens
tacctactccatttttggctttcctgactctgcacttttctggttttgatttttttttccccctcccctgttgcatattcttgtcaacttggtgtctcttwctaggctctcttcctttcactttttaattaattatgggtatctgctaggaattctttttctgttctccttcaaagaattagttacacagtctcatggcct

SEQ ID NO: 19987 - DNA, 201 bp, Homo sapiens
acctccgcctccagggttcaagcgattctcctgcctcagcctcccaagtagccaggactacagaggtgcaccaccatgcccagctaatttttgtagttttrgtagagacggggtttccccatgttggccaggctggtctcaaactcctgacctcaggtaatccccctgcctcggcctccgaaagttctaggattacaggca

SEQ ID NO: 19988 - DNA, 201 bp, Homo sapiens
aaagaaaaggattgaacagcctgagttgaaaaagagaggacaaggccaggcgcggtggctcacacctgtaatcttggcactttgggaggccaaggcaggcrgatcacctgagttcaggagtttgagacctgcctggccaacatggtgaaaccctgtctctcctaaaaatataaaaattagccaggcgtgctggcgggtgcc

SEQ ID NO: 19989 - DNA, 201 bp, Homo sapiens
caggcagttaattgccttttgggaaatgtgttttatgaacgactggctggccatggtccaaaactaggacctgtcactagaaagcatcctttagttaccargtgttgcatttttgttttttttcttattgatggttgaaaactgaaaattgtatttaacttttgaaattaacctaaatgttttctttaacatgtgagttca

SEQ ID NO: 19990 - DNA, 201 bp, Homo sapiens
tcctcacttcctagatgggatggcggccgggaagaggtgctcctcacttcccagactgggcagccgggcagaggggctcctcacatcccagacgaagggtrgccgggcagagacgcttctcacttcccagacggggtggcggccgggcagaggctgcagtctcggcactttgggaggccaaggcaggcggctgggaggtgg

SEQ ID NO: 19991 - DNA, 201 bp, Homo sapiens
gtgtttctcgcagagggggatttggcagggtcataagacaatagtggagggaaggtcagcagataaacaagtgaacagaggtctctggttttcctaggcaraggaccctgcggccttccacagtgtttgtgtccctgggtacttgagattagggagtggtgatgactcttagggagcatgctgcctccaagcatctgttta

SEQ ID NO: 19992 - DNA, 201 bp, Homo sapiens
atgaggaagcatgagtcttctaactttgttctttttctagattgttttggctattcaaggtccctggagattccatatttattttaagatggaattttctrtttctacaaagcatcattctctttggagcatttttatgatacctcccttaagcttttctgtcagatacttccaacatctgagtcacctcagtgttgtcac

SEQ ID NO: 19993 - DNA, 201 bp, Homo sapiens
gatgagcattttttcatgtgtctgttggctgcatagatgtctttgcccactttttgatggggttgtttgtttttttcttgtaaatttgcttgagttctttrtagattctggataactgaagcagagtagcttgcccagagtcacatagctactaagtggtagaggtagactttactcatggtctatcttgagagcctaggc

SEQ ID NO: 19994 - DNA, 201 bp, Homo sapiens
gggagattctgtgcaatgtaaaagaagtaaaccttgccacagccttacttgaaaagtgttgcaaatcgtaatatcctttctgtgaaacaagttttcttttmtttatttattttatttattttatttttttttgagatggagtttcactcttgttgcccaggctggagtgcaatggcgcgatctcggctcaccgcaacctcc

SEQ ID NO: 19995 - DNA, 201 bp, Homo sapiens
ctaggcagaggggctcctcacttcccagtaggggcggccaggcagaggtgcccctcacctcccggatggggcggctggccggacagggggctgaccccccsacctccctcccggacggggcggctggccgggcagaggggctcttcacttcccagtaggggcggccgggcagaggcgcccctcacctcccggacggggtcg

SEQ ID NO: 19996 - DNA, 201 bp, Homo sapiens
ccacctttttttgcagtaatggtgtgatcattttgttttagaagataatttgaagccgggtgcggtggctcacgcctgtaatcctagcactttgggaggcygaggcgggcggatcacgaggtcaggagatcgagactatcctggctaacatagtgaaaccccgtctctactaaaaatacaaaaaaaattagccgggcctgg

SEQ ID NO: 19997 - DNA, 201 bp, Homo sapiens
cccttccctgccaattctttcacctgccctaatggatgtaccttataggttaaatgagatcacaaaagaaaaggagcaatgttgtgtttctctagctgcasgtaaggaattatgtacaaggttaaaatatgtaaatcgatagtattcgcggaagaaaagttataggaaaatgattattttttaaaagcttgtaatgctact

SEQ ID NO: 19998 - DNA, 201 bp, Homo sapiens
agctattaaaatcacttttaatattactatcacccaaataacgtactttgtacccattaagtaatgtctattaaaatagcttctgatactgtattaagctragaagttattttcttattctaatttttttttttgaaagagagagcctcactctgttgcccagcctgtagtgcagtagcacaatcatggctcactgcagcc

SEQ ID NO: 19999 - DNA, 201 bp, Homo sapiens
taatacttataaaattttattttatacacattttgttttttaggttttaatataactgcaggagttgatgaagaaacaggatttgtttatggaggaaatcrtttcaattgtggcacatggatggataaaatgggagaaagtgacagagctagaaacagaggaatcccagccacaccaaggtagtgtaaatgttataatgct

SEQ ID NO: 20000 - DNA, 201 bp, Homo sapiens
tattgagcagttattttttgtgaatgcaagcaatgtggcagtgaatatccttgtacacatctccatgtgcacataagtaagggtttctctagaatatatayagaaatgaaattcctatgtggtagaatatacacatctccaactttgtgcttgtatattctggatacaaaataataagataccaccaaactgagctttaga

SEQ ID NO: 20001 - DNA, 201 bp, Homo sapiens
tttctcatctgtcactctcatctcacccttctgagtctctggtatctattattccacactctatgtccatgtacatacattatttagctccattttgatamatgtaaatccagttcattaatttcaaatggtatagagggtttcccattgtatgaataaactacagtgtttatccattcctctattgagcagttatttttt

SEQ ID NO: 20002 - DNA, 201 bp, Homo sapiens
atttctcatctgtcactctcatctcacccttctgagtctctggtatctattattccacactctatgtccatgtacatacattatttagctccattttgatwcatgtaaatccagttcattaatttcaaatggtatagagggtttcccattgtatgaataaactacagtgtttatccattcctctattgagcagttattttt

SEQ ID NO: 20003 - DNA, 201 bp, Homo sapiens
gacattcctcaagtcttgaggttcctagccaatctgccttcctctttacactttttgagtcctcttatgatagtccactgtattatgctcagggattttcrttgtacttaagagaggaagatcagggaaaaatgagtcttctcccctttttcataccagaagtttttgaactttctgtagttatgtgtgtttgagtatgtg

SEQ ID NO: 20004 - DNA, 201 bp, Homo sapiens
gtatgcagcttctggcctactcttgtgggctgtggtttcagtaacaatttaatatttagcaaggttattctggtctacttcattcatgggctatcaggagrccactcaggaaacctgagtggaattccacactgtgtaatttacttctcaaacctttgggtgtgttaatgctcatctgtttcacatgtagattggtcagag

SEQ ID NO: 20005 - DNA, 201 bp, Homo sapiens
gctgtgccattttacactcttactaatagtaaacaggcttccattcatctatatcctcaccaatacttgtttttttctgtgtttgtttttttggattttgkttttgttgttttggtttttgtttttgttcgtttgtttttgttttttgttttttttgctagtagccatcctaaatggctatgaggtggtatctaatggttt

SEQ ID NO: 20006 - DNA, 201 bp, Homo sapiens; identical to SEQ ID NO: 2749

SEQ ID NO: 20007 - DNA, 201 bp, Homo sapiens
taaatttaccttagccattttcaagtgtacagttcagtagtgttaagtatattaacattgttgtggaacagatctctagaacttttttaccttgcaaaacwaactctatactcgtgaaacactagttcttcctcctctatccccactcttcccaggccttagtaaccacctgtctgctttctgtccctgtgattttgacta

SEQ ID NO: 20008 - DNA, 201 bp, Homo sapiens
gctgttttttgttttgttttgttttgtttttactattggttttttttattgtggtaaaatagacataatgtatatttaccattttaccataaaagttacarttttagccattttaagtgtacaattcagtggctttaagtacaatcacattgttgtgcaaccatcatcactgtccatctccagaactttgtcatcattcct

SEQ ID NO: 20009 - DNA, 201 bp, Homo sapiens
ctacacgtgtgcaccactgaaccaggctaatttctttttttaatttttttgtagaggtgggagtctccctatgttccccaggcttgtcttgaattcctgayctcaagcaatcctcttgcctcagcttcctaaagtgctgggattacagggatgagccactgagctcaatctcttttgtccgttttataattgtataattgg

SEQ ID NO: 20010 - DNA, 201 bp, Homo sapiens
ggaggctgaggcagaaggatcacttgaggccaggagtatgagtccagcctaggcaacatagcaaaactcagtctctttaaaaaaaaaaaaaaaaaaaaaargaggaaaggaataatagggttgcatagtggattgaagcacagtttaggggacatagtacttaatagtgtttttgtaagagcctaggctcttataaaatac

SEQ ID NO: 20011 - DNA, 201 bp, Homo sapiens
tgagccataaaaggtgagtaggactttcggagagatggagaaagttgttgggagacattagagttgaaaagaagccaggtgtatggcacacacctgtaatytcagcttctcaggaggctgaggcagaaggatcacttgaggccaggagtatgagtccagcctaggcaacatagcaaaactcagtctctttaaaaaaaaaaa

SEQ ID NO: 20012 - DNA, 201 bp, Homo sapiens
gaagagatgatgatgtgtacataaatatggccattgcaatagattgtagaggaagtgttgtgtagtctcttaaaagagagagaaggtccagtaggtaggtytcagggagaacgttagaaagtagctaaagtttcacctaaatgagccataaaaggtgagtaggactttcggagagatggagaaagttgttgggagacatta

SEQ ID NO: 20013 - DNA, 201 bp, Homo sapiens
ctgggttcaggcaattctcttgcctaagccttctgagtagctgggactacaggcacgcaccaccattcctggcttatttttgtatttttagtagagacagsgtttcaccatgttgaccaggctggtctcaaactcctgacctcaggtgttccgcccgcctcggcctcccaaaatgctgagattacaggtgtgagccactat

SEQ ID NO: 20014 - DNA, 201 bp, Homo sapiens
gccattctgctgcctcagcctcctgagtagctgagattacaggcgcccgccaccacgcccagctaatttttgtatttctagtagagacggggtttcaccgkgttggtcaggctggtcttgaactcccgaccttgtgatttgcctgcctcggcctcccgaagtgctgggattacaggcgtgagccaccgtgcccggccgtaa

SEQ ID NO: 20015 - DNA, 201 bp, Homo sapiens
ggctcactgcaacctccgactccgcctcccgggttgaagccattctgctgcctcagcctcctgagtagctgagattacaggcgcccgccaccacgcccagytaatttttgtatttctagtagagacggggtttcaccgtgttggtcaggctggtcttgaactcccgaccttgtgatttgcctgcctcggcctcccgaagtg

SEQ ID NO: 20016 - DNA, 201 bp, Homo sapiens
gatgtttccctctatttgttgtcaagccttgtaacctccagttttatgttttctagacttaaaatggttttttttgtttttgttttttgttttttgttttwgagacagagtctcgcactgtcgtccgggctggagtgcagcggcacagtctcggctcactgcaacctccgactccgcctcccgggttgaagccattctgct

SEQ ID NO: 20017 - DNA, 201 bp, Homo sapiens
tttttagaacccattacaaaaaatagtaatttcaacctttttgattgtgtactgctgttgttaaacatcttcaaaatatacactttaaacgatatactgawataaactgttacatctgacatacttctcaggtacgatataaaacaaataaaaactaaaaaattaagttgataaacaaatacaaatagaagtgtgatattt

SEQ ID NO: 20018 - DNA, 201 bp, Homo sapiens
ccctaatggatgtaccttataggttaaatgagatcacaaaagaaaaggagcaatgttgtgtttctctagctgcaggtaaggaattatgtacaaggttaaartatgtaaatcgatagtattcgcggaagaaaagttataggaaaatgattattttttaaaagcttgtaatgctactcaagattttattttaccacttagtac

SEQ ID NO: 20019 - DNA, 201 bp, Homo sapiens
cagtgatgccaatataatttttaaggtagcatcattgaaataataaaatctgggaaattctaatgcttctaattgaagactagaaggattaagaaaaaaawaatatatatatatatacctcattttgatacttcacttagttctaagtacctcctgttaaattttaacaattccttccaaagcatgctttattcttattat

SEQ ID NO: 20020 - DNA, 201 bp, Homo sapiens
gtcagtgatgccaatataatttttaaggtagcatcattgaaataataaaatctgggaaattctaatgcttctaattgaagactagaaggattaagaaaaawaaaatatatatatatatacctcattttgatacttcacttagttctaagtacctcctgttaaattttaacaattccttccaaagcatgctttattcttatt

SEQ ID NO: 20021 - DNA, 201 bp, Homo sapiens
taattacaatttgagtctcataaacaaaattatgcctgagagagtatttatctctatgtttatatgtagcttgtaatggtagtttcttctatgtttttaayacataaagggattccttgtatttaaaagtctcaaattccaaagatggaatgtcaaagaataatttcagtctaaattcatttgtatgtctttaggatattg

SEQ ID NO: 20022 - DNA, 201 bp, Homo sapiens
atattatctcaggttttgttttggtcacagatcattcttaaaacatttccacttcagtccgcaaaattgtgatttttattttgttaaatgttcgtacgttmtgttattatgcccttttaaatattctatagtatgtttagtagtgttactaagtgttaaatatacagtaaggataattgttttttcttttaaacaattttc

SEQ ID NO: 20023 - DNA, 201 bp, Homo sapiens
tttatttctcttctagcagaacaatatgtatatttgtgttagtgtatatgtatatatgtgtataaatgtctttgtgtgtatatatgcacaaacatacatasaaacatgcgaactaaaatggaaaataatataaccttatgtttaaggcttttcataatccattctcatccaccatcctagccctatgtcagtccactattt

SEQ ID NO: 20024 - DNA, 201 bp, Homo sapiens
aaacctgtttttcatcttctactgggagatatgatgtaatgtttagatgttttataatcaattttgtatagcttacatcccagtaaacaacatatgttccyttttccttacatgagccatttctccagttaagttatggggaaaacttttttgtcacttaaactagtagacatttgtttaaatccttaaagcagttttatt

SEQ ID NO: 20025 - DNA, 201 bp, Homo sapiens
tcagtataaatttctactttggggtaagatacctcatttcaaattgaaagaccagtaggatgaactgaagactcactaacaaaaccattttttgttgttgmaaatatgcaaacctgtttttcatcttctactgggagatatgatgtaatgtttagatgttttataatcaattttgtatagcttacatcccagtaaacaaca

SEQ ID NO: 20026 - DNA, 201 bp, Homo sapiens
actttgtatgacatattctaatataactcagtctatttttatcagtataaatttctactttggggtaagatacctcatttcaaattgaaagaccagtaggrtgaactgaagactcactaacaaaaccattttttgttgttgaaaatatgcaaacctgtttttcatcttctactgggagatatgatgtaatgtttagatgtt

SEQ ID NO: 20027 - DNA, 201 bp, Homo sapiens
ataaaatgttaatttttgttatttttaggttgctttcaatatattttagaagtgactgtgaaggtgaatagcttattacacattatagtggtgtgtgcctrtagtcccagctactcgggcggctgaggcaggagaatcacttgaacccaggaggtggaggttgcagtgagccgagatcacaccactgcactccagcctggc

SEQ ID NO: 20028 - DNA, 201 bp, Homo sapiens
tcaaagggtatacagatttcaaatataataaatttattttcacagcaagttataccaacttaatattatcactaacattagatatcattaacctttatcaygtttgtcagttaggcaaaacataccttattttaatttacatttcttttttttttttgagactgagtctcactctgtcaccaggctagagtgcagtggtgt

SEQ ID NO: 20029 - DNA, 201 bp, Homo sapiens
aacagaatacaagtactatggaacattaaaagtagtagaaacacgtgttgatatactcgtagaagataaatttactacatgttaagtatataaattttctrataggcagtgtgtgtgaattttttcaaatattatctcattatctctgtcttgtatatgaggacacatatcttgaaagatttaaataaacttgcttaaagt

SEQ ID NO: 20030 - DNA, 201 bp, Homo sapiens
cctgatctattttttgtagagacaaaagtctcactgtgttgcccaagctggtcttgaactcctgggctcaagtagtcctcttgccttggcctcccaaagtrctgggattacaggtgcaaaccactgcacctgatctcaatattaattttctgcttttaagttggataatacatgaagaaaggaatgagaagttcactgaca

SEQ ID NO: 20031 - DNA, 201 bp, Homo sapiens
tgcccaccttggcctcccaaagtgctgggattataggcatgagctgctgtgcttggcccatattacatttttgatacttaaccatttttaacctataaaawtggcaaattttgtggttcagcttaagaaatgaaggaactccataatgaaacacttatcatttctaagactttaccatataaaaatcagaaataagctatt

SEQ ID NO: 20032 - DNA, 201 bp, Homo sapiens
caaatctggctggtgggaacaagcaagtgttcctgacgctgtatgagtgccacatactgcttcttctcatccttttggatggttctttccttgttctttgktagtttcctcttgtgaatttgctggttggtacactacagatacttgagtgggaccctctgcatatcttcagagttctctctttgtacagctccttcctct

SEQ ID NO: 20033 - DNA, 201 bp, Homo sapiens
gtgaatgagactccgtctgcaatcccggcacctcaggaggccgaggctggtggatcactcgcggttaggagctggagaccagcccggccaacacagcgaarccccgtctccaccaaaaaaatacgaaaaccagtcaggcgtggcggcgcgcgcctgcaatcgcaggcactcggcaggctgaggcaggagaatcaggcaggg

SEQ ID NO: 20034 - DNA, 201 bp, Homo sapiens
ctcctcacttcccagactgggcagccgggcagaggggctcctcacatcccagacgaagggtggccgggcagagacgcttctcacttcccagacggggtggyggccgggcagaggctgcagtctcggcactttgggaggccaaggcaggcggctgggaggtggaggttgtagtgagccgagatcacgccactgcactccagc

SEQ ID NO: 20035 - DNA, 201 bp, Homo sapiens
acgctcctcacttcctagatgggatggcggccgggaagaggtgctcctcacttcccagactgggcagccgggcagaggggctcctcacatcccagacgaarggtggccgggcagagacgcttctcacttcccagacggggtggcggccgggcagaggctgcagtctcggcactttgggaggccaaggcaggcggctgggag

SEQ ID NO: 20036 - DNA, 201 bp, Homo sapiens
agaggggctcctcacttcccagtaggggcggccaggcagaggtgcccctcacctcccggatggggcggctggccggacagggggctgacccccccacctcsctcccggacggggcggctggccgggcagaggggctcttcacttcccagtaggggcggccgggcagaggcgcccctcacctcccggacggggtcgcagccg

SEQ ID NO: 20037 - DNA, 201 bp, Homo sapiens
tcccagacggggtggtggctaggcagaggggctcctcacttcccagtaggggcggccaggcagaggtgcccctcacctcccggatggggcggctggccggrcagggggctgacccccccacctccctcccggacggggcggctggccgggcagaggggctcttcacttcccagtaggggcggccgggcagaggcgcccctc

SEQ ID NO: 20038 - DNA, 201 bp, Homo sapiens
catggcccgttctcaatgagctgttgggtacacctcccagacggggtggtggctaggcagaggggctcctcacttcccagtaggggcggccaggcagaggygcccctcacctcccggatggggcggctggccggacagggggctgacccccccacctccctcccggacggggcggctggccgggcagaggggctcttcact

SEQ ID NO: 20039 - DNA, 201 bp, Homo sapiens
ctccctccctcccttccttcctcccttcctccctccctccctccttccttctttccttccttcttccctttcttttcttttcttgtatttatttatttatktatttatttttattgatcattcttgggtgtttctcgcagagggggatttggcagggtcataagacaatagtggagggaaggtcagcagataaacaagtga

SEQ ID NO: 20040 - DNA, 201 bp, Homo sapiens
atgtatcccttggggtatgcgctgatatatctattgggctacagaaagaaaatataacatcccttccttccttcctccctccctccctccctccctccctmcctccctcccttccttcctcccttcctccctccctccctccttccttctttccttccttcttccctttcttttcttttcttgtatttatttatttattta

SEQ ID NO: 20041 - DNA, 201 bp, Homo sapiens
gagtggctatgtatcccttggggtatgcgctgatatatctattgggctacagaaagaaaatataacatcccttccttccttcctccctccctccctccctycctccctccctccctcccttccttcctcccttcctccctccctccctccttccttctttccttccttcttccctttcttttcttttcttgtatttattta

SEQ ID NO: 20042 - DNA, 201 bp, Homo sapiens
ggtctacagagtggctatgtatcccttggggtatgcgctgatatatctattgggctacagaaagaaaatataacatcccttccttccttcctccctccctycctccctccctccctccctccctcccttccttcctcccttcctccctccctccctccttccttctttccttccttcttccctttcttttcttttcttgta

SEQ ID NO: 20043 - DNA, 201 bp, Homo sapiens
tagaggtctacagagtggctatgtatcccttggggtatgcgctgatatatctattgggctacagaaagaaaatataacatcccttccttccttcctccctycctccctccctccctccctccctccctcccttccttcctcccttcctccctccctccctccttccttctttccttccttcttccctttcttttcttttct

SEQ ID NO: 20044 - DNA, 201 bp, Homo sapiens
atttgcattagaggtctacagagtggctatgtatcccttggggtatgcgctgatatatctattgggctacagaaagaaaatataacatcccttccttcctycctccctccctccctccctccctccctccctccctcccttccttcctcccttcctccctccctccctccttccttctttccttccttcttccctttcttt

SEQ ID NO: 20045 - DNA, 201 bp, Homo sapiens
agtgatttgcattagaggtctacagagtggctatgtatcccttggggtatgcgctgatatatctattgggctacagaaagaaaatataacatcccttcctwccttcctccctccctccctccctccctccctccctccctcccttccttcctcccttcctccctccctccctccttccttctttccttccttcttcccttt

SEQ ID NO: 20046 - DNA, 201 bp, Homo sapiens
gcctctagtcccagctactcgggaggctgaggcaggagaaaggcgtgaacccaggaggcggagcttgcagtgagctgagattgcgccactgcactccagcytgggtgacagagcaagatgccgtctcaaaaaaaaaaaaaaagataatttgaaatgtgaaagatgagtggaagagtggtagagaagggacattggagacaa

SEQ ID NO: 20047 - DNA, 201 bp, Homo sapiens
cagtctcttccctttgttattaagtggtatgtataaaatcaaatttaaatacctctgtctgacttctaagacattctgtaatgagactacaccttccttakccaagattgtatctcattctccatcattaatgtcatagatctttacagttgcccaagtcattcctgttaattcccttctcagcaggttttctcatgcctg

SEQ ID NO: 20048 - DNA, 201 bp, Homo sapiens
cctgggctcaagcagttctcctgcctcagcctcccaagtagctgggactgcaggcatacatcactatgccccgctaattttttttttttttttttttgtaraaactgggtctcactatgttgcccaggttgatattgaactcctggactcaagcaaccctccctctttggcctctgaaagtactgggattacaagcataag

SEQ ID NO: 20049 - DNA, 201 bp, Homo sapiens
gtgtttcatattaatagagccactcctggtctgttttgtttggttgtcaccatggtacagattttaccatccttttaagctatttatgtctttgtatttaragtggctttcttgtacatagtagcatgtaatcgggccttgctctcgtgtagcacaacagtttctgcttttggaatatttagaccatttacacttaaggtc

SEQ ID NO: 20050 - DNA, 201 bp, Homo sapiens
agggacttctgcgtgtttcatattaatagagccactcctggtctgttttgtttggttgtcaccatggtacagattttaccatccttttaagctatttatgyctttgtatttaaagtggctttcttgtacatagtagcatgtaatcgggccttgctctcgtgtagcacaacagtttctgcttttggaatatttagaccattt

SEQ ID NO: 20051 - DNA, 201 bp, Homo sapiens
gcctattgggtattttcttcgtgcaaaattatatttttccagattgatgggcccggagactactgcaaagactatagttttggttaaaaatgttctttccsgacattatgttcatcttgagaggtaagtcatcaggagcatgtaatttccataactagtgtttagtcagtttattagctattaggtaaattacagtttctt

SEQ ID NO: 20052 - DNA, 201 bp, Homo sapiens; identical to SEQ ID NO: 2748

SEQ ID NO: 20053 - DNA, 201 bp, Homo sapiens; identical to SEQ ID NO: 2747

SEQ ID NO: 20054 - DNA, 201 bp, Homo sapiens; identical to SEQ ID NO: 2746

SEQ ID NO: 20055 - DNA, 201 bp, Homo sapiens; identical to SEQ ID NO: 2745

SEQ ID NO: 20056 - DNA, 201 bp, Homo sapiens; identical to SEQ ID NO: 2744

SEQ ID NO: 20057 - DNA, 201 bp, Homo sapiens
ttacaccagttccaagctatttctcagtgtttaattctatttttctccctttctatatttgtaattcccttttccaacaatgaataacctacttcccacaytgggccatcaccaccacatagagtctgctcacccagcttgggcctgctaccccacagtaagccacctctatgtgtggagccctcctggcaccacttggat

SEQ ID NO: 20058 - DNA, 201 bp, Homo sapiens
acagtttgatcctttctggtcttgattttaagcttgttagacctgaccagaatagcatttggtctaggaataattattctccattagtgaatcaagacccrtctgtgttccctaccctgtatttcgaaaattatgacgttttcaaatctggctggtgggaacaagcaagtgttcctgacgctgtatgagtgccacatactg

SEQ ID NO: 20059 - DNA, 201 bp, Homo sapiens
agctgctcaagaggctaaggcaggatgatcgcttgagcccaggagattgaggctgcactgagctctgatctcgccactgcaccccagcctggtgacagagygagaccctgtctccaaaggggttaaaataaaagtgtgttctgccttcagtgtagctgtggcaacttccttttggagctgagtaactttcttgaggtgaca

SEQ ID NO: 20060 - DNA, 201 bp, Homo sapiens
cattaaaattaatgcatattcttggtcaacaatgcttttctcttctttctctgtatctctgataaatttactcatgctattggagtaaaagttctgtgttwatttatggccccagaagcaaacaatgggtatcagatgtacttaaagaaagctattatgaatctgctgaagaatgagttacataaatttaagtgtgtgctg

SEQ ID NO: 20061 - DNA, 201 bp, Homo sapiens
tgtccggcaaagaattttagactctctgctgttttaaatctatactttagtctaaaaataaactacaaggaagtaaaatagagaaggtatgtgttcttctrtgcctggctagctgttttcacgttgtcaaaaagagtaccaaacctactactataaattatagtagaatgaaaagtgtaaaagtacacaaaggtagctttg

SEQ ID NO: 20062 - DNA, 201 bp, Homo sapiens
gggagaaagtgacagagctagaaacagaggaatcccagccacaccaaggtagtgtaaatgttataatgctgtgtaattatacccttctttaagaaagcacwtacttgtggaatcttttattctgttaactatgaactctttacattaagtcaatcaaaatttccctgccttcttcccttcatctccccattatacatttac

SEQ ID NO: 20063 - DNA, 201 bp, Homo sapiens
gataaaatgggagaaagtgacagagctagaaacagaggaatcccagccacaccaaggtagtgtaaatgttataatgctgtgtaattatacccttctttaaraaagcacttacttgtggaatcttttattctgttaactatgaactctttacattaagtcaatcaaaatttccctgccttcttcccttcatctccccattat

SEQ ID NO: 20064 - DNA, 201 bp, Homo sapiens
tattcagtgtactataatatatactataatcaataatttatgttttgagattatacacagatattagatataccagtattatctatgattaaacttttacraaaaagttatcttactatatatgtccttttgcaacttgttttattcaatcattttgttttggagatttatcttttttatataaatttaaggggtacaagg

SEQ ID NO: 20065 - DNA, 201 bp, Homo sapiens
accccaaggccacctactactgccaggttgggtgtggaagttcatactccccagattcccctcgtggtgcccgcaggtaccacgctgctgaggaaggggarcactgccttaagccatctgctacccccaggtaggggataggagtccaggcttccactcagtctccactgacattccagggagaaaggacatccatggtgt

SEQ ID NO: 20066 - DNA, 201 bp, Homo sapiens
tgcatataccagtatttatttaaccattcatccaaaccattcatccattgaaggacatttgggttgttttcatgttttggctaatacgagtaaagctactrtgaacattcatgtacaagtttttgtgtgacacataagttttcattttttctgggataaatgtccaagaatgggattggttcatatagtaagtatatgttt

SEQ ID NO: 20067 - DNA, 201 bp, Homo sapiens
agtttgaaagataattttggtggtttcatttataactataataatcgccatgaactgcatgcttactattgctaggcattgtggtaactactttacctatrttattaccatttaacactccccaaaacattgagaatgagtgatattgtttccattttttttaattattatactttaaattctagggtacaggtgcacaac

SEQ ID NO: 20068 - DNA, 201 bp, Homo sapiens
tgtcggatttgggggaaaataagaaaaatgtaatttctaacagaggtaacacccattatgtctcaaacaggatcagccattgtttgaagtcatacaggaarcaatgcaaaaacacatgcagggcatacagttccgagaaaggaatgctggtccccagatagatcgaaacatgaaggacgaaggtacagaactttaactaaa

SEQ ID NO: 20069 - DNA, 201 bp, Homo sapiens
atgctgagattacaggtgtgagccactatgcccagccagtttgttttcctatatgtttgttttactcttggtttctgctatttaaaataattaagttcttrtttaatagttacttcgattttgaaataccatagacttcaaaagtagaatctggagctatgagggaccttaaaaatcacccagtccaatctcaaatgaaaa

SEQ ID NO: 20070 - DNA, 201 bp, Homo sapiens
tgaagtttgaaagcactgctctaaaagataaaactttcagcaaaagggcatttatacgataccttgttttgatgccatcaggaaaataactgaagtttgcrtctttacatgccaaaattttatttttgatacttttaaaactgaagtttttaggtgggcatctgaaatgaattgcatttttgttaatccgatatatagtaa

SEQ ID NO: 20071 - DNA, 201 bp, Homo sapiens
agtcaaattctttcacttttcgatctacattttaatatttgttttttatttcagtcatcaaatatttataggtatatattatatacagttacaattttcartgaatacatacttgttggtgaacaaggtagatgaggtttctactcataggtcttatttcctactgggaagatatatgcattcaacagatagcaaacaaga

SEQ ID NO: 20072 - DNA, 201 bp, Homo sapiens
cctgttctaataattgacaaattagaaatcacttagaagatatggaatctattagttgtgtactcttagaggtcaaaaagttaatacaaacatttccatayatagtgctagagattttatagttttgactttttcacaaagacagaccgcatatatttttggatataccgattcagactcacctttgaatctacctgtatt

SEQ ID NO: 20073 - DNA, 201 bp, Homo sapiens
gtaccttataggttaaatgagatcacaaaagaaaaggagcaatgttgtgtttctctagctgcaggtaaggaattatgtacaaggttaaaatatgtaaatcratagtattcgcggaagaaaagttataggaaaatgattattttttaaaagcttgtaatgctactcaagattttattttaccacttagtacatttcatagat

SEQ ID NO: 20074 - DNA, 201 bp, Homo sapiens
gtttctgtgggtaggaactaattcttctgtgatcttaaaaatttgtatatttgtttttggcattcactaggcccctgagctctttactacagaaaaagcakggaaagctttggagattgcagaaaaaaaattgcttggtccccttggcatgaaaactttagatccagagtaagttggaatataagtattaagaatgttatc

SEQ ID NO: 20075 - DNA, 201 bp, Homo sapiens
tggccaaaacaaattatcttcaatgttgtaaatatttggaatactgtgccaaactcctgattctgattctgaactataagctacattcgtattccttgagsgtatttattttagcactttctcaacctcgcttttatccaacttatcaaaacaacgtatttcattaacactttaggatgagccatacaaaagtgttaccta

SEQ ID NO: 20076 - DNA, 201 bp, Homo sapiens
caccactgcactcctgcactcctgggtgatggagaaagacctttctcaaaaataaatggatgaatgagagcagcattggtatttactcttttttttttttktttttgagacagggtctcattctgtcacccaggctgtagtgcagtggcacaatctcagttcattgcaacctccacttattggggtcaagcagccctccca

SEQ ID NO: 20077 - DNA, 201 bp, Homo sapiens
ttgtaacttggctcaagccagtattgtcatacttatctccaactgtattaagcagtgttgtggactgggtagcccttgtgtgtgcctctaatacgtattcmccccaaatcactagaatagagactagcagaatagggactagaggatataggaacaaattgatgctaccaataatacagcatgacatgtctctgaattttc

SEQ ID NO: 20078 - DNA, 201 bp, Homo sapiens
ttaagaaacaggctttaaaaccagatttcctgggttacattgactagttttataacctgaagtaaatgctctatggcttacttttcccctgcaaaatggtrcctaccacagggattatggttaggattaatgaattaatacatgtgaacagctcattagacgacacctaattcatactaagtaattggaaattgttagcct

SEQ ID NO: 20079 - DNA, 201 bp, Homo sapiens
tcctttttgtttcataggggtaactcattcgactgtggagttcttttaattcttatgaaagatttcaaatcctctagaagccaaaatgggacacagtaaayagattcgaattttacttctgaacgaaatggagaaactggaaaagaccctcttcagacttgaacaaggtcagtagcaagttgttttgatttgctcatttgc

SEQ ID NO: 20080 - DNA, 201 bp, Homo sapiens
gtatttttaaaattatattgagttgaaaatccatccttttatactgatttgaagtaccaccataatacttcatagtgtatggtaatatacaaaatatacakctgttatctgtgctcttccactgatccgtctcttttattctatcaatactaaagattattagtttatactgatggcatagctttttctctttttcaaaca

SEQ ID NO: 20081 - DNA, 201 bp, Homo sapiens
ttttgttttgttttttcccttagaaatgagaaaagtggtggaggttacatagttgtggaccccattttacgtgttggtgctgataatcatgtgctaccctwggactgtgttactcttcagacatttttagctaagtgtttgggaccttttgatgaatgggaaagcagacttagggttgcaaaagaatcaggtaatgtcagc

SEQ ID NO: 20082 - DNA, 201 bp, Homo sapiens
atggaatctgacctactgtaggctctctgatgtttcatttactgtatataaaaattttagtttcagtgatttgcattagaggtctacagagtggctatgtrtcccttggggtatgcgctgatatatctattgggctacagaaagaaaatataacatcccttccttccttcctccctccctccctccctccctccctccctc

SEQ ID NO: 20083 - DNA, 201 bp, Homo sapiens
tacaccttccttagccaagattgtatctcattctccatcattaatgtcatagatctttacagttgcccaagtcattcctgttaattcccttctcagcaggytttctcatgcctgtccttatacccgtactcccatcagattcctttatatctgttaaatctcatttactgtcagtctatgtgttgcctaagtttcaacttt

SEQ ID NO: 20084 - DNA, 201 bp, Homo sapiens
aggcctcaagaaacttacagtcatggcagaaggcaaaggggaagcaggcatgtcttacatggccagagaaggaggaagagaacaaagtgggaggtgctacrtgcttttaaacaaccagatcttgtgaaaactcactcactatcatgagaacaagggggaaatccacctctgtgatcaaacacctctcaccaggcccctcct

SEQ ID NO: 20085 - DNA, 201 bp, Homo sapiens
aaaaatctctaatcataatggcaaagttaggtaaagaaataggtacattctaaaatttggtgtttctgcatgtacctagaaaccaagcctccagttctacrgtgaaaacttcataatacctaagaactcagtattcttcatttgaaaatttgacattattaagccaggtgctgtggcttgcacctgtaatcccagctgctt

SEQ ID NO: 20086 - DNA, 201 bp, Homo sapiens
ttcttacaaaagattagataggcattcctggactaggatggtagttcagtggtgatagggaactagtttctctcatgttgctctgcagtctccaacacttwgcttcaaattcttagtcagatatggctattccagctcctgctaccacattctccccagtggaaatgaggaaagggcaggcatgtctttttgggtatgata

SEQ ID NO: 20087 - DNA, 201 bp, Homo sapiens
ataccataaccaaagaaaaaacttttcctgtaacagtatcatcgtaaaattgatgtccaatatagaaaaaaatgagtggtagatctttatattttatttcrcctctaaacttaacatagatacagtttcaatttaattatgagatactcctttgtgtctcctttttccttcagctgctaatagtaaatggatccaggaaca

SEQ ID NO: 20088 - DNA, 201 bp, Homo sapiens
tgtggacgtacttgagaaaaagaatttaaactttttggtaacttggccaggtatgatggctcacaccagtaatcccaacacctcaggaggctgaggcaggmagatcacttgagctcaggagttcaagaccagtctcagcattatggtaacaccctgtctctatcaaaaaaaaagtacaaaaaattagatgggcatggtggc

SEQ ID NO: 20089 - DNA, 201 bp, Homo sapiens
tccaagagtttccatcattagcaatactgagtatatattattataacgtagtgtttaagggcatggagtatagaaccagactaactggatttgaattccawtgcagactcttattagctataagaagtaagacctggctgagtgcagtggctcactcctataatctcagcactttggtaggccaaggtgggaggattgctt

SEQ ID NO: 20090 - DNA, 201 bp, Homo sapiens
tattcttaataaagtagttgcattcttaaccaaaaaatctgtgatgaagcagctttgtgtttggatggactgcttgtaaaatgcatgttcctcctcagacmtgctcagattattttggagcaaggccaagaaatttgcagttttataagatccccaggtaatttttaggcaaggagtccactggctattgaaaaatattgt

SEQ ID NO: 20091 - DNA, 201 bp, Homo sapiens
acatgcagggcatacagttccgagaaaggaatgctggtccccagatagatcgaaacatgaaggacgaaggtacagaactttaactaaaatagtacaaattyatcaaggtgatgaaattaaaccttgcaattgttcacttagtaaatatttgtgtgccaaacctcacgatataatgattaaaaagattaacatagttcctga

SEQ ID NO: 20092 - DNA, 201 bp, Homo sapiens; identical to SEQ ID NO: 2743

SEQ ID NO: 20093 - DNA, 201 bp, Homo sapiens
caaagataattgggaaaacatgagactggtcatattgatgaatattgtaacatgtgaattgtgatccatttctgatatgtcttgaactactgtgtctagtrggcaaatgtcattgttacctctgtgtgttaagaaaataaaaatattttctaaaggtctgtattttgctttcattcatagtcattgcacccagctaatttt

SEQ ID NO: 20094 - DNA, 201 bp, Homo sapiens
acatgtgaattgtgatccatttctgatatgtcttgaactactgtgtctagtgggcaaatgtcattgttacctctgtgtgttaagaaaataaaaatattttytaaaggtctgtattttgctttcattcatagtcattgcacccagctaattttttattttttacttattttttattttgtagagacaggattctacactatg

SEQ ID NO: 20095 - DNA, 201 bp, Homo sapiens
tttagcaaactgagtcatggaatctgacctactgtaggctctctgatgtttcatttactgtatataaaaattttagtttcagtgatttgcattagaggtcwacagagtggctatgtatcccttggggtatgcgctgatatatctattgggctacagaaagaaaatataacatcccttccttccttcctccctccctccctc

SEQ ID NO: 20096 - DNA, 201 bp, Homo sapiens
tgatcaaacacctctcaccaggcccctcctccaacatcggggattacaattcgaatgagatttgggcagggacacaaatccaaaccatatctttttgcctstatgtttaattttgtttcttattatttagtaatataagtagatagaaccatattaaaaaaaaattttttttttttgagacggagtatcaccctgtcacgt

SEQ ID NO: 20097 - DNA, 201 bp, Homo sapiens
atatgaggacacatatcttgaaagatttaaataaacttgcttaaagtctcttgtggtacagttaggatttgaacccaagtgtttgacctcttttccagtakcatgcttgccttgctatttataattacttaagaaagtttaaatttatattttcttcattttaggctggttttgtttgtttgtttttacagtggtctttcc

SEQ ID NO: 20098 - DNA, 201 bp, Homo sapiens
ggatttgaacccaagtgtttgacctcttttccagtagcatgcttgccttgctatttataattacttaagaaagtttaaatttatattttcttcattttagsctggttttgtttgtttgtttttacagtggtctttcctttatttgctttgcaggctacaacatgattcattttaccccattgcagactcttggactatcta

SEQ ID NO: 20099 - DNA, 201 bp, Homo sapiens
atcatactggtatgagcttcattgactgccttcattaattttgatgagaatttatgcacacacacatatacacacaaataagagaaaggaagaaagaaagrgaaaggaaaggggctaacataaattttaaaaacacaaatgatgattaggtgtccttccgtttaaaaaattaatatttttcctttcaaagaaaacattctt

SEQ ID NO: 20100 - DNA, 201 bp, Homo sapiens
cacacacatatacacacaaataagagaaaggaagaaagaaagagaaaggaaaggggctaacataaattttaaaaacacaaatgatgattaggtgtccttcygtttaaaaaattaatatttttcctttcaaagaaaacattcttaattgaggattaagtcaatatataagtatcttgcatctgttgcttataaatacaggag

SEQ ID NO: 20101 - DNA, 201 bp, Homo sapiens
tgtcacccaggctgtagtgcagtggcacaatctcagttcattgcaacctccacttattggggtcaagcagccctcccaccttagcctcctgagtagctggsactttaggcacatgccaccatgctcagctaattttttaaaaattttgtagagatgaggtctcactatgttgcccaggctgtctccagctcctggactcag

SEQ ID NO: 20102 - DNA, 201 bp, Homo sapiens
tcgtttattttaaattaaaacaaattatctgtttttaaataggtagatataaggtttcactgtgttgcccaagctggtcttgaactcctgcaggctatccwacctccactcccacaaagtgctggggttgagctaccgtgcctggccaaaacaaattatcttcaatgttgtaaatatttggaatactgtgccaaactcctg

SEQ ID NO: 20103 - DNA, 201 bp, Homo sapiens
ctcttttcttctaatttgtatttttacatttgaatatttaatatacctgaaatttatttttgtgtattatataaagaagatatttaacttgatttgtattyttaaaattatattgagttgaaaatccatccttttatactgatttgaagtaccaccataatacttcatagtgtatggtaatatacaaaatatacatctgtt

SEQ ID NO: 20104 - DNA, 201 bp, Homo sapiens
aataaatatttgttttattttcagtgaaaaaattataggccaaaaattagaaaatagtgacagttataatctctttgtagatatttgcatttaaggtatcrtcttttctttcttttagaaaataggcgagtaaccaagtctgatccaaaccaacaccttacgattattcaagatcctgaatacagacggtttggctgtact

SEQ ID NO: 20105 - DNA, 201 bp, Homo sapiens
tggatggggaaagaatagttcatggcaaggtcaaaataaaatctgctttactgattttcttccccattagtctattggtttttaaatatttcaccataaakgtaccagagatacatacaatttgagaaagaaaacatggagccaacaaaaaaagaagttcatcttctgtcctctcctttgccttcctaccttttatcttct

SEQ ID NO: 20106 - DNA, 201 bp, Homo sapiens
ttttattaatctttgtgcaaatgttgtgtttaacagtttggaaccaatctgattttttattataaaccagtgtttataataaacagctagatagatagcamcagtgttaaacgtaaatcacacaagtggaaattgtaaggtgtaagagtttttaagagttatttatcatcatctgtaggagaaactggcttcagtctggtc

SEQ ID NO: 20107 - DNA, 201 bp, Homo sapiens
catgccatagaaacaattgtagtacttggaagagcatcatacgctgatctatgctagaagacaacaacaacaaagcaaaagtttgctttctttcaaatgcrgttctagatacagccacaacagactgatggatgctaggtgagtgtcttgttactgccactatgtcttcatcaacttgatccacatacacctgagaagcag

SEQ ID NO: 20108 - DNA, 201 bp, Homo sapiens
gttaaatttgaataaattactcctaaaaattaaccactttttaattaacattttcagagttagtcttgatccacatgcacaagtcgctgttggaattcttygaaatcatctgacacaattcagtcctcactttaaatctggcagcctagctgttgacaatgcagatcctatattaaaaattccttttgcttcgtaagtatg

SEQ ID NO: 20109 - DNA, 201 bp, Homo sapiens
ttggtgcatataccactcttctggatacagcatggaagcagatgtcaaggtatatccaacaaagcttgaataaatgggcatatctgtgttgaaactatatrcagagtcacttcatacatgttcttaaaaaaccaaaccataaagaattgtcatagaactgaaaaggcttgtaggtggatagtaaatttattagcatccttt

SEQ ID NO: 20110 - DNA, 201 bp, Homo sapiens
caaaggaatttttaaatttcgctaatgttttaagaattaaatttttgaaaaaaatttcacacatacaatgtgatatcttcatgccaaatccgcgccttttyccaactttggcatttaaaatcactgagtacctactccatttttggctttcctgactctgcacttttctggttttgatttttttttccccctcccctgttg

SEQ ID NO: 20111 - DNA, 201 bp, Homo sapiens
ttgaagaatgctgtaattggtttcataaaagaatggaggaattaaattcagagaagcatcgactcattaactatcatcaggaacaggttttacttattttygaactgctgcttttccttgcatcttactactatttttttgttgtcttgaggatggtgatgatctaacacaatttaatgtttttcaggcagttaattgcct

SEQ ID NO: 20112 - DNA, 201 bp, Homo sapiens
tcttctagcagaacaatatgtatatttgtgttagtgtatatgtatatatgtgtataaatgtctttgtgtgtatatatgcacaaacatacatacaaacatgmgaactaaaatggaaaataatataaccttatgtttaaggcttttcataatccattctcatccaccatcctagccctatgtcagtccactatttcagccaaa

SEQ ID NO: 20113 - DNA, 201 bp, Homo sapiens
tgatttttgtgaatctttatcattgtgattaagaaacaggctttaaaaccagatttcctgggttacattgactagttttataacctgaagtaaatgctctrtggcttacttttcccctgcaaaatggtacctaccacagggattatggttaggattaatgaattaatacatgtgaacagctcattagacgacacctaattc

SEQ ID NO: 20114 - DNA, 201 bp, Homo sapiens
gatttgcaggtgcctgccttgtaccccaggtttagagtaactgttctatagtaatggagttcataggtttgtgtgtattattatgattaacatattacttygttgtgttttttttgttaggcttacctcatttttcttctggtattttccgctgctggggaagggatacttttattgcacttagaggtatactgctgatta

SEQ ID NO: 20115 - DNA, 201 bp, Homo sapiens
ctcccgaagtgctgggattacaggcgtgagccaccgtgcccggccgtaaaatggtattttttttaatgtcacaataatatgaatgaacttattggaggtcraaaggaaagcactacagcagtgccactcaaaatgcattccacacatcagtagtgtcaccctcacctgagagcttgttagaaatgcagattcttggaccct

SEQ ID NO: 20116 - DNA, 201 bp, Homo sapiens
aattgaaagtgtcactgtctatactaatatttttatactttgtaaataaaaagtttcccattgcattactgttgaaaagatgggcattaagcttagacatwgaattaataaaaatttctgagtggtttagccaaaaagcagtaagacctagacattttaaataacatttccaaggccacacagatggcaaagctaggattt

SEQ ID NO: 20117 - DNA, 201 bp, Homo sapiens
aatgctgagattacaggtgtgagccactatgcccagccagtttgttttcctatatgtttgttttactcttggtttctgctatttaaaataattaagttctygtttaatagttacttcgattttgaaataccatagacttcaaaagtagaatctggagctatgagggaccttaaaaatcacccagtccaatctcaaatgaaa

SEQ ID NO: 20118 - DNA, 201 bp, Homo sapiens
tactccccacccagtttgtgctaacatcatgcagcaggggtgggaaacaccctgagctgcctgctgccaccccaaggccacctactactgccaggttgggygtggaagttcatactccccagattcccctcgtggtgcccgcaggtaccacgctgctgaggaaggggagcactgccttaagccatctgctacccccaggta

SEQ ID NO: 20119 - DNA, 201 bp, Homo sapiens
gctatcttttctctagtaccttatcccaatattcagattccttactcctaccttttccaactgccatcttcttttattccacaattcccattctacatcayagaattttttaaaattatgtgaggatgatagacaatggcaaaaccgtgagaggaaaaaatctttacatgatatagtacacattcctatagagtaaggatt

SEQ ID NO: 20120 - DNA, 201 bp, Homo sapiens
tctctgctgttttaaatctatactttagtctaaaaataaactacaaggaagtaaaatagagaaggtatgtgttcttctatgcctggctagctgttttcacrttgtcaaaaagagtaccaaacctactactataaattatagtagaatgaaaagtgtaaaagtacacaaaggtagctttggttcagcgtggaccattaaaat

SEQ ID NO: 20121 - DNA, 201 bp, Homo sapiens
gagtctgctcacccagcttgggcctgctaccccacagtaagccacctctatgtgtggagccctcctggcaccacttggattctaactacccactctggacyactctcacccttggtggactccctcttcatacctcttggactctaacatcctgctccatactacctattaccctttcccctccatttctggtcacctacc

SEQ ID NO: 20122 - DNA, 201 bp, Homo sapiens
atattacatttttgatacttaaccatttttaacctataaaaatggcaaattttgtggttcagcttaagaaatgaaggaactccataatgaaacacttatcrtttctaagactttaccatataaaaatcagaaataagctattgaaaagtgaaggaaaatgtattatcattatgtatcattttaattcaacaaacattggtt

SEQ ID NO: 20123 - DNA, 201 bp, Homo sapiens
aataggttacatggagtaggctgcttgtgctagatccaactacttcagttagccccaggccccacccagctaccctgaaagctgagggtctctgtatcctrcacacctgtgctataaccagtgcctcagcacactagttggaaagccctgaactagtgaactaaagtggatagctttagttaacattctgttttcattgtt

SEQ ID NO: 20124 - DNA, 201 bp, Homo sapiens
tgtgggaaagatgaggcggcagaggtcaagaaacagaagatctaataatcatccaagtgagattgaagcccttcaaaggttcaggcttatgtagttagcasacggaattcccccacacacacccgccactcccccaagacggagtctcactctgtcacccaggctggagtacagtggggcgatctcagctcactgcaacct

SEQ ID NO: 20125 - DNA, 201 bp, Homo sapiens
ctacatatcgatatgaattataaatgcctaccaattattttttaaaaggagcaaagaatgtgtgcaggaaattcacaaaaaaaaaaaaaaaaaaaaaaaamccagcacaaatggccaaggaaatgcaaatgctgaaatccactattacacaaagccatgtaaattaaaacaacaatgcattatttttcacctatgaaaatt

SEQ ID NO: 20126 - DNA, 201 bp, Homo sapiens
aattcaaaaaaaaaaaaaaaaaacacctgtcaactctgaattctatcaccaacacaaaatgtcctttaaaatatgagggtgaaattaggacattttcagawaaaggctgagagactttatcagcaatgaacctgaactgtaaaaaacagcgtaaagaatacttttcaagctataaggagatggtatcaaatggaaactcag

SEQ ID NO: 20127 - DNA, 201 bp, Homo sapiens
aaacagtttcctttaaataataaattgcactgtaaatttatccatgtaaccaaaaaccacccgtaccccaaaatctactgaaacaaattttcttttttaargggagtggagaaggaaacctgtggtttgagagggacccaagcaggaaacatcagccaagtgcacggtgcagacatcttccggagtctgacgcaaaccaat

SEQ ID NO: 20128 - DNA, 201 bp, Homo sapiens
tattattaagagaatccaaaaatataattcttattgtggtgggacaagctaactaaaaagtctctctctccctctcccctacccatcacaacacacacacrcacacacacacacacacacacacacacacacacacacaatcaatgcttcttaagataactgttttgatcaagaggctcttaaatgacaaccaaagttctc

SEQ ID NO: 20129 - DNA, 201 bp, Homo sapiens
attaagagaatccaaaaatataattcttattgtggtgggacaagctaactaaaaagtctctctctccctctcccctacccatcacaacacacacacacacrcacacacacacacacacacacacacacacacacaatcaatgcttcttaagataactgttttgatcaagaggctcttaaatgacaaccaaagttctctctc

SEQ ID NO: 20130 - DNA, 201 bp, Homo sapiens
gaactgcatgcaaagatctggtctaccagtcttgctgcggggtactgacgctgtgtaggacctctcagggttattacggttttaattctcaaggctatagygcctctggtagttcccgtatgttcaaggtttccaagcagtctcaggcaaccctcataagtattatatccttgacagagggaaaaacagacttgaggcatt

SEQ ID NO: 20131 - DNA, 201 bp, Homo sapiens
aacttagaaaataacattagaagaggaagtccaaccaaagtatcacatgtgtccagggagataacttccacacacaccacacagtttcactttgacaacaytgtcaagaggctctctacgaatcttcagaaaggaaaccgatctacagactaatagacaaaagattagtttgagccatatgaaattgctagttttgtaaaa

SEQ ID NO: 20132 - DNA, 201 bp, Homo sapiens
gcagtggcatgcatctgtaatcccagctactcaggaggctgaggcagggtaattgcttgagcccaggaggcggaggttgcagtgagccaagatcgtgccaytgcactccagcttgggcaacagagcgagagtctgtctcaaaaaataaataaaataaataaataaaataccatttataacagcacaaatgctactttgaat

SEQ ID NO: 20133 - DNA, 201 bp, Homo sapiens
gagaggggaacagagatgagcaagacatactggcagggcaacaggaagaaaaaggaaaatatggagagggtgacaagccagggagtgggtaaagaagggayagtgaggacatacatggggacaaatacatggtctagggttaggtcagagaagatcatcttaaggagaatataaatgcagtatacccccattgaagaggaa

SEQ ID NO: 20134 - DNA, 201 bp, Homo sapiens
gggttgcagtgagccaagattgcgccactccagccagggtgacagtgagactccttctcaaaaattaaaaaaataaataaataaaacaaaagatgcaaacygcagttcatcaccttcacgatgcaaattcctcacaacaatatggctcttacccagtgtcaatgacccggggtggacagggatgctcctctcacagagtcc

SEQ ID NO: 20135 - DNA, 201 bp, Homo sapiens
atatctttaataaatcaacggcccctacatatcgatatgaattataaatgcctaccaattattttttaaaaggagcaaagaatgtgtgcaggaaattcacmaaaaaaaaaaaaaaaaaaaaaaacccagcacaaatggccaaggaaatgcaaatgctgaaatccactattacacaaagccatgtaaattaaaacaacaatg

SEQ ID NO: 20136 - DNA, 201 bp, Homo sapiens
gacagcagaattaaattacagatcaacaataagacatctctaacaactcaaaatatctgaatattaacaatatttctaaataagcatgtgtcaaagatgayatcataagggaaatctgaaatattttaaagtaaatgataataatttgcgagttatagctaaagcaagtcttagagtaaacttttggctttaaggactttg

SEQ ID NO: 20137 - DNA, 201 bp, Homo sapiens
aggaaggaaggaaggaaggaaggaaggaaggaagaagggagggagggaaggaaggaaagaaagaaaaaagaccagacccaatttcacaagtttactgaccrgcaatcatttgtgatactgatacaatgttttcactggtcccttctccagcatcccccatcaaaaccaaaccgttcccaaacaccactccctaaggatctt

SEQ ID NO: 20138 - DNA, 201 bp, Homo sapiens
aagacaaggccagaaaacaggatggagtgttctgtttacaatgcagctgtcaatgttatctaggaaccgaaaaacaacaaaacagaccattttacaatatygcagggtttggtacaaaagaaatttgcaaatgggacctacacagtgtgtggtagctacctcagtgccttcctctagctcaacagcattcacctagagtgc

SEQ ID NO: 20139 - DNA, 201 bp, Homo sapiens
gagacagaggcaagagaagccaagggctcacacccagggaaataggaggaaggacatgatctgatcaaggcaataattgagacaagaaacaacagtagccrggaccggagtggggaacaaggaagtgaacatcagtggtcatgtgctgaacaaattttaaaggtagcacctataggatctgctgatgagatgggtttgtgt

SEQ ID NO: 20140 - DNA, 201 bp, Homo sapiens
ctcactgcaacacactgaaatcactttgtgtattttcctaccttgaccttgtatttctgcaaaatttctctaaaatggatcttcagggaagcaggggacartgtggggaggggagcggacaccagagcaggatgagctgaaagccataaaggctttcctgagccaactcgaaatggctctggaaaagcagaaatgacttaa

SEQ ID NO: 20141 - DNA, 201 bp, Homo sapiens
ctagtactggtctgtggcccaggggttggggaccactggattagtcaacaagagtagttgttcacttcttcatcctccctagagcactaattagcaagaawattaaagaataaatttaacatttacccctggaggttcaaggacaagttagaagttaataccttaactttcagtttcactcaaatgtgcataaagctccat

SEQ ID NO: 20142 - DNA, 201 bp, Homo sapiens
ttactaaggatgcaaaatgacaagaagagaaagcaccacgaatggccactattgttttgcaatggacatcatccaatatgccagaatggaaagttctatgstctgctgaataccaccagacttgataaaaatgagactcttaatttttttctttaggtcttaattagcttcttgttaaactacaaacattatcattggaac

SEQ ID NO: 20143 - DNA, 201 bp, Homo sapiens
tggtttaggcaaggatttcatgactaagaacccaaaagcaaatgcaataaaaacaaagataaatagtagggacttaattaaactaaggagcttttgcaccrcaaaaggcacattcagcagagtgaagagacaacacacagagtgggagtaaatcttcacaatctatacacatttgacaaaggagtaatatccagagtctac

SEQ ID NO: 20144 - DNA, 201 bp, Homo sapiens
tgtgatacaccacataaacaaaattaaaaccaaaaaatcacataatcatctcaatagatgcagaaaaagcattcgacaaaatccagcatccctttaagatyaaaactctcagcaaaatcggcatacaagagacatacctcaatgtaataaaagccatctatgacaaacccacagccaacataatactgaatggggaaaagt

SEQ ID NO: 20145 - DNA, 201 bp, Homo sapiens
caatcccaagaggagccacagaccctttgaaggaagtggactgctactgcaggacctaggagacaccccaaatactctgcagcaagacccacccaaggagwgtctgagctcagacatgcctagccctgcccccacctgatggtccttccctacgcaccgtggtagtggaagacaaagggcatataatccagggagtcctag

SEQ ID NO: 20146 - DNA, 201 bp, Homo sapiens
ccagcacctatttttgtaaataaagttttattgaaacatagtcacagccatttgccaatgtattgacatctgcttttgtgctacaatggcaaaggtgattmatcacaacagagacaataatggcacacaatgcctaaaacacttactaggtggccttttgcagaaaacgtttgctgacagagccacaggccatgcatggtg

SEQ ID NO: 20147 - DNA, 201 bp, Homo sapiens
tgtgtggacactcatgttatcagctctatgggaaactgatccatctgtgcaaacctggacatttgtaggccattattagtagatggccaggatggaccccytcaaaggtagggaacactgagggctgcctacaaccataagactaggcactccaaactcaggtgaggatataatcagcaaaaggcaaccaaagaaaacctg

SEQ ID NO: 20148 - DNA, 201 bp, Homo sapiens
atattaatacatacttattaaatgcttacttttttttaacttttaatatttattatttattttgggatggagtttcactcttgttgcctaggctggagtgccagtggcacaatgttggctcaccacaacctccgcctcccaggttcaagcaattctcctgcctcagcctcctgagtagctggggctacagatgcgcaccac

SEQ ID NO: 20149 - DNA, 201 bp, Homo sapiens
gtaggcagctgccagttcacaagttcagaaagcagatgatatttgagaagaaaagcaaacactcaacaagaaggtgaaaaagcagtttttccctacaaggkgggccctgtctccaggcagccacttcctggatgggctcatttcagctttccactggcagtgggaagggtacacaaatactgacctaaaagcaggaggcta

SEQ ID NO: 20150 - DNA, 201 bp, Homo sapiens
cagtctcaggtatgtctttatcagcagtgtgaaaatggactaatacaccagctcccctgacttgtcttctgcaaagctctacaggcatggtgacaaggggmtgggtggtcaaagtaaacagggccagagaaatgaagagtaaggagtggaggggaaggaagtcatataataaagaatttggctgggttttatccctggttc

SEQ ID NO: 20151 - DNA, 201 bp, Homo sapiens
cactctagcctgggcaacaagagtgaaactctgtctcaaaaaaaaaaaaaaaagaaaagaaaagaaaaataagtgtatagaactttattgtttcattgacygggcacgatggctcacgcctgtaactctagcactttgggaggccaaggtgggcagattggctgagctcagcagtttgaaaccaggctgggcaacatggtg

SEQ ID NO: 20152 - DNA, 201 bp, Homo sapiens
tgagacagcagaatcgtttgaatctgggaggtggaagttgcagtgagccaagatcacgccattgcactccagcctgggcggaagggcatgacttcgtctcaaaaaaaaaaaaactttttccttaaaatacacctcttggagccagtcccagatacttgggaggatcaggaaggaggacctcttgaggccacaaatttgagg

SEQ ID NO: 20153 - DNA, 201 bp, Homo sapiens
gagaattgcttgaaccagaaggtggaggttgcagtgagccaagatcataccactgcacgccagcctgggcaacacagtgaaactccatttaaagaaataataataataagataaacttctccatgagccccaaactcatgaccaattgaatgcctattcaacatctccacttgaatgtgtagcaggcatctcaaacttaac

SEQ ID NO: 20154 - DNA, 201 bp, Homo sapiens
gaaatgccgtctctactaaaaatacaaaaatgcaccaccatgcctgtaatcccagctacttgggaagctgaggcatgggaatcacttgaacccgggaggcrgaggttgcagtgaactaagatcatgccactgtgctctagcctgggcgacagagcaagactctgtcttgaaaaaaaaaaaaaagccaggagtggtggctca

SEQ ID NO: 20155 - DNA, 201 bp, Homo sapiens
acccacctctgcctcccaaagtgcagggatacaggcgtgagccaccgcgccaggccaagatggaaattttagttactactgtcacccgagtctttctccgyttgtttccttgcacaaaatgggtagggctgtgggccctcccagctcaggagccctggggtggttttaagaaggtagaactcctggtaggaaccacctgca

SEQ ID NO: 20156 - DNA, 201 bp, Homo sapiens
aggcttatgtagttagcagacggaattcccccacacacacccgccactcccccaagacggagtctcactctgtcacccaggctggagtacagtggggcgayctcagctcactgcaacctccgcctactgggttcaagcaattcccctgcctcagcctcctgagtagctgggattacaggcgtgctccaccacacccggcta

SEQ ID NO: 20157 - DNA, 201 bp, Homo sapiens
gagtcacatctgtaatcccagactttgggtggccgaagcgggaggaacacttgagcccaggagttcaagaccagcctgagcaacaacatagagagccctayctctacaaaaaaaatttttttttattatccgggcatggtgacacacacctggagccccagctactcgggaggctgaggcaggaggattgcttcggcccag

SEQ ID NO: 20158 - DNA, 201 bp, Homo sapiens
gctttggaagtgcacccttgcagcacagcaaccttcttgatttgctcaagagcaggggttctgacaggtctcaaagcactttgtttaatgaaacagaatcraaaataccagtgtgtcacatgtttcctaagacaggacactgtttcttgaaacttttactaaagtatgtttttcttttatttttttattttttattttttt

SEQ ID NO: 20159 - DNA, 201 bp, Homo sapiens
gtactccagcctggacaacagagccactgcactccagcctgggcaacagagagagactccatcttaaaaaaaaaaaaaaaaaatccctgtcttcaaatacwatcacattctgaagtactagagatcaggactccaacatgcgaactttggggggacataattcagcccgtaatatgggtgataaaggagcaggtccagact

SEQ ID NO: 20160 - DNA, 201 bp, Homo sapiens
gaagtcaaggctgcagtgagccatgatctcaccactgcactcgagcctgggagacagtacaggacccatctccaaaaaaaaaaaaaaaaaaagtgaacgamgctgcaataagctgtgatcataccactgcacactagcctaggcgacagagtgagaccctgcctcaaaaaaaaaaaaagaaaaaaagaaaaaaccaattga

SEQ ID NO: 20161 - DNA, 201 bp, Homo sapiens
ctttcctgtgctgttcttgtgatagtggataagtctcacgagatctgatgggttttttttttggtttggttttttttttttttttttgagacggagtctcrctgttgcccaggctggaatgcagtggcgcgatctaggctcactgcaggctccgccccccggggttcacgcgatatctgatgcttttaaaaataagagttt

SEQ ID NO: 20162 - DNA, 201 bp, Homo sapiens
gggcgtggggtcccaaataacaccctctaggccatggcttcctttctttcctggccccttccctcaggttgtgagtctttagcccacctagcagactcagsgtgtgccaccagttccctggaggagcagatcattgaaaatacagcaaagttaaaattaaacgcaacaaggccaggtgcattgccttctgttccatgggga

SEQ ID NO: 20163 - DNA, 201 bp, Homo sapiens
tccctggagatgggacaagaaagctttgtatttgggactctccctttggttccaattggcagccatttgctgtagtaaaactgtaattgtaagtgtagcaytttcctgagttctgtgagtcattctagcagattattgaacccaagggggtcatgggaagcatagaatttgtagctggttgactagaagtcagggtgggct

SEQ ID NO: 20164 - DNA, 201 bp, Homo sapiens
ctgggttcaagcgattctcctgcttcagcctcctgagtagctgggattacaggcacacgccaccatgcccggctaatttttttgtatttttagtagagacraggtttcaccatgttggccaggctggtctcgaactgctgacctcaagcaatccagccaccttggcctcccaaagtgctggatttacaggtgtgagctacc

SEQ ID NO: 20165 - DNA, 201 bp, Homo sapiens
ggctggagtgctgtggtgcgatctcggctcaccacaacctccgcttcctgggttcaagcgattctcctgcttcagcctcctgagtagctgggattacaggyacacgccaccatgcccggctaatttttttgtatttttagtagagacgaggtttcaccatgttggccaggctggtctcgaactgctgacctcaagcaatcc

SEQ ID NO: 20166 - DNA, 201 bp, Homo sapiens
ctcaccctctgcccctgcccaagcttaaattttctactcagcacctgtcaacattagaagggctattatatttcactttttttgaaatcatgttttccccyggaggcatctaggctccacaaggatggggtttttctgtgttgtttgctgctaagccacccacacctacaacatgctgggcacatagaagtcacccagatt

SEQ ID NO: 20167 - DNA, 201 bp, Homo sapiens
ctcctgagactgaatctgggctctgtcatttacactttgtgtggccctgggcacattatataactacatggcacccagtgtcctcttcccaaaagtagggktaaaagaatgccttctgactgagcatggtgattcctgcctataatcccagcactttgagaggccaaggtgggaggatcatttgagcccaggagttcaaga

SEQ ID NO: 20168 - DNA, 201 bp, Homo sapiens
ttcttggtcagccaggcacagtggctcacacctgtaatcccattaatttgggagggcgaggtgggccgatggcttgagctcaggagttctagaccggcccrgacaacatggtaaaacctcatctctactaaaaatacaaaaaataagccaggcatggtgcatgcctatagtcacagctactcaggaggctgaggtgggagg

SEQ ID NO: 20169 - DNA, 201 bp, Homo sapiens
ccagaccatcagtcaatgtcgtgaccatgcaagaccacaagcttccccctcgtccatccgaggaggagacaactgggaatggtgtcttaacagcgtggatrttgatgaacttgggtcagcagggctgcacgcctcacacatgtggaggatggtactcagtgggagacaggtttctaaagggttcttggtcagccaggcaca

SEQ ID NO: 20170 - DNA, 201 bp, Homo sapiens
cagagcctttgataagtaaaaacagggaacttgacatctgcccagaccatcagtcaatgtcgtgaccatgcaagaccacaagcttccccctcgtccatccraggaggagacaactgggaatggtgtcttaacagcgtggatgttgatgaacttgggtcagcagggctgcacgcctcacacatgtggaggatggtactcagt

SEQ ID NO: 20171 - DNA, 201 bp, Homo sapiens
cccccgctgcaggctctaagtgggtggatacttgctcagtctccagtccccatcacagtctccatggaggtgcacataggggacagatgtgctggaaattygcgggctgttctgttctaattagcatttgcctggaagagcaccatgttcaccattagactagtacttgtttctctgggcattataatcattcctcaactc

SEQ ID NO: 20172 - DNA, 201 bp, Homo sapiens
agaaaataccacatgaggcttggccttggccctcatgtcaggcagctgaacaagaaatgtagaattgaagttattaaaaaccacctcattggccaggcacratggctcatgcctgtaatcccagcactctgggaggccaaggtgggtgaatcacaaggtcaagagatcgagaccatcctggccaacatggtgaaaccccat

SEQ ID NO: 20173 - DNA, 201 bp, Homo sapiens
cagctcccctgacttgtcttctgcaaagctctacaggcatggtgacaaggggctgggtggtcaaagtaaacagggccagagaaatgaagagtaaggagtgraggggaaggaagtcatataataaagaatttggctgggttttatccctggttcttctaaatccttggaatgctccaagtaatagaagtgtggtccctgatg

SEQ ID NO: 20174 - DNA, 201 bp, Homo sapiens
gcctgcaggagaaggggaatgtgcaggtcacttgaggtcagtaaatgattgaacagatgctctagcctcactcaataaatcatttattattgaaagaatartgcattgtaaagtactttcaggtgtggcaaattattaatcattggttagttttccttgaagagtctgccagccctgcctgcgggaggctgctgggcccgg

SEQ ID NO: 20175 - DNA, 201 bp, Homo sapiens
tcaggaccccaacagcctgctagctggcctacccaccttcacccttggtttccctgtgatctttcaatagaaaagccagagtggattcttaaaaatatcaygccatgctgctctcctgcagtagaaaaacaatgaaactcatggtggggtgctgtgcttgactgggtccccttcgttcagtgttccagccaccctggcctg

SEQ ID NO: 20176 - DNA, 201 bp, Homo sapiens
acacataagcctcacttatgtgagcccacacatgcctgcaggagcgccaacatgcctttccaggtgcatttgtcccaacaagaaccagatcccatttgtchcaacaagaaccctttctctctacacctttgcctccatcactgtggcccaaggcaccatgaattttcaggaccccaacagcctgctagctggcctacccac

SEQ ID NO: 20177 - DNA, 201 bp, Homo sapiens
tctcaaggctaaacaactgatagaatttagtcagttatcttgatgctttcccagattgctcaaagtttatctgtccctgggaaataaatatgagtgtcttyaatttaagacatgtgtcatgtaactcagcgcacagccatgccccacacataagcctcacttatgtgagcccacacatgcctgcaggagcgccaacatgcc

SEQ ID NO: 20178 - DNA, 201 bp, Homo sapiens
tgacaatctaaaaagggctgagatgagggaactttttccagctccggttcttcccacaatgccaacctacagagagatccaggcggcaggattaaaaaaaraaaaaaatcacaggatgcagcaaaactaggagaaaactttcggtttttgaagaagaattaaggacattctatattgagtgtagtctaagagtttcccaac

SEQ ID NO: 20179 - DNA, 201 bp, Homo sapiens
aaaaaaagaaaagaaaaagaaaaagaaaagaaaaacaatgagtaaaatgtctgatgagatatcatgctgtccaacaaatacttactgaaaaaaaattgagytggatagttctgagttctgattctactacttattagctgttcatctccaggtaagttattaatctccctgagccttagtttccttcctggagaatggggc

SEQ ID NO: 20180 - DNA, 201 bp, Homo sapiens
agagggacagacctcaggcatctcgggcctttggtgctggctcccctgacctctacggaggcacaggaaacaggagtttcccccaggccaccatggtaggmtgagcctaggggcagcctgaggaaggtgacacatattcaccttaagggtaaacggaggctccagacaggacccaggaaggcaaaacccactccccacaca

SEQ ID NO: 20181 - DNA, 201 bp, Homo sapiens
ctagcacgggatcaggatatttacagaagacattcccatccctcagatgggtcatgatattaaatcccaacacgcctgtctcggcatgtgaacgcgcgcgtgcgcgacacacacacacacactctctctcacacacttcaccaactgcactgccttccatgaggtcatggaagttttcccctatgatacagaaatcagaaa

SEQ ID NO: 20182 - DNA, 201 bp, Homo sapiens
tgtccattttgaaaaaaagaaaagttaaaagtaaataaaacttcacaaaaccaaccaaacccccgaaattcaccctgtaaacatcattttcgcatcagacktaaaaggacagagcgtgtgtgtgtttatttactgggaggaccgccttaaagtattaaataacattcaaaggtctttaaaaattaaaaaaaagttaataaa

SEQ ID NO: 20183 - DNA, 201 bp, Homo sapiens
ccaaaacaaataaataaataaataaagtgtatgagggtgggaatgccagcagataaagagaaactgtcaccttgtgtgagtttccatgtgcacaagatgcratgatgttctaaatatctgggaacacattattgttttgttggtagagatggcagaaattacatcagaattaggcaaacatgaaacagggagtgcaatact

SEQ ID NO: 20184 - DNA, 201 bp, Homo sapiens
ttgtgtatttatcaaagtattgaccttgagtaggccagatattcagtaatccgaaagtaacagtacacagtactgtaatactgcaaaattcattccatcaktcattcccatttcaagattatctttgaagctttaagaaaatgaagagatttgtgcagcaggaaaaaaaaatgacagatgtcagaaaatgtcttactaatg

SEQ ID NO: 20185 - DNA, 201 bp, Homo sapiens
ggagcccctccagccttggcacctacacagcccatgcccaatggggccgtgagtgctcagaaatagcacgcatatgtatatggtgctacttggcctctacytccaggaaggcaggatctacggacattgtttaaatgcagtttaaatcataagatgagaattcatcttgttctttgttctatgttccttctttgcagcttc

SEQ ID NO: 20186 - DNA, 201 bp, Homo sapiens
ttatgtatatatcacacacataatacatcatctatgaattttaagacacatgtgaagctattagcacacaatcctattttcctccaattctcatctccacyccatttattctcatccacacataatttgttaacaattttttaaagtgaagatttctttcccaaggcttcgacttgtcaaacaaatctttcttgtggcatt

SEQ ID NO: 20187 - DNA, 201 bp, Homo sapiens
cttcacatttcaggcattgccaaatgagtggaggtggctagagaaatgcagccaaatgccattccggtttttatgtacttctctatgactgactgttgatrtggtgactcttgcaaacataaaatgatcaactgcagattagtttttgttttttgttttgttttgttttgctttttcagtttcactcttgttgcccaggct

SEQ ID NO: 20188 - DNA, 201 bp, Homo sapiens
ggtcttcccttgggggctgagagccagacaggtcctgtcagggtgggcctggggctcattaaggttgcagcagctgctcacccaggcaaggagctggccaygtaaggatcagatctgtgatcaaactgtttcagaaagaaagagtttgcagtgaaagggatggggagggaaagcaaagcacaggttaaaggaaggcaagaa

SEQ ID NO: 20189 - DNA, 201 bp, Homo sapiens
agagcaaggcagacaggtgcttggggagaaggagggcaccctgagtgcaggggatgtgtgtccatattgggagttgtgaggagaggggtgggaaggggaakagattctactgtcttgtttgttctggtttagttccttcaagaggctgtcctagtcctagccaagggccccaggacacatgtgaaagggacattgctggca

SEQ ID NO: 20190 - DNA, 201 bp, Homo sapiens
ggactaagtgtgcacatgtgtgttattcacctggtagttcatgcccttgtatgctcagagatgcctaattcttcatatcaaatcacggcatcgagccttgscatatgccatcgtgcctttcacatgcatttcgacctgctgaaatcctaaccaccttccaaagtctgtttcaaatgtgtaattgccttaaaatcctccact

SEQ ID NO: 20191 - DNA, 201 bp, Homo sapiens
gtgagatgtaattttttttcaaaagtgttcttatcttctagagataagtaataaggtattacagataaaatacaattacagataaaatacaattgaggccragggtatgcatcagaagaatctgggttgggggtggagctagcagagggccaggggagagacggagttgaattggctacaagttgatcgcacttgaacttg

SEQ ID NO: 20192 - DNA, 201 bp, Homo sapiens
caaaagctaggaaggaaaacaagtttttatttgaggatccaaccaaagttatatttaaaaattatttaagaaataagtggacaaagcataatacttttttwaaaaaacatgacaagaacatccctgaaaataacaggataatgatcaggtttaagttacaggacattacattagaaatctttacttggatggcctataatt

SEQ ID NO: 20193 - DNA, 201 bp, Homo sapiens
ccaggtaagttattaatctccctgagccttagtttccttcctggagaatggggctaacttgacacaccctgcagggctgcagtgacaatcactgtgtcatraggctccttgcacggtgctgccaggcagcaggagcccggccaagcagggcagcacagtgaggcacgctgttcttcaaatggcaggtgcaaccaatggatc

SEQ ID NO: 20194 - DNA, 201 bp, Homo sapiens
acctcccaaaaaggtgggattacaggtatgagccaccacacccagtccctaaaaacatttttttaaaaaaactttccagccatccttctctcagcatccaktctatccatcacatgcatccattcctggagacaccatcagagcattcagctcgacgtggacactcagcacccaatttgcctgggtcacagaggaggtacc

SEQ ID NO: 20195 - DNA, 201 bp, Homo sapiens
ctggtgttatatgatcccttctttttacaggacctagagattgttttattacagaatggagtggtaaagaaaagcatcactaatgcgaaagagagactttygctggtccttaaaggatgaagaattagaagggtacatttgagggtgagccacaggtgtgcaaacacacacacacacacacacacacacacacaggtgcca

SEQ ID NO: 20196 - DNA, 201 bp, Homo sapiens
gagaaatgcagccaaatgccattccggtttttatgtacttctctatgactgactgttgatatggtgactcttgcaaacataaaatgatcaactgcagattwgtttttgttttttgttttgttttgttttgctttttcagtttcactcttgttgcccaggctggagtgcaatggtgcaatctcggctcacctcaacctctgc

SEQ ID NO: 20197 - DNA, 201 bp, Homo sapiens
gatttcagatacttttgaattttgcaatgtttgcattatacatacttacagattcagcatacttaatccgaaaatccaaaatctgaaatgccccaatgagygtctcctacaagcttcacatcagagctcaaaaagtttcagatttaggagcatttcagatttcagattaggggactcaatctgtatttactgatttgacca

SEQ ID NO: 20198 - DNA, 201 bp, Homo sapiens
aggggaagtctggggaaacaagttactgccaagctttactggattgaagccccatcagtagcacagataagccagacaacctcctccaaccacaacacttycacctagagggacagacctcaggcatctcgggcctttggtgctggctcccctgacctctacggaggcacaggaaacaggagtttcccccaggccaccatg

SEQ ID NO: 20199 - DNA, 201 bp, Homo sapiens
ctccatgcaagaccccaaaaaacaaaagctaggaaggaaaacaagtttttatttgaggatccaaccaaagttatatttaaaaattatttaagaaataagtkgacaaagcataatacttttttaaaaaaacatgacaagaacatccctgaaaataacaggataatgatcaggtttaagttacaggacattacattagaaatc

SEQ ID NO: 20200 - DNA, 201 bp, Homo sapiens
aattaacacacactttcatcccaaacaactagcacgggatcaggatatttacagaagacattcccatccctcagatgggtcatgatattaaatcccaacamgcctgtctcggcatgtgaacgcgcgcgtgcgcgacacacacacacacactctctctcacacacttcaccaactgcactgccttccatgaggtcatggaag

SEQ ID NO: 20201 - DNA, 201 bp, Homo sapiens
tcccaaaaagcagtaaaatcctgcacatgcaccatctttttaccatctgacggcagctgacggttgcgctgtgatatctcatcaagtagcaaaaaggtctraagaaaatgggaaaaacacagattgtttaaattacagaaacaaaagcacaaacaaaagtcactgcttccatggaatttgtaacataaaactttatacagc

SEQ ID NO: 20202 - DNA, 201 bp, Homo sapiens
aaaaacctgcggcctcccaagctccatggtcacgtatccaccaaacagcacacgcaggcctcctaggaggcttcatgtttcaaggaaaaataaatgttccsaatagcctgaggggaccctgccactggaatctcaagctcctgctcaaaccacacctcacataaggggcctggaaataaacgtcctatttttgaccacatt

SEQ ID NO: 20203 - DNA, 201 bp, Homo sapiens
aaccagacacgggagatgagcctgagcgatcacagcctgcccttatcagcggcaggcacaggcagggacctgcatcacatggttccctacagcgcttttgmttccgacaacacagacaggtcctactcaaaatacaaatagaaaaagacttcgattaggaagtcaacaatctataccaactcaacaagtattttggagaat

SEQ ID NO: 20204 - DNA, 201 bp, Homo sapiens
cttataccagttataacttcattcatggtcctgatcctggcatccgtgaaagttgcagttttactcctaaggggaaccagacacgggagatgagcctgagygatcacagcctgcccttatcagcggcaggcacaggcagggacctgcatcacatggttccctacagcgcttttgcttccgacaacacagacaggtcctact

SEQ ID NO: 20205 - DNA, 201 bp, Homo sapiens
tggtgaaggtcacaaacacgatgattttgcttgcactgaaaaatgaagccaaattcatccctctgaggcaggaacttctcagaatcttggaaatctccttmctgaaagagagtacaggtttttaaaaaagcagtgatgtcaaccagataaagtggctcacgcctgcaatctcagcactttgggagctgaggtggatgaatt

SEQ ID NO: 20206 - DNA, 201 bp, Homo sapiens
gaacaggatatgaaaaattactcatttccccagatagaccctttaagagaaacaattcgcaaacaaatcaaaacaatattttaaatgcatatgtatttaayatattattcatatgaaataagccgatgtcagtggtaaagaaaaagaaaataggacgatacctaaagagaaacaaaaatatcatcaaatggcagcgggcag

SEQ ID NO: 20207 - DNA, 201 bp, Homo sapiens
aaatatctttaataaatcaacggcccctacatatcgatatgaattataaatgcctaccaattattttttaaaaggagcaaagaatgtgtgcaggaaattcmcaaaaaaaaaaaaaaaaaaaaaaaacccagcacaaatggccaaggaaatgcaaatgctgaaatccactattacacaaagccatgtaaattaaaacaacaa

SEQ ID NO: 20208 - DNA, 201 bp, Homo sapiens
ggccgtgtgtccctgttcccatcagggggccttccctctcttccatccacctgtcatgaaggtcctcagtccctgcttgcctccacctaccaggatctcasccttcgccctttctcctccatgaaactcttgctgacaaatgtagctctcaggaacctgccactaatgcgagtgcctttatactggaccggctacggataa

SEQ ID NO: 20209 - DNA, 201 bp, Homo sapiens
ctctacatcaagaattagaaaacatggctgaaaaaaaatcagagactacacaaacaaatggaaatatattccatgctcatggataggaatattgtcaaaakggccatactgcccagagcaatttacagattcaatgctcttcctatcaacctaccaaagccatttttcacagaactagaaaaactatactgaaattcatat

SEQ ID NO: 20210 - DNA, 201 bp, Homo sapiens
aatcacttggacctgggaggcagaggttgcagtgagccaagattccgtcactgcactccagcctgggccacagagcaagtctccatcttaaaaaaaaaacmacaaaaaaacaaaaacacaaacttttcttctggaaggctctaataagccaggccataaggatataggagccccatcaactgctttcaaggataggggcag

SEQ ID NO: 20211 - DNA, 201 bp, Homo sapiens
gaatcacttggacctgggaggcagaggttgcagtgagccaagattccgtcactgcactccagcctgggccacagagcaagtctccatcttaaaaaaaaaamaacaaaaaaacaaaaacacaaacttttcttctggaaggctctaataagccaggccataaggatataggagccccatcaactgctttcaaggataggggca

SEQ ID NO: 20212 - DNA, 201 bp, Homo sapiens
gtctctgatgccagagactgaaatgtgataaacagcaactcaacagatgggaacaacctttaacaagaacacagctaagtgtgaacgaagcgagcggaagsccattctgggcaatacaggcctgggaaaaatggaggtgcaaggtgtggggaatagaaggcccagaggatgtggacactgctgatgtgcagatttctgtct

SEQ ID NO: 20213 - DNA, 201 bp, Homo sapiens
agtctctgatgccagagactgaaatgtgataaacagcaactcaacagatgggaacaacctttaacaagaacacagctaagtgtgaacgaagcgagcggaascccattctgggcaatacaggcctgggaaaaatggaggtgcaaggtgtggggaatagaaggcccagaggatgtggacactgctgatgtgcagatttctgtc

SEQ ID NO: 20214 - DNA, 201 bp, Homo sapiens
ggtcaagaggagagggttctcaaatgaaaagattaaaagaaacaggaattcttcccccagaaagatgaagagtacctgataatatgaactctggatggagyatccaagagaatatatacatgtattcctggagtatccatattccctgcatacagggaatatgcatttccccccaagttacagaattctaaaaagagaacc

SEQ ID NO: 20215 - DNA, 201 bp, Homo sapiens
aagatgaagagtacctgataatatgaactctggatggagcatccaagagaatatatacatgtattcctggagtatccatattccctgcatacagggaatakgcatttccccccaagttacagaattctaaaaagagaaccacacagtatcacataaatggttaaacaatacacttagggtaactacaaatatttctcaaca

SEQ ID NO: 20216 - DNA, 201 bp, Homo sapiens
tccaagagaatatatacatgtattcctggagtatccatattccctgcatacagggaatatgcatttccccccaagttacagaattctaaaaagagaaccayacagtatcacataaatggttaaacaatacacttagggtaactacaaatatttctcaacacagaaatctatagagagcacccctctgagatacactacata

SEQ ID NO: 20217 - DNA, 201 bp, Homo sapiens
gttttatccagaataaaaagtttccccaaactttctcaattctgcaaaaaagtctgcaaacagcagagaggagcaccagcaagcaggctcaggtactgctrtagctttacctggcattcaggacaagccaacccaacatcaaaatccacaactcagaagccaacccactgcaggaaccaccacggttcttcaaattagata

SEQ ID NO: 20218 - DNA, 201 bp, Homo sapiens
tctgtgtcccagatagctaaaaagtaaaaacaggagataaggcactgtccccactgcagaggttatacgaacccatgctgggaatatgacttgtgactgaygacattctaacatgagcaagtacaatgttcagcacactattgccatgaggagcccatattcttaatgccaatctgttgacctcacttaaaatacagcctg

SEQ ID NO: 20219 - DNA, 201 bp, Homo sapiens
ataaatatatactcaaaagtattaaaagcaaggactcggccgggtacagtggctcacgcctgtaatcccagcactttgggaggccaaggtgagcagatcgygaggtcagtagtttgagatcagtctggccaacatggtgaaaccctgtctctattaaaaatacaaaaattagcctggcgtggtggcaggtgcctgtagtcc

SEQ ID NO: 20220 - DNA, 201 bp, Homo sapiens
tccttctataacagttaagaccacagcaaactatggtattatttatggcatatctcaatacaaaagcacaaataaaataagaaaatatcaaatcaggtctyatcattattactgccctaatgggaaagaaaatacagtcagcctttcctgtgcatgggtttggcatccctggactcaaccaacctggggttgaaaatattt

SEQ ID NO: 20221 - DNA, 201 bp, Homo sapiens
ggactcaaccaacctggggttgaaaatatttgggggaaacaaaataggtgattgtgtctgtactgaacacacacagatttttttcttgtcactattccctraacagttatttgtttatagtacctaatacaatgtatatttacattatacaatgtacaattatataatgtacaatttacaatgtgcaattaaataatgtac

SEQ ID NO: 20222 - DNA, 201 bp, Homo sapiens
tgttatcccaaacatccaactattttcttaaataccattaaaaacaaccacaactagatttagaatataaagaaagcctgtatccgacgtggattccattyacatttttcttcagttaagaaaattatatggaatatgactaaatggttcatttaaaaaatataagaattccctttctcaaatatattcttttctcctaga

SEQ ID NO: 20223 - DNA, 201 bp, Homo sapiens
tggttttgaagcaatattaataatcatcttttccccaaggcaaaattaaaatcccacaccaatgagctgggaagcatgcgggcttaccttctgaacaagaygtagggaatgcaattttaacctccaagactaaaggcaaagaaacagcagaacgcagcttgagccacggtttgaggtaagcaaaggagctttcctttaccc

SEQ ID NO: 20224 - DNA, 201 bp, Homo sapiens
ttcaagaccttaaccttgaaaaacaacttttccttttaagcaatctctccttcttaacaaagacataataaacacctgacaggtttgccattgatagctgytttctgtccatctgaagtgagagaagaacaatcagtaaaaaacaaaaacaaaattaacacacactttcatcccaaacaactagcacgggatcaggatatt

SEQ ID NO: 20225 - DNA, 201 bp, Homo sapiens
caagaagcaagacggccaaactgtacacatgggcagccctggctcaggagtgccaagggcaaccagggccgcagcagacacacctgggctatcagccagaygctcagtgctctttgcctttctaaatgttcctgaaacttctcacagtccctgggagtcactgttacctgttacacgcttctccatttcagccgtaggtga

SEQ ID NO: 20226 - DNA, 201 bp, Homo sapiens
aaagagaatgcaaaaggcaggtaggtcacgactacctaattgtccagatttccctgccgagagacagcatttaataatccagtcaagcaaatgggctcatyggtgagtaatgctggtttttggtccatgcttttccacggacctctccatcttaaccttcaactaataagaaacgaaacaactgggaaaatactcattatc

SEQ ID NO: 20227 - DNA, 201 bp, Homo sapiens
catggtgaaaccccatctctactaaaaacacaaaaattagctgggtatggtggctcgcacctgtaatcccagctactggggaggctgaggcacaagaatcmcttgaacccaggaggtaaggctgcagtgagccaagatcgcgccactgcactccagcctggagaacagcacaagactccatctcagaaaaaaaaaaaaaaa

SEQ ID NO: 20228 - DNA, 201 bp, Homo sapiens
aatgatcatgaatggctccaaataccacacacacataaccagacctaagcgaggtatctcgaagtggcaggtggtacacaccctcacctacaaagtactcytgccaaagggaggaggggggaaaataaaacctgaatcacatcaagcttctagatctaactactaacttctggtaccagatggacatgttaaatgatacag

SEQ ID NO: 20229 - DNA, 201 bp, Homo sapiens
gggagtttatattctactgttcaacctcatcgccaaggtctgatctttcacacacaaaaaaaattggcaacctccggcataagtgggttaaaaaaggcctraaagtcatcacagaagctttttactaaatgctaggttaagtttagagcttccactatccaaaatacgaagatccacaagcagcacagacacaagaccaaa

SEQ ID NO: 20230 - DNA, 201 bp, Homo sapiens
gcaattctcctgcctcagcctcctgagtagctgggattacaggcgcccaccaccatgcccagctaatttttatatttttaatagagatggggtttcaccakgttggtcaggctggtctcgaactcctgaccttgtgatccgcccgccttggcctcccaaagtgctgggattacaggcgtgagccactgcgcctggcctaat

SEQ ID NO: 20231 - DNA, 201 bp, Homo sapiens
ctggagtgcagtggtgcaatcatagctcactaaagctgggaactcctgggctcaaataatcatcccttggcatcccaaaatgctgggattataggcataarccaccatgcctggtcaataaatagctttaatgattgaaaacccaaaacaacacctgaaatgcttttgagatgttacactcactaccttcatcttaagaaa

SEQ ID NO: 20232 - DNA, 201 bp, Homo sapiens
acttcacgattcaggccaaaggcttctgaaactgcagagatatcattgctatgcaagaaacccagagcctttgataagtaaaaacagggaacttgacatcygcccagaccatcagtcaatgtcgtgaccatgcaagaccacaagcttccccctcgtccatccgaggaggagacaactgggaatggtgtcttaacagcgtgg

SEQ ID NO: 20233 - DNA, 201 bp, Homo sapiens
ctaaaagaccagctctccaccaactgtacccatattaaagctcccctcgatccgggccccttcccacatgcccaccagcagtaaagattaccatgctcctwgcaccagagtggggcctgtcctcaagtctcaggagaaattcacgcttctacagcctctacttctgtgcctgcttctcccaaaagcttacccaaatctcac

SEQ ID NO: 20234 - DNA, 201 bp, Homo sapiens
ccctcgatccgggccccttcccacatgcccaccagcagtaaagattaccatgctccttgcaccagagtggggcctgtcctcaagtctcaggagaaattcaygcttctacagcctctacttctgtgcctgcttctcccaaaagcttacccaaatctcactgtagtccagtcaccatctgtgggttagagaccccaccccaag

SEQ ID NO: 20235 - DNA, 201 bp, Homo sapiens
tgcaccagagtggggcctgtcctcaagtctcaggagaaattcacgcttctacagcctctacttctgtgcctgcttctcccaaaagcttacccaaatctcaytgtagtccagtcaccatctgtgggttagagaccccaccccaagtggctggcagcccatgacagcatggacagccctgagcatgacaagctcagttccttc

SEQ ID NO: 20236 - DNA, 201 bp, Homo sapiens
gaccttcttcccagaggggattttggctcccagcacctgggcccactgggagggggtagctcttgggtgcttcagccagctccagcctctggggcaccacygccagcccaggtgcaaggccctcagctctgtttccccgagaggggagaggtgacaatacctctccagaagagcaattatcagatttggcttggtgaacaa

SEQ ID NO: 20237 - DNA, 201 bp, Homo sapiens
aacatagtgagatgcccacttctactaaaaacttataaagaaaaaggctgggcagtggctcatgcctgtaaccccagcactttaggtggctgaggtaggcrgatcacttgaggccagaagctcgagaccagcccggcaaaaccccatctctagtaagaaaatataaaaattagcgaggtgtgatgacacatgcctgtaatc

SEQ ID NO: 20238 - DNA, 201 bp, Homo sapiens
gtgcctggctaatatttttatttttgatagagaccaggtctctctatgttgcccaggctggtatcgaactcctgggctcaagtgatcctcccactttggcytcccaaaattctgggattacaggcatgagccaccaagcttggccaatagtggtttcttaatgtggtataagagggaaaacacaggtcccagctccctgtc

SEQ ID NO: 20239 - DNA, 201 bp, Homo sapiens
cttggccaatagtggtttcttaatgtggtataagagggaaaacacaggtcccagctccctgtctctgtgaccctgacctgagtcttcagtttctatgagcytcatgttccccatagccacaagtaaaggaggaaataaaagctaacttatctttggtaaatcccctcactttctctttccctctctccttttgtccccttt

SEQ ID NO: 20240 - DNA, 201 bp, Homo sapiens
tattctgagtagcatgatgaaatctcccacaaacccacccaggatgggaatcctccctctgtccagcatttccatgctgcagacgtcacccacctttagtyatttagtagccaccctgggcgctcagatctattgtcatggcatcacaatactggtgttcaagtcacccttattttacttaataatggcccccaaagagca

SEQ ID NO: 20241 - DNA, 201 bp, Homo sapiens
gcaaggtttctcagcctcagcactactggcatttggagctgaaaaactctttgttgggggtgtcgtcccgtgcactgtaggatggttaacagcatccctgraccccaccctcaagaagccaacagcatccccatcccaagtcctgacaactaaaattatctgaggcattgccagggtggcaaaatcacatggatcagaacc

SEQ ID NO: 20242 - DNA, 201 bp, Homo sapiens
acagcatccccatcccaagtcctgacaactaaaattatctgaggcattgccagggtggcaaaatcacatggatcagaaccaccgcactaaagttttttacrgcctttctggacaggctatagaatcttaaatcaaatgttgacctcagacagaagttgcaagacaatgacagcagtcttttagccacgttagcaaatgata

SEQ ID NO: 20243 - DNA, 201 bp, Homo sapiens
agtgtgatctctggaccagcagcaccagaatcccctgaagagttagaaatgcaaattctcaggacccactccaggtctatgaatcaggaactctgagagtrgggccctgcaatctgtatcttctgatgttctccaggtgatgcggatgcaggttcaggtttgagaacgtgccatacagcttgctttgacacaccaaatggg

SEQ ID NO: 20244 - DNA, 201 bp, Homo sapiens
aagcacttgtctgacatatacgccaatactcccaacccaaccctggctcattagcaaaatccctacctcagcctggggagttttactggggagtttcttgytttgtttttcggtaaacttcaatatgttacccaattatgcctggggaattttaaaacaaaaacccacagacacctagaaccgcaacctaaatgactgaat

SEQ ID NO: 20245 - DNA, 201 bp, Homo sapiens
gtttgagcaaactttaggaaaagaatttggagtttaccaagaagacaaaggaggaagaagggacaaattttccagaaaaatggagccacacagccaagacktattgcttggagacagcagagaaaatgctgcatggggtctggggtgataatggggtaatcaaaggtcttgtgttctaaactcagaaagttggactttatc

SEQ ID NO: 20246 - DNA, 201 bp, Homo sapiens
aactcagaaagttggactttatcctaaagataacagggaaattgtgaatgtttttaagctactttgtatatgatgaactgtggaaggcaaggaaatcagtyaggaattggatttgaaagaaacttcaccaatacagtgactcgcatccttttattcaagcaaactagatcccttcaccctcccaatatccccagtctgcac

SEQ ID NO: 20247 - DNA, 201 bp, Homo sapiens
tcagtcaggaattggatttgaaagaaacttcaccaatacagtgactcgcatccttttattcaagcaaactagatcccttcaccctcccaatatccccagtytgcacaattctcacctcccctgcttggtcgtaactctgtgactctaccacaaaaataagcagatgcacaagaagtcagtttaaaattccacatcctattt

SEQ ID NO: 20248 - DNA, 201 bp, Homo sapiens
gaattggatttgaaagaaacttcaccaatacagtgactcgcatccttttattcaagcaaactagatcccttcaccctcccaatatccccagtctgcacaawtctcacctcccctgcttggtcgtaactctgtgactctaccacaaaaataagcagatgcacaagaagtcagtttaaaattccacatcctatttctcattta

SEQ ID NO: 20249 - DNA, 201 bp, Homo sapiens
tgcctgtaatcccagctactcaggaagctaaggcggaagaatcacttgaacccaagaggcagatgttgcagtgagccaaaatcacaccactgcaactccascctgggcgacagagcaagactccctatcaaaaaaaagaaattacctagaactagcatagcagtaacataaaaagctgtatctatgagcagctcttcttat

SEQ ID NO: 20250 - DNA, 201 bp, Homo sapiens
gcagtaacataaaaagctgtatctatgagcagctcttcttatccacaaaacatatcttaaattcattgtcattaaaacaagatattagaaaggaatggctyatccatttactagtattaatggtgacatggctattgaagaagaaaaaaacacaaaaaaaagtaataaaccttatatacagagttttacacaattagaact

SEQ ID NO: 20251 - DNA, 201 bp, Homo sapiens
tggggccctggtgacaaacaagaggactgagcaaagaagtcaacgtgttgaggacagcaggagtcaagtttctcactactgaaggatgaagatacaaatayggaaagagggagaaccagaacaaagcatgagatttttgaactgtgatttgaagcactggtgtgaagtctatctaatttgtttcctaatacagatctatat

SEQ ID NO: 20252 - DNA, 201 bp, Homo sapiens
gctgctggctgttaattcaaggttaatgattaattatatattaaaaaaggtgtctctaagcagacacatgcataaaacaaggttatatattaaatggctgrcaaaaatgtgaccaaaggcgcataggaacctaaccctgtatttcgcctggaagcaatggttcagtattcactagtcctgtgtttgtggagactttataga

SEQ ID NO: 20253 - DNA, 201 bp, Homo sapiens
catgcacctgtaatcctagctacttgtgagactgaggcaggagaatcacttgaacccaggaagcagaggttacagtgagccgagatcgtgccactgtactycagcctgggtaacagagactctgtctcaaaaaagaaaaaaaaaaaatgcatagtacccagcactctttctaaatatagtatccacttatgaaaaagaata

SEQ ID NO: 20254 - DNA, 201 bp, Homo sapiens
ataaatgagtgaataaatggggaaaacagaatatttcttactgtagaatgccaaccaattaagaacagaattaacaatagaatcagaaaaaaaaaaatcaycatttggcaacttccacagtaataagtgattcagttattgaaaagccatccacggttgctaaaatcagtgggtaaaagtttcatgagaagcaagatattt

SEQ ID NO: 20255 - DNA, 201 bp, Homo sapiens
acatacaagaggcttaggcacctgtgggcgtgtgtgtgctcacagccagcaaaatgaaaaaaaatcccagctctgaaggagaggcaagtgcatggcttccrtacagattgaaaatatgtcttagcatgaaaattaaatatgcttacccaaggcagacttagataactgtgaagggggaaagactaaaatggggggaaataa

SEQ ID NO: 20256 - DNA, 201 bp, Homo sapiens
gacagggctgagactagtccagacagcagagttcagagccctcgcaccaacaagcgacaggctctcgggagccagccaggccatcttcccccattagtaartggggcattatccctttggtgaggtgcctgggtagcattggcccctgggctctctcctgtttctgtgcactgcattaccagctgatatggtttggttgtg

SEQ ID NO: 20257 - DNA, 201 bp, Homo sapiens
taagagaggataaaggaagggagggaggaagacgaccagaaaatccacatttgtatagctcttcaacgttgggcatttgataggcattaggttttctccaygaaaagagggacagtcacccaactattaatattggtgttatctgtggttggaaattaaattaatatattttgttagtattttctctaatcaacaatgact

SEQ ID NO: 20258 - DNA, 201 bp, Homo sapiens
acatttgtatagctcttcaacgttgggcatttgataggcattaggttttctccacgaaaagagggacagtcacccaactattaatattggtgttatctgtrgttggaaattaaattaatatattttgttagtattttctctaatcaacaatgactgtgggaaggggaagagaaaaaatgacttttttcatcttttaataca

SEQ ID NO: 20259 - DNA, 201 bp, Homo sapiens
actttgggaggctgaggcgagacgattataaggtcaggagatcgagactatcctggttaacatggtgaaactccatctctactaaaaatacaaaaaattakcctggcatggtggcagccgcctgtagtcccagctactcgggaggctgaggcaggagaatggcgtgaacctgggaggcggagcttgcagtgagccgagatc

SEQ ID NO: 20260 - DNA, 201 bp, Homo sapiens
agagacagggctgtaaacaatgagatctccaaaggcagtcactgctggcctaggaagcagaggataagaaggtcacacgctggcctttggttcgcagaggyccccgtcagctgtgccattcttacaaagaagcctacacagaggttgtttattctctaaggccacagctatgattaacagattattactctataaaaccac

SEQ ID NO: 20261 - DNA, 201 bp, Homo sapiens
aaccgagtgtggtggcacacgcctgtagtcccagctacttaggaggctgaggcaggagaatcgcttgaatccgggaggcaaaagttggagttagccgaagycgcaccactgcactccagactgggcgacagagcgagactcagtctcaaaaataaataaatacaataaataaataaacaaagtatacaacccacaactcac

SEQ ID NO: 20262 - DNA, 201 bp, Homo sapiens
tatgtatacttcatattatgtataatatgaacttcagctccattcatggtcatatcatctaacctgggatactcttaggagtgaaagggggagcttaatartggcagtgtgataagggatataaaccaggattctcctgggccaactggtacaggtgaaaaggatgactgaaacggcagaggtcctccattcttctagatg

SEQ ID NO: 20263 - DNA, 201 bp, Homo sapiens
gggatactcttaggagtgaaagggggagcttaatagtggcagtgtgataagggatataaaccaggattctcctgggccaactggtacaggtgaaaaggatractgaaacggcagaggtcctccattcttctagatgggtgatcaaggcagaggttcccaggaggaccaagcccagacagagaggcaaggggcggtggctca

SEQ ID NO: 20264 - DNA, 201 bp, Homo sapiens
ctattggccaggtctcagtttcatggtcacctctgaccacaaggttggggtagaaaacatagtccaggctgggcatggcggctcacgcctgtaatcccagsactttgggaggcccaggtgggtggatcacccgaggtcaggagttcaagaccagcctggacaacatgttgaaaccccatctctcctaaaagtacaaaaaat

SEQ ID NO: 20265 - DNA, 201 bp, Homo sapiens
ggaagcagtaagcgcctcaaatcaggatcacctggagcacttgaaacctcaccacccccacccacacacccagtgtttccagttttactgaatcagtccaragtggatgctggagaatctgcatctcttagaatctcccaagtgatgccgatgctgctgctctgagtgctatgctttgagaacagctgccctaaagcacac

SEQ ID NO: 20266 - DNA, 201 bp, Homo sapiens
ctgcatctcttagaatctcccaagtgatgccgatgctgctgctctgagtgctatgctttgagaacagctgccctaaagcacactaatagttgttacacatkcatcatctccaactgcaggtactttaagaatttcccttgagaaactctagccttccagaacagggagcgccttctccatgcatttccgacagcacctgaa

SEQ ID NO: 20267 - DNA, 201 bp, Homo sapiens
aacagaggtctactagctccttcccttccatcagggaaaccggaaatgaacacctactcaagtcatcaatgggagcgcatcacttcctatttccctgccayctacattttgaaaatgcagggggagaaaaatataaggaggcaggagtcacatctgtaatcccagactttgggtggccgaagcgggaggaacacttgagcc

SEQ ID NO: 20268 - DNA, 201 bp, Homo sapiens
ctggggtggttttaagaaggtagaactcctggtaggaaccacctgcatcaagaccatggatcacctctctgaaggttagcgattccagggaccccacctcygagctgtcctcctacgtggaagtgaaagtattggaaacaggggaaagaagctggtcaaagacagactccagtcgtggcggtgcatgtcccagttaaaagc

SEQ ID NO: 20269 - DNA, 201 bp, Homo sapiens
tgtgggtcgtgttgacgcttagaagatgctctgaaagattctatcccaggcagtctgctgaatgatttcctgggtcgcattaagtattgcacagtccctcwagactatgtttctttttttcaaccaacattgagccttggagacaaagccatacaaagttaaaaaggaaagtctctctgtttacaatgcttggagatcagg

SEQ ID NO: 20270 - DNA, 201 bp, Homo sapiens
taaactaaaaataaaaattgtggtacaatacacatagcataaaatttactgcttttgccatttcaaagtcaacatttcagtggtcttaaggacattcacaytgttttgcagccatcaccaccatccattcacaagacgcttttcatctgacaaaactgaagtcctatgtgaaataatgtaactcccaaccccccaccttcc

SEQ ID NO: 20271 - DNA, 201 bp, Homo sapiens
tctggaagtggaactgctggatcacgttagctctcattttttgaggaatctctacagtgttttccaaagtggctgcaccattttacattcccaccaacagkgcacagggttccaatttcttcacatcctccaaattacttaagcgtgattccaattgttttagaggtcagtgctaggatagccataactgtacttggtcta

SEQ ID NO: 20272 - DNA, 201 bp, Homo sapiens
acacacagagagagagaaatgaacaaagctggatatctgatgaaaatacctgttgaaaatatctgctcataaaaacatgctctattgggtgaaaaaaaaamcaatcctttcatccaattaaaaaaagcaataagagtaaaagcaattaaacatagtagctcttataaaaggggcaggtaaggacgctatgacttgcatacc

SEQ ID NO: 20273 - DNA, 201 bp, Homo sapiens
tatctgatgaaaatacctgttgaaaatatctgctcataaaaacatgctctattgggtgaaaaaaaaaacaatcctttcatccaattaaaaaaagcaataasagtaaaagcaattaaacatagtagctcttataaaaggggcaggtaaggacgctatgacttgcatacctgaggtatgattgacatcttcttccttaaatcg

SEQ ID NO: 20274 - DNA, 201 bp, Homo sapiens
ttgggtgaaaaaaaaaacaatcctttcatccaattaaaaaaagcaataagagtaaaagcaattaaacatagtagctcttataaaaggggcaggtaaggackctatgacttgcatacctgaggtatgattgacatcttcttccttaaatcgtgaagtccaatttcagttgtcaagatcttatcaatccaaattttaccttcg

SEQ ID NO: 20275 - DNA, 201 bp, Homo sapiens
taaaaaaagcaataagagtaaaagcaattaaacatagtagctcttataaaaggggcaggtaaggacgctatgacttgcatacctgaggtatgattgacatyttcttccttaaatcgtgaagtccaatttcagttgtcaagatcttatcaatccaaattttaccttcgggttctgacaatctaaaaagggctgagatgaggg

SEQ ID NO: 20276 - DNA, 201 bp, Homo sapiens
tcacaggctcaaaacacccatctcccaggttttctcaactccaagcactaaaaatattacttgttctgtttcttgactcaataccctcactttaatttctkcagccattacctcagtgcaaggctgcattaacatttgaaaaacaaaaactcttttgctagttataatcagtgcaagtgaattcgaaaaataaataaatgc

SEQ ID NO: 20277 - DNA, 201 bp, Homo sapiens
ctattatttaataaaagtatttacttcagtagctacataatattacagtatatatgattatttattcaacaaatcccctatttgtggatgtttaggctccratattttgctattgtaaataataccatgttaaatatccttgaagctacatctttgcaagcaaccttaattggtttcttaaaataaattcttagatgtgga

SEQ ID NO: 20278 - DNA, 201 bp, Homo sapiens
gaactcaaatacatcgctgtgctgagctggtatgaggacagagactgctattcatggaaggctgtatggtgggatgaaaactgtgatagaagacagagatsaccggaaaggtgcaaatgaatgcataaatggggaatcacacagaattaaattgtaatgtaaattcataatttgcagaatataaaagtaaaaaaacaaaaa

SEQ ID NO: 20279 - DNA, 201 bp, Homo sapiens
gaagtttcttggaaatcacagattattagtcatccaaaattgcttaccggagagcaacggctttaatgcaggggcaggagtgggggtggttcttgtcccastgcaattttaatcaaaagggtggggtgggcctgacagtctgcatttctaacatgtttccaagcagaggcaggtgatgctgatcccagcccctgagatgag

SEQ ID NO: 20280 - DNA, 201 bp, Homo sapiens
atctacctctagagctgaaaaatgctttaaaatggcccagtactctctaaaatgattaaatcaaccacaaaaccatctaaatgaaaaatgcagccagtgtytggaatctaaccaggaaggctagggtggtatatacctcattttggttcattcttttttacttgctatttcttctgtgaattagaaacctacttagcgcct

SEQ ID NO: 20281 - DNA, 201 bp, Homo sapiens
cctgccgcccaccatcctactttctgtctccatgactaactactccaggtacccacatgtaagtggaaccttatagcaccgtccttaggtgtctggcctarttcactcagcataatgtcctcagggctcatccatgtcagaatcacacatgtcagcatgtgtcagaatcaccttctttttaagtctggataatattccatt

SEQ ID NO: 20282 - DNA, 201 bp, Homo sapiens
ctcagcataatgtcctcagggctcatccatgtcagaatcacacatgtcagcatgtgtcagaatcaccttctttttaagtctggataatattccattatgcrtgcgtatcacattttgtttttccattcctcagtcaatggacacttgggctgcttccacctactgctcactgcaaataatgctgttatgaacacgggtggg

SEQ ID NO: 20283 - DNA, 201 bp, Homo sapiens
ttatgcgtgcgtatcacattttgtttttccattcctcagtcaatggacacttgggctgcttccacctactgctcactgcaaataatgctgttatgaacacrggtgggccacagatgttacattaaagaatctggccaggcatggtggctcatgcctgtaatcccaggcatgatttgggaggttaaggtgggcggatcactt

SEQ ID NO: 20284 - DNA, 201 bp, Homo sapiens
ggttaaggtgggcggatcactttagctcaggagttcgagaccagccatggccaacatggcaaaacctggtctctactaaaaattcaaaaatgagttgggtrtggtggtgcacacctataatcccagctacgggggaggttgaagcaggaaaatcgcttgaacctgggaggtggaggttgcagtgtgccgggaatgtgacat

SEQ ID NO: 20285 - DNA, 201 bp, Homo sapiens
attaaaggcaagaaaattttgtaaaggaaaggaatacttagagccaccaatcaagaatcttttgctggctgggcgcggtggctcatgcctataatcccagyactttgggaggccggggcaggtggatcacctaaggtcaggtgtttgacaccagcctggtcaacatggtgaaaccccatttctactaaaaatacaaaaatt

SEQ ID NO: 20286 - DNA, 201 bp, Homo sapiens
cagagcaaccataagactcagaaaaagatgtatatattttattttacattaactttaaacagatggaggaaggatcttaaaaaaaatctgttaccaaagaygtaaaaataacagttttaatatttcacataagaatggcttttataccatttaatggcaaggagattgaaaaggcaaagaacgtgaaggtaaatattacca

SEQ ID NO: 20287 - DNA, 201 bp, Homo sapiens
agtattgtaatgcactgttgttactggggtggtgaactcatgccctgcttgtctggtacccatgtggcattgaagataatactctcctgctgagaattttyctcaacctcatgcaccaggcaactacaaacaatagattcaagtagttggaaggctaacaccctaagttggacaaaatgcttcagaataaattggttttct

SEQ ID NO: 20288 - DNA, 201 bp, Homo sapiens
tgggtgctgcaatgcccttgtgccgtgcccaaggaacctgcccagccaagatgtctctgaatggtcttaacattggctccaggaaccggacggatgttttyatgactgccccactgcaaacttgtcctgatctctggaggtctctatggcatgtgccattgcttttttcagaatctgactgtggtctcagtgggttcttca

SEQ ID NO: 20289 - DNA, 201 bp, Homo sapiens
atatcccatgaggttccctgaccagctgctcctccttgagccattgtgtttttgtttgtgtggtgtaggtttttttttttttttttaagagggagttgccrccctgccccgacctgcccccgttcaagcgattctcctgcctcagccccctaagtagctgggattacagatgtccaccaccacggccggctaatttttgaa

SEQ ID NO: 20290 - DNA, 201 bp, Homo sapiens
gggctccagcaatcaggctgcctcagccacccaaagtgctaggattacaggtgtgagccaccgtgcgtggccaatctatcttacaggcgatggctacataygttttataaaatgatgagggggtagggtgggggtaaggggcggagggagtggaaaatttaagagaaaaattctaactcattttctgggtcggactcttag

SEQ ID NO: 20291 - DNA, 201 bp, Homo sapiens
agtcatggggacagagtcctggaatgaaattcttcaacatagctattgtcatttgctttcctcatcaggagatccaagtcgccactgttttatctccaacwgggtttcagggcagggtcaacttgagaaattaggtaccatcccagttttggaacacccgggaatatcatgaagatcaagctacacactttaattcacacc

SEQ ID NO: 20292 - DNA, 201 bp, Homo sapiens
tctgcctcctgggttcaagtgattctcctgcctcagcctgccaagtgcaatggcacaatctcagctcactgcaacctccacctcctgggttcaagcgattmtcatgtctcagcctcccaagtagctgggattacaggcatgcaccatcacgcccagctaattttgtatttttagcagagatggggtttctccatgttggtc

SEQ ID NO: 20293 - DNA, 201 bp, Homo sapiens
gtagttccagcactttgggaggctgaggcaggtggatcacttgaggtcaggagttcaagaccagcctggccaacatggtgaaaccccatctctactaatartatgaaaatagtgaggtgtggtggtgcacacttgtaatcccagctacttgggaggctgaggcatgagaatcacttgaacccaggaggtggaggctgcagt

SEQ ID NO: 20294 - DNA, 201 bp, Homo sapiens
cataaaatgtcttcctcatgattccaaaactaggaaattgaagagagcaacagactatatgttttctaaactgatatatctccttgtgatctaaggggatyattttcagtgtccatatatatataaacagcctgagggggaaaaacctcaaactgtgacattagaacaagcaccgctggtaacaaatggaaaactgaaaat

SEQ ID NO: 20295 - DNA, 201 bp, Homo sapiens
tttttttagctttaacacttggatatgcattaaattttccacgattaggagagtatttcaaacgtctatttcagaggcacatgataacaatagcaaatgayatgtatgagcacgtgcaaggcactgtgctaacgggtctgtgaatgttcacttacccatcacctcacccagcaaggtgacattatctttggaaattacctt

SEQ ID NO: 20296 - DNA, 201 bp, Homo sapiens
tcacggtctatggcttcgggaaatatgagtgcaactcaagttagtccctacctactctgaaaccacaacgcttgcttcttgagaaggatagaacagtgggrgacgtgcagattcacgttatacatgctctgaggcctccaaagttcactgtcttacataaaagtacatgacttcagcagaaagtacagagtgctatagaaa

SEQ ID NO: 20297 - DNA, 201 bp, Homo sapiens
tggctatcactcctgcttagaagggtttcaggaactctctcttggctaatcataattaaagtaaaacatttaaaataactccacctcaggattaaattacrcaagttacaggaggccataacttgtaacaagtaaataaatgaatgaatgaatgaatgaatgaatgaggacatgcagcctaataaaaggcagaattaatta

SEQ ID NO: 20298 - DNA, 201 bp, Homo sapiens
tggtaaatactttggctatcactcctgcttagaagggtttcaggaactctctcttggctaatcataattaaagtaaaacatttaaaataactccacctcargattaaattacgcaagttacaggaggccataacttgtaacaagtaaataaatgaatgaatgaatgaatgaatgaatgaggacatgcagcctaataaaagg

SEQ ID NO: 20299 - DNA, 201 bp, Homo sapiens
ctccatgacatcaagctactttactggacacatttgcaagttctattaaatgtctactaataaaaattagccaataaatttccaggcagggctgacacaartgacgatggccaaagcagccgctgacagcccaggcctcttctgataggctactgcctgctgtactggatggtaaatactttggctatcactcctgcttag

SEQ ID NO: 20300 - DNA, 201 bp, Homo sapiens
ttgtaaagaggaagcatttaggaggggcacaagtgcagtttggagagatggacgttttacacatttgactttggctggagaaagtagtccacagaagatasccaagagattgactcggcttctgcctgtgtgtgcacagacagagcccacactaactcatcccggtgccttcctcactgagagcaggcaactggacaagat

SEQ ID NO: 20301 - DNA, 201 bp, Homo sapiens
acaacaacccacgcctaacttctcaaaccctaccttagatctatgcctaaacatacagcatgaaaacttgtaagtaatttttgacttatctttattttacrtaattaccagcatgtctttacttttcatttaaaataacctcatttacatccttatttattcatctgtcaaatcaaagctattaagtttttagaaacagtg

SEQ ID NO: 20302 - DNA, 201 bp, Homo sapiens
ccctgtctctactaaaactacaaaatacttaggtgggcgtggtggtgggcgcctttaatcccaggtacatgggaagctgaggcagagaattgcttgagctygggaggcggaggttgccgtgagccaagatgatggatgctactgcactccaggctgggcgacagaacgagactccgtcaaaaaaaaaaaaaaaaaaaaaag

SEQ ID NO: 20303 - DNA, 201 bp, Homo sapiens
agagtcaggttgctcctaacttttttccacaacatagaatattataaaaggtgttaatgaactttttgtcaaaatacaaattcataaatgactctattttrcaaactgattctagaatctaatctgaagttaaagtcacctccggaattctgatacgtctcccatgacgaagacttcccaattcccttataaccgtactac

SEQ ID NO: 20304 - DNA, 201 bp, Homo sapiens
caaaggggtggaggccagagcttgggttagttaaagccactggcatctgcatggccctggacagtaagcaggtatcagaagggaagggccccagaaggctrtggggtgggggtgctacaagtccttggctgatgcgcgggcacaggtcaaggccgcccaagccttaacagagagctggtgctgaggaggagtgagctgaat

SEQ ID NO: 20305 - DNA, 201 bp, Homo sapiens
agccttaacagagagctggtgctgaggaggagtgagctgaatagagatactgaaggtcaagctgaggtgaggtactgaaattctcaccagaccagagtgcrgaaacctcattcatatatcattaacacacctggcatacggttgaaacaccagagagatcatgtcttagaattcaagagcactatccagagaaataattct

SEQ ID NO: 20306 - DNA, 201 bp, Homo sapiens
gctggtgctgaggaggagtgagctgaatagagatactgaaggtcaagctgaggtgaggtactgaaattctcaccagaccagagtgcggaaacctcattcayatatcattaacacacctggcatacggttgaaacaccagagagatcatgtcttagaattcaagagcactatccagagaaataattctcaaacagggcaatt

SEQ ID NO: 20307 - DNA, 201 bp, Homo sapiens
gtcacagaggttcaaatttcataaagtgttagcaacagcagctgagattttggaatatgtatagcttttaatagatgcatttccaaaataaacacttgggraaaaaaaagtgccccagcttgaaccactgacaagtagacaaaattaaacaataggaaaaaataaaataaaaccaaaccacatgagcaacagtactgaata

SEQ ID NO: 20308 - DNA, 201 bp, Homo sapiens
atcaaaacccagggcccgtgatgtcagcagcatgtttattacccatagaacctgatgacagccacaaaacccagggccccagtgtccgaagcatgttttgstaaggatgttaaacacaaagtcatccaggaaatttcctactatctgaattttgaaaggggctaaataaaccctgtagaagaattgatgcggtagacgagg

SEQ ID NO: 20309 - DNA, 201 bp, Homo sapiens
ctggctttccttccaaaaggcctaatcaaaaacctcacctttctttattcactactgttgcacacctgagccaatctgagttccaaagtgacacattaccytcgctgcccctctgggtttcttcccttaatacaggacagcaaatgacacccacttttaagttaccagtgtcactgttcccatctgcaatgagtgccaaca

SEQ ID NO: 20310 - DNA, 201 bp, Homo sapiens
tttgtattctataagttatttatttccagtgatatatttatatcttatgatatattcaaaaacttcccttaattctggctttccttccaaaaggcctaatyaaaaacctcacctttctttattcactactgttgcacacctgagccaatctgagttccaaagtgacacattaccctcgctgcccctctgggtttcttccct

SEQ ID NO: 20311 - DNA, 201 bp, Homo sapiens
aggaagccataattgaacttaaagtgaaagagctaggattggaaatttgtctcgtgctgagaccttaaccattctctcctacagtatcccttctattgtargtcttatcacacagcatggtaactgctttctatctgtccctcccaatagagtaaactcatagaagaagggaattcaatttcacttagccccatatctcca

SEQ ID NO: 20312 - DNA, 201 bp, Homo sapiens
cacattgggaggctgatatgggtggaccacctgaggtcaggagttcaagaccagcctggccaacatggtgaaaccccatctctactaaaaataaaaaaatyagccaggcatagtggcagtcacctgtaatcccagctacccgggaggctgaggcaggacaatcacttggaacagggaggcagaagctacagtgagccgaga

SEQ ID NO: 20313 - DNA, 201 bp, Homo sapiens
taacgttgggcaaaacatatgacacagctgttttcaggcactggaccacaggtaacacaggctgtgagcctcaagagacgggaaatgtaggtggtggcccrggactgacctggctttatgcctgaggacattttctgcccaagcaaaacagtttcactgagcggtggaggaagagatggttgttccaagttgtagaagcat

SEQ ID NO: 20314 - DNA, 201 bp, Homo sapiens
gctatggggctgagtgctgaccgaagattctggaggtcatgcagtaggagatgccgcccgaggagaggaaggaaatctccactggggcctcaggcattcamctgagacaccaggaaggctatgtcttagtaataaagatctcaccctagattaacagctgtgcacttggaataagttcagaatggagctacctgccctatg

SEQ ID NO: 20315 - DNA, 201 bp, Homo sapiens
aagattctggaggtcatgcagtaggagatgccgcccgaggagaggaaggaaatctccactggggcctcaggcattcacctgagacaccaggaaggctatgycttagtaataaagatctcaccctagattaacagctgtgcacttggaataagttcagaatggagctacctgccctatgattaactgattgacagacagaca

SEQ ID NO: 20316 - DNA, 201 bp, Homo sapiens
gaataagttcagaatggagctacctgccctatgattaactgattgacagacagacagaaggattcaatgctaaaggggccaatctgccaggaatttaactrcctgcatgaacaaaactcaatgctctttaatccagactccctatagtatatcgatcataatgttcaacatagtaaaacaattactagatacacaaggaaa

SEQ ID NO: 20317 - DNA, 201 bp, Homo sapiens
cttctcaaactgaaaaggtaatacctgaaatgaaaaataaattagatatcattaatagcagatactttccattgatttattcccagagtcgctaacccttycttctatagtttacaactgaaatctgaagaacaaacagaaaaaaagagttaagaaaaagaacaaagactgaatgaaggtccttatggaagaatattaagc

SEQ ID NO: 20318 - DNA, 201 bp, Homo sapiens
acaactgaaatctgaagaacaaacagaaaaaaagagttaagaaaaagaacaaagactgaatgaaggtccttatggaagaatattaagcaataaaatattcrtgtaattggagtcctaaaagaagaagaaataggggaagaaaaaatatttgaacaaataatgactggaattttaccaaagttggtagcaaatattaattta

SEQ ID NO: 20319 - DNA, 201 bp, Homo sapiens
agttaagaaaaagaacaaagactgaatgaaggtccttatggaagaatattaagcaataaaatattcatgtaattggagtcctaaaagaagaagaaataggrgaagaaaaaatatttgaacaaataatgactggaattttaccaaagttggtagcaaatattaatttacataatgaagaatcttagcaagttcaatgaagga

SEQ ID NO: 20320 - DNA, 201 bp, Homo sapiens
agctataaggagatggtatcaaatggaaactcagatctacagaaagaataaagagaaaccaaaatgaccaatgtgagtaaatataaggacaggctgggcaygatagctcatgcctgttatcccaacattttgggaggctgaggcagtcaaattgcttgagctcaggagttcgcgaccagcctgggctccacaaaaaatata

SEQ ID NO: 20321 - DNA, 201 bp, Homo sapiens
agagaatgaccttttcatggaactgagttttccagactggtgagatgaatatccctttttggattaaatgcattaatccaatcttcattttaacagatgtytttcccccctctctaatagtccttttaaaacagaagatgcggctgggcacggtggctcatgcctgtaatcctagcactttgggaggccagggagggcgga

SEQ ID NO: 20322 - DNA, 201 bp, Homo sapiens
ttaacagatgtctttcccccctctctaatagtccttttaaaacagaagatgcggctgggcacggtggctcatgcctgtaatcctagcactttgggaggccrgggagggcggatcaccttagatcaggagttcgagaccagcctggccaacatggtgaaaccccgtctctactaaaaatacaaaaattagctgggcatggtg

SEQ ID NO: 20323 - DNA, 201 bp, Homo sapiens
atggtgactaagcctagtggcctcagcactgctggacactgaattgcaatggggtaagtgaagagttccaaagccaagggaagcctcccaacagcatagcytggaatggagtgatctgctgtccaaccccaagatgctgatgcagatgatgatgataacagcaagatagaggagacatccactgccacaaagacctttttc

SEQ ID NO: 20324 - DNA, 201 bp, Homo sapiens
aattctcccgaaaacagaaaacctcatacaacaaagccaaacctgaaacacaatcaggtttccaccaggcagaagtatggtgactaagcctagtggcctcrgcactgctggacactgaattgcaatggggtaagtgaagagttccaaagccaagggaagcctcccaacagcatagcttggaatggagtgatctgctgtcca

SEQ ID NO: 20325 - DNA, 201 bp, Homo sapiens
caaaatgtcaacaccaaactctaagcctaagctgacccttttcaagaaatctgaagtcaattgtgcccaacttgaactatcatccacagattgtgtctgakgccaacaatgaggatttaggtaagacagcacagatgccaatttgtgaaaaagacaaagttcttctgggtgcaccaggagggctacttgtaagtcgtgtat

SEQ ID NO: 20326 - DNA, 201 bp, Homo sapiens
gagagaccctggacgatgaaggagggactttatggagggaagggaagggcactgcaggggaggcctagctaggacagaagtacggagaaggaggatgtggrggctgctgaataaagaacaccccaaacctggctgaagcaggtgaagctcatggaagcggggctgaaacaggtgaagcttatggaaatggggctgaagcag

SEQ ID NO: 20327 - DNA, 201 bp, Homo sapiens
ttagggaagaacagagaggctgtcagaggaacaaaatgagaggacgtggactataaatccgtaccaatcactaattctctgtgcaacattattaaacacayggggccttagtctcttcaccctgcctggatcacagggtttcaatgtgttcaatgggaaatgacaaatatggagtatcaactatctggaggacaccaggag

SEQ ID NO: 20328 - DNA, 201 bp, Homo sapiens
actgagcggaggctttagttcattctgatgaatgaataattggaaaaaagaagtggtcctagtgcaaaatgaatatggccagcagctagaatgccctggawaaatgataccgctacaaggtaagtattaaacaatggatactgggcgggtatggtgttcacacctgtaatcccagcactttgggaggccaaggtagcgaga

SEQ ID NO: 20329 - DNA, 201 bp, Homo sapiens
gatcgtgactatcttcactgatgagctgagcattttccagaactctctgccacagaattcagctcccatatgccctggggctccccagtaccccaagaaarcctgtactacagtgcccaccacatactccagtaatttacttgtgtgtttgtctcccagacaggcagtgagcttcttcagaacagaaaccaagtcttattc

SEQ ID NO: 20330 - DNA, 201 bp, Homo sapiens
aggccaggtaggggtggctcatgcctgtaatcccagcactttagaagaccaaggcggcaagatcacatgagcccaggagttcaagactagactgggcaacrtagtgagatcctgtctacaaaaaaatttaaaaattaaccaggcatggtggcacatgcctgtagtcccagctactcaggaggctgaggtggaaagatcgct

SEQ ID NO: 20331 - DNA, 201 bp, Homo sapiens
ggaaaaattggaacactggttgccagcctgggaagcctgggagggtccccagtgattaactgtcaccacactaatggtgacagtactgctttctacatgtrctatcacactggaaaaaacccaaccattgcatctttcattaaaaaagaaaaggtaaaggaattgttagagtgggcctgtgtgaatcctatcatcctgatc

SEQ ID NO: 20332 - DNA, 201 bp, Homo sapiens
acttatgtatattaaaaactaaaaaatcaacaagatttttaaaaacacgttttaaaaagctggcaggagatctgaaccagtatttcagaaaataagacacktgaatggccaattagcctgtatggaaaaagctcaatattaatcatcaaggcaatgcaaatggatcatctatactctactaaaaagaataaaaacaaaaag

SEQ ID NO: 20333 - DNA, 201 bp, Homo sapiens
tttgcaaaacaggaaatattcacaaatgcctaatattaaacatatacaaatacacttatgtatattaaaaactaaaaaatcaacaagatttttaaaaacaygttttaaaaagctggcaggagatctgaaccagtatttcagaaaataagacacttgaatggccaattagcctgtatggaaaaagctcaatattaatcatca

SEQ ID NO: 20334 - DNA, 201 bp, Homo sapiens
ggttagaaatattacagaatatgttatcgaattacaacaaggctaattagaaatcagtagcagtaaggttttttaaaaaaaaaaaatccctaaatctttaraaatgaagttatatactccataataactcactactaaaatattacttcagaaagtcaactcatgggccaggtacagtggctcacgcctataatcccagca

SEQ ID NO: 20335 - DNA, 201 bp, Homo sapiens
tgtcaacctagaatcttctatctgttgaaaagatcattaaaaacaaagttgaaataaagacatgctcagatgggcaaaagctaggagaaggtctctagcaraccagcctgaaaggaagttcttcaggcttaaggaaaatgataccagatggaagctcagacttcagaaagaaataaagagcactggaaaggacaaatatgt

SEQ ID NO: 20336 - DNA, 201 bp, Homo sapiens
gccatgaagagtcataatgtatagtgcaacaagcataataatgatggtttctcatcagaaacaatgaagggagaagacaatgatgtgatatatgtacagtrccaaaaaaaggaaaaaaaaagaaaactgtcaacctagaatcttctatctgttgaaaagatcattaaaaacaaagttgaaataaagacatgctcagatggg

SEQ ID NO: 20337 - DNA, 201 bp, Homo sapiens
cagtcccagaagttaaggagttaaaagagaaagaaaagaaaagtgtatcaaaacataaagtactcataattttccaaaattaaataaaaataccaacccayatattgaagctcattaatcccaagaaggatactaaacacatatagtcaaacagcaaaaactcaaagaggaaattgttttaaaaagcagccatgaagagtc

SEQ ID NO: 20338 - DNA, 201 bp, Homo sapiens
tctttaaagcataaatcatacaggacctataaaacaaaaatacaagttaaaaagcaaaaacaaacaaaaaaaacacaaagtacacagacaacaaacagcgygatgaatacaacagtacctcacatctcaacactaatattgaatgtaaattgcctaaatgctccacttaaaagatacagaagtgcagaatggataaaaact

SEQ ID NO: 20339 - DNA, 201 bp, Homo sapiens
aggagacaccccaaatactctgcagcaagacccacccaaggagagtctgagctcagacatgcctagccctgcccccacctgatggtccttccctacgcacygtggtagtggaagacaaagggcatataatccagggagtcctagggtcctgtgcactgctagttcctcttcatgctaccacagctaatgctctctgcaaag

SEQ ID NO: 20340 - DNA, 201 bp, Homo sapiens
aaaatgatgggcaaagactgacataataaaaaacctaaatctgaataattctattattgaatttaagaatatgaattcatgacacaaaaatttcccatagraaaaacaaagatgggtcacaagatgattttgcagaagttttatcaaattcttctagagaattggaatccagcattatcctgatataaaaaccaaagaaag

SEQ ID NO: 20341 - DNA, 201 bp, Homo sapiens
tagcactattcacaatagcaaacacaaggagtcaacttaggtgcccatcaatggtggcctggataaagaaaatgtggtacatatacaccatggaatactaygcagccatagaaaagaacaaacttatgccctttgcagcaacatggatggagctggaagccattatcccaagcaaattaacaagaaacagaaaaccaaata

SEQ ID NO: 20342 - DNA, 201 bp, Homo sapiens
gtcaactttaactttcacttgtgaaatttgtcatttttcatgctttttgaaaaaggtgaatacatagaatttatacatttggactagttatagcatttttwaaaaataatgtaagtttctcctactcctaagaagtatatccacttctctggaataattccaatattccatttaaatagaacttattttacaaaatttcaa

SEQ ID NO: 20343 - DNA, 201 bp, Homo sapiens
catgctaagtaatagggagtatatagagaagatttatattcgcatgggataattgtaagatgtcactaccattttattctccaaaaagagaagaagaatamatttatagttcccccaaaggaaataaattttatgcgcccaggccattctgacaccaacaggaggaaaaaaaaattaaaaataatgactacttttaaaaaa

SEQ ID NO: 20344 - DNA, 201 bp, Homo sapiens
cgagctgctttcaaactcctggcctcaagcgatcctcctgcctgagcctcccaagtagctgggattatatgacatgagccaccatgcctggcgagcatgaytgtatttggaacactgtctgcctaaagatttctaaacaccagaacaagtctaagacaggctttccaggtgttcaagaggtgctggaacatttgcctatgt

SEQ ID NO: 20345 - DNA, 201 bp, Homo sapiens
atggaataagaaaactccaattataagtgaaaatcagttctcatataaaactcaaattaaactccagttataaatggaaaactctcaaattaaaactccarttataaatgaaaaccagagttctcatatgagaacttcaaagtcaaatctttgaggggaagcagttggccttacagtaaaacagaacagcgtttcaagcta

SEQ ID NO: 20346 - DNA, 201 bp, Homo sapiens
attttattggacaaacacagtgctttctctgttactaagttgtcagtatctccatgtatgatttattatggagaaaaaccatgaatcagaacattctagtrgattaaaaattatgccaaaatgatgcaatatttaccagctgtagacaagtgctacagtaatcgcttacatacagattactgacaaaataacaatagcaat

SEQ ID NO: 20347 - DNA, 201 bp, Homo sapiens
ttttttcttttatctagtgttttagctctcatttaccttaatctataaagaaaaaagaatgatatgaatctggtttttttgttacactgttgaaggcatcratgaacataaatatacatacacacacatactccccacgcacacactggagaaaaaccagttgtgtaaaacacactggctgtaacccaatattaactttta

SEQ ID NO: 20348 - DNA, 201 bp, Homo sapiens
cccacgcacacactggagaaaaaccagttgtgtaaaacacactggctgtaacccaatattaacttttacttccctgagagagtaaacaaacacttctaccracaccagctcttgggttcttaaagccaaattaacaaattgaaagcaagtaaacatttatctggcacccattagagtcagtgtacttagctaaatgttatg

SEQ ID NO: 20349 - DNA, 201 bp, Homo sapiens
acatttaaaataaaaatcatctcttaatttctgaagacttactcttgacctaggatttgtgttacccatttattatgattggaacagaacggaaacagggmtaagacacacacaaaaactgactaggaagaggtagatgcagcgaacagtaccagaaaatatctgcaaatgccctattcaactcaggtcataatcaaaata

SEQ ID NO: 20350 - DNA, 201 bp, Homo sapiens
tagatgcagcgaacagtaccagaaaatatctgcaaatgccctattcaactcaggtcataatcaaaatatgaaggaggtgtccgagggcagctgaaaatgtraggcttcttaacagacacacgtgatcccatcaccaacctacatcaaaagaggaaagaataaaaactagcaatgggtgagaggaggataaaaagacgagaa

SEQ ID NO: 20351 - DNA, 201 bp, Homo sapiens
taatgctacatacattctaagcactcttgtgaaaacagagtgtggcgttaatattagtctggcaagccaaatgttaaattaatcacacagttggggacgcrataacattgtgatctcaaggtaagaaatagaaggcatcctaattcccagacactggatttttccctgctcagcttccctcttaagtaattagtgaagccc

SEQ ID NO: 20352 - DNA, 201 bp, Homo sapiens
cacatcttctgagcacctgcaatctatacgtaatataaagatgaatgaggcactgtgtctgccttttgtaagtttagagtttaggaagggaaagaaatctrtaaacaaatggcttcaataataaggggaaaatgaggacaaagtcacgtatggagagcccaaaagaagagatgaggattaaagagtgtgtgatgggccggg

SEQ ID NO: 20353 - DNA, 201 bp, Homo sapiens
aaataatgctcagttgttaggcattttccaaatctcatagatgtaatgaagctggaggttgacttcacttacacatcttctgagcacctgcaatctatacrtaatataaagatgaatgaggcactgtgtctgccttttgtaagtttagagtttaggaagggaaagaaatctataaacaaatggcttcaataataaggggaa

SEQ ID NO: 20354 - DNA, 201 bp, Homo sapiens
actcacctccttgacattccccagcctacatacaaaggataactccaaccagggtggtttgccttggttccgttttaatctaccaatatcatggaatagarccctgaaaccacagaatccactttgggacaaaagatgaagctttgaacagagtagaccaaagatccataaggccattaacagtgaacaaaaccaggccat

SEQ ID NO: 20355 - DNA, 201 bp, Homo sapiens
aggcccagccaatttttttgtattttcggtagagatgggttttcaccatgttggccaggttggtctcaaactcctgacctcaagtgattccccccgacacyctgacctcccaaattgctgggattacaggcatgagccaccgcgcctcgccaaatggttgttttggagaaagattattctaccacccacagactttactct

SEQ ID NO: 20356 - DNA, 201 bp, Homo sapiens
atataccccgtttgttgcaataatgtgaaatttatctcccttggagaacggtgcacacagatcttataaaatataattaacactcgtttttgttatttccrtcgttttattaagaaattgcaggaggagaaacattaaaacatttgaagacactaagcgggtttcagacccacaatcaggaatttgaccagggcctggaac

SEQ ID NO: 20357 - DNA, 201 bp, Homo sapiens
agccttcagagagcgcggccctgcggacaccttgattttggacttgcagcctcagaacagtgagacaatacatttctgttgttgtaagctgcctaatgtgwggcactttgttctggcagccctaggaaactgacacactagaccaaccccttatttctgtcttgtgaaccactaagacttcaaattacttctgctgtagct

SEQ ID NO: 20358 - DNA, 201 bp, Homo sapiens
tgagccatgagactatctgggggaagcattcctggcagatacagcaggtgcaatggtcccggggcacaaatgcgctgtgcaaaggcaccttcatgcattcrcagtctagtgcgggggctggagggaagaacacataggtggatcaagagcagctcattgagggctgtgggaagacagagaaagcgccatgccctccgagga

SEQ ID NO: 20359 - DNA, 201 bp, Homo sapiens
actatctgggggaagcattcctggcagatacagcaggtgcaatggtcccggggcacaaatgcgctgtgcaaaggcaccttcatgcattcacagtctagtgygggggctggagggaagaacacataggtggatcaagagcagctcattgagggctgtgggaagacagagaaagcgccatgccctccgaggagcagaagagaa

SEQ ID NO: 20360 - DNA, 201 bp, Homo sapiens
ggcagatacagcaggtgcaatggtcccggggcacaaatgcgctgtgcaaaggcaccttcatgcattcacagtctagtgcgggggctggagggaagaacacrtaggtggatcaagagcagctcattgagggctgtgggaagacagagaaagcgccatgccctccgaggagcagaagagaaaggcaggaggtaggatctgtgt

SEQ ID NO: 20361 - DNA, 201 bp, Homo sapiens
tttaacaagcttgcttctaacaagcatatatccaaagtcattaatccttaaaggtgcaagaggactttataaatacctcctgtgttcaaatgaaaatctgrgggagcttgtgcgatacgcacactgatactcagcaatgaaaataccttcctccttccccgcggcgactctaaacagcgtcccaccgggaattgttgtttg

SEQ ID NO: 20362 - DNA, 201 bp, Homo sapiens
aaaaatagacaagacataacatttaccatttacaccatttttaattgtatagcttggtcgcgctaagtacatacacaccattgtgcaaccatcaccatcayacacatccacttcatcatcccataccaggcacattttgcatacgcactctggtgggtaaacgttcaggaacccacgtagagccccatgctcagtggatga

SEQ ID NO: 20363 - DNA, 201 bp, Homo sapiens
ggccaggctggtctcgaactcctcaggtgatctgcctgcctcggcttcccaaagtgctgggattacaggcatgggccacagtgcccggccaacacagaacytttagagaagtaattacactaaaatgaggccatgagggtgggccctactctaatctgactggtgtcttttcaggaagaggagatttggatacagagacac

SEQ ID NO: 20364 - DNA, 201 bp, Homo sapiens
cccccatttaataagaaatgaaacagaggccaaacacccagagacgctcaggaccatttctgtccagcaggttttgattacacatgcaatctctgtacctrcaagccagaataattccagtattgctattctctatggccatctaacacccaccattgacacgtggatttgaaaaggagtcggcaaatgatctcataactc

SEQ ID NO: 20365 - DNA, 201 bp, Homo sapiens
aaacagaggccaaacacccagagacgctcaggaccatttctgtccagcaggttttgattacacatgcaatctctgtacctacaagccagaataattccagkattgctattctctatggccatctaacacccaccattgacacgtggatttgaaaaggagtcggcaaatgatctcataactcattaagaggatccctggttt

SEQ ID NO: 20366 - DNA, 201 bp, Homo sapiens
acatgcaatctctgtacctacaagccagaataattccagtattgctattctctatggccatctaacacccaccattgacacgtggatttgaaaaggagtcrgcaaatgatctcataactcattaagaggatccctggtttcttccagtcccctgctaaacagtcataaatggcatttgagaatggtagcaaaatttcttgg

SEQ ID NO: 20367 - DNA, 201 bp, Homo sapiens
cagtattgctattctctatggccatctaacacccaccattgacacgtggatttgaaaaggagtcggcaaatgatctcataactcattaagaggatccctgrtttcttccagtcccctgctaaacagtcataaatggcatttgagaatggtagcaaaatttcttggaaaccatctcatcccatgtccttatttctcagcaga

SEQ ID NO: 20368 - DNA, 201 bp, Homo sapiens
tgaggggaccccattgccactggagtctgcctgccacgcagaagcccgcaggtgcctgggacactatccgagttactgggccagtcctcaaaggtggctayggaagaggctgaatggcagccactgtcctaacccccactttcccccagagactttctgatgtgggaaggagcaaggcagagctgggtgacctgggacctg

SEQ ID NO: 20369 - DNA, 201 bp, Homo sapiens
caaggacctcacttctaacctgtcatagagaaatgatggaggaaaagagctgaaagacaaggcccaggttgccaagtgccacccttccattgaaaaatggmgtaccatctttcctatctccggggcctggtccatcagcagtttcttggttatcaactgtaattactagtaggggaaaacttgcaaaatttgccatctgtt

SEQ ID NO: 20370 - DNA, 201 bp, Homo sapiens
catcttttcctatatagtgtatactattcaataaaaatctagctcattactgctaacttaatgtcatttccgaaaatgcatcatctctcattaacaatagyccaggatgaagaaacagcccattaaacaagcaatgatttctctatccaaatcgccagcaaatactactcacctgattgacagactctgatattccagcca

SEQ ID NO: 20371 - DNA, 201 bp, Homo sapiens
aactaatcctagaaatgctgtatgtaaataacatatcctggccaggtgcagtggctcacgcctgtaatcccagcactttgggaggccgaggcgggtggatsacttgaggccaggagttcgagaccagcctggccaacatggtgaaaccccatctctactaaaactacaaacattagccgggcatggtggcacgcctgtaat

SEQ ID NO: 20372 - DNA, 201 bp, Homo sapiens
agagtatagaacctcaaccgtaaaaactgccaactctaagaacttttgtccaaacccagacatcaacactagtagacaaaaattgatactgttaagtaaastaaaaacagctacaatttgggaggaatcctaaaggggtttaagcagcacatttataatcttcgtctgaatttctcgtggatagattggagagacctgacc

SEQ ID NO: 20373 - DNA, 201 bp, Homo sapiens
gtaaagtaaaaacagctacaatttgggaggaatcctaaaggggtttaagcagcacatttataatcttcgtctgaatttctcgtggatagattggagagacytgaccatgcatgtctggtgggtaggcatttagcaaatttattcaagtcccaaatcctttcggaagtggctattcttctgcacgacacactttggtaaatg

SEQ ID NO: 20374 - DNA, 201 bp, Homo sapiens
ggatagattggagagacctgaccatgcatgtctggtgggtaggcatttagcaaatttattcaagtcccaaatcctttcggaagtggctattcttctgcacracacactttggtaaatgctcatccatatcatagaaaaatgatcaagaatgaatcaaaggcaatgcagcctcctcaactctagaaaaggattcttcaaaat

SEQ ID NO: 20375 - DNA, 201 bp, Homo sapiens
ggtaaatgctcatccatatcatagaaaaatgatcaagaatgaatcaaaggcaatgcagcctcctcaactctagaaaaggattcttcaaaatgaatctggcrtccctgaagggtggaacacccctgggatgatggaagagggaagcacgcatggagtcaaccaacccaaaacctaaagacactgagctggcgcagcccacag

SEQ ID NO: 20376 - DNA, 201 bp, Homo sapiens
cagccagaagggggcagcactcgacagctcagaaggctaggcccattccctctgggacctccccaggctccaagacacactaaggcaggcagactgagccyccactctgtgggccctggggccagagcagtgaagaaagcagaagcaaatcccttccccatggagagtcacaggctctcacggggccacagactttacagc

SEQ ID NO: 20377 - DNA, 201 bp, Homo sapiens
gtgaagaaagcagaagcaaatcccttccccatggagagtcacaggctctcacggggccacagactttacagcttcagcccaagcccctgttttataaatgrgacctaggctggtgagaagaccttccctccaatacctgctggtctatccagcaggactgctgctggggtctctgtctttctccgaaatcccagcccagca

SEQ ID NO: 20378 - DNA, 201 bp, Homo sapiens
gttccagtaccctcagaagagaccctcgccctctgctcccaaatcttgctggcagctgggccactgggctctgctcctggcagacatcatctccagccccrgggtgcagcttcctgccgtggctgatctcggggtggcctcctccacccctgctttccctttgtgctctttctttcatcacctatgaaacgaattccctgc

SEQ ID NO: 20379 - DNA, 201 bp, Homo sapiens
ttgcagaggaccccggactcaggtgagcgtaaccgcagaaccagcccaatctggttcaactttgtgtaataacatagtaaacagtttttcagtcaccatgkatcccaggttgcaagttacgtaatctgagcattcccagatgaaccaagcaggcaaccatgggcagaacccaagtgctaggaccaaggaaggaggaacgag

SEQ ID NO: 20380 - DNA, 201 bp, Homo sapiens
gaaaaaagaccagacccaatttcacaagtttactgaccggcaatcatttgtgatactgatacaatgttttcactggtcccttctccagcatcccccatcamaaccaaaccgttcccaaacaccactccctaaggatcttctgaaaacacctctgataataaacaccatgcttcaaactcttccatgacccagcagcactga

SEQ ID NO: 20381 - DNA, 201 bp, Homo sapiens
caatgttttcactggtcccttctccagcatcccccatcaaaaccaaaccgttcccaaacaccactccctaaggatcttctgaaaacacctctgataataamcaccatgcttcaaactcttccatgacccagcagcactgacagtcacactcccaaagtagcctttgccttgattccctgagtattaatcccaccctgtctt

SEQ ID NO: 20382 - DNA, 201 bp, Homo sapiens
atcagctatgtcagttagcacagcaacaagcaaaaggttatatatacatcttcttaaccttgtctagacagaataaaattctgattttagctgaagtgtaygaccaagacatcaaattcagtattctgtatgtgcaggtcagaacagaagttccccaccttcaaaataaaaaactatgcacacagtaaacctattgagcac

SEQ ID NO: 20383 - DNA, 201 bp, Homo sapiens
aaagtgaacattggatcaattcattacactcatcatttacaacctccatttttagagaaataggaaaggaggcggaaccaggcagaccccatcagtgggtsttgtagcaaacatctgcacagttctaaagcatcccagtcttcaaagccaaattcatccccaaatctggtcttctagtattccatatttcagtgaacccag

SEQ ID NO: 20384 - DNA, 201 bp, Homo sapiens
tacctagtgggtactcaccagctattacctgttcatataaagccccatggtcttgatcttaatcttcatttatctcataatggccaggaagacagactaaytttattaaccaagtaagactgtttctatttctccacatggcccaaggaaagtccatttgtttcacagcctggaagccagtcaggaggctctttttttttt

SEQ ID NO: 20385 - DNA, 201 bp, Homo sapiens
ccccagcatcagtgttaagaggtggggcctctaagaggtgatcaggtcgctacggcagagccctcctgaaggggattagtgtccttacagaaggctggagrgaactaaccaggcccattttgtccttctgtttcctccacgatgggaggacacagaggtccatctgggaagcagagaatggtccttgttacagtcgtacaa

SEQ ID NO: 20386 - DNA, 201 bp, Homo sapiens
agtgtccttacagaaggctggagggaactaaccaggcccattttgtccttctgtttcctccacgatgggaggacacagaggtccatctgggaagcagagartggtccttgttacagtcgtacaaatggagcaaggcagtagaaatcaaccaattggaaataaagaagtctggcagagataggttcatcaacagtaagaaaa

SEQ ID NO: 20387 - DNA, 201 bp, Homo sapiens
aaatcaaccaattggaaataaagaagtctggcagagataggttcatcaacagtaagaaaaaagtgaaaagcggacaggaaagaaatggcagaggtcctaamggcatgcacagaaattaacaaggaaaacatctacagaggaaagaacttattttcaaacagggatagctaagtgaagttgaggccattcttcctgaccaag

SEQ ID NO: 20388 - DNA, 201 bp, Homo sapiens
aattggaaataaagaagtctggcagagataggttcatcaacagtaagaaaaaagtgaaaagcggacaggaaagaaatggcagaggtcctaaaggcatgcayagaaattaacaaggaaaacatctacagaggaaagaacttattttcaaacagggatagctaagtgaagttgaggccattcttcctgaccaagaagcagaga

SEQ ID NO: 20389 - DNA, 201 bp, Homo sapiens
ccgagatcacaccattgcactccagcctgggcaacaagagcaaaactccatcttaaaaaaaaaaaaaaaagaaaagaaagaaacttaacagaaaacttatygtattgcaaatgtattttgactttgcttataccttgaacaataggaaataaagatcgacttttattgggtcttcttggataataaatattaaattcacat

SEQ ID NO: 20390 - DNA, 201 bp, Homo sapiens
atcgtattgcaaatgtattttgactttgcttataccttgaacaataggaaataaagatcgacttttattgggtcttcttggataataaatattaaattcayatgcagacaatatcagtgaatgtagggtttactgtatatttactatttttaagagatatacaaactatgaaccaaaaactggaaagccttaatacagaag

SEQ ID NO: 20391 - DNA, 201 bp, Homo sapiens
tacagtctatcaaagtggtgccaaaaagtagatttattcgcattaagtgctgacaggaacgaaacatttctgcagtaaataaagtacattgtaacccaatygtcaaatcaataaagtcattaaaaatagactgcattcttcaaggaaatggtgagtttaagggggaaaaagaaaaatctttggttgcgatggagaatgtat

SEQ ID NO: 20392 - DNA, 201 bp, Homo sapiens
ctggggtccaagcaatcctcctgtctcagcctcccaagtaagagactataggcatgtgccaccacacttggcttttttggagggtagaacagggagggccraggcagagacagaatctccctatgttgtccaagctggtcttgaactcctaggctcaagcaatgctcccgccttggcttctcaaagttctaggattagagg

SEQ ID NO: 20393 - DNA, 201 bp, Homo sapiens
gcgcccagcctgctttctgcttctaaaagaataagaaacaaataagaaatgtgtttataatgtatcttctcaaatatgacatgtttcatgtgccgtctttmagactaagaatacttggaggaagcaatcttcactctacagactcaccaaaattttactaagaatcagtcaaaatgaaaatattttacatacgtgattttc

SEQ ID NO: 20394 - DNA, 201 bp, Homo sapiens
tcatggccagcagacttctactataagaaatgttggccaggcgtggtggctcacgcctgtaatcccagcactttgggaggccaaggcaggcagatcacttraggtcaggagttcaagaccagcctgggtaacatagcaaaaccccatctctaccaaaaatacaaaatttagccaggtgtggtgtcacatgcctataatccc

SEQ ID NO: 20395 - DNA, 201 bp, Homo sapiens
tgttttgaatcttgagtcccatcaagttagagaagcttggaaaacacctgaaaatttccaaagttctgccctaacaaagcataaaaaacaggcctatgagytcagccagttaatatggtattggagtaaaattcaatactttttagaattatcagaagtcagacatacaatgtatcatccaaaatgtccacaataaaaaat

SEQ ID NO: 20396 - DNA, 201 bp, Homo sapiens
ccaaaattaaatttacctgaggacatgatgcgaagtgagataagccactcacaaaaggataaatatggtatgatcccacttggatgaggtcccttcagtartcagattattacagacagaaagtaaaatggaggacaccagaggatgacaggcaagagccaccatgccttgcaaaaattacaaattttatgtgacagatat

SEQ ID NO: 20397 - DNA, 201 bp, Homo sapiens
aagaaacaaataagaaatgtgtttataatgtatcttctcaaatatgacatgtttcatgtgccgtctttcagactaagaatacttggaggaagcaatcttcmctctacagactcaccaaaattttactaagaatcagtcaaaatgaaaatattttacatacgtgattttccttttttcctaatgttgtgtatttatcaaagt

SEQ ID NO: 20398 - DNA, 201 bp, Homo sapiens
gccatgaatattattaatgaggaagacatgccaggtgcggtggctcacacctgtaatcccagcactttgggaggctgaggcaggcagatcacctgaggtcrggagttcgagaccagcctggtcaacatggtgaatccctgtctctacaaaaatacaaaaattagccaggcatgatggcaggtgcctgtaatcccagctact

SEQ ID NO: 20399 - DNA, 201 bp, Homo sapiens
catgcccagctgattttgttgttgttgttttattttttgcagaggcggggtttcaccatgctggccaggctggtctagaactcctgacctcaagtgatccrtccacctaggcctccaaaagtgctgggattacagacgtgagccatcgcgcctggccgcacttctgagacagattgacggcctgggctaaagccccggatc

SEQ ID NO: 20400 - DNA, 201 bp, Homo sapiens
gagcgagactccatctcaaaaaaaacccaaagtgacagcgagcaaatgacaaagctgggccagactcctgctctgttcgacttctccaccggaggcccacygtcctaccgaggatggaaccatgcacagggggccagcagtccatgcttacacacatccaggaaggaaccaagaagtcgccatgcagcccagccctgaggg

SEQ ID NO: 20401 - DNA, 201 bp, Homo sapiens
gtgtattttcctaccttgaccttgtatttctgcaaaatttctctaaaatggatcttcagggaagcaggggacagtgtggggaggggagcggacaccagagyaggatgagctgaaagccataaaggctttcctgagccaactcgaaatggctctggaaaagcagaaatgacttaagacacaaacacactcacagttcgaaca

SEQ ID NO: 20402 - DNA, 201 bp, Homo sapiens
gggatataaatttattttattttattttttgagacagagtctctctctgttgcccaggctggagtgcagtagcccgatcttggctcactgcaacctccgcytcctgggttcaagcgattctcctgcctcagcctctcaagtagctggcaggtgtgtgccaccatgcccagctaatttttgtatttttagagacgaggtttc

SEQ ID NO: 20403 - DNA, 201 bp, Homo sapiens
aaaaaagttaggaagacagaccaggccatttcctttacccatggatctcaagaatacaccagggaggagtgaacctggcccagcctcacgtagcatccagraggtacagatccctggacagcaacaggtagaatctctaggacgactgctctcaaacactgcatggccaatgaatgccacagagtgttttcgcttggaaat

SEQ ID NO: 20404 - DNA, 201 bp, Homo sapiens
tcctttctctgaaagacttattgtagtaccagggactgcttttccatacaaaggaataacaaaagtataggtggtcctgatgatatctattacatgcctgycatgtgccaaacactatgatataaacttatccattaggtttttttttcctttttcttttttttttttttgagatggagtcttgctctgtcacccaggctg

SEQ ID NO: 20405 - DNA, 201 bp, Homo sapiens
gaattccgtctctcatgttcttccttgctattctttaacaacctcctggttaaaatcattcaccaagagctagattctaaaagtcaccacaaagccaactrtaagttttttaactctcacagcccacagtttcacagaaagcccttcatggaggtaatcacctttgagaaggtagctttagttcctacagcaaaattccaa

SEQ ID NO: 20406 - DNA, 201 bp, Homo sapiens
gtccgggaaaggatggccaatttaaccctccaccatcagagcaaacactcactgggtctgtgtgaaatacaccacacactctcacaatggtgatcgtaagraagatgaagcagaagtgcagagagatggaattccgtctctcatgttcttccttgctattctttaacaacctcctggttaaaatcattcaccaagagctag

SEQ ID NO: 20407 - DNA, 201 bp, Homo sapiens
atgttgcaaagcagagttctgatcggggactgcgccagccaacatgggtttaaagtccctaggagagggttcaggaactcaggatctggcattgagattcrccgtaaattccatttgaatcctgactctgctgtttacttgttaagtgggttaagctctctgtgcctcagtttgaaaatgtgtcaaatgaggatgacacag

SEQ ID NO: 20408 - DNA, 201 bp, Homo sapiens
agcatggagtaatatcgtgttgtgagacttttgtttctgtgcgtgtgtgtgcacctgcacgagcccacactaaatcatgttgcaaagcagagttctgatcrgggactgcgccagccaacatgggtttaaagtccctaggagagggttcaggaactcaggatctggcattgagattcgccgtaaattccatttgaatcctga

SEQ ID NO: 20409 - DNA, 201 bp, Homo sapiens
ccaccctccttggcctcccaaagtgctgggattacaggcgtgagccaccgtgcccggcccagtatttgtttcttaaagtgactccaggactggcccctgaytatgtatgtcatcatttctgtgccccagttctttcccaggtccttgctgcttaatcctaaccacgaatttgagttgctaatggtgtggtcaagagtgaca

SEQ ID NO: 20410 - DNA, 201 bp, Homo sapiens
taagcaaactcttgtctgagttatagtatcaccttggtgttctccttgggaagtgcacttaactaccctgtgtcatgaacacaaaggaagcatacatttcrgctaactattctgtttagggaaattatttaggaagtactttcactgttcgcttcttcctgaaattttgaatacaaattgaggggtactttcttaagaatt

SEQ ID NO: 20411 - DNA, 201 bp, Homo sapiens
accttttcaacttactgaagaaaattcagggagtagaaataccaagatagcagaagtctgagcagtgggctgcttaaaaactacttagcttttgctttgayagaaaaacaaaaaagtccatcaaatatgaaaaatgaatctgtttaatcctaacaaagattatagctgttgatgtatgccaaccgttagggtgctatcata

SEQ ID NO: 20412 - DNA, 201 bp, Homo sapiens
taattttgtcctcattactcacataagacaagctgatattaaacatgtgaccaggctgggtgtggtggctcatgcctgtaatcccagcactttgggaggcygaggcaggtggttcactggtggtcagaagttcaagaccagcctggccaacatggtgaaatcccatctctactaaaaatacaaaaagtagccaggcagggt

SEQ ID NO: 20413 - DNA, 201 bp, Homo sapiens
atcaaacctgtttttcattagggtttaaaggtcatactttttaaaaatctttgcgccatactgagtagtaattttgtcctcattactcacataagacaagytgatattaaacatgtgaccaggctgggtgtggtggctcatgcctgtaatcccagcactttgggaggccgaggcaggtggttcactggtggtcagaagttc

SEQ ID NO: 20414 - DNA, 201 bp, Homo sapiens
cgtctccgttttaaggctggtgaggaagaaatggatgtagaaggcagacagggtgccaccaaaaacataagtcctcagcaaaatgcaaaaatggaaacgayggtaaaatgggcactttgtgtgtataaagctgataaagtggccaatatccttccaaaagcactgaaaagtcactggtcacatgatgtttctgaattacca

SEQ ID NO: 20415 - DNA, 201 bp, Homo sapiens
ttcccaaaagcctgagaagagagataaaggtggtagacttcttttttctccagccataaagaaaaatgatacccagggaggctctcatccctttccctatygtctccgttttaaggctggtgaggaagaaatggatgtagaaggcagacagggtgccaccaaaaacataagtcctcagcaaaatgcaaaaatggaaacgac

SEQ ID NO: 20416 - DNA, 201 bp, Homo sapiens
ggctttggggcaggactgttcctcctcacttcccaaaagcctgagaagagagataaaggtggtagacttcttttttctccagccataaagaaaaatgatayccagggaggctctcatccctttccctatcgtctccgttttaaggctggtgaggaagaaatggatgtagaaggcagacagggtgccaccaaaaacataagt

SEQ ID NO: 20417 - DNA, 201 bp, Homo sapiens
gagactcttccacaggtactggagaaatgctcaagggaaccactggcctcaaatctcacctggctttggggcaggactgttcctcctcacttcccaaaagyctgagaagagagataaaggtggtagacttcttttttctccagccataaagaaaaatgatacccagggaggctctcatccctttccctatcgtctccgttt

SEQ ID NO: 20418 - DNA, 201 bp, Homo sapiens
tattttctccgttggcaaaacagttttccaagattaagaatctctcaccgggcgcagtggctcacgcatgtaatcttagtattttgggaggtcgaggcggrtggatcacctgaggtcaggagttctagaccagcccgaccaacatagtgaaaccctgtctctactaaaaatacaaaaattagctgggcatggtggcacatg

SEQ ID NO: 20419 - DNA, 201 bp, Homo sapiens
ttaatgttccactgtacaaagcgtgctccaaaataccttccagaccactgaacactaacaaaactgttgcaatgtgctatcttaagaagaaaatgaaaaayacaggcctgatgtttaaaactgttttcctcatattattagcttaacatgaaatataaggatataattattcgagggtctacatgaatagagctatagaaa

SEQ ID NO: 20420 - DNA, 201 bp, Homo sapiens
aacttagtcactaataggatctcaactcataaatacaacttctagtttaacgcattgctaaagacaaataaaacaacaccaaactgttttggacaacaggmagaaaattaaaatgagaaccagggaaattttatttttggttttcatcatcatcagtatacacattatagcatatccacatcctcaatgatctcctgggtg

SEQ ID NO: 20421 - DNA, 201 bp, Homo sapiens
ccaaagtgctgggattacaggcatgagccaccgggcctggccaatttttatttttatttatttatttatttattttgagacggagtcttgctctgtcgccyagatgggagtgcagtggcacgatctcggctcactgcaaccttggcctcccaggttcaagcaattctcttgtctcagcctcctgagtagctgggactacag

SEQ ID NO: 20422 - DNA, 201 bp, Homo sapiens
ttctttcagtcttcctgaatctaaaacctgttaatcagcagaaagaaacccattgaaacacaatgttttgcagtaacatattataacagagacaatatttyggaaaggggcaggagagggagagaatctgtttgggtggtaggcctggatagtatttaaatggtttgattaccctgttttacgaagcaaacaaaggcctaa

SEQ ID NO: 20423 - DNA, 201 bp, Homo sapiens
tttacagtgacatttagcatactttgtttgtttgccctatggaacatggggagaaaaaaatattaagctatatatgaaatttagataaatacatttttttraaaatgaaccacaatttgggagaaacgcttcatgctggaaaatgattctcagctcacttagtcttgtgtatatctaccttataaaaattcaatttaaatc

SEQ ID NO: 20424 - DNA, 201 bp, Homo sapiens
acatgctctaagggacacaatgattcataatggccaatacgttcaattacctaatgttagagaaattctggaagacagagtctgccgaatttcagggggtytctgtaatttatggcataaatggaaactagctagcatgtctataccaacccgagtttccatactcacttgtagattccaggcgcttcacatctcttgacg

SEQ ID NO: 20425 - DNA, 201 bp, Homo sapiens
ttctttttttttcagaatgaatttatccatgttaaaatgttatgtctggggcaaacagagcacttagaaatatttctcagaatcattccatgtttcccatktacacacttaaaatgtggactcaaggttacatggacctcagctttataccttggatccacatttgccgtcgcttcatcaataatcaatatctgatttttc

SEQ ID NO: 20426 - DNA, 201 bp, Homo sapiens
tatttctcagaatcattccatgtttcccatttacacacttaaaatgtggactcaaggttacatggacctcagctttataccttggatccacatttgccgtygcttcatcaataatcaatatctgatttttcctgagaattgccctggcaaggcacaccagttgtctttgtccaacactaaaattggatcctgattctgcta

SEQ ID NO: 20427 - DNA, 201 bp, Homo sapiens
cgcggctggctgtgatcacactgccgaggagcacgtaggtggtgaaggtcacaaacacgatgattttgcttgcactgaaaaatgaagccaaattcatcccyctgaggcaggaacttctcagaatcttggaaatctccttcctgaaagagagtacaggtttttaaaaaagcagtgatgtcaaccagataaagtggctcacgc

SEQ ID NO: 20428 - DNA, 201 bp, Homo sapiens
attttgcttgcactgaaaaatgaagccaaattcatccctctgaggcaggaacttctcagaatcttggaaatctccttcctgaaagagagtacaggtttttwaaaaagcagtgatgtcaaccagataaagtggctcacgcctgcaatctcagcactttgggagctgaggtggatgaattgtttgaacccaggagtttgagac

SEQ ID NO: 20429 - DNA, 201 bp, Homo sapiens
aaaagcagtgatgtcaaccagataaagtggctcacgcctgcaatctcagcactttgggagctgaggtggatgaattgtttgaacccaggagtttgagaccwtcctgggcaacaacaacaaaaaagtgcaaaggtgagaggtggccaggaactacccaagaaatcataagaagtatcatgtgctggaatgcaacaactaatc

SEQ ID NO: 20430 - DNA, 201 bp, Homo sapiens
aaatgaatcacaatgcttgcattgtctttaccgcgctctatctaagatagggaagtacacacaacattctggaatggcggcacgttttggttatgagagarttaaatgtcattacactggaacatagtgatgctaaataaaaggagacatcattctacttcaaatgcacctacaactttaaaatggcatctgacaccaacc

SEQ ID NO: 20431 - DNA, 201 bp, Homo sapiens
gcattgtctttaccgcgctctatctaagatagggaagtacacacaacattctggaatggcggcacgttttggttatgagagagttaaatgtcattacactsgaacatagtgatgctaaataaaaggagacatcattctacttcaaatgcacctacaactttaaaatggcatctgacaccaacctggattcttcggatgctg

SEQ ID NO: 20432 - DNA, 201 bp, Homo sapiens
gcgtcactgccacgaacacgcggctggctgtgatcacactgccgaggagcacgtaggtggtgaaggtcacaaacacgatgattttgcttgcactgaaaaaygaagccaaattcatccctctgaggcaggaacttctcagaatcttggaaatctccttcctgaaagagagtacaggtttttaaaaaagcagtgatgtcaacc

SEQ ID NO: 20433 - DNA, 201 bp, Homo sapiens
aaccagtaagaacacagtacagaaacgatccactggaaaagaacaggcaagatcctaaacagaaatggccacagtgggtttacacctgctaaagcagaaakccaagcacccaccacaggtgaagccattctggggaaacaaagagtgggtctgggagactcgcaagagaatccgaccagcggcattagaagaatgtcttga

SEQ ID NO: 20434 - DNA, 201 bp, Homo sapiens
actctacttattgaggccacagcgcctgaaaagctggctgggaggagccagtgaatgccttcacctttctcccttgaagatttgccttcagcataaggacrgaggcccccttggctgagcctgaagagctgcaacatatgcaaggaagagataataaaaggcatttagtttgtttctgaacaaaagcattgggaagactgt

SEQ ID NO: 20435 - DNA, 201 bp, Homo sapiens
actaaataagatttccagtaacactttatgattgctcttgttaaagaaggcttctgtgcgtcattctcagctcttaaaacttctttatcccagaacctacratgaggaaaaagcttcgtaaataagagtgaaccctgccacaatataaaacaggggagatggcagagtgacaggtatgcatttaagacagggcattttgtg

SEQ ID NO: 20436 - DNA, 201 bp, Homo sapiens
gcccctggagagaagatgacaagtgggaaaacactggactccgagctggggaaacagacagagaaaacagctcagtgaggctgggtgcagaaaaacctgcrgcctcccaagctccatggtcacgtatccaccaaacagcacacgcaggcctcctaggaggcttcatgtttcaaggaaaaataaatgttcccaatagcctga

SEQ ID NO: 20437 - DNA, 201 bp, Homo sapiens
acttactaggtggccttttgcagaaaacgtttgctgacagagccacaggccatgcatggtgagagaaagaccccacaagccagtcagggggcacaaagagrgaacgtgcagcagcgattccgagaggagtccaagcccagaagaaggggatggggaaggagacgaagatgcgcaaaaaaagcaggatgtggggctgggccc

SEQ ID NO: 20438 - DNA, 201 bp, Homo sapiens
aggctatcaattccacatgctctaagggacacaatgattcataatggccaatacgttcaattacctaatgttagagaaattctggaagacagagtctgccraatttcagggggtctctgtaatttatggcataaatggaaactagctagcatgtctataccaacccgagtttccatactcacttgtagattccaggcgctt

SEQ ID NO: 20439 - DNA, 201 bp, Homo sapiens
acttccgttttccatttgagatcctgacattactctcaacgttacctggatgaaatctaaaaacgtcagcggcagcaaatcatccaagtgtccaatgtctytggagaaacgatttaaaattcttcctgcaagaacaggatatgaaaaattactcatttccccagatagaccctttaagagaaacaattcgcaaacaaatca

SEQ ID NO: 20440 - DNA, 201 bp, Homo sapiens
acaccaaatgattaaactttacctgaataaattcctaagtaccagttaagatctagcttctcggttacatttcctcctccatttacagtgacatttagcayactttgtttgtttgccctatggaacatggggagaaaaaaatattaagctatatatgaaatttagataaatacatttttttaaaaatgaaccacaatttgg

SEQ ID NO: 20441 - DNA, 201 bp, Homo sapiens
tttttcttcgggtaaacgaagtgaggattagaagagaaggatcaacaaacacctccctctaactctatggaaaagcgagtcttcttactgattttggagtrtttcatacatcagaccagaaataacttaccagtatgaaagccaccaatcttgaagcacataggcaacctaggaggggagaaacaacaaagacaaaaatca

SEQ ID NO: 20442 - DNA, 201 bp, Homo sapiens
acactccaccagcaagcactctaatttttcttcgggtaaacgaagtgaggattagaagagaaggatcaacaaacacctccctctaactctatggaaaagcragtcttcttactgattttggagtatttcatacatcagaccagaaataacttaccagtatgaaagccaccaatcttgaagcacataggcaacctaggaggg

SEQ ID NO: 20443 - DNA, 201 bp, Homo sapiens
cagtttacactccaccagcaagcactctaatttttcttcgggtaaacgaagtgaggattagaagagaaggatcaacaaacacctccctctaactctatggraaagcgagtcttcttactgattttggagtatttcatacatcagaccagaaataacttaccagtatgaaagccaccaatcttgaagcacataggcaaccta

SEQ ID NO: 20444 - DNA, 201 bp, Homo sapiens
tgttccccaaagacagcacatttcaattcagaccccaagtgaactgcaagatgcagtcataatagcataaacataggtactgtaaatatcattttgagggygcaaaacaaatgtcattatttacctgagctgcagtgtttaggagaataaggaaaatgaagacaatccagtgagcaccagctctgaagtaattcttatagg

SEQ ID NO: 20445 - DNA, 201 bp, Homo sapiens
ggacattctctgtctgcagaggaaaaaaggtggtaagagacaaaacagtatacaaaactgttcccaaagatgacaatgcactctgttgacaaagctgtggrgaaacaggcagaagtccaaaatgatccatctcctgtggagaagggtgtggaaatagctagccaaactatacatccacttattttttatttatttaatttt

SEQ ID NO: 20446 - DNA, 201 bp, Homo sapiens
tgagttaatacttaaaaacatgaatcccagctctgagaagaaaggaacatgaaatggaggaagaagaaggggattcaacacacccaagtacttgcaagttygggagacctctagaaactacttacatctttcaatatcagaatctgacttgcagctttgaggtactgcaactgatgagtcactaaaattgtgatcttctca

SEQ ID NO: 20447 - DNA, 201 bp, Homo sapiens
aactttcaacaactgggatgttcattcaaatgccaacagaataacccaagaaggtgcttcacacaggacgcaatacacagtaagcaggtcctatgtgctcrccaccactggaaggtatcaaaagacaccggcatagtggctgctgaaatgcaacttaccttgcaaggtttacccgtgctttctgccctccactcagcgtgg

SEQ ID NO: 20448 - DNA, 201 bp, Homo sapiens
aaaagagacttaaaacatgttcttcctctgttctttgtgttcttccaaagttatcctaaactttgcacattagttcttcagaaatttacatgtatttgatsaacagcaatggaaatatttcatagtaactaaattgtaagtttgaacctatcaaatacacagtcagggcacgttatctattttaatgctgtagcttttcat

SEQ ID NO: 20449 - DNA, 201 bp, Homo sapiens
gtattactggacattcgagtacatgaaatccaaaagtcatcactcacctttttcagagcacaagcctttatgactttttcatatcgttccttttcgtattycttcccaaataaaatattactcctcagagttcccgagaacacccagggctgctgagacacataggcaattcttccatgcacgctgaccagcccgtgactt

SEQ ID NO: 20450 - DNA, 201 bp, Homo sapiens
tgacttggggccaattccccgagcacggcacttaacagtgatgactgaaacagattgtaaaaaagcacatgttcagtcaacactcgagacaagaataagcyactgcaatgcagccttgcccagccctgggagcttgaaaaacaccattcattcatttaaaagagcacaggaagttgtgattaaaaattggaaataacataa

SEQ ID NO: 20451 - DNA, 201 bp, Homo sapiens
taacaattcgccaggtctgacagtaaaggaaaggccttgtagagttggggtctctgatgcctacaaattaaagtttataaaatgtgcccatttcaataaartcacacaaatcacttcaaaaagagaagaaaacaatacaacagtcattgatacatgaacataacccaaatctttctccttcctattttaagatattgtatc

SEQ ID NO: 20452 - DNA, 201 bp, Homo sapiens
acttagtgacatttagtttagaacgaggtaacactttccttggttttttgaaaatgagataaaatacaacttgtcaaatacctaagtctgatttcataccyactttctattaattgcaaaacttactcctaattttgagaatctttgtaacatagtttcagtaaataagcaagccatattttataccatgtgtaacacctc

SEQ ID NO: 20453 - DNA, 201 bp, Homo sapiens
ctcattatcttcagcagtcatgatcttgcattaaggatatgttaccttatcccaaaaagcagtaaaatcctgcacatgcaccatctttttaccatctgacrgcagctgacggttgcgctgtgatatctcatcaagtagcaaaaaggtctaaagaaaatgggaaaaacacagattgtttaaattacagaaacaaaagcacaa

SEQ ID NO: 20454 - DNA, 201 bp, Homo sapiens
atgagagagttaaatgtcattacactggaacatagtgatgctaaataaaaggagacatcattctacttcaaatgcacctacaactttaaaatggcatctgwcaccaacctggattcttcggatgctgacgattgcctctgacaccctctcaatggctgaggggaagaagagggtaaccgtcagccgcacagccccatacag

SEQ ID NO: 20455 - DNA, 201 bp, Homo sapiens
cattcatggtcctgatcctggcatccgtgaaagttgcagttttactcctaaggggaaccagacacgggagatgagcctgagcgatcacagcctgcccttaycagcggcaggcacaggcagggacctgcatcacatggttccctacagcgcttttgcttccgacaacacagacaggtcctactcaaaatacaaatagaaaaa

SEQ ID NO: 20456 - DNA, 201 bp, Homo sapiens
cgtacatttttattatccttataccagttataacttcattcatggtcctgatcctggcatccgtgaaagttgcagttttactcctaaggggaaccagacaygggagatgagcctgagcgatcacagcctgcccttatcagcggcaggcacaggcagggacctgcatcacatggttccctacagcgcttttgcttccgacaa

SEQ ID NO: 20457 - DNA, 201 bp, Homo sapiens
cactctacttattgaggccacagcgcctgaaaagctggctgggaggagccagtgaatgccttcacctttctcccttgaagatttgccttcagcataaggayagaggcccccttggctgagcctgaagagctgcaacatatgcaaggaagagataataaaaggcatttagtttgtttctgaacaaaagcattgggaagactg

SEQ ID NO: 20458 - DNA, 201 bp, Homo sapiens
ttcttgggcacacggcatgcacacatgtgtgcacacactcgaccccccaacccctacccgcttctgccaactctttgcagaccttacttcaacccgggacrtgccgttaagacccactcatgaagctttgtctctgcaggcttataattgaaaagggtacacagtgcttgttaccatacccatggtgccaaattgtgcgga

SEQ ID NO: 20459 - DNA, 201 bp, Homo sapiens
caacccctacccgcttctgccaactctttgcagaccttacttcaacccgggacgtgccgttaagacccactcatgaagctttgtctctgcaggcttataaytgaaaagggtacacagtgcttgttaccatacccatggtgccaaattgtgcggagggagccgctgagacaaactttaattacaactccttggagcacgctc

SEQ ID NO: 20460 - DNA, 201 bp, Homo sapiens
tcacctgttttgctgtttcagtgagggcagcggcttctgccttgcccagttgttgcaccatcttgtaaaataggctctctttattttgcagcaaaacatayggctcatcatattctttcagtcttcctgaatctaaaacctgttaatcagcagaaagaaacccattgaaacacaatgttttgcagtaacatattataacag

SEQ ID NO: 20461 - DNA, 201 bp, Homo sapiens
tgtcttccctccaaattgcttaaagctgattattgggagtggattttaggaatctagctctcctgggatactgaataatatctctgacactggaaaacacrtttgggtttcttctttttttttcagaatgaatttatccatgttaaaatgttatgtctggggcaaacagagcacttagaaatatttctcagaatcattcca

SEQ ID NO: 20462 - DNA, 201 bp, Homo sapiens
atccacatcctcaatgatctcctgggtggtgaacaaagttagttaaaccgctaagctcctcttaatttcctgcaatgctgtaaaggtacatatacacataytgaggctaacagactaaagataattacattttatcaattacctcttgtaaggcattccacagttcctcatccgtgtgctcattaaagggatccaggtttt

SEQ ID NO: 20463 - DNA, 201 bp, Homo sapiens
tgtaaggcattccacagttcctcatccgtgtgctcattaaagggatccaggtttttcctcattgttccagtgaacaaaacaggttcctaagtgcccaaaayagtcacggtcattaccacagactcttttttcattttattccaatgctaacatcaacaatagaattaagataccaaaaaataaaattcatgataataatta

SEQ ID NO: 20464 - DNA, 201 bp, Homo sapiens
atataaaacctgctgacagagcaaccataagactcagaaaaagatgtatatattttattttacattaactttaaacagatggaggaaggatcttaaaaaawatctgttaccaaagatgtaaaaataacagttttaatatttcacataagaatggcttttataccatttaatggcaaggagattgaaaaggcaaagaacgtg

SEQ ID NO: 20465 - DNA, 201 bp, Homo sapiens
agattgaaaaggcaaagaacgtgaaggtaaatattaccatattctcaacttcagcactttgtcgaacacaccactgaaacatccccatgagcgtgagggcrtaggacagtgccaaaccaacctgcccggcatccagagctacgtaaggaggaagaagggaataaagtcagtctcacttcaaacctaagcctggctccttct

SEQ ID NO: 20466 - DNA, 201 bp, Homo sapiens
agaacctccctcctacagagacatttattacatctgaaaaagcttgtgatgaatataaaacctgctgacagagcaaccataagactcagaaaaagatgtayatattttattttacattaactttaaacagatggaggaaggatcttaaaaaaaatctgttaccaaagatgtaaaaataacagttttaatatttcacataag

SEQ ID NO: 20467 - DNA, 201 bp, Homo sapiens
aactgcgcatatctcaacccattcaaagaaagataaacccatcaagacccaaatgactccttaaatgagtcacactgctgaatcctacccaacctgacacmtcgtaaatgatttaatacacttcattaggaccaaacagtatgtagtagtagacaaggtggcaagagtttaataaatgtaaacacagctataaattgtaat

SEQ ID NO: 20468 - DNA, 201 bp, Homo sapiens
cctttaagggcttccattttgagaaagtagtattttctcttccttctcttttagaacatatgataaaatattgcccttctatcctttaaccatgtatccatttttttttttgatggggagtaaggggtacacactccctactacaatgtcacaaactttttctttttgttgttcctattggttgtaactgtactattttct

SEQ ID NO: 20469 - DNA, 201 bp, Homo sapiens
caggagaatcacttgaacccaggaggcagagattgcagtgagccgagactgcaacactacactccagcctgggtgacagagtgagagactgtctcaaaacmaaaaaaaaaaaaaaaaaaagttactcagattcttgtactttagcattttcatgtgtcaaaaggggataataacagcaggtcagaaggactgtgaagctta

SEQ ID NO: 20470 - DNA, 201 bp, Homo sapiens
gaatcacttgaacccaggaggcagagattgcagtgagccgagactgcaacactacactccagcctgggtgacagagtgagagactgtctcaaaacaaaaamaaaaaaaaaaaaaagttactcagattcttgtactttagcattttcatgtgtcaaaaggggataataacagcaggtcagaaggactgtgaagcttaaggga

SEQ ID NO: 20471 - DNA, 201 bp, Homo sapiens
acttgaacccaggaggcagagattgcagtgagccgagactgcaacactacactccagcctgggtgacagagtgagagactgtctcaaaacaaaaaaaaaamaaaaaaaaagttactcagattcttgtactttagcattttcatgtgtcaaaaggggataataacagcaggtcagaaggactgtgaagcttaagggagacaa

SEQ ID NO: 20472 - DNA, 201 bp, Homo sapiens
taaaaaaataagtggcatttctactgaaggcagcacaaagattagccaatgctgaaaaaacagtgtgagacacaggataggattgagcaaacaaacaaaataactaaaagttaataaagaactaaaaaggattaaggagaaaatagctttacaaaatagacaaaggacataaaacatatacatgatagatatttgtaaaga

SEQ ID NO: 20473 - DNA, 201 bp, Homo sapiens
tgagaagggagcattgcttgagcctgggaggttaaggctccagtgagctatgattgtgccactgcactccagcctggacaacagagcaagaccctgtctcaaaaaaaaaaaagaaaaagaaagaaagaaagaaaaaaggctgagttgtgtcaaacatggtcatagatgtctccatatgaacagacaacacgagaagacctt

SEQ ID NO: 20474 - DNA, 201 bp, Homo sapiens
cctcctgagtagctggggttacaggcatgtgctaccactcccagctaatttttgtatttttagtagagacggggtttctccgtgttggtcaggctggtctsagactcccaacctcaggtgatctgcctgcttggcctcccaaagtgctgggattacaggcatgaaccaccactcccagcctgacaactgcctcttatagaa

SEQ ID NO: 20475 - DNA, 201 bp, Homo sapiens
aaaaaaataaataaataaataaaaataggccaggcgcggtggctcacgcctgtaatcccagcactttgggaggctgaagcaggtggatcacgaggtcaggrgtttgagaccagcctggccaacatggtgaaaccccgtctctactaaaaatacaaaaagagtagccggcatggtggcaggcacctgtaatcacagctactc

SEQ ID NO: 20476 - DNA, 201 bp, Homo sapiens
cggtggctcacgcctgtaatcccagcactttgggaggctgaagcaggtggatcacgaggtcaggagtttgagaccagcctggccaacatggtgaaaccccrtctctactaaaaatacaaaaagagtagccggcatggtggcaggcacctgtaatcacagctactcgggaggctgaggcaggagaatcgcttggacccggga

SEQ ID NO: 20477 - DNA, 201 bp, Homo sapiens
gaggcaagagaatcgcttgaatccaggaggtggaggttgcagtgagccgagatcgtgccattgcactccagcctgggcaacaagagcaaaactccatctcaaaaaaaaaaaaaaaaaatctctccaatgtcagaatgggacatcctttttttttttttttttttttggccaaaggagatctaaacaactggggccagaggc

SEQ ID NO: 20478 - DNA, 201 bp, Homo sapiens
aggcaagagaatcgcttgaatccaggaggtggaggttgcagtgagccgagatcgtgccattgcactccagcctgggcaacaagagcaaaactccatctcaaaaaaaaaaaaaaaaaatctctccaatgtcagaatgggacatcctttttttttttttttttttttggccaaaggagatctaaacaactggggccagaggca

SEQ ID NO: 20479 - DNA, 201 bp, Homo sapiens
gcttaggtaggctgtgtgaaagttttcttctggtagctgggtgcggtggcgggcacctgtagtcccagctacttgggaggctgaggcaggagaatcacttkgacctgggaggcagaggttgcagtgagccaagattccgtcactgcactccagcctgggccacagagcaagtctccatcttaaaaaaaaaacaacaaaaaa

SEQ ID NO: 20480 - DNA, 201 bp, Homo sapiens
tgaacccaggaggtggaggttgaagtgagccaagatagcaccactgcactgcagcctgggagacagagcaagactgtctcaaaacaacagcaacaacagcaaaaaaaaaacccaccacgtgacctaaaaatggccgctctgaatcaaagcatttagtgcagtaaattgataatccctcagcaggactgcaagactgaaaat

SEQ ID NO: 20481 - DNA, 201 bp, Homo sapiens
gtttaatcctaacaaagattatagctgttgatgtatgccaaccgttagggtgctatcataaatgttgaatttgcatgaagttactctttagttgaaaacatttatttgtgccagtaggattggaggagtaaataatccatcctaaaaaaagttttgaaatccatttttccagatccttcagttaagcaaactcttgtctga

SEQ ID NO: 20482 - DNA, 201 bp, Homo sapiens
ggaagtgcacttaactaccctgtgtcatgaacacaaaggaagcatacatttcggctaactattctgtttagggaaattatttaggaagtactttcactgtycgcttcttcctgaaattttgaatacaaattgaggggtactttcttaagaattcagtattttttttttttgagacagagtctccctctgtcgccaggctgg

SEQ ID NO: 20483 - DNA, 201 bp, Homo sapiens
agtattttttttttttgagacagagtctccctctgtcgccaggctggagtgcagtggcacaatctcagctcatggcaacctctgcctctggggttcaagcrattctcctgcttcggcctcccgagcagctgggactacagatgcgcaccaccacgtccggctaatttttgtatttttagtagagacggggttttaccatgt

SEQ ID NO: 20484 - DNA, 201 bp, Homo sapiens
cttgtctcctctctgtgtttctcttctccagaatatgtgtttgtgtgtgtgtgtgtgtgtgtgtgtgtgtgtgtgtgtgtgtgttcctcagctcccctcartgactatagagtgttaaaaaaaaaaaaaacccacattaaaagaaaacaaacaaaaaacccagccatgtctggagttgaatatgtggaggtgttaaagtga

SEQ ID NO: 20485 - DNA, 201 bp, Homo sapiens
gttctttatggttatcagtggataaaactgtggcatcttagtacagaaatctatctgcgtaagttattaaatatcacacacacacacacacacacacacasagagagagagaaatgaacaaagctggatatctgatgaaaatacctgttgaaaatatctgctcataaaaacatgctctattgggtgaaaaaaaaaacaatc

SEQ ID NO: 20486 - DNA, 201 bp, Homo sapiens
cgggttctgacaatctaaaaagggctgagatgagggaactttttccagctccggttcttcccacaatgccaacctacagagagatccaggcggcaggattaaaaaaaaaaaaaaatcacaggatgcagcaaaactaggagaaaactttcggtttttgaagaagaattaaggacattctatattgagtgtagtctaagagtt

SEQ ID NO: 20487 - DNA, 201 bp, Homo sapiens
ctgtaatcccagcactttgggaggtcgaggcaggtggattgcttgaggtcggggttcaagaccagcctgaccaacatggtgaaaccccggatccactaaawatacaaaaattagccaggcatggcagcgggtgcctgtaatcgcagctactcgggaggctgaggcaggagaatcgcttgaacctgggaggcagaatgagcc

SEQ ID NO: 20488 - DNA, 201 bp, Homo sapiens
cccggatccactaaaaatacaaaaattagccaggcatggcagcgggtgcctgtaatcgcagctactcgggaggctgaggcaggagaatcgcttgaacctgrgaggcagaatgagccaagattgcgccactgcactccagcctagatgacacagcgagactctgtctcaaaagccaagtggttgtagctataattcagtctt

SEQ ID NO: 20489 - DNA, 201 bp, Homo sapiens
ttgggaggccggggcaggtggatcacctaaggtcaggtgtttgacaccagcctggtcaacatggtgaaaccccatttctactaaaaatacaaaaattagcygggcgtggtgctgcatgcctgtaatcccagctactcaggaggctgaggcaggaaaatcgcttgaacccgggaggtggaggttgcagtgagccaagatcgc

SEQ ID NO: 20490 - DNA, 201 bp, Homo sapiens
tgatctgcccacctcggcctcccaaagtgctgggattacaagtgtgagccaccgcacctggcctgttgggttttttagaaacaggatttcactctgtcacygaggctgggtgcagtggtgtgatcatagctcactgccaccttgaattccaaggctcaagggatcctcccacctcaggctcccaagtagctgggactagac

SEQ ID NO: 20491 - DNA, 201 bp, Homo sapiens
aatacaaaaattagccaggtgtggtggcgggcgcctgtagtcccaactactcaggaagctgagacgggagaattgcttgaactcgggaggtggaagttgcrgtaagccaagattacggccactgcactccagcctgggtgacagagcgagactatgtctcaaaaaaacaaaaacaagaaaacaaaaagagtactcttcaac

SEQ ID NO: 20492 - DNA, 201 bp, Homo sapiens
ttgcttgaactcgggaggtggaagttgcggtaagccaagattacggccactgcactccagcctgggtgacagagcgagactatgtctcaaaaaaacaaaarcaagaaaacaaaaagagtactcttcaacacacagagtaaccttttactcgttatttgtgtcagctctctataacctgtaactttgcactgggaaggtggc

SEQ ID NO: 20493 - DNA, 201 bp, Homo sapiens
gtggaagttgcggtaagccaagattacggccactgcactccagcctgggtgacagagcgagactatgtctcaaaaaaacaaaaacaagaaaacaaaaagaktactcttcaacacacagagtaaccttttactcgttatttgtgtcagctctctataacctgtaactttgcactgggaaggtggcaggtgacatgaccgcaa

SEQ ID NO: 20494 - DNA, 201 bp, Homo sapiens
ttatgtacttctctatgactgactgttgatatggtgactcttgcaaacataaaatgatcaactgcagattagtttttgttttttgttttgttttgttttgytttttcagtttcactcttgttgcccaggctggagtgcaatggtgcaatctcggctcacctcaacctctgcctcctgggttcaagtgattctcctgcctca

SEQ ID NO: 20495 - DNA, 201 bp, Homo sapiens
atgcagacacttaggataaatgcctcttagagttcactgttggccaggtgcagcagtacacacctgtagttccagcactttgggaggctgaggcaggtggrtcacttgaggtcaggagttcaagaccagcctggccaacatggtgaaaccccatctctactaataatatgaaaatagtgaggtgtggtggtgcacacttgt

SEQ ID NO: 20496 - DNA, 201 bp, Homo sapiens
gctttttattggtcaggataaaatccctgaatttttctttaatttttcccctaaacacacttacataagaaattagagttcattaacatgcccaataaagaatagataagagaaatgtaattaaattttacatgttttaaaagacctgagacttttttctttttattacaatatattgaattttatattgtcagaaatttt

SEQ ID NO: 20497 - DNA, 201 bp, Homo sapiens
ctttttattggtcaggataaaatccctgaatttttctttaatttttcccctaaacacacttacataagaaattagagttcattaacatgcccaataaagaatagataagagaaatgtaattaaattttacatgttttaaaagacctgagacttttttctttttattacaatatattgaattttatattgtcagaaattttt

SEQ ID NO: 20498 - DNA, 201 bp, Homo sapiens
tttttattggtcaggataaaatccctgaatttttctttaatttttcccctaaacacacttacataagaaattagagttcattaacatgcccaataaagaatagataagagaaatgtaattaaattttacatgttttaaaagacctgagacttttttctttttattacaatatattgaattttatattgtcagaaatttttg

SEQ ID NO: 20499 - DNA, 201 bp, Homo sapiens
ttttattggtcaggataaaatccctgaatttttctttaatttttcccctaaacacacttacataagaaattagagttcattaacatgcccaataaagaatagataagagaaatgtaattaaattttacatgttttaaaagacctgagacttttttctttttattacaatatattgaattttatattgtcagaaatttttgt

SEQ ID NO: 20500 - DNA, 201 bp, Homo sapiens
agaaaggcaaagcacaatgcaaggaaatccaacaaataatacaagacataaagggagaaatagtcaaagaaacagatagcttaaaaaaaatcaaaaattcragagacattggacacacttacagaaatgcaaaatgctctggaaagtctcagcaatagaactgaataagtagaagaaagaagaagaaacaagtagtagaag

SEQ ID NO: 20501 - DNA, 201 bp, Homo sapiens
aaggtaagaccaaagaaagaatcttaagagctgtgagacagaagcaccaggtaacctataaaggaaaacctatcagattaacagcagatttctcagcagamaccctataagctagaagggattggggccctatcttcagcctcctcaaacaaaacaatgatcagccaagaattttgcatccagtgaaactaagctccacat

SEQ ID NO: 20502 - DNA, 201 bp, Homo sapiens
ctcagcagaaaccctataagctagaagggattggggccctatcttcagcctcctcaaacaaaacaatgatcagccaagaattttgcatccagtgaaactawgctccacatatgaaagaaagatacagtttttttcaaacaaacaaatgctaagagaattcactactaccaaaccaccactgtaagaaactgctaaaaggag

SEQ ID NO: 20503 - DNA, 201 bp, Homo sapiens
agaattttgcatccagtgaaactaagctccacatatgaaagaaagatacagtttttttcaaacaaacaaatgctaagagaattcactactaccaaaccacyactgtaagaaactgctaaaaggagctctaaatcttgaaacaaatcctggaaacgcatcaaaacagaaactctttaaagcataaatcatacaggacctata

SEQ ID NO: 20504 - DNA, 201 bp, Homo sapiens
tgaaacaaatcctggaaacgcatcaaaacagaaactctttaaagcataaatcatacaggacctataaaacaaaaatacaagttaaaaagcaaaaacaaacaaaaaaaacacaaagtacacagacaacaaacagcgcgatgaatacaacagtacctcacatctcaacactaatattgaatgtaaattgcctaaatgctccac

SEQ ID NO: 20505 - DNA, 201 bp, Homo sapiens
tacttgttaactgaatccaacaacatatcaaaaagataagccaccatgatcaagtgggtttcataccagggatgtagagatggtttaacatatgcaagtcrataaatgtgatacaccacataaacaaaattaaaaccaaaaaatcacataatcatctcaatagatgcagaaaaagcattcgacaaaatccagcatcccttt

SEQ ID NO: 20506 - DNA, 201 bp, Homo sapiens
tccagcatccctttaagattaaaactctcagcaaaatcggcatacaagagacatacctcaatgtaataaaagccatctatgacaaacccacagccaacatratactgaatggggaaaagttgaaagcatttcctcggagaactggaacaagacaaggatgcccactcttaccactcctcttcaacatagtactggaagtcc

SEQ ID NO: 20507 - DNA, 201 bp, Homo sapiens
tgcaaaaattaaaataaaataaaatacttaggaatatacctaaccaaggaatcaaaagacctctacaaggaaaactacaaaacactgctggaagaaatcayagacaacacaaataaatggaaatacatctcatgctcatggatggatagaatcaatattgtgaaaatgaccatactgccaaaagcaatctacaaattcaat

SEQ ID NO: 20508 - DNA, 201 bp, Homo sapiens
ttaaagaagtctcaatacatttcaaaggttagaaatattacagaatatgttatcgaattacaacaaggctaattagaaatcagtagcagtaaggttttttaaaaaaaaaaaatccctaaatctttagaaatgaagttatatactccataataactcactactaaaatattacttcagaaagtcaactcatgggccaggtac

SEQ ID NO: 20509 - DNA, 201 bp, Homo sapiens
ctgaggcacaagaatcgcttgaacctgggaggtggaggttgcagtgagccgagattgcaccactgcactccagcctgggcgacagagtgagatactgtctaaaaaaaaaaaaaaaaaagtcaactcataaatattctgaactgtagataatgaaaacacaacatatcaaaatcattggatgcagctaagcaatacttagag

SEQ ID NO: 20510 - DNA, 201 bp, Homo sapiens
cagtgcttgcagtgagctgagatcacgccactgcactccagcctgggcgacagagcgagactccgtctcaaaaacaaaaaaacagaaaacaaaaacaaaayctgaagcttttcctagagaaccaagagcacttgcaaagggaattttcatggctctgatatcctgaggtagaatcaccctaaacagaccacataaatgatg

SEQ ID NO: 20511 - DNA, 201 bp, Homo sapiens
gcgatggaggtagtttcaggatgattcaagcccattacatttattgtgtactttatttctattattatgtggtaatatataatgaaataattatacaactyaccataatgtagaatcagtgggatccctgagcttgttttcctgcaactagatggtcccatctgggggtgatgggagacaatgacagatgatcaggcatta

SEQ ID NO: 20512 - DNA, 201 bp, Homo sapiens
ctcaccataatgtagaatcagtgggatccctgagcttgttttcctgcaactagatggtcccatctgggggtgatgggagacaatgacagatgatcaggcaytagattctcataaggtagatgcaagctagatccctagcatgcacatttcacaatgttcacagggttcgtgctcctatgagaatctaatgccgccgacgat

SEQ ID NO: 20513 - DNA, 201 bp, Homo sapiens
tgtatctaccaaatatctaccaaaaaataaaattagccaggcgtggtagtacacacctgttgtcccagccactgtggaggagtctgagatgggagaattgyttgaagctgggaggcaaagtttgcagcgagcagagatcacaccactgcactccagcctgggcgacagagcgagaccccatctcaaaaaaaagaaagaaag

SEQ ID NO: 20514 - DNA, 201 bp, Homo sapiens
tggtaaagaaaagcatcactaatgcgaaagagagactttcgctggtccttaaaggatgaagaattagaagggtacatttgagggtgagccacaggtgtgcaaacacacacacacacacacacacacacacacaggtgccaacagtctggcatgcacatagtttctttccaaaagttaaagagagattagatttaaggacca

SEQ ID NO: 20515 - DNA, 201 bp, Homo sapiens
ggtaaagaaaagcatcactaatgcgaaagagagactttcgctggtccttaaaggatgaagaattagaagggtacatttgagggtgagccacaggtgtgcamacacacacacacacacacacacacacacacaggtgccaacagtctggcatgcacatagtttctttccaaaagttaaagagagattagatttaaggaccag

SEQ ID NO: 20516 - DNA, 201 bp, Homo sapiens
taaagaaaagcatcactaatgcgaaagagagactttcgctggtccttaaaggatgaagaattagaagggtacatttgagggtgagccacaggtgtgcaaacacacacacacacacacacacacacacacaggtgccaacagtctggcatgcacatagtttctttccaaaagttaaagagagattagatttaaggaccagaa

SEQ ID NO: 20517 - DNA, 201 bp, Homo sapiens
aagaaaagcatcactaatgcgaaagagagactttcgctggtccttaaaggatgaagaattagaagggtacatttgagggtgagccacaggtgtgcaaacacacacacacacacacacacacacacacaggtgccaacagtctggcatgcacatagtttctttccaaaagttaaagagagattagatttaaggaccagaaaa

SEQ ID NO: 20518 - DNA, 201 bp, Homo sapiens
gcttagagtggtggtggtcatctgtaatcacagctactcaggaggctgaggcatgaaaatcgtttgaacctggggggcaaaggttgcagtgagctgagatsgcaccattgcactccagcctgggtaacagagtgagaccatctcaaaaaaaaaaaaagaaagtcacatggataaatgcaactacattatttatttctatag

SEQ ID NO: 20519 - DNA, 201 bp, Homo sapiens
tgaataaggagatgagagatgacccaatattattttttagagcctcaagttcacaaacaaaagaaaagttttacagaaggtatttctgtaggattgttggtttttttttttttaaagacagcttaagacttagagcaatcaacgtgtgaaaacaaaaaagacattttctgagttgactttgatcctgtactcaaattggct

SEQ ID NO: 20520 - DNA, 201 bp, Homo sapiens
tcagtgacacctttggcaggcccagtgacaacttttctgagcctctaataacacctcctctagagggttgtcctagggattaaacgggctcatgcctgttaaaaaaaaaaaaaaaagcccaggcacaacgccaggtactttttcatggctgctagaaaaccaaaaccaaaaaggtgcgatgatgactatgacccacaggtt

SEQ ID NO: 20521 - DNA, 201 bp, Homo sapiens
gagacattctttgtattattattgtaggattatagagcttaaatgggtgcgaaggatccccagggctgataacattcaaactttatggggtttttttttgtttttttttttttgagaaaaggtctcactctgttgcccaggtcaaggctcactggagccttgacctccctgggctcaactgatcctcctgcctcagcctcc

SEQ ID NO: 20522 - DNA, 201 bp, Homo sapiens
tttgcgggggacgaagtctcactctgttgcccaggctgaagcacactagcacgatctcggctcaccgcaacctccacttcccagatccaagcaattctccygctcagcctctcaagtagctgggaatacagacgtgcaccgccacacccagcaaatttttgtatttttagtagagacggggtttcaccatgttggctgggc

SEQ ID NO: 20523 - DNA, 201 bp, Homo sapiens
agaaataagaaagcacggaccatgcccaaggcaggcggcaatgaggaaggcacaacagcaggggggcatcaccagctggtgcgggttaccagggtgaggcrgggtcagccctcatgggaacagggcctgagaatttggaaagagggaagagaatgtattgatgaagaatgtggactttgatcaggtggaaggaatgacatc

SEQ ID NO: 20524 - DNA, 201 bp, Homo sapiens
ggtgaaaccctgtctctactaaaaacgaaaaaaaaaaaaaaaaaaaaagccagacatggtggtgtgtgcctgtagtcccggctactcgtgaggctgaggcwgaattgcctgaacctgggaggcggaagctgcagtgagccgaaatcacaccactgtactccaggctgggtgacagagtgagacttgatctcaaaaaaaaaa

SEQ ID NO: 20525 - DNA, 201 bp, Homo sapiens
ctcttggctaatcataattaaagtaaaacatttaaaataactccacctcaggattaaattacgcaagttacaggaggccataacttgtaacaagtaaataaatgaatgaatgaatgaatgaatgaatgaggacatgcagcctaataaaaggcagaattaattaggaaagtccaggggctccagttctacctcatcccagac

SEQ ID NO: 20526 - DNA, 201 bp, Homo sapiens
tcttggctaatcataattaaagtaaaacatttaaaataactccacctcaggattaaattacgcaagttacaggaggccataacttgtaacaagtaaataaatgaatgaatgaatgaatgaatgaatgaggacatgcagcctaataaaaggcagaattaattaggaaagtccaggggctccagttctacctcatcccagacc

SEQ ID NO: 20527 - DNA, 201 bp, Homo sapiens
cttggctaatcataattaaagtaaaacatttaaaataactccacctcaggattaaattacgcaagttacaggaggccataacttgtaacaagtaaataaatgaatgaatgaatgaatgaatgaatgaggacatgcagcctaataaaaggcagaattaattaggaaagtccaggggctccagttctacctcatcccagacct

SEQ ID NO: 20528 - DNA, 201 bp, Homo sapiens
ttggctaatcataattaaagtaaaacatttaaaataactccacctcaggattaaattacgcaagttacaggaggccataacttgtaacaagtaaataaatgaatgaatgaatgaatgaatgaatgaggacatgcagcctaataaaaggcagaattaattaggaaagtccaggggctccagttctacctcatcccagacctt

SEQ ID NO: 20529 - DNA, 201 bp, Homo sapiens
atttattataatagagcaaagctatatattacatgacattgctttcaagaaaaacttaagaatcttaacagaaaacaggccaggcgcagtggctcacaccygtaattccagcactttgcgaggccaaggcgggtggatcacctgaggtcaggagttggagaccagcctggccaacgtggtgaaaccctctctccactaaaa

SEQ ID NO: 20530 - DNA, 201 bp, Homo sapiens
gccaaggcgggtggatcacctgaggtcaggagttggagaccagcctggccaacgtggtgaaaccctctctccactaaaaatacaaaacttatttgagtgcrgtggcacacgccaataatcccagctacttgggaggctgaggcagaagaatcgcttgaacctggggagtggaggttgcagtgagccgagatcacaccattg

SEQ ID NO: 20531 - DNA, 201 bp, Homo sapiens
taaattaatttactacttgaaaaagacttcttatgccaagcctgtcaaaaggcaaacaggaaaggagttaagaaactgtaaataaatctaaacacagtttktgtttgatctaattttcaagtgtaggattaaaaaaaggggaagcatgccaaggaaaggcgacaagaggggacgcacaacaaaaacccgcacaggctccat

SEQ ID NO: 20532 - DNA, 201 bp, Homo sapiens
atgggcgccttgttttcagggaagagttgcccagccaggcgcagtggctcacgcctgtaatcctaacacttttggaggctgaggtgggcagatcacctgasgtcaggaatttgagagcagcctggccaacatggtgaaaccccgtctctactaaaaatataaaaaattagctgggcttggtggtgcacgactataatccca

SEQ ID NO: 20533 - DNA, 201 bp, Homo sapiens
cagcctcccgaaatgctgggattacaagtgtaagccaccgcgcctggccctcccatttaattttaaatcatccctagattacttataatgcctaaatacartgtaagtgctatgtatttgtaatacattatttttttgttgtggtattataattttttattggattgtttttccaaatattttccattctcagttggttga

SEQ ID NO: 20534 - DNA, 201 bp, Homo sapiens
taatgaaataaaaccactacaggatcccaatctctcgggcagtcatagactctgcatccctcagatgaaaagtcgtgttgctcatcactgaaaggtttccytacagctgaacagatctactagttacaaatctgaaattgcaaatattttcaccagaaaggagtaaaagagctttaatcctctgacattacaagtcggagg

SEQ ID NO: 20535 - DNA, 201 bp, Homo sapiens
gatctactagttacaaatctgaaattgcaaatattttcaccagaaaggagtaaaagagctttaatcctctgacattacaagtcggaggcaaaggcaacagccagcacaggctgaaggggtcaagatatcaaatgtcatgagatgtaatcaaaacgttaaatgttcttagactgtttaggtcgatttacttttcactgagtt

SEQ ID NO: 20536 - DNA, 201 bp, Homo sapiens
aatcaccactaaagaacttactcatgtaaccaaataccacctgctccccaatagcctatggaaataaaaaaaaaaatttttaaatttaacaaaagatcatragtaaaccagaaaaaaaagaaatagtgatatctaaggtacacacttaagttttagaacaaagaacaaatagatggctagaattaggattagatcttatca

SEQ ID NO: 20537 - DNA, 201 bp, Homo sapiens
tctacatcaagaattagaaaacatggctgaaaaaaaatcagagactacacaaacaaatggaaatatattccatgctcatggataggaatattgtcaaaatkgccatactgcccagagcaatttacagattcaatgctcttcctatcaacctaccaaagccatttttcacagaactagaaaaactatactgaaattcatatg

SEQ ID NO: 20538 - DNA, 201 bp, Homo sapiens
ttcacatattattaagagaatccaaaaatataattcttattgtggtgggacaagctaactaaaaagtctctctctccctctcccctacccatcacaacacacacacacacacacacacacacacacacacacacacacacacacaatcaatgcttcttaagataactgttttgatcaagaggctcttaaatgacaaccaaa

SEQ ID NO: 20539 - DNA, 201 bp, Homo sapiens
tcacatattattaagagaatccaaaaatataattcttattgtggtgggacaagctaactaaaaagtctctctctccctctcccctacccatcacaacacacacacacacacacacacacacacacacacacacacacacacacaatcaatgcttcttaagataactgttttgatcaagaggctcttaaatgacaaccaaag

SEQ ID NO: 20540 - DNA, 201 bp, Homo sapiens
aaaaaaaaaaaagaagaagaagaacaaagaggaaagaaggaagaaggaagaagaatgaagaaggaaggaggaggaggaggagaaggagaagaaggaggagsagaaggagaagaaggaggaggagaaggagaaggagaagaaggagaagaaggaggagaaggagaagaaggagaagaaatcatcatcatcatcatccactgt

SEQ ID NO: 20541 - DNA, 201 bp, Homo sapiens
cagctactctggaggctgaggcaagagaatggcatgaacccaggaggcagagcttgcagtgagccaagatcacgccactgcactccagcctgggtgacagwgcaagactccgtctcaaaaaaaaaaaaaaaaaagaaacagaaacttcgctgctgagaagaaacacagaccttccaggtttaccttccccttctccctaaa

SEQ ID NO: 20542 - DNA, 201 bp, Homo sapiens
taaaattgccccacaggccaggtgcagtggctcacacctgaaatcccagcactttggaagaccaaggcaggtggatcacctgaggtcaggagttcgagacyagcctggccaacatgatgaaaccccacctctactaaaaatacaaaaaaattagccgggcatctgtaatcctagctactcgggaggctgaggcaggagaat

SEQ ID NO: 20543 - DNA, 201 bp, Homo sapiens
gaggcaggagaatcacttgaacccagaaggcggaggttgcagtgagcagagatcaagccactgcactccagcctggatgacaagagcgaaactccatctcwtaaataaataaataaataaataaataaataaataaataaataattgccccaaagactcagggagttcctaactgaaaattcgacattccatgggacacaa

SEQ ID NO: 20544 - DNA, 201 bp, Homo sapiens
aggagaatctcttgaacccaggaggtcgaggctgcagtgagctgagaatgcaccactgcactccagcctgggcaacagagcgagatcctatctaaaaaaawaataataataaaatagattgtcctatattgaaatcccctaagccttggggtctgttgaacttttcccatgcacttagtcttgatccatgcagagacaaat

SEQ ID NO: 20545 - DNA, 201 bp, Homo sapiens
gcaacaaagccttcccaagaaagccctatgttggtcccaaggacctcacttctaacctgtcatagagaaatgatggaggaaaagagctgaaagacaaggcycaggttgccaagtgccacccttccattgaaaaatggcgtaccatctttcctatctccggggcctggtccatcagcagtttcttggttatcaactgtaatt

SEQ ID NO: 20546 - DNA, 201 bp, Homo sapiens
ccagcctgggtgacagagcgagactccatctcaaaaaaaacccaaagtgacagcgagcaaatgacaaagctgggccagactcctgctctgttcgacttctmcaccggaggcccaccgtcctaccgaggatggaaccatgcacagggggccagcagtccatgcttacacacatccaggaaggaaccaagaagtcgccatgca

SEQ ID NO: 20547 - DNA, 201 bp, Homo sapiens
cccttccattgaaaaatggcgtaccatctttcctatctccggggcctggtccatcagcagtttcttggttatcaactgtaactaccagtgggggaaaactwgcaaaatttgccatctgtttctcaactccctaaaacatgatacactccactcactgcaacacactgaaatcaccttgtatattctcctactttgacccta

SEQ ID NO: 20548 - DNA, 201 bp, Homo sapiens
taatcccagctacttgggaggctgaggcatgagaatcacttgaacctagggaaatggaggttgcagtgactctagatcacgccactgcactccagcctggrtgacagagcgagaccatgtctcaaaaactaaatatacatacatacgtgaataaatgaatgaataaataaaaataaataataaatcctgtgcactaggaag

SEQ ID NO: 20549 - DNA, 201 bp, Homo sapiens
cacagagctgtctgtcaatgcttgaagtgtattagagctgggcacggtggctcatgcctgcaatcccagcactttgggaggccaaggcgggcagatcactygaggccagaaattcaagaccagcctggccaacatgggagaaaccctgtctctactaaaaatacaaaaattagccaggcatggtggggcgtgcctgtaatc

SEQ ID NO: 20550 - DNA, 201 bp, Homo sapiens
gccaacgtggtgaaaccttgcctctactaaaaatacaaaaattagctggacatggtggctcacgcctgtaatcccaactactcaggaggctgaggcaggakaattgcttgaacccgggaagtagaggttgcagtgagctgagatcgtgccactgcactccagcctagccgacagagtgagactcatctcaaaagaaaaaaa

SEQ ID NO: 20551 - DNA, 201 bp, Homo sapiens
acagactaattttattaaccaagtaagactgtttctatttctccacatggcccaaggaaagtccatttgtttcacagcctggaagccagtcaggaggctctttttttttttttttttggagacagagcctcactctgtcacccagactacagtgcagtggcgtaatctcggctcactgcaacctccactttttgggttcaa

SEQ ID NO: 20552 - DNA, 201 bp, Homo sapiens
aaagtgcaaaggtgagaggtggccaggaactacccaagaaatcataagaagtatcatgtgctggaatgcaacaactaatcaaatatttaatccaaaagccaaaaaaaaaatacatattttgttttttgagacagagtttcactcttgtcgcccaggcaatggtgcgatctcagctcactgcaacctccgcctcctggttca

SEQ ID NO: 20553 - DNA, 201 bp, Homo sapiens
aagtgcaaaggtgagaggtggccaggaactacccaagaaatcataagaagtatcatgtgctggaatgcaacaactaatcaaatatttaatccaaaagccaaaaaaaaaatacatattttgttttttgagacagagtttcactcttgtcgcccaggcaatggtgcgatctcagctcactgcaacctccgcctcctggttcaa

SEQ ID NO: 20554 - DNA, 201 bp, Homo sapiens
atgcaacaactaatcaaatatttaatccaaaagccaaaaaaaaaatacatattttgttttttgagacagagtttcactcttgtcgcccaggcaatggtgcsatctcagctcactgcaacctccgcctcctggttcaagcgattctcctgcctcagcctctcaagtagctaggattacaggcatgtgccaccacgcccagca

SEQ ID NO: 20555 - DNA, 201 bp, Homo sapiens
taatccaaaagccaaaaaaaaaatacatattttgttttttgagacagagtttcactcttgtcgcccaggcaatggtgcgatctcagctcactgcaacctcygcctcctggttcaagcgattctcctgcctcagcctctcaagtagctaggattacaggcatgtgccaccacgcccagcaaatgtttgtatttttagtagag

SEQ ID NO: 20556 - DNA, 201 bp, Homo sapiens
agggtttcaccatgttggccaggctggtctcaaactcctgacctcaggtgatccacccgcctcagcctcccaaagttcttggattacaggcatgagccacygcgcccagccccctccaaaatttctaataaaacaaagcacaactaacagtatttccatgcctgtttggaatgaaaaatactgattcatatagtttggtcc

SEQ ID NO: 20557 - DNA, 201 bp, Homo sapiens
ccatgcctgtttggaatgaaaaatactgattcatatagtttggtccaatatagatatgcccagtctctataacttgtccatttggctacattaatataaaytatagttttattttaaacaccattattctcaaatactaacatcttagactcattgttgggatttgggatattcagaaacatttggaatttcacttttgta

SEQ ID NO: 20558 - DNA, 201 bp, Homo sapiens
gtggcataatatcggctcactgcaacctctgcctcctggattcaagtgattctcgtgcctgagcctcccaagtagctgggattacaggcgtgtaccaccaygcccagctaattttttaaatttagtagagacggagttttgtcatgttggccaggcaggtctcaaactcctggcctcaagtgatccacctgccttggcctc

SEQ ID NO: 20559 - DNA, 201 bp, Homo sapiens
ggcctaggaaagcagcagctatggggctgagtgctgaccgaagattctggaggtcatgcagtaggagatgccgcccgaggagaggaaggaaatctccactggggcctcaggcattcacctgagacaccaggaaggctatgtcttagtaataaagatctcaccctagattaacagctgtgcacttggaataagttcagaatg

SEQ ID NO: 20560 - DNA, 201 bp, Homo sapiens
agtgctgaaagacagacaaaaataactggccaggtgcggtggctcatgcctgtattcccagcactttgggtggttgaggcgggcagatcactcgagcccargacttcgagaccagcctggccaacatggtgagaccccgcctctactaaaaatacaaaaattagccgggcacagtggtgggcacctgtaattccagccact

SEQ ID NO: 20561 - DNA, 201 bp, Homo sapiens
ctcaggcaggaaaatcacttgaacctgggaggcagaggttgcagtgagccgagatcgcgccactccactccagcctgggtgataggtgagactccaattcaaaaaaaaaaaaaaaaaacacctgtcaactctgaattctatcaccaacacaaaatgtcctttaaaatatgagggtgaaattaggacattttcagaaaaagg

SEQ ID NO: 20562 - DNA, 201 bp, Homo sapiens
cgagatcgcgccactccactccagcctgggtgataggtgagactccaattcaaaaaaaaaaaaaaaaaacacctgtcaactctgaattctatcaccaacayaaaatgtcctttaaaatatgagggtgaaattaggacattttcagaaaaaggctgagagactttatcagcaatgaacctgaactgtaaaaaacagcgtaaa

SEQ ID NO: 20563 - DNA, 201 bp, Homo sapiens
aaagcaagtcttagagtaaacttttggctttaaggactttgcatttaaaaagaaggcataaaattgataatcaaagttctacctaaaatcaacaccaaagaaacaaacaaacaacaacaacaaaacactgctcacatcctcagaagtacaattagtgtaatcatatatctgtgttaccctcagcagctaccagaatatata

SEQ ID NO: 20564 - DNA, 200 bp, Homo sapiens
tggtggcgcacacccctgcaatcccagctactggggaggctgaggcaggagaatcgcttgaacccgagaggcaggggttgcagtgagccaagattgcgccctccagccagggtgacagtgagactccttctcaaaaattaaaaaaataaataaataaaacaaaagatgcaaaccgcagttcatcaccttcacgatgcaaa

SEQ ID NO: 20565 - DNA, 201 bp, Homo sapiens
ttcagccagttaatatggtattggagtaaaattcaatactttttagaattatcagaagtcagacatacaatgtatcatccaaaatgtccacaataaaaaaycttagacatgcaagaaagaaaatttaactcagggcaataaagaaagcagtcttcataataaaaaccaaacccctcaaatatataaataataaaagcaaat

SEQ ID NO: 20566 - DNA, 201 bp, Homo sapiens
ccagtgtaaagtatttttaaaaagagcccaataaacactctagagctgcaatactgaaatgagaaataaaggagaaaagaaaaatcactggctggtcttaycagcagtttaaaagcaacagagaagattgaataaaagtgaaaaagactgactgtcctataagacaatctcaaatagtttaatatatatgtaataggagtc

SEQ ID NO: 20567 - DNA, 201 bp, Homo sapiens
tgtggtagaggaggctgtctgctgctctgaccactgacctaaaaatatacctgccctgcagcaatgccaagaaaagagaaggaaaagatcaaggccaggcrcagtggctcacacctgtaatcccagcactttgagaggtcaatgtaggcgcattacctgaggtttggagttcgcgaccagcctggccaacatggtgaaatg

SEQ ID NO: 20568 - DNA, 201 bp, Homo sapiens
aatcaaactctccaatttttcccaatccaaactccaagagtcggtagatctaacaccaccaagtccagcttcagttggagtggggaaaagaaccagacttggaggattccaggctcttggacccacaggacattgcttcagtatgtttctgccccctacaagcccggatgtgcccagaagaactgccactttggctcaggt

SEQ ID NO: 20569 - DNA, 201 bp, Homo sapiens
tagcacgggatcaggatatttacagaagacattcccatccctcagatgggtcatgatattaaatcccaacacgcctgtctcggcatgtgaacgcgcgcgtgcgcgacacacacacacacactctctctcacacacttcaccaactgcactgccttccatgaggtcatggaagttttcccctatgatacagaaatcagaaaa

SEQ ID NO: 20570 - DNA, 201 bp, Homo sapiens
gcacgggatcaggatatttacagaagacattcccatccctcagatgggtcatgatattaaatcccaacacgcctgtctcggcatgtgaacgcgcgcgtgcgcgacacacacacacacactctctctcacacacttcaccaactgcactgccttccatgaggtcatggaagttttcccctatgatacagaaatcagaaaata

SEQ ID NO: 20571 - DNA, 201 bp, Homo sapiens
cacgggatcaggatatttacagaagacattcccatccctcagatgggtcatgatattaaatcccaacacgcctgtctcggcatgtgaacgcgcgcgtgcgcgacacacacacacacactctctctcacacacttcaccaactgcactgccttccatgaggtcatggaagttttcccctatgatacagaaatcagaaaatac

SEQ ID NO: 20572 - DNA, 201 bp, Homo sapiens
acgggatcaggatatttacagaagacattcccatccctcagatgggtcatgatattaaatcccaacacgcctgtctcggcatgtgaacgcgcgcgtgcgcgacacacacacacacactctctctcacacacttcaccaactgcactgccttccatgaggtcatggaagttttcccctatgatacagaaatcagaaaatacc

SEQ ID NO: 20573 - DNA, 201 bp, Homo sapiens
cgggatcaggatatttacagaagacattcccatccctcagatgggtcatgatattaaatcccaacacgcctgtctcggcatgtgaacgcgcgcgtgcgcgmcacacacacacacactctctctcacacacttcaccaactgcactgccttccatgaggtcatggaagttttcccctatgatacagaaatcagaaaatacca

SEQ ID NO: 20574 - DNA, 201 bp, Homo sapiens
tacagaagacattcccatccctcagatgggtcatgatattaaatcccaacacgcctgtctcggcatgtgaacgcgcgcgtgcgcgacacacacacacacactctctctcacacacttcaccaactgcactgccttccatgaggtcatggaagttttcccctatgatacagaaatcagaaaataccatttagttgaagaatt

SEQ ID NO: 20575 - DNA, 201 bp, Homo sapiens
acagaagacattcccatccctcagatgggtcatgatattaaatcccaacacgcctgtctcggcatgtgaacgcgcgcgtgcgcgacacacacacacacactctctctcacacacttcaccaactgcactgccttccatgaggtcatggaagttttcccctatgatacagaaatcagaaaataccatttagttgaagaatta

SEQ ID NO: 20576 - DNA, 201 bp, Homo sapiens
ctttaaacaaaatagtttaactagtttatttgactgtaaaaaaaatagtttgaaaagatagtccctgcacattattatctaccctaaggacaatgtaaacwgcaaaaaaaaaaaatttaaattatttttagaaatcatattatgggtaatagtgttgatactgtaagataaaataaatgaataagtatgttgatatcaaga

SEQ ID NO: 20577 - DNA, 201 bp, Homo sapiens
cacaatcatactcatcaaaatatacagaacaagcaataacaaaaaatccattaactccacaggaaaatgctggagaatcactcattattttgaaaatcggtttaaaaaaaaataacaaaattaatcatttctcctgcctttcctataggtgtactgtaactcagagtatcaaagagttgataatggcaaagtttctcttta

SEQ ID NO: 20578 - DNA, 201 bp, Homo sapiens
atcgagaccatcctggccaacatggtgaaaccccatctctactaaaaatacaaaaaaattagctgggtgtggtggcgcacacctgtagtcccagctactcrggaggcagaggcagcagaatcacttgaacctgggaggcagaggttgcagtgagccgagatcgtgccactgcactccagcctggtgacagactgagactcc

SEQ ID NO: 20579 - DNA, 201 bp, Homo sapiens
cagctactcgggaggcagaggcagcagaatcacttgaacctgggaggcagaggttgcagtgagccgagatcgtgccactgcactccagcctggtgacagamtgagactccatctcaggaaaaaaaaaaaaaaatacacatctcatttctcaaagaaacatttagataatcttcaactatctaaaatacaaagaccaacaag

SEQ ID NO: 20580 - DNA, 201 bp, Homo sapiens
gctgaagtgcagtggcgtgatctcagctcactgcaacctccacctcccaggttcaagcaattctcctgcctcagcctcctgagtagctgggattacaggcrcccaccaccatgcccagctaatttttatatttttaatagagatggggtttcaccaggttggtcaggctggtctcgaactcctgaccttgtgatccgcccg

SEQ ID NO: 20581 - DNA, 201 bp, Homo sapiens
aacttctccaaaacagccaagtgtcaataggcaaggctgggaaaacaatagtatttatactagaattcaggctgttttcactgctagaaggaaaagaaaaraaaaaatccaaggattactttgagttgaactgggaagagctttagctccctgaacttcactgcatcggaactaaaagttctaccagttattatgttaaag

SEQ ID NO: 20582 - DNA, 201 bp, Homo sapiens
acctgtggtcctagctacttgggaggactgcttgagcccagtaggccaaagctgcagtgagccaagatagcaccactgcactccagcctggcaacagagtragaccctatctcaaaaaacaaaataaaataaaataacatgaaagaagaaagaaagaaagaaagaaagaaagaaagaaagaaagaaagaaagaaagaaaga

SEQ ID NO: 20583 - DNA, 201 bp, Homo sapiens
ttgcgtgcgagcaaatgcttttccccatcttctcccatgattagatcttctctcctgcaggtctcaatccccagaaagtcctacccttgtgtacaaaaaamcaaacataccctcattgtcgatcatttatatcctcattctcactttctttacccatttactacaatctatttgtgtagatacaaaaaaatgcacttaatt

SEQ ID NO: 20584 - DNA, 201 bp, Homo sapiens
agtaaatccaccggttcaattccactccaagagttcaaggcatctatgttaacaaagaattacagtaagatgggacatgttacatctgtgtagtgtggggaaaaaaaaaaaaaaaagatgggacacatgtggacacaggctatgcacagactctacttctgggctttctaagggatcaacatcccagctcacgagactcat

SEQ ID NO: 20585 - DNA, 201 bp, Homo sapiens
cgctttgggaggctgaggcagggggatctcttgagcccaaatgttcgagaccagcctgggcaacatagtgagaccttctctccacaaaaaaaaaaaaaaawttaattggctgggcacagtggcacacacctgtagtcctagccactctggaggctgaggtaggaggaatgcttgagcccaggggcttgaggttacagtgaa

SEQ ID NO: 20586 - DNA, 201 bp, Homo sapiens
ctgcattaccagctgatatggtttggttgtgtccctactcaaatctctttttttttttttttgagatggagtttcgctctgtctccactcaaatctcatcttttttttttttttttgagacggagtttcgcccaggctggaatgcaatggtgccatctcagctcactgcaacctccacctcccaggttcaagtgattctcc

SEQ ID NO: 20587 - DNA, 201 bp, Homo sapiens
ctaagaaaaattcttctgccttgagatgctgttaatctgtaaccctacccccaaccctgtgctcgcagagacatgtgctgtgttgactcatgatttaatgratttaaggctatgcaggatgtgctttgctaaacaaatgcttgaagacagcgtgcttcttaaaagtcatcaccactccctaatctcaagtacccagggaca

SEQ ID NO: 20588 - DNA, 201 bp, Homo sapiens
aggcctctttgcagttgagataagaggaaggcatctgtctcctgctcgtcccttggcaatggaacgtctcagtgtaaaacccaattgtatattccatctaytgagataggagaaaaccaccttagggctagaggtgagacatgctggcggcagtactgctgtttaatgcattgagatgtttatgtatgtgcacatcaaagc

SEQ ID NO: 20589 - DNA, 201 bp, Homo sapiens
ggtcctggcgcgggttctccgtattctgagcggcggtcccctgggcccacttttctttctctatactttgtctctgtgtctctttcttttctcagtctctygtcccacccgatgagaaacacccacaggtgtggaggggaaggccaccccttcactaataggctaggaagtgacaggtctcaactccctggagatgggaca

SEQ ID NO: 20590 - DNA, 201 bp, Homo sapiens
ctgcttgaacacaggaggtggaggctgcagtgagctgagactgcgccactgcactccagcctgggtgacacagcgagactccatctcaaaaaaaaaaaaawatatatatatatatatatacacacaacattgatcaagatttaaaagtaatacagaccacaaagagtttgaagttgactttcagttctttctgagggaagg

SEQ ID NO: 20591 - DNA, 201 bp, Homo sapiens
gcttgaacacaggaggtggaggctgcagtgagctgagactgcgccactgcactccagcctgggtgacacagcgagactccatctcaaaaaaaaaaaaatawatatatatatatatatacacacaacattgatcaagatttaaaagtaatacagaccacaaagagtttgaagttgactttcagttctttctgagggaaggga

SEQ ID NO: 20592 - DNA, 201 bp, Homo sapiens
tgggaaggggaagagaaaaaatgacttttttcatcttttaatacagtgatttaagaaaagtaaatattccacattaccaggctgtgaaaaaaaaaaaaaaaagaaagaaaagaaaaataggaaaggaataagaaaaggtgggcgtaatagtgactgctgaactacaaccacagcttagctcacctaatccattccttggcc

SEQ ID NO: 20593 - DNA, 201 bp, Homo sapiens
gaaggggaagagaaaaaatgacttttttcatcttttaatacagtgatttaagaaaagtaaatattccacattaccaggctgtgaaaaaaaaaaaaaaaagaaagaaaagaaaaataggaaaggaataagaaaaggtgggcgtaatagtgactgctgaactacaaccacagcttagctcacctaatccattccttggcccat

SEQ ID NO: 20594 - DNA, 201 bp, Homo sapiens
agagaaaaaatgacttttttcatcttttaatacagtgatttaagaaaagtaaatattccacattaccaggctgtgaaaaaaaaaaaaaaaagaaagaaaagaaaaataggaaaggaataagaaaaggtgggcgtaatagtgactgctgaactacaaccacagcttagctcacctaatccattccttggcccatttgtgggt

SEQ ID NO: 20595 - DNA, 201 bp, Homo sapiens
agaaaaaatgacttttttcatcttttaatacagtgatttaagaaaagtaaatattccacattaccaggctgtgaaaaaaaaaaaaaaaagaaagaaaagamaaataggaaaggaataagaaaaggtgggcgtaatagtgactgctgaactacaaccacagcttagctcacctaatccattccttggcccatttgtgggtct

SEQ ID NO: 20596 - DNA, 201 bp, Homo sapiens
gtctgggacagagcatgagaacctgtgtttctccccagccccagatgatggcaatgctactgtctgcaaaccacactgagtagggaagctacaggcagagccaccacgcatgagtttctcttctttcagatgcctcatagatggtggccaaatgggccgggcacggtggctcacgcctgtaatcccagcactttgggaggc

SEQ ID NO: 20597 - DNA, 201 bp, Homo sapiens
caccacgcatgagtttctcttctttcagatgcctcatagatggtggccaaatgggccgggcacggtggctcacgcctgtaatcccagcactttgggaggcygaggcgagacgattataaggtcaggagatcgagactatcctggttaacatggtgaaactccatctctactaaaaatacaaaaaattagcctggcatggtg

SEQ ID NO: 20598 - DNA, 201 bp, Homo sapiens
ccatggggactatttgtcctaagactttgactgagcaccatggaccctcctgctctgtcaaatgcctcttcctgctggctccaggtttacactactgatabggctctgtgtccccacccaaatctcatcttgtagctcccacagttcccacatgttgtgggagggatccaatgggagataattgaatcatgggggcgggtc

SEQ ID NO: 20599 - DNA, 201 bp, Homo sapiens
acatgttgtgggagggatccaatgggagataattgaatcatgggggcgggtctttcctgtgctgttcttgtgatagtggataagtctcacgagatctgatgggttttttttttggtttggttttttttttttttttttgagacggagtctcgctgttgcccaggctggaatgcagtggcgcgatctaggctcactgcaggc

SEQ ID NO: 20600 - DNA, 201 bp, Homo sapiens
caatgggagataattgaatcatgggggcgggtctttcctgtgctgttcttgtgatagtggataagtctcacgagatctgatgggttttttttttggtttgkttttttttttttttttttgagacggagtctcgctgttgcccaggctggaatgcagtggcgcgatctaggctcactgcaggctccgccccccggggttcac

SEQ ID NO: 20601 - DNA, 201 bp, Homo sapiens
atgggagataattgaatcatgggggcgggtctttcctgtgctgttcttgtgatagtggataagtctcacgagatctgatgggttttttttttggtttggtkttttttttttttttttgagacggagtctcgctgttgcccaggctggaatgcagtggcgcgatctaggctcactgcaggctccgccccccggggttcacgc

SEQ ID NO: 20602 - DNA, 201 bp, Homo sapiens
atggtggcgggcgcctgtaatctcagttatttgggagcctgaggcaggaggatcgcctgaacccaggaggtggaggttgcagtgagctgggaccatgccaytgcactccagcctaggcaacaagagtgagacttctcaaaaaaaaaaaaaaaatccacaaagaaagtagggagccatggtagtgaatgggggcgtttactc

SEQ ID NO: 20603 - DNA, 201 bp, Homo sapiens
cctgaggcaggaggatcgcctgaacccaggaggtggaggttgcagtgagctgggaccatgccattgcactccagcctaggcaacaagagtgagacttctcaaaaaaaaaaaaaaaatccacaaagaaagtagggagccatggtagtgaatgggggcgtttactctagatgggtggtcaaggcagagtttcccaggaggaca

SEQ ID NO: 20604 - DNA, 201 bp, Homo sapiens
ccatgccattgcactccagcctaggcaacaagagtgagacttctcaaaaaaaaaaaaaaaatccacaaagaaagtagggagccatggtagtgaatgggggygtttactctagatgggtggtcaaggcagagtttcccaggaggacaaagcccccagtgacaagagcagggtcaacaagttccaagcaaagagaacagcaag

SEQ ID NO: 20605 - DNA, 201 bp, Homo sapiens
ggatcacctgagcccgagcacagggaggttgaggctgcagtgagctatgatcgcaccacttatactccagcctgagagacagagcaagaccctgtctcggaaaaaaaaaaaaaaaaaaaaaaaaaaacacagactgacaacaactcaatgaactcagataattagaaattctattagtctaatttcatatgaaaccaaggt

SEQ ID NO: 20606 - DNA, 201 bp, Homo sapiens
tggcccaattccctgggaccaccaccctggaaggacacttgagccctactcaaggacccaccacaacatctcagcattgtcggtccttaaatgccaaggtytgtgctcaccatttccatccttaagattctcacagggaagaacccacacaacagctttgtccctgcgactctgggtgagtttctgacactggcctgggct

SEQ ID NO: 20607 - DNA, 201 bp, Homo sapiens
gggtggaggttgcagtgggctgagatcacaccactgtactccagcctggacaacagagccactgcactccagcctgggcaacagagagagactccatcttaaaaaaaaaaaaaaaaaatccctgtcttcaaatacaatcacattctgaagtactagagatcaggactccaacatgcgaactttggggggacataattcagc

SEQ ID NO: 20608 - DNA, 201 bp, Homo sapiens
gagacggaggttgcagtgagccgaaatcgcaccactgcactccagcctgggcaacggagtgagactctgcctcacacaaataataaataaataaataaatattttataatgtatttttaaaatatagttcttaaaacatgccatgagtaggtttaatttttctaaatcatagaataggatactgaagcccagagtggtcat

SEQ ID NO: 20609 - DNA, 201 bp, Homo sapiens
agatagatagatgatagatagatagatgcgtggatcccacccccagaaattatttttccaattggcctataaggggaacagacatccatatttttatggckgtccaggtgatccaatcatggtgagggctaagaaactgctatgtaatctaaaaagaatttagaaaaaacaaagctaataaggttaaaagaaataatgcac

SEQ ID NO: 20610 - DNA, 201 bp, Homo sapiens
taaggggaacagacatccatatttttatggctgtccaggtgatccaatcatggtgagggctaagaaactgctatgtaatctaaaaagaatttagaaaaaayaaagctaataaggttaaaagaaataatgcacatcaacaatcatttgaagggagcaatttgagagtatattcatgaaaagcagcaccaagagccagcttgt

SEQ ID NO: 20611 - DNA, 201 bp, Homo sapiens
aggcacgagaattgcttgaaccagaaggtggaggttgcagtgagccaagatcataccactgcacgccagcctgggcaacacagtgaaactccatttaaagaaataataataataagataaacttctccatgagccccaaactcatgaccaattgaatgcctattcaacatctccacttgaatgtgtagcaggcatctcaaa

SEQ ID NO: 20612 - DNA, 201 bp, Homo sapiens
ggcacgagaattgcttgaaccagaaggtggaggttgcagtgagccaagatcataccactgcacgccagcctgggcaacacagtgaaactccatttaaagaaataataataataagataaacttctccatgagccccaaactcatgaccaattgaatgcctattcaacatctccacttgaatgtgtagcaggcatctcaaac

SEQ ID NO: 20613 - DNA, 201 bp, Homo sapiens
gcacgagaattgcttgaaccagaaggtggaggttgcagtgagccaagatcataccactgcacgccagcctgggcaacacagtgaaactccatttaaagaaataataataataagataaacttctccatgagccccaaactcatgaccaattgaatgcctattcaacatctccacttgaatgtgtagcaggcatctcaaact

SEQ ID NO: 20614 - DNA, 201 bp, Homo sapiens
cacgagaattgcttgaaccagaaggtggaggttgcagtgagccaagatcataccactgcacgccagcctgggcaacacagtgaaactccatttaaagaaataataataataagataaacttctccatgagccccaaactcatgaccaattgaatgcctattcaacatctccacttgaatgtgtagcaggcatctcaaactt

SEQ ID NO: 20615 - DNA, 201 bp, Homo sapiens
acgagaattgcttgaaccagaaggtggaggttgcagtgagccaagatcataccactgcacgccagcctgggcaacacagtgaaactccatttaaagaaataataataataagataaacttctccatgagccccaaactcatgaccaattgaatgcctattcaacatctccacttgaatgtgtagcaggcatctcaaactta

SEQ ID NO: 20616 - DNA, 201 bp, Homo sapiens
ttgaactcctgaccttgtgatccacctgcctcggcctcccaaagtgctgggattacaggcataagccaccgcacccagcctggactacgttttcttttgcttttttttttttttgagacagagtctcattctgtagcccaggctggagtgcagtggtgcaatcttggctcactgcagcctccacctcctgggttaaagcga

SEQ ID NO: 20617 - DNA, 201 bp, Homo sapiens
acacaggctcattgtaagcacctcagcctctcatacaatacaccaaatgattaaactttacctgaataaattcctaagtaccagttaagatctagcttctyggttacatttcctcctccatttacagtgacatttagcatactttgtttgtttgccctatggaacatggggagaaaaaaatattaagctatatatgaaatt

SEQ ID NO: 20618 - DNA, 201 bp, Homo sapiens
cctcccaagtagctgggattacaggcgtgtaccaccatgcccagctaattttttaaatttagtagagacggagttttgtcatgttggccaggcaggtctcdaactcctggcctcaagtgatccacctgccttggcctcccaaagtgttgggattacaggcttcagccaccacgaccagctaacaaccatattcctaacaca

SEQ ID NO: 20619 - DNA, 201 bp, Homo sapiens
cgtaccaatcactaattctctgtgcaacattattaaacacatggggccttagtctcttcaccctgcctggatcacagggtttcaatgtgttcaatgggaartgacaaatatggagtatcaactatctggaggacaccaggagccccagcagatacagtgacacagtcatgttttcctgccttgggagacagggctaggtat

SEQ ID NO: 20620 - DNA, 201 bp, Homo sapiens
cagtgacacagtcatgttttcctgccttgggagacagggctaggtatgtccagacacctgtgattcaactgtgacctgcacagagaactggggacagttckaactgagggacactgggtgggagagaccctggacgatgaaggagggactttatggagggaagggaagggcactgcaggggaggcctagctaggacagaag

SEQ ID NO: 20621 - DNA, 201 bp, Homo sapiens
tgagggacactgggtgggagagaccctggacgatgaaggagggactttatggagggaagggaagggcactgcaggggaggcctagctaggacagaagtacrgagaaggaggatgtgggggctgctgaataaagaacaccccaaacctggctgaagcaggtgaagctcatggaagcggggctgaaacaggtgaagcttatgg

SEQ ID NO: 20622 - DNA, 201 bp, Homo sapiens
actgggtgggagagaccctggacgatgaaggagggactttatggagggaagggaagggcactgcaggggaggcctagctaggacagaagtacggagaaggrggatgtgggggctgctgaataaagaacaccccaaacctggctgaagcaggtgaagctcatggaagcggggctgaaacaggtgaagcttatggaaatgggg

SEQ ID NO: 20623 - DNA, 201 bp, Homo sapiens
cacagtacagaaacgatccactggaaaagaacaggcaagatcctaaacagaaatggccacagtgggtttacacctgctaaagcagaaagccaagcacccascacaggtgaagccattctggggaaacaaagagtgggtctgggagactcgcaagagaatccgaccagcggcattagaagaatgtcttgatcgtgactatct

SEQ ID NO: 20624 - DNA, 201 bp, Homo sapiens
tttatatgaaccagaatagaatggatataatagaaaatatcagggcgcagaagcatggagtaatatcgtgttgtgagacttttgtttctgtgcgtgtgtgygcacctgcacgagcccacactaaatcatgttgcaaagcagagttctgatcggggactgcgccagccaacatgggtttaaagtccctaggagagggttcag

SEQ ID NO: 20625 - DNA, 201 bp, Homo sapiens
cagaatagaatggatataatagaaaatatcagggcgcagaagcatggagtaatatcgtgttgtgagacttttgtttctgtgcgtgtgtgtgcacctgcacragcccacactaaatcatgttgcaaagcagagttctgatcggggactgcgccagccaacatgggtttaaagtccctaggagagggttcaggaactcaggat

SEQ ID NO: 20626 - DNA, 201 bp, Homo sapiens
gttaagctctctgtgcctcagtttgaaaatgtgtcaaatgaggatgacacagaattgctgtgaggacgaagtgggagatggcaaggaaagaagataaccaygttaaggattctgcaaatgttaggaattctcactacttgtgtaacttgtctgggacgcaacaatcactaaagcactggatctaagagggacaagcccctg

SEQ ID NO: 20627 - DNA, 201 bp, Homo sapiens
taatctctctgactaagttgcagcttacacaaggtggggggtggggggtatcaatgaagtttttaataaaccttaacatatcttagcccatttttgaaaasaaccttagaagtgagactgaggggaaatggtaaaaataccatagttattctactttgggccaaaaaaagagaagctaatccaatcatccaaggagccagt

SEQ ID NO: 20628 - DNA, 201 bp, Homo sapiens
ctgtcagaggaacaaaatgagaggacgtggactataaatccgtaccaatcactaattctctgtgcaacattattaaacacatggggccttagtctcttcaycctgcctggatcacagggtttcaatgtgttcaatgggaaatgacaaatatggagtatcaactatctggaggacaccaggagccccagcagatacagtgac

SEQ ID NO: 20629 - DNA, 201 bp, Homo sapiens
ttccccatcttctcccatgattagatcttctctcctgcaggtctcaatccccagaaagtcctacccttgtgtacaaaaaaccaaacataccctcattgtcratcatttatatcctcattctcactttctttacccatttactacaatctatttgtgtagatacaaaaaaatgcacttaattactttgtcactttcccctct

SEQ ID NO: 20630 - DNA, 201 bp, Homo sapiens
gctacttttgggcagggaggaattcctgagagtttcaattgtctaccatgaatgaggccatactggggcaggtgcatattggggacacgtgacctagcacmatgtctttagcattcttttctgggataaatgatttgtgctttgcaattagcaaacactgactttgctacctgtgtagctccagagaagaccctgttagta

SEQ ID NO: 20631 - DNA, 201 bp, Homo sapiens
aaggtaaaaaggaatactaaaaactgaaagcataacatgacagaactaagacaaaacatacttataatctcaataaatgtaaatgtactaaaatcatctaytaaaaacaaaggctaagattaaacctcagagtaaaacctaaccacgccatatacaggagacacacctttggatattcaaagacaatcccatatatagcag

SEQ ID NO: 20632 - DNA, 201 bp, Homo sapiens
ggataatttttgagtttttcatagagatgagggtcctcctcctgccttggcctcccaaagtgctgggattacaggcaggtgtgagccaccatttccagcasgccactgtgtttcaagcacaccatttgatgactaccaggacatacctccctcctgcatagcagcggacatgagggctagctacttttgggcagggaggaa

SEQ ID NO: 20633 - DNA, 201 bp, Homo sapiens
ttacataatgaagaatcttagcaagttcaatgaaggacaaaaacaaagagatctatacctagacacacattaaacacagagaaacaacaaaaacaagcagmagctgacacaccagaaacaatgaaaacaagaagacaacagaacaatatttacagtgctgaaagacagacaaaaataactggccaggtgcggtggctcatg

SEQ ID NO: 20634 - DNA, 201 bp, Homo sapiens
tttagtagagatagggtttcaccatgttggccaggctagtctcaaactcctgacttcatgtgatctgcccgccttggcctcccaaagtgttgggattacakgccaccgtgcctggccagtgtaaagtatttttaaaaagagcccaataaacactctagagctgcaatactgaaatgagaaataaaggagaaaagaaaaatc

SEQ ID NO: 20635 - DNA, 201 bp, Homo sapiens
ttcaatggggaaagagtagtcttcaacaagttgttatcaggaaactggccctgggaagcgaatgtgcttctcttaagattttacagcttagaaaatgacarcactgagatgtgaactcaggtctgactgctctgagtccatgattgctctcagagtccacactcaatctctacccttgccaatctgccactagaggacttc

SEQ ID NO: 20636 - DNA, 201 bp, Homo sapiens
ttgtgaatgtttttaagctactttgtatatgatgaactgtggaaggcaaggaaatcagtcaggaattggatttgaaagaaacttcaccaatacagtgactygcatccttttattcaagcaaactagatcccttcaccctcccaatatccccagtctgcacaattctcacctcccctgcttggtcgtaactctgtgactcta

SEQ ID NO: 20637 - DNA, 201 bp, Homo sapiens
agtcccagctactcgggaggctgaggcaggagaatggcgtgaacctgggaggcggagcttgcagtgagccgagatcgcgccactgcactccagcctggggkacagagccagactccgtctcaaaaaacagatggtggtcaaatgataagcagtggaaaaatatacccaagatgacccaagaaatagccagatggcctttct

SEQ ID NO: 20638 - DNA, 201 bp, Homo sapiens
taaaatatttattttaaggaaaaacaaggactacattatattttaaagggggagaaggaagaggattttgagttgctaagagaacagagccatctcttttyttttaatactggatgctaagaacttgcacagggttttcccaaaagccagatagttcaggtaatttgcatgtggctgtaaaagagaaagttcaggccaggc

SEQ ID NO: 20639 - DNA, 201 bp, Homo sapiens
agatcttgctatgccaaaaagaacggtagctacagttaaacctgaaataaagaaatatcacttagagaacacagcatatctctgcattttcttcaatagtkgctaaagcaagccaggtagtttataaagatgttacttaatttattccataaagcatctggattctacataagtataatgtatttacaaaatacattgaca

SEQ ID NO: 20640 - DNA, 201 bp, Homo sapiens
gctaaagcattttcttccagtttgcacccacaccccagtgaagcaaatacaattatcagatgatgggacgcatctgacactcctaaatctccagcagcagmaatttcctcttggaaaaatccaaacaaaacaagtcctccctccttaacttgctttcttagctcaaactccaagctatggaaagttaacttggctcctctt

SEQ ID NO: 20641 - DNA, 201 bp, Homo sapiens
attgctcaaagtttatctgtccctgggaaataaatatgagtgtctttaatttaagacatgtgtcatgtaactcagcgcacagccatgccccacacataagyctcacttatgtgagcccacacatgcctgcaggagcgccaacatgcctttccaggtgcatttgtcccaacaagaaccagatcccatttgtcacaacaagaa

SEQ ID NO: 20642 - DNA, 201 bp, Homo sapiens
accatcttgcggctcggcctcctctcagtcctcctcctctccaggaggcctctttattcagctggagaggcgttgcatggggctggtttttgtgttccagkcgtggaagcgagacaccttttgcaaccacttcctattggccaggtctcagtttcatggtcacctctgaccacaaggttggggtagaaaacatagtccagg

SEQ ID NO: 20643 - DNA, 201 bp, Homo sapiens
acctcatttaatgaatttggacacgcccccaagtacaaaaggacataagtttctacttaagagccaaccaaagtaattttgagccaaattagggaagaacrgagaggctgtcagaggaacaaaatgagaggacgtggactataaatccgtaccaatcactaattctctgtgcaacattattaaacacatggggccttagtc

SEQ ID NO: 20644 - DNA, 201 bp, Homo sapiens
cttgtagggagctctctcatttcaccggggaaaatgtaagtaattaacaactcttggggaggaaatcaatctagcatagcaaaagccttgaaatttgtacrccctaggaaatgaaggatctgtccaaatgtttagctttaatcatgtccattaaaatgctatttgtaatatacaaaaactagaagacatctaactatctaa

SEQ ID NO: 20645 - DNA, 201 bp, Homo sapiens
tccaacttaattcaatggggaaagagtagtcttcaacaagttgttatcaggaaactggccctgggaagcgaatgtgcttctcttaagattttacagcttaraaaatgacagcactgagatgtgaactcaggtctgactgctctgagtccatgattgctctcagagtccacactcaatctctacccttgccaatctgccact

SEQ ID NO: 20646 - DNA, 201 bp, Homo sapiens
tacaacagagagcagtttgaggaaccactgagctaaagcattttcttccagtttgcacccacaccccagtgaagcaaatacaattatcagatgatgggacrcatctgacactcctaaatctccagcagcagaaatttcctcttggaaaaatccaaacaaaacaagtcctccctccttaacttgctttcttagctcaaactc

SEQ ID NO: 20647 - DNA, 201 bp, Homo sapiens
cagtgtttccagttttactgaatcagtccagagtggatgctggagaatctgcatctcttagaatctcccaagtgatgccgatgctgctgctctgagtgctrtgctttgagaacagctgccctaaagcacactaatagttgttacacatgcatcatctccaactgcaggtactttaagaatttcccttgagaaactctagcc

SEQ ID NO: 20648 - DNA, 201 bp, Homo sapiens
gcaaagagaacagcaagtgctgaagcctaaggctaatgcacttacagaaaaatccttaatgactaagtgtgttgcctctgtttgcgcagagatcacaaaaygtgtcccgcagaagggagagaaaaagggaccccaggagagggtggcggggcttcaggtcctggagaaaggcagcaagcatggctaacacattccttggtc

SEQ ID NO: 20649 - DNA, 201 bp, Homo sapiens
caaagacaatcccatatatagcagacaaagaaagcaaagtaaaagcacgcgacccagtctagttttgaaccagtgtggatttaggaccaaaaccattacaygaatcaaagaaaggtgtgttaaaatggcaggaaatataattcatagtggaaacccaagttatgaacatctgtggactgaaaaccatagcatcaaagttac

SEQ ID NO: 20650 - DNA, 201 bp, Homo sapiens
ggatttaggaccaaaaccattacatgaatcaaagaaaggtgtgttaaaatggcaggaaatataattcatagtggaaacccaagttatgaacatctgtggaytgaaaaccatagcatcaaagttaccaaaacaaaaatgacaggtactacaaagagaaatatgtacagtgtgaaactaattcacctctagatccaagtcaca

SEQ ID NO: 20651 - DNA, 201 bp, Homo sapiens
catgcccctaaatgaaatggtacacggaacaaagatcaactaagaatgtttacagcaacagagtagccaagcatgacatatatagttcatatatccaataytgaatgcattgttcctgcatgcgggtatcttttttgacaaagaactaatcctagaaatgctgtatgtaaataacatatcctggccaggtgcagtggctca

SEQ ID NO: 20652 - DNA, 201 bp, Homo sapiens
ggggaaagagtagtcttcaacaagttgttatcaggaaactggccctgggaagcgaatgtgcttctcttaagattttacagcttagaaaatgacagcactgmgatgtgaactcaggtctgactgctctgagtccatgattgctctcagagtccacactcaatctctacccttgccaatctgccactagaggacttcatggag

SEQ ID NO: 20653 - DNA, 201 bp, Homo sapiens
tagaaaatgacagcactgagatgtgaactcaggtctgactgctctgagtccatgattgctctcagagtccacactcaatctctacccttgccaatctgccrctagaggacttcatggagtcttctacaaagtgcctggacacctgactcaacacccgggctctcctgcatatgagattcccagaccagatggtaggacact

SEQ ID NO: 20654 - DNA, 201 bp, Homo sapiens
ggtacagaatctggagcatcagaaaaacaggccttgaggggaagtctggggaaacaagttactgccaagctttactggattgaagccccatcagtagcacrgataagccagacaacctcctccaaccacaacacttccacctagagggacagacctcaggcatctcgggcctttggtgctggctcccctgacctctacgga

SEQ ID NO: 20655 - DNA, 201 bp, Homo sapiens
acaaaaactagaagacatctaactatctaattactaaaaactggaaaacatctgagtatctaattattggttactctagaatccgcatgccattaagaacratactgtgaatggtggaagtaaacaccatcagagcagggcaccatttgatagctgcttactactgaaggcaggcaaggaaatacatttgagattacaaga

SEQ ID NO: 20656 - DNA, 201 bp, Homo sapiens
gtgaatggtggaagtaaacaccatcagagcagggcaccatttgatagctgcttactactgaaggcaggcaaggaaatacatttgagattacaagaaaactstactatctagaacaaaacattaattgtattcaatttcttaaaaataaatcatgtaatatctagcttcatttgaaaaatataaactgtttcttctttcttg

SEQ ID NO: 20657 - DNA, 201 bp, Homo sapiens
aaacccgcaacccatatgctatctctgtgaactggaaggtcttagttataaagcataaaattaagctgaacacatatttgaggcctattagtatcacatargagcttttaaaatttccctaaagcaattaaatcagaatgtttaggggaagagtccagacaccagtggtattttaaagatttcccctcatgaatacaacag

SEQ ID NO: 20658 - DNA, 201 bp, Homo sapiens
tatggtttaacccaagcaatttttgacttcataaagagacaatacttctaagataatcaagctgacaaattaatacctttgggagatgtttacatgcaggyaagcaagtctgccgagttagatcagatttcccaaaggctattttccaaagcgttagtggaaaagaggaagaaaaacaggtgaacagtatctcacttgtac

SEQ ID NO: 20659 - DNA, 201 bp, Homo sapiens
caggacgtttatatgactgtctttaacctcaaaagtccaaataaacatatagacattttgaatatagctatcgttttaacaaacctcattatgatcactgwtgcaatttcagtcacctaaaatacgaaccatgactattaataaacatttactgtgtgtggtttgttggactgaacattaaccatacgtgtatttctaagt

SEQ ID NO: 20660 - DNA, 201 bp, Homo sapiens
gccttcttgggaagtgtcacaatgctgagtctaaaactgcaacagttaccgtgtccaagtcatgcaactctaaaggaggatggacggtcacatttgtgtcyttcagtatcaaagcacctttaagggcttccattttgagaaagtagtattttctcttccttctcttttagaacatatgataaaatattgcccttctatcct

SEQ ID NO: 20661 - DNA, 201 bp, Homo sapiens
ggcacttagttcttcagttaggccatatttagagtaaatttatcttaagagaatatgctgaacctccaagcaggacacaggttgtttttctacatgtagayattgcagttaattccgtcccatggtatttaatcggacacatttattaagcctcataaagggcattttcctgttaatcttttgtttactactgtgaatcac

SEQ ID NO: 20662 - DNA, 201 bp, Homo sapiens
cgcagttgtttcccaacaagctttttgtttgatttacttacagtaaacaaaactatatctatccgtctttgtggagaagtattcaccaatgcaacaaaacrtaattattacaccttaagcacttgcaattacaggactgcatgatgacaatagtgttggttatgtccttcattaacatctgtcacttccccagccactccc

SEQ ID NO: 20663 - DNA, 201 bp, Homo sapiens
acaaggaaatttcttggggtaagagagatgttttaaaactggattcctgcaatgactgcacaactctataaatttaccaaaatcactgaatcacttctaakgggagcattttctgctatgcaaattagacctcaatagagttgttggaaaaaaatcatatcagtgtcccccagcacctgaactcccttaccaataaccaac

SEQ ID NO: 20664 - DNA, 201 bp, Homo sapiens
ttttggacaacaggaagaaaattaaaatgagaaccagggaaattttatttttggttttcatcatcatcagtatacacattatagcatatccacatcctcartgatctcctgggtggtgaacaaagttagttaaaccgctaagctcctcttaatttcctgcaatgctgtaaaggtacatatacacatactgaggctaacaga

SEQ ID NO: 20665 - DNA, 201 bp, Homo sapiens
atgctccctgactttaagaggctcagggtactgtgagatgctgacccagaattataaatcatgccatcgtgctatcttctttaaaaaaaaattgtggtaaratacacaaaaggtactttatgtacttttcaaattgtggtaaagtaacataaaattgatcattgtaatcacttgaaaatgttcagttcaattatattaaat

SEQ ID NO: 20666 - DNA, 201 bp, Homo sapiens
taatcccagctacgggggaggttgaagcaggaaaatcgcttgaacctgggaggtggaggttgcagtgtgccgggaatgtgacattgcactccagcctgggygacagagcaagactctgtctcgaaaaaagaatctataagatgatgtggagaatatagtttcaaagaggcagagatgcttgaactgactgaaaagggtgca

SEQ ID NO: 20667 - DNA, 201 bp, Homo sapiens
tgctaatttctcaagggtcagctatagccattgcaccctggtaactggatggtacctggcacaggacaggtactcagtaagtgagctgaacagacagactrtcacttccctgcatcctggggaatcttctgtgcccactcatgctggaagaatcctttgtgatctccatggacctgggtgctgcaatgcccttgtgccgtg

SEQ ID NO: 20668 - DNA, 201 bp, Homo sapiens
actcatgctggaagaatcctttgtgatctccatggacctgggtgctgcaatgcccttgtgccgtgcccaaggaacctgcccagccaagatgtctctgaatkgtcttaacattggctccaggaaccggacggatgtttttatgactgccccactgcaaacttgtcctgatctctggaggtctctatggcatgtgccattgct

SEQ ID NO: 20669 - DNA, 201 bp, Homo sapiens
caggccccattaccctacaaagagtttggctcccagtagttcagagaaatcactagaaccatgctcttacctccagagcaagggagtgttgtgactgaacrcgtccatcatataaagaatgccactgagaaggaaggagatgtggcagtcatggggacagagtcctggaatgaaattcttcaacatagctattgtcatttg

SEQ ID NO: 20670 - DNA, 201 bp, Homo sapiens
atcaactcacttaaatctcacaatatccctatgaagtagtattactacaccattttacagatggagacactgaggcacagggagaaaaaagtaacttgatsaagaacacacagcaccagtcacagagctgaggagcatgcattgtcagccactacattttagcttgtccccagcatacggctagctttttattggtcagga

SEQ ID NO: 20671 - DNA, 201 bp, Homo sapiens
acctctcccttcctttgtggtcagcatatctcactgacagatggtttcctttgtacattttttccatgttaatgtttattatgaaattcaaggctgaagtycgtctatatgctaccttaaaaatacacatcttagaaaaggcatataaaagtggaaataaaagataagttttaacccacttatcttaataactgatataac

SEQ ID NO: 20672 - DNA, 201 bp, Homo sapiens
tgttaagaacactaagtccgggcccggtgactcacacctgtaatcccagcactttgggaggccaaggagggcggatcacaaggtcaggagtttgagaccakcctggccaacatggtgaaaccccgtctctactaaaaatacaaaatttagctaggcgtggtcgcgggcacctgtaatcccagctacttgggaggctgaggc

SEQ ID NO: 20673 - DNA, 201 bp, Homo sapiens
caaggagggcggatcacaaggtcaggagtttgagaccagcctggccaacatggtgaaaccccgtctctactaaaaatacaaaatttagctaggcgtggtcrcgggcacctgtaatcccagctacttgggaggctgaggcaggagaaacacttgcaaccggaagctgagatcacgccactgcactccagcttgggtgaaaaa

SEQ ID NO: 20674 - DNA, 201 bp, Homo sapiens
tgacacattaccctcgctgcccctctgggtttcttcccttaatacaggacagcaaatgacacccacttttaagttaccagtgtcactgttcccatctgcartgagtgccaacatctaactatataaaaacaaatgaaaactcacaaatacaaatattttattgaagtccaaaaatcaaagttaggttaattgcctctatct

SEQ ID NO: 20675 - DNA, 201 bp, Homo sapiens
tactggaccggctacggataactgtgctgcttttctcagaaaccctccgcagctagggaagctaaccccgactctaccaaaaatacaaaacttagccgggmatggaggcacatgcctgtagtcccaggactgtgttgtgttttcaaagtgtagttgtttcttgccttttcatataattatgacatatttttgaaaaagtaa

SEQ ID NO: 20676 - DNA, 201 bp, Homo sapiens
ggaattagaattcttgtatatagttgggggatcataaaaatggtccaggtgcaatgaaaaaaaaaatatgacaggtccccaaattatgaaacacacaattwccgcatgatccagcaattccacctctacatatatacacaacagaagagactacgggggtctaaaagagatatgcgcacactcatgttcacagcagcacta

SEQ ID NO: 20677 - DNA, 201 bp, Homo sapiens
ggcacaactaattctccctaggaacccaggtcaggaaggctagcctcagaagcaggacagataagaagcgcatagtgcagaggcatcaaccacttggaaamtactgggtatagttgggtatacctaggaaacaagctactgaagatctatatggcaggttcaacaaagtctctattatagaaccaaaagtctacttcaaaa

SEQ ID NO: 20678 - DNA, 201 bp, Homo sapiens
aatatctatgcttttaagtgagctctggtacatttctgcccggaggacttagaaggcatgagattcacatactctgaagatgtattgagcagctctatgckggccactgggaacaccaaggtgagtaagatgcagctcctattcttgaaaggtaaagaaggaagttgggctgctgtgtgtcaggaactgttgggtctttgc

SEQ ID NO: 20679 - DNA, 201 bp, Homo sapiens
accacttctgaagaggcagcagttctgccttcgataatcctcttaagggtgagaattcacttgccgggacttcagtggacagattcctcactgttctttargcagcaaggaggggcttacacacaagacttgcaagagctttgctatcattatataccccgtttgttgcaataatgtgaaatttatctcccttggagaacg

SEQ ID NO: 20680 - DNA, 201 bp, Homo sapiens
cttggacggtttcttagatgataatttataatgcacatatcaacgccccccctccaccccccgcaaaaaggcttagattcttggtaacctttgccagagtkcattttccagactcttcttcaaaaataatactagatacgaaaacaaatgctagtgacatgtgactctccacagtattcttggtctcatccaggaagcaaa

SEQ ID NO: 20681 - DNA, 201 bp, Homo sapiens
aaattctagattttactagtaggttatctccaaactgacagattagtatgtaaagagcaacaaagccttcccaagaaagccctatgttggtcccaaggacstcacttctaacctgtcatagagaaatgatggaggaaaagagctgaaagacaaggcccaggttgccaagtgccacccttccattgaaaaatggcgtaccat

SEQ ID NO: 20682 - DNA, 201 bp, Homo sapiens
tgtaagaggtgataagtgctaagaaggagaaggaagctggcttagggagacagagtgacagagggaaagtccactttatatagggaggtcaacaagggctytgatcgagggggtctgagcagagacctgtcaggggatggactggctggcacagagtgcaggaagagtgctccatagaggaatgagcaagcacaaaaccca

SEQ ID NO: 20683 - DNA, 201 bp, Homo sapiens
aaacatgacaagaacatccctgaaaataacaggataatgatcaggtttaagttacaggacattacattagaaatctttacttggatggcctataattatcrctagacagatcctagcatagacaaaaggtgtggagaacatcgctgggtattgactgagctgcataagcatcaacctaggacactacagagatagccctct

SEQ ID NO: 20684 - DNA, 201 bp, Homo sapiens
gcatagacaaaaggtgtggagaacatcgctgggtattgactgagctgcataagcatcaacctaggacactacagagatagccctcttacagatcaaggtgkcatttctttgtctctactctgacaaagccggggagacaaagcaaatggcacattgagatctccatgacaagcaaatcctctgacctccctaagttctcat

SEQ ID NO: 20685 - DNA, 201 bp, Homo sapiens
gtcttgctatgttgcctaggctggtctcatactcctggcctcaagcaatcctcccacctcagctacccaaagtactgggattacaggtttgagccaccacrccgggccctcagcatttatttcctattatgtcactaaggagtgatatggttctcccaactgagagattaacaacaacaacaaaaaggcataacaacagtt

SEQ ID NO: 20686 - DNA, 201 bp, Homo sapiens
caattcaaataatggaagttatatactcagatacattctttcaagcatgtcacatttcatgtgattttacccaaaattggtggctcttataattaagaagkcctgttatgtgcctagtaatcagatgctttaagttcatgatcaaatcttatcctcacaatagcctatgaggtgaatagtttattatctctattttacaga

SEQ ID NO: 20687 - DNA, 201 bp, Homo sapiens
gaaacagcccattaaacaagcaatgatttctctatccaaatcgccagcaaatactactcacctgattgacagactctgatattccagccattgttcaagcraaattactcattcctcacaaacctggctggaagccttctgcatcacacctgtgacagtctgtggcggccttttccagacagcataaaagaacagtaggat

SEQ ID NO: 20688 - DNA, 201 bp, Homo sapiens
ggatattcagaaacatttggaatttcacttttgtattagtaagaagcatacatgctttctgtttaagaacatggtaaatggaagaccaagtgaaaataacrttctctaccattctacttaacccaactgccaagcgtggggactgggatggattgtactgaacttcccataatgtgaaaacatagtaaaacttctaaaacc

SEQ ID NO: 20689 - DNA, 201 bp, Homo sapiens
accatgtgcttcaaaagaaaaaaaaaaatttgttcagattaaagaacaaaatgagagaattcatggccagcagacttctactataagaaatgttggccagkcgtggtggctcacgcctgtaatcccagcactttgggaggccaaggcaggcagatcacttgaggtcaggagttcaagaccagcctgggtaacatagcaaaa

SEQ ID NO: 20690 - DNA, 201 bp, Homo sapiens
caccttagcctgccgccctaatacctggggcccaccttgctagtgggagggttcagataccaggacagaagagctgtccccatactagtgactcatctggsgtcttcatccttgccaagcaaactgcacacccacttcacgattcaggccaaaggcttctgaaactgcagagatatcattgctatgcaagaaacccagagc

SEQ ID NO: 20691 - DNA, 201 bp, Homo sapiens
caaactgggccaggaaatcctgcacacactggccacattgacaccgacttgtcattctatttctttccaactgaaactgatcggggccatgtggaaacacyatcgctgggacaccccagcacaggttgaagaggggctgggagaacctgaggggctcctagccctcttccaccctcaagtcagttccaccggttattctgc

SEQ ID NO: 20692 - DNA, 201 bp, Homo sapiens
gaataaaatgaagaaatgtgagtaagatttttttttaagagacaggttctcactttgtcactcaggctggggtgcagcggcataatcatagctcattgaarctcctgggctcaagcaaccctctcgcatagctgagactggaggtgcatgccatcatgcccggctaagtgagtaggatattaattatttctgcagcccaag

SEQ ID NO: 20693 - DNA, 201 bp, Homo sapiens
agtgactcgcatccttttattcaagcaaactagatcccttcaccctcccaatatccccagtctgcacaattctcacctcccctgcttggtcgtaactctgygactctaccacaaaaataagcagatgcacaagaagtcagtttaaaattccacatcctatttctcatttactctaggatctcaaaacaagaaaaacatcgc

SEQ ID NO: 20694 - DNA, 201 bp, Homo sapiens
ttttgtatttttagtagagacgaggtttcaccatgttggccaggctggtctcgaactgctgacctcaagcaatccagccaccttggcctcccaaagtgctrgatttacaggtgtgagctaccacgcccagctgacactctgccttcttattcccgctcttagagtagaaacaactgtccttcttgtgggctgttcagtacc

SEQ ID NO: 20695 - DNA, 201 bp, Homo sapiens
tgggtgacttcgctgtctaaagtggccccaagcatcatgctcaagtgcagtctagtgcatcaaagcgcaaggcgggtgtaatgtgccctacagaaaaaaaygtgtgttacagaagcttccttcaggcatgaactatagtgctgctggctgttaattcaaggttaatgattaattatatattaaaaaaggtgtctctaagca

SEQ ID NO: 20696 - DNA, 201 bp, Homo sapiens
accaattaagaacagaattaacaatagaatcagaaaaaaaaaaatcatcatttggcaacttccacagtaataagtgattcagttattgaaaagccatccayggttgctaaaatcagtgggtaaaagtttcatgagaagcaagatattttcatagcctccaattatctccccataaaacacttacctaaaagcataaagtat

SEQ ID NO: 20697 - DNA, 201 bp, Homo sapiens
cccaaggcagacttagataactgtgaagggggaaagactaaaatggggggaaataaggggccaagattacacaaaaggtcgggctgtatctgtcccccccrgtcgccagcactaacagcacttagtgtgtgccaggcactggttcaagcattttaacgcaatcctcacaatcctgtgaagtaggctcctgaagggggttta

SEQ ID NO: 20698 - DNA, 201 bp, Homo sapiens
aaaatggggggaaataaggggccaagattacacaaaaggtcgggctgtatctgtcccccccagtcgccagcactaacagcacttagtgtgtgccaggcacyggttcaagcattttaacgcaatcctcacaatcctgtgaagtaggctcctgaagggggtttaatggtggccccaaaaagatatgcccaagtcctgaccccc

SEQ ID NO: 20699 - DNA, 201 bp, Homo sapiens
atggtgaaactccatctctactaaaaatacaaaaaattagcctggcatggtggcagccgcctgtagtcccagctactcgggaggctgaggcaggagaatgkcgtgaacctgggaggcggagcttgcagtgagccgagatcgcgccactgcactccagcctggggtacagagccagactccgtctcaaaaaacagatggtgg

SEQ ID NO: 20700 - DNA, 201 bp, Homo sapiens
ctttctctcttgacccataacaaagtttagctcagatctatgattaactccagttagtgcagctaaataatgaatacagagacagctgccgacggattacrttagtgtgcaatgtgataggggctggctgggctctaccaaaaacataatctgccaccctgagtcagagacagggctgtaaacaatgagatctccaaaggc

SEQ ID NO: 20701 - DNA, 201 bp, Homo sapiens
ttcaggtgcgagtgtgttttgctcagccttaccgcagctctgtcggcctggatgggcgtggggtcccaaataacaccctctaggccatggcttcctttctytcctggccccttccctcaggttgtgagtctttagcccacctagcagactcagggtgtgccaccagttccctggaggagcagatcattgaaaatacagcaa

SEQ ID NO: 20702 - DNA, 201 bp, Homo sapiens
ttttgctcagccttaccgcagctctgtcggcctggatgggcgtggggtcccaaataacaccctctaggccatggcttcctttctttcctggccccttcccwcaggttgtgagtctttagcccacctagcagactcagggtgtgccaccagttccctggaggagcagatcattgaaaatacagcaaagttaaaattaaacgc

SEQ ID NO: 20703 - DNA, 201 bp, Homo sapiens
aacctaggctctgccactcaaaggctgtgtgaccgtgggaaataatagtacccaccccaaaggtttgttattagtatttaataatatttattggtaaggtrcttagaatagcccccctgcctacaggaagcagtacataattataatgtctaaatatacagtagttccaggccaggcatggtggctcatgtctgtattcct

SEQ ID NO: 20704 - DNA, 201 bp, Homo sapiens
gcatggtggcgggtgcctgtaatcccagctattttgggggctgaggcaggagaatcacttgaacccaggaggcagaggttgcagtgagccaagatcacacyactacactccagcctgggcaacagagcgggactccatctcaaataaataaataaatagcagttccatatcctctgaataatggactagaagttggttaat

SEQ ID NO: 20705 - DNA, 201 bp, Homo sapiens
ccattgataaacctccctgctactatttaaaacaagatggatacctttctactgtctttaaagaggaagagtacacactgttggactgtatgcactctccrtctctcaagacagtaatctgagggattacttcaatagcagaagttaaaagaagcggtcagttgggtttattacataatctcaatcacatcctgaccaata

SEQ ID NO: 20706 - DNA, 201 bp, Homo sapiens
atgctcacgagctctgaattcacaagtgtgagatttcctgtcaagtactctcatgagctcaattaatctctgacccagggtgagaaaataaacatagtgaygcagaggctgcagctcatgctttggaatttgtcagacttgactcagttcccaactccatcatgtcctgcctgggtgaccctcattatgctacctggactc

SEQ ID NO: 20707 - DNA, 201 bp, Homo sapiens
gaagataggagctagcgcagagaaaagagcagacagggactaggcctgaaacagaccagcacggaagtggtcatggaacccagaaatggaacaaggagctwcgtcgcaggccacaaaagggctgtaagtactcatgagtaaggggctggaagtgggagaagcaaagtctgaacatctgctgggatgaaagaggggagggca

SEQ ID NO: 20708 - DNA, 201 bp, Homo sapiens
agcaacaggggagcaaggatttaaccactttctgtgggccagatgcatctggagatccctctcaatgcccatatttagggaaaagtccttcgttgttagcytccaccctgctgctgaccccagatcacctctggatcaggtgtgggcagaggaatgcaaagtgcctgccgggcaccagggggcagcaggacaattcctagg

SEQ ID NO: 20709 - DNA, 201 bp, Homo sapiens
tccccacctcctgctcctcctcccccgagccctaagggcccgcagggcctccagtagcaaagccactggccccgcgtccccgcgtccccctgcgccgcgcmccggggcgcaggcagggaccacgcggccggcgtgggggcggcgccacccgcagcagaaagccccggcgtggaccgcgtggcgtaggaaagcgctcccctc

SEQ ID NO: 20710 - DNA, 201 bp, Homo sapiens
gttcaaaattgtgttacacgtagccttgggctcaaacccacgaagttaatatgataagtggggttgcaacaagctgccaaaagccattctaactcaccttycctgctcccacggggccgaccacagctaacaattcgccaggtctgacagtaaaggaaaggccttgtagagttggggtctctgatgcctacaaattaaagt

SEQ ID NO: 20711 - DNA, 201 bp, Homo sapiens
agttctagaccagcccgaccaacatagtgaaaccctgtctctactaaaaatacaaaaattagctgggcatggtggcacatgcctgtaatcccagctacttrggaggctgaggcaagagaatcgcttgaatccaggaggtggaggttgcagtgagccgagatcgtgccattgcactccagcctgggcaacaagagcaaaact

SEQ ID NO: 20712 - DNA, 201 bp, Homo sapiens
tgtagacccagctactcgggggctgacgtgggagaatcgcttgaacccacgaggcggaggttgcagtgagccaagatcacaccactccactccagccgggrtgacaaagtgaggccttgtctaaaaaaaaataaaaaataaataaaaagaagacaaattactttgaaaaacaactagctgcttagagcaaaaatggtaatg

SEQ ID NO: 20713 - DNA, 201 bp, Homo sapiens
ctgtatggctcagttgctgacaaaatttgctatcaattgtctgtccacatccactgagaaaacccagagggagacggggtgggaagactgggatgcagccrgagagctacaggtggctgcaatcttctcaccatcagcgcatgacggtgcatttattttttttacttcaggttctacttattgcatagggcggcagacatg

SEQ ID NO: 20714 - DNA, 201 bp, Homo sapiens
gcaagagccaaagaaagaaaatcccagaaacaccacgtaagagttgggagggaagccagattctagacaactagtttcaaaggcaagccaggcctacatgyctgtgggttttaagtgttcactctggtaagaatccatgaagcaacattagattcttgaaaccacagtctactatggagcaaatcattcttaaattctaga

SEQ ID NO: 20715 - DNA, 201 bp, Homo sapiens
atatgattcaactccaaaaggaatcttcaaaaccatgcaaatacatggaaattaaataatctgctcctgaatgagcattgggtcaaaaatgaaatcaagayggaaattaaaaaatatttcaaactgaatgacaataatgacacaacctatcaaaacctctgggatacagcaaaggcagtactaagaggaaagttcatagcc

SEQ ID NO: 20716 - DNA, 201 bp, Homo sapiens
aaagaagacatgtatgcagccaacaaacatatgaaaaaaagctcattatcactggtcattaaagaaatgcaaatcaaaaccacaatgagataccatctcayaccagttagaatggtgatcattaaaaagtcaggaaacaacagatgctggagaggatgtggagaaataggaacacttttacattgttggtgggagtgtaaa

SEQ ID NO: 20717 - DNA, 201 bp, Homo sapiens
gagtgcggtggcacggatctcagctcactgcaacctccacctcctgggttcaagcaattcttgtgcctcagcctcccaagtagatgggatcacaggcgtgyaccaccatgccaggctaatttttgtatttttagtagagatggggtttcaccatgttggtcaggctggtctcgaactcctggcctcaagtgatccacccac

SEQ ID NO: 20718 - DNA, 201 bp, Homo sapiens
taaaagaatgccttctgactgagcatggtgattcctgcctataatcccagcactttgagaggccaaggtgggaggatcatttgagcccaggagttcaagaycaacctgggcaacatagtgaaacaaaaatacaaaaattaaccaggcatggtggcgtgcacctgtggtcctagctacttgggaggactgcttgagcccagt

SEQ ID NO: 20719 - DNA, 201 bp, Homo sapiens
tattgtttcattgaccgggcacgatggctcacgcctgtaactctagcactttgggaggccaaggtgggcagattggctgagctcagcagtttgaaaccagsctgggcaacatggtgaaacctatctctaataaaatacaaaaaattagcccggtatggtagcacatgcctatagtttcagctacctgggaggctgaggcat

SEQ ID NO: 20720 - DNA, 201 bp, Homo sapiens
aaaagaagacaaattttttgttgttgttgttgaaatagagtctcactctgttacccagactggagtgcagtggtgtggtctcggttcactgcaacctccamctcctggactcaagcctcagcctcccaagtagctgggactacaggtgcacgccgccaaagcctggctaatttttgtttctttgtagagatggggtttcgc

SEQ ID NO: 20721 - DNA, 201 bp, Homo sapiens
ttttttttttttttttttttttttgagacagagtctcactctgtcacccaggctggagtgcagtggcataatatcggctcactgcaacctctgcctcctgrattcaagtgattctcgtgcctgagcctcccaagtagctgggattacaggcgtgtaccaccatgcccagctaattttttaaatttagtagagacggagttt

SEQ ID NO: 20722 - DNA, 201 bp, Homo sapiens
gcacttggaataagttcagaatggagctacctgccctatgattaactgattgacagacagacagaaggattcaatgctaaaggggccaatctgccaggaayttaactacctgcatgaacaaaactcaatgctctttaatccagactccctatagtatatcgatcataatgttcaacatagtaaaacaattactagatacac

SEQ ID NO: 20723 - DNA, 201 bp, Homo sapiens
tgcagtggcgcaatcatacctcactacagcctcaacctcccaggcccaagcggtcctctcacctcaacctcccaagtagctgggataacaaggcacgtgcyaccatgcccggctatttttttaagtatatttttgtaaagatagagtctcattatattgcccaggctggtctcaaactcctggcctcaagtaatcccccca

SEQ ID NO: 20724 - DNA, 201 bp, Homo sapiens
actccagcctgggcaaaaagagcaaaactccatctcaaaaaaataaataaaaataaaaaatacaaatacaataattagccgggtgtggtggcaagcacctrtaatcccagctactcgggaggctgagacaggagaaccgcttgaaccccgggaggcagaggttgtactgagctgaggttgcgccactgcacttcggcctgg

SEQ ID NO: 20725 - DNA, 201 bp, Homo sapiens
ctgggtgatagagcaagactctgtctcaaaaaaaaaaaaaaaaaatgagatatattgaaaagaattacaaattattttcacaagtcacatatttgtaataraaatgttttccttttgggagaaactttgagatattcccagatacatccagttgtaaatatagtcacaaaacaccatatctccccatcaaatactacaaat

SEQ ID NO: 20726 - DNA, 201 bp, Homo sapiens
tgcctggtcaataaatagctttaatgattgaaaacccaaaacaacacctgaaatgcttttgagatgttacactcactaccttcatcttaagaaattatttstctccaacttctccaaaacagccaagtgtcaataggcaaggctgggaaaacaatagtatttatactagaattcaggctgttttcactgctagaaggaaaa

SEQ ID NO: 20727 - DNA, 201 bp, Homo sapiens
cccagcactctttctaaatatagtatccacttatgaaaaagaatatgtaacttttctttttaatgcagaggctcttttgagaaatggctgaatccaagatyggggcagaagaagtacaagacatgtctgaactatctttttgtgccacaaaagtaatgaaatgttcaaagaatcccgacaacatgtccaaaggacccagga

SEQ ID NO: 20728 - DNA, 201 bp, Homo sapiens
atggtggcttatgcctgtaatcccagcactttgggaggccgaggcaggcggatcacttgacgtcaggagttcgagaccagcctggccaacatggtacaacyctgtcactactaaaaacacaaaaattagccaggtgtggtggtgggtgcctgtaatcccagctactcaggaggctgaagcaggataatcacttgaacccgg

SEQ ID NO: 20729 - DNA, 201 bp, Homo sapiens
atagaccaatataaataaggattaataagaatgtaattaacaaagtagaactaattaaaccttattaaactctataccttaaacagataacaccatctttycaatgcccaaagaacatctagaaaaactaggacacaaagaaaattccaaatggatagaaaggatatggatgacatgcaatgaaaatgaaactgatgcgta

SEQ ID NO: 20730 - DNA, 201 bp, Homo sapiens
tctcattgtctgaaaacacatgaatgccactgagaccaggagttctcaaaattgaccagaatctaaaaaggcagagccagaaaaaaaaaaataatgttctyaaaaagcattattattattagattaataataaaaatgacagaaagatcatttggtcaaaatactttaagccttataaatatcaacaacttagcaactgca

SEQ ID NO: 20731 - DNA, 201 bp, Homo sapiens
aatttgagtcctattacacccaggactcaaaattatttactgtgtgcctggcatatactcacagaaaaagaagacaaattttttgttgttgttgttgaaayagagtctcactctgttacccagactggagtgcagtggtgtggtctcggttcactgcaacctccacctcctggactcaagcctcagcctcccaagtagctg

SEQ ID NO: 20732 - DNA, 201 bp, Homo sapiens
ttttaccttcgggttctgacaatctaaaaagggctgagatgagggaactttttccagctccggttcttcccacaatgccaacctacagagagatccaggcrgcaggattaaaaaaaaaaaaaaatcacaggatgcagcaaaactaggagaaaactttcggtttttgaagaagaattaaggacattctatattgagtgtagt

SEQ ID NO: 20733 - DNA, 201 bp, Homo sapiens
taattacccccagggaaatgcagggcatcagcctcctggctgccccaagccacctcccttcccaaacccttccccatctctctccactaccacgcacacartgctgcaggctatttcttgagccttcgcaggaagcactacacctccacaatggcatgggcatctctaccaaagcacctcatggcatctcagatattgcct

SEQ ID NO: 20734 - DNA, 201 bp, Homo sapiens
cactctctagcatgtcacctgactttccggcaccaggacacctaggaacctagggtaatttataatccccaatctgatttcccacagccatgccccactgytccagggagctcttagcatctgacttatccctaggccaagttcaagaagcatgtgctggatactctgaagacagagttctcaagacacctttacgacagt

SEQ ID NO: 20735 - DNA, 201 bp, Homo sapiens
tcctatggcttaaattgcatactattctgagtagcatgatgaaatctcccacaaacccacccaggatgggaatcctccctctgtccagcatttccatgctrcagacgtcacccacctttagtcatttagtagccaccctgggcgctcagatctattgtcatggcatcacaatactggtgttcaagtcacccttattttact

SEQ ID NO: 20736 - DNA, 201 bp, Homo sapiens
gccgaggcgggtggatcacttggggtcaggagttcaagaccagcctggccaacaatggtgaaaccctgtctctataaaaatacagaaaaattagccggacrtggcggtgcacatcccagctactcaggaggctgagacaggacaatcgcttgaacccaggaggcagaggttgcagtgagccaagatcatgccattgcactc

SEQ ID NO: 20737 - DNA, 201 bp, Homo sapiens
gtgcagtgtatcctgcttgggtgaagggtgcaccaaaatctcacaaatcaccactaaagaacttactcatgtaaccaaataccacctgctccccaatagcstatggaaataaaaaaaaaaatttttaaatttaacaaaagatcatgagtaaaccagaaaaaaaagaaatagtgatatctaaggtacacacttaagttttag

SEQ ID NO: 20738 - DNA, 201 bp, Homo sapiens
gaggatggactgagctcaggaggtcaaggctgcagtgagctgtgatcgccactgcacaccagcctgagcagaacagcaaggctttgtctaaaaaaaaaaaraagaagaagaaacatatttgtgccctataaggaaacctctaataactttgatagatgcaattactcaattacacaaacttctttcatcttggctgtctta

SEQ ID NO: 20739 - DNA, 201 bp, Homo sapiens
tgaaatgatggtcataattttgcttaaaaaaaaacacaaaaaacattgctagtgcctaagggcacatacaatacccctgactcataaccaactgctgattyaacacctcctcctcttgggtgtctgataagcatatcaaactaaataatgtccaaacagaacaccttttcatcccacaaaaaaatcctgctcctcccaggc

SEQ ID NO: 20740 - DNA, 201 bp, Homo sapiens
taaaatttaggtataaggggcctcagatctacaatccacttttttttttttttttttttgagacagagttttgctctttctctcaaactggagtgaagtgstgtgatctcagctcactgcaacttccgcttcctgggttcaagcgattctcctgcctcagcctcctgagtagctgggactacaggtgtgcaccaccacacc

SEQ ID NO: 20741 - DNA, 201 bp, Homo sapiens
aaaaatacaaaaattagccaggcatgatggcaggtgcctgtaatcccagctactcaggaggctgaggcaggagaatcacttgaacccaggaggcagaggcwgcagtgagccaagatcgtgccattacactccagcttcggcgactgagcaagattccatcttaaaaaaaaaaaaagaggaagacacagctgacaagcaaac

SEQ ID NO: 20742 - DNA, 201 bp, Homo sapiens
caaattctaaacctagagaaatatgttaaaaaaaaaacgagaaataaaaacattttcagggcagggcaatgaaaaaatgtaaaaatttgctataacaggaygtcttagaagatagaaaaaaggaaaaaacagaaaaaaaactaaaatttaaaaactgaattaatatttttaaaaaataaataaatcattggccatgatttc

SEQ ID NO: 20743 - DNA, 201 bp, Homo sapiens
ctatctaaaatacaaagaccaacaagcagcatagatacaaatggagaagctgcctgtgtcctggtttggcccacacagaggattcccaagctcctccttcytcctgcccccgctgcaggctctaagtgggtggatacttgctcagtctccagtccccatcacagtctccatggaggtgcacataggggacagatgtgctgg

SEQ ID NO: 20744 - DNA, 201 bp, Homo sapiens
aagatacaaatatggaaagagggagaaccagaacaaagcatgagatttttgaactgtgatttgaagcactggtgtgaagtctatctaatttgtttcctaayacagatctatataaatagatacctaaataaagatagagaaatcaatatacactgatcctctttagtgacaaatcctgtatttgtgagtttgcctacttgc

SEQ ID NO: 20745 - DNA, 201 bp, Homo sapiens
tcccgggttcaagcaattctcctgcctcagcctctcgagtagctgggactacaggtgcatgccaccacgcccagctaatttttgtatttttagtagagacrgggtttcattacgttggccaggctggtcttgaactcctgaccttgtgatccacctgcctcggcctcccaaagtgctgggattacaggcataagccaccgc

SEQ ID NO: 20746 - DNA, 201 bp, Homo sapiens
aacatacttataatctcaataaatgtaaatgtactaaaatcatctattaaaaacaaaggctaagattaaacctcagagtaaaacctaaccacgccatatayaggagacacacctttggatattcaaagacaatcccatatatagcagacaaagaaagcaaagtaaaagcacgcgacccagtctagttttgaaccagtgtgg

SEQ ID NO: 20747 - DNA, 201 bp, Homo sapiens
tgcaaaaaggtcttttctaagaccggcagccagatttgaagaaataatctcacacttgcccttgattaaggggccaacccatcattcttctgggttttgascctccttgaggttatccacattgacttgatgaagaatagggttgtgaggtgaagaataatgaacacatttcccagataacagtgtcttctgagactctgt

SEQ ID NO: 20748 - DNA, 201 bp, Homo sapiens
gcagccctgctgagcaaaggggtggaggccagagcttgggttagttaaagccactggcatctgcatggccctggacagtaagcaggtatcagaagggaagsgccccagaaggctgtggggtgggggtgctacaagtccttggctgatgcgcgggcacaggtcaaggccgcccaagccttaacagagagctggtgctgagga

SEQ ID NO: 20749 - DNA, 201 bp, Homo sapiens
atccccggaagattctggagtgtagaaaccaatgcctgtacacatcactattctcctctcctgcactctctgtgtctgagtctggaggggctggagacccrctgtgaagagcttttttgagatggagtttcactcttgttgcgcaggctggagtgcagtggtgcaatctcagctcaccgcaacctccacctcccagattca

SEQ ID NO: 20750 - DNA, 201 bp, Homo sapiens
tcacaatactggtgttcaagtcacccttattttacttaataatggcccccaaagagcaagtacaaggatgctagccatttggatatgccaaggagaagccrcaaaggccttcctttatgtgaaaaggttaaggttctcaagccaataagaaaaggaaaaaaaaattgtatgctgaggttgctgagatctggtttaagagtg

SEQ ID NO: 20751 - DNA, 201 bp, Homo sapiens
tttccctttcaaggaagccacgtccagcctccctctccacacctgttgttcccttcgccatcctctagtacagaaacttccctgaggcacaaattaaatayacagatttccaggccctttctctagaaattctgaaacagcaggtcaggtctgagatggccccaggattggggtttttgttaagcacacaggtgacatatg

SEQ ID NO: 20752 - DNA, 201 bp, Homo sapiens
gctattcccatgatagtgaataggtctcacgagatctgctggttttataaagtggagtttccctacacaagttctcttgtctgccaccatgtgagatgtgyctttcccttctgccaggattgtgaggcctccccagccacatggaactgtccattaaacctctttcttttgtacactgcccagtctcaggtatgtctttat

SEQ ID NO: 20753 - DNA, 201 bp, Homo sapiens
atccatccatccatccatatttttttgagacggagtcttgctctgccgcccaggctagagtgcagtcgtgtgacgtaggctcactgcaacctccatctcckgggttcaagtgattctccagcctcagcctcccgagtagctgagattacaagcatgcgccaccatgcctggctaatttttttatttttagtagagacaggg

SEQ ID NO: 20754 - DNA, 201 bp, Homo sapiens
aagataaattaaatcaatgtaacttaaaaaatataagaaattaatgaaatagaaaatctaccaactacagagaaaattacaaaatcaaacatgaattcacwggaaaaaaaatcaaaattgataaactccaagctaaactgattgacagaaacaaattatcagtgtcaggaataaaagaagaaatttcactatagattataa

SEQ ID NO: 20755 - DNA, 201 bp, Homo sapiens
aaaaaaaaagaagaagaagaacaaagaggaaagaaggaagaaggaagaagaatgaagaaggaaggaggaggaggaggagaaggagaagaaggaggaggagraggagaagaaggaggaggagaaggagaaggagaagaaggagaagaaggaggagaaggagaagaaggagaagaaatcatcatcatcatcatccactgtcgg

SEQ ID NO: 20756 - DNA, 201 bp, Homo sapiens
aaaaaacccagcacaaatggccaaggaaatgcaaatgctgaaatccactattacacaaagccatgtaaattaaaacaacaatgcattatttttcacctatsaaaattggtgagattgacagtgattattaaaatataacatcaaatctggacttgtagggagctctctcatttcaccggggaaaatgtaagtaattaacaa

SEQ ID NO: 20757 - DNA, 201 bp, Homo sapiens
gagtttctcttctttcagatgcctcatagatggtggccaaatgggccgggcacggtggctcacgcctgtaatcccagcactttgggaggctgaggcgagaygattataaggtcaggagatcgagactatcctggttaacatggtgaaactccatctctactaaaaatacaaaaaattagcctggcatggtggcagccgcct

SEQ ID NO: 20758 - DNA, 201 bp, Homo sapiens
accagatctaagcacaagcatccccacccccccactgccccctctctctgccccaccagcacctttagtggtggcagctgtgtcaggacagcaaagcgagrggtaggaagaagaaaaatctcccacctcatttaatgaatttggacacgcccccaagtacaaaaggacataagtttctacttaagagccaaccaaagtaat

SEQ ID NO: 20759 - DNA, 201 bp, Homo sapiens
atatgcaaagagatacattggatatattgttagtagcactgagggtgtagttaagcatatgaattactgctgggaagagagccaaaattaacagaaaattwacttactaggggtttctatcaagttttacaaggaaggaataaactgaaaaagtgaacataattgggagcaacaggaattccgcaggtgaaggactcacca

SEQ ID NO: 20760 - DNA, 201 bp, Homo sapiens
tgcaactagatggtcccatctgggggtgatgggagacaatgacagatgatcaggcattagattctcataaggtagatgcaagctagatccctagcatgcayatttcacaatgttcacagggttcgtgctcctatgagaatctaatgccgccgacgatctgacaggaggcagaggtcaggcggtaacgtgagtgatggggag

SEQ ID NO: 20761 - DNA, 201 bp, Homo sapiens
ctttcaaaatccagtacagagcaaattaagagtcttcagtcaacctctcttctagtagatttttaaaataattattctaattaattcacagagtaaattcractgagactcctgatctgttaagacattactgaatgactcctggaagccctagttactcacacaggctcattgtaagcacctcagcctctcatacaatac

SEQ ID NO: 20762 - DNA, 201 bp, Homo sapiens
taatgaccctttcagcatacaagaaaaaagatctggctgggcatagtggcacacatctgtaatcccagcactttgggaggccaaggtgggatgatggtttragcccaggagttcaagaccagcatggaaaacacagtgagaccttgtctctatggggggaaaaaaaattagccaggtatggtggcatgtgcctctagttcc

SEQ ID NO: 20763 - DNA, 201 bp, Homo sapiens
aatctctgctgcccacttcttccatttaaaaaaaaagattgtcgtatgccaggtgtaggggctcacacctgtaatctcagcactccaggaagccgagggcrgggggggggggggggggggtggatcccttgagcccaggagttcgagaccagcctgggcaacatagggagaccagcctagacaacatggcaaagccccctc

SEQ ID NO: 20764 - DNA, 201 bp, Homo sapiens
ctgccccaccagcacctttagtggtggcagctgtgtcaggacagcaaagcgagaggtaggaagaagaaaaatctcccacctcatttaatgaatttggacaygcccccaagtacaaaaggacataagtttctacttaagagccaaccaaagtaattttgagccaaattagggaagaacagagaggctgtcagaggaacaaaa

SEQ ID NO: 20765 - DNA, 201 bp, Homo sapiens
accgtgcctggccagtgtaaagtatttttaaaaagagcccaataaacactctagagctgcaatactgaaatgagaaataaaggagaaaagaaaaatcactrgctggtcttatcagcagtttaaaagcaacagagaagattgaataaaagtgaaaaagactgactgtcctataagacaatctcaaatagtttaatatatatg

SEQ ID NO: 20766 - DNA, 201 bp, Homo sapiens
attccaacctcaaagactccccgcaaactggtgtcaccatctctcttcctgctggtgccatcattagtacccagggaaggccctgcttgccttcagcttasttaagagtatatggctagggagttatggatccactgcacagttgttctgtaaccagaggaattaacccatctgtgcctagcattccattattggaacact

SEQ ID NO: 20767 - DNA, 201 bp, Homo sapiens
gaaatatgtacagtgtgaaactaattcacctctagatccaagtcacagaaaatagaccaatataaataaggattaataagaatgtaattaacaaagtagarctaattaaaccttattaaactctataccttaaacagataacaccatcttttcaatgcccaaagaacatctagaaaaactaggacacaaagaaaattccaa

SEQ ID NO: 20768 - DNA, 201 bp, Homo sapiens
caagaagaagcaacgagaaaaaccaaaaaacaaaggtaataaagataaaagcagaaactgatcaactgggaaacagaatataaactagtaaataaatctgrtaagtcattcaccaggaaaaaaacaaaaatagctaacttaattggaagttaattgggaaaagtgaaaagtacagagtggaaaagtataaatactaggtag

SEQ ID NO: 20769 - DNA, 201 bp, Homo sapiens
tgtctcaagaaaaaaaaaaaaaaagaagaagaagaacaaagaggaaagaaggaagaaggaagaagaatgaagaaggaaggaggaggaggaggagaaggagragaaggaggaggagaaggagaagaaggaggaggagaaggagaaggagaagaaggagaagaaggaggagaaggagaagaaggagaagaaatcatcatcatc

SEQ ID NO: 20770 - DNA, 201 bp, Homo sapiens
tttcctcaaacagcagcaaacaaaatattaggcaaactcccagaatacaaaacaaatcaaaggagagcagctcctggctaaggcaagtcaggtgggggaargtggccaggaccctccctgctaccccaatcctccccacccccaaaaggtgggtccactgaggaaaatccaacgacaccttgggccctttggaccagtttg

SEQ ID NO: 20771 - DNA, 201 bp, Homo sapiens
catgaaccatttcaacagaccacccttggagccatcaatccaaattaaagctagtcatgattcataaaaacatctcatttagttctcaagttaaacagacraattattaaagaataagtgggaatgtaaaatggtgtggccactgtgaaaaacagtatgatggttcctcaaaaaattaaacagaattaccacataacccag

SEQ ID NO: 20772 - DNA, 201 bp, Homo sapiens
agatcgcgccactgcactccagcctggggtacagagccagactccgtctcaaaaaacagatggtggtcaaatgataagcagtggaaaaatatacccaagaygacccaagaaatagccagatggcctttctctcttgacccataacaaagtttagctcagatctatgattaactccagttagtgcagctaaataatgaatac

SEQ ID NO: 20773 - DNA, 201 bp, Homo sapiens
tcttcaaatggaccaattttctctttaaaatatttattttaaggaaaaacaaggactacattatattttaaagggggagaaggaagaggattttgagttgytaagagaacagagccatctctttttttttaatactggatgctaagaacttgcacagggttttcccaaaagccagatagttcaggtaatttgcatgtggct

SEQ ID NO: 20774 - DNA, 201 bp, Homo sapiens
gataggattgagcaaacaaacaaaataactaaaagttaataaagaactaaaaaggattaaggagaaaatagctttacaaaatagacaaaggacataaaacrtatacatgatagatatttgtaaagaagagaatataatcaaataaaaaaattcaaggatataattcaagtaaacttccagaaaaaaaagaaaacttgaatc

SEQ ID NO: 20775 - DNA, 201 bp, Homo sapiens
aagacaaaacatacttataatctcaataaatgtaaatgtactaaaatcatctattaaaaacaaaggctaagattaaacctcagagtaaaacctaaccacgycatatacaggagacacacctttggatattcaaagacaatcccatatatagcagacaaagaaagcaaagtaaaagcacgcgacccagtctagttttgaacc

SEQ ID NO: 20776 - DNA, 201 bp, Homo sapiens
aataggaacacttttacattgttggtgggagtgtaaattagttcaaccactgtgaaagacaacgtggcaattcctcaaggaactagaaccagaaataccaytggacccagcaatcccattactgggtatatacccaaaggattataaatcattcgactataaagacacatgcacacgtatgtttactgcagcactatttac

SEQ ID NO: 20777 - DNA, 201 bp, Homo sapiens
agctagtttatagaaaaacctgagtattcttctcctaaatggtagaagagagtacaggagaataacacagatgatgatgatgctgctgctgctgatgatgrtggtggtggtggtggtggtggtggtggtgatgatgatgaagaccccttgactagtgtgtacaagccttgttatcattttcatgtcacacatgaggaatcc

SEQ ID NO: 20778 - DNA, 201 bp, Homo sapiens
agaccttaacagagtgataacagttaccatcaccactgtgtgcctccggatacaatgcactgaggatactgtatttatttttatggtatttctgctatgargtcacatcacatttttttgtgtctttgaagaatattctagaatgtgatgacctgaatatttttcaaactatcaaggacatgagagacaataaaagactgc

SEQ ID NO: 20779 - DNA, 201 bp, Homo sapiens
acagagaaaccaggactgactacccctgtcttccctcaaatctcacattcaatccatcacagtccagttgctttactttgctatttactccaaatctatcsattgcaccatcttcactgctcacaccatagtctaagccgccattgtgcatggtgtagagagggcatgaccgcaacagtgaatgctgcgtttgatgaactg

SEQ ID NO: 20780 - DNA, 201 bp, Homo sapiens
agccgggcgtggtgctgcatgcctgtaatcccagctactcaggaggctgaggcaggaaaatcgcttgaacccgggaggtggaggttgcagtgagccaagaycgcactattgcactccagcctggggtacaagagcaaaactctgtcccctcacccctaccccccaaaaaagaatcttttgctatagaaggatcacctgata

SEQ ID NO: 20781 - DNA, 201 bp, Homo sapiens
ttttgccatgttgcccaggttggtctcaaactcttgaggctcaagcaatctgctcacctctgcctcccaaagtgctgggaatacaggcatgagtcacagcrcccagcctcaaaccttgtcttatgaagattctgagactgccttgaagaatcttaaagaatgagacagaggatgaagaggaggccaagcacacccaacccc

SEQ ID NO: 20782 - DNA, 201 bp, Homo sapiens
aagaagacatgtatgcagccaacaaacatatgaaaaaaagctcattatcactggtcattaaagaaatgcaaatcaaaaccacaatgagataccatctcacrccagttagaatggtgatcattaaaaagtcaggaaacaacagatgctggagaggatgtggagaaataggaacacttttacattgttggtgggagtgtaaat

SEQ ID NO: 20783 - DNA, 201 bp, Homo sapiens
ctgagacaggaggatcgcacatcacttgagcccaggagttcaagccttcagcgagctatgatcctgccactgcaatccagtgtgaacagagtgagcccctrcctccagaaagaataaaaggggaaagaggggtgtttaatgcaatgaaaaaggatccctgagctgcagcttacctgatcaaacttgttcacatcattggac

SEQ ID NO: 20784 - DNA, 201 bp, Homo sapiens
atgccaggtgcggtggctcacacctgtaatcccagcactttgggaggctgaggcaggcagatcacctgaggtcgggagttcgagaccagcctggtcaacayggtgaatccctgtctctacaaaaatacaaaaattagccaggcatgatggcaggtgcctgtaatcccagctactcaggaggctgaggcaggagaatcactt

SEQ ID NO: 20785 - DNA, 201 bp, Homo sapiens
cagaagtcaaaggcaattccttcccttttctgtgtctgtgagacggctctctgtgggattccttcctgctgcacctcatccttcctggaagggactctcaraaaatgtgcctcctccttacaggaaaggaattcctcccgaggaactgtggacatgaggcagctttgtggaatttcccttccacagacttcagcctatttt

SEQ ID NO: 20786 - DNA, 201 bp, Homo sapiens
tgccaggactaggtcaggtacttgggacatatacaggcaaggacactgcccacagggaactgacagtgtctagcagctacacagatgacacggccttttcrgcagacacccctgtcccctgtgcttggcaaacagcagagactcaaaaatgtatatggtttgactcccactggaacataagccccttagggcagggaccag

SEQ ID NO: 20787 - DNA, 201 bp, Homo sapiens
ccgaaagaaagccctcaaagccgggcgtggtggctcatgcttgtaaaccccagcactttgggaggctgaggcaggcggatcaacttaaggccaggagttcragaccagcctggccaacatagtgaaaccctatctctactaaaaatacaaaaattagcctagctgggcatggtggcacatgtgcctgtagtcccagctact

SEQ ID NO: 20788 - DNA, 201 bp, Homo sapiens
aggcaaaaggcaacaagactgtcaacgagggctatgtgaatgggaaaaaaagggccagatagaagtgaaaacattttgaaaagttaaaaaatggccgggcrcggtggctcacacctgtaatcccagcacttagtggggctgaaggcagatcacttgaggtcaggagttcgagatcagcctggccaacatggtgaaaccctg

SEQ ID NO: 20789 - DNA, 201 bp, Homo sapiens
tgcaatcatagctcactaaagctgggaactcctgggctcaaataatcatcccttggcatcccaaaatgctgggattataggcataaaccaccatgcctggycaataaatagctttaatgattgaaaacccaaaacaacacctgaaatgcttttgagatgttacactcactaccttcatcttaagaaattatttctctccaa

SEQ ID NO: 20790 - DNA, 201 bp, Homo sapiens
ttcttttaacaggaatgaggaattacccgttaagaaacaaaattaaacaggcttctaagaaattagcttatatcctctctagaatttcagaacctccctcytacagagacatttattacatctgaaaaagcttgtgatgaatataaaacctgctgacagagcaaccataagactcagaaaaagatgtatatattttatttt

SEQ ID NO: 20791 - DNA, 201 bp, Homo sapiens
tcaaatatgacatgtttcatgtgccgtctttcagactaagaatacttggaggaagcaatcttcactctacagactcaccaaaattttactaagaatcagtsaaaatgaaaatattttacatacgtgattttccttttttcctaatgttgtgtatttatcaaagtattgaccttgagtaggccagatattcagtaatccgaa

SEQ ID NO: 20792 - DNA, 201 bp, Homo sapiens
gaagaataatgaacacatttcccagataacagtgtcttctgagactctgtcatcatgattgaatcggggatggttatgagaatgatatgaatgtatggccragtacagtggctcatgcctgtaatcccagcactttgggaggctggggcaggcagatcatctgaggtcaggagttcgagaccagcctggccaacatggtga

SEQ ID NO: 20793 - DNA, 201 bp, Homo sapiens
agcactttgggaggccaaggcaggcagatcacttgaggtcaggagttcaagaccagcctgggtaacatagcaaaaccccatctctaccaaaaatacaaaayttagccaggtgtggtgtcacatgcctataatcccagctactcgggaggctgagacaggagaatcacttgaacccgggaggcggaggttgcagtgagccga

SEQ ID NO: 20794 - DNA, 201 bp, Homo sapiens
atggcaagggttggaaaggtgaatggggcagactgcaaagggcaatttgccattcgaggacttagaactgtagcttaaaagtaggggagtcctagaggacytgaaagagggaaggtgaactagtgctgtgcctgaatgtttgtggccctccccaaattcctactgaaccctaatcaccaatgtaatggtattaggaggtga

SEQ ID NO: 20795 - DNA, 201 bp, Homo sapiens
tgcacctgtaatcccagctactcgggaggctgaggcagaaaatcacttgaaccgggaggcaggggttgcaatcagccaagattgcaccactgtactccagyctgggtgacagagtgagactgtctcaaaaaaaaaaaaattaaaaaatgctattatgcaaatataagtgaatcaatcgtaaaatacaaagaaagaagaaaa

SEQ ID NO: 20796 - DNA, 201 bp, Homo sapiens
tcaggaggctgaggcaggagaatcacttgaacccaggaggcagaggctgcagtgagccaagatcgtgccattacactccagcttcggcgactgagcaagaytccatcttaaaaaaaaaaaaagaggaagacacagctgacaagcaaactaccaggcttctgcttccaaccatgagagaggacttgccctcccctggaaaac

SEQ ID NO: 20797 - DNA, 201 bp, Homo sapiens
acaaaaattagccgggcacagtggtgggcacctgtaattccagccactccggaggctcaggcaggaaaatcacttgaacctgggaggcagaggttgcagtragccgagatcgcgccactccactccagcctgggtgataggtgagactccaattcaaaaaaaaaaaaaaaaaacacctgtcaactctgaattctatcacca

SEQ ID NO: 20798 - DNA, 201 bp, Homo sapiens
aatgaaaacaaaaataaaatgtggaaatacaggaaatgggagaggcacctgcgggtcaaatgcagccccacaggaagctttcctggtggtgtccctcattygaaagatgggggggaactccaatttgcacgggttcttcaggccccatccagaacactccttaaagcacgatgtggacaggaagagtgcttatttggttgt

SEQ ID NO: 20799 - DNA, 201 bp, Homo sapiens
aagaaaaaaaaaaaaaaagaagaagaagaacaaagaggaaagaaggaagaaggaagaagaatgaagaaggaaggaggaggaggaggagaaggagaagaagraggaggagaaggagaagaaggaggaggagaaggagaaggagaagaaggagaagaaggaggagaaggagaagaaggagaagaaatcatcatcatcatcatc

SEQ ID NO: 20800 - DNA, 201 bp, Homo sapiens
gaaatttagataaatacatttttttaaaaatgaaccacaatttgggagaaacgcttcatgctggaaaatgattctcagctcacttagtcttgtgtatatcwaccttataaaaattcaatttaaatcacaactttcagttcccgaaactgtctgtgaacatgatgccgcggatcagacatgggtggagaccaccgcagttta

SEQ ID NO: 20801 - DNA, 201 bp, Homo sapiens
ggaacctcaaattaggtcggcttcatcagggaagacaatgattgaatttaccctgtgttatgggctgatttgcatccccctaaattcctatgttgaagtcytaacccccaagtacatcagaatgtgactgtatttggagaaagtctttaaaggtgtaattaagttaaaatgaggcctttagggtgggccctgatccaatat

SEQ ID NO: 20802 - DNA, 201 bp, Homo sapiens
atctgctgtgggttaagccagctagtctgtgctactttgctatggcagcctgagcaaaccagtgcacccttcagctttatgtacctgaaatgtaattatgyaatttaaatttactttaaaatattaaaatactgagtcatctgcaaaggtcagtcaaaagagagactcagctttgcctgcaccagcattttcaggaaagca

SEQ ID NO: 20803 - DNA, 201 bp, Homo sapiens
gctctgagcccaagccaggtttgatactgaaccatcaacattactaatatggtttcttctgagtagaccaccaagagaattcaccaatctttcgatttccsacattttttcaggcctagagaacagctggatgggatttccacaagcttgaaaggcacttggctgtggttcttctaacaggaacctcctgagatgcccctt

SEQ ID NO: 20804 - DNA, 201 bp, Homo sapiens
ttatataactgtacacaatgtacattgtatattgtacattatataatgtatatttacattgtattaggtattataagtaaaccaagatgatttaaagtacrtgggagtgcacccataaaaaaaaaaaaaaaatcatgtcctttgcagccacgtggatgcagctggagaccattatcctaagcgaattaacgcaggaacaga

SEQ ID NO: 20805 - DNA, 201 bp, Homo sapiens
gaaagaggtgatcaggacacagacatacacagagaaaagaccccgtgaacagaccccgtgaacatatagccatctgcaagccaaggagagaggcctcagargaaagcagctctgctgacaccctgatctcagactccagcacggaagtgtgagaacataatctgctgtgggttaagccagctagtctgtgctactttgcta

SEQ ID NO: 20806 - DNA, 201 bp, Homo sapiens
catccctttccctatcgtctccgttttaaggctggtgaggaagaaatggatgtagaaggcagacagggtgccaccaaaaacataagtcctcagcaaaatgyaaaaatggaaacgacggtaaaatgggcactttgtgtgtataaagctgataaagtggccaatatccttccaaaagcactgaaaagtcactggtcacatgat

SEQ ID NO: 20807 - DNA, 201 bp, Homo sapiens
ccccccacatacaaaccaaccccctccccccacccacctcattcccaacaaaatgcaccgtgacaactccccatcctgcatttaaagccacccttttgtarcaacagcaacatccacccctctaactttaatggaccactgacatccctaaggtagcacagaggacacaagtcacccagcaggaccctctgcatctcctct

SEQ ID NO: 20808 - DNA, 201 bp, Homo sapiens
tcccagcactttgggaggccaaggtgggatgatggtttaagcccaggagttcaagaccagcatggaaaacacagtgagaccttgtctctatggggggaaaraaaattagccaggtatggtggcatgtgcctctagttccagctttaagggaggctgagaagggagcattgcttgagcctgggaggttaaggctccagtgag

SEQ ID NO: 20809 - DNA, 201 bp, Homo sapiens
caatacaggcctgggaaaaatggaggtgcaaggtgtggggaatagaaggcccagaggatgtggacactgctgatgtgcagatttctgtcttatggtgtccygaatacaagacatccttgtattctaacagcaattctatcaatgttgaacatgattagataatttctccactattccaacatgatataacctagtcttaat

SEQ ID NO: 20810 - DNA, 201 bp, Homo sapiens
ggacacttgggctgcttccacctactgctcactgcaaataatgctgttatgaacacgggtgggccacagatgttacattaaagaatctggccaggcatggwggctcatgcctgtaatcccaggcatgatttgggaggttaaggtgggcggatcactttagctcaggagttcgagaccagccatggccaacatggcaaaacc

SEQ ID NO: 20811 - DNA, 201 bp, Homo sapiens
aagacactgagctggcgcagcccacagttactcatcaacccctctccacatctcaagcgggcatgtgcaattagtaaaatgcccaaaagacagaaagcacrgtgggggaataagagatcaagataaccttcaaaatgaaaaatttacctggaaacgacttaatggtcacatatccgaataatcacaaatatttctataaat

SEQ ID NO: 20812 - DNA, 201 bp, Homo sapiens
cccaggcgtggtggcaggcacctgtgatcccagctatttgggaggctgaggcaggagaattgcttgaaactgggaggcagaagttgcagtgagctgagatygcacctttgcactccagcctaggtgacagagcgagactgtctcaaaaacaaaacaaacaaaccaacaaagatatgtgtaagtaggaaaaaaaatcagtag

SEQ ID NO: 20813 - DNA, 201 bp, Homo sapiens
aaaaaaaaagagagagagaaagttgagagcataagtctgagtgattctgcctgaaagaacagaacagcttatactggacaggcttttgcccaagacacacmtcatctggcattgagaaacgaacaccaacaataatgagtgacagaatgttaagaacaataattatacagacttggacctcccagactgcttgtctgtagt

SEQ ID NO: 20814 - DNA, 201 bp, Homo sapiens
ttaagtgaaaaaccgtaaagaatagctattatttgtgctcaaaaaccagaaaagctatatatgcacagatgcttgtttatgcacagaatacatcaacaaartggagaagaaggtgccagggctgaaacctggcagaggaactgcgtgatgaagggcaggtgtggcagagtgacttactttttacttattaaagttttttgc

SEQ ID NO: 20815 - DNA, 201 bp, Homo sapiens
tacaaaatacttaggtgggcgtggtggtgggcgcctttaatcccaggtacatgggaagctgaggcagagaattgcttgagcttgggaggcggaggttgccrtgagccaagatgatggatgctactgcactccaggctgggcgacagaacgagactccgtcaaaaaaaaaaaaaaaaaaaaaagaattggccttagatattc

SEQ ID NO: 20816 - DNA, 201 bp, Homo sapiens
caagtattttagagacagtgcctgtgatcagaaccacaactccagactgcagatatgtaaactatcacttcatcctttacgtccaaaaggattattttttyccctttcacatatcttagtttggcttatttcaaaactaagttgttcaatctagtatacctcttcaggtttagtacttatacccctcttcaggtttagtac

SEQ ID NO: 20817 - DNA, 201 bp, Homo sapiens
ccccttgtctactaaaaatacaaaaattagccaggtgtggtggcacacgcctgtaatcccagttactcaggaggctgaggcaggagaattgcttgaacccmgaggcagaggttgcagtgagctgagtccatgccattgcactctagcctgggcaacaagagtgaaactctgtctcaaaaaaaaaaaaaaaagaaaagaaaa

SEQ ID NO: 20818 - DNA, 201 bp, Homo sapiens
attcaaaatcaccagccgaggcagtggatcacatgaagtcaggagttggagaccagcctggccaacacagcaaaaccccttctctactaaaaatacaaaawaaataaataaataaaaaattatccgggcgtggttttgagctcctgtaatcccagatacttgggaggaggctaaggcaagagaatcgcttgaacccgggag

SEQ ID NO: 20819 - DNA, 201 bp, Homo sapiens
tttttttttttttttttttttttttgagacagagtctcactctgtcacccaggctggagtgcagtggcataatatcggctcactgcaacctctgcctcctrgattcaagtgattctcgtgcctgagcctcccaagtagctgggattacaggcgtgtaccaccatgcccagctaattttttaaatttagtagagacggagtt

SEQ ID NO: 20820 - DNA, 201 bp, Homo sapiens
cactgctccagggagctcttagcatctgacttatccctaggccaagttcaagaagcatgtgctggatactctgaagacagagttctcaagacacctttacracagtctggagatggttaggtccctaagtcagcgctcctgagactgaatctgggctctgtcatttacactttgtgtggccctgggcacattatataacta

SEQ ID NO: 20821 - DNA, 201 bp, Homo sapiens
agatatgtgtaagtagggccaggtgtggtggctcacacctgtaatcctagcactttgggaggccgaggcaggtggattgcctgaggtcagcagttcaaaaycagactggccagcatggtgaaaacccatctctactaaaatacaaaaattacccaggcgtggtggcaggcacctgtgatcccagctatttgggaggctgag

SEQ ID NO: 20822 - DNA, 201 bp, Homo sapiens
gctaataactgagattgcttaagctctgtaaacaaaacacacaaagcccttgtggctctgcgccagaatcaaaggtctgatccaaaactcccccatccccytgttggctttgaacatgaaaccaattttctacaccaaatcaggcctacttctttgtaaccatccttaccatctctcttataggaaaatgtttaggactct

SEQ ID NO: 20823 - DNA, 201 bp, Homo sapiens
ctgtatttactgatttgaccaaagattctagatcttttacaacaaaataaagtgactctgaattttctttttgtacagaaaaaagggcataatcttgaatytgtatcttcatatcttctgtagctacatgaaaacagtcctgaaatctcctgcttggtcctcacctttcctctacccaagtaaaactgtaaactaagccat

SEQ ID NO: 20824 - DNA, 201 bp, Homo sapiens
aatcataaaagaaaaacaggttgggtaactttcactatttgatttataaagctatagtaattaagataatttgctatgaagaaagaatagattctatccayctgactactaaagtaaaacaaagaaaatatagatcaacaaaacagaatagaggatccagaaaaagattcacacataaatggccatctaatctacattttc

SEQ ID NO: 20825 - DNA, 201 bp, Homo sapiens
gctcacaatcatactcatcaaaatatacagaacaagcaataacaaaaaatccattaactccacaggaaaatgctggagaatcactcattattttgaaaatmggtttaaaaaaaaataacaaaattaatcatttctcctgcctttcctataggtgtactgtaactcagagtatcaaagagttgataatggcaaagtttctct

SEQ ID NO: 20826 - DNA, 201 bp, Homo sapiens
tttccctctctccttttgtcccctttcagctctcttttagccctctctgcctccttaaaggccctttctatttctcttctcctcctctttcctgacctttytgtaacaactggccatgatggaactaaaataattatttcattacttgatactcattgaatcaagattgttctctctttaatggacaagttcaatatttta

SEQ ID NO: 20827 - DNA, 201 bp, Homo sapiens
cctgcagcagcgactgctggacacacggactatgtttttttgagatggagtctcgctctgttgcccaggctggagtgcagtggcgtgatcttggctcactrcaacttctgcctcccgggttcaagcaattctcctgcctcagcctctcgagtagctgggactacaggtgcatgccaccacgcccagctaatttttgtattt

SEQ ID NO: 20828 - DNA, 201 bp, Homo sapiens
aggaagaaaaaaagaaacgccttcccctaaggcaaggtttctcagcctcagcactactggcatttggagctgaaaaactctttgttgggggtgtcgtcccrtgcactgtaggatggttaacagcatccctgaaccccaccctcaagaagccaacagcatccccatcccaagtcctgacaactaaaattatctgaggcattg

SEQ ID NO: 20829 - DNA, 201 bp, Homo sapiens
aaaacaggacacaatataacatcttgccccagacgacggggatagatgatgttgatattaatgtatctttataaaattgtagctataagatgatttgataytacattgggtggtggttcagttcactgatgtttgttttggagaaattttatagaacaagagccaaactcaggtgacatttgagagctatagaggaaccaa

SEQ ID NO: 20830 - DNA, 201 bp, Homo sapiens
tttcactgccttctgaggcttttgtttgtgtttcacctgatttttcatggctggaatacaagcctgaaaacctatacagaaagttctccgtaggccaggtrggggtggctcatgcctgtaatcccagcactttagaagaccaaggcggcaagatcacatgagcccaggagttcaagactagactgggcaacatagtgagat

SEQ ID NO: 20831 - DNA, 201 bp, Homo sapiens
acaaagaccaacaagcagcatagatacaaatggagaagctgcctgtgtcctggtttggcccacacagaggattcccaagctcctccttcttcctgcccccsctgcaggctctaagtgggtggatacttgctcagtctccagtccccatcacagtctccatggaggtgcacataggggacagatgtgctggaaattcgcggg

SEQ ID NO: 20832 - DNA, 201 bp, Homo sapiens
aaaaaacacagactgacaacaactcaatgaactcagataattagaaattctattagtctaatttcatatgaaaccaaggtattttttttttccttcctcaragaccggagtgggagagaaactgttacagccaatcacttccttccaggaaaaaaaaagacgcaaataacaacacaaaaaaacgtgatctaatagacaatc

SEQ ID NO: 20833 - DNA, 201 bp, Homo sapiens
caaaaatctagctagtttatagaaaaacctgagtattcttctcctaaatggtagaagagagtacaggagaataacacagatgatgatgatgctgctgctgmtgatgatgatggtggtggtggtggtggtggtggtggtgatgatgatgaagaccccttgactagtgtgtacaagccttgttatcattttcatgtcacacat

SEQ ID NO: 20834 - DNA, 201 bp, Homo sapiens
gaggccagttgtggtggctcacacctgtaatcccagcactttgggaggcagaggcgggtggatcacctgaggtcaggagttggagaccagcctggccaacrtggtgaaaccctatctctactgagaaaaaaaaaaatagccgggtgtggtgccgcatatttgtaaccccagctactcgagaggctgagggaggacaactgc

SEQ ID NO: 20835 - DNA, 201 bp, Homo sapiens
ctctaatgccttgtctcaaacctcctgatgcagctattccacactgcagtgtccctgtagatatcctaaactcctgcacttcctgccatatgtgcctcctyctcccctacatggctcaggaataaccaggaagccttaccagcttccccaagcagggcaacagacaaagccctttgctgctgtgatgtgaacttgtatttg

SEQ ID NO: 20836 - DNA, 201 bp, Homo sapiens
tatatatgaaatttagataaatacatttttttaaaaatgaaccacaatttgggagaaacgcttcatgctggaaaatgattctcagctcacttagtcttgtrtatatctaccttataaaaattcaatttaaatcacaactttcagttcccgaaactgtctgtgaacatgatgccgcggatcagacatgggtggagaccaccg

SEQ ID NO: 20837 - DNA, 201 bp, Homo sapiens
ccctgaggggaccccattgccactggagtctgcctgccacgcagaagcccgcaggtgcctgggacactatccgagttactgggccagtcctcaaaggtggmtacggaagaggctgaatggcagccactgtcctaacccccactttcccccagagactttctgatgtgggaaggagcaaggcagagctgggtgacctgggac

SEQ ID NO: 20838 - DNA, 201 bp, Homo sapiens
agcagcgactgctggacacacggactatgtttttttgagatggagtctcgctctgttgcccaggctggagtgcagtggcgtgatcttggctcactgcaacktctgcctcccgggttcaagcaattctcctgcctcagcctctcgagtagctgggactacaggtgcatgccaccacgcccagctaatttttgtatttttagt

SEQ ID NO: 20839 - DNA, 201 bp, Homo sapiens
cttctttcctcttcatgtgagttcccagaggtacattattatttactttcagtttctttgttttcagaagtaaaatatgggcaatgagaactgtaaacagytaattttctaagacaccttttcatttggataataactgcatattttaagaaaaatatgcctgtaagcataaaaaagttcacctattcactttccactaca

SEQ ID NO: 20840 - DNA, 201 bp, Homo sapiens
agactctgtctcaagaaaaaaaaaaaaaaagaagaagaagaacaaagaggaaagaaggaagaaggaagaagaatgaagaaggaaggaggaggaggaggagraggagaagaaggaggaggagaaggagaagaaggaggaggagaaggagaaggagaagaaggagaagaaggaggagaaggagaagaaggagaagaaatcatc

SEQ ID NO: 20841 - DNA, 201 bp, Homo sapiens
ccacaggaacattctgacacagacttcagccccaggcctacatcaccctatgatccaaattattttatagtaaatggtatgaagtttggagaggaagggcratttggccatcacgctgtgattttactgcaggtaaagtagaatcaccatgaaagtggtggagccttgctttttctttaatttttataatgccaccaccct

SEQ ID NO: 20842 - DNA, 201 bp, Homo sapiens
agcaagaacatgagtcaggaatcccttgaagcacagaaatacagatctctgaatggagatgaaaactatcatttatttcaattgaatttagtttcattaaraaattctatgataacattaaaacagaaacaggacgtttatatgactgtctttaacctcaaaagtccaaataaacatatagacattttgaatatagctatc

SEQ ID NO: 20843 - DNA, 201 bp, Homo sapiens
ctgaaaaagtaaagagctggacagctgaccacacctacttacaatatttattcactctgagcagggaaaaatcacagactcagaacctacctttcaccccraaggagaggcaagctgtggccatttccctagacgcagacgattaaccaccctaaaaacccaccatccgtacaagttgtcaatccagcaaaaatctgttca

SEQ ID NO: 20844 - DNA, 201 bp, Homo sapiens
atttacctggaaacgacttaatggtcacatatccgaataatcacaaatatttctataaatggtcaaatgctaaaatatgtgtgtatgaaaactgacccctyatgtgtcccataccacatcataggatggccgcagaccaaaacgatcatgatcccttttaagcacaaagaaattagccccagatttcataggaattatata

SEQ ID NO: 20845 - DNA, 201 bp, Homo sapiens
caagcctgtcaaaaggcaaacaggaaaggagttaagaaactgtaaataaatctaaacacagtttgtgtttgatctaattttcaagtgtaggattaaaaaarggggaagcatgccaaggaaaggcgacaagaggggacgcacaacaaaaacccgcacaggctccatcacatgggcgccttgttttcagggaagagttgccca

SEQ ID NO: 20846 - DNA, 201 bp, Homo sapiens
tagtttatagaaaaacctgagtattcttctcctaaatggtagaagagagtacaggagaataacacagatgatgatgatgctgctgctgctgatgatgatgdtggtggtggtggtggtggtggtggtgatgatgatgaagaccccttgactagtgtgtacaagccttgttatcattttcatgtcacacatgaggaatccggg

SEQ ID NO: 20847 - DNA, 201 bp, Homo sapiens
ttggagcacacactgcaggggtatccaagttatgttcaggattccggaaacctcctgctgatccaaactagcaattctaattaacccaatggcaagaagawctcatcaactcacctctttctcctcacctcctccaaaatgtgtccagaagactgtaacctaaccagtccagcttcaacttaggtgggtttcccagacatg

SEQ ID NO: 20848 - DNA, 201 bp, Homo sapiens
cagtgcgaaggctgcagggacctctgcctaggaaagccaggtattgtccaaggtttctcccatgtgatagtctacaatatggcctcgtgggaagggaaagrcctgaccgtaccccagcccaacaccctaaagggtctgtgctgaggaggattagtaaaagaggaaggcctctttgcagttgagataagaggaaggcatctg

SEQ ID NO: 20849 - DNA, 201 bp, Homo sapiens
ttctctgaggttgcacagccaaactgggccaggaaatcctgcacacactggccacattgacaccgacttgtcattctatttctttccaactgaaactgatyggggccatgtggaaacactatcgctgggacaccccagcacaggttgaagaggggctgggagaacctgaggggctcctagccctcttccaccctcaagtca

SEQ ID NO: 20850 - DNA, 201 bp, Homo sapiens
agacaacctcctccaaccacaacacttccacctagagggacagacctcaggcatctcgggcctttggtgctggctcccctgacctctacggaggcacaggmaacaggagtttcccccaggccaccatggtaggctgagcctaggggcagcctgaggaaggtgacacatattcaccttaagggtaaacggaggctccagaca

SEQ ID NO: 20851 - DNA, 201 bp, Homo sapiens
aaaaaatcctgctcctcccaggcttctccctctcagttatcagccgtcacatctttccccttgcccagattttccaaagaaaagaaaaccttcaggtgacyctgcagcccatcccttctttgtcactctttgataggacacatctaagccatccaagtcctattacttcaacatgcaaagtatatccagaaacagtcacat

SEQ ID NO: 20852 - DNA, 201 bp, Homo sapiens
gcctataataccagcgctttgggaggctgaggcagggggatctcttgagcccaaatgttcgagaccagcctgggcaacatagtgagaccttctctccacamaaaaaaaaaaaaatttaattggctgggcacagtggcacacacctgtagtcctagccactctggaggctgaggtaggaggaatgcttgagcccaggggctt

SEQ ID NO: 20853 - DNA, 201 bp, Homo sapiens
ctaaggaagaaagaatggacacaaatgcattcaagaagaagcaacgagaaaaaccaaaaaacaaaggtaataaagataaaagcagaaactgatcaactggraaacagaatataaactagtaaataaatctgataagtcattcaccaggaaaaaaacaaaaatagctaacttaattggaagttaattgggaaaagtgaaaag

SEQ ID NO: 20854 - DNA, 201 bp, Homo sapiens
caaaatatctgaatattaacaatatttctaaataagcatgtgtcaaagatgacatcataagggaaatctgaaatattttaaagtaaatgataataatttgmgagttatagctaaagcaagtcttagagtaaacttttggctttaaggactttgcatttaaaaagaaggcataaaattgataatcaaagttctacctaaaat

SEQ ID NO: 20855 - DNA, 201 bp, Homo sapiens
atgtaacacagtttgagagtaatctgttcaaaggggggccacatccccccaccatggctgaaagacccctcagccccagaccctgctatcaccagtttctytgcctgaaaaacaagccccaactgaactggtttatcgactgagaggggaacagagatgagcaagacatactggcagggcaacaggaagaaaaaggaaaat

SEQ ID NO: 20856 - DNA, 201 bp, Homo sapiens
tgggaagcatgcgggcttaccttctgaacaagatgtagggaatgcaattttaacctccaagactaaaggcaaagaaacagcagaacgcagcttgagccacrgtttgaggtaagcaaaggagctttcctttaccctccctgccaaatgagcacttcacccggcaacctacttcctccctctcgaacccgttgtaagggaccc

SEQ ID NO: 20857 - DNA, 201 bp, Homo sapiens
gtgccactgcactccagcctgggcaacagagcaagactccgtctcaaaaaataaaataaaacaggttttcattttaatttttaacatataaacctccacargaacattctgacacagacttcagccccaggcctacatcaccctatgatccaaattattttatagtaaatggtatgaagtttggagaggaagggcaatttg

SEQ ID NO: 20858 - DNA, 201 bp, Homo sapiens
caaccccagcaatctgacagaatccttgtcacatgttaataccttttctttctgaacttgagtgtgagttatctgtgttcctaaagatataatctcatatmtttaggcaaaatgagaatatgcacagaatattataatctattatttaataaaagtatttacttcagtagctacataatattacagtatatatgattattt

SEQ ID NO: 20859 - DNA, 201 bp, Homo sapiens
ggtcctgatgatatctattacatgcctgccatgtgccaaacactatgatataaacttatccattaggtttttttttcctttttcttttttttttttttgakatggagtcttgctctgtcacccaggctggagtgaagtggtgccatctcctctcactgcagcctcccactcccgtgttcaagtgattctcctgcctcagtt

SEQ ID NO: 20860 - DNA, 201 bp, Homo sapiens
agtccaggcaaaaggcaacaagactgtcaacgagggctatgtgaatgggaaaaaaagggccagatagaagtgaaaacattttgaaaagttaaaaaatggcygggcgcggtggctcacacctgtaatcccagcacttagtggggctgaaggcagatcacttgaggtcaggagttcgagatcagcctggccaacatggtgaaa

SEQ ID NO: 20861 - DNA, 201 bp, Homo sapiens
aagttttttgtttgtttgtttgttttttgagaaagagtctcactctcacccaggctggagtacagtggtgtgatctcagctcactgcaacctctgcctccygggttcaagcgattctcctgcctcagcctcctgagtaactgggattacaggcgtccgccaccacacccagctaaattttgtatttttagtagagataggg

SEQ ID NO: 20862 - DNA, 201 bp, Homo sapiens
aaagctggctgatgatcagaagctctagaatacaggagatgctttcagctaggggttgagggaacatagaggccagttcccaatctcaagctacagaatgmatgtctcctgggttccctgaggctgaatcctgccactgcctgttaagaaaaattggaaaatagttctcacaaagaattcagagcttgtaataagactcct

SEQ ID NO: 20863 - DNA, 201 bp, Homo sapiens
agtagagacggagttttgtcatgttggccaggcaggtctcaaactcctggcctcaagtgatccacctgccttggcctcccaaagtgttgggattacaggcktcagccaccacgaccagctaacaaccatattcctaacacatatgctactaggactgtgtgattttataactacatcattaaaattcaccttgcctttggg

SEQ ID NO: 20864 - DNA, 201 bp, Homo sapiens
aaaattagcgaggtgtgatgacacatgcctgtaatcccagctactcgggaagctgcggcacaagaatcacttgagcctgggaggcagaggttgcagtgagytgagatcgatgccactgcactccagtctgggcaacagagtgagactatctcaaaacaataaaaaatataaataataattaaaatttagccagatgtactg

SEQ ID NO: 20865 - DNA, 201 bp, Homo sapiens
attacctattttaacatatttaaactccaaaatccattacgagtccatgatatcaacttctcagttacaaatataaatattaaataatttacagatataartaagtctgcaatagcaaaagtttcctaaaggcctggattctgcaaatgggtttcagaaagagggtgcaaggacacacaccagtgcaaatgtgcattttct

SEQ ID NO: 20866 - DNA, 201 bp, Homo sapiens
ccacttctcacatctgtattaaaggcaagaaaattttgtaaaggaaaggaatacttagagccaccaatcaagaatcttttgctggctgggcgcggtggctyatgcctataatcccagcactttgggaggccggggcaggtggatcacctaaggtcaggtgtttgacaccagcctggtcaacatggtgaaaccccatttcta

SEQ ID NO: 20867 - DNA, 201 bp, Homo sapiens
aaagaaaggaaaattataaaccaaactgtgttaagaacactaagtccgggcccggtgactcacacctgtaatcccagcactttgggaggccaaggagggcrgatcacaaggtcaggagtttgagaccagcctggccaacatggtgaaaccccgtctctactaaaaatacaaaatttagctaggcgtggtcgcgggcacctg

SEQ ID NO: 20868 - DNA, 201 bp, Homo sapiens
acataaaaaataattatactttataaactgtttacaccagtaatacaagcctgatttaagatctgacaattaatcaatcaatgctatttatcaggttaacraaacaggaagaaccacatgatcatataaatagtggcaagaaaacaccagggcttgaacccaggagatgaaagttgcagtgagccgaaatcatgccactgc

SEQ ID NO: 20869 - DNA, 201 bp, Homo sapiens
agactggaatgcaacaccctagatcttggagctacaccaaacagtctaacatactatcattttcagtcccagaagttaaggagttaaaagagaaagaaaaraaaagtgtatcaaaacataaagtactcataattttccaaaattaaataaaaataccaacccatatattgaagctcattaatcccaagaaggatactaaac

SEQ ID NO: 20870 - DNA, 201 bp, Homo sapiens
taattagtgcctgttcaaatcaagcgctttcttccaaacgattaaacttcatctctcataagagatgacatagttctctcttgcttccaagctcaaataascacttgccagactaaggaataagactccttaacaaagcgagcatctgaagctactcatttaagtttgcgcaccaagaagcacagagaataatatacaatt

SEQ ID NO: 20871 - DNA, 201 bp, Homo sapiens
ctgccctcccctaactttatattgcagccagaaggatattttttctgaagagcatctcatgctgagtggcagcagaatgcagagattaagagagggggccrggcacagtggctcacacctctaatcccagcactttgggaggccgaggcgggtggatcacccgaggtcaggagttcaagaccagcctagccaacatggaga

SEQ ID NO: 20872 - DNA, 201 bp, Homo sapiens
aaaaaataaaaaggaagacatgtaataagaatgacacgtattggccaggcgtgatggcgcacgcctgtaatcccagcacttttggaggccgagacgggcaratcacttgaggtcaggagttccagaccagtctggccaacatcgtgaaaccccatctctactaaaaatacaaaaattagacaggcgtggtggtgggtgcct

SEQ ID NO: 20873 - DNA, 201 bp, Homo sapiens
ccacctcctgctcctcctcccccgagccctaagggcccgcagggcctccagtagcaaagccactggccccgcgtccccgcgtccccctgcgccgcgccccrgggcgcaggcagggaccacgcggccggcgtgggggcggcgccacccgcagcagaaagccccggcgtggaccgcgtggcgtaggaaagcgctcccctcgcc

SEQ ID NO: 20874 - DNA, 201 bp, Homo sapiens
cagaaggactgtgaagcttaagggagacaatgccataagcgttcacgtttgcggcaagaagagtatcaggtcagtgagtatgggaaaccttgtccctcttytccttcttctcttgagtttgctccattatagttcctctaatgtaggatgaaactaagttcatatttaaactctaactcatcagtaaagccaccgtaacag

SEQ ID NO: 20875 - DNA, 201 bp, Homo sapiens
tacaggtttattaaatgtgtgttcatgtgacttggagaagtcatatcaaaacatgtttaaagcttttcagacaagccttcataacctccagatgtcttgtwgcatctagggtcccctctgacaaaaagaagttcccactttcttagtcaatccatcctgcatagtggtcacataaataatttctttcatggagatgtccaa

SEQ ID NO: 20876 - DNA, 201 bp, Homo sapiens
ccagcctggccaacatggtgagaccccgcctctactaaaaatacaaaaattagccgggcacagtggtgggcacctgtaattccagccactccggaggctcrggcaggaaaatcacttgaacctgggaggcagaggttgcagtgagccgagatcgcgccactccactccagcctgggtgataggtgagactccaattcaaaa

SEQ ID NO: 20877 - DNA, 201 bp, Homo sapiens
cgaaacaactgggaaaatactcattatcaaaattacaactaaccaaatttaaactttctaaatatcagtaccaaggtcaaaagtaactcacataaattctycaccttagagaccaaccaatctatgacctggtgaagagtctttccacaaacaagctaagaatagtccttactccttcacaagaattctcctcgactgtga

SEQ ID NO: 20878 - DNA, 201 bp, Homo sapiens
acctttttgtaacaactggccatgatggaactaaaataattatttcattacttgatactcattgaatcaagattgttctctctttaatggacaagttcaawattttatattcttcagaagccaagcctaataaaacctttttcaatggattatgcatttgcataaccctaaaattatagtctatcaaagaagaaaagtttc

SEQ ID NO: 20879 - DNA, 201 bp, Homo sapiens
gttcaaaatcagactggccagcatggtgaaaacccatctctactaaaatacaaaaattacccaggcgtggtggcaggcacctgtgatcccagctatttggraggctgaggcaggagaattgcttgaaactgggaggcagaagttgcagtgagctgagatcgcacctttgcactccagcctaggtgacagagcgagactgtc

SEQ ID NO: 20880 - DNA, 201 bp, Homo sapiens
acaggagacacacctttggatattcaaagacaatcccatatatagcagacaaagaaagcaaagtaaaagcacgcgacccagtctagttttgaaccagtgtrgatttaggaccaaaaccattacatgaatcaaagaaaggtgtgttaaaatggcaggaaatataattcatagtggaaacccaagttatgaacatctgtggac

SEQ ID NO: 20881 - DNA, 201 bp, Homo sapiens
cgcaaatgagagagaacactaagtcaatgaacccagggaaagggctgaaagaaaacaagtgagtcacaaaactcacaagtagaacagattacacttacccrtgccccacatcagatggaagtgatacatccatatagaaaatagtgactgcaagattttaataaaactcaggcaagttctccagtccaaacctttttttgt

SEQ ID NO: 20882 - DNA, 201 bp, Homo sapiens
aagattgcaccactgtactccagtctgggtgacagagtgagactgtctcaaaaaaaaaaaaattaaaaaatgctattatgcaaatataagtgaatcaatcrtaaaatacaaagaaagaagaaaatgtaggagtgagggagaagaaagggaaggagagagaccagcccgcccctgtaggaaagaaacagaacgtaatgtgcc

SEQ ID NO: 20883 - DNA, 201 bp, Homo sapiens
acttgtagacccagctactcgggggctgacgtgggagaatcgcttgaacccacgaggcggaggttgcagtgagccaagatcacaccactccactccagccrgggtgacaaagtgaggccttgtctaaaaaaaaataaaaaataaataaaaagaagacaaattactttgaaaaacaactagctgcttagagcaaaaatggta

SEQ ID NO: 20884 - DNA, 201 bp, Homo sapiens
aaaatcttagacatgcaagaaagaaaatttaactcagggcaataaagaaagcagtcttcataataaaaaccaaacccctcaaatatataaataataaaagyaaatccaagtaggcacacacattggattttaagatttacagaaacaagtataaatgtactcaatgggttagtatgttcaaagaaactgaggaaaaatatg

SEQ ID NO: 20885 - DNA, 201 bp, Homo sapiens
aataggctgaagaggaagaggaagatgagggattggccttgctgtctcagaggtggaagaggctgaagaaaatctgcacgtaggccgggcgcagcacacgyctgtaatcccagcactttgggaggccgaggcgggtggatcacttggggtcaggagttcaagaccagcctggccaacaatggtgaaaccctgtctctataa

SEQ ID NO: 20886 - DNA, 201 bp, Homo sapiens
agagatagactccgtctcaaaaaagaaaacaagaaaccaagaccatgcctattgtcatgctatagtccccttttgggccatctagggtggtgaacaacacyatacatttactcctagctggactttcaccatcttgcggctcggcctcctctcagtcctcctcctctccaggaggcctctttattcagctggagaggcgtt

SEQ ID NO: 20887 - DNA, 201 bp, Homo sapiens
aggaggtcaaggctacagtgagctgtgatcacatcactgcactccagtctagtcaacagaatgagaccttatttctaaataaatttatatatatatatatrtatatatatatatatatatatatatatatataactattgaagtgcatacaatcagtaatgtgaattctgaggcgtaattcacagattttgtgtatccttc

SEQ ID NO: 20888 - DNA, 201 bp, Homo sapiens
ttcaaggctactatgaacatctttacacacataaactagaaaacctagaagagatggataaattcctggaaaaatacaaccctcctagcttaaatcaggargaattagataccctgaacagaccaataacaagcagcaagactgaaatggtaatttaaaaattaccaacaaaaaaaagtccaagaccagacagattcacag

SEQ ID NO: 20889 - DNA, 201 bp, Homo sapiens
attttttctatcttctagaacttatagccctctattaagtatgctcagttttcatcaactatccaccaggtttatgaaaacctcagtgtacaatcaaacayttcatcttttctgaaaacaatcactctcttggtgaaatgatacacaatgaaaaataaattttaaaacagtttcctttaaataataaattgcactgtaaat

SEQ ID NO: 20890 - DNA, 201 bp, Homo sapiens
catatatctgtgttaccctcagcagctaccagaatatatagaccaagtcatattcatttatgtcattatgatcataaatcaagctaccatttagtaagcayctactgtaagccagacaactgaacaagaaaacaactatgaagtaagaattattcctattttgtagatgagaagataaaaataaactcaaactacttacat

SEQ ID NO: 20891 - DNA, 201 bp, Homo sapiens
caactatattccctgttccaatatcattgtgcggaacacagaaagaactgggtatgctattttttcctccaactcccaaaatctctgaactcttctattaygtgcttcaatcagagtgaggaatgagaccagtcactgaagcaaaagaacatttctataaacttccacctgaagttcagagagaagtctgattagctacta

SEQ ID NO: 20892 - DNA, 201 bp, Homo sapiens
cggggccgaccacagctaacaattcgccaggtctgacagtaaaggaaaggccttgtagagttggggtctctgatgcctacaaattaaagtttataaaatgkgcccatttcaataaagtcacacaaatcacttcaaaaagagaagaaaacaatacaacagtcattgatacatgaacataacccaaatctttctccttcctat

SEQ ID NO: 20893 - DNA, 201 bp, Homo sapiens
aaagacaacgtggcaattcctcaaggaactagaaccagaaataccattggacccagcaatcccattactgggtatatacccaaaggattataaatcattckactataaagacacatgcacacgtatgtttactgcagcactatttacaacagcaaagacttggaaccaacccaaatgcccatcaatgacagactggataaa

SEQ ID NO: 20894 - DNA, 201 bp, Homo sapiens
gcagtggcacaatctcgactcactgcaacctctgcctcccgggttcaaacaattctcctgcctcagcctcctgagtagctgggattacaggtgcacgccaycatgcctggctaatttttgtatttttagtagagacagggtttcaccatgttgaccagtctgctctcaaactcctgaccttgtgatctgcccaccttggcc

SEQ ID NO: 20895 - DNA, 201 bp, Homo sapiens
agattgcagtgagccgagactgcaacactacactccagcctgggtgacagagtgagagactgtctcaaaacaaaaaaaaaaaaaaaaaaaagttactcagmttcttgtactttagcattttcatgtgtcaaaaggggataataacagcaggtcagaaggactgtgaagcttaagggagacaatgccataagcgttcacgtt

SEQ ID NO: 20896 - DNA, 201 bp, Homo sapiens
tctgtgtgttgccttgaccatctccaggcctcatctctccttactcttggacagatccacttactcagtcttaccttcagttctgcttcttccaaaagtckcctcactcatgatgtcaaccactgaaaacctgaagtttcagcgctagcccagggcactcccaccacccaccataactggtacacctacggggctctacgt

SEQ ID NO: 20897 - DNA, 201 bp, Homo sapiens
gtaattccagccactccggaggctcaggcaggaaaatcacttgaacctgggaggcagaggttgcagtgagccgagatcgcgccactccactccagcctggrtgataggtgagactccaattcaaaaaaaaaaaaaaaaaacacctgtcaactctgaattctatcaccaacacaaaatgtcctttaaaatatgagggtgaaa

SEQ ID NO: 20898 - DNA, 201 bp, Homo sapiens
ccttaacagagagctggtgctgaggaggagtgagctgaatagagatactgaaggtcaagctgaggtgaggtactgaaattctcaccagaccagagtgcggraacctcattcatatatcattaacacacctggcatacggttgaaacaccagagagatcatgtcttagaattcaagagcactatccagagaaataattctca

SEQ ID NO: 20899 - DNA, 201 bp, Homo sapiens
attataggcatgagccactgcgcctggcctaaagggggttttataaacagaactggtaacactttactttctacctgacactacacacagaatttctcagmgtattatatgttttttctaaatctagtcttaataagctttcaacctctttatatatataaaatagttttctgaaatgatggtcataattttgcttaaaaa

SEQ ID NO: 20900 - DNA, 201 bp, Homo sapiens
agtgagccgagatcgcgccactgcactccagcctggggtacagagccagactccgtctcaaaaaacagatggtggtcaaatgataagcagtggaaaaatayacccaagatgacccaagaaatagccagatggcctttctctcttgacccataacaaagtttagctcagatctatgattaactccagttagtgcagctaaat

SEQ ID NO: 20901 - DNA, 201 bp, Homo sapiens
tggcgcggtggcacgcacctgtagtcccagctacttgggaggctggggcaggagaatcgcttgaacctgggaggcggaggctgcagtgagctgagatagcrccactgcactcctgcctgggcaacagagcaagactccaactcaaaaaaaaaaaaaaaagtttaaaaactggtcctgtggcagtgggtctcaaacatcagc

SEQ ID NO: 20902 - DNA, 201 bp, Homo sapiens
tttaatcatgaggtcacttaatcagtagatggtattttcatgatttgtttatggtattaaaacataaaatcaggatcattaaggttgctaacacctcacaraaagtggaaagcttttaattctgctgtaagccactgaagaattgtgttctaagctgtgataagtacaaatcatccagattgctttaaacgattactgact

SEQ ID NO: 20903 - DNA, 201 bp, Homo sapiens
ggaagccttattaaagacacctgcaaacaaaacaagtgacaatagatctttatcataattgataactaagttatcctttagataaaactcctttcttggaracaataacattaggatttaaccttcgctgtagattcaagaaatcagctaattggggccagtaggattccacaacattaagtttaccaagattatgtgagt

SEQ ID NO: 20904 - DNA, 201 bp, Homo sapiens
gcggctggctgtgatcacactgccgaggagcacgtaggtggtgaaggtcacaaacacgatgattttgcttgcactgaaaaatgaagccaaattcatccctytgaggcaggaacttctcagaatcttggaaatctccttcctgaaagagagtacaggtttttaaaaaagcagtgatgtcaaccagataaagtggctcacgcc

SEQ ID NO: 20905 - DNA, 201 bp, Homo sapiens
atgattgatcgggttttatgagggaagctttggctgggagacacgctagaagataaaagtattctgtaaatttcaagtataaaagaaatacagtgcttcawgtacagcttccctctttattcatacacaatgtgattcttatgaaaattcagaacacagatttttgtcgatcctaaagccaggcttgaatccggactctgc

SEQ ID NO: 20906 - DNA, 201 bp, Homo sapiens
tagagaaataggaaaggaggcggaaccaggcagaccccatcagtgggtgttgtagcaaacatctgcacagttctaaagcatcccagtcttcaaagccaaaytcatccccaaatctggtcttctagtattccatatttcagtgaacccaggtgattttgcagccataaggacgaaagtagccctgatccctccttctgacta

SEQ ID NO: 20907 - DNA, 201 bp, Homo sapiens
tacagtcgtacaaatggagcaaggcagtagaaatcaaccaattggaaataaagaagtctggcagagataggttcatcaacagtaagaaaaaagtgaaaagyggacaggaaagaaatggcagaggtcctaaaggcatgcacagaaattaacaaggaaaacatctacagaggaaagaacttattttcaaacagggatagctaa

SEQ ID NO: 20908 - DNA, 201 bp, Homo sapiens
taatcccagctactcaggaggctgagacagcagaatcgtttgaatctgggaggtggaagttgcagtgagccaagatcacgccattgcactccagcctgggyggaagggcatgacttcgtctcaaaaaaaaaaaaactttttccttaaaatacacctcttggagccagtcccagatacttgggaggatcaggaaggaggacc

SEQ ID NO: 20909 - DNA, 201 bp, Homo sapiens
tggacactgctgatgtgcagatttctgtcttatggtgtcctgaatacaagacatccttgtattctaacagcaattctatcaatgttgaacatgattagatratttctccactattccaacatgatataacctagtcttaattgtagatcccagtattaaagtcgttttttaattaacagaaataacgtgctgctgattcat

SEQ ID NO: 20910 - DNA, 201 bp, Homo sapiens
gagaatctgccaacacaaatggtattagtagaaggggccagcccagggaagctgccgtaccccttccacagtgacaagacagctgtctatgaaccagagcrtgagccctctccaggcaccaaaactgctggcgccttgatcttgaatcttgtcctccagaactgtagaaacaattttctattgtttatatggagtacctag

SEQ ID NO: 20911 - DNA, 201 bp, Homo sapiens
gggattacaggcttcagccaccacgaccagctaacaaccatattcctaacacatatgctactaggactgtgtgattttataactacatcattaaaattcaycttgcctttggggagcttacaatttaatggaaatactgaattaaaaataacacacatatatacacgtgaaaacagctctaacacaagcacggtaaagatg

SEQ ID NO: 20912 - DNA, 201 bp, Homo sapiens
acccgggaggcagaggttgcggtgagccaagatcacaccattccactccagcctgggcaacaagagcaaaactctgtctcaaaaaaaatagatagatagayagatagatagatagatagatagatagatagatagatgatagatagatagatgcgtggatcccacccccagaaattatttttccaattggcctataagggg

SEQ ID NO: 20913 - DNA, 201 bp, Homo sapiens
acagagactctctcaaaaaaaaaaaaaaaaaaaaaaaagagagagagaaagttgagagcataagtctgagtgattctgcctgaaagaacagaacagcttayactggacaggcttttgcccaagacacacatcatctggcattgagaaacgaacaccaacaataatgagtgacagaatgttaagaacaataattatacagac

SEQ ID NO: 20914 - DNA, 201 bp, Homo sapiens
tggagaatagtaattactcaatgaatactttctgaatttatgttaaatatgaaccaaagcaatgacaggagctcttattgtacaaataatccaatctctaraacactccttgagagtcacttctgcaaaggagaagaaaagaaaatagaatcagagtccgggaaaggatggccaatttaaccctccaccatcagagcaaac

SEQ ID NO: 20915 - DNA, 201 bp, Homo sapiens
ggggagaggactgtttgagcccaggagtttgatgatgcagtgagctatgatcacgctaatgcactccagactgggcaagggagcaagaaatgccccctttyttaaaaaaaaaaaaaaaaaaaaaaaggctgggcacagtggctcatgcctgtaattccagcactttgggaggcagaggtggggggatcacctgaggccagg

SEQ ID NO: 20916 - DNA, 201 bp, Homo sapiens
ccaaatcttcaagaaatccccaagtcctcacagtgctttttgtggatttttgtggaaaccggtaaaaggggctgatttgctgaccccagtgggtagaaaayagagactgtcaagagaacagaagagaaggcagaaaggggatggggaagtggggttcgccatgttcacgagctcctggagccacagggccccccaggaaca

SEQ ID NO: 20917 - DNA, 201 bp, Homo sapiens
atgagtcaggcattattactttccctatttaatggatgagaaaactgagatttagagtaggacttgaatcccaaactatcatgagtcagttgatgttatgygggaaatgagcaagcaggcatcatagacaaggaacccagaagcctcagctatgcacgggataaggaagtgactaattgcaaattcagtgctcagaaaaaa

SEQ ID NO: 20918 - DNA, 201 bp, Homo sapiens
aaaggcacccgagcctgacgataacacagtggtcagagagtgctaaaatgggaatgaagtgctggggagcagaaaagaaagggctgtttgttaactccacygggaaagaggagagcaaaaaaaaaaaaaaaagcttcagaggaccaggagcatttgaacggggcctcaaaggacaaggactatttctccagatggcaaaga

SEQ ID NO: 20919 - DNA, 201 bp, Homo sapiens
aggagaatcacttgatggagactgcagtgagctgagattgcaccatagaggtccagcctgggcaacaggagtgaaactgctttaaaaaaaatacatatatmtatatatatatatatatatatatatatatatatatatatagagagagagagagagagagagagagagagagagagagagaaagagagagagagagagaga

SEQ ID NO: 20920 - DNA, 201 bp, Homo sapiens
ctatatctatccgtctttgtggagaagtattcaccaatgcaacaaaacgtaattattacaccttaagcacttgcaattacaggactgcatgatgacaataktgttggttatgtccttcattaacatctgtcacttccccagccactccctgagcctgccttttggagtgctgagctttgcagctgattcacttgtctctat

SEQ ID NO: 20921 - DNA, 201 bp, Homo sapiens
taatgttttaaaaatcatgttaaaatgttttaggacaatcttattctttaaaaacaagtataaaaatctatgtagtaatttactaattttcataaaacaaygaaaaatgtcttccctccaaattgcttaaagctgattattgggagtggattttaggaatctagctctcctgggatactgaataatatctctgacactgga

SEQ ID NO: 20922 - DNA, 201 bp, Homo sapiens
acagctaacaattcgccaggtctgacagtaaaggaaaggccttgtagagttggggtctctgatgcctacaaattaaagtttataaaatgtgcccatttcartaaagtcacacaaatcacttcaaaaagagaagaaaacaatacaacagtcattgatacatgaacataacccaaatctttctccttcctattttaagatatt

SEQ ID NO: 20923 - DNA, 201 bp, Homo sapiens
ggtttcaccatgttgatcaggctggtctcgaaatcctgacctcaagtgatccacctgccttggccttgcaaagtactgggattataggtgtgaaccaacgygcccagcctgctttctgcttctaaaagaataagaaacaaataagaaatgtgtttataatgtatcttctcaaatatgacatgtttcatgtgccgtctttca

SEQ ID NO: 20924 - DNA, 201 bp, Homo sapiens
gcatgatgaaaccccgcctctactaaaaatacaaaaattagccgggcgtggtggaggacacccgtaatcccagctactcgggaggctgaggtaggagaatmgcttaaacccaggaggcagaggttgcagtgagccgagactgcacactgcactccagcctgggcgacagagcgagaccccatcaaaaaaaaaacaacacag

SEQ ID NO: 20925 - DNA, 201 bp, Homo sapiens
ctgacacagacttcagccccaggcctacatcaccctatgatccaaattattttatagtaaatggtatgaagtttggagaggaagggcaatttggccatcaygctgtgattttactgcaggtaaagtagaatcaccatgaaagtggtggagccttgctttttctttaatttttataatgccaccaccctacattcttaggag

SEQ ID NO: 20926 - DNA, 201 bp, Homo sapiens
ctctctcagcagcactctaatgagcaaaaacaactgtgcctcaaaatacaggctgcagtgggcagaaatctctgtactgcactccagcctgggtgacagartaagtttctgtctcaaaaaaaaaaaaaaaatcaagtaacaaagaacagctgtctaaaactgttaacactgattcaaaatataataacctttatgcctgtt

SEQ ID NO: 20927 - DNA, 201 bp, Homo sapiens
tcaacacttattttaaacagtatctgctgtctggtgaccaccctagactctgaacttctaatcttggtatctttaaatctgaatgccttttattcctcatycagtttccactgttcttcctcaccttcctgtgtttctaaggaaaacacctgagaatgcctctcccctccccacgcctccacgatagaaaggttagtgcac

SEQ ID NO: 20928 - DNA, 201 bp, Homo sapiens
agagcatctcatgctgagtggcagcagaatgcagagattaagagagggggccgggcacagtggctcacacctctaatcccagcactttgggaggccgaggygggtggatcacccgaggtcaggagttcaagaccagcctagccaacatggagaaaccccgtctctatgggcgtggtggtgcatacctgtaatcccagctac

SEQ ID NO: 20929 - DNA, 201 bp, Homo sapiens
cagtagcatcgcgccattgcactccagcctgggcaaaaagagcaaaactccatctcaaaaaaataaataaaaataaaaaatacaaatacaataattagccrggtgtggtggcaagcacctataatcccagctactcgggaggctgagacaggagaaccgcttgaaccccgggaggcagaggttgtactgagctgaggttgc

SEQ ID NO: 20930 - DNA, 201 bp, Homo sapiens
actgcaaaactttactgggcactgggtatgtgttggaaatgtgacatattacctcatttgaacacctccatatctgtaaagtcaataatggcatttccacraggaattttatctttaaagagatacatgtacaaaatataaaaatgtaaatgtttaaaaagtggctttagctaattttattaactttggagtcatattcta

SEQ ID NO: 20931 - DNA, 201 bp, Homo sapiens
tactgagggaactcagagaccggtgcctggggcgcgggtcctggcgcgggttctccgtattctgagcggcggtcccctgggcccacttttctttctctatwctttgtctctgtgtctctttcttttctcagtctctcgtcccacccgatgagaaacacccacaggtgtggaggggaaggccaccccttcactaataggcta

SEQ ID NO: 20932 - DNA, 201 bp, Homo sapiens
acttcgtctcaaaaaaaaaaaaactttttccttaaaatacacctcttggagccagtcccagatacttgggaggatcaggaaggaggacctcttgaggccayaaatttgaggatgtagtgtgcctgtgaatagccactacactctagcctgggcaacacagaaagacctcataaataaataaataggccagatgaggtggct

SEQ ID NO: 20933 - DNA, 201 bp, Homo sapiens
gcgggtggatcatctgaggtcaggagttcgagaccagcctgatcaatatggtgaatccctgtctctactaaaaatacaaaaattagccaggtgtggtggcrggtgcctgcagtcctagctattcaggaagctgagacaggagaatttcttgaactcgggaggtggaagttgcagtgacccaagatcacggccactgcactc

SEQ ID NO: 20934 - DNA, 201 bp, Homo sapiens
ttctcattgttcattaacacatccacgagaggcaaggaagaaagtgaacattggatcaattcattacactcatcatttacaacctccatttttagagaaayaggaaaggaggcggaaccaggcagaccccatcagtgggtgttgtagcaaacatctgcacagttctaaagcatcccagtcttcaaagccaaattcatcccc

SEQ ID NO: 20935 - DNA, 201 bp, Homo sapiens
aaaaaaaattaaaaaatgctattatgcaaatataagtgaatcaatcgtaaaatacaaagaaagaagaaaatgtaggagtgagggagaagaaagggaaggaragagaccagcccgcccctgtaggaaagaaacagaacgtaatgtgccttattgactacaaactatctgtaaatatttataaagccagtcttacatacaaaa

SEQ ID NO: 20936 - DNA, 201 bp, Homo sapiens
ttcaagaaatccccaagtcctcacagtgctttttgtggatttttgtggaaaccggtaaaaggggctgatttgctgaccccagtgggtagaaaacagagacygtcaagagaacagaagagaaggcagaaaggggatggggaagtggggttcgccatgttcacgagctcctggagccacagggccccccaggaacaacagagc

SEQ ID NO: 20937 - DNA, 201 bp, Homo sapiens
atgattgcatcactgcactcccacctgggcaacagagcaagaccctgtctcaaaacacacacacacacacacacacacacacacacacacacaaacacaamattaaatggccaggaatagtggctcattcctgtaatcccaacgcttgggaaaaccaaggcaggaggactgcttgagcccaggattttgagaccagcctgg

SEQ ID NO: 20938 - DNA, 201 bp, Homo sapiens
cctggagacaccatcagagcattcagctcgacgtggacactcagcacccaatttgcctgggtcacagaggaggtacctgctgtggtagcccctctgtcacyaactggtgagagagatgagacagtaacagcacttctggagaccagagtcccctcccacctccaacaaaggagaactctccttgtaggataaggagagcaa

SEQ ID NO: 20939 - DNA, 201 bp, Homo sapiens
gcaggtggatcacttgaggtcaagagttcaagaccagctggtcaacacagcaaaaccccatctctactaaaagtacaaaaaaattagccaggcatggtggygcacacctgtgaccccagttactcaggaggctgaggcaggagaatcactggagcctgggaggcggaggttgcaatgaggcgagattacaccattagactc

SEQ ID NO: 20940 - DNA, 201 bp, Homo sapiens
aattagtgcctgttcaaatcaagcgctttcttccaaacgattaaacttcatctctcataagagatgacatagttctctcttgcttccaagctcaaataagsacttgccagactaaggaataagactccttaacaaagcgagcatctgaagctactcatttaagtttgcgcaccaagaagcacagagaataatatacaattg

SEQ ID NO: 20941 - DNA, 201 bp, Homo sapiens
tctactaaaaatacaaaaattagctgggcatggtggcaggcacctgtaatcccagctactcaggaggctgagacagcagaatcgtttgaatctgggaggtrgaagttgcagtgagccaagatcacgccattgcactccagcctgggcggaagggcatgacttcgtctcaaaaaaaaaaaaactttttccttaaaatacacc

SEQ ID NO: 20942 - DNA, 201 bp, Homo sapiens
aagatcgcttgagcccaggagctcaaggctgcagtaagcagtaatcatcccactggaatccagtttgggcaacagagcaaaaccaagaaagaaaagaaaaraaaagaaaagaaaagaaaagagacagacagatgagagagagagaaagagagatgagagagaaagagagagagaaagaaagaaagaaagaaagaaagaaag

SEQ ID NO: 20943 - DNA, 201 bp, Homo sapiens
ggaaaataaaacctgaatcacatcaagcttctagatctaactactaacttctggtaccagatggacatgttaaatgatacagcatgcaaggatgtagaggrtcacaagaggggaggagggatatgcaatgagcccaatctagaccctgggaatccgtgcagggcaaacaacacggtttcttcaattagaaagtacacacgc

SEQ ID NO: 20944 - DNA, 201 bp, Homo sapiens
cacagtggctcaagcctgtatcccagcactttgggatcccaaggcaggtggatcacaaggtcaggaatcaagaccatcctggtcaacacagtgaaaccccrtctctactaaaaatacaaaaaattagcctggcgcggtggcacgcacctgtagtcccagctacttgggaggctggggcaggagaatcgcttgaacctggga

SEQ ID NO: 20945 - DNA, 201 bp, Homo sapiens
cgcatgacggtgcatttattttttttacttcaggttctacttattgcatagggcggcagacatgacttgggaagggtgcacaagcccagcctctctgtgcwttatgggagggcaccttccacttcctactcagtctgtggtagaggaggctgtctgctgctctgaccactgacctaaaaatatacctgccctgcagcaatg

SEQ ID NO: 20946 - DNA, 201 bp, Homo sapiens
cagcctcctgacattcgagccccatcccttgctttcttggagtgacacattacatgtctaggcccagcgggcacgcggcctccatgctcctgctcccccaygcacttcagatattccttgcccaactgcaccataccagattgcatgggaaggaaagaaaacacaggaaatagaaacaagctaccaaagaagatgtttgag

SEQ ID NO: 20947 - DNA, 201 bp, Homo sapiens
ttacagacagaaagtaaaatggaggacaccagaggatgacaggcaagagccaccatgccttgcaaaaattacaaattttatgtgacagatatttttttgakacagggtctcactccagtgcccaggatggcgtacagtggcacaatcatggctcactgaagcctcaacttcctgagctcaggtaatcctcccacctcagcc

SEQ ID NO: 20948 - DNA, 201 bp, Homo sapiens
agttcaagaccagcctggccaacatggtgacaccacgtctctactaaaaatacaaaaattagctgggtgtggtggcccatgtccataatcccagctactcrgcaggctgaggcagaagaatcgcttgaacccgggaggtggaggttgcagtgagcagaggttgcaccactacactccagcctgggcgacagagcaagactt

SEQ ID NO: 20949 - DNA, 201 bp, Homo sapiens
taaaaactggtcctgtggcagtgggtctcaaacatcagcatgcatcagaatcacttggaggactgattaaaacacaggctgctgctgatgctgctaatccyagagccaccttgaagtttttctgtggttttttttttttttttttttttttttttgagacagggtcttgctgtctcccaggctggagtgcagtggtgcaat

SEQ ID NO: 20950 - DNA, 201 bp, Homo sapiens
gcgatctccgctcactgcaagctccgccttccgggttcacgccattctcctgcctcagcctcccgagtagctgggactacaggcgcctgccactgcgcccrgctaattttttgtatttttagtagagacggggtttcaccgtggtctcgatctcctgacctcgtgatccgcccgcctcggcctcccaaagtgctgggatta

SEQ ID NO: 20951 - DNA, 201 bp, Homo sapiens
aaaaaaattaaaaaatgctattatgcaaatataagtgaatcaatcgtaaaatacaaagaaagaagaaaatgtaggagtgagggagaagaaagggaaggagrgagaccagcccgcccctgtaggaaagaaacagaacgtaatgtgccttattgactacaaactatctgtaaatatttataaagccagtcttacatacaaaat

SEQ ID NO: 20952 - DNA, 201 bp, Homo sapiens
ctttttaaggcttcactcaataaaacatcggttgctctctgctgatgagcaaaaaacttgctatacgaaggacaaatatatgtatacaaacaaatgcacaygtgtgcatgtctatatacatatatgcaatttcagggaggtgacaccttattctgagaggtcatgagactccacttcaaaccataatagtaaaacctttag

SEQ ID NO: 20953 - DNA, 201 bp, Homo sapiens
cagacagaaagtaaaatggaggacaccagaggatgacaggcaagagccaccatgccttgcaaaaattacaaattttatgtgacagatatttttttgagacwgggtctcactccagtgcccaggatggcgtacagtggcacaatcatggctcactgaagcctcaacttcctgagctcaggtaatcctcccacctcagcctcc

SEQ ID NO: 20954 - DNA, 201 bp, Homo sapiens
ggccaggcacagtagcatcgcgccattgcactccagcctgggcaaaaagagcaaaactccatctcaaaaaaataaataaaaataaaaaatacaaatacaawaattagccgggtgtggtggcaagcacctataatcccagctactcgggaggctgagacaggagaaccgcttgaaccccgggaggcagaggttgtactgagc

SEQ ID NO: 20955 - DNA, 201 bp, Homo sapiens
ataaaacatcggttgctctctgctgatgagcaaaaaacttgctatacgaaggacaaatatatgtatacaaacaaatgcacacgtgtgcatgtctatatacrtatatgcaatttcagggaggtgacaccttattctgagaggtcatgagactccacttcaaaccataatagtaaaacctttagtaaactgaactcaacatat

SEQ ID NO: 20956 - DNA, 201 bp, Homo sapiens
caacttcacagtcttcaagtaaatagaatccctgatataaatggaaattaacatgtaattttgggggcaataaaaacaacaacaaaaacctgtgacaactytgtcctactcctttaaaaatgagctttgactctgtagtctcttaaggcacaaaacctgatagacggcatttaactggtggcctgcacctctgatttggat

SEQ ID NO: 20957 - DNA, 201 bp, Homo sapiens
tatttaatttacataaaacttcctcagaatgcttctgatgcttcaggtgaggtacatgtttaatgctgaatgtcacttaccttccgataaatcatatggcmcatggctactcgtaacctcatcccagcacactgaacgtgataaaaatataagtgatgcagtatagccaaaatgagcgtgcaaaaagtcagcaccgtggca

SEQ ID NO: 20958 - DNA, 201 bp, Homo sapiens
aaaaaataaaataaacgtgctggacaaacctaaacacctgctacctaacacaaaatcatacacacacacacacaccccctacaggaccccaatgactttayatgacaagaaagaaaacaaacagatatttaggcataattaacctggaaaacaggttgggctcataaaaatcccagaaattttatctatggcaattgattt

SEQ ID NO: 20959 - DNA, 201 bp, Homo sapiens
gtttacatagtccaaaaactagtggaaaatgccttcggaacggacttgacattttggttggattcacagtgctgtctcgaaaatagttaaggtcgagggcygtccattggaagtgtttgtaaccatgtggtcagtgtgaccaatatgtggataatttcttttgaagtatacctagaaaaaaaaaaggtaagcataaaaaga

SEQ ID NO: 20960 - DNA, 201 bp, Homo sapiens
cctcttcaataatttctgggccagagaaaattaaaatccaaaattgcagaatgtataaataaaaaataaactatgagtgaaagcactacatatcaaaaccwacagaatacgaaaattcacagcgctaaaatactaaggaagaaagaatggacacaaatgcattcaagaagaagcaacgagaaaaaccaaaaaacaaaggta

SEQ ID NO: 20961 - DNA, 201 bp, Homo sapiens
gtaataaagataaaagcagaaactgatcaactgggaaacagaatataaactagtaaataaatctgataagtcattcaccaggaaaaaaacaaaaatagctracttaattggaagttaattgggaaaagtgaaaagtacagagtggaaaagtataaatactaggtagccattaaaaaatgaggtaactggccggtcatggtg

SEQ ID NO: 20962 - DNA, 201 bp, Homo sapiens
gattgcaccatagaggtccagcctgggcaacaggagtgaaactgctttaaaaaaaatacatatatatatatatatatatatatatatatatatatatatayatatagagagagagagagagagagagagagagagagagagagagaaagagagagagagagagagagagaacgctaataaaaaatacacatataaaataaa

SEQ ID NO: 20963 - DNA, 201 bp, Homo sapiens
attgcaccatagaggtccagcctgggcaacaggagtgaaactgctttaaaaaaaatacatatatatatatatatatatatatatatatatatatatatatmtatagagagagagagagagagagagagagagagagagagagagaaagagagagagagagagagagagaacgctaataaaaaatacacatataaaataaaa

SEQ ID NO: 20964 - DNA, 201 bp, Homo sapiens
accatagaggtccagcctgggcaacaggagtgaaactgctttaaaaaaaatacatatatatatatatatatatatatatatatatatatatatatatatakagagagagagagagagagagagagagagagagagagagaaagagagagagagagagagagagaacgctaataaaaaatacacatataaaataaaatgagg

SEQ ID NO: 20965 - DNA, 201 bp, Homo sapiens
ttaaaaaaaatacatatatatatatatatatatatatatatatatatatatatatatatagagagagagagagagagagagagagagagagagagagagaragagagagagagagagagagagaacgctaataaaaaatacacatataaaataaaatgaggtaactatatgtattgatataatatggaatataatattaag

SEQ ID NO: 20966 - DNA, 201 bp, Homo sapiens
ggtgacttctgtaaggccattggctgctaagtgtctcctccacctattcaaacaggccccaggctcctaggatccaggatgtcaggacttcttgtctatcyatccatccatccatccatccatccatccatccatccatccatatttttttgagacggagtcttgctctgccgcccaggctagagtgcagtcgtgtgacgt

SEQ ID NO: 20967 - DNA, 201 bp, Homo sapiens
acttctgtaaggccattggctgctaagtgtctcctccacctattcaaacaggccccaggctcctaggatccaggatgtcaggacttcttgtctatctatcyatccatccatccatccatccatccatccatccatccatatttttttgagacggagtcttgctctgccgcccaggctagagtgcagtcgtgtgacgtaggc

SEQ ID NO: 20968 - DNA, 201 bp, Homo sapiens
atattaaaatactgagtcatctgcaaaggtcagtcaaaagagagactcagctttgcctgcaccagcattttcaggaaagcaactccgtggtcaagaatacrtgacttggaagtaccttttcccagatgttgagttttccttccaacaaatgaattctaatctgtgagagcgaaaagcttgttgatttagactaatcctcat

SEQ ID NO: 20969 - DNA, 201 bp, Homo sapiens
gagatgaaataggagctgaaggcaacctaggttttatttggataaatctttaatacagaaataccattagatatgggaacatattttctttttcttttttytttttgagacgcagtttcgctctgttgccaggctggagtgcagtggcgccatctcagctcactgcaacctccgcctcccaggttcaagctattctcctgc

SEQ ID NO: 20970 - DNA, 201 bp, Homo sapiens
agtgtcatgatcttggctcactgcaacctccacctcccaggttcaagtgattttcctgcctcagtctcccgagtagctgggattacaggcaatcgccactwcacccagctgatttttatatttttagtagaaatggggtttcaccatgttggcccctattttcttattctgttgtctgtaatagatatttaaaatattaca

SEQ ID NO: 20971 - DNA, 201 bp, Homo sapiens
tatgcattaaaacaaaatataggccaggttcagtggctcacgcctataatcctagcactttgggaggccaaggcaggtggatcacttgaggccaggagttygaaaccagcctggccaacatgacaaaaccccacctttactaaaaatacaaaaattagctgggcatggtggtgtgcaactgtagtcccagctacccaggag

SEQ ID NO: 20972 - DNA, 201 bp, Homo sapiens
cccagtgtgttcattttttattttttgagatggatctcactctgtcgcccaggctggagtgcagtggcgcgatctcggctcactgcaacctccgcctcccrggttcaaaagcgtctcctgcctcagcctcccgagtagctgggattacaggcacacggcaccacgcccagctaatttttctgtatttttagtagagacagg

SEQ ID NO: 20973 - DNA, 201 bp, Homo sapiens
gaacactttaattaaatgtctcagcatatttttcaagaagtaatttttcctcttctgaaatgttctaattgtggccgttgtcggtttcttaaagagaagtyccatgaagatgaaacatagaatttaaataaaactcaggttagctttgagttgtgtttctccagctggttctgctagaacgatttctagtttgttttctct

SEQ ID NO: 20974 - DNA, 201 bp, Homo sapiens
ggtttctatcaagttttacaaggaaggaataaactgaaaaagtgaacataattgggagcaacaggaattccgcaggtgaaggactcaccattatcttgtcrctgtcaataatggtgttcaatctgtgtgcaatggttagcacggtgcagtgggcaaatttctcccggatttttttttgtattaactcatcagttctgcaat

SEQ ID NO: 20975 - DNA, 201 bp, Homo sapiens
gaattccgcaggtgaaggactcaccattatcttgtcgctgtcaataatggtgttcaatctgtgtgcaatggttagcacggtgcagtgggcaaatttctccyggatttttttttgtattaactcatcagttctgcaatcaaagaagttaagtttaatttcgtaaagatgcaaaaagtagacttaagacttaaaaagctctac

SEQ ID NO: 20976 - DNA, 201 bp, Homo sapiens
agaagttaagtttaatttcgtaaagatgcaaaaagtagacttaagacttaaaaagctctacttcacaatagagatttaaaaaaaaaagatcatatctattyaatgttttaaaaatcatgttaaaatgttttaggacaatcttattctttaaaaacaagtataaaaatctatgtagtaatttactaattttcataaaacaac

SEQ ID NO: 20977 - DNA, 201 bp, Homo sapiens
tcccccagcacctgaactcccttaccaataaccaacatgacagccaacaagaacccctcttccaggtagggaaggaagtttctcaaaaaatgaagctcatrctcccaatatagagtctgaagaaaaggtgaaaggatctttctggttgagtcaagtttcccaaagcacattttggagacgagtgagtataactcaagggaa

SEQ ID NO: 20978 - DNA, 201 bp, Homo sapiens
gttgagtcaagtttcccaaagcacattttggagacgagtgagtataactcaagggaaaatttaaaaagaaaattactgcaggaagtatggtcctccaaagrtatcatcttataggcactttaccattttggaaggttttttaatcaactggaaaagttaaaaaaatacaaatgcaaacaatgggaaactgtgcctcatttg

SEQ ID NO: 20979 - DNA, 201 bp, Homo sapiens
gattaaatatggtattgatatttggcattagcatgcaaggtaggaaattaaaatccgaagtgtaagatttggctcgtggtgcaaaatgttaccctgaaaaytataggatggaatatgtcagcttagtcaaaccctctccattacaaagaagaggacttgctgagtaatctttttatgaaacatactcacagacctataccc

SEQ ID NO: 20980 - DNA, 201 bp, Homo sapiens
tacaaagaagaggacttgctgagtaatctttttatgaaacatactcacagacctataccccatgtgatggaactgatcaaaagtagatgttagcaaagttyttattagcttttccttctgagttgattttgataatactggtaagtgcaaaaaggtcttttctaagaccggcagccagatttgaagaaataatctcacact

SEQ ID NO: 20981 - DNA, 201 bp, Homo sapiens
agaccatactaagattattttgaagatgtttatctcctaaaattgttggagtataaaatcagtcagtatgtgtagcatttacaatagtgcttggtaccaartaagagatcaatagataatatctattctttttgtttattttgctccttcctggacaatgaaatactgcctattcttttttttttttttttttttttggag

SEQ ID NO: 20982 - DNA, 201 bp, Homo sapiens
aagagatcaatagataatatctattctttttgtttattttgctccttcctggacaatgaaatactgcctattcttttttttttttttttttttttggaggkggattcttgctctgtcacccaggttggagtgcagtggtgcgatctcagctcactgcaatctctgcctcccaggttcaagcgattctcctgcctcagcctc

SEQ ID NO: 20983 - DNA, 201 bp, Homo sapiens
acaaaaattagccaggcatggtggggcttgcctttaatcctagctacctgggaggctgaggcaggagaatcacttgaacccaggaggtagagtttgcagtkagctgagattgcaccactgcactccagcctgggcgacagagcaagactctgtctaaaaaaataaataaataaataaaaataggccaggcgcggtggctca

SEQ ID NO: 20984 - DNA, 201 bp, Homo sapiens
ggagtgccagtggcacaatgttggctcaccacaacctccgcctcccaggttcaagcaattctcctgcctcagcctcctgagtagctggggctacagatgcrcaccaccacgtctggctaattttggtatttttagtagacacagggtttcaccaagttggccaggctggtctggaactcctgacctcgtgatccatccgcc

SEQ ID NO: 20985 - DNA, 201 bp, Homo sapiens
gggaaattttatttttggttttcatcatcatcagtatacacattatagcatatccacatcctcaatgatctcctgggtggtgaacaaagttagttaaaccrctaagctcctcttaatttcctgcaatgctgtaaaggtacatatacacatactgaggctaacagactaaagataattacattttatcaattacctcttgta

SEQ ID NO: 20986 - DNA, 201 bp, Homo sapiens
aatgctgtaaaggtacatatacacatactgaggctaacagactaaagataattacattttatcaattacctcttgtaaggcattccacagttcctcatccrtgtgctcattaaagggatccaggtttttcctcattgttccagtgaacaaaacaggttcctaagtgcccaaaatagtcacggtcattaccacagactcttt

SEQ ID NO: 20987 - DNA, 201 bp, Homo sapiens
cacaattaaatcactcttggaatatcagcctcttcctggatttcaagagagactcttgaacataagcttaggtaggctgtgtgaaagttttcttctggtarctgggtgcggtggcgggcacctgtagtcccagctacttgggaggctgaggcaggagaatcacttggacctgggaggcagaggttgcagtgagccaagatt

SEQ ID NO: 20988 - DNA, 201 bp, Homo sapiens
ctttactagtaactgcatacctacctcttttccctttgaattttgttctcaaaaagaagaaaaaaaaaaaaaaaggaaagaaaatcaggtaataaaaaaaraagtcttaaagagacacactctggttaaccttttcaacttactgaagaaaattcagggagtagaaataccaagatagcagaagtctgagcagtgggctgc

SEQ ID NO: 20989 - DNA, 201 bp, Homo sapiens
tttaccatgttggccataatggtcttgatctcttgacctcgtgatccaccctccttggcctcccaaagtgctgggattacaggcgtgagccaccgtgcccrgcccagtatttgtttcttaaagtgactccaggactggcccctgactatgtatgtcatcatttctgtgccccagttctttcccaggtccttgctgcttaat

SEQ ID NO: 20990 - DNA, 201 bp, Homo sapiens
taagccaggaagagagagaacacagaaactcgtgctccacacaaccccaggaagccatgcaggctagacttgcccaaacatggccattcgaagaaacagcrcttggttctgcttttgctgtgtttgctcccaaacttcctagattccctacatcagtgtgtggtgacacaagccatttggctttccactcacttctgagga

SEQ ID NO: 20991 - DNA, 201 bp, Homo sapiens
actttgggaggctgaggcaggcggatcacaaggtcaggagatcgagaccatcctggccaacatggtgaaactctgtctctactaaaaatacaaagattagstgggtgtggtggcacgcacctgtaatcccagctactcgggaggcagaggcaggagaatcgcttgaacccaggaggcagatattgcagtgagctgagatgg

SEQ ID NO: 20992 - DNA, 201 bp, Homo sapiens
ggaggcagaggcaggagaatcgcttgaacccaggaggcagatattgcagtgagctgagatggcgtcactgcagtccagcctggcaacagagcaagactccrtctcaaaaaaaaaaaaaaaaaaaaaaaaagaaaagaaaaagaaaaagaaaagaaaaacaatgagtaaaatgtctgatgagatatcatgctgtccaacaaa

SEQ ID NO: 20993 - DNA, 201 bp, Homo sapiens
ttgaacccaggaggcagatattgcagtgagctgagatggcgtcactgcagtccagcctggcaacagagcaagactccgtctcaaaaaaaaaaaaaaaaaaraaaaaagaaaagaaaaagaaaaagaaaagaaaaacaatgagtaaaatgtctgatgagatatcatgctgtccaacaaatacttactgaaaaaaaattgagt

SEQ ID NO: 20994 - DNA, 201 bp, Homo sapiens
aaactctgagatcccgcttttaattctttctggaagtggaactgctggatcacgttagctctcattttttgaggaatctctacagtgttttccaaagtggytgcaccattttacattcccaccaacagtgcacagggttccaatttcttcacatcctccaaattacttaagcgtgattccaattgttttagaggtcagtgc

SEQ ID NO: 20995 - DNA, 201 bp, Homo sapiens
agtgcacagggttccaatttcttcacatcctccaaattacttaagcgtgattccaattgttttagaggtcagtgctaggatagccataactgtacttggtstaagataaaaatcacattctccttcccttccggtggcacgttctctatgcttcctactaaacaggcattgaagagttgtttatatccacatgcccagaaa

SEQ ID NO: 20996 - DNA, 201 bp, Homo sapiens
caaattacttaagcgtgattccaattgttttagaggtcagtgctaggatagccataactgtacttggtctaagataaaaatcacattctccttcccttcckgtggcacgttctctatgcttcctactaaacaggcattgaagagttgtttatatccacatgcccagaaagctcattactgcctgggttttgctcttgtctc

SEQ ID NO: 20997 - DNA, 201 bp, Homo sapiens
tctgctcataaaaacatgctctattgggtgaaaaaaaaaacaatcctttcatccaattaaaaaaagcaataagagtaaaagcaattaaacatagtagctcytataaaaggggcaggtaaggacgctatgacttgcatacctgaggtatgattgacatcttcttccttaaatcgtgaagtccaatttcagttgtcaagatct

SEQ ID NO: 20998 - DNA, 201 bp, Homo sapiens
agctcttataaaaggggcaggtaaggacgctatgacttgcatacctgaggtatgattgacatcttcttccttaaatcgtgaagtccaatttcagttgtcargatcttatcaatccaaattttaccttcgggttctgacaatctaaaaagggctgagatgagggaactttttccagctccggttcttcccacaatgccaacc

SEQ ID NO: 20999 - DNA, 201 bp, Homo sapiens
ttgacatcttcttccttaaatcgtgaagtccaatttcagttgtcaagatcttatcaatccaaattttaccttcgggttctgacaatctaaaaagggctgakatgagggaactttttccagctccggttcttcccacaatgccaacctacagagagatccaggcggcaggattaaaaaaaaaaaaaaatcacaggatgcagc

SEQ ID NO: 21000 - DNA, 201 bp, Homo sapiens
aagatcttatcaatccaaattttaccttcgggttctgacaatctaaaaagggctgagatgagggaactttttccagctccggttcttcccacaatgccaayctacagagagatccaggcggcaggattaaaaaaaaaaaaaaatcacaggatgcagcaaaactaggagaaaactttcggtttttgaagaagaattaaggac

SEQ ID NO: 21001 - DNA, 201 bp, Homo sapiens
aatctaaaaagggctgagatgagggaactttttccagctccggttcttcccacaatgccaacctacagagagatccaggcggcaggattaaaaaaaaaaaraaatcacaggatgcagcaaaactaggagaaaactttcggtttttgaagaagaattaaggacattctatattgagtgtagtctaagagtttcccaacctca

SEQ ID NO: 21002 - DNA, 201 bp, Homo sapiens
ggctttagctaattttattaactttggagtcatattctaccttatggtaaatcctagtttatactttataggtgggccattttctgcacataggtacatcygggtgtgtgtgtgtgtgtatatatatatatatatatatatatatatatatatatacacacacacacaccaattgaatttctgagataatttcacagggat

SEQ ID NO: 21003 - DNA, 201 bp, Homo sapiens
tagtttatactttataggtgggccattttctgcacataggtacatccgggtgtgtgtgtgtgtgtatatatatatatatatatatatatatatatatatayacacacacacacaccaattgaatttctgagataatttcacagggatattaattcaagacagaggtgtcacaagtgacataaacaggtattcatttttcca

SEQ ID NO: 21004 - DNA, 201 bp, Homo sapiens
ccttccaaagtctgtttcaaatgtgtaattgccttaaaatcctccacttgtcccctcgtgtggatttctcccacacttaatggctgtcgtaacatcttttytaaacagccataaaatctgcgaattccttctatcttacggagcaggcatttatatactactttgtttcttctactaggcgataggtgctgtgggcagggc

SEQ ID NO: 21005 - DNA, 201 bp, Homo sapiens
aacgtggccaaactaacagaatgatgttgatcaggtaggacctaataacacattgtctgagagtaagcaaacatccccctggccccatcaggaacagaatmtgagaaaccttgctttcagcaagagctacagctgatgctgcctgcagagtggtctccaccttcttcacactcacaaggatgctgggtagataatgaggaa

SEQ ID NO: 21006 - DNA, 201 bp, Homo sapiens
caaagaggcagagatgcttgaactgactgaaaagggtgcacactaagagcaaggcagacaggtgcttggggagaaggagggcaccctgagtgcaggggatrtgtgtccatattgggagttgtgaggagaggggtgggaaggggaagagattctactgtcttgtttgttctggtttagttccttcaagaggctgtcctagtc

SEQ ID NO: 21007 - DNA, 201 bp, Homo sapiens
ggtatccacattccacggttagtttccaagacaggttaacctacgtatcactgatccccttcacacatccacaaggaagacaacaagcagacatagcactmaatcttctgaaattgagaagaggcaagatgctttaaacaaaccttttcttgtgatttaatgagtgctgtcagatgcttcagtaccagaggcccacctgga

SEQ ID NO: 21008 - DNA, 201 bp, Homo sapiens
ttctactaaaaatacaaaaattagccgggcgtggtgctgcatgcctgtaatcccagctactcaggaggctgaggcaggaaaatcgcttgaacccgggaggyggaggttgcagtgagccaagatcgcactattgcactccagcctggggtacaagagcaaaactctgtcccctcacccctaccccccaaaaaagaatctttt

SEQ ID NO: 21009 - DNA, 201 bp, Homo sapiens
agctataaattgtaatcataccatacatagttattcacatctgtacttactttttgccagaatcagggacccaaaggcaacgatgatgacaaacatggcasagatggcatccagacggacggcgaaccagcgggacgttgtcaaaaacaagaaccaagcctctgaatttgagaacggtaataagcatgatgaataagtaga

SEQ ID NO: 21010 - DNA, 201 bp, Homo sapiens
ccatacatagttattcacatctgtacttactttttgccagaatcagggacccaaaggcaacgatgatgacaaacatggcacagatggcatccagacggacrgcgaaccagcgggacgttgtcaaaaacaagaaccaagcctctgaatttgagaacggtaataagcatgatgaataagtagatgaatgtgcgagtgtgtttt

SEQ ID NO: 21011 - DNA, 201 bp, Homo sapiens
aaatcctggtgtgcatcaaacagttcctgacacctctcttctgctttgtatgcccggatggtccagagcccctggagagaagatgacaagtgggaaaacamtggactccgagctggggaaacagacagagaaaacagctcagtgaggctgggtgcagaaaaacctgcggcctcccaagctccatggtcacgtatccaccaa

SEQ ID NO: 21012 - DNA, 201 bp, Homo sapiens
gtgggaaaacactggactccgagctggggaaacagacagagaaaacagctcagtgaggctgggtgcagaaaaacctgcggcctcccaagctccatggtcasgtatccaccaaacagcacacgcaggcctcctaggaggcttcatgtttcaaggaaaaataaatgttcccaatagcctgaggggaccctgccactggaatct

SEQ ID NO: 21013 - DNA, 201 bp, Homo sapiens
agagggagttgccgccctgccccgacctgcccccgttcaagcgattctcctgcctcagccccctaagtagctgggattacagatgtccaccaccacggccrgctaatttttgaatttttagtagagacatggttttgccatcttggccaggctggtcttgaactcctgacttcaggtgatctgcccacctcggcctcccaa

SEQ ID NO: 21014 - DNA, 201 bp, Homo sapiens
gagcctcccacgagtccacagggttctctctattctctatctctggcatccacaatgtctctactaaaaatacaaaaattagccaggtgtggtggcgggcrcctgtagtcccaactactcaggaagctgagacgggagaattgcttgaactcgggaggtggaagttgcggtaagccaagattacggccactgcactccagc

SEQ ID NO: 21015 - DNA, 201 bp, Homo sapiens
tgacgctgtgtaggacctctcagggttattacggttttaattctcaaggctatagcgcctctggtagttcccgtatgttcaaggtttccaagcagtctcargcaaccctcataagtattatatccttgacagagggaaaaacagacttgaggcattaagaacactgcccaaagctgggtgcgatggctcacgcctgtaatc

SEQ ID NO: 21016 - DNA, 201 bp, Homo sapiens
caacctctgcctcctgggttcaagtgattctcctgcctcagcctgccaagtgcaatggcacaatctcagctcactgcaacctccacctcctgggttcaagmgattctcatgtctcagcctcccaagtagctgggattacaggcatgcaccatcacgcccagctaattttgtatttttagcagagatggggtttctccatgt

SEQ ID NO: 21017 - DNA, 201 bp, Homo sapiens
agtagctgggattacaggcatgcaccatcacgcccagctaattttgtatttttagcagagatggggtttctccatgttggtcaggctggtctcgaactctygacctcaagtgatccacccacctcggcctcccaaagtgccaggattacaggtgtgagccaatgcgcccggcccagatttgttattaagattcattaaatg

SEQ ID NO: 21018 - DNA, 201 bp, Homo sapiens
aatgttagagaaattctggaagacagagtctgccgaatttcagggggtctctgtaatttatggcataaatggaaactagctagcatgtctataccaacccragtttccatactcacttgtagattccaggcgcttcacatctcttgacgtttccaaaaaatatcgccgaagaaaaatgaaaatgattccaaggggaaccaa

SEQ ID NO: 21019 - DNA, 201 bp, Homo sapiens
tccaggcgcttcacatctcttgacgtttccaaaaaatatcgccgaagaaaaatgaaaatgattccaaggggaaccaagggtattgcgatccaaggaatcayggccacagccacagagaccacaccaaccacttgtagcaatgtctgaaatagcagaagtagatgcaggttttccttatcaagtattcttttcaaaaatact

SEQ ID NO: 21020 - DNA, 201 bp, Homo sapiens
ccaggcgcttcacatctcttgacgtttccaaaaaatatcgccgaagaaaaatgaaaatgattccaaggggaaccaagggtattgcgatccaaggaatcacrgccacagccacagagaccacaccaaccacttgtagcaatgtctgaaatagcagaagtagatgcaggttttccttatcaagtattcttttcaaaaatactt

SEQ ID NO: 21021 - DNA, 201 bp, Homo sapiens
cttgacgtttccaaaaaatatcgccgaagaaaaatgaaaatgattccaaggggaaccaagggtattgcgatccaaggaatcacggccacagccacagagamcacaccaaccacttgtagcaatgtctgaaatagcagaagtagatgcaggttttccttatcaagtattcttttcaaaaatactttcatgagttgttgttag

SEQ ID NO: 21022 - DNA, 201 bp, Homo sapiens
tattgcgatccaaggaatcacggccacagccacagagaccacaccaaccacttgtagcaatgtctgaaatagcagaagtagatgcaggttttccttatcargtattcttttcaaaaatactttcatgagttgttgttaggattacactcctttctctgaaagacttattgtagtaccagggactgcttttccatacaaagg

SEQ ID NO: 21023 - DNA, 201 bp, Homo sapiens
acatctaaaagtcttacaaaaagatgagttctagacccagaaaacaaaatgacttaagaaaaaaagaagaaccacattttaataaatatataaaacctcargacacaaaatgaaggttgaatacatttcatattcaatatctatatttgaatggtagtgaaaaatataaaatttcccccggcagactcttctagaattaat

SEQ ID NO: 21024 - DNA, 201 bp, Homo sapiens
tctacttatttattttgggaacacatgagactaaaacaaaaaacaaacaaacaacaaacaaacaaaaaactggcagggtgcggtggctcacgcctataatyctaacactttgggaggtcaaggcaggcagattgcctgagctcaacaccagcctgggcaacatggcgaaaccccgtctctactaaaaacacaaaaacttag

SEQ ID NO: 21025 - DNA, 201 bp, Homo sapiens
atgacacaacctatcaaaacctctgggatacagcaaaggcagtactaagaggaaagttcatagccttaaacacctgcattgaaaaagctgaaagagcacaractgacattccaaggtcacacctcaaggaactagagaaacaagaacaaaccaaacccaaacccagcagaagaaaggaaataactaagatcagagcagaac

SEQ ID NO: 21026 - DNA, 201 bp, Homo sapiens
aagaattctacaaatcagtaagaaaaacaaaacaaaaacccagagtactcaatagaaaaattgttaagacacttaaataggtgcttacccaaatgatattyaattggtcaataaacataaaaagatgaaaagtataagagcaaaacaaatgaaaattctataaacaaaaattgaatatcaaaaaaacaacatttagccagg

SEQ ID NO: 21027 - DNA, 201 bp, Homo sapiens
catacatatgtataaatttctttaaaagaccattggttatttaaagcaaaatggacccaatatatcatgaagtttatagcatatgtagaagtaaacaatawgacaacataagcccaaagaatagcagaaataaattatataatagtaagattattctattgtttgcaaatttggtaggaaattatttgaaaatagattgca

SEQ ID NO: 21028 - DNA, 201 bp, Homo sapiens
ctccacagctacagaatatacattcttttttttttttttttttttttttcaaatgcacaggggaccgttaccaaagtaaagtaaatactgggccattaaaraagtctcaatacatttcaaaggttagaaatattacagaatatgttatcgaattacaacaaggctaattagaaatcagtagcagtaaggttttttaaaaaa

SEQ ID NO: 21029 - DNA, 201 bp, Homo sapiens
cactagaatttcattcccatccctttggccatgttcaggcagaggttgggcagtgtatcaatacacaaccataacgctaagagatgatctcctcaggtgcmttgagggtgggaaagggcaaatgtgagaactaatggtaaccagcccatgtgccctagaacaaaaatggctcctgatccatgtttgatacgtgtcccatag

SEQ ID NO: 21030 - DNA, 201 bp, Homo sapiens
tgaatcatggggttgggtttttcccgtggtattctcgtgatagtgaataagtcacatgagatctgatgattttataaacagcagttcccttgaacatgttytcttgcctgccgccatgtaagacatgcctttgctcctccttcaccttccaccatgtgaggcctccccagccacatggaactgtgagtccgttaaatctat

SEQ ID NO: 21031 - DNA, 201 bp, Homo sapiens
gtggctcatgcctgtaatcccaccactttgggaggccgaggtgggtggatcacctgaggttaggagttcgagaccagcctgagcaacatggcaaaaccctrtctctactaaaaatacaaaaattagcttagagtggtggtggtcatctgtaatcacagctactcaggaggctgaggcatgaaaatcgtttgaacctggggg

SEQ ID NO: 21032 - DNA, 201 bp, Homo sapiens
tcctgacattactctcaacgttacctggatgaaatctaaaaacgtcagcggcagcaaatcatccaagtgtccaatgtctttggagaaacgatttaaaattmttcctgcaagaacaggatatgaaaaattactcatttccccagatagaccctttaagagaaacaattcgcaaacaaatcaaaacaatattttaaatgcata

SEQ ID NO: 21033 - DNA, 201 bp, Homo sapiens
gttggagctgcacctcaattttcttgtctcaggcttcggacacacagactccagaaagcatcattcagtgacacctttggcaggcccagtgacaacttttytgagcctctaataacacctcctctagagggttgtcctagggattaaacgggctcatgcctgttaaaaaaaaaaaaaaaagcccaggcacaacgccaggta

SEQ ID NO: 21034 - DNA, 201 bp, Homo sapiens
aaagcccacctcctcacacagctacgccaataactgaactgaatgtcaaagatcagctgaaatcaaaactcttatcaacaatgatctcagtgtagaaagtrtaagattagaaggttcaatagttacttccttgttctaagaaacaattcaaagactggtgtttgcaaaaagaataaaagttttaattttttttttttttga

SEQ ID NO: 21035 - DNA, 201 bp, Homo sapiens
gctgagattacaggcacatgccaccatgaccagctaatttctgtatttttagtagagacggggtttcaccacgttggtcaggctggtctcaagcttctgayctcaggtgatccacccacctcagcctcccaaagtgctgggattacaggtgtgagccatagcacccggccagaatattttcatctggcttcgcagtaaact

SEQ ID NO: 21036 - DNA, 201 bp, Homo sapiens
tgaagttaaagtcacctccggaattctgatacgtctcccatgacgaagacttcccaattcccttataaccgtactacaatttaaaacttgtaagttcccaygtctactgtgagccccattcttttttgtaacaaaaaagtacacttaaatatgaaaatattgaggcatatttgcattgatacatattttacgtctcataaa

SEQ ID NO: 21037 - DNA, 201 bp, Homo sapiens
aggcagaattgcctgaacctgggaggcggaagctgcagtgagccgaaatcacaccactgtactccaggctgggtgacagagtgagacttgatctcaaaaawaaaataaaataaaataaaaaaataataataatataaaggtacatcctaacccagaccattttcttaaggcaccaaatgaggcacacaaacctagaagagt

SEQ ID NO: 21038 - DNA, 201 bp, Homo sapiens
ttaagtacaccaaatatatatatttatatatatttaagtacaccaaatatatatatatatttaagtacaccattaaaaagctaggggggaaatttaaccaytgaatttcttctttaaaaattcagataaaattttaagaactagaaatattactatgattcttataattctacctaagctgtcagttataaacagtttaag

SEQ ID NO: 21039 - DNA, 201 bp, Homo sapiens
aagcctgtcaaaaggcaaacaggaaaggagttaagaaactgtaaataaatctaaacacagtttgtgtttgatctaattttcaagtgtaggattaaaaaaargggaagcatgccaaggaaaggcgacaagaggggacgcacaacaaaaacccgcacaggctccatcacatgggcgccttgttttcagggaagagttgcccag

SEQ ID NO: 21040 - DNA, 201 bp, Homo sapiens
gcctgtcaaaaggcaaacaggaaaggagttaagaaactgtaaataaatctaaacacagtttgtgtttgatctaattttcaagtgtaggattaaaaaaaggrgaagcatgccaaggaaaggcgacaagaggggacgcacaacaaaaacccgcacaggctccatcacatgggcgccttgttttcagggaagagttgcccagcc

SEQ ID NO: 21041 - DNA, 201 bp, Homo sapiens
aagtccctaggaagtgcctgggaacatgcctgccgaacgcccagcctgcccaggcgcacacggctcgccactgccagcatgtgctgctatctcaaaaaggytcccacattcatcacattcgtgcagaaagcacagcatacttcttgacacccagagttgggccagggatagagtagcaggtttatgcaacattttacttta

SEQ ID NO: 21042 - DNA, 201 bp, Homo sapiens
acttgcaggatctgcaatagtgtctgtcaatcattcttgggaaaacccagctgacacgtttgcagttatattcttggcctagtatctatcgatttctatgrctaattttttcatactagttcttcccctttttcctccaaatccatattctgcccgacattttccatcactcacaggttatgtctgctattgtaacctaca

SEQ ID NO: 21043 - DNA, 201 bp, Homo sapiens
cttgcaggatctgcaatagtgtctgtcaatcattcttgggaaaacccagctgacacgtttgcagttatattcttggcctagtatctatcgatttctatggmtaattttttcatactagttcttcccctttttcctccaaatccatattctgcccgacattttccatcactcacaggttatgtctgctattgtaacctacag

SEQ ID NO: 21044 - DNA, 201 bp, Homo sapiens
aataaaaaaaaaaatttttaaatttaacaaaagatcatgagtaaaccagaaaaaaaagaaatagtgatatctaaggtacacacttaagttttagaacaaaraacaaatagatggctagaattaggattagatcttatcatcatactacttgtgaaaagggtatgagtaaaaatcagtgtctcactataaaatatcaagcct

SEQ ID NO: 21045 - DNA, 201 bp, Homo sapiens
cttgccactgcactggacaacagaggagaccccatctccaaaaaaaaaaaaaaaaagagacacatgcacttgtatgtttatcatagcactattcacaatakcaaacacaaggagtcaacttaggtgcccatcaatggtggcctggataaagaaaatgtggtacatatacaccatggaatactacgcagccatagaaaagaa

SEQ ID NO: 21046 - DNA, 201 bp, Homo sapiens
ccaactactcaggagactgaggcaggataattgcttacaccccagaggcggaagttgcagtgagccaagattgcgccactgcactccagcctgagtgacaragcaagactctctcaaaaaaaaaaaaaaaaagaagggaacaacaacagattctgggacctactttatggtaggaggagggcaaggatcaaaaaattacct

SEQ ID NO: 21047 - DNA, 201 bp, Homo sapiens
ttatctatgtttggcttataattcctttaaatgtcttaaaaacataatttatagtttacaagaactaaccagaaatctcattttcttcccaggttgctttwaacatattttgcgcaagaggaagttttaaaatatcagaatgtccatctgatagaaatgtagaaagattgcccagaattaactggagtgatcaaaccacag

SEQ ID NO: 21048 - DNA, 201 bp, Homo sapiens
aacaaaaaaaatactctattgattttcttttgtggcttgttagtcttggtcatttatctatttttctttgcatccaggaaaacacagacacccttcccagwctcctattgtttcatcaaaactagcaaatttggaatttgtacattttttaagactactaaaatttcatcatctcaattagtcaaaaaaatcaatttttag

SEQ ID NO: 21049 - DNA, 201 bp, Homo sapiens
catattattaagagaatccaaaaatataattcttattgtggtgggacaagctaactaaaaagtctctctctccctctcccctacccatcacaacacacacrcacacacacacacacacacacacacacacacacacacacaatcaatgcttcttaagataactgttttgatcaagaggctcttaaatgacaaccaaagttc

SEQ ID NO: 21050 - DNA, 201 bp, Homo sapiens
caaagcactgctgctgatcaaggcgtgtggaattgtatgtggagaaaatatatttaagggtaaatctgcttcaactatattccctgttccaatatcattgkgcggaacacagaaagaactgggtatgctattttttcctccaactcccaaaatctctgaactcttctattatgtgcttcaatcagagtgaggaatgagacc

SEQ ID NO: 21051 - DNA, 201 bp, Homo sapiens
tgctgatcaaggcgtgtggaattgtatgtggagaaaatatatttaagggtaaatctgcttcaactatattccctgttccaatatcattgtgcggaacacaraaagaactgggtatgctattttttcctccaactcccaaaatctctgaactcttctattatgtgcttcaatcagagtgaggaatgagaccagtcactgaag

SEQ ID NO: 21052 - DNA, 201 bp, Homo sapiens
ggagaaaatatatttaagggtaaatctgcttcaactatattccctgttccaatatcattgtgcggaacacagaaagaactgggtatgctattttttcctcyaactcccaaaatctctgaactcttctattatgtgcttcaatcagagtgaggaatgagaccagtcactgaagcaaaagaacatttctataaacttccacct

SEQ ID NO: 21053 - DNA, 201 bp, Homo sapiens
aaaatatatttaagggtaaatctgcttcaactatattccctgttccaatatcattgtgcggaacacagaaagaactgggtatgctattttttcctccaacycccaaaatctctgaactcttctattatgtgcttcaatcagagtgaggaatgagaccagtcactgaagcaaaagaacatttctataaacttccacctgaag

SEQ ID NO: 21054 - DNA, 201 bp, Homo sapiens
aaactacatgccagcagaggtcctccccgtttcctaagttttctaaaacctgggagaatatcaggatgctgagctcataggaaactcccccggggctcttytaagagcttgcttttaataactaagtattcagacatgcttcccagtctttctaccccactcaaagaacactctgcaattcagggggcacaacatcatgcc

SEQ ID NO: 21055 - DNA, 201 bp, Homo sapiens
cagacttacctattggatttctatcaaagaataataccggagctttcagaattgactcaaacattttgttgtgcaaagtttgtgaagagttaacaaggacrtagaataccaatagagatcttgctatgccaaaaagaacggtagctacagttaaacctgaaataaagaaatatcacttagagaacacagcatatctctgca

SEQ ID NO: 21056 - DNA, 201 bp, Homo sapiens
cgagaccagcctggccaacatagtgaaaccctatctctactaaaaatacaaaaattagcctagctgggcatggtggcacatgtgcctgtagtcccagctaytccggaggctgagacaggagaattgcttaaaccccagaggcagaggttgaagtgagccaagatcgcgccactgcactccaacctgggcaacagagcaaaa

SEQ ID NO: 21057 - DNA, 201 bp, Homo sapiens
gagaccagcctggccaacatagtgaaaccctatctctactaaaaatacaaaaattagcctagctgggcatggtggcacatgtgcctgtagtcccagctackccggaggctgagacaggagaattgcttaaaccccagaggcagaggttgaagtgagccaagatcgcgccactgcactccaacctgggcaacagagcaaaac

SEQ ID NO: 21058 - DNA, 201 bp, Homo sapiens
gcgcaaaacaaatgtcattatttacctgagctgcagtgtttaggagaataaggaaaatgaagacaatccagtgagcaccagctctgaagtaattcttatargcctgaaaaccaacttttccttcagaacggttctcctctgatagtgtaactgggacattctctgtctgcagaggaaaaaaggtggtaagagacaaaacag

SEQ ID NO: 21059 - DNA, 201 bp, Homo sapiens
ggatgttcagcacttacctagcacacccaaattcaagtgtcaatacagaaacttgttccaaaatcatatacaaaaagatatggaactctcaactgcatcaytcaagatggaaacataaaagagcagggggtcaaaacatgagctcaacacagtaactggggtcaagcagtgagtctcagtaaccagagtttggaaaggaag

SEQ ID NO: 21060 - DNA, 201 bp, Homo sapiens
ccaaagatccataaggccattaacagtgaacaaaaccaggccatgttgtaacaggaggtgaactcacatcttggctctccagagcaccatctttcaaggarggtctagaagattgttgagaccaaaccgaagactctgagaaggtacgattccttagtgtgggagttcctggaactggaggttgttcactttcctcattat

SEQ ID NO: 21061 - DNA, 201 bp, Homo sapiens
caaagatccataaggccattaacagtgaacaaaaccaggccatgttgtaacaggaggtgaactcacatcttggctctccagagcaccatctttcaaggagrgtctagaagattgttgagaccaaaccgaagactctgagaaggtacgattccttagtgtgggagttcctggaactggaggttgttcactttcctcattatc

SEQ ID NO: 21062 - DNA, 201 bp, Homo sapiens
ccgaagactctgagaaggtacgattccttagtgtgggagttcctggaactggaggttgttcactttcctcattatccttctttaaaagggagccaaaatcyataccagattttaggaactcagtgtaagtccccttctgcaccattttaccctaaaataaaaataaagaatttcagagagatacatgtgcaggtgataatg

SEQ ID NO: 21063 - DNA, 201 bp, Homo sapiens
gttcactttcctcattatccttctttaaaagggagccaaaatctataccagattttaggaactcagtgtaagtccccttctgcaccattttaccctaaaayaaaaataaagaatttcagagagatacatgtgcaggtgataatgttaacctaatctaattctaatccagaaaaagtaactgatcttaagttatgattatac

SEQ ID NO: 21064 - DNA, 201 bp, Homo sapiens
aaattagccgggcatctgtaatcctagctactcgggaggctgaggcaggagaatcacttgaacccagaaggcggaggttgcagtgagcagagatcaagccwctgcactccagcctggatgacaagagcgaaactccatctcataaataaataaataaataaataaataaataaataaataaataattgccccaaagactca

SEQ ID NO: 21065 - DNA, 201 bp, Homo sapiens
gttgctcagttatccaactgtgttgctgctattattattattttttaatttttatttttttgagacagagtctcactctgtagcccaggctggagtgcaayggcatgatctcggctcactacaacctccgcctcccgggttcaagtgattcccctgcctcagcctcctgagtagctgggactacaagtgtgcaccatcatg

SEQ ID NO: 21066 - DNA, 201 bp, Homo sapiens
tgggactacaagtgtgcaccatcatgctgggctaattttttgtatttttagtagagacggggtttcaccgtgttagacaggctggtcttgaactcctgacrtcaggtgatctgcctgcctcggcctcccaaagtgctgggattacaggcctgagtcactgtgcccagccatttctgctattaatagaagaggatctttagc

SEQ ID NO: 21067 - DNA, 201 bp, Homo sapiens
agaaactacttacatctttcaatatcagaatctgacttgcagctttgaggtactgcaactgatgagtcactaaaattgtgatcttctcatgcaaaatttgrcaaatacacctataaatgtaaaaggcacagggtgaaaaaatgcatgaatggggtgctccacattgaaaaacatacattttgaaaccgtagtcaaagacaa

SEQ ID NO: 21068 - DNA, 201 bp, Homo sapiens
gaaaaacatacattttgaaaccgtagtcaaagacaacacagtagtcaaagatctagaggttaaatacaaactaaatacaaatataagccaataaagccggytaggtcctcaaaaccactagcagcaaatacgagccttgctgtggtgaaatcctcaaaagttttctgggaaggaggcaataagtgtaattttttttcctaa

SEQ ID NO: 21069 - DNA, 201 bp, Homo sapiens
gcgccatgccctccgaggagcagaagagaaaggcaggaggtaggatctgtgtctttcatttttctcttttgcccaggcaaactatccctggttgtccaacrgcaggaaaaatacccttacagacaggcagacgtgagaaattcacacctccttccaggcaccccaaagaagtgtgcatggctggaggactggtcttgcatg

SEQ ID NO: 21070 - DNA, 201 bp, Homo sapiens
cattttgcatacgcactctggtgggtaaacgttcaggaacccacgtagagccccatgctcagtggatgacttcatgtccaaacccctggaatccagagccyagagatgagttactctcacacagccgactcgctatccactttgctatccaggacttgttatggactgaaccatgctcccctcaaagttcctatgttccag

SEQ ID NO: 21071 - DNA, 201 bp, Homo sapiens
ggtgagaaggcagccatcagcaggccaagaaagccctcgggaggagctgcacctgcagatgcattgatctcacacatgcagtctccagaactctgcagaawcaacctgccgctgtggaagccccccagcctgtggcattttgtgagggcagccctggctggccaacacaggacttccagagctttctctcacggtaccttc

SEQ ID NO: 21072 - DNA, 201 bp, Homo sapiens
ttccaatctctgctgcccacttcttccatttaaaaaaaaagattgtcgtatgccaggtgtaggggctcacacctgtaatctcagcactccaggaagccgakggcagggggggggggggggggggtggatcccttgagcccaggagttcgagaccagcctgggcaacatagggagaccagcctagacaacatggcaaagccc

SEQ ID NO: 21073 - DNA, 201 bp, Homo sapiens
ctcagtgtctaagcaagagccaaagaaagaaaatcccagaaacaccacgtaagagttgggagggaagccagattctagacaactagtttcaaaggcaagcmaggcctacatgtctgtgggttttaagtgttcactctggtaagaatccatgaagcaacattagattcttgaaaccacagtctactatggagcaaatcattc

SEQ ID NO: 21074 - DNA, 201 bp, Homo sapiens
aaaatttctctaaaatggatcttcagggaagcaggggacagtgtggggaggggagcggacaccagagcaggatgagctgaaagccataaaggctttcctgrgccaactcgaaatggctctggaaaagcagaaatgacttaagacacaaacacactcacagttcgaacaagtgtctgctaacttccgcatctactgcactga

SEQ ID NO: 21075 - DNA, 201 bp, Homo sapiens
tacaaagaggtatcagactctcacccaggaacatgacaactttcaacaactgggatgttcattcaaatgccaacagaataacccaagaaggtgcttcacayaggacgcaatacacagtaagcaggtcctatgtgctcaccaccactggaaggtatcaaaagacaccggcatagtggctgctgaaatgcaacttaccttgca

SEQ ID NO: 21076 - DNA, 201 bp, Homo sapiens
acattgcctgcagtctttataatcctgctgtatctcccccatttaataagaaatgaaacagaggccaaacacccagagacgctcaggaccatttctgtccrgcaggttttgattacacatgcaatctctgtacctacaagccagaataattccagtattgctattctctatggccatctaacacccaccattgacacgtgg

SEQ ID NO: 21077 - DNA, 201 bp, Homo sapiens
atggcgtaccatctttcctatctccggggcctggtccatcagcagtttcttggttatcaactgtaactaccagtgggggaaaactagcaaaatttgccatstgtttctcaactccctaaaacatgatacactccactcactgcaacacactgaaatcaccttgtatattctcctactttgaccctatatttctgcaaaatt

SEQ ID NO: 21078 - DNA, 201 bp, Homo sapiens
acaattacagataaaatacaattgaggccgagggtatgcatcagaagaatctgggttgggggtggagctagcagagggccaggggagagacggagttgaaytggctacaagttgatcgcacttgaacttgagcaatgggtacaggcaggttcaagacacccttctctccacttttgcaaatttttataattgtccattttg

SEQ ID NO: 21079 - DNA, 201 bp, Homo sapiens
gtgtgtttatttactgggaggaccgccttaaagtattaaataacattcaaaggtctttaaaaattaaaaaaaagttaataaaccttgttgttcaagtgaayactagtattactggacattcgagtacatgaaatccaaaagtcatcactcacctttttcagagcacaagcctttatgactttttcatatcgttccttttcg

SEQ ID NO: 21080 - DNA, 201 bp, Homo sapiens
aaagtcatcactcacctttttcagagcacaagcctttatgactttttcatatcgttccttttcgtatttcttcccaaataaaatattactcctcagagttyccgagaacacccagggctgctgagacacataggcaattcttccatgcacgctgaccagcccgtgacttggggccaattccccgagcacggcacttaacag

SEQ ID NO: 21081 - DNA, 201 bp, Homo sapiens
agtcatcactcacctttttcagagcacaagcctttatgactttttcatatcgttccttttcgtatttcttcccaaataaaatattactcctcagagttccygagaacacccagggctgctgagacacataggcaattcttccatgcacgctgaccagcccgtgacttggggccaattccccgagcacggcacttaacagtg

SEQ ID NO: 21082 - DNA, 201 bp, Homo sapiens
ggatgacttgaggccaggagttcgagaccagcctggccaacatggtgaaaccccatctctactaaaactacaaacattagccgggcatggtggcacgcctstaatcccagctacttgggaggctgaggcatgagaatcacttgaacctagggaaatggaggttgcagtgactctagatcacgccactgcactccagcctgg

SEQ ID NO: 21083 - DNA, 201 bp, Homo sapiens
ttaaatgtgtgttcatgtgacttggagaagtcatatcaaaacatgtttaaagcttttcagacaagccttcataacctccagatgtcttgtagcatctaggrtcccctctgacaaaaagaagttcccactttcttagtcaatccatcctgcatagtggtcacataaataatttctttcatggagatgtccaacttctaggag

SEQ ID NO: 21084 - DNA, 201 bp, Homo sapiens
tttcagacaagccttcataacctccagatgtcttgtagcatctagggtcccctctgacaaaaagaagttcccactttcttagtcaatccatcctgcatagkggtcacataaataatttctttcatggagatgtccaacttctaggagttcccaattgctcaacttgaagaaccaagggaaacatgatatgcattgtccaca

SEQ ID NO: 21085 - DNA, 201 bp, Homo sapiens
tgcaaaacgaatgttccatgcactgagaaatgccgtgccaagtgtacccagttcaaaattgtgttacacgtagccttgggctcaaacccacgaagttaatrtgataagtggggttgcaacaagctgccaaaagccattctaactcaccttccctgctcccacggggccgaccacagctaacaattcgccaggtctgacagt

SEQ ID NO: 21086 - DNA, 201 bp, Homo sapiens
aaaacgaatgttccatgcactgagaaatgccgtgccaagtgtacccagttcaaaattgtgttacacgtagccttgggctcaaacccacgaagttaatatgmtaagtggggttgcaacaagctgccaaaagccattctaactcaccttccctgctcccacggggccgaccacagctaacaattcgccaggtctgacagtaaa

SEQ ID NO: 21087 - DNA, 201 bp, Homo sapiens
ttctcctgcctcagcctcccgagtagctgggactacaggcgcctgccactgcgcccagctaattttttgtatttttagtagagacggggtttcaccgtggkctcgatctcctgacctcgtgatccgcccgcctcggcctcccaaagtgctgggattacaggcgtgagccaccgcgcccggcaatattcttaatataatatt

SEQ ID NO: 21088 - DNA, 201 bp, Homo sapiens
ctgggactacaggcgcctgccactgcgcccagctaattttttgtatttttagtagagacggggtttcaccgtggtctcgatctcctgacctcgtgatccgsccgcctcggcctcccaaagtgctgggattacaggcgtgagccaccgcgcccggcaatattcttaatataatattcagtatgggagcttttcaaccatttg

SEQ ID NO: 21089 - DNA, 201 bp, Homo sapiens
tacaggcgcctgccactgcgcccagctaattttttgtatttttagtagagacggggtttcaccgtggtctcgatctcctgacctcgtgatccgcccgcctmggcctcccaaagtgctgggattacaggcgtgagccaccgcgcccggcaatattcttaatataatattcagtatgggagcttttcaaccatttgtaaattt

SEQ ID NO: 21090 - DNA, 201 bp, Homo sapiens
cgcctgccactgcgcccagctaattttttgtatttttagtagagacggggtttcaccgtggtctcgatctcctgacctcgtgatccgcccgcctcggcctyccaaagtgctgggattacaggcgtgagccaccgcgcccggcaatattcttaatataatattcagtatgggagcttttcaaccatttgtaaattttcattc

SEQ ID NO: 21091 - DNA, 201 bp, Homo sapiens
tttttgtatttttagtagagacggggtttcaccgtggtctcgatctcctgacctcgtgatccgcccgcctcggcctcccaaagtgctgggattacaggcgwgagccaccgcgcccggcaatattcttaatataatattcagtatgggagcttttcaaccatttgtaaattttcattctgtcccttggttttaatattctat

SEQ ID NO: 21092 - DNA, 201 bp, Homo sapiens
acggggtttcaccgtggtctcgatctcctgacctcgtgatccgcccgcctcggcctcccaaagtgctgggattacaggcgtgagccaccgcgcccggcaawattcttaatataatattcagtatgggagcttttcaaccatttgtaaattttcattctgtcccttggttttaatattctatttcattaacctccacaaggt

SEQ ID NO: 21093 - DNA, 201 bp, Homo sapiens
agggagtgcaatacttagagccaagggcatgtagagaaaggaagagtctggagtctagagagttttgacatttgtcccacaggggaggacggaggcagtgkggctgggcaggagtgctgctcaaccgcctattggctcttggctccagcaaactacgctacaacgcaaggtcagccacaaagagcacccggagaggggagg

SEQ ID NO: 21094 - DNA, 201 bp, Homo sapiens
caaactacgctacaacgcaaggtcagccacaaagagcacccggagaggggaggagctggtcaccaccagcactgcccacctgttttaagcagcctgagctkttccagtaccctcagaagagaccctcgccctctgctcccaaatcttgctggcagctgggccactgggctctgctcctggcagacatcatctccagccccg

SEQ ID NO: 21095 - DNA, 201 bp, Homo sapiens
gccacaaagagcacccggagaggggaggagctggtcaccaccagcactgcccacctgttttaagcagcctgagctgttccagtaccctcagaagagacccycgccctctgctcccaaatcttgctggcagctgggccactgggctctgctcctggcagacatcatctccagccccggggtgcagcttcctgccgtggctga

SEQ ID NO: 21096 - DNA, 201 bp, Homo sapiens
gctgggattacaggtgtctgccaccatgcctggctaatttttgtatttacactggagacagggtttcaccatgttagccaggctggtctcgaactgctggyctcaagcaatctacccacctcggcctcccaaaatgctgggtttacaggcataagccaccatgctacacctacacttatcttttttccttagtcaatgtcc

SEQ ID NO: 21097 - DNA, 201 bp, Homo sapiens
gttttataggtaatattttttatgaaatacaaacttgctaatcagtagtgggagtctgcctatgaatagccactatgctccagcctgggtaacacagcaakatctcatctttaaaaaacaaacttcatcataaaaaagaatcttagcttttatgacaacacccaccccattctctcccctaccaaaaaaataaaaataaaa

SEQ ID NO: 21098 - DNA, 201 bp, Homo sapiens
accaacctggattcttcggatgctgacgattgcctctgacaccctctcaatggctgaggggaagaagagggtaaccgtcagccgcacagccccatacagcrtcactgccacgaacacgcggctggctgtgatcacactgccgaggagcacgtaggtggtgaaggtcacaaacacgatgattttgcttgcactgaaaaatga

SEQ ID NO: 21099 - DNA, 201 bp, Homo sapiens
cctctgacaccctctcaatggctgaggggaagaagagggtaaccgtcagccgcacagccccatacagcgtcactgccacgaacacgcggctggctgtgatyacactgccgaggagcacgtaggtggtgaaggtcacaaacacgatgattttgcttgcactgaaaaatgaagccaaattcatccctctgaggcaggaacttc

SEQ ID NO: 21100 - DNA, 201 bp, Homo sapiens
aaaccatcaacaagaatagcaaatagaaaaatacaaaaatatggtacaatgtatacaaaaacttactttctcaaattggtaataagatttgaaaatgactyttcccaggcgtacatttttattatccttataccagttataacttcattcatggtcctgatcctggcatccgtgaaagttgcagttttactcctaagggga

SEQ ID NO: 21101 - DNA, 201 bp, Homo sapiens
tcagagagtgctaaaatgggaatgaagtgctggggagcagaaaagaaagggctgtttgttaactccaccgggaaagaggagagcaaaaaaaaaaaaaaaarcttcagaggaccaggagcatttgaacggggcctcaaaggacaaggactatttctccagatggcaaagaggggaaggtccaagtagaaaatacaccataag

SEQ ID NO: 21102 - DNA, 201 bp, Homo sapiens
gatccagctgacaaccttgacaatgaaccatttccaattcgttggaacctgcttcaagtctaatttattttatcatcattaatctcttgatcaaaagctgkatttctttttttttttttttttttttttttttttgagacagagtctcactctgtcacccaggctggagtgcagtggcataatatcggctcactgcaacct

SEQ ID NO: 21103 - DNA, 201 bp, Homo sapiens
tttttttttgagacagagtctcactctgtcacccaggctggagtgcagtggcataatatcggctcactgcaacctctgcctcctggattcaagtgattctygtgcctgagcctcccaagtagctgggattacaggcgtgtaccaccatgcccagctaattttttaaatttagtagagacggagttttgtcatgttggccag

SEQ ID NO: 21104 - DNA, 201 bp, Homo sapiens
atgttaccaaatacatatgacatttttcacagcagtatttctcttacctcagtgatgagaacaacttcccaaaacagctttgcaagggcaggagaatgatyagaactgccatcccagcaaggcacgatattcctatctccatccagagtagggcagtcactgcaatcgcctgcagtggtcctgcccacaggaagtgtaaga

SEQ ID NO: 21105 - DNA, 201 bp, Homo sapiens
tatgacatttttcacagcagtatttctcttacctcagtgatgagaacaacttcccaaaacagctttgcaagggcaggagaatgattagaactgccatcccrgcaaggcacgatattcctatctccatccagagtagggcagtcactgcaatcgcctgcagtggtcctgcccacaggaagtgtaagaacactgtcaccttta

SEQ ID NO: 21106 - DNA, 201 bp, Homo sapiens
ttaatgcaatgaaaaaggatccctgagctgcagcttacctgatcaaacttgttcacatcattggacagcagattgactatctggcctgtggttgtcttccmcatggccatgttactaagacgaagtgcctgaaataaaagaggtaagtagagaattgtattcatgcagtgatactaagtcaggcttaggacacagcagacc

SEQ ID NO: 21107 - DNA, 201 bp, Homo sapiens
atgaaaaaggatccctgagctgcagcttacctgatcaaacttgttcacatcattggacagcagattgactatctggcctgtggttgtcttccccatggccrtgttactaagacgaagtgcctgaaataaaagaggtaagtagagaattgtattcatgcagtgatactaagtcaggcttaggacacagcagacctgaggaag

SEQ ID NO: 21108 - DNA, 201 bp, Homo sapiens
ggaggcctagctaggacagaagtacggagaaggaggatgtgggggctgctgaataaagaacaccccaaacctggctgaagcaggtgaagctcatggaagcrgggctgaaacaggtgaagcttatggaaatggggctgaagcaggtgaagctcatggaagcagggctgaagcaggtgaagcttatggaaggcaatatggaac

SEQ ID NO: 21109 - DNA, 201 bp, Homo sapiens
caggtgtagaggtggaataaaaggctgggcagatactcgggttgtaatagaagttaacccaagtgaacgataactctacagtcaacacagaaattaagggyctgctgaaattaaatcagtcatactccagataggataaaaaaaatcatgaagggccatgaatattattaatgaggaagacatgccaggtgcggtggctca

SEQ ID NO: 21110 - DNA, 201 bp, Homo sapiens
gcttcattaacctgacaggttataaaaggacaccattagattaaatttgttttccctgtgaaaacaaaatagttctaccatgagaacaaataaaaggcaaytaaaacaaactgaaatcaaaacctgtagtacacatcccagacccaaaatatctttaataaatcaacggcccctacatatcgatatgaattataaatgcct

SEQ ID NO: 21111 - DNA, 201 bp, Homo sapiens
acaaatggccaaggaaatgcaaatgctgaaatccactattacacaaagccatgtaaattaaaacaacaatgcattatttttcacctatgaaaattggtgarattgacagtgattattaaaatataacatcaaatctggacttgtagggagctctctcatttcaccggggaaaatgtaagtaattaacaactcttggggagg

SEQ ID NO: 21112 - DNA, 201 bp, Homo sapiens
acaatgcattatttttcacctatgaaaattggtgagattgacagtgattattaaaatataacatcaaatctggacttgtagggagctctctcatttcaccrgggaaaatgtaagtaattaacaactcttggggaggaaatcaatctagcatagcaaaagccttgaaatttgtacgccctaggaaatgaaggatctgtccaa

SEQ ID NO: 21113 - DNA, 201 bp, Homo sapiens
catcaaagggaggtggaaggagagaatgaccttttcatggaactgagttttccagactggtgagatgaatatccctttttggattaaatgcattaatccartcttcattttaacagatgtctttcccccctctctaatagtccttttaaaacagaagatgcggctgggcacggtggctcatgcctgtaatcctagcacttt

SEQ ID NO: 21114 - DNA, 201 bp, Homo sapiens
gcctgtagtcccagctactcaggaggctgaggtggaaagatcgcttgagcccaggagctcaaggctgcagtaagcagtaatcatcccactggaatccagtytgggcaacagagcaaaaccaagaaagaaaagaaaaaaaaagaaaagaaaagaaaagagacagacagatgagagagagagaaagagagatgagagagaaag

SEQ ID NO: 21115 - DNA, 201 bp, Homo sapiens
cagacagatgagagagagagaaagagagatgagagagaaagagagagagaaagaaagaaagaaagaaagaaagaaagaaagaaagaaagaaagaaagaaaraaagagagagtgagaaagaaaggaaggaaggaaaagaaaagaaagggaaaaaaaaccattagcgtttcaatgagtggtggggcagtcaatatacattgaa

SEQ ID NO: 21116 - DNA, 201 bp, Homo sapiens
atgagagagagagaaagagagatgagagagaaagagagagagaaagaaagaaagaaagaaagaaagaaagaaagaaagaaagaaagaaagaaaaaaagagrgagtgagaaagaaaggaaggaaggaaaagaaaagaaagggaaaaaaaaccattagcgtttcaatgagtggtggggcagtcaatatacattgaaggaaatt

SEQ ID NO: 21117 - DNA, 201 bp, Homo sapiens
cacctcccagattcaagagattcacctaccttagcctcccaagtagctgggattacaggcatgcgccatcatgcctggctaatttttttttttttttagtkttagtagagacggggtttcaccatgttgatcaggctggtctcgaaatcctgacctcaagtgatccacctgccttggccttgcaaagtactgggattatag

SEQ ID NO: 21118 - DNA, 201 bp, Homo sapiens
tgtaaagttttttgtttgtttgtttgttttttgagaaagagtctcactctcacccaggctggagtacagtggtgtgatctcagctcactgcaacctctgcytcccgggttcaagcgattctcctgcctcagcctcctgagtaactgggattacaggcgtccgccaccacacccagctaaattttgtatttttagtagagat

SEQ ID NO: 21119 - DNA, 201 bp, Homo sapiens
gtagagatagggtttcaccatgttggccaggctagtctcaaactcctgacttcatgtgatctgcccgccttggcctcccaaagtgttgggattacatgccmccgtgcctggccagtgtaaagtatttttaaaaagagcccaataaacactctagagctgcaatactgaaatgagaaataaaggagaaaagaaaaatcactg

SEQ ID NO: 21120 - DNA, 201 bp, Homo sapiens
tcacatgcctataatcccagctactcgggaggctgagacaggagaatcacttgaacccgggaggcggaggttgcagtgagccgagattgtgccactgcacyccagtctgggtgacagagtgagactctgtctcaaaaaaaaaaagaaaataaagaaatgctaatagatgttttacatgctgaaaaaaaattatatcaaatg

SEQ ID NO: 21121 - DNA, 201 bp, Homo sapiens
aggggatattaaatacaaataaaccttaagcacaaatgaatccagtaagaaactttaaatacaagtgaatccagtaagtcaggatgcaaaaagttcatgaytaaggagaaaaagagactaactctcataaccggagattttaacttctctcccttcttctctccctctcccccactgtctgtctgtctgtctgtctctctc

SEQ ID NO: 21122 - DNA, 201 bp, Homo sapiens
ttaacgcactttagcaaggtttcaggaaacaaagcaaaaatacaaaaatcaattgtatttctatatactaacaacaaacggtaagtgaaaatttaaaataygatttatggccgggcacagtggctcactcctgtaatcccagcactttgggaggccaaggtgggtggatcacctgaggtcaggagttcgagacctgcctgg

SEQ ID NO: 21123 - DNA, 201 bp, Homo sapiens
gctaacaaatataaaaatataaaaatataaaatataaaaatataacaaatgatctttaagacctctatcctaataattacaaggagagttaaagatctagkgcttggcgtgagtggctcatgcctgtaatcccaacactttggcaggctgaaacaggagaatcaattgagctcaggaagatcatcctgggcaacatactga

SEQ ID NO: 21124 - DNA, 201 bp, Homo sapiens
ggctgaaacaggagaatcaattgagctcaggaagatcatcctgggcaacatactgagactccatctccacttaaaaaaaaaaaaaaaaagaaaaagaaatktataaagatgtagataactgaggaataggtaaatacactattttcttagactggaaatctaaataatgttaagatgcccactcttaacattaatagtcag

SEQ ID NO: 21125 - DNA, 201 bp, Homo sapiens
atctaaataatgttaagatgcccactcttaacattaatagtcaggtggatagaattgccctgttggagaattacttctccaacagggcaattacttcatcyggaattacttcatctggaattctaagaccatgtcttagaattcaagatgcataacccaacagtttcctgtaaaacttgaaaagctgattctaaagtcaat

SEQ ID NO: 21126 - DNA, 201 bp, Homo sapiens
accagatggtaggacactcgggctgatgaacagctaccatgcttgaggtttatacctacaagtccgaaggagttattcaccaatgagggggattaaacccrcaacccatatgctatctctgtgaactggaaggtcttagttataaagcataaaattaagctgaacacatatttgaggcctattagtatcacataggagctt

SEQ ID NO: 21127 - DNA, 201 bp, Homo sapiens
atactattcagtctaaatataaagcaatatacagtctacagtgaaataaaaatagctttaaataaaaacaaaagttctgttttaaaactaagaccacaacwctgtatggctcagttgctgacaaaatttgctatcaattgtctgtccacatccactgagaaaacccagagggagacggggtgggaagactgggatgcagcc

SEQ ID NO: 21128 - DNA, 201 bp, Homo sapiens
tactattcagtctaaatataaagcaatatacagtctacagtgaaataaaaatagctttaaataaaaacaaaagttctgttttaaaactaagaccacaacastgtatggctcagttgctgacaaaatttgctatcaattgtctgtccacatccactgagaaaacccagagggagacggggtgggaagactgggatgcagcca

SEQ ID NO: 21129 - DNA, 201 bp, Homo sapiens
acaacactgtatggctcagttgctgacaaaatttgctatcaattgtctgtccacatccactgagaaaacccagagggagacggggtgggaagactgggatscagccagagagctacaggtggctgcaatcttctcaccatcagcgcatgacggtgcatttattttttttacttcaggttctacttattgcatagggcggca

SEQ ID NO: 21130 - DNA, 201 bp, Homo sapiens
gaaaaattaatgatgaaaagcctaaagtaattttaccaaagctgtgaaaaagtaaataaatgacgagtcattttcagacatcctgcaagatcattcaataycaaatgtcgacgacgggctcggcagtcattccatttgcaacagccaacctgatttctgccagaccgggaatcaggatatgggggcctcagtggaaactgc

SEQ ID NO: 21131 - DNA, 201 bp, Homo sapiens
tttatagaaaaacctgagtattcttctcctaaatggtagaagagagtacaggagaataacacagatgatgatgatgctgctgctgctgatgatgatggtgrtggtggtggtggtggtggtggtgatgatgatgaagaccccttgactagtgtgtacaagccttgttatcattttcatgtcacacatgaggaatccgggcat

SEQ ID NO: 21132 - DNA, 201 bp, Homo sapiens
cgcttgaacccgggaggtggaggttgcagtgagcagaggttgcaccactacactccagcctgggcgacagagcaagacttcatctcaaaaaaaaaaaaaawtttaaatggcttaaaaaaacggcccaggacaaagagatatccaggactgatttaatgacaagttctttagctcttgacactagcatctctatggcaactt

SEQ ID NO: 21133 - DNA, 201 bp, Homo sapiens
agtgagcagaggttgcaccactacactccagcctgggcgacagagcaagacttcatctcaaaaaaaaaaaaaaatttaaatggcttaaaaaaacggcccasgacaaagagatatccaggactgatttaatgacaagttctttagctcttgacactagcatctctatggcaacttctcagcaaagcaaccagaaatcccact

SEQ ID NO: 21134 - DNA, 201 bp, Homo sapiens
tgggtttggcatccctggactcaaccaacctggggttgaaaatatttgggggaaacaaaataggtgattgtgtctgtactgaacacacacagatttttttyttgtcactattccctaaacagttatttgtttatagtacctaatacaatgtatatttacattatacaatgtacaattatataatgtacaatttacaatgtg

SEQ ID NO: 21135 - DNA, 201 bp, Homo sapiens
caggctggagtgcagtggctatttatgcagtatttaatttacataaaacttcctcagaatgcttctgatgcttcaggtgaggtacatgtttaatgctgaaygtcacttaccttccgataaatcatatggcacatggctactcgtaacctcatcccagcacactgaacgtgataaaaatataagtgatgcagtatagccaaa

SEQ ID NO: 21136 - DNA, 201 bp, Homo sapiens
tgttcaaagccacagaatccatgggatcataattttcaaaataattaataatttttcccaaaaatatgggctggattactttggcactttcctaaaagaaraaaaagaaaagcctttaattagacatacagaccacaccattttttctttttactttctcttttttcagatattgcttgctctgtcacccatgctggagta

SEQ ID NO: 21137 - DNA, 201 bp, Homo sapiens
gaaataataaccattaagactccagatatacctgaagtcctctctgaatcagtgcagtcctgactgcatgttagaatcacccaggagacttacacgctcamtgatgctcaggacccatcccccacatttagggccaattgatcagggtagggcctgagttccccatccccggaagattctggagtgtagaaaccaatgcct

SEQ ID NO: 21138 - DNA, 201 bp, Homo sapiens
aatcatactcatcaaaatatacagaacaagcaataacaaaaaatccattaactccacaggaaaatgctggagaatcactcattattttgaaaatcggtttwaaaaaaaataacaaaattaatcatttctcctgcctttcctataggtgtactgtaactcagagtatcaaagagttgataatggcaaagtttctctttatgc

SEQ ID NO: 21139 - DNA, 201 bp, Homo sapiens
aagtggcaggtggtacacaccctcacctacaaagtactcttgccaaagggaggaggggggaaaataaaacctgaatcacatcaagcttctagatctaactrctaacttctggtaccagatggacatgttaaatgatacagcatgcaaggatgtagagggtcacaagaggggaggagggatatgcaatgagcccaatctaga

SEQ ID NO: 21140 - DNA, 201 bp, Homo sapiens
aacactaagcttgtgggagtttatattctactgttcaacctcatcgccaaggtctgatctttcacacacaaaaaaaattggcaacctccggcataagtggrttaaaaaaggcctgaaagtcatcacagaagctttttactaaatgctaggttaagtttagagcttccactatccaaaatacgaagatccacaagcagcaca

SEQ ID NO: 21141 - DNA, 201 bp, Homo sapiens
agaccccacctcagacgaaaacataaaaaaaaaaaaagagttcgtggtcaacctgaatgtaccttggtgctctgacctgcccagcaccccagccactctcyagcatgtcacctgactttccggcaccaggacacctaggaacctagggtaatttataatccccaatctgatttcccacagccatgccccactgctccaggg

SEQ ID NO: 21142 - DNA, 201 bp, Homo sapiens
tctcaagacacctttacgacagtctggagatggttaggtccctaagtcagcgctcctgagactgaatctgggctctgtcatttacactttgtgtggccctrggcacattatataactacatggcacccagtgtcctcttcccaaaagtagggttaaaagaatgccttctgactgagcatggtgattcctgcctataatccc

SEQ ID NO: 21143 - DNA, 201 bp, Homo sapiens
tgggaggactgcttgagcccagtaggccaaagctgcagtgagccaagatagcaccactgcactccagcctggcaacagagtgagaccctatctcaaaaaayaaaataaaataaaataacatgaaagaagaaagaaagaaagaaagaaagaaagaaagaaagaaagaaagaaagaaagaaagaaagaaagaaagaaagaaat

SEQ ID NO: 21144 - DNA, 201 bp, Homo sapiens
aaaacaaaataaaataaaataacatgaaagaagaaagaaagaaagaaagaaagaaagaaagaaagaaagaaagaaagaaagaaagaaagaaagaaagaaaraaatcatagcagttcctggtacatagtatttttcaagtactcactgtcagtattattacaactattgctactatcactgctgctgctactactactactg

SEQ ID NO: 21145 - DNA, 201 bp, Homo sapiens
attgcccttctggctgtctttgatttttcatggaatgtccatttatacattctctgcagggccaggcaccaagactctaccttccaaccagcaatccactycgacaacaaggaagacacaccggatgggtgtgatgaatccccttgggtgcacagtcctcggaccttcttcccagaggggattttggctcccagcacctgg

SEQ ID NO: 21146 - DNA, 201 bp, Homo sapiens
aattcatggtatgtaaaagcttttacctcaattaacgtaaaaattcccaaaactaaataagatttccagtaacactttatgattgctcttgttaaagaagscttctgtgcgtcattctcagctcttaaaacttctttatcccagaacctacaatgaggaaaaagcttcgtaaataagagtgaaccctgccacaatataaaa

SEQ ID NO: 21147 - DNA, 201 bp, Homo sapiens
cttaagggtaaacggaggctccagacaggacccaggaaggcaaaacccactccccacacacagacacccacgcttccttaatgcccactttactgcctccracttacccttgcaactcctctccaaggtgctgtgagcggtcttctggcagcactgaatacatatcatcttcctctaatctccgtttatggccaattttaa

SEQ ID NO: 21148 - DNA, 201 bp, Homo sapiens
ccgtttatggccaattttaaacaagggattgagccacctgttaacaagagaaaagagacatatatccagaattacacatccgtgtttaagtagactcctayctccatgggttttgcttaaacttacctttaaaatacatacagctatatatagacagacagatatgaatatatagagctagagagagaaaagttaacatgt

SEQ ID NO: 21149 - DNA, 201 bp, Homo sapiens
gtctcattatattgcccaggctggtctcaaactcctggcctcaagtaatccccccaccttggcctcccaaagtgttgggattataggcatgagccactgcrcctggcctaaagggggttttataaacagaactggtaacactttactttctacctgacactacacacagaatttctcagagtattatatgttttttctaaa

SEQ ID NO: 21150 - DNA, 201 bp, Homo sapiens
gctcaccctctgcccctgcccaagcttaaattttctactcagcacctgtcaacattagaagggctattatatttcactttttttgaaatcatgttttcccmtggaggcatctaggctccacaaggatggggtttttctgtgttgtttgctgctaagccacccacacctacaacatgctgggcacatagaagtcacccagat

SEQ ID NO: 21151 - DNA, 201 bp, Homo sapiens
gcattgttcattgcaactagcaagtgaaggatctgacgactagccagagatgccatactatatagtcagcaaggcccgtgtggccacctgctagatgcagrgctcattgttgccaagatccttctgagcccatcagtgtatgatgttgactatcctctgaaaatcaggccattggccggggactgtggctcacgcctgtaa

SEQ ID NO: 21152 - DNA, 201 bp, Homo sapiens
actatatagtcagcaaggcccgtgtggccacctgctagatgcagagctcattgttgccaagatccttctgagcccatcagtgtatgatgttgactatcctytgaaaatcaggccattggccggggactgtggctcacgcctgtaatcccaacaccttgggagtctgaggcaggaagattgcttgagcccagtagtttgaca

SEQ ID NO: 21153 - DNA, 201 bp, Homo sapiens
agaggttgcagtgagccaagatcatgccattgcactcctgcctgggcaacagagtgagacttcatctcaaaaaaaaaagaaagaaaaagaaaaaaaaagaraatctgcacataagtggactcttgcagttcaaacccttgttgttcaagggtcaactgtgcttcactggggtcaaagaattgctctggaagctgaattaca

SEQ ID NO: 21154 - DNA, 201 bp, Homo sapiens
atagaatttagtcagttatcttgatgctttcccagattgctcaaagtttatctgtccctgggaaataaatatgagtgtctttaatttaagacatgtgtcaygtaactcagcgcacagccatgccccacacataagcctcacttatgtgagcccacacatgcctgcaggagcgccaacatgcctttccaggtgcatttgtcc

SEQ ID NO: 21155 - DNA, 201 bp, Homo sapiens
actcagcgcacagccatgccccacacataagcctcacttatgtgagcccacacatgcctgcaggagcgccaacatgcctttccaggtgcatttgtcccaayaagaaccagatcccatttgtcacaacaagaaccctttctctctacacctttgcctccatcactgtggcccaaggcaccatgaattttcaggaccccaaca

SEQ ID NO: 21156 - DNA, 201 bp, Homo sapiens
gggcccggcctgggggctacattggggcagggtggagaaggaggtaggctgctcagagtcagggactctggagagcaggagctgggtgcagggagacacartgacagatctcacaggaaaacccactctacctcattagaaatgccttcccccggctgggcatggtggctcacgcctgtaatcccggcactttaggaggct

SEQ ID NO: 21157 - DNA, 201 bp, Homo sapiens
atggagaaatcctatctctactaaaaatttagccaggcgtggtggcacatgcctgtaatcccagctactcaggaggctgaagcaggagaatcgcttgaacmagggaagtggaggttgcggtgagctgagatcacgccattgtactccagcctgggcaacaagagtgaaactccgtctcaaaaaaaaaaaaaaggaagaaaa

SEQ ID NO: 21158 - DNA, 201 bp, Homo sapiens
ctcagcctcagcactactggcatttggagctgaaaaactctttgttgggggtgtcgtcccgtgcactgtaggatggttaacagcatccctgaaccccaccytcaagaagccaacagcatccccatcccaagtcctgacaactaaaattatctgaggcattgccagggtggcaaaatcacatggatcagaaccaccgcacta

SEQ ID NO: 21159 - DNA, 201 bp, Homo sapiens
caactgtatatgtatatgtgtgtgtatatatatacacatacacacaaatatataaataatatgtgttgatctgtgtatgcaaatacattctagctttgtcygcttagagttcctagaagcaatgagatcccataacaataaatatgcctaggccgggcacagtggctcacgcctgtaatcccaacactttgggaggccaag

SEQ ID NO: 21160 - DNA, 201 bp, Homo sapiens
gaggcaggagaatcacttgaacccaggaagcagaggttacagtgagccgagatcgtgccactgtactccagcctgggtaacagagactctgtctcaaaaargaaaaaaaaaaaatgcatagtacccagcactctttctaaatatagtatccacttatgaaaaagaatatgtaacttttctttttaatgcagaggctctttt

SEQ ID NO: 21161 - DNA, 201 bp, Homo sapiens
aggcaggagaatcacttgaacccaggaagcagaggttacagtgagccgagatcgtgccactgtactccagcctgggtaacagagactctgtctcaaaaaaraaaaaaaaaaaatgcatagtacccagcactctttctaaatatagtatccacttatgaaaaagaatatgtaacttttctttttaatgcagaggctcttttg

SEQ ID NO: 21162 - DNA, 201 bp, Homo sapiens
ttaaaagtataaaaataaaaggttaacaaggtaaaacatgaaattagccaggtacagtggctcatgcctgtaatcccaacactttgggaggctgaggctcraggactgcttgagtccaggaatttgggcaagtaggaaattactgaacagctgctatcacagacaaatgcctaacattgtgaagtgctacacaggggaagg

SEQ ID NO: 21163 - DNA, 201 bp, Homo sapiens
atttgcgttacctcagccctcaatatcctagcagtccggtatttatgaatgtcacaatgtttgtccaaaaatttcaggaagcggagaacttgtaccaaacstcaaggatacgttgagacactgatctgtaatggaaccttcttggttccttagctttatgttccttttctatttatataacaaacagacattggtcctaac

SEQ ID NO: 21164 - DNA, 201 bp, Homo sapiens
tgcaggctgattaatctctagtacctgagataacttcctcagaggaaatgctccagcatgttctttaagcacatatttttttttttttgagacgaactttygctcttgttgcccaggctggggtgcaatggcacgatctcggctcactgcaacctccacctcctaggttcaagtgattctcctgcctcagcctcctgagta

SEQ ID NO: 21165 - DNA, 201 bp, Homo sapiens
agaggaaatgctccagcatgttctttaagcacatatttttttttttttgagacgaactttcgctcttgttgcccaggctggggtgcaatggcacgatctcrgctcactgcaacctccacctcctaggttcaagtgattctcctgcctcagcctcctgagtagctgggattacaggcacccgccagcacacccggctaattt

SEQ ID NO: 21166 - DNA, 201 bp, Homo sapiens
ggcaggtggatcacctgaggtcaggagtttgagaccagcctggccaacatggtgaaaccctgtctctactaaaaatccaaaaattagccaggtgtggtggygcatgcctgtaatccccgctactcgagaggctgagacaggggaatcgcttgaacccgggaggcagaggttgcagtgagccaagatgtcaccattgcactc

SEQ ID NO: 21167 - DNA, 201 bp, Homo sapiens
tctttcctgtgctgttcttgtgatagtggataagtctcacgagatctgatgggttttttttttggtttggttttttttttttttttttgagacggagtctygctgttgcccaggctggaatgcagtggcgcgatctaggctcactgcaggctccgccccccggggttcacgcgatatctgatgcttttaaaaataagagtt

SEQ ID NO: 21168 - DNA, 201 bp, Homo sapiens
ataagtctcacgagatctgatgggttttttttttggtttggttttttttttttttttttgagacggagtctcgctgttgcccaggctggaatgcagtggcrcgatctaggctcactgcaggctccgccccccggggttcacgcgatatctgatgcttttaaaaataagagtttgcctgcacaagctctctctttgcctgct

SEQ ID NO: 21169 - DNA, 201 bp, Homo sapiens
aagtctcacgagatctgatgggttttttttttggtttggttttttttttttttttttgagacggagtctcgctgttgcccaggctggaatgcagtggcgcratctaggctcactgcaggctccgccccccggggttcacgcgatatctgatgcttttaaaaataagagtttgcctgcacaagctctctctttgcctgctgc

SEQ ID NO: 21170 - DNA, 201 bp, Homo sapiens
gccccccggggttcacgcgatatctgatgcttttaaaaataagagtttgcctgcacaagctctctctttgcctgctgccatccacgtgactttctcctccktgccttctgtcatgattgtgaggtctccccagccacatggaactgtaagtccactaaacctcttcttttgtaaattgcccagtctcaggtatgtctttat

SEQ ID NO: 21171 - DNA, 201 bp, Homo sapiens
gcacagctctgatatgcaaaccaaccaacccagagctatgccgtctttatctagcctgtccaccccaggaagcagtatttcttcacctatatcatgccagrgcctgataacaagcaactagaaaccatgcctgtagcttacagcctgccaaaattattcaaactagccaattctaaactgttcacatgcactcccctgccc

SEQ ID NO: 21172 - DNA, 201 bp, Homo sapiens
gcttatgcctgtaatcccagcactttgggaggccgaggcaggcggatcacttgacgtcaggagttcgagaccagcctggccaacatggtacaaccctgtcwctactaaaaacacaaaaattagccaggtgtggtggtgggtgcctgtaatcccagctactcaggaggctgaagcaggataatcacttgaacccgggaggca

SEQ ID NO: 21173 - DNA, 201 bp, Homo sapiens
aaacacaaaaattagccaggtgtggtggtgggtgcctgtaatcccagctactcaggaggctgaagcaggataatcacttgaacccgggaggcagaggttgyagtgagccgagattgtgccactgcactccagcctgggcaacagagcaagactccgtctcaaaaaataaaataaaacaggttttcattttaatttttaaca

SEQ ID NO: 21174 - DNA, 201 bp, Homo sapiens
accccaggaaaagaaatccatttctgtagcatgctatgctgttggaggcacacgtcacacttcttaattcaaggacagaaaagcacaaactaaaatgcacrctggagtatgactcccccttctctatctgctaaagcgcttcgcatgtgactttcaatctctaagctgggaatcaatcaggcagcccagcctcctatattt

SEQ ID NO: 21175 - DNA, 201 bp, Homo sapiens
agatcacaccactgtactccagcctggacaacagagccactgcactccagcctgggcaacagagagagactccatcttaaaaaaaaaaaaaaaaaatcccygtcttcaaatacaatcacattctgaagtactagagatcaggactccaacatgcgaactttggggggacataattcagcccgtaatatgggtgataaagga

SEQ ID NO: 21176 - DNA, 201 bp, Homo sapiens
gcacgccatcatgcctggctaatttttgtatttttagtagagacagggtttcaccatgttgaccagtctgctctcaaactcctgaccttgtgatctgcccrccttggcctcccaaagtgctgggattacaggtgtgagccaccgtgtccagcctaaagtatgttaaatatgttatgtgtgagagagagaaagagaatatat

SEQ ID NO: 21177 - DNA, 201 bp, Homo sapiens
tctgaggtcgggagttcgagaccagcctgaccaacatagagaaaccccgtctctactaaaaatacaaaaaaattagccgagcgtggtggcatgtgtcgtaygcctgtaatcccagctactggggaggctgaggcaggagaattacttgaacctgggaggcaggttttttgttttttgttttggttttgtttgagattttgg

SEQ ID NO: 21178 - DNA, 201 bp, Homo sapiens
catcatatattgactgtccaggaacaatggatatctgagaatgtaggaaagctaagttaggaccaggaaaaggagagtattaaatgccaaagaagatgccmccaaaggttctggaacagaaagcagcagagctatgccttgtaaagataaagcctgcagtgtattgactgggttggaatctggaatcattgcgtgcctcca

SEQ ID NO: 21179 - DNA, 201 bp, Homo sapiens
ctttaaagaggaagagtacacactgttggactgtatgcactctccgtctctcaagacagtaatctgagggattacttcaatagcagaagttaaaagaagcrgtcagttgggtttattacataatctcaatcacatcctgaccaataaaatgcaccaataaagatcagcaaataaaagcaagtgattagaagagcaatttta

SEQ ID NO: 21180 - DNA, 201 bp, Homo sapiens
gggttcaggatgaactcctgcagcagcgactgctggacacacggactatgtttttttgagatggagtctcgctctgttgcccaggctggagtgcagtggcrtgatcttggctcactgcaacttctgcctcccgggttcaagcaattctcctgcctcagcctctcgagtagctgggactacaggtgcatgccaccacgccca

SEQ ID NO: 21181 - DNA, 201 bp, Homo sapiens
ggatgaactcctgcagcagcgactgctggacacacggactatgtttttttgagatggagtctcgctctgttgcccaggctggagtgcagtggcgtgatctyggctcactgcaacttctgcctcccgggttcaagcaattctcctgcctcagcctctcgagtagctgggactacaggtgcatgccaccacgcccagctaatt

SEQ ID NO: 21182 - DNA, 201 bp, Homo sapiens
gacacacggactatgtttttttgagatggagtctcgctctgttgcccaggctggagtgcagtggcgtgatcttggctcactgcaacttctgcctcccgggytcaagcaattctcctgcctcagcctctcgagtagctgggactacaggtgcatgccaccacgcccagctaatttttgtatttttagtagagacggggtttc

SEQ ID NO: 21183 - DNA, 201 bp, Homo sapiens
ggactatgtttttttgagatggagtctcgctctgttgcccaggctggagtgcagtggcgtgatcttggctcactgcaacttctgcctcccgggttcaagcrattctcctgcctcagcctctcgagtagctgggactacaggtgcatgccaccacgcccagctaatttttgtatttttagtagagacggggtttcattacgt

SEQ ID NO: 21184 - DNA, 201 bp, Homo sapiens
ccgggaggcagaggttgcagtgagccgagatcacgccactgcactctagcctgcaagacagagatagactccgtctcaaaaaagaaaacaagaaaccaagrccatgcctattgtcatgctatagtccccttttgggccatctagggtggtgaacaacaccatacatttactcctagctggactttcaccatcttgcggctc

SEQ ID NO: 21185 - DNA, 201 bp, Homo sapiens
catcttgcggctcggcctcctctcagtcctcctcctctccaggaggcctctttattcagctggagaggcgttgcatggggctggtttttgtgttccagtcktggaagcgagacaccttttgcaaccacttcctattggccaggtctcagtttcatggtcacctctgaccacaaggttggggtagaaaacatagtccaggct

SEQ ID NO: 21186 - DNA, 201 bp, Homo sapiens
gagccatgattgcatcactgcactcccacctgggcaacagagcaagaccctgtctcaaaacacacacacacacacacacacacacacacacacacacaaasacaaaattaaatggccaggaatagtggctcattcctgtaatcccaacgcttgggaaaaccaaggcaggaggactgcttgagcccaggattttgagaccag

SEQ ID NO: 21187 - DNA, 201 bp, Homo sapiens
gaggccgatgcaggtgtatcacctgaggtcaggagttcgagaccagcctggccaacatggtgaaaccctgtctctactaaaaacatgaaaattagccaggyatggtggtgggcacttgtaatcccagctacttgggagtctgaagcaggagaatcacttgaaccctggaggcggaggttgcagtgagccgagatcacacca

SEQ ID NO: 21188 - DNA, 201 bp, Homo sapiens
tggtggtgggcacttgtaatcccagctacttgggagtctgaagcaggagaatcacttgaaccctggaggcggaggttgcagtgagccgagatcacaccacrgccagcctggcaacagagctaaaactctgtctcataaaaaaaaaaaagaaagaaaaaagaaagaaataggtgaaaatactacctttaaaaatccacaatt

SEQ ID NO: 21189 - DNA, 201 bp, Homo sapiens
cacctgaggtcaggagttcaagaccagcctggccaacatggtgcaaccccatctctaccaaaaatacaaaaattagctgggtgtgagggtgcacgcctatrgtcccagctacttgagagactggggcaggagaatcacttgaacccaggaggcagaggttgcagtgagcagagattgcaccactgcactccagcctgggtg

SEQ ID NO: 21190 - DNA, 201 bp, Homo sapiens
ttagtgttagtgtatgattagtgttagtgtattttatgtatggcccaagacaattcttccagtgtggcccagggaacccaaaaaattggagacccccaccmtaggttgtcccataataaaaggcaatatcaacatgtgggaaagatgaggcggcagaggtcaagaaacagaagatctaataatcatccaagtgagattgaa

SEQ ID NO: 21191 - DNA, 201 bp, Homo sapiens
ccctcgcccccagccgcagagggcttgggcagcatcgggcgcggccccgggagagtgcgtccgcggcgccagcggctgcagggtgacctgtttcgggcggrgacactcaccagaagaacacgcgtgagcagaggttcgcgtcctgcagcgggttgggcttcacctcctggtacacgggcagcatcttgccgggcggggcgg

SEQ ID NO: 21192 - DNA, 201 bp, Homo sapiens
catcgggcgcggccccgggagagtgcgtccgcggcgccagcggctgcagggtgacctgtttcgggcggggacactcaccagaagaacacgcgtgagcagakgttcgcgtcctgcagcgggttgggcttcacctcctggtacacgggcagcatcttgccgggcggggcgggcgcgggccggggtcgcgctgatcaggcggcg

SEQ ID NO: 21193 - DNA, 201 bp, Homo sapiens
aacttctctaaaatgtaagatgataccaaataataggacagttctttgccaagcctttgagttcctgaattctaccaatttctagctgaactagaagagakacaggttttctgataaacgtataatcagaacataaaggaaatgaaatgctgtcaagtttctctgttccacaatcatcagtttttagtagctgtatcgtat

SEQ ID NO: 21194 - DNA, 201 bp, Homo sapiens
aagcaaagtaaaagcacgcgacccagtctagttttgaaccagtgtggatttaggaccaaaaccattacatgaatcaaagaaaggtgtgttaaaatggcagraaatataattcatagtggaaacccaagttatgaacatctgtggactgaaaaccatagcatcaaagttaccaaaacaaaaatgacaggtactacaaagaga

SEQ ID NO: 21195 - DNA, 201 bp, Homo sapiens
cgtacctaggaaaacagttctgaggttaagtggcacttagttcttcagttaggccatatttagagtaaatttatcttaagagaatatgctgaacctccaarcaggacacaggttgtttttctacatgtagacattgcagttaattccgtcccatggtatttaatcggacacatttattaagcctcataaagggcattttcc

SEQ ID NO: 21196 - DNA, 201 bp, Homo sapiens
aaaaggctgtgctattggctgaaaggaaaacaggtcacaagtaaccagctaatcctaaaaactacagggaggaagctgtctttaatgtggagatagtggtrcgtattagaaaaaagaggatttctaatttgtctgtcttgctctactgttttgtggcaactgagcaaatgaagattaaattagctgtcattaagactacac

SEQ ID NO: 21197 - DNA, 201 bp, Homo sapiens
aaaaacaagaaccaagcctctgaatttgagaacggtaataagcatgatgaataagtagatgaatgtgcgagtgtgttttgctcagttgagctacagaagakttttacgtggagtagggcaccaaagttgcacacccaaggaacctttagattccagaaagctaagtgatacaggcaatatacgatacacatacacaatggt

SEQ ID NO: 21198 - DNA, 201 bp, Homo sapiens
tggaagttgcggtaagccaagattacggccactgcactccagcctgggtgacagagcgagactatgtctcaaaaaaacaaaaacaagaaaacaaaaagagkactcttcaacacacagagtaaccttttactcgttatttgtgtcagctctctataacctgtaactttgcactgggaaggtggcaggtgacatgaccgcaag

SEQ ID NO: 21199 - DNA, 201 bp, Homo sapiens
aggaaacgtgtgatatcacggtctatggcttcgggaaatatgagtgcaactcaagttagtccctacctactctgaaaccacaacgcttgcttcttgagaargatagaacagtgggggacgtgcagattcacgttatacatgctctgaggcctccaaagttcactgtcttacataaaagtacatgacttcagcagaaagtac

SEQ ID NO: 21200 - DNA, 201 bp, Homo sapiens
taaccagcccatgtgccctagaacaaaaatggctcctgatccatgtttgatacgtgtcccataggtggctggccctttgctgcgatgcacaagcggcactrtcggcttcatgactcaacgcaaatgagagagaacactaagtcaatgaacccagggaaagggctgaaagaaaacaagtgagtcacaaaactcacaagtaga

SEQ ID NO: 21201 - DNA, 201 bp, Homo sapiens
actgtttcctgaggagacccaatctattttcggactgttctgttagacaaggcttgcttacattaaaccgaatcttgccttccgggaacatccaatcgttrctgctgattctgcccttacaaccatacaaagtgaatcgaatttctcttgacagggcagctcttcaactacttgaagaaagttaatcacaagttttccaga

SEQ ID NO: 21202 - DNA, 201 bp, Homo sapiens
gccgtgtgtccctgttcccatcagggggccttccctctcttccatccacctgtcatgaaggtcctcagtccctgcttgcctccacctaccaggatctcagscttcgccctttctcctccatgaaactcttgctgacaaatgtagctctcaggaacctgccactaatgcgagtgcctttatactggaccggctacggataac

SEQ ID NO: 21203 - DNA, 201 bp, Homo sapiens
gcttccccacaggcatcctagaaatacgaacaagaaaatgcttttttttctccttcttcttctttttctaggctccaaactgacagaatattatcactttkgtagactcttgcaaatctgtgcagtggtgttgggcagaaatgtgctgagattataatatccatttatctaaactgccagcatgtaacaaaactcaggtgg

SEQ ID NO: 21204 - DNA, 201 bp, Homo sapiens
gactcacaattcattcactatttcatctaccatttagctatctgcaagagacaccagcacgagcttgagaatcccaccattttaaatggtttctagttttkctcatatttaatttagactcgtaaaagtgaataatgatatcaaaatcagaaaaagttacagaggcataaaaattgtaattttgcaaactcaactaaagtt

SEQ ID NO: 21205 - DNA, 201 bp, Homo sapiens
ggggaaccaatactgaacagcatttttatttttacagaaaaaggaccaattctttccctaagataaagcccttagagtactaatgaaacttttagaagctyaagtctccaagtctgttgctgcctttccacacacaagcacgttacactttaccaattaaaactttactgcaattccactttttaaatgaccagtggtaaa

SEQ ID NO: 21206 - DNA, 201 bp, Homo sapiens
cagtggtcaaattcaaaacaagaagaatgtgccagcttgttcctgtggcagctgtaacccagaaacttgaccctgttacagagaagcatgagggcaagctrtgtagggggtgagcaaaacacccacagccccaggagcccctccagccttggcacctacacagcccatgcccaatggggccgtgagtgctcagaaatagca

SEQ ID NO: 21207 - DNA, 201 bp, Homo sapiens
agaagcatgagggcaagctgtgtagggggtgagcaaaacacccacagccccaggagcccctccagccttggcacctacacagcccatgcccaatggggccrtgagtgctcagaaatagcacgcatatgtatatggtgctacttggcctctacctccaggaaggcaggatctacggacattgtttaaatgcagtttaaatca

SEQ ID NO: 21208 - DNA, 201 bp, Homo sapiens
atccactgccaaagtcagattctgtgtgttgccttgaccatctccaggcctcatctctccttactcttggacagatccacttactcagtcttaccttcagwtctgcttcttccaaaagtctcctcactcatgatgtcaaccactgaaaacctgaagtttcagcgctagcccagggcactcccaccacccaccataactggt

SEQ ID NO: 21209 - DNA, 201 bp, Homo sapiens
actcttggacagatccacttactcagtcttaccttcagttctgcttcttccaaaagtctcctcactcatgatgtcaaccactgaaaacctgaagtttcagygctagcccagggcactcccaccacccaccataactggtacacctacggggctctacgtttcctcaactctggggactatccccagtctctgtattcctta

SEQ ID NO: 21210 - DNA, 201 bp, Homo sapiens
tattaggtgtttgacagtttcatttctttgactggtaaacaacaggagaacttggtctagttccatgaatcacagcttccaaagaaccaatgtacggtttytctcttcaggccatcacgtatcagaaacaaagtccaccaaagtaatctattacaaactgtacttttgaaaaagaaaattggaagcaagagttaaatttaa

SEQ ID NO: 21211 - DNA, 201 bp, Homo sapiens
tctgtgccaagcccaaactcccagatatcaagggttcaagaaaatgcatattccattttaaaatcattgaaagatacccttttttcgcaggtctttgtaayggacatggaacaccagtaggcagccctcactttgttccccaaagacagcacatttcaattcagaccccaagtgaactgcaagatgcagtcataatagcat

SEQ ID NO: 21212 - DNA, 201 bp, Homo sapiens
gatctttagccaaactatgcatgacaattaaagggatacaaacaggtcttagagtctgtaatttccaaataatacaatttgaattaagtcatggaagaggyaaacaaaaagttctaaattaaaacagcatcattttctttaacaatgtagtaaccttgaggtagcaattttacatactttacggtaatatggtttagcatg

SEQ ID NO: 21213 - DNA, 201 bp, Homo sapiens
caaatagaagcgtaattcattcacttttaatacaaaacacttcacatttctaagcttcaacacaaccgccatctttcatagcatattgttcaatccaattktctaactcgttgagaacattctccagttgctgctgagtgatttcctaaattgcattcgtgctccctgccctaagtttccccaaagaatgtgattctgatt

SEQ ID NO: 21214 - DNA, 201 bp, Homo sapiens
gtcatttgctacgatatctctttgaataaataattagcctaaagcaatactgctaaatgtgaattactacttcctatcttattattttatctcaaatatayttttagctcgatgaacttataaatttacttcaactgtatctagtacaatatatctagttgctatcaacatatctgagaaatcttgttagttcctattttt

SEQ ID NO: 21215 - DNA, 201 bp, Homo sapiens
gcactgataccccaaagtctccgtaataatctacaatgtactcagcagttaacccattccatgctgcacccctagtctgtccaatcctataaaatccagcrttgccaatgtccaaacttagtgacatttagtttagaacgaggtaacactttccttggttttttgaaaatgagataaaatacaacttgtcaaatacctaag

SEQ ID NO: 21216 - DNA, 201 bp, Homo sapiens
gagataaaatacaacttgtcaaatacctaagtctgatttcatacctactttctattaattgcaaaacttactcctaattttgagaatctttgtaacatagyttcagtaaataagcaagccatattttataccatgtgtaacacctcaaaattctctattaaatcaatgtcactcattatcttcagcagtcatgatcttgca

SEQ ID NO: 21217 - DNA, 201 bp, Homo sapiens
ctttgagggcccacctcaaagactaatcctgctgggaaccagctcagggtggctgcagctgggaccgaaactgagttatgtacagggcagagatgtgtccyccatcctgcacttacaaacacactcacctgcatgaacactgcactgcacacggggtcagctcttcacagatacatgctacagtcataaacagactgtatg

SEQ ID NO: 21218 - DNA, 201 bp, Homo sapiens
attttagctgaagtgtatgaccaagacatcaaattcagtattctgtatgtgcaggtcagaacagaagttccccaccttcaaaataaaaaactatgcacacrgtaaacctattgagcactggtcaataaacaacagatctgagtggagacagacatgataatagtttagtggttaaatgagactccactcaacacatgaacg

SEQ ID NO: 21219 - DNA, 201 bp, Homo sapiens
ctgagtggagacagacatgataatagtttagtggttaaatgagactccactcaacacatgaacggcttgtaaagatgctggaggggctagctggactttcyctagtcactcaggagggtgaaaaagctgaaatgacattgccaatacagcaatgaggtgcatccccagaaagttcacttggggaagtatcagacggcagaa

SEQ ID NO: 21220 - DNA, 201 bp, Homo sapiens
caacgctttcttaccagtcatgcctggccatttgtttctcctttactgaaaatcactactgctgaactctaggcccaccctcccaccagaaactatgtacmtgaggggaaattaaggtttcctgcccaagtcaaagatgcatcctttatctggacacagagcaccttgccaaagttagccactggaaaatgtaaaattccc

SEQ ID NO: 21221 - DNA, 201 bp, Homo sapiens
atctatctacaggaacaggaatttcaagccttagacacaggtgagttgcattttggtgggaaaaaaataaaaaatcctaaggatttcttccctagctgcawattggaccacaattccctgaaaatcgtctgcaggatccctttcatgccacactctctgatgtgtgacataattcagcagagaacgacagtcatcacttcc

SEQ ID NO: 21222 - DNA, 201 bp, Homo sapiens
tctataaacaaatggcttcaataataaggggaaaatgaggacaaagtcacgtatggagagcccaaaagaagagatgaggattaaagagtgtgtgatgggcygggtgcggtggcttatacctgtaatcccagcactttgggatgccaaggcgggtggatcacttgaggtcaggaattcgagacctgcctggccaacgtggtg

SEQ ID NO: 21223 - DNA, 201 bp, Homo sapiens
tggatactgggcgggtatggtgttcacacctgtaatcccagcactttgggaggccaaggtagcgagaatcgcttgaggccagaatcttgagaccagcctgygcaacaaggcgtgatcccttctctacaaataataaaaaaagaaattagccagcaatccttttgtagttcatgagcatgataatcgggtgttcacgcactt

SEQ ID NO: 21224 - DNA, 201 bp, Homo sapiens
gattgacagtgattattaaaatataacatcaaatctggacttgtagggagctctctcatttcaccggggaaaatgtaagtaattaacaactcttggggagraaatcaatctagcatagcaaaagccttgaaatttgtacgccctaggaaatgaaggatctgtccaaatgtttagctttaatcatgtccattaaaatgctat

SEQ ID NO: 21225 - DNA, 201 bp, Homo sapiens
ccgccttggcctcccaaagtgttgggattacatgccaccgtgcctggccagtgtaaagtatttttaaaaagagcccaataaacactctagagctgcaatastgaaatgagaaataaaggagaaaagaaaaatcactggctggtcttatcagcagtttaaaagcaacagagaagattgaataaaagtgaaaaagactgactg

SEQ ID NO: 21226 - DNA, 201 bp, Homo sapiens
tcttcttttaaattgtggaaagacaactgaataattaaagcataaatattgtatggcggtgaagatgaggggatattaaatacaaataaaccttaagcacwaatgaatccagtaagaaactttaaatacaagtgaatccagtaagtcaggatgcaaaaagttcatgactaaggagaaaaagagactaactctcataaccgg

SEQ ID NO: 21227 - DNA, 201 bp, Homo sapiens
agagactaactctcataaccggagattttaacttctctcccttcttctctccctctcccccactgtctgtctgtctgtctgtctctctctcacacacacayacacacacacacacacacacacacacacacacacagagtatatttgtttttatccaaaggcatgattatctaaatagctatcctaaggaatcagccaaaa

SEQ ID NO: 21228 - DNA, 201 bp, Homo sapiens
cactttcctaaaagaagaaaaagaaaagcctttaattagacatacagaccacaccattttttctttttactttctcttttttcagatattgcttgctctgycacccatgctggagtatagtggcacaatcccagctcacagcagcctcgaactccctaactcaagcaatcctcacacctcagcctcccaagtagctgggac

SEQ ID NO: 21229 - DNA, 201 bp, Homo sapiens
ggacccacaggacattgcttcagtatgtttctgccccctacaagcccggatgtgcccagaagaactgccactttggctcaggtagtgtggagtcaaaaatyaaacacagcagaaattgagctcaaagggaatgtcatcagtggctctctttatcagccatattttgaaggtcctggttttgaagcaatattaataatcatc

SEQ ID NO: 21230 - DNA, 201 bp, Homo sapiens
ggacaagctacctggcagtgtgcctaggcagaacactgtctttctgcagatctcaagagaggcccttcggggtaacagaggttattgcccttctggctgtytttgatttttcatggaatgtccatttatacattctctgcagggccaggcaccaagactctaccttccaaccagcaatccactccgacaacaaggaagaca

SEQ ID NO: 21231 - DNA, 201 bp, Homo sapiens
tcatttatatcctcattctcactttctttacccatttactacaatctatttgtgtagatacaaaaaaatgcacttaattactttgtcactttcccctctaraacaaaagctctctgagggcaggatttttttatggtgttcactgggccagggaccaggcgagccactcaaaactgcggggtgaacgagtgagtgactctc

SEQ ID NO: 21232 - DNA, 201 bp, Homo sapiens
tcagctttgacaaggtagggcctcccacaacgtcagagtgaggttcaggtgcgagtgtgttttgctcagccttaccgcagctctgtcggcctggatgggcrtggggtcccaaataacaccctctaggccatggcttcctttctttcctggccccttccctcaggttgtgagtctttagcccacctagcagactcagggtgt

SEQ ID NO: 21233 - DNA, 201 bp, Homo sapiens
tcgcaccactgcactccagactgggcgacagagcgagactcagtctcaaaaataaataaatacaataaataaataaacaaagtatacaacccacaactcayttttttttctaaccaggaatctcaacaacaggactatagggaaacaagaattattaacctcattaattcaaattaactcttaagcacccaccactaacag

SEQ ID NO: 21234 - DNA, 201 bp, Homo sapiens
agtatgactcccccttctctatctgctaaagcgcttcgcatgtgactttcaatctctaagctgggaatcaatcaggcagcccagcctcctatattttctasttgtattgctttgagcatcaaatttaacctctgtgcacctcaatttcttcagctggagacaaagaaagtggctgcactgtggcagagtgtttgcaaatgt

SEQ ID NO: 21235 - DNA, 201 bp, Homo sapiens
ctcctgaaatacctcaacccaaatcttcaagaaatccccaagtcctcacagtgctttttgtggatttttgtggaaaccggtaaaaggggctgatttgctgrccccagtgggtagaaaacagagactgtcaagagaacagaagagaaggcagaaaggggatggggaagtggggttcgccatgttcacgagctcctggagcca

SEQ ID NO: 21236 - DNA, 201 bp, Homo sapiens
atttactatttggccggccacagtgactcacacctgcaatgtcagcactttgggaggccaaggcgggagaatcacttgaagccaagagtttaagaccaacmtgggcaacacagcgagacctggtctctaccaaaaatgtattaataaaaattactggccaggcacagtggctcgcccccgtaatcccagcactttgggagg

SEQ ID NO: 21237 - DNA, 201 bp, Homo sapiens
catcctttctagcattcagactacgaaagtgttccaagaactttcaacagcaacaatgagctgctaaacgttagcatctacaaaatgaatttgcatagggrtagaagagcagttacatggggacaagccctgcggactgtgaggtcaattggccatgtgtccaatatagctcaactgcatgtatcactgatgatgcccaaa

SEQ ID NO: 21238 - DNA, 201 bp, Homo sapiens
gtgcccaggtgatccaatactccaatacctcttgacttccataaagcagacctccatatgacacgacctctcttgacacttgtggccaagttaatctagcraccacagtgttgattagtggatctgccacaacctagaggacattcctaggacccatcctttctagcattcagactacgaaagtgttccaagaactttcaa

SEQ ID NO: 21239 - DNA, 201 bp, Homo sapiens
agggcaacatggcaaaacttcatctctacaaaaaatataaaaaattagctgggcatgctggcacacacctgtggtcccagctactcagggggctgaggtgsaaggatggcttgagcccaggaggtgaaagttgcagtgaactgagatcgcaccactgcaatccagcctgggtgacagagtgacaccctgtctcaaacaaag

SEQ ID NO: 21240 - DNA, 201 bp, Homo sapiens
caataccagccagggcaacatggcaaaacttcatctctacaaaaaatataaaaaattagctgggcatgctggcacacacctgtggtcccagctactcaggrggctgaggtggaaggatggcttgagcccaggaggtgaaagttgcagtgaactgagatcgcaccactgcaatccagcctgggtgacagagtgacaccctgt

SEQ ID NO: 21241 - DNA, 201 bp, Homo sapiens
gagcccaggagttcaataccagccagggcaacatggcaaaacttcatctctacaaaaaatataaaaaattagctgggcatgctggcacacacctgtggtcycagctactcagggggctgaggtggaaggatggcttgagcccaggaggtgaaagttgcagtgaactgagatcgcaccactgcaatccagcctgggtgacag

SEQ ID NO: 21242 - DNA, 201 bp, Homo sapiens
ctgggtgtggtggcgcgtgcctgtaatcccagctactcgggaggctgaggcacgagaattgcttgaaccagaaggtggaggttgcagtgagccaagatcayaccactgcacgccagcctgggcaacacagtgaaactccatttaaagaaataataataataagataaacttctccatgagccccaaactcatgaccaattg

SEQ ID NO: 21243 - DNA, 201 bp, Homo sapiens
tcaatgcttgcaataattttcagtttgtctcatcacgttagcagagcctattcatgcaatttagaaaggatttcaatacagcccaaaccaaaaggcttacrgtcaacagagggttagccttccataaatgagaaatccaaaaaagaataatgccacgtatttcaggaatgtcggttagaggtttggccttcttgggaagtg

SEQ ID NO: 21244 - DNA, 201 bp, Homo sapiens
acagctactacggtcaatgtattttggcagttagctgtgtgtggtgtgtgctttttaaggcttcactcaataaaacatcggttgctctctgctgatgagcraaaaacttgctatacgaaggacaaatatatgtatacaaacaaatgcacacgtgtgcatgtctatatacatatatgcaatttcagggaggtgacaccttat

SEQ ID NO: 21245 - DNA, 201 bp, Homo sapiens
tagctcaagggggtgggaactacgaggtgactgctgtgtcattttaatgtctctctgggcctgataatttaaaaggactccgcattcctcagatgatgatkattattattttctcactatgaggcctcagactttaaaatccctcaaactggcccaggcacagtggctcatgcctgtaatcccagcatttttggaggccaa

SEQ ID NO: 21246 - DNA, 201 bp, Homo sapiens
tcagactttaaaatccctcaaactggcccaggcacagtggctcatgcctgtaatcccagcatttttggaggccaaggcgggcagatcacctgaggtcaggwgttcaagaccagcctggccaacatggtgcaaccccatctctaccaaaaatacaaaaattagctgggtgtgagggtgcacgcctatagtcccagctacttg

SEQ ID NO: 21247 - DNA, 201 bp, Homo sapiens
cacaaaaaaacaggacacaatataacatcttgccccagacgacggggatagatgatgttgatattaatgtatctttataaaattgtagctataagatgatytgatactacattgggtggtggttcagttcactgatgtttgttttggagaaattttatagaacaagagccaaactcaggtgacatttgagagctatagagg

SEQ ID NO: 21248 - DNA, 201 bp, Homo sapiens
ccagagactgaaatgtgataaacagcaactcaacagatgggaacaacctttaacaagaacacagctaagtgtgaacgaagcgagcggaagcccattctggscaatacaggcctgggaaaaatggaggtgcaaggtgtggggaatagaaggcccagaggatgtggacactgctgatgtgcagatttctgtcttatggtgtcc

SEQ ID NO: 21249 - DNA, 201 bp, Homo sapiens
cagagactgaaatgtgataaacagcaactcaacagatgggaacaacctttaacaagaacacagctaagtgtgaacgaagcgagcggaagcccattctgggsaatacaggcctgggaaaaatggaggtgcaaggtgtggggaatagaaggcccagaggatgtggacactgctgatgtgcagatttctgtcttatggtgtcct

SEQ ID NO: 21250 - DNA, 201 bp, Homo sapiens
cagatttctgtcttatggtgtcctgaatacaagacatccttgtattctaacagcaattctatcaatgttgaacatgattagataatttctccactattccmacatgatataacctagtcttaattgtagatcccagtattaaagtcgttttttaattaacagaaataacgtgctgctgattcattttcttagttgtaccta

SEQ ID NO: 21251 - DNA, 201 bp, Homo sapiens
tttagggtgtgtcacaatttcactattaaacctgtcctgagagtttaggggcacaggattgccttatctttctttacatttgacagttaactgtacccacytcttctctcctagaatttcactgtacagagattcacaaatttaaatgaaatcagaggtcaattgcttatcaagtatcaggaggtgaagtaatcgacctaa

SEQ ID NO: 21252 - DNA, 201 bp, Homo sapiens
agtcacggtcattaccacagactcttttttcattttattccaatgctaacatcaacaatagaattaagataccaaaaaataaaattcatgataataattayagcgttacaaatgcctgtttacaaaacaacatatctattaatgttccactgtacaaagcgtgctccaaaataccttccagaccactgaacactaacaaaa

SEQ ID NO: 21253 - DNA, 201 bp, Homo sapiens
ctggaaaataccgacagcatgattaaagtttgtgcttcaaagccaaattattaagcattttccaatttgcactaaagaataaattaggattattttctccrttggcaaaacagttttccaagattaagaatctctcaccgggcgcagtggctcacgcatgtaatcttagtattttgggaggtcgaggcgggtggatcacct

SEQ ID NO: 21254 - DNA, 201 bp, Homo sapiens
aggctgaggcaagagaatcgcttgaatccaggaggtggaggttgcagtgagccgagatcgtgccattgcactccagcctgggcaacaagagcaaaactccwtctcaaaaaaaaaaaaaaaaaatctctccaatgtcagaatgggacatcctttttttttttttttttttttggccaaaggagatctaaacaactggggcca

SEQ ID NO: 21255 - DNA, 201 bp, Homo sapiens
attgatggtatatattttaaaatgtcatttagtacgagttttaacctccattgttagcaaaaccaatgttctgttcaacgtattattttaaatgaagcacyagatcaaacctgtttttcattagggtttaaaggtcatactttttaaaaatctttgcgccatactgagtagtaattttgtcctcattactcacataagaca

SEQ ID NO: 21256 - DNA, 201 bp, Homo sapiens
agaaacaaaggactgactgcattaggccagaatccaattgtatttctttactagtaactgcatacctacctcttttccctttgaattttgttctcaaaaasaagaaaaaaaaaaaaaaaggaaagaaaatcaggtaataaaaaaagaagtcttaaagagacacactctggttaaccttttcaacttactgaagaaaattca

SEQ ID NO: 21257 - DNA, 201 bp, Homo sapiens
tccagatccttcagttaagcaaactcttgtctgagttatagtatcaccttggtgttctccttgggaagtgcacttaactaccctgtgtcatgaacacaaargaagcatacatttcggctaactattctgtttagggaaattatttaggaagtactttcactgttcgcttcttcctgaaattttgaatacaaattgaggggt

SEQ ID NO: 21258 - DNA, 200 bp, Homo sapiens
ggctgcctgctcgcgaaatgcaaagcattagaggggtactgagagtggtgaggaatgccgctaagaccggggtgggggaaagccagaaaacaaagtgatacctcaccttttgttccttgtgagaaaaacattagatttctctcttaggcttttattgtgcacatttttttttgtttgttgctgcttcactatttaaattt

SEQ ID NO: 21259 - DNA, 201 bp, Homo sapiens
atgtctttagggtatatctgcattatagactgtcaggatttccttccattttaaagctgaataatttcccattgtatggatagaccacgttttattcatcygctcatctggcgatggacacgagctatttccaccttttgggtactgtgatgatcatggatgtacaaaactctgagatcccgcttttaattctttctggaa

SEQ ID NO: 21260 - DNA, 201 bp, Homo sapiens
tagaccacgttttattcatccgctcatctggcgatggacacgagctatttccaccttttgggtactgtgatgatcatggatgtacaaaactctgagatccygcttttaattctttctggaagtggaactgctggatcacgttagctctcattttttgaggaatctctacagtgttttccaaagtggctgcaccattttaca

SEQ ID NO: 21261 - DNA, 201 bp, Homo sapiens
acgagctatttccaccttttgggtactgtgatgatcatggatgtacaaaactctgagatcccgcttttaattctttctggaagtggaactgctggatcacrttagctctcattttttgaggaatctctacagtgttttccaaagtggctgcaccattttacattcccaccaacagtgcacagggttccaatttcttcacat

SEQ ID NO: 21262 - DNA, 201 bp, Homo sapiens
tccaatctctagaacactccttgagagtcacttctgcaaaggagaagaaaagaaaatagaatcagagtccgggaaaggatggccaatttaaccctccaccmtcagagcaaacactcactgggtctgtgtgaaatacaccacacactctcacaatggtgatcgtaaggaagatgaagcagaagtgcagagagatggaattcc

SEQ ID NO: 21263 - DNA, 201 bp, Homo sapiens
taagttttttaactctcacagcccacagtttcacagaaagcccttcatggaggtaatcacctttgagaaggtagctttagttcctacagcaaaattccaayattaagacacttaaaatccacatctccccatagaaacctccccagtgctaaacaaacaatgcatcattttgttctttatggttatcagtggataaaactg

SEQ ID NO: 21264 - DNA, 201 bp, Homo sapiens
tggtgttcactgggccagggaccaggcgagccactcaaaactgcggggtgaacgagtgagtgactctccacccaggctgaagagcagcagcagagaacacycacatctggggcccagcaaccctctttaagcgcctgcaggagaaggggaatgtgcaggtcacttgaggtcagtaaatgattgaacagatgctctagcctc

SEQ ID NO: 21265 - DNA, 201 bp, Homo sapiens
gggaaaactcaggcatatggcagacatgtagctgtcctggggcacgcagtttgcatgtgacagggctgagactagtccagacagcagagttcagagccctsgcaccaacaagcgacaggctctcgggagccagccaggccatcttcccccattagtaaatggggcattatccctttggtgaggtgcctgggtagcattggc

SEQ ID NO: 21266 - DNA, 201 bp, Homo sapiens
attcaacaaatcccctatttgtggatgtttaggctccaatattttgctattgtaaataataccatgttaaatatccttgaagctacatctttgcaagcaaycttaattggtttcttaaaataaattcttagatgtggaattgctgaggaacaggtatgaacattttcaaaggaggctgttaagtgatgccaaactaccctc

SEQ ID NO: 21267 - DNA, 201 bp, Homo sapiens
agatgcctaattcttcatatcaaatcacggcatcgagccttggcatatgccatcgtgcctttcacatgcatttcgacctgctgaaatcctaaccaccttcyaaagtctgtttcaaatgtgtaattgccttaaaatcctccacttgtcccctcgtgtggatttctcccacacttaatggctgtcgtaacatcttttctaaac

SEQ ID NO: 21268 - DNA, 201 bp, Homo sapiens
tctcccacacttaatggctgtcgtaacatcttttctaaacagccataaaatctgcgaattccttctatcttacggagcaggcatttatatactactttgtytcttctactaggcgataggtgctgtgggcagggcctatattggaattagctttgtattatttgtatcacctgtggtgtcctgcaaaaaaaaccagaaatc

SEQ ID NO: 21269 - DNA, 201 bp, Homo sapiens
gctgtcgtaacatcttttctaaacagccataaaatctgcgaattccttctatcttacggagcaggcatttatatactactttgtttcttctactaggcgayaggtgctgtgggcagggcctatattggaattagctttgtattatttgtatcacctgtggtgtcctgcaaaaaaaaccagaaatcccccagagagttaagc

SEQ ID NO: 21270 - DNA, 201 bp, Homo sapiens
taggccctatcacttgcattttgcaaaagagaaaaatcgaggcttagtaagattgattaaactgttgaaatgactgagcccctaagtgatggaatgggackgaaacccaagtctgcctgcctcttgcccattctgccgatggcctcccaatcacttggatagcctggctctgtattcccttggtgtagctagaagggagac

SEQ ID NO: 21271 - DNA, 201 bp, Homo sapiens
ggcaggtggattgcttgaggtcggggttcaagaccagcctgaccaacatggtgaaaccccggatccactaaaaatacaaaaattagccaggcatggcagcrggtgcctgtaatcgcagctactcgggaggctgaggcaggagaatcgcttgaacctgggaggcagaatgagccaagattgcgccactgcactccagcctag

SEQ ID NO: 21272 - DNA, 201 bp, Homo sapiens
cttgaggtcggggttcaagaccagcctgaccaacatggtgaaaccccggatccactaaaaatacaaaaattagccaggcatggcagcgggtgcctgtaatygcagctactcgggaggctgaggcaggagaatcgcttgaacctgggaggcagaatgagccaagattgcgccactgcactccagcctagatgacacagcgag

SEQ ID NO: 21273 - DNA, 201 bp, Homo sapiens
attgcctagtcttgggtatacctttatcagcagtgtgaaaacagactaatacaggaccaaaggatggaggaggagaaaggctggaacagaagctgcagcartggaggggaagagaaggacttgagaaatgcaacaaagtaaaaatcgacagaattagacataggagtgttggtgacacaaagccagagttgacttcctgga

SEQ ID NO: 21274 - DNA, 201 bp, Homo sapiens
gagtatcctgggtcacgttaagctccagccctgaggcccggggcccaccaaccacagtaaagcagttcacagcaggaagaatgttggtatccacattccayggttagtttccaagacaggttaacctacgtatcactgatccccttcacacatccacaaggaagacaacaagcagacatagcactaaatcttctgaaattg

SEQ ID NO: 21275 - DNA, 201 bp, Homo sapiens
catcattgtgtaacaccttcacttacaaccacttccttcaacattaggttaaaagaatgagagaaatgaatgcttagattttatttatccacttctcacayctgtattaaaggcaagaaaattttgtaaaggaaaggaatacttagagccaccaatcaagaatcttttgctggctgggcgcggtggctcatgcctataatc

SEQ ID NO: 21276 - DNA, 201 bp, Homo sapiens
tttatgaattccaacaggatcgacatagatttaattaacagtattacaaacgcaagaaataatgtcattattcagacattcattattatggtttcaaagcycattacattattccactttctacgtgcaatgcaaccacagctggaaaccactaaaaacaaagcaataggttgtaagtgccaatgcttttgagactaaaat

SEQ ID NO: 21277 - DNA, 201 bp, Homo sapiens
ctccttgttccattattaagtattgtaatgcactgttgttactggggtggtgaactcatgccctgcttgtctggtacccatgtggcattgaagataatacyctcctgctgagaatttttctcaacctcatgcaccaggcaactacaaacaatagattcaagtagttggaaggctaacaccctaagttggacaaaatgcttc

SEQ ID NO: 21278 - DNA, 201 bp, Homo sapiens
tacatagttattcacatctgtacttactttttgccagaatcagggacccaaaggcaacgatgatgacaaacatggcacagatggcatccagacggacggcraaccagcgggacgttgtcaaaaacaagaaccaagcctctgaatttgagaacggtaataagcatgatgaataagtagatgaatgtgcgagtgtgttttgct

SEQ ID NO: 21279 - DNA, 201 bp, Homo sapiens
cgtggctttctgtgaggatgcatgcgaatatgaaacccagaaatatgatcctaataaagaactgagaaaagtagtctcataaggacatctcgtacagtgcygagaaatacttatgtgaagtgcatctcatgtgaagtccacccacacacatggttgactggtccagttctccaacagcagagtgcagctcccaatttactt

SEQ ID NO: 21280 - DNA, 201 bp, Homo sapiens
acagtgctgagaaatacttatgtgaagtgcatctcatgtgaagtccacccacacacatggttgactggtccagttctccaacagcagagtgcagctcccawtttacttctcccaccttccatacttaccagaaggcccacacacactgactattgcttaggggctatataaaaatgacctcactaacaggatttgcatgtg

SEQ ID NO: 21281 - DNA, 201 bp, Homo sapiens
acagacctgaatgtaaatcctggtgtgcatcaaacagttcctgacacctctcttctgctttgtatgcccggatggtccagagcccctggagagaagatgayaagtgggaaaacactggactccgagctggggaaacagacagagaaaacagctcagtgaggctgggtgcagaaaaacctgcggcctcccaagctccatggt

SEQ ID NO: 21282 - DNA, 201 bp, Homo sapiens
tagccatctatgtgtctgtccccaccttaaattgctaatttctcaagggtcagctatagccattgcaccctggtaactggatggtacctggcacaggacakgtactcagtaagtgagctgaacagacagactgtcacttccctgcatcctggggaatcttctgtgcccactcatgctggaagaatcctttgtgatctccat

SEQ ID NO: 21283 - DNA, 201 bp, Homo sapiens
ccatggacctgggtgctgcaatgcccttgtgccgtgcccaaggaacctgcccagccaagatgtctctgaatggtcttaacattggctccaggaaccggacrgatgtttttatgactgccccactgcaaacttgtcctgatctctggaggtctctatggcatgtgccattgcttttttcagaatctgactgtggtctcagtg

SEQ ID NO: 21284 - DNA, 201 bp, Homo sapiens
tttttcatagagatgagggtcctcctcctgccttggcctcccaaagtgctgggattacaggcaggtgtgagccaccatttccagcaggccactgtgtttcmagcacaccatttgatgactaccaggacatacctccctcctgcatagcagcggacatgagggctagctacttttgggcagggaggaattcctgagagtttc

SEQ ID NO: 21285 - DNA, 201 bp, Homo sapiens
tcctgagagtttcaattgtctaccatgaatgaggccatactggggcaggtgcatattggggacacgtgacctagcacaatgtctttagcattcttttctgrgataaatgatttgtgctttgcaattagcaaacactgactttgctacctgtgtagctccagagaagaccctgttagtaaaacatggggtgtccgggagaag

SEQ ID NO: 21286 - DNA, 201 bp, Homo sapiens
atgatgagggggtagggtgggggtaaggggcggagggagtggaaaatttaagagaaaaattctaactcattttctgggtcggactcttagtacagcatccmcatgccgatctgtgctacagctgactcaatactggtgtgcccactgtacacacagacactacacatttgggggtgctggggtaccagtgtgccaagacat

SEQ ID NO: 21287 - DNA, 201 bp, Homo sapiens
ctaactcattttctgggtcggactcttagtacagcatccccatgccgatctgtgctacagctgactcaatactggtgtgcccactgtacacacagacactrcacatttgggggtgctggggtaccagtgtgccaagacatggaggttccacatatatcagagtccagagtccacagttccgtaagtgaaggaggaggccgc

SEQ ID NO: 21288 - DNA, 201 bp, Homo sapiens
gagtactcttcaacacacagagtaaccttttactcgttatttgtgtcagctctctataacctgtaactttgcactgggaaggtggcaggtgacatgaccgyaagaggactgagctggtgcttctgtgagaaaggctggatgttctgcacaggtcttttctgcacgcctcagatgttctagcctgcaccctggaacttggtc

SEQ ID NO: 21289 - DNA, 201 bp, Homo sapiens
tttgcactgggaaggtggcaggtgacatgaccgcaagaggactgagctggtgcttctgtgagaaaggctggatgttctgcacaggtcttttctgcacgccycagatgttctagcctgcaccctggaacttggtcaatctggaaacagggtgatattgggaataacacaagagaattccaggccccattaccctacaaagag

SEQ ID NO: 21290 - DNA, 201 bp, Homo sapiens
tgtgagaaaggctggatgttctgcacaggtcttttctgcacgcctcagatgttctagcctgcaccctggaacttggtcaatctggaaacagggtgatattrggaataacacaagagaattccaggccccattaccctacaaagagtttggctcccagtagttcagagaaatcactagaaccatgctcttacctccagagca

SEQ ID NO: 21291 - DNA, 201 bp, Homo sapiens
ctacaaagagtttggctcccagtagttcagagaaatcactagaaccatgctcttacctccagagcaagggagtgttgtgactgaacgcgtccatcatataragaatgccactgagaaggaaggagatgtggcagtcatggggacagagtcctggaatgaaattcttcaacatagctattgtcatttgctttcctcatcagg

SEQ ID NO: 21292 - DNA, 201 bp, Homo sapiens
gggaggtctgcaaagacaactaactagtaccgagggagagcgtatgtcaagcctcagctctaacgtactagtcagcagtttccagctgacacaacctgccrtttcacaagatcaatagctgtgttttccacaacacagagaactctttaggatacactctacagagattttctgtcttctctgaaaagaacatgaaaagga

SEQ ID NO: 21293 - DNA, 201 bp, Homo sapiens
ggtctgcaaagacaactaactagtaccgagggagagcgtatgtcaagcctcagctctaacgtactagtcagcagtttccagctgacacaacctgccgtttsacaagatcaatagctgtgttttccacaacacagagaactctttaggatacactctacagagattttctgtcttctctgaaaagaacatgaaaaggaactg

SEQ ID NO: 21294 - DNA, 201 bp, Homo sapiens
ggttttaattctcaaggctatagcgcctctggtagttcccgtatgttcaaggtttccaagcagtctcaggcaaccctcataagtattatatccttgacagwgggaaaaacagacttgaggcattaagaacactgcccaaagctgggtgcgatggctcacgcctgtaatcccagcactttgggaggctgaggcgggtggatc

SEQ ID NO: 21295 - DNA, 201 bp, Homo sapiens
cactgcactctagcctgggcaacagagtgagactatgtctcaaaaaaacaaaaacaagaaaacaaaaaaaacactgcccaaggttaagtaaagtaagccaygcaagtggtagacttgggcatggactcatatctgttttatttccaaggctgtgcttttaatctgagccacagtatcagagagagagaataatcagagtta

SEQ ID NO: 21296 - DNA, 201 bp, Homo sapiens
catcctgagggcatttttctccagactttgtagcccacgctttaaaaatcccctaatcttacttagctaatatccaacagccttccctattcctgtgccgsttattaaccaccttgcattgaacaaagtccctgggaatctaggatgaacgaacatgggacacatgggttcacactcatggcagacattgctagtggatca

SEQ ID NO: 21297 - DNA, 201 bp, Homo sapiens
agtaaatagttccaaccaaccagcccccgtggttggtgatctgagcgcatggagaaagaatcctgcatatttaactcattgttacagccaatcagggtacrggaacacccaaatatgcctcaggggccatgataaggttgtcagaatctccacatgaaaatgttttcaagctttaaggtacatgctgaaattcaagagaga

SEQ ID NO: 21298 - DNA, 201 bp, Homo sapiens
cttcctagccattttgtgagtttgcaaaagtcataaatttaccaaatacattgcttctgacacctcttttcctttctccatccttctcatttccttgtcayttttagtatcttcggggaaagatgctaaaataccctaattattttccttctatattagtttcaccatgatcaaatattttatttctaagaaaaatgttta

SEQ ID NO: 21299 - DNA, 201 bp, Homo sapiens
caaaagtcataaatttaccaaatacattgcttctgacacctcttttcctttctccatccttctcatttccttgtcacttttagtatcttcggggaaagatrctaaaataccctaattattttccttctatattagtttcaccatgatcaaatattttatttctaagaaaaatgtttaattaagtgccggctttgtgtaaga

SEQ ID NO: 21300 - DNA, 201 bp, Homo sapiens
gccacagccacagagaccacaccaaccacttgtagcaatgtctgaaatagcagaagtagatgcaggttttccttatcaagtattcttttcaaaaatacttkcatgagttgttgttaggattacactcctttctctgaaagacttattgtagtaccagggactgcttttccatacaaaggaataacaaaagtataggtggtc

SEQ ID NO: 21301 - DNA, 201 bp, Homo sapiens
ctcagaaaaaaaggaaataatttaaatcttcacctttggaagtggggagtcatctctcttggtatctatcctttgctaacatttactgaatgctgattgtrtatctggctgtatattaaatacacatgtatcaactcacttaaatctcacaatatccctatgaagtagtattactacaccattttacagatggagacactg

SEQ ID NO: 21302 - DNA, 201 bp, Homo sapiens
acagagctgaggagcatgcattgtcagccactacattttagcttgtccccagcatacggctagctttttattggtcaggataaaatccctgaatttttctytaatttttcccctaaacacacttacataagaaattagagttcattaacatgcccaataaagaatagataagagaaatgtaattaaattttacatgtttta

SEQ ID NO: 21303 - DNA, 201 bp, Homo sapiens
ttgtcttctatttctcttacatttagtagcactgaggaagaggtttgataacaagaaaacaagtcaaaatgtctaacagggttttttttttagctttaacmcttggatatgcattaaattttccacgattaggagagtatttcaaacgtctatttcagaggcacatgataacaatagcaaatgacatgtatgagcacgtgc

SEQ ID NO: 21304 - DNA, 201 bp, Homo sapiens
accttggtctaaaaggtgaaatataaaaacaaaagcaagaagcataaaaacccaagacactggatgatgctcatttcagtattcatctttattaggaaacrtgtgatatcacggtctatggcttcgggaaatatgagtgcaactcaagttagtccctacctactctgaaaccacaacgcttgcttcttgagaaggatagaa

SEQ ID NO: 21305 - DNA, 201 bp, Homo sapiens
taatcactgcaagatactatatcctacacacgattcatattttttaaagcatttaataccgaaatatatctgtattttttatatttttgttttctgaattytctagtttttaaggttattgtgtgtgtgtgtgtgtgtgtgtgtgtgtgtgtgtgtggttatatctggtctctcagtgaggtgaccaatcccagctcccag

SEQ ID NO: 21306 - DNA, 201 bp, Homo sapiens
tagaatcttctatctgttgaaaagatcattaaaaacaaagttgaaataaagacatgctcagatgggcaaaagctaggagaaggtctctagcagaccagccygaaaggaagttcttcaggcttaaggaaaatgataccagatggaagctcagacttcagaaagaaataaagagcactggaaaggacaaatatgtgaataaat

SEQ ID NO: 21307 - DNA, 201 bp, Homo sapiens
aaataaaataagaacatatattctattcactgcaaagaaggaaaagaacatatgagactaacagaagacaaataccaagatggtagacttaaaaccaaccrtatctataattacattaaatgtacatggatgaaactccacataaaatgacagagaatttcagctgagcatttaaaaagccagacctaattagatgctgct

SEQ ID NO: 21308 - DNA, 201 bp, Homo sapiens
gtaaatactgggccattaaagaagtctcaatacatttcaaaggttagaaatattacagaatatgttatcgaattacaacaaggctaattagaaatcagtarcagtaaggttttttaaaaaaaaaaaatccctaaatctttagaaatgaagttatatactccataataactcactactaaaatattacttcagaaagtcaac

SEQ ID NO: 21309 - DNA, 201 bp, Homo sapiens
acagagaaaattacaaaatcaaacatgaattcactggaaaaaaaatcaaaattgataaactccaagctaaactgattgacagaaacaaattatcagtgtcrggaataaaagaagaaatttcactatagattataaagacattaaatggacaaatgtgagattatgaacagtttcatgcaaaaagttctccagtgaagacga

SEQ ID NO: 21310 - DNA, 201 bp, Homo sapiens
aagggcaaatgtgagaactaatggtaaccagcccatgtgccctagaacaaaaatggctcctgatccatgtttgatacgtgtcccataggtggctggccctytgctgcgatgcacaagcggcactatcggcttcatgactcaacgcaaatgagagagaacactaagtcaatgaacccagggaaagggctgaaagaaaacaag

SEQ ID NO: 21311 - DNA, 201 bp, Homo sapiens
aaatgtgagaactaatggtaaccagcccatgtgccctagaacaaaaatggctcctgatccatgtttgatacgtgtcccataggtggctggccctttgctgygatgcacaagcggcactatcggcttcatgactcaacgcaaatgagagagaacactaagtcaatgaacccagggaaagggctgaaagaaaacaagtgagtc

SEQ ID NO: 21312 - DNA, 201 bp, Homo sapiens
catgtgccctagaacaaaaatggctcctgatccatgtttgatacgtgtcccataggtggctggccctttgctgcgatgcacaagcggcactatcggcttcrtgactcaacgcaaatgagagagaacactaagtcaatgaacccagggaaagggctgaaagaaaacaagtgagtcacaaaactcacaagtagaacagattac

SEQ ID NO: 21313 - DNA, 201 bp, Homo sapiens
acttacccatgccccacatcagatggaagtgatacatccatatagaaaatagtgactgcaagattttaataaaactcaggcaagttctccagtccaaacckttttttgttcatcttatcaagaaaactcagtaggtatacagacaaaaatgaatgtaatcaatcaagaatagcatagagagaatttaaaggtcctcaatta

SEQ ID NO: 21314 - DNA, 201 bp, Homo sapiens
aaacttgtccaaaccagtatcctttcttgttttcctgatgctggtacaaccccatctttctgacagtctcccattcctctccatatccttccacccaaatstctaaactctacattcctgtgcttaagaaacaagccttcttgtgatctggcccctctgcatctctccatctgatctcctctaatgccttgtctcaaacct

SEQ ID NO: 21315 - DNA, 201 bp, Homo sapiens
accagtatcctttcttgttttcctgatgctggtacaaccccatctttctgacagtctcccattcctctccatatccttccacccaaatgtctaaactctamattcctgtgcttaagaaacaagccttcttgtgatctggcccctctgcatctctccatctgatctcctctaatgccttgtctcaaacctcctgatgcagct

SEQ ID NO: 21316 - DNA, 201 bp, Homo sapiens
accggcctcgctgattttcagtaaagcccatcaactgggaataacgtctctaaaggagagagatgcatgtgcacacatcacacatccttgtttaaccttamaattacaagatgagctgccacttagctgctcaaagaccttagaggggttcagctctctataggttcaactatgaattccatacacaagtttacaaggctg

SEQ ID NO: 21317 - DNA, 201 bp, Homo sapiens
gataaagatataggctgggcatggtggctcactcctgtaatcccagcactttgggaggctgaggtgagtggatcacctgaggtcaggagttcgagaccagyctggccaacatggtgaaaccctgtatctaccaaatatctaccaaaaaataaaattagccaggcgtggtagtacacacctgttgtcccagccactgtggag

SEQ ID NO: 21318 - DNA, 201 bp, Homo sapiens
tacaaatattttattgaagtccaaaaatcaaagttaggttaattgcctctatctggccagcaaatctggtcacatgtaaaccagaatttccttatctcagygatttcatcgggagagtaataaaatctgtgcatggtttcagacttgcttctacagagcctacattctagacaccaagccacaagcagagggttctcctct

SEQ ID NO: 21319 - DNA, 201 bp, Homo sapiens
ttgttggcctttatttgagggcaggttaaatgcatttttttgggtgggtggctttaataaaaattttcacttcctaatatagcaacaggcccaaatacttyaaaatgatcctggcgatacctcagtcaaaagcccactcatcgaatgcaaatccccgggagaaaggctcggcacacaaagtaagatgaaccagttactgca

SEQ ID NO: 21320 - DNA, 201 bp, Homo sapiens
aacgagactagaattttccctcctcatgcttctaagaaatgttttatattgacatcaagtagcatccatccctctccctccatatgtgagacaaagcacayaagggatactaattacgaccgctcactctgctaagcacatagtgggccagccagcttcggaaactcaacctttgcctagcttcctgttgcaaagaaacag

SEQ ID NO: 21321 - DNA, 201 bp, Homo sapiens
tttcttttacaaacatggccctttattaagttaacattacacacagccaggccgagagtcccacccccagaccccatgaaaagggcttgaaaaaataggarcttccgttttccatttgagatcctgacattactctcaacgttacctggatgaaatctaaaaacgtcagcggcagcaaatcatccaagtgtccaatgtctt

SEQ ID NO: 21322 - DNA, 201 bp, Homo sapiens
ttccccagatagaccctttaagagaaacaattcgcaaacaaatcaaaacaatattttaaatgcatatgtatttaatatattattcatatgaaataagccgmtgtcagtggtaaagaaaaagaaaataggacgatacctaaagagaaacaaaaatatcatcaaatggcagcgggcagggagttgaaatgtggccctgatttt

SEQ ID NO: 21323 - DNA, 201 bp, Homo sapiens
aattcccttataaccgtactacaatttaaaacttgtaagttcccatgtctactgtgagccccattcttttttgtaacaaaaaagtacacttaaatatgaaratattgaggcatatttgcattgatacatattttacgtctcataaaactcatccatttcaggtatccaattcaatgaattttagtaactttactgagtgat

SEQ ID NO: 21324 - DNA, 201 bp, Homo sapiens
gattatagagcttaaatgggtgcgaaggatccccagggctgataacattcaaactttatggggtttttttttgtttttttttttttgagaaaaggtctcamtctgttgcccaggtcaaggctcactggagccttgacctccctgggctcaactgatcctcctgcctcagcctcccaagtagctgggacctctggtgcacca

SEQ ID NO: 21325 - DNA, 201 bp, Homo sapiens
acttataaaaacccaaatggcttcaaggcaaaaggcaacctcatcatctgttttccacatccagcttcaagttttccttcctctgggtaacaataatctcytactttggactcattcctttcctgctgctcacccatcaggtaagacacctataatcactcatcagaacctgctaattggaattaaaattttacttgtttc

SEQ ID NO: 21326 - DNA, 201 bp, Homo sapiens
ttttactgctccagtatcctgtcactgtcgtttgcggctaaatgctcatggaatatctccaaaagaatgactattggaggggtaaaaacaagggcctagamataccaagcggtctacaagaatgtgttcccacagagatggtggcagcaacgcatatttatacagcattcacctagacaaggaatttccacttccacaaag

SEQ ID NO: 21327 - DNA, 201 bp, Homo sapiens
atcctgtcactgtcgtttgcggctaaatgctcatggaatatctccaaaagaatgactattggaggggtaaaaacaagggcctagacataccaagcggtctmcaagaatgtgttcccacagagatggtggcagcaacgcatatttatacagcattcacctagacaaggaatttccacttccacaaaggcaactatcaaattc

SEQ ID NO: 21328 - DNA, 201 bp, Homo sapiens
ctgctaccctgcccatctgctaagcacaggtggtctccccttgcatctagaggctccacctctcagaactctatcccctcagtggtgatctcatgcccttrtggtgccattctctaaggatagtgactcccaaaccagactgtgcaatcattgactttcttctgccttactcctactgtgccatgcatcctgctggctgac

SEQ ID NO: 21329 - DNA, 201 bp, Homo sapiens
aggctccacctctcagaactctatcccctcagtggtgatctcatgcccttgtggtgccattctctaaggatagtgactcccaaaccagactgtgcaatcaytgactttcttctgccttactcctactgtgccatgcatcctgctggctgacctcttctccatgtatgggaatgcgtaacatgtttcaattgtgaactgaag

SEQ ID NO: 21330 - DNA, 201 bp, Homo sapiens
catttgtagaagaaaaatgtttcatgaaaaaaaatttttaaagatgattcagcttccttcccaaattaaatttattataatagagcaaagctatatattayatgacattgctttcaagaaaaacttaagaatcttaacagaaaacaggccaggcgcagtggctcacacctgtaattccagcactttgcgaggccaaggcgg

SEQ ID NO: 21331 - DNA, 201 bp, Homo sapiens
tgttggcagggatgtgaaggaattagaattcttgtatatagttgggggatcataaaaatggtccaggtgcaatgaaaaaaaaaatatgacaggtccccaarttatgaaacacacaattaccgcatgatccagcaattccacctctacatatatacacaacagaagagactacgggggtctaaaagagatatgcgcacactc

SEQ ID NO: 21332 - DNA, 201 bp, Homo sapiens
tccccaaattatgaaacacacaattaccgcatgatccagcaattccacctctacatatatacacaacagaagagactacgggggtctaaaagagatatgcrcacactcatgttcacagcagcactatgcacaatagtcaaagcgcagaagcaacccaagacatcaataacaaatgaatggataaacgaaagatggtacagt

SEQ ID NO: 21333 - DNA, 201 bp, Homo sapiens
ttccacctctacatatatacacaacagaagagactacgggggtctaaaagagatatgcgcacactcatgttcacagcagcactatgcacaatagtcaaagsgcagaagcaacccaagacatcaataacaaatgaatggataaacgaaagatggtacagttggttgtccctctctatctgtgtgggattggttccaggacct

SEQ ID NO: 21334 - DNA, 201 bp, Homo sapiens
tttgtaatacattatttttttgttgtggtattataattttttattggattgtttttccaaatattttccattctcagttggttgaatctgagcacccacasatacagaggctggctgactgtatatacacaccatgcaatattattcagctttaagatggaaggagattctgggccattctacaacatagatgaaccataa

SEQ ID NO: 21335 - DNA, 201 bp, Homo sapiens
cccaaggaatttgcaagtgcattaaaacctaaagttttctccagacacaaataaaatggacagcaaaccatcctattaattcaagccaccaaaaactgtaycagggtagtggccctaagaatcaatatggatatctttacagatagttaaaaagatatcaacagaataattgccttttatgcattctcttagcacaaaaat

SEQ ID NO: 21336 - DNA, 201 bp, Homo sapiens
ctcatcactgaaaggtttccttacagctgaacagatctactagttacaaatctgaaattgcaaatattttcaccagaaaggagtaaaagagctttaatccwctgacattacaagtcggaggcaaaggcaacagccagcacaggctgaaggggtcaagatatcaaatgtcatgagatgtaatcaaaacgttaaatgttctta

SEQ ID NO: 21337 - DNA, 201 bp, Homo sapiens
atctgaaattgcaaatattttcaccagaaaggagtaaaagagctttaatcctctgacattacaagtcggaggcaaaggcaacagccagcacaggctgaagrggtcaagatatcaaatgtcatgagatgtaatcaaaacgttaaatgttcttagactgtttaggtcgatttacttttcactgagtttcactttgtttctctt

SEQ ID NO: 21338 - DNA, 201 bp, Homo sapiens
agtcaaaggacatcttatttgctgattaattttcaaattttaaatttcacatattattaagagaatccaaaaatataattcttattgtggtgggacaagcyaactaaaaagtctctctctccctctcccctacccatcacaacacacacacacacacacacacacacacacacacacacacacacacacaatcaatgcttc

SEQ ID NO: 21339 - DNA, 201 bp, Homo sapiens
tttcctaagctgagctgtagcacttagacctcccccagtggctcagaaaagcatctaggcccagtcaagagtctagctagaaattgttgtgagtccacttkaagcttagagattatgatctgaaataaagaatcatttattttgtttcctgaacacctctgctactcccactggtatgatttcttttgaacacaattggtt

SEQ ID NO: 21340 - DNA, 201 bp, Homo sapiens
tacttcttaagggcatgaagtttatgaaacaaaactatacagtaccagacgcttaacccacagagtgttaaaagtcaccttcaacacacaactaaaccccmaaaaaagttattaggtgtttgacagtttcatttctttgactggtaaacaacaggagaacttggtctagttccatgaatcacagcttccaaagaaccaatg

SEQ ID NO: 21341 - DNA, 201 bp, Homo sapiens
aatacgtaattacctaaattagaatgtaactatcattttcataaacactatcaaaaacttgataaaagcaaaaatgttttaaacttcatggaaaacaaaakgtcacaacctcagcgttgtaaatattctgattttttttccactgtcttcatggcaatataaataatcatgtttataataaagggggaaggaataaaataa

SEQ ID NO: 21342 - DNA, 201 bp, Homo sapiens
ttatgattggaacagaacggaaacagggctaagacacacacaaaaactgactaggaagaggtagatgcagcgaacagtaccagaaaatatctgcaaatgcsctattcaactcaggtcataatcaaaatatgaaggaggtgtccgagggcagctgaaaatgtaaggcttcttaacagacacacgtgatcccatcaccaacct

SEQ ID NO: 21343 - DNA, 201 bp, Homo sapiens
actgcactccagtctagtcaacagaatgagaccttatttctaaataaatttatatatatatatatatatatatatatatatatatatatatatatataacyattgaagtgcatacaatcagtaatgtgaattctgaggcgtaattcacagattttgtgtatccttcaccattgtaaaaagtgcaaaaattttatctaaatg

SEQ ID NO: 21344 - DNA, 201 bp, Homo sapiens
ataactattgaagtgcatacaatcagtaatgtgaattctgaggcgtaattcacagattttgtgtatccttcaccattgtaaaaagtgcaaaaattttatcyaaatgaaaattttaattctaccattaaaaaacttttaatttttacattttttcaacatctaccactaaaaaaagtaaataattcatgacctctaaacatt

SEQ ID NO: 21345 - DNA, 201 bp, Homo sapiens
tttaattctaccattaaaaaacttttaatttttacattttttcaacatctaccactaaaaaaagtaaataattcatgacctctaaacattttggacaaagyagacctctcttggggtacttatttgggcttctattttgttgaaggaataaagtcatgctaatagatataggaggaggaagcaagataaacactcaggtgc

SEQ ID NO: 21346 - DNA, 201 bp, Homo sapiens
aattctaccattaaaaaacttttaatttttacattttttcaacatctaccactaaaaaaagtaaataattcatgacctctaaacattttggacaaagtagrcctctcttggggtacttatttgggcttctattttgttgaaggaataaagtcatgctaatagatataggaggaggaagcaagataaacactcaggtgctgc

SEQ ID NO: 21347 - DNA, 201 bp, Homo sapiens
gctactccggaggctgagacaggagaattgcttaaaccccagaggcagaggttgaagtgagccaagatcgcgccactgcactccaacctgggcaacagagmaaaactccatctcaaaaaaaaaaaaaaaaagaaagaaagaaagaaagaaagaataaaaggctcagagaactcgcatagttcttccagctcaggtctgtgc

SEQ ID NO: 21348 - DNA, 201 bp, Homo sapiens
ttcttccagctcaggtctgtgccaagcccaaactcccagatatcaagggttcaagaaaatgcatattccattttaaaatcattgaaagatacccttttttygcaggtctttgtaacggacatggaacaccagtaggcagccctcactttgttccccaaagacagcacatttcaattcagaccccaagtgaactgcaagatg

SEQ ID NO: 21349 - DNA, 201 bp, Homo sapiens
ttccattttaaaatcattgaaagatacccttttttcgcaggtctttgtaacggacatggaacaccagtaggcagccctcactttgttccccaaagacagcrcatttcaattcagaccccaagtgaactgcaagatgcagtcataatagcataaacataggtactgtaaatatcattttgagggcgcaaaacaaatgtcatt

SEQ ID NO: 21350 - DNA, 201 bp, Homo sapiens
actagagataaggaaatatcatttggacattgtggcgtggcttgctggaaggatgccatcaggatgttcagcacttacctagcacacccaaattcaagtgycaatacagaaacttgttccaaaatcatatacaaaaagatatggaactctcaactgcatcactcaagatggaaacataaaagagcagggggtcaaaacatg

SEQ ID NO: 21351 - DNA, 201 bp, Homo sapiens
agactaagtaggatttcactacagtaaattcaagaattgtagtattagtgtgagtcacacacagcttaggacttgcaccagcatacacacccgctactcayctccttgacattccccagcctacatacaaaggataactccaaccagggtggtttgccttggttccgttttaatctaccaatatcatggaatagagccctg

SEQ ID NO: 21352 - DNA, 201 bp, Homo sapiens
accacagaatccactttgggacaaaagatgaagctttgaacagagtagaccaaagatccataaggccattaacagtgaacaaaaccaggccatgttgtaayaggaggtgaactcacatcttggctctccagagcaccatctttcaaggagggtctagaagattgttgagaccaaaccgaagactctgagaaggtacgattc

SEQ ID NO: 21353 - DNA, 201 bp, Homo sapiens
ccttgggccctttggaccagtttgataactggagaattcaaaaatgcttcatgatacattgtgtcttcttccacacaggaggtaaaagtgacacacctagyttgataaaatgaccacttttcacatagtatctgtaagacacacaaggaaactcctactggtactgagatggcaattttcctcagaagccgagtactgagg

SEQ ID NO: 21354 - DNA, 201 bp, Homo sapiens
aaaatgcttcatgatacattgtgtcttcttccacacaggaggtaaaagtgacacacctagtttgataaaatgaccacttttcacatagtatctgtaagacrcacaaggaaactcctactggtactgagatggcaattttcctcagaagccgagtactgaggagcaatgcagagtgggttccgagggggaaccgtgctctgt

SEQ ID NO: 21355 - DNA, 201 bp, Homo sapiens
agtctcagccctctgcataagaaattacttgttttcaagtttgaggaacccaggctccctattcctgggggagtggggaagagccagcacacggaaccacytctgaagaggcagcagttctgccttcgataatcctcttaagggtgagaattcacttgccgggacttcagtggacagattcctcactgttctttaggcagc

SEQ ID NO: 21356 - DNA, 201 bp, Homo sapiens
acagatcaaaccatgtcactccactgctctggactgtccagtagcctctgtcctagttccagggcctctgacaactgctctgagcccacctttctccaggytctccctggcttgctctgctcctccctgatgttcctgtaaatgcaccaggtaacttccagctttaggaccccactgccagtcccctgcctcagatgccct

SEQ ID NO: 21357 - DNA, 201 bp, Homo sapiens
aacttagtttaacatagacattcaaaaatttgacttaactaaaacactaattattttattgccgtgtaggattgcaggggagaaagaaagatcgaggtcaygtaacgacgcggcatttttcttggacggtttcttagatgataatttataatgcacatatcaacgccccccctccaccccccgcaaaaaggcttagattct

SEQ ID NO: 21358 - DNA, 201 bp, Homo sapiens
aacgtagactcctgggagctacaaaaaaaaaaattagccgggtgtggtggcacacacctgtagtcccagctagaagggaggctaaggtgggagaatcactkgagcccaggaggtgaggctacagtgagccgtcatcacaccactgcactccagcctggttgacagagtaagaccctgtctcaaaaagaaaaaaaggagaaa

SEQ ID NO: 21359 - DNA, 201 bp, Homo sapiens
gggaggttaaggcaggaggatcttttgaacccaggagttaaaggccagtctgggcaacatggagagatcccatctctacaaaaaaacacgaaacttagccrggagtggtggtgtgcacttgtagtcccagctactcgggaggatcacttgagcccaggaggtagaagttgcagtgggccgtgatcatgccattgcacttca

SEQ ID NO: 21360 - DNA, 201 bp, Homo sapiens
tgaggatacatccactggtcaagcaaacagacaacaccctgagtcgtgtagggacactcactacacaaacacagaaaacacactattggatagtaaagtamaccatgaagagacagccaggcaaaggttgtactttagagggagtggccaggaaagtcctctctgcaaggaggtgatgtatgagccatgagactatctggg

SEQ ID NO: 21361 - DNA, 201 bp, Homo sapiens
tgccaagtgccacccttccattgaaaaatggcgtaccatctttcctatctccggggcctggtccatcagcagtttcttggttatcaactgtaattactagyaggggaaaacttgcaaaatttgccatctgtttctcaactccctaaaacatgatacactccactcactgcaacacactgaaatcactttgtgtattttcct

SEQ ID NO: 21362 - DNA, 201 bp, Homo sapiens
acatcagtggtcatgtgctgaacaaattttaaaggtagcacctataggatctgctgatgagatgggtttgtgttgtgatagaaaaagaggaggactgcatkggttttggtgtaagacaagggaagaacagggttaccatttactgagctgggggaaatgagggacgcagattcaagagataaaatcaaaaggttgattatg

SEQ ID NO: 21363 - DNA, 201 bp, Homo sapiens
ctctatggccatctaacacccaccattgacacgtggatttgaaaaggagtcggcaaatgatctcataactcattaagaggatccctggtttcttccagtcmcctgctaaacagtcataaatggcatttgagaatggtagcaaaatttcttggaaaccatctcatcccatgtccttatttctcagcagagacatcaaaagcc

SEQ ID NO: 21364 - DNA, 201 bp, Homo sapiens
gtagcaaaatttcttggaaaccatctcatcccatgtccttatttctcagcagagacatcaaaagcccaaggcaagtaatgtgacaagtccaaagtggacamcgagctggtcgtgcgcagtggctcatgcaaataatcccagcattttgggaagcaaaagcaggtggatcacttgaggtcaagagttcaagaccagctggtc

SEQ ID NO: 21365 - DNA, 201 bp, Homo sapiens
gtcctaccgaggatggaaccatgcacagggggccagcagtccatgcttacacacatccaggaaggaaccaagaagtcgccatgcagcccagccctgagggkaccccattgccactggagtctgcctgccacgcagaagcccgcaggtgcctgggacactatccgagttactgggccagtcctcaaaggtggctacggaaga

SEQ ID NO: 21366 - DNA, 201 bp, Homo sapiens
ctaacttaatgtcatttccgaaaatgcatcatctctcattaacaatagtccaggatgaagaaacagcccattaaacaagcaatgatttctctatccaaatmgccagcaaatactactcacctgattgacagactctgatattccagccattgttcaagcaaaattactcattcctcacaaacctggctggaagccttctgc

SEQ ID NO: 21367 - DNA, 201 bp, Homo sapiens
atgtcatttccgaaaatgcatcatctctcattaacaatagtccaggatgaagaaacagcccattaaacaagcaatgatttctctatccaaatcgccagcaratactactcacctgattgacagactctgatattccagccattgttcaagcaaaattactcattcctcacaaacctggctggaagccttctgcatcacacc

SEQ ID NO: 21368 - DNA, 201 bp, Homo sapiens
gaaggtaacatagtatttatcagtatttaccattttttctatcttctagaacttatagccctctattaagtatgctcagttttcatcaactatccaccagktttatgaaaacctcagtgtacaatcaaacacttcatcttttctgaaaacaatcactctcttggtgaaatgatacacaatgaaaaataaattttaaaacag

SEQ ID NO: 21369 - DNA, 201 bp, Homo sapiens
cactagtattactggacattcgagtacatgaaatccaaaagtcatcactcacctttttcagagcacaagcctttatgactttttcatatcgttccttttcrtatttcttcccaaataaaatattactcctcagagttcccgagaacacccagggctgctgagacacataggcaattcttccatgcacgctgaccagcccgt

SEQ ID NO: 21370 - DNA, 201 bp, Homo sapiens
aataagccactgcaatgcagccttgcccagccctgggagcttgaaaaacaccattcattcatttaaaagagcacaggaagttgtgattaaaaattggaaayaacataatggtccacataaactagtagtttataaggaatattaacaaaatagagtgtaacaatctactctgccctaatgagtttccctaaatgagtttca

SEQ ID NO: 21371 - DNA, 201 bp, Homo sapiens
aatggtccacataaactagtagtttataaggaatattaacaaaatagagtgtaacaatctactctgccctaatgagtttccctaaatgagtttcatgcccmtaaatgaaatggtacacggaacaaagatcaactaagaatgtttacagcaacagagtagccaagcatgacatatatagttcatatatccaatactgaatgc

SEQ ID NO: 21372 - DNA, 201 bp, Homo sapiens
atattaacaaaatagagtgtaacaatctactctgccctaatgagtttccctaaatgagtttcatgcccctaaatgaaatggtacacggaacaaagatcaamtaagaatgtttacagcaacagagtagccaagcatgacatatatagttcatatatccaatactgaatgcattgttcctgcatgcgggtatcttttttgaca

SEQ ID NO: 21373 - DNA, 201 bp, Homo sapiens
atatatgagactaagtctgtacgcacgtttccttcacatcttctacaatgcacagacatgacgtgtctgtgccccccactatcagagcacttacgacactraactgaaatcacctgtttgtatatctgtctcaccccagataccagaaacttctggagggcagtggcgtctgggtcttgattacaggtgtatcttttactc

SEQ ID NO: 21374 - DNA, 201 bp, Homo sapiens
tgtgccccccactatcagagcacttacgacactgaactgaaatcacctgtttgtatatctgtctcaccccagataccagaaacttctggagggcagtggcrtctgggtcttgattacaggtgtatcttttactcctaacacaggactatacacctggctacaggtttattaaatgtgtgttcatgtgacttggagaagtca

SEQ ID NO: 21375 - DNA, 201 bp, Homo sapiens
tattcttaatataatattcagtatgggagcttttcaaccatttgtaaattttcattctgtcccttggttttaatattctatttcattaacctccacaaggkggcagcatgagtacatggcatgcccagtccttggctaatggatgacttgaaatctccactaatctttccattttcacttgataaagcatgaacctcagtt

SEQ ID NO: 21376 - DNA, 201 bp, Homo sapiens
ctaatttaacaataaccaaaaactgaagaataatgaaattaagtgtatgttcataggtcaaagtgaaagtctcagtgttacacctgcagcttgtgttaccyatcctgggaaaatagggacagcatagtagttctactataaacactgaggtacccaccacagcattcaatccagcacaaagggaggaagggatgaagtact

SEQ ID NO: 21377 - DNA, 201 bp, Homo sapiens
ttaacaaaattatcaatcactgctaatgttaaaaaaaaaaaagttgttttaggcagggtacggactggttcatgcctgtaatcccaacattttgggagatrgaggtgggaggatcacttgagcctaggagttcaagacaagctggggcaacatagtgagaaaccatctcttaaagaaaaaaaaatcagccaggcatggtgt

SEQ ID NO: 21378 - DNA, 201 bp, Homo sapiens
gagccaagattgcaccactgcactctaacccgggtgacacagtaagaccttgtctcaaaaaaatgttattttgcagtttattatttaggagaccaaatcamattcattacttttacaaagagcttctaaatattttcaattgagaggattaagtgtgtatcagggagaagggatagtttaccagagcatgatagggatagt

SEQ ID NO: 21379 - DNA, 201 bp, Homo sapiens
aaagtcttgcttgacttcgccttactatataaggtgttcctcctctaaaatgtaacgggtctactctgtattcctgattaagtaacatctgtctcttaagrcaactgaaacctacttatttctgtgattacaaaaggatgaaaaaacacaaccggtcaacctgtccctttcccctcctttgcagtgtgtctctttcctaac

SEQ ID NO: 21380 - DNA, 201 bp, Homo sapiens
tccagcaaactacgctacaacgcaaggtcagccacaaagagcacccggagaggggaggagctggtcaccaccagcactgcccacctgttttaagcagcctsagctgttccagtaccctcagaagagaccctcgccctctgctcccaaatcttgctggcagctgggccactgggctctgctcctggcagacatcatctccag

SEQ ID NO: 21381 - DNA, 201 bp, Homo sapiens
gcaaactacgctacaacgcaaggtcagccacaaagagcacccggagaggggaggagctggtcaccaccagcactgcccacctgttttaagcagcctgagckgttccagtaccctcagaagagaccctcgccctctgctcccaaatcttgctggcagctgggccactgggctctgctcctggcagacatcatctccagcccc

SEQ ID NO: 21382 - DNA, 201 bp, Homo sapiens
tggtcaccaccagcactgcccacctgttttaagcagcctgagctgttccagtaccctcagaagagaccctcgccctctgctcccaaatcttgctggcagcygggccactgggctctgctcctggcagacatcatctccagccccggggtgcagcttcctgccgtggctgatctcggggtggcctcctccacccctgctttc

SEQ ID NO: 21383 - DNA, 201 bp, Homo sapiens
cttcttgtgggtggcccctgctgttggtcccatttgcctaaatgttatgagtaaaccaagtgttgaaaaatccttgtggccttgccagaactacctgtccrcttaccacacggtgaaacccttcagtcaggaatccatggagcttgctacgccggcctgcagcctcccctcggccttgggctgccaccaaagcagctggca

SEQ ID NO: 21384 - DNA, 201 bp, Homo sapiens
ttcttgtgggtggcccctgctgttggtcccatttgcctaaatgttatgagtaaaccaagtgttgaaaaatccttgtggccttgccagaactacctgtccgyttaccacacggtgaaacccttcagtcaggaatccatggagcttgctacgccggcctgcagcctcccctcggccttgggctgccaccaaagcagctggcaa

SEQ ID NO: 21385 - DNA, 201 bp, Homo sapiens
agaaacaaaagcacaaacaaaagtcactgcttccatggaatttgtaacataaaactttatacagcctacagatcattttaccaaccctatttaaagtatcrgttcacatcagcatatgatatttatttaataaataaacatgtaaagagttcatggccatgaactatctttgtaattttaggaactatctgtgtaattttt

SEQ ID NO: 21386 - DNA, 201 bp, Homo sapiens
ccaaaatgctgggtttacaggcataagccaccatgctacacctacacttatcttttttccttagtcaatgtcccctcctagacagcagaacggaccaatckctcgcttattgctattttccacactagttagcaactacacaatgcaatttaactgaataaaacaaagtcctgttaaccataacaaacctaacataatgat

SEQ ID NO: 21387 - DNA, 201 bp, Homo sapiens
atttaactgaataaaacaaagtcctgttaaccataacaaacctaacataatgatatatgggaaaactcccttttgctcctcaaatggtaggcataattcartgagagaagctacagtggcttagaaacagaataaacaacctagatcacccccaccccatccaaaattttgtagatgtggcaaaaactgtcagctctcctc

SEQ ID NO: 21388 - DNA, 201 bp, Homo sapiens
tcacccccaccccatccaaaattttgtagatgtggcaaaaactgtcagctctcctcaaaacctgctctaattttctgtgcatttttagccaacgcacagcrgccttgaacaaggaccactctctccagcccccaacacagttagatgtagccacatgactttaagttcagcccaacagaaagtgacaacgtccaggaaact

SEQ ID NO: 21389 - DNA, 201 bp, Homo sapiens
gactttctctagtcactcaggagggtgaaaaagctgaaatgacattgccaatacagcaatgaggtgcatccccagaaagttcacttggggaagtatcagayggcagaactgaagtcaaagagattgacttcagagtggacggttggcaaaaactgaagcagctttgtgaacaataaaacctcagagacacattttactgga

SEQ ID NO: 21390 - DNA, 201 bp, Homo sapiens
aacgacagtcatcacttcccactaaaataatgctcagttgttaggcattttccaaatctcatagatgtaatgaagctggaggttgacttcacttacacatyttctgagcacctgcaatctatacgtaatataaagatgaatgaggcactgtgtctgccttttgtaagtttagagtttaggaagggaaagaaatctataaac

SEQ ID NO: 21391 - DNA, 201 bp, Homo sapiens
caatctatacgtaatataaagatgaatgaggcactgtgtctgccttttgtaagtttagagtttaggaagggaaagaaatctataaacaaatggcttcaatrataaggggaaaatgaggacaaagtcacgtatggagagcccaaaagaagagatgaggattaaagagtgtgtgatgggccgggtgcggtggcttatacctgt

SEQ ID NO: 21392 - DNA, 201 bp, Homo sapiens
acttcccaaaacagctttgcaagggcaggagaatgattagaactgccatcccagcaaggcacgatattcctatctccatccagagtagggcagtcactgcratcgcctgcagtggtcctgcccacaggaagtgtaagaacactgtcacctttaaagaaaaagacagagcgttcttaggactccagaaaagcaaaaccagta

SEQ ID NO: 21393 - DNA, 201 bp, Homo sapiens
gactccagaaaagcaaaaccagtaagaacacagtacagaaacgatccactggaaaagaacaggcaagatcctaaacagaaatggccacagtgggtttacasctgctaaagcagaaagccaagcacccaccacaggtgaagccattctggggaaacaaagagtgggtctgggagactcgcaagagaatccgaccagcggcat

SEQ ID NO: 21394 - DNA, 201 bp, Homo sapiens
atcgtgactatcttcactgatgagctgagcattttccagaactctctgccacagaattcagctcccatatgccctggggctccccagtaccccaagaaaayctgtactacagtgcccaccacatactccagtaatttacttgtgtgtttgtctcccagacaggcagtgagcttcttcagaacagaaaccaagtcttattca

SEQ ID NO: 21395 - DNA, 201 bp, Homo sapiens
agtcttattcattgtccctgacactgagcggaggctttagttcattctgatgaatgaataattggaaaaaagaagtggtcctagtgcaaaatgaatatggycagcagctagaatgccctggataaatgataccgctacaaggtaagtattaaacaatggatactgggcgggtatggtgttcacacctgtaatcccagcact

SEQ ID NO: 21396 - DNA, 201 bp, Homo sapiens
cacaatagcccatctgacatgaaaattcaaaaaaaaagaaattagctgttcacggtgatgcacacctgtagtcacagctaatcaggaggctgagacaggargatcgcacatcacttgagcccaggagttcaagccttcagcgagctatgatcctgccactgcaatccagtgtgaacagagtgagcccctgcctccagaaag

SEQ ID NO: 21397 - DNA, 201 bp, Homo sapiens
acttgagcccaggagttcaagccttcagcgagctatgatcctgccactgcaatccagtgtgaacagagtgagcccctgcctccagaaagaataaaaggggraagaggggtgtttaatgcaatgaaaaaggatccctgagctgcagcttacctgatcaaacttgttcacatcattggacagcagattgactatctggcctgt

SEQ ID NO: 21398 - DNA, 201 bp, Homo sapiens
aaaagaggtaagtagagaattgtattcatgcagtgatactaagtcaggcttaggacacagcagacctgaggaagtctcgtgtgatgtcaagaccagatctragcacaagcatccccacccccccactgccccctctctctgccccaccagcacctttagtggtggcagctgtgtcaggacagcaaagcgagaggtaggaag

SEQ ID NO: 21399 - DNA, 201 bp, Homo sapiens
atgacaaatatggagtatcaactatctggaggacaccaggagccccagcagatacagtgacacagtcatgttttcctgccttgggagacagggctaggtaygtccagacacctgtgattcaactgtgacctgcacagagaactggggacagttcgaactgagggacactgggtgggagagaccctggacgatgaaggaggg

SEQ ID NO: 21400 - DNA, 201 bp, Homo sapiens
aactagctgcttagagcaaaaatggtaatggtgcattttggagacagaagtaaaatatacgacaatagcacacaagatggggaaggtaatagaattttacygttgcatacttctaacttttaaggtaaaatagtccttatgttgggccgtcagtaaatttcaatcaatatctgaacataaaaatgttacacagaatgtatt

SEQ ID NO: 21401 - DNA, 201 bp, Homo sapiens
gaggtgggaggatcacttgagggccaggagttcgaggccagcctggccaacataatgaaaacttgtatcatataatgaacataatgaaatcttgtaaaacyacaagaattagccaattgtgatggcgcacacctgtaatcccagctacttgggaggctgaagcatgagaattgcttgaaccgggagttggagggtgcagtg

SEQ ID NO: 21402 - DNA, 201 bp, Homo sapiens
atcccagctacttgggaggctgaagcatgagaattgcttgaaccgggagttggagggtgcagtgagccaagagcacgccactgcactccagtttgtggaayagacggagactctgtctcaaaaaagggaaaataaaaaataaaaaaataagtggcatttctactgaaggcagcacaaagattagccaatgctgaaaaaaca

SEQ ID NO: 21403 - DNA, 201 bp, Homo sapiens
aaacaaacaaaataactaaaagttaataaagaactaaaaaggattaaggagaaaatagctttacaaaatagacaaaggacataaaacatatacatgatagrtatttgtaaagaagagaatataatcaaataaaaaaattcaaggatataattcaagtaaacttccagaaaaaaaagaaaacttgaatcaaagtctgaaaga

SEQ ID NO: 21404 - DNA, 201 bp, Homo sapiens
attcaagtaaacttccagaaaaaaaagaaaacttgaatcaaagtctgaaagactgcacaataatgtcctaggaaaactaatgaccctttcagcatacaagraaaaagatctggctgggcatagtggcacacatctgtaatcccagcactttgggaggccaaggtgggatgatggtttaagcccaggagttcaagaccagca

SEQ ID NO: 21405 - DNA, 201 bp, Homo sapiens
taatcccagcactttgggaggccaaggtgggatgatggtttaagcccaggagttcaagaccagcatggaaaacacagtgagaccttgtctctatggggggraaaaaaattagccaggtatggtggcatgtgcctctagttccagctttaagggaggctgagaagggagcattgcttgagcctgggaggttaaggctccagt

SEQ ID NO: 21406 - DNA, 201 bp, Homo sapiens
gctatgattgtgccactgcactccagcctggacaacagagcaagaccctgtctcaaaaaaaaaaaagaaaaagaaagaaagaaagaaaaaaggctgagttrtgtcaaacatggtcatagatgtctccatatgaacagacaacacgagaagaccttagagcaaaggctgcaacatactaagtgaaagaaggtgtgacccaat

SEQ ID NO: 21407 - DNA, 201 bp, Homo sapiens
tttgcggcaagaagagtatcaggtcagtgagtatgggaaaccttgtccctcttttccttcttctcttgagtttgctccattatagttcctctaatgtaggwtgaaactaagttcatatttaaactctaactcatcagtaaagccaccgtaacagagctagattttactaaaatcaacagagcaatacaagctcccgcacgt

SEQ ID NO: 21408 - DNA, 201 bp, Homo sapiens
agtgagagactgtctcaaaacaaaaaaaaaaaaaaaaaaaagttactcagattcttgtactttagcattttcatgtgtcaaaaggggataataacagcagktcagaaggactgtgaagcttaagggagacaatgccataagcgttcacgtttgcggcaagaagagtatcaggtcagtgagtatgggaaaccttgtccctct

SEQ ID NO: 21409 - DNA, 201 bp, Homo sapiens
aatctcagcagtttgggaggccaaggcaggtggatcacttgaggtcaggagtttgagaccagcctggccaacatggtgaaaccccatctctacgaaaaatrcaaaaattagccaggcatggtggtgcacgcttgtagtcccagctactcgggaggctgaggcaggagaatcacttgaacccaggaggcagagattgcagtg

SEQ ID NO: 21410 - DNA, 201 bp, Homo sapiens
tgtattaaattgataagcggaatcattttactgactcaaaacctggagataaattaaaaacagggtgacaaagaggctgggaaatctagcgtctgcatgarggtttctcattttcacacgtaaaatgagcacaatagatttggatgttaatatcaagttgtaatccctatattttataaactctgattgacaagcattgaa

SEQ ID NO: 21411 - DNA, 201 bp, Homo sapiens
aagaacagggatgaatctactgtacagagaaattagccccactaaaaccctcagcagggctgggctgaatgccaaacaacctgtagatccattttagttcygatcactctgattcatagatatgttttatctctgtattaaattgataagcggaatcattttactgactcaaaacctggagataaattaaaaacagggtga

SEQ ID NO: 21412 - DNA, 201 bp, Homo sapiens
gtctcgaaaatagttaaggtcgagggctgtccattggaagtgtttgtaaccatgtggtcagtgtgaccaatatgtggataatttcttttgaagtatacctrgaaaaaaaaaaggtaagcataaaaagaatgtttcaaaattttaaagtctcctccctgaaacaatgcacttctgtgtctacttcttcatgtgaagcaaatc

SEQ ID NO: 21413 - DNA, 201 bp, Homo sapiens
gggagaaatattcaaatgaactagcatcttgtatgtataaatatttgttgccaaagtaaaaaaaagtacaatgtggtttacatagtccaaaaactagtggmaaatgccttcggaacggacttgacattttggttggattcacagtgctgtctcgaaaatagttaaggtcgagggctgtccattggaagtgtttgtaaccat

SEQ ID NO: 21414 - DNA, 201 bp, Homo sapiens
ggttagaggtttggccttcttgggaagtgtcacaatgctgagtctaaaactgcaacagttaccgtgtccaagtcatgcaactctaaaggaggatggacggycacatttgtgtccttcagtatcaaagcacctttaagggcttccattttgagaaagtagtattttctcttccttctcttttagaacatatgataaaatatt

SEQ ID NO: 21415 - DNA, 201 bp, Homo sapiens
aatgctattagtggtcaggagtaaactaacctggacaggctcatgaaaatgaacccctggatgcatcctgagaacgtactgcataattatagtcaatgctygcaataattttcagtttgtctcatcacgttagcagagcctattcatgcaatttagaaaggatttcaatacagcccaaaccaaaaggcttacagtcaacag

SEQ ID NO: 21416 - DNA, 201 bp, Homo sapiens
tttctaagtactaggagttgaacagctactacggtcaatgtattttggcagttagctgtgtgtggtgtgtgctttttaaggcttcactcaataaaacatckgttgctctctgctgatgagcaaaaaacttgctatacgaaggacaaatatatgtatacaaacaaatgcacacgtgtgcatgtctatatacatatatgcaat

SEQ ID NO: 21417 - DNA, 201 bp, Homo sapiens
aaattctatgataacattaaaacagaaacaggacgtttatatgactgtctttaacctcaaaagtccaaataaacatatagacattttgaatatagctatcrttttaacaaacctcattatgatcactgttgcaatttcagtcacctaaaatacgaaccatgactattaataaacatttactgtgtgtggtttgttggactg

SEQ ID NO: 21418 - DNA, 201 bp, Homo sapiens
tcatcattgccatcagggctcaccacatcaatcaaatctctgctctgctctattctttggcttatattgtcaatgactaggggcatgtttaatgtatttgytagtgcccagcgtaatactgtgcacacaaaggcatttatagaatcgttttgaggataaatgcaggattcaaagaaatatcctacagacagtggcaaggat

SEQ ID NO: 21419 - DNA, 201 bp, Homo sapiens
atattacacacaaacaagcaattttattctacctacagtgatgaaaacctgaaaaatacagaaaacaatgaaggaaaattatacccatattatactgcctrtggatgaacagttttgatgggagcctcaccatgtactgctagaagtctccttccaccctaagccaagaacattggatgttccttccctccctccatcaat

SEQ ID NO: 21420 - DNA, 201 bp, Homo sapiens
ttactgcccaggctggagtgcagtggcgtgatcttggcccaccgcaacctccgcctcctcggttcaagtgattcttctgcctagcctcctgagtagctggkgttacaggcatgtgctaccactcccagctaatttttgtatttttagtagagacggggtttctccgtgttggtcaggctggtctcagactcccaacctcag

SEQ ID NO: 21421 - DNA, 201 bp, Homo sapiens
ggtttctccgtgttggtcaggctggtctcagactcccaacctcaggtgatctgcctgcttggcctcccaaagtgctgggattacaggcatgaaccaccackcccagcctgacaactgcctcttatagaaggtggaggaagcatatgggctatatgggcctaattctaaacaacaaagaatgaggggaaaacccaggtcaac

SEQ ID NO: 21422 - DNA, 201 bp, Homo sapiens
gcccctgcttttaggaagcccatactcaaaaaaaaaaaaaaaaaaaaagacagaagaaaacactcaagtgactagaatgccagaaaaaaggcaaaacaagygggagtttagcagcagcagaagtcacctctggccaaaatttctgaggaggagcttcagggaggagaaaatagcaaactgggccttgaggaatggacagac

SEQ ID NO: 21423 - DNA, 201 bp, Homo sapiens
gacacgtagaaatggtggtggaggtgaggggtgggaggaccgtggtcattccagatgccgagaggtctgacagctcacctatcacttcctcaagggcaggsttatgtgcttgctcttgttcactgttgcatctccatggcctggcattgcacataacgtgtgagcaggcaccccatgcacactgcctaaaagttaaataca

SEQ ID NO: 21424 - DNA, 201 bp, Homo sapiens
atgccgagaggtctgacagctcacctatcacttcctcaagggcagggttatgtgcttgctcttgttcactgttgcatctccatggcctggcattgcacatracgtgtgagcaggcaccccatgcacactgcctaaaagttaaatacaaaggaagggaaattcagggcacaattgggtgactgaccagtggtgcagtctggt

SEQ ID NO: 21425 - DNA, 201 bp, Homo sapiens
cattttttattttttgagatggatctcactctgtcgcccaggctggagtgcagtggcgcgatctcggctcactgcaacctccgcctcccgggttcaaaagygtctcctgcctcagcctcccgagtagctgggattacaggcacacggcaccacgcccagctaatttttctgtatttttagtagagacagggtttcaccatg

SEQ ID NO: 21426 - DNA, 201 bp, Homo sapiens
cgcccagccccagtttgtgctttctaccttcacattagttctttgtccccctgaacactttaattaaatgtctcagcatatttttcaagaagtaatttttyctcttctgaaatgttctaattgtggccgttgtcggtttcttaaagagaagttccatgaagatgaaacatagaatttaaataaaactcaggttagctttga

SEQ ID NO: 21427 - DNA, 201 bp, Homo sapiens
ttgcttctctgtaattcactcccgaagaattctctaactgcagattcgcttattcctcgttcactcacactaccagggagaatccagagcgttgtaaggaygggtgtgcagggactggaggaaaaggctgtgctattggctgaaaggaaaacaggtcacaagtaaccagctaatcctaaaaactacagggaggaagctgtc

SEQ ID NO: 21428 - DNA, 201 bp, Homo sapiens
ggagaatccagagcgttgtaaggacgggtgtgcagggactggaggaaaaggctgtgctattggctgaaaggaaaacaggtcacaagtaaccagctaatccyaaaaactacagggaggaagctgtctttaatgtggagatagtggtgcgtattagaaaaaagaggatttctaatttgtctgtcttgctctactgttttgtgg

SEQ ID NO: 21429 - DNA, 201 bp, Homo sapiens
tgacaaacgtcctctggggcaaaactgcccctggttgagatccactgttctaaaaaagagttgaaaataacagaatctgtttactggcattgaaaagtcarcagtctcctaagtggcccatgaaaaggcaacttttaaattagctttgcttgcaggatctgagtaatctgaatttctgagataatttcacagggatattaa

SEQ ID NO: 21430 - DNA, 201 bp, Homo sapiens
atgagcccccatatttgccaggtcctccactccctacttttctgccatgactgcccaataaccaccccgctaaaagaccagctctccaccaactgtacccrtattaaagctcccctcgatccgggccccttcccacatgcccaccagcagtaaagattaccatgctccttgcaccagagtggggcctgtcctcaagtctca

SEQ ID NO: 21431 - DNA, 201 bp, Homo sapiens
ctaggagtacaatgctttcagggcaatgactactgccatattatttggaatccccattatgcctggtatgtgatagatactcaataaacagttatggaaakaatgaatgattgtattattgaataagacagatgggtagagtaccttgagcaatgatctagggtaaaattcaatacaaactcaatatagcatagtcgtgct

SEQ ID NO: 21432 - DNA, 201 bp, Homo sapiens
tgttgtttgctgctaagccacccacacctacaacatgctgggcacatagaagtcacccagatttgtcacgtgaatgaacacatcctgtaaaaattacctaytttaacatatttaaactccaaaatccattacgagtccatgatatcaacttctcagttacaaatataaatattaaataatttacagatataaataagtctg

SEQ ID NO: 21433 - DNA, 201 bp, Homo sapiens
agggacctctgcctaggaaagccaggtattgtccaaggtttctcccatgtgatagtctacaatatggcctcgtgggaagggaaagacctgaccgtaccccwgcccaacaccctaaagggtctgtgctgaggaggattagtaaaagaggaaggcctctttgcagttgagataagaggaaggcatctgtctcctgctcgtccc

SEQ ID NO: 21434 - DNA, 201 bp, Homo sapiens
tgaaaacaactgattttgatactgtggttccagaagagaaaatagccattaaagccttcagggataataaacctaatatctggaatacaaactcatgtccwaatacttatgggtctggtaactgtctgacaattaccttaatgcagcataatgtcattgtcaggctatttctcccacttaaaaatatacgtagtatttaaa

SEQ ID NO: 21435 - DNA, 201 bp, Homo sapiens
tcatgtaaccaaataccacctgctccccaatagcctatggaaataaaaaaaaaaatttttaaatttaacaaaagatcatgagtaaaccagaaaaaaaagaratagtgatatctaaggtacacacttaagttttagaacaaagaacaaatagatggctagaattaggattagatcttatcatcatactacttgtgaaaaggg

SEQ ID NO: 21436 - DNA, 201 bp, Homo sapiens
gctgaactacaaccacagcttagctcacctaatccattccttggcccatttgtgggtctgacccttccttctcccatcattcctggcacagggtttgactytattacccacctcctttgcagtttggtgagaccctgtggcacagaagagaaagggaggtctaccagcagcagcccagcgtcaaccaagcacacaacaggg

SEQ ID NO: 21437 - DNA, 201 bp, Homo sapiens
ctgataagcatatcaaactaaataatgtccaaacagaacaccttttcatcccacaaaaaaatcctgctcctcccaggcttctccctctcagttatcagccrtcacatctttccccttgcccagattttccaaagaaaagaaaaccttcaggtgaccctgcagcccatcccttctttgtcactctttgataggacacatcta

SEQ ID NO: 21438 - DNA, 201 bp, Homo sapiens
ccaaagaaaagaaaaccttcaggtgaccctgcagcccatcccttctttgtcactctttgataggacacatctaagccatccaagtcctattacttcaacakgcaaagtatatccagaaacagtcacattgaccctataaggctcaccctctgcccctgcccaagcttaaattttctactcagcacctgtcaacattagaag

SEQ ID NO: 21439 - DNA, 201 bp, Homo sapiens
cccaagaaagccctatgttggtcccaaggacctcacttctaacctgtcatagagaaatgatggaggaaaagagctgaaagacaaggcccaggttgccaagygccacccttccattgaaaaatggcgtaccatctttcctatctccggggcctggtccatcagcagtttcttggttatcaactgtaattactagtaggggaa

SEQ ID NO: 21440 - DNA, 100 bp, Homo sapiens
tgaatttagtttcattaaaaaattctatgataacattaaaacagaaacargacgtttatatgactgtctttaacctcaaaagtccaaataaacatataga

SEQ ID NO: 21441 - DNA, 201 bp, Homo sapiens
gcagatgcctataatcccagctactcaggaggctgaggcaggagaatcacttgaacccaggaggcagaggttgcagtgaaccaagatcatgccactgcacyccagcctgggcaagagcaaaactccatctcaaaacacacacacacacacacacacacacacacacacacatcttcagagggggcagtgagcagggcttca

SEQ ID NO: 21442 - DNA, 201 bp, Homo sapiens
aataggagctgaaggcaacctaggttttatttggataaatctttaatacagaaataccattagatatgggaacatattttctttttcttttttcttttttytttttgagacgcagtttcgctctgttgccaggctggagtgcagtggcgccatctcagctcactgcaacctccgcctcccaggttcaagctattctcctgc

SEQ ID NO: 21443 - DNA, 201 bp, Homo sapiens
tattttaagtttacatgattccattaagagtcccagaacagcactgggctgttttcatccttacagagaggcctaggcaacttaaaaaaaaaaaaaaaaawttacatttagatttttgttggcctttatttgagggcaggttaaatgcatttttttgggtgggtggctttaataaaaattttcacttcctaatatagcaac

SEQ ID NO: 21444 - DNA, 201 bp, Homo sapiens
acccgggaggcagaggttgcggtgagccaagatcacaccattccactccagcctgggcaacaagagcaaaactctgtctcaaaaaaaatagatagatagayagatagatagatagatagatagatagatagatgatagatagatagatgcgtggatcccacccccagaaattatttttccaattggcctataaggggaaca

SEQ ID NO: 21445 - DNA, 201 bp, Homo sapiens
cagttagctgtgtgtggtgtgtgctttttaaggcttcactcaataaaacatctgttgctctctgctgatgagcaaaaaacttgctatacgaaggacaaatrtatgtatacaaacaaatgcacacgtgtgcatgtctatatacatatatgcaatttcagggaggtgacaccttattctgagaggtcatgagactccacttca

SEQ ID NO: 21446 - DNA, 201 bp, Homo sapiens
ggccacagagcaagtctccatcttaaaaaaaaaaacaacaaaaaaacaaaaacacaaacttttcttctggaaggctctaataagccaggccataaggatakaggagccccatcaactgctttcaaggataggggcagaacaaggggatgcacagatgtgggaacaagagaaggtgagactcttccacaggtactggagaaa

SEQ ID NO: 21447 - DNA, 201 bp, Homo sapiens
acctcgtgatccaccctccttggcctcccaaagtgctgggattacaggcgtgagccaccgtgcccggcccagtatttgtttcttaaagtgactccaggacwggcccctgactatgtatgtcatcatttctgtgccccagttctttcccaggtccttgctgcttaatcctaaccacgaatttgagttgctaatggtgtggtc

SEQ ID NO: 21448 - DNA, 201 bp, Homo sapiens
agcattagaggggtactgagagtggtgaggaatgccgctaagaccggggtgggggaaagccagaaaacaaagtgatagcctcaccttttgttccttgtgaraaaaacattagatttctctcttaggcttttattgtgcacatttttttttgtttgttgctgcttcactatttaaatttacataaacaatttggttaaagga

SEQ ID NO: 21449 - DNA, 201 bp, Homo sapiens
ttcattgaggtcacacttctatcaggcagtgctggaataaaaatgtgggtcgtgttgacgcttagaagatgctctgaaagattctatcccaggcagtctgytgaatgatttcctgggtcgcattaagtattgcacagtccctctagactatgtttctttttttcaaccaacattgagccttggagacaaagccatacaaag

SEQ ID NO: 21450 - DNA, 201 bp, Homo sapiens
ttagctttgtattatttgtatcacctgtggtgtcctgcaaaaaaaaccagaaatcccccagagagttaagcatttaactcaggcttgaaacatttatgggwaatctattgccatattgttcaggtatacaataagctaggtgttttacacctcttatcttgtttaagttataaaactctaatggctaggccctatcacttg

SEQ ID NO: 21451 - DNA, 201 bp, Homo sapiens
gcactaagtcagcagatgtaaattatgtgctactgtagcatctcacctgcctcagggagttcagaggtcaactctggttcccaggtcccacctggggagakctctactttacatctgttttttttgttacctcatccaacccagtgaatgcctttaaatcagaactttatggagtgttggtatgtcttctgtgtatgacaa

SEQ ID NO: 21452 - DNA, 201 bp, Homo sapiens
actagtccatccttgtaaatgcagtgactaaaactcttttgttgactttgaaagcatgagaacgccgtgattcagttaaaatggatgagtttacttttgaragactcagtaaaacagagatctttcaaatgacggcaaggcgacctaactaacgatctcttttgtccaatggggatttgagggtaggagttgggggaaggg

SEQ ID NO: 21453 - DNA, 201 bp, Homo sapiens
atcaaaggcaagcaaagcaaaacaaatctatttagatatttattctaacatatggctgcactgtgagaagagggtttgagtcctcactccagcattaggtrttgcatggccagtcttggaggaagccataattgaacttaaagtgaaagagctaggattggaaatttgtctcgtgctgagaccttaaccattctctcctac

SEQ ID NO: 21454 - DNA, 201 bp, Homo sapiens
ccttccctctcttccatccacctgtcatgaaggtcctcagtccctgcttgcctccacctaccaggatctcagccttcgccctttctcctccatgaaactcwtgctgacaaatgtagctctcaggaacctgccactaatgcgagtgcctttatactggaccggctacggataactgtgctgcttttctcagaaaccctccgc

SEQ ID NO: 21455 - DNA, 201 bp, Homo sapiens
tccccaactggaagatgctaggtgagactgtctacactaagtgacttataaaaacccaaatggcttcaaggcaaaaggcaacctcatcatctgttttccayatccagcttcaagttttccttcctctgggtaacaataatctcctactttggactcattcctttcctgctgctcacccatcaggtaagacacctataatca

SEQ ID NO: 21456 - DNA, 201 bp, Homo sapiens
cttcatggactcggcatagcatctaaaggaaaggcaacaaagacagccaaacaggctacagattgcccaaggaatttgcaagtgcattaaaacctaaagtkttctccagacacaaataaaatggacagcaaaccatcctattaattcaagccaccaaaaactgtaccagggtagtggccctaagaatcaatatggatatct

SEQ ID NO: 21457 - DNA, 201 bp, Homo sapiens
tactacttgtgaaaagggtatgagtaaaaatcagtgtctcactataaaatatcaagccttgtgaagactaaattagaagatttatgaaacgctattttccrcaaatttccaaatactgtttgacttctacagcaaacaagaaagaaagcaaatctcttaaattactgccaaaaaaatataataataagaagaagaaacaag

SEQ ID NO: 21458 - DNA, 201 bp, Homo sapiens
tggatctactgtgtggatgctcagaggcagagagactgcaacagatttcttgttgctttgttgctactgcagatgaaacaagacaacggaagtgacagaakttttataagcttaagttgtcaaataaatttataatgttgctataaaattataagacacagggcaagattccaaatgtattgtacctctggctgatcctca

SEQ ID NO: 21459 - DNA, 201 bp, Homo sapiens
aattggggcatctcaacacctcaactccctgtgcaagaacagattttcaatgtctactgatgattttaaatggattaattcctctctttacttcttaaggscatgaagtttatgaaacaaaactatacagtaccagacgcttaacccacagagtgttaaaagtcaccttcaacacacaactaaacccccaaaaaagttatt

SEQ ID NO: 21460 - DNA, 201 bp, Homo sapiens
catggccatgttactaagacgaagtgcctgaaataaaagaggtaagtagagaattgtattcatgcagtgatactaagtcaggcttaggacacagcagacckgaggaagtctcgtgtgatgtcaagaccagatctaagcacaagcatccccacccccccactgccccctctctctgccccaccagcacctttagtggtggca

SEQ ID NO: 21461 - DNA, 201 bp, Homo sapiens
agatatccaggactgatttaatgacaagttctttagctcttgacactagcatctctatggcaacttctcagcaaagcaaccagaaatcccactccttctayaacagttaagaccacagcaaactatggtattatttatggcatatctcaatacaaaagcacaaataaaataagaaaatatcaaatcaggtcttatcattat

SEQ ID NO: 21462 - DNA, 201 bp, Homo sapiens
actattttcttaaataccattaaaaacaaccacaactagatttagaatataaagaaagcctgtatccgacgtggattccatttacatttttcttcagttargaaaattatatggaatatgactaaatggttcatttaaaaaatataagaattccctttctcaaatatattcttttctcctagatttaatttcatagatcca

SEQ ID NO: 21463 - DNA, 201 bp, Homo sapiens
aaccttgaaaaacaacttttccttttaagcaatctctccttcttaacaaagacataataaacacctgacaggtttgccattgatagctgttttctgtccawctgaagtgagagaagaacaatcagtaaaaaacaaaaacaaaattaacacacactttcatcccaaacaactagcacgggatcaggatatttacagaagaca

SEQ ID NO: 21464 - DNA, 201 bp, Homo sapiens
aaaaaaattggcaacctccggcataagtgggttaaaaaaggcctgaaagtcatcacagaagctttttactaaatgctaggttaagtttagagcttccactrtccaaaatacgaagatccacaagcagcacagacacaagaccaaaaaatgaaaagcatcttcattaaatcaactgtgaaactaacatttgttctaactcca

SEQ ID NO: 21465 - DNA, 201 bp, Homo sapiens
tccccagtctgcacaattctcacctcccctgcttggtcgtaactctgtgactctaccacaaaaataagcagatgcacaagaagtcagtttaaaattccacwtcctatttctcatttactctaggatctcaaaacaagaaaaacatcgcaacccaagtcatcttttcaaaaacaattttgtaaatgtcctatttcatagaaa

SEQ ID NO: 21466 - DNA, 201 bp, Homo sapiens
tgcacccttgcagcacagcaaccttcttgatttgctcaagagcaggggttctgacaggtctcaaagcactttgtttaatgaaacagaatcgaaaataccastgtgtcacatgtttcctaagacaggacactgtttcttgaaacttttactaaagtatgtttttcttttatttttttattttttattttttttgagaaggag

SEQ ID NO: 21467 - DNA, 201 bp, Homo sapiens
catccccggaagattctggagtgtagaaaccaatgcctgtacacatcactattctcctctcctgcactctctgtgtctgagtctggaggggctggagaccygctgtgaagagcttttttgagatggagtttcactcttgttgcgcaggctggagtgcagtggtgcaatctcagctcaccgcaacctccacctcccagattc

SEQ ID NO: 21468 - DNA, 201 bp, Homo sapiens
tttaaggaagaattacaggtgaccatgtgacatctggctaagtcccttaaatcaaactgcagttatcacatctgtagaatgagatacttccacatcaccaytgttggaaagagatcacgtagcctgcgtgtctttaatgccttataaacatacttcaaggattattcaggctatagctataacatattataaattcttgat

SEQ ID NO: 21469 - DNA, 201 bp, Homo sapiens
gaatcatctaatgttacttctttatttagagttcttttatgtacacaagcacacaactatttcttattaagaattcattcaaagtaatgcagggcacgttyctagaacctttcatccaaggatataaaagcactttacagacatgcccattatctctgctaagtaaacctcatttggcccatttttgagatgggcataacc

SEQ ID NO: 21470 - DNA, 201 bp, Homo sapiens
caaaagctatttgaaaatctctggataagccttgatggtgggtaggagagaccaaatcagagactcacaattcattcactatttcatctaccatttagctwtctgcaagagacaccagcacgagcttgagaatcccaccattttaaatggtttctagttttgctcatatttaatttagactcgtaaaagtgaataatgata

SEQ ID NO: 21471 - DNA, 201 bp, Homo sapiens
ctcagagcacaacatctatgctttgtcctgctccagctcacaggcctcagctgctacaggcacttccctttcagagatattagtcacagtggcattaattkgtcactacaaaaaagtcttgctgtttcccatttagatggtagatactgcatattttgaaaataatatagaaaatgaaacccatatttttaatggacagtc

SEQ ID NO: 21472 - DNA, 201 bp, Homo sapiens
cagaaccacaactccagactgcagatatgtaaactatcacttcatcctttacgtccaaaaggattattttttcccctttcacatatcttagtttggcttayttcaaaactaagttgttcaatctagtatacctcttcaggtttagtacttatacccctcttcaggtttagtactaaagcttttaatgaaactgtttccctt

SEQ ID NO: 21473 - DNA, 201 bp, Homo sapiens
tttcctaacaactacttctgattttacttctttttattcagttttggctgcaaaagagtgagccacatgcaaaacccagcttcccatcaaggccctggttyttagagcaggtttctgccccgccgggaggcctgggacccagcactggtgggctgcagccagaagggggcagcactcgacagctcagaaggctaggcccat

SEQ ID NO: 21474 - DNA, 201 bp, Homo sapiens
attgttgggatttgggatattcagaaacatttggaatttcacttttgtattagtaagaagcatacatgctttctgtttaagaacatggtaaatggaagacmaagtgaaaataacgttctctaccattctacttaacccaactgccaagcgtggggactgggatggattgtactgaacttcccataatgtgaaaacatagta

SEQ ID NO: 21475 - DNA, 201 bp, Homo sapiens
gttcttctgggtgcaccaggagggctacttgtaagtcgtgtattactgtgaccaggtgtagaggtggaataaaaggctgggcagatactcgggttgtaatwgaagttaacccaagtgaacgataactctacagtcaacacagaaattaagggcctgctgaaattaaatcagtcatactccagataggataaaaaaaatcat

SEQ ID NO: 21476 - DNA, 201 bp, Homo sapiens
gggcacatagaagtcacccagatttgtcacgtgaatgaacacatcctgtaaaaattacctattttaacatatttaaactccaaaatccattacgagtccaygatatcaacttctcagttacaaatataaatattaaataatttacagatataagtaagtctgcaatagcaaaagtttcctaaaggcctggattctgcaaat

SEQ ID NO: 21477 - DNA, 201 bp, Homo sapiens
taatcatagctcattgaaactcctgggctcaagcaaccctctcgcatagctgagactggaggtgcatgccatcatgcccggctaagtgagtaggatattarttatttctgcagcccaagttatgcggctgactcataaggagatgaaagcattgttcattgcaactagcaagtgaaggatctgacgactagccagagatgc

SEQ ID NO: 21478 - DNA, 201 bp, Homo sapiens
acagcttgcacaaagcaagatcctgtctcaaaaaaaaaaaaaaaaagttccttgccctgcctgaagttgaggagaccatttgtctacctcaagttattatytgcagaaaccacacccatattccttcctcctccacgtgcccctctccttaagagaaaggccgccaaacaaccaagagaagttcctacacccactgagtgt

SEQ ID NO: 21479 - DNA, 201 bp, Homo sapiens
ctagtacttgtttctctgggcattataatcattcctcaactctgacaatcgttcctaatctcacttgcattactttgaaattccaacctcaaagactcccygcaaactggtgtcaccatctctcttcctgctggtgccatcattagtacccagggaaggccctgcttgccttcagcttagttaagagtatatggctaggga

SEQ ID NO: 21480 - DNA, 201 bp, Homo sapiens
aacaaatttaatataaactccaaaatccatcttcagagacaagtctccatataaacataatacatggaaggttaagtgttccttcaaatgtgggcaatacyctcatgcaaatttttgtataaagtggatttttctcttttttttgagacagggtctcactctcttacccaggctggagtgcagtggcgcaatcatacctca

SEQ ID NO: 21481 - DNA, 201 bp, Homo sapiens
gtccatgatatcaacttctcagttacaaatataaatattaaataatttacagatataagtaagtctgcaatagcaaaagtttcctaaaggcctggattctkcaaatgggtttcagaaagagggtgcaaggacacacaccagtgcaaatgtgcattttctcgtaggtaagtgactgagtgctggggaggaaggaatggtgta

SEQ ID NO: 21482 - DNA, 201 bp, Homo sapiens
tgagtaggtttaatttttctaaatcatagaataggatactgaagcccagagtggtcatgtgtcttgcctaaggtcacacacagctaatatatacaagatcrtgggtcttctggctccagtctgaggctgtcacaataactagcttctcacttggtcctacctaagacacaggtgtcagcaactctaaattcaagaaattga

SEQ ID NO: 21483 - DNA, 201 bp, Homo sapiens
ttaaggtgcattctgaaatcggctctgggtgtactttattattccgagagagaaaggctagccgaaaaagctgttacctaagcagctttagcataattgckctctgcacagaagaaatctctagaaatccaattttctctttggataagactaaagaaccaattaagaaattgagctccaaattcctgtgatcacagccca

SEQ ID NO: 21484 - DNA, 201 bp, Homo sapiens
ggtaaatgaatatttatgaaatattggtcattatttataagaaaataaacccaggaaatatactaatttgccctggagttccaaactaaatgtgtacatgwccttatgcaataattttctggattacagagataataaaatatgttggtttactcctctttgggaggtgcttggaacaggaacaaacagtaagaagataga

SEQ ID NO: 21485 - DNA, 201 bp, Homo sapiens
ggtgcttggaacaggaacaaacagtaagaagatagactttgctgctattatactcaatgcaattaaatgaaaatcaaagaatcaaaatggccacaaacaakatggtgaaatgtgaactaagtgtcagatagttacaaaatttgtgacacattaaaataagttcatgtttaaaacaaacaaacaggccaggcacgatggctc

SEQ ID NO: 21486 - DNA, 201 bp, Homo sapiens
ccctgttttataaatgagacctaggctggtgagaagaccttccctccaatacctgctggtctatccagcaggactgctgctggggtctctgtctttctcckaaatcccagcccagcacacccttctttcctctgcagcttctctccagaagcccgtgtctgtgcccctcctcccaccccagcaccctctcagccgcaggac

SEQ ID NO: 21487 - DNA, 201 bp, Homo sapiens
atttgcaaatgggacctacacagtgtgtggtagctacctcagtgccttcctctagctcaacagcattcacctagagtgcttttttctagtgggatgttcayagagctgtctgtcaatgcttgaagtgtattagagctgggcacggtggctcatgcctgcaatcccagcactttgggaggccaaggcgggcagatcacttga

SEQ ID NO: 21488 - DNA, 201 bp, Homo sapiens
aaaacacaaagttctaaaggaagaaaaaacaaacaaataaacaaaacaaaacaaaacctccaacaatgacttcaacaccaccatgaaggagtttaccataygagcgccaacgctttcttaccagtcatgcctggccatttgtttctcctttactgaaaatcactactgctgaactctaggcccaccctcccaccagaaact

SEQ ID NO: 21489 - DNA, 201 bp, Homo sapiens
tgggccccagacttttgctaaggttgctgcttctgtccatccagcatttggtgcccattatgtgtccatcaatgctgagctgcaccgtactggccttgctyggcaggaacaaaagtaccaccaggctcctgagacctggccggagggcttagtagcatttgcttaaatcaaggacagaagggaggacaccccagccacaca

SEQ ID NO: 21490 - DNA, 201 bp, Homo sapiens
aagaaagagggtatagtcaggtacctgggaagttggagagggtttggagaaagggacacagtttgagcaaactttaggaaaagaatttggagtttaccaaraagacaaaggaggaagaagggacaaattttccagaaaaatggagccacacagccaagacttattgcttggagacagcagagaaaatgctgcatggggtct

SEQ ID NO: 21491 - DNA, 201 bp, Homo sapiens
atcatacacacacacacacaccccctacaggaccccaatgactttatatgacaagaaagaaaacaaacagatatttaggcataattaacctggaaaacagkttgggctcataaaaatcccagaaattttatctatggcaattgattttttttatcctaattcaaagagcaatttatgaagaagatggtccctgcttatctg

SEQ ID NO: 21492 - DNA, 201 bp, Homo sapiens
gctgcacagtctttttatttggtaaaagttgtaagaaataacacagagttccgaggaacctgaacaaaccaccatgaaccatttcaacagaccacccttgragccatcaatccaaattaaagctagtcatgattcataaaaacatctcatttagttctcaagttaaacagacaaattattaaagaataagtgggaatgtaa

SEQ ID NO: 21493 - DNA, 201 bp, Homo sapiens
accagtgcaaatgtgcattttctcgtaggtaagtgactgagtgctggggaggaaggaatggtgtagcccaccgccagcacacttctcgtgtaacactccarcaattctgctcagaccccaaaacctgaatgcctaaaagaaaacaaaatccttccaaagttcaccagggcctctgtccttacaaagtttcccatggcctgg

SEQ ID NO: 21494 - DNA, 201 bp, Homo sapiens
ctcagacagaagttgcaagacaatgacagcagtcttttagccacgttagcaaatgatataaacccattagtaaatccaccggttcaattccactccaagakttcaaggcatctatgttaacaaagaattacagtaagatgggacatgttacatctgtgtagtgtggggaaaaaaaaaaaaaaaagatgggacacatgtgga

SEQ ID NO: 21495 - DNA, 201 bp, Homo sapiens
cccttgttggctttgaacatgaaaccaattttctacaccaaatcaggcctacttctttgtaaccatccttaccatctctcttataggaaaatgtttaggastcttggcggtgactctagaactaggaaatcaactctctcagcagcactctaatgagcaaaaacaactgtgcctcaaaatacaggctgcagtgggcagaaa

SEQ ID NO: 21496 - DNA, 201 bp, Homo sapiens
attatctgaggcattgccagggtggcaaaatcacatggatcagaaccaccgcactaaagttttttacagcctttctggacaggctatagaatcttaaatcraatgttgacctcagacagaagttgcaagacaatgacagcagtcttttagccacgttagcaaatgatataaacccattagtaaatccaccggttcaattcc

SEQ ID NO: 21497 - DNA, 201 bp, Homo sapiens
cattgccagggtggcaaaatcacatggatcagaaccaccgcactaaagttttttacagcctttctggacaggctatagaatcttaaatcaaatgttgaccycagacagaagttgcaagacaatgacagcagtcttttagccacgttagcaaatgatataaacccattagtaaatccaccggttcaattccactccaagagt

SEQ ID NO: 21498 - DNA, 201 bp, Homo sapiens
ctcagaaaaaaaaaaaaaaaaaaaaagaaatgggggaacaggggacaaaactagggttgagaaagatccagagataaggaagaaaaaaggtgaatctgggraaataataaccattaagactccagatatacctgaagtcctctctgaatcagtgcagtcctgactgcatgttagaatcacccaggagacttacacgctcac

SEQ ID NO: 21499 - DNA, 201 bp, Homo sapiens
ttgcccagtctcaggtatgtctttatcagcagcgtgaaaacagactcatacaactaacaagcctgctttagcttttcactgttctgcccaagcaactttcyccttcagccaggccagtagatttctcatacagcagggtgaccctgttcagggcctttgtactgtttatattttttactttgtgcatactatgatgtcttg

SEQ ID NO: 21500 - DNA, 201 bp, Homo sapiens
ttctgagataatttcacagggatattaattcaagacagaggtgtcacaagtgacataaacaggtattcatttttccagacttctatcatttaagatgacayattctttggtagagaaacttccaaatattaaatacctgactatattttgtctctctcacacacatacacacacacacacgtgtatgtgtgtatgtgtgtg

SEQ ID NO: 21501 - DNA, 201 bp, Homo sapiens
tttgtgttctgcgttcccaggaagttctccctggacgacctgctgaccaacgtcatgctctactggacaacaggcaccatcatctcctcccagcgcttctmcaaggagaacctgggacagggctggatgacccagaagcatgagcggtgagcctggctgagccgagaacaggggcctctgaggctggaggcagggggacgg

SEQ ID NO: 21502 - DNA, 201 bp, Homo sapiens
ggttctccatccatcagtgctcctctgtgcgaccctactcctccttcctcggccagcaccacctgtggccccagcctctctcctctttgccaatggctcarggacctgctgggtctaggggagcagccctctcccacagaaaccctggaggttgtgggctcacggtagggccccaagcaaaggacttcacctgggccccaa

SEQ ID NO: 21503 - DNA, 201 bp, Homo sapiens
cctcttcagaggatgacgaaagccctcagtatctaaagcaaccagtctgaagccaacaaggttcatagccttggcccaacagaagccctgagggagctgarcatctgagcctgggtttttgtttttgttttttgttttgtgagcacaatgagggtagcgaggctgacctcatgggtctgtggtgaagagcaaagagaacag

SEQ ID NO: 21504 - DNA, 201 bp, Homo sapiens
ctaaccagattaaataaccttctctgctccctatacaaaaccaatgactgatgccatggcaagactgaacaccgaaggcctggagtcctggccggcgggcrggggggggggtgccctgcctgctcagctcccactgtccagctgcagcatatcagggctccactgtgtgtgtccacaatcctgctgtttgttactgggatt

SEQ ID NO: 21505 - DNA, 201 bp, Homo sapiens
gccacagaggagaaagtaaagggggtggtctagggtagggacggggagggagtcaggagtcccagggcctcctcagggacctctgggtcccctagctctgygctttcacacacacatacccctcctgggtaccatcagtctaactgcaaggcccagcatttccaaagcaaacactgctccaggctgggttgttgacctttc

SEQ ID NO: 21506 - DNA, 201 bp, Homo sapiens
tctaagtggtgatgggagagcagggtggaggaggactttggaaataggagatgcgtggctccccgcctcccaaggtccttcccatccctcccagcctgccytgcttcactcagtgcacccagccctcccgaggcatggtgatgcgtgtttgctcgtgctcccttcgttccacccaacaggcatgtgagcccctggagggaa

SEQ ID NO: 21507 - DNA, 201 bp, Homo sapiens
tttctggctgccctttgtcacacaactgcatgtggcactgagagtggggctttgtgttctgcgttcccaggaagttctccctggacgacctgctgaccaaygtcatgctctactggacaacaggcaccatcatctcctcccagcgcttctacaaggagaacctgggacagggctggatgacccagaagcatgagcggtgag

SEQ ID NO: 21508 - DNA, 201 bp, Homo sapiens; identical to SEQ ID NO: 4728

SEQ ID NO: 21509 - DNA, 201 bp, Homo sapiens
gaggggcgcagggccacagcctcacccctccgtcggctctttcacttccaggatgaaggtctatgtgcccactggcttctctgccttcccttttgagctaytgcacacgcctgaaaagtgggtgaggttcaagtacccaaagctcatctcctattcctacatggttcgtgggggccactttgcggcctttgaggagccgga

SEQ ID NO: 21510 - DNA, 201 bp, Homo sapiens
tgctgctgcggagacagtgctgtcctctccgaggccaagccgttcagaatccgaggcacgtagggctgtcagcaaatggatttgtgcttggcctggacagscatgagcttccacactgcatccctcccctcctgcccttctcccaacaggacacagacagtggccataaaggacatatgaagaaacaccgacatccattta

SEQ ID NO: 21511 - DNA, 201 bp, Homo sapiens
gcccattccagggacacacacacacacactatacacacatatatgcacacacgcacatatacacactcacgcacatatacacactcacacgtacgcacacrcatgctcacagcctaggcgatatgtctttacctgtctgcttctgacaccagggcaatgcggccatagtcccagaatcttcttcttataatagaaaacacc

SEQ ID NO: 21512 - DNA, 201 bp, Homo sapiens
cattcctgcggtcagcagccgtcttggccatgatcatgcggaaggtatagaggatgagacctggcagccgcagcagctccatgccattgccgatgaaggcygaggcgatgacatagttcacaaagaaggcaccctggtcaggcaggaagacgcacctggggaaaccagggcccaggtctgtgagctgagagccgctcttgg

SEQ ID NO: 21513 - DNA, 201 bp, Homo sapiens
catccatgcatacatggctccaaactcgtactggaaggcctggttctgggaggaggaggtggtgaggagctcatggacttgttccacctcaaacacccttytgtgctctctaagtggtgatgggagagcagggtggaggaggactttggaaataggagatgcgtggctccccgcctcccaaggtccttcccatccctccca

SEQ ID NO: 21514 - DNA, 201 bp, Homo sapiens
ttcagtccctgcacagctgataaaggcactatcttctctccagggatgtatgggacaattgaccaggccttcacaagggttacacctgcactcgggctagsttaggagccaggctgtcaacaccacacccaaccagcccctcaccctgggtatcatgttttgattggacacctaaccagtcctcactctgggcaccacatt

SEQ ID NO: 21515 - DNA, 201 bp, Homo sapiens
ggagtcgttgggccggtccccgagtcccagctgctccctgatggacactgccttggactgccacagctccaggaacggggagtccatcatcgcgcctgtcytccctggagcacaggacaacaggacaaggcagacgttcagggctcaaatttcttgcaggttcccaccagtgctggcagagccaaaggcaggcgtttccca

SEQ ID NO: 21516 - DNA, 201 bp, Homo sapiens
cgtgtttcttaaaaccctggcaaaacagtgtctgcctgtggcatgttcatgcccacagctcaacaacacactagctgcaaggggccttcagataccagccrgccccctttggagtacctctggcctgccccgggctcctgacctgccttctccttgatctcacccatcagcacctatccccacgggctccatactcactca

SEQ ID NO: 21517 - DNA, 201 bp, Homo sapiens
gccttgcagaacagttactcacattcagcgcatggatgggtttggtgacattaaacttgtccatggtggacaggatgatggagggtgtggtcaggaaaaayagccccaggaagagggtgaagttgatgcccagccactgtagccaccagcggaggccctggatagagaggttcttcctgcagcgggagaggggatacaggt

SEQ ID NO: 21518 - DNA, 201 bp, Homo sapiens
cccagtgaggcccctgccatgtgcccactgcctgagcagctggggggttagggtgtggacaagggagcggtcagagatatccttcttaggggcagggcctyggggctcccgggcactcacttggtccagtgagactccagcagtgtagagtagtagacaatggaggggagcagggccgagaaggaccagagcaggagggtg

SEQ ID NO: 21519 - DNA, 201 bp, Homo sapiens
ccgcttcacctgtcttctcaccccacaggctcccctgagcctggcccagccagcagctcacccagcctcaggcctcctggggggcagcagccacactgccygtggcgctctgcgccaagcactgtccagggatagtcccgctgatgttgtggatggcaccataggtctgctgctgctgctgctgcggagacagtgctgtcc

SEQ ID NO: 21520 - DNA, 201 bp, Homo sapiens
ccacctttctcaccctcccaaagtgctgggattacaggcatgagccaatgcccccagcctgttccagccatttttaatgactgtacagtattttggcttakgagtatatcaatatttgtaactgatcccctattttagacttttttaggtggcttctcatttttcatgaatcagagcacatagactgaaaaaccccgcctt

SEQ ID NO: 21521 - DNA, 201 bp, Homo sapiens
tccttaccgcaggtgatccacctttctcaccctcccaaagtgctgggattacaggcatgagccaatgcccccagcctgttccagccatttttaatgactgkacagtattttggcttatgagtatatcaatatttgtaactgatcccctattttagacttttttaggtggcttctcatttttcatgaatcagagcacataga

SEQ ID NO: 21522 - DNA, 201 bp, Homo sapiens
gctgctgcggagacagtgctgtcctctccgaggccaagccgttcagaatccgaggcacgtagggctgtcagcaaatggatttgtgcttggcctggacaggsatgagcttccacactgcatccctcccctcctgcccttctcccaacaggacacagacagtggccataaaggacatatgaagaaacaccgacatccatttag

SEQ ID NO: 21523 - DNA, 201 bp, Homo sapiens
aggaggccctgagcactgcccacccccacaccttggagggagcagacggagggggtgagtactgcacagagcctgcctggaggtgcagactcatgcactcrgccctgaagaggtgagagaggctggatcttaactgtggtccaatgggcatattatgagtggtccttgtccctgcctgctatggggtaaccctgacccagc

SEQ ID NO: 21524 - DNA, 201 bp, Homo sapiens
gagcaggaggtagacaggatcagatctgtgttctagaaagaacaggaatacactagggtggaaatggtggtcgtggtcgttttcaagctgcgggcagagcygaaagggagatggaagcacttggccaacttgcagaaatccagttcacagaggtgatgtgtatactggaactagttttcattgaccagttttcattttgcc

SEQ ID NO: 21525 - DNA, 201 bp, Homo sapiens
gacaatctcatataacctcttctccctccccacatcccctctccttcaaaagaacttgtgaacattttggtgagaattttcacaagtgaagtacgtccatmtcaccaacatggccccaacactccagatgcccctcggggttctctcccaggtaccacgctctgacttctgactgagatggttttgattgtgcctgtttaa

SEQ ID NO: 21526 - DNA, 201 bp, Homo sapiens
tgctctctaagtggtgatgggagagcagggtggaggaggactttggaaataggagatgcgtggctccccgcctcccaaggtccttcccatccctcccagcytgccctgcttcactcagtgcacccagccctcccgaggcatggtgatgcgtgtttgctcgtgctcccttcgttccacccaacaggcatgtgagcccctgga

SEQ ID NO: 21527 - DNA, 201 bp, Homo sapiens
caagttctctgcactgaccttcaactacagaaagaccaaatcttaggtccccaagagctcagagggaacaattattctctcagatgtggctccccagctaragtctgggggccagaacctacccaaagagatggcatgagcacccaagcaggccaaacaaggctccagcatggcatttattttttctttttctgttttttt

SEQ ID NO: 21528 - DNA, 201 bp, Homo sapiens
ccgagaaggaccagagcaggagggtggggaagaactggctgatgatcgggttctaggagaaaggtccacagcagagagagtcacaggggccgtgggccacrcggctctgaggccatgacctattggtatggtcgctcagtggactcccagggtaggagtttgtcatctctgaccccagaaccaaaactgtgccaggtacag

SEQ ID NO: 21529 - DNA, 201 bp, Homo sapiens
ggatgagacctggcagccgcagcagctccatgccattgccgatgaaggccgaggcgatgacatagttcacaaagaaggcaccctggtcaggcaggaagacrcacctggggaaaccagggcccaggtctgtgagctgagagccgctcttggagggagaggaggggcccctaggctgggcaggagcagaaagcccctgggagg

SEQ ID NO: 21530 - DNA, 201 bp, Homo sapiens
tctcacccatcagcacctatccccacgggctccatactcactcagtctgtaggtttgctattgttgtcctcccaaaactatacgggtctttgtctgcagaraagcacagatacttagttccagggtcatgtggggaagcaggagggggcgtaaccaatcagccttggtttgtggagctctggggaggaggagcatgtctgg

SEQ ID NO: 21531 - DNA, 201 bp, Homo sapiens
atagcacaaagtgggtcagctcccacagtgtctaccagaaacctggcagggtggaggtgaggccccaagccctgctgtctggggaggaagatgcctgttcrgaagcataggctacgaccgcccccacccatcccactgcagccccagcccctgtgggactttcacccagggccatggctccagaactcaacttggcaatac

SEQ ID NO: 21532 - DNA, 201 bp, Homo sapiens
agtccctcccagcacatgtccctaagtcccgcctcactcaccaggttctcctctttgtacttaatggactgagtgtggtgccgcatgaaacccacagtgargaagaggtaaatgacagcaaagatggtgtgcagccaaaggaggtcattgctgagagggaaaccacctgccatcagggctgggatcccaggcagggagctg

SEQ ID NO: 21533 - DNA, 201 bp, Homo sapiens
cccagggatggtgggtcagcagtaccatctccactcgagagggacagtgagttatctggaggggaacagggagtcagccaagaaggggtctggatgtgccyacactcactaggtggccatggacttctcctggaaggtgacgaaggccattcccaggggctggtcctggacgtggcgttcttcctctgtgatcctctccag

SEQ ID NO: 21534 - DNA, 201 bp, Homo sapiens
gaagaggtaaatgacagcaaagatggtgtgcagccaaaggaggtcattgctgagagggaaaccacctgccatcagggctgggatcccaggcagggagctgsgggtgcagagctggggcctggttaccctcagtgggcactgaactgaggaccaacagcttcactgcaagagatgcctcccacagaggttgtgtggccagca

SEQ ID NO: 21535 - DNA, 201 bp, Homo sapiens
tcccgctgatgttgtggatggcaccataggtctgctgctgctgctgctgcggagacagtgctgtcctctccgaggccaagccgttcagaatccgaggcacrtagggctgtcagcaaatggatttgtgcttggcctggacaggcatgagcttccacactgcatccctcccctcctgcccttctcccaacaggacacagacag

SEQ ID NO: 21536 - DNA, 201 bp, Homo sapiens
aagagtttatttccagcattccatattgtcactacacatgctttcattttcttttgctctaaaaacaggccaaagctcgagattgacttttgttctcaacratgccacttactacggcatgacctgtcacagtctgctttaacagaaacttccttccttgagataaataaagccatgatgaggccttccctaagtggaagg

SEQ ID NO: 21537 - DNA, 201 bp, Homo sapiens
agtgtcatgtgtgggtcctgcccacatggagggcttcataagcccctagcccattccagggacacacacacacacactatacacacatatatgcacacacrcacatatacacactcacgcacatatacacactcacacgtacgcacacgcatgctcacagcctaggcgatatgtctttacctgtctgcttctgacaccagg

SEQ ID NO: 21538 - DNA, 201 bp, Homo sapiens
aggttcatagccttggcccaacagaagccctgagggagctgagcatctgagcctgggtttttgtttttgttttttgttttgtgagcacaatgagggtagcraggctgacctcatgggtctgtggtgaagagcaaagagaacagctattggtacaggccaggtagatacacttaatgaacacaatctcatagcagtgtcatg

SEQ ID NO: 21539 - DNA, 201 bp, Homo sapiens
tgctgaccaacgtcatgctctactggacaacaggcaccatcatctcctcccagcgcttctacaaggagaacctgggacagggctggatgacccagaagcawgagcggtgagcctggctgagccgagaacaggggcctctgaggctggaggcagggggacggccagtcttgggctccacgaagggcacttggtggtgggata

SEQ ID NO: 21540 - DNA, 201 bp, Homo sapiens
agccgagaacaggggcctctgaggctggaggcagggggacggccagtcttgggctccacgaagggcacttggtggtgggataagtatagccttgcctgcargtgccccaggggcccttggatgggaacactaaaggtcgaggtgtttggagaaagccctcatggagggaccaggtgcctggctcccgggcggccctcagta

SEQ ID NO: 21541 - DNA, 201 bp, Homo sapiens
agcttcagtaaagggtttggctgaaggcagctgaattctcttaaaagcttagggtgcagatacataggaatgtgggggagtttacctaaatagcttgtttmctcatgtggtcctaagaccaacctttgatcatccactggtgcatgattgctcgctattcagggggtcggcaatgttaattaccctctagtggtgtttact

SEQ ID NO: 21542 - DNA, 201 bp, Homo sapiens
cagtgtatgtctgtctgtctgtttttttgagacagagtctctgttgcccaggctggagtgcagtggtgcgatctcggctcactgcaagctccgcctcctgrgttcatgccattcttctgcctcagcctctcaagtagctgggactacgggcgcctgacaccatgcccggctaattttttatatttttagtagagatagggt

SEQ ID NO: 21543 - DNA, 201 bp, Homo sapiens
gccattcttctgcctcagcctctcaagtagctgggactacgggcgcctgacaccatgcccggctaattttttatatttttagtagagatagggtttcaccwtgttaaccaggatggtctcgatctcctgacctcgtgatccgcccacctttgcctcccaaagtgctgggattacaggcgagagccaccgcacccggcagtg

SEQ ID NO: 21544 - DNA, 201 bp, Homo sapiens
ctgactaaccagattaaataaccttctctgctccctatacaaaaccaatgactgatgccatggcaagactgaacaccgaaggcctggagtcctggccggcgggcgggggggggggtgccctgcctgctcagctcccactgtccagctgcagcatatcagggctccactgtgtgtgtccacaatcctgctgtttgttactgg

SEQ ID NO: 21545 - DNA, 201 bp, Homo sapiens
tgactaaccagattaaataaccttctctgctccctatacaaaaccaatgactgatgccatggcaagactgaacaccgaaggcctggagtcctggccggcgggcgggggggggggtgccctgcctgctcagctcccactgtccagctgcagcatatcagggctccactgtgtgtgtccacaatcctgctgtttgttactggg

SEQ ID NO: 21546 - DNA, 201 bp, Homo sapiens
actaaccagattaaataaccttctctgctccctatacaaaaccaatgactgatgccatggcaagactgaacaccgaaggcctggagtcctggccggcgggygggggggggggtgccctgcctgctcagctcccactgtccagctgcagcatatcagggctccactgtgtgtgtccacaatcctgctgtttgttactgggat

SEQ ID NO: 21547 - DNA, 201 bp, Homo sapiens
taaccagattaaataaccttctctgctccctatacaaaaccaatgactgatgccatggcaagactgaacaccgaaggcctggagtcctggccggcgggcgkgggggggggtgccctgcctgctcagctcccactgtccagctgcagcatatcagggctccactgtgtgtgtccacaatcctgctgtttgttactgggatta

SEQ ID NO: 21548 - DNA, 201 bp, Homo sapiens
ttgagtagatgccagttgagtgagtgtttggctgttatctcattgattcatctaagatttttgaaaatcgttcattacctatacagaatagtttttttttktttttttttttttttttgagatggagtttcgctcttgtcgcccaggctggagtgcagtggtgcaatctcggcttactgcaacctccacctcccggttcaa

SEQ ID NO: 21549 - DNA, 201 bp, Homo sapiens
tgagtagatgccagttgagtgagtgtttggctgttatctcattgattcatctaagatttttgaaaatcgttcattacctatacagaatagtttttttttgtttttttttttttttttgagatggagtttcgctcttgtcgcccaggctggagtgcagtggtgcaatctcggcttactgcaacctccacctcccggttcaag

SEQ ID NO: 21550 - DNA, 201 bp, Homo sapiens
tgaatataccacattcaactcaaatgatccctaccattcagtatttagatagtctattaaaatatatatgtatgcatgtgtgtgtatatatacatataatgtgtgtgtgtgtgtgtgtgtgtgtgtgtgtgtgtgtgtgtgtatggcattactataaggactttgtaataaatgtggccatgcctgctcagggcttaaaag

SEQ ID NO: 21551 - DNA, 201 bp, Homo sapiens
gaatataccacattcaactcaaatgatccctaccattcagtatttagatagtctattaaaatatatatgtatgcatgtgtgtgtatatatacatataatgtgtgtgtgtgtgtgtgtgtgtgtgtgtgtgtgtgtgtgtgtatggcattactataaggactttgtaataaatgtggccatgcctgctcagggcttaaaagc

SEQ ID NO: 21552 - DNA, 201 bp, Homo sapiens
cacctttgcactgaaggctctgacacttgcaggcattgaaatctttcaggatgctgcaaggaaatgtagcaacagccaggcccaggctactcaggttaccaagcacacatgtggcaagtggggactgagtaggagtgggaggcagtggcataggacctttgctttgttgtgattagtgtattatgagtaacgctatgtaag

SEQ ID NO: 21553 - DNA, 201 bp, Homo sapiens
gggggaaattttgaaatttaatacaaagagggcttttgttttgttttgttttgtttagagacagggtctcactctgtcacccaggctgctgtacagtggcrcaatcatggctcactgcagcctcaaccttctgggctcaatcaatcctcccacctcagcctcctgagtagctggggctacaggcacatgccaccaggctga

SEQ ID NO: 21554 - DNA, 201 bp, Homo sapiens
ttaatacaaagagggcttttgttttgttttgttttgtttagagacagggtctcactctgtcacccaggctgctgtacagtggcgcaatcatggctcactgyagcctcaaccttctgggctcaatcaatcctcccacctcagcctcctgagtagctggggctacaggcacatgccaccaggctgatttttattttttgtaga

SEQ ID NO: 21555 - DNA, 201 bp, Homo sapiens
aagatgccttaagtccaggagttgaggccgcagtaagctattattgcactactgaactctagcctgggcaacagagcaagaccctgtctctaaaaaaatargattacaaaaaaaggaatgaagaaagaataaaatgtcagctcctcagcccagccttcaggtcctccagcatggggtcctgggagccttcccggactgctt

SEQ ID NO: 21556 - DNA, 201 bp, Homo sapiens
ggtgatcttggctcactgcgacctccgccttccggtttcaagcgattctcctgcctcagcctcccgagtagctgggattacaggcacccgccaccaagccyggctaatttttgtatttttagtagagacggagtttcaccatgttggccaggctggtcttgaactcctgacctcgtgatctgcctgcctcagcctcccaaa

SEQ ID NO: 21557 - DNA, 201 bp, Homo sapiens
tagctgacaacattttcttgttcttagtgctatataaaataacatgcacctgggccgggcgcggtggctcatgcctataatcccagcactttgggaggccraggcaggcagatcacctgaggtcgggagttggagatccacgtgaccaacatggagaaaccctgtctctactaaaaatacaaaaatattagctgggcatgg

SEQ ID NO: 21558 - DNA, 201 bp, Homo sapiens
taacatgcacctgggccgggcgcggtggctcatgcctataatcccagcactttgggaggccaaggcaggcagatcacctgaggtcgggagttggagatccrcgtgaccaacatggagaaaccctgtctctactaaaaatacaaaaatattagctgggcatggtggcgcatgcctgtaatctcagctactctggaggctgag

SEQ ID NO: 21559 - DNA, 201 bp, Homo sapiens
tactaaaaatacaaaaatattagctgggcatggtggcgcatgcctgtaatctcagctactctggaggctgaggcaggagaattgcttgaacccgggaggcrgaggctgcggtgagccgagatcgtgccattgcactccagcctgggcgacaagagcgaaactcggtctgaaaaaaaaaaaaaacatgcatcttacaacaat

SEQ ID NO: 21560 - DNA, 201 bp, Homo sapiens
cattttaatcagatcctttcttgcgagtacccccataaaaacaccccatgcgctataaatctgaggtgtttgcaatacgtatatgtgactgcttttcttctttttttttttttttttttttgagacagagtctggctctgtcacccaagctggaagtgcagtggggtgatcttggctcactgcaagctctgccacccgggt

SEQ ID NO: 21561 - DNA, 201 bp, Homo sapiens
attttaatcagatcctttcttgcgagtacccccataaaaacaccccatgcgctataaatctgaggtgtttgcaatacgtatatgtgactgcttttcttctttttttttttttttttttttgagacagagtctggctctgtcacccaagctggaagtgcagtggggtgatcttggctcactgcaagctctgccacccgggtt

SEQ ID NO: 21562 - DNA, 201 bp, Homo sapiens
ttttaatcagatcctttcttgcgagtacccccataaaaacaccccatgcgctataaatctgaggtgtttgcaatacgtatatgtgactgcttttcttctttttttttttttttttttttgagacagagtctggctctgtcacccaagctggaagtgcagtggggtgatcttggctcactgcaagctctgccacccgggttc

SEQ ID NO: 21563 - DNA, 201 bp, Homo sapiens
agcgctgacgccaagcttgcctggagcctgcctagttctgcacgtcagccctgtctcttgctctcaaggcagcggtaacaccacaaggcccagtctcgggccctgctctgccttcagtggccccgagcaggagggtaaggtctggccccagagcagccccaggaaccagcatccttcttcactttacagaaaatttttttc

SEQ ID NO: 21564 - DNA, 201 bp, Homo sapiens
ccatggggcatctttgtgaacaaggagatctacgttaaagaaaggccacctgctgaaggtacgctctaagaatcagcttctaattcttttttttgtttttttttttttttgagacagcgtctcgctcttgttgcacaggctggagtgcagtggcgtgatctcggctcattgcaactctgcctcccaggttcaagcaattct

SEQ ID NO: 21565 - DNA, 201 bp, Homo sapiens
catggggcatctttgtgaacaaggagatctacgttaaagaaaggccacctgctgaaggtacgctctaagaatcagcttctaattcttttttttgtttttttttttttttgagacagcgtctcgctcttgttgcacaggctggagtgcagtggcgtgatctcggctcattgcaactctgcctcccaggttcaagcaattctc

SEQ ID NO: 21566 - DNA, 201 bp, Homo sapiens
catgccctgctaatttttttgtatttttaatagagatggggtttcaccatgtcagccaggatagtctcgaactccttaccgcaggtgatccacctttctcrccctcccaaagtgctgggattacaggcatgagccaatgcccccagcctgttccagccatttttaatgactgtacagtattttggcttatgagtatatcaa

SEQ ID NO: 21567 - DNA, 201 bp, Homo sapiens; identical to SEQ ID NO: 4737

SEQ ID NO: 21568 - DNA, 201 bp, Homo sapiens; identical to SEQ ID NO: 4738

SEQ ID NO: 21569 - DNA, 201 bp, Homo sapiens
cctggatcctaggaggatttctcactttgtagaagaaacaagtctacctatataggggggcttagaacgctgccctgggacccctgggatgctcaacatawctgtgtgagtctcattttgagtctcatttcctcccaatcccaggctccagccactgaccccaggcacagagccctgccatactcctcctgagaccctggc

SEQ ID NO: 21570 - DNA, 201 bp, Homo sapiens
tgtgtgccctccagcatggaggctccaatcctacaggcctccttcctctgcccctgaccccaggggctgcctggtcaccttgattctcagccctcacatastgctttggacattaactaaaaagtatctaagagacaccatcttaagatcaagcatcttggctcttgcctcttgactggccaaacacccaaaaaaaccagc

SEQ ID NO: 21571 - DNA, 201 bp, Homo sapiens
tcctgcctcagatgccttcccctttcctcctgccccagtgtctgcaaggaggcaggaagtcctgtgtgagtccattcctagtgtcacaatgcctggggcartggctggacacctttccacacccctctcccgacccaccctgtgctgctcctaaggcgagatgacactgagaccacaggcatgagagcctagagtcccatg

SEQ ID NO: 21572 - DNA, 201 bp, Homo sapiens
ctactaaaaatacaaaaagttaggcaggcatggtggcgggcacctgtaatcccagctactcaggaggctgagatgggaggatggcttgagcccaggaggtrggggttgcagtaagccaagatcatgccactccagcctgggcatcagcatgagaccctgtctcaaaacaaaaaaagaaagaaatgagtgaaatctggtgtc

SEQ ID NO: 21573 - DNA, 201 bp, Homo sapiens
caccagtgctggcagagccaaaggcaggcgtttcccagggactgatcgggcagtaagccagcagcaaggagtccgggagagccagacattggacctctgcrtgcctggcagtgtccacagagaatggctgcattgtgggacaatctcaggggatcagatggtcagagtggatggctcatccagaacacagtgggcagatcc

SEQ ID NO: 21574 - DNA, 201 bp, Homo sapiens
agaccctagccctgtgggtccatacaaatgctcagctcacgtctctcttattctgcaaaggtgatgctaagaaccccggggtcaacaattttttcccccgkatgctctcaagacgtttattcgcacctacaccctggtctgtgctctggacactgtgcacaggctgcttgaagaggataggccaccagggcgctattcact

SEQ ID NO: 21575 - DNA, 201 bp, Homo sapiens
aggccgggcatggtggctcacgcctgtaatcccagcactttgggagggcaaggcaggaggatcacttgagcccagcaattcgagaccagcctgggcaacayagcaagactctatctccataaaaaatttaaaaattagctgggtgtggtgccatgtgtctgcagtcccagctacttgggaggctgaggcaggaagatgcct

SEQ ID NO: 21576 - DNA, 201 bp, Homo sapiens
tgtgcacagctggcaggagcactggccacctcccaacctgttccccatagcttactcctggatgtagcctggagggactgctgggctggggagggactggycatggagcagggagctggatgccagcgggacctcagacctggactgcagcatctctttggttatcggttgtgtgtgtgctcagaagggaggaggccttcc

SEQ ID NO: 21577 - DNA, 201 bp, Homo sapiens
gggcagggaggggccaccacctaccctcaccctgctgaggaaggggccgcacctggtgtggaaactgcccgtgacttctccctcaggcagaaaataaaggyaaggcctaaccccccacccccacccctcaactccagcagcaaggatggtgtcttcacagccaggaacacacagagggacccactgaatgactggcatcat

SEQ ID NO: 21578 - DNA, 201 bp, Homo sapiens
tttggtgcaatcagccgtccatgtacccatgtaccctgggacaggctccagggccactcaccaaatggcgcgatgatgggacaagtgatgctgtaggccaygatgacagtgaagacacacagcatccatgcatacatggctccaaactcgtactggaaggcctggttctgggaggaggaggtggtgaggagctcatggact

SEQ ID NO: 21579 - DNA, 201 bp, Homo sapiens
cgtggctccccgcctcccaaggtccttcccatccctcccagcctgccctgcttcactcagtgcacccagccctcccgaggcatggtgatgcgtgtttgctmgtgctcccttcgttccacccaacaggcatgtgagcccctggagggaagaggtggtcagggaagaggtgtagagtgactccagcccttctagcaggggatc

SEQ ID NO: 21580 - DNA, 201 bp, Homo sapiens
tccacctcccggttcaagcgattctcctgcctcagcctcctgactatctgggattataagcgcccaccaacacgcccagctaatttttgtattttcagtaragatggggttgtgccatgttggccaggctagtctcgaactcctgacctcaggtgatccgcccaccttggcctcccaaaatgctgggattacaggcgtgag

SEQ ID NO: 21581 - DNA, 201 bp, Homo sapiens
agtgctgggattacaggtgtgagcaccacgcccggccccagcgtggcatttcttagacacatctgcaatgctttgtgactaacgacacattcttcccaacrgggctgtagctggggtacaggaaggaggaaggcagggacaaaggagtgaaggcatagcttgcacctgccctggcctctcatcccaaagaacagacccaca

SEQ ID NO: 21582 - DNA, 201 bp, Homo sapiens
gcacagctgcacatcaaccacctcacacgtgggatacgcgtccctgtggccagggagagaaggaggcaaaagacaccgttggaaaagaaaacaccccaagmaggagacgtgcccacggatccaagggaaaggatggcagagtgatctcgctgctggtttctgtgccagcggagacctctcttctctttgtcttttatcctc

SEQ ID NO: 21583 - DNA, 201 bp, Homo sapiens
aagccagtgtgccggtatgctcaggtttcctacccaactccagcctctggaaagtaaacaacaggaaatcagaaggctccagttttctccttctgtggccrggggagcccccaaagcatgtcatttacacagcgtcttcttccaggctgtacaaagaatccacttccaaagcaactctatgagccttctttgcatggcagg

SEQ ID NO: 21584 - DNA, 201 bp, Homo sapiens
ctcctggggttctggtctaccacagtgagccctttccctaggactgccactctgccccattacaacatagacaagggtgaggagggtcattacccagcaartcccctgagaggttgacaggcaggatgacacacagggacaaaaagctgaccaccaccaacaggaagatgatgtgcctctggaaggacaggtagtggatgg

SEQ ID NO: 21585 - DNA, 201 bp, Homo sapiens
cacagtgagactccatctcaaaaaagaaaaaaaaaaaaagaataaagttgggaatatgcccaggccccaggcccccacctgtttcctgtctccccctcagrtggagacctgaggtggagccaagagtcccagtccatcctaccaccctggcctcctccctgtgtccccagagatggggaggtgacttgctccaccctttcc

SEQ ID NO: 21586 - DNA, 201 bp, Homo sapiens
tccctgaaggcgctacttctaggctgggaaagcagtgctttgggaagagctcaggggggcaagggctgcatcataaaaaggcagatgtgaaagatgtcagygtgggctttgcagtcagaccacagtgtaatccagcgcagcggcctccacctgagggcaggtcatggagcttacccgcctctgacctcgagcaaggaaact

SEQ ID NO: 21587 - DNA, 201 bp, Homo sapiens
ctgtctctactaaaaatacaaaaatattagctgggcatggtggcgcatgcctgtaatctcagctactctggaggctgaggcaggagaattgcttgaacccrggaggcggaggctgcggtgagccgagatcgtgccattgcactccagcctgggcgacaagagcgaaactcggtctgaaaaaaaaaaaaaacatgcatctta

SEQ ID NO: 21588 - DNA, 201 bp, Homo sapiens
tgaaaaaaaaaaaaaacatgcatcttacaacaataacttcttagattcaatggaatatggcagcaggtgagaaccaagactcacatcagtccccgcccccsccgcctcctggctccctacaccacatgagaggtaactaactggctcttaatcacctttaataatcttttagctttctctccatgggccccattgaaaaaa

SEQ ID NO: 21589 - DNA, 201 bp, Homo sapiens
tatgatttccactgaatatgttgaaataaataaagttcatctctatcttcaagaactcttgggatccagctcaatttgggaagccccaggctccagcaggsactgtgtgccctccagcatggaggctccaatcctacaggcctccttcctctgcccctgaccccaggggctgcctggtcaccttgattctcagccctcaca

SEQ ID NO: 21590 - DNA, 201 bp, Homo sapiens
agtacttcacaatatacaccacatgcctggaactcttgctaaaatctcctgacaacttcgtggtcaaatcacaaaacttagatcaaaagctgatgaaagckcagggcagctctgggcaaagtgatgtgggctgctgtttgattgtttacaatcactgaccaagaggtgaggcaaaagagaggaaacaagcctaatggattg

SEQ ID NO: 21591 - DNA, 201 bp, Homo sapiens
ggcccagcttctgattctttaaaaaccccagggatgccagaggggaacaggaggtgacacttgggaactgcagctgctctattctagtccgtactctccaktcacatgtctcaaccccttgagatgacccttcccaagggccttaaagatacgacaggctgagagctctgcaatcacggtagtaatcacaggcatagctat

SEQ ID NO: 21592 - DNA, 201 bp, Homo sapiens
tcacatgtctcaaccccttgagatgacccttcccaagggccttaaagatacgacaggctgagagctctgcaatcacggtagtaatcacaggcatagctatrtgagtattctggccttatccaaattccaaaattctctgagataggaattatgatctccatttccggagcagaaaggggaggtgcacagaagctaagtaac

SEQ ID NO: 21593 - DNA, 201 bp, Homo sapiens
aacaggacaaggcagacgttcagggctcaaatttcttgcaggttcccaccagtgctggcagagccaaaggcaggcgtttcccagggactgatcgggcagtragccagcagcaaggagtccgggagagccagacattggacctctgcgtgcctggcagtgtccacagagaatggctgcattgtgggacaatctcaggggatc

SEQ ID NO: 21594 - DNA, 201 bp, Homo sapiens
agacattggacctctgcgtgcctggcagtgtccacagagaatggctgcattgtgggacaatctcaggggatcagatggtcagagtggatggctcatccagracacagtgggcagatccccagagggggcgacatggagcaaaggagggacagagttgctgcagctgctgtcttaagaagtcctaaagttcctctagcctcg

SEQ ID NO: 21595 - DNA, 201 bp, Homo sapiens
aagtcactcctgcagaagccactggcggatctagagtacaggcagaggagagggagaaaggcacacaaaggcaggaagaggaaaacaccgggataaacaamcagggaagaagggaacatccaagtattcacgatggtccatccacgagccacagacaacacctcactcccactgctcacagaatgtcagagctgggacctc

SEQ ID NO: 21596 - DNA, 201 bp, Homo sapiens
ggcctctgcggagggaaacacctgcggctcctcttccccctccctccagccccagtcatgcctctaagttacttgtctcttgccaaataggcttcccaggrtggtttgacaaagtttgatatgaactcagggaggtggctagcaaatactatcagcctgagacagaggtaaggtcaggtggccagtcctgtctgccctctc

SEQ ID NO: 21597 - DNA, 201 bp, Homo sapiens
ctaagttacttgtctcttgccaaataggcttcccagggtggtttgacaaagtttgatatgaactcagggaggtggctagcaaatactatcagcctgagacrgaggtaaggtcaggtggccagtcctgtctgccctctccgatgagcacccaggttagggtagagctctggggacccacaatctctctcagacctttcagct

SEQ ID NO: 21598 - DNA, 201 bp, Homo sapiens
aagccggagaggaaagtcctgaaaagccgccaggaattcccaaggagcgcagggctggaatggaggcgctgcccggaccctctcctcccacccaatcccgmgtcgtcaccccctgcttggggtcgggggctctggggtctgcgtaggctgggagccgttccggaaccggacacctggcgcgcacgtcccgggaaaggcgga

SEQ ID NO: 21599 - DNA, 201 bp, Homo sapiens
tgccgcacaggccacatgtcaggaggcgcccgagagtggagggtctgccagagcccctctggggctctgggtggcagctggggccagtccctgagttttcrtcactcacttcctattaccacatctgacacaagatcctgggtgcaaacagccagctggagctggaacgtcaggttgtgcagatccagaattcactgtcac

SEQ ID NO: 21600 - DNA, 201 bp, Homo sapiens
ctgcactagtgggtagtcaggtaaatgctacccactagtgggggtagtgggggtgagaggccctcgggtcagtgaagggggacatgggagggagtcagagrcacagccctgggcccaggggatggcacctgcttgacattcctgcggtcagcagccgtcttggccatgatcatgcggaaggtatagaggatgagacctggc

SEQ ID NO: 21601 - DNA, 201 bp, Homo sapiens
acctttgcggatttggtttcttagcagagctcgcctcaccctttccgcccccgcccttccccccagtccccgagtccccagcctccctcctcaggactcckccaaggctgcaggaagtggtcacccaggaacagcccgaggggtggcctctgccttcctggcgtcaggagagtcggacgcttggccctttcccagcccggc

SEQ ID NO: 21602 - DNA, 201 bp, Homo sapiens
tcggctctttcacttccaggatgaaggtctatgtgcccactggcttctctgccttcccttttgagctattgcacacgcctgaaaagtgggtgaggttcaartacccaaagctcatctcctattcctacatggttcgtgggggccactttgcggcctttgaggagccggagctgctcgcccaggacatccgcaagttcctgt

SEQ ID NO: 21603 - DNA, 201 bp, Homo sapiens; identical to SEQ ID NO: 4734

SEQ ID NO: 21604 - DNA, 201 bp, Homo sapiens; identical to SEQ ID NO: 4735

SEQ ID NO: 21605 - DNA, 201 bp, Homo sapiens
attataaaatacatgttgtcaaaaagcttaaaaatgcaaaaagtacaaaacattaaagacaatctcatataacctcttctccctccccacatcccctctcyttcaaaagaacttgtgaacattttggtgagaattttcacaagtgaagtacgtccatatcaccaacatggccccaacactccagatgcccctcggggttct

SEQ ID NO: 21606 - DNA, 201 bp, Homo sapiens
aaaatcacattgaaaaggctgttccctttatctctgtccctgctccctgctgctgttgctagagattcagggtttgagtgaggaaggtagggttgggaggrcgtgctctggggaaagtggaaggtggggtgggggctgtggagtatgcatcctggacccaagctggctaggtttggattctccacttaataagtaaaatgg

SEQ ID NO: 21607 - DNA, 201 bp, Homo sapiens
ttgtggatggcaccataggtctgctgctgctgctgctgcggagacagtgctgtcctctccgaggccaagccgttcagaatccgaggcacgtagggctgtcrgcaaatggatttgtgcttggcctggacaggcatgagcttccacactgcatccctcccctcctgcccttctcccaacaggacacagacagtggccataaag

SEQ ID NO: 21608 - DNA, 201 bp, Homo sapiens
tctgtcctggccacggctgtcaggaaggctggtgactacagctctggaaccctggggctctgctttcccttcccagccccaccctaggagcaggaccctgraggctgtgtgcagagagaactaggaaggcaaggagccctgtgtctctctaccatggggtcttcctctgaagcaggtgcaatgttcatttcttgaattcaa

SEQ ID NO: 21609 - DNA, 201 bp, Homo sapiens
gggatggggctgtgagctggagacctcgcagggccacacagacacctctgtcctcttcctctccggggcggctattttggcaaggagccagggctggggckgctgctctactgcctgaacacaaaatgaggcatcctgcacctctggctactagttttttttcactttctctctcctacccacttcctcacttatctgtga

SEQ ID NO: 21610 - DNA, 201 bp, Homo sapiens
tgcgatctcggctcactgcaagctccgcctcctgggttcatgccattcttctgcctcagcctctcaagtagctgggactacgggcgcctgacaccatgccyggctaattttttatatttttagtagagatagggtttcaccatgttaaccaggatggtctcgatctcctgacctcgtgatccgcccacctttgcctcccaa

SEQ ID NO: 21611 - DNA, 201 bp, Homo sapiens
tgctgccttttctattatgccaggttcttttgtttttttattttttattttttttgagatggagtctcgctcattggtcaggctggagtgcactggtgcartcttggctcactgcaacctctgcctcctgagttcaagtgattctcctacctcagcctcccgagtagctgggattacaggcgcctgccaccatgcccagtt

SEQ ID NO: 21612 - DNA, 201 bp, Homo sapiens
gggggaatagaaacaggaactgccttgtaggatgaggtgagaaatgtggtaatccacgtggaggcaggcatctgccagagtgaaagcagcacgagagcttygattgtgactctggcactgtcttacttgctgctaaagaaatcaaccatgaacgacatagtcagtgggcagagaacctcagaccagaaatactaagagagg

SEQ ID NO: 21613 - DNA, 201 bp, Homo sapiens
catggcagaggagaataaaagagaaagccacaccctccagttcagggaatcctggaataaatgccacaagccgaaaatgcctttgacatctggggtttggytaagaatttatgcaaatgggtgcctacagaaaaagagtctgttggtttgagttgtatgtatgtatgtgtgcgatcaaaccgtttcaaatgccaaagtccc

SEQ ID NO: 21614 - DNA, 201 bp, Homo sapiens
ttgagaagcacttagcccagtgcctgcactagtgggtagtcaggtaaatgctacccactagtgggggtagtgggggtgagaggccctcgggtcagtgaagrgggacatgggagggagtcagaggcacagccctgggcccaggggatggcacctgcttgacattcctgcggtcagcagccgtcttggccatgatcatgcgga

SEQ ID NO: 21615 - DNA, 201 bp, Homo sapiens
cctgcactagtgggtagtcaggtaaatgctacccactagtgggggtagtgggggtgagaggccctcgggtcagtgaagggggacatgggagggagtcagargcacagccctgggcccaggggatggcacctgcttgacattcctgcggtcagcagccgtcttggccatgatcatgcggaaggtatagaggatgagacctgg

SEQ ID NO: 21616 - DNA, 201 bp, Homo sapiens
gcagtgtggacccagaactgggggctgagccttcaggcagccaaaatctagagttggggagatgggagagaacccaccaaggagggtgacaagaggatgckgcgagatgagagacccaaggccgagcttcgaggaggaaggctcggataaatgtgtcagatgtcgctgatagatcataagatgaggattgagctggtcact

SEQ ID NO: 21617 - DNA, 201 bp, Homo sapiens
cataagatgaggattgagctggtcactggacttgtcaatctgaaagtcactgtcaacctagactattgctggctgtatgtatgtgtgtctgtcacagtcaycagctcccaactcatcagcttactcagcaagaactcatttaaaataactcgccccatccttacaggtaagcacattcttttaggaaagtcaatgccaagc

SEQ ID NO: 21618 - DNA, 201 bp, Homo sapiens
actcaacttggcaatactcactccaacctgatggaggcctccgaggaagttttgtcaaagagccaccggaagaaaaaatctagactgaaaaacaaaggaamcccctaagagtttatttccagcattccatattgtcactacacatgctttcattttcttttgctctaaaaacaggccaaagctcgagattgacttttgttc

SEQ ID NO: 21619 - DNA, 201 bp, Homo sapiens
gttctcaacgatgccacttactacggcatgacctgtcacagtctgctttaacagaaacttccttccttgagataaataaagccatgatgaggccttccctragtggaaggtccttgataagtttcattttcttttctcttttgtagagatggggtttcgccagactgcccaggctggaactcctgggctcaagcaatctgc

SEQ ID NO: 21620 - DNA, 201 bp, Homo sapiens
ggcctcccaaaatgctaggattacaggcgtgagccactgtgcctggccacaaaattttcaagctggttttttttttttttttttttgagacagagtctcaygcctgtaatcccagcactttgggaggccgaggcgggtggatcacctgaggtcaggagctcaagaacagcctgaccaatatggtgtttttttcttttttaa

SEQ ID NO: 21621 - DNA, 201 bp, Homo sapiens
acgccgagtggttgcgacaggcttagatattgttagaggtttgcttctgctgccaaaccgtttgcattctcctggggacagtgctctcctgatgtgactcktattctgaatttagagcagaaggtggtggcatatacctggtgagacccagggagggcaggatcagcaccatgaagatcaagaatatgtagactttggtca

SEQ ID NO: 21622 - DNA, 201 bp, Homo sapiens
cacatacgagtaaactccacttatctgactaaccagattaaataaccttctctgctccctatacaaaaccaatgactgatgccatggcaagactgaacacygaaggcctggagtcctggccggcgggcgggggggggggtgccctgcctgctcagctcccactgtccagctgcagcatatcagggctccactgtgtgtgtc

SEQ ID NO: 21623 - DNA, 201 bp, Homo sapiens
taaccttctctgctccctatacaaaaccaatgactgatgccatggcaagactgaacaccgaaggcctggagtcctggccggcgggcgggggggggggtgcyctgcctgctcagctcccactgtccagctgcagcatatcagggctccactgtgtgtgtccacaatcctgctgtttgttactgggattacatgagctgattg

SEQ ID NO: 21624 - DNA, 201 bp, Homo sapiens
tcatcccaaagaacagacccacaaagcaatcctgagtttaggaagccttgtgaaccaaagagcaaaactgtcagaggcagaactagaaccgagcagagggragcacttcaagctcattctgtgcaaggagctgaggcagggctggacaggcagctgcgctggggcttgcgctgggtgcccttaccctcagcacagcactgg

SEQ ID NO: 21625 - DNA, 201 bp, Homo sapiens
agcactggaggctcaccagggcccccatggacacagctcagctccccagcacggccccaggctgacactggacctaagtaaggctgcacaagctgcatgcrgctactgagcattttaaatgtggctggtgtgaattgagaggtgctagaagtgtaaaatacacaccagatattgaagactaagtgtgaaaaagagaatgta

SEQ ID NO: 21626 - DNA, 201 bp, Homo sapiens
acgtggcgttcttcctctgtgatcctctccagcagcctgtccttcatccgtgtgtagtaagagatggcgtcttcctgccacaagacacatcccattgggawgacgtggccccatgctggtatctggggcaccccgatgccaatgcctctgctcccagccggggggtgggacccttacccactcacagcccagcacttcaca

SEQ ID NO: 21627 - DNA, 201 bp, Homo sapiens
tcctagctgggagatgcgaggccagcaaggaaggagggggcatcttgcaaggcccgcccaccactcacttctccttgcacaggtagatcagtttggccacrttgtagcacagctgcacatcaaccacctcacacgtgggatacgcgtccctgtggccagggagagaaggaggcaaaagacaccgttggaaaagaaaacacc

SEQ ID NO: 21628 - DNA, 201 bp, Homo sapiens
ctggccaatgtggtgaaacgctgtctctactaaaaatacaaaaattagccaggtgtggtggcacacacctgtaatccagctacttgggaggctggggcacragaatcacttgaacctgggaggcagaggttgcagtgagcaagattgccccactgcactccagcctgggcaacagagtgagactccgtctcaaaaaaaaaa

SEQ ID NO: 21629 - DNA, 201 bp, Homo sapiens
catcggcttagcaggggctcaagagataataagcatcaaacacctagtcctgtacgtggtatcagcagatgctcagaaatatgcctgttcatatgagtccygattactatttatctagaggacaaagctttgcaattaactacattgttctcatttctaaataaactaactcgcctcctgcttcctcctgttccagaccag

SEQ ID NO: 21630 - DNA, 201 bp, Homo sapiens
gtattcattcctttgaattaggctgagcatatgttatcctcagcctccttttacagttgggaaaactgaggcccagaacatttcatccttataaccaccayatttcattatataaccaccacatttcatcaattctaagatatcattttcatatttcttttcttttcttttcttttttttttttttttttgagacagtttt

SEQ ID NO: 21631 - DNA, 201 bp, Homo sapiens
tgaaatgaggtgtacactatcgttatagttgatggtagcttagctgacaacattttcttgttcttagtgctatataaaataacatgcacctgggccgggckcggtggctcatgcctataatcccagcactttgggaggccaaggcaggcagatcacctgaggtcgggagttggagatccacgtgaccaacatggagaaacc

SEQ ID NO: 21632 - DNA, 201 bp, Homo sapiens
ccccccccgcctcctggctccctacaccacatgagaggtaactaactggctcttaatcacctttaataatcttttagctttctctccatgggccccattgraaaaaagaaaacttgtaaccaaatgaattgaatgtattatatttcttcacttttcactaattcaaagacatgcaaacctgcctaggagagcgtccattga

SEQ ID NO: 21633 - DNA, 201 bp, Homo sapiens
gccccattgaaaaaaagaaaacttgtaaccaaatgaattgaatgtattatatttcttcacttttcactaattcaaagacatgcaaacctgcctaggagagygtccattgacatctaattggtgttaaatattaagttgaataattaaagcaaaaaaatagctttaattagtttgtgcagtattatgagagatgaacatatg

SEQ ID NO: 21634 - DNA, 201 bp, Homo sapiens
cctctctgtccacagcggctgccgccctggcctgtgcagtgcagacacttcccacaaacccatgctctccagggccctctggctcttatgtgtcccccctyccccacccccaaaacttactgcaataaaaatccacccctggccgggcaccatggctcactcctgtaatcccagcactttgggaggccaaggctggtgaat

SEQ ID NO: 21635 - DNA, 201 bp, Homo sapiens
ctgaggtgggaggattgcttgagcccaggaggaggaagtcgcagtgaattgtgattatgccactgtacttcagcctgggtgacagtgagaccttgtctcawaaaaaaaaaaaaaaaaaaaaaaaaaaaaaaaaaattcaccttcagcagcacaatagagggtgactctcttctcagccaacactgttgcaacaatacccac

SEQ ID NO: 21636 - DNA, 201 bp, Homo sapiens
ccctgcccactcctccttgctaccctaagccaccctccccatgttccccacccgagcctagtctccagctccaagcagtccaaggatgtttactccatcaragccatctgcccccttcactcagatggtctctgccacatgttaggagacagtatcaagaggcactggccagcccatggcatttgtgaaaagaaggggcac

SEQ ID NO: 21637 - DNA, 201 bp, Homo sapiens
cctaagccaccctccccatgttccccacccgagcctagtctccagctccaagcagtccaaggatgtttactccatcagagccatctgcccccttcactcaratggtctctgccacatgttaggagacagtatcaagaggcactggccagcccatggcatttgtgaaaagaaggggcactttaaccccaataaatctcagcc

SEQ ID NO: 21638 - DNA, 201 bp, Homo sapiens
ccaaagttcaacccatgtgcaggcaagcgtctgattgtggccagtgggagagggctaaatccaacagctggtctaaatttgccaaagtaaactacctatgytaatccactgccagtctccattggcagcaaggactggcctggtggtcaacttgacaagctctagaaataccagcagaatgttgcaggaagtatatggata

SEQ ID NO: 21639 - DNA, 201 bp, Homo sapiens
cacagcagacttgaggatgacctgagaggtgtcaagggagggtcagtgggtccgccacgctgtccacccctgcccttgaagaggacaccacctgcctgggrctgaatgaccaaggcccctccagggcctcaggtagctagtcttatcaggtgctggaacctttgcggatttggtttcttagcagagctcgcctcacccttt

SEQ ID NO: 21640 - DNA, 201 bp, Homo sapiens
aaaacattaaagacaatctcatataacctcttctccctccccacatcccctctccttcaaaagaacttgtgaacattttggtgagaattttcacaagtgamgtacgtccatatcaccaacatggccccaacactccagatgcccctcggggttctctcccaggtaccacgctctgacttctgactgagatggttttgattg

SEQ ID NO: 21641 - DNA, 201 bp, Homo sapiens
tgcctgcaggtgccccaggggcccttggatgggaacactaaaggtcgaggtgtttggagaaagccctcatggagggaccaggtgcctggctcccgggcggmcctcagtaccgctccccagtctaggatgctggtctggagtggcactgatggttctgggatttccaagtctcacatggaaaccctcaaaggtggggattta

SEQ ID NO: 21642 - DNA, 201 bp, Homo sapiens
gatggttctgggatttccaagtctcacatggaaaccctcaaaggtggggatttagaggctgtcccatgcccctgcctgggtggccctcccagaaaagagarggccctcagtgaggggagagcggttgagaccctggatttgtccttttctttatggctccttgtgggtgggccagctgatctcacccccaggcgctttaac

SEQ ID NO: 21643 - DNA, 201 bp, Homo sapiens; identical to SEQ ID NO: 4736

SEQ ID NO: 21644 - DNA, 201 bp, Homo sapiens
gaaaaaaaaaaaaaacatgcatcttacaacaataacttcttagattcaatggaatatggcagcaggtgagaaccaagactcacatcagtccccgccccccscgcctcctggctccctacaccacatgagaggtaactaactggctcttaatcacctttaataatcttttagctttctctccatgggccccattgaaaaaaa

SEQ ID NO: 21645 - DNA, 201 bp, Homo sapiens
aggacaccacctgcctggggctgaatgaccaaggcccctccagggcctcaggtagctagtcttatcaggtgctggaacctttgcggatttggtttcttagmagagctcgcctcaccctttccgcccccgcccttccccccagtccccgagtccccagcctccctcctcaggactccgccaaggctgcaggaagtggtcacc

SEQ ID NO: 21646 - DNA, 201 bp, Homo sapiens
atgtgggcctctgcctcacttcctttgtcacttgcaggctcttctgtctgcagataacagcaaaaacttgcgatgataaacaaaactgatctctgtgaacraacaccctccaaacacacagactattaacacccggaataatagtaccagctggcaccaagctccccagcagcccgagagaggatggggtgggggagtgca

SEQ ID NO: 21647 - DNA, 201 bp, Homo sapiens
cccagagcagatgtctgaaaggagggtgcctccatctcccctggggcaaggctggcacatgaagccaacaggatgggtccagggcagcagggaagagcccrgcagtggggccaggccacatcagctcgagggggtcagccagaatcacccactccgtggctgctgcccacacccccaccgcctgttacacaaacatgggct

SEQ ID NO: 21648 - DNA, 201 bp, Homo sapiens
cttcagaggggtccccatccctgtcctgacaaatgaactccagatccacaggaccctccgtgtttcttaaaaccctggcaaaacagtgtctgcctgtggcrtgttcatgcccacagctcaacaacacactagctgcaaggggccttcagataccagccggccccctttggagtacctctggcctgccccgggctcctgacc

SEQ ID NO: 21649 - DNA, 201 bp, Homo sapiens
ctgacaaatgaactccagatccacaggaccctccgtgtttcttaaaaccctggcaaaacagtgtctgcctgtggcatgttcatgcccacagctcaacaacwcactagctgcaaggggccttcagataccagccggccccctttggagtacctctggcctgccccgggctcctgacctgccttctccttgatctcacccatc

SEQ ID NO: 21650 - DNA, 201 bp, Homo sapiens
cacagtgtaatccagcgcagcggcctccacctgagggcaggtcatggagcttacccgcctctgacctcgagcaaggaaactgcccactgcctacctcatcrgcttagcaggggctcaagagataataagcatcaaacacctagtcctgtacgtggtatcagcagatgctcagaaatatgcctgttcatatgagtcctgatt

SEQ ID NO: 21651 - DNA, 201 bp, Homo sapiens
gacctcgtgatctgcctgcctcagcctcccaaagcgttgggattacaggcgtcagccaccgcagccggccatatttcaactcctctgaaatgaggtgtacrctatcgttatagttgatggtagcttagctgacaacattttcttgttcttagtgctatataaaataacatgcacctgggccgggcgcggtggctcatgcct

SEQ ID NO: 21652 - DNA, 201 bp, Homo sapiens
tgcggtgagccgagatcgtgccattgcactccagcctgggcgacaagagcgaaactcggtctgaaaaaaaaaaaaaacatgcatcttacaacaataacttyttagattcaatggaatatggcagcaggtgagaaccaagactcacatcagtccccgccccccccgcctcctggctccctacaccacatgagaggtaactaa

SEQ ID NO: 21653 - DNA, 201 bp, Homo sapiens
ccatgggccccattgaaaaaaagaaaacttgtaaccaaatgaattgaatgtattatatttcttcacttttcactaattcaaagacatgcaaacctgcctakgagagcgtccattgacatctaattggtgttaaatattaagttgaataattaaagcaaaaaaatagctttaattagtttgtgcagtattatgagagatgaa

SEQ ID NO: 21654 - DNA, 201 bp, Homo sapiens
tgccgtaaaggcatcagatgtcccaaaagtttctctccaacagtccaaggtcatcatcacctcaggctttagcaaatcccagagcagggatcacggggaargatggtgcattttcaggtacacctcctcttcccagttcaaaggaccctgccgcacaggccacatgtcaggaggcgcccgagagtggagggtctgccagag

SEQ ID NO: 21655 - DNA, 201 bp, Homo sapiens
ggtgacatattttcaaaggcaggtgagtcatgttgtaggaaaaccacgaaacctgctcagcaggtgcctgccctctctgtccacagcggctgccgccctgrcctgtgcagtgcagacacttcccacaaacccatgctctccagggccctctggctcttatgtgtcccccctcccccacccccaaaacttactgcaataaaa

SEQ ID NO: 21656 - DNA, 201 bp, Homo sapiens
tctgtccacagcggctgccgccctggcctgtgcagtgcagacacttcccacaaacccatgctctccagggccctctggctcttatgtgtcccccctccccmacccccaaaacttactgcaataaaaatccacccctggccgggcaccatggctcactcctgtaatcccagcactttgggaggccaaggctggtgaatcgct

SEQ ID NO: 21657 - DNA, 201 bp, Homo sapiens
ctgtttacctctaccctggagcacaaaggaaatgacacagcccctggctgaaaccagaggcagtgtggctcagggattatgtgagcaggctctggagttarggtctcagcaccacgcagttcagacaagcagcctaaccactctgtgccttggcttccttcgccaggaaatgcgagtgatgactttctctcacggagctgt

SEQ ID NO: 21658 - DNA, 201 bp, Homo sapiens
gctgctgactctgaacagagtgtcacaagagtgacctctggaacacagatgttcttggcttccctttaaaatcccccagtggcaccacccaatggaacacmccagcccaacacttcaaggccaccacctacccctcctccttcctgtccccacacttaccagacactaggggaaggaaggactgtggatgggcccgttgga

SEQ ID NO: 21659 - DNA, 201 bp, Homo sapiens
acacacacacacacacacacacacacacacacacgaagcacaggaagcatgaatgagtggaaagcccaagaacatgggagcatcccacagacagccaagtsactttctcaaccttctaagagacttggcaatggctggaggtagtgggggttgtgatgccagagtcatggggctgctgactctgaacagagtgtcacaaga

SEQ ID NO: 21660 - DNA, 201 bp, Homo sapiens
tcgcagtgaattgtgattatgccactgtacttcagcctgggtgacagtgagaccttgtctcaaaaaaaaaaaaaaaaaaaaaaaaaaaaaaaaaaaattcmccttcagcagcacaatagagggtgactctcttctcagccaacactgttgcaacaatacccacccagcccagctagggtccctgcccaggtccccctctct

SEQ ID NO: 21661 - DNA, 201 bp, Homo sapiens
cctccctgtgtccccagagatggggaggtgacttgctccaccctttcccacccttggagtgctacacttggaggctctgggtccactggggactcagaaawttccaggttcacacaagccagacttctgtgctacagagggagaaggggcagggcactctgctctttcccactccctgaaggcgctacttctaggctggga

SEQ ID NO: 21662 - DNA, 201 bp, Homo sapiens; identical to SEQ ID NO: 4739

SEQ ID NO: 21663 - DNA, 201 bp, Homo sapiens
ctctgattataaaatacatgttgtcaaaaagcttaaaaatgcaaaaagtacaaaacattaaagacaatctcatataacctcttctccctccccacatcccytctccttcaaaagaacttgtgaacattttggtgagaattttcacaagtgaagtacgtccatatcaccaacatggccccaacactccagatgcccctcggg

SEQ ID NO: 21664 - DNA, 201 bp, Homo sapiens
agctttttgagtagatgccagttgagtgagtgtttggctgttatctcattgattcatctaagatttttgaaaatcgttcattacctatacagaatagtttkttttttttttttttttttttttttgagatggagtttcgctcttgtcgcccaggctggagtgcagtggtgcaatctcggcttactgcaacctccacctccc

SEQ ID NO: 21665 - DNA, 201 bp, Homo sapiens
gggaggcagaggttgcagtgagcaagattgccccactgcactccagcctgggcaacagagtgagactccgtctcaaaaaaaaaaaaaaaaaaaaaaaaaamccagcaaaatacatactcactattgaccaggtattgttacatatatttatttatttaatcctcatcataacctgtgaggttttgtccccattttacagat

SEQ ID NO: 21666 - DNA, 201 bp, Homo sapiens
tgacgtggcggaaaatcttctgggactgagcccttaacttgcaggatctgacattaactccaggtagagtcagaatcaattaaataacaggacagccggctggtgttagagagctggagaatccctttgtgtcccacaggtgttgtatgagagtgcagagaaatgtgttcccgacgctcctgaagttgcctccctaattta

SEQ ID NO: 21667 - DNA, 201 bp, Homo sapiens
aaaaactgagtctctatcctactctcaccccagagacaactagtccacagtttcctgtgtatccttctagaagcactgcacgcatctatgtttttttttttacacaaatggtggtataatttacaaattattctgttccttgtttttctccacttaatgttaccatgtcaatacataaagatttgcctcaatctttttgct

SEQ ID NO: 21668 - DNA, 201 bp, Homo sapiens
tgagagagagaaacagtgcgcactcagatttttagaaggagaaatctggagaggagatatggggtcagtaaaaggtttttaaaggatgggagctttcagcrcctgtttgcacgctggcgagaataactcactggaaagaagagactgatgctgcagaatggagaagagatgatcaaaggagctgcagagctgaggggatca

SEQ ID NO: 21669 - DNA, 201 bp, Homo sapiens
aatgtataaagactgtattttctatacattgcctgctttaacgttaattgtgcatctactattatgtcagtaatttgccaagctctataaaccataacaawcttatgagatagatcctcttattttctgaaatttttggataagaagactaaagttcaaagaatttaagtcaactgtttaaggtcagtcacagagttacgt

SEQ ID NO: 21670 - DNA, 201 bp, Homo sapiens
ttttcatcatgaaatattaaaaattattaaagaatggacaaaagacttgaacataaaattcacaaaaataagtaaatggctaataagcacatgagaaggtrctcaatatcattagtcatcagggaaataaaaattaaacctctgtggggccgagctggaaggatcactggaggccagcctgggcaacacagtgagaatctg

SEQ ID NO: 21671 - DNA, 201 bp, Homo sapiens
tgggtaattcaaaggaaagatgaatgccagccggacagaaggtctgaccacattgtcaaccagaaatgcccaaggggatttccattccaaagaacaaaagyttcttagcaccatggggctctctattattttaagcactgaaatatcactaaggctggagagaaaaaatggatggtggagctagctgcaagcgttaagttt

SEQ ID NO: 21672 - DNA, 201 bp, Homo sapiens; identical to SEQ ID NO: 3156

SEQ ID NO: 21673 - DNA, 201 bp, Homo sapiens
tgccagtgaagtctgattcatttaacaccaaagataacgtcttctaattctaaagatctagccacagaaatcttgatgttacctgggtctgccagctagcwacctatttaaggtgacctgttcttgcttttttaacaaacaaaacaaaaataagcaaactatcaaggtttccttacatttaatcaaagtgcctagaaatgt

SEQ ID NO: 21674 - DNA, 201 bp, Homo sapiens
gcaaaggatcaatcacctatcaacaaaaaaacaccatcaacaccctttaaatcaccagtgaggcagagaaacaccatctctccacgagtcccacacagccwagtctagcctcccacactggaacagacggatctttcttttgctgagcaccggatgataaacaaggagcactgaacattctacagactcagcatgggggca

SEQ ID NO: 21675 - DNA, 201 bp, Homo sapiens
attgttttactccatttcccatcataaggcctagaaaataaaagtaaatgaactcagtgactacagacaagtcagcctcaggccacccccagagaactacygggcacagagagatgagcattcctgtctggtcctaaaagttctcttaaggatgagatgacctcagatggtacagaaagcagctgtgggcagtgctcatgg

SEQ ID NO: 21676 - DNA, 201 bp, Homo sapiens
ggttctggtataattacctgactgaggcagactgcgattctgcaaatagaacttatatcctcccggggcctcggtttcaaaaacaccttctgcaacttccrtcagtggccactccagcttcctggcgttgctgacagcctggctagaagcgagcgtgattccctacaacaaacaacagtacatccaagtacatgatcacaa

SEQ ID NO: 21677 - DNA, 201 bp, Homo sapiens
cgctggtttttgtattatgcacagagggccgaataagcgtctttggaattagcttctgtttctccttagctctttgttgttgtttttgtttcaccatgttrgccaggctgatctggaactcctgacctcaggtgatccgcccgcctcggcctcccaatgtgctgggattacaggcgtgagccaccgcgcccggccctctcc

SEQ ID NO: 21678 - DNA, 201 bp, Homo sapiens
ccacgaagggcgccacgggccgtgacgtcactagccgccgacggcgcgctttcgtgacgcagcccgggtctcagggaacatggcggcgctggtgagaccckcgaggtttgtcgtgcgaccgttgctgcaggtggtccaggcttgggaccttgacgcgaggcgctgggtccgggcgctgcggcggagcccagtgaaagtggt

SEQ ID NO: 21679 - DNA, 201 bp, Homo sapiens
ccgctggtttttgtattatgcacagagggccgaataagcgtctttggaattagcttctgtttctccttagctctttgttgttgtttttgtttcaccatgtkggccaggctgatctggaactcctgacctcaggtgatccgcccgcctcggcctcccaatgtgctgggattacaggcgtgagccaccgcgcccggccctctc

SEQ ID NO: 21680 - DNA, 201 bp, Homo sapiens
tttttttttttttttttgagacggagttttgctttcgtcatccaggctggaacacaatggtgcgatctcggctcactgcaacctccgcctcccagatacargcgattctcttgcctcagcctcccgagtagctgggattacaggcgtgtgccaccatgcccggctaatttttgtatttttagtagagacagggtttcacca

SEQ ID NO: 21681 - DNA, 201 bp, Homo sapiens
tgaggtcaggagatcgagaccatcctggctaacacagtaaaaccccatctctactaaaaatacaaaaaataagcagggcgtggtggcgggcgcctgtagtmccagctactcgggaggctgaggcaggagaatggtgtgaacccaggaggcggagcttgcagtgagccgagattgcgccactgcactccagcctgggcgaaa

SEQ ID NO: 21682 - DNA, 201 bp, Homo sapiens
cgtggtggcgcacgcctgtaatcccagctactcgggaggctgagacaggagaattgcttgaacctgggaggcggaggttgcagtgagccgagatggcgccrttgcactctagcctgggagacaagagcaaaactctgtctcaaaaaaaaaaaaaaaaaaaaaaaagattagacaggcgtggtggctcatgtgtgtattccc

SEQ ID NO: 21683 - DNA, 201 bp, Homo sapiens
aaggaataaagtaaaaactgagtctctatcctactctcaccccagagacaactagtccacagtttcctgtgtatccttctagaagcactgcacgcatctaygtttttttttttacacaaatggtggtataatttacaaattattctgttccttgtttttctccacttaatgttaccatgtcaatacataaagatttgcctc

SEQ ID NO: 21684 - DNA, 201 bp, Homo sapiens
tacacgtatgtggtagaaaaattcaaatattatatactaaaggaataaagtaaaaactgagtctctatcctactctcaccccagagacaactagtccacastttcctgtgtatccttctagaagcactgcacgcatctatgtttttttttttacacaaatggtggtataatttacaaattattctgttccttgtttttctc

SEQ ID NO: 21685 - DNA, 201 bp, Homo sapiens
gaaacagcgcacactcagatttttagaagaaatctggagaggatgtgagagagagaaacagcgcgcactcagatttttagaagaagaaatctggagaggaygtgagagagagaaacagcgcgcactcagatttttagaagaaatctggagaggatgtgagagagagaaacagcgcgcactcagatttttagaagaagaaat

SEQ ID NO: 21686 - DNA, 201 bp, Homo sapiens
tttttagaggaagaaatctggagaggacgtgagagagaaacagcgcgcactcagatttttagaagaaatctggagaggacgtgagagagagaaacagcgcrcactcagatttttagaagaaatctggagaggatgtgagagagagaaacagcgcgcactcagatttttagaagaagaaatctggagaggacgtgagagaga

SEQ ID NO: 21687 - DNA, 201 bp, Homo sapiens
gaggacgtgagagagagaaacagcgcgcactcagatttttagaagaagaaatctggagaggacgtgagagggagaaacagcgcgcactcagatttttagargaagaaatctggagaggacgtgagagagaaacagcgcgcactcagatttttagaagaaatctggagaggacgtgagagagagaaacagcgcacactcaga

SEQ ID NO: 21688 - DNA, 201 bp, Homo sapiens
cactcagatttttagaagaagaagtctggagaggacgtgagagagagaaacagcgcgcactcagatttttagaagaagaaatctggagaggacgtgagagrgagaaacagcgcgcactcagatttttagaggaagaaatctggagaggacgtgagagagaaacagcgcgcactcagatttttagaagaaatctggagagga

SEQ ID NO: 21689 - DNA, 201 bp, Homo sapiens
tgagagagagaaacagcgcgcactcagatttttagaagaagaagtctggagaggacgtgagagagagaaacagcgcgcactcagatttttagaagaagaartctggagaggacgtgagagggagaaacagcgcgcactcagatttttagaggaagaaatctggagaggacgtgagagagaaacagcgcgcactcagatttt

SEQ ID NO: 21690 - DNA, 201 bp, Homo sapiens
gcgcactcagatttttagaagaaatctggagaggacgtgagagagagaaacagcgcgcactcagatttttagaagaagaagtctggagaggacgtgagagrgagaaacagcgcgcactcagatttttagaagaagaaatctggagaggacgtgagagggagaaacagcgcgcactcagatttttagaggaagaaatctgga

SEQ ID NO: 21691 - DNA, 201 bp, Homo sapiens
acgtgagagagagaaacagcgcgcactcagatttttagaagaaatctggagaggacgtgagagagagaaacagcgcgcactcagatttttagaagaagaartctggagaggacgtgagagagagaaacagcgcgcactcagatttttagaagaagaaatctggagaggacgtgagagggagaaacagcgcgcactcagatt

SEQ ID NO: 21692 - DNA, 201 bp, Homo sapiens
aagaagaaatctgaagaggacgtgagagagagaaacagcgcgcactcagatttttagaagaagaaatctggagaggacgtaagagagagaaacagcgcgcrctcagatttttagaagaaatctggagaggacataagagggagaaacagcgcgcactcagatttttagaagaaatctggagaggacgtgagagagagaaac

SEQ ID NO: 21693 - DNA, 201 bp, Homo sapiens
gggcgcactcagatttttagaagaagaaatctgaagaggacgtgagagagagaaacagcgcgcactcagatttttagaagaagaaatctggagaggacgtragagagagaaacagcgcgcgctcagatttttagaagaaatctggagaggacataagagggagaaacagcgcgcactcagatttttagaagaaatctggag

SEQ ID NO: 21694 - DNA, 201 bp, Homo sapiens
tgagagagaaacagcgcgcactcagatttttagaagaaatctggagaggatgtgagagagagaaacagggcgcactcagatttttagaagaagaaatctgragaggacgtgagagagagaaacagcgcgcactcagatttttagaagaagaaatctggagaggacgtaagagagagaaacagcgcgcgctcagatttttag

SEQ ID NO: 21695 - DNA, 201 bp, Homo sapiens
atttttagaagaagaaatctggagaggatgtgtgagagagaaacagcgcgcactcagatttttagaagaaatctggagaggatgtgagagagagaaacagsgcgcactcagatttttagaagaagaaatctgaagaggacgtgagagagagaaacagcgcgcactcagatttttagaagaagaaatctggagaggacgtaa

SEQ ID NO: 21696 - DNA, 201 bp, Homo sapiens
aggacgtgagagagagaaacggcgcacactcagatttttagaagaagaaatctggagaggatgtgtgagagagaaacagcgcgcactcagatttttagaaraaatctggagaggatgtgagagagagaaacagggcgcactcagatttttagaagaagaaatctgaagaggacgtgagagagagaaacagcgcgcactcag

SEQ ID NO: 21697 - DNA, 201 bp, Homo sapiens
gaaacagcgcgcactcagatttttagaagaagaaatctggagaggatgtgtgagagagaaacagcgtgcactcagatttttagaagaaatctggagaggaygtgagagagagaaacggcgcacactcagatttttagaagaagaaatctggagaggatgtgtgagagagaaacagcgcgcactcagatttttagaagaaat

SEQ ID NO: 21698 - DNA, 201 bp, Homo sapiens
ggagaggacgtgagagagagaaacagcgcgcactcagatttttagaagaagaaatctggagaggatgtgtgagagagaaacagcgtgcactcagatttttrgaagaaatctggagaggacgtgagagagagaaacggcgcacactcagatttttagaagaagaaatctggagaggatgtgtgagagagaaacagcgcgcac

SEQ ID NO: 21699 - DNA, 201 bp, Homo sapiens
tagaagaagaaatctggagaggacgtgagagagagaaacagcgcgcactcagatttttagaagaagaaatctggagaggatgtgtgagagagaaacagcgygcactcagatttttagaagaaatctggagaggacgtgagagagagaaacggcgcacactcagatttttagaagaagaaatctggagaggatgtgtgagag

SEQ ID NO: 21700 - DNA, 201 bp, Homo sapiens
cgcgcactcagatttttagaagaagaaatctggagaggacgtgagagagagaaacagcgcgcactcagatttttagaagaagaaatctggagaggatgtgwgagagagaaacagcgtgcactcagatttttagaagaaatctggagaggacgtgagagagagaaacggcgcacactcagatttttagaagaagaaatctgg

SEQ ID NO: 21701 - DNA, 201 bp, Homo sapiens
gcactcagatttttagaagaaatctggagaggacgtgagagagagaaacagcgcgcactcagatttttagaagaagaaatctggagaggacgtgagagagrgaaacagcgcgcactcagatttttagaagaagaaatctggagaggatgtgtgagagagaaacagcgtgcactcagatttttagaagaaatctggagagga

SEQ ID NO: 21702 - DNA, 201 bp, Homo sapiens
acagcgcgcactcagatttttagaagaaatctggagaggacgtgagagagagaaacagcgcgcactcagatttttagaagaagaaatctggagaggacgtragagagagaaacagcgcgcactcagatttttagaagaagaaatctggagaggatgtgtgagagagaaacagcgtgcactcagatttttagaagaaatctg

SEQ ID NO: 21703 - DNA, 201 bp, Homo sapiens
tttagaaaaaatctggagaggacgtaagagagagaaacagcgcgcactcagatttttagaagaaatctggagaggacgtgagagagagaaacagcgcgcaytcagatttttagaagaagaaatctggagaggacgtgagagagagaaacagcgcgcactcagatttttagaagaagaaatctggagaggatgtgtgagaga

SEQ ID NO: 21704 - DNA, 201 bp, Homo sapiens
cagatttttagaaaaaatctggagaggacgtaagagagagaaacagcgcgcactcagatttttagaagaaatctggagaggacgtgagagagagaaacagsgcgcactcagatttttagaagaagaaatctggagaggacgtgagagagagaaacagcgcgcactcagatttttagaagaagaaatctggagaggatgtgt

SEQ ID NO: 21705 - DNA, 201 bp, Homo sapiens
agagaaacagcgcgcactcagatttttagaaaaaatctggagaggacgtaagagagagaaacagcgcgcactcagatttttagaagaaatctggagaggaygtgagagagagaaacagcgcgcactcagatttttagaagaagaaatctggagaggacgtgagagagagaaacagcgcgcactcagatttttagaagaaga

SEQ ID NO: 21706 - DNA, 201 bp, Homo sapiens
tttttagaagaagaaatctggagaggacgtaagagagagaaacagcgcgcactcagatttttagaaaaaatctggagaggacgtaagagagagaaacagcrcgcactcagatttttagaagaaatctggagaggacgtgagagagagaaacagcgcgcactcagatttttagaagaagaaatctggagaggacgtgagaga

SEQ ID NO: 21707 - DNA, 201 bp, Homo sapiens
acagcgcgcactcagatttttagaagaagaaatctggagaggacgtaagagagagaaacagcgcgcactcagatttttagaaaaaatctggagaggacgtragagagagaaacagcgcgcactcagatttttagaagaaatctggagaggacgtgagagagagaaacagcgcgcactcagatttttagaagaagaaatctg

SEQ ID NO: 21708 - DNA, 201 bp, Homo sapiens
gtgagagagaaacagcgcgcactcagatttttagaagaagaaatctggagaggacgtaagagagagaaacagcgcgcactcagatttttagaaaaaatctrgagaggacgtaagagagagaaacagcgcgcactcagatttttagaagaaatctggagaggacgtgagagagagaaacagcgcgcactcagatttttagaa

SEQ ID NO: 21709 - DNA, 201 bp, Homo sapiens
tttttagaagaaatctggagagtatgtgagagagaaacagcgcgcactcagatttttagaagaagaaatctggagaggacgtaagagagagaaacagcgcrcactcagatttttagaaaaaatctggagaggacgtaagagagagaaacagcgcgcactcagatttttagaagaaatctggagaggacgtgagagagagaa

SEQ ID NO: 21710 - DNA, 201 bp, Homo sapiens
atttttagaagaaatctggagagtatgtgagagagaaacagcgcgcactcagatttttagaagaagaaatctggagaggacgtaagagagagaaacagcgygcactcagatttttagaaaaaatctggagaggacgtaagagagagaaacagcgcgcactcagatttttagaagaaatctggagaggacgtgagagagaga

SEQ ID NO: 21711 - DNA, 201 bp, Homo sapiens
tggatcgaatgattgagcccaggaagtttgaaaccagcctgggcaacatggtgaaaccccatctctagaaaaaatacaaaaattagccaggcatggtggcrcacgcctatggttccagctactagggaggctgaggtgggaggatcactggaacataggaggcggaggttgcagtgagctgagatcatgccactgcactcc

SEQ ID NO: 21712 - DNA, 201 bp, Homo sapiens
attgagtatcagtcagcaattaaaaaaaaaagagctgtgatatgcaattacatggtggaatctcaaaaccatgttgagtaggccgggcgcggtggctcacrcctgtaatcccagccctttgggaggccaaggtgggtggatcacaaggtcaggagatcgagaccatcctggctaacacggtgaaacccgtctctactaaaa

SEQ ID NO: 21713 - DNA, 201 bp, Homo sapiens
atattcataaaattgagtatcagtcagcaattaaaaaaaaaagagctgtgatatgcaattacatggtggaatctcaaaaccatgttgagtaggccgggcgsggtggctcacacctgtaatcccagccctttgggaggccaaggtgggtggatcacaaggtcaggagatcgagaccatcctggctaacacggtgaaacccgt

SEQ ID NO: 21714 - DNA, 201 bp, Homo sapiens
gtagctgggattacaggcgtacaccaccgtgcctggctaattttttgtgtttagtagagacagggtttcaccatgttggtcaggctggtctgggactcctracctcaggtgagccacccgccttggtcccccaaggtgctgggattacaggggtgagccatcgcgcccggctgaacctaagaaagcttttaagtgttgaag

SEQ ID NO: 21715 - DNA, 201 bp, Homo sapiens
tttagaagaagaaatctggagaggatgtgtgagagagaaacagcgtgcactcagatttttagaagaaatctggagaggacgtgagagagagaaacggcgcrcactcagatttttagaagaagaaatctggagaggatgtgtgagagagaaacagcgcgcactcagatttttagaagaaatctggagaggatgtgagagaga

SEQ ID NO: 21716 - DNA, 201 bp, Homo sapiens
tgagctctaatggaggatatatatcagggtcatttgcacctttgttgccaaaactcaacgtagtaccctgaaaatagcagatattttaaaaatgacctgaygaattcagatccccgtctattgcaccgtctatacactaaaccgcgctcttgcacctttcaagtcttccttagtggtgtgttccctacctccctggcttat

SEQ ID NO: 21717 - DNA, 201 bp, Homo sapiens
ttcagaccagccttgctagaagcagaactctgaatacgctgattttatctacatcaaaggctccaaaccggaaaacacaaatattaactagaaagcattayataacattttatttaccgtcttttccggtagacggtaagctccacaagggcggggctcaataaacgtttacgagtggcttaaatgaaaggacgtgcgtgg

SEQ ID NO: 21718 - DNA, 201 bp, Homo sapiens
acagcgcgcactcagatttttagaagaagaaatctggagaggacgtaagagagagaaacagcgcgcgctcagatttttagaagaaatctggagaggacatragagggagaaacagcgcgcactcagatttttagaagaaatctggagaggacgtgagagagagaaacagcgcgcactcagatttttagaagaaatctggag

SEQ ID NO: 21719 - DNA, 201 bp, Homo sapiens
agaagaagaaatctagagaggacgtgagagagagaaacagcacgcactcagatttttagaagaagaaatctggagaggacgtgagagagagaaacagcgcrcattcagatttttagaagaagaaatctggagaggacgtaagagagggaaacagcgcgcactcagatttttagaagaaatctggagaggatgtgagagaga

SEQ ID NO: 21720 - DNA, 201 bp, Homo sapiens
tctccatggcaagagctgaggggatgggatggaggcatctccatgcggagagctgaggggaacggatggaggcatctccatggggagagctgagggggtcrgatggaggcatctccctggcgagagctgaggggaacggatagaggcatctccatggggagagctgagggggtcagatggaggcatctccatgcagagagc

SEQ ID NO: 21721 - DNA, 201 bp, Homo sapiens
catggggagagctgaggggaacggatggaggcatctccatggcaagagctgaggggatgggatggaggcatctccatgcggagagctgaggggaacggatrgaggcatctccatggggagagctgagggggtcggatggaggcatctccctggcgagagctgaggggaacggatagaggcatctccatggggagagctgag

SEQ ID NO: 21722 - DNA, 201 bp, Homo sapiens
atctccacggggagagctgaggggatgggatggaggcatctccatggggagagctgaggggaacggatggaggcatctccatggcaagagctgaggggatsggatggaggcatctccatgcggagagctgaggggaacggatggaggcatctccatggggagagctgagggggtcggatggaggcatctccctggcgagag

SEQ ID NO: 21723 - DNA, 201 bp, Homo sapiens
gcatctccacggggagagctgaggggatgggatggaggcatctccatggggagagctgaggggaacggatggaggcatctccatggcaagagctgaggggrtgggatggaggcatctccatgcggagagctgaggggaacggatggaggcatctccatggggagagctgagggggtcggatggaggcatctccctggcgag

SEQ ID NO: 21724 - DNA, 201 bp, Homo sapiens
gggtcagatggaggcatctccacggggagagctgaggggatgggatggaggcatctccatggggagagctgaggggaacggatggaggcatctccatggcragagctgaggggatgggatggaggcatctccatgcggagagctgaggggaacggatggaggcatctccatggggagagctgagggggtcggatggaggca

SEQ ID NO: 21725 - DNA, 201 bp, Homo sapiens
ggggtcagatggaggcatctccacggggagagctgaggggatgggatggaggcatctccatggggagagctgaggggaacggatggaggcatctccatggsaagagctgaggggatgggatggaggcatctccatgcggagagctgaggggaacggatggaggcatctccatggggagagctgagggggtcggatggaggc

SEQ ID NO: 21726 - DNA, 201 bp, Homo sapiens
ggggaacggatggaggcatctccatggggagagctgagggggtcagatggaggcatctccacggggagagctgaggggatgggatggaggcatctccatgsggagagctgaggggaacggatggaggcatctccatggcaagagctgaggggatgggatggaggcatctccatgcggagagctgaggggaacggatggagg

SEQ ID NO: 21727 - DNA, 201 bp, Homo sapiens
aaattacatcagagctttcaaagattgaaatacacaaatctgcactacccaagcctccttgcctgtacgggaaacaaatcagaagagcatttattgggaaytgacacgtcaggcctcacaggtgctgggcaggaatcacagaggcttgctctgcatcatgtcttccgttaacctgaagctttgggtttattgtgtttggca

SEQ ID NO: 21728 - DNA, 201 bp, Homo sapiens
gagaaacagcgcgcactcagatttttagaggaagaaatctggagaggacgtgagagagaaacagcgcgcactcagatttttagaagaaatctggagaggaygtgagagagagaaacagcgcacactcagatttttagaagaaatctggagaggatgtgagagagagaaacagcgcgcactcagatttttagaagaagaaat

SEQ ID NO: 21729 - DNA, 201 bp, Homo sapiens
ctcaggatggggctggtcaccagaaagacaaatgattagaggactgaactttcagtcccatccaccaacctctgggaaggaaagggatggagactgggctmtattaggcttgaacaatgagactcatgagcttctgggatgctgaacgtagggaggtgctggattggagcctgcccagaagagcatggaagctctgccacc

SEQ ID NO: 21730 - DNA, 201 bp, Homo sapiens
ggaagccttaagccgtgcccagtggtcacacctatagtcacagccacttggaggctgaggccagaggatcacgtgagctcaggaattcgagttcagcctgygtaacagagtgggaccccgtctcatatatatacatacagatacaaataaaaataaatgaataatacaaagccttaacaataatgttttggttccacaagc

SEQ ID NO: 21731 - DNA, 201 bp, Homo sapiens
acctatagtcacagccacttggaggctgaggccagaggatcacgtgagctcaggaattcgagttcagcctgtgtaacagagtgggaccccgtctcatatayatacatacagatacaaataaaaataaatgaataatacaaagccttaacaataatgttttggttccacaagcatccctttcgttgtttagtaaggacaaac

SEQ ID NO: 21732 - DNA, 201 bp, Homo sapiens
gacttactcattcttagcctcggtttcctcatttgcaaaggctgatgctatcaaccttgcaggttatattaagaatcagagaatgtggctgggcgcggtgrctcacgcctgtaatcccaacactttgggaggccgaggcaggcggatcacgaggtcaggagatcgagaccatcctggctaacacggtgaaaccccgtctct

SEQ ID NO: 21733 - DNA, 201 bp, Homo sapiens
tggtggtgggcgcctgtagtcccagctactcgggaggctgaggctgaggcaggagaatggtgtgaacccgggaggcggagcttgccgtgagccgagatcaygccactgcactccagcctgggcgacagagcgagactccgtctaaaaaaaaaaaaaaaaaatcagagaatgtatatgaagcacttaaggttggatgcggtg

SEQ ID NO: 21734 - DNA, 201 bp, Homo sapiens
acccactccccatgccctgccctgtgtatctcctctgtccagccatttctgactcgtactctttatgataaaccagtaaatgtaagtaagtgtttccagcrtttcccttagttccatgagccactgtagcagactatcaaacccaaggaagcaggagcgggagccctgacttgtagttggtcatcggaaatcctgaagatc

SEQ ID NO: 21735 - DNA, 201 bp, Homo sapiens
agcctgggcgacagagcaagactccgtctcaaaaaacaaataatttttaaaagttaataaaaatactaaaaaaaaaaaaaaaaaagctgagcgtggtggcrggcgcctataatcccagctacttgggaggctgaggaaggagaattgcttgaacccgggaggcagaggttgcagtgagcagagatcatgccagtacactcc

SEQ ID NO: 21736 - DNA, 201 bp, Homo sapiens
tctcaaaaaaaaaaaaaaaatttcaacccgacgcccccaaacaacaaagaaattagaattcacataaaatcctttgttaactaatgtgcaaataatgttamaagttggcagtgttaactgtgttagtgtagaggggaaaatcacaatcatgtaatacaagtgtaaatcagtacatttctgggcaatagtttgatggaatgt

SEQ ID NO: 21737 - DNA, 201 bp, Homo sapiens
aaaaagatcttgcattaaatccattcaatctcttggattaagcaattccacttctgaagagatatatccccaaatataaacaaggtaatatctgggtggtraggttatcacttattttcttctgtttatctatataaatattgaatcactgtgaagaaactatgggaacaaccttcatgttaacttcatttataaaggtta

SEQ ID NO: 21738 - DNA, 201 bp, Homo sapiens
gagtaggccgggcgcggtggctcacacctgtaatcccagccctttgggaggccaaggtgggtggatcacaaggtcaggagatcgagaccatcctggctaasacggtgaaacccgtctctactaaaaatacaaaaaattagccgggcgaggtggcaggtgcctgtagtcccagctactcggtaggctgaggcaggagaatgg

SEQ ID NO: 21739 - DNA, 201 bp, Homo sapiens
ttagccaggcatggtggtgggcgcttgtaatcccagctactcaggaggctgaggtaggagaattgcttgaacacgggaggcagaggttgcaatgagctgarattgcaccattacactccagcctgggtgacaagagcaaaactcaaactcaaaaaaaaaaaaaagtctgatttggaattctgtcatttagtagttgtgtaa

SEQ ID NO: 21740 - DNA, 201 bp, Homo sapiens
caaaattagccaggcatggtggtgggcgcttgtaatcccagctactcaggaggctgaggtaggagaattgcttgaacacgggaggcagaggttgcaatgarctgagattgcaccattacactccagcctgggtgacaagagcaaaactcaaactcaaaaaaaaaaaaaagtctgatttggaattctgtcatttagtagttg

SEQ ID NO: 21741 - DNA, 201 bp, Homo sapiens
aatataaaaaatacaaaattagccaggcatggtggtgggcgcttgtaatcccagctactcaggaggctgaggtaggagaattgcttgaacacgggaggcaraggttgcaatgagctgagattgcaccattacactccagcctgggtgacaagagcaaaactcaaactcaaaaaaaaaaaaaagtctgatttggaattctgt

SEQ ID NO: 21742 - DNA, 201 bp, Homo sapiens
agtgaaaccccatctctactaaaaatataaaaaatacaaaattagccaggcatggtggtgggcgcttgtaatcccagctactcaggaggctgaggtaggaraattgcttgaacacgggaggcagaggttgcaatgagctgagattgcaccattacactccagcctgggtgacaagagcaaaactcaaactcaaaaaaaaaa

SEQ ID NO: 21743 - DNA, 201 bp, Homo sapiens
aattccatctcaaattaaaaaaaaaaaaaaaaaaaaaaaaaaagatgggcatcgtggctcacgcctgtaatcccagcactttgggaggctgaggtgggcaratcacctgaggtcgggagttcgagaccagcctagccaacacagtgaaaccccatctctactaaaaatataaaaaatacaaaattagccaggcatggtggt

SEQ ID NO: 21744 - DNA, 201 bp, Homo sapiens
gaaacttttcacattgtaaagtgactttctaaagagctgttccacgtctccatctgactacgataaattcagtacatttttctttggctttactgccttartcctgtttgctagaacagcaatattgggattaagacgctgtttctcacaagtgcctccgcctggcaggctccatttttttctttccatttacttcaaaat

SEQ ID NO: 21745 - DNA, 201 bp, Homo sapiens
cactcagatttttagaagaagaaatctggagaggacgtgagagggagaaacagcgcgcactcagatttttagaggaagaaatctggagaggacgtgagagrgaaacagcgcgcactcagatttttagaagaaatctggagaggacgtgagagagagaaacagcgcacactcagatttttagaagaaatctggagaggatgt

SEQ ID NO: 21746 - DNA, 201 bp, Homo sapiens
tttagaagaagaaatctgaagaggacgtgagagagagaaacagcgcgcactcagatttttagaagaagaaatctggagaggacgtaagagagagaaacagygcgcgctcagatttttagaagaaatctggagaggacataagagggagaaacagcgcgcactcagatttttagaagaaatctggagaggacgtgagagaga

SEQ ID NO: 21747 - DNA, 201 bp, Homo sapiens
acagggcgcactcagatttttagaagaagaaatctgaagaggacgtgagagagagaaacagcgcgcactcagatttttagaagaagaaatctggagaggaygtaagagagagaaacagcgcgcgctcagatttttagaagaaatctggagaggacataagagggagaaacagcgcgcactcagatttttagaagaaatctg

SEQ ID NO: 21748 - DNA, 201 bp, Homo sapiens
gaaacagcgcgcactcagatttttagaagaaatctggagaggatgtgagagagagaaacagggcgcactcagatttttagaagaagaaatctgaagaggaygtgagagagagaaacagcgcgcactcagatttttagaagaagaaatctggagaggacgtaagagagagaaacagcgcgcgctcagatttttagaagaaat

SEQ ID NO: 21749 - DNA, 201 bp, Homo sapiens
gaaacggcgcacactcagatttttagaagaagaaatctggagaggatgtgtgagagagaaacagcgcgcactcagatttttagaagaaatctggagaggaygtgagagagagaaacagggcgcactcagatttttagaagaagaaatctgaagaggacgtgagagagagaaacagcgcgcactcagatttttagaagaaga

SEQ ID NO: 21750 - DNA, 201 bp, Homo sapiens
atttttagaagaaatctggagaggacgtgagagagagaaacggcgcacactcagatttttagaagaagaaatctggagaggatgtgtgagagagaaacagsgcgcactcagatttttagaagaaatctggagaggatgtgagagagagaaacagggcgcactcagatttttagaagaagaaatctgaagaggacgtgagag

SEQ ID NO: 21751 - DNA, 201 bp, Homo sapiens
agatttttagaagaagaaatctggagaggatgtgtgagagagaaacagcgtgcactcagatttttagaagaaatctggagaggacgtgagagagagaaacrgcgcacactcagatttttagaagaagaaatctggagaggatgtgtgagagagaaacagcgcgcactcagatttttagaagaaatctggagaggatgtgag

SEQ ID NO: 21752 - DNA, 201 bp, Homo sapiens
gaggatcactggaacataggaggcggaggttgcagtgagctgagatcatgccactgcactccagcctcggtgacagagagagaccccgtcttaaaaaaaawaaaatgggcccaggcgtggtggctcacgcctgtaatcccagcactttgggaggccaaggcagacggatcgcctgaagttaggagttcaagaccatcctgg

SEQ ID NO: 21753 - DNA, 201 bp, Homo sapiens
atgtagaaatgggactcacatcatccaacaatttgcttccctctggatccatcttagaaagttctcgaaatgcttcatccccgacaaagcaaatttcatgwccgtcctacaccaataaagagaaaagacacctgccaaagacatccttgaagaaacccctggtccagcctgccccctgcctgagaaatacttacagggtcg

SEQ ID NO: 21754 - DNA, 201 bp, Homo sapiens
tagaagaagaaatctggagaggacgtaagagagagaaacagcgcgcactcagatttttagaaaaaatctggagaggacgtaagagagagaaacagcgcgcrctcagatttttagaagaaatctggagaggacgtgagagagagaaacagcgcgcactcagatttttagaagaagaaatctggagaggacgtgagagagaga

SEQ ID NO: 21755 - DNA, 201 bp, Homo sapiens
aaagagctgtgatatgcaattacatggtggaatctcaaaaccatgttgagtaggccgggcgcggtggctcacacctgtaatcccagccctttgggaggccraggtgggtggatcacaaggtcaggagatcgagaccatcctggctaacacggtgaaacccgtctctactaaaaatacaaaaaattagccgggcgaggtggc

SEQ ID NO: 21756 - DNA, 201 bp, Homo sapiens
atatgtctctaatctataggacactgaaattcttacacattgtgattacagacaatgctgcagcagataaccttgcacacacttctttgtgccgatgtatrttgagcacatctgtaaaataattcctaggagtagaattgcagggtcaaagtgcaaggactaaatcgtgctcaaacgctgggttattagaaaaagaagatg

SEQ ID NO: 21757 - DNA, 201 bp, Homo sapiens
gcacgcagccgtcacgcgcaccgtacagcccagtccacgaagggcgccacgggccgtgacgtcactagccgccgacggcgcgctttcgtgacgcagcccgrgtctcagggaacatggcggcgctggtgagacccgcgaggtttgtcgtgcgaccgttgctgcaggtggtccaggcttgggaccttgacgcgaggcgctggg

SEQ ID NO: 21758 - DNA, 201 bp, Homo sapiens
gaggttgcgccattgcactccagcctgggcaacaagagtgaaactccgtcttaaaaaaaaacaaaaacaaaagcaaaaacaaaacgcaacaaagcgagacrtgacaggcaatgaaataaataaaaggaggcagatctcctaaagccaaaatgtcctatgcagacaaacagcattactgttcaccctgcatggtgcccacta

SEQ ID NO: 21759 - DNA, 201 bp, Homo sapiens
aatgaaaagttgtagagctggatgagaatttatttctctccgtgaaggtataatagcatcacccctataagaagataagctcaaatacaaccaaaatttcratgccctacgccctgccagtaagggaggaaagcagaggttacgatttacaagtaattctctatgtgttctttgggaaccaggatcctctgagtcaatccc

SEQ ID NO: 21760 - DNA, 201 bp, Homo sapiens
aaaaaaacaccatcaacaccctttaaatcaccagtgaggcagagaaacaccatctctccacgagtcccacacagccaagtctagcctcccacactggaacrgacggatctttcttttgctgagcaccggatgataaacaaggagcactgaacattctacagactcagcatgggggcatcggggacaggaggccgaccagtg

SEQ ID NO: 21761 - DNA, 201 bp, Homo sapiens
acatcgattatggaaaagaaatagatgccaattttaacacttggtttctggttctttatgtaatgatattgagttcccaaattgctgagtatatgagccaytcctgagtcttgacttctgaatcctatgaaaggaatgacgtcagcagctctgaatcctaatgtcattgtgatccgtttcccttagattcccttagcctca

SEQ ID NO: 21762 - DNA, 201 bp, Homo sapiens; identical to SEQ ID NO: 3156

SEQ ID NO: 21763 - DNA, 201 bp, Homo sapiens; identical to SEQ ID NO: 21677

SEQ ID NO: 21764 - DNA, 201 bp, Homo sapiens; identical to SEQ ID NO: 3185

SEQ ID NO: 21765 - DNA, 201 bp, Homo sapiens; identical to SEQ ID NO: 21678

SEQ ID NO: 21766 - DNA, 201 bp, Homo sapiens
cttgattgtttcctttttattttccaggctgtgtggatgcctgggagcccaaagtgctccgggcgggtatgggcgcacatttccggatgcccattatcaayaatctggaatgggaaaccgtgcccaattacctgccccctgacactcgggtctatgtggctgacaactgtggcctttatgcccaggctgagatgtctaata

SEQ ID NO: 21767 - DNA, 201 bp, Homo sapiens; identical to SEQ ID NO: 21679

SEQ ID NO: 21768 - DNA, 201 bp, Homo sapiens
cgcgatctcggcccactgcaacctccgcctctcgggttcaagggattctcttgcctcagcctccgcagtagctgggattacaggcgtctgccaccatgccmgggtgatttttgtatttttagtagaggtggggtttcaccatgttggccaggctgacgtcgaacttgtgacctcaggtgatcctcctgcctcggcctccca

SEQ ID NO: 21769 - DNA, 201 bp, Homo sapiens
gtgcaggcgctgttacatcctctgtgtcttattctccgtttaaaatctggtttgcctggttcgtctatcccgaggtttgacaaatgaacttctaaaataaytcgtcaggagaagacttgcgctaacaagctgtgcgggggagggtgggaggccatgcagtcactgcgaggccccaccctcggccactctcccagcccgccc

SEQ ID NO: 21770 - DNA, 201 bp, Homo sapiens
gtctatcccgaggtttgacaaatgaacttctaaaataactcgtcaggagaagacttgcgctaacaagctgtgcgggggagggtgggaggccatgcagtcaytgcgaggccccaccctcggccactctcccagcccgcccgtggtgaggagccgcccctgggaaaggccaggcgtcgcaggctgctgccggggttgcctctt

SEQ ID NO: 21771 - DNA, 201 bp, Homo sapiens
ccacccgctgattggctggctcacctcctgtgccgccacagcgccaccgctgattggccggctcaccccctgtgccgccacagcaccaccagtgattggcmggctcacctgtgccaccacacccccacccgctgattggccagctcacctcctgtgccaccacacccccccacccgctgattggccacctcaactgtgcca

SEQ ID NO: 21772 - DNA, 201 bp, Homo sapiens
tgattggcaggctcacctgtgccaccacacccccacccgctgattggccagctcacctcctgtgccaccacacccccccacccgctgattggccacctcamctgtgccaccacacccccaccggctgattggctggctcacctcctgtgccgccacagcgccaccgctgattggccggctcaccccctgtgccgccacagc

SEQ ID NO: 21773 - DNA, 201 bp, Homo sapiens
ccgcttttaagaagggtttgagctggaaaacaggttttgttttgttttgttttttgtttttgagatagtgtctctgttgcccaggccggaatgcagtggcrcgatcttgcctcactgcaacctccacctcctgggttcaagcaattctcttgcctcagcctcctgagtagctgggattacaggcatgcgccaccatgcctg

SEQ ID NO: 21774 - DNA, 201 bp, Homo sapiens
tgtcacttggggcaggtgtgctcacagtggccagcccatcttgaacttgtgcttgtcacttggggcaggtgtgcttacagtggccaacccatcttgaactycatcatcatacctgctttcatcatttcctggcttatccttatgttactatattttagatttgagggcagggaataagggagaaatggataggaactggca

SEQ ID NO: 21775 - DNA, 201 bp, Homo sapiens
ctcgtaacgccacaaggaataatgggttagtgattacccagtgtatctttttttttttttgtcttgttctgtcacccaggctggagtgcaatggcgcgatstcggcccactgcaacctccgcctctcgggttcaagggattctcttgcctcagcctccgcagtagctgggattacaggcgtctgccaccatgcccgggtga

SEQ ID NO: 21776 - DNA, 201 bp, Homo sapiens
cacccgctgattggccagctcacctcctgtgccaccacacccccccacccgctgattggccacctcaactgtgccaccacacccccaccggctgattggcyggctcacctcctgtgccgccacagcgccaccgctgattggccggctcaccccctgtgccgccacagcaccaccagtgattggcaggctcacctgtgccac

SEQ ID NO: 21777 - DNA, 201 bp, Homo sapiens
caccacacccccacccgctgattggccagctcacctcctgtgccaccacacccccccacccgctgattggccacctcaactgtgccaccacacccccaccsgctgattggctggctcacctcctgtgccgccacagcgccaccgctgattggccggctcaccccctgtgccgccacagcaccaccagtgattggcaggctc

SEQ ID NO: 21778 - DNA, 201 bp, Homo sapiens
ccccacccgctgattggccacctcaactgtgccaccacacccccaccggctgattggctggctcacctcctgtgccgccacagcgccaccgctgattggcyggctcaccccctgtgccgccacagcaccaccagtgattggcaggctcacctgtgccaccacacccccacccgctgattggccagctcacctcctgtgcca

SEQ ID NO: 21779 - DNA, 201 bp, Homo sapiens
acccgctgattggccagctcacctcctgtgccaccacacccccccacccgctgattggccacctcaactgtgccaccacacccccaccggctgattggctrgctcacctcctgtgccgccacagcgccaccgctgattggccggctcaccccctgtgccgccacagcaccaccagtgattggcaggctcacctgtgccacc

SEQ ID NO: 21780 - DNA, 201 bp, Homo sapiens
ctgtgccaccacacccccaccggctgattggctggctcacctcctgtgccgccacagcgccaccgctgattggccggctcaccccctgtgccgccacagcrccaccagtgattggcaggctcacctgtgccaccacacccccacccgctgattggccagctcacctcctgtgccaccacaccccccccccacccgctgatt

SEQ ID NO: 21781 - DNA, 201 bp, Homo sapiens
ctgattggccacctcaactgtgccaccacacccccaccggctgattggctggctcacctcctgtgccgccacagcgccaccgctgattggccggctcaccycctgtgccgccacagcaccaccagtgattggcaggctcacctgtgccaccacacccccacccgctgattggccagctcacctcctgtgccaccacacccc

SEQ ID NO: 21782 - DNA, 201 bp, Homo sapiens
taagtcgattacagaataatacagagtatgacacggaatgtaaaacacatttacatatggacaggtgtgcatatatataggtagatgcatagaacaagttytaaaaggatacactccaaaacagaacagttgagggggaggagagtggtactggtagaattttatgttgtttgaattttgccaatcagaatgtattcgtgg

SEQ ID NO: 21783 - DNA, 201 bp, Homo sapiens
accatgttgttcaggctggtctcaaactcctgaccttgtgatccgcccacctcagcctcccaaagtgctgggattataggcatgagccactgcgcccagcygaaaacaggtatttatgagttcctgatgtgaataaactgaaagagcctgtgtgaacgttaatagtgcacgcacatcatttgtccatttcactcacaggta

SEQ ID NO: 21784 - DNA, 201 bp, Homo sapiens
aagtagaagtaaaggacttctaaggtcctcagccctactgaatggcttttggccatctgtgactccgaagtggaggctctctcacagcacacagacgcctratacccttccattgccttcagtggtggataggctttttacctgcaccatcttttagaaagaatcctaaatctttgattgtatcatgtttcagtacaagta

SEQ ID NO: 21785 - DNA, 201 bp, Homo sapiens
tttgggaggccgaggcaggagggtcacttgagcccaggagttcaggaccatcctgggcaacatagtgagacctcatctctacaaaaaaaactacaattagytgggtgtggtggggtgtgcctgtactcagtcccagcaacttgggaggctgaggtgggaggattgcttgagcctgggatgtcaaagctcatcacatgtcaa

SEQ ID NO: 21786 - DNA, 201 bp, Homo sapiens; identical to SEQ ID NO: 21757

SEQ ID NO: 21787 - DNA, 201 bp, Homo sapiens
cttcatgatacttgaactatttagtttgttattattgaggatattctcataaaggcggaggaaaaatacttttcccaagcaaaatccaagttaaatatgtdaaattaaccaaacactggattgttgaaaaatatttagtcatttattcacctcaattaatgtaactttaggatacagattcttctgtgattttattatctt

SEQ ID NO: 21788 - DNA, 201 bp, Homo sapiens
tctgcttgtgattgacaagggcagtgcaccctacagactattttcattcattcaactccaggcactctcccaggtagctgccatgcggcgggtagaggcarggttcgcggaggggctggaacaaacaacaaataggtgtgatgggggctatttaaagaggatgttacagtagcggacaggatacctgcctgtctgaggtga

SEQ ID NO: 21789 - DNA, 201 bp, Homo sapiens
ctgactttatatggctgcgcctggcgagcgactgagtcgtccgtgaggaaaaagaggcgaggcttttccgagatcgtctcagcgatggcgcttcggtcgcrgttttgggggttctcggtttgcaggaaccctggtaattagtcttgccccccttctcccagctcactcgcctgggcttgcacagtacattggaacgtgcgg

SEQ ID NO: 21790 - DNA, 201 bp, Homo sapiens; identical to SEQ ID NO: 3189

SEQ ID NO: 21791 - DNA, 201 bp, Homo sapiens
cttcatggtctaccaaccaaccccgtgggaggcagcctcagactcggtatttttgttttcatgtacttattgaaaaggtattgtgttaattcttggcattrgataacttacataataataacagtttttacttaccaaatactttccatgtgtcagaccctttggtgagtactcaacagtgttacttcatttaatcctcac

SEQ ID NO: 21792 - DNA, 201 bp, Homo sapiens
tgatacttgaactatttagtttgttattattgaggatattctcataaaggcggaggaaaaatacttttcccaagcaaaatccaagttaaatatgttaaatkaaccaaacactggattgttgaaaaatatttagtcatttattcacctcaattaatgtaactttaggatacagattcttctgtgattttattatcttctcac

SEQ ID NO: 21793 - DNA, 201 bp, Homo sapiens
agtactgttatgatttcagtttttgcatttaaatttttgttccgtcttatatttattttggtgctagctataaataaaagcaaagagtaagtatatccatrtcatgcatatgttcagtaacttagctctgtctcttcaaatctctttgaagtagatctgtaaataaaactcagctcttcagaaacaaatttcttcatgata

SEQ ID NO: 21794 - DNA, 201 bp, Homo sapiens
gctgggtgacagtgagaccctgtttctgaaaaataataaaagccatatgacatggtttgatgtcatatttaaatatgcataccttgagattataaaaaaawttctcatgttttcttctagtactgttatgatttcagtttttgcatttaaatttttgttccgtcttatatttattttggtgctagctataaataaaagcaa

SEQ ID NO: 21795 - DNA, 201 bp, Homo sapiens
aaaccctgtctctacaaaaaaatacaaaaattagctgggtgcagtggcatgcgcctgtagtcccagccacttgggaggttgaggtggaaggatgacttgawcccaggaggcagaggctgctgtgagccaagttcgtgcctctgtactctagcctgagagacagaggcagaccctgtctcaaaaaaaaaaaaaaatggccat

SEQ ID NO: 21796 - DNA, 201 bp, Homo sapiens
agctactagggaggctgagacaggagagtggcgtgaacctgggaggcggagcttgcagtgagccgagatcgcgccactgcactccagcctgggcaacagastgagactccgtctcaaaaaaaaaaaaagagattgtgattttttactagagccaccaggaaaaccaggagtagactccatatttccaaatctaatgcctct

SEQ ID NO: 21797 - DNA, 201 bp, Homo sapiens
ggatcacgaggtcaggagatcaagaccatcctggctaacacggtgaaaccccgtctctactaaaaatacacaaaaaaattagccaggcgtggtggcaggcrcctgtagtcccagctactagggaggctgagacaggagagtggcgtgaacctgggaggcggagcttgcagtgagccgagatcgcgccactgcactccagcc

SEQ ID NO: 21798 - DNA, 201 bp, Homo sapiens
tgtttttactttttttaagttaaaaaaaaaatcaaaagaatattttgtggcttgggaaaattaaatgaaaatcaaatttcgttgcccaggttcttagaacmtagctgtacctactctcatttgtttacgcatcacctggctgttctagcactacaatggctgagtcgaacagtttcaacagaagctattggacctagaaag

SEQ ID NO: 21799 - DNA, 201 bp, Homo sapiens
gtagagatggggttttgctgctgcccaggctggtctcgagctcttgagctcgagagatctgcctgattcagcctcccaaggtgctgggattacagacgtgrgccactgcactcggccccaacgcattactttgatttaatatttggatcattaaaaataactaaagatgtatttcctcattttttctctgtctgccttact

SEQ ID NO: 21800 - DNA, 201 bp, Homo sapiens
tttttgtagagatggggttttgctgctgcccaggctggtctcgagctcttgagctcgagagatctgcctgattcagcctcccaaggtgctgggattacagrcgtgagccactgcactcggccccaacgcattactttgatttaatatttggatcattaaaaataactaaagatgtatttcctcattttttctctgtctgcc

SEQ ID NO: 21801 - DNA, 201 bp, Homo sapiens
ggccggctaatttttttctttttctttttttttttttctggtattttttgtagagatggggttttgctgctgcccaggctggtctcgagctcttgagctcragagatctgcctgattcagcctcccaaggtgctgggattacagacgtgagccactgcactcggccccaacgcattactttgatttaatatttggatcatt

SEQ ID NO: 21802 - DNA, 201 bp, Homo sapiens
acttcttaagtactatgtaaagttgtaagagtaaattggaaatcattactgtgtgatgtattatttatttattgaacaagcatcatacctgtatcacttgmtaggcattgcgttagaggcaggagttacaaagataaagtagatgttatccctgtcatcaaaagtcttaagtttcatagtggaaagtggaatggggataat

SEQ ID NO: 21803 - DNA, 201 bp, Homo sapiens
attaaatttttgagggagcaggacttgaagaaagaccagttaggagtctagtatgacttgagatactttgttataaaggtggttgtttaatgaacacttayatttgccaggaattatgctacttgctttatatgttttttctcatttaatccttaaaattacatcatgaagcagttataatttcccccattttacaggatc

SEQ ID NO: 21804 - DNA, 201 bp, Homo sapiens
ctggccaacatggtgaaaccccgtctctactaaaaatataaaaattagaggggcgtggtggtgcacgcctgtaatcccagctactccagtggctgaggcaygagaatcacttgaacccaggaggcggaggttgcagtgagctgagcgcctgggcgacagagcaaaattctgtctcaaaaaaaaaaaaatcattttagctgc

SEQ ID NO: 21805 - DNA, 201 bp, Homo sapiens
atttaaagcttgagcccgaattggtttttcaagatcattctggctgggcgcattgtctcatgcctgtaatcccagcactttagggagccagccgaagaagscggatcatctgaggtcaggagtttgagaccaacctggccaacatggtgaaaccccgtctctactaaaaatataaaaattagaggggcgtggtggtgcacg

SEQ ID NO: 21806 - DNA, 201 bp, Homo sapiens
ccattttacaggatcaaagaaattgaggtttagggagacatgattagtaagtgccagagctaagatttacatatgttttaactgacctcagagccaggacrctaggttattaccactatactacagcatgtaagtgtttatcaggtttatctgctgcttatctgcttggtgaggattttttagaatttcttaaggacttct

SEQ ID NO: 21807 - DNA, 201 bp, Homo sapiens
tgatgactcttaacgagcatgctgccttcaagcatctgtttaacaaagcacatcttgcacaacccttaatccatttaaccctgagtttgacacagcacgtrtttcagagagcagggggttgggggtaaggtcatagattaacagaatctcaaggcagaagaatttttcttagtacagaacaaaatggagtctcctatgtct

SEQ ID NO: 21808 - DNA, 201 bp, Homo sapiens; identical to SEQ ID NO: 3200

SEQ ID NO: 21809 - DNA, 201 bp, Homo sapiens; identical to SEQ ID NO: 3193

SEQ ID NO: 21810 - DNA, 201 bp, Homo sapiens; identical to SEQ ID NO: 3195

SEQ ID NO: 21811 - DNA, 201 bp, Homo sapiens; identical to SEQ ID NO: 3202

SEQ ID NO: 21812 - DNA, 201 bp, Homo sapiens; identical to SEQ ID NO: 3199

SEQ ID NO: 21813 - DNA, 201 bp, Homo sapiens
tgacatcttgtccatataatattttgaaatgctgctgaaccttgacatctctacatttcctttttacttacatcattattaagatcactttctgaaaaacygttgtaggctgggaagttagcaagaacaaatcaatttatttctgtcttttggaaggtgaaagtattttcagcctactcgtgctgctgacttaatcttttc

SEQ ID NO: 21814 - DNA, 201 bp, Homo sapiens
gctgggaagttagcaagaacaaatcaatttatttctgtcttttggaaggtgaaagtattttcagcctactcgtgctgctgacttaatcttttccttttttwtctgattttcaaaaccagatgaaacgactacaaagtgccatgacagaaggtggtgtggttctacgggaacctcagagaatctatgaataaatggaagcat

SEQ ID NO: 21815 - DNA, 201 bp, Homo sapiens
ttaagatcactttctgaaaaactgttgtaggctgggaagttagcaagaacaaatcaatttatttctgtcttttggaaggtgaaagtattttcagcctactygtgctgctgacttaatcttttccttttttttctgattttcaaaaccagatgaaacgactacaaagtgccatgacagaaggtggtgtggttctacgggaac

SEQ ID NO: 21816 - DNA, 201 bp, Homo sapiens
gtgctggcacagagatgcttagaggcgggaatcaacttcatggtctaccaaccaaccccgtgggaggcagcctcagactcggtatttttgttttcatgtayttattgaaaaggtattgtgttaattcttggcattggataacttacataataataacagtttttacttaccaaatactttccatgtgtcagaccctttggt

SEQ ID NO: 21817 - DNA, 201 bp, Homo sapiens
tgttattattgaggatattctcataaaggcggaggaaaaatacttttcccaagcaaaatccaagttaaatatgttaaattaaccaaacactggattgttgraaaatatttagtcatttattcacctcaattaatgtaactttaggatacagattcttctgtgattttattatcttctcaccccatttaggttgcgagttat

SEQ ID NO: 21818 - DNA, 201 bp, Homo sapiens
ttatatttattttggtgctagctataaataaaagcaaagagtaagtatatccatgtcatgcatatgttcagtaacttagctctgtctcttcaaatctctttgaagtagatctgtaaataaaactcagctcttcagaaacaaatttcttcatgatacttgaactatttagtttgttattattgaggatattctcataaaggc

SEQ ID NO: 21819 - DNA, 201 bp, Homo sapiens
cattaatatttttcttttctgtgaacagtctgtttggataatgctttgcctattaagttatgaaggggtgggttgcccctcctcacctgtgggtgtttctygttaggtggaacgagagacttggaaaagaaaaagacacaaagtatagagaaagaaataaggggacccagggaaccagcgttcagcatatggaggatcccg

SEQ ID NO: 21820 - DNA, 201 bp, Homo sapiens
ttgcatcgaattgtcttgtccatgcattttgttagtgagattgagcatatttttgtgaatttgagtcattaatatttttcttttctgtgaacagtctgttyggataatgctttgcctattaagttatgaaggggtgggttgcccctcctcacctgtgggtgtttcttgttaggtggaacgagagacttggaaaagaaaaag

SEQ ID NO: 21821 - DNA, 201 bp, Homo sapiens
tcttcatggtagttaagagcattgactctggagccagacactgggacttaaaccatggctccattacttactagttttaatctttttcaagttacttaacstttctgtgttagtttctgcagctaaaaaaaaatatagaaaaaataatagaattgagacataagctttatctataaaccgttaagacaggcctggcatata

SEQ ID NO: 21822 - DNA, 201 bp, Homo sapiens
ggcggcgtctggcgtggagagtttggggatctacagcagccaaaggcttgtccctgactttatatggctgcgcctggcgagcgactgagtcgtccgtgagraaaaagaggcgaggcttttccgagatcgtctcagcgatggcgcttcggtcgcagttttgggggttctcggtttgcaggaaccctggtaattagtcttgcc

SEQ ID NO: 21823 - DNA, 201 bp, Homo sapiens; identical to SEQ ID NO: 3190

SEQ ID NO: 21824 - DNA, 201 bp, Homo sapiens; identical to SEQ ID NO: 3192

SEQ ID NO: 21825 - DNA, 201 bp, Homo sapiens; identical to SEQ ID NO: 3198

SEQ ID NO: 21826 - DNA, 201 bp, Homo sapiens
cttggagctggggtgtaactggaggggcgggcccttctccaagttagagttggggttctgagcgagtcgtgcgttttaggtttagtgtcttttccttgtcyctgctcggggagcgtgaggcagatcggccggctttgctccaggcctcaggagtgtaagtttaagggcgcgaacctgggtgggacggggcagtttttccag

SEQ ID NO: 21827 - DNA, 201 bp, Homo sapiens
ccacctcagcctcctgagtggctgggactagaggcgcatgccattactcccagctaatttgttttgttttgtttgagacaagctctggctctatcacccargctggagtgcagtggtacagtatcagctggctgcaacctctgcctcccaggctcaaacgattctcccatctcagcttcctgagcatctgggactgcaggc

SEQ ID NO: 21828 - DNA, 201 bp, Homo sapiens
gcttttccgagatcgtctcagcgatggcgcttcggtcgcagttttgggggttctcggtttgcaggaaccctggtaattagtcttgccccccttctcccagstcactcgcctgggcttgcacagtacattggaacgtgcgggttctattttgtattcgacgtgccggatcgaaatagagctcgcggcactgcgaagaccaca

SEQ ID NO: 21829 - DNA, 201 bp, Homo sapiens
ccattacttactagttttaatctttttcaagttacttaacctttctgtgttagtttctgcagctaaaaaaaaatatagaaaaaataatagaattgagacayaagctttatctataaaccgttaagacaggcctggcatatactaagtgctcagtaaatgttaactattatcttcatcattataaagcattatttcattcat

SEQ ID NO: 21830 - DNA, 201 bp, Homo sapiens
gaggcttttccgagatcgtctcagcgatggcgcttcggtcgcagttttgggggttctcggtttgcaggaaccctggtaattagtcttgccccccttctccyagctcactcgcctgggcttgcacagtacattggaacgtgcgggttctattttgtattcgacgtgccggatcgaaatagagctcgcggcactgcgaagacc

SEQ ID NO: 21831 - DNA, 201 bp, Homo sapiens
gcatacacataaacatctcaatgctttacaaagcagtattgctgcccgcatgtcccacctccagccctaaggcggtttttccctaactcagtagatggaaygtacaatcgggttttataccgagacagtgcattgcccagggacaggcaggagacagatgctttcctcttgtctcaagtgcaagaggcatgccttcctctt

SEQ ID NO: 21832 - DNA, 201 bp, Homo sapiens; identical to SEQ ID NO: 3203

SEQ ID NO: 21833 - DNA, 201 bp, Homo sapiens
tttcactctgtcacccaggctggagtgcagggcattatcacggctcactgcagccacaacctcctgggctcaaacaatcttcccacctcagcctcccaagyagctgggactacaggtgcacaccatcacgcctggctgattttttctattttttgtagagacagagtgtcactgtgttgcctgggctggtcttgaactcct

SEQ ID NO: 21834 - DNA, 201 bp, Homo sapiens
gtgctgctgacttaatcttttccttttttttctgattttcaaaaccagatgaaacgactacaaagtgccatgacagaaggtggtgtggttctacgggaacytcagagaatctatgaataaatggaagcattaattgttttgaacatgtaaatataaatctgtcagccactacagccatcaaaagagagcatctggaagaac

SEQ ID NO: 21835 - DNA, 201 bp, Homo sapiens
gtcatatttaaatatgcataccttgagattataaaaaaatttctcatgttttcttctagtactgttatgatttcagtttttgcatttaaatttttgttccrtcttatatttattttggtgctagctataaataaaagcaaagagtaagtatatccatgtcatgcatatgttcagtaacttagctctgtctcttcaaatctc

SEQ ID NO: 21836 - DNA, 201 bp, Homo sapiens
cttggcaacatagggagaccctgtctctacaaaataaaaattatcttggtgcagtggcatgcacctgtaatgccaactacttgggagactaaggcaggagrgttgcttgagcctaggggtttgaggctacagtgagctgtggttgcactgctgtactccgagctgggtgacagtgagaccctgtttctgaaaaataataaa

SEQ ID NO: 21837 - DNA, 201 bp, Homo sapiens
ctgcctcagccttccaaagtgctgggattacaagcttgagtcacatgcccagcctaaaatattttttgtttcattgcttttcttttgacttcattttactktttttttttttttttttttaaccatgcagcaaattttgtccatcatttcttttttatgccatatgaggggctgggcatggtggctcagcctgtaacccca

SEQ ID NO: 21838 - DNA, 201 bp, Homo sapiens
cctcctgcctcagccttccaaagtgctgggattacaagcttgagtcacatgcccagcctaaaatattttttgtttcattgcttttcttttgacttcatttyactttttttttttttttttttttaaccatgcagcaaattttgtccatcatttcttttttatgccatatgaggggctgggcatggtggctcagcctgtaac

SEQ ID NO: 21839 - DNA, 201 bp, Homo sapiens
ctcgcaatattaaaagtagagaatttcagaatattatagtaggaaatgacctttgacataatgaatcgggcccttcattgaacaaatggttcaagtgtcascaaactacggcccgtgggccaaaggtagattgtgagctaaaaacttgtttttactttttttaagttaaaaaaaaaatcaaaagaatattttgtggcttgg

SEQ ID NO: 21840 - DNA, 201 bp, Homo sapiens
gctggagtgcagtggtacagtatcagctggctgcaacctctgcctcccaggctcaaacgattctcccatctcagcttcctgagcatctgggactgcaggcwcacactaccatggccggctaatttttttctttttctttttttttttttctggtattttttgtagagatggggttttgctgctgcccaggctggtctcgag

SEQ ID NO: 21841 - DNA, 201 bp, Homo sapiens
caatcttcccacctcagcctcctgagtggctgggactagaggcgcatgccattactcccagctaatttgttttgttttgtttgagacaagctctggctctrtcacccaggctggagtgcagtggtacagtatcagctggctgcaacctctgcctcccaggctcaaacgattctcccatctcagcttcctgagcatctggga

SEQ ID NO: 21842 - DNA, 201 bp, Homo sapiens
gcttcggtcgcagttttgggggttctcggtttgcaggaaccctggtaattagtcttgccccccttctcccagctcactcgcctgggcttgcacagtacatkggaacgtgcgggttctattttgtattcgacgtgccggatcgaaatagagctcgcggcactgcgaagaccacagtaggaagttaaggacggggtcagtgct

SEQ ID NO: 21843 - DNA, 201 bp, Homo sapiens; identical to SEQ ID NO: 3191

SEQ ID NO: 21844 - DNA, 201 bp, Homo sapiens; identical to SEQ ID NO: 3204

SEQ ID NO: 21845 - DNA, 201 bp, Homo sapiens
aagtaaccctgagagcttaccagtgaatttcacaatccaattttaagatagtatcttctaggtgttggccatgtgggtaatagttaaagaaatactagttactaggactgagttcattacttcccaaggtaaaaaaaaaaaaaaaaaaaaaaagacattggcttacttggcataaaaggaacgaggtaagataggcaggga

SEQ ID NO: 21846 - DNA, 201 bp, Homo sapiens
cagacaaaagcaaactagagagattgatagttgtacaatgcatgcttctttattggctcaaataaaggagctagaaggacattactgaaatataggtgaartttgaatgtggaccaaggattagataatagtgtttgattcatgttaaatttcctgatttttgttttgttttgtgagacagggtcacccaggctggagtgc

SEQ ID NO: 21847 - DNA, 201 bp, Homo sapiens
caaaactctgtctcaaaaaattaaattaaattaaattaaattaaaaaataggccaggtgtggtggctcatgcctgtaatcccagcactttgggaggtcaaygcaggcagatcacctgaggtcgggagtttgagacccacatgaccaacatggagaaactccatctctactaaaaatacaaaattagccaggctggtggcgc

SEQ ID NO: 21848 - DNA, 201 bp, Homo sapiens
tctcaggttcaagcaattctcctgcctcaacctcctgagtagctgggattacaggcgtgcaccaccatgcccagctaatttttgtatttttagtagagagrgggggtttcaccatattgtccaggctggtctcaaactcctgacctcaagtaatgcgcccccccccccggcctcccaaagtgctgggattacaggtgtgag

SEQ ID NO: 21849 - DNA, 201 bp, Homo sapiens
aggtggtaaagaagccacagatatgtaactgaggttaataagcatggtagaaattaagtcactcatattttacaggaataaatgatggtgctgcagctgtygttcttatgaagaagtcagaagctgataaacgtgggcttacacctttagcacggatagtttcctggtcccaagtgggtgtggagccttccattatgggaa

SEQ ID NO: 21850 - DNA, 201 bp, Homo sapiens
caggccaagccgcgaggagccgcgggatccctggaaccctgcggctcccgcgttccctgacctggtgctacagccccaccctctcctctcccgatgtgcgyactccgtccctcgtgcttggattggctcccggggtagagccatcgcgtggcctgcctctcccattggttggcgtagggaggtgttctcctccggggcccc

SEQ ID NO: 21851 - DNA, 201 bp, Homo sapiens
tgaaagggtagcatgctgatacattaagaggaaaaagacaagtttaagattttaaactgtgtccacagaagaataaacaatctaaatcttttctcccccgytaggtcaatattgaaggaggggctatagccttgggccaccctcttggagcatctggctgtcgaattcttgtgaccctgttacacacactggagagaatgg

SEQ ID NO: 21852 - DNA, 201 bp, Homo sapiens
ttgagatttcaggtgtgagccactacccccagccactgagagcatttggatcacatgctttctaggggaactgattctgttacattagccttaggtacacrtaacagatgctactggttcaaaattttaagacaatttagaatttctaagggatcttttagatcacacccttaaccttttggatggaatggatgtcactaa

SEQ ID NO: 21853 - DNA, 201 bp, Homo sapiens
aataagcatggtagaaattaagtcactcatattttacaggaataaatgatggtgctgcagctgtcgttcttatgaagaagtcagaagctgataaacgtggrcttacacctttagcacggatagtttcctggtcccaagtgggtgtggagccttccattatgggaataggaccaattccagccataaagcaagctgtgagta

SEQ ID NO: 21854 - DNA, 201 bp, Homo sapiens
tttcctgtcagagatctcccctccccaactgctgtaatcctttttttttctttttgagacggagcctcactctgtcgcccaggctggagtgcagtggtgcratcttggctcactgcaatctccgcctcccaggttcaagcaattctcctgtctcagcctcctgagtggctgggactacaggcgcacaccaccacaccggct

SEQ ID NO: 21855 - DNA, 201 bp, Homo sapiens
tcctgggctcaagtgagccccctgccttaacctcccaagtagctgggggactacaggcatgagccaccacacccaactcaatatttatgtacaaaattatycttaaaacagtttaaggaaacatgtcatttctctgtatttgatcattgacttaacctatactgaaagaattaatttggtttcttgacatcccaactagac

SEQ ID NO: 21856 - DNA, 201 bp, Homo sapiens
caggacaaggttgcagttctgtcccagaacaggacagagaatgcacagaaagctggccattttgacaaagagattgtaccagttttggtgtcaactagaaraggtgagtatatcatagtggtttaaacatcaacctatttataggtaagagtaacatctaaaagagtaatacataggaatctttagaaattatatcttagt

SEQ ID NO: 21857 - DNA, 201 bp, Homo sapiens
attcatgttaaatttcctgatttttgttttgttttgtgagacagggtcacccaggctggagtgcagaggcacaatcatggctcactgcagccttgaactcytaggctcaagtgatccttctgcctcagcctcccaagcagctaggactactagctacatggcacacacaccatgcccggctaaatttatttttaatggaga

SEQ ID NO: 21858 - DNA, 201 bp, Homo sapiens
gaaagtaatgagttataacttattcaataaaatgaaaatgtatgagtccatcctgatataaataactgaataaatgggagaaaaggaaaaggttttctttrtggtaaaatgccaattaatatcttaccaatagaaggaatgttggagttagaaagtcatgaatgaatgctaaaactagtgggtgaaaatatgatggggaag

SEQ ID NO: 21859 - DNA, 201 bp, Homo sapiens
gcctaaattttgaacaatttcagcgtgcaaataagtaatgatagtaatgggttataactgcccaagtattgaaaaatttcagcatcaaagtaagtaatgaragtaatgagttataacttattcaataaaatgaaaatgtatgagtccatcctgatataaataactgaataaatgggagaaaaggaaaaggttttctttatg

SEQ ID NO: 21860 - DNA, 201 bp, Homo sapiens
tgggagtatggttccaacaatacaggtaagttccctgccctcttagggctcagttctgagcttggaaaataggtgccacatcatgccccttgcaaatgggrcatatcactccccagaggaatatagctgagtcctgagagtgcccccatcttctgattctttgggtttgaacactcgtaattaattaattaattattatta

SEQ ID NO: 21861 - DNA, 201 bp, Homo sapiens
ttttcagtctcaagtaaccttacccgtttttagtttccagcctaatcccagattgataacattgtgatgaatataatctctaagtttttatcagcgacttmtttgctagttcttccccacaaactctccaaggaagggtggtaggtttgagtatatctgaaactgggaatagagtaaccactttataaacatttaccattg

SEQ ID NO: 21862 - DNA, 201 bp, Homo sapiens
gcaccgcactgggcctgtctttttaatatgtatatgatcctgcatatgttttcagtctcaagtaaccttacccgtttttagtttccagcctaatcccagaytgataacattgtgatgaatataatctctaagtttttatcagcgacttatttgctagttcttccccacaaactctccaaggaagggtggtaggtttgagta

SEQ ID NO: 21863 - DNA, 201 bp, Homo sapiens
ggcgtagggaggtgttctcctccggggcccctgattggccggctccgggaggcgccatcggtaatgcctgcggcaggggcggaactgctaggtggtctgagcccggctttgggctggggtcgggctgtcacacaatggctagaagtcgtgacttcgtctccttcgtgccgcatggttttcaacgcccttgacccgccggtt

SEQ ID NO: 21864 - DNA, 201 bp, Homo sapiens
ccaagacgtcaagtcggggaactccaacattggggtgtccagaaacactggggtttcaggcgctctgtaaatgcgtccgaggtccgcggttctgcccgcargcccagaccccggcctcacttccgccccgcgccccgcgccccggcctcacttccgccccgcgccccgcgccccgcgccccgcgcgcctccgcccgcccct

SEQ ID NO: 21865 - DNA, 201 bp, Homo sapiens; identical to SEQ ID NO: 3211

SEQ ID NO: 21866 - DNA, 201 bp, Homo sapiens
tacagccccaccctctcctctcccgatgtgcgtactccgtccctcgtgcttggattggctcccggggtagagccatcgcgtggcctgcctctcccattggktggcgtagggaggtgttctcctccggggcccctgattggccggctccgggaggcgccatcggtaatgcctgcggcaggggcggaactgctaggtggtctg

SEQ ID NO: 21867 - DNA, 201 bp, Homo sapiens
caggagcgccgagggccggacttgtgtaggagaggggcgtatgtggaggaagccggtcaggccaagccgcgaggagccgcgggatccctggaaccctgcgsctcccgcgttccctgacctggtgctacagccccaccctctcctctcccgatgtgcgtactccgtccctcgtgcttggattggctcccggggtagagccat

SEQ ID NO: 21868 - DNA, 201 bp, Homo sapiens; identical to SEQ ID NO: 3215

SEQ ID NO: 21869 - DNA, 201 bp, Homo sapiens
aaatttctccagttacatgaaaaatggctctataaatgtgttggtagcacaaagcattaagagaatataaatgtttttgagctgttttctgtcaatattcyaatgtaaaaagacctttgataggatcagggataataaaagtattttatgtgacagccagcacaagacatacctccagaagctttggcaatgcgtttaagg

SEQ ID NO: 21870 - DNA, 201 bp, Homo sapiens
aaaaaaatggcattttaataaaataagtctacataaagttcccttaagtcctgcctacacaggatatttagatatactatacagaaacaatgtctagtccmtgcagaagagatgaaaatggttacttcatctcaatttacagtggcccaatgttattttatcccatgcgtataactgctcgtatcactgtgagactacaag

SEQ ID NO: 21871 - DNA, 201 bp, Homo sapiens
aggtcatctttggacatgtcttggcagcaggtaagtctcagtgattccaggagaagtcaggcttattagaaacagcccataaacacacacacacacacacwctctcacacactcacacactctctcactcactcaagttcttgcctccttgcttttgctcagagttccctctgttatgattcctcctgttggcccccttct

SEQ ID NO: 21872 - DNA, 201 bp, Homo sapiens
catcgcgtggcctgcctctcccattggttggcgtagggaggtgttctcctccggggcccctgattggccggctccgggaggcgccatcggtaatgcctgcrgcaggggcggaactgctaggtggtctgagcccggctttgggctggggtcgggctgtcacacaatggctagaagtcgtgacttcgtctccttcgtgccgca

SEQ ID NO: 21873 - DNA, 201 bp, Homo sapiens
cgatgtgcgtactccgtccctcgtgcttggattggctcccggggtagagccatcgcgtggcctgcctctcccattggttggcgtagggaggtgttctcctscggggcccctgattggccggctccgggaggcgccatcggtaatgcctgcggcaggggcggaactgctaggtggtctgagcccggctttgggctggggtcg

SEQ ID NO: 21874 - DNA, 201 bp, Homo sapiens
ggatcttttagatcacacccttaaccttttggatggaatggatgtcactaaggcaaaaatgtgtgagaatgtcactgtattaacctaagaacaaaccaaastagcagttaccagtatcatgcagcatatatttatgttgacaaagaatggtttaactttagcctttccacccaagtttagacctcttttctatgaatcttt

SEQ ID NO: 21875 - DNA, 201 bp, Homo sapiens
acctttagcacggatagtttcctggtcccaagtgggtgtggagccttccattatgggaataggaccaattccagccataaagcaagctgtgagtataaccytattcccttttatgaaatttgtcttcctgttagccttaagtgagcttattcatgtagttagctctagtctttccctaccagaagagtaaccaagagcatt

SEQ ID NO: 21876 - DNA, 201 bp, Homo sapiens
tgagccccctgccttaacctcccaagtagctgggggactacaggcatgagccaccacacccaactcaatatttatgtacaaaattattcttaaaacagttkaaggaaacatgtcatttctctgtatttgatcattgacttaacctatactgaaagaattaatttggtttcttgacatcccaactagacatacaaatgaaga

SEQ ID NO: 21877 - DNA, 201 bp, Homo sapiens
tttggggtcactcgctattttctaatacagaatgctcccgtcaagctcccttattgataactgatatctcttatgtcctgccagcagtgcacgattggctytgagactgcctgatccactcactcgtaaccagccaagtactatgacccaaactatagcagaatttggcacaaacaggtccctggtagctactttcctcag

SEQ ID NO: 21878 - DNA, 201 bp, Homo sapiens
tcacatttctaaagggtggatcttttggggtcactcgctattttctaatacagaatgctcccgtcaagctcccttattgataactgatatctcttatgtcmtgccagcagtgcacgattggctttgagactgcctgatccactcactcgtaaccagccaagtactatgacccaaactatagcagaatttggcacaaacagg

SEQ ID NO: 21879 - DNA, 201 bp, Homo sapiens
gtttaaacatcaacctatttataggtaagagtaacatctaaaagagtaatacataggaatctttagaaattatatcttagttatgtttttcaggttgcaartatatgtcctggatacatgaatgtggggagggggtatgctgggtttacaggacacggtaacatgggacctatgtcagcactcaagcactcttggttccag

SEQ ID NO: 21880 - DNA, 201 bp, Homo sapiens
tacataggaatctttagaaattatatcttagttatgtttttcaggttgcaaatatatgtcctggatacatgaatgtggggagggggtatgctgggtttacrggacacggtaacatgggacctatgtcagcactcaagcactcttggttccagagcgtccatgaccactgtgcacacacagcaggtttcatgagaagctgga

SEQ ID NO: 21881 - DNA, 201 bp, Homo sapiens
tgtgatggtcttacagatgcatttcacaactgtcatatgggtattacaggtaaggcagacatggctgaaactgtattagctttaaaaaggttaaaaagacmatatactaatctgcttcttaggtgctttcgtccttatggccagagactgtcttaaggatttttatatctcttctttgattaactgaagtgaagtaagtat

SEQ ID NO: 21882 - DNA, 201 bp, Homo sapiens
gccagggttgacagaatagttgctaataagagagttacaaaggatctgtgaatattgctctttcatgattttaatatccttggactcagtagcatttgtgrtaaaagtgctatattacaagtttagaatttagttaggcagcacacggtaactccttttatcctaagatggaactgtcattttagaaatgaacaaattcag

SEQ ID NO: 21883 - DNA, 201 bp, Homo sapiens
ttacagcttgtactttactttaatgtgtaatactcaactcaaggtacaagacaattgcatttaacattgttataaataaaaggaacatcagatcaatcatwaagggctccagagtgaacagcatcttcataacttccatgtttatcatctttactttctggatgtaatttaataagatcatcaattcgaagaatggtgatt

SEQ ID NO: 21884 - DNA, 201 bp, Homo sapiens
tttacagcttgtactttactttaatgtgtaatactcaactcaaggtacaagacaattgcatttaacattgttataaataaaaggaacatcagatcaatcawtaagggctccagagtgaacagcatcttcataacttccatgtttatcatctttactttctggatgtaatttaataagatcatcaattcgaagaatggtgat

SEQ ID NO: 21885 - DNA, 201 bp, Homo sapiens; identical to SEQ ID NO: 3219

SEQ ID NO: 21886 - DNA, 201 bp, Homo sapiens
cttgggagcaaatggccctagttagaaacactgataatgcctaggttatatcctgtgtttattagacataggtttgataatgcttatttaagcacccccccgcacttttttttttttgagacggagtttcgcccttgttgcccaggctggagtgtaatggtgtgatctcagctcaccgcaacctccgcttcccaggttcaa

SEQ ID NO: 21887 - DNA, 201 bp, Homo sapiens
ctctgtctcaggttcaagcaattctcctgcctcaacctcctgagtagctgggattacaggcgtgcaccaccatgcccagctaatttttgtatttttagtasagagggggggtttcaccatattgtccaggctggtctcaaactcctgacctcaagtaatgcgcccccccccccggcctcccaaagtgctgggattacaggt

SEQ ID NO: 21888 - DNA, 201 bp, Homo sapiens; identical to SEQ ID NO: 3209

SEQ ID NO: 21889 - DNA, 201 bp, Homo sapiens
ggatttaaaaataaaagcaaaaaatgtaaagcttctagaagtatatataagagaatagcttttacagggtgcagtggcaggtgcctatagtcccagctacyagggaggctgtggtgggaggatcacttgaggccagcagtttgaggttgtatagtatactatggttgattttgcctgttagtagctgctgcactccagcct

SEQ ID NO: 21890 - DNA, 201 bp, Homo sapiens
tcattaagggctccagagtgaacagcatcttcataacttccatgtttatcatctttactttctggatgtaatttaataagatcatcaattcgaagaatggkgattgcagcttctgttgcaaatttcaaactcttaactttaactatggttggttcaaacacccctgcttgtttgttgtctcgaggtttaccattgctcaaa

SEQ ID NO: 21891 - DNA, 201 bp, Homo sapiens
atatgggtattacaggtaaggcagacatggctgaaactgtattagctttaaaaaggttaaaaagaccatatactaatctgcttcttaggtgctttcgtccktatggccagagactgtcttaaggatttttatatctcttctttgattaactgaagtgaagtaagtattctcttctttgtgaactcttgattatcagagaat

SEQ ID NO: 21892 - DNA, 201 bp, Homo sapiens
ggtgctacagccccaccctctcctctcccgatgtgcgtactccgtccctcgtgcttggattggctcccggggtagagccatcgcgtggcctgcctctcccrttggttggcgtagggaggtgttctcctccggggcccctgattggccggctccgggaggcgccatcggtaatgcctgcggcaggggcggaactgctaggtg

SEQ ID NO: 21893 - DNA, 201 bp, Homo sapiens
aacaacaacaacaaaagaatagcttccagccgggcgcggtggctcacgcctgtaatcctagcactttgggaggccgaggcgggcggatcatgaggtcaggmgattgagaccatcctggctaacacggtgaaaccccatctctactaaaactacaaaaaattagccaggtgttgcagcaggtgcctgtagtcccagctactc

SEQ ID NO: 21894 - DNA, 201 bp, Homo sapiens
tttgaggttgtatagtatactatggttgattttgcctgttagtagctgctgcactccagcctggtcaacatagtgagacatcatccaacaaaaaaaaaaaraaagaaagaaaaacagcttgataagtaaagacaagacatagaaagcaaagcaataacttttttgtgtgtgtgtgtggagacgggtctcactctggcaccc

SEQ ID NO: 21895 - DNA, 201 bp, Homo sapiens
ttttcaacaaatggtgctggaataacagattactcacatgggaaagatgaacctagatccctacctcacaccctatataaaagctaatttgagataaatcrtggatttaaaaataaaagcaaaaaatgtaaagcttctagaagtatatataagagaatagcttttacagggtgcagtggcaggtgcctatagtcccagcta

SEQ ID NO: 21896 - DNA, 201 bp, Homo sapiens
gatttcaggtgtgagccactacccccagccactgagagcatttggatcacatgctttctaggggaactgattctgttacattagccttaggtacacataasagatgctactggttcaaaattttaagacaatttagaatttctaagggatcttttagatcacacccttaaccttttggatggaatggatgtcactaaggca

SEQ ID NO: 21897 - DNA, 201 bp, Homo sapiens
gtgtaaataaatactgtataaaatgcaaagcactcagaatagccaaaacaattttgaagtcagaaaatagcacttacatgctctgattttaacattacctwtaaagctgttgtaaacaagacaatgtggttttggcataaggacagagaaagagaacagagttcagaaatagacccagacttatgctcgttttcaacaaag

SEQ ID NO: 21898 - DNA, 201 bp, Homo sapiens
attccctagatagaagctgattcagcccagccattgctgaggttcaggaggaggcaggctaaaggtaacaaaaataatcggagtgattttgatgggatgayactgacatctgtgtagtactttaccaggtgcttttgtacatgtgttcacaacagccccatatagggtagatgataccattcccagtttacaggtaaggaa

SEQ ID NO: 21899 - DNA, 201 bp, Homo sapiens
tcaacatagtgagacatcatccaacaaaaaaaaaaaaaaagaaagaaaaacagcttgataagtaaagacaagacatagaaagcaaagcaataacttttttktgtgtgtgtgtggagacgggtctcactctggcacccagattggagtgcagtggctcaatcttggctcactgcaacccccacctcagcctcctgagtagct

SEQ ID NO: 21900 - DNA, 201 bp, Homo sapiens
tagatatactatacagaaacaatgtctagtccctgcagaagagatgaaaatggttacttcatctcaatttacagtggcccaatgttattttatcccatgcstataactgctcgtatcactgtgagactacaagcagcaaataaatgggaagaaaacctacttttacttaacaaaatcggtataactttacaattttagaaa

SEQ ID NO: 21901 - DNA, 201 bp, Homo sapiens
gcctcccgagtagctgggactacaggcggcccactgccttttcattcttacgaagcagggccggccgggcccggtggctcacgcctgtaatcccagcactytgggaggccgaggtgggcggatcatgaggtcaggagatcaagaccatcctggctgacacggtgaaaccccgtttctactaaaaatacaaaaaattagccg

SEQ ID NO: 21902 - DNA, 201 bp, Homo sapiens
agataacatcacctgggataaactgattgtcatttgtgtcctaataagactcactgagaaaaatcatactatcattcagtggtatacctgccttttggcasaatcttaatctaattctgaggaaacatcagacaaatcaaaattgatgacccttaacaaaagaactcgcccatgttcttcaaaaatatcaagcttaagaag

SEQ ID NO: 21903 - DNA, 201 bp, Homo sapiens
aaaataaattgctcttctttagaaaaaaagaaaagaaaaaaggctcaggtcatgatggagtaattgacaaagattagatttcctactataaacaagcatawaacttgtgaaaatatataaagccactgttttatgtatgtcaggttttgactaatactcatgtaagactgagatccttgagagaagggaaaaccccactgt

SEQ ID NO: 21904 - DNA, 201 bp, Homo sapiens
tttaacattacctataaagctgttgtaaacaagacaatgtggttttggcataaggacagagaaagagaacagagttcagaaatagacccagacttatgctygttttcaacaaaggcatcaatggaatgaaatggagaaattaaagtcttttcaacaaatggtgctggaataacagattactcacatgggaaagatgaacct

SEQ ID NO: 21905 - DNA, 201 bp, Homo sapiens
tgaacccgggaggcggagcttgcagtgagctgagattgtgccactgcactccattcagcctgggcaacagagtgagactccttttaaaaagaagaagaagmagcagcagcagggccagcctgacgcataggaaagtatgcctgctcctccttactacctcaaagtgtcactcattcaacaaaaatgtattcagttcctcct

SEQ ID NO: 21906 - DNA, 201 bp, Homo sapiens
gaccactgacctacaccacctacactgccttttcttttccttttttttttttttttttttttttttttgagacggagtctctctctgtggcccaggctggrgtgcagtggcgtgatctcggctcactgcaagctccgtctcccggtttcacgccattctcctgcctcagcctcccgagtagctgggactacaggcggccca

SEQ ID NO: 21907 - DNA, 201 bp, Homo sapiens
gggcggatcatgaggtcaggagattgagaccatcctggctaacacggtgaaaccccatctctactaaaactacaaaaaattagccaggtgttgcagcaggygcctgtagtcccagctactctggaggccaagggaggagacttgcttgaacctaagaggcggaggttgcagtaagctgagatattgcaccattgcactcca

SEQ ID NO: 21908 - DNA, 201 bp, Homo sapiens
caagagattgcttgagtccaagagtttgagtctagcctgggcaatgctatcatagtctactatgattgcacctgtgagtatctactgcattccagtctggktaacatagtgacacaacaacaacaacaacaacaaaagaatagcttccagccgggcgcggtggctcacgcctgtaatcctagcactttgggaggccgaggc

SEQ ID NO: 21909 - DNA, 201 bp, Homo sapiens
agacctcttttctatgaatctttcctctaggttacaaaagcaggttggtcactggaagatgttgacatatttgaaatcaatgaagcctttgcagctgtctytgctgcaatagttaaagaacttggattaaacccagagaaggtaaagatgcacaagtaaccctgagagcttaccagtgaatttcacaatccaattttaaga

SEQ ID NO: 21910 - DNA, 201 bp, Homo sapiens
ttagacctcttttctatgaatctttcctctaggttacaaaagcaggttggtcactggaagatgttgacatatttgaaatcaatgaagcctttgcagctgtytctgctgcaatagttaaagaacttggattaaacccagagaaggtaaagatgcacaagtaaccctgagagcttaccagtgaatttcacaatccaattttaa

SEQ ID NO: 21911 - DNA, 201 bp, Homo sapiens
cagtaccagaaactcccaatacctccttgtgaagcccaggcttattcttccatttcctgtcagagatctcccctccccaactgctgtaatccttttttttyctttttgagacggagcctcactctgtcgcccaggctggagtgcagtggtgcaatcttggctcactgcaatctccgcctcccaggttcaagcaattctcct

SEQ ID NO: 21912 - DNA, 201 bp, Homo sapiens
aacttcagtttatctacctttgtatttttccagtaccagaaactcccaatacctccttgtgaagcccaggcttattcttccatttcctgtcagagatctcycctccccaactgctgtaatcctttttttttctttttgagacggagcctcactctgtcgcccaggctggagtgcagtggtgcaatcttggctcactgcaat

SEQ ID NO: 21913 - DNA, 201 bp, Homo sapiens
cctatagtcccagctactagggaggctgtggtgggaggatcacttgaggccagcagtttgaggttgtatagtatactatggttgattttgcctgttagtakctgctgcactccagcctggtcaacatagtgagacatcatccaacaaaaaaaaaaaaaaagaaagaaaaacagcttgataagtaaagacaagacatagaaa

SEQ ID NO: 21914 - DNA, 201 bp, Homo sapiens
ccagctactctggaggccaagggaggagacttgcttgaacctaagaggcggaggttgcagtaagctgagatattgcaccattgcactccagcctgggcaamaagaatgaaactccatctctaaataaataaataaatagtgtaaataaatactgtataaaatgcaaagcactcagaatagccaaaacaattttgaagtcag

SEQ ID NO: 21915 - DNA, 201 bp, Homo sapiens
acgcaggcagatcacctgaggtcgggagtttgagacccacatgaccaacatggagaaactccatctctactaaaaatacaaaattagccaggctggtggcrcatgcctgtaatcccagctactcgggaggctgaggcaggagaatcgcttgaacctgggaggcggaggttgcgttgagctgagatcacgccattgcactcc

SEQ ID NO: 21916 - DNA, 201 bp, Homo sapiens
cggcctcccaaagtgctgggattacaggtgtgagccactgctcacagcctgaggcaccgcactgggcctgtctttttaatatgtatatgatcctgcatatsttttcagtctcaagtaaccttacccgtttttagtttccagcctaatcccagattgataacattgtgatgaatataatctctaagtttttatcagcgactt

SEQ ID NO: 21917 - DNA, 201 bp, Homo sapiens
caagccgcgaggagccgcgggatccctggaaccctgcggctcccgcgttccctgacctggtgctacagccccaccctctcctctcccgatgtgcgtactcsgtccctcgtgcttggattggctcccggggtagagccatcgcgtggcctgcctctcccattggttggcgtagggaggtgttctcctccggggcccctgatt

SEQ ID NO: 21918 - DNA, 201 bp, Homo sapiens
gtgcagtggcaccatcatagctcactgcagcctcaaaactcctaggctcaaatattcctcctgccttagcctcccattacctcgaactacaggtgcaccamgccttcttcatttcgtagagacaaggtctatgtcgcccaggctggttttgaactcctgagttcaattgatcctcttgccttaggctccccaagtgttgag

SEQ ID NO: 21919 - DNA, 201 bp, Homo sapiens; identical to SEQ ID NO: 3218

SEQ ID NO: 21920 - DNA, 201 bp, Homo sapiens
tcgtctgggcgacaggtgggaccctgtccctaaacaaagcgagcctatttggcacagctttgatgcggggtggaatctgatggcggggaaaaaaaaaaaaagtaataaccaccaatttcatgctctgccacttcgtacagctataccagccttttccttcagattctgcaagttttttgctcattaaaactctctttatct

SEQ ID NO: 21921 - DNA, 201 bp, Homo sapiens
gatgagaagaaaagcaccagagaagttttgtgtagtaaaccactcatgacatctgcctgtaaagatgtacgatagggagtacctatagcacaaggatgtaygaagaagcttgaaggacaaaagagccacaggaagaatccaggaaagagcataattagttgaagatgcaagtatgaaacaagaatcaaagaaaaggctcta

SEQ ID NO: 21922 - DNA, 201 bp, Homo sapiens; identical to SEQ ID NO: 21845

SEQ ID NO: 21923 - DNA, 201 bp, Homo sapiens; identical to SEQ ID NO: 21846

SEQ ID NO: 21924 - DNA, 201 bp, Homo sapiens; identical to SEQ ID NO: 21847

SEQ ID NO: 21925 - DNA, 201 bp, Homo sapiens; identical to SEQ ID NO: 21849

SEQ ID NO: 21926 - DNA, 201 bp, Homo sapiens
gacgcccgacctcgactgcagctgcgggcggacagggcaccgggctcatccgagggcgcgcggatggacctactctttttctggtaaatggtcctaaaatraaacctggcgtttaacatggacactcagggggtcgccctgaaacaaaagggggtgcgaggcgtggcccgcacgtgcgagcccgggaggcccgctttcccg

SEQ ID NO: 21927 - DNA, 201 bp, Homo sapiens
atggctaaagtttaatctagaaatacattttccccacaaactatctagtttctccagaattaacatctttctcaccaaacaatagtgtttctactataccrgcatgctggatgatctatgaagagtttatactgtgtatcacatttactgactcggtaagatcacactgtcatatcatgatgtatttattaatttctcaca

SEQ ID NO: 21928 - DNA, 201 bp, Homo sapiens
gttcatcaatacaaccgtaaaagacaacacatctattacctttagaaaaaatgctcaacagaagctaaaccgagtgtgactattcatatgacctatattargctattattttatttaaaaaagatagttcttcaagttgataaaacactaagaaatatttttaaagcaaaaagactgtcagcttcttatggaaggaaaact

SEQ ID NO: 21929 - DNA, 201 bp, Homo sapiens
tcgtaagtaataatacccgttcagccatttcatataggaggaggacatgaaaaaaccctccctcttcagatcatggcaagtttaatctatcccataagcayagccactaaaatctattattaggagaaaatgtggtagtcaaatgagaaaaaagatactggtccaagtttttaacttcaaatattactacttaaatgctaa

SEQ ID NO: 21930 - DNA, 201 bp, Homo sapiens
gtttaaaagtgtgggggagaaaaacgcttataaagtcactactcaaactctttgcattcatcatgcttaacacagagccaaaatgtcgtaagtaataatayccgttcagccatttcatataggaggaggacatgaaaaaaccctccctcttcagatcatggcaagtttaatctatcccataagcatagccactaaaatcta

SEQ ID NO: 21931 - DNA, 201 bp, Homo sapiens
ttactgtagagggactggctttgatggaagaaaggacactttgttgtatgaggaaggaaggaaaaaagaatacccgtgcagactgatttaaaagatgacarcacatttcttactcttggcaaagctttcttgtaggtctggtttaactactgtttaaactattttttttttttttttttttttgagacagggtctcgctgt

SEQ ID NO: 21932 - DNA, 201 bp, Homo sapiens
tagagcagaaggaaacagactctagaacacttactgtagagggactggctttgatggaagaaaggacactttgttgtatgaggaaggaaggaaaaaagaayacccgtgcagactgatttaaaagatgacagcacatttcttactcttggcaaagctttcttgtaggtctggtttaactactgtttaaactatttttttttt

SEQ ID NO: 21933 - DNA, 201 bp, Homo sapiens
agcattctactagatagaggtatgtgtgtttggagcttagagaaacagctgaaagagtctctggcatagagagataatacatgaagtcatgggaacaaagrggctatcctggagagtattatgacatggtccagacaaagcagcatcacaaagccttccatccccgaaagcatttcaagaaggacataatcaaagggttgc

SEQ ID NO: 21934 - DNA, 201 bp, Homo sapiens
tgccactgcactccagcctgggcaacaagagcaaaactccgtctcaaaaacaaacaaacaaacaaaaacaggagtccagagttgaaagcacaaaagaaggyagaaccagaaaagtgaaaaaccttgcaggttacaccaaacaatctagatactaagcttaatatctctaagcaagactagtatatcatctgtgttttcaaa

SEQ ID NO: 21935 - DNA, 201 bp, Homo sapiens
ctttgggaggctgaggcgggcagatcacctgaggtcaggagttcgagaccaacctggccaacacggtgaaaccgcctctactaaaaatacaaaaaattagytgggcctggtggtgggcgcctgtaatcccagatactcaggagactgaggcaggagtatcacttaaacccggaaggcggaggtcgcagtgagccgagaccg

SEQ ID NO: 21936 - DNA, 201 bp, Homo sapiens
taatcccagcactttgggaggctgaggcgggcagatcacctgaggtcaggagttcgagaccaacctggccaacacggtgaaaccgcctctactaaaaatasaaaaaattagttgggcctggtggtgggcgcctgtaatcccagatactcaggagactgaggcaggagtatcacttaaacccggaaggcggaggtcgcagtg

SEQ ID NO: 21937 - DNA, 201 bp, Homo sapiens
attactaattgagaactatggttaaacagggaacacaggtcctgccttcaaggatctagtggggagagggattaccaatcacactccagggcaagtgtcaytaaagtggtatgcagagattacaagcacataaaagacataaatttagcctaggaggtggacaatgaagatgagtccaggccaagtgcagtggctcacgcc

SEQ ID NO: 21938 - DNA, 201 bp, Homo sapiens
ttttaaaaataatttaacttccattaagtatttatcacaagataatcatagatcaaattgtattatcctttgttatctctgaccagaatttaaattagtcsaattcatggaaaatttgaaggaattaaaaattaccacttagctctccccaacccaaatttgaattactaattgagaactatggttaaacagggaacacag

SEQ ID NO: 21939 - DNA, 201 bp, Homo sapiens; identical to SEQ ID NO: 21851

SEQ ID NO: 21940 - DNA, 201 bp, Homo sapiens; identical to SEQ ID NO: 21852

SEQ ID NO: 21941 - DNA, 201 bp, Homo sapiens; identical to SEQ ID NO: 21853

SEQ ID NO: 21942 - DNA, 201 bp, Homo sapiens; identical to SEQ ID NO: 21854

SEQ ID NO: 21943 - DNA, 201 bp, Homo sapiens; identical to SEQ ID NO: 21855

SEQ ID NO: 21944 - DNA, 201 bp, Homo sapiens; identical to SEQ ID NO: 21856

SEQ ID NO: 21945 - DNA, 201 bp, Homo sapiens; identical to SEQ ID NO: 21857

SEQ ID NO: 21946 - DNA, 201 bp, Homo sapiens; identical to SEQ ID NO: 21858

SEQ ID NO: 21947 - DNA, 201 bp, Homo sapiens; identical to SEQ ID NO: 21859

SEQ ID NO: 21948 - DNA, 201 bp, Homo sapiens
atcttgacggcagcgatacacgtcgaattctgcttacaccgcgggcaaccagtatcgcggcccctcggccgaccggcgaccacagcagtggctgcgacggygtggagcgtacccgagcgatgtcccaggagctactgggtaacacaccaccccacccgcttcccggctgccccggcccggccgcggggcacggcgggaagg

SEQ ID NO: 21949 - DNA, 201 bp, Homo sapiens
gccactaataactgatgtgggatgaattttctgtttgactaattcatctgcattttttaggagttctgctgcaataataacctgttgagaaaacattcacyggtctgagtgtgccggatattcaacatgtgcaatacatatggaatgacactaaaatggccatatattattaaccaaaatggtagtgatgaaatgaattaa

SEQ ID NO: 21950 - DNA, 201 bp, Homo sapiens
tcagggggtcgccctgaaacaaaagggggtgcgaggcgtggcccgcacgtgcgagcccgggaggcccgctttcccgcggagggcgcgtttccaacgccgcmccggacaccacatccacgcgttgccggtctcaaaaccctgccgcgcgcggcggggctcctcctcgctgtgggaaaagtggggccacagcgccctgcccca

SEQ ID NO: 21951 - DNA, 201 bp, Homo sapiens
tccaccagtggttagaataacattggcaccagttgccaggatcttctgaattctctccttggtgatatctgattctctgcaaagtatttttgtaacctgarttaccttctgtgatttttaaaaataatttaacttccattaagtatttatcacaagataatcatagatcaaattgtattatcctttgttatctctgaccag

SEQ ID NO: 21952 - DNA, 201 bp, Homo sapiens; identical to SEQ ID NO: 21869

SEQ ID NO: 21953 - DNA, 201 bp, Homo sapiens; identical to SEQ ID NO: 21870

SEQ ID NO: 21954 - DNA, 201 bp, Homo sapiens; identical to SEQ ID NO: 21874

SEQ ID NO: 21955 - DNA, 201 bp, Homo sapiens; identical to SEQ ID NO: 21875

SEQ ID NO: 21956 - DNA, 201 bp, Homo sapiens; identical to SEQ ID NO: 21876

SEQ ID NO: 21957 - DNA, 201 bp, Homo sapiens; identical to SEQ ID NO: 21877

SEQ ID NO: 21958 - DNA, 201 bp, Homo sapiens; identical to SEQ ID NO: 21878

SEQ ID NO: 21959 - DNA, 201 bp, Homo sapiens; identical to SEQ ID NO: 21879

SEQ ID NO: 21960 - DNA, 201 bp, Homo sapiens; identical to SEQ ID NO: 21880

SEQ ID NO: 21961 - DNA, 201 bp, Homo sapiens; identical to SEQ ID NO: 21881

SEQ ID NO: 21962 - DNA, 201 bp, Homo sapiens
aaattgatactgctgctactacgcacgcgtgcgcgcaacacatgcgcacacacgcacccactcccgagacagggtcttgctatgttgcccacattggactrgcactcctgggttcaattaatactcctacctcagcctccttagtagctgggactacaggcacataccaccatgcccatctcaaagtcttatgctttaaaa

SEQ ID NO: 21963 - DNA, 201 bp, Homo sapiens; identical to SEQ ID NO: 21882

SEQ ID NO: 21964 - DNA, 201 bp, Homo sapiens
gtcaccaaaatgttacaacattatcactatctgcaattcatatcacttttagacatgctttttattaccttttcaccctaaaaaagcagggaaggcaacargtaatttcaatacagcattactcctctctattgatatcaatttgcataaaattggttattcaaaattttattgcacaaaattgatactgctgctactacg

SEQ ID NO: 21965 - DNA, 201 bp, Homo sapiens
gttttttgctcattaaaactctctttatctgtgaggagagaaatcggtagtcaacggggaaggtggtgactttcagatttgtttacgaaaaaaattaggartctatcaagaaacagtaagctctgtaggtatccaaaggcctgacagcaaacgctctgctaagttagcgctgccgtctcctggggtcaatgcactcgagtg

SEQ ID NO: 21966 - DNA, 201 bp, Homo sapiens
gcttacaccgcgggcaaccagtatcgcggcccctcggccgaccggcgaccacagcagtggctgcgacggcgtggagcgtacccgagcgatgtcccaggagmtactgggtaacacaccaccccacccgcttcccggctgccccggcccggccgcggggcacggcgggaaggaaaaagaggcagggacaacagggagagaaac

SEQ ID NO: 21967 - DNA, 201 bp, Homo sapiens
catcttgacggcagcgatacacgtcgaattctgcttacaccgcgggcaaccagtatcgcggcccctcggccgaccggcgaccacagcagtggctgcgacgrcgtggagcgtacccgagcgatgtcccaggagctactgggtaacacaccaccccacccgcttcccggctgccccggcccggccgcggggcacggcgggaag

SEQ ID NO: 21968 - DNA, 201 bp, Homo sapiens
accctgtccctaaacaaagcgagcctatttggcacagctttgatgcggggtggaatctgatggcggggaaaaaaaaaaaaagtaataaccaccaatttcargctctgccacttcgtacagctataccagccttttccttcagattctgcaagttttttgctcattaaaactctctttatctgtgaggagagaaatcggtag

SEQ ID NO: 21969 - DNA, 201 bp, Homo sapiens
gatatctgattctctgcaaagtatttttgtaacctgagttaccttctgtgatttttaaaaataatttaacttccattaagtatttatcacaagataatcayagatcaaattgtattatcctttgttatctctgaccagaatttaaattagtccaattcatggaaaatttgaaggaattaaaaattaccacttagctctccc

SEQ ID NO: 21970 - DNA, 201 bp, Homo sapiens
ttttcttcttgctcaatcttctgggcattcagaatatgtaacttatttctgacacagcacaaatgacccacttatggcttcaactttctgaaagtcggtcrtttttagaaaaatgatcattctttagccagtctacctaccactgaagtagttccatctccaacttctttgtcttgcagatcagccagctcacaaagaact

SEQ ID NO: 21971 - DNA, 201 bp, Homo sapiens; identical to SEQ ID NO: 21883

SEQ ID NO: 21972 - DNA, 201 bp, Homo sapiens; identical to SEQ ID NO: 21884

SEQ ID NO: 21973 - DNA, 201 bp, Homo sapiens; identical to SEQ ID NO: 3219

SEQ ID NO: 21974 - DNA, 201 bp, Homo sapiens
tctgcaattcatatcacttttagacatgctttttattaccttttcaccctaaaaaagcagggaaggcaacaggtaatttcaatacagcattactcctctctattgatatcaatttgcataaaattggttattcaaaattttattgcacaaaattgatactgctgctactacgcacgcgtgcgcgcaacacatgcgcacaca

SEQ ID NO: 21975 - DNA, 201 bp, Homo sapiens
atctgcaattcatatcacttttagacatgctttttattaccttttcaccctaaaaaagcagggaaggcaacaggtaatttcaatacagcattactcctctctattgatatcaatttgcataaaattggttattcaaaattttattgcacaaaattgatactgctgctactacgcacgcgtgcgcgcaacacatgcgcacac

SEQ ID NO: 21976 - DNA, 201 bp, Homo sapiens
ctatctgcaattcatatcacttttagacatgctttttattaccttttcaccctaaaaaagcagggaaggcaacaggtaatttcaatacagcattactcctctctattgatatcaatttgcataaaattggttattcaaaattttattgcacaaaattgatactgctgctactacgcacgcgtgcgcgcaacacatgcgcac

SEQ ID NO: 21977 - DNA, 201 bp, Homo sapiens
ttaattcacattccttctaccatgttgtatgtgctttaaattacaaaaagatgtactgcacataatccacaaaaaaacattttttatttttttttttttttgagacggagtctcactctgtagcccaggctggagtgcagtggtgtgatcttggctcactgcaatctccgcctcccaggttccagtgattctccttcctca

SEQ ID NO: 21978 - DNA, 201 bp, Homo sapiens
ctgatttaaaagatgacagcacatttcttactcttggcaaagctttcttgtaggtctggtttaactactgtttaaactattttttttttttttttttttttgagacagggtctcgctgtcacccaggttggagtgcagtggtacaatcacagctcactgcagcctcaacctcctgggcttcagattcttgccacctcagcc

SEQ ID NO: 21979 - DNA, 201 bp, Homo sapiens
actgatttaaaagatgacagcacatttcttactcttggcaaagctttcttgtaggtctggtttaactactgtttaaactattttttttttttttttttttttgagacagggtctcgctgtcacccaggttggagtgcagtggtacaatcacagctcactgcagcctcaacctcctgggcttcagattcttgccacctcagc

SEQ ID NO: 21980 - DNA, 201 bp, Homo sapiens
ttgtatgaggaaggaaggaaaaaagaatacccgtgcagactgatttaaaagatgacagcacatttcttactcttggcaaagctttcttgtaggtctggtttaactactgtttaaactattttttttttttttttttttttgagacagggtctcgctgtcacccaggttggagtgcagtggtacaatcacagctcactgcag

SEQ ID NO: 21981 - DNA, 201 bp, Homo sapiens
gttgtatgaggaaggaaggaaaaaagaatacccgtgcagactgatttaaaagatgacagcacatttcttactcttggcaaagctttcttgtaggtctggtttaactactgtttaaactattttttttttttttttttttttgagacagggtctcgctgtcacccaggttggagtgcagtggtacaatcacagctcactgca

SEQ ID NO: 21982 - DNA, 201 bp, Homo sapiens
tgttgtatgaggaaggaaggaaaaaagaatacccgtgcagactgatttaaaagatgacagcacatttcttactcttggcaaagctttcttgtaggtctggtttaactactgtttaaactattttttttttttttttttttttgagacagggtctcgctgtcacccaggttggagtgcagtggtacaatcacagctcactgc

SEQ ID NO: 21983 - DNA, 201 bp, Homo sapiens
ttgttgtatgaggaaggaaggaaaaaagaatacccgtgcagactgatttaaaagatgacagcacatttcttactcttggcaaagctttcttgtaggtctggtttaactactgtttaaactattttttttttttttttttttttgagacagggtctcgctgtcacccaggttggagtgcagtggtacaatcacagctcactg

SEQ ID NO: 21984 - DNA, 201 bp, Homo sapiens
tttgttgtatgaggaaggaaggaaaaaagaatacccgtgcagactgatttaaaagatgacagcacatttcttactcttggcaaagctttcttgtaggtctggtttaactactgtttaaactattttttttttttttttttttttgagacagggtctcgctgtcacccaggttggagtgcagtggtacaatcacagctcact

SEQ ID NO: 21985 - DNA, 201 bp, Homo sapiens; identical to SEQ ID NO: 3209

SEQ ID NO: 21986 - DNA, 201 bp, Homo sapiens; identical to SEQ ID NO: 21889

SEQ ID NO: 21987 - DNA, 201 bp, Homo sapiens; identical to SEQ ID NO: 21890

SEQ ID NO: 21988 - DNA, 201 bp, Homo sapiens
tgcggtcaccgaacacggacaaaggcccctccatcttgacggcagcgatacacgtcgaattctgcttacaccgcgggcaaccagtatcgcggcccctcggscgaccggcgaccacagcagtggctgcgacggcgtggagcgtacccgagcgatgtcccaggagctactgggtaacacaccaccccacccgcttcccggctg

SEQ ID NO: 21989 - DNA, 201 bp, Homo sapiens; identical to SEQ ID NO: 21891

SEQ ID NO: 21990 - DNA, 201 bp, Homo sapiens
agcataataaagagtacctataatcgattgtatgtaaacacacaaatttagactaattcattgcattttatcttagaaaaattttatggcattaaatgcaygtaatttcttttaattcacattccttctaccatgttgtatgtgctttaaattacaaaaagatgtactgcacataatccacaaaaaaacattttttatttt

SEQ ID NO: 21991 - DNA, 201 bp, Homo sapiens; identical to SEQ ID NO: 21893

SEQ ID NO: 21992 - DNA, 201 bp, Homo sapiens; identical to SEQ ID NO: 21894

SEQ ID NO: 21993 - DNA, 201 bp, Homo sapiens; identical to SEQ ID NO: 21895

SEQ ID NO: 21994 - DNA, 201 bp, Homo sapiens; identical to SEQ ID NO: 21896

SEQ ID NO: 21995 - DNA, 201 bp, Homo sapiens; identical to SEQ ID NO: 21897

SEQ ID NO: 21996 - DNA, 201 bp, Homo sapiens; identical to SEQ ID NO: 21899

SEQ ID NO: 21997 - DNA, 201 bp, Homo sapiens; identical to SEQ ID NO: 21900

SEQ ID NO: 21998 - DNA, 201 bp, Homo sapiens; identical to SEQ ID NO: 21902

SEQ ID NO: 21999 - DNA, 201 bp, Homo sapiens; identical to SEQ ID NO: 21903

SEQ ID NO: 22000 - DNA, 201 bp, Homo sapiens; identical to SEQ ID NO: 21904

SEQ ID NO: 22001 - DNA, 201 bp, Homo sapiens
accctgtctcttaaaaaaaaaaaaaagaggtttttaattagttgcttgtggtggcacatgcctgcaatcccaagcactctgggaggctaaggcaggaggaytgcttgaacccaggagttccaggctgcagtgagatatgacagcactgcagcacttcagactgtgctacagatggtctcttaaaaataataatataaaaac

SEQ ID NO: 22002 - DNA, 201 bp, Homo sapiens; identical to SEQ ID NO: 21907

SEQ ID NO: 22003 - DNA, 201 bp, Homo sapiens; identical to SEQ ID NO: 21908

SEQ ID NO: 22004 - DNA, 201 bp, Homo sapiens
gcgtgtaatcccagcactacagaggccgagaagggaggatcacttgaggccaggagttcaagaccagcctgggcaacatagcgagaccctgtctcttaaaraaaaaaaaaagaggtttttaattagttgcttgtggtggcacatgcctgcaatcccaagcactctgggaggctaaggcaggaggattgcttgaacccagga

SEQ ID NO: 22005 - DNA, 201 bp, Homo sapiens; identical to SEQ ID NO: 21909

SEQ ID NO: 22006 - DNA, 201 bp, Homo sapiens; identical to SEQ ID NO: 21910

SEQ ID NO: 22007 - DNA, 201 bp, Homo sapiens; identical to SEQ ID NO: 21911

SEQ ID NO: 22008 - DNA, 201 bp, Homo sapiens; identical to SEQ ID NO: 21912

SEQ ID NO: 22009 - DNA, 201 bp, Homo sapiens; identical to SEQ ID NO: 21913

SEQ ID NO: 22010 - DNA, 201 bp, Homo sapiens; identical to SEQ ID NO: 21914

SEQ ID NO: 22011 - DNA, 201 bp, Homo sapiens; identical to SEQ ID NO: 21915

SEQ ID NO: 22012 - DNA, 201 bp, Homo sapiens; identical to SEQ ID NO: 21918

SEQ ID NO: 22013 - DNA, 201 bp, Homo sapiens; identical to SEQ ID NO: 3218

SEQ ID NO: 22014 - DNA, 201 bp, Homo sapiens
atgttacaacattatcactatctgcaattcatatcacttttagacatgctttttattaccttttcaccctaaaaaagcagggaaggcaacaggtaatttcmatacagcattactcctctctattgatatcaatttgcataaaattggttattcaaaattttattgcacaaaattgatactgctgctactacgcacgcgtgc

SEQ ID NO: 22015 - DNA, 201 bp, Homo sapiens
tatctgcaattcatatcacttttagacatgctttttattaccttttcaccctaaaaaagcagggaaggcaacaggtaatttcaatacagcattactcctcyctattgatatcaatttgcataaaattggttattcaaaattttattgcacaaaattgatactgctgctactacgcacgcgtgcgcgcaacacatgcgcaca

SEQ ID NO: 22016 - DNA, 201 bp, Homo sapiens
gttaaggacagtaacaggtttggaatggacaaagggtacacacgtgaaaaatcaagggtaatttcaagggacttccttttagtaatctaatctattaaagmagcaagcattacttgtcaccaaaatgttacaacattatcactatctgcaattcatatcacttttagacatgctttttattaccttttcaccctaaaaaag

SEQ ID NO: 22017 - DNA, 201 bp, Homo sapiens
tggtacttatcatgagcttctcctgttttcccattttataaactagaacattgggtgacctcatgttttcaaatatacttataaaaaatttaaggccgggygtggtggctcacgcctgtaatcccagcactttgggaggccgaggcgggcggatcacgaggtcaggagatcgagaccatcccggctaaaacggtgaaaccc

SEQ ID NO: 22018 - DNA, 201 bp, Homo sapiens
catcccggctaaaacggtgaaaccccgtctctactaaaaatacaaaaaattagccgggcgtagtggcgggcgcctgtagtcccagctacttgggaggctgmggcaggagaatggcgtgaacccgggaggcggagcttgcagtgagccgagatcccgccactgcactccagcctgggcgacagagcgagactccgtctcaaa

SEQ ID NO: 22019 - DNA, 201 bp, Homo sapiens
aaattatatagtttctgtgtcccctcagtctcttcatctataaaatgagactaataatagtgcctacctcattagatttttgtgaggattaaataagttamtacatgtaacatgcagatgatggatttttgaccaccatttcctctgggcaagtacgtgctgtcatatgtagaggagacagtgaacagattgttactgtgt

SEQ ID NO: 22020 - DNA, 201 bp, Homo sapiens
cctaggagaacaccctttgtaaatgtggatgttcacagttatgagtggggtatgagcctgcagtgtatgttttgcagctctcggagctctggcggtccacmaggaaatacctgcagcctgacaacctttccaaggctgaggctgtcagaaacttcctggccttcattcagcacctcaggactgcgaagaaagaagagatcc

SEQ ID NO: 22021 - DNA, 201 bp, Homo sapiens
ctatagcctttcagaacttactaggataaaagctacagtcctgtgacagtctgaatggcagctagacaagtgcacaaccagtactatgccacatgtttctkttttatgtttgtcttttgcttatgttttgacctcccggcatcctaattccttattttcactgaatttgtacttgaaaaaatgtaaacctacagaaaagtt

SEQ ID NO: 22022 - DNA, 201 bp, Homo sapiens
tactgtccctatgaaaaatactattgagttcatgttgaacttgactattaactcagtgtcatttcaaatgtcaaacagcagggtattaggcttagttaaabttgccttcgttttctagttggatgtaggcaattcctggaacttgtatacagttggcgtctctgtaaccgctggttcctcatcaaattcaaccaacctcag

SEQ ID NO: 22023 - DNA, 201 bp, Homo sapiens
aagtgtttctgttgatataaaaagaaatgagaagaaaatcacccattcatggagtagcctttgacactcatatcctttctcagattgctttggaacagaarcttcaagtacattcagtaacttggctggagaggtatagggtgacttaactgtgtgtgtaattctgttattgttgctgttgttgtacaggcaatttgagaa

SEQ ID NO: 22024 - DNA, 201 bp, Homo sapiens
tgaatataggacatcagaaggtactctaagtgattcagggattaaaacgacctctgacctatttttacactgatcataacagcagcaggggttttaatttrcgcagcaaaaattaatattcctgtcaaaacataagggcataaaactctcatttaattgtgaaagcagtttctcacagtttgatttaaagtccacaattca

SEQ ID NO: 22025 - DNA, 201 bp, Homo sapiens
aaaaaaacaccaaacaataaaatatagcaaaacgacagtatatattcatacaatttttaaaatacagcataacagcaacatagcatttacactgtattagrtattataagtaatctagagatgatttaaagtgtatgggaggatgggtgtaggttacatgcaaatactatgcctttttatataagggacttgagcaccctt

SEQ ID NO: 22026 - DNA, 201 bp, Homo sapiens
tgtcatttcaaatgtcaaacagcagggtattaggcttagttaaatttgccttcgttttctagttggatgtaggcaattcctggaacttgtatacagttggygtctctgtaaccgctggttcctcatcaaattcaaccaacctcagatcaaaaatatttggaaaaaaaacaccaaacaataaaatatagcaaaacgacagta

SEQ ID NO: 22027 - DNA, 201 bp, Homo sapiens
ataatgcctcaaacaaccccttcatcccatgcagccatattttgtcctatatcaaatgtctctttaagtatccttagagctatctcctaatgtgtcctgarcatggcactgagaatctcatgcttccatcaaagagtgtccttcagactgaaagtagcttcatgccgcaaccgtacttttttaatacacctggttgtaaac

SEQ ID NO: 22028 - DNA, 201 bp, Homo sapiens
atcctgctgtctattggggagcttccccaagaaatgaataaatacatgctcgccattgttcaagacatcctacgttttgaaatgcctgcaaggtataatayattgcacatgtctctctgtgtattcaagcttatttgtgtgttcatggggtaccgatgtagctaataataatgatgtggtcattatgcagggttacgttgc

SEQ ID NO: 22029 - DNA, 201 bp, Homo sapiens
tttatttctcaggctatgcctaatgtgcataaggaagtatgtggtctgaagttcactacagtcatggaagaaagagatggagaaagccaccagctcttaayggcctcagcctagaagtgatcctcatagattctatccatggcgtattagccagaactagtcacgtggcccccaccaaatcacaaaggaatctgggaaatg

SEQ ID NO: 22030 - DNA, 201 bp, Homo sapiens
aaacattacttcatataactacctttccccagagccccatgccatgtagtatccttaaaattctatattagttaggtaacaccaggttatgctgcaataamaaatgtccctcaaaatctcagcaatgtgttaaaagtttatttctgagccaggcatggtggctcacgcctgtaatcccaacactttggaaggccgaggcgg

SEQ ID NO: 22031 - DNA, 201 bp, Homo sapiens
atacttctccactcttccccatatcatccattctccccaaccccatgtatgtgtgtgtgtgtgtgtgtgtgtatgtgtgtgtctgtgtgtttgtgtgtgcytgtagcctaatttcagaggttatgaatcctgtggatgaattagatcttaaaaccctttatttttaaaaaatttttcagcctagactctgtcatacaaaga

SEQ ID NO: 22032 - DNA, 201 bp, Homo sapiens
atttaccaaattgtgagttcccactgctatctctaattctaattctaattcaacactacagggttattttttccctcatttcatcattctattttccttcycccactgtgacaactgtggttttcgagaacaccaatatattgattcacctgctcaattctaaaacatacacaatatatttttggaattgccatactgata

SEQ ID NO: 22033 - DNA, 201 bp, Homo sapiens
gcttgggtattaacttattaagttctggcagaaattaaatttattatttttatattagggaagcatgacttcttatatttttcaatttccataattatttkagtagctgatttacttcagctatttgtgtattaaatatcttggcaaaagataaaacccacatatcaaaagatctattcagcagtatttaatgagcatcta

SEQ ID NO: 22034 - DNA, 201 bp, Homo sapiens
ttttttgttcattgaccccatgaatccaatccataaatttccagggttaagaattccctgtaccacaggttaaaaatccctgaaaaggggattaactcttyaattcaaagctagatagcaaatgtgtaagtgtctcaaaagcaaaattctgagtttgcaatctagaaacataaaaatactttaccaagtatgtgtttattt

SEQ ID NO: 22035 - DNA, 201 bp, Homo sapiens
tatgcctttttttatagacctcagctggtggatgctgtcacctctgctcagacctcagactcattagaagccattttggactttttggatttcaaaagtgmcagcagcattatcctccaggagaggtttctctatgcctgtggatttgcttctcatcccaatgaagaactcctgagagccctcattgtaagtcaaatagaa

SEQ ID NO: 22036 - DNA, 201 bp, Homo sapiens
cgagagatgctgttaattagaactatttattaggttgttgcaaaagtaattgtggtttttgccattacttttgtgacaacctaatattatttttaaaaccrcaatagaataacttagtgtgtgtgagaattacctttatctaaatgctactctaaaaaacatagatataagaaatgaataattcagaccttagcaacagca

SEQ ID NO: 22037 - DNA, 201 bp, Homo sapiens
attcatattgatatgctctctgccttcagaaatgacccagtaaatctttagctaagtgcagctggaatttcacttggaatatcttcttaagattacatagytaaaaggcacttgaaaaagagaaaaaaaaggatccattgcttattaaaagtaatgaataatttaaaaactggcagcaagttattactatagagttagaga

SEQ ID NO: 22038 - DNA, 201 bp, Homo sapiens
gctgaatttctaaaaaacttttttcctccatcataaattaaccttagcttactgtaatatttttacgttaaaaactttttaatttttgttaacttttgaastactctgtaataacacatagtttaaaacacattgtataggtgtacaaaaaatattttttctttaaatctttataagcttttttctatttttaaatttttt

SEQ ID NO: 22039 - DNA, 201 bp, Homo sapiens
caattttcaagccacttctcactagaattcaaatggcccacaaggaatcccaagcattatgcccttgcctttctttttaggtagatatctctggaaattgyaaagtgacctaccaggctcatcaagacaaagtgatcaaaattaaggccttggattcatgcaaaatagcgaggtctggatttacgaccccaaatcaggtat

SEQ ID NO: 22040 - DNA, 201 bp, Homo sapiens
ttgtctttgtatcttatcatcctgggggagaaaaaaagtcccctatggcctattagagacctcaattttcaagccacttctcactagaattcaaatggccyacaaggaatcccaagcattatgcccttgcctttctttttaggtagatatctctggaaattgtaaagtgacctaccaggctcatcaagacaaagtgatcaa

SEQ ID NO: 22041 - DNA, 201 bp, Homo sapiens
aaagagttctactcatatcaaaatgaggcagtggccatagaaaatatcaagagaggcctggctagcctatttcagacacagttaagctctggaaccaccartgaggtacttaccaatattaataaggattcagcatctcaataaaatttgtaaggatttctacttatacaatttcagtagaagagttactactaaggtaat

SEQ ID NO: 22042 - DNA, 201 bp, Homo sapiens
atttttgcttcatttgtgttctgttcccctctccccaccaggtcaaagagttctactcatatcaaaatgaggcagtggccatagaaaatatcaagagaggyctggctagcctatttcagacacagttaagctctggaaccaccaatgaggtacttaccaatattaataaggattcagcatctcaataaaatttgtaaggat

SEQ ID NO: 22043 - DNA, 201 bp, Homo sapiens
gtccaagaacttttttatttgctattattttaaaccttagttattttttgtttcaagtacagttacaggtagagaacatgctgacatgttcaaacagaatkttcatcatttctcttccctgggccatccttgttttcatgaggctcccagcctatatcagtgctctctcccaatgctgtgcccatcatgcaagagccttca

SEQ ID NO: 22044 - DNA, 201 bp, Homo sapiens
tttctggttttggctttgtgttgattaaattaaccacgtggctgctgagtcagacctttattttgtattgtttccgggcattgatttgctctctaaatcascatggctcttgtacacacactgaactgccacaagaaatgtgacaccttgaaagtccttctgaaatttgttgtatatttctttacttgtttgttctccagt

SEQ ID NO: 22045 - DNA, 201 bp, Homo sapiens
gaagagagagtaaacctagtctgtgttcttcctgaggaaggaaccaagtactcccctgaataacagtgtttggtcagttaaaatggtttagatttatgtgytgagaagggaggccaaattagttggtctctggggacttttccaattgtaatatatggtgattcccttatttgcttctcaagaacctaaagataatagatt

SEQ ID NO: 22046 - DNA, 201 bp, Homo sapiens
aaaattaactgggcttagtggcgtgagtgtgtggtcccaactactcagaaggctgaggtgggaggatcacttgagcctggagatgaaggttgcagtgagcygagatcgcatgactgcactccagcctgggtgacagagtgagaccctgtctcaaaaaaaaaaaaaaaaaaaaagtaaagaaagaagaagaaactttctctg

SEQ ID NO: 22047 - DNA, 201 bp, Homo sapiens
tttctttgaaggttcgacagattatgtgacttcactacccaaaattctatggcagcgtcccatctcactcaaactccccaaatcttcctgccacccatagrtacctcctttaccttgtctccttcactgtgtcttttacttatttatttccagcctctttggtctccctgctcttcctccattacacctgcaggagccctc

SEQ ID NO: 22048 - DNA, 201 bp, Homo sapiens
agataagacaacatgtatttcctttatgccctatgtggaatttgataggtgtcataaaaagaaggcctcctgaccgaaatatttttcctgaccagaaagcyagtatttgaacccgctatagagtccccaattacaatgcagaagacatagagataagagggaatcccagtcttcatccccttcaaggtttttcctgactct

SEQ ID NO: 22049 - DNA, 201 bp, Homo sapiens
aattctaaatgcacttgaagggcaaatgaaagagattctgacttttttggctaatattactttctgttttggttttatctaacaacagttatcaaaaaatrttactatacatactctgaagagcactatcctacaaaaggaattaagtcaacaatataaatgggacatgccccaatgcccagtgttgccagatctctgcaa

SEQ ID NO: 22050 - DNA, 201 bp, Homo sapiens
agagtccacttctcagtgactcctagctgggcactggatgcagttgaggattgctggtcaatatgattcttcttgctgtgctttttctctgcttcatttcstcatattcagcttctgttaaaggtaagtttgtgttgccttttgctaaactttaatttccatctttggagttggaggcagatacgtgcgtgtgtgtgtgtt

SEQ ID NO: 22051 - DNA, 201 bp, Homo sapiens
tagcagtcatataaaagaaaaagagatgtgttcatttttctagttctggggaagcaataaaaactaatagaaaggattaaaaaaacttttttcattgtgtytcacagtttatatctatcattcagcctgccaggagggaaaaaaggctctaacaccattttctaagggatccagaggtcaagatcaaaacttgatccattg

SEQ ID NO: 22052 - DNA, 201 bp, Homo sapiens
aaaagaaaaagagatgtgttcatttttctagttctggggaagcaataaaaactaatagaaaggattaaaaaaacttttttcattgtgtttcacagtttatrtctatcattcagcctgccaggagggaaaaaaggctctaacaccattttctaagggatccagaggtcaagatcaaaacttgatccattgcagtgggtcagt

SEQ ID NO: 22053 - DNA, 201 bp, Homo sapiens
ttccaaggctgaggctgtcagaaacttcctggccttcattcagcacctcaggactgcgaagaaagaagagatccttcaaatactaaagatggaaaataagsaagtattgtaagttccccaacctttgtgtggggttgtctgtcagaaacatttctggattgttggttttttgaagtaagaaagaccccttttaaaccaact

SEQ ID NO: 22054 - DNA, 201 bp, Homo sapiens
taagaaaccatggactccagagtcagaaaaacctaggtttcaatcccagcaatgccatttaccatttaccagctatatgaccttgaacaaatgactaggtrtatctgcgtctgtttcctagcatgtacaggggaatattaatattaaactgacagagatgttcagtggattaaatgaggtggtagtattagtaacagctaa

SEQ ID NO: 22055 - DNA, 201 bp, Homo sapiens
attgggagccttttgttaatacttctccactcttccccatatcatccattctccccaaccccatgtatgtgtgtgtgtgtgtgtgtgtgtatgtgtgtgtstgtgtgtttgtgtgtgcttgtagcctaatttcagaggttatgaatcctgtggatgaattagatcttaaaaccctttatttttaaaaaatttttcagccta

SEQ ID NO: 22056 - DNA, 201 bp, Homo sapiens
ccttttgttaatacttctccactcttccccatatcatccattctccccaaccccatgtatgtgtgtgtgtgtgtgtgtgtgtatgtgtgtgtctgtgtgtktgtgtgtgcttgtagcctaatttcagaggttatgaatcctgtggatgaattagatcttaaaaccctttatttttaaaaaatttttcagcctagactctgt

SEQ ID NO: 22057 - DNA, 201 bp, Homo sapiens
ttttgttaatacttctccactcttccccatatcatccattctccccaaccccatgtatgtgtgtgtgtgtgtgtgtgtgtatgtgtgtgtctgtgtgtttrtgtgtgcttgtagcctaatttcagaggttatgaatcctgtggatgaattagatcttaaaaccctttatttttaaaaaatttttcagcctagactctgtca

SEQ ID NO: 22058 - DNA, 201 bp, Homo sapiens
caaatgcattttaaaaaccccaaccttctaatggttgaaatgcagtgaccaccaacccacccacatgattaattggtttggttccacatttgccttgggcsagagctcttagaatgtttctctgtccgcattctctgcttaaatccagctgggcttgcctgttactcaaaaggagagtgctcccaaggtggggcttctgga

SEQ ID NO: 22059 - DNA, 201 bp, Homo sapiens
tttacctgttttttttttcatatgtcatttaatgttctaatgtaattttctaatgctgtatgagatggaaattatttaggaaggtggctaataaaactaawcttttcttatgctctgcactattaatttctctcccatagatattaaacattatgagccatctaagatttttgataattatttcttaattattatagaaaa

SEQ ID NO: 22060 - DNA, 201 bp, Homo sapiens
taagtcacatctagaattcagggaggatagagggcttaatgaagttagggggaagcatatggtgtcaagaatgtggacaacggctgaaccttgaaagttcwgtcacataatagttatttgtccacaggtgacatactttactggcctcagtgttctgattattgctgcaaggactgaaaaaggataccaggatctttgcct

SEQ ID NO: 22061 - DNA, 201 bp, Homo sapiens
gtgtagatcattgtaacatttttaatccaacaaagaaaattttccttttattgcatgaatcagttatgatatacattcagagaaatgacttaccacccagmatttccttatctgtaatctcttgtcagaagagcaaaccattggcttcatgctctgtgtgtaactatagggagatgctctttccttcagtattactggtgt

SEQ ID NO: 22062 - DNA, 201 bp, Homo sapiens
agaatatataaggagattgaaataaaaatttacagatgattggattgacttgtaaagtttactttattgttttaatacattaatggataatagcctacgtktgaattttgcctccgttaccttcttgctatgtgctcttgggcagttacttaatagccttaagccacaatttcatactagtaaaatgaggcacctggaaca

SEQ ID NO: 22063 - DNA, 201 bp, Homo sapiens
tttttcaatgggtgtctgaacaaaattgtttctgtcaatacaaatgtagaaaggacaaagagcagtgcgtcttgtatcccttaatcctcaagtcacacatkaaaaaaacagttctcaaattatatcagaattttacattgcacaattccagttttaatgaaagaatcgtctaaaggcagcataagtactgaaaaagtagtc

SEQ ID NO: 22064 - DNA, 201 bp, Homo sapiens
ccagctggcaccaccctggctcttggaaaggcatgaggaaaatttggcttcctcttttttccactgaggattttttttttccaaatttgacttgggaaacwgtcattacaatgaatgtgcagctttttttttcctcatatgttgcagcaaaattgtccgtcgagttctgaaggaaatggtcgctcacaattatgaccgttt

SEQ ID NO: 22065 - DNA, 201 bp, Homo sapiens
ctgatgaagacagatataggaagttttttttaacagctttctttctgttactccagatgaaggatgtaaatgttgaaaatgtgaatcagcagagaggagasaagagcatcttcaaaggaaaaagcccatctaaaataatgggaaaggaaaacttggaagctctgcaaagacctacgctccttcatctaatccatggaaagg

SEQ ID NO: 22066 - DNA, 201 bp, Homo sapiens
gcccaagattgatgtctggaaagcaggctgcagccataatcaaagcagttgattcaaagtacacggccattcccattgtggggcaggtcttccagagccastgtaaaggatgtccttctgtaagtgcagacaaatatgggaataatcatgacatcagactctgttttcattttgtctccagtgaaagcatcaactcattca

SEQ ID NO: 22067 - DNA, 201 bp, Homo sapiens
atggagcaagtgagtgagaaaagaagccaaatctctctgcagccatgtatttctagttgaacgcatttagcttctccatttctttgtttgcttttatgagrccctgtgaaggagatcctgggtgtacttgctgccttcgtcttatggctctagcatttcagggacccggaaagaggagacagtggggtagagaacagacta

SEQ ID NO: 22068 - DNA, 201 bp, Homo sapiens
aattaaaacaaaacagtagaaacccagggaaagatgaattttctttaaatgagtagaagaataattgataaggccaaaaaaagtcagtttctgggataccaaaaaaaaatctaatgactagttcatttgattctggagatagttatcatattctaatccagaaacaatttatccaggaaagaaaggcctatgatttaccat

SEQ ID NO: 22069 - DNA, 201 bp, Homo sapiens
agatttggagtgtcagatctctttctcccaggattaatacaggtaagaatctgaccttgcctgacacttatttaaatctgataaatgatgcatttttgctycatttgtgttctgttcccctctccccaccaggtcaaagagttctactcatatcaaaatgaggcagtggccatagaaaatatcaagagaggcctggctagc

SEQ ID NO: 22070 - DNA, 201 bp, Homo sapiens
cagagaggagagaagagcatcttcaaaggaaaaagcccatctaaaataatgggaaaggaaaacttggaagctctgcaaagacctacgctccttcatctaayccatggaaaggtaaaggggcgtttagattccacaactttttctccaacttcatatttttcttcccttcagtagatattattttgaggtaatcacattgta

SEQ ID NO: 22071 - DNA, 201 bp, Homo sapiens
cgctcacaattatgaccgtttctccaggagtggatcttcttctgcctacactggctacatagaacgtatgtacaccaaaaagaggttctccttccataccycacaacttagcattgctggaactgctattaaattacagttattgtgtgtcatcaggtagtccccgttcggcatctacttacagcctagacattctctact

SEQ ID NO: 22072 - DNA, 201 bp, Homo sapiens
agagatactctgatgaagacagatataggaagttttttttaacagctttctttctgttactccagatgaaggatgtaaatgttgaaaatgtgaatcagcasagaggagagaagagcatcttcaaaggaaaaagcccatctaaaataatgggaaaggaaaacttggaagctctgcaaagacctacgctccttcatctaatcc

SEQ ID NO: 22073 - DNA, 201 bp, Homo sapiens
tgcctgacacttatttaaatctgataaatgatgcatttttgcttcatttgtgttctgttcccctctccccaccaggtcaaagagttctactcatatcaaartgaggcagtggccatagaaaatatcaagagaggcctggctagcctatttcagacacagttaagctctggaaccaccaatgaggtacttaccaatattaat

SEQ ID NO: 22074 - DNA, 201 bp, Homo sapiens
ccaatattaataaggattcagcatctcaataaaatttgtaaggatttctacttatacaatttcagtagaagagttactactaaggtaatgctcagaaaagrtgacttgtgtagtgaagtcgcatttgcctatgaaacaattgccatttatcccaatgttttgttaattaattacaaggtagagaggattagaaatatttat

SEQ ID NO: 22075 - DNA, 201 bp, Homo sapiens
agttatgagtggggtatgagcctgcagtgtatgttttgcagctctcggagctctggcggtccaccaggaaatacctgcagcctgacaacctttccaaggcygaggctgtcagaaacttcctggccttcattcagcacctcaggactgcgaagaaagaagagatccttcaaatactaaagatggaaaataaggaagtattgt

SEQ ID NO: 22076 - DNA, 201 bp, Homo sapiens
taagttccccaacctttgtgtggggttgtctgtcagaaacatttctggattgttggttttttgaagtaagaaagaccccttttaaaccaactgccccaccwccaaaacaattattttcttgtactacattttcatcgaaaagttatgccacagtgcagtaatttaatggtcacttgaccagaaatacaatagcagattttc

SEQ ID NO: 22077 - DNA, 201 bp, Homo sapiens
aaaattaaaataaaatggggaggggtctttttgagaaagtcttaatcattttttcatttgttcaaattaaaaaaaaaatcacttcttgagaaaactcaaaycaatagaaactctgtgaatggtagagatttttaagtattccttcccctaaacattgatatccatgattatgcctttttttatagacctcagctggtggat

SEQ ID NO: 22078 - DNA, 201 bp, Homo sapiens
ctatggcctattagagacctcaattttcaagccacttctcactagaattcaaatggcccacaaggaatcccaagcattatgcccttgcctttctttttagrtagatatctctggaaattgtaaagtgacctaccaggctcatcaagacaaagtgatcaaaattaaggccttggattcatgcaaaatagcgaggtctggatt

SEQ ID NO: 22079 - DNA, 201 bp, Homo sapiens
tgcggcaggagaatggcgtgaacccgggaggcggagcttgcagtgagccgagatcccgccactgcactccagcctgggcgacagagcgagactccgtctcaaaaaaaaaaaaaaaaaaaaaaaaatttaaatatacacatacactagacaatggcataattgggaaatggcataaatgagaaaatgtggtttagaatatta

SEQ ID NO: 22080 - DNA, 201 bp, Homo sapiens
atttgagttaatcccagtggattttaattaatcccacaggattttaagaatttctaatcatgttcagctagttgaagttacacacacacacacacacacacacacaccacacacacacagaatctagatacagcattaacaatcaactcccttgccacagaattacccatttatccaaagtttcaattattaccaggccat

SEQ ID NO: 22081 - DNA, 201 bp, Homo sapiens
tgagttaatcccagtggattttaattaatcccacaggattttaagaatttctaatcatgttcagctagttgaagttacacacacacacacacacacacacacaccacacacacacagaatctagatacagcattaacaatcaactcccttgccacagaattacccatttatccaaagtttcaattattaccaggccatttg

SEQ ID NO: 22082 - DNA, 201 bp, Homo sapiens
gttaatcccagtggattttaattaatcccacaggattttaagaatttctaatcatgttcagctagttgaagttacacacacacacacacacacacacacaccacacacacacagaatctagatacagcattaacaatcaactcccttgccacagaattacccatttatccaaagtttcaattattaccaggccatttgtct

SEQ ID NO: 22083 - DNA, 201 bp, Homo sapiens
aaggggaaaatagtatcgaagtaagataatgctaaaatttttattttctttgctattctttgttatattattatacttgatttgtaaatagatctgtgtttgtgtgtgtgtgtgtgtgcgcgtgtagtcatgcattgcttaacaatgggaataagttctgagaaaagcattgttaggcaatttcatcactgtgcaaacatc

SEQ ID NO: 22084 - DNA, 201 bp, Homo sapiens
aggggaaaatagtatcgaagtaagataatgctaaaatttttattttctttgctattctttgttatattattatacttgatttgtaaatagatctgtgtttgtgtgtgtgtgtgtgtgcgcgtgtagtcatgcattgcttaacaatgggaataagttctgagaaaagcattgttaggcaatttcatcactgtgcaaacatca

SEQ ID NO: 22085 - DNA, 201 bp, Homo sapiens
ggggaaaatagtatcgaagtaagataatgctaaaatttttattttctttgctattctttgttatattattatacttgatttgtaaatagatctgtgtttgtgtgtgtgtgtgtgtgcgcgtgtagtcatgcattgcttaacaatgggaataagttctgagaaaagcattgttaggcaatttcatcactgtgcaaacatcat

SEQ ID NO: 22086 - DNA, 201 bp, Homo sapiens
gggaaaatagtatcgaagtaagataatgctaaaatttttattttctttgctattctttgttatattattatacttgatttgtaaatagatctgtgtttgtgtgtgtgtgtgtgtgcgcgtgtagtcatgcattgcttaacaatgggaataagttctgagaaaagcattgttaggcaatttcatcactgtgcaaacatcata

SEQ ID NO: 22087 - DNA, 201 bp, Homo sapiens
taataacacatagtttaaaacacattgtataggtgtacaaaaaatattttttctttaaatctttataagcttttttctatttttaaattttttatttttatttttttcttttaaaaatttctggttaaaaattaagacataagcatatatattagcctcggcctacacaaggtcaggatcatcaatatcactgtcttcctc

SEQ ID NO: 22088 - DNA, 201 bp, Homo sapiens
cagtaattgcttattagtttctgaaattgagttagaggaaaaaggaaacattttaaaacacaaaatcatcattttcaaacattgtttcttcttttacctgttttttttttcatatgtcatttaatgttctaatgtaattttctaatgctgtatgagatggaaattatttaggaaggtggctaataaaactaaacttttctt

SEQ ID NO: 22089 - DNA, 201 bp, Homo sapiens
tgtttgagtgagagagaggggcgttcaaggagaaaattaaaataaaatggggaggggtctttttgagaaagtcttaatcattttttcatttgttcaaattaaaaaaaaaatcacttcttgagaaaactcaaaccaatagaaactctgtgaatggtagagatttttaagtattccttcccctaaacattgatatccatgatt

SEQ ID NO: 22090 - DNA, 201 bp, Homo sapiens
ttgttaatacttctccactcttccccatatcatccattctccccaaccccatgtatgtgtgtgtgtgtgtgtgtgtgtatgtgtgtgtctgtgtgtttgtktgtgcttgtagcctaatttcagaggttatgaatcctgtggatgaattagatcttaaaaccctttatttttaaaaaatttttcagcctagactctgtcata

SEQ ID NO: 22091 - DNA, 201 bp, Homo sapiens
ggggctagccctaatcctgatgctaccacgccagctggcaccaccctggctcttggaaaggcatgaggaaaatttggcttcctcttttttccactgaggattttttttttccaaatttgacttgggaaacagtcattacaatgaatgtgcagctttttttttcctcatatgttgcagcaaaattgtccgtcgagttctgaa

SEQ ID NO: 22092 - DNA, 201 bp, Homo sapiens
tttttagctgttgcaaatatttaagtttttggccccttgagaagttctagctgcagctcagaagcttcaccattatttacagagcaggcagggagcttgcrtcatgaacattatattgattttatccaggtggttattgaagcccaaggactggaagccttaatcgcagccacccctgacgagggggaggagaaccttgac

SEQ ID NO: 22093 - DNA, 201 bp, Homo sapiens
aggccaagatccacatcacaggcctctgctggactgggtggatgaacaagattataattttcaaattaggaagagagaaaaagatgcaaagaaaggaatayttctgaggtgaggcacaccatagctttcatttggaaacaatcatgtttggagtacacatacagaactctcatattttggtcccatagttcacaggcatag

SEQ ID NO: 22094 - DNA, 201 bp, Homo sapiens
aaacaaaacagtagaaacccagggaaagatgaattttctttaaatgagtagaagaataattgataaggccaaaaaaagtcagtttctgggataccaaaaaraaatctaatgactagttcatttgattctggagatagttatcatattctaatccagaaacaatttatccaggaaagaaaggcctatgatttaccataggag

SEQ ID NO: 22095 - DNA, 201 bp, Homo sapiens
ttaactggataattaccagatttccatttctggttttggctttgtgttgattaaattaaccacgtggctgctgagtcagacctttattttgtattgtttcygggcattgatttgctctctaaatcagcatggctcttgtacacacactgaactgccacaagaaatgtgacaccttgaaagtccttctgaaatttgttgtat

SEQ ID NO: 22096 - DNA, 201 bp, Homo sapiens
gcaacaggatgagttgtcaaaatgtcagcatctgagctataagaaacacttatgggaccaagaggatcaaagaggtcacattagctacaaagttctaatawctttttcctctagttcataggaaagaatctaaataaatatgcactctgggccaaacaaggacataaacctatgctctctctctctttttttttccttttt

SEQ ID NO: 22097 - DNA, 201 bp, Homo sapiens
aaatttttgattcatcttgagctatggatgaaggaactgagagcaatcaaacagtagcacatttaatgtgaagtgtgacccacagtgttaccaaaaggaamcacagaatgaaaaatgacactggtcatcaaaaggttcacaatataacttagggcttcccacataatcagtcatctttcacctctttccaaagtactttct

SEQ ID NO: 22098 - DNA, 201 bp, Homo sapiens
actaaaagccaatatagaggtccagggtggtctagctattgatatttcaggtgcaatggagtttagcttgtggtatcgtgagtctaaaacccgagtgaaawataggtaagtgtttatgcattatacatttatgaattacatataagactatatacagagaacttccgaaatatgttttgggaattaatcttctgacttttc

SEQ ID NO: 22099 - DNA, 201 bp, Homo sapiens
tatcagctcaggatagctgtatataacaaaaacaaaaagcaatttagagtggcttaactaaatagtttcacttttatagtgtaacaaacatttggaagtasgtggtccagggttaatatggaaatcttaagatatcatcagaatccaagctgccttccttcagctcagccattcttacttgtgacttttgacctcatgctt

SEQ ID NO: 22100 - DNA, 201 bp, Homo sapiens
aataatgattgaacactttataatatatatttgaaaatctgttttaaaaattctatgtgtgcattacttatggcttgattctagtcaattgaaatggtctwaataaatttggaattgagaaacaattgtgatcagttgattattaggcattacatatttgtgtttatgaaaattacagatagtgtgttgacatacataaaa

SEQ ID NO: 22101 - DNA, 201 bp, Homo sapiens
gatagatatcaaagataaaattactaatctttgtttgctgggattctttttattatttttattgtttggccacttaatggaatttagtctcctcttattcytaaaataaatataaaggaaggtgtggagaaaggcatcttcttcctaaggaaaaaacaatatgaatgatgcctacctatttcaagaggaaactggcccctc

SEQ ID NO: 22102 - DNA, 201 bp, Homo sapiens
agatatcactgtgcaccactgtaccatggaggggcttgttacaaatatagattccctatattcatcccagagattctgattcagtagatcggggaggaccygaacgtctttttttttgagatggagtctcactctgtggcccaggctggagtgcaatggcgcaatctcggctcactgcaacctctgcctcccaggttcaag

SEQ ID NO: 22103 - DNA, 201 bp, Homo sapiens
gcaatctcggctcactgcaacctctgcctcccaggttcaagcgattctcctgcctcagcctcccaagtagctgggattacaggcgtgtgccaccatgcccrgcttgtatttttagtagagacagggtttcaccatgttggccaggctggtcttgaactcctgacctcagatgatccacccgccttggcctcccaaagtgct

SEQ ID NO: 22104 - DNA, 201 bp, Homo sapiens
tatttttggaaaataagattttctagctgtcttggttaataagtaacacgtggttgtattgacgatatcattttcagaaagctgggctaaattcaaaagarctgacattgcatatcttattcatcatccaggcaatttttcttccctgtatactgttgaaataatattttgaaaatgcaaacttaaattttcaaatctttt

SEQ ID NO: 22105 - DNA, 201 bp, Homo sapiens
cttattcatcatccaggcaatttttcttccctgtatactgttgaaataatattttgaaaatgcaaacttaaattttcaaatcttttaatataattgttgcyccagaaagacttcataatgagctttcagttacctctggagatatcacagtttgaaagacatggctatatacaacttgaataaattactatcttgtttgcc

SEQ ID NO: 22106 - DNA, 201 bp, Homo sapiens
ttgaaaatgcaaacttaaattttcaaatcttttaatataattgttgctccagaaagacttcataatgagctttcagttacctctggagatatcacagtttkaaagacatggctatatacaacttgaataaattactatcttgtttgccaaaagaatggcaattagtatcttgttcactcaaaagaatgattataatatagc

SEQ ID NO: 22107 - DNA, 201 bp, Homo sapiens
agtatcttgttcactcaaaagaatgattataatatagcatttccctttggtattatgcaggcagaaattagagctgaagacaaccgaagcaggcccaagaytgatgtctggaaagcaggctgcagccataatcaaagcagttgattcaaagtacacggccattcccattgtggggcaggtcttccagagccagtgtaaagg

SEQ ID NO: 22108 - DNA, 201 bp, Homo sapiens
aactcaagggcagcctttaataagtcacatctagaattcagggaggatagagggcttaatgaagttagggggaagcatatggtgtcaagaatgtggacaamggctgaaccttgaaagttctgtcacataatagttatttgtccacaggtgacatactttactggcctcagtgttctgattattgctgcaaggactgaaaaa

SEQ ID NO: 22109 - DNA, 201 bp, Homo sapiens
aaacacatgatcttgaaaatcccttttcttaaagcattttgtaagactagtgttaacatggaaaacactttgagaaacatcactataattaagaaaccatrgactccagagtcagaaaaacctaggtttcaatcccagcaatgccatttaccatttaccagctatatgaccttgaacaaatgactaggtatatctgcgtct

SEQ ID NO: 22110 - DNA, 201 bp, Homo sapiens
tgaatgtaagagatgtaccactgagggcattgttgatacaaggggtgattgtgcgtgtgtagggttaaaaggtgtgtgggaactctctgtactttccactyaattttgctgtgaacctaaactgctctttaaaaagtctattaattaaaaaaaagagagatgggaagattctgaggtacttcattgtaaggaaacattact

SEQ ID NO: 22111 - DNA, 201 bp, Homo sapiens
tagggaatgcagaaaaacatttaaagaaatattgtgcaatctccccagtttggcacaattttcctttaagtgtatgcactattaaacaataaaaccatgamgaatcaaagaattttgccatgcctgaaatgtgtctactagtcaacttaagccacctcaaagctggacacccttgccttgctgtcattttgataccaaact

SEQ ID NO: 22112 - DNA, 201 bp, Homo sapiens
acaatgcctgaggatttgaatcggggtgtaaaaccatgaggagtaatctagatctgggtcagcaaacttgttctgtaaagggtagaaagtaaatattttaygctttgcaggccacatggtttctgttgcagccactcaattctgttactgtagagtgaagacagccatcagcaatacattaacaaatgagtatggctgtgt

SEQ ID NO: 22113 - DNA, 201 bp, Homo sapiens; identical to SEQ ID NO: 3305

SEQ ID NO: 22114 - DNA, 201 bp, Homo sapiens
tctacttacagcctagacattctctactcgggttctggcattctaaggagaagtaacctgaacatctttcagtacattgggaaggctggtcttcacggtasccaggtaactcacttctcatggattttgcttaataaagtatgcaagaaatcaggctgaggtaaaataaaacatatatgctgtgggtaatgctatagaatg

SEQ ID NO: 22115 - DNA, 201 bp, Homo sapiens
tttttttttttagacagtgtttcgctcttgttgcccaggctggagtgcaatggcgcaatcttggctcaccacaacctccaccttcagggttcaagcaattvtcctgcctcagcctcccgaatagctgggattacaggcatgtgccaccacacccggctaattctgtatttttagtagagatggggtttttccatgttggtc

SEQ ID NO: 22116 - DNA, 201 bp, Homo sapiens
ttcgctcttgttgcccaggctggagtgcaatggcgcaatcttggctcaccacaacctccaccttcagggttcaagcaattatcctgcctcagcctcccgartagctgggattacaggcatgtgccaccacacccggctaattctgtatttttagtagagatggggtttttccatgttggtcaggctggtctcaaactcctg

SEQ ID NO: 22117 - DNA, 201 bp, Homo sapiens
tttaaataatgcttttggtaaaatagttagtgttttaaaatacaaagatataatttccatgtaacatttgtgctgtgtcatttgaattttgtaaccattayttgtaacaatactatcacatagagctagaatgccttgagtctaggtagcactgaccctttcataatagttgacctacggtaagcataagggtcatttgta

SEQ ID NO: 22118 - DNA, 201 bp, Homo sapiens
attagagttagtgagatctgactggaagcatttgcaataacctaggcaagaattagtaaaggtctgaattaatgtaggggcagagggctgagaggagatasattcaagggccactttatttagtgactgataagatgtggaaaatgagaaagagataagaatccaggtgactctaaagctttcagttgaggttaccaggtg

SEQ ID NO: 22119 - DNA, 201 bp, Homo sapiens
ctgttaaaaaccaattgatataacaacatagcgttatagggaccaattttaaaaccatgtactctaagtaattgatagaaaacaattcacttataaacttmtaaaacctgttagggataaatgtggcttttgatattaaagtaaagtttgcctcaggattttttgtgtagaaaatttccacatgaggaaaaaaacctaatc

SEQ ID NO: 22120 - DNA, 201 bp, Homo sapiens
catgcctgtaatcccagcgctttgggaggccaaggtgggtagatcacttgaggttgggagttcgagaccagtctgaccaacgtggagaaaccccatctctrctaaaaacacaaaattagccaggcatggtagcgcatgcctgtaatcccagctactcaggaggctgaggcaggagaattgcgtgaaactgggaggtggagg

SEQ ID NO: 22121 - DNA, 201 bp, Homo sapiens
gaggccgaggtgggtggattacctgaggttaggagttcaagaccagcctggctaacatggtgaaaccccgtctctactaaaaatacaaaaattagccaggygtggtggcacacacctgtattactagctactcaggaggctgaggcaggagaattgcttgagcctgggagatggaggttgcagtgaactgaaatcgtgtca

SEQ ID NO: 22122 - DNA, 201 bp, Homo sapiens
ggcgtggtggcacacacctgtattactagctactcaggaggctgaggcaggagaattgcttgagcctgggagatggaggttgcagtgaactgaaatcgtgycactgcactccagcctggccgacagagtgagactctgtctcaaaaaaaaaaaaaaaaaaaaaaaaaagaatcatgtctctatgatgaattacctgggtga

SEQ ID NO: 22123 - DNA, 201 bp, Homo sapiens
atacacacatatatatatgttcatatatatacacacatatatatgttcatatatatacacacatatatatgttcatatatatattcatatatatatatatwttttttttacccaataccaatataaatgctctggagggtggaaaacattgcccctgtgaaatgttgaccatgggtattatggccatgcctggggccttgc

SEQ ID NO: 22124 - DNA, 201 bp, Homo sapiens
acaattaaacacaatggtaagtttttgtgtatctagacatagaaaaagtcagcagaaaaatacagtataaaagatactatgtaggtgtacctttattcatwaaaggtacataagtgaaatttgcagggctgaaagttgctctggatgaatcaccaaatgagcactgagtgaatgtcatagactaggacgttactgtacact

SEQ ID NO: 22125 - DNA, 201 bp, Homo sapiens
caaaggtggttcccccatgtatctggtgcatgggctggaaagactcaaacatctgaggctcctcatgcaactatctttatttccctgtcgcctctcagcaytgcagcttcatgtcagacttcttatgtagtagctcaaggctccgaagcacatgtactgatagtgtgccagagaaaagctgaattctcttttaagacatag

SEQ ID NO: 22126 - DNA, 201 bp, Homo sapiens
tattaatttagaatagagattacattaaaccttattagcattatctgtatcctaaaaatcttaaggcagcaataatttggaggactgcatgatgtattttytaaatcagattatttatacaatattgaaccatataacatgcaacacacatgtagtgtagtgtaatagaaaggatactaagatgaactaaaattggaaaat

SEQ ID NO: 22127 - DNA, 201 bp, Homo sapiens
ttgaaccatataacatgcaacacacatgtagtgtagtgtaatagaaaggatactaagatgaactaaaattggaaaatttagtttaaattctgacctccaayaacagtatatccttcaaggaagtcttttttttttttttttttttttttttttagacagtgtttcgctcttgttgcccaggctggagtgcaatggcgcaat

SEQ ID NO: 22128 - DNA, 201 bp, Homo sapiens
aagcaattatcctgcctcagcctcccgaatagctgggattacaggcatgtgccaccacacccggctaattctgtatttttagtagagatggggtttttccmtgttggtcaggctggtctcaaactcctgacctcaggtgatccacccgcctcggcctcccaaagtgctgggattacaggcgtgagccaccgcacatggcca

SEQ ID NO: 22129 - DNA, 201 bp, Homo sapiens
ttaactgtataataaattatttcagttagtgcctttttcgtaatttcagtaagtagtataaactatatggaaatttaaagattgtgttcacctatcatgtkatatagcataggacagaatttcagaggggagaaatctagcttatgcttcagtaatcaattttacaagatttgttttgacttcaaaaattctcatgatatt

SEQ ID NO: 22130 - DNA, 201 bp, Homo sapiens
aatgtacccattcagaatctgataaaagtgatgaggcccctttttactcatacataaaattttataaccctcacccctcctttttttttttttttttttgktcattgaccccatgaatccaatccataaatttccagggttaagaattccctgtaccacaggttaaaaatccctgaaaaggggattaactcttcaattcaa

SEQ ID NO: 22131 - DNA, 201 bp, Homo sapiens
tcatttattatgtttattgtatatttctatttcactagaatgtaagttccatgaagaaatggatctcagtttttttcaacaccaattgctcaccagttccyggtacatagataatatttaataaagacttgctaaaaagtgaatagtacaataacctccctacccatatactttattgagtgcccactatgtactcagttt

SEQ ID NO: 22132 - DNA, 201 bp, Homo sapiens
ggtctgaagttcactacagtcatggaagaaagagatggagaaagccaccagctcttaacggcctcagcctagaagtgatcctcatagattctatccatggygtattagccagaactagtcacgtggcccccaccaaatcacaaaggaatctgggaaatgtagtaacacatgtatatttttatgaacactcactattcctgc

SEQ ID NO: 22133 - DNA, 201 bp, Homo sapiens
atggaagaaagagatggagaaagccaccagctcttaacggcctcagcctagaagtgatcctcatagattctatccatggcgtattagccagaactagtcaygtggcccccaccaaatcacaaaggaatctgggaaatgtagtaacacatgtatatttttatgaacactcactattcctgctattcctgctgaaatgtccat

SEQ ID NO: 22134 - DNA, 201 bp, Homo sapiens
agaaaagaagccaaatctctctgcagccatgtatttctagttgaacgcatttagcttctccatttctttgtttgcttttatgagaccctgtgaaggagatsctgggtgtacttgctgccttcgtcttatggctctagcatttcagggacccggaaagaggagacagtggggtagagaacagactagaaattgtgaggaaaa

SEQ ID NO: 22135 - DNA, 201 bp, Homo sapiens
atgactctgccaacacctttccatctacttttagatgctctgcaagacagctgatgcgttgtatatgacagtcctggaaagactaagagtctgtaggatgmcatcataaaatagaaagctcatggttttcatagtcagacagaaggggtatgggtcccgcctctgacatttattagctgagtaaacttgaaaacttttttt

SEQ ID NO: 22136 - DNA, 201 bp, Homo sapiens
gcagttttctcagtacccattcttagtttgcatgcagatggacaaggatgaagctccattcaggtaagatgcagcgttcaggtcatgttccaggaccatcyccagtgcaccaggaacttgcattcagtttagaacattcagtttcagaattaaaacaaaacagtagaaacccagggaaagatgaattttctttaaatgagt

SEQ ID NO: 22137 - DNA, 201 bp, Homo sapiens
tcttaaggcagcaataatttggaggactgcatgatgtattttctaaatcagattatttatacaatattgaaccatataacatgcaacacacatgtagtgtrgtgtaatagaaaggatactaagatgaactaaaattggaaaatttagtttaaattctgacctccaacaacagtatatccttcaaggaagtctttttttttt

SEQ ID NO: 22138 - DNA, 201 bp, Homo sapiens
attgttgctgttgttgtacaggcaatttgagaaaaagtacgaaaggctgtccacaggcagaggttatgtctctcagaaaagaaaagaaagcgtattagcakgatgtgaattcccgctccatcaagagaactcagagatgtgcaaagtggtgtttgcccctcagccggatagtacttccagcggatggttttgaaactgacc

SEQ ID NO: 22139 - DNA, 201 bp, Homo sapiens
aacttcaagtacattcagtaacttggctggagaggtatagggtgacttaactgtgtgtgtaattctgttattgttgctgttgttgtacaggcaatttgagwaaaagtacgaaaggctgtccacaggcagaggttatgtctctcagaaaagaaaagaaagcgtattagcaggatgtgaattcccgctccatcaagagaactc

SEQ ID NO: 22140 - DNA, 201 bp, Homo sapiens
ggtcaaatgtgccattggaaagggggttaactaaattgtacttattatttttataactattattatgcttttttcttctaggaacttcagttacaatctgractaaaagccaatatagaggtccagggtggtctagctattgatatttcaggtgcaatggagtttagcttgtggtatcgtgagtctaaaacccgagtgaaa

SEQ ID NO: 22141 - DNA, 201 bp, Homo sapiens
gaatgtataagttaatggtggcttctgtcatattttgcccatgatttccttatctgtaagaggctgtatggtttatagtcactcagagaaagtttcgaatwtgaacttgaaacctaagtaatttgatccattgaacttgacaaatgtccatttgtcttttcaaaggtgcacatattcacaaaactgaaattgtgccaatat

SEQ ID NO: 22142 - DNA, 201 bp, Homo sapiens
gttctggcattctaaggagaagtaacctgaacatctttcagtacattgggaaggctggtcttcacggtagccaggtaactcacttctcatggattttgctyaataaagtatgcaagaaatcaggctgaggtaaaataaaacatatatgctgtgggtaatgctatagaatgtataagttaatggtggcttctgtcatatttt

SEQ ID NO: 22143 - DNA, 201 bp, Homo sapiens
ccactgaggattttttttttccaaatttgacttgggaaacagtcattacaatgaatgtgcagctttttttttcctcatatgttgcagcaaaattgtccgtygagttctgaaggaaatggtcgctcacaattatgaccgtttctccaggagtggatcttcttctgcctacactggctacatagaacgtatgtacaccaaaaa

SEQ ID NO: 22144 - DNA, 201 bp, Homo sapiens
gtcaagaacatcctgctgtctattggggagcttccccaagaaatgaataaatacatgctcgccattgttcaagacatcctacgttttgaaatgcctgcaakgtataatacattgcacatgtctctctgtgtattcaagcttatttgtgtgttcatggggtaccgatgtagctaataataatgatgtggtcattatgcaggg

SEQ ID NO: 22145 - DNA, 201 bp, Homo sapiens
aatctagatgtgcactaagtttgaacatcttatgaacaggtgaagaagaccttaaacagaatataccaccaaaaccgtaaagttcatgaaaagactgtgcrcactgctgcagctgctatcattttaaataacaatccatcctacatggacgtcaagaacatcctgctgtctattggggagcttccccaagaaatgaataaa

SEQ ID NO: 22146 - DNA, 201 bp, Homo sapiens
gttcaaaggttctattggtagcagtgacatcagagaaactgttatgatcatcactgggacacttgtcagaaagttgtgtcagaatgaaggctgcaaactcwaagtaagtgcaaatccaatctcatgtattacatcattctacaccattgtccatttgatactcaccatgctgcctactattggcactcctaattctcttta

SEQ ID NO: 22147 - DNA, 201 bp, Homo sapiens
atttttctggaaatctttatagtggaatgaagtatttatttattgatgaaaggcattattaaaaggtaaatttctcatcaaattataagggattacaaacrtaatgtaacaaagcaagtcatcaaagcatgattggatgaattcaggaaaggagacaaattatgagactgaaatgatccaactgagattagtaatattgat

SEQ ID NO: 22148 - DNA, 201 bp, Homo sapiens
tgatgaaaggcattattaaaaggtaaatttctcatcaaattataagggattacaaacataatgtaacaaagcaagtcatcaaagcatgattggatgaattyaggaaaggagacaaattatgagactgaaatgatccaactgagattagtaatattgatttgttatgagattatcgatatctggctaaagtacaaggttaaa

SEQ ID NO: 22149 - DNA, 201 bp, Homo sapiens
agacaaattatgagactgaaatgatccaactgagattagtaatattgatttgttatgagattatcgatatctggctaaagtacaaggttaaagattttaaragggtatgacaagtctaaagtagagtttttttaaagcctttagaaattattttaaaactatgacatggaaaagccttttatatattaaaataatgattga

SEQ ID NO: 22150 - DNA, 201 bp, Homo sapiens
ctatttcagacacagttaagctctggaaccaccaatgaggtacttaccaatattaataaggattcagcatctcaataaaatttgtaaggatttctacttayacaatttcagtagaagagttactactaaggtaatgctcagaaaaggtgacttgtgtagtgaagtcgcatttgcctatgaaacaattgccatttatcccaa

SEQ ID NO: 22151 - DNA, 201 bp, Homo sapiens
ctttccttctattgggagccttttgttaatacttctccactcttccccatatcatccattctccccaaccccatgtatgtgtgtgtgtgtgtgtgtgtgtrtgtgtgtgtctgtgtgtttgtgtgtgcttgtagcctaatttcagaggttatgaatcctgtggatgaattagatcttaaaaccctttatttttaaaaaatt

SEQ ID NO: 22152 - DNA, 201 bp, Homo sapiens
aaattgtgccaatatttcttacataaacgtttaaaaataatattttatttttattcacagatatatttcttagcctcctctcacccccaagtatttaattmtagaatatattttccttttctggttgtttctatgaagagattgattccccataataaaacccttcataatagaatatgatgctctaaagagtcaatctgt

SEQ ID NO: 22153 - DNA, 201 bp, Homo sapiens
aagacaaaattgtgcccatcttggagctcatattccaagcacttggccctcttggtattggtcccctttctcctttactatagatatgttataatttcatwtattagatgattaataagtgcctttaattggaggcaaagagaaaatgttgatgttaacagaaacaagaaagtttaggacacaacagaatagagctaccac

SEQ ID NO: 22154 - DNA, 201 bp, Homo sapiens
ctttactatagatatgttataatttcatatattagatgattaataagtgcctttaattggaggcaaagagaaaatgttgatgttaacagaaacaagaaagkttaggacacaacagaatagagctaccactgtctcctcacttggctctctcaggcacgagggcttaggtgatatttatcctgaaggcaggagctgaactat

SEQ ID NO: 22155 - DNA, 201 bp, Homo sapiens
aatgagtatggctgtgttccaataaaattttatgtacaagaatagccagtgggccagacttgcctgctggccatagtttgccaatccctgatctagattawcttgtacagtttttctattcactaagctagggcagctaaggcaaggcatattctatgagaaagattgccccctagctattaaacatagcccagtgtctgt

SEQ ID NO: 22156 - DNA, 201 bp, Homo sapiens
tggatgaacaagattataattttcaaattaggaagagagaaaaagatgcaaagaaaggaatatttctgaggtgaggcacaccatagctttcatttggaaayaatcatgtttggagtacacatacagaactctcatattttggtcccatagttcacaggcataggtgaaaatgtgggcatgactattgtgttttcttcagga

SEQ ID NO: 22157 - DNA, 201 bp, Homo sapiens
agtttgtgtccatcacattagttataatgcctcaaacaaccccttcatcccatgcagccatattttgtcctatatcaaatgtctctttaagtatccttagrgctatctcctaatgtgtcctgagcatggcactgagaatctcatgcttccatcaaagagtgtccttcagactgaaagtagcttcatgccgcaaccgtactt

SEQ ID NO: 22158 - DNA, 201 bp, Homo sapiens
ttcccaggcaatgctgatgctgttgttcacagaaacacactttgagaaccattgttcctttcaaagtgtagcaatgattgaaggaaaacatccttcttaaytggcacttcatcactctggtattttaattgactaattaatttagcaaatcaacagagtctacttccggtgcttaaaattaggacagcatgtttccaagcc

SEQ ID NO: 22159 - DNA, 201 bp, Homo sapiens
tactttctagacagaagtttttccaaatgaaatggaattgaattctttgcaaagagaaatcaacaacagcaacaacaacaaaaagtaatttggattttttwaaaaagtacacagtatccttaagaatctacccttatccatattgtaaccaatctgtcttccatttccacttgttcatttgaaaaaaatatcttttaaacc

SEQ ID NO: 22160 - DNA, 201 bp, Homo sapiens
aatataggacatcagaaggtactctaagtgattcagggattaaaacgacctctgacctatttttacactgatcataacagcagcaggggttttaatttgcrcagcaaaaattaatattcctgtcaaaacataagggcataaaactctcatttaattgtgaaagcagtttctcacagtttgatttaaagtccacaattcaat

SEQ ID NO: 22161 - DNA, 201 bp, Homo sapiens
ttgaaattatttatcctcttcatcattatccagggcacattccccagccaatgcaatctgtttatccagttatctagagcatcattaaaggacccaccatwtttttcctcctaggacctactgtacatgccccactgtaagaatgattttttgtaacacaatattttttcaaatatcttggcaatcaagggcttacgcctc

SEQ ID NO: 22162 - DNA, 201 bp, Homo sapiens
tctaagcacatccaggtcacctctgaatcccttaagtgtttccttccagtcactggcatcatacgttcagaccctgtaaagttacagctgttagtccaatwccattaaatataatatgaacaagttttttctttttttctcaaatgtttagggtgactgtggtaataaccactgacatcacagtggactcctcttttgtga

SEQ ID NO: 22163 - DNA, 201 bp, Homo sapiens
cattcaggtaagatgcagcgttcaggtcatgttccaggaccatccccagtgcaccaggaacttgcattcagtttagaacattcagtttcagaattaaaacraaacagtagaaacccagggaaagatgaattttctttaaatgagtagaagaataattgataaggccaaaaaaagtcagtttctgggataccaaaaaaaaat

SEQ ID NO: 22164 - DNA, 201 bp, Homo sapiens
cattgattatataaaagtaaacgagtcagttgtattttcagagaataaaagattgtgctttatagttaaactattaagctgtcactaacttacattaagtkatatctagaatgaacctccacaaatgcattttaaaaaccccaaccttctaatggttgaaatgcagtgaccaccaacccacccacatgattaattggtttg

SEQ ID NO: 22165 - DNA, 201 bp, Homo sapiens; identical to SEQ ID NO: 3304

SEQ ID NO: 22166 - DNA, 201 bp, Homo sapiens; identical to SEQ ID NO: 3306

SEQ ID NO: 22167 - DNA, 201 bp, Homo sapiens
ctgaggtgggaggatcacttgagcctggagatgaaggttgcagtgagccgagatcgcatgactgcactccagcctgggtgacagagtgagaccctgtctcaaaaaaaaaaaaaaaaaaaaagtaaagaaagaagaagaaactttctctgcctttctctgcttgttaactggtgtagtcccagagccttaaaaagtacttac

SEQ ID NO: 22168 - DNA, 201 bp, Homo sapiens
agttcataatctttatggaaaatgtacccattcagaatctgataaaagtgatgaggcccctttttactcatacataaaattttataaccctcacccctcctttttttttttttttttttgttcattgaccccatgaatccaatccataaatttccagggttaagaattccctgtaccacaggttaaaaatccctgaaaagg

SEQ ID NO: 22169 - DNA, 201 bp, Homo sapiens
ggatatgtgtcattatctttatgcaggtcacacaactggtctctcattaaataatgaccggctgtacaagctcacgtactccactgaagttcttcttgatsggggcaaaggaaaactgcaagacagcgtgggctaccgcatttcctccaacgtggatgtggccttactatggaggaatcctgatggtgatgatgaccagtt

SEQ ID NO: 22170 - DNA, 201 bp, Homo sapiens
gggattaactcttcaattcaaagctagatagcaaatgtgtaagtgtctcaaaagcaaaattctgagtttgcaatctagaaacataaaaatactttaccaartatgtgtttattttttaactaaaagtgttccttggaaatatttaaatgtcttggtaacctattttatccctgtttggttaatagagtaagttcaaaggtt

SEQ ID NO: 22171 - DNA, 201 bp, Homo sapiens
gaactttgtatatagtaagtgtggtttccagttttaagttttgatagtagaaatttagttacttttaatcacagagaactttatattttattttcaatttyatttgcctaaagcttttccacttgcctgagtggactatcaattttcacgtctttcttattaaaaagcaaaaagcaaaaacactttttaagtataactaaa

SEQ ID NO: 22172 - DNA, 201 bp, Homo sapiens
gagaaatattagactctaagtctatctcctagagtagaactttgtatatagtaagtgtggtttccagttttaagttttgatagtagaaatttagttacttytaatcacagagaactttatattttattttcaatttcatttgcctaaagcttttccacttgcctgagtggactatcaattttcacgtctttcttattaaaa

SEQ ID NO: 22173 - DNA, 201 bp, Homo sapiens
tatcctcacagggtaacgtcctatatctatatcctgaagcataaatattgaagcatattctcttattttaagaaacaaattcttttttgaaatatatttayttttataagttttaagatgctgttacatttttcaatactgaaatatcctggtttaagtataactttgtttgttactacaactacatttttcaggaagcca

SEQ ID NO: 22174 - DNA, 201 bp, Homo sapiens
gctgtctattggggagcttccccaagaaatgaataaatacatgctcgccattgttcaagacatcctacgttttgaaatgcctgcaaggtataatacattgyacatgtctctctgtgtattcaagcttatttgtgtgttcatggggtaccgatgtagctaataataatgatgtggtcattatgcagggttacgttgcataaa

SEQ ID NO: 22175 - DNA, 201 bp, Homo sapiens
gagtagaagaataattgataaggccaaaaaaagtcagtttctgggataccaaaaaaaaatctaatgactagttcatttgattctggagatagttatcataytctaatccagaaacaatttatccaggaaagaaaggcctatgatttaccataggagttgccacatagtttcataaaaaaaatcagatacacatttactgtc

SEQ ID NO: 22176 - DNA, 201 bp, Homo sapiens
cacagcgtttacatatttacctgtatttaagatttttgtaaaaagctacaaaaaactgcagtttgatcaaatttgggtatatgcagtatgctacccacagygtcattttgaatcatcatgtgacgctttcaacaacgttcttagtttacttatacctctctcaaatctcatttggtacagtcagaatagttattctctaag

SEQ ID NO: 22177 - DNA, 201 bp, Homo sapiens
acagcgtcattttgaatcatcatgtgacgctttcaacaacgttcttagtttacttatacctctctcaaatctcatttggtacagtcagaatagttattctstaagaggaaactagtgtttgttaaaaacaaaaataaaaacaaaaccacacaaggagaacccaattttgtttcaacaatttttgatcaatgtatatgaagc

SEQ ID NO: 22178 - DNA, 201 bp, Homo sapiens
cgggaaaaccaaacacgttccctaatcaggaaaaaaaaaaaaaaaaaaagtaagacacaaacaaaccattttttttctctttttttggagttgggggcccrgggagaagggacaagacttttaaaagacttgttagccaacttcaagaattaatatttatgtctctgttattgttagttttaagccttaaggtagaaggca

SEQ ID NO: 22179 - DNA, 201 bp, Homo sapiens
cagttcaaaagctacatctgtcaccacctataagatagaagacagctttgttatagctgtgcttgctgaagaaacacacaattttggactgaatttcctasaaaccattaaggggaaaatagtatcgaagtaagataatgctaaaatttttattttctttgctattctttgttatattattatacttgatttgtaaataga

SEQ ID NO: 22180 - DNA, 201 bp, Homo sapiens
ttgatctttttaaattaccccatgccaactttaagcctgtactaagatttcatatagtaaaacattattttattcgggcacagctaatttaaagttacatrtgtgcaacgctgaaatgtacctttgtactaaaagtttgataattacattaatagagtaaattacactgaagagatgtttcttaaatatcaaaaatgtcca

SEQ ID NO: 22181 - DNA, 201 bp, Homo sapiens
aagattatatggggctcaactgagttgaactttgataaaggttttacttattgtttacttaataatagctaaaatgaactaagcacttactgtgtgctagrtgctgactaaaggcattacacgaactgtctcttttattcttgtaatggccctgagcagtaagggctgccttatcaacctcttgtgatagatgaggaacca

SEQ ID NO: 22182 - DNA, 201 bp, Homo sapiens
tccatcactaggcagagtatatgtaggaagtaaaaatagagatttgagacacttgtttggataattcaggaaaagtattctcttcttctaaggcacaagakaattttcatgtagactaaattactgagcttggtattatttggattcattgcatagctattgagctttatgttttactttagaagctatggttggttttaa

SEQ ID NO: 22183 - DNA, 201 bp, Homo sapiens
agtctacagggtgaaaaccaacaagctgattttcattaaattcactttgtacttttatccttgtttcttaaacattagttaaattatcaaaatggcaaaaracacttatcatctctgtgcctataaatatcaaagatgataaaacaaaactaagtggcttactattcctgccaaatcatagtcaccctcctcatttcaacc

SEQ ID NO: 22184 - DNA, 201 bp, Homo sapiens
atacattttgtagcctggaaggaaagtgacatagtggtgacaatactggtatttttcccacttaggagatcttgctttctaaagtatttaaggttcatacsaaaaagacatgggccatatagacatgtgtgcattgccactgagtgaacacttctgactattttggggcaatctagttatgaacttctaatggtcatgata

SEQ ID NO: 22185 - DNA, 201 bp, Homo sapiens
ccagtgatttgtttgagaatatgatactgtgaattttcagacactgaggtcattattccagttcctttctaagtcggacaaacactattccaacatttatrggttagtccagtctaatgactaaaactgattgccagataaagtacctagtaaatccatcactaggcagagtatatgtaggaagtaaaaatagagatttga

SEQ ID NO: 22186 - DNA, 201 bp, Homo sapiens
aataccattgaaaaggcaagtgaaaaaacattttatgaggaatggtttcataaaactgttgtgaagtgtattaatatagaatcatgtttcagatcagctasattataaacatcggttttccaaatgctgcattgtgtaaaatgatcactttttagtttcttaggaagacacactgttaaaaaccaattgatataacaacat

SEQ ID NO: 22187 - DNA, 201 bp, Homo sapiens
taaatgctctggagggtggaaaacattgcccctgtgaaatgttgaccatgggtattatggccatgcctggggccttgcaatagcccataaaggctgtgccrtctcaggaatctcaaaggtagtgattgccattttcgtccaagaacttttttatttgctattattttaaaccttagttattttttgtttcaagtacagtta

SEQ ID NO: 22188 - DNA, 201 bp, Homo sapiens
tttcaaagtttggcagaagcaaagtttagtagcagtttggatggcaaaattataggataatttgatgaagcataaacatcgtacaaatgctttgttttacktggagcctcagagacataagtctaagcatctatggacgttaaaagtcatctggagctctgttcagttagttgtctcagttgtaactctgctaccatgttg

SEQ ID NO: 22189 - DNA, 201 bp, Homo sapiens
cactcaggctatctcttgaaatttcaaagtttggcagaagcaaagtttagtagcagtttggatggcaaaattataggataatttgatgaagcataaacatygtacaaatgctttgttttacgtggagcctcagagacataagtctaagcatctatggacgttaaaagtcatctggagctctgttcagttagttgtctcagt

SEQ ID NO: 22190 - DNA, 201 bp, Homo sapiens
ccttgaaagtattcgggaaatccaggaaagctatgaaagacaagaaactagtcttaaaaaaatggttctgttttttacaaaattcaactgataaataagtwtatgtgacctgtttttagataacgcactgtattataaaattgccatttttatgggtccaaatagaatggcagctactttaagtggctcaacctggtaact

SEQ ID NO: 22191 - DNA, 201 bp, Homo sapiens
aactaccatttcataaattcctgtgccaggaaccctgctaggctttgtatgtacattatcactaggctacaaaactctattgaataagaaccatttattayctcattctgcagatgaggaaactgaggcacagagaagttaaagaaggcattaatggttaaagacctgagaaatattggccatgagatttgaaatagagtc

SEQ ID NO: 22192 - DNA, 201 bp, Homo sapiens; identical to SEQ ID NO: 3314

SEQ ID NO: 22193 - DNA, 201 bp, Homo sapiens
caaaccagcagggagcgttattaacatttttaaaaaattaggacctttctccaggtaatttacaacaaattaagtagatcattattttagatagacaatcktggaaagttccaagaaaataaactccacaacttctttttgttacttgcttcgtttcccttctttcaacctccactacggaatttagatccagtgaaagtt

SEQ ID NO: 22194 - DNA, 201 bp, Homo sapiens
tgattttaacaaattccttctattttcctttgttgtcttccttaaacaaatttcagtgaagatgtagtttgctcccttctgaagcaaaccagcagggagcsttattaacatttttaaaaaattaggacctttctccaggtaatttacaacaaattaagtagatcattattttagatagacaatcgtggaaagttccaagaa

SEQ ID NO: 22195 - DNA, 201 bp, Homo sapiens
atgcacaccatcgcactctgtgacttttaaaactatcttgtggatctccttagcacatctcttgtgctctgcttatattctggcccagatgtgcagagcasctagttcacaataacctcccaaccaccagtgtcatcatgtgctttgtggatgaagtgtggtccactctcctgagatctgttcacagtgtcatcaatcgct

SEQ ID NO: 22196 - DNA, 201 bp, Homo sapiens
ttcaacctccacaagcagaaatttaaatccagtgaaagttttggttttttgtaataagaagaaatattttcttattgaaacgacgacatttgaagctaatraaagaatctcaccaataatgtatttttacactggattaaaccgctggcaaatagcctaatgtttaacaattctgtcataaattgtgcggaatgtctactt

SEQ ID NO: 22197 - DNA, 201 bp, Homo sapiens
gctccgtttcccttttttcaacctccacaagcagaaatttaaatccagtgaaagttttggttttttgtaataagaagaaatattttcttattgaaacgacracatttgaagctaatgaaagaatctcaccaataatgtatttttacactggattaaaccgctggcaaatagcctaatgtttaacaattctgtcataaattg

SEQ ID NO: 22198 - DNA, 201 bp, Homo sapiens
agttttgtgcatcacttaaagattgtaggcattattctcagtataaggtgaagccaatgaagaatattaaataggaacgaaactgtctgatgtacattttsaaagctcattctggccactgtgtagagaatggatattaggaagatgaaaaaggaagtagggaggccagttaggaggctactatagttgtccaagtaccag

SEQ ID NO: 22199 - DNA, 201 bp, Homo sapiens
gctaccatgttggaatgatctaactatggctccttggagatgggcacttagaagtagtggagtttagatgtcctctacaattgcacaaatcccttttaatkgaatcacaattaacgggaggccttgcctactggtaataactagagttacagttagactctatggaaggcaaagaaattaagatcttatggcttcttcctt

SEQ ID NO: 22200 - DNA, 201 bp, Homo sapiens
ttttacgtggagcctcagagacataagtctaagcatctatggacgttaaaagtcatctggagctctgttcagttagttgtctcagttgtaactctgctacsatgttggaatgatctaactatggctccttggagatgggcacttagaagtagtggagtttagatgtcctctacaattgcacaaatcccttttaatggaatc

SEQ ID NO: 22201 - DNA, 201 bp, Homo sapiens
ctatctcttgaaatttcaaagtttggcagaagcaaagtttagtagcagtttggatggcaaaattataggataatttgatgaagcataaacatcgtacaaaygctttgttttacgtggagcctcagagacataagtctaagcatctatggacgttaaaagtcatctggagctctgttcagttagttgtctcagttgtaactc

SEQ ID NO: 22202 - DNA, 201 bp, Homo sapiens
agggaacaagtctttcttgccaacctttgcaagtttccctgtagcctttaattttttccgcatattctgatccctgaagatgtcccttactttcttgttcrctaagctaagcatgtaaaattgaggaccaatgtactgagcccccttttatgaagtctggcaattctgtgagcatccagtctgcatcagtgcagcaccctg

SEQ ID NO: 22203 - DNA, 201 bp, Homo sapiens; identical to SEQ ID NO: 3312

SEQ ID NO: 22204 - DNA, 201 bp, Homo sapiens
agatgttactggatcagggatacttttctgaaggtccagttgttccatttaccagaacattcctggtctactgtattcattctcaaagtcctctccatttktcccaattacattttaacagaatacggagtcataagccttggtgtaggagcttgggattggcgagaatagtctcagaattgccttcttaaattttctaca

SEQ ID NO: 22205 - DNA, 201 bp, Homo sapiens
gaagatgttactggatcagggatacttttctgaaggtccagttgttccatttaccagaacattcctggtctactgtattcattctcaaagtcctctccatwtgtcccaattacattttaacagaatacggagtcataagccttggtgtaggagcttgggattggcgagaatagtctcagaattgccttcttaaattttcta

SEQ ID NO: 22206 - DNA, 201 bp, Homo sapiens
aatgtttaacaattctgtcataaattgtgcggaatgtctacttcctaaattggaaaatgaaataatacaacatggataatttaaaattcatacactgcctwttttttttaaagattaaaatggtttacagtaaaaacatggatcaattatttttaaataaaaaggaaaattctgaaaacaactaataatgaaatgaagaat

SEQ ID NO: 22207 - DNA, 201 bp, Homo sapiens
tacaaggctgagaaaacatcaagaaagaggagaagctggggaaaagccatttcaaaccccttctaggagtgaagctgcatttgaagaggatggtaagacaygtgggtttagatatgattagtcaagccttcagctggggttcttagacagtcatgcttatttctaatcttttatttctaatttaatttgacttataactaa

SEQ ID NO: 22208 - DNA, 201 bp, Homo sapiens
accagggaggtgccagggtaaatgggagaaatggtcagcttcatcatagattgtgcacatggaacgtataggacttgccgtcagataagatgtgaagagartaagaatgacaccaatcagaaacaaaccctaggactggtatctgaacaacttggtgggtggtaggctcaaaactggaggagcaggtttggaattgcagtt

SEQ ID NO: 22209 - DNA, 201 bp, Homo sapiens
aacagcttacccttgagctgtgaccacagcaacatgggaagtttctttagcttcagagtttctgccataatcacactgagctcaagaagctgtgggatgayagagaaaaactggctgaaaaacataaaatgtggccttggaagcataaacaggaatagtacccaattagtaagtagataggagtccctttatgaggggcag

SEQ ID NO: 22210 - DNA, 201 bp, Homo sapiens
atttcaaatgagttattttaaatagaaatcaccaagttcttctagttgcattgctatcatttgcttcagtcaatcaacaacaccgaaagtcaggcttaaargctagaactggtccccactggtcatcagtaatgcttataaggagaggatatgggcaacacaggaagcagcatgtctcctacaagtcctgcactttagagt

SEQ ID NO: 22211 - DNA, 201 bp, Homo sapiens
taaaattctcattgtcaccttcctcagtcagaagttttgtgtgtttgtgaccatgggattatgtaaaagttcattcacagagatgcatggatatctttcgraagttgacaagtccttttttttttatttttcaaaatttatttcaaatgagttattttaaatagaaatcaccaagttcttctagttgcattgctatcattt

SEQ ID NO: 22212 - DNA, 201 bp, Homo sapiens
tgctaaattctattaattgagaggtagtttgcagatttcagtgataatgatctgtcatctagataactatcctcatcttgttctctaagccttctcatacycaaagctctgcctccttctagcattttttaaagaatgtaatctatggaatgagctacttattttctaatatcacattgctgtttgttagctgcgcaacca

SEQ ID NO: 22213 - DNA, 201 bp, Homo sapiens
aggccccacctcctaatactgtcatcttagagttaggtttcaaaatatgaattttggattgacacgtacattcagaccatgcaggggacaataccctgtcrttgtcaaacaagcattaatgccctgaaaataggacccttccagcctggtcaggagatgaaactgctatctccaagaacagaagactacatggagcgggtt

SEQ ID NO: 22214 - DNA, 201 bp, Homo sapiens
agaagactccaccctcatgatcttatcacaaaggccccacctcctaatactgtcatcttagagttaggtttcaaaatatgaattttggattgacacgtacrttcagaccatgcaggggacaataccctgtcattgtcaaacaagcattaatgccctgaaaataggacccttccagcctggtcaggagatgaaactgctatc

SEQ ID NO: 22215 - DNA, 201 bp, Homo sapiens
actctccagcctctttcatatgagcactaatcctacttaagaagactccaccctcatgatcttatcacaaaggccccacctcctaatactgtcatcttagrgttaggtttcaaaatatgaattttggattgacacgtacattcagaccatgcaggggacaataccctgtcattgtcaaacaagcattaatgccctgaaaat

SEQ ID NO: 22216 - DNA, 201 bp, Homo sapiens
aggtccaatcagttgcttgctgtgaatgaggaggttgagaggcccaagtaggattttaaaattgacaggtaggccggggcaatggatctctaagaattgcycactatatgaagccaacagaattaaaaagatagagtaaatgagatatcagggaagaagtagatcacccatatcccttcctagtatggaacagaccaagtg

SEQ ID NO: 22217 - DNA, 201 bp, Homo sapiens
acatgataaataataaaatcatcattggtatatataaatagatgatagatagaccagacagatcgatgacagattaagtgtgtgtgtatatgcacaccatygcactctgtgacttttaaaactatcttgtggatctccttagcacatctcttgtgctctgcttatattctggcccagatgtgcagagcagctagttcacaa

SEQ ID NO: 22218 - DNA, 201 bp, Homo sapiens
acagggtaaataatatgcccatactatcagaattacaaatgataataccaggacttgaatataaaatgtcagatcatagttcctatattcttaactgttgytaacaaaaatgtttgacaaagcccctgcctgtgtttgctgcctgaagtgacctctttattcatttcccccacagcttcaacaatttaattacacctggtt

SEQ ID NO: 22219 - DNA, 201 bp, Homo sapiens
tgtaactaacatttattgaaggcttattgtgtgctaaacacttgacagtcattaccccaaccctctgagatagacacaatcgctatccaacttaaaaatarttagaaaaataagattagacagggtaaataatatgcccatactatcagaattacaaatgataataccaggacttgaatataaaatgtcagatcatagttc

SEQ ID NO: 22220 - DNA, 201 bp, Homo sapiens
taattgcactgaataatttttattattgtaactaacatttattgaaggcttattgtgtgctaaacacttgacagtcattaccccaaccctctgagatagayacaatcgctatccaacttaaaaatagttagaaaaataagattagacagggtaaataatatgcccatactatcagaattacaaatgataataccaggactt

SEQ ID NO: 22221 - DNA, 201 bp, Homo sapiens
ctgtggctgatcacaggccaaaattaacagattgaagctgtactattacaagattacattatgtctctgttagagatagcaaccaataaaactggatagtrctaagtaatgctaagctattaacttttaaccttattatagttttatattctgtattttctaaatgtgtctgaatgtcttgttttactttaaaatattttg

SEQ ID NO: 22222 - DNA, 201 bp, Homo sapiens
acggagaccacctcatcgaccaagggctagatgttggcaacctcacccagcaaagggagctgcgaaagaaactgaagtgcaaaagtttcaaatggtacttrgagaatgtctttcctgacttaagggctcccattgtgagagctagtggtgtggtaagttcaagtggcaatttaaaatcttactccataaaaacaaaacaca

SEQ ID NO: 22223 - DNA, 201 bp, Homo sapiens; identical to SEQ ID NO: 3307

SEQ ID NO: 22224 - DNA, 201 bp, Homo sapiens
ctcatcaagaggcatataatataacataatatcaccagtattgttgatactaactttgttagttaagatgttgacagctaaacctttactttgggattaaraagtaatttgtggaatgacacattgatccatgaaaatattctgtttttcttacaatgttttacccaatggtttttagtatccattgatcatccttgctta

SEQ ID NO: 22225 - DNA, 201 bp, Homo sapiens
tactttggtcttcttagtctgaaaagtcaactcctcacacactttgtttaaataccagtgtgtgtgtgtgtgtgtgtgtgtgtgtgtgtgtgtgtgtgtgtattttaagttcatgccatttgtttggtaccagtgaccatgttctgaaatttttgatttcctcttgttacctgcaggataaatgtttttggagtgaaaata

SEQ ID NO: 22226 - DNA, 201 bp, Homo sapiens
atactttggtcttcttagtctgaaaagtcaactcctcacacactttgtttaaataccagtgtgtgtgtgtgtgtgtgtgtgtgtgtgtgtgtgtgtgtgtgtattttaagttcatgccatttgtttggtaccagtgaccatgttctgaaatttttgatttcctcttgttacctgcaggataaatgtttttggagtgaaaat

SEQ ID NO: 22227 - DNA, 201 bp, Homo sapiens
atgccataagtacatacacaagcagaatgggagaaaagaataaatcccatggcagttggcagacagccagttggaaaggcaatcataaaccacttgggaacattaaataagtcagaatgctatcttctagcatataatctagtaatgatagcaataactaccatttcataaattcctgtgccaggaaccctgctaggcttt

SEQ ID NO: 22228 - DNA, 201 bp, Homo sapiens
ttcaatcactgataccctttcttccacttgattaaatcggctattgaagcttgtgcatgcatcacgaagttctcttgccatggttttcagctccatcaggycatttcaggtcttctctacactgtttattctagttagccattcgtctagtgttttttcaaggtttttagcttccttttgatgggtttaaacatgctcctt

SEQ ID NO: 22229 - DNA, 201 bp, Homo sapiens
gtgggtaagccaacctttctatctggctgtccttaacatttttcccttcatttcaactttggtgaatctgaaaattatgtgtcttggagttgctcttctcmtggagtatctttgtggtgttctctgtatttcctgaatttgaatgttggctaggttggggacattctcctggataatatcctgaagtgtgttttccaactt

SEQ ID NO: 22230 - DNA, 201 bp, Homo sapiens
ttttttgaagggttttttgtgtctctatctccttcagttctgctctgatcttagttatttcttgccttctgctagcttttgaatgtgtaagctcttgcttstctagttcttttaatttgtgatgttagggtgtcaattttagatctttcctgctttcttttgtgggcatttagtgctataaatttccctctacacactgct

SEQ ID NO: 22231 - DNA, 201 bp, Homo sapiens
tttttattgcatctatttgattcttctctcttttcttattagtcttgttagcggtctatcaattttgttgatcttttcaaaaaactagctcctggattcaytgattttttgaagggttttttgtgtctctatctccttcagttctgctctgatcttagttatttcttgccttctgctagcttttgaatgtgtaagctcttg

SEQ ID NO: 22232 - DNA, 201 bp, Homo sapiens
taagcaatgcagtggtgccttttgaatagtgtgtatgtgttcatttgtgtgtgcacgtgcatgcatttgtgagcatttgtgtttgtgtgttagagcacagyactctttttcactcaaaagtcatgtaggagagcaggacataaaaaggaaaacttgttaaaagggttcagactaggctgtaacataatgaaggtgaaatat

SEQ ID NO: 22233 - DNA, 201 bp, Homo sapiens; identical to SEQ ID NO: 3308

SEQ ID NO: 22234 - DNA, 201 bp, Homo sapiens
gataggtgcagggtatgacacattcattgctcaactgagaaattcatctttgcccaacagaaaaataattttctaaatttctttgtaaaaagagagtccaycactaaacacaaagacagtgactaagggaataaaggtgtgggtccggcagtcaactcactgggtccagaatgaatccagtcctggcaccatcatttgcaa

SEQ ID NO: 22235 - DNA, 201 bp, Homo sapiens
tctttgcccaacagaaaaataattttctaaatttctttgtaaaaagagagtccatcactaaacacaaagacagtgactaagggaataaaggtgtgggtcckgcagtcaactcactgggtccagaatgaatccagtcctggcaccatcatttgcaaaagcgtgttaacgtctgcagattccttaacctttgggtaaatggta

SEQ ID NO: 22236 - DNA, 201 bp, Homo sapiens; identical to SEQ ID NO: 3309

SEQ ID NO: 22237 - DNA, 201 bp, Homo sapiens
aaattagagatcagcaaagacagcagacaaaaattttctctaggatgcctcgccaaacaaggagtttaaagataagaatctgagtccagaatctgacaggscttgatgctactgttccctaaaatttgccctttaggactcaaagaaaagggaagtaacaggcaagggtgagatccagagatccaaagacatgcagaaata

SEQ ID NO: 22238 - DNA, 201 bp, Homo sapiens
tgtggagcttaatttgggtagagaagaaagattataaacaaataagcaagtcaagtgtaaatacaaaatataatagctctcatttagggaacaggccacarttgatgactcctcagttagagtggctgagaaatcctctctgagaaggagactttgtaactcaggcctaaaacactaagtgtcagtcagccaagctctaaa

SEQ ID NO: 22239 - DNA, 201 bp, Homo sapiens
tgtaacataatgaaggtgaaatatggccaaaggacaatgaactgggcctttgaatacttttatttatcccactctccttataacaaagggaataacaaagwcaacaaagattagaggagaagaatggaaagcacaattctgctactagttcaaattctgctactagtttctttctaaaaagaaaacagctaaacagtgcct

SEQ ID NO: 22240 - DNA, 201 bp, Homo sapiens
aacctttctatctggctgtccttaacatttttcccttcatttcaactttggtgaatctgaaaattatgtgtcttggagttgctcttctcatggagtatctytgtggtgttctctgtatttcctgaatttgaatgttggctaggttggggacattctcctggataatatcctgaagtgtgttttccaacttggttccattct

SEQ ID NO: 22241 - DNA, 201 bp, Homo sapiens
gactcaaagaaaagggaagtaacaggcaagggtgagatccagagatccaaagacatgcagaaatagaagtcagatggcctattttggtcccagggtattakgaggctctctgaagttctgcaagaggctctctgaaagtctgcaatcatctacaaaataataaggggccaagcagtgatcggccttaccattagcaatgtc

SEQ ID NO: 22242 - DNA, 201 bp, Homo sapiens
tgcttcctttaggtgcctccgttccttttaacaacacaatgactattcttttctcaacatttttcttcctgctcagagccaaaactggggcctgagtaatstattctccaacatttctcccattagatcttctctgttgtatttcaattctttctgaacagttttttctctttagtaataatggttattattgagttattc

SEQ ID NO: 22243 - DNA, 201 bp, Homo sapiens
taagggtctgctggagccaactctcaccagctcgctggagccacttgtgcacacccttgccagctttgcatttaatcataccacattggtagctggaaacyggccatattgggagtatttataccacagaaattggaagatgttactggatcagggatacttttctgaaggtccagttgttccatttaccagaacattcct

SEQ ID NO: 22244 - DNA, 201 bp, Homo sapiens
agcattagagtaaattgaccgggtagacaatagtaggttgtaaacaactgaagaaaaatgtttcagaattaaaaacatggtttcattacctgaattggtayttattttagacactggcaatttctccaagagcagtttctatgaactgggggatgccaacctggtagcaacctgatgattcctcatgctagtagcaaagaa

SEQ ID NO: 22245 - DNA, 201 bp, Homo sapiens
aaacttcacttacaatacaaatgattcattaggtaaaggcatttagatagattttaccagaagcctatttttttcaaatatgtttatattagtacaaaacrataaatttcccacagacccagagcattagagtaaattgaccgggtagacaatagtaggttgtaaacaactgaagaaaaatgtttcagaattaaaaacatg

SEQ ID NO: 22246 - DNA, 201 bp, Homo sapiens
acacaatgactttgatctaacctgataatcaaagttaaacttcacttacaatacaaatgattcattaggtaaaggcatttagatagattttaccagaagcytatttttttcaaatatgtttatattagtacaaaacgataaatttcccacagacccagagcattagagtaaattgaccgggtagacaatagtaggttgtaa

SEQ ID NO: 22247 - DNA, 201 bp, Homo sapiens
tttggttcttcccaaaaatgagagtagaggaacgtgaacaaatggacatctatacttctttccctgattcaatcaaaacaagaactcatgttttacaaaaygggattctgtgaagatttatttacaaattaaaaaaaacttacattgaaagttaggaaagaaaaaattacattttactaatcctaaaatgatccacagcaa

SEQ ID NO: 22248 - DNA, 201 bp, Homo sapiens
ttaaaatacctctaaagcaggtcaccaacaggtcaggtgtgccttatagtacagctcctttgggcactttatacaatctattatacaatcattgattaacwtctgagaaagccttggcaacagcagtagtagagagtgtccaaaaagtaattgctttcctattgggtgggtgttctgtatgtatgtaaaagggtgtaattt

SEQ ID NO: 22249 - DNA, 201 bp, Homo sapiens
atagtgcctgatactcccttagccctgaataagtgttaaaaataacattcctggacagtttgtgtcacagtataaaggacaaataatactagttccaggakgcatctttgctgaacctaatctagctctgccaccatgatccagggatcgcatcacttaagccctatttgtgactccatcccagggcttccctgcatcagg

SEQ ID NO: 22250 - DNA, 201 bp, Homo sapiens
tctctgctcactgcaacctccgcctcctgggttcaagtgattctcctgcctaggcctcctgaatagctggggctacaggcacacacacacgcccggttgakttttgtatttttagtagagatggggtttcaccatgttggccaggatggccttgatctctcagcctcatgatcctaccacctcagcctcccaaagtgctga

SEQ ID NO: 22251 - DNA, 201 bp, Homo sapiens
cgtgatctctgctcactgcaacctccgcctcctgggttcaagtgattctcctgcctaggcctcctgaatagctggggctacaggcacacacacacgcccgrttgagttttgtatttttagtagagatggggtttcaccatgttggccaggatggccttgatctctcagcctcatgatcctaccacctcagcctcccaaagt

SEQ ID NO: 22252 - DNA, 201 bp, Homo sapiens
cacccaccccccccccagatttttaagttacaaatgaaacccatctgtaaacaatccagtattattgggacctatccttagaaaacagaaaatcctaacargtagcaatcaaggttggactaaaattttatattctttaacccgcctctccctatatcccctctctcctaccctttccaaatctagtgctctgtagcacta

SEQ ID NO: 22253 - DNA, 201 bp, Homo sapiens
gaaaaaggaagtagggaggccagttaggaggctactatagttgtccaagtaccagggaggtgccagggtaaatgggagaaatggtcagcttcatcatagaytgtgcacatggaacgtataggacttgccgtcagataagatgtgaagagagtaagaatgacaccaatcagaaacaaaccctaggactggtatctgaacaac

SEQ ID NO: 22254 - DNA, 201 bp, Homo sapiens
ttgcagtgacagttaagattcttgatgagagactgcattcagaaaaatttaatggcattccatgcttaatttcctttggaaagtaattatctataaatgaygtaaaaataggatactcaagaactagtttaaataggtaatttttgagctgaggtctgggtgaagaatattcccaagcaaatggaacaagaagtacaaatg

SEQ ID NO: 22255 - DNA, 201 bp, Homo sapiens
ttataatatttatgatcatcattaattatcacattactgacagtagctgtgttagtaagatggcaaatacattttgtgaggttccactgggcactgcttaygaagagtggcacaggcagggggtgaaagaatgccagcagtgaggcagtgtattctgcagggcatgggaaaaaacccaggccagttgcaacccacctgaat

SEQ ID NO: 22256 - DNA, 201 bp, Homo sapiens
agcctatgtgtgtctctgcacatgagatgggtctcctgaatacagcacactgatgcgtcttgactgtttatccaatttgccagactgtgtcttttaattarggcatttagcccatttacatttaagattgatattgttatgtttgaatttgatcctttcattatgatgttagctggttagtttgcccattaattgatgcag

SEQ ID NO: 22257 - DNA, 201 bp, Homo sapiens
ccctccttccttaccctctctagtagtccccagtgtctatcattgccatctttatgtctatgagtacccaatgcttagctcccacctataagtgagaacaygtgatatttggttttctggtcctgtgttaatttgctaaggataatgtcctccagctgcattcatgttgctgctaaggaaatgattttgttattttttatg

SEQ ID NO: 22258 - DNA, 201 bp, Homo sapiens
attctaaggtctgggagaaaagaataaaatcccaggcagagctcttcagctgtgtgctcaattctcctcctgatgttcctgagacatcagtgcttggggaktgaaggcccctgaaggctcacatgaaggcagtagttgaattgcaaatagaagttaagaaaatattctccttgaccttctgttcaaacctgtgaaggctga

SEQ ID NO: 22259 - DNA, 201 bp, Homo sapiens
cgaatccctgcttgtgccgcttcgttcatgtgtttcgttcctttgttagtgtgttttgttcaactctttgttcaaaatacccagaacctggacaactcacwctcacggccttccttccagtaacggctgagaggcagtacagtggagtgagtggcacagcgtcccctcagactgcccagagcaaacccaaggtgtctactg

SEQ ID NO: 22260 - DNA, 201 bp, Homo sapiens
catcactctggtctttaatggtcatcacaagagattctgagaattagaatcttattttggagatgttcccttttttgccttatgaaaaacatttcagagtytaaagtttgtccagttccaaaattgtcctctaattgttggaattgttggtaattatgcaaccaaatagaccaattttttagtacttcttggaaatccctc

SEQ ID NO: 22261 - DNA, 201 bp, Homo sapiens
ccttttactttgcagttcattgtgctctagccccaccaattctctcgttgggaaactttagtctcatcactctggtctttaatggtcatcacaagagattytgagaattagaatcttattttggagatgttcccttttttgccttatgaaaaacatttcagagtctaaagtttgtccagttccaaaattgtcctctaattg

SEQ ID NO: 22262 - DNA, 201 bp, Homo sapiens
atccaaaaaggctcagaaagaataagacccttagattgaatcatcaagctctatcccttaccttacctaaaaagtttccttagttattaacctttaaagcrgttgaaacgtattttttcaaggtaatatctagcttctcttagtagcacataacttccttatattatgccatacttccatgcttcctacatgttaatgttc

SEQ ID NO: 22263 - DNA, 201 bp, Homo sapiens
gagattctgagaattagaatcttattttggagatgttcccttttttgccttatgaaaaacatttcagagtctaaagtttgtccagttccaaaattgtcctytaattgttggaattgttggtaattatgcaaccaaatagaccaattttttagtacttcttggaaatccctcaatttatattctttcttctttttttctaat

SEQ ID NO: 22264 - DNA, 201 bp, Homo sapiens
tagatacctgatcactacatgaagatagtgaatcaaaatgtgttattttaattctctgtcacttgaacatttaggacatgctcctatcagctgtcaatttwttttttttaatattagcctcaaataataagaataaattaactttatcttgagctcaagttcttaaactcaccaatcaatgatttgtgagtcattcttttg

SEQ ID NO: 22265 - DNA, 201 bp, Homo sapiens
ctagaaattttgcctataaaatttgcttgaaataaaatgcttttttgacagttaaagttccatatttaatctttttttaattaaaagctaatcctttcagytcttgctcctaatgattgaagtttgtttctgtcagcaacaatcaacacacatacacacacacacacacacacacacacacacgtacacacaggttttgct

SEQ ID NO: 22266 - DNA, 201 bp, Homo sapiens
tgaagacaccagacctgctgggtaagacctatttctcttctctttcctcaaccccaagtgctttggctgttatgtaaagaggatttattgctagataattytgtgtgatttttggtcacctagagaattaaagaaacattaatcattggatatcattcaaatatttcaccagctacagagacaaaaattctcttattagca

SEQ ID NO: 22267 - DNA, 201 bp, Homo sapiens
gggctatccccaaagtaagcacctttgcttcctttaggtgcctccgttccttttaacaacacaatgactattcttttctcaacatttttcttcctgctcaragccaaaactggggcctgagtaatgtattctccaacatttctcccattagatcttctctgttgtatttcaattctttctgaacagttttttctctttagt

SEQ ID NO: 22268 - DNA, 201 bp, Homo sapiens; identical to SEQ ID NO: 3313

SEQ ID NO: 22269 - DNA, 201 bp, Homo sapiens
tctgttgtatttcaattctttctgaacagttttttctctttagtaataatggttattattgagttattcagaaagattaggaattattagcatatatgccrctaattttattttgcatagtgttaggaaatccataaacatgcagtgtagtgaataacttacatcttaccttctccctgtgccaaagtcaggagggaggga

SEQ ID NO: 22270 - DNA, 201 bp, Homo sapiens
tgctggagccaactctcaccagctcgctggagccacttgtgcacacccttgccagctttgcatttaatcataccacattggtagctggaaactggccataktgggagtatttataccacagaaattggaagatgttactggatcagggatacttttctgaaggtccagttgttccatttaccagaacattcctggtctact

SEQ ID NO: 22271 - DNA, 201 bp, Homo sapiens
tgtgaattgtaaacctgaagccaaggccactcttttttaattaggaaagaaaggagtcaaagggaagtgaagaagtgttaaaactcattaaaagaaataamtttcacttactaacaaagaggaaataaagtcataaattgtaaaaacaaaaccacaattatttcacattatatgaaaggaaagtattaaataatgcatttt

SEQ ID NO: 22272 - DNA, 201 bp, Homo sapiens
tcagtaatttctaagaaaaaggaaaaaaaaatcttcaggtcaaatgagggagggacatgtaagggacagaaaagttttatctttccttccaatgcttttcrgttcttggaaggattatacaaaatagacacaaatagttaaacagggggttcccaaacactgtcctgaccaatgttacttgtgctgtctcagggttccatg

SEQ ID NO: 22273 - DNA, 201 bp, Homo sapiens
tatatgaagaaaagtattaggttggtgtaaaagtaccttccatggcaaaaacctcaattaaatagtttcctcagtaatttctaagaaaaaggaaaaaaaartcttcaggtcaaatgagggagggacatgtaagggacagaaaagttttatctttccttccaatgcttttcggttcttggaaggattatacaaaatagacac

SEQ ID NO: 22274 - DNA, 201 bp, Homo sapiens
gaccagaagaccggaagaccggccctcctctatcagggatggtcgtcctcttccacagagcgcgcagctttcgggagggacgcacatggagcggtgagggrggaaggagacagccgcctagccagctagatcagccgaatcaaccctggcaatcaatgggctgacagatgttgcagccagatcgccctcacatccagtgtt

SEQ ID NO: 22275 - DNA, 201 bp, Homo sapiens
ggagagtctctgccttggactggccaagcagggaccttcccttcatctgcacagggcgccaattcaccgcagcctttcattagccaaccaaatcctccatycagataaggggcagctggtagggacctcgaaaggagtacttgaaacccagaaaacttggtaacccggcccttgaaccgtttgctccggcccactcccacc

SEQ ID NO: 22276 - DNA, 201 bp, Homo sapiens
ctctttttaccttgcaaaaataaaactccatacccattaatcagtaacctcccattccccactcctgtctcctataactcttttcattacctcctagcctygctggtttgtccactttaatttctttcatccctattgtgtgaagtaatttttcctcttcatcattcctaaggccaaacttgtcatctcagtctgtctgct

SEQ ID NO: 22277 - DNA, 201 bp, Homo sapiens
tgtataaaatacatagaatataaaaatgtaccatcttaaccatttttaagtgtgcaggcccatagtgttacatacgttcacattggtgtgcaatctccacractctttttaccttgcaaaaataaaactccatacccattaatcagtaacctcccattccccactcctgtctcctataactcttttcattacctcctagcc

SEQ ID NO: 22278 - DNA, 201 bp, Homo sapiens
ttaaaaattgtataaaatacatagaatataaaaatgtaccatcttaaccatttttaagtgtgcaggcccatagtgttacatacgttcacattggtgtgcartctccacaactctttttaccttgcaaaaataaaactccatacccattaatcagtaacctcccattccccactcctgtctcctataactcttttcattacc

SEQ ID NO: 22279 - DNA, 201 bp, Homo sapiens
ctctggagcaatgtagatgctactgaggtttcaatggagagagagagagagagtgttacttcacacaactaacagggaaataaaagagttcttaatactayttctggcctccaagtttcttttcctttttttttttcctcctctaagtctttttaaaaattgtataaaatacatagaatataaaaatgtaccatcttaacc

SEQ ID NO: 22280 - DNA, 201 bp, Homo sapiens
gtctcaaaaaaaaaaaatgtatatatatatatatatacacatacacaaacacatatatacatatatatgcatatgtatctacatgtatataaaaacagtamataaataataaatttataaatttgacaaattgctataaagtttcaaaatatttgttctcaatttctattgctatcaccctgtagacagcagggtctgtgg

SEQ ID NO: 22281 - DNA, 201 bp, Homo sapiens
gaggttgcagtgagccaagatcacaccactgcactccagcctgggcaacaagagcaaaattctgtctcaaaaaaaaaaaatgtatatatatatatatatayacatacacaaacacatatatacatatatatgcatatgtatctacatgtatataaaaacagtacataaataataaatttataaatttgacaaattgctata

SEQ ID NO: 22282 - DNA, 201 bp, Homo sapiens
tttattgacctacccctttgtaaattataatcaatattaattacccaaaaaggaaagtagatatataaaacacaaacccatttttattacatacaaaatayatatggctgggtggtggctcactcctgtaatcccaacactttgggaggccaaggcaggcagatcacctgaagtcaggagttcgagaccagcctgcccaac

SEQ ID NO: 22283 - DNA, 201 bp, Homo sapiens
tttcaagatttcgtaatgttttaattctataatcctcacccctctcttctctgacccatgtctattcttcctatggttctttctgccttccccaaaggccrtatgccttcttttcctctcccctttttagtgtgcaggtgttggtgagtgaatgagaagtgaatctattttatgagtattctaaaaacaacatcaaacatt

SEQ ID NO: 22284 - DNA, 201 bp, Homo sapiens
gcccgcctcggcctcccaaagtgctgggattacaggcctcaaaatgtttttttaaattcgggaactaattaagtttcatactctgcatttgatactttggkcttcttagtctgaaaagtcaactcctcacacactttgtttaaataccagtgtgtgtgtgtgtgtgtgtgtgtgtgtgtgtgtgtgtgtgtgtattttaag

SEQ ID NO: 22285 - DNA, 201 bp, Homo sapiens
ggcaggtccagattctgtgggacctgaagcttattcagttttcagggtcctgtctaagaaaaactttcttagaaagttttctggaagccattccaacctasgatagctgtcaatagcttgattacacacagaaatgactgtaagtcacataaacatagctcataaagcccccggaaaactgttcctttagctggatccctc

SEQ ID NO: 22286 - DNA, 201 bp, Homo sapiens
attcccaaatggaacccatttttcagaaaagtttagaaaatagcaaagacttggcaatgctaatggaacagcttacccttgagctgtgaccacagcaacawgggaagtttctttagcttcagagtttctgccataatcacactgagctcaagaagctgtgggatgatagagaaaaactggctgaaaaacataaaatgtggc

SEQ ID NO: 22287 - DNA, 201 bp, Homo sapiens
aaatcccatggcagttggcagacagccagttggaaaggcaatcataaaccacttgggaacattaaataagtcagaatgctatcttctagcatataatctastaatgatagcaataactaccatttcataaattcctgtgccaggaaccctgctaggctttgtatgtacattatcactaggctacaaaactctattgaataa

SEQ ID NO: 22288 - DNA, 201 bp, Homo sapiens
tataaaagagagccaggcagaggtttcacccagagagacacagaggagaaagtgatgtgaagacagagagagagatttgagtgattcaacaagtcaaagaytgccagcagaagctgaaagaggcaaggaacagaatgtcccctacaacatatggagggactgaggtcctactgacatcttggttttagaattctggacccc

SEQ ID NO: 22289 - DNA, 201 bp, Homo sapiens
cagacctcaattttttgtattttttagtagagatggggtttctccatgttcgtcaggctggtctcgaactcctgacctcagatgatccacccaccttggcytcccaaagcactggcattacaggcatgagctacctcacccagcctatttcttgccttaactcattaagcccttgtgtcaggctaaaagacatggttctcc

SEQ ID NO: 22290 - DNA, 201 bp, Homo sapiens
tcacgctgggagctgcagatcggagctgttcctatttggccatcttggaacagacctcaattttttgtattttttagtagagatggggtttctccatgttsgtcaggctggtctcgaactcctgacctcagatgatccacccaccttggcctcccaaagcactggcattacaggcatgagctacctcacccagcctatttc

SEQ ID NO: 22291 - DNA, 201 bp, Homo sapiens
aggcctttcatccttcaggcatattatttcatctgatccttgtggccatgccagattagcaaagtgttacctctctttattaacagatgaggggggaaaawagagcaaatggtaaagtaatttgcccaaggcctcacagctcacaagtgccaatgttgggacccaacctctagttttctgactcttcctcactcagtaata

SEQ ID NO: 22292 - DNA, 201 bp, Homo sapiens
aatatatagaagatattaaaatctgatttaaggcaaatacattctgtttaacactataatctattcattaatttgtgtttatcccttattttatatttttsttattgttttggttcttaattttaatgttttggctttcaagagaggaaagcctattttatttacaagaatgttttacgtcagtatgtaaaatacaacttc

SEQ ID NO: 22293 - DNA, 201 bp, Homo sapiens
tgcacagctgttcgagaaatctgaaaaccctaagttgcactgttaacccatcatcttgttagccctgcccaggatgtcaaagggggaaaggaaatcaacayttttctgcattaaatggtgacttaaagaaagctacctccatatttgaccctgtaaatccattaaaaacctgggggcctgccagaaagtgcctttatgctt

SEQ ID NO: 22294 - DNA, 201 bp, Homo sapiens
agagtaaccagcattttatctgaaaacccaaattctattcttgatgaccattgagtctttctcaattggatgctgagaggcaaaagtataaattatgcagscttcgacttccacaaagccccagctcccttttagtctttgttgctcatttttagcttctgcctcttgtggtttgcttgggtaataaaaagtaaagaaatg

SEQ ID NO: 22295 - DNA, 201 bp, Homo sapiens
acttaagacaagaaaataattacttttcttgccacctttgctcatttgttatttagcattccaggcaagggttaattaaaagcttctgtgtgttggctctrtggctgatcacaggccaaaattaacagattgaagctgtactattacaagattacattatgtctctgttagagatagcaaccaataaaactggatagtgct

SEQ ID NO: 22296 - DNA, 201 bp, Homo sapiens
gtaaatccattaaaaacctgggggcctgccagaaagtgcctttatgcttggctctgtattagctttcgtgactttcctataatgaattgtagcttgcttgrgtcattaagaagattctgacagggaatcagctggaatctgctgttctttgaaggactcaatttatctatgattcagtgcttaagcagtcaaaaggcttga

SEQ ID NO: 22297 - DNA, 201 bp, Homo sapiens
aatctgaaaaccctaagttgcactgttaacccatcatcttgttagccctgcccaggatgtcaaagggggaaaggaaatcaacatttttctgcattaaatgstgacttaaagaaagctacctccatatttgaccctgtaaatccattaaaaacctgggggcctgccagaaagtgcctttatgcttggctctgtattagcttt

SEQ ID NO: 22298 - DNA, 201 bp, Homo sapiens
ggacacaaatagtgtccctggcaacaaagacttcagctcctcccagctcaggaggctttcccaggacatgtcatatagattcggctctgcacagctgttckagaaatctgaaaaccctaagttgcactgttaacccatcatcttgttagccctgcccaggatgtcaaagggggaaaggaaatcaacatttttctgcattaa

SEQ ID NO: 22299 - DNA, 201 bp, Homo sapiens
aggcatcatagaacaggaaggacacaaatagtgtccctggcaacaaagacttcagctcctcccagctcaggaggctttcccaggacatgtcatatagattyggctctgcacagctgttcgagaaatctgaaaaccctaagttgcactgttaacccatcatcttgttagccctgcccaggatgtcaaagggggaaaggaaat

SEQ ID NO: 22300 - DNA, 201 bp, Homo sapiens
tgttcattgattaactcaacagatatctattgagtatccgtagatctgggagtatttcagacttggattacagggtgatgaatgaagtagacttggttccytccttgtggagcttaatttgggtagagaagaaagattataaacaaataagcaagtcaagtgtaaatacaaaatataatagctctcatttagggaacaggc

SEQ ID NO: 22301 - DNA, 201 bp, Homo sapiens
ggctgagaattaaatataggtaaacttgaggaaggctaccaagtggtcatgttcattgattaactcaacagatatctattgagtatccgtagatctgggastatttcagacttggattacagggtgatgaatgaagtagacttggttccttccttgtggagcttaatttgggtagagaagaaagattataaacaaataagc

SEQ ID NO: 22302 - DNA, 201 bp, Homo sapiens
ctgagtttaattttctcataactggaccccatatttgaagctcttctcatttcattggtttgctaacaaatgtcttctctttgtagaggaaattttaagtragcaacaaatacatcacaccaaaattggcattgcagtgacagttaagattcttgatgagagactgcattcagaaaaatttaatggcattccatgcttaat

SEQ ID NO: 22303 - DNA, 201 bp, Homo sapiens
atccatgaaaatattctgtttttcttacaatgttttacccaatggtttttagtatccattgatcatccttgcttaaatcaattattacactgaggactgamaatttgcttttctataattcattcttttttatttagctggcattcatgtgtaaggagaaaatctctatctctccctctcctgctttctaactcttcctcc

SEQ ID NO: 22304 - DNA, 201 bp, Homo sapiens
gactattgttgaagtggtgaatgtttatgctggtggcttatatttctaagcctgagtcctgtcactttgatgactttacatttaccatggcaaccacagcygcagctggctaagaactttggagtagaagtgatgagtgtgacttaaattttctgaatcagtagccaggtgattttgactgaatgtcatggatagtctacc

SEQ ID NO: 22305 - DNA, 201 bp, Homo sapiens
gcagttcatttcattgcacgtgatatttgctcattgcctatcaatcaggagcggtgcgccatgccaggcagttgaggcctttcatccttcaggcatattayttcatctgatccttgtggccatgccagattagcaaagtgttacctctctttattaacagatgaggggggaaaaaagagcaaatggtaaagtaatttgccc

SEQ ID NO: 22306 - DNA, 201 bp, Homo sapiens
agagatttgagtgattcaacaagtcaaagactgccagcagaagctgaaagaggcaaggaacagaatgtcccctacaacatatggagggactgaggtcctaytgacatcttggttttagaattctggaccccagaaatgtgacagaatatgttaccaagtttgtggtaatttgtcatggcagtcagaagaaactaatataaa

SEQ ID NO: 22307 - DNA, 201 bp, Homo sapiens
tctccctcagttcatataagatttggttggttaaaagtgtcagagacctcaccttactgtctcttgcttgctctgtcatgtaacatgcctgctcccacttygtcttctgccatgggtaaaagctccctgaggcctcaccaagagctgagcagatggcagagccatgcttcctgtacagcctgcagaaccgtgagccaatta

SEQ ID NO: 22308 - DNA, 201 bp, Homo sapiens
ctcatactcaaagctctgcctccttctagcattttttaaagaatgtaatctatggaatgagctacttattttctaatatcacattgctgtttgttagctgygcaaccatagaaaagttacctagggtctttgttctttagtttccttgtctcttaagtgggaataaaaattagttctatactgcagggttgttgtaaagac

SEQ ID NO: 22309 - DNA, 201 bp, Homo sapiens
aagtggaggcttcctattacttcttcagaatataagcctgcagcacaagcattaagccagccacaggaagagctgcagggggcttaaactttccctgttgwagtgaccacttaaacagacacaagtaagccagccccaacagaaagccaagcccagaccgtgcaccgaagcgtgttttccccaaacttacccctcaatcag

SEQ ID NO: 22310 - DNA, 201 bp, Homo sapiens
tgtttgaagatagaatatttctgcatgatccacaaatacaggagcttacataatatttatctctgcttcagtacagagagcaattgcagcatgctttcctycctttaagccccgagattattctaccttcatgtctttctattcaccttcctctctgaagttcaggggtgggactgtgggggcattgaatccttctgtgcc

SEQ ID NO: 22311 - DNA, 201 bp, Homo sapiens
tgtttctatgccttgaaagtctgtgatggttcctatccaaggcaggtggtgtaaatattcatctcaaatccaaatgaagcctggtgtaaagtttcagattmtcagggacaatccagcttccttgttttctccctttgctaatgggcaaattgtttttcccagtgcagcattcaactgaagatctgtttttccgctgttatg

SEQ ID NO: 22312 - DNA, 201 bp, Homo sapiens
tgccttgaaagtctgtgatggttcctatccaaggcaggtggtgtaaatattcatctcaaatccaaatgaagcctggtgtaaagtttcagattctcagggabaatccagcttccttgttttctccctttgctaatgggcaaattgtttttcccagtgcagcattcaactgaagatctgtttttccgctgttatgtggaagac

SEQ ID NO: 22313 - DNA, 201 bp, Homo sapiens
ctctttgttaggcatcatagaacaggaaggacacaaatagtgtccctggcaacaaagacttcagctcctcccagctcaggaggctttcccaggacatgtcmtatagattcggctctgcacagctgttcgagaaatctgaaaaccctaagttgcactgttaacccatcatcttgttagccctgcccaggatgtcaaaggggg

SEQ ID NO: 22314 - DNA, 201 bp, Homo sapiens
gcagtgagccaagatcacaccactgcactccagcctgggcaacaagagcaaaattctgtctcaaaaaaaaaaaatgtatatatatatatatatatatatayacatacacaaacacatatatacatatatatgcatatgtatctacatgtatataaaaacagtaaataaataataaatttataaatttgacaaattgctata

SEQ ID NO: 22315 - DNA, 201 bp, Homo sapiens
cattacattttagtcagtgttactaggaggaaggcagatacaggagaagctttatccacattagaaagaagagtctcttcattgtgatgtcggctacaacyaggtcgttttccatctcttagccatcagcaaacagctatcagccatgcactgcttataccaagcactgtgccattcacgcttctcaccctggtgataatc

SEQ ID NO: 22316 - DNA, 201 bp, Homo sapiens
cgttttccatctcttagccatcagcaaacagctatcagccatgcactgcttataccaagcactgtgccattcacgcttctcaccctggtgataatcacagycttgaggagaatgcagacatactcaaagatgaggaaactgaggccctgggatgctagattgcctgtggtcacaaagctagtcattgtagagaaatgatta

SEQ ID NO: 22317 - DNA, 201 bp, Homo sapiens
taactgtaagaatacaggagggctagcttaaaattagctggagtagcatcctactgcaacctttaaattttaagagttttggagaatatcttcctttttgrcctattcatttccccaaaatccactgttatagatgaattcacacataactgtcatatcacaactgctcattgatacagaatgaaccaaaaaatgtaaaaa

SEQ ID NO: 22318 - DNA, 201 bp, Homo sapiens
ctcttgcacacattctaattcaatgttgctcagaatccaactgtggcttccttccacctggaccatgaggtagctgtgacctctaaattgcaattactctyagtgtacacaggcatcctagttactgaaacactgtttattctgtgttcttcattaactgaatccttgaacgtctgtttttccttcctagtgaaattataa

SEQ ID NO: 22319 - DNA, 201 bp, Homo sapiens
cctatgcagggcagttctacttggagaagtctgtcttttggcctgaagctatagttaagatggaactccaaaaatgaacttattttaagagtgcacttccygaatctgaatttagagaaaaatgactcaaaggaatttttgctgccagcatttagtttttaaagtacaataagaattctggcgtgcttgtctaccactgct

SEQ ID NO: 22320 - DNA, 201 bp, Homo sapiens
gactcaaaggaatttttgctgccagcatttagtttttaaagtacaataagaattctggcgtgcttgtctaccactgctgtgtcctcataacgttactcaaytgcttaatttaatgctttgctttccctacaaaactctggcaagcccctcaataaagcaattaaaatggtctttattctcttagcccagagccaggactgt

SEQ ID NO: 22321 - DNA, 201 bp, Homo sapiens
ctttaaagttaaattaaatttaaatttttaatttttacatgggacacaaatcttaattgatgaaatgaacgtgattttgtgactaatagtgattggagaayattaattaaaattgattggagaagctatgagatctccttgagaaaccaattggaggcagggaaaaaaaaacctcatgagatgaattcaaaaggatttact

SEQ ID NO: 22322 - DNA, 201 bp, Homo sapiens
aggaaagcatttcctatatagcactaagcaaaggtgattctttaaaacttggccataaccacagccctgcagtgaacaaatctctctgggctgctactgcraagtatggcatcagagcatggtcattgacttcaaggcgtatacagcaaaatgtgatgccgaaacacaggggactgttgggaaaaaggagataaaaagcta

SEQ ID NO: 22323 - DNA, 201 bp, Homo sapiens
tctttaaaacttggccataaccacagccctgcagtgaacaaatctctctgggctgctactgcaaagtatggcatcagagcatggtcattgacttcaaggcrtatacagcaaaatgtgatgccgaaacacaggggactgttgggaaaaaggagataaaaagctaaacctgtcctgggagagaacaaaaatgtttgagctgca

SEQ ID NO: 22324 - DNA, 201 bp, Homo sapiens
gaaacacaggggactgttgggaaaaaggagataaaaagctaaacctgtcctgggagagaacaaaaatgtttgagctgcaacctgaaagagtagagagtcasagaaatggagaaagcagtaaaaaggatgatccattgagaaatcgagggaaatctgacatgggttgcaggagagcaatgaggacgtaaatgaggccacaga

SEQ ID NO: 22325 - DNA, 201 bp, Homo sapiens
gtagttgaattgcaaatagaagttaagaaaatattctccttgaccttctgttcaaacctgtgaaggctgagacttgacccacatagtacatcttgactgtytcggaataaaatgaaaaattcatagaaatgagagaatgttatcattccctcaatcttatgatttaaaaccttctctatttgataggctacattcaaatca

SEQ ID NO: 22326 - DNA, 201 bp, Homo sapiens
ttagcctcaaaaaagttacaaacctagaaatatctggcattcaaattagactttagcagcaatttctcctcccatgatataggcagaaattaaggaaaaaytgaaataaaggaaacttgcttgaattaggttggtgtaggataacttgaaatggtttttacaacctatgccaactagatgacatagtgtctgcccagaata

SEQ ID NO: 22327 - DNA, 201 bp, Homo sapiens
caggtctctgtaaatgtcagagtgccttgacatgtcagtcaccccaaatcaaggcacaccctgaaactttgtattggaaatctcaggcatctcttttgggkccctctttcccatcctgtaatattgcttttaccaggcactaatatgatctgtaccatataatcttccacagaatttcttcattgtaattctttaaacaca

SEQ ID NO: 22328 - DNA, 201 bp, Homo sapiens
gcactggtggagcaaatcatatattgaaatttcataaaattttggcatctccagtttcaggaaagtgctcactgcccctctgaaatcctagctagctggcyagcattctctcccattgcccatagtatctgtccaaaatattctccattctcctcaagcccctagcctattacattaacagataacccttcctccagtatg

SEQ ID NO: 22329 - DNA, 201 bp, Homo sapiens
cctatcaattactgatttttttttcaactctcagctctatctgtacctactctgatgctcataaatatgattctgtccatgtctactcaacagaggaaggragaacagggatgacaaattttcctggtatcccacctatctaccctcctatttctttcttttctaggttttctcccaaaattgtccacaaaatactatcct

SEQ ID NO: 22330 - DNA, 201 bp, Homo sapiens
cataaacatcgtacaaatgctttgttttacgtggagcctcagagacataagtctaagcatctatggacgttaaaagtcatctggagctctgttcagttagytgtctcagttgtaactctgctaccatgttggaatgatctaactatggctccttggagatgggcacttagaagtagtggagtttagatgtcctctacaatt

SEQ ID NO: 22331 - DNA, 201 bp, Homo sapiens
ataaaattatgacccaaggaataaaattcagtgatgatggtaatgtcatagtttttggcatttgactttggggagcacttctgatactatccggacttacytaattcaagtatttcctggtttatctttactctgatgtagactatctaaaagataatttggataaatacatgtcccagtttccaaaagttcggattcttc

SEQ ID NO: 22332 - DNA, 201 bp, Homo sapiens
tggaatagattctaataccttcttttctatgttatttatgttttagatcctagccaatctcaataaattgatttagtgattgattcactaagggaatctayagctctcagtttgaaaaaccccagctaggtgtatcttaattgcttgccactgcctagtagagtgatgcttcccaaactatctgaaaaggaatttttttcc

SEQ ID NO: 22333 - DNA, 201 bp, Homo sapiens
cacacaagattttttgtgaagtctgggctggaatatatatataatacttacaatagtgcctgatactcccttagccctgaataagtgttaaaaataacatwcctggacagtttgtgtcacagtataaaggacaaataatactagttccaggatgcatctttgctgaacctaatctagctctgccaccatgatccagggatc

SEQ ID NO: 22334 - DNA, 201 bp, Homo sapiens
acatggatcaattatttttaaataaaaaggaaaattctgaaaacaactaataatgaaatgaagaataacaattccaaaacacttcagagatgatgtctatrtgaagaaaagtattaggttggtgtaaaagtaccttccatggcaaaaacctcaattaaatagtttcctcagtaatttctaagaaaaaggaaaaaaaaatct

SEQ ID NO: 22335 - DNA, 201 bp, Homo sapiens
gagaagttctggagtagaaccacctgttcggctctgtggaaaccagaattttccaaatttgtttgaagatagaatatttctgcatgatccacaaatacagragcttacataatatttatctctgcttcagtacagagagcaattgcagcatgctttccttcctttaagccccgagattattctaccttcatgtctttctat

SEQ ID NO: 22336 - DNA, 201 bp, Homo sapiens
ttggtccaaggaccacccttccaatggcaaggtccaacacaatgactttgatctaacctgataatcaaagttaaacttcacttacaatacaaatgattcawtaggtaaaggcatttagatagattttaccagaagcctatttttttcaaatatgtttatattagtacaaaacgataaatttcccacagacccagagcatta

SEQ ID NO: 22337 - DNA, 201 bp, Homo sapiens
tcatgctattgctactaggtctcccattatatgtaagtcttaaacaacaagagaagtataaaatgagacttccttacaaatccttgacaatactcaagcaycgtatttccaaaatcctgcaagggtgacaatacttttgtagcagcaatctttaaaataaattattatgaaagtcacccctgtttgataactttttaaagt

SEQ ID NO: 22338 - DNA, 201 bp, Homo sapiens
gttgactttttcctaatctggattttggacatcagttattatgaattgtcagagattatggtaaggagctcataaataaaatacatcacttccagaatttkgtaatccaaactcacaaagacacctactttaaaaattaattaactttttgttacggtatgtattctttctttaccatcaatgaagtagttatcatctatc

SEQ ID NO: 22339 - DNA, 201 bp, Homo sapiens
aatttaaacttttgttcagttgagatgattgtgaaactaggtatctttcattctgactcctagtttaacatttaattttgactcccaatgagttacgtaaragcaaaactataactaagaatgggaaaaagaactatttctgcacatttgtaacatatttaagatgttttcttcatataattgaaaactgcagatgagtaa

SEQ ID NO: 22340 - DNA, 201 bp, Homo sapiens
actaagaatgggaaaaagaactatttctgcacatttgtaacatatttaagatgttttcttcatataattgaaaactgcagatgagtaagagaatgactagraaatgagatacagttatatgacacataatgatgttttagtcaacaatgaaccacatatttgacattggtcccaaaagattatattaataatatggtatct

SEQ ID NO: 22341 - DNA, 201 bp, Homo sapiens
tctgaaggaggttgtcccaactgtaggaaaaattgacacatgtgcttgagaggatgagtcagagagcatgtggccaggcctcctccctcttatcacataayccaccttggctaaatataggtgtgtctcaagctgcctggcggatgctacgctccactcaggggtctaccaccagggatcctggacctggggcctcccaaa

SEQ ID NO: 22342 - DNA, 201 bp, Homo sapiens
aagagcacaaattattcactttagtacataataacaaggttcttttcctaaaagtatccagacagagattagagcaaaagcaagaggatttgtcagatctkccaggagccatgagcaagaatccagccaatcaccaccttctttgttgcttgccagttccctggcagagttaaaggcatccttttgatttacataaacaaa

SEQ ID NO: 22343 - DNA, 201 bp, Homo sapiens
cggaacatctgtcatgatgtgcggttgaatccgatctggagagagagctttagggaaactgagtgagtagatccttgataagatacctgctcttgccttcragtcctatagttccaactcctactctaagagcacaaattattcactttagtacataataacaaggttcttttcctaaaagtatccagacagagattagag

SEQ ID NO: 22344 - DNA, 201 bp, Homo sapiens
aaaatatttattgttcaacagttaataagttatcaatttaaactctaggtagaagtctttaattttaaatctgatcattaaaatttactatttcactcttyggattcattctttatcaattcaatttatttacttaatgatcactttattgattgtaatctctcctttaatatttatataagatatatatataagatatag

SEQ ID NO: 22345 - DNA, 201 bp, Homo sapiens
tgcacaaacaggctacacagccaaattaatttcaaaaacactgcattaaatacagttaaataagcatcttcagaatttttacaagcctttgaaatgctaasgagtattgtaaatctgtaagaaagtcaacaacctaacttcatttgtctatggaactctgttgtggactactgtatttagtgagactggtgttccctgaga

SEQ ID NO: 22346 - DNA, 201 bp, Homo sapiens
cacatgaaatccataggttgtatagaatgagggtaacagaacttttatgttatctgtttgaaagaatgaaaggagcactgtaatcctgaattcaaattggmgtcttgtaaacaactaaataatagtatgtgatactatggaaatataatatatgacccggaaggattaaagaagttgtcattagaatatgtgggatttatg

SEQ ID NO: 22347 - DNA, 201 bp, Homo sapiens
ggaaatataatatatgacccggaaggattaaagaagttgtcattagaatatgtgggatttatgttacacataaataagcagtcatctaagaggactaacayggagtttttcacaaaatgaaaaagaaagaaacaaagggttgaatagtacaatgaagactgtattacattcagacaataaggaattgtctttttatttgca

SEQ ID NO: 22348 - DNA, 201 bp, Homo sapiens
cacattggtttgagtgaagctccacaagtacaattttaagcatcttgatttgggctgaggtccagtaaattatatattcccaacaactatcagagctctcycactaaaaatacatgctcacgctctactttgaaaatattctaagataattatttccattttcatagtaactagtacagttatgactagcattctctcagg

SEQ ID NO: 22349 - DNA, 201 bp, Homo sapiens
gaagaaagataccaaaagaaataccagaatcatttcaaatagtcccctcaaatagtctcatttgatgactacctttccaagcattgctacatttatagccraattatgccagattcccccaggggactgactgcttagtgcttatcacacaatgctatattagtgaagttttaaaagataaatgcccaagaatttatttaa

SEQ ID NO: 22350 - DNA, 201 bp, Homo sapiens
aaccaatagtctcttcaatattttgcctgttaaagtcctaacaaagctaaattggttaggtttagcaagctgacttcaatttgacataagatgtgtatggytgcaagagaggaaagaaatgattaattaatagattttatcctacactttatttgggaactgtttaaatgtaggtgtcttagaaaaatctaaaggattttg

SEQ ID NO: 22351 - DNA, 201 bp, Homo sapiens
tcaggcttcgggagacagaaagttgtctggggtcacagctgtcaaatagaccagcctggatttcaccagaggcagaggtttagtccttatactatgcgtastagaataaagggctacatttttggggtgtccagctcatttcgataatagtttatcaaaaaaatccagggtaaatttataagtcaaaacaagaaaattaag

SEQ ID NO: 22352 - DNA, 201 bp, Homo sapiens
ctcaaatggccaaccatcaccattatgttacctgaggtcacttaactctgtggctttcaactctgtggctttcaactctgtggctttcgtgtaagatggcrgtatagggccatggacaccaatgccaaagaatagtttcagggtttttttgcaaaaacattgtgtcatccatgaacatgaagcatttaccaactaaacata

SEQ ID NO: 22353 - DNA, 201 bp, Homo sapiens
aaccttggcccagactccttcacaaagcccccggtgttcaactattctcagtccaggagcccagcagtgctcccagtggagtttatgaagccgattcagasccagcaaatccaaagttttcttcccttaagcagactgacagccttacttacagaattcacttgtaatttatgacaaaaactgcactagaacttatcacaa

SEQ ID NO: 22354 - DNA, 201 bp, Homo sapiens
tttgcctttgcaaccttgggcaaaaaatacatcaaaacattctgtgtcttttaaaacagggaaacagtaaatggcttaccttctttggattttctgcacayctcttgacactccgcgttactctctgcacagattcgctctccaaagtgcttgctgcaggctggctttttgtctttcttgatctcaggcacatggagtctg

SEQ ID NO: 22355 - DNA, 201 bp, Homo sapiens
gcgtaatcagtttgtaatccagattttctacaatactgtaggacattttctttttgtgattttacatccaactctttcttcactgactcataaagcttccwaaagggagattcattttttttgctattgtcaagacattgtgtagtgggaacagacttcaattctccataacggctcactaatttaacgctggaaatttct

SEQ ID NO: 22356 - DNA, 201 bp, Homo sapiens
ctgctttcctgagacttctcttgggctgtggcttggagcttgttggggtgtccactaggtctggctgtgaagctctgtaggatactttggtagttttttcrttagtcattgattccttagtgtgacttggtgtctggaagagctcgatgaagccggccaggtcttcagggacttcagactttcccttaggagttctcagct

SEQ ID NO: 22357 - DNA, 201 bp, Homo sapiens
ccgcacagggcacattttgggggacagctaccctgtctggtgcaccatcctcacctgcacctggcaaggtgggtgaatggggaggaatccagacaggtgayctgggggatggcgggctattctctgatttggggaacacagagaggacagggggcaaagtggaaagtaaatgaagatgaacgagttatatctacaagtctg

SEQ ID NO: 22358 - DNA, 201 bp, Homo sapiens
tctggggaggtcttcatgggcttcttttcatttctgtttatttctattctttctgctaatacaaagacctcagttatttgctgttctgcctcagtcttatyttggcgtctggagcgcagggatattccctaaagaaatgagaagacatccacaaaattccaataattagtaaaacaaacttcaaaattcaacagggagcac

SEQ ID NO: 22359 - DNA, 201 bp, Homo sapiens
atctgctttggagactccttaaacgttctgatgctcttgccatctcctgctggctctctgtgcgtgtgcgtggtctcccctgacgtccgtgtgaacttgcygactgctaggagctcttctttcacacctactttccccagggatgccttcaactgttgttttgtgtgtgttggggtgtttattggttctggttgtaatgac

SEQ ID NO: 22360 - DNA, 201 bp, Homo sapiens
gaccagatcccacaggccctgggaggcgaaaaagtaaaaacagcttgtatttaatgggaatgtcctattacatggaaattcacttggaaactgaagctcasagaagttaccataccatggtggaaatgggtgggtatttgttctcaaatccagtcagcctaggggaatgggcagtatttgtcagatctctccctcccccag

SEQ ID NO: 22361 - DNA, 201 bp, Homo sapiens
gctgccaattacatcttctgcgtccagcttccgctttgcaggttgcttaaatgctttcgtgcctttgccctcacctaccggctctttgtcggtgtgcgtgstctcccctgaggtttgtgtgagcttgccaactgctaacagctcctccttcacttctactttctgggcacgtgtcctgggccgtctctttgagcttgttgc

SEQ ID NO: 22362 - DNA, 201 bp, Homo sapiens
atgaaaagctatacttaaaagacacaaaggaatacttacatcaattttggataatgactatttttaatactctgtgctttttcaaaaacgtttgtttgtartgttaaatatgtttagaggtttaatcatccccaaatgtgcttatttgatgctagcacttctgtgcatcagtttcttcatatacaataaagaaattacatt

SEQ ID NO: 22363 - DNA, 201 bp, Homo sapiens
cttccttaaccccaataaaataatttgattttaaggtaacaggacatcagagcaaaggaaagactatcccttacaactgagaatttgtttggcaggaggaygactatagatgggtgtttctgagctttggcactgttgacatcttgggccagatgcttctgtattgtgggggctgccctgagcctggtaggatgcccaccc

SEQ ID NO: 22364 - DNA, 201 bp, Homo sapiens
acatcagagcaaaggaaagactatcccttacaactgagaatttgtttggcaggaggacgactatagatgggtgtttctgagctttggcactgttgacatcwtgggccagatgcttctgtattgtgggggctgccctgagcctggtaggatgcccaccctgacctctcctccgcgatgacagcgcatgcccctgtcctatat

SEQ ID NO: 22365 - DNA, 201 bp, Homo sapiens
accaccaccaaacaggacagcaatataagaggaaacgttctcgaattccaggcaggaagactttctgtcccattttcctattgccacaaggagccaagagrcaagtgtatggcttccttccttcattctctgtgtccccagtggccagggatgcccactgtggaggcacccgggggcgcacagtgtcttcagacgcctgcc

SEQ ID NO: 22366 - DNA, 201 bp, Homo sapiens
tgtctgtgtgagcttgccaactgctaggagctcttctttcacgcccactttccccagggatgtcttgagccgtcgcttggagcttgctgggtttttgtctrggtctggttgtgaagatttgcaggctactttggcagttttatcgttagtcattgattcctcagtgtgacctcgtgtctggaagagctctttaaagccagc

SEQ ID NO: 22367 - DNA, 201 bp, Homo sapiens
gggaaataacagtagattcctcccttgaaatcctggtacataggcctcataaaaagagtgattccattaataatgtactcattttgtaaaaaagagagcamagagaagatatgttatgctcttcgctttgcttttcttggaaaggaaacaaatgaagttagctgacctctgggtcctcctaacaagaccccacacgtgagc

SEQ ID NO: 22368 - DNA, 201 bp, Homo sapiens
agagacagcgccctaactttccttcatatggaattatttccggaagggtggaagaactaaagaataacatatatatataacttttataaaagtctgatgcsccaaaggaagaaaagcttatcatctggattattaagaaaatatctaaaaaatattaacaaaggcaaagaatctaacttccttaatcaattttaggtttct

SEQ ID NO: 22369 - DNA, 201 bp, Homo sapiens
ttttaggtttcttgatacgtaacaccttgcttctaaaactatctatgtgagggatggttttttatttccaatctgaagtggaacaagaatcttatgactamacaatataaatgaaccactaataaaattatgaatatgtaaagtatataatctcacttttgttgtacgattacattcaatagccacaaaattgctgtcgaa

SEQ ID NO: 22370 - DNA, 201 bp, Homo sapiens
tgtgggatgcctcagaaactggcttccagcacgggaactgatgaccatcagattcaacattaaggctgctcctctagggaagaaggcagtacttaaatggyagaaatggactgggcatggtggctcaagcctgtaatcccagcactttgggaggcccaggtgggtggatcacgaggttaggagttcaagaccagcctggtc

SEQ ID NO: 22371 - DNA, 201 bp, Homo sapiens
ccaaggagctcatctgaaactagctttaggagcactctaaaatgtaggaaaaatatgaattctcagggctcatcctaagcctaaatcccactaaatttccragcacatgccgacaactgtgttttaataagctgtacaactaaaatacctcttccacactgatatactcaaactatctaaattgcgaagcacgtgtcgaca

SEQ ID NO: 22372 - DNA, 201 bp, Homo sapiens
tgcattaaaaaacagctaatacaaatgaagacaataacagagattcatttagcagaatggatttttaaatgacccaactaatacgttgtctacaagagacrcaattttgattcaaagacacaatcttttaaaataaaagcatgggaaaagatataccatgcaaacagcaagcagaggggaactggagtactgtactaacat

SEQ ID NO: 22373 - DNA, 201 bp, Homo sapiens
taataggtggtgatcaaaagggtgttcacatgataaattgacctgtccatcttgttttgtacctttttctctgtgtatattttgctttaaaataaaaaagratagaaaaatctcatgcagtttcaaaacacttggaagaaaataacaaactcctttaggacaaggtcaacctccctctgcataattatttgcacccaaatc

SEQ ID NO: 22374 - DNA, 201 bp, Homo sapiens
aaaaatctcatgcagtttcaaaacacttggaagaaaataacaaactcctttaggacaaggtcaacctccctctgcataattatttgcacccaaatccttgwattccatcacattttgtcccaattagtcatcttcctagatccatatccttttaaattaagattagtgttgagaatgaaaacctgaaatactttgacatcc

SEQ ID NO: 22375 - DNA, 201 bp, Homo sapiens
aggactgtcctgtgcagatgtccaatagccttaatttggggaccaaatgcccccggccattggaaagacagatcttgtaagctccattcatccgtgcgctyatccattcattcgtgtttaccgagtgcctgctcagtgttgggacagacgaggatagttgttcctgccaccgtgccctggaggacataggcaaacaaacga

SEQ ID NO: 22376 - DNA, 201 bp, Homo sapiens
tgggcatcagtgcccttcttgagcctctcctcttccctctctggaacagtctatgggcatctccccactaggacttcctgcccaccatccagacacacaakccctccccctccactggctgcctggctatgcagcaggtactggggacacctgggaatctttccttttcttggcagttgaagcttcctagtttgtgccgaa

SEQ ID NO: 22377 - DNA, 201 bp, Homo sapiens
tgagagagctcttggaagctggccagatcttccaggggttgggccttttccttaggtgctcttggctgtctcctgctgccaattacatcttctgcgtccascttccgctttgcaggttgcttaaatgctttcgtgcctttgccctcacctaccggctctttgtcggtgtgcgtggtctcccctgaggtttgtgtgagcttg

SEQ ID NO: 22378 - DNA, 201 bp, Homo sapiens
atgaaaacttttggcctcagtgaaatgacctgatttgaatttataggcaacctaagtaagatctgaagcagtcacacatctgatattatttctcatggtaragagtttggaatcaagtctctctttctaagattcactttcaaatctttgttggatgtctttaatcatctgaatttatctcaatttggataatatcttgtt

SEQ ID NO: 22379 - DNA, 201 bp, Homo sapiens
ggaaagactatcccttacaactgagaatttgtttggcaggaggacgactatagatgggtgtttctgagctttggcactgttgacatcttgggccagatgcwtctgtattgtgggggctgccctgagcctggtaggatgcccaccctgacctctcctccgcgatgacagcgcatgcccctgtcctatattgtgacatggaaa

SEQ ID NO: 22380 - DNA, 201 bp, Homo sapiens
agtgttaaaggaaaccctctggggaaaggataaccacttataacgtcaggttacatgcaaagtataacacagaaattcacaactatccaagacgatattgrgtgatgctgtaatacttcctctcaccttattttcagggaccgagtcttgtaatttgtgttcctctttgttggttttcatgtcgttgctgttcagctcttc

SEQ ID NO: 22381 - DNA, 201 bp, Homo sapiens
caggtgtttgctttggagcgcttgtaaagctatcagcagcaccatttgccagttcctcagtgtggcctggtgtttgagagagctcttggaagctggccagrtcttccaggggttgggccttttccttaggtgctcttggctgtctcctgctgccaattacatcttctgcgtccagcttccgctttgcaggttgcttaaatg

SEQ ID NO: 22382 - DNA, 201 bp, Homo sapiens
gagagagctcttggaagctggccagatcttccaggggttgggccttttccttaggtgctcttggctgtctcctgctgccaattacatcttctgcgtccagsttccgctttgcaggttgcttaaatgctttcgtgcctttgccctcacctaccggctctttgtcggtgtgcgtggtctcccctgaggtttgtgtgagcttgc

SEQ ID NO: 22383 - DNA, 201 bp, Homo sapiens
agcttcgtattcactgaacgacatgaggctacttatgtgtctataaatctgtcttataagagccatgcacaattaagaataatgttatttggtgctatagyggggtcatcattaagcaaagttagatgctgaaatgatcatagaaggtaaaaatactgcttcagaaggttcctccaaaggttgccatgccctgtgtcattg

SEQ ID NO: 22384 - DNA, 201 bp, Homo sapiens
caaaaactgcactagaacttatcacaaaactaactttattatatttttcccagttcgatttttctgtcaaatatcttcactgtccctatgacttctggttsttattttcttgacacacacattgtcctcagcctgtgtgggaagaaaaaaaatagaactcttaagtaatttaaacacccatttttagaatcgacctcctct

SEQ ID NO: 22385 - DNA, 201 bp, Homo sapiens
ggttcttattttcttgacacacacattgtcctcagcctgtgtgggaagaaaaaaaatagaactcttaagtaatttaaacacccatttttagaatcgacctmctctgcaaaaccccaaaggcttactaggtattatgcaggtccttagttgcagaaaattaattttgaggttggaaataagttttaaaatatattccattaa

SEQ ID NO: 22386 - DNA, 201 bp, Homo sapiens
gttcttattttcttgacacacacattgtcctcagcctgtgtgggaagaaaaaaaatagaactcttaagtaatttaaacacccatttttagaatcgacctcmtctgcaaaaccccaaaggcttactaggtattatgcaggtccttagttgcagaaaattaattttgaggttggaaataagttttaaaatatattccattaac

SEQ ID NO: 22387 - DNA, 201 bp, Homo sapiens
aaattaattttgaggttggaaataagttttaaaatatattccattaacattgtttttcttgacttgaactgcttttattatgcagtttttttacacttaartaatgtgatcttttcatacagaagttcctaatgcatttttaagctaattcataataaaatttcttcatcgatgcacacattttcacaaactaaaaaatgt

SEQ ID NO: 22388 - DNA, 201 bp, Homo sapiens
ataaaatttcttcatcgatgcacacattttcacaaactaaaaaatgtcactcagaaaaagtgaatccaaccaggattaagtcttttgggtctcctaaaccraggaacccctgtagacagaagcatgcccaacttgcatgcaggggacctgccttggcctttactcttgcagtagttctcaccccttggctaagggagagga

SEQ ID NO: 22389 - DNA, 201 bp, Homo sapiens
atgtcactcagaaaaagtgaatccaaccaggattaagtcttttgggtctcctaaaccaaggaacccctgtagacagaagcatgcccaacttgcatgcaggrgacctgccttggcctttactcttgcagtagttctcaccccttggctaagggagaggaaccatggtgaaaagcatggctacaagcttcttactggaaaaaa

SEQ ID NO: 22390 - DNA, 201 bp, Homo sapiens
acctgccttggcctttactcttgcagtagttctcaccccttggctaagggagaggaaccatggtgaaaagcatggctacaagcttcttactggaaaaaatstatcttatatatgcattttctaggactaccgacacccaccgaagagctcggcaaagaggagcatgtgtgtgttgggcgtctcctgggtgcttgtgtgtga

SEQ ID NO: 22391 - DNA, 201 bp, Homo sapiens
ctttgctcctatggagaaatgactgtctctgctgacaaattataaataaggaattcaggataaatttcaataacaatgcctaataagatatatatcaaatstaatttttacagtttacattatagaaagaaggtccgttattcattcatttacagggagtaaatgaattcctattcctttaaccatcactgctaaggcaga

SEQ ID NO: 22392 - DNA, 201 bp, Homo sapiens
ggcagaacaggaaattgccatttctggagtttccccaaacttctctgcatgcagtgggagcctctctatctaacagtccagacagtttccccttctcaagratacacattccttattgatattgttctgatagttaaaatagtgacatagataggatttttaacccagtcctggtcttggtgacagtatccagaacataga

SEQ ID NO: 22393 - DNA, 201 bp, Homo sapiens
ttctctgcatgcagtgggagcctctctatctaacagtccagacagtttccccttctcaagaatacacattccttattgatattgttctgatagttaaaatrgtgacatagataggatttttaacccagtcctggtcttggtgacagtatccagaacatagaactgaaccacccacctatcctctgatcaattttttaaaca

SEQ ID NO: 22394 - DNA, 201 bp, Homo sapiens
tattgcggaagaaccaaagtcaatattaaacatcacctatactgaagatctgtaaccccccacgagctcagaactactgactgcgtcatcagttttctcayaaatgggccataggacctgtcgatgaactgaggctccacttggcatgtgcgccctcttggctggtggatacttagggtggatctgagagcctagattcac

SEQ ID NO: 22395 - DNA, 201 bp, Homo sapiens
attagggcccatactaatagctcaaaaagccttcattgcctttttaaatgccctctttccaaatacagttacatcctaaggtacgaggggttaggaattcmaaatatgaatttcgggagagcacaaatcagtccataataggtggtgatcaaaagggtgttcacatgataaattgacctgtccatcttgttttgtaccttt

SEQ ID NO: 22396 - DNA, 201 bp, Homo sapiens
gaaaagcacaagccaggcacaaatgtatacattcttgtatcactgttaaggacttttataagaacagacaaaactatcgtgttcagagatccatgcttagrtagtgaaactcgagacgtttatgatatcctaaaagccaaaacggtggtttacttgctgagggaatgaagtagtgattagacaacagcatttttaaaaagc

SEQ ID NO: 22397 - DNA, 201 bp, Homo sapiens
atataatatatattattatattatatattactatataacatatagtatatactatataatattatatattataatatattataattatatatgattatatrtaatatattataattatatattatataagtgatatatataatatataattatatattacatatatatgagacactgtagaatacagttttcaattacaca

SEQ ID NO: 22398 - DNA, 201 bp, Homo sapiens
agataactctcctaagccaagatattccaaggagctcatctgaaactagctttaggagcactctaaaatgtaggaaaaatatgaattctcagggctcatcytaagcctaaatcccactaaatttccaagcacatgccgacaactgtgttttaataagctgtacaactaaaatacctcttccacactgatatactcaaacta

SEQ ID NO: 22399 - DNA, 201 bp, Homo sapiens
ctccccttttgagaggcgtattaggaggcaagttttcatcaaatagttcaggtcttaggtgcccaccaaaggacacacgccttcttttcaaaggtattccstcactctcatctaaagtaacggatacaaatgtggaaagagcaatgaaaaaacataccaagactagtgatttatttcacgttagcattaaagacaaaccaa

SEQ ID NO: 22400 - DNA, 201 bp, Homo sapiens
gcagattaacaagttaactctcttcactgtaaagcaccttccagctttctatgtatacgctgctctccagggtaaagacatgcatttgacatttccacacytatttcatgcaggacatgtgatcccaaaaattagcagagacttgtctttgcaagccaaaacagctttatcttccctgaacactaagaccccagaagggtg

SEQ ID NO: 22401 - DNA, 201 bp, Homo sapiens
aaacattagaaacaaacagctgtttcttgccttaaatcgccaataaaataacatggattatccttatgtggttagggtccatattacacaggaaatatttrcctaccgcaaacatcttcagggtagcaagctgttccctctgtgacaggaatacagtgaccagtgccaaatgagagattagacagattctcatctcccatc

SEQ ID NO: 22402 - DNA, 201 bp, Homo sapiens
tagaaggtaaaaatactgcttcagaaggttcctccaaaggttgccatgccctgtgtcattgacgtaaatataggcattttttccttcaaacattagaaacraacagctgtttcttgccttaaatcgccaataaaataacatggattatccttatgtggttagggtccatattacacaggaaatatttacctaccgcaaaca

SEQ ID NO: 22403 - DNA, 201 bp, Homo sapiens
agatggctgttttgctgcattctgtgcactgaagaacacatttcctcctgaaataaaaacatacacaataaaaacattctattagtgtctcatgtcaatcragtattacagcctcataaaatatggtaaaaaactaaatatttagcttcgtattcactgaacgacatgaggctacttatgtgtctataaatctgtcttata

SEQ ID NO: 22404 - DNA, 201 bp, Homo sapiens
agcttctgtatattcctgaactctgtagaccttcctgacctgtttgcagtggatactgtttttgaaggctctgtctcagtatctgaagtttttgtctccasagaagtcattttgtaggtgttcctgggcgtttttgctacgtttccattttctctaatacactgccgtcttaagggagggcttgcagagcatttatcagat

SEQ ID NO: 22405 - DNA, 201 bp, Homo sapiens; identical to SEQ ID NO: 22359

SEQ ID NO: 22406 - DNA, 201 bp, Homo sapiens
tccctctacatctgctttcctgatacttctcttgggtcgttgctttgtgcttgttggggtgtccactgggtctgactgtggagagtcgcagggtattttartggttttaccagcagccactaattcctcggtgtgaccaggagtctggaagagctctttaaagccagccaggtcttctagagcctgggccttttccttagg

SEQ ID NO: 22407 - DNA, 201 bp, Homo sapiens; identical to SEQ ID NO: 3378

SEQ ID NO: 22408 - DNA, 201 bp, Homo sapiens
ctctacgtctgctttcctgaggcttctcttgggccgttgctttgtgcttgctggggtgtccactgggtctggttgtggagatttgcaggctattttggtakttttctcatcagtcgtgggcttgtcagtgcctggtgtctggaagagctctttgaagccagccaggtcttctagagcctgggccttttccttaggagtttg

SEQ ID NO: 22409 - DNA, 201 bp, Homo sapiens
ctcatcaccgcttgctggttctttgtgtgtgtgtgtgctttgccctgatgtttgcgtgagcctctcaactgctgagagctcctcttttacttctttcctgrgacgtgtcttggggcatctctttgtgctcgtggcagtgtctgttagttctggtgggggagatttgcagggaatttttgtgtttttgtcaatagtcattga

SEQ ID NO: 22410 - DNA, 201 bp, Homo sapiens
gaagccggccaggtcttccaggggttgggccttttccttaggtgctcttggccttctcctgctgggttcctcttctactgggtttggtttcttctttgcaygttgcttcaatactttgatgccctcatcaccgcttgctggttctttgtgtgtgtgtgtgctttgccctgatgtttgcgtgagcctctcaactgctgagag

SEQ ID NO: 22411 - DNA, 201 bp, Homo sapiens
tctgcatccgtggtttcccctgatgtttgtgtgaacttgactgctgaaggctcttcttttacttgtaccttctgcacacgtgtcctgagatgcctctttgkgcttgctgtggtgtctaccacttctagtgggggagattcgcagggtattttagtggctttgccagcagtcagtgattcctgagtgtgacctgatgtttca

SEQ ID NO: 22412 - DNA, 201 bp, Homo sapiens
actttccctgggtgctcttggccgtctcctgctgccagttacacttgctgctggagccggtgtctgttttgcagattccttcaatgctttgatgcctttaycttcacctgctggttctttgtctgcatccgtggtttcccctgatgtttgtgtgaacttgactgctgaaggctcttcttttacttgtaccttctgcacacg

SEQ ID NO: 22413 - DNA, 201 bp, Homo sapiens
ctcacctaccggctctttgtcggtgtgcgtggtctcccctgaggtttgtgtgagcttgccaactgctaacagctcctccttcacttctactttctgggcaygtgtcctgggccgtctctttgagcttgttgcggtgtcttctagttctggtgatgatttgcagggtattttagtggttttgtcatcagtcattgattcttc

SEQ ID NO: 22414 - DNA, 201 bp, Homo sapiens
accatttgccagttcctcagtgtggcctggtgtttgagagagctcttggaagctggccagatcttccaggggttgggccttttccttaggtgctcttggcygtctcctgctgccaattacatcttctgcgtccagcttccgctttgcaggttgcttaaatgctttcgtgcctttgccctcacctaccggctctttgtcggt

SEQ ID NO: 22415 - DNA, 201 bp, Homo sapiens
aacgtcaggttacatgcaaagtataacacagaaattcacaactatccaagacgatattgagtgatgctgtaatacttcctctcaccttattttcagggacygagtcttgtaatttgtgttcctctttgttggttttcatgtcgttgctgttcagctcttccgcaggttcaattctttttgcagaagtcctcaaacttctct

SEQ ID NO: 22416 - DNA, 201 bp, Homo sapiens
ctcaccccttggctaagggagaggaaccatggtgaaaagcatggctacaagcttcttactggaaaaaatctatcttatatatgcattttctaggactaccracacccaccgaagagctcggcaaagaggagcatgtgtgtgttgggcgtctcctgggtgcttgtgtgtgagaagaggctggaacgcccccggcagaacaca

SEQ ID NO: 22417 - DNA, 201 bp, Homo sapiens
ttttcttgacttgaactgcttttattatgcagtttttttacacttaaataatgtgatcttttcatacagaagttcctaatgcatttttaagctaattcatrataaaatttcttcatcgatgcacacattttcacaaactaaaaaatgtcactcagaaaaagtgaatccaaccaggattaagtcttttgggtctcctaaacc

SEQ ID NO: 22418 - DNA, 201 bp, Homo sapiens
cactgtccctatgacttctggttcttattttcttgacacacacattgtcctcagcctgtgtgggaagaaaaaaaatagaactcttaagtaatttaaacacycatttttagaatcgacctcctctgcaaaaccccaaaggcttactaggtattatgcaggtccttagttgcagaaaattaattttgaggttggaaataagtt

SEQ ID NO: 22419 - DNA, 201 bp, Homo sapiens
tatagtacaagtcagtaccgctgatttctgcattcattcagcaagtatttatgatgtcacctggctccccgccagacactggggaaacaaacgtggagacrgggcactgcccgcacagggcacattttgggggacagctaccctgtctggtgcaccatcctcacctgcacctggcaaggtgggtgaatggggaggaatcca

SEQ ID NO: 22420 - DNA, 201 bp, Homo sapiens
gggagtgtgtggtggttggaggtgcctgcctaagggaggcaggagatggtaggtacagagttagtgtaagaaagcccaagagaggctgggggaccagatcscacaggccctgggaggcgaaaaagtaaaaacagcttgtatttaatgggaatgtcctattacatggaaattcacttggaaactgaagctcagagaagttac

SEQ ID NO: 22421 - DNA, 201 bp, Homo sapiens
ctccctataataaaaataccatgggttttaagaccatttcatcacatactttattggacatctcctgtggctggtcactgggatacagtaaccaggaaatrcagtcggccctcatgaatgaacaaaacttacaaccccaggaggggagccagaaactcaattagtggcttagtttccacaacactacgtgctacaaagagg

SEQ ID NO: 22422 - DNA, 201 bp, Homo sapiens
gtttctttccccactctccctataataaaaataccatgggttttaagaccatttcatcacatactttattggacatctcctgtggctggtcactgggatasagtaaccaggaaatacagtcggccctcatgaatgaacaaaacttacaaccccaggaggggagccagaaactcaattagtggcttagtttccacaacacta

SEQ ID NO: 22423 - DNA, 201 bp, Homo sapiens
ttttaccagcagccactaattcctcggtgtgaccaggagtctggaagagctctttaaagccagccaggtcttctagagcctgggccttttccttaggagtytgtagctgtcttttgctgccaggtaaagttcctgccaggtccagtttctgcactggagttcccataaatgctttaatgtctttctcatcacctcctgctg

SEQ ID NO: 22424 - DNA, 201 bp, Homo sapiens; identical to SEQ ID NO: 22408

SEQ ID NO: 22425 - DNA, 201 bp, Homo sapiens
ttccctaaacgcgttgatgcttttatcctcacctcctggtactttatctgtgtgtgtggtttcccctgatgtctgtgtgagcttcttcagggctgagagcwccttctgtacgtcccttttctccaaaggtgtcttgggctgccttcttgtgcttgttggggtgtctgctgattctggtggagaagattcgcagggcatttt

SEQ ID NO: 22426 - DNA, 201 bp, Homo sapiens; identical to SEQ ID NO: 22414

SEQ ID NO: 22427 - DNA, 201 bp, Homo sapiens; identical to SEQ ID NO: 22413

SEQ ID NO: 22428 - DNA, 201 bp, Homo sapiens
tttgtcatcagtcattgattcttcagtgtgacctgctgctgggtctttgaagccagctaggtcttctatggcttgggcactttccctgggtgctcttggcygtctcctgctgccagttacacttgctgctggagccggtgtctgttttgcagattccttcaatgctttgatgcctttatcttcacctgctggttctttgtc

SEQ ID NO: 22429 - DNA, 201 bp, Homo sapiens
tttgcagggtattttagtggttttgtcatcagtcattgattcttcagtgtgacctgctgctgggtctttgaagccagctaggtcttctatggcttgggcaytttccctgggtgctcttggccgtctcctgctgccagttacacttgctgctggagccggtgtctgttttgcagattccttcaatgctttgatgcctttatc

SEQ ID NO: 22430 - DNA, 201 bp, Homo sapiens
atgatttgcagggtattttagtggttttgtcatcagtcattgattcttcagtgtgacctgctgctgggtctttgaagccagctaggtcttctatggcttgrgcactttccctgggtgctcttggccgtctcctgctgccagttacacttgctgctggagccggtgtctgttttgcagattccttcaatgctttgatgcctt

SEQ ID NO: 22431 - DNA, 201 bp, Homo sapiens; identical to SEQ ID NO: 22406

SEQ ID NO: 22432 - DNA, 201 bp, Homo sapiens
ttaaagccagccaggtcttctagagcctgggccttttccttaggagtttgtagccgtctcttgctgccagttaagttctctgtcaggtccagtttctgcaytggagttcccataaatgcgtagatgtttttctcaccacttactgctggtttgggtgtgtgcatggctttgcctgctgatggtgttcgtttcctgagtgcg

SEQ ID NO: 22433 - DNA, 201 bp, Homo sapiens
attctgaatgtccatctctggggaggtcttcatgggcttcttttcatttctgtttatttctattctttctgctaatacaaagacctcagttatttgctgtyctgcctcagtcttattttggcgtctggagcgcagggatattccctaaagaaatgagaagacatccacaaaattccaataattagtaaaacaaacttcaaa

SEQ ID NO: 22434 - DNA, 201 bp, Homo sapiens; identical to SEQ ID NO: 22410

SEQ ID NO: 22435 - DNA, 201 bp, Homo sapiens
ctgctttcctgagacttctcttggactgtggcttgaagattgttggggtacccactgggtctggttgtggagatctgcaggctattttggtagttttctcrtgagtcgtgggcttgtcagtgcatattggtgtctggaagagctctttcaagccagccaagtcttctaggggttgggcttttcccttaggagttcttggct

SEQ ID NO: 22436 - DNA, 201 bp, Homo sapiens
caccaaaggacacacgccttcttttcaaaggtattccgtcactctcatctaaagtaacggatacaaatgtggaaagagcaatgaaaaaacataccaagacwagtgatttatttcacgttagcattaaagacaaaccaagtgaaaagtcatcgaaacacagtacctacagcacgcctctattcttgcaatcctggtgaagct

SEQ ID NO: 22437 - DNA, 201 bp, Homo sapiens
tgctttaggcgtgtgcatggctttgcctgctgatggtgttagtttcctgaatgctaaaaattcttcctctacgtctgctttcttgaggcttctcttgggcygttgctttgtgtttgttggggtgtccgctgggtctgattgcggagatttgcagagtatttttttggtagttttctcatcagtcgtggggttatcagtgca

SEQ ID NO: 22438 - DNA, 201 bp, Homo sapiens
tgctgctttaggcgtgtgcatggctttgcctgctgatggtgttagtttcctgaatgctaaaaattcttcctctacgtctgctttcttgaggcttctcttgrgccgttgctttgtgtttgttggggtgtccgctgggtctgattgcggagatttgcagagtatttttttggtagttttctcatcagtcgtggggttatcagt

SEQ ID NO: 22439 - DNA, 201 bp, Homo sapiens
ataaatgatttcatatcatcgaaacgaatcagcccaaacttggatattttctatcacctgttcacgtatttttcttggaaattcagttgacttccttccaytctgaagactttcattttcatacctgcagtttatagaacgacaaagatcctgattaaaaatttataccctggggcggaagtctccatatccacttaatgt

SEQ ID NO: 22440 - DNA, 201 bp, Homo sapiens
tgaggcttctcttgggccgttgctttgtgtttgttggggtgtccgctgggtctgattgcggagatttgcagagtatttttttggtagttttctcatcagtygtggggttatcagtgcatggtgtctggaaaagctctctgaagccagtcagttcttctagagcctgggccttttccttacgagtttgtagccgtctattgc

SEQ ID NO: 22441 - DNA, 201 bp, Homo sapiens
tgagagcaaccctagttagaaaagtattcccaagagaccaaggcaagccacgagtcactccttacagaaagtcactcttggtccctaaagatgtgctcacragtcattctccaaagcacaaaactttattttcagaaaggaaaggacatcaaaaataggactgtcctgtgcagatgtccaatagccttaatttggggacca

SEQ ID NO: 22442 - DNA, 201 bp, Homo sapiens
ctcatccattcattcgtgtttaccgagtgcctgctcagtgttgggacagacgaggatagttgttcctgccaccgtgccctggaggacataggcaaacaaaygacgacacagtgtggcaagtgtcacagttaaggctgctgtagggtggctgtgggtggtgacagacctcaaggcttcattctgcaaagctgagggcaaacc

SEQ ID NO: 22443 - DNA, 201 bp, Homo sapiens
gttgaagataatgctttttgtttgcctttgcaaccttgggcaaaaaatacatcaaaacattctgtgtcttttaaaacagggaaacagtaaatggcttaccytctttggattttctgcacatctcttgacactccgcgttactctctgcacagattcgctctccaaagtgcttgctgcaggctggctttttgtctttcttga

SEQ ID NO: 22444 - DNA, 201 bp, Homo sapiens
ggattttctgcacatctcttgacactccgcgttactctctgcacagattcgctctccaaagtgcttgctgcaggctggctttttgtctttcttgatctcargcacatggagtctgaatttcctgcttctcctttccctttctgattctgcatgagaaccttcgcactcttctgccctccgctctcctctgccaccttaggc

SEQ ID NO: 22445 - DNA, 201 bp, Homo sapiens
atttgcaggctattttggtagttttgtcatcagttgttgattcctcagtgtggtctggtgtctggaagagctctttgaagccggccaggtcttctagtgaytgggcctcttccttaggtgttcttggccacctctccatcccagttccatagtttgctgggtccagcatctgctttgcagattccttaaacgctttgatgc

SEQ ID NO: 22446 - DNA, 201 bp, Homo sapiens
gagctcttccactatatcccttttccccaaaggtgttttgggccgcctccttgtgcttgttggagtgtccattgattctggtggtggagatttgcaggctrttttggtagttttgtcatcagttgttgattcctcagtgtggtctggtgtctggaagagctctttgaagccggccaggtcttctagtgattgggcctcttc

SEQ ID NO: 22447 - DNA, 201 bp, Homo sapiens
atatcttgagtcgttgcttggagcttgttggggttttgactgggtctggttgtggagatttgcaggatacttctgtgattttgtcatcggtcattgattcstcagtgtgacctggtgtctggaagagctctttgaagccagccagatcttctagagccttggccttttctttaggagtttgtggccgtctcttgctgccag

SEQ ID NO: 22448 - DNA, 201 bp, Homo sapiens
tgtcatcagttgttgattcctcagtgtggtctggtgtctggaagagctctttgaagccggccaggtcttctagtgattgggcctcttccttaggtgttctyggccacctctccatcccagttccatagtttgctgggtccagcatctgctttgcagattccttaaacgctttgatgctctttccatctcctgctgtctctc

SEQ ID NO: 22449 - DNA, 201 bp, Homo sapiens
ttggggttttgactgggtctggttgtggagatttgcaggatacttctgtgattttgtcatcggtcattgattcctcagtgtgacctggtgtctggaagagytctttgaagccagccagatcttctagagccttggccttttctttaggagtttgtggccgtctcttgctgccaggtaaatttcctagcaggtccagtttct

SEQ ID NO: 22450 - DNA, 201 bp, Homo sapiens
ggagatttgcaggatacttctgtgattttgtcatcggtcattgattcctcagtgtgacctggtgtctggaagagctctttgaagccagccagatcttctakagccttggccttttctttaggagtttgtggccgtctcttgctgccaggtaaatttcctagcaggtccagtttctccactggagtccccacaaatgtgttg

SEQ ID NO: 22451 - DNA, 201 bp, Homo sapiens
cttctagagcacgggccttttccttacgagttctcagctgcctcctgctaccagttacacttgctgctgggtccaggatctgctttggagactccttaaaygctttgatgctcttactatctcctgttggctctgtgtgtgtttgcgtagtctcccctgatgtccgtgtgagcttgctgactgctaggggctcttctttca

SEQ ID NO: 22452 - DNA, 201 bp, Homo sapiens
atcacttactgctggttttggtgtgtccatggctttgcctgctgatggtgttcgtttcctgagtgctaaaaattcttcctctacgtctgctttcctgaggyttctcttgggccgttgctttgtgcttgctggggtgtccactgggtctggttgtggagatttgcaggctattttggtagttttctcatcagtcgtgggctt

SEQ ID NO: 22453 - DNA, 201 bp, Homo sapiens
tctcttgctgccaggtaaatttcctagcaggtccagtttctgcactggagtttccacaaatgtgttgatatttttctcatcacttactgctggttttggtstgtccatggctttgcctgctgatggtgttcgtttcctgagtgctaaaaattcttcctctacgtctgctttcctgaggcttctcttgggccgttgctttgt

SEQ ID NO: 22454 - DNA, 201 bp, Homo sapiens
aaaagctctctgaagccagtcagttcttctagagcctgggccttttccttacgagtttgtagccgtctattgctgccaggtaaatttcctggctggtccastttctgcactggagttcccaaaaacgtgttgatgtctttctcttcacctactgctggtttgggtgtgtgcatggctttgcctgctgatggcgtttgtttc

SEQ ID NO: 22455 - DNA, 201 bp, Homo sapiens
ggcgtaagcatggctttccctgctgatggtgttagtttcctgagtgctaagaattcttcctctacatctgctttcctgagacttctcttaggccattgctytgtgcttgttggagtgtccactgattctggtggtggagatttgcaggctattttggtagttttctcatcagtcattgattcctcagagggacctggtgtc

SEQ ID NO: 22456 - DNA, 201 bp, Homo sapiens
aggcgttcttggccacttcttcattccagttacacgggctgctgggtccaggatctgctttggagactccttaaacgttctgatgctcttgccatctcctrctggctctctgtgcgtgtgcgtggtctcccctgacgtccgtgtgaacttgccgactgctaggagctcttctttcacacctactttccccagggatgcctt

SEQ ID NO: 22457 - DNA, 201 bp, Homo sapiens
ctggttgtaatgactggcagggcattttagtgattttgcctttctcactctttggtgccttggcatgatcttgggtttggaggagattctggccacgtgcygtgtctttcatgagttctgtatcaggcaagctcttgaggtctgtcaggtcagacattggtgcacatttctgcccccaagttcttgatctcttcattgctt

SEQ ID NO: 22458 - DNA, 201 bp, Homo sapiens
taggatgcactcaacaatttctgtatttgtttcttcactcttactttccacaggtagcttctgtatattcctgaactctgtagaccttcctgacctgtttrcagtggatactgtttttgaaggctctgtctcagtatctgaagtttttgtctccagagaagtcattttgtaggtgttcctgggcgtttttgctacgtttcc

SEQ ID NO: 22459 - DNA, 201 bp, Homo sapiens
ggctctgtctcagtatctgaagtttttgtctccagagaagtcattttgtaggtgttcctgggcgtttttgctacgtttccattttctctaatacactgccrtcttaagggagggcttgcagagcatttatcagatggctgttttgctgcattctgtgcactgaagaacacatttcctcctgaaataaaaacatacacaata

SEQ ID NO: 22460 - DNA, 201 bp, Homo sapiens
agagcatttatcagatggctgttttgctgcattctgtgcactgaagaacacatttcctcctgaaataaaaacatacacaataaaaacattctattagtgtytcatgtcaatcgagtattacagcctcataaaatatggtaaaaaactaaatatttagcttcgtattcactgaacgacatgaggctacttatgtgtctataa

SEQ ID NO: 22461 - DNA, 201 bp, Homo sapiens
tggtgatgatttgcagggtattttagtggttttgtcatcagtcattgattcttcagtgtgacctgctgctgggtctttgaagccagctaggtcttctatgrcttgggcactttccctgggtgctcttggccgtctcctgctgccagttacacttgctgctggagccggtgtctgttttgcagattccttcaatgctttgat

SEQ ID NO: 22462 - DNA, 201 bp, Homo sapiens
tctcccctgaggtttgtgtgagcttgccaactgctaacagctcctccttcacttctactttctgggcacgtgtcctgggccgtctctttgagcttgttgcrgtgtcttctagttctggtgatgatttgcagggtattttagtggttttgtcatcagtcattgattcttcagtgtgacctgctgctgggtctttgaagccag

SEQ ID NO: 22463 - DNA, 201 bp, Homo sapiens
gtggctttgccagcagtcagtgattcctgagtgtgacctgatgtttcagagagctctgtgaagccggccaggtcttccaggggttgggccttttccttagrtgctcttggccttctcctgctgggttcctcttctactgggtttggtttcttctttgcacgttgcttcaatactttgatgccctcatcaccgcttgctggt

SEQ ID NO: 22464 - DNA, 201 bp, Homo sapiens
cgcagggtattttagtggctttgccagcagtcagtgattcctgagtgtgacctgatgtttcagagagctctgtgaagccggccaggtcttccaggggttgrgccttttccttaggtgctcttggccttctcctgctgggttcctcttctactgggtttggtttcttctttgcacgttgcttcaatactttgatgccctcat

SEQ ID NO: 22465 - DNA, 201 bp, Homo sapiens
gatatttttagaggttttccactgtcaggtgtttgctttggagcgcttgtaaagctatcagcagcaccatttgccagttcctcagtgtggcctggtgtttkagagagctcttggaagctggccagatcttccaggggttgggccttttccttaggtgctcttggctgtctcctgctgccaattacatcttctgcgtccagc

SEQ ID NO: 22466 - DNA, 201 bp, Homo sapiens
tagtttcctgaatgctaaaaattcttcctctacgtctgctttcttgaggcttctcttgggccgttgctttgtgtttgttggggtgtccgctgggtctgatwgcggagatttgcagagtatttttttggtagttttctcatcagtcgtggggttatcagtgcatggtgtctggaaaagctctctgaagccagtcagttcttc

SEQ ID NO: 22467 - DNA, 201 bp, Homo sapiens
atcaccgcttgctggttctttgtgtgtgtgtgtgctttgccctgatgtttgcgtgagcctctcaactgctgagagctcctcttttacttctttcctgggaygtgtcttggggcatctctttgtgctcgtggcagtgtctgttagttctggtgggggagatttgcagggaatttttgtgtttttgtcaatagtcattgactc

SEQ ID NO: 22468 - DNA, 201 bp, Homo sapiens
ctagagcctgggccttttccttaggagtttgtagccgtctcttgctgccagttaagttctctgtcaggtccagtttctgcactggagttcccataaatgcrtagatgtttttctcaccacttactgctggtttgggtgtgtgcatggctttgcctgctgatggtgttcgtttcctgagtgcgaagaattcttcttctacgt

SEQ ID NO: 22469 - DNA, 201 bp, Homo sapiens
cagtttctgcactggagttcccataaatgcgtagatgtttttctcaccacttactgctggtttgggtgtgtgcatggctttgcctgctgatggtgttcgtwtcctgagtgcgaagaattcttcttctacgtccactttcctgagacttctcttggactgtggcttggagcttgttggtgtgtccactgggtctggttgtga

SEQ ID NO: 22470 - DNA, 201 bp, Homo sapiens
tctgcactggagttcccataaatgcgtagatgtttttctcaccacttactgctggtttgggtgtgtgcatggctttgcctgctgatggtgttcgtttcctragtgcgaagaattcttcttctacgtccactttcctgagacttctcttggactgtggcttggagcttgttggtgtgtccactgggtctggttgtgatctgc

SEQ ID NO: 22471 - DNA, 201 bp, Homo sapiens
tgcgaagaattcttcttctacgtccactttcctgagacttctcttggactgtggcttggagcttgttggtgtgtccactgggtctggttgtgatctgcagkctattttggtagttttctcgtgagtcgtgggcttgtcagtgcatactggtgtctggaagagctctttcaagccagccaggtcttctaggggttgggcctt

SEQ ID NO: 22472 - DNA, 201 bp, Homo sapiens
tgcacgctaagagttctccctctacatctgctttcctgatacttctcttgggtcgttgctttgtgcttgttggggtgtccactgggtctgactgtggagadtcgcagggtattttagtggttttaccagcagccactaattcctcggtgtgaccaggagtctggaagagctctttaaagccagccaggtcttctagagcct

SEQ ID NO: 22473 - DNA, 201 bp, Homo sapiens
tttgtggccgtctcttgctgccggttaagttctctgtcaggtccagtttctgcactggagttcccacaaatatgatgatgtctttctcttcacctactgayggtttaggcgtgtgcatggctttgcctgctgatggcattagattcctgcacgctaagagttctccctctacatctgctttcctgatacttctcttgggtc

SEQ ID NO: 22474 - DNA, 201 bp, Homo sapiens
cactgggtctgactgtggagagtcgcagggtattttagtggttttaccagcagccactaattcctcggtgtgaccaggagtctggaagagctctttaaagmcagccaggtcttctagagcctgggccttttccttaggagtctgtagctgtcttttgctgccaggtaaagttcctgccaggtccagtttctgcactggagt

SEQ ID NO: 22475 - DNA, 201 bp, Homo sapiens
ggcttgaagattgttggggtacccactgggtctggttgtggagatctgcaggctattttggtagttttctcatgagtcgtgggcttgtcagtgcatattgstgtctggaagagctctttcaagccagccaagtcttctaggggttgggcttttcccttaggagttcttggctgcctcttgctaccagttacacttgctgct

SEQ ID NO: 22476 - DNA, 201 bp, Homo sapiens
agtttgcgtggcctgtactaaattgactgtgaacttcgcccacaggcttctgtagaaaacaggaaggaggtaaacaggacattaaagcataaatccacacwgaatgcaagcttcgatgacaccggtatgtgtaaagcagccattcagtgaggcccctacctttggagtagcaggtcttctttgccttttgttcattgacct

SEQ ID NO: 22477 - DNA, 201 bp, Homo sapiens
aggaggcaagttttcatcaaatagttcaggtcttaggtgcccaccaaaggacacacgccttcttttcaaaggtattccgtcactctcatctaaagtaacgratacaaatgtggaaagagcaatgaaaaaacataccaagactagtgatttatttcacgttagcattaaagacaaaccaagtgaaaagtcatcgaaacacag

SEQ ID NO: 22478 - DNA, 201 bp, Homo sapiens
tcaaatagttcaggtcttaggtgcccaccaaaggacacacgccttcttttcaaaggtattccgtcactctcatctaaagtaacggatacaaatgtggaaasagcaatgaaaaaacataccaagactagtgatttatttcacgttagcattaaagacaaaccaagtgaaaagtcatcgaaacacagtacctacagcacgcct

SEQ ID NO: 22479 - DNA, 201 bp, Homo sapiens
catccaactctttcttcactgactcataaagcttccaaaagggagattcattttttttgctattgtcaagacattgtgtagtgggaacagacttcaattcwccataacggctcactaatttaacgctggaaatttctttaaaatccccagaaatgggatcagctgcatttctgccattacgtccagcatgttctgaggaat

SEQ ID NO: 22480 - DNA, 201 bp, Homo sapiens
accctggggcggaagtctccatatccacttaatgtccaaggatcaacgaacaaactttgggtttagttcaagacatcaccttatacaaagaaataaatttwgagttagaaaagtgcttttacactaaaaactaggattagttgcatcgagtttgttttgaaataccactgtcagaggctggggacccagattaacttctga

SEQ ID NO: 22481 - DNA, 201 bp, Homo sapiens
tttcattttcatacctgcagtttatagaacgacaaagatcctgattaaaaatttataccctggggcggaagtctccatatccacttaatgtccaaggatcracgaacaaactttgggtttagttcaagacatcaccttatacaaagaaataaatttagagttagaaaagtgcttttacactaaaaactaggattagttgca

SEQ ID NO: 22482 - DNA, 201 bp, Homo sapiens
acccaaagtccgccgcaggaggagccggcgccgcgctcacctccgcccggtaagctgcgcccgccacgctccgcacacaccgggccgcagcccgcggggtmgcgttcgctgcaccccggcctgcagtccccgctgctcccgccgccgcctctgacggggacccggtggccctacaggctacgtccccgggcgcccggctct

SEQ ID NO: 22483 - DNA, 201 bp, Homo sapiens
tcagaagagtttgttagtaggttcttggagtcttcagtgttcctgttctagcctgtgatcttaaaaatttgaataaactatgcaatggcctgtctgttctycatctgaacctttggagtctaagaatctctcttcctacccaggtcatgtgaccaaacacttaggaattatttctaaattataaaatcttgcatgaagata

SEQ ID NO: 22484 - DNA, 201 bp, Homo sapiens
ggttaatcagaagatgacatttactgttagaccaatcagcttttacctacctgaaggaacgatcaataatagttattacatctccatgttttagccgtacwggctcatcaataacagacccatttacttgtgttggatttgtggaactgaaattatgtaatattgcctgcaagtgaaaagaaggggaaatatgtaactaat

SEQ ID NO: 22485 - DNA, 201 bp, Homo sapiens
cgtctctactaaaaattgcaaaaattagccgggtgttgtggcgcgtgcctgtaatcccagctacttggtaggctgaggcatgagaatcacttgaacccggraggcggaggttgcagtgagccaagatcacaccactgcactccagcctgggtgacagagcaagactctgtctcaaaaacaaacaaacaaacaaacaaaaag

SEQ ID NO: 22486 - DNA, 201 bp, Homo sapiens
gtagtcccagctactcaggtggccgaggcaggagaattgctggaacccgggaggcagaggttgcagtgagcagagattgcaccactgcactctagcctggrcaataaagcgagactctgtctcaaaaaataaaaataaaaacaataaaaaattgttttctttaccaaaccactcgtatatgacttttaaagactgtttgag

SEQ ID NO: 22487 - DNA, 201 bp, Homo sapiens
tgtattctaatgtcagactaaccaatcagatttgcttccgaagcaccacttcttcttttggaacatatcatctgtaaaatatcatgttgacttcggctgakagacactctctttgaaggcaggttgccactctttctccctcctctcttaggaacctctgtctgagatttgctgctggaagcaggggctgttttgcaggac

SEQ ID NO: 22488 - DNA, 201 bp, Homo sapiens
tgtgtccactgggtctggttgtgatctgcaggctattttggtagttttctcgtgagtcgtgggcttgtcagtgcatactggtgtctggaagagctctttcmagccagccaggtcttctaggggttgggccttttccttagtttttgggtgcctcttgctaccagttacacttgctgctgggtccagtttctgttttgcagt

SEQ ID NO: 22489 - DNA, 201 bp, Homo sapiens
ttgaggcttctcttgggccgttgctttgtgtttgttggggtgtccgctgggtctgattgcggagatttgcagagtatttttttggtagttttctcatcagycgtggggttatcagtgcatggtgtctggaaaagctctctgaagccagtcagttcttctagagcctgggccttttccttacgagtttgtagccgtctattg

SEQ ID NO: 22490 - DNA, 201 bp, Homo sapiens
tgtggcttgaagattgttggggtacccactgggtctggttgtggagatctgcaggctattttggtagttttctcatgagtcgtgggcttgtcagtgcataytggtgtctggaagagctctttcaagccagccaagtcttctaggggttgggcttttcccttaggagttcttggctgcctcttgctaccagttacacttgct

SEQ ID NO: 22491 - DNA, 201 bp, Homo sapiens
gtctcttgctgccaggtaaatttcctagcaggtccagtttctgcactggagtttccacaaatgtgttgatatttttctcatcacttactgctggttttggkgtgtccatggctttgcctgctgatggtgttcgtttcctgagtgctaaaaattcttcctctacgtctgctttcctgaggcttctcttgggccgttgctttg

SEQ ID NO: 22492 - DNA, 201 bp, Homo sapiens
tccattcatccgtgcgctcatccattcattcgtgtttaccgagtgcctgctcagtgttgggacagacgaggatagttgttcctgccaccgtgccctggagracataggcaaacaaacgacgacacagtgtggcaagtgtcacagttaaggctgctgtagggtggctgtgggtggtgacagacctcaaggcttcattctgca

SEQ ID NO: 22493 - DNA, 201 bp, Homo sapiens
tattatatattactatataacatatagtatatactatataatattatatattataatatattataattatatatgattatatataatatattataattatrtattatataagtgatatatataatatataattatatattacatatatatgagacactgtagaatacagttttcaattacacaaggcagattagtaagata

SEQ ID NO: 22494 - DNA, 201 bp, Homo sapiens
atatactgtatacagtatatactatatggtatatataatatatattattatattatatattactatataacatatagtatatactatataatattatataktataatatattataattatatatgattatatataatatattataattatatattatataagtgatatatataatatataattatatattacatatatatg

SEQ ID NO: 22495 - DNA, 201 bp, Homo sapiens
gtaaccccccacgagctcagaactactgactgcgtcatcagttttctcacaaatgggccataggacctgtcgatgaactgaggctccacttggcatgtgcrccctcttggctggtggatacttagggtggatctgagagcctagattcaccctaggtaaattcatggtacaggcacacatggtatattcacagattctgca

SEQ ID NO: 22496 - DNA, 201 bp, Homo sapiens
tttaaaacattgaaacattatgtgtggacatagaaaggaggagtctgcagcagcagatttcaccttagagtagggggacgacagccagagaactctctaaagacatgcacttgggtctcagcctgagccacccagtgaccagaatgcatgagctgtaaaaactcctccaggtggttctgagtcaattcacaggagcccagt

SEQ ID NO: 22497 - DNA, 201 bp, Homo sapiens
ctttaaaacattgaaacattatgtgtggacatagaaaggaggagtctgcagcagcagatttcaccttagagtagggggacgacagccagagaactctctaaagacatgcacttgggtctcagcctgagccacccagtgaccagaatgcatgagctgtaaaaactcctccaggtggttctgagtcaattcacaggagcccag

SEQ ID NO: 22498 - DNA, 201 bp, Homo sapiens
tcatttacagggagtaaatgaattcctattcctttaaccatcactgctaaggcagaacaggaaattgccatttctggagtttccccaaacttctctgcatrcagtgggagcctctctatctaacagtccagacagtttccccttctcaagaatacacattccttattgatattgttctgatagttaaaatagtgacataga

SEQ ID NO: 22499 - DNA, 201 bp, Homo sapiens
agaattaaatttatattatatttttgtgaattgctcacaaaaagggagcaattcaacctatttttattttagctaaaccaagtattccccagaagaacacyaatggaatctaatcattcttatggatttgtccacatgcttgtaattatgagtggctcaacttgatgtgatttcagtagcacttaaagttcattagcttag

SEQ ID NO: 22500 - DNA, 201 bp, Homo sapiens
cttctagtgactgggcctcttccttaggcgttcttggccacttcttcattccagttacacgggctgctgggtccaggatctgctttggagactccttaaaygttctgatgctcttgccatctcctgctggctctctgtgcgtgtgcgtggtctcccctgacgtccgtgtgaacttgccgactgctaggagctcttctttca

SEQ ID NO: 22501 - DNA, 201 bp, Homo sapiens
gctgctggaagcaggggctgttttgcaggacctacggcgttgatcactggcaactggagttttcctaggactaggagctggagggcttataaccaagcttkgtgccttcacttccacatggatttctgaacctgactcttgttttcctgatggttgaggctgttcctgacaagacaaaattgtttacaagaagccttaaca

SEQ ID NO: 22502 - DNA, 201 bp, Homo sapiens
aaatgaagatgaacgagttatatctacaagtctgaagctggagaaagatgtctgggcttcaaaggagatttcggaggcagcggctcacaaggaagcgatcytgaaatcgtggctgaaggtgctgagtgctcagtctctccaaggatgatgatgctttacagagtactggtgtcacttcctgtactgggtggcatcgggctg

SEQ ID NO: 22503 - DNA, 201 bp, Homo sapiens
cacccaaagtccgccgcaggaggagccggcgccgcgctcacctccgcccggtaagctgcgcccgccacgctccgcacacaccgggccgcagcccgcggggycgcgttcgctgcaccccggcctgcagtccccgctgctcccgccgccgcctctgacggggacccggtggccctacaggctacgtccccgggcgcccggctc

SEQ ID NO: 22504 - DNA, 201 bp, Homo sapiens
ggccgcagctcacctgggacgatccggcccgcaaggccacttgtcgaaccaccgctcgtcaagtcgcacccaaagtccgccgcaggaggagccggcgccgmgctcacctccgcccggtaagctgcgcccgccacgctccgcacacaccgggccgcagcccgcggggtcgcgttcgctgcaccccggcctgcagtccccgct

SEQ ID NO: 22505 - DNA, 201 bp, Homo sapiens
ctgtatacagtatatactatatggtatatataatatatattattatattatatattactatataacatatagtatatactatataatattatatattatawtatattataattatatatgattatatataatatattataattatatattatataagtgatatatataatatataattatatattacatatatatgagaca

SEQ ID NO: 22506 - DNA, 201 bp, Homo sapiens
atactgtatacagtatatactatatggtatatataatatatattattatattatatattactatataacatatagtatatactatataatattatatattwtaatatattataattatatatgattatatataatatattataattatatattatataagtgatatatataatatataattatatattacatatatatgag

SEQ ID NO: 22507 - DNA, 201 bp, Homo sapiens
gctaatacaaatgaagacaataacagagattcatttagcagaatggatttttaaatgacccaactaatacgttgtctacaagagacacaattttgattcaragacacaatcttttaaaataaaagcatgggaaaagatataccatgcaaacagcaagcagaggggaactggagtactgtactaacatgagacaaaatcatc

SEQ ID NO: 22508 - DNA, 201 bp, Homo sapiens
gccgtctctactaaaaattgcaaaaattagccgggtgttgtggcgcgtgcctgtaatcccagctacttggtaggctgaggcatgagaatcacttgaacccrggaggcggaggttgcagtgagccaagatcacaccactgcactccagcctgggtgacagagcaagactctgtctcaaaaacaaacaaacaaacaaacaaaa

SEQ ID NO: 22509 - DNA, 201 bp, Homo sapiens
accaaggatcaagtgttcatgtggcatatggactcatgggtacagtccagtgtttacagcaaattgtttgtaggacactctgaaaacagagtatcaacacytgagaactaccgctatgtttaatgattaccagtgatttattccacatgaccaaactcatatgatacagttgattgtagttcagaattaaactccatgtga

SEQ ID NO: 22510 - DNA, 201 bp, Homo sapiens
aatgccttaactatagccttgtaactctaaaagaaaataaaacaatccttatgggtcgacgtggtaatgtatccagaatctttgtaattggctattctgayggtgcctgcaggtgattacgcagtgctgtaagcgtgggtgtctgggaacttctgcacgaaaaggacaacatcaaggactcccccgactcggtcgcatcag

SEQ ID NO: 22511 - DNA, 201 bp, Homo sapiens
gcacggaggctggtgacgggctcctgagacccataggcctccctgctaggatctagaggccaaatgccttcatgcttctcaaagtcttgggtgctcagttytagattttaagtacaaataacacgtacccacattttagaaaatgacaaagagctgcccatttttagtactgtcaagtaataatatatatttttgaaaatc

SEQ ID NO: 22512 - DNA, 201 bp, Homo sapiens
tttcctgagacttctcttaggccattgctttgtgcttgttggagtgtccactgattctggtggtggagatttgcaggctattttggtagttttctcatcastcattgattcctcagagggacctggtgtctggaagagctctttgaagccagccaggtcttctagtgactgggcctcttccttaggcgttcttggccactt

SEQ ID NO: 22513 - DNA, 201 bp, Homo sapiens
tctaatcattcttatggatttgtccacatgcttgtaattatgagtggctcaacttgatgtgatttcagtagcacttaaagttcattagcttagatagtctstggctggaggagggttggagggcagacgcatcccccactgaccaggaactctcacatagtgagcatgtgtctcagggacatcccaacttctgttccttct

SEQ ID NO: 22514 - DNA, 201 bp, Homo sapiens
gagcatgtgtgtgttgggcgtctcctgggtgcttgtgtgtgagaagaggctggaacgcccccggcagaacacaccaggcctggctcagccttgggcctggytgctctgtgtttaggaatcatcctagttaaaagattcgctttcacccttctttggtttcattctgaggaagcagcaccttccagactgtgaattcggtaa

SEQ ID NO: 22515 - DNA, 201 bp, Homo sapiens
aagtaaaaacagcttgtatttaatgggaatgtcctattacatggaaattcacttggaaactgaagctcagagaagttaccataccatggtggaaatgggtkggtatttgttctcaaatccagtcagcctaggggaatgggcagtatttgtcagatctctccctcccccagtaccaaggagggttgtgtagaagtggtgttc

SEQ ID NO: 22516 - DNA, 201 bp, Homo sapiens
ataagttttaaaatatattccattaacattgtttttcttgacttgaactgcttttattatgcagtttttttacacttaaataatgtgatcttttcatacasaagttcctaatgcatttttaagctaattcataataaaatttcttcatcgatgcacacattttcacaaactaaaaaatgtcactcagaaaaagtgaatcca

SEQ ID NO: 22517 - DNA, 201 bp, Homo sapiens
agtaacaaacaaaatgggcaatgtaaacgatcttgcattttgcaaagaacttttggaagtattaaacatgtaactattagatctttaaaacagagagtatrtaaaaacaagggaaaacactagaacacaaatcgaattaccttttatatgaaaagctatacttaaaagacacaaaggaatacttacatcaattttggataa

SEQ ID NO: 22518 - DNA, 201 bp, Homo sapiens
tcaaagactagacattagtcaaatgtccatcaagaatgaatgaattctgtatagttatgtatattattgtatatattaaacatttttttttcagtgaaatmcttatgccatgagaaggaacaaactacagagatgtccaacatgctatgaatctcacacacagaaaagcacaagccaggcacaaatgtatacattcttgta

SEQ ID NO: 22519 - DNA, 201 bp, Homo sapiens
gccaccagataatgcaattcccaaatgttagctctacgtgttggggttatcctaatcatgggtttgcaaaaagctcgcaacatgctctaatagactttttkgctaaaagtgtaagaccaacttagtgctctgattttgaacaataaagaggaaatatcattttagattattttaatacgtctaagttcaactcgtttttat

SEQ ID NO: 22520 - DNA, 201 bp, Homo sapiens; identical to SEQ ID NO: 22487

SEQ ID NO: 22521 - DNA, 201 bp, Homo sapiens
ttttgctatgtcaccctggttacttacaataaagaagccaaaagtgtacacaggtcatttacacacattaacggagtctttctttctatataagtcaatgratgccaatgttagttcaactgctgattgaaatctccctttcaattagaacagagaagacggaaatggtattttgtgccaggaacatttgttttagagaag

SEQ ID NO: 22522 - DNA, 201 bp, Homo sapiens
ttccgggctccatcatctggattctgaatgtccatctctggggaggtcttcatgggcttcttttcatttctgtttatttctattctttctgctaatacaawgacctcagttatttgctgttctgcctcagtcttattttggcgtctggagcgcagggatattccctaaagaaatgagaagacatccacaaaattccaataa

SEQ ID NO: 22523 - DNA, 201 bp, Homo sapiens
catgagaaccttcgcactcttctgccctccgctctcctctgccaccttaggctgggagctctcattctgtctagcagacctcaagcaccttttgttctcastgactttgtctctaggtatgggtttccgggctccatcatctggattctgaatgtccatctctggggaggtcttcatgggcttcttttcatttctgtttat

SEQ ID NO: 22524 - DNA, 201 bp, Homo sapiens
aacattctgtgtcttttaaaacagggaaacagtaaatggcttaccttctttggattttctgcacatctcttgacactccgcgttactctctgcacagattygctctccaaagtgcttgctgcaggctggctttttgtctttcttgatctcaggcacatggagtctgaatttcctgcttctcctttccctttctgattctgc

SEQ ID NO: 22525 - DNA, 201 bp, Homo sapiens
cccagcctggaggacaggcatgggggtgagggaacccacaggcaagaagcctcccttaagctgagctcaggactggatgaaatgatcttggtggggcaggwgggaaagttccaggcagggaaaacagcagggagtgtgtggtggttggaggtgcctgcctaagggaggcaggagatggtaggtacagagttagtgtaagaa

SEQ ID NO: 22526 - DNA, 201 bp, Homo sapiens
tgccccagcctggaggacaggcatgggggtgagggaacccacaggcaagaagcctcccttaagctgagctcaggactggatgaaatgatcttggtggggcwggagggaaagttccaggcagggaaaacagcagggagtgtgtggtggttggaggtgcctgcctaagggaggcaggagatggtaggtacagagttagtgtaa

SEQ ID NO: 22527 - DNA, 201 bp, Homo sapiens
ttcttattttacctctattccattcataggaaaaaaatatttaatactgcccatttctcttaagagcaacatgcagaagccttttttttttttttttttttcaaattttctgtggcacatgtatgacatgctctaagatcctgcacactgcttggtagaattccctgaagctgccctgcctgttctgctgattgtgtgcat

SEQ ID NO: 22528 - DNA, 201 bp, Homo sapiens
ctacttgggaggctgaggcagtagaattgcttgaacccaggaggtggaagttgctgtgagtcgagatcatgccactgcactccagtctgggtgacagagccagactctgtctcaaaaaaaccagaaccccccagaaaaccaggggtctccatccttcaggctgcggaccactgggctgctttcccccacctgccgcctgcc

SEQ ID NO: 22529 - DNA, 201 bp, Homo sapiens
ttctccctggtaccccaagagtagtcttgcaccctcttgctcatttctgcatggctggcctgatgtacagtcagaagtgcggatgaggaaaaggattgtargttgtttttgtcccattttaagtttttttttttggtattttgtgctaggattggggagggtcttcttgttattttccccaagtattgtttttataagaat

SEQ ID NO: 22530 - DNA, 201 bp, Homo sapiens
gaactcctgaactcaggtgatccgcccacctcagcctctcaaagtgctgggatcacaggcatgagccaccatgcccagcctgatactgctgtttctactaygtgcttttattgctggtgagtgatccacgcccttggactagcccatggtcaggcattataatcaggaaacacttccccccacaagatgggcccctcataa

SEQ ID NO: 22531 - DNA, 201 bp, Homo sapiens
tccttcctcagggcacctttgatacccttggtatggaaagcactgccaaggtaatgatggagtgttggaagacaaggtgctggagctagaagggtaattarcatttccacagatggcgctgctatggtgttggattaaaggcttgatttcattcctctaattgagtgacttagttcatctttgtggattgatgcccaatat

SEQ ID NO: 22532 - DNA, 201 bp, Homo sapiens
acttactgagtcttgtggaagaaaacaagagtcttctttttctaggtaatatcttcctgggggccactgcggtccacagacatcctggccttctgaggcaygatggggaggggtgagggagttgtgtgagtgtaaagttagtagttctttaagtgattccttttttttttttttggattatggagtcttgctctgtcgcca

SEQ ID NO: 22533 - DNA, 201 bp, Homo sapiens
agacctctggatcagagagggtttctaatttcagccagttcgagtttttttatggttggtgcatgatgtcggagaggaagcctgactgaatccctgctcargtgtcttctctggggttgtcacaccccagggtctgagcttcagttctggaagtttgatttttgtcagtgtagccagattgagcgtcttgggactcttaga

SEQ ID NO: 22534 - DNA, 201 bp, Homo sapiens
actctaccacctagcattgcttcaacctgagctcccattttttagatgtcggaatctgtgctccctgtggtgaggggtgagggggttcctgtatccatcargtttcctagtgagtagaacaggaggatttgcactattaaaagtcatattgcagggtggtttggagaggagttatatgcctagtcttgttgcttgtttgat

SEQ ID NO: 22535 - DNA, 201 bp, Homo sapiens
atgttctccccacccgcccccctcccggaaacaggtaagagagggagagatttgcttaatggtccccaggtgttgtgttttcagtcccacgctctttgcastgtcatcacagagtctcagagccttgcttttcaaactgggctttataatttggcaagtgtgaggaacgctattttggagggatggaggaggaggaaggtg

SEQ ID NO: 22536 - DNA, 201 bp, Homo sapiens
aagggctcagtgatgattattaccacattctgatagtgtttcaattaaagcatgttaactggtagactcgcatgtgtttgttacattcttagtcacgtaartattggtttcctccagcatctccatcctctcctgagcacttgcctgcaacacccgcggaatctccagcccagaggttcgaagctcggatagaagatggca

SEQ ID NO: 22537 - DNA, 201 bp, Homo sapiens
agaaaggtggcacagcctagcaaatctaattgcactttttatctcttgcagaactcttcctccagctggaagtaagtaccacggatcttctgggtttgcargccctgtctgagactggaatcttgcagtcctgatctggtggcttttccttctatcaccaagtagatagtttggaagccttcaccactgttctgtttgact

SEQ ID NO: 22538 - DNA, 201 bp, Homo sapiens; identical to SEQ ID NO: 3635

SEQ ID NO: 22539 - DNA, 201 bp, Homo sapiens; identical to SEQ ID NO: 3636

SEQ ID NO: 22540 - DNA, 201 bp, Homo sapiens
cgaaaaaatatctgggtagcaagtgaggtgtactcaaaaataagcaaaagtcacatgggtctgattttataccctcgctggaaagcttgttctcagacacrctgttactgcaagtgtgtgtgagggggaaactctcacacactttgcagttgaggacagggctagactttgagttggagccctggctcccagggctgtgta

SEQ ID NO: 22541 - DNA, 201 bp, Homo sapiens
acggtctggctgatcttagctatccagtacattttgctatcttttgctgtcagtaaagtggtgattttccagctccttgattttgaaacatttatttccartatgtgtgagattctttcttcaaatgaaatctcacttgggactttcaatggagcacgaattgaacgccactgtgcctaaagctagagatttttaggagag

SEQ ID NO: 22542 - DNA, 201 bp, Homo sapiens
aaggaagtacagtggagtactgtcttctatgtgggttagattctaaagtcaggcagaaattgcacattgtcaaaatcatccttgaaaagtccttacattcrcttgactacaacatatgcggatttgtctattccatggggtatttgtgaactcccggtacagctactgatttgggaaccacggagctagattccaggaaag

SEQ ID NO: 22543 - DNA, 201 bp, Homo sapiens; identical to SEQ ID NO: 3632

SEQ ID NO: 22544 - DNA, 201 bp, Homo sapiens
aatgcaagttagattgtttttcccctctctctgccgaatattgtcgcgtcttgacataatagagtgtcagtgagatctgacaaatggtgacactgaaacaygtcttctggaggggagaagcttcagtgcactgaagacatgcaactctggcaatggggaaaccgttctcatttcttgaaagtgttccagctcatttttcag

SEQ ID NO: 22545 - DNA, 201 bp, Homo sapiens
ccgggttcacaccattctcctgcctcagcctcccaagtagctgggactataggcacctgccaccatgcccggctactttttttgtatttttagtagagacrgggttttaccgtgttagccaggatggtcttgatctcctgaccttgtgatccgcctgcctcggcctcccaaagtgctgggattacaggcttgagccaccgc

SEQ ID NO: 22546 - DNA, 201 bp, Homo sapiens
acttgcatttaaaccattctcgctgttctaattgaatttaaaattcttttttttttttttttaagatagagtctcgctctgttgctcaggctggagtgcartggcatgatcttggcttgctgcaagctccgcctccggggtcaagcaattctcctgcctcagcctcccgagtagctgggattacaggagcctgccaccact

SEQ ID NO: 22547 - DNA, 201 bp, Homo sapiens
cctgagctcaggcaatccacccaccttggcctcccaaagtgctaggattacaagcatgagccaccatacctggccagttttttttttttttttgagacagrgtctcgttcttccagccaggctggagtgcagtggcatgatctcagcccactgcagtccctgcctcctgggttcaagcaattcttgtgcttcagcctcccg

SEQ ID NO: 22548 - DNA, 201 bp, Homo sapiens
agacggggtttcaccttgttgcccaggctggtctcgaacccctgagctcaggcaatccacccaccttggcctcccaaagtgctaggattacaagcatgagscaccatacctggccagttttttttttttttttgagacagagtctcgttcttccagccaggctggagtgcagtggcatgatctcagcccactgcagtccct

SEQ ID NO: 22549 - DNA, 201 bp, Homo sapiens
aaaaatccaaaacacttctgatcccaagcatttcagataagggatacttaatctgtagtaaccttgtgtgtatgagtttgaccatagcgcttccaaagacmatgtatgtttacaatttctccactttaaattaattacatttaatcagtcttcccgttataagactttgttgagtactctctagaaagaatcttgagggca

SEQ ID NO: 22550 - DNA, 201 bp, Homo sapiens
aaaatccaaaacacttctgatcccaagcatttcagataagggatacttaatctgtagtaaccttgtgtgtatgagtttgaccatagcgcttccaaagaccwtgtatgtttacaatttctccactttaaattaattacatttaatcagtcttcccgttataagactttgttgagtactctctagaaagaatcttgagggcaa

SEQ ID NO: 22551 - DNA, 201 bp, Homo sapiens
gcagagtgggcctttcctcaagatgttctttcctggtgctggcattgtggaatcagggttttttttttttttttttttttttttaagacggagtctcgctytgtcccccaggctggagtgcagtggcgcgatctcggctcactgcaagctccgcctcccgggttcacgccattctcctgcctcaacctcctgagtagctgg

SEQ ID NO: 22552 - DNA, 201 bp, Homo sapiens; identical to SEQ ID NO: 3633

SEQ ID NO: 22553 - DNA, 201 bp, Homo sapiens
ccaaagtgctgggattacagacatgaaccaccgtgcccagccctaacattcattcttattccccacccccacaaaccttaggcgctcttctgttaccaccrcagcattaatttgtgtcaacattgatggcgccctccatcctgctagagaagggcatgatgtctgctaggattgctctgggctgctagtctagcctatggg

SEQ ID NO: 22554 - DNA, 201 bp, Homo sapiens
catttcagaaagatttgatatgattccaacaggatagccaaactgaactagtttcccataaaggtaggaaagttacatgagactcagagccaatgcctttytaaccttctagaatttagtaatccacatatgggaactcagcaggttgtaggcaggtttcagggagaaacaatatgggccaactcttctgttgccatatgt

SEQ ID NO: 22555 - DNA, 201 bp, Homo sapiens
cagccagaaggatcacgtgatcagcctgaaggtacactcaagtgaggtactcacatccttagcccaccataggcccctatgtcagtcaccacaatggcgaratttgaaaagcggaggcatatacaatttttgtcttagtataatatcaatatatgtatactttggggttcaggcacttactaaatgttgttccattctttt

SEQ ID NO: 22556 - DNA, 201 bp, Homo sapiens; identical to SEQ ID NO: 3634

SEQ ID NO: 22557 - DNA, 201 bp, Homo sapiens
caccacaatggcgagatttgaaaagcggaggcatatacaatttttgtcttagtataatatcaatatatgtatactttggggttcaggcacttactaaatgwtgttccattcttttgtcttgctgtatcaaaaataatagtaactttttgaatatacacaatttatctagaatctattttcctttgaagctgtaactttatg

SEQ ID NO: 22558 - DNA, 201 bp, Homo sapiens
atctggggtgttgacccttaaatgtttgtgcactcttcttgttgcagataaaagtcattaaaaatcaagtgaatagaatggatcttgggtggaaaaacaaycttgaaataaacttgtgattgaggatattgttcatttggtgcatgattaaggaggatattgttcctggcttttgagatagtgcctaccaatcttaaccaa

SEQ ID NO: 22559 - DNA, 201 bp, Homo sapiens
caaatttaaaagcatctttaagatcaaggcagaaatggaacccaagattgctgtgctttccattttcgtaatcacaggtgtgagagagatggctgagaaaygagttcaaggctgatgcctgttcccagcggcatgcctttagatggcccgaggtcaggggtgcttatgaagccctcacaagttgagacagtttattccagc

SEQ ID NO: 22560 - DNA, 201 bp, Homo sapiens
ccctttgagtttcagtatctaaccaaaagttccaaaattggggtaatgattatttattttgaattcttaaaaaaacccagcattgtgttaggttggttacycgataacattgtacttgtcaaaaatgcttagggttctagtcatggccgaagtaaatcatttccacctattaagttgcagtgagttaattgcccagtagat

SEQ ID NO: 22561 - DNA, 201 bp, Homo sapiens
atgaccctttgagtttcagtatctaaccaaaagttccaaaattggggtaatgattatttattttgaattcttaaaaaaacccagcattgtgttaggttggktacccgataacattgtacttgtcaaaaatgcttagggttctagtcatggccgaagtaaatcatttccacctattaagttgcagtgagttaattgcccagt

SEQ ID NO: 22562 - DNA, 201 bp, Homo sapiens
taaaaaatgtattagcagtcatttaatcaatacttccggtggatctttgaaagcagcgtttcccaaaaccatgttctgctccccttccttctccattctgstgtctctgtactagaatttgcaggctggtatcttgtgtggtacccctgccaactggggctggggtgtatgtcccccctctgacccctcttacctctgctc

SEQ ID NO: 22563 - DNA, 201 bp, Homo sapiens
atgacaaaagatggtatgttatgggaaaacctggactagtaagagtctcatatgaaccacttggaaagagggctggggctattgtagttatttcagatcayggctgctgctaaacttacatagtactaaaagtagaaacccattaaaaaatgtattagcagtcatttaatcaatacttccggtggatctttgaaagcagcg

SEQ ID NO: 22564 - DNA, 201 bp, Homo sapiens
aagaggaggaaacctgctccagatatccatttacatcaagccttaaccgcctttcttttttaagactgtggaatcctatgtttatccgtttgctagggtayacatggccgttgtcctacagaaaatagtaacatttaactggaaagcgtgtgttaaatgtttgtccacaggtcaggggttgctcattttatcatggtagtc

SEQ ID NO: 22565 - DNA, 201 bp, Homo sapiens
aagacagggtctcactccagttgccaagggtggagtgcaatggtgccatcggggctcactgcagctcgacttcccaggctcaggtgattctcccacctcarcctcctgagtagctgggactacaggcatgtgccaccttacctggctcatttttgtactttttgtagagatagggttttgccatgttgcgtagctggtctt

SEQ ID NO: 22566 - DNA, 201 bp, Homo sapiens
tctgtttgacttaaggacatttggtctcagctcagacatcctgtctggtcatttgttgttgcgcagcctctgcttatcacaggggaataaggaatactcayccctaactgcttattgacttctatcccgtgttagagctgtttggaagtctctgagttataacggcctaatagtttgatattggtccttgaagcagttcaa

SEQ ID NO: 22567 - DNA, 201 bp, Homo sapiens; identical to SEQ ID NO: 3642

SEQ ID NO: 22568 - DNA, 201 bp, Homo sapiens; identical to SEQ ID NO: 3640

SEQ ID NO: 22569 - DNA, 201 bp, Homo sapiens
catatgtagactgatgattcctagaaggatacagggaattggcttgaactagctattttggaacttggcaaatactgcaaggcaagtcagtggtgagtttrtcacttggatatggaggtggcatgcctttctgtacatccccaaatttaactcttacaattcggaaagtgctggggctctggtgtgtctgattttagcagg

SEQ ID NO: 22570 - DNA, 201 bp, Homo sapiens; identical to SEQ ID NO: 3637

SEQ ID NO: 22571 - DNA, 201 bp, Homo sapiens; identical to SEQ ID NO: 3628

SEQ ID NO: 22572 - DNA, 201 bp, Homo sapiens
tcaaattctaggtgacactggagctacttggctttagcatagcttgactccaagcaggtttggtgggtagctctgagtgtgtggatgactccctgacttakcttttcttgggatcagtttttcatttaaaatgattctgcaaggtcccttggaggcttagcttcatgtgaggtctttaactttttaaatttttaagccagt

SEQ ID NO: 22573 - DNA, 201 bp, Homo sapiens
tctcctgcctcagcctcctgagtagctgggattacaggcacccaccaccacgcccggctaatttttgtatttttttttaagtagagatggggtttcaccaygttggtcaggctggtcttgaactcctgaccccgtggtctacccagctcggcctcccaaagtgctgggattacaggcgtgagccaccacacctggccaact

SEQ ID NO: 22574 - DNA, 201 bp, Homo sapiens
atttaacaatttttaatttactttttgaactgggtcatatagtccaaaaaaagggaaaaatacatagttttccaacactttcctcagccttttcccttctrtagagggaccaaggaatataagctttagatcccaaagaagattaggtggtcttctaacctaaggatggaagcctttatttatttatttatttatttattt

SEQ ID NO: 22575 - DNA, 201 bp, Homo sapiens
tccgcctccggggtcaagcaattctcctgcctcagcctcccgagtagctgggattacaggagcctgccaccactcccggctaatttttgtgtttttagtasagatggggtttcaccatgttggccaggctggtctcgatctcctgaccttgtgatctgcccaccttggcctcccaaagtgctgggattacaggcgtgagcc

SEQ ID NO: 22576 - DNA, 201 bp, Homo sapiens
tttttttacctaccagtatatggagcatgtttccacactcgtaatattctacaccacatccatgacctttctttattaaagtgtttagaaagttgtatcaraatgacttgagggtagttgcattttgttttgtgtctttatctctttaataacttacagtccctttagaacaactgtgagtattctccctctgtattttta

SEQ ID NO: 22577 - DNA, 201 bp, Homo sapiens
tgagacagagtctcgcactgtcacccaggctggagtgcagtggcgccatctcagctcactgcaacctccgcctcccgagttcaagctgttctctccctcarcctcccaagtagctgggactacaggcacccgccaccacgcccagctaatttttgtatttttagtacagacggggtttcaccatgttcgccaggatggcct

SEQ ID NO: 22578 - DNA, 201 bp, Homo sapiens
actgcagactccgcctcccaggttcaagcgattctcctacctcagcctcctgagtagctgggactacaggcacacgccaatatgcctggctaattttttgkattttatttatttatttatattttttgagacagagtctcgcactgtcacccaggctggagtgcagtggcgccatctcagctcactgcaacctccgcctcc

SEQ ID NO: 22579 - DNA, 201 bp, Homo sapiens
gagatggggtttcaccatgttggccaggatggtctcatctgttgacctcgtgattcacctgcctcagcctcccaaaatgctggaatcacaggtgtgcgccwccgcaccctgctgaaaacgattgcatttttaagagattttcataatacttgccctttgatcaccagggctttagtcctactctaagtgaccttatgtatt

SEQ ID NO: 22580 - DNA, 201 bp, Homo sapiens
ttgtttaaagcaccatgattactcgattactcgattactcacacatccctctacttactgagtcttgtggaagaaaacaagagtcttctttttctaggtartatcttcctgggggccactgcggtccacagacatcctggccttctgaggcacgatggggaggggtgagggagttgtgtgagtgtaaagttagtagttctt

SEQ ID NO: 22581 - DNA, 201 bp, Homo sapiens
ctaaaagagcctttcataccaatgggcttcagcacacccaccctctttgggagctgcagaaattagtcagctgagatgaccttcaggttccttcctatccygagagcctgtgactctgggcttcttaatttgagggagaggaggaatatcccctaggttttgagggtgctggagagatgcccacagtggctgtaatgcttg

SEQ ID NO: 22582 - DNA, 201 bp, Homo sapiens
ttggcctccaaagacctaacattaattcttgtggattgattgattgattgattttgagacgtagtctagctctgtcacccaggctgaagtgcagtgccacrgtcttggctcactgtaccctctgcctcctgggttcaagcgattctcctgcctcagcctcccgagtagctgggactacaggtgcgtgccaccatgcctgac

SEQ ID NO: 22583 - DNA, 201 bp, Homo sapiens
atgctaatgagtagctatttgggtgtcaagacaagaggaagaggccccacacaaatatctggagagggagaatggaagaggtgacctggattttgggcagwgtgggcctttcctcaagatgttctttcctggtgctggcattgtggaatcagggttttttttttttttttttttttttttaagacggagtctcgctttgtc

SEQ ID NO: 22584 - DNA, 201 bp, Homo sapiens
ctgccttggtctcccaaagtgctgggattacaggagtgagctactacatctggcttttttactcattttaaaaccctaagatatatgtggttgtactactrtaggagcagtaagtttcacgcgtatgcaatagatgctaatgagtagctatttgggtgtcaagacaagaggaagaggccccacacaaatatctggagaggg

SEQ ID NO: 22585 - DNA, 201 bp, Homo sapiens
taactgtacatagagaagctaggaagaattataggtcagtgcatcccaacttcaatgtgttaggtcagtggggtcttgataaaatgcagattctgtttcargggctttggagtggaggctgagatcctgcatttctttctttcttttttttttttaaatttaatttttttttgagaccaagtcttgctctgtcgcccaggc

SEQ ID NO: 22586 - DNA, 201 bp, Homo sapiens
gcccacttgtgcatggtacagatctgaagctgttataggaatgatcacattgggttgggtgtgcctgggttcctatgcccagcaattcccagtgccaaagygggtaggacttctgggggctaaaaaataatgagtggcttgtccctttcctcagttaattttctctgtcaacaactgttaacatctgggcttttaatctgg

SEQ ID NO: 22587 - DNA, 201 bp, Homo sapiens
gatgtcttgaaaatcctcaaccggttgctcttcctagacttcccttttagcagataaaggaggtggcatttgtggaaggaggtcctgcctcctcactttaratctgatcctttaagcagaatatttgctcttgaaacctcaatttctccatctgtagaggggaatattaatacctcatggaactggcataagatggaagta

SEQ ID NO: 22588 - DNA, 201 bp, Homo sapiens
cccctttctactctgagttcctgaagcacctccttgagatgtcttgaaaatcctcaaccggttgctcttcctagacttcccttttagcagataaaggaggkggcatttgtggaaggaggtcctgcctcctcactttagatctgatcctttaagcagaatatttgctcttgaaacctcaatttctccatctgtagaggggaa

SEQ ID NO: 22589 - DNA, 201 bp, Homo sapiens
acacctgtaatcccagcactttgcgaggccgaggcgggtggatcacgaggtcaggagatcgagacaatcttggctaacatggtgaaaccccgtctctactraaaaatgcaaaaaattagctgggcgttgtagtgggcacctgtagtcccagctactctggaggctgaggcaggagaatagcgtgaacctggaggcggaact

SEQ ID NO: 22590 - DNA, 201 bp, Homo sapiens
gcagctcactgcagtctcaacctctggggctcaatccattgatcctcccacctcagccttccaagtagctgggacaacaggcacgtgccaccacgcccagstgatttttaaaatttttagtagaaactaggtctcactgtgttgcccaggctggtcttgaatgcctgagctcaagcattcctcctgtttcggcctcctgga

SEQ ID NO: 22591 - DNA, 201 bp, Homo sapiens
actcacttttagcgtacacccagatggaaaacggtataaagtatatttaatgtatatttgttgaatgtgttaggtttttaaagttctttaccttttaacargatgatccacattcatttccctttaggtcctttttgcaaatgttttgtggccatcctctggattctcacattgtttttgtgctttggaactcaaaggggt

SEQ ID NO: 22592 - DNA, 201 bp, Homo sapiens
gctcagagaagccacgattgaaaagcaggctgctgactcttatttatttatttatttatttttatttgtttaatttttttttttgagatggagtcttgctyggttgcccaggctggagtgcagtggtgcaatcttggctcaccacaacctccacctcccaggttcaagtgattctcctgcctcagcctcccaagtagctgg

SEQ ID NO: 22593 - DNA, 201 bp, Homo sapiens
caggtttcgtgtttgcagatagggatggcctactaactgtatgtaatgtttttcattgatggctttgtgcaagcctgccttgaatagaaattgattttacrggagtttattgagtgcatactctgtgtcaggtgacgccaactccgtgaattatgattttaactagcccctatttcctaactttattcagacactgaggat

SEQ ID NO: 22594 - DNA, 201 bp, Homo sapiens
tacaacctgaggatactcaaattctttgcattggccttttgtgtccacaggtttcgtgtttgcagatagggatggcctactaactgtatgtaatgtttttsattgatggctttgtgcaagcctgccttgaatagaaattgattttacgggagtttattgagtgcatactctgtgtcaggtgacgccaactccgtgaattat

SEQ ID NO: 22595 - DNA, 201 bp, Homo sapiens
tgctttggccttccaaagtgctgggattacagacatgagctgccatgcctggcctggatattctaagtaatctagagatgatttaaagtgtactgttggcytggtgcagtggctcatgcctgtaatcccagcactttggaatgcgaaagcaggtggttcacttgaggccaggagttcgagaccagcctggccaacgtggcg

SEQ ID NO: 22596 - DNA, 201 bp, Homo sapiens
gttctcctgcctcagtctccggagtagttgggattactggcacctgccaccatgcctggctaatttttgtggttttatttgttgttttgtttattttattyttttttgagatggagtttcactcttgttgcccagggtggagtgcaatggcgcgatctcggctcaccacaacctctgcctcccgagttcaagcaattctcc

SEQ ID NO: 22597 - DNA, 201 bp, Homo sapiens
caaagttgcccctccccacccccgaaatgcataagtcatctatactttaggtagtacactattgagaactcaggttggttaaaggaaagggacctagaacyagccagatacaggtttaaatttggctttgtcacttaactcagctttgtaaacttaagttttccagcctcgatttacccaactgtaatggagctgtttaat

SEQ ID NO: 22598 - DNA, 201 bp, Homo sapiens; identical to SEQ ID NO: 3631

SEQ ID NO: 22599 - DNA, 201 bp, Homo sapiens; identical to SEQ ID NO: 3630

SEQ ID NO: 22600 - DNA, 201 bp, Homo sapiens
aggttcaagtgattctcctgcctcagcctcctgagtagctgggattacaggcacccaccaccacgcccggctaatttttgtatttttttttaagtagagayggggtttcaccacgttggtcaggctggtcttgaactcctgaccccgtggtctacccagctcggcctcccaaagtgctgggattacaggcgtgagccacca

SEQ ID NO: 22601 - DNA, 201 bp, Homo sapiens
aggatttgcactattaaaagtcatattgcagggtggtttggagaggagttatatgcctagtcttgttgcttgtttgatgttttttctcacataacgctctstcaagtctgctttaagtgcttgatgtttaatgataaaatagtatctccactgaagcaaacctatgaggagacctctggatcagagagggtttctaatttc

SEQ ID NO: 22602 - DNA, 201 bp, Homo sapiens
tcttaagagcaacatgcagaagccttttttttttttttttttttcaaattttctgtggcacatgtatgacatgctctaagatcctgcacactgcttggtaraattccctgaagctgccctgcctgttctgctgattgtgtgcataatcacaaattaacttcctcccatgatcagacttgacctcatctacccgttctgcac

SEQ ID NO: 22603 - DNA, 201 bp, Homo sapiens
ccacctcggcctcccgcagtgctgggattacaggcgtgagccactgcacccagctgtaacatgtgtatgttttatcataaacacaggaacatagttgacayagttttttttggtttttttttttttacctaccagtatatggagcatgtttccacactcgtaatattctacaccacatccatgacctttctttattaaagt

SEQ ID NO: 22604 - DNA, 201 bp, Homo sapiens
cacacatccctctacttactgagtcttgtggaagaaaacaagagtcttctttttctaggtaatatcttcctgggggccactgcggtccacagacatcctgrccttctgaggcacgatggggaggggtgagggagttgtgtgagtgtaaagttagtagttctttaagtgattccttttttttttttttggattatggagtct

SEQ ID NO: 22605 - DNA, 201 bp, Homo sapiens
gaaatgagtaactgtacatagagaagctaggaagaattataggtcagtgcatcccaacttcaatgtgttaggtcagtggggtcttgataaaatgcagattytgtttcaggggctttggagtggaggctgagatcctgcatttctttctttcttttttttttttaaatttaatttttttttgagaccaagtcttgctctgtc

SEQ ID NO: 22606 - DNA, 201 bp, Homo sapiens
ctacctttgagaaatgtgttttagtataaaatataggatgtggaagcgaaaaaatatctgggtagcaagtgaggtgtactcaaaaataagcaaaagtcacrtgggtctgattttataccctcgctggaaagcttgttctcagacacactgttactgcaagtgtgtgtgagggggaaactctcacacactttgcagttgagg

SEQ ID NO: 22607 - DNA, 201 bp, Homo sapiens
tggggctgcgtggaggggccgccgggagttgcggggctcggggaagttacccccatccgtgctggagtagcggggaagccctgggtgcgttacactcgacygtgatggggagaggggacttagatgttgtcacgctgggggtccctttaagaccccgtcctccctcccagccgtttctgattgaacctcactcactagtag

SEQ ID NO: 22608 - DNA, 201 bp, Homo sapiens
gcataaagtacttggcctggtactgtaaatactccgtaaatgttctccccacccgcccccctcccggaaacaggtaagagagggagagatttgcttaatgrtccccaggtgttgtgttttcagtcccacgctctttgcagtgtcatcacagagtctcagagccttgcttttcaaactgggctttataatttggcaagtgtg

SEQ ID NO: 22609 - DNA, 201 bp, Homo sapiens
actgcaaggcaagtcagtggtgagtttgtcacttggatatggaggtggcatgcctttctgtacatccccaaatttaactcttacaattcggaaagtgctgsggctctggtgtgtctgattttagcagggttctgtaggaaatgcatgcagtgtttttgtggacgttctcagggctgactttgaaattaaaagtagccagtt

SEQ ID NO: 22610 - DNA, 201 bp, Homo sapiens
tagtctttgaggctatttaaatatcttttttcagcagctgagttgcagcttgtaaaacaggttaattggcctaaaaaaaaaacgcacatttttactacccygttgatgttgcttcgtagcacattttatatctaaacatatttttaaatttcttcccccccctttgatttttctttagaaattaaaaagtaaattcttatg

SEQ ID NO: 22611 - DNA, 201 bp, Homo sapiens
agtctttgaggctatttaaatatcttttttcagcagctgagttgcagcttgtaaaacaggttaattggcctaaaaaaaaaacgcacatttttactaccctrttgatgttgcttcgtagcacattttatatctaaacatatttttaaatttcttcccccccctttgatttttctttagaaattaaaaagtaaattcttatgt

SEQ ID NO: 22612 - DNA, 201 bp, Homo sapiens
tggattggcttgatcttttatcagtccacaaatgtctgcaaagaaattgatttctatgtgtctgccctctgtaacttattcgtgccagtgcacagtaaatstaatgaaactggattatgaagtaacttaagcctcttctattcttccagcttcctgaattgaaaatgccctgaaatgtgactagtttgcaaaatgattgtt

SEQ ID NO: 22613 - DNA, 201 bp, Homo sapiens; identical to SEQ ID NO: 3629

SEQ ID NO: 22614 - DNA, 201 bp, Homo sapiens; identical to SEQ ID NO: 3638

SEQ ID NO: 22615 - DNA, 201 bp, Homo sapiens; identical to SEQ ID NO: 3639

SEQ ID NO: 22616 - DNA, 201 bp, Homo sapiens; identical to SEQ ID NO: 3641

SEQ ID NO: 22617 - DNA, 201 bp, Homo sapiens
ctcatgttgccatcttgagatgttcaaaaaatttggggttagagcaactgttagcgtctctatgagcaatcagtagaacttacacatcctaggaaatcttyctttgtaagtaattcttttggtctcaagtgattctcttcatgttgtctcttgatgtacatacccccaagcaagttggggggactgtgatgacaattaaat

SEQ ID NO: 22618 - DNA, 201 bp, Homo sapiens
caaagtgctgggattgtaggtgtgagccaccgtgccccggctgagatcctgcatttctaaccaccttccccaggggtcgctgatcctgctggttgatagcygataccacaagtcattacaatgtcaaaatagaagtctgtttcccaagcacttacactgagccaagcattacataaatatattagagctaactttgcaggc

SEQ ID NO: 22619 - DNA, 201 bp, Homo sapiens
aatcaggctaatggataaagtctgtgtcttctaggaggctattttctggtagttagaaagctgacacagcttccttgacttccccaaggtaatgtgttgaratggagggcccctaaataaaggtaacaatttgacaggcttgtttttgactcattgatttatttaaagacagggtctcactccagttgccaagggtggagt

SEQ ID NO: 22620 - DNA, 201 bp, Homo sapiens
agatgttattagatgttttttgatgacacatacccttttttcttacatgatccagctgcaaaagtggtcaaggacacttgcttgggggaactgtatcctaraacattcctagtttgttttttgttttttgagacggagtcttgctctgtcgccaggctggagtgcagtggcgtaatctcggctcactgcaacctccgcctt

SEQ ID NO: 22621 - DNA, 201 bp, Homo sapiens
gcatagtctattcattctaaggcatagtggacatacggtttgctttgcctttctgtttggttatattgagaatgtttttctgggttactgtaaggtgtctmattatcatttataatggctatataatgaccctttgagtttcagtatctaaccaaaagttccaaaattggggtaatgattatttattttgaattcttaaaa

SEQ ID NO: 22622 - DNA, 201 bp, Homo sapiens
gacgtggggctggcccaggccagggttgctagctgcagctccgctgatacttccaactcttgtaatccagcaggggctccttcatcctgtggcagctgctkttgtcccatttgggctttggcccccagcaacttcactttcatccttggccttgtctctgaacttgtagaaataagaagtggccctacactacaggttgag

SEQ ID NO: 22623 - DNA, 201 bp, Homo sapiens
tacatagttttccaacactttcctcagccttttcccttctgtagagggaccaaggaatataagctttagatcccaaagaagattaggtggtcttctaaccyaaggatggaagcctttatttatttatttatttatttattttatttatttatttatttatttatttattttttgagatggagtcttgctctgtcgcccagg

SEQ ID NO: 22624 - DNA, 201 bp, Homo sapiens
gaaagcgtgtgttaaatgtttgtccacaggtcaggggttgctcattttatcatggtagtcctcatttgctactgcttttggtgggagagatgtatagagtygtgatttggaaaggtgctttgcatgcaaagttcagcctggttttaatgctaacatcaagattcaggggcatctgaaaacttgatgtgccttaattttttc

SEQ ID NO: 22625 - DNA, 201 bp, Homo sapiens
tgcttttggctctatttaattgcatgttacagaaaaacaggcaagaagaagccagagactgctttagtagagaagagccaggggctttgatgtcagacacyagaattcacgtcgtgataagtgactcagccttgctgagctttggtttcctcttctttaaaatggggccaatgatagtagttatttcatagggttgtcttg

SEQ ID NO: 22626 - DNA, 201 bp, Homo sapiens
agaaatgaagagttaaatgtggctagattggaggtttggtgcagggctaagagagtaatactcgcttagccaggaaaggatgcatttgttttacgcatttkgtgcgtctgaggggctggcaggccttgcacgtggcagtgtctatcctgtcagatttgggaggtcagctattaattagatcagctattaatcagactgttc

SEQ ID NO: 22627 - DNA, 201 bp, Homo sapiens
atgaagagttaaatgtggctagattggaggtttggtgcagggctaagagagtaatactcgcttagccaggaaaggatgcatttgttttacgcattttgtgygtctgaggggctggcaggccttgcacgtggcagtgtctatcctgtcagatttgggaggtcagctattaattagatcagctattaatcagactgttctcct

SEQ ID NO: 22628 - DNA, 201 bp, Homo sapiens
atatagaaaagtaaacagttacattacagtgtgctaagggctctgaaaagactaaatatgggtattcttggaacatggtcatgggatagggtcttggagtractagggaaggcttttcagtggaaggtatgtctaaattgcaaagagtttgggaggagccatcaagagacatccaggcagaaggaatgatatgtgtaaagg

SEQ ID NO: 22629 - DNA, 201 bp, Homo sapiens
aatcatcagcatggggcttggaggtttttaatctggggcccttgggtggcttcaggaggttcatgaaatgttatatgtctgtacatttgtctggaagatcmatagcttttatgattgcagagaggtctgtgacctaaaaattaaaactatctgttacactgatcagtcacagaagacgatgtgattgtataggaagtgtag

SEQ ID NO: 22630 - DNA, 201 bp, Homo sapiens
cctctttcatcgtacaagtaaggaagctggtcgactgtgcaagtttttactcagtagtaaaggcagagtgagggcccaaatcccagtatttaagccactcttatttccaccatgccactctgctgcctgaagatgaaatacatctctccaaaatgggtggtttgagaactgtgcaacaccagatttgaagtccctgcgtct

SEQ ID NO: 22631 - DNA, 201 bp, Homo sapiens
ctgattcataggtcaggagagggtaggtacctttattttattttatttttgagacagggtcttgctttgtcacccaggctgaagtgcagtggagcagtcgyggctcactacaaactccgcctcccgggttgaagcaattcacgtgcctcagcctcctgagtagctgggactgcaggcctgcaccagcatgcctggcaaact

SEQ ID NO: 22632 - DNA, 201 bp, Homo sapiens
ggcatgtgccactacgcccggctaatttttgtatttttagttgagatggggtttcgccatgttgtgctggctgatcccgaactgctgagctcaagtgatcygcccgcttcggccttccaaagtgctgggattacaggcatgagccactacacctggcctaatatattctttacttagattctattttgttagttactaaga

SEQ ID NO: 22633 - DNA, 201 bp, Homo sapiens
ggcatgagccactacacctggcctaatatattctttacttagattctattttgttagttactaagatcactatccagcttcctttcaaatcatatttacckgatacactcttccatcctttatctgcaacctttctgtgtgctttcatcccactcttcctaccctgacagtccccaagcagccactgatctgatctactcc

SEQ ID NO: 22634 - DNA, 201 bp, Homo sapiens
tcactatccagcttcctttcaaatcatatttacctgatacactcttccatcctttatctgcaacctttctgtgtgctttcatcccactcttcctaccctgmcagtccccaagcagccactgatctgatctactccctgtcactctaggttagtctgcactttctagagttgataaaaatgaaatcatacagtatgcactct

SEQ ID NO: 22635 - DNA, 201 bp, Homo sapiens
tgtattgattctcataactgaaaagctcagacgtatgatggttttcggctaagtttgatccagtgacaggtgtggcacctttaggacttggtctctttccrtcttctacctctttcttctcagacaggcctgctctgtatggtagcaagatagtctctagccaagtttacatcctactaagcccctgtttatcttgaaaaa

SEQ ID NO: 22636 - DNA, 201 bp, Homo sapiens
aagatatatattaatagatgccactccagagggctggctgaaaacaaccaagaactactgtgatgggtagatgctgtccttatgtggcatagatgtatccrtagggaaaagcagaataacagagcaggtcatcatcattaaatatttattgagtgcttactgtatgcaaggcactggggatacaaagaggtataattcatg

SEQ ID NO: 22637 - DNA, 201 bp, Homo sapiens; identical to SEQ ID NO: 3676

SEQ ID NO: 22638 - DNA, 201 bp, Homo sapiens; identical to SEQ ID NO: 3677

SEQ ID NO: 22639 - DNA, 201 bp, Homo sapiens; identical to SEQ ID NO: 3678

SEQ ID NO: 22640 - DNA, 201 bp, Homo sapiens
agataataggtatgcttaattttagatttttactggaatgaaaacaatgaaaacttctatagggaatttgtaaatcctaagaatatgtctgagaaacccayggagtctgcagacccccatttgagcaatattgctaaagagactttgttgcaaccaggtcaaaacccccatatccttagagaccatccctagaagattgct

SEQ ID NO: 22641 - DNA, 201 bp, Homo sapiens
cttgatgtcaggagtttgagaccagcctggccaacatggcgaaaccctgtctctactaaaataaactacaaaaattagccaggtgcagtggtgcgtgcctrtagtcccagctactcgggaggctgaagcaggggaattgcttgaacctcggaggcagaggttgcagcaagctgagatggtgccactgcattccagcctgga

SEQ ID NO: 22642 - DNA, 201 bp, Homo sapiens
atgcccaggccatgttttgggggagttggtttttttggtgtttttttttgtcatgctgctggaatggtgcctgtttatttccagcccccagattttaaggmtgaggaaagaatctctagaagacctcccaagagaacctcacatagaagtttccttgcccccttcttagtgtcccctgtaagcttctgacatcgcagactc

SEQ ID NO: 22643 - DNA, 201 bp, Homo sapiens
tgagcaatttgctggctcaatcctttatcctattgaaacctgtaagtaaggctcattggtttcctcagactgcttctaccactgaccattcccttaggcastttgagttgacaggatacgaaaccatcattaagcaattattcaagtccattttaaaacattttttaagaatgtgtaaagcggcggggcatggtggctcat

SEQ ID NO: 22644 - DNA, 201 bp, Homo sapiens
gtagtgttttcattatattctatataattctaattaattttgtttatgattttttaaccaaggaatttgttttaattttattgcattatagttggagaacwtagtctgaattatattgtttctttggaatctattgcaggtttctttatggactaatacaggtctggtttttgtttgtttgtttgttttgttttgttttgt

SEQ ID NO: 22645 - DNA, 201 bp, Homo sapiens
tctcacaagtttttggcatgtagtgttttcattatattctatataattctaattaattttgtttatgattttttaaccaaggaatttgttttaattttatygcattatagttggagaacatagtctgaattatattgtttctttggaatctattgcaggtttctttatggactaatacaggtctggtttttgtttgtttgt

SEQ ID NO: 22646 - DNA, 201 bp, Homo sapiens
ctatgcggaactaagtatgcctctttgaaatgccaaatgcctgtatcttttgtagcttgggctcaaattgatgaaattagaaattactgtatacatgtaaytcctcaggacagtgaggagctcctgccttgctttactgaattgtaaattgaaattctttcctcagatcattaaagacttttaccttctgggacgtggaga

SEQ ID NO: 22647 - DNA, 201 bp, Homo sapiens
tgcctgtttatttccagcccccagattttaaggctgaggaaagaatctctagaagacctcccaagagaacctcacatagaagtttccttgcccccttcttwgtgtcccctgtaagcttctgacatcgcagactccattgagctctgttgcttttcttttggagacagagtctcactctgttgaccaggctggagtgcagtg

SEQ ID NO: 22648 - DNA, 201 bp, Homo sapiens
ttttgttggttgttttcatagcatctctggaagttgatggtagaagaatccgatttactgggtcagctgaaggtaatggcttagctgttgtaattcttacrgtgatgctggtaggcagtgacttgcattctctgatgtttcctgagagcactggttgcctatacccagacttccagagtcaactcatttgttcttatccaa

SEQ ID NO: 22649 - DNA, 201 bp, Homo sapiens
actgtaatgaaatttgtccctgttttgttggttgttttcatagcatctctggaagttgatggtagaagaatccgatttactgggtcagctgaaggtaatgrcttagctgttgtaattcttacggtgatgctggtaggcagtgacttgcattctctgatgtttcctgagagcactggttgcctatacccagacttccagagt

SEQ ID NO: 22650 - DNA, 201 bp, Homo sapiens
ggtcctgttctctgtgggtgtacacctctagagggcaggagctatgtcaagctttcacctctagagggcaggagctatgtcaagctttcagtgaatttatyggtaattcatgtgaaataagttatggatttctcatcactagaaatattcaagtgaaggcaaggcctctaattggtttgtttgtataacttttaaaagaaa

SEQ ID NO: 22651 - DNA, 201 bp, Homo sapiens
agtaaatttttctatgtggggcaaggtatagtcttcttttaatacattgctggatttgtatggaaccattctttgcaggagttctcactgtaatgaaattygtccctgttttgttggttgttttcatagcatctctggaagttgatggtagaagaatccgatttactgggtcagctgaaggtaatggcttagctgttgtaa

SEQ ID NO: 22652 - DNA, 201 bp, Homo sapiens
tcgaagaccctagtttttagtagtttttatttattcattcatttaacaatatctgcttggttatcatgttaagtgtcaggaatgcaaaagtatgactctgyctttaaacacctcctggtccagaaggtagaggaaatgttcatagatgttcccaagaatgttgttggggtaagaaaaaaagtgctgtggatgtttgcaggt

SEQ ID NO: 22653 - DNA, 201 bp, Homo sapiens
gctttgctaagcactgagggaatattactaattaattttgctttacattatttttcgaagaccctagtttttagtagtttttatttattcattcatttaamaatatctgcttggttatcatgttaagtgtcaggaatgcaaaagtatgactctgcctttaaacacctcctggtccagaaggtagaggaaatgttcatagat

SEQ ID NO: 22654 - DNA, 201 bp, Homo sapiens
ctgtatacatgtaattcctcaggacagtgaggagctcctgccttgctttactgaattgtaaattgaaattctttcctcagatcattaaagacttttacctyctgggacgtggagaactgtttcaggccttcattgacacagctcaacacatgttgaaaacaccacccactgcagtaactgagcatggtaattgtcagtggc

SEQ ID NO: 22655 - DNA, 201 bp, Homo sapiens
ttctcatgcctcagcccccctgagtagctgggactacaagtgcgtgccaccatgcccagctaatttatgtatttttagtagagatggggtttcactgtatygcccagactggtcttgaactcctgtgagctctagtttcattaatgttattcacttgttgagtctctggttctagattaaccaagttgttatcttttcttt

SEQ ID NO: 22656 - DNA, 201 bp, Homo sapiens
cacaaggtattgctagatgatgacaaccttctccctctgttgcacttgacaatcgagtatcacggaaaggagcacaaaggtttgccattcctccctgccaycttagagttcctgctggtcatcatccattttcccatctctgcttccatcccccgccacagaaaccatatgattttggatcttagaaatcagctagtacag

SEQ ID NO: 22657 - DNA, 201 bp, Homo sapiens
tggcagtgtctatcctgtcagatttgggaggtcagctattaattagatcagctattaatcagactgttctcctaacactttaacttcatggatgtaccttycttcctttcctaatgccaactctgtttcccgggtaggtgtttcactgcctgaatgaaatcctagatctctgtcacagtttttgttcgctggtcagtcaga

SEQ ID NO: 22658 - DNA, 201 bp, Homo sapiens
aaattaaaatagcacaattatttttaacttaattggttatttctgttatgactcatcaaattctcaggcctctgtttatcctgtaacagtttaaagcatgrcttctgagcctcttactttctactctgcccagaatcctggccgtttgtcatggggtcatgtataaacagctctcagcctggatgctccatggactcctct

SEQ ID NO: 22659 - DNA, 201 bp, Homo sapiens
tctcagcactttgggagggtgaggctggaggatcagttaatgccaggagtttgaggctagcctgcgcaacagagcaagactccatctctacaaaaaaaaawtttttaattagctgggcatggtgacacatgcctgtagtcctagctactctggtggctgaggtgggagaattggttgaacctaggggttcaaggttacagt

SEQ ID NO: 22660 - DNA, 201 bp, Homo sapiens
tagggggattgcagatggctgaatcttcctccctgccagaatagtggtagagaaactagtgtaccaaggctcttcagagtttttaaaatcaggtggtcaarattctaggtttgggttgagaatggagattgattgcagacaggcacaaaggcgctttttggagtagtggaaatgttataaaactggattgtggtaatggtt

SEQ ID NO: 22661 - DNA, 201 bp, Homo sapiens
tggtaatggttgcccagtgtttgaaatttactaaaaattgtttattagtatgcttaaaatgggtgaatttcattgtaaattatacctcaaagtggtaaaartaaaagtctggggaccgggcatggtggctcacgcctgtaatcccagcacttcgggaggccgaggcgggcggaccacgaggtcaggagattgagtccatcc

SEQ ID NO: 22662 - DNA, 201 bp, Homo sapiens
agcttggtggactttgaacaggtggtggatcgcattcgcagcactgtggctgaggtttgtgtttcatcgtatatatatatatatatatatatatatatatwtttttttttttttttttttttttcttaggcaaaattggactagtttcctagaaattgagttacttggtcgggcgcagtggctcacgcatgcagtctcaac

SEQ ID NO: 22663 - DNA, 201 bp, Homo sapiens
catagatgtccactgtacttatatagtacaaatataagtacttgtggttgcaaatatcagaaaatccaattcaaactcacttaagcaaagcaaaaggaaagaaataatgtattgattctcataactgaaaagctcagacgtatgatggttttcggctaagtttgatccagtgacaggtgtggcacctttaggacttggtct

SEQ ID NO: 22664 - DNA, 201 bp, Homo sapiens
tggcctggcttggtcatgttaatatccctaaacaatatagcataacaaagtagagtattacattccatttgatcatgcctacatcacccagctacccctakaatcaggtgttgtctagcactaacccactggaaatatgtgaactgtactgaatagggatgattctccaaggaaaatcaagaggcagtttgtcagcaagaa

SEQ ID NO: 22665 - DNA, 201 bp, Homo sapiens
agtatttctgagtttctcacaggtaaatatgacccaccttacttgtaagggaagaaactagcaggaacagaattagtgggaaagcaaggtgtggtggcacwcacctgtaatcccagctagtccagagcctgagcaggaggatcccttaagcccaggatttcaaatccatcctgggcaacatagtaagacccccatctcata

SEQ ID NO: 22666 - DNA, 201 bp, Homo sapiens
acacctgtaatcccagctagtccagagcctgagcaggaggatcccttaagcccaggatttcaaatccatcctgggcaacatagtaagacccccatctcataaaaaaaaaaaaaaaaattaatgggagcaagagagccacccaactagtttttaacaatctgtaaatcaaaaattgtaaacccttatgccttcaggggctag

SEQ ID NO: 22667 - DNA, 201 bp, Homo sapiens
atcctcatcaacaatctattatttattgttgacttgccccttatttttattgtttgctataacttctggaatcctgtaggtgaccaagtcagtcagtagasggaatgtggccatgagtggattaggatggggcaggggaggctgggcgcagtggctcacacctgtaatcccagcactttgggaggctgagccaaacagatc

SEQ ID NO: 22668 - DNA, 201 bp, Homo sapiens
gaggcaggagaattgcttgaaccctggtatgtggaagttgcagtgagccaggatcgcaccactgcactccagcctgggtggcagagcaagactccgtctcaaaaaaaaaaaaaggaaaaagagaaaaggatggggcaggggagagtggtcagccaggacgttggagggagggggttcagaattatgcaaataacttcctac

SEQ ID NO: 22669 - DNA, 201 bp, Homo sapiens
cttttgcatctttccaataagtacaccaaaagattctgatagttggctgggcacggtggctcacacctgtaatcccagcactttgggaggccgaggcgggyggatcacgaggtcaggagatcaaggccatcctggctaacacggtgaaactccgtctctactaaaaatacaaaaacattagcccagcgtggcggcgggcgc

SEQ ID NO: 22670 - DNA, 201 bp, Homo sapiens
gaaagcatgacacttaataaggctctttttctcttttgtagtttcgggatgtgaaaatttctggctcataaattgaaataacagccacgttcccaaggttrtaacagaagattcaaaacatcccattctagccacacacaaataaatatctgcggcttagtgataggactctaccttttctcctagaagcagttactgaac

SEQ ID NO: 22671 - DNA, 201 bp, Homo sapiens
atgtattgctatgctgggaggcagtgggccttccactcccaattctgatatgaactagctgtgcagccgtgggcaccccgccttgctggtccctagcttcygcatctgtgaaaggaggcgaccaccccttctaactctaaactttaaaaaaaactgataccgagattcagtggtagctggcttcccagaggtctgtcattc

SEQ ID NO: 22672 - DNA, 201 bp, Homo sapiens
gaaaaaaagaaaaataaaagaaaaagggattctcttatagaacatcaattccatattacacccaagaaagttaacattaattcagtaatactatatccaartttttctagttgtccctcagaattccttcatagctgttctttttttgcaatccaggatccgatcagtgttcacatactacattttgttctcatgtctttt

SEQ ID NO: 22673 - DNA, 201 bp, Homo sapiens
ctctactgaaaatacaaaaattagtcgggtgtggtggcatgcacctgtagtcccagctacttacgaggctgaggcaggagaatcgcttgaacccgggaggyggaggttgcagtcagccgagatcacaccattgcactccaacctgggcaacagagcaagactctgtctccaaaaaaaaaaaaaaaaaaaaaaaagacactg

SEQ ID NO: 22674 - DNA, 201 bp, Homo sapiens
aaatgatctctggtagtttctaatggaacggttatgcctcctctgacatgagctggttgttattcctcagtgtgctacagcacagctgttacagacttttwaaaaatgttctggtgtttagggctatttctgctgtaccaggaagagtaagatatatattaatagatgccactccagagggctggctgaaaacaaccaaga

SEQ ID NO: 22675 - DNA, 201 bp, Homo sapiens
cttgccaaaaattttctgagaaacaaacaggtgaataaaagataaattttataggctgggcatggtggctcacacctgtaatcccagcactttgggaggcygaggcgggcagatcacaaggttaggagatcaagaccatcctggccaacatggcaaaaccccgtctctactaaaaatgcaaaaattaactgggcatggtgg

SEQ ID NO: 22676 - DNA, 201 bp, Homo sapiens
agtctcgctctgtcgcccaggctggagtgcagtggtgcaatctcggctcactgcaagctccacctcctgggttcacgccattctcctgcctcagcctcccragcagctgggactacaggcgcctgccgccacacccggctaatttttttgtagtttttttagtaaagatggggtttcaccgtgttagccaggatggtctcg

SEQ ID NO: 22677 - DNA, 201 bp, Homo sapiens
gactacaggcgcctgccgccacacccggctaatttttttgtagtttttttagtaaagatggggtttcaccgtgttagccaggatggtctcgatctcctgayctcgtgatccgcccacctcggcctcccaaagtgctgggattacaggcgtgagccactgcgcccggcaagagaccaggttcttaagcaccgtgttgtgcaa

SEQ ID NO: 22678 - DNA, 201 bp, Homo sapiens
cctagctgcacgtctcagttggccttcaacttccgctggctataggaaggagagtggaaaatagggggattgcagatggctgaatcttcctccctgccagratagtggtagagaaactagtgtaccaaggctcttcagagtttttaaaatcaggtggtcaaaattctaggtttgggttgagaatggagattgattgcagac

SEQ ID NO: 22679 - DNA, 201 bp, Homo sapiens
gtaaaaataaaagtctggggaccgggcatggtggctcacgcctgtaatcccagcacttcgggaggccgaggcgggcggaccacgaggtcaggagattgagwccatcctggctaacacagtgaaaccctgtctctactaaaaatacaaaaaaaattagccaggcgtggtggcgggtgcctgtgtcgcactactcgggaggct

SEQ ID NO: 22680 - DNA, 201 bp, Homo sapiens
cttttcttgcttcacactgcatctcgatgtgtactctttccttgactagcgcctgattgaggaagagaacatgctggcaccatctctgaagcagttttccstacgagtggagattttgccatcctacattccagtgagggttgctgaaaaaatcctatttgttggagaatctgtccagatgtttgagaatcaaaatgtgaa

SEQ ID NO: 22681 - DNA, 201 bp, Homo sapiens
agctgcaccgtctcaagcagcagccactcttcagcttggtggactttgaacaggtggtggatcgcattcgcagcactgtggctgaggtttgtgtttcatcrtatatatatatatatatatatatatatatatatttttttttttttttttttttttcttaggcaaaattggactagtttcctagaaattgagttacttggt

SEQ ID NO: 22682 - DNA, 201 bp, Homo sapiens
actcctggtgcacagtcttcttcattttgaattgtgctggtgccaccgacttaaattgtgaccagtaatttttcaaaggagcatatatgttctgtggcttrtattaacatttgtctcatggatatgtgataacacgaaatgagacatttagtcagctgtgttgttaactatattcctggctttcaacattggctaagcata

SEQ ID NO: 22683 - DNA, 201 bp, Homo sapiens
tgtgaacttacgacttgtacttttctgtatgtattttggtacttcaacaaaaggttttaaaaattctgaggtacttaatagttttcattttaattatgtckttagtttttactgcttacatagagaaatggtggtattactttttgtggttaatcttataacttgcaacgtgttgaactctttttagttgtaatagtctga

SEQ ID NO: 22684 - DNA, 201 bp, Homo sapiens
aatttaaaaaaaatttgtagagacagcttctcgctctgtcacccaagctggagagcagtggtgcaatgatgagtcactgcagcgcgatctccaggctcaawcaattttcccatctcagcctcccaagtagctgggactagaggtgcatgccaccatgcccagctaattcttttcttttttttttcttttcttttcttcttt

SEQ ID NO: 22685 - DNA, 201 bp, Homo sapiens
gccttccaaagtacagggattataggcatgagcctcagcacctggcctttcattttctttttttcccccagagacagggtcttgttctatctcccaggctkgagtgcagtgatgtcatcatagctcaccataatcttgaactcttagggtaaagcaatcctcctccctcagcctcctgagtagctagtattacaggtgcaa

SEQ ID NO: 22686 - DNA, 201 bp, Homo sapiens
actacaagtttctatttgataaaatggtggggtttgggaaaattcaggagttatatcaccaagcatgtttcttaaaataaaaaaagcattttattttattktattttattattttttagagacagggtctttctctgtttcccaggctggaatgcagtggtacagtcatagctcactgaagcctcaagctcctggactcaa

SEQ ID NO: 22687 - DNA, 201 bp, Homo sapiens
tccccctgcctcagcctctcaagtagctatgactacagatacatgccaccacacccagctggtttgtttttattttttgtagagatggattctcactttgytgcccaggctggtctcaaactcctggcttcagcgaggtgtcatgggtcacgtctgtaatctcagcactttgggaggctgagatgggcggatcacttgagg

SEQ ID NO: 22688 - DNA, 201 bp, Homo sapiens
tgtgcccaccatcacacctggctaattttttgtatttttggtagagacaggatttcacagtgtccagccaggatggtctcgatctcctgacctagtgatcygcccgcctcggcctcccaaagtgctgggattacaggtgtgagccaccatgcccagccttttttttttttttttaacatagtgaggctcatgagggacttg

SEQ ID NO: 22689 - DNA, 201 bp, Homo sapiens
agcctcctgagtagctggggttacaggcatgtgccactacgcccggctaatttttgtatttttagttgagatggggtttcgccatgttgtgctggctgatmccgaactgctgagctcaagtgatctgcccgcttcggccttccaaagtgctgggattacaggcatgagccactacacctggcctaatatattctttactta

SEQ ID NO: 22690 - DNA, 201 bp, Homo sapiens
gcccagactggtcttgaactcctgtgagctctagtttcattaatgttattcacttgttgagtctctggttctagattaaccaagttgttatcttttctttytttcttttcttttatcacagcagatgctactcaggcaagagaagggccttctcgggaaacttctccccgggaagcccctgcatctggctgggcagcccta

SEQ ID NO: 22691 - DNA, 201 bp, Homo sapiens
tgttatcttttctttttttcttttcttttatcacagcagatgctactcaggcaagagaagggccttctcgggaaacttctccccgggaagcccctgcatcyggctgggcagccctaggtctttcctacaaagtacagtggccactacatattctcttcaccccagctgtcctggaaaagtgagtatttctgagtttctcac

SEQ ID NO: 22692 - DNA, 201 bp, Homo sapiens
caaggtgtggtggcacacacctgtaatcccagctagtccagagcctgagcaggaggatcccttaagcccaggatttcaaatccatcctgggcaacatagtragacccccatctcataaaaaaaaaaaaaaaaattaatgggagcaagagagccacccaactagtttttaacaatctgtaaatcaaaaattgtaaaccctta

SEQ ID NO: 22693 - DNA, 201 bp, Homo sapiens
aaaaaaaattaatgggagcaagagagccacccaactagtttttaacaatctgtaaatcaaaaattgtaaacccttatgccttcaggggctagactgatcamattaataagtgaagccacagatatgagacacggagttggaatcagtgggagggcatatctacttcaaaccatcatttttttaaattgccaaataataagc

SEQ ID NO: 22694 - DNA, 201 bp, Homo sapiens
aatcctgtgtcctcattattcaccttcagtaaccagcaacattatactacttttatctgtccctcccccacttttttgctagagctgtataaagcaaatcmcagtcatttcattctgccaataaacaattgaaaaaggcatatttcaacagaactacaatgccattatcacatccagtaaaattaacagtagtcccttata

SEQ ID NO: 22695 - DNA, 201 bp, Homo sapiens
ccccacttttttgctagagctgtataaagcaaatcacagtcatttcattctgccaataaacaattgaaaaaggcatatttcaacagaactacaatgccatyatcacatccagtaaaattaacagtagtcccttataatcccttataatatccagtctacattgaaatttctccagttatctaaaaattatctttatgtttg

SEQ ID NO: 22696 - DNA, 201 bp, Homo sapiens
acagatacatgccaccacacccagctggtttgtttttattttttgtagagatggattctcactttgttgcccaggctggtctcaaactcctggcttcagcraggtgtcatgggtcacgtctgtaatctcagcactttgggaggctgagatgggcggatcacttgaggtcaggagtttgagaccagcctggccagcatggtg

SEQ ID NO: 22697 - DNA, 201 bp, Homo sapiens
agtgcttactgtatgcaaggcactggggatacaaagaggtataattcatggctctgcccttaaggagctcacaatctagttggaaaaacaagacatatatwtatatatacatacaaaaatcagtaacaacacagaggcctgaacaattgccaagtggacaacagtacagataataaagaagcaagaaacgagggttcacta

SEQ ID NO: 22698 - DNA, 201 bp, Homo sapiens
atgcactcttttggaggaggagaccaggcttcttttactcagcataattattttgagatgaacccatgttgcatttatcaatggtttattcctttatattrcttactagtattctattgtttataccagtgtgtttatccattcatccttgataaatatttgggtggcttcccaatgtcttttttttttttttttaagacg

SEQ ID NO: 22699 - DNA, 201 bp, Homo sapiens
cttggtggactttgaacaggtggtggatcgcattcgcagcactgtggctgaggtttgtgtttcatcgtatatatatatatatatatatatatatatatatwtttttttttttttttttttttcttaggcaaaattggactagtttcctagaaattgagttacttggtcgggcgcagtggctcacgcatgcagtctcaacac

SEQ ID NO: 22700 - DNA, 201 bp, Homo sapiens
ttctctctctctctcattcactcattcaccacatcttgtttgtgtctcttgtgaacactttgatgaccttctggaaacatgatcacagcatctcccaggamtatgcctcacagtgtcctctacggaaggaactgaacccagtccctcttgttgcaagttagagaattctagggaattatctaggttttgattggcccagcc

SEQ ID NO: 22701 - DNA, 201 bp, Homo sapiens
tcatgttaagtgtcaggaatgcaaaagtatgactctgcctttaaacacctcctggtccagaaggtagaggaaatgttcatagatgttcccaagaatgttgytggggtaagaaaaaaagtgctgtggatgtttgcaggtgagaggaacctgcagtaaggttttagaactgttgggtgtgaagcagaaagttaattcttagga

SEQ ID NO: 22702 - DNA, 201 bp, Homo sapiens
ctagtgtgcacttcctgagatctgcgcccttgtcacctgcatcttccatgccatgtgtccgtatcctctcgctctactaacatctcgcttgcccatccttmctgcacactccatggcgttccgcagtctccctgaggcagcggagctctatgcagcccctggggcccctctggtcacaccctccaccgcagtgttttggac

SEQ ID NO: 22703 - DNA, 201 bp, Homo sapiens; identical to SEQ ID NO: 3723

SEQ ID NO: 22704 - DNA, 201 bp, Homo sapiens; identical to SEQ ID NO: 3724

SEQ ID NO: 22705 - DNA, 201 bp, Homo sapiens; identical to SEQ ID NO: 3738

SEQ ID NO: 22706 - DNA, 201 bp, Homo sapiens; identical to SEQ ID NO: 3707

SEQ ID NO: 22707 - DNA, 201 bp, Homo sapiens; identical to SEQ ID NO: 3726

SEQ ID NO: 22708 - DNA, 201 bp, Homo sapiens
gctgctcctatgctgggggtgagcagggcagtgagtttttgccaagtaagggaaggtgggggacactatggaaaagaagggaggaaagggtcactaagacstggcacgcgcctccttacagaccaaccggtttgcagtgggctcccccaccctattccctgcggctagctttagaatgggactctaaacccccctttctgg

SEQ ID NO: 22709 - DNA, 201 bp, Homo sapiens; identical to SEQ ID NO: 3685

SEQ ID NO: 22710 - DNA, 201 bp, Homo sapiens; identical to SEQ ID NO: 3728

SEQ ID NO: 22711 - DNA, 201 bp, Homo sapiens
gtcaacgctcactcagaggcagtagtggaacacagtccctatttattaaaggatgggccttttctaagggcagcagagctgcttctgagaccatgaggtgscccttccccctcacctaccttccctttatgttctcacatcagacatatcttatctcccttctaggtgactctgatccctactcatgacacggaggtgact

SEQ ID NO: 22712 - DNA, 201 bp, Homo sapiens
acataagttgggagcatgttcttgaggtactgaggggccattcattgcctttccctggatttcctatatctgtgaccactccccttcttccattccaggtwcatcatcttcttagcagctcatcagcttataaactactaatcttgagtgggcaaagtttagagcctgggggagacctcatcctacagagtggcacctact

SEQ ID NO: 22713 - DNA, 201 bp, Homo sapiens; identical to SEQ ID NO: 3725

SEQ ID NO: 22714 - DNA, 201 bp, Homo sapiens; identical to SEQ ID NO: 3705

SEQ ID NO: 22715 - DNA, 201 bp, Homo sapiens; identical to SEQ ID NO: 3740

SEQ ID NO: 22716 - DNA, 201 bp, Homo sapiens; identical to SEQ ID NO: 3746

SEQ ID NO: 22717 - DNA, 201 bp, Homo sapiens; identical to SEQ ID NO: 3748

SEQ ID NO: 22718 - DNA, 201 bp, Homo sapiens; identical to SEQ ID NO: 3722

SEQ ID NO: 22719 - DNA, 201 bp, Homo sapiens; identical to SEQ ID NO: 3699

SEQ ID NO: 22720 - DNA, 201 bp, Homo sapiens; identical to SEQ ID NO: 3680

SEQ ID NO: 22721 - DNA, 201 bp, Homo sapiens
caagccagcgtcccctgcacggcgtctggatcttcggggaaaacgctcacccacccctggtaaagggcctgcagatcgagcatcccgggccccacctcgaycacgcagcaccacaagccaggtcaccccagcagaggaaaaggatggacacagccccatgtccaaaggcctagtcaatggactcaaggcaggaccaagtaa

SEQ ID NO: 22722 - DNA, 201 bp, Homo sapiens
atctaagctgacgtattgtctccagcccactctggaggtgttatgagggacataagttgggagcatgttcttgaggtactgaggggccattcattgccttkccctggatttcctatatctgtgaccactccccttcttccattccaggttcatcatcttcttagcagctcatcagcttataaactactaatcttgagtggg

SEQ ID NO: 22723 - DNA, 201 bp, Homo sapiens
agcatgttcttgaggtactgaggggccattcattgcctttccctggatttcctatatctgtgaccactccccttcttccattccaggttcatcatcttctkagcagctcatcagcttataaactactaatcttgagtgggcaaagtttagagcctgggggagacctcatcctacagagtggcacctactcatatgaaaact

SEQ ID NO: 22724 - DNA, 201 bp, Homo sapiens
gcagctcatcagcttataaactactaatcttgagtgggcaaagtttagagcctgggggagacctcatcctacagagtggcacctactcatatgaaaacttkgcccaggtccttcacaaccccgaggtaagttccatgccagagtgtctgggagaaagggtagcactagagctgtgggagggatctaagggaaagtctcata

SEQ ID NO: 22725 - DNA, 201 bp, Homo sapiens; identical to SEQ ID NO: 3736

SEQ ID NO: 22726 - DNA, 201 bp, Homo sapiens; identical to SEQ ID NO: 3706

SEQ ID NO: 22727 - DNA, 201 bp, Homo sapiens; identical to SEQ ID NO: 3737

SEQ ID NO: 22728 - DNA, 201 bp, Homo sapiens; identical to SEQ ID NO: 3694

SEQ ID NO: 22729 - DNA, 201 bp, Homo sapiens; identical to SEQ ID NO: 3739

SEQ ID NO: 22730 - DNA, 201 bp, Homo sapiens; identical to SEQ ID NO: 3727

SEQ ID NO: 22731 - DNA, 201 bp, Homo sapiens; identical to SEQ ID NO: 3681

SEQ ID NO: 22732 - DNA, 201 bp, Homo sapiens; identical to SEQ ID NO: 3716

SEQ ID NO: 22733 - DNA, 201 bp, Homo sapiens; identical to SEQ ID NO: 3730

SEQ ID NO: 22734 - DNA, 201 bp, Homo sapiens; identical to SEQ ID NO: 3684

SEQ ID NO: 22735 - DNA, 201 bp, Homo sapiens; identical to SEQ ID NO: 3708

SEQ ID NO: 22736 - DNA, 201 bp, Homo sapiens; identical to SEQ ID NO: 3742

SEQ ID NO: 22737 - DNA, 201 bp, Homo sapiens; identical to SEQ ID NO: 3717

SEQ ID NO: 22738 - DNA, 201 bp, Homo sapiens
cagcaccacaagccaggtcaccccagcagaggaaaaggatggacacagccccatgtccaaaggcctagtcaatggactcaaggcaggaccaagtaagtatrtcatgaaacttggcagagagtgtgggttagggctgggtgtgggctggtcagacttcaggagtgggacagaggggaaggttgccaaaagggttctactttt

SEQ ID NO: 22739 - DNA, 201 bp, Homo sapiens; identical to SEQ ID NO: 3729

SEQ ID NO: 22740 - DNA, 201 bp, Homo sapiens; identical to SEQ ID NO: 3731

SEQ ID NO: 22741 - DNA, 201 bp, Homo sapiens; identical to SEQ ID NO: 3693

SEQ ID NO: 22742 - DNA, 201 bp, Homo sapiens; identical to SEQ ID NO: 3700

SEQ ID NO: 22743 - DNA, 201 bp, Homo sapiens; identical to SEQ ID NO: 3701

SEQ ID NO: 22744 - DNA, 201 bp, Homo sapiens; identical to SEQ ID NO: 3695

SEQ ID NO: 22745 - DNA, 201 bp, Homo sapiens; identical to SEQ ID NO: 3710

SEQ ID NO: 22746 - DNA, 201 bp, Homo sapiens; identical to SEQ ID NO: 3718

SEQ ID NO: 22747 - DNA, 201 bp, Homo sapiens; identical to SEQ ID NO: 3696

SEQ ID NO: 22748 - DNA, 201 bp, Homo sapiens; identical to SEQ ID NO: 3682

SEQ ID NO: 22749 - DNA, 201 bp, Homo sapiens; identical to SEQ ID NO: 3688

SEQ ID NO: 22750 - DNA, 201 bp, Homo sapiens
ctccttgagaagagggttgtttgtggatagctgttgacatgcactaaagaaatgagggactcctcttagtgatcaatcatctctcacgcaaaaattcactstcttcatttgtgttcccctttctgcataccccgggtctccctgcttccctttacagacaccccagaatcccccattcatcttccttgacccttgtttagc

SEQ ID NO: 22751 - DNA, 201 bp, Homo sapiens; identical to SEQ ID NO: 3709

SEQ ID NO: 22752 - DNA, 201 bp, Homo sapiens
aaggaagtgctaccactctccagattcttcctttgagtcctagagcgctttactaaatctgagatggaggtagagactaagggaaacaggatcaacattasaaagatccaaataatataatatagaaacagcaaagagacaaggagagagcaagaacccaatcaccctacaaagtcattatagggtttttttaatctaaag

SEQ ID NO: 22753 - DNA, 201 bp, Homo sapiens
ctgaaagtcctcaccatccctggagaatccacgtccctatcttgctgtatcttctttatggtccctgaaccagcacggggagctttctgaacgccccgtayaaatctcaaatctctgaatgccagtagccaaccactaagtgaccttcgtggctaccagctcctaagtcctcacctccttccccagtgctgtgcctgtggc

SEQ ID NO: 22754 - DNA, 201 bp, Homo sapiens
tcaattctcaagtaaatagaagggaacccttgaattcccctttggcccaacccacgctgtatggggtttggtcttctgacaccatcgttcatttcccccayagctgcatctgcagccctgtgctgccagatctgcctgatcctggcaccatggctctgcctcttaacaaaggccctggccccaggcttctcttgtccaagc

SEQ ID NO: 22755 - DNA, 201 bp, Homo sapiens
cacagaagctcctatttccttatttctagacactctgcgggcaggaaagcccagggcagaggcaagccaggaaggagaaagggaagtgagggtcatcatcscaggggccctctctccagctgagccccccatccccaggcagcaccaggagcttagtgctcgagaaggacaaaagcttcttgtcaatagggcagtctgagg

SEQ ID NO: 22756 - DNA, 201 bp, Homo sapiens
gcacatctagaactagcccagtggcagtaggcaggatggggaaatggagagagaagatgaacgttactggctgtgggcccagcctggacccagaaccagasgccaccaggggctgtgacagtccacctctccagctgggcggggatgggagaaatcagcctgggacagcagcagagggtggtgccactggctctgcctgac

SEQ ID NO: 22757 - DNA, 201 bp, Homo sapiens
tcaatagggcagtctgaggccatagttccaggcagagggatgggggcacaggcagcagagggtgtggtagatgaagggaaggagaggacagccagtgtggragaggggaggtggaaaccctctaagggaagggctggatgagccagttcctagaccttactcagcagtatccaaggtggcagggcctaaggataccttctc

SEQ ID NO: 22758 - DNA, 201 bp, Homo sapiens
gagtgtctgggagaaagggtagcactagagctgtgggagggatctaagggaaagtctcatattgcatgaccatggggggccctggcagaaaggtaagagtscaccttggaaagaggtgaagattagggtactgaatctaagtcagaccaaaacaactctagtgacctgatcaggtttctatctcctattcttctagatttc

SEQ ID NO: 22759 - DNA, 201 bp, Homo sapiens
gccccccatccccaggcagcaccaggagcttagtgctcgagaaggacaaaagcttcttgtcaatagggcagtctgaggccatagttccaggcagagggatrggggcacaggcagcagagggtgtggtagatgaagggaaggagaggacagccagtgtgggagaggggaggtggaaaccctctaagggaagggctggatgag

SEQ ID NO: 22760 - DNA, 201 bp, Homo sapiens; identical to SEQ ID NO: 3686

SEQ ID NO: 22761 - DNA, 201 bp, Homo sapiens; identical to SEQ ID NO: 3732

SEQ ID NO: 22762 - DNA, 201 bp, Homo sapiens; identical to SEQ ID NO: 3733

SEQ ID NO: 22763 - DNA, 201 bp, Homo sapiens; identical to SEQ ID NO: 3687

SEQ ID NO: 22764 - DNA, 201 bp, Homo sapiens
acatcactgaggctgatcatggcaactatccatataccctccctctccttacctgttctgtgaacttgaaagtgttcctgcagtctcaccaccctacaacmtgcaaccttatccagaaccttctttgtttttctcccacagggattctctcctggaacattgacctgtcatcctttgacttgaaccaacagttgagactct

SEQ ID NO: 22765 - DNA, 201 bp, Homo sapiens; identical to SEQ ID NO: 3702

SEQ ID NO: 22766 - DNA, 201 bp, Homo sapiens; identical to SEQ ID NO: 3744

SEQ ID NO: 22767 - DNA, 201 bp, Homo sapiens
ctgcagatcgagcatcccgggccccacctcgaccacgcagcaccacaagccaggtcaccccagcagaggaaaaggatggacacagccccatgtccaaaggmctagtcaatggactcaaggcaggaccaagtaagtatatcatgaaacttggcagagagtgtgggttagggctgggtgtgggctggtcagacttcaggagtg

SEQ ID NO: 22768 - DNA, 201 bp, Homo sapiens
tggtcaagtctggtaaaagctttcaaaggtgatttttgcaccaggtagtctctccagtggtgactttctaacccctacaaaaaatctggatcttccgagcrttctaatacaaattcagaaacaattaggacagtggaaaactgagtttcaataactctctgattcttttactattggatacctataggaaatagaaggggg

SEQ ID NO: 22769 - DNA, 201 bp, Homo sapiens
tgtgaggttaatgccactatgtactgcaattggaaaggggatttggcaaggaagggcgggtgcaggggatggcagcattcttcttcagcatcttctgtctsatttgccactttctttctttgctgaattgtttggtgtttcatgtgaggctggagaagggaaataggggatttggggatgccttatctttctccatggcct

SEQ ID NO: 22770 - DNA, 201 bp, Homo sapiens
cagcaccaggagcttagtgctcgagaaggacaaaagcttcttgtcaatagggcagtctgaggccatagttccaggcagagggatgggggcacaggcagcasagggtgtggtagatgaagggaaggagaggacagccagtgtgggagaggggaggtggaaaccctctaagggaagggctggatgagccagttcctagacctt

SEQ ID NO: 22771 - DNA, 201 bp, Homo sapiens
gcccaggtccttcacaaccccgaggtaagttccatgccagagtgtctgggagaaagggtagcactagagctgtgggagggatctaagggaaagtctcataytgcatgaccatggggggccctggcagaaaggtaagagtccaccttggaaagaggtgaagattagggtactgaatctaagtcagaccaaaacaactctagt

SEQ ID NO: 22772 - DNA, 201 bp, Homo sapiens; identical to SEQ ID NO: 3747

SEQ ID NO: 22773 - DNA, 201 bp, Homo sapiens
tcttcctgatgtgactggcttcctgtaaagcaggctactcactcttttgagaatgtttctgtttagaattactcatgtcatggcttcctccatttatcccyaatgatgaaaatcggcagttttaccacttagtactcctaggagctttggtgaaaggccagatacagggatgacagaggatgaaattaatgactgaacaga

SEQ ID NO: 22774 - DNA, 201 bp, Homo sapiens; identical to SEQ ID NO: 3743

SEQ ID NO: 22775 - DNA, 201 bp, Homo sapiens; identical to SEQ ID NO: 3683

SEQ ID NO: 22776 - DNA, 201 bp, Homo sapiens; identical to SEQ ID NO: 3711

SEQ ID NO: 22777 - DNA, 201 bp, Homo sapiens; identical to SEQ ID NO: 3703

SEQ ID NO: 22778 - DNA, 201 bp, Homo sapiens; identical to SEQ ID NO: 3689

SEQ ID NO: 22779 - DNA, 201 bp, Homo sapiens; identical to SEQ ID NO: 3712

SEQ ID NO: 22780 - DNA, 201 bp, Homo sapiens; identical to SEQ ID NO: 3690

SEQ ID NO: 22781 - DNA, 201 bp, Homo sapiens; identical to SEQ ID NO: 3734

SEQ ID NO: 22782 - DNA, 201 bp, Homo sapiens; identical to SEQ ID NO: 3719

SEQ ID NO: 22783 - DNA, 201 bp, Homo sapiens; identical to SEQ ID NO: 3697

SEQ ID NO: 22784 - DNA, 201 bp, Homo sapiens; identical to SEQ ID NO: 3691

SEQ ID NO: 22785 - DNA, 201 bp, Homo sapiens; identical to SEQ ID NO: 3698

SEQ ID NO: 22786 - DNA, 201 bp, Homo sapiens; identical to SEQ ID NO: 3720

SEQ ID NO: 22787 - DNA, 201 bp, Homo sapiens; identical to SEQ ID NO: 3735

SEQ ID NO: 22788 - DNA, 201 bp, Homo sapiens; identical to SEQ ID NO: 3692

SEQ ID NO: 22789 - DNA, 201 bp, Homo sapiens; identical to SEQ ID NO: 3721

SEQ ID NO: 22790 - DNA, 201 bp, Homo sapiens
tctacaatgaatcctggcttgtctctacagtggccttgagttccaagggcagctctggtgcccctgtatatgtggatctcgcctacatcccgaatcattgsagtggcaagactgctgaccttgacttcttccgtcgagtgcgtgcatcctactatgtggtcagtgggaatgaccctgccaatggcgagccaagccgggctg

SEQ ID NO: 22791 - DNA, 201 bp, Homo sapiens
tctctacagtggccttgagttccaagggcagctctggtgcccctgtatatgtggatctcgcctacatcccgaatcattgcagtggcaagactgctgacctwgacttcttccgtcgagtgcgtgcatcctactatgtggtcagtgggaatgaccctgccaatggcgagccaagccgggctgtgctggatgccctgctggagg

SEQ ID NO: 22792 - DNA, 100 bp, Homo sapiens
ctatgccatcctgcagctgaaatgggaacactggctgcctctccaaaccmgctcttggacagaggatctgggaggtggaagccaggccagaggacttggg

SEQ ID NO: 22793 - DNA, 201 bp, Homo sapiens
tgagaatatgggtgggctctgtattggtctgggaaatgttattttgttcgtaaactaaatgtctacttaagtttccctcctaacacactccagaaagcccwagaaagcagggaggagatagaaggcttgaggtgggaggaaataagaacgatgaagttgcagaagaggggtatttcccttttgtgatgctcagaactcagc

SEQ ID NO: 22794 - DNA, 201 bp, Homo sapiens
aaaatgagcccaccttgtgttcttcctagctccaccctccccgtgctgctgtgttctgctcctccccacgcttccctgctatagttcccagctgctgtaayggagccacctccaactctaacaataaaccaagttcattgcagatagtgtagtgctgcttaggctttttctgactccatacatgcttagttactgggccct

SEQ ID NO: 22795 - DNA, 201 bp, Homo sapiens
aggaactccagctggcccgcaagcgccgcgcacagccccggttgctgctcgcacctctccctgcacgcctccctgcaagctgagggagcgggctccagccytggccagcccagaaaggggatcccacagtgcagcggtgggctgaagggctcctcaagtgccgccaaagtgggagcccaggcagaggaggcgccgagagcg

SEQ ID NO: 22796 - DNA, 201 bp, Homo sapiens
caccaggcctcctgactaactcccttctatcgtctctgctctcttcacagccaacaactatagtactgacacaaagtagacaaccagaggacaggcaaatwgagaaagcccgaagtctgcaagacctgaggaacctggagtcaaatggaacacaaacatttgatctccaagacagtacatcaggggatatttagcaataca

SEQ ID NO: 22797 - DNA, 201 bp, Homo sapiens
gagaccagcctggccaaaataatgaaaccctgtctccactaaaaatacaaaaattagctgggtgtagtggcaggtgcctgtaatcccagctactcaggagrctgaggcaggagaactgcttgaacctgggaggcagaggttgcagtaagccaagatggtgccaccgcactacagcctggatgacagagcgagaccgtgcct

SEQ ID NO: 22798 - DNA, 201 bp, Homo sapiens
acactgtggaaggggacccgagcgggttgccactgctggctcgggcagcctgcttttattctcttatctagccccacccacatcctgctgattggtagagscagtggtctgtgctgacagggggctgattggtgcatttacaatccctgagctagacacaaaggttctccacgtccccaccagattagctagatacagagt

SEQ ID NO: 22799 - DNA, 201 bp, Homo sapiens
cacagggtgctgactggtgtgtttacaaaccctgagctagatacagagtgccgattggtgtatttacaatccctgagctagacataaaggttctccacgtcctcaccagactcagcagcccagctggcttcacccagtggatctcgcacgggggctgcaggtggagctgcctaccagtcctgtgccgtgctcctgcactcc

SEQ ID NO: 22800 - DNA, 201 bp, Homo sapiens
cagggtgctgactggtgtgtttacaaaccctgagctagatacagagtgccgattggtgtatttacaatccctgagctagacataaaggttctccacgtccycaccagactcagcagcccagctggcttcacccagtggatctcgcacgggggctgcaggtggagctgcctaccagtcctgtgccgtgctcctgcactcctc

SEQ ID NO: 22801 - DNA, 201 bp, Homo sapiens
tccacgtcctcaccagactcagcagcccagctggcttcacccagtggatctcgcacgggggctgcaggtggagctgcctaccagtcctgtgccgtgctccygcactcctcagccctttgggtggtcgatgggactaggtgccgtggagcagggggcagtgctcatcagggaggctcagccacacaggagcccacggagggg

SEQ ID NO: 22802 - DNA, 201 bp, Homo sapiens
aaggctcaggcatggcgggctgcaggtcccgagtcctgccccactggaaggcagctaagtaaggcccggcgagaaatcaagcgcagcgccggtgggctagyactgctgggggacccagtacaccctccatagccgctggcccgggtgctaagcccctcattgcccggggggccggcagggccggccggctgctccgagtgc

SEQ ID NO: 22803 - DNA, 201 bp, Homo sapiens
cgagtcctgccccactggaaggcagctaagtaaggcccggcgagaaatcaagcgcagcgccggtgggctagcactgctgggggacccagtacaccctccayagccgctggcccgggtgctaagcccctcattgcccggggggccggcagggccggccggctgctccgagtgcaggacccgccaagcccacacccaccagga

SEQ ID NO: 22804 - DNA, 201 bp, Homo sapiens
ggcgagaaatcaagcgcagcgccggtgggctagcactgctgggggacccagtacaccctccatagccgctggcccgggtgctaagcccctcattgcccggrgggccggcagggccggccggctgctccgagtgcaggacccgccaagcccacacccaccaggaactccagctggcccgcaagcgccgcgcacagccccggt

SEQ ID NO: 22805 - DNA, 201 bp, Homo sapiens
caagtgccgccaaagtgggagcccaggcagaggaggcgccgagagcgagcgagggctgtgaggactgccagcacgctgtcacctctcaatggggttagacaaaaaaaaaaaaaaaaaaaggaaggaaggaaaagcaaagaactgaggacagcactttacagtaggtcacatccctaaaggttagacaaacatgagtcctac

SEQ ID NO: 22806 - DNA, 201 bp, Homo sapiens
ataaataaaatccaaagcttacaaaatatcaatagtcaacagagaaatacaaattaaaatcacaatgaaataccactacacgcaacaaaagcaactaacawaggccaggcacggtggctcacacctgtaatcccagcactttagtaggccaaggcaggcggatcacctgacgtcagaagttcgagaccaacctggccaaca

SEQ ID NO: 22807 - DNA, 201 bp, Homo sapiens
gagaagggagtatactgggcagcagggagatcaaccacaaaaggttataaggaaactttttagggtgagggaactgctctctactttgatggtggtgatgkttacacagctgtatacatttgccaaaattcatcaaaacatacacgtaaaataattttattttatgtaaccaatacttcaatatttttaaaaagagaaatt

SEQ ID NO: 22808 - DNA, 201 bp, Homo sapiens
acttataatcccaacactttggaaggccgaggcagaaggattacttgagcccaggagtttgagataagcctgcgcaacaaagtgagaccctgtctctaccaaaaaaaaaaaaaacattagctgagtgtggtggcacacgtctgtggtcacagctacttgggagcctggatggttaaggctgcagtgagcagtgtgattgtg

SEQ ID NO: 22809 - DNA, 201 bp, Homo sapiens
aaataacattatactatatgccaaacgtccaatacaggacctaacacagagcatgaactcaaaaaatgggtattataaagatatgcaaaagacatggtaamaattgaatcttgtttagggtaagaattaaacattctagatctaaaactggtggggtacttcagttgatagatggaaaacatgcctaatagttctgataat

SEQ ID NO: 22810 - DNA, 201 bp, Homo sapiens
aaaaaatatacgaaaaaaattagctgggtgtggtggcatgtgcctgtagtcccagctactcaggaggctgaggtgagagcatctcctgaactaggaggcasaggttgcaatgagccaagattgcaacactgtgctccagcctgggcaagagagtgagaccctgtctgaaacaacaacaataaaaacctaaaaaccgccagg

SEQ ID NO: 22811 - DNA, 201 bp, Homo sapiens
tggtggtggagagagagcagtgtataaggatgagtaatatctagtttctagcttcaaagaatttacaatctaggaaggagataagacatagaaataatgayagtacaagatacaataaaagttctgtaggaattgtgagacaaatcgaaataattttagtcatgtggttataatgaatacttcttgagcacttactatgtt

SEQ ID NO: 22812 - DNA, 201 bp, Homo sapiens
cccaatccagtgcataaggttcaatgccggtaccactccccttccccttcacacccagtagtaaaacttagagcagatcccttatgacggctcccccttcrgtgccctcgttgtctgctggaggagctcaggcaccgccgaggccccaggtcaggggtctccatctccacttagttctgactagccaacctattcactttt

SEQ ID NO: 22813 - DNA, 201 bp, Homo sapiens
ctaacatagcatccagcttcattatttcttgttcataattttctatttacagacagcccgagttcatattttagtcagatctgaataatttttaaaagatwacttcttagcaaattaggtcttaaagccctatttaccacctcgaatcattagttagtttgagactttcggcctttattacctaggacctgcctgtggcta

SEQ ID NO: 22814 - DNA, 201 bp, Homo sapiens
gttaaagcacaggtctgtcctacctcaatcatcagggtacccatgcatgagaactatgacagcctgtacttcctgcctgcacacacaatcagactattccscactaaagagaaagtcagtctaaaaggtttcagtgctttacatattcctgaaatgcagccaagaagcttccctgtattcttccagttacaacagccatat

SEQ ID NO: 22815 - DNA, 201 bp, Homo sapiens
tttatgagacaatcagagaaatctgaacattgaatatttcatgatattaaggaaccattgtcaattttttaaagtatgataatagtaatacggttaagttyaaaataagaatccttatcttttggagacagcactgaagtatttcagataaaattatataatgctgaaattatcttcaaaataattcagtagggagggggg

SEQ ID NO: 22816 - DNA, 201 bp, Homo sapiens
atctctgaactatgttcagaatcactcatttgtctcaaattttcattgctgattttttagctaattctgaaggtctttggtaaatgttgaaaatagagcarttccttcaacagtgccttgtttttcaaaacgtccattctccctttgtggccaggcattatctccacccccccaaccagcaggaatacctttccaaagacc

SEQ ID NO: 22817 - DNA, 201 bp, Homo sapiens
agctaattctgaaggtctttggtaaatgttgaaaatagagcaattccttcaacagtgccttgtttttcaaaacgtccattctccctttgtggccaggcatyatctccacccccccaaccagcaggaatacctttccaaagaccataaaagtctcgtttggtcactgataaacatctgtaaccattttctttaaatcagtgt

SEQ ID NO: 22818 - DNA, 201 bp, Homo sapiens
ctttggtaaatgttgaaaatagagcaattccttcaacagtgccttgtttttcaaaacgtccattctccctttgtggccaggcattatctccacccccccarccagcaggaatacctttccaaagaccataaaagtctcgtttggtcactgataaacatctgtaaccattttctttaaatcagtgttggaagaatcttctca

SEQ ID NO: 22819 - DNA, 201 bp, Homo sapiens
gagaaaggatataataggaggcatatacatgacagatgaaggcacaggctctggaggcagctgcctgagttcaaattctgcttctacatctcattagttgmaaaatctctctatgcctccatttcctcatctgtaaaatggggataaaaataacacctccttcttaggatgtttgtgaggattcaatgagaaaaaccacag

SEQ ID NO: 22820 - DNA, 201 bp, Homo sapiens
taaatcaaatgaacaaaaaaagagagaaaagatgccaaaatgtttacagcaattagcctctgggtggcaggattacagatgacatctttgcttccttgcawctttctacacaactaatatttcataaaaagagcattaagcgtaactgtaataaacacaaaagaggtgaaaatataaatttgcaaagttgggaaccgtgac

SEQ ID NO: 22821 - DNA, 201 bp, Homo sapiens
aggtgaaaatataaatttgcaaagttgggaaccgtgacccaagcaagtgaaagaagactaagtaaagatttttacaaaagcaaaatagaacattatctatrtaactggaaggaccagataaatgactttgggaaacagagggaaagaaagttcaagagcaaatattgcaaatggtagaaaagaagcaatgaaggacgacag

SEQ ID NO: 22822 - DNA, 201 bp, Homo sapiens
atgacctgactgatggaaccacatgtgtccaagttagaagaatccacagggtctgaaaaaaataactggatattagcatgaaagacatttaccaacaaacyttaatacaaaatcaggaatacagacaataccaatctaatcagtgacactagcacatcaacttttgagtgactactacgcagataccacagtaggcttcct

SEQ ID NO: 22823 - DNA, 201 bp, Homo sapiens
tgtcttgtcatttgttctgagattaagctcaaaaaaacagatgaagaaatcccagttactacaaccaaagagattcaacatttattttatcataaaagttmagcaaataaaactatatacaagatccatgcaaggaatccagttacacacaagacacatttaaaacctggttaaaacacaatctccacgatagcagggaat

SEQ ID NO: 22824 - DNA, 201 bp, Homo sapiens
cttgcttaaaacttagttctctgactttacaggttgagaatattgaacctatatacaaatcttcacacatttgcaaaaggttcctagccaatgtaacctakggaaataaactagataaactcctgaagtcatttcaaacccactcaaatttatcccacagacattccaatttctagaaagctttactctctcacctagatt

SEQ ID NO: 22825 - DNA, 201 bp, Homo sapiens
gggcttcattgaaatcttcaaggatatagccagctcctgctcgaagctgggattctgtatactgcttgttgaaaggaggaatttccaaaaattctatattaaaaaaaaaaaccaagataataattactgagtggttttcttatttgctaccttatgcctccttcttactgcccccttttccactccccagctatccacaac

SEQ ID NO: 22826 - DNA, 201 bp, Homo sapiens
tcaaattgatacaactggcagataaagacaaaaatgtgtatctataaaatatttaacaaaatttctcatgacagctcatcaatctatccagaatacactayagtccctcaaggtataaaaaaataaggtaagctcaagctcacaaaacagtagcagtacatcttagtctgttttctgctgctataacagaattcccaccag

SEQ ID NO: 22827 - DNA, 201 bp, Homo sapiens
aatatttaacaaaatttctcatgacagctcatcaatctatccagaatacactatagtccctcaaggtataaaaaaataaggtaagctcaagctcacaaaayagtagcagtacatcttagtctgttttctgctgctataacagaattcccaccagactgggaaattgataaagaaaaagatttacaggatttggctcatggt

SEQ ID NO: 22828 - DNA, 201 bp, Homo sapiens
aggctgcagctgagtatgcgattgcagaaggaacaaggtctgtagctatctcttgttaatccttctttttctcatcaattggatcaacaatcctgagattrtggagactcttgtatcagcaacagaaaaaaggggggaaaggaactctcacatgaacaaaagtaaagacatttcaattatcttagttctaggtgtagaaaa

SEQ ID NO: 22829 - DNA, 201 bp, Homo sapiens
ctcattttgttgcccaggcttgtttcaaaatcctgggcttgagcaatctgcccagcttagcctcccaaactgctaggattacaggcatgagccaccacgcycaggctttttttcctatgatttttaagggaatgaggaatcaaatgggtagtaaagcattctgtatattccataacttctgatatttcaatgtctggtatt

SEQ ID NO: 22830 - DNA, 201 bp, Homo sapiens
tagtaagtataaacatacaaacatttcttgtaattttatttatttatttctttattttgagacagtctcactctatcacccaagctggagggcagtagcgkgatctcagctcactgcaacctccgcctcctgggttcaagcgatctcctgcctcaacctcccgagtagctgggactacaggcatgcgccaccacgtccagc

SEQ ID NO: 22831 - DNA, 201 bp, Homo sapiens
agtaagtataaacatacaaacatttcttgtaattttatttatttatttctttattttgagacagtctcactctatcacccaagctggagggcagtagcgtratctcagctcactgcaacctccgcctcctgggttcaagcgatctcctgcctcaacctcccgagtagctgggactacaggcatgcgccaccacgtccagct

SEQ ID NO: 22832 - DNA, 201 bp, Homo sapiens
gtaagtataaacatacaaacatttcttgtaattttatttatttatttctttattttgagacagtctcactctatcacccaagctggagggcagtagcgtgwtctcagctcactgcaacctccgcctcctgggttcaagcgatctcctgcctcaacctcccgagtagctgggactacaggcatgcgccaccacgtccagcta

SEQ ID NO: 22833 - DNA, 201 bp, Homo sapiens
tgtttataagccttaatagtctgtaggattctccaaagcaaagtttgaagttaatacttataatgtacaatctaatcaaagagatgacagaggatctcacrggttaaaggacttcaagatactgactggttctagcatagaaatccaagggtttcatggttcagcagtacggaccagcattcactctaggcctaagtgtaa

SEQ ID NO: 22834 - DNA, 201 bp, Homo sapiens
tacccctaagaatttattaaaagccatctagttaaaaatgtaagaatttatatatccggcgatatcatgcatgaagtctaccccaaaagtctgcctctgayattaatagccaattaagatggcattctatcaagtaagcaaataaaggttatagctagagcctaaaacacatctagatcccctgatcattattaactatta

SEQ ID NO: 22835 - DNA, 201 bp, Homo sapiens
caagcactttcctatcatgcctaccaagtcaccattcctcgttatttacaataagcctgactatccctccctatttttcatcaccttctcgtagacacccyttcccctccttcctaacctcttctctccccgcccctttttccatcccccccgccacgtccttctggcgcctctacctccccccaaaagaatgttttctaa

SEQ ID NO: 22836 - DNA, 201 bp, Homo sapiens
cattgtcttgaacacaatgctcatatcccatatgtgccacaggtgttcaataaataagaactgtattttatttttacaaaacaaacaacttggacaatcaraatgagaggtatatcaataatgaagatttcctaagtagatcccaaatgaagataatctaccacagcaactgaaaaagcaatttgaccactacaatatctc

SEQ ID NO: 22837 - DNA, 201 bp, Homo sapiens
cctcatccttcctcaattactttcagtatagctcccaccccaactgctgcactgaaatggctcttgctagagtcaccaaatggatcctaattgcctcgccraagtcaaagtatatttccagacacatcttactaaacttgctcctgtgcctgacatgatcttcttgtaactcccctccccataggcttccatggcttcata

SEQ ID NO: 22838 - DNA, 201 bp, Homo sapiens
cctgtaacaaggtttcctttgcacagtattacataaaacttatggaaagtaattttagcaccatttatctaactgcattactataacctaatggaaaattsagacttttacaggccctagggacagcactgccactactctcctcaggtctccaatgcctcattcctggattattaccatagcctatcaatcacttcctct

SEQ ID NO: 22839 - DNA, 201 bp, Homo sapiens
tctcaacatttagcaactaaacaactatatttttaagtacaaaataatatttttctgttctttttgcaacgctcttctgaatgatttattttatacaattytctaagttaaaaactattgttctcggctgagcacggtggctcatacctgtaatcctggcactctgggaggccaaggtgggtggattgcctgaatccaaga

SEQ ID NO: 22840 - DNA, 201 bp, Homo sapiens
ctccatctcaaaaaaaacacaaaaacaaaaataaaataattcaatggcatttggtgcatttacaatgttatgccaccaccaccactattctagtttgaaamcatttaattgtctaatttgtcctcaccaaaattaatacatatatcaagaatgagaaaatgttaactatcaaactgtgttctactaatcctctccccatcc

SEQ ID NO: 22841 - DNA, 201 bp, Homo sapiens
ctcaagtgccgccaaagtgggagcccaggcagaggaggcgccgagagcgagcgagggctgtgaggactgccagcacgctgtcacctctcaatggggttagmcaaaaaaaaaaaaaaaaaaaggaaggaaggaaaagcaaagaactgaggacagcactttacagtaggtcacatccctaaaggttagacaaacatgagtcct

SEQ ID NO: 22842 - DNA, 201 bp, Homo sapiens
agacaactgttcttttgcttccatagcagcaacagatgctttggggctaaaaggcatgtcctctgacctaggaaattcatatcaccaggagaaaaagttcytaagttcaaatgtttttaaataaaaagcttttcctgttttgtgtgtttttctttaataatttcaaaaattccagtggctctaatttacataattatatat

SEQ ID NO: 22843 - DNA, 201 bp, Homo sapiens
ctatctttaaaacctagatagatgtcattaagttgggatcatctcatttggtcctataattatataataaatttcaaaccatcaaacaacaaatctaaatrctatatgacttagtttgtgagtatttttctgaagcctcctcaaagacttcttaagcaaaagaaccctagcccagcttattcttccctcacaggtattcca

SEQ ID NO: 22844 - DNA, 201 bp, Homo sapiens
aatagttcacaaaacagtcaggcatcgtggctcagccagggatggtggctcacacctgtaatcccagcactttggggaggctgaggtgggaaaactgcttragcccaggagttcaagaccagcctggacaacatggctacaccccatgtctacagaaactttaaaaattagccaggcatggtattgtgtccctacagtccc

SEQ ID NO: 22845 - DNA, 201 bp, Homo sapiens
acatattaagctccatttttccagcagctgaccctgcattctgccatggtctgaaggaagaatgaggcaaaaaggagcacttaccaggttttactgtggcwgacttgcgacctcgcttggcaggggaccgttcctcttcagaagtgataagttttcttttgcctgagagaactcccatggaggcacgaggactttctgtga

SEQ ID NO: 22846 - DNA, 201 bp, Homo sapiens
cttcagtgtccagcgggatggggtcacataacagaatgtctttgcccaacacatcacattcgtacccatcatcaaagagcaatttatacttcccagctccracatctcgtgtgattttcccagagtaaaagtagccattggatgaccacttggctacaacacggagccctacaaagctatttcctggagaggaggcatcta

SEQ ID NO: 22847 - DNA, 201 bp, Homo sapiens
atcagaagggccagcagcagcctggaaaggaatttctggagagtcactacgacgcaaagcaccagcacccacatctgttcgtctggtggagtctggcactyggggcacgacacggctgaaggatttatcatctggtgacaagttaggtgaaatgtcctctatgcccaaggggccaggcacagctgtttctctaaagagaga

SEQ ID NO: 22848 - DNA, 201 bp, Homo sapiens
tttctggagagtcactacgacgcaaagcaccagcacccacatctgttcgtctggtggagtctggcactcggggcacgacacggctgaaggatttatcatcyggtgacaagttaggtgaaatgtcctctatgcccaaggggccaggcacagctgtttctctaaagagagataggggataggagaagccggtgagaacaagaa

SEQ ID NO: 22849 - DNA, 201 bp, Homo sapiens
aacaaaccaccagagttacaccacagttccaacacccataatctcaccctgcccctcctctgccctggagagagtaaaacagagtgtcccaggactggcasacaagaggcacagttatcaggaagtacaatactgaaaatacggagattaaatgaaaatctacatattgaatgaaacctgcacctgcctcccaacccccct

SEQ ID NO: 22850 - DNA, 201 bp, Homo sapiens
cagcaattagcctctgggtggcaggattacagatgacatctttgcttccttgcaactttctacacaactaatatttcataaaaagagcattaagcgtaacygtaataaacacaaaagaggtgaaaatataaatttgcaaagttgggaaccgtgacccaagcaagtgaaagaagactaagtaaagatttttacaaaagcaaa

SEQ ID NO: 22851 - DNA, 201 bp, Homo sapiens
agttcaagaccagcctggacaacatggctacaccccatgtctacagaaactttaaaaattagccaggcatggtattgtgtccctacagtcccagctactcrggaggctgaggcagcaggatccttgagccacaggagttcaaggctgcagtgagctattattgtaccactcactgtacactagcctgggtgacagagaaag

SEQ ID NO: 22852 - DNA, 201 bp, Homo sapiens
gtgccactgcactccagtctgggtgacagagcgagactccgtttcaaaaaataaataaataaaattttaaaaataaaataaaaacaggatatttgcaggasgtaatgttggaaagggaagttagggcatattatgaaggatctttgagaaggaactgatgagaagaaagacaaagtatttgtgattttgtgatattgtaaa

SEQ ID NO: 22853 - DNA, 201 bp, Homo sapiens
aatcaactttattgagaaggtaatgatcttctaaatacttatgtttgctggttttcggtttaaaaaaaaaaatctgctcaatcttcttcaaacaaggtatyactcaccaacacaggattttctttgtgcgtctggagattaggaaggtgtcgagatagcatactgaagtgagaaccagaatcatcctctagaacctggctt

SEQ ID NO: 22854 - DNA, 201 bp, Homo sapiens
ctagaaaagtttggcagtttcttaaaaaaacaaacatgcaactaccatgacccagcaattgcaaatctgggcatttatcctagagaaatgaagacttatgytcacagaaaaacctgtacatatggccgggcacagtgactcacacctataatctcagcactttgggaggctgaggcaggcagatcacctgaggtcaggagt

SEQ ID NO: 22855 - DNA, 201 bp, Homo sapiens
gaaaacttgcatacagcctttctcatttgctaacctctcttcaaaagatggcacaccaatttcaatttctgttattctatacaccatctatatatttttastatggtaaaatctgcataacataaaatatatcattgtcttgaacacaatgctcatatcccatatgtgccacaggtgttcaataaataagaactgtatttt

SEQ ID NO: 22856 - DNA, 201 bp, Homo sapiens
gtaacacggtggaaagacatcacatggtgagggtgcattcaagaaggtggaaagggggccaaactgccccttcagccttttataattaacccatgctcacsgcaacagccttaatgcatacatatgggcagtgcccccacgacctaattacctcttttttgtgtatgtgtggtcaacttctgtagctttataccaatacca

SEQ ID NO: 22857 - DNA, 201 bp, Homo sapiens
gaataggattaaataacattatactatatgccaaacgtccaatacaggacctaacacagagcatgaactcaaaaaatgggtattataaagatatgcaaaasacatggtaacaattgaatcttgtttagggtaagaattaaacattctagatctaaaactggtggggtacttcagttgatagatggaaaacatgcctaatag

SEQ ID NO: 22858 - DNA, 201 bp, Homo sapiens
agagctgggaaacgggaccacttcaggactcctccaattagaatattatatttataattgctgcaagcactttcctatcatgcctaccaagtcaccattcstcgttatttacaataagcctgactatccctccctatttttcatcaccttctcgtagacaccctttcccctccttcctaacctcttctctccccgcccctt

SEQ ID NO: 22859 - DNA, 201 bp, Homo sapiens
gagtggggagcgtgggataacaagtaaaggacattctccttcatgtaagtctattccctctgacaaagcttcctactgctgctgcaaaaacagcacacccmatttctgctatgccttctcctctactttaggctctggacacctgcaaagaataacaaaaagctaggagatgcattaagtttgggctactatcccaaactt

SEQ ID NO: 22860 - DNA, 201 bp, Homo sapiens
tcaaaaataaaagaccacacacacttcctgattccaattgcatgaaattcttttttttcttttttttttttaaagacaaggcttcactctgttgcctaggytctggagtgcagtggtgagatcacagctcactgcagcctcaatttcctgggctcaagcaatctctcacctcagcctcccaagtagctgggaatacaggtg

SEQ ID NO: 22861 - DNA, 201 bp, Homo sapiens
aaggaatatacttagagactatggaaactgccagaaatcagacccaggatggtagaaggtgagaaaagttcattttgcaaattaaaaacaacaacaacaamaaaaaaaaaacaaaacaaaccagttactcctaaactcttatgtttcaatggaaagaagggagtttttatgtcctggggctgagaaatctaaaaagaatat

SEQ ID NO: 22862 - DNA, 201 bp, Homo sapiens
tggaatcatcacccagtggaatggctggaatactgttaaccaaggaaagaggaggataattaacagacacctatagccaatctttctgtgacattgtcagmctttggcagtgagcctgcaaaatactcatccagcacacataagcaattttagtactatcataatctacatttgcactgtaattaataaaacccaatttta

SEQ ID NO: 22863 - DNA, 201 bp, Homo sapiens
ctcaccaataggagtactgtgtctcttgggctccaattttaggtgcccaataagaggtggggttgcaccagtcaatggtgggatgatatcaccttctttargcaaagtgaaatgaaatggggtttctgaaaaaaaaaaaaaaaagaaaaaagaaagaaagaaaaaatgatttaaaaaaaacagaagtataaaataagcaaa

SEQ ID NO: 22864 - DNA, 201 bp, Homo sapiens
gaataggcaaatctatagagacagaaagtagactggtgtctactttccatttgtagactggtgtctacaaatctatagagacagaaagtagactaccctckaagggccgagggtagaagaaatgttgagtgagtgctaaagggcatgggttttgaggaggtgatgaaactattctgaaattagatcatggtgatggttgca

SEQ ID NO: 22865 - DNA, 201 bp, Homo sapiens
tcttaatgaactaagccccatgtggcatatgtgtttgttttgttgttgttgttgttgaggggtgggggtatattatttaagtggcagttggatccaggatwgaattctagccagagcagctgtcaatagggaaagcacctagcacagtgccaaacatatacatagtaggcattcaatatgaggcagttttctctttctacc

SEQ ID NO: 22866 - DNA, 201 bp, Homo sapiens
ataaagagaatattttaaacataagaacaccgtcaacacacccaaagaaaatgaacaggccaggcatggtggcttacatcccagaactttgggaggccaaygcaggaggatcacttgagctcaggaggtcaagtctgcagtgagcagtgatcatgccactgcacaccagcctgggtgacagtgacagtctgtctaaaaaac

SEQ ID NO: 22867 - DNA, 201 bp, Homo sapiens
aagtcaaactggctttatctcggatgcctactttgataaattggtagtagctgcctggtgctcagttttaagaagccttctggaggctaaatcccagactyagtgggaaaagattctaagaccaatcagcaatgttcgctatgggcacagcatagagaaattatagcatgagtatgacacatctgccttcctagtctagaa

SEQ ID NO: 22868 - DNA, 201 bp, Homo sapiens
tagtgtgacagaatcttcctactgttttgttttatccacctataggtaagaccagggatggatgagttatatagccagaggctaagagaagtttatatgarcatgacctaataaaatgacctattcttgtctaaatcaaaatcattacatctagtacttgtatttacggacatttaggtgaacctttgacccctaaaagtt

SEQ ID NO: 22869 - DNA, 201 bp, Homo sapiens
tgtcccaaaaaaagacaaaaaaaaaaaggttcacaaaacccaggattagcaacgatgttgaacaactgcaactctcgtacattgctgctgggaatgcaaartgttacacccactttggaaaaacagtatggcagtatcttataaagttgaacattcattactatataacctaggcattctgcttgtaggcatttacccaag

SEQ ID NO: 22870 - DNA, 201 bp, Homo sapiens
gatccttccttaacccatttatgctggaggttgcaaatttttttttgtgaaaaatcagaccttggtgatgaccttgagcagcaggatataaataactcccrcaagcttagtgttccaatagtggaacactaggcataaatgggttaaaatctgtaaacttgctcaggcctctcccagcctaaaataacaaatcctctctca

SEQ ID NO: 22871 - DNA, 201 bp, Homo sapiens
atctttaatggaggatgggggatttcccattactccccttttcctgtgatattaaaatgtcagcaaccctgcccctgctgtggctctctctctctggagamcctgtctgcacctcagttttcctgggcctcctcgggagctgggtaaggcaaaatctgcgggttctgtcccgctggttttccctctgagtggtccggctcc

SEQ ID NO: 22872 - DNA, 201 bp, Homo sapiens
aaaaatgatttaaaaaaaacagaagtataaaataagcaaaaataataagaactgcaagaaatatttcaatcactcttttcctttgctcccaaattctgtcwcattgccaccaccctcaccaggcctcctgactaactcccttctatcgtctctgctctcttcacagccaacaactatagtactgacacaaagtagacaacc

SEQ ID NO: 22873 - DNA, 201 bp, Homo sapiens
aatatttgaaaaacaaatgaatacaagaggaagaaaactcaatatgcagaaaggggctaaccaatgaactacaaattcctgaataccaaatcaggtggaayattttaaattactagcaaatttcttaatgactctcaatttaattatgagaaatctgcaacctaataaagaggagaaatttagacatctgcacaatcatgt

SEQ ID NO: 22874 - DNA, 201 bp, Homo sapiens
ctaaacctaaataatggggcggaagtacaagagctgggaaacgggaccacttcaggactcctccaattagaatattatatttataattgctgcaagcactytcctatcatgcctaccaagtcaccattcctcgttatttacaataagcctgactatccctccctatttttcatcaccttctcgtagacaccctttcccctc

SEQ ID NO: 22875 - DNA, 201 bp, Homo sapiens
ggccagcagcagcctggaaaggaatttctggagagtcactacgacgcaaagcaccagcacccacatctgttcgtctggtggagtctggcactcggggcacracacggctgaaggatttatcatctggtgacaagttaggtgaaatgtcctctatgcccaaggggccaggcacagctgtttctctaaagagagataggggat

SEQ ID NO: 22876 - DNA, 201 bp, Homo sapiens
gctgaaacagtttctgggaccctcaaggaacactccatggtttggattcctatgttattttggctgggcctttcaatcaaggccttactaggattttcctkattagtactccgtccttctttctggtcttctagcacatctgtcaccattgcctctccttgaggactggatggcccttgtatgaccatcttctgggaagca

SEQ ID NO: 22877 - DNA, 201 bp, Homo sapiens
tgccaacttttgaggggaatcaatactaatcacactggtttcaacttccatagcttctgagcattctttttttggcatttccttttgaagacacaaccctygggactgagtttcagtcagagaaaggtgcaacggaacactctccatattttcttctttgagttcctctccttgactttcacaaggtgtctcagggatttc

SEQ ID NO: 22878 - DNA, 201 bp, Homo sapiens
cagacattttcactctaaaaaaatagtgacgtaatttttcagaaaagctgacagaataatagtagactgggtcctagcaatctaccaatacttcctttggktggcggagcagtccaagctcctatttttaggtatagatcaaaactggatgcatctggggctacccacccattcataaaaaatgttaaattaacttggctc

SEQ ID NO: 22879 - DNA, 201 bp, Homo sapiens
atttgccacacagactcagagtatgtattacctcagttacttttctttctacttctgttccatccacataatacacatctgtaatgacacgagtgacaagygtgcgtacttcccggattgttctcatgtgacgatgtaagacatggccatgtggaggctgaggcatatcaaactcttcttctccctgtgacagaaaataca

SEQ ID NO: 22880 - DNA, 201 bp, Homo sapiens
taggaagtgacccaggagggaagactggtgtgctctgagatattggtgttgaggcttgtggtgatacagtggactcaggcaggagaggggggttttctaaytccactggttcaccactttgaagtttcttctgaaaaggctctcctccttcttcagataacactgacgtgtccattggcttatctggtttaaaacaggaga

SEQ ID NO: 22881 - DNA, 201 bp, Homo sapiens
aaccgcggaggcagaggttgcagtgagccaagatcgtgtcattgcactccagtctggattacagagcaagactccatctcaaaaaatagtaataataatamtaataataataaataaaatccaaagcttacaaaatatcaatagtcaacagagaaatacaaattaaaatcacaatgaaataccactacacgcaacaaaagc

SEQ ID NO: 22882 - DNA, 201 bp, Homo sapiens
ccgcggaggcagaggttgcagtgagccaagatcgtgtcattgcactccagtctggattacagagcaagactccatctcaaaaaatagtaataataatactrataataataaataaaatccaaagcttacaaaatatcaatagtcaacagagaaatacaaattaaaatcacaatgaaataccactacacgcaacaaaagcaa

SEQ ID NO: 22883 - DNA, 201 bp, Homo sapiens
caggagttcaaggctgcagtgagctattattgtaccactcactgtacactagcctgggtgacagagaaagactctgtcccaaaaaaagacaaaaaaaaaamggttcacaaaacccaggattagcaacgatgttgaacaactgcaactctcgtacattgctgctgggaatgcaaaatgttacacccactttggaaaaacagt

SEQ ID NO: 22884 - DNA, 201 bp, Homo sapiens
aatacttagctacaaaatggttcactgctatattattatttagaataggaaacaatatgaaataccttaaatggttacaaataggaattttattttattttttttttgagacaggtcttgctctgttgcccaggctggagtgcagtaatgcgatcatggctcactgcagtcttgacctcctaggctcaagtgattctctta

SEQ ID NO: 22885 - DNA, 201 bp, Homo sapiens
attaaaaaaagaagaagaacagagaaaacaaaggggaagaaattaaagaaataaatttctttgaactgaaggacctgagtttctaaattgagagggcctgscaagtacccaatacaatgaatgaaaatagacgtatcccaaaggtctggaaatttcagaacactgggaacgaagagaaaatcctacaggattccagtaaag

SEQ ID NO: 22886 - DNA, 201 bp, Homo sapiens
tctgcttgagcccagtagttcaagaccagcctgggcaacatagtgaggtcccatctctacaaaaaaatttttaattagccaggtgtgatagtgtgtgccastagtcctagctactcaggaggccgaggtgggaggatggcctgagtacagaagttcgaggttacagtgagctatgattgctccactgcattccagcctgag

SEQ ID NO: 22887 - DNA, 201 bp, Homo sapiens
gtctcgctatgttgcccaggctgttctcaaactcctgggctcacgtgatcctcccacctcggcctcccaaagtgctgcaattataggtgtgggctactgcrcccggcctactaaaggtattcttgagagacttttcaggaggcatggactgcactggctaaggcatcttataaaatatgagttcaaagaaacctgattaga

SEQ ID NO: 22888 - DNA, 201 bp, Homo sapiens
aaatatgagttcaaagaaacctgattagagtcatcttaggttccaagaatctctgaactatgttcagaatcactcatttgtctcaaattttcattgctgattttttagctaattctgaaggtctttggtaaatgttgaaaatagagcaattccttcaacagtgccttgtttttcaaaacgtccattctccctttgtggcca

SEQ ID NO: 22889 - DNA, 201 bp, Homo sapiens
aatttttgtattttttggtagagactgggtttcactgtgctggccatgctggtcttgaactcctggtctcaagtgatccgcctgcctcggcctcccaaagkgctgggattacaggcatgagccaccacacctggtcagatttataactttttttttttttgagacagggtcttgctattttgcccaagctgttctcaaact

SEQ ID NO: 22890 - DNA, 201 bp, Homo sapiens
aagctaaagaaaatgatgtatggttcgaacatccatttcacctctaggtaaccttgtttttaaccctttcactgccaacaacagctacccttatatgcagwaccaagtgcaaggcactagtctaagcattttatatatattaactcaacctttcataaacatcctacgaggtagacagtatcaatatccccatcatttgac

SEQ ID NO: 22891 - DNA, 201 bp, Homo sapiens
ggcacaagcaaactccatatatttttaaaataagttaacaccgaccaggcacggtggctcacgcctgtaatcccagcactttgggaggccaaggagggcgsatcacgagatcaggagatcgagaccatcctggctaacatggtgaaaccccatctctactaaaaaatacaaaaaaattagctgggcgtggtggcaggtgcc

SEQ ID NO: 22892 - DNA, 201 bp, Homo sapiens
agaatgacgtgaacccaggaggcggagcttgcagtgagccgagatcgtgccactgcactccagcctgggcaacagagcgagacgccgtctcaaaaaaaaaaaaaaaaaaaaaagaaagtactttgggaggccgagatgggcagatcacttgaggtcaggagttcaagaccagcctggccaacaaggtgaaaccctgtctct

SEQ ID NO: 22893 - DNA, 201 bp, Homo sapiens
gtgctgggattacaggtgtgagccactgcgcccagccaaaaaccatttctttttaagaaaaaacaatagtctttaaccatctcaagctaacattctcctcyctaaccacctcccctttctaccaccccaaaactcctgaagttctctacattctccttggaccttagaaatattggggcggaagactgagaagcactgatt

SEQ ID NO: 22894 - DNA, 201 bp, Homo sapiens
gtaggtggatcatgaggtcaggagtttgagaccagtatggccaacatggtgaaaccccgtctctactaaaactacaaaaattagctgggcatggtggcgcrcgcctgtagtcccagctactcaggaggctaaggcagaagaatcgcttgaacccgggaggcagaggttgcagtgaaccaagatcacgccactgcactccaa

SEQ ID NO: 22895 - DNA, 201 bp, Homo sapiens
tatccaacaaactgcctttctgcaaagggactcatgtacatctgaatgctttcaaaaataaatgccccatcagacatagtgtctcaagcctgtaatcccarcactttgggaggctgtcgtggttggatctcttgggcctgggagttcgagaccagcctgggcaatgtggtgagaccccatctctacaaaagacaacaaaaa

SEQ ID NO: 22896 - DNA, 201 bp, Homo sapiens
gttgcccaggctggagtgcaatggtgcaatttcggctcactgcaacctccgccttcctgggttcaagcgattctcccacctcagcctccccagtagctggkattacaggcgcccgccaccacactcagctaattctggccttgctatctacccgcactagagtctgtaggggatgggggaggagggatacagtgagctgtc

SEQ ID NO: 22897 - DNA, 201 bp, Homo sapiens
tcactatgtttcagcctggtctcaaactcctgacctcaagtgatccccctgctttggcctcccaaagtgctggaattacaggcatgagctaccacacccasccatctatgtggcattatttttaaaatatcccataactccagtctaatgagaaaatattagacaaatccaaatggagggacattccacaaaatacctgac

SEQ ID NO: 22898 - DNA, 201 bp, Homo sapiens
tagtcccagctacttgggaggctgaggtgggaggatcacttgagcttggaagtcaaggctgcagtgagccgggatcatgccactgtactccagcctaggtratagcatgagaccctgtctcaacaacaacaacaacaaaaaaggctaaaatagtattaccatttggaaaaatgaaggacaaaaaggttataagtatctata

SEQ ID NO: 22899 - DNA, 201 bp, Homo sapiens
tgtaatcccagcactttgggaggcagaggcaggtggatcacttgaggtcaggagttcaagaccagtctggccatcatggtgaaaccccgtctctactaacwcaaaaaaaatagccgggcatggtggtgcactcctgtactcccaggtactcgaaaagctgaggcagaagaatcacatgtgaacctgggagatggagctgca

SEQ ID NO: 22900 - DNA, 201 bp, Homo sapiens
tgtggctaaaaaaaagtgctagaatttcagtcctgcatttctgaaaaaatacatgttttctaataacaactatatcacattttttcacatctttatcctcyctcctacaccccactaactccgtaattctgaagagaaaatgcacacttttgtctctcaccttatctcccctatggtaggctgattttactttcagcattc

SEQ ID NO: 22901 - DNA, 201 bp, Homo sapiens
tcccctatggtaggctgattttactttcagcattcagtatcaaagtagccaagtctttaaaaagaattacatatacaaatgcaataatggtaattctgcatttttttcctgacatgtggtagtaatttaccaaaagctttcagtaatttctccgaataatccccactccaattccaacttggaaactggcagaggtgaaat

SEQ ID NO: 22902 - DNA, 201 bp, Homo sapiens
cctctcttcaaaagatggcacaccaatttcaatttctgttattctatacaccatctatatatttttactatggtaaaatctgcataacataaaatatatcattgtcttgaacacaatgctcatatcccatatgtgccacaggtgttcaataaataagaactgtattttatttttacaaaacaaacaacttggacaatcaaa

SEQ ID NO: 22903 - DNA, 201 bp, Homo sapiens
ctctcttcaaaagatggcacaccaatttcaatttctgttattctatacaccatctatatatttttactatggtaaaatctgcataacataaaatatatcattgtcttgaacacaatgctcatatcccatatgtgccacaggtgttcaataaataagaactgtattttatttttacaaaacaaacaacttggacaatcaaaa

SEQ ID NO: 22904 - DNA, 201 bp, Homo sapiens
tctcttcaaaagatggcacaccaatttcaatttctgttattctatacaccatctatatatttttactatggtaaaatctgcataacataaaatatatcattgtcttgaacacaatgctcatatcccatatgtgccacaggtgttcaataaataagaactgtattttatttttacaaaacaaacaacttggacaatcaaaat

SEQ ID NO: 22905 - DNA, 201 bp, Homo sapiens
cagagagctctcttgcccccaactgccatgtgagaacagctgtctacaaaccaggaagcaggccctcaccagacaccaaatctgccagtgctttgatctaraacttctcagcctccagaaatgagagaaataaattcttttgtttataagctatctagcctatggcagtttgttgcagcagcccaaagagactaagacacc

SEQ ID NO: 22906 - DNA, 201 bp, Homo sapiens
tatgcttgaaaccttctgtagtaaaatgattgagaaataaggtgacagcaagtaatttgaacagagtacagttacaaacaacacttaaaagtttcatgtasgctgggcacggtggcttatacctgtaatcctaccactttgggaggccaagccaggtggatcacttgagcttcaggagttagagactagcctgggcaacat

SEQ ID NO: 22907 - DNA, 201 bp, Homo sapiens
ctaattttttgtattttttaggaaagacagggttttgccaagtttcccaagctggtctcaaactcctgaaatcaagtgatctgccagatttcttgtttttkgtttgtttgttttgagacaacagtctcgctctgtcacccaggctgcagtgcaggccagatttgttttaatttttttttttttttttttttgagacagagt

SEQ ID NO: 22908 - DNA, 201 bp, Homo sapiens
agggttttgccaagtttcccaagctggtctcaaactcctgaaatcaagtgatctgccagatttcttgttttttgtttgtttgttttgagacaacagtctcrctctgtcacccaggctgcagtgcaggccagatttgttttaatttttttttttttttttttttgagacagagtctcactctgtcgcccaggctggagtgca

SEQ ID NO: 22909 - DNA, 201 bp, Homo sapiens
gaggatcgcttgagcccaggagttcaacaccagcctggctaacatggcgaagccccatctctataataaatacaaaaattaaccaggcatgggtggtgggygtgcctgtagtcccacctactcagggggctaagatgggaggatcgcttgagcctgggagatggaggctgcagtgagctgagatcaccccattgcactcca

SEQ ID NO: 22910 - DNA, 201 bp, Homo sapiens
tgggactacaggcgccctccatcacgcccagctaattttttgtatttttagtagagatggggtttcaagagaaaatgaattagtaatctgaggagataaaragagaaaaagaaatggtctttagaaataaaggattaaagtacatatgctcagctaaagaaactgtaaagaggggccaggtaccatggctcatgcctgtaa

SEQ ID NO: 22911 - DNA, 201 bp, Homo sapiens
catggctcatgcctgtaatcccaacactttgggagacgaaggcggatggatcacttgaggtcagaagttcgagaccagcctggccaaaataatgaaacccygtctccactaaaaatacaaaaattagctgggtgtagtggcaggtgcctgtaatcccagctactcaggaggctgaggcaggagaactgcttgaacctggga

SEQ ID NO: 22912 - DNA, 201 bp, Homo sapiens
cccgtccccccaccccacaacagtccccagagtgtgatgttccccttcctgtgtccatgtgttctcattgttctattcccatctatgagtgagaacatgcrgtgtttggttttttgtccttgcgatagtttactgagaatgatgatttccaatttcatccatgtccctacaaaggacacgaactcatcattttttatggct

SEQ ID NO: 22913 - DNA, 201 bp, Homo sapiens
gcccgggaggtcaaggctgcagtgaacattgatggtgccactgcactccagcctgggcgacagagtgagaccctggctcaaaaacaaacaaaaaaaaagayaaaaagctattattctcccttcatgttctaatttgtagttaaaattatttttatttaacttctcctcataaatactattttccaaccactgtcttcatta

SEQ ID NO: 22914 - DNA, 201 bp, Homo sapiens
aaaaggggggaaaggaactctcacatgaacaaaagtaaagacatttcaattatcttagttctaggtgtagaaaaaagcttcactgaacttaaaaaagtatyaactaaaaagtctatgatccattcaaaacattgctaaatcctttatgaaagagtctcattttaactttctcattttaacttttttcctttgttgataaac

SEQ ID NO: 22915 - DNA, 201 bp, Homo sapiens
actggtttctcaccactccccctctcagtctgaactgtggcatcttgctttccaaagttctggtccactgtactggtcccctgctcacacacattctttayagtctgggttgctgctgaaacagtttctgggaccctcaaggaacactccatggtttggattcctatgttattttggctgggcctttcaatcaaggcctta

SEQ ID NO: 22916 - DNA, 201 bp, Homo sapiens
tcgtccattcgctgccgccgcccgccactcaagaaatcccgtggatgataggtagctgcggcagagtgccctgccccacgtaagaaaaaggaacacggcgscgcgtttccatggcagcatggacgttgcaggccctcccctttagtagagccggagaatgacggtatccttgaaccgaagggaccttgagagggcgtgaaa

SEQ ID NO: 22917 - DNA, 201 bp, Homo sapiens
aattcagcacgtgatataggcaaagctgaagtggagcttcctaccagtcttctcactgctgctataaattacagtgatcctattttccaaaccaaattcawagcatgttgtctgaatacacgttacttatgggaacaaaaggactgactccttgaaactgtcctgaaaaatctagaatctattactgctataactggaata

SEQ ID NO: 22918 - DNA, 201 bp, Homo sapiens
gccgattggtgtatttacaatccctgagctagacataaaggttctccacgtcctcaccagactcagcagcccagctggcttcacccagtggatctcgcacsggggctgcaggtggagctgcctaccagtcctgtgccgtgctcctgcactcctcagccctttgggtggtcgatgggactaggtgccgtggagcagggggca

SEQ ID NO: 22919 - DNA, 201 bp, Homo sapiens
cctgcactcctcagccctttgggtggtcgatgggactaggtgccgtggagcagggggcagtgctcatcagggaggctcagccacacaggagcccacggagsgggtggaaggctcaggcatggcgggctgcaggtcccgagtcctgccccactggaaggcagctaagtaaggcccggcgagaaatcaagcgcagcgccggtg

SEQ ID NO: 22920 - DNA, 201 bp, Homo sapiens
atccagcagagcagggctggagttctgccaaatgagctcagacccccagaaaaactaatgacattcatcaggctagaagagaaggcccagcatcttttctktatgaattgccagagctgccttaaatcttatggagactttaagcattgaaagaattatgatgttcttctctcctatgaacacctaattcaagatgagtgc

SEQ ID NO: 22921 - DNA, 201 bp, Homo sapiens
tgggaggccaaggcaggaagatcacttgagaacagagttcaagaccagtctgggcaacacagtgaaaccccatctctacaaaagatacaaaaattagcagrtgtggtagcgtgtgcctatggtcccagctactcagaaggctgaggtgggaggctcccttgagccaggaggtcaaggctgcagtgagctgtgatcatacca

SEQ ID NO: 22922 - DNA, 201 bp, Homo sapiens
tgtgaacttctacgtatttgttaacacatacatttctacgacttcttttcatctactcaattttttttttaagagacaaggtctcactatgttgcccagtytagtctcaaactcctgggctcaagtaatcctcccacctgagcctccaaaagcgctgggatttcaggcatgtgccaccaggcacagccacctacttaattt

SEQ ID NO: 22923 - DNA, 201 bp, Homo sapiens
aaagtactattaataatcacacttagacaatgggtataaaatgggactgttctaggctgggtgcagcggctcacgcctgtaatcccagcactttggaggcygaggaaggcagatgacgaggtcaggagattgaaaccatcctggccagcatggtgaaaccccgtctctactaaaaatacaaaaattagctgggcatggtgg

SEQ ID NO: 22924 - DNA, 201 bp, Homo sapiens
gagaccaccttaggcaacatagtgagaacaggtctccatatgaaaataaaactattagccaggcgtgggagtgcacacctgtagtcccagctacttgggasgctgaggtgggaggatcacttgagcttggaagtcaaggctgcagtgagccgggatcatgccactgtactccagcctaggtgatagcatgagaccctgtct

SEQ ID NO: 22925 - DNA, 201 bp, Homo sapiens
ggatacgtactcattttacttcacgatttcaaaatgtgctagcattcaacacggtgaaaccctgtctctactaaaaatacaaaaaaatcagccaggcgtgstggtgggcacctgtaatcccagctacttgggaggctgaggcaggagaatcacttgaaccttggaggcggaggttgcagtaagccgagattgcaccactgc

SEQ ID NO: 22926 - DNA, 201 bp, Homo sapiens
actagcagataagtttagcctctttcagccttagcctaagactctcaggcacatactgccttggcataagctattttaggcttacttacgtggaaagactstcctgaacaagggacctctgaccagagagctgcaggagatgcagagtggtggcaggagtggaagccaaagaacacccaccttcctcccttgaaggagtag

SEQ ID NO: 22927 - DNA, 201 bp, Homo sapiens
acagtagtcaaagaatggtgtgatcaagtcctggccttctttttttttttttttttttctggagaccaagtttcactcttgttgcccaggctggagtgcartggtgcaatttcggctcactgcaacctccgccttcctgggttcaagcgattctcccacctcagcctccccagtagctggtattacaggcgcccgccacca

SEQ ID NO: 22928 - DNA, 201 bp, Homo sapiens
tgtaaacccagctactcgggaggctgaggcacgagaaacacttgaacccaggaggcagaggttgcagtgagccaagatcacgccactcactgcactccagyctaggaggcagagtgaaactgtgtctcaaaaaaaaaaaaaaagatagaaagaaagccattttcccccattatatgccaatccatgttcaaaaagtcctca

SEQ ID NO: 22929 - DNA, 201 bp, Homo sapiens
ccaccatgcccagctatgttcacatataacttagaaaaataaaagctaaagaaggccaggtacggtggcccacacctgtaatctcaacacactgggaggckgagagaggaggattgcttgagcccaagagtttaagaacagccctggcaacatagtgataccccgtctctataagaaaaattaagaaattagttgggcatg

SEQ ID NO: 22930 - DNA, 201 bp, Homo sapiens
tatgactttttttttttttgatggagtctcactctgtcacccaggatggagtgccgtggcgtgatctcggctcactgcaacctctgcctcccaggttcaartgattctactgcctcagcctccggagaagctgggactacaggcatgtgccaccactcatagctactttttttgtatttttagtagagatggggttttgcc

SEQ ID NO: 22931 - DNA, 201 bp, Homo sapiens
gatcgagaccatcctggctaacatggtgaaaccccatctctactaaaaaatacaaaaaaattagctgggcgtggtggcaggtgcctgtagtcccagctackcaggaggctgaggcagtagaatggcgtgaacccgggaggcagagcttgcagtgagccgagatcgcgccactgcactccagcctgggcgacagagcgagac

SEQ ID NO: 22932 - DNA, 201 bp, Homo sapiens
gctgggattataggcgcctgccagcactcctggctaattttgtgtttttggtaaagacagggtttctccatgttggtcaggctagtctcaaacttccgacytcaggcgatctgctggcctcagcctcccaaagtgctgggattacaggcgtgagccaccacgcctgacctacattatactaactctaaggattcagaaaga

SEQ ID NO: 22933 - DNA, 201 bp, Homo sapiens
gaccctctgaatgtcttgcacagcaacctgtatcacagcatagcaaaggaagatagccttcttcccttcccgccttacaaccaacataatatgttttgctrgtaattaactcaagctttctagctctctgaggctgtggaatgaaagattggtggaggttaaagaggtgtgaaacaaattatatccttttaagttttatgt

SEQ ID NO: 22934 - DNA, 201 bp, Homo sapiens
ccaggaggcggaggttgcagtgagccgagatcgcgccactgcactgcagcctggtgacagagcgagactctgtctcaaaaaaaaaaaaaaaagagagagasagagtctgtctcccaggctaaagtgcagtagcacgatcacagcttactgcagccttgaactactgggcacaagcaaactccatatatttttaaaataagt

SEQ ID NO: 22935 - DNA, 201 bp, Homo sapiens
actcacctcttgaaggtggtacttttcttctctaagaaacatggatacggtcaacctattaggcctgagccttggaccacaaggcctaacacctacaggtytaaggagatccctggaacaaagacactacacacactctttcaggtacctttgttatgggcacttgaatggtgctgcttcacagaggctgcaccaccagtc

SEQ ID NO: 22936 - DNA, 201 bp, Homo sapiens
gccaaccctcacagatgtccagtggtgcaaattatgacaaccatgttgcctaattcaattccctcttgcaagacaacattagtcagaactctaacttgtayaacatcattccatctggacctttagcctttacagacacattcagatactgctgtcagtcacatttacagtgtatacatttatatctgctcattccctctc

SEQ ID NO: 22937 - DNA, 201 bp, Homo sapiens
gaagcttgctgttgtcttaggctccttagcaccctctcacaagggctctgtaaagcaggcctgagttagggaatttagagatccaacagtggactgaagtkaggacttaacaaaattccagttgtcaatcccaaacagtaacacttaggatatatgtagctactacactgggattaggacaaggaaagtttcttgacagaa

SEQ ID NO: 22938 - DNA, 201 bp, Homo sapiens
atttaggatctgttcttttttttttctcccccaggtgattctgagaagaattgttcattctaatgggactatactgtatctcaataaaatataaaataaasatggtactatattggtaagaaagagtttatctttttattggataagttcacaacctctggctaccagcaaagattctaacctagacgacagaagtaaatt

SEQ ID NO: 22939 - DNA, 201 bp, Homo sapiens
caaggcaatagaaaagtatatgcaaaaataggctaaaaggggtcaggtgtggtggctcacgcctgtaatcccagcactttgggaggccaaggcagaaggaytgcttgagtccaggagcttgagaccaccttaggcaacatagtgagaacaggtctccatatgaaaataaaactattagccaggcgtgggagtgcacacctg

SEQ ID NO: 22940 - DNA, 201 bp, Homo sapiens
tccaaatcaccctctctcatgcatgaagaccttagcttcataacctctctaccttccccattcctacttctgtcatcattctcagtggcctattttaactwgatacacttgtgttttcacatctgcaaaatgagaataataactggatctatcacagaatagttgttaagaattaaataattcactaaagtgcttagaata

SEQ ID NO: 22941 - DNA, 201 bp, Homo sapiens
tttcttaccaacaggtctatgaccacacacagatagtgacaaataaagaacagaatgagtagacatgaaaatatgtgagaaaacacaggtagtttgaaacrgagtgttctaaactccatttgagtttctaaggatttaaaataatacatacaatctttatacatgagagagatttatcagtctgttctttacagaaaagga

SEQ ID NO: 22942 - DNA, 201 bp, Homo sapiens
ttacagaaaaggaaagcatgatgggatgcattaaataactaaccaatggtcaaacagcaaacctatggctggggaaagctttagaaagcaggaagtctaayttctaaccctgttcttctatctctggtaataaaaagatgaagaaaaacaaagtgttgcacaggaaagcgggatggggtagaaagtcaagagaatttttct

SEQ ID NO: 22943 - DNA, 201 bp, Homo sapiens
gcttcatgatgagaactgtttagaggctccatgaatctagtgtgacagaatcttcctactgttttgttttatccacctataggtaagaccagggatggatsagttatatagccagaggctaagagaagtttatatgagcatgacctaataaaatgacctattcttgtctaaatcaaaatcattacatctagtacttgtatt

SEQ ID NO: 22944 - DNA, 201 bp, Homo sapiens
gccgagattgcaccactgcactccagcctgggtgacggagtgagactccatctcaaaaaaaaaaaaaaaaaaaaaaaaaaaaaaagctagcattcataaarcaggtattaaaatccagtggccaggtgtggtagctcatgcctattatcccagcattttgggaggctgaggcaggtatatcacctgaggtcaggagttcaa

SEQ ID NO: 22945 - DNA, 201 bp, Homo sapiens
ctcactaaatttacagttcattactattcattttcaaattttacttttaaatacaaactcttgttataacacctgcaaactgaaaggggtaaaataagttstcccaataaaactacaataattcccccacttaaggtcttataagaataggtatttagattgaatatataatagtcatttagatttaaggattttcaactc

SEQ ID NO: 22946 - DNA, 201 bp, Homo sapiens
aaagtttaaagacattgtaaaaagtttaaacataaaaaaaaatcaagatgttaggtgactttggaactgttctaaaactgctttgtgacgacagcttcacmactctgtaaatttactaaaatatcacaaaattatacatttaaaacgtgtgaattttatggtatgtaaattataccccaataatgctgctttaaaaaaata

SEQ ID NO: 22947 - DNA, 201 bp, Homo sapiens
tacaggtgtgagacaccgtgcccagcctgagaaagtatatttaatataattatttttatattttttcaatgttcacactacagataaaagataaaagaaaytgttttaagaattaaccaaacttcacttgtattacctgggtttttgtagaattaattcacctaatcatgttatacttagattgatatcagtcactaatca

SEQ ID NO: 22948 - DNA, 201 bp, Homo sapiens
cttaggatgtttgtgaggattcaatgagaaaaaccacagaaatgcccttagaacaatgccttgcctatactaagtgctcaataaataaaactattataccrttacttgtatatgaaagagtgaaaagatgaaaatcatagaatttattagaaaaagctttgtagaaatcgtaagaacttagaaacatcttgaatgactgga

SEQ ID NO: 22949 - DNA, 201 bp, Homo sapiens
ctaagtgctcaataaataaaactattataccattacttgtatatgaaagagtgaaaagatgaaaatcatagaatttattagaaaaagctttgtagaaatcktaagaacttagaaacatcttgaatgactggataggagactaggtcagagcaaaagaagcttaaataatgagataaattaggtaagtgaaaaggaaagctt

SEQ ID NO: 22950 - DNA, 201 bp, Homo sapiens
ggctggtggaagaaccaaaaatacttcaataactatttcccacaccagacatttctgttgtaaaataagaactttttcaaaaagagagtaagggcaaagtsaatgatcagacacaaggacatcatgatttaaaagcaaaatgagcagtgctaggaaataaattcatttgcagatttgagacataaaaaaaattattccatt

SEQ ID NO: 22951 - DNA, 201 bp, Homo sapiens
agaacagtccaaaccatgacattccatggaaagcatttgatgtcaattatcctccttactagtgccacacacatcttctgctgaccttttccatttgatgkacccaaaccccaaaccaattctccttcagatcaatactaacatgtataagacattcatccctggcccctttccagagacttatgaggttcacctgttcta

SEQ ID NO: 22952 - DNA, 201 bp, Homo sapiens
ggtggaacattttaaattactagcaaatttcttaatgactctcaatttaattatgagaaatctgcaacctaataaagaggagaaatttagacatctgcacmatcatgttaaagggaagttagaacagtctattattctgaaaaaagcacaaggctaccttcagcaccaagggaatgtgtagtattgcctgaagtatcttct

SEQ ID NO: 22953 - DNA, 201 bp, Homo sapiens
acaaaaattagccaggcatggtggcacttgcctgtaatcccagctactcaggaggctgagggacaaggatcgcttgaactcaggaggtggaagttgcagtragccaagatggtggtgccactgcgctccagcctgggcaacaaagcaagactccgtttcaaaaaagaaaaaagaaaatactcaaaaaaatttgtagaatga

SEQ ID NO: 22954 - DNA, 201 bp, Homo sapiens
tccttagatgagttaaggaaaacagagtattcaaggaaaaatgaacagcctaaacaaaaaatacaagaatgagaaaaaggcaagtggttcagactgactgmataaaaaggttgatacaggatatttgcggccaggcacggtgtctcactcctgtaatcccagtactttgggaggccgaggcggagagatcacctgaggtca

SEQ ID NO: 22955 - DNA, 201 bp, Homo sapiens
gaattccctaactggtttaaacttagccgatacttttcaaaccatttgagatttatactatcttttgccttgtgctgactccagtgcataaccaaggaaasagcctataatagtgccttcctcttgcacctcttctaacctcctctttcagtggtggatccttagacaccttcgacaattcaagggtccttcatcacagtt

SEQ ID NO: 22956 - DNA, 201 bp, Homo sapiens
cccccaccaaaatgagggagtaaaccaagcaagaagatatgaaacccaagaggtatccaacacagacaggtaaggagaatctccacggatgacagtgaacrgaggttaacagttatgcaccaggcatagagggcaacagtacagattagaaatcaggagggtccaaaagaggtttctccaaaaagatgaaacagaaagtct

SEQ ID NO: 22957 - DNA, 201 bp, Homo sapiens
cccttcccacccaaagcccgcttccattaatagacctctagtacagccaggccaataccctgcaaataggagatcagacattttcctaagggatctgaccrggccaagatgaatcaagatactgacattatgggactcccaataaaatgtctcagcggatcacattacagcaaatcccaaaaacaataagacccaaccacc

SEQ ID NO: 22958 - DNA, 201 bp, Homo sapiens
tttatgtgtgctatgtttcacaataaagatgattcaaaataaatatcattaatgctaaaactcataatatggtgaaagagggtatatacatgatctcaaartatctccctaaaatgtactgaattattacaaagagaaaagtggtaaatttgcagtgaagaaacctggtattcaccaactcaaccaagtgatctcagttaa

SEQ ID NO: 22959 - DNA, 201 bp, Homo sapiens
ggcaacttcacccttctggttgcttataacaaaaagcttgaagatactgtctttttattaacagaaaaaattttaaaagctatgtacttatataatacacyttcaacaattagcaacaaatgctcaatcttcttttgttgaaatttttttttttcaaacaaatgctcaatcttatttcatctatatccacccacttccccc

SEQ ID NO: 22960 - DNA, 201 bp, Homo sapiens
gctcaattgatcctcccatctcagcctcctgagtagctgggactacaggcacacaccaccacacccggctaatttttgtattttttgtaaagatggggttycattatgtaccccaggctggtcttgaacttctgggctcaagcaatccacccgcctcagtctcccaaacagctgggattacagatgtgagccaccactcct

SEQ ID NO: 22961 - DNA, 201 bp, Homo sapiens
ctgctgtcctcagcaaaggagggtcccgttaagtccttcacatcaaagccctgtgcaccccccaaatttttcaaaaataaaaaataaatgtggccgagcayggtggctcacacctataatcccggcatttgggaggccaaggtaggtgaatcacttgaggtcaggcggtcaagaccagcctggccaacatggtgaaacccc

SEQ ID NO: 22962 - DNA, 201 bp, Homo sapiens
gtggctcacgtctgtaatcccagcactttgggaggctgaggcaggcagataagttgaggttgggagttcgagaccagcctggccaatgtggcgaaaccccrtctctacgaaaaacacaaaaaaaaattagccaggtgtggtggtgcgtgcctgtaaacccagctactcgggaggctgaggcacgagaaacacttgaaccca

SEQ ID NO: 22963 - DNA, 201 bp, Homo sapiens
tctactaaaaatacaaaaaattagccgggcgcggtggcgggcacctgtagtcccagctacttgggaggctgaggcaggagaatggcgtgaacccaggaggyggagcttgcagtgagccgaggtagcgccactgcaccccagcctgggccaaagagcgagactccgtctcaaaaaaaaaaaaacaaaaaatatttttaaaat

SEQ ID NO: 22964 - DNA, 201 bp, Homo sapiens
cccagctacttgggaggctgaggcaggagaatcacttgaaccttggaggcggaggttgcagtaagccgagattgcaccactgcactccagcctgggtgacrgagtgagactccatctcaaaaaaaaaaaaaaaaaaaaaaaaaaaaaaagctagcattcataaagcaggtattaaaatccagtggccaggtgtggtagctc

SEQ ID NO: 22965 - DNA, 201 bp, Homo sapiens
aggcattcatttcctatgttttgttttgttttgttttgttttgagacaaggtctcgctctgccagccaggctggagtgcagtggcttaatcacggctcatkgcagccttaatgtcttggactcaactgatcctcccacctcagtctcccgagtagctggaactacaggtgcgcaccaccagagccaggtaatttttgtatt

SEQ ID NO: 22966 - DNA, 201 bp, Homo sapiens
tttttgagacacagtcttgttctgtcacccaggctgaagtgcagtggcaccatctccgctcactgcaacctccacctcccaggttcaagtgattttcctgsctcagcctccagagtaactgggattacaggtgcccgccaccacacccggctaatttttgtactttttagtagagatggggtttcaccgtgttggccaggc

SEQ ID NO: 22967 - DNA, 201 bp, Homo sapiens
agcgagacttcatctcaaaaaaaaaaaaaaaaaaaaaaaaaaaaaaaaaaaaagctaagagttgttatttctgaggtagaataactaatgatcttatcttytcttttttcttttcttcaagatggggtcttgctttgtcacccaggccagagggcagtggcacaatcatagttcactgcagcttcaaacacctgaactcaa

SEQ ID NO: 22968 - DNA, 201 bp, Homo sapiens
acccattaagaataacaagaataagtttgacatataatgaaaaaagtagggaacttaatagaaatggagaactaaatatacacatattcagagttttctgmaatcccattaagtaatggtaaagggatttttcttaagcacaaaacttcaagaaaaagagaacagaagaaaagagaactgcaaaaaaaatctggaaaaggt

SEQ ID NO: 22969 - DNA, 201 bp, Homo sapiens
agaataacaagaataagtttgacatataatgaaaaaagtagggaacttaatagaaatggagaactaaatatacacatattcagagttttctgaaatcccaktaagtaatggtaaagggatttttcttaagcacaaaacttcaagaaaaagagaacagaagaaaagagaactgcaaaaaaaatctggaaaaggtaatctatt

SEQ ID NO: 22970 - DNA, 201 bp, Homo sapiens
tgccaggcatggtggtgcatgcctgtaatcccagctactcaggaggctaaggcaggagaatcgcttgaacctgggaggcgaaggttgcagtgagccaagawcatgccattgcactccagcatgggcaacaagtacgaaactccatctcaaaaagaaaaataaataaataaataaataaaaaaggaatgaaattcttttttc

SEQ ID NO: 22971 - DNA, 201 bp, Homo sapiens
ggggttttacacatgcttattaagtaaaatcaaatctttaacttaaaagctatgttgtaaaggtattcttttttttttttgagacaaggtctcactctgtygctcaagctgagtgctgtggcatgatcatggctcactgcagcctcaacttcccagattcaagcaattctccaggcaattctcctgcctcagcctcctgag

SEQ ID NO: 22972 - DNA, 201 bp, Homo sapiens
taaaggtattcttttttttttttgagacaaggtctcactctgttgctcaagctgagtgctgtggcatgatcatggctcactgcagcctcaacttcccagawtcaagcaattctccaggcaattctcctgcctcagcctcctgagcagctgggactacaggcacacaccaccactcctggctatttttgaccatttgtagaa

SEQ ID NO: 22973 - DNA, 201 bp, Homo sapiens
ccctgagctagacataaaggttctccacgtcccaccagagcagccagatacagagtgtggattggtgcattcacaaactcagagctagacacagggtgctsactggtgtgtttacaaaccctgagctagatacagagtgccgattggtgtatttacaatccctgagctagacataaaggttctccacgtcctcaccagact

SEQ ID NO: 22974 - DNA, 201 bp, Homo sapiens
gagggggtggaaggctcaggcatggcgggctgcaggtcccgagtcctgccccactggaaggcagctaagtaaggcccggcgagaaatcaagcgcagcgccrgtgggctagcactgctgggggacccagtacaccctccatagccgctggcccgggtgctaagcccctcattgcccggggggccggcagggccggccggctg

SEQ ID NO: 22975 - DNA, 201 bp, Homo sapiens
ttgggaggctgaggcgggcggatcacgaggtcaggagatcaagaccatcctggctaacatggtgaaaccccatctccactaaaaatacaaaaaattagccrggcgtggtagcaggtgcctgtagtcccagctacttgggaggctgaggcaggagaatgacgtgaacccaggaggcggagcttgcagtgagccgagatcgtg

SEQ ID NO: 22976 - DNA, 201 bp, Homo sapiens
aatctcagctcactgcaacctccgcctcccaggttcaagcaactctcctgcctcagcctcctgaatagctgggattacaggcacgcaccaccaggcccagmtaatttttctgtttttagtagagatggggtttcaccatgttggccaggctggtctcaaactcctgacctcaagtgatccatccgcctcagcctctcaaag

SEQ ID NO: 22977 - DNA, 201 bp, Homo sapiens
gaggctgaggcaggagaattgcttgaaccctggaggcgtaggttacagtgagccgagatcgtgccactgcactccagcgtgggcagcagagtgagactccrtcacacacacacacacacacacacacacacacacacaaaagccaggtgcggtagctcacgcctgtaatcccagcactctgggaggccaagtcgggcagat

SEQ ID NO: 22978 - DNA, 201 bp, Homo sapiens
tgtgtctaaaatatagagaatattttaggccaggcttggtggctcacacttaaaatcccagcactttgggaggctgaggtgggtggaccacctgaggtcaraagtttaagaccagcctggccaacatggtgaaaccccatccctattaaaaaatacaaaaattagctgggcatggtggcgagcacctgtagtcccaactac

SEQ ID NO: 22979 - DNA, 201 bp, Homo sapiens
caccattgcctcagcaaaagccttaacaccaaaaggccccagcaccaagcatgacctgatgggcaggcactgtcctgatgaacttatctgagccagaaacyaaagaccattccaatggccaaccattctaaatggccgacagcctaggataaaatttacaacaaagagaaatttacatatttaaattttacacagtcatga

SEQ ID NO: 22980 - DNA, 201 bp, Homo sapiens
tggtatacacaaagaataaaaaacaggccgggcgcagtggctcacgcctgtaatcccagcactttgggaggccaaggcagatcacttgagatcaggagttygagaccagcctggccaacatggtgaaatcccatctctactacaaacacaaaaattagctgggcatggtggcacacacctataatcccagctactcaggag

SEQ ID NO: 22981 - DNA, 201 bp, Homo sapiens
ttagccaggcacggtggcgggtgcctgcaatcccagcgacttgggaggccgagccaggaaaatcacttgaaccaggaaggcggaggttgcagtgagctgarattgcaccactgcactctagcctgggcaacagagcaagactctgcctcaaaaaaaaaaaaaaaaaaagaaaatagctgtgcctcttaccaaccaataaaa

SEQ ID NO: 22982 - DNA, 201 bp, Homo sapiens
tttgatctagaacttctcagcctccagaaatgagagaaataaattcttttgtttataagctatctagcctatggcagtttgttgcagcagcccaaagagaytaagacacctcagaagctgtttattcaggttagaatacctgaattgaattttacttctacagcaatccaataaattgtaagaagtgccatacctctctcc

SEQ ID NO: 22983 - DNA, 201 bp, Homo sapiens
ataaattgtaagaagtgccatacctctctccctctccattagttccagctatgcaattctactctggtcactatatgccagacttagaaactgatgctaaraaagtaaattttaggctgggcacagtggctcacaccagtaatcccagcactttgggaagccaagacgggtggatcacctgaggtgaggagttcgagacct

SEQ ID NO: 22984 - DNA, 201 bp, Homo sapiens
tagaaatagggtctcactatgtcacccaggctcatctcaaactcctggcctcaagtaatcctcatgctttggcctccaagtgctgggattacaggcgtgasccaccgtggccagccgcttccttaattatttaaatagagataaaggcctgtaactcaaaacttttttcctgcctcacgactgttctaagagattatggag

SEQ ID NO: 22985 - DNA, 201 bp, Homo sapiens
ggattacaggcgtgagccaccgtggccagccgcttccttaattatttaaatagagataaaggcctgtaactcaaaacttttttcctgcctcacgactgttytaagagattatggagtaaagaaattatggggctaagcacagttgctcatatctgtaattctagcacgttgggaagatgaggcaggaggatcacttgagcc

SEQ ID NO: 22986 - DNA, 201 bp, Homo sapiens
atcagcaaaatccagaatgtagaaaaccatacaacaatctgtaccttcaacaaataatttgcaagcaagaggcaaaaaaaaaaaaaaaaaaaaaaaaaaargactggaggggtactctgtattttaaaagacttaaagagatataatcaaatgcaatatgcagaccttatttagatcttgagtcaaactgtaaaacaccat

SEQ ID NO: 22987 - DNA, 201 bp, Homo sapiens
aagcaagaggcaaaaaaaaaaaaaaaaaaaaaaaaaaaagactggaggggtactctgtattttaaaagacttaaagagatataatcaaatgcaatatgcaraccttatttagatcttgagtcaaactgtaaaacaccatttatgagacaatcagagaaatctgaacattgaatatttcatgatattaaggaaccattgtca

SEQ ID NO: 22988 - DNA, 201 bp, Homo sapiens
atgcagaccttatttagatcttgagtcaaactgtaaaacaccatttatgagacaatcagagaaatctgaacattgaatatttcatgatattaaggaaccaytgtcaattttttaaagtatgataatagtaatacggttaagtttaaaataagaatccttatcttttggagacagcactgaagtatttcagataaaattata

SEQ ID NO: 22989 - DNA, 201 bp, Homo sapiens
aacctggctcacaccctggctattgcacttaatagtccaacctaggagtaaactactttgtcattttgagtctcagtgtcctcctctataagataaaaacmcaacaaacctaaaaagtttgttgtaaggatgaaatgatgtaagtaacactgaatacagtccttgatactatgctcctggtattaggaaaggtagtaaaat

SEQ ID NO: 22990 - DNA, 201 bp, Homo sapiens
ctcacaccctggctattgcacttaatagtccaacctaggagtaaactactttgtcattttgagtctcagtgtcctcctctataagataaaaacacaacaamcctaaaaagtttgttgtaaggatgaaatgatgtaagtaacactgaatacagtccttgatactatgctcctggtattaggaaaggtagtaaaatttactga

SEQ ID NO: 22991 - DNA, 201 bp, Homo sapiens
actttgtcattttgagtctcagtgtcctcctctataagataaaaacacaacaaacctaaaaagtttgttgtaaggatgaaatgatgtaagtaacactgaawacagtccttgatactatgctcctggtattaggaaaggtagtaaaatttactgatataaccatccttaacacttcgctagttgtaatttcagatccaaagg

SEQ ID NO: 22992 - DNA, 201 bp, Homo sapiens
ttagtagagatggggtttcaagagaaaatgaattagtaatctgaggagataaagagagaaaaagaaatggtctttagaaataaaggattaaagtacatatrctcagctaaagaaactgtaaagaggggccaggtaccatggctcatgcctgtaatcccaacactttgggagacgaaggcggatggatcacttgaggtcaga

SEQ ID NO: 22993 - DNA, 201 bp, Homo sapiens
actccctctctccccacaccctccccactcagaatctctactttgtattgtttgaatgtttttcaaaattaagcatgcattatttatttacttatttattkgagacagggtctcgccctgttgcgcaggctaaagtgcagtggtgcaatctcagcttactacaacctccgcctcccgagttcaagtgattctcaagcctca

SEQ ID NO: 22994 - DNA, 201 bp, Homo sapiens
aaaagtactattaataatcacacttagacaatgggtataaaatgggactgttctaggctgggtgcagcggctcacgcctgtaatcccagcactttggaggycgaggaaggcagatgacgaggtcaggagattgaaaccatcctggccagcatggtgaaaccccgtctctactaaaaatacaaaaattagctgggcatggtg

SEQ ID NO: 22995 - DNA, 201 bp, Homo sapiens
acacctggctaattttttgtattttagtggagatgggtttcaccatgttagccaggctggtctcaaactcctgagctcaggcaatccgcccaccttggccycccaaagtgttaggattacaggcgtgagccactgcacccagcctgtacaaatactttagaaagtaatctacgttttcatgctgaatttcataaaataaag

SEQ ID NO: 22996 - DNA, 201 bp, Homo sapiens
cacctggctaattttttgtattttagtggagatgggtttcaccatgttagccaggctggtctcaaactcctgagctcaggcaatccgcccaccttggcctyccaaagtgttaggattacaggcgtgagccactgcacccagcctgtacaaatactttagaaagtaatctacgttttcatgctgaatttcataaaataaaga

SEQ ID NO: 22997 - DNA, 201 bp, Homo sapiens
ctaattttttgtattttagtggagatgggtttcaccatgttagccaggctggtctcaaactcctgagctcaggcaatccgcccaccttggcctcccaaagwgttaggattacaggcgtgagccactgcacccagcctgtacaaatactttagaaagtaatctacgttttcatgctgaatttcataaaataaagaacaagaa

SEQ ID NO: 22998 - DNA, 201 bp, Homo sapiens
attttttgtattttagtggagatgggtttcaccatgttagccaggctggtctcaaactcctgagctcaggcaatccgcccaccttggcctcccaaagtgtkaggattacaggcgtgagccactgcacccagcctgtacaaatactttagaaagtaatctacgttttcatgctgaatttcataaaataaagaacaagaacta

SEQ ID NO: 22999 - DNA, 201 bp, Homo sapiens
tcctgagctcaggcaatccgcccaccttggcctcccaaagtgttaggattacaggcgtgagccactgcacccagcctgtacaaatactttagaaagtaatytacgttttcatgctgaatttcataaaataaagaacaagaactaatacattttccagtttcaggtttaagagatatgtattttttgaactaagtttagaaa

SEQ ID NO: 23000 - DNA, 201 bp, Homo sapiens
cctgagctcaggcaatccgcccaccttggcctcccaaagtgttaggattacaggcgtgagccactgcacccagcctgtacaaatactttagaaagtaatcwacgttttcatgctgaatttcataaaataaagaacaagaactaatacattttccagtttcaggtttaagagatatgtattttttgaactaagtttagaaac

SEQ ID NO: 23001 - DNA, 201 bp, Homo sapiens
caccttggcctcccaaagtgttaggattacaggcgtgagccactgcacccagcctgtacaaatactttagaaagtaatctacgttttcatgctgaatttcwtaaaataaagaacaagaactaatacattttccagtttcaggtttaagagatatgtattttttgaactaagtttagaaactttacctaatgcccataaaaa

SEQ ID NO: 23002 - DNA, 201 bp, Homo sapiens
ccaaagtgttaggattacaggcgtgagccactgcacccagcctgtacaaatactttagaaagtaatctacgttttcatgctgaatttcataaaataaagamcaagaactaatacattttccagtttcaggtttaagagatatgtattttttgaactaagtttagaaactttacctaatgcccataaaaaggaaataactaa

SEQ ID NO: 23003 - DNA, 201 bp, Homo sapiens
aaagtgctgggattacaggcatgagccaccacacctggtcagatttataactttttttttttttgagacagggtcttgctattttgcccaagctgttctckaactcctaggttcaaatgctcctcccacctcaatctcctgagcagctgagattacaggcatgccccaccatgcccagctatgttcacatataacttagaa

SEQ ID NO: 23004 - DNA, 201 bp, Homo sapiens
tgggaggctgagagaggaggattgcttgagcccaagagtttaagaacagccctggcaacatagtgataccccgtctctataagaaaaattaagaaattagytgggcatggtgccatgtgcctgtagttccagctacttgggatgctgaggtgggaggatcacttgagactgggaagtcaaggctgcagtgagccatggtcg

SEQ ID NO: 23005 - DNA, 201 bp, Homo sapiens
agaaattagttgggcatggtgccatgtgcctgtagttccagctacttgggatgctgaggtgggaggatcacttgagactgggaagtcaaggctgcagtgasccatggtcgcaccactgcactccagcctgggcaacagaccaagatcctgtctcaaaaaaaaaaaaaaaaagctaaagaaaatgatgtatggttcgaacat

SEQ ID NO: 23006 - DNA, 201 bp, Homo sapiens
tttttttttttctgtttgagataagaggcttgctctgttgcccaagctagagcgcagtggcgagatctcggctcactgcctcctgggctcaattgatcctyccatctcagcctcctgagtagctgggactacaggcacacaccaccacacccggctaatttttgtattttttgtaaagatggggttccattatgtacccca

SEQ ID NO: 23007 - DNA, 201 bp, Homo sapiens
tgaaaataaaactattagccaggcgtgggagtgcacacctgtagtcccagctacttgggaggctgaggtgggaggatcacttgagcttggaagtcaaggcwgcagtgagccgggatcatgccactgtactccagcctaggtgatagcatgagaccctgtctcaacaacaacaacaacaaaaaaggctaaaatagtattacc

SEQ ID NO: 23008 - DNA, 201 bp, Homo sapiens
ccttacaccaaaatgcaaattctccatacttgttttgaattagcataatttaaaattctcaaggaagattcactggaaataaggtggacagaggactgtaytaaataccataaagatgcgatcagcaaaatccagaatgtagaaaaccatacaacaatctgtaccttcaacaaataatttgcaagcaagaggcaaaaaaaa

SEQ ID NO: 23009 - DNA, 201 bp, Homo sapiens
ttcctataaaagactaataagattggcaagaaatacaatacaatgagtaactttttttttttttggagacagagtcttactccgttgcccaggctagagtrcagcggcgtaatctcgacttgctgcaacctgtgtctcctgggttcaagcgattctcatgcctcaccctcctgagtagctgggattacaggtgtgcaccac

SEQ ID NO: 23010 - DNA, 201 bp, Homo sapiens
caccatcttggccaggctggtctcgaactcctgacctcaggtgatccacccacctcagcctcccaaagtgctgggattacaggcatgagccaccacacccrgccagcagtaacattcttaaatgaaaattaaacttctgaatccaaattcatctctgcccatataagaagttaaaaaagtatgtaataatacaaaattaaa

SEQ ID NO: 23011 - DNA, 201 bp, Homo sapiens
gatcttggctcactgcaacctctgcctctcaggttcaagcgattctcatgcctcagcctcccgagtagctggaactactggtacacacgacacacctggcwaattttttgtattttagtggagatgggtttcaccatgttagccaggctggtctcaaactcctgagctcaggcaatccgcccaccttggcctcccaaagtg

SEQ ID NO: 23012 - DNA, 201 bp, Homo sapiens
ctgcccctgatcatcccttccatgtccttgtacatatctacacatggctgcagtcggtgagatatagttttggttaattaggaaagagtcatccacacacytgaaatgccaaccctcacagatgtccagtggtgcaaattatgacaaccatgttgcctaattcaattccctcttgcaagacaacattagtcagaactctaa

SEQ ID NO: 23013 - DNA, 201 bp, Homo sapiens
cccttccatgtccttgtacatatctacacatggctgcagtcggtgagatatagttttggttaattaggaaagagtcatccacacacctgaaatgccaaccstcacagatgtccagtggtgcaaattatgacaaccatgttgcctaattcaattccctcttgcaagacaacattagtcagaactctaacttgtacaacatca

SEQ ID NO: 23014 - DNA, 201 bp, Homo sapiens
atccaaatggagggacattccacaaaatacctgaccaggactccccaaaactgtcaaggtcatgaaaaacaaaagactgagaaattgccacaaatcagagsagaccaaagggtatgtgatgactaaatgcaatgttggatgctggaagagaaaaaggacatgatggaaaagctagtgaaatccaaataaagtctaaagttt

SEQ ID NO: 23015 - DNA, 201 bp, Homo sapiens
gtgaaacaaaatcacgcaactgcattccagcctaggtaacaaagtaagaccctgtctccaaaaaaaaaaaaaaaagaaagaaagaaatttgccacacagaytcagagtatgtattacctcagttacttttctttctacttctgttccatccacataatacacatctgtaatgacacgagtgacaagtgtgcgtacttcccg

SEQ ID NO: 23016 - DNA, 201 bp, Homo sapiens
ttagtatttctggactgcagctgaccatgggcaactaaaaccaccaagaaaaagaaaccactgataagcagagactactgtttactagtaacttccaaatyttctctgccatagatcccactctgccactcaatgaaatgttgtgaacttctacgtatttgttaacacatacatttctacgacttcttttcatctactcaa

SEQ ID NO: 23017 - DNA, 201 bp, Homo sapiens
cagggggttcaggcaggaggattgcttgagcctaggaatttggggctgccgtgagctattactgcaccactgcacctcagcctgggtgacagagtgagacmctgtctctaaaaagaaaaagaaattatggaaaaattaattccattaagtctgaaaaactttaaatttgggatgttaaacatctcatattttgctctgtgg

SEQ ID NO: 23018 - DNA, 201 bp, Homo sapiens
atttcaaattgatacaactggcagataaagacaaaaatgtgtatctataaaatatttaacaaaatttctcatgacagctcatcaatctatccagaatacaytatagtccctcaaggtataaaaaaataaggtaagctcaagctcacaaaacagtagcagtacatcttagtctgttttctgctgctataacagaattcccac

SEQ ID NO: 23019 - DNA, 201 bp, Homo sapiens
ataaaaataagtaaaactagtaagtataaacatacaaacatttcttgtaattttatttatttatttctttattttgagacagtctcactctatcacccaarctggagggcagtagcgtgatctcagctcactgcaacctccgcctcctgggttcaagcgatctcctgcctcaacctcccgagtagctgggactacaggcat

SEQ ID NO: 23020 - DNA, 201 bp, Homo sapiens
aacctctcttactctgttttctcatcaataaaatgaaaatgcagatacctacttgggagtactattatggaaatgagatcatacagtatatgtgaagagtmattctctctttttttcctcccccttacttccatattcacctggcaccatcgttctgcctactcgctcctcaaattcatccctcatctccagccccactac

SEQ ID NO: 23021 - DNA, 201 bp, Homo sapiens
atgaattacttgttttctcctgagtttggggctgctgcaactcctggtcaagtcttaaaggatcatctgctctcactaaaggtaaggaaggctgtgaagartcttgctctacaggttctgtttctgcagtccctgatttcagatctccttcatattctacactcttttcttccttggtgtctaatctattctcagcacatg

SEQ ID NO: 23022 - DNA, 201 bp, Homo sapiens
ttaacaaaacaagttttaaaactccagaaaacaaatcaatttcttcctactgtcccctcctcactaaatttacagttcattactattcattttcaaatttyacttttaaatacaaactcttgttataacacctgcaaactgaaaggggtaaaataagttgtcccaataaaactacaataattcccccacttaaggtcttat

SEQ ID NO: 23023 - DNA, 201 bp, Homo sapiens
gtaaaataagttgtcccaataaaactacaataattcccccacttaaggtcttataagaataggtatttagattgaatatataatagtcatttagatttaargattttcaactcagtatgaaacctgaatttcatttctttaaatatttaaatttaaaattatacaaattaatagttttccctcgcttttagaagaaaatac

SEQ ID NO: 23024 - DNA, 201 bp, Homo sapiens
aagttgtgctatataaacaccttttttaaaaaacataagcatgtgggggcacatatcgtcaggacctcctgaggctgtgtcataggcaaaaaaatttattwaaaaaaaccataagcatgtagaaagacaaaaattacagtaacagttgtgttaaagtagaataatgatttatgtcacttcgcaattttgcagtaacatttt

SEQ ID NO: 23025 - DNA, 201 bp, Homo sapiens
ttttgcagtaacattttcaaaaagtttaaagacattgtaaaaagtttaaacataaaaaaaaatcaagatgttaggtgactttggaactgttctaaaactgytttgtgacgacagcttcacaactctgtaaatttactaaaatatcacaaaattatacatttaaaacgtgtgaattttatggtatgtaaattataccccaat

SEQ ID NO: 23026 - DNA, 201 bp, Homo sapiens
ggagggaagactggtgtgctctgagatattggtgttgaggcttgtggtgatacagtggactcaggcaggagaggggggttttctaactccactggttcacyactttgaagtttcttctgaaaaggctctcctccttcttcagataacactgacgtgtccattggcttatctggtttaaaacaggagaaacaaattgagaaa

SEQ ID NO: 23027 - DNA, 201 bp, Homo sapiens
gttaagagaaaagcaaaaaaacaaataaatacaaaaagcacatatagtttcacaaacactgatgtacatacatattaagcaaatgcattaaatctaaaatmtaactgacaagggaaaatacactgttacataaaaaaaaaaaactgagtcatatacacaacatgccaattatgtaaaactactttatgcattgaaaactga

SEQ ID NO: 23028 - DNA, 201 bp, Homo sapiens
tcaaataaaatttaaaaaataataataaataataaagtaaaagtaacatagcatgaacacagtgcctactcttggatcctacttcctgtgtcattattacmctttcccattctactctgagcatatcccttctgcagtgtcttcagtacagctaggtctcaaaggctgatctggacttgtacagagctagtgtgctaacta

SEQ ID NO: 23029 - DNA, 201 bp, Homo sapiens
aaaagcacctaaaagattaacaattcaacatcctacacagaattaagtaaagaaaaaataaggcaccaacatactcgaattttatatttttgagaagaggyagaaaaatcttgcattcaggagaattactgacaagtgacaagagaagatatgcattggatgagcacagaaagggctcaaaaaactttttaaaagttcaca

SEQ ID NO: 23030 - DNA, 201 bp, Homo sapiens
ccattagggaaatgcaaactgaaacaacaatgaggtatcactacagacttgtaatggctaaaataaaaaatactgaaaacaccaaatgccagtaaggatgaaaaaaaattagatcactcatacattgctggtgggactataaaacagtacggccactctagaaaagtttggcagtttcttaaaaaaacaaacatgcaacta

SEQ ID NO: 23031 - DNA, 201 bp, Homo sapiens
tcaggatgctgaggctgaagaatcacttaaaccctggagtggaggttgcagtgagctgagattgcattccagcctgggcgacagagcaagactccatctcaaaaaaaaaaaaaaagaaaagaaaaacctgttcataaatgcttataacagcttctcaatagtagtcaaaaacaagaaaaaaaaatgcagatgtccttcaac

SEQ ID NO: 23032 - DNA, 201 bp, Homo sapiens
aatcaatactaatcacactggtttcaacttccatagcttctgagcattctttttttggcatttccttttgaagacacaacccttgggactgagtttcagtmagagaaaggtgcaacggaacactctccatattttcttctttgagttcctctccttgactttcacaaggtgtctcagggatttcttccacctcagaccctg

SEQ ID NO: 23033 - DNA, 201 bp, Homo sapiens
atgcagacactgcccaatcagaacgtggctcacaggcagccttgctgaatctgatactgtgttcctttctttcctgtactatctccaaagcaaaggcaaaygggacaaaaaaaaacccaaaaacccaaaaaacaaaacaaaacaaaaaaacaaaaaaacaagtgctgctggagccctagggtgaaagataggcgctcccat

SEQ ID NO: 23034 - DNA, 201 bp, Homo sapiens
caacaaaggtcccagatctttaattctagaaaatctgtctaatctctctcattattagatgtaaacaaagtcagcatagtatgccattcaagataacaaayagtcactaaatgccaatactgagctgacatttgtaatgagtctataatgaatcccactaaaaaataaaggtgcatttcttaccaacaggtctatgaccac

SEQ ID NO: 23035 - DNA, 201 bp, Homo sapiens
cctttttccatcccccccgccacgtccttctggcgcctctacctccccccaaaagaatgttttctaaaatctgttcgccagaggccccacagcctttcagstttcctcacgaccaccaagccttcttagctaacgtttccccaccccctccttagggccctccaaccccttccccgtcaccgccgccatgcttgccacccc

SEQ ID NO: 23036 - DNA, 201 bp, Homo sapiens
tggtattacaggtgtaagccaccaagcatgaccacatcttctgcaagacatatgtattttttcccttgttgcaaaaaataagtcattttacaaagtctcayagataaaacatcactaacgtaaagctataaatacctttttttaaatgaaactcacaatataaaattaacccattttaaactaaacaattcaggccaggcg

SEQ ID NO: 23037 - DNA, 201 bp, Homo sapiens
ctgtaaatctctccaagctcttttccagattcagatccacaaacggggggggggggggcagaggtacagcggaacaccgtctcatgtgtcatagtcatgaractagagggtgaggcatccccagcatctgacattctgccagtactcttattttcccctttctgtgcaaaaaggattttcagggccatgtccaaattggtt

SEQ ID NO: 23038 - DNA, 100 bp, Homo sapiens
tggcccttctgatggcttagatgcctcctctccaggaaatagctttgtakggctccgtgttgtagccaagtggtcatccaatggctacttttactctggg

SEQ ID NO: 23039 - DNA, 201 bp, Homo sapiens
ggctcacacctgtaatcccagcactttgggaggacgaggcgggcggatcatgaggtcaggagatcgagaccatcctggctaagatagtgaaaccccgcctmtactaaaaatacaaaaaatcagctgggcatggtggtgggcgcctgtagtcccagctactcaggaggctgaggcaggagaattgcttgaaccctggaggcg

SEQ ID NO: 23040 - DNA, 201 bp, Homo sapiens
aaattttaaaacccaacccaatccagtgcataaggttcaatgccggtaccactccccttccccttcacacccagtagtaaaacttagagcagatcccttaygacggctcccccttcagtgccctcgttgtctgctggaggagctcaggcaccgccgaggccccaggtcaggggtctccatctccacttagttctgactagc

SEQ ID NO: 23041 - DNA, 201 bp, Homo sapiens
tcaacactgttgcactgggggttaagtttccaacacatgccacattcaaaccacagcacagtacatattaggatttgggcactaaccattttgtgaaccartggagcccaaaagattctataaaaataatgcttacctgatgggtgtggtggggggatcctcacttcgagcctcattctcttgcctggcttcacagataca

SEQ ID NO: 23042 - DNA, 201 bp, Homo sapiens
tggtgccaccgcactacagcctggatgacagagcgagaccgtgcctcaaaaaaacaaaacaaaacaaaacaaaaacaaacctgtaaacagtatggatgaasaatctcaacattacatctaactgacagacatccaccatagttacagaaaagagaaatgggtcaggtagataagcattcattctgtggtagccccttataa

SEQ ID NO: 23043 - DNA, 201 bp, Homo sapiens
agagatacagaaacttaaaaaacaccttgcaaagcctcatatattccagacttctgaaaatgtgcatgaaatctttaagcagacctttctatgtgacataytatattacgcaaatgcaatatgcaagcattaatcgctgaaaatatatccctgtaacaaggtttcctttgcacagtattacataaaacttatggaaagtaa

SEQ ID NO: 23044 - DNA, 201 bp, Homo sapiens
atagatttttaaatactttataattcatatatgtatttaattttttatttagctttctaagtcttatacatatgtatcagagcattttctgtctttgcttrtaaaattctgggacacagatgctaatgctccacagttttcttttttcttttttttttttctgtttgagataagaggcttgctctgttgcccaagctagag

SEQ ID NO: 23045 - DNA, 201 bp, Homo sapiens
tatcctgcccaaggccactcttctcactggaaggcccaagtaatttccatagatgttctctctgcctcacctgcagcatactgaggacctaaatcctcaayggacaaccaaaacctatgaactcagcctttcaggctaaaaatcagcaaccctaataggggtttctactactaaacataaacatcaatcttcttttgtccc

SEQ ID NO: 23046 - DNA, 201 bp, Homo sapiens
ctattaaaaaacagcaaatgagccttttattccaacgtctaccttaggtgaagtcaagctcatgccatgatacagatgggagaagtcaaaaaaatgcacaygacacttgatgttataaatgcagcagttttcaagatttgggcctgctcaaaggagtaaaaggatttatgagcagccattactgttttatactatgaagag

SEQ ID NO: 23047 - DNA, 201 bp, Homo sapiens
attttactcagtgcctttttaaaggttattttactccatgcctttgcagacaaaccagctgttcaggctgaggtgaccctatggctgctggtatgcattaygatcatagtatttcccccaaaagccaaggataagcctctgacacagcacttctgtaatccaacacgcctctctctgggtaagaatgctttacaggcagaa

SEQ ID NO: 23048 - DNA, 201 bp, Homo sapiens
gagggcatttttccctctcatatcaattctagatacctttatggcaacaagaaaagaaaaaaccatcctgaaatgtttcttagaaatatatagtccaataktcctaattcaatagatatttattgggtgtgtattataaccatacacccttatctttatctttcagatgaataaaagaatcctaagggaggtagtatggcc

SEQ ID NO: 23049 - DNA, 201 bp, Homo sapiens
catcctgaggttgtaatggaacacggaagtggttgtcccaatttctaagcccatgttgcagactgtcaccatgccagtgcaggagatggagtctacaacargcccgtggtattccacgattgcacctgtgccacctttcatggtgaggatgcctgccaccttcaggatcacatctttgggtgaggtccaaccagagaggga

SEQ ID NO: 23050 - DNA, 201 bp, Homo sapiens
ggccggcagctgagatgtggtcagtggtaccccatgcgggggtgctggtaggtgtcctgccctgggccaaactctgcttggggaagctcatctgcatccgsagcctccagcttgaacttcttgccatccttgcctgtcaggtagttggtctctgggttgaacttgagggttcccacaatggccagggctgtgacagtctct

SEQ ID NO: 23051 - DNA, 201 bp, Homo sapiens
gaggaaaaggaaggaggtgtcagttggactgccccaaggcaacccttgagccatcaggacagctcaacacctcctctgttttcatctttgtacttcctgtyagtcaggcagaggaccgttccttcccatgattcagactgtatcccgcctcatctccctgaactttttgaggacagctataggcaggtacaagccctgatt

SEQ ID NO: 23052 - DNA, 201 bp, Homo sapiens
cagacggcgccttgggagcttgatctcttccaactgtcagggcatgggagtcattctgccattcttgtctcacagcaggagtacctgaagagaaccctggyccttttggggaggggggtttaactaggcttgttcttacagaaaataatgggctgataggggagattctcttcttcttcacaatttatgtcagatgtaacc

SEQ ID NO: 23053 - DNA, 201 bp, Homo sapiens
tcacagtggatggtggatggcatggtcaccttgggagcctgctgctgatgaactgcagcatggccatctgggccgtccatcctgcatggtcacgctgtccrgccactgctgcaggtacgtcccgccccgctcaatttcctggctggtggggtcatccgggtgtctgtacacgatcttctctgagagggtcagaggccggtt

SEQ ID NO: 23054 - DNA, 201 bp, Homo sapiens
gtcacagtggatggtggatggcatggtcaccttgggagcctgctgctgatgaactgcagcatggccatctgggccgtccatcctgcatggtcacgctgtcyggccactgctgcaggtacgtcccgccccgctcaatttcctggctggtggggtcatccgggtgtctgtacacgatcttctctgagagggtcagaggccggt

SEQ ID NO: 23055 - DNA, 201 bp, Homo sapiens
agtgatctttgaattcatcagctagattggcaatgtctgcctggcaggtcttgctcatgtacttcttcatcctgaggttgtaatggaacacggaagtggtkgtcccaatttctaagcccatgttgcagactgtcaccatgccagtgcaggagatggagtctacaacaggcccgtggtattccacgattgcacctgtgccac

SEQ ID NO: 23056 - DNA, 201 bp, Homo sapiens
atactttcactatggcctactttaaaataccaacatggtatcagtgagaagtgatgtgcagtagcataccattttctagtatttttaccacacagacacarttaacataaatatcctcaaaagcatacgtaatagtgaaatgtagtaaaataactagaaagttatgagttttgaatacttggttccgttttaaatataatt

SEQ ID NO: 23057 - DNA, 201 bp, Homo sapiens
atgagttttgaatacttggttccgttttaaatataattcatttaattgaaagtttatataacttaatttgtaacaagagctgcacttaacaaccaacccayaaaatttctaaaactccgtcagcttgctttggctcttgcaactcagtgtgagccatcaccaggacagcatagattctgtgtctcaatgtctcatttataa

SEQ ID NO: 23058 - DNA, 201 bp, Homo sapiens
gtatatatgtgacacattttctttatccagtctatcactgatgggcctttgggttggttccaaatctttgctattgtgaatagtgccgcaataaataggcrcgtgcacgtggtaccaggcatttttctaaacactttacatagattcagtcatttgttcttcacaaaattggatgaggcaggcacaagtatcatctccatt

SEQ ID NO: 23059 - DNA, 201 bp, Homo sapiens
atggtgaggatgcctgccaccttcaggatcacatctttgggtgaggtccaaccagagagggagcccatcagcttcacgccaatcaccttggggcacttcarctcccaggggatcccagtcatgacatccacagctcggcacccccaactccaatgcagatgccccccaggctgccaccattgggggtgtgggagtcagtgc

SEQ ID NO: 23060 - DNA, 201 bp, Homo sapiens
cttgatctcttccaactgtcagggcatgggagtcattctgccattcttgtctcacagcaggagtacctgaagagaaccctggcccttttggggaggggggkttaactaggcttgttcttacagaaaataatgggctgataggggagattctcttcttcttcacaatttatgtcagatgtaaccctatactctctgaaagat

SEQ ID NO: 23061 - DNA, 201 bp, Homo sapiens
actcactctgacttcatcacctctttcagctggatttgctgagctcttccctggcaggccaaacccatgaaagcagacggcgccttgggagcttgatctcktccaactgtcagggcatgggagtcattctgccattcttgtctcacagcaggagtacctgaagagaaccctggcccttttggggaggggggtttaactagg

SEQ ID NO: 23062 - DNA, 201 bp, Homo sapiens
tatttcattctttttattgttgaatagtattccattatatcaatatactgcaatgtgtttatcctcttattgatggacatcttgactatttcaagttctgrtcgataaagctataagtgtttttatacaaatgtttctatgaacatatgttttgtttctttttattagggaaatacctgggaggagaaattctagatcata

SEQ ID NO: 23063 - DNA, 201 bp, Homo sapiens
tccattatatcaatatactgcaatgtgtttatcctcttattgatggacatcttgactatttcaagttctgatcgataaagctataagtgtttttatacaartgtttctatgaacatatgttttgtttctttttattagggaaatacctgggaggagaaattctagatcatagagtacgtgtgtggttagttttataagaaa

SEQ ID NO: 23064 - DNA, 201 bp, Homo sapiens
gtgagctgagaatacagaacagaggggagaataagacattgctagcagagtgatagtcaagcaggtgaataattatcatctcatatgataagagctatagyagagacatgtgcaggtaccatgggggtagaggtgaatgtccgattccacagaacagagacaatggagaaagaagagaagaaagcatctggactggagata

SEQ ID NO: 23065 - DNA, 201 bp, Homo sapiens
ttttaaagtccatcagattaactgcaaatccctttatccaactctgtgtccctgggaaaatcacttaacctttctgagtccctatttaatcaatatgatakaaagagtatactcacatcataagattatgatgaggattagatgagatcttttagactactcatctagagcactgccaggcccatggtcactccccagcaa

SEQ ID NO: 23066 - DNA, 201 bp, Homo sapiens
tcacagtaatcacgaaggaggaaaaggaaggaggtgtcagttggactgccccaaggcaacccttgagccatcaggacagctcaacacctcctctgttttcwtctttgtacttcctgtcagtcaggcagaggaccgttccttcccatgattcagactgtatcccgcctcatctccctgaactttttgaggacagctataggc

SEQ ID NO: 23067 - DNA, 201 bp, Homo sapiens
cagaagataggcaaggtggctatcacagccaacccttccagtgtgctttactcccctaaatctcccttatacccttatacatattgtccattctccatgcygcaggctatcgcccctacaccatgactaaggtcatcctatacttcaaaacttggggtcctgagttttcatagtcttcttccaatttcatcaaaacctgct

SEQ ID NO: 23068 - DNA, 201 bp, Homo sapiens
taaaataagacccgcctgagcctgagaagaggaccaagagaaaaggagaactaacattctagggccacagtaggactcaacatgctgtcctgacctggagmcagcccaaagacacattctttcttagcgtgtgattgcacaggtggattgagggacatgttttccaagctcatggcagtaccttgaatagatggcccatct

SEQ ID NO: 23069 - DNA, 201 bp, Homo sapiens
caagtgagtgaaagagctagaatttgcacctcactgttggtttcaatacccacacccttccttccctacagagctccactgttgccgagctactgtgcttstcatcgcatgctttcatcatagacagcagcagcatcgaagccaagaagataattattttatggtttgggattttaatatatttttggcagcaaagcaact

SEQ ID NO: 23070 - DNA, 201 bp, Homo sapiens
ggtaccaccaagctttcatatgaggaactggaaaaggctgctggttgtaggctcaccatcatagttaaatgcactgatgaaatcttctttgaatttcccasagtaatttaggggctccctcctctgagcttccatggtatcctgtaaacagctccttcattacacaccttatatctccacacacattattacacgcattat

SEQ ID NO: 23071 - DNA, 201 bp, Homo sapiens
tgtcagttggactgccccaaggcaacccttgagccatcaggacagctcaacacctcctctgttttcatctttgtacttcctgtcagtcaggcagaggaccrttccttcccatgattcagactgtatcccgcctcatctccctgaactttttgaggacagctataggcaggtacaagccctgattggactcattacctcaat

SEQ ID NO: 23072 - DNA, 201 bp, Homo sapiens
ctggctagggttattttcaccatgacaaattacttttttgttttaatgtgaaacacatacacagacatgattgctcttagccatctgaagtactgagcctsagcgaagcagaagataggcaaggtggctatcacagccaacccttccagtgtgctttactcccctaaatctcccttatacccttatacatattgtccattc

SEQ ID NO: 23073 - DNA, 201 bp, Homo sapiens
gagtcttgctctgtctcgcaggctggagtgcagtgtcgtgatctcggcttactgcaacctccacctcctgggttcaagcaattctcctgcctcgacctccwgaatagctgggactacaagcacgtgccaccacgccaggctaatttttgtacttttagtagagatgagatttcactatgttggccaggatggtctcaatct

SEQ ID NO: 23074 - DNA, 201 bp, Homo sapiens
ttagaaatagcaagagtccagcattgcagctgcaaatgagaaaataatgggcagtggtatttgcttacaggctgtgatcatgcacatctctaagcctcacktatgccccgtctcctgcccagaattgctccccttttccttcatatctacctaaaatacaccaatccaccaagcactgggtcaaaccacacttcctccatg

SEQ ID NO: 23075 - DNA, 201 bp, Homo sapiens
gcacatgaatgttggaaagaatacttggttatacagtaggagagagcatttaaaaatcaaatttattgaggtagaatttaggtacaataaatgagtgcatstattttaagtgaacagtgtgaagcattttgttatatgtatccacccatataactagtgagggcatagaatattcccgtcaccctagaaagttctctcttg

SEQ ID NO: 23076 - DNA, 201 bp, Homo sapiens
ctccttgcttcccagcccagatacccactgatctgaggcctatcactacagacaagttttgcctcttctagaatttcatatgcatggaattatacagtatrttctcttttgtgtccagcttcatagggtcagcataattgtttccaacattttattatgtaatttttcagacatacagaaaagttaaaaaaattttacagt

SEQ ID NO: 23077 - DNA, 201 bp, Homo sapiens
ttccctgctcaataatcttaaatgtacttgcatgtatttgaatattaggcatctctatgaccttccttacgtgcagacagtttaatttgaatagaggaggrcatttttccctctcatatcaattctagatacctttatggcaacaagaaaagaaaaaaccatcctgaaatgtttcttagaaatatatagtccaatagtcct

SEQ ID NO: 23078 - DNA, 201 bp, Homo sapiens
tggatacaagtcttctgtctgatgatagatacataatatttaagtggcttacattttaaattttctttttatctttttgaattttgctgtatatatctaakgtatacaacatgatgtttcgacatacatagagatagtgacgtggctaccatagtcaagcaaattaacacatccattatctgacatagttactcccctttt

SEQ ID NO: 23079 - DNA, 201 bp, Homo sapiens
agccctgattggactcattacctcaatcattcttttaattcgatatctatattgaattacctactttatgccaagagctgacctaggacctgaaggaacarttgaatggaatagttgagttccctgctcaataatcttaaatgtacttgcatgtatttgaatattaggcatctctatgaccttccttacgtgcagacagtt

SEQ ID NO: 23080 - DNA, 201 bp, Homo sapiens
tcaggcagcttccacttctgcataccagaaggtgatgcatgccagcaccctctccactcctcagacacagctcacccaggctggcttctattcactgccarcacccttccctgtggggcagaagagaacagaaaggaccaacctggacttactctagatgcttgctcatttaatatgggaccccttggtgccactagggat

SEQ ID NO: 23081 - DNA, 201 bp, Homo sapiens
agcgggaattcagtacatttttgttgattgaatgaatcagttaatcaatacccaaatgtgtccacattaaacatgttttctataaagattaaaaaaataaygcagctgagttaaaagtcctaggaggttgccaggctctccagtgttcagccctctagccccagcctgtcaacctggacaattcacagcagtgcatggatg

SEQ ID NO: 23082 - DNA, 201 bp, Homo sapiens
ccactcctcagacacagctcacccaggctggcttctattcactgccagcacccttccctgtggggcagaagagaacagaaaggaccaacctggacttactytagatgcttgctcatttaatatgggaccccttggtgccactagggatgagccagctgaaggatgttaccactaggagcatagggaaggtctgaacctctg

SEQ ID NO: 23083 - DNA, 201 bp, Homo sapiens
tctgtagagggcactgccggccctgaaccactcgatctccgtctcgttgaaggtgtggttcaggaggttgatttcctggggtgcttgacgatgtacttcargggcttgccagcgtcaagtccttcaggctctgaatggtcagcttgtccacaaggtgaatcttgttgtcagctgggtcagcgaaggtcaggggcagcaggc

SEQ ID NO: 23084 - DNA, 201 bp, Homo sapiens
tctggtattgctgtgtgcacttgtaatgcagaagaatgagataaggcagagttgcccaagaggtatgcagtgtagtgcagtggtagaaaaaatactagggsctatgtttgaagaaggtgaaaggttcaattttctcattcaaacatttggatacttttataaggacctaaagacataattacaggacactgtaataagtgt

SEQ ID NO: 23085 - DNA, 201 bp, Homo sapiens
tgttatatgtatccacccatataactagtgagggcatagaatattcccgtcaccctagaaagttctctcttgccccctctctgtcaactctccttgcttcscagcccagatacccactgatctgaggcctatcactacagacaagttttgcctcttctagaatttcatatgcatggaattatacagtatgttctcttttgt

SEQ ID NO: 23086 - DNA, 201 bp, Homo sapiens
gagccacaggccctactctggcagagtttagagtttactaaggacccgaggtagatcagagaataccaggaaaagatgacatttctgtgagttgagaagarctaggtgagaaatcagagaagggtatggggtgtaggacaggtaacaattaagtgggttcatgaaacacatactgggttgtttataagcagtatcagtctt

SEQ ID NO: 23087 - DNA, 201 bp, Homo sapiens
ccctgtggggcagaagagaacagaaaggaccaacctggacttactctagatgcttgctcatttaatatgggaccccttggtgccactagggatgagccagytgaaggatgttaccactaggagcatagggaaggtctgaacctctgtaggttgaggacaccctaagaggcattagttatgcccagctccatcctcacctgc

SEQ ID NO: 23088 - DNA, 201 bp, Homo sapiens
tattgttttactttagtgattcccattagtgtttagtgatttctcactaggattttgttgttgttgttgttgttgttgttttctgagatggagtcttgctstgtctcgcaggctggagtgcagtgtcgtgatctcggcttactgcaacctccacctcctgggttcaagcaattctcctgcctcgacctcctgaatagctgg

SEQ ID NO: 23089 - DNA, 201 bp, Homo sapiens
tctgtgttttctttttttccaagaaattttacaatttcagcatttacatttaggtctataatctattttgtttgttttgcgaggtaggatttgagatgctrtttgtttatatgggttctttagaaatgatgtaggagtgttattatttataccttaaatatgtattagaatttaccattgaagccctctaggcctggagtt

SEQ ID NO: 23090 - DNA, 201 bp, Homo sapiens
gcttgatctcttccaactgtcagggcatgggagtcattctgccattcttgtctcacagcaggagtacctgaagagaaccctggcccttttggggagggggktttaactaggcttgttcttacagaaaataatgggctgataggggagattctcttcttcttcacaatttatgtcagatgtaaccctatactctctgaaaga

SEQ ID NO: 23091 - DNA, 201 bp, Homo sapiens
gggaggcagaagttgcagtgagccgagatcacaccactgcgccccagcctgggcaacaagagtgaaactccatcaaaggaaggaaggaagggggaggggargggaggggggggagggagggagggagggggagagagagagagagagaaagaaagaaagaaagactgcatgtttgtcaggggttggctgatctaggctggt

SEQ ID NO: 23092 - DNA, 201 bp, Homo sapiens
tgtttacttctgtctcattctattggacaaagcaaatcttttaactggaacgtggttacttttgcctcattttattggctaacgtaggtcaaacagatgakcccaggatcagaacaggaacatgctgtcaagtttaaggacaaaggtgtgaatacatggaagggaagaaaattgggatcattaaggcaatctaacacatcc

SEQ ID NO: 23093 - DNA, 201 bp, Homo sapiens
ttttttgttttaatgtgaaacacatacacagacatgattgctcttagccatctgaagtactgagcctcagcgaagcagaagataggcaaggtggctatcayagccaacccttccagtgtgctttactcccctaaatctcccttatacccttatacatattgtccattctccatgccgcaggctatcgcccctacaccatga

SEQ ID NO: 23094 - DNA, 201 bp, Homo sapiens
agaaaaggagatggggaagaaggaaggaagcaaggaagcaaggaagggagggagggagggagggagggagggacaaagggagggagggagggatggagggraaccaagctagctctgcctagtagcatcttctattttccatgatgtaaatactttcactatggcctactttaaaataccaacatggtatcagtgagaagt

SEQ ID NO: 23095 - DNA, 201 bp, Homo sapiens
tctcttaattgtgctttgcttcatcttgaattaaaataattacattgaattctgtgacaaacaatagaatgctagtagtcattcttccaaccaacattttytaagtgtcttctatgtgctgtctggtattgctgtgtgcacttgtaatgcagaagaatgagataaggcagagttgcccaagaggtatgcagtgtagtgcag

SEQ ID NO: 23096 - DNA, 201 bp, Homo sapiens
gtttccaacattttattatgtaatttttcagacatacagaaaagttaaaaaaattttacagtagattcctaacctagactctatcattaagattttccttscctgctttattatatttctatgcatttatccatcttctattcatctaccttattttttgatacatttcaaagtaaattgcagacaccagtcaacttcctt

SEQ ID NO: 23097 - DNA, 201 bp, Homo sapiens
tgagatggagtcttgctctgtctcgcaggctggagtgcagtgtcgtgatctcggcttactgcaacctccacctcctgggttcaagcaattctcctgcctcracctcctgaatagctgggactacaagcacgtgccaccacgccaggctaatttttgtacttttagtagagatgagatttcactatgttggccaggatggtc

SEQ ID NO: 23098 - DNA, 201 bp, Homo sapiens
agcaattctcctgcctcgacctcctgaatagctgggactacaagcacgtgccaccacgccaggctaatttttgtacttttagtagagatgagatttcactwtgttggccaggatggtctcaatctcctgaccttgtgatgcaccagcctcagcctcccaaagtgctgggattacaggcatgagccaccgcacccagccctc

SEQ ID NO: 23099 - DNA, 201 bp, Homo sapiens
ttttcttctgtgttttctttttttccaagaaattttacaatttcagcatttacatttaggtctataatctattttgtttgttttgcgaggtaggatttgaratgctatttgtttatatgggttctttagaaatgatgtaggagtgttattatttataccttaaatatgtattagaatttaccattgaagccctctaggcct

SEQ ID NO: 23100 - DNA, 201 bp, Homo sapiens
tcttttgtgtccagcttcatagggtcagcataattgtttccaacattttattatgtaatttttcagacatacagaaaagttaaaaaaattttacagtagawtcctaacctagactctatcattaagattttccttccctgctttattatatttctatgcatttatccatcttctattcatctaccttattttttgatacat

SEQ ID NO: 23101 - DNA, 201 bp, Homo sapiens
aaatatgtattagaatttaccattgaagccctctaggcctggagttttctttgggggaaggttttaaattattcattcaatattctcggtagatataggcytttgaggttttctattttctctttagttacttttattaatttacacatttccaaaagaatttcaatctcatctaggctataaattggaagcaattgttta

SEQ ID NO: 23102 - DNA, 201 bp, Homo sapiens
aaattattcattcaatattctcggtagatataggcctttgaggttttctattttctctttagttacttttattaatttacacatttccaaaagaatttcartctcatctaggctataaattggaagcaattgtttataatatttatattatttaatatcttgttcttaaggtggttccagcagacccaatataccatgata

SEQ ID NO: 23103 - DNA, 201 bp, Homo sapiens
gggtctcggggttcgtgtcattgtggcccatgaagttcctgttgtaggaggtgacaattatgttcttctcctgcttgttgatgtcctttctgtgcaactgrccaatgcaggggccacaagcattggccaggacgatgccacccacatccctcaaggtctgtgcatagccatcctgctcaatggaggcacggatctgctcgg

SEQ ID NO: 23104 - DNA, 201 bp, Homo sapiens
ttactgcaggtggtctctcttgtccgggacaaagagtctgtgggagctgtcctcagaagggtgtctgaccctttgtgttttgaggtcctaaaataagaccygcctgagcctgagaagaggaccaagagaaaaggagaactaacattctagggccacagtaggactcaacatgctgtcctgacctggagccagcccaaagac

SEQ ID NO: 23105 - DNA, 201 bp, Homo sapiens
cacacggtgggcacccactgagagctatgggagggatgaatgacggagtacatgaggacctgtctccaacccaggggatgaggcccagccccagaacctgsagtgcttctttgacggggccgccgtgctcagctgctcctgggaggtgaggaaggaggtggccagctcggtctcctttggcctattctacaagcccagccc

SEQ ID NO: 23106 - DNA, 201 bp, Homo sapiens
acctcatgcccagcagcacctacgtggcccgagtacggacccgcctggccccaggttctcggctctcaggacgtcccagcaagtggagcccagaggtttgytgggactcccagccaggtaatgttgccagagcccaggaaatgccccgtggtgggagggcaggctcatcaggagctcctggcacagcagggttcctgggct

SEQ ID NO: 23107 - DNA, 201 bp, Homo sapiens
agcacaagagacaaagtccccagcaatttcttttccctagttccatagcttattcttttcaccacatgtattcttccagaacattttctaagcatgatacragcatatagtttttcttttcctgtttgttttttgttttgttttgttttgtttttgtgacagagttttactcttgtcgcccaggctggaatgcagtggtgc

SEQ ID NO: 23108 - DNA, 201 bp, Homo sapiens
ggggcagcccctgacaaggaggaccaccgcggcctccctgcagtttctcttgcacctgactctgcccacagctcacccagtgcccccggggccctgcccaycctcctctttctccttgtctgctgcctcctgatggcaagacacccaggcccagtccatggacctcctctctgctgtatccactctgcagagaccccctca

SEQ ID NO: 23109 - DNA, 201 bp, Homo sapiens
gggacctgtcaggtcagcctcggggtgggagtggacagaggacagaggaggagggaggccctgcaagagctcctgctccgccaggcacctgcgaggccggstgctgccgtctgacctggggtttctgcggagtgcctcctacactgatgttggtgacaatggtggtggtggcaatggtgaaaatcttctcttgtttcatca

SEQ ID NO: 23110 - DNA, 201 bp, Homo sapiens
acaccagccacatcacctgcaggtgggcagacacccaggatgcccagcggctcgtcaacgtgaccctcattcgccgggtgaatgagtgagtgatgctgggkgcaggggccacgggcaggggctacgacgtcccctgtgcctggcatggggcgacagtgtagagagggacctgtcaggtcagcctcggggtgggagtggaca

SEQ ID NO: 23111 - DNA, 201 bp, Homo sapiens
agtgcccctattacatcctaggcttctatacatacttcgttattttctttattgttttctcttccatttggctgtcactacattccttattatttttctarcgaatggagcaagtctctcatctctggtttgttataatttagaatcagtttgccaaggccaggcacagtggctcatgcctataatcccagcactttggga

SEQ ID NO: 23112 - DNA, 201 bp, Homo sapiens
gccacagactgggtccttggattggaaggttttgctgtgattccttcatcttcccacctccctgcacttgctgcgtgcactgacccctcacctttcaccayagtgaccaccaggcgactcccgcagaacaagacaagtccaaggggtggtttcagagagagtaaggatacaggagatattgggagcaacccaagtccccag

SEQ ID NO: 23113 - DNA, 201 bp, Homo sapiens
ccacttccctgtccctgtcctcactgctgcaccctgggggagggccgcagcgtatcctcaggatcctgcccgccagccctcctcctgctcccctccctctrtctctccccctggccttccctgggcctcccccgcttccctcctcctgcacattcctgctcatcctgtcttggaaagtccagctgagcgtgtctggcttcc

SEQ ID NO: 23114 - DNA, 201 bp, Homo sapiens
atgatatagtgaagtggggatgaaaaggatccaaccatgggcagaacctggggtctggtgccagtggagacagccccagtgtctagcatgagacacggggratgttccgttggagggtgggtatgatgactctcctgaaagcttccctccctccagtccagatggcccctccatccctcaacgtgaccaaggatggagaca

SEQ ID NO: 23115 - DNA, 201 bp, Homo sapiens; identical to SEQ ID NO: 4072

SEQ ID NO: 23116 - DNA, 201 bp, Homo sapiens; identical to SEQ ID NO: 4076

SEQ ID NO: 23117 - DNA, 201 bp, Homo sapiens; identical to SEQ ID NO: 4062

SEQ ID NO: 23118 - DNA, 201 bp, Homo sapiens
gcgtcacactgcagaggcctcatggggtagctggggctgcagactcccgggaactcggcgcctgagccggcagctgaccaccaactcggcagggagaaggkggtggcatggttgatagaatgatggaagggttgcccagtgcacaggctgggcatgagcctggtgctgaaggaggatggactttaaggtcaaaagggagag

SEQ ID NO: 23119 - DNA, 201 bp, Homo sapiens
gccgtctccccgattagatggtggccaaagagaaagggaaggcctttgcagagagcacctcccacctggtcatcagacccgcaagttgaaagaggcaaagrgtaaagcaggcagaaactgggcgtggagtcagaagttctccacccactcttcatgagacagcacagctgggcagaggatgccacatctctgggtgggcac

SEQ ID NO: 23120 - DNA, 201 bp, Homo sapiens; identical to SEQ ID NO: 4064

SEQ ID NO: 23121 - DNA, 201 bp, Homo sapiens; identical to SEQ ID NO: 4080

SEQ ID NO: 23122 - DNA, 201 bp, Homo sapiens
ttcagaccaatgcccttcccagcatggatctggcctctctcccctaatcccccaaggcagtaagttccagagccctgggcctgcacagagcggggtcttarggaatactgcaccaaccccactccctgccctgaggtcgatttcccgcccagatgctgacattcctctttctccccggctgctggaagtgctgcctatgtg

SEQ ID NO: 23123 - DNA, 201 bp, Homo sapiens
tccctgcacttgctgcgtgcactgacccctcacctttcaccatagtgaccaccaggcgactcccgcagaacaagacaagtccaaggggtggtttcagagasagtaaggatacaggagatattgggagcaacccaagtccccagccaggcttggtagcggcaggggcccagggagagggccacaaccaggtagaaaggaggc

SEQ ID NO: 23124 - DNA, 201 bp, Homo sapiens
gggcgtcctgtgggtagctgtgccctggggacttggaggagttagggcttggcctcttaggatgacctgagcccagactcctagggcggccagtggatggrgaggcagccaggggtgccaagctgcttgggtgttgtaggagagctctggggaggactcagcctcgctagcgggatctggttggtcctggtgggaaggacg

SEQ ID NO: 23125 - DNA, 201 bp, Homo sapiens
gtgttgtaggagagctctggggaggactcagcctcgctagcgggatctggttggtcctggtgggaaggacgcctagtggggtgaagagagctcaggcctgrgagtcaggcacctatagtctgtcttcgctttgtcactaagatgctggtggtagtgagagcaccccctgtccaccctgggcttctgtctcctcatctgtgg

SEQ ID NO: 23126 - DNA, 201 bp, Homo sapiens
caccctgggcttctgtctcctcatctgtggaatggggagcatggatagtccctgacatcttggtttagaaagagagagaacgcatgctcgtgtgtttgccygtgtgtgcatttgtgtgtgtgcctgtgtgtgtatgtgcatgtgcggatgtctggggatgcaggagtgcagagagactaagaggcagagggtgaaacctgg

SEQ ID NO: 23127 - DNA, 201 bp, Homo sapiens
tattctcccaggttatgacttatctttttctttaccatgtttaagatgtcttatgtcatataaaaatgttttcattgttaagtcaaacctgtcattacttyttactttatggtttctgattttggtgtcttgtaaacctctaagatcacaggtgtcttgtaaacctctttttactttatggtttctggttttgtgtcttga

SEQ ID NO: 23128 - DNA, 201 bp, Homo sapiens
tcattacttcttactttatggtttctgattttggtgtcttgtaaacctctaagatcacaggtgtcttgtaaacctctttttactttatggtttctggtttkgtgtcttgaaacctctaagattacagaaagagttttaataattttactattttggttttgactttgagatttttagcccacctagaatttagagaagtga

SEQ ID NO: 23129 - DNA, 201 bp, Homo sapiens
atcccagcactttgggaggctgaggcaggcagatcccttgaagttggacgttcaagaccagcctggccaacacggtgaaaccccatgtctactaaaaataygaaaaattagccgggtttggtggtgtgcacctgtaatcccagctacttgggatgctgaagtgggagaactgcttgaacccaggaggcaaagtttgcagtg

SEQ ID NO: 23130 - DNA, 201 bp, Homo sapiens
tgagccgagatcatgccattgcactccagcctgggtgatggggtgagattctgtctcaaaaaaaaaaaatagtattttttttaaagaaaccatatttgctrccagcatttgggtttatttagcacatatatgatcttccaaaacaagaggagatctttagcaagttttcagttctcttccattctccaccccagcctcaca

SEQ ID NO: 23131 - DNA, 201 bp, Homo sapiens
ttctcttccattctccaccccagcctcacagcaaactcccacattaaaatcatctgagttttagttcaatattcttctttaacttatctgtaagtgttacwggtttatttacctcagtatttcagctttcttggatttttttttcctgaaatataacctagagtaatttctttcagaaaagatctgaaaaactttctttgt

SEQ ID NO: 23132 - DNA, 201 bp, Homo sapiens
tccattctccaccccagcctcacagcaaactcccacattaaaatcatctgagttttagttcaatattcttctttaacttatctgtaagtgttacaggtttmtttacctcagtatttcagctttcttggatttttttttcctgaaatataacctagagtaatttctttcagaaaagatctgaaaaactttctttgtccttac

SEQ ID NO: 23133 - DNA, 201 bp, Homo sapiens
cctcagtatttcagctttcttggatttttttttcctgaaatataacctagagtaatttctttcagaaaagatctgaaaaactttctttgtccttacatacycaaaattttttgtgtcctttaaatgtcaaagaaaacttggcattttgtgattctaggtttaagcataattttcccttggtattttcaagacatctattta

SEQ ID NO: 23134 - DNA, 201 bp, Homo sapiens
gtcaaagaaaacttggcattttgtgattctaggtttaagcataattttcccttggtattttcaagacatctatttaaagttcagagtctcttatgtgaaayctttagccaatctgacccttgttgcattcaaagtatcctatttgttttcttctggaagcatttctgggatcatcctcatattcttgcaagacgaaaagtt

SEQ ID NO: 23135 - DNA, 201 bp, Homo sapiens
atgtgaaatctttagccaatctgacccttgttgcattcaaagtatcctatttgttttcttctggaagcatttctgggatcatcctcatattcttgcaagasgaaaagtttaccagtgagaactaggcatggctttattaaaaggaatcttgggagttaaccctgatctctgtcccctactacaaaacctcatcgtagtagc

SEQ ID NO: 23136 - DNA, 201 bp, Homo sapiens
cttgttgcattcaaagtatcctatttgttttcttctggaagcatttctgggatcatcctcatattcttgcaagacgaaaagtttaccagtgagaactaggyatggctttattaaaaggaatcttgggagttaaccctgatctctgtcccctactacaaaacctcatcgtagtagcctccccccttgaatacagattcctta

SEQ ID NO: 23137 - DNA, 201 bp, Homo sapiens
ctttattgagtggcctcttgtctccttgaaagccctgtgaagctttccccatttgctgttgtatctgtttggctgcacatggaaaatccctaagcaacagwggcttaacaacatagaagtttctttttcccagcatataaaagatgcccagaggtagcagtttcaggctagtatggttgctccagagtgagagtgggaatc

SEQ ID NO: 23138 - DNA, 201 bp, Homo sapiens
gttttaaccttttaaagtaaaagacactaacctgtcctccataattctggttggtatggtctatatgttgaagtgcacccaagtttatgttgcaacctaakccccaatgtgagaatatctggaggtagtgcctgtggcaccctataaaataccccagcgagctcccttgcttattccatgtgagattatagggagaagact

SEQ ID NO: 23139 - DNA, 201 bp, Homo sapiens
gttgcaacctaagccccaatgtgagaatatctggaggtagtgcctgtggcaccctataaaataccccagcgagctcccttgcttattccatgtgagattayagggagaagactgcaaggaacaggccctcaccagatagtgaatctgcccgcaccttgatcttgaacttcccagcctccagaactatgagaaataaacttt

SEQ ID NO: 23140 - DNA, 201 bp, Homo sapiens
tgtgtgtacgtgtatatatgtatgtatctgtgtgtgtctgtgtgttgtgcgtgtgtgtgcctgcgtgtgtccgtgtgcttgtgtgtgtgtgtgtgtttgcrtgggcatcttgagtgaagcttccaacaatctaacagaagaaaaggagccacacttgtctgttctgctctcttgggtacttcccagaccagtgaaatgaaa

SEQ ID NO: 23141 - DNA, 201 bp, Homo sapiens
ccgccagccctcctcctgctcccctccctctgtctctccccctggccttccctgggcctcccccgcttccctcctcctgcacattcctgctcatcctgtcytggaaagtccagctgagcgtgtctggcttccttgcccacatttctcagggcggcactcccggcccctaggctccaggatggctgctctggccgtttccct

SEQ ID NO: 23142 - DNA, 201 bp, Homo sapiens
ctgcagggccttggctggggttctctccctgcttcagccgctagcaccctccttgtgcctgaagcccgcactgggatgctcctgggctcttgaggtgaaayggcccctcccaagggctcccagagacctggcttctgtgataatgctgggaccacagtccccttaacaaataccaggctcctgaggacggggactagagag

SEQ ID NO: 23143 - DNA, 201 bp, Homo sapiens
ccacgctgcatcccagggctgagtgtgtgccccctcccaggctgcacagtcggtccaggggccaggcctgtgcttgatgcatgtccctgtcctggggtggrgggaggggaccgtgcccaggaacagcacactgcggaggcccagaaaccatgctgagaaccaacagaatgtcttgcttctgccaggagaggagggtccgca

SEQ ID NO: 23144 - DNA, 201 bp, Homo sapiens
cttgatgcatgtccctgtcctggggtggggggaggggaccgtgcccaggaacagcacactgcggaggcccagaaaccatgctgagaaccaacagaatgtcktgcttctgccaggagaggagggtccgcaaccaggagcccaccccggcagacatgaacacatgtacatgtgcctggccacctggtgcctctgcagggacct

SEQ ID NO: 23145 - DNA, 201 bp, Homo sapiens
tgaggccctggaggtgaggtgccagccctggccacggggtagacagtggcagagcaagctgtgtggacgtgtctgggagggggctccgcgctctcccaggscccccctccgtatgtgggctgccacctctcccacccaagctctcctgggcacgtgccacaagggaaggggaccagaatcgctctggggtgttggccaggg

SEQ ID NO: 23146 - DNA, 201 bp, Homo sapiens
tccctccctcaatgcctttaacattctgcccccaggtcacctccttagagaagcctgcttgtcccatatttcaaattgcctccctggcccagcccttcctscctcctcacctgcttcttgctttatttttccacatgaagttctctccactgcacacgctacacactttgttccatgcgggtccccttctcccaggatggc

SEQ ID NO: 23147 - DNA, 201 bp, Homo sapiens
cctccctggcccagcccttcctccctcctcacctgcttcttgctttatttttccacatgaagttctctccactgcacacgctacacactttgttccatgcrggtccccttctcccaggatggcagctccgtgggcaggatttttgtgtgttttatcactgctggcccctgattctgaacagagccaggcatgtggtgagca

SEQ ID NO: 23148 - DNA, 201 bp, Homo sapiens
cagaagggctgggagctgagaaggctcaaaatagggtgggacaggtggcttcagggttctgggcctcagtgttgtcaatgtcaggggctgcactgacaggyggagtccccggtgccatccgaagtgctgtccgtgggtgggccctcagggaggatccacggtggtgagagagaagccgcagcaggcctggggtatggcagg

SEQ ID NO: 23149 - DNA, 201 bp, Homo sapiens
acgcccacagcatggccctgccagccctggagccctccaccaggtactgggccagggtgagggtcaggacctcccgcaccggctacaacgggatctggagygagtggagtgaggcgcgctcctgggacaccgagtcgggtaggtgaaggctggagtccagagcttctggccaggaccagctcatagtttctcactgccaga

SEQ ID NO: 23150 - DNA, 201 bp, Homo sapiens
tacaacgggatctggagtgagtggagtgaggcgcgctcctgggacaccgagtcgggtaggtgaaggctggagtccagagcttctggccaggaccagctcayagtttctcactgccagaaaatccccaatgcagcagccgtagcaggcctgcaacaacttgtaggtgagccgtctccccgattagatggtggccaaagagaa

SEQ ID NO: 23151 - DNA, 201 bp, Homo sapiens
gcaccggctacaacgggatctggagtgagtggagtgaggcgcgctcctgggacaccgagtcgggtaggtgaaggctggagtccagagcttctggccaggaycagctcatagtttctcactgccagaaaatccccaatgcagcagccgtagcaggcctgcaacaacttgtaggtgagccgtctccccgattagatggtggcc

SEQ ID NO: 23152 - DNA, 201 bp, Homo sapiens
tcatagtttctcactgccagaaaatccccaatgcagcagccgtagcaggcctgcaacaacttgtaggtgagccgtctccccgattagatggtggccaaagrgaaagggaaggcctttgcagagagcacctcccacctggtcatcagacccgcaagttgaaagaggcaaagggtaaagcaggcagaaactgggcgtggagtc

SEQ ID NO: 23153 - DNA, 201 bp, Homo sapiens
catttgagatccagtacaggaaagacacggccacgtggaaggtgagggcctttgcccagggacgggagaaacactggggagggcgggagaagggaaagcarccagaggcattccacctgcaaggcgtcgggcccttggcaggtgaccagtgagaggtagccactgggacgtggtgatcactaggctgtgtggtcagcaggt

SEQ ID NO: 23154 - DNA, 201 bp, Homo sapiens
aaaacatgatatagtgaagtggggatgaaaaggatccaaccatgggcagaacctggggtctggtgccagtggagacagccccagtgtctagcatgagacayggggaatgttccgttggagggtgggtatgatgactctcctgaaagcttccctccctccagtccagatggcccctccatccctcaacgtgaccaaggatgg

SEQ ID NO: 23155 - DNA, 201 bp, Homo sapiens
ggaaacaatgaaaatgcgatacgaacacatagaccacacatttgagatccagtacaggaaagacacggccacgtggaaggtgagggcctttgcccagggasgggagaaacactggggagggcgggagaagggaaagcaaccagaggcattccacctgcaaggcgtcgggcccttggcaggtgaccagtgagaggtagccac

SEQ ID NO: 23156 - DNA, 201 bp, Homo sapiens
cttcaggactcttgggaggtaggaaccacggccagctctgccccagcccgaagggatgggcagcacccctcctccagcacccactgtctcctgacaggacrcagccatcctcctctccaacacctcccaggccaccctggggccagagcacctcatgcccagcagcacctacgtggcccgagtacggacccgcctggcccc

SEQ ID NO: 23157 - DNA, 201 bp, Homo sapiens; identical to SEQ ID NO: 4075

SEQ ID NO: 23158 - DNA, 201 bp, Homo sapiens
caggcctggaggaggcagaggccaggagggagaggtcccaagagcctgtgaaatgggtctggcctggctcccagctgggcaggaacacaggacttcaggayactaaggaccctgtcatgcccatggccagcacccaccagtgctggtgcctgcctgtccagagctgaccagggagatggtgctggcccaggggctgctctc

SEQ ID NO: 23159 - DNA, 201 bp, Homo sapiens
gtgagtcccgtggctcccacccacttccctgtccctgtcctcactgctgcaccctgggggagggccgcagcgtatcctcaggatcctgcccgccagccctyctcctgctcccctccctctgtctctccccctggccttccctgggcctcccccgcttccctcctcctgcacattcctgctcatcctgtcttggaaagtcca

SEQ ID NO: 23160 - DNA, 201 bp, Homo sapiens
tgggctaagccgtgtcctctcccaacagggacctcctggagccagtgtcctgtgacctcagtgatgacatgccctggtcagcctgcccccatccccgctgygtgcccaggagatgtgtcattccctgccagagttttgtcgtcactgacgttgactacttctcattccaaccagacaggcctctgggcacccggctcaccg

SEQ ID NO: 23161 - DNA, 201 bp, Homo sapiens
gggggacatcagggcttccagagaaccatctccaccccaccaagacccttgtgcctgacccggatcatctgcccagggtggtcccaactcttctgcccatkttcttcccacagggtgttccctgtaggattcggggacagcgaggtgtcacctctcaccatagaggaccccaagcatgtctgtgatccaccatctgggcct

SEQ ID NO: 23162 - DNA, 201 bp, Homo sapiens; identical to SEQ ID NO: 4065

SEQ ID NO: 23163 - DNA, 201 bp, Homo sapiens
gctgtcacctccgtggtgtcttccaggctgcgcagaaagtgggaggagaagatccccaaccccagcaagagccacctgttccaggtaggaactggctgcgwggggcggagtgggggcttctctgttcctgcctctcttgtctctgtccccacctcctccttcccttcctgtgggctttgggtggtagggatgtaggtggac

SEQ ID NO: 23164 - DNA, 201 bp, Homo sapiens
ctgggggagggccgcagcgtatcctcaggatcctgcccgccagccctcctcctgctcccctccctctgtctctccccctggccttccctgggcctcccccrcttccctcctcctgcacattcctgctcatcctgtcttggaaagtccagctgagcgtgtctggcttccttgcccacatttctcagggcggcactcccggcc

SEQ ID NO: 23165 - DNA, 201 bp, Homo sapiens
ccagagccactggttgtccccaggggatctggagtttgaggtggtctacaagcggcttcaggactcttgggaggtaggaaccacggccagctctgccccascccgaagggatgggcagcacccctcctccagcacccactgtctcctgacaggacgcagccatcctcctctccaacacctcccaggccaccctggggccag

SEQ ID NO: 23166 - DNA, 201 bp, Homo sapiens
acgggtcttgctcaaggtccctcagctgctgggggcaggggtggcctggaaccccctgtgtccacacaaaaggccatgcaggccctgactgccccccagcrgtccagcccttaggtgcccttcacttcctcccctccagtccagcctcctgagcccagggacctgcagatcagcaccgaccaggaccacttcctgctgacc

SEQ ID NO: 23167 - DNA, 201 bp, Homo sapiens
gaggcccagagctgggtgcggtgtggcttgagaagctcactttgaacttgagaaagagcccagcactttgcccagagacataccaggcactatccagcaatctctctctctctctctctctctctcagtctctctctctgtctgtctgtctttttagttatgacactctgccctgctgatttgggttgctgatttgggttg

SEQ ID NO: 23168 - DNA, 201 bp, Homo sapiens
aggcccagagctgggtgcggtgtggcttgagaagctcactttgaacttgagaaagagcccagcactttgcccagagacataccaggcactatccagcaatctctctctctctctctctctctctcagtctctctctctgtctgtctgtctttttagttatgacactctgccctgctgatttgggttgctgatttgggttgg

SEQ ID NO: 23169 - DNA, 201 bp, Homo sapiens
actgggaccttgtcagacaggtgctagcgacaagctgcatatgtgcaatttttagtcttcaaaaaccctgctgttatatttttgtacagcccaattctaatttttttctatcatctttcctgctttgtaatcattttataatgagtaaacatttcctattagcttttggtcactctttttttcatccagcagttttattta

SEQ ID NO: 23170 - DNA, 201 bp, Homo sapiens
ttttgttttgttttgttttgtttttgtgacagagttttactcttgtcgcccaggctggaatgcagtggtgcaatcttggctcactgcaacctctgcctccygggttcaggtgattctcctgcctcagcctcctgagtagccgggattacaggcatgagccaccacacgtggctaatttttgtatttttagtagagacaggg

SEQ ID NO: 23171 - DNA, 201 bp, Homo sapiens
ggaatgcagtggtgcaatcttggctcactgcaacctctgcctcccgggttcaggtgattctcctgcctcagcctcctgagtagccgggattacaggcatgmgccaccacacgtggctaatttttgtatttttagtagagacagggtttcaccatattggccaggctggtctcgaactcctgacctcagatgatccgcctgt

SEQ ID NO: 23172 - DNA, 201 bp, Homo sapiens
gctgtgcagaggttgtgcgttagaaattataataggtattgtcaaatcagcctcaaagtagctgagctaagctgacgtccccaaggtagtgcataaagggkccaatttacctttagagaaattatcaatcttctaattttgtccaatattatgtatggaaattctcaatgtcgcgtgatttttttctttccctgattatgg

SEQ ID NO: 23173 - DNA, 201 bp, Homo sapiens
ctgacgtccccaaggtagtgcataaagggtccaatttacctttagagaaattatcaatcttctaattttgtccaatattatgtatggaaattctcaatgtygcgtgatttttttctttccctgattatgggtgaagttgtacattttctatatgtggattggccttttggatttcatttatgatgaatgtggagaaatttt

SEQ ID NO: 23174 - DNA, 201 bp, Homo sapiens
ttgtgtgtatacatgtgggtatgtgtgtgcatgttttgtgtgtacgtgtatatatgtatgtatctgtgtgtgtctgtgtgttgtgcgtgtgtgtgcctgcrtgtgtccgtgtgcttgtgtgtgtgtgtgtgtttgcatgggcatcttgagtgaagcttccaacaatctaacagaagaaaaggagccacacttgtctgttct

SEQ ID NO: 23175 - DNA, 201 bp, Homo sapiens
tggggcatctcccaaaggtgacctcaagcccacaattcccctaagctccagccctccaggcgtactggcctctccacctgtcacttagacaacaggtgtcyccgactccaaacgtcctcaaccaaagtcccgctctcacccgagctgcgctgctgcctctgtcttccccatctccctttctaaatgggagctcctagtggc

SEQ ID NO: 23176 - DNA, 201 bp, Homo sapiens
agctaaacctgaaaagggacacgttttatgaaagttttcgttgacgtggcaaaaacccatgctggtggcaggctggtaggaggtactgcaggctgtcattgggagtctcagaaccacggcaggcttggtgctgttattggtgcctttggctgctgctgaaacggagacagagggaggtgactagtccaaggcctctctact

SEQ ID NO: 23177 - DNA, 201 bp, Homo sapiens
gggggtaaagggcagggcccctgggagatcagaacaggcttcccagagggaagagctttgcaactcagatctgaagggtagacaggaggggagggcagtaagagcctctctggcagggtaacagctgtgcagaggctgggggatcagaagggcatgggcagctggggaacctgctcaccattgtgtccagggagcatcagc

SEQ ID NO: 23178 - DNA, 201 bp, Homo sapiens
ggggtaaagggcagggcccctgggagatcagaacaggcttcccagagggaagagctttgcaactcagatctgaagggtagacaggaggggagggcagtaagagcctctctggcagggtaacagctgtgcagaggctgggggatcagaagggcatgggcagctggggaacctgctcaccattgtgtccagggagcatcagct

SEQ ID NO: 23179 - DNA, 201 bp, Homo sapiens
cggtccagcccttaggtgcccttcacttcctcccctccagtccagcctcctgagcccagggacctgcagatcagcaccgaccaggaccacttcctgctgacctggagtgtggcccttgggagtccccagagccactggttgtccccaggggatctggagtttgaggtggtctacaagcggcttcaggactcttgggaggta

SEQ ID NO: 23180 - DNA, 201 bp, Homo sapiens
gcgcatgtccattgccttcatgccgcaggagactgaggggtcatgcatgagggccacttctctgggttgtccccacaacacgggcggtgtccctgggacaygtggaaggggaggggcagctcactgctgacatctccttctgcaggcctggaggaggcagaggccaggagggagaggtcccaagagcctgtgaaatgggtc

SEQ ID NO: 23181 - DNA, 201 bp, Homo sapiens
agcgcattgtgcagtggtaggtgtcagtgatccaagtggggacccagtccctcaggccacacagcgcatgtccattgccttcatgccgcaggagactgagrggtcatgcatgagggccacttctctgggttgtccccacaacacgggcggtgtccctgggacacgtggaaggggaggggcagctcactgctgacatctcct

SEQ ID NO: 23182 - DNA, 201 bp, Homo sapiens
cagtccctcaggccacacagcgcatgtccattgccttcatgccgcaggagactgaggggtcatgcatgagggccacttctctgggttgtccccacaacackggcggtgtccctgggacacgtggaaggggaggggcagctcactgctgacatctccttctgcaggcctggaggaggcagaggccaggagggagaggtccca

SEQ ID NO: 23183 - DNA, 201 bp, Homo sapiens
tgtgtacatgtgttcatgtccaggggatgacactgtggcatccaacagccgtggaccagcagcccacggggagcttagtaggagtcaaatcctaggccccygtctcagctgctctgctgtctagcgcattgtgcagtggtaggtgtcagtgatccaagtggggacccagtccctcaggccacacagcgcatgtccattgcc

SEQ ID NO: 23184 - DNA, 201 bp, Homo sapiens
cggggagcttagtaggagtcaaatcctaggcccccgtctcagctgctctgctgtctagcgcattgtgcagtggtaggtgtcagtgatccaagtggggaccyagtccctcaggccacacagcgcatgtccattgccttcatgccgcaggagactgaggggtcatgcatgagggccacttctctgggttgtccccacaacacg

SEQ ID NO: 23185 - DNA, 201 bp, Homo sapiens
gggaccctctaggcatggagagcactgaggggaaatgacatgatcagatgtggatgtgagaatgctggggacaggggacttacagggtagattggaggagyattagttgggaaagaagttgaaattcaggctgtggcctaaagcactcattcctagaaatgatgaggacacaactggctaggagatggggacatgagggca

SEQ ID NO: 23186 - DNA, 201 bp, Homo sapiens
ttatattgttccagtatacagatataccaacaccacaggataattcatgagttgtataaggaatgtatttaatgctaaacaagcaactacacagaaacctrccttcatgaaaattagaataatctagaattatgtagcacaagagacaaagtccccagcaatttcttttccctagttccatagcttattcttttcaccaca

SEQ ID NO: 23187 - DNA, 201 bp, Homo sapiens
gtggcccttggcctcctggagcctgtgttgagtagcgaggtagggtccagcctaatgcagattagcaatgaatcaaggatgctgggaggtactgggcaggygacaggcatgcatctgatctgctctgagtctccatgtttggagaccttggacattttacttcctctatgagtttctccgtctgtgaaatgagctggtgga

SEQ ID NO: 23188 - DNA, 201 bp, Homo sapiens
gctcatgactgtttcccactcactcgcagtgagatccaatcccatcatgtagatggatgggtctcctagacctccctatcacacgctctactccctgcgcmctggttttaggccaagccacgcagcacaccaaactctgcctgtcccagggcctttgcacgtgctgttcccatttcctgaaatcctcacaatttgcacagt

SEQ ID NO: 23189 - DNA, 201 bp, Homo sapiens
gggaggctgaggcaggcagatcccttgaagttggacgttcaagaccagcctggccaacacggtgaaaccccatgtctactaaaaatacgaaaaattagccrggtttggtggtgtgcacctgtaatcccagctacttgggatgctgaagtgggagaactgcttgaacccaggaggcaaagtttgcagtgagccgagatcacg

SEQ ID NO: 23190 - DNA, 201 bp, Homo sapiens
tgtattcatatccgtaaaaccttttgaataatgcctggctcatggaaaacactgcaatattgtcagccactatcatgaattctctctgtgtatgtgagtaytgtttgtgctctttgatgatattgatttgttttaaccttttaaagtaaaagacactaacctgtcctccataattctggttggtatggtctatatgttgaa

SEQ ID NO: 23191 - DNA, 201 bp, Homo sapiens
cggtgggaagaagcaggagacacaggtaaggacctgtccctggagaggcttctgtctcctgcagtctcaggtagaggggaccctctaggcatggagagcaytgaggggaaatgacatgatcagatgtggatgtgagaatgctggggacaggggacttacagggtagattggaggagcattagttgggaaagaagttgaaat

SEQ ID NO: 23192 - DNA, 201 bp, Homo sapiens
tccctgtgacctgcttcctgctgctctgacacaacaggggaccagggagaagctccccacccaccccacactcacactccccaccccctttgcccaccgcyggggcctgggcctggaccagggctcctgtctgaggcctgagacacgatgctgtctggtcctgttgctcaggaacatcacggcccccaagtccccactctg

SEQ ID NO: 23193 - DNA, 201 bp, Homo sapiens
gccaggctggtctcaaactcctgacctcaagtgatctgcccaccttggcctcccaaagtgctgggattacaggcatgagccaccgcgcccaggctttgatygatttttttttaaattatggatctcatatcttcaaattccaagaactctgttctttgcatagaagtgtcttcttttaaatggctatgattctcaaatctc

SEQ ID NO: 23194 - DNA, 201 bp, Homo sapiens
tagaggcagcccactgcgggctcgaatctcaacctgttccttaccaaccgtgtgactgtcgaccaattacataacatcccacccctgttttctcatctacraagtggagcttctagtggtaacctatacatagatgtattcatatccgtaaaaccttttgaataatgcctggctcatggaaaacactgcaatattgtcagc

SEQ ID NO: 23195 - DNA, 201 bp, Homo sapiens
aacttgttatttggggaatggtgtaaaatggggttttagataggcatttttatgttgttaatcaatgattttagcatttttttaaatttaatatttcatcrcttcacattgattcctgattccttctcagtctggggtcaagtagagtttgtttccagccagcatgtccattgatagattctgtgtgtgtgtatgtgtgtc

SEQ ID NO: 23196 - DNA, 201 bp, Homo sapiens
agtaaagacggggttctaccacgttggccaggctggtctcaaactcctgacctcaagtgatctgcccaccttggcctcccaaagtgctgggattacaggcrtgagccaccgcgcccaggctttgattgatttttttttaaattatggatctcatatcttcaaattccaagaactctgttctttgcatagaagtgtcttctt

SEQ ID NO: 23197 - DNA, 201 bp, Homo sapiens
tgaatttgtattttgcttttcccccctagtttttatccctgccattcaatttcttcataagcttgggaatgtttatccctgccattcaatttcttcatgarcttgggaatgtaatatgtgcatgtttattttgagtaagaaggtgtttggtttttctcttctcttttctctctcttcctttctctgtccctcccatccctt

SEQ ID NO: 23198 - DNA, 201 bp, Homo sapiens
tttgtctctgtgatgtctcctatgcttttaagcttaaagagttcaaaggcattcactcctctggtttgcagctttcataggatgtaacattttacatttamatttataattaacttgttatttggggaatggtgtaaaatggggttttagataggcatttttatgttgttaatcaatgattttagcatttttttaaattta

SEQ ID NO: 23199 - DNA, 201 bp, Homo sapiens
ctttgcatagaagtgtcttcttttaaatggctatgattctcaaatctccctgaggatgctgatttagatgtcttaatgtactcttttatttttgctgtatmtgtacatgtctgtagaagtgtctgctgggttagcatatgtcagaatagatgtgcgctgttttgacatttgggaaactgaatcactattggcatagaggtc

SEQ ID NO: 23200 - DNA, 201 bp, Homo sapiens
actgccagaggaggggatcagttaggccaccaggagtccatcagaagcaacatttccacacatgggtttgatggacacgagagtcccttccttcccgaatrgagctcagggggcccaggctggagggaggggaaacactgtatgccgtccaccgtgagaacttactgacagtggcgggtgggtgcctcatgcagggggtaa

SEQ ID NO: 23201 - DNA, 201 bp, Homo sapiens
tgctctgacacaacaggggaccagggagaagctccccacccaccccacactcacactccccaccccctttgcccaccgccggggcctgggcctggaccagrgctcctgtctgaggcctgagacacgatgctgtctggtcctgttgctcaggaacatcacggcccccaagtccccactctgccctgtgccacccaccatgcc

SEQ ID NO: 23202 - DNA, 201 bp, Homo sapiens; identical to SEQ ID NO: 4078

SEQ ID NO: 23203 - DNA, 201 bp, Homo sapiens
tgacatcttggtttagaaagagagagaacgcatgctcgtgtgtttgcccgtgtgtgcatttgtgtgtgtgcctgtgtgtgtatgtgcatgtgcggatgtcyggggatgcaggagtgcagagagactaagaggcagagggtgaaacctggaagcttgctgcgctgaggcccagagctgggtgcggtgtggcttgagaagctc

SEQ ID NO: 23204 - DNA, 201 bp, Homo sapiens
agcatgtccattgatagattctgtgtgtgtgtatgtgtgtctgtgcatgtatctgtatgtgtgtgtgtatgtctgtgtgtaggtggtatatgcgagtgtgyatgtgtgtgtgtgttgtgcatgtatgtgtatgtgtgtctgtgtatgtgtgcctctgtgtgtgaatttctgtgtatgtgtgaatgtgtgtgcatgtttgtg

SEQ ID NO: 23205 - DNA, 201 bp, Homo sapiens
gttagcatatgtcagaatagatgtgcgctgttttgacatttgggaaactgaatcactattggcatagaggtcagggacagagtctagaggcagcccactgygggctcgaatctcaacctgttccttaccaaccgtgtgactgtcgaccaattacataacatcccacccctgttttctcatctacaaagtggagcttctagt

SEQ ID NO: 23206 - DNA, 201 bp, Homo sapiens
gcattctcttttttcttttgggtagactgaagctcagagaggttgagtggcttacttaaagctgcacagctattagtaggcagatcaagattagagttcaraacttctcactccctgcccagtttctgctttctttaccctttgcctctttcaagttgtgggtctgccggccaggtgggaggtgctgtctgcaaagggctt

SEQ ID NO: 23207 - DNA, 201 bp, Homo sapiens
aactcagatctgaagggtagacaggaggggagggcagtaagagcctctctggcagggtaacagctgtgcagaggctgggggatcagaagggcatgggcagytggggaacctgctcaccattgtgtccagggagcatcagcttcaagggctggacagcggtgggaagaagcaggagacacaggtaaggacctgtccctggag

SEQ ID NO: 23208 - DNA, 201 bp, Homo sapiens
ccatattggccaggctggtctcgaactcctgacctcagatgatccgcctgtctcagcctcccaaaatgctgggattacaggcttgagccactgtgccaggmtggtagtttttctttttacagaaatgggattattttatttatatatatatatatatatattcctaattttttcacttaatattgtattttggaatatttc

SEQ ID NO: 23209 - DNA, 201 bp, Homo sapiens
tggccagctatttttttttttttttgcgtttttagtaaagacggggttctaccacgttggccaggctggtctcaaactcctgacctcaagtgatctgcccrccttggcctcccaaagtgctgggattacaggcatgagccaccgcgcccaggctttgattgatttttttttaaattatggatctcatatcttcaaattcca

SEQ ID NO: 23210 - DNA, 201 bp, Homo sapiens
tgtgtgttttatcactgctggcccctgattctgaacagagccaggcatgtggtgagcactcgaggaacctttcgtgagtcagtgatacccatacaccctgrgctaagccgtgtcctctcccaacagggacctcctggagccagtgtcctgtgacctcagtgatgacatgccctggtcagcctgcccccatccccgctgcgt

SEQ ID NO: 23211 - DNA, 201 bp, Homo sapiens
tgtactcttttatttttgctgtatctgtacatgtctgtagaagtgtctgctgggttagcatatgtcagaatagatgtgcgctgttttgacatttgggaaaytgaatcactattggcatagaggtcagggacagagtctagaggcagcccactgcgggctcgaatctcaacctgttccttaccaaccgtgtgactgtcgacc

SEQ ID NO: 23212 - DNA, 201 bp, Homo sapiens
ggggttctaccacgttggccaggctggtctcaaactcctgacctcaagtgatctgcccaccttggcctcccaaagtgctgggattacaggcatgagccacygcgcccaggctttgattgatttttttttaaattatggatctcatatcttcaaattccaagaactctgttctttgcatagaagtgtcttcttttaaatggc

SEQ ID NO: 23213 - DNA, 201 bp, Homo sapiens
cctttcaccatagtgaccaccaggcgactcccgcagaacaagacaagtccaaggggtggtttcagagagagtaaggatacaggagatattgggagcaaccsaagtccccagccaggcttggtagcggcaggggcccagggagagggccacaaccaggtagaaaggaggccggaccaatgggcccaagagaggaggaagagg

SEQ ID NO: 23214 - DNA, 201 bp, Homo sapiens
atttgcccggggcactgacaacaggaaggaccctgggcaggaggaagggagcttggacagcaggaggggggaggccgctgaaccgcaggcccctctgctakcaggagccacccaggccgcagcgtgggcagtggggagcctcaggacagaggaggctccaatgagtttcctcgccagcgctttttatggagttcgggtcac

SEQ ID NO: 23215 - DNA, 201 bp, Homo sapiens
atttttctagcgaatggagcaagtctctcatctctggtttgttataatttagaatcagtttgccaaggccaggcacagtggctcatgcctataatcccagmactttgggaggctgaggcaggcagatcccttgaagttggacgttcaagaccagcctggccaacacggtgaaaccccatgtctactaaaaatacgaaaaat

SEQ ID NO: 23216 - DNA, 201 bp, Homo sapiens
tctgaagggtagacaggaggggagggcagtaagagcctctctggcagggtaacagctgtgcagaggctgggggatcagaagggcatgggcagctggggaamctgctcaccattgtgtccagggagcatcagcttcaagggctggacagcggtgggaagaagcaggagacacaggtaaggacctgtccctggagaggcttct

SEQ ID NO: 23217 - DNA, 201 bp, Homo sapiens; identical to SEQ ID NO: 4079

SEQ ID NO: 23218 - DNA, 201 bp, Homo sapiens
cctcccactaagccatgggcttccagcactgcaggcttgtcttgaagaaaaccgttctcaccactcacttagaaacctaccaagttagaaaactctgtccrcttagttgtttcatctcatctctgaagcaacccatttcctggatgtggcccttgaggcccaggaggtcagatgcctcctctgaagtcccacagctgagca

SEQ ID NO: 23219 - DNA, 201 bp, Homo sapiens
tccccttctcccaggatggcagctccgtgggcaggatttttgtgtgttttatcactgctggcccctgattctgaacagagccaggcatgtggtgagcactygaggaacctttcgtgagtcagtgatacccatacaccctgggctaagccgtgtcctctcccaacagggacctcctggagccagtgtcctgtgacctcagtg

SEQ ID NO: 23220 - DNA, 201 bp, Homo sapiens
tgggaaaactgaggccctggaggtgaggtgccagccctggccacggggtagacagtggcagagcaagctgtgtggacgtgtctgggagggggctccgcgckctcccagggcccccctccgtatgtgggctgccacctctcccacccaagctctcctgggcacgtgccacaagggaaggggaccagaatcgctctggggtgt

SEQ ID NO: 23221 - DNA, 201 bp, Homo sapiens
aaagagttcaaaggcattcactcctctggtttgcagctttcataggatgtaacattttacatttaaatttataattaacttgttatttggggaatggtgtraaatggggttttagataggcatttttatgttgttaatcaatgattttagcatttttttaaatttaatatttcatcgcttcacattgattcctgattcctt

SEQ ID NO: 23222 - DNA, 201 bp, Homo sapiens
cagggctgagtgtgtgccccctcccaggctgcacagtcggtccaggggccaggcctgtgcttgatgcatgtccctgtcctggggtggggggaggggaccgwgcccaggaacagcacactgcggaggcccagaaaccatgctgagaaccaacagaatgtcttgcttctgccaggagaggagggtccgcaaccaggagcccac

SEQ ID NO: 23223 - DNA, 201 bp, Homo sapiens
gagtgccatggcaacggtctcagctcactgcaacctccacctcccaggttcaagcaattctcctgcctcagcctccagaatagttgggattacagacgtgygccaccatggccagctatttttttttttttttgcgtttttagtaaagacggggttctaccacgttggccaggctggtctcaaactcctgacctcaagtga

SEQ ID NO: 23224 - DNA, 201 bp, Homo sapiens
tgaaggcatcaaggttataagcattctcttttttcttttgggtagactgaagctcagagaggttgagtggcttacttaaagctgcacagctattagtaggyagatcaagattagagttcagaacttctcactccctgcccagtttctgctttctttaccctttgcctctttcaagttgtgggtctgccggccaggtgggag

SEQ ID NO: 23225 - DNA, 201 bp, Homo sapiens
cagaatagttgggattacagacgtgcgccaccatggccagctatttttttttttttttgcgtttttagtaaagacggggttctaccacgttggccaggctrgtctcaaactcctgacctcaagtgatctgcccaccttggcctcccaaagtgctgggattacaggcatgagccaccgcgcccaggctttgattgatttttt

SEQ ID NO: 23226 - DNA, 201 bp, Homo sapiens
atgtctgtgtgtaggtggtatatgcgagtgtgtatgtgtgtgtgtgttgtgcatgtatgtgtatgtgtgtctgtgtatgtgtgcctctgtgtgtgaatttstgtgtatgtgtgaatgtgtgtgcatgtttgtgtgtatatgtgtatatatgtgtatatacatgtatgtatctgtgttgttcatgtgtgtatgtgtgtctgt

SEQ ID NO: 23227 - DNA, 201 bp, Homo sapiens
gtaacagctgtgcagaggctgggggatcagaagggcatgggcagctggggaacctgctcaccattgtgtccagggagcatcagcttcaagggctggacagyggtgggaagaagcaggagacacaggtaaggacctgtccctggagaggcttctgtctcctgcagtctcaggtagaggggaccctctaggcatggagagcac

SEQ ID NO: 23228 - DNA, 201 bp, Homo sapiens
tggctaggagatggggacatgagggcatgcaaatcatagttcagatatacacacaattcattcattcaaccttctttccttgagcgcctacataagccaaygaagcagtcaacaaaccagccagcaaccctgcccttggagcttacagcctggaaacaaggaaggtttctaaggcgatggagacaacttagatatagggag

SEQ ID NO: 23229 - DNA, 201 bp, Homo sapiens
tgggaaacaatgaaaatgcgatacgaacacatagaccacacatttgagatccagtacaggaaagacacggccacgtggaaggtgagggcctttgcccaggsacgggagaaacactggggagggcgggagaagggaaagcaaccagaggcattccacctgcaaggcgtcgggcccttggcaggtgaccagtgagaggtagcc

SEQ ID NO: 23230 - DNA, 201 bp, Homo sapiens
aggcattccacctgcaaggcgtcgggcccttggcaggtgaccagtgagaggtagccactgggacgtggtgatcactaggctgtgtggtcagcaggtcactstcctgtctcttggtgaagtaactgaggtttggaaaagtggcgtggcttggccaacgtgaacagctgaccctgagtccccaggcaacagaagaccctctgg

SEQ ID NO: 23231 - DNA, 201 bp, Homo sapiens
cccaggccagggctcggtcccctgcctccacagagcccagaacagaaaccacagaaccaaccccacaccttcagtctagaaatggggcaactgaggctagragggaggtgggccagtggtggagccaggagcgggccctggggtcctgaacccccattctcagggtccagagtccagtcggcctgcactgcgttcctgaaa

SEQ ID NO: 23232 - DNA, 201 bp, Homo sapiens
taggagggaggtgggccagtggtggagccaggagcgggccctggggtcctgaacccccattctcagggtccagagtccagtcggcctgcactgcgttcctraaaaggccacaatatgggtgcaagctgccccagaagggctgggagctgagaaggctcaaaatagggtgggacaggtggcttcagggttctgggcctcagt

SEQ ID NO: 23233 - DNA, 201 bp, Homo sapiens
taccaggatggatggggtgtcaggaggcagaagggctccccaaggacaagatacctgggctgagctttgagggtcccagtggtgccaggtggcaaaagttkctctggctcagggcatcttgagggtggagacagaaacccttcaggaagggagctgaaggggtgggacaggaggctgggggccatgttgggaggctgagat

SEQ ID NO: 23234 - DNA, 201 bp, Homo sapiens; identical to SEQ ID NO: 4069

SEQ ID NO: 23235 - DNA, 201 bp, Homo sapiens; identical to SEQ ID NO: 4070

SEQ ID NO: 23236 - DNA, 201 bp, Homo sapiens; identical to SEQ ID NO: 4071

SEQ ID NO: 23237 - DNA, 201 bp, Homo sapiens; identical to SEQ ID NO: 4077

SEQ ID NO: 23238 - DNA, 201 bp, Homo sapiens; identical to SEQ ID NO: 4081

SEQ ID NO: 23239 - DNA, 201 bp, Homo sapiens
atgtatctgtgtgtgtctgtgtgttgtgcgtgtgtgtgcctgcgtgtgtccgtgtgcttgtgtgtgtgtgtgtgtttgcatgggcatcttgagtgaagctyccaacaatctaacagaagaaaaggagccacacttgtctgttctgctctcttgggtacttcccagaccagtgaaatgaaagggaggaaacccccggcctcc

SEQ ID NO: 23240 - DNA, 201 bp, Homo sapiens
gattctcaaatctccctgaggatgctgatttagatgtcttaatgtactcttttatttttgctgtatctgtacatgtctgtagaagtgtctgctgggttagyatatgtcagaatagatgtgcgctgttttgacatttgggaaactgaatcactattggcatagaggtcagggacagagtctagaggcagcccactgcgggct

SEQ ID NO: 23241 - DNA, 201 bp, Homo sapiens
aagcagtcaacaaaccagccagcaaccctgcccttggagcttacagcctggaaacaaggaaggtttctaaggcgatggagacaacttagatatagggagaraagtgtggcccttggcctcctggagcctgtgttgagtagcgaggtagggtccagcctaatgcagattagcaatgaatcaaggatgctgggaggtactggg

SEQ ID NO: 23242 - DNA, 201 bp, Homo sapiens
agcctcgggggctgggagtgcagtgacccatgagggacgcctgtcctggctgtgggtgaggaggggcggttcccctgctgtgtgtctgccgttctgggttratggttcctgacatgctctagcatgccataacccatgtccagcagagagcacttacatcctatgtgtgaggatgttttcgtttgaaagccatccctcagc

SEQ ID NO: 23243 - DNA, 201 bp, Homo sapiens
aaagagggaaacagttggccttcccctccctggctgcctcagaggcgtcacactgcagaggcctcatggggtagctggggctgcagactcccgggaactcrgcgcctgagccggcagctgaccaccaactcggcagggagaagggggtggcatggttgatagaatgatggaagggttgcccagtgcacaggctgggcatga

SEQ ID NO: 23244 - DNA, 201 bp, Homo sapiens; identical to SEQ ID NO: 4066

SEQ ID NO: 23245 - DNA, 201 bp, Homo sapiens
ttattatgagagtggggctgaggtctgagctgagccttatcagactgagatgcggctggttgtgttgaggacttgtgtgggctgcctgtccccggcagtcrctgatgcacatgacatgattctcatctgggtgcagaggtgggaggcaccaggtgggcacccgtgggggttagggcttggaagagtggcacaggactgggc

SEQ ID NO: 23246 - DNA, 201 bp, Homo sapiens
cccttgagaccccacgtcatgtagagaagttaacggcccaagtggtgggcaggctggcgggacctggggaacatcaggagaggagtccagagcccacgtcyactgcggaaaagtcaggggaaactgccaaacaaaggaaaatgccccaaaggcatatatgctttagggcctttggtccaaatggcccgggtggccactctt

SEQ ID NO: 23247 - DNA, 201 bp, Homo sapiens
cggtgtgggccgaaatcccacagtggtccatgaagccatctgtggtctagggtggggtagatgattattttatgtagttaggttttatttgcctctatatkagaaagaaatataacctgcacttcgaagtcctggattcaaggaaatggttgcttagaatgaagctaaacctgaaaagggacacgttttatgaaagttttc

SEQ ID NO: 23248 - DNA, 201 bp, Homo sapiens; identical to SEQ ID NO: 4125

SEQ ID NO: 23249 - DNA, 201 bp, Homo sapiens
ccccaacagtacctacttcttaaacaaacactgagatccccagaggcgggcccgatcagagaggaaccccgcgtgttcctagaacatggggaacaggcctrtgagagggaccagtcacaaccaagcgcaccactggaggaccagtcctacagagacaggaccactggagagctagaacaggaggatgactcctgtcacagg

SEQ ID NO: 23250 - DNA, 201 bp, Homo sapiens; identical to SEQ ID NO: 4129

SEQ ID NO: 23251 - DNA, 201 bp, Homo sapiens
tgctgtggctgcaacaggccatcaatagccgtaaggaggtaacactaacctggaactctttctgaacatttagggtcaagggtgggggttagggagagacsacctgccatgcccaagcaggcctgcttggtacaatgtatgttctctcccccaacagtacctacttcttaaacaaacactgagatccccagaggcgggccc

SEQ ID NO: 23252 - DNA, 201 bp, Homo sapiens
gctgtggctgcaacaggccatcaatagccgtaaggaggtaacactaacctggaactctttctgaacatttagggtcaagggtgggggttagggagagacgwcctgccatgcccaagcaggcctgcttggtacaatgtatgttctctcccccaacagtacctacttcttaaacaaacactgagatccccagaggcgggcccg

SEQ ID NO: 23253 - DNA, 201 bp, Homo sapiens
tggaccgagggccgcattcccaggccgcgattcctcccagaggtagaacacacctaggagagaagggaaggagggacttgggcagggtggaacccaccctwcccagtgataagcttttctcactggaagaggcagtagactcacctcctcacaccccactccttaaccctcaccaacttgtctgctagatcatggtgccca

SEQ ID NO: 23254 - DNA, 201 bp, Homo sapiens; identical to SEQ ID NO: 4127

SEQ ID NO: 23255 - DNA, 201 bp, Homo sapiens; identical to SEQ ID NO: 4130

SEQ ID NO: 23256 - DNA, 201 bp, Homo sapiens; identical to SEQ ID NO: 4128

SEQ ID NO: 23257 - DNA, 201 bp, Homo sapiens
gcttggtacaatgtatgttctctcccccaacagtacctacttcttaaacaaacactgagatccccagaggcgggcccgatcagagaggaaccccgcgtgtkcctagaacatggggaacaggcctgtgagagggaccagtcacaaccaagcgcaccactggaggaccagtcctacagagacaggaccactggagagctagaa

SEQ ID NO: 23258 - DNA, 201 bp, Homo sapiens
atgaaggtccagggcaggaatgctgagggctcttcagcctgggcatcacccagtgctgcctcccctctttaggagttataggagtatatggagctccccamcgaaggaaggagacagcgggggccctggaagtagcagatgatgaagacactcagacagaggagcccttggatcaggtaagctgttggatcaggaaacagt

SEQ ID NO: 23259 - DNA, 201 bp, Homo sapiens
cccaggatctgttccttaattttgaagttccaaggggctgactgccaataagcaaacttgaaaaagagtaatggagttggctgggtgcagggtggctcacrcctgtaatcccagcactttgggaggctgaggcgggcggatcacctgaggtcaggagttcaagaccagcttggccaacatggtgaaaccccgtctctacta

SEQ ID NO: 23260 - DNA, 201 bp, Homo sapiens
ctccgctggtcacacatgactgccaggcttcaaaccaactccagtgcctagcaacatactcataaccagcacactgtgcccctcttgttcagagaagaggrtagtaagagggaactagagctagtcagccctctctcactgatgggaatgaggtgtttcaagctccaccccgccccccccaatcactcttccaggtggcct

SEQ ID NO: 23261 - DNA, 201 bp, Homo sapiens
agggtagactgttgcccctgggtcttactcactgagcttgtgatgcagagtgaaattcctatcacggtgagcaccatgccagcaactgctcctgggataayaggcagaaatcaggagggtctgagctcagccatgccagtaggagctggtacagggctggaggaagggctcagatggggtctggtcttcaatcccaaaccc

SEQ ID NO: 23262 - DNA, 201 bp, Homo sapiens
tttccaccaatatcttctccaagggccttcccaacaatcagtgtgaagatgatagccagagagttacagatgggcacagccagggtcagatctgggtggtmagaatgaaaagaatgcctgagatgcaacaaatgcctttctaggcacaaaacacttccatcatcatcatttcatacctttaaaaaaggtatcaaaacccca

SEQ ID NO: 23263 - DNA, 201 bp, Homo sapiens
ttacaggcgtgagtcaccatgcccagtcgagcataaacttttaatatatggcttcaaatccttctgcactgacatcctgtgggacttgagaggtgaaattrcacaaagttttgcaacttcattttctaagataatcatatctgctttacagagtcatgattggaattaaataatgtgtaagactagtgcagtatctgacgt

SEQ ID NO: 23264 - DNA, 201 bp, Homo sapiens
caggcagaaagggtaatgagataaaaagaacctaaaactgcaatttgattaaaacttggtgaatggctacctgtagtcagctggtcaagggttcagcattyttccacagcagtgaatgcatgaggccagaggttttcaaactctttaaataagtgcatattatttctttctttctgtttttgagacagagtctcgctctgt

SEQ ID NO: 23265 - DNA, 201 bp, Homo sapiens
tgaaggtccagggcaggaatgctgagggctcttcagcctgggcatcacccagtgctgcctcccctctttaggagttataggagtatatggagctccccacmgaaggaaggagacagcgggggccctggaagtagcagatgatgaagacactcagacagaggagcccttggatcaggtaagctgttggatcaggaaacagta

SEQ ID NO: 23266 - DNA, 201 bp, Homo sapiens
tctttcactcttgttctcttattgtgatccatgaggtagctgttatccccataagagaggaggaagctaaggccagagaggggaagtgctaggtccatccrctcactgccagcacttcatggcccaggggcttcctggaggcagcagagctggaagtgggttcggcccactcaaagggtagactgttgcccctgggtctta

SEQ ID NO: 23267 - DNA, 201 bp, Homo sapiens
caaactcaggttggaggagtggaaaagtggggagaagattctggatccgagccaccttaatgctctaatgccacctttgcactacctccctctaggagaaractcttccacctctttttgcctgaatggcctttgggcacaaggtcagaggctggatgtggaccaggccctgaacagaagccatgagatctggactcacag

SEQ ID NO: 23268 - DNA, 201 bp, Homo sapiens
aaggcagctaggggtgaggccacaggcagtaggcccggctcattcttccctctctctctaccgtccctttcccacacactctgcagaaggtggtgttgtcytctgggtcggggccagggctggatctgcccctggtcttgggactccctcttcagctgaagctgagtatgtccagggtggtcttgagccaagggtcgaaga

SEQ ID NO: 23269 - DNA, 201 bp, Homo sapiens
cgcctgagacaggtctctgggcccctgaccagcaaacgccatcccatcatgaggattgcgcttggggggctgctcttccccgcttccaaccttcggttgcyggtaactacaccccaggggtggaaccctagccaagacttggtaaagcactgctgggtggctggccgtgggaatctaagtccacacttttagggagaaggg

SEQ ID NO: 23270 - DNA, 201 bp, Homo sapiens
gagccgccgagtggacagtggctgattatggagagcagaggcccactggctacctcgcgcctgctgctgttgctgctgttgctactactgcgtcacacccrccagggatgggccctgagacctgttctccccacccaggtgcaggagcgggacagggcactcagctcatgcagtcttcccttctctcctctggccctgtag

SEQ ID NO: 23271 - DNA, 201 bp, Homo sapiens
gccctgaacagaagccatgagatctggactcacagctgcccccagagcccaggcaatggcactgacgcttcccattaaagctccacctaagaaccccctttgaaagttactgattattcatttattcaacaaatattcactgtgcactagcaatgtaccaggcactgtgccaagtattgagttgtcttaatgagcaaaaac

SEQ ID NO: 23272 - DNA, 201 bp, Homo sapiens
cctctgggagggaagaagaataggccacaagaagaagatatgggggcagtggaaggtagtgcttttgcaaactcaggttggaggagtggaaaagtggggakaagattctggatccgagccaccttaatgctctaatgccacctttgcactacctccctctaggagaagactcttccacctctttttgcctgaatggccttt

SEQ ID NO: 23273 - DNA, 201 bp, Homo sapiens
ggttgagagctgcaagggggaggccaaatgctcagaggggagtcaactgagggcagggaggtcgggactgcggctccgatgccctgatttctacatccccrtatcttatctctgtcacactccagctggttcctgccctggatggctgcctgcgccgggattcctggctggacaaacaggccgagatctcagcatctgccc

SEQ ID NO: 23274 - DNA, 201 bp, Homo sapiens
cctttgacctcaccaagatcacaaagtatggggttggcctagcccttgacccagtcccctggttctgccctctctccatcagctcttctcttttccctgtyttcctttccttatctgtgaacaccatctcccccaaacccacactggttctcaaaggacacatgacatacacaatctttccttctgtgtccttccagaacc

SEQ ID NO: 23275 - DNA, 201 bp, Homo sapiens
caagttcatgagcacaacattggaaacagctcaagggaggcggcacattttgaggggaaggaaacctctgggagggaagaagaataggccacaagaagaakatatgggggcagtggaaggtagtgcttttgcaaactcaggttggaggagtggaaaagtggggagaagattctggatccgagccaccttaatgctctaatg

SEQ ID NO: 23276 - DNA, 201 bp, Homo sapiens
agcagtgagccgagatcacgccactgcactccagcctgggtgatagagcaagactctgtctaaaataaaataaaataaaataaaataaaataaaataaaawgggtcagggagtgggtgatttctactgctagactgtttaggccctgtaataaatggataagggaagataactgagaggcggggggcaggtcccttcttaa

SEQ ID NO: 23277 - DNA, 201 bp, Homo sapiens
agcgattctcctgcctcaccctcggagtagctgggattacaggcatgggcaaccatacctggctaatttttgtatttttagtagagacggggtttcactaygttggccaggctggtctggaactcctgacctcaagtgatctgcccgcctcagccttctaaagtgctgggattacagatgtgacccaccaagcccggtctg

SEQ ID NO: 23278 - DNA, 201 bp, Homo sapiens
acgcaggggaggactgtttctagacctcaggcctgtgaatgcaggctccccgagtggacagaaatcttggaggacctagatcaggccctagaggaggagargggagatggaatatcctctcccagttcagaaactttctcggcagtggaggatgatagtggaggggactctgtccttcaccccattgatccccagaggggt

SEQ ID NO: 23279 - DNA, 201 bp, Homo sapiens
acactctgcagaaggtggtgttgtcttctgggtcggggccagggctggatctgcccctggtcttgggactccctcttcagctgaagctgagtatgtccagrgtggtcttgagccaagggtcgaagatgaaggcccttgccctgcctcccttaggcctggctcccctccttaacctctgggccaagcctcaagggcgtctct

SEQ ID NO: 23280 - DNA, 201 bp, Homo sapiens
tcagaccagatgccaggcactgtgcctgcattttctcaatgaaccctctttcacagtcaccccgtaaagtattattttcctcattttacagacaaggacaytgaagcacaaaggtgaagtgacttgcccaaggtcactcagctagaaatttaggattccattatctcatttctagtcctgatacaggatgctacttgggac

SEQ ID NO: 23281 - DNA, 201 bp, Homo sapiens
gagttgtctgagccgccgagtggacagtggctgattatggagagcagaggcccactggctacctcgcgcctgctgctgttgctgctgttgctactactgcrtcacacccgccagggatgggccctgagacctgttctccccacccaggtgcaggagcgggacagggcactcagctcatgcagtcttcccttctctcctctg

SEQ ID NO: 23282 - DNA, 201 bp, Homo sapiens
ccttctctcctctggccctgtagcagggcctctccctctgtctgtctctgacatgtccctactcagctttgtttgttttctctttctgatagagtgcccaygaccctccggctgtccacctcagcaatggcccaggacaagagcctatcgctgtcatgacctttgacctcaccaagatcacaaagtatggggttggcctag

SEQ ID NO: 23283 - DNA, 201 bp, Homo sapiens
tcatggggtgggcacagtggctcacacctgtaatcccagcattttgggaggcagaggcaggcggatcacctgagatcaggaatttgagaccagcctgaccracatggtgaaaccccgtctctactaaaaatacaaaaattagacaggtgtggtggcgcatgcctttactcccagctactcgggaggctgagacaggagaat

SEQ ID NO: 23284 - DNA, 201 bp, Homo sapiens
tgccaggcactgtgcctgcattttctcaatgaaccctctttcacagtcaccccgtaaagtattattttcctcattttacagacaaggacactgaagcacaraggtgaagtgacttgcccaaggtcactcagctagaaatttaggattccattatctcatttctagtcctgatacaggatgctacttgggacgcaggggagg

SEQ ID NO: 23285 - DNA, 201 bp, Homo sapiens
agtcttgtgactgggcccctgggcaggggtcaagggtcagtgcccctgtttcctttaccccctcctccccgggcaacctttaaccctccaccgcccacacrcaaggctgcctgcctctacacattctcccaagagttgtctgagccgccgagtggacagtggctgattatggagagcagaggcccactggctacctcgcgc

SEQ ID NO: 23286 - DNA, 201 bp, Homo sapiens
atgggagatggcaccaggtaagctagctctggtcctcaggggagggatgtctggagctggtctgaggaaagggaacaaaaccaagttattgggcatccctytaccactgtcatctcgtttaatccacacgaacccccacaaagtagctattcttggccccatcttttctgatgggaattctaaggctcagtcagtatataa

SEQ ID NO: 23287 - DNA, 201 bp, Homo sapiens
ggggagacctctgaggccggctggagaggtggacttctaagggccaggtgctcttacccagtagcttcccgggcgctggaagaatctctgctaccaaacartgatagaaaggattgtctccaaagccatctgctctcagggctgccgagattggagttgtgacaaagagatagagaaagaggacgtgggtgtatgcccagc

SEQ ID NO: 23288 - DNA, 201 bp, Homo sapiens
agagatagagaaagaggacgtgggtgtatgcccagcctggagctgtcgcctggggaacccatccctcatttcctccccagcctccgccagaacctgggcgytgagcccccaccttcttcactgatcttcacctgatccgagagtttttcgaattcggctagctcctaaggcgtgggtacggaagctagattagagcagaag

SEQ ID NO: 23289 - DNA, 201 bp, Homo sapiens
aagcagaagaagtgccagccctcagcttccgtcagatcttgggctcctagggccttgtacaagtccatggccctctggttccagtccaggacggccaggcrgaattgggagcagcccttatccaaggccacctgtgggagaagacaacactaacttttctggggtcaaaaaagaaaaaggttttctcactccctctttcaa

SEQ ID NO: 23290 - DNA, 201 bp, Homo sapiens
ttgtcgccccacccatctcctcacctcagccacctttttgattattttggaaccaatcccttgacctgttgtggagagaaagaggcaaaaaatagctattstttgagctgaaggggatcagaaaatgacaccggctgggctctggggacaggggataacagtggggtctgtggggtgctttgctcccaccccagcctcagc

SEQ ID NO: 23291 - DNA, 201 bp, Homo sapiens
atgacaccggctgggctctggggacaggggataacagtggggtctgtggggtgctttgctcccaccccagcctcagcttctgcccagtaccccgatattcyggcatcacatagatatcctccagataaatggtgcgtcccttccatgtactgtagatgaaatagtatatcccatagcccaccacgcagggccctgagagag

SEQ ID NO: 23292 - DNA, 201 bp, Homo sapiens
cctgagggctcaggtaaggggtaggagggacctcaactcccagccttgtctgaccctccaattatacactcctttgcctctttccgtcattccataaccaccccaacccctactccaccgggagggggttgggcatacctggatttccatccgcgcacctagccacagggtccctaagagcagcagctaggcatgggaggg

SEQ ID NO: 23293 - DNA, 201 bp, Homo sapiens
caagagaagtctgggtcggagaatagacaagacaaaccaactgcaagtagccttgctaagacgtttagaaatagcagcctgggctcttcttaaataagacygttctgatgaagagcattctcagggggtcgagtacaccctggctcacctgaattacaggtcaaaatgatatgggttagaaaatgagatgagaacagaagt

SEQ ID NO: 23294 - DNA, 201 bp, Homo sapiens
gggggtccaggggtggagctaagaaggatctgctccccaggctgggtcagttaggggctcacagtgggatcctgttaggtgtgggtggatgagagtcaggktccatcagtgtattcatttaactgttcatttgtataaccccgtttaagaatactgtcctccaagtgccaagaatggtgctcaggggattaccacctaatt

SEQ ID NO: 23295 - DNA, 201 bp, Homo sapiens
cgggatcctgctgcaccttgagtcagagctggcacagacccgggcagagggacagcgccaggcccaggagtatgaggccctgctgaacatcaaggtcaagstggaggctgagatcgccacctaccgccgcctgctggaagatggcgaggactttaagtgagtggggctctcctacccacacgtgctgggatcaggagatca

SEQ ID NO: 23296 - DNA, 201 bp, Homo sapiens
ctgatgactttagagtcaagtaagtttgggggctagagagctgggggtccaggggtggagctaagaaggatctgctccccaggctgggtcagttaggggcwcacagtgggatcctgttaggtgtgggtggatgagagtcagggtccatcagtgtattcatttaactgttcatttgtataaccccgtttaagaatactgtcc

SEQ ID NO: 23297 - DNA, 201 bp, Homo sapiens
gggggctagagagctgggggtccaggggtggagctaagaaggatctgctccccaggctgggtcagttaggggctcacagtgggatcctgttaggtgtgggwggatgagagtcagggtccatcagtgtattcatttaactgttcatttgtataaccccgtttaagaatactgtcctccaagtgccaagaatggtgctcaggg

SEQ ID NO: 23298 - DNA, 201 bp, Homo sapiens; identical to SEQ ID NO: 4166

SEQ ID NO: 23299 - DNA, 201 bp, Homo sapiens
tgggtcagttaggggctcacagtgggatcctgttaggtgtgggtggatgagagtcagggtccatcagtgtattcatttaactgttcatttgtataaccccktttaagaatactgtcctccaagtgccaagaatggtgctcaggggattaccacctaattgctgactcaagttgctggtttgcaatgggcacagaacttctc

SEQ ID NO: 23300 - DNA, 201 bp, Homo sapiens
ctctcaaggaggagctgctcttcatgaagaagaaccacgaagaggcaagcaggggccactggccaggccagggattgaggggccaagagaagtctgggtcrgagaatagacaagacaaaccaactgcaagtagccttgctaagacgtttagaaatagcagcctgggctcttcttaaataagaccgttctgatgaagagcat

SEQ ID NO: 23301 - DNA, 201 bp, Homo sapiens
tcaaggaggagctgctcttcatgaagaagaaccacgaagaggcaagcaggggccactggccaggccagggattgaggggccaagagaagtctgggtcggaraatagacaagacaaaccaactgcaagtagccttgctaagacgtttagaaatagcagcctgggctcttcttaaataagaccgttctgatgaagagcattct

SEQ ID NO: 23302 - DNA, 201 bp, Homo sapiens
cttcctaaaagatggtagaaggagcaggtttgtgaaggggagggtggataaaggaacagggtgaagttacagagaaaccatcagtgagtgggtggcatttytacccactggagtagaaaggccagaactggcattgccctgagtgcaagccaaggggttcctcctgtctcttctccaactgtaggcctcctagaagaggca

SEQ ID NO: 23303 - DNA, 201 bp, Homo sapiens
gctgaacatcaaggtcaagctggaggctgagatcgccacctaccgccgcctgctggaagatggcgaggactttaagtgagtggggctctcctacccacacrtgctgggatcaggagatcacttctccccaaagtctgagcttttggaagcaccccatgtgtctgttcactggtatccactgagcactgggccgttgctccg

SEQ ID NO: 23304 - DNA, 201 bp, Homo sapiens
cttgagtttcccttttctggaggaagaggctgagggtgatttggagataaaggtagaggtcaggaggctttttccctctacctttcttgtctcccttctaytccacggggctgtttataacttgggcttggtcttctgttacagtcttggtgatgccttggacagcagcaactccatgcaaaccatccaaaagaccaccac

SEQ ID NO: 23305 - DNA, 201 bp, Homo sapiens
ccatgctgcccctgaagctggtggagcaggacacggatatctgggaatccaaacccctggcgcccgcatagacgctggctgtgctcctgacaggccgggcrccgtagctgggcgcctggacagagcccagggaccggtagttggtggagaaggtggagcgagtggtgaagctcatactgtcgggggaggagagcgaaagga

SEQ ID NO: 23306 - DNA, 201 bp, Homo sapiens
ggaccccatgctgcccctgaagctggtggagcaggacacggatatctgggaatccaaacccctggcgcccgcatagacgctggctgtgctcctgacaggcygggcgccgtagctgggcgcctggacagagcccagggaccggtagttggtggagaaggtggagcgagtggtgaagctcatactgtcgggggaggagagcga

SEQ ID NO: 23307 - DNA, 201 bp, Homo sapiens
ggctctcctacccacacgtgctgggatcaggagatcacttctccccaaagtctgagcttttggaagcaccccatgtgtctgttcactggtatccactgagyactgggccgttgctccgtgggtgctcctgtgtcttcaagggagtaacagttacagaggtctcccccttgaagaaagcaaactaagtattgtccctagctg

SEQ ID NO: 23308 - DNA, 201 bp, Homo sapiens; identical to SEQ ID NO: 4161

SEQ ID NO: 23309 - DNA, 201 bp, Homo sapiens
actccacggggctgtttataacttgggcttggtcttctgttacagtcttggtgatgccttggacagcagcaactccatgcaaaccatccaaaagaccaccmcccgccggatagtggatggcaaagtggtgtctgagaccaatgacaccaaagttctgaggcattaagccagcagaagcagggtaccctttggggagcagga

SEQ ID NO: 23310 - DNA, 201 bp, Homo sapiens
gctgagtcatctaggagtaaacaagaggccttcctttgggaggagccaatccagggtgtagggggcccagagtgaccaggtgcactagggaaaaaatgccrggagagggccaggaagaggacttgttagtagcgactcacttctgggcaggcaggccagccagctagccagcctgctgaggcttcccaagaggggcagagt

SEQ ID NO: 23311 - DNA, 201 bp, Homo sapiens
ctctgatcacctccactcctataggtatgagacagagctggccatgcgccagtctgtggagaacgacatccatgggctccgcaaggtcattgatgacaccratatcacacgactgcagctggagacagagatcgaggctctcaaggaggagctgctcttcatgaagaagaaccacgaagaggcaagcaggggccactggcc

SEQ ID NO: 23312 - DNA, 201 bp, Homo sapiens
atagcagcctgggctcttcttaaataagaccgttctgatgaagagcattctcagggggtcgagtacaccctggctcacctgaattacaggtcaaaatgatrtgggttagaaaatgagatgagaacagaagtagaagcagctaacactaggagctgggggtgataaaggaatgacagcagatggagttggcagcgcttccta

SEQ ID NO: 23313 - DNA, 201 bp, Homo sapiens
gataaaggtagaggtcaggaggctttttccctctacctttcttgtctcccttctactccacggggctgtttataacttgggcttggtcttctgttacagtyttggtgatgccttggacagcagcaactccatgcaaaccatccaaaagaccaccacccgccggatagtggatggcaaagtggtgtctgagaccaatgacac

SEQ ID NO: 23314 - DNA, 201 bp, Homo sapiens
tcaactcccagccttgtctgaccctccaattatacactcctttgcctctttccgtcattccataaccaccccaacccctactccaccgggagggggttggrcatacctggatttccatccgcgcacctagccacagggtccctaagagcagcagctaggcatgggagggctctttcccaggagagagggggaaggggacag

SEQ ID NO: 23315 - DNA, 100 bp, Homo sapiens
ccagcttggagaacagcctgagggaggtggaggcccgctacgccctacasatggagcagctcaacgggatcctgctgcaccttgagtcagagctggcaca

SEQ ID NO: 23316 - DNA, 100 bp, Homo sapiens
tccgcaaggtcattgatgacaccaatatcacacgactgcagctggagacmgagatcgaggctctcaaggaggagctgctcttcatgaagaagaaccacga

SEQ ID NO: 23317 - DNA, 100 bp, Homo sapiens
cagcttcaggggcggcatggggtccgggggcctggccaccgggatagccrggggtctggcaggaatgggaggcatccagaacgagaaggagaccatgcaa

SEQ ID NO: 23318 - DNA, 100 bp, Homo sapiens
agtctgtggagaacgacatccatgggctccgcaaggtcattgatgacacyaatatcacacgactgcagctggagacagagatcgaggctctcaaggagga

SEQ ID NO: 23319 - DNA, 100 bp, Homo sapiens
agcgtctatgcaggcgctgggggctctggttcccggatctccgtgtccckctccaccagcttcaggggcggcatggggtccgggggcctggccaccggga

SEQ ID NO: 23320 - DNA, 201 bp, Homo sapiens
ctggagggtccaggagccccctgaactgagtatccggtgggaggtcagatttccgcattcagaacgagagctcatacggcatccacgcgtgtctttctcaygcatatccccagcccgagtagaagaggacttctgcatctctgttagttctttctcctcctaagaaaaagcagattttaagtaacttatcatttgttcatt

SEQ ID NO: 23321 - DNA, 201 bp, Homo sapiens
agggagcgatgagtagaggagcagctggagggtccaggagccccctgaactgagtatccggtgggaggtcagatttccgcattcagaacgagagctcatayggcatccacgcgtgtctttctcatgcatatccccagcccgagtagaagaggacttctgcatctctgttagttctttctcctcctaagaaaaagcagattt

SEQ ID NO: 23322 - DNA, 201 bp, Homo sapiens
gagaaggcgcatctgccccctccatagcatctgaatcttaatgaataaaagcactgacacttctttaaaagggaatagcgtgatgctatttacagtttatrcagttttgtaatccagctccatgctggatatttaccgtcagtcatttgaggaagttcacttctctgctggttttctgagtgagggagcgatgagtagagg

SEQ ID NO: 23323 - DNA, 201 bp, Homo sapiens; identical to SEQ ID NO: 4173

SEQ ID NO: 23324 - DNA, 201 bp, Homo sapiens; identical to SEQ ID NO: 4174

SEQ ID NO: 23325 - DNA, 201 bp, Homo sapiens; identical to SEQ ID NO: 4175

SEQ ID NO: 23326 - DNA, 201 bp, Homo sapiens
aatttcatatatgaaggcaaaggaaaaaaaaattaaactttaaataatgaccagttatacttcatcaactctaacaaatgaaggagcagagttggttttcyggagtttgcttcagttctttgatatggtcagtgtaggtcggggaggtcttccctagcttgagaaatcataacctaggatatttaagctgtcagtaatagt

SEQ ID NO: 23327 - DNA, 201 bp, Homo sapiens
tcagtaatagtgttttaaaactccaggcctataataaagtaaaaagtgtgtctgataaaatgggtttttttccttgcttagtgaatgtcttctgtttctckctaaacattgtcacttgccaaaccatgttttctgtttcatactaattttctactggcagtgagaccagcggaatctaagaaattgcatacgaaattcaag

SEQ ID NO: 23328 - DNA, 201 bp, Homo sapiens
caggcctataataaagtaaaaagtgtgtctgataaaatgggtttttttccttgcttagtgaatgtcttctgtttctcgctaaacattgtcacttgccaaascatgttttctgtttcatactaattttctactggcagtgagaccagcggaatctaagaaattgcatacgaaattcaaggattggaaagaagaagaggaagt

SEQ ID NO: 23329 - DNA, 201 bp, Homo sapiens; identical to SEQ ID NO: 4176

SEQ ID NO: 23330 - DNA, 201 bp, Homo sapiens
ctaagagattagtgttagacctgattctagagcaactagaccactttgcttaatagcagaccagaaaccacaccccctcgagtgagtgagattttcctttrgagataattcatgtttttctacacagttttgcagttgtcttcagaattggtttaaagtaggtgttattgccaggcgcagtagctcatgcctgtaatccca

SEQ ID NO: 23331 - DNA, 201 bp, Homo sapiens
atgagatcgtgacagggccagtaaccgtgtgttctctccttcaccttcccaaggtcacgctggatcttcagaacagcacggaaaagtttggagggtttctycgctcagccttggatgttctttctcagatactagagctggccacactgcaggacattgggaaggtttgtgtcttgttttttctccttgggttgtggctgg

SEQ ID NO: 23332 - DNA, 201 bp, Homo sapiens
taggaattatttcttccagtagcgccagtgtaacctgaaagcctttgaaagagtagtttttgtatagctatctgaaaggaatttctttccaaaatattttyccagtgctgacaacaaacacgcagacacaccctgcaaggtgagtgtacggcgccgcacagtggaggcatctgctgcagccgtcgatgtttgtgtctttgg

SEQ ID NO: 23333 - DNA, 201 bp, Homo sapiens
tcctagtgtataaggaataggacttagtattttctattttttgatataccacataccagatactgattatgatggacatttaacccttttttctcattatraaagaaagttaggaattatttcttccagtagcgccagtgtaacctgaaagcctttgaaagagtagtttttgtatagctatctgaaaggaatttctttcca

SEQ ID NO: 23334 - DNA, 201 bp, Homo sapiens
tgcctgcttctgacttcgcccagagaaagcttctctttcacaagggttcttagatttatgttcactgagcaccttcttttctgaggcagtgttttaccaayatttattttcctagtcagtctcgccttacctttcttgttatgcatgtctttggtcctgacccattctctgagtctgtaaaatagaattgctgtataattt

SEQ ID NO: 23335 - DNA, 201 bp, Homo sapiens
ccttggaccctcagtggtgtcactgctggatttttctttcctttggctggccttagggcacacccaggttgactagcgtagtcatggtatttagatccackcacattttcagtttctgtgtctgtctcttgcctgcttctgacttcgcccagagaaagcttctctttcacaagggttcttagatttatgttcactgagcac

SEQ ID NO: 23336 - DNA, 201 bp, Homo sapiens
gtctctttaagctgcatggttctcatgtcagctcccaaagcagaagacggcatgttgaaaaatgccgtagagaagatacttcttttccacctgttttcaaytcatatcatcttgaatttcagggcacctttccatgctcctagtgcttgctatctgtttattattttccttcctgaataccctgaactccagcatgttctg

SEQ ID NO: 23337 - DNA, 201 bp, Homo sapiens
actttttaaattacctcagaagcacatgaaatttaaaggattttaaaaaaaacttaaagattatttcacatagctcttgcacatttcttgataaatgaatyctcaggtattcctctgtttttgttactaatagttacttcttatgggttttttttcccctgaaaatcatttatcaaacgtatgtggcttattttctgaagg

SEQ ID NO: 23338 - DNA, 201 bp, Homo sapiens
ctttcctatttgttcagaactttttaaattacctcagaagcacatgaaatttaaaggattttaaaaaaaacttaaagattatttcacatagctcttgcacrtttcttgataaatgaatcctcaggtattcctctgtttttgttactaatagttacttcttatgggttttttttcccctgaaaatcatttatcaaacgtatg

SEQ ID NO: 23339 - DNA, 201 bp, Homo sapiens
agttgatgtttttcttatgatttgtaggatgtataagccctttgagatatgagttacatttagttttttcaagtttgtttgtctttcagctttgtttatgwtagcttctatcatacaggtgttttggattttcatattgtttgtactcacagctaagattgattacagtgacagagctaggatgtgcagccaggttatagg

SEQ ID NO: 23340 - DNA, 201 bp, Homo sapiens
aatacacatcagtaaagtgagagaaagtttctccaggtgcggttcaagatattagaaactaatgactgatgtacacagaccaccttttggtctgaagcatytctaagtgccactggctgacatgcagcccctacagcctccaggcttccagccctagcatggagcatcactctcctatgcttccctggttgcaggtgatgg

SEQ ID NO: 23341 - DNA, 201 bp, Homo sapiens
tgtgtgggtaaaagtaaataaaatgtgtacagtgtctgaactgtacatatcagggtccaagaacaaaatgagtgacatgggttagctctttttaataaatrgtaaaaccaaatattctaattttcagttttgttatacttccatcacatgtttttgtttttttgttttttgtttttgtttttctattttaggcagccttgc

SEQ ID NO: 23342 - DNA, 201 bp, Homo sapiens
tattttaaagtagcctcttcccaatatagcccctcagttaactacaagtaaactcattttgaatttcattttaatgggcaccatatgccagtactccctcrggcactgggatgttaagaaagtataatgtatggacttcattctcaagttagttttagattagagggggatacacgtaaacaaaagtgcagtggtcacaca

SEQ ID NO: 23343 - DNA, 201 bp, Homo sapiens
tccttagggggaatgggggtggtgagcatatgaggggaaaatactataaggtcattgccagtgatggcttgtccctttagtcaaatttcagatgttacctrtatgcataaacacatgcagttggcagctgttctgtgctgagtattttaaagtagcctcttcccaatatagcccctcagttaactacaagtaaactcattt

SEQ ID NO: 23344 - DNA, 201 bp, Homo sapiens
ttaggcattgatgggaatttcagggtgtggtcttcaagttcatttaagggaattttcatatgctggcaaaaggcttttctcattagcttgactctttccaraattatttgctgtgaattagaagtttaggaaccttttttcacttaattgtgacctagcatacgaaatggtgatgatttaggaactactgttcttgtatta

SEQ ID NO: 23345 - DNA, 201 bp, Homo sapiens
tggaaaaatatctgatggaatacttgtttctgctatattagctgtgtgagactagtgacaggagctgtgggaaatgaatgccaaatgttcttaggcattgwtgggaatttcagggtgtggtcttcaagttcatttaagggaattttcatatgctggcaaaaggcttttctcattagcttgactctttccaaaattatttgc

SEQ ID NO: 23346 - DNA, 201 bp, Homo sapiens
acatagttattaggatgccctttttctttctttttaagtcttttatcaatttggctttttggaaaaatatctgatggaatacttgtttctgctatattagytgtgtgagactagtgacaggagctgtgggaaatgaatgccaaatgttcttaggcattgatgggaatttcagggtgtggtcttcaagttcatttaagggaa

SEQ ID NO: 23347 - DNA, 201 bp, Homo sapiens
aggcggaagggtgggagatcattccagggtgtgggcagcacaggaacctctcttcattgggatataattgccattctgataacacgtgtttgaggtgtctraagtaggaagttgtaccatggtgggacagatatcctgtggttatcatacacagatctcagttttcttctcattgtttgtactttttataaagggtaacag

SEQ ID NO: 23348 - DNA, 201 bp, Homo sapiens
aatgatcaaaatttattttcagcccgtttcacttaaaagttgagactgcttaactttttttaatctttaatcttaaacttttaaatgccatttgatctttraaaatatatgttttaatagtgtattttaagtctctatatttttgttattagaatatatagaggctataacctactaccaagcataacagacgtcactatg

SEQ ID NO: 23349 - DNA, 201 bp, Homo sapiens
attttattttttgccttttttccatgtgttctaaaggaattagagtttgtatataactataatgggggatagaaattgacatgtgccatgaagggaatgcmaaaaagtgccgtgggagatgagaagtggagaaaggaatttcttttttcttggaagcaggaataacttcatgaagcatgtatttcaacttaaacagatagt

SEQ ID NO: 23350 - DNA, 201 bp, Homo sapiens
aaaaaagaaaaaaagaaagtacagcacccagttatgtccgagtgggtgcatgagagtgaccctgagattggagacaacgctgtcacgtgcttgaagaacgycacctgagaaagggggcgagaagtggtgtccgctggtaaccagaggtgttggcttagccatctgcagggaggagggtggtctatcacaggtgagtttcat

SEQ ID NO: 23351 - DNA, 201 bp, Homo sapiens
ctcagtactctgtggacagacactgttcagcacttgttgatcagaaggtttagaaagagaactttcaaagttggtttttaattaaagcatttaatagtgtraatagaaagggattaaattttatgacagacaaaagaaagtacagcacccagctgggcgtgggggctcacgcctgtaatccagcactatggggggctgagg

SEQ ID NO: 23352 - DNA, 201 bp, Homo sapiens
gtttttgtaggaaaatgttacccgtattctccatttgaattcagtttagatttgttaggaatcgcagcttaagctttgccatctgggagtgtttgggacarttttgcagacaaaattgcaaaagtgcctaaggaatgcagctggcattcagacctgctctgtgctcagtactctgtggacagacactgttcagcacttgtt

SEQ ID NO: 23353 - DNA, 201 bp, Homo sapiens
cttgcagaccaatatgataaaatagttcattgtttctaaaagtattactgagtgttgatggcagatatgaacccttttgtttttgtaggaaaatgttaccygtattctccatttgaattcagtttagatttgttaggaatcgcagcttaagctttgccatctgggagtgtttgggacagttttgcagacaaaattgcaaaa

SEQ ID NO: 23354 - DNA, 201 bp, Homo sapiens
ggtaagtgtttactgagtaactaaatgatttcattgttaaatgtgctcttttgttaggctggtgagctttttggaggcaaaagcagaaaacttacacagargggctcatcattatacaggggtaagcggtttatttttgtgagatgctgttttaccttcaagaaggtgaaagtgaggctttccttgtggaatttctctaaa

SEQ ID NO: 23355 - DNA, 201 bp, Homo sapiens
ttttatagagcccttgtgggttatttcatttaatccttagaatgtttataaatctgggcttgttctcggctccacccacagatagggacgctgagcgtgcrtgagtgggcagcaagatagcaggttatggagggcccagctcaccccttctgtggcttgagccaattttatagggcacttacagagtcttttgaaatagta

SEQ ID NO: 23356 - DNA, 201 bp, Homo sapiens
aaatggaaggaagaaagaaccagttatgtgaaagggacacatttacttttaagcttgtatttactgagataaagtattcttaatcaatgttcttgagaggygtgggaaaaatgcaacatcctggttgcagttaaacccagaacattgtgtgttgaagagtgacggttctcaaaccgtcaagacgcgggtactgagtgggac

SEQ ID NO: 23357 - DNA, 201 bp, Homo sapiens
gttgctgtttgagagttgaaaccatgacataagcagaaatggaaggaagaaagaaccagttatgtgaaagggacacatttacttttaagcttgtatttackgagataaagtattcttaatcaatgttcttgagaggtgtgggaaaaatgcaacatcctggttgcagttaaacccagaacattgtgtgttgaagagtgacgg

SEQ ID NO: 23358 - DNA, 201 bp, Homo sapiens
ctctaaagctgtaaccagtaatacccaccatgtatccatctctcagctttagaaagaaaacgttgccagtaaagttaatgcttcataaacttcagtttaarttctaattctcagaatatttgtttgaaatagacctcttcctaaaggatatatttagaaataacctatcattaagtgtaaagtctgttgaatatgctgggc

SEQ ID NO: 23359 - DNA, 201 bp, Homo sapiens
tacagctgtgagggtgagcataatcttctgtggaaccatttcttcacttagtggacattttatcattgctacaattaaaattggagcttaataggaaatayttccatgcactctaaagctgtaaccagtaatacccaccatgtatccatctctcagctttagaaagaaaacgttgccagtaaagttaatgcttcataaact

SEQ ID NO: 23360 - DNA, 201 bp, Homo sapiens
agagggtacacttgtgtttttgaatttatatgaggtaagtgtgtaatagggttttttctaatcttttttaagtggaatctggaattttaatcagatttatyatctgacaacctagaattataatccagaaagtctgtggtattgaggacatattggcaatatgatgaatctctaattcttaaatcctgaaacttttttttt

SEQ ID NO: 23361 - DNA, 201 bp, Homo sapiens
aggccaggcattcacactcagggtgagtgggaaccaggactggctgaggcagcagtggacccaagtctccatcgcgcccatgcttactatggagccttctygttctctctttttctttgggtgagagggtacacttgtgtttttgaatttatatgaggtaagtgtgtaatagggttttttctaatcttttttaagtggaat

SEQ ID NO: 23362 - DNA, 201 bp, Homo sapiens
tttctcagatttaatcattattgtaaaaactatttcagtattgactattttagttttagagcagtaagtgttttgagttcatttgggatatttgacctgcrttgtagctcttcagaaaacacatgaatagtgaagttctttgtttcatgggttccctttagatgaaacccatagaggagaaaagtagaaacctcagcacgt

SEQ ID NO: 23363 - DNA, 201 bp, Homo sapiens
ctgcctctgacttgtctgtttctgcttggccatggtctctgtgaggtcaggtgtgcatatgggcacaaaccagggcatctctttatccccagcacctggcktaagtgctgctctggaactatctgttgaatgaactaatgcatgaatgtattgttgagtatgagacaaacaagtgtcattgtctcctttctagccttgccg

SEQ ID NO: 23364 - DNA, 201 bp, Homo sapiens
ctgcatttatcccctgccacagccctgtgaccctgtgtcctgctgcctctgacttgtctgtttctgcttggccatggtctctgtgaggtcaggtgtgcatrtgggcacaaaccagggcatctctttatccccagcacctggcttaagtgctgctctggaactatctgttgaatgaactaatgcatgaatgtattgttgagt

SEQ ID NO: 23365 - DNA, 201 bp, Homo sapiens
tcttaccacgcccaccctccctgcatgctgcatttatcccctgccacagccctgtgaccctgtgtcctgctgcctctgacttgtctgtttctgcttggccrtggtctctgtgaggtcaggtgtgcatatgggcacaaaccagggcatctctttatccccagcacctggcttaagtgctgctctggaactatctgttgaatg

SEQ ID NO: 23366 - DNA, 201 bp, Homo sapiens
taccaggcccacttcctcttagatttgggcttccccaggctgttgcctttccccaagtagcttctgcttgtcctgtagaagacctttcatgctttgcttcygcagcagccgttcctgaatgcctagtgtcaactgccttcttaccacgcccaccctccctgcatgctgcatttatcccctgccacagccctgtgaccctgt

SEQ ID NO: 23367 - DNA, 201 bp, Homo sapiens
caaggaatagcgtttcacagttcgtcccatcaatcagaattatagcctttggcatctccctatctaccaggcccacttcctcttagatttgggcttccccwggctgttgcctttccccaagtagcttctgcttgtcctgtagaagacctttcatgctttgcttctgcagcagccgttcctgaatgcctagtgtcaactgcc

SEQ ID NO: 23368 - DNA, 201 bp, Homo sapiens
tgcctgagttctgcctcctttgagagtgtgccccagacaaatctattctgtactgaatgtttccttgtctgatttcttggatcattcatttgatggttgcrtatggcctgcaacgtttcttgttttggttctactgaactgttctaaaagtctctcttcatattatctttttacatgtaaatgtaactgtcttcactttta

SEQ ID NO: 23369 - DNA, 201 bp, Homo sapiens
tctactttattgctttcccatccctgggcctttaaatttcccctttaaataccagctcttcccaggcctgttgttttctgcctttccaggtactacccacrgccttgagaattgcctgagttctgcctcctttgagagtgtgccccagacaaatctattctgtactgaatgtttccttgtctgatttcttggatcattcat

SEQ ID NO: 23370 - DNA, 201 bp, Homo sapiens
gcttgtgtgaggatttaaaatcgccctggctactgtctactttattgctttcccatccctgggcctttaaatttcccctttaaataccagctcttcccagrcctgttgttttctgcctttccaggtactacccacagccttgagaattgcctgagttctgcctcctttgagagtgtgccccagacaaatctattctgtact

SEQ ID NO: 23371 - DNA, 201 bp, Homo sapiens
aaggtgagggacataggcttgagacgacttggtgtttctgagcttgtgtgaggatttaaaatcgccctggctactgtctactttattgctttcccatcccwgggcctttaaatttcccctttaaataccagctcttcccaggcctgttgttttctgcctttccaggtactacccacagccttgagaattgcctgagttctg

SEQ ID NO: 23372 - DNA, 201 bp, Homo sapiens
cagtaagctcttagcagtttccatgcgtgcatttctgtgccttgaaataaatgacagatgagtacatttgtgttctgtgtgtaaaatgtgctctttcctcrttgcacttccatgttggagggcttgtctcttggtgatcacacttcaaaattctcacagccccccttgaaccgtttaggtgttagacggtaccgacaacca

SEQ ID NO: 23373 - DNA, 201 bp, Homo sapiens
agtttaaaatgctgctttgggttgggcacggtggctcatgcctgtaattccagcactttgggaggctgagatgggaggatcactggagcttggagttcgaraccagcctgggcatcatagtgtgagatcctgtctcctcaagaaattaaaaaattagctgggtgatgtggcgtgtgcctgtggtcccatctactctggagg

SEQ ID NO: 23374 - DNA, 201 bp, Homo sapiens
ttctagctttgctggtaaccagctgtgaccttgaataagttacttcatctctgagcctgtttcctcttttagaaacaggagtttaaaatgctgctttgggktgggcacggtggctcatgcctgtaattccagcactttgggaggctgagatgggaggatcactggagcttggagttcgagaccagcctgggcatcatagtg

SEQ ID NO: 23375 - DNA, 201 bp, Homo sapiens
ttaagggaattttcatatgctggcaaaaggcttttctcattagcttgactctttccaaaattatttgctgtgaattagaagtttaggaaccttttttcacktaattgtgacctagcatacgaaatggtgatgatttaggaactactgttcttgtattaacagcttttatttaaaaatgattttcctccagtagatggccct

SEQ ID NO: 23376 - DNA, 201 bp, Homo sapiens
ttttcctgcctcagcctcccaagtagctgggattacaggagtgtgccaccatgcccggctaatttttgtatctttagtagagatggggttttgccatgttrgccgggctgatcttgaactcctggcctcaagcggtccccctgtctcggcctcccaaagtgctgggattacaggcgtgagccaccgtacccagccagtagt

SEQ ID NO: 23377 - DNA, 201 bp, Homo sapiens
cagtagggaaaatagttccaggatcctcatgttaatttgccagaaatggcatcttcaagtcgtcagagggatctgagagttccttcctggcctgacttgaraaaatccgtctgtccccagctctgcgtctgcctccactgcccagtcacctcctctccatgctcttggggctgggccctaccccaccatgcagtgctgccc

SEQ ID NO: 23378 - DNA, 201 bp, Homo sapiens
gctcccccaccattcggcggacagcggctggatcagcagtgagcatctgccagcactcaagaaggacacaatatttctatagttggctactaaatgtgctsttaggtaaggtggaggcatatgagtggaagagtctccagcatgtactcaagatagacctttgaaataaataaaaccagatgatccctcagcttctagacc

SEQ ID NO: 23379 - DNA, 201 bp, Homo sapiens
attcacgttaagttttatgtaatacatgataagcttcataggagcttcatcttttatctacttggacttttgcttccgtaggttttgttaaaggccttcayagcgaacctgaagtcaagctcccccaccattcggcggacagcggctggatcagcagtgagcatctgccagcactcaagaaggacacaatatttctatagt

SEQ ID NO: 23380 - DNA, 201 bp, Homo sapiens
tcctatgggtgagagtggggcaccaaagtcttccctgtcccatcccctagcttgagaagcccttctctaatgtggactttgtgccgttagcatcgttactrgcttgaagttgaccatctggacgtactttctggtttagcctcacaagtgagcaaggagggttgagagatgtgctgtgaggaatgtggggccccagctggc

SEQ ID NO: 23381 - DNA, 201 bp, Homo sapiens
gccgcaacccctcagcgagcaagtcaagctcttcacagcgatgtcttacaagcgcagagggctctgtgacaccctggtctcaccgccactcttccaaagtygcagaggctttagcagagatgggcccagcctctctgagtcataggcttctgcacacgggagctgtctttagagggagggtggaatttcatcagccaccca

SEQ ID NO: 23382 - DNA, 201 bp, Homo sapiens
gttcaaaatcaggtcaaaattacatgcaattttgtaatctgacaatttccacttaatattttattagcattttcctgttatgaaacagtaattttagttaygggtcgttgttttgctatgcggttgggataaaattttatatactttttttggcaattacttattatacataaatgtttgtgtatagttttctttttctga

SEQ ID NO: 23383 - DNA, 201 bp, Homo sapiens
ggagccatgagaccagccactatttcaccctctccatccctccactttcagatgtatgtggcgcctccaaagcccgagctcttcttggcgtctgtggcttsaataagcttgctttttgctggtatccctcctaccctcccctgtccccagcaaagcttgcatttgaacttcttcctacgggctaacaaatcagtcagttat

SEQ ID NO: 23384 - DNA, 201 bp, Homo sapiens
gaggtgggggaggggctgcttcctgggctgccttggattggagggaagacctcaggtgagtgggtgggaatttgcccaaggagccatgagaccagccactrtttcaccctctccatccctccactttcagatgtatgtggcgcctccaaagcccgagctcttcttggcgtctgtggcttcaataagcttgctttttgctgg

SEQ ID NO: 23385 - DNA, 201 bp, Homo sapiens
cctgttcaagggaggcaggagcatgctcactcaagggacctcgactaggtgccctctgatttcacacttctggtgttgccccaagccggccccatcacctygcaagaaaggctctggagcccccagggctggagtacctggtcagggttgaccgtccctgtggtcactcatcccatgtggctgagctgggctgggtcctgg

SEQ ID NO: 23386 - DNA, 201 bp, Homo sapiens; identical to SEQ ID NO: 4198

SEQ ID NO: 23387 - DNA, 201 bp, Homo sapiens
agggcagggcgttggggaggtagacgggctcagccactcagggagtggtcaagcagaggctgaagggtcaggccaggttgcaggggcctgggggagccackcggggtaggcgctcccgggagcccgcctggcccatagctctacactcccgcgtggggccggacatgctgtgaagccctctccacgttggatgggggtggc

SEQ ID NO: 23388 - DNA, 201 bp, Homo sapiens
cactctagcctgggtgacagagtgagactccatctcaaaaaaaaaaaaaaaaaaaaaaaattaatggatcaatggatttttaacctaataattaaatttcmaaaaatatcgttctttaatggtaatgtaaaggtaaaattaagataatatgtaacaagcatgtgagtgtctaaggtgtccccgtggtggaaggaaaaaata

SEQ ID NO: 23389 - DNA, 201 bp, Homo sapiens
gcactctagcctgggtgacagagtgagactccatctcaaaaaaaaaaaaaaaaaaaaaaaattaatggatcaatggatttttaacctaataattaaatttyaaaaaatatcgttctttaatggtaatgtaaaggtaaaattaagataatatgtaacaagcatgtgagtgtctaaggtgtccccgtggtggaaggaaaaaat

SEQ ID NO: 23390 - DNA, 201 bp, Homo sapiens
tagctgtttctctgggtgcagcctgcatccgccttcctgcccgcctcctttcctgcactgccatcgtggtctccgggcacttggtccctttctcttccccygagtccctttggctcccctgtgccacccttgtgatccacaggctctgccttctttctgtctcagactgctgctcatcactactcgggaccctaggaaggg

SEQ ID NO: 23391 - DNA, 201 bp, Homo sapiens
gaagtttaatgattcatgcatctcttcccttttgaagtactcttacaggtatgttgtgcatgtgttgaaaagtggcactatctattctaaaatacagtatrcctcctctgtgtttgaacagttgtagcgtggccttggggcctcctgttagctggcttggagaagggattcttgggattgtagagattagacctgaggagg

SEQ ID NO: 23392 - DNA, 201 bp, Homo sapiens
ccaccttcaacaaaattgaaagtaaattgaacttggggaaagtattgacagcatatagatcaaaggttactagcctgtgtaaagagcagttataaatatcrttaagaaaaacactgtcgacctgtcggcaccttgttctccgactcccagcctccagaactgtgacgagtaagtgcttattgtttaaaccacccagtctgt

SEQ ID NO: 23393 - DNA, 201 bp, Homo sapiens
tttagcaggttgggtggcaaaatgaggccacacatttaaagcccctcctcctgattcttttctctgccttggctgcctcctgtggcattttaggtgctgaraaatgaaaacagtagggaaaatagttccaggatcctcatgttaatttgccagaaatggcatcttcaagtcgtcagagggatctgagagttccttcctggc

SEQ ID NO: 23394 - DNA, 201 bp, Homo sapiens; identical to SEQ ID NO: 4238

SEQ ID NO: 23395 - DNA, 201 bp, Homo sapiens
gattcttttctctgccttggctgcctcctgtggcattttaggtgctgagaaatgaaaacagtagggaaaatagttccaggatcctcatgttaatttgccaraaatggcatcttcaagtcgtcagagggatctgagagttccttcctggcctgacttgagaaaatccgtctgtccccagctctgcgtctgcctccactgccc

SEQ ID NO: 23396 - DNA, 201 bp, Homo sapiens
agctgatgtatgtgacgctgacagaactgcgaagggtgcacccttcagaagacgagatcctcgctcagtacctggtgcctgccacctgcaaggcagctgcygtccttgggatggtaagtgacaggtggcacagaggtttctgtgctgaagccacgggggcccatctgccttgggacctggtgttggccagaggtgccgggt

SEQ ID NO: 23397 - DNA, 201 bp, Homo sapiens
ggttgcctgcatgggcgtccctgccctgtccctgtgtctgctccactgggggttgaccaggctgccagggccgacttgggcctgtgccacctgcctctcaygtgtctcggacagtgcagccgatgtctatacttcggtttcctcaatgatgaaatggaggggatagtgttccccgcatcatagaactgtgtgaggtttaag

SEQ ID NO: 23398 - DNA, 201 bp, Homo sapiens
gctgaacctcattgaacgcctgcctttattctagcacagcacctgctgtttgtgggcgaggggtgctgtctctaactcctgcctgcttctcccagcactcyctgagtggggtgtgccagcagcctcaggatgaggacaggaagtgggagggcagagcagatttgggagggccacttgatggggaaggaagtcccaggaagc

SEQ ID NO: 23399 - DNA, 201 bp, Homo sapiens
ggcttccccaggctgttgcctttccccaagtagcttctgcttgtcctgtagaagacctttcatgctttgcttctgcagcagccgttcctgaatgcctagtrtcaactgccttcttaccacgcccaccctccctgcatgctgcatttatcccctgccacagccctgtgaccctgtgtcctgctgcctctgacttgtctgttt

SEQ ID NO: 23400 - DNA, 200 bp, Homo sapiens
gctgcacaggagccaggccaggtgagtgctgccgagtgggtgccctgcctgcagggcatccagccagccaagggttgcaggaatggaggtggaggcgctgtgcagctggaggcatccaggtggcccttccggggctctgctcgctctccaggctccctggacccctttgtagactgtttcaggagaggaactcccaggtg

SEQ ID NO: 23401 - DNA, 201 bp, Homo sapiens
catctcaggttggtattgcccacctactttacaggggggatcccacagctccgagaggttatggaggtgatcaggcagcacacagctttagagtgctgggktgagggcgggccaaggctaactctaaagcccgaacccttacctcctacactgcctcctgcattctggtcaacccagtgttttatttggtggttagatttt

SEQ ID NO: 23402 - DNA, 200 bp, Homo sapiens
gggccagccttgcacacaggcctctcaggatggtctccggcctgctgtgtagtctcttctgcacacaagcgtgagggcagcgcccccgcctcggctgtgggaggagccactgggacgtgagctctggtggcatgcagcagcttttgtctgtgtgtgcctaggacaaggccgtggcggagcctgtcagccgcctgctggag

SEQ ID NO: 23403 - DNA, 201 bp, Homo sapiens
ccacaccagtgatgcgggaagacctgagtgtggtctgagttggaggctgtggtgctaaatacgctgcccctttcataagcaggagtcttagtcaggcccarggaggaagtaaaatctggaaatgaatgagaagcattctctcctgccagtcaagaaatgagaagcgaaagaattctcacgggctgtaagaccagcaggatt

SEQ ID NO: 23404 - DNA, 200 bp, Homo sapiens
ggggccctgtgtggtaacaagaaaaaagtcctggttgacaacagtgccacgaagcgttagaacacatagggatgtttgtggagcatttgcatgtggaaagagcaaaaacataatgggaacgggttcttttgttatgatttttaaaaatctcttttgtaacatccttcccgctgcgccgtttctgcatattcctttatgta

SEQ ID NO: 23405 - DNA, 201 bp, Homo sapiens
ggattctaacagcgcgattctccccttgccctcctggttttccacatctccagcttctagtggtctcagacttgttcaccgagcgcaaccagtttgagctratgtatgtgacgctgacagaactgcgaagggtgcacccttcagaagacgagatcctcgctcagtacctggtgcctgccacctgcaaggcagctgccgtcc

SEQ ID NO: 23406 - DNA, 201 bp, Homo sapiens; identical to SEQ ID NO: 4240

SEQ ID NO: 23407 - DNA, 201 bp, Homo sapiens
tgactctgctctcgaggccatcggctctcattctctgctcccagaaccctgttattacccaggctagcctcctctctgcaccttccccgccctggcccagyacctccctcttgtttccactgtgattccgacctcaccttatcttaaagctgctggacggcaggttctgtacacacgtgtccttgacaaagcacggctggt

SEQ ID NO: 23408 - DNA, 201 bp, Homo sapiens
tagcttttgtttctgtggaaatgggtcagaatatggtgtttagaaacacttatgagctctgagagtttcctcttctgagttcctggcctgcagccttcacrgcagaaaccctgtgatgtcacaagcctgtttctgttccctgctctctgcctgtactgtcctgttttgtgcctgccggtttcagtgacaggaagcagggag

SEQ ID NO: 23409 - DNA, 201 bp, Homo sapiens
tagcagtggctggagcccactcctctgtgcttcgggattagtggggatcgtggggcattgactgtaggtcagctttccttgcttgatctttctcactgggrtgaactagcagcaccttcttttgtagctgctttgcttttgactatctttctgaccgttgttcctagtagctgtagatggtaaatatatttaggcctgttt

SEQ ID NO: 23410 - DNA, 201 bp, Homo sapiens
atgaactggaaggaccctttcatctgagcagccactatggagaaaaacaaccgaatgaggggagagacaatgtgcaattttatttagggcacaaaggagakctgtggttagaaggtgacatttgagtggaaagggggcaagccatgtgtatagcgggagaagagaggtccaggcagagttaacagaaggcagaaatgcttt

SEQ ID NO: 23411 - DNA, 201 bp, Homo sapiens
atgatcaaaatttattttcagcccgtttcacttaaaagttgagactgcttaactttttttaatctttaatcttaaacttttaaatgccatttgatctttaraaatatatgttttaatagtgtattttaagtctctatatttttgttattagaatatatagaggctataacctactaccaagcataacagacgtcactatgg

SEQ ID NO: 23412 - DNA, 201 bp, Homo sapiens
gctcctccgctttaaagcagcaatgcctctggcccccaccccacccccgccacccaggcgcagcaggtgcttcccgtccccccagccctgacactcaggcrcctgcttgctccttgcaggtgtttcagactctgcacagcaccgggcagtcgtccatggtccgggactgggtcatgctgtccctctccaacttcacgcaga

SEQ ID NO: 23413 - DNA, 201 bp, Homo sapiens
ccgagggcactgatgagtgcttttggaggagcaaagggagccaaaccctaatgggaatgtgttcctgaaaggacaggagagagacttgggaaaaggttttrcttgaagagggaacggagaaatagggcagtagccagaggaggagaggagtcggcaatgggttaagttggcagaaatgaaggcctgtttacgcactgaggg

SEQ ID NO: 23414 - DNA, 201 bp, Homo sapiens
gacatttgagtgaatttgcagaaaggaaagatacaagcctaggagatacctggggaaggaacattccaggcagagcaaatagcagtgcaaaggccctggcrgggggcggacatgctgttagggtacaagcaatgagggtggaggagtggggcagccatggggagggaagggagtgaggcctggtggggtgaggccagtgtg

SEQ ID NO: 23415 - DNA, 201 bp, Homo sapiens
actggcagtgcatacatcagtgatcaaagcagattaaagaaagaccccctgccttcttggagtgaagattttgttgggatgcgggtaaggggacagacaayagaaaagcaagtgagtgaagtctataccatggcggctgatcaggaacaccgtacagaagaatccaggagggaagagagttaggtggtgtctgcggtggga

SEQ ID NO: 23416 - DNA, 201 bp, Homo sapiens
gccgagtggcacctcaggctgtggatcctgtgcttctgtggtgaggataagaatagtgccaaccgtgtggattgaaatcaatcagttaatccctccatgtraagcacctggaacggatgacagtcttgttatgaatactcaacaaatgctatcatgatttttagttagatttccattgctttaaaacagttgagacatctt

SEQ ID NO: 23417 - DNA, 201 bp, Homo sapiens; identical to SEQ ID NO: 4235

SEQ ID NO: 23418 - DNA, 201 bp, Homo sapiens
cagtattagagccaaggccctccgcgggcaggtggggcagctgtgggagctggtgccagtctctgacctgcgtccctcctcccaggatcaggaaaggcttwccttgtgaagccagagtggtggccaggatcctgccccagtttctagacgacttcttcccaccccaggacatcatgaacaaagtcatcggagagtttctgt

SEQ ID NO: 23419 - DNA, 201 bp, Homo sapiens
gagcctattgggttgtatagaggtaaccttcgtactgaacacttttgttacaggaaaggagaaagtcagtccgggtagaacttcagaccctaatcctgcakcccccgacagcgagtcagtgattgttgctatggagcgggtatctgttctttttgataggtaagaagcgaagccccatccctcagccgttagcttccctag

SEQ ID NO: 23420 - DNA, 201 bp, Homo sapiens
cccgcctggcccatagctctacactcccgcgtggggccggacatgctgtgaagccctctccacgttggatgggggtggctgagcctggatgctgtctcccrttttcagctgcgtgaacattcacagccagcagcacgtactggtcatgtgtgccactgcgttttacctcattgagaactatcctctggacgtagggccgga

SEQ ID NO: 23421 - DNA, 201 bp, Homo sapiens
tcgttgagggacagagagaggaagtgtgtggtggccagcatggaggtggccacaggggaggctgagttaggccgagagggcagggcgttggggaggtagaygggctcagccactcagggagtggtcaagcagaggctgaagggtcaggccaggttgcaggggcctgggggagccacgcggggtaggcgctcccgggagccc

SEQ ID NO: 23422 - DNA, 201 bp, Homo sapiens
gccactcattcagtccctggctaccaggtcctcactgtgccatggggaaggccggcgctgtcgggggatcacagaaggcagcacgtcatgatggcatgtgmcatgaaggaaaagcacagggcactcaggaagtagaggggactggcctggggtgtgggaatctagggcctcgttgagggacagagagaggaagtgtgtggt

SEQ ID NO: 23423 - DNA, 201 bp, Homo sapiens
gaagttttccttttttttaaaaaaaaatttaatgttcattgtttttatctgttttattcctaggtcccgcaagcagaggaagcattagttttgtttttatktatgttctgtattccagaaagtagttaagagacctcacatgtagcgatagagatgtgtgtaagagacagtgagagggcgtgacttggacttaagcaagga

SEQ ID NO: 23424 - DNA, 201 bp, Homo sapiens
gaagcgaaagaattctcacgggctgtaagaccagcaggatttaaaagttgaattagttgcttatgttaagaactcaaccaagttcatctacacaagctgartctccagcttttcctaagaaaccatgtgtggcagtggctgcagggcagggcacagctgggcctgagcaccccgctccctgcacctctcccctccctgggc

SEQ ID NO: 23425 - DNA, 201 bp, Homo sapiens
cagacccaaaggtggcctcctggtcagtgagaagctggaaacgtgacaggaactgacgtggggttattgagcatttaggggaagacgttagcagagcaggratgagcaggcaactagtagaacacccacttaagggctcacggacaggtgctcacttaggaagtgagtttcatttggtattacaccaggttcctttaggca

SEQ ID NO: 23426 - DNA, 201 bp, Homo sapiens
gggtgtcttgctgctcttgttgacatgtgggctctccttccaggaagacacagagaggacccagatcaacgtcctggccgtgcaggccatcacctcactgstgctcagtgcaatgactgtgcctgtggccggcaacccagctgtaagctgcttggagcagcagccccggaacaagcctctgaaagctctcgacaccaggtt

SEQ ID NO: 23427 - DNA, 201 bp, Homo sapiens
acagcggagccagcagaatgggaagttgtggaatgcaggcccttgattctgatagaaggtgtggtttgaactcacagaaatgacagtttggagggtagacrtatgtcacaagtcatcaagattgtctttaaattcatgcatagaagctaacagggtgtcataagcaaggcctgtaaaatgtatgagggaattcaaagataa

SEQ ID NO: 23428 - DNA, 201 bp, Homo sapiens
agggttgacactctctcatgtaacatttatatttctaggctggaccagtcgtactcagtttgaagaaacttgggccaccctccttggtgtcctggtgacgyagcccctcgtgatggagcaggaggagagcccaccagaagtaaggccacaccctgtgctggttggcacatgggcagttatggccgcttgcaggcctttggt

SEQ ID NO: 23429 - DNA, 201 bp, Homo sapiens
aacccttgtttcagataacatgaggagcttagcttgaggagagtgagggttgatggagggggactgacttctgcccagtgaaatggcatcatctcccaccwgcccgctgaaataagatgatggggcctgttccttagggcctgcagcatcctcaggcaggaaagaaaggccgacctggcagggtgtgagccagcaggtgta

SEQ ID NO: 23430 - DNA, 201 bp, Homo sapiens
cagcttgagcagctggttgtaggtcatgctttctacactgggcatataggatgtgttttttaaaaagtcctctcttaaccgttgcttgtttagatcctaartatatcactgcagcctgtgagatggtggcagaaatggtggagtctctgcagtcggtgttggccttgggtcataaaaggaatagcggcgtgccggcgtttc

SEQ ID NO: 23431 - DNA, 201 bp, Homo sapiens
tcctaaaggaagtctgaggctgaggagccacaggatggcttccagctgtcacaggctgctgctggccttatcacagagagtgggccagagggctgggaacsaaggccagagctcaggttcaggaccattccagcaatcccagcagaaaatggggagaattgtatggtataggcggatatgaaggtagaatctgcaggcctt

SEQ ID NO: 23432 - DNA, 201 bp, Homo sapiens
gagggacagacacaggtcctgggagaccagagaaagacgaggggcagaggaggtgtcctaaaggaagtctgaggctgaggagccacaggatggcttccagmtgtcacaggctgctgctggccttatcacagagagtgggccagagggctgggaaccaaggccagagctcaggttcaggaccattccagcaatcccagcaga

SEQ ID NO: 23433 - DNA, 201 bp, Homo sapiens
gaagcaaggatgacaacatggccctttgatactagctgagggacagacacaggtcctgggagaccagagaaagacgaggggcagaggaggtgtcctaaagkaagtctgaggctgaggagccacaggatggcttccagctgtcacaggctgctgctggccttatcacagagagtgggccagagggctgggaaccaaggccag

SEQ ID NO: 23434 - DNA, 201 bp, Homo sapiens
ttttcatctgtgcatttgtagccaacttgaaaacaaagatccagggattactacttaaaagccagacttcttggaggttatagtgatgattttgatagtawcttgagccgtctcataataacctcagggtgagagatggccaacaggagacagtcgagggacttagaaatctgaatgaaatctgaagttcaaatcttcaga

SEQ ID NO: 23435 - DNA, 201 bp, Homo sapiens
gttaaaatgtttgtttttatactgcattgtaatattaacgtactgtaaaataaaagtggcttgttcttttcaaggaacagtatcctcaacaagggtcattrgccacaatttttaaaaaattggacgtcatagtttacatgttagagggcgttttgaagctttgtatttttaaattaaatgttatagagtgatgttttcatg

SEQ ID NO: 23436 - DNA, 201 bp, Homo sapiens
ggtgaatcaaggaatagtcggccgtggcctgcaggcccctgactgcacaggccttcaagcacatgtcaatgccgttagcctccctccatctcctcataccwtctggccacctgtgagttgcactgccactgccagccattctggtatgttgtcagcacctccactgctcatacctcatggttagggaccacctggagcctt

SEQ ID NO: 23437 - DNA, 201 bp, Homo sapiens
ggctggctttttcctccgtaagtatggtcttgacatggtcaccgatagaaacatggaaacatctgcaaacttgccgttactcgtgtgtccgatctgactgyttcttgtatttttttctagtctgcccttactaggatgaactgtacacatcagttcatcctttttaaatgagcatgaggttattttgggttgttaggtgtt

SEQ ID NO: 23438 - DNA, 201 bp, Homo sapiens
gctgagcattgtatggctaggctgtagtttgttttcacttcaccagttgggaaacagagaaaaggcactttttaaaaagtttaaatctgtagaattttggkttttaccagttctcttctaaatcctgagggattacaggaaaagttgttgtatttcagaatattcttagcttgatgtgacctctgtccccgttaaggccct

SEQ ID NO: 23439 - DNA, 201 bp, Homo sapiens
aaaaatgaattactagaagtgtgaaatacaaaacacagctgctctttttttagccatagactcagcagccataaaattgctgtatccagttgcagaaattsctgctgcttactcttgaccctctctcggtttgtgtgcatctcctctcaggctggctcccagatgggagctggctccaggcgacactgggtgctctgctcc

SEQ ID NO: 23440 - DNA, 201 bp, Homo sapiens
tgtgctgcttctgttagctcgcttccttggtctcaggttatagtttaaggcattgtggagccctaaaaagcctgtactctgtttttacctgttttaggacyctttcactttggggatgtgttgattttttttttttttttttttttttttttgagatagagtctcgctccattgcccaggctagagtgcagtggcacgatc

SEQ ID NO: 23441 - DNA, 201 bp, Homo sapiens
aatccttctcatgagcctctgtccagttgttcctccctccacctggaagggaccctgggttcctcataacatcccagcggaacaggggaccttctatcctrtccccaagttcatcctcatcctcctgccggcttcctggcccctcttatgtctgcttcctgacgccacatccttctggattctctggaattgaattttgcc

SEQ ID NO: 23442 - DNA, 201 bp, Homo sapiens
cttcacatcctctgtgtctggttggggacaaggagagggaaggtaaagaaggctttgtggccttggataagtgacaggcatgcctttgctggtgttctctygtggtgacaggtcacagccccaccctgtaaaaggggactgagagacgtcgtcctgctgcttcccagcagcagcactgtggtctctgatgtgttttctgtg

SEQ ID NO: 23443 - DNA, 201 bp, Homo sapiens
atttcatcctcagtgaggaaggtgatacacagagagaccaagtgactgtgtccacggcgacggcgctctgcatttcactttagcggttaatgtactctacytatatttttactttatatttaccatatatcttttcatgtatacttggcgtaagtgctttatagtagtcacctaattcactgtcatcttttttgtttcttg

SEQ ID NO: 23444 - DNA, 201 bp, Homo sapiens
tctgctaagtggctgtgacttcatgcagccttcacttggtttgtcatcagtggagatgccctgtgttgtcgaaggagataagcccagtaagcctgctgggyaccttttggtttgcaggttcagcaggcagcccatggctttccctgtgtcgcattgaagcagctggctaaaattgatgatacattaaattcctgtgacaga

SEQ ID NO: 23445 - DNA, 201 bp, Homo sapiens
aagtttgccaaagattaatatacatttgattttcatgttgtgccttttctctgattgtgaaatattacaaattctatacaaataacaatgatggcaaatcytcctgagcaaagtgtgcaccttgtatgtgccctagaggaacttgtgtttcgttctgattcccctacatttctcatgtcatagagtgggggttgcattagt

SEQ ID NO: 23446 - DNA, 201 bp, Homo sapiens
tcttttcctttcctttgacactaggaggctgactggggagaagccctggtctatggctgtgggcagcaggggctgagaggagcaggctctcaggggggcaygggtaccccaagggaagccagagccctgatttgttccattctagtaagaacaaagactgctctggtttcatgtttgttctgattgcctttcatcaaccgg

SEQ ID NO: 23447 - DNA, 201 bp, Homo sapiens
ttgggttaatttcatatatgtttcttagaagggatatcattgatgtaaatattttaaaggcttgtcctccaaaaaaatcatgtaatttcttctaaattackgatcttttaaatgaccttcacctttctctcaaatctcacttaagactgggctgagtagtcagtttcctgtagcagaaaaaagctcagacttgagtagcct

SEQ ID NO: 23448 - DNA, 201 bp, Homo sapiens
gcaagaatgctgtcgttggtggaagcacgaaagagcaagcaggaaatactttgtaaaagaataaaaacgaaaaatgttagcgaacatcttctaatagtctkctgtattcagagaactctaggagatatatatggttgatgcaaagatgatttaaggcatagcccggccttccaagaagtgtgtggccagtgagtgagatgg

SEQ ID NO: 23449 - DNA, 201 bp, Homo sapiens
gccaggcttgtaccactactgcttcatggccccgtacacccacttcacccaggccctcgctgacgccagcctgaggaacatggtgcaggcggagcaggagmacgacacctcggggtaacagttgtggcaagaatgctgtcgttggtggaagcacgaaagagcaagcaggaaatactttgtaaaagaataaaaacgaaaaat

SEQ ID NO: 23450 - DNA, 201 bp, Homo sapiens
gagaaagcttctctttcacaagggttcttagatttatgttcactgagcaccttcttttctgaggcagtgttttaccaatatttattttcctagtcagtctygccttacctttcttgttatgcatgtctttggtcctgacccattctctgagtctgtaaaatagaattgctgtataatttaattacatgaaatcctttagaa

SEQ ID NO: 23451 - DNA, 201 bp, Homo sapiens
ctcctgtttcctttgctctgtcatccccgcggtcagctcctgctgcgcagcttctcagctgaagtgcgtttggagtgcctggcgtgtcttgctggatcttkgagtattgcctctggtttccttggttccttctgctgagttgctcagcgtctccactccccatttcttgtgtggcccttcctgcactcctctgattccttt

SEQ ID NO: 23452 - DNA, 201 bp, Homo sapiens
agggcacctttccatgctcctagtgcttgctatctgtttattattttccttcctgaataccctgaactccagcatgttctgctgtaattctggcctccctrgcatcttggactcctgtttcctttgctctgtcatccccgcggtcagctcctgctgcgcagcttctcagctgaagtgcgtttggagtgcctggcgtgtctt

SEQ ID NO: 23453 - DNA, 201 bp, Homo sapiens
agcagaagacggcatgttgaaaaatgccgtagagaagatacttcttttccacctgttttcaactcatatcatcttgaatttcagggcacctttccatgctyctagtgcttgctatctgtttattattttccttcctgaataccctgaactccagcatgttctgctgtaattctggcctccctggcatcttggactcctgtt

SEQ ID NO: 23454 - DNA, 201 bp, Homo sapiens
aaaaaacttaaagattatttcacatagctcttgcacatttcttgataaatgaatcctcaggtattcctctgtttttgttactaatagttacttcttatggkttttttttcccctgaaaatcatttatcaaacgtatgtggcttattttctgaaggatgtttgataattttggaagatatgaaagtcttcatattttacaag

SEQ ID NO: 23455 - DNA, 201 bp, Homo sapiens
aaatattctaattttcagttttgttatacttccatcacatgtttttgtttttttgttttttgtttttgtttttctattttaggcagccttgccttctctarcaaaccccccttctctaagtcccatccgacgaaaggggaaggagaaagaaccaggagaacaagcatctgtaccgttgagtcccaagaaaggcagtgaggc

SEQ ID NO: 23456 - DNA, 201 bp, Homo sapiens
ttgaaattgattttgggagaagttgccaatctccatgaaagaattggggcctgtgctatttgcttcagggggctataggagagtttcgtgaaagggactawaagatgagtattttaataagatcattcatccaacttgaacatgggctggaggagaaggtagggagactcaggagattaatgttgatgctaaggcaagata

SEQ ID NO: 23457 - DNA, 201 bp, Homo sapiens
agagggggatacacgtaaacaaaagtgcagtggtcacacagagtggccctaatcactctccttgggcagatttatgggctggtaggaaagagcacaacacrgagagggtgtagcaccttggcgatgataatggaggatgtggccagcaaggaagacggagtccattgaaattgattttgggagaagttgccaatctccatg

SEQ ID NO: 23458 - DNA, 201 bp, Homo sapiens
tcaggaatttgataagcttagaataaattgttgcttcttaatgtcatttcagaagatgaatatttattaatagatgccaactgagatatcattaaaattgrttactaactactacttggaaaagtctcccagttccaaacttcagcaggcctcttgacaattcagctgtggtcaattgggtcttgcgtgatagatacaatg

SEQ ID NO: 23459 - DNA, 201 bp, Homo sapiens
tgtttacctgaaacttctcatgcatgagacgcagcctccatctcatttctccgtcagcacaataaccaggtatgctgacccagtggcatcttcacattgtygggaaaatgccctttcctgatgcctttctttaggctttaattgaaaacattttattttctagaaaaaagcttcagctcaggatgtttgagtgtaggtcag

SEQ ID NO: 23460 - DNA, 201 bp, Homo sapiens
tagatgaaacccatagaggagaaaagtagaaacctcagcacgtaagagccaacatatatacacatcggatttaaacctaaagcacaaattgtgcctggtcrcagtggcgctgagtcgcactcagccaggccaggcattcacactcagggtgagtgggaaccaggactggctgaggcagcagtggacccaagtctccatcgc

SEQ ID NO: 23461 - DNA, 201 bp, Homo sapiens
aataccctggtatgttaaaagttcacatcttattttctcagatttaatcattattgtaaaaactatttcagtattgactattttagttttagagcagtaartgttttgagttcatttgggatatttgacctgcgttgtagctcttcagaaaacacatgaatagtgaagttctttgtttcatgggttccctttagatgaaac

SEQ ID NO: 23462 - DNA, 201 bp, Homo sapiens
aaggaaataactaggtttcagaggtcagcttggtggcctgtttttgccttgcgtgcagcagaggaagtagaatctgaggatgagtttggttttcactagcsgaggggagggaggaaatgatgggagcaggtaggttattgggtctggttttgttcatttgaaaacaatctgttgtttgaggctgaaggtggcttgggtgat

SEQ ID NO: 23463 - DNA, 201 bp, Homo sapiens
tgagggacataggcttgagacgacttggtgtttctgagcttgtgtgaggatttaaaatcgccctggctactgtctactttattgctttcccatccctgggmctttaaatttcccctttaaataccagctcttcccaggcctgttgttttctgcctttccaggtactacccacagccttgagaattgcctgagttctgcctc

SEQ ID NO: 23464 - DNA, 201 bp, Homo sapiens
taataaatggtaaaaccaaatattctaattttcagttttgttatacttccatcacatgtttttgtttttttgttttttgtttttgtttttctattttaggmagccttgccttctctaacaaaccccccttctctaagtcccatccgacgaaaggggaaggagaaagaaccaggagaacaagcatctgtaccgttgagtccc

SEQ ID NO: 23465 - DNA, 201 bp, Homo sapiens
agtggccactcattcagtccctggctaccaggtcctcactgtgccatggggaaggccggcgctgtcgggggatcacagaaggcagcacgtcatgatggcaygtgccatgaaggaaaagcacagggcactcaggaagtagaggggactggcctggggtgtgggaatctagggcctcgttgagggacagagagaggaagtgtg

SEQ ID NO: 23466 - DNA, 201 bp, Homo sapiens
taatgtttctgaaagatataggtgaccactttctagataggaagattttatattactaagttgaattttctctaaattaacacagaaatttaaaataatcwtgatcaaaattctagtagaggtatttttgaacttgttcactgcaagaataaatacataattgcaaagaatatctcaaaatcatcaccaggcctggtgtgg

SEQ ID NO: 23467 - DNA, 201 bp, Homo sapiens
attctgtggatcttcccaagggtgtgaagtgtccacagcgtctgccttgggagtttccatgcccaccagaaccatgccccaagcccctcaagcactctgayctaggaaagccagtgaagcaaggatgacaacatggccctttgatactagctgagggacagacacaggtcctgggagaccagagaaagacgaggggcagag

SEQ ID NO: 23468 - DNA, 201 bp, Homo sapiens
cctgctcttagcactgtgtttttccagctgtgggtggtgggggatgagtatctttttatttccatgagatgagaaaaatgaattactagaagtgtgaaatrcaaaacacagctgctctttttttagccatagactcagcagccataaaattgctgtatccagttgcagaaattcctgctgcttactcttgaccctctctcg

SEQ ID NO: 23469 - DNA, 201 bp, Homo sapiens
agttattgtagccatccttcaccctcacctcgccactcctcatggtggcctgtgaggtcagccaggtccccttctcatctgcacctaccatgttaggtggrtcctaattttagagacatgaaaaataatcatctggaagtactttatgtcttaagttggcctggacatgtcagccaaggaatacttacttggtttgtgtta

SEQ ID NO: 23470 - DNA, 201 bp, Homo sapiens
ggtttgtgttagtgcttgtaattcgcccccagaatgtgtacacgttctggatgcattaaagtctggcctgtatccttaaagggccatcgctgtgctgcctrccctcagcaaggacacactttgcagacccacagaggctccgcctccacctcacaccaaagaaagggaggagtccaaagggcatcagtgccattactcaca

SEQ ID NO: 23471 - DNA, 201 bp, Homo sapiens
acaaaagggttgctaaaacataatccaaattgacataagaaataccatttttccaaccaaaattttggcattcatatggctacttttacgtatttcagctkcatttgaacatctttttcaaactttagggtggttggtgtatcactgaggtcttggatgacactttagctttgattttgtttttatgaattaaaattgtca

SEQ ID NO: 23472 - DNA, 201 bp, Homo sapiens
tttttgaagcagcccgtgaggtgactctggcccgtgtgagcggcaccgtgcagcagctccctgctgtccatcatgtcttccagcccgagctgcctgcagarccggcggcctactggagcaagttgaatgatctgtttggtaattaaaattaaaatttatcttatttttaaaaagcattccagggccagtatagtactttgc

SEQ ID NO: 23473 - DNA, 201 bp, Homo sapiens
caccgtgcagcagctccctgctgtccatcatgtcttccagcccgagctgcctgcagagccggcggcctactggagcaagttgaatgatctgtttggtaatyaaaattaaaatttatcttatttttaaaaagcattccagggccagtatagtactttgcaccaagtaaatgtacaataaaggcagtggatctaatacattga

SEQ ID NO: 23474 - DNA, 201 bp, Homo sapiens
attgaaagcgtttacagaggtagctaaagagcagcacgggtgtcctcggctcagaatttcttcctgtgtgtttgccactttgccattcattgacatggtcrtggacatagggctctaagcccttgaggaaggctgggccagacctcaggggagatgcagccccaaaccacgtgcagtcctgtggacggatgtgtagatgtg

SEQ ID NO: 23475 - DNA, 201 bp, Homo sapiens
cagggtgacaggccctcagccccagggaagtaaaatgctgacaggggtacagaaaggagcacgtccagacatttgctgaccagggcctctcagaggggccsgtgtatggcaggagggtcgcagctgaggggcctttctgtggagggcctgggtgaggggagcgagggtgggcggtggtctctgcagacgtcccgcccactc

SEQ ID NO: 23476 - DNA, 201 bp, Homo sapiens
cccactcgcgggctctgtgtggctgggcttctcctgacactgcttctcattagctttggtcattgtgcctcgatcgccctctcggggaaaggcttaagtaragatccagttcccacccccagatgctggctgccaggagtttccctttccacagcccttccccaagacagaccacaagagcctccaagcagcacagttgtc

SEQ ID NO: 23477 - DNA, 201 bp, Homo sapiens
aatataaaaattagccaggtgtggtggtgtacgcctgtaatcccagctactcaggagactgagacaggagaatcgcttgaacccaggaggcgaaggttgcrgtaagccgagatcgcgccactgcactctagcctgggcaacagagcaagactccgtctcaaaaaaaaaaaaggtaggtgttattgatcagaacccttgttt

SEQ ID NO: 23478 - DNA, 201 bp, Homo sapiens; identical to SEQ ID NO: 4241

SEQ ID NO: 23479 - DNA, 201 bp, Homo sapiens; identical to SEQ ID NO: 4237

SEQ ID NO: 23480 - DNA, 201 bp, Homo sapiens; identical to SEQ ID NO: 4236

SEQ ID NO: 23481 - DNA, 201 bp, Homo sapiens; identical to SEQ ID NO: 4234

SEQ ID NO: 23482 - DNA, 201 bp, Homo sapiens; identical to SEQ ID NO: 4232

SEQ ID NO: 23483 - DNA, 201 bp, Homo sapiens; identical to SEQ ID NO: 4230

SEQ ID NO: 23484 - DNA, 201 bp, Homo sapiens; identical to SEQ ID NO: 4227

SEQ ID NO: 23485 - DNA, 201 bp, Homo sapiens; identical to SEQ ID NO: 4226

SEQ ID NO: 23486 - DNA, 201 bp, Homo sapiens; identical to SEQ ID NO: 4225

SEQ ID NO: 23487 - DNA, 201 bp, Homo sapiens; identical to SEQ ID NO: 4224

SEQ ID NO: 23488 - DNA, 201 bp, Homo sapiens; identical to SEQ ID NO: 4189

SEQ ID NO: 23489 - DNA, 201 bp, Homo sapiens
tttgtggagcatttgcatgtggaaagcagcaaaaacataatgggaacgggttcttttgttatgatttttaaaaatctcttttgtaacatccttcccgctgygccgtttctgcatattcctttatgtagctttcaaactcctcttaggagttctggtccctacagggcgtgggagcccaggctttacgtagctttcaaactc

SEQ ID NO: 23490 - DNA, 201 bp, Homo sapiens
cctgccagtgattccccaccacagcctgaccatgggctgccttggctcagggttccactggcgagctggtggtccttggaccccagcactcaggtgtagcrttgaccagttccaaggttgtcccagtgcctgcccatctctcctgagggctcagggacagtacctggcagttgggggtgtggcagggggcaggaatgacca

SEQ ID NO: 23491 - DNA, 201 bp, Homo sapiens
tatcttaaagctgctggacggcaggttctgtacacacgtgtccttgacaaagcacggctggtgccgcaacccctcagcgagcaagtcaagctcttcacagygatgtcttacaagcgcagagggctctgtgacaccctggtctcaccgccactcttccaaagtcgcagaggctttagcagagatgggcccagcctctctgag

SEQ ID NO: 23492 - DNA, 201 bp, Homo sapiens
ctcctctctgcaccttccccgccctggcccagtacctccctcttgtttccactgtgattccgacctcaccttatcttaaagctgctggacggcaggttctrtacacacgtgtccttgacaaagcacggctggtgccgcaacccctcagcgagcaagtcaagctcttcacagcgatgtcttacaagcgcagagggctctgtg

SEQ ID NO: 23493 - DNA, 201 bp, Homo sapiens
attacaggcatgagccaccatacctggccagtgttgatattttaaatacggtgttcagggaaggtccactgagaagacagctttttttttttttttttttkgggttggggggcaaggtcttgctctttaacccaggctggaatgcagtatcactatcgtagctcacttcagccttgaactcctgggctcaagtgatcctcc

SEQ ID NO: 23494 - DNA, 201 bp, Homo sapiens
acacagccgccaccgccgccgccgccgccgccgcctcctcagcttcctcagccgccgccgcaggcacagccgctgctgcctcagccgcagccgcccccgcmgccgcccccgccgccacccggcccggctgtggctgaggagccgctgcaccgaccgtgagtttgggcccgctgcagctccctgtcccggcgggtcccaggc

SEQ ID NO: 23495 - DNA, 201 bp, Homo sapiens; identical to SEQ ID NO: 4191

SEQ ID NO: 23496 - DNA, 201 bp, Homo sapiens; identical to SEQ ID NO: 4187

SEQ ID NO: 23497 - DNA, 201 bp, Homo sapiens
gctgtgtgaggcagaacctgcgggggcaggggcgggctggttccctggccagccattggcagagtccgcaggctagggctgtcaatcatgctggccggcgyggccccgcctccgccggcgcggccccgcctccgccggcgcagcgtctgggacgcaaggcgccgtgggggctgccgggacgggtccaagatggacggccgc

SEQ ID NO: 23498 - DNA, 201 bp, Homo sapiens
tttgaaatgcttggtggatgtcttaggcctgttacgatgactgagcactgtgggggcaggagacagaaagtcagtgtctcctagttctgtgctgctttaaygtgcatagaaatcagctgcggattcagcagatcactccttttctgacagatgggcctgcttactctgatgttatatcagaaagctctgaatctgggaatt

SEQ ID NO: 23499 - DNA, 201 bp, Homo sapiens
acaaaagagggcaggtgctgccgtgcctctctgctcagtatggatactggaccttgtgctgccagggctcccagtagggccagttcatggcactcagctgraaagtccactgttgggaggcattcttaaccatccactctgtgccgtatgtagtggggtctggtcattctgttggaggagacagaccagtgacgacatttg

SEQ ID NO: 23500 - DNA, 201 bp, Homo sapiens
tttctggaaggctcaagatcccacgctggggaaaagaagttctggagacaaaagagggcaggtgctgccgtgcctctctgctcagtatggatactggaccwtgtgctgccagggctcccagtagggccagttcatggcactcagctggaaagtccactgttgggaggcattcttaaccatccactctgtgccgtatgtagt

SEQ ID NO: 23501 - DNA, 201 bp, Homo sapiens
tggttctggttatccttagataatgaagtaacagtgtagcaaatttcaaaacctcttggaaatgttattttaccattcaaaaaggcttactaaggttctcrttatgggtggccctctttttgcaaaaggttttcaggcttaagctccatttctaggtgctccaacactccattatttgtatatgtatggaaataaaagctg

SEQ ID NO: 23502 - DNA, 201 bp, Homo sapiens
tcatgctctgtggctcctactaagttctagtccttaaattggttccatagccagacatgttgcaatgtcttaacctcattataaagtaaatgtggttctgrttatccttagataatgaagtaacagtgtagcaaatttcaaaacctcttggaaatgttattttaccattcaaaaaggcttactaaggttctcgttatgggt

SEQ ID NO: 23503 - DNA, 201 bp, Homo sapiens
cgtcgtgacctggtctgcattctctgagtgtgctgcttctgttagctcgcttccttggtctcaggttatagtttaaggcattgtggagccctaaaaagccygtactctgtttttacctgttttaggaccctttcactttggggatgtgttgattttttttttttttttttttttttttttgagatagagtctcgctccatt

SEQ ID NO: 23504 - DNA, 201 bp, Homo sapiens
acagccacactaagccagccttaaatgaaaaacaaaccagcacttcctgtgccctcctgcttccttcatgaggggtccctccctctgtgtacactccattytcattgcccatggtggtttgtttccctcttgtttctcaagccatggcagcctgcctcttgccctctttactaaaaaggcctttgcagaggctgcctgtgt

SEQ ID NO: 23505 - DNA, 201 bp, Homo sapiens
aagcaggaatactggaagagagagaaagtggtcctttctatagtaataaagttgacattgattcaagttcatgcttggggaaaggacagggctactaacarttataatgctgggagcaatggaattttctcatgggtatgtggtaggtttaattttaattatcccagttaattcttagaactgctctgtgaagtatttccc

SEQ ID NO: 23506 - DNA, 201 bp, Homo sapiens
ccagtcagggtggcaggagctgctgccccttcctccctgagtcctggtcgtgggtggtggagatgtgccatgacgctcacggaggcatgctcaccccttcytctgtggcagaggggatggctgcacgacagctcttccctgtcctttccaaagcgtctgtggttccactttttggggcaaagcaggaatactggaagagag

SEQ ID NO: 23507 - DNA, 201 bp, Homo sapiens
cttcttaaataatacctggttcaggaactagtcagaatggcacccttgactttttgtttcctgcttttcctcttgttgggagaggagggtattcatcccamagtggtttgcctatttcacattccatctaggataagcagaatagccaagaaagatagctgtcctcctgtttacaacatttggggtaaccagcatccctct

SEQ ID NO: 23508 - DNA, 201 bp, Homo sapiens
gtgtgtgtatatataaatgtgtgtttctgtcttcttgtttcctttgactgcatttatttgaaagacactaggtggcagaattactgtatttgattggtttsaagataagagttgaaataattcatctcgtgtttttatataagtaaggtgtgtttagcatgtaaaattggtaatatgtattcacgtactgcttaaacaaag

SEQ ID NO: 23509 - DNA, 201 bp, Homo sapiens
gcccagtaagcctgctgggcaccttttggtttgcaggttcagcaggcagcccatggctttccctgtgtcgcattgaagcagctggctaaaattgatgatamattaaattcctgtgacagatgatcagcttgtatttgtgtaatggtgtacagttcacaaagcttaaaaaaatgctacctgccatttcatcctcagtgagga

SEQ ID NO: 23510 - DNA, 201 bp, Homo sapiens
cctagatgggtccctctccacctttgctagattctgagcattcactgagttagagctgcttctgcaaatgtgctgcttctgctaagtggctgtgacttcaygcagccttcacttggtttgtcatcagtggagatgccctgtgttgtcgaaggagataagcccagtaagcctgctgggcaccttttggtttgcaggttcagc

SEQ ID NO: 23511 - DNA, 201 bp, Homo sapiens
cacttctgagttgggtaaagaagtctgtatcagtgtaattttctaatccgtcctgcattatctatggctcttggttcatacctgtcttgaagttctgtcaygttctgtctcttgtcctcagtagagatgctacagcagtggctcgcctcaggcagggcagggcagtggggtggctgtcctgggggcaggcagtaggggcac

SEQ ID NO: 23512 - DNA, 201 bp, Homo sapiens
tcaactgaagatattgttctttctcgtattcaggagctctccttctctccgtatttaatctcctgtacagtaattaataggttaagagatggggacagtamttcaacgctagaagaacacagtgaagggaaacaaataaagaatttgccagaagaaacattttcaaggtatgctttctatctgagcctataactaacccat

SEQ ID NO: 23513 - DNA, 201 bp, Homo sapiens
gtttgcttggttcaccactgaacttaaaatgcttttaaatgagggaaggtgacgatgagatgattatgatgatttgcccttgagttacatagctggtgtayaggaagctgtcgtttcttttggcttacgtagaaatgtttgtggtgtctaattccacagatgcacattgactctcatgaagcccttggagtgttaaataca

SEQ ID NO: 23514 - DNA, 201 bp, Homo sapiens
aagtacatgtatcataaagaggtctgaaaatgagcaactggcaagcaggtggtggcaggcagagctgcttgggtgggtgggtgtcatggagaggagttcaycagccacatgttcagtgagctctggatatgtctgtttagaaatgatcactaataaacttgtgctcaaccatgtatacctctgggaagcaggtgctcttca

SEQ ID NO: 23515 - DNA, 201 bp, Homo sapiens
aaataaaaactttatttgtatatttatttaccactattttgacatagggctaaggtctttttctttgagctgatttctggttttgttttcttaaagtggcrtaagaattcaaagacattttgaggaaggctgagtgcagaaatctctctttttaaatgacttctcctttcttttaacttgcactgttgtctagccctcact

SEQ ID NO: 23516 - DNA, 201 bp, Homo sapiens
tgacctcaagtgatcctcctgccttggcctcccaaagtgctaggattacaggcgtgagccaccatgcccagcctggtgtttatctttaaagtgggcacagycacaggagttcacctgactcctggtctgagagtcacgagatcgttcaagatagtgaggccctcttttccaaaacgaggaccaaaaatcaattgacagtgt

SEQ ID NO: 23517 - DNA, 201 bp, Homo sapiens
atgtaatttccatgaaatgcctgataagggtacccttttgtccccacagccataccggctctgcagcccatagtccacgacctctttgtattaagaggaayaaataaagctgatgcaggaaaagagcttgaaacccaaaaagaggtggtggtgtcaatgttactgagactcatccagtaccatcaggtaagaggaatgtat

SEQ ID NO: 23518 - DNA, 201 bp, Homo sapiens
tggaaagttttatcattttcaaattgacttttgaatttgagtcaccttttttcagaagtggtgttaaattataggagccctaggttttttttctttttttrgaagtcatcacaaaatgatcagtgttcagaggaagagctttgaccttccacatggtataatgattgataaccttaattcatctcttaccataaaccaagt

SEQ ID NO: 23519 - DNA, 201 bp, Homo sapiens
agaccaaaataagacttgggggaaagtcccttatctatctaatgacagagtgagtttacttaaaaaagcataataatccagtggctttgactaaatgtatwatgtggaagtctttattgtcttttcagatgaatcaagtagattattcttgagaccaggaatgttgctgttttggttatttggaaagttttatcattttca

SEQ ID NO: 23520 - DNA, 201 bp, Homo sapiens
cacatcctaagacccttgcaaactcccagatgtgagaatggcactactacttagagtcttttcgactcagcgtgtgtgcagaagagcatcaaccgggctgygttgcgaggcagggccttggctgacctctcagtgtttacatagctaagccagttagtgtttgccacggcctcacaagggcttcagattcacacagccaaa

SEQ ID NO: 23521 - DNA, 201 bp, Homo sapiens
cacacctttcactgtcgtcttcggtgtcgtgatgtgcttggcagtgttcgttttcatatacccactttgaacgttgtcagtggcagccatgtgcttctcargctctgcatgtgtgtctgtgtatgtgaaggtactggttagagacgtttcaaaagagaagagagcatattctttactctcagcaatttgtaatcttctcag

SEQ ID NO: 23522 - DNA, 201 bp, Homo sapiens
gtgtgcttgctgtcaaggttgaatcatgaattattttatgttgcttatattgatatgtatcttaattttaaaagaaaggtctaaatggatgtttttgtttytagggaatcagaggcaatcattccaaacatctttttcttcttggtattactatcttatgaacgctatcattcaaaacagatcattggaattcctaaaatc

SEQ ID NO: 23523 - DNA, 201 bp, Homo sapiens
tatgcatttgtattctctgcagctttttcttgctagatgttgaggttttaatacttcttgctagtccattacaggtttataattattaaaagttaaaattmttttagtacctaaaatgcttaataaacattgtaattaggaaaatttagtgcagaaggaaagtgttcccagattccctggggtctggaaacatagtgttta

SEQ ID NO: 23524 - DNA, 201 bp, Homo sapiens
cacatttcaaagcatttaattgtgttgacagatggtggaatgaaatcttgtggtggagcactagtttttaaatcttcttagagaaagcagttttatataakgttgtctttagtaattattatgcatttgtattctctgcagctttttcttgctagatgttgaggttttaatacttcttgctagtccattacaggtttataa

SEQ ID NO: 23525 - DNA, 201 bp, Homo sapiens
gtctcttggaatttattatttgtttttccaatgagatttcacctcagggtatagtaaagttgttgaggggattcctggatgtgttctgcaattatctaggytgatttcagaatagagttatgcttatagtcaaatttatcagctgtcaagaattttatttaaaatttatgcagataagcaggaggaaaagaagcctggttt

SEQ ID NO: 23526 - DNA, 201 bp, Homo sapiens
gtttcatgtttgttctgattgcctttcatcaaccggtcccctttctcccagttcttaagattcagtacagtgacagttttatgaacaagaatagaacactrgaacagacaaaccattgaactctatgctgataaagatttattgagctcctgctgtatgtttgcattctgcccagaggctctgagaaaaccaggccatatg

SEQ ID NO: 23527 - DNA, 201 bp, Homo sapiens
tcaagattcgtcccagttaaatcactgcagatgaaactgccttttcatcgtcaaaatttaactgtcatttttgagccgtgatcttgggctactttcttatrtggggtaggaatatttgtgagttagaaatattacacttctctatttccttctagacgtaaatctgttaatcctgtcagcactgttactcacctgaaaggg

SEQ ID NO: 23528 - DNA, 201 bp, Homo sapiens
attaccttcctcctatagttgctgtgggcaccagattctggctagtcctgtcccttcatgatgcacattttcctcaagattcgtcccagttaaatcactgsagatgaaactgccttttcatcgtcaaaatttaactgtcatttttgagccgtgatcttgggctactttcttatgtggggtaggaatatttgtgagttagaa

SEQ ID NO: 23529 - DNA, 201 bp, Homo sapiens
tgtttggggaacatttttgcaaaatctagagttagtttaaacagattatcaattattaccataattgatcatctgcagtttcaagctatctaacaggttcrcttacctctttaaaaaggaatggaatttagcaggacagtaactgagacccgtgctcctggagtccatgtgggagctgtgtggctctgcacaagcatttgc

SEQ ID NO: 23530 - DNA, 201 bp, Homo sapiens
gatttccaaaggtttgtcccatccacttgcctcccctccaaaataagtttgaatttaaattgtgagatacaattaagatttattgtttggggaacattttygcaaaatctagagttagtttaaacagattatcaattattaccataattgatcatctgcagtttcaagctatctaacaggttcacttacctctttaaaaag

SEQ ID NO: 23531 - DNA, 201 bp, Homo sapiens
gcagaaaaaagctcagacttgagtagccttctgcgagtgaggagacttgatggctgtcaggcagctgtaaactctaaatagagtgtcattatctgaagagkgcgatgctgccacactgagtggcctttcaagttgtttctcaatctgacacgttctgatcgtgtgaatgtgaaattggtttgagcaggagtatatctgagt

SEQ ID NO: 23532 - DNA, 201 bp, Homo sapiens
agacgttcgggtatgacagcaaaacgctgctactccttaagaggcaggcgctgttggcataatcagctgggaggattgtggggtccagcgcagcacttttyggctcagtccatgattgagccaagaggccatccttcccttcactccccaggaggacgaggtctgtcactgtggagggcagaggacaccagaagctcctct

SEQ ID NO: 23533 - DNA, 201 bp, Homo sapiens
gcatcaccctctccaagtgcccaggctcctggccagatggcaggccaggtatcagtgggaacccaggtgggtgccatggctgaggtcagtgagacgcaagrgcacaggtgcgtcctagaggcttcctcgggcacctccagcgagctggagctctcgcctctgctgctgtctcatgtggcgcttagcacactctcccacgtg

SEQ ID NO: 23534 - DNA, 201 bp, Homo sapiens
gtgtgcctaggacaaggccgtggcggagcctgtcagccgcctgctggagagcacgctcaggagcagccacctgcccagcagggttggagccctgcacggcrtcctctatgtgctggagtgcgacctgctggacgacactgccaagcagctcatcccggtcatcagcgactatctcctctccaacctgaaagggatcgccca

SEQ ID NO: 23535 - DNA, 201 bp, Homo sapiens
actttggcgcttgacacacccaggagaaaagctcagtgcactttttaaatgaaaggaagttttccttttttttaaaaaaaaatttaatgttcattgttttyatctgttttattcctaggtcccgcaagcagaggaagcattagttttgtttttatttatgttctgtattccagaaagtagttaagagacctcacatgtagc

SEQ ID NO: 23536 - DNA, 201 bp, Homo sapiens
agctggggagcatgagctacaaactcggccaggtcagtctcgcgcccccgccgcctggcctctgtccgtttctgtcctcagactttggcgcttgacacacycaggagaaaagctcagtgcactttttaaatgaaaggaagttttccttttttttaaaaaaaaatttaatgttcattgtttttatctgttttattcctaggt

SEQ ID NO: 23537 - DNA, 201 bp, Homo sapiens
ctggtatggggtgggcctgcggccctgcccccctgtgcagatcaagactcagggtgctggtgttcacaggtgccctcatcagccacgagaagctgctgctrcagatcaaccccgagcgggagctggggagcatgagctacaaactcggccaggtcagtctcgcgcccccgccgcctggcctctgtccgtttctgtcctcag

SEQ ID NO: 23538 - DNA, 201 bp, Homo sapiens
gagctctgtgattccgtagctatttaggagtttaagcaccttgaaggctttaattgcagaaagttctatgtggacgtgcaatgtgttatacgcagtgtctrtgagactcaaatgtttattagggcgttgaagtaaactgagcacttggagggccatggatccagccttcaaggagctcataagtcaggaggacccaggagc

SEQ ID NO: 23539 - DNA, 201 bp, Homo sapiens
gcctgccctatcacaggcatcggagcttgtcacctggtttaaaagaagagagttgtgtggggatttgggatgcacgtttttcactcaaaagtattttagcrtagagctctgtgattccgtagctatttaggagtttaagcaccttgaaggctttaattgcagaaagttctatgtggacgtgcaatgtgttatacgcagtgt

SEQ ID NO: 23540 - DNA, 201 bp, Homo sapiens
cgttttccttcattgctagaattgaaaacaccgtccgtgtggcctgtgcaggagatgcagacccaaaggtggcctcctggtcagtgagaagctggaaacgygacaggaactgacgtggggttattgagcatttaggggaagacgttagcagagcaggaatgagcaggcaactagtagaacacccacttaagggctcacgga

SEQ ID NO: 23541 - DNA, 201 bp, Homo sapiens
cttcaaccaggccgttttccttcattgctagaattgaaaacaccgtccgtgtggcctgtgcaggagatgcagacccaaaggtggcctcctggtcagtgagragctggaaacgtgacaggaactgacgtggggttattgagcatttaggggaagacgttagcagagcaggaatgagcaggcaactagtagaacacccactta

SEQ ID NO: 23542 - DNA, 201 bp, Homo sapiens
tgctggggacagtgggttccccgctgaagcgtccagcagcttcaaccaggccgttttccttcattgctagaattgaaaacaccgtccgtgtggcctgtgcmggagatgcagacccaaaggtggcctcctggtcagtgagaagctggaaacgtgacaggaactgacgtggggttattgagcatttaggggaagacgttagca

SEQ ID NO: 23543 - DNA, 201 bp, Homo sapiens
tttgcttgagttcccacgtgtctctgggacatagcaggtgctggggacagtgggttccccgctgaagcgtccagcagcttcaaccaggccgttttccttcrttgctagaattgaaaacaccgtccgtgtggcctgtgcaggagatgcagacccaaaggtggcctcctggtcagtgagaagctggaaacgtgacaggaactg

SEQ ID NO: 23544 - DNA, 201 bp, Homo sapiens
aaagctctcgacaccaggtttgcttgagttcccacgtgtctctgggacatagcaggtgctggggacagtgggttccccgctgaagcgtccagcagcttcamccaggccgttttccttcattgctagaattgaaaacaccgtccgtgtggcctgtgcaggagatgcagacccaaaggtggcctcctggtcagtgagaagctg

SEQ ID NO: 23545 - DNA, 201 bp, Homo sapiens
ggcctgtaaaatgtatgagggaattcaaagataatttattaaaaagtaattcatgtttggagttttgtgcccaaaggagtccttgatttgaaaaatgggcktttgcccatcagattgtttcagggcccgtgtgtgcggaggccctgccttgtgccccgtgagctcagcctgacagaaatcctttggtagcacttaaggctc

SEQ ID NO: 23546 - DNA, 201 bp, Homo sapiens
tattcagaggagtgtaggttgaattaaaatgaaaaggcactttataaaggccatgagtagtacctggtttcatttttctaatgtcttgcagagattttatyaggcttcttgaagtgttcacgtacattacgctaacacgatattaataataactgtgctctggtacagcggagccagcagaatgggaagttgtggaatgca

SEQ ID NO: 23547 - DNA, 201 bp, Homo sapiens
ccattgtcggacatctaccgggaggaaatccagagcccccagtactgggatcttctcatttgactccagaaaagatttaagcatgataataatacaaacckatgtgaatacattttgcagtgttggcaaaactccttttatactgagaaaatagatcccagttcctgtgttttgtggcttgaatcccagctttgtgtattc

SEQ ID NO: 23548 - DNA, 201 bp, Homo sapiens
cacccaaaccgggaggggattttggcacagcattccctgagatccccgtggagttcctccaggaaaaggaagtctttaaggagttcatctaccgcatcaayacactaggtactcttggggcctctccttcaggtcaccattgtcggacatctaccgggaggaaatccagagcccccagtactgggatcttctcatttgact

SEQ ID NO: 23549 - DNA, 201 bp, Homo sapiens
gagaaggtgccagctctgggacagtgttggggtagtgaggagggagcccagtggagagaagtcgggcttcctgcttcctcacagtatgtctgtcctgactsaactcggatgatgtcacttccttttcatcttctcaggtgtggaagcttggatggtcacccaaaccgggaggggattttggcacagcattccctgagatcc

SEQ ID NO: 23550 - DNA, 201 bp, Homo sapiens
agattagctggtcattatcatagagccccctctgcctttgtgcagatgggctgtgggaatcctggggttccgttgggtcctttgtcacctcactgaaggcrtgtaagctgagctggccagaccgtgagctgatcctgccacttgaacagcatcaagcctgcctctggattcttctgtgcatggcacttgtctgagcacctc

SEQ ID NO: 23551 - DNA, 201 bp, Homo sapiens
aaccgatttaaagagagggctttcctgtggtgaggtaagagattagctggtcattatcatagagccccctctgcctttgtgcagatgggctgtgggaatcytggggttccgttgggtcctttgtcacctcactgaaggcatgtaagctgagctggccagaccgtgagctgatcctgccacttgaacagcatcaagcctgcc

SEQ ID NO: 23552 - DNA, 201 bp, Homo sapiens
cttatcacagagagtgggccagagggctgggaaccaaggccagagctcaggttcaggaccattccagcaatcccagcagaaaatggggagaattgtatggyataggcggatatgaaggtagaatctgcaggccttcagtggccaactcagagtctaagtggattccacagttacagcttgagcagctggttgtaggtcatg

SEQ ID NO: 23553 - DNA, 201 bp, Homo sapiens
agtaagtctcaggacccatttttttcttacatgttgttcctccaggacttaaaaatcattcacagagacgtgcaccgcggtgagtgtggactcctggaagygcaccgtagctccgctgtgtcctgctgctcctccctagctgtcagggaggctgtagtccattgctttgccagctcttttgtttccgagtgaacaccttat

SEQ ID NO: 23554 - DNA, 201 bp, Homo sapiens
accactaaccaagagattggtacctcagtctagtattgtctgtttgtctaaaattggttctaaggaatctaggctagtctgtctatccctttcaacttttktgaggctgcacaaatgtaaaatgttgaataaaaagcactgatggaagtgtgtagaaattcttctctttgttctgttgtaattttagttgcagtgcagcct

SEQ ID NO: 23555 - DNA, 201 bp, Homo sapiens
tgatgttttcatgtttcataattgttttcatctgtgcatttgtagccaacttgaaaacaaagatccagggattactacttaaaagccagacttcttggagkttatagtgatgattttgatagtatcttgagccgtctcataataacctcagggtgagagatggccaacaggagacagtcgagggacttagaaatctgaatg

SEQ ID NO: 23556 - DNA, 201 bp, Homo sapiens
cattgtaatattaacgtactgtaaaataaaagtggcttgttcttttcaaggaacagtatcctcaacaagggtcattagccacaatttttaaaaaattggaygtcatagtttacatgttagagggcgttttgaagctttgtatttttaaattaaatgttatagagtgatgttttcatgtttcataattgttttcatctgtgc

SEQ ID NO: 23557 - DNA, 201 bp, Homo sapiens
agtcttatatgatcataagattaataacattacattcagaagattatttgttttctgtcagagttaaaatgtttgtttttatactgcattgtaatattaasgtactgtaaaataaaagtggcttgttcttttcaaggaacagtatcctcaacaagggtcattagccacaatttttaaaaaattggacgtcatagtttacat

SEQ ID NO: 23558 - DNA, 201 bp, Homo sapiens
ccaggcagggctggactgctgctgcctggccctgcagctgcctggcctctggagcgtggtctcctccacagagtttgtgacccacgcctgctccctcatcyactgtgtgcacttcatcctggaggccggtgagtccccgtccatgaacggtgggttcctatcatagttcctgtctgcttcaccatgtttttattttgtgct

SEQ ID NO: 23559 - DNA, 201 bp, Homo sapiens
ttgaggtaagaggcagctcgggagctcagtgttgctgtggggagggggcatggggctgacactgaagagggtaaagcagttttatttgaaaagcaagatckctgaccagtccagtcacttttccatctcagcctggcagtaagtcttgtcaccgtcaagttattgtagccatccttcaccctcacctcgccactcctcatg

SEQ ID NO: 23560 - DNA, 201 bp, Homo sapiens
atggtttgggatgagaactatctggcctccactggaggaacaaacacaggatgttatcatctaagctccatggccaagacagaatggaagtcaaggttgcrtatttgccgtagacttcaacacagtgtcgtaatgcgtgacgtcaataacttgtttctagtgtcttggaagttgatctttagtcgtaaaagagacccttgg

SEQ ID NO: 23561 - DNA, 201 bp, Homo sapiens
tgaaatttctggaaaatattaatggagtacaaactgtgatacttaaaagtaaactagggcctgcatttgtatcatgacctgtttgagtattgatgagaagwtagctgtgaagaaaaaggtttaaacaagtgtattttcctttaagaagccactaatagtgcatctccttagagtgtatatttctagaatcctagtgtgcag

SEQ ID NO: 23562 - DNA, 201 bp, Homo sapiens
gagattaaaagattataaatatcttgtgccagatgaggtgattttattttgaaatgaccatgaattcctatcagttgtcttactgggatatttgatagtgraatttgtgcatttgagtcttagatgatctgttttacatttattaagaaagcctttattagcttttatactgtgtattgcctgttgcagtgtttgagtata

SEQ ID NO: 23563 - DNA, 201 bp, Homo sapiens
ccaggatataaaggatatagatttgtacgggaataaattcacaggacaagaaatcgatgtgccttataggtgggtttactgcagaagtgccataatagaaycttcctacttttaaaacaaccagatctcactttctaaagagtaaaggatgaccggcaggatcacgtctgtgacgtgagtggaggcagtttgcactcctgg

SEQ ID NO: 23564 - DNA, 201 bp, Homo sapiens
tcaacagaatccaggaataccttcagagcagcgggctcgctcagaggtaatgctggaaacacaggtcgtccttgtgttaggacaacccaggatataaaggrtatagatttgtacgggaataaattcacaggacaagaaatcgatgtgccttataggtgggtttactgcagaagtgccataatagaaccttcctacttttaa

SEQ ID NO: 23565 - DNA, 201 bp, Homo sapiens
gtaaaacatgaaagcagggaggttttcattctggcagttggcaactttcacggcagatggagaatttcaaaagcaattgctcaattatcaaacatagccartgtgagttctgaaataaaggtgctgattgaatgtgcagctttatggtggattttgctattcaggcaagcattttaattttctgcctgttaaattctgttt

SEQ ID NO: 23566 - DNA, 201 bp, Homo sapiens
tgctgagcattgtatggctaggctgtagtttgttttcacttcaccagttgggaaacagagaaaaggcactttttaaaaagtttaaatctgtagaattttgktttttaccagttctcttctaaatcctgagggattacaggaaaagttgttgtatttcagaatattcttagcttgatgtgacctctgtccccgttaaggccc

SEQ ID NO: 23567 - DNA, 201 bp, Homo sapiens
cacgtttcctgttcgttagttttcacattgacacataatttacaatacagtaaaatgtacttttctatcaactgtagtcagtaacagcccccctcccccamccacatcaagatatagaggagtgctgtcacttcaaacagttccctcttcctctgccacatcctgcccctccccaggtctaaccaccaatccgtgctctgt

SEQ ID NO: 23568 - DNA, 201 bp, Homo sapiens; identical to SEQ ID NO: 4242

SEQ ID NO: 23569 - DNA, 201 bp, Homo sapiens
ggcagggcgttggggaggtagacgggctcagccactcagggagtggtcaagcagaggctgaagggtcaggccaggttgcaggggcctgggggagccacgcrgggtaggcgctcccgggagcccgcctggcccatagctctacactcccgcgtggggccggacatgctgtgaagccctctccacgttggatgggggtggctg

SEQ ID NO: 23570 - DNA, 201 bp, Homo sapiens
gggcagcagagcaagatcctgactctaaaaaaaagtaaaataaagtaaaatgggggaaatgaactgctttagtaacatcatctgttttttctgtgagcagygtagcttgacagccattggtgaactcgtgccctgtgcttccctgtccagatccccattctgcccgcaacatggagtataacggtttattcatagtagtcg

SEQ ID NO: 23571 - DNA, 201 bp, Homo sapiens
gcagggaaggggatagggaaatgtcagggttaatcgagtgttaacttatttttatttttaaaaaaattgttaagggctttccagcaaaacccagaaagccygctagacaaattccaaaagagctgtagcactaagtgttgacatttttattttattttgttttgttttgttttttttgagacagttcttgctctatcagcc

SEQ ID NO: 23572 - DNA, 201 bp, Homo sapiens
tgttcttggggagaatttttgaaacaggaaaagagagaccattaaaacatctagcggaaccccaggactttccctggaagtctgtgtgtcgagtgtacagyaggagttaggaagtactctggtgcagttcaggcctttctcttacctctcagtattctatttccgatctggatgtgtcccagatggcatttggtaagaata

SEQ ID NO: 23573 - DNA, 201 bp, Homo sapiens
caccacgccccgtcccctctccgttgagccccgcgccttcgcccgggtggggcgctgcgctgtcagcggccttgctgtgtgaggcagaacctgcgggggcrggggcgggctggttccctggccagccattggcagagtccgcaggctagggctgtcaatcatgctggccggcgtggccccgcctccgccggcgcggccccg

SEQ ID NO: 23574 - DNA, 201 bp, Homo sapiens
tacctgttcaaaacccctacatcccgggtctgtccctgcacgtgctctgtggcctggctgcatcttccttgaaggcagtgcatgcctcttcactcaggggkcccatgcaggaacagagggccccacagaaggatgaggccagtgcagaatgggctggaggggacaatgctgaccaggaagcaagtgtagagaaatcccagg

SEQ ID NO: 23575 - DNA, 201 bp, Homo sapiens
ggtgagggggcaaggatatggctataggaacatggggcagattaagaaagggatatacacacaccacttagcatttgttacaactgttgtgggagggatggagtgcagaaaaagaaaaaaaaaagtgcacaccatcccatgtatgtgtatacaaagggacgcttggaagactggtccccaaaatgttggtaatgattgtgt

SEQ ID NO: 23576 - DNA, 201 bp, Homo sapiens
tcattcttattcctgagttgagaatagccttgagggggaggtgagggcagagcagggccacccatgtgagacccggcactggagtggaatggcccaagtcrgcatcccttggcagcatgaaagcaaaaccagcaaggtttgctggtggcttagatgtggcatgtgagagagagcagggctttgggggtgatttcagggtga

SEQ ID NO: 23577 - DNA, 201 bp, Homo sapiens
gaagacaagtggaagcgactgtctcgacagatagctgacatcatcctcccaatgttagccaaacagcaggtttgtccccgcagccttggcttgttgttgcrtagtgatggtagcttaaggtccttgtgaaaggtgggtggctggaatcagctcttccttcagtcctaatctgtgccttgatagcagttctccgtgctagtc

SEQ ID NO: 23578 - DNA, 201 bp, Homo sapiens
taagacaattctaggactgatttgtggtaaatcacacattgctgtatcatagttgtgttcactgaacatattcaggggctctacagatgcagggctcttarctgctttgcacacttctgaattcctgccctgcgaacaggactggatacctaatagacaacaggtacttgataacagtttattgaattaatgagtgaatga

SEQ ID NO: 23579 - DNA, 201 bp, Homo sapiens
tgtggcttcatagtatttttaaagtttggaaaattttaggccattctttctttctttctttcttttttttttttttgagacagtgtctcgctctgtcgccygcgttggagtgcagtgacactatcttggctcactgcaagctctgcctcctgggttcacgccattctcctgcctcagcctcctgagtagctgggactacag

SEQ ID NO: 23580 - DNA, 201 bp, Homo sapiens
tctctacaaaaagaaaaacaaaaatagttggccgcagtggcatgcgtctgtggtcccagctactcggggctgaggtgggaggattgcttgagccttgggasgttgaggctgcaaagagccatgatcatgccattgcactccagcatgggtgacagactttatactgtctgttttgggtgatttgataatgatatgccctga

SEQ ID NO: 23581 - DNA, 201 bp, Homo sapiens
ttcagacttctgtgagtttacctagttccaggatttaaaggcacagagactttagaattaaaatagaatcattttctttttctaaatagcaacactaggaataaaaaataataattccacattcttgacaggtaatgttttttcttgtcttctaatccttatttattccatactcatttttatacataattgaaatgtatt

SEQ ID NO: 23582 - DNA, 201 bp, Homo sapiens
gcccgtggggaggcccttctcgcctgtcatccttgctgggcagtgggtgctgtgctagcaggacaggcggacggctggcaactgtctctgcatccctggakcctggcatagggccaagtcacacggggcacaggcctgcaaatcaggcacatatgttggtgcagtgacgtgattttggggggcagccccagaacaggcccc

SEQ ID NO: 23583 - DNA, 201 bp, Homo sapiens
ggggcgatgtcccgaggacaccaggcttgagcttccagaatcctctcccagcggggtcgtgcaggacgcacttaactccccgcacagtgagccgtgacagygcgtgtgcagtgtcgtcgccaggaaagcacactagagactcggtgccagggtttttactgggggctgggcacatgggcaccctctgcctgcctcgtgccc

SEQ ID NO: 23584 - DNA, 201 bp, Homo sapiens
acgtgcgtgacccaagactgtgccgcagtccttgccttgtctgtgctcattttctttgttcatttttttccctgtaacgtaaattgttatatttgtctgtrtctgtgtctgaatcagtcctgcacgctctccttctctctgtctcttgttctttctttaccccgtttatcacggggaccccgatgtccattgctctagttc

SEQ ID NO: 23585 - DNA, 201 bp, Homo sapiens
gccataaaattgctgtatccagttgcagaaattcctgctgcttactcttgaccctctctcggtttgtgtgcatctcctctcaggctggctcccagatgggrgctggctccaggcgacactgggtgctctgctccaggaggtccttatgtgggtcctgccctagcctagcccctctcttatggactctgtcactgtgggttt

SEQ ID NO: 23586 - DNA, 201 bp, Homo sapiens
attcagccctctgagggcaaactacagctttttgtaaatgtaggtaaattctgtgactgtttcgtgaccccctctgatccagttttcctttataaccttckgtattgttccttctattatcctgaaataacattaatagattaggctgggcgtggtggctcatgcctataatcccagcaccttgggaagccaaggcgggca

SEQ ID NO: 23587 - DNA, 201 bp, Homo sapiens
ccacacgcaccatagacaccacacacacatgccacatgcacacacatacacggcatgcaccatacacacaacacacacagcacacatgccacacacacacrccacaccacatgcaccacacacatgccacatgcacacacactccacatgcatgcaccacacacacacacacacaccacacacaccacatgcaccacacca

SEQ ID NO: 23588 - DNA, 201 bp, Homo sapiens
gttataaagtgacaaatccccaagacccacagggctctgcacaacctgggccctcctgccagtggcggcgagggcaggtggctcacggctgggtgcctgtytgggcaggagctgggctggtatggggtgggcctgcggccctgcccccctgtgcagatcaagactcagggtgctggtgttcacaggtgccctcatcagcca

SEQ ID NO: 23589 - DNA, 201 bp, Homo sapiens
tggatcctgccgtccagctcagccaggaggaccccggccatcctgatcagtgaggtggtcagatccgtaagtgagccttcccattcccctcacacctgcaygtgccacacgcaccacacacgccacacaccccccacacacacaccgcccacacacatgccacttgcacacacacccctcatgcatgcaacacacacacag

SEQ ID NO: 23590 - DNA, 201 bp, Homo sapiens
ccggccatcctgatcagtgaggtggtcagatccgtaagtgagccttcccattcccctcacacctgcacgtgccacacgcaccacacacgccacacaccccmcacacacacaccgcccacacacatgccacttgcacacacacccctcatgcatgcaacacacacacaggccacacgcaccatagacaccacacacacatgc

SEQ ID NO: 23591 - DNA, 201 bp, Homo sapiens
cctggcctctgtccgtttctgtcctcagactttggcgcttgacacacccaggagaaaagctcagtgcactttttaaatgaaaggaagttttcctttttttwaaaaaaaaatttaatgttcattgtttttatctgttttattcctaggtcccgcaagcagaggaagcattagttttgtttttatttatgttctgtattccag

SEQ ID NO: 23592 - DNA, 201 bp, Homo sapiens
ggggtgtctgaacgacccttgctaaggggcagactgttagacggtaggcatgtgctgagtcccagtggccacacccacccaccaggagcctggcactgtgkccgcagcactgagcagtgccccgtttctgtggcaggtgtccatacactccgtgtggctggggaacagcatcacacccctgagggaggaggaatgggacga

SEQ ID NO: 23593 - DNA, 201 bp, Homo sapiens
cgtcaccacccacgtctccagtcaactccaggttttccaatggcctttttctttttaacagaaatttgaaatttcttatcagtcatttgatttgtttgagrtgcttcttgaaatgagcctctcatctcatgtacttggaaaatacccatctcgcatattccacaggaaacaccgggctggagttgacatccactcctgttc

SEQ ID NO: 23594 - DNA, 201 bp, Homo sapiens
cttatttgtcatagagaaaaagtgacagagtccagcttgcccactggccctgccagcttaactggttataaagtgacaaatccccaagacccacagggctytgcacaacctgggccctcctgccagtggcggcgagggcaggtggctcacggctgggtgcctgtctgggcaggagctgggctggtatggggtgggcctgcg

SEQ ID NO: 23595 - DNA, 201 bp, Homo sapiens
cctgtgcaggagatgcagacccaaaggtggcctcctggtcagtgagaagctggaaacgtgacaggaactgacgtggggttattgagcatttaggggaagaygttagcagagcaggaatgagcaggcaactagtagaacacccacttaagggctcacggacaggtgctcacttaggaagtgagtttcatttggtattacacc

SEQ ID NO: 23596 - DNA, 201 bp, Homo sapiens
caagcaatggtttcaaagagagagaatattgccacccatcatttatatcaggcatgggatcctgtcccttctctgtctccggctactacaggtacctgagrgaaagggtgcgggggagcggttgtacttgggctagaatgagagaagactggcatgctcaccacaccagtgatgcgggaagacctgagtgtggtctgagtt

SEQ ID NO: 23597 - DNA, 201 bp, Homo sapiens
gtcggacatctaccgggaggaaatccagagcccccagtactgggatcttctcatttgactccagaaaagatttaagcatgataataatacaaacctatgtkaatacattttgcagtgttggcaaaactccttttatactgagaaaatagatcccagttcctgtgttttgtggcttgaatcccagctttgtgtattccgggc

SEQ ID NO: 23598 - DNA, 201 bp, Homo sapiens
cagcgaggaggaggaggaagtagatccaaacacacagagtaagtctcaggacccatttttttcttacatgttgttcctccaggacttaaaaatcattcacrgagacgtgcaccgcggtgagtgtggactcctggaagcgcaccgtagctccgctgtgtcctgctgctcctccctagctgtcagggaggctgtagtccattg

SEQ ID NO: 23599 - DNA, 201 bp, Homo sapiens
ggcacctggacgcgctgcccctcagtgctttggacggttccacaactgtgattcacacggcttccccaaacgaaggtacacgagtgggcattctgtgactyggtacttccctttaggccctgtcctggcatttgatccatgagcagatcccgctgagtctggatctccaggcagggctggactgctgctgcctggccctgc

SEQ ID NO: 23600 - DNA, 201 bp, Homo sapiens
ccaaactgcccagtcatttgcaccttcctcctgagaaagagaaggacattgtgaaattcgtggtggcaacccttgaggtaagaggcagctcgggagctcartgttgctgtggggagggggcatggggctgacactgaagagggtaaagcagttttatttgaaaagcaagatctctgaccagtccagtcacttttccatctc

SEQ ID NO: 23601 - DNA, 201 bp, Homo sapiens
cagtacctggtggtggtctccaaactgcccagtcatttgcaccttcctcctgagaaagagaaggacattgtgaaattcgtggtggcaacccttgaggtaaraggcagctcgggagctcagtgttgctgtggggagggggcatggggctgacactgaagagggtaaagcagttttatttgaaaagcaagatctctgaccagt

SEQ ID NO: 23602 - DNA, 201 bp, Homo sapiens
ccactgaggaacaatgtcttgagctttcatcagattctcagagaattgcttgactgcctttcgaagttgatgcatctgtgctcacgtttgcacccacccaygaggtccttctgtttcaggggatgctgcactgtatcagtccctgcccactctggcccgggccctggcacagtacctggtggtggtctccaaactgcccag

SEQ ID NO: 23603 - DNA, 201 bp, Homo sapiens
ttgaatgatctgtttggtaattaaaattaaaatttatcttatttttaaaaagcattccagggccagtatagtactttgcaccaagtaaatgtacaataaargcagtggatctaatacattgaaagcgtttacagaggtagctaaagagcagcacgggtgtcctcggctcagaatttcttcctgtgtgtttgccactttgcc

SEQ ID NO: 23604 - DNA, 201 bp, Homo sapiens
cctgccggccggcagccctctcagcctagtgcggtgttcccaagcactggcctaggcctgtagctccagggatgtgaagtccccttgaacgccgcccatcwtgttccccttatccatttttttcttcccaggactggtacgttcatcttgtcaaatcccagtgttggaccaggtcagattctgcactgctggaaggtgcag

SEQ ID NO: 23605 - DNA, 201 bp, Homo sapiens
agggtgcccaggcaggtaacagaagtccaaaggggaaaacctgtggtgtggtgagccgtatagccacagcctgccggccggcagccctctcagcctagtgyggtgttcccaagcactggcctaggcctgtagctccagggatgtgaagtccccttgaacgccgcccatcatgttccccttatccatttttttcttcccagg

SEQ ID NO: 23606 - DNA, 201 bp, Homo sapiens
atggcaatatttaaaacaacttgtctgttttagaactagaattaaacataatcatcttcagtattttgcaaataagctcactgccatccagaaacattgtyaatgcatctgttgctccttctagaagacacagtctgtccagcacaaagttacttagtccccagatgtctggagaagaggaggattctgacttggcagcca

SEQ ID NO: 23607 - DNA, 201 bp, Homo sapiens
attttctaaatgccaggtgttctgaatacgtaagtatgggagacgactcagcctgtttcatttttatgtaaaatcttcgcgtagccatgtggcactggacygagatgaaagcaaagacatttctccttaactttgtttctaggaatgttccggagaatcacagcagctgccactaggctgttccgcagtgatggctgtggc

SEQ ID NO: 23608 - DNA, 201 bp, Homo sapiens
tagaaaaatcagaattttctaaatgccaggtgttctgaatacgtaagtatgggagacgactcagcctgtttcatttttatgtaaaatcttcgcgtagccaygtggcactggaccgagatgaaagcaaagacatttctccttaactttgtttctaggaatgttccggagaatcacagcagctgccactaggctgttccgcag

SEQ ID NO: 23609 - DNA, 201 bp, Homo sapiens
ttatatttaccatatatcttttcatgtatacttggcgtaagtgctttatagtagtcacctaattcactgtcatcttttttgtttcttggaaggtttctatwacaactggttggtattcttttagaagacattgttacaaaacagctgaaggtggaaatgagtgagcagcaacatactttctattgccaggaactaggcaca

SEQ ID NO: 23610 - DNA, 201 bp, Homo sapiens
cacatcttcaagtctggtaggtgaatcacattagtcttcctggagtgtctcgttccccattctgcactatacactctcagagtgtaggagctgtgctgccyggtagaaactctgccttgcccagtgtgccagttgaaaatatttgttgctgtaagagtacacctgataccatgtgacccagcagttccactcttgggtata

SEQ ID NO: 23611 - DNA, 201 bp, Homo sapiens
atcttccttttttcttcagctgtgacttatgtattatgtttattttaggcgtccgtgagcactgttcaactgtggatatcgggaattctggccattttgarggttctgatttcccagtcaactgaagatattgttctttctcgtattcaggagctctccttctctccgtatttaatctcctgtacagtaattaataggtta

SEQ ID NO: 23612 - DNA, 201 bp, Homo sapiens
atctgtttggatcctagagtcttccagctgaactgggacaagtataacagacggacacgtaggggtggaaaggcgtctcttggcagcagactttctaattstgcacgctcttataggtgttggagatgttcattcttgtcctgcagcagtgccacaaggagaatgaagacaagtggaagcgactgtctcgacagatagctg

SEQ ID NO: 23613 - DNA, 201 bp, Homo sapiens
tcatagagtgggggttgcattagtgtccccctgtcctcgctgggatcacatctgtttggatcctagagtcttccagctgaactgggacaagtataacagayggacacgtaggggtggaaaggcgtctcttggcagcagactttctaattgtgcacgctcttataggtgttggagatgttcattcttgtcctgcagcagtgc

SEQ ID NO: 23614 - DNA, 201 bp, Homo sapiens
aagagctttgaccttccacatggtataatgattgataaccttaattcatctcttaccataaaccaagtatgtgtaagggttttctttatttcttgaaagcrttttgtagatgttgagagcagttttccaaatgtaatttccatgaaatgcctgataagggtacccttttgtccccacagccataccggctctgcagcccat

SEQ ID NO: 23615 - DNA, 201 bp, Homo sapiens
tgggccagttcaggtaatagcattttattattttagatttttttcttcttcttgtgtacttacatgtaatttaggttattaagtgaatgtttaaactactrttaggcatttttgctgttttctttaaatggaaatctgactaacatactgtgcatttttgcttctcttaaaaattaatgtatatctcaagacttgtttgga

SEQ ID NO: 23616 - DNA, 201 bp, Homo sapiens
gaaccgtgcagataaggtaaatggtgccgtttgtggcatgtgaactcaggcgtgtcagtgctagagaggaaactggagctgagactttccaggtattttgsttgaagcttttagttgaaggcttacttatggattctttctttctttttttcttttttatagaatgctattcataatcacattcgtttgtttgaacctctt

SEQ ID NO: 23617 - DNA, 201 bp, Homo sapiens
aatttcacgctgtgagtctttgctaacatatccagttatttacagatggatttgatatttgtgtgggagattcttaaaagtgttgttcacgccacattgtygatgcctcatttttttcactgtagttgttgaagactctctttggcacaaacttggcctcccagtttgatggcttatcttccaaccccagcaagtcacaag

SEQ ID NO: 23618 - DNA, 201 bp, Homo sapiens
tttgtgtctttggttgtacattatgagatcgtgacagggccagtaaccgtgtgttctctccttcaccttcccaaggtcacgctggatcttcagaacagcayggaaaagtttggagggtttctccgctcagccttggatgttctttctcagatactagagctggccacactgcaggacattgggaaggtttgtgtcttgttt

SEQ ID NO: 23619 - DNA, 201 bp, Homo sapiens
atgttctttctcagatactagagctggccacactgcaggacattgggaaggtttgtgtcttgttttttctccttgggttgtggctggcacacttgatgtgygtcttctgggctgagttcatctaggatggagcctggttctccagggtgcctccgggagactcctccctgccccacgtgcttgcgtcacaggacccaagtc

SEQ ID NO: 23620 - DNA, 201 bp, Homo sapiens
gttgtgggccagtccctaccatgtatcattgtgtgggtaaaagtaaataaaatgtgtacagtgtctgaactgtacatatcagggtccaagaacaaaatgartgacatgggttagctctttttaataaatggtaaaaccaaatattctaattttcagttttgttatacttccatcacatgtttttgtttttttgttttttgt

SEQ ID NO: 23621 - DNA, 201 bp, Homo sapiens
acaagcatctgtaccgttgagtcccaagaaaggcagtgaggccagtgcaggtaggaaacagcgtggggaagggagggacatgagtgcagcatctgtcatgyagaaacataggatttaagtaacttggtgttttagagaaataaatataatacacatcagtaaagtgagagaaagtttctccaggtgcggttcaagatatta

SEQ ID NO: 23622 - DNA, 201 bp, Homo sapiens
tgttgtttgcttaaaaattgtctataatttgactttgcaaatgtctgcttccagagtgcctccactgagtgcctcagatgagtctaggaagagctgtaccrttgggatggccacaatgattctgaccctgctctcgtcagcttggttcccattggatctctcagcccatcaagatgctttgattttggccggaaacttgct

SEQ ID NO: 23623 - DNA, 201 bp, Homo sapiens
caacagtatgacataaacatagttattaggatgccctttttctttctttttaagtcttttatcaatttggctttttggaaaaatatctgatggaatacttrtttctgctatattagctgtgtgagactagtgacaggagctgtgggaaatgaatgccaaatgttcttaggcattgatgggaatttcagggtgtggtcttca

SEQ ID NO: 23624 - DNA, 201 bp, Homo sapiens
tctatttatttaaagccattggccttttttgttgttttgagtaagtgctgcccaaggtccttccagggcacctggatgagcctgctctggagcaagctggyggtaagtgtttactgagtaactaaatgatttcattgttaaatgtgctcttttgttaggctggtgagctttttggaggcaaaagcagaaaacttacacaga

SEQ ID NO: 23625 - DNA, 201 bp, Homo sapiens
ccattgtgtccgccttttatctgcttcgtttttgctaacagggggaaaaaatggtgagtacaaaaggggatgtgcacagttgaaggaaataactaggtttyagaggtcagcttggtggcctgtttttgccttgcgtgcagcagaggaagtagaatctgaggatgagtttggttttcactagccgaggggagggaggaaatg

SEQ ID NO: 23626 - DNA, 201 bp, Homo sapiens
ccttgccgcatcaaaggtgacattggacagtccactgatgatgactctgcacctcttgtccattgtgtccgccttttatctgcttcgtttttgctaacagrgggaaaaaatggtgagtacaaaaggggatgtgcacagttgaaggaaataactaggtttcagaggtcagcttggtggcctgtttttgccttgcgtgcagca

SEQ ID NO: 23627 - DNA, 201 bp, Homo sapiens
tgaggaagccacaggtattcttcctgatgaagcctcggaggccttcaggaactcttccatgggtatgtggactacaggtgatgcgctacaaagtggtttgyattcagacctggacatcttaattatatctttgcttccaagaagaagtcctttgatactgttttctgagttctgaatagctgatgaaaatgaccaattgag

SEQ ID NO: 23628 - DNA, 201 bp, Homo sapiens
gctgtcctgcatttcagcatcttcaggatgctgtgcagctgaaacatttgataacggtggaactgttcgttattttgcaagcctgtgattccctattgaaygttttctctcgccatttgacaaatgagtgtttctctgtcttcagcctcagtgaaggatgagatcagtggagagctggctgcttcttcaggggtttccact

SEQ ID NO: 23629 - DNA, 201 bp, Homo sapiens
aactttttccatataggtttattgactttaatagcattctaaacataacatctctacattctttgtgtttaatactgtggaggtataaaaatacttatatrtgatgataaactatattagagtaaattaaatattcttatgagtttcattttagagtgcatttacttaattttgaagtccttatttttagcaaactaaaag

SEQ ID NO: 23630 - DNA, 201 bp, Homo sapiens
ctgcgatgttaagtgtttcctgtggaaaaacgttcacattttctctagttttaaagttgaatcaagctgtttgaagattttcacatttcttctagattttrtcagcttgttactttatctgtcactttctgtgatttgcagctggagggggttcctcatgcagccctgtcctttcaagaaaacaaaaaggtgattatttca

SEQ ID NO: 23631 - DNA, 201 bp, Homo sapiens
tgttcgcagtttttgcttgagttgtacagccgctggatcctgccgtccagctcagccaggaggaccccggccatcctgatcagtgaggtggtcagatccgwaagtgagccttcccattcccctcacacctgcacgtgccacacgcaccacacacgccacacaccccccacacacacaccgcccacacacatgccacttgca

SEQ ID NO: 23632 - DNA, 201 bp, Homo sapiens
tgcttcttgaaatgagcctctcatctcatgtacttggaaaatacccatctcgcatattccacaggaaacaccgggctggagttgacatccactcctgttcrcagtttttgcttgagttgtacagccgctggatcctgccgtccagctcagccaggaggaccccggccatcctgatcagtgaggtggtcagatccgtaagtg

SEQ ID NO: 23633 - DNA, 201 bp, Homo sapiens; identical to SEQ ID NO: 4245

SEQ ID NO: 23634 - DNA, 201 bp, Homo sapiens; identical to SEQ ID NO: 4244

SEQ ID NO: 23635 - DNA, 201 bp, Homo sapiens; identical to SEQ ID NO: 4243

SEQ ID NO: 23636 - DNA, 201 bp, Homo sapiens
ccagccctgatttcacatcggcattttccccagtattagagccaaggccctccgcgggcaggtggggcagctgtgggagctggtgccagtctctgacctgygtccctcctcccaggatcaggaaaggctttccttgtgaagccagagtggtggccaggatcctgccccagtttctagacgacttcttcccaccccaggaca

SEQ ID NO: 23637 - DNA, 201 bp, Homo sapiens
cttcaatgtttgcgttgtgtccagcgtccgcaaaccaactgtcatgggatcatactggggctgaagtacggtcccacccctgccctgtctggggctgaagkacagtgccacccctgccctgtctggggctgaaggacagtgccacccctgccctgtctggggctgaagtacagtgccacccctgccctgtctggggctgaa

SEQ ID NO: 23638 - DNA, 201 bp, Homo sapiens
gggctctgcacaacctgggccctcctgccagtggcggcgagggcaggtggctcacggctgggtgcctgtctgggcaggagctgggctggtatggggtgggyctgcggccctgcccccctgtgcagatcaagactcagggtgctggtgttcacaggtgccctcatcagccacgagaagctgctgctacagatcaaccccgag

SEQ ID NO: 23639 - DNA, 201 bp, Homo sapiens
cctgtgagatggtggcagaaatggtggagtctctgcagtcggtgttggccttgggtcataaaaggaatagcggcgtgccggcgtttctcacgccattgctmaggaacatcatcatcagcctggcccgcctgccccttgtcaacagctacacacgtgtgcccccactggtgagtctgctcgttccttgcagaagaccaagta

SEQ ID NO: 23640 - DNA, 201 bp, Homo sapiens
aagtgtattttcctttaagaagccactaatagtgcatctccttagagtgtatatttctagaatcctagtgtgcagagtttagactaagactaaaaaaaaamaaaaacaaattatactgtaatttcatttttatttgtattttagacaccaaaggctctattccctgctggacaggtttcgtctctccaccatgcaagactc

SEQ ID NO: 23641 - DNA, 201 bp, Homo sapiens
taggctgttccgcagtgatggctgtggcggcagtttctacaccctggacagcttgaacttgcgggctcgttccatgatcaccacccacccggccctggtgytgctctggtgtcagatactgctgcttgtcaaccacaccgactaccgctggtgggcagaagtgcagcagaccccgaagtaggttcataatgccccacagcc

SEQ ID NO: 23642 - DNA, 201 bp, Homo sapiens
atacaaatattagctgggcgtggtggcaggcgcctgtaatcctagctacttgggaggctgaggcaggagaacagcttgaaaccggaaggtggagtttgcartgagccaagattgcgccactgcactccaacctgggcaacaagagcaaaactctatctcaaaaaaaaaaaaaaaagtaggatatctgtttctgcttagaaa

SEQ ID NO: 23643 - DNA, 201 bp, Homo sapiens
gtctcgctccattgcccaggctagagtgcagtggcacgatcttggccactgctgcccctgcctcctgggttcaagcaattcttgtgctcccgcctcccaartacctgggattacaggcacccgccaccacactcggccaatttttgtatttttagtggagacagggttttaccatgttggtcaggctggtctcgaactcct

SEQ ID NO: 23644 - DNA, 201 bp, Homo sapiens
gaaggccatagaagcatcttggatatattaccttgtgttttgtcagctttatgactagaagtctcttttcacttaaatttgttttttttttttttgagacrgagtcttgctctgtcgcccaggctggagtgcagtggtgcaatctcagctcactgcaagctctgcatcctgggttcatgccattctcctgcctcagcctcc

SEQ ID NO: 23645 - DNA, 201 bp, Homo sapiens
aacctctgcctccctggttcaagcgattctcctgcctcagcctctcaagtagctgggattacaggtgtgcgccaccacgcctggctaattttgtatttttrgtagagatggggtttcactatattggtcaggctggtcttgaactcctgacctcaagtgatgcacctgcctcgatctcccaaaatgctgggattacaggcg

SEQ ID NO: 23646 - DNA, 201 bp, Homo sapiens
tcttgtgtttcttgtgcctgggtttattgaggttgggtctgtggcttcatagtatttttaaagtttggaaaattttaggccattctttctttctttctttyttttttttttttttgagacagtgtctcgctctgtcgcctgcgttggagtgcagtgacactatcttggctcactgcaagctctgcctcctgggttcacgcc

SEQ ID NO: 23647 - DNA, 201 bp, Homo sapiens
tatgtgtgaatttgatcctgtcattatgatcctagttggttattttgcccgttaactgatgcagtttcttcatagcgtcagtagtctttacaatttggcatgtttttgcagtggctggtactggttgttcctttccatgtttagtgcttccttcaggagctcttgtaaggcaggcctggtggtgacaaaatctctgcattt

SEQ ID NO: 23648 - DNA, 201 bp, Homo sapiens
ctgtagatgtctattaggtccgcttggtccagtgctgagttcaagtcctggatatccttgttaattttctggctcattgatctgcctaatattgacagtgrggtgttaaagtctcccactattaccgggtgggagtctctttgtaggtctctaagaacttgcttcatgaatctgggtgctcctgtattgggggcgtgtata

SEQ ID NO: 23649 - DNA, 201 bp, Homo sapiens
atttaagctctgccacaatcactcagctgtgacactgtaaatctcttaatagtttattacattccatgtgctgacagttgtatttttgtttgtgacacttacgtattatctgttaaaacattttcactttagttgtgttacctttaaagaggattgtattctatcatgcctgttgattttttggtgagcgggctattaaag

SEQ ID NO: 23650 - DNA, 201 bp, Homo sapiens
tatttaagctctgccacaatcactcagctgtgacactgtaaatctcttaatagtttattacattccatgtgctgacagttgtatttttgtttgtgacacttacgtattatctgttaaaacattttcactttagttgtgttacctttaaagaggattgtattctatcatgcctgttgattttttggtgagcgggctattaaa

SEQ ID NO: 23651 - DNA, 201 bp, Homo sapiens
gtatttaagctctgccacaatcactcagctgtgacactgtaaatctcttaatagtttattacattccatgtgctgacagttgtatttttgtttgtgacacttacgtattatctgttaaaacattttcactttagttgtgttacctttaaagaggattgtattctatcatgcctgttgattttttggtgagcgggctattaa

SEQ ID NO: 23652 - DNA, 201 bp, Homo sapiens
taaaaaaacaacaaaatactaactgtccattgtaaaaagtaatgcactttcattgtaaaaattttggactatagagaatagtactaagaagaaaaaaaaaatcaccttcaattctgctgccacctggaggtaatcactgttaatattttgctatatactctatgagtttcttgttcaaaatcaggtcaaaattacatgcaa

SEQ ID NO: 23653 - DNA, 201 bp, Homo sapiens
ttcattttctaagagtagttttggctggagaagttttctttcagtactttcttttagaagggaaattttcctttataatttagggtttgttttttttttttccaagccaccttttatagagcccttgtgggttatttcatttaatccttagaatgtttataaatctgggcttgttctcggctccacccacagatagggacg

SEQ ID NO: 23654 - DNA, 201 bp, Homo sapiens
agacagagtcttgctttcacccatgctagagtacagtggcatgaccttggctcactgcaacctccgcctcccgggttcaaccgaactttgggctggtctcraactcctgacctcaggtgatccgcccgcctcggcctcccaaagtgttgggattacaggcgtgagccactgtgccgggcctgattgtacattttaaaataa

SEQ ID NO: 23655 - DNA, 201 bp, Homo sapiens
ttcccggacggggcggctgctgggcggaggggctcctcacttctcagacggggcggctggtcagagacgctcctcacctcccagacggggtggcagtgggscagagacattcttaagttcccagacggagtcacggccgggcagaggtgctcttcacatctcagacggggcggcggggcagaggtgctccccacttcccag

SEQ ID NO: 23656 - DNA, 201 bp, Homo sapiens
ctcctcacttcccggacggggcggctgctgggcggaggggctcctcacttctcagacggggcggctggtcagagacgctcctcacctcccagacggggtgkcagtggggcagagacattcttaagttcccagacggagtcacggccgggcagaggtgctcttcacatctcagacggggcggcggggcagaggtgctcccca

SEQ ID NO: 23657 - DNA, 201 bp, Homo sapiens
cctcccggacggagcggctgccgggcggaggggctcctcacttcccggacggggcggctgctgggcggaggggctcctcacttctcagacggggcggctgktcagagacgctcctcacctcccagacggggtggcagtggggcagagacattcttaagttcccagacggagtcacggccgggcagaggtgctcttcacatc

SEQ ID NO: 23658 - DNA, 201 bp, Homo sapiens
agtgaggccagtcatggtggctcatacctataatcccagtgctttgggaggccaagatgggaagatcgcttgaggccaggagtttgagcaattgggcaacrtcgtgaggccccgtctctacaaaatattttgaaaaaattagccaggcccagtggtgcgtgcctgtggtccgcgccactcaggaggctgagacgggaggat

SEQ ID NO: 23659 - DNA, 201 bp, Homo sapiens
cactacactacaacctgggcaagagagtgagaccctgtctctaaatataacacacacacacacacacacacacacacacacacacacacacacacacacacacatatatatgtatatatatgcatttagatgaaaagatcactttgacaataccacatgctggtgaggatttagaaaaactaggtcacttattgctggtgg

SEQ ID NO: 23660 - DNA, 201 bp, Homo sapiens
ccactacactacaacctgggcaagagagtgagaccctgtctctaaatataacacacacacacacacacacacacacacacacacacacacacacacacacacacatatatatgtatatatatgcatttagatgaaaagatcactttgacaataccacatgctggtgaggatttagaaaaactaggtcacttattgctggtg

SEQ ID NO: 23661 - DNA, 201 bp, Homo sapiens
gccactacactacaacctgggcaagagagtgagaccctgtctctaaatataacacacacacacacacacacacacacacacacacacacacacacacacacacacatatatatgtatatatatgcatttagatgaaaagatcactttgacaataccacatgctggtgaggatttagaaaaactaggtcacttattgctggt

SEQ ID NO: 23662 - DNA, 201 bp, Homo sapiens
tgccactacactacaacctgggcaagagagtgagaccctgtctctaaatataacacacacacacacacacacacacacacacacacacacacacacacacacacacatatatatgtatatatatgcatttagatgaaaagatcactttgacaataccacatgctggtgaggatttagaaaaactaggtcacttattgctgg

SEQ ID NO: 23663 - DNA, 201 bp, Homo sapiens
tctttatatattctggatactggattcttatcagatagatgatttgtaaaaactctcccttcctttggattgtctttttactttcttgatagtgtcttttgaagtgtaaaagtttttaattttgatgaagtcgagtttatctattttgtctttggttgctgtgcttcaagtgtcatatctaagaaatcattgtctaatcca

SEQ ID NO: 23664 - DNA, 201 bp, Homo sapiens
ttctttatatattctggatactggattcttatcagatagatgatttgtaaaaactctcccttcctttggattgtctttttactttcttgatagtgtcttttgaagtgtaaaagtttttaattttgatgaagtcgagtttatctattttgtctttggttgctgtgcttcaagtgtcatatctaagaaatcattgtctaatcc

SEQ ID NO: 23665 - DNA, 201 bp, Homo sapiens
actcgcctcagcctgccaaagtgctgggattacaggtttgggccactgcacccggtcagaacccaggctctttcttatacttaccttgcaaacccttgttstcattttttccctttgtatttttattgttgaattgtaatagttctttatatattctggatactggattcttatcagatagatgatttgtaaaaactctcc

SEQ ID NO: 23666 - DNA, 201 bp, Homo sapiens
tcaccatgttggccaggctggtctcgaacttctgacctcaggtgatccactcgcctcagcctgccaaagtgctgggattacaggtttgggccactgcaccsggtcagaacccaggctctttcttatacttaccttgcaaacccttgttctcattttttccctttgtatttttattgttgaattgtaatagttctttatata

SEQ ID NO: 23667 - DNA, 201 bp, Homo sapiens
agtagagatggggtttcaccatgttggccaggctggtctcgaacttctgacctcaggtgatccactcgcctcagcctgccaaagtgctgggattacaggtktgggccactgcacccggtcagaacccaggctctttcttatacttaccttgcaaacccttgttctcattttttccctttgtatttttattgttgaattgta

SEQ ID NO: 23668 - DNA, 201 bp, Homo sapiens
agagatgtgtgtaagagacagtgagagggcgtgacttggacttaagcaaggaccgtgagacacaaaaaggggggtgaggacagagtggagtcagctgaaaygctcaggaggaagtagacgccatgaagggccatggtatggggggccgcaggcgtggccgtgagtgtccctggggccagctcttggggggctccctgagtg

SEQ ID NO: 23669 - DNA, 201 bp, Homo sapiens
agttatgttccaggccccccgagcttcctggctggacagcttctctcctgggggccgttttgtcacagtgaccctgtgtttctagtcccaaatctgggtgytatagtctctttttagcgtggtggttgtcttagtcttttttggctgctaccacaagttaccttagactgggtaatttataaacagtggaaatttacttct

SEQ ID NO: 23670 - DNA, 201 bp, Homo sapiens
acctccgcctcccgggttcaagtgattctcctgcctcagcctccctagtagctgggattacaggcacacaccaccatgcccagctaatttttgtgtttttrgtagagacggggtttcaccgtgttggctgggctggtctcgaactcctgaactcaagtgatccaccctccttggcctcccaaagtgctgggattgcaggcg

SEQ ID NO: 23671 - DNA, 201 bp, Homo sapiens
cagtgccacccctgccctgtctggggctgaaggacagtgccacccctgccctgtctggggctgaagtacagtgccacccctgccctgtctggggctgaagkacagtgccaccccttccctgtctggggctgaaggacagtgccacccctgccctgtctggggctgaaggacagtgccacccctgccctgtctggggctgaa

SEQ ID NO: 23672 - DNA, 201 bp, Homo sapiens
tcactgactcacagcatggcaaggtttcagatctctttctgccacacagcagttctgaggcagctggaaagatatccagatgcttagattgtcaggccagscttgagatatacaaactattgagccttatctgtgaccttgcttaggtgaaggcatcagagcccctgcaccaacatgcataggcctctgcatgtgtgcggg

SEQ ID NO: 23673 - DNA, 201 bp, Homo sapiens
gcacctggacgcgctgcccctcagtgctttggacggttccacaactgtgattcacacggcttccccaaacgaaggtacacgagtgggcattctgtgactckgtacttccctttaggccctgtcctggcatttgatccatgagcagatcccgctgagtctggatctccaggcagggctggactgctgctgcctggccctgca

SEQ ID NO: 23674 - DNA, 201 bp, Homo sapiens
catagacagtaagcaagatagataagtaaaatatacagtacgttaatacgtggaggaacttcaaagcagggaaggggatagggaaatgtcagggttaatcragtgttaacttatttttatttttaaaaaaattgttaagggctttccagcaaaacccagaaagcctgctagacaaattccaaaagagctgtagcactaagt

SEQ ID NO: 23675 - DNA, 201 bp, Homo sapiens; identical to SEQ ID NO: 4231

SEQ ID NO: 23676 - DNA, 201 bp, Homo sapiens; identical to SEQ ID NO: 4228

SEQ ID NO: 23677 - DNA, 201 bp, Homo sapiens; identical to SEQ ID NO: 4239

SEQ ID NO: 23678 - DNA, 201 bp, Homo sapiens
aagtcctattaaaaacaacaaaaaagtgaagcttaggatgcattttataaactctgaccagaacacctgtgtttctctgtttctaggtttatgaactgacsttacatcatacacagcaccaagaccacaatgttgtgaccggagccctggagctgttgcagcagctcttcagaacgcctccacccgagcttctgcaaaccc

SEQ ID NO: 23679 - DNA, 201 bp, Homo sapiens; identical to SEQ ID NO: 4229

SEQ ID NO: 23680 - DNA, 201 bp, Homo sapiens
ttaattttgatgaagtcgagtttatctattttgtctttggttgctgtgcttcaagtgtcatatctaagaaatcattgtctaatccaaagtcaaaaaggttyactcctatgttttcttctaagaattttagagttttacatttaagtctgatccattttgagttaatttttatatatggttcaggtagaagtccaactttat

SEQ ID NO: 23681 - DNA, 201 bp, Homo sapiens
tggacttaagcaaggaccgtgagacacaaaaaggggggtgaggacagagtggagtcagctgaaatgctcaggaggaagtagacgccatgaagggccatggkatggggggccgcaggcgtggccgtgagtgtccctggggccagctcttggggggctccctgagtgtccctgtccctgtggccagttctgggtgggagcccc

SEQ ID NO: 23682 - DNA, 201 bp, Homo sapiens
ttctaaggattgactgtagtacaggaggaagattgacctgttgaaaagcctcagcctttacaagtgtaaaattatcagtatattactatcatctttctgawgaattaaataaactaaggactccaagtcaaaagtcttcaaactgaagtagaatagttgtatatagtgcttggcactttaatatttagtatcggtttaatg

SEQ ID NO: 23683 - DNA, 201 bp, Homo sapiens
actgtcacatagcaaaacagtgttaaatattctgaatcagaaaaggaagccgactctccaactgaaagaggtgttatcctagagactttttctggtgatgrcaatttattaatagtcactttttgctttactttctctattgaagtagtttttctattttgttctacttttaaggataatataatttataatgctgttttt

SEQ ID NO: 23684 - DNA, 201 bp, Homo sapiens
tgatacattaaattcctgtgacagatgatcagcttgtatttgtgtaatggtgtacagttcacaaagcttaaaaaaatgctacctgccatttcatcctcagygaggaaggtgatacacagagagaccaagtgactgtgtccacggcgacggcgctctgcatttcactttagcggttaatgtactctacctatatttttactt

SEQ ID NO: 23685 - DNA, 201 bp, Homo sapiens
cgctgacgtcagggaagttgaaacccaagagaagccagtaaaagtgagtctcagattgtcaccatgtgctggcagttttacacgctgtcagtaataaaagwcttctccctgcagggcagcctgcctccaataaatacgtgtagtatcaaatcctgtcttccctcataaattgtttggaagctccccaaggacagtgatgag

SEQ ID NO: 23686 - DNA, 201 bp, Homo sapiens
acttctgaattcctgccctgcgaacaggactggatacctaatagacaacaggtacttgataacagtttattgaattaatgagtgaatgaacagatacataratgcatgaaagaatggttgtaatgtatataacttggatttcaagactttttactgactgttcaaaataagaaattgaaaactttcctctgattttcctct

SEQ ID NO: 23687 - DNA, 201 bp, Homo sapiens
atttaatgaagattgatgttagttgatctttatattcttgaaatcagccatatggttgtgtgtgtatgtatatatttttaaaggtacataaagataataarctcatctctgaaaatttttacatttggcataagaataactggataattaagcatcttattctctggcctgtgtctttacagttaaaggtagatttactca

SEQ ID NO: 23688 - DNA, 201 bp, Homo sapiens
atgttgaaaaatgccgtagagaagatacttcttttccacctgttttcaactcatatcatcttgaatttcagggcacctttccatgctcctagtgcttgctrtctgtttattattttccttcctgaataccctgaactccagcatgttctgctgtaattctggcctccctggcatcttggactcctgtttcctttgctctgt

SEQ ID NO: 23689 - DNA, 201 bp, Homo sapiens
acatagtggggtggtccttggtgtaggtcccttgttcctacccctgggtctgagatttatttagaagtggtgttggggctgtgcggcaggcccctctgtarctgatcaatgtttgtgaagttgctgtttgagagttgaaaccatgacataagcagaaatggaaggaagaaagaaccagttatgtgaaagggacacatttac

SEQ ID NO: 23690 - DNA, 201 bp, Homo sapiens
acagtatttgttttacttagcataatgtccccaaagctcatgcatgttgtagcctatgttagaacttcctaatgtttcaggccaaatactattccattgtrtggataggccacattttgcttttccattcctctgtccatggacacttgtattgcttcatgttttagccattgtgaatcatgctgttatgaacgtgggtgt

SEQ ID NO: 23691 - DNA, 201 bp, Homo sapiens
agatgaacaataaaatgtatttttagaactttcaaatgaaatattatttcatccttccagatcatataatgcttaagttctgattgttaatcataaagtcyagaaaattaaaagataataaaatgaaagtgacttttaggtattagagttttattataaattctggtgtgtcattggagctatgacatgaatatttcaaag

SEQ ID NO: 23692 - DNA, 201 bp, Homo sapiens
cacatgagcctggaagatcaaggctgcagtgatccatgattgtaccactgcactccatcctgggtgatggagcaagattctgtctcaaaaaaacaaaactscaaaacaacgtcacaaaacagtgccattgttagacctgaaaatattaaacatttcctacatcaaatacccaccaactcattatcaatttttctctctact

SEQ ID NO: 23693 - DNA, 201 bp, Homo sapiens
aaagcaaaccccaattatcctcttatttcatctataagtatttcagtatctctatagatgaggactcttctttatttttaaaactttatttttaaaatgayggtcagatgcagtgttcatgcctgtaatcccagaactttgggaggccaagctgggcggatcacttgaacctgggagtttgagaccagcccgggaaacatg

SEQ ID NO: 23694 - DNA, 201 bp, Homo sapiens
ccctgagtgaaggttataaagaagcaaatagactacacatgtctgtaaactgctcttgagtgtcccaaatttggggtacttcagttcagctgtaggaaaarcctcaaactgtttatactttgcaagaattggaaacttctaattcacgttaagttttatgtaatacatgataagcttcataggagcttcatcttttatcta

SEQ ID NO: 23695 - DNA, 201 bp, Homo sapiens
cttttctccttaactttgtcatttgttgatttttttttaactgtccccaaatactgtgggcagagtgtatctagaattgaggcctccaccattgcggagasgacatggatgctgagcagtcccctgagtgaaggttataaagaagcaaatagactacacatgtctgtaaactgctcttgagtgtcccaaatttggggtact

SEQ ID NO: 23696 - DNA, 201 bp, Homo sapiens
atttgtctgttacatgagttaaaaatatggttgttgcactgtgaatagtttggtttagtcaaaacagttgtatcttaacggattgagaaacaaaagcaggrccacttttcatcagctccctccttctccttaaccagcaatacatgctgatgctgatatcccatagaccctcagctccatcctgagtcactgggaatgtgg

SEQ ID NO: 23697 - DNA, 201 bp, Homo sapiens
gtgcccctcggagtttgcgtgctgccctgtggaggtttgctgagctggctcacctggttcggcctcagaaatgcaggtaagttgtacactctggatgttgrtttttgtcgggggccagctgctactgatcctttatgtctcagctcagatgtcatttcaaaagtctgctctgccctctccaaattgcagtcgaccttgccc

SEQ ID NO: 23698 - DNA, 201 bp, Homo sapiens
aatattgtattaaattggatcaatttgggggctagaatgtatgttagagacatgatatgtccataggtccttgctatcacagtgaggtctcagggacagtmgtttggtatcatttgggatctcataagcagactctctctgcttgacctgacaaatcagagtctgtgttttaacaggttcagtgagtgacttacatgcaca

SEQ ID NO: 23699 - DNA, 201 bp, Homo sapiens
gcatatacaagcatttaaatgtgtcattttttgtttgcttgactgagatcacattacatatgtatttttttacttaacaatgtgtcatagatattgttccwtagcagtacctgtaattcttattaattgctatgtaatattttagaatttctttttaaaagaggacttttggagatgtaaaggcaaaggtctcacattttt

SEQ ID NO: 23700 - DNA, 201 bp, Homo sapiens
attgtcacccaggctggagtgcagtgatacaatctcggctcactgcagtctctgcctcccaggttcaaatgcttctcctgcctcagccttctgagtagctrggattacaggcgcccaccaccatgtccagctaatttttgtatttttagtagagatggggtttcaccatgttggccaggctggtcttgaactcctgacctt

SEQ ID NO: 23701 - DNA, 201 bp, Homo sapiens; identical to SEQ ID NO: 4181

SEQ ID NO: 23702 - DNA, 201 bp, Homo sapiens
atctgttaatctgttgttaatcctgtccagcgtatttttttttttgtttttgaaacagtctcactctgttgcccaggctggagtttagtggtgcgatatcrgctcactgcaacctccacctcccaggctcaagcaattcttctgcctcagcctcccgagtagctgggactataggcacgtgccaccacacctggctaattt

SEQ ID NO: 23703 - DNA, 201 bp, Homo sapiens
aaatgcacataaaattgactgtcttaaccatttttaggggtacagttcagtatatatattcgtaatgttgtacagccatcactgccatctacttcataagkttttcttctgtcaaaactgaacatctgtcttcattaaactccctatcatccattctttcctgtagtccctttctactttctgtctgtatgagtgtaactg

SEQ ID NO: 23704 - DNA, 201 bp, Homo sapiens
aattgtcttccacagaaccggtccctggtgccaaaaagtttggggacctctgcacatatgcatgcacctgtacatggacacataatacatgtacatatgcrtactttatattctctgccacttctggtccagactgatatactatctcatttggattactgcactagccttttgttttggaaacagcattttttaaaaaat

SEQ ID NO: 23705 - DNA, 201 bp, Homo sapiens
tattgaaaatttagcaggccaagcaaaacaggtggctggctttttcctccgtaagtatggtcttgacatggtcaccgatagaaacatggaaacatctgcaracttgccgttactcgtgtgtccgatctgactgtttcttgtatttttttctagtctgcccttactaggatgaactgtacacatcagttcatcctttttaaa

SEQ ID NO: 23706 - DNA, 201 bp, Homo sapiens
tttgcttgtctgtaaaggattttatttctcgttcacttatgaagcttagtttggctggatatgaaattctgggttgaaaatactttttttaaagaatgttsaatattggctcccactcttttctggcttgtaggatttctgcagagagatctgctgttagtctgatgggcttccctttgtgggtaacccgacctttctctc

SEQ ID NO: 23707 - DNA, 201 bp, Homo sapiens
caggcctggtggtgacaaaatctctgcatttgcttgtctgtaaaggattttatttctcgttcacttatgaagcttagtttggctggatatgaaattctggrttgaaaatactttttttaaagaatgttgaatattggctcccactcttttctggcttgtaggatttctgcagagagatctgctgttagtctgatgggcttc

SEQ ID NO: 23708 - DNA, 201 bp, Homo sapiens; identical to SEQ ID NO: 4204

SEQ ID NO: 23709 - DNA, 201 bp, Homo sapiens
agtggtttgtattcagacctggacatcttaattatatctttgcttccaagaagaagtcctttgatactgttttctgagttctgaatagctgatgaaaatgmccaattgaggaataatcatactttttcttgatctaaatcttatacttttgagttatcttagcataaatgtataattgtattttaagtggaaatttgtcac

SEQ ID NO: 23710 - DNA, 201 bp, Homo sapiens
gacttctgcaggggtctcctcactgttaaagagcagattgaaagtgaagaacgtgggctaagtgtttaggtcgatatttaaccctgctaggttttggatastaagtgaaattgaggccattttggttgaagttgacagaaaccactatcagggatccccaagactaccccaggcttttctagaaagactctcagctaagat

SEQ ID NO: 23711 - DNA, 201 bp, Homo sapiens
gccttggcctcccaaagtgctaggattacaggcgtgagccaccatgcccagcctggtgtttatctttaaagtgggcacagccacaggagttcacctgactmctggtctgagagtcacgagatcgttcaagatagtgaggccctcttttccaaaacgaggaccaaaaatcaattgacagtgttggtcaagatggtagaaacc

SEQ ID NO: 23712 - DNA, 201 bp, Homo sapiens
aggtaaaaaattggaatagttgattatatgaactctgctaaaattgagtgcattttacattttttaaggccttgttgggccctggttaaataattattttwaaaaatccttaaggagcctattataaacagatctgtggtcttaatgaaatgtgattaatactgtgcattattttaagaacttttgacttttcaaaaaact

SEQ ID NO: 23713 - DNA, 201 bp, Homo sapiens
gtggggtgaagagttgaattgggagatggtttctagatgcaaattgaaaaggcatttttccagagcagatttgttttcggcgtactagagtgactctttarcctagctgcgggaagatgactgtgccaagactgcaggtaggagaaagctcactgacgaggccttgtgggtctgaacgtcctgcagctatcagagcctgtt

SEQ ID NO: 23714 - DNA, 201 bp, Homo sapiens
cagttttagaacccataaaggaactctgtactctttacccaaaacctccatgcctccagctgcaggcagccactaacctgccttctgtctctgtgactctrcgtcttctggacattactgtggatgggctcatacagtcagtgagcttgtgactggtgccttctaccaagcagggttttcagtgtagcagcctctctgttt

SEQ ID NO: 23715 - DNA, 201 bp, Homo sapiens
tttttgtatttttagtagagccagagtttcaccatgttggccaggctggtctcgaacgcctgacctcaggtgatccgcctgccttggcctccgaaagtgcygggattacaggcgtgagcccatcattagatctttaaataccagtatctataagtcttttcctcttgagtcagctagtatccctggaaggaaattactcat

SEQ ID NO: 23716 - DNA, 201 bp, Homo sapiens
ttttttttttttttgagatggagtcctactctgtcgcccaggctagagtgcggtggtgggattttggctcacttaagcctctgcctcccaggttcaagcarttctcctgcctcagcctctcaagtagctgggattacaggtgtgcaccaccatgcccggctaatttttgtatttttagtagagccagagtttcaccatgtt

SEQ ID NO: 23717 - DNA, 201 bp, Homo sapiens
gttgtgcgtgtgaggggatagcacagggtgaggtgggggcccaagaaggaagtgacccacaaagaacagcctcctcttttggtccttgttcctgggatggstgggagtggcttctgtgtcgtccggccatttcccctgcggagaggctcctaccactgccgagaacctcatcattccacaaaaacaagaggccgcctggcc

SEQ ID NO: 23718 - DNA, 201 bp, Homo sapiens
tggaagtactttatgtcttaagttggcctggacatgtcagccaaggaatacttacttggtttgtgttagtgcttgtaattcgcccccagaatgtgtacacrttctggatgcattaaagtctggcctgtatccttaaagggccatcgctgtgctgcctgccctcagcaaggacacactttgcagacccacagaggctccgcc

SEQ ID NO: 23719 - DNA, 201 bp, Homo sapiens
ttgaagctttgtatttttaaattaaatgttatagagtgatgttttcatgtttcataattgttttcatctgtgcatttgtagccaacttgaaaacaaagatycagggattactacttaaaagccagacttcttggaggttatagtgatgattttgatagtatcttgagccgtctcataataacctcagggtgagagatggcc

SEQ ID NO: 23720 - DNA, 201 bp, Homo sapiens
cccagcaacccagagcccatgagggacacccgccccctcctggggcgaggccttcccccacttcagccccgctccctcacttgggtcttcccttgtcctcycgcgaggggaggcagagccttgttggggcctgtcctgaattcaccgaggggagtcacggcctcagccctctcgcccttcgcaggatgcgaagagttgggg

SEQ ID NO: 23721 - DNA, 201 bp, Homo sapiens
catttgcttgtctgtaaaggattttatttctcgttcacttatgaagcttagtttggctggatatgaaattctgggttgaaaatactttttttaaagaatgktgaatattggctcccactcttttctggcttgtaggatttctgcagagagatctgctgttagtctgatgggcttccctttgtgggtaacccgacctttctc

SEQ ID NO: 23722 - DNA, 201 bp, Homo sapiens
atatggtgagacttaatgtatgtgacattaaaatagtgattggatgttaaaacaggtatagaacagaaagaagagtgtatgtgtgtatctgtatgaatttwtgatgggtgtaacatatatgtattagggaaatgagggaaatgatacatttctctgactttgggagaacattatatctctacctcatattgcaaacaaaca

SEQ ID NO: 23723 - DNA, 201 bp, Homo sapiens
cacctactcataggccaggcccctatcgaagttctaggtgacccagtgctggggacgggggggccacctgcaaggtctaatcatggaggtgggggctacaktgttggcttgtgctggggccagcatccttaggaaggcatcttggaggtggaggagacagccgcccacttcttgattggggccttcagcagcaccagcttc

SEQ ID NO: 23724 - DNA, 201 bp, Homo sapiens
ctagttcttggctattgcgagcagtgctactgtgaccactcttaggtgtgtcttttggagtacatgtgcaggtttccatcttgcacagctagaggtggagytgttgggtgatagggtgtgtgcatctcagctgcagtagaaactgccaaatagctttccttgagtgcttgtaccagctcacccttttgccactgtgtatgg

SEQ ID NO: 23725 - DNA, 201 bp, Homo sapiens
gcgcctgccaccacgtccagctaatttttttgtatttttaatagagacggggtttcaccgtgttagccaggatgatcttgatctcctgacctcgtcatccsccgaccttgtgatccgcccacctcggcctcccaaagtgctgggattacaggcatgagccactgtgcccggccacgcctgggtaatttttgtatttttagt

SEQ ID NO: 23726 - DNA, 201 bp, Homo sapiens
gggtttcactatattggtcaggctggtcttgaactcctgacctcaagtgatgcacctgcctcgatctcccaaaatgctgggattacaggcgtgagccaccrctcccagccccttcttgattcttgaaaaggacattgggtgctgtacatctcgttatagatgttgataaaaatgcttgtgagaagagtaacattaaggtag

SEQ ID NO: 23727 - DNA, 201 bp, Homo sapiens
ctaatcagcttaaggagattttgagctgaaccaatagggttttctaaatatacaatcatgtcatctgcaaacagggacagttttacttcctctcttcctayttgaataccctttattgctttctcttgcctgattgcgctggccagaacttccaatactatgttgaataggagtggtgagagagggcatccttgtcttgtg

SEQ ID NO: 23728 - DNA, 201 bp, Homo sapiens
ctacttgggaggctgaggcaggagaatggcgtgaacccgggaggcggagcttgcagtgagccgagatcccgccactgcactccagcctgggcgacagagcragactccgtctcaaaaaaaaaaaaaaatattaataaagccaactcgttagcgtggggcttaattgcttaagtccaatgagaagtccttctctatcctagg

SEQ ID NO: 23729 - DNA, 201 bp, Homo sapiens
ctgtaggaaaagcctcaaactgtttatactttgcaagaattggaaacttctaattcacgttaagttttatgtaatacatgataagcttcataggagcttcrtcttttatctacttggacttttgcttccgtaggttttgttaaaggccttcatagcgaacctgaagtcaagctcccccaccattcggcggacagcggctgg

SEQ ID NO: 23730 - DNA, 201 bp, Homo sapiens
gtggtggctcatgcctgtaatcccagtattttgagaggctgaagtgggaggatgacttgaggctgggagttcaagactagcctgggctgcctagcaagacmccatctccagaaaaaaaaaatttaaaaattacaatcacgtccctgtagttcagctgcttgggaggctgaggcaggaggatcacttgagctcaggagttag

SEQ ID NO: 23731 - DNA, 201 bp, Homo sapiens
ttcatgtatattgtgaaaatgtagtctgctttaagctctctaaagtggtctaagttactggttcctaagtatggatgagcatcaaaatcatctggaaaatytgttaaaaatacagtaatgaaggcacctcactgtcctttttcccaaacatacttctgcattctgtttgagtaggtagggactacacatttttcacaagta

SEQ ID NO: 23732 - DNA, 201 bp, Homo sapiens
cccaggctggagtttagtggtgcgatatcagctcactgcaacctccacctcccaggctcaagcaattcttctgcctcagcctcccgagtagctgggactayaggcacgtgccaccacacctggctaatttgtgtatttttattagagatggggtttcaccatgttggccaaactggccttgaactcctgacctcaggtgat

SEQ ID NO: 23733 - DNA, 201 bp, Homo sapiens
agcatcccttgttttttgaggtggagtcttgctctgtcgcccaggctgacgtgcatcggcacaatctcggcccactgcaacctttgcctcctggtttcaarcgattctcctacctcagcctccggagtagctgggattacaggcacctgccaccatgcctggctaattttttgtatttttagtggagatggggtttcacca

SEQ ID NO: 23734 - DNA, 201 bp, Homo sapiens
cccaggctacggcggggatggcggtaaccctgcagcctgcgggccggcgacacgaacccccggccccgcagagacagagtgacccagcaacccagagcccmtgagggacacccgccccctcctggggcgaggccttcccccacttcagccccgctccctcacttgggtcttcccttgtcctctcgcgaggggaggcagagc

SEQ ID NO: 23735 - DNA, 201 bp, Homo sapiens
gtaaatggtagtttctgctgctgttatttttattaccatctctttggaatgggagtaggtgctcctttgtggtcagaggctgtgagagctccacagcgccrgtttgcccatctgtacactggggtctgttgaaggcagtcccctctgtgatatctctggctgtcagagctcagatgatagatggtatttttgtactcttag

SEQ ID NO: 23736 - DNA, 201 bp, Homo sapiens
gtgcaatgtggtgctgagaagaatgtatgttctgttgatttggggtgcagagttctgtagatgtctattaggtccgcttggtccagtgctgagttcaagtsctggatatccttgttaattttctggctcattgatctgcctaatattgacagtggggtgttaaagtctcccactattaccgggtgggagtctctttgtagg

SEQ ID NO: 23737 - DNA, 201 bp, Homo sapiens
tcggcaatgggttaagttggcagaaatgaaggcctgtttacgcactgagggcagaagcaacagggaggatcagttcatgacacaggagacacaaatcgccrttgtggtgttcacagacatgggttaggattggctgcatggatgacagagcactgtgggttctcccagagttgctggggaggaggcagagttggtgagcac

SEQ ID NO: 23738 - DNA, 201 bp, Homo sapiens
gatcttggctcactgcaacctccgcctcccgggttcaaactattctcctgcctcagcctctcgagtagctgggattacaggcgcccaccaccacacccggstaatttttgtattttttagtagagacggagtttctccatgttggtcaggctggtcttgaactcctgacctcaggtgatctgcccgccttggcctcccaaa

SEQ ID NO: 23739 - DNA, 201 bp, Homo sapiens
ggaggatgaaggtggaacccacacatgcatctttgagacccgtgtggtcagtggcttctgccccccaccaccccccactgctgtgcgtgcatagaattggsttccctcacctgctctggaagtgggttaggagcttggtagggctttttctcaaggacaagggcccctgatttgctctcaggcctcagtcctggcgacatg

SEQ ID NO: 23740 - DNA, 201 bp, Homo sapiens
gtgcctgtgagcagggtgaggagcagcggcaggaggatgaaggtggaacccacacatgcatctttgagacccgtgtggtcagtggcttctgccccccaccmccccccactgctgtgcgtgcatagaattggcttccctcacctgctctggaagtgggttaggagcttggtagggctttttctcaaggacaagggcccctga

SEQ ID NO: 23741 - DNA, 201 bp, Homo sapiens
gtggtgcctgtgagcagggtgaggagcagcggcaggaggatgaaggtggaacccacacatgcatctttgagacccgtgtggtcagtggcttctgccccccmccaccccccactgctgtgcgtgcatagaattggcttccctcacctgctctggaagtgggttaggagcttggtagggctttttctcaaggacaagggcccc

SEQ ID NO: 23742 - DNA, 201 bp, Homo sapiens
ggaggggggccgtggtgcctgtgagcagggtgaggagcagcggcaggaggatgaaggtggaacccacacatgcatctttgagacccgtgtggtcagtggcktctgccccccaccaccccccactgctgtgcgtgcatagaattggcttccctcacctgctctggaagtgggttaggagcttggtagggctttttctcaagg

SEQ ID NO: 23743 - DNA, 201 bp, Homo sapiens
tgggaggggggccgtggtgcctgtgagcagggtgaggagcagcggcaggaggatgaaggtggaacccacacatgcatctttgagacccgtgtggtcagtgkcttctgccccccaccaccccccactgctgtgcgtgcatagaattggcttccctcacctgctctggaagtgggttaggagcttggtagggctttttctcaa

SEQ ID NO: 23744 - DNA, 201 bp, Homo sapiens
ggagcccacggggctgtgggaggggggccgtggtgcctgtgagcagggtgaggagcagcggcaggaggatgaaggtggaacccacacatgcatctttgagrcccgtgtggtcagtggcttctgccccccaccaccccccactgctgtgcgtgcatagaattggcttccctcacctgctctggaagtgggttaggagcttgg

SEQ ID NO: 23745 - DNA, 201 bp, Homo sapiens
aggggagcccacggggctgtgggaggggggccgtggtgcctgtgagcagggtgaggagcagcggcaggaggatgaaggtggaacccacacatgcatctttsagacccgtgtggtcagtggcttctgccccccaccaccccccactgctgtgcgtgcatagaattggcttccctcacctgctctggaagtgggttaggagct

SEQ ID NO: 23746 - DNA, 201 bp, Homo sapiens
agggctctgtgacaccctggtctcaccgccactcttccaaagtcgcagaggctttagcagagatgggcccagcctctctgagtcataggcttctgcacacrggagctgtctttagagggagggtggaatttcatcagccacccacatgggggagttgagggcaagaattaggagcaaagatgggaaggggtctgggaggaa

SEQ ID NO: 23747 - DNA, 201 bp, Homo sapiens
tgatgatggagaacagctttttatgggcacacagcccacagcactgtgccaagtgctcgaggcttcccgagaaccaggcagaaaggaggacagtcgaggtstgctgactgcgtggtggctgcgtgatctagagcgcgggtcacaaaggcgcgagggagctctggccttgggtttaccgcaatgactgccagtgcgggagac

SEQ ID NO: 23748 - DNA, 201 bp, Homo sapiens
aatggcccttggtgccaagaacgtgagttggggctagtgccagtgatgatggagaacagctttttatgggcacacagcccacagcactgtgccaagtgctmgaggcttcccgagaaccaggcagaaaggaggacagtcgaggtgtgctgactgcgtggtggctgcgtgatctagagcgcgggtcacaaaggcgcgagggag

SEQ ID NO: 23749 - DNA, 201 bp, Homo sapiens
aaatggcccttggtgccaagaacgtgagttggggctagtgccagtgatgatggagaacagctttttatgggcacacagcccacagcactgtgccaagtgcycgaggcttcccgagaaccaggcagaaaggaggacagtcgaggtgtgctgactgcgtggtggctgcgtgatctagagcgcgggtcacaaaggcgcgaggga

SEQ ID NO: 23750 - DNA, 201 bp, Homo sapiens
cccactccctgcagggtgctgggtcccaggggggaaatggcccttggtgccaagaacgtgagttggggctagtgccagtgatgatggagaacagctttttrtgggcacacagcccacagcactgtgccaagtgctcgaggcttcccgagaaccaggcagaaaggaggacagtcgaggtgtgctgactgcgtggtggctgcg

SEQ ID NO: 23751 - DNA, 201 bp, Homo sapiens
caggggctcctccttggcctgagagctgttcatacagactcctcgcccactccctgcagggtgctgggtcccaggggggaaatggcccttggtgccaagarcgtgagttggggctagtgccagtgatgatggagaacagctttttatgggcacacagcccacagcactgtgccaagtgctcgaggcttcccgagaaccagg

SEQ ID NO: 23752 - DNA, 201 bp, Homo sapiens
ctgggcgaggggagtgcaggggctcctccttggcctgagagctgttcatacagactcctcgcccactccctgcagggtgctgggtcccaggggggaaatgrcccttggtgccaagaacgtgagttggggctagtgccagtgatgatggagaacagctttttatgggcacacagcccacagcactgtgccaagtgctcgagg

SEQ ID NO: 23753 - DNA, 201 bp, Homo sapiens
ctgcacaacctgggccctcctgccagtggcggcgagggcaggtggctcacggctgggtgcctgtctgggcaggagctgggctggtatggggtgggcctgcrgccctgcccccctgtgcagatcaagactcagggtgctggtgttcacaggtgccctcatcagccacgagaagctgctgctacagatcaaccccgagcggga

SEQ ID NO: 23754 - DNA, 201 bp, Homo sapiens
tatttgactctcacaaccccctgtgagataggctctgttactcccatttgacaggtgaggaaagcaaggcttagagaatttcagtgacttgcccaggtccwctgagctaggaagtagccattctggcatttgaacccaaggcctgctatccctagaacccacgctctcaaattcaacctatgacagaggcaagccctggtg

SEQ ID NO: 23755 - DNA, 201 bp, Homo sapiens
ttatttgactctcacaaccccctgtgagataggctctgttactcccatttgacaggtgaggaaagcaaggcttagagaatttcagtgacttgcccaggtcytctgagctaggaagtagccattctggcatttgaacccaaggcctgctatccctagaacccacgctctcaaattcaacctatgacagaggcaagccctggt

SEQ ID NO: 23756 - DNA, 201 bp, Homo sapiens
tttagctttgattttgtttttatgaattaaaattgtcataccaaaatttttatttcaagcaaatccaagagcataaaaaattaaaatattacttaaaataytaagagagaacagatatatattttactaagcatatgttgaatgaaattgttcaaatatttataacaggcatagagtagaattttcttaaaaatatttttg

SEQ ID NO: 23757 - DNA, 201 bp, Homo sapiens
tcttctccctgcagggcagcctgcctccaataaatacgtgtagtatcaaatcctgtcttccctcataaattgtttggaagctccccaaggacagtgatgargcactcgtaagtgcttgctgcctagatgggtccctctccacctttgctagattctgagcattcactgagttagagctgcttctgcaaatgtgctgcttct

SEQ ID NO: 23758 - DNA, 201 bp, Homo sapiens
taactccttactgttccattttatatgttttgtctggtttaagactttatctgcaaaccgggaaactgtctctacaaaaagaaaaacaaaaatagttggcygcagtggcatgcgtctgtggtcccagctactcggggctgaggtgggaggattgcttgagccttgggaggttgaggctgcaaagagccatgatcatgccat

SEQ ID NO: 23759 - DNA, 201 bp, Homo sapiens
attggatttttcttttgcattatattatagacgatttttcatgtaactccttactgttccattttatatgttttgtctggtttaagactttatctgcaaaycgggaaactgtctctacaaaaagaaaaacaaaaatagttggccgcagtggcatgcgtctgtggtcccagctactcggggctgaggtgggaggattgcttg

SEQ ID NO: 23760 - DNA, 201 bp, Homo sapiens
ccctctacacactgctttaaatgtgtcccagagattctggtatgttgtgtcttcgttctcattggtttccaagaaaatttttatttctgccttcatttcgytatttacccagtagtcattcaagagcaggttgttcagtttccatgtagttgtgtggttttgagtgagattctcaatcctgagttctaatttgattgcact

SEQ ID NO: 23761 - DNA, 201 bp, Homo sapiens
tttgaaatatgtgtacattggccaggcgtggtggctcacacctgtaatcccagcactttgggaggctgaggtgggcggatcacgaggtcgggagttcaagrccaaactggccagcatggtgaaatcctgtctctactaaaaataccccaaaaaaaaaaaaaaaaaaaaaaagccgggcatggtggctcgcgccagtcgtcc

SEQ ID NO: 23762 - DNA, 201 bp, Homo sapiens
acatgatgtttgaaatatgtgtacattggccaggcgtggtggctcacacctgtaatcccagcactttgggaggctgaggtgggcggatcacgaggtcgggrgttcaaggccaaactggccagcatggtgaaatcctgtctctactaaaaataccccaaaaaaaaaaaaaaaaaaaaaaagccgggcatggtggctcgcgcc

SEQ ID NO: 23763 - DNA, 201 bp, Homo sapiens
atttatttatttttaattgacaaaattgtatatatctgtaatatacaacatgatgtttgaaatatgtgtacattggccaggcgtggtggctcacacctgtwatcccagcactttgggaggctgaggtgggcggatcacgaggtcgggagttcaaggccaaactggccagcatggtgaaatcctgtctctactaaaaatacc

SEQ ID NO: 23764 - DNA, 201 bp, Homo sapiens
ctatttatttatttttaattgacaaaattgtatatatctgtaatatacaacatgatgtttgaaatatgtgtacattggccaggcgtggtggctcacacctktaatcccagcactttgggaggctgaggtgggcggatcacgaggtcgggagttcaaggccaaactggccagcatggtgaaatcctgtctctactaaaaata

SEQ ID NO: 23765 - DNA, 201 bp, Homo sapiens
catgcacatatgcaggggtccccaacctctgttaaaaaccggactgcaggccgtgcgtggtggctcacgcctgtaattccagaactttgggaggccgagascagtgcatcacaaggtcaggagatcgagaccattccggctcacacggtgaaaccccgtctctactaaaaatacaaaaaaaaattagccgggtgtggtggc

SEQ ID NO: 23766 - DNA, 201 bp, Homo sapiens
acatgcacatatgcaggggtccccaacctctgttaaaaaccggactgcaggccgtgcgtggtggctcacgcctgtaattccagaactttgggaggccgagwccagtgcatcacaaggtcaggagatcgagaccattccggctcacacggtgaaaccccgtctctactaaaaatacaaaaaaaaattagccgggtgtggtgg

SEQ ID NO: 23767 - DNA, 201 bp, Homo sapiens
gcgagaagaaagtgtgtacctttgtattcacatacatgtacatgcacatatacatgcacatatgcaggggtccccaacctctgttaaaaaccggactgcargccgtgcgtggtggctcacgcctgtaattccagaactttgggaggccgagaccagtgcatcacaaggtcaggagatcgagaccattccggctcacacggt

SEQ ID NO: 23768 - DNA, 201 bp, Homo sapiens
attttgtgcctgtttactcaatggcattaacatgcccaaatgtctgggtagctgtctcatctccagttcagcagaaccattgtcatatgccctagtaaaarcattccttcattggacacttaggccccaatactttcattcagatctactacctgatttcatttctcaaatgatttttatggagctctgatttataggaaa

SEQ ID NO: 23769 - DNA, 201 bp, Homo sapiens
atgggaatttcagggtgtggtcttcaagttcatttaagggaattttcatatgctggcaaaaggcttttctcattagcttgactctttccaaaattatttgytgtgaattagaagtttaggaaccttttttcacttaattgtgacctagcatacgaaatggtgatgatttaggaactactgttcttgtattaacagctttta

SEQ ID NO: 23770 - DNA, 201 bp, Homo sapiens
gatgggaatttcagggtgtggtcttcaagttcatttaagggaattttcatatgctggcaaaaggcttttctcattagcttgactctttccaaaattatttsctgtgaattagaagtttaggaaccttttttcacttaattgtgacctagcatacgaaatggtgatgatttaggaactactgttcttgtattaacagctttt

SEQ ID NO: 23771 - DNA, 201 bp, Homo sapiens
caaaattacatgcaattttgtaatctgacaatttccacttaatattttattagcattttcctgttatgaaacagtaattttagttatgggtcgttgttttrctatgcggttgggataaaattttatatactttttttggcaattacttattatacataaatgtttgtgtatagttttctttttctgagaattcctggaagt

SEQ ID NO: 23772 - DNA, 201 bp, Homo sapiens
tgatgatctgaggtggaacagtctcgtcttgaaaccatcccctggccctgtggaaaaattgtctcccatgaaaccagtctctggtgccagaaaggttgggkagcactgtgatatagtattaaaagtgctaataaatatggcatactgcctttaaaatgtctggtagctctttctcagtggcactcataatagtgttttttg

SEQ ID NO: 23773 - DNA, 201 bp, Homo sapiens
tttaatgattcatgcatctcttcccttttgaagtactcttacaggtatgttgtgcatgtgttgaaaagtggcactatctattctaaaatacagtatgcctmctctgtgtttgaacagttgtagcgtggccttggggcctcctgttagctggcttggagaagggattcttgggattgtagagattagacctgaggaggcccc

SEQ ID NO: 23774 - DNA, 201 bp, Homo sapiens
tttttttactttcactatagttctatcagaattcagtgtgtacgttattatgcctaagtaaatagtcatggttgcttacgtattatatttctttgattgtrtttcttatttgatgagaaagctgtgttttttgctctgggttgaaactggagagaggacctggggaggaggaggaggacagatgaagttggtgactgtacc

SEQ ID NO: 23775 - DNA, 201 bp, Homo sapiens
gagtgcaatgacgcaatcttggctcaccacaacctctgtctcccgggttcaagcgattctcctgcctcagcctcctagtagctgggattacaggcatgcaycaccacgctcggctaattttgtacttttagtagagatggggtttctccgggttggtcaggctggtctcgaactcctgacctcaggtgatcctcccacctc

SEQ ID NO: 23776 - DNA, 201 bp, Homo sapiens
gcctgattgtacattttaaaataactaaaacagtcagggcacagtggctcatgcctgtaatcccagcattttgggaggctgaggcaggtgatcacctgagrtcaggagttcgagaccagcctggccaacatggagaaaccctgtctctactaaaaatacaaaaattagccaagtgtggtggcgggcgcctgtaatcctggc

SEQ ID NO: 23777 - DNA, 201 bp, Homo sapiens
tgaactgtgattgtgccactgtgttccatcctgggcaacagaatgagaccctgtctcaaaaacaaaaacagttactagaagaatggacatcataaagatargagcagaagtcagtaaaatagaaaacaaaaatacataggaaatcaataaaaccaaaagctggttcatcaagaacatcaataaattggtaaagctgatagg

SEQ ID NO: 23778 - DNA, 201 bp, Homo sapiens
acagcacatgtttcagagagcacggggttgggggtaaggttatagattaacagcatcccaaggcagaagaatttttcttagtacagaacaaaatggagtgkcctatgtctacttctttctacgcagacacagtaacaatctgatctctctttcttttcccacatttcctccttttctattcgacaaaactgccaccgtcat

SEQ ID NO: 23779 - DNA, 201 bp, Homo sapiens
tgcaccgcccttaatccatttaacccttagtggacacagcacatgtttcagagagcacggggttgggggtaaggttatagattaacagcatcccaaggcaraagaatttttcttagtacagaacaaaatggagtgtcctatgtctacttctttctacgcagacacagtaacaatctgatctctctttcttttcccacattt

SEQ ID NO: 23780 - DNA, 201 bp, Homo sapiens
cggagcagttctcatttagagcctactccagagggaatgtggtgctgccaattccttttttttttttttttttaagatatcatttacccctttaagttggktttttttttttttttttttttttagtatttattgatcattcttgggtgtttcttggagagggggatttggcagggtcataggacaatagtggagggaagg

SEQ ID NO: 23781 - DNA, 201 bp, Homo sapiens
caagaaaaaagagaaaaaagaaaaagaaatcaacactaatatggtgagacttaatgtatgtgacattaaaatagtgattggatgttaaaacaggtatagamcagaaagaagagtgtatgtgtgtatctgtatgaatttatgatgggtgtaacatatatgtattagggaaatgagggaaatgatacatttctctgactttgg

SEQ ID NO: 23782 - DNA, 201 bp, Homo sapiens
tctaaattaacacagaaatttaaaataatcttgatcaaaattctagtagaggtatttttgaacttgttcactgcaagaataaatacataattgcaaagaayatctcaaaatcatcaccaggcctggtgtggtggcccatgcctgtaatcccagcactttgggaggctgaggcaggcagatcacctgaggtcaagagtttga

SEQ ID NO: 23783 - DNA, 201 bp, Homo sapiens
ttttatattactaagttgaattttctctaaattaacacagaaatttaaaataatcttgatcaaaattctagtagaggtatttttgaacttgttcactgcawgaataaatacataattgcaaagaatatctcaaaatcatcaccaggcctggtgtggtggcccatgcctgtaatcccagcactttgggaggctgaggcaggc

SEQ ID NO: 23784 - DNA, 201 bp, Homo sapiens
tctaaggaatcgataaatatgcaaaaactttataaaaacttctgttaatgtttctgaaagatataggtgaccactttctagataggaagattttatattastaagttgaattttctctaaattaacacagaaatttaaaataatcttgatcaaaattctagtagaggtatttttgaacttgttcactgcaagaataaatac

SEQ ID NO: 23785 - DNA, 201 bp, Homo sapiens
ccactcaggaggctgagacgggaggatcctttcagcctaggagtttaaggctaaagtgagccatgattgtgctatcgtactccagcctgggcagcagagcragatcctgactctaaaaaaaagtaaaataaagtaaaatgggggaaatgaactgctttagtaacatcatctgttttttctgtgagcagcgtagcttgacag

SEQ ID NO: 23786 - DNA, 201 bp, Homo sapiens
tgggccgggtgtggtggctcacacctgtaatcccagcactttgggaggccgagatgggcagatcacgaggtcaggagatccagaccatcccggctaacacrgtgaaaccccgtctctactaaaaaatacaaaaaattagccgggtatagtggtgggtgcctgtagtcccagctacttgggaggctgaagcaggagaatggt

SEQ ID NO: 23787 - DNA, 201 bp, Homo sapiens
acagcattactgggccgggtgtggtggctcacacctgtaatcccagcactttgggaggccgagatgggcagatcacgaggtcaggagatccagaccatccyggctaacacggtgaaaccccgtctctactaaaaaatacaaaaaattagccgggtatagtggtgggtgcctgtagtcccagctacttgggaggctgaagca

SEQ ID NO: 23788 - DNA, 201 bp, Homo sapiens
caattaaaatacagcattactgggccgggtgtggtggctcacacctgtaatcccagcactttgggaggccgagatgggcagatcacgaggtcaggagatcsagaccatcccggctaacacggtgaaaccccgtctctactaaaaaatacaaaaaattagccgggtatagtggtgggtgcctgtagtcccagctacttggga

SEQ ID NO: 23789 - DNA, 201 bp, Homo sapiens
acttctgacctcaggtgatccactcgcctcagcctgccaaagtgctgggattacaggtttgggccactgcacccggtcagaacccaggctctttcttatasttaccttgcaaacccttgttctcattttttccctttgtatttttattgttgaattgtaatagttctttatatattctggatactggattcttatcagata

SEQ ID NO: 23790 - DNA, 201 bp, Homo sapiens
gcccagctaatttttgtgtttttagtagagatggggtttcaccatgttggccaggctggtctcgaacttctgacctcaggtgatccactcgcctcagcctrccaaagtgctgggattacaggtttgggccactgcacccggtcagaacccaggctctttcttatacttaccttgcaaacccttgttctcattttttccctt

SEQ ID NO: 23791 - DNA, 201 bp, Homo sapiens
tgtcacccgggctggagtgcaatgatgtgatctcagctcactaaaacctctacctcctgggttcaagtgattcttctgcctcagcctcccaagtaactggsattacaggcgtataccaccatgcccagctaatttttgtgtttttagtagagatggggtttcaccatgttggccaggctggtctcgaacttctgacctcag

SEQ ID NO: 23792 - DNA, 201 bp, Homo sapiens
cttgcgttatcaggtttgtattcagctgcaagtaacagaaaatcctgctgcaatagcttaaactggtaacaagcaagagcttatcagaagacaaaaataastctggggaaattcaacaataagttaaggaacccaggctctttcttttttttttttttgaaacggagtttcgctcttgtcacccgggctggagtgcaatga

SEQ ID NO: 23793 - DNA, 201 bp, Homo sapiens
cgccgcccccgccgccacccggcccggctgtggctgaggagccgctgcaccgaccgtgagtttgggcccgctgcagctccctgtcccggcgggtcccaggmtacggcggggatggcggtaaccctgcagcctgcgggccggcgacacgaacccccggccccgcagagacagagtgacccagcaacccagagcccatgaggg

SEQ ID NO: 23794 - DNA, 201 bp, Homo sapiens; identical to SEQ ID NO: 4186

SEQ ID NO: 23795 - DNA, 201 bp, Homo sapiens
tgcctgtgctctccaatcagggtggccagtggggagccatttggcttttctcaagagcatactcaggtggaccttgctccactgtttgaccagatgaggcrttctgaacagccaagcctgtgctggtctgttttcatgttgatttttttttttcttttctttttgagatggagtttttcccttgtcacccaggctggagtg

SEQ ID NO: 23796 - DNA, 201 bp, Homo sapiens
tgtggggagggcaacacaacagtgtgttctgacgtactgaagagctcaactgaaaacaacaggagaattagcccaaaatccatttactaaaattgtttatytttttttttttttttgagacaaagtctcgctgttgtcccccaggctggagtgcaatggcgctatcttggctcactgcaacctccgcctcctgggttcata

SEQ ID NO: 23797 - DNA, 201 bp, Homo sapiens
tgtattttcctttaagaagccactaatagtgcatctccttagagtgtatatttctagaatcctagtgtgcagagtttagactaagactaaaaaaaaaaaamaacaaattatactgtaatttcatttttatttgtattttagacaccaaaggctctattccctgctggacaggtttcgtctctccaccatgcaagactcact

SEQ ID NO: 23798 - DNA, 201 bp, Homo sapiens
agttagcatcttcttctttcttgattcttttttttttttttttgagatggactttcgctcttgttgcccaggtaacaactccagtgcaatggcgccatctyggctcactgtaacctctgcctccctggttcaagcgattctcctgcctcagcctctcaagtagctgggattacaggtgtgcgccaccacgcctggctaatt

SEQ ID NO: 23799 - DNA, 201 bp, Homo sapiens
tgaggggatcagttcccctgttgttctttagaattttctggatattcttctttattgattttgggatgtgaacaatagaatcaacttctacttgtagattratttagggagaacttatacctcagatgttaagtcaccctgtccagaatgtgggatgctttcctatttgttcagaactttttaaattacctcagaagcaca

SEQ ID NO: 23800 - DNA, 201 bp, Homo sapiens
ttgagttacttacattctcatagttctctagtttcagtagtttcatttattattttgttatatcaatctatctgtctgctcatctattagaagcatccttkttttttttttttcttttttagacagagtcttgctctgtccccaggttggagtgcagtggtgcaaccatgcctccctgcagtctcagggctcaagtgatcc

SEQ ID NO: 23801 - DNA, 201 bp, Homo sapiens
ggtttcaccaggttggtcaggctggtctcgaactcctgacctcgtgatccacccacctcggcctcccaaagtgctgggattacaggcgtgagctactgcgsccagccagacctttttattttatttgacaaaagaaatacttccatgttatagaagactaaatattgtttgggctgtctgcagtatggtcttcccttgatt

SEQ ID NO: 23802 - DNA, 201 bp, Homo sapiens
tactgacattgtaatagtttttggtagcttgtatggccagttagttgtatggtcatcttacggtgaggtgcttgtcttacagctcttacttatccatgagrcttgctaagaaattgtgcttctgtgaaaagaatctcagcttactccaggaatgtaaatgactatgttttttctgattattaaagtaatacacgcccaaaa

SEQ ID NO: 23803 - DNA, 201 bp, Homo sapiens
taatgatcaaaatttattttcagcccgtttcacttaaaagttgagactgcttaactttttttaatctttaatcttaaacttttaaatgccatttgatcttkaaaaatatatgttttaatagtgtattttaagtctctatatttttgttattagaatatatagaggctataacctactaccaagcataacagacgtcactat

SEQ ID NO: 23804 - DNA, 201 bp, Homo sapiens
acagaaagatttgaaggtgctggccttgaaaattggagtgatgaagctataagccaaggaatgcagcagccaccaaagctggaagaggcacggagcagttytcatttagagcctactccagagggaatgtggtgctgccaattccttttttttttttttttttaagatatcatttacccctttaagttggttttttttttt

SEQ ID NO: 23805 - DNA, 201 bp, Homo sapiens
atggtgtgaacccgggaggcagagctggcagtgagctgagatcgcgccactgcactccagcctgggcgacagagcaagactccgtctcgggggaaaaaaawaaataaataaatagaatgctgtagtgtccttgagtttacatgcccctccttacgcttgtgtgcccgtgcagattgcttgattacacaattagaggaggct

SEQ ID NO: 23806 - DNA, 201 bp, Homo sapiens
taaaatatacagtacgttaatacgtggaggaacttcaaagcagggaaggggatagggaaatgtcagggttaatcgagtgttaacttatttttatttttaaraaaattgttaagggctttccagcaaaacccagaaagcctgctagacaaattccaaaagagctgtagcactaagtgttgacatttttattttattttgttt

SEQ ID NO: 23807 - DNA, 201 bp, Homo sapiens
gtgtcagccaccacgcccagccatattttcagatctccctctctttgccctaaaccactgtgcttaataagtagtttttagtggccagcagtctccatgtwtaacacattttagcaaaatggaaaatactatatgttttaaatttgaacgtgagattatactgaaataaaaatcatctaactgggattctttaaatagtaa

SEQ ID NO: 23808 - DNA, 201 bp, Homo sapiens
tttcccctgaaaatcatttatcaaacgtatgtggcttattttctgaaggatgtttgataattttggaagatatgaaagtcttcatattttacaaggtttgrggtctctttaagctgcatggttctcatgtcagctcccaaagcagaagacggcatgttgaaaaatgccgtagagaagatacttcttttccacctgttttca

SEQ ID NO: 23809 - DNA, 201 bp, Homo sapiens
taaagattatttcacatagctcttgcacatttcttgataaatgaatcctcaggtattcctctgtttttgttactaatagttacttcttatgggttttttttcccctgaaaatcatttatcaaacgtatgtggcttattttctgaaggatgtttgataattttggaagatatgaaagtcttcatattttacaaggtttgggg

SEQ ID NO: 23810 - DNA, 201 bp, Homo sapiens
gtggcagaattttctataaccatggcagtgctccatagctatgccaggcaagacagtagccactaaacacatatagctgttgagcccttgaaatgcagctrgtgtgactgaagaactgaaccccgattcggtttaattttcattaaatttaaatttaaataaccttatgtgggtagtggctccagtattgggcagggcagc

SEQ ID NO: 23811 - DNA, 201 bp, Homo sapiens
gctacccccatcttgagtgtcctcttcagttggctttcagagggcctcctgggtgttcccttacccacttgccactccccagtcactgggttcagtccttyctgcccaccagcacatgctttctaggctctgtcctaggccgtcttctctctttgtagtctctgggccagtgctgttctagagagtggcagaattttctat

SEQ ID NO: 23812 - DNA, 201 bp, Homo sapiens
aactcattttgaatttcattttaatgggcaccatatgccagtactccctcgggcactgggatgttaagaaagtataatgtatggacttcattctcaagttrgttttagattagagggggatacacgtaaacaaaagtgcagtggtcacacagagtggccctaatcactctccttgggcagatttatgggctggtaggaaag

SEQ ID NO: 23813 - DNA, 201 bp, Homo sapiens
ctaggaagagctgtaccgttgggatggccacaatgattctgaccctgctctcgtcagcttggttcccattggatctctcagcccatcaagatgctttgatkttggccggaaacttgcttgcaggtactggtactgagttgaaacagggactccaggacttggattttgatttccttagggggaatgggggtggtgagcata

SEQ ID NO: 23814 - DNA, 201 bp, Homo sapiens
aaaaataaaacaatttctgagctggtataaaatgtattgtgacatgccttcctcttggaattgcaagagaaaggaagactgttgtttgcttaaaaattgtytataatttgactttgcaaatgtctgcttccagagtgcctccactgagtgcctcagatgagtctaggaagagctgtaccgttgggatggccacaatgattc

SEQ ID NO: 23815 - DNA, 201 bp, Homo sapiens
ttttatggagctctgatttataggaaagatgttagttgattaaaaataaaacaatttctgagctggtataaaatgtattgtgacatgccttcctcttggaattgcaagagaaaggaagactgttgtttgcttaaaaattgtctataatttgactttgcaaatgtctgcttccagagtgcctccactgagtgcctcagatga

SEQ ID NO: 23816 - DNA, 201 bp, Homo sapiens
tttcctgatgcctttctttaggctttaattgaaaacattttattttctagaaaaaagcttcagctcaggatgtttgagtgtaggtcagtcctttgataggwtattatcattttgaggattgaccacaccacctctgtatttaagctctgccacaatcactcagctgtgacactgtaaatctcttaatagtttattacattc

SEQ ID NO: 23817 - DNA, 201 bp, Homo sapiens
gaccctcatctgctccatcctcagcaggtcccgcttccacgtgggagattggatgggcaccattagaaccctcacaggtaacggccagtttttcagctgtrttttttctagttatgcttactaaggtttaagtttagatgatgatgtttgttgcttgttcttctggttaggaaatacattttctttggcggattgcattcc

SEQ ID NO: 23818 - DNA, 201 bp, Homo sapiens
cataatagtgttttttgatttttaaatgtgtgtcaagctgactctcccctccgtgtatgctgggctttattttccctttcctagtcaccagttttgggaartagagatcttcattctcatgctgctcctctagtgcaagtgctccatttatttttaaggaattaatataacaaaaaatcatgggaatttagaaaacaacat

SEQ ID NO: 23819 - DNA, 201 bp, Homo sapiens
ccctgcatgtgaatgactgacattcaaagaaccgattaatttggaagagaagcggcagaaccgagagttagaggtgtggactctggagctgcgctgctcgkttccaaccctaggtgctgacctctagctgtcttccctctgtatgtccctgtcaccgtgagtcaaatgcgggtgatgcctcctcaggtgccgtgttaccta

SEQ ID NO: 23820 - DNA, 201 bp, Homo sapiens
gttgaaggttgaggtaccaatttcattattgctgactataggagttatagcaaaatatccatttgtctgttacatgagttaaaaatatggttgttgcactrtgaatagtttggtttagtcaaaacagttgtatcttaacggattgagaaacaaaagcaggaccacttttcatcagctccctccttctccttaaccagcaat

SEQ ID NO: 23821 - DNA, 201 bp, Homo sapiens
agatgtcatttcaaaagtctgctctgccctctccaaattgcagtcgaccttgccctgtttatgtttccctcatagcactaatccatgtcagaaattgtcaygtacagtctatctgtgtgcttgtttattttctatcccacccttccgcaagagacttatgggatgtgtgccccaggacagcaggggtcttactgtcttatg

SEQ ID NO: 23822 - DNA, 201 bp, Homo sapiens
ctaatcacaggtaaaggttttctgatgaaaatttagtgtctgaattgagatatactgtaaaaaatgttatatatcttaattatttcttcacattaattacrtgttgaaataatactttgggtgtattgggttaaattaaatattatgaaaatcttgcctgttttctttttacttttgatgcgtcagctaggaaatataaaa

SEQ ID NO: 23823 - DNA, 201 bp, Homo sapiens
gaagccagaaataggggaagaggcaaataaaggaaagaaagagcttgatggtagatttcaacctaactatgtcaaaaaggacattacatgtaaaaggcagmgatttttcagattgaatggaaaagtaagactcggtatatgctgctgcctgcaagaaacacattctaaatataaaggcaaaaataacctacaggtaacaga

SEQ ID NO: 23824 - DNA, 201 bp, Homo sapiens
aggaaactaatttatgctgcatgtgaaatggtgtaataaggtagattgtgatgaagatacatagtataaacaattaagcaacaactaaaagcacaacaagraattatagctaatgaaccaaaaaaggagattagaataataaaaatggtgaatcccaaagaagccagaaataggggaagaggcaaataaaggaaagaaaga

SEQ ID NO: 23825 - DNA, 201 bp, Homo sapiens
gacccaggaaataagatctctttcaatctgagtgcgtcaggctttattcttgtcattttgtcttttgataattttcaaatggaattcatggaatgttggcktatattcatatattagtaaagtatgttgagacatcttaagattgatttgtggttctatatgccatattaaatcaaaataatagctgttaatggttttcac

SEQ ID NO: 23826 - DNA, 201 bp, Homo sapiens; identical to SEQ ID NO: 4247

SEQ ID NO: 23827 - DNA, 201 bp, Homo sapiens; identical to SEQ ID NO: 4246

SEQ ID NO: 23828 - DNA, 201 bp, Homo sapiens; identical to SEQ ID NO: 4233

SEQ ID NO: 23829 - DNA, 201 bp, Homo sapiens
agagcatgtcgttttgaggtatttgcccaccgttgtgaaatccgtgccacccgagagcaggtcctgatgtggggctttcagaagtgggacctggggccgtrcgcagtccttagggaggggccgtgtggcgttgtgcgtgtgaggggatagcacagggtgaggtgggggcccaagaaggaagtgacccacaaagaacagcct

SEQ ID NO: 23830 - DNA, 201 bp, Homo sapiens
aatctaggctagtctgtctatccctttcaacttttgtgaggctgcacaaatgtaaaatgttgaataaaaagcactgatggaagtgtgtagaaattcttctstttgttctgttgtaattttagttgcagtgcagcctggagagcagcttcttagtccagaaagaaggacaaataccccaaaagccatcagcgaggaggagga

SEQ ID NO: 23831 - DNA, 201 bp, Homo sapiens
tgggcacctgggaggacaaatgcctgtagaggccgggagtgacggcaggtgttcatgaaaagagaccttgtggggagggcaacacaacagtgtgttctgaygtactgaagagctcaactgaaaacaacaggagaattagcccaaaatccatttactaaaattgtttatctttttttttttttttgagacaaagtctcgctg

SEQ ID NO: 23832 - DNA, 201 bp, Homo sapiens
cacaggttttcccctttggacttctgttacctgcctgggcaccctcacagcctcccccttcacctggtgaacttccaataggccttccaaatatagctaakgtctcgatcagcataacccccatgtcccgaccccatctgaaatggagtcctccccacttcccggccccattcagagtggagtctctccgacatcccgtcc

SEQ ID NO: 23833 - DNA, 201 bp, Homo sapiens
tgtgctgccagggctcccagtagggccagttcatggcactcagctggaaagtccactgttgggaggcattcttaaccatccactctgtgccgtatgtagtkgggtctggtcattctgttggaggagacagaccagtgacgacatttgaaatgcttggtggatgtcttaggcctgttacgatgactgagcactgtgggggca

SEQ ID NO: 23834 - DNA, 201 bp, Homo sapiens
gtccttcccatgctattggggtggagaggtaatgtctgtgcccatatcacagccagtgctcccaaatctctgagaagttcatgggcctctgaagaagaagscaacccagcagccaccaagcaagaggaggtctggccagccctgggggaccgggccctggtgcccatggtggagcagctcttctctcacctgctgaaggtg

SEQ ID NO: 23835 - DNA, 201 bp, Homo sapiens
agtgcctccactgagtgcctcagatgagtctaggaagagctgtaccgttgggatggccacaatgattctgaccctgctctcgtcagcttggttcccattgvatctctcagcccatcaagatgctttgattttggccggaaacttgcttgcaggtactggtactgagttgaaacagggactccaggacttggattttgattt

SEQ ID NO: 23836 - DNA, 201 bp, Homo sapiens
tttcccctcagataatttcctttgtttaaactcagaactggcattttctctcttggagaagattcaggacaaatactcctttaagataagtagaagcagtkaaagaggatttgattatcaggaatttgataagcttagaataaattgttgcttcttaatgtcatttcagaagatgaatatttattaatagatgccaactga

SEQ ID NO: 23837 - DNA, 201 bp, Homo sapiens; identical to SEQ ID NO: 4190

SEQ ID NO: 23838 - DNA, 201 bp, Homo sapiens
gcagagtgtatctagaattgaggcctccaccattgcggagaggacatggatgctgagcagtcccctgagtgaaggttataaagaagcaaatagactacacrtgtctgtaaactgctcttgagtgtcccaaatttggggtacttcagttcagctgtaggaaaagcctcaaactgtttatactttgcaagaattggaaacttc

SEQ ID NO: 23839 - DNA, 201 bp, Homo sapiens
aagaggctgaagtgatttttgtctagggaggcaggaaaggcttcctggagtcagcagccagtaggtgaaagagtagattggagaccttcttaatcatcacygcctcttgtctcaaggggtgccaggaagctgtggaggctgaacccatcttatgctgccagagagtgggacaccatgagggtcaggtcaaggggttgtacc

SEQ ID NO: 23840 - DNA, 201 bp, Homo sapiens
caggcatgagccaccatacctggccagtgttgatattttaaatacggtgttcagggaaggtccactgagaagacagcttttttttttttttttttttgggktggggggcaaggtcttgctctttaacccaggctggaatgcagtatcactatcgtagctcacttcagccttgaactcctgggctcaagtgatcctcccacc

SEQ ID NO: 23841 - DNA, 201 bp, Homo sapiens
agagtctgcagtgagttgagatcacgccactgcactccagcctgggtgacagagcgagactctatctcaaaaaaaattttttttaatgtattatttttgcrtaagtaatacattgacatgatacaaattctgtaattacaaaagggcaataattaaaatatcttccttccacccctttcctctgagtacctaactttgtcc

SEQ ID NO: 23842 - DNA, 201 bp, Homo sapiens
ctcccaggctcaagtgatccttctgcctcagccttctcagtagttgggactacaggcatacccaccatgcccagctaattttttgatttttttttttttttgagacagagtctcagcctgtcgcccaggctggagtgggttggcgcgatctcagctcactgcaacttctgcctcccaggttcaagtgattctcctgcctca

SEQ ID NO: 23843 - DNA, 201 bp, Homo sapiens
aaacgtttctgagatgtttttactcctcagaatttcccagaatgtgatctggttttgattttcaagcttgctgacccaataggttaacccacaagttttaygaagaccatctcagtccacttacatcaactgcccatgccacggttaaagagatcatcgactgatgtttggcacagcttcctccctcttgggtgggcaagc

SEQ ID NO: 23844 - DNA, 201 bp, Homo sapiens
gaatgtgatctggttttgattttcaagcttgctgacccaataggttaacccacaagttttacgaagaccatctcagtccacttacatcaactgcccatgcyacggttaaagagatcatcgactgatgtttggcacagcttcctccctcttgggtgggcaagcatttggaagagaaggctcctatgggtgagagtggggcac

SEQ ID NO: 23845 - DNA, 201 bp, Homo sapiens
tctttactagttattttcctctaggcaaactgcccaacagctctaagctatttccttcgtattctgaaaaataagccttaatgggacccatatagggcaaytctgagagtaaaataaaggaatatgtgttagagtgtagcatagtcacccacgggaagggcttagatgttagctgctactgctcttattagctgaatgatt

SEQ ID NO: 23846 - DNA, 201 bp, Homo sapiens
ataagtcttttcctcttgagtcagctagtatccctggaaggaaattactcattttcctgcttggaggctataagcttggctatgtttatcctgcaaccggrgactggaagggaggggactgacagtgttgctggtcagggtgccctcttactttttgttttctgtgtgcatctcacgtctgtcctcagcctatgtaaacac

SEQ ID NO: 23847 - DNA, 201 bp, Homo sapiens
tgggtatacaatggtgagtatttcagctgcagcttctgccccgtggaggctgtggcctagcacactggtctaggcacggtggtatatgctcactcaaggaratagggacgtggtcgtttggggtgtcggaacaaaatgtcggaacttctctttccaatgcagagaaaccttgcagtaattctaatgtactgtgattggcag

SEQ ID NO: 23848 - DNA, 201 bp, Homo sapiens
tgagtatttcagctgcagcttctgccccgtggaggctgtggcctagcacactggtctaggcacggtggtatatgctcactcaaggagatagggacgtggtygtttggggtgtcggaacaaaatgtcggaacttctctttccaatgcagagaaaccttgcagtaattctaatgtactgtgattggcagttgacttcagttct

SEQ ID NO: 23849 - DNA, 201 bp, Homo sapiens
cagcctcattttaagcaattggattttttgaactttacttaaaatgttatgtcagggtttttattgtgcttaatgtgtgccatttagctaagttttgtagsatacgaaattgtaagtggcttaaaatgattcttaatagaatcatgaattgaagataatgctaataatttaagcactgagttaggtagtgtttgtaaaatg

SEQ ID NO: 23850 - DNA, 201 bp, Homo sapiens
gtggggcctggagaagttcagtcatgagccgtcacttatgggcacgtggaatctgacccggcacagagttgggagaagacaggagctttatagacagaaartgtggtctttgctaagtcccaggagtgaaagggtgagacagtgctcacagcacacgagtgtgggtgcgtagacagagcaagggtgggtcctgaaaaggcc

SEQ ID NO: 23851 - DNA, 201 bp, Homo sapiens
aatttgtgatccaagtatgaagcaaaataaggtgcagaataaattttaagcaagtaatagattagagtaagagaacccatttgaccattaaccttgggacrttctctttcaaatgacatggagtagtactgaaatctttctttctttctgagtctaggttattgtgactggactcagaaagaaatatttcattattgcagt

SEQ ID NO: 23852 - DNA, 201 bp, Homo sapiens
cagtaagccttgattgtgccgctgcactccagcctgggtgacagagtcagactctttccaaaagaagaaaaaaatgtgaccatgtgttttatagctctttyagtatcatcagtcactgttatccctaagagggaaatacctagctttagttttaggtttccagcattagccaagaaagctcagaattgatgttcctggcca

SEQ ID NO: 23853 - DNA, 201 bp, Homo sapiens
ctatagacattgaaaccataacaagcacttttctaagatcagggagtgagtaagtagcagagctaggacctcaattccacatgtcagtcatcttgccttcwctctgctccatgatggctgcctcctagagcattgggagtctcgatgttctatatgctctcatgtgttgtgtattggagatagttgaggctttatgaatac

SEQ ID NO: 23854 - DNA, 201 bp, Homo sapiens
tggtgtacagttcacaaagcttaaaaaaatgctacctgccatttcatcctcagtgaggaaggtgatacacagagagaccaagtgactgtgtccacggcgayggcgctctgcatttcactttagcggttaatgtactctacctatatttttactttatatttaccatatatcttttcatgtatacttggcgtaagtgcttta

SEQ ID NO: 23855 - DNA, 201 bp, Homo sapiens
tggtttggatttgatgccaggaggagacagcctcatttctaaggactagtcttgcctttgtgggataagggtggtgtgttctgtgtccttctacatgtccragcgatctctgtgcagctcaaatgtggtcactgtcttattgcgctgatttcctctccttccatctcacaattgaggcaaaatattgttactgttgaagtg

SEQ ID NO: 23856 - DNA, 201 bp, Homo sapiens
ggagcgctcccttccccccgcacttcccacactctgcagttattctgagatccttgagggcagggaacaggtttgtcttctttgtgttctcagaaattaawgctcggcctctggtcagcaagcaacaaccttttgttgagtgataatgaataaataaatgtttcccacatgagtattcagtaacctcagtgtcaggttcag

SEQ ID NO: 23857 - DNA, 201 bp, Homo sapiens
tggtggatatttaaaagaaaattccgcttttcctacagaaaaaaaaaaaaatccaaatcccagtgatttaagccagttatagacttagacatatactacgrcttttcatgcactttcctcccaattctagagtaggtattttactaggaaaatggtggcagtgcctgttgggaggaagattctttggccaagtgtcttttg

SEQ ID NO: 23858 - DNA, 201 bp, Homo sapiens
tctctggctgtcagagctcagatgatagatggtatttttgtactcttagttctcatcattttcatgatttcgatcaccatttgagtatgatgatgctaacrctttgttgaacgtagaatccgttaattacttccttcctgaacctttggcattaaaaaaaatctattctgctacctctctgctcatttatggttattcaaa

SEQ ID NO: 23859 - DNA, 201 bp, Homo sapiens
ggttcctgcgggttctctgtaggtcagttgacagtttctcctgttgtttgggtaactgtggaaacgaacactggcaagtgctgaagcgagcatgtggacgygcgatatgaaataacgacctggctttcaaaggcagtgaggctctctggaaaggaccttgctgagctagggatgtgggtgtgtagccattcccagtgggcc

SEQ ID NO: 23860 - DNA, 201 bp, Homo sapiens
caccaaccttggcctgccaaagtgctggcattacaggtgtgagccacctcgcctggcctattcatcactaatcagaatttctatgatcaaatgacatgaaycattgtttccacaactgcagtggaaggaaatggcctggcagtgccagtttcagaagcagcctgcccccagtcaggcacaggccactgtgcccccagtgta

SEQ ID NO: 23861 - DNA, 201 bp, Homo sapiens
tcacctgtcaataattcagagatcaacaccttttccttttgtttttcaggattaagaaagaatggtgggatcagattcccaacccagcccgcagccgcctsgtggctataataatccaggatgctcaggtaggagtaggcgtggatgaggacatgtgggactgtgtacatgaagaagtgtggttcagaacacctgggctgt

SEQ ID NO: 23862 - DNA, 201 bp, Homo sapiens
agaatgaataggagtttttcaagtgtcgaaactgaaccctgaccaacctttgcttttgcagacactggaagaattgtcttaccaagctcttgccctgtttyctggagcacaacatgaaaagggatgaagatcctcacaaggctgccaaagagatgcctttccagggctctggaaaatcagcatggtgcccagtggagatca

SEQ ID NO: 23863 - DNA, 201 bp, Homo sapiens; identical to SEQ ID NO: 4454

SEQ ID NO: 23864 - DNA, 201 bp, Homo sapiens; identical to SEQ ID NO: 4462

SEQ ID NO: 23865 - DNA, 201 bp, Homo sapiens; identical to SEQ ID NO: 4452

SEQ ID NO: 23866 - DNA, 201 bp, Homo sapiens; identical to SEQ ID NO: 4448

SEQ ID NO: 23867 - DNA, 201 bp, Homo sapiens; identical to SEQ ID NO: 4470

SEQ ID NO: 23868 - DNA, 201 bp, Homo sapiens
aagtgatcttattctcatttcacagatgaggagactgaggctctgagtggactccagcctgccacggtctcccaccgagtcaggttggagcctgcacttargcccagagttatgcttctgtgtctcagatgcttgggggtccctgcccacaaaggtggcccccatgtctgtgtgtccccacccatccaggaatggtatggg

SEQ ID NO: 23869 - DNA, 201 bp, Homo sapiens
taaggaggctgtttccaatggctctgcttaactgagacctgagagtgattgctccatctgtggtggcatatgggctgaaactgcctagcagcatgtcagargtggggtgttcgcaggacatccttgtccaggttggcagttgagcttggcaggtgaccgctgagaccccttccaactccaccacttcaggaatctcttttt

SEQ ID NO: 23870 - DNA, 201 bp, Homo sapiens
aagcctcttctcccactgcatctgtgatctctcctgaaatgtagcacccacacatccctgagaagctagctgcggcacgtgtgtgtgcacatgggcatgcrtaagtctgggcgtgccttccacaacagattaaggatatcaatcctgacgccatgctgggatgttttagtgaatcttgacagggttgttgactcccctgtt

SEQ ID NO: 23871 - DNA, 201 bp, Homo sapiens
ccttcaagtgtgcccaagtcactcggagagcatccagcaggggcctagagctcctgaggtggccttaagttcttatgatgccccagacactgcacacagtrcttcagaggcaacacctccgttcctgtttgctgcaagcctgtgaggttagccttggaaccattcctgtgccacagaaacacagccagagcaccaaaagag

SEQ ID NO: 23872 - DNA, 201 bp, Homo sapiens
gtgacggacccaccagaaccccagacttcaccactaggcagcatatccagtgagaacagatctgaggcttgccatcaaaattgcacttgtaaggccgggcrctgtggtggctcgcggctgtaatcccagccctttgggaggccgaggtgggcagatcacttgaggtcaggagttcgagaccggcctggccaacatggtgaa

SEQ ID NO: 23873 - DNA, 201 bp, Homo sapiens
gtttccacccctgaacttaagtgcccaggaaggcgtattgagatgaggtgtgcttgctggaaggcatgcctgctgctgattgaaaaccgaactgggaacaktccttccattctgtgtccactggtcagctgctgcggctttggatggtcttgaccgtggaaggctgaccttcttctggtacccggagtccctgcaggaatc

SEQ ID NO: 23874 - DNA, 201 bp, Homo sapiens
ttaaaaagggcgagaggatttacaggaaactatcaggtcagtaatggcaggggccgtccacagtgggtggctgagtccccctatttttctgctggtgtgcrgggaggtcatttcctgccacccatgtttccccaccctgaatccaccttcctcacattcccattggagggacactctctggacatatgggacctggggtcc

SEQ ID NO: 23875 - DNA, 201 bp, Homo sapiens
ctgaaaataaggcaggagtggcttccccaggggaaactggggaagaggaagcaggactgtgctggctaaaatgccagccaggtttaagacgtggcaccagatgccagtcatgggattggattggtcagcatgcctgggctatggcttaggggtatgttggtgctcagggatgccacaggcctccagataccaggtctgagg

SEQ ID NO: 23876 - DNA, 201 bp, Homo sapiens
aggtccagagaggttatgtcacttacttaaggtcacacagccaggaagtggtagtagggactcttacccttgttttacagatgagattgaattatctcacraaaactcagaaaggttaaacaacttgcctaagtaacatacagctaattagtcgaggagcctgacgcatgttgctctagcctggtcacagttacagaggtg

SEQ ID NO: 23877 - DNA, 201 bp, Homo sapiens
tgaactcctgacctcaagtgatccacccacctcgttctcccaaggtgctgggtacaggcatgagccactgtgcctggccaattttcttacattttgtagagactggctgtcacttatgtagcccaggctgatcttgaacttctacccctttatctttattcatggcacttattaccatgaatgaatgacctcatataagca

SEQ ID NO: 23878 - DNA, 201 bp, Homo sapiens
actggggactcggcagtgaatgggacagaccctggctgtcaggatgacagacaatttaaaaagggacagatgtcccacgctggcttgtcctttgcaccccyggcacttcgtgaggagcagcggccagttcttgtatatagactggcccttggtgtacatttgtctgacgtttccaaatgatgtatgcatccttggcaggaa

SEQ ID NO: 23879 - DNA, 201 bp, Homo sapiens
tagagggttgtccaaggaaggccacatccagaagcatctcccaggacagttgttgtgtagctcaccctctggactttgtgggtctgggtgttgtttcatgwttatagagagagctctgtgaacgtggaggacctgttgtcggcagagacacaaatggccagggcatggctgggcagccgcagtggctcaggcctgtaatcc

SEQ ID NO: 23880 - DNA, 201 bp, Homo sapiens
aggaggccgaggcaggaggatcgcttgagcccaggagttcgaggtcagcttgggcaacatagggagaccttgtctctacaaataataaaatattagccagrtgtggcagtgcacgcctgtagccccagctactcaggaggccgaggtgggaggatcccttgaactcaggaggtcaaggctgcagtgaactgtgatcgcgcc

SEQ ID NO: 23881 - DNA, 201 bp, Homo sapiens
gaggtgggaggatcccttgaactcaggaggtcaaggctgcagtgaactgtgatcgcgccactccactccagcctgcgtgagaaagtgagaccctgtcaaamaaaaagagaaggtgatggggaaagaacacagaacagcataagagggggttggggaagctgggtggagtgggggggattgcagttgaaagtagggaagtca

SEQ ID NO: 23882 - DNA, 201 bp, Homo sapiens
tgagaaagtgagaccctgtcaaaaaaaaagagaaggtgatggggaaagaacacagaacagcataagagggggttggggaagctgggtggagtgggggggaytgcagttgaaagtagggaagtcagggaaggcctcattgagctgacttggaggaagcgggaaccgtgcagatgtctggggaaggctcattcttggcagaga

SEQ ID NO: 23883 - DNA, 201 bp, Homo sapiens
atggaggcgcctgagtggtctcatgctcaggtggtttagcaaactcagtgtacatcctgccaattccagtcctgccatggccactgacaagctaggagggygctgaaaggagaaggaccccgatgtctcctccagcccatccatctcctctctcccattggccaaacccaaccggaaactaaaggccaagggtacccggtg

SEQ ID NO: 23884 - DNA, 201 bp, Homo sapiens
gtacatcctgccaattccagtcctgccatggccactgacaagctaggagggcgctgaaaggagaaggaccccgatgtctcctccagcccatccatctcctstctcccattggccaaacccaaccggaaactaaaggccaagggtacccggtgatgaagactgtggtatcagcctcctgagcacagagagggcagaaagggg

SEQ ID NO: 23885 - DNA, 201 bp, Homo sapiens
catcctgccaattccagtcctgccatggccactgacaagctaggagggcgctgaaaggagaaggaccccgatgtctcctccagcccatccatctcctctcwcccattggccaaacccaaccggaaactaaaggccaagggtacccggtgatgaagactgtggtatcagcctcctgagcacagagagggcagaaaggggtgg

SEQ ID NO: 23886 - DNA, 201 bp, Homo sapiens
gccactgacaagctaggagggcgctgaaaggagaaggaccccgatgtctcctccagcccatccatctcctctctcccattggccaaacccaaccggaaacyaaaggccaagggtacccggtgatgaagactgtggtatcagcctcctgagcacagagagggcagaaaggggtggagacaaagaggggcgcagatagtgggc

SEQ ID NO: 23887 - DNA, 201 bp, Homo sapiens
ctagctcgagggcagaggcttggtgtgatggaatggcactccttaaactgctacatattttccctttaatttggccaagaacaagttgtcaagtttgtgtragataaaggtgcacttggttcgttcttgtctaatggcccccgcacccatgggtatttcttcagcttccacagtcatcccgacactagctgggaagctcca

SEQ ID NO: 23888 - DNA, 201 bp, Homo sapiens
atggtttgctgctgtttatatggtgttagaggggaggtcccatctccagggacatgttatgtaagatacagtggagcgcatggtgggagtgttggtccacrtggcacatggatacggctggaatactggactagaccagcagttctcacactttttggtctcaggaccctttttcacacttaaaaatgagtgaggacccaa

SEQ ID NO: 23889 - DNA, 201 bp, Homo sapiens
gtattatgatgaaaagagttttacctggtgggcccagaccacactttgagaaccactggactagacccttgattgaggagtacggtgttgagagtggagtyctctgtgatggtggatggaccaggacacatggcataggagtcaggtggttccctgggctactccatggtgcacaggatgcttcgttacactggtgcccag

SEQ ID NO: 23890 - DNA, 201 bp, Homo sapiens
ggtcagtgcggataactatacactggacctgtgggctgggcagcagctgctgtggaagggctccttcaagcccagcgagcatggtgagcagggcggagtgyggcaggggtggctgggtgtgttcccacagctgcctgggctgagggtggggtgggcaggggaggaggtggggtcatagcaacagcaggaggaagccgcctg

SEQ ID NO: 23891 - DNA, 201 bp, Homo sapiens
gcagcagctgctgtggaagggctccttcaagcccagcgagcatggtgagcagggcggagtgcggcaggggtggctgggtgtgttcccacagctgcctgggytgagggtggggtgggcaggggaggaggtggggtcatagcaacagcaggaggaagccgcctgtattttcccaaatctgatgggattcctgcccctgcctgg

SEQ ID NO: 23892 - DNA, 201 bp, Homo sapiens
cctcccacctttgaaacggagctggtcgcagtagaccaccaagcccccttcagcccagctgtttccacccctgaacttaagtgcccaggaaggcgtattgrgatgaggtgtgcttgctggaaggcatgcctgctgctgattgaaaaccgaactgggaacattccttccattctgtgtccactggtcagctgctgcggcttt

SEQ ID NO: 23893 - DNA, 201 bp, Homo sapiens
aacttaagtgcccaggaaggcgtattgagatgaggtgtgcttgctggaaggcatgcctgctgctgattgaaaaccgaactgggaacattccttccattctrtgtccactggtcagctgctgcggctttggatggtcttgaccgtggaaggctgaccttcttctggtacccggagtccctgcaggaatcccccttgagcttg

SEQ ID NO: 23894 - DNA, 201 bp, Homo sapiens
gcccaggaaggcgtattgagatgaggtgtgcttgctggaaggcatgcctgctgctgattgaaaaccgaactgggaacattccttccattctgtgtccactsgtcagctgctgcggctttggatggtcttgaccgtggaaggctgaccttcttctggtacccggagtccctgcaggaatcccccttgagcttgctgggctgt

SEQ ID NO: 23895 - DNA, 201 bp, Homo sapiens
gctgattgaaaaccgaactgggaacattccttccattctgtgtccactggtcagctgctgcggctttggatggtcttgaccgtggaaggctgaccttcttytggtacccggagtccctgcaggaatcccccttgagcttgctgggctgtggtgacaggagtttaaaacatgcgttgtattccagtgatgcatgatatgaca

SEQ ID NO: 23896 - DNA, 201 bp, Homo sapiens
tgacaggagtttaaaacatgcgttgtattccagtgatgcatgatatgacatgcatcacaggaataaaaacctgaggtctcatggatatgattgcttcaaargagaccaagttttaaaacagatgaatcaaaataaagaaaaatactcagtaaatcatcataaagtacagagatgtggccaaaggtgtgaaggatgcagctg

SEQ ID NO: 23897 - DNA, 201 bp, Homo sapiens
gcactttgggagcccagcgcaggcagatcacttgagccctgggctattgaggctgcagtgagctgggattgtgccactgcactccagcctgggcaacagartgggaccctgtctcaaaaaagaagaaaaaaagggtaattaataaacactaaagttctatgtagaattttagcaacattattgttattataatcttctttg

SEQ ID NO: 23898 - DNA, 201 bp, Homo sapiens
gtgagtgggcatgctttgacgtttttctgtgacctctggggaacagggtgggtgaccagcagaggcccagtccctggagccaggagcctgggaggcaagcyctggggctggatagcaaatcccaggagctagagacctggcttctcacctggctctgccctaggcaagtccctttgcttcctggccccccacccctcacat

SEQ ID NO: 23899 - DNA, 201 bp, Homo sapiens
acgtttttctgtgacctctggggaacagggtgggtgaccagcagaggcccagtccctggagccaggagcctgggaggcaagccctggggctggatagcaawtcccaggagctagagacctggcttctcacctggctctgccctaggcaagtccctttgcttcctggccccccacccctcacatcagagaaggggagttatc

SEQ ID NO: 23900 - DNA, 201 bp, Homo sapiens
ggaggcaagccctggggctggatagcaaatcccaggagctagagacctggcttctcacctggctctgccctaggcaagtccctttgcttcctggccccccrcccctcacatcagagaaggggagttatctctgcatgccgctcctcctctgtaaaggtagggctgtgggccacatctgtgtttcccagtttgggggacaca

SEQ ID NO: 23901 - DNA, 201 bp, Homo sapiens
gcctcggcctcccaaagtgctgggattacaggtgtgagccaccgcacctggccagtggagttccttcttaagtacatgtattgacatctttaaaaagggcragaggatttacaggaaactatcaggtcagtaatggcaggggccgtccacagtgggtggctgagtccccctatttttctgctggtgtgcggggaggtcatt

SEQ ID NO: 23902 - DNA, 201 bp, Homo sapiens
aggtgtgagccaccgcacctggccagtggagttccttcttaagtacatgtattgacatctttaaaaagggcgagaggatttacaggaaactatcaggtcartaatggcaggggccgtccacagtgggtggctgagtccccctatttttctgctggtgtgcggggaggtcatttcctgccacccatgtttccccaccctgaa

SEQ ID NO: 23903 - DNA, 201 bp, Homo sapiens
agtccccctatttttctgctggtgtgcggggaggtcatttcctgccacccatgtttccccaccctgaatccaccttcctcacattcccattggagggacamtctctggacatatgggacctggggtcccacagggctgcattccaatgcctgctgtgccactcgccagctgtgtgatgttgggcatatcccataacctctt

SEQ ID NO: 23904 - DNA, 201 bp, Homo sapiens
cctgccacccatgtttccccaccctgaatccaccttcctcacattcccattggagggacactctctggacatatgggacctggggtcccacagggctgcawtccaatgcctgctgtgccactcgccagctgtgtgatgttgggcatatcccataacctctttgtgcctcagtttcctcatctgtaacacaggagtgacaag

SEQ ID NO: 23905 - DNA, 201 bp, Homo sapiens
tgatgttgggcatatcccataacctctttgtgcctcagtttcctcatctgtaacacaggagtgacaagagcacccgcccacagggctatgacagtacaagktgtgtgatacagatgagctcccctgtttggcccacatgtgtcctaaaagccatgtgccctttctcttgagtgccccaggccacagagatccccatctgcc

SEQ ID NO: 23906 - DNA, 201 bp, Homo sapiens
tttatatctctcaggtctggtttcccctttggcactgggccaggtatggggaaagagcaggaatggggcagttggctcacacagcagaggctcagaaagcrgggggcatggggggaaggagtgcacagatgctagagagtggggcaagttttgtttggtcaataaatctccttctcatgccccaggcctgtgcaagaccta

SEQ ID NO: 23907 - DNA, 201 bp, Homo sapiens
cttgacggttctaataagagtcctaaggctgctgctcagtggcctggcttcgatgctgtgccagcctctgaaccaatcactggctgtgggtggagagaggrtgctggtggagggccctgcttgtccagggaggagtcacatacctgcctctagggctgcaggtgggctcagctccatccaaaccagatgaactgaaaataa

SEQ ID NO: 23908 - DNA, 201 bp, Homo sapiens
tggcttcgatgctgtgccagcctctgaaccaatcactggctgtgggtggagagagggtgctggtggagggccctgcttgtccagggaggagtcacataccygcctctagggctgcaggtgggctcagctccatccaaaccagatgaactgaaaataaggcaggagtggcttccccaggggaaactggggaagaggaagcag

SEQ ID NO: 23909 - DNA, 201 bp, Homo sapiens
gtggagggggagttttggcttgggcattgaaggatgcataggagttttctagatggggaaagaagggaacggtagaccaggcagagggaactgcatgatawaaggtttatgggtgtgaaaattcatggaatgtttgaggattatggggttgggggatgtgggaatatgtgtagcgataaagcaccaaacaaagccaaaagt

SEQ ID NO: 23910 - DNA, 201 bp, Homo sapiens
ccaggcagagggaactgcatgataaaaggtttatgggtgtgaaaattcatggaatgtttgaggattatggggttgggggatgtgggaatatgtgtagcgawaaagcaccaaacaaagccaaaagtttagttagagccctgaatgcctgcctcataatggtttccatattttatatgcctactatgtgccaggcacattgct

SEQ ID NO: 23911 - DNA, 201 bp, Homo sapiens
attttttgtatttttagtagcgacagggtctcgccatgttgtccgggctggtctggatctcctggcttcaagtgatccccctggctcagcctcccaaggtrctgggattacaggcttgagccaccgcatccagcccagatctgagatttgcacccagtatttgaactcccaagcctgtgctctttttcctcccatggacat

SEQ ID NO: 23912 - DNA, 201 bp, Homo sapiens
gggtctcgccatgttgtccgggctggtctggatctcctggcttcaagtgatccccctggctcagcctcccaaggtgctgggattacaggcttgagccaccrcatccagcccagatctgagatttgcacccagtatttgaactcccaagcctgtgctctttttcctcccatggacatttctctcagagatggtctcccaaac

SEQ ID NO: 23913 - DNA, 201 bp, Homo sapiens
ttaaaaaacagacaaaccgcaagtagttctttggaagctcagatttctcttttgtttcttagtaaaacatttcccagttcccagctcccttccagggtgtragatttcttcggtaacttacatctagctgttgcttcttgtttgctcatgtttagaaagaaagacaaaagagagtgagaattttctctcccttccccagtc

SEQ ID NO: 23914 - DNA, 200 bp, Homo sapiens
ccccaccctcagctccctctgtaataggaaaatctctgaactctctgtagttgctccagcaatcttttggaactttgcttctttcttgtgaaaaaacctcccttggctcactttgcaccaggtttccccaaatgtgcttccaaccacaagcagaaatggagctgccagtaaccaggaagaaactgccgggggctgaggaa

SEQ ID NO: 23915 - DNA, 201 bp, Homo sapiens
gttgggagtctggacatagcttagccaggttctctgctttagagtctcgtgaggctataatcaaggtgtgggatggggctgcagtttcatctgaggctcarttggggaagggtcacttctaagctcatacaatattggtgacattcagtccctggcaggctgttgaactgagagcctcagtttcgtgctggctgttggttg

SEQ ID NO: 23916 - DNA, 201 bp, Homo sapiens
ccagccccatctctctttaaaaaacaaacaaacaaacaaaaaacataaaaagaagcagagaacacatacacatctgcatcttcccttgtttacttaacaayagatcttggaagtcacttctcagtagaggctaggttgggcagagcattggattctaggccagtgagtttggacttgaccatggagacactaggaagccca

SEQ ID NO: 23917 - DNA, 201 bp, Homo sapiens
acaaaaaacataaaaagaagcagagaacacatacacatctgcatcttcccttgtttacttaacaatagatcttggaagtcacttctcagtagaggctaggytgggcagagcattggattctaggccagtgagtttggacttgaccatggagacactaggaagcccatgaaggacagagagagatgcctcgaccctgccagt

SEQ ID NO: 23918 - DNA, 201 bp, Homo sapiens
accctatttgaaatacttacgtatattaacccatttccttatcaccacaaccctgcgggaagggagataggcacttttattatcttcattttgcagatgasgacattgaggtccagagaggttatgtcacttacttaaggtcacacagccaggaagtggtagtagggactcttacccttgttttacagatgagattgaatt

SEQ ID NO: 23919 - DNA, 201 bp, Homo sapiens
tacagatgagattgaattatctcacgaaaactcagaaaggttaaacaacttgcctaagtaacatacagctaattagtcgaggagcctgacgcatgttgctstagcctggtcacagttacagaggtggcaagcaatggcctgaacaggacgaacaaccaaatacccaggctggtggctcttaaacatggtggggtcagctaa

SEQ ID NO: 23920 - DNA, 201 bp, Homo sapiens
cttgcctaagtaacatacagctaattagtcgaggagcctgacgcatgttgctctagcctggtcacagttacagaggtggcaagcaatggcctgaacaggaygaacaaccaaatacccaggctggtggctcttaaacatggtggggtcagctaacgacagcaaccagggtgggcactggtgcccctcgcccccggctggtgc

SEQ ID NO: 23921 - DNA, 201 bp, Homo sapiens
caatcctgccattagatacacctgccgtggtgtatctgccaggtaggcaggctaggctgcagtaacacacaagcccacaatttccatggcttaacactatrggaatatatttcttgctcacgtaacaagctaacgtgaatgttgctggtttgtaggtggtttccctccctgtagaaatctggggagtgaggttctttccat

SEQ ID NO: 23922 - DNA, 201 bp, Homo sapiens
cttgctcacgtaacaagctaacgtgaatgttgctggtttgtaggtggtttccctccctgtagaaatctggggagtgaggttctttccatcttgtggtgccrtcattctccaggacaaagattcttacctacttttgtgtcctggtttcctttggcagcctggtgaagcctatggacctcatttcagaatatttttaaatac

SEQ ID NO: 23923 - DNA, 201 bp, Homo sapiens
taacaagctaacgtgaatgttgctggtttgtaggtggtttccctccctgtagaaatctggggagtgaggttctttccatcttgtggtgccatcattctccmggacaaagattcttacctacttttgtgtcctggtttcctttggcagcctggtgaagcctatggacctcatttcagaatatttttaaatacataaaatccc

SEQ ID NO: 23924 - DNA, 201 bp, Homo sapiens
ctacttttgtgtcctggtttcctttggcagcctggtgaagcctatggacctcatttcagaatatttttaaatacataaaatcccagcctgggcaatatagwgaaacccccatctgtacaaaaattagccaggcatggtggcatgcacctgtagtcccaggtactgggaaggctgaggtgggaggatcacttgagcccagga

SEQ ID NO: 23925 - DNA, 201 bp, Homo sapiens
taatttcaaagtagataagcataaataatactttatgatactgaaattgtgatgtgatatgagaatagctgtgagttttgttttgctggggacaggatcastgatgctgtcattactggggtctcttccctccattctttttttaaaattgtattttattttatttttaaaattttaaaataaatagagacagggtatcac

SEQ ID NO: 23926 - DNA, 201 bp, Homo sapiens
gccaagtgatatctcttcccttctgctgtcttcccttctgccatccttcacatggtggcattgtatccttagacttgccacccatgccctcaggttggccrttgcacactgtcttacataaagcaggaaggaaaggaaaggctgctacgagagagtgtaccttgtgcatctcttttttaatcaggaagcaaacatctttct

SEQ ID NO: 23927 - DNA, 201 bp, Homo sapiens
atatctcttcccttctgctgtcttcccttctgccatccttcacatggtggcattgtatccttagacttgccacccatgccctcaggttggccgttgcacaytgtcttacataaagcaggaaggaaaggaaaggctgctacgagagagtgtaccttgtgcatctcttttttaatcaggaagcaaacatctttctagaagctt

SEQ ID NO: 23928 - DNA, 201 bp, Homo sapiens
atctcttcccttctgctgtcttcccttctgccatccttcacatggtggcattgtatccttagacttgccacccatgccctcaggttggccgttgcacactrtcttacataaagcaggaaggaaaggaaaggctgctacgagagagtgtaccttgtgcatctcttttttaatcaggaagcaaacatctttctagaagcttcc

SEQ ID NO: 23929 - DNA, 201 bp, Homo sapiens
tgtaccttgtgcatctcttttttaatcaggaagcaaacatctttctagaagcttccctagcaaaattccccttacatctcattggccaagactgttacatrttacatggttactgttattacttgctcattgcaaggaagactgggaactcaaatgcctggaaaaaggaacaggataatcgtgattggctcaagccttagg

SEQ ID NO: 23930 - DNA, 201 bp, Homo sapiens
gggcatggctccctgacaagggagagaggaaaaagctgttgagtgaagaagactgcttcagtttccccatctgtataatgggaggagtaagggctgtcgtraaaactcaatgaaagaagattcttcaacgtggtaggtgcagtggcagctggcagtaccctgaccctgccaccgcacagccctctcagcattgctcatcct

SEQ ID NO: 23931 - DNA, 201 bp, Homo sapiens
aagattcttcaacgtggtaggtgcagtggcagctggcagtaccctgaccctgccaccgcacagccctctcagcattgctcatcctgcactgtggatatcarttgagccacgtgtctcctgccctgggctgtgagctccataggcagggtctccatggctgtatctccagaacccagcacagaaccaggtgcttgggaaagt

SEQ ID NO: 23932 - DNA, 201 bp, Homo sapiens
atgaggatgcggaggcacagagaagataagggacttgtcctgtgtcacacagcaaggagccatccggctcctaagttggtgcatttgacttctgtgcttcyggaaagaaagagcagcaagtttaagatctggaggtggcactgagctttggaggagcagggggcaatgaggtggccggtgtgacgaggactcaatgtgcaa

SEQ ID NO: 23933 - DNA, 201 bp, Homo sapiens
gtggaggggtggtcggcggtcagatcgtggagggtctcggacgagggtcctgaccctgggtctccagtcctgggaagtggagcccaggctgtaccatggckgacctcagctcatggcttcccctcccacttccagcctacagggagcccttcgagcagcacctcctgctgggcgtcagcgtttcctgcattgtcatcctgg

SEQ ID NO: 23934 - DNA, 201 bp, Homo sapiens
cagcctacagggagcccttcgagcagcacctcctgctgggcgtcagcgtttcctgcattgtcatcctggccgtctgcctgttgtgctatgtcagcatcacsaagtgagtcctgggcccagtgctgccgagcagtccctctggagtgcagggtggcagggacttgcccctctagtctgcccctttgcagtcctctcagtcaa

SEQ ID NO: 23935 - DNA, 201 bp, Homo sapiens
aactcctgacctcatgatctgcctgcctcagcctcccaaagtgctgggattacaggtgtgagccactgcacccaaccaggactccacatttctaaaaccgscatcctactggggagactgaaaatacatatcaatcacaaacaggtggttttccatagtgacccactctctgaatgcactagaccagggtggaggccagag

SEQ ID NO: 23936 - DNA, 201 bp, Homo sapiens
tatcaatcacaaacaggtggttttccatagtgacccactctctgaatgcactagaccagggtggaggccagagatcttctggggtgctttttgcaaggggsaccaggataaggctctccaaggagggaaaatttgaggggggccctgactggggagaatgagctggccagggataagcaagatggagtcatcccacatccc

SEQ ID NO: 23937 - DNA, 201 bp, Homo sapiens
aatgcactagaccagggtggaggccagagatcttctggggtgctttttgcaagggggaccaggataaggctctccaaggagggaaaatttgaggggggccytgactggggagaatgagctggccagggataagcaagatggagtcatcccacatccccttacaacactgggtgcctgggcaactgggggcatttgggggca

SEQ ID NO: 23938 - DNA, 201 bp, Homo sapiens
ggggggccctgactggggagaatgagctggccagggataagcaagatggagtcatcccacatccccttacaacactgggtgcctgggcaactgggggcatytgggggcatgtggtaggagccagaggaatttgcgacgattgccctgatggagtcaggagacctgggtttgaatcctggccttggagcttggtagctggcg

SEQ ID NO: 23939 - DNA, 201 bp, Homo sapiens
tttgggggcatgtggtaggagccagaggaatttgcgacgattgccctgatggagtcaggagacctgggtttgaatcctggccttggagcttggtagctggyggccgacaagttgctgaaacccctgagcctggggttcctgctttgcagagtgacagtgatggtgagaacatatttcatcagccagaagaggccaaatcac

SEQ ID NO: 23940 - DNA, 201 bp, Homo sapiens
ggctgaagtgcagtggcgcggttacggctcactgcagcctccaattcctgggctaaagagatcctcccatttcaacttccagagcagctgggacaacaggygcttgccaccacacctggctaattttcttattttaatttaattttattttattttttgggacagagtggagtctcaaaaaccaagctagagtgcagtggt

SEQ ID NO: 23941 - DNA, 201 bp, Homo sapiens
atagaaggtgctcaataaatatgtgtttatttattgaaaccatgggcagaggctaattcagaagcggtctgaggaccttacctcccagtgatgatgcaccrtggccccaggcaggccaggaagagagaagggttgtgtttctccgtaggtcccccagcttcccaggccatcccaggccattccctggtcatttgccctcag

SEQ ID NO: 23942 - DNA, 201 bp, Homo sapiens
acatgaagaagtgtggttcagaacacctgggctgttaaggaccttcactggcttctggaatggcaaatagacagtcaggagggttgcaggggagacagagrcagaagccgaatgaggtcattagcagaccagaggctttcccgcccttccccttggcaatcccagcctggggtgggcttctctggggttggtttcctgttt

SEQ ID NO: 23943 - DNA, 201 bp, Homo sapiens
gtgtaacaaatgaccccgaaatgtagagggttacaacaactttatttagcttatgcttctgcaggctggcatttggggctgggctcagcagtgagggtggygggggaggctgggctgggctgggctgggcagatctgaattgagctgacccgtccccgtagcctccctccgtgtctgacagttggcttttttttttttttt

SEQ ID NO: 23944 - DNA, 201 bp, Homo sapiens
ggatgggaggagattcagagcactcctctgtggccacttttgccatcgaccacagtccctgtaaatattaggacaatgtaattaattcccaggaatctgargctcagaaagcgtaagtgacctgttggacttctgatctgtgtgatgtcgaggcttgtaccccttcctgagcattgccgtactccaggccgggctgcaagg

SEQ ID NO: 23945 - DNA, 201 bp, Homo sapiens
tctgccttctcttccctgcattcggtaattgccctgtgacattagccttcaagggacggcaggaggaggggtgttctggaaacgtggactgctggccaagmcccctgagtttcactggtgtgtcaggtacatggtgataccccttgggagtgctgttatagttaacaaccagagcagccgtgcctgttgttaaaatcttga

SEQ ID NO: 23946 - DNA, 201 bp, Homo sapiens
aaacgtggactgctggccaagccccctgagtttcactggtgtgtcaggtacatggtgataccccttgggagtgctgttatagttaacaaccagagcagccktgcctgttgttaaaatcttgacctaattgtatacttgtcggcaaatagccactatcctgaacactcccctccttttttttaatatacaggatctcactct

SEQ ID NO: 23947 - DNA, 201 bp, Homo sapiens
cctgagctcaagtgatcctcccatcttagcctcccgagtagctgatactacagatgtgcattaccacgcctggctattttaaaaggtttttgcctgtaatbccagctactcaggaggctgaggcatgagaatcacttgaacccgggaggcagaggttgcagtgagcgcagattgtgccactgcactccagcctgggcgaca

SEQ ID NO: 23948 - DNA, 201 bp, Homo sapiens
ttctctagcctcagccttctaagtagctgggactacagtcatacaccaacatgcccagctaattttccttttttttaattcttgtagagatgtttgagacrgcttgggctctgttgcccaggctgttctcaaactcctgagctcaagcgatcctccctcctcagcctcctaaagtgctgggattacaggcgtgagccaccg

SEQ ID NO: 23949 - DNA, 201 bp, Homo sapiens
cctgagctcaagcgatcctccctcctcagcctcctaaagtgctgggattacaggcgtgagccaccgcacccggcttccatatcctttctaattggtcatgrcttgggataatggtgttgcttttaattatcatcatccataaagactttttcttactcaacagatctgagcttgtatttggtgcccaggacatgtgctggg

SEQ ID NO: 23950 - DNA, 201 bp, Homo sapiens
cgcacccggcttccatatcctttctaattggtcatggcttgggataatggtgttgcttttaattatcatcatccataaagactttttcttactcaacagayctgagcttgtatttggtgcccaggacatgtgctgggttcccgaaatcccaaagacacagaccctaccctcagggatttctcattctagcaacatagactg

SEQ ID NO: 23951 - DNA, 201 bp, Homo sapiens
ttcccgaaatcccaaagacacagaccctaccctcagggatttctcattctagcaacatagactgatcaattactgattataacgttagaaggcatgtctgmagtagacagccatcaggacatggtgatttcaggctgggctttgaagaatgaataggagtttttcaagtgtcgaaactgaaccctgaccaacctttgcttt

SEQ ID NO: 23952 - DNA, 201 bp, Homo sapiens
acaagttgtcaagtttgtgtgagataaaggtgcacttggttcgttcttgtctaatggcccccgcacccatgggtatttcttcagcttccacagtcatcccracactagctgggaagctccagcagccctggtcctggccccagctctgtgggcgctggccctcaactttgcctgcactgtgcttttgtgctattccccttg

SEQ ID NO: 23953 - DNA, 201 bp, Homo sapiens
gcagaggcccagtccctggagccaggagcctgggaggcaagccctggggctggatagcaaatcccaggagctagagacctggcttctcacctggctctgcmctaggcaagtccctttgcttcctggccccccacccctcacatcagagaaggggagttatctctgcatgccgctcctcctctgtaaaggtagggctgtggg

SEQ ID NO: 23954 - DNA, 201 bp, Homo sapiens; identical to SEQ ID NO: 4467

SEQ ID NO: 23955 - DNA, 201 bp, Homo sapiens; identical to SEQ ID NO: 4463

SEQ ID NO: 23956 - DNA, 201 bp, Homo sapiens; identical to SEQ ID NO: 4469

SEQ ID NO: 23957 - DNA, 201 bp, Homo sapiens; identical to SEQ ID NO: 4471

SEQ ID NO: 23958 - DNA, 201 bp, Homo sapiens; identical to SEQ ID NO: 4472

SEQ ID NO: 23959 - DNA, 201 bp, Homo sapiens
gagtttggacttgaccatggagacactaggaagcccatgaaggacagagagagatgcctcgaccctgccagtcctttagaaagatcacccagtgctttttrtataccaaaccctatttgaaatacttacgtatattaacccatttccttatcaccacaaccctgcgggaagggagataggcacttttattatcttcatttt

SEQ ID NO: 23960 - DNA, 201 bp, Homo sapiens
tggtgccatcattctccaggacaaagattcttacctacttttgtgtcctggtttcctttggcagcctggtgaagcctatggacctcatttcagaatatttwtaaatacataaaatcccagcctgggcaatatagtgaaacccccatctgtacaaaaattagccaggcatggtggcatgcacctgtagtcccaggtactggg

SEQ ID NO: 23961 - DNA, 201 bp, Homo sapiens
tttatttttaaaattttaaaataaatagagacagggtatcactatgttgcccaggctgcttttgacctcctgggctccagtgatcttcccatcttggcttyccaaagtgctgggattacaagtgggagccagtgttcctggccccttcctccattcttaatggaaggagatgctaggtgtgagaggttagggaaagtaaag

SEQ ID NO: 23962 - DNA, 201 bp, Homo sapiens
tgaaacagataacaatgtatgggaccctcattcattatttcagcaaatatttgctgagttcctcctacatggctagccctgtgctagacactggggaatcrgcgatgaacaaagcagatagaaatccccactcttgtggagctgacattctggagggagagacaaaaagcaaacatataaagaaagaaagaaatcacatgg

SEQ ID NO: 23963 - DNA, 201 bp, Homo sapiens
tcctactggggagactgaaaatacatatcaatcacaaacaggtggttttccatagtgacccactctctgaatgcactagaccagggtggaggccagagatsttctggggtgctttttgcaagggggaccaggataaggctctccaaggagggaaaatttgaggggggccctgactggggagaatgagctggccagggataa

SEQ ID NO: 23964 - DNA, 201 bp, Homo sapiens
tgtatacttgtcggcaaatagccactatcctgaacactcccctccttttttttaatatacaggatctcactctgtggcccaggctggtgtgcagtggtgcratcatagctcactgcaccttcaaactcctgagctcaagtgatcctcccatcttagcctcccgagtagctgatactacagatgtgcattaccacgcctggc

SEQ ID NO: 23965 - DNA, 201 bp, Homo sapiens
acatgcccagctaattttccttttttttaattcttgtagagatgtttgagacggcttgggctctgttgcccaggctgttctcaaactcctgagctcaagcratcctccctcctcagcctcctaaagtgctgggattacaggcgtgagccaccgcacccggcttccatatcctttctaattggtcatggcttgggataatgg

SEQ ID NO: 23966 - DNA, 201 bp, Homo sapiens
ggaagggctccttcaagcccagcgagcatggtgagcagggcggagtgcggcaggggtggctgggtgtgttcccacagctgcctgggctgagggtggggtgrgcaggggaggaggtggggtcatagcaacagcaggaggaagccgcctgtattttcccaaatctgatgggattcctgcccctgcctgggcctcagtcctccc

SEQ ID NO: 23967 - DNA, 201 bp, Homo sapiens
ttgtcggtgtactccctgccatccatctgcccagaaatactgtgaatgtgggcagcgcaggactggttcctccaagccccattttacagacagtccaatcrttttacatattattttatgaatgagcaccttcctcagtgtctcagaccaggggtccccacacagcagggccacacagcaggaggtgagtggcgggtgagt

SEQ ID NO: 23968 - DNA, 201 bp, Homo sapiens
gctgaagacacacctgccatttagatcgatccacttttttacattgtcggtgtactccctgccatccatctgcccagaaatactgtgaatgtgggcagcgyaggactggttcctccaagccccattttacagacagtccaatcattttacatattattttatgaatgagcaccttcctcagtgtctcagaccaggggtccc

SEQ ID NO: 23969 - DNA, 201 bp, Homo sapiens; identical to SEQ ID NO: 4465

SEQ ID NO: 23970 - DNA, 201 bp, Homo sapiens; identical to SEQ ID NO: 4459

SEQ ID NO: 23971 - DNA, 201 bp, Homo sapiens
tgccaccacgccaggctaattttgtatttttaatagagatggggtttcttcatgttggtcaggctggtctggaactcctaatatcagatgatccacccacytcagcctcccaaagtgctgggattacaggcgtgagccactgcacccagcctagttggctgacttttacctgggacagtgcaggtgcctgagccatgtgcc

SEQ ID NO: 23972 - DNA, 201 bp, Homo sapiens
gtgccaccacgccaggctaattttgtatttttaatagagatggggtttcttcatgttggtcaggctggtctggaactcctaatatcagatgatccacccayctcagcctcccaaagtgctgggattacaggcgtgagccactgcacccagcctagttggctgacttttacctgggacagtgcaggtgcctgagccatgtgc

SEQ ID NO: 23973 - DNA, 201 bp, Homo sapiens
gattacaggcatgtgccaccacgccaggctaattttgtatttttaatagagatggggtttcttcatgttggtcaggctggtctggaactcctaatatcagrtgatccacccacctcagcctcccaaagtgctgggattacaggcgtgagccactgcacccagcctagttggctgacttttacctgggacagtgcaggtgcc

SEQ ID NO: 23974 - DNA, 201 bp, Homo sapiens
aattttcttgcctcagcctcccaagtagctgggattacaggcatgtgccaccacgccaggctaattttgtatttttaatagagatggggtttcttcatgtyggtcaggctggtctggaactcctaatatcagatgatccacccacctcagcctcccaaagtgctgggattacaggcgtgagccactgcacccagcctagtt

SEQ ID NO: 23975 - DNA, 201 bp, Homo sapiens
gacagttggctttttttttttttttctttttctgagacggagttttgctcttattgcccaggagtgcaatggcgtgatcttggctcactgcaacctctgcytcctgggttcaagcaattttcttgcctcagcctcccaagtagctgggattacaggcatgtgccaccacgccaggctaattttgtatttttaatagagatg

SEQ ID NO: 23976 - DNA, 201 bp, Homo sapiens
gtctgacagttggctttttttttttttttctttttctgagacggagttttgctcttattgcccaggagtgcaatggcgtgatcttggctcactgcaacctstgcctcctgggttcaagcaattttcttgcctcagcctcccaagtagctgggattacaggcatgtgccaccacgccaggctaattttgtatttttaataga

SEQ ID NO: 23977 - DNA, 201 bp, Homo sapiens
ccgtccccgtagcctccctccgtgtctgacagttggctttttttttttttttctttttctgagacggagttttgctcttattgcccaggagtgcaatggcrtgatcttggctcactgcaacctctgcctcctgggttcaagcaattttcttgcctcagcctcccaagtagctgggattacaggcatgtgccaccacgccag

SEQ ID NO: 23978 - DNA, 201 bp, Homo sapiens
acggtgtttcaccatattggccaggctggtctcgaacttctgacctcaggtgatacacctgccttggcctcccaaagtgctgggattacaggcgtgagccrccatgcctggcctcatataagcatttctgtctccatttatcatccatctttccctcttgaaggtcagtttcaccaaggcaggcatctttgtctcgttcac

SEQ ID NO: 23979 - DNA, 201 bp, Homo sapiens
agtagagacggtgtttcaccatattggccaggctggtctcgaacttctgacctcaggtgatacacctgccttggcctcccaaagtgctgggattacaggcrtgagccgccatgcctggcctcatataagcatttctgtctccatttatcatccatctttccctcttgaaggtcagtttcaccaaggcaggcatctttgtct

SEQ ID NO: 23980 - DNA, 201 bp, Homo sapiens
tttagtagagacggtgtttcaccatattggccaggctggtctcgaacttctgacctcaggtgatacacctgccttggcctcccaaagtgctgggattacargcgtgagccgccatgcctggcctcatataagcatttctgtctccatttatcatccatctttccctcttgaaggtcagtttcaccaaggcaggcatctttg

SEQ ID NO: 23981 - DNA, 201 bp, Homo sapiens
gaactcctgacctcaagtgatccacccacctcgttctcccaaggtgctgggtacaggcatgagccactgtgcctggccaattttcttacattttgtagagactggctgtcacttatgtagcccaggctgatcttgaacttctacccctttatctttattcatggcacttattaccatgaatgaatgacctcatataagcat

SEQ ID NO: 23982 - DNA, 201 bp, Homo sapiens
tgggacaacaggcgcttgccaccacacctggctaattttcttattttaatttaattttattttattttttgggacagagtggagtctcaaaaaccaagctrgagtgcagtggtgcgatctcgactcactgcaatctctgcctcccgggttcaagcgattctcctgccttagcctcccgactagctgggattacaggcgtgt

SEQ ID NO: 23983 - DNA, 201 bp, Homo sapiens
tcctgggctaaagagatcctcccatttcaacttccagagcagctgggacaacaggcgcttgccaccacacctggctaattttcttattttaatttaatttwattttattttttgggacagagtggagtctcaaaaaccaagctagagtgcagtggtgcgatctcgactcactgcaatctctgcctcccgggttcaagcgat

SEQ ID NO: 23984 - DNA, 201 bp, Homo sapiens
acaatcttgcctaacagtaacctccgcctcccgggttcaagcaattcttctgcctcagcctccagagtagctgggattacaggcgcatgccactatgcccrgctaattttttgtatttttggtagagatggggtttcaccatgttggtcaggctggtctcgaactcctgacctcatgatctgcctgcctcagcctcccaaa

SEQ ID NO: 23985 - DNA, 201 bp, Homo sapiens
cacaatcttgcctaacagtaacctccgcctcccgggttcaagcaattcttctgcctcagcctccagagtagctgggattacaggcgcatgccactatgccyggctaattttttgtatttttggtagagatggggtttcaccatgttggtcaggctggtctcgaactcctgacctcatgatctgcctgcctcagcctcccaa

SEQ ID NO: 23986 - DNA, 201 bp, Homo sapiens
ttttgagacggagtctcactctgtcacccaggctggagtatagtggcacaatcttgcctaacagtaacctccgcctcccgggttcaagcaattcttctgcytcagcctccagagtagctgggattacaggcgcatgccactatgcccggctaattttttgtatttttggtagagatggggtttcaccatgttggtcaggct

SEQ ID NO: 23987 - DNA, 201 bp, Homo sapiens
atacgtatttactgagcagctactacacaccttgagagtagagctgagaacatatcgacaaggaccccacttttttcttttttttttttttttttttttttgagacggagtctcactctgtcacccaggctggagtatagtggcacaatcttgcctaacagtaacctccgcctcccgggttcaagcaattcttctgcctca

SEQ ID NO: 23988 - DNA, 201 bp, Homo sapiens
gtcctctcagtcaataatacgtatttactgagcagctactacacaccttgagagtagagctgagaacatatcgacaaggaccccacttttttctttttttyttttttttttttttttgagacggagtctcactctgtcacccaggctggagtatagtggcacaatcttgcctaacagtaacctccgcctcccgggttcaag

SEQ ID NO: 23989 - DNA, 201 bp, Homo sapiens
tgcctcagcctcctgagtagctgggattacaggtgcccgccaccacacccagctaatttttgtatttttagtagagacagagtttcaccatgttggccagrctggtcttgaactcctcacctcaagtgatccacccacttcggcctcccaaagtgctgggattacaggcatgagccaccatgcccagccccatctctcttt

SEQ ID NO: 23990 - DNA, 201 bp, Homo sapiens
ttcttctgcctcagcctcctgagtagctgggattacaggtgcccgccaccacacccagctaatttttgtatttttagtagagacagagtttcaccatgttrgccaggctggtcttgaactcctcacctcaagtgatccacccacttcggcctcccaaagtgctgggattacaggcatgagccaccatgcccagccccatct

SEQ ID NO: 23991 - DNA, 201 bp, Homo sapiens
caaagatgtgattcaaagtggggatcatcggggccatcttaggtttgtctgcagtgatcactgtgccatctctctctctctcttttttttttttttttttygagacgaagtcgtcactctgtcacccaggctggagtgcagtggcatgatctcagcttaccacaatctctgcctcccaggttcaaatgattcttctgcctc

SEQ ID NO: 23992 - DNA, 201 bp, Homo sapiens
acaaagatgtgattcaaagtggggatcatcggggccatcttaggtttgtctgcagtgatcactgtgccatctctctctctctcttttttttttttttttttcgagacgaagtcgtcactctgtcacccaggctggagtgcagtggcatgatctcagcttaccacaatctctgcctcccaggttcaaatgattcttctgcct

SEQ ID NO: 23993 - DNA, 201 bp, Homo sapiens
caccgtgcccagctaatttttgtatatttagtagagatggggtttcactgcgttggccaggctggtctcaaactcctgacctcagatgatccactcgcctyggcctcccaaagtgctgggattacaggtgtgagccaccgcacctggccagtggagttccttcttaagtacatgtattgacatctttaaaaagggcgagag

SEQ ID NO: 23994 - DNA, 201 bp, Homo sapiens
agcagccgggactacaggcacctgccaccgtgcccagctaatttttgtatatttagtagagatggggtttcactgcgttggccaggctggtctcaaactcytgacctcagatgatccactcgcctcggcctcccaaagtgctgggattacaggtgtgagccaccgcacctggccagtggagttccttcttaagtacatgta

SEQ ID NO: 23995 - DNA, 201 bp, Homo sapiens
ctctgtcacccagggtggaacacagtggcgtgatcttggctcactgcaacctccgcctcctgggttctagcgattctcctgcctcagcctcctgagcagcygggactacaggcacctgccaccgtgcccagctaatttttgtatatttagtagagatggggtttcactgcgttggccaggctggtctcaaactcctgacct

SEQ ID NO: 23996 - DNA, 201 bp, Homo sapiens
gctacttgggaggctgaggtaggagaatggcttgaacccaggagaaggaggttgcagtgagcttagatcatgctactgccctccagcctgggcgacagagygagattacgtctcaaaaaaataaaaataaataaaaataaaaagattttttaaaaggctgaagtttgggttactttggctcatacactttgccttcactgt

SEQ ID NO: 23997 - DNA, 201 bp, Homo sapiens
gaggccgggtgtggtggttcatgcctataatcccagcactttgggaggccgagcccagcggatcaccggaggtcaggagttcgagaccagcctggacaacrtggtaaaaccccgtctctactaaaaatacaaaaaattagtctggcatggtggcaggcgcctgtaatcccagctacttgggaggctgaggtaggagaatgg

SEQ ID NO: 23998 - DNA, 201 bp, Homo sapiens
tgtggccaaaggtgtgaaggatgcagctgtaaaagctgaagtttgaggccgggtgtggtggttcatgcctataatcccagcactttgggaggccgagcccrgcggatcaccggaggtcaggagttcgagaccagcctggacaacatggtaaaaccccgtctctactaaaaatacaaaaaattagtctggcatggtggcagg

SEQ ID NO: 23999 - DNA, 201 bp, Homo sapiens
atgaatcaaaataaagaaaaatactcagtaaatcatcataaagtacagagatgtggccaaaggtgtgaaggatgcagctgtaaaagctgaagtttgaggcygggtgtggtggttcatgcctataatcccagcactttgggaggccgagcccagcggatcaccggaggtcaggagttcgagaccagcctggacaacatggta

SEQ ID NO: 24000 - DNA, 201 bp, Homo sapiens
gtgacagtgagactttgtctcaggaaaaaaaaacaaaaacaaaaaacaaaaaactcgtaccccctaaatttatacaaataaccaaaaaaaaaaaaaaaaaaggaaattgtgtggcctttgaagtccaaaatattaactatctggcctgttacagaaaaagtttgcagacccctggcctagcccgtgagatgtgggttggct

SEQ ID NO: 24001 - DNA, 201 bp, Homo sapiens
ggtgacagtgagactttgtctcaggaaaaaaaaacaaaaacaaaaaacaaaaaactcgtaccccctaaatttatacaaataaccaaaaaaaaaaaaaaaaaaggaaattgtgtggcctttgaagtccaaaatattaactatctggcctgttacagaaaaagtttgcagacccctggcctagcccgtgagatgtgggttggc

SEQ ID NO: 24002 - DNA, 201 bp, Homo sapiens
tgcacttgtaaggccgggcactgtggtggctcgcggctgtaatcccagccctttgggaggccgaggtgggcagatcacttgaggtcaggagttcgagaccrgcctggccaacatggtgaagctccatctctactaaaaatacaacaattaactgggtgtagtggcgcacacctgtaatcccagctactagggaggctgagg

SEQ ID NO: 24003 - DNA, 201 bp, Homo sapiens
cagaaccccagacttcaccactaggcagcatatccagtgagaacagatctgaggcttgccatcaaaattgcacttgtaaggccgggcactgtggtggctcrcggctgtaatcccagccctttgggaggccgaggtgggcagatcacttgaggtcaggagttcgagaccggcctggccaacatggtgaagctccatctctac

SEQ ID NO: 24004 - DNA, 201 bp, Homo sapiens
tgttggccaagctggtctcgaactcctgaactcaggtgatccacccgcctcagcgtcccaaagtgctgggattacaggcatgagccactgagcccggcctyctcctttatcttaattgaaataattcagaaatggaaagtcaaatactgcatgttctcacttataagtaagagttaaataatgtgtacacatgggcattat

SEQ ID NO: 24005 - DNA, 201 bp, Homo sapiens
cacccggctaatttttcgtatttttagtagagaccggttttcatcatgttggccaagctggtctcgaactcctgaactcaggtgatccacccgcctcagcstcccaaagtgctgggattacaggcatgagccactgagcccggcctcctcctttatcttaattgaaataattcagaaatggaaagtcaaatactgcatgtt

SEQ ID NO: 24006 - DNA, 201 bp, Homo sapiens
ccacacccggctaatttttcgtatttttagtagagaccggttttcatcatgttggccaagctggtctcgaactcctgaactcaggtgatccacccgcctcrgcgtcccaaagtgctgggattacaggcatgagccactgagcccggcctcctcctttatcttaattgaaataattcagaaatggaaagtcaaatactgcat

SEQ ID NO: 24007 - DNA, 201 bp, Homo sapiens
aagcgattctcctgtctcagcctcccgagtagttgggattaatggtgcctgccaccacacccggctaatttttcgtatttttagtagagaccggttttcaycatgttggccaagctggtctcgaactcctgaactcaggtgatccacccgcctcagcgtcccaaagtgctgggattacaggcatgagccactgagcccggc

SEQ ID NO: 24008 - DNA, 201 bp, Homo sapiens
tgtttgtttgtttgtttgttttctttgagacagagtttcgctcttgttgcccaggctggagtgcagtggcacaatctcggctcactgcaacctctgcctcscgggttcaagcgattctcctgtctcagcctcccgagtagttgggattaatggtgcctgccaccacacccggctaatttttcgtatttttagtagagaccg

SEQ ID NO: 24009 - DNA, 201 bp, Homo sapiens
atccggcccactgcttgtttttgtaaataaagttttattggaacacactggctgctgtagttgtaacagaaactgcatggccctcctttatgtttttttttgtttgtttgtttgtttgtttgttttctttgagacagagtttcgctcttgttgcccaggctggagtgcagtggcacaatctcggctcactgcaacctctgc

SEQ ID NO: 24010 - DNA, 201 bp, Homo sapiens
aatccggcccactgcttgtttttgtaaataaagttttattggaacacactggctgctgtagttgtaacagaaactgcatggccctcctttatgtttttttttgtttgtttgtttgtttgtttgttttctttgagacagagtttcgctcttgttgcccaggctggagtgcagtggcacaatctcggctcactgcaacctctg

SEQ ID NO: 24011 - DNA, 201 bp, Homo sapiens
aaatccggcccactgcttgtttttgtaaataaagttttattggaacacactggctgctgtagttgtaacagaaactgcatggccctcctttatgtttttttttgtttgtttgtttgtttgtttgttttctttgagacagagtttcgctcttgttgcccaggctggagtgcagtggcacaatctcggctcactgcaacctct

SEQ ID NO: 24012 - DNA, 201 bp, Homo sapiens
caaatccggcccactgcttgtttttgtaaataaagttttattggaacacactggctgctgtagttgtaacagaaactgcatggccctcctttatgtttttttttgtttgtttgtttgtttgtttgttttctttgagacagagtttcgctcttgttgcccaggctggagtgcagtggcacaatctcggctcactgcaacctc

SEQ ID NO: 24013 - DNA, 201 bp, Homo sapiens
tgtggtggtgggcacctgtaatcccagctactcgggaggctgaggcagaagaatcgcttgaacccgggaggtggaggttgcagtgagctgagattgcaccrctgcactccagccttggagacagagcgagactctgtctcggaaaaacaaacaaacaagcaaacaaacaaacaaataaatggccagggcaggggagggttg

SEQ ID NO: 24014 - DNA, 201 bp, Homo sapiens
catggtgaaaccccgtctctactaaaaatacaaaaattagccaggtgtggtggtgggcacctgtaatcccagctactcgggaggctgaggcagaagaatcrcttgaacccgggaggtggaggttgcagtgagctgagattgcaccgctgcactccagccttggagacagagcgagactctgtctcggaaaaacaaacaaac

SEQ ID NO: 24015 - DNA, 201 bp, Homo sapiens
tggtcttgaactcctgggctcaagccatcctccctccttagcctcccaaagtgctgggattacaggtgtgagccaccacacctggcttctgaacattttttcttaatgataatagctggtgctatgggctgaatgtgttcccccaaattcatatgttgaaacttcatcccattgtagtcatattaagagatggggcctttg

SEQ ID NO: 24016 - DNA, 201 bp, Homo sapiens
cattgcactccagcctgggcaacaagagtgaaactctgtctcaaaaaaataaaatgaaataaaataaaataaaatgttaaaaaacaaaaaagaagaagaagtgtaggtggcaggcgtaggatgcatgggtgctgggcccaggtggagagggaggtggagccctgctggggggagggccttcaagtgtgcccaagtcactcg

SEQ ID NO: 24017 - DNA, 201 bp, Homo sapiens
ccattgcactccagcctgggcaacaagagtgaaactctgtctcaaaaaaataaaatgaaataaaataaaataaaatgttaaaaaacaaaaaagaagaagaagtgtaggtggcaggcgtaggatgcatgggtgctgggcccaggtggagagggaggtggagccctgctggggggagggccttcaagtgtgcccaagtcactc

SEQ ID NO: 24018 - DNA, 201 bp, Homo sapiens
gccattgcactccagcctgggcaacaagagtgaaactctgtctcaaaaaaataaaatgaaataaaataaaataaaatgttaaaaaacaaaaaagaagaagaagtgtaggtggcaggcgtaggatgcatgggtgctgggcccaggtggagagggaggtggagccctgctggggggagggccttcaagtgtgcccaagtcact

SEQ ID NO: 24019 - DNA, 201 bp, Homo sapiens
ggagtgcagtggctcaatcttggctcactgcaagctccgcctcccgggttcaagccattctcctgcctcagcctcctgagtagctgggactacaggcaccygccaccacgcccagctaattttttgtatttttagtagagactgagtttcaccatgttagccaggatggtctcgatctcctgacctcatgatctgcctgcc

SEQ ID NO: 24020 - DNA, 201 bp, Homo sapiens
cagccttcccagtagctggggctacaggcatgtgccacctctaataacttttctttaatttacaatagtattagtttgttctcatgctgctctaaggacaygcccaagactgggtaatttataaaggaaagaggtttgactcacagttctgcagggctggggaggcttcaggaaacatattatcatggcggaaagggaagc

SEQ ID NO: 24021 - DNA, 201 bp, Homo sapiens
tctcatttctgattttaaaatggctctggctgtgatgtggagaagaggcagggtgagcctcatctgcagcaactgctaactgcccacatccccccagacttctcaaaaatttgccactcccctgctcaaagaccctcaaaagctgcccactgcttagaggacaggcctttgacctgaggtcctcacttgggcttcagggat

SEQ ID NO: 24022 - DNA, 201 bp, Homo sapiens
cttgaacccgggaggtggaggttgcagtgagccgacatcacgccactgctctccagcttggggaacagagcaaacctccgtctcaaaaaaaaaaaaaaaaatctagggaagttgaaaacattttgcagtcaaagctatctttgctatctgcatcttgaaataaaataaacattcatacatgtaacctcattaatctgatta

SEQ ID NO: 24023 - DNA, 201 bp, Homo sapiens
gcttgaacccgggaggtggaggttgcagtgagccgacatcacgccactgctctccagcttggggaacagagcaaacctccgtctcaaaaaaaaaaaaaaaaatctagggaagttgaaaacattttgcagtcaaagctatctttgctatctgcatcttgaaataaaataaacattcatacatgtaacctcattaatctgatt

SEQ ID NO: 24024 - DNA, 201 bp, Homo sapiens
ttttctgttgggtataaggttctagaaatgtatctatttgatcaagctagctattatattatctatatttgttatgtcactatgtggttttttttttttttacctgatttacctcccaccgtaatacaattacaattcaccataatagaggctttgttaagttctccttttgagtctgtcagttttttgctttatttttga

SEQ ID NO: 24025 - DNA, 201 bp, Homo sapiens
acttcaggctaacatgctatcattttttctttgagtactgctttggtttctttccacaacttgttacacaatgttattcactgcccagtttagaatttcccttttggttcccattttaagacttatttaattatatgctttttaaatttttgagacagatagaattttttaagttatctttttattgttgatttctaaatt

SEQ ID NO: 24026 - DNA, 201 bp, Homo sapiens
gatgactaaatgagttaatatatgtcaagcatacaaaacagtacctggtatgtagtacaaactatgtatttgttaaatgaataccttttttttttttttttagagccatggtctctctctatttcccaggctggagcacagtggcacaatcatagctcactgtagcatccaatacctgggttcaagtaatccttccacctc

SEQ ID NO: 24027 - DNA, 201 bp, Homo sapiens
tgatgactaaatgagttaatatatgtcaagcatacaaaacagtacctggtatgtagtacaaactatgtatttgttaaatgaataccttttttttttttttttagagccatggtctctctctatttcccaggctggagcacagtggcacaatcatagctcactgtagcatccaatacctgggttcaagtaatccttccacct

SEQ ID NO: 24028 - DNA, 201 bp, Homo sapiens
atttttttttgtatttttggtagagacaggtttcaccatgttggccaggctggttgtgaactcctaaagtgctgggattacagatgtgagccaccacgccyggccccagtacacactttttggagggtatttgacgttatgtaccaggagtgctggggaaaagtacacacttgactccgtgagattctgcttcttagcatt

SEQ ID NO: 24029 - DNA, 201 bp, Homo sapiens; identical to SEQ ID NO: 4475

SEQ ID NO: 24030 - DNA, 201 bp, Homo sapiens
attggaatttattgagacaatacatataaagtgcatattccagcctcttgcaaataccaagtgccatttatgtatcagttagtgtttgctgtgtaacaaaygaccccgaaatgtagagggttacaacaactttatttagcttatgcttctgcaggctggcatttggggctgggctcagcagtgagggtggcgggggaggct

SEQ ID NO: 24031 - DNA, 201 bp, Homo sapiens
ctggcctcatataagcatttctgtctccatttatcatccatctttccctcttgaaggtcagtttcaccaaggcaggcatctttgtctcgttcactgttgtrgcctcagggccaggcacagtgagtcaaacatagaaggtgctcaataaatatgtgtttatttattgaaaccatgggcagaggctaattcagaagcggtctg

SEQ ID NO: 24032 - DNA, 201 bp, Homo sapiens
aaggctctccaaggagggaaaatttgaggggggccctgactggggagaatgagctggccagggataagcaagatggagtcatcccacatccccttacaacrctgggtgcctgggcaactgggggcatttgggggcatgtggtaggagccagaggaatttgcgacgattgccctgatggagtcaggagacctgggtttgaat

SEQ ID NO: 24033 - DNA, 201 bp, Homo sapiens
ctaaaaccggcatcctactggggagactgaaaatacatatcaatcacaaacaggtggttttccatagtgacccactctctgaatgcactagaccagggtgsaggccagagatcttctggggtgctttttgcaagggggaccaggataaggctctccaaggagggaaaatttgaggggggccctgactggggagaatgagct

SEQ ID NO: 24034 - DNA, 201 bp, Homo sapiens
tcctgggcccagtgctgccgagcagtccctctggagtgcagggtggcagggacttgcccctctagtctgcccctttgcagtcctctcagtcaataatacgyatttactgagcagctactacacaccttgagagtagagctgagaacatatcgacaaggaccccacttttttcttttttttttttttttttttttttgagac

SEQ ID NO: 24035 - DNA, 201 bp, Homo sapiens
cagcaagtttaagatctggaggtggcactgagctttggaggagcagggggcaatgaggtggccggtgtgacgaggactcaatgtgcaagagggagagtggyggggagatgaggtggaggggtggtcggcggtcagatcgtggagggtctcggacgagggtcctgaccctgggtctccagtcctgggaagtggagcccaggc

SEQ ID NO: 24036 - DNA, 201 bp, Homo sapiens
aaaagcaaacatataaagaaagaaagaaatcacatggatctggatgacagtgagtgctgggaagaaaataaaagcagaggaaggggatggagcgatgggcrgggggcaacggtagggagggtgtcggggaaaactttttggagaatgtgacgatgaaagtgaacaaggagaagtcaaccgtgttgagatgatggcagctaa

SEQ ID NO: 24037 - DNA, 201 bp, Homo sapiens
gcgatgaacaaagcagatagaaatccccactcttgtggagctgacattctggagggagagacaaaaagcaaacatataaagaaagaaagaaatcacatggrtctggatgacagtgagtgctgggaagaaaataaaagcagaggaaggggatggagcgatgggcagggggcaacggtagggagggtgtcggggaaaactttt

SEQ ID NO: 24038 - DNA, 201 bp, Homo sapiens
tccatggctgtatctccagaacccagcacagaaccaggtgcttgggaaagttttgaattgattctcatctgccattggcatggggaagggaactagcttgyatgaaacagataacaatgtatgggaccctcattcattatttcagcaaatatttgctgagttcctcctacatggctagccctgtgctagacactggggaat

SEQ ID NO: 24039 - DNA, 201 bp, Homo sapiens
tcgtgaaaactcaatgaaagaagattcttcaacgtggtaggtgcagtggcagctggcagtaccctgaccctgccaccgcacagccctctcagcattgctcrtcctgcactgtggatatcagttgagccacgtgtctcctgccctgggctgtgagctccataggcagggtctccatggctgtatctccagaacccagcacag

SEQ ID NO: 24040 - DNA, 201 bp, Homo sapiens
ttgattatctcacataaaatgaagtcttacaaatggacctactgggttttgtacagcagccaagtgatatctcttcccttctgctgtcttcccttctgccrtccttcacatggtggcattgtatccttagacttgccacccatgccctcaggttggccgttgcacactgtcttacataaagcaggaaggaaaggaaaggct

SEQ ID NO: 24041 - DNA, 201 bp, Homo sapiens
cacttcctctcaaattctattggtgaaaatggtcacatgactacacatagccacaaaggaggctgggaactttctcacttggaacctacatcccagaaacractcttttcagtgaggtatcccacaggtctttcgcagtagaaatattgattatctcacataaaatgaagtcttacaaatggacctactgggttttgtaca

SEQ ID NO: 24042 - DNA, 201 bp, Homo sapiens
ggaagtgggccgcatcacttcctctcaaattctattggtgaaaatggtcacatgactacacatagccacaaaggaggctgggaactttctcacttggaacstacatcccagaaacaactcttttcagtgaggtatcccacaggtctttcgcagtagaaatattgattatctcacataaaatgaagtcttacaaatggacct

SEQ ID NO: 24043 - DNA, 201 bp, Homo sapiens
ctatgttgcccaggctgcttttgacctcctgggctccagtgatcttcccatcttggcttcccaaagtgctgggattacaagtgggagccagtgttcctggycccttcctccattcttaatggaaggagatgctaggtgtgagaggttagggaaagtaaagatgtaatttctttcccatccaagttctcagacccctgaatt

SEQ ID NO: 24044 - DNA, 201 bp, Homo sapiens
tattgaaatgcagttataaaacatttaaacacatttttaatctagagatatatgtgcttctttattaagatctataaataataagttctaggggtagctcrcataaatactgtaatttcaaagtagataagcataaataatactttatgatactgaaattgtgatgtgatatgagaatagctgtgagttttgttttgctgg

SEQ ID NO: 24045 - DNA, 201 bp, Homo sapiens
tgaaacccccatctgtacaaaaattagccaggcatggtggcatgcacctgtagtcccaggtactgggaaggctgaggtgggaggatcacttgagcccaggrgtttgaggctgcagtgagccgtgatcgtaccactttactcccacctgggtgacagagcaagagcccatctctaaaaataaataaatacaatgaaataaaa

SEQ ID NO: 24046 - DNA, 201 bp, Homo sapiens
cctgccgtggtgtatctgccaggtaggcaggctaggctgcagtaacacacaagcccacaatttccatggcttaacactataggaatatatttcttgctcaygtaacaagctaacgtgaatgttgctggtttgtaggtggtttccctccctgtagaaatctggggagtgaggttctttccatcttgtggtgccatcattctc

SEQ ID NO: 24047 - DNA, 201 bp, Homo sapiens
ctgggcttttatatcataggatgcctctaatggcaatcctgccattagatacacctgccgtggtgtatctgccaggtaggcaggctaggctgcagtaacamacaagcccacaatttccatggcttaacactataggaatatatttcttgctcacgtaacaagctaacgtgaatgttgctggtttgtaggtggtttccctcc

SEQ ID NO: 24048 - DNA, 201 bp, Homo sapiens
ccattcttcccctgtggccagacacttcccctggctgagtctctgggcttttatatcataggatgcctctaatggcaatcctgccattagatacacctgcygtggtgtatctgccaggtaggcaggctaggctgcagtaacacacaagcccacaatttccatggcttaacactataggaatatatttcttgctcacgtaac

SEQ ID NO: 24049 - DNA, 201 bp, Homo sapiens
tttcatctgaggctcaattggggaagggtcacttctaagctcatacaatattggtgacattcagtccctggcaggctgttgaactgagagcctcagtttcstgctggctgttggttgtagttaaccctgaattccttcccatgtgccctttgcaaagccatcaaggcagagagacttgcctagcaagtaggatattacagt

SEQ ID NO: 24050 - DNA, 201 bp, Homo sapiens
ggcacaggccaccacgccaggctaattttttgtatttttagtagcgacagggtctcgccatgttgtccgggctggtctggatctcctggcttcaagtgatmcccctggctcagcctcccaaggtgctgggattacaggcttgagccaccgcatccagcccagatctgagatttgcacccagtatttgaactcccaagcctg

SEQ ID NO: 24051 - DNA, 201 bp, Homo sapiens
ttttgttgttgttgttgttgttgagacagagtctcactctatcacccaggctggaatgcaggggcgtgatcatggctcactgcatccttgacttcctgggmtcaggtgattctcccacctctgcctcccaggtagctgggactacaggcacaggccaccacgccaggctaattttttgtatttttagtagcgacagggtct

SEQ ID NO: 24052 - DNA, 201 bp, Homo sapiens
aaagtttagttagagccctgaatgcctgcctcataatggtttccatattttatatgcctactatgtgccaggcacattgctcagggtcacacagctggaartggcagggctgagtttttgttgttgttgttgttgttgagacagagtctcactctatcacccaggctggaatgcaggggcgtgatcatggctcactgcatc

SEQ ID NO: 24053 - DNA, 201 bp, Homo sapiens
ctggagttgcaggcagtggagttctgtcctaagcagtgggcacctaaacccgatggcataaaagctgggcgggtgtccacctgcatctgccacagcactgyaggcaccaactgtggctcatactgagtgggataaattccagaaagaaacattaggaacttactatagaattttggggctagagctactcattcattcccc

SEQ ID NO: 24054 - DNA, 201 bp, Homo sapiens
cctggagttgcaggcagtggagttctgtcctaagcagtgggcacctaaacccgatggcataaaagctgggcgggtgtccacctgcatctgccacagcactrcaggcaccaactgtggctcatactgagtgggataaattccagaaagaaacattaggaacttactatagaattttggggctagagctactcattcattccc

SEQ ID NO: 24055 - DNA, 201 bp, Homo sapiens
ttaatattttcatatttctagatctgccttcaggcatggctggatccagcttctaggaacctgtccagctctgcgccctgctttattctgtactggcttcrtttttaggcaggctcttccctcatgtagtggcagatatgcctactagttgctccaggcctacatcccaaagccacagtgggaaaagggttttttttcttg

SEQ ID NO: 24056 - DNA, 201 bp, Homo sapiens
gtgtgatacagatgagctcccctgtttggcccacatgtgtcctaaaagccatgtgccctttctcttgagtgccccaggccacagagatccccatctgcccrctgtcccacacactggtctgtcatttgttccttgaggtttgtgagggccggctctgtgcatcccaggggcccaggctgggcctggttggctctcagggag

SEQ ID NO: 24057 - DNA, 201 bp, Homo sapiens
tgacagctcacttgaataaccctattattgaagagaataatactgactcaagagacagtgacccgtgtcagttcccttttgaggccaacgggttaaggagraagtccccatacagctgactcgtttactaattcctcttaatgaagagagcagaggccacaccccaggcttagactttcccaagaaaacaagatcagtttg

SEQ ID NO: 24058 - DNA, 201 bp, Homo sapiens
gcaagtccctttgcttcctggccccccacccctcacatcagagaaggggagttatctctgcatgccgctcctcctctgtaaaggtagggctgtgggccacrtctgtgtttcccagtttgggggacacaagtgatcgtaggtggcacattgacagctcacttgaataaccctattattgaagagaataatactgactcaaga

SEQ ID NO: 24059 - DNA, 201 bp, Homo sapiens
ggctctgccctaggcaagtccctttgcttcctggccccccacccctcacatcagagaaggggagttatctctgcatgccgctcctcctctgtaaaggtagrgctgtgggccacatctgtgtttcccagtttgggggacacaagtgatcgtaggtggcacattgacagctcacttgaataaccctattattgaagagaataa

SEQ ID NO: 24060 - DNA, 201 bp, Homo sapiens
aggcaagccctggggctggatagcaaatcccaggagctagagacctggcttctcacctggctctgccctaggcaagtccctttgcttcctggccccccacycctcacatcagagaaggggagttatctctgcatgccgctcctcctctgtaaaggtagggctgtgggccacatctgtgtttcccagtttgggggacacaag

SEQ ID NO: 24061 - DNA, 201 bp, Homo sapiens
atgtctccgacactctgctgctgacctggagcaacccgtatccccctgacaattacctgtataatcatctcacctatgcagtcaacatttggagtgaaaaygacccggcagatgtgagtgggcatgctttgacgtttttctgtgacctctggggaacagggtgggtgaccagcagaggcccagtccctggagccaggagcc

SEQ ID NO: 24062 - DNA, 201 bp, Homo sapiens
cgaccaaaaatctgggtggtggctgtggtttgtaggccggggctgggctgggtgatgggggagtcactgcatagatcctcacatagaggccgcttctcccrcagtgaaacccagggccccaggaaacctgacagttcacaccaatgtctccgacactctgctgctgacctggagcaacccgtatccccctgacaattacct

SEQ ID NO: 24063 - DNA, 200 bp, Homo sapiens
gcggttcctggaggcatgtcccggacacagctgtggggcccagccagcctacaggtgaccagcctaacccagcccctgtgtctgcagagcccacacgtgttccctgagaacaacggaggcgcggggtgcgtgtgccacctgctcatggatgacgtggtcagtgcggataactatacactggacctgtgggctgggcagca

SEQ ID NO: 24064 - DNA, 201 bp, Homo sapiens
tgggagggtgggagaggggtgaaggaagagaagttacttaatgggcatagtgtacaccatttgggtgacggacccaccagaaccccagacttcaccactakgcagcatatccagtgagaacagatctgaggcttgccatcaaaattgcacttgtaaggccgggcactgtggtggctcgcggctgtaatcccagccctttgg

SEQ ID NO: 24065 - DNA, 201 bp, Homo sapiens
gcacaggatgcttcgttacactggtgcccaggacataatcacgtacacaagacacacagttacggggcagactggggatatacggcacaccagcatgcagsgttcaccagtaaaggtggtattccatgattattctaaggtagatgggctgtgctttgtttccattggcttagtccagggattggcaaactatggcccgtg

SEQ ID NO: 24066 - DNA, 201 bp, Homo sapiens
attaaaacaattaaaaattttttttcttactgaaatggaggtctcactgtgttgcccaggctgctctcaaactcctgggctccagtgatcctcctgcctcmgcctcccaaagtgctgggattacaagcgtgagccgctgtatccggcccaaaatggagaaattttaagtcccaacaacatgcaagcccgcattcaacaaat

SEQ ID NO: 24067 - DNA, 201 bp, Homo sapiens
acagtcatcccgacactagctgggaagctccagcagccctggtcctggccccagctctgtgggcgctggccctcaactttgcctgcactgtgcttttgtgytattccccttggtcctgtttgggtgcaagtccccctcacgcattgagttcctgggccgctcaggctgctcctgtgtctccccagggaacatgaaggtctt

SEQ ID NO: 24068 - DNA, 201 bp, Homo sapiens
ttaaactgctacatattttccctttaatttggccaagaacaagttgtcaagtttgtgtgagataaaggtgcacttggttcgttcttgtctaatggcccccrcacccatgggtatttcttcagcttccacagtcatcccgacactagctgggaagctccagcagccctggtcctggccccagctctgtgggcgctggccctc

SEQ ID NO: 24069 - DNA, 201 bp, Homo sapiens
cttaacatggtaagcccttatgcaagttgttgtcagctgagatgggcgtggcactgagcatgggagcatggaggcgcctgagtggtctcatgctcaggtgrtttagcaaactcagtgtacatcctgccaattccagtcctgccatggccactgacaagctaggagggcgctgaaaggagaaggaccccgatgtctcctcca

SEQ ID NO: 24070 - DNA, 201 bp, Homo sapiens
cagaaggatgccagaagagaaggtactttggggaggggcgggaatcaggagttagttttggacatgagataagcttggaatatttatttgctatctaagayagctccttaacatggtaagcccttatgcaagttgttgtcagctgagatgggcgtggcactgagcatgggagcatggaggcgcctgagtggtctcatgctc

SEQ ID NO: 24071 - DNA, 201 bp, Homo sapiens
ataagagggggttggggaagctgggtggagtgggggggattgcagttgaaagtagggaagtcagggaaggcctcattgagctgacttggaggaagcgggamccgtgcagatgtctggggaaggctcattcttggcagagaggccctgcactgagcctggcgggagggttgagcacaggagggaatgtggtggaggagagtg

SEQ ID NO: 24072 - DNA, 201 bp, Homo sapiens
gtagctgggactagagatgcacaccattgcacccaatagagcaatacgtttctgttctttgtaaattacctgctctaaggtatttttgttatagcagcctrtatggactaagctgacttgtaacgttacttgagactttaaagtgttccggtcactgttggagggctctgtctgtgttagctcatttaatccccacaacac

SEQ ID NO: 24073 - DNA, 201 bp, Homo sapiens
aaacttcatcccattgtagtcatattaagagatggggcctttggagaagtgattaagtcatgagggctctgtggttggtcatgaatggggttagtgccctyatgaacgggctgaaggaagtgtgtttgccccttctgtcatatgaagacacagcagcatggcatcgtccgtgaggaatgggctctcaccagatctggatct

SEQ ID NO: 24074 - DNA, 201 bp, Homo sapiens
aaaccctgtctctactaaaaatacaaaattagttgggtgtgtggcccatgcctgtaatcccagctactcagaaggctgaggcaggagaatcgcttgaaccygggaggcggaggttgcagtgagccgagatcgcgccattgcactccagcctgggcaacaagagtgaaactctgtctcaaaaaaataaaatgaaataaaata

SEQ ID NO: 24075 - DNA, 201 bp, Homo sapiens
gaaaaggcatggaggtgggactgagtttggtgtgtttaagaagtgcaggtggcagccgggctcagtggctcacgcctgtaatcccagcactttgggaggcygaggcaggcggatcacctggggtcgggagttcaagaccagcctgaccagcatggagaaaccctgtctctactaaaaatacaaaattagttgggtgtgtgg

SEQ ID NO: 24076 - DNA, 201 bp, Homo sapiens
ctttctttctaagatatacattcaataatataaatttccctctaagcactgcttttgctacgtctcaccgattttgataggctatattttcatttttattkagttaaaaatatttttagtttctcttgtgatttcttctttgatccatatgttattcggaagtgtgtttttaaatctccaaatacttggaaattttctggc

SEQ ID NO: 24077 - DNA, 201 bp, Homo sapiens
attaattagtgccttctctctcatttttttgattcgcctaggtagagatttatcaatttcattgatcttttcgaagaaccaatttttgatttcattgattytcctcgattaattttctatttttaatttcattgatgtatgctccaattttgtatttttttcttctgcttgttttagacatatattgcttttctgtttcta

SEQ ID NO: 24078 - DNA, 201 bp, Homo sapiens
gccttaacctcctgggctcaagtgatcctcctgcctcagccttcccagtagctggggctacaggcatgtgccacctctaataacttttctttaatttacartagtattagtttgttctcatgctgctctaaggacatgcccaagactgggtaatttataaaggaaagaggtttgactcacagttctgcagggctggggagg

SEQ ID NO: 24079 - DNA, 201 bp, Homo sapiens
aaaatggaatgcagaattaagtgtatgcaccttgccagaaacagggtttggggtttacattagatgctcagataggtcattgatccccaaaacactaaggwctctgacttctagacagatagtagttaagaaccaaagctttggagcttgagtgctggatttaagacccatgactgtcacagctgtgcaacctcagacaaa

SEQ ID NO: 24080 - DNA, 201 bp, Homo sapiens
tggtctcatttctgattttaaaatggctctggctgtgatgtggagaagaggcagggtgagcctcatctgcagcaactgctaactgcccacatccccccagmcttctcaaaaatttgccactcccctgctcaaagaccctcaaaagctgcccactgcttagaggacaggcctttgacctgaggtcctcacttgggcttcagg

SEQ ID NO: 24081 - DNA, 201 bp, Homo sapiens
cctggtctcatttctgattttaaaatggctctggctgtgatgtggagaagaggcagggtgagcctcatctgcagcaactgctaactgcccacatccccccrgacttctcaaaaatttgccactcccctgctcaaagaccctcaaaagctgcccactgcttagaggacaggcctttgacctgaggtcctcacttgggcttca

SEQ ID NO: 24082 - DNA, 201 bp, Homo sapiens
taatcccagcacttttggaggctgaggcgggcagatcacttgagatcaggagttcgagaccagcctggtcagtatgatgaaaccccatctctactaaaaayacaaaaattagttgggcatggtggcttgcctgtagtcccagctactggggaggctgaggcaggagaatcacttgagcctaggaggtagaggttgcagtga

SEQ ID NO: 24083 - DNA, 201 bp, Homo sapiens; identical to SEQ ID NO: 4455

SEQ ID NO: 24084 - DNA, 201 bp, Homo sapiens
gatctttataggattttctggtcatttttttcctcttgtgtttgaaaagaatgtatattttctgttgggtataaggttctagaaatgtatctatttgatcmagctagctattatattatctatatttgttatgtcactatgtggttttttttttttttacctgatttacctcccaccgtaatacaattacaattcaccata

SEQ ID NO: 24085 - DNA, 201 bp, Homo sapiens
ttcctgagatttagccaaattagctttctttctttctttttttttttttgagatggagtctcactctgctgcccaggctggagtgcagtggcgcaatctcrgctcactgcaatctctgcctcccgggttcaagtgattctcctgcctcaacctcccgagtagctgggatttcaggcacacaccaccacgcctggctaattt

SEQ ID NO: 24086 - DNA, 201 bp, Homo sapiens
agattcaaacccagggctacagacccagaagcctgtgcatttaaccacggttctgagctatccagcccaaagaggagagtttaaaaggattacatttcttsgttggaaatcagtgagcatagtcgcccagaaccatttttgaaaaactcagagaaggcctatgttttcctgaagcggccagggaagtattctgccttttta

SEQ ID NO: 24087 - DNA, 201 bp, Homo sapiens
ctgctcatttccctgaggaggaacctgaggctcaggctagagacttacctgggtgacacggctcctaagtggcagagtccagattcaaacccagggctacrgacccagaagcctgtgcatttaaccacggttctgagctatccagcccaaagaggagagtttaaaaggattacatttcttcgttggaaatcagtgagcata

SEQ ID NO: 24088 - DNA, 201 bp, Homo sapiens
tctcctgcctcagcctggtggctgggattacaggcctgtgctatcacacccagctaatttttgtatttttagtagagacagggtttcactgtgttggccargctggtgtcgaactcctggcctcaggtgatccacctgcctcagtctcccaaagtgctgggattacaggcatgagccactgcacgcggccctgggtgcgtg

SEQ ID NO: 24089 - DNA, 201 bp, Homo sapiens
tccaatcattttacatattattttatgaatgagcaccttcctcagtgtctcagaccaggggtccccacacagcagggccacacagcaggaggtgagtggcrggtgagtgagcgaagttttatctgtatttacagctgctccccatcgctcgcattaccacccaagctcggccacctgtcaggtcagctgaggcattagatg

SEQ ID NO: 24090 - DNA, 201 bp, Homo sapiens
attttacagacagtccaatcattttacatattattttatgaatgagcaccttcctcagtgtctcagaccaggggtccccacacagcagggccacacagcargaggtgagtggcgggtgagtgagcgaagttttatctgtatttacagctgctccccatcgctcgcattaccacccaagctcggccacctgtcaggtcagct

SEQ ID NO: 24091 - DNA, 201 bp, Homo sapiens
ttgaactgctggtctcaagcagtcctcctgcctcagcctcctaaagtgttggatttatagatgcgagcaaacgtgcctggcctaaatgaataaatctttaytgttgcctcctttgagctttattggttgggatttagtccactcattttgcaggtgagaactgagacccggagatgaatgcagtagccttgcctcaggtcc

SEQ ID NO: 24092 - DNA, 201 bp, Homo sapiens
caatgcagattcctgggccccaccctgggcctctggatctgaatctggagggagacgctggggaggcagcagggaggaaaacctgcagtcactcaccccakttacaacacatgcagttaccggcaggtccgagataacctaagggtttccaaatgctaggaagtgactcaatgactgatatgtttaatacaatacaatccc

SEQ ID NO: 24093 - DNA, 201 bp, Homo sapiens
gatggaaagttgggctgggctgcattgtggaaagccttgaatgccatgccaaggaacttgggccagtgtattcaccttggcttgagttgtaaaagcaacartgcagattcctgggccccaccctgggcctctggatctgaatctggagggagacgctggggaggcagcagggaggaaaacctgcagtcactcaccccagtt

SEQ ID NO: 24094 - DNA, 201 bp, Homo sapiens
gagcaccccctctgcaggaagacagacgtgagggctgggagggtgcggatgcaccagcggctgcaggaccacaagccagaggggatcagctcttcaaaggkcactgggccaggcttcccagcacccagggaccctgagctagccttgtgagtagagcaggggagtctggcaggtagaggatgggaggtaaagggaggcaca

SEQ ID NO: 24095 - DNA, 201 bp, Homo sapiens
gcacttccctgcccccagtagcctatgaggagcccaaggcatttgctgggacctcagtgcctttatcaaaatcccaaagtccaatggggaaacaggctcakgtgtaggtttggccagggtgtcctgcacattagggcattccagggtcctgcaggggtttcttagaactcggctagcccagcccatgaatgggaggtgacc

SEQ ID NO: 24096 - DNA, 201 bp, Homo sapiens
tttatttttaaaaatttattttataaagatggtgtctcactatgttgtccaggctggcctcaagtgatcctcccacctcggcctcccaaaatgctgggatkacaggtgtgagccactgagccctgattttttttttaaacaaaatctggatttcttagacttaagcaagataggggaccactagtttgtctgcttctgggg

SEQ ID NO: 24097 - DNA, 201 bp, Homo sapiens
gcagattcccaggtccttgccctgagattcagattcagtaaacccaggaatctgatctttattttatttttaaaaatttattttataaagatggtgtctcmctatgttgtccaggctggcctcaagtgatcctcccacctcggcctcccaaaatgctgggattacaggtgtgagccactgagccctgattttttttttaaa

SEQ ID NO: 24098 - DNA, 201 bp, Homo sapiens
ggccggggctgggctgggtgatgggggagtcactgcatagatcctcacatagaggccgcttctcccgcagtgaaacccagggccccaggaaacctgacagktcacaccaatgtctccgacactctgctgctgacctggagcaacccgtatccccctgacaattacctgtataatcatctcacctatgcagtcaacatttgg

SEQ ID NO: 24099 - DNA, 201 bp, Homo sapiens
gctgtttccaatggctctgcttaactgagacctgagagtgattgctccatctgtggtggcatatgggctgaaactgcctagcagcatgtcagaagtggggygttcgcaggacatccttgtccaggttggcagttgagcttggcaggtgaccgctgagaccccttccaactccaccacttcaggaatctctttttttttttt

SEQ ID NO: 24100 - DNA, 201 bp, Homo sapiens
cccaggtttaaatcggagctggctacttcccagctctccactgtgtaatctggaggaagttgtttaacctctctgagcctccctttgttttgtcatgggtrtttgcagggagagcattcatgagatagtttgtatagacattttgcccttggaaggcgctcagtgattgctgtttttctctgcattttggaccgagtccct

SEQ ID NO: 24101 - DNA, 201 bp, Homo sapiens
aagggctcggccgccggcggggaccacggggaccaccccgactccgagcggggcccgagcccgcgactctcggtgcgcgcggagcagcgcccggttccgtycttgccgccgaacggcagcggaggcgcgaggcccggggtacgtggacacccagcgctccccaaagccggtgctggcagtgagacctccgccgggacggcc

SEQ ID NO: 24102 - DNA, 201 bp, Homo sapiens
acattgtcggtgtactccctgccatccatctgcccagaaatactgtgaatgtgggcagcgcaggactggttcctccaagccccattttacagacagtccawtcattttacatattattttatgaatgagcaccttcctcagtgtctcagaccaggggtccccacacagcagggccacacagcaggaggtgagtggcgggtg

SEQ ID NO: 24103 - DNA, 201 bp, Homo sapiens
tcggcctcccgtgtagctgggactacaggtgtgcgccaccacactcggctaatttttgtatttttagtagagacagggtttcactatgttggccaggctgktctcaaactcctgacctcgtgatccgcccacctcagcctcccaaactttctgttttcttttcttttcttttttttttatgacagggtcttgctggagtgc

SEQ ID NO: 24104 - DNA, 201 bp, Homo sapiens
catggtctcggctcgctgcaacctccgcctcctgggttcaagcaattctcccacctcggcctcccgtgtagctgggactacaggtgtgcgccaccacactyggctaatttttgtatttttagtagagacagggtttcactatgttggccaggctggtctcaaactcctgacctcgtgatccgcccacctcagcctcccaaa

SEQ ID NO: 24105 - DNA, 201 bp, Homo sapiens; identical to SEQ ID NO: 4453

SEQ ID NO: 24106 - DNA, 201 bp, Homo sapiens
tttgaataagatcccaggagagagacccaagcgggaagtgaaggatgggcacttgaaatgttgcagggaatataacccagcgcgtgctgttttcttttttyctttttcttttttttttttttctctttttgcaacagggtctcactgtgtcgcccagcctagagtgcagtggtgccatctcggctcaccacaacctccacc

SEQ ID NO: 24107 - DNA, 201 bp, Homo sapiens
aaacccttttgtgaactgcacatgtgagggatctgggttgcgtactttttcttttttttttaagacggagtttcgctcttgtcgcccagactggagtgcartggtgcgatcttggctcactgcaatctccacctccccatgttcaagtgattctcctgcctcagcctggtggctgggattacaggcctgtgctatcacacc

SEQ ID NO: 24108 - DNA, 201 bp, Homo sapiens
agcaggtgcctctagccccagctatttgggaggctgaggtgggaggatggcttgagcccaggtggtcaaggctgcagtgaactatgattgtgccactgcaytgtagcctgggtgacagagcgagactctgtctcaaaataaacaaatacataaatacatgagaagagagaaccttttctacctcccccatctccctgccct

SEQ ID NO: 24109 - DNA, 201 bp, Homo sapiens
gtagcaggtgcctctagccccagctatttgggaggctgaggtgggaggatggcttgagcccaggtggtcaaggctgcagtgaactatgattgtgccactgyactgtagcctgggtgacagagcgagactctgtctcaaaataaacaaatacataaatacatgagaagagagaaccttttctacctcccccatctccctgcc

SEQ ID NO: 24110 - DNA, 201 bp, Homo sapiens
caggcgtggtagcaggtgcctctagccccagctatttgggaggctgaggtgggaggatggcttgagcccaggtggtcaaggctgcagtgaactatgattgkgccactgcactgtagcctgggtgacagagcgagactctgtctcaaaataaacaaatacataaatacatgagaagagagaaccttttctacctcccccatc

SEQ ID NO: 24111 - DNA, 201 bp, Homo sapiens
aaaaatttaaaaacttagccaggcgtggtagcaggtgcctctagccccagctatttgggaggctgaggtgggaggatggcttgagcccaggtggtcaaggstgcagtgaactatgattgtgccactgcactgtagcctgggtgacagagcgagactctgtctcaaaataaacaaatacataaatacatgagaagagagaac

SEQ ID NO: 24112 - DNA, 201 bp, Homo sapiens
cctgggcaacatagtgagatcctgttcctacaaaaaaaatttaaaaacttagccaggcgtggtagcaggtgcctctagccccagctatttgggaggctgargtgggaggatggcttgagcccaggtggtcaaggctgcagtgaactatgattgtgccactgcactgtagcctgggtgacagagcgagactctgtctcaaaa

SEQ ID NO: 24113 - DNA, 201 bp, Homo sapiens
gaccagcctgggcaacatagtgagatcctgttcctacaaaaaaaatttaaaaacttagccaggcgtggtagcaggtgcctctagccccagctatttgggargctgaggtgggaggatggcttgagcccaggtggtcaaggctgcagtgaactatgattgtgccactgcactgtagcctgggtgacagagcgagactctgtc

SEQ ID NO: 24114 - DNA, 201 bp, Homo sapiens
caaccagagcagccgtgcctgttgttaaaatcttgacctaattgtatacttgtcggcaaatagccactatcctgaacactcccctccttttttttaatatmcaggatctcactctgtggcccaggctggtgtgcagtggtgcgatcatagctcactgcaccttcaaactcctgagctcaagtgatcctcccatcttagcct

SEQ ID NO: 24115 - DNA, 201 bp, Homo sapiens
cctgagtttcactggtgtgtcaggtacatggtgataccccttgggagtgctgttatagttaacaaccagagcagccgtgcctgttgttaaaatcttgaccyaattgtatacttgtcggcaaatagccactatcctgaacactcccctccttttttttaatatacaggatctcactctgtggcccaggctggtgtgcagtgg

SEQ ID NO: 24116 - DNA, 201 bp, Homo sapiens
tatgttatttaatattttcatatttctagatctgccttcaggcatggctggatccagcttctaggaacctgtccagctctgcgccctgctttattctgtaytggcttcgtttttaggcaggctcttccctcatgtagtggcagatatgcctactagttgctccaggcctacatcccaaagccacagtgggaaaagggtttt

SEQ ID NO: 24117 - DNA, 201 bp, Homo sapiens; identical to SEQ ID NO: 4476

SEQ ID NO: 24118 - DNA, 201 bp, Homo sapiens; identical to SEQ ID NO: 4474

SEQ ID NO: 24119 - DNA, 201 bp, Homo sapiens; identical to SEQ ID NO: 4473

SEQ ID NO: 24120 - DNA, 201 bp, Homo sapiens; identical to SEQ ID NO: 4458

SEQ ID NO: 24121 - DNA, 201 bp, Homo sapiens; identical to SEQ ID NO: 4461

SEQ ID NO: 24122 - DNA, 201 bp, Homo sapiens; identical to SEQ ID NO: 4450

SEQ ID NO: 24123 - DNA, 201 bp, Homo sapiens; identical to SEQ ID NO: 4466

SEQ ID NO: 24124 - DNA, 201 bp, Homo sapiens; identical to SEQ ID NO: 4460

SEQ ID NO: 24125 - DNA, 201 bp, Homo sapiens; identical to SEQ ID NO: 4449

SEQ ID NO: 24126 - DNA, 201 bp, Homo sapiens
tgacctttaccttgcaccataaacaaaaattaatttgctgtggatcatagacataaatgtagaagctaaagctataagacttcttctaaacaatgatttargggaagattccttgaatcgaatatagaaaaacacaaaccattaagaaggaattgatgcaaatgactatataaaaatttgttttgaaacgttttcttcatt

SEQ ID NO: 24127 - DNA, 201 bp, Homo sapiens
aaattaatttgctgtggatcatagacataaatgtagaagctaaagctataagacttcttctaaacaatgatttaggggaagattccttgaatcgaatataraaaaacacaaaccattaagaaggaattgatgcaaatgactatataaaaatttgttttgaaacgttttcttcattgactagtcttaaaaaagaaaatacca

SEQ ID NO: 24128 - DNA, 201 bp, Homo sapiens
ggcatggtgggtgtcatgcgcttataatcccagttactcgtgaggctgaggcaggagaatcacttgaacccaggaggtggaggttgcagtgagccaagatygtgcagtagccaagattgtgccactgcactccagcctgggagacagagtgagactccatctcaaaaaaaaaaaagaggtcaggctggaggcattggaagc

SEQ ID NO: 24129 - DNA, 201 bp, Homo sapiens
tggtgggtgtcatgcgcttataatcccagttactcgtgaggctgaggcaggagaatcacttgaacccaggaggtggaggttgcagtgagccaagatcgtgyagtagccaagattgtgccactgcactccagcctgggagacagagtgagactccatctcaaaaaaaaaaaagaggtcaggctggaggcattggaagctgtc

SEQ ID NO: 24130 - DNA, 201 bp, Homo sapiens
tcaggctggaggcattggaagctgtcctcagggactcatgagtcagtaaggggtctccaagtgagcatgaaacagtgaggcctgaaccccaagaagcaccyacagggagagaaggacaggaaacaataaaggaactgagccaggtgcagtggcacatgctgcaatcccagctactcagaggcttaggtggcaggatcgctt

SEQ ID NO: 24131 - DNA, 201 bp, Homo sapiens
tgcagtggcacatgctgcaatcccagctactcagaggcttaggtggcaggatcgcttgagcctaagagttcaagaccagcctgggcagcatagcaagaccytatgtctaaaaataaaaataaagaaactgagatgcaccatcagcctgggcaagtcttaaaggaagaagacagagtgcttatttttttaatagataataca

SEQ ID NO: 24132 - DNA, 201 bp, Homo sapiens
caaccatctctttgaccactactaacttgagaaatgttgcataaggccttctatttaaaagtaaacgtgaattccccatatatccagagtgccaggggacktaatgtatgttaaattagttgccctgtcctcagcaacttccagaccgtgcactcatgacctttggaaggggcagccctctgctctccaagacacctccct

SEQ ID NO: 24133 - DNA, 201 bp, Homo sapiens
taggctagtctgtttatcagctggccagcagcaaatcagaatgtctctttcaaagacactcagggctgaatcagccttaggatgctaagcaaatcattccrtaggataggacacagtcacatagaagctacagctgggaaaggcagaattcatagtagagagtgctggtccacctagaggccagcccaagaggccagaggt

SEQ ID NO: 24134 - DNA, 201 bp, Homo sapiens
gaccttacatagtgcttgtcaagtgaatgcagcggtttaagcccatgtggggtttttggcttgttttaacgcactcataagtaacgtactcatgcggggcygtgtatacagagggaagagcaccacgttagtcagcaggtttgagtttggtcctcagctctgtggcttcccagccacgtgaccctgggcaagtgacttcct

SEQ ID NO: 24135 - DNA, 201 bp, Homo sapiens
ttccatccaaaatggagatatgcgtggtactagccctgcttcctgtatgggctgtcatggggattcgatggcagtaatatatgtgaaaatgctctgtcaaytaggaagcaatgcaaaggcaggataatgtttatttaataagaataatcacctatcgagtttttctttggtccttggctaagtagctttgtagcatttgga

SEQ ID NO: 24136 - DNA, 201 bp, Homo sapiens
agtatagcaattcagagcatggactttggagccaaactcaacggagttcaaatctggaccttgctacttactagctgggtgcaactcagaggaagttactycacttccctgatcctccattttctcttctgtaaaatgggaataatagtagtgtctatgttgtaacattaaagaagacctaggatatgcttttagcaccta

SEQ ID NO: 24137 - DNA, 201 bp, Homo sapiens
gtgagataacacatgagattattattacataaagttcttagtatcacatctggcatttagctgcttacatattacagttcccttccccttgttgtttcatwtgtgcatggttttttgctttgccagaatacaggctccttaggtgcagggcccggatgttttgtctgtgtaccttagccccctgagttggtatatgctagg

SEQ ID NO: 24138 - DNA, 201 bp, Homo sapiens
attagtagggcaggcgtctctcatcttagttacccagggagctaggccactcacatttcactggccaaagcccatcacctagccagatcagaacttctaakgggccagggaagtgtaatcctattgtgtatctggaaggagagaaattcaggaacattttcaaccacctagtgaccaccatatcctccaggtcctatctca

SEQ ID NO: 24139 - DNA, 201 bp, Homo sapiens
tagttacccagggagctaggccactcacatttcactggccaaagcccatcacctagccagatcagaacttctaaggggccagggaagtgtaatcctattgwgtatctggaaggagagaaattcaggaacattttcaaccacctagtgaccaccatatcctccaggtcctatctcaggtttcctgtgtggagatgtctgttg

SEQ ID NO: 24140 - DNA, 201 bp, Homo sapiens
tcttggcatatcttaaccctggtggtagctccctatccattctctaggacctggctctcttactgtgagcttgggaaggtttcaaatgagagattgcttcwctttcattggtcatttaaaaggaaccacaactcttgactttatcaagtgatagaaacttgagcccagagtcccggctgtagaatgtctaaagagaatgcc

SEQ ID NO: 24141 - DNA, 201 bp, Homo sapiens
cctggctctcttactgtgagcttgggaaggtttcaaatgagagattgcttcactttcattggtcatttaaaaggaaccacaactcttgactttatcaagtkatagaaacttgagcccagagtcccggctgtagaatgtctaaagagaatgccactgaaccccatcattccctacgcccttctgcattcagaaaaattaaaa

SEQ ID NO: 24142 - DNA, 201 bp, Homo sapiens
aaacttgagcccagagtcccggctgtagaatgtctaaagagaatgccactgaaccccatcattccctacgcccttctgcattcagaaaaattaaaaacatwaggacttgtgtgaaccatgtatggggcatttttcttcagagtcaagcactgctgtctgaaaaagaacacttctttccagaaaactctgttttttcagaac

SEQ ID NO: 24143 - DNA, 201 bp, Homo sapiens
cctagctacttgggagtctgaggcaggagaatcacttgaaccagaaaggcggatgtgtagtgagccaagatcgtgccactgcatttcagcctgggtgacasagcaagactccatctaaaaaaaataataaattaaaaattaaaaaaacagaccaggtggcttaaacaacagaaattttcagttttggaggctgaaagtcca

SEQ ID NO: 24144 - DNA, 201 bp, Homo sapiens
tgaaagtccaagatcaaggcccgccaattcagttcctagtaagggccctcctggcttatagacagccagcttttcatggcgtcctcctcagcacgcactcyggtgttccctcttcactggggcgctaatcctagcatgggggtcccactctcaggacctcattactccctaacctcccaaaggcttcatcttaaccaccat

SEQ ID NO: 24145 - DNA, 201 bp, Homo sapiens
tgtatttaattaaacttctagctggcttagccaggcaagcctgccttgtgttgtgttgtagtctcctcaaactattagcaaagtctttccaaacaaatagyaccccaaaatataaaagaggcagttgctggaaaggaggcagtcgcggatgtggtttttctcaactcttcctttaattttcagatttctagcttccttgga

SEQ ID NO: 24146 - DNA, 201 bp, Homo sapiens
tttttgaggtcagctgttactttctggaatagtgtgtgatttctgaaggcagttacagctcaccagaggggccaggatgggccccagtgaatgctggttcmacggcacttttccaattctcattaagcacaatggcttttagtttaaaaaaaaaaaaaatccatcacagacgtacataccagactgccattagctgacccg

SEQ ID NO: 24147 - DNA, 201 bp, Homo sapiens
acattggcacttgttctgcagaagtcccttgagcacctatgacaacaggctggagccgcctattcttgcccccgccctaatgcacagcccccatcttcccytcaggttcccaggttcttcctcctcttcatttataagtgacttgaaactaagaggaaactaagatttatagtttccaagctcagctgggactccagcgcc

SEQ ID NO: 24148 - DNA, 201 bp, Homo sapiens
tcgagaagagattggtcaccgcagcacagggcacgcagaattccattagtatcacttacctgggaagtccaggtgccttcaatagttgaggggagtaaatkatatgactacctaccttcaaaacttgtagtttaaagtggtaacttgaatactcacatttacctctgtttccttcctctaaaagaatggttttttaaaggg

SEQ ID NO: 24149 - DNA, 201 bp, Homo sapiens
gtacctatctcatggtggtgttatacagatcaatcatgtaaggtacttagagtataatgcttgacatgtaataagcactcagtaaatatgagatatcatgrttattatgctagcccagagaaactacggtatatgcagttgccggcaatgtctataaaatagtcttctcttgcagtgagtcacaggagctaacagctccca

SEQ ID NO: 24150 - DNA, 201 bp, Homo sapiens
ggaatgcagtggcacaagatggcttgtgttcaccactgagactgataaatgagagctggaaagagtgctccagtgtctgtcattgaaaagtggggagatavcctgtacctgggctccctcactgtcgagttcattattccctcacatggattaattggcctctcgaggtgagattgccactggttctgaaggatgcctctc

SEQ ID NO: 24151 - DNA, 201 bp, Homo sapiens
gcccatgatgttggagagacaaaactgaagctgtcctctggcctgtagttgggtagaatattttactgacctttgcccagatctttcacctttgttctccctagagtgtttccaggtatctcaaatgagatggaccaagtcttaaagcaccagtaactttaatgcaataaaaagatcaaatagtacttttagaaggagaca

SEQ ID NO: 24152 - DNA, 201 bp, Homo sapiens
cttccctccctctctgactttggccttgacactgatctgagcctgcagataacagaaaggaggagcttatctagacaggagtggtggaagtagccagtaayaaatcattgaagtgaggagaatgaaggtaaagaaattgatcagctttaaataggaggtgactccgcattcctcttgcttggaaatgatccccaggatgga

SEQ ID NO: 24153 - DNA, 201 bp, Homo sapiens
ttaactgctggcaccacttcaaaactctggctagtctttaaaataactagttagctttcattacaaaagtaatacctacacatggtaaaaaaaaaaaaaaattctaagaattacaggactaaggtgaaaaaataagccttcctcactacccctgcttattgttctctgtctttttgcagctatttttccacaaattactgt

SEQ ID NO: 24154 - DNA, 201 bp, Homo sapiens
tagctgggagtggtagcaggtgcctgtaattccagctacttgagaggctgaggtaggagaatcacttgaacccaggaggtggtggttgcagtgagccaagrttgtgccactgcactccagcctgggtaacagagtgagactctgtctcagaaaaaaaaggttagagcccagaaacctgtattttttacaagcgtctcagct

SEQ ID NO: 24155 - DNA, 201 bp, Homo sapiens
accactttgttctcaatccctcagtctcatcctgcagaagcccttgcctccaactctatggagaagaattaaggcctcccagtgagagtttcttcaacctyctctccaccccaggatttcagtttcccactgttcccctccccgccgccagcccaactgctgagggttctctcctggaacctgccacacttctttgacctc

SEQ ID NO: 24156 - DNA, 201 bp, Homo sapiens
cactgggtacaggattcttggctgataattgttttgtttaatcaggctaaagctaggaccactcccttctagcttgcagggtttctgctgagaaatccgcygttaatctgataggttttcctttataggttacctgatgcttttgcctcacagctgttaagattatttccttcatcttgacttcagataacctgttgacta

SEQ ID NO: 24157 - DNA, 201 bp, Homo sapiens
ttttataggccctgtgggatttatgctttttggaagttctattttggtgtatttcaaggtttttttttttcaaaatttagaactccttttagcagttgttrtaagtgctggcttggtagtggtgaattgtctcagcatttctttgtctaaaaaagactatctttccttcatttatggagcttagtttcactgggtacagga

SEQ ID NO: 24158 - DNA, 201 bp, Homo sapiens
ttttccttgtagaggtctttcatgttcttggttaggtatattcctaaggtgtttttttgtttgtttgttttgcagctattgcaaaaggagttgagttcttkatttgattctcagcttggtcgctgttggtgtatagcagtacttctgatttgtgcacattgattttgtatcctgaaactttactgaatttatttgtcagat

SEQ ID NO: 24159 - DNA, 201 bp, Homo sapiens
acccctgccacccttcccagcttctggtaaccatcattctactctttccctctgtgagatcaattttgtttagctcccacatgtaagtgagaacatgtaawatttgtgtttctgtgcctggcttatttcacttaacctaatgtcttccagttctagttcctgtcatttgttactgcaaatgacagaatttcattctttctg

SEQ ID NO: 24160 - DNA, 201 bp, Homo sapiens
tcaaaccagggtaattgggatatccaccacctcaaacatttatcatttatttctgctgggaacatgccaaatcatctcttctagctgttttgaaatatatrattattgttaactgtagtcaccctactgcgctgttgaatactaggacttattccttctgtttaactttacgtttgtacctattaaccaaactgtctttat

SEQ ID NO: 24161 - DNA, 201 bp, Homo sapiens
tagggtaccaggcactgtgtgtaaagtacatttcttatattacccctttgattcctcccaggaatcctatggcatctataatactatccccattttctaamtgaggaaatggaacttcagagtgattttgttccaagtagaaatcaggctctggcaactgcttcctgctagcagggtgagatacaaacttttacaaatagc

SEQ ID NO: 24162 - DNA, 201 bp, Homo sapiens
tttatctgctgaccttccctccactattgtcctgtgaccctgctaaatctccctctgcgagaaacacccaagaatgatcaataaaaaaaagaaaaaaaaaagtgttggaggttaggacttcaacacaggaatttaggagagaacaaaattcagcccataacaccaggtaaatagccaaatgaatgggtgctggtgagaagc

SEQ ID NO: 24163 - DNA, 201 bp, Homo sapiens
ggttgctttagttgagtctccatctctgtaaaaatagttgtaaagttaattttgtccctctctggtcagcagtggctatttaatgtgtgtgtgtacatctragatagggctaaaataaataaaatggtcatagcaaggagcagacggatagggggaggaatagtccaactgtccctggtgggttttccattatctgtgggc

SEQ ID NO: 24164 - DNA, 201 bp, Homo sapiens
tgggaagttgataaaacaagagagattgtaaaagccaagactttggatctctgtctccatctgatagtctgtgaaagaatcccagggtcaaggttgaaccstagttagagtcctgagtctttgtggggctggaaagccactgacattccaagagcagtttggaggccttttttattcaggaaccttctcagacaccttgca

SEQ ID NO: 24165 - DNA, 201 bp, Homo sapiens
tctggtccttttgctgtgtgtgtgggtgagtgacaaacactaggcggggagatgataccagccagggttcgatttcttgacccgaattgtagttacatggsggttcgttttcattctttgagctctaaattcgtattcccctcttaaaatgtgtttattgtattttagaattaaaaaaataaggtactttccaccatggag

SEQ ID NO: 24166 - DNA, 201 bp, Homo sapiens
cagttggccattaggtacatcctgatgtcagagatgttacaacatcaaataaaagtgtcttcttggccatctttctttcggctcttatatacctacccatkcttttaaaaacagctttctggtgtgtgtacatactataatttatttaatgctttccctgctggtggatcttatttcattttcagagtagtttattcaggt

SEQ ID NO: 24167 - DNA, 201 bp, Homo sapiens
tgggtgctttaaaatatatttttaattactttaaattattgaatcttccgaatagcgtaaaagatctgagaacagtataacaaacagtagtgtacctatcrtatagatttatcagatttttaatatatgtcattataattcaggctttcctcttaaaagaaaaatgtggctaggtgtggtggctcatacctataatcttag

SEQ ID NO: 24168 - DNA, 201 bp, Homo sapiens
tgtcctctagagaggctgcaccagtatactccccaccagcactaaatgagggtgccatttttcccattgcttttcaatcaagtgtgttatcacacattttkatcctagtcagtgtctcattgtgtttctcactcttataatgaggaaacatctttccataagtgtaagaaccatgtgtagtttcatttctataaactgttt

SEQ ID NO: 24169 - DNA, 201 bp, Homo sapiens
ttttctccaatggcgacagcttcttccaacaactgggtctctgttgctgaagtagaaaatagaaaagggagtgggcacggggatgttcctagtgtcacagrtctctgcagagctctccctcgtaagcttctttggttacatggctgttaatagctaaattattaatgcaggtttgctggtggagggagctgcttttgacca

SEQ ID NO: 24170 - DNA, 201 bp, Homo sapiens
acattagaaagtttagacagtagagggaaggagaaaaagtcccttttctaaaacaaattctactttcatttaaaatttctttctttttttttttttttttwagacggagtcttgcctctgtcacccaggctggaatgcagtggcgtgatctcggctcactgtaagctccgcctcccgggttcacgccattctctcgcctca

SEQ ID NO: 24171 - DNA, 201 bp, Homo sapiens
cacacacacacacacacacacacacacacaccccagaataatccaatggcaataaaatgcaagtatgacgcattatagtataagcattctaaatgattatrtcatcctatatattccctgccataattaaagaccttgtatgatttaaatgtttggacatttgtctttaattttctctttttttttgagacaaggtcttgc

SEQ ID NO: 24172 - DNA, 201 bp, Homo sapiens
tttatcttcctcccttccccctgctcacccttcccagtctctgttatctatttttccactctctaccaccgtgtgatcaaatttttagcttttggaattcytgaggttgctttttagagcgtttctgtccccttctctggctgtcagcttttatttcttgctgccagtttgtctgcaaggcagtaagtggcatccccctcc

SEQ ID NO: 24173 - DNA, 201 bp, Homo sapiens
atttgtctactgtaaaatttatcattttaaccgtttgtaagtatacagttcagtagatgttaagtatgttcacattgttgtgcaaccaatctccagaacgytttcattttgcaaatctgaaactctatacccattaaaaaataactccctattctccttccccccaggccccgggcagtcatcattctacttctatcttca

SEQ ID NO: 24174 - DNA, 201 bp, Homo sapiens
tttaatcttttttttttttttttttgaagtggagtctcgctctgtcacccaggctggagtgcagtggcgcgatctcagcctgactgcaggctccacctccygggttcacaccattctcctgcctcagcctccagagtagctgggactacaggcgcccaccaccacgcccagctaatttttttgtattttttagtagagacg

SEQ ID NO: 24175 - DNA, 201 bp, Homo sapiens
ctgggctgtgctggctctccatcccaaaagctccatgtgaagcctggcttgaaataaatgatttgcaggtatgaggaccccagaggtactacctgtgttcytgaggtgtgttatacatttctactaaagaacggatttctgctacaagaactctcactcctgttccctggatagcatatgatactttttaaaacaacttaa

SEQ ID NO: 24176 - DNA, 201 bp, Homo sapiens
aacaaaacaaaacaaaaacctcattttagcttaatcacttctcgaaagaccttgcctccaaatgcagtcgcattctaaagtgttggaggctccctctcccyctccctctccccctccccctccccctccccctccctctcttgccacggtctccctctgatgccgagccgaagctggactgtactgctgccatctcggctc

SEQ ID NO: 24177 - DNA, 201 bp, Homo sapiens
tacaactatttgactctttaaattgtgtgcacatgttactttgatagaaataaaagtggaatttcaagaatgcgctggtaggaacaattggtctgtgacastacttgcactttaaacgtgagctatcaaacaaaaacctctttcaagcatctctagcctcgcaacagatgatctgggcatgcagaagaccactgcaccccc

SEQ ID NO: 24178 - DNA, 201 bp, Homo sapiens
ggtctgacagatttggattcagatcttagctctgccacttactagctgagacatcttgggaatgttattttacttctcaatgttctcaccaaataggaatktataaactgggaatactgtcattattcccagtttacaaatggggacattgagaggtgagataacacatgagattattattacataaagttcttagtatca

SEQ ID NO: 24179 - DNA, 201 bp, Homo sapiens
caatgttctcaccaaataggaatttataaactgggaatactgtcattattcccagtttacaaatggggacattgagaggtgagataacacatgagattatkattacataaagttcttagtatcacatctggcatttagctgcttacatattacagttcccttccccttgttgtttcatttgtgcatggttttttgctttgc

SEQ ID NO: 24180 - DNA, 201 bp, Homo sapiens
ataaactgggaatactgtcattattcccagtttacaaatggggacattgagaggtgagataacacatgagattattattacataaagttcttagtatcacwtctggcatttagctgcttacatattacagttcccttccccttgttgtttcatttgtgcatggttttttgctttgccagaatacaggctccttaggtgcag

SEQ ID NO: 24181 - DNA, 201 bp, Homo sapiens
gagttatctaatatctttggcatgagccagaaaatggtggaaatggtagaaaatgtgttcttttcttactctaagacacaagggagttggaaaaagcacayttttttcctccacatttaaaaatgactagaaggtgagagagaaagagagaaagctcacctgcagccggtgaagtcacgcttttgcattccgtttgtagga

SEQ ID NO: 24182 - DNA, 201 bp, Homo sapiens
gaggatacctttctgtgtcagccagcaggaccaacatcctgagagccaagagccactgcagaccttccagctcagttccgtgcctggtttgcttccccccsatcccactcctgcctctgcatgaagcagggtggttctgcttctagagccagccttcttcactctcacctgacagctcttggcacacacctagctctggac

SEQ ID NO: 24183 - DNA, 201 bp, Homo sapiens
agtctttaattttgctcactggtggtaagagccggagtgcgagtgttggacatcttggaaaatttccccaggcggcacatgagatgatatttggatacttrcaaagaactttctagaatctccacagcaaagagttaaagaagtgtagattgtccctcactgtaatgattacggggtcttgtttttatttaacatggagca

SEQ ID NO: 24184 - DNA, 201 bp, Homo sapiens
gcatgccagcatgcctggctaatttttgtatttttagtagagacagggtttcaccatgttggtcaggctggtctcgaactactgacctcgtgatccacctrcctcggcctcccaaagtgctgggattacaggtgtgaaccaccatgcctggccaaactgtactatttttgcaactcttgtgtatgtctaaacttatctcca

SEQ ID NO: 24185 - DNA, 201 bp, Homo sapiens
cagtttaagagattggatgtcaatgaagtggcccaactgaatcatctaatggtgaagcccacaaccaagagctttttttttttttccattttttaaaataraagctttattaagacattcacatagcatgctttcactcattgaaattgtacaatttgggtttttcatagaatttgcaaccatcatcacattaaacatatt

SEQ ID NO: 24186 - DNA, 201 bp, Homo sapiens
agtaggaatcagagctagaattaacccctattttcttactattgacccagcatgctttctatgttgaaaagtgcaccacatcgagaagagattggtcaccrcagcacagggcacgcagaattccattagtatcacttacctgggaagtccaggtgccttcaatagttgaggggagtaaatgatatgactacctaccttcaa

SEQ ID NO: 24187 - DNA, 201 bp, Homo sapiens
ggaggagatacacctgcttgcacgtctctagcagatgtgtgtgacctgcccccaactcctgctaattctggcccctttcttagcctcttctcctatatccrtctttccttggcttcctattacctttacttcttttctcagatcctagggttttttttactcttttaatttacatttagtctttccttttttatgatcaga

SEQ ID NO: 24188 - DNA, 201 bp, Homo sapiens
cagcccaacgcacagatcagggtagatgctgtgtcagttttcttcccaaagtgccacattcagttctgcatcctggttccagggggttcctacctgcctcrgtacactatcatttttcctcatcctcagcattagttgaaggtctcttccatcctaagtcagcagctcttcttcagctgggatttgtctgcctcttcactc

SEQ ID NO: 24189 - DNA, 201 bp, Homo sapiens
atatgtaaaatggccagcccaacgcacagatcagggtagatgctgtgtcagttttcttcccaaagtgccacattcagttctgcatcctggttccagggggktcctacctgcctcggtacactatcatttttcctcatcctcagcattagttgaaggtctcttccatcctaagtcagcagctcttcttcagctgggatttgt

SEQ ID NO: 24190 - DNA, 201 bp, Homo sapiens
tggacttcagacagaacacagcccacatcatgctttgagctgaacacgtttaaaagagtttcacattgaggttgaagcatggctgtgcagaatgacatatraggaatgactgtattcccattataggagtcaccctgcttttttactctcccagaagagttgtcttatttctgatttgggtgagtgcagactacagttgtg

SEQ ID NO: 24191 - DNA, 201 bp, Homo sapiens
ttaaagttataatattaacaaaacaacatggttgtagaggggatggataaatgattttattccgtttttttctttcttctttttttttttttttttttttwactgcctcaggcatatttgttggcattttcagaaggagatagaatcaggagttatttttctgctaggaaatgtttaagtaaatcccagttgtgatcaata

SEQ ID NO: 24192 - DNA, 201 bp, Homo sapiens; identical to SEQ ID NO: 7974

SEQ ID NO: 24193 - DNA, 201 bp, Homo sapiens
ttcaaaaaatttatttcagtagtttttgagaaacaggtggtttttggttacatggtaagttctttttaaattttattttaagttctgggatacatgtgcaraaagtgcaggtgtgttacataggtatacatgtgccatggtggtttgctgcacccatcaacctgtcatctaggttttaagacccgcgtgcattaggtattt

SEQ ID NO: 24194 - DNA, 201 bp, Homo sapiens
ggtggaatgaataactgaaagagcaaagccttagactgtctaaacattacattgatttccacctcatttttctcaggactagccgtctatgtgtaaagcartttgtagaaccatgaactatgttagggaagggagggcattactgaatctctaccagatagcaagcattttgctgtattctctacatgcaaaatctcattt

SEQ ID NO: 24195 - DNA, 201 bp, Homo sapiens
tgagccaccgcgcccggcccagaaacctagatgcttcttatctctgagtccttctgacctcttaaccctaggctgtagacctcctcttctcagcataaaaragaagagttttggaaagaattttctacgagagaatcttgtggcaaagctgtttcaactggatgccttctttctgtatttatattccagttagcgtatggt

SEQ ID NO: 24196 - DNA, 201 bp, Homo sapiens
ataaaagagaagagttttggaaagaattttctacgagagaatcttgtggcaaagctgtttcaactggatgccttctttctgtatttatattccagttagcrtatggtctgttgctctttcactccccagtgtgtacgtctgaaacagccaatatgttattttaggaagaaataatacattgcaatatctgatcaataaaac

SEQ ID NO: 24197 - DNA, 201 bp, Homo sapiens
actgacaggtgtcaataggcaagccaaggtcaaggcagcgagcattttccaagtcacaaagggtgcagggcttgttgtcgggatgatttgcagggagactscttcagtgggctctggtttcctggggccaggcgccctctatcctctagaagagaagtctcagtgcagccccctctccctcagttgcctggtttccaggga

SEQ ID NO: 24198 - DNA, 201 bp, Homo sapiens
cttcatttcctgtcttgaagcaggtcagttgcttttgggagaccgcagtggtccctcggtcttatcttttagatgtggttgaagtaaaccctgccagtttrattaaccactaagcggttcccttcactcctgcctccctccctccctccctctgccagagagagagacaagttctttttcctgagtgttgtggcttgggaa

SEQ ID NO: 24199 - DNA, 201 bp, Homo sapiens
gacctcatgatccgcccgcctcggcctcccaaagtgctgggattacaggcgtgagccaccgtgcctggcccagtatttaatcattcttaagtgtgtatgtrtcctggactcacttactcagggtgccctaagacgttcagtgaaaagactcccaagtctaagacgtggaggttaggcgtgccgaaggtttgggcaacaccc

SEQ ID NO: 24200 - DNA, 201 bp, Homo sapiens
cgtgttagccgggatggtctccatctcctgacctcatgatccgcccgcctcggcctcccaaagtgctgggattacaggcgtgagccaccgtgcctggcccmgtatttaatcattcttaagtgtgtatgtgtcctggactcacttactcagggtgccctaagacgttcagtgaaaagactcccaagtctaagacgtggaggt

SEQ ID NO: 24201 - DNA, 201 bp, Homo sapiens
aaaactaacatacagtctgtaaggaactgggcacgagaatggggccctgaaagtgcagtcattattctgtctttgtattctatatgagatgtattagagamcaaagaaggttgtggtggaactgaattttaattggggcttcattgattggcaacataacccatttccaagaaataaagtaatagctgtggagcaggcttt

SEQ ID NO: 24202 - DNA, 201 bp, Homo sapiens
gccattctcctgcctcagcctcccgagtagctggaactacaggcgcccgccactacgcctggcttattttttgtatttttagtagcgacggggtttcaccrtcttagccaggatggtcttgatctcctgacctcgtgatccacccgcctcggcctcccaaagttctgggattacaggcgtgagccaccgcacccggccgac

SEQ ID NO: 24203 - DNA, 201 bp, Homo sapiens
gtgctctgtacatagtggatttgctaagtgctgaagactagaaaagacttcttggtagagtgttgttattaatgctgtgttttaatttgcaccctgtgtgrtattgcaccgtataggtttttaagttatgtgagttcagatatccacgatttattaaaataataacaagtattattattgttgtttaaattgggtagagaa

SEQ ID NO: 24204 - DNA, 201 bp, Homo sapiens
attcacctgtattgtttgttgttggagattgtttgtcttgacttatgttcagtgttctactgtatgattgtaccatagtttatagatctaataaaagtgtraaaagaaaagtaagagaatgatggttaactgcttagctggttaactcatatattgggaggtaggatagatgatggataagttccatgtagttagatgtag

SEQ ID NO: 24205 - DNA, 201 bp, Homo sapiens
aattggtatcatctgtatgtaatctttcctattttcacttagtattatattgctgtgattcacctgtattgtttgttgttggagattgtttgtcttgactkatgttcagtgttctactgtatgattgtaccatagtttatagatctaataaaagtgtgaaaagaaaagtaagagaatgatggttaactgcttagctggtta

SEQ ID NO: 24206 - DNA, 201 bp, Homo sapiens
aaggcagaaagcaacacccattcccattccaaacacaatagctctgttagtttttgcactcagccttgcagcccttgtacaggtaggtacccgtgtttacrtggctttaactacaacacacctaccattttgaattttgtattgttcctgaattaaatatcatctatacatttctcttcaaaactgtaatatgccccaact

SEQ ID NO: 24207 - DNA, 201 bp, Homo sapiens
cggggtggagagtggcaaaatagataacagagaccagagacttggaagggtgagtagggggaagggaggaagataaagagatgaagagaagtgggttaaargatacaaacatacagtgagataaaaggaaaccagagtagggtgaatatacttaacaaaaatgtactgcacttgagtaatggacacctgaataccctgact

SEQ ID NO: 24208 - DNA, 201 bp, Homo sapiens
ctgaaggaaaagtaagtagatgacagtagtttcagcaaggatgactctgcacagctttccccatcaggacgtttacataagcttatgaacgccccgtcttrgagcacttagaatgcctttcccaggctgtctgagtgagcaggtggttactgatgttttggttgcatagatgtgacccacaaggtcctagagaagctgaag

SEQ ID NO: 24209 - DNA, 201 bp, Homo sapiens
ttgatttttcactacaacacagcatcagttgatgcactatggccctgttttgcctagcaccagtttttgtacataaaattgtatgcatacatagtatgccyttcatttacaaattgtctgtggctgctttgtgacacaatggcaaggttgagtcattacaacagagacaaaagaccaaacagctaccaaaacctacaatat

SEQ ID NO: 24210 - DNA, 201 bp, Homo sapiens
agttcattgatttttcactacaacacagcatcagttgatgcactatggccctgttttgcctagcaccagtttttgtacataaaattgtatgcatacatagwatgcctttcatttacaaattgtctgtggctgctttgtgacacaatggcaaggttgagtcattacaacagagacaaaagaccaaacagctaccaaaaccta

SEQ ID NO: 24211 - DNA, 201 bp, Homo sapiens
tctgtggatttgacttgtagcttggctttcaggctttaaactgtctttggcttggaggtggggtttcaccggggactcgcccctgtctgcccaggcatttktctgcttcctggcaccatcactgcttgctttcctccctcactattgtatttgtgggatttatccatcttgacaccagttcattgatttttcactacaaca

SEQ ID NO: 24212 - DNA, 201 bp, Homo sapiens
ccatcagaggagagtgcaccaaataagaagacagtttctcaatccagtctgtggatttgacttgtagcttggctttcaggctttaaactgtctttggcttsgaggtggggtttcaccggggactcgcccctgtctgcccaggcatttgtctgcttcctggcaccatcactgcttgctttcctccctcactattgtatttgt

SEQ ID NO: 24213 - DNA, 201 bp, Homo sapiens
gcccaggtggacttcacactttcacttctaaccactacagcaaaatgtatgcttggaattgtcagctggggcagatcataagaagttgagaatataaaagrttatattttatactcagtgagaagcagttgataatgagcagatgcaggatgaggagaggaagaagatcacatgatgggagactggggaactgggaaatgg

SEQ ID NO: 24214 - DNA, 201 bp, Homo sapiens
ttccatgctttgctcatttaatttttataaaagcttatgacagagacattatttttgtcctcactttatagatgaggacattgaggcttagagaagttgartaatttttccaacatcatatagctagtgaagtggtaggctgaaatttgagcccaggtggacttcacactttcacttctaaccactacagcaaaatgtatg

SEQ ID NO: 24215 - DNA, 201 bp, Homo sapiens
ccaccctgcttggcctcccaaagtgctgggattacaggcatgagccactgcacccagccaaatttaaaaaaaaaaggtagagatggggttttgccatgttrcccagactggtcttgaactcctgagctcaagccaactgcttgccttgacctcccaaagtactggaattacaggtgtgagccaccccacccagccccccaa

SEQ ID NO: 24216 - DNA, 201 bp, Homo sapiens
agtgaggtgtgatgactgcatctgacctggagcaggaacttctataagccagtttcagcagcacaaaaagacagtcgtctgatgcagtgcaaaggaatacrcatcaccattatgagattgttctgccaaaatcatcccacctgaatctgattgagcctctaaatctaaccattagtttactggaaattcagggacagggga

SEQ ID NO: 24217 - DNA, 201 bp, Homo sapiens
gcaaaactgagaggaaggtacagagattttccaaatcctctgccccaacacatacacagcttctcccattatcaatatcctcggccagtgtgatacaatcrttacgatcaaacctgtgttaacacatcaagtccataatttacattagggttcactctggtgttgaacattctatggatcttgataagtatatcatgacac

SEQ ID NO: 24218 - DNA, 201 bp, Homo sapiens
tggtcactctggtcactgtttcttcttctttccccattcctcaaaatgtttagactacttgagccttcataattatcattggctctgaacaaacttacgcrtttattttctgtgcatatatatataaaagactttatgttttagaggggtttgaggttcacagcaaaactgagaggaaggtacagagattttccaaatcct

SEQ ID NO: 24219 - DNA, 201 bp, Homo sapiens
gcagcctcagtgaccttcaagcctctcttcttcgcctttaatactggcccagctcgcccatcaggttgcttcatacctgccactggtcactctggtcactktttcttcttctttccccattcctcaaaatgtttagactacttgagccttcataattatcattggctctgaacaaacttacgcgtttattttctgtgcata

SEQ ID NO: 24220 - DNA, 201 bp, Homo sapiens
acttgaacactgtgatcccttgttctttcccgccagccaaacttgtccacattggtcaccctcatcatgtgcttcttatacctagaggctcaggcattctsttctgttacccagattctgttcttccctacttcttgtgtaaatctgtaaatgttcagccaccatttatcaggggctctaccaagtgcactgagcctgagg

SEQ ID NO: 24221 - DNA, 201 bp, Homo sapiens
cagtgttagtgggatgagtatgcagtcatctgagaacatctcctgatgtcttgctgtttctttttcttcctgcagccaaggctaagtcgaaatgtggcccraccttcttcccctgtgccagcggcatccattgcatcattggtcgcttccggtgcaatgggtttgaggactgtcccgatggcagcgatgaagagaactgca

SEQ ID NO: 24222 - DNA, 201 bp, Homo sapiens
ggcaccctctgttcagcatgtaccaaaattatagcctcccagaagtaaggaaagcaggggtgttcagtgtaagttgtactgtttgcataaacagtttaggyacagtgagccactcttgttaggtagggtggtgcaaagtctcccaaaatccaagttcccagactccagccaaggaagagccaaccttgcaaggaggtcttt

SEQ ID NO: 24223 - DNA, 201 bp, Homo sapiens
accattaacgggagagtacattaccccacagggctgtttgttatttagcaggacactcaattaagcccaagttacagcagtttctgctaaaactgtttgtrcagcatgagtggaagaagaatttatttggagcaggagtctgccttctgttgtgaaaagtgacagcctctggcagagagagaggcaatgctgttgagttgg

SEQ ID NO: 24224 - DNA, 201 bp, Homo sapiens
gcttgaggaaacactctcagcgtagatggcaaagcctataagcattcttccctcatccctcaaaaggtgatcagaaccagactggctgatcaaggaccgtrtgtcagaagcttgaacctgtctggaaggacacgatggctggagagctggcagaggggcaaacctgaccctggaaaatggaactcctctgcttttctgtta

SEQ ID NO: 24225 - DNA, 201 bp, Homo sapiens
tagaagagagatcctggagacccacagctacagcaggagctgtttccatagcctgagagatgcagcaggtctgattagctgacttcatggctgttctggtkgaacagagaggcttccacattgcagcctctgtccagctcttttgtatgattgctgcctgggaagagtctggggaggtggccagagacagcaagcccatgc

SEQ ID NO: 24226 - DNA, 201 bp, Homo sapiens
cagtaaagttacccttagccattaaaaatgatgatgtgtaccagtagttattgacaagaaaagatgtcacaacatattatgtagcaaaaacaggtttcagratagcatatattttaagggtgcatttaagtaaaattgcatgctcggatttctgcctattaattcagtcagtaattattgagtagtctgtgtgcctggcac

SEQ ID NO: 24227 - DNA, 201 bp, Homo sapiens
ccacagtttgaccttttaccaaatgagctagaggactgaatatattaatagcagcaacatcagatcgaccgctttttgcagtttttagctagcaatggccrcatgtcggttttcactttggggagctgtgcatgttgattcaaattatgtgaattttatactttgattcttttctaacatatacttttgattagcccttgt

SEQ ID NO: 24228 - DNA, 201 bp, Homo sapiens
cctggagaatccaggcagattactttttagaagtcagttatttttacaaggccttctttgctttcttgtccccaaccatgaagtcattttcaaaggaaccrcagtttgaccttttaccaaatgagctagaggactgaatatattaatagcagcaacatcagatcgaccgctttttgcagtttttagctagcaatggccaca

SEQ ID NO: 24229 - DNA, 201 bp, Homo sapiens
ctcccgagtagctgggactacaggcatgtgccaccacacctggctaattttttgtatttttagtagagatggggtttcaccgtgttagccaggatggtctygatctcctgatctcgtgatccacccacctcagcctccccaagtgctgggattacaggcgtgagccaccgcgcccggcccagaaacctagatgcttcttat

SEQ ID NO: 24230 - DNA, 201 bp, Homo sapiens
ctttatcttccttttacagatggggacgctgaggctgagggaagttaagtgattcatccaagatctcagtgattacgtggtggaactgaggtggaaacctsgatgcttcttttcttttctttttgacagagtctcactctgtcacccaggctggagtgcagtggcgcaatctcagctcactgcaatcaccgcctcttgggt

SEQ ID NO: 24231 - DNA, 201 bp, Homo sapiens
aatagctaatactgtataataatgctggataatctgtaacactcaatactacataacactacattttatattttataatactatattttatagtgtaataycaaataataagatgtaatgtataaaacgatagcaaatatagtattaactatcatagctaatactttgttccagaaaaagtgccaagtaattattacattg

SEQ ID NO: 24232 - DNA, 201 bp, Homo sapiens
tttcttcagaaaaaacaaatctgactcatcactttcctttagaaagatgtctgttggcttccaggataattccagactcctgtctgcctcgctcccagacrcatctcctgccgcatagcccatgtcccaggtgtcctaacttctcccagatttctgtacaagccataacctgtttcaactctgagcttcagttcatgccat

SEQ ID NO: 24233 - DNA, 201 bp, Homo sapiens
tctcttctgctccctcagggctgttggggggatgaggagatttccttgactttcaatagcctcatgatatctttgtgagttcatataaaaagtttcttcasaaaaaacaaatctgactcatcactttcctttagaaagatgtctgttggcttccaggataattccagactcctgtctgcctcgctcccagacgcatctcct

SEQ ID NO: 24234 - DNA, 201 bp, Homo sapiens
tcatcccttagatatcacctttcatgcagttggatgatacctttactgaaagactctttttttaggtggaaactattctgttctccctgaatctctgtgcycacatctggtcttaatcccagggacttggatccactgtcaggaagtttttccaccaagtagtgaaaagcctccagaggctcagttacctaacccacattt

SEQ ID NO: 24235 - DNA, 201 bp, Homo sapiens
ttccccattcttccctctcttagtccctgggaaccactaatccactttttgtctctacagatttgcctattctggacatttcatataatggaatcatacartatgtggccttttgtgtctagcttctttgacttagaataatgttttcaaggttcatctgtgttgtatcatgtatcagtacttcattccattatatggaat

SEQ ID NO: 24236 - DNA, 201 bp, Homo sapiens
taccctcccctgccatccctgggcactctgcttcagccccactccacaacccttctttctgtttcaagttcttcccaggctttaggtatgttcttgagatrttgcctctgcctggctgctgtcccctcttacccttggttggctgacttcttgtcttctaaacctctctggaactgcttctgccttagatattcctttcct

SEQ ID NO: 24237 - DNA, 201 bp, Homo sapiens
ctctgctgtgctgccccctgtgggtaagtgcacaccacggcaggtctgtatggaggaggttttcaggattcacttggagctctcggaatgcataaagtgcratactttcccattgccgcaaaaagatattgcattttaaatgtctgaaatcatgattgacttagctcctcagccctgaagggtgcagcagtggcttgaagc

SEQ ID NO: 24238 - DNA, 201 bp, Homo sapiens
gggtttcaccatgttggtcaggctggtctcgaactcctgactttgtgatccacccgccgcggcctcccaaagtgctgggtttacaggtgtgagccaccgcrcctggctgacagcctgcctttaaacagcaactgaattttatataataggcactgtgcccaatgctctgcatggatgatctcattcagtcctcacatcacc

SEQ ID NO: 24239 - DNA, 201 bp, Homo sapiens
atcctttttgaagtcttatatttaaggctggccttgaggaaaattacataggagcagcattgtatttaccctttgtatgactgcaggggatgtgagtaaartcaaaacaaaacaagcaattttaaaaacaaaacagtacctctgtgagtgaattccagagtagaccggtatgccatggccgagcaaggtagaagagcagct

SEQ ID NO: 24240 - DNA, 201 bp, Homo sapiens
ggtctgatttttttttttttttaaactctgcagtgaggagtaggacccctatctgtttttctaactgtacttcttggagtgccaaagggagaaaggagagmacctgagccatgggggcttggagcatggactcttgtccttgccgaaaacaaagcagctataagtctattttgtaaaaaatatctattgggcttgagattt

SEQ ID NO: 24241 - DNA, 201 bp, Homo sapiens
gatgtgtgaagggtctagcatatctgtcataaggaccaatcaggatttgctaggacccagctctctgatttgaggtctgatttttttttttttttaaactstgcagtgaggagtaggacccctatctgtttttctaactgtacttcttggagtgccaaagggagaaaggagagcacctgagccatgggggcttggagcatg

SEQ ID NO: 24242 - DNA, 201 bp, Homo sapiens
gacaaatcttacattgccagcctcttttgatgtctgggtagggggaatgttcagcagagcattccttctgctaagtccaggcagatgcattgcagttagtwtggtggcctcaaaagcaaactgttttgaacagggagtgctaagtaatgggatggtgacatgatatgggttattgctttgttttgcttttaaagttctttc

SEQ ID NO: 24243 - DNA, 201 bp, Homo sapiens
ctgcatctaaacaagcagcccaggggagtctggtgctcactgaattttgaaactcatctgtcataggactagactgagtctcactgagtaaggaagttggytggacaaatcttacattgccagcctcttttgatgtctgggtagggggaatgttcagcagagcattccttctgctaagtccaggcagatgcattgcagtta

SEQ ID NO: 24244 - DNA, 201 bp, Homo sapiens
gtcaagtgaagtgttgtttgcctctcctgctctttcaggatctagcaataaagcctgtgatgtttactgacctctgagagagaggtgaggagaatagaccygagaattttgtttatttggagagaggagggagagaggccatcctgttgctttcttgaatcacatagagagctaagagagaatgcttcaaagatggattgg

SEQ ID NO: 24245 - DNA, 201 bp, Homo sapiens
catcacttgcatgtacctgagttacttatttctattgtccttgcccttcattttggtgggataagggtggagaggcaaaaaatcagtgtctcagattctcyatgagatttaaatatgcaggatctgaagaccatcttggctcctgctgtctcctgtcaagtgaagtgttgtttgcctctcctgctctttcaggatctagca

SEQ ID NO: 24246 - DNA, 201 bp, Homo sapiens
ttgagtcagaagggagtctggaagcagaattccttcttttcccgggaacctcagtcttttctctgaaagccttcaactgattggatgaggcccgcccacaytatttgcttgaactcagagatgttaatctcatctgaagaaatatcttcacagctgcatctggactggtggtggactaaaagctgattaccatagcctagc

SEQ ID NO: 24247 - DNA, 201 bp, Homo sapiens
atctggatgttagattagaaaatttgatatttacaaatgtgcttcaccttgaattagccatgacccagttgctattgtttgttgaaagagatatcttttaraattttacttatacaactgacttgcttttcaaaagcacaataaaatcttatgttcccattataaaagtacatatactcattacaggatgtttggaaaata

SEQ ID NO: 24248 - DNA, 201 bp, Homo sapiens
ctgcccctgcacttgcatatggtcttagattgctgctcatttccaggcacagatggcttgcttcaaaattttttgcttgaacagggtaaaaaagcgagagktggtagcttttaagtgtacaaacttgccaagaaaggaaaatgctgtgagtggggatgattgctggcaagcagcagggtccgatataatccatgtctgtcc

SEQ ID NO: 24249 - DNA, 201 bp, Homo sapiens
attagcttatgggatccacattaatgaagcctagccttacttccctgcatatgatgtgtgactgggtatagtcaagtgcccagtgtaggtaaatagatttyggagaatggtgatgtaagatacctaccaaccatatgtggaaatccttttcaggatggtttccctctgcaagactgtaaaggtaggaaatgcactgccttt

SEQ ID NO: 24250 - DNA, 201 bp, Homo sapiens
agtctccatttttaaaatgcattggctaactttgcagcttcccccatccccttctcatgacagtctccctttctggaatatttcaaatgcaaagggggaarcagggttgtcgttatatctggatcctatccacaagggctcagcagctgtgatgttcagcaggccaaatacagacccaagagaccaaacagcttcttcctt

SEQ ID NO: 24251 - DNA, 201 bp, Homo sapiens
agaaatgaggaagaagaagaacagtgagataaggagatagtgacagtgatacatgttgacaattccattgaaaaagaacttggccgggtgtggtcgttcayggctgtaatcccagcacttaggacacgaaggccgaagcatcgcttgagcccaggaatttgagaccagcctgggcaacatagtgagacccccatctatata

SEQ ID NO: 24252 - DNA, 201 bp, Homo sapiens
gtgagtggttctgttgcacttttgttgatttttaaaatttctttttatttagtcagtttttaaagtcccaaatgaaccatggggttcttggcccagagaamagatgaacattggttaggccagggagttattttccagcaaactgcccatgagttaaactccactctgtggattgggggtcatgataagggaagggagccc

SEQ ID NO: 24253 - DNA, 201 bp, Homo sapiens
ttaaacgggaacattaataatttcctgcttagtgcaggatgtagtccaaaaactcaaaatgagttgtccagataaagggagacctctgggggatgccagamaaacttggtcttgtcagaagagaaaaacttgagagggagttaattgaagagtttcccacattgcagcttgtgagtggttctgttgcacttttgttgattt

SEQ ID NO: 24254 - DNA, 201 bp, Homo sapiens
gctgtaaggggctgatggggtctccagattgtatacagtttcctgcacccccgaaaccatcatagaggatctctgccccctcatgcctttaaacgggaacwttaataatttcctgcttagtgcaggatgtagtccaaaaactcaaaatgagttgtccagataaagggagacctctgggggatgccagaaaaacttggtctt

SEQ ID NO: 24255 - DNA, 201 bp, Homo sapiens
gactctgctgattcgaggtagagccttgcgatgtgtcagaagtcctttgctttcgttgagaagaacgtactgagtggaaattgtataacctcatcaacagytaagcacctgaagggataaaaaagaccgccagtagttggcagtcttggttgaggcttcaagattgaatccaaagcagcttgtgattcctttggagtggca

SEQ ID NO: 24256 - DNA, 201 bp, Homo sapiens
ggaggcactttcccaatcttagaaatcacaacagaggtttagagaagtcgtagggaaaagaaattgtttgttgttgtctaacctgtgtttcctgaacttarttgaccaaaaaccccgttattttcccccattccatactgcctgtagcctcccatgcaaacccatttcagaacctgcagctgcagtcagtctggagtcagg

SEQ ID NO: 24257 - DNA, 201 bp, Homo sapiens
ttccttagaaccctaaatccacaagcagctccgcctgtggtcacatgaatttgggaggcactttcccaatcttagaaatcacaacagaggtttagagaagycgtagggaaaagaaattgtttgttgttgtctaacctgtgtttcctgaacttaattgaccaaaaaccccgttattttcccccattccatactgcctgtagc

SEQ ID NO: 24258 - DNA, 201 bp, Homo sapiens
tttgctgggtcagttggcacccctccctctcttaggacattgaggcttgtctctggattaccttggttgatctatttctggatctgtctgtaaatttgtcrtaaaggtagaccctgttaccaagtacatgttcttaattagcaagacacattttgaatggctaagtggaacatccctttttgcaatcccagtgacccattt

SEQ ID NO: 24259 - DNA, 201 bp, Homo sapiens
gactctgttaccgccattttacgaagaaggaaactaaggctacaaatgttaagtttcttgcccagggccacatagctagtaaacaattgggctgggctgtrgtcaactcaggtctctttccaaagcccatggtctttccatggcactccgctccctccttaatagatgctaagttccgtgagggcgggatcccactttgaa

SEQ ID NO: 24260 - DNA, 201 bp, Homo sapiens
cagggtctgtggctcccagcgctgtagtgtcctgccacgtttgtctcagttggtaattgggtagaaaaccatctcctggggcttggtgaccagggtatgarggcactgaacacagtgccagagcttccagaagtgctggggcaggtgcatcccttgctgacttggggccccattgaggctctgcgtctgttcctcatgact

SEQ ID NO: 24261 - DNA, 201 bp, Homo sapiens
acaaatgattcaagaagcaccgtctgtgtctgagacgctgtccctgcacagcagtgtcgtccagctggtgagagatgaggatgagagggagtttgaatctkttcgctgctcctatctacctgttgaaaatgtcagagctgtgagtctgcttctgggctggtggccagggtctgtggctcccagcgctgtagtgtcctgcca

SEQ ID NO: 24262 - DNA, 201 bp, Homo sapiens
ctagaaaggataggacaaaataacccaacttggaaggccccagaaagacaaatgattcaagaagcaccgtctgtgtctgagacgctgtccctgcacagcartgtcgtccagctggtgagagatgaggatgagagggagtttgaatctgttcgctgctcctatctacctgttgaaaatgtcagagctgtgagtctgcttctg

SEQ ID NO: 24263 - DNA, 201 bp, Homo sapiens
ctagcatagggattttagaaaaggagcccagtgatggtcctctccttggttctcaaccctgtgatctttgtgttttaacccctgccctgtcactttagggrtctggaagcgggaaggagacatctgcgagtgctcagatgactatctcgatacactcagggtgtattttctggggtgactgtaggggcatctcggttcatt

SEQ ID NO: 24264 - DNA, 201 bp, Homo sapiens
aatgccacaggaaaaagagaaacaggtatggagactgtgtgttccagccttcctaagtgtattagttggctgtggctgctaacaaaataccacagactggrtggcttaaataacggaaatgcatctgctcactgttctggaggccggaagtccaagcacaaggtgtcagcaggtctggtttctcccagcaccccttttttt

SEQ ID NO: 24265 - DNA, 201 bp, Homo sapiens
cccatttaagctgcaatatcgatctgctctgtgaaattgcagtatcagaggttgttttcttttttttccttaaccatacaattgggacctttccctgaatytcagacaggatgtgcaggctaacttgttccattttctaaggaaaaataaaccactattgcttgcttccagtcgcctcccccttcttcacttttggggaag

SEQ ID NO: 24266 - DNA, 201 bp, Homo sapiens
aatttttatgtgcgtcttggaaggctggggaggatgtggaagcggatgcatccctccgggaaaatggagacagctgcctgaatggaaacccacagccccakccctgtcctgaggtctggggtttgatcttgtagtgcatctgatcaactttagtacatgcttactgggtcgttggtctaggcagtagccagaataggagaa

SEQ ID NO: 24267 - DNA, 201 bp, Homo sapiens
tggggattcgatggcagtaatatatgtgaaaatgctctgtcaactaggaagcaatgcaaaggcaggataatgtttatttaataagaataatcacctatcgrgtttttctttggtccttggctaagtagctttgtagcatttggaggcttgggagagtttgcagtgatttacactctccataccttgaagttcatgttcgtt

SEQ ID NO: 24268 - DNA, 201 bp, Homo sapiens
aagaacagcctaacacagttacccaaagccctacaactagcaaattctggcagggccagaattcagcatagatattaggaagaggtccatggaacataackcagccatgctaagcctcatttgtcactggccagcaacctgaactgaggttgaccaggaaatggatttgtgatgggaccattctgtcactgtttgtgtatg

SEQ ID NO: 24269 - DNA, 201 bp, Homo sapiens
ggtgtttggatcatgggggcggatccttcatggcttggtgctgtctctatgatagtgagttctcttgagatatggttgtttaaaagtgtgtggcacctccygccagactctgtcttacttgcttctgctttcaccatgtgacatgcctgctcctccttcaccttctgccatgatggaaagtttcccgaggcccacccagaa

SEQ ID NO: 24270 - DNA, 201 bp, Homo sapiens
aaaatccaaaaattagttgggtgtggtggtgcacacctgtaatcccagctactcaggaggctgaggcaggagaatcgtttgaacccgggaggcagaggttkcagtgagccgagatagcaccactgcactccagcccaggcaacagagtgagactccatctcaaaaaaagaagaagaaaaaataaatccctaagtgggagat

SEQ ID NO: 24271 - DNA, 201 bp, Homo sapiens
ggaagtggtttcttcatccagagctctcaagctttgagagggaattttacatatcatcttaacagtggtgtgtgggaaatgagatatggcatttttgttcragggaactcttgtaggcccccttcacatctcatggagaaggcagcagtgtagtttttgcaagcctgagcccagcctttcagctgaaggtagctgcagcca

SEQ ID NO: 24272 - DNA, 201 bp, Homo sapiens
tttcctgtcatgtcttaggctgcttaatcatagattctcactccatagggtctgcagcatttgcatgtctgaaggaagtggtttcttcatccagagctctyaagctttgagagggaattttacatatcatcttaacagtggtgtgtgggaaatgagatatggcatttttgttcgagggaactcttgtaggcccccttcaca

SEQ ID NO: 24273 - DNA, 201 bp, Homo sapiens
ttgtcaaaggtcacaaagccacagtaaatattttgtgatagagaaattgttcaggactcagaagcacatggatttttaattcgggtttcaggtgatgttgygttttttcttcctatccatacatcacttttgagcgccttacagtcccgataggagaggaccttacatagtgcttgtcaagtgaatgcagcggtttaagcc

SEQ ID NO: 24274 - DNA, 201 bp, Homo sapiens
gtttttgtgtgagagaagagaaaaagaaaacgtgtgactgtgtgtgtgtgtacacatgcttcaatgatgtgtgattatctaataagagcaataatgcagcrtggctaaacttacacagtgttgactgtgtgcccaacactgttcttagtgctttatatttaaaatttgttaaatcacacaacaacccagaaggagtaggtg

SEQ ID NO: 24275 - DNA, 201 bp, Homo sapiens
tatttatttcttaggaatgaaaacactatactattcctattattggggatgctttgccttttaaaaaaattatggtgaaatatacataacagaaaacctastgtcttagccatttttaagtgtatggctcagtagcattaagtactgaattattgtgatgatttgccttttgaaatccagaaaagaatacctgggtgtatt

SEQ ID NO: 24276 - DNA, 201 bp, Homo sapiens
gctttggggctagaatacattataccagagtaagagatggtaactgactacattattgtatttatttcttaggaatgaaaacactatactattcctattaytggggatgctttgccttttaaaaaaattatggtgaaatatacataacagaaaacctactgtcttagccatttttaagtgtatggctcagtagcattaagt

SEQ ID NO: 24277 - DNA, 201 bp, Homo sapiens
tatctctttcatggactgcctcccattctcaggatcctaatgtctttatctaaccctgctggtggccagaagcctctacctggtacccgtcacaacccagstgagaccaggcatctcaggatgcctcacctgacttccagctggaatccaacctgagctgtgcagttggctcaaagggtggccaaccagaggagcagattt

SEQ ID NO: 24278 - DNA, 201 bp, Homo sapiens
tgcctggaactcaggaggggctcagtcaatatttgttgaatggatagtaatagtaatggctagcttttatcagctgagaccctatgcttacagttcactgmagagttgagagacaggcattgaacaggcaatttcaagtgtgatgattcgtgtaaggaaaagtgtaggacacgatagtagcacggtgggcttccctgagga

SEQ ID NO: 24279 - DNA, 201 bp, Homo sapiens
ctgggtctttgctcagtgagaccttccctgaccaccctctatcaaactgcatcttttcccttccctgctatatttttctctgtagtatttatcaccactgkgtgtacactgtccttacattcattcttgttgtttgctagtctccctctgtaagataaaagctccaggagggaacttccgtgttttgtttgttgttcattg

SEQ ID NO: 24280 - DNA, 201 bp, Homo sapiens
gctgggatgctacctttgtagtctacatgagggatggtggtggctttccctgtgagatggagggaaatggacaaagtcaagagatgtcagggaagtagaartacaggtctcaatactagatttgatgtttggggagtagagaggaataatgatgagggaaccagcccctgcctccagctcgagagatttaatagaccttcc

SEQ ID NO: 24281 - DNA, 201 bp, Homo sapiens
tagagacggggtttcgccatgttggtcaggctggtcttgatctcctggcctcaagtgatctgcctgccttgacctcctcatttccatttcttagacatgcsaagctctttcctgtttaagggtctttgcaggtgctgttacctctgcctagaactgtgttcctgcaaggtcacccgttctaccttagctgtttccctcctc

SEQ ID NO: 24282 - DNA, 201 bp, Homo sapiens
ttaaccacggctctcccaactgggctctgcaaggtgggtattttgggagttttttcactgcacctggagtgaaatctgaaccctttaccacagactacatrccctgtatgttctaactggtcttcaagcacatcttctcctggtatcctccaccttgtccggcacgctagtctccttttcctttctttttttttttttttc

SEQ ID NO: 24283 - DNA, 201 bp, Homo sapiens
caccgtaatagctacaagaagtattgatcacaaattaatttggcctcattccttctcctttttgtctctacccttatcagtctcacttcccctactaaaayaggaaggctattgaatacatggagaaaacttggagtttgtggaggctgaggctaccaagtatcatggaagcaatatactatatgccaggcactagcatag

SEQ ID NO: 24284 - DNA, 201 bp, Homo sapiens
ttatgcatttgcctgcataattgtccaaagcaactgatggcaacagctggcagagaagctggtcttcagctctatttgtgtttatctggtgcctgtcaccrtaatagctacaagaagtattgatcacaaattaatttggcctcattccttctcctttttgtctctacccttatcagtctcacttcccctactaaaatagga

SEQ ID NO: 24285 - DNA, 201 bp, Homo sapiens
catattttaagcatctgctcatttgtcccattgaccccaaggtaagtcacatgaccaagcccaagatcagtggggcagataaatatattctatctccagcsagagaggctgcaaggtggcatggccaagtgcacgggtgtggaaagggtgaagaattggaaacagttatgcctctttcacagtgaagtttggagggggagt

SEQ ID NO: 24286 - DNA, 201 bp, Homo sapiens
acagcatggttttctcctggcagtattagaagtacaaaatcgcaagcccagctctataagcatattttaagcatctgctcatttgtcccattgaccccaargtaagtcacatgaccaagcccaagatcagtggggcagataaatatattctatctccagccagagaggctgcaaggtggcatggccaagtgcacgggtgtg

SEQ ID NO: 24287 - DNA, 201 bp, Homo sapiens
tggcacatggtaggactccataaatagacactgcaattattcgttctgtggttactgcatgacgatgatgataacaataataattactattattattaagyaggaactgttttaggtgctgggaaaccaaaaggaaaaaactccatccccagcccctaggagcctgtagtctagtgaaggagataaacttgtgaacagata

SEQ ID NO: 24288 - DNA, 201 bp, Homo sapiens
ggggagaagtgggaagggcttgtgctgtacacatgagggttaggaactgatgaagccacctccccaagcctcagattttccatctgaaaaatggaaacagkattcatctccttaattgtgactatcaagtgtaataacgttggtaaagagcttagcacaggcttggcacatggtaggactccataaatagacactgcaatt

SEQ ID NO: 24289 - DNA, 201 bp, Homo sapiens
ccctcgcggcatgccaggcactgctcattcgtgttttacaccatttcggaatcctttgaggaagttatttctattatcacaatccccattttacaggaggrgaaagtgaggttaagggagacaatgggataggcatgaggtcatccagtaaatggcagagccaggattcgaacccacactcttgtgacctcagagcccaag

SEQ ID NO: 24290 - DNA, 201 bp, Homo sapiens
aggccttcttcctcacaaatccagcacctcccacctgccatcgggtaaagagagggagggcactgcaatggctggtgttactgagccctcgcggcatgccrggcactgctcattcgtgttttacaccatttcggaatcctttgaggaagttatttctattatcacaatccccattttacaggaggggaaagtgaggttaag

SEQ ID NO: 24291 - DNA, 201 bp, Homo sapiens
aggccgtgaggccttcttcctcacaaatccagcacctcccacctgccatcgggtaaagagagggagggcactgcaatggctggtgttactgagccctcgcrgcatgccaggcactgctcattcgtgttttacaccatttcggaatcctttgaggaagttatttctattatcacaatccccattttacaggaggggaaagtg

SEQ ID NO: 24292 - DNA, 201 bp, Homo sapiens
ataattgctggttgtggaattctggagaagtagtatcgcaaaagagagacatgcacagaagtgttcaggcagggagagctggtttgtataaataagagctygatgagctatctgttatgatttatgctaggaatccatagcctctgtgcttctcacacagtacataaacccaaaaggtcgcctctagtttggagtggtgat

SEQ ID NO: 24293 - DNA, 201 bp, Homo sapiens
tctagttcactattctgtccccggtacccagggcatcatagacactcaacaaccattcgttgaatatgcaattggatgaaatgaataaacgaccagaggartaatccagacagagcagcagtggccaagggaagggaggattgatttatgggagaaaattaggggaatgaaatccatagaaagggtttgcctaagtgagag

SEQ ID NO: 24294 - DNA, 201 bp, Homo sapiens
cacccggtccatggtattttgttagagcagccccaactaagccaccgcctctctagttcactattctgtccccggtacccagggcatcatagacactcaayaaccattcgttgaatatgcaattggatgaaatgaataaacgaccagaggaataatccagacagagcagcagtggccaagggaagggaggattgatttatg

SEQ ID NO: 24295 - DNA, 201 bp, Homo sapiens
aggaggaataaatgtttgttgttcacccggtccatggtattttgttagagcagccccaactaagccaccgcctctctagttcactattctgtccccggtayccagggcatcatagacactcaacaaccattcgttgaatatgcaattggatgaaatgaataaacgaccagaggaataatccagacagagcagcagtggcca

SEQ ID NO: 24296 - DNA, 201 bp, Homo sapiens
accaggaaatgggccctcaccagaccctaattctaccaggactttgatcttagacttcccagcctccagaaccaggaggaataaatgtttgttgttcaccyggtccatggtattttgttagagcagccccaactaagccaccgcctctctagttcactattctgtccccggtacccagggcatcatagacactcaacaacc

SEQ ID NO: 24297 - DNA, 201 bp, Homo sapiens
aagaaaatgagacccagaggcattagttaatttgccctgggtcactcagctagtaggtgaaggggccaggtttgaacccagcagcccacctccagatgccrgtctacacctccagaagtgagactaaactgcctgctgtgggtctgaatgtttgtgtctcccgcaaattctatatgctgaaattctaacccccagtatgat

SEQ ID NO: 24298 - DNA, 201 bp, Homo sapiens
ttttaaatggttagatctcttcttcactgagtgaccttataacaccacacacgtctcctgcagagaaccagtgccaatctccttcaccagaatattttctrctccacagatagtgatagttgtagcagtagttgtactcattggaaactgtcctgtgagtgtttagtatgtgctaggcactctcctgagcactttatgcat

SEQ ID NO: 24299 - DNA, 201 bp, Homo sapiens
acaaatacacaagtagtgtgtgattgtctctgtcttcatatttagttgggacaagccgaagctgtatgatgatgtaacaggcattttttttttaaatggtyagatctcttcttcactgagtgaccttataacaccacacacgtctcctgcagagaaccagtgccaatctccttcaccagaatattttctgctccacagata

SEQ ID NO: 24300 - DNA, 201 bp, Homo sapiens
tcccttggctatatttctagtctggaaacaaatacacaagtagtgtgtgattgtctctgtcttcatatttagttgggacaagccgaagctgtatgatgatrtaacaggcattttttttttaaatggttagatctcttcttcactgagtgaccttataacaccacacacgtctcctgcagagaaccagtgccaatctccttc

SEQ ID NO: 24301 - DNA, 201 bp, Homo sapiens
cttagcataacgtgttcaaggttcatgtaaccatgggtgtcctaccttttggcttccctgggccatattggaagaagaattgccttggggaattgttagtrtagtaaaatacactaacaatagctgatgagctaaaaataaaaaataaaaaaggttcgtccgtaattttcttgatatccaccacaaaagataagcaaaaaa

SEQ ID NO: 24302 - DNA, 201 bp, Homo sapiens
aggaaatggcaagaactgcgaatgggaacctggttctttggactctaaaactgaggtctgttttcatcatgctccttgttaaggggaaaaaattaacttayggtgtagtgattagagggaaacgtctgcatggcattgtatatggtatcagcacattactactgtgccatttgacacacatgtctccaaacagaagtgaga

SEQ ID NO: 24303 - DNA, 201 bp, Homo sapiens
tgagagagggcatttggaaatgtggatggtgagttccacagtgttggcgtaggggtggagatgtgattggcatttaatcatagggtcagggaaacttaacrtcctccatgatagggtagtcttacaaagcaaagaattgtcccactccagataccaatagtactctggttgaaaggtgttagaccaactcttttgttttat

SEQ ID NO: 24304 - DNA, 201 bp, Homo sapiens
tggacttcagtagcgcaatcttgggtcactgcaacctctgcctcccgggttcaaccaattctcgtgcctcagcctcctgagtagctgggactacaggcgcragctgccatgcccggctaatttttgtatttttatagaggtggggtttcaccatgttggccaggctggtctcgaactcctgacctcaggtgatctacccac

SEQ ID NO: 24305 - DNA, 201 bp, Homo sapiens
tgccttgtcattgcctgagtaacctttctttttctttttttctttttttttttttttgagatagagtctcactctgtcacccaggctggacttcagtagcrcaatcttgggtcactgcaacctctgcctcccgggttcaaccaattctcgtgcctcagcctcctgagtagctgggactacaggcgcgagctgccatgcccg

SEQ ID NO: 24306 - DNA, 201 bp, Homo sapiens
ttcagtgttaggcacctgggatgcatccttggacaagagagactccctgcattatgtggttctcttcatttctagtgattggcacctcagatatcaagggwggagactaaaaaaataaaaaataaaaaaataaaaaaataacaactggcactagtttaaaagccacgtgtaattcttgattagttttcttgattagtttgg

SEQ ID NO: 24307 - DNA, 201 bp, Homo sapiens
ctcaaattcctaaaccatagaaactgtgagagatgataaagatggtgttaaatttggggatgatttgttatgtagtagttgctgattggaacctcagtcartaaaaaggcatctccttgctgcatcgtcagtgtgctcgtcttgatagagaagctaatagtaggtacccattttcagagtcttacttttcctaggggcagc

SEQ ID NO: 24308 - DNA, 201 bp, Homo sapiens
tgtggtgccctgagactgccatattgtgaggaagcccgaactatctacacaaagagaccctggagaggccaatgagaggagagagatgcttgggccacccytggctgcttcagccactgctgtcccagctgcagatactgtctgactgcaatgacttgtgagacctggaaccaaaaccaccgcttccttctcaaattccta

SEQ ID NO: 24309 - DNA, 201 bp, Homo sapiens
ctgggccagctattgtgactattttgatcagtagagtatggcagaaatgatgctatgtgatttctacgactaggatataaaaggcgacatggcctcttccrtgtccagaatacccctcttgagagcttcagccaccatgtgaatgtggtgccctgagactgccatattgtgaggaagcccgaactatctacacaaagagac

SEQ ID NO: 24310 - DNA, 201 bp, Homo sapiens
gaggtacagactgtgtccctacttctggaaactgggccagctattgtgactattttgatcagtagagtatggcagaaatgatgctatgtgatttctacgamtaggatataaaaggcgacatggcctcttccatgtccagaatacccctcttgagagcttcagccaccatgtgaatgtggtgccctgagactgccatattgt

SEQ ID NO: 24311 - DNA, 201 bp, Homo sapiens
tcttcctacatgggctcatttattgtaagcccattgtgacccttggaaagccaagcttttatcttgattttggagtgtgatcaaggtgacagttgttctcyggatgacaggaatctgactttggttttgctttttccatagaggtcagttggcctcaaatttgggccaatttgcatctggaggagacctccaaggacagat

SEQ ID NO: 24312 - DNA, 201 bp, Homo sapiens
aagacttttagaagatttgttgctgctgtgagtgacatcagttcacacagcctgagagagaactctcagtccatgctgtccctccttgggctcactcaagygaaatgggtcgagctgcaacactgtgcggtgccaaccgggagaaatctgcctatcggggctgagagacatcctgtagtggctgcccgtctcctttgcccc

SEQ ID NO: 24313 - DNA, 201 bp, Homo sapiens
ctctctccccggtgaatggcggagtccatcctggacacctggcagagtgtgattcctcctgaggtggaaggactgagtttcagagcagtcagggatcaggkgtagggcttgctgtctctctgcaagtttgctctgcaagtttctggagccctaagactgctgtgttgtgctgcttgattgtagaggggacatttatccctc

SEQ ID NO: 24314 - DNA, 201 bp, Homo sapiens
gaagttcaaggctgcagtgagctatgtttgtactgctgcaccccagcctgggcaacagagggagaccctgtctctaaaaaataccaaacaaacagaagatwgtagtaaatgtataactctagcatgtgctatgatgaaagagagataactagatttaggtgaacatgaataaggggatctgtcataagcatgaaggtcatc

SEQ ID NO: 24315 - DNA, 201 bp, Homo sapiens
tcatctattgtcttctgtgtctttgggaaggcattcctggaatgactgggggctgtgtgtctcagtttaataatgcaagcttttggtttttgttaaacacrtgcagagcctgatattaagcattaaaccaaggagctaggctaagacagttgtgtcaagaagttgttgtctttgaagaagcacaaggaatttaaagggatg

SEQ ID NO: 24316 - DNA, 201 bp, Homo sapiens
tgttgaagctcttgcagacccctaatagtgcatgctaccgttctgcagagaagaccatgatgacaaaccacagacatcccccttcatctattgtcttctgygtctttgggaaggcattcctggaatgactgggggctgtgtgtctcagtttaataatgcaagcttttggtttttgttaaacacatgcagagcctgatatta

SEQ ID NO: 24317 - DNA, 201 bp, Homo sapiens
agtagggattgtggaatgttgccactcaccttcagttccctgttgaagctcttgcagacccctaatagtgcatgctaccgttctgcagagaagaccatgakgacaaaccacagacatcccccttcatctattgtcttctgtgtctttgggaaggcattcctggaatgactgggggctgtgtgtctcagtttaataatgcaa

SEQ ID NO: 24318 - DNA, 201 bp, Homo sapiens
tgcttttgaccattgcctctcttcttacatcagcttttcgatagctacaattgtaggagtcacattgcatgcagagcagttcataaattgaatggttgtgkgtgtgtgtgtgtgtgtgtgtgtgtgtgtgtgttagcaggggaggctcagagttttggcctctggctgtatggctgtatgcttgtgagtatcctttgtctg

SEQ ID NO: 24319 - DNA, 201 bp, Homo sapiens
gcttttgaccattgcctctcttcttacatcagcttttcgatagctacaattgtaggagtcacattgcatgcagagcagttcataaattgaatggttgtgtktgtgtgtgtgtgtgtgtgtgtgtgtgtgtgttagcaggggaggctcagagttttggcctctggctgtatggctgtatgcttgtgagtatcctttgtctga

SEQ ID NO: 24320 - DNA, 201 bp, Homo sapiens
cttcatttggccatttccataatgtgaggatactctaaatgctagttagtatgtatggcagtctgtgaaagttctgtgcttttagtagccctggggctggmgggggctgctgtggactaagcacacagtgtcaccagctctccactctccagccctgtttgggacctgggagggctccaactgggggtcccagccagtttg

SEQ ID NO: 24321 - DNA, 201 bp, Homo sapiens
ttcatttggccatttccataatgtgaggatactctaaatgctagttagtatgtatggcagtctgtgaaagttctgtgcttttagtagccctggggctggakggggctgctgtggactaagcacacagtgtcaccagctctccactctccagccctgtttgggacctgggagggctccaactgggggtcccagccagtttgg

SEQ ID NO: 24322 - DNA, 201 bp, Homo sapiens
tcagtggcatcttggattcaatgaaatgcactaattttctctgattgttagcatatgatatttcagccaatggtgctgaacatttccaaacagataaatgmaccatgtgtgtatgttttcctttggatgctgtgcttagagggtagcagacagggtgcaaagtgagaaggacctggctctgcacccaacactgccagtatt

SEQ ID NO: 24323 - DNA, 201 bp, Homo sapiens
tgcactaattttctctgattgttagcatatgatatttcagccaatggtgctgaacatttccaaacagataaatgcaccatgtgtgtatgttttcctttggrtgctgtgcttagagggtagcagacagggtgcaaagtgagaaggacctggctctgcacccaacactgccagtattgaatcctgactccatcatctgggagc

SEQ ID NO: 24324 - DNA, 201 bp, Homo sapiens
gattgttagcatatgatatttcagccaatggtgctgaacatttccaaacagataaatgcaccatgtgtgtatgttttcctttggatgctgtgcttagaggrtagcagacagggtgcaaagtgagaaggacctggctctgcacccaacactgccagtattgaatcctgactccatcatctgggagctgtgcaacctacgcaa

SEQ ID NO: 24325 - DNA, 201 bp, Homo sapiens
agccaatggtgctgaacatttccaaacagataaatgcaccatgtgtgtatgttttcctttggatgctgtgcttagagggtagcagacagggtgcaaagtgrgaaggacctggctctgcacccaacactgccagtattgaatcctgactccatcatctgggagctgtgcaacctacgcaaggtacttggcctcagtttcctc

SEQ ID NO: 24326 - DNA, 201 bp, Homo sapiens
gtgctgaacatttccaaacagataaatgcaccatgtgtgtatgttttcctttggatgctgtgcttagagggtagcagacagggtgcaaagtgagaaggacytggctctgcacccaacactgccagtattgaatcctgactccatcatctgggagctgtgcaacctacgcaaggtacttggcctcagtttcctcatcatccc

SEQ ID NO: 24327 - DNA, 201 bp, Homo sapiens
ttccaaacagataaatgcaccatgtgtgtatgttttcctttggatgctgtgcttagagggtagcagacagggtgcaaagtgagaaggacctggctctgcasccaacactgccagtattgaatcctgactccatcatctgggagctgtgcaacctacgcaaggtacttggcctcagtttcctcatcatccccatggcatttt

SEQ ID NO: 24328 - DNA, 201 bp, Homo sapiens
aaacagataaatgcaccatgtgtgtatgttttcctttggatgctgtgcttagagggtagcagacagggtgcaaagtgagaaggacctggctctgcacccarcactgccagtattgaatcctgactccatcatctgggagctgtgcaacctacgcaaggtacttggcctcagtttcctcatcatccccatggcatttttgtg

SEQ ID NO: 24329 - DNA, 201 bp, Homo sapiens
aaaatctggctttgttccttcttccctctttcagatttccaagtatatatatatataacatgtatgtatacacacacatacacacacatgcatgcatagcracccagataattttggatcaagtataacaggaatggagataaaatcagaaggacatcagacatttggatgggcaaccagacactggggaaaaaatcttgt

SEQ ID NO: 24330 - DNA, 201 bp, Homo sapiens
ctgaggtacaaagaaggtaagtagttggcccaaagtggaaaaacgagccaaccagtggccaaacagttccaggcttggtccttcttctcctcccatgtccytcctacacttagacaactcgtgctcttctttggcatgttgggtttttcttgatgtcattggagtttctctctctttctttttttttttttgagatgaagt

SEQ ID NO: 24331 - DNA, 201 bp, Homo sapiens
gggagttggagaggcaccttcatcccagactgaaggccagaagcctcgggttccagttgtgtctcaaccactgagttgtcccagagactttggcataaacygcttgacttcctcggcctctgttcttctttttgtaaagagatgagttcatccagaatgttctctcgcattctggcattcttaaagagtcccaattttgag

SEQ ID NO: 24332 - DNA, 201 bp, Homo sapiens
gtcccttcacacgctccacctaccccaaacccaccaccaccatatggggtctgtgatagactggatttttactttcagttcttcactccctccctctgctktgtgacctggcagaatggccagaggaaatgtccctgccccgtggatgcggggcttgctttggcccgtggtgtgttggcagtcagcatgagaccagcatgg

SEQ ID NO: 24333 - DNA, 201 bp, Homo sapiens; identical to SEQ ID NO: 7975

SEQ ID NO: 24334 - DNA, 201 bp, Homo sapiens
ctgttgcctggttggcctggtgtctcaggatatttgagaaggtgtgacactggagtcctcaaaatctgatctggatcttctttttctttttcccgaggtgygttgagttcatgcacgttactgagaggagtcctgggcaatgtaagcattgcctctgaattctgcacttcactcttctctgggatctggctctgggcctcc

SEQ ID NO: 24335 - DNA, 201 bp, Homo sapiens
atcacaatggatcagactggtcagatcgatcagatcctggctcccttgaaaatctccccccagggtccactggtagatgaactcagcaccctgcccacctycaccgccacagcactggtgttctctctttgctttctagcctgagggttggctgttcgggttgggggctttggcactttatgaccatgttcagtggagttg

SEQ ID NO: 24336 - DNA, 200 bp, Homo sapiens
cctggaaagatcttgcagttcctaatgttggagacattgggagtccagtgctcactcctgtctagaattttaatttttaaccactgctgatggccagaaagaacatttggattttacaaccagtctttgatggagaaagaaaaaaagtcagtgaacacccattttgtgcctgacattcaagtatgtttgttccctgtatt

SEQ ID NO: 24337 - DNA, 201 bp, Homo sapiens
atccatggagaaaatccactctgcagaagcttatgacttaatgagctcagtcaaagtcaatctgaagttgcaggcagcagctttgatcattgtgataggcrttttggtttccaccgagcagagaatgggaaaaagctttgcccatgatttattaatcacttccttggctgagctttcttgcctggctctcctgggaagcac

SEQ ID NO: 24338 - DNA, 201 bp, Homo sapiens
gtgccttggagttatgaatgcgttaaagggatatctcctctcttccttgatgtccctggtcctgggcatcctcacagcccactgggcagcctttcctgctstcagacccatgacatcatctccactcctctgataccccatttagatgcttatgggtttgctgggcttccagggagggactagacctcctggtgactgctg

SEQ ID NO: 24339 - DNA, 201 bp, Homo sapiens
tgaaccaaacagtctgaggtcagatcctggctgcgtgaccttacttaggccagttacagagctgctctgcctcagtgtgttctttacctgtaaaaggaggrtaaggttaatagcagcctcacagcattcttggggagagtagacaagatcatgaatgcaggttgcttagcccatgctggcatttcaggagcactcaccaca

SEQ ID NO: 24340 - DNA, 201 bp, Homo sapiens
ggcacaagagtgatatagacctaatgttgctggagttagaggaggtccccatttcttccggccatgatgaataaacaaggattgggaaggcagtccttgaygtgatggaattccaggatggcgtgggctgggtcccagaggagagaaactatgcagtgtatttgggaagccataagtattacaagtttgctggagtcttga

SEQ ID NO: 24341 - DNA, 201 bp, Homo sapiens
ggctttgggacataggcactgggaaggctttcccttgctcagggctctgtttggaaagcctggagttagcctctactttggaggctgtcgtctgtctgagygtaaccagggcctggtctaggctgtcagatgcaggctagagggaagaaggcccagatttggacaccattgagggaatggtttcacttgaatggtgagagt

SEQ ID NO: 24342 - DNA, 201 bp, Homo sapiens
aaagggagcacataatgaaagctgtccttttgacctgaccccagctgccctggtctcctccctggaggcacctcagttttgttttgttttgttttgttttgttttttttgattattgttgtcgttgtttacttactaaatatatttcagagatctctctttcagaatggaaagattccttattctgtgtgtatggttcatg

SEQ ID NO: 24343 - DNA, 201 bp, Homo sapiens
catgatgtgatcaagtcagggtattcagctgtccattactcaagtgcagtacatttttgttaagtgtattcaccctactctggtttccttttatctcactstatgtttgtatcctttaacccacttctcttcatctctttatcttcctcccttccccctgctcacccttcccagtctctgttatctatttttccactctct

SEQ ID NO: 24344 - DNA, 201 bp, Homo sapiens
catgataagggaagggagcccctactattttgcgggtctctgttttgagtgtcttaaaattctagtggagtaggagccattgggaccatcacaggaagatrtagcccctgggtgggaagcagggtgtctgtcttttggagggagcggagtgtctccatttcagttgttgctgagacaggcaaggtctggtggttgaggaaa

SEQ ID NO: 24345 - DNA, 201 bp, Homo sapiens
actctaagacacaagggagttggaaaaagcacatttttttcctccacatttaaaaatgactagaaggtgagagagaaagagagaaagctcacctgcagccsgtgaagtcacgcttttgcattccgtttgtaggacaagttgtcagtgtgcgatgatttccataggctttgaaatggggtagcagtttaaacatatcaaatg

SEQ ID NO: 24346 - DNA, 201 bp, Homo sapiens
cgggcagtcatcattctacttctatcttcattaatttggtaactctaggtacctcatacagtggaatcatacagtatttaatcttttttttttttttttttgaagtggagtctcgctctgtcacccaggctggagtgcagtggcgcgatctcagcctgactgcaggctccacctcccgggttcacaccattctcctgcctc

SEQ ID NO: 24347 - DNA, 201 bp, Homo sapiens
taacatagcaaagtccacagactgggtggctgaaatgacagaagtttgttttcccacagtgctggaggctagaagtctgagatggaggtgcaggattagcrtcctctgaggcccctctttcttggctaatgagtggtcgtcttttccctgtgtcctcacatggtcttccctcttacatggtctctttcctgatgtcttctt

SEQ ID NO: 24348 - DNA, 201 bp, Homo sapiens; identical to SEQ ID NO: 7976

SEQ ID NO: 24349 - DNA, 201 bp, Homo sapiens; identical to SEQ ID NO: 7977

SEQ ID NO: 24350 - DNA, 201 bp, Homo sapiens; identical to SEQ ID NO: 7978

SEQ ID NO: 24351 - DNA, 201 bp, Homo sapiens; identical to SEQ ID NO: 7979

SEQ ID NO: 24352 - DNA, 201 bp, Homo sapiens; identical to SEQ ID NO: 7980

SEQ ID NO: 24353 - DNA, 201 bp, Homo sapiens; identical to SEQ ID NO: 7981

SEQ ID NO: 24354 - DNA, 201 bp, Homo sapiens; identical to SEQ ID NO: 7982

SEQ ID NO: 24355 - DNA, 201 bp, Homo sapiens
aaccatgtacctttgggaatatagtgtctgcctttctaagccttagtttctcatgtcaaacaaggacagtgatgtccttgcctcatggaatgatggatggytgaaaataaagtaatacacatacagcacttggcatacaaaatgggccataaaatgatggctatttttatgattaggtggaaacttttgtttctttttttt

SEQ ID NO: 24356 - DNA, 201 bp, Homo sapiens
acatttttgcattgagcatagtgtctgacaccctgtgcattgccctggctgagcgaggaggctccatttgtttatttttcaagcatagatgctattttctsaggactgtagagtaaaaacattagaaatttctagctgcctgccacttagggcttgctggcttctagcccttctgctgaaagtcaaatttaagatagggga

SEQ ID NO: 24357 - DNA, 201 bp, Homo sapiens
atgggatattattcagccatacaaaggaacaaagttctgatacatgctacagtatgattgaaccttggaaatattatgctaaatgaaaagaagccagttayaaaagaccacatattgtatcattcaatttataggaaatgtccagaataggcaaatacatggagatagaaagtagataggtggttgcctagggctgagtgg

SEQ ID NO: 24358 - DNA, 201 bp, Homo sapiens
tatatcttggttaggtatgtattttatttgttaattttttgtggctattataaatgggattgtgttcttgatttgactctcagctagaatgttattggtgrgtagaaatgctactgatttttgtacattgattttgtatcccaaaactttactgaagttgtttatcagttctgggagccttttgttggagtctttagggtt

SEQ ID NO: 24359 - DNA, 201 bp, Homo sapiens
gtccagtaatgtgatgcctgcacctttgttctttttgcttaggattgctctggctctttgggctcttttttggttccatatgaattttagaattacttttytctaattctgtgggaaatgacattggtagtttgataggattagcattgaatctgtagattgctttcggcagtatggccattttaacaatgttgattattc

SEQ ID NO: 24360 - DNA, 201 bp, Homo sapiens
gcctgttctttttttttttttttttttccctgagacagggtcccactatgtgcagtggcatgaacatagctcactgcagcctcgaactcctgggctcaagygattctcccacctcagcctcccaagtagcagggaactactcgtgcatgccatcatgccaggctcactttttatttacagtttttgtagagatgagctctt

SEQ ID NO: 24361 - DNA, 201 bp, Homo sapiens
cctgagtagctgggattacaggtgcacgccaggctaattcttttgtatttttagtagacacggggtttcaccacgttggccaggctggcctcgaactcctsacctcaagtgatccgcctgcctcggcctcccaaagtgctgggattacaggcgtgagccactgtgcctggccaagttaagatcttgagaagaggtcatgct

SEQ ID NO: 24362 - DNA, 201 bp, Homo sapiens
cagctgaagacttcttttataatattctccccgctagccagatgttttgaaatagcaaaattattaaataataatttgtattgttaaaacatgaatgaaakacagatatagctatgagagtttctacttagaggtcgttcttgttgccttgcagatgtgttttgatttcagccaagaacaaagatatttgatatgtcaatt

SEQ ID NO: 24363 - DNA, 201 bp, Homo sapiens
aaataaatgacccatggacagtcaaaccacagaaaagaattactgtgctggcattttccccttccttgataccattggctttattgggatgggcgttatayggcttattggctcctgttagggaaccgatccactggtagattagttagttggtttgagttactccttttgaaaatgaggtttctgtttctgtttatatat

SEQ ID NO: 24364 - DNA, 201 bp, Homo sapiens
cagttgtgttgtagtatgatagagttttccttcctgaggttgaccatggcttagtccttgctatacagggtagtgtgaggattggatttctcaggttagcrgagctttagacgagcgttgagactgtctgtctcagagcctctgatccatttgttttaggttgttggagtttatttgcctcttctgaagacattgggagaa

SEQ ID NO: 24365 - DNA, 201 bp, Homo sapiens
agttgtttttctttccacacattgaataatgctccactccggatctgaggtgtctgcctagagtgttgctttcataaacatggtgaggaaagacaagaagmagcagacccaatctgtggaaactagcctggttgataattcaggtggtgggcaccaggaaacaggcatgtggtttttcctttgggtaccctccagccgagt

SEQ ID NO: 24366 - DNA, 201 bp, Homo sapiens
ctgcagtgctgcactgctcccttcagccttcgtgcagggtcatccagggcagggcagcttcatccattctgtttgtgacattgtgtaacacgacccagtayggccatcagttaaatgtgtttgctgtcgtggtagctcttcttgatgtactaaactccttgattcaagatgggctgttcctcacacatctttgggacccca

SEQ ID NO: 24367 - DNA, 201 bp, Homo sapiens
gtaggtatgtctgagcagatagatagtctgaatttaatttctttgcagaaactgtagcataccatgcatcctattctacaaattatatgtatttattgatwtgaattttattgtttgaaaaagaaatgcaatcgtatggttcaacatttaaaaggtataaaagaggtcaggcgcggtggctcacgcctgtaatcctaccac

SEQ ID NO: 24368 - DNA, 201 bp, Homo sapiens
cagttgtcagtaagatgttctctggcaactggtttttgtatctggagctcagacaagagatctgggcagggatggggatttggaaagtactggcatctagrtgaccactcagctgtgggtaccaatgaggaggaggagacgaaaacttgttaagcacaaaactctgtgaaaccccagagtttcacagaaaccagatcttaa

SEQ ID NO: 24369 - DNA, 201 bp, Homo sapiens
cctgctgactccttgaacttggacttccagcctccagaactatgtctgtcattcaagcccctcggtcagtggcattttgtgatggcagtcccagggtacgratatagaaccaaaaagatgaattgagcctcagggcggagaatggataggggagcaatattgtgggtattcagaacagccgggaactcacaggaaagagga

SEQ ID NO: 24370 - DNA, 201 bp, Homo sapiens
gcaaatggggtcttgacatatgtaattcgttaagacacagttctgttggactggagtgggccctaattcccatgactggtgtctttgtaataagagggggyacacagacactcacagagggaagatggccttgtgaagacagaggcagacactggagcatgtaggtgcagggcaaggaatgccaaggattgccagcaacct

SEQ ID NO: 24371 - DNA, 201 bp, Homo sapiens
gtgtgctccgggtactgtccttagtgcttttaggtcattatttaatcctctcacaatcattcaagtaggtgtcacaggttaaattgtgtcccctgaaaagrtacactgaagccctaaaacctggtacttgtgaatgcaaaccaatttgcaaatggggtcttgacatatgtaattcgttaagacacagttctgttggactgg

SEQ ID NO: 24372 - DNA, 201 bp, Homo sapiens
tattgtggctcttttcgtgctcccctctgcgtcttgaaaagtgaattccaaggagtaggacagtcaccggcttcacacagccctgtcattgtcttggtgtycctgatgaagggctgttgaaggacttttatccacagagagaattgataatggtggagatgccacagatgacagtatctttagctgaaggtgtgaagttga

SEQ ID NO: 24373 - DNA, 201 bp, Homo sapiens
gagagggatgggttataaacatgactgagaggagaatccagcccttgacaagtttaatgtttgctttacggaagactagctatgtccgtaactctacaacrtgggagagagtaagatgtgccatgacatgggtcaggtaaagcacagtgggaggcagaggcagagcgtggttatttctagttagggaactcaggggagaag

SEQ ID NO: 24374 - DNA, 201 bp, Homo sapiens
tgatacacccaccttggcctcccaaagtgctgggattacaggcatgaaccactgcacccgaccctgattctactttttgtacacgagtttctctggcttargatctctcatgtgattgcacttcttctgtctgctggaactgtggtctcatctgaagtttcaactagggggtttccgttccttgtgggttgctggaatgag

SEQ ID NO: 24375 - DNA, 201 bp, Homo sapiens
gggctattgaagggcttgtatccacagtgagatcatgtctcaaaaaaaaaagtgagaaataagtccaaccacaactcacgggaaagggatcacaaaagggsatgaatctcaaaaggcaggcattggaggagctgcctcagaggttgtccaccacactggggaagggaatagaacatctggagcgagggcagagagagaaca

SEQ ID NO: 24376 - DNA, 201 bp, Homo sapiens
aataactcatgccccataacagtggctcagaatcttctggcaccctggctggcccttagtaggtgctaggaaatgtaggatgaatgagtgaattcattctrctgcctgccctccgtgggattcatctttgtatcacatcagacggtgtaggtccttttattcctcttcctaaggaggccagcttgggccctctgttggcaa

SEQ ID NO: 24377 - DNA, 201 bp, Homo sapiens
tccgtgggattcatctttgtatcacatcagacggtgtaggtccttttattcctcttcctaaggaggccagcttgggccctctgttggcaacagaagacttygatttcttcactttcttgttttaaacacagccccattaatgtttaaaatgcttgtctgagctctccagtctgtcttaggtgtttcgagggctttcaacag

SEQ ID NO: 24378 - DNA, 201 bp, Homo sapiens
attgctaggagtttgtatttccagtacagtgagcaatgcttggtgggaatataaagcaggaaacataccatggtcttatttatttcctaaaacgagctttstaggtgctgtgtggaaaatggattggagaggggcaagatcagaaattgggagaccaagtagaggttcacatggtaatccatgcaacagatgatggtaact

SEQ ID NO: 24379 - DNA, 201 bp, Homo sapiens
cagaggcatggatagtcatttccagatgtggcctgcaggagcagcccaggatatcatatataggaatctggatctggcgaagccactcgatgcagaggagrcagatgcctcagaggtttccctttggatgggtagaatgattagattgatcccggtgcaggtgcatgagctcattaccaagtcccacccccttcccgtgct

SEQ ID NO: 24380 - DNA, 201 bp, Homo sapiens
ctgaagcaatgacacaattgagcagagttctaaaaaggccacctgggccctagctcccaattaccctctcactgagttttagtggcaatctgaattcctayttaaaaaatgccattgcactctagcctgggcaacagagtgagaccctgtctcaaaaaaaaaaaaaagcccttttctatcttaaacagccaattaaatgcc

SEQ ID NO: 24381 - DNA, 201 bp, Homo sapiens
atgggatgctttttttagacaggaaagtcagggtggatgtggggatgcccttggtttacagtggcccagacaatcccttgatgcttccaggcttgagaaartgtggctgccactgtggcagaggccatggtaggaggcatgcaggagtgaaatgggacccccagggccgctcccaccctgggagtgccattggggtcaggc

SEQ ID NO: 24382 - DNA, 201 bp, Homo sapiens
ctgcctccctctcagcagcgttttctcttctctgccattcagcactcccaaggcccgttttaatctagtgtgaagggtcagactcttcgtccaggtaaaasgaaactacagaagcaagctcacagtcgcttcactcggctcaaatttaaaacagtcttcagtgttcatctaaactttgtggcaggtacaagttgttcatcc

SEQ ID NO: 24383 - DNA, 201 bp, Homo sapiens
attcagcactcccaaggcccgttttaatctagtgtgaagggtcagactcttcgtccaggtaaaaggaaactacagaagcaagctcacagtcgcttcactcrgctcaaatttaaaacagtcttcagtgttcatctaaactttgtggcaggtacaagttgttcatcctgattttacagtcccaattttaatcccgctgtccct

SEQ ID NO: 24384 - DNA, 201 bp, Homo sapiens
ggttggcctggagtgactatgtcaaggcaccatcttggccactttgggagaggagtctgcctgcactggccccacacttttggtcctgcgagttggtggawctctagatgattctgggaaagggttacattgatcccacctcatttgtgagaaggaagattctagaaggatgagactgtttttgtacagtgaacatgtgtt

SEQ ID NO: 24385 - DNA, 201 bp, Homo sapiens
actcgcagatcccaagaacagaaccagggcagcctttggactccttgtgaatttctgcagcatcagctcctgcatgctcagttcttgacaaatgtaagacrcggcagagtgtcatacagcccccacagtggcatctctcacttcatgctcaggagctgctcccagtgcttggccatcagtgatgatgatgccgaaccttaa

SEQ ID NO: 24386 - DNA, 201 bp, Homo sapiens
gggcagcctttggactccttgtgaatttctgcagcatcagctcctgcatgctcagttcttgacaaatgtaagacgcggcagagtgtcatacagcccccacrgtggcatctctcacttcatgctcaggagctgctcccagtgcttggccatcagtgatgatgatgccgaaccttaactgatgtggcctgggacctgggcctc

SEQ ID NO: 24387 - DNA, 201 bp, Homo sapiens
tgtaagacgcggcagagtgtcatacagcccccacagtggcatctctcacttcatgctcaggagctgctcccagtgcttggccatcagtgatgatgatgccsaaccttaactgatgtggcctgggacctgggcctcactgtatcacgagaagagaggatggggctaagatagttgtctctcagcttcatcttcttccatcgg

SEQ ID NO: 24388 - DNA, 201 bp, Homo sapiens
acagcccccacagtggcatctctcacttcatgctcaggagctgctcccagtgcttggccatcagtgatgatgatgccgaaccttaactgatgtggcctggkacctgggcctcactgtatcacgagaagagaggatggggctaagatagttgtctctcagcttcatcttcttccatcggcagctgcaacccagagcttcctc

SEQ ID NO: 24389 - DNA, 201 bp, Homo sapiens
gatgtggcctgggacctgggcctcactgtatcacgagaagagaggatggggctaagatagttgtctctcagcttcatcttcttccatcggcagctgcaacmcagagcttcctccaacagcctgcccaaaggccagggattcccctttctgatttgtgagaagatatcttctagaatgttgggaatgcacatatttggaata

SEQ ID NO: 24390 - DNA, 201 bp, Homo sapiens
aatcacatcctttcatgaagagtcacagtggacatttgcctagtaaaggctctgacaagtcttgtaataatagctattgataataactaaaagttttgtcraatgctactttgtgccagacaccactttaaacatttctatacatattttccctttttatccaaaaaataaccctagggggtgggttctattatcccattt

SEQ ID NO: 24391 - DNA, 201 bp, Homo sapiens
tgtaagtgaagaaattgtgaattaccatgttgacatgtttcagagttagtttaccaatatcaaaaaacactgtggagtacctgttgtatttcccagattgyggtgagccctgagtggggttccaagaaggagcaagcctggtctttgcccaccgagaacttaatggtaagatagccacatatgtaaaatgaaataaagctt

SEQ ID NO: 24392 - DNA, 201 bp, Homo sapiens
aggagcaagcctggtctttgcccaccgagaacttaatggtaagatagccacatatgtaaaatgaaataaagctttgggctaagagtacagatgctggaacyagacttcctgggttcctcttggtttctctactagctagctctgataatagctattaataattcctcaggtatagggagtatttgggcaagttccttaacc

SEQ ID NO: 24393 - DNA, 201 bp, Homo sapiens
ctactagctagctctgataatagctattaataattcctcaggtatagggagtatttgggcaagttccttaacctgtgttcccatttcctcacctgtgaaayggtctacttcataggagggtgtattcgtttgctagggctgccataacaaatgaccacaaacttggctttgaaacaacagaaatttattctctcacagttc

SEQ ID NO: 24394 - DNA, 201 bp, Homo sapiens
gcttctggggccgctggcaattcttggtgttccttggcttggttggggctgcatgattccagtttctgccttcaacttcgcatggcctttgcccttgtctrtttctgtgtcatctccttctctgtctctcataaagacactcatcattggatctaaagctctctctaattcagaatgagctcatcttgaaactcttacctt

SEQ ID NO: 24395 - DNA, 201 bp, Homo sapiens
atgctacaaagtaggaaggagtaaacaataaaaagtaaatctccctctccacaagcatctattccccttcctggaagctcccagtgttactggttatattrtgtctttccagatatattctatacattctctactgaactttgcttttttccccttatttatatatccttctcatggttccatatcagtatatgtagaggt

SEQ ID NO: 24396 - DNA, 201 bp, Homo sapiens
acctctctgagtcaatttgcttatctgaaaaatagcaataacaacagcactcattttactagggcatgtgaataaacagatttttttcccattgagtggcrggtatttattgagtgcctactatgtgccaggcaccatcctactctctggggatacagcagtgaacaaaacagacgcacacctagtgatgagggatggagt

SEQ ID NO: 24397 - DNA, 201 bp, Homo sapiens
agaggacatgagtcacctgtagtcgctgccactgctgctatttcatggctacattttgacccctgtggacccactgaaacctcctcactgcctcacaggcrgaacaaggacagggtcttggccaccaagtttactcacttgagctgcatttagattattcttccagctaggccatgacagtaggtagtggcagctctctgt

SEQ ID NO: 24398 - DNA, 201 bp, Homo sapiens
ttaaaaaaaaaaggagaatcacaccacctaccccatggagttgttatgaggcagagagatgtgatataaagcatgtacttggccaggcacagtggctcacrcctgtaatcccagcactttgggaggccgaggcagttggatcacttgaggtcaagagttcgagaccagcctggccaacatggttgaaaccccatctctaaa

SEQ ID NO: 24399 - DNA, 201 bp, Homo sapiens
gtgtgagtgatacacagtgagaattctaatgtttccaggtctgtgactactttgctccaataccaagatggacagaacagccctttgattacccagggagmctgtcaagtttgcatctggtcaatctctgttttatatataaggaaactgaggcacagggtgggtaagtaattccctgagcttggaaagtaatggtaatag

SEQ ID NO: 24400 - DNA, 201 bp, Homo sapiens
gcaatgggtttgaggactgtcccgatggcagcgatgaagagaactgcagtaagtgctgcgcacttgaacactgtgatcccttgttctttcccgccagccaracttgtccacattggtcaccctcatcatgtgcttcttatacctagaggctcaggcattctcttctgttacccagattctgttcttccctacttcttgtgt

SEQ ID NO: 24401 - DNA, 201 bp, Homo sapiens
ctgtgccagcggcatccattgcatcattggtcgcttccggtgcaatgggtttgaggactgtcccgatggcagcgatgaagagaactgcagtaagtgctgcrcacttgaacactgtgatcccttgttctttcccgccagccaaacttgtccacattggtcaccctcatcatgtgcttcttatacctagaggctcaggcattc

SEQ ID NO: 24402 - DNA, 201 bp, Homo sapiens
gttttagcagttgttctgtggttaggaaagggatcatcactaggggaacctagatgaaggatttgcagaaactgtacttttttttttttttttttttttttgagactgagtctcgctctgtcacccaggctggagtgcaatggtgtgatctcggctcactgcaaccttcgcctcccgggttcaagcaattctcttgcctca

SEQ ID NO: 24403 - DNA, 201 bp, Homo sapiens
agttttagcagttgttctgtggttaggaaagggatcatcactaggggaacctagatgaaggatttgcagaaactgtacttttttttttttttttttttttttgagactgagtctcgctctgtcacccaggctggagtgcaatggtgtgatctcggctcactgcaaccttcgcctcccgggttcaagcaattctcttgcctc

SEQ ID NO: 24404 - DNA, 201 bp, Homo sapiens
cagttttagcagttgttctgtggttaggaaagggatcatcactaggggaacctagatgaaggatttgcagaaactgtacttttttttttttttttttttttttgagactgagtctcgctctgtcacccaggctggagtgcaatggtgtgatctcggctcactgcaaccttcgcctcccgggttcaagcaattctcttgcct

SEQ ID NO: 24405 - DNA, 201 bp, Homo sapiens
tcccatgtccctcctacacttagacaactcgtgctcttctttggcatgttgggtttttcttgatgtcattggagtttctctctctttctttttttttttttgagatgaagtcttgctcttgtcatccaggttggagtgcaatggctgctcattgcaacctccacctcccgggtttaagcgattctgctgcctcagcctcct

SEQ ID NO: 24406 - DNA, 201 bp, Homo sapiens
gtagttggcccaaagtggaaaaacgagccaaccagtggccaaacagttccaggcttggtccttcttctcctcccatgtccctcctacacttagacaactcrtgctcttctttggcatgttgggtttttcttgatgtcattggagtttctctctctttctttttttttttttgagatgaagtcttgctcttgtcatccaggt

SEQ ID NO: 24407 - DNA, 201 bp, Homo sapiens
ctctcaatgagggtccctgttatataatgttaggagtagcaggaagctgtggttctacacacacacacacacacacaccaccacgcacgcacgcgtgcgckcacacgctttctggctcattccaggtggattgacagccgctgcttagcatgtcacaggcctcaaccttctaacagtagcccgtccagcttcctttgtgtc

SEQ ID NO: 24408 - DNA, 201 bp, Homo sapiens
tctctcaatgagggtccctgttatataatgttaggagtagcaggaagctgtggttctacacacacacacacacacacaccaccacgcacgcacgcgtgcgygcacacgctttctggctcattccaggtggattgacagccgctgcttagcatgtcacaggcctcaaccttctaacagtagcccgtccagcttcctttgtgt

SEQ ID NO: 24409 - DNA, 201 bp, Homo sapiens
gacatctctcaatgagggtccctgttatataatgttaggagtagcaggaagctgtggttctacacacacacacacacacacaccaccacgcacgcacgcgygcgcgcacacgctttctggctcattccaggtggattgacagccgctgcttagcatgtcacaggcctcaaccttctaacagtagcccgtccagcttccttt

SEQ ID NO: 24410 - DNA, 201 bp, Homo sapiens
agacatctctcaatgagggtccctgttatataatgttaggagtagcaggaagctgtggttctacacacacacacacacacacaccaccacgcacgcacgcrtgcgcgcacacgctttctggctcattccaggtggattgacagccgctgcttagcatgtcacaggcctcaaccttctaacagtagcccgtccagcttcctt

SEQ ID NO: 24411 - DNA, 201 bp, Homo sapiens
aaaagaaatcaatgtctttgtgctatgttaatttgctttccacctctttctcctcctcatctactcaatacaagttgattcattcatctcctctgtggtaygatcgaagacatctctcaatgagggtccctgttatataatgttaggagtagcaggaagctgtggttctacacacacacacacacacacaccaccacgcac

SEQ ID NO: 24412 - DNA, 201 bp, Homo sapiens
atctggaatgaaagcctctgtttacacatttggaggaaaaatgtatccacaggcacagcaccttatttcttgttttgtttttttttggagatggagtctcrctctgtcgcccaggctggaatggaatggcgcgatcttggctcactgcaagctccgcctccggggttcaccccattctcctgcctcagcctcccaagtagc

SEQ ID NO: 24413 - DNA, 201 bp, Homo sapiens
ggctacctcctggcacctgcttagagcctccaggtaccttacagtgtattctcctgatgtgcaaattggatccagaggctttatggctgtgtctgaacacytcatttaggtttgtgatcaacatcaacatttatgggcttatctggaatgaaagcctctgtttacacatttggaggaaaaatgtatccacaggcacagcac

SEQ ID NO: 24414 - DNA, 201 bp, Homo sapiens
aagcagggtggttctgcttctagagccagccttcttcactctcacctgacagctcttggcacacacctagctctggacttccatctatttgcaaggctacytcctggcacctgcttagagcctccaggtaccttacagtgtattctcctgatgtgcaaattggatccagaggctttatggctgtgtctgaacacttcattt

SEQ ID NO: 24415 - DNA, 201 bp, Homo sapiens
ataatttatccatccaatcatagccattattaacattttgctatatatagccctctacaccttctttatgaatggttagaaatacacacacacacacacactttctcatcaacataaatggcatcctgctctcgtaaaagatatactgtccactaatgtgctgtctttaccaagcagcatgctgaggatacctttctgtgt

SEQ ID NO: 24416 - DNA, 201 bp, Homo sapiens
tataatttatccatccaatcatagccattattaacattttgctatatatagccctctacaccttctttatgaatggttagaaatacacacacacacacacactttctcatcaacataaatggcatcctgctctcgtaaaagatatactgtccactaatgtgctgtctttaccaagcagcatgctgaggatacctttctgtg

SEQ ID NO: 24417 - DNA, 201 bp, Homo sapiens
caacgcttttggaagctaagcaggaggatggcttgaggccagctgttcaagaccagcctgggcaacagagcaagtccccatgtcttaaaaaaaaaaaaaaagaaattaactgggcgtggtggcacacacctgtagtcccagctactcaggaggctgaggcaagaggattgctccatcccagaagttcaaggctgcagtgag

SEQ ID NO: 24418 - DNA, 201 bp, Homo sapiens
aggacttgtgtgaaccatgtatggggcatttttcttcagagtcaagcactgctgtctgaaaaagaacacttctttccagaaaactctgttttttcagaacracctctttcattctgctgcctcattcccagaggagtgattttgtatttcccctcatccaaacacggagatgactttttcaggattgtaaaaaggaatgtg

SEQ ID NO: 24419 - DNA, 201 bp, Homo sapiens
tctaatatctttggcatgagccagaaaatggtggaaatggtagaaaatgtgttcttttcttactctaagacacaagggagttggaaaaagcacatttttttcctccacatttaaaaatgactagaaggtgagagagaaagagagaaagctcacctgcagccggtgaagtcacgcttttgcattccgtttgtaggacaagtt

SEQ ID NO: 24420 - DNA, 201 bp, Homo sapiens
atcagtcaagcatcacctgattcaaggacatactaagccacagtcagcccatcccaactttttgccaaaatgcctaccccaaaagacaaaaaaaaaaaaaagcataccccatccaaaaagctggcctaattaaatcctgacagactgctgctctatttcacagctgcctagtagctgggtctgtttctgagctctggcagg

SEQ ID NO: 24421 - DNA, 201 bp, Homo sapiens
tccctgcctgttcagacctgacaattaggcggagaaggcagtagtctaaaataattaacagaatgggctctggagtcagacagctcatcactgggcttgcmtttcttccaatcaaccttgggaaagttcctaaacctctctgtacctcagtcttaccatgtgcaaagtgggagtgaggaccatacttctgttatagagctt

SEQ ID NO: 24422 - DNA, 201 bp, Homo sapiens
agagatttatgaatctgggaaagactttgtgtttgaattattgagaaatatatggaatgctaaacaaatggggagggggaaacttttgttttcccaggaasaaaagtgttcaaatcatagtatacctgtgttgttcatctgtagcattttcttgatcaagataataaaaacagtgattatctgtaattactgtctaactaa

SEQ ID NO: 24423 - DNA, 201 bp, Homo sapiens
tctctctctctctctctctctctctctctctctctctctctctctctctctctctctctatatatatatatatatatacacacacacacacacacacacasacgcacgcacaaagaagaaattgatagaatacttaatgtatttgaattcgttgagaagagatttatgaatctgggaaagactttgtgtttgaattattga

SEQ ID NO: 24424 - DNA, 201 bp, Homo sapiens
tgtctctctctctctctctctctctctctctctctctctctctctctctctctctctctctatatatatatatatatatacacacacacacacacacacasacacgcacgcacaaagaagaaattgatagaatacttaatgtatttgaattcgttgagaagagatttatgaatctgggaaagactttgtgtttgaattatt

SEQ ID NO: 24425 - DNA, 201 bp, Homo sapiens
ctgggtgacagagcaagaccctgtctctctctctctctctctctctctctctctctctctctctctctctctctctctctctatatatatatatatatatwcacacacacacacacacacacacacgcacgcacaaagaagaaattgatagaatacttaatgtatttgaattcgttgagaagagatttatgaatctgggaa

SEQ ID NO: 24426 - DNA, 201 bp, Homo sapiens
gcgcgccactgcactctagcctgggtgacagagcaagaccctgtctctctctctctctctctctctctctctctctctctctctctctctctctctctctmtatatatatatatatatatacacacacacacacacacacacacacgcacgcacaaagaagaaattgatagaatacttaatgtatttgaattcgttgagaa

SEQ ID NO: 24427 - DNA, 201 bp, Homo sapiens
gagcgcgccactgcactctagcctgggtgacagagcaagaccctgtctctctctctctctctctctctctctctctctctctctctctctctctctctctmtctatatatatatatatatatacacacacacacacacacacacacacgcacgcacaaagaagaaattgatagaatacttaatgtatttgaattcgttgag

SEQ ID NO: 24428 - DNA, 201 bp, Homo sapiens
atgagcgcgccactgcactctagcctgggtgacagagcaagaccctgtctctctctctctctctctctctctctctctctctctctctctctctctctctmtctctatatatatatatatatatacacacacacacacacacacacacacgcacgcacaaagaagaaattgatagaatacttaatgtatttgaattcgttg

SEQ ID NO: 24429 - DNA, 201 bp, Homo sapiens
ctatgagcgcgccactgcactctagcctgggtgacagagcaagaccctgtctctctctctctctctctctctctctctctctctctctctctctctctctmtctctctatatatatatatatatatacacacacacacacacacacacacacgcacgcacaaagaagaaattgatagaatacttaatgtatttgaattcgt

SEQ ID NO: 24430 - DNA, 201 bp, Homo sapiens
agctatgagcgcgccactgcactctagcctgggtgacagagcaagaccctgtctctctctctctctctctctctctctctctctctctctctctctctctmtctctctctatatatatatatatatatacacacacacacacacacacacacacgcacgcacaaagaagaaattgatagaatacttaatgtatttgaattc

SEQ ID NO: 24431 - DNA, 201 bp, Homo sapiens
atgaaagtaagtgtttttacaaaggttcaagaatcaaaatggtgtcagtcttctcaataacattggacatgagaagacagttctgaaacaaatcgtttcarctcaagttctgtactataaagacattttcagaaatgattaaaaagttactctcatacagtcctttcaagaagctgctaataaatacggtctaccaaaacc

SEQ ID NO: 24432 - DNA, 201 bp, Homo sapiens
ttgggcaaaaagaagatcctacaagtttctagagagggcattacaaaaataaatacataaatgaaagtaagtgtttttacaaaggttcaagaatcaaaatkgtgtcagtcttctcaataacattggacatgagaagacagttctgaaacaaatcgtttcaactcaagttctgtactataaagacattttcagaaatgatta

SEQ ID NO: 24433 - DNA, 201 bp, Homo sapiens
ctttgggaaaactcaccagtttaagagattggatgtcaatgaagtggcccaactgaatcatctaatggtgaagcccacaaccaagagctttttttttttttccattttttaaaataaaagctttattaagacattcacatagcatgctttcactcattgaaattgtacaatttgggtttttcatagaatttgcaaccatca

SEQ ID NO: 24434 - DNA, 201 bp, Homo sapiens
aggggagtaaatgatatgactacctaccttcaaaacttgtagtttaaagtggtaacttgaatactcacatttacctctgtttccttcctctaaaagaatgkttttttaaagggtaaatccacagggacaaagaaaaggagaggaaaaccagcaaaaaaaaaaaaaaaaaaaaaaaattgtggaagctggagaacaaatggg

SEQ ID NO: 24435 - DNA, 201 bp, Homo sapiens
ttctatgacctcgagcaagttactcacatctctgtgcctgagttccccatctatgaagtggaaataatggtggtacctatctcatggtggtgttatacagwtcaatcatgtaaggtacttagagtataatgcttgacatgtaataagcactcagtaaatatgagatatcatgattattatgctagcccagagaaactacgg

SEQ ID NO: 24436 - DNA, 201 bp, Homo sapiens
gatctggagaaggtttatttctggctcatcctcaccttaaaaattagcactttggagtccaagcataacagagggtctcctttagactctccactttggcyctggatcttgacttaatgttcctctcaatttttggcaaaactgaaactcaagttggtctagctcaccattgcccttggaagaaaatttgcctcaattttc

SEQ ID NO: 24437 - DNA, 201 bp, Homo sapiens
ggggatgagaggatggaagtcagttgtcaaccgtctcctctctctctctgtttctgtctctgtctctcacactttctctctctcactgtttctctctctgytcaatacacatatgcacatccttatctcacaattgacccaaagcatcagaaataaaaagtcagactgagtgaccttagctgctaggaagcatcttattgt

SEQ ID NO: 24438 - DNA, 201 bp, Homo sapiens
ttgtggggttctttttttcattgtgttactgttttataggccctgtgggatttatgctttttggaagttctattttggtgtatttcaaggtttttttttttcaaaatttagaactccttttagcagttgttgtaagtgctggcttggtagtggtgaattgtctcagcatttctttgtctaaaaaagactatctttccttca

SEQ ID NO: 24439 - DNA, 201 bp, Homo sapiens
atacatatatatacacatatatgtacatatatacacacatatatatacatatatacgtatatatgtatatatgtatatatgtatgtatatacgtatatatwcatatatatacacacacacatatatatctgacattttctttatccacttgttgatttatgggcatttgggctggttccatattttttcaattgcaaattg

SEQ ID NO: 24440 - DNA, 201 bp, Homo sapiens
gtgtgtatatatatatatacatatatatacacatatatgtacatatatacacacatatatatacatatatacgtatatatgtatatatgtatatatgtatgtatatacgtatatatacatatatatacacacacacatatatatctgacattttctttatccacttgttgatttatgggcatttgggctggttccatattt

SEQ ID NO: 24441 - DNA, 201 bp, Homo sapiens
tgtgtgtatatatatatatacatatatatacacatatatgtacatatatacacacatatatatacatatatacgtatatatgtatatatgtatatatgtaygtatatacgtatatatacatatatatacacacacacatatatatctgacattttctttatccacttgttgatttatgggcatttgggctggttccatatt

SEQ ID NO: 24442 - DNA, 201 bp, Homo sapiens
tgtgtgtgtatatatatatatacatatatatacacatatatgtacatatatacacacatatatatacatatatacgtatatatgtatatatgtatatatgtatgtatatacgtatatatacatatatatacacacacacatatatatctgacattttctttatccacttgttgatttatgggcatttgggctggttccata

SEQ ID NO: 24443 - DNA, 201 bp, Homo sapiens
atgtgtgtgtatatatatatatacatatatatacacatatatgtacatatatacacacatatatatacatatatacgtatatatgtatatatgtatatatgtatgtatatacgtatatatacatatatatacacacacacatatatatctgacattttctttatccacttgttgatttatgggcatttgggctggttccat

SEQ ID NO: 24444 - DNA, 201 bp, Homo sapiens
tatgtgtgtgtatatatatatatacatatatatacacatatatgtacatatatacacacatatatatacatatatacgtatatatgtatatatgtatatatgtatgtatatacgtatatatacatatatatacacacacacatatatatctgacattttctttatccacttgttgatttatgggcatttgggctggttcca

SEQ ID NO: 24445 - DNA, 201 bp, Homo sapiens
gtatgtgtgtgtatatatatatatacatatatatacacatatatgtacatatatacacacatatatatacatatatacgtatatatgtatatatgtatatatgtatgtatatacgtatatatacatatatatacacacacacatatatatctgacattttctttatccacttgttgatttatgggcatttgggctggttcc

SEQ ID NO: 24446 - DNA, 201 bp, Homo sapiens
tgtatgtgtgtgtatatatatatatacatatatatacacatatatgtacatatatacacacatatatatacatatatacgtatatatgtatatatgtatatatgtatgtatatacgtatatatacatatatatacacacacacatatatatctgacattttctttatccacttgttgatttatgggcatttgggctggttc

SEQ ID NO: 24447 - DNA, 201 bp, Homo sapiens
gtgtatgtgtgtgtatatatatatatacatatatatacacatatatgtacatatatacacacatatatatacatatatacgtatatatgtatatatgtatmtatgtatgtatatacgtatatatacatatatatacacacacacatatatatctgacattttctttatccacttgttgatttatgggcatttgggctggtt

SEQ ID NO: 24448 - DNA, 201 bp, Homo sapiens
tgtgtatgtgtgtgtatatatatatatacatatatatacacatatatgtacatatatacacacatatatatacatatatacgtatatatgtatatatgtatatatgtatgtatatacgtatatatacatatatatacacacacacatatatatctgacattttctttatccacttgttgatttatgggcatttgggctggt

SEQ ID NO: 24449 - DNA, 201 bp, Homo sapiens
cttaaaataatggtattgaactccatccaggttgttgcatatgccattattttgttcctttttatggctgaacaatattccatggtgtgtatgtgtgtgtrtatatatatatacatatatatacacatatatgtacatatatacacacatatatatacatatatacgtatatatgtatatatgtatatatgtatgtatata

SEQ ID NO: 24450 - DNA, 201 bp, Homo sapiens
cttttcggtatcctgatttcctttcctttgaatatatcctcagcagtgagattgttggatcatgggggtaaatctatttttaggtttttgtattttttaarttttttaattcaataggtttttggggaacaggtgctgtttggttccatggataagttctttagcggtaatttctgaaattctggtacacctatcacccga

SEQ ID NO: 24451 - DNA, 201 bp, Homo sapiens
ccttcttattgatctgtgagcttttttattgatacataatgattgtagtgtttatggggtacatgtgatattttgacaaatgcatacaatgcataatgatsaaaccagggtaattgggatatccaccacctcaaacatttatcatttatttctgctgggaacatgccaaatcatctcttctagctgttttgaaatatatga

SEQ ID NO: 24452 - DNA, 201 bp, Homo sapiens
caaattcctcttacagaagagcggtaagatacattggtagacatatacaacctgggcttcagaccagggaagttttattttgccactaaatttagccactrtatcaacacatctcccagcttacaagatgactgagaacaagtgtaagttcttgaggacacaagcccttgccttagtcagctttgtgtgccctgctgtact

SEQ ID NO: 24453 - DNA, 201 bp, Homo sapiens
ctccacttcagtcccggcaaattcctcttacagaagagcggtaagatacattggtagacatatacaacctgggcttcagaccagggaagttttattttgcyactaaatttagccactgtatcaacacatctcccagcttacaagatgactgagaacaagtgtaagttcttgaggacacaagcccttgccttagtcagcttt

SEQ ID NO: 24454 - DNA, 201 bp, Homo sapiens
catccccatccccaccccctgtttaaaattgcaacccatcaccaaccccgctccctcttcgttccacttaccatgttctgggcttttttttttttttttttgccacagcatttattatcttctcccaaacaatataccctataactttttattatatctactctctgtctctgcccactaccatgtaaattctgtgagggc

SEQ ID NO: 24455 - DNA, 201 bp, Homo sapiens
ccaagattgagccactgcactccagcctgggcaacagagcaagactctgtttcaaaaaaataaataaataaaaaattaaaaaggaaagaaagaaagaaagatcccttgttgaagctgaatgcccatgcccaaattctggccttctctctacctcctgcttttgcagtagctttctaatgagccttcctgacctccagtcct

SEQ ID NO: 24456 - DNA, 201 bp, Homo sapiens
gccaagattgagccactgcactccagcctgggcaacagagcaagactctgtttcaaaaaaataaataaataaaaaattaaaaaggaaagaaagaaagaaagatcccttgttgaagctgaatgcccatgcccaaattctggccttctctctacctcctgcttttgcagtagctttctaatgagccttcctgacctccagtcc

SEQ ID NO: 24457 - DNA, 201 bp, Homo sapiens
agccaagattgagccactgcactccagcctgggcaacagagcaagactctgtttcaaaaaaataaataaataaaaaattaaaaaggaaagaaagaaagaaagatcccttgttgaagctgaatgcccatgcccaaattctggccttctctctacctcctgcttttgcagtagctttctaatgagccttcctgacctccagtc

SEQ ID NO: 24458 - DNA, 201 bp, Homo sapiens
gagccaagattgagccactgcactccagcctgggcaacagagcaagactctgtttcaaaaaaataaataaataaaaaattaaaaaggaaagaaagaaagaaagatcccttgttgaagctgaatgcccatgcccaaattctggccttctctctacctcctgcttttgcagtagctttctaatgagccttcctgacctccagt

SEQ ID NO: 24459 - DNA, 201 bp, Homo sapiens
ctcacacgtgtaatctcaacactttgggaggctgaggcagcaggatcacttggggccaggagtttgagaacagccagggcaacaaagtgagacctcatctstacaaaaaaattaaaaattagccaggcgtggtaccacacgcctgtagtcccagctacccaggaggctgaggtgggaggatcacttgcacccaggagtccc

SEQ ID NO: 24460 - DNA, 201 bp, Homo sapiens
tggcgtggttttggctcactgcaacctccgcctcccagcttcaagtgattctctctcctcagcctcctgaatagctgagactacagatgcatactgccacrtgcagctaatttttgtatttttagtagagacagggtttcaccgtgttagtcaggctggtctccaactcctaacctcgagtgacccacccaccttggcccc

SEQ ID NO: 24461 - DNA, 201 bp, Homo sapiens
tgttcacttgtttatctgctgaccttccctccactattgtcctgtgaccctgctaaatctccctctgcgagaaacacccaagaatgatcaataaaaaaaaraaaaaaaaaagtgttggaggttaggacttcaacacaggaatttaggagagaacaaaattcagcccataacaccaggtaaatagccaaatgaatgggtgct

SEQ ID NO: 24462 - DNA, 201 bp, Homo sapiens
cgcattctaaagtgttggaggctccctctccctctccctctccccctccccctccccctccccctccctctcttgccacggtctccctctgatgccgagcsgaagctggactgtactgctgccatctcggctcactgcaacctccctgcctgattctcctgcctcagcctgccaagtgcctgcgattgcaggcgcgcgcca

SEQ ID NO: 24463 - DNA, 201 bp, Homo sapiens
ggtcacctaggagtgatcagaaccagcatctgaacccaattctctctgtgagcctgtgaacctgttccccaggcacaacgcgctgtctccggcagccttgyttcccctgcttaaaagtcacaaagaactccctggccagaaaggaaacccaaggcctggcgtcctctacctctttcccgtggtggccttgaatgagaaacc

SEQ ID NO: 24464 - DNA, 201 bp, Homo sapiens
gatgggtaactgttttgtctgtattcacagacgtctctagttcagctgtgctcattattttttaacatgagataagaggaaagtgttcagtttttttaaaagtcaaaccacatcttaagggtggaatttactgggccatacgtaactcaggggccctttaatctgttgcatttgaggtgcatcaccctgagtgcttgaaga

SEQ ID NO: 24465 - DNA, 201 bp, Homo sapiens
ctgtgatgggtaactgttttgtctgtattcacagacgtctctagttcagctgtgctcattattttttaacatgagataagaggaaagtgttcagttttttwaaaagtcaaaccacatcttaagggtggaatttactgggccatacgtaactcaggggccctttaatctgttgcatttgaggtgcatcaccctgagtgcttg

SEQ ID NO: 24466 - DNA, 201 bp, Homo sapiens
attttggatcaagtataacaggaatggagataaaatcagaaggacatcagacatttggatgggcaaccagacactggggaaaaaatcttgtttgtctgcawgttacctcctacaaggcaaaaatcataatatcagcatcttatggaaactgaaaagggagatccggagaagcttccagaaagcagggggatacattgaaat

SEQ ID NO: 24467 - DNA, 201 bp, Homo sapiens
acagtgttgactgtgtgcccaacactgttcttagtgctttatatttaaaatttgttaaatcacacaacaacccagaaggagtaggtgtcattatttccccrttttatagatgagaaaactggggcacacaaaggttgggtggtttgtcaaaggtcacaaagccacagtaaatattttgtgatagagaaattgttcaggact

SEQ ID NO: 24468 - DNA, 201 bp, Homo sapiens
ttgaacccaggaggctgaggttgcagtgagtggagatcacattactgcactccagcctgggtaagagagtgagactgtgtctcaaggaaaaaaaaaaaaaagagagaaaagaaaaatcaccctagcatcggtggaacagtgatgggcagaggccaaggttagtagagagaccctggctgggatgctacctttgtagtctac

SEQ ID NO: 24469 - DNA, 201 bp, Homo sapiens
cttgaacccaggaggctgaggttgcagtgagtggagatcacattactgcactccagcctgggtaagagagtgagactgtgtctcaaggaaaaaaaaaaaaaagagagaaaagaaaaatcaccctagcatcggtggaacagtgatgggcagaggccaaggttagtagagagaccctggctgggatgctacctttgtagtcta

SEQ ID NO: 24470 - DNA, 201 bp, Homo sapiens
ggctatatttctagtctggaaacaaatacacaagtagtgtgtgattgtctctgtcttcatatttagttgggacaagccgaagctgtatgatgatgtaacargcattttttttttaaatggttagatctcttcttcactgagtgaccttataacaccacacacgtctcctgcagagaaccagtgccaatctccttcaccaga

SEQ ID NO: 24471 - DNA, 201 bp, Homo sapiens
ggtatcagcacattactactgtgccatttgacacacatgtctccaaacagaagtgagaaagtaagagtgagtgtgtgtgtgtgtgtgagagagagagagaraaggagggagagagagagaaaaaaaatacctcattttctgccaagtagaagccctaaactgaactggattcaatttgggggtcctgagcaccactacaga

SEQ ID NO: 24472 - DNA, 201 bp, Homo sapiens
actctgttgcccaggctggagtgcagtagagcgatctcagctcactgcatcctccgcctcccgggttcaagcacttctctgcctcactctcccgagtagckgggattacaggcgcctgccaccacacccggctaatttttatgtttttagtagagatggggtttcgccatcttggccaggctggcctggactcttgacctc

SEQ ID NO: 24473 - DNA, 201 bp, Homo sapiens
taatttctacagaagtcgtgcagggcatgtgataggagaagtgctaattttagtttagttttccaaatatggatggaaaaagctttatatttaaaaaaaaatagtctgcgtttaggggatccaatcaaaaatgtcacaacctggaatttgaagggtggtcagtatttacgccaaaccttgtggctgcaagtgatgtcaaga

SEQ ID NO: 24474 - DNA, 201 bp, Homo sapiens
gaaggatgttgcgctctctcccatgggccgtgggaagccacggataagacacgcgaaggtgggggcagtgggaacatatgggggatggcttcaggaagtayttcaggctagaatcgccaagatttgatgacaaactggatgagagtagcaagctgcgttatcaccatggggatactaattttgtggaactagagaatctgc

SEQ ID NO: 24475 - DNA, 201 bp, Homo sapiens
ggctgtgagatttggcacctcactggaagctaacattgacagctttgtcctgttccttctgcagaatttgtgtgtgtgtgtgtgtgtgtgtgtgtgtgtgwgagagagagagagagagagagagaaagacaaggcggtgtgtgtggttgtaagagtgtatgcattcttcaagttggcatttttgtccttggggaggtaatg

SEQ ID NO: 24476 - DNA, 201 bp, Homo sapiens
tattttcctgaagaatctcagagatagtttgactagacaaaatattgccctatgccacataggatttgacccactgtcatcttttttttttttttttttttgagacggagtctcactcttgttgcccaggctggagtgcagtggcacaatctcggctcactgcaagctccgcctcccaggttcacgccattctcctgcctc

SEQ ID NO: 24477 - DNA, 201 bp, Homo sapiens
tgatggacaccaaatagggaacaagaatgcaaaatcaagtaagtattagcatagataggaaggattgaggaacattttctatggcgattgtttcttttttkggggggatggcatggacggagtcttgctctgtcacccaggctgaagtgcagtggcgtgatcttggctcagtgcaacctctgcctcccgggttcaagcgat

SEQ ID NO: 24478 - DNA, 201 bp, Homo sapiens
taagtttacattgctgacatcattgtctgtgcctgtcagttttactgtgctatcacagacattcacaggcatcacaactgctgccctattttttttttcccatttttgctaatttggtagtcatagaataacaacctccccaaatgctttcatttgcatttctctgattatgagcagagttcacattttttcccgtcatgt

SEQ ID NO: 24479 - DNA, 201 bp, Homo sapiens
ataccctgacttgatcacatcatgcattatgtatatgtagcaaaatttctcctgtaccccgtatatttgcataaataaaaaaacaaaaatggaaaaaaaaattaaaaagaattccaaaagcacagcagcctaggatagtttaaaaagagactagaaagttctaaaaaggagccaaaggcatccctgtattatagcctggtc

SEQ ID NO: 24480 - DNA, 201 bp, Homo sapiens
acacctgaataccctgacttgatcacatcatgcattatgtatatgtagcaaaatttctcctgtaccccgtatatttgcataaataaaaaaacaaaaatggraaaaaaaattaaaaagaattccaaaagcacagcagcctaggatagtttaaaaagagactagaaagttctaaaaaggagccaaaggcatccctgtattata

SEQ ID NO: 24481 - DNA, 201 bp, Homo sapiens
cacgtatgtggcgtttttccttggaaagtttgagaggttgaaagggtctaagactgaaggaaaagtaagtagatgacagtagtttcagcaaggatgactctgcacagctttccccatcaggacgtttacataagcttatgaacgccccgtcttggagcacttagaatgcctttcccaggctgtctgagtgagcaggtggtt

SEQ ID NO: 24482 - DNA, 201 bp, Homo sapiens
acacgtatgtggcgtttttccttggaaagtttgagaggttgaaagggtctaagactgaaggaaaagtaagtagatgacagtagtttcagcaaggatgactctgcacagctttccccatcaggacgtttacataagcttatgaacgccccgtcttggagcacttagaatgcctttcccaggctgtctgagtgagcaggtggt

SEQ ID NO: 24483 - DNA, 201 bp, Homo sapiens
atccccctccctttttatttgctttgtccttgggagctggaatacagaacttgttggaatttacgtaaatggagaagccatagaccctgagagagctgatrgcctgaggccttttccttgaggaagctcctggcactttcaaggcatgaacattgtgatgtatattttgatggttgggaggcatttttctgtggcttgctg

SEQ ID NO: 24484 - DNA, 201 bp, Homo sapiens
agtggcatagttgaggtatcaacctaggcggtataaatacagagcctgaacttttaactattatatgaatgtgtattcccaatacatttttttttttttttgagatggagtctcgctctgtctccaggctggagtgcagtggcacgatctcggctaactgcaacctccgcctcccgggttcaagcaattttcctgtctcag

SEQ ID NO: 24485 - DNA, 201 bp, Homo sapiens
aagtggcatagttgaggtatcaacctaggcggtataaatacagagcctgaacttttaactattatatgaatgtgtattcccaatacatttttttttttttttgagatggagtctcgctctgtctccaggctggagtgcagtggcacgatctcggctaactgcaacctccgcctcccgggttcaagcaattttcctgtctca

SEQ ID NO: 24486 - DNA, 201 bp, Homo sapiens
cttttacgatttctggagagaaatttacagtcgttcaagttgtttccccgtagattatatatcatttttctttagctgctttgaactgtttttttttttttgtctttagttttcatcagttagatcatagcgtgtctgggtataatttctttgagtttatcctgttagggttctctgagctatttgaatctgtaggttttt

SEQ ID NO: 24487 - DNA, 201 bp, Homo sapiens
tttaaatgtttggacatttgtctttaattttctctttttttttgagacaaggtcttgctctgtcacccaggctggagtgcagtggtgccatcacagctcamtccagcctcaacctcctgggctcagctaatccttctacctcagccttgtgagtagctgggatcacaggagtgtgccaccacaccctcctaatttaaaagc

SEQ ID NO: 24488 - DNA, 201 bp, Homo sapiens
aatcttagctttgattatatgccaagtcctgggagttagcctagtgaatcattgaatctgtgtgggcttggggacccctgacacagcatcttatatgaagsgactgtagtgttggtgtatctcattactgatgatgttgaccatggtcccttggctgaggtggtatctaccaagtttctccactgtcaagttactattttt

SEQ ID NO: 24489 - DNA, 201 bp, Homo sapiens
ggcttctggtgaaatgggaaaaataaggacatctagtgaacatgtagctataaagtttctaccctttcagggtggagagttctttactctgagactttgccttcctgtatttcggatgctaaggcagctgtttatttagggtattagtaagtagagctcattgctggtgtttttgtaagtctttgtgtaaaataaaaagtt

SEQ ID NO: 24490 - DNA, 201 bp, Homo sapiens
gaggaggcagtcaacagtcaaaaggataccaaaatgtaaagcatgcatgtcctttgacctagcagttatactttcacgagataatatacaagtgggaaaawtatatgtatctggctgtgcattgtttattgaaaacaccccaaatgtccatcagtaacgggatttatggatacatagacacagtaaagttacccttagcca

SEQ ID NO: 24491 - DNA, 201 bp, Homo sapiens
tgtagcccaggaaagtcaactcaaggagcatctcacagaaggaggatgctgcattttgccatgattcctgcaacccagagaaaccaattccagcaaagatygatgccctgtacccggtgcaaatttagaatgataaaaagaagagtcatggtttccttgaccagacaggagtgtcccctactttgcagaataatgaaatac

SEQ ID NO: 24492 - DNA, 201 bp, Homo sapiens
ccttgccctttgtcaaggtccttagtcaaaggagaccatgtagcccaggaaagtcaactcaaggagcatctcacagaaggaggatgctgcattttgccatkattcctgcaacccagagaaaccaattccagcaaagatcgatgccctgtacccggtgcaaatttagaatgataaaaagaagagtcatggtttccttgacca

SEQ ID NO: 24493 - DNA, 201 bp, Homo sapiens
attttctgttgggcacaggtaaatgtaaatccttacaaagtagacagaactgagtaagtttcaaagctctaaaaagggcctttttgcttgaacaaaaaccrtttgtatatgagcccacagcttttgtgtgtgaagcagaatttgtatcttgcacacaaatggggaagaagagagcagtgttgaaatggggaaagatcataa

SEQ ID NO: 24494 - DNA, 201 bp, Homo sapiens
tcccaaagcgctgggattacaggtgtgagccactgcgcctggccaagcatgaagcaatcttgtgctggtacctggcatagtggaggtgatagaaggtggtwtaatatgtcttactgagctgctaagcagcagctgcatgtcttattgagctgctaattgatactactaactggggagctccattacaaaaacccacaataa

SEQ ID NO: 24495 - DNA, 201 bp, Homo sapiens
ggtttcaccatgttggtcaggctggtctcgaacttctgacctcaagtgatctgcctgccttggcctcccaaagcgctgggattacaggtgtgagccactgygcctggccaagcatgaagcaatcttgtgctggtacctggcatagtggaggtgatagaaggtggtttaatatgtcttactgagctgctaagcagcagctgc

SEQ ID NO: 24496 - DNA, 201 bp, Homo sapiens
actccagagttgttgctcttaatcaccccaccacagtgcttgttgaggaaatgaatgtggaatttgaatgatgaattcacactcatccttccttagggtagcctttgtaggattgggattcagtctgatctgggttcaaattttgtaactgactcacattttatgatttacttgcttgtgtgatggggttatggtgtggga

SEQ ID NO: 24497 - DNA, 201 bp, Homo sapiens
aactccagagttgttgctcttaatcaccccaccacagtgcttgttgaggaaatgaatgtggaatttgaatgatgaattcacactcatccttccttagggtagcctttgtaggattgggattcagtctgatctgggttcaaattttgtaactgactcacattttatgatttacttgcttgtgtgatggggttatggtgtggg

SEQ ID NO: 24498 - DNA, 201 bp, Homo sapiens
caactccagagttgttgctcttaatcaccccaccacagtgcttgttgaggaaatgaatgtggaatttgaatgatgaattcacactcatccttccttagggtagcctttgtaggattgggattcagtctgatctgggttcaaattttgtaactgactcacattttatgatttacttgcttgtgtgatggggttatggtgtgg

SEQ ID NO: 24499 - DNA, 201 bp, Homo sapiens
ccaactccagagttgttgctcttaatcaccccaccacagtgcttgttgaggaaatgaatgtggaatttgaatgatgaattcacactcatccttccttagggtagcctttgtaggattgggattcagtctgatctgggttcaaattttgtaactgactcacattttatgatttacttgcttgtgtgatggggttatggtgtg

SEQ ID NO: 24500 - DNA, 201 bp, Homo sapiens
tccaactccagagttgttgctcttaatcaccccaccacagtgcttgttgaggaaatgaatgtggaatttgaatgatgaattcacactcatccttccttagggtagcctttgtaggattgggattcagtctgatctgggttcaaattttgtaactgactcacattttatgatttacttgcttgtgtgatggggttatggtgt

SEQ ID NO: 24501 - DNA, 201 bp, Homo sapiens
aacccgggaggcggagcttgcagtgagctgagattgcgccactgcactccagcctgggcgacagagcaagactctgtctcaaaaaaaaaaaaaaaaaaaaagttatataactcacaatcaaagatcatgtagccatgtagctagaaagttgcagagctggggtttaacttaagtggtccaactccagagttgttgctctta

SEQ ID NO: 24502 - DNA, 201 bp, Homo sapiens
cttgagcatgagaggttgaggcagcagtgagccatgattgtaccactgcacacaaacttgagcaacagagtgaaaccctgtctcagaaaaaaaaaaaaaaagataaggtcactcccctgtaatgacttctcatcacagctagaattctgaactcaaactccttagccaggctgaagaagccctacctgacctggctcctgc

SEQ ID NO: 24503 - DNA, 201 bp, Homo sapiens
aaccaagatcgcgccactgcactccagcttgggcaacagagtgataccttgtctcaaaaaatacatattaaacattaaaaaggaataaaaaataaaaaaaatacatctcactggaatggaactcagtctgttcatatcttctccccagccccatcccccagaggtggctcccccagctttctacccccagttgcgagaagt

SEQ ID NO: 24504 - DNA, 201 bp, Homo sapiens
gggagatgaaaagaaccttgacctttaccttgcaccataaacaaaaattaatttgctgtggatcatagacataaatgtagaagctaaagctataagacttmttctaaacaatgatttaggggaagattccttgaatcgaatatagaaaaacacaaaccattaagaaggaattgatgcaaatgactatataaaaatttgttt

SEQ ID NO: 24505 - DNA, 201 bp, Homo sapiens
tttataatcagaaataaagttcattttggaagggggaaaaaggcgtgcaagacacactacctcatttcgagacttaactataaagctgtagttaacaacamccttattggcataaagatagttgtatagctcaatcatacaaaatagatagtctaagaatagactcagacttgtatggtcaattgattttcaacaaaggtg

SEQ ID NO: 24506 - DNA, 201 bp, Homo sapiens
gaaggtactggcagggtttgttctttctggaggctctgagggagagtctgttccatgcctcattcctagcttctggggccgctggcaattcttggtgttccttggcttggttggggctgcatgattccagtttctgccttcaacttcgcatggcctttgcccttgtctgtttctgtgtcatctccttctctgtctctcata

SEQ ID NO: 24507 - DNA, 201 bp, Homo sapiens
accgagtgagtttggcttagcgaatgtcagaagtgtgtcctctttgatggcattactggaacattttccttcagctttagccttgaatcagagcagtgttstccaggcgtcgttaaactaattggacatggctgaaaaatgagccctagtcacacttgtagttccacagtccgttgaaaaaagcctcttgattgatttgga

SEQ ID NO: 24508 - DNA, 201 bp, Homo sapiens
tgggaggctgaggcaggagaatcacttgaacctgggaagtggaggttgcagtgagccgagatcgtgccactgactccagcctgggtgacatagtgagactstgtctcaaaaaataaaaaattaaaaaaaaatacacagactgagtacgtgcttatgatacaaaattcatacaaattagaagtaatggcaataataaaacat

SEQ ID NO: 24509 - DNA, 201 bp, Homo sapiens
gtgagatgctttgctcattactttaagcacatgatcccattgaaacttgccaaggatatcatgtggcaggaaatcattgtatggttcaggagagattgatmatacccagggtaccacagtaaaggctgaagcctagattctaacttaagcttctctttgccccctacctgggcttttcccactctgtttccaggcttcctg

SEQ ID NO: 24510 - DNA, 201 bp, Homo sapiens
tgccaagtgcttctagcagcttggctgtcgaggtgtctttggtggcctgtgggtttgctaagttgaggctcacttcattcttagctgtgccttggagttaygaatgcgttaaagggatatctcctctcttccttgatgtccctggtcctgggcatcctcacagcccactgggcagcctttcctgctctcagacccatgaca

SEQ ID NO: 24511 - DNA, 201 bp, Homo sapiens
gggactgtttggtttgggtaaagtgagttgaagcaaggccggatctgggaattcatttttccccactgatcctgggaaccgaagctttatttaagacgtcygaccaccctacttgccccgcgatgggcgccctgaccggcgaggggccctgggagaggacacggggcttcatccggcggccctttgaacctggcatcacca

SEQ ID NO: 24512 - DNA, 201 bp, Homo sapiens
gcgggagcctgtaatcccagctacttgggagactgaggcacaagatttacttgaacctgggaggtggaggttgcagtgagctgagattgtgccactgcacycaagtctgagtgacagagtgagaccgtatctcaaaacaaaccccaaaaattattatatagtgaatgatagcttcctgcagctgtctaacaggctgacgtc

SEQ ID NO: 24513 - DNA, 201 bp, Homo sapiens
aaactatctcctttgtttaaaaaaaaaaaattattataggctgggcatggtggcttatgcctgtaatcccagcactttgggaggccaaggtgggcagatcrtttgagcccaagaatttgagaccagcctgggcaacatggtgaaatcctgactctactaaaaatacaaaaattagctagatgtgttggcgggagcctgtaa

SEQ ID NO: 24514 - DNA, 201 bp, Homo sapiens
ccaaggcggttcattttcttctttggaaagttacactgattgatgtctttgactttccatgtacagacctggccctttatgtttggtgggtgtgtttggttgaggggggtgtggaggagggataaatttgaggactttgttaaatgataaaatattaatgaatctccaaatccagagatagaaaagtaggtgcaaaaatgg

SEQ ID NO: 24515 - DNA, 201 bp, Homo sapiens
tcccgggttcacgccattctctcgcctcagtctcccgagtagctgggactacaggcgcccgccactacgcccggctacttttttgtatttttagtagagayggggtttcaccgtgttagccaggatggtctggatctcctgacctcgtgacccgcccgcctcggcctcccaaagtgctgggattacaggcgtgagccaccg

SEQ ID NO: 24516 - DNA, 201 bp, Homo sapiens
aacattagaaagtttagacagtagagggaaggagaaaaagtcccttttctaaaacaaattctactttcatttaaaatttctttcttttttttttttttttttagacggagtcttgcctctgtcacccaggctggaatgcagtggcgtgatctcggctcactgtaagctccgcctcccgggttcacgccattctctcgcctc

SEQ ID NO: 24517 - DNA, 201 bp, Homo sapiens
gaacattagaaagtttagacagtagagggaaggagaaaaagtcccttttctaaaacaaattctactttcatttaaaatttctttcttttttttttttttttttagacggagtcttgcctctgtcacccaggctggaatgcagtggcgtgatctcggctcactgtaagctccgcctcccgggttcacgccattctctcgcct

SEQ ID NO: 24518 - DNA, 201 bp, Homo sapiens
gaggccgaggcaggcggatcacagggtcaggagatcgagaccatcctggtcaatatggggaaaccccgtctctactaaaaatacaaaaaaattagctgggygtggtggtacatgcctgtaatcccagctacttgggaggctgagacagaagaatcgcttgaacccgggaggcggaggttgcagtgagccgagatcgtgtca

SEQ ID NO: 24519 - DNA, 201 bp, Homo sapiens
atagggcaattgtaaggagtaaaaaggaactgaagggccgggcgcagtggctcacgcctgtaatccaagcactttgggaggccgaggcaggcggatcacarggtcaggagatcgagaccatcctggtcaatatggggaaaccccgtctctactaaaaatacaaaaaaattagctgggcgtggtggtacatgcctgtaatcc

SEQ ID NO: 24520 - DNA, 201 bp, Homo sapiens
agctgtgtgaccttgggcaagttacttcttcagtttcagtttcctcatctgcaaaatggaaatggtgcctgtttcatagggcaattgtaaggagtaaaaargaactgaagggccgggcgcagtggctcacgcctgtaatccaagcactttgggaggccgaggcaggcggatcacagggtcaggagatcgagaccatcctgg

SEQ ID NO: 24521 - DNA, 201 bp, Homo sapiens
cacacaagcttgacagaggccaacatgggtttgtcctagttcctttgcatactggacacattatttaatctctctgtgcctcagtttccttatctgtgaawtagggaaataataaaatagaatctacctcctagagtttaaatacatttgtacctgttaagtgtttaacaggtattaacaatgcttgacccttcttagttg

SEQ ID NO: 24522 - DNA, 201 bp, Homo sapiens
acaaaagtgtgtgagcttcactaggagttgccaaattgctcttcagatgtgccgtgtatgagttcctgttcctccccatcttcttgccacttaagaatgtsaggcttcaaatttttgcaagttgggtgtaaaagagagccctcttgttccattaatcattctttgattacaagtgagattgagtatatattaagtggctat

SEQ ID NO: 24523 - DNA, 201 bp, Homo sapiens
cataaaaatgagcaaccagcagccattggggctgctttgcctatggagtaggcattcttttattcttttgctttcttaataaacttgctctcacgttactytggattcgccttgaattctttcttacatgagatccaagaaccctctcttggagtttgggtcgggacccttttccagtaacaaaagtgtgtgagcttcact

SEQ ID NO: 24524 - DNA, 201 bp, Homo sapiens
cctcattgctcattatatgctaattacgatgcattagcatgctaaaagacactcccacaagtgccataacagtttccaaatgccatagcaacatcaggaakttaccctatatggtctaaaatggggaggagtcctcacttccaggaattgcccacccctttcctagaaaacttatgaataatccaccctgtgtttagcatg

SEQ ID NO: 24525 - DNA, 201 bp, Homo sapiens
gtggcgtgatcttggctcactgcaacctctgcctgccgggctcaagtgatcctcccacctcagcctcctgagtagctgtgacttacaggcacatgccactrtgcctggctaatttttaattctttctttttttggtagaaatgacgtctcactatataccccaggctgatcttgaacttctaggctcaagtaatcctccta

SEQ ID NO: 24526 - DNA, 201 bp, Homo sapiens; identical to SEQ ID NO: 7983

SEQ ID NO: 24527 - DNA, 201 bp, Homo sapiens; identical to SEQ ID NO: 7984

SEQ ID NO: 24528 - DNA, 201 bp, Homo sapiens; identical to SEQ ID NO: 7985

SEQ ID NO: 24529 - DNA, 201 bp, Homo sapiens; identical to SEQ ID NO: 7986

SEQ ID NO: 24530 - DNA, 201 bp, Homo sapiens; identical to SEQ ID NO: 7987

SEQ ID NO: 24531 - DNA, 201 bp, Homo sapiens
ggctccatttgtttatttttcaagcatagatgctattttctcaggactgtagagtaaaaacattagaaatttctagctgcctgccacttagggcttgctggcttctagcccttctgctgaaagtcaaatttaagataggggatcatagaaaatgaagaaaagacatacaagtcattagggagaaaagaggagctggtgttc

SEQ ID NO: 24532 - DNA, 201 bp, Homo sapiens
cttttcgatagctacaattgtaggagtcacattgcatgcagagcagttcataaattgaatggttgtgtgtgtgtgtgtgtgtgtgtgtgtgtgtgtgtgttagcaggggaggctcagagttttggcctctggctgtatggctgtatgcttgtgagtatcctttgtctgaaacctgatgatgcaggaatttacatcttggaa

SEQ ID NO: 24533 - DNA, 201 bp, Homo sapiens
gcttttcgatagctacaattgtaggagtcacattgcatgcagagcagttcataaattgaatggttgtgtgtgtgtgtgtgtgtgtgtgtgtgtgtgtgtgktagcaggggaggctcagagttttggcctctggctgtatggctgtatgcttgtgagtatcctttgtctgaaacctgatgatgcaggaatttacatcttgga

SEQ ID NO: 24534 - DNA, 201 bp, Homo sapiens
agcttttcgatagctacaattgtaggagtcacattgcatgcagagcagttcataaattgaatggttgtgtgtgtgtgtgtgtgtgtgtgtgtgtgtgtgtgttagcaggggaggctcagagttttggcctctggctgtatggctgtatgcttgtgagtatcctttgtctgaaacctgatgatgcaggaatttacatcttgg

SEQ ID NO: 24535 - DNA, 201 bp, Homo sapiens
gctgcttttgaccattgcctctcttcttacatcagcttttcgatagctacaattgtaggagtcacattgcatgcagagcagttcataaattgaatggttgtgtgtgtgtgtgtgtgtgtgtgtgtgtgtgtgtgttagcaggggaggctcagagttttggcctctggctgtatggctgtatgcttgtgagtatcctttgtc

SEQ ID NO: 24536 - DNA, 201 bp, Homo sapiens
gccacctctgtctcctgggttcaagtgattctcctgcctcagcttcctgagtagctaggattacaggtgcatgccagctaatttttgtattttttttttttagtagagatggggttttgccatgttgcccaggctggtctcgaactcctggcctcaaatgatctgcctgcctcggcctcccaaagtgctgggattacaggt

SEQ ID NO: 24537 - DNA, 201 bp, Homo sapiens
gaaagatgggtgttcaatttcattcttctgcttatagctagccagatatcccagcaccgtttactgaataggaagtcctttccccattgtttatttttgtygactttgtaaaagatcagatggctgtaggtgtgcaggtttatttctgggttctctcttctgttccattggtttatgtgtctgtctttgtaccattaccat

SEQ ID NO: 24538 - DNA, 201 bp, Homo sapiens
attctcctgcctcggcctcctgagtagctgggattacaggtgcacgccaggctaattcttttgtatttttagtagacacggggtttcaccacgttggccasgctggcctcgaactcctgacctcaagtgatccgcctgcctcggcctcccaaagtgctgggattacaggcgtgagccactgtgcctggccaagttaagatc

SEQ ID NO: 24539 - DNA, 201 bp, Homo sapiens
gggacctgggagggctccaactgggggtcccagccagtttggactgctgtcaggttttgtttgtcctgcacaaggacactaaaaacaataattagttgtckgtgtttataaagcaagagcttgcacataaaaattagattatcaggttttcttgagaaatcagatattaggttactttttgcactcacagagaaccatgtc

SEQ ID NO: 24540 - DNA, 201 bp, Homo sapiens
acatatgtaattcgttaagacacagttctgttggactggagtgggccctaattcccatgactggtgtctttgtaataagagggggtacacagacactcacagagggaagatggccttgtgaagacagaggcagacactggagcatgtaggtgcagggcaaggaatgccaaggattgccagcaacctccagaagccaggcaa

SEQ ID NO: 24541 - DNA, 201 bp, Homo sapiens
gacatatgtaattcgttaagacacagttctgttggactggagtgggccctaattcccatgactggtgtctttgtaataagagggggtacacagacactcacagagggaagatggccttgtgaagacagaggcagacactggagcatgtaggtgcagggcaaggaatgccaaggattgccagcaacctccagaagccaggca

SEQ ID NO: 24542 - DNA, 201 bp, Homo sapiens
ttgacatatgtaattcgttaagacacagttctgttggactggagtgggccctaattcccatgactggtgtctttgtaataagagggggtacacagacactcacagagggaagatggccttgtgaagacagaggcagacactggagcatgtaggtgcagggcaaggaatgccaaggattgccagcaacctccagaagccagg

SEQ ID NO: 24543 - DNA, 201 bp, Homo sapiens
cttgacatatgtaattcgttaagacacagttctgttggactggagtgggccctaattcccatgactggtgtctttgtaataagagggggtacacagacactcacagagggaagatggccttgtgaagacagaggcagacactggagcatgtaggtgcagggcaaggaatgccaaggattgccagcaacctccagaagccag

SEQ ID NO: 24544 - DNA, 201 bp, Homo sapiens
agatcaccacattctgacagttagatgtcagaacccctcattcattacaattgtttccttgcctctcccagttctgtgtgtgtgtgtgtttttttttttttaacacgttgttacatttcttccctaaaacctctagttttagttattcagggagactgatttaagactgagtctcctcggctttgccacccgattaaagcc

SEQ ID NO: 24545 - DNA, 201 bp, Homo sapiens
agaactgaaactcaccagatcaccacattctgacagttagatgtcagaacccctcattcattacaattgtttccttgcctctcccagttctgtgtgtgtgwgtgtttttttttttttaacacgttgttacatttcttccctaaaacctctagttttagttattcagggagactgatttaagactgagtctcctcggctttg

SEQ ID NO: 24546 - DNA, 201 bp, Homo sapiens
agcttgtctccaagttctaggggtattctctttcatgacctaggacatagtgcagggtcagtgctaagtgagattctggaagcagagtcttcagaattccaggtatattttagttttgctgctggttcaaacggctcatctcagtctcgttttgcctctacagaaagtacctttttcttcctgaattttgggtggaagagg

SEQ ID NO: 24547 - DNA, 201 bp, Homo sapiens
gagcttgtctccaagttctaggggtattctctttcatgacctaggacatagtgcagggtcagtgctaagtgagattctggaagcagagtcttcagaattccaggtatattttagttttgctgctggttcaaacggctcatctcagtctcgttttgcctctacagaaagtacctttttcttcctgaattttgggtggaagag

SEQ ID NO: 24548 - DNA, 201 bp, Homo sapiens
tgagcttgtctccaagttctaggggtattctctttcatgacctaggacatagtgcagggtcagtgctaagtgagattctggaagcagagtcttcagaattccaggtatattttagttttgctgctggttcaaacggctcatctcagtctcgttttgcctctacagaaagtacctttttcttcctgaattttgggtggaaga

SEQ ID NO: 24549 - DNA, 201 bp, Homo sapiens
gacggagtctcaccatgttggccaggctggtcttgaactcctgacctcatgatccgcccgcctcgcctcccaaagtgctgggattacaggcgtgagccacygtgcccggcctgctttggttttaatttgcctgcccctgatgactggtcaggggagtggtgggctgtggccaggcctgttccctcatctcccgctgaggtg

SEQ ID NO: 24550 - DNA, 201 bp, Homo sapiens
ggccaggagttcgcgaccagcctggctcacatggtgaaaccccatctctactaaaaatatacagaaaaaaaattagccgggcatggtagggtacacctgtrgtccctgtagctacttgggaggctgaggcatgagaattgcttgaacccagaaggctgaggttgctgtgagctaagatctcaccattctactccagctttg

SEQ ID NO: 24551 - DNA, 201 bp, Homo sapiens
tttttaatatatgtcattataattcaggctttcctcttaaaagaaaaatgtggctaggtgtggtggctcatacctataatcttagcactttgggaggctgmggctggtggatcacttgaggccaggagttcgcgaccagcctggctcacatggtgaaaccccatctctactaaaaatatacagaaaaaaaattagccgggc

SEQ ID NO: 24552 - DNA, 201 bp, Homo sapiens
ggagagtgttacctagggggtggaaaaaagactgaaaaccatactacatgagtacaaggtgacaaccaccccagaccttgattcacgtgtgcagacgtgcrctgctctcgtctagtttgcagaccctcctggaaactttgcaagaaggctctgtggtcactggaccctccatcccctgcccctcccagcagcattgggcct

SEQ ID NO: 24553 - DNA, 201 bp, Homo sapiens
tttttcctgtgctgttctcatgatagtgaataagtctcacgagatctgatgggtttttttttttttttcatttcaaaaaatttatttcagtagtttttgaraaacaggtggtttttggttacatggtaagttctttttaaattttattttaagttctgggatacatgtgcagaaagtgcaggtgtgttacataggtataca

SEQ ID NO: 24554 - DNA, 201 bp, Homo sapiens
cctggtgggaggtaattgaatcatgggggtgggtttttcctgtgctgttctcatgatagtgaataagtctcacgagatctgatgggtttttttttttttttcatttcaaaaaatttatttcagtagtttttgagaaacaggtggtttttggttacatggtaagttctttttaaattttattttaagttctgggatacatgt

SEQ ID NO: 24555 - DNA, 201 bp, Homo sapiens
tgagacagaagaatcgcttgaacccaggagacggaggttgcatggagctgagatcgtgccattgcgctccagcctgggtgacagagtgagaccttatctcwaaaaaaaaaaaaaaaaaaagaaaagaaaagaaaaaaatacaatgccgtacacatctgtgttattttaagtgggtgattctaatatgtaggaaatccctaa

SEQ ID NO: 24556 - DNA, 201 bp, Homo sapiens
ggctgagacagaagaatcgcttgaacccaggagacggaggttgcatggagctgagatcgtgccattgcgctccagcctgggtgacagagtgagaccttatytcaaaaaaaaaaaaaaaaaaaagaaaagaaaagaaaaaaatacaatgccgtacacatctgtgttattttaagtgggtgattctaatatgtaggaaatccc

SEQ ID NO: 24557 - DNA, 201 bp, Homo sapiens
accacgttagccaggatgatctcgatctcctgacctcgtgatccgcctgtctcggcctcccaaagtgctgggattacccaaagtgctgggattacaggcgygagacactgcacctggccacactttatttataattgctcactaaatgttattgattagtaataggtttattataaaaacttggacaaaaggtagaaacac

SEQ ID NO: 24558 - DNA, 201 bp, Homo sapiens
aaccacaactcttgactttatcaagtgatagaaacttgagcccagagtcccggctgtagaatgtctaaagagaatgccactgaaccccatcattccctacrcccttctgcattcagaaaaattaaaaacattaggacttgtgtgaaccatgtatggggcatttttcttcagagtcaagcactgctgtctgaaaaagaacac

SEQ ID NO: 24559 - DNA, 201 bp, Homo sapiens
ctatccattctctaggacctggctctcttactgtgagcttgggaaggtttcaaatgagagattgcttcactttcattggtcatttaaaaggaaccacaackcttgactttatcaagtgatagaaacttgagcccagagtcccggctgtagaatgtctaaagagaatgccactgaaccccatcattccctacgcccttctgc

SEQ ID NO: 24560 - DNA, 201 bp, Homo sapiens
gagccttgttgctccgtgttgagagatgtggtggttgatgtacctgggacaaggttgttgagccagtggcattctcctggggagggctctcctggtctccmgatttcagccaggctcacaactattctactggatatatcctcttccctttaattggccaattgtttatcaatgcggagcatcatcaagaatgttagagaa

SEQ ID NO: 24561 - DNA, 201 bp, Homo sapiens
ttttgtgatccttcccaccccacctccttttctgccctttacctgtttcatgacgccgaaacatgcatgagatttgggttgatgatcatctacgagaaaaraggcaccggggatgtgagttgagaggggtccgtggtgtcaaatgatcctgctccctgccctgcagaggtgtatttctcttcctcttcagtttgtctctgc

SEQ ID NO: 24562 - DNA, 201 bp, Homo sapiens
cggtagtgcaatcatagttcaccgtgaccttgaactcctggcctcaagcgatcctcccatctcagcctccaaaagtgctgagattacaggtgtgagccccygcgtccagccctgtgctacatactttataacgaccatgtctgatcttcacaaacacctcatgagatgcatgctcttatccttcattttacagatgaggaa

SEQ ID NO: 24563 - DNA, 201 bp, Homo sapiens
aagctaaaatctgaactgccaagatggcaggccatcaggaaaaggatggagaggcaacatggtgatggggtgggggaagacagtgttggcaccaaatgccygctctgccacttgctggctgtgtgaacttaggagcatacttaatttctctgaacttgcctttccttctctctcaaagtggggccgatggtgctcaaccca

SEQ ID NO: 24564 - DNA, 201 bp, Homo sapiens
cttctcaataacattggacatgagaagacagttctgaaacaaatcgtttcaactcaagttctgtactataaagacattttcagaaatgattaaaaagttastctcatacagtcctttcaagaagctgctaataaatacggtctaccaaaaccaagggagtaaaccaagaaaaagaaagacacaggatatgggaaattgggg

SEQ ID NO: 24565 - DNA, 201 bp, Homo sapiens
ttgcatgttcctgggactcaacctagtctgaagaatcaaaagagtggtattagagccccagaatccatgttttaataagctccaaaggtgattctgcaccrtaatttgaatttcctttagatcacctcaatccatatctgttaacctctcgtccatattttctctttttgtgtctctttctgctgcgttctgaataattct

SEQ ID NO: 24566 - DNA, 201 bp, Homo sapiens
tggtctcctgctggaaagagaggaccccattcagaatgctcccagtaatgctgtaaggggctgatggggtctccagattgtatacagtttcctgcaccccygaaaccatcatagaggatctctgccccctcatgcctttaaacgggaacattaataatttcctgcttagtgcaggatgtagtccaaaaactcaaaatgagt

SEQ ID NO: 24567 - DNA, 201 bp, Homo sapiens
gagtgtttaaaatgataaactccttcatggcatcacctacccatctcccaaaacagtgatttaaaaagcatgaaaaaccccaggtaaaatgaagtcaaacmgatttctttgttttggaactactacaagtcttggatgctttagaaatccgtaagtggggttgggcacggtggctcacgctgtaaccccagcactttggga

SEQ ID NO: 24568 - DNA, 201 bp, Homo sapiens
agctatctgttatgatttatgctaggaatccatagcctctgtgcttctcacacagtacataaacccaaaaggtcgcctctagtttggagtggtgatgctgkgccagtgtgggagcaggcaaggccgtgaggccttcttcctcacaaatccagcacctcccacctgccatcgggtaaagagagggagggcactgcaatggct

SEQ ID NO: 24569 - DNA, 201 bp, Homo sapiens
gggcctgggaaaccatgggaaggatgttgcgctctctcccatgggccgtgggaagccacggataagacacgcgaaggtgggggcagtgggaacatatgggrgatggcttcaggaagtatttcaggctagaatcgccaagatttgatgacaaactggatgagagtagcaagctgcgttatcaccatggggatactaattttg

SEQ ID NO: 24570 - DNA, 201 bp, Homo sapiens
gtagcttggctttcaggctttaaactgtctttggcttggaggtggggtttcaccggggactcgcccctgtctgcccaggcatttgtctgcttcctggcacyatcactgcttgctttcctccctcactattgtatttgtgggatttatccatcttgacaccagttcattgatttttcactacaacacagcatcagttgatgc

SEQ ID NO: 24571 - DNA, 201 bp, Homo sapiens
ttcaccgtgttagccaggatggtctcgatctcctgatctcgtgatccacccacctcagcctccccaagtgctgggattacaggcgtgagccaccgcgcccrgcccagaaacctagatgcttcttatctctgagtccttctgacctcttaaccctaggctgtagacctcctcttctcagcataaaagagaagagttttggaa

SEQ ID NO: 24572 - DNA, 201 bp, Homo sapiens
tttcaggatgccttggtgaaacctttcctagagcaagacttgtggtgcactaacgtactattttccctaaagagttgttttcaagttacatcatgacacakagaatgttttcttgtgcaggctgtgggaacagcctgaaggagcctccctccctctctgccctgttgacacactcacctctgatgtatctgaatggaagtc

SEQ ID NO: 24573 - DNA, 201 bp, Homo sapiens
acaggatcatctggctgctgtgttgagaatagactgcagagggtagtggtggacatgaggaagcagatgggagactctggctgtaataaggggtaggtggrggttgggggtggggtgcggatggtggccaaggccagcgtgtgccaattggtgtggtaagaacggtcagtgcgggccatgcttggaaagtagagaccattg

SEQ ID NO: 24574 - DNA, 201 bp, Homo sapiens
ctctgacaaataggaaggaatgggaagacagggaaaaggttcagaaagacagatatgtgcacatcttttgagggacttttgggatctagtttctagggttycttctatgattctttctcacattaggttcttaatgtggaatatttgaggtggcccagggattctgtattagttagaacatagggtaagctgccataacaa

SEQ ID NO: 24575 - DNA, 201 bp, Homo sapiens
tctggggtctttggagagatctgccactctggttaagtacgtctgcttaataactgaatatttatgcctttcaacaccagcaacaggaatctatctgagaygtatcgaatcttggctttgtcagcatgtaccttttttggtagtagcacagggtcattcttaggaacattaatttttagaccaggctataatacagggttg

SEQ ID NO: 24576 - DNA, 201 bp, Homo sapiens
ctgcttcgtggtgactttctgtttcctgcacctcttctacatttattaatgagaagtcttcaataaggaagaactttcctttctcccctttttacttactyattcaacaatttttggtatcagtctcaggtactagatccttattttgttggcctcagatatttattttattctctgtgtcataatctgataccgttgttg

SEQ ID NO: 24577 - DNA, 201 bp, Homo sapiens
tgacaaagaagagtactctacctgtaatttgtctttcgacaagataaaatgctttatttaaaaatgcaggctgggcgcagtggctgacacctgtagtcccrgcactttgggaggccgaggtgggtggatcagaggtcaggagtttgagaccagcctggccaatatggtgaaaccccatctctactaaaaatataaaagtta

SEQ ID NO: 24578 - DNA, 201 bp, Homo sapiens
agaaggctactatgttggccatgctggtctcaaactcctgacctcaggtgatccacccgcctcagcctcccaaagtgctggtattacaggtgtgagccacygcgcctggcaggggacatctttatctataatgcaggatgtaggaattggactatagcaggaatacccaataataatagtaacagcacctctcacggttga

SEQ ID NO: 24579 - DNA, 201 bp, Homo sapiens
ttggcagaaggtcaaaatctgattccatagagtgggaatgcagggggaaatatttgatttctttgacacagttcattaaaaattcatacatatggatctgraaatgaaacattgctccatgtcaacatgagttacagtgggagcctagagcaagacatgagtattcaagtgagacactgtcacaaggtaatcacatcggca

SEQ ID NO: 24580 - DNA, 201 bp, Homo sapiens
ttgaactgatttgagtggattgcaagctcttaccaagaatggtcagtgtcagtcagtcatacatggagtcatggaagacctacattgcatacctctgacarataggaaggaatgggaagacagggaaaaggttcagaaagacagatatgtgcacatcttttgagggacttttgggatctagtttctagggtttcttctatg

SEQ ID NO: 24581 - DNA, 201 bp, Homo sapiens
tgcggggcttgctttggcccgtggtgtgttggcagtcagcatgagaccagcatggcctcttgcatctcagagatcttcctggagaagaatataccctgggmgctgctggtccaaggagaatgcagtggcacatggaactgacccggacccaccctgcagctcaggatctgtcccagctgaagccagcagagccacagccag

SEQ ID NO: 24582 - DNA, 201 bp, Homo sapiens
tttctaggtagtgaccagattgcctggaattagtacagtcgaagcggcacgtacaggacaagaattcaagatgcttgacagtggagcacaagggcattagyttgagggacagccagaataaatggaaacttcattatccatggattatgcacttggaacttaggtcctaggcaactctgatattagtaatttggccagcag

SEQ ID NO: 24583 - DNA, 201 bp, Homo sapiens
ttattaagctttcatgttatttaaattattcgataacagagctgggtatggtggctcatgcctgtaattccagctactccggaggctgagacaggaggatygcttgaggccaggagtggagaccagcctgtgcaacatagcaagacccccatctctaaaaataaaattcaaaataattattagaaaacattttcctggttg

SEQ ID NO: 24584 - DNA, 201 bp, Homo sapiens
ctttttcattccccaaaacagctttcttgaactatccaccaggctgcagggggtatcgtttacctggggactgtgtggtgtcccatctctagggaagaacmatgttgcctcctagtggctgtgtctgtcttggacaccggtatctgagaactgagaacaatatttgttccataaatgaggcatgaatattactctttaaag

SEQ ID NO: 24585 - DNA, 201 bp, Homo sapiens
aatttggggagtattgccatcttacccaattttaagtctttcaatttttgaacatggtttggctttctgtttacttaggtcttctttatttcagtgatgtkttgtagttttcagtgtacaagtcttacacttcttttgttaaaattattcctaagtattttattatttttgatactattggaaatggaattgttttcataa

SEQ ID NO: 24586 - DNA, 201 bp, Homo sapiens
aagtaatgccacaggcctgtaaagtgttagctacaggcagagcagagtgaaccccaggattttaaacttactcccaaggcctttccagagacctgagaacyggactctccttttgttgagtcattgtgatatcaagagacaggtgataaattgggtgaattcgctgttgcccaaatccaactgtgatttttgacagacaaa

SEQ ID NO: 24587 - DNA, 201 bp, Homo sapiens
tcatacatatggatctggaaatgaaacattgctccatgtcaacatgagttacagtgggagcctagagcaagacatgagtattcaagtgagacactgtcacmaggtaatcacatcggcatggcagtgcctctcagtgagacatggaagggggaaaggtgacctggactctggagggtggaaatgaaatttttctcttttgcc

SEQ ID NO: 24588 - DNA, 201 bp, Homo sapiens
gccccaaagctagggcttctttgagaagagagctcagaagaaccggagtggagtttggtcaaggagagaatctttgtcgtggacgggggaagaacagcctrcagggaagctggagtggtccgtggtggcctgcgtggactgggggcctgggaaaccatgggaaggatgttgcgctctctcccatgggccgtgggaagccac

SEQ ID NO: 24589 - DNA, 201 bp, Homo sapiens
gggcccagggagtgcagagatgtctgcatctgcagctgcaatttgggtggctgcagccatgcccagaagggtgggactcctgcctgctccatgcttctgcygacactgtagagtgtggcactgccctgggcccagctctgcctcagtgcccctctctgcctgcctctccatgaccgaccacactgcttccctaccagcgga

SEQ ID NO: 24590 - DNA, 201 bp, Homo sapiens
gcggagaaggatccttccaggcagagagaatggcaggtaagcagatcccaaggtgagaaacagcgtgatgcatttgaggaactggcagatccacgtggctkccctggggtggatgtcaaagaaaagccagagctagatggtaaagcactaaaaacaaactttatctagaaaaatggttgccatcagggaaaagagacctca

SEQ ID NO: 24591 - DNA, 201 bp, Homo sapiens
atttttcttctgaagggaaatattctctcaacttttctcctttttgatttgggtcccaaggggtatgaactcttggagagtgttatccctccctctctttstctctcagcccttgcatagatgcctattatcatcagttcaagccatggtatccagatattttgcttggatttaaaaccagaggcagaagctaatgaaggg

SEQ ID NO: 24592 - DNA, 201 bp, Homo sapiens
caagccatggtatccagatattttgcttggatttaaaaccagaggcagaagctaatgaagggctttcatgttcagaaacagagggttcctggcagcctcaytggcttctccatttaattccatggtgctaggggcactcccactgcttagcacagcctgggggactggcagatggcactatcggcccagaagggccagtct

SEQ ID NO: 24593 - DNA, 201 bp, Homo sapiens
gcccagcaaatttttaaattttttatagagacagtgtctcactgtgttgcccaggctggagtacggtagtgcaatcatagttcaccgtgaccttgaactcytggcctcaagcgatcctcccatctcagcctccaaaagtgctgagattacaggtgtgagcccccgcgtccagccctgtgctacatactttataacgaccat

SEQ ID NO: 24594 - DNA, 201 bp, Homo sapiens
ggaagaaggacacggcggagggggatgtgatggtggcactggcagcagcagctgcaaatatttaatgaccccttagactgtttgccaggcactgtgctacrtacttatttaattatgtgtttttatttgtcttaagagacagagtcttgctctgtcgcccaggctggagtgcaatggtgccgtcatagcacactgtgacct

SEQ ID NO: 24595 - DNA, 201 bp, Homo sapiens
cattcactatcatttttctccaacttgagaaaaagaaggaaattattgtaagtccccacttttcatttttcttcaacttgagaaaaagaaggaaattattrtaagtccccagtttaggctgtagatggaattcatgcatctcccttgtttttccaaggtcaccttcatactacagatagatgtcccaggggcacctaagtc

SEQ ID NO: 24596 - DNA, 201 bp, Homo sapiens
gttaaagaatttgctcctagggtcttaagagactcccgaatcttaggagcctcttagaggatggattgtttcttctgaaattgttgaaggctcagatcacraaagtcacctttatagaagatacttctatgggcttaaaaagaaatcaatgtctttgtgctatgttaatttgctttccacctctttctcctcctcatctac

SEQ ID NO: 24597 - DNA, 201 bp, Homo sapiens
ctgagttggtatatgctaggtggtgctttggtaacttacaggcccaagtctcagcagtttcaaacaatagaggtttgtttcccacttgctttgtaggtccrtgatggattagtagggcaggcgtctctcatcttagttacccagggagctaggccactcacatttcactggccaaagcccatcacctagccagatcagaac

SEQ ID NO: 24598 - DNA, 201 bp, Homo sapiens
attcaggcctactttccttttgtctggccaccaaaatagcttatctggccaccctgagtctctctccctctttctgctgtagctcatcctgcatacagtcrccagaacaattttacatcaacacggcttttatcacttcccacacctgctgaggagcccactgcggttagaagatcgaaacaccccagcctgttatttaaa

SEQ ID NO: 24599 - DNA, 201 bp, Homo sapiens
atattagaggccacagaggcaaagaaagctctagccagggagacaggaggtgacactttaaaaccctggtctgcctgtccttccctgaatgagagaaagtrtagtatagccttgcagataaaaacagaccctggagtcaccaactgcctgggttcccattcctcacactatcactttttaattctatgacctcgagcaagt

SEQ ID NO: 24600 - DNA, 201 bp, Homo sapiens
cactgtcgagttcattattccctcacatggattaattggcctctcgaggtgagattgccactggttctgaaggatgcctctctttaccacattattgctckcccttcactctgcttctgaaagtcacccttgaaaacacacattcttctctactggtgaagtctgatttatcagccaactcctcagagaagaaataacaag

SEQ ID NO: 24601 - DNA, 201 bp, Homo sapiens
gaaggactctttcctagggccttcagagggagcacgccctgctgacagcttgattgcagactttgggcctccagaatacatttctattgttttcatgccaygcagttcatggcactttgttacagcagccctgggaagctagcacggtatctaagacataggcctacaacagacctaagaacatcatcacaaagccagaat

SEQ ID NO: 24602 - DNA, 201 bp, Homo sapiens
aaaccaccagcagcgaggaagagacaaggaaggactctttcctagggccttcagagggagcacgccctgctgacagcttgattgcagactttgggcctccrgaatacatttctattgttttcatgccacgcagttcatggcactttgttacagcagccctgggaagctagcacggtatctaagacataggcctacaacaga

SEQ ID NO: 24603 - DNA, 201 bp, Homo sapiens
aaacagagattgagagctaaacacaattgatccaatggaggtaaagagtagaatcattaccagatgcatctacaagccaaggagcacccaagatagccagmaaccaccagcagcgaggaagagacaaggaaggactctttcctagggccttcagagggagcacgccctgctgacagcttgattgcagactttgggcctcca

SEQ ID NO: 24604 - DNA, 201 bp, Homo sapiens
taattttggaagcaaaattggtgtataagctgtatttagcctcgatgtgctaagcaactttgaaccaaatataaattcctggcgtggtatttttaagccayggtgggggcagggtgctggggaaaaagttgagttggaggagcatcaaagctatttttgtaagtttcatctacatttttagaaagatgcatttttgaagaa

SEQ ID NO: 24605 - DNA, 201 bp, Homo sapiens
tcgggactgaaaacgcgttagtgaccagctcaaagtcacacaatgacttagtgagaactcgaaatggaaacaggatcttttttttggcgtggggagggacrgagtttcgctcttgttgcccaggctggagtgcaatggcgcaatctgggctcactgcaacctccgcctcccaggttcaagtgattctcctgcctcaccctc

SEQ ID NO: 24606 - DNA, 201 bp, Homo sapiens
aataatgctgtctggttcttttcataggtatcgtttaccctttcatattggttttcagttttaaaaagtattttcacatagaagaaatcgggactgaaaaygcgttagtgaccagctcaaagtcacacaatgacttagtgagaactcgaaatggaaacaggatcttttttttggcgtggggagggacggagtttcgctctt

SEQ ID NO: 24607 - DNA, 201 bp, Homo sapiens
ttattttcccccattccatactgcctgtagcctcccatgcaaacccatttcagaacctgcagctgcagtcagtctggagtcaggtaacttaattaggaatytgtttcatgtcttatcattcagttcctattggttaattttcttggaacttatgtcagagggacatccatgtgcatcctaatgacagcctcatttgagaca

SEQ ID NO: 24608 - DNA, 201 bp, Homo sapiens
tgagtcaagaataggtcagccttacatgcttggagatgctctggaaaatgacatatctcttattgggctaagcaccatgctagggaaaagtaaatattccytctggcagccatgaaaagaacagtcagcagtgatgagcaggacaagggaaatgatttgttttgtcttggaaagctgtgtttgttacctctgaatatggca

SEQ ID NO: 24609 - DNA, 201 bp, Homo sapiens
gatgttgggaagaacctagtatggaaagaatagggggcaacctctcttcccctggaaggcttggcaacaggaatccagccgaagtgaatgtgctgtgggtktagagctgggcactgattggttcttctgtggcagccctgaaggctgagtcaagaataggtcagccttacatgcttggagatgctctggaaaatgacatat

SEQ ID NO: 24610 - DNA, 201 bp, Homo sapiens
tgaagggatagcgtgggagtgccctttgagaatggatgttgggaagaacctagtatggaaagaatagggggcaacctctcttcccctggaaggcttggcarcaggaatccagccgaagtgaatgtgctgtgggtgtagagctgggcactgattggttcttctgtggcagccctgaaggctgagtcaagaataggtcagcct

SEQ ID NO: 24611 - DNA, 201 bp, Homo sapiens
ttggagacactgtggaaccaggaagtcagtctgcacattgtgatctgcgcctgcgatgctcctccccacccttcacgtacagtgctgtttggagggctcartcctgctttctgctctcctcttgcctttggttctcctttggcaggatcccgcaggaagcgttagaaccccaccactgctcccgatgccttgcttctgtct

SEQ ID NO: 24612 - DNA, 201 bp, Homo sapiens
tgaaagcaacttcccgggttcaaattccagctctgccacttattgtcgactatgtgacttttaggcggatgactttctctttctgtcctcgttttctctgyctgtaaaataggaataatgatattgttgtgtagaatgaattaagacataaaaatgctttgtacagtgcctaatacgcagcaagcagtacatgtttcactg

SEQ ID NO: 24613 - DNA, 201 bp, Homo sapiens
gctacaagaagtattgatcacaaattaatttggcctcattccttctcctttttgtctctacccttatcagtctcacttcccctactaaaataggaaggctrttgaatacatggagaaaacttggagtttgtggaggctgaggctaccaagtatcatggaagcaatatactatatgccaggcactagcataggtagcatttg

SEQ ID NO: 24614 - DNA, 201 bp, Homo sapiens
gcctccgcctcattatttacatagactgtaaaataaagcttaactcaaaattaccgtaagtcagcgcatccgagtgaagccggcagctggaccttcacaaytgaaagcagactaaataaaagggggaggatgaaaaaagaagagctgcaaataagatgtcagggaatgcttaattatataaaggttatgcatttgcctgca

SEQ ID NO: 24615 - DNA, 201 bp, Homo sapiens
tgtttctgtcacacacagctattccttatcaccccacggtcacatccgcaaaaggacgccccagtccctcctcacctcaagcatcatccagcgaggctgtrtatggtgcttctgatggaagctgagcctgagtccctgatccctcacttccttggcatgagactgaagcctgagatacctttactttctctgtgccaggcc

SEQ ID NO: 24616 - DNA, 201 bp, Homo sapiens
gagacctggaaccaaaaccaccgcttccttctcaaattcctaaaccatagaaactgtgagagatgataaagatggtgttaaatttggggatgatttgttaygtagtagttgctgattggaacctcagtcaataaaaaggcatctccttgctgcatcgtcagtgtgctcgtcttgatagagaagctaatagtaggtacccat

SEQ ID NO: 24617 - DNA, 201 bp, Homo sapiens
tcccagctgcagatactgtctgactgcaatgacttgtgagacctggaaccaaaaccaccgcttccttctcaaattcctaaaccatagaaactgtgagagaygataaagatggtgttaaatttggggatgatttgttatgtagtagttgctgattggaacctcagtcaataaaaaggcatctccttgctgcatcgtcagtgt

SEQ ID NO: 24618 - DNA, 201 bp, Homo sapiens
agagatgcttgggccacccctggctgcttcagccactgctgtcccagctgcagatactgtctgactgcaatgacttgtgagacctggaaccaaaaccacckcttccttctcaaattcctaaaccatagaaactgtgagagatgataaagatggtgttaaatttggggatgatttgttatgtagtagttgctgattggaacc

SEQ ID NO: 24619 - DNA, 201 bp, Homo sapiens
gagagatgcttgggccacccctggctgcttcagccactgctgtcccagctgcagatactgtctgactgcaatgacttgtgagacctggaaccaaaaccacygcttccttctcaaattcctaaaccatagaaactgtgagagatgataaagatggtgttaaatttggggatgatttgttatgtagtagttgctgattggaac

SEQ ID NO: 24620 - DNA, 201 bp, Homo sapiens
attcatagtagagagtgctggtccacctagaggccagcccaagaggccagaggtggccatccccaaaagagagatggagagagtatttgctttttttcctyagatgttttcccaaatccccaggaagcccagtatctctgccttttcagtgaagcctctgtcttctagagtatgcctttcccttcatttgaactgatttga

SEQ ID NO: 24621 - DNA, 201 bp, Homo sapiens
gacctgtgaatttctaggggtgagaagagtttgggaagctcagtgaccatagaagggatatcctccccctcctgcttccaacaagtggcttgaaaaacttwcctgggttattcaatcaggtcagttatgtctttttttttggccccagtttgacttcctgatagctttgtggccagtgaaaggtggaaatgtgctctgtgt

SEQ ID NO: 24622 - DNA, 201 bp, Homo sapiens
gtctttctaacattcgttcatgcacacatcatttgcagagtgcctgcaattgcccggtctcacccaggtactggaagaaatacaaactattatagatcagmtcaaagttgctcacagtcctgcaagggagaaacataatagcctgcagataattaccctcaagtgtgataaatgctgtaatagaggaatgagcagcatgcc

SEQ ID NO: 24623 - DNA, 201 bp, Homo sapiens
tgctcttatcacaccccttttctagatgaagaaactgaggaacacatagtttgttcctggtctagtccgcacagggagcaggtggtggagccaggatgggractcggctcatcacactgacggacagactcatgtttttcatcaccccataagactcctgtctggtaacactgagctgggcccaggactttcaggcggtca

SEQ ID NO: 24624 - DNA, 201 bp, Homo sapiens
cggcctctgtattgacaagagcttcatctgcgatggacagaataactgtcaagacaacagtgatgaggaaagctgtgaaagttctcaaggtaggaacctcycaagctctaaaaagataattgcaacacaacactgcagtaatggaacaccctgaaaggcagaaagcaacacccattcccattccaaacacaatagctctgt

SEQ ID NO: 24625 - DNA, 201 bp, Homo sapiens
tcctgtagcaacatagcaatcttctgtgctgggcctggcgtctgttctggtgctgtacccaccacatgaatatgggtgccagctcagttcattccccgagstctgggatgacccctcttcatcattacagatgttgctccttgtgggagggccacactctgtaggaccgagattcacataatgaggggaatgagtgtaaca

SEQ ID NO: 24626 - DNA, 201 bp, Homo sapiens
atacgtctttgggatcttctcttttctccagaggcatccattgctctggacttggggttgtttattcccattaaggttttttttttctttctgtatatatytttttaatcctgctatgataagtagcattctcttgcatggggtaacttcatattaacgtaatatagtacagtacatagcctactactgacacaggatttt

SEQ ID NO: 24627 - DNA, 201 bp, Homo sapiens
aacatccagtttcaaaaatgtatcattgtgttgctgtatttgcttcagaattttaaaataataaaatattaccaaatataattagaaatctcagccatacstctttgggatcttctcttttctccagaggcatccattgctctggacttggggttgtttattcccattaaggttttttttttctttctgtatatatctttt

SEQ ID NO: 24628 - DNA, 201 bp, Homo sapiens
ccaacatccagtttcaaaaatgtatcattgtgttgctgtatttgcttcagaattttaaaataataaaatattaccaaatataattagaaatctcagccatrcgtctttgggatcttctcttttctccagaggcatccattgctctggacttggggttgtttattcccattaaggttttttttttctttctgtatatatctt

SEQ ID NO: 24629 - DNA, 201 bp, Homo sapiens
tgtggaccagggagagctttatgatgggagagtaaaagggaagggaagtgagtgctcactgaaacatttctgctagactagacgttcaaaaatgtttagcraagtttctcaaacatactgaaaaggaaaagtaaagtaaaatgaacacctgcattcccaacatccagtttcaaaaatgtatcattgtgttgctgtatttgc

SEQ ID NO: 24630 - DNA, 201 bp, Homo sapiens
gcaaaggatgggggagattacactgtgttttatgaggagtcattgacaaggtggaatgctaggtgtggttgtatacaaggatatagctatgtctcctgagyaactatgcccctgagtgtgaaagatactaaatattaagaggtgtttgtggaccagggagagctttatgatgggagagtaaaagggaagggaagtgagtgc

SEQ ID NO: 24631 - DNA, 201 bp, Homo sapiens
tgatggttgggaggcatttttctgtggcttgctgctacgtttgggctgtgttcctctaccatcctctgcttctgttttttctgccctgcaaaggatggggsagattacactgtgttttatgaggagtcattgacaaggtggaatgctaggtgtggttgtatacaaggatatagctatgtctcctgagcaactatgcccctg

SEQ ID NO: 24632 - DNA, 201 bp, Homo sapiens
gcctatggttcagtttttgaagttaactctgcagacaattttttccacccctagtgaaataaatattgtaaaatagaatgttcctctccccagttaactgrgtaacataatacatttctcagtgactggtaagccacaacgaggacaaagaaaacaaacatttggagcacgttaaatatggctaaaagatagtgaaacata

SEQ ID NO: 24633 - DNA, 201 bp, Homo sapiens
cacagcttctcccattatcaatatcctcggccagtgtgatacaatcgttacgatcaaacctgtgttaacacatcaagtccataatttacattagggttcastctggtgttgaacattctatggatcttgataagtatatcatgacacatagccaccattatagtatcatacggaatagtttcactgccctaaacattttct

SEQ ID NO: 24634 - DNA, 201 bp, Homo sapiens
actggtcactctggtcactgtttcttcttctttccccattcctcaaaatgtttagactacttgagccttcataattatcattggctctgaacaaacttacrcgtttattttctgtgcatatatatataaaagactttatgttttagaggggtttgaggttcacagcaaaactgagaggaaggtacagagattttccaaatc

SEQ ID NO: 24635 - DNA, 201 bp, Homo sapiens
cccagctcgcccatcaggttgcttcatacctgccactggtcactctggtcactgtttcttcttctttccccattcctcaaaatgtttagactacttgagcmttcataattatcattggctctgaacaaacttacgcgtttattttctgtgcatatatatataaaagactttatgttttagaggggtttgaggttcacagca

SEQ ID NO: 24636 - DNA, 201 bp, Homo sapiens
cacacttcctagtatggtgaatacttactgaatgttgattacagttcctttgacattcagggaatgaattttgattggtgcttcagcaccttcatctactmgtcatccatttacttacctgttcttcgttcatggctttgttcagcacattttgattggcacctgctgtggtgcaggggctatgttatcctcttgggtact

SEQ ID NO: 24637 - DNA, 201 bp, Homo sapiens
tctttgtatgttcctccatggtttgactttttcacagtgagctatgtcttgtgtttataaaagcaagggtggtgatattgtggaacagctcctcattcgtygggctctctcagccacatactggcaggatcctggggcaggagtgggaggtgagcaggggttgaaggtgagtagctgttgctcatttggccaaccacagag

SEQ ID NO: 24638 - DNA, 201 bp, Homo sapiens
tcctggggcaatccatttgcacacactagtttttgagaccatgctgtaagagcatgtttaccaaaatgtccacagaatacttccccacgtggtggcaattwgttataaattttacatctgtctttgtatgttcctccatggtttgactttttcacagtgagctatgtcttgtgtttataaaagcaagggtggtgatattgt

SEQ ID NO: 24639 - DNA, 201 bp, Homo sapiens
tttttatgagaaatagggcttttttttttttaattaatgaaaagatgccaggtacttttgcgtatatgagaagcttgttcatactggcctcctttcagttsctcctttaccacattgttctgcctccaggcctttacacaggcggcttggaacatctttgattccacaattccacaaacactaaaatttcaaatgtggcct

SEQ ID NO: 24640 - DNA, 201 bp, Homo sapiens
attactgaatctctaccagatagcaagcattttgctgtattctctacatgcaaaatctcattttattttcacaacagcttgggagttctataccatctttrtcttccttttacagatggggacgctgaggctgagggaagttaagtgattcatccaagatctcagtgattacgtggtggaactgaggtggaaacctggatg

SEQ ID NO: 24641 - DNA, 201 bp, Homo sapiens
gtatctgaatggaagtcttcagttcccgtgggtgttacagtggcttatcttcacattgtaggcctttatatctgccctttgcaggtgttttgagacaaaamctgagttttagggttctgctgtttatgtggatcatgtggggagggccaagaaaacctttcagagatgcctctagagagctcatcagaaatgagcttcctc

SEQ ID NO: 24642 - DNA, 201 bp, Homo sapiens
ttggtaatcattcctgcctcacagttttttggtggagcctaagtggggtaaagtccacgaaagcccagaacacacaataaacatttagtaagagtgtcttyttcctcttcctcatttacggtaaagatgaggaaatctttttttttcccctgagacagagtctcgctctgttgcccaggctgtgatgcagtggtgcaatct

SEQ ID NO: 24643 - DNA, 201 bp, Homo sapiens
gatggagttttataaaggtaaccaagtaaaaatgaagttgttaggtgggtcctaatccaatacgactggagtccttatgaaaaggggaaatttggaagcasaaatatgtacagagggaagatgatgtgaagacttggagcaagaagacagctgtctacactccaaggagagggcctggaacagatccttccatcacagccc

SEQ ID NO: 24644 - DNA, 201 bp, Homo sapiens
cgccacctgtccaagaaataaacataaggatgtatacaaagtgcttggtacagtgcctggtagacatcagccttggctgccactagcagcagcaacactaytgttctaacaatcagaagtgactggtgcacatctgcttggaatcctcttcccgtgaccccagaagaagagacttatgttcatggttaaggataattttta

SEQ ID NO: 24645 - DNA, 201 bp, Homo sapiens
aggtgtatttctcttcctcttcagtttgtctctgcagagtgagcttggccatggtgccctgtgtggttgtcctcctgggtgccctggtaggtaggaagcakgactgacaagtggtgggcacagggttgtctcacaggggattgccttgagaccacatgactggacgatggttcctggctctttcatgtgctttgggcacca

SEQ ID NO: 24646 - DNA, 201 bp, Homo sapiens
gcttttgatggtttcagctcccagcttcactcatgactggctgtgttgtacggctgggtaagtctcgccacctgtccaagaaataaacataaggatgtatrcaaagtgcttggtacagtgcctggtagacatcagccttggctgccactagcagcagcaacactactgttctaacaatcagaagtgactggtgcacatctg

SEQ ID NO: 24647 - DNA, 201 bp, Homo sapiens
tctgggctacgtcttcctgcacagagtctttgctgacactgttctctagacctgaagggtgcttactttttatctctgtgtgtctatcaacatccactgtrgatgctaccctctttctcggaatcttttttgatttatttgaattttgactttatcttaaggacaccagggagccattcaatgaccttttaaagttaagaa

SEQ ID NO: 24648 - DNA, 201 bp, Homo sapiens
tatttgcatgctgtcataaaatgtgtgaaaaattcagaagcttctactgaattttagtatttttttttttctttaagaggttttcttgtgtgagtgatacrcagtgagaattctaatgtttccaggtctgtgactactttgctccaataccaagatggacagaacagccctttgattacccagggagactgtcaagtttgc

SEQ ID NO: 24649 - DNA, 201 bp, Homo sapiens; identical to SEQ ID NO: 7988

SEQ ID NO: 24650 - DNA, 201 bp, Homo sapiens; identical to SEQ ID NO: 7989

SEQ ID NO: 24651 - DNA, 201 bp, Homo sapiens; identical to SEQ ID NO: 7990

SEQ ID NO: 24652 - DNA, 201 bp, Homo sapiens; identical to SEQ ID NO: 7991

SEQ ID NO: 24653 - DNA, 201 bp, Homo sapiens; identical to SEQ ID NO: 7992

SEQ ID NO: 24654 - DNA, 201 bp, Homo sapiens
agtcctgttattattgcttcttttacccctggggccccaaactgcagaaggcttattcactgcaagactctaaatgtcttacctccatatattacattccrtattatgccggaacatggtgaaattaattgcggccagccagggaagacagaaaaaaacctataatggtttatcatattttttaggctttgtgagggccat

SEQ ID NO: 24655 - DNA, 201 bp, Homo sapiens
tgcataaagggccattgggattgcaactggacagtggctgattatctctaggaagaggctgaattctgaaaacattttgtatatgcaatgccccggattgrttaaaggagagataatttatttcgttttatttttgtgtctctttgatatagaagaaaagaaatgtgaacagaacttgtacaatatatggtaaattctctc

SEQ ID NO: 24656 - DNA, 201 bp, Homo sapiens
gagttaactggaggttaggactccggcatactgtttttgggggacacatttcaacccataactaatatgtgctaatttgcacaaagtagcctactcatgamgccatggacttactgtgcatgcccagaaggtgtgccttttaaaaatccactcaagggcatgtctgggtagctgccacttgccccacagtctgtcatcccc

SEQ ID NO: 24657 - DNA, 201 bp, Homo sapiens
ccaagtgcttcaggtcaggggaggaaagaggagttattttagcttaaattatgcttatcctctgaggggcacagctattactatatggtttccctgaactkgggctcattttggattttgctgaatggtttacacatttttcccttattagtgaataccagaatctcagatttgcaaaggattctttaataaggctgttcg

SEQ ID NO: 24658 - DNA, 201 bp, Homo sapiens
gtgatgcaaggtaagccagcttatttaaaataaccaggatgtctaattcacatttttaggaggaagggaagtaacactgaaggctgtttcccattgcatcraaggcaaaatccaaactgtagtcgtttgtgaatggaatccctgcctgtctccagcctcacactcactcgaggtgtgcctgcctgcagtgctgcactgctc

SEQ ID NO: 24659 - DNA, 201 bp, Homo sapiens
ttttttcagagacccactgataaaatatttacttcagtgacatggtaccaagtcctgctttgtttattttaaaagtcttaatacagcattagccatgaggrtaccggcttatttgcttttggtttcttgcttgtggtttttgtttttatgaggagcaaagaagctaggcctgatcttctgggaaagtagcctgctgtatgt

SEQ ID NO: 24660 - DNA, 201 bp, Homo sapiens
ccactctgcagaagcttatgacttaatgagctcagtcaaagtcaatctgaagttgcaggcagcagctttgatcattgtgataggcgttttggtttccaccragcagagaatgggaaaaagctttgcccatgatttattaatcacttccttggctgagctttcttgcctggctctcctgggaagcaccagtgttgaggttgc

SEQ ID NO: 24661 - DNA, 201 bp, Homo sapiens
ggcatgtgttatgcctattgagtggctttcagagcctgctggaggtaggtaattcagggtggcatggtgctagctccatgctatcagggacccagctcccyctcttacttggtattcctgtgctaagtacctcatggcccaagatgactgcttgaataccagccatgtcatctgaattccagttggaggaaggcagaaggc

SEQ ID NO: 24662 - DNA, 201 bp, Homo sapiens
tcaataatatatattctcacaattgtgaaactacatcagaaaaacccaaattgagggacattctacaaaataacttctcgatcctcttcacagtattaaaktcatgaagaacaaggaaagactgagaaactgtcaccgattagaggagatcaatgccatgtgggatcctggcaaaatttgaatcaattctattaacttagt

SEQ ID NO: 24663 - DNA, 201 bp, Homo sapiens
gatcagtattttgttgttaaagttagctcatagctaccaagagatgatagccatgggattttctgattcctgtgactgatgtagaaggcattatagaaatktcaggatgccttggtgaaacctttcctagagcaagacttgtggtgcactaacgtactattttccctaaagagttgttttcaagttacatcatgacacaga

SEQ ID NO: 24664 - DNA, 201 bp, Homo sapiens
caagggccttctgaaggagttgagcctcagaaaacataactggcactctgaagggtctagagaatatcgtggtttaaagctctgtccattaaacacttcaraatgaaaagacatgctctttcacagcgcttacggtgtgcgggaaatccaagacctatgtatattagcgttgcttcttttctcattgagtcattctgtttg

SEQ ID NO: 24665 - DNA, 201 bp, Homo sapiens
ctgcttttgaccattgcctctcttcttacatcagcttttcgatagctacaattgtaggagtcacattgcatgcagagcagttcataaattgaatggttgtktgtgtgtgtgtgtgtgtgtgtgtgtgtgtgtgttagcaggggaggctcagagttttggcctctggctgtatggctgtatgcttgtgagtatcctttgtct

SEQ ID NO: 24666 - DNA, 201 bp, Homo sapiens
ctcatctgaagaaatatcttcacagctgcatctggactggtggtggactaaaagctgattaccatagcctagctaagttgacacataaaattaaccatcaygatgaggtcatactggattagggtgggccctaaatccaatatgtctcatgtccctgtaagaagaaggaattttggacacagactcacaggaccacgtgaa

SEQ ID NO: 24667 - DNA, 201 bp, Homo sapiens
taaatgagataatgtgtgtcgtgcctagcacagtgcctggcacatgatgcgggaatagatcagttagtttttattgatagtctcttttatcttttgtgcartaaagtagtttgaccaaatcaaagagtcccaaagtaaggtcttgacaaacatattggtggaggtggctctcagactattttcagtattaattagaagtgc

SEQ ID NO: 24668 - DNA, 201 bp, Homo sapiens
gtctcctctctctctctgtttctgtctctgtctctcacactttctctctctcactgtttctctctctgttcaatacacatatgcacatccttatctcacarttgacccaaagcatcagaaataaaaagtcagactgagtgaccttagctgctaggaagcatcttattgtgccttccctccctctctgactttggccttgac

SEQ ID NO: 24669 - DNA, 201 bp, Homo sapiens
ttcctttttcttcctggtttaatctaggagggttgtatatttccaaaaatttatccatctcctctagcttttctactttgtgtgtgtaagggtattcatartagccttgaatggtcttttgtatttctgtggtatcacctataatatctcccatttcattcttttttattattattatgctttaagttctagggtacatgt

SEQ ID NO: 24670 - DNA, 201 bp, Homo sapiens
aaatattttagtaaccgttgagtgcctactgtttatatttcttttctaggctgactggcttgcttcctccctccctccctccctccctccctccctccctyccttccttccttccttccttcctctattccatcctctcctctcctccctcctctcccatcctagacagcttaggtgaagggctgacagagggaaattgac

SEQ ID NO: 24671 - DNA, 201 bp, Homo sapiens
ctcttagaggatggattgtttcttctgaaattgttgaaggctcagatcacgaaagtcacctttatagaagatacttctatgggcttaaaaagaaatcaatktctttgtgctatgttaatttgctttccacctctttctcctcctcatctactcaatacaagttgattcattcatctcctctgtggtacgatcgaagacatc

SEQ ID NO: 24672 - DNA, 201 bp, Homo sapiens
ccacactcactgatctgaggcatcaggtggccgggaggttcataactcaactgttgcgtattgatggcagagttgtttttacatatatatatatatatatrtatatgacatgtaggcaattaaacttagaatgggaactgaaagatgaagaattaattccctgtttgtttgtaatactgtgtgtaggcaaacaattaatca

SEQ ID NO: 24673 - DNA, 201 bp, Homo sapiens
aggctagagtacagtagtgcgatcttggctcacttcaacctctgcctcctgggttcaagcaattctcctgcctcagcctcacgagtagctggattacaggygcccccgccaccaagcccgggtaatttctgtatttttagtagagacgggttttcaccatgttggccaggctggtctcaaactcttgacctcgtgatacac

SEQ ID NO: 24674 - DNA, 201 bp, Homo sapiens
tctttgcctttgactggactcactccaacttcatagcaacacccattatctcatggaggtcagaggcttggtttggcagtgacatttgtttatgattagtwaaaaatgggaatcatattaattagtatttaatagctgcattttggtgacagattttgctaccaagctgcccttacacatcttacttggaaaatgcctctg

SEQ ID NO: 24675 - DNA, 201 bp, Homo sapiens
ggtattgaactccatccaggttgttgcatatgccattattttgttcctttttatggctgaacaatattccatggtgtgtatgtgtgtgtatatatatatayacatatatatacacatatatgtacatatatacacacatatatatacatatatacgtatatatgtatatatgtatatatgtatgtatatacgtatatatac

SEQ ID NO: 24676 - DNA, 201 bp, Homo sapiens
gttctcaatccctcagtctcatcctgcagaagcccttgcctccaactctatggagaagaattaaggcctcccagtgagagtttcttcaacctcctctccascccaggatttcagtttcccactgttcccctccccgccgccagcccaactgctgagggttctctcctggaacctgccacacttctttgacctccatggttc

SEQ ID NO: 24677 - DNA, 201 bp, Homo sapiens
ttgagaaatttgcttaggctaaattctcagaattaaaattactgggttggagggaaggcgccttttctggctcttgacaccgactgccgacttgttttgcyaaaggtttgcaccagtttgttggcaacatgtgaaaactatgactttattttagtcttggcagccctgggtaacatctttaaaaaatatttttctggttaa

SEQ ID NO: 24678 - DNA, 201 bp, Homo sapiens
ccactttgttctcaatccctcagtctcatcctgcagaagcccttgcctccaactctatggagaagaattaaggcctcccagtgagagtttcttcaacctcytctccaccccaggatttcagtttcccactgttcccctccccgccgccagcccaactgctgagggttctctcctggaacctgccacacttctttgacctcc

SEQ ID NO: 24679 - DNA, 201 bp, Homo sapiens
tatatgcaaagactctttttccaattgaggtcacattcagaggtattggaggttaggctttgaacatatctttttgggagactcagtgctaacctcagtarcatggcaaagtcctaacacagtatccacacataggtggccttcagtaaataatagtttccattgttctgctgttgtagagtgtttggcagtgcctatatg

SEQ ID NO: 24680 - DNA, 201 bp, Homo sapiens
ttaatagaataggatgtagatagaatgatattaatttattttaaggaattggttcatgcagttgttcggggctagctagtccaaaatctgcagggcaggtyagcaagctggagaccaagagaagagtagatgttgcagtcttgagtcagaagggagtctggaagcagaattccttcttttcccgggaacctcagtcttttc

SEQ ID NO: 24681 - DNA, 201 bp, Homo sapiens
tttacattcccatcaactgtgtataagcgttccgtttgctccacagcctcaccagcatctgttgttttttgactttttaataatagtcattctgacgggtrtgagatagtatctcattatggttttgatttgcatttctctaatgacatttttaaaaatatgtttcttggccacttgtatgccttcttttttgttcgtttg

SEQ ID NO: 24682 - DNA, 201 bp, Homo sapiens
aaggcggttcattttcttctttggaaagttacactgattgatgtctttgactttccatgtacagacctggccctttatgtttggtgggtgtgtttggttgrggggggtgtggaggagggataaatttgaggactttgttaaatgataaaatattaatgaatctccaaatccagagatagaaaagtaggtgcaaaaatggga

SEQ ID NO: 24683 - DNA, 201 bp, Homo sapiens
attgagcagtagagcgattacatggagcttgcctgttggcccagaaaataagtctccataaccttcctccatcagagacccccagtgggggctttcagtcyttttctctaggtatctgttaccctgctgaaatggaatcttactgctatcatgacatattatcatgtcaaacctgctttttaaaaagattctaaaaacgtc

SEQ ID NO: 24684 - DNA, 201 bp, Homo sapiens
attagaggcccttggccacattctatattgaggattcacagttgttttgggaggctgcctaatgctctgtcaagtagtgacactgtaacttaaccatcccyctatgtttcagtctcttctgtttcagtctcttctgcacttttacttctgctggtcaaaatgtttaggatcatttaaagaacttatgcataaccagacgac

SEQ ID NO: 24685 - DNA, 201 bp, Homo sapiens
tagaaagtttagacagtagagggaaggagaaaaagtcccttttctaaaacaaattctactttcatttaaaatttctttcttttttttttttttttttagayggagtcttgcctctgtcacccaggctggaatgcagtggcgtgatctcggctcactgtaagctccgcctcccgggttcacgccattctctcgcctcagtct

SEQ ID NO: 24686 - DNA, 201 bp, Homo sapiens
tattagtgcattctatggcattctgtgtcctgtcactccagtctcatgattttagaattcatgctcaaactggaagacatggtggagagcaaatgtttttwaaaaagatgttgccggcagctgcctggagctgcttggtttggtttggaacaggctcattcttggctattctccattatttttttcccctgacttcctacc

SEQ ID NO: 24687 - DNA, 201 bp, Homo sapiens
tcatctgtctggttttgaggatttattaaacactgtacaagtgtgccaagttaccatttttgagatatggtgtatatttcaacttcggcacatacggattrtcgttagctgacctgggaatgtttggcacatgatcagtttctgaaagaacgcaggattaaggagttgattcctaaattgtatgcccagctttgtcaatag

SEQ ID NO: 24688 - DNA, 201 bp, Homo sapiens
ggtctcaaactactgacctcatgatccgcccacctcagcctcccaaagtgctgggattacaggcatgagccactgtgcccagtcagtcatttgaatttttwacatatttctgaccagaatttggggccgagtctgttgacgcatgggaacgggcactggctttggagttcacacacctctggagcaagctgccccctctga

SEQ ID NO: 24689 - DNA, 201 bp, Homo sapiens
tgaaggtcagagaggttgagtcatctaccagaagtctcacctataccaaaccacacacctttcagttgaggggcgctgaggtccctgctgttgctgtgccrtctgacctgtcccctctctctgacagagagccagctgctccccgggaacaacttcaccaatgagtgcaacataccaggcaacttcatgtgcagcaatgga

SEQ ID NO: 24690 - DNA, 201 bp, Homo sapiens
cgatcagatcctggctcccttgaaaatctccccccagggtccactggtagatgaactcagcaccctgcccacctccaccgccacagcactggtgttctctmtttgctttctagcctgagggttggctgttcgggttgggggctttggcactttatgaccatgttcagtggagttgaatctgaacttgcagcttggttctca

SEQ ID NO: 24691 - DNA, 201 bp, Homo sapiens
ctcagccattgatcacaatggatcagactggtcagatcgatcagatcctggctcccttgaaaatctccccccagggtccactggtagatgaactcagcacyctgcccacctccaccgccacagcactggtgttctctctttgctttctagcctgagggttggctgttcgggttgggggctttggcactttatgaccatgtt

SEQ ID NO: 24692 - DNA, 201 bp, Homo sapiens
ttactcacatggctccttatctctcagccattgatcacaatggatcagactggtcagatcgatcagatcctggctcccttgaaaatctccccccagggtcyactggtagatgaactcagcaccctgcccacctccaccgccacagcactggtgttctctctttgctttctagcctgagggttggctgttcgggttgggggc

SEQ ID NO: 24693 - DNA, 201 bp, Homo sapiens
aattccatgttgttccatgctctgggctacgtcttcctgcacagagtctttgctgacactgttctctagacctgaagggtgcttactttttatctctgtgygtctatcaacatccactgtagatgctaccctctttctcggaatcttttttgatttatttgaattttgactttatcttaaggacaccagggagccattcaa

SEQ ID NO: 24694 - DNA, 201 bp, Homo sapiens
gactttgcactacaataggagaaattgcagcagaataggagaaatagtagcataatacctttgcatttcctaacaatcagagctgcatgatttttgaattmcatgttgttccatgctctgggctacgtcttcctgcacagagtctttgctgacactgttctctagacctgaagggtgcttactttttatctctgtgtgtct

SEQ ID NO: 24695 - DNA, 201 bp, Homo sapiens
gtactttggaatctaatctggccaattttcccgctccaaaaatctgtttatcagaacaagatttcacagttgcagtgacgtttccaggggggcttgccttsgaggagctaactctacaaatgcaagtgtaagtatttccaaacaaagcagaatgacccttacattccaggcccctgaagagttctctgctacagagcagtt

SEQ ID NO: 24696 - DNA, 201 bp, Homo sapiens
ccatccatttgtcaagtccatgtgccgccagccttattgactctcagagcaagtactttggaatctaatctggccaattttcccgctccaaaaatctgttkatcagaacaagatttcacagttgcagtgacgtttccaggggggcttgccttggaggagctaactctacaaatgcaagtgtaagtatttccaaacaaagca

SEQ ID NO: 24697 - DNA, 201 bp, Homo sapiens
ccccatggctggcaggaccacctgtgtgtaacagacatggtatttagtctctgcatccacccatccatttgtcaagtccatgtgccgccagccttattgaytctcagagcaagtactttggaatctaatctggccaattttcccgctccaaaaatctgtttatcagaacaagatttcacagttgcagtgacgtttccaggg

SEQ ID NO: 24698 - DNA, 201 bp, Homo sapiens
actcccaagtagctgggattacaggtgtgcaccaccacacccggctaattttgtatttttagtagagaaggggtttcaccatgttggtaggctggtctcaractcctgacctcaagtgatccacccgcctcggcctcccaaagtgctgtgattacaggtgtgagctaccgttaccggccctcctcatgctttgagtttgat

SEQ ID NO: 24699 - DNA, 201 bp, Homo sapiens
ctggctccatccatcagttgttcctgctgcagaattgcacaccatcttcttttagggtcataggcagtgtaaatatgaaatctgtggatatcaatagccartggtcctgggctgaacccaggggtcatgttataccttctcaccaatttccctgggctgtcttccttgaacagatgggtaaatggaggctggggctactgg

SEQ ID NO: 24700 - DNA, 201 bp, Homo sapiens
gactcatgctgctttacccttgtaggagaaacaaccatatagctatacaaagtgcagacacctcatggcacagtaggcagctaggcccactcactatcccrgtgactggctccatccatcagttgttcctgctgcagaattgcacaccatcttcttttagggtcataggcagtgtaaatatgaaatctgtggatatcaata

SEQ ID NO: 24701 - DNA, 201 bp, Homo sapiens
catgggtgtgagtgaaaagcaagcgcttgcaaaagttcttccagaagctcttgacttcagtgcctttactcctgggagcccagaagtgttcttcaccccartctcatttatccattgcatattgcgtggcagattataaatggggtcaactcctgtttagataaattcacagaatttaagaatgtcagaactggaaaggtt

SEQ ID NO: 24702 - DNA, 201 bp, Homo sapiens
ttgctctctgggttttagtctctctctattaaacaagaggaactatcttcagtacctgcctttcaaggatattttcagtccctcagaggaggagctctatgtcaatcccacttattatttttaaatgctgaagactctatctaggacaggcagatgatgtgtgtttgcctgctatggggacgattacgagtccacagaaac

SEQ ID NO: 24703 - DNA, 201 bp, Homo sapiens
tttaaacttgcttcgttttctggaaggtcataagctaccttttcataggctaccctttgcaatctggaaaccccaaacaggttcgtctacacagtttcagmcctttaaaacagatttaccaaacctgatagtctcttgcaaaggtaaattgcttgctcaggaggtctgaaagctgcgatcattcagacatgcatactaaag

SEQ ID NO: 24704 - DNA, 201 bp, Homo sapiens
ttgtcttatgaaatgacgtgttatgtacctacattacatctagtctttatatcatagtaattctttaatcgtgaattataacacctttaagaaatgagccytagttaatcttatggccactatttgcatgctgtcataaaatgtgtgaaaaattcagaagcttctactgaattttagtatttttttttttctttaagaggt

SEQ ID NO: 24705 - DNA, 201 bp, Homo sapiens
gttcatgagttgtcgggggaagaaaggcacccaacagaaatttgtggagcattatggtaaatgaagagatagaggtttgcataagttatgttgagaggtcygagtgggggcttgtacattgtcttgggggactagggagaaaacccctggagaggtgggctggccaggatacccagggcacctctgctgacccagggacct

SEQ ID NO: 24706 - DNA, 201 bp, Homo sapiens; identical to SEQ ID NO: 7993

SEQ ID NO: 24707 - DNA, 201 bp, Homo sapiens; identical to SEQ ID NO: 7994

SEQ ID NO: 24708 - DNA, 201 bp, Homo sapiens; identical to SEQ ID NO: 7995

SEQ ID NO: 24709 - DNA, 201 bp, Homo sapiens; identical to SEQ ID NO: 7996

SEQ ID NO: 24710 - DNA, 201 bp, Homo sapiens; identical to SEQ ID NO: 7997

SEQ ID NO: 24711 - DNA, 201 bp, Homo sapiens; identical to SEQ ID NO: 7998

SEQ ID NO: 24712 - DNA, 201 bp, Homo sapiens; identical to SEQ ID NO: 7999

SEQ ID NO: 24713 - DNA, 201 bp, Homo sapiens; identical to SEQ ID NO: 8000

SEQ ID NO: 24714 - DNA, 201 bp, Homo sapiens; identical to SEQ ID NO: 8001

SEQ ID NO: 24715 - DNA, 201 bp, Homo sapiens; identical to SEQ ID NO: 8002

SEQ ID NO: 24716 - DNA, 201 bp, Homo sapiens; identical to SEQ ID NO: 8003

SEQ ID NO: 24717 - DNA, 201 bp, Homo sapiens; identical to SEQ ID NO: 8004

SEQ ID NO: 24718 - DNA, 201 bp, Homo sapiens; identical to SEQ ID NO: 8005

SEQ ID NO: 24719 - DNA, 201 bp, Homo sapiens; identical to SEQ ID NO: 8006

SEQ ID NO: 24720 - DNA, 201 bp, Homo sapiens; identical to SEQ ID NO: 8007

SEQ ID NO: 24721 - DNA, 201 bp, Homo sapiens; identical to SEQ ID NO: 8008

SEQ ID NO: 24722 - DNA, 201 bp, Homo sapiens
catgcacgttactgagaggagtcctgggcaatgtaagcattgcctctgaattctgcacttcactcttctctgggatctggctctgggcctccctgcttccytgtgctttcttttgccctacattctgagtctcttcttccaaacaggaaaagcttaatttctcagttttaatgttttaatttaatttatgtttaatgcctc

SEQ ID NO: 24723 - DNA, 201 bp, Homo sapiens
tgttgctaacctgtgaaccctttttcacggaccagggtgttcttgtaacacacatttgggaactgctggtagagactattctgttcagaggcttgactggragagaggaggctccaaggctgtggctgggggccatgggagggtgtaggtaatttgttttcaggtatgtgggtatttagggtttcaggaagagttttctaa

SEQ ID NO: 24724 - DNA, 201 bp, Homo sapiens
tgaaggatggtcctgtaagtggaataagtttaattctaagaagagcttgctgcaattgtgccttcattttctacttttgttgctaacctgtgaaccctttktcacggaccagggtgttcttgtaacacacatttgggaactgctggtagagactattctgttcagaggcttgactggaagagaggaggctccaaggctgtg

SEQ ID NO: 24725 - DNA, 201 bp, Homo sapiens
aacaaaagcttgggctcttgatgttgagtcacccgcttttatttgatcagatgagaataatgaaaaccaaatcactctctaattatccaatcattattttmtaaaataaattatgttttaatacaaaaatgttgtaatggctcatcagaatgaaggatggtcctgtaagtggaataagtttaattctaagaagagcttgct

SEQ ID NO: 24726 - DNA, 201 bp, Homo sapiens
aagattatgaaatagaaatgccctttctctaagcatatttaggggaggacacactgactgttccctttcctgtttaaatatgttatatttgtttgcgagayggaagaggaaagtagaatgaaaagaaattaaaatctctgtagacttgagctatttgcatacataggacaccatgaaaaggacatttagtggattcagaac

SEQ ID NO: 24727 - DNA, 201 bp, Homo sapiens
ttcataatcacatcatggagaatggggtatccattccctcaagcatttatcctttgtgttacaaacgatccaattatactcttttagttattttaaaatgyacaatgaggatattttaagccagggatgactgtgatcctgtttgtggtcttaaaaccgagatgaggactcttgatcctcctgaaaatttcagtcctgaaa

SEQ ID NO: 24728 - DNA, 201 bp, Homo sapiens
ccgagactagggttgagggctgggagtgtcatttatctcaaacccccagtgcctagcttgttgaataaatgaatgagtttctacttagtgacttctcagtygtgctttggtttgtacagcaggctatgtaaagcttttgcattttactctaacaacaatgagaatattaaaatttttttaaaatttaaaatttttgtgtgt

SEQ ID NO: 24729 - DNA, 201 bp, Homo sapiens
caaatggcctacgcttctgcagctggcttttttcatttacctttataattttgagttccatcccatttataattttgagttctatccacattgccacatayagatacagtttattttagctgcggtagaatatcctattatatgaatatactacactttgctcattcatctcttaaaaggatatttagattattactatga

SEQ ID NO: 24730 - DNA, 201 bp, Homo sapiens
cctcttaaaagaaaaatgtggctaggtgtggtggctcatacctataatcttagcactttgggaggctgaggctggtggatcacttgaggccaggagttcgmgaccagcctggctcacatggtgaaaccccatctctactaaaaatatacagaaaaaaaattagccgggcatggtagggtacacctgtggtccctgtagcta

SEQ ID NO: 24731 - DNA, 201 bp, Homo sapiens
ctatacttgaatgtttattaagcctagatgattataagattaacttgggtgctttaaaatatatttttaattactttaaattattgaatcttccgaatagygtaaaagatctgagaacagtataacaaacagtagtgtacctatcatatagatttatcagatttttaatatatgtcattataattcaggctttcctcttaa

SEQ ID NO: 24732 - DNA, 201 bp, Homo sapiens
ttcttcagtccaccttttcccatcaattaactaccccctacattttacagcagtgatattcaagggttggggaagaggaagccactcttcctctccctcaytgagatcgatgggagagtgttacctagggggtggaaaaaagactgaaaaccatactacatgagtacaaggtgacaaccaccccagaccttgattcacgtg

SEQ ID NO: 24733 - DNA, 201 bp, Homo sapiens
attttcctctgttcagtccaatctggccgtagtagtccccactcactaaaagctagagatctgatgtcagtcacctcgaagaattgacctttggtgtaggycaattcttgagggccctccttttcctgtaggctctctcaggactcctgggtgcctggtctgatcattggtgttactattgcattttgttccaaagcctgt

SEQ ID NO: 24734 - DNA, 201 bp, Homo sapiens
agcaagactgcctcaattaaaaaaaaaaaaaagaaaaaagaattggcctttacaaccttgcctgtttctgtgggcaagggaaagagagggaacccactatyagtgaagcatctcctgtgtgtgagatgctttgctcattactttaagcacatgatcccattgaaacttgccaaggatatcatgtggcaggaaatcattgta

SEQ ID NO: 24735 - DNA, 201 bp, Homo sapiens
gggagaatcacttgaacctgggaagcggaggttgcaataagccaagatcgcgccgctgcactccagagcaagactgcctcaattaaaaaaaaaaaaaagaraaaagaattggcctttacaaccttgcctgtttctgtgggcaagggaaagagagggaacccactatcagtgaagcatctcctgtgtgtgagatgctttgct

SEQ ID NO: 24736 - DNA, 201 bp, Homo sapiens
cttaagccggagtaatggctcacgcctgtaatcccagcactttgggaggccaagatgtgtggatcgcttgaggtcaggagtttgagaccagcctggccaayatggtgaaaccgtcgtctctactaaaaatacaaaaattagccaggtgtggtgacgtgcgcctgtaatcccagctactccggaggccaaggtgggagaatc

SEQ ID NO: 24737 - DNA, 201 bp, Homo sapiens
tttagacacctttcagccagtctgcaggataagttgaaagtggacttgtattgtcacctttgtaaagcagtttagagaatttggagtttaggaacacttayaatcaagtaatttcatgttaaagaattggccttaagccggagtaatggctcacgcctgtaatcccagcactttgggaggccaagatgtgtggatcgcttg

SEQ ID NO: 24738 - DNA, 201 bp, Homo sapiens
gggtttcaccatgttggtcaggctggtctcgaactactgacctcgtgatccacctgcctcggcctcccaaagtgctgggattacaggtgtgaaccaccatscctggccaaactgtactatttttgcaactcttgtgtatgtctaaacttatctccaaataaaaaattaaattttaaaaaaggagaacctagcatatagaaa

SEQ ID NO: 24739 - DNA, 201 bp, Homo sapiens
ttagcagttgttctgtggttaggaaagggatcatcactaggggaacctagatgaaggatttgcagaaactgtacttttttttttttttttttttttttgaractgagtctcgctctgtcacccaggctggagtgcaatggtgtgatctcggctcactgcaaccttcgcctcccgggttcaagcaattctcttgcctcagcc

SEQ ID NO: 24740 - DNA, 201 bp, Homo sapiens
gcaacaaaataaataataatgcctttgttttgtgctggtgtgacaaaatacctgagactgaatcatctataaagaacagaaatttgtttcacacagttctrgagcctgggaagttcaagatcaaggcgcgagcaggttcagccatctagcgagggctgctctctgcttctaagatactaccctattgctgcatcctctagc

SEQ ID NO: 24741 - DNA, 201 bp, Homo sapiens
agtagcccccaaaccaaacaacaaaaaaataagaacatggaggtgcattgaaaggatgcgggagccaacctgaaagtgttccccgtggccaaaggtgaaayaacctgagcaacaaaataaataataatgcctttgttttgtgctggtgtgacaaaatacctgagactgaatcatctataaagaacagaaatttgtttcaca

SEQ ID NO: 24742 - DNA, 201 bp, Homo sapiens
ggatttttatcataaaagattataatagaaaagtttggaaatagatagatcctggttataaataaatcatttctacatctccacaaatggcacactcactrtgcagctattaagaagagttagagttgattctaggcctggggctgggaaatacaagatgagcccgaagcatcttctcccagaaagtaaacaagtagcccc

SEQ ID NO: 24743 - DNA, 201 bp, Homo sapiens
gtgccggcctggagtttcttctttaatggtttcagttttcctctggttcttaagtttgcaaagttttcctaagctatcatttcagtatttggacattcctrtctcctgccagacagtcacttgggttgtcacattggcacttgttctgcagaagtcccttgagcacctatgacaacaggctggagccgcctattcttgccc

SEQ ID NO: 24744 - DNA, 201 bp, Homo sapiens
cttgctcttgtcatccaggttggagtgcaatggctgctcattgcaacctccacctcccgggtttaagcgattctgctgcctcagcctcctgagtagctgarattacaggcacccaccaccacgccctgctaattttttgtatttttagtagagacagggtttcactatgttggccaggctggtcttgaactcctgacttca

SEQ ID NO: 24745 - DNA, 201 bp, Homo sapiens
ctccacccttgccccttcactgttaggtcacaacatctcagctagtgactttctttggtttgggaagcacactttttgaggtcagctgttactttctggawtagtgtgtgatttctgaaggcagttacagctcaccagaggggccaggatgggccccagtgaatgctggttcaacggcacttttccaattctcattaagca

SEQ ID NO: 24746 - DNA, 201 bp, Homo sapiens
aaacacctcatgagatgcatgctcttatccttcattttacagatgaggaaaacaggctcaggagtttaagtaacttgccacagttgcaaagccaataaatygtagagccaggattcagacatgggtctgtcagcctccagagtctgtggtctgtgttggatgtcagtgcatcatcgtctcaactcctttttaatgtccatg

SEQ ID NO: 24747 - DNA, 201 bp, Homo sapiens
tgtttttccaaggtcaccttcatactacagatagatgtcccaggggcacctaagtcagtaaagtcagaccctgacagggagctaggaagaaggacacggcrgagggggatgtgatggtggcactggcagcagcagctgcaaatatttaatgaccccttagactgtttgccaggcactgtgctacatacttatttaattatg

SEQ ID NO: 24748 - DNA, 201 bp, Homo sapiens
ttgtttcatttccaccttgtgtcaaagacccctccttgggtacttcctggggacatcttttttttttttttttttaagacggagtttcactcttctcgccyaggctgtagtgcaatggcaggatctcagcccactgcaacctccacctcccaggttcaagcaattctgcctcagcctccagagtagccagaataaaaggtg

SEQ ID NO: 24749 - DNA, 201 bp, Homo sapiens
caagcaattgtatttaattaaacttctagctggcttagccaggcaagcctgccttgtgttgtgttgtagtctcctcaaactattagcaaagtctttccaarcaaatagcaccccaaaatataaaagaggcagttgctggaaaggaggcagtcgcggatgtggtttttctcaactcttcctttaattttcagatttctagct

SEQ ID NO: 24750 - DNA, 201 bp, Homo sapiens
agtgtgatggagtgacaatggaaaccacatgctggtcttctttgaaggctggagatgtaatttctgaaggacaacatgataaaccagcaaccagaagacarctggaccactgacagccctccccactcaatacaagtctttgttgctgtatggtagaaaaaatagagatgtgagttctgagacatttatgggactggcctt

SEQ ID NO: 24751 - DNA, 201 bp, Homo sapiens
cccatgggcttgcagtaagtgttcttctatcaatcagccagtcaagaaataatgatagatttatatgtcaggaactcttaggtgatgaaattaaatgaaaytcttgcttatgctgaaagctcagtgcaggacatggtagacacatgatcaatgtctccttcctggtcccgcgcagaagggatccccaaaacaggattagtg

SEQ ID NO: 24752 - DNA, 201 bp, Homo sapiens
tgagttgatttttctcttatattttcctttatattctcacagcttaaccctgagtcagtccaaaatgaataaagtgagtaaccaaggtcatctaataaaaytgtggaatgatctcacagtctgcttaggctgccataacaaaataccatagactggagccaggtgtggtggctcatgcctgtaatctcagcactttaggag

SEQ ID NO: 24753 - DNA, 201 bp, Homo sapiens
tgttaaagaatttgctcctagggtcttaagagactcccgaatcttaggagcctcttagaggatggattgtttcttctgaaattgttgaaggctcagatcaygaaagtcacctttatagaagatacttctatgggcttaaaaagaaatcaatgtctttgtgctatgttaatttgctttccacctctttctcctcctcatcta

SEQ ID NO: 24754 - DNA, 201 bp, Homo sapiens
cgcccggctaattttttatatttttagtagagacggggtttcaccttattagccaggatggtctcgatctcctaacctcgtgatccgcccaccttggcctmccaaagagctgggattacaggcgtgagccactgcgcccggccacagcaccttatttcttaaaatacctttcatattcctggagccagagcactaaaggat

SEQ ID NO: 24755 - DNA, 201 bp, Homo sapiens
agctgggactacaggcgcctgccacctcgcccggctaattttttatatttttagtagagacggggtttcaccttattagccaggatggtctcgatctcctracctcgtgatccgcccaccttggcctaccaaagagctgggattacaggcgtgagccactgcgcccggccacagcaccttatttcttaaaatacctttcat

SEQ ID NO: 24756 - DNA, 201 bp, Homo sapiens
ctcccaagtagctgggactacaggcgcctgccacctcgcccggctaattttttatatttttagtagagacggggtttcaccttattagccaggatggtctygatctcctaacctcgtgatccgcccaccttggcctaccaaagagctgggattacaggcgtgagccactgcgcccggccacagcaccttatttcttaaaat

SEQ ID NO: 24757 - DNA, 201 bp, Homo sapiens
gttttgtttttttttggagatggagtctcactctgtcgcccaggctggaatggaatggcgcgatcttggctcactgcaagctccgcctccggggttcaccmcattctcctgcctcagcctcccaagtagctgggactacaggcgcctgccacctcgcccggctaattttttatatttttagtagagacggggtttcacctt

SEQ ID NO: 24758 - DNA, 201 bp, Homo sapiens
aagtgatagaaacttgagcccagagtcccggctgtagaatgtctaaagagaatgccactgaaccccatcattccctacgcccttctgcattcagaaaaatyaaaaacattaggacttgtgtgaaccatgtatggggcatttttcttcagagtcaagcactgctgtctgaaaaagaacacttctttccagaaaactctgttt

SEQ ID NO: 24759 - DNA, 201 bp, Homo sapiens
cagctgaataggaattgaacattttaaaatagggagaaaggactcataattctaaaagccagactaaagggctgcaaaacagcccttcgatgcatcagacytgtgcctgtgtatatttgttcatggcctgactttgagtcactgttcttaaggaaaaatatattctaaatccctctgtggctcccctcctcagtcacccaa

SEQ ID NO: 24760 - DNA, 201 bp, Homo sapiens
gtctctctctctctctctctctctctctctctctctctctctctctctctctctctctctatatatatatatatatatacacacacacacacacacacacrcacgcacgcacaaagaagaaattgatagaatacttaatgtatttgaattcgttgagaagagatttatgaatctgggaaagactttgtgtttgaattattg

SEQ ID NO: 24761 - DNA, 201 bp, Homo sapiens
ccctgtctctctctctctctctctctctctctctctctctctctctctctctctctctctctctatatatatatatatatatacacacacacacacacacrcacacacgcacgcacaaagaagaaattgatagaatacttaatgtatttgaattcgttgagaagagatttatgaatctgggaaagactttgtgtttgaatt

SEQ ID NO: 24762 - DNA, 201 bp, Homo sapiens
ctagcctgggtgacagagcaagaccctgtctctctctctctctctctctctctctctctctctctctctctctctctctctctctctatatatatatatayatatacacacacacacacacacacacacacgcacgcacaaagaagaaattgatagaatacttaatgtatttgaattcgttgagaagagatttatgaatct

SEQ ID NO: 24763 - DNA, 201 bp, Homo sapiens
ctctagcctgggtgacagagcaagaccctgtctctctctctctctctctctctctctctctctctctctctctctctctctctctctctatatatatatayatatatacacacacacacacacacacacacacgcacgcacaaagaagaaattgatagaatacttaatgtatttgaattcgttgagaagagatttatgaat

SEQ ID NO: 24764 - DNA, 201 bp, Homo sapiens
ttgaacccaggagtttgaggctgtggtgagctatgagcgcgccactgcactctagcctgggtgacagagcaagaccctgtctctctctctctctctctctytctctctctctctctctctctctctctctctctctctatatatatatatatatatacacacacacacacacacacacacacgcacgcacaaagaagaaat

SEQ ID NO: 24765 - DNA, 201 bp, Homo sapiens
ggctgagattggaggattgcttgaacccaggagtttgaggctgtggtgagctatgagcgcgccactgcactctagcctgggtgacagagcaagaccctgtstctctctctctctctctctctctctctctctctctctctctctctctctctctctctatatatatatatatatatacacacacacacacacacacacaca

SEQ ID NO: 24766 - DNA, 201 bp, Homo sapiens
ttgatcccaggagttaaagtctgccgtgagttatgattgcaccactgcattccagcctgggcaacagagtgagaccttgtctctaaaaaaacataataatkgaaaaagttaggtcataaatttgaaggtatatcccagaaggtagaaaaacacaaggaaattgaaaataagaaaaactgaagaccgggttaggagatatat

SEQ ID NO: 24767 - DNA, 201 bp, Homo sapiens
taacttgaaaaagttgggattgtttaaggtcaggaaatcaagactagtgtgggcaacatagtgagaccccatcttcacaaacaatttaaaaaatatattasttgggtgtggcggcacatgcctgtagtcctagctactcagttggctgaggtgggaggattgcttgatcccaggagttaaagtctgccgtgagttatgatt

SEQ ID NO: 24768 - DNA, 201 bp, Homo sapiens
tgccatgttggtgtgctgcacccattaactcgtcatttacattaggtatatctcctaatgctttccctccccccttcccccaccccacaacaggccccacygtgtgatgttccatttcctgtgtccaaatgttctcattgttcagttcccacctatgagtgagaacatgtggtgtttggttttttgttcttgcgatagttt

SEQ ID NO: 24769 - DNA, 201 bp, Homo sapiens
aggagttcaagaccagcctggccaacatggtgaaaccccgtctctactaaaaatacaaaaattagctgggcgtggtggcacacatgtgatcccagctacaygagaggctgaggcaggagaattgcttgaacccgagaggcggaggttgcagtgagccgagattgtgccactgcactccagcttgggtgacagagcgagact

SEQ ID NO: 24770 - DNA, 201 bp, Homo sapiens
acacagccagccaggctcatattccttctaagcaggagtttataaaagtcttctttgggaaaactcaccagtttaagagattggatgtcaatgaagtggcscaactgaatcatctaatggtgaagcccacaaccaagagctttttttttttttccattttttaaaataaaagctttattaagacattcacatagcatgctt

SEQ ID NO: 24771 - DNA, 201 bp, Homo sapiens
aagtggtaacttgaatactcacatttacctctgtttccttcctctaaaagaatggttttttaaagggtaaatccacagggacaaagaaaaggagaggaaamccagcaaaaaaaaaaaaaaaaaaaaaaaattgtggaagctggagaacaaatgggtgagctatgactggattagtgaactcagaaaatggaattctaagct

SEQ ID NO: 24772 - DNA, 201 bp, Homo sapiens
tacctaccttcaaaacttgtagtttaaagtggtaacttgaatactcacatttacctctgtttccttcctctaaaagaatggttttttaaagggtaaatccmcagggacaaagaaaaggagaggaaaaccagcaaaaaaaaaaaaaaaaaaaaaaaattgtggaagctggagaacaaatgggtgagctatgactggattagt

SEQ ID NO: 24773 - DNA, 201 bp, Homo sapiens
gtttttatcctgagactacaaatgataccaaggataacgatgagtaggaatcagagctagaattaacccctattttcttactattgacccagcatgctttytatgttgaaaagtgcaccacatcgagaagagattggtcaccgcagcacagggcacgcagaattccattagtatcacttacctgggaagtccaggtgcctt

SEQ ID NO: 24774 - DNA, 201 bp, Homo sapiens
gttgttttattataggaacggaatcctacaaaacatctttcatggcactacatagagcactgccaccccattctttttcagtggctatcatatatccactrtttggatatattaaccactcttttttccgtatttctaactttagtcaaggtggacatacagctcagctgagaagcagacacattgtgaaatggactcccc

SEQ ID NO: 24775 - DNA, 201 bp, Homo sapiens
tattactcattgtctttgaaaaattatttttggaaattcattgaagactgtgataaaagatgcctttctccagagagatttaggttggcttctgacaggtkcctaggagtactaccagttcaggaccatttcaaaccaagtttttgaggttccctggaccatctgagtaatgcaaggccaaggtatacaatccatgagaag

SEQ ID NO: 24776 - DNA, 201 bp, Homo sapiens
atttctgatatctgctgtttttactggtctactcatggtatcctggatcctccagtacttagtatttttgactgtatattactcattgtctttgaaaaatwatttttggaaattcattgaagactgtgataaaagatgcctttctccagagagatttaggttggcttctgacaggttcctaggagtactaccagttcagga

SEQ ID NO: 24777 - DNA, 201 bp, Homo sapiens
tagtaatatgtttatgattaggtctgataattttaatatctgaagtctttacatgtctatttctgatatctgctgtttttactggtctactcatggtatcytggatcctccagtacttagtatttttgactgtatattactcattgtctttgaaaaattatttttggaaattcattgaagactgtgataaaagatgccttt

SEQ ID NO: 24778 - DNA, 201 bp, Homo sapiens
tgcttttatttcttaataatttactaatatgttcatgaaatttagtaatatgtttatgattaggtctgataattttaatatctgaagtctttacatgtctrtttctgatatctgctgtttttactggtctactcatggtatcctggatcctccagtacttagtatttttgactgtatattactcattgtctttgaaaaatt

SEQ ID NO: 24779 - DNA, 201 bp, Homo sapiens
ggtttctccatgttggtcagtctggtctcaaactcccgagctcaggtgatccacccaccttggcctcccaaagtgctgggattgcaaatgtgagccactgygtccagtcttccatcattttttaatagtttactcttccctgcagatggacatattcaagctttgcttttatttcttaataatttactaatatgttcatga

SEQ ID NO: 24780 - DNA, 201 bp, Homo sapiens
agctgggattacaggcatgcgctaccacacccagctaattttgtatttttaatagagacagggtttctccatgttggtcagtctggtctcaaactcccgasctcaggtgatccacccaccttggcctcccaaagtgctgggattgcaaatgtgagccactgtgtccagtcttccatcattttttaatagtttactcttccc

SEQ ID NO: 24781 - DNA, 201 bp, Homo sapiens
atttggttctttttccaaatatatttcatctttttttttttttttttcccgagatggagtttcgctcttgttgcccagcctggaatgcagtggcacatctyggctcaccgcaacctccaccttccgggttcaagtgattctcctgcctcagcctcccgagtagctgggattacaggcatgcgctaccacacccagctaatt

SEQ ID NO: 24782 - DNA, 201 bp, Homo sapiens
ctctttttgtgtctctttctgctgcgttctgaataattcttcttgagctatcattcagttcatttattcttttttcatctgtgtctaatctacggttaagkgggtccattgagtttttaattttagctacagtatttttcacttctagatgttctatttggttctttttccaaatatatttcatctttttttttttttttt

SEQ ID NO: 24783 - DNA, 201 bp, Homo sapiens
cctttagatcacctcaatccatatctgttaacctctcgtccatattttctctttttgtgtctctttctgctgcgttctgaataattcttcttgagctatcwttcagttcatttattcttttttcatctgtgtctaatctacggttaagtgggtccattgagtttttaattttagctacagtatttttcacttctagatgtt

SEQ ID NO: 24784 - DNA, 201 bp, Homo sapiens
ttttgctttggaaagttagaaatactggttttcaaaatatgttttgattttcctatctaaacctctattggattaaagtaaaacatgttgaccatattacrtggagaaatattgcacactctgtccagctatgctggatgaaaaggttgcagtcagtgaagggtgaaaaacttagtctagtttggacaagaagaaaaaatt

SEQ ID NO: 24785 - DNA, 201 bp, Homo sapiens
tgggaccacaatacaaaattgaatttatcatttatgaataatggcttctagtttttgagtacttacagggtcccaggcactgtagatggtgggacgtagayggtgggatggtgggaaggtgggagacccagagagcttaagtgatccagccctagacacacggtgttagttaacttttgggagacacttcacaagctggtg

SEQ ID NO: 24786 - DNA, 201 bp, Homo sapiens
tgaaattccacaagccccttgttcacttcccctggagtagggattgtggaatgttgccactcaccttcagttccctgttgaagctcttgcagacccctaayagtgcatgctaccgttctgcagagaagaccatgatgacaaaccacagacatcccccttcatctattgtcttctgtgtctttgggaaggcattcctggaat

SEQ ID NO: 24787 - DNA, 201 bp, Homo sapiens
aagaagacagggagtgagtgggctccaatcttggcaacgttggctgcttattagagcatttgcaggcctgggagatttgctcctcctcttggtatctgaarttccacaagccccttgttcacttcccctggagtagggattgtggaatgttgccactcaccttcagttccctgttgaagctcttgcagacccctaatagtg

SEQ ID NO: 24788 - DNA, 201 bp, Homo sapiens
tttttttctctcctcatttgatttccccttcaagaagacagggagtgagtgggctccaatcttggcaacgttggctgcttattagagcatttgcaggcctrggagatttgctcctcctcttggtatctgaaattccacaagccccttgttcacttcccctggagtagggattgtggaatgttgccactcaccttcagttcc

SEQ ID NO: 24789 - DNA, 201 bp, Homo sapiens
ctccacctgcccccgcaaaaaaaaagaaaggtagtatagagacttagaaagtagagaaatataggtagaagtacagtacctttgagtgaccttcagaattyggtcctcttggctcaaaattttggcatcatttcaacaaactattttttttctctcctcatttgatttccccttcaagaagacagggagtgagtgggctcc

SEQ ID NO: 24790 - DNA, 201 bp, Homo sapiens
tttgtgaatcagtcctttccagatagaatatatgaggcttgaaactacatagtgcttatcaccaagaggtgtataggtttgtcagagcaagaagaccactstcccctccacctgcccccgcaaaaaaaaagaaaggtagtatagagacttagaaagtagagaaatataggtagaagtacagtacctttgagtgaccttcag

SEQ ID NO: 24791 - DNA, 201 bp, Homo sapiens
ggatggaattgtgtccagggtgtgaggttgtttgtgaatcagtcctttccagatagaatatatgaggcttgaaactacatagtgcttatcaccaagaggtrtataggtttgtcagagcaagaagaccactctcccctccacctgcccccgcaaaaaaaaagaaaggtagtatagagacttagaaagtagagaaatataggt

SEQ ID NO: 24792 - DNA, 201 bp, Homo sapiens
tgactttggccttgacactgatctgagcctgcagataacagaaaggaggagcttatctagacaggagtggtggaagtagccagtaataaatcattgaagtraggagaatgaaggtaaagaaattgatcagctttaaataggaggtgactccgcattcctcttgcttggaaatgatccccaggatggaattgtgtccagggt

SEQ ID NO: 24793 - DNA, 201 bp, Homo sapiens
tgctgtgctggctttcttagaacacctttctgttgggccatttactcaacatacacttgttgagtgtctgccctgtggcagattctgtcttagagactggwtgtacagcagtgaatacaatgagcccaaatccctgtcttcatggacgtatagtctagaggcactgtacatgtagaagtaagtaggaaggtgctcaaggag

SEQ ID NO: 24794 - DNA, 201 bp, Homo sapiens
tggctttcctgctgtgttcctgtggtggtttttggagctaaagttcacgatgtgagtttctacatgctgttctgtccttctgagtgggagctgcaagttartcctgcctcctcaccaccatttttccctattttcagttttttgatgctaccacagttttataccactttgttctcaatccctcagtctcatcctgcagaa

SEQ ID NO: 24795 - DNA, 201 bp, Homo sapiens
ctttccttcatttatggagcttagtttcactgggtacaggattcttggctgataattgttttgtttaatcaggctaaagctaggaccactcccttctagcytgcagggtttctgctgagaaatccgccgttaatctgataggttttcctttataggttacctgatgcttttgcctcacagctgttaagattatttccttca

SEQ ID NO: 24796 - DNA, 201 bp, Homo sapiens
aattcttatccattctgatattctttctcttttaagtggagtacttaggccatttactttcaatgttagtattgagatgtgaggtcctattctgttcctcrtgctagttgttgcctgaataccttgtggggttctttttttcattgtgttactgttttataggccctgtgggatttatgctttttggaagttctattttgg

SEQ ID NO: 24797 - DNA, 201 bp, Homo sapiens
ggctgagacaggagaatggcatgaacccaggaggcagagcttgcagtgagctgagatcgtgctactccactccagcctggggacagagcgagactccgtcycaaaaaaaaagaaaagaaaagaaaaaaagaatggcgatcattaaaaagtcaggaaacaacaggtgctggagaggatgtggagaaatacgaacatttttac

SEQ ID NO: 24798 - DNA, 201 bp, Homo sapiens
cactggccatcagagaaatgcaaatcaaaaccacaatgagataccatctcacaccagttagaatggcgatcattaggccaggcgcagtggctcacgcctgwaatcccagtactttgggaggctgaggcaggcggatcacgaggtcaggagatcgagaccatcctggctaacatgatgaaaccctgtctctactaaaaatac

SEQ ID NO: 24799 - DNA, 201 bp, Homo sapiens
actcacttgatcatggttggattatctttttgatatgctgttggattcagttagctatcattttgttgaggatttttgcatctatgttcatcagggatatyggtctgtaattttattttttggttatgtcctttcctggttttggtgttagggtgatactggcttcatagaaagatttagggagaattctctatttctcta

SEQ ID NO: 24800 - DNA, 201 bp, Homo sapiens
aaatttaggattgttttttctagttctttgaagaattatgataatatattgatgggaattagattgaatttggagattgcttttgcaatatagtcattttyacaatattctacccatccacaagcatagggtgtgtttccatttgtttgtgtaatctgtgatttctttcagcagtgttttgtagttttccttgtagaggtc

SEQ ID NO: 24801 - DNA, 201 bp, Homo sapiens
tgttgatttatgggcatttgggctggttccatattttttcaattgcaaattgtgctgctataaacatgtatgtgcaagtgtattttttatataatgacttmttttcctctgggtagatacccagtaatgaaattgctggatcaaatgatagatctacttttagttctttaaggaatctccatattgttttccatagtggtt

SEQ ID NO: 24802 - DNA, 201 bp, Homo sapiens
acatatatatacacatatatgtacatatatacacacatatatatacatatatacgtatatatgtatatatgtatatatgtatgtatatacgtatatatacrtatatatacacacacacatatatatctgacattttctttatccacttgttgatttatgggcatttgggctggttccatattttttcaattgcaaattgtg

SEQ ID NO: 24803 - DNA, 201 bp, Homo sapiens
gtgtgtgtatatatatatatacatatatatacacatatatgtacatatatacacacatatatatacatatatacgtatatatgtatatatgtatatatgtrtgtatatacgtatatatacatatatatacacacacacatatatatctgacattttctttatccacttgttgatttatgggcatttgggctggttccatat

SEQ ID NO: 24804 - DNA, 201 bp, Homo sapiens
agttctttagcggtaatttctgaaattctggtacacctatcacccgagcaatgtacactgtacccaatgtgcagtcttttatccctcaccctcctcccacycttccctctctggatccccagagtgcattatatcattctcacgcctttgcctcctcatagcttagctcccacttgtaagtgagaacatatgatgtttggt

SEQ ID NO: 24805 - DNA, 201 bp, Homo sapiens
caagaaccagagaaataattaaagttataatattaacaaaacaacatggttgtagaggggatggataaatgattttattccgtttttttctttcttctttyttttttttttttttttttactgcctcaggcatatttgttggcattttcagaaggagatagaatcaggagttatttttctgctaggaaatgtttaagtaaa

SEQ ID NO: 24806 - DNA, 201 bp, Homo sapiens
cacaaatcatctggggatctgttaaaatgaagattctgattcagtaggtccaggatggggccagagagaatgcatgtctgtcaaattcccaggagatgccrctgctgctgatccaagcaccatttgaatagcgaggctctagtctaccatatctgtactgggttgaataatgttctccataaattcataaccacccagcac

SEQ ID NO: 24807 - DNA, 201 bp, Homo sapiens
agtgagtgagctttagcaaatggagtgtctatgacagctatttgaatcatcctagaatctactggcttaaagctgacagctctgactcttcctttaacttsttaagtgcagtgttttggacagagatagaagctttgcgagcaggcagcccgccagattcttctatgtcccagatctggatgttagattagaaaatttgat

SEQ ID NO: 24808 - DNA, 201 bp, Homo sapiens
agtgtctcaaatggtggaagttcactggtttagagcactgaatgagccacctcaattttgctcccgttttcatctttgtccctagtgctgagtggcttcasttttcactgctttgatctatgtcctgcctgactggattaagaaaatagagacctagagcttccagtgggaagagaggaaatcggtgacagaactgaatta

SEQ ID NO: 24809 - DNA, 201 bp, Homo sapiens
atatagattgacgggatcatgtatataatggaaatatacatatattgggggaatagtgtctcaaatggtggaagttcactggtttagagcactgaatgagycacctcaattttgctcccgttttcatctttgtccctagtgctgagtggcttcagttttcactgctttgatctatgtcctgcctgactggattaagaaaat

SEQ ID NO: 24810 - DNA, 201 bp, Homo sapiens
gggagggagggagggagggaaaagggagagagaaagggaaaaggggaggggaagaagggcaggaagaaagaaaagctttagatttgatatatagattgacrggatcatgtatataatggaaatatacatatattgggggaatagtgtctcaaatggtggaagttcactggtttagagcactgaatgagccacctcaatttt

SEQ ID NO: 24811 - DNA, 201 bp, Homo sapiens
tacccttgtggagtctacattctgttgattcattttgggatggatggatggatggatggatggatggagtacaacaatcttcagaggccaactccacttcmgtcccggcaaattcctcttacagaagagcggtaagatacattggtagacatatacaacctgggcttcagaccagggaagttttattttgccactaaattt

SEQ ID NO: 24812 - DNA, 201 bp, Homo sapiens
gggtttcaccatgttggccaggctggtcttgaacgcctgacctcaggtgatctgcccacctcagcctcccaaagtgctgggattacaggcgtgagccaccrcgcctggccagaagcaggatcttgaagctctcagaatgcccgtctctccttctgtgcacagtgagggcttcccattctttctgatttccctttcctgtag

SEQ ID NO: 24813 - DNA, 201 bp, Homo sapiens
atagaagaaatcgggactgaaaacgcgttagtgaccagctcaaagtcacacaatgacttagtgagaactcgaaatggaaacaggatcttttttttggcgtrgggagggacggagtttcgctcttgttgcccaggctggagtgcaatggcgcaatctgggctcactgcaacctccgcctcccaggttcaagtgattctcctg

SEQ ID NO: 24814 - DNA, 201 bp, Homo sapiens
ttgggaggttgaggctgcagtaagcccagatcatgccactgcactccagcctggcaacagagcgaggccctcaaaaaaaaaggagaactcagggaacaagratcaaggtggcaaaggcctatgacctttgcccacagaataaccacccctaccctggagggccaggacggttccttcctctccttccatcccaagcctgag

SEQ ID NO: 24815 - DNA, 201 bp, Homo sapiens
acttgaggccaggagttcaagaccagcctggtcaacatagtaaaacaccgtctttacagaaactaaaaaaaaaaaaaaaaaaaaaaaagccagatgtggtracatgctcctgtagtcccagctacatgggaagctgaggtgggaggattgcttgagcttgggaggttgaggctgcagtaagcccagatcatgccactgcac

SEQ ID NO: 24816 - DNA, 201 bp, Homo sapiens
aaggcagaaggatcacttgaggccaggagttcaagaccagcctggtcaacatagtaaaacaccgtctttacagaaactaaaaaaaaaaaaaaaaaaaaaawagccagatgtggtgacatgctcctgtagtcccagctacatgggaagctgaggtgggaggattgcttgagcttgggaggttgaggctgcagtaagcccaga

SEQ ID NO: 24817 - DNA, 201 bp, Homo sapiens
tctgttcacttagaacacctgtcttccatatacccaagggtccaccttcagctctttatcaggtgccaccctctcaaggagaaccccatccccatccccascccctgtttaaaattgcaacccatcaccaaccccgctccctcttcgttccacttaccatgttctgggcttttttttttttttttttgccacagcatttat

SEQ ID NO: 24818 - DNA, 201 bp, Homo sapiens
ttctgttcacttagaacacctgtcttccatatacccaagggtccaccttcagctctttatcaggtgccaccctctcaaggagaaccccatccccatccccmccccctgtttaaaattgcaacccatcaccaaccccgctccctcttcgttccacttaccatgttctgggcttttttttttttttttttgccacagcattta

SEQ ID NO: 24819 - DNA, 201 bp, Homo sapiens
gatgttgaaaaaacattccagtgggatagtctatgaagatagcctcagcacatgagttatgagagctgcctcagctgtgagagttccaggcacgtcactgwccgggggtaattccctttgagtttcattgaattttaaggaaaaagcccccttgctcttcctcaaatgcaccaaagactctctcaccccaggatctttgca

SEQ ID NO: 24820 - DNA, 201 bp, Homo sapiens
cagtaatgctgtaaggggctgatggggtctccagattgtatacagtttcctgcacccccgaaaccatcatagaggatctctgccccctcatgcctttaaaygggaacattaataatttcctgcttagtgcaggatgtagtccaaaaactcaaaatgagttgtccagataaagggagacctctgggggatgccagaaaaact

SEQ ID NO: 24821 - DNA, 201 bp, Homo sapiens
gacaaagaaggaagatcagcattcatcatcttcagcatgatatggtttcagagatttttagcatttgatttgtaacatttcagaaggcaacataaatcaarctggtaatttgttttgtcatgccaaaaaaaaaggaaaatctgaattcatttgggagaacgtgtgtatgtcagtcactgccttttcggatctggttgaaaa

SEQ ID NO: 24822 - DNA, 201 bp, Homo sapiens
aggtccacccatttgccattgttagcatgagctgaaagaagttgggtctcccaaggcagtgctgtctcactgcagtaaacagcagttttcagaagatctaygtccttgaaatatacacagattgggttttgtttgtttacccacacacagccttctcttagaggggagttaaggtaaggaaatgactgtctcaacactcac

SEQ ID NO: 24823 - DNA, 201 bp, Homo sapiens
gcaggggcctcttgttcacccctgttattcccaggggtacccgcctggctcatagtaggtgcgcagcaagatttttttcaatggaaactagagtgggatgygcctatctagaaaatcctctgttggagcctagtcttggtccttaaaagtcctgggcctgccttccccctgcctttaagaagctgagccagcaatagtagc

SEQ ID NO: 24824 - DNA, 201 bp, Homo sapiens
cagaaattccaaattattttcttccttcttgtttaaagaatttcatctaaaactttgtttggagagagcccgctgaagtcatagttatattgacttccgcrtctgttccccagctcatctttgctccctgttttctccccacgctggcctccgtgcctggaacaagtcagacttgtgttatttcccagctgtgtgaccttg

SEQ ID NO: 24825 - DNA, 201 bp, Homo sapiens
gctgggaagaggatggccttttaccccagacccacaatctttccagttcaggctggttcatttgccatcatttgctttctcattgattaggaattaatcawtggctgacagtctccccagagtggatcacagctgtctaggaaatctgctgacctagaaagattttcagatgctgttaacaacccacagatcacgctgtca

SEQ ID NO: 24826 - DNA, 201 bp, Homo sapiens
ccttgggcagctcctcctcttccccatttccctgttttccaccctctcacccttgcccttactttgaattctgctgggaagaggatggccttttaccccakacccacaatctttccagttcaggctggttcatttgccatcatttgctttctcattgattaggaattaatcaatggctgacagtctccccagagtggatca

SEQ ID NO: 24827 - DNA, 201 bp, Homo sapiens
tggcacagcctaggggctcttggaccccacttattccctttgtacccaagtagctttcctaaagcatgttccttagaaccctaaatccacaagcagctccrcctgtggtcacatgaatttgggaggcactttcccaatcttagaaatcacaacagaggtttagagaagtcgtagggaaaagaaattgtttgttgttgtcta

SEQ ID NO: 24828 - DNA, 201 bp, Homo sapiens
tgttcttctaagtttttaaacattggttggaattgtgccttcagtggggtgtgggggagttggagaggcaccttcatcccagactgaaggccagaagcctygggttccagttgtgtctcaaccactgagttgtcccagagactttggcataaactgcttgacttcctcggcctctgttcttctttttgtaaagagatgagt

SEQ ID NO: 24829 - DNA, 201 bp, Homo sapiens
gttattttctcactctgagcctcaggatctccaacaaaggggttagtaacacttaatggcttcgggttcttggaggacgccgagagatgcccagcatagtsggggtgcttgaccaggatgtgctccatgggcataggaactctgagttgtagatgtggtatccccacttctcagaacaggtcctcctgcagcaaatatttg

SEQ ID NO: 24830 - DNA, 201 bp, Homo sapiens
cataggcacctctgaacaatccttggtttcccacctttcaggcacacttttctgtctgtctagaacgccctcaccagtctagccaggccagaggtttccarttgttcaaattgtaattcacatggtgctgtttcagtgaatcatgctcatatctgggaatgacctgaattctatcccagctctgatgtacccacatggtaa

SEQ ID NO: 24831 - DNA, 201 bp, Homo sapiens
aaaggataggacaaaataacccaacttggaaggccccagaaagacaaatgattcaagaagcaccgtctgtgtctgagacgctgtccctgcacagcagtgtygtccagctggtgagagatgaggatgagagggagtttgaatctgttcgctgctcctatctacctgttgaaaatgtcagagctgtgagtctgcttctgggct

SEQ ID NO: 24832 - DNA, 201 bp, Homo sapiens
tacttttaaaaggacaccagtcatttgacttagggtcaagtctaaatgcaagatgatctcatctaaagttccttaactcaattacatctgcagagaccccrttttccaaataaagtcatattcacaggcaccaggggttagaacatggacataacttttgagggacacagttcaaccccctacacatagtatcatgtacac

SEQ ID NO: 24833 - DNA, 201 bp, Homo sapiens
aggctgcataaattactacagctttggtggcttaaaaaaacagacagttattctcgtacagttcagaagagaagtccaaatcaaggcatcagcagggtttrttccttctgcggaccctgagggaaaattcactgcatacctttctcctaggttctggcagcttccagcaatccttggcatttcttggcttgtagacgcatc

SEQ ID NO: 24834 - DNA, 201 bp, Homo sapiens
ccatataattgaaattatcctgtaaagagctatataagctgcttctacatatcatagtatattgtatattggtttcctcaggctgcataaattactacagmtttggtggcttaaaaaaacagacagttattctcgtacagttcagaagagaagtccaaatcaaggcatcagcagggtttgttccttctgcggaccctgagg

SEQ ID NO: 24835 - DNA, 201 bp, Homo sapiens
ctttataggagtaatatacacccattgtccatccttttcataccatataattgaaattatcctgtaaagagctatataagctgcttctacatatcatagtrtattgtatattggtttcctcaggctgcataaattactacagctttggtggcttaaaaaaacagacagttattctcgtacagttcagaagagaagtccaaa

SEQ ID NO: 24836 - DNA, 201 bp, Homo sapiens
ataagagatggcaaactttttgtatgtttctcataaccttttctctctttataggagtaatatacacccattgtccatccttttcataccatataattgarattatcctgtaaagagctatataagctgcttctacatatcatagtatattgtatattggtttcctcaggctgcataaattactacagctttggtggctta

SEQ ID NO: 24837 - DNA, 201 bp, Homo sapiens
ctgtgctctctgaaacatgtgctgtgtccactcagggttgaatggattaagggtggtgcaagatgtgctttgttaaacagatgcttgaaggcagcatgctsgttaagagtcatcgccactccctaatctcaagtacccagggacacaaacactgcggaaggctgcagggtcctctgcctaggaaaaccagagacctttgtt

SEQ ID NO: 24838 - DNA, 201 bp, Homo sapiens
acccccaaccctgtgctctctgaaacatgtgctgtgtccactcagggttgaatggattaagggtggtgcaagatgtgctttgttaaacagatgcttgaagscagcatgctggttaagagtcatcgccactccctaatctcaagtacccagggacacaaacactgcggaaggctgcagggtcctctgcctaggaaaaccaga

SEQ ID NO: 24839 - DNA, 201 bp, Homo sapiens
ccaccctacaaacaaaacaaaacaaaaacctcattttagcttaatcacttctcgaaagaccttgcctccaaatgcagtcgcattctaaagtgttggaggcyccctctccctctccctctccccctccccctccccctccccctccctctcttgccacggtctccctctgatgccgagccgaagctggactgtactgctgcc

SEQ ID NO: 24840 - DNA, 201 bp, Homo sapiens
tccattacctgaagaggtagctggctggagcagccagggtcacaggaagtcagcagaatagttgggtggaaggcaggctaaaacacagtgcatagcctcayctgcatttctgaaggcaataaattcccatttaagctgcaatatcgatctgctctgtgaaattgcagtatcagaggttgttttcttttttttccttaacca

SEQ ID NO: 24841 - DNA, 201 bp, Homo sapiens
ggtttgatcttgtagtgcatctgatcaactttagtacatgcttactgggtcgttggtctaggcagtagccagaataggagaatttggtgggggtgggagtrgggaatcagtcagtaaagggagacagggatgggtgaagaagggatgtacgctaacccatatagatgaagggcatgttcaaataagtagtttctatggcaa

SEQ ID NO: 24842 - DNA, 201 bp, Homo sapiens
aggataatgtttatttaataagaataatcacctatcgagtttttctttggtccttggctaagtagctttgtagcatttggaggcttgggagagtttgcagkgatttacactctccataccttgaagttcatgttcgtttgttttgtaaaaactccccagagcacacagcagagataaaagtaaagagaaagcagggatcga

SEQ ID NO: 24843 - DNA, 201 bp, Homo sapiens
tcctagctggttttaattctgggtgctgttgagctttctctctctctctctctctctctctctctctctctctctctctctctctctccgtgtgggggtgwgcgtgtgtgtctgtattttaaaaaatggttccatccaaaatggagatatgcgtggtactagccctgcttcctgtatgggctgtcatggggattcgatggc

SEQ ID NO: 24844 - DNA, 201 bp, Homo sapiens
gaaaggtactactaatgtgaaaaataattaatggaaatgtgacaaaatcctagctggttttaattctgggtgctgttgagctttctctctctctctctctytctctctctctctctctctctctctctctctctccgtgtgggggtgtgcgtgtgtgtctgtattttaaaaaatggttccatccaaaatggagatatgcgt

SEQ ID NO: 24845 - DNA, 201 bp, Homo sapiens
ttatccgaaaggtactactaatgtgaaaaataattaatggaaatgtgacaaaatcctagctggttttaattctgggtgctgttgagctttctctctctctytctctctctctctctctctctctctctctctctctctctccgtgtgggggtgtgcgtgtgtgtctgtattttaaaaaatggttccatccaaaatggagat

SEQ ID NO: 24846 - DNA, 201 bp, Homo sapiens
gatgtttttcagtcgcttcatgtatattttctctaattcttacaacaaccctcatcttaacaggaaagatatctgaggctcagagcgggtaagtaacttamccgtagtcacacagctgatgagtccaaacctgtgcgcttccccataaaccaccaaaccctgccagtttcgggagggcagcaagaaggcagttggtgtctc

SEQ ID NO: 24847 - DNA, 201 bp, Homo sapiens
ttggatcatgggggcggatccttcatggcttggtgctgtctctatgatagtgagttctcttgagatatggttgtttaaaagtgtgtggcacctcccgccaractctgtcttacttgcttctgctttcaccatgtgacatgcctgctcctccttcaccttctgccatgatggaaagtttcccgaggcccacccagaagctga

SEQ ID NO: 24848 - DNA, 201 bp, Homo sapiens
cctctaggtttctctcctggttactcttatgtccccagttctccactctcagcacccttcttttctccattttccctgtttcccctctctctttccctccycttcctcactgttgtaggtgcagcaaaagaagagtgatgtttggtggatacttgggataactgagcttccaccttcttttgactcagcctggagatgcag

SEQ ID NO: 24849 - DNA, 201 bp, Homo sapiens
tactgatagtctccttaatatgcagtgtctgttgtcattaggtattaataagcactaatgatattaataagcacttttatcagttcctgtaaaaatcgagwtttcctgatcttatttttcctgtcatgtcttaggctgcttaatcatagattctcactccatagggtctgcagcatttgcatgtctgaaggaagtggtttc

SEQ ID NO: 24850 - DNA, 201 bp, Homo sapiens
gttacctcctacaaggcaaaaatcataatatcagcatcttatggaaactgaaaagggagatccggagaagcttccagaaagcagggggatacattgaaatrcattgtacactcctaatgattgcaattttaagatgtgtaaagtgttactgatagtctccttaatatgcagtgtctgttgtcattaggtattaataagcac

SEQ ID NO: 24851 - DNA, 201 bp, Homo sapiens
ataaaatcagaaggacatcagacatttggatgggcaaccagacactggggaaaaaatcttgtttgtctgcatgttacctcctacaaggcaaaaatcataayatcagcatcttatggaaactgaaaagggagatccggagaagcttccagaaagcagggggatacattgaaatgcattgtacactcctaatgattgcaattt

SEQ ID NO: 24852 - DNA, 201 bp, Homo sapiens
atctcctgaccttgtgatccgcctgcctcagcctcccaaagtgttggtattacaggcatgagccaccgcgcccggcccattttctacatcgaaggataaartggtccagttctgcttgggtgtgggttcttaaatgtctgttctagttgaaagaactgaaagctgagaaaaatctggctttgttccttcttccctctttca

SEQ ID NO: 24853 - DNA, 201 bp, Homo sapiens
gggctcaagcagtcctcctgtctcagcctcccagaatgctgggattacaggtgtcagccatcatgcccagcctgagtccattttcttttcctttcttttcytttcttttcttttcttttcttttcttttcttttggaaaaaactgagacaaggtcttgctctgttttccaggttggtctcaaactcctgggctgaagcagt

SEQ ID NO: 24854 - DNA, 201 bp, Homo sapiens
tacttagctctccttttgcattttctggcatctcctgcagtgatgattcatcttccttatggcctaagaaggccaagtccatttgtccattttcttttttyttttttttagttgagatggggccttgctatgttgtccaggttggtctcgaactcctgggctcaagcagtcctcctgtctcagcctcccagaatgctggga

SEQ ID NO: 24855 - DNA, 201 bp, Homo sapiens
aatttgttaaatcacacaacaacccagaaggagtaggtgtcattatttccccattttatagatgagaaaactggggcacacaaaggttgggtggtttgtcraaggtcacaaagccacagtaaatattttgtgatagagaaattgttcaggactcagaagcacatggatttttaattcgggtttcaggtgatgttgcgtttt

SEQ ID NO: 24856 - DNA, 201 bp, Homo sapiens
cagctctgatcccttggaaacttacaactaaaattcatttcattagcagtcagaacagtgtgtccctttgaagttcagacagggtgagattaatatgaacmcgatattaagctattaagcatcagtttgccaaacctatttataaaggagagcggaagacggaaaataaaggaggctgcattaagaggctcctttgccaag

SEQ ID NO: 24857 - DNA, 201 bp, Homo sapiens
agactgtgtctcaaggaaaaaaaaaaaaaagagagaaaagaaaaatcaccctagcatcggtggaacagtgatgggcagaggccaaggttagtagagagacmctggctgggatgctacctttgtagtctacatgagggatggtggtggctttccctgtgagatggagggaaatggacaaagtcaagagatgtcagggaagta

SEQ ID NO: 24858 - DNA, 201 bp, Homo sapiens
tagattgcctgaggtcgggacttcaagaccagcttgggcaacatggtgaaaccccatctctactaaaaatacaaaaattagcctggtgtggtgataggcayctgtagtctcagctactcaggtggctgagtcaggagaatcgcttgaacccaggaggctgaggttgcagtgagtggagatcacattactgcactccagcct

SEQ ID NO: 24859 - DNA, 201 bp, Homo sapiens
tatcagccttgtttgggtttttcagtggaagctcattcacgtatgcaataatgggatgctgggtggtctaagttgccttttgatttttagtctccgggaaytccagtgttcctggtgttatttggtatgtctgtggctttaatttcctttttaatttctgttgaaaggaagaaagaactctgtggagttataatctgcaga

SEQ ID NO: 24860 - DNA, 201 bp, Homo sapiens
ccagttgttggctgtgcctttggggcagcggagtctggagcccggatcatccatcagggctatcagccttgtttgggtttttcagtggaagctcattcacrtatgcaataatgggatgctgggtggtctaagttgccttttgatttttagtctccgggaactccagtgttcctggtgttatttggtatgtctgtggcttta

SEQ ID NO: 24861 - DNA, 201 bp, Homo sapiens
atcaatatgctcagatctcttattggagagagtaagttatcaccaagacccctgccagccccatttcagccaattccagcatgcagggaagaggttgaggwttggccttcggtgtggtcagggtcgggaggctggtccccagaagaagccagttgttggctgtgcctttggggcagcggagtctggagcccggatcatcca

SEQ ID NO: 24862 - DNA, 201 bp, Homo sapiens
cacctatctctgctggcctctcaagggcactgcattgtccttcagttcctgggcgtgaatctgctcatcaggcaccatttaccttctccagccctgtgccytgttcctaaatcaaggcttacacccaccaagagcagggtttcttttatcccactgtaatcactcctaatgtaatcaatatgctcagatctcttattggag

SEQ ID NO: 24863 - DNA, 201 bp, Homo sapiens
gtttggagggctcagtcctgctttctgctctcctcttgcctttggttctcctttggcaggatcccgcaggaagcgttagaaccccaccactgctcccgatkccttgcttctgtctgctgctggtccccgctgcctgcactgcccgccccctcatcacctatctctgctggcctctcaagggcactgcattgtccttcagtt

SEQ ID NO: 24864 - DNA, 201 bp, Homo sapiens
gctgtttggagggctcagtcctgctttctgctctcctcttgcctttggttctcctttggcaggatcccgcaggaagcgttagaaccccaccactgctcccsatgccttgcttctgtctgctgctggtccccgctgcctgcactgcccgccccctcatcacctatctctgctggcctctcaagggcactgcattgtccttca

SEQ ID NO: 24865 - DNA, 201 bp, Homo sapiens
ctgcgatgctcctccccacccttcacgtacagtgctgtttggagggctcagtcctgctttctgctctcctcttgcctttggttctcctttggcaggatccygcaggaagcgttagaaccccaccactgctcccgatgccttgcttctgtctgctgctggtccccgctgcctgcactgcccgccccctcatcacctatctct

SEQ ID NO: 24866 - DNA, 201 bp, Homo sapiens
ggcttatgctgggaccccaccagggacaaatgaggccgatttggagacactgtggaaccaggaagtcagtctgcacattgtgatctgcgcctgcgatgctyctccccacccttcacgtacagtgctgtttggagggctcagtcctgctttctgctctcctcttgcctttggttctcctttggcaggatcccgcaggaagcg

SEQ ID NO: 24867 - DNA, 201 bp, Homo sapiens
tagctgtttccctcctcacccttagtattattgttcacagtgtccagagtgtttgttccagggcagttatcatacttatcagttgtgcctttatgattgtrggtctgcactctgatctgtgcattccatgtaagcagggatcatacttgtttcattcacttatgtgtacctagatcctggtacacagaggcagtagagtgc

SEQ ID NO: 24868 - DNA, 201 bp, Homo sapiens
catttgacaaaagtcacacagcttggggtagcctggtgattcccttaaccacggctctcccaactgggctctgcaaggtgggtattttgggagttttttcmctgcacctggagtgaaatctgaaccctttaccacagactacatgccctgtatgttctaactggtcttcaagcacatcttctcctggtatcctccaccttg

SEQ ID NO: 24869 - DNA, 201 bp, Homo sapiens
cagagagatgaactcatttgacaaaagtcacacagcttggggtagcctggtgattcccttaaccacggctctcccaactgggctctgcaaggtgggtattytgggagttttttcactgcacctggagtgaaatctgaaccctttaccacagactacatgccctgtatgttctaactggtcttcaagcacatcttctcctgg

SEQ ID NO: 24870 - DNA, 201 bp, Homo sapiens
attcttattcctgttttacatataagggtagtgagacccagagagatgaactcatttgacaaaagtcacacagcttggggtagcctggtgattcccttaamcacggctctcccaactgggctctgcaaggtgggtattttgggagttttttcactgcacctggagtgaaatctgaaccctttaccacagactacatgccct

SEQ ID NO: 24871 - DNA, 201 bp, Homo sapiens
tattggctgaagccaggctgccttttattgagtctgcctccgcctcattatttacatagactgtaaaataaagcttaactcaaaattaccgtaagtcagcrcatccgagtgaagccggcagctggaccttcacaattgaaagcagactaaataaaagggggaggatgaaaaaagaagagctgcaaataagatgtcagggaa

SEQ ID NO: 24872 - DNA, 201 bp, Homo sapiens
tagccacaaatgtctgccccttggcctggcagatgtcctgttttccaggagtccagccaggctgtggcacagtgccgaccccctgactcttgtccgagggkctgtgccaaccacccggactcctaaagtccggctgtggctgtagagttgaatattggctgaagccaggctgccttttattgagtctgcctccgcctcatt

SEQ ID NO: 24873 - DNA, 201 bp, Homo sapiens
tccagccagagaggctgcaaggtggcatggccaagtgcacgggtgtggaaagggtgaagaattggaaacagttatgcctctttcacagtgaagtttggagrgggagtaggccctagccacaaatgtctgccccttggcctggcagatgtcctgttttccaggagtccagccaggctgtggcacagtgccgaccccctgact

SEQ ID NO: 24874 - DNA, 201 bp, Homo sapiens
ctctataagcatattttaagcatctgctcatttgtcccattgaccccaaggtaagtcacatgaccaagcccaagatcagtggggcagataaatatattctrtctccagccagagaggctgcaaggtggcatggccaagtgcacgggtgtggaaagggtgaagaattggaaacagttatgcctctttcacagtgaagtttgg

SEQ ID NO: 24875 - DNA, 201 bp, Homo sapiens
tgttttaggtgctgggaaaccaaaaggaaaaaactccatccccagcccctaggagcctgtagtctagtgaaggagataaacttgtgaacagataattcctrtctaactgcttgcttccttttctatgcactcatggtactgcctggtgtgatggttcatgcctgtaatcccagcactttgggagggcatggcagaaggatt

SEQ ID NO: 24876 - DNA, 201 bp, Homo sapiens
atgtaagcacgtacacccagggcattctaccctgtcctgtaaaacagcaagggcccactttgtccaccaccacaatggcgatggctcctgggaagggtgcrccatgagtatcaaattattatggttcgggaaaataattgctggttgtggaattctggagaagtagtatcgcaaaagagagacatgcacagaagtgttcag

SEQ ID NO: 24877 - DNA, 201 bp, Homo sapiens
aaatgggccctcaccagaccctaattctaccaggactttgatcttagacttcccagcctccagaaccaggaggaataaatgtttgttgttcacccggtccrtggtattttgttagagcagccccaactaagccaccgcctctctagttcactattctgtccccggtacccagggcatcatagacactcaacaaccattcgt

SEQ ID NO: 24878 - DNA, 201 bp, Homo sapiens
caccacacacgtctcctgcagagaaccagtgccaatctccttcaccagaatattttctgctccacagatagtgatagttgtagcagtagttgtactcattkgaaactgtcctgtgagtgtttagtatgtgctaggcactctcctgagcactttatgcatattatttatttaaaccttgtgagatcttagactaagttagca

SEQ ID NO: 24879 - DNA, 201 bp, Homo sapiens
gatgtaacaggcattttttttttaaatggttagatctcttcttcactgagtgaccttataacaccacacacgtctcctgcagagaaccagtgccaatctcyttcaccagaatattttctgctccacagatagtgatagttgtagcagtagttgtactcattggaaactgtcctgtgagtgtttagtatgtgctaggcactc

SEQ ID NO: 24880 - DNA, 201 bp, Homo sapiens
ctcccttggctatatttctagtctggaaacaaatacacaagtagtgtgtgattgtctctgtcttcatatttagttgggacaagccgaagctgtatgatgaygtaacaggcattttttttttaaatggttagatctcttcttcactgagtgaccttataacaccacacacgtctcctgcagagaaccagtgccaatctcctt

SEQ ID NO: 24881 - DNA, 201 bp, Homo sapiens
gaattattaaactaggacaaacctaaaacatcggaacaccccagcagagctggaactgaactggttgttgcctggctccctggttcccacccagcgtgacrgtgtgatgggcagtgtgacagccgtggctgctgtggtgtctgcaactgagcttccacttcagctctgctctgattcaggagcagtgtcagtgatggcctt

SEQ ID NO: 24882 - DNA, 201 bp, Homo sapiens
cctcccagagtgcagggattatacaggtatgagccaccgcacctggcctgcctaagtaatcatttagagcaaaagttgtgaggtagaatctggaaggaaarggaggaaggagcctctgagatcagtgatccattctagacaatcacactttgagacatttggcgtagatgagtcaccttagactaatttatggtgtgtttt

SEQ ID NO: 24883 - DNA, 201 bp, Homo sapiens
gctgccatgcccggctaatttttgtatttttatagaggtggggtttcaccatgttggccaggctggtctcgaactcctgacctcaggtgatctacccaccrgtgatctgcccaccttggcctcccagagtgcagggattatacaggtatgagccaccgcacctggcctgcctaagtaatcatttagagcaaaagttgtgag

SEQ ID NO: 24884 - DNA, 201 bp, Homo sapiens
ctgtgctaggcatggaggatatggaggagaacattagatgtgagaaagtttttaaaaataaagtccttctgctttgggtataaatctcaggagtaagctarttttgcaaggcctcccccttaccttagcatgtatattaacatattcatgatataaaacattaagagcccaggttctggataggtcaggcaacagctgtac

SEQ ID NO: 24885 - DNA, 201 bp, Homo sapiens
acgactaggatataaaaggcgacatggcctcttccatgtccagaatacccctcttgagagcttcagccaccatgtgaatgtggtgccctgagactgccatmttgtgaggaagcccgaactatctacacaaagagaccctggagaggccaatgagaggagagagatgcttgggccacccctggctgcttcagccactgctgt

SEQ ID NO: 24886 - DNA, 201 bp, Homo sapiens
caccggaacttttagaagacttttagaagatttgttgctgctgtgagtgacatcagttcacacagcctgagagagaactctcagtccatgctgtccctccktgggctcactcaagtgaaatgggtcgagctgcaacactgtgcggtgccaaccgggagaaatctgcctatcggggctgagagacatcctgtagtggctgcc

SEQ ID NO: 24887 - DNA, 201 bp, Homo sapiens
ttcatgcgattctcctgcctcaacctcctgagtagctgagattacaggcccacgccaccacacccagctaatttttgtatttttagtagagacggagtttygccattttggccaggccggtctcaaactcctaacctcaggtgatccacctgcctcggcctcccaaagtgctgggattacaggtgtgagccaccattccca

SEQ ID NO: 24888 - DNA, 201 bp, Homo sapiens
gcttaataagtgccttcgatgagaaaaagatctctcacttggaataccccagagatgagcagtttaggccaacagggagctctccgctcctcaggaattcyaagaccactacagtggttactatttctgagacatcagaaagcggggaagtacagaaggagaagactgaaattaaaaaaaaaagaaagaaaaaggaaataa

SEQ ID NO: 24889 - DNA, 201 bp, Homo sapiens
gcccggcccagtctggttcatctttagttcattttgtggaatgcctctaaatgacacttacccatcttctcccattggttctcttccttgagattttgtgmcctttatcatgtgtctgctgctcaaatttgcatcagtaggtcagctgttattgaaaccctcctttttttctttaagaaaatttatttgtacctctacagc

SEQ ID NO: 24890 - DNA, 201 bp, Homo sapiens
tgggattacaggcgcctgccaccacacccggctaatttttatgtttttagtagagatggggtttcgccatcttggccaggctggcctggactcttgacctygtgatccacctgcctcggcctcccaaagtgttggggttacaggcgtgagccaccacgcccggcccagtctggttcatctttagttcattttgtggaatgc

SEQ ID NO: 24891 - DNA, 201 bp, Homo sapiens
tttcctctctggaaacccaccatgttatcagtctgtttcatcttttttttttttttttctttctctgagatggagtctcactctgttgcccaggctggagygcagtagagcgatctcagctcactgcatcctccgcctcccgggttcaagcacttctctgcctcactctcccgagtagctgggattacaggcgcctgccac

SEQ ID NO: 24892 - DNA, 201 bp, Homo sapiens
gggagtgggagacgtgaaactgttagggtgcattgaggctgactgctgggggccccctccctgcaggatccaatgagaaggtggagacagaggaagaaacscaggagaaatgagatgttcaaccctggaaaagaaattcataggagcagctcgttatcactgcatgccgtgagaattctgcttatccttgtgtcttactga

SEQ ID NO: 24893 - DNA, 201 bp, Homo sapiens
caatgcagagaggaacgcagaagccccaaagctagggcttctttgagaagagagctcagaagaaccggagtggagtttggtcaaggagagaatctttgtcrtggacgggggaagaacagcctgcagggaagctggagtggtccgtggtggcctgcgtggactgggggcctgggaaaccatgggaaggatgttgcgctctct

SEQ ID NO: 24894 - DNA, 201 bp, Homo sapiens
tgaggcaggagaatggtgtgaacccaggaggcagagcttccagtgagccgagatcgcgccattgcactccagcctgggtgacagagcgagactccatctcmaaaaaaaaaaaaaaaaaaaaaaaaaaaagatgcattccagtttcagaatgttaaaatgtaaaataaaaattgtatcttagaattgaagaacggtaatagg

SEQ ID NO: 24895 - DNA, 201 bp, Homo sapiens
gaggctgaggcaggagaatggtgtgaacccaggaggcagagcttccagtgagccgagatcgcgccattgcactccagcctgggtgacagagcgagactccmtctccaaaaaaaaaaaaaaaaaaaaaaaaaaaagatgcattccagtttcagaatgttaaaatgtaaaataaaaattgtatcttagaattgaagaacggta

SEQ ID NO: 24896 - DNA, 201 bp, Homo sapiens
cacagcctcccgagtagctgagaggcgcccgctactatgtctcactaatttttgtatttttagtagagacggggtttcaccacgttggccaggctggtctygaactcctgacctcaggtgatctgcccacctcagcttcccaaagtgctgggattacaggtgtgagccaccatgcccagcctctgtttgtagtttaacagg

SEQ ID NO: 24897 - DNA, 201 bp, Homo sapiens
ggctggagtgcaatggcgcgatcttggctcactgcaacctccacctcccaggttcaagcagttctcctgccacagcctcccgagtagctgagaggcgcccrctactatgtctcactaatttttgtatttttagtagagacggggtttcaccacgttggccaggctggtcttgaactcctgacctcaggtgatctgcccacc

SEQ ID NO: 24898 - DNA, 201 bp, Homo sapiens
atcctcaggaaatgtctgtctgtaatttttctttttctttttctttttttttttttgagacagagtttcactcttgtcacccaggctggagtgcaatggcrcgatcttggctcactgcaacctccacctcccaggttcaagcagttctcctgccacagcctcccgagtagctgagaggcgcccgctactatgtctcactaa

SEQ ID NO: 24899 - DNA, 201 bp, Homo sapiens
tgtcctcctcccccgctgaaattcttgtgttaatgtcctaaaccccagtgcctcagagtgtgaccttatttggaaatagggtcattgcagatgttacttgygaagatgaggtcatactggagttgtgtggggctctaatctgatatgaccggtgttcttataagaagggaaatttggacaccgacatcacacagagagatc

SEQ ID NO: 24900 - DNA, 201 bp, Homo sapiens
gagtgtatgcattcttcaagttggcatttttgtccttggggaggtaatgggtaggtgaggtgttacctcccctgtgccaggcccctggctgcatgcagggrtatagaagtggtcttggccccttgttgaattgtcctcctcccccgctgaaattcttgtgttaatgtcctaaaccccagtgcctcagagtgtgaccttatt

SEQ ID NO: 24901 - DNA, 201 bp, Homo sapiens
ggtgtgtgtggttgtaagagtgtatgcattcttcaagttggcatttttgtccttggggaggtaatgggtaggtgaggtgttacctcccctgtgccaggccyctggctgcatgcagggatatagaagtggtcttggccccttgttgaattgtcctcctcccccgctgaaattcttgtgttaatgtcctaaaccccagtgcct

SEQ ID NO: 24902 - DNA, 201 bp, Homo sapiens
tgttccttctgcagaatttgtgtgtgtgtgtgtgtgtgtgtgtgtgtgtgtgagagagagagagagagagagagaaagacaaggcggtgtgtgtggttgtragagtgtatgcattcttcaagttggcatttttgtccttggggaggtaatgggtaggtgaggtgttacctcccctgtgccaggcccctggctgcatgcagg

SEQ ID NO: 24903 - DNA, 201 bp, Homo sapiens
tgagtgaggttggaagtgggtcctcccctagtcaaacagagacatctgcagccccggctgacacgccgactgtagccttgtaagactccctgagccagggygtggccactcctgggtttctgacccatagaaactgtgagatcataaatgtttgtttgtttaaacctctaagttttgggggtcattttttctgccacatta

SEQ ID NO: 24904 - DNA, 201 bp, Homo sapiens
tgccaatagccacatgagtgaggttggaagtgggtcctcccctagtcaaacagagacatctgcagccccggctgacacgccgactgtagccttgtaagacwccctgagccagggtgtggccactcctgggtttctgacccatagaaactgtgagatcataaatgtttgtttgtttaaacctctaagttttgggggtcattt

SEQ ID NO: 24905 - DNA, 201 bp, Homo sapiens
caagggacggaaggagggctccaacctaagctagcggggaaccgaggcctgccaatagccacatgagtgaggttggaagtgggtcctcccctagtcaaacrgagacatctgcagccccggctgacacgccgactgtagccttgtaagactccctgagccagggtgtggccactcctgggtttctgacccatagaaactgtg

SEQ ID NO: 24906 - DNA, 201 bp, Homo sapiens
tgccctcgctggctagctctctcccactcttgaggcaagccagctgccatattgtgagccgccctactcagaggcccatatggcaagggacggaaggaggkctccaacctaagctagcggggaaccgaggcctgccaatagccacatgagtgaggttggaagtgggtcctcccctagtcaaacagagacatctgcagcccc

SEQ ID NO: 24907 - DNA, 201 bp, Homo sapiens
cccgaggttagatgatggagccactctagcattgtcttgcctgccctcgctggctagctctctcccactcttgaggcaagccagctgccatattgtgagcygccctactcagaggcccatatggcaagggacggaaggagggctccaacctaagctagcggggaaccgaggcctgccaatagccacatgagtgaggttgga

SEQ ID NO: 24908 - DNA, 201 bp, Homo sapiens
gattgtgactcgcttttaacaaagaaaatgcagcaaaagtggcggctgtcagtcccgaggttagatgatggagccactctagcattgtcttgcctgccctygctggctagctctctcccactcttgaggcaagccagctgccatattgtgagccgccctactcagaggcccatatggcaagggacggaaggagggctccaa

SEQ ID NO: 24909 - DNA, 201 bp, Homo sapiens
ggtttcaccgtgttagccgggatggtctccatctcctgacctcatgatccgcccgcctcggcctcccaaagtgctgggattacaggcgtgagccaccgtgyctggcccagtatttaatcattcttaagtgtgtatgtgtcctggactcacttactcagggtgccctaagacgttcagtgaaaagactcccaagtctaagac

SEQ ID NO: 24910 - DNA, 201 bp, Homo sapiens
tgcctcagcctccagagtagctgggactacaggcgcccaccaccacgcccagctaatttttttgtattttttagtagagacggggtttcaccgtgttagcygggatggtctccatctcctgacctcatgatccgcccgcctcggcctcccaaagtgctgggattacaggcgtgagccaccgtgcctggcccagtatttaat

SEQ ID NO: 24911 - DNA, 201 bp, Homo sapiens
ctctcagttatgtgggagaaaatgatattttatcatatttatcttgatggggtagagcaaactggctggctccaagaccagaaagagagtgcttgaaatawttctcttccaatttgactagggtatgaaatagtggtttctccactttagcaacaccagtttatgggagcccctcctcctctctctccttatctgggattt

SEQ ID NO: 24912 - DNA, 201 bp, Homo sapiens
acggggtttcaccgtcttagccaggatggtcttgatctcctgacctcgtgatccacccgcctcggcctcccaaagttctgggattacaggcgtgagccacygcacccggccgacccactgccatcttaacaatactttttgatgcactgagtactctgctaagcacctctgtacatgagctcacttagtcaaactttgttc

SEQ ID NO: 24913 - DNA, 201 bp, Homo sapiens
gcctcccaggttcacgccattctcctgcctcagcctcccgagtagctggaactacaggcgcccgccactacgcctggcttattttttgtatttttagtagmgacggggtttcaccgtcttagccaggatggtcttgatctcctgacctcgtgatccacccgcctcggcctcccaaagttctgggattacaggcgtgagcca

SEQ ID NO: 24914 - DNA, 201 bp, Homo sapiens
catagataggaaggattgaggaacattttctatggcgattgtttctttttttggggggatggcatggacggagtcttgctctgtcacccaggctgaagtgyagtggcgtgatcttggctcagtgcaacctctgcctcccgggttcaagcgattctcctgcctcagcctcccaagtagctgggactacaggcgtgtgccacc

SEQ ID NO: 24915 - DNA, 201 bp, Homo sapiens
aatctaaatctatatgcctgaggtccataggaaagaaaagacaaaatgtgtattggcatagactttgccaagatttgtgcagagaacagctgtgggaggcragtcttggatagaattagcttctgattgtctttgcctggaaaatgcctttcttgggtcgactcttcacagtggttctcaaagtataatcctcagtccggg

SEQ ID NO: 24916 - DNA, 201 bp, Homo sapiens
tttatgctattaaaaatgaacgagtgaatgaacagatggtcatacataacaactggtgagagtgggctacaaaccaaggattatggtcaatctaaatctakatgcctgaggtccataggaaagaaaagacaaaatgtgtattggcatagactttgccaagatttgtgcagagaacagctgtgggaggcgagtcttggatag

SEQ ID NO: 24917 - DNA, 201 bp, Homo sapiens
gattagaaatactaagatttaaaatgcacatctgttttaaggcatccgaaagaatatatatttctaatgttataaattggtatcatctgtatgtaatcttkcctattttcacttagtattatattgctgtgattcacctgtattgtttgttgttggagattgtttgtcttgacttatgttcagtgttctactgtatgattg

SEQ ID NO: 24918 - DNA, 201 bp, Homo sapiens
cctgaattaaatatcatctatacatttctcttcaaaactgtaatatgccccaactgtgttacatactgtcatgttactctcctgtggttttctgagacaaygctttattggggcaatccaggttgtttctttcccttgaattacttctttgggataaagtctgcagagtgggatgtctgcacaggtgtctgttacacctca

SEQ ID NO: 24919 - DNA, 201 bp, Homo sapiens
aatgaggcagagtaagtcttgtgtccaggtttggctggccagccttacagcatgggctttgagtctgccagcttagaagataagcttactgcttcctgagygggacacacgccaggctggaagaagttccagggtccccaagggaacttgctggcctccctggtaatgtgctgtgttttccctctgcagcagcaaaccctc

SEQ ID NO: 24920 - DNA, 201 bp, Homo sapiens
ggcaaaatagataacagagaccagagacttggaagggtgagtagggggaagggaggaagataaagagatgaagagaagtgggttaaaggatacaaacatasagtgagataaaaggaaaccagagtagggtgaatatacttaacaaaaatgtactgcacttgagtaatggacacctgaataccctgacttgatcacatcatg

SEQ ID NO: 24921 - DNA, 201 bp, Homo sapiens
ggtggagagtggcaaaatagataacagagaccagagacttggaagggtgagtagggggaagggaggaagataaagagatgaagagaagtgggttaaaggayacaaacatacagtgagataaaaggaaaccagagtagggtgaatatacttaacaaaaatgtactgcacttgagtaatggacacctgaataccctgacttga

SEQ ID NO: 24922 - DNA, 201 bp, Homo sapiens
tggccagccttcgggttgaccatttcgggtgaggcatttagcatgtcggggtggagagtggcaaaatagataacagagaccagagacttggaagggtgagyagggggaagggaggaagataaagagatgaagagaagtgggttaaaggatacaaacatacagtgagataaaaggaaaccagagtagggtgaatatacttaa

SEQ ID NO: 24923 - DNA, 201 bp, Homo sapiens
gtggctgctggccagccttcgggttgaccatttcgggtgaggcatttagcatgtcggggtggagagtggcaaaatagataacagagaccagagacttggargggtgagtagggggaagggaggaagataaagagatgaagagaagtgggttaaaggatacaaacatacagtgagataaaaggaaaccagagtagggtgaat

SEQ ID NO: 24924 - DNA, 201 bp, Homo sapiens
acatacacttacttgtagacatacacacacataaacacgtatgtggcgtttttccttggaaagtttgagaggttgaaagggtctaagactgaaggaaaagyaagtagatgacagtagtttcagcaaggatgactctgcacagctttccccatcaggacgtttacataagcttatgaacgccccgtcttggagcacttagaa

SEQ ID NO: 24925 - DNA, 201 bp, Homo sapiens
cttgctactagtcttttgggttatatgcattaaaaccaatctgtgacttgctttttaaacatacatacacttacttgtagacatacacacacataaacacrtatgtggcgtttttccttggaaagtttgagaggttgaaagggtctaagactgaaggaaaagtaagtagatgacagtagtttcagcaaggatgactctgca

SEQ ID NO: 24926 - DNA, 201 bp, Homo sapiens
taaatgggcctcctaggtggacgtaccaatttgcacccccacttgtaacttatgagacttcctctccctccacattcttgccaatgacctggtactttaaraccttgagtgtggcacgtcatcaccagtgacagtatacattatttcacggttttactgaccatttgctgttcctcttatgtcaattgcctgattacatcc

SEQ ID NO: 24927 - DNA, 201 bp, Homo sapiens
cagtgacgctccctgccccgcccaggccttactgcaccccaggtctgctgctggaggcaccctgcccattcagcccacctgtgttataggttgtacccacrttcagtggttcctgagctcttgtcccatgtccaagaagaatgagatatgctgacaatttgaagggtgaatgggggtagagaagaattttattgagtgata

SEQ ID NO: 24928 - DNA, 201 bp, Homo sapiens
tcagaattttaaaataataaaatattaccaaatataattagaaatctcagccatacgtctttgggatcttctcttttctccagaggcatccattgctctgkacttggggttgtttattcccattaaggttttttttttctttctgtatatatctttttaatcctgctatgataagtagcattctcttgcatggggtaactt

SEQ ID NO: 24929 - DNA, 201 bp, Homo sapiens
gggtacaggagaaattttgttacatacacataatgcatgatgtgatcaagtcagggtattcagctgtccattactcaagtgcagtacatttttgttaagtrtattcaccctactctggtttccttttatctcactgtatgtttgtatcctttaacccacttctcttcatctctttatcttcctcccttccccctgctcacc

SEQ ID NO: 24930 - DNA, 201 bp, Homo sapiens
tttttatctttattttttaaatttatgcatatatatggggtacaggagaaattttgttacatacacataatgcatgatgtgatcaagtcagggtattcagstgtccattactcaagtgcagtacatttttgttaagtgtattcaccctactctggtttccttttatctcactgtatgtttgtatcctttaacccacttctc

SEQ ID NO: 24931 - DNA, 201 bp, Homo sapiens
gctgggagaggcccagaggacctgttgagcagacttaggaaggaggaactgacaggtgtcaataggcaagccaaggtcaaggcagcgagcattttccaagycacaaagggtgcagggcttgttgtcgggatgatttgcagggagactgcttcagtgggctctggtttcctggggccaggcgccctctatcctctagaagag

SEQ ID NO: 24932 - DNA, 201 bp, Homo sapiens
actggtttcctttggaaatctttctggtttgccaaggctgggctgggtcatcctcctgtgtgttctcagaccatacaggactttcttcaaacaaatgtcamctcatcagagaggccttccatgaccactctatgaaaaatgacccctctcctccccagtctcacactctgtttctgtcccctgcttcatccttccccacac

SEQ ID NO: 24933 - DNA, 201 bp, Homo sapiens
tttttttgtctttagttttcatcagttagatcatagcgtgtctgggtataatttctttgagtttatcctgttagggttctctgagctatttgaatctgtargtttttgtcttttgctatacatgttcagctattatttcttcagatattttaaaagtattatacgttttctcctttctttatgggagtctaatgacaacaa

SEQ ID NO: 24934 - DNA, 201 bp, Homo sapiens
agcttgatctctgcttcctgctgtccatggggatcttataatctaagggagaaattacacacacacacacacacacacacacacacacacacacacacacmccccagaataatccaatggcaataaaatgcaagtatgacgcattatagtataagcattctaaatgattatgtcatcctatatattccctgccataattaa

SEQ ID NO: 24935 - DNA, 201 bp, Homo sapiens
gagttcaagaccagcctaggcaacaaggtaaaaccccatctctacaaaaagtacaaaagttaagtaggcatggtggcacatgcctctagtcccagctactygggaggatgaggtgggaggatgcttgagcctgggaggtcaaggctgcagtgagctgagatggcaccactgcactccagcctgggcaacagagtgagaccc

SEQ ID NO: 24936 - DNA, 201 bp, Homo sapiens
atgaggatgatgataaatagcataagcattaccattaattgagcatctactgtattctatgctctatactgttttgtatagattatctcacttaatctttrctagagcccaaggtagtagatatcacctccaatttactgataagtgctgtggatacaactggttggggctgatgttgtgggtggtgaaagaataccgaga

SEQ ID NO: 24937 - DNA, 201 bp, Homo sapiens
ataataagctttctaaactttggtcatcagaaaaaaatttctgtcagcccaaggatcagtttttaaattctatgaacttagtgatgatgaggaggatgagratgaggatgaggatgatgataaatagcataagcattaccattaattgagcatctactgtattctatgctctatactgttttgtatagattatctcactta

SEQ ID NO: 24938 - DNA, 201 bp, Homo sapiens
gctccctcagggacgcagggcacaggggacctactgccgccactgctgctcctgcagccactcctgctgccacagctcacgcttccttactgcagctggtrtgatggcagcggccactctgaacagcccactgctgccatcagtactatagatactcttttctactttacttttttgacttatcagtatgtcctagaaatc

SEQ ID NO: 24939 - DNA, 201 bp, Homo sapiens
ccacactgcttccctaccagcggacgattcagcttggccctgtcacagtggctcccagggtggcgggcaaggtgcaggtggtacggcagccccagtcaacyccacacaaatgaacctgacgcttccagggccagtcccataagtcccagctgtgccatcagctgggtgctcgcaggcccctgggatacagcggagagcgag

SEQ ID NO: 24940 - DNA, 201 bp, Homo sapiens
taaagagtgtatcacaaacctggcttggggttgctcctaggtctgggctccccaaagggccacagctcttctcttccttcttctctcctcttgtctgctgygacatggtgggcaaacagcatgtttcagccctgtttgtgttatagctcttttagccttgccattcagtgagtccctagttcttgtcctgcatccgggaag

SEQ ID NO: 24941 - DNA, 201 bp, Homo sapiens
cagccaatacgcctggcctagccttcccactttctttatttgcaacttctttctctgacagaaatcttacaatatatttacatatttgttcacccctagtrcacccagaagacagtttcagaattgatgacccatacccttgggagaaacaaatataactagtgtacagtattgtagattttttttttctttagctttatg

SEQ ID NO: 24942 - DNA, 201 bp, Homo sapiens
tctctcagcagacagagctaggaaatgtatgtatgtgcattatcccttacatacacacaagtcaatatttatttttgtctgtctgtccatccgtccatccrtccatccatccatccatccatccatccatccatccatcctgtctgtctaatttttaaagaccttgagttcatactggtgacctccaattccttcaaattt

SEQ ID NO: 24943 - DNA, 201 bp, Homo sapiens
gtcttctctcagcagacagagctaggaaatgtatgtatgtgcattatcccttacatacacacaagtcaatatttatttttgtctgtctgtccatccgtccrtccatccatccatccatccatccatccatccatccatccatcctgtctgtctaatttttaaagaccttgagttcatactggtgacctccaattccttcaa

SEQ ID NO: 24944 - DNA, 201 bp, Homo sapiens
ctttcccagcagaagctaaaatgcccatctgtgcagaaaaagcattaacgcagcaggcctgactgctgccctttgaaaagtctgcttggaacattggcccytggctggcagctgggaacctaaatttcagtaggtttcccattacccaactgttaatggtggctcactgtgcctaaactggctgtgcagacagtgtagttg

SEQ ID NO: 24945 - DNA, 201 bp, Homo sapiens
caactgagcatgctgaccaggcaggaagtctcattagtaattcctgaaaagggtgcaagggcagggccaaagagctggttaattgaatgatggctaattcrtttataattattcatattttcactcttttctctttctcccataaaacctagtcctctggagctgggctggtccttagagaaatctaaggaggcggcagag

SEQ ID NO: 24946 - DNA, 201 bp, Homo sapiens
cacacactagtttttgagaccatgctgtaagagcatgtttaccaaaatgtccacagaatacttccccacgtggtggcaatttgttataaattttacatctrtctttgtatgttcctccatggtttgactttttcacagtgagctatgtcttgtgtttataaaagcaagggtggtgatattgtggaacagctcctcattcgt

SEQ ID NO: 24947 - DNA, 201 bp, Homo sapiens
aggaatgcaggatcccaggctccaccccagacccactgcattttaacaaggtcctggggcaatccatttgcacacactagtttttgagaccatgctgtaaragcatgtttaccaaaatgtccacagaatacttccccacgtggtggcaatttgttataaattttacatctgtctttgtatgttcctccatggtttgacttt

SEQ ID NO: 24948 - DNA, 201 bp, Homo sapiens
aatgtccatcagtaacgggatttatggatacatagacacagtaaagttacccttagccattaaaaatgatgatgtgtaccagtagttattgacaagaaaakatgtcacaacatattatgtagcaaaaacaggtttcagaatagcatatattttaagggtgcatttaagtaaaattgcatgctcggatttctgcctattaat

SEQ ID NO: 24949 - DNA, 201 bp, Homo sapiens
tcatagctgtctgtggccagaagacaataccagttcctcagggaggaggcagtcaacagtcaaaaggataccaaaatgtaaagcatgcatgtcctttgacytagcagttatactttcacgagataatatacaagtgggaaaaatatatgtatctggctgtgcattgtttattgaaaacaccccaaatgtccatcagtaacg

SEQ ID NO: 24950 - DNA, 201 bp, Homo sapiens
aaaagggcctttttgcttgaacaaaaaccatttgtatatgagcccacagcttttgtgtgtgaagcagaatttgtatcttgcacacaaatggggaagaagaragcagtgttgaaatggggaaagatcataaagaggccagttgtttccttgtggatatttatctcatggtaactcctctatctggggtgtattagacttggc

SEQ ID NO: 24951 - DNA, 201 bp, Homo sapiens
gttcatagcacatttttttatgagaaatagggcttttttttttttaattaatgaaaagatgccaggtacttttgcgtatatgagaagcttgttcatactgrcctcctttcagttcctcctttaccacattgttctgcctccaggcctttacacaggcggcttggaacatctttgattccacaattccacaaacactaaaat

SEQ ID NO: 24952 - DNA, 201 bp, Homo sapiens
tctttttcgttctctttctcttggccaggtgttttttttagctaagggcctcttgctagcaggaatcattcttgcagcccccacacttggttctgtgtgtrgcataaagtgagtttgagaattaatgttggtggaatgaataactgaaagagcaaagccttagactgtctaaacattacattgatttccacctcatttttc

SEQ ID NO: 24953 - DNA, 201 bp, Homo sapiens
cccaggtgtcctaacttctcccagatttctgtacaagccataacctgtttcaactctgagcttcagttcatgccattcctcttgtctggagtgtccttccmtcttttttttcactaacacactcctaataatctttcatacccaactaaaatagcacaggtttatgaagtactccttggcttccccaggctgagtgggtcc

SEQ ID NO: 24954 - DNA, 201 bp, Homo sapiens
gccttctgttttcttgttgatcttcagcctagttattctatccattattgaagatggagtactgaagtttctaactatcattgtttaactgactatttctycctttaattctgtcagtttttgcttcaagaatcttggggctctgtttttaagtacatgtaattatgtcttcctgatagaagacattggctattttatcat

SEQ ID NO: 24955 - DNA, 201 bp, Homo sapiens
acttcaaacttaagaccagaagggttatccacacccaccccactacatcccccagtattgcctaactttgcctggggaggaattggctaattaggactttsctggaaaaaagcaactctttcatttctgatgtcaccagtcttcttagatctcaggatttaccagaaagttttgttctttatttggttatgttcagagagc

SEQ ID NO: 24956 - DNA, 201 bp, Homo sapiens
agaggcctgaaagtccttccctgaggaaggaactgaaataaaacaaatgtaaacttcaaacttaagaccagaagggttatccacacccaccccactacatyccccagtattgcctaactttgcctggggaggaattggctaattaggactttcctggaaaaaagcaactctttcatttctgatgtcaccagtcttcttaga

SEQ ID NO: 24957 - DNA, 201 bp, Homo sapiens
gagaggcctgaaagtccttccctgaggaaggaactgaaataaaacaaatgtaaacttcaaacttaagaccagaagggttatccacacccaccccactacaycccccagtattgcctaactttgcctggggaggaattggctaattaggactttcctggaaaaaagcaactctttcatttctgatgtcaccagtcttcttag

SEQ ID NO: 24958 - DNA, 201 bp, Homo sapiens
ctggtgagtttcagctctttgatacttttttgagaggcctgaaagtccttccctgaggaaggaactgaaataaaacaaatgtaaacttcaaacttaagacmagaagggttatccacacccaccccactacatcccccagtattgcctaactttgcctggggaggaattggctaattaggactttcctggaaaaaagcaact

SEQ ID NO: 24959 - DNA, 201 bp, Homo sapiens
tctggtgagtttcagctctttgatacttttttgagaggcctgaaagtccttccctgaggaaggaactgaaataaaacaaatgtaaacttcaaacttaagascagaagggttatccacacccaccccactacatcccccagtattgcctaactttgcctggggaggaattggctaattaggactttcctggaaaaaagcaac

SEQ ID NO: 24960 - DNA, 201 bp, Homo sapiens
agcagggaagaaatgtaacaatgtgtaagaaaacaggaactgggaaagggcaaggaaacgattatgatgaatagagagtctctgcatttcattgtctggakgtggtgatctggtgagtttcagctctttgatacttttttgagaggcctgaaagtccttccctgaggaaggaactgaaataaaacaaatgtaaacttcaaa

SEQ ID NO: 24961 - DNA, 201 bp, Homo sapiens
cactgacacgacgattattgccaaggaagaagcctttaattaggtgctgcagcttaggagatgggagctcagtcagtctcaaatccatctccctgactgayatggtttggctgtgtccccacccaaatctcatcttgaattgtagttcccataatccccacgtcatgggagggacctggtgggaagtaatttaatcatggg

SEQ ID NO: 24962 - DNA, 201 bp, Homo sapiens
gtgtgtcttagagagccctcctggctggtccctcctgtctcttcagcagcagctccttccctcctgctctccgcccgccagctctgtctcacaccctggtkctgtggcacatgccatttccctctgtgcctctgtcttccaggcacaacactggaatctcactggagcactcacaccacttcccccagaagcaaagagcca

SEQ ID NO: 24963 - DNA, 201 bp, Homo sapiens
gcagactgcctcttcgtcttctctcctttgtttgctgagattctgcccactatctcttggctgcccttctaccttcttggtcttcctccctggatcgtcarttgcctggaaatgaattctgacctttccatctaatacattttcccttgctcatttatttccataaactagtgatcctcagatatttttatttcctgaatg

SEQ ID NO: 24964 - DNA, 201 bp, Homo sapiens
gggccagaagcccacttgtatcctgtttcgccgggggagcctaatctacactcaagtttgtgaattcctcgcagtaattacttctttacctcctcatcttycgtctgtcccttggccccaaactcttcctcaagctagtgtcccactggctcttgttccttctcctttgttgtagccagtgtgtgactccttggccctctg

SEQ ID NO: 24965 - DNA, 201 bp, Homo sapiens
caaagtgctgggtttacaggtgtgagccaccgcacctggctgacagcctgcctttaaacagcaactgaattttatataataggcactgtgcccaatgctckgcatggatgatctcattcagtcctcacatcacctaagttctgctagtatccccattatacagttggagagttgaggcttagagaagttaagtaactggct

SEQ ID NO: 24966 - DNA, 201 bp, Homo sapiens
tgtcacccaggccggagtgcagtggcatgatctcagctcactgcagcctctgcctcccaggttcaagcaattctcctgcctcagcctcctgagtagctgarattacagtcatgcgccactacgcccggctaattttgtatttttagtagagacagggtttcaccatgttggtcaggctggtctcgaactcctgactttgtg

SEQ ID NO: 24967 - DNA, 201 bp, Homo sapiens
gggaggccgaggcagttggatcacttgaggtcaagagttcgagaccagcctggccaacatggttgaaaccccatctctaaaacactaaaagtagctgagcrtggtggcacacacctgtagtcccagctacttgggaggctgaggtgagagaattgcttgaacccaggaggcggaggttgagtgcaccgagattgtgccact

SEQ ID NO: 24968 - DNA, 201 bp, Homo sapiens
gaagtcaatgtgtttcgcaggtttgtggttttttgaaggagaaacatctagattctagtcctgttcctctgcctccttcttaggtgatgttagacaaaatmattcacctctctgagtcaatttgcttatctgaaaaatagcaataacaacagcactcattttactagggcatgtgaataaacagatttttttcccattgag

SEQ ID NO: 24969 - DNA, 201 bp, Homo sapiens
caaattaacacacagagccggaccttgaaggggaaggtcctcatttgtctcagattgggatcatttggggaatcagaaaatgtttatatcagaaaagaagrgaagtcaatgtgtttcgcaggtttgtggttttttgaaggagaaacatctagattctagtcctgttcctctgcctccttcttaggtgatgttagacaaaat

SEQ ID NO: 24970 - DNA, 201 bp, Homo sapiens
cacagacgaggagggtgaggcttctaagagttaagtgactcacttgagctcaaacagctagaagcagtggctccaggattcccccaaggctcctaactctrcagctctccctgctagataataaaataaagaagttattttagtttaagccagaattctgaaacatacacatacacaagcctccacccagcttctaattgt

SEQ ID NO: 24971 - DNA, 201 bp, Homo sapiens
tcggagacataagtgagcccattaagttccacaggcattttatatcccatgcattttaaagggctcccacttgtattcttaaaacctcacgtgtttacacrgaagtcagcgttttaaaatctctggaccatttgttttctgtgtgacagtttacccactttcctcctttaagaaatacatttcactggccaggagtggtga

SEQ ID NO: 24972 - DNA, 201 bp, Homo sapiens
gctcaaactttgcttctgccaatctgataggcgaaaaatggtatccggtaggaaatttaatttgcatctggaggaggggatttttttggaagtgaaagaayaccaagtcacaagtgtcagctgcttgagtgcctttgctggtccagacagcacctctgagtgaattagttaaaggtactcctcctcaagacacttggctgc

SEQ ID NO: 24973 - DNA, 201 bp, Homo sapiens
ctcccagtgttactggttatattgtgtctttccagatatattctatacattctctactgaactttgcttttttccccttatttatatatccttctcatggktccatatcagtatatgtagaggttccctaattttaaaaataggtacaagattgtacggatacaccataatttatttagccaggctgcaactgataaacat

SEQ ID NO: 24974 - DNA, 201 bp, Homo sapiens
accagcctgggcagcatagcaagaccttatgtctaaaaataaaaataaagaaactgagatgcaccatcagcctgggcaagtcttaaaggaagaagacagartgcttatttttttaatagataatacagaacaaatgctacaaagtaggaaggagtaaacaataaaaagtaaatctccctctccacaagcatctattcccct

SEQ ID NO: 24975 - DNA, 201 bp, Homo sapiens
tagcaactttggagaacagtgggacaatttcttctaaagttaaacatatgcttcccatatgacccagaaatctctcagccctatgtatgcccaagaaataygaaaatatatgttagcacaaagaccagcattcctgaaactgggaacagcccagtaccctccctcatctggggaatcaaattgtgatacatccatgcaact

SEQ ID NO: 24976 - DNA, 201 bp, Homo sapiens
aaaaagaaaataccaaaaagctctttttaagacactgtaaagaaaatgaaaagataagccatagactaggagaaaatatttgcaaaacacatttgtgataraatactatgtcacagaacatataaaatgctcttactatccaataataatgtcaaaccaatttaaaaatgggcaaaagatttgaataaacacttcattaaa

SEQ ID NO: 24977 - DNA, 201 bp, Homo sapiens
atattatttttttttaaataatgaacatggatttttataatcagaaataaagttcattttggaagggggaaaaaggcgtgcaagacacactacctcatttygagacttaactataaagctgtagttaacaacacccttattggcataaagatagttgtatagctcaatcatacaaaatagatagtctaagaatagactcag

SEQ ID NO: 24978 - DNA, 201 bp, Homo sapiens
ccgctggcaattcttggtgttccttggcttggttggggctgcatgattccagtttctgccttcaacttcgcatggcctttgcccttgtctgtttctgtgtyatctccttctctgtctctcataaagacactcatcattggatctaaagctctctctaattcagaatgagctcatcttgaaactcttaccttaattatatct

SEQ ID NO: 24979 - DNA, 201 bp, Homo sapiens
cgtttgctagggctgccataacaaatgaccacaaacttggctttgaaacaacagaaatttattctctcacagttctggaggccagaagtgcaaattgaagrtactggcagggtttgttctttctggaggctctgagggagagtctgttccatgcctcattcctagcttctggggccgctggcaattcttggtgttccttgg

SEQ ID NO: 24980 - DNA, 201 bp, Homo sapiens
aagattgagtattcattgaagttactggaaagggaccccattgcaagaacagtacagtgaggtgacagatgttcaggataaatgggacagaggagaggagrgagcagagagaagtattcaggatagcgcaatggattctgacttcagactcctgcacccaaagactagttgtaccacttgtttgctctatgaccttctgta

SEQ ID NO: 24981 - DNA, 201 bp, Homo sapiens
atccaaaaaataaccctagggggtgggttctattatcccattttaaaggtgaggattttgagacacagagaggcaaagtaacttttcctagtccatacagmtagtgagtgacacggctgaggtttgaatctagacagtttgatctctgtaccttccctccaaacagctacaaaaaaggaggggggaaggggtttaacttgt

SEQ ID NO: 24982 - DNA, 201 bp, Homo sapiens
atgtaagacgcggcagagtgtcatacagcccccacagtggcatctctcacttcatgctcaggagctgctcccagtgcttggccatcagtgatgatgatgcygaaccttaactgatgtggcctgggacctgggcctcactgtatcacgagaagagaggatggggctaagatagttgtctctcagcttcatcttcttccatcg

SEQ ID NO: 24983 - DNA, 201 bp, Homo sapiens
gggtcagggtcgttgtgttcagatctgaaatctcaagaagccatgaatttgttcatggtggataaagctcccccttgggagccctgcttacagtgattctstatcagcccgttcccctaaattactcagaaagttttctgcactctgaagctccaagtgtgcacactcagcatttccccgggtaataaagtttcacaggca

SEQ ID NO: 24984 - DNA, 201 bp, Homo sapiens
caggatctgggctctccaagtggacgaatgaattgtggacccagccagactcccctccatcgcatcacagcttggaggctctgtgcccctgtgaatcccarctgttctccctgcctccctctcagcagcgttttctcttctctgccattcagcactcccaaggcccgttttaatctagtgtgaagggtcagactcttcgtc

SEQ ID NO: 24985 - DNA, 201 bp, Homo sapiens
ttcagtcatttgctggtctgccctttaaattaaactttttcaatccgcatctaaattgggatgggtgatgtgcttggaatagggatccgcaaaggcgctcyagccccatgggatgctttttttagacaggaaagtcagggtggatgtggggatgcccttggtttacagtggcccagacaatcccttgatgcttccaggctt

SEQ ID NO: 24986 - DNA, 201 bp, Homo sapiens
atagaaaacctctgcagtcttttggaataagaatgactgaaaatttccagggaagtgtctacttcattcggtcttcagtttagaactttcttctctctctstctctctctcccccacccctctctttctctccccctcgctccctccctctctccctccctgttcctcttccactccccctccccttgctttccctccctc

SEQ ID NO: 24987 - DNA, 201 bp, Homo sapiens
ctcaaggaattaacattagcccttcttgggtcagtttgtattttaggcttgatgggccctagagtcactgtctcaactatgcaactctgccattgtagcakgaaagcagccatagatgatacataatgaatgggaatggctgtgtaccaataaaactttatctatgaaagcagacagtaggctggactgacccctgagcta

SEQ ID NO: 24988 - DNA, 201 bp, Homo sapiens
tacaccttgggaggccgaggcgggcagataacttgaggccaggacttcgagaccagcctggccaacatggcgaaacatcatctctactaaaaatataaaamttagccgggcatggtggcacatgcctgtaatcccagctactcgggaggccgaggcacgagaatcgcttgaacctgggaggtggaggttgtaatgagctga

SEQ ID NO: 24989 - DNA, 201 bp, Homo sapiens
tggcttacaccttgggaggccgaggcgggcagataacttgaggccaggacttcgagaccagcctggccaacatggcgaaacatcatctctactaaaaatayaaaaattagccgggcatggtggcacatgcctgtaatcccagctactcgggaggccgaggcacgagaatcgcttgaacctgggaggtggaggttgtaatga

SEQ ID NO: 24990 - DNA, 201 bp, Homo sapiens
gggtgcactggcttacaccttgggaggccgaggcgggcagataacttgaggccaggacttcgagaccagcctggccaacatggcgaaacatcatctctacyaaaaatataaaaattagccgggcatggtggcacatgcctgtaatcccagctactcgggaggccgaggcacgagaatcgcttgaacctgggaggtggaggt

SEQ ID NO: 24991 - DNA, 201 bp, Homo sapiens
aataacagtattaggccgggtgcactggcttacaccttgggaggccgaggcgggcagataacttgaggccaggacttcgagaccagcctggccaacatggsgaaacatcatctctactaaaaatataaaaattagccgggcatggtggcacatgcctgtaatcccagctactcgggaggccgaggcacgagaatcgcttga

SEQ ID NO: 24992 - DNA, 201 bp, Homo sapiens
gttttataaaataacagtattaggccgggtgcactggcttacaccttgggaggccgaggcgggcagataacttgaggccaggacttcgagaccagcctggscaacatggcgaaacatcatctctactaaaaatataaaaattagccgggcatggtggcacatgcctgtaatcccagctactcgggaggccgaggcacgaga

SEQ ID NO: 24993 - DNA, 201 bp, Homo sapiens
tgttttataaaataacagtattaggccgggtgcactggcttacaccttgggaggccgaggcgggcagataacttgaggccaggacttcgagaccagcctgkccaacatggcgaaacatcatctctactaaaaatataaaaattagccgggcatggtggcacatgcctgtaatcccagctactcgggaggccgaggcacgag

SEQ ID NO: 24994 - DNA, 201 bp, Homo sapiens
ttaaagcaggtctgttttataaaataacagtattaggccgggtgcactggcttacaccttgggaggccgaggcgggcagataacttgaggccaggacttcragaccagcctggccaacatggcgaaacatcatctctactaaaaatataaaaattagccgggcatggtggcacatgcctgtaatcccagctactcgggagg

SEQ ID NO: 24995 - DNA, 201 bp, Homo sapiens
tgttggtaattttacactaaggggaggaagtacaaagtgctccaaatctttctggttttattagtttcctagggctgctgtaacaacataccacaaactgrgtggcttagaacaacagatatttattctttcacagttctggaggctagatgtctaaggcaaggtgtcggcccggccgtggtttctctgaaggttctaggg

SEQ ID NO: 24996 - DNA, 201 bp, Homo sapiens
gcaccatgacacttgcctttgaatatattaatgatagagataattcttcccccctttatgggaatattttgttggaataccaaccaaaagcaatttctttycagcacttccctcaaatagtgctgggtgccaaatagaagggcccactgttcaaaaagtctggaaatatattttctagacaaagatacagtactgatgata

SEQ ID NO: 24997 - DNA, 201 bp, Homo sapiens
tgctttggtatagaatagaaatccaagtctgtatgtgttgggagaagaattgcaccgtctaccttgtgctggagaattccagcattgcatagggatgtcartattgacttcatgcttatcgtgttggatagaatgatttgttagagagccattggagtggggggcatctcaagttgattctactcaaatggcctgtctttg

SEQ ID NO: 24998 - DNA, 201 bp, Homo sapiens
gcaccactccctatggccttcagcactgtaggcctagaacttgcaaaaattactgtcttcctgaccccctcttgccactccagatgtgctctttgtgcctygtggcctatgatgaggacagactttcagttcagatgttggaatcacagcatgaagtttgaggtgggcatctgataagcacccacctacatacagacgttt

SEQ ID NO: 24999 - DNA, 201 bp, Homo sapiens
tgggcggatcacgaagtcagaagatcgagaccatcctggctaacatggtgaaaccccgtctcttctaaaaatgcaaaacgttagccgggagtggtggcacrcacctgtaatcccagctacttgggaggctgaggcaggagaatcacttgaacctgggaagtggaggttgcagtgagccgagatcgtgccactgactccagc

SEQ ID NO: 25000 - DNA, 201 bp, Homo sapiens
ccttgagggactgggatcatatattaagtgtctgtgatactttttcttttgtggtgtctagaagagtgagagtggctcccattcattgaaggtttactctrtctggcagggtggcaagcactgtacgtgtcttattttgttataaacttcttgaattacaaacactgcaaaaataatacacgggggccaggagcagtgact

SEQ ID NO: 25001 - DNA, 201 bp, Homo sapiens
tgtaaacgattatgaaaacaatgcatatgtgaaacacactttccctgcgctctctgtttaatatcccaggttgtgtgccaggtttcccccccattttctgyatttcagaaatattttgtttttcattccagacagtgggagtacaaaggcagatttgtgtcatcacttaatttgttaattctgccaggatttttctcccac

SEQ ID NO: 25002 - DNA, 201 bp, Homo sapiens
ccgccttcccggagggagggagactggttctgtgtcttgcttatgagctacaaagccctttctctgattctttggagcaactgggtacttaaggggaggtkagtgaaggtggcagtgttctcgcctcggagaggtgattacttcaagtgccctgtggagctttggcattggaaagataatacgcttcttaaaaaagagaat

SEQ ID NO: 25003 - DNA, 201 bp, Homo sapiens
cgtgaaaacagaacattagaaagtttagacagtagagggaaggagaaaaagtcccttttctaaaacaaattctactttcatttaaaatttctttctttttyttttttttttttagacggagtcttgcctctgtcacccaggctggaatgcagtggcgtgatctcggctcactgtaagctccgcctcccgggttcacgccat

SEQ ID NO: 25004 - DNA, 201 bp, Homo sapiens
gccattgatcacaatggatcagactggtcagatcgatcagatcctggctcccttgaaaatctccccccagggtccactggtagatgaactcagcaccctgyccacctccaccgccacagcactggtgttctctctttgctttctagcctgagggttggctgttcgggttgggggctttggcactttatgaccatgttcagt

SEQ ID NO: 25005 - DNA, 201 bp, Homo sapiens
ggggtttcaccatgttggtaggctggtctcaaactcctgacctcaagtgatccacccgcctcggcctcccaaagtgctgtgattacaggtgtgagctaccrttaccggccctcctcatgctttgagtttgatgatgtcacttccctaaagcacacggctgtgcaccagctgcatgcctaatgcggttgctcagaagagcaa

SEQ ID NO: 25006 - DNA, 201 bp, Homo sapiens
gagataatggcggcttggattgggtggtgccagttgagtgatgcaaattggatgggtttgaggcaggtttttgaagacagaatcaataagatttaacctgyctttgccttagtttctcctcatgcctttttttttttagacagagttttgctcttgttgcccaggctggagtgcagtggcgtgatctcggctcactgcaac

SEQ ID NO: 25007 - DNA, 201 bp, Homo sapiens
attgttttaacttcattacctctttaaagatcctcatctccaaatacagtcacattcggaggttctagggtttaggacttcaacatgtaaattttgggggsacacaattgagcctgttacacagatgaaaggtaggtggaagaatgtccggggtcagcaaacagcacatctggaggcctcacagcagggggcactgagatg

SEQ ID NO: 25008 - DNA, 201 bp, Homo sapiens
aggacactaccagcgtgaaaaacggggaccagctttagattgagtgtccatgaagggacctgaagaagtgatgtaagctgaggtctggatgaatgaggttrgccaagtgtattagtttgctcgggctgctgtgaggttggtgcagaagtaattgccttgtgcattatgcagttacttctgcaccaacctaacatagcaaag

SEQ ID NO: 25009 - DNA, 201 bp, Homo sapiens
aacctcttttaaagcagactgggtagtaatttacttgtacaaatccagacacccccatgtcccttattttaactatgtatgtacagattccactcacattmtagggggatgaggcaaggggcaggtggaactttctagggaagagtatgggggaaagggaggaaataaattagtgcctgaacacttggctttcttcttaga

SEQ ID NO: 25010 - DNA, 201 bp, Homo sapiens
tgcagcaggctgtttgcctttgtccaatagaatgggacttgtaattttttttttttcattcttggtgcagatggtgtagttattttaagtaagtgatgtgmtgcagtgaaaatgggcaactctttttcatttttcagcttaatgaaaaaaagagaagggaggaggagaaaccccagctagccaacttcgtgctaatgcttg

SEQ ID NO: 25011 - DNA, 201 bp, Homo sapiens
tcagctcactgcaagcaccgcctccagggttcacgccattctcctgcctcagcctcccgagtagctgggactataggcgcccgccaccactcccggctaaktttttgtattttttagtagagacggggtttcaccctgttagccaggatgggcttgatctcctgaccttgtgatctgcccgcctcggcctcccaaagtgct

SEQ ID NO: 25012 - DNA, 201 bp, Homo sapiens
tcagaatatgaaaagagctcataatagatggaatctcccagaagaaggtctttgcatttgctctttcttttccagtatgaatgcttgcccccttttatctmgcattcctttgtagttggtggggtttttgaagcgagaatatagtggtaaatgcttccatatgtctttcatagggttttttttcctaaaatattagtgtaa

SEQ ID NO: 25013 - DNA, 201 bp, Homo sapiens
tggagtcacctgaagaactggacccacactgtggcgcacgttatttcaatttactgaaaaatcgtttcctaataaacagttcccttctgttctttcatctygcctggtatgattctattgtattcagttcagggtggatccttttacacttcagatcacccttcctctaattattaatcatgtaactacattagaatgctt

SEQ ID NO: 25014 - DNA, 201 bp, Homo sapiens; identical to SEQ ID NO: 8009

SEQ ID NO: 25015 - DNA, 201 bp, Homo sapiens; identical to SEQ ID NO: 8010

SEQ ID NO: 25016 - DNA, 201 bp, Homo sapiens
gaaagaagaggatgctgcatatttaggcctgcttatggtgattcctatggctggtgggaagggagaggaaaggtttcaggggcacctagagaagtatgtgrtgggtcagtcaggcagggccacataagccaagggaaggaagtagccatgtgcttggtggtcaacatggttgagagcattggcgccaaagtgggatgagtg

SEQ ID NO: 25017 - DNA, 201 bp, Homo sapiens; identical to SEQ ID NO: 8011

SEQ ID NO: 25018 - DNA, 201 bp, Homo sapiens; identical to SEQ ID NO: 8012

SEQ ID NO: 25019 - DNA, 201 bp, Homo sapiens; identical to SEQ ID NO: 8013

SEQ ID NO: 25020 - DNA, 201 bp, Homo sapiens; identical to SEQ ID NO: 8014

SEQ ID NO: 25021 - DNA, 201 bp, Homo sapiens; identical to SEQ ID NO: 8015

SEQ ID NO: 25022 - DNA, 201 bp, Homo sapiens; identical to SEQ ID NO: 8016

SEQ ID NO: 25023 - DNA, 201 bp, Homo sapiens; identical to SEQ ID NO: 8017

SEQ ID NO: 25024 - DNA, 201 bp, Homo sapiens; identical to SEQ ID NO: 8018

SEQ ID NO: 25025 - DNA, 201 bp, Homo sapiens; identical to SEQ ID NO: 8019

SEQ ID NO: 25026 - DNA, 201 bp, Homo sapiens; identical to SEQ ID NO: 8020

SEQ ID NO: 25027 - DNA, 201 bp, Homo sapiens; identical to SEQ ID NO: 8021

SEQ ID NO: 25028 - DNA, 201 bp, Homo sapiens
ctattgtccttgcccttcattttggtgggataagggtggagaggcaaaaaatcagtgtctcagattctctatgagatttaaatatgcaggatctgaagacyatcttggctcctgctgtctcctgtcaagtgaagtgttgtttgcctctcctgctctttcaggatctagcaataaagcctgtgatgtttactgacctctgag

SEQ ID NO: 25029 - DNA, 201 bp, Homo sapiens; identical to SEQ ID NO: 8022

SEQ ID NO: 25030 - DNA, 201 bp, Homo sapiens
aataaagtgaagcacagcaaaatgagatttgcctgcacagtttctatatcgagtggaggtctgttctttagatcaataattgatgttctcacctgattgasagggccaggagcaaggaccatgatgaagggaatcaaagccacaaatataaatcataatgagtaaaacaataacagttaactgtttttggttaaatgtgcc

SEQ ID NO: 25031 - DNA, 201 bp, Homo sapiens
agcttgaagtcaccagctgcattagctcttaacaagacagttagcctgtcctgtgaaatttgaagccaggcattgacttattctgtctagatatgaaagtmctggatggcatcttcttccaaaagaaggctgttccatctacattgaaaatctgtttttagtgtagccactgttatcagtgatcttagctatctagatctt

SEQ ID NO: 25032 - DNA, 201 bp, Homo sapiens
taagaagcagctcctcatccattaaatttgttcctgagattgcatcaattcagtcacatctttaggctccacttctaattctagttcttttgctctttccmctacatctgcagttactcccctgactgaagtcttgaacacctaaaagtcatttgtgagggttggaatcagtttcctccaaactcctgttgatgttgatat

SEQ ID NO: 25033 - DNA, 201 bp, Homo sapiens
gccagctaatttttgtattttttttttttagtagagatggggttttgccatgttgcccaggctggtctcgaactcctggcctcaaatgatctgcctgcctyggcctcccaaagtgctgggattacaggtgtaagccaccgtgcctggcctctgcctccatcttcacatggtattcttccctgtctgtgtccaaatttccct

SEQ ID NO: 25034 - DNA, 201 bp, Homo sapiens
gaatgttattggtgggtagaaatgctactgatttttgtacattgattttgtatcccaaaactttactgaagttgtttatcagttctgggagccttttgttkgagtctttagggttctctaggtatagaatcatattgtcagtgaagagagatggcttgacatcttcttttcctatttggatgcccttcctttctttctctt

SEQ ID NO: 25035 - DNA, 201 bp, Homo sapiens
gctagaatgttattggtgggtagaaatgctactgatttttgtacattgattttgtatcccaaaactttactgaagttgtttatcagttctgggagcctttygttggagtctttagggttctctaggtatagaatcatattgtcagtgaagagagatggcttgacatcttcttttcctatttggatgcccttcctttctttc

SEQ ID NO: 25036 - DNA, 201 bp, Homo sapiens
tttttgtggctattataaatgggattgtgttcttgatttgactctcagctagaatgttattggtgggtagaaatgctactgatttttgtacattgattttrtatcccaaaactttactgaagttgtttatcagttctgggagccttttgttggagtctttagggttctctaggtatagaatcatattgtcagtgaagagag

SEQ ID NO: 25037 - DNA, 201 bp, Homo sapiens
ttctgcttatagctagccagatatcccagcaccgtttactgaataggaagtcctttccccattgtttatttttgtcgactttgtaaaagatcagatggctrtaggtgtgcaggtttatttctgggttctctcttctgttccattggtttatgtgtctgtctttgtaccattaccatgctgttttggttcgtgtagccctat

SEQ ID NO: 25038 - DNA, 201 bp, Homo sapiens
ctcggcctcccaaagtgctgggattacaggcgtgagtcaccatgcctggccaggtcccacttgtcaatttttgtttttgttgcagttgcttttgaggactkagctataaattctttgccaagactgatgtccagaatagtatttcctacgttttcttctgggagtcttatagtttgtggtcttatatttaaatctctatct

SEQ ID NO: 25039 - DNA, 201 bp, Homo sapiens
tgagatagtatctcattatggttttgatttgcatttctctaatgacatttttaaaaatatgtttcttggccacttgtatgccttcttttttgttcgtttgktttttgagacatggtctcactctgtcacccaggctggagtgcagtggcatggtcacaactcactgcagtctcaatctcgtcgggtcaagccatcctccca

SEQ ID NO: 25040 - DNA, 201 bp, Homo sapiens
ccgggctgtctgcctcacacttttctcagcactcagcaaaggttagttgagttgaatgaatgaggcatttaaaatctgtttgagtattcgtctcattcacrgggctgcttcacttagaattttgctaatgtagttgtctgcctaaagagaatattcatgcctcctgtggtggaggtgggtcaagtaccagctatgacacat

SEQ ID NO: 25041 - DNA, 201 bp, Homo sapiens
gagacggagtcttgctctgtcgtccaagctgcagtgcggtgtcgcaatctcaactcattacaacctctgcttcccagattcaagtgattctcctgcctcarcctcccgagttgctgggactacaggtgtgcaccaccatgcctggctaatttttgtattttcagtagaggcagggttttaccatgttggccaggctggtct

SEQ ID NO: 25042 - DNA, 201 bp, Homo sapiens
atttcttgtgtctgtgtttaggcctgtttgctgctttttttttttttttttttttttgagacggagtcttgctctgtcgtccaagctgcagtgcggtgtcscaatctcaactcattacaacctctgcttcccagattcaagtgattctcctgcctcagcctcccgagttgctgggactacaggtgtgcaccaccatgcctg

SEQ ID NO: 25043 - DNA, 201 bp, Homo sapiens
cattccattcctttcccaaggccactgcttgtgacatttcttgtgtctgtgtttaggcctgtttgctgctttttttttttttttttttttttgagacggartcttgctctgtcgtccaagctgcagtgcggtgtcgcaatctcaactcattacaacctctgcttcccagattcaagtgattctcctgcctcagcctcccga

SEQ ID NO: 25044 - DNA, 201 bp, Homo sapiens
catgtgcattccattcctttcccaaggccactgcttgtgacatttcttgtgtctgtgtttaggcctgtttgctgctttttttttttttttttttttttgaracggagtcttgctctgtcgtccaagctgcagtgcggtgtcgcaatctcaactcattacaacctctgcttcccagattcaagtgattctcctgcctcagcc

SEQ ID NO: 25045 - DNA, 201 bp, Homo sapiens
ccccacagtctgtcatcccccttcctctcttcccatgcatgttgttgtgcagcttgaagacagctcagctctctctaaggtggccttttcttctgaattcrttatacccatgtgcattccattcctttcccaaggccactgcttgtgacatttcttgtgtctgtgtttaggcctgtttgctgctttttttttttttttttt

SEQ ID NO: 25046 - DNA, 201 bp, Homo sapiens
tgagggagaatctgttccgtgcctttccctagctccccgtggctttctggcactctttgtcgttccttgggcagcattcccttggtctctgccttcgtcgwgacattatgttctctgtgtgtctccacatcactctctctctgtacaggtctgtctctgtgtacaaatatcccctctttatgaggacgccagtcatgttgg

SEQ ID NO: 25047 - DNA, 201 bp, Homo sapiens
attctgctcctgggccttgtgaaagtattttctggttttccaaatgcgaacaggtgctgataaatccttttctactcactccctgcccaacccagctgaaracttcttttataatattctccccgctagccagatgttttgaaatagcaaaattattaaataataatttgtattgttaaaacatgaatgaaatacagatat

SEQ ID NO: 25048 - DNA, 201 bp, Homo sapiens
cggagcatcatcaagaatgttagagaaggcctgatgtctctttgctagaaatatctaaaccggctgtttaagtgttcttgtctttaaaataacaatgtgayggaaattatttaaaaatgaagccttttaattgagccttaatctccagagaagtatttttatgagatttataatgtgtttagtagctctctaatgagttca

SEQ ID NO: 25049 - DNA, 201 bp, Homo sapiens
tcaatgcggagcatcatcaagaatgttagagaaggcctgatgtctctttgctagaaatatctaaaccggctgtttaagtgttcttgtctttaaaataacartgtgatggaaattatttaaaaatgaagccttttaattgagccttaatctccagagaagtatttttatgagatttataatgtgtttagtagctctctaatg

SEQ ID NO: 25050 - DNA, 201 bp, Homo sapiens
ccaacctatgacctctctgaacttggaaaatgaagttgcagttttggccacaggatatttattgatggtggaagggtgtggaagtctctgagttgcagttktgttgtagtatgatagagttttccttcctgaggttgaccatggcttagtccttgctatacagggtagtgtgaggattggatttctcaggttagcggagct

SEQ ID NO: 25051 - DNA, 201 bp, Homo sapiens
gtggaagagctttctgagagttgtgtgcaaaaaaacacttagctgccgttccatatttgcttgcttgatccccttggctgctttgggactcatccaacctrtgacctctctgaacttggaaaatgaagttgcagttttggccacaggatatttattgatggtggaagggtgtggaagtctctgagttgcagttgtgttgta

SEQ ID NO: 25052 - DNA, 201 bp, Homo sapiens
cacatgtccatgcatgcatgtgtctgtgtttagctgtgttgctttggctttttatttatcttggagttctagaaatatgcatgcttacaacatatttacaratgtggttttttgggtgttactgatttattgaaattcaagctcgaattcaataactcaccttattagaatgaaaactgcattgctcaggcatgtgttatg

SEQ ID NO: 25053 - DNA, 201 bp, Homo sapiens
ctgtgacagtgcatgaatttgacttcattcatcatgaaacttactatgttccaggcatcgtgttagtcacttgggggtactgagttgaataacacaaagtstcttctctaggagcttagtctggtgggggtggggaaggacactatgaggtgtctgagacgatgttggaatgaataagtcttccattttcaaaagagtcta

SEQ ID NO: 25054 - DNA, 201 bp, Homo sapiens
tagtatttcctgtgtaccctcatttcctcccctcctgtgacagtgcatgaatttgacttcattcatcatgaaacttactatgttccaggcatcgtgttagkcacttgggggtactgagttgaataacacaaagtctcttctctaggagcttagtctggtgggggtggggaaggacactatgaggtgtctgagacgatgttg

SEQ ID NO: 25055 - DNA, 201 bp, Homo sapiens
atcctaggtttattttactttaaatttctatgggtatatacctgcttctgtgaccccaccaacttttaaggagtgaagccagctgcaagaagtaaatgcartggggctgagctcatctttcctgattccctggttaggtgtggagcctaactctgtccagttgtggacttcatttcgtaagaccctttggcagctcttcac

SEQ ID NO: 25056 - DNA, 201 bp, Homo sapiens
ctattcttctgccttagcctcccgaatagctgggactacaggtgcacgccaccacgcctggctaatttttgtatttttttttttagtagaagtgaggtttygccatgttgcccaggctggtctccaactcctgaccttaggtgatatgcccacctcagcttcccagaatgctgggattacaggcgtgagtcaccgtgccca

SEQ ID NO: 25057 - DNA, 201 bp, Homo sapiens
ttttgttttgttttgttttttttgattattgttgtcgttgtttacttactaaatatatttcagagatctctctttcagaatggaaagattccttattctgkgtgtatggttcatggtattctgttatatatgcactataaattatttcactctaagctcctattggtagacaggttgattcacatctttgctgtgacaaac

SEQ ID NO: 25058 - DNA, 201 bp, Homo sapiens
catttcttcctgatctctctaattctgcctgtacccttacccccatctgaactcccacccctgcctacactacccttccatctgggagagagaatagtagrcaggggtcatgttttggaaaggatattatttcaagggcgttgggaccccagtgaaagattttattgaggggagtgacatgacctgttggacactgtggtg

SEQ ID NO: 25059 - DNA, 201 bp, Homo sapiens
aggcttttaatgcacttgtagactgtaccaaattcaccaaccccaattttttctacctccgagcattcttttttatagtaggaagccatgttggtttctcrtagaacacatgtctcagcaggcagcccttgttcttccttgccttcctctggaccagcttcctcaagatcatctcgaattttcctcttgacactggattga

SEQ ID NO: 25060 - DNA, 201 bp, Homo sapiens
ggagactgaggcagaagaatctcttgaacccgggaggcggaggttgcagtgagctgagatcgcaccactgcactccagcctgggtgacagagtgagactcygtcccaaaaaacaaaaagcaaaaatgcagtattcttttcctttaaaaatgtgtacataaaaaggatttggataaagtatgatgaaataataggaaacaag

SEQ ID NO: 25061 - DNA, 201 bp, Homo sapiens
gacaagataaaatgctttatttaaaaatgcaggctgggcgcagtggctgacacctgtagtcccagcactttgggaggccgaggtgggtggatcagaggtcrggagtttgagaccagcctggccaatatggtgaaaccccatctctactaaaaatataaaagttagccagacgtggtggtatgcacctgtagtcccagctcc

SEQ ID NO: 25062 - DNA, 201 bp, Homo sapiens
taccatctatttttaaatgacctgtttggtattattgtcactggctttttaaaacaattgcttattgttcgcttacttgtaaatcaatatagtaggtatgrttggatatgcagaactttcccctgaccttaagtaatgaagaatttatgaaaagagggaaaacgtgcacgtgggtctctgagtaaggtgttgtatagtaat

SEQ ID NO: 25063 - DNA, 201 bp, Homo sapiens
gaagtggtgatctgagtgaagatatggaaataatgtggtaaagactaaaccagaagtagatataccagaagaagacataatcaaaacaacacagagatcaraactacagagatgtagatgttaatgggagaacaaagtagagttatatggtgacagtcagtcacaactgtggagggaggaaggccaggccacaaggacgat

SEQ ID NO: 25064 - DNA, 201 bp, Homo sapiens
gcctcagtgtgttctttacctgtaaaaggaggataaggttaatagcagcctcacagcattcttggggagagtagacaagatcatgaatgcaggttgcttakcccatgctggcatttcaggagcactcaccacatgcttaccaatccatgccgagactagggttgagggctgggagtgtcatttatctcaaacccccagtgc

SEQ ID NO: 25065 - DNA, 201 bp, Homo sapiens
gcattaggtatttgtcctaatgctctccctcccttcgtcccccacccccaacaggccccagtgtgtgatgttcccctccctgtgtctatgcatacccattrttcaactcccacttatgagtgagaacatgtggtgtttggttttctgttcctgtgttagtttgctgagaatgatggcttccagcttcatccatgtccctgc

SEQ ID NO: 25066 - DNA, 201 bp, Homo sapiens
gtttatttttgagacagagtctcgctctgtcgcccaggctggagtgcagtggcgcgatctcggctcactgcaaccccccgcctgttgggttcaagcagttytctgcctcagccaccttagtagctgggattataggcttgtgttcccacatctggctaatttttgtatttttagtagagacggagtctcaccatgttggcc

SEQ ID NO: 25067 - DNA, 201 bp, Homo sapiens
tgcaaggtggtgacttgctgtgttttgttttgttttgtttgtttatttttgagacagagtctcgctctgtcgcccaggctggagtgcagtggcgcgatctyggctcactgcaaccccccgcctgttgggttcaagcagttctctgcctcagccaccttagtagctgggattataggcttgtgttcccacatctggctaatt

SEQ ID NO: 25068 - DNA, 201 bp, Homo sapiens
tttttgtgcataatagcaggactttctctataataatatccttgaagtagaattgctgatcaaaggatttgcacgttttcaacctgagtagatattgccarcttctctataaaatggtcctgcccatttatcctctcattagtggtttatgagagcatctgtttctccacttttcttccaacatttggaatttagagtttt

SEQ ID NO: 25069 - DNA, 201 bp, Homo sapiens
agatacagtttattttagctgcggtagaatatcctattatatgaatatactacactttgctcattcatctcttaaaaggatatttagattattactatgastagccacactgcagtgaaaatttttgtgcataatagcaggactttctctataataatatccttgaagtagaattgctgatcaaaggatttgcacgttttc

SEQ ID NO: 25070 - DNA, 201 bp, Homo sapiens
gggatacatgtgcagaaagtgcaggtgtgttacataggtatacatgtgccatggtggtttgctgcacccatcaacctgtcatctaggttttaagacccgcrtgcattaggtatttgtcctaatgctctccctcccttcgtcccccacccccaacaggccccagtgtgtgatgttcccctccctgtgtctatgcatacccat

SEQ ID NO: 25071 - DNA, 201 bp, Homo sapiens
cctacattttacagcagtgatattcaagggttggggaagaggaagccactcttcctctccctcattgagatcgatgggagagtgttacctagggggtggaraaaagactgaaaaccatactacatgagtacaaggtgacaaccaccccagaccttgattcacgtgtgcagacgtgcgctgctctcgtctagtttgcagacc

SEQ ID NO: 25072 - DNA, 201 bp, Homo sapiens
agacattaagaaggatgtcactgacctgtgttctccagtaaggtggccactagccacctggggctactgaaatttaaattagttaagtttaaatacaatgyaaaaattcagtttctcagtcacacccagcctatttcagatgctcaatagtcccatgtggctgatgggattggatagcacagacacagagcatttctgtca

SEQ ID NO: 25073 - DNA, 201 bp, Homo sapiens
ggagacggaggttgcatggagctgagatcgtgccattgcgctccagcctgggtgacagagtgagaccttatctcaaaaaaaaaaaaaaaaaaaagaaaagwaaagaaaaaaatacaatgccgtacacatctgtgttattttaagtgggtgattctaatatgtaggaaatccctaaaaacagaaattacccgttgactccac

SEQ ID NO: 25074 - DNA, 201 bp, Homo sapiens
gaggctgagacagaagaatcgcttgaacccaggagacggaggttgcatggagctgagatcgtgccattgcgctccagcctgggtgacagagtgagaccttwtctcaaaaaaaaaaaaaaaaaaaagaaaagaaaagaaaaaaatacaatgccgtacacatctgtgttattttaagtgggtgattctaatatgtaggaaatc

SEQ ID NO: 25075 - DNA, 201 bp, Homo sapiens
aattttttgtattttcagtagagatggggtttcaccacgttagccaggatgatctcgatctcctgacctcgtgatccgcctgtctcggcctcccaaagtgytgggattacccaaagtgctgggattacaggcgcgagacactgcacctggccacactttatttataattgctcactaaatgttattgattagtaataggtt

SEQ ID NO: 25076 - DNA, 201 bp, Homo sapiens
ctgggtggtgtgtgcagtgggaatggtgggtgggactgaccagttccttggggagcccccaggggcctttcctacacacctgctccctggatctacagaartgctcactcatggaagctatggggataaaatccttcctgctaatgagatgagaaggttgattaactttgagttgggcttagtgagtctgacaccagtggc

SEQ ID NO: 25077 - DNA, 201 bp, Homo sapiens
ggcactgtgctacatacttatttaattatgtgtttttatttgtcttaagagacagagtcttgctctgtcgcccaggctggagtgcaatggtgccgtcatarcacactgtgacctcaaactcctgggctcaagcgatcctccctccttagcctcctgagtagctaggtttacaggagcatgccaccatgcccagcaaatttt

SEQ ID NO: 25078 - DNA, 201 bp, Homo sapiens
tgttagccaggatggtctcaatctcctgactttgtgatccacccgcctcggcctcccaaagtgctgggattacaggcatgagccaccacacccggcccctytatttacttttaaaaggacaccagtcatttgacttagggtcaagtctaaatgcaagatgatctcatctaaagttccttaactcaattacatctgcagaga

SEQ ID NO: 25079 - DNA, 201 bp, Homo sapiens
ggcttgtagatggcatctccttgctatgtcttcacattagattagagcccaccctacaaacaaaacaaaacaaaaacctcattttagcttaatcacttctygaaagaccttgcctccaaatgcagtcgcattctaaagtgttggaggctccctctccctctccctctccccctccccctccccctccccctccctctcttg

SEQ ID NO: 25080 - DNA, 201 bp, Homo sapiens
taaggctgttggatttcccctgcttggggcgatggctctgtaaaacccaaatagctttaaaagagcaccaaggagatgtttgtctttttaaatcagctggratttttttttttttccagctctgatcccttggaaacttacaactaaaattcatttcattagcagtcagaacagtgtgtccctttgaagttcagacagggt

SEQ ID NO: 25081 - DNA, 201 bp, Homo sapiens
tgtggaatgcctctaaatgacacttacccatcttctcccattggttctcttccttgagattttgtgccctttatcatgtgtctgctgctcaaatttgcatyagtaggtcagctgttattgaaaccctcctttttttctttaagaaaatttatttgtacctctacagcagaaatagagagagaataagtttgtgcaaaccac

SEQ ID NO: 25082 - DNA, 201 bp, Homo sapiens
tttaaggcatccgaaagaatatatatttctaatgttataaattggtatcatctgtatgtaatctttcctattttcacttagtattatattgctgtgattcrcctgtattgtttgttgttggagattgtttgtcttgacttatgttcagtgttctactgtatgattgtaccatagtttatagatctaataaaagtgtgaaaa

SEQ ID NO: 25083 - DNA, 201 bp, Homo sapiens
gacagtcacggaaaacagacagtggccttcagtggcctcatgacactatgtttgttggcactgggcagtggaaagaggtggttaattctctggggaggttrtagacaagatccgtttgagatctgcaaaaccaaatgctaagccgtatgtgtgtctgtacctatgtatgggtgtctgtcttgcttttgctgttcattgagc

SEQ ID NO: 25084 - DNA, 201 bp, Homo sapiens
catgtgaaaaacttaaatcaggtctgtctgctggtacacgcagtcctaatccgttaaatatttctagctaacaatgcacgtggggctcttcagctctgcayacagtcatgttctgctaagtccatgcaaatataaccacttctgcctgcttttttgagggagggatcagtaatgcctacatggttttacccaaatccctca

SEQ ID NO: 25085 - DNA, 200 bp, Homo sapiens
ccagttttatctcctgctttaacctggaatgatgccagcatgttgggttttaccctggagaattcatatcatgtgaaaaacttaaatcaggtctgtctgcggtacacgcagtcctaatccgttaaatatttctagctaacaatgcacgtggggctcttcagctctgcatacagtcatgttctgctaagtccatgcaaata

SEQ ID NO: 25086 - DNA, 201 bp, Homo sapiens
cctaagtcagcagctcttcttcagctgggatttgtctgcctcttcactctcttctgcttgtggcccagaggacctgagttgcagaggtcacaactgctgtrctggctttcttagaacacctttctgttgggccatttactcaacatacacttgttgagtgtctgccctgtggcagattctgtcttagagactggatgtaca

SEQ ID NO: 25087 - DNA, 201 bp, Homo sapiens
gctaccagtaacagagatggggcaggggcacacattgcagaaagaacacatcaggaactcagctagggatatattacctcctgaaattcagtgtggccttrggtagctgatctcgggcagagattggtgactcttgtccccgtgtgtggctcaatgttaactttttaacgatcagatgctgacctctcccaataaaatgta

SEQ ID NO: 25088 - DNA, 201 bp, Homo sapiens
ttaagtgctggataagcatcacctcccagtaatcctgttatcagcctttgaaatgtaggtagctttattatccacattttgcagatgaggaaacagagtcrggtgaagtgtcttttccaaggccaagctcctgagggcaggggctcaagcttaggccttcagactccaaagtccagaccgtccctgggaacaagcacccta

SEQ ID NO: 25089 - DNA, 201 bp, Homo sapiens
tcaggtgaagtgtcttttccaaggccaagctcctgagggcaggggctcaagcttaggccttcagactccaaagtccagaccgtccctgggaacaagcaccstaggttttcacatggagcctccgaaacgcctctggcatctcctgctgtggggttggatatgagctgtcttatatagaccctacctaaattaaattaaaat

SEQ ID NO: 25090 - DNA, 201 bp, Homo sapiens
ggttttcacatggagcctccgaaacgcctctggcatctcctgctgtggggttggatatgagctgtcttatatagaccctacctaaattaaattaaaatcgrctaattaaatgtggcctctttgaatacactgccgtatttctaattacagctttccttctctcctgagaaggcagcccaacattgtttctgaaaaggtcct

SEQ ID NO: 25091 - DNA, 201 bp, Homo sapiens
cctggatcttgacttaatgttcctctcaatttttggcaaaactgaaactcaagttggtctagctcaccattgcccttggaagaaaatttgcctcaattttmcagatgcttaccttttccttttttttacttttttgatgatattaagaatcttaaaaaatatattttactctagaattaggttttttccccagtaggggag

SEQ ID NO: 25092 - DNA, 201 bp, Homo sapiens
gatcttgacttaatgttcctctcaatttttggcaaaactgaaactcaagttggtctagctcaccattgcccttggaagaaaatttgcctcaattttccagrtgcttaccttttccttttttttacttttttgatgatattaagaatcttaaaaaatatattttactctagaattaggttttttccccagtaggggagatgg

SEQ ID NO: 25093 - DNA, 200 bp, Homo sapiens
tcttaaaaaatatattttactctagaattaggttttttccccagtaggggagatggtttgcatatatagctcgccatattactagaactggaagtctctggctagaattatagaaccattcctctgtttattccagcccatgatgttggagagacaaaactgaagctgtcctctggcctgtagttgggtagaatatttta

SEQ ID NO: 25094 - DNA, 201 bp, Homo sapiens
ccagtaggggagatggtttgcatatatagctcgccatattactagaactggaagtctctgcgctagaattatagaaccattcctctgtttattccagcccrtgatgttggagagacaaaactgaagctgtcctctggcctgtagttgggtagaatattttactgacctttgcccagatctttcacctttgttctccctaga

SEQ ID NO: 25095 - DNA, 201 bp, Homo sapiens
ctgtagttgggtagaatattttactgacctttgcccagatctttcacctttgttctccctagagtgtttccaggtatctcaaatgagatggaccaagtctyaaagcaccagtaactttaatgcaataaaaagatcaaatagtacttttagaaggagacaaaggggattccataaaaggtaaaaatctttagatgctgagaa

SEQ ID NO: 25096 - DNA, 201 bp, Homo sapiens
gtagaatattttactgacctttgcccagatctttcacctttgttctccctagagtgtttccaggtatctcaaatgagatggaccaagtcttaaagcaccartaactttaatgcaataaaaagatcaaatagtacttttagaaggagacaaaggggattccataaaaggtaaaaatctttagatgctgagaatttagggtat

SEQ ID NO: 25097 - DNA, 201 bp, Homo sapiens
ggtataggaaccacagctgttcagatgaacttgggctagtcttccctgtcacgatcaccatgtgcctctagacaataaatgcagtttgaggaatgcagtgrcacaagatggcttgtgttcaccactgagactgataaatgagagctggaaagagtgctccagtgtctgtcattgaaaagtggggagatagcctgtacctgg

SEQ ID NO: 25098 - DNA, 201 bp, Homo sapiens
aataacaagataaaaacctctggctataaagcactgttatgcattatgctctgttggctttatgtctagacagagctaagagacgcctttgtgaccctagsaatacctagagatgactgtatatttacctctttttagaagaaagatggacttgacatttttatatattagaggccacagaggcaaagaaagctctagcca

SEQ ID NO: 25099 - DNA, 201 bp, Homo sapiens
cctagcaatacctagagatgactgtatatttacctctttttagaagaaagatggacttgacatttttatatattagaggccacagaggcaaagaaagctcyagccagggagacaggaggtgacactttaaaaccctggtctgcctgtccttccctgaatgagagaaagtatagtatagccttgcagataaaaacagaccct

SEQ ID NO: 25100 - DNA, 201 bp, Homo sapiens
aagttgatagtggagcttgcataaatgtgcaggtggttgccatggcccacaggggatccatttgtgattaccagctgggaggagatacacctgcttgcacrtctctagcagatgtgtgtgacctgcccccaactcctgctaattctggcccctttcttagcctcttctcctatatccatctttccttggcttcctattacc

SEQ ID NO: 25101 - DNA, 201 bp, Homo sapiens
caattttgtttagctcccacatgtaagtgagaacatgtaatatttgtgtttctgtgcctggcttatttcacttaacctaatgtcttccagttctagttccygtcatttgttactgcaaatgacagaatttcattctttctgtggctaaatagtattccattatgtatacataccacattttctttatctattcatccattg

SEQ ID NO: 25102 - DNA, 201 bp, Homo sapiens
tagattgtccctcactgtaatgattacggggtcttgtttttatttaacatggagcactttgtctgagcttctcatttccaaatgcataaccccagaaggcktctccacccttgccccttcactgttaggtcacaacatctcagctagtgactttctttggtttgggaagcacactttttgaggtcagctgttactttctgg

SEQ ID NO: 25103 - DNA, 201 bp, Homo sapiens
ttttgctcactggtggtaagagccggagtgcgagtgttggacatcttggaaaatttccccaggcggcacatgagatgatatttggatacttgcaaagaacyttctagaatctccacagcaaagagttaaagaagtgtagattgtccctcactgtaatgattacggggtcttgtttttatttaacatggagcactttgtctg

SEQ ID NO: 25104 - DNA, 201 bp, Homo sapiens
atgttggccatgctggtctcaaactcctgacctcaggtgatccacccgcctcagcctcccaaagtgctggtattacaggtgtgagccaccgcgcctggcargggacatctttatctataatgcaggatgtaggaattggactatagcaggaatacccaataataatagtaacagcacctctcacggttgagccattcctac

SEQ ID NO: 25105 - DNA, 201 bp, Homo sapiens
cggagtttcactcttctcgcccaggctgtagtgcaatggcaggatctcagcccactgcaacctccacctcccaggttcaagcaattctgcctcagcctccrgagtagccagaataaaaggtgtgcaccaccacgcccagctaatttttgtatttttagtagagaaggctactatgttggccatgctggtctcaaactcctg

SEQ ID NO: 25106 - DNA, 201 bp, Homo sapiens
aggaactcttaggtgatgaaattaaatgaaactcttgcttatgctgaaagctcagtgcaggacatggtagacacatgatcaatgtctccttcctggtcccrcgcagaagggatccccaaaacaggattagtgggagtaactcaaataaaagacctgatgggaacagagtgcagtaacagagggggagaaagaaatgttttc

SEQ ID NO: 25107 - DNA, 201 bp, Homo sapiens
atcttttcctgagcagtaggtctcaacagtgtgcttaaaatattcagtaaaccatgctataaacagatgcactgtcatccaggctttgttgttccatttayagagtgcaggcaggttagagttagcataatttttaaaggctccaggattttcagaaaagtaaatgagtattcacttcagcttgaagtcaccagctgcatt

SEQ ID NO: 25108 - DNA, 201 bp, Homo sapiens
ctatggccttcagcactgtaggcctagaacttgcaaaaattactgtcttcctgaccccctcttgccactccagatgtgctctttgtgccttgtggcctatsatgaggacagactttcagttcagatgttggaatcacagcatgaagtttgaggtgggcatctgataagcacccacctacatacagacgtttccaggttgtc

SEQ ID NO: 25109 - DNA, 201 bp, Homo sapiens
gcatgatcctcacttcactaaatttctttagtcttaaatgcaaaaccattaatgctatggttaagaacaggggctttgggcccagacagtactgagttctycccccagcttccatttatgacctgtgcagcccccgggcttaccatgcacctattttctcatctgtaaaatggagataatagcagtgcctatcccagagat

SEQ ID NO: 25110 - DNA, 201 bp, Homo sapiens
tgtctttgactttccatgtacagacctggccctttatgtttggtgggtgtgtttggttgaggggggtgtggaggagggataaatttgaggactttgttaartgataaaatattaatgaatctccaaatccagagatagaaaagtaggtgcaaaaatgggatttgaattttacttgcttttactgttcctgaccgtttcttg

SEQ ID NO: 25111 - DNA, 201 bp, Homo sapiens
ttcgaagggcaagaaagagcctggagaggtgtgtcatggtgggatatgaggcagtgagcagctcttctgtatccacagcagaggaaggatttttaccagasaggaagattttttttttttaatcgtgacggtaataagatcacatattgtaaaaattgagggcagagaaggaggaaaagcatctgtactcagatccactat

SEQ ID NO: 25112 - DNA, 201 bp, Homo sapiens
agagtcagggtggacagggctgaggtctccagggtgaccaacttgaccaccttttcaaggatgatggaaacggctgatgtggaatttctgccgccttcccrgagggagggagactggttctgtgtcttgcttatgagctacaaagccctttctctgattctttggagcaactgggtacttaaggggaggtgagtgaaggtg

SEQ ID NO: 25113 - DNA, 201 bp, Homo sapiens
acaagtggtgggcacagggttgtctcacaggggattgccttgagaccacatgactggacgatggttcctggctctttcatgtgctttgggcaccaggccaygtggcctgtctgacaggagaactatgtgtcctggctctgagcctgctgtctccctggaagccagctgaggaaatagctgaagacaggttaatcatttgaa

SEQ ID NO: 25114 - DNA, 201 bp, Homo sapiens
acagggatcttggtggtggtggagccaacgctttgagagagcagaaggttttaccatcaggctctactaatccctaccctggagtcccatccttgccttcrctttatgtacgagccaactgagcatcccagaggttatgtggctgcagcatcttaaaaccagcaagtggcacattggacttgggaacccagggctgcctga

SEQ ID NO: 25115 - DNA, 201 bp, Homo sapiens
cactttatgaccatgttcagtggagttgaatctgaacttgcagcttggttctcagcttccagtaactcttgaaaggcaattccatgaccttgggaccctgstggaggttacaaatcccaagttcaagattcaatgtggccttttctacctgtgccacctcaggcaggttggttttataggtctgggctcctgtttcctaga

SEQ ID NO: 25116 - DNA, 201 bp, Homo sapiens
ctggcaggcagggaggccaagttgggaagttgtgctgtgcagcaatccctgtaagaaagggtggctgctttggctggagtcgcaactgtggcaatggagastcggggactggccacatataggggttgatagattgaggaggggacaagggagatttctaggattctgatgtgggcagttgggcagggtagagcccctcat

SEQ ID NO: 25117 - DNA, 201 bp, Homo sapiens
cttgcctggagatggtgaattggtttcatgttcttctcagggttgttggtggctttctggagtccggtcttgagagggagtctcatattgattcttggctyggtggaacagagcatcatgattaattagggatggctgactttgcactacaataggagaaattgcagcagaataggagaaatagtagcataatacctttgc

SEQ ID NO: 25118 - DNA, 201 bp, Homo sapiens
tccaggcccctgaagagttctctgctacagagcagttctctaacaacagagcagttgttagcaaacagctggaatgtgggggttttctgggttgagcattygttgtctggctagtatccagtacctggctgcccttctagggtccccctcaagcccttgcctggagatggtgaattggtttcatgttcttctcagggttgt

SEQ ID NO: 25119 - DNA, 201 bp, Homo sapiens
gaggtggttaattctctggggaggttctagacaagatccgtttgagatctgcaaaaccaaatgctaagccgtatgtgtgtctgtacctatgtatgggtgtmtgtcttgcttttgctgttcattgagccttcagatccagattgtcaggaagcagaggataaaaatgaaggccactgggcagaagttggaaagcagggctgt

SEQ ID NO: 25120 - DNA, 201 bp, Homo sapiens
gatgggaaccgaatgggaagtgcacaggacagatgtctctggttccttctgtcactgatgctactgtgtggagcaacctagagtcgaggaggtcttcaggsactttctggggatgtttgtaaacagatcactgcagagccgctcactcactggcctgtgcctgtgcatggagtgtgtgtgtgtgtgtgtgtgtgtgtgtgt

SEQ ID NO: 25121 - DNA, 201 bp, Homo sapiens
tttttgactgtgctctgtgcctttggcccttccttagttgcaaaagccagggggccctaccaagtcacagccttggctatcctcaactgagcccatctgarccttgctcagccttctgcagccccatgttgaggggcgaggaggcagatggtgtggactattctaaggaagacagctttactgtggctttcctcaccctga

SEQ ID NO: 25122 - DNA, 201 bp, Homo sapiens
ccagcccagattccagcaggcttcccatctgaccaggctacacccactctagagaggcaggaagagaaaagggacccagccttctctgactcagagagtcmgtaagaatgtatggagggaaggaaggagtaacatatactagtaccatttattaaaccccaagtatataccacctgctctcttatatatactttatccttc

SEQ ID NO: 25123 - DNA, 201 bp, Homo sapiens
ttatcaccgtgaaggtccaactaatagtggacaaaatgacttaactagggaagatatcgcttgtttaagcagttgggagcaaaactctgaaggctgttaarggagggaaaggagcttccgagatgactgagaaggaatgatcagagagccaggtgtgtgttaacgggaggcagaggaagagaagaatatggtgtgagggtg

SEQ ID NO: 25124 - DNA, 201 bp, Homo sapiens; identical to SEQ ID NO: 8023

SEQ ID NO: 25125 - DNA, 201 bp, Homo sapiens; identical to SEQ ID NO: 8024

SEQ ID NO: 25126 - DNA, 201 bp, Homo sapiens; identical to SEQ ID NO: 8025

SEQ ID NO: 25127 - DNA, 201 bp, Homo sapiens; identical to SEQ ID NO: 8026

SEQ ID NO: 25128 - DNA, 201 bp, Homo sapiens; identical to SEQ ID NO: 8027

SEQ ID NO: 25129 - DNA, 201 bp, Homo sapiens; identical to SEQ ID NO: 8028

SEQ ID NO: 25130 - DNA, 201 bp, Homo sapiens; identical to SEQ ID NO: 8029

SEQ ID NO: 25131 - DNA, 201 bp, Homo sapiens; identical to SEQ ID NO: 8030

SEQ ID NO: 25132 - DNA, 201 bp, Homo sapiens; identical to SEQ ID NO: 8031

SEQ ID NO: 25133 - DNA, 201 bp, Homo sapiens; identical to SEQ ID NO: 8032

SEQ ID NO: 25134 - DNA, 201 bp, Homo sapiens; identical to SEQ ID NO: 8033

SEQ ID NO: 25135 - DNA, 201 bp, Homo sapiens; identical to SEQ ID NO: 8034

SEQ ID NO: 25136 - DNA, 201 bp, Homo sapiens; identical to SEQ ID NO: 8035

SEQ ID NO: 25137 - DNA, 201 bp, Homo sapiens; identical to SEQ ID NO: 8036

SEQ ID NO: 25138 - DNA, 201 bp, Homo sapiens
atggagatgttagggcgattcatcagtgagaatcttaaagggggaagagcagaggaccagagaaaccacaacagcttaaacttttttttttttaatcgttkgttttcaaattggtaatagatataatggtataaaattggaaagagaatttctcatccctgctgcttcactgcacagtttactggttacccattctccagc

SEQ ID NO: 25139 - DNA, 201 bp, Homo sapiens
gaaatgttcttccctctgtcttcttggtctttttgaaatacatttaaatagcctttttccttttttgttgattctaaaatcctcacgtttttggagtttgmacttgagcttgtctccaagttctaggggtattctctttcatgacctaggacatagtgcagggtcagtgctaagtgagattctggaagcagagtcttcaga

SEQ ID NO: 25140 - DNA, 201 bp, Homo sapiens
tacagagtaggtgcatatttacggggtacatgagatgttttgatacaggcatgcagtgtttcataatcacatcatggagaatggggtatccattccctcargcatttatcctttgtgttacaaacgatccaattatactcttttagttattttaaaatgtacaatgaggatattttaagccagggatgactgtgatcctgt

SEQ ID NO: 25141 - DNA, 201 bp, Homo sapiens
gcctcccaaagtgctgggattacaggcgtgagccaccgtgcccggcctgctttggttttaatttgcctgcccctgatgactggtcaggggagtggtgggcygtggccaggcctgttccctcatctcccgctgaggtggataatggatggggaaccccaaggccattcatgacaggcagttaagaggcggttgttctactgt

SEQ ID NO: 25142 - DNA, 201 bp, Homo sapiens
agaaagcttcctgttcaccctctgaaacctggctagtgaatctcctattctagaaaagtgtcctcccatcttcaactcccaatcagagaattaatctctgwcttcttaatggctgcctgtaacttgtatttgttcgtgtagaacttaacacacagtattgcagtttatttatgcttgttctctatacttgaatgtttatta

SEQ ID NO: 25143 - DNA, 201 bp, Homo sapiens
gggggtggaaaaaagactgaaaaccatactacatgagtacaaggtgacaaccaccccagaccttgattcacgtgtgcagacgtgcgctgctctcgtctagwttgcagaccctcctggaaactttgcaagaaggctctgtggtcactggaccctccatcccctgcccctcccagcagcattgggcctccaggctcccaggcc

SEQ ID NO: 25144 - DNA, 201 bp, Homo sapiens
caagggttggggaagaggaagccactcttcctctccctcattgagatcgatgggagagtgttacctagggggtggaaaaaagactgaaaaccatactacaygagtacaaggtgacaaccaccccagaccttgattcacgtgtgcagacgtgcgctgctctcgtctagtttgcagaccctcctggaaactttgcaagaaggc

SEQ ID NO: 25145 - DNA, 201 bp, Homo sapiens
cagatgattcaaatttgtagtgtgtatgtgtgtgaggtacaaattgccccatggtgcttggtgcccagcacttcatttctttattttcctctgttcagtcyaatctggccgtagtagtccccactcactaaaagctagagatctgatgtcagtcacctcgaagaattgacctttggtgtaggccaattcttgagggccctc

SEQ ID NO: 25146 - DNA, 201 bp, Homo sapiens
attcttacgaaacagatgattcaaatttgtagtgtgtatgtgtgtgaggtacaaattgccccatggtgcttggtgcccagcacttcatttctttattttcytctgttcagtccaatctggccgtagtagtccccactcactaaaagctagagatctgatgtcagtcacctcgaagaattgacctttggtgtaggccaattc

SEQ ID NO: 25147 - DNA, 201 bp, Homo sapiens
aacacattggtttatttatttatattgattttagatagttttgatcatacgtggaatataatttcatgtcctgcttttttcacttctgaatatagcatagrcgttttcccatgttacactaatctacgagtacaagaagtctcccatcacagaatgctgggtgtattctttgatgttggctgtaaaaatcatctgacccac

SEQ ID NO: 25148 - DNA, 201 bp, Homo sapiens
tgtgacatatcaaaagggtttctgacaggctaatgaaaactgctatgcatcttaattccatttgaagggagtttacatagtttactgaacaagtaggagargtcaccaagaggaaataaattaaagcaggtctgttttataaaataacagtattaggccgggtgcactggcttacaccttgggaggccgaggcgggcagat

SEQ ID NO: 25149 - DNA, 201 bp, Homo sapiens
agacccaaatgacccactgatggaaatgggattgttgaccttcttcgttatctgggaagggtagaggctctctgccagtgtaatctcggaggcatttctaracaggagttgtactgatggatcttggaccttgatgggaacacagagccgtgaagatgtcacagtgcccaggcaaacatgggtactgcgtcttcagggata

SEQ ID NO: 25150 - DNA, 201 bp, Homo sapiens
gaaacttgccaaggatatcatgtggcaggaaatcattgtatggttcaggagagattgataatacccagggtaccacagtaaaggctgaagcctagattctracttaagcttctctttgccccctacctgggcttttcccactctgtttccaggcttcctgcaccatgcttccatgcctttcctccacagtgctcttgcgaa

SEQ ID NO: 25151 - DNA, 201 bp, Homo sapiens
agaattggcctttacaaccttgcctgtttctgtgggcaagggaaagagagggaacccactatcagtgaagcatctcctgtgtgtgagatgctttgctcatyactttaagcacatgatcccattgaaacttgccaaggatatcatgtggcaggaaatcattgtatggttcaggagagattgataatacccagggtaccacag

SEQ ID NO: 25152 - DNA, 201 bp, Homo sapiens
ggaagcggaggttgcaataagccaagatcgcgccgctgcactccagagcaagactgcctcaattaaaaaaaaaaaaaagaaaaaagaattggcctttacarccttgcctgtttctgtgggcaagggaaagagagggaacccactatcagtgaagcatctcctgtgtgtgagatgctttgctcattactttaagcacatgat

SEQ ID NO: 25153 - DNA, 201 bp, Homo sapiens
cttccctccactattgtcctgtgaccctgctaaatctccctctgcgagaaacacccaagaatgatcaataaaaaaaagaaaaaaaaaagtgttggaggttrggacttcaacacaggaatttaggagagaacaaaattcagcccataacaccaggtaaatagccaaatgaatgggtgctggtgagaagcaccaagacctaaa

SEQ ID NO: 25154 - DNA, 201 bp, Homo sapiens
tagaattgtgatattttcctgttggactaatccttttaccattatataatgtccctctttgtcttttttaactattgttgctttaaagtctgttttgtctrtagctactcctgctcgcttttgttgtccatttgcatagactgtctttttccacccctttaccttaagtttatgtgagtccttatgtgttaggtgagtctc

SEQ ID NO: 25155 - DNA, 201 bp, Homo sapiens
ttcaactagggggtttccgttccttgtgggttgctggaatgagagcctcagtccctcactggctatctgtttgctggaggcctccctctgttcctgggcaygtggacttctccatagggcagctcacatcatggttcttagagcaagcaaacgagaaaatgatcaagagcaggtagctaagatggaacggaaaccacagtc

SEQ ID NO: 25156 - DNA, 201 bp, Homo sapiens
tgacaccagtggctgcccaaggggagtctgctggtgggaatttacaagagcagcttcgggcctctcatatggatggaaagaggatgtaaaggttactgagragaaggtgtatttttgttatatattattaagctttcatgttatttaaattattcgataacagagctgggtatggtggctcatgcctgtaattccagctac

SEQ ID NO: 25157 - DNA, 201 bp, Homo sapiens
tgatttattaatcacttccttggctgagctttcttgcctggctctcctgggaagcaccagtgttgaggttgctcagggttcagcctcagcatgggctttargtgtccataggccccgtgttgccttgtttctggaaggctttgctgagctggaatgcagccagatgttggaaccagaggtgcacaccttgagtaaactcct

SEQ ID NO: 25158 - DNA, 201 bp, Homo sapiens
agacattcatatcccaagcatttgttggatccaggaagatccagatccatctaggttaggggccacaaaaataagacaaaaatctctgcataaagggccaytgggattgcaactggacagtggctgattatctctaggaagaggctgaattctgaaaacattttgtatatgcaatgccccggattggttaaaggagagata

SEQ ID NO: 25159 - DNA, 201 bp, Homo sapiens
caaggaaatttattcatcactgaattctcctgagagttcagcagctcctgtgagcatggaagtgcccccgtctcaatctttttggacaatgaagatgcatrttccaaaggttagatttctctgaaatgactggtttttcaagatagtaggaaagcagtattggccacagagatccaggtggctgcatgaacaagaatgcaa

SEQ ID NO: 25160 - DNA, 201 bp, Homo sapiens; identical to SEQ ID NO: 8037

SEQ ID NO: 25161 - DNA, 201 bp, Homo sapiens; identical to SEQ ID NO: 8038

SEQ ID NO: 25162 - DNA, 201 bp, Homo sapiens; identical to SEQ ID NO: 8039

SEQ ID NO: 25163 - DNA, 201 bp, Homo sapiens; identical to SEQ ID NO: 8040

SEQ ID NO: 25164 - DNA, 201 bp, Homo sapiens; identical to SEQ ID NO: 8041

SEQ ID NO: 25165 - DNA, 201 bp, Homo sapiens
gattccctgtgagctggctctgtgggcatgggtcatcacagaatgctgggtttgtctatgggcagctgtgtcagatgatgctgacagcacatgttatcacwtgcaaagtccttgtgccccggagttctggaggcaagcttttacctgccaaagttgcagtatgaaggactggactacatttgaatttttactttgagccat

SEQ ID NO: 25166 - DNA, 201 bp, Homo sapiens
tttacctgccaaagttgcagtatgaaggactggactacatttgaatttttactttgagccatgaagaattactggtttacactcaagctaatctggaggtraaggttgcctcacagaaaatcctagggtccatagccttctcaggaaagaaaataataatatgaataaaaaataatatgaataaaaacatgaatttttggt

SEQ ID NO: 25167 - DNA, 201 bp, Homo sapiens
gcaagttgggtgtaaaagagagccctcttgttccattaatcattctttgattacaagtgagattgagtatatattaagtggctatttgagtttcctcatcrgtgaaagtacctgttcatgggctttgtccatttttctactgggctgcttgtattttcttatatcattttgtcagaaaattctagatattgatacttcgtg

SEQ ID NO: 25168 - DNA, 201 bp, Homo sapiens
tttttcattcttggtgcagatggtgtagttattttaagtaagtgatgtgctgcagtgaaaatgggcaactctttttcatttttcagcttaatgaaaaaaaragaagggaggaggagaaaccccagctagccaacttcgtgctaatgcttgtcttttttggattctaaatgtgtcccaaggcactaagatgggataaatatt

SEQ ID NO: 25169 - DNA, 201 bp, Homo sapiens
cattgtgccatgtaagagagagagcctccagggttggcgagagtttttgatccaggctttttcaggtgtcaaagatgagctgggtgattctccatagattytcctttctaacaggtgacagttctgtttcagaaatactgtggatgttcaggtttacagcacattagtcaaaattagcacctcctcttccctgaaccattt

SEQ ID NO: 25170 - DNA, 201 bp, Homo sapiens
gagctgggtgattctccatagattttcctttctaacaggtgacagttctgtttcagaaatactgtggatgttcaggtttacagcacattagtcaaaattarcacctcctcttccctgaaccattttcaggagatggaatccagggatctcttgatagtctggttctgaggagtgggctgggggacagcctaggatggggag

SEQ ID NO: 25171 - DNA, 201 bp, Homo sapiens
tgctccctcccttgaagctgggacagaagacccaagactctggttgggaagaagttgagtcaggtctattgagataaggcttcctggagcctagagaaaawctgagaagaacttatccaattaagtatctcccaggagaagagtgactgtttcattttctgaagtgactaaatcccccagttcttagaacgtttgtttcat

SEQ ID NO: 25172 - DNA, 201 bp, Homo sapiens
attaagtatctcccaggagaagagtgactgtttcattttctgaagtgactaaatcccccagttcttagaacgtttgtttcattatttagttaagtctcctrtcacatatctctgctggtgccattctaatcctattctggtggtgatagggggacttggacggcatctgcaagaatcccaccaggcctcttccatctccct

SEQ ID NO: 25173 - DNA, 201 bp, Homo sapiens
agtgacagtatcttaatccattcaaataccactaactgggtggcttataaacagcaacacttatttctctcagttctggagtgggaaagtccaagaccaasgcactgacagatttggtgtttggtgagggctcgcgtcctggtttgtggacagccgtcttctcactgtgtcctcatatggtgtaaaggatgcctgagctcc

SEQ ID NO: 25174 - DNA, 201 bp, Homo sapiens
ggctctgccacttgtcagccaagaaatcttgtgcaagtcactgagttctttaggttgcagttttctcatctggaggagggatgaagtacctcatctcagtrgagcgcccagcactggggttgatgccctctgagcactcaggagatgtctctttgattttcctttaatcattagtaataagtagtaggaataataacaaca

SEQ ID NO: 25175 - DNA, 201 bp, Homo sapiens
ctctacttctaaagcagtgggtctcagtcagaggtgattttaaccctcatagtcatttggcaatgtatagagacatttttgatggtcacaattggggttgyagctggtgtatatggatagaggctaggaaagatgtgaaacaccttacaatgtataggacagtcacctcaacaaagaattatccagctttagtgtgaagag

SEQ ID NO: 25176 - DNA, 201 bp, Homo sapiens
gaaagttgcagagctggggtttaacttaagtggtccaactccagagttgttgctcttaatcaccccaccacagtgcttgttgaggaaatgaatgtggaatktgaatgatgaattcacactcatccttccttagggtagcctttgtaggattgggattcagtctgatctgggttcaaattttgtaactgactcacattttat

SEQ ID NO: 25177 - DNA, 201 bp, Homo sapiens
aggaggatgctgcattttgccatgattcctgcaacccagagaaaccaattccagcaaagatcgatgccctgtacccggtgcaaatttagaatgataaaaaraagagtcatggtttccttgaccagacaggagtgtcccctactttgcagaataatgaaatacacagatgttaaaatgaaaagagacagagatggatggaga

SEQ ID NO: 25178 - DNA, 201 bp, Homo sapiens
cagatgttaaaatgaaaagagacagagatggatggagaataatagagcgcagcagcagttaaggagcaacttaacaaaaatgcagaggaaccatgggatgmtctcagcctttgtgcttctaggagcgtcattgccaacttgagagaatcagcccatcgcagacaatcctaggctggaggcttttctcatagctgtctgtgg

SEQ ID NO: 25179 - DNA, 201 bp, Homo sapiens
gctgcctgggaagagtctggggaggtggccagagacagcaagcccatgctgaagtttccatcatcctccaggaccttgagcagccctgagcccttcccagrcagattgggagctacaggcatgatgtctggggaagagccttctatacaaggcctggaaagttctgctcctgtgggagaagggctttttcttgggagtctc

SEQ ID NO: 25180 - DNA, 201 bp, Homo sapiens
catcatcctccaggaccttgagcagccctgagcccttcccaggcagattgggagctacaggcatgatgtctggggaagagccttctatacaaggcctggamagttctgctcctgtgggagaagggctttttcttgggagtctctcctgtacctgtcccagatgaggggtttgatcaggtatggctctagggtaccctgcct

SEQ ID NO: 25181 - DNA, 201 bp, Homo sapiens
aaggcctggaaagttctgctcctgtgggagaagggctttttcttgggagtctctcctgtacctgtcccagatgaggggtttgatcaggtatggctctaggktaccctgcctaaagtgtagtgtagttaaaagaagctggactctagagcagaagaactggactatagaccagtctgaccctaaatagctatgtgactttgg

SEQ ID NO: 25182 - DNA, 201 bp, Homo sapiens
tgtgccatgggaaagatttgaaccttgactttgtttattagcagtgtcaagttacttcacttctggacctcagttttcttatctgtaaaatgttttttttktgtgtgtgagaacttaaagaaaaagatatctgtgaaacagagcgcaatgcttagctcatattaagcattcagaaaatgctagccatgttctccggcctca

SEQ ID NO: 25183 - DNA, 201 bp, Homo sapiens
cctgtgtagttaagatttccaagatgggaagatcttcatggccttcatgagaaagcctggaattggagagcagcatgatgactctaggttttattctaacrtaatgggaaggcagtgacgttcttactagaggagtgatgtgctgaggcttgaggaaacactctcagcgtagatggcaaagcctataagcattcttccctc

SEQ ID NO: 25184 - DNA, 201 bp, Homo sapiens
tacagacagcaagaacatggaggtaatttattgcctgtttgtttcaaagaaatggcccttccttcttggaggaccatgggtcctgcctctaagacagaagmcaagagggatgctacatagggcctgctacctgggatgtagcaataggtctcatcttacatctcctaatcgcaagccggagcaccagaaccattaacggga

SEQ ID NO: 25185 - DNA, 201 bp, Homo sapiens
agtggtccgtggtggcctgcgtggactgggggcctgggaaaccatgggaaggatgttgcgctctctcccatgggccgtgggaagccacggataagacacgygaaggtgggggcagtgggaacatatgggggatggcttcaggaagtatttcaggctagaatcgccaagatttgatgacaaactggatgagagtagcaagct

SEQ ID NO: 25186 - DNA, 201 bp, Homo sapiens
ctctcccatgggccgtgggaagccacggataagacacgcgaaggtgggggcagtgggaacatatgggggatggcttcaggaagtatttcaggctagaatcrccaagatttgatgacaaactggatgagagtagcaagctgcgttatcaccatggggatactaattttgtggaactagagaatctgccgtattattttctga

SEQ ID NO: 25187 - DNA, 201 bp, Homo sapiens
gagatggagtctcactctgttgcccaggctggagtgcagtagagcgatctcagctcactgcatcctccgcctcccgggttcaagcacttctctgcctcacyctcccgagtagctgggattacaggcgcctgccaccacacccggctaatttttatgtttttagtagagatggggtttcgccatcttggccaggctggcctg

SEQ ID NO: 25188 - DNA, 201 bp, Homo sapiens
ccccaggaagcccagtatctctgccttttcagtgaagcctctgtcttctagagtatgcctttcccttcatttgaactgatttgagtggattgcaagctctyaccaagaatggtcagtgtcagtcagtcatacatggagtcatggaagacctacattgcatacctctgacaaataggaaggaatgggaagacagggaaaagg

SEQ ID NO: 25189 - DNA, 201 bp, Homo sapiens
ggagtcatggaagacctacattgcatacctctgacaaataggaaggaatgggaagacagggaaaaggttcagaaagacagatatgtgcacatcttttgagsgacttttgggatctagtttctagggtttcttctatgattctttctcacattaggttcttaatgtggaatatttgaggtggcccagggattctgtattagt

SEQ ID NO: 25190 - DNA, 201 bp, Homo sapiens
tgatgagctaaaaataaaaaataaaaaaggttcgtccgtaattttcttgatatccaccacaaaagataagcaaaaaagtcctcacattcaaagaacactcwtgattctaacctacagtatgtatcagcttctggatttttttcactttttggctattatgaataaggctgccatgcacatttgtgtgcaagtttctgtgtg

SEQ ID NO: 25191 - DNA, 201 bp, Homo sapiens
aacttcactttacagatgaggacattgagtctcagtctgggaaagcattttgcctggggtcacctaggagtgatcagaaccagcatctgaacccaattctstctgtgagcctgtgaacctgttccccaggcacaacgcgctgtctccggcagccttgcttcccctgcttaaaagtcacaaagaactccctggccagaaagg

SEQ ID NO: 25192 - DNA, 201 bp, Homo sapiens
tacgaagaaggaaactaaggctacaaatgttaagtttcttgcccagggccacatagctagtaaacaattgggctgggctgtagtcaactcaggtctctttmcaaagcccatggtctttccatggcactccgctccctccttaatagatgctaagttccgtgagggcgggatcccactttgaattgtttttagtcttccacc

SEQ ID NO: 25193 - DNA, 201 bp, Homo sapiens
agatgctaagttccgtgagggcgggatcccactttgaattgtttttagtcttccacctcctccattgagcttgataaatgtatattggtcaaaatccccartcctgtctagtgccagttacacatcagtgtctgtagtagagaccctggcgctagcatgaattctaccaagcaggctagactttacaatcaatcaatagaa

SEQ ID NO: 25194 - DNA, 201 bp, Homo sapiens
agaatgcaaagcacttagcctagttcaagaacatagttatccatcactttaggatacagcaggggcctcttgttcacccctgttattcccaggggtacccrcctggctcatagtaggtgcgcagcaagatttttttcaatggaaactagagtgggatgcgcctatctagaaaatcctctgttggagcctagtcttggtcct

SEQ ID NO: 25195 - DNA, 201 bp, Homo sapiens
agttcaagaacatagttatccatcactttaggatacagcaggggcctcttgttcacccctgttattcccaggggtacccgcctggctcatagtaggtgcgyagcaagatttttttcaatggaaactagagtgggatgcgcctatctagaaaatcctctgttggagcctagtcttggtccttaaaagtcctgggcctgcctt

SEQ ID NO: 25196 - DNA, 201 bp, Homo sapiens
gggcctgccttccccctgcctttaagaagctgagccagcaatagtagcatgtggccacctgcagggctctgtggaggaaagagctttgagctgggaaattwtgttcttagatgagtcgtgttctgcctcgccatttctttagtggttctcaatcctagttgcacattagaatcacccagggagcagtttttagagactcca

SEQ ID NO: 25197 - DNA, 201 bp, Homo sapiens
gcctttaagaagctgagccagcaatagtagcatgtggccacctgcagggctctgtggaggaaagagctttgagctgggaaattatgttcttagatgagtcrtgttctgcctcgccatttctttagtggttctcaatcctagttgcacattagaatcacccagggagcagtttttagagactccatacaagagattgactct

SEQ ID NO: 25198 - DNA, 201 bp, Homo sapiens
ctgagccagcaatagtagcatgtggccacctgcagggctctgtggaggaaagagctttgagctgggaaattatgttcttagatgagtcgtgttctgcctcrccatttctttagtggttctcaatcctagttgcacattagaatcacccagggagcagtttttagagactccatacaagagattgactctgctgattcgagg

SEQ ID NO: 25199 - DNA, 201 bp, Homo sapiens
catggcagtgcctctcagtgagacatggaagggggaaaggtgacctggactctggagggtggaaatgaaatttttctcttttgcctaaaggctttccttgyaaatagaagccagtttgttagaaaacctctgttacaaagagcccatttcattcatgtattcttttgtccatttgtttgacaaatatttatttattttcca

SEQ ID NO: 25200 - DNA, 201 bp, Homo sapiens
ccaagagaagagtagatgttgcagtcttgagtcagaagggagtctggaagcagaattccttcttttcccgggaacctcagtcttttctctgaaagccttcractgattggatgaggcccgcccacactatttgcttgaactcagagatgttaatctcatctgaagaaatatcttcacagctgcatctggactggtggtgga

SEQ ID NO: 25201 - DNA, 201 bp, Homo sapiens
cagcctcctcctggtggatgtacaccgaggaggcaggagctaccccacactcactgatctgaggcatcaggtggccgggaggttcataactcaactgttgygtattgatggcagagttgtttttacatatatatatatatatatgtatatgacatgtaggcaattaaacttagaatgggaactgaaagatgaagaattaat

SEQ ID NO: 25202 - DNA, 201 bp, Homo sapiens
gaactctgcttgtcagagaggatctttgaataaaataatgctgtctggttcttttcataggtatcgtttaccctttcatattggttttcagttttaaaaaktattttcacatagaagaaatcgggactgaaaatgcgttagtgaccagctcaaagtcacacaatgacttagtgagaactcgaaatggaaacaggatctttt

SEQ ID NO: 25203 - DNA, 201 bp, Homo sapiens
tcgttttcattctttgagctctaaattcgtattcccctcttaaaatgtgtttattgtattttagaattaaaaaaataaggtactttccaccatggagatgscttggagtgatggaactgtttttagctatgggattgccccagggatggatctatttttggttgttgggttttcttgtttgttcttttcccctctttctgt

SEQ ID NO: 25204 - DNA, 201 bp, Homo sapiens
aagagatataaatagagtgaaaagttaaggaaataaaatccattatgtaaggactacttttatggtatcatataagtaatttcatagcattaagcattaaratagataaacagggttactgcaaatgacaaaagattcattaaaaaacaaatatctgatcatcccacataaaaagacatgaagaattaggaacataatgaa

SEQ ID NO: 25205 - DNA, 201 bp, Homo sapiens
cagaggctcatgctgtcctgaggtaaagcttgaagaccttgcactctttcctcctaccaggcatttggtgttttctgatcccgtgtggtcccaaagacccragggtcaccatgatggaagtctccctgcagggactgggcctgctgggcttcccttagttccctttccagtgcagctgtcttggacttttccaaattcagc

SEQ ID NO: 25206 - DNA, 201 bp, Homo sapiens
ggtttatgggaacactgaaggagctgccggtgtgggggaggagtcccagttgtcagtaagatgttctctggcaactggtttttgtatctggagctcagacragagatctgggcagggatggggatttggaaagtactggcatctagatgaccactcagctgtgggtaccaatgaggaggaggagacgaaaacttgttaagc

SEQ ID NO: 25207 - DNA, 201 bp, Homo sapiens
attcaagatgggctgttcctcacacatctttgggaccccagctttgctttgcttgggacatgtgattctgacccagtaccccagacctgaaggcccctctrtgtgtcagtcctgaaaggattcgctgttttcttagcctcatggtctctcctaagcaggaggcattgctttacctagagcagattattgagctggaaaaga

SEQ ID NO: 25208 - DNA, 201 bp, Homo sapiens
tgagttgcagttgtgttgtagtatgatagagttttccttcctgaggttgaccatggcttagtccttgctatacagggtagtgtgaggattggatttctcasgttagcggagctttagacgagcgttgagactgtctgtctcagagcctctgatccatttgttttaggttgttggagtttatttgcctcttctgaagacatt

SEQ ID NO: 25209 - DNA, 201 bp, Homo sapiens
gcatctcccatcaagttggcatttccctggctttagctttcgacaggaaccagctgtagccctgctcagcacaggctgagaacacactgtgggggtgagcrtttgggtgcttgaggcatgcttttgttgcatgttagaaaagctgtattttctgcttttggttcttccactgaaaactaaaggacgattccttcttacttg

SEQ ID NO: 25210 - DNA, 201 bp, Homo sapiens
gatttacctagagattttgggttcccagcaaacattttagaaagggccctcacactactaattgcaaaataaacatcttcagcctcatgtgcagctgactkatttggccagtgtttatgtttatggggaagagaaggaacatttgttgaccgcccacaatgcattaggcattttttttttcataattacttctgttaatcc

SEQ ID NO: 25211 - DNA, 201 bp, Homo sapiens; identical to SEQ ID NO: 8042

SEQ ID NO: 25212 - DNA, 201 bp, Homo sapiens; identical to SEQ ID NO: 8043

SEQ ID NO: 25213 - DNA, 201 bp, Homo sapiens
aggactttgttaaatgataaaatattaatgaatctccaaatccagagatagaaaagtaggtgcaaaaatgggatttgaattttacttgcttttactgttcstgaccgtttcttgaacatgtgttattattgctctggtgtaaaggcataaatccatgagatagggttgagagggcaagtttgggcaaatgatcaccacgaa

SEQ ID NO: 25214 - DNA, 201 bp, Homo sapiens
gaggaacccatgaggcagtaggagaaagatgtttatttctgggggaaggtttagggagctatccacagaaaggtggtggttgaagcagtgatactggactygttccccggaaaaggcagggttgggtgttggacaggagataaccatgtccaggaagcctttaccgacaaggaagaaacagactaccattagcaatgactg

SEQ ID NO: 25215 - DNA, 201 bp, Homo sapiens
tccagggtcctggaccaggccccatgggaccacagaaacccctaagacttgtctaccatagtcccaaatgcaatcattctgaaatctggctgagccaagtraatagctgcagagggtctggaagaaatgtagtgaaatctgagctgtctggggtctttggagagatctgccactctggttaagtacgtctgcttaataact

SEQ ID NO: 25216 - DNA, 201 bp, Homo sapiens
aaggcatgaacattgtgatgtatattttgatggttgggaggcatttttctgtggcttgctgctacgtttgggctgtgttcctctaccatcctctgcttctrttttttctgccctgcaaaggatgggggagattacactgtgttttatgaggagtcattgacaaggtggaatgctaggtgtggttgtatacaaggatatagc

SEQ ID NO: 25217 - DNA, 201 bp, Homo sapiens
ggttaggcctgtcaatagtttgggcaacaccctcttctgtgcccatcccagtattttactgaagcagatttttgcttgcccttaagaagaatggtgggtcyctctgtaggctgtttaaagctcctatttttttaaattctgctttttctctctcaccatattccacgtcccataaatatgaggtttatggagaaagttagt

SEQ ID NO: 25218 - DNA, 201 bp, Homo sapiens
tgaagcccaactcttgacacatactttccttagaatctcagctttgtgccttccttagccagagggcatccccttagaaaataagctacatatgcacgtgstcccagaaaataaggcccaccaggcagttgctgacacctgtcagtttcatgggtataacagccaccccacaaggtgcccacttgtggaaggcattgctgt

SEQ ID NO: 25219 - DNA, 201 bp, Homo sapiens
ctgcaattctgcagcctcatccttcgtagggtgtacacatctccctgccctgagtgagactctggtattaagggtgtgttttcttgcatcatgtaacctcyatgtccaaaccgactaactcattttggtgcttgaccaaaggaaccccagcacatcagtgctgtgggaaaactgacccacactgagctctatgcagtattt

SEQ ID NO: 25220 - DNA, 201 bp, Homo sapiens
cattttggtgcttgaccaaaggaaccccagcacatcagtgctgtgggaaaactgacccacactgagctctatgcagtattttcctgaagaatctcagagakagtttgactagacaaaatattgccctatgccacataggatttgacccactgtcatcttttttttttttttttttttgagacggagtctcactcttgttgc

SEQ ID NO: 25221 - DNA, 201 bp, Homo sapiens
agagcagtcagggatcaggggtagggcttgctgtctctctgcaagtttgctctgcaagtttctggagccctaagactgctgtgttgtgctgcttgattgtrgaggggacatttatccctccatggactgactgctgtggctctcagctccccaacccccaacaccctttgactctcttgggtctttctaacattcgttcat

SEQ ID NO: 25222 - DNA, 201 bp, Homo sapiens
tcctcagcaacttccagaccgtgcactcatgacctttggaaggggcagccctctgctctccaagacacctccctgccatctcagtcattgttgaccaaacmttaagtggacaattgatcctaggctagtctgtttatcagctggccagcagcaaatcagaatgtctctttcaaagacactcagggctgaatcagccttagg

SEQ ID NO: 25223 - DNA, 201 bp, Homo sapiens
ttggactgagccgataggtcaaaggttagcttatgcagtagcatgggctgtaggttttttgcactgatcaacaccggaacttttagaagacttttagaagrtttgttgctgctgtgagtgacatcagttcacacagcctgagagagaactctcagtccatgctgtccctccttgggctcactcaagtgaaatgggtcgagc

SEQ ID NO: 25224 - DNA, 201 bp, Homo sapiens
gagagaactctcagtccatgctgtccctccttgggctcactcaagtgaaatgggtcgagctgcaacactgtgcggtgccaaccgggagaaatctgcctatyggggctgagagacatcctgtagtggctgcccgtctcctttgccccaaatgtcaagtggaagaggtgcttcacatatttatttcttcctacatgggctcat

SEQ ID NO: 25225 - DNA, 201 bp, Homo sapiens
aagggtctttgcaggtgctgttacctctgcctagaactgtgttcctgcaaggtcacccgttctaccttagctgtttccctcctcacccttagtattattgwtcacagtgtccagagtgtttgttccagggcagttatcatacttatcagttgtgcctttatgattgtgggtctgcactctgatctgtgcattccatgtaag

SEQ ID NO: 25226 - DNA, 201 bp, Homo sapiens
cccctcaacctgatctgctgcaaaaggctaccccccttggaaggcagctgatagagaagctgtaggcttatgctgggaccccaccagggacaaatgaggcygatttggagacactgtggaaccaggaagtcagtctgcacattgtgatctgcgcctgcgatgctcctccccacccttcacgtacagtgctgtttggagggc

SEQ ID NO: 25227 - DNA, 201 bp, Homo sapiens
aatagtaatggctagcttttatcagctgagaccctatgcttacagttcactgaagagttgagagacaggcattgaacaggcaatttcaagtgtgatgattygtgtaaggaaaagtgtaggacacgatagtagcacggtgggcttccctgaggaaggggcatttggctgagacctgaagggtgataagaccctgaagagaag

SEQ ID NO: 25228 - DNA, 201 bp, Homo sapiens
tatgcttacagttcactgaagagttgagagacaggcattgaacaggcaatttcaagtgtgatgattcgtgtaaggaaaagtgtaggacacgatagtagcayggtgggcttccctgaggaaggggcatttggctgagacctgaagggtgataagaccctgaagagaagagtcttcccggtggagggagcagcatttgtgagg

SEQ ID NO: 25229 - DNA, 201 bp, Homo sapiens
tgaaatcacccagcccctacccgtgtccctattcactcccaccaaaaaaatcctccatatagtctgttttacaaattcatccattcttctttcagggaggktttcatctatacttctggctttgtctgcttccaactccctttggccatttgcacagatcagcttttctaacagaaaggtgtgcagaaaaaagttgaaata

SEQ ID NO: 25230 - DNA, 201 bp, Homo sapiens
ggaccggagattattgtcaagcaagatgagtaaattccatataagtttctgtctgagcactggctggctctggttgctgtgggagagaacttttaattgarcacagttgggggtatctctgctttcccagaccttttgctgggtcagttggcacccctccctctcttaggacattgaggcttgtctctggattaccttggt

SEQ ID NO: 25231 - DNA, 201 bp, Homo sapiens
atggctgacagtctccccagagtggatcacagctgtctaggaaatctgctgacctagaaagattttcagatgctgttaacaacccacagatcacgctgtcmagtattttctttcttcagcagctcttggcatggcgagcatgtgattctgcccctctgctctgtggcctttcagtgacattcattatttatccgggtcctt

SEQ ID NO: 25232 - DNA, 201 bp, Homo sapiens
taagaactacttttatatcacaaatatacagataggaagtcattctacattcagcacactgacgcaggtattttttaatacattctattcccttcttttcrttttatgctggccctgacccactatgttagtttctgtacttattatactatttggttgagacctgatgttgaaaaaacattccagtgggatagtctatga

SEQ ID NO: 25233 - DNA, 201 bp, Homo sapiens
tcagggtagatgctgtgtcagttttcttcccaaagtgccacattcagttctgcatcctggttccagggggttcctacctgcctcggtacactatcattttycctcatcctcagcattagttgaaggtctcttccatcctaagtcagcagctcttcttcagctgggatttgtctgcctcttcactctcttctgcttgtggcc

SEQ ID NO: 25234 - DNA, 201 bp, Homo sapiens
ttaaataggaggtgactccgcattcctcttgcttggaaatgatccccaggatggaattgtgtccagggtgtgaggttgtttgtgaatcagtcctttccagrtagaatatatgaggcttgaaactacatagtgcttatcaccaagaggtatataggtttgtcagagcaagaagaccactctcccctccacctgcccccgcaa

SEQ ID NO: 25235 - DNA, 201 bp, Homo sapiens
gttagttaacttttgggagacacttcacaagctggtgtgaatgaaagaaaagcagcatgtacttttacaaaccttaatttaagcaaaggtaataaatttcmacctactcaaagcagaactagggtgtgattacttgctttgtaaaagattttttgctttggaaagttagaaatactggttttcaaaatatgttttgatttt

SEQ ID NO: 25236 - DNA, 201 bp, Homo sapiens
tgcgctggtaggaacaattggtctgtgacagtacttgcactttaaacgtgagctatcaaacaaaaacctctttcaagcatctctagcctcgcaacagatgrtctgggcatgcagaagaccactgcacccccacttgtctcccaatcttggatccaccttaatgatggaagcacagatgctgtgggaacatttcagaagcct

SEQ ID NO: 25237 - DNA, 201 bp, Homo sapiens
gtccatgaaaacctatttcttatggaccagaagcacactgtgaacaccaccattctagttacacctaaccactgtttataacattgtgcagggtccagctyatcccctgttattggccatttatgttgttccaactgattctctgttgttggcccctgaagtcccaccgtctaattccttttgaacattcaagtagctttt

SEQ ID NO: 25238 - DNA, 201 bp, Homo sapiens
ttttaaaatagggagaaaggactcataattctaaaagccagactaaagggctgcaaaacagcccttcgatgcatcagacttgtgcctgtgtatatttgttyatggcctgactttgagtcactgttcttaaggaaaaatatattctaaatccctctgtggctcccctcctcagtcacccaagacacttgacccagcagtgac

SEQ ID NO: 25239 - DNA, 201 bp, Homo sapiens
cagatacctctgggtctatatttacttgtgtttagcatctgcacgtaaagaaagggaagttaccccctgctacctcccatcagtcaagcatcacctgattsaaggacatactaagccacagtcagcccatcccaactttttgccaaaatgcctaccccaaaagacaaaaaaaaaaaaaagcataccccatccaaaaagctg

SEQ ID NO: 25240 - DNA, 201 bp, Homo sapiens
aaaaggaatgtgtgatcaatcttttatttaatacatatttatgaggtgcctctgtgtgtgaagttaagtgctgggtaaaagggcagtgtagcatcacagtygcaagcatggattcgagagtccaactgcccgggttgataactgtgtgaggttgtgctgggtacacagtctttctgtgctgtggtttccccttcaggaaaa

SEQ ID NO: 25241 - DNA, 201 bp, Homo sapiens
agaagattgtagtaaatgtataactctagcatgtgctatgatgaaagagagataactagatttaggtgaacatgaataaggggatctgtcataagcatgamggtcatcaaatgcttttctgaagagcagatgattgacctgagatgaaggagaggtcttaattcaatacaagatcattaactcagaaaatatagaaaaata

SEQ ID NO: 25242 - DNA, 201 bp, Homo sapiens
ggcaccctggctggcccttagtaggtgctaggaaatgtaggatgaatgagtgaattcattctgctgcctgccctccgtgggattcatctttgtatcacatyagacggtgtaggtccttttattcctcttcctaaggaggccagcttgggccctctgttggcaacagaagactttgatttcttcactttcttgttttaaaca

SEQ ID NO: 25243 - DNA, 201 bp, Homo sapiens
gcagtgagccgagatcgtgccactgactccagcctgggtgacatagtgagactctgtctcaaaaaataaaaaattaaaaaaaaatacacagactgagtacrtgcttatgatacaaaattcatacaaattagaagtaatggcaataataaaacattaaaatcctccttcatcttcctttcccatttctctcccctcccttaa

SEQ ID NO: 25244 - DNA, 201 bp, Homo sapiens
caataatcatcatctcagccattggctttctttgcggaaaacagcaggatgtagacccaacttgtggtatttctgtaacatatatacccacatgtaaacaytactgttcttcgtcctgggaagaaattcaacattggccataagaagtctccactctgtatgtgcttaccatctatttttaaatgacctgtttggtattat

SEQ ID NO: 25245 - DNA, 201 bp, Homo sapiens
aggaaaacaggacactaccagcgtgaaaaacggggaccagctttagattgagtgtccatgaagggacctgaagaagtgatgtaagctgaggtctggatgartgaggttagccaagtgtattagtttgctcgggctgctgtgaggttggtgcagaagtaattgccttgtgcattatgcagttacttctgcaccaacctaaca

SEQ ID NO: 25246 - DNA, 201 bp, Homo sapiens; identical to SEQ ID NO: 8044

SEQ ID NO: 25247 - DNA, 201 bp, Homo sapiens
cctccccaagtgctgggattacaggcgtgagccaccgcgcccagcccagaaacctagatgcttcttatctctgagtccttctgacctcttaaccctaggcygtagacctcctcttctcagcataaaagagaagagttttggaaagaattttctacgagagaatcttgtggcaaagctgtttcaactggatgccttctttct

SEQ ID NO: 25248 - DNA, 201 bp, Homo sapiens
ggattttgcctttgattttggacttacaatatacttcttttgtattttagttaatcctttagtaagtgagtatcagcttgatctctgcttcctgctgtccrtggggatcttataatctaagggagaaattacacacacacacacacacacacacacacacacacacacacacacaccccagaataatccaatggcaataaa

SEQ ID NO: 25249 - DNA, 201 bp, Homo sapiens
ttgagcttgggaggttgaggctgcagtaagcccagatcatgccactgcactccagcctggcaacagagcgaggccctcaaaaaaaaaggagaactcagggracaagaatcaaggtggcaaaggcctatgacctttgcccacagaataaccacccctaccctggagggccaggacggttccttcctctccttccatcccaag

SEQ ID NO: 25250 - DNA, 201 bp, Homo sapiens
gcattttacaatgtgcatgtcagaggaaaatcggaggctctgggcagaacatcctgggtatccccttgtcataaatatggcatagcaagggggtcaggtcmaagccatctcttcctgctatatccggggcagcataaagagaccaggaaactgaggtacaaagaaggtaagtagttggcccaaagtggaaaaacgagccaa

SEQ ID NO: 25251 - DNA, 201 bp, Homo sapiens
gaccaacaacgtgaactgtcaagaaccagagaaataattaaagttataatattaacaaaacaacatggttgtagaggggatggataaatgattttattccrtttttttctttcttctttttttttttttttttttttactgcctcaggcatatttgttggcattttcagaaggagatagaatcaggagttatttttctgct

SEQ ID NO: 25252 - DNA, 201 bp, Homo sapiens
taaatgagtattcacttcagcttgaagtcaccagctgcattagctcttaacaagacagttagcctgtcctgtgaaatttgaagccaggcattgacttattytgtctagatatgaaagtcctggatggcatcttcttccaaaagaaggctgttccatctacattgaaaatctgtttttagtgtagccactgttatcagtgat

SEQ ID NO: 25253 - DNA, 201 bp, Homo sapiens
ctaactgtacttcttggagtgccaaagggagaaaggagagcacctgagccatgggggcttggagcatggactcttgtccttgccgaaaacaaagcagctayaagtctattttgtaaaaaatatctattgggcttgagatttgattttcacagaggcttctgtggtaaacagacaaaagagttgattcctactggacttgct

SEQ ID NO: 25254 - DNA, 201 bp, Homo sapiens
atactatccacactacaagactgtcgtgaaggtcaaatgagatcatgtgactggcacgcctggcacatgatagatacttaacagcttttcttcctttcctrtaatactgtcttattaatgcattatatatatatataataaaatgtatagctgggtttttctgttaggtcatagaataggctatgatctaacagagtgtag

SEQ ID NO: 25255 - DNA, 201 bp, Homo sapiens
cttcctgctctttggaggaagtgaaagataattgtgcagctgagttctataaataaaagtacagttggagaaaacgatatttttggggctgggcatggtgrctcacacctgaaatcccggcactttgggaggctgaggtgggaaaatcacttgaagccaagagtttgagaccagcccgggcaacatagtgagactctgtct

SEQ ID NO: 25256 - DNA, 201 bp, Homo sapiens
ccactctctggctttctcagcactcagctgagaacctcggctaacaacacactgcacggggttggccacatgcccattggcctttcccagtgggccgtgarcttcttgacttctcaggaagggggtcgttcatcttggttccacagcctggagtggagtaagggttccactcatatttgtggtctgagtgagcacacccag

SEQ ID NO: 25257 - DNA, 201 bp, Homo sapiens
aagaactttttatttattattatttttattttttgaggtagtctcactctgtcacccagcctggagtgcagtggcatgatcttggctcactgcaacctccrcctccctagttcaagcaattctcctgcctcagcctcctgagtagctgggattacaggtgcccaccaccatgccagctaatttttgtatttttagtagaga

SEQ ID NO: 25258 - DNA, 201 bp, Homo sapiens
gaggagagtttactgcatttttaaaagcatttttgaagagtctaaatctgtcttccacccaagccatccattggtcccagctatgttttttttttttttttgttctgttttgttttttaaaaattagagacgaggtctcacttgttgcccaggctgttctcgaactcctgacctcaagtgaccctcccaccacagcctccc

SEQ ID NO: 25259 - DNA, 201 bp, Homo sapiens
ggaggagagtttactgcatttttaaaagcatttttgaagagtctaaatctgtcttccacccaagccatccattggtcccagctatgttttttttttttttttgttctgttttgttttttaaaaattagagacgaggtctcacttgttgcccaggctgttctcgaactcctgacctcaagtgaccctcccaccacagcctcc

SEQ ID NO: 25260 - DNA, 201 bp, Homo sapiens
gtcttatatctcaacaataattgtggaggtcttttctagaaactttattctgtgattcccattgtgtgggcaaaaatcgctttttttttttttttttttttctgaagccttgggccccttggagagggtcttcaaagcctcacgcctttcccaccgcttccttagtgtcaggggccccatccgctagcactcttcctgcct

SEQ ID NO: 25261 - DNA, 201 bp, Homo sapiens
gaagatgtgcttggtcatgactttttaaactttattattatttttttattttattttatttatttatttatttatttatttatttatttatttatttattwgagatggagtctcactcacccagtctggagtgcaatggcacgatctcggctcattgcaacctccgcctcctgggttcaagcgattctcatgcctcagcct

SEQ ID NO: 25262 - DNA, 201 bp, Homo sapiens
ctggtattcgtcctgttaaattctgtgctgcttttctcttctttgggtggcccctgtggaagatgtgcttggtcatgactttttaaactttattattattwttttattttattttatttatttatttatttatttatttatttatttatttatttatttgagatggagtctcactcacccagtctggagtgcaatggcacg

SEQ ID NO: 25263 - DNA, 201 bp, Homo sapiens
ttgctggtattcgtcctgttaaattctgtgctgcttttctcttctttgggtggcccctgtggaagatgtgcttggtcatgactttttaaactttattattwtttttttattttattttatttatttatttatttatttatttatttatttatttatttatttgagatggagtctcactcacccagtctggagtgcaatggc

SEQ ID NO: 25264 - DNA, 201 bp, Homo sapiens
ctccaacccagtaagggttgaaactatgagccataaacacaaattcattaatcactgattcactcatcaaaaaaaaattttttttttgagatggatcttgytctgtcactcagctggagtgcagtggcaccatctcggctcactgcaagctctgcctcccgggttcacacaattctcctgcctcagcctcccgagtaggtg

SEQ ID NO: 25265 - DNA, 201 bp, Homo sapiens
ctctacctcttgggctgaagcagtcgtcccaccttagcctcctgagtagctgggactacaggtgtgcaccaccatgtctgactaattttttttttttttttggatagagacaagtatcttgctatattgcccaagctggtcttgaactcctgggctcaaccaatcttcctgcctcggcctcccaaagtgttgggattacag

SEQ ID NO: 25266 - DNA, 201 bp, Homo sapiens
tcactagaagagtatgacagaaaccacccccatgatttaattatctccacctggtccctcccatgagatgtggggattatggggactacaattcaagatgwgatttgggtgaggacacagtcaaaccctatcatcagctgacaatggaacagtcccagcctacatggccacattccagacgcattgctgagcaatttaccg

SEQ ID NO: 25267 - DNA, 201 bp, Homo sapiens
ggggaaaatccctgcaaacatggtactggaatacgatggatatgtgagggcaggaacacagctgatggtattctctagtggtcagactcctgctgcactcrgcaataagcccatcagttcatatgttttttgtgcacgaccttcctgcaatttgttagggtaattacacagtctggtaataaaactatcttggtagattat

SEQ ID NO: 25268 - DNA, 201 bp, Homo sapiens
atcaccctgcctcagcctcctgagtagctgggatcataggcacatgccatcacacctggctaatttttatttatttatttattttgtagaaacagggcctsactatgttgcccaggccggtctcaaactcctggcctcaggcaatcctcccaccttgatctccgaaagtgctgggattacaggtgtgagccaccacgccca

SEQ ID NO: 25269 - DNA, 201 bp, Homo sapiens
tgtgccaccaagcctggctaatgttttgtattttttgtagagacggggtttcacatcgttagccaggatggtctcgatctcctgacctcgtgatccgcccrccttggcctcccaaagtgctgggattacaggcgtgagacactgtaatttatttcatctgtgaagtgggctaataaaagcacctacctggtaggctagtgt

SEQ ID NO: 25270 - DNA, 201 bp, Homo sapiens
aagtgctcactcatcaaatgtttaaagagaacacagggccggctgcagtggctcacgcctgtaatcccagcactttgggaggttgagtgggggcagatcayttgaggtcagtagttcaagaccagtctggccaacatggtgaaaccctgtctgtactaaaaatacaaaaattagctaggcatggtggtgggcacctgtaat

SEQ ID NO: 25271 - DNA, 201 bp, Homo sapiens
gcctcccgagtaggtgggactacaggcgcctgccaccacgcctggctaattttttttttttttgtatttttagtagagacggggtttcaccatgttagccrggatggtctcaatctcctgacctcgtgatctgcccacctcggcctcccaaagtgctcactcatcaaatgtttaaagagaacacagggccggctgcagtgg

SEQ ID NO: 25272 - DNA, 201 bp, Homo sapiens
gtttgtttttgagacagagtttcactcttgttgcccaggctggagtacagtggcacaatctcggctcactgcaacctccgcctcctgggttcaagggatcytcctgcctcagcctcccgagtagctgggattacaggcacgtgccaccatgcctgggtaatttttgtattgttttttggtagagacggggtgtcatcatgt

SEQ ID NO: 25273 - DNA, 201 bp, Homo sapiens
atttatttatttatttatttgagatggagtctcactcacccagtctggagtgcaatggcacgatctcggctcattgcaacctccgcctcctgggttcaagygattctcatgcctcagcctcccaagtagctggaaatacaggcacgcgccaccaggcccagctaatttttatattttgggtagagacagggtttcaccatg

SEQ ID NO: 25274 - DNA, 201 bp, Homo sapiens
caaatatccttgaaaaacaagcaagtaagagaactttgttgcgtgttttgggtggtttcaggtttttgtctttttattttgttaaggttgtacagacataygggagtggggggtggagcaaaagggatagagttcaatgtctattgatgcccagtcccactttctaggggtaataaccagttttttaaatccttccacaga

SEQ ID NO: 25275 - DNA, 201 bp, Homo sapiens
ctggagtacagtggcacaatctcggctcactgcaacctccgcctcctgggttcaagggatcctcctgcctcagcctcccgagtagctgggattacaggcaygtgccaccatgcctgggtaatttttgtattgttttttggtagagacggggtgtcatcatgttggccaggctgttcttgaactcttgacctcgtgatcctc

SEQ ID NO: 25276 - DNA, 201 bp, Homo sapiens
tagttagcagggttacttcctgctctttggaggaagtgaaagataattgtgcagctgagttctataaataaaagtacagttggagaaaacgatatttttgkggctgggcatggtggctcacacctgaaatcccggcactttgggaggctgaggtgggaaaatcacttgaagccaagagtttgagaccagcccgggcaacat

SEQ ID NO: 25277 - DNA, 201 bp, Homo sapiens
tatgttttttttttttttttgttctgttttgttttttaaaaattagagacgaggtctcacttgttgcccaggctgttctcgaactcctgacctcaagtgaycctcccaccacagcctcccaaagtgctaggattataggcgtcaaccaccacacccaacttcaagaactttttatttattattatttttattttttgaggt

SEQ ID NO: 25278 - DNA, 201 bp, Homo sapiens
ggcctcccacagtgttgggattataggcgtgagccactgtgccgggccaagaacttgtgttcttaattaaacacaagtttaaggcctgtgaacagtgttcrtttcgcactgggcgctgcaagtggtgcggctgctcctgactgcaagtgcctcaagcgagagctttgccttgagtgactctagatctgccacatacgtagg

SEQ ID NO: 25279 - DNA, 201 bp, Homo sapiens
ctctacagaaaataaaaaaattagccgggtgtggtggtgcatgcctgtggtctcagctactcagaggatgaggtaggaggattgcttgagcctgagaggtygaggctgcagtgagctgtgatcatcgtgccctgcattccagcctgcgtaacagagcgagaccctgtctcaaagaaaaaagaaaaagaaaaagaaagaaaa

SEQ ID NO: 25280 - DNA, 201 bp, Homo sapiens
acactacaagactgtcgtgaaggtcaaatgagatcatgtgactggcacgcctggcacatgatagatacttaacagcttttcttcctttcctataatactgkcttattaatgcattatatatatatataataaaatgtatagctgggtttttctgttaggtcatagaataggctatgatctaacagagtgtagcagacccat

SEQ ID NO: 25281 - DNA, 201 bp, Homo sapiens
taatagagatggggtttcaccatgttgaccaggctggtcttaactcctgacctcaggtgatccacccacctcagcctcccaaagtgctgggattacaggcrtgtgccactgctcctggccaacatttatttatttaatagcctatgtcacccaggctggagtgcagaggctactcacaggcaatcaaagcccattgcagcc

SEQ ID NO: 25282 - DNA, 201 bp, Homo sapiens
tagaaaaaccacaacgcagagtctaagaggtggcctcccaaagccaaataaagcagttccaagtaagaaccacagaattgtactttatggaaaactggcarcctttgaaagcatgtgcaacattccaaggacacagcactgaaagctaacatccaccagttagccgaagaaagttttttttttttcccaatcactgccatg

SEQ ID NO: 25283 - DNA, 201 bp, Homo sapiens
cttaatatttataattgtttcacctgtattcttttttttatttaatctccaaggagctgtaagttggtatgtatcgcctgtattcttaaatagcattttcrcaatgttatatccaagtttcaagattatgaagctttcagatttcatggttaaattttttaatagctctatattctgtctccaggagaaaatatagtgaaa

SEQ ID NO: 25284 - DNA, 201 bp, Homo sapiens
atatttctaatgtatgtgaacatgtttatataggtatgtatgtatgtatataaaatggtttatttcttagaattgcatcgtaatatccactttaatttgtyttactagcggaaaccctttctgtgagtgggattccaaatgctaggaagctaggggagcctatccgagcagctattcctttacatccaccctaccaccctt

SEQ ID NO: 25285 - DNA, 201 bp, Homo sapiens
ctcaggtccaagggcctaggacaaggaagcctcccaaaggaaaaaggtaacattactgcagacttcagtgtttacagtctgtttacaaaggaatttgaaartgcaggggcatgatctccaaatttagctgtgaagaccagaatgaagtatttgttaaagtacgtattacagttattttaaactaaataatagacacctagc

SEQ ID NO: 25286 - DNA, 201 bp, Homo sapiens; identical to SEQ ID NO: 4485

SEQ ID NO: 25287 - DNA, 201 bp, Homo sapiens
tttgttggagtatcttacagaacgcatcagtgaaacatctcatgagaaaagtaagtttaagaatggaaatttggtttggtttaccttttatgatgtgtccyttttgccttttatctttttgtgtatttttcttcataggaagcagattcactaatacagtatacctgataaccgtagttgtaaatttcaaattcttattgt

SEQ ID NO: 25288 - DNA, 201 bp, Homo sapiens
ccaaaaaaggaaggaatatgccagtgaattattagacgccatatttaaagcttccccctttttttcttcaaatataatcaggcagcaggaaattgttgttyttaatatttataattgtttcacctgtattcttttttttatttaatctccaaggagctgtaagttggtatgtatcgcctgtattcttaaatagcattttca

SEQ ID NO: 25289 - DNA, 201 bp, Homo sapiens
taaaggcagcaaatgggaagtatatccagctcaggtccaagggcctaggacaaggaagcctcccaaaggaaaaaggtaacattactgcagacttcagtgtytacagtctgtttacaaaggaatttgaaaatgcaggggcatgatctccaaatttagctgtgaagaccagaatgaagtatttgttaaagtacgtattacagt

SEQ ID NO: 25290 - DNA, 201 bp, Homo sapiens
gatgcacacaatgtacaagcagtaattgattcactggccttggactacttgcaggtcagcttgtctcacataacaggttggtatatgtataactatcacayaattatgcattttagtaaaaataattgttagaactgtagacattgtttacttaaccaaatgagtgagcttatggagtagaccaaattgtaagattgagct

SEQ ID NO: 25291 - DNA, 201 bp, Homo sapiens
tggtgagtagttaaacctgaagtatcagttattattcaacatacaactataaaaatgtaaatggtatgtaggagtgtttaaaattgagaagaatagagtgytaactggacatgggatttgaaattccagaatatcccactacccattaaatatgaacacttatctgaagtcgcaggcatatgggcagataagtccaaggca

SEQ ID NO: 25292 - DNA, 201 bp, Homo sapiens
tgggcagagcctttatagcagttgagcatattcagtagcctagtcagagacaatgagatgaaaacttggcctctcatggatacaaaattatgtgatttttyccccccccagacctcatagttattcctaggagtcaagaagatgatgcacacaatgtacaagcagtaattgattcactggccttggactacttgcaggtca

SEQ ID NO: 25293 - DNA, 201 bp, Homo sapiens
ctaatgaaatgctgtctaaaaaagccttagcctcaccaagttctaaatcacatgaagatatgttgtaccctcctagtgttttgtccaagagtaggacatcytttgttgaagacagtgagttgtaatggatgttagttctttactgctgatgatcattcttggggcaattgttgttgccattagcctttttacttttattgc

SEQ ID NO: 25294 - DNA, 201 bp, Homo sapiens
ctcgagcaccctgccccataggaaaagaatacttgcattcaagtcactgctccccagccgtaaattctactggagagcatacggaattttctggggtaagyggaaaagcttactttcagttggctagaagtacacttgtatgtatgtctgtgtgtgtgttggtaattgattagaaggccgtgtgtgtgtatgtgtattggt

SEQ ID NO: 25295 - DNA, 201 bp, Homo sapiens
tctctcagcttcaccacctcttcgcttcgaggccgtggaacagcagtatgctgtgggagagagagaggcactggggcgaggccggtaggacacttgggtcytggctgtaaaaagagcggtcagaagggtcgtccccggacttgtctttctgtggggcgtctagccgctgtccgtgtgccctccgcccttgcactatgggcc

SEQ ID NO: 25296 - DNA, 201 bp, Homo sapiens
gaaaatgcttatgctaaaatattcatgaacaaaacaggatataaagtacagtatggttacaactaagcatactgcatagttgcctgagaattttttaaatytacatggaaaaagagaagtacattgaaacattaatggttaaaaaaaagattaatagtggttgtatttagggtgtgggactatggtgactgaaacttgaaa

SEQ ID NO: 25297 - DNA, 201 bp, Homo sapiens
acatagtggagatgtttgtttctaataccgattgaaagtgctttcctaccaattcccaggcatttcaaggaacaagtattttaagctaagttacttttggyacagaaaccgttaaactttgcaaatcccagcaatatctaggggagaggagaatgtggtacgcaggaaacgtcaacagtattgataattctgagcttcatg

SEQ ID NO: 25298 - DNA, 201 bp, Homo sapiens
caccagagaaaccctgacttgcacaagataattgggtaaacacaagaccaatactattgcaagtgcgaagcagcctccattaatgagtttctggtaacctsggattatcattaaactgttgtttatgacataatattcctgtttacttgtaaatatgttttaactaaaaacacccatgtaaggcttatataagtaacttaa

SEQ ID NO: 25299 - DNA, 201 bp, Homo sapiens
attcctgtttacttgtaaatatgttttaactaaaaacacccatgtaaggcttatataagtaacttaagattttaggctgcaacagtatcaattgaatttgsagtatagttttgactatgtagaaattacagcactctggaaatcatcccaagaaattaaatacatctttttaaaaaccatgcctaaagggtctttgaaatt

SEQ ID NO: 25300 - DNA, 201 bp, Homo sapiens
tagatcgatataataaaaaagaaaaactaacaaatgcattaccgttgatgttgttattataccagttcttaacagcctaagtttaatcaccactttttccrgcaccagagaaaccctgacttgcacaagataattgggtaaacacaagaccaatactattgcaagtgcgaagcagcctccattaatgagtttctggtaacc

SEQ ID NO: 25301 - DNA, 201 bp, Homo sapiens
aaagcaaatgggagaaatatcgctgaattctttttctcagcaaggaacatccctgggaaagagaatacacgcctgggggcaggtctacagacggtcccccuggcgtggccatcttttatggtctgtagactgtagggctgaaatagacctcagtctcccatatcgctcccaggcttattaggaagaagaaattcccgccta

SEQ ID NO: 25302 - DNA, 201 bp, Homo sapiens
taagagcttggatgctcggttgaggcaccattggaattgaaactcaggatctcctgtttactagacaggtgctttaaccagctaagccatggtgctgcccrttgtgtatgtttttaataactgtaatatatgaccttttcccctttaggcgtttactgaagcatttgaaagggaactaagaagacataaagttcaagagaa

SEQ ID NO: 25303 - DNA, 201 bp, Homo sapiens
gagtcagggagacagccataactacatacaataaaagcataaagggggaattagaactaggggagagtattgacaggtgggactcacctaattcaaggctmccagtaggtatttgtatgctgtgtacctttctagtctttttagtaacagggttaagaggtagaaaacaacctctaagtaaagagattgagattaatttga

SEQ ID NO: 25304 - DNA, 201 bp, Homo sapiens
ttatttattttaaaagggtaaggctggactcagtggctcacgcctgtaatcccagcactttgggaagctgaggtgcaaggattgcttgggaccagcctggrcaacatagtgagacgtcatctctccaaaaaattaaaaatttagccaggcgtggtggcacatgcctatagtcccagctatttgggtagccaaggtgggaga

SEQ ID NO: 25305 - DNA, 201 bp, Homo sapiens
acccagcagctctccaggtcctcaggggaagggccctctggtcaggctgggccctgagtgaaggagggaacttttccaggtgctccttgtcttctgagatrttgggcccctcttgggatggagatgaagcagaatccactggtgaaatcattagacttggagacacagcacacaccttttctctaagaagtaatggtgagt

SEQ ID NO: 25306 - DNA, 201 bp, Homo sapiens
attccttaaggaataccctgtggaacccactcataataacggccttgagcagatcagtttgagggctcctgataatcacggcttaacctaatcatggctamtgccttgtgaaagttgcatcttttctgtaaatgtaccttcaaaggttgtaaaattgagtggagcttgggaatttattggattctgttacttaaccagtgc

SEQ ID NO: 25307 - DNA, 201 bp, Homo sapiens
agaattgtcaagcatattgcactagtcaaagcatcgtactccttaaaatttgcctctgtatacacctgcacattcttgttctaggaagataggagaaaaaygaatgcatataaagggaaataataagagccaacacatagtgaatgtttatgttgtgccaggcgcagttctggatactttaggggtattgaataatttact

SEQ ID NO: 25308 - DNA, 201 bp, Homo sapiens
taattttgactaggaattgtgcttagagaattacgaagggagaggatggaggtcagaaacaatctgccaaagggagagatttaaaaatctttgcctgagtrtggagtagagataagccatgagaactgtaatactgaacagttccaggaagacatctcaggaactgcagatggtactttcctgtggagggaaaaaacacta

SEQ ID NO: 25309 - DNA, 201 bp, Homo sapiens
gggcagcagagcaagaccctgtctcaaaaagaaaaaaataaaataagaaaaacaacaggcaggtatgtacacagggtagatatataaacagtgatacattytcattatttaaacattcaagcaatgcattaaaagtacagagatgaaataagcattattaacaataggtgaccacattctcaacattctgtgcatctaaac

SEQ ID NO: 25310 - DNA, 201 bp, Homo sapiens; identical to SEQ ID NO: 4480

SEQ ID NO: 25311 - DNA, 201 bp, Homo sapiens
ttttagtcctttagttagattctttgatatttataaaatttcattttctctttgcttgtttctttttttaatattgcatattaaattctatattaatatayaatattaaaataaatattgtatattaaattgtatttaatatcacatattgtataattataatattgtattccttaaggaataccctgtggaacccactca

SEQ ID NO: 25312 - DNA, 201 bp, Homo sapiens
gtaaagacaggcataagaagttataaaagtattaatttggggaactaataaatgtccatgaaatcttcacaatccacgttcttctgccatggcttcagccrgtccctctgtttggggtccctgacttctcgcaacacctggccgtattgttttattttaaagcatactaatgctacttgtttgtgatagctaaaaattaga

SEQ ID NO: 25313 - DNA, 201 bp, Homo sapiens
aaagtattaatttggggaactaataaatgtccatgaaatcttcacaatccacgttcttctgccatggcttcagccggtccctctgtttggggtccctgacytctcgcaacacctggccgtattgttttattttaaagcatactaatgctacttgtttgtgatagctaaaaattagaaacacctaaatgtccattagtaggg

SEQ ID NO: 25314 - DNA, 201 bp, Homo sapiens
tttttgtttttatgttatgttgttttatttatttttattttttgattcagagtctctgttgcccaggctggagtgcagtggtgcaatcacagctcactgcrgcctcaacctcccaagctcaggtgatcctctcacctcagcctcccgggtagccggggctacaggtgtgcaccaccatgcctggctaattttttctatttt

SEQ ID NO: 25315 - DNA, 201 bp, Homo sapiens
ccatgcccggctaatttttatatttttagtagagatggggtttcaccatgttggtcaggctggcctcgaactcctgatctcaggtgatccacctgccttgkcctcccaaagtgctgggattacaggcatgagccaccgcgcctggtccctgtttttctcttaatcatcaaagtacgtcatcatctttgcaaaaaacttgca

SEQ ID NO: 25316 - DNA, 201 bp, Homo sapiens
cacacgtgccaccacacctggctgattttttttaaaaatatttttagtagagacggggttttgccatgttggccaggctggtctcaaactcctggcctcayctgcctgcctctgcttcccagattgctgagattataggcatgaatcaccatacccagcctactaaagggtatttaattttactttaatagaaaaagataa

SEQ ID NO: 25317 - DNA, 201 bp, Homo sapiens
aaaaccttttttatatagtcatcctgtccttatctttctaaaaagaacaggactgggttcggtggctcacacccataatcccagcactttgggaggctcaygtgagtgccagagtttgagaccaccctgggaaacatagtgagaccttgtctctgctaaaaatagaaaattagcctggagtggtggtgcatgcctgtgatc

SEQ ID NO: 25318 - DNA, 201 bp, Homo sapiens; identical to SEQ ID NO: 4481

SEQ ID NO: 25319 - DNA, 201 bp, Homo sapiens
gccaaaagtttttagtcctttagttagattctttgatatttataaaatttcattttctctttgcttgtttctttttttaatattgcatattaaattctatwttaatatacaatattaaaataaatattgtatattaaattgtatttaatatcacatattgtataattataatattgtattccttaaggaataccctgtgga

SEQ ID NO: 25320 - DNA, 201 bp, Homo sapiens
gtcattgataacatcttatcaggagacagggttttgagagcaacctgtctgaccaaaatttattaggcgggaatttcttcttcctaataagcctgggagcratatgggagactgaggtctatttcagccctacagtctacagaccataaaagatggccacgcccgggggaccgtctgtagacctgcccccaggcgtgtatt

SEQ ID NO: 25321 - DNA, 201 bp, Homo sapiens
ggtcttgaactaataacctcaagtgatctgcctgccttggcctcccaaagtactgagattacaggtatgagccactgcgcttggcctggaccatgagtccrtgtttctggtactagctaagaccctaactctggtgtctattcataccaagacatgtccataaaacagccagcatttccgtaactctggcatctatttttc

SEQ ID NO: 25322 - DNA, 201 bp, Homo sapiens
tcttaaaaaaaataacctggctggacatagcttggtgttccagtagattaagaaagaggagatcagtgtgagttgttattttcagagtgagcttcagagawgaagggaatttgaggtggattaaacgtgaaaggccacttgagttacagagaagatgagatcaagtacccaagacaggaatgagaggaggtggttgggatt

SEQ ID NO: 25323 - DNA, 201 bp, Homo sapiens
gatttaggcttaaaatacatttaatattcttgagcggagtggatgatagagagctatgtgacatagcttatgtctttgttagcataaaattatactcatgmaactcttaaaaaaaataacctggctggacatagcttggtgttccagtagattaagaaagaggagatcagtgtgagttgttattttcagagtgagcttcag

SEQ ID NO: 25324 - DNA, 100 bp, Homo sapiens
ttatcaagtctggcctcatagggagggacttttactgtactgaaaggaarccagctgaagccgagatctgaagcgctcagcttccagttcccggaagaaa

SEQ ID NO: 25325 - DNA, 201 bp, Homo sapiens
gaaagtatcccaacaagtttattgtttttttttgttgttttgatgttactctgctgctataatcttctgaacaaaccaccatttagaataggataccacartctgaaagtgttctctcctgccactttttcccaccaatctggtaaagttctgtttagctgcaatatattttggtataaatcttactagacatgttttctt

SEQ ID NO: 25326 - DNA, 201 bp, Homo sapiens
cctatacatttaatcgttgacactttatatacagctatttctaccattcatatatcagtgaaaacaaaacataagcagcaagacatgctaagcagcaaaarggagagtcttttcctttttctgcacccagcagctctccaggtcctcaggggaagggccctctggtcaggctgggccctgagtgaaggagggaacttttcc

SEQ ID NO: 25327 - DNA, 201 bp, Homo sapiens
ggcaaactcaccctccagtagaccaaaaagctatgcttgccattgggataggcacagaaacggaaggaccagagtcaagtgtggatactacaaaaatgttkcttgaagtaggagaatcagatggattgattgggaatggaagggatggtgattgcagaaacgggttctgtgatgtcaagtgctatgtaaaaaagatgttac

SEQ ID NO: 25328 - DNA, 201 bp, Homo sapiens
gcggctctctcagtctgcacctctgagcccagttttccttgacacaggctttcacagcaggacagtggcatgccagaggagggcgggggcgtgccacctcyctcccaggcacctggcctcccactagtgtagaaggtaaaagatctccttggctatgtagggactttgattccgccaaaaaggccagggcaatgtaaataa

SEQ ID NO: 25329 - DNA, 201 bp, Homo sapiens
cgcactgacagcagggcaggccagggcggctccccgggcagacctctcacaccagcacgccggtgcaggctcagcattcagcaggcgcctatctcaggccyctgactgggcagctcagttcccttttgggcactcctaactgaaaacacaggggcccaagcccagaggaaaagaggaggtcctgttggccttatctgaggc

SEQ ID NO: 25330 - DNA, 200 bp, Homo sapiens
cctgggtgaggctctggaatgtggcgataaaggagcactgtgctccgagtggggctgtggcaggcgtgtcacagacgccgccaaggtgcccccacagccgactgacagcagggcaggccagggcggctccccgggcagacctctcacaccagcacgccggtgcaggctcagcattcagcaggcgcctatctcaggcccct

SEQ ID NO: 25331 - DNA, 201 bp, Homo sapiens
cagctcagtttcaggtctttgtagcattacagaagccacacacatgcacacacacactcaccacacaggcacagacacacatacacatatgcacgcgcgcrcacacacacacacacacaaatgctctctgcttaccttccttcaaaacagcccagcggctctctcagtctgcacctctgagcccagttttccttgacacag

SEQ ID NO: 25332 - DNA, 201 bp, Homo sapiens
cacagctcagtttcaggtctttgtagcattacagaagccacacacatgcacacacacactcaccacacaggcacagacacacatacacatatgcacgcgcrcgcacacacacacacacacaaatgctctctgcttaccttccttcaaaacagcccagcggctctctcagtctgcacctctgagcccagttttccttgacac

SEQ ID NO: 25333 - DNA, 201 bp, Homo sapiens
gggcagctcagttcccttttgggcactcctaactgaaaacacaggggcccaagcccagaggaaaagaggaggtcctgttggccttatctgaggccacccaygccggctggccacagaggcggccagagagcttgcaaacagcatgtcagaccatcactgactcttccccaaaaagaagtcagtaagttaagactcctccag

SEQ ID NO: 25334 - DNA, 201 bp, Homo sapiens
tttacaaaaaataaaagacggtaataaactctactctgtagggacaactctttctctccttaggcagaataactccattctaaggcattgctcccttggtrcatcagtctcaccttgagagttaactccttcccaagcccccaaacccaaatcaccctctgagctgccaggaggggaggtgcccagcaggaaagaggctgc

SEQ ID NO: 25335 - DNA, 201 bp, Homo sapiens
tattcttcatgactagttagctaacaccaagcagagttaaaaaaaaaaaaaaaaaaggcagtgaatttctactgtttggtgtgtcagggaagcttggggcygatggaggggttgattcataacgtttgctaaatcctgtggtgtaaacaatcccgccctggcagatcccaagctgccaatgtgctgtcagctggctcacaa

SEQ ID NO: 25336 - DNA, 201 bp, Homo sapiens
ggcatttaaaacatgagcacactgggcacaagcacatctctgggaaaagcaggattcccagggctcagccacccagggccagatgcccaggggccttctcygtcccccgactcatgctctgaacccagacttacagttgtcactggtctccccagctcagggaaccgcccttcatatggatgctctgttctcctaacagca

SEQ ID NO: 25337 - DNA, 201 bp, Homo sapiens
tggtccaatcttctcaagaaccatgtgcagtaggaatgactactgttgtacaggacatgaaactagggctcagagaggtccctagaactgcctgagctcayccagataggaagtctcagagccactatatgtgtgcatccagcatttgaccagagagagaagaaatgtcaggagaggacccaccagacaccactctgccgt

SEQ ID NO: 25338 - DNA, 201 bp, Homo sapiens
tcccattgttacatttttacaaatatttttgttttcaagaaaagcatgtccatttgaggctcccatgtggaatttctgagaagcctaaggatactgtcctmcaacacatggctcctggggcataatgtggccatgtggcaatacattcaacagacggacgatggcgagggctgccactgacgctcccgcttgagggcccca

SEQ ID NO: 25339 - DNA, 201 bp, Homo sapiens
aaacagaactaccattcaacccagcaactcacttatgggtacatacccaaagaaatatagatcattataccaaaaagacacatgcactcatatgttcatcmccgtgctattcacaatagcaaagacatagaattatcctaagtgccattaagggtggactggataaagaaaatgtggtataggctgggcacggtggctcac

SEQ ID NO: 25340 - DNA, 201 bp, Homo sapiens
cactgcatgttccaggtcgaatgttctcatagcacgtcgtttccttacctgcaaggctaggtgtcagtgtcactgggaaaggagcccattggcttgccctycttcactggtactcactgtgtgtgcccatcaagagaaaggcacgtgcacagggatatagggagaaactttcaaaggggtgaaatgcacagaaaactgaga

SEQ ID NO: 25341 - DNA, 201 bp, Homo sapiens
agccccagtcctgacatactggaccacagtctgcaaggcgagtggcaagggactcaggggctcctgagatgatgccagaatgcaagtcctgtctggacttygacactcccacccactgggaccgaaggggaaatacactaggcgctcctctcaggccttggaagcctgcattacaaactacatagacttcagggagctgtt

SEQ ID NO: 25342 - DNA, 201 bp, Homo sapiens
ggaccgaaggggaaatacactaggcgctcctctcaggccttggaagcctgcattacaaactacatagacttcagggagctgtttaaaaagaacagcccatygaattatttttcttagaagaattagagccattatcttaataggcttttatgagtcctgcacttcacacaataatgaccatatccctatccaggtcctggg

SEQ ID NO: 25343 - DNA, 201 bp, Homo sapiens
aagaatacagggaaactaaagagacacagaaaaaagacaactctgacaagggcacatagaacagatcctgtgaagaaataacatatcttccaagggcagcrgggaggaaggaacagtcaacattgtgagggtccttaaggagcccaaccctgaccctgagtctaccatgtcgccaagctatgcctccagaccctgagtcca

SEQ ID NO: 25344 - DNA, 201 bp, Homo sapiens
cacacaagcccacagatgggctaggatgtccctgggtgtcacagtgcagggtgacttgtgagttgctggaccatcctttctatccaccgcaaaggccataktgtttatagctgaagacactctgaggaattgagcccactatttttgatgatcacttggtgatatggtttggctctgtccccacccaaatctcatcttgaa

SEQ ID NO: 25345 - DNA, 201 bp, Homo sapiens
tatagtttgtccattttttgtttgttcagtcaggataataaatcaagtctctgttactccatcctgacctgaagcatacatctctaatctttcatatttaragacgaacaattcactgaaattaaagttaacttatcaattattcaataattataaattattgaaaactctataaattaatatccccaagacttaagagta

SEQ ID NO: 25346 - DNA, 201 bp, Homo sapiens
tgaatttattatttctttctattaaagctgggatagaaaaacaaagatgcatggagtttaaaaccatccctctgcaccctcacttctattcccagtactamgatgacttatctccatttgtgtttgtccgtatttcttttccattaaaaatgtctttgctggggctgggtgcggcgggtcatgcctgtaatcccagcactt

SEQ ID NO: 25347 - DNA, 201 bp, Homo sapiens
aacaggagtttccctttcggaggaagacacaagcagacttggttgccagagggaggtgagaaaaggggcattaaaccaaggagaagggaggagctggggcrcccagagaagacacacgggaagggatgagcaagtttaaaggtctcgcagcctccatagggggcacgtccttcctgagacacgacctgatcagctggatgg

SEQ ID NO: 25348 - DNA, 201 bp, Homo sapiens
ttcagccctctcagtgactcaagacatctgacccttctgcaagtctcacaatcccagaccctcccaagtgtgtcaaaaagaatgggtgcattttggccagsaatcacagcctgaagggacagtggtaacaggtgcttcagagaaaatgcccaggcattttacctcttgacgcccagtgctcttgggacaccactgtgaggc

SEQ ID NO: 25349 - DNA, 201 bp, Homo sapiens
aaacccatggagaaatccatataggaatgcatgtgcttttgaggctctagaaaatccaaagtaaacaagggcctctataaatgtcacacatattcacattsagtacatgcctttgtccctattataaacattctcattcagagctcataaaaattcaacagaaaagggagtcgagtacaggaaagaaagaagaagattggt

SEQ ID NO: 25350 - DNA, 201 bp, Homo sapiens
gaaaagggagtcgagtacaggaaagaaagaagaagattggtaaaagcattgtatctgtcaatttttgaaggatgacagctttttcaataaaaataaagcaytgtgtcaaaataatctctctgtctctgtcttcctcttgtcctcttctcacgctgtgtctctctatcagtccctggggctctgaaactatttcaataagaa

SEQ ID NO: 25351 - DNA, 201 bp, Homo sapiens; identical to SEQ ID NO: 25335

SEQ ID NO: 25352 - DNA, 201 bp, Homo sapiens
gatgctgtggttgctgaaggcagctgatgggaaacccagggcattctcagactctcagggatgaacaaggccacagccttggaaatgtgcagcttccccakgccagcatgctccttccagaacaggccacttggagataggaccaagcacccagactcactctcagtgctgggaaaggacagtgcccggatggaatgctgg

SEQ ID NO: 25353 - DNA, 201 bp, Homo sapiens
ccacttggccttgcccccctgccacacctaggcagaccttgaacacccagagagtagcattacatccatctgaataaaccaacagaaaacaaccccacaayttaacataaaattccagatcacagttactgcaaaacaaatacttggatttatgagcttggctacactactcagtgagttttaaaaatcaaaatccaccag

SEQ ID NO: 25354 - DNA, 201 bp, Homo sapiens
aggaaatatactattgatgacagcggttgctaccatcacgctggctgcagcagggaggtgaggctggggctgcactctccatggagccggtgggagctccrccccttctgagttggggtgggaactccctgggtgccactgcagctgcccaaactgcagctgtagatccaagcctccctgcgctcttgagtggggccagga

SEQ ID NO: 25355 - DNA, 201 bp, Homo sapiens
atggcaaaactggccgcaaatctcccagagccgaaatctccccagagggagcccaagggaaagcactggaaggcagaagcaaatctcgcaacgcccgtgtmtatagacctcccatgtcactcttccaaccccatgtttaatgcatatttaaatatacagacaggcaggtcgtggtggttcacacctgtaatcccatcactt

SEQ ID NO: 25356 - DNA, 201 bp, Homo sapiens
ccaaaaaaagataaaattctaatcctagtcaatcactttttatatttcacagatcaactatctagatcaagacacacacacacacacacacacacacacamactcatatacacctcactcactcttcagagactattaagtgctttgtgctttcctccctaactcctaaaattattcattatcaggaacagacccttgtgg

SEQ ID NO: 25357 - DNA, 201 bp, Homo sapiens
tgcctgtgcctggaccaccacagggaacaggtagcttctccagacacagccaggaaccatcctgtccctaggtcaccctcaaatgactcacttggggccgyccagctgaatcaattcaccatatccaaacagtcccaataagtggaggcttattggaatgatgtctgcagctgcaagtgcccatggtgggctctgacaacc

SEQ ID NO: 25358 - DNA, 201 bp, Homo sapiens
cacctagacagatcagggtgtggcttctgaggaggccattacctggactgcaggtcagaaagtgacacgcagggcctcctgtgaagttcctcctcataagkagagacacatgaaagtgacatctaaattcagatagcttctggtagaaagttctgatttgaaaacatgacaccaccaactttcaacaaatgcaggtccctc

SEQ ID NO: 25359 - DNA, 201 bp, Homo sapiens
cctgcgggctgccattgcccctcacttcccagcccatcccccaaacgtccatgcctcccttggtccaggttcaaacactctcatcaccggcatttctgtgrcttctcctgggaaaccatcaacattttattgaggccctggccttgactctttggactttagataactttctttggtttgactttagaatttctcatgaca

SEQ ID NO: 25360 - DNA, 201 bp, Homo sapiens
ttaagacatcgagggcaacacagatccatggtgcttcctctcctagcccatctagacccacaaggcctgctgtctccctcgcctgtggcccacgtccatgyccctgctgatgtgcatgcctctgaaatcacagaggccgtaacagtgtggcgtccacacatcactgggcacaccacactgctcacccaacaaccacctgtt

SEQ ID NO: 25361 - DNA, 201 bp, Homo sapiens
cacgtggcctctggttttctttcatgagcttcccagaaggtgacactctgccttcactccccaggtgacctattggaatcctccgatttatgattaacaaragagcaatatattacatgtacaggaataaagaatgaactcccaatactacgagaaagatggtttcctcgcagcctcttcccaccctcaggaaagcaccca

SEQ ID NO: 25362 - DNA, 201 bp, Homo sapiens
gaaaggagtgctgtgaaaaccagctttcatccccaaagtaggtcagaattgctcctatcggcaagataaactgagcaagtctgaagatccattaaagctcrcttttcttacataacagcacaagctgccattatatcaaccctgtttttcaagaaatagctggatgttttacataaaatatccctgcaatctgtgctatgt

SEQ ID NO: 25363 - DNA, 201 bp, Homo sapiens
cgcaacctttccctcccctaggaggccctggcagctccatcttgtagcactttccaaagaaagaagtagatgagacagtcttgcatgcataatctaaaacrcctccccagacattccttcaaggctgaaagagaagagccagagcacgcacaagttctactcttccagccaagggctgaggaagatggtgaggatgaccct

SEQ ID NO: 25364 - DNA, 201 bp, Homo sapiens
gcctcgttctctctcacattttggttctgtatatcaaatacttaaagtcagcaggtgctctctttccccgacttggcacaagtgcaattgcaggctcttayagacaggcacaatgaagttgcagccctgcctcttccaggcaatggagagaaaggttctacgcacggaagacacagatggaaactcagcaggtttgatcgc

SEQ ID NO: 25365 - DNA, 201 bp, Homo sapiens
gggttgggaggaccctgaggacccaggacaaatccagccaactctcagcacctctttctctgtcccagggggtgatgctacttaactattaaggccactcytgtgggctgatttctgcaaacttgtacaggacaacatacaacttgagccaattcctctgattcctgtcggattcgaaaagtaacgaacacttaatgagat

SEQ ID NO: 25366 - DNA, 201 bp, Homo sapiens
tccctattcttgggttccacattcatggactcaactgactggggacagaaaatattgtgggaaataaataaaaaacaaaaatgcaaccataaaaaataatagaagttaaaaaacaatacattgtaacaactattttcacagcctttacattgaattaggtattgttatgtaatctagagatgatttaaagtatacaggaga

SEQ ID NO: 25367 - DNA, 201 bp, Homo sapiens
acacacacacacacacacacgtataaaatatataatatatatatacacatatatataaaataaatatcacggtcttgctcctgacaacacaaactgacccratagagaggtggtacatggtggggaaggctgtccctcctctatggcctggtggccccaggcctggaaagggctgagttcatgcccggccaaaagccatgg

SEQ ID NO: 25368 - DNA, 201 bp, Homo sapiens
gcatccaaacaattcccaaggattttgttttctctaccttatttatcagacatggatttcattccaattcaaatgtattgaacactgttagaacagaaatraagcgcttcctacggtcatgaggatccacagtgagtgcctctccagaagatgctggctcagggcccccctcatctgctctaaaggggctcttgccagcac

SEQ ID NO: 25369 - DNA, 201 bp, Homo sapiens
cttgctgttgcacaggctggagtgcagtggcacgatctcagctcactgcaagctccacctcccaggttcatgccattctcctgcctcagcctcccaagtakctgggactacaggtgcctgctaccatgcccagctaatttttttgtatttttaatagaggcaaggttccactctctaggtgttttgaaaagagagctgcct

SEQ ID NO: 25370 - DNA, 201 bp, Homo sapiens
gtggcacgatctcagctcactgcaagctccacctcccaggttcatgccattctcctgcctcagcctcccaagtagctgggactacaggtgcctgctaccaygcccagctaatttttttgtatttttaatagaggcaaggttccactctctaggtgttttgaaaagagagctgcctgctcacgtcctcagaagccttcccga

SEQ ID NO: 25371 - DNA, 201 bp, Homo sapiens
atgcccagctaatttttttgtatttttaatagaggcaaggttccactctctaggtgttttgaaaagagagctgcctgctcacgtcctcagaagccttcccragctgtggtttccttgtggaccctatcgccaatgtcaatcaaatccaagcccttagtgattagagtttccatgagatagaaacacaagttgcttcttttg

SEQ ID NO: 25372 - DNA, 201 bp, Homo sapiens
cagcctggccaactctgatgggcaaaggggctgcccagagaatgctgagaggatcaccccaactcagaccaggaccatacctgcctccacacccagaaggrcacagcagggcttttgctttagaatgaagagctaatgaattgcactgacactgacagagcagccttaacctggagtttatcccacaataatcagattcat

SEQ ID NO: 25373 - DNA, 201 bp, Homo sapiens
agcagacagctgctgacctggacctcatctgttagtggcatcaggagtggctccagcaggctccaggagcccagggtgcacttcccagacatcaggtcggmggttgaaatcagcaatggggggagtatttataccaaagaaatcagcaaacactgccgaccgagcttttacctggaaaacctctattaaacattcaccagc

SEQ ID NO: 25374 - DNA, 201 bp, Homo sapiens
caatggggggagtatttataccaaagaaatcagcaaacactgccgaccgagcttttacctggaaaacctctattaaacattcaccagcaaccccgtgataytcgtcctctagaagcctcagattccccacctggggaatgggggtggaaatggcacataatgcagagttctaggaagatcaagtaaggtaagcatgcaaag

SEQ ID NO: 25375 - DNA, 201 bp, Homo sapiens
tggaacataatccctctttaacagcatgttttttggtctcaaatttcccactcttatgaatgatgctatgagaaacattctatagtttaaaatgttaacawccttagtggctgcctcgggataaacacccagagatgccatgtgctttggggtccacatcactaggacttcctctagaaagtgctgtgacttccaggacca

SEQ ID NO: 25376 - DNA, 201 bp, Homo sapiens
aggggcagggcagtggaagagaggactcatctgttccataatcaagaccataacttcaagtttatgatttattacccaccatatctggcaaaggtagcacygtcctcctccccactggagactgacaaaatgcctggtaccatctgttaatggatgaaatgcattcccacaaacatccatatgttgaagtcctagtgccca

SEQ ID NO: 25377 - DNA, 201 bp, Homo sapiens
cagctccatctttcactctggggatgttccagggtcacaaattcccccaaacctttgaccacgaacagattcaagcaggaaaaccagggcattggaatgtwgaaataagcctgaaatacacttgattcagtggcttagatgatggcaaacagtggcactcaaaaacagcttgtcagtaccggggtttcttctctttttcct

SEQ ID NO: 25378 - DNA, 201 bp, Homo sapiens
tttcttttccattaaaaatgtctttgctggggctgggtgcggcgggtcatgcctgtaatcccagcactttgggaggcgaggcaggcggatcacctgaggtyagaagttcaagaccatcctagccaacatggtgaaaccccgtctcttctaaaaatacaaaaattagctgggtgtggtggtgtgtgcctgtaatcccagcta

SEQ ID NO: 25379 - DNA, 201 bp, Homo sapiens
gacatgagtgttagggtgttaaatttagttttcagtatgtgcttaaggaggttatattcgctatgactttcatctcagaagagtaaagatggcgctagaargtatctgttatagaaacgatacttcattttgggcctgaaccagtgaaggtcccttgatgtagctatcacgggcagtgtggactgagcagaaggtgggctg

SEQ ID NO: 25380 - DNA, 201 bp, Homo sapiens
cttttccaaatcatcaaaaattccagtcatggtgggtcacgtgaatcagcttcctagaacctcacagaaacatgaagtaaggactgaagagaggccgggcrcagtagctcaaacctataatcccagcactttgggaggcccagatgggcggatcacctgaggtcaggagctcgagaccaacctggtcaacatggcaaaacc

SEQ ID NO: 25381 - DNA, 201 bp, Homo sapiens
ctcagcgctctcttccagaaaagggagaccatcaggatggcatacatgcacggttcagcaacgatcagactagggacagaaagtgcccaagccaccttggrtacttgagtagtaaaaggaagggggtcttgttagccgcgttattaggctgagagctggcgggctgtttgcagagggctcccagggcttcctgcccagcgc

SEQ ID NO: 25382 - DNA, 201 bp, Homo sapiens
cgtggcgggtcccactgtacttgcttcgagcatcagtcatttccttgagggagcttccaggatcttccaggccaaagccactgagcagctggtccaactcwgccttctcctgggcactcaggcccctcctggttcctggggccaggcgctcttccgtcttatccgtcctggcagaggctgtagagtggccggagtcactgc

SEQ ID NO: 25383 - DNA, 201 bp, Homo sapiens
agaagcgaatcacagaaggccactcattgcacgactccagtgagtgagatgtccggaatgggaaacagagagaaggaaagtagcttcgtggttgccagggsctgaggaaaggaggaactgggagtgaccgctaatgagtacagggcttcttttggggtgatgaagatgttctggaattagataatggcgacagttccacaa

SEQ ID NO: 25384 - DNA, 201 bp, Homo sapiens
gaagcgaatcacagaaggccactcattgcacgactccagtgagtgagatgtccggaatgggaaacagagagaaggaaagtagcttcgtggttgccaggggstgaggaaaggaggaactgggagtgaccgctaatgagtacagggcttcttttggggtgatgaagatgttctggaattagataatggcgacagttccacaac

SEQ ID NO: 25385 - DNA, 201 bp, Homo sapiens
cacgactccagtgagtgagatgtccggaatgggaaacagagagaaggaaagtagcttcgtggttgccaggggctgaggaaaggaggaactgggagtgaccrctaatgagtacagggcttcttttggggtgatgaagatgttctggaattagataatggcgacagttccacaaccttgtgaacgtactaaaaatcaatgcat

SEQ ID NO: 25386 - DNA, 201 bp, Homo sapiens
tcctgcagggcgccatcctgcagtgcgctatcctagcacaccctaggcttcaccctaaagaccctaccctaaagcctcatcccatcccacagcgccccacyccaccacgcgccatttgccaagaccagcggacaactctagaacatgtgatgatgctcgctctagtatctctatgagaaccatgctttccactgtgaactg

SEQ ID NO: 25387 - DNA, 201 bp, Homo sapiens
ccagcctctttgttatctttctgtatcctccagtcatgtggcacctgggatcctcactgtcacccagcaaagaagccaggctcaggaaaggaagctgacaytcccccgatctcacgatccaccacacacagcacctcttacttcctcctgcacacaccagccaggcggaacacacttccaccccgtgaatatgtgctgctc

SEQ ID NO: 25388 - DNA, 201 bp, Homo sapiens
ttacaacaggccactttacagactgggaaagtgaaagggaatgaggcttatgagagcaagtagaaagcaccccaatggggagtgtggccactgacaccgaygctccagagatgtccagcgaggaaaatgagatgttctccatagggctcagcaacatgggggtccagagctttgcagagcctccctgaagagtactgtggg

SEQ ID NO: 25389 - DNA, 201 bp, Homo sapiens
gggctcagcaacatgggggtccagagctttgcagagcctccctgaagagtactgtggggacaatcctggtggtgacaatacaaatccagggacacatatgstgctgtgggcattcccttagaccatcacagcaagtctgatcctgaaagagcaggtacatcctgctagggtaagaaatccccccacccacagccctcttgt

SEQ ID NO: 25390 - DNA, 201 bp, Homo sapiens
gtctcccacctgctcacaccactggctcagaagatgctgcatgaaaaatacaccaatgggaattgtgatttgtaatgtcagggccttagatatttaaagtycaaattgcttctctaatcattcattcaagaaacacgcattgagtatctgctatggactgaatatttgtgtcccctaagattcatatgtcaaaacctaatc

SEQ ID NO: 25391 - DNA, 201 bp, Homo sapiens
accactggctcagaagatgctgcatgaaaaatacaccaatgggaattgtgatttgtaatgtcagggccttagatatttaaagttcaaattgcttctctaaycattcattcaagaaacacgcattgagtatctgctatggactgaatatttgtgtcccctaagattcatatgtcaaaacctaatccccagagtgatggtatt

SEQ ID NO: 25392 - DNA, 201 bp, Homo sapiens
gacctttggcggtgctcagagcataagggtggaacccctataagtgggattgatgccctcagaaaggaggctccaaggagctccctctcctcaccaccacrtggagacacaagaaggcaggagttggcaaccagatgacagccctcaccagaatccgccaggctggctgcctgatcttggacttcccagcctctcaaagta

SEQ ID NO: 25393 - DNA, 201 bp, Homo sapiens
cttctccatctgcactgaggttctcgtacgagtcccagcgtatcagtgggtctgttgtgttgtagtccacaatcacaccgtggtcgttgtacaagtgttcrgaccctgcacagagcacaggcagcaacattagtcccagtgaaacccatcacctccatccacccgactccaccataaggacaggtgagcagcctgacttga

SEQ ID NO: 25394 - DNA, 201 bp, Homo sapiens
ccactgtgaaccaggcttggacacttctgcaaaacgagtcttcagaccacctcactgatgaggacacagaggcccggtaagctgtctctgagcctcagagyccacagatttgaatccaggctccaggctctcagatccacactcctcccttcaagtctttttaggaataccaaggggatttttaacacacaagccatgtat

SEQ ID NO: 25395 - DNA, 201 bp, Homo sapiens
catagaaaaagcatgattatttccacagctattaaaaagggaaacaaaactcccatgcatgtggatcttggtgatggatctggacaattcaccttgatgawaaagggactggtttcttttgaaatatattttttagggaaaaaaattgtttcgcacataatacttgcagcctactatatttctaattctctttttaaaatg

SEQ ID NO: 25396 - DNA, 201 bp, Homo sapiens
tctggacaattcaccttgatgataaagggactggtttcttttgaaatatattttttagggaaaaaaattgtttcgcacataatacttgcagcctactatayttctaattctctttttaaaatgctggttactttggggttaatgatgaaatcatgatggaaatttaaaaattccttgaaatgaatgataatagtgacacaa

SEQ ID NO: 25397 - DNA, 201 bp, Homo sapiens
ggacaaaggcaccatacaacaggggtgagggacaacacatcccagtcctcctaggggagggggaagctctccaagtctgaaatgctcccccaaaggtacartcttcccactcaccactgcattcagaagcactgctcccacaccactgaaggtgcacagcaccccaggaaaggagcctatctgtggacaaaaaacctcaaa

SEQ ID NO: 25398 - DNA, 201 bp, Homo sapiens
tcttatctgaaatcaaattcttaagaattattttccataatcaaaaccgtggatttcaaagctctttggtttatccttgagatgaaaagtatacaccgtaycccagccctggctttcctaaagagttttctttccgtggctgcagtccaaagaggcccccccacacatatcattcaatgaaggccaagtcagctataaaaa

SEQ ID NO: 25399 - DNA, 201 bp, Homo sapiens
ttcaatgaaggccaagtcagctataaaaagtcccatgggaaagcaacggaatgcttaccttggcttcacatttcttgtggcaggaatacttgcaggctggraaaaaaaaaaagagaaagaatgtgtgtcaagcagtctctctagcaagaattcttacatcttcaaaccctctcaatccttcagagtctctggcttgaagat

SEQ ID NO: 25400 - DNA, 201 bp, Homo sapiens
ccaacctgagaactgactgtcagaataaattcatgtctaaattcctataggagaatccttccagaggggccattgtgtgaacggagcgagtcctgtgtccyttcggaggccctaacaatgcaatgcggagctggaaccaatgcggatttcacaggcccttctgcccagaggctgcagctgtgatcatgaggcataaacctc

SEQ ID NO: 25401 - DNA, 201 bp, Homo sapiens
aaattcatgtctaaattcctataggagaatccttccagaggggccattgtgtgaacggagcgagtcctgtgtcccttcggaggccctaacaatgcaatgcrgagctggaaccaatgcggatttcacaggcccttctgcccagaggctgcagctgtgatcatgaggcataaacctccccacgagcaccacgggcatgctgca

SEQ ID NO: 25402 - DNA, 201 bp, Homo sapiens
ctatccgtggcccagctctggtcagcaccgcaccaggcagtgtacaagatactttcccgtatgttactgcacttgctcctcgtaagcacctctcggggagraactgtaagggtgactcagccaagggggcagccatggtccatgaaggtgggactccagcccgtctgtgcatcaaattcagtgtttgcatccagccatact

SEQ ID NO: 25403 - DNA, 201 bp, Homo sapiens
gttactgcacttgctcctcgtaagcacctctcggggagaaactgtaagggtgactcagccaagggggcagccatggtccatgaaggtgggactccagcccrtctgtgcatcaaattcagtgtttgcatccagccatactctccctgcctttctgacatattacaaaatatgaatcaaacagtgcccaggcccagcttccta

SEQ ID NO: 25404 - DNA, 201 bp, Homo sapiens
tctgaagcacacaggcccagaagacaaaacgtatgtgttcactttgaccctcagccaggcagacccgcctcctttttggaatagcagttgtgtgagctggyagctaaactagccaccttctcaggggatgtcatttttatttgaaagaactcctagcagacaaaatgcagttattcagactcgagtgcttgtcattttctc

SEQ ID NO: 25405 - DNA, 201 bp, Homo sapiens
caacagaaaggtaagtgaattctcccaggggcttctggcgaaggccttcccactcctgtaaacgaagcaagggaaaatgcctcagcttctggaacctcccsctctgagcacggagctggacccacaagaagaacctggagaacttgggttgcagaaccggggcccaggcacactgcccggagcctgccggccgctgcacct

SEQ ID NO: 25406 - DNA, 201 bp, Homo sapiens
gctcccgctgcagcagttacagcccagagctgtctggcttgcaaacgcccaacatttttatatgttgtcttggaactgctattcttcacaacgtctccacsagccttgggaatccaggccactgtcttacagggttgtcagaatcttttatacaacactcgaaacatattgaccaagttataaacaagcctgtgagtcacc

SEQ ID NO: 25407 - DNA, 201 bp, Homo sapiens
catttttatatgttgtcttggaactgctattcttcacaacgtctccaccagccttgggaatccaggccactgtcttacagggttgtcagaatcttttatasaacactcgaaacatattgaccaagttataaacaagcctgtgagtcaccctctgcttctcctagcatcaactgtcaagtttgccagcctctctgtgtccca

SEQ ID NO: 25408 - DNA, 201 bp, Homo sapiens
gggaccgccagacaaggcctgcccaatgcccacattcactgctcaaccccatgaccccattgttgccttgttagttttaaataactaccatgttctcctgragtcctaatactgcacctggcccaaagcaaaaaacacacacctaccgacctgcccgtctatctccaaacctttatctgtaatcacttagtgtattgctga

SEQ ID NO: 25409 - DNA, 201 bp, Homo sapiens
tgtaatcacttagtgtattgctgactccgatggactcaaagacaggacacaaaactctcatctttctctcctagcaggtgcttaataatgttgggttaacygcgtggaacaacccattaccaaatctttcttacaaaactcccttcatcccactttccctctggtctcctttctcagctttctccttgcttcttttctcct

SEQ ID NO: 25410 - DNA, 201 bp, Homo sapiens
agcacttctttattctgtgccatcctgtctcattccatgatagtctcgctgattccactattagatcccagaaaaccatctctcaaatggggagcatttayacgtggtctgaccctggatcctccctggatctaccttcttccagggaccaagtcccacaaaacttgtaacttttggggccgaatctactcaattccagaa

SEQ ID NO: 25411 - DNA, 201 bp, Homo sapiens
gcacttctttattctgtgccatcctgtctcattccatgatagtctcgctgattccactattagatcccagaaaaccatctctcaaatggggagcatttacrcgtggtctgaccctggatcctccctggatctaccttcttccagggaccaagtcccacaaaacttgtaacttttggggccgaatctactcaattccagaat

SEQ ID NO: 25412 - DNA, 201 bp, Homo sapiens
taacttttggggccgaatctactcaattccagaatgccgagactcacccataacagcaccttcctctgtcctctgtgaaatacaaccattttgggatatcratggcaactggaccatgttaggccacccaagggaactcagtgacatgtagtgagaacgggttgcctcagagtcctaactgatggtatgagcacaccagca

SEQ ID NO: 25413 - DNA, 201 bp, Homo sapiens
ttctttcccttacttaaagttccaagagtagagataacagggcccttacatgttaacataacagtttttaaaagatgaaatgttttctttctacttaaccrcatatgaaatttgcatttaactaggaggttaaaatgtgaaagtcagggacctgaaagtccaagaatgagccagaaaaggaacggtagaaatactggcctg

SEQ ID NO: 25414 - DNA, 201 bp, Homo sapiens
ccaccatccacctcacctccaccacgctctgctgcttccccagaaataagccaaagaaagaacacctctaccaaaacgtcacatcactgtgatgcatgatkacttacataatctatgtaaagggaataccttgttgtttccaggtagcatgtacacaaagggatcaaaatgcaaatgtatatgacatatgtgaattattag

SEQ ID NO: 25415 - DNA, 201 bp, Homo sapiens
aactaaatacttctaccttttattccctccttaattccaccagtattcattaatacccacagctgaaacattttgtaagcctataaatatgtcctggacayctacaacagggcagaaactgatctggacctggatactattgggaacacaaaaaacattcatgaatgtacactgcagtgcaagaggaaaggaaaatcaaca

SEQ ID NO: 25416 - DNA, 201 bp, Homo sapiens
tacctctgataaagcactcctcacacgggatcctgttcctgctcactactccagcccactagactccgagcccttcgaagccttggtcaccgtgggcatcrcaatgcaccagctgccgcacctgctcagtaaaagtgtgctggtgagggttcaccctgcaagacaagacagcactccactttgggacggaggtgtctgccc

SEQ ID NO: 25417 - DNA, 201 bp, Homo sapiens
gcttgagctgaaacctaaaggatgagggtcagcaggcagagcagcacagtccagcaagaggtcaaaaatgagccctgtgcagccggcctctcaaagcacckgggggagtcaggagagaccaaataaggcaggcacagcctcaaagggccaccatgaggatgcaggcacaggttcttcccgctggatggtttacagtttccc

SEQ ID NO: 25418 - DNA, 201 bp, Homo sapiens
ggagaggcaaacaggagactggatctcaagggcatcccagcctgggcagacaaagggccagacccagggaagctgggttaggaaggaggaatgggaggtcygcacggcgatggagaccggggcccagcctccaggaagaaggccagcaagggtggagcagcaggcagggctgggggccaaagcctggccaggggctctccc

SEQ ID NO: 25419 - DNA, 201 bp, Homo sapiens
attaacttaacataactgaaaaagctaatgaaaacaatcatgtctaaaagacttctgaaacatggaatcctgtatgttttttataaagagtttctaggccrggcacggtggctcacgcctgtaatcccagcactttgagaggccaaagcaggcggatcatgaggtcaggagatcgagaccatcctggctaacatggtgaaa

SEQ ID NO: 25420 - DNA, 201 bp, Homo sapiens
catcccatggagggttagaatgtcaacataagaattttggggagacacaaacattctgaccataacacagggcacacgtgaggcagttccaaaaaactatsccacagaaagaagaagacagacacttctccaacagaagtcctcaagatctcagtgcacatatgcccaagggcacaacactcaccacatgctaaagtcaac

SEQ ID NO: 25421 - DNA, 201 bp, Homo sapiens
ggctggaaaggtgaacgcaactcaccacaccacccccaggattcacagccagcaagctcagggcaactctttggggagaagctgaaccagcgccctctgaraggcggcacatccagggtgcagtgcagcactgcctgccagcacgaagcagccgtcccctggggaggcggtggtcccgtcctgcctcactggcctggcaga

SEQ ID NO: 25422 - DNA, 201 bp, Homo sapiens
cccctggaaaggaaccagcttaaaaaaggcaatgggaggccgggcgcggtggctcacgcctgtaatcccagcactttgggaggccgaggcgggtggatcaygaggtcaggagatcgagaccatcctggctaacaaggtgaaaccccgtctctactaaaaatacaaaaaattagccgggcgcggtggcgggcgcctgtagtc

SEQ ID NO: 25423 - DNA, 201 bp, Homo sapiens
gcaatgggaggccgggcgcggtggctcacgcctgtaatcccagcactttgggaggccgaggcgggtggatcatgaggtcaggagatcgagaccatcctggstaacaaggtgaaaccccgtctctactaaaaatacaaaaaattagccgggcgcggtggcgggcgcctgtagtcccagctactcgggaggctgaggcaggag

SEQ ID NO: 25424 - DNA, 201 bp, Homo sapiens
ggaggccgggcgcggtggctcacgcctgtaatcccagcactttgggaggccgaggcgggtggatcatgaggtcaggagatcgagaccatcctggctaacamggtgaaaccccgtctctactaaaaatacaaaaaattagccgggcgcggtggcgggcgcctgtagtcccagctactcgggaggctgaggcaggagaatggc

SEQ ID NO: 25425 - DNA, 201 bp, Homo sapiens
gtgagaaaaaccagtgctacactgggttccctggagtagaggagcattagccaaacaggacaggagataatgctgcacgaggacagagctggcagccccgytgcttgtccatgttgggtacgtgtggggtcctccaggccaaagtgggccttgaatcctcggaggtgacgctctaggtgtctcgctgcctcccaccgaagc

SEQ ID NO: 25426 - DNA, 201 bp, Homo sapiens
aagcagaactccagagagttccaagaggaggcgggaaagcatcattaccaacagaaaccagtagatgggccacggggccaccacactgggctttgttctcrtgagtgcctggatgttgccagaagcgtgtgaaatttaaaccattatctggagacagcatgccttactgcatcttccttaacaaccaggtgacacacagca

SEQ ID NO: 25427 - DNA, 201 bp, Homo sapiens
actcaggcacatacacaccactctggcaggcctcctcacccctccgtaatatttcacacgccacatatttaaaataccacaaaacagagttcatttggaaycagaggatcaatctggggtccttccctggcccttctgagtgtgtgcaactgcaggacagaggaagagacacaagtcccaacccagggaaggcaccaagac

SEQ ID NO: 25428 - DNA, 201 bp, Homo sapiens
aagctcttctctttcgttggttccatttactctgaaaatagtcaatactacttaaatggcaggaacagaatactgaagtattaaaaaggatgtctgagatractcttcagtaaactcagttctcttttatacaaagaaggaaaaattactcctcaagcagtataaccaacctagtgcagcccaagccactgtggtaagttg

SEQ ID NO: 25429 - DNA, 201 bp, Homo sapiens
caacgctggctgtgcactttaagcctgacttctgcccttggaacagcccttaccctaagtcctagacccagagtgaggagactttgcccctgtcaggggcwgggccaggacccagctctgtctgacctccacctttgctcctaaatcagacctgtccccacatagcatctgacaggcagaagtcagttcatggggaacctt

SEQ ID NO: 25430 - DNA, 201 bp, Homo sapiens
gtctgacctccacctttgctcctaaatcagacctgtccccacatagcatctgacaggcagaagtcagttcatggggaaccttcggctgtgcaactttgccygggacgtcatcacagggtgaggaagccgagaacaagcccaggtgtccctgctgatgccatgctgctcatgacagctctcccagtatcgcccaatggctcc

SEQ ID NO: 25431 - DNA, 201 bp, Homo sapiens
gtggctcacgcctgtaatcccagcactttgggaggccgaggcaggcggatcacaagttcaggagatggagaccatcctggctaacatggtgaaaccccatstctattaaaaatacaaaaaaaaaaaattagccgggcatggtggcgggcgcctgtagtcccagctgctggggaggctgaggcaggagaatggcgtgaacct

SEQ ID NO: 25432 - DNA, 201 bp, Homo sapiens
cctcctgaactggacaagctatgcaggggaatggccagtgacaggccacagcattcacagatgaccaagatatcacctagtgcagtgccgtttgcaagtaygggcttaaaacaatggctcaaacctgtaatcccagcactttgggaggctaaggcaggagaatcacttgaggccaagagtttaagagcagcctggacaaca

SEQ ID NO: 25433 - DNA, 201 bp, Homo sapiens
ataaacacagacttacctcggcatgaaataccttgaccgtcaataatttgtttgcaaactccacacactttggattttttaaaggccttgttcttaaaagygtgcagactcgaggttaattcttccggctgaaaaagtaaaggaagaaattgtcaacgtttcatctcatagtttgtttctttttccttttcatttaaggga

SEQ ID NO: 25434 - DNA, 201 bp, Homo sapiens
tccggctgaaaaagtaaaggaagaaattgtcaacgtttcatctcatagtttgtttctttttccttttcatttaagggaaataataaatctagtggaattgyaaagagcaaaaacaggaattttaccaagcaaacagagaacaagaaaccatcttggtgatgctaaaattcccaagacgacccacggataccatgttagcat

SEQ ID NO: 25435 - DNA, 201 bp, Homo sapiens
aaccactcagctacctattcatgtttgtagagccaaggctctcagctatatgataaccttataagaattcaatttgcttttagagtcaagcactaatcatrtctatttgctgatatgtgaccgtgtattctatcagtacttaatatccatatggattcagtgaggccattactcacccactggaataattaaatttatttg

SEQ ID NO: 25436 - DNA, 201 bp, Homo sapiens
tgtttgtagagccaaggctctcagctatatgataaccttataagaattcaatttgcttttagagtcaagcactaatcatgtctatttgctgatatgtgacmgtgtattctatcagtacttaatatccatatggattcagtgaggccattactcacccactggaataattaaatttatttgaaaagatgaaatggtatttag

SEQ ID NO: 25437 - DNA, 201 bp, Homo sapiens
tttgtagagccaaggctctcagctatatgataaccttataagaattcaatttgcttttagagtcaagcactaatcatgtctatttgctgatatgtgaccgkgtattctatcagtacttaatatccatatggattcagtgaggccattactcacccactggaataattaaatttatttgaaaagatgaaatggtatttagaa

SEQ ID NO: 25438 - DNA, 201 bp, Homo sapiens
ctcatgcctgtaatcccagcattttgggacgccgaggcgggttgatcacctgagctcaggagttcaagaccagcctggccaacatggtgaaaccccgtctmtactaaaaatataaaaattagctgggcgtggtggcgggcacccgtaatcccagctactcaggaggctgagggaggagaatcccttgaacccaggagtcag

SEQ ID NO: 25439 - DNA, 201 bp, Homo sapiens
caagacagaaccaccactgtatataaccgactatactgtaagtatctatatacatttaaggtactgttattatgtagttgttcctatgtcggtatctggtyttttcaaagagattgcatcctttctgataacacaggttgtgtgttcagtgctctgcaaaagaaggataatgatgctgctaattatgcagttggtaacact

SEQ ID NO: 25440 - DNA, 201 bp, Homo sapiens
cttctgtgtcattaccgtaatcaccactagtctacaaaccgtgatggtgagatgcaaaaccgagatgcagcaccacacagccaatggatgaggcatatgakactcaggcctcatatgcctcaagccccagtctcacgctcagacaagagtagcattcaaacacctaacaaacacatctctctattgcaatgcagcagctgg

SEQ ID NO: 25441 - DNA, 201 bp, Homo sapiens
gctcacgcttcatctgtacataacatctctattgtgaaatgagaccagacgggattagactgcccttgttttcacctgatactgtgctttcatttctcccraagggggagaggaggcagcaatgctgaagcatttagcaggctcagttcaggaatctaaattgcacttaattgttaggaacaaaatgttggaagggtagag

SEQ ID NO: 25442 - DNA, 201 bp, Homo sapiens
cgcttcatctgtacataacatctctattgtgaaatgagaccagacgggattagactgcccttgttttcacctgatactgtgctttcatttctcccaaaggrggagaggaggcagcaatgctgaagcatttagcaggctcagttcaggaatctaaattgcacttaattgttaggaacaaaatgttggaagggtagagagcag

SEQ ID NO: 25443 - DNA, 201 bp, Homo sapiens
ctgcaagaagctttgtggcaagtctaaaactaaaagaacatgttcaagatgaagccactgcctgtggtctacggtgggcagcggaagagacccctgcctcrgagcaggatagggggccttctagtctcaggccagctaaccctgtactcctaccactggccttcactccaggcccagcctaggagcagtgtcccagagctc

SEQ ID NO: 25444 - DNA, 201 bp, Homo sapiens
gaagagacccctgcctcagagcaggatagggggccttctagtctcaggccagctaaccctgtactcctaccactggccttcactccaggcccagcctaggrgcagtgtcccagagctcagcctttatggctccaacactctaacttcagatctacagctccacttgcaactccacatgccttggatgtggggagcagtctg

SEQ ID NO: 25445 - DNA, 201 bp, Homo sapiens
cactccaggcccagcctaggagcagtgtcccagagctcagcctttatggctccaacactctaacttcagatctacagctccacttgcaactccacatgccytggatgtggggagcagtctgggtgggctaagtcgtggcctttatggctgacatatgtgcaaattccagccatcaattcaactggctgacgttaacctctc

SEQ ID NO: 25446 - DNA, 201 bp, Homo sapiens
agactttaacaccaagtacaaggttccctgggggagagctgaggggccactcgtgcccgttttgtcactggaaactggaggctgctcctatgagtccattycctcacacgatcatgcattcacccacagatacgtgagcaacgtgtgtgctcgatgtcagaggaaatacagcggctggctcaccccgcccctcccagaggg

SEQ ID NO: 25447 - DNA, 201 bp, Homo sapiens
gtgttaggagggggcacggagtccacagatcatgggaagaactccatgaatggcctgtgacttgaagcagaagcagacactttccagacaggaaaagaggygaggagaggcaagggtggtaaagcgccgtatttttggtgaactggccaaaggctgggtggctaatgcacagctgtgttgggacactgagggtagacaggg

SEQ ID NO: 25448 - DNA, 201 bp, Homo sapiens
ggtggtaaagcgccgtatttttggtgaactggccaaaggctgggtggctaatgcacagctgtgttgggacactgagggtagacagggctcaagaagcaagkacagggtggtgagcaggattgcacaaagcagtcacaaggaaggaggccccagtaccgagctgggctggactccaacgtcacagggggctctaactggcaa

SEQ ID NO: 25449 - DNA, 201 bp, Homo sapiens
cactccagtgtgggcaacagagcgagactccatctcaaaaaaaaaaaagcaaatgaccacagagacagtctcagagaggcaatgggagtcctgggagcagrttattaggaagcgtaaaggtctcagcttccatgcgtcgtgggatgggagactcgggagttatgtgcagtggagagacagaatctaataggctgtcactgg

SEQ ID NO: 25450 - DNA, 201 bp, Homo sapiens
gggggtgcccagcccaaaagataaacaagggcccacctgtctccacctctcacaagcacggagcacacctttctcatggtaaaacggacccccacagctaygggctctctgtgtgcctccaaaatccatatgttgaaatcctcacccacgaggtgacgatattaggaggtgaggcctttgggaggtgcttaggtcatgagg

SEQ ID NO: 25451 - DNA, 201 bp, Homo sapiens
tggatgaaccaggagccagccctcaccagacaatctgccagagccttgatcttggacttccagcctccaactgtgatagcttccagaactgcctgaggtcrcagagctaaataaccacaagcccaagtccccaggtccagcttacagacctactgctaccaatgggtgtcccaggacccaggcacggatcagtaggcatcc

SEQ ID NO: 25452 - DNA, 201 bp, Homo sapiens
tcgaacactaaaaacggagagaggtatgttcacttcctccaggggggtaaagaaaaaggacacagttgttggtgttgtgcctggccttttaaactcttccrtgataatacattgagatgcgtaagagggcatttttttttttttttttttgagacggagtctcgctctgtcgcctggagtgcagtgtggcacaatctcggc

SEQ ID NO: 25453 - DNA, 201 bp, Homo sapiens
gtccagagagctgcggcggaccccgaccccactcctctactcactgcctgcgggtttattattaattattctgggccacagtttcttcatctgctaaagcrgatgatcaaattgcaaccgacctcaaaagcttctaatgaggcgctgaggctcagaccttaaccatcttacctgagccacttgtctcacgtggcgtccacg

SEQ ID NO: 25454 - DNA, 201 bp, Homo sapiens
acctcaaaagcttctaatgaggcgctgaggctcagaccttaaccatcttacctgagccacttgtctcacgtggcgtccacgtccggcaccccctggcctcrcacacagtcaccgcacagcagcactgctgttccggagctggactgagctcccaggacctgccgtcaccgcaggagagctccttccttacagtcttcctgc

SEQ ID NO: 25455 - DNA, 201 bp, Homo sapiens
cacacacagtcaccgcacagcagcactgctgttccggagctggactgagctcccaggacctgccgtcaccgcaggagagctccttccttacagtcttcctrcgtcccagccctgtgcacatccactgaataagagcctgaggaaaacccctccccaggtggcccaggacggtgaggtgctgaggctgggagcctgtggcaa

SEQ ID NO: 25456 - DNA, 201 bp, Homo sapiens
tcatttctttttttttcattatttttctcctgaggctattttggctgcaagatagattctaacagaataacagggatttaacaaataaaaggaatgcttarggatgcgttaacagtaatcttgccaagccaggaagccgtctagagcttggcacatgagtgaaggcgagaaacaatttgcctggagaaacaagaagaaaaa

SEQ ID NO: 25457 - DNA, 201 bp, Homo sapiens
tccctgggcatccccgggccaggccctctgcctgggcacacaaggatcatccagagtgagtgaggcagatggagtggtcacagccaggagctgcatgggcrcctgccagaaacacagaacccctcctgcctggagccccccttcaaggactctcaaacctaggccaacgacaaagatctaaagtccacagccctaccatct

SEQ ID NO: 25458 - DNA, 201 bp, Homo sapiens
cggattcaacatactctaagattcaaaacgccctcaatctaggagaatttagtcctgctcagcagcattttggtggcagcgatttttcttgtctcagcgtkttaggagcagtgaggcagcgtggaaacgacacaactgtgagccatgatccctgtgaagatgaagccacgcaacacgcccttcactgtgggggcagaaaga

SEQ ID NO: 25459 - DNA, 201 bp, Homo sapiens
ggattcaacatactctaagattcaaaacgccctcaatctaggagaatttagtcctgctcagcagcattttggtggcagcgatttttcttgtctcagcgttwtaggagcagtgaggcagcgtggaaacgacacaactgtgagccatgatccctgtgaagatgaagccacgcaacacgcccttcactgtgggggcagaaagaa

SEQ ID NO: 25460 - DNA, 201 bp, Homo sapiens
gattcaacatactctaagattcaaaacgccctcaatctaggagaatttagtcctgctcagcagcattttggtggcagcgatttttcttgtctcagcgtttyaggagcagtgaggcagcgtggaaacgacacaactgtgagccatgatccctgtgaagatgaagccacgcaacacgcccttcactgtgggggcagaaagaaa

SEQ ID NO: 25461 - DNA, 201 bp, Homo sapiens
attcaacatactctaagattcaaaacgccctcaatctaggagaatttagtcctgctcagcagcattttggtggcagcgatttttcttgtctcagcgttttaggagcagtgaggcagcgtggaaacgacacaactgtgagccatgatccctgtgaagatgaagccacgcaacacgcccttcactgtgggggcagaaagaaag

SEQ ID NO: 25462 - DNA, 201 bp, Homo sapiens
catactctaagattcaaaacgccctcaatctaggagaatttagtcctgctcagcagcattttggtggcagcgatttttcttgtctcagcgttttaggagcagtgaggcagcgtggaaacgacacaactgtgagccatgatccctgtgaagatgaagccacgcaacacgcccttcactgtgggggcagaaagaaagaactgt

SEQ ID NO: 25463 - DNA, 201 bp, Homo sapiens
agcaacttactttgaggaagggccatctttgatccaccttgcaaattaaagagaaaaacagaggttaatttttttaaactaaaggatagaattaagtacaytccttgctcaataaaaatgcaaatttcttacttcctgtcttgtgggtccaaggcacagaaaatcacactgttcacggggtaatgcctccggaagaagagc

SEQ ID NO: 25464 - DNA, 201 bp, Homo sapiens
aggatggttggggccctgaccctctagtgtggtcataagtcttgtacctccaataggaagtcctaaccttgtctgggattttccacacacagcaccaagcrggagcaataaacactggtgcaggaatgaaaacattctcctttgctgtatttccaccacatcaacaccggtgttcactgcctgtctcagaccacacccttc

SEQ ID NO: 25465 - DNA, 201 bp, Homo sapiens
gctgaaccaaggcttcatacttgcctgagcaatctgagtgcagcgtctaaggagcccactgggcaatatatgtaaacacagtaatgaaggactcaaaagcygagtgcaataatgtgggagaagccacagccatattcagttcctggaagaccgagcggctcccttagccacataccctgcaggagcagctggggagttatg

SEQ ID NO: 25466 - DNA, 201 bp, Homo sapiens
ccactgggatccaagtccaggtctctgcctccatccatccactgagctgcatggcctggcctgagaggacatactgtccaatggctcaagaagagagtgayagcagtcttttggcgcttctcaaaatgtcccaacgatggctctgcctccctgcctgaggcaggtccccagctgctgtctcggtccccatttctgcaggat

SEQ ID NO: 25467 - DNA, 201 bp, Homo sapiens
cagaaatatacttcccaaggttctagggttgggaagtacaagatcaaggcaccagcagattcagtgtctggtgtgggcccttttcagggttcatagagggygccttcttgccatgtatgctcatggcagaagaggtaagggatctctctggggtcccttttataaaggcactaatctcatttatagacactccaccctcgc

SEQ ID NO: 25468 - DNA, 201 bp, Homo sapiens
catctgctttcctacaactgcttcatttctcctacttcttttttcactcttgccagtaagtcaagtgacagccaggaaaaaagcaagtcatgatgcccacwcagctcatgtggctcacatgaataagcactgcattccaggaagcaaaacagttgaaatcccaaactttcaagtgattgtacatacattatgtgacttccc

SEQ ID NO: 25469 - DNA, 201 bp, Homo sapiens
gggggcaccacctgccaccctttcctcccccttctcccctccccaacatctgctttcctacaactgcttcatttctcctacttcttttttcactcttgccrgtaagtcaagtgacagccaggaaaaaagcaagtcatgatgcccacacagctcatgtggctcacatgaataagcactgcattccaggaagcaaaacagttg

SEQ ID NO: 25470 - DNA, 201 bp, Homo sapiens
cgtgagctggggcaggaccatcgcaggccttagcaagagatgcaactgctcggtcccagccctgtcacctgtaagagggagcagaacaagcctcctcagasagaagtgtgacgagtaaatgacagagcatatctaaagcactcggcagggtcctgcagatccctcaacagcgctgactgagtggcattccttctgcacagg

SEQ ID NO: 25471 - DNA, 201 bp, Homo sapiens
ggagggaggagaagggatgcccgtgtaaacatttactgagacggcagagagaggcagagcccgtgctggccgcgtgagctggggcaggaccatcgcaggcyttagcaagagatgcaactgctcggtcccagccctgtcacctgtaagagggagcagaacaagcctcctcagacagaagtgtgacgagtaaatgacagagca

SEQ ID NO: 25472 - DNA, 201 bp, Homo sapiens
aatgtacaacacccagagtgagccctaacgtagactgtggactcatcaatactggctcatcaattctaacaaatgtgctgttctggtgcggcgatgctgamggcaggagagtgtgtgtctctgtgcgtgaatatgcatgcgtgtgtacatgtaagcacgtgtgtgtgagccctcggttctttcccctcaattttgcggcaa

SEQ ID NO: 25473 - DNA, 201 bp, Homo sapiens
tgccagcagggtcaccataaagccccgcagatgccgagacggtgcaaggagcagagccccacagggcaaggccccgagctgctggcagctggtgtcgcccrgctgacgcacttccttagttgacagtggcttggtcctgctggccaccttcgagtccaagaaaggcctagaagtccacaatgaatgcctctgattgaggct

SEQ ID NO: 25474 - DNA, 201 bp, Homo sapiens
cctctgtggggtgagccaaggcagggtgagcctgtgcaaatgcaggaggctggggggagtagaaagaagggcagccagtcaggggaaaggtcacagagctsgccagaaccaaggcagcatcgagcaagaggcacttggattccagtgtcagaaaatattaagcccacggctctgccattagccatatggaaccactttcag

SEQ ID NO: 25475 - DNA, 201 bp, Homo sapiens
ccatggcccacaaggcagggccaggccttcgctggcctcaggcaaacaagttaccactggtagggaatataatagatttaaagcaaaagcatagtatcctstatccattatgtcaccattatttgtctcagatcagaaatcaaatgtgaacctattgttggaacaatgtccaggggattctcgaagtggctgaaaagcact

SEQ ID NO: 25476 - DNA, 201 bp, Homo sapiens
ccatcctaatgaccctatttcaacctaattacctctttaaagaccttatctccaaatcctgccatattctggggtcctggggatttggacttcaacatttraatttggggaaacaaaatgcaaccccccagcactaacaatcaaaggtctgacaggacgggtggagacgtcaggtcgacacagaacgttctgggcacacca

SEQ ID NO: 25477 - DNA, 201 bp, Homo sapiens
cctgtttgggagcctctttattgccttctttcagctatcctgggatcctaatctactgttcccaaggaaaccacaaacaaacactgctgtgcctgccccasacctggctacgtgggtgcctgggtacactggcatcaataaccttgtccccaagccagcaggtccacaggacagaggggcagagggacaagggcttgccac

SEQ ID NO: 25478 - DNA, 201 bp, Homo sapiens
tgtgtcaaggcacactcctggggaggcccacggctcatccaatgtgtggactcgaatcagctggataaacacgaaacagtgccctgtctgtaggtctttcwctgtagccctcacaataaggccagcgagcccccactctgtgtatgagaagctgcgtctcagagagggccagcgccagccacgggaactctcccagagatg

SEQ ID NO: 25479 - DNA, 201 bp, Homo sapiens
gatgtgtgcggtggcatggccaggagtctagatgggcacccgctggccttgtgctttgcctgctctgtaacatgatgctgagtgagctgcaggggcgtgaraggatgagacaagaaccaggcagcgttccctgtgtcaaggcacactcctggggaggcccacggctcatccaatgtgtggactcgaatcagctggataaac

SEQ ID NO: 25480 - DNA, 201 bp, Homo sapiens
gagttttaaagacggcagccacttaaggatttggtccagaagccaggtctgtgtgttcccacatccctctgtggccagatggggtgcaataacggcccacsacctggcctggccccagggtgtcctacagaaaaggagaggtgagctctgtaagccgggactgcccgagtcccatctcaccccagaccatccacggcttat

SEQ ID NO: 25481 - DNA, 201 bp, Homo sapiens
gagaagaaacagataagcaaatggattctccaggaaaaaattagcataataatcaagccaggctcccaaagactgaatgaaactgtctctaacctcactcyggctacaaagctgtagcagatcaagactgacaagatttagagttaagagagtccagggttttgttcacttttggaaagtccctgtcatttttgctaatgt

SEQ ID NO: 25482 - DNA, 201 bp, Homo sapiens
aaacacacacatccatatgttcacacacaggtaacaattacattatccacatatatataccctcagatatataacaactacattaaaaacctacacacatkaataattacatacaagatacatatattcacatgtgtaacatttatatacataatatatgcatacaaaccttcatataaacaattacataacatatataca

SEQ ID NO: 25483 - DNA, 201 bp, Homo sapiens
acaagtatttgcaggagggctagcccatttcaggcactgcagggagaatgcaggtgtgacagaggggaaagaccaggatggactgaaaactgaatggatgrgaatcctgtcctggaggtgctggataagtacacatttaagaccccataaaggagagagaaggcagtgccagaggtggcggcgatgggcacctgggagaag

SEQ ID NO: 25484 - DNA, 201 bp, Homo sapiens
atggggaggggctgctctgggggggcaacagctgggcagggtgtggcaccctgaggacaggccagtttattccttacttcatggtgacagaaaacaggccragccctagagagccagctctctcaaagtacccccaatgggagtgtcctcaactgcaggcagcggccagccaggcagagccaggcagggggctcccatcca

SEQ ID NO: 25485 - DNA, 201 bp, Homo sapiens
acctgtccctttactggccacagtcatcagacccggagacactaaacaggactttaactcctccgagcattggtttccacctctgtgaaactagctgacamcaccaccagcctcccaggatctctgtggggactaagaagatgcctcaaggcaccaagcccaagccagcagcactcatcatcagccctgggggagagagga

SEQ ID NO: 25486 - DNA, 201 bp, Homo sapiens
gggcataaaggaggcagctggaatagcccaccaggtgggagagcctggtgagtgtgggagtccccagaaccacagccaggagcagctggcaggtgtgcccrgccccacggtgagcacgcaggcatggagctcacaggacaatgtccgcccggggctgagggccagcctgccgagggccagcctgccaagggcctgagggac

SEQ ID NO: 25487 - DNA, 201 bp, Homo sapiens
ttttgggttaacaaaaataaatgtacccattgactttaacaggcttatctaaaagaagaataggatgaaaagcagtgacatctgctccttcccaaggtcawaacatggaataactggggcctatttaggaagacagtgcccacagaatagcaatgtggttaagcatcagcttgacagctcggtaaaagctaacagtgtgac

SEQ ID NO: 25488 - DNA, 201 bp, Homo sapiens
ttttgtatttttagtagagatggggtttcaccatgttggccaggctggtcttgaactcctgacctcaggtgatatgcccgcctcggcctcccaaagtgttrggattacaggcgtgagccaccacgcccagccctggtctactttactgtgccgaccacaactgcaagaaaacaactaactgtgaattctcgtctgagctct

SEQ ID NO: 25489 - DNA, 201 bp, Homo sapiens
gtgaagagtagagtcagctgcagcaaaccaagcctatgtcgtgcaattaatgctagtgcggcatttcaaatggagcatccttcactgacgtcccattgccmtggggtgaaaggcaggtgctcagcctggtcctcagagccctgggtgagccagcccctgcctcctcatgtgcctccctcactccctgtccctaccttacct

SEQ ID NO: 25490 - DNA, 201 bp, Homo sapiens
cccagccagaatttggttcttttttaacctatgtccttcgactgcttgtttgaacaaatcaacagtttccaaaacctcacagtatagtaatgaaatctggmatcagacagacctgggtgtgagtcccacaccacctgccagctgcagaatcttgggccagggcactcatgagcctcagtgaccccatctgtggagcgggac

SEQ ID NO: 25491 - DNA, 201 bp, Homo sapiens
tcccagccagaatttggttcttttttaacctatgtccttcgactgcttgtttgaacaaatcaacagtttccaaaacctcacagtatagtaatgaaatctgrcatcagacagacctgggtgtgagtcccacaccacctgccagctgcagaatcttgggccagggcactcatgagcctcagtgaccccatctgtggagcggga

SEQ ID NO: 25492 - DNA, 201 bp, Homo sapiens
ccacatatgtttgtttgtttgtttgtttgtttgtttgtttgtttttgagatggagtcttgctctgttgcccaggacagagcacttcctagtgtgtcacagsagtgggtgagagcagactaagcggcaggaaggcaaaaacacctcttttgggagaaagtagcctagccttatggcaaagcacacaggctccacatcaggca

SEQ ID NO: 25493 - DNA, 201 bp, Homo sapiens
aaatctggaaccaagtagaggacatgcctatgacaggtccccctgacacactggggtagaaccccctcagctgctttgacttggactaaaatgagaaccargccccatactgaactggaactgccgccaagagtttctgaaatactgtgcttgtcaagaggagactcagggatacaatgtcactgtaagtctttatttgaa

SEQ ID NO: 25494 - DNA, 201 bp, Homo sapiens
acctcatgcctccagatgtgcaaacacaggtctggccacctccaaggcatgtggtgctcagcagcttccatagcacaaccctgaagagcattgcacggagmccagcagaaaccccagtaagcagacatcaccacccctatgttacatgttacaggttggtaacatagggatggtgatgaggaaatgaggatttggtgggcg

SEQ ID NO: 25495 - DNA, 201 bp, Homo sapiens
ggaaatgatacatcaaaaacccgtttaggttaattcatacaatctgtacatgtaacactcaaattcaagcagctcagatgcaatcctaatagagccaatcycattatggggaaactcagcttaaccagggtcccatttaattcaaaaaagtattcaataagccaacatctcaggggagaacagcaaggagtttgatcgacc

SEQ ID NO: 25496 - DNA, 201 bp, Homo sapiens
aataaacaacaaaaaaaaagtatttagaatacaatcccagagtaaactgaatgcactaaaatgaagtctccgaaaaggtaaggaaatgatacatcaaaaayccgtttaggttaattcatacaatctgtacatgtaacactcaaattcaagcagctcagatgcaatcctaatagagccaatctcattatggggaaactcagc

SEQ ID NO: 25497 - DNA, 201 bp, Homo sapiens
aggagttcaagaccaccctggccaacatggtgaaaccacgtctctactaaaaatacaaaaattagcctgcgtggtggcgcacacctgtaatcctagctacycgggaggctgaggcacaagaatcacttgaacctgggaggaggaggttgcagtgagccaagatcgtgccactgcactccagcctgggcaacagagcaagac

SEQ ID NO: 25498 - DNA, 201 bp, Homo sapiens
cctgggtccacctcctcattgcttttcccgggaaagccccttggccactccacttctttgtctcctgccttttgaagtgagaatagtaacagacagggccmgtctcatggagctgtccagggattcactgaggtaattctgtcaatggcttggaatccagcctggcaccgcatggccactgcccgtgctgggcagacctgg

SEQ ID NO: 25499 - DNA, 201 bp, Homo sapiens
tcgtctcagcctcccaagacaggggcaggatctaggggcgtgctcttcagttctacaccaaggtgctggcgagctcagccctgggtccacctcctcattgyttttcccgggaaagccccttggccactccacttctttgtctcctgccttttgaagtgagaatagtaacagacagggccagtctcatggagctgtccaggg

SEQ ID NO: 25500 - DNA, 201 bp, Homo sapiens
cctagcgccaattccaaaaccacagagatcatcgtctcagcctcccaagacaggggcaggatctaggggcgtgctcttcagttctacaccaaggtgctggygagctcagccctgggtccacctcctcattgcttttcccgggaaagccccttggccactccacttctttgtctcctgccttttgaagtgagaatagtaaca

SEQ ID NO: 25501 - DNA, 201 bp, Homo sapiens
aagcctagcgccaattccaaaaccacagagatcatcgtctcagcctcccaagacaggggcaggatctaggggcgtgctcttcagttctacaccaaggtgcyggcgagctcagccctgggtccacctcctcattgcttttcccgggaaagccccttggccactccacttctttgtctcctgccttttgaagtgagaatagta

SEQ ID NO: 25502 - DNA, 201 bp, Homo sapiens
ccaacacaggaggtgccagatgacaccagcgctatgactatcatggctgctattatttacttgaaagaaccaattaatgagtgactttcaggaattctcartcatacctactcttttttaaagagcctattcaacagggagaaaagactcgggttataattactttatagttatataactcttccttgtgtgtaagggttg

SEQ ID NO: 25503 - DNA, 201 bp, Homo sapiens
atcgtaactacaagcccaccttatcacctcagaagggtctacaccatgttgtgtgattcagctcaccagaggacgcagtgccactaaccagcatcaggacrggcttccacaggagccagtgaggccaccctccagtcagggcaaggtaggcatcgcttggcctgcaaacagtgccctgccctccaacacaggaggtgccag

SEQ ID NO: 25504 - DNA, 201 bp, Homo sapiens
tttcctttcctgccagtctacatgacacagacaccactgagagggaacaatgacagccgttccacagtttaatcataaacagcaagtcaatcgtaactacwagcccaccttatcacctcagaagggtctacaccatgttgtgtgattcagctcaccagaggacgcagtgccactaaccagcatcaggacgggcttccacag

SEQ ID NO: 25505 - DNA, 201 bp, Homo sapiens
cacacctcaaaaagaaataataacatcaaacatccaataccatacatttatttttatttttatttatttttattttttcgagacagagtctcgctctgtcrccaggctggaatgcagtggcgcaatctcggcttactgcagtctctgcctcctgggttaaagggattctcctgcctcagcctcccgaatagctgggattac

SEQ ID NO: 25506 - DNA, 201 bp, Homo sapiens
ggagaggggaccagctggggcataatcaaagcggcctttcatctactgagtagcaactcagcagactcctatcagaaggctaagagctccatggggccccrctgggaccccacccagctagccacaggccaggtggatgcagggtagaatgtggggctggccacccaaccaggtgcccaggtggccagggcaggcccccaa

SEQ ID NO: 25507 - DNA, 201 bp, Homo sapiens
gaaggactctttgtggttacactgggagcaggaacagggttccaggcgggactcctggagtgggagcctcaaccctgctctgaggtgtcaaggtcggcacragggggcaccgggagggggccaggaggaagcggagatggtgtgagcagaagccaaacatcagcaagcagctcctcgtgtccgtatgcggcatcctggggg

SEQ ID NO: 25508 - DNA, 201 bp, Homo sapiens
cggggtaccgcaagctgcggtcagggaacgcacagagagaaagcaactcagagcagtgacgcatgggctcaaatgcaaaagcacgaaggcgggaaggactytttgtggttacactgggagcaggaacagggttccaggcgggactcctggagtgggagcctcaaccctgctctgaggtgtcaaggtcggcacaagggggca

SEQ ID NO: 25509 - DNA, 201 bp, Homo sapiens
gcagggcatgacggggtaccgcaagctgcggtcagggaacgcacagagagaaagcaactcagagcagtgacgcatgggctcaaatgcaaaagcacgaaggygggaaggactctttgtggttacactgggagcaggaacagggttccaggcgggactcctggagtgggagcctcaaccctgctctgaggtgtcaaggtcggc

SEQ ID NO: 25510 - DNA, 201 bp, Homo sapiens
tttacagtgtgtgcagcctctgtgctgtgttcccataacagcgggcagtgtggggaggggcacaagattgaattttcctagcagggcatgacggggtacckcaagctgcggtcagggaacgcacagagagaaagcaactcagagcagtgacgcatgggctcaaatgcaaaagcacgaaggcgggaaggactctttgtggtt

SEQ ID NO: 25511 - DNA, 201 bp, Homo sapiens
gagagcagtgggcagatcagaaacagggtaaggaggcagcagacattcatcctctaggaaaaaggtgaagacgacggacactcatcccctgggtgttcacrtcagcacctgggcggccagctacgggaatttacagtgtgtgcagcctctgtgctgtgttcccataacagcgggcagtgtggggaggggcacaagattgaa

SEQ ID NO: 25512 - DNA, 201 bp, Homo sapiens
tgaaaatcaagctgtctccttgtctccagggcagcccctggtttcttgggtgcccacctaatttgtcttcctaatttctggctcaggaggagagtcacaartttgtctcttgatacgagggatgcagcatgggagcgcaagggtggctggctggggacatgtcccaaggcactggggagccagcctcactgatgagtgcag

SEQ ID NO: 25513 - DNA, 201 bp, Homo sapiens
atgtacaggccatgtctgcactgcaatggctccacgtggaaaggacaacacgtttactgcaatggcatcatgccatcatctagtccatcaactgattaccwtaactcaagatggcatggaaagtctgacacagtccatctgaaaagggcatacatagctcttttgaaaaggagggctttccatgaaaaataaaatttaata

SEQ ID NO: 25514 - DNA, 201 bp, Homo sapiens
gaattaagaggaaagatcccaggaggtgggaggaggaagcatggaaggagcccgatgcagccaggaggaggagtgcccaccagctatgcacctgggctgcyggcatccaccaaccctgctggggctgacagacagacagtcccggccactctgtgaagatgtacaggccatgtctgcactgcaatggctccacgtggaaag

SEQ ID NO: 25515 - DNA, 201 bp, Homo sapiens
cacttctgagaagtttcaacatgttcccatgaattccactaacaagagctgtccagaaagccgaaagttgcttagcaaaaggatgcattttagaaagctcyaggtggtccccactaggacccatatgttttaaataatctcatcatttctttcaatttcatttaaaaaattgaagtgaacaacaactaaaatggaataaat

SEQ ID NO: 25516 - DNA, 201 bp, Homo sapiens
actcattttacaaggccagcagtaccctgatatgaggtctttcttaatgaaatagtaagtatttaaggttttgcaggctgcaaggtcttgtttcaaccatycaaacctacccctgcattgtgggtggaagcagccatggatgtacgtgaacagatggaggtggccatgttccactcaaactacgtatggaactgaagtagg

SEQ ID NO: 25517 - DNA, 201 bp, Homo sapiens
tcccaagtagctggaattacaggcatgcatcaccatgcccggctaattttttgtatttttaatagagacgggcttgctccatgttagtcaggctgatctcraactcccgatgtcaggtgatccccccgcctcggcctcccaaagtgctgggattacaggcatgagccactgcacccggcctataaagcaaatattaaaaga

SEQ ID NO: 25518 - DNA, 201 bp, Homo sapiens
caaaaaggcagggcctctaatatgtagctccctaacttcttgagaagaaactactgatcaaattcaagtcacaattctgataagcccagtcatacatgaawgtcacccaggagcatccttctctctgtcagtgaaagtcaagagcatgccttatagatactcaatgcgggcacttgatacactctttgcagctgaatcctg

SEQ ID NO: 25519 - DNA, 201 bp, Homo sapiens
gcctcccgggttcacgccattctcctgcctcagcctcccaagtagctgggactacaggcgcccgccaccatacccagctaattttttgtatttttagtagmgatggggtttcaccatgttagccaggatggtctcgatctcctgaccttgtgatccaccagcctcggcctcccaaagtgctgggactatgggactacaggc

SEQ ID NO: 25520 - DNA, 201 bp, Homo sapiens
acccagtgcaactggagtctctgcaacagggaacccgcacgctgggtgcaaacagtaagagtgggtgctaactggagcagctgtagaagcccaggagggcygaccaacacagcagctgcctgtcattttacccaattaggctggaaaaaactgtgccaggagctgcagcaattagcatgacttaattatccaggtcagaca

SEQ ID NO: 25521 - DNA, 201 bp, Homo sapiens
cactgaccaacccagcactgggggatgggaaacacaggtcagccgagcccttggtatccagaacagctcccgcgcagacagccttcagccccatgcaggcycagcttttagcacctcaagacagcgagctgacatcttcatcctacctggctgagacgttggtgaaatgcatgtaggatgatatgaccactcctatgcgtc

SEQ ID NO: 25522 - DNA, 201 bp, Homo sapiens
tcaatcacacagtcacccaacctggaaaatgccactttcacaagtgtaaacgcttaactggaaactgggtttctaggcactgaccaacccagcactggggratgggaaacacaggtcagccgagcccttggtatccagaacagctcccgcgcagacagccttcagccccatgcaggctcagcttttagcacctcaagacag

SEQ ID NO: 25523 - DNA, 201 bp, Homo sapiens
aagaggtggctgtcatcatcattatatacaaggtatgagctgatttagtgagaccactctgttcttttcataatggtgacttttatctctgttattttttrttagagaattctctattaaagaacaagggacagtggggtcacttatttttttaatgcctccatggaagtacttagaatcaatcacacagtcacccaacct

SEQ ID NO: 25524 - DNA, 201 bp, Homo sapiens
tggctctccactcctaggctgtgagatcatgagcaagctgcctggctcctctgagcctcacctccctcatccatgcaatgggaatgatagtaactgcctcrtggattagttaggagaattcagggagaaaaggaaaataatcagtatacttcccagaggcccagtgcctgcaaaagaggtggctgtcatcatcattatata

SEQ ID NO: 25525 - DNA, 201 bp, Homo sapiens
actttgctggggatagaaatgctcaggtgtggctgggcgtggtggctcacacctgtaatcccagcactttggcaggccgaggtgagtgatcacctgaggtygggagttcaagaccagcctggccaacatggtgaaaccctgtccctactaaaaatacaaaaaattagctgggcatcttggcacacacctataatcccagct

SEQ ID NO: 25526 - DNA, 201 bp, Homo sapiens
tcccaaaaaatccgggactatccacagtgcatggaacttcggttcaggcagtactactttgctggggatagaaatgctcaggtgtggctgggcgtggtggstcacacctgtaatcccagcactttggcaggccgaggtgagtgatcacctgaggttgggagttcaagaccagcctggccaacatggtgaaaccctgtccct

SEQ ID NO: 25527 - DNA, 201 bp, Homo sapiens
ttaaatgctgagaatacattttgaccaatgtttattttgtatagtgatatgagtagtagtaataatattagtactggttttgtctttataactcttatttytatggtgttgatacaagaatgttcttctctggtgacttgaagtttcttttttcttctgtttgcagtttgtgataaagatctcaaatgtgtgcttgtgcta

SEQ ID NO: 25528 - DNA, 201 bp, Homo sapiens
tgcagctccatagcctcccagtgacttttaagcattcctttttctgaaatttacttgttttattaaatgctgagaatacattttgaccaatgtttattttstatagtgatatgagtagtagtaataatattagtactggttttgtctttataactcttatttctatggtgttgatacaagaatgttcttctctggtgactt

SEQ ID NO: 25529 - DNA, 201 bp, Homo sapiens
aggcctcggggctgcagcattgtttttgaagtgactgaaagtaaccctgctttccaacaatatatttgaccttcaatgccaggtccacagtgcccacaggwagtgtctgacagaaacttccagaaatctcacagcagggcattcatgggatttcttgatatgacttcagcacaaatcctggaatatgagtgcagtgtctta

SEQ ID NO: 25530 - DNA, 201 bp, Homo sapiens
agaaagagagttaactcagtggagcccacaccacgtgggtacttgacgggggatgtgtctcatggctgttcaaagcgaccagctcccacaaggggcttcascctttgctgcacctgtgcacacccaatccacctgtcccttgttagacttcatttcccccgcaggaatatgctgtgctcaaagtgggagccatagtgcagg

SEQ ID NO: 25531 - DNA, 201 bp, Homo sapiens
aatcacgggaaaggggcacaagacatgggaagtgggccagcctataaagtctaggaccaaggttaaacaccacacttgaccttcatgtgcccgcttgggtstcttctaagcgtactttcctttctttcttgttctaaagccttttaaaataaacttccactctggctctgaaacttgtctctgtctctttttctgccttat

SEQ ID NO: 25532 - DNA, 201 bp, Homo sapiens
aggggctcctgttcatggcagcataaggggtccaagtagctaagcccagagttagcgccaaggtcctatgaggggcaaacagccatcctccgggaaaccayggcctctccctgacccaggtcttgtaccatactgtggtcacacagcttcatttctgctgatgtggcctggccgaaattgttgcccctgacaccagacgaa

SEQ ID NO: 25533 - DNA, 201 bp, Homo sapiens
ttgttttatgacttcctgcaaacatggaagactctggagcgctgggcctgaggggctcctgttcatggcagcataaggggtccaagtagctaagcccagarttagcgccaaggtcctatgaggggcaaacagccatcctccgggaaaccacggcctctccctgacccaggtcttgtaccatactgtggtcacacagcttca

SEQ ID NO: 25534 - DNA, 201 bp, Homo sapiens
ggaggagatgggttcatgagatgcgtcaggggagactgggtcacattcatgcctcttactgggcttcttccatggcttgtgacctcaaggccaactgcacrgctgacccactagggctgcagcccagaacaatgcttgtctgccctagtcactgtgcatatacacaggggtatttctgatcccccttgctggccgccagtc

SEQ ID NO: 25535 - DNA, 201 bp, Homo sapiens
tacattgtaacaactattttcacagcctttacattgaattaggtattgttatgtaatctagagatgatttaaagtatacaggagaatgctcatgggttatrtgaaaatacaatgccagtttttttgttgttgttgttttctttttttttcagaccgagtctcgctctgtcgccaggctggagtgccatggcacaatctcgg

SEQ ID NO: 25536 - DNA, 201 bp, Homo sapiens
tcctccaagaaccaacacacataagaatcaaaattatctggagaaatcattgttttgatcattaatcaagctgtaattgcaccagctgtatttcacacttyggctattaatgatacataaatattctatttctgcacccacactctgggaggcctgtgatcatgtgaagaatgcaaattatagtcagaacacaggggttct

SEQ ID NO: 25537 - DNA, 201 bp, Homo sapiens
gtgggtcttccaaggccatgaaatctttacattctatgattctatgcatgctgaaagtcatacatatgccttaaaagcttaccttatttcagataaaaaaytttcctaaaattattttaaatgtatgaattgtttgtattcaagaaagataaaaggcaaaaatgtaatggctaatctcctccaagaaccaacacacataag

SEQ ID NO: 25538 - DNA, 201 bp, Homo sapiens
tcctcgctgatttgatttttgtaagaattcaggaccagcaaggtagggagttcaccatccactaagctaagatttcaaaatctaggggttacagggaaatkaatgaaaatcctcaaaaactttgtatagggtatttataatacaatgaaaagctatttctcgagtcaccctactgccttatagaagtgggtcttccaaggc

SEQ ID NO: 25539 - DNA, 201 bp, Homo sapiens
aggagcctccagggtgaagcctcctaggaaacaagcccagggctgccttctggaccacaggatgtgaggaacaccagagcggatgtttctctcccctcctrgtcctccctctcacttccagccacagggatgctgcaccatcgctgcagcacagcactgctgaggacagacttccagcccaggtcctcctccttaggacag

SEQ ID NO: 25540 - DNA, 201 bp, Homo sapiens
ctcctgccagaaagcccatgtccccaacgggatcctctagggcaaaaacttcactcatgggcctagagcaagcatagcaactccaaaagcacaaaacattmaaaaaaaagactactggatgaatgacagtaggaagaaggggccacagaaaataatgaggaggaaggagggagggagcagagaggaggaaaaggaagaagg

SEQ ID NO: 25541 - DNA, 201 bp, Homo sapiens
acggcccctctccgccctgccccaccctgttcctgggcctgcctcatttatcaagtgccaaacccacacctccaccacaccccttccaagtcccacccacrccgcccactcaaagcctcattccaactgctacaacagagatgcatgtaatgtctactcagaccacacgcttgggctgcggtgcccactacagggtgggac

SEQ ID NO: 25542 - DNA, 201 bp, Homo sapiens
ccacggaggggaaaactcaaagaggacaagaggccttttgaaggaggaggattaaggatggctaccccgcctgggaagccactttccgccttcaaaagtamacagacagcctcagaaaacacccagactgagggcaccaagccatctgcagtcttcagggtgtaaatctatgcacatgctttctgctcgttaggatcctct

SEQ ID NO: 25543 - DNA, 201 bp, Homo sapiens
gacaatgccatatttactaaacctcttgaggttctgcccttttgaaaggagcagacttaagaatctgaccttttgggaaaagcacactgcaaagatgggaygggtcaggtgtgcagctgggaggggccaagcagggatgggctggctgtgtcgaggcgaaggcagacggtgggtcaaggtcagctttgctgttgcctgcag

SEQ ID NO: 25544 - DNA, 201 bp, Homo sapiens
gcaagatgaagcatgtgtttacaaactgtggacctgagagccgagaccagggagggagcaagccggatcaggcccctggagccctgccagactcctgatgrgcccgctgcccgcatgaattcctgaacagggttacataacgcctcggctgccctccccatggcactgtctgacaatgccatatttactaaacctcttgag

SEQ ID NO: 25545 - DNA, 201 bp, Homo sapiens
taaattagcactacatattaatataattcattatccaataatgatatgctatatttatatgaatatattatttaaagggcataagcttctagagagagggyacttggtactcaaaaacatatagggtgaatgatgatctcaatgggaaggcctgtaagcactcttgctttcttttagtctgatgaggcaattcagaaacca

SEQ ID NO: 25546 - DNA, 201 bp, Homo sapiens
ggtggggtgcacccatgcccagcttcttctacccaaaaagcatgtggctacagagatgtgtcagataagtcactttcaggaaaggccaattcacggtgatrttgtttgttcttgtttttgcagagctggaagatcctctttcccctcatgggcctggaatgtcaggtttactagtttggtaaaaagtgggggccccaccct

SEQ ID NO: 25547 - DNA, 201 bp, Homo sapiens
cctagggggtggggtgcacccatgcccagcttcttctacccaaaaagcatgtggctacagagatgtgtcagataagtcactttcaggaaaggccaattcamggtgatgttgtttgttcttgtttttgcagagctggaagatcctctttcccctcatgggcctggaatgtcaggtttactagtttggtaaaaagtgggggcc

SEQ ID NO: 25548 - DNA, 201 bp, Homo sapiens
tttcttcacaccttccccgggccaggcactgggatagggtttccttctcacagatggagtgaagagaaattcacagagacgctgccctttacccacttgcrtcactcaggcaacccacagcacactcagacctgaagccaggaccaacatctgcagggtgtgtgctccttcgcccaggccaccccagacctgagtcgggac

SEQ ID NO: 25549 - DNA, 201 bp, Homo sapiens
atcatgccactgcactcactccagcctgggcaagagagcaagactccgtctcaaaaaaaaaagaaaagaaaaaaactgaatgtctgctcaaatgtcaatamgaaattcaatgaaaagagaaagtgcaggaattgatttgggtcttcctgtttggcacagcaactttgggccacgtaggtgccgggtgaatgtctcaggatc

SEQ ID NO: 25550 - DNA, 201 bp, Homo sapiens
ttcaaagcagcgaggaggagacaagcccaggctcaggcccgagctgtggattccggattccacaccagccacaggctgcttcagaagggaccccagcccgmgagctgccccagggccaggaccgcctcccttcctcaatcccgggatggagcacaattctcatagacaatggggctcagaaaatgcttgaataaggaagtg

SEQ ID NO: 25551 - DNA, 201 bp, Homo sapiens
attcacattccctccaacagtgtatacatgttctttttctctgcagctttgccagcatctgttgtttttcgactttttaataatagtttggctcattttcyaagtgaattgtttgttctttactgctgagtattgagagattatatacattctagatgatattcctttttttggacatgtggtttgcaaaccttttctcct

SEQ ID NO: 25552 - DNA, 201 bp, Homo sapiens
tagcgtactgaaatagaactagtttttgtgtgtcgaactagaatcctgcaaagtggctgaatttgttctaacagtttcactttttgttgttgttttgttgytccctgggattttcttttttttcttttttttttttttgagacagagtctcacactgtcgcccaggctggagtgcagtggtgcaatctcagctcactgcaa

SEQ ID NO: 25553 - DNA, 201 bp, Homo sapiens
ccacatgccacccctggtgtcctgtcaggaccagagtgccctgaggaccacacacctgcggtgaccttgggcagagcatggcccgactatgataatttgartcttagcaatgagaaattctggagagggaaaaaacctattatttcaagcatcaacaataaatattcaccatcccaatctttccttgccagaaacaccaca

SEQ ID NO: 25554 - DNA, 201 bp, Homo sapiens
gctgcggatgcaggaggagaacctttccacatctcagtccagggtaaatcatcccattcggtgtcccctttcccttgcgttgccaccagacccagccaacsagcatcaaggacctcccctcccaagggaggctgtccactgtctggcaacgatttcctggtggccagatcttagttaaaaatccaacaaacataaatacag

SEQ ID NO: 25555 - DNA, 201 bp, Homo sapiens
cttccctgctgctcaacccttcctctaaatctgtcatagagtctcactcatctacctcctaaatatctaaaggcccctactctccatcgccagagccacayccaagtccaggcctccgtcagttcttagctggggagtccagaagcccattctctactctccttcctctccagactctgcctcccagagggcgtcctccag

SEQ ID NO: 25556 - DNA, 201 bp, Homo sapiens
ttcctcctgcacacaccagccaggcggaacacacttccaccccgtgaatatgtgctgctcgcctatgccccatgcccagggctaggcataccctgtctgcmttccctacctgcaagggctgtcctcttcgtgaatctccttggattgtacaggcaaagtggttgtttctcttcaattctttcctaattcctggtacccaat

SEQ ID NO: 25557 - DNA, 201 bp, Homo sapiens
ctctactcgcccctagacccaactctcggtgacacagagtcccgagtgcatgcccagaccatcacctgcatggctccaccacctccaaccacacaatccayagcagtctcccacctgctcacaccactggctcagaagatgctgcatgaaaaatacaccaatgggaattgtgatttgtaatgtcagggccttagatattta

SEQ ID NO: 25558 - DNA, 201 bp, Homo sapiens
ctggtgtgctgaataattcacaccagcaaagaacactctgtttactttacaggccagagcaaagctctccccgtccacaacttgcccactagccccagatwtcatctgtgttttaatgtccttaccatcaacattccatctgtgggtctccacctctggtctaggtgtatttgggttgcaacaattccttgagttgaaatt

SEQ ID NO: 25559 - DNA, 201 bp, Homo sapiens
tagctatgacccaatgtgcatattacacaggtgaacagaggacatgtttgggtgagacggtttcacgaaaacagagatttaaatgatacagccataaatcrggaacactagactaacaagcaaacagaaattaaaacaagatgtctgttgcatgtggggccgtacaacagtagctagtttggctgtggccagcgcttggca

SEQ ID NO: 25560 - DNA, 201 bp, Homo sapiens
gtagtccacaatcacaccgtggtcgttgtacaagtgttcggaccctgcacagagcacaggcagcaacattagtcccagtgaaacccatcacctccatccamccgactccaccataaggacaggtgagcagcctgacttgagcaggagagagaagcctctccatcctccaccctcctgccaggagccacaacactaatcaga

SEQ ID NO: 25561 - DNA, 201 bp, Homo sapiens
gactgagaaactaacttgctataggttatattaaacctggctcctgagaaacccgaaatcctaacctcatataaggtttaaaaaactctctctacttgtargcaccagtcctgcaaatctgtgttgcaaactcactctctaggtgtttttttcttttgttttgttttgttttgagatagagtcttgctgttgcacaggctg

SEQ ID NO: 25562 - DNA, 201 bp, Homo sapiens
agccatctccagaatgaaataagaacaacacaaagctggcttaggggatcctacagataatgcagcaaaggctggggcttggcacacagttgcaggcagtmagtgttataatgggccacactcaaaatgggctgttcatgttgtcattaaaagtcaagtttatggaacttgaagtggacaaacacgctccaacattaagtg

SEQ ID NO: 25563 - DNA, 201 bp, Homo sapiens
gctcaagaatcacagcaggtctcaaccctgaattagcactgcattatttggggagcatttttaaagcaagtctgacatccaggccccaccagggccaactyaatctgccaccctctggaggtagaagcaggtacccacatttttagcgtctgcatttttaaagctccccaggtgactccaacatgcaagacaaagtgtcca

SEQ ID NO: 25564 - DNA, 201 bp, Homo sapiens
gccagaatccttcctattcacacatggatctaagctgaaagaggagggctccagctcaacagccctggtctcctttggctggctgaggagacggatatggrttgagggatctaggacaccttcaaagtgcaggcactccagcagcatccccaaccttctgacgatgtcccagggactcggaactagctgctttgctaccac

SEQ ID NO: 25565 - DNA, 201 bp, Homo sapiens
gtattttcaaccacgccagcctcatgctgagaaaggcggggttccggacatggagctctggagcaggaggagctcccactgcctgtgagagccaaggcccrttcatcaggacggcactgagctcacagggagcagagcctcgggcgatgacatcagctaatgccacccccagctcctgcttcttgggggtctgtggcatct

SEQ ID NO: 25566 - DNA, 201 bp, Homo sapiens
gacagggatggttatgtcccaacaggggcgggcttccaacacctctcccagcctgaactcaggctctggaagacctgagtctgaacgggccatagagaggyctcaggaacaagatcccactgggaacctacactcagagccagaatgcagtctcccagccagagccagggcccaggactgccagaaagtcccggagataag

SEQ ID NO: 25567 - DNA, 201 bp, Homo sapiens
aaactcacacagatccccctgcagagagcctggaaaccagcccctcagggcacagcacaggcatcccaaggacagccccaccaaacccccagcatacagayacctggtcctgtccacatgggatgtcgggggtgctgacgggggcaagacccacagatgctgaccaccatgggccacagagataggtctctggccctgcag

SEQ ID NO: 25568 - DNA, 201 bp, Homo sapiens
catgtgttgacacatgtataacatacatattcatttgtgtgcgtataacaattacatgtataacatgcatgtatgtgttcatgtaccaataaaattacatrcataacatgcatgtctatccatatacatgtaacaactacatgcataacatacatgtatgtatttgtacgcacaacaattacacacataatacacacacac

SEQ ID NO: 25569 - DNA, 201 bp, Homo sapiens
tccctggcacctgccttctcaaagagttttctgaaaatgtgcaaccgaaggagaatcgtagagaatctcagagatctgactaattgtacttgtggtttggrgtgggcggcggcgtaaccttggctcttaccaggataactatttatagcctcttgcttatcttacgcagtccagtcctcagggagtatgtgacacatggcc

SEQ ID NO: 25570 - DNA, 201 bp, Homo sapiens
aaacaaaacaaaaaacagctttggaaacagaaggagtcacagacaaaaccttacaggatggcggaaacagccggacaaggagaccccatggttaacagagyggtgtgacttatctcccctcaagcatggtatctactcagtgcacacatgcatcttgttgcctcactccacatgtgacatgcaggcaagaaatgtgcgaag

SEQ ID NO: 25571 - DNA, 201 bp, Homo sapiens
cacacttggcaaacataggtggagacctgcaatcatctggcagaatcagactctcatttcgtcctgtggggctgcagacagaagctccctgtggacagcaygctgcatctgggtccagctctgtgcacggccgagagctaccctcaggaaatgtctgctgaactggctggcttaaaaattaactgcctctgcccttagagc

SEQ ID NO: 25572 - DNA, 201 bp, Homo sapiens
tgtggacagcatgctgcatctgggtccagctctgtgcacggccgagagctaccctcaggaaatgtctgctgaactggctggcttaaaaattaactgcctcygcccttagagcaagaagtggggagggaggagaagggatgcccgtgtaaacatttactgagacggcagagagaggcagagcccgtgctggccgcgtgagct

SEQ ID NO: 25573 - DNA, 201 bp, Homo sapiens
agaaagagagaaagagagaaagggagaaagggagaagaggagaaagggaggaagagaggaagggaggaaggaaagaaagggaggaagagaggaaggaaggragggagggagggagggagggagggagggagaaaggaagagagaaagaaagaatttattaggccttgttactagcaaattcagatcattcattcctagtga

SEQ ID NO: 25574 - DNA, 201 bp, Homo sapiens
tccccccatcccttcccgcaggtgcaggcttgcagctcgggagtcagaccccaggcatgtaggtcccaggccatctgaggagcctgtgtagacccctgtgrctgaagagcagggcctcactgcccttgagaggctagctctgagaaccagctttttaaataacaagtaccacctactttcattcttatgataaaagttact

SEQ ID NO: 25575 - DNA, 201 bp, Homo sapiens
cctgccccacacctggctacgtgggtgcctgggtacactggcatcaataaccttgtccccaagccagcaggtccacaggacagaggggcagagggacaagkgcttgccaccaagtcatgactgtgtccttgggaatgtgagtgtgtgggtgagcgtatgtgtgtgtggatgagtgtgagtgtgggtgtgtgaatgtgggtg

SEQ ID NO: 25576 - DNA, 201 bp, Homo sapiens
gtccccaagccagcaggtccacaggacagaggggcagagggacaagggcttgccaccaagtcatgactgtgtccttgggaatgtgagtgtgtgggtgagcrtatgtgtgtgtggatgagtgtgagtgtgggtgtgtgaatgtgggtgagtgtgggtgtgtgagtgtgggtgtgtggaggtgagtgtgtgtgggggtgagtg

SEQ ID NO: 25577 - DNA, 201 bp, Homo sapiens
ttaacaagcagctagtgaagatcatgtctgtggcacagtaaaatgaaaaaagaaaggctcaagctttcccagtccttggtcttggcttggtctcggctctyctcacctctaggggcctcagtttcccctttcaatccaactctatggaatctaataatttttagacaaaagagtagtgcccctatcccagatgggcttagc

SEQ ID NO: 25578 - DNA, 201 bp, Homo sapiens
atgccatgcctgacaccatgaacattctaaaacactcaactggtagtctaagcaaatgaaggaacgctttttgattttgctttgatttattcatgtttaamatacaagttaaaatacctgactctgaagaagctgtaggggcctactgagtggggaccttaactattggcaccagaaatggctccctttccaactgtgtgc

SEQ ID NO: 25579 - DNA, 201 bp, Homo sapiens
gcatccatttcccttttaaacatggggacagatgtgtcctctaacctctgaggcttccatctggaagtgcctcatgagtcagtggctcacatttagaacasctgtgcctcctggatgccccaaccttttttctccctcatttctatcccagagagattagatgtcctgtacaaattggatctgaaaatgataataaaataa

SEQ ID NO: 25580 - DNA, 201 bp, Homo sapiens
ttggccagcagcaggaaggctgggtttggagcccatgtgcctggtgcgcaggccttcatggaggacacagccgcatatcggcaggctgccctgcctgccgyacggtagactccagggcctggcactgtcagctccccacacctgatctcttcttatcctctgtcctcacctgcagccaacatagtccaggctcaactccct

SEQ ID NO: 25581 - DNA, 201 bp, Homo sapiens
aggacacagccgcatatcggcaggctgccctgcctgccgtacggtagactccagggcctggcactgtcagctccccacacctgatctcttcttatcctctktcctcacctgcagccaacatagtccaggctcaactcccttgcctaaccctacctcccacctgtgagcctcagcccaggctgctccctctgcctggaaaac

SEQ ID NO: 25582 - DNA, 201 bp, Homo sapiens
agctgcaggaggctccaaacatgttcctctgatcttctcaaagccctaacccaaagcctttcacagctcagactagacagctacaaaacagaagactactmttttgcctagtagagcagcaaaaataaaaatcttgaaaacattttttaaagttttgatgaaatataaacagatgcaagatttcagaggacaacttgtcag

SEQ ID NO: 25583 - DNA, 201 bp, Homo sapiens
atgccagcagggtcaccataaagccccgcagatgccgagacggtgcaaggagcagagccccacagggcaaggccccgagctgctggcagctggtgtcgccyagctgacgcacttccttagttgacagtggcttggtcctgctggccaccttcgagtccaagaaaggcctagaagtccacaatgaatgcctctgattgaggc

SEQ ID NO: 25584 - DNA, 201 bp, Homo sapiens
ctgaaaaacacttcttttggggtcagagctctcaaaagggtgaccaaccacagatgaaagaaaaggaatcgaaggctaacctggtttccactggaaagaamctcgggtacacagtgtcgacagctactcctaacagctcagtgaggtccgtgctatcaacacagttttcagcaccacttcagagaagtttggggaccatcc

SEQ ID NO: 25585 - DNA, 201 bp, Homo sapiens
acgagaaggggtgccacctgggttcctgcaaagcctgctccctttccgcttcacccccagggtaaacaggcaggacaacgcagccacaggctgcacccacrctggggccttcctcttgtttgctcaaagccatctggcagtatgggaaacggaaaagctggtgtcccggctcacagagctgacaagaggcgaaaccgtgca

SEQ ID NO: 25586 - DNA, 201 bp, Homo sapiens
acacgaatctactccagatggttgcccaagggaggtgacagggtggtgaggggggtagagccgaaatggaagcaaaacgggcttagtggatgccttatccyatggttctaatttttgaacaatgaaatggattacctattcaaaacaatagaaaataaaattaacaaattaatgttctttcttaaataaggtgaaaacttt

SEQ ID NO: 25587 - DNA, 201 bp, Homo sapiens
actggatcagtggggacctggccgggatccctctgcttggctggaagaactacatgtccatgcagttgagggaccttcagggaggtctctgtggtgtcgtrtatgtttcatgggtgggcctgcctgttgaggaggcagaaaggacaggaacatccctctctttagctagactgaggtgccgggcactgtcctgtgggctgc

SEQ ID NO: 25588 - DNA, 201 bp, Homo sapiens
tgggggtgagtggcactctgggctgggcctggacgaggccaggattgtctgcagggcagcggctcaccagccgggcctccccatctggggcgaagctatastggtgagctacaaccatctgctgctggcgcacccaggtctgtgtggagtagctgctctgcccataggcctgcatctgggcggacactgagggctttctca

SEQ ID NO: 25589 - DNA, 201 bp, Homo sapiens
aaattgggagggtccaacatgtttgtgacattgtcttcctatccacaaacatggctttctctccatttatttttatctttttaaatgtctcttaacagggmtaggcaaggtggctcacgcctgtaatcccagcactttaggaggcggaggcaggcagaccgcttgaggtcaggagtttgagaccagcctggccaacatggt

SEQ ID NO: 25590 - DNA, 201 bp, Homo sapiens
cactcagcaagggtgagctctgacaacaacaaccattagccattccagccctgtcctggcctctgcacggagctgtgccatccaattcagctctgtatctrcagcatccagcactgccgatgctcagagaggcagggaggagatggagactgcatcctggatcctacagagcctgcctgacaagcacacgtggcctctggt

SEQ ID NO: 25591 - DNA, 201 bp, Homo sapiens
tggcccaggaccagcccaggtccctcacaagggaaagggtgaggccggcttcccaggaaaggccattcctcttgggccagaaaaatgctcccaaggcattktcaatgtcctattcatttaatcttttcaactgctatgtgtggaaatattattatccccactgaccagatacaaacctcaggtccgcatggctaagtgatt

SEQ ID NO: 25592 - DNA, 201 bp, Homo sapiens
tcctgtgacctctcccaccccgtctcatcaaggcctctgtaggctacacggtatcagtaggttccctcctgccagaaagcccatgtccccaacgggatccwctagggcaaaaacttcactcatgggcctagagcaagcatagcaactccaaaagcacaaaacattcaaaaaaaagactactggatgaatgacagtaggaag

SEQ ID NO: 25593 - DNA, 201 bp, Homo sapiens
gaaaggacgctggcttgggaaacactggtgtgtcatatgataaaaacagtgaccagccagcctgagctctgtgcctaaacacatcatctgcgccctgcacratgcccctgtgaagtagagacacgcggatcagaagccccaggtcccaccactttgtttccagtcaccaacttgtccccaaatcaactgcatccatacacc

SEQ ID NO: 25594 - DNA, 201 bp, Homo sapiens
tgtttaaggacagcgggtggacaccgtgagaatccagccagcaccctatgtctcaactgcaatttgaccatatatactaaggagttccaaaaagcttgtgytcaccaaaaaaaaaatggaaagcagggacttatacacccatgtccatagcagcattattcacaacagccgaagggtagaagtaactgaagtgtatcaaca

SEQ ID NO: 25595 - DNA, 201 bp, Homo sapiens
gggactggggggaggggaacatggggagttagtgcttaagggacaccgagtttcagttctgcaaaatggaaagagttctggagctggagggtggtgatggytgcacaacgtgaaggttcttaatgtcgcctaactgccgcagttaaacatgattaaaacgacaaagttcatgttatgcatgttttaccaaagcttaaaaaa

SEQ ID NO: 25596 - DNA, 201 bp, Homo sapiens
acaatctaacatgaaccataattagagctgagggaggaaggaagagtaaagaaaggcccagccttggggtccgaggaagcagctggggctggcgcactggytgaggtagacagcaggcacgccgcagctcctgagccttggcctggccactccaggggctgggctgtgggtggggactgcacaaacccctcatcttggcaa

SEQ ID NO: 25597 - DNA, 201 bp, Homo sapiens
aagccatctccagaatgaaataagaacaacacaaagctggcttaggggatcctacagataatgcagcaaaggctggggcttggcacacagttgcaggcagkaagtgttataatgggccacactcaaaatgggctgttcatgttgtcattaaaagtcaagtttatggaacttgaagtggacaaacacgctccaacattaagt

SEQ ID NO: 25598 - DNA, 201 bp, Homo sapiens
cggattcaaggccggctcctttctgagtatagaagcagaatgttgcgctcacacatcaaagccagcgctcccctaacaggcccagattgaaggcagctgcrgagggctccattccaggacggcaaccactgctagagataaatgcggcttaagtcaacatttttggggttttttaaccaggcggcggggggatagaaaagg

SEQ ID NO: 25599 - DNA, 201 bp, Homo sapiens
agcaataagatcaaacgcactttggaagcccctctaagggaatccagtgtgctcagtgagaaggacatgggaagaaagtttaaagatgtgcacagatgctmaaggaggtgggttaagtgaaaaactcaggctataaaacaatgcacaggctgatcctactatgagaaattacatgatatttagaaatcatgccaaaaatac

SEQ ID NO: 25600 - DNA, 201 bp, Homo sapiens
acgttttagtgcaagctgcattcttttggacttggaattgttaacaaaaatcacagaatcactaactgcacaattttccatgggtattcttcaccatggaytcagaaacaaaaggtatggtgtggatgaaatctcccaaaagaactgcaggccatttctggtcagtcaataaccagggtgtggaggggtgaggaggagact

SEQ ID NO: 25601 - DNA, 201 bp, Homo sapiens
ccgtggagcacctcccatggagacccagctcaccttgccgcccggtggccctgctggggccctctcctgtgtcaggcagcctgctgcttgcccggagcccrcctcccacgctgtctggagacacagagccattggcctggctaccgagggcgttcatgtgggtagggatgggctcgaaggtgggatccagctccaggatca

SEQ ID NO: 25602 - DNA, 201 bp, Homo sapiens
aacaaaatctctatgttctcatttcaaacacatatcacaatggtcaattctccttcaaggaatgtgttctaaggcaatgaccatgcctggaaagatctacrtggaagggcagggtacagaattatgcacaacaaaaaaggctggaagcagttttaatagccagcaactgggctctggtcattttatggtactaacatagaa

SEQ ID NO: 25603 - DNA, 201 bp, Homo sapiens
cttcaacatggcgatggctggagaaagggaggagaaagacaagaaggtctgccgggtggacaaaggtctatgcccactcataaccttgggtaggtcctctycccttactctttttgcaaactggatcagtggggacctggccgggatccctctgcttggctggaagaactacatgtccatgcagttgagggaccttcaggg

SEQ ID NO: 25604 - DNA, 201 bp, Homo sapiens
tattttaaggagaacagaggtagaatttaaaaagttaaatagggagctacgtgttcatacaacaaagcataaagaaacttattcctactctgagcaagtgraatggtctcacgtatgaatgtcctcaggggtagtatctttgtgaagcagaaataggccatttttccctgttaatacccaccctctcccacccccaggtct

SEQ ID NO: 25605 - DNA, 201 bp, Homo sapiens
gtctcaaaaaaataaataaaaaaataaagtaatgagtttaccaagtaatttaaaaacagccaaactgagggtggataatatgatgtggctttcgaaaattycaggccttataactgtttctttgcagcaagaacagggaatcactaaggattgaattcaatcaattggaagacatattaacctcaagagactactatatgt

SEQ ID NO: 25606 - DNA, 201 bp, Homo sapiens
aatcaatcgcttgcagagtgtatgaaggtaaacacaggatggaaaaaaacaaggacactctgcccttgaacttcaatcaaaagctgtggggccaccattcsgaccactgttaggccgcagcatcatgaaaagatcctgcaaacctgcaactaccaaggacagactcgcatgcgcccttgttctgaccgtggtgcctccaag

SEQ ID NO: 25607 - DNA, 201 bp, Homo sapiens
ccccagttccagcccacagccaggattcccacacttgagctgatcagccttgccagagggtttgttaaagcaccgatcgcagggccccagcaattcagtasgtctgggctggggcctgagaatgtgcatttctataggtccccaggcaatgctgaggctgtaggtccagggaccacacctgggggccagctggtcaaggca

SEQ ID NO: 25608 - DNA, 201 bp, Homo sapiens
gtttccggcagggacttttttctttttaattttttaacaaaaattgtttcctgatactctcgggaaagtgcacattttaaagaaacctgttataaatgcascaggagaatgagacaattatcacagcagctatgaggaccaggagcccatgaagtttcagattttgaagccaacagttgtcctgatgctggcagactgaca

SEQ ID NO: 25609 - DNA, 201 bp, Homo sapiens
cctttcaattatcctgcaagctgctaataagccctcagaaacaaagcttcactcactcagctccaaaggatggaggcaaagaaaacaccaggaggtaccaygaccttccaaggagctgcatttgaaaagcagacagcaatttaaatttgcctaatcacaagccaaagagaaagtgctattgtgtttaccttcaatctgatt

SEQ ID NO: 25610 - DNA, 201 bp, Homo sapiens
cattccgcacaagagacggggagaggagactttgactccaccatagtctctgaagaccgagagctccctgggaaagataaagaaagtaacggaggcaaggyggctcaaacacagtcaggagaggcagttagtaacaggcacagggagccaccagtcctgcagggcaaagaccccaccttgggcaggatctccaccacttac

SEQ ID NO: 25611 - DNA, 201 bp, Homo sapiens
ctcaaagagttttctgaaaatgtgcaaccgaaggagaatcgtagagaatctcagagatctgactaattgtacttgtggtttggggtgggcggcggcgtaaycttggctcttaccaggataactatttatagcctcttgcttatcttacgcagtccagtcctcagggagtatgtgacacatggccgttcctgtgtctgggac

SEQ ID NO: 25612 - DNA, 201 bp, Homo sapiens
gttttctgaaaatgtgcaaccgaaggagaatcgtagagaatctcagagatctgactaattgtacttgtggtttggggtgggcggcggcgtaaccttggctyttaccaggataactatttatagcctcttgcttatcttacgcagtccagtcctcagggagtatgtgacacatggccgttcctgtgtctgggacacatcatt

SEQ ID NO: 25613 - DNA, 201 bp, Homo sapiens
gtcccatctcaccccagaccatccacggcttatatggctaaccggctcgcgcgataagttggcacgcccaatcttgtcgaactccatccatcacttgtgcygcacattttcactgacagccttctcctgccaggacttcacttggaaatgaagcagactggtccctaaccccacagagcttacggctcacgtaatagaaac

SEQ ID NO: 25614 - DNA, 201 bp, Homo sapiens
acactgcttacaggtgagtccagggaccacacgacaatacttcagccaaaggtgcctttggtgcgtccagccctgacctggcccacctgtcactttaggargagatccccagcgcagagaaatgcagcaaccctgaaccacagacgcaggtaatggtcagggctgatgggaatccagtgtctgtgagccacacacctgcag

SEQ ID NO: 25615 - DNA, 201 bp, Homo sapiens
gtcagtagttatgtgcatgggagtgtaaaagtgtagggggtgtgagcgtgtgtgcttgtgagaatgtatgaacgtgcatgtgtgaaactgagttttgtaartgtgtctgtgtgtgtttctatgtatgcctatgcctcatgtgtgtgtattgatgtgagagcgtgtctgtgtgtgtctccgtgtgtgagtgtatacctgtat

SEQ ID NO: 25616 - DNA, 201 bp, Homo sapiens
aggatcgctcgggggcccaaacgccttcctgcagtgagtctgtcttacaagaccagggctgagcagggaggccaagcatctcatggtgcagccgaggcccrcagaggcagaatcagggtctacagacccctgaaggccaacacttaccacagtcctacgccttatcttttcaaaaagagaaagaggacatctggtgattga

SEQ ID NO: 25617 - DNA, 201 bp, Homo sapiens
tgttctcccaaagaggccaggcaagagaaaataagtattcgcctagtacagagtttcacgtatggaacacacacacacacacacacacacacacacacacrcacacacggagcaggaaatgttcaccgcgtgctcttttcttttgtttttgtttacactggagcgacgtgtgcccatggatgcctggccttgctgctctgt

SEQ ID NO: 25618 - DNA, 201 bp, Homo sapiens
gggctccccaccctggtctatctgacccagtcagggcagtcactcaaacattcattactgtcaccatgaaagtggcatctgttttgaattcaggggcctcwtcttctctgggtgtcccactctgtcatcagagcctggctgcatgaggtcagctggccccttctctcctccgtgacacccctggtaaacagacacccaaca

SEQ ID NO: 25619 - DNA, 201 bp, Homo sapiens
ataaagccccgcagatgccgagacggtgcaaggagcagagccccacagggcaaggccccgagctgctggcagctggtgtcgcccagctgacgcacttcctyagttgacagtggcttggtcctgctggccaccttcgagtccaagaaaggcctagaagtccacaatgaatgcctctgattgaggctcagattactagggatt

SEQ ID NO: 25620 - DNA, 201 bp, Homo sapiens
agctatgggaattggggagagatactgcccctgctcactgtctcgtgggaggactgggagtctcggacaagatgccacggatgtatgagcagagccttcayggggaagaagaggcctgagccatgcgggagtcagagaattctcaggcatcatttcatgagagagaaatagagatgcagcccaagaggagtgagccccaag

SEQ ID NO: 25621 - DNA, 201 bp, Homo sapiens
acttttagaggcaagtccctctaaggagccagcagcccccagatggcaaaacaccccaacgtgccaatgtgggaggccctggcaccacacggatgccacaytttctggcccaaggttatcctttgggtcctggtccttgcatggcactgccagggctcccagaacacagctctgtctctccaccttctgtagcctcccagt

SEQ ID NO: 25622 - DNA, 201 bp, Homo sapiens
tcaaggctgcacagaaaggcactgtgctggtttccaaaccaccagcctcacgggaaaaggacatgtgcagtcctggcctccctgcagttagcatgaccccrgcctggttttggggcatccccagaggcccccgcaccgggtcccatggctttgggtcccaccacagctctcagtcccctcacccctgggcctgttccccca

SEQ ID NO: 25623 - DNA, 201 bp, Homo sapiens
accagcctcacgggaaaaggacatgtgcagtcctggcctccctgcagttagcatgaccccggcctggttttggggcatccccagaggcccccgcaccgggwcccatggctttgggtcccaccacagctctcagtcccctcacccctgggcctgttcccccaagcccctcccatcactgagctgctctccacagtagaaccc

SEQ ID NO: 25624 - DNA, 201 bp, Homo sapiens
agcatgacagcatttggatcctaggccaaaattcacaagagttgaaactgcaagggaaatgtccctcccttgtggatttcgccaaaagctaacctactagrctgatttctcatcacacattagcctcccgtggagcacctcccgtggagcacctcccatggagacccagctcaccttgccgcccggtggccctgctggggc

SEQ ID NO: 25625 - DNA, 201 bp, Homo sapiens
atcctacacaaatgttctgatttcctcctatctcttctgaaaccatttggtctgttccagcccactgtccatcccaccgtgttcttcatgcagcagccacmgtgatgtgtgaaaatgcaaatctgagcagtcacctccccatcctgaggttcagtaatgacctcacattgcatgtggatgccacaccaccaccttctggga

SEQ ID NO: 25626 - DNA, 201 bp, Homo sapiens; identical to SEQ ID NO: 25328

SEQ ID NO: 25627 - DNA, 201 bp, Homo sapiens; identical to SEQ ID NO: 25329

SEQ ID NO: 25628 - DNA, 200 bp, Homo sapiens; identical to SEQ ID NO: 25330

SEQ ID NO: 25629 - DNA, 201 bp, Homo sapiens
gtccagaagctctgttaacataatctgagcaggttctttcagtgaatgcatgggtttttgtttttgtttttttcaatgacatgaactcgtttagaaatacyctctttgcttgcttcaaccacagaagagacaacagtaaatctcattttagaacccagcgcctgatcctaacgcttgctttcggcatttagtagaaacaac

SEQ ID NO: 25630 - DNA, 201 bp, Homo sapiens
ccacccacccaggcagggctctgtgttccggcctgtcccgagggagtcgtgcagggggcggggcggccacctccaaagaggcccattcagagggcggccgrgagagctcaggcccgggaaagaatcccgggattgttgagctgctgctggctgtcgcgggcggcctgcccagtcagtgcctccagacggccctggccccgc

SEQ ID NO: 25631 - DNA, 201 bp, Homo sapiens
cctttattccaaccagtacagcaccactcccaaatctgcaataaagacaccccatgatacagaaagtataggcagtttcattggttatccataattttttycccccagggatcaatgatcattttctcctactttgggaacaattttgtcagtaggctgaattttggaaagagggtaaaggggatagtgaaagaatcaacc

SEQ ID NO: 25632 - DNA, 201 bp, Homo sapiens; identical to SEQ ID NO: 25336

SEQ ID NO: 25633 - DNA, 201 bp, Homo sapiens
ggagaggaggaacagagggagagaaggggcaacaggagtttccctttcggaggaagacacaagcagacttggttgccagagggaggtgagaaaaggggcaktaaaccaaggagaagggaggagctggggcgcccagagaagacacacgggaagggatgagcaagtttaaaggtctcgcagcctccatagggggcacgtcct

SEQ ID NO: 25634 - DNA, 201 bp, Homo sapiens
caaaacaaacttttatccagatccttctctgtgttagatgccaggagtgtgatgaagactctgctctggaaatgtcctgaggctgagggagggagggtgayaccaaatcccaacccaggtcccactgggaagtcacatccttcaaatgcaggtgagagcgaggcagcagaaacaaaaggacggagggaaggtgaagcaagg

SEQ ID NO: 25635 - DNA, 201 bp, Homo sapiens
tccccaactctggagttgaaatgaggtgggactgtctgcctgtctccactttgtgaggctgtgagccttctgccacggaatcagagcttgcagataagctrctttctgaatcctaaagcgctcttccagctttcacatttggttcctttggttggggtttagcacacaatttaaatcaacgggctctccatggtcaattat

SEQ ID NO: 25636 - DNA, 201 bp, Homo sapiens
tccggtggctctgctagggacagctcatggctgtggaaaggagcctggagctctgacggcgggaagcaggacagcactggggagtccttcctggtaccggrgaactcagcgctgaggggacttccggtgggccggccgctccccagcagggaaaccatgggcttggggctgctctccacccactggcgttctgcagaagag

SEQ ID NO: 25637 - DNA, 201 bp, Homo sapiens
gtggctctgctagggacagctcatggctgtggaaaggagcctggagctctgacggcgggaagcaggacagcactggggagtccttcctggtaccggagaaytcagcgctgaggggacttccggtgggccggccgctccccagcagggaaaccatgggcttggggctgctctccacccactggcgttctgcagaagaggagc

SEQ ID NO: 25638 - DNA, 201 bp, Homo sapiens
gccctgcaggcctggactgtggtggctgctgtgtccaggcgccaccgtgagaaagttgtgggacaggaagccattgtcggcagcccctgtcgctgtcagckggatgctgggggtcggtgacgctccatgagaattggccagcaaggcccccaggtcctcctcgggcggaaggccacttcccactggggcggtgccgaagcc

SEQ ID NO: 25639 - DNA, 201 bp, Homo sapiens
ggactgtggtggctgctgtgtccaggcgccaccgtgagaaagttgtgggacaggaagccattgtcggcagcccctgtcgctgtcagcgggatgctgggggycggtgacgctccatgagaattggccagcaaggcccccaggtcctcctcgggcggaaggccacttcccactggggcggtgccgaagcccaggaaggcctgg

SEQ ID NO: 25640 - DNA, 201 bp, Homo sapiens
cctcatccaaggcttctgagatacgacacaaatggaaacatttctgcatacgagttcttctctgtaaaaatggcgaccccgcgatgcagcgcctgagtgcygcgcgcctgtgacccgcgggtagatttcttaccacgtcctcctttgtgctgactggctgggctgctcagcgggggctcaggtgggctgaacggaggatgg

SEQ ID NO: 25641 - DNA, 201 bp, Homo sapiens
cctgagtgccgcgcgcctgtgacccgcgggtagatttcttaccacgtcctcctttgtgctgactggctgggctgctcagcgggggctcaggtgggctgaayggaggatggcgcagcgctgttttcactggaaaagaaagcagagcaaggggctgttgtcaccctccttgggcatggagcagcacatgcagctagtgttact

SEQ ID NO: 25642 - DNA, 201 bp, Homo sapiens
agtagaatgtgagaacagggagtcaagtgaaggcccctccaaacagttgtggttgtggctcccccaggctggcccactgagcaaacccctcctctgacagwaggacaaggaggctgaggtctggatccactgcacaaaaccagcccgcctctcctagccatggaaaactggaaaacactttcaccttcaacagtaaaggaa

SEQ ID NO: 25643 - DNA, 201 bp, Homo sapiens
attcttaccatacggtgtctctggagacacaggaaatgctggagttgaacacatggactccttgctacttaaaattctgccatcgataatatcgaggtcckggggatagccaggggtcatcgtctgaaattggcacagggagtagaatgtgagaacagggagtcaagtgaaggcccctccaaacagttgtggttgtggctc

SEQ ID NO: 25644 - DNA, 201 bp, Homo sapiens
cgtcctcctttgtgctgactggctgggctgctcagcgggggctcaggtgggctgaacggaggatggcgcagcgctgttttcactggaaaagaaagcagagyaaggggctgttgtcaccctccttgggcatggagcagcacatgcagctagtgttacttcattcttaccatacggtgtctctggagacacaggaaatgctgg

SEQ ID NO: 25645 - DNA, 201 bp, Homo sapiens
gggtgatgctcagggccttctggatcgcctggtggccggtgagggactccatctccacagagttcaagtaccacacgttgcaggctggaagacaccaaggragacacatgttagttgcaactattgggacaggtgtgtcctgttaacacacaggcagttgctgatgtgcagactgggtttatgaacaacttgcgcatgtgg

SEQ ID NO: 25646 - DNA, 201 bp, Homo sapiens
caaaaggaagttgtgtcagtgagtcctttttctccccagtcaccagatgtagaaatggagctgcatttactgacctgccccctgcttcaacagctcagctrctgaattggctgccgtctggggagaactttctgctatttcctccaatggatctgtaggaaggggcaagaaaatacagaaatgagtcctgctcctgaccaa

SEQ ID NO: 25647 - DNA, 201 bp, Homo sapiens
agctcagctgctgaattggctgccgtctggggagaactttctgctatttcctccaatggatctgtaggaaggggcaagaaaatacagaaatgagtcctgcycctgaccaagaatcctcatgacaaagttagacaatttgatgacagaattcccagatggtgacatgcaatggttttgcagagtcaagagtttctctttggg

SEQ ID NO: 25648 - DNA, 201 bp, Homo sapiens
ccttcggggtacactcgatcaaaaagtgccggacgagttcattggccaaatctccagctgtggcaagaaatttaaagaaagaagaattttttgaaaatggragcatgggagaattcaatagagagaacataaaagccaggagctacagttgaaaaggctcttctctgaatacgagtccagtcactgcaaaagaggctgcca

SEQ ID NO: 25649 - DNA, 201 bp, Homo sapiens
agaattttttgaaaatgggagcatgggagaattcaatagagagaacataaaagccaggagctacagttgaaaaggctcttctctgaatacgagtccagtcrctgcaaaagaggctgccaagaaccatcttcgtcctaggaatggtagccgggctgcaggacagctggatgagcacaggctaggccagatacagggcgggaa

SEQ ID NO: 25650 - DNA, 201 bp, Homo sapiens
cacataccttgttctcttgaaatatccgccttgtaccagaacttggaagtgtcttgaacaaatttcacgatcacaagtttatcacctggactatctgtaamgcaaaatttaaaaacagtgaccatgatgggcacttttcttcttgcaacctctcatctgctgtgatcccagaagtccaaatcccatgccaagggcaagcaa

SEQ ID NO: 25651 - DNA, 201 bp, Homo sapiens
gtagcagtgtcgtgcacacagccctggtcccctgccccgccccatcttcaggccagtccctgcctggtctagcttcagcttctctgaagagcaagcccccrctggtcccacatgcctctcagcattctgggtctttaaggggaacttgtgccaagtttaaagatccatcttcttacctctctctcctctgcccagggccgt

SEQ ID NO: 25652 - DNA, 201 bp, Homo sapiens
gtgggccctgctcaaactcaatccatatgaaggccacggctgcccgatgttcccaccgcagggcccatcttcacacaaggcagcgaagcgggcactagggmagatgcccaaggaggccctcatcctccccacataccttgttctcttgaaatatccgccttgtaccagaacttggaagtgtcttgaacaaatttcacgatc

SEQ ID NO: 25653 - DNA, 201 bp, Homo sapiens
tcttatcatagacacatcattaccaaattatataaagactaaagcatacagtttgttggatcttgaatcaggagggttgacatcaagccaactccaacttyaaccatatatattacccctgcacaatgcttcttaacaaagctctaataacaatgatgcctaaggctgcactgtgctttgtgtggattgctcaagtcatct

SEQ ID NO: 25654 - DNA, 201 bp, Homo sapiens
atttctacagaagaaaatgatgccatgcccaagtttcctctgtagagagctgacctacagccagagacacaggaatgcatgacccacacagacactcaccrcagaggtttatcacggcagagagaactggacagcgtggaactccctggagcctgcaaataacaaaacaagggtcattttgaagtttcctttcctgccagt

SEQ ID NO: 25655 - DNA, 201 bp, Homo sapiens
gcccaagtttcctctgtagagagctgacctacagccagagacacaggaatgcatgacccacacagacactcaccgcagaggtttatcacggcagagagaaytggacagcgtggaactccctggagcctgcaaataacaaaacaagggtcattttgaagtttcctttcctgccagtctacatgacacagacaccactgagag

SEQ ID NO: 25656 - DNA, 201 bp, Homo sapiens
actcaccgcagaggtttatcacggcagagagaactggacagcgtggaactccctggagcctgcaaataacaaaacaagggtcattttgaagtttcctttcytgccagtctacatgacacagacaccactgagagggaacaatgacagccgttccacagtttaatcataaacagcaagtcaatcgtaactacaagcccacct

SEQ ID NO: 25657 - DNA, 201 bp, Homo sapiens
ttgagcttctccctcatgtgtaaaccagtgttctgtgagtgcccatccctacacagtgcctgctgcagagcctgcccaaaggctcccagagccgcccaccrctcaccaggtagttgtccccgtgcttggacttgagcatgcgcgtgacctcctgtaggttgtgcaggtaggactcctcagagcagccggcagggaaggaca

SEQ ID NO: 25658 - DNA, 201 bp, Homo sapiens
ggtgggactcaggatgacgggcctgcgagagagcagtgggcagatcagaaacagggtaaggaggcagcagacattcatcctctaggaaaaaggtgaagacracggacactcatcccctgggtgttcacatcagcacctgggcggccagctacgggaatttacagtgtgtgcagcctctgtgctgtgttcccataacagcgg

SEQ ID NO: 25659 - DNA, 201 bp, Homo sapiens
gatcagaaacagggtaaggaggcagcagacattcatcctctaggaaaaaggtgaagacgacggacactcatcccctgggtgttcacatcagcacctgggcrgccagctacgggaatttacagtgtgtgcagcctctgtgctgtgttcccataacagcgggcagtgtggggaggggcacaagattgaattttcctagcaggg

SEQ ID NO: 25660 - DNA, 201 bp, Homo sapiens
gctgaagcccagccagacccccaaatgtgagagggggcgcactcaccctgcagtgaatgacgaccacatgctggaggttgctgttcagccaggactcctgygccttgcatatggtacacatcttatccaggggcggtgcgtggagctctggccagcccacatccatgatctgcaacaagaaaggggagcttcctcggtttc

SEQ ID NO: 25661 - DNA, 201 bp, Homo sapiens
tcctgcgccttgcatatggtacacatcttatccaggggcggtgcgtggagctctggccagcccacatccatgatctgcaacaagaaaggggagcttcctcrgtttccatttcctaaaaccttctgaggccatctcacaatgacttctttcatcatcagtacatttcatttgggagtaaagaacatgctgggtgaccctttc

SEQ ID NO: 25662 - DNA, 201 bp, Homo sapiens
cagcccacatccatgatctgcaacaagaaaggggagcttcctcggtttccatttcctaaaaccttctgaggccatctcacaatgacttctttcatcatcartacatttcatttgggagtaaagaacatgctgggtgaccctttcctaaaactcagtgagcatgaggatcaacttccttcactgggaagaaaaaataaagca

SEQ ID NO: 25663 - DNA, 201 bp, Homo sapiens
agacagaattttgctgtggagtgactgagcacatctcccaagtctgcacccagccaaggaacatgagctcactcagaaaaagggcaaggaggggctcagcctcttgggagcctgggtgaatagcattcaccagacctgtgggaagcgccaggaagatcttcctaaaacacccggttccttcaggaagcatctcctcggagt

SEQ ID NO: 25664 - DNA, 201 bp, Homo sapiens
cccaaagagacagaattttgctgtggagtgactgagcacatctcccaagtctgcacccagccaaggaacatgagctcactcagaaaaagggcaaggaggggctcagcctcttgggagcctgggtgaatagcattcaccagacctgtgggaagcgccaggaagatcttcctaaaacacccggttccttcaggaagcatctcc

SEQ ID NO: 25665 - DNA, 201 bp, Homo sapiens
ggtcacagacttccaggagccctcagcatggccccacgtctacgccgccatccacccctccacagtcctttctcatcagtgcatagctgctctgtgcagcracacgcacaggagctaaagcctcccaacaaacctcagcccagaagaaaatggagaccactgcagttcaccagctcatgtgcatcgctgccaggtgccaaa

SEQ ID NO: 25666 - DNA, 201 bp, Homo sapiens
catcttccctgcatgaggtagggaagatgaaggtctgagggacagcaagccaaggtcacagacttccaggagccctcagcatggccccacgtctacgccgscatccacccctccacagtcctttctcatcagtgcatagctgctctgtgcagcaacacgcacaggagctaaagcctcccaacaaacctcagcccagaagaa

SEQ ID NO: 25667 - DNA, 201 bp, Homo sapiens
aaggttcgatgtattgctcttataatttttttaaatatcactaaagtatacttacagcatagtactcacaatcctcttatcctccttatttaaaaaaaaaagtttttaaatgttattcaagcaaagaaaaaggcagttcaagtcccacctcaccactgaagcttctcatcccatgtctgcagtgacagccatcactgtcca

SEQ ID NO: 25668 - DNA, 201 bp, Homo sapiens
aagaaaaaggacacagttgttggtgttgtgcctggccttttaaactcttccgtgataatacattgagatgcgtaagagggcatttttttttttttttttttgagacggagtctcgctctgtcgcctggagtgcagtgtggcacaatctcggctcactgcaacgtccacctcccaggttcaagcgattctcctgcctcagcc

SEQ ID NO: 25669 - DNA, 201 bp, Homo sapiens
aacttagggaaagggaggctgaacctagcggggagccaaccagcaccgctctgtttaattcagcaataacttagggaaagggaggctgaacctagcggggwgccaaccagcaccgctctgtttaattcaaacaccgtgaaaggccgtcctgtggaccacagagcaccgctggaacccatgcggtccccagggaacctgtaa

SEQ ID NO: 25670 - DNA, 201 bp, Homo sapiens
ttcatcagcagcatgaaaatggactaatacaatcacctaataaagaacttcatggccaagcgcggtggctcatgcctgtaatcccagcattttgggacgcmgaggcgggttgatcacctgagctcaggagttcaagaccagcctggccaacatggtgaaaccccgtctctactaaaaatataaaaattagctgggcgtggt

SEQ ID NO: 25671 - DNA, 201 bp, Homo sapiens
tgtccccgcccaaatctcatcttgaattcccatgtgttgtgagagggacccagtgggaggtaactgaatcatggcggcaggtctttcctgtgctgttctcrtgataatgaataattatcatgagatctgatggttttataagggggagttcctctgcacaagctctctctctttgcctgctgccatgtgagatgtgccttt

SEQ ID NO: 25672 - DNA, 201 bp, Homo sapiens
taataaaaggattgattcatcaagaacacctaacagtcctaaacatttaatcactgatatggcttgactgtgtccccgcccaaatctcatcttgaattccyatgtgttgtgagagggacccagtgggaggtaactgaatcatggcggcaggtctttcctgtgctgttctcgtgataatgaataattatcatgagatctgat

SEQ ID NO: 25673 - DNA, 201 bp, Homo sapiens
ccatgttggtcaggctggtctcgaactcctgacctcgtgatccatccgccttggcctcccaaagcgctgggattacaggtgtgagccaccgcacctggccctttttttttttttttaaagacaaaggctagaaaaaagaggtaccttgctgatgttaatcaaagggaagttggagtggctatatcagacaaagtaggctac

SEQ ID NO: 25674 - DNA, 201 bp, Homo sapiens
cagagtctcgctctgtcgcccacactggagtacagtggcgcaatcttggctcactgcaacttctgcctcccgagttcaagcaattctctgcctcagcctcycaagtagctgggattacaggcacccgccaccatgcctggctaatttttgtatttttagtagagacagggtttcaccatgttggtcaggctggtctcgaac

SEQ ID NO: 25675 - DNA, 201 bp, Homo sapiens
atgtaaatagtctaagtatctcaattataagtcaacaaaagttgtcagattttatatatatatatatatatatatatatatatttttttttttttttttttgagacagagtctcgctctgtcgcccacactggagtacagtggcgcaatcttggctcactgcaacttctgcctcccgagttcaagcaattctctgcctcag

SEQ ID NO: 25676 - DNA, 201 bp, Homo sapiens
ctttgggaggccgaggcaggcggatcacaagttcaggagatggagaccatcctggctaacatggtgaaaccccatctctattaaaaatacaaaaaaaaaaaattagccgggcatggtggcgggcgcctgtagtcccagctgctggggaggctgaggcaggagaatggcgtgaacctgggaggcagagcttgcagtgagccg

SEQ ID NO: 25677 - DNA, 201 bp, Homo sapiens
acagaatactgaagtattaaaaaggatgtctgagatgactcttcagtaaactcagttctcttttatacaaagaaggaaaaattactcctcaagcagtatamccaacctagtgcagcccaagccactgtggtaagttgtgcaaaaggcctctgtgtctaaggagctcccccactggattacagctcaaggatgtgtggtgca

SEQ ID NO: 25678 - DNA, 201 bp, Homo sapiens
aaaaaaaaaaaggcaatgggagcagccatgcatccctgcggtggaaagtaagctgtaggggaggaggaggtaaagaagaaagggataaaccaggcgtgagragaggggtgaagtcacctaacatcatagctgtccatgagtgattttcttcaagggatgaaaaaaggtacatggctgttttttcccttgttacctccactg

SEQ ID NO: 25679 - DNA, 201 bp, Homo sapiens
ctactaaaaatacaaaaaattagccgggtgtggtggcgggcgcctgtagtcccagctactcgggaggctgaggcgggagaatggcgtgaacctgggaggcrgagcttgctgtgagctgagatcgcgccaatgcactccagcctgggtgacagagcgagactccatctcaaaaaaaaaaagagtttctattgtttattaaca

SEQ ID NO: 25680 - DNA, 201 bp, Homo sapiens
gaaatactggcctgcatcacagaatatgcccctaacccttctccatctatcatcaccatcagtatcatcacgatcagcatcatcatcacaatcgttaccaytgccattgttactatcaccatcaactacactatcactatcaccatcaccagtcacagcactatcattgctgtcatcaacatcatcatcaccatcattgtc

SEQ ID NO: 25681 - DNA, 201 bp, Homo sapiens
ttctaggaccctagcagtgggtgcccgagacccgcagcacgagggcaaccccgttcattctccttgcctgaggctctcagaatggggtaaggacccaactytgaccaacagaaaggtaagtgaattctcccaggggcttctggcgaaggccttcccactcctgtaaacgaagcaagggaaaatgcctcagcttctggaacc

SEQ ID NO: 25682 - DNA, 201 bp, Homo sapiens
atggctcacactagaatcccagcactctgggaggccaaggtgggtggatcacttgaggttaggagtttgagaccagcctggccaatatggtgaaaccccgyctctactaaaaataaaaattaaaaaaaaatagccaggcgtgttggcacacgcctataaccccagctacttgggaggctgaggcagaagaatcccttgaac

SEQ ID NO: 25683 - DNA, 201 bp, Homo sapiens
ggcagagagaggcagagcccgtgctggccgcgtgagctggggcaggaccatcgcaggccttagcaagagatgcaactgctcggtcccagccctgtcacctrtaagagggagcagaacaagcctcctcagacagaagtgtgacgagtaaatgacagagcatatctaaagcactcggcagggtcctgcagatccctcaacagc

SEQ ID NO: 25684 - DNA, 201 bp, Homo sapiens
cggcgatgctgacggcaggagagtgtgtgtctctgtgcgtgaatatgcatgcgtgtgtacatgtaagcacgtgtgtgtgagccctcggttctttcccctcrattttgcggcaaatctgaaactgctctaaaaataacatcttctaattttaaaaaccattttaaaagctgtcaaacattaaaacacacacacacacgcaca

SEQ ID NO: 25685 - DNA, 201 bp, Homo sapiens
caaagaggccaggcaagagaaaataagtattcgcctagtacagagtttcacgtatggaacacacacacacacacacacacacacacacacacacacacacggagcaggaaatgttcaccgcgtgctcttttcttttgtttttgtttacactggagcgacgtgtgcccatggatgcctggccttgctgctctgtcccctgcc

SEQ ID NO: 25686 - DNA, 201 bp, Homo sapiens
ccaaagaggccaggcaagagaaaataagtattcgcctagtacagagtttcacgtatggaacacacacacacacacacacacacacacacacacacacacacggagcaggaaatgttcaccgcgtgctcttttcttttgtttttgtttacactggagcgacgtgtgcccatggatgcctggccttgctgctctgtcccctgc

SEQ ID NO: 25687 - DNA, 201 bp, Homo sapiens
ttctcccaaagaggccaggcaagagaaaataagtattcgcctagtacagagtttcacgtatggaacacacacacacacacacacacacacacacacacacacacacggagcaggaaatgttcaccgcgtgctcttttcttttgtttttgtttacactggagcgacgtgtgcccatggatgcctggccttgctgctctgtcc

SEQ ID NO: 25688 - DNA, 201 bp, Homo sapiens
gttctcccaaagaggccaggcaagagaaaataagtattcgcctagtacagagtttcacgtatggaacacacacacacacacacacacacacacacacacacacacacggagcaggaaatgttcaccgcgtgctcttttcttttgtttttgtttacactggagcgacgtgtgcccatggatgcctggccttgctgctctgtc

SEQ ID NO: 25689 - DNA, 201 bp, Homo sapiens
gcctgtcctgtggtctagggggctgagactcatggacacacacgctgacaacatgagagggcagcgtctggggcaggggctgcacgagacagagtggggtrtctggaagtatggtgggcacagggccacgacccccgccctgaggacgaggcctgcagaggtctctcctagcctgacagggatggttatgtcccaacaggg

SEQ ID NO: 25690 - DNA, 201 bp, Homo sapiens
tgtggtgttcttgaatgtaagcttcggttttaaacaaatatgtattttaaaccatatatatactgtttcaagccccagagtgactggacagaaccgaaaaagctctgtctttgcatccagagactgaaattagggcaagccctctgcttctcccagctggctctgatgaatttacggagactgtcctctgtgaactcaatt

SEQ ID NO: 25691 - DNA, 201 bp, Homo sapiens
ttggggaaacaaaatgcaaccccccagcactaacaatcaaaggtctgacaggacgggtggagacgtcaggtcgacacagaacgttctgggcacaccaacargagctgggtcccccaggtgaggccgggggctcctgacatgccgaaggtggccttactcatcattcaaggctgcttttccaatggtgcctggggacagggg

SEQ ID NO: 25692 - DNA, 201 bp, Homo sapiens
tctttctaaggacaccagtcatactggattaggcccatcctaatgaccctatttcaacctaattacctctttaaagaccttatctccaaatcctgccataytctggggtcctggggatttggacttcaacatttaaatttggggaaacaaaatgcaaccccccagcactaacaatcaaaggtctgacaggacgggtggaga

SEQ ID NO: 25693 - DNA, 201 bp, Homo sapiens
agtagcagcctggttgcaaggagggtggagcttttacgaagggccacttctattataccacagctttgacttcttacattgtatgttactgatcaataaamtagcaagatctttaattcacccattagttaagattgaaaaaggatgcattgttcatgtgtttatattaccattattatcatttattacaagggcagggta

SEQ ID NO: 25694 - DNA, 201 bp, Homo sapiens
agagcgtgtctgtgtgtgtctccgtgtgtgagtgtatacctgtatgtgtctctgtgtgtttgtgtgtgtgcacacacaacaaagcttagccctgcagttcyatcccccaaggtgaatgaaagcacttcagctaacaagtacattctgccttagaaagtgctttcatccaaggtgcactggcccggccaccattacccccag

SEQ ID NO: 25695 - DNA, 201 bp, Homo sapiens
gtgtgagtgtgggtgtgtgggtgagtgtgtgtgtgtgagtgactacatgtggtggtgtctgtgtttgactaggtatattttactgtggatatctgcaaatrtattcttttgtgtgaatgtgtgtaagtttgagagtgttgtgagtttgcatatgagtgggtgagtcagtagttatgtgcatgggagtgtaaaagtgtaggg

SEQ ID NO: 25696 - DNA, 201 bp, Homo sapiens
gagacggtgaaatcaaaggaaaagtgtggatcaaagttcagcctgtggggagaaggggtgagggtgggggtgccacaaccacaggcatcagtcccagaagwctgtgcccacagggtcatgatggcctcactaggcaattgtgcagatgctaaggggagcagctggaaacagaggccggggccaaggggcagggaccatcct

SEQ ID NO: 25697 - DNA, 201 bp, Homo sapiens
agagaaaaacttcccactaaagtagaaaatactcatccaattaaacatgtttctccttattctttctctacgattgagtctccaaatatgacaaggtttcyggcagggacttttttctttttaattttttaacaaaaattgtttcctgatactctcgggaaagtgcacattttaaagaaacctgttataaatgcaccagga

SEQ ID NO: 25698 - DNA, 201 bp, Homo sapiens
tgaggagaggcattcctcagataaaaaattagatgcactgcctggagggtcattctggttccacatatgtttgtttgtttgtttgtttgtttgtttgtttktttttgagatggagtcttgctctgttgcccaggacagagcacttcctagtgtgtcacaggagtgggtgagagcagactaagcggcaggaaggcaaaaaca

SEQ ID NO: 25699 - DNA, 201 bp, Homo sapiens
actgcaagctccacctcccaggttcatgccattctcctgcctcagcctcccaagtagctgggactacaggtgcctgctaccatgcccagctaatttttttrtatttttaatagaggcaaggttccactctctaggtgttttgaaaagagagctgcctgctcacgtcctcagaagccttcccgagctgtggtttccttgtgg

SEQ ID NO: 25700 - DNA, 201 bp, Homo sapiens
tgaaggatgactgagaaactaacttgctataggttatattaaacctggctcctgagaaacccgaaatcctaacctcatataaggtttaaaaaactctctctacttgtaggcaccagtcctgcaaatctgtgttgcaaactcactctctaggtgtttttttcttttgttttgttttgttttgagatagagtcttgctgttgc

SEQ ID NO: 25701 - DNA, 201 bp, Homo sapiens
ctgaaggatgactgagaaactaacttgctataggttatattaaacctggctcctgagaaacccgaaatcctaacctcatataaggtttaaaaaactctctctacttgtaggcaccagtcctgcaaatctgtgttgcaaactcactctctaggtgtttttttcttttgttttgttttgttttgagatagagtcttgctgttg

SEQ ID NO: 25702 - DNA, 201 bp, Homo sapiens
ccatggcctaagttcactgaaaaatcacagccatttgtggaaccttgctaaatactcaagtagttcaaaatgaaaataataataataataataataataatgttccagcagcaaggagccttaaaaattaactaaacgtccctctcacttcagagtcagagatgtgaggaaagtggagggtgggggcttgtcctggtcacc

SEQ ID NO: 25703 - DNA, 201 bp, Homo sapiens
gccatggcctaagttcactgaaaaatcacagccatttgtggaaccttgctaaatactcaagtagttcaaaatgaaaataataataataataataataataatgttccagcagcaaggagccttaaaaattaactaaacgtccctctcacttcagagtcagagatgtgaggaaagtggagggtgggggcttgtcctggtcac

SEQ ID NO: 25704 - DNA, 201 bp, Homo sapiens
agccatggcctaagttcactgaaaaatcacagccatttgtggaaccttgctaaatactcaagtagttcaaaatgaaaataataataataataataataataatgttccagcagcaaggagccttaaaaattaactaaacgtccctctcacttcagagtcagagatgtgaggaaagtggagggtgggggcttgtcctggtca

SEQ ID NO: 25705 - DNA, 201 bp, Homo sapiens
ttactatttttttttaattctcatggctacaaaatatcccaacatataggatacacacacacacacacacacacacacacacgtataaaatatataatatatatatacacatatatataaaataaatatcacggtcttgctcctgacaacacaaactgacccaatagagaggtggtacatggtggggaaggctgtccctcc

SEQ ID NO: 25706 - DNA, 201 bp, Homo sapiens
ggtcaatttggggtcaacagtttcaaatgtccagctacacattcagggaccacaatcctataaattctaaagccaaacttggggaggtgtgataactctttgtttccttctttaagagcaagtaggaaaacctaaagacaaacccataaggagcacatcgcaccagctcaaagcggaaatgtgctcagatgcagcattggt

SEQ ID NO: 25707 - DNA, 201 bp, Homo sapiens
tggtcaatttggggtcaacagtttcaaatgtccagctacacattcagggaccacaatcctataaattctaaagccaaacttggggaggtgtgataactctttgtttccttctttaagagcaagtaggaaaacctaaagacaaacccataaggagcacatcgcaccagctcaaagcggaaatgtgctcagatgcagcattgg

SEQ ID NO: 25708 - DNA, 201 bp, Homo sapiens
tctcaaaaaacaaaacaaaacacaaaacctaatgttgtacctgaaggaacaaagaacaaactaaaccccaaattagcaaaggaaggaaaaaacaaaggtcrgagcagaaacaaataaaggagagactagaaaaacaatagaaaagatcaacaaaactaagggttgggttttctgaagactaacaaaattgacaaatcttta

SEQ ID NO: 25709 - DNA, 201 bp, Homo sapiens
gagtgcagtgtcttaacaattccaactcatttgggccaaatgcttccttaaaaccctgataggctgggtgcggtggctcacgcctgtactcccagcacttygggaggccaaggcgggcggatcacctgaggtcaggagttcaagaccagcctggtcaacagggtgaaatcccagctctactgaaaataaaaattaccgcgg

SEQ ID NO: 25710 - DNA, 201 bp, Homo sapiens
tccctatttacacctcattttccatgcaggaggtcatatgaatgtcacgattttggaaactgttcaacaaagaaataacatttaatggttccaaaaaaaaacaaaaaaaaaacccaagtgactgtttaactaaaatattttagaaaatgctaggttttctgcacacaacttgcattgcatgtgggccctgttgctgaccac

SEQ ID NO: 25711 - DNA, 201 bp, Homo sapiens
gttgaggctgctgtgagccaagattgcaccactgcactacagcctgggtgacagagcaacactctgtttcaaaaaaagaaaaaagaaaagaaaaaaaagaaaatgaagagatatcttccccctttttccatattcttttaatgttataaacaagctgctggtgccgtaagaaataagaacaaaaaaaagaaaagacgacag

SEQ ID NO: 25712 - DNA, 201 bp, Homo sapiens
ggttgaggctgctgtgagccaagattgcaccactgcactacagcctgggtgacagagcaacactctgtttcaaaaaaagaaaaaagaaaagaaaaaaaagaaaatgaagagatatcttccccctttttccatattcttttaatgttataaacaagctgctggtgccgtaagaaataagaacaaaaaaaagaaaagacgaca

SEQ ID NO: 25713 - DNA, 201 bp, Homo sapiens
aggttgaggctgctgtgagccaagattgcaccactgcactacagcctgggtgacagagcaacactctgtttcaaaaaaagaaaaaagaaaagaaaaaaaaraaaatgaagagatatcttccccctttttccatattcttttaatgttataaacaagctgctggtgccgtaagaaataagaacaaaaaaaagaaaagacgac

SEQ ID NO: 25714 - DNA, 201 bp, Homo sapiens
agggcaagaggaggagggagaagtttgtaaaggcagggtgggagagaagagaggggagaagagaaggaaggaggaggaggtagctgggaagagaggagaggagccaggcacttcccaggagactgcccccgcccgcctggtctcaggaagaccctgcagctaccagcccataaacagcccaggggagagggccccgcctgg

SEQ ID NO: 25715 - DNA, 201 bp, Homo sapiens
ctaaaagggagaggaaaaggcaatcacaaaataatgctgtgatgcgtccaacagagatctgtagaaacctctcctggggcagagtctcaggagaacactttcattttccctggccttatgtaagtgccctcggtaagaaacaaccagcaacagcactatttgtttgtgaaaacttcttgagcaggcaacacctttgtttac

SEQ ID NO: 25716 - DNA, 201 bp, Homo sapiens
caaactctccatcaacaagagaaaaagcaccatgtaccaagagagtcaaggcttaaggtatcagccccaggaatgccagtccccaattcagaagtcagccytcaggttcctatcatcccccaatgccagccgttgctgggcagctcctattcagctctgcttcccctaaatttactaagcaaaagagcagaaccctcaaag

SEQ ID NO: 25717 - DNA, 201 bp, Homo sapiens
accatcgccaaaatttattttctaatagtggtataaaaatatgcctgtgcccggccgggcgcggtggctcacgcctgtaatcccagcactttgggaggccraggcaggcggatcacaaggtcaggagatcgacaccatcctggctaacatggtgaaaccccgtctttactaaaaaaatacaaaaagccggtcatgggggca

SEQ ID NO: 25718 - DNA, 201 bp, Homo sapiens; identical to SEQ ID NO: 25331

SEQ ID NO: 25719 - DNA, 201 bp, Homo sapiens; identical to SEQ ID NO: 25332

SEQ ID NO: 25720 - DNA, 201 bp, Homo sapiens
ggcacataggaaagagcctcatctaaacactttctgccattgctatgctttctaagactcaatgcaaaagctgcaggataagagcaataaaaagagaatcmtgactagaaaagacacctaacagaggtgtggaagcagggtcactgcatggctgactgccagtctcgccaatgagaaaccaaacaggagcccgcaccctgc

SEQ ID NO: 25721 - DNA, 201 bp, Homo sapiens
tttttttttttttgggccagagtgcttgctctgtcacccaggctggagtgcagtggtgcgatctctggctcactgcaatctctgcctcctgggttcaagcrattctcctgcctcagcctcccgagtagctggaattacaggcatgcaccaccatgcctgaccaatttttgtaactttgtagagacagggttttgccatgtt

SEQ ID NO: 25722 - DNA, 201 bp, Homo sapiens
ttttttttttttttgggccagagtgcttgctctgtcacccaggctggagtgcagtggtgcgatctctggctcactgcaatctctgcctcctgggttcaagygattctcctgcctcagcctcccgagtagctggaattacaggcatgcaccaccatgcctgaccaatttttgtaactttgtagagacagggttttgccatgt

SEQ ID NO: 25723 - DNA, 201 bp, Homo sapiens
tgatgaaacccagtctctacagaaaaatacaaaaaaaaaaaaaaaatgatccaggcatggtggcacatgcctgtcgtcctaactactctggaggctgaggygagaggatcaattgagcccaggaggtcaaggatgcagtgagctgtgatcacaccaactacactgcagcctgggtgacagagtgagatcctatctcaaatg

SEQ ID NO: 25724 - DNA, 201 bp, Homo sapiens
gaggaatgtttctattgatgacatagtctgaatatgcaaacccaacaacactgtcccctacagtttagatttaaactataaatacatagtccctgtaagtrtagagtgcagagtagcatttcactgaaagatggagtttgattcataaacatgagtggcccacataaggctcctcttagaatgactttgttccaaattggt

SEQ ID NO: 25725 - DNA, 201 bp, Homo sapiens
ttacagggtattcaagtagtctatttcctattgggtgagttgtgacagttcatgctcattaaggaactggtctatttaacctaagttttaaaaactatgcrtgtagagtagtttgtgtattccttcattattcttttggtgtctgcagggtctttagtgatggtgcctgtttccttcctaacaatagtaatctatgtcctc

SEQ ID NO: 25726 - DNA, 201 bp, Homo sapiens
atttggttctttttttacgtctgcggagtacttcgatggtgtatatgtcccacattttctttatccaattcactgttgatgggcacctaggttgagtccakgtctttgctattgtgaattgtgctgtgataaacatacaagtgcatgcgtctttttggtagaatgattttttttcttttgggtgtatatccggtaatggga

SEQ ID NO: 25727 - DNA, 201 bp, Homo sapiens
agatgcttttatgttatgtgtttatatttttaaaaaattatgaaatagtttggaagctgagatgtatcagaaccacgactcttttttttttttttttttttgacagagtctcactctgttgtcaggctgcagtacagtggtgcgatctcggctcatgcaacctccgcctcctgggttcaaacagtatttaaatcctgcctc

SEQ ID NO: 25728 - DNA, 201 bp, Homo sapiens
ctcatggggccctgagccagcccgaggagggagatgatgcggcttcacccgccttccttcttggtcccgattctcctctctttgtgtttttgtttcactahggtttccgattcataccatgcctaatgggtaggctactcactttgctgatgcaagggtctcattctcaacccactggttttcggtggtaccattctcctt

SEQ ID NO: 25729 - DNA, 201 bp, Homo sapiens
aaacctgcatctcatggggccctgagccagcccgaggagggagatgatgcggcttcacccgccttccttcttggtcccgattctcctctctttgtgtttttgtttcactaaggtttccgattcataccatgcctaatgggtaggctactcactttgctgatgcaagggtctcattctcaacccactggttttcggtggtac

SEQ ID NO: 25730 - DNA, 201 bp, Homo sapiens
actttaaagaaagatgacactgaagtggagctactgaggctgcctagagaccacatcaagcctgcagacagagccaacacacagctgagaagatcagggtmtagggagtcactggaaataaatgtgtgagagagacagagagagagacccacccgctgagtggccaaggagtcctcatgaagccaaatctgaggccacagc

SEQ ID NO: 25731 - DNA, 201 bp, Homo sapiens
gtcatattcacaataaactttcagaagtaagtgagactatccacctaactaactatttctctctctctctctctctctctctctctctctctctctctctccattctttcctccctcctagtcacatcccgggattattatgcagttaaataggaagtatctttttccattatttgagagagttctaaaaaaatggaacat

SEQ ID NO: 25732 - DNA, 201 bp, Homo sapiens
agtcatattcacaataaactttcagaagtaagtgagactatccacctaactaactatttctctctctctctctctctctctctctctctctctctctctctccattctttcctccctcctagtcacatcccgggattattatgcagttaaataggaagtatctttttccattatttgagagagttctaaaaaaatggaaca

SEQ ID NO: 25733 - DNA, 201 bp, Homo sapiens
ggaggcagaggttgcaatgagctgagatcatgccactgcactccagcctgggcgagagagcaaaactctgtctcaaaaaataaaaataaaaataaaaaaawaaaatgtcagggggaggggggagggatagcattaagagatatacctaatgctaaatgacaagttaatgggtgcagcacaccaacatggcacatgtacaca

SEQ ID NO: 25734 - DNA, 201 bp, Homo sapiens
aggctaggccagatacagggcgggaacccttgcaatgacagtgtgggggctggagaggtcccttgggagaggccctcaaacattgtgcaagaatccccaamgaagggaatgagcttgcagctaagaaagaggatctttcttagctaagaatctccagctgaatcctctcccaaagaggagaggtgagaaaggctcagacac

SEQ ID NO: 25735 - DNA, 201 bp, Homo sapiens
ggaggctatgcgtgtatatggtgtatctctgtaccttcttctccattttgctgtgaatctgtcactgctctaaaaaagaaactctatgaataattttttttaagtgacctgctctgtctggcgagctggttcttgggtgttgtatgtctcactggggttgctggcagtgtgggtcaaatcattgactcatgtcaagtgact

SEQ ID NO: 25736 - DNA, 201 bp, Homo sapiens
tctagtccaattttctaccagactcagaaattccctccccatcatttctgacaataaacacctaccttgcatgaaaaacttaaaacagttttgaaagtcarggtttgaaagtcagcagtccccactgtcctctctagctgtgtccctccctcatggccacagaaccacaagagccctatggtgtgtggtttgtttacaacc

SEQ ID NO: 25737 - DNA, 201 bp, Homo sapiens
cattgtggagttacacctgtaaactactctgcagatatgaggtacagaatggaggtatttctagtccaattttctaccagactcagaaattccctccccawcatttctgacaataaacacctaccttgcatgaaaaacttaaaacagttttgaaagtcaaggtttgaaagtcagcagtccccactgtcctctctagctgtg

SEQ ID NO: 25738 - DNA, 201 bp, Homo sapiens
tgcataggggcaaccgatctatgagtagttcatttttccttttcttttattttccatttttaaaacttaaagaacatataagactctataaaaaaaaaaaagtatacctaccatatgctaaaaaatgcaactgcaacatttctgggaaatctattagaaggctactgaaaagaagtaagtctttcttttcaggattatatt

SEQ ID NO: 25739 - DNA, 201 bp, Homo sapiens
agggcagcagggggttccgctgacttccccaggacctcctgtagtctcagcttaaaaagagcagcaagcctatcacaaagttctctctccctcaagcagcsagctggagagcggggaaaggctcctggcttggcaagtgcccagacgtagcaccgggacagtggaagaagatgctgaggccacctgcaggagccaagaggc

SEQ ID NO: 25740 - DNA, 201 bp, Homo sapiens
caaagagggctgataaatgcaggcgaacttcaggtcgtgcagcttcaggcctgaagatgatcgaaaagcccatgtgggggatgctgagcttaaatccaggmgttttccatccctcctggactctctccatcagaaaagaagtcatccacaatcggggaaaaacattccaatgagtaaaacatcagggtaggttgcttgagg

SEQ ID NO: 25741 - DNA, 201 bp, Homo sapiens
cggcctcgggtgcagctggacagaagcgcccatgcggacgggcgaagcatggcagtcactcggcacctctgcctcaagggctggggattcctcatcccccrgaatgctagtgtgccagggacatggggaccacctcgtgttctgtgctgtttccttgcatgtccctttcccatggggaccctagggggtggggtgcaccca

SEQ ID NO: 25742 - DNA, 201 bp, Homo sapiens
attacatagaaataatatttttgttccttcttctcatttctcctctcggtcctcacaggctctccccagcccagctcgcccagctcgcccagctcgcccarctcaccacaggtgagcaggaggcacagagcactcaccatggtggggtggcatggggtctctaacgtggccaattcttcccaccacccccatcctcacagc

SEQ ID NO: 25743 - DNA, 201 bp, Homo sapiens
aaaatggaaaagtaccccaacggctctggatttcctctccaggtgcccagcccagcactagagatatgccagctcagctgcaggtctgaacccttcccttycccagtgaatggacagaggggcccttccaaccagctggaaacacacctacctggcagaggtgaggccgcttctgaagccttggaaaagtcgggaaggaca

SEQ ID NO: 25744 - DNA, 201 bp, Homo sapiens; identical to SEQ ID NO: 25333

SEQ ID NO: 25745 - DNA, 201 bp, Homo sapiens
ctccccagcccagctcgcccagctcgcccagctcgcccagctcaccacaggtgagcaggaggcacagagcactcaccatggtggggtggcatggggtctcyaacgtggccaattcttcccaccacccccatcctcacagcccatcgcaaaggcccctcgttgtaggccctgctgtgttccagaagggcctgacttgcacaa

SEQ ID NO: 25746 - DNA, 201 bp, Homo sapiens
atggaaaagtaccccaacggctctggatttcctctccaggtgcccagcccagcactagagatatgccagctcagctgcaggtctgaacccttcccttcccsagtgaatggacagaggggcccttccaaccagctggaaacacacctacctggcagaggtgaggccgcttctgaagccttggaaaagtcgggaaggacattt

SEQ ID NO: 25747 - DNA, 201 bp, Homo sapiens
ttttttattttattttactgatttctaagaaaaatagccttgcaaacaaatgctaagagttcctatgtggttcccaggacgtatttaatgacagaaaaatrcctagacagaccctgggtgactcatgacctcaaagacggctaatgatttacctggatgactactcacactagggaagaacaagaggaacgtgacagcccc

SEQ ID NO: 25748 - DNA, 201 bp, Homo sapiens
tccaaccttggctcccactgacttagtgcctgactcctgcaggcagctccagggcacccgcgggccctgccagcctttcctggaagagccctggggtgacrgaagcctcacaatcccgcccagttcgaatgacagttcatcaccagaagctcctcttttaaacacgttccactaacatcttctgctgtttatctgcccatt

SEQ ID NO: 25749 - DNA, 201 bp, Homo sapiens
gacaggaagccattgtcggcagcccctgtcgctgtcagcgggatgctgggggtcggtgacgctccatgagaattggccagcaaggcccccaggtcctcctygggcggaaggccacttcccactggggcggtgccgaagcccaggaaggcctggctgctgggaggcgccagggagtccggtggctctgctagggacagctca

SEQ ID NO: 25750 - DNA, 201 bp, Homo sapiens
taaaagtagagatgacaaggcctaacaaaatatttttctaatcaccgaattagtcatatgaacaatgacactttgaaaagtaaatcacatttacctatatrttaagttagaccatttttatgtgaagttgtgactgcttaggaaagtgggacatacggtcacatcgccctgacatgctgtgggtgttatttaatttcatta

SEQ ID NO: 25751 - DNA, 201 bp, Homo sapiens
agaaacaccagttgactccagatagagcaacccaccaccccgtctctgggcctgcaggcctgcccggccagggacctcaagtaatccagaggagaaacatyaggatgagtctgcctcctccttgagcccccaaatcccaccaattctgcaaatgcccacgttggaaaagatgccagtaattctggttcaacatgttccaag

SEQ ID NO: 25752 - DNA, 201 bp, Homo sapiens
gccccccatctgacctcccagactggttaatcatcctccatggctgagccactcaaggatggttggggccctgaccctctagtgtggtcataagtcttgtrcctccaataggaagtcctaaccttgtctgggattttccacacacagcaccaagcaggagcaataaacactggtgcaggaatgaaaacattctcctttgct

SEQ ID NO: 25753 - DNA, 201 bp, Homo sapiens
actcagaaattacacagaatgcccaatcagcccagaatctaattcctgagaatctaaatgaatctaaaaaggtaaagaaagctcccaggccatggagggtmctcatagcatcatcatggtcagtgactgacttgaagtgactaaggtccaactccagaggcccgagcttggagacgaccatgcaggcttagaggaaggggc

SEQ ID NO: 25754 - DNA, 201 bp, Homo sapiens
tgggccggctcgatgacgatgcagatcctgctggggttttctgggccaacgttgctttgggatgaagaagaaggtagatcattatgcaacttcatgatttygtgggaagaatacatgtagagaaaagcaaccctacaacccaaaactcagaaattacacagaatgcccaatcagcccagaatctaattcctgagaatctaa

SEQ ID NO: 25755 - DNA, 201 bp, Homo sapiens
tcagcccagaatctaattcctgagaatctaaatgaatctaaaaaggtaaagaaagctcccaggccatggagggtcctcatagcatcatcatggtcagtgaytgacttgaagtgactaaggtccaactccagaggcccgagcttggagacgaccatgcaggcttagaggaaggggcccagggtgtgcacagccacagtttca

SEQ ID NO: 25756 - DNA, 201 bp, Homo sapiens
ttgtctgggattttccacacacagcaccaagcaggagcaataaacactggtgcaggaatgaaaacattctcctttgctgtatttccaccacatcaacaccrgtgttcactgcctgtctcagaccacacccttctgagtcctcccagaagtaagctgtagctgagggtctggggatgcgaagggactcagaagccagggcac

SEQ ID NO: 25757 - DNA, 201 bp, Homo sapiens
ctaaaaaggtaaagaaagctcccaggccatggagggtcctcatagcatcatcatggtcagtgactgacttgaagtgactaaggtccaactccagaggcccragcttggagacgaccatgcaggcttagaggaaggggcccagggtgtgcacagccacagtttcagttacaaactgagggtgcaattccagagtgacatcag

SEQ ID NO: 25758 - DNA, 201 bp, Homo sapiens
agcaaccctacaacccaaaactcagaaattacacagaatgcccaatcagcccagaatctaattcctgagaatctaaatgaatctaaaaaggtaaagaaagytcccaggccatggagggtcctcatagcatcatcatggtcagtgactgacttgaagtgactaaggtccaactccagaggcccgagcttggagacgaccatg

SEQ ID NO: 25759 - DNA, 201 bp, Homo sapiens
ctacagggtactttttttgggggtgagggttactgttttaacacagaatcatgatttcaagtcatcaccactgggagagtggggacaccgacccatctgcrgccacagcgggcactcaccatgacatctcccttcagaagctgggccggctcgatgacgatgcagatcctgctggggttttctgggccaacgttgctttgg

SEQ ID NO: 25760 - DNA, 201 bp, Homo sapiens
aattaagatatcactctgtccaaaacctggtgttttcatgtcttccataaatctgcccaaccaaagccctaaacctaacttctcacccggtggcattctcyccagactcccttgtccacctctctgctgctgtcaggggcaaccagtccttggccgactctgcctgtggtcccgctggctgctcctgcaaccctcgaactg

SEQ ID NO: 25761 - DNA, 201 bp, Homo sapiens
aggcggaggcaaccagttggagttcagtgtgtgaatcccatgttcagattctccttgaacccacatgccctcttttgtagaataaccctgttgacaattgrgcagtaagaggttctagtaaactgcagaagatcctggagacactttaaaatcaaaacgtgatttttaaaaaattacctttagtaaaacaagtcagctact

SEQ ID NO: 25762 - DNA, 201 bp, Homo sapiens
tattatatctttcatggttatttgtgatctgtgctctttgatgttactattgtaattgttttggggtgccatgaaccaaatccatataagactgcgaactyaatggataaacgttctgtgtgttctgatgctctggactgctctttccctctcctcggacctccatattccctgagacacaacaacactgaaatcaggcca

SEQ ID NO: 25763 - DNA, 201 bp, Homo sapiens
cattattattatatctttcatggttatttgtgatctgtgctctttgatgttactattgtaattgttttggggtgccatgaaccaaatccatataagactgmgaactcaatggataaacgttctgtgtgttctgatgctctggactgctctttccctctcctcggacctccatattccctgagacacaacaacactgaaatc

SEQ ID NO: 25764 - DNA, 201 bp, Homo sapiens
cgtgtggcacaggtaggattggatgtcgccgcaaggtccctccgccgatgtcatagggcggccatctccatgctcttatctatttgctgttctcactctcytcacagatcctcacctccccacgccagatctgcccaagaacactgcaacacacttcaagacaacagcccctaaaactcttgaagttttcatccccagata

SEQ ID NO: 25765 - DNA, 201 bp, Homo sapiens
attcagactcgagtgcttgtcattttctcaaaaatgaagtgagtctgtcatcataaaccaatgtcaaaatttgagatttcaagtgaaaattagaattttawaagactagtacccaggccaggtgcggtggctcacgcctgtaatctcaacactttgggaggctgaggcgggcagatcacttgaggtcaggagtttgagact

SEQ ID NO: 25766 - DNA, 201 bp, Homo sapiens
tcagcctctcgagtagctgggactacaggcgcccgccaccacgcctggctaattttttgtatttttagtagagatggggtttcactgtgtgagccaggatrgtctcgatctcctgacctcatgatccacccgcctcggcctcccaaagtactgggattacaggcgtgagccaccatacctggcctgagtgtctgatttttg

SEQ ID NO: 25767 - DNA, 201 bp, Homo sapiens
ttactattggggcaatcaacggaggccaggagggcatccattcaggatgtgaggagaaggaagacaaggccaacagacccaggtcccctgaagctgaggargtaaatgatgctgagacagcaacagggaacgctcaaggaccagcacgtataggtgcaggcccggcaagcacacacacaacacagcccacgagacattcgc

SEQ ID NO: 25768 - DNA, 201 bp, Homo sapiens
gtgcctggaacaccacacatgctcaacacgtgccagcttttactagtatattacattattactattggggcaatcaacggaggccaggagggcatccattsaggatgtgaggagaaggaagacaaggccaacagacccaggtcccctgaagctgaggaggtaaatgatgctgagacagcaacagggaacgctcaaggacca

SEQ ID NO: 25769 - DNA, 201 bp, Homo sapiens
attagagtccaaagatctgcagctttggggaaggaatgtagggcaggggcatgaatcattgcatgcatgttggttaagtgggcagggtcaccaaagagcawtggagatactgatcacaaacagcagaggaaagtgaaaagagattaagaagcacagctcctctggactctaagaagacatagtaggccaggcgtggtggct

SEQ ID NO: 25770 - DNA, 201 bp, Homo sapiens
gtgccaaagaccaggctggactcttgctaaacttcctgctacatacataggtagttttctacatcagaaaatgcccaataaatgttaaacgtacaggaaargaatatgaaacatatcaagtgaattccaagataggactggtcaagcttctgaatcactctgtaggagcacagatcttcctaaaggtgcagagctctgggt

SEQ ID NO: 25771 - DNA, 201 bp, Homo sapiens
tgggctccaggtggcagcaagtccactgaggaaaaaacatttaaaaattcttcccggacagtctgctccccccacccaaacacccagagatccccggggasgacaggacctggactgtccacatgttgactctgctacagccaggaccacccactgcaccttagcaaaatcaagcaggggtgcaaatcagacacctggaag

SEQ ID NO: 25772 - DNA, 201 bp, Homo sapiens
ctcttgtgtgacgaggaggtggggcacccagtgagactcagcccagtctcactgagtctcaaagtctcaaagaggaaagtcaagggtatgagccctgtccygcacggtctcgagcacaagacacactctgagccacagctgccatcgccgacagtgtacgccagaaggctaccagggtccctggccagttactagcttttg

SEQ ID NO: 25773 - DNA, 201 bp, Homo sapiens
agaggcgagccaggccacagcagcaggcacatagtcctgagcaggccacgggatcgtcttccttcaccttcgagatgcagctggaagaactgggggctccrgagcaggcagaatggagacaagcagactctgggtctgagaggcgtgatcggaagccccttgccctgccatgtccaagctgagatggtgggcaagctacct

SEQ ID NO: 25774 - DNA, 201 bp, Homo sapiens
caggaccatcgcaggccttagcaagagatgcaactgctcggtcccagccctgtcacctgtaagagggagcagaacaagcctcctcagacagaagtgtgacragtaaatgacagagcatatctaaagcactcggcagggtcctgcagatccctcaacagcgctgactgagtggcattccttctgcacaggctggacatggag

SEQ ID NO: 25775 - DNA, 201 bp, Homo sapiens
catttacctgttgatggacacttgggttgttgccactatggggctgctacatataaagctgcaatgagtatttttagacacttttgggtgaatacctaggratggaatggctggaccatatggtaagtgtctatgtaactttttaagaaaatgcaaagctgcttcccagaatacttgcagcatttcacatccccaccatca

SEQ ID NO: 25776 - DNA, 201 bp, Homo sapiens
ctctcaagttcatacacagggacacagggagggaacaagaggcttcccctgaacaggggtggtttacaacaggctgatcttaagaaaggaatggggcacayagagtcagagaactgggctcattcagatccctaactgttcccagactttaagaatttacttggtattttactcatctgtaaaatgggtccttgtgtagag

SEQ ID NO: 25777 - DNA, 201 bp, Homo sapiens
gaggcgtctagaccagaaggcgcaggtgagccatgggaacaggaagtcccagcccacatctcagcacatcttcagcctgtcctactccctcccacagagtwaatcccggacactcctgctggtctgcacttgctccaaagcaacagagaaccagcctgcactacatccacaccctcccagggctgaggccatgggcaatga

SEQ ID NO: 25778 - DNA, 201 bp, Homo sapiens
tctcctggggggagggtatgaataatcctattttattagtagtagaaatcttaaaataataatagatgcattaaaaacaacaacttttccattaccattgrctaaacactccatctacgtcaggcccattctgagcactcagagcagggtctcatcgaatcctgacagcccaggtggcgttcaaccaccttcctattaata

SEQ ID NO: 25779 - DNA, 201 bp, Homo sapiens
cccgccaccacgcctggctaattttttgtatttttagtagagatggggtttcactgtgtgagccaggatggtctcgatctcctgacctcatgatccacccrcctcggcctcccaaagtactgggattacaggcgtgagccaccatacctggcctgagtgtctgatttttgtataaatctaaaactctcttaaaaatacagt

SEQ ID NO: 25780 - DNA, 201 bp, Homo sapiens
tctgcctttgcccttgggtgacctgagataaacctgctaagaagcaggactatgcagacagaaaggccaggctgtgaagacctgctgagcacagctcccaygcagctagcccactagacctcaagaaagaatttgttttcctttaaaccactaagttatttagtctgcttcacagtagatagctggttcagccacttagtc

SEQ ID NO: 25781 - DNA, 201 bp, Homo sapiens
agaaacctcaaatcctgacaacccagaccgttgagaaacatctgggaggggtccaggccttcttcccagccacagagttagaaaacaggaaggatttcagwcaaaatccacgagtaaagtccgtgtggaggcggctgagaaaggctttgtattgcaacagaggagcagaatttagaggcagggaagtgctgcttcccatcg

SEQ ID NO: 25782 - DNA, 201 bp, Homo sapiens
gctgcccaaaggtactcagggtgctcttacagagtcagggtttgagaaaaggcacacatgtttgttttgtcagatttgcaaactgcctatggaatcaacamagtaaatacgattttctccccctctactctcccttttactctgaagagcttgctccccaagcaaaagggattgctaagtaacagtctgattatgtgcaag

SEQ ID NO: 25783 - DNA, 201 bp, Homo sapiens
cacgtttccactgcagttacaatagcgtgctgcccaaaggtactcagggtgctcttacagagtcagggtttgagaaaaggcacacatgtttgttttgtcaratttgcaaactgcctatggaatcaacacagtaaatacgattttctccccctctactctcccttttactctgaagagcttgctccccaagcaaaagggatt

SEQ ID NO: 25784 - DNA, 201 bp, Homo sapiens
aatccagatgagtggttctaaaccctgccgagccgcaacccaaagtgtctgacgcaggaggtctgtctggggtggaacccagaactggcattcctaacagyttccaggggatgctaatgctggtgtcaggacctcactgtgagaactgctgacttaagatagcactcgtccaaaaacatggactcctcaacagagccaccc

SEQ ID NO: 25785 - DNA, 201 bp, Homo sapiens
caagtctttggtacagtgagcatggcatgcaaggaaggaatggcacctggcgattctcaatgcaacggtgctgggcagaagggcaggttgcagccaagagrccctactcccagccctctgtcctccagtccctgccaccaagccatgccccccacagacgataaccaggagcagcgggggcggggagcaacagaacctgac

SEQ ID NO: 25786 - DNA, 201 bp, Homo sapiens
cctaatcaaggggtcaaggtgaccatgaccttggatgggacaagccatggtcagcgccacctgtgattcagagatgagaatatgcattaccactgggtgtytctgcagagaggcatcatctaaaccaaatcctcaccacaccttggccagacaacccaagtgaggggtggagagtccaaatccttagtccctctgacgtgt

SEQ ID NO: 25787 - DNA, 201 bp, Homo sapiens
atatgtgcacccacacactcaggcacatacacaccactctggcaggcctcctcacccctccgtaatatttcacacgccacatatttaaaataccacaaaayagagttcatttggaatcagaggatcaatctggggtccttccctggcccttctgagtgtgtgcaactgcaggacagaggaagagacacaagtcccaaccca

SEQ ID NO: 25788 - DNA, 201 bp, Homo sapiens
gcccacaagtctacttcctactgaccccacccattgttcaaggttgggccactccagctcttgctgggcagtgctaagctttctaaccaacctcctgaggwtcaatcgactcccctccaaatgctttttagaagtaaagaaacctctgaaaaagcgaaaggttttagataaagattctgaaagcagaatttctcacatcac

SEQ ID NO: 25789 - DNA, 201 bp, Homo sapiens
tgaaatcaatagcaggctcttcatatcaagccctggcttccactgacctgttgctaatgacaaggcagaggaagtggtcacccctagggaggggatgcccrgatctcgaataaaaccaccctccagagtgaagcgcagagctctgacagtcaatgttcagtggtcatccgtaaagaaaaggaatagcacaaataagtgagc

SEQ ID NO: 25790 - DNA, 201 bp, Homo sapiens
ggataatacgacctcgcggggtggatgtgaacctcaagctcataggaaagtcttgacagtgggactatatcaaatatacactgtcagattggagtgagggygaaaggggaccccacggcctttcaaagacagcagcatagttaccgaaggccatctcagtcggccatacagactttgcctctctcctgaaacacgaactcc

SEQ ID NO: 25791 - DNA, 201 bp, Homo sapiens
tgaatgtaagcttcggttttaaacaaatatgtattttaaaccatatatatactgtttcaagccccagagtgactggacagaaccgaaaaagctctgtcttygcatccagagactgaaattagggcaagccctctgcttctcccagctggctctgatgaatttacggagactgtcctctgtgaactcaattttcctcctcat

SEQ ID NO: 25792 - DNA, 201 bp, Homo sapiens
ctgaacatgcacggtatgtggtgttcttgaatgtaagcttcggttttaaacaaatatgtattttaaaccatatatatactgtttcaagccccagagtgacwggacagaaccgaaaaagctctgtctttgcatccagagactgaaattagggcaagccctctgcttctcccagctggctctgatgaatttacggagactgtc

SEQ ID NO: 25793 - DNA, 201 bp, Homo sapiens
atcatttattacaagggcagggtaaggagaataatcacagaaggaaagtcccctcattcccagtgctgacactgacccaagtgtttatctgcttaaataarcaacagtcttagctcgggtaaggggcggctgttgtaacaacataccacagaatgggcagctgacaccacagccgtttatcctcccatagtcctggaggct

SEQ ID NO: 25794 - DNA, 201 bp, Homo sapiens
gatctacaggctgccctgcctcccatgcatcaggagggtatctcctgtggatggagccaggtaagggagtaaggcacacctgcttgctctcctcacctcaractccagctctgatcacacattccccagcactgtggggttctttcactgttttcactggacagagggaagcaccgtgggtcggggccaactccaggtggg

SEQ ID NO: 25795 - DNA, 201 bp, Homo sapiens
agcagactggtccctaaccccacagagcttacggctcacgtaatagaaactgcataaaatgaatcgtttttaagaaagtgagctggggaacagtagggggmgagcagcccccaggttctgcagagcaaatggcaggcagccttgccctgagcctccacattcgcatcctactgaacttgctcctctcttccaagagaacca

SEQ ID NO: 25796 - DNA, 201 bp, Homo sapiens
gcttggggagcttgggagcggggcccagagaaggaggtggaaggctctgcctggtggtcttcaagaccccactcctcccatcctcacccaggggcatgcawtctctacacaaggggccatcttttctagaactatttctacaagtagaactgaagagtctgaatgtggcaatgtcaacctggttattccattccgcacaag

SEQ ID NO: 25797 - DNA, 201 bp, Homo sapiens
aatgcaaatcactcatagatacaaaatttagcccccactttcacaaagaactggtagacctcaaggatggaaacctctgagtcggtccgtgcttggggagyttgggagcggggcccagagaaggaggtggaaggctctgcctggtggtcttcaagaccccactcctcccatcctcacccaggggcatgcattctctacaca

SEQ ID NO: 25798 - DNA, 201 bp, Homo sapiens
gtttgcatgaagactcctgatgagacacacagaatctggaaggggcagcggtgaatccagaaaccatgagcacgcacacatacacgtgtaggtgatcttcwgccgagactctgctgtggtgtatagacccgtgtctgtgtttctgaagtttactgaggggtggaaacaatctataagcaggaaataaccactgtccagtca

SEQ ID NO: 25799 - DNA, 201 bp, Homo sapiens
tgaagggaaggccaaggctgctgggaagcctcctcactggggcgcagttcccagaaaccctttggaaatagccaaaggcctgtatgttattttaggcgtgrgaggagacggtgaaatcaaaggaaaagtgtggatcaaagttcagcctgtggggagaaggggtgagggtgggggtgccacaaccacaggcatcagtcccag

SEQ ID NO: 25800 - DNA, 201 bp, Homo sapiens
gtgcacttcttttccagatttatgttccctacctgaggacctctattgatttggcaatgccttgccttgagaagcttacagcattttctaggcaaacacaytgaggactctggcatcagaatattttctggagcacgtacgacagaagccaatagtcatctgcccgggatggaaagaagaaaggcatcagagaatgtgagt

SEQ ID NO: 25801 - DNA, 201 bp, Homo sapiens
ctagggttccatagtaagacagccccattgtcaggctgtcacttcatctagttcaaacccaggaccaggcttgcccacctgaggccatttgcagcaagggragtgctaggacacaggccaggtctgtcttagctttcactccaccacgagggaccatcgacttttctacctccctagaactccacagccaagactagttag

SEQ ID NO: 25802 - DNA, 201 bp, Homo sapiens
ctgtgctgggcctgggcagggaccaccggccagggctgcttttcccttccagaaacagctcctcctacgtttcgctccttcccctgctttagtcaagcacrcccctcttcgtgttaatgtctcggcagctctgggcataaaggaggcagctggaatagcccaccaggtgggagagcctggtgagtgtgggagtccccagaa

SEQ ID NO: 25803 - DNA, 201 bp, Homo sapiens
gcacagcagtctgtagaatgaagaaaggaagaaacgaaccactaatcccaaagtggctgtggagtcatctggccatctgaagaggcatgaggatgctgttmttagatttcaataacagacagctagttagctttagttttgggttaacaaaaataaatgtacccattgactttaacaggcttatctaaaagaagaatagga

SEQ ID NO: 25804 - DNA, 201 bp, Homo sapiens
gtctcttctaagcgtactttcctttctttcttgttctaaagccttttaaaataaacttccactctggctctgaaacttgtctctgtctctttttctgcctyatatccctcagtcaaattctttcttctgagcaggcaagaattgaggttcctgcagacccttatggattcactgctggtaactcggataccttccaccagt

SEQ ID NO: 25805 - DNA, 201 bp, Homo sapiens
gggaagcttctacactaggagcatctgactgctggggtcctcatgaggcatgacgtggcagcagtgaccacaggatgagccggaggcttaccaagctctcygacgcttccctggcctgtcctgcctgttggtgccctgcctggcgtggcccctgccctgaggtccctcaccatggccacttcacccacataacctccactg

SEQ ID NO: 25806 - DNA, 201 bp, Homo sapiens
gtcaatggcacctgactgcgctagtaatcttactaaactttctaggagaggtttatttaataaacagacttgttacaggctgaatggtgtccttccaaaawccataagttgaaggtctcagcacttcagcatagggctgtgtttggagatggggtcttcacaaaggtaaattaaaatgaggtcattaggctgggcccgaat

SEQ ID NO: 25807 - DNA, 201 bp, Homo sapiens
caatgcttagaaaagcctggtttggggacaagacctaaagaaatattcttctgcctggtgcagagtcaaatgtcatagggtggctgaataccatgcaaagmgccctggagcagctctcaatgctgggggacagcactccaccttgccaacaaggaccgaggctgcagacacaaggcactgtgtatacccaagcactcagca

SEQ ID NO: 25808 - DNA, 201 bp, Homo sapiens
gccggcgcccccaggccactctctcaggtgacattgaggaagatttgctgtttggtctgcgatcacgcctgcaagggggtcctttggtgtttgtgggttgraggcttgctgcctcaattcacaatcaagagatgcagagggaggaaatctcaggctcagaacaggactacccgcccatctggcccgtttctgtctcataca

SEQ ID NO: 25809 - DNA, 201 bp, Homo sapiens
atctcagtccagggtaaatcatcccattcggtgtcccctttcccttgcgttgccaccagacccagccaaccagcatcaaggacctcccctcccaagggagsctgtccactgtctggcaacgatttcctggtggccagatcttagttaaaaatccaacaaacataaatacagccctgaatgactttcactgcatgacatacc

SEQ ID NO: 25810 - DNA, 201 bp, Homo sapiens
ccagatgagggaggctgcagggctttaagtctccactctgtctctggcacctgatgtgctattagggctgacactgctgtgaggaggtggtggggtaaggrcagagttctaaaaggtggggtcctgccactcgtctgctccttccatctttttatatcattaaataacatattttaacattttgcttccatctcaaaggga

SEQ ID NO: 25811 - DNA, 201 bp, Homo sapiens
gagaatgctactgataatatggttctggtttggaaaagtgatgtagaaagaccacagaaatgacatagccaactaaactcccatttgtggttcctggacaygggttgtgggtggggttcctggtgccctgatgagctcctaggagcaggcagggtgaggagcccccaccagatgagggaggctgcagggctttaagtctcc

SEQ ID NO: 25812 - DNA, 201 bp, Homo sapiens
gtgggatccagctccaggatcagcctgttgagctgctcgatggactggtcgatgtccagggtgggcgagcctggggaggggcctgtgctcagctctgggcyggctccattcacaacctggtctcctggaaacctgggtttgaacgctttgctgggagagggctgctgtgtgtcagggggatgtggcccactgcctacaccc

SEQ ID NO: 25813 - DNA, 201 bp, Homo sapiens
taggccaaaattcacaagagttgaaactgcaagggaaatgtccctcccttgtggatttcgccaaaagctaacctactaggctgatttctcatcacacattwgcctcccgtggagcacctcccgtggagcacctcccatggagacccagctcaccttgccgcccggtggccctgctggggccctctcctgtgtcaggcagcc

SEQ ID NO: 25814 - DNA, 201 bp, Homo sapiens
caattccttgtgccaaagctgtctgagggctcagtagtcttcttcatccccaaccttcagccccactgaagtacctggcattcttccacaaagccctgacytataccgcagggacagaagtaagtatgctttctttgtaaatccaccaacattcacgaaggaagaatggtttcactgttaagcccattctgcaatggaggc

SEQ ID NO: 25815 - DNA, 201 bp, Homo sapiens
acaggtgtatttgtaatcagaacattttataccacgactgcttaatcaattccttgtgccaaagctgtctgagggctcagtagtcttcttcatccccaacyttcagccccactgaagtacctggcattcttccacaaagccctgacctataccgcagggacagaagtaagtatgctttctttgtaaatccaccaacattca

SEQ ID NO: 25816 - DNA, 201 bp, Homo sapiens
ttggacgtgccagaatccttcctattcacacatggatctaagctgaaagaggagggctccagctcaacagccctggtctcctttggctggctgaggagacrgatatggattgagggatctaggacaccttcaaagtgcaggcactccagcagcatccccaaccttctgacgatgtcccagggactcggaactagctgcttt

SEQ ID NO: 25817 - DNA, 201 bp, Homo sapiens
ggaccaaagattttcatctcaaaattcatatgactttattgtgaattactttctttttatttttcctttgacatgagtgttagggtgttaaatttagtttycagtatgtgcttaaggaggttatattcgctatgactttcatctcagaagagtaaagatggcgctagaaggtatctgttatagaaacgatacttcattttg

SEQ ID NO: 25818 - DNA, 201 bp, Homo sapiens; identical to SEQ ID NO: 25337

SEQ ID NO: 25819 - DNA, 201 bp, Homo sapiens
cctccgagggaccaggcactgcagactgagatcctcagctttattcgaatgtacttgtttgttcctgagaattacgtgctggccagcaccccagggcgagytctactctggggttcttgagactcaagtggagtgctcacttgggcattgcggagaaggaattaaaaacaaacacaaaacacaaaccctccacaacctcag

SEQ ID NO: 25820 - DNA, 201 bp, Homo sapiens
aatacactgacacgcatatggaattcatgaaaaattactaatgtatataaaatacattaaaaggacaggaaacttttgaaaagatagcatcttccatcagstggagagcaatccatcaatcctggaagggatactgggcaagattttcagcctgggaaggagaagctggaccttgagccacttgggcttgtctcagagcgg

SEQ ID NO: 25821 - DNA, 201 bp, Homo sapiens
gtgatgataaatctagtaggcagcagaagtgatgggaccactgggaaaactatcaagggaaaccagacttggaggagtcagcttggaagcatgatggaccrtgtggttttgtgtatccattactcccatcaacagatgcacaaagaggggttcccaagacccacatcttccagaagcaagccttatctttggtcccatttc

SEQ ID NO: 25822 - DNA, 201 bp, Homo sapiens
tttctcccgaggcttctctctgcggtgcacagatggccatcttctccctgtgtcctcacatggtcttccctctgtgtgtctgtgtcctgatcgcccccttmtacagggacacaagtcatgttggatgagggctcaccctaagggacccactttcaccagtcaccactgtaaaggccctttctccaaacactcacatcctgg

SEQ ID NO: 25823 - DNA, 201 bp, Homo sapiens
acgggcccttttccaaacgatctatttttatgctctcatccaggcttctgtgggaagctggataccactcattctccaacggccactatttacatgacatrtaagttaacaggaagaggagaaacccacggggctcaggcagggccactggctcgctcttcggaagccttagagcctggccaaaacctgcaacctaaatgt

SEQ ID NO: 25824 - DNA, 201 bp, Homo sapiens
cacgggcccttttccaaacgatctatttttatgctctcatccaggcttctgtgggaagctggataccactcattctccaacggccactatttacatgacawataagttaacaggaagaggagaaacccacggggctcaggcagggccactggctcgctcttcggaagccttagagcctggccaaaacctgcaacctaaatg

SEQ ID NO: 25825 - DNA, 201 bp, Homo sapiens
tgtgtggaaacaacactcatctcactttctggtattccgcctaagcagctggtgtccctggtgccctgcgggggtgaggtggccgggaaggctgctgctgyggggcagccccccgggaccgggctagaacttgggaggcgcgtgcccgtcgttctgggacttcaggaatgtctatgctcctctcctctcggcttccacctc

SEQ ID NO: 25826 - DNA, 201 bp, Homo sapiens
ggcataataccgttagtgtgtggaaacaacactcatctcactttctggtattccgcctaagcagctggtgtccctggtgccctgcgggggtgaggtggccrggaaggctgctgctgcggggcagccccccgggaccgggctagaacttgggaggcgcgtgcccgtcgttctgggacttcaggaatgtctatgctcctctcc

SEQ ID NO: 25827 - DNA, 201 bp, Homo sapiens
atgctgtttagaccgtgtgcacgccagcacagccctgccagccacagccgatcttgggccctgaacagacgctccttttagttccagcatcctgctggctyggcctccttctgcccttaattcccacaatattctcacattttccctttgctgctcagacccagagcaggaggcataataccgttagtgtgtggaaacaac

SEQ ID NO: 25828 - DNA, 201 bp, Homo sapiens
acacaaatgttcaatgttatggctaaagagaaagaggttaaacagatgtttatccagtgaggtagaagaagccagaatgttagattgttcactgcaggtcstcaagaaaggtggaaaaacatgcttatcaacaatcttggagacattacaatctgtaaacccttatctatcaaagatggccacatcagctgcatcagctca

SEQ ID NO: 25829 - DNA, 201 bp, Homo sapiens
atgtaactttttaagaaaatgcaaagctgcttcccagaatacttgcagcatttcacatccccaccatcaatcctgcccctacttggtatggttggcatttygaattttagccattctagtgctggcgtagtggtataacactgtgtttttaatttgcaactttattaattactaatgatgttgaacatctttttgtatgct

SEQ ID NO: 25830 - DNA, 201 bp, Homo sapiens
ggccgcctgggctggtcctcccagccccatcccccacaaaggctgatgtcctgtaatgtactctccactccatgatctaggctgcacctcactttagaatyggcatggcctttcctctgcaaaccagcaggcgacttctcccaataaagaccataagtgcaggccctgcggcagccgggcggcctaggtgtcctccacctt

SEQ ID NO: 25831 - DNA, 201 bp, Homo sapiens
gataccacaaagactactggaaattaccaaccacttacgagtacggaaagacagctaaaaccacaccacgtgacacacgtatttcactagcaatggaacaytcatgggtacagagtctatgcgtaatgtccttaaatgagggctcctcttttattttaaggagaacagaggtagaatttaaaaagttaaatagggagctac

SEQ ID NO: 25832 - DNA, 201 bp, Homo sapiens
gcccctcacatgcccccaggcctgaccggacccacagccaaggcatctgtctggccataggatgaaacgaatggtttcttttacacatttttcaatgtctscaccgtggccctgtgcacaggatgagggcacggggaggagctcaacatgcccctggggatgaagcaggagcttctaaacagcacgcagtgggaaggatgg

SEQ ID NO: 25833 - DNA, 201 bp, Homo sapiens
tagagtataaagttatacataattacagccatggaaatgctgcctttctggaatgccaaaggctctgcctggaagcgatcagggcgcagaacatgaaccartaagtgctgggatgcccccggcatgcctcagtaaatacctccacggcgcactcccacagaggcccctcacatgcccccaggcctgaccggacccacagcc

SEQ ID NO: 25834 - DNA, 201 bp, Homo sapiens
gaaaggacaggaacatccctctctttagctagactgaggtgccgggcactgtcctgtgggctgcccatggaagaacacaggatttctgttaatcccacaayacctgtgatgtccaaatgatggtccccacctgacagcccaggaaaccaaggctcacgctgagtaagaaacaagaccagatccaaatatacacaaagggga

SEQ ID NO: 25835 - DNA, 201 bp, Homo sapiens
tcagataggagctgcgagggagcctggagaattcaaaacagacttcacgagagggacagtccgcctttgattttattagcattactgtcatgctgatcatrcagttatgaaagagagaaaaaagggaaaattttgacctaactactaggaaaattccacaaaattggcacaatctcaatcagttcacacagaaccacagct

SEQ ID NO: 25836 - DNA, 201 bp, Homo sapiens
ctgccggcctgtctgctgtgatggctcctgccatcatgctgctgccacggttgatgccaacgtgcctcctcaaccacacaatacaaaataattgcatctgraatgctctgttcctaggccacaggctgcactcagggatggcattctggagggagggagacaggaacagccctgtggctgctctgttccatgcttatgctg

SEQ ID NO: 25837 - DNA, 201 bp, Homo sapiens
ggcaccacagagaggcatgggggccctgctcggggagcatcctgggaaagcagccaggctggtctgagtgtcccctgccggcctgtctgctgtgatggctsctgccatcatgctgctgccacggttgatgccaacgtgcctcctcaaccacacaatacaaaataattgcatctggaatgctctgttcctaggccacaggct

SEQ ID NO: 25838 - DNA, 201 bp, Homo sapiens
acagggcacttgctgagtgcccttttcatttgagacactaaaccttgaaataggtattttggtgcaggattgaaatacgagagcatcaagcattgggaccytgcccagggtcatctactggtcagtgtcaggggcactgaacgggtctgaccagcaaaacccacgttctgctttgtgctcatttttttcagcagatgaagg

SEQ ID NO: 25839 - DNA, 201 bp, Homo sapiens
ccatgccccgaccctgagtctaccataaagccaaggcacaaccctgactctgaccctgagtccaccaaacagcaaagctatgccccctgaacctgaccatragtccaccatacagctgagctatgtccctgaccctgagtccaccgtgaaactgagccttgcctgtgaccctgaccctgagaacacagtggggctgagcca

SEQ ID NO: 25840 - DNA, 201 bp, Homo sapiens
ccatactcctgactgtaagcctgagtccaccaagcagcctggccatgccctgagcctgaccctgagcccaccaggtagatgatccatatcccaaaccctawgtccaccatgtagctccgctatgcccctgacactgactctgagtccaccgtgcagctgagccacacccaacgggaaccctgagtgagccatgtagccgag

SEQ ID NO: 25841 - DNA, 201 bp, Homo sapiens
atcgtggggaaaccactaacagcctccaggctccgagccttggtttcctcacctgtgaaaagtggatcatgttaccagcccaccccttccacaggacagaygcccaagtcagatgcagtcacaggtctgagagcactgagtgaacaataaagtgctgtgcaaggaatattccttaaggaaggactccacatggtcactgat

SEQ ID NO: 25842 - DNA, 201 bp, Homo sapiens
gcctgaggaacgcctgaatctcttcccgccacagacactcaaatcactccaagcaaaggacccgggactcacatgtcaggccgctgcacagcaccgacacwgagacccctgggccgtccgggaccctccctcctcctgcttgtcagcgacagctcccgcgtgccaggaggcacatgccacacagctggcccccagcctggg

SEQ ID NO: 25843 - DNA, 201 bp, Homo sapiens
ggaagccgtctagagcttggcacatgagtgaaggcgagaaacaatttgcctggagaaacaagaagaaaaataacaacaaaaaatcactctctgcctccgtygcagaaatcaacaagacacacacaggcagacagacctcgttttattgtgctttgctttattgaactttgcagatactcagttttttttaacaaactaaag

SEQ ID NO: 25844 - DNA, 201 bp, Homo sapiens
accagacctgtgggaagcgccaggaagatcttcctaaaacacccggttccttcaggaagcatctcctcggagtgcccctgcttctttctcaaatgggcaasgtgggctccctgctgcacagagggcagacaagctctagcacctgagctcccgggcagaaggctggcctggtgtccacttcctgccgctggactcgggaac

SEQ ID NO: 25845 - DNA, 201 bp, Homo sapiens
caagtctacaatgagcacatattacaagaaaactattttgtagaaaaatagtcaaaaagcaaattaagaagcaaagatacggccgggcgcggtggctcacrcctgtaatcccagcactttgggaggccgaggagggcggatcatgaggtcaggagatcgagaccattctggctaacatggtgaaaccccgtctctactaaa

SEQ ID NO: 25846 - DNA, 201 bp, Homo sapiens
tcttgacaggggtgccagacccatgccttggtctcctctcccctcttccatccctcccacccatccccactcagctaaacattggtccccaaatgcaacaytgaggtctcccctgcgaggccttctcagggtggatcgggcaaggtcttctggccccaggcctcagggccccacaaaagttcttacatcacagggaagccc

SEQ ID NO: 25847 - DNA, 201 bp, Homo sapiens
tgcatctcagttaaaacaaccgttgtgagatcaagacaaaaatgagactcacagcagactagaccccaacctgaggtggctcctcttgatctcctcccttycttccctcttcctctttttccccctcctccctttcctcctccttctcctcctccctttcctcttcttctccctcctcccctccctccttctccttctccc

SEQ ID NO: 25848 - DNA, 201 bp, Homo sapiens
ctgaatctcacccattctacaagaaggatacaaaactgtgctcactggcacacagagcacccaggtctcagccaccagagctttgtgataccccacctctrgagggcctctctctgatcttgtaggtgggcagggctactctacactgtccagcgataaatctcccctcagtgcccattcagcagagtagttcaggtctca

SEQ ID NO: 25849 - DNA, 201 bp, Homo sapiens
gaggacagagctggcagccccgttgcttgtccatgttgggtacgtgtggggtcctccaggccaaagtgggccttgaatcctcggaggtgacgctctaggtrtctcgctgcctcccaccgaagcagaactccagagagttccaagaggaggcgggaaagcatcattaccaacagaaaccagtagatgggccacggggccacc

SEQ ID NO: 25850 - DNA, 201 bp, Homo sapiens
tcataaatatatgtatacatatgtgtatatgtgtgtatatatatacatacgaatatatgtgtgtgtgcatatacatatatatatatatatatatatatttwtttttttttttttttttttttttgagacggagtctagctcgtcgccaggctggaatgcagtggtgcaatcacagctcactgtaacctccacctcctgggt

SEQ ID NO: 25851 - DNA, 201 bp, Homo sapiens
cctcaaggctctagaagaccccatgccatgactcagaagccctcaatgcactcccatggcgcctgggaatttcaccaaatgagaagaggctgaaggaaaakaaaatccactttgttcctgttatcacagtgcttgtcccagaaaacagcaagcccagcaattcccatgaaagtggctttgtttatcattcaattagcacca

SEQ ID NO: 25852 - DNA, 201 bp, Homo sapiens
gcaagggccatgcctattggcaggtgtgttggcaggtgcacagacagatgtgttggcaggtggtttggcaggtatgttggtagacgttctggcagatgtgytggcaggtgcactggaaggtgtgctggcaggtggtctgacaggtgtgccacagggtgcattgacacacaagcccacagatgggctaggatgtccctgggt

SEQ ID NO: 25853 - DNA, 201 bp, Homo sapiens
tcggcctgtcccaaacaggttcctctccaggccccatatgattctcctgtaagattcctatttttcacagcacaagctttcaaatactcctaaggctccayagtgaaagaaagagcggtctatcccactggcagagaacaactgctgcctgaaatcacgtggccctcccttcaggggtttctctgtgtattttaatgctaa

SEQ ID NO: 25854 - DNA, 201 bp, Homo sapiens
acagcgtctctgttgtgcatgaccagggtctcacaatagcagcactaacacgagtaacaggcagctaatacactcagcacctaaaagtttgaactgcatgsgtattgccaaatttccaccacaccctggaaagaagctacctatcttcgcctgttttactaatgtgagactggggtttgtggatgagactgaggattcacg

SEQ ID NO: 25855 - DNA, 201 bp, Homo sapiens
tacacatgtatgattccaaccctatggcattctggaaaaggcaacactatgaagacagtgaaaaggtcagcggctgccggggtgcaggagagagaagcgcrgcacagaggatttctagggcagcgaaactactccatacggtactgtcatggtggatgtcacttatcatgcacctgtccaaacccatggaatgtacaacac

SEQ ID NO: 25856 - DNA, 201 bp, Homo sapiens
cctgggcagaagggggtgggtcctcagtaaggccccaccttcaggccagggagggcctgtaggctggggacgggctgccagtcccacagactggagtgggkactcatggtgcctcttccagccagcccatggccgcccatggaccaatcagcaggcacttcctcccctccaagggcttttccatgttcagccagagcaaga

SEQ ID NO: 25857 - DNA, 201 bp, Homo sapiens
caacctaggaaaaactcttctggacatttgcctaggcaaataatccatgactaagaccccaaaagcaaatgcaacagaacaaaaataagtaaatgggacckaattaaactaaaaatcttctgtaccacaaaagaaataatcatcagagtaaacagaacccacagagtgagacagaatatttgcaaactatgcatctgacaa

SEQ ID NO: 25858 - DNA, 201 bp, Homo sapiens
tgcctctgcttggacactgccccctgtggcatttttcttaaagattttagaacatgagaacatgaactctttcaacagcataaaaggaaagaagttttttktttttttttttttgagatggagtctcgctctgttgcccaggctagagtgcagtggcatggtctcggctcactgcaacctccacttctgggttcaagcgat

SEQ ID NO: 25859 - DNA, 201 bp, Homo sapiens
cataccaacctcacctcctcattcacgccatcctgcacccacctcctgggcccggctcagctgcctccgttcctgagttgacacccttctgtgccactgamccatcatggcaggtcatcatggcttgtcatatcatgatgatctccctgtgtccatctctcccgatgggctgcaagctcctcaagggacagcgtctctgtt

SEQ ID NO: 25860 - DNA, 201 bp, Homo sapiens
tgcagctctgcacaccctgggccgaccatgcagccagtctagggctggaggtaccgctcctcgaggcctcatgtgcccagtccccagttgctttttctcayggagccacatttctgaaatctgtgcataccttttcacccacagtgcatcctgttttacctggcactgttttccctatcttagtgtcatataaaatgacag

SEQ ID NO: 25861 - DNA, 201 bp, Homo sapiens
atatacatgtatacgcatatatatatgaacatgccctgttggttctgcttccctggacaacctgactgattaatatcactaagctcttggctgcctccccsaccctatcctcattcagctctcagtttccacagcaccttcttttcctctgcagacatgtccccttctcacagcttggtccacattcacacgtggctacct

SEQ ID NO: 25862 - DNA, 201 bp, Homo sapiens
aacattgtgccatcgcactccagcctgggcaacagagcaagactccgtctcaaaaaaaaaaaaaacaaaaaaaaacaaaaaaagactgcaacctcaagaayggctaaaatttattcatatatatatatgcgtatatacatgtatacgcatatatatatgaacatgccctgttggttctgcttccctggacaacctgactga

SEQ ID NO: 25863 - DNA, 201 bp, Homo sapiens
gcttgaacttcagtcggacaaaggagacggccgtttccctttatctttgaagatgggatccccattccaccatttactctgtgtgtgttcctggtcatgayattcaggctgttcagtttcctggttttacgtttacaaaatggaatgcttcctatctttcaagggaatgaaagatacaaagatgccatccatttttctctt

SEQ ID NO: 25864 - DNA, 201 bp, Homo sapiens
cattgaagtgaaaggggaaaaatgacttggaaatgccccttcactgcaaagcagccagtaccggaggccacagaggagggtggccagggacagacaaagtrcccagtgccagcccagccgagaggcggcacgtggggagttgggaacttactgtgctgggcctgggcagggaccaccggccagggctgcttttcccttcca

SEQ ID NO: 25865 - DNA, 201 bp, Homo sapiens
atagaggccatcgggcaattgaacctctctagagactcacaaacctcagtgaacatcactaaaccttactccagggttcccaggtttccgtggcagctgamaaccccaatccgtctatgcacaactatctccaaaatgaggcagaaaagtctccaggccaggggaatgccctggacctccctgctcctgccctctctccac

SEQ ID NO: 25866 - DNA, 201 bp, Homo sapiens
aattagagctgagggaggaaggaagagtaaagaaaggcccagccttggggtccgaggaagcagctggggctggcgcactggttgaggtagacagcaggcasgccgcagctcctgagccttggcctggccactccaggggctgggctgtgggtggggactgcacaaacccctcatcttggcaagaactccaagcattgctga

SEQ ID NO: 25867 - DNA, 201 bp, Homo sapiens
cctcccgggttcacgccattctcctgcctcagcctctcgagtagctgggactacaggcgcccgccaccacgcctggctaattttttgtatttttagtagasatggggtttcactgtgtgagccaggatggtctcgatctcctgacctcatgatccacccgcctcggcctcccaaagtactgggattacaggcgtgagccac

SEQ ID NO: 25868 - DNA, 201 bp, Homo sapiens
ctgggaaaggagcccattggcttgcccttcttcactggtactcactgtgtgtgcccatcaagagaaaggcacgtgcacagggatatagggagaaactttcmaaggggtgaaatgcacagaaaactgagagcagtccaggactgtggccctaaacttgctccctggcagctccctacacacaggccttatggttgattcgct

SEQ ID NO: 25869 - DNA, 201 bp, Homo sapiens
gggaagcagctccattttctctttgcctttaagtctgacttttcagaaccagcaagggccatgcctattggcaggtgtgttggcaggtgcacagacagatrtgttggcaggtggtttggcaggtatgttggtagacgttctggcagatgtgttggcaggtgcactggaaggtgtgctggcaggtggtctgacaggtgtgcc

SEQ ID NO: 25870 - DNA, 201 bp, Homo sapiens
cagcatggataaatcaaggcacacggaagatgggtttcaggacaactccatgagtgcctggggataattcaacaacaacaaccgttgggagccaagacacrgccccacccccagctccgggcccagccttctctggccatacccttctttagctatgcccgttcttgtttatgtccctaacagcgaagctaggcaaaactc

SEQ ID NO: 25871 - DNA, 201 bp, Homo sapiens
actctcttcaattctatgcagactcagcaaggtgaggaagcggcaggagaaaagtttgaagctagcagaggttggctcaagaggtttaggtaaacaagccrtctccataacatagcagagtaaggtgaagcagcaagtactaatgtagaagctgccgcaagttattcagaagatctagctaagaccattgatgaaggtggc

SEQ ID NO: 25872 - DNA, 201 bp, Homo sapiens
cccgatgggctgcaagctcctcaagggacagcgtctctgttgtgcatgaccagggtctcacaatagcagcactaacacgagtaacaggcagctaatacacycagcacctaaaagtttgaactgcatgcgtattgccaaatttccaccacaccctggaaagaagctacctatcttcgcctgttttactaatgtgagactggg

SEQ ID NO: 25873 - DNA, 201 bp, Homo sapiens
tctatttttttttttttgagacagagtctcactctgtcacccaagctggagtgcagtggcgcgatctcagctcactgcaagctccgcctcctgggttcacrccattctcctgcctcagcctcctgagtagctgggactacaggcgcccaccaccaagcccggctaattttttgtatttttagtagagacggggtttcactg

SEQ ID NO: 25874 - DNA, 201 bp, Homo sapiens
acctccacctcccaaagtgctgggattacaggtgtgagccaccaagcctggcctttttttttttttttttttttttttgactctcgctctgtcacctagcytggagtgcagtggtgtgatctcggctcactgcaacctccacctcccaggttcaagtgaattctcctgcctccacctcgagtggctgggtttacagatgca

SEQ ID NO: 25875 - DNA, 201 bp, Homo sapiens
aggctgggcaatttattttaaaaagaggtttatttggctcacggttctgaaggctgtagaaaaagcatctgcacctggtgagggcctcaggaagcttccawtgatgtgcactctgcacaccctcaccctggcctaaccaccccatgccagtgcattcctgtctacctccactcccactggacttgtgaaaggaagctggca

SEQ ID NO: 25876 - DNA, 201 bp, Homo sapiens
cagggtgcagtcacgggtgatatgcacagctttgtcagaggctttgaaaaccagcagccgccaaggctacttccaccaggaccatcaaacctgcctgcagsgagctcacaaatggacctttctgtcccaacactactatttaacccaaccctcacccatctagggggtgctatcttttaatctttcaaatacaggaaagga

SEQ ID NO: 25877 - DNA, 201 bp, Homo sapiens
gagtcctcccctgtcactccacctccctgggggtgctcatgggcttcagatatcatcgaggctgcaagggatgaaccaggcactgggaggaggctgcactstcacccactatatccctgaggagtctgggcatgactctgcccataaagggggtctctgctgctttatgaagcctggaagcagtaatgacaaagctgtgaa

SEQ ID NO: 25878 - DNA, 201 bp, Homo sapiens
aagaaagtttgaatggtctggattagaagatcaaaccagccaccacattcccttaagccaaagcctaatccagagcaaggccctaactctcttcaattctrtgcagactcagcaaggtgaggaagcggcaggagaaaagtttgaagctagcagaggttggctcaagaggtttaggtaaacaagccgtctccataacatagc

SEQ ID NO: 25879 - DNA, 201 bp, Homo sapiens
cctaacaggccacagaccgataaggtccacggcccaggcgtgggggaccccagtgttaaggtaaaagctacttttccttcttcctacagggtacttttttkgggggtgagggttactgttttaacacagaatcatgatttcaagtcatcaccactgggagagtggggacaccgacccatctgcggccacagcgggcactca

SEQ ID NO: 25880 - DNA, 201 bp, Homo sapiens
catacttttcagtatattttcagagtcctccatgatcatgcattcaaatagtgaaaaaaatggggggaaagccaacccggaagatcaaagtgtgtgaatgmgccccaaggaagcctgggggcttcccagggggttgtgaccaccctcagtagtgctctctgctggccccacaccctgatggcgctttgagtttttcaacca

SEQ ID NO: 25881 - DNA, 201 bp, Homo sapiens
agatgatggcaaacagtggcactcaaaaacagcttgtcagtaccggggtttcttctctttttcctcatcctcccttctgctcacacatgccacaaccacasatggtccccagcaggaaccccaaggtggcaaggagcagcacaaagagggctgataaatgcaggcgaacttcaggtcgtgcagcttcaggcctgaagatga

SEQ ID NO: 25882 - DNA, 201 bp, Homo sapiens
gatgagtggttctaaaccctgccgagccgcaacccaaagtgtctgacgcaggaggtctgtctggggtggaacccagaactggcattcctaacagtttccargggatgctaatgctggtgtcaggacctcactgtgagaactgctgacttaagatagcactcgtccaaaaacatggactcctcaacagagccacccaagcag

SEQ ID NO: 25883 - DNA, 201 bp, Homo sapiens
tggaacttcggttcaggcagtactactttgctggggatagaaatgctcaggtgtggctgggcgtggtggctcacacctgtaatcccagcactttggcaggycgaggtgagtgatcacctgaggttgggagttcaagaccagcctggccaacatggtgaaaccctgtccctactaaaaatacaaaaaattagctgggcatct

SEQ ID NO: 25884 - DNA, 201 bp, Homo sapiens
tatatatttttttttttttttttttgagacagagtctcgctctgtcgcccacactggagtacagtggcgcaatcttggctcactgcaacttctgcctcccragttcaagcaattctctgcctcagcctctcaagtagctgggattacaggcacccgccaccatgcctggctaatttttgtatttttagtagagacagggtt

SEQ ID NO: 25885 - DNA, 201 bp, Homo sapiens
catttcttgtggcaggaatacttgcaggctggaaaaaaaaaaaagagaaagaatgtgtgtcaagcagtctctctagcaagaattcttacatcttcaaaccmtctcaatccttcagagtctctggcttgaagatcccataggtggcctctctctggcacgagagagatttttacatatgacacacggcagtgtggacagaag

SEQ ID NO: 25886 - DNA, 201 bp, Homo sapiens
agaacctgcataagaggctttgagagccctgggctgattatcatgatggagaatggaggttaccataatgtatacaccacgtccacacaggagtggacagyggtcagagaaagcttcaggcagctcaagatgataccggcgagggtctatgccaatgaagaggctgtacctaagatgcttggttccaagtctttagtccgc

SEQ ID NO: 25887 - DNA, 201 bp, Homo sapiens
tagcatttctctatcttttccaagtctacaatgagcacatattacaagaaaactattttgtagaaaaatagtcaaaaagcaaattaagaagcaaagatacrgccgggcgcggtggctcacgcctgtaatcccagcactttgggaggccgaggagggcggatcatgaggtcaggagatcgagaccattctggctaacatggt

SEQ ID NO: 25888 - DNA, 201 bp, Homo sapiens
ggcacctgaaagactggagaggtggggagctgacttccagtccctgcggtgagggggctttcgcccaggctcttagtgacccagcgacatcctaggagacraggagtccaactcccagagtggtattaatgatcaaagatgccatttgtgaagtgcctgaccctcaagatggtccaaagctggagttacccactcgggtgg

SEQ ID NO: 25889 - DNA, 201 bp, Homo sapiens
aggccccaccttcaggccagggagggcctgtaggctggggacgggctgccagtcccacagactggagtggggactcatggtgcctcttccagccagcccayggccgcccatggaccaatcagcaggcacttcctcccctccaagggcttttccatgttcagccagagcaagagagaggacagagagaatggagagaccaca

SEQ ID NO: 25890 - DNA, 201 bp, Homo sapiens
aatattcttctgcctggtgcagagtcaaatgtcatagggtggctgaataccatgcaaagcgccctggagcagctctcaatgctgggggacagcactccacsttgccaacaaggaccgaggctgcagacacaaggcactgtgtatacccaagcactcagcaaaaagcagagccaagactgaaggatctgtcaggtgccatcg

SEQ ID NO: 25891 - DNA, 201 bp, Homo sapiens
cagcttgattgccttggatgttattttttttaaagacagggaagtggaaacagaagggtagaggagagaaggtcaaagtgcgcagcagttagaactatgtwgatgcatggtcctggctgcaaactgcctttttagaaccatgcggattatcagatcccagctccaaccacgggagctttcactgtgcttttggagaaatgt

SEQ ID NO: 25892 - DNA, 201 bp, Homo sapiens
ctccctcttccttttcctgcaggcctggtttttaccctgggggtgataacctagccatgtttaaggacagcgggtggacaccgtgagaatccagccagcaycctatgtctcaactgcaatttgaccatatatactaaggagttccaaaaagcttgtgttcaccaaaaaaaaaatggaaagcagggacttatacacccatgt

SEQ ID NO: 25893 - DNA, 201 bp, Homo sapiens
tggacaacacagtgaaaccccatctctactaaaaatacaaaaattaggccgggcacagtggctcacacttgtaatcccagcactttaggaggcaggcagamttacctgaggtcaggagttcgagaccagcctggccaacatgatgaaaccccgtctctagtaaaaatacaaaaatcatccaggcgtggtggcacacgcata

SEQ ID NO: 25894 - DNA, 201 bp, Homo sapiens
ggtatggccacttcaggactgtgtcttattgcgaaggctgcagacaaatgtgaatctcctctgtctgcctgctctagcagccccatgggagccccaaagcstggattctgggaatgttcatcaaggtatccacttaaagtggcagagcccaggcctggcaatgccacggccctcgtcctgcacactcttggattggtaagt

SEQ ID NO: 25895 - DNA, 201 bp, Homo sapiens
gatggcagcacgtgacctgcaagacttcctgacagtcacatctgtcctgtccttgtgttggttggtcttgttgctctggtcacttcctctgtctggctttstgagttcaagtaaaacatactgagcaagtctcaacacacacacacacacacacacacacacaacacacataaaaaaacctcacacacaacacctcacaca

SEQ ID NO: 25896 - DNA, 201 bp, Homo sapiens
tatttttattttttcgagacagagtctcgctctgtcaccaggctggaatgcagtggcgcaatctcggcttactgcagtctctgcctcctgggttaaagggrttctcctgcctcagcctcccgaatagctgggattacaggcatgcgctatcacacccagctaattttgtatttttagtagagatggggtttcactgtgttg

SEQ ID NO: 25897 - DNA, 201 bp, Homo sapiens
ctacaaatcgcctttgaatgttttatatcacctttaatgaaaaataaaataaatttagctgaggtcaatattatagtctcctatccaagtgaagaaacttsagttttgttaactacctaaaaatacagtctcaatctttggcccataaatacacagtcatattcacaataaactttcagaagtaagtgagactatccacct

SEQ ID NO: 25898 - DNA, 201 bp, Homo sapiens
ttctcttcaaattccataatttctggaaagacaggccatggggctaccccagggcctgagggccagagaggacgggatggggagtgctagtggtcatcacrctgggaaacgaagtgttagttaagtagagaaaaacttcccactaaagtagaaaatactcatccaattaaacatgtttctccttattctttctctacgatt

SEQ ID NO: 25899 - DNA, 201 bp, Homo sapiens
gcctttaagtctgacttttcagaaccagcaagggccatgcctattggcaggtgtgttggcaggtgcacagacagatgtgttggcaggtggtttggcaggtrtgttggtagacgttctggcagatgtgttggcaggtgcactggaaggtgtgctggcaggtggtctgacaggtgtgccacagggtgcattgacacacaagcc

SEQ ID NO: 25900 - DNA, 201 bp, Homo sapiens
cctgaggctattttggctgcaagatagattctaacagaataacagggatttaacaaataaaaggaatgcttagggatgcgttaacagtaatcttgccaagscaggaagccgtctagagcttggcacatgagtgaaggcgagaaacaatttgcctggagaaacaagaagaaaaataacaacaaaaaatcactctctgcctcc

SEQ ID NO: 25901 - DNA, 201 bp, Homo sapiens
cccgaatagctgggattacaggcatgcgctatcacacccagctaattttgtatttttagtagagatggggtttcactgtgttggccaggatggtctcgatytcctgaccttgtggtctccccacctcagcctcccaaagtgctgggattacaagtgtgagccactgtgcccggcccatacatttattttttaaggttgatt

SEQ ID NO: 25902 - DNA, 201 bp, Homo sapiens
ctctttccgcacgcactaggagaatgtggggtaatggttcggcaattatcacattgcctctctgaaagtgatacactggcagctggtgccaggaggaggcygtttcctgatggtccacgcctattgcactgttaattgaatgcaggctccagggagacacaacttcttgggcacgtgcattaacagaaaaaatggcagagt

SEQ ID NO: 25903 - DNA, 201 bp, Homo sapiens
cttataaagaaacactaaacacatctctggctcttgctatgtggaagaaaacttcctgggagcagttgtaccctccacctaggccctatcaactggagggkgtccccccacatccacaacaggcaggtgcaggcggagcgcacacaggacatttgctggggacgccctcctcctgtccacagaaacctgttttcccagctc

SEQ ID NO: 25904 - DNA, 201 bp, Homo sapiens
tgttacgagcccaaatgcacaccagctaacaaatgaataggcagagtgtggtgtgtccacacagtggcacaccacagccatgaaaggatggagcgtaacargaatgcagctggaacacaggctgagtgaaagaagcgaatcacagaaggccactcattgcacgactccagtgagtgagatgtccggaatgggaaacagaga

SEQ ID NO: 25905 - DNA, 201 bp, Homo sapiens
aaaacacagacaagaatgttcacaggcaacgttattcatactagacaaaaagtgttacgagcccaaatgcacaccagctaacaaatgaataggcagagtgyggtgtgtccacacagtggcacaccacagccatgaaaggatggagcgtaacaggaatgcagctggaacacaggctgagtgaaagaagcgaatcacagaagg

SEQ ID NO: 25906 - DNA, 201 bp, Homo sapiens
ataaactctagtccatctgtccatccggttcagagggatccccctgcctagaacacagctaaggatttgctgaatgaatgaatgatactcctgatgggccytggcacacagaccgcctactggcccattccaggtttttcatgctctgaccagaacactgcagtatcaactctacccacgtccccgccctcccaccccatc

SEQ ID NO: 25907 - DNA, 201 bp, Homo sapiens
ccaagggagagctgtgggtcttgtccctgaccatctcctcttgggagaagaaaaacaactgggctccataacaacccttctttcccttctagcctgtgacyctgcagttcaagcataagtgcacgtgtgactttggggcatgggtgaaattgaggtgttccaagacatccagccttagcctgaagctcattcactgaagta

SEQ ID NO: 25908 - DNA, 201 bp, Homo sapiens
gtataagaatatcctagggccaaaacacagacaagaatgttcacaggcaacgttattcatactagacaaaaagtgttacgagcccaaatgcacaccagctracaaatgaataggcagagtgtggtgtgtccacacagtggcacaccacagccatgaaaggatggagcgtaacaggaatgcagctggaacacaggctgagtg

SEQ ID NO: 25909 - DNA, 201 bp, Homo sapiens
ccgaaattattgttaccattctgcaaatgatgtgatcactgcaataaaggcagtgactaatttatcacaaaatactttgctttaaagaatacacatcaaaygaaaagagattagaagtagtgaatacaacgcaatgaatgtccgagtctctcctgagcaccggggtctttccaaactgtagctaactgtatgtctagatat

SEQ ID NO: 25910 - DNA, 201 bp, Homo sapiens
caaaatgcctggtaccatctgttaatggatgaaatgcattcccacaaacatccatatgttgaagtcctagtgcccaggacctcagagggtgacagtttggmaacaggatctttaaagaagtgattaagttaaaatgacaccattagggtggccctaatccagtatgagtggtgtctttataaaaagaggagattatcctgg

SEQ ID NO: 25911 - DNA, 201 bp, Homo sapiens
tccacctcccaggttcaagtgaattctcctgcctccacctcgagtggctgggtttacagatgcacgaccccaagactggctaatttttgtatttttagtaragacggggtttcaccatgatggccaggggctcggtggctcacatctgtaatcctggcactttgggaggccgagacgggtagatcacttgaggtcaggagt

SEQ ID NO: 25912 - DNA, 201 bp, Homo sapiens
aaacaacacctcagccaaaacaggcacacatggtggtgacattcaccccattatcaatcacttttgtggcactatttatggatatataaagcaagtatttyttttcttttcttttcttttcttttttttttttgagacagagtttcgctcttgttgcccaggctggagtgcaatggaacgatcttggctcacggcaacctc

SEQ ID NO: 25913 - DNA, 201 bp, Homo sapiens
ttgcctttaagtctgacttttcagaaccagcaagggccatgcctattggcaggtgtgttggcaggtgcacagacagatgtgttggcaggtggtttggcagrtatgttggtagacgttctggcagatgtgttggcaggtgcactggaaggtgtgctggcaggtggtctgacaggtgtgccacagggtgcattgacacacaag

SEQ ID NO: 25914 - DNA, 201 bp, Homo sapiens
gtggcgcgatctcagctcactgcaagctccgcctcctgggttcacaccattctcctgcctcagcctcctgagtagctgggactacaggcgcccaccaccawgcccggctaattttttgtatttttagtagagacggggtttcactgttagccaggatggtctcgatctcctgacctcgtgatccacctgcctcagcctccc

SEQ ID NO: 25915 - DNA, 201 bp, Homo sapiens
aattaacagcttcactggggtttcagattagtactacatattggaaaaaagattaatccagatgagtggttctaaaccctgccgagccgcaacccaaagtrtctgacgcaggaggtctgtctggggtggaacccagaactggcattcctaacagtttccaggggatgctaatgctggtgtcaggacctcactgtgagaact

SEQ ID NO: 25916 - DNA, 201 bp, Homo sapiens
ccagggccatgctggagggggaagaccagcagaggactttcggtacgtcaagtcccaggggctcaggatatgtgcatggggcacctgaaagactggagagstggggagctgacttccagtccctgcggtgagggggctttcgcccaggctcttagtgacccagcgacatcctaggagacaaggagtccaactcccagagtg

SEQ ID NO: 25917 - DNA, 201 bp, Homo sapiens
cacattagaaatgagagaggggtgaaattagctccctcggtgtaataccaagcaaccagcaagcggtaaccaggaaaatcacatggcagcatggaaagacrtcatcagcaatcagcagggaaagcagaataaaaaccacgtctgctatgattagaacgggaaaatgaaaagcatgtgtgcatcagataggagctgcgaggg

SEQ ID NO: 25918 - DNA, 201 bp, Homo sapiens
acagagcaagactctgtcccaaaaaaaaaaaagaagaggagattaggacacagacacacatagaggggcagccatgtgaggacacagggagaaaacggccrcctacaagccaatgagaaagccctcaggagaatccaaccctgcagacaccctcatctcagccttccagcctccaggactgagggtgataaccgcccattg

SEQ ID NO: 25919 - DNA, 201 bp, Homo sapiens
ccattgagaagacagggcagatgcaaatgtagaccccataaataatattttctgcactgcatttcagcgagagtgaagatctgcactctgggaagggtccrggtgtacaccacagctgcccagggccagaaggatgggcatagggctgaggtccttgtggccctgctgtgtttgtgtcatgtctggcttaggggacccgag

SEQ ID NO: 25920 - DNA, 201 bp, Homo sapiens
aaagtgccctgcagcaggtgggaggggttatgtatgctgagtccactctggagtatgccctgcagagctgcgttctgtcctgttagatgtcccacccaaaytcacacagatccccctgcagagagcctggaaaccagcccctcagggcacagcacaggcatcccaaggacagccccaccaaacccccagcatacagacacc

SEQ ID NO: 25921 - DNA, 201 bp, Homo sapiens
tgagtagctgggactacaggcgcccaccaccaagcccggctaattttttgtatttttagtagagacggggtttcactgttagccaggatggtctcgatctyctgacctcgtgatccacctgcctcagcctcccaaagtgctgggattacaggcatgagccaccgcgcccggcctttttttttggagacagaggctcactct

SEQ ID NO: 25922 - DNA, 201 bp, Homo sapiens
ggatcacctgaggtcaggagttcgagaccagcctgaccaacatggtgaaacactgtccctgataaaaatataaaaattagccaggcgtaatggcaggtgcrtgtaatccaagttactcaggaggctaaggcaggagaatcgcttgagcccaggaggcagaggttgcagtgagccaagattgttccactgcactccagcctg

SEQ ID NO: 25923 - DNA, 201 bp, Homo sapiens
agatgcttactgctatgttaaggtactaactttggggatcatttgtcatgcaacacgccaactcaacacaaaaaaatggccctggtcagtgcaagggtggmagtggtatgatacattcatggtgggtggcctactcggccaccagacagccatcggcactgtagggcaaaatcattaaattcaattatcatagtgaaatca

SEQ ID NO: 25924 - DNA, 201 bp, Homo sapiens
ggctagagtgcagtggcatggtctcggctcactgcaacctccacttctgggttcaagcgattctcctgcctcagcctccggagtagctgggactacaggcrcctgccaccacgtctggctaattttttgtatttttagtagagatggggtttcaccatgttagccaggatggtcttgatctcctgaccttgtgatccaccc

SEQ ID NO: 25925 - DNA, 201 bp, Homo sapiens
ctaccatgatcatgaggcctccccagccatgtgaaactgtgagtccattaaacctcttcttctttataaattacccagtctcagatatggctgtattagcrtcatgagagccgactagtatacttggcgatatttatcaggtggatatgaaatgcctagaagtaacctagtggtcccgcttctgaggagattgagaaagga

SEQ ID NO: 25926 - DNA, 201 bp, Homo sapiens
aggaaggacagatggatctgctgatagagcgataacttgtaccgggacacactatctcctcctcactgtggctgtgaacaaagcccacagtattcacagcrtggctgccatcaccacacccactcctcctccaggcagggatctgagcagttgctcatctgagaattgatgtgcttcaggcacgaagcctatgtattatat

SEQ ID NO: 25927 - DNA, 201 bp, Homo sapiens
tgggggggcaacagctgggcagggtgtggcaccctgaggacaggccagtttattccttacttcatggtgacagaaaacaggccgagccctagagagccagytctctcaaagtacccccaatgggagtgtcctcaactgcaggcagcggccagccaggcagagccaggcagggggctcccatccataggcgagcaagttagc

SEQ ID NO: 25928 - DNA, 201 bp, Homo sapiens
tttcataaatatatgtatacatatgtgtatatgtgtgtatatatatacatacgaatatatgtgtgtgtgcatatacatatatatatatatatatatatatwtttttttttttttttttttttttttgagacggagtctagctcgtcgccaggctggaatgcagtggtgcaatcacagctcactgtaacctccacctcctgg

SEQ ID NO: 25929 - DNA, 201 bp, Homo sapiens
ccgaactcagtccccgcgccccagctccagatctctgtgctccccaagcctcgttcctgcgcccggagcgcgaaagcccgcgccgggcccgaaacaaagargaccgcggcgcgtggccgcgtttcctccttccccggccccagtacctgggggagcctgaggcgcggtccggcagggcgatggccgcaacgaggctgggct

SEQ ID NO: 25930 - DNA, 201 bp, Homo sapiens
gcccgtgcgcccccaaccgggtccccgcgctccctaacctgggttctcccgtgaccccatccccgcgccctgagctcccgtaccccgcgctccccgaactmtgtctccgcgctccccgaactcagtccccgcgccccagctccagatctctgtgctccccaagcctcgttcctgcgcccggagcgcgaaagcccgcgccgg

SEQ ID NO: 25931 - DNA, 201 bp, Homo sapiens
tggcagcctcagctgaggaatcgctgtctggacatgcattagaattcagtcgacagacgcgcagcagcagccaggaacaggggtctgggaccctagagtcytgtcccagaatcccaggctgcactaccaccatgtttcatttcatctcggccaagttacttagccttcctttgcctcagtttactcgtctgtaaaatgggg

SEQ ID NO: 25932 - DNA, 201 bp, Homo sapiens
cctagccaacaaggtgaaaccccatctctactaaaaatacaaaaattagctgggcatggtggtatgcgcctgtaatcccagctacttgggaggctgaggcwgaattgcttgaacccaggaggcagagattgcagtgagctgagatggcccgactggactccagcctggactccagcaagactccatctcaaaaaaataaaa

SEQ ID NO: 25933 - DNA, 201 bp, Homo sapiens
aatcccagcactttgggaggccgaggagggcggatcatgaggtcaggagatcgagaccattctggctaacatggtgaaaccccgtctctactaaaaatacmaaaaattagccgggcagccaggcgtagtggcaggcgcctgtagtcccagctacttgggaggctgaggcaggagaatggcgtgaacccgggaggcagatct

SEQ ID NO: 25934 - DNA, 201 bp, Homo sapiens
gactctctccacctcccaccctggggacaccctgccgccctccacgctgcctcccaccagcccgctaggtcgctggggcattggtctcaaatctacaagcrccatggaaagttgtccagggctttgccacagttctccgaaagggtgaaacaccctaccttgtgtctttgtattcttctttgccttctgcaaatccccttt

SEQ ID NO: 25935 - DNA, 201 bp, Homo sapiens
gggctgtgctcttggaaatttctgtgcagactctctccacctcccaccctggggacaccctgccgccctccacgctgcctcccaccagcccgctaggtcgstggggcattggtctcaaatctacaagcgccatggaaagttgtccagggctttgccacagttctccgaaagggtgaaacaccctaccttgtgtctttgtat

SEQ ID NO: 25936 - DNA, 201 bp, Homo sapiens
gttgaggacccaggagccaacgccctgatacaagccagcagggcaatgccttcacccacctcacgagcaagcctattcttcccttatgggctgtgctcttrgaaatttctgtgcagactctctccacctcccaccctggggacaccctgccgccctccacgctgcctcccaccagcccgctaggtcgctggggcattggtc

SEQ ID NO: 25937 - DNA, 201 bp, Homo sapiens
gtcggcattaagcggcccagtgcgtgtctagccctgtcagcatgccgctggccacacagctgtgcttgccccgtgcgtggtgtcccagggaactatgcttyggaagaactaacccagtctgtgaagagctagcctggcaggagccacagcacctcccactcctctcaccgccagggcccacaggtcctggcagccagccat

SEQ ID NO: 25938 - DNA, 201 bp, Homo sapiens
cccccagctggccgctcaccaagagtcctggtcacagactcacaggccaaggtcggcattaagcggcccagtgcgtgtctagccctgtcagcatgccgctrgccacacagctgtgcttgccccgtgcgtggtgtcccagggaactatgctttggaagaactaacccagtctgtgaagagctagcctggcaggagccacagc

SEQ ID NO: 25939 - DNA, 201 bp, Homo sapiens
ttcctcttgtttgctcaaagccatctggcagtatgggaaacggaaaagctggtgtcccggctcacagagctgacaagaggcgaaaccgtgcagaaaaaccrgtgtgtacaaatgaaaggagaggcagtacctccagagggtcaaggggactccagacaatagcgatcacagtcggccaaaagcctctgtccgctcccactc

SEQ ID NO: 25940 - DNA, 201 bp, Homo sapiens
tgcacccacgctggggccttcctcttgtttgctcaaagccatctggcagtatgggaaacggaaaagctggtgtcccggctcacagagctgacaagaggcgraaccgtgcagaaaaaccggtgtgtacaaatgaaaggagaggcagtacctccagagggtcaaggggactccagacaatagcgatcacagtcggccaaaagc

SEQ ID NO: 25941 - DNA, 201 bp, Homo sapiens
ggggtgccacctgggttcctgcaaagcctgctccctttccgcttcacccccagggtaaacaggcaggacaacgcagccacaggctgcacccacgctggggmcttcctcttgtttgctcaaagccatctggcagtatgggaaacggaaaagctggtgtcccggctcacagagctgacaagaggcgaaaccgtgcagaaaaac

SEQ ID NO: 25942 - DNA, 201 bp, Homo sapiens
atgaaggccatggctaactgggcctcagaacagagggccaggcctctggtagtcagcgtcccacctggaccactctggaagggacatagcctgggaaggamtcaggaggcccacagctccactcccttctcagtcagtctgtcttggggggcccaacgtggaggaacttgggccaatctgaaaaacacttcttttggggtc

SEQ ID NO: 25943 - DNA, 201 bp, Homo sapiens
gtggctcacgcctgtaatcccagcactttggtaggccaaggcaggcggatcacctgaggtcaagagttccagaccagcctggccaacatggtgaaaccccmcctctactaaaaatataaaaaattagccaggcgtggtggcaggcgcctataatcccaactacttgggaggctgaggcaggagaatcacttgaacctagga

SEQ ID NO: 25944 - DNA, 201 bp, Homo sapiens
caggagaattgctcgaaccagggaggtggaggttccagtgagccaagatggcgccactgcactccagcctgggcaacagagtgagattctatcacaaacayacatacatacatattacacagggacggggcgtggtggctcacgtctgtaatcctaacactttgggaggccaaggtgggtggatcacctgagatcatgagt

SEQ ID NO: 25945 - DNA, 201 bp, Homo sapiens
ccaaacatctctccaaaatttggctagtgtcttacgtgcactcagtccccgatgcagtatttgtgaacacgatctgggggtctcagcacaaagcaaaaagsgggagaggagacattttcccaggacaagtctgctggatgcccaacatctttataagaacaaaacctgcatttaaatattacacaagggtccaggcgcagt

SEQ ID NO: 25946 - DNA, 201 bp, Homo sapiens
gaaatgaaagataatctaaataactgaaaagatatatcatgttcatgaactggaagtcctgcaactggtgagtggttgagtaaactgtggtacatccctcrtaggtaacatcgatcagtaataaggaacaagctgggcctaacatgacttattctgccagtcgccccctaaaacaagaggctcgggcatccggctgattct

SEQ ID NO: 25947 - DNA, 201 bp, Homo sapiens
actccagcctgggcaacagagcaagactccgtctcaaaaaaaaaaaaaacaaaaaaaaacaaaaaaagactgcaacctcaagaacggctaaaatttattcwtatatatatatgcgtatatacatgtatacgcatatatatatgaacatgccctgttggttctgcttccctggacaacctgactgattaatatcactaagct

SEQ ID NO: 25948 - DNA, 201 bp, Homo sapiens
agcttgaacccaggacgcagaagttgcagtgagccaacattgtgccatcgcactccagcctgggcaacagagcaagactccgtctcaaaaaaaaaaaaaamaaaaaaaaacaaaaaaagactgcaacctcaagaacggctaaaatttattcatatatatatatgcgtatatacatgtatacgcatatatatatgaacatgc

SEQ ID NO: 25949 - DNA, 201 bp, Homo sapiens
tttatcattgatagttatcttaagtagactcaaagagatggaattagatttatttggtcaaaggtggataaacacttgaaaggtcacacccttcagtctcrtctgctgcctttttttttttttttcccatatggagtttcactcttgttgcccagtctggagtgcaatggcgctatctcggctcactgcaacctccgcctc

SEQ ID NO: 25950 - DNA, 201 bp, Homo sapiens
ctttgcccttgggtgacctgagataaacctgctaagaagcaggactatgcagacagaaaggccaggctgtgaagacctgctgagcacagctcccacgcagytagcccactagacctcaagaaagaatttgttttcctttaaaccactaagttatttagtctgcttcacagtagatagctggttcagccacttagtctactg

SEQ ID NO: 25951 - DNA, 201 bp, Homo sapiens
gggaccacccacctcaggattcagcctcagaaacttctctactttccagaataacttgtttctgttcattatctgtttttcttaactcttttttttaaatygcttagataccaaaaaacaattcaaaaccattgtttccctcatcacaatggctactaggaagctcatagccaaatcatgcagtcacctcagaagtgtgag

SEQ ID NO: 25952 - DNA, 201 bp, Homo sapiens
gtagctcgagtgcaatattctagtgctttgtccttgtgtctcagagttggacacatggagcacaggatgctcaaatccctggcaccttattcttaggggcytgaatcttatcacactgcctttggccaccactgggagtgttagagactgttgtgttccacttctctaatgtggtgggtgcagggtatgctgaggactatg

SEQ ID NO: 25953 - DNA, 201 bp, Homo sapiens
gcctctgatgtcaggtcacagtgactgctcaccccagggattttcaggtgtgacttcatgaaaatatcactgtaacaccagaagtaaactgaggcacagcrtggtcacctctttgtctagggtaatagggataggacgtggtgcgacgctggttgggcaaacttcagagggtaagctaggacagatgctcatgcctctgta

SEQ ID NO: 25954 - DNA, 201 bp, Homo sapiens
gaaggcagaagcaaatctcgcaacgcccgtgtatatagacctcccatgtcactcttccaaccccatgtttaatgcatatttaaatatacagacaggcaggkcgtggtggttcacacctgtaatcccatcactttgggaggccaaggtgggcggatcatgagatcaggaatttgagaccagtctggccaatatggtgaaact

SEQ ID NO: 25955 - DNA, 201 bp, Homo sapiens
agcgattttcctgcctcagcctcccgagtagctgggattacaggaggctgccaccaagcctgtctaatttttgtatttttagtagagacggggtttcaccrtgttggccaggctggtctcgaacgcctgacctcaggtgatccgcccacctcggcctcccaaagtgctgggattacaagcgtgagccactgtgcctggccc

SEQ ID NO: 25956 - DNA, 201 bp, Homo sapiens
ctcgaggttcaagcgattttcctgcctcagcctcccgagtagctgggattacaggaggctgccaccaagcctgtctaatttttgtatttttagtagagacrgggtttcaccatgttggccaggctggtctcgaacgcctgacctcaggtgatccgcccacctcggcctcccaaagtgctgggattacaagcgtgagccact

SEQ ID NO: 25957 - DNA, 201 bp, Homo sapiens
tcactgcaacctccacctcgaggttcaagcgattttcctgcctcagcctcccgagtagctgggattacaggaggctgccaccaagcctgtctaatttttgkatttttagtagagacggggtttcaccatgttggccaggctggtctcgaacgcctgacctcaggtgatccgcccacctcggcctcccaaagtgctgggatt

SEQ ID NO: 25958 - DNA, 201 bp, Homo sapiens
tttttttttgagatgaagtctggctctttttgcccaggctggagtgcaatggtgcaatctcggctaactgcagcctccggctcactgcaacctccacctcraggttcaagcgattttcctgcctcagcctcccgagtagctgggattacaggaggctgccaccaagcctgtctaatttttgtatttttagtagagacgggg

SEQ ID NO: 25959 - DNA, 201 bp, Homo sapiens
gccgcaagttattcagaagatctagctaagaccattgatgaaggtggctacactaaacaacagatttcaatgcagacaaaatcagccttctattagaagaygccacctaggactttcatagccagagaggagaagtcaatgtcaagcttcaaagcttcgaagcacaggctaactgtcttgtgaggggctaaggcaactaat

SEQ ID NO: 25960 - DNA, 201 bp, Homo sapiens
catgttggtcaggctggcctcgaactcctgacctcaggtgatccaccctccttggcctcccaaagtgctgggattataggggtgagtcaccacccaccccrtccctccagctcctaaccttcacgtttttcttgcctgtgccaactttcccagtggcatacagcctgctgtaacacatcccatctttgaaaacacaaccct

SEQ ID NO: 25961 - DNA, 201 bp, Homo sapiens
agtagtgttgaggtttcaccatgttggtcaggctggcctcgaactcctgacctcaggtgatccaccctccttggcctcccaaagtgctgggattatagggktgagtcaccacccaccccgtccctccagctcctaaccttcacgtttttcttgcctgtgccaactttcccagtggcatacagcctgctgtaacacatccca

SEQ ID NO: 25962 - DNA, 201 bp, Homo sapiens
gcagtggcgcgatctcagttcactgcaacctctgcctcccaggtgcagacgtttctcctgtgtcagtctcccaagtagctcggactacaggcatgcaccaycacacccggctaattttgtatttttagtagtgttgaggtttcaccatgttggtcaggctggcctcgaactcctgacctcaggtgatccaccctccttggc

SEQ ID NO: 25963 - DNA, 201 bp, Homo sapiens
gaacagacatgggcttgcggcataccccactcatactataaactacgcgtgtgccaagaccacggtctctcagtgtgtgcgctcagcacccgcctggtaasacacggctgtgctcaacaggcgctgcggatggaatgactaaaatgacaaagacagacgccaggttttaaggtcacccccttgactaccacacccctcagt

SEQ ID NO: 25964 - DNA, 201 bp, Homo sapiens
ttactctgccactttgagcacctcgaacactaaaaacggagagaggtatgttcacttcctccaggggggtaaagaaaaaggacacagttgttggtgttgtrcctggccttttaaactcttccgtgataatacattgagatgcgtaagagggcatttttttttttttttttttgagacggagtctcgctctgtcgcctggag

SEQ ID NO: 25965 - DNA, 201 bp, Homo sapiens
ctagcctcagtgctctgaaattggggccaccagatactctgggcagatgactcctagctctcctctacccactacatgcccgtcgacacgaaatctgacayggccagtcccactgctccatggcttgagggtgtccgagtgtgagggagtttctatgtgccacctaaagcacatttaaaagcactttacggccgagcacgg

SEQ ID NO: 25966 - DNA, 201 bp, Homo sapiens
ttccaaccagggagaaagaggcactgttttcctgcagctttcttgcccactggtccacagctagaaaacttaaagagggaaacagcataagcactgttgcragggctcagccatttgaattgctggatctctgaggagttcatttaggatagtgtaataacatctgctcacgcttcatctgtacataacatctctattgtg

SEQ ID NO: 25967 - DNA, 201 bp, Homo sapiens
attaccaaggatatagaaagtcctctcataataataaaaggattgattcatcaagaacacctaacagtcctaaacatttaatcactgatatggcttgactrtgtccccgcccaaatctcatcttgaattcccatgtgttgtgagagggacccagtgggaggtaactgaatcatggcggcaggtctttcctgtgctgttctc

SEQ ID NO: 25968 - DNA, 201 bp, Homo sapiens
aattataagtcaacaaaagttgtcagattttatatatatatatatatatatatatatatatttttttttttttttttttgagacagagtctcgctctgtcrcccacactggagtacagtggcgcaatcttggctcactgcaacttctgcctcccgagttcaagcaattctctgcctcagcctctcaagtagctgggattac

SEQ ID NO: 25969 - DNA, 201 bp, Homo sapiens
gcttgaacccaggaggtggaggttgcagtgagccgagatcgcgccattgcactccagcctgggcaacaagagtgaaactccatctcaaaaaaaaaaaaaawatatatatatatatatatatttctagcacaagaaatgtgacaggaactaccccaaggcatacaataatcaaattgcttaaacccagtaacaaagagaaag

SEQ ID NO: 25970 - DNA, 201 bp, Homo sapiens
agaatggcgtgaacccgggaggcggaacttgcagtgagccgagatcgcgccactgcagtccgcagtccggcctgggcgacagagcgagactccgtctcaaraaaaaaaaaaaaaaaaaaaaaaaaaggcaatgggagcagccatgcatccctgcggtggaaagtaagctgtaggggaggaggaggtaaagaagaaagggat

SEQ ID NO: 25971 - DNA, 201 bp, Homo sapiens
ctaaaaatacaaaaaattagccgggcgcggtggcgggcgcctgtagtcccagctactcgggaggctgaggcaggagaatggcgtgaacccgggaggcggarcttgcagtgagccgagatcgcgccactgcagtccgcagtccggcctgggcgacagagcgagactccgtctcaaaaaaaaaaaaaaaaaaaaaaaaaaaag

SEQ ID NO: 25972 - DNA, 201 bp, Homo sapiens
tgcttttaactgacttaaatattttaaatactcatcagtttcccatttctaatagggtaaatcgtgatgaatacaaaccacactgacaggagccctttagrgtcttctaggaccctagcagtgggtgcccgagacccgcagcacgagggcaaccccgttcattctccttgcctgaggctctcagaatggggtaaggaccca

SEQ ID NO: 25973 - DNA, 201 bp, Homo sapiens
gttcattaccattgcttttaactgacttaaatattttaaatactcatcagtttcccatttctaatagggtaaatcgtgatgaatacaaaccacactgacargagccctttagggtcttctaggaccctagcagtgggtgcccgagacccgcagcacgagggcaaccccgttcattctccttgcctgaggctctcagaatgg

SEQ ID NO: 25974 - DNA, 201 bp, Homo sapiens
agtggaccaataatttccaaatgtccagtgcgtggtgttccacaccgggtaaaagatgcacttggtgtgcaagacaggccagtggattttaataaaacagmgtaggaaaaactctactgacacaatttcagattccacagtgaaactgaactttaagcaactgtcacttgagttctggtgtagaatcaaaatgaaatagct

SEQ ID NO: 25975 - DNA, 201 bp, Homo sapiens
tgggtgacagagtaagactgtctttaaaaaaaaaaaaaaaaaaaagacttgtacccatcaccagggcctaacaactcctaggacatttctgttaaaatcamcaatattattaacaaatgtggggattttcctgagattgtataacaaatatgtcaacatttagaagttctgcgaaattgtcagtggaccaataatttccaa

SEQ ID NO: 25976 - DNA, 201 bp, Homo sapiens
cccatctctactaaaaatacaagaaattagctgggcatgatgatgcatgtctgtaatcccagctacttgggaggctgaggcacaagaatctcctgaacccrggaggcagaggttgcagtgagccgagatcgtgccctgggtgacagagtaagactgtctttaaaaaaaaaaaaaaaaaaaagacttgtacccatcaccagg

SEQ ID NO: 25977 - DNA, 201 bp, Homo sapiens
atagtgaaaccccatctctactaaaaatacaagaaattagctgggcatgatgatgcatgtctgtaatcccagctacttgggaggctgaggcacaagaatckcctgaacccaggaggcagaggttgcagtgagccgagatcgtgccctgggtgacagagtaagactgtctttaaaaaaaaaaaaaaaaaaaagacttgtacc

SEQ ID NO: 25978 - DNA, 201 bp, Homo sapiens
catagtgaaaccccatctctactaaaaatacaagaaattagctgggcatgatgatgcatgtctgtaatcccagctacttgggaggctgaggcacaagaatytcctgaacccaggaggcagaggttgcagtgagccgagatcgtgccctgggtgacagagtaagactgtctttaaaaaaaaaaaaaaaaaaaagacttgtac

SEQ ID NO: 25979 - DNA, 201 bp, Homo sapiens
cttgtcattttctcaaaaatgaagtgagtctgtcatcataaaccaatgtcaaaatttgagatttcaagtgaaaattagaattttaaaagactagtacccargccaggtgcggtggctcacgcctgtaatctcaacactttgggaggctgaggcgggcagatcacttgaggtcaggagtttgagactagcctggccaacata

SEQ ID NO: 25980 - DNA, 201 bp, Homo sapiens
atccatctctgaagcacacaggcccagaagacaaaacgtatgtgttcactttgaccctcagccaggcagacccgcctcctttttggaatagcagttgtgtragctggcagctaaactagccaccttctcaggggatgtcatttttatttgaaagaactcctagcagacaaaatgcagttattcagactcgagtgcttgtca

SEQ ID NO: 25981 - DNA, 201 bp, Homo sapiens
ccatcggcactgtagggcaaaatcattaaattcaattatcatagtgaaatcatataaactgcccatgagccaagactacaatcctgagaggcagggccatygtttctggtatgtagacaagtgaccctcaaagttttacaaatgtttggactaggacttcacactcgattgtcagcagcatggataatcctcagagtagca

SEQ ID NO: 25982 - DNA, 201 bp, Homo sapiens
ggatcatttgtcatgcaacacgccaactcaacacaaaaaaatggccctggtcagtgcaagggtggcagtggtatgatacattcatggtgggtggcctactmggccaccagacagccatcggcactgtagggcaaaatcattaaattcaattatcatagtgaaatcatataaactgcccatgagccaagactacaatcctga

SEQ ID NO: 25983 - DNA, 201 bp, Homo sapiens
ttggggatcatttgtcatgcaacacgccaactcaacacaaaaaaatggccctggtcagtgcaagggtggcagtggtatgatacattcatggtgggtggccyactcggccaccagacagccatcggcactgtagggcaaaatcattaaattcaattatcatagtgaaatcatataaactgcccatgagccaagactacaatc

SEQ ID NO: 25984 - DNA, 201 bp, Homo sapiens
gagccccaagccaagcgggagagacgctcaactcgtgttttagagaagttggccctggagctggagttcacaagaggcatagtaggttctgtaggcatacragcaaggtgggctaaagtcacccacacaaacctcagctccatttctgatacatgaagatggcaaagcaccaaaaagaacacatggaacagcaaaaatcag

SEQ ID NO: 25985 - DNA, 201 bp, Homo sapiens
agagatactgcccctgctcactgtctcgtgggaggactgggagtctcggacaagatgccacggatgtatgagcagagccttcacggggaagaagaggcctragccatgcgggagtcagagaattctcaggcatcatttcatgagagagaaatagagatgcagcccaagaggagtgagccccaagccaagcgggagagacgc

SEQ ID NO: 25986 - DNA, 201 bp, Homo sapiens
ggaaggaagggagggagggagggagggagggagggagggagaaaggaagagagaaagaaagaatttattaggccttgttactagcaaattcagatcattcrttcctagtgaagaccatatgaagaaaggccactacttacaccttttggggaggtcaaagctgacaccccaaccttaaaagctgtggcaatgagcttcacc

SEQ ID NO: 25987 - DNA, 201 bp, Homo sapiens
gagaagaggagaaagggaggaagagaggaagggaggaaggaaagaaagggaggaagagaggaaggaagggagggagggagggagggagggagggagggagraaggaagagagaaagaaagaatttattaggccttgttactagcaaattcagatcattcattcctagtgaagaccatatgaagaaaggccactacttacac

SEQ ID NO: 25988 - DNA, 201 bp, Homo sapiens
gacagcatgctgcatctgggtccagctctgtgcacggccgagagctaccctcaggaaatgtctgctgaactggctggcttaaaaattaactgcctctgccyttagagcaagaagtggggagggaggagaagggatgcccgtgtaaacatttactgagacggcagagagaggcagagcccgtgctggccgcgtgagctgggg

SEQ ID NO: 25989 - DNA, 201 bp, Homo sapiens
attttgcggcaaatctgaaactgctctaaaaataacatcttctaattttaaaaaccattttaaaagctgtcaaacattaaaacacacacacacacgcacayacacacacacttggcaaacataggtggagacctgcaatcatctggcagaatcagactctcatttcgtcctgtggggctgcagacagaagctccctgtgga

SEQ ID NO: 25990 - DNA, 201 bp, Homo sapiens
ctgaggacgaggcctgcagaggtctctcctagcctgacagggatggttatgtcccaacaggggcgggcttccaacacctctcccagcctgaactcaggctytggaagacctgagtctgaacgggccatagagaggcctcaggaacaagatcccactgggaacctacactcagagccagaatgcagtctcccagccagagcc

SEQ ID NO: 25991 - DNA, 201 bp, Homo sapiens
ccctgaggacgaggcctgcagaggtctctcctagcctgacagggatggttatgtcccaacaggggcgggcttccaacacctctcccagcctgaactcaggytctggaagacctgagtctgaacgggccatagagaggcctcaggaacaagatcccactgggaacctacactcagagccagaatgcagtctcccagccagag

SEQ ID NO: 25992 - DNA, 201 bp, Homo sapiens
agcgtctggggcaggggctgcacgagacagagtggggtgtctggaagtatggtgggcacagggccacgacccccgccctgaggacgaggcctgcagaggtytctcctagcctgacagggatggttatgtcccaacaggggcgggcttccaacacctctcccagcctgaactcaggctctggaagacctgagtctgaacggg

SEQ ID NO: 25993 - DNA, 201 bp, Homo sapiens
gaggctgaggcaggagaatggcatgaacccaggaggcggagcttgcaatgagccgagatcgcgccactgcactccagcctgggcaacagagcgagactccstctcaaaaaaaaaaaaaagctgacaagaaaagaaaacatgagaaaccctaagagctcacaacttatcaaatcttttaaaattaagcattgagctgcaaat

SEQ ID NO: 25994 - DNA, 201 bp, Homo sapiens
attaggttcacattcctcaggaagctctgttatcccactaagcgtcaaagcccaatttagcctgctctaatccccatgagaaaacacccgcccggcagacrcaattaaaccttctcagcctgcgggctgagaaccgggacaggagcggaagagaaagagaaggaaaattcccagaatcaggtcattatatttttccttaca

SEQ ID NO: 25995 - DNA, 201 bp, Homo sapiens
ctggttactaagactgtatcaatattggctaatcaagtgtaacaaatgtaccacaggaatggaaaatgtttatatatgaagaggaagaagagtgtgtccartttttttttttttttgagacggagtctcactctgtcacccaggctagagtgcagtggcacgatcttggctcactgcaagctccgcctcccgggttcacgc

SEQ ID NO: 25996 - DNA, 201 bp, Homo sapiens
tggctcccggggcctatgacaagcctgaggaaatcagtcacaaaccgcagcctgtcaaaaccaactacaaacacaggctcccaagtccccccacgcccccyactcccccacccccccgtcggcggtgagtgccacaggaggaatggagtgagactggaccacaggcctggggacacagctgaggccagcagggacagccag

SEQ ID NO: 25997 - DNA, 201 bp, Homo sapiens
acatatatacactcacatataaagactgcatacctaatatacatatatattcacatacataactctcatatgtatggcacatgtatgtattcatgtgttgmcacatgtataacatacatattcatttgtgtgcgtataacaattacatgtataacatgcatgtatgtgttcatgtaccaataaaattacatacataacatg

SEQ ID NO: 25998 - DNA, 201 bp, Homo sapiens
tcaaattccagctacaaagggagagcgcctgcttgtgtgaggctcacattgacgggtgtgttttgttttttttttttttttaatgtgttgaaggtttttcstctttctcagcaggtcagtgaactgagacctgtgggctcctgactgtggatgaggagtctgcctgaagggaaggccaaggctgctgggaagcctcctcac

SEQ ID NO: 25999 - DNA, 201 bp, Homo sapiens
cttcaggaacagtatccaacccaccactttcaaattccagctacaaagggagagcgcctgcttgtgtgaggctcacattgacgggtgtgttttgttttttktttttttttaatgtgttgaaggtttttcctctttctcagcaggtcagtgaactgagacctgtgggctcctgactgtggatgaggagtctgcctgaaggga

SEQ ID NO: 26000 - DNA, 201 bp, Homo sapiens
gccggaatggcccctagccacacgtggaaacgttgcctcctcctcctgaatgtgttaaataaaagggagaggcagtggggaaaacaatccagtaagtcaarctggttaatgtaactaggaagattgggcaatttgatgggcatgccaaaatattgaaggaggaggaacagcaggagcatcaagacacaagatatccaacta

SEQ ID NO: 26001 - DNA, 201 bp, Homo sapiens
cttcccatatcattatccctggaggtgtgctggtaaaggggaggggaggggaggggaggggaggaggggaggggaggggaggggaatagaggggaggggargggaggggaggggaggggaggggagaggcaaccacctcgatgtatcctctgtccattcctgtggcgtaaatactgccaccatggttcattctaagctagc

SEQ ID NO: 26002 - DNA, 201 bp, Homo sapiens
tgtgggctcaattcttcccatatcattatccctggaggtgtgctggtaaaggggaggggaggggaggggaggggaggaggggaggggaggggaggggaatrgaggggaggggaagggaggggaggggaggggaggggagaggcaaccacctcgatgtatcctctgtccattcctgtggcgtaaatactgccaccatggttc

SEQ ID NO: 26003 - DNA, 201 bp, Homo sapiens
aagctgagtggctgtgccttcctggggactagccactagggagaaccgcctctcaaaagttcccccaggaaaaacaaaacctacttcgagctgctgggagrgcaggttactcacctctgtatcccaggtaacagatgcctgatgcccactggccttcctccctccctctttccttcctctcccccaaccccattctctcct

SEQ ID NO: 26004 - DNA, 201 bp, Homo sapiens
aattaattgtcaggattgcccaacttgattttctgcttaatgcttttaaacataagcagcaatcgttaagaactgccagagaaagtacaccccatggaggrtgggaaactaaaataaagtcatcttgtcattttaccttcatgttcaactatgagaaacaacagactaagattgtatctctatttatttgtaacgaaatag

SEQ ID NO: 26005 - DNA, 201 bp, Homo sapiens
caaaaaattagctgggcatagtggcgggcaccagtaatcccagctacttgagaggctgaggcaggagaatcacttgaacctgggaggtggaggttacagcraaccaagatcacgccactgcactccagccccggcaacagagtgagactctgtcttaaacacacacgtacacaaaactggaagcaacttggataggcaaaa

SEQ ID NO: 26006 - DNA, 201 bp, Homo sapiens
ggagacagggtctagctctgtcatccaggctggcatgcagtggggcaattacagctcactgtaacctccaactcctgggctcaagggatcctcccacctcmgcttccagagtagctgggactacaggtgtgtgccatcacatccagctaattttttttttttttttctgatagagatggggtcttcctgtgttgctaaggc

SEQ ID NO: 26007 - DNA, 201 bp, Homo sapiens
gcttgggtctcttctaagcgtactttcctttctttcttgttctaaagccttttaaaataaacttccactctggctctgaaacttgtctctgtctctttttmtgccttatatccctcagtcaaattctttcttctgagcaggcaagaattgaggttcctgcagacccttatggattcactgctggtaactcggataccttcc

SEQ ID NO: 26008 - DNA, 201 bp, Homo sapiens
atggcagactgaggcaggaagtggcaggtgactgtgttgccagcacctacaaccatcctaccctaagccagaaacggccatcatggaccttgtgttaagamaaaagtctctcacttacgctggcaattcacacccagtcccttattcaagcagttaaatttgtatacaaacaaactaaacaagagaagatttctgttaaac

SEQ ID NO: 26009 - DNA, 201 bp, Homo sapiens
tgcacctgctgctttctgctcatactcgagagccctaagaaaaggctggagtccatactcccctcctatcccgcagccttccacgccacatctgataagasgctctccttcctgctgtccccctcttcaaggcccagctccaaaggcgaaggccatgtgggccatcagcctttctgagttctaggagtcggcctcatgctt

SEQ ID NO: 26010 - DNA, 201 bp, Homo sapiens
tctgctgagaagggaactcaaggagaaacacatcctggctgagtctggggctctgggagagaatcggtccactgctcacagccaggggttctcagcatggkgctgcgcttacaggtctgagggcttcccaccagcgcaccaggcaccaagcaccagacaccaaggcacaaccggcctcttggcttgagcatcccacacctg

SEQ ID NO: 26011 - DNA, 201 bp, Homo sapiens
cctgcccacacctggatctcaggctcccagcctccaggactgtgggagaatcacctctgttgtttaagctgagaccaaagggtgaagcctgagttgagagrtcagggccagggtgggtggacagtgctagatcagcagggcttggggacagaatggcgggatcagctggggcagcaagaggcggctggcgggttccagtgg

SEQ ID NO: 26012 - DNA, 201 bp, Homo sapiens
gagctgtgggctccagtacgggccacataaggggcacagtggaatatccccaaccgcagctcaccgtgcccctcccgtcagtaccgccccgcccagcgcarggcctccttccaggccaggtcctgccctccctcttcaggaatccaggatgctcccccaggtccccccactgctcctcatagcagctacacacaaacacac

SEQ ID NO: 26013 - DNA, 201 bp, Homo sapiens
gccaacatttgcccacaggagtcaggaaactcctcaggaggcagctgtgggctcagtcctggcaggcagggagtgtcctgggtgaaaacagagggagctgygggctccagtacgggccacataaggggcacagtggaatatccccaaccgcagctcaccgtgcccctcccgtcagtaccgccccgcccagcgcagggcctc

SEQ ID NO: 26014 - DNA, 201 bp, Homo sapiens
tgtgccaatgagccaaagggtagagcaagcccctccttgcagatgcttggcatgtggggaacggtgggcagagcaggagcctgagtgtcctgacctgcctktataactaggtcccccctgcttcttgtgaccgtgcgcagcactggcatcattggaagggttctcaggccacagctgggggagctgcagggacagggatac

SEQ ID NO: 26015 - DNA, 201 bp, Homo sapiens
tgaggtccccagggtgcagctcaagcaccctaaatgattgtgccaatgagccaaagggtagagcaagcccctccttgcagatgcttggcatgtggggaacrgtgggcagagcaggagcctgagtgtcctgacctgcctgtataactaggtcccccctgcttcttgtgaccgtgcgcagcactggcatcattggaagggttc

SEQ ID NO: 26016 - DNA, 201 bp, Homo sapiens
cacatcccatgctcatggattggaagaatcaatatactgaaaacaaccatactgtccaaagcaatctacagattcaatgcaattcctatcaaaatactaayatcattcttcacgaaattggaaaaaaaaaatcctaaaattcatatggaaccaaaaaggggcccaaatggccaaagcaatcctaaaaacaaaacaaaacaa

SEQ ID NO: 26017 - DNA, 201 bp, Homo sapiens
aaaacaataaaaactcctccaaaagacttctagatttgataaacgaattcagtaaagtatcaggtttcaaaatcaatgtacacatatctgtagcactgctrtacaccaacaatgaccaaactgacaatcaaattaagaactcaattctttttacgacagctgaaaaaaaaaaaaaaaaaactagaaatatacttaatcaaa

SEQ ID NO: 26018 - DNA, 201 bp, Homo sapiens
tcggaaaagaggaattaaaactgttgctatttgccaatgatatgatcatatacctagaaaacaataaaaactcctccaaaagacttctagatttgataaaygaattcagtaaagtatcaggtttcaaaatcaatgtacacatatctgtagcactgctgtacaccaacaatgaccaaactgacaatcaaattaagaactcaa

SEQ ID NO: 26019 - DNA, 201 bp, Homo sapiens
cagctaagagaaagaaataaagggcacctaaatcggaaaagaggaattaaaactgttgctatttgccaatgatatgatcatatacctagaaaacaataaaractcctccaaaagacttctagatttgataaacgaattcagtaaagtatcaggtttcaaaatcaatgtacacatatctgtagcactgctgtacaccaacaa

SEQ ID NO: 26020 - DNA, 201 bp, Homo sapiens
gcaatcagctaagagaaagaaataaagggcacctaaatcggaaaagaggaattaaaactgttgctatttgccaatgatatgatcatatacctagaaaacamtaaaaactcctccaaaagacttctagatttgataaacgaattcagtaaagtatcaggtttcaaaatcaatgtacacatatctgtagcactgctgtacacc

SEQ ID NO: 26021 - DNA, 201 bp, Homo sapiens
caagggacctctctggtaaaatccactcgcctcagcctggaatttaggatgctaagtcagctgtcctcagagtccccatccagctctccaaattagccccyttccccatcttgccttgcgatgattatttacacacttcaccagccaccgcttcacccttctctcctccagtggaaaacatcaccatgtgatggacagaat

SEQ ID NO: 26022 - DNA, 201 bp, Homo sapiens
ttcattcaagaaacacgcattgagtatctgctatggactgaatatttgtgtcccctaagattcatatgtcaaaacctaatccccagagtgatggtattagkaggcaggacctttggcggtgctcagagcataagggtggaacccctataagtgggattgatgccctcagaaaggaggctccaaggagctccctctcctcac

SEQ ID NO: 26023 - DNA, 201 bp, Homo sapiens
gtgcttgtctgtaactcaggagctggaattctcaagaatactcaggcagtggttcaagggaaggttgctgagatccagttttgggagaggactcagattcygtgtggcgggttctgggctaagcatccggataccagtcctgagctcgctctgagtcctcccctgtcactccacctccctgggggtgctcatgggcttcag

SEQ ID NO: 26024 - DNA, 201 bp, Homo sapiens
tggggaggaaagttttcaaatccattttcaaagtggcaatacttgaatggtctcagcttgatctggcacttccgggccagctctgcacactgcagccagcrcttcctgacccaacatgtcctcgtggtagcccattcctggagctcggaacagtactctgagaacgcggtatggccacttcaggactgtgtcttattgcga

SEQ ID NO: 26025 - DNA, 201 bp, Homo sapiens
aggggagagggagagggagaggaggagaagagaagaagaaggagaagcagaaacagaagaagcagaagcagaagaagcagcagaggaagaagaagaagaargaagaagaagaagaagaagaagaagaagaagaagaagaagaagaagaagaagaagaagaagaagaagaagaagaagaagaagaggaagaggaagaggaag

SEQ ID NO: 26026 - DNA, 201 bp, Homo sapiens
aggctgaggcagggacaactgcttgaacccgggaggtggaggttgcagtgagccaagattgggccgctgcactccagcctgggtctcagagcgagatttcytctcaaagaaagaaaaaaaagaaaaagaagaagaaagaagaagaaggggagagggagagggagaggaggagaagagaagaagaaggagaagcagaaacag

SEQ ID NO: 26027 - DNA, 201 bp, Homo sapiens
catggtggcaggcacctgtagtcccagctactcgggaggctgaggcagggacaactgcttgaacccgggaggtggaggttgcagtgagccaagattgggcmgctgcactccagcctgggtctcagagcgagatttcctctcaaagaaagaaaaaaaagaaaaagaagaagaaagaagaagaaggggagagggagagggaga

SEQ ID NO: 26028 - DNA, 201 bp, Homo sapiens
ctttccccgacttggcacaagtgcaattgcaggctcttatagacaggcacaatgaagttgcagccctgcctcttccaggcaatggagagaaaggttctacrcacggaagacacagatggaaactcagcaggtttgatcgcctgccattcaggccccctactcctaccaggagatggacataagagcacatctgggaatagg

SEQ ID NO: 26029 - DNA, 201 bp, Homo sapiens
actggtcttcagatcttgtttacgtagctggcagccactgagcaggcaggctcagaacgctctcattttctacaggttccctgctaatgggtcttgattayatggagcctgtgcaggctgttagtattaacctttcttgaaacaacgtggtcttttgaagctttgctgatgtttggccagaaggcagttctgtggctcaga

SEQ ID NO: 26030 - DNA, 201 bp, Homo sapiens
ggggtttttgttgttttgtttttcggtggctgagggcaaattttcttcatgtggatgacagctttgtaaacgggctgccataagcctttgtgaatatatgkcaacaggcacccactggtcttcagatcttgtttacgtagctggcagccactgagcaggcaggctcagaacgctctcattttctacaggttccctgctaat

SEQ ID NO: 26031 - DNA, 201 bp, Homo sapiens
cctgagtcgggactgcagtcctcacctgtgtgactccaaagaggatggagacactgagtccacacctcagggcactgacttttgctctactatgcaggtcmcatgtgaacctgggcaggccacatgtgaacctgggcaggccacataatctactgacacctccatcaacacgactgtaaggcagagactggtgcctgcagc

SEQ ID NO: 26032 - DNA, 201 bp, Homo sapiens
gacctgagtcgggactgcagtcctcacctgtgtgactccaaagaggatggagacactgagtccacacctcagggcactgacttttgctctactatgcaggycccatgtgaacctgggcaggccacatgtgaacctgggcaggccacataatctactgacacctccatcaacacgactgtaaggcagagactggtgcctgca

SEQ ID NO: 26033 - DNA, 201 bp, Homo sapiens
aaatacttagccttcacatataattttcatctcataaataatgcaggatgcacagaagtcccccggaggagcacagggcaatgctattcccaactctctamcacaagtggtggtctttctcataatgaggacataatctgcaaatagtgaaagattctggtaacttcaggatgctgaggtctctgtgacaaaccttcatcc

SEQ ID NO: 26034 - DNA, 201 bp, Homo sapiens
gaaatacttagccttcacatataattttcatctcataaataatgcaggatgcacagaagtcccccggaggagcacagggcaatgctattcccaactctctrccacaagtggtggtctttctcataatgaggacataatctgcaaatagtgaaagattctggtaacttcaggatgctgaggtctctgtgacaaaccttcatc

SEQ ID NO: 26035 - DNA, 201 bp, Homo sapiens
atcaccatcaccaccatcaacatcaccattaccaccattaacatcatcaccaccatcaacatcaccaccatcatcagagtcatttaccatcaccatcaccwacatcatcacagtcatcaccatcatcagggtcatcaccatcaccatcaacatcatcaccaccatcaccgtcatcatccaccatcaccaccatcaatatca

SEQ ID NO: 26036 - DNA, 201 bp, Homo sapiens
ctaacaccaccataaacatcatcactatcatcacagtcatcaccgtcatcatcactatcaccaaagcatcatcaccaccatcagcatcatcaccatcatcrcagtcataaccatcatcactgtcatcatcaccatcaccattaccaccatcaacatcatcacagtcatcaccatcaccatcaccaccatcaacatcaccat

SEQ ID NO: 26037 - DNA, 201 bp, Homo sapiens
tgaactcccaattatgtaaactaattgagagtgtaaaataacacatcctgataggtaagtcagtacttatgttgaccctgagctgtgattctgtgattcakactgctcttggagactgatctttgccagcgcacggcctggcagatcccaggccctgaggctctgctgggaagtgggatgagggaggggaaggaagatggg

SEQ ID NO: 26038 - DNA, 201 bp, Homo sapiens
tactgtgcccttggaggagtctcacaactccacttgactttgcagagtgggtggggcctcctggcaagggcactggctcaccacactgtctgatgaaagcrtccactaagtcagcactgtgttatctctgtgctccttgtgggctaatgtgaagttgaccctccctggggactgctgaaataaaaatctagaaggctcaca

SEQ ID NO: 26039 - DNA, 201 bp, Homo sapiens
cttagcctttccacataaattttagaattatgttgtctatatctacaaaaaaatcttgctgagattttgataggaattgtggtaaaactgtctgtcaatcyggaaagaagtgacagctctactaggttgagttttccatccatgaaaacagtatgtctccccacttattgaaatattctgtggtttccttcatcagcattg

SEQ ID NO: 26040 - DNA, 201 bp, Homo sapiens
catctacagtttggggctattaaagtaaaaagagttcctgtacaggttttatgtgaacataagtctatttctttgggataaatgcccaggaatgcaatcaytgagtcacatggcagatgtaggtttttcatttttaagaaattgccaaaattgttttccacagcagctgtaccattttaacaatccctccagcaacgtata

SEQ ID NO: 26041 - DNA, 201 bp, Homo sapiens
tggcaccaaagttccaagcatgtgctggtctgttttgcactttcatctgtttgttggtcaatttatctgtccttgtaccagctcatgtttaccgaattttytatctttgtggtaagtcctcatttctagtagttgtatactggctactgagaatttttactttattatataaattttgaatcagcttatcaagttccacaa

SEQ ID NO: 26042 - DNA, 201 bp, Homo sapiens
ttttgtctggcaccaaagttccaagcatgtgctggtctgttttgcactttcatctgtttgttggtcaatttatctgtccttgtaccagctcatgtttaccraattttctatctttgtggtaagtcctcatttctagtagttgtatactggctactgagaatttttactttattatataaattttgaatcagcttatcaagt

SEQ ID NO: 26043 - DNA, 201 bp, Homo sapiens
ttgggactggttacttgcaacaggaaacagactcagtgacacaatgtccttgcctcaaagctgcttccagtccagtgggagtgcaaacagacaggaatgcwccagcacagggcagtcaggccagggtgagggtatgcaaagcagcaccagaaaagaaaagagccatctgaccctcctcagggaagctttccttatgctgag

SEQ ID NO: 26044 - DNA, 201 bp, Homo sapiens
tgtctttttaaaggaagcaaggttcttattcccccagtgaagccagaattgctccagccagggctgaaatgggaatcctgtccaccaaaagccgggtgacycttttatgacattctcatcacaattggaattatccccttcaaaagagaccatgccacagtcttccttttaagcaataacacaaaaggaagtagaaaatgt

SEQ ID NO: 26045 - DNA, 201 bp, Homo sapiens
aacaagacaaagccagctgctacgaatctaaaaaagatcagcagggattgtggcagtctcttagtggatgctaagtaaccaaaaacggcagttcaagatgyacctaggaagaggggcctttgcaaacaccacaaggtttcaaggtgagacccttgaagggctacaaactagaaacaagaggaccatgacaggatctgatta

SEQ ID NO: 26046 - DNA, 201 bp, Homo sapiens
ggccttcaatgtccctaatgtcctcctacccaacgctcagttgaatacgtatggcggatcctctgcagatctccaacagctctctctctgttcagccttcwctccatcctgcaagtcattgtggtcccctggagtttcaactccaaatgcccaactcagagtctcccagattctgcgtgagtttcctctccctgccttaca

SEQ ID NO: 26047 - DNA, 201 bp, Homo sapiens
gaacaggcactcttcccagctttgagttagcactgggttagcctctctttccaatcttttcatttggttctttccctggccttcaatgtccctaatgtccycctacccaacgctcagttgaatacgtatggcggatcctctgcagatctccaacagctctctctctgttcagccttctctccatcctgcaagtcattgtgg

SEQ ID NO: 26048 - DNA, 201 bp, Homo sapiens
ggggggcctcctggggcagggcacaggccctgggaataaaccctgaattctggtgcacgttttctcacagcgtagtctataaacttgggggctgaacgtgmatgacattttttcagtttttaatttttatttttttgagataggctctctcactctgttgcccagactgaagtacagtgacacaatcatagctcactgcag

SEQ ID NO: 26049 - DNA, 201 bp, Homo sapiens
ttttcccccaaactaaatccagggcttgacatttattccactgaatttagtcttgcttgagttagaccggcccatgaaggccttgctgatgtcccaacaaytgcaccccacccagctctgtgcaagcttctataaaaggaaacctccttcaaggctcacagaaaagaaaggaaacctgaatactgaagtgcaaaaggaagt

SEQ ID NO: 26050 - DNA, 201 bp, Homo sapiens
caccgttcttctgcgctttcttgaacactgccgatgcataagttgtgattttaaaaccactaattaaaggttttcaaaatttcaaatacatttttaaaagrtgcaactgaaacaaataaatccatcagagtggagctggttttgtagccctgtctcctcagttgagagtgagtgagctgctcatcagataggtctacagta

SEQ ID NO: 26051 - DNA, 201 bp, Homo sapiens
aggatgcccaactcaacactctgctgtgtccaggctgggccagtctagctggctttggggtcacccctctccttctgggaatgactctgcaccggcacagrgtaaagctcatctggagatgaagagagaggccaggagataggctagggcagaggcagagcctgggtgtgcttcaattcaaggtgaccctgcagccacctg

SEQ ID NO: 26052 - DNA, 201 bp, Homo sapiens
cagcccaccccttccacaggacagatgcccaagtcagatgcagtcacaggtctgagagcactgagtgaacaataaagtgctgtgcaaggaatattccttarggaaggactccacatggtcactgatacgacccccatagagacctccttccaggctcacctgacagcccttagtcactgacatgaccacctggggcattct

SEQ ID NO: 26053 - DNA, 201 bp, Homo sapiens
cttttttcttttttaaaagaaattggcatggtgtagtcattttcttataaggcaccccctgtgcaaatctggaagagaattcaactttggagtacaactgyagacaaggagagaatgtaaagaaatctcagcaacttactttgaggaagggccatctttgatccaccttgcaaattaaagagaaaaacagaggttaatttt

SEQ ID NO: 26054 - DNA, 201 bp, Homo sapiens
ccccaagcctcgttcctgcgcccggagcgcgaaagcccgcgccgggcccgaaacaaagaggaccgcggcgcgtggccgcgtttcctccttccccggccccmgtacctgggggagcctgaggcgcggtccggcagggcgatggccgcaacgaggctgggctccgagtagcgcgcgggcgggcccgtcctcctggctggctgc

SEQ ID NO: 26055 - DNA, 201 bp, Homo sapiens
caggaacactgggccaggaatgagcccaggccaagcaaggccacggtactcagggagccagggaaaggtgtgcttataaaaggggaactctaagccgggcrcggtggctcacacctttaatcccggcactttgggaggctgaggcaggtggatcacctgaggtcaggagttcgagaccagcctgaccaacatggtgaaacc

SEQ ID NO: 26056 - DNA, 201 bp, Homo sapiens
aggcaaacactcaatcggtatgcctgttactttgtcttcggggtcaccattactattcctaaggtcaggagtcgggcttgctgccagttcctcctgtcaaytccctgtgtacacaccccccaccccctgtgctaccacacccccaccaggacccagtgcacctccatctctgtgtaatggccttgcccctccaccctccag

SEQ ID NO: 26057 - DNA, 201 bp, Homo sapiens
gcgatctcagttcactgcaacctctgcctcccaggtgcagacgtttctcctgtgtcagtctcccaagtagctcggactacaggcatgcaccaccacacccrgctaattttgtatttttagtagtgttgaggtttcaccatgttggtcaggctggcctcgaactcctgacctcaggtgatccaccctccttggcctcccaaa

SEQ ID NO: 26058 - DNA, 201 bp, Homo sapiens
ccactattcttacccaacccctcttccagggccacagaccacagtggccaaggccaagcaagaacaatcacagcgtgagtgcaggcagctggtgcgggctygggacctgcccggagctggatcaggcactgccctgaaccctcccacaccagaggccgccaccagaaggcggagacaccggcctccttcaaggacagtggc

SEQ ID NO: 26059 - DNA, 201 bp, Homo sapiens
ctgtctctacaaaaaattaattaattaattttaaaaattagctgggcatggtggcatgcgcctgtaatcccagctacacaggaagctgaggcatgagaatygcttgaaccaggaggcagaggttgcagtgagcctagactgcaccactgcactccagcctgagtgacagagcaagaccctgtctcaaagtaaaaaaagaaa

SEQ ID NO: 26060 - DNA, 201 bp, Homo sapiens
acagcatcagcctttgtgggtgcctcaagcctgggatgcttcatctgtttgtataataacaccccttccaacctggagccaactcacaggacacgtccatmtgagtcctcctgtgacctctcccaccccgtctcatcaaggcctctgtaggctacacggtatcagtaggttccctcctgccagaaagcccatgtccccaac

SEQ ID NO: 26061 - DNA, 201 bp, Homo sapiens
aagaagaagaagaagaagaagaagaagaagaagaagaagaagaagaagaagaagaagaagaagaagaagaagaggaagaggaagaggaagcggaagcagargaagaagaagaagaagaagaagaagaagaagaagaagaagaagcagaagaagcagcagaagcagaagaagcagaagaagaagaagaagaagaagagggag

SEQ ID NO: 26062 - DNA, 201 bp, Homo sapiens
gagagacccacccgctgagtggccaaggagtcctcatgaagccaaatctgaggccacagccacccacagctgctcagtgagtttcgttatttttctcaaaktgtgataagacatacataacaaaatttaccatcttagccatttttaagtgtacagtgctgtagcatcaagtacattcactttttcgtacaccaactatct

SEQ ID NO: 26063 - DNA, 201 bp, Homo sapiens
aactgtggggagcgacgcagccggtgacttctggcagaagccgtgggagccggcagtgctctcgggagtgtcggcagccttgggtgcacagagagggctcrcccctcatcccaggtcctggcatgaggcccatgtcaagccacaatgcagtggacatgtggcatgattggaaaaagaccatgttgctttatgtccctgaga

SEQ ID NO: 26064 - DNA, 201 bp, Homo sapiens
cagactggagtttctcattctaaaacgttttccgaattggacacccacagagctccctgcagtgcagtgggctgactcggttattaaatgtgcactcacayacacatgacctgttcatacccacggccctaaagcatcggggtctgaaggtggagaggagctgtgtctagtcctgacccctgggcaggagtctcttttcag

SEQ ID NO: 26065 - DNA, 201 bp, Homo sapiens
agtttctcattctaaaacgttttccgaattggacacccacagagctccctgcagtgcagtgggctgactcggttattaaatgtgcactcacatacacatgrcctgttcatacccacggccctaaagcatcggggtctgaaggtggagaggagctgtgtctagtcctgacccctgggcaggagtctcttttcagagttctca

SEQ ID NO: 26066 - DNA, 201 bp, Homo sapiens
tagagagagagacagagagagagagagagaggaggggaggtgccaggctctttttgacaatcagttctcgtgtgaactaacagtgagaactcactcgttaycatgaggacagcaccaagcccttcatgaagtatctgcccccatggaggggacaaatatccaaactgtatcaatgactgcaccatggaagtctaaatcaca

SEQ ID NO: 26067 - DNA, 201 bp, Homo sapiens
acacgaattgtgtgtggtttggggagatgcagcccctctataaatggcaggagagtgacataggccctacttcagagttctcagggaatctgccaagttarggcatgaaaggtgtttacagcagggcctggcccctggcaagcactcgaaagatccatcgcgacgaggaagaaatgaaaactgacatgaggcatgtggctt

SEQ ID NO: 26068 - DNA, 201 bp, Homo sapiens
catgcaccatgccactggcttctggaccccgaaggtgctatggagcccagctccattccactgagtccaaaactcacgaatacagaggccaccagcactaytgaaatgccagcagggtgtgtcggcatttggagggccttccagcaaagctttgaacatgctataattgctccaatataacaagtgatgttccaattaata

SEQ ID NO: 26069 - DNA, 201 bp, Homo sapiens
tgacctatagaaggaagctgatgcaacagcaaaaccacaaaccaatgggaaagcacatgagagtgaagtagaacgggcaaaaaaaaaaaaaaaaaaaaaargcaaaggccaggtgcagtggctcacgcctgtaatcccagcactttgggagactgacgcaggcggatcacgaggtcaggaattcaagaccagcctgaccaa

SEQ ID NO: 26070 - DNA, 201 bp, Homo sapiens
cacatgagagtgaagtagaacgggcaaaaaaaaaaaaaaaaaaaaaaagcaaaggccaggtgcagtggctcacgcctgtaatcccagcactttgggagacygacgcaggcggatcacgaggtcaggaattcaagaccagcctgaccaacatggtgaaaccccgtctctactaaaaatacaaaaattagccgggcgtggtag

SEQ ID NO: 26071 - DNA, 201 bp, Homo sapiens
tgcctcacagccccgggctccaggttgatgcaccaccatggtcagcagctgctggcctttttgaaaacactgggacaacgtgttgggacagagtcccaagrggtcctggggtgtggtgctgaaaacgcgcccacgccaggctttcttcttgtttcaacagtgcccaagggaaagcacgcagagaagtggggagtggggaga

SEQ ID NO: 26072 - DNA, 201 bp, Homo sapiens
cctgtggccttggcttttgtctttctctgcatctcagctccctcacctcctcaacaggtgctgccctaccaccctttcctcactgagtttttgtccacagyacatacttgcattcagaagaactgcacctttacccactggaactcaggctcactgagggcagggagtttgctttattttgctctcccttgcatttctagc

SEQ ID NO: 26073 - DNA, 201 bp, Homo sapiens
gtatttcaaaagtcacccaaaaaatggagaagaccaaaaaaatatatgaaaacatcccttccatcccggttgaaaacagattaggcaatgcccaactgtgytccccggcatgctaacaatcagatagccaaagggacagctgatctcacacttcagcaccctccatcatcaatcactcagcaaccaaaaatattcatcact

SEQ ID NO: 26074 - DNA, 201 bp, Homo sapiens
tcaaaggagaaactagaaaattcttctccatgaaagttggttagaattgactaagcacttgctatgattgctagtcataaacggggacttaaaagcaataytcagcccagtcctgatgatgtgctggagaatggacaagcccccttggggaacagagagagaaacaagagatggaaagggtggtgggcacatttcacggca

SEQ ID NO: 26075 - DNA, 201 bp, Homo sapiens
tgctagaagatcctacttttcaagaattatctgtcctttctcccctacacaacgccttctctctacttcacttcaggacaatcagtagccacaggcttcgrggctgagctttgactgagccccgggtctttcccagcctcactccccaccccttccactctcacaccattacctgtgccaaaatgaacccatctatgtttc

SEQ ID NO: 26076 - DNA, 201 bp, Homo sapiens
ccttgtgctgtgggatagggtcatgctggagctccaaccttctcaggacttacctgcctgccaactaggatagaatcttattgacgtctgtaattcctacrtctgatatggtgcttttcatttgtttggttttgacagagcttttaagaacaacttcaaatctagtttatcttaaagataataatgcagatcagcaggatt

SEQ ID NO: 26077 - DNA, 201 bp, Homo sapiens
tttgtctgagggttttatatttttaaactacagaatctttgctctatagaaatctttcatcaaaatccatgatgtaaagctatctgggagctgtcagtgargtagaatctcctcttctctccttaatttggatgaactcattggccttttcttgggttcaaccaagagaatacgaaaaaacttccagtcttattatttttc

SEQ ID NO: 26078 - DNA, 201 bp, Homo sapiens
ttaagttagaccatttttatgtgaagttgtgactgcttaggaaagtgggacatacggtcacatcgccctgacatgctgtgggtgttatttaatttcattayggatattgtttaacaaacataaaagtaaaaagaacagtgcatccatcatctaagttcaacaacatcaacattttgcccattccgtagaaacgtaaaaatt

SEQ ID NO: 26079 - DNA, 201 bp, Homo sapiens
ttctctttgggacaataatttggcccatagaaaccatgatcacattctgaataaaagtagagatgacaaggcctaacaaaatatttttctaatcaccgaawtagtcatatgaacaatgacactttgaaaagtaaatcacatttacctatatattaagttagaccatttttatgtgaagttgtgactgcttaggaaagtggg

SEQ ID NO: 26080 - DNA, 201 bp, Homo sapiens
aattgttttagagattggaacaaaggcataatggccttaatatttaaaaaaagggattaaactggagagcattacaagtttattcccatctttgtgagttgtctgctaatatttctgagtttcagcttcctgaatctttataacggggaaattggacatgatcatctcaaagaacattgcacatccaggagtctaggactc

SEQ ID NO: 26081 - DNA, 201 bp, Homo sapiens
acacaggtggaggctcctggaccagggtgatgctcagggccttctggatcgcctggtggccggtgagggactccatctccacagagttcaagtaccacacrttgcaggctggaagacaccaagggagacacatgttagttgcaactattgggacaggtgtgtcctgttaacacacaggcagttgctgatgtgcagactggg

SEQ ID NO: 26082 - DNA, 201 bp, Homo sapiens
atcattggactctgatcatagtatcagagtgtttttaaggaactgagttaaaagattttttgcatttgcaattatgtgtgtatgtgtgtaattttaaaacrccaaacgtctttttttattttattttactgatttctaagaaaaatagccttgcaaacaaatgctaagagttcctatgtggttcccaggacgtatttaatg

SEQ ID NO: 26083 - DNA, 201 bp, Homo sapiens
ctgagccatgcccctgaccctgagtctaccatgcagatgagccatgccccgaccctgagtctaccataaagccaaggcacaaccctgactctgaccctgartccaccaaacagcaaagctatgccccctgaacctgaccatgagtccaccatacagctgagctatgtccctgaccctgagtccaccgtgaaactgagcctt

SEQ ID NO: 26084 - DNA, 201 bp, Homo sapiens
agggaaactaaagagacacagaaaaaagacaactctgacaagggcacatagaacagatcctgtgaagaaataacatatcttccaagggcagcggggaggarggaacagtcaacattgtgagggtccttaaggagcccaaccctgaccctgagtctaccatgtcgccaagctatgcctccagaccctgagtccaccatgcag

SEQ ID NO: 26085 - DNA, 201 bp, Homo sapiens
cggggcatgaagccctctaaagccctcaagagcagcctgcctccgctccctgattccctcttacggaggccctcggtggccacggaccctgctctatctgrcacatggccagtagcacactgctggaaccgtgtcagaggtgaggctgtgtctcattcactgtcacatcaccagggcttcctacataggaggccagcaggg

SEQ ID NO: 26086 - DNA, 201 bp, Homo sapiens
cataatcattgcttcaaaaaatctctctccttcatggccaaaatctggcatttccaagaagagggagtgggttagggtaatagtaacctcaactcgatacygcccagacaagccagagtgttccctgataactagactacatctcagaatttcttttctagacatttactctttattttaaaaaagggaaaactggggatt

SEQ ID NO: 26087 - DNA, 201 bp, Homo sapiens
ccaaccacgggagctttcactgtgcttttggagaaatgttgccatcagtacaggtgccaatctgaatgtcaacagcttttaaatcacacagctcttgggastgttgtaaaatcctgtttatatgacacatatcaacttttcatataaagaaagtaaaatggaaatcagaattacagctccctttctctgagtgcctactat

SEQ ID NO: 26088 - DNA, 201 bp, Homo sapiens
agactctgtctcaaaaaaataaataaaaaaataaagtaatgagtttaccaagtaatttaaaaacagccaaactgagggtggataatatgatgtggctttcraaaattccaggccttataactgtttctttgcagcaagaacagggaatcactaaggattgaattcaatcaattggaagacatattaacctcaagagactac

SEQ ID NO: 26089 - DNA, 201 bp, Homo sapiens
ggacaacctgtcagggcacctacagagcccccataggcagggccaaacagtagatggggcaaaacactgctgacaccccgactgcagacccaaatcatacytggggattccgtaagtacagccaccatccccaggagatctgaaggtgcgagcaccaagacaacgtagaaaaccatgtgcttcttccttggggtgtctgtc

SEQ ID NO: 26090 - DNA, 201 bp, Homo sapiens
tctgaaatcaaattcttaagaattattttccataatcaaaaccgtggatttcaaagctctttggtttatccttgagatgaaaagtatacaccgtatcccarccctggctttcctaaagagttttctttccgtggctgcagtccaaagaggcccccccacacatatcattcaatgaaggccaagtcagctataaaaagtccc

SEQ ID NO: 26091 - DNA, 201 bp, Homo sapiens
aaggagaagggcggtgggcaggcctctggcctctggctgagtgagagtcaggcaaagaattctgcccacacacgtctagcagcatgtcacaggaccacgayatcatgcagcggttagccttccagatggcctgggtgacctcgtctcttggcccccatgctggtgtatagccccctcccacagtgaatcagctgggctgtg

SEQ ID NO: 26092 - DNA, 201 bp, Homo sapiens
cttactgctatgttaaggtactaactttggggatcatttgtcatgcaacacgccaactcaacacaaaaaaatggccctggtcagtgcaagggtggcagtgrtatgatacattcatggtgggtggcctactcggccaccagacagccatcggcactgtagggcaaaatcattaaattcaattatcatagtgaaatcatataa

SEQ ID NO: 26093 - DNA, 201 bp, Homo sapiens
ttttactaatgtgagactggggtttgtggatgagactgaggattcacgtgctggacaactgtgtcccaatcttgacctgttccaggtctgctttcagaagsccatagccagcaggcccacaagctatggagacctcattacctgatcaccacttagggattcggggctgtgaaggtgctggccagaagggaggctccaaaa

SEQ ID NO: 26094 - DNA, 201 bp, Homo sapiens
agaagcccatagccagcaggcccacaagctatggagacctcattacctgatcaccacttagggattcggggctgtgaaggtgctggccagaagggaggctscaaaacagaagaagaacttcgcaccaaaatccatctctgaagcacacaggcccagaagacaaaacgtatgtgttcactttgaccctcagccaggcagacc

SEQ ID NO: 26095 - DNA, 201 bp, Homo sapiens
aaattatgatctcaaactatttcacatgtgagagttcttacaaaaggcaaggctaacagatatacagcactctgtgttgtatgaaataaactttgtgaccracagacatgcgcggtggcctcatctataggagagaaaatgacactggagagagacctcacaactcagacagaaaggaggagccagacaacaaaactggga

SEQ ID NO: 26096 - DNA, 201 bp, Homo sapiens
agtaggctccaccaaaagcgttttcctgtgaggagcctgaaccttctccagcccagcttaccctccggcgtctgagctggtgtgtggcaggccccttctcrtggctttgcctgaacactcggctccacagctgacagtctgcaaaccacacatcagttcccttgtcagacgaggtttccagactcatgtttaagaatcctg

SEQ ID NO: 26097 - DNA, 201 bp, Homo sapiens
taacctttgagcctctcagaaatcaatcgaggtggacttaatcttcacaaataggacactgaatcagctgcggcactgactaatgttgatgaagcactcargagctgacagagtccttttacgtcccttgactcacatgttcctccaaacagcctgtgagtagggccagccaggcctcactgcccacttcacagtccagag

SEQ ID NO: 26098 - DNA, 201 bp, Homo sapiens
tgactcacatgttcctccaaacagcctgtgagtagggccagccaggcctcactgcccacttcacagtccagagaatcaagcccagagtcagtgagacccaytgaggccccgcctgctgcttcgtctcagggcgccagctcccatccctaacattacttacataatctatgtataggacgaaccttgttgtctctttacctt

SEQ ID NO: 26099 - DNA, 201 bp, Homo sapiens
ccccgcctgctgcttcgtctcagggcgccagctcccatccctaacattacttacataatctatgtataggacgaaccttgttgtctctttaccttgttgtyaacctgccccccatttaagatatccccccccaacacaaggcacgggtgcaaaggagaatgtctctgcatctccatcagatattcaaagggatcatattat

SEQ ID NO: 26100 - DNA, 201 bp, Homo sapiens
agcctccacgtaacttccgaccccccagtactcctgctctgatgatgggggcttatctcagccgcctcagcctacaccatgacacctcctgtccacagggmcccttggcctcaacagaccatggcacctcaggcttgggagcatccctgaacacctcctggtctctagcacacacattaacttaacataactgaaaaagct

SEQ ID NO: 26101 - DNA, 201 bp, Homo sapiens
cactgcctgccagcacgaagcagccgtcccctggggaggcggtggtcccgtcctgcctcactggcctggcagaccaggccctttcacgtacacccctcccygagtcccagctctgcaccactggatctgcattttcatgcccattttagggttgagaaaatgggcttcataaaagcctactgtccaaaactgcccagggtg

SEQ ID NO: 26102 - DNA, 201 bp, Homo sapiens
tcctaaatcagacctgtccccacatagcatctgacaggcagaagtcagttcatggggaaccttcggctgtgcaactttgcccgggacgtcatcacagggtraggaagccgagaacaagcccaggtgtccctgctgatgccatgctgctcatgacagctctcccagtatcgcccaatggctccgctggcacaggaccagggc

SEQ ID NO: 26103 - DNA, 201 bp, Homo sapiens
tgggaactccctgggtgccactgcagctgcccaaactgcagctgtagatccaagcctccctgcgctcttgagtggggccaggagcaggcaggatctgcccmccggggtgcagctgcagccaccatccacggctgcagacctgggcctcccactccaccacacaggcgggagctggggaaaagcaggagctccctgagtgca

SEQ ID NO: 26104 - DNA, 201 bp, Homo sapiens
tgattggaattaccgacgcgccgcgcttggcgcagggttcagctttactaggatttcaaacctctccgagaacgctggcgaggtgcttaaaagaatcaaarccgggcaagctctggctttcggaatttctaaatcttgaatattatccagtcaactctgcatctgtaatgagcagtaatctacactaccctgataatctac

SEQ ID NO: 26105 - DNA, 201 bp, Homo sapiens
caactccacatgccttggatgtggggagcagtctgggtgggctaagtcgtggcctttatggctgacatatgtgcaaattccagccatcaattcaactggcygacgttaacctctcaagttctggcactaaatatccatctttctgtttctgcagtagaagagcaaagctgctcttcaacttttaactacaaaggaaaaaac

SEQ ID NO: 26106 - DNA, 201 bp, Homo sapiens
cacctggcagacaagcaggcattctcatttccccctgtccttcaaatgacaccattattcacctttttctatattcattccttcattcatttttctgtatwcattcatcatttttttcctatagcatatccaaactttagtcttttcaaacatttttccctgagaacacatctgtatcgtattcattccagattgcttcac

SEQ ID NO: 26107 - DNA, 201 bp, Homo sapiens
agatggtttacaattatactggcagggttcatctgtccattcattcattcccgagtttatagcctaggagggagcagagagaagataaagccaaggaggcrgtggaccctccagggtgaggagggagggaggcagtgtgtgtcgggctccagtgtagactgggccttgaccaaaacaggtaagcagaggctcaggagcaaa

SEQ ID NO: 26108 - DNA, 201 bp, Homo sapiens
agggagcagagagaagataaagccaaggaggcggtggaccctccagggtgaggagggagggaggcagtgtgtgtcgggctccagtgtagactgggccttgmccaaaacaggtaagcagaggctcaggagcaaagggtgggagtggggcggagggcaaagcgaagaattgtgttgacttcaactggactaagaattaagaga

SEQ ID NO: 26109 - DNA, 201 bp, Homo sapiens
actcctgacctcaggtgatccaccctccttggcctcccaaagtgctgggattataggggtgagtcaccacccaccccgtccctccagctcctaaccttcaygtttttcttgcctgtgccaactttcccagtggcatacagcctgctgtaacacatcccatctttgaaaacacaaccctccttgaatgcctacccagccttc

SEQ ID NO: 26110 - DNA, 201 bp, Homo sapiens
ggtgagtcaccacccaccccgtccctccagctcctaaccttcacgtttttcttgcctgtgccaactttcccagtggcatacagcctgctgtaacacatccyatctttgaaaacacaaccctccttgaatgcctacccagccttcccatacctggcctgtctctctgctgttccccttataggaagccttcctcaaaggctg

SEQ ID NO: 26111 - DNA, 201 bp, Homo sapiens
atctgtccatccggttcagagggatccccctgcctagaacacagctaaggatttgctgaatgaatgaatgatactcctgatgggccctggcacacagaccrcctactggcccattccaggtttttcatgctctgaccagaacactgcagtatcaactctacccacgtccccgccctcccaccccatccccacaacctagtt

SEQ ID NO: 26112 - DNA, 201 bp, Homo sapiens
caaggtcttctggccccaggcctcagggccccacaaaagttcttacatcacagggaagccctgcaccctcaccctgcccttcacctatccaaggcccagaygcgagaaggggtccatgcctgtttgctgaattaatgaaggaaggaagaagggaaatgggaatagaaacacggccccatggttccatggccagcaatgtcc

SEQ ID NO: 26113 - DNA, 201 bp, Homo sapiens
aagatgctgtccctagttgtcccacagcaagacagctaggaccaggagatagaagcacaaagacacatttgcagcagggtctcaatgggcaaggcacatgmgaacaaaatctctatgttctcatttcaaacacatatcacaatggtcaattctccttcaaggaatgtgttctaaggcaatgaccatgcctggaaagatcta

SEQ ID NO: 26114 - DNA, 201 bp, Homo sapiens
aatggtcaattctccttcaaggaatgtgttctaaggcaatgaccatgcctggaaagatctacgtggaagggcagggtacagaattatgcacaacaaaaaargctggaagcagttttaatagccagcaactgggctctggtcattttatggtactaacatagaatgggattcgaatactatgaagtcactaaaaataataat

SEQ ID NO: 26115 - DNA, 201 bp, Homo sapiens
ttgggagcctgggtgaatagcattcaccagacctgtgggaagcgccaggaagatcttcctaaaacacccggttccttcaggaagcatctcctcggagtgcycctgcttctttctcaaatgggcaaggtgggctccctgctgcacagagggcagacaagctctagcacctgagctcccgggcagaaggctggcctggtgtcc

SEQ ID NO: 26116 - DNA, 201 bp, Homo sapiens
cctgggcacgtcctgaaggtggaggcccagtggggcacagccatggactggatggttctgtctcactccaggtgtttccttaagcaaatggggagaccacrgaggaggtgggtgagggcacaaaacgtcatgtggctggagccctgggtgtggccacctcaggccaaagggaaggagctagagttccagcatagccaccag

SEQ ID NO: 26117 - DNA, 201 bp, Homo sapiens
cagttggtgatgcatccgaatcctgatctctgcctggagcacatgaggaggctcagatccaccttggacaagtcctgcaaatgtccagggtcagaacaatycttaagaccaacagtgcgtctgggaaagtttacaagcgtcctacgtaagggagaggctgacttttcgtctttcctcagggtgcagtcacgggtgatatgc

SEQ ID NO: 26118 - DNA, 201 bp, Homo sapiens
ggctgacttttcgtctttcctcagggtgcagtcacgggtgatatgcacagctttgtcagaggctttgaaaaccagcagccgccaaggctacttccaccagraccatcaaacctgcctgcagcgagctcacaaatggacctttctgtcccaacactactatttaacccaaccctcacccatctagggggtgctatcttttaa

SEQ ID NO: 26119 - DNA, 201 bp, Homo sapiens
cccatatgggtaaataactgaaggttttatgggaatatgacgtggcaactggcagaatactctctgggatttttcatcctagtttgtttttttaagtgccractgacttctctgcctactaataattggaggcgctggggacatttggaaatgtgaggacattttaaccatcaccaccactggggtggccactagcatgta

SEQ ID NO: 26120 - DNA, 201 bp, Homo sapiens
aggagaaagggaacaaaacccaagctcccacacagggatgttcacgggcaaagggcagctcccaaagccctggggtggggcaggggggcacctgcatctgsctgcacccatggcacacacaccctgatctctcacacctgtgcccaccctgctcccagcctgaggcccaggtgctggggaagagctgcccttacttccctg

SEQ ID NO: 26121 - DNA, 201 bp, Homo sapiens
ggcaggaaacagtgctcaatcgtaaggcgaatccgcattcatcagcaggccgcctctccagcccctctccctgcccccgactctgacctcctcctgccagkcttgcaatctaggctcttacactccagggtccttctgctctgcgcccttgggctcacttggggcttctcccaaggcagtttcccattctcctttctggct

SEQ ID NO: 26122 - DNA, 201 bp, Homo sapiens
tcccacacttcgttactagtaacaaatatcgtgcgtgtgataaacctccccagtgaggacaacaaactgatttttcactggcaggaaacagtgctcaatcstaaggcgaatccgcattcatcagcaggccgcctctccagcccctctccctgcccccgactctgacctcctcctgccagtcttgcaatctaggctcttaca

SEQ ID NO: 26123 - DNA, 201 bp, Homo sapiens
gtagccattcagaaaactcccacacttcgttactagtaacaaatatcgtgcgtgtgataaacctccccagtgaggacaacaaactgatttttcactggcargaaacagtgctcaatcgtaaggcgaatccgcattcatcagcaggccgcctctccagcccctctccctgcccccgactctgacctcctcctgccagtcttg

SEQ ID NO: 26124 - DNA, 201 bp, Homo sapiens
ccatggtgcccacaggaaccggccaaagaaatctgaattcagcaatgaacagatagcccccagcaggataaaactcctccaacctgagtaccaggattcayactctctggggtccacccaggaacaacggccaggagcacaggccagcccactgcctatgcaagccagagtggaaggcaaatggttgaaggtggcttttta

SEQ ID NO: 26125 - DNA, 201 bp, Homo sapiens
gcccacagtacaatctgtgatgacacacagcttgttctgtttaatgcacatgtaacacaaaaggaagaaagaaacttcctataccagctcttcagaaatcrtggaaacttgcttcctttggttcctcagagggagctatctgcttggagcaaattccccgatgcccttgaccacgtttaccttgtgtaaaaatcacacctg

SEQ ID NO: 26126 - DNA, 201 bp, Homo sapiens
tccagccttcacagacctacagatgggatgtctgactctagctctgcagtgaggaccctgaggctgagaggtgagtgccctgtccacagccccaggttagracctgaatcaaagctgaggctcaacttcctctatagatgcttccccacgccagggccagaatctcctgggcacctgtccctgcagattcctgagccccag

SEQ ID NO: 26127 - DNA, 201 bp, Homo sapiens
tgaggaccctgaggctgagaggtgagtgccctgtccacagccccaggttaggacctgaatcaaagctgaggctcaacttcctctatagatgcttccccacrccagggccagaatctcctgggcacctgtccctgcagattcctgagccccagtcctgacatactggaccacagtctgcaaggcgagtggcaagggactcag

SEQ ID NO: 26128 - DNA, 201 bp, Homo sapiens
gttagaattgactaagcacttgctatgattgctagtcataaacggggacttaaaagcaatattcagcccagtcctgatgatgtgctggagaatggacaagyccccttggggaacagagagagaaacaagagatggaaagggtggtgggcacatttcacggcatccgaatagacagatcaacagaggcaagggaaagacgga

SEQ ID NO: 26129 - DNA, 201 bp, Homo sapiens; identical to SEQ ID NO: 25338

SEQ ID NO: 26130 - DNA, 201 bp, Homo sapiens
agatcacctagacagaaaaccagtaagaaaacagggtactcaacctgcactttagaccaaatagaccttacagacatatacagaacattgcatcagaataygcattcttctgaagtgcacacagaaagttctccagcatagatggcatgttaggccacaaaacaaaccttaacgaatttaaggagactgaaatcatattca

SEQ ID NO: 26131 - DNA, 201 bp, Homo sapiens
gcaattcacctacaaagaaacaacacctcagccaaaacaggcacacatggtggtgacattcaccccattatcaatcacttttgtggcactatttatggatrtataaagcaagtattttttttcttttcttttcttttcttttttttttttgagacagagtttcgctcttgttgcccaggctggagtgcaatggaacgatct

SEQ ID NO: 26132 - DNA, 201 bp, Homo sapiens
ggtacttgacgggggatgtgtctcatggctgttcaaagcgaccagctcccacaaggggcttcaccctttgctgcacctgtgcacacccaatccacctgtcycttgttagacttcatttcccccgcaggaatatgctgtgctcaaagtgggagccatagtgcagggtcagaattctcatctgaaataacagctccttatcta

SEQ ID NO: 26133 - DNA, 201 bp, Homo sapiens
aaaacttcttcattgcaaacctgtcaagggcctggtcggcgctgaaggggagagagagagaaagagagttaactcagtggagcccacaccacgtgggtacktgacgggggatgtgtctcatggctgttcaaagcgaccagctcccacaaggggcttcaccctttgctgcacctgtgcacacccaatccacctgtcccttgt

SEQ ID NO: 26134 - DNA, 201 bp, Homo sapiens
tgatttgctgaagacaaggaaggtataaaaacagaaaacttacatgggcacatgtgagttttacgggtcagctccatgggccaactgctccatggcgtttyagtgtaacaaagattgacctcccatcagagttgctgttgagacttctgagcttcccagtcacaaattccttgctaattaattattctcaagagtgattat

SEQ ID NO: 26135 - DNA, 201 bp, Homo sapiens
aaaccaacatattgttcaaaatcccaaataaaagcatgcctttaaaaaacattttttaaaaaatagcaatgccttataaaaacaacaaagttcactgcaamtataagctgtagtgaatgctatgagattgcagacagatagccaacgtaggtaatagcactgagtttgtgagtgacttcttagagaaccaccatcagtacc

SEQ ID NO: 26136 - DNA, 201 bp, Homo sapiens
tttgtttcctttactgacttttcataaaatgcctgtccacatacaaaaagacaaagaaaactcaggaatgtgtacaaatttgggggatgtgtggctacgtwttgtttaaaatgcaaaggaggctagacatggctcacgcctgtaatcccagcactttgggaagccaaggcaggcagatcacttgaggtcaggagtttgaga

SEQ ID NO: 26137 - DNA, 201 bp, Homo sapiens
tttccttcttcctacagggtactttttttgggggtgagggttactgttttaacacagaatcatgatttcaagtcatcaccactgggagagtggggacaccracccatctgcggccacagcgggcactcaccatgacatctcccttcagaagctgggccggctcgatgacgatgcagatcctgctggggttttctgggccaa

SEQ ID NO: 26138 - DNA, 201 bp, Homo sapiens
cagggtggcctggaggccattgggaacactcccaagggctgcaggtgggacactgaggaaaggaggccaccgcctccttcacccactcacggcccctctcygccctgccccaccctgttcctgggcctgcctcatttatcaagtgccaaacccacacctccaccacaccccttccaagtcccacccacaccgcccactcaa

SEQ ID NO: 26139 - DNA, 201 bp, Homo sapiens
ctgcgtgtggtgggtggggcagccaggagtgacacacgccatgctcacaggatgcatgagaaagaggctcaagcccgggctcaaggagcccaaatgccagrtgatgaatccatgacgatgaaaggtgtcagaagtttctgcataggggagtgacacaatctcaattgtttttaacaaggtttagtggtagtagcagcagca

SEQ ID NO: 26140 - DNA, 201 bp, Homo sapiens
aagacctgagcttcaaagagtctttctgcacatctgggagcagaacaagggaagagccaagcacatccacctaaagaaggcagagaagacagcaggaggcygggggccctggcagaaggaggggaggctgtggactgctgggactgaaagggccactggagattccccaaggccactgccaaagcacatttccagagcagc

SEQ ID NO: 26141 - DNA, 201 bp, Homo sapiens
tgtttgtttgtttgtttgtttgtttgtttgtttgtttttgagatggagtcttgctctgttgcccaggacagagcacttcctagtgtgtcacaggagtgggygagagcagactaagcggcaggaaggcaaaaacacctcttttgggagaaagtagcctagccttatggcaaagcacacaggctccacatcaggcagtctggg

SEQ ID NO: 26142 - DNA, 201 bp, Homo sapiens
gaggactctgctgtccctgacggaacccagggcccatttcctcagctgcagagtgagaagggcaggtcagacagacccacgggatcttctcaatccaatartctctgaatccaattcagcattataggcctcgatacagtaactccaatgttcaaaccccgaaaccatacaaattgcaaccactgccaaaaaaacaaacaa

SEQ ID NO: 26143 - DNA, 201 bp, Homo sapiens
attgcaatgccatgctggagtacactggcccagttcctacaagtgggctgtcgcttcagaccctatgtcacgcttatcatttgaccgtgaaagactggcaygcaacttaacatataaacagcattatataactcatggggcaaaactatttaactctcacatgacacatcattccaagatgacaaccacacaaatacgtga

SEQ ID NO: 26144 - DNA, 201 bp, Homo sapiens
actacaagcccaccttatcacctcagaagggtctacaccatgttgtgtgattcagctcaccagaggacgcagtgccactaaccagcatcaggacgggcttycacaggagccagtgaggccaccctccagtcagggcaaggtaggcatcgcttggcctgcaaacagtgccctgccctccaacacaggaggtgccagatgaca

SEQ ID NO: 26145 - DNA, 201 bp, Homo sapiens
tcaaatggggcttggccaccacttcctgtccactgccaggtcacagacaagacgggcttcaagaccagaaagaggcaggagcctgagtgaatcaaggatcrgggaggggtcaggacccaggtagcacctgggccagggctgctctggcatcagacggaggccacatcctactctgccacttgggtccacctctcccagcca

SEQ ID NO: 26146 - DNA, 201 bp, Homo sapiens
tgacaacacaaactgacccaatagagaggtggtacatggtggggaaggctgtccctcctctatggcctggtggccccaggcctggaaagggctgagttcaygcccggccaaaagccatggcctaagttcactgaaaaatcacagccatttgtggaaccttgctaaatactcaagtagttcaaaatgaaaataataataata

SEQ ID NO: 26147 - DNA, 201 bp, Homo sapiens
atatcaggctcactgtgtcaaaatcaccacaccaagcctgaaaagcataggttgttttaattaacaagaattatatttatttaaaagtccgtctgtctatmtctctctctctctctctctctctctctcttagtttgcaccaaaacacaatttgggtgaaggatccataatctaaaataatacttgaaaagatcaggtcat

SEQ ID NO: 26148 - DNA, 201 bp, Homo sapiens
atgccgccatgcagacaatggagacacccgagggaccctgagctcagcactacatcccacattgcagtgatggatgtgtaccaaacacattcctgagtcayagagtacaaacagaaagctcacgaaacttggagagtctagttttctgcttttacgagaaacggatagacatcaaggaaaccactgttcctgcccgagctg

SEQ ID NO: 26149 - DNA, 201 bp, Homo sapiens
actcaggctggctgtgggctgcccaggaggccgggcggggaagtgggtcccatacatggcctcggggtgtcctagtgaaggctgccctgcacctgagggcmtcaagatttgctggtatgaatcaatcgcttgcagagtgtatgaaggtaaacacaggatggaaaaaaacaaggacactctgcccttgaacttcaatcaaaa

SEQ ID NO: 26150 - DNA, 201 bp, Homo sapiens
cagtgtcataccccggatgggactcaacccaactctagtccatgctcacacctaccactacattctgtgcctgtgtgcgcatgtgagcactgcgtgtacayatacacgtagacttacagagcagctggaccacaggctgtgactcccctgtaaggagcccggccacctctcccagccttagggacagtagttacctgaaca

SEQ ID NO: 26151 - DNA, 201 bp, Homo sapiens
agagcactcctgcagaagccaccaggccctgtgcttggggagctgttgaattcagttctccgcagtcctcttagtaggggttaattcctgttttatagagraagaaactgaagcccaaggtcacatgggtaagacaaagcagagtcaggatccagacccaggtctgttattcattcttctcttttatgagtcctcaaagtt

SEQ ID NO: 26152 - DNA, 201 bp, Homo sapiens
cacacacacacacacacacacacacacacacacacacacacggagcaggaaatgttcaccgcgtgctcttttcttttgtttttgtttacactggagcgacrtgtgcccatggatgcctggccttgctgctctgtcccctgcccctcgagctatatggggctccctccaggaccgggctccccaccctggtctatctgaccc

SEQ ID NO: 26153 - DNA, 201 bp, Homo sapiens
ctggccccttctctcctccgtgacacccctggtaaacagacacccaacaacatcccgcagggtggaggtggggagtgaaccttaaccaacagcacgcttgyccaaattatttctcaagtaatggaggttctgcagggagagcttctttctcaggttagaactggtcaaaagacacagaggtggggttcagaagaagatttc

SEQ ID NO: 26154 - DNA, 201 bp, Homo sapiens
aggagtgatctgaagatgaaagttaactgccagacagaagttaatggttgaaacttatcagttaggccactgagcgtctgttgacgcccaggatgaatgtytagggacagtttctgaagaagccataaactctaggtcccgtgttttccatggcagaggaccaagtctttgccctgggcctgtctggtggaagtgaaaaag

SEQ ID NO: 26155 - DNA, 201 bp, Homo sapiens
atgtggctcacatgaataagcactgcattccaggaagcaaaacagttgaaatcccaaactttcaagtgattgtacatacattatgtgacttccctgaaacktaagtaagtattaacataaccaacagctaagagaaagttatttttctgtttattacagaaacctattattcactttttttatgcaggaagaaagtgaggc

SEQ ID NO: 26156 - DNA, 201 bp, Homo sapiens
tgaagttttcatccccagatattcagttttactctttctctctttctttccacgtaatgattttcttttctcgaaaaataatcactggggccaggcacagmggccgacgcctgaattcccagcactttgggaggcaaagttggcaggcttatttgaggttatgagttggaaaacagcctgggcaacagtaagacccccatc

SEQ ID NO: 26157 - DNA, 201 bp, Homo sapiens
ccaattcctctgattcctgtcggattcgaaaagtaacgaacacttaatgagatggcggctcagggactggaacaactcttttgactgcccccaatgccacsctcactcttctgatggagtgtatcaattttttgaaagtaacacccacatgacttgatcctggttttaacagagggtacgcctctcgcacttgagacagga

SEQ ID NO: 26158 - DNA, 201 bp, Homo sapiens
ttcaaaaaatattgatacaagcttaaatgtatgtaaaagaaagaaagaaaagcataaaactcattccattgaatcaggtaccccagacacgccagacagcrcgtggggatggagggtcaggaggaggggatgcagatttgaggaaaggctccgtgcttgtctgtaactcaggagctggaattctcaagaatactcaggcag

SEQ ID NO: 26159 - DNA, 201 bp, Homo sapiens
gcaggggtgatttaacatatagaagtcaataaatgtgatacaccatacaaacagaattaaaaacaaaaaccatatgtcatttcagtagatgtgaaaaaggyattcgataaaatctagcatccctttatgataaaaacactcaacaaactaggcatagaagggacttacctcaaaataataaaagccatgtatgacaaaccc

SEQ ID NO: 26160 - DNA, 201 bp, Homo sapiens
gacacccaagggcagccttccgctgtttggagactctgacacgggcagtagaaggttcgtctgcacaggtctcttctatgtaaaatatgtagaaaatgaargttatccttttagagctcagctggaaaaaccaacactcgatgcacatgttggccatcctgagatggggtcctcccagcaaaccttctacaatgtgtgctg

SEQ ID NO: 26161 - DNA, 201 bp, Homo sapiens
catgcttgctagatgaaccagttgattaacggataccacaaagactactggaaattaccaaccacttacgagtacggaaagacagctaaaaccacaccacrtgacacacgtatttcactagcaatggaacattcatgggtacagagtctatgcgtaatgtccttaaatgagggctcctcttttattttaaggagaacagag

SEQ ID NO: 26162 - DNA, 201 bp, Homo sapiens
tgggacaatcctgagtgtgaatctacagatttaagcatcttctggagatctgtttatctttcctctcttgcttctttctcctcagctgcagtgccagggamtaaagtgatttcaaaggtgggctccaggtggcagcaagtccactgaggaaaaaacatttaaaaattcttcccggacagtctgctccccccacccaaacac

SEQ ID NO: 26163 - DNA, 201 bp, Homo sapiens
atgccaggtctcctctcagaaacacaggtgctggtctcacgcagctcccactctgcgggctcaggccctttgcaggcatgatgcactcagctccctggagmtgagagactgtctctctccttccacttacccatcagaaaacaaaacaaacttttatccagatccttctctgtgttagatgccaggagtgtgatgaagact

SEQ ID NO: 26164 - DNA, 201 bp, Homo sapiens
aaagtaacgagtttggctgggagcaacggctcatgcctgtaatcccagcactttgggaagccgaggggggcggatcacaaggtcaggagatcgagaccttyttggctaacatggtgaaactccatctctactaaaaatacaaaaaaattagccgggcgtgatggcgggcgcctgtagtcccagctactgggttgaggcagg

SEQ ID NO: 26165 - DNA, 201 bp, Homo sapiens
gtggtgtgtgcctgtaatcccagctactcgggaggctaaggcaagagaatcacttgaacctgggaggcagaggttgcaatgagctgagatcatgccactgyactccagcctgggcgagagagcaaaactctgtctcaaaaaataaaaataaaaataaaaaaataaaatgtcagggggaggggggagggatagcattaagag

SEQ ID NO: 26166 - DNA, 201 bp, Homo sapiens
ggtggagacataagggcaccacagtgagcataatggtccctcaaagcaactacatggagggttttccggtgcaggccaacttctactaaggcaaaagccgycttcctgaggccatgcacccctcccctatgaagatgtgtttccacaacgtgggaggctccagaggccacacagggatgctgtttagaccgtgtgcacgcc

SEQ ID NO: 26167 - DNA, 201 bp, Homo sapiens
caacttctactaaggcaaaagccgtcttcctgaggccatgcacccctcccctatgaagatgtgtttccacaacgtgggaggctccagaggccacacagggwtgctgtttagaccgtgtgcacgccagcacagccctgccagccacagccgatcttgggccctgaacagacgctccttttagttccagcatcctgctggctc

SEQ ID NO: 26168 - DNA, 201 bp, Homo sapiens
ccctcggtggccacggaccctgctctatctggcacatggccagtagcacactgctggaaccgtgtcagaggtgaggctgtgtctcattcactgtcacatcmccagggcttcctacataggaggccagcagggaggggtcccctgctgaggattcattgcatggtaggcaccccgtctccagcccacctgcagctctgcaca

SEQ ID NO: 26169 - DNA, 201 bp, Homo sapiens
taaagattttagaacatgagaacatgaactctttcaacagcataaaaggaaagaagttttttttttttttttttttgagatggagtctcgctctgttgccsaggctagagtgcagtggcatggtctcggctcactgcaacctccacttctgggttcaagcgattctcctgcctcagcctccggagtagctgggactacagg

SEQ ID NO: 26170 - DNA, 201 bp, Homo sapiens
tggtctcgaactcctgacctcgtgatccatccgccttggcctcccaaagcgctgggattacaggtgtgagccaccgcacctggcccttttttttttttttwaaagacaaaggctagaaaaaagaggtaccttgctgatgttaatcaaagggaagttggagtggctatatcagacaaagtaggctacagatcaaagaacatt

SEQ ID NO: 26171 - DNA, 201 bp, Homo sapiens
ccatttctaatagggtaaatcgtgatgaatacaaaccacactgacaagagccctttagggtcttctaggaccctagcagtgggtgcccgagacccgcagcrcgagggcaaccccgttcattctccttgcctgaggctctcagaatggggtaaggacccaactttgaccaacagaaaggtaagtgaattctcccaggggctt

SEQ ID NO: 26172 - DNA, 201 bp, Homo sapiens
aagaggagaaagggaggaagagaggaagggaggaaggaaagaaagggaggaagagaggaaggaaggaagggagggagggagggagggagggagggagggaraaaggaagagagaaagaaagaatttattaggccttgttactagcaaattcagatcattcattcctagtgaagaccatatgaagaaaggccactacttaca

SEQ ID NO: 26173 - DNA, 201 bp, Homo sapiens
accaatttttgtaactttgtagagacagggttttgccatgttggccaggctggtcttgaactcctgacctcaggtgatctgcctgcctcggcccagtaagsatcttttaatgggatttctatcaggtcagaaagtcttggactgagatccaaaagcctgccatgcaggctgttcagagaccacctctacactgtgcaggct

SEQ ID NO: 26174 - DNA, 201 bp, Homo sapiens
gtacctctgcactgccagctcagagagctcttggattgctttctgaggacagaggcagtagcagccagctgtcccaggtggggacaaggatcaggtcttaytcagctccaaagtctgtccaagctgagacaccctgcgggttcagtacttctttgctaagtcggtgagctctgaaggggtgaagaggtgaggggtgaacag

SEQ ID NO: 26175 - DNA, 201 bp, Homo sapiens
tgtgagtccattaaacctcttcttctttataaattacccagtctcagatatggctgtattagcatcatgagagccgactagtatacttggcgatatttatyaggtggatatgaaatgcctagaagtaacctagtggtcccgcttctgaggagattgagaaaggaaatattctgtaaccacataggatagctaaccttcagg

SEQ ID NO: 26176 - DNA, 201 bp, Homo sapiens
gttctacggagcacacatcaaccaactgacaccaagtgccccaaagcctctctccagcagagaacaggcatgcctgcgcctgcctatgattgtccaactgyacctgacccaagaccatccaatgccacttgacaggtgctcttggccagaggtgaagattcagtgcccagtaagagttaccaggaaggcacccaccagacc

SEQ ID NO: 26177 - DNA, 201 bp, Homo sapiens
tcttctgggtgggatttaaccaggagcctggatctttaaaaccttccagaaagcaagcactcagctgcacgggagcagcactctaccacattgctattaayagtaaacagtgcatctgctttaggccagcccatgagtccaaagagaaaacacatcataaaaagccactgaatggcaaaactatctgagagtggaaaagta

SEQ ID NO: 26178 - DNA, 201 bp, Homo sapiens
cttttctataaacacagggagtttaaaatccgagctgcttctgatttccccactcctagtgaatcaagctgtccttactgggaaccaacgacctgcaatgwcccctcagtccacaatttccatttggggagacagacagagtgaaagaatagcttccctttccttagtctagtctgcagcatggtagcacacaaagatgag

SEQ ID NO: 26179 - DNA, 201 bp, Homo sapiens
acttgaaatatttcataatgacgttttggatgaattaatttaatttgacaaggaatttgttatttacaaaaagccatgttcccaagtgacatggaaagtaraaccactgcaaatgtctgcactttctacaactggaaggaatccaaggtggccaaacacagaagccaagaagagtgaatgaaaagcctgagccagtgcttg

SEQ ID NO: 26180 - DNA, 201 bp, Homo sapiens
tctcttattctttgaagatgtcccatttatattcaaggttttgatcagactggaaagaaaacacatttaccagtttagttggtgttgtgtagagaattctmatgttgaaacagtgaaaacagcgtttttcttcatagtgagtgtttcccaagcagtttttacacttgggatgcactaagtgaggccagttcctccagggac

SEQ ID NO: 26181 - DNA, 201 bp, Homo sapiens
tctgacgcccatcgcacacttggttggccctgaagcatcagaaaagtttactttcattccaaatgatggaattctcacttgcctggctttcaggatttttygtaaacttgttcatttgctctttctctacatgtgtgcatatataagtgcatggcctgtaagaagtgctcagaaagtggcaaatgcctcaatctaggcaga

SEQ ID NO: 26182 - DNA, 201 bp, Homo sapiens
gctttcagtcagggatgaaagtgagcctcacaccctctgaatgggcgtgtgcatctgtctaaacaaataaatggattcaaaatatgacttacaataaacarggacaaagattcctctaacatcacaaagttctatatatactctggaggatgccaatgaaaaggcattcaaataaacatcttcaggtgctagaatcacttc

SEQ ID NO: 26183 - DNA, 201 bp, Homo sapiens
tatgagaactagagaatatggacataaagtacccagctcataggctccaagtaagagtactcataattactattaaaggctcttcccatagtggacagggscttgcatccgctccctgggctcatctctttaccgcctgccctgttcctagcagtccactgcaggcatgcacctgccctgtggccttggcttttgtctttc

SEQ ID NO: 26184 - DNA, 201 bp, Homo sapiens
gcacctttacccactggaactcaggctcactgagggcagggagtttgctttattttgctctcccttgcatttctagcattagtgaacagcctctgacaccyggtgaatattgagtgacaggctaaaagtttgagctttttcacacatgacaaaatgtggggagctattttggaaagctcagctgccttagcaggcaaaaca

SEQ ID NO: 26185 - DNA, 201 bp, Homo sapiens
tccaaaggcgaaggccatgtgggccatcagcctttctgagttctaggagtcggcctcatgcttccaacactgactgcacacaacttccatgagcatttggyggtcaagagggaagcttctacactaggagcatctgactgctggggtcctcatgaggcatgacgtggcagcagtgaccacaggatgagccggaggcttacc

SEQ ID NO: 26186 - DNA, 201 bp, Homo sapiens
ggggaggggcacaagattgaattttcctagcagggcatgacggggtaccgcaagctgcggtcagggaacgcacagagagaaagcaactcagagcagtgacrcatgggctcaaatgcaaaagcacgaaggcgggaaggactctttgtggttacactgggagcaggaacagggttccaggcgggactcctggagtgggagcct

SEQ ID NO: 26187 - DNA, 201 bp, Homo sapiens
agaaaggaggagccagacaacaaaactgggaaaactggttactccatgaaaaacatcatcataataataacagaaataccatgaatttcagatgcatcaaycatagaactgattcggaattggaaaagctgaaatgaattattagaataaaatatcagagaacatctttgtgactttggaaaagggcagacattctacaac

SEQ ID NO: 26188 - DNA, 201 bp, Homo sapiens
gattgtcatgcaacttacattccctgtgcacctactgggctctaggccctttgctgagactcaggatacccaagaaacagcagtgcatcgcatcatagtasgggcagtcggcccaggggagcagatagattcataaacaaatgatcagaacacagcagttcctccatcgtcctgacaatgcccacactccctgccccaccc

SEQ ID NO: 26189 - DNA, 201 bp, Homo sapiens
atctccctcaagataagataatggacgtcatagagcagctgaactctacaaagtggtctgaacaggagggatgctctcacatgttccctcacaatgtggamtatctgtgcgctcaagcaaatgcattcactcagacgcatgcacgcatgcacacacatgcaatcacaggtgtgtgcactgcttgtcctcatatgcatgaac

SEQ ID NO: 26190 - DNA, 201 bp, Homo sapiens
ggaagtcttgatgttttctgttttcaggcagaattcccagagaatctggctttcctttagaaacggcacatgggacacagatgacatgtgctgaactttgycacagcccttctaaggaaaggtcactttagcctggtggctcaacagctgaagtcccgaggagtcctggtccaggatcatcattttgtcctacaaccactg

SEQ ID NO: 26191 - DNA, 201 bp, Homo sapiens
gtcaagactatgaatagcttttttttcttgtgaattctgtagcttccaactttgccaacttgaaaagaaatcccacccaagtctaaaataattaatcgttytggatacaccgacctgctttacatccattctgactagaagccttacctaggcctcttggaagagcaagaagctctcatctgtggccctcatctgtgggtc

SEQ ID NO: 26192 - DNA, 201 bp, Homo sapiens; identical to SEQ ID NO: 25334

SEQ ID NO: 26193 - DNA, 201 bp, Homo sapiens
tttccgattcataccatgcctaatgggtaggctactcactttgctgatgcaagggtctcattctcaacccactggttttcggtggtaccattctccttcakgctggctctatgttcttcatgggcagcgtctccacggtcatgcaccatgccactggcttctggaccccgaaggtgctatggagcccagctccattccact

SEQ ID NO: 26194 - DNA, 201 bp, Homo sapiens
tgaattgtatatgtttaatcatgcaaattttacgcattgtggatttcatgggtcctttggctccctggttttgagtaaaagtgaggaaccacaaatgcccrgattgagaggcctgagtcacctcctctggagcagttccgccctccttccagcacggggcagccctggtcactgggaaatcagcttcctcagctcgtccag

SEQ ID NO: 26195 - DNA, 201 bp, Homo sapiens
aagttataaacaagcctgtgagtcaccctctgcttctcctagcatcaactgtcaagtttgccagcctctctgtgtcccagtaacaggctccacaaggcagraggggactgattaacccacagcgggggaccgccagacaaggcctgcccaatgcccacattcactgctcaaccccatgaccccattgttgccttgttagtt

SEQ ID NO: 26196 - DNA, 201 bp, Homo sapiens
ttaaccacatatgaaatttgcatttaactaggaggttaaaatgtgaaagtcagggacctgaaagtccaagaatgagccagaaaaggaacggtagaaatacyggcctgcatcacagaatatgcccctaacccttctccatctatcatcaccatcagtatcatcacgatcagcatcatcatcacaatcgttaccattgccatt

SEQ ID NO: 26197 - DNA, 201 bp, Homo sapiens
atctgagcagttgctcatctgagaattgatgtgcttcaggcacgaagcctatgtattatatgaacccaaacatctctccaaaatttggctagtgtcttacrtgcactcagtccccgatgcagtatttgtgaacacgatctgggggtctcagcacaaagcaaaaagggggagaggagacattttcccaggacaagtctgctg

SEQ ID NO: 26198 - DNA, 201 bp, Homo sapiens
aaccattcgcgcggtagtcacacacacactatgcttctcacgcccactgctgcaaacaccttcgtgggaagaggaaaatgaatgatcgtgtgttctgttaycctgtgagaagagtgagcctttaaaaagtgaataaacaccattccagttgtcgcaaaatctctactaataataagcaaaatgccttaaaagcacagtatg

SEQ ID NO: 26199 - DNA, 201 bp, Homo sapiens
agactccatctcaaaaaaaaaaaaaaaaaaaagtcattatcctataattcttttgttatttgtctatgaacaatcaggccatttaaccaaccttcttgaargcaaagagaaaatggcaggcagccagatataatgagaattaattagtgaccaccccaacactggaaaagcattttcatggtttccgatgagaatcaaagt

SEQ ID NO: 26200 - DNA, 201 bp, Homo sapiens
cttgaactcctgagctcagatgatctgcccacctcagcctcccaaagtgctgggattacaggcaagagccaccatgcctggcaaaatttaccatcttaacyctttttttgaggctggagtgcagtggtgtgatctcagctcacttcagcctccacctcccaggttcaagtgatcctcccacctcagcctcctgggtagcta

SEQ ID NO: 26201 - DNA, 201 bp, Homo sapiens; identical to SEQ ID NO: 4586

SEQ ID NO: 26202 - DNA, 201 bp, Homo sapiens
ctcctgggtagctaggattacagacacgtgccaccatgtctggctaatttttatatttttagtagagacggggtttcaccatcttggccaagctggtctcraattcctgacctcaagtgatccacctgccttagcctctcaaagtgctgggattacaggtgtgagccactgcgccccctccatcttaaccatttttaagtg

SEQ ID NO: 26203 - DNA, 201 bp, Homo sapiens
ttttaaaaaaataagagctcatggtacctatttgcatccagtacatcattgaagcttgtagaaagctgcttagttaaagtgaggttgggtcacttcgaagyagtcctccagttttctaagcaagtaagttttggaggtagaaagaaaatgttctcctttatcctagaggctcgactgtggtatggtgggcccgggtcattg

SEQ ID NO: 26204 - DNA, 201 bp, Homo sapiens
ctatttgcatccagtacatcattgaagcttgtagaaagctgcttagttaaagtgaggttgggtcacttcgaagcagtcctccagttttctaagcaagtaarttttggaggtagaaagaaaatgttctcctttatcctagaggctcgactgtggtatggtgggcccgggtcattgatttgctttgtccttaattggttgctc

SEQ ID NO: 26205 - DNA, 201 bp, Homo sapiens
gactgtgcagtgaatgttccctgatctcctgtggtgctgacatcccgtgtttcttcatgcagagaatggcatcatttcctggtggtcaacatgaagggcartgacatcagcagtggcacagtcctctccgattatgtgggctcggggcctcccaagggcacaggttagtaaaggttgtttttggtgggaggttggggaggg

SEQ ID NO: 26206 - DNA, 201 bp, Homo sapiens
acccgctgcatgtcacctacgccggggcggcggtggacgagctgggcaaagtgctgacgcccacccaggtacaccgggcggcgggcgtgcagcgagcggcmcggcgcggaggcctgtgccggcctcctgggtgggacccagcggagacagggccaggggcggtggggaggttcagcctgcgtgtgtcgaggcccccccagg

SEQ ID NO: 26207 - DNA, 201 bp, Homo sapiens
aacctcctgatcaccaaatccagaaacgctgtgattccggacagacaatgtaagggtgtcgttgagaggggactcagtgccagggttggaatcccagcctyatctgtttctcttaatagtgtgctgggatactagccccatggtgttgttgggactgaaataatatacagcctgggcaacatagcaagaccccaactctac

SEQ ID NO: 26208 - DNA, 201 bp, Homo sapiens
acagatcggaagggttcagtcagcaaatgtgatcaatgcatacacccatggaaggtagcagccattggaaagacagatgacatttccatcgcccaacgacrttctcatgtgacctttttacttaaattcccccagagctaaccatattctgactcctgtctccataaatcactttcactattcttttttttttttctgaga

SEQ ID NO: 26209 - DNA, 201 bp, Homo sapiens
gagatcaaagaaagagtattggtttcttcagcatttcttgtttttgagacagagtctcactctgtcgcccaggctggagtgcagtggggtgatcttggccscctgcagcctctgcctccccagctcaagtgatcctcccacctcagcctcccgagtagctgggattacagattcccgccaccatgcccagctaatttttgt

SEQ ID NO: 26210 - DNA, 201 bp, Homo sapiens
ccacctcagcctcccgagtagctgggattacagattcccgccaccatgcccagctaatttttgtagttttagtagaggcaggtttcaccgtgttggccagsctggtctcaaacccctgacctcaagtgatcctctctcctaggcctcccaaagtgctgggattacaggcgtgagccaccacacccagccagtttcttcagc

SEQ ID NO: 26211 - DNA, 201 bp, Homo sapiens
gctgcacgctctgcttggcctcgccatgccggtggacctcagcaagtggtccgggcccttgagcctgcaagaagtggacgagcagccgcagcacccgctgmatgtcacctacgccggggcggcggtggacgagctgggcaaagtgctgacgcccacccaggtacaccgggcggcgggcgtgcagcgagcggcacggcgcgg

SEQ ID NO: 26212 - DNA, 201 bp, Homo sapiens
ttttagtagaggcaggtttcaccgtgttggccaggctggtctcaaacccctgacctcaagtgatcctctctcctaggcctcccaaagtgctgggattacargcgtgagccaccacacccagccagtttcttcagcatttctgacttttttactgcaaactggttccttcatacaggttaagaatagacccaccagcatttc

SEQ ID NO: 26213 - DNA, 201 bp, Homo sapiens
gaatggtttttacatttttatttagttatttattttttatttttttgagacagagtctcagtcacccaggctggagtgcagtggcatgatcttggctcacwgcaacctccacctcccaggttcaagtgattctcatgcctcagctaaccgagtagctggaattacaagcgcccaccaccatgcctggctaatttttgtatt

SEQ ID NO: 26214 - DNA, 201 bp, Homo sapiens
ctgaggcagagaattgcttgagcccaggaggaggagcttgcagtgagccgagatcgtgccactgcattccagcctgggtgacagagtgagactctgtctcaaaaaaaaaaaaaaaagaaaggactgttgttcgtggctgtgttgtggcagccagcatgttcttgatgcccagttgctgactgtgcagtgaatgttccctga

SEQ ID NO: 26215 - DNA, 201 bp, Homo sapiens
tgaggcagagaattgcttgagcccaggaggaggagcttgcagtgagccgagatcgtgccactgcattccagcctgggtgacagagtgagactctgtctcaaaaaaaaaaaaaaaagaaaggactgttgttcgtggctgtgttgtggcagccagcatgttcttgatgcccagttgctgactgtgcagtgaatgttccctgat

SEQ ID NO: 26216 - DNA, 201 bp, Homo sapiens
taggcaggttaattatgggaagcttacccatgagaataaggcaattctctcaagtaagagctgtgttctcattttttttttttgagatggagtcttgctcygtctcccaggctggagtgcagtggcacgatctcgctcactgcaagctccacctccccggttcatgccattctcctgcctcagcctcccgagtagctggga

SEQ ID NO: 26217 - DNA, 201 bp, Homo sapiens
tagtcccagccacctgtggggctgaggtgggaggatggcttgaacccgggaggtggaggttgcagtgagctgagattgtgccattgcgctctagcctgggygatagagcaagcctctgcctccaaaaaaaaagtatcatgcaatgtgtattttaaaaaatttgggtgactggtctgcttcattccagataatatctgtgag

SEQ ID NO: 26218 - DNA, 201 bp, Homo sapiens
aagacaaataccgtacaattctatgagatacctaaagtagccaagctcactgaaacaaagtggagtggctgccatgcattctttttttttttttttttttwaatttttttttttcttgagacagagtcttgctctgtcacccaggctggagtgcaatggtgtgatcgcggctcactgcaacctccacctcccaggtttaag

SEQ ID NO: 26219 - DNA, 201 bp, Homo sapiens
gaggcaggagaattgcttgaacccaggaggctgaggttgtagtgagccgagatcatgccactgcactccacgcctaggcaacagagtgagactccgtctcaaaaaaaaaaaaaaaaacccactttttaaaaaaataagagctcatggtacctatttgcatccagtacatcattgaagcttgtagaaagctgcttagttaaa

SEQ ID NO: 26220 - DNA, 201 bp, Homo sapiens
gcctctccccacaggcctccaccgctatgtctggctggtttacgagcaggacaggccgctaaagtgtgacgagcccatcctcagcaaccgatctggagacyaccgtggcaaattcaaggtggcgtccttccgtaaaaagtatgagctcagggccccggtggctggcacgtgttaccaggccgagtgggatgactatgtgcc

SEQ ID NO: 26221 - DNA, 201 bp, Homo sapiens; identical to SEQ ID NO: 4598

SEQ ID NO: 26222 - DNA, 201 bp, Homo sapiens; identical to SEQ ID NO: 4618

SEQ ID NO: 26223 - DNA, 201 bp, Homo sapiens; identical to SEQ ID NO: 4620

SEQ ID NO: 26224 - DNA, 201 bp, Homo sapiens
aggttggggagggagctcgggggcacattaggattgacccaatgcttttcttttgagagcccttaaccctgctggaaatagcatctcagcttacctctagrgcagctgccttcagggcacacattcagacctgcagcagtgtcaggtggctagagccttgggttctggacagacggaccctttgtgtagagctgtctctgc

SEQ ID NO: 26225 - DNA, 201 bp, Homo sapiens
tcatttcttgaaacaacagccttgcaggccgagccgctgttcccgagaactcggcagccacagggagcaggttgcatggacccaggagcgcgagaggcccygctctgccagcttcggccaatcagaggccagggagcggtgggcgtgacgtggggcggtgcgcggggctgggcggcggctgaggcgcgtgctctcgcgtgg

SEQ ID NO: 26226 - DNA, 201 bp, Homo sapiens; identical to SEQ ID NO: 4589

SEQ ID NO: 26227 - DNA, 201 bp, Homo sapiens; identical to SEQ ID NO: 4603

SEQ ID NO: 26228 - DNA, 201 bp, Homo sapiens
gcggcggtggacgagctgggcaaagtgctgacgcccacccaggtacaccgggcggcgggcgtgcagcgagcggcacggcgcggaggcctgtgccggcctcytgggtgggacccagcggagacagggccaggggcggtggggaggttcagcctgcgtgtgtcgaggcccccccaggccagaggtcccggggtccatgtccca

SEQ ID NO: 26229 - DNA, 201 bp, Homo sapiens
gtgggaggggctgggtctgctcttctgcaaacacatgaggttcgtgctggcctctaagaaagtgaggactgggccgggcgcggtggctcatgcctgtaatyccagcactttgggaggccgagtcggggggatcacgaggtcaggagttcaagaccagtctggccaacatggtgaaaccccgtctctactaaaaatacgaaa

SEQ ID NO: 26230 - DNA, 201 bp, Homo sapiens
taattccagcactttgggaggccgagtcggggggatcacgaggtcaggagttcaagaccagtctggccaacatggtgaaaccccgtctctactaaaaataygaaaattagccaggcatgatggcaggcgcctgtaatcccagctacttgggagcctgaggcagagaattgcttgagcccaggaggaggagcttgcagtgag

SEQ ID NO: 26231 - DNA, 201 bp, Homo sapiens
gcctggccaacatggtacaactctgtctctaccaaaaatacaaaaattatccaggcatggtggcatacgtctgtagtcccagccacctgtggggctgaggygggaggatggcttgaacccgggaggtggaggttgcagtgagctgagattgtgccattgcgctctagcctgggcgatagagcaagcctctgcctccaaaaa

SEQ ID NO: 26232 - DNA, 201 bp, Homo sapiens
attctaggactatttagctttgaaaagaaatttgggcacatgctacaccaggatgaaccctgaggaacattatgttagtgaaatgagccagtcacacaaasacaaataccgtacaattctatgagatacctaaagtagccaagctcactgaaacaaagtggagtggctgccatgcattctttttttttttttttttttaaa

SEQ ID NO: 26233 - DNA, 201 bp, Homo sapiens
ctcctgggctcaagcaaccctcctacctcaggctcccgagaagctgggactacaggcacaggctacctaccacatccagcaaatttttgtatttctagtaragacggggtttcgccatattgcccaagctggtctcaaattcctcctgggctcaggtgaccctcccaccttggcctcccaaagtcctgggattataaatgt

SEQ ID NO: 26234 - DNA, 201 bp, Homo sapiens
atgccggtggacctcagcaagtggtccgggcccttgagcctgcaagaagtggacgagcagccgcagcacccgctgcatgtcacctacgccggggcggcggyggacgagctgggcaaagtgctgacgcccacccaggtacaccgggcggcgggcgtgcagcgagcggcacggcgcggaggcctgtgccggcctcctgggtgg

SEQ ID NO: 26235 - DNA, 201 bp, Homo sapiens
ggaagggttcagtcagcaaatgtgatcaatgcatacacccatggaaggtagcagccattggaaagacagatgacatttccatcgcccaacgacgttctcawgtgacctttttacttaaattcccccagagctaaccatattctgactcctgtctccataaatcactttcactattcttttttttttttctgagatggagtc

SEQ ID NO: 26236 - DNA, 201 bp, Homo sapiens; identical to SEQ ID NO: 4593

SEQ ID NO: 26237 - DNA, 201 bp, Homo sapiens; identical to SEQ ID NO: 4617

SEQ ID NO: 26238 - DNA, 201 bp, Homo sapiens; identical to SEQ ID NO: 4619

SEQ ID NO: 26239 - DNA, 100 bp, Homo sapiens
acgtgttaccaggccgagtgggatgactatgtgcccaaactgtacgagcmgctgtctgggaagtagggggttagcttggggacctgaactgtcctggagg

SEQ ID NO: 26240 - DNA, 100 bp, Homo sapiens
tcccggctgcacgctctgcttggcctcgccatgccggtggacctcagcargtggtccgggcccttgagcctgcaagaagtggacgagcagccgcagcacc

SEQ ID NO: 26241 - DNA, 100 bp, Homo sapiens
cagcaaccgatctggagaccaccgtggcaaattcaaggtggcgtccttcmgtaaaaagtatgagctcagggccccggtggctggcacgtgttaccaggcc

SEQ ID NO: 26242 - DNA, 100 bp, Homo sapiens
ccccggtggctggcacgtgttaccaggccgagtgggatgactatgtgccmaaactgtacgagcagctgtctgggaagtagggggttagcttggggacctg

SEQ ID NO: 26243 - DNA, 201 bp, Homo sapiens; identical to SEQ ID NO: 14360

SEQ ID NO: 26244 - DNA, 201 bp, Homo sapiens; identical to SEQ ID NO: 4629

SEQ ID NO: 26245 - DNA, 201 bp, Homo sapiens; identical to SEQ ID NO: 4628

SEQ ID NO: 26246 - DNA, 201 bp, Homo sapiens; identical to SEQ ID NO: 4631

SEQ ID NO: 26247 - DNA, 201 bp, Homo sapiens; identical to SEQ ID NO: 4626

SEQ ID NO: 26248 - DNA, 201 bp, Homo sapiens; identical to SEQ ID NO: 4681

SEQ ID NO: 26249 - DNA, 201 bp, Homo sapiens; identical to SEQ ID NO: 4683

SEQ ID NO: 26250 - DNA, 201 bp, Homo sapiens; identical to SEQ ID NO: 4671

SEQ ID NO: 26251 - DNA, 201 bp, Homo sapiens; identical to SEQ ID NO: 4673

SEQ ID NO: 26252 - DNA, 201 bp, Homo sapiens
aggtagagttctcaaggagcaacttttatacaactgattactattgctttacctggagtaaatatttgcctctttgcaaagctggcaatggggctcaatamgtctgcttccaccttccagcttactggcttcccaggcatggagaaggcacatcactggatattcatcccattattggcagcctacatctccatacttctt

SEQ ID NO: 26253 - DNA, 201 bp, Homo sapiens; identical to SEQ ID NO: 4680

SEQ ID NO: 26254 - DNA, 201 bp, Homo sapiens; identical to SEQ ID NO: 4684

SEQ ID NO: 26255 - DNA, 201 bp, Homo sapiens; identical to SEQ ID NO: 4685

SEQ ID NO: 26256 - DNA, 201 bp, Homo sapiens; identical to SEQ ID NO: 4672

SEQ ID NO: 26257 - DNA, 201 bp, Homo sapiens; identical to SEQ ID NO: 4677

SEQ ID NO: 26258 - DNA, 201 bp, Homo sapiens; identical to SEQ ID NO: 4674

SEQ ID NO: 26259 - DNA, 201 bp, Homo sapiens; identical to SEQ ID NO: 4670

SEQ ID NO: 26260 - DNA, 201 bp, Homo sapiens; identical to SEQ ID NO: 4678

SEQ ID NO: 26261 - DNA, 201 bp, Homo sapiens; identical to SEQ ID NO: 4675

SEQ ID NO: 26262 - DNA, 201 bp, Homo sapiens
ttcacatcacaatgagctacatccacttccttttcccaccttttatgaacccatttatctatagcattaaaactaagcagattcagagtggcatacttcgyttattctctctgcctcactctagagcatgacattgtttcactggtctctgaggaataattcaggggacctggacaggatgacaatgttgccagcataagt

SEQ ID NO: 26263 - DNA, 201 bp, Homo sapiens; identical to SEQ ID NO: 4679

SEQ ID NO: 26264 - DNA, 201 bp, Homo sapiens
gcgtgaacccaggaggtggagcttgcagtgagccgagatcgtgccactgcactccagcctgggcaacagagcaagactccttctcaaaaacaaaaaaaaaraaaaataaataaatatctgtgctgttaagtatgtggtaaaagaggtattttcacataccagaatgaaaacataatttaatttgccttttataaaaaacaa

SEQ ID NO: 26265 - DNA, 201 bp, Homo sapiens
aataaaacttatactggccccttgaaagccaggctttccaccccaccatacccccaccccacctctctctctctgtcgctcgctcgctgtttctctctctytctctcacacacacacaaacaatattacatgcaatgaaaaccatttgcacattaacaaataggtacactgttacagtgacacttttcacttttagtaatg

SEQ ID NO: 26266 - DNA, 201 bp, Homo sapiens; identical to SEQ ID NO: 4695

SEQ ID NO: 26267 - DNA, 201 bp, Homo sapiens
tggaagaataggccttaggagatccgacttgcttcagaatggcacttagcacttacatgtgtgcatgtgtgcctgcattttttcttccttttttttttttkggggacggagtcttgctctgtggcccatcgcccaggctggagtgcagtggcgcgatcatagctcaccacaacctccgcctcccaggttcaaatgactcct

SEQ ID NO: 26268 - DNA, 201 bp, Homo sapiens
tagaaacggtttcaccatgttggccaggctggtcttgaactcctgacctcaagtgatctgcctgcctcagcctcccaaagtgctgggattacaggcatgakccaccactcccggcctcacttttttacattgattccgtgttgaaattgtaatgttttggatattaggttaaatacatatattactaaaattaatttcacc

SEQ ID NO: 26269 - DNA, 201 bp, Homo sapiens; identical to SEQ ID NO: 4710

SEQ ID NO: 26270 - DNA, 201 bp, Homo sapiens
gcagcagccaggctcctcggaagccggagggtgtgtgccagctctgcgttgccagcgggcagggggaggagctgtggggtcggcctcgcttctggacttasaggccgaggccaggttgtccgggaggaggagatgtagaatgagaggacagtgctgggggccgcggtcccccctgcgctctggcgagttggcggagctgcc

SEQ ID NO: 26271 - DNA, 201 bp, Homo sapiens; identical to SEQ ID NO: 13414

SEQ ID NO: 26272 - DNA, 201 bp, Homo sapiens; identical to SEQ ID NO: 13415

SEQ ID NO: 26273 - DNA, 201 bp, Homo sapiens; identical to SEQ ID NO: 4696

SEQ ID NO: 26274 - DNA, 201 bp, Homo sapiens
ccctcaaggtaggcctgggccccctggaacaggtgactctggtttccttgacttccacttaatgtttctttcatgggctttcctcttaaaaagtagtgcargctagggccaggcgcagtggcacacataagtgattaaaaatcttctggccactaaaaaacagaaattaattttagtaatatacttaacccaatatccaaa

SEQ ID NO: 26275 - DNA, 201 bp, Homo sapiens
ggaacagaagagtttgaaaatcaacataaaggcaaaataaaagtcaccctaagtctcctactttccaggcttagcattttggattatatccttccaaatayatagctttgctttgttttaaggaaaaatagtatctcaatagaattactggtcagagagtcaaggacgggtctgagtgtgttgaccagagtgcctcccaga

SEQ ID NO: 26276 - DNA, 201 bp, Homo sapiens; identical to SEQ ID NO: 4687

SEQ ID NO: 26277 - DNA, 201 bp, Homo sapiens; identical to SEQ ID NO: 4708

SEQ ID NO: 26278 - DNA, 201 bp, Homo sapiens
ctgtttcctagagggggccagctttggactcggtctgctctcagccttgttaaagtgtttgccgccaagtggtgatggtaagtgggaggttgatggggcayggcactgaaggtctcatttctttccctagaaaacagtccgggataaagaactggagggcctgcaggtaaaaatccaacggctggagaagctgtgccgggc

SEQ ID NO: 26279 - DNA, 201 bp, Homo sapiens
tggtgaggagagggagtttggacttgacgttctctgggccagtctgttctgccaggattcaaaggaaaacggtacttctcagagcagcaagtcactctagkctaatcaaagccagggatgtgggggccacggcatagagagatgcaggagttaccagcacaaagccttctgggttttggagcaactggagcttggcatggg

SEQ ID NO: 26280 - DNA, 201 bp, Homo sapiens
tgggtgagcagagggcggctctttgtgaagctggtgaggagagggagtttggacttgacgttctctgggccagtctgttctgccaggattcaaaggaaaayggtacttctcagagcagcaagtcactctagtctaatcaaagccagggatgtgggggccacggcatagagagatgcaggagttaccagcacaaagccttct

SEQ ID NO: 26281 - DNA, 201 bp, Homo sapiens
tggctgtgtcctggctgctatgacgccttggttgagcctttgttctctccggacctgcacagtacctatgtggtggtgaccaggtagttaggtgggctcasaggacttcatttgtagctcagaaatgtattgcttttgaggaggtaggaacagaagagtttgaaaatcaacataaaggcaaaataaaagtcaccctaagtc

SEQ ID NO: 26282 - DNA, 201 bp, Homo sapiens; identical to SEQ ID NO: 4706

SEQ ID NO: 26283 - DNA, 201 bp, Homo sapiens; identical to SEQ ID NO: 4711

SEQ ID NO: 26284 - DNA, 201 bp, Homo sapiens; identical to SEQ ID NO: 4709

SEQ ID NO: 26285 - DNA, 201 bp, Homo sapiens
gtgttctgagtgttggaagtacccaggaagaagccctgagcaggtgccctcaggagcagtgcccatggctccccacatcagccaagaggcccaaccccagraagccactcctgcccggggatggggaaggtgggctgggtggctgtgtgcactgccctgggccagctcacttgagcctgctgagccgcctggccaaacatg

SEQ ID NO: 26286 - DNA, 201 bp, Homo sapiens; identical to SEQ ID NO: 4707

SEQ ID NO: 26287 - DNA, 201 bp, Homo sapiens
gggtaagggtcagggcagctcaggagaccctagacctgcatagtgatccccccaccaggaaggccccacaagatgctcacctgccctccctatccctgtcyccagctggaggagcaccggaattcacagaagcagatgaagctcctacagaaaaagcagagccagctggtgcaagagaaggaccacctgcgcggtgagcac

SEQ ID NO: 26288 - DNA, 201 bp, Homo sapiens; identical to SEQ ID NO: 4694

SEQ ID NO: 26289 - DNA, 201 bp, Homo sapiens; identical to SEQ ID NO: 4712

SEQ ID NO: 26290 - DNA, 201 bp, Homo sapiens
aggtagttaggtgggctcagaggacttcatttgtagctcagaaatgtattgcttttgaggaggtaggaacagaagagtttgaaaatcaacataaaggcaarataaaagtcaccctaagtctcctactttccaggcttagcattttggattatatccttccaaatatatagctttgctttgttttaaggaaaaatagtatct

SEQ ID NO: 26291 - DNA, 201 bp, Homo sapiens
ggggtgcagtggcacgatctcggctcgctgcaagctccgccttctgggttcatgccattctcctgcctcagcctcccgagtagctgggtctacaggcgccygccaccatgctaggctatttttttttttttttttttttttagtagagacggggtttcaccgtgttagccaggatggtctcgatctcttgacctcgtgatc

SEQ ID NO: 26292 - DNA, 201 bp, Homo sapiens
cccgcctcggcctcccaaagtgctgggattacaggcttgagccaccacgcctggcctatttatttatttattcagagtcagagtctcgctctgtcaccagrctggagtgcagtggcgcgatctcggctcattgcaacctccacctcccaggttcaagcgagtctcctgcctcagcctcccgagtagctgggattacaggtg

SEQ ID NO: 26293 - DNA, 201 bp, Homo sapiens; identical to SEQ ID NO: 4692

SEQ ID NO: 26294 - DNA, 201 bp, Homo sapiens; identical to SEQ ID NO: 4690

SEQ ID NO: 26295 - DNA, 201 bp, Homo sapiens
gtctacaggcgcccgccaccatgctaggctatttttttttttttttttttttttagtagagacggggtttcaccgtgttagccaggatggtctcgatctcytgacctcgtgatccgcccgcctcggcctcccaaagtgctgggattacaggcttgagccaccacgcctggcctatttatttatttattcagagtcagagtc

SEQ ID NO: 26296 - DNA, 201 bp, Homo sapiens
tttttttttttttttttttttttaaataaagaaaagccagaaatctagagttatgtgagaactctagattttttcatagttagcagctaaaatggtaagakccaaacaaaacccatccgtgggttggatttggcacacatgcctgcgaattgcagtctccatgctgatctcttgggcccttctggggaggcagagggaagg

SEQ ID NO: 26297 - DNA, 201 bp, Homo sapiens; identical to SEQ ID NO: 4693

SEQ ID NO: 26298 - DNA, 201 bp, Homo sapiens; identical to SEQ ID NO: 4691

SEQ ID NO: 26299 - DNA, 201 bp, Homo sapiens; identical to SEQ ID NO: 4688

SEQ ID NO: 26300 - DNA, 201 bp, Homo sapiens
ctgcgcgaggaggtaagggtatcacggacagcagtcatggcccagaaattgtgaggttttgagtgtgtgctaggcactgggacagtaccttttcaggcttyatcccattctccctttcttcctcctcctcctccttgggaggagagtaatgttattcctcatagataaaaaacaggtgtggagaagagactcacttacagc

SEQ ID NO: 26301 - DNA, 201 bp, Homo sapiens
caagataaattcgtctctagctaattgacatgtggccagtttgaatttgaacatgctataaatgtaagatacacatcagcttttgaagacttaagcaaaamcaaagaatataaaacatctttttgtgagagagtgtctcagtcacccaggctggagtgcagtggcgtgatgtcctgcttccaggttcaaacgattctcctg

SEQ ID NO: 26302 - DNA, 201 bp, Homo sapiens
ccttttttttttaattaattaatttttttagacagagtctcgctctgtcaccaagctggagtgcagtggcgcgatctgggctcactgcaacctccgcctcstgggttcaagcgattctcctacctcagcctccggagtaactgggactacaggcgcgtgccaccacaccaagctaatttttttgtgtatgtctttagtaga

SEQ ID NO: 26303 - DNA, 201 bp, Homo sapiens
acgcctgtaattgcagcactttgggaggccgaggcgggtggatcacctgagggtcaggagttcgagaacagcctggccaacatgatgaaatcccgtctctwctaaaaatacaaaaattagctggacatgctggcacacgcctgtaatcccagctacttgggaggctgaggcaggagaatggcttgaacccgggaggcagag

SEQ ID NO: 26304 - DNA, 201 bp, Homo sapiens
tcacgcctgtaattgcagcactttgggaggccgaggcgggtggatcacctgagggtcaggagttcgagaacagcctggccaacatgatgaaatcccgtctytactaaaaatacaaaaattagctggacatgctggcacacgcctgtaatcccagctacttgggaggctgaggcaggagaatggcttgaacccgggaggcag

SEQ ID NO: 26305 - DNA, 201 bp, Homo sapiens
gccaactccccgcgtgggccgggggctgtctggggatatgcgcatgcgcgggcgtgcctcgcggcttgagggcgcgcggggcgtgggtggctgcgcgcgcsgggggcgcacgtggggcctgaggggcgggggcggtgccgggagtcccgccacgtcagtctccggccctgagccaatcccgcgcccggcctgccgcgaggg

SEQ ID NO: 26306 - DNA, 201 bp, Homo sapiens
gggaagccatcggacgtcggcggtgaggtacgtgcagcggcggccggtgggcgagactatttgagagtgtgcgggccgggatgttctcggcctgtggggamatcacgccaactccccgcgtgggccgggggctgtctggggatatgcgcatgcgcgggcgtgcctcgcggcttgagggcgcgcggggcgtgggtggctgcg

SEQ ID NO: 26307 - DNA, 201 bp, Homo sapiens
cagaggtggggaagccatcggacgtcggcggtgaggtacgtgcagcggcggccggtgggcgagactatttgagagtgtgcgggccgggatgttctcggccygtggggaaatcacgccaactccccgcgtgggccgggggctgtctggggatatgcgcatgcgcgggcgtgcctcgcggcttgagggcgcgcggggcgtggg

SEQ ID NO: 26308 - DNA, 201 bp, Homo sapiens
acctgtgatcagtgatggactccagagactgtgtccactgattccttgctgctcctgccactcaaaaggcagaatttatcaggctgggcgtggtggctcaygcctgtaatcccaacactttgggaggccaaagcgggcggatcacctgaggtcaggagttcaagaccagcctggccaacatggtgaaaccctgtctctact

SEQ ID NO: 26309 - DNA, 201 bp, Homo sapiens; identical to SEQ ID NO: 4689

SEQ ID NO: 26310 - DNA, 201 bp, Homo sapiens; identical to SEQ ID NO: 13423

SEQ ID NO: 26311 - DNA, 201 bp, Homo sapiens; identical to SEQ ID NO: 13424

SEQ ID NO: 26312 - DNA, 201 bp, Homo sapiens
taccggtcccggtgggagagcagcaacaaggccctgcttgagatggctgaggaggtgggctgtctgtgatctgcagccagggtgggggtgtgcacttagcrcatatcaggccctttcctgtatgttctacccatcagtgacacagctagcatgaggtagaggtgagatttgcacacaatgtccaagtccaaagttaatgct

SEQ ID NO: 26313 - DNA, 201 bp, Homo sapiens
cctgaccctgtgccttcaagtttccctcactgggccccatcctgggggtagtgaaatgggaccctcattctaggactggctgtgtcctggctgctatgacrccttggttgagcctttgttctctccggacctgcacagtacctatgtggtggtgaccaggtagttaggtgggctcagaggacttcatttgtagctcagaaa

SEQ ID NO: 26314 - DNA, 201 bp, Homo sapiens
acgtacatagggcattttgcaaggccttgcaaatgcatttatacctgtaagtgtacagtgggcttgcattggggatgggggtgtgtacagatgaagtcagyggcttgtctgtgagctgaagagtcttgagaggggctgtcatctgtagctgccatcacagtgagttggcagaagtgacttgagcatttctctgtctgattt

SEQ ID NO: 26315 - DNA, 201 bp, Homo sapiens
catagggcattttgcaaggccttgcaaatgcatttatacctgtaagtgtacagtgggcttgcattggggatgggggtgtgtacagatgaagtcagtggctygtctgtgagctgaagagtcttgagaggggctgtcatctgtagctgccatcacagtgagttggcagaagtgacttgagcatttctctgtctgatttgaggc

SEQ ID NO: 26316 - DNA, 201 bp, Homo sapiens
tcaggcacaaaggatgatatgtgctgaatgcccaggaaatggcagagacaacccacctgcccttccctccaggcctccacaaatagatgtgcccacaatgrctgtgacagtcccagcagagcctctgacccttctagctgggtcctgatacatgttttccatgctggccatgttatttctagtcgcagatcctctggaggg

SEQ ID NO: 26317 - DNA, 201 bp, Homo sapiens; identical to SEQ ID NO: 21501

SEQ ID NO: 26318 - DNA, 201 bp, Homo sapiens
gcattgcacttaaaaaaaaatcttccactttattttattttaattttttgagatggagtcttgctctgttgcccaggctggagtgtggtggtgtgatctcrgctcagtgcaacctctgcttcccaggttcaagcgattctcttgcctcagcctcccgagtagctggaattgcaggcgcctgtcagcatgcccgggtaattt

SEQ ID NO: 26319 - DNA, 201 bp, Homo sapiens
gacagaagccttctcagacatgcaaaaaacatgaggctgtcgggcgccgtggctcacacctgtaatcccagcactttgggaggccgaggcgggcggatcaygaggtcaagagattgagaccatcctggctaacatggtgaaaccccatctctactaaaaatacaaaaattagctgggtgtggtggcacgtgcctgtagtcc

SEQ ID NO: 26320 - DNA, 201 bp, Homo sapiens
aaaagggaaagcaatggcctggcttggctggagatggaacatgcatcaacgtgtcccacgtgtctccagcagggatagcgaaggcctgccccctggcacatggtagactgagtaaatgttgatcagtgagaccttgaggcactttagagtttcacaatccagagagggagatagattggaagttcaagggtggacacctgg

SEQ ID NO: 26321 - DNA, 201 bp, Homo sapiens; identical to SEQ ID NO: 21507

SEQ ID NO: 26322 - DNA, 201 bp, Homo sapiens
gtggtttgtaaagttcactggggagggtgatccctctttattgttctaatattatgctcgcagcctccttgacaacatcatgcaaaatgtgtcttactagyttctagtgcataaaatattggtggagctcttcgctgtgctgggccagtcaccagtgctgggcactgtgggtcaaggcagtgcccaggacgggcacagccc

SEQ ID NO: 26323 - DNA, 201 bp, Homo sapiens
ggctgcagcgggaccttggggtgtgggctaaataacaagaacaggggctcctctggggtctgttacaaggcagagatgctccacggtaattagggatttakgggaagaggaaggaacacacatgttgataataagtagttcaacattattatccccattttacagatgcagctactgagcttagagaggtttcataacttg

SEQ ID NO: 26324 - DNA, 201 bp, Homo sapiens
gagagtccagatgggagccaaagcagacatggtcagtggcctacaggagcttccgtccagctgtcagtcacataatcaccctgacaaatgtgagctcgacraaggctaggactgagagatctgccttgctgggataggtcaggagaggctacccagaggagggacagtcagtctgaaatctgaaaggtggatagaagttag

SEQ ID NO: 26325 - DNA, 201 bp, Homo sapiens; identical to SEQ ID NO: 4728

SEQ ID NO: 26326 - DNA, 201 bp, Homo sapiens; identical to SEQ ID NO: 21509

SEQ ID NO: 26327 - DNA, 201 bp, Homo sapiens
tgcagggtcttctctctccctccaccctgactgtgctctgtccccccagggctggacatccacttcatccacgtgaagcccccccagctgcccgcaggccrtaccccgaagcccttgctgatggtgcacggctggcccggctctttctacgagttttataagatcatcccactcctgactgaccccaagaaccatggcctg

SEQ ID NO: 26328 - DNA, 201 bp, Homo sapiens
ataagttccgtttcaccccacctttggaggacagctgcttccactatggcttcaactccaactacctgaagaaagtcatctcctactggcggaatgaattygactggaagaagcaggtggagattctcaacagataccctcacttcaagactaagattgaaggtatgtttgcaaaacgccagccagagagggatgtatgtc

SEQ ID NO: 26329 - DNA, 201 bp, Homo sapiens
gtgttttctggaaacagactttgctcttgtgctctgtccttcccatccctctcaacttggggtcctgaattttgctccaggacttacaccagaggatcgayaagttccgtttcaccccacctttggaggacagctgcttccactatggcttcaactccaactacctgaagaaagtcatctcctactggcggaatgaatttg

SEQ ID NO: 26330 - DNA, 201 bp, Homo sapiens
ctactggttcatctcccgggacaaagaggaaactttgccacttgaagatgggtggtgggggccaggcacgaggtccgcagccagggaggacgacagcatcygccctttcaaggtggaaacgtcagatgaggagatccacgtaaggcaccttgggccgggccgggctgggcagtggagagggtggtgtgtcgaagacagggg

SEQ ID NO: 26331 - DNA, 201 bp, Homo sapiens; identical to SEQ ID NO: 4767

SEQ ID NO: 26332 - DNA, 201 bp, Homo sapiens
ctgcttccactatggcttcaactccaactacctgaagaaagtcatctcctactggcggaatgaatttgactggaagaagcaggtggagattctcaacagayaccctcacttcaagactaagattgaaggtatgtttgcaaaacgccagccagagagggatgtatgtcatgagaacagccttcttccacaatgtgacttaca

SEQ ID NO: 26333 - DNA, 201 bp, Homo sapiens
gttcttcctctcaggctggagtgcagtgatcatagctcactgcagcctcaaccacctgggctcaagcaatcttcccacttcagcctcccgagtagctgggwcctcaggcatgcaccaccatgcctggctaatttttttttattatttgtggagatggggttttgccatgttgcccaggctggtctcaaactcctgggctca

SEQ ID NO: 26334 - DNA, 201 bp, Homo sapiens
tcaaagagaaattaaaagcactggaatctactgctcaggagaactgctttttacattcttggagtttatcctcccagacttttaaaattcaccaatacatrgtataagtacagtataagcatagatgactttttataaaaactgggtcacacaatggatatgacttgatcatttgcttttacctcccagcaatatcttctg

SEQ ID NO: 26335 - DNA, 201 bp, Homo sapiens
gtcccaaacatctgacatgtagccaatggaggacatgcaagtggtggggttcccagcagggaccacctcctgccttgggtttccaagacagagcgaggggygctgctggggcgtggtttgcaggggccttgtcagaactcgatgctttctcctccgtctgggtcctaactgcagtgcatctagagaccctcctctgactca

SEQ ID NO: 26336 - DNA, 201 bp, Homo sapiens
ggggttggaaacccacccccacacagtcaacacctgctgtcacaccaggctaatcaagaacacctttctttggtgcattaaccacctgctattaaataaarggctgttactaggtggcaaagtaacacactgcagtagagcctatttgtaatctgagatcagtggctgtaaggcaccatccttgagccaagcaagtactaa

SEQ ID NO: 26337 - DNA, 201 bp, Homo sapiens
aagaaggactgttcatgtgggagcgcaaggcggcagcggggttggaaacccacccccacacagtcaacacctgctgtcacaccaggctaatcaagaacacytttctttggtgcattaaccacctgctattaaataaagggctgttactaggtggcaaagtaacacactgcagtagagcctatttgtaatctgagatcagtg

SEQ ID NO: 26338 - DNA, 201 bp, Homo sapiens
tgccatcaggcctccgagctccttcgccaggcggctttatttggagtaagaggaaagcaaaggtttgaggctcagtcaagagggcgccactctgcctggcyagctctccgacaaagcagacgggggggtgtggagccgtggtgaccccctccgtcctccccagggtgggctccttgggcttgggctggtggaagtgaatat

SEQ ID NO: 26339 - DNA, 201 bp, Homo sapiens
tgagttgtggctctttagtgggtggatttgcatgtaccatggattacatttaccagggtctaggaattgtcaagcgcccagcaggctgccatcaggcctcygagctccttcgccaggcggctttatttggagtaagaggaaagcaaaggtttgaggctcagtcaagagggcgccactctgcctggccagctctccgacaaa

SEQ ID NO: 26340 - DNA, 201 bp, Homo sapiens
acgccagccagagagggatgtatgtcatgagaacagccttcttccacaatgtgacttacagtcagataaagttggagagattcagaacccaattataggtsactgagatgtacttatacgttgtaaccttactaaatgcaaaaatattgcagtcacaacaaatctgtccatctttagagctaggcaggaacacatacatgc

SEQ ID NO: 26341 - DNA, 201 bp, Homo sapiens
ctttggttttaagcaacttctctaccctgaccctcctcctgggacagcgtttcgggaggtttcttggcctcactgagagggatgtggagctgctgtacccygtcaaggagaaggtattctacagcctgatgagggagagcggctacatgcacatccagtgcaccaagcctgacaccgtaggtgagtgtgctcaggggtcct

SEQ ID NO: 26342 - DNA, 201 bp, Homo sapiens
cacgtttttgaagtcatctgcccttccatccctggctatggcttctcagaggcatcctccaagaagggtacggggctgctagaggttccataactgccccrtcctcgccaagggtgggcccggtgttcccaccaggctctccttccggcggggtgagcagggagttggcccgaggaagctgggaaaggaggggcctgagag

SEQ ID NO: 26343 - DNA, 201 bp, Homo sapiens
actccaactacctgaagaaagtcatctcctactggcggaatgaatttgactggaagaagcaggtggagattctcaacagataccctcacttcaagactaarattgaaggtatgtttgcaaaacgccagccagagagggatgtatgtcatgagaacagccttcttccacaatgtgacttacagtcagataaagttggagaga

SEQ ID NO: 26344 - DNA, 201 bp, Homo sapiens; identical to SEQ ID NO: 21520

SEQ ID NO: 26345 - DNA, 201 bp, Homo sapiens; identical to SEQ ID NO: 21521

SEQ ID NO: 26346 - DNA, 201 bp, Homo sapiens
tgaaaaaaattatgcatttaatacctgttcattgtagaaaaattggaaagtacataaaactcaaagagaaattaaaagcactggaatctactgctcaggaraactgctttttacattcttggagtttatcctcccagacttttaaaattcaccaatacatggtataagtacagtataagcatagatgactttttataaaaa

SEQ ID NO: 26347 - DNA, 201 bp, Homo sapiens
tggtcagtcagataaactaaagttcctaaaaaaaggaaattgaaattatagtgttaactgggtgtggtggcatgcacctgtagtcccagctactcaggagrctgaggcaggaggattgcttgagcccaggaattcaaggctgcagtgagctacaaggacaccactgcactgggtgacagatcaagaccccatctcttaaaa

SEQ ID NO: 26348 - DNA, 201 bp, Homo sapiens
acatgttaggaatcttatttttaatgttttaagataatttggccttttcaaggaacagtgaagattttaatttgttaaaattctaggaattacttaaagtrtatgaaagacatgttggtcagtcagataaactaaagttcctaaaaaaaggaaattgaaattatagtgttaactgggtgtggtggcatgcacctgtagtcc

SEQ ID NO: 26349 - DNA, 201 bp, Homo sapiens
aaaagaaaaaagaaatgcgaagtctacagtgaagaaggaagaagtgaagaacacatccgctttgggagtagccagtgatgtgggaaactgccttgccactyccagagggcagtatcttgtggctgcagggtttgctgtgttttctggaaacagactttgctcttgtgctctgtccttcccatccctctcaacttggggtcc

SEQ ID NO: 26350 - DNA, 201 bp, Homo sapiens; identical to SEQ ID NO: 21524

SEQ ID NO: 26351 - DNA, 201 bp, Homo sapiens; identical to SEQ ID NO: 21525

SEQ ID NO: 26352 - DNA, 201 bp, Homo sapiens
ccaggctggtcttgagctcctgaccttaggtgatccacccgcctcagccttccaaagtgctgggattacaggcgtgagccaccacaccaggcccaaaaatmctccactttaaagaaaatatcatttggtaatcagaaaaaggtgacattttgtcaatgtgtatgaaaaaaattatgcatttaatacctgttcattgtagaa

SEQ ID NO: 26353 - DNA, 201 bp, Homo sapiens
tcagtctggttcgttaattgtaataaatgtaccatgctaacataaaatattaataatggaggaaacccggtgggtgtgaggtatatgggagttttctggaytctttgcagtttttcagcaatctaaaactgttccaaaataaagtttagacagacaacaccatgttttctttagagagtgggattacatgtgagtcttccc

SEQ ID NO: 26354 - DNA, 201 bp, Homo sapiens
cttcactcaaccacaaaatcctcacattcccaagtatattttctttctttcttttttttgtttttttgagacagagtcttgctgtgttccccaggctggartgcagtggtgtgatcttggctcactgcaacctccgcctcctgggttcaagcaattctccctgcctcagcctcctgagtagctgggattacaggcatgccc

SEQ ID NO: 26355 - DNA, 201 bp, Homo sapiens
gccacctttcttcactcaaccacaaaatcctcacattcccaagtatattttctttctttcttttttttgtttttttgagacagagtcttgctgtgttcccmaggctggagtgcagtggtgtgatcttggctcactgcaacctccgcctcctgggttcaagcaattctccctgcctcagcctcctgagtagctgggattaca

SEQ ID NO: 26356 - DNA, 201 bp, Homo sapiens
ctgggccacctttcttcactcaaccacaaaatcctcacattcccaagtatattttctttctttcttttttttgtttttttgagacagagtcttgctgtgtyccccaggctggagtgcagtggtgtgatcttggctcactgcaacctccgcctcctgggttcaagcaattctccctgcctcagcctcctgagtagctgggat

SEQ ID NO: 26357 - DNA, 201 bp, Homo sapiens
tgcgtccgcttggcaggcaggccaggaatgggagggaagccatccgtttttccctttccactggatgttcccttcgccttccccagggaggagtgatgagrctggggtgctggggagggcagtatgggggcaggcttgggaccaggcctgcagaagcagcagaccctccaagcccacctacctctctggcctggcatctga

SEQ ID NO: 26358 - DNA, 201 bp, Homo sapiens
caccagggtcctgttaaaggacaatactttttcaaaaaggtaaatttataaaggaaccagtaaaattttaaaaagaaacaattcaaagacaaataagaacrctgaaattaatttgctaacagacacaaaacttgtcaacatccacagagtaatatcaattaaatctccatgggacaaaattcatttgcctctatgaacaag

SEQ ID NO: 26359 - DNA, 201 bp, Homo sapiens
caagtgtaaataaaatcagggacagggttggagcgcagcaggaaagagcctgctggggatcagagtctctgggctgtcagggccgggctgggcgggctccrttgttaatggcttcccctcatcttgcaggagccatgtggctagaaatcctcctcacttcagtgctgggctttgccatctactggttcatctcccgggaca

SEQ ID NO: 26360 - DNA, 201 bp, Homo sapiens
tatgtatatattaggtcaagtgtaaataaaatcagggacagggttggagcgcagcaggaaagagcctgctggggatcagagtctctgggctgtcagggccrggctgggcgggctccgttgttaatggcttcccctcatcttgcaggagccatgtggctagaaatcctcctcacttcagtgctgggctttgccatctactgg

SEQ ID NO: 26361 - DNA, 201 bp, Homo sapiens
cactgccggctccactggggcagggagacacccgcggggtaacctcaccaccccaccccaatgctgcccacagaaggaagcctcttgtaaggacctcccarctctttagatctttaaactgcattttcccatagaatcaagaggatggaccctcagcagattcccaggccaatttagcaactctgtttagccgactcagta

SEQ ID NO: 26362 - DNA, 201 bp, Homo sapiens
tgtcctctaagaagtggacctgtgtgcagggtgggccaaggaccccccaggggagaggagggagtgtgacctgtcactcagcagtgcctgaggcacgttgrcttggatcctcctgtctgtaacccagggttgcggctctgggtcaggttcccaggcagagaaggcctgtgataggaggggaaggtcaggcattagacctct

SEQ ID NO: 26363 - DNA, 201 bp, Homo sapiens
gtgtgtgtcctctaagaagtggacctgtgtgcagggtgggccaaggaccccccaggggagaggagggagtgtgacctgtcactcagcagtgcctgaggcaygttgacttggatcctcctgtctgtaacccagggttgcggctctgggtcaggttcccaggcagagaaggcctgtgataggaggggaaggtcaggcattaga

SEQ ID NO: 26364 - DNA, 201 bp, Homo sapiens
tcctctctccctgtccttgacaccagcccagcctcaccccggcccctctctctgccttcagccacgtgaaaggcctgcacttgaacatggctttggttttragcaacttctctaccctgaccctcctcctgggacagcgtttcgggaggtttcttggcctcactgagagggatgtggagctgctgtaccccgtcaaggaga

SEQ ID NO: 26365 - DNA, 201 bp, Homo sapiens
cagaggcatcctccaagaagggtacggggctgctagaggttccataactgccccgtcctcgccaagggtgggcccggtgttcccaccaggctctccttccrgcggggtgagcagggagttggcccgaggaagctgggaaaggaggggcctgagaggccggccccagacacaccgccctccggggctggagatgccacccct

SEQ ID NO: 26366 - DNA, 201 bp, Homo sapiens
tgccgccttgggttcctgcgtgagcagtccttctcactctgggcgatgttcgctttcaccagcccaaccccaagaagtccaccctggggaggacagagggrgtctccacggctccacacccccatgctttgtcggagatctggccaggcagagtggtgccctcttgactgagcctcgagcctttgctttccccttactcca

SEQ ID NO: 26367 - DNA, 201 bp, Homo sapiens
gtctccacggctccacacccccatgctttgtcggagatctggccaggcagagtggtgccctcttgactgagcctcgagcctttgctttccccttactccamataaagccgcagccctggcgagggagcccagaggcctgaggacagcctgctgggtgcctggcactctctagatcctccctgcctgggcggtgggcatctg

SEQ ID NO: 26368 - DNA, 201 bp, Homo sapiens
aaagggaaagcaatggcctggcttggctggagatggaacatgcatcaacgtgtcccacgtgtctccagcagggatagcgaaggcctgccccctggcacatggtagactgagtaaatgttgatcagtgagaccttgaggcactttagagtttcacaatccagagagggagatagattggaagttcaagggtggacacctggg

SEQ ID NO: 26369 - DNA, 201 bp, Homo sapiens
aagggaaagcaatggcctggcttggctggagatggaacatgcatcaacgtgtcccacgtgtctccagcagggatagcgaaggcctgccccctggcacatggtagactgagtaaatgttgatcagtgagaccttgaggcactttagagtttcacaatccagagagggagatagattggaagttcaagggtggacacctgggc

SEQ ID NO: 26370 - DNA, 201 bp, Homo sapiens
gactggcttgaacctgggaggtgggggttgcagtgggccgagatcacgccactgccctccagcctgggcaacagagtgagaccctatctcaaaaaaaaaaaaagaaaaaagaaaaaagaaatgcgaagtctacagtgaagaaggaagaagtgaagaacacatccgctttgggagtagccagtgatgtgggaaactgccttg

SEQ ID NO: 26371 - DNA, 201 bp, Homo sapiens
actggcttgaacctgggaggtgggggttgcagtgggccgagatcacgccactgccctccagcctgggcaacagagtgagaccctatctcaaaaaaaaaaaaagaaaaaagaaaaaagaaatgcgaagtctacagtgaagaaggaagaagtgaagaacacatccgctttgggagtagccagtgatgtgggaaactgccttgc

SEQ ID NO: 26372 - DNA, 201 bp, Homo sapiens
ctggcttgaacctgggaggtgggggttgcagtgggccgagatcacgccactgccctccagcctgggcaacagagtgagaccctatctcaaaaaaaaaaaaagaaaaaagaaaaaagaaatgcgaagtctacagtgaagaaggaagaagtgaagaacacatccgctttgggagtagccagtgatgtgggaaactgccttgcc

SEQ ID NO: 26373 - DNA, 201 bp, Homo sapiens
ggcttgaacctgggaggtgggggttgcagtgggccgagatcacgccactgccctccagcctgggcaacagagtgagaccctatctcaaaaaaaaaaaaagaaaaaagaaaaaagaaatgcgaagtctacagtgaagaaggaagaagtgaagaacacatccgctttgggagtagccagtgatgtgggaaactgccttgccac

SEQ ID NO: 26374 - DNA, 201 bp, Homo sapiens
gcttgaacctgggaggtgggggttgcagtgggccgagatcacgccactgccctccagcctgggcaacagagtgagaccctatctcaaaaaaaaaaaaagaaaaaagaaaaaagaaatgcgaagtctacagtgaagaaggaagaagtgaagaacacatccgctttgggagtagccagtgatgtgggaaactgccttgccact

SEQ ID NO: 26375 - DNA, 201 bp, Homo sapiens
tgggcttccaggaattctacattcaaggaggggactgggggtccctgatctgcactaatatggcccagctggtgcccaggtgaggtcactgttggggtggkgtgtgtgtgtgtgtgtgtgtgtgtgtgtgtgtgtcctctaagaagtggacctgtgtgcagggtgggccaaggaccccccaggggagaggagggagtgtga

SEQ ID NO: 26376 - DNA, 201 bp, Homo sapiens; identical to SEQ ID NO: 21539

SEQ ID NO: 26377 - DNA, 201 bp, Homo sapiens; identical to SEQ ID NO: 21540

SEQ ID NO: 26378 - DNA, 201 bp, Homo sapiens
taaactgaactagctcagtctgtaagtgaggggactcctgagctttctgcggccttcttcccaattccaggaaaggaaggaccttccacagaaaataactrctcagcaagacagccagggtgaacctcagcaccatctgtgacaagccacatgctctctgcgtgatgcctcctgcctctcagctgtgcctgaagcacacta

SEQ ID NO: 26379 - DNA, 201 bp, Homo sapiens
accaagcatgagctggtcacccctgctgaagaagtagctcgaagcccacccactcggggacagagtgggcacagatgggatagacagatagtgattcgagrggtgcctaggatctcatactgaaaacccacctctgctagggccataaatcccatcaacagcaattcattcctttgagaggtaatacagtgatgtgggaag

SEQ ID NO: 26380 - DNA, 201 bp, Homo sapiens
cagtgggccctgtagcctctgctgggtccagtgaagacacttcaactagagtgaaggccctggccacagggtaggggaggcaaaatcttaagagttcaagrgccctgagtcaaggcaggagggtcactgcccagcccagctggccccctgggctgcctgtgtgtggttcttgacccagacctagtggcttaggagcagagt

SEQ ID NO: 26381 - DNA, 201 bp, Homo sapiens
aggccgtgttctgagtgtctctgccacgggcccgcctggctggctttagtccaggagcagcctggactgtgactcttgaaggctgtgggaggctggtgacygggagcaggaggtctcagtgcatccctgaagggtcagagagccatgccgtgagaggccaggagcaggcagccattggccctccagccctcaccaaaggcc

SEQ ID NO: 26382 - DNA, 201 bp, Homo sapiens
tgaagggtcagagagccatgccgtgagaggccaggagcaggcagccattggccctccagccctcaccaaaggccaccacctcagcttgtcctctggcaacycagcctgggaatttgctttccctgtggaacgagagacactggccgcattgaggggtgactttccggtcctacaaaattgtagccctctttctgctagaac

SEQ ID NO: 26383 - DNA, 201 bp, Homo sapiens
aaccttcaccacgaccaaacaacccagaactcggaccctggtcctcgggctgccctacaggaagcacccctagtcctcttgctgctctgctagatgagacrgcaggctcaggttcctccatgaggcccggctttcagtgctctcctgttacacactgcaaggaagcttccagatcgtggagcacattgttgaggaaaagac

SEQ ID NO: 26384 - DNA, 201 bp, Homo sapiens
gctggtcttgaactcctgacctcaggtgatctgcccaccttggcctccaaagtgctgggattacaagcatgagccaccacgcctgtccccaagtatatttycttagctcactcttttcagcatgtaatttacagaagggtaatctgaattgtaaacacgatttctaagttaaaactcctgggtcagctcgtgatgaagtag

SEQ ID NO: 26385 - DNA, 201 bp, Homo sapiens
agaacacctttctttggtgcattaaccacctgctattaaataaagggctgttactaggtggcaaagtaacacactgcagtagagcctatttgtaatctgaratcagtggctgtaaggcaccatccttgagccaagcaagtactaatattcttgttatcttaattagaatgcaagagatcgtgtttttaaaattctctttga

SEQ ID NO: 26386 - DNA, 201 bp, Homo sapiens
gtgcattaaccacctgctattaaataaagggctgttactaggtggcaaagtaacacactgcagtagagcctatttgtaatctgagatcagtggctgtaagkcaccatccttgagccaagcaagtactaatattcttgttatcttaattagaatgcaagagatcgtgtttttaaaattctctttgaatctgtcactttgccc

SEQ ID NO: 26387 - DNA, 201 bp, Homo sapiens
ctgttactaggtggcaaagtaacacactgcagtagagcctatttgtaatctgagatcagtggctgtaaggcaccatccttgagccaagcaagtactaataytcttgttatcttaattagaatgcaagagatcgtgtttttaaaattctctttgaatctgtcactttgccctcctcttcctgggtgatacacctggtagtgc

SEQ ID NO: 26388 - DNA, 201 bp, Homo sapiens
tggctgtaaggcaccatccttgagccaagcaagtactaatattcttgttatcttaattagaatgcaagagatcgtgtttttaaaattctctttgaatctgycactttgccctcctcttcctgggtgatacacctggtagtgctggtgggggccatcataatgccccttgtcccagattcccttcttttagatgggactcga

SEQ ID NO: 26389 - DNA, 201 bp, Homo sapiens
ggggagataaccacgctgtgcacacatgagattggctgacttggcaggactgtgcaattgtcagaaggccgtggggagtgggggccagtgcctgcagcctrccctgcctctctcacaggcccttagagcatcgccaggtgcagagctccacagctctctttcccaaggagtaatcagagggtgagaacgtggagcctggtg

SEQ ID NO: 26390 - DNA, 201 bp, Homo sapiens
tgctctctgccttcggctgcctcccacacgctcccatgtgtctcccagtccctaacccctagtcctgctttcaataccgcaggggcttttagctgactttwctccatcttcttaaagggcaggatttcctggcagagacataacgtctttctggaaatgaaagaagctgatgcatgttttttcttttctgaattacttaaa

SEQ ID NO: 26391 - DNA, 201 bp, Homo sapiens
tcgcaccactgcactctttgagactctgtctcaaaaaaaaaaaaaaaaaaaaaaagggaaagcaatggcctggcttggctggagatggaacatgcatcaaygtgtcccacgtgtctccagcagggatagcgaaggcctgccccctggcacatggtagactgagtaaatgttgatcagtgagaccttgaggcactttagagt

SEQ ID NO: 26392 - DNA, 201 bp, Homo sapiens
tagcgaaggcctgccccctggcacatggtagactgagtaaatgttgatcagtgagaccttgaggcactttagagtttcacaatccagagagggagatagaktggaagttcaagggtggacacctgggcatgattcccaggacgaaggctgcagtcggttctaagaagtatgctggtgactatgagagaagaggttgtgggt

SEQ ID NO: 26393 - DNA, 201 bp, Homo sapiens
gcagggaccacctcctgccttgggtttccaagacagagcgaggggtgctgctggggcgtggtttgcaggggccttgtcagaactcgatgctttctcctccktctgggtcctaactgcagtgcatctagagaccctcctctgactcaggcataaggacggcccgcatattcatgcaggttactctgaacaagaacagtctgt

SEQ ID NO: 26394 - DNA, 201 bp, Homo sapiens
cgtctgggtcctaactgcagtgcatctagagaccctcctctgactcaggcataaggacggcccgcatattcatgcaggttactctgaacaagaacagtctrtgggttacttccctaggaatgaggaagatgaagagctagataacaatgctgggctggtatctgcctgatagtgctttgccaagactatggtttcttcctc

SEQ ID NO: 26395 - DNA, 201 bp, Homo sapiens
aaagacaactgagttgatgtgaaatgtaacaggcaacactatggacacagaaagtagattagaggctgcttaggacctaacgtggagggcagtaggggagygacagctgaagggtatggagtttctccgtgccgatgaaaatgttctacagttgactgtggctatggctgcacatgtctgtgaatatcctagaaaccactg

SEQ ID NO: 26396 - DNA, 201 bp, Homo sapiens
gggccaggcacgaggtccgcagccagggaggacgacagcatccgccctttcaaggtggaaacgtcagatgaggagatccacgtaaggcaccttgggccggrccgggctgggcagtggagagggtggtgtgtcgaagacaggggttgggtcttaggccagatgcgggaggggacgggggcttgggaatggtccatcctactt

SEQ ID NO: 26397 - DNA, 201 bp, Homo sapiens
ggctaggtgcggtggctcacgcttttaatcccagcactttaggaggctgaggcggtggatcacctgaggtcaggagttcaagaccagcctggccaacatcrtgaaaccccgtctctactaaaaatacaaaaaattagccgggcatagtggcgggcacctataataatcccagctactcgggaggctgaggcaggagaatcc

SEQ ID NO: 26398 - DNA, 201 bp, Homo sapiens
caggaggcagaggctgcagtgagccaagatcacaccactgcactccagcctgggcaacaagagtgaaatgccatctcaaaaaaagaaacagatgcataagrataaatgtcacaaaaagcatggataaaagtcatgagagttccaaggaggaagagatttaaaagcagaagctgggctaaacccaagagcaaccaggctgag

SEQ ID NO: 26399 - DNA, 201 bp, Homo sapiens
ggtaactgaaacacttgggaagaagcctgggaatggtgatgcttgagaggctctctaagctgacatgaacttcctccctctggggctggccttttagcctratacatgccaatgagacttgcaccctctctcctggtctgtaaattttttagtttttggagacagggtcttgctctgtcaccaggctggggtgcagtggtg

SEQ ID NO: 26400 - DNA, 201 bp, Homo sapiens
aaacacttgggaagaagcctgggaatggtgatgcttgagaggctctctaagctgacatgaacttcctccctctggggctggccttttagcctaatacatgycaatgagacttgcaccctctctcctggtctgtaaattttttagtttttggagacagggtcttgctctgtcaccaggctggggtgcagtggtgcgatcttg

SEQ ID NO: 26401 - DNA, 201 bp, Homo sapiens
aataggagtaaatttggcaacataggaggacacccaggatacattgttaagttaaaaaaaaagagattctaaaatagaatgtatgtatggttctatttttgttaaaagttatgttctctaagtctttttaaaaagtttgaactgtcacagccaagaagggtctaaagagacatgacagctcagtggtgtgtgagtcctgga

SEQ ID NO: 26402 - DNA, 201 bp, Homo sapiens
agaatgtatgtatggttctatttttgttaaaagttatgttctctaagtctttttaaaaagtttgaactgtcacagccaagaagggtctaaagagacatgayagctcagtggtgtgtgagtcctggatgggatcctggaacagaaaatggatatcaggggaaaaactgaggaaatctggctcatattttgttgtgtgtagat

SEQ ID NO: 26403 - DNA, 201 bp, Homo sapiens
ttggctatgatgatgttttcagcattgcacttaaaaaaaaatcttccactttattttattttaattttttgagatggagtcttgctctgttgcccaggctrgagtgtggtggtgtgatctcggctcagtgcaacctctgcttcccaggttcaagcgattctcttgcctcagcctcccgagtagctggaattgcaggcgcct

SEQ ID NO: 26404 - DNA, 201 bp, Homo sapiens
ccgggtaatttttttgtatttttagtagagacggggtttcaccatgttggccaggctggtcttgagctcctgaccttaggtgatccacccgcctcagcctyccaaagtgctgggattacaggcgtgagccaccacaccaggcccaaaaatcctccactttaaagaaaatatcatttggtaatcagaaaaaggtgacatttt

SEQ ID NO: 26405 - DNA, 201 bp, Homo sapiens
tgtatttttagtagagacggggtttcaccatgttggccaggctggtcttgagctcctgaccttaggtgatccacccgcctcagccttccaaagtgctgggrttacaggcgtgagccaccacaccaggcccaaaaatcctccactttaaagaaaatatcatttggtaatcagaaaaaggtgacattttgtcaatgtgtatga

SEQ ID NO: 26406 - DNA, 201 bp, Homo sapiens
gggaggttgtgaaggctgagtgaggacatctgtgcacctggagcacagtgtgagtgtgaaaccagtgtcagcccttattactgtcaataccatgaaggggsggcgggggcactaagggtggcaggactcaatatctaggctctggggggtgccagagcctgaccgtgcagggtcttctctctccctccaccctgactgtgc

SEQ ID NO: 26407 - DNA, 201 bp, Homo sapiens
ggcctgttcctccgccatctctcctctctccctgtccttgacaccagcccagcctcaccccggcccctctctctgccttcagccacgtgaaaggcctgcayttgaacatggctttggttttaagcaacttctctaccctgaccctcctcctgggacagcgtttcgggaggtttcttggcctcactgagagggatgtggagc

SEQ ID NO: 26408 - DNA, 201 bp, Homo sapiens
actttttcaaaaaggtaaatttataaaggaaccagtaaaattttaaaaagaaacaattcaaagacaaataagaacactgaaattaatttgctaacagacasaaaacttgtcaacatccacagagtaatatcaattaaatctccatgggacaaaattcatttgcctctatgaacaagagtcattcgcattaccctcagttct

SEQ ID NO: 26409 - DNA, 201 bp, Homo sapiens; identical to SEQ ID NO: 21566

SEQ ID NO: 26410 - DNA, 201 bp, Homo sapiens; identical to SEQ ID NO: 4737

SEQ ID NO: 26411 - DNA, 201 bp, Homo sapiens
tccaggggagataaccacgctgtgcacacatgagattggctgacttggcaggactgtgcaattgtcagaaggccgtggggagtgggggccagtgcctgcakcctgccctgcctctctcacaggcccttagagcatcgccaggtgcagagctccacagctctctttcccaaggagtaatcagagggtgagaacgtggagcct

SEQ ID NO: 26412 - DNA, 201 bp, Homo sapiens; identical to SEQ ID NO: 4738

SEQ ID NO: 26413 - DNA, 201 bp, Homo sapiens
gtgctgggctttgccatctactggttcatctcccgggacaaagaggaaactttgccacttgaagatgggtggtgggggccaggcacgaggtccgcagccasggaggacgacagcatccgccctttcaaggtggaaacgtcagatgaggagatccacgtaaggcaccttgggccgggccgggctgggcagtggagagggtgg

SEQ ID NO: 26414 - DNA, 201 bp, Homo sapiens
atgtctgtgaatatcctagaaaccactggagggttcactttaaatgggcgaattgtatggtatatgaattatgtttcaataaagctcttacacagctaagstgtgtggccatggctgggcttcctagcagtgtcccccaaccccaaattgaacttactctcccagcacttgggcctccccattaccccctgtctgccctga

SEQ ID NO: 26415 - DNA, 201 bp, Homo sapiens
aaaagaaatgcgaagtctacagtgaagaaggaagaagtgaagaacacatccgctttgggagtagccagtgatgtgggaaactgccttgccactcccagagkgcagtatcttgtggctgcagggtttgctgtgttttctggaaacagactttgctcttgtgctctgtccttcccatccctctcaacttggggtcctgaattt

SEQ ID NO: 26416 - DNA, 201 bp, Homo sapiens
ctctttattgttctaatattatgctcgcagcctccttgacaacatcatgcaaaatgtgtcttactagcttctagtgcataaaatattggtggagctcttcrctgtgctgggccagtcaccagtgctgggcactgtgggtcaaggcagtgcccaggacgggcacagccctgccttcccaagctatggtttattgtggtagga

SEQ ID NO: 26417 - DNA, 201 bp, Homo sapiens
gactatggtttcttcctcttctgatcaaaaaagacacaggagtcagacaaatggggattaaaagacaactgagttgatgtgaaatgtaacaggcaacactrtggacacagaaagtagattagaggctgcttaggacctaacgtggagggcagtaggggagcgacagctgaagggtatggagtttctccgtgccgatgaaaa

SEQ ID NO: 26418 - DNA, 201 bp, Homo sapiens
gtcagatgaggagatccacgtaaggcaccttgggccgggccgggctgggcagtggagagggtggtgtgtcgaagacaggggttgggtcttaggccagatgygggaggggacgggggcttgggaatggtccatcctacttgggagtgtgtttcagtctgcttttcctctgctgggcaggtgcaggttgctttggagagggat

SEQ ID NO: 26419 - DNA, 201 bp, Homo sapiens
caccagaggatcgataagttccgtttcaccccacctttggaggacagctgcttccactatggcttcaactccaactacctgaagaaagtcatctcctactrgcggaatgaatttgactggaagaagcaggtggagattctcaacagataccctcacttcaagactaagattgaaggtatgtttgcaaaacgccagccagag

SEQ ID NO: 26420 - DNA, 201 bp, Homo sapiens
tggaggcctgctgtgagccaggagctgtcctgagccctggaaacccagcagtggctgtacagacctggcccagctgtcagggggcacctctaaggaaaccrggaggcaataatcgtagctcccttgcagggaggttgtgaaggctgagtgaggacatctgtgcacctggagcacagtgtgagtgtgaaaccagtgtcagcc

SEQ ID NO: 26421 - DNA, 201 bp, Homo sapiens
cctcctgcctctcagctgtgcctgaagcacactagctggcatggacttacgcggctgggaacatcttcaggaagccctgaatgagggctctgtgggcagarggacctttgcagaaagggcatcttgaccactgcaggaggtggagtgactctcctggggtgtcctggttcctgcctgatgtcttaagcataactggcattt

SEQ ID NO: 26422 - DNA, 201 bp, Homo sapiens
tggctccttaaatggcatcacccaagttggccatcaagcttccccagactcagtcactcggccccctctttccctggctgtagagcaggggtttggactcsaggctgctgagttcctctccagcttccatgcccagtggcagtgacttatcaactggcccacccggtggatgtaggggtgatgcagccctgctctgtcctc

SEQ ID NO: 26423 - DNA, 201 bp, Homo sapiens
gaaaccccgtctctactaaaaatacaaaaattagctgggcatggtggcacgtgcctgtagttccagctactcgggaggctgaggcaaaagaattgcttgamccagggaggcggaggttgcagtgagccgagatcgcgccactgcactccagcctggcaacagagcaagactccatctcaaaaaaaaagggagaaaggaagg

SEQ ID NO: 26424 - DNA, 201 bp, Homo sapiens
gagaccccttctctacaaaaaaaaataacaaaaataggctagacatggtgttgcccacctgtagtcccagctacttgagaggctgaggtgggaggatcacytgagcctgggaggttgaggctgcagtgagccgtgattgtgccactgcacttcagcctgggcaacacagtgagacctcatctctaaaagaagaagaaaaaa

SEQ ID NO: 26425 - DNA, 201 bp, Homo sapiens; identical to SEQ ID NO: 21602

SEQ ID NO: 26426 - DNA, 201 bp, Homo sapiens; identical to SEQ ID NO: 4734

SEQ ID NO: 26427 - DNA, 201 bp, Homo sapiens; identical to SEQ ID NO: 4735

SEQ ID NO: 26428 - DNA, 201 bp, Homo sapiens; identical to SEQ ID NO: 4715

SEQ ID NO: 26429 - DNA, 201 bp, Homo sapiens; identical to SEQ ID NO: 4717

SEQ ID NO: 26430 - DNA, 201 bp, Homo sapiens
aacactgattttcatgcgcgtccgtgtgaagagaccaccaaacaggctttgtgtgagcaacatggctgtttatttcacctgggtgcaggcgggctgagtcygaaaagagtcagccaagggagataggggtggggccgttttataggatttgggtaggtaaaggaaaattacagtcaaaggggggttctctggcgggcagag

SEQ ID NO: 26431 - DNA, 201 bp, Homo sapiens
ggggatatgatggcttagcttcggctcagaggcctgacactgatcacaccttttagttgaaatgcgctttcatctccatctgctgccgcagccgccgcccsgcaccccctcgctctggtctcgggattgaaggccagccctctcctcttgtagaacaggaaacttgcccgggagttcaccttgtagttgaagccagggaat

SEQ ID NO: 26432 - DNA, 201 bp, Homo sapiens
ggaggtggagtgactctcctggggtgtcctggttcctgcctgatgtcttaagcataactggcattttcagggagcccaggttcaccaatgcacagtgcccytcctgtcgacctgatacccaggcttggtgattgctcacctggcaccttgattcccgttctggtatcttggcccaggcccagacatgtgaaagcaggggct

SEQ ID NO: 26433 - DNA, 201 bp, Homo sapiens
ggtgtcctggttcctgcctgatgtcttaagcataactggcattttcagggagcccaggttcaccaatgcacagtgcccctcctgtcgacctgatacccagkcttggtgattgctcacctggcaccttgattcccgttctggtatcttggcccaggcccagacatgtgaaagcaggggctaccgagattcatttctcagttc

SEQ ID NO: 26434 - DNA, 201 bp, Homo sapiens
aatgtctttttggtacttaagagctggattaactacttcacatatctgagcttcatttttaattctttttaaaacagaaaaagtggctgggcaagatggcrcacacctgtaatcccagcattttgggaagctgaggtgggtggatcacttgagcccaggagttctgagaccagcctgggcaacaaagtgagacctcgtctc

SEQ ID NO: 26435 - DNA, 201 bp, Homo sapiens
gggtccacctcatggcctttgttctggaaaaatacttgggcattctgccctgcaatgcacttagccaaggccgggcacatggcaagtgctgagtcatggcyggctagcactttactgcgattttaggagcactttcttgtggtgaggttctgactgcttgcttgggttgggggaggggagtctttgggcaggcggtagacc

SEQ ID NO: 26436 - DNA, 201 bp, Homo sapiens
gggagtctttgggcaggcggtagacctgccctttactttgtgtggccggatctgagtctgaccccatctttttagacccaaaaccctgatatttgtagtgygcctaggatactggttctccagtcttctttggggtcagggggcgttatagtgcctcatgccacctactcagccctcttcctgcatcttatggtctgtctc

SEQ ID NO: 26437 - DNA, 201 bp, Homo sapiens
gggcaatatagtgagaacctgtctccattaaaaaaaaaaaaaaaaaaaaggtttgtatggtggctcacgcctgtaatcccagcactttgggaggcggaggygggcggatcacgaggtcaggagattgagaccatcctggccaatatggtgaaaccccatctctgctaaaaatacaaaaaattagccgggcgtagtggcggg

SEQ ID NO: 26438 - DNA, 201 bp, Homo sapiens
ggcggaggcgggcggatcacgaggtcaggagattgagaccatcctggccaatatggtgaaaccccatctctgctaaaaatacaaaaaattagccgggcgtrgtggcgggcgcctgtagtcccagctacttgggaggctgaggcaggagaatggcgtgaacccgggaggcggagcttgcagtgagccgagattgcgccactg

SEQ ID NO: 26439 - DNA, 201 bp, Homo sapiens
ggcgggcggatcacgaggtcaggagattgagaccatcctggccaatatggtgaaaccccatctctgctaaaaatacaaaaaattagccgggcgtagtggcrggcgcctgtagtcccagctacttgggaggctgaggcaggagaatggcgtgaacccgggaggcggagcttgcagtgagccgagattgcgccactgcactcc

SEQ ID NO: 26440 - DNA, 201 bp, Homo sapiens
gcgggcggatcacgaggtcaggagattgagaccatcctggccaatatggtgaaaccccatctctgctaaaaatacaaaaaattagccgggcgtagtggcgkgcgcctgtagtcccagctacttgggaggctgaggcaggagaatggcgtgaacccgggaggcggagcttgcagtgagccgagattgcgccactgcactcca

SEQ ID NO: 26441 - DNA, 201 bp, Homo sapiens
ggtcaggagattgagaccatcctggccaatatggtgaaaccccatctctgctaaaaatacaaaaaattagccgggcgtagtggcgggcgcctgtagtcccmgctacttgggaggctgaggcaggagaatggcgtgaacccgggaggcggagcttgcagtgagccgagattgcgccactgcactccagcctgggcgacagag

SEQ ID NO: 26442 - DNA, 201 bp, Homo sapiens
agattgagaccatcctggccaatatggtgaaaccccatctctgctaaaaatacaaaaaattagccgggcgtagtggcgggcgcctgtagtcccagctactygggaggctgaggcaggagaatggcgtgaacccgggaggcggagcttgcagtgagccgagattgcgccactgcactccagcctgggcgacagagcgagact

SEQ ID NO: 26443 - DNA, 201 bp, Homo sapiens
agaccatcctggccaatatggtgaaaccccatctctgctaaaaatacaaaaaattagccgggcgtagtggcgggcgcctgtagtcccagctacttgggagrctgaggcaggagaatggcgtgaacccgggaggcggagcttgcagtgagccgagattgcgccactgcactccagcctgggcgacagagcgagactccgtct

SEQ ID NO: 26444 - DNA, 201 bp, Homo sapiens
taaaaatacaaaaaattagccgggcgtagtggcgggcgcctgtagtcccagctacttgggaggctgaggcaggagaatggcgtgaacccgggaggcggagsttgcagtgagccgagattgcgccactgcactccagcctgggcgacagagcgagactccgtctcaaaaaaaaaaaaaaaaaaaaatacaaaaattatctgg

SEQ ID NO: 26445 - DNA, 201 bp, Homo sapiens
gccgggcgtagtggcgggcgcctgtagtcccagctacttgggaggctgaggcaggagaatggcgtgaacccgggaggcggagcttgcagtgagccgagatygcgccactgcactccagcctgggcgacagagcgagactccgtctcaaaaaaaaaaaaaaaaaaaaatacaaaaattatctgggcatggtggcatgcgcct

SEQ ID NO: 26446 - DNA, 201 bp, Homo sapiens
cgggcgtagtggcgggcgcctgtagtcccagctacttgggaggctgaggcaggagaatggcgtgaacccgggaggcggagcttgcagtgagccgagattgygccactgcactccagcctgggcgacagagcgagactccgtctcaaaaaaaaaaaaaaaaaaaaatacaaaaattatctgggcatggtggcatgcgcctgt

SEQ ID NO: 26447 - DNA, 201 bp, Homo sapiens
gaattggaattaaaatgtatgcaatcccatttcttacagtaggagccaaatgttcatcaagttcccctctgagctcagtatcttgtagctaaatgaccacyatcttccagtcacgtttttaaaaaaaatcatgctggtttgcaacaaaaattgtattttctttactaggcaagtgaaccattttgttgggaagagtacctt

SEQ ID NO: 26448 - DNA, 201 bp, Homo sapiens
aagatgtacatagccttgtgctttggtcatcctcccaaatcatgtccttggtgaaggcacatggagaggagagcagatgctgccagaccacggtgcctgaygccatgcactccctcacgtccagcctgtttatgtgcacacggctgcagcgggaccttggggtgtgggctaaataacaagaacaggggctcctctggggtc

SEQ ID NO: 26449 - DNA, 201 bp, Homo sapiens
ctggcctgaagactcaaggctgcaaacaggtgctgagagggaacaagaaggggagttggggtgcaacacacccagtgacagaccaggagtgagtgctgtgrccacagattctaatcctcacaactgcagtgtgatttaggctaagccccttgcctactccgattcttgccttaaataagtgaaaaggaaagtcaagtttga

SEQ ID NO: 26450 - DNA, 201 bp, Homo sapiens
caacgtgtcccacgtgtctccagcagggatagcgaaggcctgccccctggcacatggtagactgagtaaatgttgatcagtgagaccttgaggcactttaragtttcacaatccagagagggagatagattggaagttcaagggtggacacctgggcatgattcccaggacgaaggctgcagtcggttctaagaagtatgc

SEQ ID NO: 26451 - DNA, 201 bp, Homo sapiens
cacctataataatcccagctactcgggaggctgaggcaggagaatcccttgaacccaggaggcagaggctgcagtgagccaagatcacaccactgcactcyagcctgggcaacaagagtgaaatgccatctcaaaaaaagaaacagatgcataaggataaatgtcacaaaaagcatggataaaagtcatgagagttccaag

SEQ ID NO: 26452 - DNA, 201 bp, Homo sapiens
tgaacctgggaggtgggggttgcagtgggccgagatcacgccactgccctccagcctgggcaacagagtgagaccctatctcaaaaaaaaaaaaagaaaaragaaaaaagaaatgcgaagtctacagtgaagaaggaagaagtgaagaacacatccgctttgggagtagccagtgatgtgggaaactgccttgccactccc

SEQ ID NO: 26453 - DNA, 201 bp, Homo sapiens
ctcaccacagcctcgaactcctgggctcaagcaatcctctcgcctcagacctcctgaatagctggtactataggcgagcaccactgtgcccagcttgttarttttttatattgaagaaattgtacatgttaggaatcttatttttaatgttttaagataatttggccttttcaaggaacagtgaagattttaatttgttaa

SEQ ID NO: 26454 - DNA, 201 bp, Homo sapiens
cttggtgaaaccccgtctctactaaaaatacaaaaaattagccgggcgtggtggcaggcgcctgtggtcccagctacttgggaggctgaggcagaagaatrgcgtgaacccggaaggcggagcttgcagtgagcccagattgcgccactgcactccagcctgggtgacagggcaagactctgtctcaaaaaaaaaaaaaag

SEQ ID NO: 26455 - DNA, 201 bp, Homo sapiens
ttggtgaaaccccgtctctactaaaaatacaaaaaattagccgggcgtggtggcaggcgcctgtggtcccagctacttgggaggctgaggcagaagaatascgtgaacccggaaggcggagcttgcagtgagcccagattgcgccactgcactccagcctgggtgacagggcaagactctgtctcaaaaaaaaaaaaaaga

SEQ ID NO: 26456 - DNA, 201 bp, Homo sapiens
ggaggccgaggcgggtggatcccaaggtcaagagatcgagaccatcctggccaacatggtgaaaccccgtctctactaaaaatacaaaaattagctgggcrtggtggcacgtgcctgtagttccagctactcgggaggctgaggcaaaagaattgcttgaaccagggaggcggaggttgcagtgagccgagatcgcgccac

SEQ ID NO: 26457 - DNA, 201 bp, Homo sapiens
atcacagttcattgcagcctcaatttcctgagctcaagcgatcctcccacctcagcctctcaagtagctgggaccacaggtatgcaccaccacactaggcytttttttttttttttttttttcttgagacggagtctcgctctgtcacccaggctggagtgcagtgacgcaatctcgactcactgcaagctccgcctccca

SEQ ID NO: 26458 - DNA, 201 bp, Homo sapiens
acggagtctcgctctgtcacccaggctggagtgcagtgacgcaatctcgactcactgcaagctccgcctcccaggttcacgccattctcctgcctcagccwcccgagtagctgggactacaggcgcccgccaccatgcccagctaattttttgtatttttagtagagacggggtttcaccgtgttagccaggatgatcttg

SEQ ID NO: 26459 - DNA, 201 bp, Homo sapiens
aatgctaagtgaagtaagccagggacaggacaaataccgcatgattccacctatagaaggaatctgaaatagtcaaactcagcagaagcagagaggagaakggtggttgtcaggggctggggaataggggaaacggcattgctgatcgttgctgtgtaaagtttgagtcctgccagccgaatacatcctagagatgggctg

SEQ ID NO: 26460 - DNA, 201 bp, Homo sapiens
cccagggttgcggctctgggtcaggttcccaggcagagaaggcctgtgataggaggggaaggtcaggcattagacctctctgctggaccaagctctgggayagccctgagcagaactccccagaaactgtatttttcccccaacctcccttctccaactcccatggcctccccagtggggccagtgctgaaagaggctggc

SEQ ID NO: 26461 - DNA, 201 bp, Homo sapiens; identical to SEQ ID NO: 21605

SEQ ID NO: 26462 - DNA, 201 bp, Homo sapiens; identical to SEQ ID NO: 21606

SEQ ID NO: 26463 - DNA, 201 bp, Homo sapiens
ccccttccgtccaacagcatacagtccagtgaatgagaaaaggaatgtgcacaaagaaaagtagactaaaagataaataaagataggctaggtgcggtggstcacgcttttaatcccagcactttaggaggctgaggcggtggatcacctgaggtcaggagttcaagaccagcctggccaacatcgtgaaaccccgtctct

SEQ ID NO: 26464 - DNA, 201 bp, Homo sapiens
ctgcagccttgctatttagggccaaggctgagccctaaggaaagctcctttagggaattagactcctaagggagtctgagatttccaaaatctgtttgggkgtaactgaaacacttgggaagaagcctgggaatggtgatgcttgagaggctctctaagctgacatgaacttcctccctctggggctggccttttagccta

SEQ ID NO: 26465 - DNA, 201 bp, Homo sapiens
ccctggctatggcttctcagaggcatcctccaagaagggtacggggctgctagaggttccataactgccccgtcctcgccaagggtgggcccggtgttccyaccaggctctccttccggcggggtgagcagggagttggcccgaggaagctgggaaaggaggggcctgagaggccggccccagacacaccgccctccgggg

SEQ ID NO: 26466 - DNA, 201 bp, Homo sapiens; identical to SEQ ID NO: 21640

SEQ ID NO: 26467 - DNA, 201 bp, Homo sapiens; identical to SEQ ID NO: 21641

SEQ ID NO: 26468 - DNA, 201 bp, Homo sapiens; identical to SEQ ID NO: 21642

SEQ ID NO: 26469 - DNA, 201 bp, Homo sapiens; identical to SEQ ID NO: 4736

SEQ ID NO: 26470 - DNA, 201 bp, Homo sapiens; identical to SEQ ID NO: 4739

SEQ ID NO: 26471 - DNA, 201 bp, Homo sapiens; identical to SEQ ID NO: 21663

SEQ ID NO: 26472 - DNA, 201 bp, Homo sapiens
tctctaccctgaccctcctcctgggacagcgtttcgggaggtttcttggcctcactgagagggatgtggagctgctgtaccccgtcaaggagaaggtattytacagcctgatgagggagagcggctacatgcacatccagtgcaccaagcctgacaccgtaggtgagtgtgctcaggggtcctcgcccactgccggctcca

SEQ ID NO: 26473 - DNA, 100 bp, Homo sapiens
ggaaactttgccacttgaagatgggtggtgggggccaggcacgaggtccrcagccagggaggacgacagcatccgccctttcaaggtggaaacgtcagat

SEQ ID NO: 26474 - DNA, 201 bp, Homo sapiens
gatatcttctattatgagcctaacaagaggatccaagccacttaatcccagccaaactgctgtatgcaattaccataggttcctgtttggattcctggcaygaaattgcctggcttccttgagtttgacttggatccctgtgttgtcccagctcttcagtgtccatccagcagaaactaacagggcgcctgctgtacccag

SEQ ID NO: 26475 - DNA, 201 bp, Homo sapiens
tcaaggactgaaattgcatagagggcaatgctttttctttataggtggtgaactgggttctgcttgagttttttctctggtaatttagaaccaatggaagmaactcaacagctctaattttaattggcagaatgtgagatggaatgggacctcaaatgaaactccaggccaagagctcatgagccctgcagcatgtggggc

SEQ ID NO: 26476 - DNA, 201 bp, Homo sapiens
cccacgggcggacccccagacccaatcctctccagagccagggtgggatgggcagggacaggagccggaggccctactggccccgggcgaaggcatcctgraaagcatccagagcgtccagcatccctcccgcggccacccgcaggctgaccgacccctgggcagaccctcagactcaatccagtccagggcggattaagg

SEQ ID NO: 26477 - DNA, 201 bp, Homo sapiens
cgagatcatgccattacactccagcctgggtaacaagagtgagattctgtctcaaaaaaaaagttgggaatatctcaagccaatgccacgatgacttgtgytgcccccagaaaccaagggccccctgtctgggatggaatgctccctccaatggacaagaagacccatttatgtccctgctaggggtgcaggctgctcctc

SEQ ID NO: 26478 - DNA, 201 bp, Homo sapiens
ccccagaaaccaagggccccctgtctgggatggaatgctccctccaatggacaagaagacccatttatgtccctgctaggggtgcaggctgctcctccaamaggggttggccaggtgcaagccaaaatatggccagtgctcagaaaagggagatggaaatgccatgtgtatacaggggatccagcccatggcacctccaag

SEQ ID NO: 26479 - DNA, 201 bp, Homo sapiens
gagatggaaatgccatgtgtatacaggggatccagcccatggcacctccaagtggctggagtttctccttttatggaaggagatgtcaaaggccagagacrttaagtaatttgcccaaagacatcacttaatagctatataatattccactgtatgaaaataccaaaatttaatttagtatggtgaaaggaagatttactc

SEQ ID NO: 26480 - DNA, 201 bp, Homo sapiens
cttgggcaggtgtaggaacccccaaagtgctcacgacaaaaccctaggcggtcagttcttaccttgtagtgcgccagctggagggccagctgcacaaaggygtctgggctcgtgcgacatttcttgatgattcctttaccaaaggctacgaatgggaaggaatggaaatccacgtcgtttgccagaagatttgcggtgttc

SEQ ID NO: 26481 - DNA, 201 bp, Homo sapiens
ctggaaatagggtctttgctgatataattcaatattaagatgaggtcatactggactagggtggaccccaaatccaatgactgttgtccttgtaagagagmcacacacacacagaggtgagagccaaggtgacatggaggcagagatcagagtgatatgcctacaagccaaggagcacctggacccccccagaagctggaa

SEQ ID NO: 26482 - DNA, 201 bp, Homo sapiens
tatatctttctataacccgtgaaatctagcactggagtttcactgtagtctcttctttaaacctatacactcttttctggtcatctaacctataaacaaayttgggtttagggatttaagaagctatcttttagataatctacattttagattactgaaagaaaaagacctatatacttacttgatttgcaaaaataaaaa

SEQ ID NO: 26483 - DNA, 201 bp, Homo sapiens
gctgagaattcatgcctggacctgccacatgtgaaatgtcaccaggacatccgggtggagatgccccacatcgccagagcaagggaggagctgggcaagaygacacacccgggaggtatcagcacagaacctgccagctctgcctcaatgactcggaaagagtaatttggcaaaactacattccaccagctataacttcag

SEQ ID NO: 26484 - DNA, 201 bp, Homo sapiens
atgactcggaaagagtaatttggcaaaactacattccaccagctataacttcagcttagagcaatttgcaaagcaatcgacaatatgtatgggccaggcaygatggctcatacctgtaatcccagcactttgggaggctgacgtgggaggatcgcttgagtccaggaactcaagaccagcctgggcaacatggcgaaaccc

SEQ ID NO: 26485 - DNA, 201 bp, Homo sapiens
aggctgagggaggagaatggcgtgaacccgggagccggagcttgcagtgagctgagatcaggctactgcactactgggtgagagagtgagactccctgtcaaaaaaaaaaaaaagaaaaccaacctggccctcagcgtgactttctgtaacatactttacttagcacaaacgggattcctcaaagtaaatcgggtctgcgg

SEQ ID NO: 26486 - DNA, 201 bp, Homo sapiens
cacgtatggagatactaatagataggtgtgtgggaaggtaggtaggtaagacataaagattcctttttgtgcttttaataatgaagttacagcacattccttttttttttttttgagacgaagttttgctccatcacccaggctggagtgcaatgacatgatctcggctcacagcaacctctgcctcctgggttcaagtga

SEQ ID NO: 26487 - DNA, 201 bp, Homo sapiens
ccttcccaggagctggaattacaggcacgcaccaccacgcctggctaattttgtatttttagtagagatgggtttttaccatgttgaccaggctggtctcraactcctgaccccaagcgatccgtctgccttggcctcctaaagtgctgggattacaggcatgagccactgtgcccgacccagaacattctttttaccaaa

SEQ ID NO: 26488 - DNA, 201 bp, Homo sapiens
tgggctgggcacggtggctcatgcctataatcccagcactttgggaggctgaggcgtgtggatcacctgaggtcaggagttcaagaccagcctggccaacrtggcaaaacctcatctctagtaaaaatacaaaaattagccaggtgtggtggtgggcacttgtaatccagctattcgggaggctgaggcaggagaatcgct

SEQ ID NO: 26489 - DNA, 201 bp, Homo sapiens
gagttcaagaccagcctggccaacgtggcaaaacctcatctctagtaaaaatacaaaaattagccaggtgtggtggtgggcacttgtaatccagctattcrggaggctgaggcaggagaatcgcttgaacccgggaggcagaggttgcagtgagccgagatcatgccactgcaccccagcctgggtgacagagggagactt

SEQ ID NO: 26490 - DNA, 201 bp, Homo sapiens
agcctgggtgacagagggagacttcgtctcaaaaaataaaaataataaaataaaaggaattctggactgggtatggtggctcatgcctgtaatcccaatastttggcaggcgaaggcaggaagttcgcttgagcccaggtatttgagaccaatctgggcaatgtagcaagaccccatctctacaaaaaatacaaaaattag

SEQ ID NO: 26491 - DNA, 201 bp, Homo sapiens
tatctgacctagctattcagaagcccaccagaagtttaacagctgctacttctttcccactgtgcctgccctgcctctagccagcatcggcactcgggcasgagctcagactgcaaggaggagacctgcacctgcccaaaggacatcctaaacctcctcttcgtaccagtatattgttcccacaaatgtccctaagacaac

SEQ ID NO: 26492 - DNA, 201 bp, Homo sapiens
agaagcccaccagaagtttaacagctgctacttctttcccactgtgcctgccctgcctctagccagcatcggcactcgggcaggagctcagactgcaaggrggagacctgcacctgcccaaaggacatcctaaacctcctcttcgtaccagtatattgttcccacaaatgtccctaagacaacaggagcggtgtcccctgt

SEQ ID NO: 26493 - DNA, 201 bp, Homo sapiens
gatcctcacaaaactcgtgtgacatggaatgacaggttcagacccaccaccttacagatgaggaaatggaaacccagaaaccctagaggcggattcagtgmcacacccagtctgcatggggtagggagtgggggcctccaaaacccaggccctctggctgcccagtggtctgggaagcagcctgggaaagggaaagaaaac

SEQ ID NO: 26494 - DNA, 201 bp, Homo sapiens
gggaaagaaaacacacagatctgggttcaaatcccagctctaccaattactcagacctgtgaccttgagcaagtatttgcctcacataaagtatgcaggaygcccttacctcctccggcaaactgcaggaggacgtggcagccagctctgacacctgttaggtctttactgcaggaacacgttctttgtccctttccaact

SEQ ID NO: 26495 - DNA, 201 bp, Homo sapiens
agagcggtacccaccctactgcccaaccctccaaggtgacggtgaccctcctgcacaccctggagagggcacgcctcactcagcagcatgatttctttcaytgttaacttccaaagacgttcctggaccgaagaacaatcctcaccaaaaaaaaggcaaaggcagacacttctgaggccgtcaagatacccaaatagggta

SEQ ID NO: 26496 - DNA, 201 bp, Homo sapiens
agatatatggagtaagattcggaacggggacagaggtgtcagacttgtaccaactcccacgagccagctgccatattttcagagaattttcaagctggctrttaaatacagccactattaaaaattaaatttgccaggcgcaatggttcatgtctgtaatctcagcactttgggaacccgacgcgggtggattgcctgagc

SEQ ID NO: 26497 - DNA, 201 bp, Homo sapiens
ggaacctgggggagaaaggaatgagggatttcttttggaggtgataaaaatagtacagaattaggctgggctctgtgactcacgactgtaatcctagcackttgggaggccaaggcgggtagatcactttaggtcaggagttcgagaccaagctggccaacaaggggaaaccccgcctctaccaaaaatacaaaaattagg

SEQ ID NO: 26498 - DNA, 201 bp, Homo sapiens
ggaacgagacagcagtgagggctgcgcaacattataaatgtacttagtgcccctgaactgtacacttgaaaatggttaacagtacaattcatgttgtgtayattttaccataatttttttaaaaacaaagaaatggagctgctccctctccttttgttcaattaaagaaaaaaaaagaccgaagcaggtagatcacttgag

SEQ ID NO: 26499 - DNA, 201 bp, Homo sapiens
aagctgtttgaaaataatttttttaaagcaatttgtttgcctactggtttgatttcctcccggtccagtttgcgcctgtaaagcaggatggcatggatggygttgccggctcttgctgcctgaatgtgagttggaaggatatacagcagatcctgaaaagcgacaaaggtggagagaatttgcatagggaaagataagcaa

SEQ ID NO: 26500 - DNA, 201 bp, Homo sapiens
acaggacccactcagctggggaacggggagccggacagagcacaggacccactcagctggggaacggagagtcagacagagcacaggacccgctcagccgsggaaggcctggcacctgcacacaggcccagctgaagtcaggctcctcacagtgcagccaagatctctggaggagaggaggcccctgaaaggcagaaggta

SEQ ID NO: 26501 - DNA, 201 bp, Homo sapiens
atgaggccacggggcctcctgcttcccatgctgatagcaaacgcgcctttcagagcccttcccgcatctcctcactacagagcacttcataggcgctcacratgaagaagtggggagagggagagaagcagataaaagggaaagcggaaatgtggcattttagttatttaataaaggtaaacttgaactatatgatgcaat

SEQ ID NO: 26502 - DNA, 201 bp, Homo sapiens
gttattgtgcataaccttgaaggaccccttcaaggggtcaatataacacaaggttatattgtgtataaccttgaaggacccctgagaaggggtccccaggstctcctaggctgcccaaggggtccagggcagaaaaaaggttcagaagcttagaagagacccacagggccacagcaaggttctggatttatgtaaaaccac

SEQ ID NO: 26503 - DNA, 201 bp, Homo sapiens
tgtcgtaacatcggccgtgtagtagagatttggcgtagctgtccattgacgtatccgggtcttcacttctgtatccttcttcagtttcatctaacgtcacraagaacgctgctttctccacagcatcaagagactgcttatttttcccacgtccaaaataggcctgacgacacctggcccagggaactctgcagtgaagat

SEQ ID NO: 26504 - DNA, 201 bp, Homo sapiens
caggccatcagcccccaggtgcattccacagatgcccatgtgacccctccacaaggaggtctccgtgcccgtcttatttgaatacacagaactggtgtgaygcccacttccttcttggaagacccaccagctgggcttcctcgagtgctcccgggtccctctcactccagctcctccagggccctctgccactgcccaccc

SEQ ID NO: 26505 - DNA, 201 bp, Homo sapiens
aatacacagaactggtgtgatgcccacttccttcttggaagacccaccagctgggcttcctcgagtgctcccgggtccctctcactccagctcctccaggrccctctgccactgcccacccttccagatcggggccatctggctctctccccaccttcttctctctaggagtgcttggctatggcggcccgcagggcgaat

SEQ ID NO: 26506 - DNA, 201 bp, Homo sapiens
tcttctctctaggagtgcttggctatggcggcccgcagggcgaataagcctagaaacacgctaggcctcagtgcaccccgctcggggaacaaaggtgacgstgacggtggccggcacgtacggagcccttcctgtgaatgactcccatgggtaagatgctgatctggccctatccagagggggcatcgggaccgaggcgcc

SEQ ID NO: 26507 - DNA, 201 bp, Homo sapiens
taagatgctgatctggccctatccagagggggcatcgggaccgaggcgcctacagacccacagggagcccaggccccgcggcgccggctcaggctccccaygtctcctccgctggggattccaggctctgagaggagggcatcggatgagcgcatcttcacccgagatgcatctcctgccgccgctctttccagccttgtc

SEQ ID NO: 26508 - DNA, 201 bp, Homo sapiens
cacccgagatgcatctcctgccgccgctctttccagccttgtcaacaccacagcagataccgaacaacgccggcttgcccgcacacatcctcctccatccygctcctgctcccaggcctggccctctttcaggccctcactacttgggccaccgaaaagcatccctgtgtccagggcccctcctccctgcccaaccagaag

SEQ ID NO: 26509 - DNA, 201 bp, Homo sapiens
gcagccgcccatcatggtagagccagaccttgaagtagcgtcctcgatggtacacgacgatgtgcttgctgtctctcatgtgctggatggtgtctgagccrgccgcaggttggagacacaaaaccaagagtcccaagttcagcacgtgctgagacgaccgtaccctgactctgcaaagggcatgggagtccctgctctgcg

SEQ ID NO: 26510 - DNA, 201 bp, Homo sapiens
acttaagacccttaagataagtctatacctctttccctttttttattttggggaatttgaatggtctaattagtgaggattgtgactgatgggatcctccrgtggggatgtctgagaaagtgggtggggctttgcccgatgatcaccaacgaatggcattgcacgtgctcatatacatttacctttctttatttttttttt

SEQ ID NO: 26511 - DNA, 201 bp, Homo sapiens
aaaaataaacgagggaaaaaaataaaaggaagtgaaggaatggaaggaaaaggaaagagaagagttctatttgccagttattaaagcagtggtcaagaacmcaaactgagaggccttctaaccatccatgctttgaaagacaaagcccaggaaaccagaaactaccgtcgatgcacacccctctggcgtctcagaaaacag

SEQ ID NO: 26512 - DNA, 201 bp, Homo sapiens
gagctcgggaaggatgcccttggaatcaagataaaccaaagaggaggatgggagcaggtctctggggcagcatggcactgctgcaggagaaacagctcacrggaggactctccggggaagagggagagggagaagcctcctgcgtgcaaaacacagcatcgtgctggtgtacctgcactcagggtaaaactgtcactgtag

SEQ ID NO: 26513 - DNA, 201 bp, Homo sapiens
ggagccaggggaagccagggggaaaagccttccaggcagagaggagagtgagtgcgaagactttgcaagaaaaaactggcaccagaatttgtttatctctwggggaaaaaatagacagacacaatattataaaaagaaacgtcaaggccaggcgtggtggctcatgccataatcccagcactttgagaggccaaggcgggt

SEQ ID NO: 26514 - DNA, 201 bp, Homo sapiens
ccatgagtcatatgcgcagacacctcaagaatgggtgtccacagacggagcgggccttcttccttggaggcagcggctgaaacggaacgtgccttggcggscccacgggctaaacggatcccggggcgctgcagtccagacccaagcacagcccctggggagagcatcccctggccggctgcagaaaactgcttccggatc

SEQ ID NO: 26515 - DNA, 201 bp, Homo sapiens
cggtctccgtcctcccctctcggaagagccgggtcatggaggcctcgtatgtgaggcaaaacttgcccatgtcctggggaaagagaagtacttcagtgcayggcagggcatgctgatatgtctaaaacgtaaggaaggattgggtaagattggcaaggagaagtggacttcattgtcaacatttttttgagacggggtctt

SEQ ID NO: 26516 - DNA, 201 bp, Homo sapiens
cagttcaagggtcacagaactctggaatgaacagactccaagtgcaaagaaatgactacatggggaatcagccctttgagcagaaattccatttcagagcsctattggccaggctaagggcactgtcattattgaccaaaccctcgggccctgacaccttccaaggggtgccccagggccactaccactcttctcaccctg

SEQ ID NO: 26517 - DNA, 201 bp, Homo sapiens
caaagaaatgactacatggggaatcagccctttgagcagaaattccatttcagagccctattggccaggctaagggcactgtcattattgaccaaaccctygggccctgacaccttccaaggggtgccccagggccactaccactcttctcaccctggtctacagaggaaaggccgcaggggaccgcaaactcctaggggg

SEQ ID NO: 26518 - DNA, 201 bp, Homo sapiens
caggggaagccagggggaaaagccttccaggcagagaggagagtgagtgcgaagactttgcaagaaaaaactggcaccagaatttgtttatctctaggggraaaaatagacagacacaatattataaaaagaaacgtcaaggccaggcgtggtggctcatgccataatcccagcactttgagaggccaaggcgggtggatc

SEQ ID NO: 26519 - DNA, 201 bp, Homo sapiens
gagcagctgcaatgttatagcaggtagcgggtctgacatgagcaggccaggagagggcttcctccgacacacactgggaatatcacgcgaccatcagtgayggtcaggtggttgtgaactgtctctctaaaataataataggtcacagccggtgccagggaaaggcagtctctcagtagatagaaatggagctggtgacca

SEQ ID NO: 26520 - DNA, 201 bp, Homo sapiens
acaaaagcagcaagcagcaagcaagttaagaccacatggaaatgctgaatgtgttttctgtgcgaattgcttcgtttgacttcctcttttccagtggctcmctggaatgattcgttgggggactcattaaaccatgccagggtgcaacttcctgcacagttaaatcctaaataacacattctaattgattattgataactg

SEQ ID NO: 26521 - DNA, 201 bp, Homo sapiens
tcactatgttggccaggctggtcttgaactgctaacctcagatgatccgcctgctttggcctcccaaagtgccaagattacaggcgtgagaccctgtgccyggccacaaactgtatattttaaacatgtgcaatatgtcaattatacctctgtaaagctgtttgaaaataatttttttaaagcaatttgtttgcctactgg

SEQ ID NO: 26522 - DNA, 201 bp, Homo sapiens
cggagcttgcagtgagccgagatcgctccactgcactccagcctgggtgacgagcgagactttgtctcagaaactaaagaaaataaaagaaaacaaagaaraaaccaatgttatgcaaaattgctccacagactgcttcccaggtctgcctgaagaagccaccgtcccagtccgtggcactaacctggtgttccgcaggtg

SEQ ID NO: 26523 - DNA, 201 bp, Homo sapiens
caagaccgacagcaaaatcttgagcaagtgctgtcatccgtttgaagtcttcttccttcataagaggcctcaccgactgtagatactgggattattggggraaaaaaaaatcacccaagttaaaacatattaatcaaagcctatgtttgcctcacttgtgccttaggaaaagttctaacacattgaaaaggttttaggctg

SEQ ID NO: 26524 - DNA, 201 bp, Homo sapiens
gtgcatgtctgtggtcccagctacctggggggctgaggttgggaggatcgcttgagcccagaaggttgcggctgcagtgagccatgatcatgccactgcamcccagcctgggcaacagagtgagaccctatctcaaaaaaaaaaaagaaaaagtttagactcttcccccaagttggtcttggcagtccttagacaggtaaa

SEQ ID NO: 26525 - DNA, 201 bp, Homo sapiens
aggtcaagagcaggccagcggggtcaagggcagggtgtcgggtcaaaagcaggtgtctggggtcaaaggcagggtagctggggtcaagggtagggtgtctrgggtcaagcgcaggtggctggggtcgacagggtgtctgggttcaaggacagggggcctagtttggagaggaaggcagaggcagccggtgggaggtggcag

SEQ ID NO: 26526 - DNA, 201 bp, Homo sapiens
caggccagcggggtcaagggcagggtgtcgggtcaaaagcaggtgtctggggtcaaaggcagggtagctggggtcaagggtagggtgtctagggtcaagcrcaggtggctggggtcgacagggtgtctgggttcaaggacagggggcctagtttggagaggaaggcagaggcagccggtgggaggtggcagggttttgtgc

SEQ ID NO: 26527 - DNA, 201 bp, Homo sapiens
caagggaggagctgggcaagacgacacacccgggaggtatcagcacagaacctgccagctctgcctcaatgactcggaaagagtaatttggcaaaactacmttccaccagctataacttcagcttagagcaatttgcaaagcaatcgacaatatgtatgggccaggcatgatggctcatacctgtaatcccagcactttgg

SEQ ID NO: 26528 - DNA, 201 bp, Homo sapiens
aataacatcctttctgtaggtaaggtatcaactgcttgcatgccctcatactgcacgtttacgggcaaaatctgctcatcaattctcaaaatccagctcaytgattctgagatgcgatgcctctattccatgtcaccttttaatcacatgatctttagtcaatgatctgtcacagacaggagcttgtcactgtgctcctgg

SEQ ID NO: 26529 - DNA, 201 bp, Homo sapiens
agcagagagcgacagatgaaacgtggaccatgttcacctgacctgtgtgaagtgcagatttaccgagcgccagacgaatacgtaactgactattcccctasctgcccacactatttccactttagcaaatgctaggattcggggcttattatggggcttaactctccctctgtagagtgatgagatctcactttgtcctca

SEQ ID NO: 26530 - DNA, 201 bp, Homo sapiens
ctgaggcaggaggatcccttgagctcaggaggtagaggctacagtgagccatgatcacgccattatactccagccagggcgacagagtgagaccctatctmaacaacaacaacaacaaaacaacagtatttacatattatttagtaggcacgcagccaactcccacggcctggccagttttaaaggaatggatcccatttt

SEQ ID NO: 26531 - DNA, 201 bp, Homo sapiens
attttttgttattatttaggttttttctttttccccaaatgttttcaatccttggttggttaaatccacagaagcagagcctgaggatacaaagctgaccrtataggtttggttctgtccgcaaattcaggcacccaccaggggtcttggaatgtatccccccaaggataaggggggaccactgcaagtgtaagactgcct

SEQ ID NO: 26532 - DNA, 201 bp, Homo sapiens
gaaagaagccatacagaaggtcatatattgctgattctatttattctaaatgtctggaacaagcaaatctacagagacagaaagtacactagtggttgccrggggcttggagcagatgggaagatagggaggtcatgggtaaggagttgggggtatcttcttagggtgatgaaaacattccaaaattgattgtggtgatag

SEQ ID NO: 26533 - DNA, 201 bp, Homo sapiens
ttcatgcaaggctgtagtaatttactaagttttggtctagccaatacaactgacggaagaagtggaagagacttacttccttaaggaaaggggactccacrgcgagatatttagacaccacgtaaaggcagaagaggtgacgatcgatcccagagccggtcatggcgaggcgatacatatgctgatgcttctcagacgcca

SEQ ID NO: 26534 - DNA, 201 bp, Homo sapiens
ccttgtctcaaaaaaataaaaaataagtgcaagactgccaaggacatccatagcaatgatcagcagtaattcctttacggcggtagaaccgcaaggtaacrggggcacccagcacggagatgggcccatcacaccccattacccatcccatcaccacgccccactgcgcctcgcccagccccgccgcactcaccggtccaa

SEQ ID NO: 26535 - DNA, 201 bp, Homo sapiens
aggatggcatggatggcgttgccggctcttgctgcctgaatgtgagttggaaggatatacagcagatcctgaaaagcgacaaaggtggagagaatttgcayagggaaagataagcaaatttaaataatcacagcacatcctgcacactgtcacaatatttctagagatgcatcaatatacatacatattcggttacatctg

SEQ ID NO: 26536 - DNA, 201 bp, Homo sapiens
tttatgagaacataagtcctctaaaacttctgcgctattaaagataactatttgcaccaaataccctcacgtaacacagagaaaggaaagcaaaaattagycggggagcaattagacaatcaggaagttttctggatgagacacaatgaaaggttaaaatagttgtttatatagagctgtgcctgcagctttctaaatttt

SEQ ID NO: 26537 - DNA, 201 bp, Homo sapiens
gtctgatctcgtgaagctaagcagggtcagtcctggttagtacttggatgggagaatgaccatttcaaagacaaggctatgttaaagatccgaagccactyttcccgtgcgcacaatgtgccaaccacttactgattttctgtgtcaatttatttttcatctggtccatcttttacccgccccatacttacaggttctagc

SEQ ID NO: 26538 - DNA, 201 bp, Homo sapiens
catttcaaagacaaggctatgttaaagatccgaagccacttttcccgtgcgcacaatgtgccaaccacttactgattttctgtgtcaatttatttttcatstggtccatcttttacccgccccatacttacaggttctagcaaataagcatataaccctgccctccatgccaataaaagcctgggcaacatggcaaaaccc

SEQ ID NO: 26539 - DNA, 201 bp, Homo sapiens
cacgactcatcttgccgtgctcagtgaacatccacccgtggtaggagagcagcactttcagggagtagcgcatggtgacgatgagggccacccacaggccrgtgccaaacagcacgccgctgaccacgttcttcgtctggctggacatgcagttgctgtggagacagacccagacaagggaggctgtgcgtgaggccacac

SEQ ID NO: 26540 - DNA, 201 bp, Homo sapiens
cccgtggtaggagagcagcactttcagggagtagcgcatggtgacgatgagggccacccacaggccggtgccaaacagcacgccgctgaccacgttcttcrtctggctggacatgcagttgctgtggagacagacccagacaagggaggctgtgcgtgaggccacacggtgccaccaacaccaccggtgacgccacagaca

SEQ ID NO: 26541 - DNA, 201 bp, Homo sapiens
acgttcttcgtctggctggacatgcagttgctgtggagacagacccagacaagggaggctgtgcgtgaggccacacggtgccaccaacaccaccggtgacrccacagacaccacgtgctgcagggtccagcagcctgccccaggtacagccgggaaagtcagagggagagcacttgcaggaactgagctcttaaaacactc

SEQ ID NO: 26542 - DNA, 201 bp, Homo sapiens
cgcaggggaccgcaaactcctagggggaccttaacagcacccaggagacaggaagaaagctgacgtgagaacagcatcaggagcttcatatggaatccagracagtgacaatcatcacatttgaagagacataaaaacagcaataaaatcggtaacttcccagacaattggagatttcacaggattacttacgccgtttcc

SEQ ID NO: 26543 - DNA, 201 bp, Homo sapiens
aaaacagcaataaaatcggtaacttcccagacaattggagatttcacaggattacttacgccgtttccagagtccgattgatttttgcaattattcctaaygaggggtcgatcttggcgtacatcgttgtcatcacgcccaccaccacgataagccaactggaggggcttgccgggtacacgccagtgatgatgccgttct

SEQ ID NO: 26544 - DNA, 201 bp, Homo sapiens
agttccaaagcagccacctgctatgcctttcctcattgtgtgtcctggcctaatttaaagactctcaggaagtagaatatgatttggagaagtatcatttrtaacatgcgtctctgtccttgtccctacctttaccttttaatattttaataccttctgtacccttgaaaggggcagaggaaagaagctgaattgagcacc

SEQ ID NO: 26545 - DNA, 201 bp, Homo sapiens
gggccgggtccaccatggcccgcacgaagtcgcatgactcagtggtgcaggagcgcacggtctccgtcctcccctctcggaagagccgggtcatggaggcytcgtatgtgaggcaaaacttgcccatgtcctggggaaagagaagtacttcagtgcacggcagggcatgctgatatgtctaaaacgtaaggaaggattggg

SEQ ID NO: 26546 - DNA, 201 bp, Homo sapiens
aattggaggctggtttttagtgcagctataaactcggtactgggaagtacacaaacgttttcctgacccagaagccctagtaagttaggggcatggctccytgaccccggaggagcagctgcaatgttatagcaggtagcgggtctgacatgagcaggccaggagagggcttcctccgacacacactgggaatatcacgcg

SEQ ID NO: 26547 - DNA, 201 bp, Homo sapiens
caaatgtgtttcccatcccaggtaagtaacaatggttggataatccggacttacttcccccgggatgtcccactgcagcctggtggggtacggaatgttcrgattgatgtcgcctttgcagtgcccatcctccgcatagcccagctggaggctgtcaatggacatgacgtactgtcaaaaatagaacaaaattattaaaac

SEQ ID NO: 26548 - DNA, 201 bp, Homo sapiens
tagtagagacggggtttcaacatgttgcccagggtggtttcgaactcctgagctcaggcaatccgcccacctcatcctcccaaagtactgggattacaggygtgagtcaccgcgcccggtgtgacagcctttccagaatgaagtttgtctcggaaaaaaagagccctggccagtgtctcctctggggatcagcggaaagca

SEQ ID NO: 26549 - DNA, 201 bp, Homo sapiens
tgcagagggaagcgtctagagaccgtgggagcacgctggacaccagcgctaagcagcacttgcagtgaggacctggctgagcccccaggatccccccaacrtagctggccgccttggggagctctcttccccaacccacagatgccaccaaccctggtggcatgacacgacactcaagattcccttgggagcgggggtcac

SEQ ID NO: 26550 - DNA, 201 bp, Homo sapiens
tactatggggctaatgattcaggttggtagggcttccaaagcaggaggcaaataactgctgcagactagaattaataccactgtctagtgtcagcattcamtccatattcaatattcaatactgatttactgatgctcccggcacaggcaatactgttgtaagacagatcatgcctttgccctcaatgagcaaacattcta

SEQ ID NO: 26551 - DNA, 201 bp, Homo sapiens
aaacaagaacctgaccggtgagttaaggaaacaaaactttcatttaatttctcatgccaaacacggaacaggtcaaacagttcagagtaacgaattattaaaaaaaaaaaaaaaaaaaaaaaaggctgagtgtggtggctcccatctgtaatcccagcactttgggaggcccaggcaggcagatcccctgtgcccaggagt

SEQ ID NO: 26552 - DNA, 201 bp, Homo sapiens
gagttaaggaaacaaaactttcatttaatttctcatgccaaacacggaacaggtcaaacagttcagagtaacgaattattaaaaaaaaaaaaaaaaaaaamaaaggctgagtgtggtggctcccatctgtaatcccagcactttgggaggcccaggcaggcagatcccctgtgcccaggagttcaagaccagcctgggcaa

SEQ ID NO: 26553 - DNA, 201 bp, Homo sapiens
tttgagacagagtctcgctctgtcgcccaggccggagtgcagtggcacgatctcggctcactgcaacctctgtctcccgggttcaatcgatttcttctgcytcagcctcccaagtagctggggctacaggcatgcaccaccatgcccggctaatttttgtatttttagtagagacggggtttcaccatgttggccaggctg

SEQ ID NO: 26554 - DNA, 201 bp, Homo sapiens
aggcccatcttcccgtttttgaagacaacaaacgtgaacgacttgtcaaaccacctacgtgaaacacacatgtgtggaacttaagtgtttaaagaggcaamaatgaggagacattgcacctctctgcttcatcctggatggactaattcactttgcacctgtccctctaacagtgagcagacactcagtctctgtggagtg

SEQ ID NO: 26555 - DNA, 201 bp, Homo sapiens
atctggccctatccagagggggcatcgggaccgaggcgcctacagacccacagggagcccaggccccgcggcgccggctcaggctccccacgtctcctccrctggggattccaggctctgagaggagggcatcggatgagcgcatcttcacccgagatgcatctcctgccgccgctctttccagccttgtcaacaccacag

SEQ ID NO: 26556 - DNA, 201 bp, Homo sapiens
aggtgtggtgacatgcacctctagtcccagctactcgggaggctgaggcaggagaatcgcttgaaaccaggaggtggaggttgcagtgagccgagatcacmccactgcactccagcctgggtaacagagtgatactccatctcaggaaaaaaaaaaaaaaaaagcatgcttagcaaaatggaatattatcattaaaaaaaa

SEQ ID NO: 26557 - DNA, 201 bp, Homo sapiens
agatcacaccactgcactccagcctgggtaacagagtgatactccatctcaggaaaaaaaaaaaaaaaaagcatgcttagcaaaatggaatattatcattaaaaaaaaaaaaaacaaattacccaaccctccctaagcctctcctcagtaaaatggaggtcatatgttccccatatgcactgtgcaagaattaagagacga

SEQ ID NO: 26558 - DNA, 201 bp, Homo sapiens
tgcttagcaaaatggaatattatcattaaaaaaaaaaaaaacaaattacccaaccctccctaagcctctcctcagtaaaatggaggtcatatgttccccayatgcactgtgcaagaattaagagacgatatccgtaaagcccatgtaaataggcattcgatccgtatagtaactttttattaattaatgacaatagggcaa

SEQ ID NO: 26559 - DNA, 201 bp, Homo sapiens
gatcagcctgggcaacatggcaaaaccctatctctacaaaaaatacaaaaattagctgggtgtggtggtgtgcacctgtagtcccagttattctggagctgagatgggaggatcacttgagcctggggagcagaggctgcagtgaactgaaattgcaccactgcactccagcctgggtgacagagcaagatcctatctcaa

SEQ ID NO: 26560 - DNA, 201 bp, Homo sapiens
atcagcctgggcaacatggcaaaaccctatctctacaaaaaatacaaaaattagctgggtgtggtggtgtgcacctgtagtcccagttattctggagctgagatgggaggatcacttgagcctggggagcagaggctgcagtgaactgaaattgcaccactgcactccagcctgggtgacagagcaagatcctatctcaaa

SEQ ID NO: 26561 - DNA, 201 bp, Homo sapiens
tcagcctgggcaacatggcaaaaccctatctctacaaaaaatacaaaaattagctgggtgtggtggtgtgcacctgtagtcccagttattctggagctgagatgggaggatcacttgagcctggggagcagaggctgcagtgaactgaaattgcaccactgcactccagcctgggtgacagagcaagatcctatctcaaac

SEQ ID NO: 26562 - DNA, 201 bp, Homo sapiens
aaatgaagggaaaagggtattttatagattgctggggacgtgaaagttggtaaaatcactttgagggtaatttgtccatgccagtaagactggaaatgtcmaccagggcagccggcaagccaattctaggtgcctgctctacagactgtttgaccaatgcatgcaggggagaaacatacacagaattcactgagcgtcact

SEQ ID NO: 26563 - DNA, 201 bp, Homo sapiens
gtgggacgatcacgaggtcaggagatgagaccatcctggctaacacggtgaaactccgtctctactaaaaatataaaaaattagccgggcgtggtggcagrcacctatagtcccagctactcgggaggctgaggcaggagaatggcgtgaactcgggaggtggaggttgcagtgagccgagatcgcgccactgcactccag

SEQ ID NO: 26564 - DNA, 201 bp, Homo sapiens
gagaatggcgtgaactcgggaggtggaggttgcagtgagccgagatcgcgccactgcactccagcctgggcaacagagcgagactccctctaaaaaaaaawaaataaataaaattgcaggtcagctctggccctttccagccagcttcccaagcagccccgaggcccgcccgtcatacaggcctgccatgatggtcttggg

SEQ ID NO: 26565 - DNA, 201 bp, Homo sapiens
ggtacatcaccttcattttgtagatggttcaaaagggaaataaaaagccgaagtgggaggattgcttgagaccaggagttcgagaccaggctaggcaacayagcaaggctctagccctacattaaaaataaaaataataaataaaataaaaatttaaaaatgtttaagagaccaaatggaaagtaaatcataaatgtctga

SEQ ID NO: 26566 - DNA, 201 bp, Homo sapiens
tacagacagacaggagattagtggttctgaggggctgggagagggaggtagaaggatggggagtgactgcttagtggctatgagcttttgggggatgaaakgtcctggaacgagacagcagtgagggctgcgcaacattataaatgtacttagtgcccctgaactgtacacttgaaaatggttaacagtacaattcatgtt

SEQ ID NO: 26567 - DNA, 201 bp, Homo sapiens
tccttccgcaaggcccttagtttcgggatgggctccaggctctaggaacagtgaggagggtcaacgtgcctggccctgagccaagccgaggggaagcagtktctttccttcagtcattgccaagtctcccagaggacacatctgtggcccttggttttaggctggatgatcaagcctgtataataaccagtcacctcaatg

SEQ ID NO: 26568 - DNA, 201 bp, Homo sapiens
gctccaggctctaggaacagtgaggagggtcaacgtgcctggccctgagccaagccgaggggaagcagtgtctttccttcagtcattgccaagtctcccaraggacacatctgtggcccttggttttaggctggatgatcaagcctgtataataaccagtcacctcaatggcaaccaaaacaaaggcagtccttgggccca

SEQ ID NO: 26569 - DNA, 201 bp, Homo sapiens
tgaggtgagagaatcgcttgagcccgggaggcggaggttgtaatgagccgagattgcaccactgcactccagcctgggtgacagagcaagatgctgtctcaaaaaaaaaaaaaaatttgtttggcaaagagtggagtcccggtgtgtggtgggcactgcagtgactcccatgcttctctcacaagcaggctcccccagagg

SEQ ID NO: 26570 - DNA, 201 bp, Homo sapiens
cgcttgagcccgggaggcggaggttgtaatgagccgagattgcaccactgcactccagcctgggtgacagagcaagatgctgtctcaaaaaaaaaaaaaawtttgtttggcaaagagtggagtcccggtgtgtggtgggcactgcagtgactcccatgcttctctcacaagcaggctcccccagaggttgggacagcagcc

SEQ ID NO: 26571 - DNA, 201 bp, Homo sapiens
gcccgggaggcggaggttgtaatgagccgagattgcaccactgcactccagcctgggtgacagagcaagatgctgtctcaaaaaaaaaaaaaaatttgttkggcaaagagtggagtcccggtgtgtggtgggcactgcagtgactcccatgcttctctcacaagcaggctcccccagaggttgggacagcagcccagtcca

SEQ ID NO: 26572 - DNA, 201 bp, Homo sapiens
accccatcaatacaaaaataaaatttaaaaaagaaaataaaataagaaataaaaaataataaaaataaaaaataataaatatttcttcaaaataagaaataaaaaaagaaaaccactaatttaacactgcataatatttaagtggacaaaaacaaattatcttcaaggttatatactctttgctccaaaatgtatatcttt

SEQ ID NO: 26573 - DNA, 201 bp, Homo sapiens
gctcctcttgccgcccctgtgtcagaagggctgcttaaccctgaagatttcatgggagacctcaccccatgtcgagaatttgctgtaaaatactccagccmaaaaaaaaaaaggattatatcaaacaaaattggcaaaattgttgaaacaaggaagggaatggtggggatctttaatcagtcctcttcactcttgtgtatg

SEQ ID NO: 26574 - DNA, 201 bp, Homo sapiens
aaaaagaacaaagttctacttctttagataaacagaattgagaacatgtggactcaactgtatttgaacttgtggagagtttctttttttttgtttgtttkttttgagacagagtctcgctctctcacccaggctggagtgcagtggcgcgatctcggctcactgcaagctccgcctcccgggttcgtgccattctcctgc

SEQ ID NO: 26575 - DNA, 201 bp, Homo sapiens
acccaggctggagtgcagtggcgcgatctcggctcactgcaagctccgcctcccgggttcgtgccattctcctgcctcagcctcccgagtagctgggactrcaggcgcccgccaccacgcccggctaattttttgtattttttagtagagacgggggtttcaccatgttagccaggatggtctcgatctcctgacctcgtg

SEQ ID NO: 26576 - DNA, 201 bp, Homo sapiens
ataggtgtgagccactgcacctggcctggaaaaatcctatttgaacaaggtgtaaaggattctgactcagagcagaagatgtgaattctagtctttactcygcctcctattaagtaggtcgctggccctttaagcctcgatttcccagcctgctttaacgcatgccaagtccctccacctgcctaatggaactgctccaag

SEQ ID NO: 26577 - DNA, 201 bp, Homo sapiens
caaatctcaatcttgcagccaggcccttggaggctggcattagaagaggcccagagtgtccacgcaggagtccacgaaggagcccacgacagccctagacyctgaacttcgagcgcagatcaatcccaaatgcctctgcctctggtgtctgtgtggctgctctttcgagaaactgttctagggtttcggagagacccacga

SEQ ID NO: 26578 - DNA, 201 bp, Homo sapiens
tccatgagtcatatgcgcagacacctcaagaatgggtgtccacagacggagcgggccttcttccttggaggcagcggctgaaacggaacgtgccttggcgsccccacgggctaaacggatcccggggcgctgcagtccagacccaagcacagcccctggggagagcatcccctggccggctgcagaaaactgcttccggat

SEQ ID NO: 26579 - DNA, 201 bp, Homo sapiens
tactccagccagggcgacagagtgagaccctatctcaacaacaacaacaacaaaacaacagtatttacatattatttagtaggcacgcagccaactcccayggcctggccagttttaaaggaatggatcccatttttgaaagcagcaagatcaccaagcagatgtttgccatgggttgaagagggcatcaaagcaagcagc

SEQ ID NO: 26580 - DNA, 201 bp, Homo sapiens
cgccccgcctcaaggttaactcttagcccccttccccatcaaagccttcgcagtaaccatgaggaaggcatcccagaagaggactctgcaaagcatgcacsgtggcaaataaagtgacgtgactggctacctctgcacgattgataagatctcctgggcttcatacagaacacaaaggcattattcatggcagtggattaa

SEQ ID NO: 26581 - DNA, 201 bp, Homo sapiens
aaatcccaccctgggttctggcctggatcagtggccttatgcttaaaaacactgatatagccgcacctacagcagtcccctctcagctacagtttgcacgtttgtttgtttgtttgtttgtttgtttgtttgagacagggtctcgctgtattgcccaggctggagtgcagtggcacgatcatggctcactgcagcctctac

SEQ ID NO: 26582 - DNA, 201 bp, Homo sapiens
aatcccaccctgggttctggcctggatcagtggccttatgcttaaaaacactgatatagccgcacctacagcagtcccctctcagctacagtttgcacgtttgtttgtttgtttgtttgtttgtttgtttgagacagggtctcgctgtattgcccaggctggagtgcagtggcacgatcatggctcactgcagcctctact

SEQ ID NO: 26583 - DNA, 201 bp, Homo sapiens
atcccaccctgggttctggcctggatcagtggccttatgcttaaaaacactgatatagccgcacctacagcagtcccctctcagctacagtttgcacgtttgtttgtttgtttgtttgtttgtttgtttgagacagggtctcgctgtattgcccaggctggagtgcagtggcacgatcatggctcactgcagcctctactc

SEQ ID NO: 26584 - DNA, 201 bp, Homo sapiens
aggaggctgaagtaggaggatcccctgagcccaggaggctgaagctgcagtgagccgagatcacaccactgcactctagcctgggtggcagagtgagaccctgtctaaaacaaacaaacaaacaaacaacaaaagaaaaccgcagtgaacaaataaaccccaacttcctctgttaacagcgacagtggcatgggttgccag

SEQ ID NO: 26585 - DNA, 201 bp, Homo sapiens
ggaggctgaagtaggaggatcccctgagcccaggaggctgaagctgcagtgagccgagatcacaccactgcactctagcctgggtggcagagtgagaccctgtctaaaacaaacaaacaaacaaacaacaaaagaaaaccgcagtgaacaaataaaccccaacttcctctgttaacagcgacagtggcatgggttgccagg

SEQ ID NO: 26586 - DNA, 201 bp, Homo sapiens
gaggctgaagtaggaggatcccctgagcccaggaggctgaagctgcagtgagccgagatcacaccactgcactctagcctgggtggcagagtgagaccctgtctaaaacaaacaaacaaacaaacaacaaaagaaaaccgcagtgaacaaataaaccccaacttcctctgttaacagcgacagtggcatgggttgccaggc

SEQ ID NO: 26587 - DNA, 201 bp, Homo sapiens
aggctgaagtaggaggatcccctgagcccaggaggctgaagctgcagtgagccgagatcacaccactgcactctagcctgggtggcagagtgagaccctgtctaaaacaaacaaacaaacaaacaacaaaagaaaaccgcagtgaacaaataaaccccaacttcctctgttaacagcgacagtggcatgggttgccaggct

SEQ ID NO: 26588 - DNA, 201 bp, Homo sapiens
ttggtgcggtggctcatgcctgtaatcccagcactttgggaggcccaggtgggtggatcacttgaggtcaggggttcgagaccagcctggccaacatggcraaaccctgtctttactaaaaatacaaaaattagctgggcatgttggtgcatgcctgtaatcccagctacttgggaagctgaggcaggagaattgcctgaa

SEQ ID NO: 26589 - DNA, 201 bp, Homo sapiens
cccaggtgggtggatcacttgaggtcaggggttcgagaccagcctggccaacatggcgaaaccctgtctttactaaaaatacaaaaattagctgggcatgktggtgcatgcctgtaatcccagctacttgggaagctgaggcaggagaattgcctgaactgggaggcagaggtttcagtgagctgagattgcaccactgca

SEQ ID NO: 26590 - DNA, 201 bp, Homo sapiens
tttccccacgttggccaggctggtctcaaactcctgactttaggtgatccacccacctcggcctcccaaagtgctgggattaacaggtgtgagccaccgcrcccaaccctcctgtatactttaagtcatctctagattacttacaataatgaataccttataaatgctatgtaaacagttgttatgctgtatttttatttt

SEQ ID NO: 26591 - DNA, 201 bp, Homo sapiens
ctctgtataataaacaaaaataaaaaaaaaaataaaaattgggccaggtgcagtggctcacccctgtaatcccagcacttcgcaaggccaagacaggaggrttgctttggctcaggagttcgagaccagcctggggaacatggcaagacctcatctctattaaaaatcaaagaaattacccaggcatggtagtgcattgct

SEQ ID NO: 26592 - DNA, 201 bp, Homo sapiens
cagtcaccacctgcttgcccaacccaacaggatttttatgaccctggtgtaaaaaggatgagaaaggaaaagcagggcctccccccagtgcccgcctcccygagtgcccgcctccctccagtgcctgccccccacctcacccagccagcctcttccaggtgcttcctcttcaggcaggaggccacactcctggcccacgca

SEQ ID NO: 26593 - DNA, 201 bp, Homo sapiens
gcttgaacccgggaggcagaggttgcagtgagccgagaccaggccactgcactcctaggtgagagagtgagactccgtctcaaaaaaaaaaaggtcaggcrcggtggctcacgcctgtaatcccagcactttgggaggccgaggggggcagatcatgaggtcaggaggtagagaccatcgtcgctaacacggtgaaacccc

SEQ ID NO: 26594 - DNA, 201 bp, Homo sapiens
tcctgtactgaagtttatcataatggactattcacatttatggggtcaatataatgggtcgtcaggttataaaaggaattctgggctgggcacggtggctyatgcctataatcccagcactttgggaggctgaggcgtgtggatcacctgaggtcaggagttcaagaccagcctggccaacgtggcaaaacctcatctcta

SEQ ID NO: 26595 - DNA, 201 bp, Homo sapiens
gaggctgaggcaggagaatcgcttgaacccgggaggcagaggttgcagtgagccgagatcatgccactgcaccccagcctgggtgacagagggagacttcrtctcaaaaaataaaaataataaaataaaaggaattctggactgggtatggtggctcatgcctgtaatcccaatactttggcaggcgaaggcaggaagttc

SEQ ID NO: 26596 - DNA, 201 bp, Homo sapiens
aaacatatcctgtacatgtcgtcaaagaaactggtaatagtggtggcatctggagaggggaaccaagtgagaaggactctactctgtatctgcaccttttaaaaaaaaaaaaaaaaaaaaaaaaaaaaaaccagagacagggtctggctgtcaccgaggctggagcgcagtggtgcaatcatagctcactgcagtctccac

SEQ ID NO: 26597 - DNA, 201 bp, Homo sapiens
atgcttctcagacgccaacttgaacaacttcagcctctgttccacctgagtgacaaaaggtgggaaggacatatgttgcatgtctcaagttgagcagttayggatctaagttagccaccgcacccggctaatattttttgttatttttagtagagacggggtttcaacatgttgcccagggtggtttcgaactcctgagct

SEQ ID NO: 26598 - DNA, 201 bp, Homo sapiens
tgaacaaatgctcagaggtggaaacacagagagcaattgtttaaaaagacactcaaaagcttctgctacacacctaagcaagctcttacagaaagtaacastggtcaggtgtggtagctcacacctgtaatcccagcactttgagaggctgaggtatgaagagtgcttgagcccaagcaatcttgaccagttcaagaccac

SEQ ID NO: 26599 - DNA, 201 bp, Homo sapiens
ctaaccctgtgcctagccctgtttgccactctcccctgcctgagtccagggacctggcagccctgcatctcatgagcatctccaaacaaaggtggtcatgyacagaggagggaagaatctcagatttgcagctcaggctgtgtatgtgtgatagttttggcagagggaagaaaactgaaggttggccaggcgcagtggctc

SEQ ID NO: 26600 - DNA, 201 bp, Homo sapiens
ttactctgccaaaaggaaaggattaagctgaaagctaagtcatgcaagaagctttttattttgttcccaagcagagagcgacagatgaaacgtggaccatrttcacctgacctgtgtgaagtgcagatttaccgagcgccagacgaatacgtaactgactattcccctacctgcccacactatttccactttagcaaatgc

SEQ ID NO: 26601 - DNA, 201 bp, Homo sapiens
aaggacatatgttgcatgtctcaagttgagcagttacggatctaagttagccaccgcacccggctaatattttttgttatttttagtagagacggggtttyaacatgttgcccagggtggtttcgaactcctgagctcaggcaatccgcccacctcatcctcccaaagtactgggattacaggtgtgagtcaccgcgcccg

SEQ ID NO: 26602 - DNA, 201 bp, Homo sapiens
tagccaccgcacccggctaatattttttgttatttttagtagagacggggtttcaacatgttgcccagggtggtttcgaactcctgagctcaggcaatccrcccacctcatcctcccaaagtactgggattacaggtgtgagtcaccgcgcccggtgtgacagcctttccagaatgaagtttgtctcggaaaaaaagagcc

SEQ ID NO: 26603 - DNA, 201 bp, Homo sapiens
gggggagggggcaggtgtcaagcatcttgaggcttattcaaagtaaaatgcccgtgaatgagacagaaaatcatgccctgaatgagctgaagtggaacccygagctacgcaacacagacagaggtcactgaaggtcaagcatctcttgctcaccccatcctgccagtggaacaggggccgtcatcagccctgatttgcaag

SEQ ID NO: 26604 - DNA, 201 bp, Homo sapiens
gtttttttgagatgaagtttcactcttgttgcccgggctggagtgcagtggcacaatctcagttcactgcaacctccacctcccatgttcaagtgattcgyctgccttagcctcccaagtagctgggattacgggtgcccaccaccatacctggctaattttgtatttttagtagagatggggttttgtagaccagtagta

SEQ ID NO: 26605 - DNA, 201 bp, Homo sapiens
ccaagatgatcatcaggagtcaggcccgtggtaccccaaccctggccctggacattccctggaaccacgcctccaagccagcatccaggcccgtggtaccycaactctggccctggacgtcccccagaaccacgcctccaagccagcatccaggcccgtggtaccccaaccctggccctggacgtcccccggaaccatgcc

SEQ ID NO: 26606 - DNA, 201 bp, Homo sapiens
tttaatacttttcatcaacagaccaattccatcaccacagctggcacccccttgcctgtccaccgctacaaagacagtcgccacctctgcttagagccccragatgatcatcaggagtcaggcccgtggtaccccaaccctggccctggacattccctggaaccacgcctccaagccagcatccaggcccgtggtacctca

SEQ ID NO: 26607 - DNA, 201 bp, Homo sapiens
tggtaggagagcagcactttcagggagtagcgcatggtgacgatgagggccacccacaggccggtgccaaacagcacgccgctgaccacgttcttcgtctrgctggacatgcagttgctgtggagacagacccagacaagggaggctgtgcgtgaggccacacggtgccaccaacaccaccggtgacgccacagacaccac

SEQ ID NO: 26608 - DNA, 201 bp, Homo sapiens
ggacacgcaattaccatccagatcttggtggcacgactcatcttgccgtgctcagtgaacatccacccgtggtaggagagcagcactttcagggagtagcrcatggtgacgatgagggccacccacaggccggtgccaaacagcacgccgctgaccacgttcttcgtctggctggacatgcagttgctgtggagacagacc

SEQ ID NO: 26609 - DNA, 201 bp, Homo sapiens
gcgcacctgtctcctgcggtgagggctgccagcctggcctccccgggctgaggctccgaggtattgtccaggatcctctgcatctgctgctccatctcccrgggcttcagcagccgcccatcatggtagagccagaccttgaagtagcgtcctcgatggtacacgacgatgtgcttgctgtctctcatgtgctggatggtg

SEQ ID NO: 26610 - DNA, 201 bp, Homo sapiens
tcggccgtgtagtagagatttggcgtagctgtccattgacgtatccgggtcttcacttctgtatccttcttcagtttcatctaacgtcacgaagaacgctrctttctccacagcatcaagagactgcttatttttcccacgtccaaaataggcctgacgacacctggcccagggaactctgcagtgaagatgaaatacgat

SEQ ID NO: 26611 - DNA, 201 bp, Homo sapiens
gtgctgggattacaggtgtgcgccactgcgcctggccaggtttggattttcaaaagcaacttccacattcaagtgaaaagtgtgaaaactcacctcccaarggtgggccacgatcggcgcatctgcccaggagtgttcagcgttgaggcccatcttcccgtttttgaagacaacaaacgtgaacgacttgtcaaaccacct

SEQ ID NO: 26612 - DNA, 201 bp, Homo sapiens
acccagcacggagatgggcccatcacaccccattacccatcccatcaccacgccccactgcgcctcgcccagccccgccgcactcaccggtccaaagcccyctccgctggacacgtactctgggttattctccaagtcaaacagctccacttgctgctgaggggtctggcttgttgataatctccaaggctcagataaaac

SEQ ID NO: 26613 - DNA, 201 bp, Homo sapiens
ctgggcctagagaggacagcacggcaggaggggctgatgcccctgaggctgagccttggtggagatgacgggatagtgcagcaagggcccctgctgggaayagcagatggtggataaggacagagactgagtccaaggcagcacgcggctgtgggaggaacagcatctgcgtgctgccccaagaaggggcccggggccacc

SEQ ID NO: 26614 - DNA, 201 bp, Homo sapiens
gcgaatatgcccggccccctgaggctagagagacccctccaggcactgcccatccacccaccatgccacgtctagcgccacctgctggttctgtcagggtygctttggacaccttctcttccgtgttagttgttcctcaaagctagactccctcccttgctttgtctgccggaggcctgctcttgccctcccagtacgtgg

SEQ ID NO: 26615 - DNA, 201 bp, Homo sapiens
acggggtttcaacatgttgcccagggtggtttcgaactcctgagctcaggcaatccgcccacctcatcctcccaaagtactgggattacaggtgtgagtcrccgcgcccggtgtgacagcctttccagaatgaagtttgtctcggaaaaaaagagccctggccagtgtctcctctggggatcagcggaaagcacctgcacg
